United States Patent 7,691,997 (FUNCTIONAL AND HYPERFUNCTIONAL SIRNA) - sequence listing, part 28

SEQ ID NO: 1130783 - RNA, 19 nt, Homo sapiens
ggaaucccagugaggaauu

SEQ ID NO: 1130784 - RNA, 19 nt, Homo sapiens
gucuagcacugcacugaaa

SEQ ID NO: 1130785 - RNA, 19 nt, Homo sapiens
gguacuggaauuacaacua

SEQ ID NO: 1130786 - RNA, 19 nt, Homo sapiens
cagauucuagccaacauaa

SEQ ID NO: 1130787 - RNA, 19 nt, Homo sapiens
caucuagaaggacaaauga

SEQ ID NO: 1130788 - RNA, 19 nt, Homo sapiens
uuuaaaugguggccaggua

SEQ ID NO: 1130789 - RNA, 19 nt, Homo sapiens
agugaggaauucuaaguga

SEQ ID NO: 1130790 - RNA, 19 nt, Homo sapiens
gcaaagaagccuugaaaag

SEQ ID NO: 1130791 - RNA, 19 nt, Homo sapiens
gccaaacacgucaaagcua

SEQ ID NO: 1130792 - RNA, 19 nt, Homo sapiens
acauaaagaugagaacaca

SEQ ID NO: 1130793 - RNA, 19 nt, Homo sapiens
cagaucugccuuaaagaaa

SEQ ID NO: 1130794 - RNA, 19 nt, Homo sapiens
gagauuuuguugccuguuu

SEQ ID NO: 1130795 - RNA, 19 nt, Homo sapiens
gugaacauuccuuauagaa

SEQ ID NO: 1130796 - RNA, 19 nt, Homo sapiens
gggaaauggccucuaaauc

SEQ ID NO: 1130797 - RNA, 19 nt, Homo sapiens
uaacuugccuucuaaauga

SEQ ID NO: 1130798 - RNA, 19 nt, Homo sapiens
gaucauguauguguaguua

SEQ ID NO: 1130799 - RNA, 19 nt, Homo sapiens
gaagguaguuuauggaaau

SEQ ID NO: 1130800 - RNA, 19 nt, Homo sapiens
gaagauggcaagaauauug

SEQ ID NO: 1130801 - RNA, 19 nt, Homo sapiens
gaugaugucucuaauuugu

SEQ ID NO: 1130802 - RNA, 19 nt, Homo sapiens
ugaauaacuugccuucuaa

SEQ ID NO: 1130803 - RNA, 19 nt, Homo sapiens
gcauauaacagaucaugua

SEQ ID NO: 1130804 - RNA, 19 nt, Homo sapiens
gagugugucuauacuauuu

SEQ ID NO: 1130805 - RNA, 19 nt, Homo sapiens
gcaaauuccucuagucaag

SEQ ID NO: 1130806 - RNA, 19 nt, Homo sapiens
ggucguaugucuucccuuu

SEQ ID NO: 1130807 - RNA, 19 nt, Homo sapiens
uggaugaugucucuaauuu

SEQ ID NO: 1130808 - RNA, 19 nt, Homo sapiens
ggaagguaguuuauggaaa

SEQ ID NO: 1130809 - RNA, 19 nt, Homo sapiens
ccaggaagcuaccaaggaa

SEQ ID NO: 1130810 - RNA, 19 nt, Homo sapiens
gagcucaaauggguaaauu

SEQ ID NO: 1130811 - RNA, 19 nt, Homo sapiens
gguuggagguggcagauaa

SEQ ID NO: 1130812 - RNA, 19 nt, Homo sapiens
caagaaaucugaggaggau

SEQ ID NO: 1130813 - RNA, 19 nt, Homo sapiens
aaaggaagauggcaagaau

SEQ ID NO: 1130814 - RNA, 19 nt, Homo sapiens
uaacagaucauguaugugu

SEQ ID NO: 1130815 - RNA, 19 nt, Homo sapiens
gaugaugagugugucuaua

SEQ ID NO: 1130816 - RNA, 19 nt, Homo sapiens
gaaguucccaccacggaua

SEQ ID NO: 1130817 - RNA, 19 nt, Homo sapiens
uugaauaacuugccuucua

SEQ ID NO: 1130818 - RNA, 19 nt, Homo sapiens
ccacggauauugacuucuu

SEQ ID NO: 1130819 - RNA, 19 nt, Homo sapiens
gcagaucuauguguacuca

SEQ ID NO: 1130820 - RNA, 19 nt, Homo sapiens
agucagaguucaaguuaaa

SEQ ID NO: 1130821 - RNA, 19 nt, Homo sapiens
ccagucagaguucaaguua

SEQ ID NO: 1130822 - RNA, 19 nt, Homo sapiens
ggcagcagaucuaugugua

SEQ ID NO: 1130823 - RNA, 19 nt, Homo sapiens
cuucccagcucuuugauuu

SEQ ID NO: 1130824 - RNA, 19 nt, Homo sapiens
ggacugacguuuuaagaau

SEQ ID NO: 1130825 - RNA, 19 nt, Homo sapiens
cuggaaauaugcuuugauu

SEQ ID NO: 1130826 - RNA, 19 nt, Homo sapiens
ggaugcauauaacagauca

SEQ ID NO: 1130827 - RNA, 19 nt, Homo sapiens
gauggcaagaauauuguua

SEQ ID NO: 1130828 - RNA, 19 nt, Homo sapiens
acucaaagcugguaaaaga

SEQ ID NO: 1130829 - RNA, 19 nt, Homo sapiens
gcucuuugauuugccauau

SEQ ID NO: 1130830 - RNA, 19 nt, Homo sapiens
caacucaaaucuuguuucc

SEQ ID NO: 1130831 - RNA, 19 nt, Homo sapiens
uaaaauaggugggucguau

SEQ ID NO: 1130832 - RNA, 19 nt, Homo sapiens
uuuguuaccuuacagaaga

SEQ ID NO: 1130833 - RNA, 19 nt, Homo sapiens
gaauaacuugccuucuaaa

SEQ ID NO: 1130834 - RNA, 19 nt, Homo sapiens
cuagucaagugugauauau

SEQ ID NO: 1130835 - RNA, 19 nt, Homo sapiens
agaucuauguguacucaaa

SEQ ID NO: 1130836 - RNA, 19 nt, Homo sapiens
ugaugucucuaauuuguca

SEQ ID NO: 1130837 - RNA, 19 nt, Homo sapiens
agaugggagucguggguua

SEQ ID NO: 1130838 - RNA, 19 nt, Homo sapiens
cuagugcucaagaagauua

SEQ ID NO: 1130839 - RNA, 19 nt, Homo sapiens
gacuguagauucauuaacg

SEQ ID NO: 1130840 - RNA, 19 nt, Homo sapiens
gcucaagaagauuauaaug

SEQ ID NO: 1130841 - RNA, 19 nt, Homo sapiens
uaacuggaaauaugcuuug

SEQ ID NO: 1130842 - RNA, 19 nt, Homo sapiens
cugaugggcccacaaguuu

SEQ ID NO: 1130843 - RNA, 19 nt, Homo sapiens
gggaagguaguuuauggaa

SEQ ID NO: 1130844 - RNA, 19 nt, Homo sapiens
ugacuucuucugcgaguaa

SEQ ID NO: 1130845 - RNA, 19 nt, Homo sapiens
gcugugcauggaauauuua

SEQ ID NO: 1130846 - RNA, 19 nt, Homo sapiens
gaugagugugucuauacua

SEQ ID NO: 1130847 - RNA, 19 nt, Homo sapiens
ccauagauguuuggaugau

SEQ ID NO: 1130848 - RNA, 19 nt, Homo sapiens
ggcuagugcucaagaagau

SEQ ID NO: 1130849 - RNA, 19 nt, Homo sapiens
aaaugccucuacuuaaugu

SEQ ID NO: 1130850 - RNA, 19 nt, Homo sapiens
ggaagauggcaagaauauu

SEQ ID NO: 1130851 - RNA, 19 nt, Homo sapiens
gugcaaauuccucuaguca

SEQ ID NO: 1130852 - RNA, 19 nt, Homo sapiens
gugcauggaauauuuaugg

SEQ ID NO: 1130853 - RNA, 19 nt, Homo sapiens
ggaugaugucucuaauuug

SEQ ID NO: 1130854 - RNA, 19 nt, Homo sapiens
gguaaauugagaccagaaa

SEQ ID NO: 1130855 - RNA, 19 nt, Homo sapiens
gaauuuguuaccuuacaga

SEQ ID NO: 1130856 - RNA, 19 nt, Homo sapiens
caccacggauauugacuuc

SEQ ID NO: 1130857 - RNA, 19 nt, Homo sapiens
gugcucaagaagauuauaa

SEQ ID NO: 1130858 - RNA, 19 nt, Homo sapiens
ggagguggcagauaaaaga

SEQ ID NO: 1130859 - RNA, 19 nt, Homo sapiens
ucaaggaacagcgugugua

SEQ ID NO: 1130860 - RNA, 19 nt, Homo sapiens
ccucuagucaagugugaua

SEQ ID NO: 1130861 - RNA, 19 nt, Homo sapiens
ucguaugucuucccuuuag

SEQ ID NO: 1130862 - RNA, 19 nt, Homo sapiens
aggaagauggcaagaauau

SEQ ID NO: 1130863 - RNA, 19 nt, Homo sapiens
cagucagaguucaaguuaa

SEQ ID NO: 1130864 - RNA, 19 nt, Homo sapiens
uugauguagucaugaguuu

SEQ ID NO: 1130865 - RNA, 19 nt, Homo sapiens
aaauuccucuagucaagug

SEQ ID NO: 1130866 - RNA, 19 nt, Homo sapiens
cuucugcgaguaauaaauu

SEQ ID NO: 1130867 - RNA, 19 nt, Homo sapiens
gaagcuaccaaggaaguuc

SEQ ID NO: 1130868 - RNA, 19 nt, Homo sapiens
ucuagucaagugugauaua

SEQ ID NO: 1130869 - RNA, 19 nt, Homo sapiens
gugcagaugaugagugugu

SEQ ID NO: 1130870 - RNA, 19 nt, Homo sapiens
auagauguuuggaugaugu

SEQ ID NO: 1130871 - RNA, 19 nt, Homo sapiens
ccugaugggcccacaaguu

SEQ ID NO: 1130872 - RNA, 19 nt, Homo sapiens
caacuuugaauuuccucuu

SEQ ID NO: 1130873 - RNA, 19 nt, Homo sapiens
caagcugcaagucaucaaa

SEQ ID NO: 1130874 - RNA, 19 nt, Homo sapiens
cagcagaucuauguguacu

SEQ ID NO: 1130875 - RNA, 19 nt, Homo sapiens
ugcugugcauggaauauuu

SEQ ID NO: 1130876 - RNA, 19 nt, Homo sapiens
gauguuuucuacucauuug

SEQ ID NO: 1130877 - RNA, 19 nt, Homo sapiens
caaagcugguaaaagaaaa

SEQ ID NO: 1130878 - RNA, 19 nt, Homo sapiens
gggcagcagaucuaugugu

SEQ ID NO: 1130879 - RNA, 19 nt, Homo sapiens
ugaggaggaugcagguuuu

SEQ ID NO: 1130880 - RNA, 19 nt, Homo sapiens
augagugugucuauacuau

SEQ ID NO: 1130881 - RNA, 19 nt, Homo sapiens
auaacuugccuucuaaaug

SEQ ID NO: 1130882 - RNA, 19 nt, Homo sapiens
guuuggaugaugucucuaa

SEQ ID NO: 1130883 - RNA, 19 nt, Homo sapiens
cauagauguuuggaugaug

SEQ ID NO: 1130884 - RNA, 19 nt, Homo sapiens
caaggaacagcguguguac

SEQ ID NO: 1130885 - RNA, 19 nt, Homo sapiens
aacagaucauguaugugua

SEQ ID NO: 1130886 - RNA, 19 nt, Homo sapiens
ugggagucguggguuauuu

SEQ ID NO: 1130887 - RNA, 19 nt, Homo sapiens
gaaaauggagcuggagaau

SEQ ID NO: 1130888 - RNA, 19 nt, Homo sapiens
uaugugcugugcauggaau

SEQ ID NO: 1130889 - RNA, 19 nt, Homo sapiens
uauucaagcugcaagucau

SEQ ID NO: 1130890 - RNA, 19 nt, Homo sapiens
gaguucaaguuaaaacaga

SEQ ID NO: 1130891 - RNA, 19 nt, Homo sapiens
ggaagcuaccaaggaaguu

SEQ ID NO: 1130892 - RNA, 19 nt, Homo sapiens
gaugggagucguggguuau

SEQ ID NO: 1130893 - RNA, 19 nt, Homo sapiens
gaccgucuagcuuccaaga

SEQ ID NO: 1130894 - RNA, 19 nt, Homo sapiens
cugaggaggaugcagguuu

SEQ ID NO: 1130895 - RNA, 19 nt, Homo sapiens
gauauuauucaagcugcaa

SEQ ID NO: 1130896 - RNA, 19 nt, Homo sapiens
gggagucguggguuauuuc

SEQ ID NO: 1130897 - RNA, 19 nt, Homo sapiens
caaaggagcucacauuuau

SEQ ID NO: 1130898 - RNA, 19 nt, Homo sapiens
gcaaagagauuuucaacaa

SEQ ID NO: 1130899 - RNA, 19 nt, Homo sapiens
uggaauggaugaaucaaua

SEQ ID NO: 1130900 - RNA, 19 nt, Homo sapiens
ucaaaggagcucacauuua

SEQ ID NO: 1130901 - RNA, 19 nt, Homo sapiens
gaacggaagcugcugaugu

SEQ ID NO: 1130902 - RNA, 19 nt, Homo sapiens
caacaaggccacacucgaa

SEQ ID NO: 1130903 - RNA, 19 nt, Homo sapiens
caacacgucuuccguuucu

SEQ ID NO: 1130904 - RNA, 19 nt, Homo sapiens
gagcucacauuuauggaau

SEQ ID NO: 1130905 - RNA, 19 nt, Homo sapiens
gggagcggcugaucaggaa

SEQ ID NO: 1130906 - RNA, 19 nt, Homo sapiens
ggaauggaugaaucaauaa

SEQ ID NO: 1130907 - RNA, 19 nt, Homo sapiens
cagcaaggauaacauucaa

SEQ ID NO: 1130908 - RNA, 19 nt, Homo sapiens
gaaggucagcaaagagauu

SEQ ID NO: 1130909 - RNA, 19 nt, Homo sapiens
caaaauccgugcugaaaau

SEQ ID NO: 1130910 - RNA, 19 nt, Homo sapiens
gcaaggauaacauucaaag

SEQ ID NO: 1130911 - RNA, 19 nt, Homo sapiens
ccaaggggcucuacucaga

SEQ ID NO: 1130912 - RNA, 19 nt, Homo sapiens
ggagcucacauuuauggaa

SEQ ID NO: 1130913 - RNA, 19 nt, Homo sapiens
cgcaacacgucuuccguuu

SEQ ID NO: 1130914 - RNA, 19 nt, Homo sapiens
gcucucuccuggccuguug

SEQ ID NO: 1130915 - RNA, 19 nt, Homo sapiens
caugcgggcucucuucugu

SEQ ID NO: 1130916 - RNA, 19 nt, Homo sapiens
gcacuuugccugcgaacag

SEQ ID NO: 1130917 - RNA, 19 nt, Homo sapiens
aaggauaacauucaaagga

SEQ ID NO: 1130918 - RNA, 19 nt, Homo sapiens
cagaggcguuacuccaaga

SEQ ID NO: 1130919 - RNA, 19 nt, Homo sapiens
gggcaguccugaccuuugc

SEQ ID NO: 1130920 - RNA, 19 nt, Homo sapiens
gugaaggucagcaaagaga

SEQ ID NO: 1130921 - RNA, 19 nt, Homo sapiens
gcaacacgucuuccguuuc

SEQ ID NO: 1130922 - RNA, 19 nt, Homo sapiens
ccagcaaggauaacauuca

SEQ ID NO: 1130923 - RNA, 19 nt, Homo sapiens
aggaggagacgcauacuga

SEQ ID NO: 1130924 - RNA, 19 nt, Homo sapiens
cuccuggccuguugucuga

SEQ ID NO: 1130925 - RNA, 19 nt, Homo sapiens
gacgcauacugacgccaaa

SEQ ID NO: 1130926 - RNA, 19 nt, Homo sapiens
aacggaagcugcugauguc

SEQ ID NO: 1130927 - RNA, 19 nt, Homo sapiens
auucaaaggagcucacauu

SEQ ID NO: 1130928 - RNA, 19 nt, Homo sapiens
caaagagauuuucaacaag

SEQ ID NO: 1130929 - RNA, 19 nt, Homo sapiens
gaggugaaggucagcaaag

SEQ ID NO: 1130930 - RNA, 19 nt, Homo sapiens
uuuauggaauggaugaauc

SEQ ID NO: 1130931 - RNA, 19 nt, Homo sapiens
gaggaggagacgcauacug

SEQ ID NO: 1130932 - RNA, 19 nt, Homo sapiens
gaagugaaguugucuauuu

SEQ ID NO: 1130933 - RNA, 19 nt, Homo sapiens
ggaaauaggucauuaacuu

SEQ ID NO: 1130934 - RNA, 19 nt, Homo sapiens
gaacaaccuuccauucuaa

SEQ ID NO: 1130935 - RNA, 19 nt, Homo sapiens
caacaaagauacagugauu

SEQ ID NO: 1130936 - RNA, 19 nt, Homo sapiens
gaacucaaccugaauuuaa

SEQ ID NO: 1130937 - RNA, 19 nt, Homo sapiens
gaaugcagcuguauagauu

SEQ ID NO: 1130938 - RNA, 19 nt, Homo sapiens
gaagauagaugccauagag

SEQ ID NO: 1130939 - RNA, 19 nt, Homo sapiens
caacagaaauugaaacuag

SEQ ID NO: 1130940 - RNA, 19 nt, Homo sapiens
gagcaaagcauauaugaaa

SEQ ID NO: 1130941 - RNA, 19 nt, Homo sapiens
ccacacauguuuaguagua

SEQ ID NO: 1130942 - RNA, 19 nt, Homo sapiens
gaggauggcuauaaaggua

SEQ ID NO: 1130943 - RNA, 19 nt, Homo sapiens
gaaugugacuucaucuaaa

SEQ ID NO: 1130944 - RNA, 19 nt, Homo sapiens
gaacucaugucgcuguuga

SEQ ID NO: 1130945 - RNA, 19 nt, Homo sapiens
ggaaaugucucagcuuaug

SEQ ID NO: 1130946 - RNA, 19 nt, Homo sapiens
guacaucacuauacccaaa

SEQ ID NO: 1130947 - RNA, 19 nt, Homo sapiens
ucaaugggccugugaaaua

SEQ ID NO: 1130948 - RNA, 19 nt, Homo sapiens
ucaugucgcuguugaauuu

SEQ ID NO: 1130949 - RNA, 19 nt, Homo sapiens
ggccaaucauccuuuauua

SEQ ID NO: 1130950 - RNA, 19 nt, Homo sapiens
gauauugacuguaauccuu

SEQ ID NO: 1130951 - RNA, 19 nt, Homo sapiens
gaaaggauucaucuaauug

SEQ ID NO: 1130952 - RNA, 19 nt, Homo sapiens
caucuugucugaauugaaa

SEQ ID NO: 1130953 - RNA, 19 nt, Homo sapiens
uaaaggaaccuacacauug

SEQ ID NO: 1130954 - RNA, 19 nt, Homo sapiens
caagaaagaucgaauugag

SEQ ID NO: 1130955 - RNA, 19 nt, Homo sapiens
caaaauggcuuuaacaaga

SEQ ID NO: 1130956 - RNA, 19 nt, Homo sapiens
gaagagagagccauuguuc

SEQ ID NO: 1130957 - RNA, 19 nt, Homo sapiens
gauggaggauggcuauaaa

SEQ ID NO: 1130958 - RNA, 19 nt, Homo sapiens
caaagagaguuguugaaga

SEQ ID NO: 1130959 - RNA, 19 nt, Homo sapiens
caauacaguucaagagaaa

SEQ ID NO: 1130960 - RNA, 19 nt, Homo sapiens
gcauggaaauaggucauua

SEQ ID NO: 1130961 - RNA, 19 nt, Homo sapiens
gcauagguaccucagauua

SEQ ID NO: 1130962 - RNA, 19 nt, Homo sapiens
aaacaguaccgacacauua

SEQ ID NO: 1130963 - RNA, 19 nt, Homo sapiens
uggaagaccuuucggaauu

SEQ ID NO: 1130964 - RNA, 19 nt, Homo sapiens
cagaacagauuacuuaaag

SEQ ID NO: 1130965 - RNA, 19 nt, Homo sapiens
guacauaaacauggacuua

SEQ ID NO: 1130966 - RNA, 19 nt, Homo sapiens
gggaggcucuguucacaaa

SEQ ID NO: 1130967 - RNA, 19 nt, Homo sapiens
ccaauucucuuccucucua

SEQ ID NO: 1130968 - RNA, 19 nt, Homo sapiens
gaggaaauaucaacuuugg

SEQ ID NO: 1130969 - RNA, 19 nt, Homo sapiens
gauauagccacauuacuaa

SEQ ID NO: 1130970 - RNA, 19 nt, Homo sapiens
aaggaaaugucucagcuua

SEQ ID NO: 1130971 - RNA, 19 nt, Homo sapiens
gaaauaggucauuaacuug

SEQ ID NO: 1130972 - RNA, 19 nt, Homo sapiens
ccacaaauauguaguucug

SEQ ID NO: 1130973 - RNA, 19 nt, Homo sapiens
caaugggccugugaaauaa

SEQ ID NO: 1130974 - RNA, 19 nt, Homo sapiens
ggagguggauggaacauag

SEQ ID NO: 1130975 - RNA, 19 nt, Homo sapiens
cacagaagcuuuagaaucu

SEQ ID NO: 1130976 - RNA, 19 nt, Homo sapiens
caaagcagacugaauguga

SEQ ID NO: 1130977 - RNA, 19 nt, Homo sapiens
caagaaagagauguaguua

SEQ ID NO: 1130978 - RNA, 19 nt, Homo sapiens
ggagaggaaucaaaugagu

SEQ ID NO: 1130979 - RNA, 19 nt, Homo sapiens
ggaauuggaagaccuuaaa

SEQ ID NO: 1130980 - RNA, 19 nt, Homo sapiens
cagcagauauagccacauu

SEQ ID NO: 1130981 - RNA, 19 nt, Homo sapiens
gcugguggauuaggaauaa

SEQ ID NO: 1130982 - RNA, 19 nt, Homo sapiens
ggaugcaucuugucugaau

SEQ ID NO: 1130983 - RNA, 19 nt, Homo sapiens
gauuugauauggcacugua

SEQ ID NO: 1130984 - RNA, 19 nt, Homo sapiens
gagaaguacucaaggaaca

SEQ ID NO: 1130985 - RNA, 19 nt, Homo sapiens
ccaauacaguucaagagaa

SEQ ID NO: 1130986 - RNA, 19 nt, Homo sapiens
uggcagaacagauuacuua

SEQ ID NO: 1130987 - RNA, 19 nt, Homo sapiens
gggauuaguuggugauugu

SEQ ID NO: 1130988 - RNA, 19 nt, Homo sapiens
uaagaacugugaacucuca

SEQ ID NO: 1130989 - RNA, 19 nt, Homo sapiens
caaacaagcagaagauaga

SEQ ID NO: 1130990 - RNA, 19 nt, Homo sapiens
gcaaugucaugaugcaguu

SEQ ID NO: 1130991 - RNA, 19 nt, Homo sapiens
ggccauaugcugaagaaua

SEQ ID NO: 1130992 - RNA, 19 nt, Homo sapiens
aaagugagguuccaaaugg

SEQ ID NO: 1130993 - RNA, 19 nt, Homo sapiens
guacacagaagcuuuagaa

SEQ ID NO: 1130994 - RNA, 19 nt, Homo sapiens
aacaaaagcugguggauua

SEQ ID NO: 1130995 - RNA, 19 nt, Homo sapiens
gaagauauggaaguuauga

SEQ ID NO: 1130996 - RNA, 19 nt, Homo sapiens
caagaagaacguaaacaaa

SEQ ID NO: 1130997 - RNA, 19 nt, Homo sapiens
ggaagaccuuucggaauug

SEQ ID NO: 1130998 - RNA, 19 nt, Homo sapiens
gcacguagaaaugaugaua

SEQ ID NO: 1130999 - RNA, 19 nt, Homo sapiens
guacgacccucuggauuug

SEQ ID NO: 1131000 - RNA, 19 nt, Homo sapiens
guuaaagaaugcagcugua

SEQ ID NO: 1131001 - RNA, 19 nt, Homo sapiens
gaacugugaacucucaauu

SEQ ID NO: 1131002 - RNA, 19 nt, Homo sapiens
gaagaauguuuuccucuaa

SEQ ID NO: 1131003 - RNA, 19 nt, Homo sapiens
gugcuuggauaguucauuu

SEQ ID NO: 1131004 - RNA, 19 nt, Homo sapiens
caauaugcaucacaaagug

SEQ ID NO: 1131005 - RNA, 19 nt, Homo sapiens
ggcaaacacuccugauuca

SEQ ID NO: 1131006 - RNA, 19 nt, Homo sapiens
cauaauggauaucucaugu

SEQ ID NO: 1131007 - RNA, 19 nt, Homo sapiens
cauccuaacuugcuaagau

SEQ ID NO: 1131008 - RNA, 19 nt, Homo sapiens
gcacaccuguacagaacaa

SEQ ID NO: 1131009 - RNA, 19 nt, Homo sapiens
gauguacacagaagcuuua

SEQ ID NO: 1131010 - RNA, 19 nt, Homo sapiens
acaaagaagugacaaugau

SEQ ID NO: 1131011 - RNA, 19 nt, Homo sapiens
gcuaagaugcuagguagua

SEQ ID NO: 1131012 - RNA, 19 nt, Homo sapiens
gcagaacagauuacuuaaa

SEQ ID NO: 1131013 - RNA, 19 nt, Homo sapiens
cgaacuacauguacuuugu

SEQ ID NO: 1131014 - RNA, 19 nt, Homo sapiens
acagaaaugugcaauguca

SEQ ID NO: 1131015 - RNA, 19 nt, Homo sapiens
ugaagacucugaauaugau

SEQ ID NO: 1131016 - RNA, 19 nt, Homo sapiens
aaagguggcauuccauaua

SEQ ID NO: 1131017 - RNA, 19 nt, Homo sapiens
uaaagaaugcagcuguaua

SEQ ID NO: 1131018 - RNA, 19 nt, Homo sapiens
gccacuaacugaauucuuc

SEQ ID NO: 1131019 - RNA, 19 nt, Homo sapiens
ugucucagcuuaugcuaaa

SEQ ID NO: 1131020 - RNA, 19 nt, Homo sapiens
gaaguuagcagggcaaaca

SEQ ID NO: 1131021 - RNA, 19 nt, Homo sapiens
augcuaaacuucagacuuu

SEQ ID NO: 1131022 - RNA, 19 nt, Homo sapiens
gcuaggcacuaaguuguuu

SEQ ID NO: 1131023 - RNA, 19 nt, Homo sapiens
cagaaacuccagauaauga

SEQ ID NO: 1131024 - RNA, 19 nt, Homo sapiens
gugauagaguuguguuauu

SEQ ID NO: 1131025 - RNA, 19 nt, Homo sapiens
aaaggaaccuacacauugu

SEQ ID NO: 1131026 - RNA, 19 nt, Homo sapiens
guaaaacacugauccaaga

SEQ ID NO: 1131027 - RNA, 19 nt, Homo sapiens
aaugauaggcuguuucuuu

SEQ ID NO: 1131028 - RNA, 19 nt, Homo sapiens
gcaagguggugcuuucuac

SEQ ID NO: 1131029 - RNA, 19 nt, Homo sapiens
acagaagggugauagaguu

SEQ ID NO: 1131030 - RNA, 19 nt, Homo sapiens
cuuugaagguccucuguua

SEQ ID NO: 1131031 - RNA, 19 nt, Homo sapiens
ccuuaaagaugcuaaacuu

SEQ ID NO: 1131032 - RNA, 19 nt, Homo sapiens
ggacacagauuagauuauu

SEQ ID NO: 1131033 - RNA, 19 nt, Homo sapiens
gcaaauagcaauugacuug

SEQ ID NO: 1131034 - RNA, 19 nt, Homo sapiens
ccaaguagcugggauuaaa

SEQ ID NO: 1131035 - RNA, 19 nt, Homo sapiens
caccaugacuggccaauuu

SEQ ID NO: 1131036 - RNA, 19 nt, Homo sapiens
gagcauuggucgacagaaa

SEQ ID NO: 1131037 - RNA, 19 nt, Homo sapiens
gaagguggauacaagaaau

SEQ ID NO: 1131038 - RNA, 19 nt, Homo sapiens
gauaauaccacaguucuaa

SEQ ID NO: 1131039 - RNA, 19 nt, Homo sapiens
gcccugacguuuggaauua

SEQ ID NO: 1131040 - RNA, 19 nt, Homo sapiens
ggaauuaaucccuucauug

SEQ ID NO: 1131041 - RNA, 19 nt, Homo sapiens
uaacaauacuccaaucaca

SEQ ID NO: 1131042 - RNA, 19 nt, Homo sapiens
ggagggagcauguaaugaa

SEQ ID NO: 1131043 - RNA, 19 nt, Homo sapiens
aaaccugccuuuauaucua

SEQ ID NO: 1131044 - RNA, 19 nt, Homo sapiens
gagggagcauguaaugaaa

SEQ ID NO: 1131045 - RNA, 19 nt, Homo sapiens
gacagagucucgcuccauu

SEQ ID NO: 1131046 - RNA, 19 nt, Homo sapiens
gaacaagaagccacaagau

SEQ ID NO: 1131047 - RNA, 19 nt, Homo sapiens
aaugacagauuucagauug

SEQ ID NO: 1131048 - RNA, 19 nt, Homo sapiens
aaacaucauuugccuuuca

SEQ ID NO: 1131049 - RNA, 19 nt, Homo sapiens
caaauccaauguucaucaa

SEQ ID NO: 1131050 - RNA, 19 nt, Homo sapiens
gaugagguuucaccauguu

SEQ ID NO: 1131051 - RNA, 19 nt, Homo sapiens
cuaaacagaccaaguguga

SEQ ID NO: 1131052 - RNA, 19 nt, Homo sapiens
ccagggaugaggaaacuua

SEQ ID NO: 1131053 - RNA, 19 nt, Homo sapiens
gauuucagauuggaguuaa

SEQ ID NO: 1131054 - RNA, 19 nt, Homo sapiens
gaauuaaucccuucauugc

SEQ ID NO: 1131055 - RNA, 19 nt, Homo sapiens
gcgcauguguguguccuuu

SEQ ID NO: 1131056 - RNA, 19 nt, Homo sapiens
ugaggaaacuuaccguaca

SEQ ID NO: 1131057 - RNA, 19 nt, Homo sapiens
gcaaagcccucgccaaaag

SEQ ID NO: 1131058 - RNA, 19 nt, Homo sapiens
aagcaaagcccucgccaaa

SEQ ID NO: 1131059 - RNA, 19 nt, Homo sapiens
ccaaagugcugggauuaca

SEQ ID NO: 1131060 - RNA, 19 nt, Homo sapiens
gggauaccauggcaaauac

SEQ ID NO: 1131061 - RNA, 19 nt, Homo sapiens
gcauguguguguccuuuua

SEQ ID NO: 1131062 - RNA, 19 nt, Homo sapiens
ggacuugcuccaucucuga

SEQ ID NO: 1131063 - RNA, 19 nt, Homo sapiens
acaagaagccacaagauuc

SEQ ID NO: 1131064 - RNA, 19 nt, Homo sapiens
gaguuaaucugagcaugga

SEQ ID NO: 1131065 - RNA, 19 nt, Homo sapiens
gaaaugugaaagugaaauc

SEQ ID NO: 1131066 - RNA, 19 nt, Homo sapiens
guucaucaaugccuacaca

SEQ ID NO: 1131067 - RNA, 19 nt, Homo sapiens
cagcuuccagaacuuauua

SEQ ID NO: 1131068 - RNA, 19 nt, Homo sapiens
uaucagaaauggacucacu

SEQ ID NO: 1131069 - RNA, 19 nt, Homo sapiens
gaaacuuaccguacagaca

SEQ ID NO: 1131070 - RNA, 19 nt, Homo sapiens
ugacagauuucagauugga

SEQ ID NO: 1131071 - RNA, 19 nt, Homo sapiens
aauccaauguucaucaaug

SEQ ID NO: 1131072 - RNA, 19 nt, Homo sapiens
auuuauaccuuccaaguga

SEQ ID NO: 1131073 - RNA, 19 nt, Homo sapiens
uggaauuaaucccuucauu

SEQ ID NO: 1131074 - RNA, 19 nt, Homo sapiens
caaauguaaucaccugcau

SEQ ID NO: 1131075 - RNA, 19 nt, Homo sapiens
ccaaauccaauguucauca

SEQ ID NO: 1131076 - RNA, 19 nt, Homo sapiens
aaaggacacagauuagauu

SEQ ID NO: 1131077 - RNA, 19 nt, Homo sapiens
gccuuuauaucuaggaguu

SEQ ID NO: 1131078 - RNA, 19 nt, Homo sapiens
acuguuggcugaacuuaug

SEQ ID NO: 1131079 - RNA, 19 nt, Homo sapiens
aguacaaccugauggcauu

SEQ ID NO: 1131080 - RNA, 19 nt, Homo sapiens
cccuuaggcuuaugaauuc

SEQ ID NO: 1131081 - RNA, 19 nt, Homo sapiens
ggcaaaaggacacagauua

SEQ ID NO: 1131082 - RNA, 19 nt, Homo sapiens
caaugcaucccaucccaaa

SEQ ID NO: 1131083 - RNA, 19 nt, Homo sapiens
auacuccaaucacaguuaa

SEQ ID NO: 1131084 - RNA, 19 nt, Homo sapiens
caucauuugccuuucaauu

SEQ ID NO: 1131085 - RNA, 19 nt, Homo sapiens
ugaaugcgcaugugugugu

SEQ ID NO: 1131086 - RNA, 19 nt, Homo sapiens
uaguagagaugagguuuca

SEQ ID NO: 1131087 - RNA, 19 nt, Homo sapiens
gcucugaagccauucuaga

SEQ ID NO: 1131088 - RNA, 19 nt, Homo sapiens
gaaaagcaaauagcaauug

SEQ ID NO: 1131089 - RNA, 19 nt, Homo sapiens
gacacagauuagauuauuc

SEQ ID NO: 1131090 - RNA, 19 nt, Homo sapiens
caaccugauggcauuaauu

SEQ ID NO: 1131091 - RNA, 19 nt, Homo sapiens
gccuacacauucaguacaa

SEQ ID NO: 1131092 - RNA, 19 nt, Homo sapiens
caauuuauaccuuccaagu

SEQ ID NO: 1131093 - RNA, 19 nt, Homo sapiens
gugaaagugaaaucgauaa

SEQ ID NO: 1131094 - RNA, 19 nt, Homo sapiens
guacaaccugauggcauua

SEQ ID NO: 1131095 - RNA, 19 nt, Homo sapiens
cgaagguggauacaagaaa

SEQ ID NO: 1131096 - RNA, 19 nt, Homo sapiens
uagauccuauacacacaaa

SEQ ID NO: 1131097 - RNA, 19 nt, Homo sapiens
gaggaaacuuaccguacag

SEQ ID NO: 1131098 - RNA, 19 nt, Homo sapiens
auaccacaguucuaaaugu

SEQ ID NO: 1131099 - RNA, 19 nt, Homo sapiens
gcauuggucgacagaaaga

SEQ ID NO: 1131100 - RNA, 19 nt, Homo sapiens
aacaagaagccacaagauu

SEQ ID NO: 1131101 - RNA, 19 nt, Homo sapiens
ugagggagggagcauguaa

SEQ ID NO: 1131102 - RNA, 19 nt, Homo sapiens
aaacuuaccguacagacau

SEQ ID NO: 1131103 - RNA, 19 nt, Homo sapiens
gcugccaccugaucuugga

SEQ ID NO: 1131104 - RNA, 19 nt, Homo sapiens
caaugacagauuucagauu

SEQ ID NO: 1131105 - RNA, 19 nt, Homo sapiens
uggcauuaauucugugguu

SEQ ID NO: 1131106 - RNA, 19 nt, Homo sapiens
ucuaggagucucuugauga

SEQ ID NO: 1131107 - RNA, 19 nt, Homo sapiens
ugccucagccucccaagua

SEQ ID NO: 1131108 - RNA, 19 nt, Homo sapiens
gcccuaaacagaccaagug

SEQ ID NO: 1131109 - RNA, 19 nt, Homo sapiens
ggaaaugugaaagugaaau

SEQ ID NO: 1131110 - RNA, 19 nt, Homo sapiens
caaauagcaauugacuuga

SEQ ID NO: 1131111 - RNA, 19 nt, Homo sapiens
aagauucggugcucugaag

SEQ ID NO: 1131112 - RNA, 19 nt, Homo sapiens
cgaugacugugguugacaa

SEQ ID NO: 1131113 - RNA, 19 nt, Homo sapiens
cuaggagucucuugaugag

SEQ ID NO: 1131114 - RNA, 19 nt, Homo sapiens
ucggugcucugaagccauu

SEQ ID NO: 1131115 - RNA, 19 nt, Homo sapiens
cagcacugcccuaaacaga

SEQ ID NO: 1131116 - RNA, 19 nt, Homo sapiens
ggggaaaugugaaagugaa

SEQ ID NO: 1131117 - RNA, 19 nt, Homo sapiens
cugauggcauuaauucugu

SEQ ID NO: 1131118 - RNA, 19 nt, Homo sapiens
gacuaugcccugacguuug

SEQ ID NO: 1131119 - RNA, 19 nt, Homo sapiens
uacaaugacagauuucaga

SEQ ID NO: 1131120 - RNA, 19 nt, Homo sapiens
agggauaccauggcaaaua

SEQ ID NO: 1131121 - RNA, 19 nt, Homo sapiens
aaggacacagauuagauua

SEQ ID NO: 1131122 - RNA, 19 nt, Homo sapiens
ggacuggggcuuccuguug

SEQ ID NO: 1131123 - RNA, 19 nt, Homo sapiens
aauacuccaaucacaguua

SEQ ID NO: 1131124 - RNA, 19 nt, Homo sapiens
gcaaaaggacacagauuag

SEQ ID NO: 1131125 - RNA, 19 nt, Homo sapiens
ugacgaugacugugguuga

SEQ ID NO: 1131126 - RNA, 19 nt, Homo sapiens
caagaagccacaagauucg

SEQ ID NO: 1131127 - RNA, 19 nt, Homo sapiens
agaacaagaagccacaaga

SEQ ID NO: 1131128 - RNA, 19 nt, Homo sapiens
gccuuucaauuuauaccuu

SEQ ID NO: 1131129 - RNA, 19 nt, Homo sapiens
acagggauaccauggcaaa

SEQ ID NO: 1131130 - RNA, 19 nt, Homo sapiens
guaaauggccccagcagau

SEQ ID NO: 1131131 - RNA, 19 nt, Homo sapiens
ugccuaggauuauaauucu

SEQ ID NO: 1131132 - RNA, 19 nt, Homo sapiens
gaagaaagauggcagcauu

SEQ ID NO: 1131133 - RNA, 19 nt, Homo sapiens
gaucauggaugcucucuuu

SEQ ID NO: 1131134 - RNA, 19 nt, Homo sapiens
caacucagaucccucagua

SEQ ID NO: 1131135 - RNA, 19 nt, Homo sapiens
ccaaacagccucagaauga

SEQ ID NO: 1131136 - RNA, 19 nt, Homo sapiens
gcacuaacgguuccucuua

SEQ ID NO: 1131137 - RNA, 19 nt, Homo sapiens
ccaaaugggaguaauaaua

SEQ ID NO: 1131138 - RNA, 19 nt, Homo sapiens
gaugugaaguacagcaaua

SEQ ID NO: 1131139 - RNA, 19 nt, Homo sapiens
gaaaggaacucgggaaacu

SEQ ID NO: 1131140 - RNA, 19 nt, Homo sapiens
gaaacuggcucugggaaga

SEQ ID NO: 1131141 - RNA, 19 nt, Homo sapiens
gcccuuaguucuuguuuaa

SEQ ID NO: 1131142 - RNA, 19 nt, Homo sapiens
gaaauacagcugugucauu

SEQ ID NO: 1131143 - RNA, 19 nt, Homo sapiens
ggugaaagcugcacagaag

SEQ ID NO: 1131144 - RNA, 19 nt, Homo sapiens
uagaagaagccgugauuua

SEQ ID NO: 1131145 - RNA, 19 nt, Homo sapiens
gggugaagguugauuugua

SEQ ID NO: 1131146 - RNA, 19 nt, Homo sapiens
gaaaguacccagaacuaug

SEQ ID NO: 1131147 - RNA, 19 nt, Homo sapiens
gcucacagccucuucauga

SEQ ID NO: 1131148 - RNA, 19 nt, Homo sapiens
gaacugaacuugggaagcu

SEQ ID NO: 1131149 - RNA, 19 nt, Homo sapiens
gauggcagcauuuccuuua

SEQ ID NO: 1131150 - RNA, 19 nt, Homo sapiens
caaugaaagucccaaaugu

SEQ ID NO: 1131151 - RNA, 19 nt, Homo sapiens
gcaaagugaucauuucaac

SEQ ID NO: 1131152 - RNA, 19 nt, Homo sapiens
gaggugcuguuaucucgua

SEQ ID NO: 1131153 - RNA, 19 nt, Homo sapiens
ggacgaguuugagaaguuu

SEQ ID NO: 1131154 - RNA, 19 nt, Homo sapiens
gcaaugaaagucccaaaug

SEQ ID NO: 1131155 - RNA, 19 nt, Homo sapiens
uagaagaccugcuggacaa

SEQ ID NO: 1131156 - RNA, 19 nt, Homo sapiens
gaggagacguggagagugu

SEQ ID NO: 1131157 - RNA, 19 nt, Homo sapiens
uaggugcucuugaacauaa

SEQ ID NO: 1131158 - RNA, 19 nt, Homo sapiens
caucugggcuuacauucuu

SEQ ID NO: 1131159 - RNA, 19 nt, Homo sapiens
ccaaagggcuaucgcaaag

SEQ ID NO: 1131160 - RNA, 19 nt, Homo sapiens
gaaagugauugugauguca

SEQ ID NO: 1131161 - RNA, 19 nt, Homo sapiens
gaaaccuccauaaccauua

SEQ ID NO: 1131162 - RNA, 19 nt, Homo sapiens
gcucucagcuaguguuuag

SEQ ID NO: 1131163 - RNA, 19 nt, Homo sapiens
gagugacuguguaccauuu

SEQ ID NO: 1131164 - RNA, 19 nt, Homo sapiens
gccguuaggcugaauguua

SEQ ID NO: 1131165 - RNA, 19 nt, Homo sapiens
gcugaaaccuccauaacca

SEQ ID NO: 1131166 - RNA, 19 nt, Homo sapiens
ggacugaaccauauagaca

SEQ ID NO: 1131167 - RNA, 19 nt, Homo sapiens
gguguaaccuggccagugu

SEQ ID NO: 1131168 - RNA, 19 nt, Homo sapiens
gaucugacagcuccuauau

SEQ ID NO: 1131169 - RNA, 19 nt, Homo sapiens
gcuaggcaccucucucuaa

SEQ ID NO: 1131170 - RNA, 19 nt, Homo sapiens
aaacaaaacugacuucugu

SEQ ID NO: 1131171 - RNA, 19 nt, Homo sapiens
gaaauaaggauuggugcaa

SEQ ID NO: 1131172 - RNA, 19 nt, Homo sapiens
gagaagagaacugaacuug

SEQ ID NO: 1131173 - RNA, 19 nt, Homo sapiens
cuacuagagucucagauga

SEQ ID NO: 1131174 - RNA, 19 nt, Homo sapiens
gaauguuuaguccuacuua

SEQ ID NO: 1131175 - RNA, 19 nt, Homo sapiens
gagaaccgccagaaacuga

SEQ ID NO: 1131176 - RNA, 19 nt, Homo sapiens
cacaugacccugcucaaua

SEQ ID NO: 1131177 - RNA, 19 nt, Homo sapiens
gaaaaggaauggaaaguac

SEQ ID NO: 1131178 - RNA, 19 nt, Homo sapiens
agacauggacauaucauuu

SEQ ID NO: 1131179 - RNA, 19 nt, Homo sapiens
ggacauaucauuuguaccu

SEQ ID NO: 1131180 - RNA, 19 nt, Homo sapiens
gagcacagcugagggacau

SEQ ID NO: 1131181 - RNA, 19 nt, Homo sapiens
gaccuguucucucaguauu

SEQ ID NO: 1131182 - RNA, 19 nt, Homo sapiens
gaagacaccaggaucaagu

SEQ ID NO: 1131183 - RNA, 19 nt, Homo sapiens
gaagcugguuggcuauaca

SEQ ID NO: 1131184 - RNA, 19 nt, Homo sapiens
guacagcaauaucccaagu

SEQ ID NO: 1131185 - RNA, 19 nt, Homo sapiens
ggaaaguacccagaacuau

SEQ ID NO: 1131186 - RNA, 19 nt, Homo sapiens
cauaaccauuacaggaaua

SEQ ID NO: 1131187 - RNA, 19 nt, Homo sapiens
gagaaaggaacucgggaaa

SEQ ID NO: 1131188 - RNA, 19 nt, Homo sapiens
ucugacagcuccuauauac

SEQ ID NO: 1131189 - RNA, 19 nt, Homo sapiens
cacuuauucuugcaucuua

SEQ ID NO: 1131190 - RNA, 19 nt, Homo sapiens
caugaggagugacugugua

SEQ ID NO: 1131191 - RNA, 19 nt, Homo sapiens
guaggugacucccacauac

SEQ ID NO: 1131192 - RNA, 19 nt, Homo sapiens
gcuguaacacuuauucuug

SEQ ID NO: 1131193 - RNA, 19 nt, Homo sapiens
ccuguuaggugcucuugaa

SEQ ID NO: 1131194 - RNA, 19 nt, Homo sapiens
ccagagauccagaggugua

SEQ ID NO: 1131195 - RNA, 19 nt, Homo sapiens
ugagaaguuugauaagaug

SEQ ID NO: 1131196 - RNA, 19 nt, Homo sapiens
uuuaaugucucucugaaug

SEQ ID NO: 1131197 - RNA, 19 nt, Homo sapiens
gaauggaaaguacccagaa

SEQ ID NO: 1131198 - RNA, 19 nt, Homo sapiens
gcugagggacaucugcuua

SEQ ID NO: 1131199 - RNA, 19 nt, Homo sapiens
acaugacccugcucaauau

SEQ ID NO: 1131200 - RNA, 19 nt, Homo sapiens
gcacagaagaggagaaagg

SEQ ID NO: 1131201 - RNA, 19 nt, Homo sapiens
acucuuugcuucggaaaua

SEQ ID NO: 1131202 - RNA, 19 nt, Homo sapiens
gcugccaucucucuugcua

SEQ ID NO: 1131203 - RNA, 19 nt, Homo sapiens
caaccaacaucgcugaaac

SEQ ID NO: 1131204 - RNA, 19 nt, Homo sapiens
caaguccggcucagucuuu

SEQ ID NO: 1131205 - RNA, 19 nt, Homo sapiens
ggugaagguugauuuguac

SEQ ID NO: 1131206 - RNA, 19 nt, Homo sapiens
ucgaguagcugccaucucu

SEQ ID NO: 1131207 - RNA, 19 nt, Homo sapiens
gacauggacauaucauuug

SEQ ID NO: 1131208 - RNA, 19 nt, Homo sapiens
agggacaucugcuuaaaga

SEQ ID NO: 1131209 - RNA, 19 nt, Homo sapiens
ugagggacaucugcuuaaa

SEQ ID NO: 1131210 - RNA, 19 nt, Homo sapiens
aaauaaggauuggugcaaa

SEQ ID NO: 1131211 - RNA, 19 nt, Homo sapiens
ugaaagugauugugauguc

SEQ ID NO: 1131212 - RNA, 19 nt, Homo sapiens
gcuauacagugcgcuuuga

SEQ ID NO: 1131213 - RNA, 19 nt, Homo sapiens
cauaugaugugaaguacag

SEQ ID NO: 1131214 - RNA, 19 nt, Homo sapiens
gcugguagcagaagucaga

SEQ ID NO: 1131215 - RNA, 19 nt, Homo sapiens
uaacgguuccucuuagcua

SEQ ID NO: 1131216 - RNA, 19 nt, Homo sapiens
gcuagagcuguaacacuua

SEQ ID NO: 1131217 - RNA, 19 nt, Homo sapiens
cagagaacauuggcuuaug

SEQ ID NO: 1131218 - RNA, 19 nt, Homo sapiens
acugaacgcuugugucuca

SEQ ID NO: 1131219 - RNA, 19 nt, Homo sapiens
gggugacuuugacuuaauu

SEQ ID NO: 1131220 - RNA, 19 nt, Homo sapiens
uagagaagccuuggaauca

SEQ ID NO: 1131221 - RNA, 19 nt, Homo sapiens
ggcagcauuuccuuuagaa

SEQ ID NO: 1131222 - RNA, 19 nt, Homo sapiens
gggauuagaauguuuaguc

SEQ ID NO: 1131223 - RNA, 19 nt, Homo sapiens
gcuccuauauaccuuaucu

SEQ ID NO: 1131224 - RNA, 19 nt, Homo sapiens
gauaauauuuugcccuaga

SEQ ID NO: 1131225 - RNA, 19 nt, Homo sapiens
ucagaagcaaguaaucuuu

SEQ ID NO: 1131226 - RNA, 19 nt, Homo sapiens
cagagggaauuggaggaua

SEQ ID NO: 1131227 - RNA, 19 nt, Homo sapiens
ccacaucugggcuuacauu

SEQ ID NO: 1131228 - RNA, 19 nt, Homo sapiens
agagggaggugcuguuauc

SEQ ID NO: 1131229 - RNA, 19 nt, Homo sapiens
ugacccugcucaauaucua

SEQ ID NO: 1131230 - RNA, 19 nt, Homo sapiens
aaagggcuaucgcaaagug

SEQ ID NO: 1131231 - RNA, 19 nt, Homo sapiens
caaacagccucagaaugau

SEQ ID NO: 1131232 - RNA, 19 nt, Homo sapiens
gaacagguguccacaagaa

SEQ ID NO: 1131233 - RNA, 19 nt, Homo sapiens
ggaaagggaugaaguuaau

SEQ ID NO: 1131234 - RNA, 19 nt, Homo sapiens
gaagagauccuuugacaga

SEQ ID NO: 1131235 - RNA, 19 nt, Homo sapiens
ggaaauggccucuaagcua

SEQ ID NO: 1131236 - RNA, 19 nt, Homo sapiens
gagcacauuucuuguaauu

SEQ ID NO: 1131237 - RNA, 19 nt, Homo sapiens
ggaagagccucgaggugua

SEQ ID NO: 1131238 - RNA, 19 nt, Homo sapiens
gcacugagauuaaccuauc

SEQ ID NO: 1131239 - RNA, 19 nt, Homo sapiens
gggaugaaguuaauauuug

SEQ ID NO: 1131240 - RNA, 19 nt, Homo sapiens
gcacauuucuuguaauuac

SEQ ID NO: 1131241 - RNA, 19 nt, Homo sapiens
caaccgcucugccaucuuu

SEQ ID NO: 1131242 - RNA, 19 nt, Homo sapiens
caagggaucugccauuugu

SEQ ID NO: 1131243 - RNA, 19 nt, Homo sapiens
gggaagagauccuuugaca

SEQ ID NO: 1131244 - RNA, 19 nt, Homo sapiens
gagaaaagcugaauuuaca

SEQ ID NO: 1131245 - RNA, 19 nt, Homo sapiens
cagagcacauuucuuguaa

SEQ ID NO: 1131246 - RNA, 19 nt, Homo sapiens
caacgaacaccugcacuua

SEQ ID NO: 1131247 - RNA, 19 nt, Homo sapiens
gagaggauauggagaugga

SEQ ID NO: 1131248 - RNA, 19 nt, Homo sapiens
gugcagagcuccaggaaag

SEQ ID NO: 1131249 - RNA, 19 nt, Homo sapiens
ggaggaggacuaaaugaaa

SEQ ID NO: 1131250 - RNA, 19 nt, Homo sapiens
ccauguaccuagaugagua

SEQ ID NO: 1131251 - RNA, 19 nt, Homo sapiens
gcaggagacccuuaggaua

SEQ ID NO: 1131252 - RNA, 19 nt, Homo sapiens
gcagaagauugagaggaua

SEQ ID NO: 1131253 - RNA, 19 nt, Homo sapiens
gcucaggcuucacuuugua

SEQ ID NO: 1131254 - RNA, 19 nt, Homo sapiens
cagaugaggugcugcaguu

SEQ ID NO: 1131255 - RNA, 19 nt, Homo sapiens
gagauucccuccauuaaaa

SEQ ID NO: 1131256 - RNA, 19 nt, Homo sapiens
gcccuucucugugcucuua

SEQ ID NO: 1131257 - RNA, 19 nt, Homo sapiens
caacaccuaucaccgaaau

SEQ ID NO: 1131258 - RNA, 19 nt, Homo sapiens
gcuauuaacuccuggaaac

SEQ ID NO: 1131259 - RNA, 19 nt, Homo sapiens
gcaagaggguugggugguu

SEQ ID NO: 1131260 - RNA, 19 nt, Homo sapiens
gagccuaccugaccgacuu

SEQ ID NO: 1131261 - RNA, 19 nt, Homo sapiens
gaacaccugcacuuagaaa

SEQ ID NO: 1131262 - RNA, 19 nt, Homo sapiens
gaacugggaccugaaauag

SEQ ID NO: 1131263 - RNA, 19 nt, Homo sapiens
gaugucuguuugccucuua

SEQ ID NO: 1131264 - RNA, 19 nt, Homo sapiens
gauaagagcacuggguuug

SEQ ID NO: 1131265 - RNA, 19 nt, Homo sapiens
guaccgagaccgccucuuu

SEQ ID NO: 1131266 - RNA, 19 nt, Homo sapiens
ggguggaaauggccucuaa

SEQ ID NO: 1131267 - RNA, 19 nt, Homo sapiens
gaacaaauggagcacuuuc

SEQ ID NO: 1131268 - RNA, 19 nt, Homo sapiens
ccugagcucuggugagaaa

SEQ ID NO: 1131269 - RNA, 19 nt, Homo sapiens
ccagaagcacugagauuaa

SEQ ID NO: 1131270 - RNA, 19 nt, Homo sapiens
ggauuuaggaagacuguuu

SEQ ID NO: 1131271 - RNA, 19 nt, Homo sapiens
gaaauggagaucucuguca

SEQ ID NO: 1131272 - RNA, 19 nt, Homo sapiens
gagaugggccuugugguuu

SEQ ID NO: 1131273 - RNA, 19 nt, Homo sapiens
gaaauagucccuccguucu

SEQ ID NO: 1131274 - RNA, 19 nt, Homo sapiens
gaaagggaugaaguuaaua

SEQ ID NO: 1131275 - RNA, 19 nt, Homo sapiens
gagcuaggcaagaagauga

SEQ ID NO: 1131276 - RNA, 19 nt, Homo sapiens
gaagggaggaggagcacaa

SEQ ID NO: 1131277 - RNA, 19 nt, Homo sapiens
gaaacaagguagagaaaag

SEQ ID NO: 1131278 - RNA, 19 nt, Homo sapiens
ggccagggaugcagaagau

SEQ ID NO: 1131279 - RNA, 19 nt, Homo sapiens
ggucagggcucaggcuuca

SEQ ID NO: 1131280 - RNA, 19 nt, Homo sapiens
ggaggaguguguucgaaag

SEQ ID NO: 1131281 - RNA, 19 nt, Homo sapiens
gaucugccauuuguucuca

SEQ ID NO: 1131282 - RNA, 19 nt, Homo sapiens
caaggaaagggaugaaguu

SEQ ID NO: 1131283 - RNA, 19 nt, Homo sapiens
ucagagcacauuucuugua

SEQ ID NO: 1131284 - RNA, 19 nt, Homo sapiens
guauuuguguguugagaug

SEQ ID NO: 1131285 - RNA, 19 nt, Homo sapiens
ggaggaggaggacuaaaug

SEQ ID NO: 1131286 - RNA, 19 nt, Homo sapiens
gaggauauggagauggaua

SEQ ID NO: 1131287 - RNA, 19 nt, Homo sapiens
gaauguggaggcucuguga

SEQ ID NO: 1131288 - RNA, 19 nt, Homo sapiens
gcacaugagcugaaaauga

SEQ ID NO: 1131289 - RNA, 19 nt, Homo sapiens
aaacaaccaagacaaagaa

SEQ ID NO: 1131290 - RNA, 19 nt, Homo sapiens
gcucagaagccaccuggaa

SEQ ID NO: 1131291 - RNA, 19 nt, Homo sapiens
gaugggaccuacgauguca

SEQ ID NO: 1131292 - RNA, 19 nt, Homo sapiens
gugaacaaauggagcacuu

SEQ ID NO: 1131293 - RNA, 19 nt, Homo sapiens
ggaugaaguuaauauuugc

SEQ ID NO: 1131294 - RNA, 19 nt, Homo sapiens
acucagagcacauuucuug

SEQ ID NO: 1131295 - RNA, 19 nt, Homo sapiens
gaggaggacuaaaugaaaa

SEQ ID NO: 1131296 - RNA, 19 nt, Homo sapiens
aaauggagaucucugucaa

SEQ ID NO: 1131297 - RNA, 19 nt, Homo sapiens
aagcugaauuuacaaggaa

SEQ ID NO: 1131298 - RNA, 19 nt, Homo sapiens
acgaacaccugcacuuaga

SEQ ID NO: 1131299 - RNA, 19 nt, Homo sapiens
gcaacgaacaccugcacuu

SEQ ID NO: 1131300 - RNA, 19 nt, Homo sapiens
aaaggacgaagaaguguaa

SEQ ID NO: 1131301 - RNA, 19 nt, Homo sapiens
gggaaacaagguagagaaa

SEQ ID NO: 1131302 - RNA, 19 nt, Homo sapiens
ucacggagagguguagaua

SEQ ID NO: 1131303 - RNA, 19 nt, Homo sapiens
aaagcugaauuuacaagga

SEQ ID NO: 1131304 - RNA, 19 nt, Homo sapiens
gaccaggcauggccagauc

SEQ ID NO: 1131305 - RNA, 19 nt, Homo sapiens
gggaggaggaggacuaaau

SEQ ID NO: 1131306 - RNA, 19 nt, Homo sapiens
gaggagcuccagguguuua

SEQ ID NO: 1131307 - RNA, 19 nt, Homo sapiens
cacaugagcugaaaaugaa

SEQ ID NO: 1131308 - RNA, 19 nt, Homo sapiens
gcacuggguuugagauucc

SEQ ID NO: 1131309 - RNA, 19 nt, Homo sapiens
caggagacccuuaggauag

SEQ ID NO: 1131310 - RNA, 19 nt, Homo sapiens
acggagagguguagauaau

SEQ ID NO: 1131311 - RNA, 19 nt, Homo sapiens
ggagaucucugucaaaagg

SEQ ID NO: 1131312 - RNA, 19 nt, Homo sapiens
caaccggacccaccugcua

SEQ ID NO: 1131313 - RNA, 19 nt, Homo sapiens
ugagauucccuccauuaaa

SEQ ID NO: 1131314 - RNA, 19 nt, Homo sapiens
ggacgaagaaguguaaguc

SEQ ID NO: 1131315 - RNA, 19 nt, Homo sapiens
cccaagggaucugccauuu

SEQ ID NO: 1131316 - RNA, 19 nt, Homo sapiens
agaacugggaccugaaaua

SEQ ID NO: 1131317 - RNA, 19 nt, Homo sapiens
gaagguggagcaacaaugc

SEQ ID NO: 1131318 - RNA, 19 nt, Homo sapiens
gcaccaaugugagacuuac

SEQ ID NO: 1131319 - RNA, 19 nt, Homo sapiens
gcucgaaccaugucacugu

SEQ ID NO: 1131320 - RNA, 19 nt, Homo sapiens
caagguguacuucuucuuc

SEQ ID NO: 1131321 - RNA, 19 nt, Homo sapiens
ggacugaugcugcgcacau

SEQ ID NO: 1131322 - RNA, 19 nt, Homo sapiens
gaggagaggaggaaaggau

SEQ ID NO: 1131323 - RNA, 19 nt, Homo sapiens
acacauucaugacacacaa

SEQ ID NO: 1131324 - RNA, 19 nt, Homo sapiens
cuagaggcauagacugcua

SEQ ID NO: 1131325 - RNA, 19 nt, Homo sapiens
gaagaggcagugggacuug

SEQ ID NO: 1131326 - RNA, 19 nt, Homo sapiens
gaugaggugcugcaguuug

SEQ ID NO: 1131327 - RNA, 19 nt, Homo sapiens
gaggaggaggacuaaauga

SEQ ID NO: 1131328 - RNA, 19 nt, Homo sapiens
gcauuguugucccuugugu

SEQ ID NO: 1131329 - RNA, 19 nt, Homo sapiens
ccaugguacuguaugcuau

SEQ ID NO: 1131330 - RNA, 19 nt, Homo sapiens
caaccaagacaaagaaagg

SEQ ID NO: 1131331 - RNA, 19 nt, Homo sapiens
gguuugagauucccuccau

SEQ ID NO: 1131332 - RNA, 19 nt, Homo sapiens
gcaaggaaauggccaguua

SEQ ID NO: 1131333 - RNA, 19 nt, Homo sapiens
gcauuugggucacuaauua

SEQ ID NO: 1131334 - RNA, 19 nt, Homo sapiens
gcacuuaccugaaauguuc

SEQ ID NO: 1131335 - RNA, 19 nt, Homo sapiens
ggaaauggccaguuaagua

SEQ ID NO: 1131336 - RNA, 19 nt, Homo sapiens
ggacgcagcugccucugua

SEQ ID NO: 1131337 - RNA, 19 nt, Homo sapiens
gaagaaacauuaccaaggu

SEQ ID NO: 1131338 - RNA, 19 nt, Homo sapiens
ggaaggaaguauugagauu

SEQ ID NO: 1131339 - RNA, 19 nt, Homo sapiens
gcaugcagauugaagauaa

SEQ ID NO: 1131340 - RNA, 19 nt, Homo sapiens
gaaauguucuguuaaugga

SEQ ID NO: 1131341 - RNA, 19 nt, Homo sapiens
ggaauuugcugaacuuugu

SEQ ID NO: 1131342 - RNA, 19 nt, Homo sapiens
ccagaaacaugacucuuaa

SEQ ID NO: 1131343 - RNA, 19 nt, Homo sapiens
gaacaagaauuucaagaac

SEQ ID NO: 1131344 - RNA, 19 nt, Homo sapiens
gaaauuccaugcauguaga

SEQ ID NO: 1131345 - RNA, 19 nt, Homo sapiens
gggagaagcugcagucaga

SEQ ID NO: 1131346 - RNA, 19 nt, Homo sapiens
cagcagagcuaccuaucua

SEQ ID NO: 1131347 - RNA, 19 nt, Homo sapiens
gaagaagacugaauaucuc

SEQ ID NO: 1131348 - RNA, 19 nt, Homo sapiens
caacagacacacuccuuua

SEQ ID NO: 1131349 - RNA, 19 nt, Homo sapiens
gcaaugcuguguacuuguu

SEQ ID NO: 1131350 - RNA, 19 nt, Homo sapiens
uaccugaaauguucuguua

SEQ ID NO: 1131351 - RNA, 19 nt, Homo sapiens
gagauucccucaugguuau

SEQ ID NO: 1131352 - RNA, 19 nt, Homo sapiens
ggaagaagacugaauaucu

SEQ ID NO: 1131353 - RNA, 19 nt, Homo sapiens
gaacacgccaggagaauug

SEQ ID NO: 1131354 - RNA, 19 nt, Homo sapiens
ggagauucccucaugguua

SEQ ID NO: 1131355 - RNA, 19 nt, Homo sapiens
gaaugaggauuguuagauc

SEQ ID NO: 1131356 - RNA, 19 nt, Homo sapiens
gaacaccuuucauauugga

SEQ ID NO: 1131357 - RNA, 19 nt, Homo sapiens
cagaagauccuagcaauaa

SEQ ID NO: 1131358 - RNA, 19 nt, Homo sapiens
gagagaagauuccuuugag

SEQ ID NO: 1131359 - RNA, 19 nt, Homo sapiens
caccaacauugacuucuua

SEQ ID NO: 1131360 - RNA, 19 nt, Homo sapiens
cuucgaagcuagaauauau

SEQ ID NO: 1131361 - RNA, 19 nt, Homo sapiens
gagcacauccaaauccaua

SEQ ID NO: 1131362 - RNA, 19 nt, Homo sapiens
ggaggaagaaucagacaaa

SEQ ID NO: 1131363 - RNA, 19 nt, Homo sapiens
agacugcacuuaccugaaa

SEQ ID NO: 1131364 - RNA, 19 nt, Homo sapiens
ggaaaacacuauuuaccua

SEQ ID NO: 1131365 - RNA, 19 nt, Homo sapiens
gcagaagauccuagcaaua

SEQ ID NO: 1131366 - RNA, 19 nt, Homo sapiens
ggagagaagauuccuuuga

SEQ ID NO: 1131367 - RNA, 19 nt, Homo sapiens
gcaaacagaggagaaauug

SEQ ID NO: 1131368 - RNA, 19 nt, Homo sapiens
gaaauggccaguuaaguag

SEQ ID NO: 1131369 - RNA, 19 nt, Homo sapiens
ccauagcuguaacguauaa

SEQ ID NO: 1131370 - RNA, 19 nt, Homo sapiens
gcuauccugucaugauuaa

SEQ ID NO: 1131371 - RNA, 19 nt, Homo sapiens
cauaaagucuccaaaggau

SEQ ID NO: 1131372 - RNA, 19 nt, Homo sapiens
ccaaauacuuaucuucugu

SEQ ID NO: 1131373 - RNA, 19 nt, Homo sapiens
uuaauggaguugcuaguaa

SEQ ID NO: 1131374 - RNA, 19 nt, Homo sapiens
gaucaauucucuccauuuu

SEQ ID NO: 1131375 - RNA, 19 nt, Homo sapiens
gaucagaacaagaauuuca

SEQ ID NO: 1131376 - RNA, 19 nt, Homo sapiens
uaauggaguugcuaguaaa

SEQ ID NO: 1131377 - RNA, 19 nt, Homo sapiens
gagagaagcuaagaagucu

SEQ ID NO: 1131378 - RNA, 19 nt, Homo sapiens
aaaggaaugaggauuguua

SEQ ID NO: 1131379 - RNA, 19 nt, Homo sapiens
guaaagcgaagcugauuau

SEQ ID NO: 1131380 - RNA, 19 nt, Homo sapiens
cugcuaaagcuguaaauua

SEQ ID NO: 1131381 - RNA, 19 nt, Homo sapiens
gcuguguacuuguuugaaa

SEQ ID NO: 1131382 - RNA, 19 nt, Homo sapiens
ugacagaaauuccaugcau

SEQ ID NO: 1131383 - RNA, 19 nt, Homo sapiens
ccaagguccucauugcaaa

SEQ ID NO: 1131384 - RNA, 19 nt, Homo sapiens
ggucacuaauuaucucaaa

SEQ ID NO: 1131385 - RNA, 19 nt, Homo sapiens
ggaagugccuccagcuuuu

SEQ ID NO: 1131386 - RNA, 19 nt, Homo sapiens
gaagacugaauaucucgua

SEQ ID NO: 1131387 - RNA, 19 nt, Homo sapiens
gcagggccaugccuucgaa

SEQ ID NO: 1131388 - RNA, 19 nt, Homo sapiens
ggagagaagcuaagaaguc

SEQ ID NO: 1131389 - RNA, 19 nt, Homo sapiens
agaauuggcuauccuguca

SEQ ID NO: 1131390 - RNA, 19 nt, Homo sapiens
caauguagccauagcugua

SEQ ID NO: 1131391 - RNA, 19 nt, Homo sapiens
ggaacgugcacacugauuu

SEQ ID NO: 1131392 - RNA, 19 nt, Homo sapiens
agccauagcuguaacguau

SEQ ID NO: 1131393 - RNA, 19 nt, Homo sapiens
gagcagggacuguggaguu

SEQ ID NO: 1131394 - RNA, 19 nt, Homo sapiens
gaaggaaguauugagauug

SEQ ID NO: 1131395 - RNA, 19 nt, Homo sapiens
ccugaaauguucuguuaau

SEQ ID NO: 1131396 - RNA, 19 nt, Homo sapiens
ggcaaagaaccaugaagua

SEQ ID NO: 1131397 - RNA, 19 nt, Homo sapiens
ccaguuaaguagugucuuc

SEQ ID NO: 1131398 - RNA, 19 nt, Homo sapiens
agaagucuuucaaugauga

SEQ ID NO: 1131399 - RNA, 19 nt, Homo sapiens
caaaggauggcacaguaaa

SEQ ID NO: 1131400 - RNA, 19 nt, Homo sapiens
gcaaagaaccaugaaguac

SEQ ID NO: 1131401 - RNA, 19 nt, Homo sapiens
caugaugggucuuauagca

SEQ ID NO: 1131402 - RNA, 19 nt, Homo sapiens
ucaggcacaugaucaauuc

SEQ ID NO: 1131403 - RNA, 19 nt, Homo sapiens
ggaaugaggauuguuagau

SEQ ID NO: 1131404 - RNA, 19 nt, Homo sapiens
uccaaaggauggcacagua

SEQ ID NO: 1131405 - RNA, 19 nt, Homo sapiens
aaggaaguauugagauuga

SEQ ID NO: 1131406 - RNA, 19 nt, Homo sapiens
gaacgugcacacugauuuc

SEQ ID NO: 1131407 - RNA, 19 nt, Homo sapiens
uuagagacauggguauaaa

SEQ ID NO: 1131408 - RNA, 19 nt, Homo sapiens
gaccgacacuuucacucuu

SEQ ID NO: 1131409 - RNA, 19 nt, Homo sapiens
gguacagccuucgucagua

SEQ ID NO: 1131410 - RNA, 19 nt, Homo sapiens
ggacuguggaguuuauuau

SEQ ID NO: 1131411 - RNA, 19 nt, Homo sapiens
caaagaaccaugaaguaca

SEQ ID NO: 1131412 - RNA, 19 nt, Homo sapiens
cugaauaucucguauacca

SEQ ID NO: 1131413 - RNA, 19 nt, Homo sapiens
gaucacaggaacugacuug

SEQ ID NO: 1131414 - RNA, 19 nt, Homo sapiens
auaaagagcacauccaaau

SEQ ID NO: 1131415 - RNA, 19 nt, Homo sapiens
ggauggcacaguaaagaaa

SEQ ID NO: 1131416 - RNA, 19 nt, Homo sapiens
gaagcugauuauccuggaa

SEQ ID NO: 1131417 - RNA, 19 nt, Homo sapiens
ggccaugccuucgaagcua

SEQ ID NO: 1131418 - RNA, 19 nt, Homo sapiens
gaggauuguuagaucagaa

SEQ ID NO: 1131419 - RNA, 19 nt, Homo sapiens
gacugaauaucucguauac

SEQ ID NO: 1131420 - RNA, 19 nt, Homo sapiens
gaaguuuccgugcauuaug

SEQ ID NO: 1131421 - RNA, 19 nt, Homo sapiens
gacaucagaagaucauuga

SEQ ID NO: 1131422 - RNA, 19 nt, Homo sapiens
gugcagaggcgacaucaga

SEQ ID NO: 1131423 - RNA, 19 nt, Homo sapiens
gaaaaggaaugaggauugu

SEQ ID NO: 1131424 - RNA, 19 nt, Homo sapiens
cuaccuaucuauggagaaa

SEQ ID NO: 1131425 - RNA, 19 nt, Homo sapiens
gcagagcuaccuaucuaug

SEQ ID NO: 1131426 - RNA, 19 nt, Homo sapiens
ccuccuccaucugcaauua

SEQ ID NO: 1131427 - RNA, 19 nt, Homo sapiens
cauggaauuugcugaacuu

SEQ ID NO: 1131428 - RNA, 19 nt, Homo sapiens
uaaguagugucuucucucu

SEQ ID NO: 1131429 - RNA, 19 nt, Homo sapiens
gcacggagagaagcuaaga

SEQ ID NO: 1131430 - RNA, 19 nt, Homo sapiens
aaacauggaauuugcugaa

SEQ ID NO: 1131431 - RNA, 19 nt, Homo sapiens
ccaaaggauggcacaguaa

SEQ ID NO: 1131432 - RNA, 19 nt, Homo sapiens
gaacagaugucaagaacaa

SEQ ID NO: 1131433 - RNA, 19 nt, Homo sapiens
caacagcccucucuaguga

SEQ ID NO: 1131434 - RNA, 19 nt, Homo sapiens
caaaucugcuggcaucuuu

SEQ ID NO: 1131435 - RNA, 19 nt, Homo sapiens
caacuacccuuucuuguuc

SEQ ID NO: 1131436 - RNA, 19 nt, Homo sapiens
gaauggcucuuacaacuca

SEQ ID NO: 1131437 - RNA, 19 nt, Homo sapiens
ggaaaggcauggcaccuau

SEQ ID NO: 1131438 - RNA, 19 nt, Homo sapiens
ccauguggaucuacaauuu

SEQ ID NO: 1131439 - RNA, 19 nt, Homo sapiens
gcaccuauaccuugauuaa

SEQ ID NO: 1131440 - RNA, 19 nt, Homo sapiens
ccaagaacgugacuggaaa

SEQ ID NO: 1131441 - RNA, 19 nt, Homo sapiens
gaaacuagaagauccauuc

SEQ ID NO: 1131442 - RNA, 19 nt, Homo sapiens
gcaacuacccuuucuuguu

SEQ ID NO: 1131443 - RNA, 19 nt, Homo sapiens
gaacagcaccgaggaguau

SEQ ID NO: 1131444 - RNA, 19 nt, Homo sapiens
gaagauccauuccagaaac

SEQ ID NO: 1131445 - RNA, 19 nt, Homo sapiens
uuacgaagccugugacuuu

SEQ ID NO: 1131446 - RNA, 19 nt, Homo sapiens
gaucucuucuuuccacaaa

SEQ ID NO: 1131447 - RNA, 19 nt, Homo sapiens
ugaagggaaugcaaauauu

SEQ ID NO: 1131448 - RNA, 19 nt, Homo sapiens
gaucuacaauuucaucauc

SEQ ID NO: 1131449 - RNA, 19 nt, Homo sapiens
cuacaggcauaacuuguuu

SEQ ID NO: 1131450 - RNA, 19 nt, Homo sapiens
gcagcagucuacaggcaua

SEQ ID NO: 1131451 - RNA, 19 nt, Homo sapiens
gaacaaacuaucaaagcuu

SEQ ID NO: 1131452 - RNA, 19 nt, Homo sapiens
gaaaaucagucaacaagau

SEQ ID NO: 1131453 - RNA, 19 nt, Homo sapiens
ggagcugaccgaagauaua

SEQ ID NO: 1131454 - RNA, 19 nt, Homo sapiens
ucaugucucuguaucaauu

SEQ ID NO: 1131455 - RNA, 19 nt, Homo sapiens
ugaagacgcccaccaacua

SEQ ID NO: 1131456 - RNA, 19 nt, Homo sapiens
uagaauggcucuuacaacu

SEQ ID NO: 1131457 - RNA, 19 nt, Homo sapiens
agaggaacaucccauaaug

SEQ ID NO: 1131458 - RNA, 19 nt, Homo sapiens
gcacucagacuaaagaaag

SEQ ID NO: 1131459 - RNA, 19 nt, Homo sapiens
gaaaggcauggcaccuaua

SEQ ID NO: 1131460 - RNA, 19 nt, Homo sapiens
aguuagaucugguuucaaa

SEQ ID NO: 1131461 - RNA, 19 nt, Homo sapiens
gagaggaacaucccauaau

SEQ ID NO: 1131462 - RNA, 19 nt, Homo sapiens
uggcucagcuugaaacaga

SEQ ID NO: 1131463 - RNA, 19 nt, Homo sapiens
ggugucaggugucuucuuc

SEQ ID NO: 1131464 - RNA, 19 nt, Homo sapiens
gcucaggccuuggauuuua

SEQ ID NO: 1131465 - RNA, 19 nt, Homo sapiens
caaagacccugcagaaaau

SEQ ID NO: 1131466 - RNA, 19 nt, Homo sapiens
gcuguucuacuuuauauga

SEQ ID NO: 1131467 - RNA, 19 nt, Homo sapiens
gugcuguucuacuuuauau

SEQ ID NO: 1131468 - RNA, 19 nt, Homo sapiens
gaacaucuuccugacagaa

SEQ ID NO: 1131469 - RNA, 19 nt, Homo sapiens
acccaagacugccugauuu

SEQ ID NO: 1131470 - RNA, 19 nt, Homo sapiens
gaugaagggaaugcaaaua

SEQ ID NO: 1131471 - RNA, 19 nt, Homo sapiens
ugacuuucgugacugcuuu

SEQ ID NO: 1131472 - RNA, 19 nt, Homo sapiens
ggucaccuccuuccuauuc

SEQ ID NO: 1131473 - RNA, 19 nt, Homo sapiens
gcgcaacuacccuuucuug

SEQ ID NO: 1131474 - RNA, 19 nt, Homo sapiens
uagaagauccauuccagaa

SEQ ID NO: 1131475 - RNA, 19 nt, Homo sapiens
gugaacagaugucaagaac

SEQ ID NO: 1131476 - RNA, 19 nt, Homo sapiens
ugucaggugucuucuucua

SEQ ID NO: 1131477 - RNA, 19 nt, Homo sapiens
cgacucuucuucagcuuug

SEQ ID NO: 1131478 - RNA, 19 nt, Homo sapiens
gaaaguuuguggcaaugcu

SEQ ID NO: 1131479 - RNA, 19 nt, Homo sapiens
uacgugcuguucuacuuua

SEQ ID NO: 1131480 - RNA, 19 nt, Homo sapiens
agaguuagaucugguuuca

SEQ ID NO: 1131481 - RNA, 19 nt, Homo sapiens
aaaggcaugugcucacuuc

SEQ ID NO: 1131482 - RNA, 19 nt, Homo sapiens
gccaagaacgugacuggaa

SEQ ID NO: 1131483 - RNA, 19 nt, Homo sapiens
acauguacgugcuguucua

SEQ ID NO: 1131484 - RNA, 19 nt, Homo sapiens
gaaaugguucguccugagu

SEQ ID NO: 1131485 - RNA, 19 nt, Homo sapiens
cagcauccauggcaucaag

SEQ ID NO: 1131486 - RNA, 19 nt, Homo sapiens
guacgugcuguucuacuuu

SEQ ID NO: 1131487 - RNA, 19 nt, Homo sapiens
cauggcaccuauaccuuga

SEQ ID NO: 1131488 - RNA, 19 nt, Homo sapiens
ugaggcagaugaagggaau

SEQ ID NO: 1131489 - RNA, 19 nt, Homo sapiens
gguagaauggcucuuacaa

SEQ ID NO: 1131490 - RNA, 19 nt, Homo sapiens
ccacauugaccgacucuuc

SEQ ID NO: 1131491 - RNA, 19 nt, Homo sapiens
ucaaagacccugcagaaaa

SEQ ID NO: 1131492 - RNA, 19 nt, Homo sapiens
ccucauggcacucagacua

SEQ ID NO: 1131493 - RNA, 19 nt, Homo sapiens
gcaaaucugcuggcaucuu

SEQ ID NO: 1131494 - RNA, 19 nt, Homo sapiens
gagaagccaacaucagugu

SEQ ID NO: 1131495 - RNA, 19 nt, Homo sapiens
cagagaggaacaucccaua

SEQ ID NO: 1131496 - RNA, 19 nt, Homo sapiens
ccaauucccaugucaguca

SEQ ID NO: 1131497 - RNA, 19 nt, Homo sapiens
gcagaugaagggaaugcaa

SEQ ID NO: 1131498 - RNA, 19 nt, Homo sapiens
caacucauguacccauugc

SEQ ID NO: 1131499 - RNA, 19 nt, Homo sapiens
gagguagaauggcucuuac

SEQ ID NO: 1131500 - RNA, 19 nt, Homo sapiens
ucaccuccuuccuauucua

SEQ ID NO: 1131501 - RNA, 19 nt, Homo sapiens
caagaacaaacuaucaaag

SEQ ID NO: 1131502 - RNA, 19 nt, Homo sapiens
gacagaaugccacuuugug

SEQ ID NO: 1131503 - RNA, 19 nt, Homo sapiens
guggaggaguggagugaau

SEQ ID NO: 1131504 - RNA, 19 nt, Homo sapiens
gaagacgcccaccaacuac

SEQ ID NO: 1131505 - RNA, 19 nt, Homo sapiens
uggcaucuuucuucccaaa

SEQ ID NO: 1131506 - RNA, 19 nt, Homo sapiens
gauauuagagagguagaau

SEQ ID NO: 1131507 - RNA, 19 nt, Homo sapiens
agaacaaacuaucaaagcu

SEQ ID NO: 1131508 - RNA, 19 nt, Homo sapiens
gagcugaccgaagauauag

SEQ ID NO: 1131509 - RNA, 19 nt, Homo sapiens
uccagaaugugaucucuuc

SEQ ID NO: 1131510 - RNA, 19 nt, Homo sapiens
ucaucaguguccucuacua

SEQ ID NO: 1131511 - RNA, 19 nt, Homo sapiens
gugagaagccaacaucagu

SEQ ID NO: 1131512 - RNA, 19 nt, Homo sapiens
cagaaugcuuccuggaucu

SEQ ID NO: 1131513 - RNA, 19 nt, Homo sapiens
gagcugacucuccucuaug

SEQ ID NO: 1131514 - RNA, 19 nt, Homo sapiens
cagaugaagggaaugcaaa

SEQ ID NO: 1131515 - RNA, 19 nt, Homo sapiens
gaucuaccagcagaaacua

SEQ ID NO: 1131516 - RNA, 19 nt, Homo sapiens
gaaacagagccucguacca

SEQ ID NO: 1131517 - RNA, 19 nt, Homo sapiens
ccaacagcccucucuagug

SEQ ID NO: 1131518 - RNA, 19 nt, Homo sapiens
ccugacagaaugccacuuu

SEQ ID NO: 1131519 - RNA, 19 nt, Homo sapiens
gaaugugaucucuucuuuc

SEQ ID NO: 1131520 - RNA, 19 nt, Homo sapiens
cuucaugucucuguaucaa

SEQ ID NO: 1131521 - RNA, 19 nt, Homo sapiens
uguacgugcuguucuacuu

SEQ ID NO: 1131522 - RNA, 19 nt, Homo sapiens
agagaggaacaucccauaa

SEQ ID NO: 1131523 - RNA, 19 nt, Homo sapiens
agauauagguccccaauuc

SEQ ID NO: 1131524 - RNA, 19 nt, Homo sapiens
ugucuuggucuuaguguuu

SEQ ID NO: 1131525 - RNA, 19 nt, Homo sapiens
ucauggcacucagacuaaa

SEQ ID NO: 1131526 - RNA, 19 nt, Homo sapiens
cacagaaggaagacaugua

SEQ ID NO: 1131527 - RNA, 19 nt, Homo sapiens
ucaucuacguuccgaguca

SEQ ID NO: 1131528 - RNA, 19 nt, Homo sapiens
aagcuuccacuuuaacaaa

SEQ ID NO: 1131529 - RNA, 19 nt, Homo sapiens
uuguggagcugaccgaaga

SEQ ID NO: 1131530 - RNA, 19 nt, Homo sapiens
ugacagaaugccacuuugu

SEQ ID NO: 1131531 - RNA, 19 nt, Homo sapiens
gacuaaagaaagacaaauc

SEQ ID NO: 1131532 - RNA, 19 nt, Homo sapiens
gaagggaccugcuuucuug

SEQ ID NO: 1131533 - RNA, 19 nt, Homo sapiens
gaagugaucuccaggucuu

SEQ ID NO: 1131534 - RNA, 19 nt, Homo sapiens
ugaaggugcucucacuuua

SEQ ID NO: 1131535 - RNA, 19 nt, Homo sapiens
gcaaagacgucccuaagag

SEQ ID NO: 1131536 - RNA, 19 nt, Homo sapiens
ccaaugggcuggcugcaaa

SEQ ID NO: 1131537 - RNA, 19 nt, Homo sapiens
gagagaacaucgugugugu

SEQ ID NO: 1131538 - RNA, 19 nt, Homo sapiens
ggacagagacacagcaaga

SEQ ID NO: 1131539 - RNA, 19 nt, Homo sapiens
uguguuaccuuucaaguuu

SEQ ID NO: 1131540 - RNA, 19 nt, Homo sapiens
uaaaggcaguuguccacua

SEQ ID NO: 1131541 - RNA, 19 nt, Homo sapiens
gcacagggauauuucuaag

SEQ ID NO: 1131542 - RNA, 19 nt, Homo sapiens
gcaacuguguuaccuuuca

SEQ ID NO: 1131543 - RNA, 19 nt, Homo sapiens
cuucugagcuucuccugua

SEQ ID NO: 1131544 - RNA, 19 nt, Homo sapiens
gaagaaacgcccugagauc

SEQ ID NO: 1131545 - RNA, 19 nt, Homo sapiens
ucaacgacauccagaaguu

SEQ ID NO: 1131546 - RNA, 19 nt, Homo sapiens
gaaagaacuucaggugucu

SEQ ID NO: 1131547 - RNA, 19 nt, Homo sapiens
agacaggaauguaaggauu

SEQ ID NO: 1131548 - RNA, 19 nt, Homo sapiens
gaacaucgugugugugugu

SEQ ID NO: 1131549 - RNA, 19 nt, Homo sapiens
ucaggugucuggacccuuu

SEQ ID NO: 1131550 - RNA, 19 nt, Homo sapiens
ucaguauucucuccaaaga

SEQ ID NO: 1131551 - RNA, 19 nt, Homo sapiens
cugcuggucuccacagaua

SEQ ID NO: 1131552 - RNA, 19 nt, Homo sapiens
gggugaagcucucggacuu

SEQ ID NO: 1131553 - RNA, 19 nt, Homo sapiens
ggacagcuacgugaagauu

SEQ ID NO: 1131554 - RNA, 19 nt, Homo sapiens
gaggaaagccaccuugaca

SEQ ID NO: 1131555 - RNA, 19 nt, Homo sapiens
aguauucucuccaaagauu

SEQ ID NO: 1131556 - RNA, 19 nt, Homo sapiens
cuucagggcugcugugaga

SEQ ID NO: 1131557 - RNA, 19 nt, Homo sapiens
gagaacaucgugugugugu

SEQ ID NO: 1131558 - RNA, 19 nt, Homo sapiens
gaaugaaggcugccaagca

SEQ ID NO: 1131559 - RNA, 19 nt, Homo sapiens
uggcaacuguguuaccuuu

SEQ ID NO: 1131560 - RNA, 19 nt, Homo sapiens
gacaucgucucccaaguca

SEQ ID NO: 1131561 - RNA, 19 nt, Homo sapiens
gcucucacuuuacagaaug

SEQ ID NO: 1131562 - RNA, 19 nt, Homo sapiens
caaguaugccugccaccua

SEQ ID NO: 1131563 - RNA, 19 nt, Homo sapiens
ucaacgugguggagaugua

SEQ ID NO: 1131564 - RNA, 19 nt, Homo sapiens
aaaagcaucuucccuagaa

SEQ ID NO: 1131565 - RNA, 19 nt, Homo sapiens
ggugaggagucgcgaggaa

SEQ ID NO: 1131566 - RNA, 19 nt, Homo sapiens
gcagauugccacugugugu

SEQ ID NO: 1131567 - RNA, 19 nt, Homo sapiens
cuccaaagauugaaaugug

SEQ ID NO: 1131568 - RNA, 19 nt, Homo sapiens
gcaagcccaacuccucuuu

SEQ ID NO: 1131569 - RNA, 19 nt, Homo sapiens
ugauccagcucuaccgaaa

SEQ ID NO: 1131570 - RNA, 19 nt, Homo sapiens
ccucagcgccuaagagaga

SEQ ID NO: 1131571 - RNA, 19 nt, Homo sapiens
ccaccgacccagacaugua

SEQ ID NO: 1131572 - RNA, 19 nt, Homo sapiens
caucagggacccauuguuc

SEQ ID NO: 1131573 - RNA, 19 nt, Homo sapiens
guguuaccuuucaaguuua

SEQ ID NO: 1131574 - RNA, 19 nt, Homo sapiens
caacuguguuaccuuucaa

SEQ ID NO: 1131575 - RNA, 19 nt, Homo sapiens
agaaaaggcugcugugguu

SEQ ID NO: 1131576 - RNA, 19 nt, Homo sapiens
gaugaccccuugauauuug

SEQ ID NO: 1131577 - RNA, 19 nt, Homo sapiens
cuggauggcuccugaagug

SEQ ID NO: 1131578 - RNA, 19 nt, Homo sapiens
ucuggacccuuucuaucua

SEQ ID NO: 1131579 - RNA, 19 nt, Homo sapiens
gccagagacaggaauguaa

SEQ ID NO: 1131580 - RNA, 19 nt, Homo sapiens
aaaggcaguuguccacuag

SEQ ID NO: 1131581 - RNA, 19 nt, Homo sapiens
ucaacgagguggugaucau

SEQ ID NO: 1131582 - RNA, 19 nt, Homo sapiens
ccagguggccgucaagaug

SEQ ID NO: 1131583 - RNA, 19 nt, Homo sapiens
ugaauuguuugcacuugug

SEQ ID NO: 1131584 - RNA, 19 nt, Homo sapiens
ggaccauguuccgcaagaa

SEQ ID NO: 1131585 - RNA, 19 nt, Homo sapiens
ccucugaccacuucggaua

SEQ ID NO: 1131586 - RNA, 19 nt, Homo sapiens
caucuucccuagaaauuuu

SEQ ID NO: 1131587 - RNA, 19 nt, Homo sapiens
gaccauguuccgcaagaaa

SEQ ID NO: 1131588 - RNA, 19 nt, Homo sapiens
gggcuugacaggaguuuau

SEQ ID NO: 1131589 - RNA, 19 nt, Homo sapiens
uccaaagauugaaauguga

SEQ ID NO: 1131590 - RNA, 19 nt, Homo sapiens
gagcagauugccacugugu

SEQ ID NO: 1131591 - RNA, 19 nt, Homo sapiens
aaugaaggcugccaagcau

SEQ ID NO: 1131592 - RNA, 19 nt, Homo sapiens
gacaggaauguaaggauug

SEQ ID NO: 1131593 - RNA, 19 nt, Homo sapiens
ccacagccaguuucaggaa

SEQ ID NO: 1131594 - RNA, 19 nt, Homo sapiens
cgucugauguccugaaggu

SEQ ID NO: 1131595 - RNA, 19 nt, Homo sapiens
gugaauuguuugcacuugu

SEQ ID NO: 1131596 - RNA, 19 nt, Homo sapiens
gcaucuucccuagaaauuu

SEQ ID NO: 1131597 - RNA, 19 nt, Homo sapiens
gggcugcugugagauggaa

SEQ ID NO: 1131598 - RNA, 19 nt, Homo sapiens
aggauuggcaacuguguua

SEQ ID NO: 1131599 - RNA, 19 nt, Homo sapiens
ggccagagacaggaaugua

SEQ ID NO: 1131600 - RNA, 19 nt, Homo sapiens
cagcaaagacgucccuaag

SEQ ID NO: 1131601 - RNA, 19 nt, Homo sapiens
ugaagggaccugcuuucuu

SEQ ID NO: 1131602 - RNA, 19 nt, Homo sapiens
aagaagaaacgcccugaga

SEQ ID NO: 1131603 - RNA, 19 nt, Homo sapiens
gaaggugcucucacuuuac

SEQ ID NO: 1131604 - RNA, 19 nt, Homo sapiens
gauggcuccugaagugauc

SEQ ID NO: 1131605 - RNA, 19 nt, Homo sapiens
gugcagcuccagcccauga

SEQ ID NO: 1131606 - RNA, 19 nt, Homo sapiens
gggaggaaagccaccuuga

SEQ ID NO: 1131607 - RNA, 19 nt, Homo sapiens
gagugaaagagaaagaaug

SEQ ID NO: 1131608 - RNA, 19 nt, Homo sapiens
gaucucagcgccacagaac

SEQ ID NO: 1131609 - RNA, 19 nt, Homo sapiens
ccaaagauugaaaugugaa

SEQ ID NO: 1131610 - RNA, 19 nt, Homo sapiens
ccacagagcaagcccaacu

SEQ ID NO: 1131611 - RNA, 19 nt, Homo sapiens
uguaaggauuggcaacugu

SEQ ID NO: 1131612 - RNA, 19 nt, Homo sapiens
aaggugcucucacuuuaca

SEQ ID NO: 1131613 - RNA, 19 nt, Homo sapiens
cuuccucccucacgucuga

SEQ ID NO: 1131614 - RNA, 19 nt, Homo sapiens
gaucuccaggucuuuguau

SEQ ID NO: 1131615 - RNA, 19 nt, Homo sapiens
ccaccggcaucgucugcuu

SEQ ID NO: 1131616 - RNA, 19 nt, Homo sapiens
cagaaguugucagucauca

SEQ ID NO: 1131617 - RNA, 19 nt, Homo sapiens
ggucacccacagccaguuu

SEQ ID NO: 1131618 - RNA, 19 nt, Homo sapiens
guuguccacuaguguccua

SEQ ID NO: 1131619 - RNA, 19 nt, Homo sapiens
gcagccaacacaguagaaa

SEQ ID NO: 1131620 - RNA, 19 nt, Homo sapiens
cauggugauugagauggua

SEQ ID NO: 1131621 - RNA, 19 nt, Homo sapiens
aggagcagauugccacugu

SEQ ID NO: 1131622 - RNA, 19 nt, Homo sapiens
ugugggugcucauggaguu

SEQ ID NO: 1131623 - RNA, 19 nt, Homo sapiens
gcucaacgacauccagaag

SEQ ID NO: 1131624 - RNA, 19 nt, Homo sapiens
aaagaaauugcaaggacuu

SEQ ID NO: 1131625 - RNA, 19 nt, Homo sapiens
gggacaauuucugagugaa

SEQ ID NO: 1131626 - RNA, 19 nt, Homo sapiens
gcucucggacuucggauuc

SEQ ID NO: 1131627 - RNA, 19 nt, Homo sapiens
agaagaaacgcccugagau

SEQ ID NO: 1131628 - RNA, 19 nt, Homo sapiens
ugauggaccucaggaagca

SEQ ID NO: 1131629 - RNA, 19 nt, Homo sapiens
ucucagcgccacagaacuu

SEQ ID NO: 1131630 - RNA, 19 nt, Homo sapiens
gguggacccuucgcgaauc

SEQ ID NO: 1131631 - RNA, 19 nt, Homo sapiens
gggacuaccagcacuucaa

SEQ ID NO: 1131632 - RNA, 19 nt, Homo sapiens
ggaaauguaucuccagaaa

SEQ ID NO: 1131633 - RNA, 19 nt, Homo sapiens
ugaaggagcuugcgacuuu

SEQ ID NO: 1131634 - RNA, 19 nt, Homo sapiens
ggaaggagcugaggaagaa

SEQ ID NO: 1131635 - RNA, 19 nt, Homo sapiens
gaacugcacagcugaagua

SEQ ID NO: 1131636 - RNA, 19 nt, Homo sapiens
gaaagaauccagaugaaga

SEQ ID NO: 1131637 - RNA, 19 nt, Homo sapiens
guaaacaugucuauugaug

SEQ ID NO: 1131638 - RNA, 19 nt, Homo sapiens
gcacagaacuacaucaacu

SEQ ID NO: 1131639 - RNA, 19 nt, Homo sapiens
gaagacacaugguauaaaa

SEQ ID NO: 1131640 - RNA, 19 nt, Homo sapiens
aaauguaucuccagaaaug

SEQ ID NO: 1131641 - RNA, 19 nt, Homo sapiens
acaagaaacugcaccagaa

SEQ ID NO: 1131642 - RNA, 19 nt, Homo sapiens
ggaaguacaacuggaauaa

SEQ ID NO: 1131643 - RNA, 19 nt, Homo sapiens
ucaagcaagugcaaagaaa

SEQ ID NO: 1131644 - RNA, 19 nt, Homo sapiens
ugaagaagacaacacauuu

SEQ ID NO: 1131645 - RNA, 19 nt, Homo sapiens
gcacagcugaaguacuuua

SEQ ID NO: 1131646 - RNA, 19 nt, Homo sapiens
gacgcucguucuacauuua

SEQ ID NO: 1131647 - RNA, 19 nt, Homo sapiens
guguaaacaugucuauuga

SEQ ID NO: 1131648 - RNA, 19 nt, Homo sapiens
ugaauuagacuacaccauu

SEQ ID NO: 1131649 - RNA, 19 nt, Homo sapiens
caauuucacuggcaucuag

SEQ ID NO: 1131650 - RNA, 19 nt, Homo sapiens
caauacggcacuaaaguaa

SEQ ID NO: 1131651 - RNA, 19 nt, Homo sapiens
gaaggaaccgcuagaagca

SEQ ID NO: 1131652 - RNA, 19 nt, Homo sapiens
cugcacagcugaaguacuu

SEQ ID NO: 1131653 - RNA, 19 nt, Homo sapiens
gaagaggacauaaguaucg

SEQ ID NO: 1131654 - RNA, 19 nt, Homo sapiens
ggaagaagacagacugaag

SEQ ID NO: 1131655 - RNA, 19 nt, Homo sapiens
uagcuuaugaggccaaaua

SEQ ID NO: 1131656 - RNA, 19 nt, Homo sapiens
ugccugugguuauauaaua

SEQ ID NO: 1131657 - RNA, 19 nt, Homo sapiens
ccaaauaaucccaaagugu

SEQ ID NO: 1131658 - RNA, 19 nt, Homo sapiens
ucacuggcaucuagcuuau

SEQ ID NO: 1131659 - RNA, 19 nt, Homo sapiens
aggagaaacuggaaagaau

SEQ ID NO: 1131660 - RNA, 19 nt, Homo sapiens
gagauuauucccuggcaaa

SEQ ID NO: 1131661 - RNA, 19 nt, Homo sapiens
acaauacggcacuaaagua

SEQ ID NO: 1131662 - RNA, 19 nt, Homo sapiens
gaaaugacgcucguucuac

SEQ ID NO: 1131663 - RNA, 19 nt, Homo sapiens
gaauccagaugaagaagac

SEQ ID NO: 1131664 - RNA, 19 nt, Homo sapiens
acaccauucuacuucauaa

SEQ ID NO: 1131665 - RNA, 19 nt, Homo sapiens
gguugccugugguuauaua

SEQ ID NO: 1131666 - RNA, 19 nt, Homo sapiens
gaaauguaucuccagaaau

SEQ ID NO: 1131667 - RNA, 19 nt, Homo sapiens
gaaguguaaacaugucuau

SEQ ID NO: 1131668 - RNA, 19 nt, Homo sapiens
ugacgcucguucuacauuu

SEQ ID NO: 1131669 - RNA, 19 nt, Homo sapiens
gaagaagacaacacauuuu

SEQ ID NO: 1131670 - RNA, 19 nt, Homo sapiens
gccaaauaaucccaaagug

SEQ ID NO: 1131671 - RNA, 19 nt, Homo sapiens
cuacugaagacacauggua

SEQ ID NO: 1131672 - RNA, 19 nt, Homo sapiens
aaaugacgcucguucuaca

SEQ ID NO: 1131673 - RNA, 19 nt, Homo sapiens
ggagaaacuggaaagaauc

SEQ ID NO: 1131674 - RNA, 19 nt, Homo sapiens
ggaaagaauccagaugaag

SEQ ID NO: 1131675 - RNA, 19 nt, Homo sapiens
ggaagaggacauaaguauc

SEQ ID NO: 1131676 - RNA, 19 nt, Homo sapiens
aaacaguaauagugguaug

SEQ ID NO: 1131677 - RNA, 19 nt, Homo sapiens
gcuagaagcacaaaauauu

SEQ ID NO: 1131678 - RNA, 19 nt, Homo sapiens
gaaggagaaacuggaaaga

SEQ ID NO: 1131679 - RNA, 19 nt, Homo sapiens
aaguaucgccuuaaauuug

SEQ ID NO: 1131680 - RNA, 19 nt, Homo sapiens
aaagaauccagaugaagaa

SEQ ID NO: 1131681 - RNA, 19 nt, Homo sapiens
ccuuaaauuugcuguugaa

SEQ ID NO: 1131682 - RNA, 19 nt, Homo sapiens
gaggccaaauaaucccaaa

SEQ ID NO: 1131683 - RNA, 19 nt, Homo sapiens
caguaauagugguauguau

SEQ ID NO: 1131684 - RNA, 19 nt, Homo sapiens
gaacuuuauagaguccaua

SEQ ID NO: 1131685 - RNA, 19 nt, Homo sapiens
ugauguguaugccaauuuc

SEQ ID NO: 1131686 - RNA, 19 nt, Homo sapiens
ggaaguguaaacaugucua

SEQ ID NO: 1131687 - RNA, 19 nt, Homo sapiens
uggguugccugugguuaua

SEQ ID NO: 1131688 - RNA, 19 nt, Homo sapiens
ccaggaagaggacauaagu

SEQ ID NO: 1131689 - RNA, 19 nt, Homo sapiens
acuggcaucuagcuuauga

SEQ ID NO: 1131690 - RNA, 19 nt, Homo sapiens
gaaacugcaccagaaguca

SEQ ID NO: 1131691 - RNA, 19 nt, Homo sapiens
caagugcaaagaaaugaug

SEQ ID NO: 1131692 - RNA, 19 nt, Homo sapiens
agaacuacaucaacuacca

SEQ ID NO: 1131693 - RNA, 19 nt, Homo sapiens
cgccuuaaauuugcuguug

SEQ ID NO: 1131694 - RNA, 19 nt, Homo sapiens
ugaagacacaugguauaaa

SEQ ID NO: 1131695 - RNA, 19 nt, Homo sapiens
gaagacaacacauuuuauc

SEQ ID NO: 1131696 - RNA, 19 nt, Homo sapiens
gccuuaaauuugcuguuga

SEQ ID NO: 1131697 - RNA, 19 nt, Homo sapiens
aggaagaggacauaaguau

SEQ ID NO: 1131698 - RNA, 19 nt, Homo sapiens
ggccaaauaaucccaaagu

SEQ ID NO: 1131699 - RNA, 19 nt, Homo sapiens
aguguaaacaugucuauug

SEQ ID NO: 1131700 - RNA, 19 nt, Homo sapiens
gaggaagaagacagacuga

SEQ ID NO: 1131701 - RNA, 19 nt, Homo sapiens
aaaggaaguacaacuggaa

SEQ ID NO: 1131702 - RNA, 19 nt, Homo sapiens
ccacaauacggcacuaaag

SEQ ID NO: 1131703 - RNA, 19 nt, Homo sapiens
caagccagcauggaggaua

SEQ ID NO: 1131704 - RNA, 19 nt, Homo sapiens
gaguccauaauacaaagua

SEQ ID NO: 1131705 - RNA, 19 nt, Homo sapiens
caagcaagugcaaagaaau

SEQ ID NO: 1131706 - RNA, 19 nt, Homo sapiens
agacuacaccauucuacuu

SEQ ID NO: 1131707 - RNA, 19 nt, Homo sapiens
aauucaaacugucaagcaa

SEQ ID NO: 1131708 - RNA, 19 nt, Homo sapiens
ucacugcucauccggaaug

SEQ ID NO: 1131709 - RNA, 19 nt, Homo sapiens
caggaagaggacauaagua

SEQ ID NO: 1131710 - RNA, 19 nt, Homo sapiens
uagaguccauaauacaaag

SEQ ID NO: 1131711 - RNA, 19 nt, Homo sapiens
gcaagugcaaagaaaugau

SEQ ID NO: 1131712 - RNA, 19 nt, Homo sapiens
cugaagacacaugguauaa

SEQ ID NO: 1131713 - RNA, 19 nt, Homo sapiens
caagaaacugcaccagaag

SEQ ID NO: 1131714 - RNA, 19 nt, Homo sapiens
agugguauguauauccaaa

SEQ ID NO: 1131715 - RNA, 19 nt, Homo sapiens
ucucuggcauccacaauac

SEQ ID NO: 1131716 - RNA, 19 nt, Homo sapiens
gacuacaccauucuacuuc

SEQ ID NO: 1131717 - RNA, 19 nt, Homo sapiens
gcaaaauucuacugaagac

SEQ ID NO: 1131718 - RNA, 19 nt, Homo sapiens
cacaaaauauuccagacaa

SEQ ID NO: 1131719 - RNA, 19 nt, Homo sapiens
cacaauacggcacuaaagu

SEQ ID NO: 1131720 - RNA, 19 nt, Homo sapiens
gauuauucccuggcaaaug

SEQ ID NO: 1131721 - RNA, 19 nt, Homo sapiens
aagccagcauggaggauau

SEQ ID NO: 1131722 - RNA, 19 nt, Homo sapiens
cacagaacuacaucaacua

SEQ ID NO: 1131723 - RNA, 19 nt, Homo sapiens
gccaaaggaaguacaacug

SEQ ID NO: 1131724 - RNA, 19 nt, Homo sapiens
auacggcacuaaaguaaaa

SEQ ID NO: 1131725 - RNA, 19 nt, Homo sapiens
gaaccgcuagaagcacaaa

SEQ ID NO: 1131726 - RNA, 19 nt, Homo sapiens
ugucuugauuacaguauag

SEQ ID NO: 1131727 - RNA, 19 nt, Homo sapiens
gaaggagcuugcgacuuuu

SEQ ID NO: 1131728 - RNA, 19 nt, Homo sapiens
aagcaagugcaaagaaaug

SEQ ID NO: 1131729 - RNA, 19 nt, Homo sapiens
acugaagacacaugguaua

SEQ ID NO: 1131730 - RNA, 19 nt, Homo sapiens
acaguaauagugguaugua

SEQ ID NO: 1131731 - RNA, 19 nt, Homo sapiens
gugcagaaggucaaacaag

SEQ ID NO: 1131732 - RNA, 19 nt, Homo sapiens
ggagggagcuuccuuccuu

SEQ ID NO: 1131733 - RNA, 19 nt, Homo sapiens
gcguggacaugguuauuua

SEQ ID NO: 1131734 - RNA, 19 nt, Homo sapiens
aagcacacaugcacgauua

SEQ ID NO: 1131735 - RNA, 19 nt, Homo sapiens
cuaagacccugacccguaa

SEQ ID NO: 1131736 - RNA, 19 nt, Homo sapiens
gagaggaccuucccaccau

SEQ ID NO: 1131737 - RNA, 19 nt, Homo sapiens
gugagugacuggcugauug

SEQ ID NO: 1131738 - RNA, 19 nt, Homo sapiens
ggccucagcuuccucauca

SEQ ID NO: 1131739 - RNA, 19 nt, Homo sapiens
ggacaugguuauuuaucuc

SEQ ID NO: 1131740 - RNA, 19 nt, Homo sapiens
ggucccggguggauucuaa

SEQ ID NO: 1131741 - RNA, 19 nt, Homo sapiens
ucacagagcagaugcagau

SEQ ID NO: 1131742 - RNA, 19 nt, Homo sapiens
gaaggaggcccguguugag

SEQ ID NO: 1131743 - RNA, 19 nt, Homo sapiens
ucuacaaccugacagagaa

SEQ ID NO: 1131744 - RNA, 19 nt, Homo sapiens
acacaugcacgauuaaaga

SEQ ID NO: 1131745 - RNA, 19 nt, Homo sapiens
gcacacaugcacgauuaaa

SEQ ID NO: 1131746 - RNA, 19 nt, Homo sapiens
ggaaugcagugcugaacac

SEQ ID NO: 1131747 - RNA, 19 nt, Homo sapiens
uguccguucuuuagcaaua

SEQ ID NO: 1131748 - RNA, 19 nt, Homo sapiens
caauagaaaggauguguuc

SEQ ID NO: 1131749 - RNA, 19 nt, Homo sapiens
caagcgggacccagaguuu

SEQ ID NO: 1131750 - RNA, 19 nt, Homo sapiens
ggagcuuccuuccuuccuu

SEQ ID NO: 1131751 - RNA, 19 nt, Homo sapiens
ugaagcaagugaugaaugc

SEQ ID NO: 1131752 - RNA, 19 nt, Homo sapiens
ccuacaaccuccuguucuu

SEQ ID NO: 1131753 - RNA, 19 nt, Homo sapiens
gagaaggaggcccguguug

SEQ ID NO: 1131754 - RNA, 19 nt, Homo sapiens
ggacccagaguuugucuuc

SEQ ID NO: 1131755 - RNA, 19 nt, Homo sapiens
ggauggaugcacugacuga

SEQ ID NO: 1131756 - RNA, 19 nt, Homo sapiens
acccagaguuugucuucua

SEQ ID NO: 1131757 - RNA, 19 nt, Homo sapiens
gcaccaguucccugaggua

SEQ ID NO: 1131758 - RNA, 19 nt, Homo sapiens
cgccucugcugcugaagua

SEQ ID NO: 1131759 - RNA, 19 nt, Homo sapiens
ucagcuuccucaucaauag

SEQ ID NO: 1131760 - RNA, 19 nt, Homo sapiens
gcacuucagccuccucuac

SEQ ID NO: 1131761 - RNA, 19 nt, Homo sapiens
gcuccuggccguuggcauu

SEQ ID NO: 1131762 - RNA, 19 nt, Homo sapiens
ccacuacgacgccuuugga

SEQ ID NO: 1131763 - RNA, 19 nt, Homo sapiens
caggauggaugcacugacu

SEQ ID NO: 1131764 - RNA, 19 nt, Homo sapiens
acacugaauuacagagcuu

SEQ ID NO: 1131765 - RNA, 19 nt, Homo sapiens
acgaggcccugcugucuau

SEQ ID NO: 1131766 - RNA, 19 nt, Homo sapiens
gaacguuugcugggaagga

SEQ ID NO: 1131767 - RNA, 19 nt, Homo sapiens
ccucaucaauagaaaggau

SEQ ID NO: 1131768 - RNA, 19 nt, Homo sapiens
cagaguuugucuucuacga

SEQ ID NO: 1131769 - RNA, 19 nt, Homo sapiens
gacgaggcccugcugucua

SEQ ID NO: 1131770 - RNA, 19 nt, Homo sapiens
cggagaugcuggccaugga

SEQ ID NO: 1131771 - RNA, 19 nt, Homo sapiens
cgggaagccuuggacagaa

SEQ ID NO: 1131772 - RNA, 19 nt, Homo sapiens
cagagcagaugcagaucca

SEQ ID NO: 1131773 - RNA, 19 nt, Homo sapiens
ggagaucgagccggagaug

SEQ ID NO: 1131774 - RNA, 19 nt, Homo sapiens
ggggagugcuugcaugcua

SEQ ID NO: 1131775 - RNA, 19 nt, Homo sapiens
gggaagccuuggacagaac

SEQ ID NO: 1131776 - RNA, 19 nt, Homo sapiens
uuauuuaucucugcuccuu

SEQ ID NO: 1131777 - RNA, 19 nt, Homo sapiens
gaaggccaagacacaguga

SEQ ID NO: 1131778 - RNA, 19 nt, Homo sapiens
uccagaggcugcucgugaa

SEQ ID NO: 1131779 - RNA, 19 nt, Homo sapiens
ucucccggcucuacaccua

SEQ ID NO: 1131780 - RNA, 19 nt, Homo sapiens
ccuacgagcaguaccagaa

SEQ ID NO: 1131781 - RNA, 19 nt, Homo sapiens
cuacaaccuccuguucuuu

SEQ ID NO: 1131782 - RNA, 19 nt, Homo sapiens
agagcaaggccgugaguga

SEQ ID NO: 1131783 - RNA, 19 nt, Homo sapiens
ggcaauucauggagaucga

SEQ ID NO: 1131784 - RNA, 19 nt, Homo sapiens
cccaggccauccaggcuuu

SEQ ID NO: 1131785 - RNA, 19 nt, Homo sapiens
gaccagcugaagcaaguga

SEQ ID NO: 1131786 - RNA, 19 nt, Homo sapiens
gaagcagcaccacgucaag

SEQ ID NO: 1131787 - RNA, 19 nt, Homo sapiens
uaagcacacaugcacgauu

SEQ ID NO: 1131788 - RNA, 19 nt, Homo sapiens
ugaagcagcaccacgucaa

SEQ ID NO: 1131789 - RNA, 19 nt, Homo sapiens
gcccugcugucuaucuaca

SEQ ID NO: 1131790 - RNA, 19 nt, Homo sapiens
cguaacacgaggaucauug

SEQ ID NO: 1131791 - RNA, 19 nt, Homo sapiens
ucacuuuggccaccaguuc

SEQ ID NO: 1131792 - RNA, 19 nt, Homo sapiens
agaaggaggcccguguuga

SEQ ID NO: 1131793 - RNA, 19 nt, Homo sapiens
ggcgucaggugagaacguu

SEQ ID NO: 1131794 - RNA, 19 nt, Homo sapiens
gugguuggaacacugaauu

SEQ ID NO: 1131795 - RNA, 19 nt, Homo sapiens
gcugccaccuugucaccau

SEQ ID NO: 1131796 - RNA, 19 nt, Homo sapiens
ucaauagaaaggauguguu

SEQ ID NO: 1131797 - RNA, 19 nt, Homo sapiens
ggcguggacaugguuauuu

SEQ ID NO: 1131798 - RNA, 19 nt, Homo sapiens
cuccgugucuguccuagga

SEQ ID NO: 1131799 - RNA, 19 nt, Homo sapiens
ggggauuguuucuucuuuu

SEQ ID NO: 1131800 - RNA, 19 nt, Homo sapiens
guuggaacacugaauuaca

SEQ ID NO: 1131801 - RNA, 19 nt, Homo sapiens
acgaccagcugaagcaagu

SEQ ID NO: 1131802 - RNA, 19 nt, Homo sapiens
acaugccgguguucacaga

SEQ ID NO: 1131803 - RNA, 19 nt, Homo sapiens
ucuggaggaggcaaguuua

SEQ ID NO: 1131804 - RNA, 19 nt, Homo sapiens
uacaaccuccuguucuuug

SEQ ID NO: 1131805 - RNA, 19 nt, Homo sapiens
uggacaugguuauuuaucu

SEQ ID NO: 1131806 - RNA, 19 nt, Homo sapiens
gccaagacacagugacaca

SEQ ID NO: 1131807 - RNA, 19 nt, Homo sapiens
cagcugaagcaagugauga

SEQ ID NO: 1131808 - RNA, 19 nt, Homo sapiens
ucaugcggcuacuggacuu

SEQ ID NO: 1131809 - RNA, 19 nt, Homo sapiens
cuggacaggucgucaggau

SEQ ID NO: 1131810 - RNA, 19 nt, Homo sapiens
cgacugcagggucugaugu

SEQ ID NO: 1131811 - RNA, 19 nt, Homo sapiens
uuggaacacugaauuacag

SEQ ID NO: 1131812 - RNA, 19 nt, Homo sapiens
ugguuggaacacugaauua

SEQ ID NO: 1131813 - RNA, 19 nt, Homo sapiens
uggacuggcucaccaacca

SEQ ID NO: 1131814 - RNA, 19 nt, Homo sapiens
gcagcuggacucggugaug

SEQ ID NO: 1131815 - RNA, 19 nt, Homo sapiens
guaauaagacgcaguauga

SEQ ID NO: 1131816 - RNA, 19 nt, Homo sapiens
guacaguccuccaggguau

SEQ ID NO: 1131817 - RNA, 19 nt, Homo sapiens
ggaacugcaccuucuauga

SEQ ID NO: 1131818 - RNA, 19 nt, Homo sapiens
ggugaugaccugcguguuu

SEQ ID NO: 1131819 - RNA, 19 nt, Homo sapiens
gaacugcaccuucuaugag

SEQ ID NO: 1131820 - RNA, 19 nt, Homo sapiens
aaagguacaugaagcacaa

SEQ ID NO: 1131821 - RNA, 19 nt, Homo sapiens
gugagaagcugcccauggu

SEQ ID NO: 1131822 - RNA, 19 nt, Homo sapiens
gcucuacuauuucuacgau

SEQ ID NO: 1131823 - RNA, 19 nt, Homo sapiens
acaaagacaugcuggacau

SEQ ID NO: 1131824 - RNA, 19 nt, Homo sapiens
gugaugaccugcguguuug

SEQ ID NO: 1131825 - RNA, 19 nt, Homo sapiens
caacauggucaucaucuuc

SEQ ID NO: 1131826 - RNA, 19 nt, Homo sapiens
gggcagcggcuuugcgaaa

SEQ ID NO: 1131827 - RNA, 19 nt, Homo sapiens
gacgcaguaugaugagauu

SEQ ID NO: 1131828 - RNA, 19 nt, Homo sapiens
gcgaagaaccagccacauc

SEQ ID NO: 1131829 - RNA, 19 nt, Homo sapiens
acaacagccugcccuacuu

SEQ ID NO: 1131830 - RNA, 19 nt, Homo sapiens
gguaauaagacgcaguaug

SEQ ID NO: 1131831 - RNA, 19 nt, Homo sapiens
auaagacgcaguaugauga

SEQ ID NO: 1131832 - RNA, 19 nt, Homo sapiens
cgacaucuucuucguguuc

SEQ ID NO: 1131833 - RNA, 19 nt, Homo sapiens
ggucaucaucuucaucaug

SEQ ID NO: 1131834 - RNA, 19 nt, Homo sapiens
ggcguuggccuccuuguga

SEQ ID NO: 1131835 - RNA, 19 nt, Homo sapiens
ggagucgggacgugaagaa

SEQ ID NO: 1131836 - RNA, 19 nt, Homo sapiens
gcgaaaguccuaccuccau

SEQ ID NO: 1131837 - RNA, 19 nt, Homo sapiens
gugcugcucuacuauuucu

SEQ ID NO: 1131838 - RNA, 19 nt, Homo sapiens
uggugcugcucuacuauuu

SEQ ID NO: 1131839 - RNA, 19 nt, Homo sapiens
gcucagcuacaaagacaug

SEQ ID NO: 1131840 - RNA, 19 nt, Homo sapiens
gaaaguccuaccuccaucu

SEQ ID NO: 1131841 - RNA, 19 nt, Homo sapiens
gguuugacauccagguaca

SEQ ID NO: 1131842 - RNA, 19 nt, Homo sapiens
caacagccugcccuacuuc

SEQ ID NO: 1131843 - RNA, 19 nt, Homo sapiens
cugcucagcuacaaagaca

SEQ ID NO: 1131844 - RNA, 19 nt, Homo sapiens
gaagaaaagguacaugaag

SEQ ID NO: 1131845 - RNA, 19 nt, Homo sapiens
acaacauggucaucaucuu

SEQ ID NO: 1131846 - RNA, 19 nt, Homo sapiens
aauaagacgcaguaugaug

SEQ ID NO: 1131847 - RNA, 19 nt, Homo sapiens
ggccuacugccacagguuu

SEQ ID NO: 1131848 - RNA, 19 nt, Homo sapiens
gcugagcaguccccaaaau

SEQ ID NO: 1131849 - RNA, 19 nt, Homo sapiens
ccuucucccuccuggguuu

SEQ ID NO: 1131850 - RNA, 19 nt, Homo sapiens
ggugcuggacuacaacaug

SEQ ID NO: 1131851 - RNA, 19 nt, Homo sapiens
gggaacugcaccuucuaug

SEQ ID NO: 1131852 - RNA, 19 nt, Homo sapiens
gacaucuucuucguguuca

SEQ ID NO: 1131853 - RNA, 19 nt, Homo sapiens
ggacuacaacauggucauc

SEQ ID NO: 1131854 - RNA, 19 nt, Homo sapiens
aacugcaccuucuaugaga

SEQ ID NO: 1131855 - RNA, 19 nt, Homo sapiens
gcacuuaauuugcuuguua

SEQ ID NO: 1131856 - RNA, 19 nt, Homo sapiens
gggcagauguuaauagaaa

SEQ ID NO: 1131857 - RNA, 19 nt, Homo sapiens
gaaaguuccuuguacucua

SEQ ID NO: 1131858 - RNA, 19 nt, Homo sapiens
auaaagagauugcucagua

SEQ ID NO: 1131859 - RNA, 19 nt, Homo sapiens
caaaggacauaaagagauu

SEQ ID NO: 1131860 - RNA, 19 nt, Homo sapiens
gcaaugcagugccuccaua

SEQ ID NO: 1131861 - RNA, 19 nt, Homo sapiens
guacuacuguuacauuuga

SEQ ID NO: 1131862 - RNA, 19 nt, Homo sapiens
gggcauacgugcuugauga

SEQ ID NO: 1131863 - RNA, 19 nt, Homo sapiens
ccugauaccucuuacuaua

SEQ ID NO: 1131864 - RNA, 19 nt, Homo sapiens
gagaaugcaggcacuauua

SEQ ID NO: 1131865 - RNA, 19 nt, Homo sapiens
gaacuauucuccuuuaugc

SEQ ID NO: 1131866 - RNA, 19 nt, Homo sapiens
ggacaagaauacuacaugu

SEQ ID NO: 1131867 - RNA, 19 nt, Homo sapiens
ggaaguaugcuuuggauau

SEQ ID NO: 1131868 - RNA, 19 nt, Homo sapiens
gaacagugcagaagagcua

SEQ ID NO: 1131869 - RNA, 19 nt, Homo sapiens
gaaguaugcuuuggauaug

SEQ ID NO: 1131870 - RNA, 19 nt, Homo sapiens
agagauugcucaguauuua

SEQ ID NO: 1131871 - RNA, 19 nt, Homo sapiens
caacacgacuuuaaccaau

SEQ ID NO: 1131872 - RNA, 19 nt, Homo sapiens
caucaugaaucuccuuauu

SEQ ID NO: 1131873 - RNA, 19 nt, Homo sapiens
ugaaguaccuuguagaaca

SEQ ID NO: 1131874 - RNA, 19 nt, Homo sapiens
ccacaaacuugcacaaaca

SEQ ID NO: 1131875 - RNA, 19 nt, Homo sapiens
caaacaaacugcuagugau

SEQ ID NO: 1131876 - RNA, 19 nt, Homo sapiens
gcauaucgcugcucuuaac

SEQ ID NO: 1131877 - RNA, 19 nt, Homo sapiens
cauacgugcuugaugauuu

SEQ ID NO: 1131878 - RNA, 19 nt, Homo sapiens
uaacaaccauccagacauc

SEQ ID NO: 1131879 - RNA, 19 nt, Homo sapiens
gcaucaaccuauggaagua

SEQ ID NO: 1131880 - RNA, 19 nt, Homo sapiens
uaaagagauugcucaguau

SEQ ID NO: 1131881 - RNA, 19 nt, Homo sapiens
gccagcagcuuauuaucuu

SEQ ID NO: 1131882 - RNA, 19 nt, Homo sapiens
gauagaauguggugcugau

SEQ ID NO: 1131883 - RNA, 19 nt, Homo sapiens
guacccuguuuguaaauuu

SEQ ID NO: 1131884 - RNA, 19 nt, Homo sapiens
gcgguacccuguuuguaaa

SEQ ID NO: 1131885 - RNA, 19 nt, Homo sapiens
gaacaagaccauuucaaaa

SEQ ID NO: 1131886 - RNA, 19 nt, Homo sapiens
guguccagcugacccauua

SEQ ID NO: 1131887 - RNA, 19 nt, Homo sapiens
ccacagacacuaauaaugg

SEQ ID NO: 1131888 - RNA, 19 nt, Homo sapiens
aacaugagguacagugaua

SEQ ID NO: 1131889 - RNA, 19 nt, Homo sapiens
ggaaaaggaugguuaugga

SEQ ID NO: 1131890 - RNA, 19 nt, Homo sapiens
caaagguaauacugcauug

SEQ ID NO: 1131891 - RNA, 19 nt, Homo sapiens
gcugacccauuacaguuaa

SEQ ID NO: 1131892 - RNA, 19 nt, Homo sapiens
gauuucauguuacaaagga

SEQ ID NO: 1131893 - RNA, 19 nt, Homo sapiens
gcuagugauugcuggauga

SEQ ID NO: 1131894 - RNA, 19 nt, Homo sapiens
caaaagcguccuugaaaua

SEQ ID NO: 1131895 - RNA, 19 nt, Homo sapiens
gcaaugaacaugagguaca

SEQ ID NO: 1131896 - RNA, 19 nt, Homo sapiens
uaaagggcauaucccagaa

SEQ ID NO: 1131897 - RNA, 19 nt, Homo sapiens
ggguacuacuguuacauuu

SEQ ID NO: 1131898 - RNA, 19 nt, Homo sapiens
gagcuagaaggucuuauug

SEQ ID NO: 1131899 - RNA, 19 nt, Homo sapiens
ucuaaagacagcaguauuu

SEQ ID NO: 1131900 - RNA, 19 nt, Homo sapiens
agaacaagaccauuucaaa

SEQ ID NO: 1131901 - RNA, 19 nt, Homo sapiens
gcuagaaggucuuauugcu

SEQ ID NO: 1131902 - RNA, 19 nt, Homo sapiens
caagacagaacguauuaau

SEQ ID NO: 1131903 - RNA, 19 nt, Homo sapiens
aaacaaacugcuagugauu

SEQ ID NO: 1131904 - RNA, 19 nt, Homo sapiens
ggcgguacccuguuuguaa

SEQ ID NO: 1131905 - RNA, 19 nt, Homo sapiens
agagcgagcuaucaaacaa

SEQ ID NO: 1131906 - RNA, 19 nt, Homo sapiens
gcaaaagcguccuugaaau

SEQ ID NO: 1131907 - RNA, 19 nt, Homo sapiens
ucuacaaguuacugcaaua

SEQ ID NO: 1131908 - RNA, 19 nt, Homo sapiens
caauucaacuccucuucga

SEQ ID NO: 1131909 - RNA, 19 nt, Homo sapiens
acaaacaaacugcuaguga

SEQ ID NO: 1131910 - RNA, 19 nt, Homo sapiens
agacacuaauaauggcuua

SEQ ID NO: 1131911 - RNA, 19 nt, Homo sapiens
gaacaugagguacagugau

SEQ ID NO: 1131912 - RNA, 19 nt, Homo sapiens
aaaggaugguuauggaaug

SEQ ID NO: 1131913 - RNA, 19 nt, Homo sapiens
gaaguuuggacaucaugaa

SEQ ID NO: 1131914 - RNA, 19 nt, Homo sapiens
uagagaaaguuccuuguac

SEQ ID NO: 1131915 - RNA, 19 nt, Homo sapiens
gagcaucugucaacaacac

SEQ ID NO: 1131916 - RNA, 19 nt, Homo sapiens
uaauccagccuauaaauca

SEQ ID NO: 1131917 - RNA, 19 nt, Homo sapiens
gaugagaaggaaauagcua

SEQ ID NO: 1131918 - RNA, 19 nt, Homo sapiens
caaguuacugcaauacuga

SEQ ID NO: 1131919 - RNA, 19 nt, Homo sapiens
caauuuggauccuuuaagc

SEQ ID NO: 1131920 - RNA, 19 nt, Homo sapiens
gagcaauuuggauccuuua

SEQ ID NO: 1131921 - RNA, 19 nt, Homo sapiens
gaacguauucuugguccuu

SEQ ID NO: 1131922 - RNA, 19 nt, Homo sapiens
ggaagugaacagugcagaa

SEQ ID NO: 1131923 - RNA, 19 nt, Homo sapiens
caaacgaugcaucaaccua

SEQ ID NO: 1131924 - RNA, 19 nt, Homo sapiens
gaaugcaggcacuauuaau

SEQ ID NO: 1131925 - RNA, 19 nt, Homo sapiens
gucaacaacacgacuuuaa

SEQ ID NO: 1131926 - RNA, 19 nt, Homo sapiens
acaaguuacugcaauacug

SEQ ID NO: 1131927 - RNA, 19 nt, Homo sapiens
gauaugcagcagagcaauu

SEQ ID NO: 1131928 - RNA, 19 nt, Homo sapiens
agacagaacguauuaaugc

SEQ ID NO: 1131929 - RNA, 19 nt, Homo sapiens
gaaguaccuuguagaacac

SEQ ID NO: 1131930 - RNA, 19 nt, Homo sapiens
guccaguccuuguuaaauc

SEQ ID NO: 1131931 - RNA, 19 nt, Homo sapiens
cugcaauacugauagaaug

SEQ ID NO: 1131932 - RNA, 19 nt, Homo sapiens
acaagaauacuacaugugu

SEQ ID NO: 1131933 - RNA, 19 nt, Homo sapiens
uuagagaaaguuccuugua

SEQ ID NO: 1131934 - RNA, 19 nt, Homo sapiens
gaagugaacagugcagaag

SEQ ID NO: 1131935 - RNA, 19 nt, Homo sapiens
cugcauaucgcugcucuua

SEQ ID NO: 1131936 - RNA, 19 nt, Homo sapiens
ggugguccaguccuuguua

SEQ ID NO: 1131937 - RNA, 19 nt, Homo sapiens
gaccgccagcagcuuauua

SEQ ID NO: 1131938 - RNA, 19 nt, Homo sapiens
agagcaauuuggauccuuu

SEQ ID NO: 1131939 - RNA, 19 nt, Homo sapiens
cagcaagacagaacguauu

SEQ ID NO: 1131940 - RNA, 19 nt, Homo sapiens
guguuucgauggccauuug

SEQ ID NO: 1131941 - RNA, 19 nt, Homo sapiens
cagcugacccauuacaguu

SEQ ID NO: 1131942 - RNA, 19 nt, Homo sapiens
aaagcguccuugaaauaga

SEQ ID NO: 1131943 - RNA, 19 nt, Homo sapiens
ccagcagcuuauuaucuuu

SEQ ID NO: 1131944 - RNA, 19 nt, Homo sapiens
gcaagacagaacguauuaa

SEQ ID NO: 1131945 - RNA, 19 nt, Homo sapiens
ucaaagguaauacugcauu

SEQ ID NO: 1131946 - RNA, 19 nt, Homo sapiens
gaucuaaagacagcaguau

SEQ ID NO: 1131947 - RNA, 19 nt, Homo sapiens
agugauugcuggaugagaa

SEQ ID NO: 1131948 - RNA, 19 nt, Homo sapiens
gcacaaacaaacugcuagu

SEQ ID NO: 1131949 - RNA, 19 nt, Homo sapiens
gccacaaacuugcacaaac

SEQ ID NO: 1131950 - RNA, 19 nt, Homo sapiens
gacaucaugaaucuccuua

SEQ ID NO: 1131951 - RNA, 19 nt, Homo sapiens
uuacugcaauacugauaga

SEQ ID NO: 1131952 - RNA, 19 nt, Homo sapiens
ggaauuccuccuagagcaa

SEQ ID NO: 1131953 - RNA, 19 nt, Homo sapiens
gguacccuguuuguaaauu

SEQ ID NO: 1131954 - RNA, 19 nt, Homo sapiens
aaaguuccuuguacucuag

SEQ ID NO: 1131955 - RNA, 19 nt, Homo sapiens
ggacauccguggcaaacuu

SEQ ID NO: 1131956 - RNA, 19 nt, Homo sapiens
gagaagacuugccgggaaa

SEQ ID NO: 1131957 - RNA, 19 nt, Homo sapiens
gaggagaguacaauaaauu

SEQ ID NO: 1131958 - RNA, 19 nt, Homo sapiens
ggagucggcugcuaagugu

SEQ ID NO: 1131959 - RNA, 19 nt, Homo sapiens
ggugaucgcugccgcuuuc

SEQ ID NO: 1131960 - RNA, 19 nt, Homo sapiens
gggagcagcuacagacuca

SEQ ID NO: 1131961 - RNA, 19 nt, Homo sapiens
gucaauaccucaccaccaa

SEQ ID NO: 1131962 - RNA, 19 nt, Homo sapiens
gcgaggagaguacaauaaa

SEQ ID NO: 1131963 - RNA, 19 nt, Homo sapiens
ggagcaguuucaccaauuc

SEQ ID NO: 1131964 - RNA, 19 nt, Homo sapiens
cgaggagaguacaauaaau

SEQ ID NO: 1131965 - RNA, 19 nt, Homo sapiens
ccaucgaccucguguacaa

SEQ ID NO: 1131966 - RNA, 19 nt, Homo sapiens
gcaacggccuggacaaagc

SEQ ID NO: 1131967 - RNA, 19 nt, Homo sapiens
ccaccaaguuccagcagau

SEQ ID NO: 1131968 - RNA, 19 nt, Homo sapiens
gggcgaggagaguacaaua

SEQ ID NO: 1131969 - RNA, 19 nt, Homo sapiens
gaucguccguggcaugaac

SEQ ID NO: 1131970 - RNA, 19 nt, Homo sapiens
gcugugcccucaugaaucg

SEQ ID NO: 1131971 - RNA, 19 nt, Homo sapiens
gagcagcuacagacucaga

SEQ ID NO: 1131972 - RNA, 19 nt, Homo sapiens
gaugugccgcugacuguga

SEQ ID NO: 1131973 - RNA, 19 nt, Homo sapiens
ccacgaacuacgacaagaa

SEQ ID NO: 1131974 - RNA, 19 nt, Homo sapiens
ggcgaggagaguacaauaa

SEQ ID NO: 1131975 - RNA, 19 nt, Homo sapiens
ggccaacgcguacaaguag

SEQ ID NO: 1131976 - RNA, 19 nt, Homo sapiens
ucaaacgccaccaguguga

SEQ ID NO: 1131977 - RNA, 19 nt, Homo sapiens
aggagcaguuucaccaauu

SEQ ID NO: 1131978 - RNA, 19 nt, Homo sapiens
ccaaagggcaggagaagac

SEQ ID NO: 1131979 - RNA, 19 nt, Homo sapiens
augaaucgcuccaccaagu

SEQ ID NO: 1131980 - RNA, 19 nt, Homo sapiens
ccaccaaggagcaguuuca

SEQ ID NO: 1131981 - RNA, 19 nt, Homo sapiens
ccagugugaggacaucuuu

SEQ ID NO: 1131982 - RNA, 19 nt, Homo sapiens
ugugacauguggagagaug

SEQ ID NO: 1131983 - RNA, 19 nt, Homo sapiens
ggcgcuaccuggagaccaa

SEQ ID NO: 1131984 - RNA, 19 nt, Homo sapiens
gaaucgcuccaccaaguuc

SEQ ID NO: 1131985 - RNA, 19 nt, Homo sapiens
ccguggagguggacuuugu

SEQ ID NO: 1131986 - RNA, 19 nt, Homo sapiens
ucaccgggaucaugauugc

SEQ ID NO: 1131987 - RNA, 19 nt, Homo sapiens
gacauccguggcaaacuuu

SEQ ID NO: 1131988 - RNA, 19 nt, Homo sapiens
aaggagcaguuucaccaau

SEQ ID NO: 1131989 - RNA, 19 nt, Homo sapiens
agaagaagcggcuggacau

SEQ ID NO: 1131990 - RNA, 19 nt, Homo sapiens
caucuugucauuugaggau

SEQ ID NO: 1131991 - RNA, 19 nt, Homo sapiens
gaagaagcggcuggacauc

SEQ ID NO: 1131992 - RNA, 19 nt, Homo sapiens
caaggagcaguuucaccaa

SEQ ID NO: 1131993 - RNA, 19 nt, Homo sapiens
cagcggcacugggacaucu

SEQ ID NO: 1131994 - RNA, 19 nt, Homo sapiens
ccgacaccaugaccaagug

SEQ ID NO: 1131995 - RNA, 19 nt, Homo sapiens
ugcgggacuucaccaacua

SEQ ID NO: 1131996 - RNA, 19 nt, Homo sapiens
aggccaacgcguacaagua

SEQ ID NO: 1131997 - RNA, 19 nt, Homo sapiens
ggacauccugcgggacuuc

SEQ ID NO: 1131998 - RNA, 19 nt, Homo sapiens
aggagacccugcuggcaau

SEQ ID NO: 1131999 - RNA, 19 nt, Homo sapiens
ccgcaacggccuggacaaa

SEQ ID NO: 1132000 - RNA, 19 nt, Homo sapiens
gaacaaaccugucuauaua

SEQ ID NO: 1132001 - RNA, 19 nt, Homo sapiens
ggacaaaguugaccaagga

SEQ ID NO: 1132002 - RNA, 19 nt, Homo sapiens
ucacauaucuguaguagga

SEQ ID NO: 1132003 - RNA, 19 nt, Homo sapiens
ggugguaguuucuauauuu

SEQ ID NO: 1132004 - RNA, 19 nt, Homo sapiens
gaacucagcuuggaaucuu

SEQ ID NO: 1132005 - RNA, 19 nt, Homo sapiens
caacugcauucuuugauuu

SEQ ID NO: 1132006 - RNA, 19 nt, Homo sapiens
acaaacacaugcaaacaua

SEQ ID NO: 1132007 - RNA, 19 nt, Homo sapiens
gcacauacauacaaacaca

SEQ ID NO: 1132008 - RNA, 19 nt, Homo sapiens
gaacaaagccaagaagaau

SEQ ID NO: 1132009 - RNA, 19 nt, Homo sapiens
gaauugacguaaccuagaa

SEQ ID NO: 1132010 - RNA, 19 nt, Homo sapiens
gcaacugcauucuuugauu

SEQ ID NO: 1132011 - RNA, 19 nt, Homo sapiens
cgacagacuucuugcguuu

SEQ ID NO: 1132012 - RNA, 19 nt, Homo sapiens
ggacacuuauuucuagauu

SEQ ID NO: 1132013 - RNA, 19 nt, Homo sapiens
ggucuguucuccuuccuua

SEQ ID NO: 1132014 - RNA, 19 nt, Homo sapiens
guauauauaucaccacaga

SEQ ID NO: 1132015 - RNA, 19 nt, Homo sapiens
caaggacacuuauuucuag

SEQ ID NO: 1132016 - RNA, 19 nt, Homo sapiens
gaauacaucucucacacau

SEQ ID NO: 1132017 - RNA, 19 nt, Homo sapiens
gagcaugagugacaacuuc

SEQ ID NO: 1132018 - RNA, 19 nt, Homo sapiens
aaacauaccuacacacaca

SEQ ID NO: 1132019 - RNA, 19 nt, Homo sapiens
cauaucagcucaacagaau

SEQ ID NO: 1132020 - RNA, 19 nt, Homo sapiens
gaaugcacuuugccuugua

SEQ ID NO: 1132021 - RNA, 19 nt, Homo sapiens
agccagaucucacaaagua

SEQ ID NO: 1132022 - RNA, 19 nt, Homo sapiens
guuaccagcucaauaaaug

SEQ ID NO: 1132023 - RNA, 19 nt, Homo sapiens
ggucauacauuguguuugg

SEQ ID NO: 1132024 - RNA, 19 nt, Homo sapiens
ggaacaaagccaagaagaa

SEQ ID NO: 1132025 - RNA, 19 nt, Homo sapiens
augaauggcuccucaagua

SEQ ID NO: 1132026 - RNA, 19 nt, Homo sapiens
caucaaacccauuucuuaa

SEQ ID NO: 1132027 - RNA, 19 nt, Homo sapiens
cccagaagcuucaguauag

SEQ ID NO: 1132028 - RNA, 19 nt, Homo sapiens
gcacuuggaaugagaauca

SEQ ID NO: 1132029 - RNA, 19 nt, Homo sapiens
ugaacaaaccugucuauau

SEQ ID NO: 1132030 - RNA, 19 nt, Homo sapiens
ccucuaguuucaucacuua

SEQ ID NO: 1132031 - RNA, 19 nt, Homo sapiens
gagauuugccggaacaauu

SEQ ID NO: 1132032 - RNA, 19 nt, Homo sapiens
ggaaugcacuuugccuugu

SEQ ID NO: 1132033 - RNA, 19 nt, Homo sapiens
gacagcaaguuggaucaua

SEQ ID NO: 1132034 - RNA, 19 nt, Homo sapiens
ccaaggacacuuauuucua

SEQ ID NO: 1132035 - RNA, 19 nt, Homo sapiens
ucaucaaacccauuucuua

SEQ ID NO: 1132036 - RNA, 19 nt, Homo sapiens
cacagaagcugcaaagagu

SEQ ID NO: 1132037 - RNA, 19 nt, Homo sapiens
ggagauccgacuacacuuu

SEQ ID NO: 1132038 - RNA, 19 nt, Homo sapiens
ugaccaaggacacuuauuu

SEQ ID NO: 1132039 - RNA, 19 nt, Homo sapiens
gcaaacauaccuacacaca

SEQ ID NO: 1132040 - RNA, 19 nt, Homo sapiens
acagcaaguuggaucauaa

SEQ ID NO: 1132041 - RNA, 19 nt, Homo sapiens
uaugaugggucgaugacua

SEQ ID NO: 1132042 - RNA, 19 nt, Homo sapiens
gaggaacuauauccagaga

SEQ ID NO: 1132043 - RNA, 19 nt, Homo sapiens
ucaaacccauuucuuaauc

SEQ ID NO: 1132044 - RNA, 19 nt, Homo sapiens
ggaaugagaaucagaggau

SEQ ID NO: 1132045 - RNA, 19 nt, Homo sapiens
caguuaaccugauuucaau

SEQ ID NO: 1132046 - RNA, 19 nt, Homo sapiens
gauuggcccuuucuucaug

SEQ ID NO: 1132047 - RNA, 19 nt, Homo sapiens
ggacuucgagggcaacuug

SEQ ID NO: 1132048 - RNA, 19 nt, Homo sapiens
caaguaauuucagauagug

SEQ ID NO: 1132049 - RNA, 19 nt, Homo sapiens
gcccagaagcuucaguaua

SEQ ID NO: 1132050 - RNA, 19 nt, Homo sapiens
uaucgucuaugucuucuug

SEQ ID NO: 1132051 - RNA, 19 nt, Homo sapiens
cauacauuguguuugguua

SEQ ID NO: 1132052 - RNA, 19 nt, Homo sapiens
guaguaggauuugccaaga

SEQ ID NO: 1132053 - RNA, 19 nt, Homo sapiens
aaacugcgauauugaucuu

SEQ ID NO: 1132054 - RNA, 19 nt, Homo sapiens
uuccaaaggucauacauug

SEQ ID NO: 1132055 - RNA, 19 nt, Homo sapiens
cauuugcuguuucuuguuu

SEQ ID NO: 1132056 - RNA, 19 nt, Homo sapiens
uugaagagcuacacauugu

SEQ ID NO: 1132057 - RNA, 19 nt, Homo sapiens
gaaaugcuacaacugugaa

SEQ ID NO: 1132058 - RNA, 19 nt, Homo sapiens
ccaccucagugaaaugcua

SEQ ID NO: 1132059 - RNA, 19 nt, Homo sapiens
gcaccaauaucaacuucag

SEQ ID NO: 1132060 - RNA, 19 nt, Homo sapiens
gcuaugagacagcaaguug

SEQ ID NO: 1132061 - RNA, 19 nt, Homo sapiens
gcagucgccagucaacaua

SEQ ID NO: 1132062 - RNA, 19 nt, Homo sapiens
gcagccagaucucacaaag

SEQ ID NO: 1132063 - RNA, 19 nt, Homo sapiens
ugagauagcaggcgacaga

SEQ ID NO: 1132064 - RNA, 19 nt, Homo sapiens
gacagacauugaagagcua

SEQ ID NO: 1132065 - RNA, 19 nt, Homo sapiens
ccaguuaaccugauuucaa

SEQ ID NO: 1132066 - RNA, 19 nt, Homo sapiens
caugggaagucaaguuuca

SEQ ID NO: 1132067 - RNA, 19 nt, Homo sapiens
cgaaugcucaacagagaua

SEQ ID NO: 1132068 - RNA, 19 nt, Homo sapiens
ccaaagaggagaagaacug

SEQ ID NO: 1132069 - RNA, 19 nt, Homo sapiens
auacaucucucacacauac

SEQ ID NO: 1132070 - RNA, 19 nt, Homo sapiens
aagcuucaguauagaguaa

SEQ ID NO: 1132071 - RNA, 19 nt, Homo sapiens
gcauaucagcucaacagaa

SEQ ID NO: 1132072 - RNA, 19 nt, Homo sapiens
cuccauggcucaaucauuc

SEQ ID NO: 1132073 - RNA, 19 nt, Homo sapiens
caaaggucauacauugugu

SEQ ID NO: 1132074 - RNA, 19 nt, Homo sapiens
aaacggacuuugcaucaag

SEQ ID NO: 1132075 - RNA, 19 nt, Homo sapiens
gagaaucagaggauggaaa

SEQ ID NO: 1132076 - RNA, 19 nt, Homo sapiens
uuacugaguuuguggcaau

SEQ ID NO: 1132077 - RNA, 19 nt, Homo sapiens
aaacggcagucgccaguca

SEQ ID NO: 1132078 - RNA, 19 nt, Homo sapiens
ccaaaggucauacauugug

SEQ ID NO: 1132079 - RNA, 19 nt, Homo sapiens
gggauuggcccuuucuuca

SEQ ID NO: 1132080 - RNA, 19 nt, Homo sapiens
gugcagcucauccacuaua

SEQ ID NO: 1132081 - RNA, 19 nt, Homo sapiens
ucacacauacucacaaaca

SEQ ID NO: 1132082 - RNA, 19 nt, Homo sapiens
ucucacacauacucacaaa

SEQ ID NO: 1132083 - RNA, 19 nt, Homo sapiens
ucccuccucuucuucaaua

SEQ ID NO: 1132084 - RNA, 19 nt, Homo sapiens
caugagcuauauacgaaug

SEQ ID NO: 1132085 - RNA, 19 nt, Homo sapiens
accaugagcuauauacgaa

SEQ ID NO: 1132086 - RNA, 19 nt, Homo sapiens
gauagcaggcgacagacuu

SEQ ID NO: 1132087 - RNA, 19 nt, Homo sapiens
caauucaaacugcgauauu

SEQ ID NO: 1132088 - RNA, 19 nt, Homo sapiens
gaccaaggacacuuauuuc

SEQ ID NO: 1132089 - RNA, 19 nt, Homo sapiens
caaauggauuggugguagu

SEQ ID NO: 1132090 - RNA, 19 nt, Homo sapiens
gagauccgacuacacuuug

SEQ ID NO: 1132091 - RNA, 19 nt, Homo sapiens
gaggagauccgacuacacu

SEQ ID NO: 1132092 - RNA, 19 nt, Homo sapiens
gaaucccaccucagugaaa

SEQ ID NO: 1132093 - RNA, 19 nt, Homo sapiens
gagcccagaagcuucagua

SEQ ID NO: 1132094 - RNA, 19 nt, Homo sapiens
gcuuuggucuguucuccuu

SEQ ID NO: 1132095 - RNA, 19 nt, Homo sapiens
ccacagacuauaaggaaau

SEQ ID NO: 1132096 - RNA, 19 nt, Homo sapiens
gaagcuucaguauagagua

SEQ ID NO: 1132097 - RNA, 19 nt, Homo sapiens
gauuggugguaguuucuau

SEQ ID NO: 1132098 - RNA, 19 nt, Homo sapiens
cuggagggcccaugacaua

SEQ ID NO: 1132099 - RNA, 19 nt, Homo sapiens
gcacuuggucaacauaucu

SEQ ID NO: 1132100 - RNA, 19 nt, Homo sapiens
caaagggacuguauuucuu

SEQ ID NO: 1132101 - RNA, 19 nt, Homo sapiens
caagucaccuguacuggaa

SEQ ID NO: 1132102 - RNA, 19 nt, Homo sapiens
gaaugugccauacaccuua

SEQ ID NO: 1132103 - RNA, 19 nt, Homo sapiens
auaaguagcuccaccugaa

SEQ ID NO: 1132104 - RNA, 19 nt, Homo sapiens
ugucuucucuggucuuuga

SEQ ID NO: 1132105 - RNA, 19 nt, Homo sapiens
uaacucaagucaccuguac

SEQ ID NO: 1132106 - RNA, 19 nt, Homo sapiens
gggaauaggggauguuuua

SEQ ID NO: 1132107 - RNA, 19 nt, Homo sapiens
auucagagauguucauguu

SEQ ID NO: 1132108 - RNA, 19 nt, Homo sapiens
ggaucaugcuucuuuccaa

SEQ ID NO: 1132109 - RNA, 19 nt, Homo sapiens
ggacacacccuccuagcau

SEQ ID NO: 1132110 - RNA, 19 nt, Homo sapiens
gcaggaauaacucaaguca

SEQ ID NO: 1132111 - RNA, 19 nt, Homo sapiens
ggagcacccugucuucucu

SEQ ID NO: 1132112 - RNA, 19 nt, Homo sapiens
gaauaaaggagauaauagc

SEQ ID NO: 1132113 - RNA, 19 nt, Homo sapiens
ucaaagggaagcccaagaa

SEQ ID NO: 1132114 - RNA, 19 nt, Homo sapiens
ccaaagggacuguauuucu

SEQ ID NO: 1132115 - RNA, 19 nt, Homo sapiens
gaaagaugcggcagcucaa

SEQ ID NO: 1132116 - RNA, 19 nt, Homo sapiens
aauccacacucaccucauu

SEQ ID NO: 1132117 - RNA, 19 nt, Homo sapiens
ucauguugcugagcuguaa

SEQ ID NO: 1132118 - RNA, 19 nt, Homo sapiens
gcuuucauauucagagaug

SEQ ID NO: 1132119 - RNA, 19 nt, Homo sapiens
gggcaggaauaacucaagu

SEQ ID NO: 1132120 - RNA, 19 nt, Homo sapiens
gaaccucugggucaggaaa

SEQ ID NO: 1132121 - RNA, 19 nt, Homo sapiens
ggcagcagaucacuacagu

SEQ ID NO: 1132122 - RNA, 19 nt, Homo sapiens
ucaugugccuuucagacuu

SEQ ID NO: 1132123 - RNA, 19 nt, Homo sapiens
gacuguauuucuucucugu

SEQ ID NO: 1132124 - RNA, 19 nt, Homo sapiens
ggagauaauagccuuaaaa

SEQ ID NO: 1132125 - RNA, 19 nt, Homo sapiens
guuuggaucaugcuucuuu

SEQ ID NO: 1132126 - RNA, 19 nt, Homo sapiens
gggacuguauuucuucucu

SEQ ID NO: 1132127 - RNA, 19 nt, Homo sapiens
aagggaagcccaagaagga

SEQ ID NO: 1132128 - RNA, 19 nt, Homo sapiens
uaucagugaaugugccaua

SEQ ID NO: 1132129 - RNA, 19 nt, Homo sapiens
ucaccucauucccauuguu

SEQ ID NO: 1132130 - RNA, 19 nt, Homo sapiens
ggucuuugacuugauuaaa

SEQ ID NO: 1132131 - RNA, 19 nt, Homo sapiens
ucucuggucuuugacuuga

SEQ ID NO: 1132132 - RNA, 19 nt, Homo sapiens
cuccaaagggacuguauuu

SEQ ID NO: 1132133 - RNA, 19 nt, Homo sapiens
caugugccuuucagacuuc

SEQ ID NO: 1132134 - RNA, 19 nt, Homo sapiens
ucucugugcuuaaugugau

SEQ ID NO: 1132135 - RNA, 19 nt, Homo sapiens
ucaggaaacagcuggaauc

SEQ ID NO: 1132136 - RNA, 19 nt, Homo sapiens
aauaggggauguuuuauca

SEQ ID NO: 1132137 - RNA, 19 nt, Homo sapiens
ucuggucuuugacuugauu

SEQ ID NO: 1132138 - RNA, 19 nt, Homo sapiens
gugcuuaaugugauuugaa

SEQ ID NO: 1132139 - RNA, 19 nt, Homo sapiens
ggggauguuuuaucaguga

SEQ ID NO: 1132140 - RNA, 19 nt, Homo sapiens
aaguaucuccgcuuucuug

SEQ ID NO: 1132141 - RNA, 19 nt, Homo sapiens
uggaaucccucuggacaca

SEQ ID NO: 1132142 - RNA, 19 nt, Homo sapiens
ugaucgugguguuugugua

SEQ ID NO: 1132143 - RNA, 19 nt, Homo sapiens
caccucauucccauuguuu

SEQ ID NO: 1132144 - RNA, 19 nt, Homo sapiens
ugaaugugccauacaccuu

SEQ ID NO: 1132145 - RNA, 19 nt, Homo sapiens
caaagggaagcccaagaag

SEQ ID NO: 1132146 - RNA, 19 nt, Homo sapiens
gaucgugguguuuguguac

SEQ ID NO: 1132147 - RNA, 19 nt, Homo sapiens
gcucuugaucgugguguuu

SEQ ID NO: 1132148 - RNA, 19 nt, Homo sapiens
uauuucuucucugugcuua

SEQ ID NO: 1132149 - RNA, 19 nt, Homo sapiens
aaagggacuguauuucuuc

SEQ ID NO: 1132150 - RNA, 19 nt, Homo sapiens
caagaaggagcggaagcaa

SEQ ID NO: 1132151 - RNA, 19 nt, Homo sapiens
uuucuucucugugcuuaau

SEQ ID NO: 1132152 - RNA, 19 nt, Homo sapiens
gaauauggcucccuagugu

SEQ ID NO: 1132153 - RNA, 19 nt, Homo sapiens
guggacagauggucauuua

SEQ ID NO: 1132154 - RNA, 19 nt, Homo sapiens
caaggaaggugggaaguaa

SEQ ID NO: 1132155 - RNA, 19 nt, Homo sapiens
ggaauugccuuuguugaga

SEQ ID NO: 1132156 - RNA, 19 nt, Homo sapiens
gaaggaaucaucucuacuu

SEQ ID NO: 1132157 - RNA, 19 nt, Homo sapiens
agacagcagucaugccuua

SEQ ID NO: 1132158 - RNA, 19 nt, Homo sapiens
gugaugcuguuuagcuuua

SEQ ID NO: 1132159 - RNA, 19 nt, Homo sapiens
ggaaucaucucuacuucuc

SEQ ID NO: 1132160 - RNA, 19 nt, Homo sapiens
aaaccaggaucaggaauaa

SEQ ID NO: 1132161 - RNA, 19 nt, Homo sapiens
gcaguguuccauuccauua

SEQ ID NO: 1132162 - RNA, 19 nt, Homo sapiens
gagcuggaauugccuuugu

SEQ ID NO: 1132163 - RNA, 19 nt, Homo sapiens
ccagagaguuuggagugua

SEQ ID NO: 1132164 - RNA, 19 nt, Homo sapiens
caccaugucaguauuauuu

SEQ ID NO: 1132165 - RNA, 19 nt, Homo sapiens
gagcaaauucucaccaguu

SEQ ID NO: 1132166 - RNA, 19 nt, Homo sapiens
caaagcaccaugucaguau

SEQ ID NO: 1132167 - RNA, 19 nt, Homo sapiens
ugaaauacuugcaauacca

SEQ ID NO: 1132168 - RNA, 19 nt, Homo sapiens
caaauucucaccaguuaug

SEQ ID NO: 1132169 - RNA, 19 nt, Homo sapiens
agcaaauucucaccaguua

SEQ ID NO: 1132170 - RNA, 19 nt, Homo sapiens
uaaaccaggaucaggaaua

SEQ ID NO: 1132171 - RNA, 19 nt, Homo sapiens
caggcaacuuuaacccuua

SEQ ID NO: 1132172 - RNA, 19 nt, Homo sapiens
cagcagucaugccuuaaga

SEQ ID NO: 1132173 - RNA, 19 nt, Homo sapiens
acaggaaauugguugguuu

SEQ ID NO: 1132174 - RNA, 19 nt, Homo sapiens
ggaaauugguugguuuggu

SEQ ID NO: 1132175 - RNA, 19 nt, Homo sapiens
ggccauauccacccauuga

SEQ ID NO: 1132176 - RNA, 19 nt, Homo sapiens
ggaauauggcucccuagug

SEQ ID NO: 1132177 - RNA, 19 nt, Homo sapiens
caguauuccucuccuggua

SEQ ID NO: 1132178 - RNA, 19 nt, Homo sapiens
agaguuguguucacuauca

SEQ ID NO: 1132179 - RNA, 19 nt, Homo sapiens
ugagaguuguguucacuau

SEQ ID NO: 1132180 - RNA, 19 nt, Homo sapiens
ccaaguggcacaggaaauu

SEQ ID NO: 1132181 - RNA, 19 nt, Homo sapiens
aagcagagcuaccuuacgu

SEQ ID NO: 1132182 - RNA, 19 nt, Homo sapiens
ccaaagcaccaugucagua

SEQ ID NO: 1132183 - RNA, 19 nt, Homo sapiens
gugaaggaaucaucucuac

SEQ ID NO: 1132184 - RNA, 19 nt, Homo sapiens
gugcuucccuuccauuaag

SEQ ID NO: 1132185 - RNA, 19 nt, Homo sapiens
cuacuucucugaggacaau

SEQ ID NO: 1132186 - RNA, 19 nt, Homo sapiens
ggagagggcagaggugguu

SEQ ID NO: 1132187 - RNA, 19 nt, Homo sapiens
gagcaguguuccauuccau

SEQ ID NO: 1132188 - RNA, 19 nt, Homo sapiens
agucaugccuuaagaagca

SEQ ID NO: 1132189 - RNA, 19 nt, Homo sapiens
ggacagauggucauuuagc

SEQ ID NO: 1132190 - RNA, 19 nt, Homo sapiens
aaagcaccaugucaguauu

SEQ ID NO: 1132191 - RNA, 19 nt, Homo sapiens
ggguauccuuggcugcuuu

SEQ ID NO: 1132192 - RNA, 19 nt, Homo sapiens
gagugcuucccuuccauua

SEQ ID NO: 1132193 - RNA, 19 nt, Homo sapiens
ggacaauuaggguauccuu

SEQ ID NO: 1132194 - RNA, 19 nt, Homo sapiens
ucaaggaaggugggaagua

SEQ ID NO: 1132195 - RNA, 19 nt, Homo sapiens
cacaggaaauugguugguu

SEQ ID NO: 1132196 - RNA, 19 nt, Homo sapiens
cagagaguuuggaguguag

SEQ ID NO: 1132197 - RNA, 19 nt, Homo sapiens
aagaagcagagcuaccuua

SEQ ID NO: 1132198 - RNA, 19 nt, Homo sapiens
ucaagccacgcccaaauga

SEQ ID NO: 1132199 - RNA, 19 nt, Homo sapiens
gcagucaugccuuaagaag

SEQ ID NO: 1132200 - RNA, 19 nt, Homo sapiens
ccaugucaguauuauuugu

SEQ ID NO: 1132201 - RNA, 19 nt, Homo sapiens
uuacugugguggccgaaga

SEQ ID NO: 1132202 - RNA, 19 nt, Homo sapiens
cauugacucugccuucauc

SEQ ID NO: 1132203 - RNA, 19 nt, Homo sapiens
uggcucaccuccaucuuuc

SEQ ID NO: 1132204 - RNA, 19 nt, Homo sapiens
ggugaaauacuugcaauac

SEQ ID NO: 1132205 - RNA, 19 nt, Homo sapiens
cugcagauaauguucaauu

SEQ ID NO: 1132206 - RNA, 19 nt, Homo sapiens
ugucaucaggcaacuuuaa

SEQ ID NO: 1132207 - RNA, 19 nt, Homo sapiens
caaaaggucacauucaguu

SEQ ID NO: 1132208 - RNA, 19 nt, Homo sapiens
gggugaaauacuugcaaua

SEQ ID NO: 1132209 - RNA, 19 nt, Homo sapiens
gcaccaugucaguauuauu

SEQ ID NO: 1132210 - RNA, 19 nt, Homo sapiens
aagcaccaugucaguauua

SEQ ID NO: 1132211 - RNA, 19 nt, Homo sapiens
gauccaaagcaccauguca

SEQ ID NO: 1132212 - RNA, 19 nt, Homo sapiens
gcaaauucucaccaguuau

SEQ ID NO: 1132213 - RNA, 19 nt, Homo sapiens
caacuuuaacccuuagagu

SEQ ID NO: 1132214 - RNA, 19 nt, Homo sapiens
ggccgaagagcuggaauug

SEQ ID NO: 1132215 - RNA, 19 nt, Homo sapiens
gaguuuggaguguaggauu

SEQ ID NO: 1132216 - RNA, 19 nt, Homo sapiens
ggagcaguguuccauucca

SEQ ID NO: 1132217 - RNA, 19 nt, Homo sapiens
ugggagcaguguuccauuc

SEQ ID NO: 1132218 - RNA, 19 nt, Homo sapiens
gaugcuguuuagcuuuaau

SEQ ID NO: 1132219 - RNA, 19 nt, Homo sapiens
aaggaaucaucucuacuuc

SEQ ID NO: 1132220 - RNA, 19 nt, Homo sapiens
ggugaugcuguuuagcuuu

SEQ ID NO: 1132221 - RNA, 19 nt, Homo sapiens
gguuuggugaugcuguuua

SEQ ID NO: 1132222 - RNA, 19 nt, Homo sapiens
gcuggaauugccuuuguug

SEQ ID NO: 1132223 - RNA, 19 nt, Homo sapiens
guaggauucccucugugaa

SEQ ID NO: 1132224 - RNA, 19 nt, Homo sapiens
gcucaccuccaucuuucaa

SEQ ID NO: 1132225 - RNA, 19 nt, Homo sapiens
caaguggcacaggaaauug

SEQ ID NO: 1132226 - RNA, 19 nt, Homo sapiens
auggcaagcugcacaaauc

SEQ ID NO: 1132227 - RNA, 19 nt, Homo sapiens
uuagagugcuucccuucca

SEQ ID NO: 1132228 - RNA, 19 nt, Homo sapiens
uaguuucuuucugggaaua

SEQ ID NO: 1132229 - RNA, 19 nt, Homo sapiens
gguauccuuggcugcuuua

SEQ ID NO: 1132230 - RNA, 19 nt, Homo sapiens
ucucaccaguuaugauagu

SEQ ID NO: 1132231 - RNA, 19 nt, Homo sapiens
ucaccaguuaugauaguuu

SEQ ID NO: 1132232 - RNA, 19 nt, Homo sapiens
ccucaccuaugccugaaag

SEQ ID NO: 1132233 - RNA, 19 nt, Homo sapiens
aguguaggauucccucugu

SEQ ID NO: 1132234 - RNA, 19 nt, Homo sapiens
auucucaccaguuaugaua

SEQ ID NO: 1132235 - RNA, 19 nt, Homo sapiens
gcuguuuagcuuuaauaga

SEQ ID NO: 1132236 - RNA, 19 nt, Homo sapiens
caggaaauugguugguuug

SEQ ID NO: 1132237 - RNA, 19 nt, Homo sapiens
ucaccuccaucuuucaaaa

SEQ ID NO: 1132238 - RNA, 19 nt, Homo sapiens
aaaggucacauucaguugu

SEQ ID NO: 1132239 - RNA, 19 nt, Homo sapiens
gugaaauacuugcaauacc

SEQ ID NO: 1132240 - RNA, 19 nt, Homo sapiens
ccccuuaaauuuccuggua

SEQ ID NO: 1132241 - RNA, 19 nt, Homo sapiens
guugagaguuguguucacu

SEQ ID NO: 1132242 - RNA, 19 nt, Homo sapiens
ucucaaugccucaccuuuc

SEQ ID NO: 1132243 - RNA, 19 nt, Homo sapiens
uguaggauucccucuguga

SEQ ID NO: 1132244 - RNA, 19 nt, Homo sapiens
gucaagccacgcccaaaug

SEQ ID NO: 1132245 - RNA, 19 nt, Homo sapiens
cacccuggcucaccuccau

SEQ ID NO: 1132246 - RNA, 19 nt, Homo sapiens
ggcuguuccugccuaaauc

SEQ ID NO: 1132247 - RNA, 19 nt, Homo sapiens
gccuuaagaagcagagcua

SEQ ID NO: 1132248 - RNA, 19 nt, Homo sapiens
guuuggugaugcuguuuag

SEQ ID NO: 1132249 - RNA, 19 nt, Homo sapiens
gcacaggaaauugguuggu

SEQ ID NO: 1132250 - RNA, 19 nt, Homo sapiens
gaucaauucucacuuaaga

SEQ ID NO: 1132251 - RNA, 19 nt, Homo sapiens
gcagaaugcugacuaguag

SEQ ID NO: 1132252 - RNA, 19 nt, Homo sapiens
gaacagccuuuaaaucaca

SEQ ID NO: 1132253 - RNA, 19 nt, Homo sapiens
ggaaacugcuugaaaucuu

SEQ ID NO: 1132254 - RNA, 19 nt, Homo sapiens
gcaaagagaaggauaaaca

SEQ ID NO: 1132255 - RNA, 19 nt, Homo sapiens
gaaacugcuugaaaucuug

SEQ ID NO: 1132256 - RNA, 19 nt, Homo sapiens
ucacggagcuggaguuugu

SEQ ID NO: 1132257 - RNA, 19 nt, Homo sapiens
guaagacucuguauuugga

SEQ ID NO: 1132258 - RNA, 19 nt, Homo sapiens
gauggaaacuucucuugug

SEQ ID NO: 1132259 - RNA, 19 nt, Homo sapiens
gaacacuccgcgcuucuua

SEQ ID NO: 1132260 - RNA, 19 nt, Homo sapiens
gaaacugcuuguuguguau

SEQ ID NO: 1132261 - RNA, 19 nt, Homo sapiens
gaaccugccucuccgugaa

SEQ ID NO: 1132262 - RNA, 19 nt, Homo sapiens
acaguagucuuucuuguuu

SEQ ID NO: 1132263 - RNA, 19 nt, Homo sapiens
gaaagaaaaugucguuguu

SEQ ID NO: 1132264 - RNA, 19 nt, Homo sapiens
ugaagaaacugcuuguugu

SEQ ID NO: 1132265 - RNA, 19 nt, Homo sapiens
gcacuuguaaagaugauua

SEQ ID NO: 1132266 - RNA, 19 nt, Homo sapiens
cagaacagccuuuaaauca

SEQ ID NO: 1132267 - RNA, 19 nt, Homo sapiens
aaacaacgcuucccuucug

SEQ ID NO: 1132268 - RNA, 19 nt, Homo sapiens
aaacuucucuugugucugu

SEQ ID NO: 1132269 - RNA, 19 nt, Homo sapiens
gaaaggacacccucucuag

SEQ ID NO: 1132270 - RNA, 19 nt, Homo sapiens
guacacgacucccaucuag

SEQ ID NO: 1132271 - RNA, 19 nt, Homo sapiens
ccagagggcucgaugacuu

SEQ ID NO: 1132272 - RNA, 19 nt, Homo sapiens
ggacgcacuuguaaagaug

SEQ ID NO: 1132273 - RNA, 19 nt, Homo sapiens
gauaagagaaacuguaugu

SEQ ID NO: 1132274 - RNA, 19 nt, Homo sapiens
ggaauggcuuugcgugaga

SEQ ID NO: 1132275 - RNA, 19 nt, Homo sapiens
gcagggcgcuuuggugguu

SEQ ID NO: 1132276 - RNA, 19 nt, Homo sapiens
agaaacugcuuguugugua

SEQ ID NO: 1132277 - RNA, 19 nt, Homo sapiens
ccacaggccugaagaaacu

SEQ ID NO: 1132278 - RNA, 19 nt, Homo sapiens
caagcucuguucaaguuaa

SEQ ID NO: 1132279 - RNA, 19 nt, Homo sapiens
ggaaacuucucuugugucu

SEQ ID NO: 1132280 - RNA, 19 nt, Homo sapiens
gaagguggcagcugacaga

SEQ ID NO: 1132281 - RNA, 19 nt, Homo sapiens
agagaaggauaaacagaaa

SEQ ID NO: 1132282 - RNA, 19 nt, Homo sapiens
gaaaucuugcuguacuaua

SEQ ID NO: 1132283 - RNA, 19 nt, Homo sapiens
gguauggucuggauuugug

SEQ ID NO: 1132284 - RNA, 19 nt, Homo sapiens
ucacuuaagaggccaauaa

SEQ ID NO: 1132285 - RNA, 19 nt, Homo sapiens
gaaccaucuucgacaguga

SEQ ID NO: 1132286 - RNA, 19 nt, Homo sapiens
gggaguggcuuuccauuuu

SEQ ID NO: 1132287 - RNA, 19 nt, Homo sapiens
gcgcagaauucuucaccuu

SEQ ID NO: 1132288 - RNA, 19 nt, Homo sapiens
uaaacaacccaacaugaaa

SEQ ID NO: 1132289 - RNA, 19 nt, Homo sapiens
acggaucaauucucacuua

SEQ ID NO: 1132290 - RNA, 19 nt, Homo sapiens
agucagaaaguguguauua

SEQ ID NO: 1132291 - RNA, 19 nt, Homo sapiens
gagaaaucaguacagguua

SEQ ID NO: 1132292 - RNA, 19 nt, Homo sapiens
guaaagcaguugagcaaac

SEQ ID NO: 1132293 - RNA, 19 nt, Homo sapiens
gacagugaccugauggaua

SEQ ID NO: 1132294 - RNA, 19 nt, Homo sapiens
cccaagcucuguucaaguu

SEQ ID NO: 1132295 - RNA, 19 nt, Homo sapiens
gcuaagaaccguccguguu

SEQ ID NO: 1132296 - RNA, 19 nt, Homo sapiens
acagugaccugauggauag

SEQ ID NO: 1132297 - RNA, 19 nt, Homo sapiens
ggagcaaagagaaggauaa

SEQ ID NO: 1132298 - RNA, 19 nt, Homo sapiens
cauauccucuugagccaaa

SEQ ID NO: 1132299 - RNA, 19 nt, Homo sapiens
ccagggaggugccuagcuu

SEQ ID NO: 1132300 - RNA, 19 nt, Homo sapiens
cagguuaucccgaaaggua

SEQ ID NO: 1132301 - RNA, 19 nt, Homo sapiens
ggcagaaugcugacuagua

SEQ ID NO: 1132302 - RNA, 19 nt, Homo sapiens
gaaaagggaccccauaugu

SEQ ID NO: 1132303 - RNA, 19 nt, Homo sapiens
gaguaaagcaguugagcaa

SEQ ID NO: 1132304 - RNA, 19 nt, Homo sapiens
guuaucaccacguuauaua

SEQ ID NO: 1132305 - RNA, 19 nt, Homo sapiens
uauuagaagaggccuauua

SEQ ID NO: 1132306 - RNA, 19 nt, Homo sapiens
gaagaaacugcuuguugug

SEQ ID NO: 1132307 - RNA, 19 nt, Homo sapiens
gcguaagacucuguauuug

SEQ ID NO: 1132308 - RNA, 19 nt, Homo sapiens
gaagcuuccagaaccauaa

SEQ ID NO: 1132309 - RNA, 19 nt, Homo sapiens
ccaccucccuguguauaaa

SEQ ID NO: 1132310 - RNA, 19 nt, Homo sapiens
gagcaaagagaaggauaaa

SEQ ID NO: 1132311 - RNA, 19 nt, Homo sapiens
gcaccgaguuccagguagu

SEQ ID NO: 1132312 - RNA, 19 nt, Homo sapiens
gagcuggaguuuguucaga

SEQ ID NO: 1132313 - RNA, 19 nt, Homo sapiens
gcagccaucuggagcaaag

SEQ ID NO: 1132314 - RNA, 19 nt, Homo sapiens
guugucacguuaucuuuga

SEQ ID NO: 1132315 - RNA, 19 nt, Homo sapiens
uaaagcaguugagcaaaca

SEQ ID NO: 1132316 - RNA, 19 nt, Homo sapiens
gaaggcaggugcgguaacu

SEQ ID NO: 1132317 - RNA, 19 nt, Homo sapiens
ggaugcuucugccuaguga

SEQ ID NO: 1132318 - RNA, 19 nt, Homo sapiens
ugucagugcuugcuugaug

SEQ ID NO: 1132319 - RNA, 19 nt, Homo sapiens
aagcagggguuuagaguua

SEQ ID NO: 1132320 - RNA, 19 nt, Homo sapiens
ucuggaaacugcuugaaau

SEQ ID NO: 1132321 - RNA, 19 nt, Homo sapiens
ucuagugccuuacugaaga

SEQ ID NO: 1132322 - RNA, 19 nt, Homo sapiens
agaaaucaguacagguuau

SEQ ID NO: 1132323 - RNA, 19 nt, Homo sapiens
gcuggagcuugacgucuuu

SEQ ID NO: 1132324 - RNA, 19 nt, Homo sapiens
gagccugucccucucauga

SEQ ID NO: 1132325 - RNA, 19 nt, Homo sapiens
ugaaacgugugcuuuacga

SEQ ID NO: 1132326 - RNA, 19 nt, Homo sapiens
uauauucccuaccgaagga

SEQ ID NO: 1132327 - RNA, 19 nt, Homo sapiens
agggagaaaugucggaauu

SEQ ID NO: 1132328 - RNA, 19 nt, Homo sapiens
aaaucuugcuguacuauag

SEQ ID NO: 1132329 - RNA, 19 nt, Homo sapiens
gaccuccuccugucuguuu

SEQ ID NO: 1132330 - RNA, 19 nt, Homo sapiens
aagaugcccuguccucaga

SEQ ID NO: 1132331 - RNA, 19 nt, Homo sapiens
aaaauuaucuccccugcaa

SEQ ID NO: 1132332 - RNA, 19 nt, Homo sapiens
agagaaaucaguacagguu

SEQ ID NO: 1132333 - RNA, 19 nt, Homo sapiens
gcaugccgccagccuagua

SEQ ID NO: 1132334 - RNA, 19 nt, Homo sapiens
gggcaugugagcguaaaua

SEQ ID NO: 1132335 - RNA, 19 nt, Homo sapiens
caauaaacaacccaacaug

SEQ ID NO: 1132336 - RNA, 19 nt, Homo sapiens
cggaucaauucucacuuaa

SEQ ID NO: 1132337 - RNA, 19 nt, Homo sapiens
cugcgugcgugaaugcuua

SEQ ID NO: 1132338 - RNA, 19 nt, Homo sapiens
caugugaugucuggucuga

SEQ ID NO: 1132339 - RNA, 19 nt, Homo sapiens
aaaugucguuguuguuguu

SEQ ID NO: 1132340 - RNA, 19 nt, Homo sapiens
gaaggccgagcguggcuuu

SEQ ID NO: 1132341 - RNA, 19 nt, Homo sapiens
acgcgucucuagugccuua

SEQ ID NO: 1132342 - RNA, 19 nt, Homo sapiens
gaaacaacgcuucccuucu

SEQ ID NO: 1132343 - RNA, 19 nt, Homo sapiens
auaaacaacccaacaugaa

SEQ ID NO: 1132344 - RNA, 19 nt, Homo sapiens
ugugaugucuggucugaau

SEQ ID NO: 1132345 - RNA, 19 nt, Homo sapiens
cugaaaagcugcaauacuu

SEQ ID NO: 1132346 - RNA, 19 nt, Homo sapiens
gaaaaugucguuguuguug

SEQ ID NO: 1132347 - RNA, 19 nt, Homo sapiens
gaauuguacguuucagaga

SEQ ID NO: 1132348 - RNA, 19 nt, Homo sapiens
ggaaacgaccagaguuaag

SEQ ID NO: 1132349 - RNA, 19 nt, Homo sapiens
ucauuuacaucucucuuag

SEQ ID NO: 1132350 - RNA, 19 nt, Homo sapiens
gaacagauauugcaaauga

SEQ ID NO: 1132351 - RNA, 19 nt, Homo sapiens
gcacagagcugggauauuu

SEQ ID NO: 1132352 - RNA, 19 nt, Homo sapiens
gcagauagccaguugaaua

SEQ ID NO: 1132353 - RNA, 19 nt, Homo sapiens
gcaaaggccucaugaccua

SEQ ID NO: 1132354 - RNA, 19 nt, Homo sapiens
gaaagauacucauacugua

SEQ ID NO: 1132355 - RNA, 19 nt, Homo sapiens
gaccaaaguuuauaccaua

SEQ ID NO: 1132356 - RNA, 19 nt, Homo sapiens
gcaggaguaugucaaauaa

SEQ ID NO: 1132357 - RNA, 19 nt, Homo sapiens
ggaagauccugacacauaa

SEQ ID NO: 1132358 - RNA, 19 nt, Homo sapiens
gagcagcgcuguccaauag

SEQ ID NO: 1132359 - RNA, 19 nt, Homo sapiens
aaacugaccuggaaagaaa

SEQ ID NO: 1132360 - RNA, 19 nt, Homo sapiens
uaagugagaugauuucuug

SEQ ID NO: 1132361 - RNA, 19 nt, Homo sapiens
ggauuaaccucugcauaua

SEQ ID NO: 1132362 - RNA, 19 nt, Homo sapiens
gaagaacugucugcaauga

SEQ ID NO: 1132363 - RNA, 19 nt, Homo sapiens
ccaaagaaauccuacaaga

SEQ ID NO: 1132364 - RNA, 19 nt, Homo sapiens
gacaucagguuuagaauga

SEQ ID NO: 1132365 - RNA, 19 nt, Homo sapiens
ucagugaaauggcuuauaa

SEQ ID NO: 1132366 - RNA, 19 nt, Homo sapiens
ugaauaaccugauugaaga

SEQ ID NO: 1132367 - RNA, 19 nt, Homo sapiens
gagaugauuucuugcuuaa

SEQ ID NO: 1132368 - RNA, 19 nt, Homo sapiens
aaucagagcuggaaguaaa

SEQ ID NO: 1132369 - RNA, 19 nt, Homo sapiens
ggaaacauacuuagggaua

SEQ ID NO: 1132370 - RNA, 19 nt, Homo sapiens
caucauuucuucaggauaa

SEQ ID NO: 1132371 - RNA, 19 nt, Homo sapiens
ugaaguagaccaaaguuua

SEQ ID NO: 1132372 - RNA, 19 nt, Homo sapiens
gaucaaaccuccuuuuaaa

SEQ ID NO: 1132373 - RNA, 19 nt, Homo sapiens
gugaguacuugaacauuua

SEQ ID NO: 1132374 - RNA, 19 nt, Homo sapiens
cgacaucuaugauuagcua

SEQ ID NO: 1132375 - RNA, 19 nt, Homo sapiens
uagcacaucucacuuugua

SEQ ID NO: 1132376 - RNA, 19 nt, Homo sapiens
ggauagggcuuacacacuu

SEQ ID NO: 1132377 - RNA, 19 nt, Homo sapiens
caagggaggucuaggaaga

SEQ ID NO: 1132378 - RNA, 19 nt, Homo sapiens
gaagaaaggaacaguaaga

SEQ ID NO: 1132379 - RNA, 19 nt, Homo sapiens
gcucauagccaaacugaaa

SEQ ID NO: 1132380 - RNA, 19 nt, Homo sapiens
ugagaggcauuuaugauuu

SEQ ID NO: 1132381 - RNA, 19 nt, Homo sapiens
gaagaauccucuagacagu

SEQ ID NO: 1132382 - RNA, 19 nt, Homo sapiens
gaagcuggccuccaaauau

SEQ ID NO: 1132383 - RNA, 19 nt, Homo sapiens
ucacugaagaucucuauua

SEQ ID NO: 1132384 - RNA, 19 nt, Homo sapiens
gcucagacauuuaauccuu

SEQ ID NO: 1132385 - RNA, 19 nt, Homo sapiens
caacagguuuaaugaaaga

SEQ ID NO: 1132386 - RNA, 19 nt, Homo sapiens
caacagcgauuuuaggaua

SEQ ID NO: 1132387 - RNA, 19 nt, Homo sapiens
gaagauuacagccauauau

SEQ ID NO: 1132388 - RNA, 19 nt, Homo sapiens
gaaaggaacaguaagaaag

SEQ ID NO: 1132389 - RNA, 19 nt, Homo sapiens
gaagaagaaaggaacagua

SEQ ID NO: 1132390 - RNA, 19 nt, Homo sapiens
gagaguguaugguguaugu

SEQ ID NO: 1132391 - RNA, 19 nt, Homo sapiens
gaacaugcuuucugaacuc

SEQ ID NO: 1132392 - RNA, 19 nt, Homo sapiens
gagguaaaguguugagaga

SEQ ID NO: 1132393 - RNA, 19 nt, Homo sapiens
gcuagaagccauaaagaaa

SEQ ID NO: 1132394 - RNA, 19 nt, Homo sapiens
ggaugucuuuguugucaua

SEQ ID NO: 1132395 - RNA, 19 nt, Homo sapiens
ggaaucaagugaaaugagu

SEQ ID NO: 1132396 - RNA, 19 nt, Homo sapiens
ggaacuaguuguagcuuuc

SEQ ID NO: 1132397 - RNA, 19 nt, Homo sapiens
ugagaugauuucuugcuua

SEQ ID NO: 1132398 - RNA, 19 nt, Homo sapiens
guugagcacuuuaagauga

SEQ ID NO: 1132399 - RNA, 19 nt, Homo sapiens
caagaugaccacaauaauu

SEQ ID NO: 1132400 - RNA, 19 nt, Homo sapiens
gcaaauguuuccuucaagu

SEQ ID NO: 1132401 - RNA, 19 nt, Homo sapiens
acauuggucucacagauua

SEQ ID NO: 1132402 - RNA, 19 nt, Homo sapiens
aggaacaacuuucuucuuu

SEQ ID NO: 1132403 - RNA, 19 nt, Homo sapiens
caacuauucuuaaguacug

SEQ ID NO: 1132404 - RNA, 19 nt, Homo sapiens
ggauuucgaugcccuaugu

SEQ ID NO: 1132405 - RNA, 19 nt, Homo sapiens
guaagaaagacaacaguaa

SEQ ID NO: 1132406 - RNA, 19 nt, Homo sapiens
gaaguagaccaaaguuuau

SEQ ID NO: 1132407 - RNA, 19 nt, Homo sapiens
gauagcacaucucacuuug

SEQ ID NO: 1132408 - RNA, 19 nt, Homo sapiens
ugacaaacauaccaacaga

SEQ ID NO: 1132409 - RNA, 19 nt, Homo sapiens
ggugauagauuagaacuuc

SEQ ID NO: 1132410 - RNA, 19 nt, Homo sapiens
ggauagauuuguccuaaag

SEQ ID NO: 1132411 - RNA, 19 nt, Homo sapiens
ugaaauggcuuauaaucca

SEQ ID NO: 1132412 - RNA, 19 nt, Homo sapiens
gcacaaagcaguucuacag

SEQ ID NO: 1132413 - RNA, 19 nt, Homo sapiens
gcacgaaaguaucauaaaa

SEQ ID NO: 1132414 - RNA, 19 nt, Homo sapiens
aguuguagcuuucuaagua

SEQ ID NO: 1132415 - RNA, 19 nt, Homo sapiens
gaacaacuuucuucuuuug

SEQ ID NO: 1132416 - RNA, 19 nt, Homo sapiens
guuauauggucaucacuaa

SEQ ID NO: 1132417 - RNA, 19 nt, Homo sapiens
aaagaaauccuacaagaug

SEQ ID NO: 1132418 - RNA, 19 nt, Homo sapiens
ccaguuuccuguucuauau

SEQ ID NO: 1132419 - RNA, 19 nt, Homo sapiens
cagauuaaaugucuugugu

SEQ ID NO: 1132420 - RNA, 19 nt, Homo sapiens
ggauauuuaugcucaguug

SEQ ID NO: 1132421 - RNA, 19 nt, Homo sapiens
gcucacacaugacagaguu

SEQ ID NO: 1132422 - RNA, 19 nt, Homo sapiens
gggauuaaccucugcauau

SEQ ID NO: 1132423 - RNA, 19 nt, Homo sapiens
uggcugcauuuaugaauua

SEQ ID NO: 1132424 - RNA, 19 nt, Homo sapiens
guggagagauuaaugugaa

SEQ ID NO: 1132425 - RNA, 19 nt, Homo sapiens
gugcaugguuugauccuuu

SEQ ID NO: 1132426 - RNA, 19 nt, Homo sapiens
gcaaaugaaauucuggauu

SEQ ID NO: 1132427 - RNA, 19 nt, Homo sapiens
aaacaaagacaaacaggaa

SEQ ID NO: 1132428 - RNA, 19 nt, Homo sapiens
ugagccacauguauaauuu

SEQ ID NO: 1132429 - RNA, 19 nt, Homo sapiens
gcagacaggccgacaucua

SEQ ID NO: 1132430 - RNA, 19 nt, Homo sapiens
gaaguaaacauagagauca

SEQ ID NO: 1132431 - RNA, 19 nt, Homo sapiens
ggacaagaccaacagcuau

SEQ ID NO: 1132432 - RNA, 19 nt, Homo sapiens
cagccuaaguguuauaguu

SEQ ID NO: 1132433 - RNA, 19 nt, Homo sapiens
gauagggcuuacacacuuu

SEQ ID NO: 1132434 - RNA, 19 nt, Homo sapiens
ucacaaauccuuggacaaa

SEQ ID NO: 1132435 - RNA, 19 nt, Homo sapiens
gcucgucuguauauuggua

SEQ ID NO: 1132436 - RNA, 19 nt, Homo sapiens
ggaaaguacagaauagaga

SEQ ID NO: 1132437 - RNA, 19 nt, Homo sapiens
ucaacagggucuucugauu

SEQ ID NO: 1132438 - RNA, 19 nt, Homo sapiens
gcagcgcuguccaauagaa

SEQ ID NO: 1132439 - RNA, 19 nt, Homo sapiens
gaggagaaccagugcauug

SEQ ID NO: 1132440 - RNA, 19 nt, Homo sapiens
caaauccaguuuccuguuc

SEQ ID NO: 1132441 - RNA, 19 nt, Homo sapiens
gaaacauacuuagggauag

SEQ ID NO: 1132442 - RNA, 19 nt, Homo sapiens
cuaaccaacucccacgaua

SEQ ID NO: 1132443 - RNA, 19 nt, Homo sapiens
uuacagagguuacagucuu

SEQ ID NO: 1132444 - RNA, 19 nt, Homo sapiens
caaagcaguucuacagagu

SEQ ID NO: 1132445 - RNA, 19 nt, Homo sapiens
ucacugagcccuggaauug

SEQ ID NO: 1132446 - RNA, 19 nt, Homo sapiens
gggcacagguacaagaaau

SEQ ID NO: 1132447 - RNA, 19 nt, Homo sapiens
caaguccuguggauuagaa

SEQ ID NO: 1132448 - RNA, 19 nt, Homo sapiens
gacaauaaccaaagcaaau

SEQ ID NO: 1132449 - RNA, 19 nt, Homo sapiens
gcaaaggaagugauucaga

SEQ ID NO: 1132450 - RNA, 19 nt, Homo sapiens
gacaagacauuucaaagaa

SEQ ID NO: 1132451 - RNA, 19 nt, Homo sapiens
ggaaugggaugaacaagau

SEQ ID NO: 1132452 - RNA, 19 nt, Homo sapiens
gaagcugaauauauacgua

SEQ ID NO: 1132453 - RNA, 19 nt, Homo sapiens
gaauauauacguagucaug

SEQ ID NO: 1132454 - RNA, 19 nt, Homo sapiens
guagugauuuguaaacuug

SEQ ID NO: 1132455 - RNA, 19 nt, Homo sapiens
ggugagagcugccuuguac

SEQ ID NO: 1132456 - RNA, 19 nt, Homo sapiens
guuaauaaagggcaacuua

SEQ ID NO: 1132457 - RNA, 19 nt, Homo sapiens
guagucauguuuauguuga

SEQ ID NO: 1132458 - RNA, 19 nt, Homo sapiens
gaacaaggugacacauauu

SEQ ID NO: 1132459 - RNA, 19 nt, Homo sapiens
agaacaaggugacacauau

SEQ ID NO: 1132460 - RNA, 19 nt, Homo sapiens
gaccgaaagcucuauguuu

SEQ ID NO: 1132461 - RNA, 19 nt, Homo sapiens
ggcaguggcugaaggaaga

SEQ ID NO: 1132462 - RNA, 19 nt, Homo sapiens
guacaucggcaacuucaaa

SEQ ID NO: 1132463 - RNA, 19 nt, Homo sapiens
uaauguaccugaaguuucu

SEQ ID NO: 1132464 - RNA, 19 nt, Homo sapiens
ucagaagacuguaauguac

SEQ ID NO: 1132465 - RNA, 19 nt, Homo sapiens
ugacaagacauuucaaaga

SEQ ID NO: 1132466 - RNA, 19 nt, Homo sapiens
gcccguguguucucaaauu

SEQ ID NO: 1132467 - RNA, 19 nt, Homo sapiens
ugacacuggugaucgcaua

SEQ ID NO: 1132468 - RNA, 19 nt, Homo sapiens
gcggaacaauugagcaaga

SEQ ID NO: 1132469 - RNA, 19 nt, Homo sapiens
ggacgagcccaguguaguu

SEQ ID NO: 1132470 - RNA, 19 nt, Homo sapiens
guugagaacuaaggauauu

SEQ ID NO: 1132471 - RNA, 19 nt, Homo sapiens
gaaaagcaacauagaguuu

SEQ ID NO: 1132472 - RNA, 19 nt, Homo sapiens
ccagagacgcggaacaauu

SEQ ID NO: 1132473 - RNA, 19 nt, Homo sapiens
caacgugggcuuccagaga

SEQ ID NO: 1132474 - RNA, 19 nt, Homo sapiens
cagagacgcggaacaauug

SEQ ID NO: 1132475 - RNA, 19 nt, Homo sapiens
gcaacauagaguuuaagua

SEQ ID NO: 1132476 - RNA, 19 nt, Homo sapiens
gaguuuaaguauccaguag

SEQ ID NO: 1132477 - RNA, 19 nt, Homo sapiens
gaauugaccgaaagcucua

SEQ ID NO: 1132478 - RNA, 19 nt, Homo sapiens
ccaggaacccgacuacgaa

SEQ ID NO: 1132479 - RNA, 19 nt, Homo sapiens
agcaugagguccaucagua

SEQ ID NO: 1132480 - RNA, 19 nt, Homo sapiens
gcaagaacaaggugacaca

SEQ ID NO: 1132481 - RNA, 19 nt, Homo sapiens
gaacaauugagcaagaaca

SEQ ID NO: 1132482 - RNA, 19 nt, Homo sapiens
cggcaaggcgggaccauuu

SEQ ID NO: 1132483 - RNA, 19 nt, Homo sapiens
gggaaugggaugaacaaga

SEQ ID NO: 1132484 - RNA, 19 nt, Homo sapiens
ccuguaacaugccauagug

SEQ ID NO: 1132485 - RNA, 19 nt, Homo sapiens
guaauguaccugaaguuuc

SEQ ID NO: 1132486 - RNA, 19 nt, Homo sapiens
guuuaaguauccaguagug

SEQ ID NO: 1132487 - RNA, 19 nt, Homo sapiens
gcaugagguccaucaguau

SEQ ID NO: 1132488 - RNA, 19 nt, Homo sapiens
aagaacaaggugacacaua

SEQ ID NO: 1132489 - RNA, 19 nt, Homo sapiens
caaggacgagcccagugua

SEQ ID NO: 1132490 - RNA, 19 nt, Homo sapiens
gugguggaauugaccgaaa

SEQ ID NO: 1132491 - RNA, 19 nt, Homo sapiens
uaaguauccaguagugauu

SEQ ID NO: 1132492 - RNA, 19 nt, Homo sapiens
ggaugcagaagaagccaaa

SEQ ID NO: 1132493 - RNA, 19 nt, Homo sapiens
acauagaguuuaaguaucc

SEQ ID NO: 1132494 - RNA, 19 nt, Homo sapiens
cucagaagacuguaaugua

SEQ ID NO: 1132495 - RNA, 19 nt, Homo sapiens
cggaacaauugagcaagaa

SEQ ID NO: 1132496 - RNA, 19 nt, Homo sapiens
guaguuguguggcgugaac

SEQ ID NO: 1132497 - RNA, 19 nt, Homo sapiens
agacuguaauguaccugaa

SEQ ID NO: 1132498 - RNA, 19 nt, Homo sapiens
gcugaaggaagaauaugga

SEQ ID NO: 1132499 - RNA, 19 nt, Homo sapiens
gccaggaacccgacuacga

SEQ ID NO: 1132500 - RNA, 19 nt, Homo sapiens
cugaauauauacguaguca

SEQ ID NO: 1132501 - RNA, 19 nt, Homo sapiens
gcggauucaccaucucaaa

SEQ ID NO: 1132502 - RNA, 19 nt, Homo sapiens
uguaauguaccugaaguuu

SEQ ID NO: 1132503 - RNA, 19 nt, Homo sapiens
caaggugacacauauucug

SEQ ID NO: 1132504 - RNA, 19 nt, Homo sapiens
accgaaagcucuauguuuu

SEQ ID NO: 1132505 - RNA, 19 nt, Homo sapiens
ugugaacgccucccaagga

SEQ ID NO: 1132506 - RNA, 19 nt, Homo sapiens
agagagcccuuugcaggau

SEQ ID NO: 1132507 - RNA, 19 nt, Homo sapiens
ccaaggacgagcccagugu

SEQ ID NO: 1132508 - RNA, 19 nt, Homo sapiens
caucggcaacuucaaagau

SEQ ID NO: 1132509 - RNA, 19 nt, Homo sapiens
ccgcuccuccucccuguaa

SEQ ID NO: 1132510 - RNA, 19 nt, Homo sapiens
uauguuggagggaguuaaa

SEQ ID NO: 1132511 - RNA, 19 nt, Homo sapiens
ugaccgaaagcucuauguu

SEQ ID NO: 1132512 - RNA, 19 nt, Homo sapiens
uguuggagggaguuaaaua

SEQ ID NO: 1132513 - RNA, 19 nt, Homo sapiens
auccaguagugauuuguaa

SEQ ID NO: 1132514 - RNA, 19 nt, Homo sapiens
uccaggaguuugagaagca

SEQ ID NO: 1132515 - RNA, 19 nt, Homo sapiens
ccugacaagacauuucaaa

SEQ ID NO: 1132516 - RNA, 19 nt, Homo sapiens
uuaaguauccaguagugau

SEQ ID NO: 1132517 - RNA, 19 nt, Homo sapiens
gcgcuagcguucgccuuca

SEQ ID NO: 1132518 - RNA, 19 nt, Homo sapiens
uaauaaagggcaacuuagc

SEQ ID NO: 1132519 - RNA, 19 nt, Homo sapiens
gacgagcccaguguaguug

SEQ ID NO: 1132520 - RNA, 19 nt, Homo sapiens
uauccaguagugauuugua

SEQ ID NO: 1132521 - RNA, 19 nt, Homo sapiens
gugccaggccuauguugga

SEQ ID NO: 1132522 - RNA, 19 nt, Homo sapiens
uuaauaaagggcaacuuag

SEQ ID NO: 1132523 - RNA, 19 nt, Homo sapiens
ucgcuuggaugccuguaag

SEQ ID NO: 1132524 - RNA, 19 nt, Homo sapiens
gaaguucugggccuuucuc

SEQ ID NO: 1132525 - RNA, 19 nt, Homo sapiens
ggaagacgcugugucguuu

SEQ ID NO: 1132526 - RNA, 19 nt, Homo sapiens
gcgaacauccugucacuua

SEQ ID NO: 1132527 - RNA, 19 nt, Homo sapiens
gcagauggauucuaugagu

SEQ ID NO: 1132528 - RNA, 19 nt, Homo sapiens
gagaaacggucauuuaagg

SEQ ID NO: 1132529 - RNA, 19 nt, Homo sapiens
ggaagucucugcccugauc

SEQ ID NO: 1132530 - RNA, 19 nt, Homo sapiens
gcacugcuguucugauaau

SEQ ID NO: 1132531 - RNA, 19 nt, Homo sapiens
gagauguccuguauuccua

SEQ ID NO: 1132532 - RNA, 19 nt, Homo sapiens
ccacugggcucuuucacuu

SEQ ID NO: 1132533 - RNA, 19 nt, Homo sapiens
cuaaauggcuugacuuugg

SEQ ID NO: 1132534 - RNA, 19 nt, Homo sapiens
gagaggaggcaguuucuaa

SEQ ID NO: 1132535 - RNA, 19 nt, Homo sapiens
ucacuuaccuagagauguu

SEQ ID NO: 1132536 - RNA, 19 nt, Homo sapiens
gaacaucaccuuccaugca

SEQ ID NO: 1132537 - RNA, 19 nt, Homo sapiens
gguggagucuucccucaaa

SEQ ID NO: 1132538 - RNA, 19 nt, Homo sapiens
ggaggcaguuucuaaaugg

SEQ ID NO: 1132539 - RNA, 19 nt, Homo sapiens
gugaacaacucgcgaaaca

SEQ ID NO: 1132540 - RNA, 19 nt, Homo sapiens
caacagagaacaucaccuu

SEQ ID NO: 1132541 - RNA, 19 nt, Homo sapiens
gaaauuaauccacccaaca

SEQ ID NO: 1132542 - RNA, 19 nt, Homo sapiens
gaacaacucgcgaaacaac

SEQ ID NO: 1132543 - RNA, 19 nt, Homo sapiens
gaagucagguagcauuggu

SEQ ID NO: 1132544 - RNA, 19 nt, Homo sapiens
caacaagaguccucaaucc

SEQ ID NO: 1132545 - RNA, 19 nt, Homo sapiens
agccauacuucaucuauuu

SEQ ID NO: 1132546 - RNA, 19 nt, Homo sapiens
ucucugcccugaucuggua

SEQ ID NO: 1132547 - RNA, 19 nt, Homo sapiens
cugcacugcuguucugaua

SEQ ID NO: 1132548 - RNA, 19 nt, Homo sapiens
gauguccuguauuccuaua

SEQ ID NO: 1132549 - RNA, 19 nt, Homo sapiens
aagcugcaguucaauacua

SEQ ID NO: 1132550 - RNA, 19 nt, Homo sapiens
aggaagcucugaaauuaau

SEQ ID NO: 1132551 - RNA, 19 nt, Homo sapiens
gagaaagucugggacaacu

SEQ ID NO: 1132552 - RNA, 19 nt, Homo sapiens
ccagucaguuccugcagaa

SEQ ID NO: 1132553 - RNA, 19 nt, Homo sapiens
cacaguggauuccugcaaa

SEQ ID NO: 1132554 - RNA, 19 nt, Homo sapiens
gggaagacgcugugucguu

SEQ ID NO: 1132555 - RNA, 19 nt, Homo sapiens
ggagaaacggucauuuaag

SEQ ID NO: 1132556 - RNA, 19 nt, Homo sapiens
guugugggcucauguaguc

SEQ ID NO: 1132557 - RNA, 19 nt, Homo sapiens
caaaccagaggcagccaua

SEQ ID NO: 1132558 - RNA, 19 nt, Homo sapiens
uggagaaacggucauuuaa

SEQ ID NO: 1132559 - RNA, 19 nt, Homo sapiens
guucaauacuaccaacugu

SEQ ID NO: 1132560 - RNA, 19 nt, Homo sapiens
ugcaaaggcuugagugaca

SEQ ID NO: 1132561 - RNA, 19 nt, Homo sapiens
gggcgguguugaagaaugu

SEQ ID NO: 1132562 - RNA, 19 nt, Homo sapiens
uuuagcagauggauucuau

SEQ ID NO: 1132563 - RNA, 19 nt, Homo sapiens
aaaggaagagucagauguu

SEQ ID NO: 1132564 - RNA, 19 nt, Homo sapiens
gggagaaagucugggacaa

SEQ ID NO: 1132565 - RNA, 19 nt, Homo sapiens
cagccauacuucaucuauu

SEQ ID NO: 1132566 - RNA, 19 nt, Homo sapiens
gcagccauacuucaucuau

SEQ ID NO: 1132567 - RNA, 19 nt, Homo sapiens
uagcagauggauucuauga

SEQ ID NO: 1132568 - RNA, 19 nt, Homo sapiens
guagugauaccguaaugga

SEQ ID NO: 1132569 - RNA, 19 nt, Homo sapiens
cuuccaagcugcaguucaa

SEQ ID NO: 1132570 - RNA, 19 nt, Homo sapiens
gaucugguacuccuuguag

SEQ ID NO: 1132571 - RNA, 19 nt, Homo sapiens
gagguguccugcugcuguu

SEQ ID NO: 1132572 - RNA, 19 nt, Homo sapiens
gaggaggcaguuucuaaau

SEQ ID NO: 1132573 - RNA, 19 nt, Homo sapiens
gcaaaggcuugagugacau

SEQ ID NO: 1132574 - RNA, 19 nt, Homo sapiens
ugucucgacugcacuuuga

SEQ ID NO: 1132575 - RNA, 19 nt, Homo sapiens
gggcgaacauccugucacu

SEQ ID NO: 1132576 - RNA, 19 nt, Homo sapiens
caggaagcucugaaauuaa

SEQ ID NO: 1132577 - RNA, 19 nt, Homo sapiens
uaaauggcuugacuuuggu

SEQ ID NO: 1132578 - RNA, 19 nt, Homo sapiens
gagaagucagguagcauug

SEQ ID NO: 1132579 - RNA, 19 nt, Homo sapiens
gugauaccguaauggagaa

SEQ ID NO: 1132580 - RNA, 19 nt, Homo sapiens
guggacagcuuuggaagag

SEQ ID NO: 1132581 - RNA, 19 nt, Homo sapiens
gcagcgaugucagggaaca

SEQ ID NO: 1132582 - RNA, 19 nt, Homo sapiens
ucucuucuguggugaacaa

SEQ ID NO: 1132583 - RNA, 19 nt, Homo sapiens
cagagaacaucaccuucca

SEQ ID NO: 1132584 - RNA, 19 nt, Homo sapiens
aggaggcaguuucuaaaug

SEQ ID NO: 1132585 - RNA, 19 nt, Homo sapiens
auggagaaacggucauuua

SEQ ID NO: 1132586 - RNA, 19 nt, Homo sapiens
ccucaaaucaagacagaga

SEQ ID NO: 1132587 - RNA, 19 nt, Homo sapiens
uaaggugccucugggaaag

SEQ ID NO: 1132588 - RNA, 19 nt, Homo sapiens
guauauguguuugcuuugg

SEQ ID NO: 1132589 - RNA, 19 nt, Homo sapiens
gacacaggacuuucagaga

SEQ ID NO: 1132590 - RNA, 19 nt, Homo sapiens
acaagaguccucaauccaa

SEQ ID NO: 1132591 - RNA, 19 nt, Homo sapiens
caucugagcguaucauugc

SEQ ID NO: 1132592 - RNA, 19 nt, Homo sapiens
ccugagaacugggagaaag

SEQ ID NO: 1132593 - RNA, 19 nt, Homo sapiens
ccuauaccaucaucacagu

SEQ ID NO: 1132594 - RNA, 19 nt, Homo sapiens
cagauaguccugagaacug

SEQ ID NO: 1132595 - RNA, 19 nt, Homo sapiens
acagagaagucagguagca

SEQ ID NO: 1132596 - RNA, 19 nt, Homo sapiens
ggccacaacgucacccaaa

SEQ ID NO: 1132597 - RNA, 19 nt, Homo sapiens
agaggaggcaguuucuaaa

SEQ ID NO: 1132598 - RNA, 19 nt, Homo sapiens
ggagaggaggcaguuucua

SEQ ID NO: 1132599 - RNA, 19 nt, Homo sapiens
ggagauguccuguauuccu

SEQ ID NO: 1132600 - RNA, 19 nt, Homo sapiens
acuggaggcugcugacaau

SEQ ID NO: 1132601 - RNA, 19 nt, Homo sapiens
uguguuaguugacaguugu

SEQ ID NO: 1132602 - RNA, 19 nt, Homo sapiens
aaagugauccuuccaagcu

SEQ ID NO: 1132603 - RNA, 19 nt, Homo sapiens
gcagauaguccugagaacu

SEQ ID NO: 1132604 - RNA, 19 nt, Homo sapiens
agagaagucagguagcauu

SEQ ID NO: 1132605 - RNA, 19 nt, Homo sapiens
ugacaguugugggcucaug

SEQ ID NO: 1132606 - RNA, 19 nt, Homo sapiens
ggagaaagucugggacaac

SEQ ID NO: 1132607 - RNA, 19 nt, Homo sapiens
gcauuggugcugcagauag

SEQ ID NO: 1132608 - RNA, 19 nt, Homo sapiens
cgaacauccugucacuuac

SEQ ID NO: 1132609 - RNA, 19 nt, Homo sapiens
uuaaggugccucugggaaa

SEQ ID NO: 1132610 - RNA, 19 nt, Homo sapiens
ggcaguagcagaggauguu

SEQ ID NO: 1132611 - RNA, 19 nt, Homo sapiens
ugaagucucaacucaggaa

SEQ ID NO: 1132612 - RNA, 19 nt, Homo sapiens
gugggcucauguagucuuu

SEQ ID NO: 1132613 - RNA, 19 nt, Homo sapiens
guggcacuguguuaguuga

SEQ ID NO: 1132614 - RNA, 19 nt, Homo sapiens
ggagguggcacuguguuag

SEQ ID NO: 1132615 - RNA, 19 nt, Homo sapiens
gacugcacuuugagaagga

SEQ ID NO: 1132616 - RNA, 19 nt, Homo sapiens
ggucccuucuugguucaaa

SEQ ID NO: 1132617 - RNA, 19 nt, Homo sapiens
cauuggugcugcagauagu

SEQ ID NO: 1132618 - RNA, 19 nt, Homo sapiens
gguggacagcuuuggaaga

SEQ ID NO: 1132619 - RNA, 19 nt, Homo sapiens
ggaggagguggcacugugu

SEQ ID NO: 1132620 - RNA, 19 nt, Homo sapiens
ccagugguccagucaguuc

SEQ ID NO: 1132621 - RNA, 19 nt, Homo sapiens
uuaauccacccaacagaga

SEQ ID NO: 1132622 - RNA, 19 nt, Homo sapiens
uuggugaagucucaacuca

SEQ ID NO: 1132623 - RNA, 19 nt, Homo sapiens
ggaugccugccauauuaga

SEQ ID NO: 1132624 - RNA, 19 nt, Homo sapiens
gauaaguacugccccucuu

SEQ ID NO: 1132625 - RNA, 19 nt, Homo sapiens
gaaaaugccugaagaauga

SEQ ID NO: 1132626 - RNA, 19 nt, Homo sapiens
aaagaugcauccugacuua

SEQ ID NO: 1132627 - RNA, 19 nt, Homo sapiens
ugacuuaucuccacacuug

SEQ ID NO: 1132628 - RNA, 19 nt, Homo sapiens
uaaagacucuggguugaua

SEQ ID NO: 1132629 - RNA, 19 nt, Homo sapiens
gaaugcaacgucuugauua

SEQ ID NO: 1132630 - RNA, 19 nt, Homo sapiens
gaaagugaccugugagaga

SEQ ID NO: 1132631 - RNA, 19 nt, Homo sapiens
gagaagaccuaaagacucu

SEQ ID NO: 1132632 - RNA, 19 nt, Homo sapiens
guugauaccugaaagaauc

SEQ ID NO: 1132633 - RNA, 19 nt, Homo sapiens
gaagaaugaguacguagaa

SEQ ID NO: 1132634 - RNA, 19 nt, Homo sapiens
gaaccauggagaaauauga

SEQ ID NO: 1132635 - RNA, 19 nt, Homo sapiens
cauaauccuuugaauggaa

SEQ ID NO: 1132636 - RNA, 19 nt, Homo sapiens
aaaccugacuucaccaugu

SEQ ID NO: 1132637 - RNA, 19 nt, Homo sapiens
ugaaaacccuggauucuga

SEQ ID NO: 1132638 - RNA, 19 nt, Homo sapiens
cugaguaacuuaucuccuu

SEQ ID NO: 1132639 - RNA, 19 nt, Homo sapiens
aaugcaacgucuugauuaa

SEQ ID NO: 1132640 - RNA, 19 nt, Homo sapiens
auugaaccauggagaaaua

SEQ ID NO: 1132641 - RNA, 19 nt, Homo sapiens
gagauugaaccauggagaa

SEQ ID NO: 1132642 - RNA, 19 nt, Homo sapiens
aauggaaagugaccuguga

SEQ ID NO: 1132643 - RNA, 19 nt, Homo sapiens
gagagaagaccuaaagacu

SEQ ID NO: 1132644 - RNA, 19 nt, Homo sapiens
gagcagggagcauggcauu

SEQ ID NO: 1132645 - RNA, 19 nt, Homo sapiens
gcaacgucuugauuaacuu

SEQ ID NO: 1132646 - RNA, 19 nt, Homo sapiens
ccaguuaauaucugaguaa

SEQ ID NO: 1132647 - RNA, 19 nt, Homo sapiens
ccuaaagacucuggguuga

SEQ ID NO: 1132648 - RNA, 19 nt, Homo sapiens
gcagggcguuuaguacugu

SEQ ID NO: 1132649 - RNA, 19 nt, Homo sapiens
aaagugaccugugagagau

SEQ ID NO: 1132650 - RNA, 19 nt, Homo sapiens
acaaccaguuaauaucuga

SEQ ID NO: 1132651 - RNA, 19 nt, Homo sapiens
gcugagagaagaccuaaag

SEQ ID NO: 1132652 - RNA, 19 nt, Homo sapiens
gaugcauccugacuuaucu

SEQ ID NO: 1132653 - RNA, 19 nt, Homo sapiens
caccauguuuauucccuuu

SEQ ID NO: 1132654 - RNA, 19 nt, Homo sapiens
ccugaagaaugaguacgua

SEQ ID NO: 1132655 - RNA, 19 nt, Homo sapiens
gcuuaaggaaugucacaaa

SEQ ID NO: 1132656 - RNA, 19 nt, Homo sapiens
uaaagaugcauccugacuu

SEQ ID NO: 1132657 - RNA, 19 nt, Homo sapiens
gaucgggaguugagaaaau

SEQ ID NO: 1132658 - RNA, 19 nt, Homo sapiens
uaacuugcuuaaggaaugu

SEQ ID NO: 1132659 - RNA, 19 nt, Homo sapiens
agaaugcaacgucuugauu

SEQ ID NO: 1132660 - RNA, 19 nt, Homo sapiens
aagaaugaguacguagaaa

SEQ ID NO: 1132661 - RNA, 19 nt, Homo sapiens
ggguugcacugcugugauc

SEQ ID NO: 1132662 - RNA, 19 nt, Homo sapiens
ggagggcgucacuggguuu

SEQ ID NO: 1132663 - RNA, 19 nt, Homo sapiens
ugacuucaccauguuuauu

SEQ ID NO: 1132664 - RNA, 19 nt, Homo sapiens
ugaagaaugaguacguaga

SEQ ID NO: 1132665 - RNA, 19 nt, Homo sapiens
caacgucuugauuaacuug

SEQ ID NO: 1132666 - RNA, 19 nt, Homo sapiens
gccuacaaccaguuaauau

SEQ ID NO: 1132667 - RNA, 19 nt, Homo sapiens
ggcagggcguuuaguacug

SEQ ID NO: 1132668 - RNA, 19 nt, Homo sapiens
cuacaaccaguuaauaucu

SEQ ID NO: 1132669 - RNA, 19 nt, Homo sapiens
gcaagcgguucagcugucu

SEQ ID NO: 1132670 - RNA, 19 nt, Homo sapiens
agaauccugucuuauuugg

SEQ ID NO: 1132671 - RNA, 19 nt, Homo sapiens
gacuucaccauguuuauuc

SEQ ID NO: 1132672 - RNA, 19 nt, Homo sapiens
aacccuggauucugaguau

SEQ ID NO: 1132673 - RNA, 19 nt, Homo sapiens
gcugugauccauccucauc

SEQ ID NO: 1132674 - RNA, 19 nt, Homo sapiens
guagaaaacaggaccaaga

SEQ ID NO: 1132675 - RNA, 19 nt, Homo sapiens
aaccugacuucaccauguu

SEQ ID NO: 1132676 - RNA, 19 nt, Homo sapiens
ggauucugaguauuuguug

SEQ ID NO: 1132677 - RNA, 19 nt, Homo sapiens
ugccuuggcugagagaaga

SEQ ID NO: 1132678 - RNA, 19 nt, Homo sapiens
gcagggagcauggcauugc

SEQ ID NO: 1132679 - RNA, 19 nt, Homo sapiens
gcaaaccugacuucaccau

SEQ ID NO: 1132680 - RNA, 19 nt, Homo sapiens
ccuggauucugaguauuug

SEQ ID NO: 1132681 - RNA, 19 nt, Homo sapiens
gauugaaccauggagaaau

SEQ ID NO: 1132682 - RNA, 19 nt, Homo sapiens
acacuugcacacugaagaa

SEQ ID NO: 1132683 - RNA, 19 nt, Homo sapiens
ugcaacgucuugauuaacu

SEQ ID NO: 1132684 - RNA, 19 nt, Homo sapiens
uacaaccaguuaauaucug

SEQ ID NO: 1132685 - RNA, 19 nt, Homo sapiens
gggcagggcguuuaguacu

SEQ ID NO: 1132686 - RNA, 19 nt, Homo sapiens
ggguugauaccugaaagaa

SEQ ID NO: 1132687 - RNA, 19 nt, Homo sapiens
cuccacacuugcacacuga

SEQ ID NO: 1132688 - RNA, 19 nt, Homo sapiens
ugauguugaucgggaguug

SEQ ID NO: 1132689 - RNA, 19 nt, Homo sapiens
ugucuuauuuggucuccau

SEQ ID NO: 1132690 - RNA, 19 nt, Homo sapiens
cuuaaggaaugucacaaaa

SEQ ID NO: 1132691 - RNA, 19 nt, Homo sapiens
gauagaaacuggagaaaga

SEQ ID NO: 1132692 - RNA, 19 nt, Homo sapiens
gcugagagcuaaauuaauu

SEQ ID NO: 1132693 - RNA, 19 nt, Homo sapiens
gaacaaagaugcgcagaug

SEQ ID NO: 1132694 - RNA, 19 nt, Homo sapiens
gagaacgccucaaagaguu

SEQ ID NO: 1132695 - RNA, 19 nt, Homo sapiens
ugaaugaguuugaaguuug

SEQ ID NO: 1132696 - RNA, 19 nt, Homo sapiens
cgaagagugugguagguaa

SEQ ID NO: 1132697 - RNA, 19 nt, Homo sapiens
gagcagcgauuaaccaaaa

SEQ ID NO: 1132698 - RNA, 19 nt, Homo sapiens
aaagagaacgccucaaaga

SEQ ID NO: 1132699 - RNA, 19 nt, Homo sapiens
uuagcaagaugaacaaaga

SEQ ID NO: 1132700 - RNA, 19 nt, Homo sapiens
gcacgaggacuuucugugu

SEQ ID NO: 1132701 - RNA, 19 nt, Homo sapiens
gaauuagauuguguuguug

SEQ ID NO: 1132702 - RNA, 19 nt, Homo sapiens
ccugguaccugacagugua

SEQ ID NO: 1132703 - RNA, 19 nt, Homo sapiens
agaaagagaacgccucaaa

SEQ ID NO: 1132704 - RNA, 19 nt, Homo sapiens
gaaagagaacgccucaaag

SEQ ID NO: 1132705 - RNA, 19 nt, Homo sapiens
gagcuccuacaaagaauaa

SEQ ID NO: 1132706 - RNA, 19 nt, Homo sapiens
cagaugagagcagcgauua

SEQ ID NO: 1132707 - RNA, 19 nt, Homo sapiens
gaaguuugcuuggauuuug

SEQ ID NO: 1132708 - RNA, 19 nt, Homo sapiens
gguauacaguuuucaguaa

SEQ ID NO: 1132709 - RNA, 19 nt, Homo sapiens
uggcugaaaucacuccaaa

SEQ ID NO: 1132710 - RNA, 19 nt, Homo sapiens
gauggugguuagcaagaug

SEQ ID NO: 1132711 - RNA, 19 nt, Homo sapiens
gaaggcacacuguaaagag

SEQ ID NO: 1132712 - RNA, 19 nt, Homo sapiens
gaaugaguuugaaguuugc

SEQ ID NO: 1132713 - RNA, 19 nt, Homo sapiens
gcagaugagagcagcgauu

SEQ ID NO: 1132714 - RNA, 19 nt, Homo sapiens
caugccagccuuuaagauu

SEQ ID NO: 1132715 - RNA, 19 nt, Homo sapiens
aagaguugcugagagcuaa

SEQ ID NO: 1132716 - RNA, 19 nt, Homo sapiens
gagagcagcgauuaaccaa

SEQ ID NO: 1132717 - RNA, 19 nt, Homo sapiens
guugaaggcacacuguaaa

SEQ ID NO: 1132718 - RNA, 19 nt, Homo sapiens
ggagcuccuacaaagaaua

SEQ ID NO: 1132719 - RNA, 19 nt, Homo sapiens
gcuggaaggaucaguugaa

SEQ ID NO: 1132720 - RNA, 19 nt, Homo sapiens
gacuagaacacguuacugu

SEQ ID NO: 1132721 - RNA, 19 nt, Homo sapiens
ggcacacuguaaagaggua

SEQ ID NO: 1132722 - RNA, 19 nt, Homo sapiens
uugcugagagcuaaauuaa

SEQ ID NO: 1132723 - RNA, 19 nt, Homo sapiens
agagaacgccucaaagagu

SEQ ID NO: 1132724 - RNA, 19 nt, Homo sapiens
guugcugagagcuaaauua

SEQ ID NO: 1132725 - RNA, 19 nt, Homo sapiens
caaagaugcgcagaugaga

SEQ ID NO: 1132726 - RNA, 19 nt, Homo sapiens
caugaaugaguuugaaguu

SEQ ID NO: 1132727 - RNA, 19 nt, Homo sapiens
gaugagagcagcgauuaac

SEQ ID NO: 1132728 - RNA, 19 nt, Homo sapiens
guuugaaguuugcuuggau

SEQ ID NO: 1132729 - RNA, 19 nt, Homo sapiens
ugccagccuuuaagauuga

SEQ ID NO: 1132730 - RNA, 19 nt, Homo sapiens
aaaggacuagaacacguua

SEQ ID NO: 1132731 - RNA, 19 nt, Homo sapiens
guugauagaaacuggagaa

SEQ ID NO: 1132732 - RNA, 19 nt, Homo sapiens
guaccugacaguguaaaga

SEQ ID NO: 1132733 - RNA, 19 nt, Homo sapiens
gcuccuacaaagaauaaga

SEQ ID NO: 1132734 - RNA, 19 nt, Homo sapiens
ugaaggcacacuguaaaga

SEQ ID NO: 1132735 - RNA, 19 nt, Homo sapiens
aaagaguugcugagagcua

SEQ ID NO: 1132736 - RNA, 19 nt, Homo sapiens
gaaacuggagaaagagaac

SEQ ID NO: 1132737 - RNA, 19 nt, Homo sapiens
gcucagcaugccagccuuu

SEQ ID NO: 1132738 - RNA, 19 nt, Homo sapiens
augccagccuuuaagauug

SEQ ID NO: 1132739 - RNA, 19 nt, Homo sapiens
uaccugacaguguaaagaa

SEQ ID NO: 1132740 - RNA, 19 nt, Homo sapiens
acaaagaugcgcagaugag

SEQ ID NO: 1132741 - RNA, 19 nt, Homo sapiens
cagcaugccagccuuuaag

SEQ ID NO: 1132742 - RNA, 19 nt, Homo sapiens
ucagcaugccagccuuuaa

SEQ ID NO: 1132743 - RNA, 19 nt, Homo sapiens
ccgaagagugugguaggua

SEQ ID NO: 1132744 - RNA, 19 nt, Homo sapiens
gcgauuaaccaaaaguuga

SEQ ID NO: 1132745 - RNA, 19 nt, Homo sapiens
aggacuuucugugugcuua

SEQ ID NO: 1132746 - RNA, 19 nt, Homo sapiens
ugacuugguggcugaaauc

SEQ ID NO: 1132747 - RNA, 19 nt, Homo sapiens
acacguuacuguugaugac

SEQ ID NO: 1132748 - RNA, 19 nt, Homo sapiens
ggacuagaacacguuacug

SEQ ID NO: 1132749 - RNA, 19 nt, Homo sapiens
gugguuagcaagaugaaca

SEQ ID NO: 1132750 - RNA, 19 nt, Homo sapiens
uuugaaguuugcuuggauu

SEQ ID NO: 1132751 - RNA, 19 nt, Homo sapiens
gcaugccagccuuuaagau

SEQ ID NO: 1132752 - RNA, 19 nt, Homo sapiens
cuugguggcugaaaucacu

SEQ ID NO: 1132753 - RNA, 19 nt, Homo sapiens
gggcagcacucccuuauuu

SEQ ID NO: 1132754 - RNA, 19 nt, Homo sapiens
gaagaaggaaugagaagua

SEQ ID NO: 1132755 - RNA, 19 nt, Homo sapiens
caagugagaucaaugaaga

SEQ ID NO: 1132756 - RNA, 19 nt, Homo sapiens
gcuaccagauugucuauaa

SEQ ID NO: 1132757 - RNA, 19 nt, Homo sapiens
gaugauggcuaccagauug

SEQ ID NO: 1132758 - RNA, 19 nt, Homo sapiens
gcacagggcagcugguaua

SEQ ID NO: 1132759 - RNA, 19 nt, Homo sapiens
ggagaacacuuugcagcua

SEQ ID NO: 1132760 - RNA, 19 nt, Homo sapiens
gagaacacuuugcagcuaa

SEQ ID NO: 1132761 - RNA, 19 nt, Homo sapiens
ggaaugagaaguacgauau

SEQ ID NO: 1132762 - RNA, 19 nt, Homo sapiens
caaguuagauccacagaca

SEQ ID NO: 1132763 - RNA, 19 nt, Homo sapiens
uaugguggcuuucuuuauu

SEQ ID NO: 1132764 - RNA, 19 nt, Homo sapiens
gcugguauaugguggcuuu

SEQ ID NO: 1132765 - RNA, 19 nt, Homo sapiens
cagagaagaucuacguguu

SEQ ID NO: 1132766 - RNA, 19 nt, Homo sapiens
gagaagaucuacguguuag

SEQ ID NO: 1132767 - RNA, 19 nt, Homo sapiens
ucaacaaauuucaggcuaa

SEQ ID NO: 1132768 - RNA, 19 nt, Homo sapiens
gaagaaagaggaggagguu

SEQ ID NO: 1132769 - RNA, 19 nt, Homo sapiens
ccagggcucuaaccuugua

SEQ ID NO: 1132770 - RNA, 19 nt, Homo sapiens
gaacugaggccgacaccau

SEQ ID NO: 1132771 - RNA, 19 nt, Homo sapiens
ucacucccauacauuuaua

SEQ ID NO: 1132772 - RNA, 19 nt, Homo sapiens
gaaagaggaggagguuuga

SEQ ID NO: 1132773 - RNA, 19 nt, Homo sapiens
ugaagauucugaagcgauu

SEQ ID NO: 1132774 - RNA, 19 nt, Homo sapiens
uacacaaucucucaaguga

SEQ ID NO: 1132775 - RNA, 19 nt, Homo sapiens
ucuuucagcuccuuuguuu

SEQ ID NO: 1132776 - RNA, 19 nt, Homo sapiens
gaaguacgauauggugaca

SEQ ID NO: 1132777 - RNA, 19 nt, Homo sapiens
gaaggaaugagaaguacga

SEQ ID NO: 1132778 - RNA, 19 nt, Homo sapiens
guacauggaacgccgacua

SEQ ID NO: 1132779 - RNA, 19 nt, Homo sapiens
cagggcagcugguauaugg

SEQ ID NO: 1132780 - RNA, 19 nt, Homo sapiens
guguagaguuugaugagaa

SEQ ID NO: 1132781 - RNA, 19 nt, Homo sapiens
caacaaauuucaggcuaag

SEQ ID NO: 1132782 - RNA, 19 nt, Homo sapiens
caauggcaaucaaauucuu

SEQ ID NO: 1132783 - RNA, 19 nt, Homo sapiens
ucuauaagcuggagaugag

SEQ ID NO: 1132784 - RNA, 19 nt, Homo sapiens
uggcucaaauccucuauau

SEQ ID NO: 1132785 - RNA, 19 nt, Homo sapiens
ucagcuccuuuguuucaua

SEQ ID NO: 1132786 - RNA, 19 nt, Homo sapiens
gggaagaggcugacuguac

SEQ ID NO: 1132787 - RNA, 19 nt, Homo sapiens
cacagacacuggacacaga

SEQ ID NO: 1132788 - RNA, 19 nt, Homo sapiens
ccuggcagcugaugaggaa

SEQ ID NO: 1132789 - RNA, 19 nt, Homo sapiens
gguauaugguggcuuucuu

SEQ ID NO: 1132790 - RNA, 19 nt, Homo sapiens
agagaagaucuacguguua

SEQ ID NO: 1132791 - RNA, 19 nt, Homo sapiens
ugagaucaaugaagauucu

SEQ ID NO: 1132792 - RNA, 19 nt, Homo sapiens
ccgacuagcugcuuuagag

SEQ ID NO: 1132793 - RNA, 19 nt, Homo sapiens
gacccucuaugucgucuau

SEQ ID NO: 1132794 - RNA, 19 nt, Homo sapiens
agaaagaggaggagguuug

SEQ ID NO: 1132795 - RNA, 19 nt, Homo sapiens
guauaugguggcuuucuuu

SEQ ID NO: 1132796 - RNA, 19 nt, Homo sapiens
ugccauggcugcccggaaa

SEQ ID NO: 1132797 - RNA, 19 nt, Homo sapiens
gaucaaugaagauucugaa

SEQ ID NO: 1132798 - RNA, 19 nt, Homo sapiens
caaauucuuucagcuccuu

SEQ ID NO: 1132799 - RNA, 19 nt, Homo sapiens
uugaggagcuagccuuguu

SEQ ID NO: 1132800 - RNA, 19 nt, Homo sapiens
gaggagguuugaggagcua

SEQ ID NO: 1132801 - RNA, 19 nt, Homo sapiens
aaacagagaagaucuacgu

SEQ ID NO: 1132802 - RNA, 19 nt, Homo sapiens
gaaugagaaguacgauaug

SEQ ID NO: 1132803 - RNA, 19 nt, Homo sapiens
cuccucaucuuguuccuuu

SEQ ID NO: 1132804 - RNA, 19 nt, Homo sapiens
uauaugguggcuuucuuua

SEQ ID NO: 1132805 - RNA, 19 nt, Homo sapiens
ggaugauggcuaccagauu

SEQ ID NO: 1132806 - RNA, 19 nt, Homo sapiens
ggacuucaagaacaagaug

SEQ ID NO: 1132807 - RNA, 19 nt, Homo sapiens
uagaugggacacagaauga

SEQ ID NO: 1132808 - RNA, 19 nt, Homo sapiens
gcuacacaaucucucaagu

SEQ ID NO: 1132809 - RNA, 19 nt, Homo sapiens
acaggacuuucuccacauu

SEQ ID NO: 1132810 - RNA, 19 nt, Homo sapiens
gacuuucuccacauuguuu

SEQ ID NO: 1132811 - RNA, 19 nt, Homo sapiens
cccacuaaauuucuuguuc

SEQ ID NO: 1132812 - RNA, 19 nt, Homo sapiens
cgagaacgccagcucuaug

SEQ ID NO: 1132813 - RNA, 19 nt, Homo sapiens
gcagugggacacaccaugu

SEQ ID NO: 1132814 - RNA, 19 nt, Homo sapiens
gcaagggaagaaggaauga

SEQ ID NO: 1132815 - RNA, 19 nt, Homo sapiens
ggacuuucuccacauuguu

SEQ ID NO: 1132816 - RNA, 19 nt, Homo sapiens
guccagcucuguccucucu

SEQ ID NO: 1132817 - RNA, 19 nt, Homo sapiens
caugccagccuccgcuaua

SEQ ID NO: 1132818 - RNA, 19 nt, Homo sapiens
cccucuaugucgucuauaa

SEQ ID NO: 1132819 - RNA, 19 nt, Homo sapiens
gaaggucuuugggcugucu

SEQ ID NO: 1132820 - RNA, 19 nt, Homo sapiens
gacuguacguuccuucuac

SEQ ID NO: 1132821 - RNA, 19 nt, Homo sapiens
gaccaaaggcaagggaaga

SEQ ID NO: 1132822 - RNA, 19 nt, Homo sapiens
ccagcucuguccucucuuc

SEQ ID NO: 1132823 - RNA, 19 nt, Homo sapiens
ucaaauuccaccuggcaaa

SEQ ID NO: 1132824 - RNA, 19 nt, Homo sapiens
gaacgccgacuagcugcuu

SEQ ID NO: 1132825 - RNA, 19 nt, Homo sapiens
ggagcgggagguagacuau

SEQ ID NO: 1132826 - RNA, 19 nt, Homo sapiens
cuucaaaugugggccaguu

SEQ ID NO: 1132827 - RNA, 19 nt, Homo sapiens
gaggaugacaggcacuugu

SEQ ID NO: 1132828 - RNA, 19 nt, Homo sapiens
ggaagaaggaaugagaagu

SEQ ID NO: 1132829 - RNA, 19 nt, Homo sapiens
gcaaacagagaagaucuac

SEQ ID NO: 1132830 - RNA, 19 nt, Homo sapiens
acaaauuucaggcuaagga

SEQ ID NO: 1132831 - RNA, 19 nt, Homo sapiens
cagcagacaccuacaucga

SEQ ID NO: 1132832 - RNA, 19 nt, Homo sapiens
gguggacagcucaguauuc

SEQ ID NO: 1132833 - RNA, 19 nt, Homo sapiens
ggcaaacagagaagaucua

SEQ ID NO: 1132834 - RNA, 19 nt, Homo sapiens
uggcccagcuggucuaugg

SEQ ID NO: 1132835 - RNA, 19 nt, Homo sapiens
aguacgauauggugacaga

SEQ ID NO: 1132836 - RNA, 19 nt, Homo sapiens
ggcaagggaagaaggaaug

SEQ ID NO: 1132837 - RNA, 19 nt, Homo sapiens
ucucacucccauacauuua

SEQ ID NO: 1132838 - RNA, 19 nt, Homo sapiens
gagcugcgggacuucaaga

SEQ ID NO: 1132839 - RNA, 19 nt, Homo sapiens
cuacacaaucucucaagug

SEQ ID NO: 1132840 - RNA, 19 nt, Homo sapiens
cugcgggacuucaagaaca

SEQ ID NO: 1132841 - RNA, 19 nt, Homo sapiens
ugacuguacguuccuucua

SEQ ID NO: 1132842 - RNA, 19 nt, Homo sapiens
gacagcagcaccaccuugu

SEQ ID NO: 1132843 - RNA, 19 nt, Homo sapiens
gugagauggagaacacuuu

SEQ ID NO: 1132844 - RNA, 19 nt, Homo sapiens
acuagcugcuuuagaggaa

SEQ ID NO: 1132845 - RNA, 19 nt, Homo sapiens
cugcugagcugcgggacuu

SEQ ID NO: 1132846 - RNA, 19 nt, Homo sapiens
cuccagauccugaguaauc

SEQ ID NO: 1132847 - RNA, 19 nt, Homo sapiens
gagaacgccagcucuaugc

SEQ ID NO: 1132848 - RNA, 19 nt, Homo sapiens
gagcgggaggcacucagaa

SEQ ID NO: 1132849 - RNA, 19 nt, Homo sapiens
guggugagauggagaacac

SEQ ID NO: 1132850 - RNA, 19 nt, Homo sapiens
ugguggagguggugagaug

SEQ ID NO: 1132851 - RNA, 19 nt, Homo sapiens
gaugggacacagaaugaca

SEQ ID NO: 1132852 - RNA, 19 nt, Homo sapiens
gaagauucugaagcgauuu

SEQ ID NO: 1132853 - RNA, 19 nt, Homo sapiens
gaacagaaacaaccaaaua

SEQ ID NO: 1132854 - RNA, 19 nt, Homo sapiens
gaagggagccuauauagaa

SEQ ID NO: 1132855 - RNA, 19 nt, Homo sapiens
ccaaauauguguuuacuga

SEQ ID NO: 1132856 - RNA, 19 nt, Homo sapiens
gaagagcgaguaccaauaa

SEQ ID NO: 1132857 - RNA, 19 nt, Homo sapiens
caagaaaccuacauuuaug

SEQ ID NO: 1132858 - RNA, 19 nt, Homo sapiens
caagaccuaugaagauaua

SEQ ID NO: 1132859 - RNA, 19 nt, Homo sapiens
ccaagaaaccuacauuuau

SEQ ID NO: 1132860 - RNA, 19 nt, Homo sapiens
ccaccaaccuauaagcuaa

SEQ ID NO: 1132861 - RNA, 19 nt, Homo sapiens
ugaggaaguucaaagcaua

SEQ ID NO: 1132862 - RNA, 19 nt, Homo sapiens
gaacuaacacugcagacuu

SEQ ID NO: 1132863 - RNA, 19 nt, Homo sapiens
cacaagaccuaugaagaua

SEQ ID NO: 1132864 - RNA, 19 nt, Homo sapiens
ccuauaagcuaaugacuca

SEQ ID NO: 1132865 - RNA, 19 nt, Homo sapiens
gaagaacgggaccgaauga

SEQ ID NO: 1132866 - RNA, 19 nt, Homo sapiens
uaagccagcuauacaagaa

SEQ ID NO: 1132867 - RNA, 19 nt, Homo sapiens
ggaagagcgaguaccaaua

SEQ ID NO: 1132868 - RNA, 19 nt, Homo sapiens
gaacgggaccgaaugauac

SEQ ID NO: 1132869 - RNA, 19 nt, Homo sapiens
gaaacaaccaaauaugugu

SEQ ID NO: 1132870 - RNA, 19 nt, Homo sapiens
gcugagggaauaaauuuaa

SEQ ID NO: 1132871 - RNA, 19 nt, Homo sapiens
gcacagaagggagccuaua

SEQ ID NO: 1132872 - RNA, 19 nt, Homo sapiens
gcagcuaaaguacgauuaa

SEQ ID NO: 1132873 - RNA, 19 nt, Homo sapiens
aacuaacacugcagacuua

SEQ ID NO: 1132874 - RNA, 19 nt, Homo sapiens
cagaguauaucaagguuca

SEQ ID NO: 1132875 - RNA, 19 nt, Homo sapiens
gaccgaaugauacaaguuu

SEQ ID NO: 1132876 - RNA, 19 nt, Homo sapiens
ucacaagaccuaugaagau

SEQ ID NO: 1132877 - RNA, 19 nt, Homo sapiens
gagcgaguaccaauaaaug

SEQ ID NO: 1132878 - RNA, 19 nt, Homo sapiens
ggaauggugugguauuuug

SEQ ID NO: 1132879 - RNA, 19 nt, Homo sapiens
gaccaagaaaccuacauuu

SEQ ID NO: 1132880 - RNA, 19 nt, Homo sapiens
ggaagaacgggaccgaaug

SEQ ID NO: 1132881 - RNA, 19 nt, Homo sapiens
uguguuagcugaagauaag

SEQ ID NO: 1132882 - RNA, 19 nt, Homo sapiens
gaaguucaaagcauacuca

SEQ ID NO: 1132883 - RNA, 19 nt, Homo sapiens
guggaauggugugguauuu

SEQ ID NO: 1132884 - RNA, 19 nt, Homo sapiens
caagauacuuugguggaau

SEQ ID NO: 1132885 - RNA, 19 nt, Homo sapiens
cagaaacaaccaaauaugu

SEQ ID NO: 1132886 - RNA, 19 nt, Homo sapiens
cagcuaaaguacgauuaaa

SEQ ID NO: 1132887 - RNA, 19 nt, Homo sapiens
ggcuugaacuugcagaaga

SEQ ID NO: 1132888 - RNA, 19 nt, Homo sapiens
uaacacugcagacuuauca

SEQ ID NO: 1132889 - RNA, 19 nt, Homo sapiens
gggagccuauauagaacua

SEQ ID NO: 1132890 - RNA, 19 nt, Homo sapiens
accaagaaaccuacauuua

SEQ ID NO: 1132891 - RNA, 19 nt, Homo sapiens
ugaggcagcuaaaguacga

SEQ ID NO: 1132892 - RNA, 19 nt, Homo sapiens
gcagacuuaucaagaagca

SEQ ID NO: 1132893 - RNA, 19 nt, Homo sapiens
ugaagccaccaaccuauaa

SEQ ID NO: 1132894 - RNA, 19 nt, Homo sapiens
acagaagggagccuauaua

SEQ ID NO: 1132895 - RNA, 19 nt, Homo sapiens
uaucaagguucaucacaag

SEQ ID NO: 1132896 - RNA, 19 nt, Homo sapiens
ccagagaccaagaaaccua

SEQ ID NO: 1132897 - RNA, 19 nt, Homo sapiens
gaagcacucagucgccauu

SEQ ID NO: 1132898 - RNA, 19 nt, Homo sapiens
gaacugaagccaccaaccu

SEQ ID NO: 1132899 - RNA, 19 nt, Homo sapiens
gaccagauucagagagauu

SEQ ID NO: 1132900 - RNA, 19 nt, Homo sapiens
agaacgggaccgaaugaua

SEQ ID NO: 1132901 - RNA, 19 nt, Homo sapiens
cagaagggagccuauauag

SEQ ID NO: 1132902 - RNA, 19 nt, Homo sapiens
ccacagaguauaucaaggu

SEQ ID NO: 1132903 - RNA, 19 nt, Homo sapiens
gggaagaacgggaccgaau

SEQ ID NO: 1132904 - RNA, 19 nt, Homo sapiens
gauugaugguuugcugauu

SEQ ID NO: 1132905 - RNA, 19 nt, Homo sapiens
ugaacuugcagaagacuuu

SEQ ID NO: 1132906 - RNA, 19 nt, Homo sapiens
gaguaccaauaaaugaugu

SEQ ID NO: 1132907 - RNA, 19 nt, Homo sapiens
cuacaagacaggcaguuga

SEQ ID NO: 1132908 - RNA, 19 nt, Homo sapiens
ccagauucagagagauuua

SEQ ID NO: 1132909 - RNA, 19 nt, Homo sapiens
gcguggaacgggucuguuu

SEQ ID NO: 1132910 - RNA, 19 nt, Homo sapiens
gauaagauuuuggaaggaa

SEQ ID NO: 1132911 - RNA, 19 nt, Homo sapiens
acaagauacuuugguggaa

SEQ ID NO: 1132912 - RNA, 19 nt, Homo sapiens
ucucugcuuugcccaguuu

SEQ ID NO: 1132913 - RNA, 19 nt, Homo sapiens
agaaacaaccaaauaugug

SEQ ID NO: 1132914 - RNA, 19 nt, Homo sapiens
ggaacagaaacaaccaaau

SEQ ID NO: 1132915 - RNA, 19 nt, Homo sapiens
ccucggaacaacuguauug

SEQ ID NO: 1132916 - RNA, 19 nt, Homo sapiens
cugcugagggaauaaauuu

SEQ ID NO: 1132917 - RNA, 19 nt, Homo sapiens
caacuugguccagcuguau

SEQ ID NO: 1132918 - RNA, 19 nt, Homo sapiens
ggaccgaaugauacaaguu

SEQ ID NO: 1132919 - RNA, 19 nt, Homo sapiens
gagccuauauagaacuaac

SEQ ID NO: 1132920 - RNA, 19 nt, Homo sapiens
acagaaacaaccaaauaug

SEQ ID NO: 1132921 - RNA, 19 nt, Homo sapiens
ugacaggcuugaacuugca

SEQ ID NO: 1132922 - RNA, 19 nt, Homo sapiens
gcacucagucgccauucug

SEQ ID NO: 1132923 - RNA, 19 nt, Homo sapiens
cacagaguauaucaagguu

SEQ ID NO: 1132924 - RNA, 19 nt, Homo sapiens
cagauuccacagaguauau

SEQ ID NO: 1132925 - RNA, 19 nt, Homo sapiens
gaaaaucuuaggacuaugu

SEQ ID NO: 1132926 - RNA, 19 nt, Homo sapiens
gaaggaacagaaacaacca

SEQ ID NO: 1132927 - RNA, 19 nt, Homo sapiens
acugcagacuuaucaagaa

SEQ ID NO: 1132928 - RNA, 19 nt, Homo sapiens
aaccuacauuuauggauga

SEQ ID NO: 1132929 - RNA, 19 nt, Homo sapiens
uguccucaaucucugcuuu

SEQ ID NO: 1132930 - RNA, 19 nt, Homo sapiens
gcgaguaccaauaaaugau

SEQ ID NO: 1132931 - RNA, 19 nt, Homo sapiens
uggaagaggcuacaagaca

SEQ ID NO: 1132932 - RNA, 19 nt, Homo sapiens
aagauacuuugguggaaug

SEQ ID NO: 1132933 - RNA, 19 nt, Homo sapiens
gagccagauuccacagagu

SEQ ID NO: 1132934 - RNA, 19 nt, Homo sapiens
gaugaggaaguucaaagca

SEQ ID NO: 1132935 - RNA, 19 nt, Homo sapiens
gaaaccuacauuuauggau

SEQ ID NO: 1132936 - RNA, 19 nt, Homo sapiens
gccaccaaccuauaagcua

SEQ ID NO: 1132937 - RNA, 19 nt, Homo sapiens
caaagcauacucacgaaaa

SEQ ID NO: 1132938 - RNA, 19 nt, Homo sapiens
accgaaugauacaaguuua

SEQ ID NO: 1132939 - RNA, 19 nt, Homo sapiens
agaagggagccuauauaga

SEQ ID NO: 1132940 - RNA, 19 nt, Homo sapiens
cacagaagggagccuauau

SEQ ID NO: 1132941 - RNA, 19 nt, Homo sapiens
auugaugguuugcugauug

SEQ ID NO: 1132942 - RNA, 19 nt, Homo sapiens
gguggaauggugugguauu

SEQ ID NO: 1132943 - RNA, 19 nt, Homo sapiens
ucaaagcauacucacgaaa

SEQ ID NO: 1132944 - RNA, 19 nt, Homo sapiens
guuggaagaggcuacaaga

SEQ ID NO: 1132945 - RNA, 19 nt, Homo sapiens
cagauucagagagauuuaa

SEQ ID NO: 1132946 - RNA, 19 nt, Homo sapiens
auaucaagguucaucacaa

SEQ ID NO: 1132947 - RNA, 19 nt, Homo sapiens
ccagauuccacagaguaua

SEQ ID NO: 1132948 - RNA, 19 nt, Homo sapiens
gaaaaugacaggcuugaac

SEQ ID NO: 1132949 - RNA, 19 nt, Homo sapiens
ccaaaagaaggucguaaaa

SEQ ID NO: 1132950 - RNA, 19 nt, Homo sapiens
cgaguaccaauaaaugaug

SEQ ID NO: 1132951 - RNA, 19 nt, Homo sapiens
agaccaagaaaccuacauu

SEQ ID NO: 1132952 - RNA, 19 nt, Homo sapiens
cugaagccaccaaccuaua

SEQ ID NO: 1132953 - RNA, 19 nt, Homo sapiens
aaacgcagguucuuauuaa

SEQ ID NO: 1132954 - RNA, 19 nt, Homo sapiens
ccacagaauuauacagaua

SEQ ID NO: 1132955 - RNA, 19 nt, Homo sapiens
gauaguaguuccucuucua

SEQ ID NO: 1132956 - RNA, 19 nt, Homo sapiens
gcuaguaacagaaacauua

SEQ ID NO: 1132957 - RNA, 19 nt, Homo sapiens
caacagaaauguagagagu

SEQ ID NO: 1132958 - RNA, 19 nt, Homo sapiens
caagacagcuaguaacaga

SEQ ID NO: 1132959 - RNA, 19 nt, Homo sapiens
ccuaauagcucuucagaau

SEQ ID NO: 1132960 - RNA, 19 nt, Homo sapiens
aaagaaagcugaagagagu

SEQ ID NO: 1132961 - RNA, 19 nt, Homo sapiens
gagacuagcccuaccauaa

SEQ ID NO: 1132962 - RNA, 19 nt, Homo sapiens
gaugaacgguuaacaacaa

SEQ ID NO: 1132963 - RNA, 19 nt, Homo sapiens
gaagaaccacagaauuaua

SEQ ID NO: 1132964 - RNA, 19 nt, Homo sapiens
ggaauagguucuacaguuc

SEQ ID NO: 1132965 - RNA, 19 nt, Homo sapiens
aaucaaagcucuguuagaa

SEQ ID NO: 1132966 - RNA, 19 nt, Homo sapiens
gcaguuauaucaagugcaa

SEQ ID NO: 1132967 - RNA, 19 nt, Homo sapiens
aagaagaaccacagaauua

SEQ ID NO: 1132968 - RNA, 19 nt, Homo sapiens
aagcugacaucaccaguua

SEQ ID NO: 1132969 - RNA, 19 nt, Homo sapiens
ggagcaaucacccacauua

SEQ ID NO: 1132970 - RNA, 19 nt, Homo sapiens
gcaaagccagcuauccuua

SEQ ID NO: 1132971 - RNA, 19 nt, Homo sapiens
gcuaaaugcuggaggagaa

SEQ ID NO: 1132972 - RNA, 19 nt, Homo sapiens
ggagagcaguaaacgauga

SEQ ID NO: 1132973 - RNA, 19 nt, Homo sapiens
gucaacagcuggaugauga

SEQ ID NO: 1132974 - RNA, 19 nt, Homo sapiens
gcaagauaauuagcaguaa

SEQ ID NO: 1132975 - RNA, 19 nt, Homo sapiens
gaaguacuguuuaugucaa

SEQ ID NO: 1132976 - RNA, 19 nt, Homo sapiens
uugaagagauggacacuuu

SEQ ID NO: 1132977 - RNA, 19 nt, Homo sapiens
caagacaacccacuauuga

SEQ ID NO: 1132978 - RNA, 19 nt, Homo sapiens
gagcauugccaacuccuua

SEQ ID NO: 1132979 - RNA, 19 nt, Homo sapiens
aguaaacgaugaacgguua

SEQ ID NO: 1132980 - RNA, 19 nt, Homo sapiens
gaacccagcccuucucaga

SEQ ID NO: 1132981 - RNA, 19 nt, Homo sapiens
gcgaggaacuuggaacuga

SEQ ID NO: 1132982 - RNA, 19 nt, Homo sapiens
gaaaaugucuuugauggaa

SEQ ID NO: 1132983 - RNA, 19 nt, Homo sapiens
caaacaagacagcuaguaa

SEQ ID NO: 1132984 - RNA, 19 nt, Homo sapiens
cagcagggaugaaugcaaa

SEQ ID NO: 1132985 - RNA, 19 nt, Homo sapiens
caacacagaagguuauuau

SEQ ID NO: 1132986 - RNA, 19 nt, Homo sapiens
cuaaacaacuucacuaguc

SEQ ID NO: 1132987 - RNA, 19 nt, Homo sapiens
gaagagaguccagcagaaa

SEQ ID NO: 1132988 - RNA, 19 nt, Homo sapiens
gaagccaccaguuguuaua

SEQ ID NO: 1132989 - RNA, 19 nt, Homo sapiens
gcuaaacagcagaaacuua

SEQ ID NO: 1132990 - RNA, 19 nt, Homo sapiens
acacaauagugcacuuuaa

SEQ ID NO: 1132991 - RNA, 19 nt, Homo sapiens
gauggaagcucagauugau

SEQ ID NO: 1132992 - RNA, 19 nt, Homo sapiens
gugcaauuaugacaacuaa

SEQ ID NO: 1132993 - RNA, 19 nt, Homo sapiens
ccacaugucuccuguaaaa

SEQ ID NO: 1132994 - RNA, 19 nt, Homo sapiens
uaauagcucuucagaaugg

SEQ ID NO: 1132995 - RNA, 19 nt, Homo sapiens
ggaggcauaugcuggaguu

SEQ ID NO: 1132996 - RNA, 19 nt, Homo sapiens
guacccaaaucauuagcua

SEQ ID NO: 1132997 - RNA, 19 nt, Homo sapiens
uaugacaacuaaacuggua

SEQ ID NO: 1132998 - RNA, 19 nt, Homo sapiens
cugaauacaucacuacuga

SEQ ID NO: 1132999 - RNA, 19 nt, Homo sapiens
ccaaaccgccuuuacugua

SEQ ID NO: 1133000 - RNA, 19 nt, Homo sapiens
aagcucagauugauacaaa

SEQ ID NO: 1133001 - RNA, 19 nt, Homo sapiens
gcugguaauucaucuauuc

SEQ ID NO: 1133002 - RNA, 19 nt, Homo sapiens
aggaauagguucuacaguu

SEQ ID NO: 1133003 - RNA, 19 nt, Homo sapiens
gaacgguuaacaacaauug

SEQ ID NO: 1133004 - RNA, 19 nt, Homo sapiens
agacucagcugcaagugaa

SEQ ID NO: 1133005 - RNA, 19 nt, Homo sapiens
gacuagcccuaccauaauu

SEQ ID NO: 1133006 - RNA, 19 nt, Homo sapiens
caacaacacagaagguuau

SEQ ID NO: 1133007 - RNA, 19 nt, Homo sapiens
uaaacaacuucacuaguca

SEQ ID NO: 1133008 - RNA, 19 nt, Homo sapiens
acccaaggauccucuguua

SEQ ID NO: 1133009 - RNA, 19 nt, Homo sapiens
gguagagucagaacuagua

SEQ ID NO: 1133010 - RNA, 19 nt, Homo sapiens
uaauaugucuggaccuaau

SEQ ID NO: 1133011 - RNA, 19 nt, Homo sapiens
gaacgguccuaguguuugg

SEQ ID NO: 1133012 - RNA, 19 nt, Homo sapiens
ucaaagcucuguuagaacu

SEQ ID NO: 1133013 - RNA, 19 nt, Homo sapiens
gagcuaaacaacuucacua

SEQ ID NO: 1133014 - RNA, 19 nt, Homo sapiens
acuaguagcugaauacauc

SEQ ID NO: 1133015 - RNA, 19 nt, Homo sapiens
uagcaucauuacaguagua

SEQ ID NO: 1133016 - RNA, 19 nt, Homo sapiens
uaaacaacaucaacagucu

SEQ ID NO: 1133017 - RNA, 19 nt, Homo sapiens
uaauacaguugcaguaaca

SEQ ID NO: 1133018 - RNA, 19 nt, Homo sapiens
cauugaaggucgucgauug

SEQ ID NO: 1133019 - RNA, 19 nt, Homo sapiens
gagaguccagcagaaauua

SEQ ID NO: 1133020 - RNA, 19 nt, Homo sapiens
gauccucuguuacaaagau

SEQ ID NO: 1133021 - RNA, 19 nt, Homo sapiens
gccuguaguucauguaauu

SEQ ID NO: 1133022 - RNA, 19 nt, Homo sapiens
guaccaacgucagucauug

SEQ ID NO: 1133023 - RNA, 19 nt, Homo sapiens
cacagaagguuauuauagu

SEQ ID NO: 1133024 - RNA, 19 nt, Homo sapiens
ccaaguggaaguacuguuu

SEQ ID NO: 1133025 - RNA, 19 nt, Homo sapiens
gcugaacgguccuaguguu

SEQ ID NO: 1133026 - RNA, 19 nt, Homo sapiens
caaguggaaguacuguuua

SEQ ID NO: 1133027 - RNA, 19 nt, Homo sapiens
gaaguucggagagcaguaa

SEQ ID NO: 1133028 - RNA, 19 nt, Homo sapiens
gggaaacccuuguauuuug

SEQ ID NO: 1133029 - RNA, 19 nt, Homo sapiens
caacuucacuagucaacag

SEQ ID NO: 1133030 - RNA, 19 nt, Homo sapiens
gaagagauggacacuuuag

SEQ ID NO: 1133031 - RNA, 19 nt, Homo sapiens
gcaauuaugacaacuaaac

SEQ ID NO: 1133032 - RNA, 19 nt, Homo sapiens
caacaaacacaacaacaca

SEQ ID NO: 1133033 - RNA, 19 nt, Homo sapiens
gcagcuauccagcauaaug

SEQ ID NO: 1133034 - RNA, 19 nt, Homo sapiens
gcacggaggauggaacuga

SEQ ID NO: 1133035 - RNA, 19 nt, Homo sapiens
ugaagagaguccagcagaa

SEQ ID NO: 1133036 - RNA, 19 nt, Homo sapiens
gcacaaacucccgcaaaug

SEQ ID NO: 1133037 - RNA, 19 nt, Homo sapiens
ccaagacaacccacuauug

SEQ ID NO: 1133038 - RNA, 19 nt, Homo sapiens
ucacaacguugcuaaaugc

SEQ ID NO: 1133039 - RNA, 19 nt, Homo sapiens
ggcaagauaauuagcagua

SEQ ID NO: 1133040 - RNA, 19 nt, Homo sapiens
aguaguacccaaaucauua

SEQ ID NO: 1133041 - RNA, 19 nt, Homo sapiens
acagugagcccauccauug

SEQ ID NO: 1133042 - RNA, 19 nt, Homo sapiens
gcaacucuacccaccagua

SEQ ID NO: 1133043 - RNA, 19 nt, Homo sapiens
caacaucaacagucuccua

SEQ ID NO: 1133044 - RNA, 19 nt, Homo sapiens
caucaacacagacaacaaa

SEQ ID NO: 1133045 - RNA, 19 nt, Homo sapiens
aguguaagcuguucagaug

SEQ ID NO: 1133046 - RNA, 19 nt, Homo sapiens
ggaaguacuguuuauguca

SEQ ID NO: 1133047 - RNA, 19 nt, Homo sapiens
gagcaggacauagacagua

SEQ ID NO: 1133048 - RNA, 19 nt, Homo sapiens
ccaaggauccucuguuaca

SEQ ID NO: 1133049 - RNA, 19 nt, Homo sapiens
ggaacagacucagcugcaa

SEQ ID NO: 1133050 - RNA, 19 nt, Homo sapiens
ucacagaccgcaacacaga

SEQ ID NO: 1133051 - RNA, 19 nt, Homo sapiens
caauggagcaggacauaga

SEQ ID NO: 1133052 - RNA, 19 nt, Homo sapiens
cagcagaaauuaucaucca

SEQ ID NO: 1133053 - RNA, 19 nt, Homo sapiens
ggaaggaccuauauuugua

SEQ ID NO: 1133054 - RNA, 19 nt, Homo sapiens
gaacaaggauuccaagaag

SEQ ID NO: 1133055 - RNA, 19 nt, Homo sapiens
caucgacacuucaacauua

SEQ ID NO: 1133056 - RNA, 19 nt, Homo sapiens
gaacaaagaacgugcuaaa

SEQ ID NO: 1133057 - RNA, 19 nt, Homo sapiens
gaagcaaguuaaaggauuu

SEQ ID NO: 1133058 - RNA, 19 nt, Homo sapiens
aaagagaaauggucaugua

SEQ ID NO: 1133059 - RNA, 19 nt, Homo sapiens
gagaaauggucauguauuc

SEQ ID NO: 1133060 - RNA, 19 nt, Homo sapiens
ggaggaaggaccuauauuu

SEQ ID NO: 1133061 - RNA, 19 nt, Homo sapiens
ggaauauacugaaggcauu

SEQ ID NO: 1133062 - RNA, 19 nt, Homo sapiens
gaagaaauccgagcaguug

SEQ ID NO: 1133063 - RNA, 19 nt, Homo sapiens
cagcagaucuugaccuuau

SEQ ID NO: 1133064 - RNA, 19 nt, Homo sapiens
gagagagucuguagagaau

SEQ ID NO: 1133065 - RNA, 19 nt, Homo sapiens
cgacagauaaucaaacuaa

SEQ ID NO: 1133066 - RNA, 19 nt, Homo sapiens
ucacuaagacgacagauaa

SEQ ID NO: 1133067 - RNA, 19 nt, Homo sapiens
gaaauggaauauacugaag

SEQ ID NO: 1133068 - RNA, 19 nt, Homo sapiens
gagagucuguagagaauug

SEQ ID NO: 1133069 - RNA, 19 nt, Homo sapiens
cucaacagcuggaaauaua

SEQ ID NO: 1133070 - RNA, 19 nt, Homo sapiens
guaaagguauauucuguca

SEQ ID NO: 1133071 - RNA, 19 nt, Homo sapiens
gccaaacgcugaccuggaa

SEQ ID NO: 1133072 - RNA, 19 nt, Homo sapiens
gaaauggucauguauucaa

SEQ ID NO: 1133073 - RNA, 19 nt, Homo sapiens
ucagucaacucccuuuaaa

SEQ ID NO: 1133074 - RNA, 19 nt, Homo sapiens
ggagagagucuguagagaa

SEQ ID NO: 1133075 - RNA, 19 nt, Homo sapiens
guacuuacgcugagugaaa

SEQ ID NO: 1133076 - RNA, 19 nt, Homo sapiens
gcacauugaagcaaguuaa

SEQ ID NO: 1133077 - RNA, 19 nt, Homo sapiens
ggaauuguuguguaaagua

SEQ ID NO: 1133078 - RNA, 19 nt, Homo sapiens
gaggaaggaccuauauuug

SEQ ID NO: 1133079 - RNA, 19 nt, Homo sapiens
uaaauaggcuccaguuuug

SEQ ID NO: 1133080 - RNA, 19 nt, Homo sapiens
guagcuuucuggcugcuua

SEQ ID NO: 1133081 - RNA, 19 nt, Homo sapiens
ugaagcaaguuaaaggauu

SEQ ID NO: 1133082 - RNA, 19 nt, Homo sapiens
caaagaacgugcuaaaaga

SEQ ID NO: 1133083 - RNA, 19 nt, Homo sapiens
cagaugaccugacuguugu

SEQ ID NO: 1133084 - RNA, 19 nt, Homo sapiens
gcacuugguuuucuauaaa

SEQ ID NO: 1133085 - RNA, 19 nt, Homo sapiens
agaugcagcuucacuaaga

SEQ ID NO: 1133086 - RNA, 19 nt, Homo sapiens
ggacagcuggucagaaaug

SEQ ID NO: 1133087 - RNA, 19 nt, Homo sapiens
caagaaggaguuccaaaug

SEQ ID NO: 1133088 - RNA, 19 nt, Homo sapiens
gcugagauggcagaaauua

SEQ ID NO: 1133089 - RNA, 19 nt, Homo sapiens
ggagaggauuguuguagca

SEQ ID NO: 1133090 - RNA, 19 nt, Homo sapiens
ggaccuauauuuguagaag

SEQ ID NO: 1133091 - RNA, 19 nt, Homo sapiens
aagcagauagugccaaaua

SEQ ID NO: 1133092 - RNA, 19 nt, Homo sapiens
ggaagaggagaacaaagaa

SEQ ID NO: 1133093 - RNA, 19 nt, Homo sapiens
gcaccggaguacacuguga

SEQ ID NO: 1133094 - RNA, 19 nt, Homo sapiens
gaacaagcagugacacauc

SEQ ID NO: 1133095 - RNA, 19 nt, Homo sapiens
uauguuaccugaagaugga

SEQ ID NO: 1133096 - RNA, 19 nt, Homo sapiens
cgaaugagggucccagaaa

SEQ ID NO: 1133097 - RNA, 19 nt, Homo sapiens
gaauauacugaaggcauua

SEQ ID NO: 1133098 - RNA, 19 nt, Homo sapiens
cgaaccaccuaauauuuca

SEQ ID NO: 1133099 - RNA, 19 nt, Homo sapiens
aaacucgaaccaccuaaua

SEQ ID NO: 1133100 - RNA, 19 nt, Homo sapiens
ccacccaacugauucugaa

SEQ ID NO: 1133101 - RNA, 19 nt, Homo sapiens
gguaacaucagcccucaaa

SEQ ID NO: 1133102 - RNA, 19 nt, Homo sapiens
gugaaagaccacuagauuu

SEQ ID NO: 1133103 - RNA, 19 nt, Homo sapiens
guaaauaggcuccaguuuu

SEQ ID NO: 1133104 - RNA, 19 nt, Homo sapiens
caacagcuggaaauauaaa

SEQ ID NO: 1133105 - RNA, 19 nt, Homo sapiens
ggucauguauucaauuacu

SEQ ID NO: 1133106 - RNA, 19 nt, Homo sapiens
guagaugcagcuucacuaa

SEQ ID NO: 1133107 - RNA, 19 nt, Homo sapiens
uccaaaugcuagugugaua

SEQ ID NO: 1133108 - RNA, 19 nt, Homo sapiens
gaaggaguuccaaaugcua

SEQ ID NO: 1133109 - RNA, 19 nt, Homo sapiens
gaaaagcaguguccguguu

SEQ ID NO: 1133110 - RNA, 19 nt, Homo sapiens
cagaauaagguacaaaugu

SEQ ID NO: 1133111 - RNA, 19 nt, Homo sapiens
uaacauugcagcaguuuca

SEQ ID NO: 1133112 - RNA, 19 nt, Homo sapiens
gaaguaaagguauauucug

SEQ ID NO: 1133113 - RNA, 19 nt, Homo sapiens
ugaccugacuguuguagau

SEQ ID NO: 1133114 - RNA, 19 nt, Homo sapiens
gaucuugaccuuauucagu

SEQ ID NO: 1133115 - RNA, 19 nt, Homo sapiens
caaauagcaagcaguaguu

SEQ ID NO: 1133116 - RNA, 19 nt, Homo sapiens
cgaaauggaauauacugaa

SEQ ID NO: 1133117 - RNA, 19 nt, Homo sapiens
gaaugagggucccagaaaa

SEQ ID NO: 1133118 - RNA, 19 nt, Homo sapiens
caguaguuguuacacauuu

SEQ ID NO: 1133119 - RNA, 19 nt, Homo sapiens
gaaaaucgcagaccugugu

SEQ ID NO: 1133120 - RNA, 19 nt, Homo sapiens
gaucuuggaugugcuggau

SEQ ID NO: 1133121 - RNA, 19 nt, Homo sapiens
ccaagaaggaguuccaaau

SEQ ID NO: 1133122 - RNA, 19 nt, Homo sapiens
ggacaaaaguggcucucaa

SEQ ID NO: 1133123 - RNA, 19 nt, Homo sapiens
agaagcagauagugccaaa

SEQ ID NO: 1133124 - RNA, 19 nt, Homo sapiens
agaccuguauuuacuguau

SEQ ID NO: 1133125 - RNA, 19 nt, Homo sapiens
gcagcaguuucauaugugu

SEQ ID NO: 1133126 - RNA, 19 nt, Homo sapiens
cgucagguauggcauuuca

SEQ ID NO: 1133127 - RNA, 19 nt, Homo sapiens
uuagaaagaccuccuacaa

SEQ ID NO: 1133128 - RNA, 19 nt, Homo sapiens
gcaucgacacuucaacauu

SEQ ID NO: 1133129 - RNA, 19 nt, Homo sapiens
aaagguauauucugucacu

SEQ ID NO: 1133130 - RNA, 19 nt, Homo sapiens
gacgacagauaaucaaacu

SEQ ID NO: 1133131 - RNA, 19 nt, Homo sapiens
gggcauaccagcagaucuu

SEQ ID NO: 1133132 - RNA, 19 nt, Homo sapiens
ccaaauagcaagcaguagu

SEQ ID NO: 1133133 - RNA, 19 nt, Homo sapiens
gaaacucgaaccaccuaau

SEQ ID NO: 1133134 - RNA, 19 nt, Homo sapiens
gcacaugcacauugaagca

SEQ ID NO: 1133135 - RNA, 19 nt, Homo sapiens
ccagaaaaguuaaaaguag

SEQ ID NO: 1133136 - RNA, 19 nt, Homo sapiens
auggacagcuggucagaaa

SEQ ID NO: 1133137 - RNA, 19 nt, Homo sapiens
ugaaagaccacuagauuuu

SEQ ID NO: 1133138 - RNA, 19 nt, Homo sapiens
caaaugcuagugugauaau

SEQ ID NO: 1133139 - RNA, 19 nt, Homo sapiens
aauaaacugucaaccaaag

SEQ ID NO: 1133140 - RNA, 19 nt, Homo sapiens
uggaagaggagaacaaaga

SEQ ID NO: 1133141 - RNA, 19 nt, Homo sapiens
gcaguaguuguuacacauu

SEQ ID NO: 1133142 - RNA, 19 nt, Homo sapiens
gaaaagugucugugaaaga

SEQ ID NO: 1133143 - RNA, 19 nt, Homo sapiens
gagaacaaagaacgugcua

SEQ ID NO: 1133144 - RNA, 19 nt, Homo sapiens
gacagaauaagguacaaau

SEQ ID NO: 1133145 - RNA, 19 nt, Homo sapiens
cagcuggucagaaaugauu

SEQ ID NO: 1133146 - RNA, 19 nt, Homo sapiens
gacagcuggucagaaauga

SEQ ID NO: 1133147 - RNA, 19 nt, Homo sapiens
gaccuguauuuacuguauu

SEQ ID NO: 1133148 - RNA, 19 nt, Homo sapiens
uugcagcaguuucauaugu

SEQ ID NO: 1133149 - RNA, 19 nt, Homo sapiens
gggaauuguuguguaaagu

SEQ ID NO: 1133150 - RNA, 19 nt, Homo sapiens
gggagagagucuguagaga

SEQ ID NO: 1133151 - RNA, 19 nt, Homo sapiens
gaaggaccuauauuuguag

SEQ ID NO: 1133152 - RNA, 19 nt, Homo sapiens
gcaagcaguaguuguuaca

SEQ ID NO: 1133153 - RNA, 19 nt, Homo sapiens
gaagccaucugguucuuag

SEQ ID NO: 1133154 - RNA, 19 nt, Homo sapiens
ggaaauuguagccuaagua

SEQ ID NO: 1133155 - RNA, 19 nt, Homo sapiens
gagaaugcucugcaguuua

SEQ ID NO: 1133156 - RNA, 19 nt, Homo sapiens
aaaggaaauuguagccuaa

SEQ ID NO: 1133157 - RNA, 19 nt, Homo sapiens
caacuccacgggaauauaa

SEQ ID NO: 1133158 - RNA, 19 nt, Homo sapiens
ucacagguguagcuuacua

SEQ ID NO: 1133159 - RNA, 19 nt, Homo sapiens
gaagauggaaugaaaccuu

SEQ ID NO: 1133160 - RNA, 19 nt, Homo sapiens
gccguaaucucaucagguu

SEQ ID NO: 1133161 - RNA, 19 nt, Homo sapiens
gaaauuguagccuaaguag

SEQ ID NO: 1133162 - RNA, 19 nt, Homo sapiens
agaaugcucugcaguuuag

SEQ ID NO: 1133163 - RNA, 19 nt, Homo sapiens
ccaguccucuuucccauug

SEQ ID NO: 1133164 - RNA, 19 nt, Homo sapiens
ucaacuccuuguaagauuu

SEQ ID NO: 1133165 - RNA, 19 nt, Homo sapiens
ccucaacccucuccgaaga

SEQ ID NO: 1133166 - RNA, 19 nt, Homo sapiens
gagcugaagccaucugguu

SEQ ID NO: 1133167 - RNA, 19 nt, Homo sapiens
gggcuuagucggagauuga

SEQ ID NO: 1133168 - RNA, 19 nt, Homo sapiens
ccacgggaauauaaacaau

SEQ ID NO: 1133169 - RNA, 19 nt, Homo sapiens
uguaagauuucccaguuug

SEQ ID NO: 1133170 - RNA, 19 nt, Homo sapiens
cuccgaagauggaaugaaa

SEQ ID NO: 1133171 - RNA, 19 nt, Homo sapiens
cuuguaagauuucccaguu

SEQ ID NO: 1133172 - RNA, 19 nt, Homo sapiens
ugacguuggucucccgaaa

SEQ ID NO: 1133173 - RNA, 19 nt, Homo sapiens
gcucugcaguuuaggcaau

SEQ ID NO: 1133174 - RNA, 19 nt, Homo sapiens
cucacaggcuuccagguua

SEQ ID NO: 1133175 - RNA, 19 nt, Homo sapiens
ccacccaauugcuggcuaa

SEQ ID NO: 1133176 - RNA, 19 nt, Homo sapiens
gaagccgaaucucccuaau

SEQ ID NO: 1133177 - RNA, 19 nt, Homo sapiens
ucucaaggccguaaucuca

SEQ ID NO: 1133178 - RNA, 19 nt, Homo sapiens
ugacugcggaguaugauga

SEQ ID NO: 1133179 - RNA, 19 nt, Homo sapiens
ggucuuagucacaggugua

SEQ ID NO: 1133180 - RNA, 19 nt, Homo sapiens
gguugggacauuaaucuuu

SEQ ID NO: 1133181 - RNA, 19 nt, Homo sapiens
cccaugcccuugaagcaaa

SEQ ID NO: 1133182 - RNA, 19 nt, Homo sapiens
ucuccaaccucguaaccaa

SEQ ID NO: 1133183 - RNA, 19 nt, Homo sapiens
ggaggggacuuugacuuuu

SEQ ID NO: 1133184 - RNA, 19 nt, Homo sapiens
cuaaagccaucaccaaagc

SEQ ID NO: 1133185 - RNA, 19 nt, Homo sapiens
gccuagagaccacccaauu

SEQ ID NO: 1133186 - RNA, 19 nt, Homo sapiens
ucacaggcuuccagguuag

SEQ ID NO: 1133187 - RNA, 19 nt, Homo sapiens
caucagguugggacauuaa

SEQ ID NO: 1133188 - RNA, 19 nt, Homo sapiens
ucaucagguugggacauua

SEQ ID NO: 1133189 - RNA, 19 nt, Homo sapiens
gcgacagcgugccaucaug

SEQ ID NO: 1133190 - RNA, 19 nt, Homo sapiens
gcuaaagccaucaccaaag

SEQ ID NO: 1133191 - RNA, 19 nt, Homo sapiens
ccaguuugguuucucuaca

SEQ ID NO: 1133192 - RNA, 19 nt, Homo sapiens
gcuaggggcugccuuaaag

SEQ ID NO: 1133193 - RNA, 19 nt, Homo sapiens
gcucaggccaccaauucuu

SEQ ID NO: 1133194 - RNA, 19 nt, Homo sapiens
ucaaggccguaaucucauc

SEQ ID NO: 1133195 - RNA, 19 nt, Homo sapiens
ccucacaggcuuccagguu

SEQ ID NO: 1133196 - RNA, 19 nt, Homo sapiens
ccacuaaugcugaguuugc

SEQ ID NO: 1133197 - RNA, 19 nt, Homo sapiens
ccuagagaccacccaauug

SEQ ID NO: 1133198 - RNA, 19 nt, Homo sapiens
ggacauuaaucuuuucaac

SEQ ID NO: 1133199 - RNA, 19 nt, Homo sapiens
guugggacauuaaucuuuu

SEQ ID NO: 1133200 - RNA, 19 nt, Homo sapiens
guucuguugcuccaccuua

SEQ ID NO: 1133201 - RNA, 19 nt, Homo sapiens
aggcucagcuccucuagag

SEQ ID NO: 1133202 - RNA, 19 nt, Homo sapiens
ccaacuccacgggaauaua

SEQ ID NO: 1133203 - RNA, 19 nt, Homo sapiens
caaccuggccggagagaac

SEQ ID NO: 1133204 - RNA, 19 nt, Homo sapiens
ccuuuacgcuguguagaga

SEQ ID NO: 1133205 - RNA, 19 nt, Homo sapiens
gguuaggcacugugaauag

SEQ ID NO: 1133206 - RNA, 19 nt, Homo sapiens
cgccacuaaugcugaguuu

SEQ ID NO: 1133207 - RNA, 19 nt, Homo sapiens
cggcucaggccaccaauuc

SEQ ID NO: 1133208 - RNA, 19 nt, Homo sapiens
agucacagguguagcuuac

SEQ ID NO: 1133209 - RNA, 19 nt, Homo sapiens
ugaagccaucugguucuua

SEQ ID NO: 1133210 - RNA, 19 nt, Homo sapiens
cagguuaggcacugugaau

SEQ ID NO: 1133211 - RNA, 19 nt, Homo sapiens
cccaauugcuggcuaaagc

SEQ ID NO: 1133212 - RNA, 19 nt, Homo sapiens
caguuugguuucucuacau

SEQ ID NO: 1133213 - RNA, 19 nt, Homo sapiens
uuguaagauuucccaguuu

SEQ ID NO: 1133214 - RNA, 19 nt, Homo sapiens
caacuccuuguaagauuuc

SEQ ID NO: 1133215 - RNA, 19 nt, Homo sapiens
gcuccaccuuauugucuca

SEQ ID NO: 1133216 - RNA, 19 nt, Homo sapiens
gcuccauccuccgccacua

SEQ ID NO: 1133217 - RNA, 19 nt, Homo sapiens
ucaacccucuccgaagaug

SEQ ID NO: 1133218 - RNA, 19 nt, Homo sapiens
agaagccgaaucucccuaa

SEQ ID NO: 1133219 - RNA, 19 nt, Homo sapiens
uucaacuccuuguaagauu

SEQ ID NO: 1133220 - RNA, 19 nt, Homo sapiens
guuaggcacugugaauagg

SEQ ID NO: 1133221 - RNA, 19 nt, Homo sapiens
ccugacccaugcccuugaa

SEQ ID NO: 1133222 - RNA, 19 nt, Homo sapiens
agauuucccaguuugguuu

SEQ ID NO: 1133223 - RNA, 19 nt, Homo sapiens
ccaaccucguaaccaaaug

SEQ ID NO: 1133224 - RNA, 19 nt, Homo sapiens
ggcacgaagugacguuggu

SEQ ID NO: 1133225 - RNA, 19 nt, Homo sapiens
gcaccuaccugaccaaauu

SEQ ID NO: 1133226 - RNA, 19 nt, Homo sapiens
caugaucgcugcaaagaug

SEQ ID NO: 1133227 - RNA, 19 nt, Homo sapiens
gaaccaauucucugucaaa

SEQ ID NO: 1133228 - RNA, 19 nt, Homo sapiens
acgcagcacucucgaauuu

SEQ ID NO: 1133229 - RNA, 19 nt, Homo sapiens
gcaucucgcuguucaagug

SEQ ID NO: 1133230 - RNA, 19 nt, Homo sapiens
gaaguacuuugaugguuca

SEQ ID NO: 1133231 - RNA, 19 nt, Homo sapiens
ggacgaugcccgugucauu

SEQ ID NO: 1133232 - RNA, 19 nt, Homo sapiens
ccaauucucugucaaaugc

SEQ ID NO: 1133233 - RNA, 19 nt, Homo sapiens
ucaaggaaaugcugcguau

SEQ ID NO: 1133234 - RNA, 19 nt, Homo sapiens
caucaacuaugccauguuc

SEQ ID NO: 1133235 - RNA, 19 nt, Homo sapiens
guucagagcccgugcagaa

SEQ ID NO: 1133236 - RNA, 19 nt, Homo sapiens
gaccgacccugccuaugaa

SEQ ID NO: 1133237 - RNA, 19 nt, Homo sapiens
gcaaugaggacaccaucaa

SEQ ID NO: 1133238 - RNA, 19 nt, Homo sapiens
caaauucauugcccgcuau

SEQ ID NO: 1133239 - RNA, 19 nt, Homo sapiens
gucaacaacugucaugaga

SEQ ID NO: 1133240 - RNA, 19 nt, Homo sapiens
gguguucucucgccgacua

SEQ ID NO: 1133241 - RNA, 19 nt, Homo sapiens
gaaaucaugcggaaccaau

SEQ ID NO: 1133242 - RNA, 19 nt, Homo sapiens
gaccucaucucccagaauc

SEQ ID NO: 1133243 - RNA, 19 nt, Homo sapiens
caagugaccggcuggauga

SEQ ID NO: 1133244 - RNA, 19 nt, Homo sapiens
gcagaggaguacauugagu

SEQ ID NO: 1133245 - RNA, 19 nt, Homo sapiens
gcagcacucucgaauuugg

SEQ ID NO: 1133246 - RNA, 19 nt, Homo sapiens
ugaccgacccugccuauga

SEQ ID NO: 1133247 - RNA, 19 nt, Homo sapiens
cagcuacguuuguacauca

SEQ ID NO: 1133248 - RNA, 19 nt, Homo sapiens
gugcagaggaguacauuga

SEQ ID NO: 1133249 - RNA, 19 nt, Homo sapiens
acaugaagcugcuggaaca

SEQ ID NO: 1133250 - RNA, 19 nt, Homo sapiens
gagagggccuuuguguuca

SEQ ID NO: 1133251 - RNA, 19 nt, Homo sapiens
ugagagggccuuuguguuc

SEQ ID NO: 1133252 - RNA, 19 nt, Homo sapiens
gaggacaccaucaaggaaa

SEQ ID NO: 1133253 - RNA, 19 nt, Homo sapiens
gcaagcguguggugucagu

SEQ ID NO: 1133254 - RNA, 19 nt, Homo sapiens
gggagaucaucaacaccua

SEQ ID NO: 1133255 - RNA, 19 nt, Homo sapiens
gagaugugccugcgguuug

SEQ ID NO: 1133256 - RNA, 19 nt, Homo sapiens
ggaaccaauucucugucaa

SEQ ID NO: 1133257 - RNA, 19 nt, Homo sapiens
ggccggaccuugucuucga

SEQ ID NO: 1133258 - RNA, 19 nt, Homo sapiens
cagaggaguacauugagua

SEQ ID NO: 1133259 - RNA, 19 nt, Homo sapiens
ccucgucuguggcuagauu

SEQ ID NO: 1133260 - RNA, 19 nt, Homo sapiens
gcacgggaccuguuugaac

SEQ ID NO: 1133261 - RNA, 19 nt, Homo sapiens
gacacgagaacuacgauga

SEQ ID NO: 1133262 - RNA, 19 nt, Homo sapiens
ccagcaguaugacauguuc

SEQ ID NO: 1133263 - RNA, 19 nt, Homo sapiens
gaaccgcguguacaaguca

SEQ ID NO: 1133264 - RNA, 19 nt, Homo sapiens
ccaauacagcuacguuugu

SEQ ID NO: 1133265 - RNA, 19 nt, Homo sapiens
ccagaauccggacaaggua

SEQ ID NO: 1133266 - RNA, 19 nt, Homo sapiens
cggaaccaauucucuguca

SEQ ID NO: 1133267 - RNA, 19 nt, Homo sapiens
gaucaucaacaccuacaca

SEQ ID NO: 1133268 - RNA, 19 nt, Homo sapiens
gcgaggaggaggaugaugu

SEQ ID NO: 1133269 - RNA, 19 nt, Homo sapiens
ggcaagcucugguguucuc

SEQ ID NO: 1133270 - RNA, 19 nt, Homo sapiens
caagguacagucccucaau

SEQ ID NO: 1133271 - RNA, 19 nt, Homo sapiens
cuaugaagaugucaacaac

SEQ ID NO: 1133272 - RNA, 19 nt, Homo sapiens
acacgcaggucaacuucau

SEQ ID NO: 1133273 - RNA, 19 nt, Homo sapiens
ggacaacggacagcuugga

SEQ ID NO: 1133274 - RNA, 19 nt, Homo sapiens
gaggccauccggacaguga

SEQ ID NO: 1133275 - RNA, 19 nt, Homo sapiens
ccagaucgucaucaacuau

SEQ ID NO: 1133276 - RNA, 19 nt, Homo sapiens
caagcugaguccugagagu

SEQ ID NO: 1133277 - RNA, 19 nt, Homo sapiens
caacacgcaggucaacuuc

SEQ ID NO: 1133278 - RNA, 19 nt, Homo sapiens
caaaauaugccaagaccuu

SEQ ID NO: 1133279 - RNA, 19 nt, Homo sapiens
uggaggagcacaaguacuu

SEQ ID NO: 1133280 - RNA, 19 nt, Homo sapiens
ugacagcuacgcccaguuc

SEQ ID NO: 1133281 - RNA, 19 nt, Homo sapiens
caugagagggccuuugugu

SEQ ID NO: 1133282 - RNA, 19 nt, Homo sapiens
ccucgcagaugcucaaggu

SEQ ID NO: 1133283 - RNA, 19 nt, Homo sapiens
agacguggaaggacuuuga

SEQ ID NO: 1133284 - RNA, 19 nt, Homo sapiens
ccaccaaggccguguacga

SEQ ID NO: 1133285 - RNA, 19 nt, Homo sapiens
gcagcggccauuucgagaa

SEQ ID NO: 1133286 - RNA, 19 nt, Homo sapiens
augaagaugucaacaacug

SEQ ID NO: 1133287 - RNA, 19 nt, Homo sapiens
gggcacgggaccuguuuga

SEQ ID NO: 1133288 - RNA, 19 nt, Homo sapiens
ucgaaguacuuugaugguu

SEQ ID NO: 1133289 - RNA, 19 nt, Homo sapiens
cagcggccauuucgagaag

SEQ ID NO: 1133290 - RNA, 19 nt, Homo sapiens
gagccugaaggaagacuga

SEQ ID NO: 1133291 - RNA, 19 nt, Homo sapiens
cuaccugaccaaauucauu

SEQ ID NO: 1133292 - RNA, 19 nt, Homo sapiens
cacaagaugccucgucugu

SEQ ID NO: 1133293 - RNA, 19 nt, Homo sapiens
gaugucaacaacugucaug

SEQ ID NO: 1133294 - RNA, 19 nt, Homo sapiens
gagcaugaucgcugcaaag

SEQ ID NO: 1133295 - RNA, 19 nt, Homo sapiens
cacagguguuugacagcua

SEQ ID NO: 1133296 - RNA, 19 nt, Homo sapiens
ggaccuugucuucgaggaa

SEQ ID NO: 1133297 - RNA, 19 nt, Homo sapiens
ucacgcagcacucucgaau

SEQ ID NO: 1133298 - RNA, 19 nt, Homo sapiens
gugaagcaucgcuguguga

SEQ ID NO: 1133299 - RNA, 19 nt, Homo sapiens
gcaagcucgggaagauuga

SEQ ID NO: 1133300 - RNA, 19 nt, Homo sapiens
cccagaucgucaucaacua

SEQ ID NO: 1133301 - RNA, 19 nt, Homo sapiens
ccuaugaagaugucaacaa

SEQ ID NO: 1133302 - RNA, 19 nt, Homo sapiens
caauguggacgccaucauc

SEQ ID NO: 1133303 - RNA, 19 nt, Homo sapiens
gaauuuggccccuguaucu

SEQ ID NO: 1133304 - RNA, 19 nt, Homo sapiens
cgugccagccgcaguguuu

SEQ ID NO: 1133305 - RNA, 19 nt, Homo sapiens
uaccugaccaaauucauug

SEQ ID NO: 1133306 - RNA, 19 nt, Homo sapiens
gggucgaaguacuuugaug

SEQ ID NO: 1133307 - RNA, 19 nt, Homo sapiens
agaaggcucgggacgugua

SEQ ID NO: 1133308 - RNA, 19 nt, Homo sapiens
gguacagucccucaaugug

SEQ ID NO: 1133309 - RNA, 19 nt, Homo sapiens
aagguacagucccucaaug

SEQ ID NO: 1133310 - RNA, 19 nt, Homo sapiens
gacccugccuaugaagaug

SEQ ID NO: 1133311 - RNA, 19 nt, Homo sapiens
acaacacgcaggucaacuu

SEQ ID NO: 1133312 - RNA, 19 nt, Homo sapiens
ugaggacaccaucaaggaa

SEQ ID NO: 1133313 - RNA, 19 nt, Homo sapiens
gagcaccuaccugaccaaa

SEQ ID NO: 1133314 - RNA, 19 nt, Homo sapiens
cagaaccgcguguacaagu

SEQ ID NO: 1133315 - RNA, 19 nt, Homo sapiens
ggaaaucaugcggaaccaa

SEQ ID NO: 1133316 - RNA, 19 nt, Homo sapiens
ggacaccaucaaggaaaug

SEQ ID NO: 1133317 - RNA, 19 nt, Homo sapiens
gacgaugcccgugucauuc

SEQ ID NO: 1133318 - RNA, 19 nt, Homo sapiens
agagcaugaucgcugcaaa

SEQ ID NO: 1133319 - RNA, 19 nt, Homo sapiens
ugggcaagcucugguguuc

SEQ ID NO: 1133320 - RNA, 19 nt, Homo sapiens
ucacacccacugccugaga

SEQ ID NO: 1133321 - RNA, 19 nt, Homo sapiens
gcagaaccgcguguacaag

SEQ ID NO: 1133322 - RNA, 19 nt, Homo sapiens
ccuugcggcugcugcgaaa

SEQ ID NO: 1133323 - RNA, 19 nt, Homo sapiens
gagaucaucaacaccuaca

SEQ ID NO: 1133324 - RNA, 19 nt, Homo sapiens
uugggagccugaaggaaga

SEQ ID NO: 1133325 - RNA, 19 nt, Homo sapiens
gaacaaacuugaaugauga

SEQ ID NO: 1133326 - RNA, 19 nt, Homo sapiens
ggaaguagcucacggcaaa

SEQ ID NO: 1133327 - RNA, 19 nt, Homo sapiens
gcaaagaucauccauauau

SEQ ID NO: 1133328 - RNA, 19 nt, Homo sapiens
uguaauggcuucacaauug

SEQ ID NO: 1133329 - RNA, 19 nt, Homo sapiens
gaaaugaccgguuaagaga

SEQ ID NO: 1133330 - RNA, 19 nt, Homo sapiens
gaaagccacugaaacuaug

SEQ ID NO: 1133331 - RNA, 19 nt, Homo sapiens
gaagaugagcucuguguuu

SEQ ID NO: 1133332 - RNA, 19 nt, Homo sapiens
ggaaggagcccugcaauau

SEQ ID NO: 1133333 - RNA, 19 nt, Homo sapiens
cggcaaagaucauccauau

SEQ ID NO: 1133334 - RNA, 19 nt, Homo sapiens
ugacauagcugcucuccau

SEQ ID NO: 1133335 - RNA, 19 nt, Homo sapiens
ggaauguucucccaugguu

SEQ ID NO: 1133336 - RNA, 19 nt, Homo sapiens
ugaacaaacuugaaugaug

SEQ ID NO: 1133337 - RNA, 19 nt, Homo sapiens
agauagaaaugaccgguua

SEQ ID NO: 1133338 - RNA, 19 nt, Homo sapiens
aaucacaucuggauaaguu

SEQ ID NO: 1133339 - RNA, 19 nt, Homo sapiens
aaagaaggauuguccaaau

SEQ ID NO: 1133340 - RNA, 19 nt, Homo sapiens
ggcaugguuucauauguua

SEQ ID NO: 1133341 - RNA, 19 nt, Homo sapiens
cagcaucucuguaaaauaa

SEQ ID NO: 1133342 - RNA, 19 nt, Homo sapiens
agucagagcuguacaggaa

SEQ ID NO: 1133343 - RNA, 19 nt, Homo sapiens
guaauggcuucacaauuga

SEQ ID NO: 1133344 - RNA, 19 nt, Homo sapiens
gaagaaggccauugcaauc

SEQ ID NO: 1133345 - RNA, 19 nt, Homo sapiens
gaaagaaggauuguccaaa

SEQ ID NO: 1133346 - RNA, 19 nt, Homo sapiens
ucauuaagcccuacaguaa

SEQ ID NO: 1133347 - RNA, 19 nt, Homo sapiens
gucugaaucuugaacuuua

SEQ ID NO: 1133348 - RNA, 19 nt, Homo sapiens
gaaaauacuucuugcacuu

SEQ ID NO: 1133349 - RNA, 19 nt, Homo sapiens
gaaggagcccugcaauaug

SEQ ID NO: 1133350 - RNA, 19 nt, Homo sapiens
auaauggcaugguuucaua

SEQ ID NO: 1133351 - RNA, 19 nt, Homo sapiens
caacgucauugaagaguuc

SEQ ID NO: 1133352 - RNA, 19 nt, Homo sapiens
ugacaaugauagccucgua

SEQ ID NO: 1133353 - RNA, 19 nt, Homo sapiens
ugaaggaguuugaaucaca

SEQ ID NO: 1133354 - RNA, 19 nt, Homo sapiens
gaagaaggauuugauucag

SEQ ID NO: 1133355 - RNA, 19 nt, Homo sapiens
acaaugagaagaaggauuu

SEQ ID NO: 1133356 - RNA, 19 nt, Homo sapiens
gaaggauuguccaaaugug

SEQ ID NO: 1133357 - RNA, 19 nt, Homo sapiens
ggagaaagcccugaagaag

SEQ ID NO: 1133358 - RNA, 19 nt, Homo sapiens
gagguuagucugaaucuug

SEQ ID NO: 1133359 - RNA, 19 nt, Homo sapiens
gaucauccauauauuucug

SEQ ID NO: 1133360 - RNA, 19 nt, Homo sapiens
cuagugagcugcuggagau

SEQ ID NO: 1133361 - RNA, 19 nt, Homo sapiens
uggauaaguuagacaauga

SEQ ID NO: 1133362 - RNA, 19 nt, Homo sapiens
gggaaggagcccugcaaua

SEQ ID NO: 1133363 - RNA, 19 nt, Homo sapiens
gagagaacaccuucggaaa

SEQ ID NO: 1133364 - RNA, 19 nt, Homo sapiens
caaggauucuggccaaaca

SEQ ID NO: 1133365 - RNA, 19 nt, Homo sapiens
gaaggccauugcaaucaug

SEQ ID NO: 1133366 - RNA, 19 nt, Homo sapiens
aagaugagcucuguguuug

SEQ ID NO: 1133367 - RNA, 19 nt, Homo sapiens
ggagggccaagcacuauaa

SEQ ID NO: 1133368 - RNA, 19 nt, Homo sapiens
gcaacgucauugaagaguu

SEQ ID NO: 1133369 - RNA, 19 nt, Homo sapiens
caacggaagauagaaauga

SEQ ID NO: 1133370 - RNA, 19 nt, Homo sapiens
gauguugcauugaugaauc

SEQ ID NO: 1133371 - RNA, 19 nt, Homo sapiens
uuucaugccucuuguaaug

SEQ ID NO: 1133372 - RNA, 19 nt, Homo sapiens
gaaauugaaagccacugaa

SEQ ID NO: 1133373 - RNA, 19 nt, Homo sapiens
ccaccaaggacaaggauaa

SEQ ID NO: 1133374 - RNA, 19 nt, Homo sapiens
gauauuuccugauguugca

SEQ ID NO: 1133375 - RNA, 19 nt, Homo sapiens
gaaggaguuugaaucacau

SEQ ID NO: 1133376 - RNA, 19 nt, Homo sapiens
acaguaagcacuauccuuu

SEQ ID NO: 1133377 - RNA, 19 nt, Homo sapiens
acaguaacguguacauguu

SEQ ID NO: 1133378 - RNA, 19 nt, Homo sapiens
ggaaauugaaagccacuga

SEQ ID NO: 1133379 - RNA, 19 nt, Homo sapiens
ggaaagaaggauuguccaa

SEQ ID NO: 1133380 - RNA, 19 nt, Homo sapiens
gggagaaagcccugaagaa

SEQ ID NO: 1133381 - RNA, 19 nt, Homo sapiens
gagaagaugagcucugugu

SEQ ID NO: 1133382 - RNA, 19 nt, Homo sapiens
uccgagacauggucagaua

SEQ ID NO: 1133383 - RNA, 19 nt, Homo sapiens
gagaagaaggauuugauuc

SEQ ID NO: 1133384 - RNA, 19 nt, Homo sapiens
ugaaagccacugaaacuau

SEQ ID NO: 1133385 - RNA, 19 nt, Homo sapiens
gacaguaacguguacaugu

SEQ ID NO: 1133386 - RNA, 19 nt, Homo sapiens
uggcaugguuucauauguu

SEQ ID NO: 1133387 - RNA, 19 nt, Homo sapiens
gggccaagcacuauaaauc

SEQ ID NO: 1133388 - RNA, 19 nt, Homo sapiens
aaugaccgguuaagagauu

SEQ ID NO: 1133389 - RNA, 19 nt, Homo sapiens
aagaaggauuguccaaaug

SEQ ID NO: 1133390 - RNA, 19 nt, Homo sapiens
gcacaugccguacuuugag

SEQ ID NO: 1133391 - RNA, 19 nt, Homo sapiens
uaacuguaauggcuucaca

SEQ ID NO: 1133392 - RNA, 19 nt, Homo sapiens
uagcugcucuccaucacuu

SEQ ID NO: 1133393 - RNA, 19 nt, Homo sapiens
ugaagaaggccauugcaau

SEQ ID NO: 1133394 - RNA, 19 nt, Homo sapiens
gcacgcaacgucauugaag

SEQ ID NO: 1133395 - RNA, 19 nt, Homo sapiens
aagaaggauuugauucaga

SEQ ID NO: 1133396 - RNA, 19 nt, Homo sapiens
ccauauauuucugagauca

SEQ ID NO: 1133397 - RNA, 19 nt, Homo sapiens
gaugagcucuguguuugag

SEQ ID NO: 1133398 - RNA, 19 nt, Homo sapiens
agaagaaggauuugauuca

SEQ ID NO: 1133399 - RNA, 19 nt, Homo sapiens
ugcacaagcuggaauguuc

SEQ ID NO: 1133400 - RNA, 19 nt, Homo sapiens
gagauaauggcaugguuuc

SEQ ID NO: 1133401 - RNA, 19 nt, Homo sapiens
ccugcaauauggacagaaa

SEQ ID NO: 1133402 - RNA, 19 nt, Homo sapiens
gcagaagccauccgagaca

SEQ ID NO: 1133403 - RNA, 19 nt, Homo sapiens
ggaaugaaaauacuucuug

SEQ ID NO: 1133404 - RNA, 19 nt, Homo sapiens
acacgucacuccagcaucu

SEQ ID NO: 1133405 - RNA, 19 nt, Homo sapiens
guaagcacuauccuuugua

SEQ ID NO: 1133406 - RNA, 19 nt, Homo sapiens
gaaaauccacccagagaga

SEQ ID NO: 1133407 - RNA, 19 nt, Homo sapiens
caauguggagugucagaaa

SEQ ID NO: 1133408 - RNA, 19 nt, Homo sapiens
gcacuuaaacacugcacau

SEQ ID NO: 1133409 - RNA, 19 nt, Homo sapiens
aaggagcccugcaauaugg

SEQ ID NO: 1133410 - RNA, 19 nt, Homo sapiens
gauagaaaugaccgguuaa

SEQ ID NO: 1133411 - RNA, 19 nt, Homo sapiens
ucagagcuguacaggaaau

SEQ ID NO: 1133412 - RNA, 19 nt, Homo sapiens
uaaguuagacaaugagaag

SEQ ID NO: 1133413 - RNA, 19 nt, Homo sapiens
ucaugccucuuguaauguu

SEQ ID NO: 1133414 - RNA, 19 nt, Homo sapiens
gagaucaaacaggaaauug

SEQ ID NO: 1133415 - RNA, 19 nt, Homo sapiens
ugagaagaaggauuugauu

SEQ ID NO: 1133416 - RNA, 19 nt, Homo sapiens
aguaagcacuauccuuugu

SEQ ID NO: 1133417 - RNA, 19 nt, Homo sapiens
ggauaaggccaagguggaa

SEQ ID NO: 1133418 - RNA, 19 nt, Homo sapiens
agaaaugaccgguuaagag

SEQ ID NO: 1133419 - RNA, 19 nt, Homo sapiens
aggauuugauucagaguga

SEQ ID NO: 1133420 - RNA, 19 nt, Homo sapiens
gauaauggcaugguuucau

SEQ ID NO: 1133421 - RNA, 19 nt, Homo sapiens
ggcaaagaucauccauaua

SEQ ID NO: 1133422 - RNA, 19 nt, Homo sapiens
uaagcacuauccuuuguac

SEQ ID NO: 1133423 - RNA, 19 nt, Homo sapiens
caaugauagccucguagua

SEQ ID NO: 1133424 - RNA, 19 nt, Homo sapiens
ggacaguaacguguacaug

SEQ ID NO: 1133425 - RNA, 19 nt, Homo sapiens
guacucaacucacauauuu

SEQ ID NO: 1133426 - RNA, 19 nt, Homo sapiens
caaugaagauccuaguaua

SEQ ID NO: 1133427 - RNA, 19 nt, Homo sapiens
caaagacacucuagacaau

SEQ ID NO: 1133428 - RNA, 19 nt, Homo sapiens
guaccuaggucuuucaaau

SEQ ID NO: 1133429 - RNA, 19 nt, Homo sapiens
ggaggaggaucuucucaug

SEQ ID NO: 1133430 - RNA, 19 nt, Homo sapiens
gaugacaccuuggaagaaa

SEQ ID NO: 1133431 - RNA, 19 nt, Homo sapiens
ggaauaccaucgccuagau

SEQ ID NO: 1133432 - RNA, 19 nt, Homo sapiens
agaggaagcugauaacaau

SEQ ID NO: 1133433 - RNA, 19 nt, Homo sapiens
acaguguacuuuccuaaua

SEQ ID NO: 1133434 - RNA, 19 nt, Homo sapiens
gcaauugguacuuaaauga

SEQ ID NO: 1133435 - RNA, 19 nt, Homo sapiens
gcacugugauuugaauuug

SEQ ID NO: 1133436 - RNA, 19 nt, Homo sapiens
gaaauugaacagucaguga

SEQ ID NO: 1133437 - RNA, 19 nt, Homo sapiens
caaaccaaaccuucuauuu

SEQ ID NO: 1133438 - RNA, 19 nt, Homo sapiens
gauaaugcuuuggauuuga

SEQ ID NO: 1133439 - RNA, 19 nt, Homo sapiens
acaaggauaugugugauaa

SEQ ID NO: 1133440 - RNA, 19 nt, Homo sapiens
cauaggcaauugguacuua

SEQ ID NO: 1133441 - RNA, 19 nt, Homo sapiens
cugcaauccuuccuucuua

SEQ ID NO: 1133442 - RNA, 19 nt, Homo sapiens
uuaaagcacugugauuuga

SEQ ID NO: 1133443 - RNA, 19 nt, Homo sapiens
caauggcgauuauggagaa

SEQ ID NO: 1133444 - RNA, 19 nt, Homo sapiens
gcaaugggcagaguuuaaa

SEQ ID NO: 1133445 - RNA, 19 nt, Homo sapiens
gcuuuggauuugaguaaua

SEQ ID NO: 1133446 - RNA, 19 nt, Homo sapiens
accuaggucuuucaaauua

SEQ ID NO: 1133447 - RNA, 19 nt, Homo sapiens
gaaaacugcuuuggauauu

SEQ ID NO: 1133448 - RNA, 19 nt, Homo sapiens
gugauaaugcuuuggauuu

SEQ ID NO: 1133449 - RNA, 19 nt, Homo sapiens
ggaagcugauaacaaugaa

SEQ ID NO: 1133450 - RNA, 19 nt, Homo sapiens
cagauucguuuacuucguu

SEQ ID NO: 1133451 - RNA, 19 nt, Homo sapiens
gggcagaguuuaaaauuau

SEQ ID NO: 1133452 - RNA, 19 nt, Homo sapiens
ccaaagacacucuagacaa

SEQ ID NO: 1133453 - RNA, 19 nt, Homo sapiens
uauggcaacuggaaaguau

SEQ ID NO: 1133454 - RNA, 19 nt, Homo sapiens
caagaaaacugcuuuggau

SEQ ID NO: 1133455 - RNA, 19 nt, Homo sapiens
cuuugaagauuaccaauga

SEQ ID NO: 1133456 - RNA, 19 nt, Homo sapiens
aaaccaaaccuucuauuuc

SEQ ID NO: 1133457 - RNA, 19 nt, Homo sapiens
ggacaguguacuuuccuaa

SEQ ID NO: 1133458 - RNA, 19 nt, Homo sapiens
ggcaauugguacuuaaaug

SEQ ID NO: 1133459 - RNA, 19 nt, Homo sapiens
gaaaacauagcccuaauau

SEQ ID NO: 1133460 - RNA, 19 nt, Homo sapiens
ugauaaugcuuuggauuug

SEQ ID NO: 1133461 - RNA, 19 nt, Homo sapiens
gcauugcuguuguuuacau

SEQ ID NO: 1133462 - RNA, 19 nt, Homo sapiens
gggauucauuuaugucugu

SEQ ID NO: 1133463 - RNA, 19 nt, Homo sapiens
cuacuccucugucucaaga

SEQ ID NO: 1133464 - RNA, 19 nt, Homo sapiens
ugaaugcuuuaacacauga

SEQ ID NO: 1133465 - RNA, 19 nt, Homo sapiens
gugaaugcuuuaacacaug

SEQ ID NO: 1133466 - RNA, 19 nt, Homo sapiens
gggaagcacaauggaaaua

SEQ ID NO: 1133467 - RNA, 19 nt, Homo sapiens
gaacagucagugaaaucuu

SEQ ID NO: 1133468 - RNA, 19 nt, Homo sapiens
aacagucagugaaaucuuu

SEQ ID NO: 1133469 - RNA, 19 nt, Homo sapiens
caaccguacucaacucaca

SEQ ID NO: 1133470 - RNA, 19 nt, Homo sapiens
ggauaaugauauugcucaa

SEQ ID NO: 1133471 - RNA, 19 nt, Homo sapiens
gcaauccuuccuucuuauu

SEQ ID NO: 1133472 - RNA, 19 nt, Homo sapiens
aaggauaugugugauaaug

SEQ ID NO: 1133473 - RNA, 19 nt, Homo sapiens
cauggaaauugaacaguca

SEQ ID NO: 1133474 - RNA, 19 nt, Homo sapiens
acuaugggauucauuuaug

SEQ ID NO: 1133475 - RNA, 19 nt, Homo sapiens
caagcaaugggcagaguuu

SEQ ID NO: 1133476 - RNA, 19 nt, Homo sapiens
guacaaggauaugugugau

SEQ ID NO: 1133477 - RNA, 19 nt, Homo sapiens
gaagaggaagacagccauu

SEQ ID NO: 1133478 - RNA, 19 nt, Homo sapiens
aaacagggguuacauggaa

SEQ ID NO: 1133479 - RNA, 19 nt, Homo sapiens
ccacgacgaguaccaagaa

SEQ ID NO: 1133480 - RNA, 19 nt, Homo sapiens
gaagaaggccguccauccu

SEQ ID NO: 1133481 - RNA, 19 nt, Homo sapiens
ccuccaagguuucaagcaa

SEQ ID NO: 1133482 - RNA, 19 nt, Homo sapiens
ggauaugugugauaaugcu

SEQ ID NO: 1133483 - RNA, 19 nt, Homo sapiens
gaauguuaaugaggcaaug

SEQ ID NO: 1133484 - RNA, 19 nt, Homo sapiens
ggaaguauuagugaugcua

SEQ ID NO: 1133485 - RNA, 19 nt, Homo sapiens
ccuaggucuuucaaauuaa

SEQ ID NO: 1133486 - RNA, 19 nt, Homo sapiens
ucccaaacuuguaacuaaa

SEQ ID NO: 1133487 - RNA, 19 nt, Homo sapiens
gccuagaucagaauguuaa

SEQ ID NO: 1133488 - RNA, 19 nt, Homo sapiens
ucuagacaauggcgauuau

SEQ ID NO: 1133489 - RNA, 19 nt, Homo sapiens
gaucuucucaugcugaaca

SEQ ID NO: 1133490 - RNA, 19 nt, Homo sapiens
caguguacuuuccuaauag

SEQ ID NO: 1133491 - RNA, 19 nt, Homo sapiens
uaucagauucguuuacuuc

SEQ ID NO: 1133492 - RNA, 19 nt, Homo sapiens
aucccaaacuuguaacuaa

SEQ ID NO: 1133493 - RNA, 19 nt, Homo sapiens
aaagcacugugauuugaau

SEQ ID NO: 1133494 - RNA, 19 nt, Homo sapiens
acaaugaagauccuaguau

SEQ ID NO: 1133495 - RNA, 19 nt, Homo sapiens
ugucugucuuucuaucaua

SEQ ID NO: 1133496 - RNA, 19 nt, Homo sapiens
ucaccacgcugggacguau

SEQ ID NO: 1133497 - RNA, 19 nt, Homo sapiens
guauuagugaugcuacuuu

SEQ ID NO: 1133498 - RNA, 19 nt, Homo sapiens
uaaaugucacaaacgagua

SEQ ID NO: 1133499 - RNA, 19 nt, Homo sapiens
gucacaaacgaguauauaa

SEQ ID NO: 1133500 - RNA, 19 nt, Homo sapiens
gggguuacauggaaauuga

SEQ ID NO: 1133501 - RNA, 19 nt, Homo sapiens
gaaaucuuggcaacagaga

SEQ ID NO: 1133502 - RNA, 19 nt, Homo sapiens
gaucccaaacuuguaacua

SEQ ID NO: 1133503 - RNA, 19 nt, Homo sapiens
ugaagauccuaguauagag

SEQ ID NO: 1133504 - RNA, 19 nt, Homo sapiens
ccucaucccucgccuacuc

SEQ ID NO: 1133505 - RNA, 19 nt, Homo sapiens
ccaaaugugaaugcuuuaa

SEQ ID NO: 1133506 - RNA, 19 nt, Homo sapiens
gcagcuugcaguggacaua

SEQ ID NO: 1133507 - RNA, 19 nt, Homo sapiens
uuaaaaggaucccaaacuu

SEQ ID NO: 1133508 - RNA, 19 nt, Homo sapiens
gugauggccuuuguuccaa

SEQ ID NO: 1133509 - RNA, 19 nt, Homo sapiens
cuuggugcuuuggaaauua

SEQ ID NO: 1133510 - RNA, 19 nt, Homo sapiens
ucuauccaguguuguauca

SEQ ID NO: 1133511 - RNA, 19 nt, Homo sapiens
aaccaaaccuucuauuucc

SEQ ID NO: 1133512 - RNA, 19 nt, Homo sapiens
gaagcacaauggaaauacc

SEQ ID NO: 1133513 - RNA, 19 nt, Homo sapiens
uaccuaggucuuucaaauu

SEQ ID NO: 1133514 - RNA, 19 nt, Homo sapiens
ugucacaaacgaguauaua

SEQ ID NO: 1133515 - RNA, 19 nt, Homo sapiens
auaggcaauugguacuuaa

SEQ ID NO: 1133516 - RNA, 19 nt, Homo sapiens
uugcauugcuguuguuuac

SEQ ID NO: 1133517 - RNA, 19 nt, Homo sapiens
gaggaagacagccauuucu

SEQ ID NO: 1133518 - RNA, 19 nt, Homo sapiens
ccaaaccaaaccuucuauu

SEQ ID NO: 1133519 - RNA, 19 nt, Homo sapiens
cuaugggauucauuuaugu

SEQ ID NO: 1133520 - RNA, 19 nt, Homo sapiens
auaccugaaugaaguuguu

SEQ ID NO: 1133521 - RNA, 19 nt, Homo sapiens
uauuaugcuucuucuggaa

SEQ ID NO: 1133522 - RNA, 19 nt, Homo sapiens
uaaagcacugugauuugaa

SEQ ID NO: 1133523 - RNA, 19 nt, Homo sapiens
ggucuuggcgcuccugcuu

SEQ ID NO: 1133524 - RNA, 19 nt, Homo sapiens
aagaggaagcugauaacaa

SEQ ID NO: 1133525 - RNA, 19 nt, Homo sapiens
gaagccagcugucaaguuu

SEQ ID NO: 1133526 - RNA, 19 nt, Homo sapiens
uaaaggagguuacaaauuc

SEQ ID NO: 1133527 - RNA, 19 nt, Homo sapiens
ccagauagcaucauauuua

SEQ ID NO: 1133528 - RNA, 19 nt, Homo sapiens
gaaacgcaguguacaauga

SEQ ID NO: 1133529 - RNA, 19 nt, Homo sapiens
ccaaggauauuaugaaaga

SEQ ID NO: 1133530 - RNA, 19 nt, Homo sapiens
ccaccuaguuacucaaaua

SEQ ID NO: 1133531 - RNA, 19 nt, Homo sapiens
gggaaaggacaauuuaaua

SEQ ID NO: 1133532 - RNA, 19 nt, Homo sapiens
ggagggaaaggacaauuua

SEQ ID NO: 1133533 - RNA, 19 nt, Homo sapiens
cuaaagacaugaauucuca

SEQ ID NO: 1133534 - RNA, 19 nt, Homo sapiens
gaacaucagccgaaauuca

SEQ ID NO: 1133535 - RNA, 19 nt, Homo sapiens
gcacuauuauggagacuug

SEQ ID NO: 1133536 - RNA, 19 nt, Homo sapiens
gcaaugcuaucuaccuuca

SEQ ID NO: 1133537 - RNA, 19 nt, Homo sapiens
caugaauucucaccacuaa

SEQ ID NO: 1133538 - RNA, 19 nt, Homo sapiens
gaagagaacauccagaagu

SEQ ID NO: 1133539 - RNA, 19 nt, Homo sapiens
ggguaugacuugaauuuau

SEQ ID NO: 1133540 - RNA, 19 nt, Homo sapiens
gauuggagcuuccgguaug

SEQ ID NO: 1133541 - RNA, 19 nt, Homo sapiens
gggaaugcagcuauuaaua

SEQ ID NO: 1133542 - RNA, 19 nt, Homo sapiens
ccacuaaagucccagauag

SEQ ID NO: 1133543 - RNA, 19 nt, Homo sapiens
ggccaaggauauuaugaaa

SEQ ID NO: 1133544 - RNA, 19 nt, Homo sapiens
guacucaacuguguuuaau

SEQ ID NO: 1133545 - RNA, 19 nt, Homo sapiens
uaagguagccaguuuguug

SEQ ID NO: 1133546 - RNA, 19 nt, Homo sapiens
gcacuacucagcaauauag

SEQ ID NO: 1133547 - RNA, 19 nt, Homo sapiens
ugauuaagguagccaguuu

SEQ ID NO: 1133548 - RNA, 19 nt, Homo sapiens
gaacugggaggaccaugaa

SEQ ID NO: 1133549 - RNA, 19 nt, Homo sapiens
uagaacaccuuaagaacau

SEQ ID NO: 1133550 - RNA, 19 nt, Homo sapiens
ggauaugccuuagauuaca

SEQ ID NO: 1133551 - RNA, 19 nt, Homo sapiens
gaaauacaagcccaacaug

SEQ ID NO: 1133552 - RNA, 19 nt, Homo sapiens
ugaaagcacuacucagcaa

SEQ ID NO: 1133553 - RNA, 19 nt, Homo sapiens
gugcugaucucguagaaca

SEQ ID NO: 1133554 - RNA, 19 nt, Homo sapiens
ugaaagacauaggauauag

SEQ ID NO: 1133555 - RNA, 19 nt, Homo sapiens
ucacucagcaggauauaaa

SEQ ID NO: 1133556 - RNA, 19 nt, Homo sapiens
ugggauaugccuuagauua

SEQ ID NO: 1133557 - RNA, 19 nt, Homo sapiens
gauaugccuuagauuacaa

SEQ ID NO: 1133558 - RNA, 19 nt, Homo sapiens
ggugggauaugccuuagau

SEQ ID NO: 1133559 - RNA, 19 nt, Homo sapiens
ucacauaugcgucaucaau

SEQ ID NO: 1133560 - RNA, 19 nt, Homo sapiens
guagaacaccuuaagaaca

SEQ ID NO: 1133561 - RNA, 19 nt, Homo sapiens
caacuguguuuaauacucu

SEQ ID NO: 1133562 - RNA, 19 nt, Homo sapiens
ugccuuagauuacaaugaa

SEQ ID NO: 1133563 - RNA, 19 nt, Homo sapiens
gacauaggauauagugaca

SEQ ID NO: 1133564 - RNA, 19 nt, Homo sapiens
uaaacacuccgccuuguga

SEQ ID NO: 1133565 - RNA, 19 nt, Homo sapiens
gggcgaggcgucgugauua

SEQ ID NO: 1133566 - RNA, 19 nt, Homo sapiens
ucaaugagcacgguaaaga

SEQ ID NO: 1133567 - RNA, 19 nt, Homo sapiens
gcuuaaaggagguuacaaa

SEQ ID NO: 1133568 - RNA, 19 nt, Homo sapiens
gcauggauguacucaacug

SEQ ID NO: 1133569 - RNA, 19 nt, Homo sapiens
aagagaacauccagaagug

SEQ ID NO: 1133570 - RNA, 19 nt, Homo sapiens
caaauucugugcugaucuc

SEQ ID NO: 1133571 - RNA, 19 nt, Homo sapiens
gauguacucaacuguguuu

SEQ ID NO: 1133572 - RNA, 19 nt, Homo sapiens
gagggaaaggacaauuuaa

SEQ ID NO: 1133573 - RNA, 19 nt, Homo sapiens
ggaagccagcugucaaguu

SEQ ID NO: 1133574 - RNA, 19 nt, Homo sapiens
gugaagagaacauccagaa

SEQ ID NO: 1133575 - RNA, 19 nt, Homo sapiens
caggguaugacuugaauuu

SEQ ID NO: 1133576 - RNA, 19 nt, Homo sapiens
cauaggauauagugacauc

SEQ ID NO: 1133577 - RNA, 19 nt, Homo sapiens
gcuccgccuuccuuuguuu

SEQ ID NO: 1133578 - RNA, 19 nt, Homo sapiens
caaaugagagagcuuucuu

SEQ ID NO: 1133579 - RNA, 19 nt, Homo sapiens
cagauagcaucauauuuac

SEQ ID NO: 1133580 - RNA, 19 nt, Homo sapiens
ggaacugggaggaccauga

SEQ ID NO: 1133581 - RNA, 19 nt, Homo sapiens
gacgguaugucauguaugc

SEQ ID NO: 1133582 - RNA, 19 nt, Homo sapiens
gguaugugaugacgguaug

SEQ ID NO: 1133583 - RNA, 19 nt, Homo sapiens
caguguacaaugaaucuua

SEQ ID NO: 1133584 - RNA, 19 nt, Homo sapiens
ugacuaugcuggauuugag

SEQ ID NO: 1133585 - RNA, 19 nt, Homo sapiens
gagcuccgccuuccuuugu

SEQ ID NO: 1133586 - RNA, 19 nt, Homo sapiens
ugagagagcuuucuuuucu

SEQ ID NO: 1133587 - RNA, 19 nt, Homo sapiens
ucacguacccacagcacua

SEQ ID NO: 1133588 - RNA, 19 nt, Homo sapiens
cggaggcgaugaucuuuca

SEQ ID NO: 1133589 - RNA, 19 nt, Homo sapiens
aagaacaucagccgaaauu

SEQ ID NO: 1133590 - RNA, 19 nt, Homo sapiens
caucauauuuacgccugua

SEQ ID NO: 1133591 - RNA, 19 nt, Homo sapiens
uuaagaacaucagccgaaa

SEQ ID NO: 1133592 - RNA, 19 nt, Homo sapiens
gacaggccauuauuaucug

SEQ ID NO: 1133593 - RNA, 19 nt, Homo sapiens
ugacaggccauuauuaucu

SEQ ID NO: 1133594 - RNA, 19 nt, Homo sapiens
uuaagaagcuggggacuuu

SEQ ID NO: 1133595 - RNA, 19 nt, Homo sapiens
ccucaucccucaugguauc

SEQ ID NO: 1133596 - RNA, 19 nt, Homo sapiens
uacaagcccaacaugauua

SEQ ID NO: 1133597 - RNA, 19 nt, Homo sapiens
ugggugagaugcagauaau

SEQ ID NO: 1133598 - RNA, 19 nt, Homo sapiens
gaaagacauaggauauagu

SEQ ID NO: 1133599 - RNA, 19 nt, Homo sapiens
gccaggguaugacuugaau

SEQ ID NO: 1133600 - RNA, 19 nt, Homo sapiens
acucagcaauauagagaaa

SEQ ID NO: 1133601 - RNA, 19 nt, Homo sapiens
ggcgaggcgucgugauuau

SEQ ID NO: 1133602 - RNA, 19 nt, Homo sapiens
acucaacuguguuuaauac

SEQ ID NO: 1133603 - RNA, 19 nt, Homo sapiens
gaguaucaaagguuccuaa

SEQ ID NO: 1133604 - RNA, 19 nt, Homo sapiens
caaugagcacgguaaagaa

SEQ ID NO: 1133605 - RNA, 19 nt, Homo sapiens
aaagcacuacucagcaaua

SEQ ID NO: 1133606 - RNA, 19 nt, Homo sapiens
ucagaucgauuugucucaa

SEQ ID NO: 1133607 - RNA, 19 nt, Homo sapiens
gagcggcuggccaaggaua

SEQ ID NO: 1133608 - RNA, 19 nt, Homo sapiens
aaauacaagcccaacauga

SEQ ID NO: 1133609 - RNA, 19 nt, Homo sapiens
auucugugcugaucucgua

SEQ ID NO: 1133610 - RNA, 19 nt, Homo sapiens
gaaagcacuacucagcaau

SEQ ID NO: 1133611 - RNA, 19 nt, Homo sapiens
gaacaccuuaagaacauca

SEQ ID NO: 1133612 - RNA, 19 nt, Homo sapiens
gaucucguagaacaccuua

SEQ ID NO: 1133613 - RNA, 19 nt, Homo sapiens
gguccugugugugcuuaaa

SEQ ID NO: 1133614 - RNA, 19 nt, Homo sapiens
ucaacuguguuuaauacuc

SEQ ID NO: 1133615 - RNA, 19 nt, Homo sapiens
agucccagauagcaucaua

SEQ ID NO: 1133616 - RNA, 19 nt, Homo sapiens
ugaauucucaccacuaaag

SEQ ID NO: 1133617 - RNA, 19 nt, Homo sapiens
gggauaugccuuagauuac

SEQ ID NO: 1133618 - RNA, 19 nt, Homo sapiens
auacaagcccaacaugauu

SEQ ID NO: 1133619 - RNA, 19 nt, Homo sapiens
cuacucagcaauauagaga

SEQ ID NO: 1133620 - RNA, 19 nt, Homo sapiens
ggccauuauuaucugcuuu

SEQ ID NO: 1133621 - RNA, 19 nt, Homo sapiens
caucuucacucagcaggau

SEQ ID NO: 1133622 - RNA, 19 nt, Homo sapiens
aaagacauaggauauagug

SEQ ID NO: 1133623 - RNA, 19 nt, Homo sapiens
gaucgauuugucucaauga

SEQ ID NO: 1133624 - RNA, 19 nt, Homo sapiens
cagccgaaauucagaucga

SEQ ID NO: 1133625 - RNA, 19 nt, Homo sapiens
gagaaggccaucagcauuu

SEQ ID NO: 1133626 - RNA, 19 nt, Homo sapiens
ggagauggccagccuacaa

SEQ ID NO: 1133627 - RNA, 19 nt, Homo sapiens
aauaaaugcuguucaugug

SEQ ID NO: 1133628 - RNA, 19 nt, Homo sapiens
guacuuuggcccugacuuu

SEQ ID NO: 1133629 - RNA, 19 nt, Homo sapiens
cugcugaccuucucauaga

SEQ ID NO: 1133630 - RNA, 19 nt, Homo sapiens
gagauggccagccuacaaa

SEQ ID NO: 1133631 - RNA, 19 nt, Homo sapiens
cgagaaggccaucagcauu

SEQ ID NO: 1133632 - RNA, 19 nt, Homo sapiens
ucaaguacugucccuauga

SEQ ID NO: 1133633 - RNA, 19 nt, Homo sapiens
caaguacugucccuaugag

SEQ ID NO: 1133634 - RNA, 19 nt, Homo sapiens
acacugacgucuucaucug

SEQ ID NO: 1133635 - RNA, 19 nt, Homo sapiens
ucaagauguucaaguacug

SEQ ID NO: 1133636 - RNA, 19 nt, Homo sapiens
cagcaaacacucacuaggu

SEQ ID NO: 1133637 - RNA, 19 nt, Homo sapiens
acaaaacacugacgucuuc

SEQ ID NO: 1133638 - RNA, 19 nt, Homo sapiens
agaaggccaucagcauuug

SEQ ID NO: 1133639 - RNA, 19 nt, Homo sapiens
gagaguccguaggcuugaa

SEQ ID NO: 1133640 - RNA, 19 nt, Homo sapiens
ucgaccagcuuagagguuu

SEQ ID NO: 1133641 - RNA, 19 nt, Homo sapiens
agauugugcugaccagaga

SEQ ID NO: 1133642 - RNA, 19 nt, Homo sapiens
gcacaagccccaucaagau

SEQ ID NO: 1133643 - RNA, 19 nt, Homo sapiens
gaguugaggccacuguuca

SEQ ID NO: 1133644 - RNA, 19 nt, Homo sapiens
cagcaaggaggaccaggaa

SEQ ID NO: 1133645 - RNA, 19 nt, Homo sapiens
guucaaguacugucccuau

SEQ ID NO: 1133646 - RNA, 19 nt, Homo sapiens
uccguaggcuugaacaugu

SEQ ID NO: 1133647 - RNA, 19 nt, Homo sapiens
caucagcauuugggaguca

SEQ ID NO: 1133648 - RNA, 19 nt, Homo sapiens
ggaguugaggccacuguuc

SEQ ID NO: 1133649 - RNA, 19 nt, Homo sapiens
gcgagaaggccaucagcau

SEQ ID NO: 1133650 - RNA, 19 nt, Homo sapiens
guacugucccuaugagaag

SEQ ID NO: 1133651 - RNA, 19 nt, Homo sapiens
uggaagcugucaaggagau

SEQ ID NO: 1133652 - RNA, 19 nt, Homo sapiens
gcugggagcauguccucuu

SEQ ID NO: 1133653 - RNA, 19 nt, Homo sapiens
augccuggguggagaagua

SEQ ID NO: 1133654 - RNA, 19 nt, Homo sapiens
ugacuucgagggcggauuc

SEQ ID NO: 1133655 - RNA, 19 nt, Homo sapiens
aaacacugacgucuucauc

SEQ ID NO: 1133656 - RNA, 19 nt, Homo sapiens
ucugggcgcuuggacauag

SEQ ID NO: 1133657 - RNA, 19 nt, Homo sapiens
ugaagaagcuggcugaaau

SEQ ID NO: 1133658 - RNA, 19 nt, Homo sapiens
gacaaagccuccuauguug

SEQ ID NO: 1133659 - RNA, 19 nt, Homo sapiens
gcacaaaucuacgcacaga

SEQ ID NO: 1133660 - RNA, 19 nt, Homo sapiens
gauaguuucuccacauuug

SEQ ID NO: 1133661 - RNA, 19 nt, Homo sapiens
ugacaaagccuccuauguu

SEQ ID NO: 1133662 - RNA, 19 nt, Homo sapiens
gaagaagcuggcugaaaua

SEQ ID NO: 1133663 - RNA, 19 nt, Homo sapiens
cagcauauaucucauugga

SEQ ID NO: 1133664 - RNA, 19 nt, Homo sapiens
ucagauuucuuccaucaaa

SEQ ID NO: 1133665 - RNA, 19 nt, Homo sapiens
gcugggaaauuauauaaca

SEQ ID NO: 1133666 - RNA, 19 nt, Homo sapiens
agaggaugcugggaaauua

SEQ ID NO: 1133667 - RNA, 19 nt, Homo sapiens
aaucguguauucagacaua

SEQ ID NO: 1133668 - RNA, 19 nt, Homo sapiens
ugaagaggaugcugggaaa

SEQ ID NO: 1133669 - RNA, 19 nt, Homo sapiens
gaagcgaucagaccucuau

SEQ ID NO: 1133670 - RNA, 19 nt, Homo sapiens
ucaacucccuauuaaauuc

SEQ ID NO: 1133671 - RNA, 19 nt, Homo sapiens
gaagcuuucugaaguagca

SEQ ID NO: 1133672 - RNA, 19 nt, Homo sapiens
uaacgucacucgcgcuugu

SEQ ID NO: 1133673 - RNA, 19 nt, Homo sapiens
gauggaacuuuacuagcaa

SEQ ID NO: 1133674 - RNA, 19 nt, Homo sapiens
aagaagcaaucguguauuc

SEQ ID NO: 1133675 - RNA, 19 nt, Homo sapiens
gaaauacgccagcaaaucc

SEQ ID NO: 1133676 - RNA, 19 nt, Homo sapiens
gcaaggagccaaaauaguu

SEQ ID NO: 1133677 - RNA, 19 nt, Homo sapiens
ugauggaacuuuacuagca

SEQ ID NO: 1133678 - RNA, 19 nt, Homo sapiens
caaaucagauaacgucacu

SEQ ID NO: 1133679 - RNA, 19 nt, Homo sapiens
gugcuugucugcagaguca

SEQ ID NO: 1133680 - RNA, 19 nt, Homo sapiens
ggugauaguuucuccacau

SEQ ID NO: 1133681 - RNA, 19 nt, Homo sapiens
agaauaggacgauaugauu

SEQ ID NO: 1133682 - RNA, 19 nt, Homo sapiens
ccacauuugauacuccuua

SEQ ID NO: 1133683 - RNA, 19 nt, Homo sapiens
gcaaucguguauucagaca

SEQ ID NO: 1133684 - RNA, 19 nt, Homo sapiens
gugauaguuucuccacauu

SEQ ID NO: 1133685 - RNA, 19 nt, Homo sapiens
agaagaagcaaucguguau

SEQ ID NO: 1133686 - RNA, 19 nt, Homo sapiens
ucauccagcuucagauuuc

SEQ ID NO: 1133687 - RNA, 19 nt, Homo sapiens
cuagcaaaguauagaaaga

SEQ ID NO: 1133688 - RNA, 19 nt, Homo sapiens
gagccaaaauaguuucuuu

SEQ ID NO: 1133689 - RNA, 19 nt, Homo sapiens
gaagaagcaaucguguauu

SEQ ID NO: 1133690 - RNA, 19 nt, Homo sapiens
cagaagaagcaaucgugua

SEQ ID NO: 1133691 - RNA, 19 nt, Homo sapiens
cuucagauuucuuccauca

SEQ ID NO: 1133692 - RNA, 19 nt, Homo sapiens
gaggcucuaucccugaaga

SEQ ID NO: 1133693 - RNA, 19 nt, Homo sapiens
cagaauaggacgauaugau

SEQ ID NO: 1133694 - RNA, 19 nt, Homo sapiens
ucacagaauaggacgauau

SEQ ID NO: 1133695 - RNA, 19 nt, Homo sapiens
gaugcugggaaauuauaua

SEQ ID NO: 1133696 - RNA, 19 nt, Homo sapiens
acauagaccugaagaagcu

SEQ ID NO: 1133697 - RNA, 19 nt, Homo sapiens
ugaaauacgccagcaaauc

SEQ ID NO: 1133698 - RNA, 19 nt, Homo sapiens
aagcaaucguguauucaga

SEQ ID NO: 1133699 - RNA, 19 nt, Homo sapiens
acaaaucuacgcacagaga

SEQ ID NO: 1133700 - RNA, 19 nt, Homo sapiens
gggcaucugcuacgacaug

SEQ ID NO: 1133701 - RNA, 19 nt, Homo sapiens
cgauaugauucuacaacau

SEQ ID NO: 1133702 - RNA, 19 nt, Homo sapiens
ccaaagcuggcacagaaga

SEQ ID NO: 1133703 - RNA, 19 nt, Homo sapiens
ucuaugcuguggagaugaa

SEQ ID NO: 1133704 - RNA, 19 nt, Homo sapiens
gaagcaaucguguauucag

SEQ ID NO: 1133705 - RNA, 19 nt, Homo sapiens
gaauccacacagaagcuuu

SEQ ID NO: 1133706 - RNA, 19 nt, Homo sapiens
agacauagaccugaagaag

SEQ ID NO: 1133707 - RNA, 19 nt, Homo sapiens
uuucuuccaucaaaucaga

SEQ ID NO: 1133708 - RNA, 19 nt, Homo sapiens
gaggaugcugggaaauuau

SEQ ID NO: 1133709 - RNA, 19 nt, Homo sapiens
ccucuaugcuguggagaug

SEQ ID NO: 1133710 - RNA, 19 nt, Homo sapiens
caaagcuggcacagaagaa

SEQ ID NO: 1133711 - RNA, 19 nt, Homo sapiens
gcagagcuugcacaaaucu

SEQ ID NO: 1133712 - RNA, 19 nt, Homo sapiens
ccuggugaauccacacaga

SEQ ID NO: 1133713 - RNA, 19 nt, Homo sapiens
uugccggaaugcuuuaauu

SEQ ID NO: 1133714 - RNA, 19 nt, Homo sapiens
gcacagaagaagcaaucgu

SEQ ID NO: 1133715 - RNA, 19 nt, Homo sapiens
gaugacaaagccuccuaug

SEQ ID NO: 1133716 - RNA, 19 nt, Homo sapiens
uuucugaaguagcaaagga

SEQ ID NO: 1133717 - RNA, 19 nt, Homo sapiens
gggaugacaaagccuccua

SEQ ID NO: 1133718 - RNA, 19 nt, Homo sapiens
ugaguccgggugauaguuu

SEQ ID NO: 1133719 - RNA, 19 nt, Homo sapiens
uccugaauaugcagagaaa

SEQ ID NO: 1133720 - RNA, 19 nt, Homo sapiens
ccucauccagcuucagauu

SEQ ID NO: 1133721 - RNA, 19 nt, Homo sapiens
aagaggaugcugggaaauu

SEQ ID NO: 1133722 - RNA, 19 nt, Homo sapiens
gaagaggaugcugggaaau

SEQ ID NO: 1133723 - RNA, 19 nt, Homo sapiens
caaaguauagaaagaucca

SEQ ID NO: 1133724 - RNA, 19 nt, Homo sapiens
ugcagcauauaucucauug

SEQ ID NO: 1133725 - RNA, 19 nt, Homo sapiens
ggaggcagcaacgcaagga

SEQ ID NO: 1133726 - RNA, 19 nt, Homo sapiens
acgauaugauucuacaaca

SEQ ID NO: 1133727 - RNA, 19 nt, Homo sapiens
uggaggcucuaucccugaa

SEQ ID NO: 1133728 - RNA, 19 nt, Homo sapiens
gacgauaugauucuacaac

SEQ ID NO: 1133729 - RNA, 19 nt, Homo sapiens
ggaugacaaagccuccuau

SEQ ID NO: 1133730 - RNA, 19 nt, Homo sapiens
gaguccgggugauaguuuc

SEQ ID NO: 1133731 - RNA, 19 nt, Homo sapiens
auaggacgauaugauucua

SEQ ID NO: 1133732 - RNA, 19 nt, Homo sapiens
cacagaauaggacgauaug

SEQ ID NO: 1133733 - RNA, 19 nt, Homo sapiens
ugauaguuucuccacauuu

SEQ ID NO: 1133734 - RNA, 19 nt, Homo sapiens
gcuuuaauucuccauaugg

SEQ ID NO: 1133735 - RNA, 19 nt, Homo sapiens
ccaggagcuuuuaaucuga

SEQ ID NO: 1133736 - RNA, 19 nt, Homo sapiens
aggaugcugggaaauuaua

SEQ ID NO: 1133737 - RNA, 19 nt, Homo sapiens
ugaaguagcaaaggaaugc

SEQ ID NO: 1133738 - RNA, 19 nt, Homo sapiens
gcccucauccagcuucaga

SEQ ID NO: 1133739 - RNA, 19 nt, Homo sapiens
gagaauaaaucaagagcua

SEQ ID NO: 1133740 - RNA, 19 nt, Homo sapiens
gaaauggauuccuuuaaug

SEQ ID NO: 1133741 - RNA, 19 nt, Homo sapiens
guacucaucuugacacaaa

SEQ ID NO: 1133742 - RNA, 19 nt, Homo sapiens
caagcaaccuuaaaugaaa

SEQ ID NO: 1133743 - RNA, 19 nt, Homo sapiens
cgaaauggauuccuuuaau

SEQ ID NO: 1133744 - RNA, 19 nt, Homo sapiens
gaaaguaccaacuauaaug

SEQ ID NO: 1133745 - RNA, 19 nt, Homo sapiens
caaacuacaugaccaagaa

SEQ ID NO: 1133746 - RNA, 19 nt, Homo sapiens
gcgcagcucucaucagaaa

SEQ ID NO: 1133747 - RNA, 19 nt, Homo sapiens
acaaaugccuucuauguug

SEQ ID NO: 1133748 - RNA, 19 nt, Homo sapiens
gacagagacugaauaaaga

SEQ ID NO: 1133749 - RNA, 19 nt, Homo sapiens
gagaauaagggaaguagua

SEQ ID NO: 1133750 - RNA, 19 nt, Homo sapiens
ggaaauaccauuggaacua

SEQ ID NO: 1133751 - RNA, 19 nt, Homo sapiens
gaaaggguguagaucauuc

SEQ ID NO: 1133752 - RNA, 19 nt, Homo sapiens
gcaagagaauaaaucaaga

SEQ ID NO: 1133753 - RNA, 19 nt, Homo sapiens
gaaccaagcaaccuuaaau

SEQ ID NO: 1133754 - RNA, 19 nt, Homo sapiens
gaaauaccauuggaacuag

SEQ ID NO: 1133755 - RNA, 19 nt, Homo sapiens
ggaaagaaagaaagauuug

SEQ ID NO: 1133756 - RNA, 19 nt, Homo sapiens
caagagcuaucaucuaaag

SEQ ID NO: 1133757 - RNA, 19 nt, Homo sapiens
gagcuaucaucuaaagaaa

SEQ ID NO: 1133758 - RNA, 19 nt, Homo sapiens
gaaagaggcagaugcuguu

SEQ ID NO: 1133759 - RNA, 19 nt, Homo sapiens
gcagcucucaucagaaaua

SEQ ID NO: 1133760 - RNA, 19 nt, Homo sapiens
uugaguaggugucauuuaa

SEQ ID NO: 1133761 - RNA, 19 nt, Homo sapiens
ggaagguugaguuucauua

SEQ ID NO: 1133762 - RNA, 19 nt, Homo sapiens
uaagucaacugggaauaaa

SEQ ID NO: 1133763 - RNA, 19 nt, Homo sapiens
guagagggcagcaacgaua

SEQ ID NO: 1133764 - RNA, 19 nt, Homo sapiens
gccugaggaugucaauuua

SEQ ID NO: 1133765 - RNA, 19 nt, Homo sapiens
gaacugagugagccaagaa

SEQ ID NO: 1133766 - RNA, 19 nt, Homo sapiens
gagcagguauucugaaggu

SEQ ID NO: 1133767 - RNA, 19 nt, Homo sapiens
gcaaaggcaguaccagaaa

SEQ ID NO: 1133768 - RNA, 19 nt, Homo sapiens
ggagcucccuggaagagaa

SEQ ID NO: 1133769 - RNA, 19 nt, Homo sapiens
ugauauaucuccuuucagu

SEQ ID NO: 1133770 - RNA, 19 nt, Homo sapiens
caaagagaauacucacaau

SEQ ID NO: 1133771 - RNA, 19 nt, Homo sapiens
ggaaguaguaaaucucaaa

SEQ ID NO: 1133772 - RNA, 19 nt, Homo sapiens
aaagaagccucaaagagau

SEQ ID NO: 1133773 - RNA, 19 nt, Homo sapiens
aaagcacacucgaaggaua

SEQ ID NO: 1133774 - RNA, 19 nt, Homo sapiens
ggauggagaugaugcuauc

SEQ ID NO: 1133775 - RNA, 19 nt, Homo sapiens
ucacaaaugccuucuaugu

SEQ ID NO: 1133776 - RNA, 19 nt, Homo sapiens
caucagaaauaacaugcaa

SEQ ID NO: 1133777 - RNA, 19 nt, Homo sapiens
gaauaaaggguuugaggau

SEQ ID NO: 1133778 - RNA, 19 nt, Homo sapiens
caagaauccuggucuccuu

SEQ ID NO: 1133779 - RNA, 19 nt, Homo sapiens
gcaaguaugaauuaugcua

SEQ ID NO: 1133780 - RNA, 19 nt, Homo sapiens
ggugaaagauaccagagau

SEQ ID NO: 1133781 - RNA, 19 nt, Homo sapiens
ccagaaaaguccaguaaaa

SEQ ID NO: 1133782 - RNA, 19 nt, Homo sapiens
acaaauagacagagacuga

SEQ ID NO: 1133783 - RNA, 19 nt, Homo sapiens
aucaagagcuaucaucuaa

SEQ ID NO: 1133784 - RNA, 19 nt, Homo sapiens
aacaaagguuuccuaguaa

SEQ ID NO: 1133785 - RNA, 19 nt, Homo sapiens
ccaagcaaccuuaaaugaa

SEQ ID NO: 1133786 - RNA, 19 nt, Homo sapiens
gaagagaggauagagugaa

SEQ ID NO: 1133787 - RNA, 19 nt, Homo sapiens
ggccugaggaugucaauuu

SEQ ID NO: 1133788 - RNA, 19 nt, Homo sapiens
agacagagacugaauaaag

SEQ ID NO: 1133789 - RNA, 19 nt, Homo sapiens
ugagagcgauggugacuag

SEQ ID NO: 1133790 - RNA, 19 nt, Homo sapiens
acacaacauugacuaccua

SEQ ID NO: 1133791 - RNA, 19 nt, Homo sapiens
uaagggaaguaguaaaucu

SEQ ID NO: 1133792 - RNA, 19 nt, Homo sapiens
gcaaagcuguguggaagag

SEQ ID NO: 1133793 - RNA, 19 nt, Homo sapiens
caaaugccuucuauguugu

SEQ ID NO: 1133794 - RNA, 19 nt, Homo sapiens
gaauaaggguaugccacaa

SEQ ID NO: 1133795 - RNA, 19 nt, Homo sapiens
gcugaaaguaccaacuaua

SEQ ID NO: 1133796 - RNA, 19 nt, Homo sapiens
gggaugaaacugcgaaaga

SEQ ID NO: 1133797 - RNA, 19 nt, Homo sapiens
aacaauaucucucgaugau

SEQ ID NO: 1133798 - RNA, 19 nt, Homo sapiens
ggaugaaacugcgaaagag

SEQ ID NO: 1133799 - RNA, 19 nt, Homo sapiens
gaaggcaaagauauucaaa

SEQ ID NO: 1133800 - RNA, 19 nt, Homo sapiens
cagcaaguaugaauuaugc

SEQ ID NO: 1133801 - RNA, 19 nt, Homo sapiens
gagaacacaccuaggaaug

SEQ ID NO: 1133802 - RNA, 19 nt, Homo sapiens
aggcaaagauauucaaaca

SEQ ID NO: 1133803 - RNA, 19 nt, Homo sapiens
gaauaagggaaguaguaaa

SEQ ID NO: 1133804 - RNA, 19 nt, Homo sapiens
gcacgagcagguauucuga

SEQ ID NO: 1133805 - RNA, 19 nt, Homo sapiens
gagcagaggcaggaagaaa

SEQ ID NO: 1133806 - RNA, 19 nt, Homo sapiens
ugucacaaaugccuucuau

SEQ ID NO: 1133807 - RNA, 19 nt, Homo sapiens
cagaaaggguguagaucau

SEQ ID NO: 1133808 - RNA, 19 nt, Homo sapiens
aaacaucucucaaaaguca

SEQ ID NO: 1133809 - RNA, 19 nt, Homo sapiens
aaagagaacacaccuagga

SEQ ID NO: 1133810 - RNA, 19 nt, Homo sapiens
gaagggaugacaguaguga

SEQ ID NO: 1133811 - RNA, 19 nt, Homo sapiens
ccagaaaggguguagauca

SEQ ID NO: 1133812 - RNA, 19 nt, Homo sapiens
gaauaaaucaagagcuauc

SEQ ID NO: 1133813 - RNA, 19 nt, Homo sapiens
aaagaaggcaguagugaug

SEQ ID NO: 1133814 - RNA, 19 nt, Homo sapiens
uggcgcagcucucaucaga

SEQ ID NO: 1133815 - RNA, 19 nt, Homo sapiens
cugaaaguaccaacuauaa

SEQ ID NO: 1133816 - RNA, 19 nt, Homo sapiens
aagggaagguugaguuuca

SEQ ID NO: 1133817 - RNA, 19 nt, Homo sapiens
gaagagaaggaaacagagu

SEQ ID NO: 1133818 - RNA, 19 nt, Homo sapiens
acaaagagaauacucacaa

SEQ ID NO: 1133819 - RNA, 19 nt, Homo sapiens
gagaggauagagugaagaa

SEQ ID NO: 1133820 - RNA, 19 nt, Homo sapiens
caaaggcaguaccagaaag

SEQ ID NO: 1133821 - RNA, 19 nt, Homo sapiens
gaccuagaaggcaaagaua

SEQ ID NO: 1133822 - RNA, 19 nt, Homo sapiens
gaaggcagcgguuauacag

SEQ ID NO: 1133823 - RNA, 19 nt, Homo sapiens
gaauauggcgcagcucuca

SEQ ID NO: 1133824 - RNA, 19 nt, Homo sapiens
gcaaacuacaugaccaaga

SEQ ID NO: 1133825 - RNA, 19 nt, Homo sapiens
gaguaggugucauuuaaaa

SEQ ID NO: 1133826 - RNA, 19 nt, Homo sapiens
uagaagggaugacaguagu

SEQ ID NO: 1133827 - RNA, 19 nt, Homo sapiens
cagcugaaaguaccaacua

SEQ ID NO: 1133828 - RNA, 19 nt, Homo sapiens
ccaagggaagguugaguuu

SEQ ID NO: 1133829 - RNA, 19 nt, Homo sapiens
ccuaaaacaucucucaaaa

SEQ ID NO: 1133830 - RNA, 19 nt, Homo sapiens
caacauugacuaccuaaaa

SEQ ID NO: 1133831 - RNA, 19 nt, Homo sapiens
caggaaagaaagaaagauu

SEQ ID NO: 1133832 - RNA, 19 nt, Homo sapiens
gaaagauaccagagauucu

SEQ ID NO: 1133833 - RNA, 19 nt, Homo sapiens
aaacgaaauggauuccuuu

SEQ ID NO: 1133834 - RNA, 19 nt, Homo sapiens
ggaaccaagcaaccuuaaa

SEQ ID NO: 1133835 - RNA, 19 nt, Homo sapiens
ggcaaaggcaguaccagaa

SEQ ID NO: 1133836 - RNA, 19 nt, Homo sapiens
gaagaaaaugguggaaaua

SEQ ID NO: 1133837 - RNA, 19 nt, Homo sapiens
gaaaauauuguccaggaaa

SEQ ID NO: 1133838 - RNA, 19 nt, Homo sapiens
gacaguggcaguucaagug

SEQ ID NO: 1133839 - RNA, 19 nt, Homo sapiens
gaucaugaauggaggaaua

SEQ ID NO: 1133840 - RNA, 19 nt, Homo sapiens
gcagcaagcucaagaagaa

SEQ ID NO: 1133841 - RNA, 19 nt, Homo sapiens
caaaggagguucucaguca

SEQ ID NO: 1133842 - RNA, 19 nt, Homo sapiens
cuaauuggcucaucaagaa

SEQ ID NO: 1133843 - RNA, 19 nt, Homo sapiens
ggaaagaauugggauguga

SEQ ID NO: 1133844 - RNA, 19 nt, Homo sapiens
ggaaugaacugaucaagcu

SEQ ID NO: 1133845 - RNA, 19 nt, Homo sapiens
ggacauggaugcuguucug

SEQ ID NO: 1133846 - RNA, 19 nt, Homo sapiens
gaaucuaucugccuuugga

SEQ ID NO: 1133847 - RNA, 19 nt, Homo sapiens
gaagggaguugagaaggaa

SEQ ID NO: 1133848 - RNA, 19 nt, Homo sapiens
caaggaggcuaaacaaagu

SEQ ID NO: 1133849 - RNA, 19 nt, Homo sapiens
gaaggagaauaccaaggaa

SEQ ID NO: 1133850 - RNA, 19 nt, Homo sapiens
agauggcgauucugucuua

SEQ ID NO: 1133851 - RNA, 19 nt, Homo sapiens
gcaaggaggcuaaacaaag

SEQ ID NO: 1133852 - RNA, 19 nt, Homo sapiens
gaacaggcagggcguuuga

SEQ ID NO: 1133853 - RNA, 19 nt, Homo sapiens
ugaaaguacuugaggauca

SEQ ID NO: 1133854 - RNA, 19 nt, Homo sapiens
gcagagaggaagaucauga

SEQ ID NO: 1133855 - RNA, 19 nt, Homo sapiens
gcacugagacacuggagaa

SEQ ID NO: 1133856 - RNA, 19 nt, Homo sapiens
cugcauagcuacaugaaug

SEQ ID NO: 1133857 - RNA, 19 nt, Homo sapiens
ucacaggggugccuuguua

SEQ ID NO: 1133858 - RNA, 19 nt, Homo sapiens
uggcgauucugucuuauaa

SEQ ID NO: 1133859 - RNA, 19 nt, Homo sapiens
ggaagcagcggcacugaga

SEQ ID NO: 1133860 - RNA, 19 nt, Homo sapiens
caaagaugauagugacaau

SEQ ID NO: 1133861 - RNA, 19 nt, Homo sapiens
ugagagccuugaagaguuu

SEQ ID NO: 1133862 - RNA, 19 nt, Homo sapiens
ggaguggaaugaacugauc

SEQ ID NO: 1133863 - RNA, 19 nt, Homo sapiens
agacacagcagaauaaaga

SEQ ID NO: 1133864 - RNA, 19 nt, Homo sapiens
uuccagaucucacuguaua

SEQ ID NO: 1133865 - RNA, 19 nt, Homo sapiens
cugcagagcuugacuugau

SEQ ID NO: 1133866 - RNA, 19 nt, Homo sapiens
gaacugcagcuucuaugga

SEQ ID NO: 1133867 - RNA, 19 nt, Homo sapiens
agaggaagaucaugaaugg

SEQ ID NO: 1133868 - RNA, 19 nt, Homo sapiens
gcggaaagcuuuguaugca

SEQ ID NO: 1133869 - RNA, 19 nt, Homo sapiens
caaccgaacugcagcuucu

SEQ ID NO: 1133870 - RNA, 19 nt, Homo sapiens
gggaugggccugugucuga

SEQ ID NO: 1133871 - RNA, 19 nt, Homo sapiens
gaaagaauugggaugugaa

SEQ ID NO: 1133872 - RNA, 19 nt, Homo sapiens
ccgaguggcugauuccuau

SEQ ID NO: 1133873 - RNA, 19 nt, Homo sapiens
cugaggagccuguauauga

SEQ ID NO: 1133874 - RNA, 19 nt, Homo sapiens
cagcagacacagcagaaua

SEQ ID NO: 1133875 - RNA, 19 nt, Homo sapiens
ggaaaaugcaguaauguuu

SEQ ID NO: 1133876 - RNA, 19 nt, Homo sapiens
caacucagaccaaaugcaa

SEQ ID NO: 1133877 - RNA, 19 nt, Homo sapiens
uaacaaacugggcagcuuu

SEQ ID NO: 1133878 - RNA, 19 nt, Homo sapiens
gagguucucagucaauaaa

SEQ ID NO: 1133879 - RNA, 19 nt, Homo sapiens
gcaaagaugauagugacaa

SEQ ID NO: 1133880 - RNA, 19 nt, Homo sapiens
gaggugggcagaagucuug

SEQ ID NO: 1133881 - RNA, 19 nt, Homo sapiens
gagaggaagaucaugaaug

SEQ ID NO: 1133882 - RNA, 19 nt, Homo sapiens
ggaucccacuguccucuga

SEQ ID NO: 1133883 - RNA, 19 nt, Homo sapiens
gcaucuagguaccaaugga

SEQ ID NO: 1133884 - RNA, 19 nt, Homo sapiens
uguaugcacugauggagaa

SEQ ID NO: 1133885 - RNA, 19 nt, Homo sapiens
cauggaugcuguucuguca

SEQ ID NO: 1133886 - RNA, 19 nt, Homo sapiens
ucaacuaauuggcucauca

SEQ ID NO: 1133887 - RNA, 19 nt, Homo sapiens
gcugauuccuauagcaaug

SEQ ID NO: 1133888 - RNA, 19 nt, Homo sapiens
cagcugagucuguugguaa

SEQ ID NO: 1133889 - RNA, 19 nt, Homo sapiens
cugagacacuggagaagaa

SEQ ID NO: 1133890 - RNA, 19 nt, Homo sapiens
gaaugcaucuagguaccaa

SEQ ID NO: 1133891 - RNA, 19 nt, Homo sapiens
agaagggaguugagaagga

SEQ ID NO: 1133892 - RNA, 19 nt, Homo sapiens
guucugaggagccuguaua

SEQ ID NO: 1133893 - RNA, 19 nt, Homo sapiens
uaacggagggagcaaguau

SEQ ID NO: 1133894 - RNA, 19 nt, Homo sapiens
caagcugugaucccacuua

SEQ ID NO: 1133895 - RNA, 19 nt, Homo sapiens
gagguggaggccugaauuu

SEQ ID NO: 1133896 - RNA, 19 nt, Homo sapiens
gguauacacagaagaugaa

SEQ ID NO: 1133897 - RNA, 19 nt, Homo sapiens
gaugagguuugagguacaa

SEQ ID NO: 1133898 - RNA, 19 nt, Homo sapiens
ccgauuggccaguguaauu

SEQ ID NO: 1133899 - RNA, 19 nt, Homo sapiens
cucagaggcugcuuccuuu

SEQ ID NO: 1133900 - RNA, 19 nt, Homo sapiens
gaaaagauggcgauucugu

SEQ ID NO: 1133901 - RNA, 19 nt, Homo sapiens
gggcaaggaggcuaaacaa

SEQ ID NO: 1133902 - RNA, 19 nt, Homo sapiens
gaaaaugcaguaauguuug

SEQ ID NO: 1133903 - RNA, 19 nt, Homo sapiens
gcacagcaaggguucaaag

SEQ ID NO: 1133904 - RNA, 19 nt, Homo sapiens
gcagaaggaguggaaugaa

SEQ ID NO: 1133905 - RNA, 19 nt, Homo sapiens
gcagacacagcagaauaaa

SEQ ID NO: 1133906 - RNA, 19 nt, Homo sapiens
ggagaagggaguugagaag

SEQ ID NO: 1133907 - RNA, 19 nt, Homo sapiens
gcaugcagccucccuugga

SEQ ID NO: 1133908 - RNA, 19 nt, Homo sapiens
gaaaguacuugaggaucac

SEQ ID NO: 1133909 - RNA, 19 nt, Homo sapiens
ggagaaggacaagaagaga

SEQ ID NO: 1133910 - RNA, 19 nt, Homo sapiens
agaaggagaauaccaagga

SEQ ID NO: 1133911 - RNA, 19 nt, Homo sapiens
ccauggagcagaaggagaa

SEQ ID NO: 1133912 - RNA, 19 nt, Homo sapiens
uauaugagagccuugaaga

SEQ ID NO: 1133913 - RNA, 19 nt, Homo sapiens
ggagguggcagcagacaca

SEQ ID NO: 1133914 - RNA, 19 nt, Homo sapiens
gcuuccagaucucacugua

SEQ ID NO: 1133915 - RNA, 19 nt, Homo sapiens
gggaaaagauggcgauucu

SEQ ID NO: 1133916 - RNA, 19 nt, Homo sapiens
caacuaauuggcucaucaa

SEQ ID NO: 1133917 - RNA, 19 nt, Homo sapiens
aaacaaaguuaagcucaac

SEQ ID NO: 1133918 - RNA, 19 nt, Homo sapiens
ggagagauuccuggcagaa

SEQ ID NO: 1133919 - RNA, 19 nt, Homo sapiens
cagaaggaguggaaugaac

SEQ ID NO: 1133920 - RNA, 19 nt, Homo sapiens
uaaagagucagggcuggua

SEQ ID NO: 1133921 - RNA, 19 nt, Homo sapiens
ucccaugucuccuccaaug

SEQ ID NO: 1133922 - RNA, 19 nt, Homo sapiens
ggagguucucagucaauaa

SEQ ID NO: 1133923 - RNA, 19 nt, Homo sapiens
ggaaugggcaaaggagguu

SEQ ID NO: 1133924 - RNA, 19 nt, Homo sapiens
cagaacagaagcagaagga

SEQ ID NO: 1133925 - RNA, 19 nt, Homo sapiens
gacaagaagagagcagauu

SEQ ID NO: 1133926 - RNA, 19 nt, Homo sapiens
acuuacagauucagaguau

SEQ ID NO: 1133927 - RNA, 19 nt, Homo sapiens
cacgccagcuccagcauug

SEQ ID NO: 1133928 - RNA, 19 nt, Homo sapiens
cuaacaaacugggcagcuu

SEQ ID NO: 1133929 - RNA, 19 nt, Homo sapiens
ugaggagccuguauaugag

SEQ ID NO: 1133930 - RNA, 19 nt, Homo sapiens
ggucacugccgaggaauga

SEQ ID NO: 1133931 - RNA, 19 nt, Homo sapiens
agagauuccuggcagaaca

SEQ ID NO: 1133932 - RNA, 19 nt, Homo sapiens
guacuugaggaucacauga

SEQ ID NO: 1133933 - RNA, 19 nt, Homo sapiens
caugcagccucccuuggaa

SEQ ID NO: 1133934 - RNA, 19 nt, Homo sapiens
aaaggagguucucagucaa

SEQ ID NO: 1133935 - RNA, 19 nt, Homo sapiens
gcagagcuugacuugauga

SEQ ID NO: 1133936 - RNA, 19 nt, Homo sapiens
uggcagaacagaagcagaa

SEQ ID NO: 1133937 - RNA, 19 nt, Homo sapiens
ucugaggacugccaugcaa

SEQ ID NO: 1133938 - RNA, 19 nt, Homo sapiens
gaucccacuuacagauuca

SEQ ID NO: 1133939 - RNA, 19 nt, Homo sapiens
gagaagagauccuugacuu

SEQ ID NO: 1133940 - RNA, 19 nt, Homo sapiens
ccucuaaucucuucccuua

SEQ ID NO: 1133941 - RNA, 19 nt, Homo sapiens
cuaaaugucuaaacagaga

SEQ ID NO: 1133942 - RNA, 19 nt, Homo sapiens
gcaagauccucaagugcaa

SEQ ID NO: 1133943 - RNA, 19 nt, Homo sapiens
aagacaaacugcaccugua

SEQ ID NO: 1133944 - RNA, 19 nt, Homo sapiens
ucaagaugcuccacuccaa

SEQ ID NO: 1133945 - RNA, 19 nt, Homo sapiens
gaucugccauuacgagaag

SEQ ID NO: 1133946 - RNA, 19 nt, Homo sapiens
cgaagugcuugguucuaaa

SEQ ID NO: 1133947 - RNA, 19 nt, Homo sapiens
ucgaagugcuugguucuaa

SEQ ID NO: 1133948 - RNA, 19 nt, Homo sapiens
gccaacagccugaagauca

SEQ ID NO: 1133949 - RNA, 19 nt, Homo sapiens
aaacugcaccuguaugaga

SEQ ID NO: 1133950 - RNA, 19 nt, Homo sapiens
ccagcaagcucaccaucau

SEQ ID NO: 1133951 - RNA, 19 nt, Homo sapiens
gcacaacugcuccaaggau

SEQ ID NO: 1133952 - RNA, 19 nt, Homo sapiens
gcuaaaugcaaguaaaguu

SEQ ID NO: 1133953 - RNA, 19 nt, Homo sapiens
ggagaggagcagggucuua

SEQ ID NO: 1133954 - RNA, 19 nt, Homo sapiens
ucuaaucucuucccuuaag

SEQ ID NO: 1133955 - RNA, 19 nt, Homo sapiens
gccugaagaucacugagaa

SEQ ID NO: 1133956 - RNA, 19 nt, Homo sapiens
gaagugcuugguucuaaau

SEQ ID NO: 1133957 - RNA, 19 nt, Homo sapiens
guuggaggaugucaagaug

SEQ ID NO: 1133958 - RNA, 19 nt, Homo sapiens
cagaggaaguggucaaugc

SEQ ID NO: 1133959 - RNA, 19 nt, Homo sapiens
ccaggaggcugcagaacgu

SEQ ID NO: 1133960 - RNA, 19 nt, Homo sapiens
gguucuaaaugucuaaaca

SEQ ID NO: 1133961 - RNA, 19 nt, Homo sapiens
gcagugugaaugugugaaa

SEQ ID NO: 1133962 - RNA, 19 nt, Homo sapiens
gccgugauguuugacagua

SEQ ID NO: 1133963 - RNA, 19 nt, Homo sapiens
agacagccguggccaagug

SEQ ID NO: 1133964 - RNA, 19 nt, Homo sapiens
cgacaauaauuaccugaac

SEQ ID NO: 1133965 - RNA, 19 nt, Homo sapiens
gcaaguaaaguuugguuuu

SEQ ID NO: 1133966 - RNA, 19 nt, Homo sapiens
cgaccuguguggaguguca

SEQ ID NO: 1133967 - RNA, 19 nt, Homo sapiens
ccagggaccucucauacac

SEQ ID NO: 1133968 - RNA, 19 nt, Homo sapiens
acaaacugcaccuguauga

SEQ ID NO: 1133969 - RNA, 19 nt, Homo sapiens
ggccgcucaucgacaauaa

SEQ ID NO: 1133970 - RNA, 19 nt, Homo sapiens
gcagggucuucaaccucua

SEQ ID NO: 1133971 - RNA, 19 nt, Homo sapiens
cgugcaagauccucaagug

SEQ ID NO: 1133972 - RNA, 19 nt, Homo sapiens
gcucaucgacaauaauuac

SEQ ID NO: 1133973 - RNA, 19 nt, Homo sapiens
gucccuauguuggaaguaa

SEQ ID NO: 1133974 - RNA, 19 nt, Homo sapiens
aaacagagaagagauccuu

SEQ ID NO: 1133975 - RNA, 19 nt, Homo sapiens
agagauccuugacuucugu

SEQ ID NO: 1133976 - RNA, 19 nt, Homo sapiens
uggaggaccuguacuacca

SEQ ID NO: 1133977 - RNA, 19 nt, Homo sapiens
gagaggagcagggucuuag

SEQ ID NO: 1133978 - RNA, 19 nt, Homo sapiens
gggagaggcuagugguaac

SEQ ID NO: 1133979 - RNA, 19 nt, Homo sapiens
ggacagccagggucucuac

SEQ ID NO: 1133980 - RNA, 19 nt, Homo sapiens
ccacaccucaggacuuuca

SEQ ID NO: 1133981 - RNA, 19 nt, Homo sapiens
ggucuucaaccucuaaucu

SEQ ID NO: 1133982 - RNA, 19 nt, Homo sapiens
gugcuugguucuaaauguc

SEQ ID NO: 1133983 - RNA, 19 nt, Homo sapiens
ggugacuggugccgugaug

SEQ ID NO: 1133984 - RNA, 19 nt, Homo sapiens
agacaaacugcaccuguau

SEQ ID NO: 1133985 - RNA, 19 nt, Homo sapiens
gaugcuccacuccaacaaa

SEQ ID NO: 1133986 - RNA, 19 nt, Homo sapiens
gcacgcacacacucuuaca

SEQ ID NO: 1133987 - RNA, 19 nt, Homo sapiens
acccacaccucaggacuuu

SEQ ID NO: 1133988 - RNA, 19 nt, Homo sapiens
gaggagcagggucuuagga

SEQ ID NO: 1133989 - RNA, 19 nt, Homo sapiens
acagagaagagauccuuga

SEQ ID NO: 1133990 - RNA, 19 nt, Homo sapiens
gaaagucgaagugcuuggu

SEQ ID NO: 1133991 - RNA, 19 nt, Homo sapiens
uuagaaagucgaagugcuu

SEQ ID NO: 1133992 - RNA, 19 nt, Homo sapiens
ggagauccaggccaaguac

SEQ ID NO: 1133993 - RNA, 19 nt, Homo sapiens
caagcucaccaucaucuuc

SEQ ID NO: 1133994 - RNA, 19 nt, Homo sapiens
gugaagcacuuuauuuugg

SEQ ID NO: 1133995 - RNA, 19 nt, Homo sapiens
gcuugguucuaaaugucua

SEQ ID NO: 1133996 - RNA, 19 nt, Homo sapiens
ccacuccaacaaagacaaa

SEQ ID NO: 1133997 - RNA, 19 nt, Homo sapiens
guucagcccugggauucug

SEQ ID NO: 1133998 - RNA, 19 nt, Homo sapiens
cuaccaggccugcgucuuc

SEQ ID NO: 1133999 - RNA, 19 nt, Homo sapiens
ccgcucaucgacaauaauu

SEQ ID NO: 1134000 - RNA, 19 nt, Homo sapiens
cgagaagagcuuucacaag

SEQ ID NO: 1134001 - RNA, 19 nt, Homo sapiens
gguuguguuugcucacguu

SEQ ID NO: 1134002 - RNA, 19 nt, Homo sapiens
gcuaugcccacagcacaaa

SEQ ID NO: 1134003 - RNA, 19 nt, Homo sapiens
gccccgagaucugccauua

SEQ ID NO: 1134004 - RNA, 19 nt, Homo sapiens
cgugauguuugacaguaga

SEQ ID NO: 1134005 - RNA, 19 nt, Homo sapiens
ugacuggugccgugauguu

SEQ ID NO: 1134006 - RNA, 19 nt, Homo sapiens
ggcgcugcuuggcaccuua

SEQ ID NO: 1134007 - RNA, 19 nt, Homo sapiens
ccuggccgcucaucgacaa

SEQ ID NO: 1134008 - RNA, 19 nt, Homo sapiens
ggcaggagacccaguggau

SEQ ID NO: 1134009 - RNA, 19 nt, Homo sapiens
ucaaccagcagaucgacuu

SEQ ID NO: 1134010 - RNA, 19 nt, Homo sapiens
ggccguccauggcauagag

SEQ ID NO: 1134011 - RNA, 19 nt, Homo sapiens
cuggugccgugauguuuga

SEQ ID NO: 1134012 - RNA, 19 nt, Homo sapiens
gacaaacugcaccuguaug

SEQ ID NO: 1134013 - RNA, 19 nt, Homo sapiens
gaccuucccauacgagaca

SEQ ID NO: 1134014 - RNA, 19 nt, Homo sapiens
ccaacagccugaagaucac

SEQ ID NO: 1134015 - RNA, 19 nt, Homo sapiens
aggaguguguggaccagaa

SEQ ID NO: 1134016 - RNA, 19 nt, Homo sapiens
aaaugcaaguaaaguuugg

SEQ ID NO: 1134017 - RNA, 19 nt, Homo sapiens
guuggucccuauguuggaa

SEQ ID NO: 1134018 - RNA, 19 nt, Homo sapiens
uuuaguuggucccuauguu

SEQ ID NO: 1134019 - RNA, 19 nt, Homo sapiens
gugcagccuugcgcagcua

SEQ ID NO: 1134020 - RNA, 19 nt, Homo sapiens
uggccucccugcccauguu

SEQ ID NO: 1134021 - RNA, 19 nt, Homo sapiens
gcaagcucaccaucaucuu

SEQ ID NO: 1134022 - RNA, 19 nt, Homo sapiens
gcucacguucugcuuggaa

SEQ ID NO: 1134023 - RNA, 19 nt, Homo sapiens
gaagcacuuuauuuugguu

SEQ ID NO: 1134024 - RNA, 19 nt, Homo sapiens
uuaguuggucccuauguug

SEQ ID NO: 1134025 - RNA, 19 nt, Homo sapiens
aagagauccuugacuucug

SEQ ID NO: 1134026 - RNA, 19 nt, Homo sapiens
guaacaggccgagcuggau

SEQ ID NO: 1134027 - RNA, 19 nt, Homo sapiens
uagugcacgugacaagguu

SEQ ID NO: 1134028 - RNA, 19 nt, Homo sapiens
gacccacaccucaggacuu

SEQ ID NO: 1134029 - RNA, 19 nt, Homo sapiens
gccgcuaccugaccuuugc

SEQ ID NO: 1134030 - RNA, 19 nt, Homo sapiens
gaacucagguuuacacaaa

SEQ ID NO: 1134031 - RNA, 19 nt, Homo sapiens
gaucagggcuucaguuauu

SEQ ID NO: 1134032 - RNA, 19 nt, Homo sapiens
ggaaacaucugagcaauga

SEQ ID NO: 1134033 - RNA, 19 nt, Homo sapiens
ccaagacucuggccuuuaa

SEQ ID NO: 1134034 - RNA, 19 nt, Homo sapiens
ggagggagauaaugaauca

SEQ ID NO: 1134035 - RNA, 19 nt, Homo sapiens
ugaaggagaucuacaguga

SEQ ID NO: 1134036 - RNA, 19 nt, Homo sapiens
ggacagaaccuauuguguu

SEQ ID NO: 1134037 - RNA, 19 nt, Homo sapiens
gcaaugggcuggucaaugc

SEQ ID NO: 1134038 - RNA, 19 nt, Homo sapiens
agaaacagauggacaaguu

SEQ ID NO: 1134039 - RNA, 19 nt, Homo sapiens
gacagaaccuauuguguug

SEQ ID NO: 1134040 - RNA, 19 nt, Homo sapiens
gugaagugauuacaucuaa

SEQ ID NO: 1134041 - RNA, 19 nt, Homo sapiens
gagcagaggugguggaucu

SEQ ID NO: 1134042 - RNA, 19 nt, Homo sapiens
gaacagaggauuccaacau

SEQ ID NO: 1134043 - RNA, 19 nt, Homo sapiens
guaccuagauggaccagaa

SEQ ID NO: 1134044 - RNA, 19 nt, Homo sapiens
gcaagaacauucccacucu

SEQ ID NO: 1134045 - RNA, 19 nt, Homo sapiens
gggcuucaguuauucuaua

SEQ ID NO: 1134046 - RNA, 19 nt, Homo sapiens
gaccaugucugcacaagau

SEQ ID NO: 1134047 - RNA, 19 nt, Homo sapiens
cacaaagggugacaugaaa

SEQ ID NO: 1134048 - RNA, 19 nt, Homo sapiens
agaaagcucuggauagugu

SEQ ID NO: 1134049 - RNA, 19 nt, Homo sapiens
gagcaaugauuucuugaag

SEQ ID NO: 1134050 - RNA, 19 nt, Homo sapiens
gaaaggcaaacuaggugua

SEQ ID NO: 1134051 - RNA, 19 nt, Homo sapiens
gaccagaaccauccauuga

SEQ ID NO: 1134052 - RNA, 19 nt, Homo sapiens
gaucggaacucagguuuac

SEQ ID NO: 1134053 - RNA, 19 nt, Homo sapiens
gggaucagggcuucaguua

SEQ ID NO: 1134054 - RNA, 19 nt, Homo sapiens
cuaaggaccuccagaagca

SEQ ID NO: 1134055 - RNA, 19 nt, Homo sapiens
ggugggcgaugccaacauu

SEQ ID NO: 1134056 - RNA, 19 nt, Homo sapiens
gauaaugaaucagaggaau

SEQ ID NO: 1134057 - RNA, 19 nt, Homo sapiens
gaagccagcugucuguacu

SEQ ID NO: 1134058 - RNA, 19 nt, Homo sapiens
ggucacacauugucaaacu

SEQ ID NO: 1134059 - RNA, 19 nt, Homo sapiens
gaucaugaaguaugcagaa

SEQ ID NO: 1134060 - RNA, 19 nt, Homo sapiens
ggaaaucaagaaacagaug

SEQ ID NO: 1134061 - RNA, 19 nt, Homo sapiens
ucgaugacguggacauuga

SEQ ID NO: 1134062 - RNA, 19 nt, Homo sapiens
cagagaauauggaacuauc

SEQ ID NO: 1134063 - RNA, 19 nt, Homo sapiens
aaggagaucuacagugaga

SEQ ID NO: 1134064 - RNA, 19 nt, Homo sapiens
ggacaucaaaggccaguuc

SEQ ID NO: 1134065 - RNA, 19 nt, Homo sapiens
caagugguaccaucaagaa

SEQ ID NO: 1134066 - RNA, 19 nt, Homo sapiens
ggacauugaccuccacauc

SEQ ID NO: 1134067 - RNA, 19 nt, Homo sapiens
ucacccuguuuguaaauaa

SEQ ID NO: 1134068 - RNA, 19 nt, Homo sapiens
uaaacuguauagcacuuug

SEQ ID NO: 1134069 - RNA, 19 nt, Homo sapiens
gcacaccucacaccaguuc

SEQ ID NO: 1134070 - RNA, 19 nt, Homo sapiens
acccagggcuguaggaauu

SEQ ID NO: 1134071 - RNA, 19 nt, Homo sapiens
aaacaucugagcaaugauu

SEQ ID NO: 1134072 - RNA, 19 nt, Homo sapiens
ggaccagaaccauccauug

SEQ ID NO: 1134073 - RNA, 19 nt, Homo sapiens
gaccuaacaaagcaugaua

SEQ ID NO: 1134074 - RNA, 19 nt, Homo sapiens
acccuaagaagaagaauua

SEQ ID NO: 1134075 - RNA, 19 nt, Homo sapiens
caacaauggaaacaucuga

SEQ ID NO: 1134076 - RNA, 19 nt, Homo sapiens
caucaaauaaggaaggauu

SEQ ID NO: 1134077 - RNA, 19 nt, Homo sapiens
cauaucaucccacgccuuu

SEQ ID NO: 1134078 - RNA, 19 nt, Homo sapiens
gucggaaucuaaacuguau

SEQ ID NO: 1134079 - RNA, 19 nt, Homo sapiens
cagcaugucuuccaaaaug

SEQ ID NO: 1134080 - RNA, 19 nt, Homo sapiens
acagaggauuccaacauug

SEQ ID NO: 1134081 - RNA, 19 nt, Homo sapiens
aacagaggauuccaacauu

SEQ ID NO: 1134082 - RNA, 19 nt, Homo sapiens
gcaagugguaccaucaaga

SEQ ID NO: 1134083 - RNA, 19 nt, Homo sapiens
ucugagcaaugauuucuug

SEQ ID NO: 1134084 - RNA, 19 nt, Homo sapiens
gaaucuaaacuguauagca

SEQ ID NO: 1134085 - RNA, 19 nt, Homo sapiens
gaaacagauggacaaguug

SEQ ID NO: 1134086 - RNA, 19 nt, Homo sapiens
ccacugaucccaagacucu

SEQ ID NO: 1134087 - RNA, 19 nt, Homo sapiens
gcaucaucuuugagccuua

SEQ ID NO: 1134088 - RNA, 19 nt, Homo sapiens
ugucuguacucgugaacua

SEQ ID NO: 1134089 - RNA, 19 nt, Homo sapiens
gugguaccaucaagaaguu

SEQ ID NO: 1134090 - RNA, 19 nt, Homo sapiens
uaacaaagcaugauauccu

SEQ ID NO: 1134091 - RNA, 19 nt, Homo sapiens
caacaucagcuuccucgau

SEQ ID NO: 1134092 - RNA, 19 nt, Homo sapiens
gacuucacccuguuuguaa

SEQ ID NO: 1134093 - RNA, 19 nt, Homo sapiens
ggcgaugccaacauuaaua

SEQ ID NO: 1134094 - RNA, 19 nt, Homo sapiens
agauacaacaggaugaaua

SEQ ID NO: 1134095 - RNA, 19 nt, Homo sapiens
caaugcauccuacaccaaa

SEQ ID NO: 1134096 - RNA, 19 nt, Homo sapiens
ucaagaaacagauggacaa

SEQ ID NO: 1134097 - RNA, 19 nt, Homo sapiens
gacauugaccuccacauca

SEQ ID NO: 1134098 - RNA, 19 nt, Homo sapiens
caaagcaugauauccuuau

SEQ ID NO: 1134099 - RNA, 19 nt, Homo sapiens
caacaggucacacauuguc

SEQ ID NO: 1134100 - RNA, 19 nt, Homo sapiens
ugacuucacccuguuugua

SEQ ID NO: 1134101 - RNA, 19 nt, Homo sapiens
gaagugauuacaucuaagg

SEQ ID NO: 1134102 - RNA, 19 nt, Homo sapiens
cugcagagucggaaucuaa

SEQ ID NO: 1134103 - RNA, 19 nt, Homo sapiens
ucauaaaaguguucaggua

SEQ ID NO: 1134104 - RNA, 19 nt, Homo sapiens
caucuccaguauuuccuuu

SEQ ID NO: 1134105 - RNA, 19 nt, Homo sapiens
agcaacaggucacacauug

SEQ ID NO: 1134106 - RNA, 19 nt, Homo sapiens
gagaagaggcacaguuggu

SEQ ID NO: 1134107 - RNA, 19 nt, Homo sapiens
gcuaguuuauggauaugau

SEQ ID NO: 1134108 - RNA, 19 nt, Homo sapiens
ccaagaacuacuccacauu

SEQ ID NO: 1134109 - RNA, 19 nt, Homo sapiens
caucuaaggaccuccagaa

SEQ ID NO: 1134110 - RNA, 19 nt, Homo sapiens
cagaggauuccaacauuga

SEQ ID NO: 1134111 - RNA, 19 nt, Homo sapiens
gauuugggcugggucuuca

SEQ ID NO: 1134112 - RNA, 19 nt, Homo sapiens
gauuuucucucucccagua

SEQ ID NO: 1134113 - RNA, 19 nt, Homo sapiens
gaucuacagugagaacucu

SEQ ID NO: 1134114 - RNA, 19 nt, Homo sapiens
aaggaaaucaugcguguga

SEQ ID NO: 1134115 - RNA, 19 nt, Homo sapiens
uggaucaucucuagcaaca

SEQ ID NO: 1134116 - RNA, 19 nt, Homo sapiens
gagaugacccagggcugua

SEQ ID NO: 1134117 - RNA, 19 nt, Homo sapiens
gccuuuccaugggauaaua

SEQ ID NO: 1134118 - RNA, 19 nt, Homo sapiens
gcagaacagaggauuccaa

SEQ ID NO: 1134119 - RNA, 19 nt, Homo sapiens
gaaucuguuccucaccaua

SEQ ID NO: 1134120 - RNA, 19 nt, Homo sapiens
gcaggaaaaggauauguaa

SEQ ID NO: 1134121 - RNA, 19 nt, Homo sapiens
gauacaacaggaugaauac

SEQ ID NO: 1134122 - RNA, 19 nt, Homo sapiens
caugauauccuuauuucuc

SEQ ID NO: 1134123 - RNA, 19 nt, Homo sapiens
ccuuuaacccuaagaagaa

SEQ ID NO: 1134124 - RNA, 19 nt, Homo sapiens
gagaauauggaacuaucga

SEQ ID NO: 1134125 - RNA, 19 nt, Homo sapiens
gagacccaccugcauguug

SEQ ID NO: 1134126 - RNA, 19 nt, Homo sapiens
gagcagcaugucuuccaaa

SEQ ID NO: 1134127 - RNA, 19 nt, Homo sapiens
aaagauccuggguauguuu

SEQ ID NO: 1134128 - RNA, 19 nt, Homo sapiens
gagcuaguuuauggauaug

SEQ ID NO: 1134129 - RNA, 19 nt, Homo sapiens
agcaugauauccuuauuuc

SEQ ID NO: 1134130 - RNA, 19 nt, Homo sapiens
gaacucagguuuacacaaa

SEQ ID NO: 1134131 - RNA, 19 nt, Homo sapiens
gaaggacagugacuuguua

SEQ ID NO: 1134132 - RNA, 19 nt, Homo sapiens
ggaaacaucugagcaauga

SEQ ID NO: 1134133 - RNA, 19 nt, Homo sapiens
gaucucagcugcucuugaa

SEQ ID NO: 1134134 - RNA, 19 nt, Homo sapiens
ccaagacucuggccuuuaa

SEQ ID NO: 1134135 - RNA, 19 nt, Homo sapiens
ggagggagauaaugaauca

SEQ ID NO: 1134136 - RNA, 19 nt, Homo sapiens
ugaaggagaucuacaguga

SEQ ID NO: 1134137 - RNA, 19 nt, Homo sapiens
ggacagaaccuauuguguu

SEQ ID NO: 1134138 - RNA, 19 nt, Homo sapiens
gcaaugggcuggucaaugc

SEQ ID NO: 1134139 - RNA, 19 nt, Homo sapiens
gcacggaccucuccuuugg

SEQ ID NO: 1134140 - RNA, 19 nt, Homo sapiens
agaaacagauggacaaguu

SEQ ID NO: 1134141 - RNA, 19 nt, Homo sapiens
gacagaaccuauuguguug

SEQ ID NO: 1134142 - RNA, 19 nt, Homo sapiens
gugaagugauuacaucuaa

SEQ ID NO: 1134143 - RNA, 19 nt, Homo sapiens
gagcagaggugguggaucu

SEQ ID NO: 1134144 - RNA, 19 nt, Homo sapiens
gaacagaggauuccaacau

SEQ ID NO: 1134145 - RNA, 19 nt, Homo sapiens
guaccuagauggaccagaa

SEQ ID NO: 1134146 - RNA, 19 nt, Homo sapiens
gcaagaacauucccacucu

SEQ ID NO: 1134147 - RNA, 19 nt, Homo sapiens
gaccaugucugcacaagau

SEQ ID NO: 1134148 - RNA, 19 nt, Homo sapiens
agaaagcucuggauagugu

SEQ ID NO: 1134149 - RNA, 19 nt, Homo sapiens
gagcaaugauuucuugaag

SEQ ID NO: 1134150 - RNA, 19 nt, Homo sapiens
gaaaggcaaacuaggugua

SEQ ID NO: 1134151 - RNA, 19 nt, Homo sapiens
gaccagaaccauccauuga

SEQ ID NO: 1134152 - RNA, 19 nt, Homo sapiens
gaucggaacucagguuuac

SEQ ID NO: 1134153 - RNA, 19 nt, Homo sapiens
cuaaggaccuccagaagca

SEQ ID NO: 1134154 - RNA, 19 nt, Homo sapiens
ggugggcgaugccaacauu

SEQ ID NO: 1134155 - RNA, 19 nt, Homo sapiens
acaccaaacugcaggaaug

SEQ ID NO: 1134156 - RNA, 19 nt, Homo sapiens
gauaaugaaucagaggaau

SEQ ID NO: 1134157 - RNA, 19 nt, Homo sapiens
gaagccagcugucuguacu

SEQ ID NO: 1134158 - RNA, 19 nt, Homo sapiens
ggucacacauugucaaacu

SEQ ID NO: 1134159 - RNA, 19 nt, Homo sapiens
gaucaugaaguaugcagaa

SEQ ID NO: 1134160 - RNA, 19 nt, Homo sapiens
ggaaaucaagaaacagaug

SEQ ID NO: 1134161 - RNA, 19 nt, Homo sapiens
ucgaugacguggacauuga

SEQ ID NO: 1134162 - RNA, 19 nt, Homo sapiens
cagagaauauggaacuauc

SEQ ID NO: 1134163 - RNA, 19 nt, Homo sapiens
aaggagaucuacagugaga

SEQ ID NO: 1134164 - RNA, 19 nt, Homo sapiens
ggacaucaaaggccaguuc

SEQ ID NO: 1134165 - RNA, 19 nt, Homo sapiens
gaccugagaguguguguga

SEQ ID NO: 1134166 - RNA, 19 nt, Homo sapiens
caagugguaccaucaagaa

SEQ ID NO: 1134167 - RNA, 19 nt, Homo sapiens
ggacauugaccuccacauc

SEQ ID NO: 1134168 - RNA, 19 nt, Homo sapiens
ucacccuguuuguaaauaa

SEQ ID NO: 1134169 - RNA, 19 nt, Homo sapiens
uaaacuguauagcacuuug

SEQ ID NO: 1134170 - RNA, 19 nt, Homo sapiens
gcacaccucacaccaguuc

SEQ ID NO: 1134171 - RNA, 19 nt, Homo sapiens
aaacaucugagcaaugauu

SEQ ID NO: 1134172 - RNA, 19 nt, Homo sapiens
ggaccagaaccauccauug

SEQ ID NO: 1134173 - RNA, 19 nt, Homo sapiens
acccuaagaagaagaauua

SEQ ID NO: 1134174 - RNA, 19 nt, Homo sapiens
caacaauggaaacaucuga

SEQ ID NO: 1134175 - RNA, 19 nt, Homo sapiens
caucaaauaaggaaggauu

SEQ ID NO: 1134176 - RNA, 19 nt, Homo sapiens
gucggaaucuaaacuguau

SEQ ID NO: 1134177 - RNA, 19 nt, Homo sapiens
cagcaugucuuccaaaaug

SEQ ID NO: 1134178 - RNA, 19 nt, Homo sapiens
acagaggauuccaacauug

SEQ ID NO: 1134179 - RNA, 19 nt, Homo sapiens
aacagaggauuccaacauu

SEQ ID NO: 1134180 - RNA, 19 nt, Homo sapiens
gcaagugguaccaucaaga

SEQ ID NO: 1134181 - RNA, 19 nt, Homo sapiens
ucugagcaaugauuucuug

SEQ ID NO: 1134182 - RNA, 19 nt, Homo sapiens
gaaucuaaacuguauagca

SEQ ID NO: 1134183 - RNA, 19 nt, Homo sapiens
gaaacagauggacaaguug

SEQ ID NO: 1134184 - RNA, 19 nt, Homo sapiens
ccacugaucccaagacucu

SEQ ID NO: 1134185 - RNA, 19 nt, Homo sapiens
gcaucaucuuugagccuua

SEQ ID NO: 1134186 - RNA, 19 nt, Homo sapiens
ugucuguacucgugaacua

SEQ ID NO: 1134187 - RNA, 19 nt, Homo sapiens
gugguaccaucaagaaguu

SEQ ID NO: 1134188 - RNA, 19 nt, Homo sapiens
caacaucagcuuccucgau

SEQ ID NO: 1134189 - RNA, 19 nt, Homo sapiens
gacuucacccuguuuguaa

SEQ ID NO: 1134190 - RNA, 19 nt, Homo sapiens
ggcgaugccaacauuaaua

SEQ ID NO: 1134191 - RNA, 19 nt, Homo sapiens
agauacaacaggaugaaua

SEQ ID NO: 1134192 - RNA, 19 nt, Homo sapiens
caaugcauccuacaccaaa

SEQ ID NO: 1134193 - RNA, 19 nt, Homo sapiens
ucaagaaacagauggacaa

SEQ ID NO: 1134194 - RNA, 19 nt, Homo sapiens
gacauugaccuccacauca

SEQ ID NO: 1134195 - RNA, 19 nt, Homo sapiens
caacaggucacacauuguc

SEQ ID NO: 1134196 - RNA, 19 nt, Homo sapiens
ugacuucacccuguuugua

SEQ ID NO: 1134197 - RNA, 19 nt, Homo sapiens
gaagugauuacaucuaagg

SEQ ID NO: 1134198 - RNA, 19 nt, Homo sapiens
cugcagagucggaaucuaa

SEQ ID NO: 1134199 - RNA, 19 nt, Homo sapiens
ugacccagggcucauauuu

SEQ ID NO: 1134200 - RNA, 19 nt, Homo sapiens
ucauaaaaguguucaggua

SEQ ID NO: 1134201 - RNA, 19 nt, Homo sapiens
gccuagcacugaccugaga

SEQ ID NO: 1134202 - RNA, 19 nt, Homo sapiens
agcaacaggucacacauug

SEQ ID NO: 1134203 - RNA, 19 nt, Homo sapiens
gagaagaggcacaguuggu

SEQ ID NO: 1134204 - RNA, 19 nt, Homo sapiens
ccaagaacuacuccacauu

SEQ ID NO: 1134205 - RNA, 19 nt, Homo sapiens
caucuaaggaccuccagaa

SEQ ID NO: 1134206 - RNA, 19 nt, Homo sapiens
cagaggauuccaacauuga

SEQ ID NO: 1134207 - RNA, 19 nt, Homo sapiens
gauuugggcugggucuuca

SEQ ID NO: 1134208 - RNA, 19 nt, Homo sapiens
gauuuucucucucccagua

SEQ ID NO: 1134209 - RNA, 19 nt, Homo sapiens
gaucuacagugagaacucu

SEQ ID NO: 1134210 - RNA, 19 nt, Homo sapiens
aaggaaaucaugcguguga

SEQ ID NO: 1134211 - RNA, 19 nt, Homo sapiens
uggaucaucucuagcaaca

SEQ ID NO: 1134212 - RNA, 19 nt, Homo sapiens
gcagaacagaggauuccaa

SEQ ID NO: 1134213 - RNA, 19 nt, Homo sapiens
gcaggaaaaggauauguaa

SEQ ID NO: 1134214 - RNA, 19 nt, Homo sapiens
gauacaacaggaugaauac

SEQ ID NO: 1134215 - RNA, 19 nt, Homo sapiens
ccuuuaacccuaagaagaa

SEQ ID NO: 1134216 - RNA, 19 nt, Homo sapiens
cagcacggaccucuccuuu

SEQ ID NO: 1134217 - RNA, 19 nt, Homo sapiens
ccuaaaugcccaucucguu

SEQ ID NO: 1134218 - RNA, 19 nt, Homo sapiens
gagaauauggaacuaucga

SEQ ID NO: 1134219 - RNA, 19 nt, Homo sapiens
ugaaggacagugacuuguu

SEQ ID NO: 1134220 - RNA, 19 nt, Homo sapiens
gacccagggcucauauuug

SEQ ID NO: 1134221 - RNA, 19 nt, Homo sapiens
gagcagcaugucuuccaaa

SEQ ID NO: 1134222 - RNA, 19 nt, Homo sapiens
aaagauccuggguauguuu

SEQ ID NO: 1134223 - RNA, 19 nt, Homo sapiens
gagucggaaucuaaacugu

SEQ ID NO: 1134224 - RNA, 19 nt, Homo sapiens
ggucccacauugagaacug

SEQ ID NO: 1134225 - RNA, 19 nt, Homo sapiens
caucaucuuugagccuuau

SEQ ID NO: 1134226 - RNA, 19 nt, Homo sapiens
gcugaaaggcaaacuaggu

SEQ ID NO: 1134227 - RNA, 19 nt, Homo sapiens
uaccuugucucccuuugug

SEQ ID NO: 1134228 - RNA, 19 nt, Homo sapiens
cacccuguuuguaaauaaa

SEQ ID NO: 1134229 - RNA, 19 nt, Homo sapiens
ugacuuucccuuugacuuc

SEQ ID NO: 1134230 - RNA, 19 nt, Homo sapiens
gcagaaaccuuacuauuau

SEQ ID NO: 1134231 - RNA, 19 nt, Homo sapiens
gcagagagaugcacguuaa

SEQ ID NO: 1134232 - RNA, 19 nt, Homo sapiens
ggaaauaaauccugacaga

SEQ ID NO: 1134233 - RNA, 19 nt, Homo sapiens
gcacagggauuuaucaguu

SEQ ID NO: 1134234 - RNA, 19 nt, Homo sapiens
guaagcaguugacuucaua

SEQ ID NO: 1134235 - RNA, 19 nt, Homo sapiens
ggagaaagcccuacaaagu

SEQ ID NO: 1134236 - RNA, 19 nt, Homo sapiens
cgccauaaauucugaaaua

SEQ ID NO: 1134237 - RNA, 19 nt, Homo sapiens
gagagaugcacguuaauua

SEQ ID NO: 1134238 - RNA, 19 nt, Homo sapiens
ggagagggauggaggagaa

SEQ ID NO: 1134239 - RNA, 19 nt, Homo sapiens
caucuucucuuauuucuga

SEQ ID NO: 1134240 - RNA, 19 nt, Homo sapiens
gagcaaaucugcaucuucu

SEQ ID NO: 1134241 - RNA, 19 nt, Homo sapiens
ggauuucgcugugcucuuu

SEQ ID NO: 1134242 - RNA, 19 nt, Homo sapiens
gggaagagcuuaggaaugg

SEQ ID NO: 1134243 - RNA, 19 nt, Homo sapiens
uuaaagaaccacaccauua

SEQ ID NO: 1134244 - RNA, 19 nt, Homo sapiens
guuaauuacugucgcauuu

SEQ ID NO: 1134245 - RNA, 19 nt, Homo sapiens
gaaugaggaugcagagaga

SEQ ID NO: 1134246 - RNA, 19 nt, Homo sapiens
ucaucugccuucauuauua

SEQ ID NO: 1134247 - RNA, 19 nt, Homo sapiens
gggcugagcugcuaugaca

SEQ ID NO: 1134248 - RNA, 19 nt, Homo sapiens
guggagagcugacaagugu

SEQ ID NO: 1134249 - RNA, 19 nt, Homo sapiens
gagggaaagugacaaagga

SEQ ID NO: 1134250 - RNA, 19 nt, Homo sapiens
ugcagaaaccuuacuauua

SEQ ID NO: 1134251 - RNA, 19 nt, Homo sapiens
gagagcaucggaaauguuu

SEQ ID NO: 1134252 - RNA, 19 nt, Homo sapiens
gagaaagcccuacaaagug

SEQ ID NO: 1134253 - RNA, 19 nt, Homo sapiens
gaaggugguugaacugagu

SEQ ID NO: 1134254 - RNA, 19 nt, Homo sapiens
gaagagggaaagugacaaa

SEQ ID NO: 1134255 - RNA, 19 nt, Homo sapiens
gauccugaauguucuaugu

SEQ ID NO: 1134256 - RNA, 19 nt, Homo sapiens
caagacaaauggcacuuuc

SEQ ID NO: 1134257 - RNA, 19 nt, Homo sapiens
caaugcauaugaagaguau

SEQ ID NO: 1134258 - RNA, 19 nt, Homo sapiens
aaaucugcaucuucucuua

SEQ ID NO: 1134259 - RNA, 19 nt, Homo sapiens
guagaagucaugcauuuau

SEQ ID NO: 1134260 - RNA, 19 nt, Homo sapiens
gauucucgcuccuuucaga

SEQ ID NO: 1134261 - RNA, 19 nt, Homo sapiens
gacaagggcucuauaugcu

SEQ ID NO: 1134262 - RNA, 19 nt, Homo sapiens
caucuaaucgagaccuuua

SEQ ID NO: 1134263 - RNA, 19 nt, Homo sapiens
ggauuuaucaguuccagaa

SEQ ID NO: 1134264 - RNA, 19 nt, Homo sapiens
guugaaggcauacuaauau

SEQ ID NO: 1134265 - RNA, 19 nt, Homo sapiens
gaaauccaugugacuguuu

SEQ ID NO: 1134266 - RNA, 19 nt, Homo sapiens
uugcaggccucgauuauug

SEQ ID NO: 1134267 - RNA, 19 nt, Homo sapiens
aaauaaauccugacagaug

SEQ ID NO: 1134268 - RNA, 19 nt, Homo sapiens
cauguggucucuuagaaau

SEQ ID NO: 1134269 - RNA, 19 nt, Homo sapiens
gaaagugacaaaggacaaa

SEQ ID NO: 1134270 - RNA, 19 nt, Homo sapiens
gaacuuuucccuacccuua

SEQ ID NO: 1134271 - RNA, 19 nt, Homo sapiens
ugacagaugugcacagcau

SEQ ID NO: 1134272 - RNA, 19 nt, Homo sapiens
gaaggcauacuaauauucu

SEQ ID NO: 1134273 - RNA, 19 nt, Homo sapiens
uaugcaugcuuuccacuuu

SEQ ID NO: 1134274 - RNA, 19 nt, Homo sapiens
cugaaacuaugcaugcuuu

SEQ ID NO: 1134275 - RNA, 19 nt, Homo sapiens
cagcauauuugcagggaau

SEQ ID NO: 1134276 - RNA, 19 nt, Homo sapiens
gagauuugguccugaagag

SEQ ID NO: 1134277 - RNA, 19 nt, Homo sapiens
gcaguugacuucauaaaag

SEQ ID NO: 1134278 - RNA, 19 nt, Homo sapiens
caccgaacauccuacaaug

SEQ ID NO: 1134279 - RNA, 19 nt, Homo sapiens
gagacuuagugguggcuuu

SEQ ID NO: 1134280 - RNA, 19 nt, Homo sapiens
aauaaauccugacagaugu

SEQ ID NO: 1134281 - RNA, 19 nt, Homo sapiens
gaaauaaauccugacagau

SEQ ID NO: 1134282 - RNA, 19 nt, Homo sapiens
cuguagaagucaugcauuu

SEQ ID NO: 1134283 - RNA, 19 nt, Homo sapiens
gcauuuacuggguuucuuu

SEQ ID NO: 1134284 - RNA, 19 nt, Homo sapiens
gaacagccagauccugaau

SEQ ID NO: 1134285 - RNA, 19 nt, Homo sapiens
gcagaugcccagugauugu

SEQ ID NO: 1134286 - RNA, 19 nt, Homo sapiens
gcugugcucuuuugauuaa

SEQ ID NO: 1134287 - RNA, 19 nt, Homo sapiens
gguagcagccuuugagcaa

SEQ ID NO: 1134288 - RNA, 19 nt, Homo sapiens
ggacagugaucugcaacuc

SEQ ID NO: 1134289 - RNA, 19 nt, Homo sapiens
uaaagaaccacaccauuac

SEQ ID NO: 1134290 - RNA, 19 nt, Homo sapiens
gaugugcacagcauauuug

SEQ ID NO: 1134291 - RNA, 19 nt, Homo sapiens
aaaugauucucgcuccuuu

SEQ ID NO: 1134292 - RNA, 19 nt, Homo sapiens
gcaagacaaauggcacuuu

SEQ ID NO: 1134293 - RNA, 19 nt, Homo sapiens
ggucaagaggcaaauaaga

SEQ ID NO: 1134294 - RNA, 19 nt, Homo sapiens
uaugauguguucugaguca

SEQ ID NO: 1134295 - RNA, 19 nt, Homo sapiens
ggaaagugacaaaggacaa

SEQ ID NO: 1134296 - RNA, 19 nt, Homo sapiens
aaagggaccucucugaaaa

SEQ ID NO: 1134297 - RNA, 19 nt, Homo sapiens
gaaaugauucucgcuccuu

SEQ ID NO: 1134298 - RNA, 19 nt, Homo sapiens
gacugaagacgaucaaaga

SEQ ID NO: 1134299 - RNA, 19 nt, Homo sapiens
caucaucugccuucauuau

SEQ ID NO: 1134300 - RNA, 19 nt, Homo sapiens
ccacaccauuacugcguuu

SEQ ID NO: 1134301 - RNA, 19 nt, Homo sapiens
aaauggcacuuuccuucuu

SEQ ID NO: 1134302 - RNA, 19 nt, Homo sapiens
gcaaaucugcaucuucucu

SEQ ID NO: 1134303 - RNA, 19 nt, Homo sapiens
cacugaaggucuuugagaa

SEQ ID NO: 1134304 - RNA, 19 nt, Homo sapiens
gccagucguucucaaggaa

SEQ ID NO: 1134305 - RNA, 19 nt, Homo sapiens
cugagaggcuugagagugu

SEQ ID NO: 1134306 - RNA, 19 nt, Homo sapiens
cauucugccuuggaaauaa

SEQ ID NO: 1134307 - RNA, 19 nt, Homo sapiens
ugaggaagagggaaaguga

SEQ ID NO: 1134308 - RNA, 19 nt, Homo sapiens
gaaaagggaccucucugaa

SEQ ID NO: 1134309 - RNA, 19 nt, Homo sapiens
ccacugaaggucuuugaga

SEQ ID NO: 1134310 - RNA, 19 nt, Homo sapiens
gugagucauugaguaaauu

SEQ ID NO: 1134311 - RNA, 19 nt, Homo sapiens
guugagauuugguccugaa

SEQ ID NO: 1134312 - RNA, 19 nt, Homo sapiens
gcuaaggagcugugauuca

SEQ ID NO: 1134313 - RNA, 19 nt, Homo sapiens
ccugaucccugcaagacaa

SEQ ID NO: 1134314 - RNA, 19 nt, Homo sapiens
gagaaaagaagaaaacaug

SEQ ID NO: 1134315 - RNA, 19 nt, Homo sapiens
ugaaaucucacuuuguuag

SEQ ID NO: 1134316 - RNA, 19 nt, Homo sapiens
ccucaccaaugcauaugaa

SEQ ID NO: 1134317 - RNA, 19 nt, Homo sapiens
gucauguggucucuuagaa

SEQ ID NO: 1134318 - RNA, 19 nt, Homo sapiens
caucugccuucauuauuag

SEQ ID NO: 1134319 - RNA, 19 nt, Homo sapiens
ccaguugaaggcauacuaa

SEQ ID NO: 1134320 - RNA, 19 nt, Homo sapiens
ggaauuugcaggccucgau

SEQ ID NO: 1134321 - RNA, 19 nt, Homo sapiens
agccaggccugucuuaaga

SEQ ID NO: 1134322 - RNA, 19 nt, Homo sapiens
cagcugaggccguguggaa

SEQ ID NO: 1134323 - RNA, 19 nt, Homo sapiens
caggacaacuaacuaucga

SEQ ID NO: 1134324 - RNA, 19 nt, Homo sapiens
ugacaagggcucuauaugc

SEQ ID NO: 1134325 - RNA, 19 nt, Homo sapiens
uguaugauguguucugagu

SEQ ID NO: 1134326 - RNA, 19 nt, Homo sapiens
acagccagauccugaaugu

SEQ ID NO: 1134327 - RNA, 19 nt, Homo sapiens
cuaaggagcugugauucag

SEQ ID NO: 1134328 - RNA, 19 nt, Homo sapiens
ccaaugcauaugaagagua

SEQ ID NO: 1134329 - RNA, 19 nt, Homo sapiens
agaaauccaugugacuguu

SEQ ID NO: 1134330 - RNA, 19 nt, Homo sapiens
gaaacaagcuugaccacua

SEQ ID NO: 1134331 - RNA, 19 nt, Homo sapiens
caaguuggcuagaaagauu

SEQ ID NO: 1134332 - RNA, 19 nt, Homo sapiens
caaacaaguuggcuagaaa

SEQ ID NO: 1134333 - RNA, 19 nt, Homo sapiens
cuaaguggcugaaggcaua

SEQ ID NO: 1134334 - RNA, 19 nt, Homo sapiens
gagcuaaagucuaggaaga

SEQ ID NO: 1134335 - RNA, 19 nt, Homo sapiens
ggaccgagcuaaagucuag

SEQ ID NO: 1134336 - RNA, 19 nt, Homo sapiens
ugagagagauuauuacugu

SEQ ID NO: 1134337 - RNA, 19 nt, Homo sapiens
ggaggaagguaaugaagga

SEQ ID NO: 1134338 - RNA, 19 nt, Homo sapiens
ccuuugaucuugagucuua

SEQ ID NO: 1134339 - RNA, 19 nt, Homo sapiens
gagcuggccugaaugaaug

SEQ ID NO: 1134340 - RNA, 19 nt, Homo sapiens
ccaagaagguaguguugaa

SEQ ID NO: 1134341 - RNA, 19 nt, Homo sapiens
ccaguuaccuuugaucuug

SEQ ID NO: 1134342 - RNA, 19 nt, Homo sapiens
gccuaaagcugaagccaaa

SEQ ID NO: 1134343 - RNA, 19 nt, Homo sapiens
gcuaaagucuaggaagaaa

SEQ ID NO: 1134344 - RNA, 19 nt, Homo sapiens
gaauagaacagugguuuga

SEQ ID NO: 1134345 - RNA, 19 nt, Homo sapiens
uuuaaucucucaccucuuu

SEQ ID NO: 1134346 - RNA, 19 nt, Homo sapiens
gaagaagcucugugacauu

SEQ ID NO: 1134347 - RNA, 19 nt, Homo sapiens
gaucuugagucuuacuuuc

SEQ ID NO: 1134348 - RNA, 19 nt, Homo sapiens
aaacaagcuugaccacuau

SEQ ID NO: 1134349 - RNA, 19 nt, Homo sapiens
ccagagagauuaagaagcu

SEQ ID NO: 1134350 - RNA, 19 nt, Homo sapiens
gauuccaggcuauguauua

SEQ ID NO: 1134351 - RNA, 19 nt, Homo sapiens
ccaguagaguuaccucaaa

SEQ ID NO: 1134352 - RNA, 19 nt, Homo sapiens
uuaccuaggucccucagua

SEQ ID NO: 1134353 - RNA, 19 nt, Homo sapiens
gcuuccagguuaaaugaua

SEQ ID NO: 1134354 - RNA, 19 nt, Homo sapiens
gcaagcacucaauauagua

SEQ ID NO: 1134355 - RNA, 19 nt, Homo sapiens
ugagugguguugauuuaaa

SEQ ID NO: 1134356 - RNA, 19 nt, Homo sapiens
gauaauuugucucuugagu

SEQ ID NO: 1134357 - RNA, 19 nt, Homo sapiens
uaggauaauuugucucuug

SEQ ID NO: 1134358 - RNA, 19 nt, Homo sapiens
gagagauuauuacugucua

SEQ ID NO: 1134359 - RNA, 19 nt, Homo sapiens
gcuaguaaagugauuugua

SEQ ID NO: 1134360 - RNA, 19 nt, Homo sapiens
gaagauggcaccgaaagug

SEQ ID NO: 1134361 - RNA, 19 nt, Homo sapiens
ccaggaaacccaucuguug

SEQ ID NO: 1134362 - RNA, 19 nt, Homo sapiens
ugacuuggaucaugugcuu

SEQ ID NO: 1134363 - RNA, 19 nt, Homo sapiens
gaagcucugugacauugau

SEQ ID NO: 1134364 - RNA, 19 nt, Homo sapiens
gcacucaauauaguacuua

SEQ ID NO: 1134365 - RNA, 19 nt, Homo sapiens
ucucuacucuggcuuuauu

SEQ ID NO: 1134366 - RNA, 19 nt, Homo sapiens
cuugagugguguugauuua

SEQ ID NO: 1134367 - RNA, 19 nt, Homo sapiens
agaguuaccucaaagauac

SEQ ID NO: 1134368 - RNA, 19 nt, Homo sapiens
gaacaauucaguagugucu

SEQ ID NO: 1134369 - RNA, 19 nt, Homo sapiens
ggucuuuccuacaguuuga

SEQ ID NO: 1134370 - RNA, 19 nt, Homo sapiens
ugaagaagcucugugacau

SEQ ID NO: 1134371 - RNA, 19 nt, Homo sapiens
uggccugaaugaaugauua

SEQ ID NO: 1134372 - RNA, 19 nt, Homo sapiens
cuauucagcugcuuuagga

SEQ ID NO: 1134373 - RNA, 19 nt, Homo sapiens
gaguccaucuggcuaauuc

SEQ ID NO: 1134374 - RNA, 19 nt, Homo sapiens
gaaugcauccuguggucua

SEQ ID NO: 1134375 - RNA, 19 nt, Homo sapiens
gauggccaguuaccuuuga

SEQ ID NO: 1134376 - RNA, 19 nt, Homo sapiens
caacaagcaccagaucaaa

SEQ ID NO: 1134377 - RNA, 19 nt, Homo sapiens
aguagugucuggaauagaa

SEQ ID NO: 1134378 - RNA, 19 nt, Homo sapiens
acagaacaauucaguagug

SEQ ID NO: 1134379 - RNA, 19 nt, Homo sapiens
aagaagcucugugacauug

SEQ ID NO: 1134380 - RNA, 19 nt, Homo sapiens
auagaacagugguuugaaa

SEQ ID NO: 1134381 - RNA, 19 nt, Homo sapiens
ugagguaauucaaacaugu

SEQ ID NO: 1134382 - RNA, 19 nt, Homo sapiens
guauccaucauuugucuua

SEQ ID NO: 1134383 - RNA, 19 nt, Homo sapiens
aaacuauucagcugcuuua

SEQ ID NO: 1134384 - RNA, 19 nt, Homo sapiens
gagaugaaggcauauguuc

SEQ ID NO: 1134385 - RNA, 19 nt, Homo sapiens
auggagagaugaaggcaua

SEQ ID NO: 1134386 - RNA, 19 nt, Homo sapiens
ccacuaugcuaucaucaag

SEQ ID NO: 1134387 - RNA, 19 nt, Homo sapiens
caccgaaagugaagaagga

SEQ ID NO: 1134388 - RNA, 19 nt, Homo sapiens
ggaucuaguuucuuucucu

SEQ ID NO: 1134389 - RNA, 19 nt, Homo sapiens
ucauuaacauggaacucua

SEQ ID NO: 1134390 - RNA, 19 nt, Homo sapiens
caugugcuguuaacuucua

SEQ ID NO: 1134391 - RNA, 19 nt, Homo sapiens
gcagaguacugauggucau

SEQ ID NO: 1134392 - RNA, 19 nt, Homo sapiens
gauagcaggaguuacagaa

SEQ ID NO: 1134393 - RNA, 19 nt, Homo sapiens
gcugauagcaggaguuaca

SEQ ID NO: 1134394 - RNA, 19 nt, Homo sapiens
uaauagcaagcacucaaua

SEQ ID NO: 1134395 - RNA, 19 nt, Homo sapiens
ggaacucuauggagaucau

SEQ ID NO: 1134396 - RNA, 19 nt, Homo sapiens
uaacauggaacucuaugga

SEQ ID NO: 1134397 - RNA, 19 nt, Homo sapiens
uagaguuaccucaaagaua

SEQ ID NO: 1134398 - RNA, 19 nt, Homo sapiens
ggaauagaacagugguuug

SEQ ID NO: 1134399 - RNA, 19 nt, Homo sapiens
accaggaucuaguuucuuu

SEQ ID NO: 1134400 - RNA, 19 nt, Homo sapiens
ccaucuggcuaauucuaaa

SEQ ID NO: 1134401 - RNA, 19 nt, Homo sapiens
uaaccuuucuaggauguuu

SEQ ID NO: 1134402 - RNA, 19 nt, Homo sapiens
ucauuugucuuaaccuuuc

SEQ ID NO: 1134403 - RNA, 19 nt, Homo sapiens
caucauuugucuuaaccuu

SEQ ID NO: 1134404 - RNA, 19 nt, Homo sapiens
gaggaugcuuuucugcuua

SEQ ID NO: 1134405 - RNA, 19 nt, Homo sapiens
aaaaguagagggcuuguua

SEQ ID NO: 1134406 - RNA, 19 nt, Homo sapiens
cauacuaacucugcagugu

SEQ ID NO: 1134407 - RNA, 19 nt, Homo sapiens
gaacagugguuugaaaagu

SEQ ID NO: 1134408 - RNA, 19 nt, Homo sapiens
uagcaggaguuacagaaca

SEQ ID NO: 1134409 - RNA, 19 nt, Homo sapiens
gaaaagaggaagaggagaa

SEQ ID NO: 1134410 - RNA, 19 nt, Homo sapiens
gaaaguuuggucagucuca

SEQ ID NO: 1134411 - RNA, 19 nt, Homo sapiens
ccaacaagcaccagaucaa

SEQ ID NO: 1134412 - RNA, 19 nt, Homo sapiens
gaugcugcuuccagguuaa

SEQ ID NO: 1134413 - RNA, 19 nt, Homo sapiens
agaugcugcuuccagguua

SEQ ID NO: 1134414 - RNA, 19 nt, Homo sapiens
ggcaaaauauugaaaagga

SEQ ID NO: 1134415 - RNA, 19 nt, Homo sapiens
auagcaagcacucaauaua

SEQ ID NO: 1134416 - RNA, 19 nt, Homo sapiens
acuaugcuaucaucaaguu

SEQ ID NO: 1134417 - RNA, 19 nt, Homo sapiens
ggaguuacagaacaauuca

SEQ ID NO: 1134418 - RNA, 19 nt, Homo sapiens
ugucuuaaccuuucuagga

SEQ ID NO: 1134419 - RNA, 19 nt, Homo sapiens
ggaagaggagaauggaugu

SEQ ID NO: 1134420 - RNA, 19 nt, Homo sapiens
gcuagugagguaauucaaa

SEQ ID NO: 1134421 - RNA, 19 nt, Homo sapiens
uacuaacucugcaguguau

SEQ ID NO: 1134422 - RNA, 19 nt, Homo sapiens
gcuagaaagauuggaauau

SEQ ID NO: 1134423 - RNA, 19 nt, Homo sapiens
gcuauguauuaucuccuuu

SEQ ID NO: 1134424 - RNA, 19 nt, Homo sapiens
gagucuuacuuucugauuc

SEQ ID NO: 1134425 - RNA, 19 nt, Homo sapiens
gacccuggcuugugcuagu

SEQ ID NO: 1134426 - RNA, 19 nt, Homo sapiens
ugaccaggaucuaguuucu

SEQ ID NO: 1134427 - RNA, 19 nt, Homo sapiens
uagcaagcacucaauauag

SEQ ID NO: 1134428 - RNA, 19 nt, Homo sapiens
agaaucucaugugcuguua

SEQ ID NO: 1134429 - RNA, 19 nt, Homo sapiens
gagagaugaaggcauaugu

SEQ ID NO: 1134430 - RNA, 19 nt, Homo sapiens
gaagggaacuuuagagaaa

SEQ ID NO: 1134431 - RNA, 19 nt, Homo sapiens
gagcagaacugaaggaaau

SEQ ID NO: 1134432 - RNA, 19 nt, Homo sapiens
caaagaaggccauuacaua

SEQ ID NO: 1134433 - RNA, 19 nt, Homo sapiens
gagcaaagccuccaagaaa

SEQ ID NO: 1134434 - RNA, 19 nt, Homo sapiens
gaccaaggcucgagaacua

SEQ ID NO: 1134435 - RNA, 19 nt, Homo sapiens
gcaaguagcauuaacauug

SEQ ID NO: 1134436 - RNA, 19 nt, Homo sapiens
ugagagagaugccugguua

SEQ ID NO: 1134437 - RNA, 19 nt, Homo sapiens
gcaccaagcggaccuaaua

SEQ ID NO: 1134438 - RNA, 19 nt, Homo sapiens
gaaaggacauccacaccaa

SEQ ID NO: 1134439 - RNA, 19 nt, Homo sapiens
gcaaggauauccaggaguu

SEQ ID NO: 1134440 - RNA, 19 nt, Homo sapiens
ggacuaaaugcuccaauua

SEQ ID NO: 1134441 - RNA, 19 nt, Homo sapiens
gaaacugcaugaacuaaug

SEQ ID NO: 1134442 - RNA, 19 nt, Homo sapiens
ugaaauacccagugacuua

SEQ ID NO: 1134443 - RNA, 19 nt, Homo sapiens
gaacagcucuggucuacag

SEQ ID NO: 1134444 - RNA, 19 nt, Homo sapiens
gaaaugaaggcagaaauaa

SEQ ID NO: 1134445 - RNA, 19 nt, Homo sapiens
gcaaagccuccaagaaaua

SEQ ID NO: 1134446 - RNA, 19 nt, Homo sapiens
ggaagaaacugcaugaacu

SEQ ID NO: 1134447 - RNA, 19 nt, Homo sapiens
gcagaucucucagcagaaa

SEQ ID NO: 1134448 - RNA, 19 nt, Homo sapiens
ggaaagggaucaauucaac

SEQ ID NO: 1134449 - RNA, 19 nt, Homo sapiens
gauggaagaugaagugaau

SEQ ID NO: 1134450 - RNA, 19 nt, Homo sapiens
gaacaaagacacaacauac

SEQ ID NO: 1134451 - RNA, 19 nt, Homo sapiens
guaaagcucuccucagcaa

SEQ ID NO: 1134452 - RNA, 19 nt, Homo sapiens
ggaaaggcaaagaaauuua

SEQ ID NO: 1134453 - RNA, 19 nt, Homo sapiens
caaguagcauuaacauuga

SEQ ID NO: 1134454 - RNA, 19 nt, Homo sapiens
caacaaagaucaaaagaga

SEQ ID NO: 1134455 - RNA, 19 nt, Homo sapiens
caaauuggauaaagaguca

SEQ ID NO: 1134456 - RNA, 19 nt, Homo sapiens
ggaggaaauucaaaccaaa

SEQ ID NO: 1134457 - RNA, 19 nt, Homo sapiens
caacauguauucagcuaug

SEQ ID NO: 1134458 - RNA, 19 nt, Homo sapiens
gaagaaacugcaugaacua

SEQ ID NO: 1134459 - RNA, 19 nt, Homo sapiens
ugaaugaaaugaagcaaga

SEQ ID NO: 1134460 - RNA, 19 nt, Homo sapiens
ggacggagaaugacuuuga

SEQ ID NO: 1134461 - RNA, 19 nt, Homo sapiens
gaagaugaagugaaugaaa

SEQ ID NO: 1134462 - RNA, 19 nt, Homo sapiens
gcacgcagcuggagaucug

SEQ ID NO: 1134463 - RNA, 19 nt, Homo sapiens
ccagugacuuacacauuua

SEQ ID NO: 1134464 - RNA, 19 nt, Homo sapiens
ggaucaaauucacacauaa

SEQ ID NO: 1134465 - RNA, 19 nt, Homo sapiens
uaucagcgauggaagauga

SEQ ID NO: 1134466 - RNA, 19 nt, Homo sapiens
gaagaccgaguguuaguuu

SEQ ID NO: 1134467 - RNA, 19 nt, Homo sapiens
cgaaaugaaggcagaaaua

SEQ ID NO: 1134468 - RNA, 19 nt, Homo sapiens
gagcuaacuauccuaaaua

SEQ ID NO: 1134469 - RNA, 19 nt, Homo sapiens
caagauggccgaauaggaa

SEQ ID NO: 1134470 - RNA, 19 nt, Homo sapiens
gagaauccacauaugaaua

SEQ ID NO: 1134471 - RNA, 19 nt, Homo sapiens
gaaaacugcuucugcauga

SEQ ID NO: 1134472 - RNA, 19 nt, Homo sapiens
ggacucagcucugcaccaa

SEQ ID NO: 1134473 - RNA, 19 nt, Homo sapiens
gaagagcuaacuauccuaa

SEQ ID NO: 1134474 - RNA, 19 nt, Homo sapiens
aaagaaggccauuacauaa

SEQ ID NO: 1134475 - RNA, 19 nt, Homo sapiens
gacacagacuggcaaauug

SEQ ID NO: 1134476 - RNA, 19 nt, Homo sapiens
ggaguucccuuuccuaguc

SEQ ID NO: 1134477 - RNA, 19 nt, Homo sapiens
gaagaugcaguugguauaa

SEQ ID NO: 1134478 - RNA, 19 nt, Homo sapiens
ucaacuacauggaaacuga

SEQ ID NO: 1134479 - RNA, 19 nt, Homo sapiens
gcaaggagaaugagagaga

SEQ ID NO: 1134480 - RNA, 19 nt, Homo sapiens
gaagaucuacgaagcaaau

SEQ ID NO: 1134481 - RNA, 19 nt, Homo sapiens
gagaagagcaacuccaaga

SEQ ID NO: 1134482 - RNA, 19 nt, Homo sapiens
gaacuaaaauggcaaaucu

SEQ ID NO: 1134483 - RNA, 19 nt, Homo sapiens
gauucaagcuaaggucaua

SEQ ID NO: 1134484 - RNA, 19 nt, Homo sapiens
acacauaauugucagauuc

SEQ ID NO: 1134485 - RNA, 19 nt, Homo sapiens
aguaaccucugcagacuua

SEQ ID NO: 1134486 - RNA, 19 nt, Homo sapiens
gcacagcagucugagauca

SEQ ID NO: 1134487 - RNA, 19 nt, Homo sapiens
ugaugaagcuuucuuuaca

SEQ ID NO: 1134488 - RNA, 19 nt, Homo sapiens
gauaugggguguuaaaauu

SEQ ID NO: 1134489 - RNA, 19 nt, Homo sapiens
ccaaaugagugugcagaaa

SEQ ID NO: 1134490 - RNA, 19 nt, Homo sapiens
ucaagacaguguggaauuu

SEQ ID NO: 1134491 - RNA, 19 nt, Homo sapiens
ccacauggguuagucaaga

SEQ ID NO: 1134492 - RNA, 19 nt, Homo sapiens
gaacugaaggaaauagaga

SEQ ID NO: 1134493 - RNA, 19 nt, Homo sapiens
uagcagaaggcaagaaaua

SEQ ID NO: 1134494 - RNA, 19 nt, Homo sapiens
ucaacgagacagaaaguua

SEQ ID NO: 1134495 - RNA, 19 nt, Homo sapiens
caaaggaacauaauucauc

SEQ ID NO: 1134496 - RNA, 19 nt, Homo sapiens
cagauacacagucauguua

SEQ ID NO: 1134497 - RNA, 19 nt, Homo sapiens
auaaccagcuaacaucaua

SEQ ID NO: 1134498 - RNA, 19 nt, Homo sapiens
agagaugccugguuagcua

SEQ ID NO: 1134499 - RNA, 19 nt, Homo sapiens
gggaucaauucaacaagaa

SEQ ID NO: 1134500 - RNA, 19 nt, Homo sapiens
uaaagaccaucgagacuag

SEQ ID NO: 1134501 - RNA, 19 nt, Homo sapiens
gcuaugaggaauacagaua

SEQ ID NO: 1134502 - RNA, 19 nt, Homo sapiens
gaaggcaagaaauaacuaa

SEQ ID NO: 1134503 - RNA, 19 nt, Homo sapiens
ugaagaaacucacucaaaa

SEQ ID NO: 1134504 - RNA, 19 nt, Homo sapiens
gggccaauauucaacauuc

SEQ ID NO: 1134505 - RNA, 19 nt, Homo sapiens
gcaagaagggaacuuuaga

SEQ ID NO: 1134506 - RNA, 19 nt, Homo sapiens
cauggagucucacugauug

SEQ ID NO: 1134507 - RNA, 19 nt, Homo sapiens
cacccuaacaucacaauua

SEQ ID NO: 1134508 - RNA, 19 nt, Homo sapiens
ugauggagcugaagaccaa

SEQ ID NO: 1134509 - RNA, 19 nt, Homo sapiens
caaaauugcauucgucuua

SEQ ID NO: 1134510 - RNA, 19 nt, Homo sapiens
cccagugacuuacacauuu

SEQ ID NO: 1134511 - RNA, 19 nt, Homo sapiens
gaaaggaucaacaaaauug

SEQ ID NO: 1134512 - RNA, 19 nt, Homo sapiens
caggaaagauccaaaauug

SEQ ID NO: 1134513 - RNA, 19 nt, Homo sapiens
ugaacaaccugcuccugaa

SEQ ID NO: 1134514 - RNA, 19 nt, Homo sapiens
gcaauccuagucucugaua

SEQ ID NO: 1134515 - RNA, 19 nt, Homo sapiens
gacuaaaugcuccaauuaa

SEQ ID NO: 1134516 - RNA, 19 nt, Homo sapiens
guaaagaccaucgagacua

SEQ ID NO: 1134517 - RNA, 19 nt, Homo sapiens
gaaggaagugccaaacaug

SEQ ID NO: 1134518 - RNA, 19 nt, Homo sapiens
caaagcuacuccucgagaa

SEQ ID NO: 1134519 - RNA, 19 nt, Homo sapiens
gaagcaagaagggaacuuu

SEQ ID NO: 1134520 - RNA, 19 nt, Homo sapiens
gcgaucaacuggaagaaag

SEQ ID NO: 1134521 - RNA, 19 nt, Homo sapiens
gcagauacacagucauguu

SEQ ID NO: 1134522 - RNA, 19 nt, Homo sapiens
ugaaggcuuucucugcaua

SEQ ID NO: 1134523 - RNA, 19 nt, Homo sapiens
cuagggaccugaccauuuc

SEQ ID NO: 1134524 - RNA, 19 nt, Homo sapiens
gaaguugaaaugaaggaaa

SEQ ID NO: 1134525 - RNA, 19 nt, Homo sapiens
gaugggugauuucugcauu

SEQ ID NO: 1134526 - RNA, 19 nt, Homo sapiens
ugagaugccuuuugaagua

SEQ ID NO: 1134527 - RNA, 19 nt, Homo sapiens
uaucugaaauacccaguga

SEQ ID NO: 1134528 - RNA, 19 nt, Homo sapiens
gccaaacuaagcuuuauaa

SEQ ID NO: 1134529 - RNA, 19 nt, Homo sapiens
gaagagcaacuccaagaca

SEQ ID NO: 1134530 - RNA, 19 nt, Homo sapiens
aaagauaccugcugaauuc

SEQ ID NO: 1134531 - RNA, 19 nt, Homo sapiens
gauaaaguguugccaaaga

SEQ ID NO: 1134532 - RNA, 19 nt, Homo sapiens
gcacugagacuucuuguca

SEQ ID NO: 1134533 - RNA, 19 nt, Homo sapiens
caaaggcacugacuguaau

SEQ ID NO: 1134534 - RNA, 19 nt, Homo sapiens
aaucacagcugucguccua

SEQ ID NO: 1134535 - RNA, 19 nt, Homo sapiens
gugauaaaguguugccaaa

SEQ ID NO: 1134536 - RNA, 19 nt, Homo sapiens
gagacuaugucgccagaug

SEQ ID NO: 1134537 - RNA, 19 nt, Homo sapiens
caaagauaccugcugaauu

SEQ ID NO: 1134538 - RNA, 19 nt, Homo sapiens
gcaauaaaaccaacucuaa

SEQ ID NO: 1134539 - RNA, 19 nt, Homo sapiens
ucaaaggcacugacuguaa

SEQ ID NO: 1134540 - RNA, 19 nt, Homo sapiens
gaaaggacacagcucaaag

SEQ ID NO: 1134541 - RNA, 19 nt, Homo sapiens
uaaaguguugccaaagaua

SEQ ID NO: 1134542 - RNA, 19 nt, Homo sapiens
cguguugacuccauaugaa

SEQ ID NO: 1134543 - RNA, 19 nt, Homo sapiens
auauagacgugaaucgauu

SEQ ID NO: 1134544 - RNA, 19 nt, Homo sapiens
guuccuagcuccgcacuca

SEQ ID NO: 1134545 - RNA, 19 nt, Homo sapiens
cacaucuucucgucucuuu

SEQ ID NO: 1134546 - RNA, 19 nt, Homo sapiens
ccaaagauaccugcugaau

SEQ ID NO: 1134547 - RNA, 19 nt, Homo sapiens
gcacuaaacccucguuccu

SEQ ID NO: 1134548 - RNA, 19 nt, Homo sapiens
ugaaaggacacagcucaaa

SEQ ID NO: 1134549 - RNA, 19 nt, Homo sapiens
cugcugaauucucgcguuu

SEQ ID NO: 1134550 - RNA, 19 nt, Homo sapiens
caggaaacaaacaaacaaa

SEQ ID NO: 1134551 - RNA, 19 nt, Homo sapiens
ucaggaaacaaacaaacaa

SEQ ID NO: 1134552 - RNA, 19 nt, Homo sapiens
auaaaguguugccaaagau

SEQ ID NO: 1134553 - RNA, 19 nt, Homo sapiens
uuaaggucgugauaaagug

SEQ ID NO: 1134554 - RNA, 19 nt, Homo sapiens
ugagacuucuugucaaugc

SEQ ID NO: 1134555 - RNA, 19 nt, Homo sapiens
guauauagacgugaaucga

SEQ ID NO: 1134556 - RNA, 19 nt, Homo sapiens
acacagaccucggggauug

SEQ ID NO: 1134557 - RNA, 19 nt, Homo sapiens
acugagacuucuugucaau

SEQ ID NO: 1134558 - RNA, 19 nt, Homo sapiens
agacgugaaucgauuuuau

SEQ ID NO: 1134559 - RNA, 19 nt, Homo sapiens
uauagacgugaaucgauuu

SEQ ID NO: 1134560 - RNA, 19 nt, Homo sapiens
guggagcccucugggacuu

SEQ ID NO: 1134561 - RNA, 19 nt, Homo sapiens
uuaacugccugguacaaaa

SEQ ID NO: 1134562 - RNA, 19 nt, Homo sapiens
uauauagacgugaaucgau

SEQ ID NO: 1134563 - RNA, 19 nt, Homo sapiens
ugagcccucuuuccaccuu

SEQ ID NO: 1134564 - RNA, 19 nt, Homo sapiens
gggucguguugacuccaua

SEQ ID NO: 1134565 - RNA, 19 nt, Homo sapiens
gcaugggaccccgaaaaua

SEQ ID NO: 1134566 - RNA, 19 nt, Homo sapiens
ugaggagggucguguugac

SEQ ID NO: 1134567 - RNA, 19 nt, Homo sapiens
acucaaaggcacugacugu

SEQ ID NO: 1134568 - RNA, 19 nt, Homo sapiens
gacaagagcuuuauuaauc

SEQ ID NO: 1134569 - RNA, 19 nt, Homo sapiens
gaaaggcccucuccaauca

SEQ ID NO: 1134570 - RNA, 19 nt, Homo sapiens
uuaaagaccucaagucauu

SEQ ID NO: 1134571 - RNA, 19 nt, Homo sapiens
ucacagcgcugauauaagu

SEQ ID NO: 1134572 - RNA, 19 nt, Homo sapiens
ggaaauacacugauacaau

SEQ ID NO: 1134573 - RNA, 19 nt, Homo sapiens
guagagaauugaacuguga

SEQ ID NO: 1134574 - RNA, 19 nt, Homo sapiens
caaagagccuugcuaaagu

SEQ ID NO: 1134575 - RNA, 19 nt, Homo sapiens
gcaacuagcugcgcaaauc

SEQ ID NO: 1134576 - RNA, 19 nt, Homo sapiens
gcaacucauuagcgaaaua

SEQ ID NO: 1134577 - RNA, 19 nt, Homo sapiens
gcaaaugguuccucagaag

SEQ ID NO: 1134578 - RNA, 19 nt, Homo sapiens
gagcaaaugcgaucucuga

SEQ ID NO: 1134579 - RNA, 19 nt, Homo sapiens
gacgaggaguuacuaguuu

SEQ ID NO: 1134580 - RNA, 19 nt, Homo sapiens
caacaccucuugacaugga

SEQ ID NO: 1134581 - RNA, 19 nt, Homo sapiens
gaacaguaccguauaucuu

SEQ ID NO: 1134582 - RNA, 19 nt, Homo sapiens
gagccauacuucccuauau

SEQ ID NO: 1134583 - RNA, 19 nt, Homo sapiens
gagagacgacgcccguuua

SEQ ID NO: 1134584 - RNA, 19 nt, Homo sapiens
gaaauaauagggugcacuu

SEQ ID NO: 1134585 - RNA, 19 nt, Homo sapiens
ucagacaagagcuuuauua

SEQ ID NO: 1134586 - RNA, 19 nt, Homo sapiens
cagccaacguuuccaguuu

SEQ ID NO: 1134587 - RNA, 19 nt, Homo sapiens
gaaccuugaagccuacaua

SEQ ID NO: 1134588 - RNA, 19 nt, Homo sapiens
ggaaaggcccucuccaauc

SEQ ID NO: 1134589 - RNA, 19 nt, Homo sapiens
caagagaacaguaccguau

SEQ ID NO: 1134590 - RNA, 19 nt, Homo sapiens
aaacuaacauggaguagag

SEQ ID NO: 1134591 - RNA, 19 nt, Homo sapiens
gagcuuuauuaaucccuua

SEQ ID NO: 1134592 - RNA, 19 nt, Homo sapiens
ccaaagagccuugcuaaag

SEQ ID NO: 1134593 - RNA, 19 nt, Homo sapiens
uuacaauccuugccuauuc

SEQ ID NO: 1134594 - RNA, 19 nt, Homo sapiens
gcaaaggaaagaggaaauu

SEQ ID NO: 1134595 - RNA, 19 nt, Homo sapiens
ccaaggcuguccaacaaug

SEQ ID NO: 1134596 - RNA, 19 nt, Homo sapiens
gagaaucccuggagcuaac

SEQ ID NO: 1134597 - RNA, 19 nt, Homo sapiens
ccacugaguuccagagaag

SEQ ID NO: 1134598 - RNA, 19 nt, Homo sapiens
uuucauagcucucaagucu

SEQ ID NO: 1134599 - RNA, 19 nt, Homo sapiens
acauggaaauacacugaua

SEQ ID NO: 1134600 - RNA, 19 nt, Homo sapiens
gagauucuauacugaccuu

SEQ ID NO: 1134601 - RNA, 19 nt, Homo sapiens
cagacaagagcuuuauuaa

SEQ ID NO: 1134602 - RNA, 19 nt, Homo sapiens
gagccuugcuaaaguggaa

SEQ ID NO: 1134603 - RNA, 19 nt, Homo sapiens
caagucuacugacaagaga

SEQ ID NO: 1134604 - RNA, 19 nt, Homo sapiens
ugucacagcuucuccaagu

SEQ ID NO: 1134605 - RNA, 19 nt, Homo sapiens
guagacaccucagcagcaa

SEQ ID NO: 1134606 - RNA, 19 nt, Homo sapiens
agagaacaguaccguauau

SEQ ID NO: 1134607 - RNA, 19 nt, Homo sapiens
uaacauggaguagagaauu

SEQ ID NO: 1134608 - RNA, 19 nt, Homo sapiens
gagagacccgcaacucauu

SEQ ID NO: 1134609 - RNA, 19 nt, Homo sapiens
gcgcgaagccauccacaga

SEQ ID NO: 1134610 - RNA, 19 nt, Homo sapiens
gcagcaggaggcaccuuua

SEQ ID NO: 1134611 - RNA, 19 nt, Homo sapiens
gagauaaggaagagcagaa

SEQ ID NO: 1134612 - RNA, 19 nt, Homo sapiens
ugccaaggcuguccaacaa

SEQ ID NO: 1134613 - RNA, 19 nt, Homo sapiens
gggaaaggcccucuccaau

SEQ ID NO: 1134614 - RNA, 19 nt, Homo sapiens
agacgacgcccguuuauca

SEQ ID NO: 1134615 - RNA, 19 nt, Homo sapiens
caacuugcaggcuguuaaa

SEQ ID NO: 1134616 - RNA, 19 nt, Homo sapiens
caaagacgaggaguuacua

SEQ ID NO: 1134617 - RNA, 19 nt, Homo sapiens
gcucucaagucuacugaca

SEQ ID NO: 1134618 - RNA, 19 nt, Homo sapiens
aaagagccuugcuaaagug

SEQ ID NO: 1134619 - RNA, 19 nt, Homo sapiens
ucauagcucucaagucuac

SEQ ID NO: 1134620 - RNA, 19 nt, Homo sapiens
ugacagcauagcuuucaua

SEQ ID NO: 1134621 - RNA, 19 nt, Homo sapiens
ggagagacccgcaacucau

SEQ ID NO: 1134622 - RNA, 19 nt, Homo sapiens
cgguggcgcugguuuggua

SEQ ID NO: 1134623 - RNA, 19 nt, Homo sapiens
ggaaugcagccaacguuuc

SEQ ID NO: 1134624 - RNA, 19 nt, Homo sapiens
ugacauggaaauacacuga

SEQ ID NO: 1134625 - RNA, 19 nt, Homo sapiens
caagucagcgccucuaagu

SEQ ID NO: 1134626 - RNA, 19 nt, Homo sapiens
ugcgaucucugaccuacua

SEQ ID NO: 1134627 - RNA, 19 nt, Homo sapiens
caacucauuagcgaaauaa

SEQ ID NO: 1134628 - RNA, 19 nt, Homo sapiens
caaaucagccugggaagca

SEQ ID NO: 1134629 - RNA, 19 nt, Homo sapiens
auaauagggugcacuucaa

SEQ ID NO: 1134630 - RNA, 19 nt, Homo sapiens
gccaacguuuccaguuuga

SEQ ID NO: 1134631 - RNA, 19 nt, Homo sapiens
ugccaaagacgaggaguua

SEQ ID NO: 1134632 - RNA, 19 nt, Homo sapiens
aacaguaccguauaucuuu

SEQ ID NO: 1134633 - RNA, 19 nt, Homo sapiens
ugagaaugcuauauuuggu

SEQ ID NO: 1134634 - RNA, 19 nt, Homo sapiens
gagaggaucaaacuaacau

SEQ ID NO: 1134635 - RNA, 19 nt, Homo sapiens
ugggagaggaucaaacuaa

SEQ ID NO: 1134636 - RNA, 19 nt, Homo sapiens
cagcaaaugguuccucaga

SEQ ID NO: 1134637 - RNA, 19 nt, Homo sapiens
ucucugaccuacuagacuu

SEQ ID NO: 1134638 - RNA, 19 nt, Homo sapiens
uaaagaccucaagucauua

SEQ ID NO: 1134639 - RNA, 19 nt, Homo sapiens
gggagaggaucaaacuaac

SEQ ID NO: 1134640 - RNA, 19 nt, Homo sapiens
acacuacaguuuccuacau

SEQ ID NO: 1134641 - RNA, 19 nt, Homo sapiens
cuucacagcgcugauauaa

SEQ ID NO: 1134642 - RNA, 19 nt, Homo sapiens
gcaacaccaacaccucuug

SEQ ID NO: 1134643 - RNA, 19 nt, Homo sapiens
gaccucaagucauuagcau

SEQ ID NO: 1134644 - RNA, 19 nt, Homo sapiens
ccacagacuuccacaaccu

SEQ ID NO: 1134645 - RNA, 19 nt, Homo sapiens
gcgaagccauccacagacu

SEQ ID NO: 1134646 - RNA, 19 nt, Homo sapiens
gcaucagacaagagcuuua

SEQ ID NO: 1134647 - RNA, 19 nt, Homo sapiens
aggaagagcagaaccuuga

SEQ ID NO: 1134648 - RNA, 19 nt, Homo sapiens
gguuccagguggccuuauu

SEQ ID NO: 1134649 - RNA, 19 nt, Homo sapiens
caaaggaaagaggaaauuc

SEQ ID NO: 1134650 - RNA, 19 nt, Homo sapiens
cccugagaaugcuauauuu

SEQ ID NO: 1134651 - RNA, 19 nt, Homo sapiens
ccaagugccuagugaaacg

SEQ ID NO: 1134652 - RNA, 19 nt, Homo sapiens
gcucagcaaguucaagaga

SEQ ID NO: 1134653 - RNA, 19 nt, Homo sapiens
gcagccaacguuuccaguu

SEQ ID NO: 1134654 - RNA, 19 nt, Homo sapiens
agacgaggaguuacuaguu

SEQ ID NO: 1134655 - RNA, 19 nt, Homo sapiens
ggaagagcagaaccuugaa

SEQ ID NO: 1134656 - RNA, 19 nt, Homo sapiens
gaaacacucgauugcaucu

SEQ ID NO: 1134657 - RNA, 19 nt, Homo sapiens
accaacaccucuugacaug

SEQ ID NO: 1134658 - RNA, 19 nt, Homo sapiens
caacaccaacaccucuuga

SEQ ID NO: 1134659 - RNA, 19 nt, Homo sapiens
ggagaggaucaaacuaaca

SEQ ID NO: 1134660 - RNA, 19 nt, Homo sapiens
ggccagagauaaggaagag

SEQ ID NO: 1134661 - RNA, 19 nt, Homo sapiens
ucucaagucuacugacaag

SEQ ID NO: 1134662 - RNA, 19 nt, Homo sapiens
caacuagcugcgcaaauca

SEQ ID NO: 1134663 - RNA, 19 nt, Homo sapiens
aagggaaacugaggagaga

SEQ ID NO: 1134664 - RNA, 19 nt, Homo sapiens
caaacuaacauggaguaga

SEQ ID NO: 1134665 - RNA, 19 nt, Homo sapiens
gggaaagaacugacugagu

SEQ ID NO: 1134666 - RNA, 19 nt, Homo sapiens
aagagaacaguaccguaua

SEQ ID NO: 1134667 - RNA, 19 nt, Homo sapiens
cgacaucccugagaaugcu

SEQ ID NO: 1134668 - RNA, 19 nt, Homo sapiens
ggacaagguuucaguguua

SEQ ID NO: 1134669 - RNA, 19 nt, Homo sapiens
gaagagaaauguaagauuc

SEQ ID NO: 1134670 - RNA, 19 nt, Homo sapiens
gaucggaaauaacugauua

SEQ ID NO: 1134671 - RNA, 19 nt, Homo sapiens
guaggaaucucaagaauug

SEQ ID NO: 1134672 - RNA, 19 nt, Homo sapiens
gguccaaacucuugaauaa

SEQ ID NO: 1134673 - RNA, 19 nt, Homo sapiens
gcucaagacuccacaggaa

SEQ ID NO: 1134674 - RNA, 19 nt, Homo sapiens
gaacgaaggauucuuagca

SEQ ID NO: 1134675 - RNA, 19 nt, Homo sapiens
gaacaggccagaaagugaa

SEQ ID NO: 1134676 - RNA, 19 nt, Homo sapiens
aaagaaagguccaaacucu

SEQ ID NO: 1134677 - RNA, 19 nt, Homo sapiens
gaagaaagaggaaccaaag

SEQ ID NO: 1134678 - RNA, 19 nt, Homo sapiens
gggagaaacugcuaugagu

SEQ ID NO: 1134679 - RNA, 19 nt, Homo sapiens
guaccucauucuucccuua

SEQ ID NO: 1134680 - RNA, 19 nt, Homo sapiens
gaagaagaguccagaacag

SEQ ID NO: 1134681 - RNA, 19 nt, Homo sapiens
ggucaagccucugcuauca

SEQ ID NO: 1134682 - RNA, 19 nt, Homo sapiens
ccagaaagacauaaacuug

SEQ ID NO: 1134683 - RNA, 19 nt, Homo sapiens
ggauaguucuguaaguguu

SEQ ID NO: 1134684 - RNA, 19 nt, Homo sapiens
uauagaaccugccgaguca

SEQ ID NO: 1134685 - RNA, 19 nt, Homo sapiens
gagaaacugcuaugaguau

SEQ ID NO: 1134686 - RNA, 19 nt, Homo sapiens
ggagaaacugcuaugagua

SEQ ID NO: 1134687 - RNA, 19 nt, Homo sapiens
gaaagucgcagcaggaaag

SEQ ID NO: 1134688 - RNA, 19 nt, Homo sapiens
ggaagagaaauguaagauu

SEQ ID NO: 1134689 - RNA, 19 nt, Homo sapiens
gaagucacaccuccucauu

SEQ ID NO: 1134690 - RNA, 19 nt, Homo sapiens
aaacaaauccgccacuuuc

SEQ ID NO: 1134691 - RNA, 19 nt, Homo sapiens
ggaagaaagaggaaccaaa

SEQ ID NO: 1134692 - RNA, 19 nt, Homo sapiens
gacuagagaugaggaagaa

SEQ ID NO: 1134693 - RNA, 19 nt, Homo sapiens
gugaacugcuggucuggua

SEQ ID NO: 1134694 - RNA, 19 nt, Homo sapiens
ggaagaagaguccagaaca

SEQ ID NO: 1134695 - RNA, 19 nt, Homo sapiens
gucaagagaucaaagaaag

SEQ ID NO: 1134696 - RNA, 19 nt, Homo sapiens
ggauacuccuggcugguaa

SEQ ID NO: 1134697 - RNA, 19 nt, Homo sapiens
agaaagacauaaacuugga

SEQ ID NO: 1134698 - RNA, 19 nt, Homo sapiens
gaagucugcugaccccuua

SEQ ID NO: 1134699 - RNA, 19 nt, Homo sapiens
ccacacagccguaaugaca

SEQ ID NO: 1134700 - RNA, 19 nt, Homo sapiens
gcacugauccccuccauuu

SEQ ID NO: 1134701 - RNA, 19 nt, Homo sapiens
agucaaaccuccucaguca

SEQ ID NO: 1134702 - RNA, 19 nt, Homo sapiens
gagcagcaauauccagauc

SEQ ID NO: 1134703 - RNA, 19 nt, Homo sapiens
agaagagccugccauuuca

SEQ ID NO: 1134704 - RNA, 19 nt, Homo sapiens
guaagaagagccugccauu

SEQ ID NO: 1134705 - RNA, 19 nt, Homo sapiens
acacagccguaaugacaaa

SEQ ID NO: 1134706 - RNA, 19 nt, Homo sapiens
aagaagagccugccauuuc

SEQ ID NO: 1134707 - RNA, 19 nt, Homo sapiens
acaggcagaucuucuauag

SEQ ID NO: 1134708 - RNA, 19 nt, Homo sapiens
gaguccgucugguuuaauu

SEQ ID NO: 1134709 - RNA, 19 nt, Homo sapiens
gacaagguuucaguguuaa

SEQ ID NO: 1134710 - RNA, 19 nt, Homo sapiens
ggaaugaggcaucugaucu

SEQ ID NO: 1134711 - RNA, 19 nt, Homo sapiens
gaagaggcagccaacaaug

SEQ ID NO: 1134712 - RNA, 19 nt, Homo sapiens
ggaagaacaagggauaguu

SEQ ID NO: 1134713 - RNA, 19 nt, Homo sapiens
ccacuuucaugacuagaga

SEQ ID NO: 1134714 - RNA, 19 nt, Homo sapiens
uaaacaaauccgccacuuu

SEQ ID NO: 1134715 - RNA, 19 nt, Homo sapiens
gaacaacgcucaaaauccu

SEQ ID NO: 1134716 - RNA, 19 nt, Homo sapiens
cagcaugugugguucuuuc

SEQ ID NO: 1134717 - RNA, 19 nt, Homo sapiens
gcagggaggaugaguaagu

SEQ ID NO: 1134718 - RNA, 19 nt, Homo sapiens
gguaggaaucucaagaauu

SEQ ID NO: 1134719 - RNA, 19 nt, Homo sapiens
gaacuucccaggaccaucu

SEQ ID NO: 1134720 - RNA, 19 nt, Homo sapiens
gaugagguaugugaacugu

SEQ ID NO: 1134721 - RNA, 19 nt, Homo sapiens
ccaaguguguaccucauuc

SEQ ID NO: 1134722 - RNA, 19 nt, Homo sapiens
ugaggaagaacaagggaua

SEQ ID NO: 1134723 - RNA, 19 nt, Homo sapiens
ggucaagagaucaaagaaa

SEQ ID NO: 1134724 - RNA, 19 nt, Homo sapiens
aaccaaaggucaagagauc

SEQ ID NO: 1134725 - RNA, 19 nt, Homo sapiens
caaauccgccacuuucaug

SEQ ID NO: 1134726 - RNA, 19 nt, Homo sapiens
ggaacacaggcaaauuauu

SEQ ID NO: 1134727 - RNA, 19 nt, Homo sapiens
cgcaaucacuccucucaga

SEQ ID NO: 1134728 - RNA, 19 nt, Homo sapiens
ccucuccucugcugccaua

SEQ ID NO: 1134729 - RNA, 19 nt, Homo sapiens
gaaagguccaaacucuuga

SEQ ID NO: 1134730 - RNA, 19 nt, Homo sapiens
agaaucaggagcagcaaua

SEQ ID NO: 1134731 - RNA, 19 nt, Homo sapiens
gcaaucacuccucucagaa

SEQ ID NO: 1134732 - RNA, 19 nt, Homo sapiens
ccaacuggaugagguaugu

SEQ ID NO: 1134733 - RNA, 19 nt, Homo sapiens
agaaagguccaaacucuug

SEQ ID NO: 1134734 - RNA, 19 nt, Homo sapiens
gaucaaagaaagguccaaa

SEQ ID NO: 1134735 - RNA, 19 nt, Homo sapiens
gcagcaaguggaagaaaga

SEQ ID NO: 1134736 - RNA, 19 nt, Homo sapiens
ugugaaagccagacaagaa

SEQ ID NO: 1134737 - RNA, 19 nt, Homo sapiens
agucacaccuccucauuca

SEQ ID NO: 1134738 - RNA, 19 nt, Homo sapiens
ggguaggaaucucaagaau

SEQ ID NO: 1134739 - RNA, 19 nt, Homo sapiens
ggaugaauacggccaggaa

SEQ ID NO: 1134740 - RNA, 19 nt, Homo sapiens
gaacugcuggucugguaug

SEQ ID NO: 1134741 - RNA, 19 nt, Homo sapiens
aaacugaacacucgaacga

SEQ ID NO: 1134742 - RNA, 19 nt, Homo sapiens
ccagaagggccacagagaa

SEQ ID NO: 1134743 - RNA, 19 nt, Homo sapiens
aaagagaucggaaauaacu

SEQ ID NO: 1134744 - RNA, 19 nt, Homo sapiens
cgaagaggcagccaacaau

SEQ ID NO: 1134745 - RNA, 19 nt, Homo sapiens
agggaacacaggcaaauua

SEQ ID NO: 1134746 - RNA, 19 nt, Homo sapiens
ggacauggcagagggagau

SEQ ID NO: 1134747 - RNA, 19 nt, Homo sapiens
gcagcaauauccagaucca

SEQ ID NO: 1134748 - RNA, 19 nt, Homo sapiens
gaaacugcuaugaguaugu

SEQ ID NO: 1134749 - RNA, 19 nt, Homo sapiens
gguaugugcccuccgugua

SEQ ID NO: 1134750 - RNA, 19 nt, Homo sapiens
uaagaagagccugccauuu

SEQ ID NO: 1134751 - RNA, 19 nt, Homo sapiens
ucaagacuccacaggaauu

SEQ ID NO: 1134752 - RNA, 19 nt, Homo sapiens
aacaagggauaguucugua

SEQ ID NO: 1134753 - RNA, 19 nt, Homo sapiens
auucuucccuuaucacuga

SEQ ID NO: 1134754 - RNA, 19 nt, Homo sapiens
gggaacacaggcaaauuau

SEQ ID NO: 1134755 - RNA, 19 nt, Homo sapiens
gaaugaggcaucugaucug

SEQ ID NO: 1134756 - RNA, 19 nt, Homo sapiens
ugagaugugucagaacuuc

SEQ ID NO: 1134757 - RNA, 19 nt, Homo sapiens
ccaggaccaucugcaagaa

SEQ ID NO: 1134758 - RNA, 19 nt, Homo sapiens
guccagaacaggccagaaa

SEQ ID NO: 1134759 - RNA, 19 nt, Homo sapiens
gauccacacagccguaaug

SEQ ID NO: 1134760 - RNA, 19 nt, Homo sapiens
ccaaguccaggaagagaaa

SEQ ID NO: 1134761 - RNA, 19 nt, Homo sapiens
gauguuauuacacaccaaa

SEQ ID NO: 1134762 - RNA, 19 nt, Homo sapiens
uggacaagguuucaguguu

SEQ ID NO: 1134763 - RNA, 19 nt, Homo sapiens
aaacugcuaugaguaugug

SEQ ID NO: 1134764 - RNA, 19 nt, Homo sapiens
caaagaaagguccaaacuc

SEQ ID NO: 1134765 - RNA, 19 nt, Homo sapiens
ucacuccucucagaacuuc

SEQ ID NO: 1134766 - RNA, 19 nt, Homo sapiens
gcugagaauugggccauca

SEQ ID NO: 1134767 - RNA, 19 nt, Homo sapiens
gaaccugccgagucauuag

SEQ ID NO: 1134768 - RNA, 19 nt, Homo sapiens
uagaguagcuucuuuauga

SEQ ID NO: 1134769 - RNA, 19 nt, Homo sapiens
guaaaucacuuaucgaaga

SEQ ID NO: 1134770 - RNA, 19 nt, Homo sapiens
gaauguaaccgccgauuua

SEQ ID NO: 1134771 - RNA, 19 nt, Homo sapiens
agaaagaccuuacuucauu

SEQ ID NO: 1134772 - RNA, 19 nt, Homo sapiens
gaaagaagcauccagaguu

SEQ ID NO: 1134773 - RNA, 19 nt, Homo sapiens
gaaagaccuuacuucauuu

SEQ ID NO: 1134774 - RNA, 19 nt, Homo sapiens
gaacugcuuuaucuuguuu

SEQ ID NO: 1134775 - RNA, 19 nt, Homo sapiens
ggagaagacuaguggaauu

SEQ ID NO: 1134776 - RNA, 19 nt, Homo sapiens
gcaaagacuuccuguguuc

SEQ ID NO: 1134777 - RNA, 19 nt, Homo sapiens
gaaauccagucuuuaugaa

SEQ ID NO: 1134778 - RNA, 19 nt, Homo sapiens
gaauuugccuugcucuuga

SEQ ID NO: 1134779 - RNA, 19 nt, Homo sapiens
ucagugaguuauaguguua

SEQ ID NO: 1134780 - RNA, 19 nt, Homo sapiens
gaagguggcauuucuuauu

SEQ ID NO: 1134781 - RNA, 19 nt, Homo sapiens
ggauuuacaugaagaccua

SEQ ID NO: 1134782 - RNA, 19 nt, Homo sapiens
gacccuauccuguuauuua

SEQ ID NO: 1134783 - RNA, 19 nt, Homo sapiens
uaagggaucuggaagaaau

SEQ ID NO: 1134784 - RNA, 19 nt, Homo sapiens
aaagggagccugcugaaua

SEQ ID NO: 1134785 - RNA, 19 nt, Homo sapiens
ggucugaacugcuuuaucu

SEQ ID NO: 1134786 - RNA, 19 nt, Homo sapiens
acacaggacuugcuacauu

SEQ ID NO: 1134787 - RNA, 19 nt, Homo sapiens
ggaagcaauuuaagcgaaa

SEQ ID NO: 1134788 - RNA, 19 nt, Homo sapiens
agaaagggauuuacaugaa

SEQ ID NO: 1134789 - RNA, 19 nt, Homo sapiens
gaccuuacuucauuucaaa

SEQ ID NO: 1134790 - RNA, 19 nt, Homo sapiens
uugaagagauggcaaauga

SEQ ID NO: 1134791 - RNA, 19 nt, Homo sapiens
gaagagacacccagacaug

SEQ ID NO: 1134792 - RNA, 19 nt, Homo sapiens
uagaagaggugccagaguu

SEQ ID NO: 1134793 - RNA, 19 nt, Homo sapiens
gaaagggauuuacaugaag

SEQ ID NO: 1134794 - RNA, 19 nt, Homo sapiens
gaagagauggcaaaugaug

SEQ ID NO: 1134795 - RNA, 19 nt, Homo sapiens
gaacagaaagaccuuacuu

SEQ ID NO: 1134796 - RNA, 19 nt, Homo sapiens
gagcuggucuuuuaacaua

SEQ ID NO: 1134797 - RNA, 19 nt, Homo sapiens
gcugaaagacuguuacauu

SEQ ID NO: 1134798 - RNA, 19 nt, Homo sapiens
caagacacauugacacugu

SEQ ID NO: 1134799 - RNA, 19 nt, Homo sapiens
gaacuuuauugauguguag

SEQ ID NO: 1134800 - RNA, 19 nt, Homo sapiens
ggucaucuuuaucaaauug

SEQ ID NO: 1134801 - RNA, 19 nt, Homo sapiens
ggaaauauuaaguggcaua

SEQ ID NO: 1134802 - RNA, 19 nt, Homo sapiens
gaucauguggccauucaua

SEQ ID NO: 1134803 - RNA, 19 nt, Homo sapiens
gaagaccuaugguuugagu

SEQ ID NO: 1134804 - RNA, 19 nt, Homo sapiens
uaaguagaguagcuucuuu

SEQ ID NO: 1134805 - RNA, 19 nt, Homo sapiens
guaacuggaugauguuugu

SEQ ID NO: 1134806 - RNA, 19 nt, Homo sapiens
gauuggagcugcagaaugc

SEQ ID NO: 1134807 - RNA, 19 nt, Homo sapiens
gaaagaaagggauuuacau

SEQ ID NO: 1134808 - RNA, 19 nt, Homo sapiens
ccacagaacagagaucuuu

SEQ ID NO: 1134809 - RNA, 19 nt, Homo sapiens
aagaaacgguucccagauu

SEQ ID NO: 1134810 - RNA, 19 nt, Homo sapiens
ggaaagaaagggauuuaca

SEQ ID NO: 1134811 - RNA, 19 nt, Homo sapiens
ucgcauggcuuucagauca

SEQ ID NO: 1134812 - RNA, 19 nt, Homo sapiens
ugacaaagauauucaacag

SEQ ID NO: 1134813 - RNA, 19 nt, Homo sapiens
gacaggaugugccaaguuc

SEQ ID NO: 1134814 - RNA, 19 nt, Homo sapiens
ggaguagguuggauguaga

SEQ ID NO: 1134815 - RNA, 19 nt, Homo sapiens
ggaccuggauuugaagaga

SEQ ID NO: 1134816 - RNA, 19 nt, Homo sapiens
agaaacgguucccagauuu

SEQ ID NO: 1134817 - RNA, 19 nt, Homo sapiens
guguagauuucgcacuuua

SEQ ID NO: 1134818 - RNA, 19 nt, Homo sapiens
aagggagccugcugaauaa

SEQ ID NO: 1134819 - RNA, 19 nt, Homo sapiens
gaacugucccagaccuuaa

SEQ ID NO: 1134820 - RNA, 19 nt, Homo sapiens
gcaaagcccacauucugaa

SEQ ID NO: 1134821 - RNA, 19 nt, Homo sapiens
gaaagaucauguggccauu

SEQ ID NO: 1134822 - RNA, 19 nt, Homo sapiens
acaugaagcuccacucaga

SEQ ID NO: 1134823 - RNA, 19 nt, Homo sapiens
uguaaccgccgauuuauaa

SEQ ID NO: 1134824 - RNA, 19 nt, Homo sapiens
gguuugaguugucugauga

SEQ ID NO: 1134825 - RNA, 19 nt, Homo sapiens
ugaggaagaugaggaagaa

SEQ ID NO: 1134826 - RNA, 19 nt, Homo sapiens
gaucagguauucugcacau

SEQ ID NO: 1134827 - RNA, 19 nt, Homo sapiens
uauaagggaucuggaagaa

SEQ ID NO: 1134828 - RNA, 19 nt, Homo sapiens
gauggccacuucuaauaau

SEQ ID NO: 1134829 - RNA, 19 nt, Homo sapiens
gaaaguucuucgagagcaa

SEQ ID NO: 1134830 - RNA, 19 nt, Homo sapiens
gaacugaaggugugguaug

SEQ ID NO: 1134831 - RNA, 19 nt, Homo sapiens
agaaucaccuggagcagaa

SEQ ID NO: 1134832 - RNA, 19 nt, Homo sapiens
guacauucagugaguuaua

SEQ ID NO: 1134833 - RNA, 19 nt, Homo sapiens
gcauaucaccaaaccauga

SEQ ID NO: 1134834 - RNA, 19 nt, Homo sapiens
gaacggaagcagcgaagug

SEQ ID NO: 1134835 - RNA, 19 nt, Homo sapiens
aaagaagcauccagaguuc

SEQ ID NO: 1134836 - RNA, 19 nt, Homo sapiens
gaaagacuguuacauucac

SEQ ID NO: 1134837 - RNA, 19 nt, Homo sapiens
gagaagacuaguggaauuu

SEQ ID NO: 1134838 - RNA, 19 nt, Homo sapiens
aagguggcauuucuuauuu

SEQ ID NO: 1134839 - RNA, 19 nt, Homo sapiens
gcaaacuucugcccucucu

SEQ ID NO: 1134840 - RNA, 19 nt, Homo sapiens
gaagaggugccagaguuaa

SEQ ID NO: 1134841 - RNA, 19 nt, Homo sapiens
acucagaccagaagacuua

SEQ ID NO: 1134842 - RNA, 19 nt, Homo sapiens
cacaggacuugcuacauuu

SEQ ID NO: 1134843 - RNA, 19 nt, Homo sapiens
gaauuggcccugcuaugaa

SEQ ID NO: 1134844 - RNA, 19 nt, Homo sapiens
ccaaagaggaagaggauga

SEQ ID NO: 1134845 - RNA, 19 nt, Homo sapiens
agacugcguucauguaguu

SEQ ID NO: 1134846 - RNA, 19 nt, Homo sapiens
caggauccauuuaucauuc

SEQ ID NO: 1134847 - RNA, 19 nt, Homo sapiens
gucauuauguguuaucaga

SEQ ID NO: 1134848 - RNA, 19 nt, Homo sapiens
gcgcaaagcccacauucug

SEQ ID NO: 1134849 - RNA, 19 nt, Homo sapiens
cuagauguguuuagcagaa

SEQ ID NO: 1134850 - RNA, 19 nt, Homo sapiens
cugaaagacuguuacauuc

SEQ ID NO: 1134851 - RNA, 19 nt, Homo sapiens
cuuaagauaucuaggucua

SEQ ID NO: 1134852 - RNA, 19 nt, Homo sapiens
aagaaucacugaauggaau

SEQ ID NO: 1134853 - RNA, 19 nt, Homo sapiens
gugauggccacuucuaaua

SEQ ID NO: 1134854 - RNA, 19 nt, Homo sapiens
gaugucagcagaaucuaaa

SEQ ID NO: 1134855 - RNA, 19 nt, Homo sapiens
ggagccugcugaauaacaa

SEQ ID NO: 1134856 - RNA, 19 nt, Homo sapiens
gcaacagcaucucaauucu

SEQ ID NO: 1134857 - RNA, 19 nt, Homo sapiens
agcagaaccugguggcuua

SEQ ID NO: 1134858 - RNA, 19 nt, Homo sapiens
uaaguugucuucuucuucu

SEQ ID NO: 1134859 - RNA, 19 nt, Homo sapiens
gauuacaaauauccuagug

SEQ ID NO: 1134860 - RNA, 19 nt, Homo sapiens
cgaagugcauaucaccaaa

SEQ ID NO: 1134861 - RNA, 19 nt, Homo sapiens
gaaaauggacucucuuugu

SEQ ID NO: 1134862 - RNA, 19 nt, Homo sapiens
guacuaagagaacuugaga

SEQ ID NO: 1134863 - RNA, 19 nt, Homo sapiens
gaguagcuucuuuaugaua

SEQ ID NO: 1134864 - RNA, 19 nt, Homo sapiens
gugacaugcuaacacauuu

SEQ ID NO: 1134865 - RNA, 19 nt, Homo sapiens
cuuaccaaguguacauuua

SEQ ID NO: 1134866 - RNA, 19 nt, Homo sapiens
gagagagaaaguauugaaa

SEQ ID NO: 1134867 - RNA, 19 nt, Homo sapiens
uaagaaggagauauuggua

SEQ ID NO: 1134868 - RNA, 19 nt, Homo sapiens
caaaucagcuggcuucuuc

SEQ ID NO: 1134869 - RNA, 19 nt, Homo sapiens
gcucaccucucuuccuuua

SEQ ID NO: 1134870 - RNA, 19 nt, Homo sapiens
gcauggagguggucaagga

SEQ ID NO: 1134871 - RNA, 19 nt, Homo sapiens
gaagaaaauugaccugauu

SEQ ID NO: 1134872 - RNA, 19 nt, Homo sapiens
ggagaagucugagcagguu

SEQ ID NO: 1134873 - RNA, 19 nt, Homo sapiens
gcagcucaaugaauauuau

SEQ ID NO: 1134874 - RNA, 19 nt, Homo sapiens
cuagaaggauggagaguga

SEQ ID NO: 1134875 - RNA, 19 nt, Homo sapiens
gugggaggcuuaaguaaau

SEQ ID NO: 1134876 - RNA, 19 nt, Homo sapiens
gacaagaacaaccgcuaua

SEQ ID NO: 1134877 - RNA, 19 nt, Homo sapiens
cuaaagcucucuguggaaa

SEQ ID NO: 1134878 - RNA, 19 nt, Homo sapiens
gcagguaaguugguuugga

SEQ ID NO: 1134879 - RNA, 19 nt, Homo sapiens
ggagcuccaggcagaauua

SEQ ID NO: 1134880 - RNA, 19 nt, Homo sapiens
aagaggagccuucaucauu

SEQ ID NO: 1134881 - RNA, 19 nt, Homo sapiens
gaggagccuucaucauuca

SEQ ID NO: 1134882 - RNA, 19 nt, Homo sapiens
cugagcagguucuggauaa

SEQ ID NO: 1134883 - RNA, 19 nt, Homo sapiens
caagguaggguucaauguu

SEQ ID NO: 1134884 - RNA, 19 nt, Homo sapiens
aguugcagcucaaugaaua

SEQ ID NO: 1134885 - RNA, 19 nt, Homo sapiens
guucuucucuuccugaauc

SEQ ID NO: 1134886 - RNA, 19 nt, Homo sapiens
gaauuagacaugcuuaagu

SEQ ID NO: 1134887 - RNA, 19 nt, Homo sapiens
gagcccagguccucagugu

SEQ ID NO: 1134888 - RNA, 19 nt, Homo sapiens
ccaauuggaggaugaagaa

SEQ ID NO: 1134889 - RNA, 19 nt, Homo sapiens
ggaaguugagcccaagaaa

SEQ ID NO: 1134890 - RNA, 19 nt, Homo sapiens
guauccuccuugucaauaa

SEQ ID NO: 1134891 - RNA, 19 nt, Homo sapiens
ucaggaaaguccccaaaua

SEQ ID NO: 1134892 - RNA, 19 nt, Homo sapiens
guacagcgaggacuacaug

SEQ ID NO: 1134893 - RNA, 19 nt, Homo sapiens
ggacaagaacaaccgcuau

SEQ ID NO: 1134894 - RNA, 19 nt, Homo sapiens
gcagaauuagacaugcuua

SEQ ID NO: 1134895 - RNA, 19 nt, Homo sapiens
guauucgccuaaagaagaa

SEQ ID NO: 1134896 - RNA, 19 nt, Homo sapiens
agaggagccuucaucauuc

SEQ ID NO: 1134897 - RNA, 19 nt, Homo sapiens
caaggagccaggccaauug

SEQ ID NO: 1134898 - RNA, 19 nt, Homo sapiens
gaacuucccaccaccucuu

SEQ ID NO: 1134899 - RNA, 19 nt, Homo sapiens
ggagaccugaggaguguaa

SEQ ID NO: 1134900 - RNA, 19 nt, Homo sapiens
caaccgcuauaaguccaua

SEQ ID NO: 1134901 - RNA, 19 nt, Homo sapiens
ggacacuaguggagagagu

SEQ ID NO: 1134902 - RNA, 19 nt, Homo sapiens
aagguaggguucaauguug

SEQ ID NO: 1134903 - RNA, 19 nt, Homo sapiens
ccaaagcccaauuucuaaa

SEQ ID NO: 1134904 - RNA, 19 nt, Homo sapiens
ggugugugcuguguucuug

SEQ ID NO: 1134905 - RNA, 19 nt, Homo sapiens
ccaaggagccaggccaauu

SEQ ID NO: 1134906 - RNA, 19 nt, Homo sapiens
aaauugaagugccaugcaa

SEQ ID NO: 1134907 - RNA, 19 nt, Homo sapiens
uaaguugguuuggaugaga

SEQ ID NO: 1134908 - RNA, 19 nt, Homo sapiens
gcaccucacuggucaucag

SEQ ID NO: 1134909 - RNA, 19 nt, Homo sapiens
cagguaaguugguuuggau

SEQ ID NO: 1134910 - RNA, 19 nt, Homo sapiens
uguauucgccuaaagaaga

SEQ ID NO: 1134911 - RNA, 19 nt, Homo sapiens
ccagagagagaaagacaga

SEQ ID NO: 1134912 - RNA, 19 nt, Homo sapiens
ucucuuggcuucccuaacu

SEQ ID NO: 1134913 - RNA, 19 nt, Homo sapiens
gccaggugcuccauguguu

SEQ ID NO: 1134914 - RNA, 19 nt, Homo sapiens
uaacuguauucgccuaaag

SEQ ID NO: 1134915 - RNA, 19 nt, Homo sapiens
gcacagcaugucccaggaa

SEQ ID NO: 1134916 - RNA, 19 nt, Homo sapiens
agaaugaccgagaacauga

SEQ ID NO: 1134917 - RNA, 19 nt, Homo sapiens
cauuucgggucacaaggua

SEQ ID NO: 1134918 - RNA, 19 nt, Homo sapiens
cccauggugugcagaauau

SEQ ID NO: 1134919 - RNA, 19 nt, Homo sapiens
acagugagcgcaucuacuu

SEQ ID NO: 1134920 - RNA, 19 nt, Homo sapiens
gggaggagagggagcagaa

SEQ ID NO: 1134921 - RNA, 19 nt, Homo sapiens
caagaacaaccgcuauaag

SEQ ID NO: 1134922 - RNA, 19 nt, Homo sapiens
acaagaacaaccgcuauaa

SEQ ID NO: 1134923 - RNA, 19 nt, Homo sapiens
ggacuccucggccauggaa

SEQ ID NO: 1134924 - RNA, 19 nt, Homo sapiens
agaguaagccaccucaaug

SEQ ID NO: 1134925 - RNA, 19 nt, Homo sapiens
gaaugaccgagaacaugaa

SEQ ID NO: 1134926 - RNA, 19 nt, Homo sapiens
agagagaaagacagaauga

SEQ ID NO: 1134927 - RNA, 19 nt, Homo sapiens
gagagagaaagacagaaug

SEQ ID NO: 1134928 - RNA, 19 nt, Homo sapiens
gcaguugcagcucaaugaa

SEQ ID NO: 1134929 - RNA, 19 nt, Homo sapiens
cccaaagcccaauuucuaa

SEQ ID NO: 1134930 - RNA, 19 nt, Homo sapiens
uauccuccuugucaauaaa

SEQ ID NO: 1134931 - RNA, 19 nt, Homo sapiens
ucucggacccugcagguaa

SEQ ID NO: 1134932 - RNA, 19 nt, Homo sapiens
aauuagacaugcuuaaguc

SEQ ID NO: 1134933 - RNA, 19 nt, Homo sapiens
aagaacaaccgcuauaagu

SEQ ID NO: 1134934 - RNA, 19 nt, Homo sapiens
gaaguugagcccaagaaac

SEQ ID NO: 1134935 - RNA, 19 nt, Homo sapiens
cacagcaugucccaggaaa

SEQ ID NO: 1134936 - RNA, 19 nt, Homo sapiens
aggaguacuucguggauga

SEQ ID NO: 1134937 - RNA, 19 nt, Homo sapiens
gccuggaguucuagaagga

SEQ ID NO: 1134938 - RNA, 19 nt, Homo sapiens
cgggagaccugaggagugu

SEQ ID NO: 1134939 - RNA, 19 nt, Homo sapiens
gguaaguugguuuggauga

SEQ ID NO: 1134940 - RNA, 19 nt, Homo sapiens
gcacagugagcgcaucuac

SEQ ID NO: 1134941 - RNA, 19 nt, Homo sapiens
gaucuccacccaggacaaa

SEQ ID NO: 1134942 - RNA, 19 nt, Homo sapiens
ccucggccauggaaguuga

SEQ ID NO: 1134943 - RNA, 19 nt, Homo sapiens
ucccuagccuggaguucua

SEQ ID NO: 1134944 - RNA, 19 nt, Homo sapiens
ggacccugcagguaaguug

SEQ ID NO: 1134945 - RNA, 19 nt, Homo sapiens
gagagugacgugcgaugug

SEQ ID NO: 1134946 - RNA, 19 nt, Homo sapiens
cagaaugaccgagaacaug

SEQ ID NO: 1134947 - RNA, 19 nt, Homo sapiens
ccacacauggucccaguuc

SEQ ID NO: 1134948 - RNA, 19 nt, Homo sapiens
ccucacuggucaucaggaa

SEQ ID NO: 1134949 - RNA, 19 nt, Homo sapiens
ucgguuucuucaucuauaa

SEQ ID NO: 1134950 - RNA, 19 nt, Homo sapiens
ugaccgagaacaugaagga

SEQ ID NO: 1134951 - RNA, 19 nt, Homo sapiens
gcccuuguauccuccuugu

SEQ ID NO: 1134952 - RNA, 19 nt, Homo sapiens
cagaauuagacaugcuuaa

SEQ ID NO: 1134953 - RNA, 19 nt, Homo sapiens
guaaguugguuuggaugag

SEQ ID NO: 1134954 - RNA, 19 nt, Homo sapiens
cguauugccaccacaggua

SEQ ID NO: 1134955 - RNA, 19 nt, Homo sapiens
ccaggcagaauuagacaug

SEQ ID NO: 1134956 - RNA, 19 nt, Homo sapiens
caucugacccucaugaacu

SEQ ID NO: 1134957 - RNA, 19 nt, Homo sapiens
ugaauccgagccaggagua

SEQ ID NO: 1134958 - RNA, 19 nt, Homo sapiens
ugaagugccaugcaaguag

SEQ ID NO: 1134959 - RNA, 19 nt, Homo sapiens
aggccucccuugcaucuga

SEQ ID NO: 1134960 - RNA, 19 nt, Homo sapiens
gggcaaaagucccuacaag

SEQ ID NO: 1134961 - RNA, 19 nt, Homo sapiens
gaguaagccaccucaaugg

SEQ ID NO: 1134962 - RNA, 19 nt, Homo sapiens
cuaacuguauucgccuaaa

SEQ ID NO: 1134963 - RNA, 19 nt, Homo sapiens
ugaagcgccugcacagcau

SEQ ID NO: 1134964 - RNA, 19 nt, Homo sapiens
aagacagaaugaccgagaa

SEQ ID NO: 1134965 - RNA, 19 nt, Homo sapiens
ugagguacguggucaucuc

SEQ ID NO: 1134966 - RNA, 19 nt, Homo sapiens
ggaugaaugcccaaaccau

SEQ ID NO: 1134967 - RNA, 19 nt, Homo sapiens
ugugggaggcuuaaguaaa

SEQ ID NO: 1134968 - RNA, 19 nt, Homo sapiens
aaacagaucucuccaaugu

SEQ ID NO: 1134969 - RNA, 19 nt, Homo sapiens
gggagaaccucuugaguga

SEQ ID NO: 1134970 - RNA, 19 nt, Homo sapiens
caagagcuguuacaauuug

SEQ ID NO: 1134971 - RNA, 19 nt, Homo sapiens
gaacccaacucuaccuuuc

SEQ ID NO: 1134972 - RNA, 19 nt, Homo sapiens
ugauguagcucaagagauu

SEQ ID NO: 1134973 - RNA, 19 nt, Homo sapiens
uccaagagcuguuacaauu

SEQ ID NO: 1134974 - RNA, 19 nt, Homo sapiens
gaccagaaaucgugagaug

SEQ ID NO: 1134975 - RNA, 19 nt, Homo sapiens
gagaaccucuugagugaau

SEQ ID NO: 1134976 - RNA, 19 nt, Homo sapiens
gaagccaguuuauuaggaa

SEQ ID NO: 1134977 - RNA, 19 nt, Homo sapiens
gcaccuauaccuugaauau

SEQ ID NO: 1134978 - RNA, 19 nt, Homo sapiens
ggaaguaguacaacucauu

SEQ ID NO: 1134979 - RNA, 19 nt, Homo sapiens
ggaagccaguuuauuagga

SEQ ID NO: 1134980 - RNA, 19 nt, Homo sapiens
uaacaggucuuuggagaau

SEQ ID NO: 1134981 - RNA, 19 nt, Homo sapiens
gcugcaaguuuccgguuua

SEQ ID NO: 1134982 - RNA, 19 nt, Homo sapiens
acaggucuuuggagaauua

SEQ ID NO: 1134983 - RNA, 19 nt, Homo sapiens
ggugagaagcuuaccauaa

SEQ ID NO: 1134984 - RNA, 19 nt, Homo sapiens
gaaggaaagguuaugauca

SEQ ID NO: 1134985 - RNA, 19 nt, Homo sapiens
acucuaaauuccugucuua

SEQ ID NO: 1134986 - RNA, 19 nt, Homo sapiens
ugaaagauaccuuaggaaa

SEQ ID NO: 1134987 - RNA, 19 nt, Homo sapiens
uaugaaagauaccuuagga

SEQ ID NO: 1134988 - RNA, 19 nt, Homo sapiens
gaaguaguacaacucauug

SEQ ID NO: 1134989 - RNA, 19 nt, Homo sapiens
cuaauacacugauaugaag

SEQ ID NO: 1134990 - RNA, 19 nt, Homo sapiens
gaaagauaccuuaggaaag

SEQ ID NO: 1134991 - RNA, 19 nt, Homo sapiens
cuucaugcccuacuucuua

SEQ ID NO: 1134992 - RNA, 19 nt, Homo sapiens
aaggaaagguuaugaucaa

SEQ ID NO: 1134993 - RNA, 19 nt, Homo sapiens
ucaggagguuucuauaaug

SEQ ID NO: 1134994 - RNA, 19 nt, Homo sapiens
acuaucagaucacuaagaa

SEQ ID NO: 1134995 - RNA, 19 nt, Homo sapiens
ggugaugaguggcuagaau

SEQ ID NO: 1134996 - RNA, 19 nt, Homo sapiens
gaugcccuuugucccauua

SEQ ID NO: 1134997 - RNA, 19 nt, Homo sapiens
gaaagccagcugcuaagga

SEQ ID NO: 1134998 - RNA, 19 nt, Homo sapiens
uaggaaagccagcugcuaa

SEQ ID NO: 1134999 - RNA, 19 nt, Homo sapiens
ucaguaagacaucagagua

SEQ ID NO: 1135000 - RNA, 19 nt, Homo sapiens
ccagucuucuccuucagua

SEQ ID NO: 1135001 - RNA, 19 nt, Homo sapiens
ggaaagguuaugaucaaau

SEQ ID NO: 1135002 - RNA, 19 nt, Homo sapiens
gaaaggggaagccaguuua

SEQ ID NO: 1135003 - RNA, 19 nt, Homo sapiens
caaaacagaucucuccaau

SEQ ID NO: 1135004 - RNA, 19 nt, Homo sapiens
guggaucacugcaaauaca

SEQ ID NO: 1135005 - RNA, 19 nt, Homo sapiens
aaagauaccuuaggaaagc

SEQ ID NO: 1135006 - RNA, 19 nt, Homo sapiens
ggagauggugaucaaugua

SEQ ID NO: 1135007 - RNA, 19 nt, Homo sapiens
ccaacucuaccuuucauuu

SEQ ID NO: 1135008 - RNA, 19 nt, Homo sapiens
caagccaaauaccugguuu

SEQ ID NO: 1135009 - RNA, 19 nt, Homo sapiens
uaucugcuaucaagccaaa

SEQ ID NO: 1135010 - RNA, 19 nt, Homo sapiens
ggugaucaauguacgagau

SEQ ID NO: 1135011 - RNA, 19 nt, Homo sapiens
gaggccaauugcaugagua

SEQ ID NO: 1135012 - RNA, 19 nt, Homo sapiens
ugaauaaggaccagaaauc

SEQ ID NO: 1135013 - RNA, 19 nt, Homo sapiens
guugaaaacugaacuauag

SEQ ID NO: 1135014 - RNA, 19 nt, Homo sapiens
ccaagagcuguuacaauuu

SEQ ID NO: 1135015 - RNA, 19 nt, Homo sapiens
aggcguagcugcaaguuuc

SEQ ID NO: 1135016 - RNA, 19 nt, Homo sapiens
cauagaaagaggccaauug

SEQ ID NO: 1135017 - RNA, 19 nt, Homo sapiens
gccaugcaaugauguagga

SEQ ID NO: 1135018 - RNA, 19 nt, Homo sapiens
cugcuaccauggugucaua

SEQ ID NO: 1135019 - RNA, 19 nt, Homo sapiens
guaacgagaaggaaagguu

SEQ ID NO: 1135020 - RNA, 19 nt, Homo sapiens
agccauggguucacuauau

SEQ ID NO: 1135021 - RNA, 19 nt, Homo sapiens
ccagaaaucgugagaugug

SEQ ID NO: 1135022 - RNA, 19 nt, Homo sapiens
gaccauaguccucuuugug

SEQ ID NO: 1135023 - RNA, 19 nt, Homo sapiens
aaagccagcugcuaaggau

SEQ ID NO: 1135024 - RNA, 19 nt, Homo sapiens
ucagaucacuaagaacaga

SEQ ID NO: 1135025 - RNA, 19 nt, Homo sapiens
gaagcuagggacccacuau

SEQ ID NO: 1135026 - RNA, 19 nt, Homo sapiens
cuaccauggugucauagaa

SEQ ID NO: 1135027 - RNA, 19 nt, Homo sapiens
cuguguggcucacuuguuu

SEQ ID NO: 1135028 - RNA, 19 nt, Homo sapiens
ugauguaggaguucucuuu

SEQ ID NO: 1135029 - RNA, 19 nt, Homo sapiens
gcaaugauguaggaguucu

SEQ ID NO: 1135030 - RNA, 19 nt, Homo sapiens
guacaacucauugcuggaa

SEQ ID NO: 1135031 - RNA, 19 nt, Homo sapiens
gguguugagcacuuuauuu

SEQ ID NO: 1135032 - RNA, 19 nt, Homo sapiens
uaucagaucacuaagaaca

SEQ ID NO: 1135033 - RNA, 19 nt, Homo sapiens
ggagaauuacgaaccaugu

SEQ ID NO: 1135034 - RNA, 19 nt, Homo sapiens
gaucaauguacgagauuau

SEQ ID NO: 1135035 - RNA, 19 nt, Homo sapiens
ugaucaauguacgagauua

SEQ ID NO: 1135036 - RNA, 19 nt, Homo sapiens
acauggagauggugaucaa

SEQ ID NO: 1135037 - RNA, 19 nt, Homo sapiens
ggaugaauaaggaccagaa

SEQ ID NO: 1135038 - RNA, 19 nt, Homo sapiens
ccaaaauguugaaaacuga

SEQ ID NO: 1135039 - RNA, 19 nt, Homo sapiens
ggagucagguucaaaaugg

SEQ ID NO: 1135040 - RNA, 19 nt, Homo sapiens
gaucucugucacuuuauuu

SEQ ID NO: 1135041 - RNA, 19 nt, Homo sapiens
gaugauguagcucaagaga

SEQ ID NO: 1135042 - RNA, 19 nt, Homo sapiens
gcagcacaguggccaugga

SEQ ID NO: 1135043 - RNA, 19 nt, Homo sapiens
agaaagaggccaauugcau

SEQ ID NO: 1135044 - RNA, 19 nt, Homo sapiens
cucaggagguuucuauaau

SEQ ID NO: 1135045 - RNA, 19 nt, Homo sapiens
acucauugcuggaauugug

SEQ ID NO: 1135046 - RNA, 19 nt, Homo sapiens
cucaagagauugcugaaag

SEQ ID NO: 1135047 - RNA, 19 nt, Homo sapiens
gaagccauggguucacuau

SEQ ID NO: 1135048 - RNA, 19 nt, Homo sapiens
acaacucauugcuggaauu

SEQ ID NO: 1135049 - RNA, 19 nt, Homo sapiens
gaauaaggaccagaaaucg

SEQ ID NO: 1135050 - RNA, 19 nt, Homo sapiens
gagaaggaaagguuaugau

SEQ ID NO: 1135051 - RNA, 19 nt, Homo sapiens
gagaauuacgaaccauguu

SEQ ID NO: 1135052 - RNA, 19 nt, Homo sapiens
aaagaggccaauugcauga

SEQ ID NO: 1135053 - RNA, 19 nt, Homo sapiens
ugaucucugucacuuuauu

SEQ ID NO: 1135054 - RNA, 19 nt, Homo sapiens
gaugaauaaggaccagaaa

SEQ ID NO: 1135055 - RNA, 19 nt, Homo sapiens
accauaagcuuggcaccua

SEQ ID NO: 1135056 - RNA, 19 nt, Homo sapiens
gccauggguucacuauauc

SEQ ID NO: 1135057 - RNA, 19 nt, Homo sapiens
guaaaaccauaaacugugu

SEQ ID NO: 1135058 - RNA, 19 nt, Homo sapiens
gcccuuugucccauuauuu

SEQ ID NO: 1135059 - RNA, 19 nt, Homo sapiens
gaaaucgugagauguggau

SEQ ID NO: 1135060 - RNA, 19 nt, Homo sapiens
ccauaagcuuggcaccuau

SEQ ID NO: 1135061 - RNA, 19 nt, Homo sapiens
gugaugaguggcuagaauu

SEQ ID NO: 1135062 - RNA, 19 nt, Homo sapiens
gaaggagucagguucaaaa

SEQ ID NO: 1135063 - RNA, 19 nt, Homo sapiens
gauccucucauucuucugu

SEQ ID NO: 1135064 - RNA, 19 nt, Homo sapiens
agacaucagaguaccauga

SEQ ID NO: 1135065 - RNA, 19 nt, Homo sapiens
uggagauggugaucaaugu

SEQ ID NO: 1135066 - RNA, 19 nt, Homo sapiens
gauggcagagguagucaga

SEQ ID NO: 1135067 - RNA, 19 nt, Homo sapiens
gaggaugauggcagaggua

SEQ ID NO: 1135068 - RNA, 19 nt, Homo sapiens
caacagaacuuagcauaaa

SEQ ID NO: 1135069 - RNA, 19 nt, Homo sapiens
gaugaaagcuguucuaaag

SEQ ID NO: 1135070 - RNA, 19 nt, Homo sapiens
gcugguggcucuacaguua

SEQ ID NO: 1135071 - RNA, 19 nt, Homo sapiens
caauggaucugauuauuuc

SEQ ID NO: 1135072 - RNA, 19 nt, Homo sapiens
cauaaaugcugaaguguau

SEQ ID NO: 1135073 - RNA, 19 nt, Homo sapiens
gcaauggaucugauuauuu

SEQ ID NO: 1135074 - RNA, 19 nt, Homo sapiens
gaucugguauuaggaaauu

SEQ ID NO: 1135075 - RNA, 19 nt, Homo sapiens
ucaaagccguucugugaaa

SEQ ID NO: 1135076 - RNA, 19 nt, Homo sapiens
cauuaggucuuguugagua

SEQ ID NO: 1135077 - RNA, 19 nt, Homo sapiens
aaucaaagccguucuguga

SEQ ID NO: 1135078 - RNA, 19 nt, Homo sapiens
agaaggaaauucaacagaa

SEQ ID NO: 1135079 - RNA, 19 nt, Homo sapiens
gcacuuuucugaucuaauu

SEQ ID NO: 1135080 - RNA, 19 nt, Homo sapiens
gaaggaaauucaacagaac

SEQ ID NO: 1135081 - RNA, 19 nt, Homo sapiens
cugaauaugucuaagauug

SEQ ID NO: 1135082 - RNA, 19 nt, Homo sapiens
gaucugcagcuucguagua

SEQ ID NO: 1135083 - RNA, 19 nt, Homo sapiens
ggaaauucaacagaacuua

SEQ ID NO: 1135084 - RNA, 19 nt, Homo sapiens
ucaaaccacuuagcgauga

SEQ ID NO: 1135085 - RNA, 19 nt, Homo sapiens
aauagaugauuccgaguuu

SEQ ID NO: 1135086 - RNA, 19 nt, Homo sapiens
gugcauuccugaaauagau

SEQ ID NO: 1135087 - RNA, 19 nt, Homo sapiens
cagauacucaaaccacuua

SEQ ID NO: 1135088 - RNA, 19 nt, Homo sapiens
ccagaugcauuaggucuug

SEQ ID NO: 1135089 - RNA, 19 nt, Homo sapiens
gaaauucaacagaacuuag

SEQ ID NO: 1135090 - RNA, 19 nt, Homo sapiens
gaaagcugguggcucuaca

SEQ ID NO: 1135091 - RNA, 19 nt, Homo sapiens
gaauaugucuaagauuggu

SEQ ID NO: 1135092 - RNA, 19 nt, Homo sapiens
ccaaaacacuuacuaccaa

SEQ ID NO: 1135093 - RNA, 19 nt, Homo sapiens
uaacugggaagaaauggaa

SEQ ID NO: 1135094 - RNA, 19 nt, Homo sapiens
cugauuauuucuacacuga

SEQ ID NO: 1135095 - RNA, 19 nt, Homo sapiens
caucauaugcaccaaaugu

SEQ ID NO: 1135096 - RNA, 19 nt, Homo sapiens
ccggugcauuccugaaaua

SEQ ID NO: 1135097 - RNA, 19 nt, Homo sapiens
ugucuaagauugguuacuu

SEQ ID NO: 1135098 - RNA, 19 nt, Homo sapiens
ucauaugcaccaaauguaa

SEQ ID NO: 1135099 - RNA, 19 nt, Homo sapiens
ucaacagaacuuagcauaa

SEQ ID NO: 1135100 - RNA, 19 nt, Homo sapiens
uguaugaucugguauuagg

SEQ ID NO: 1135101 - RNA, 19 nt, Homo sapiens
gaccacagaaggaaauuca

SEQ ID NO: 1135102 - RNA, 19 nt, Homo sapiens
ccagagucauuguucuuuc

SEQ ID NO: 1135103 - RNA, 19 nt, Homo sapiens
cuuaaugaguggcuucaga

SEQ ID NO: 1135104 - RNA, 19 nt, Homo sapiens
gggaggagguaucacaaaa

SEQ ID NO: 1135105 - RNA, 19 nt, Homo sapiens
ucuuggagauuacucuuug

SEQ ID NO: 1135106 - RNA, 19 nt, Homo sapiens
agcaguaucuguuggaaau

SEQ ID NO: 1135107 - RNA, 19 nt, Homo sapiens
ugcaauggaucugauuauu

SEQ ID NO: 1135108 - RNA, 19 nt, Homo sapiens
cauaugcaccaaauguaaa

SEQ ID NO: 1135109 - RNA, 19 nt, Homo sapiens
ggucuuguugaguaucuua

SEQ ID NO: 1135110 - RNA, 19 nt, Homo sapiens
uaaugaguggcuucagaua

SEQ ID NO: 1135111 - RNA, 19 nt, Homo sapiens
aaauaaagagccuuaacug

SEQ ID NO: 1135112 - RNA, 19 nt, Homo sapiens
cuacaguuaagauccauuu

SEQ ID NO: 1135113 - RNA, 19 nt, Homo sapiens
cuacacugaauaugucuaa

SEQ ID NO: 1135114 - RNA, 19 nt, Homo sapiens
gcucuacaguuaagaucca

SEQ ID NO: 1135115 - RNA, 19 nt, Homo sapiens
uaaaugcugaaguguauuc

SEQ ID NO: 1135116 - RNA, 19 nt, Homo sapiens
cagaaggaaauucaacaga

SEQ ID NO: 1135117 - RNA, 19 nt, Homo sapiens
uuacuucuauaccgauugu

SEQ ID NO: 1135118 - RNA, 19 nt, Homo sapiens
cacugaauaugucuaagau

SEQ ID NO: 1135119 - RNA, 19 nt, Homo sapiens
aaauagaugauuccgaguu

SEQ ID NO: 1135120 - RNA, 19 nt, Homo sapiens
agccuuaacugggaagaaa

SEQ ID NO: 1135121 - RNA, 19 nt, Homo sapiens
acacugaauaugucuaaga

SEQ ID NO: 1135122 - RNA, 19 nt, Homo sapiens
ugaugaaagcuguucuaaa

SEQ ID NO: 1135123 - RNA, 19 nt, Homo sapiens
caguaucuguuggaaaugu

SEQ ID NO: 1135124 - RNA, 19 nt, Homo sapiens
cggcuucacccuccuaaug

SEQ ID NO: 1135125 - RNA, 19 nt, Homo sapiens
gaaauccaaauggcaguuc

SEQ ID NO: 1135126 - RNA, 19 nt, Homo sapiens
cuauaccgauugucuugug

SEQ ID NO: 1135127 - RNA, 19 nt, Homo sapiens
caguucugcugaaauuugu

SEQ ID NO: 1135128 - RNA, 19 nt, Homo sapiens
gccggugcauuccugaaau

SEQ ID NO: 1135129 - RNA, 19 nt, Homo sapiens
gccagagucauuguucuuu

SEQ ID NO: 1135130 - RNA, 19 nt, Homo sapiens
gguuacuucuauaccgauu

SEQ ID NO: 1135131 - RNA, 19 nt, Homo sapiens
auucauugccuucaagaaa

SEQ ID NO: 1135132 - RNA, 19 nt, Homo sapiens
ugcauuaggucuuguugag

SEQ ID NO: 1135133 - RNA, 19 nt, Homo sapiens
guucugcugaaauuuguuu

SEQ ID NO: 1135134 - RNA, 19 nt, Homo sapiens
uuucuacacugaauauguc

SEQ ID NO: 1135135 - RNA, 19 nt, Homo sapiens
ccagcaguaucuguuggaa

SEQ ID NO: 1135136 - RNA, 19 nt, Homo sapiens
cuuguugaguaucuuaaug

SEQ ID NO: 1135137 - RNA, 19 nt, Homo sapiens
ccuaaugccagcaguaucu

SEQ ID NO: 1135138 - RNA, 19 nt, Homo sapiens
uaugaugaaagcuguucua

SEQ ID NO: 1135139 - RNA, 19 nt, Homo sapiens
acuuacaccuuccaugcaa

SEQ ID NO: 1135140 - RNA, 19 nt, Homo sapiens
ccacagaaggaaauucaac

SEQ ID NO: 1135141 - RNA, 19 nt, Homo sapiens
uaugaucugguauuaggaa

SEQ ID NO: 1135142 - RNA, 19 nt, Homo sapiens
acagaacuuagcauaaaug

SEQ ID NO: 1135143 - RNA, 19 nt, Homo sapiens
ucagauacucaaaccacuu

SEQ ID NO: 1135144 - RNA, 19 nt, Homo sapiens
cccuuccgguaccuacuua

SEQ ID NO: 1135145 - RNA, 19 nt, Homo sapiens
caaagccguucugugaaaa

SEQ ID NO: 1135146 - RNA, 19 nt, Homo sapiens
uggaaauguuggccagcuu

SEQ ID NO: 1135147 - RNA, 19 nt, Homo sapiens
gcaggaagauggacaauua

SEQ ID NO: 1135148 - RNA, 19 nt, Homo sapiens
gaagauggcuuuaauuucc

SEQ ID NO: 1135149 - RNA, 19 nt, Homo sapiens
cagcuaaacugguugaaug

SEQ ID NO: 1135150 - RNA, 19 nt, Homo sapiens
gggaaaccaugaauucuau

SEQ ID NO: 1135151 - RNA, 19 nt, Homo sapiens
gaagauggacaauuaagga

SEQ ID NO: 1135152 - RNA, 19 nt, Homo sapiens
gaauaguccucaaggugaa

SEQ ID NO: 1135153 - RNA, 19 nt, Homo sapiens
gcauaugacuugagugucu

SEQ ID NO: 1135154 - RNA, 19 nt, Homo sapiens
acacuaaguuucuagaaga

SEQ ID NO: 1135155 - RNA, 19 nt, Homo sapiens
gaaagcagcaugcccuguu

SEQ ID NO: 1135156 - RNA, 19 nt, Homo sapiens
gacauagucuucuucacuu

SEQ ID NO: 1135157 - RNA, 19 nt, Homo sapiens
gaaaaugagcuuuguguuu

SEQ ID NO: 1135158 - RNA, 19 nt, Homo sapiens
ccaaauacggaacugaaua

SEQ ID NO: 1135159 - RNA, 19 nt, Homo sapiens
ggacgccucugacaaugug

SEQ ID NO: 1135160 - RNA, 19 nt, Homo sapiens
uaacuucaguagagaguau

SEQ ID NO: 1135161 - RNA, 19 nt, Homo sapiens
aagaacagcuaaacugguu

SEQ ID NO: 1135162 - RNA, 19 nt, Homo sapiens
caaccuagaaggaguuauu

SEQ ID NO: 1135163 - RNA, 19 nt, Homo sapiens
ucuagaagaucagauugua

SEQ ID NO: 1135164 - RNA, 19 nt, Homo sapiens
gcagucauuuggucucaug

SEQ ID NO: 1135165 - RNA, 19 nt, Homo sapiens
guuuggagguuauggauga

SEQ ID NO: 1135166 - RNA, 19 nt, Homo sapiens
gaacagcuaaacugguuga

SEQ ID NO: 1135167 - RNA, 19 nt, Homo sapiens
gauggacaauuaaggacuu

SEQ ID NO: 1135168 - RNA, 19 nt, Homo sapiens
agaaggaguuauugaaaca

SEQ ID NO: 1135169 - RNA, 19 nt, Homo sapiens
aagaucagauuguacauca

SEQ ID NO: 1135170 - RNA, 19 nt, Homo sapiens
cuuagaagauggcuuuaau

SEQ ID NO: 1135171 - RNA, 19 nt, Homo sapiens
gaaagggagaggcagaguu

SEQ ID NO: 1135172 - RNA, 19 nt, Homo sapiens
gugcuaacauucucugaca

SEQ ID NO: 1135173 - RNA, 19 nt, Homo sapiens
agacuuagaagauggcuuu

SEQ ID NO: 1135174 - RNA, 19 nt, Homo sapiens
aaaaugagcuuuguguuug

SEQ ID NO: 1135175 - RNA, 19 nt, Homo sapiens
uaaacugguugaaugaagu

SEQ ID NO: 1135176 - RNA, 19 nt, Homo sapiens
uggcacaguucaugucuau

SEQ ID NO: 1135177 - RNA, 19 nt, Homo sapiens
gaacugaauaguccucaag

SEQ ID NO: 1135178 - RNA, 19 nt, Homo sapiens
acauagucuucuucacuua

SEQ ID NO: 1135179 - RNA, 19 nt, Homo sapiens
ucaauuugcagacuuagaa

SEQ ID NO: 1135180 - RNA, 19 nt, Homo sapiens
caaauacggaacugaauag

SEQ ID NO: 1135181 - RNA, 19 nt, Homo sapiens
ugagggagcacaauccaaa

SEQ ID NO: 1135182 - RNA, 19 nt, Homo sapiens
gaagacuggaauaaugaaa

SEQ ID NO: 1135183 - RNA, 19 nt, Homo sapiens
cggcgauacuacagacaua

SEQ ID NO: 1135184 - RNA, 19 nt, Homo sapiens
aggcagaguuccagauaga

SEQ ID NO: 1135185 - RNA, 19 nt, Homo sapiens
cuagaaggaguuauugaaa

SEQ ID NO: 1135186 - RNA, 19 nt, Homo sapiens
guagagaguauuuaacaca

SEQ ID NO: 1135187 - RNA, 19 nt, Homo sapiens
ggagauaucaucgauggau

SEQ ID NO: 1135188 - RNA, 19 nt, Homo sapiens
ccuuugagcugagaaucua

SEQ ID NO: 1135189 - RNA, 19 nt, Homo sapiens
gaucagauuguacaucauc

SEQ ID NO: 1135190 - RNA, 19 nt, Homo sapiens
cuaaguuucuagaagauca

SEQ ID NO: 1135191 - RNA, 19 nt, Homo sapiens
ggaaaccaugaauucuaua

SEQ ID NO: 1135192 - RNA, 19 nt, Homo sapiens
aaaguuccaguucaucaua

SEQ ID NO: 1135193 - RNA, 19 nt, Homo sapiens
uaacauucucugacacaaa

SEQ ID NO: 1135194 - RNA, 19 nt, Homo sapiens
ggaacugaauaguccucaa

SEQ ID NO: 1135195 - RNA, 19 nt, Homo sapiens
gcuuaaaguuccaguucau

SEQ ID NO: 1135196 - RNA, 19 nt, Homo sapiens
gcagaguuccagauagaau

SEQ ID NO: 1135197 - RNA, 19 nt, Homo sapiens
uagaaggaguuauugaaac

SEQ ID NO: 1135198 - RNA, 19 nt, Homo sapiens
cauuuggucucaugagugu

SEQ ID NO: 1135199 - RNA, 19 nt, Homo sapiens
ccaguuuaauggaggauuc

SEQ ID NO: 1135200 - RNA, 19 nt, Homo sapiens
gagcaguguaugaagauau

SEQ ID NO: 1135201 - RNA, 19 nt, Homo sapiens
agaguuccagauagaauua

SEQ ID NO: 1135202 - RNA, 19 nt, Homo sapiens
gaggcagaguuccagauag

SEQ ID NO: 1135203 - RNA, 19 nt, Homo sapiens
gccaagaacagcuaaacug

SEQ ID NO: 1135204 - RNA, 19 nt, Homo sapiens
uguucaauuugcagacuua

SEQ ID NO: 1135205 - RNA, 19 nt, Homo sapiens
gcuuggagauaucaucgau

SEQ ID NO: 1135206 - RNA, 19 nt, Homo sapiens
aaagcagcaugcccuguug

SEQ ID NO: 1135207 - RNA, 19 nt, Homo sapiens
aauccucugucucaucaaa

SEQ ID NO: 1135208 - RNA, 19 nt, Homo sapiens
auugccaucuucccauuua

SEQ ID NO: 1135209 - RNA, 19 nt, Homo sapiens
cuaaacugguugaaugaag

SEQ ID NO: 1135210 - RNA, 19 nt, Homo sapiens
gaagaucagauuguacauc

SEQ ID NO: 1135211 - RNA, 19 nt, Homo sapiens
cccuagaacuuguuaugga

SEQ ID NO: 1135212 - RNA, 19 nt, Homo sapiens
ccuagaaggaguuauugaa

SEQ ID NO: 1135213 - RNA, 19 nt, Homo sapiens
ccacgucaaccuagaagga

SEQ ID NO: 1135214 - RNA, 19 nt, Homo sapiens
ucgcagauguucaauuugc

SEQ ID NO: 1135215 - RNA, 19 nt, Homo sapiens
caguagagaguauuuaaca

SEQ ID NO: 1135216 - RNA, 19 nt, Homo sapiens
guucaagaggcuuaaaguu

SEQ ID NO: 1135217 - RNA, 19 nt, Homo sapiens
gauaaacccaauccugaag

SEQ ID NO: 1135218 - RNA, 19 nt, Homo sapiens
gaauuacaagaaaggaaga

SEQ ID NO: 1135219 - RNA, 19 nt, Homo sapiens
agaggcagaguuccagaua

SEQ ID NO: 1135220 - RNA, 19 nt, Homo sapiens
ugauugccaucuucccauu

SEQ ID NO: 1135221 - RNA, 19 nt, Homo sapiens
cgagcaguguaugaagaua

SEQ ID NO: 1135222 - RNA, 19 nt, Homo sapiens
ggaucagucuucuccaaaa

SEQ ID NO: 1135223 - RNA, 19 nt, Homo sapiens
uagaagaucagauuguaca

SEQ ID NO: 1135224 - RNA, 19 nt, Homo sapiens
gccuggaacuacagagaug

SEQ ID NO: 1135225 - RNA, 19 nt, Homo sapiens
gguggugauugccaucuuc

SEQ ID NO: 1135226 - RNA, 19 nt, Homo sapiens
acaauuaaggacuuucuga

SEQ ID NO: 1135227 - RNA, 19 nt, Homo sapiens
ggaagauggacaauuaagg

SEQ ID NO: 1135228 - RNA, 19 nt, Homo sapiens
uacgagcaguguaugaaga

SEQ ID NO: 1135229 - RNA, 19 nt, Homo sapiens
gacauguucaagaggcuua

SEQ ID NO: 1135230 - RNA, 19 nt, Homo sapiens
acaguauaaugcauccaaa

SEQ ID NO: 1135231 - RNA, 19 nt, Homo sapiens
gauagaaaaugagcuuugu

SEQ ID NO: 1135232 - RNA, 19 nt, Homo sapiens
aaagggagaggcagaguuc

SEQ ID NO: 1135233 - RNA, 19 nt, Homo sapiens
cccaguuuguccaguuuaa

SEQ ID NO: 1135234 - RNA, 19 nt, Homo sapiens
ggacaauuaaggacuuucu

SEQ ID NO: 1135235 - RNA, 19 nt, Homo sapiens
guuauggacauguucaaga

SEQ ID NO: 1135236 - RNA, 19 nt, Homo sapiens
gcacaguucaugucuaucc

SEQ ID NO: 1135237 - RNA, 19 nt, Homo sapiens
ugauaaacccaauccugaa

SEQ ID NO: 1135238 - RNA, 19 nt, Homo sapiens
gaacuuguuauggacaugu

SEQ ID NO: 1135239 - RNA, 19 nt, Homo sapiens
uggauauaaugcacaguau

SEQ ID NO: 1135240 - RNA, 19 nt, Homo sapiens
augagugugugguguguuu

SEQ ID NO: 1135241 - RNA, 19 nt, Homo sapiens
ggcuuaaaguuccaguuca

SEQ ID NO: 1135242 - RNA, 19 nt, Homo sapiens
aaaugagcuuuguguuugu

SEQ ID NO: 1135243 - RNA, 19 nt, Homo sapiens
cagaguuccagauagaauu

SEQ ID NO: 1135244 - RNA, 19 nt, Homo sapiens
agaagauggcuuuaauuuc

SEQ ID NO: 1135245 - RNA, 19 nt, Homo sapiens
caggaagauggacaauuaa

SEQ ID NO: 1135246 - RNA, 19 nt, Homo sapiens
agcaguguaugaagauauu

SEQ ID NO: 1135247 - RNA, 19 nt, Homo sapiens
gaacagauuccacuuguga

SEQ ID NO: 1135248 - RNA, 19 nt, Homo sapiens
caggaaaacuuacacauua

SEQ ID NO: 1135249 - RNA, 19 nt, Homo sapiens
caaaugcucuggagauaag

SEQ ID NO: 1135250 - RNA, 19 nt, Homo sapiens
ccagauacuuuccuuucua

SEQ ID NO: 1135251 - RNA, 19 nt, Homo sapiens
gauaaagaaugccaaaugc

SEQ ID NO: 1135252 - RNA, 19 nt, Homo sapiens
acaagccacuuaugucuuu

SEQ ID NO: 1135253 - RNA, 19 nt, Homo sapiens
gccaaaugcucuggagaua

SEQ ID NO: 1135254 - RNA, 19 nt, Homo sapiens
gcaccuaugauauguguuu

SEQ ID NO: 1135255 - RNA, 19 nt, Homo sapiens
caaaagaacuggaagaaca

SEQ ID NO: 1135256 - RNA, 19 nt, Homo sapiens
agacuaccauacugauaua

SEQ ID NO: 1135257 - RNA, 19 nt, Homo sapiens
ugaagaaugucucucaauc

SEQ ID NO: 1135258 - RNA, 19 nt, Homo sapiens
guacugcuauacaugcaaa

SEQ ID NO: 1135259 - RNA, 19 nt, Homo sapiens
gaaugaagaaugucucuca

SEQ ID NO: 1135260 - RNA, 19 nt, Homo sapiens
caauugaagccauuuacua

SEQ ID NO: 1135261 - RNA, 19 nt, Homo sapiens
cauguuauguuccaguuga

SEQ ID NO: 1135262 - RNA, 19 nt, Homo sapiens
gcagugcaccuaugauaug

SEQ ID NO: 1135263 - RNA, 19 nt, Homo sapiens
cuuagcaccugaauuugua

SEQ ID NO: 1135264 - RNA, 19 nt, Homo sapiens
caaacuacuuccauagcuu

SEQ ID NO: 1135265 - RNA, 19 nt, Homo sapiens
gaaauacagagggcaauau

SEQ ID NO: 1135266 - RNA, 19 nt, Homo sapiens
ugaagccauuuacuacuuu

SEQ ID NO: 1135267 - RNA, 19 nt, Homo sapiens
acucuuagcaccugaauuu

SEQ ID NO: 1135268 - RNA, 19 nt, Homo sapiens
caagaguucuggugauuuu

SEQ ID NO: 1135269 - RNA, 19 nt, Homo sapiens
gcaccugaauuuguaaaca

SEQ ID NO: 1135270 - RNA, 19 nt, Homo sapiens
gucacaaacuacuuccaua

SEQ ID NO: 1135271 - RNA, 19 nt, Homo sapiens
gagauaaggaaacaggaaa

SEQ ID NO: 1135272 - RNA, 19 nt, Homo sapiens
ggagauaaggaaacaggaa

SEQ ID NO: 1135273 - RNA, 19 nt, Homo sapiens
ggaccucagucuaucucaa

SEQ ID NO: 1135274 - RNA, 19 nt, Homo sapiens
ggagacguguggagcuguu

SEQ ID NO: 1135275 - RNA, 19 nt, Homo sapiens
uuuagcaucucaagaaguu

SEQ ID NO: 1135276 - RNA, 19 nt, Homo sapiens
ugauaaagaaugccaaaug

SEQ ID NO: 1135277 - RNA, 19 nt, Homo sapiens
caaacgaagugaagaaaau

SEQ ID NO: 1135278 - RNA, 19 nt, Homo sapiens
ccaccuauauuucucaaac

SEQ ID NO: 1135279 - RNA, 19 nt, Homo sapiens
guuacaaguugaguugaaa

SEQ ID NO: 1135280 - RNA, 19 nt, Homo sapiens
uaacaagccacuuaugucu

SEQ ID NO: 1135281 - RNA, 19 nt, Homo sapiens
gaagccauuuacuacuuuc

SEQ ID NO: 1135282 - RNA, 19 nt, Homo sapiens
gugcaccuaugauaugugu

SEQ ID NO: 1135283 - RNA, 19 nt, Homo sapiens
gauacuuuccuuucuacaa

SEQ ID NO: 1135284 - RNA, 19 nt, Homo sapiens
cuacugcuauacauguuau

SEQ ID NO: 1135285 - RNA, 19 nt, Homo sapiens
acaaaacagucacaaacua

SEQ ID NO: 1135286 - RNA, 19 nt, Homo sapiens
ccaaaugcucuggagauaa

SEQ ID NO: 1135287 - RNA, 19 nt, Homo sapiens
aacaagaguucuggugauu

SEQ ID NO: 1135288 - RNA, 19 nt, Homo sapiens
caaaaguacugcuauacau

SEQ ID NO: 1135289 - RNA, 19 nt, Homo sapiens
cuacuuccauagcuucaga

SEQ ID NO: 1135290 - RNA, 19 nt, Homo sapiens
ugaaacagauggcaaaagu

SEQ ID NO: 1135291 - RNA, 19 nt, Homo sapiens
cauugaagauugacaucau

SEQ ID NO: 1135292 - RNA, 19 nt, Homo sapiens
uugugaagcuuccauugaa

SEQ ID NO: 1135293 - RNA, 19 nt, Homo sapiens
ucucaauccaccuauauuu

SEQ ID NO: 1135294 - RNA, 19 nt, Homo sapiens
uguaccaguugauaaagaa

SEQ ID NO: 1135295 - RNA, 19 nt, Homo sapiens
aagaaugucucucaaucca

SEQ ID NO: 1135296 - RNA, 19 nt, Homo sapiens
uugaagccauuuacuacuu

SEQ ID NO: 1135297 - RNA, 19 nt, Homo sapiens
aaaugaaacagauggcaaa

SEQ ID NO: 1135298 - RNA, 19 nt, Homo sapiens
aaauguaccuauugaacag

SEQ ID NO: 1135299 - RNA, 19 nt, Homo sapiens
gaaacaaaacagucacaaa

SEQ ID NO: 1135300 - RNA, 19 nt, Homo sapiens
cuacaauugaagccauuua

SEQ ID NO: 1135301 - RNA, 19 nt, Homo sapiens
caaguugaguugaaaacaa

SEQ ID NO: 1135302 - RNA, 19 nt, Homo sapiens
gaacuggaagaacaagagu

SEQ ID NO: 1135303 - RNA, 19 nt, Homo sapiens
gaaaaggaccaugaaguug

SEQ ID NO: 1135304 - RNA, 19 nt, Homo sapiens
gaacgaaaaggaccaugaa

SEQ ID NO: 1135305 - RNA, 19 nt, Homo sapiens
caccugaauuuguaaacau

SEQ ID NO: 1135306 - RNA, 19 nt, Homo sapiens
uagacuaccauacugauau

SEQ ID NO: 1135307 - RNA, 19 nt, Homo sapiens
agaaauacagagggcaaua

SEQ ID NO: 1135308 - RNA, 19 nt, Homo sapiens
cagauacuuuccuuucuac

SEQ ID NO: 1135309 - RNA, 19 nt, Homo sapiens
cgaaaaggaccaugaaguu

SEQ ID NO: 1135310 - RNA, 19 nt, Homo sapiens
uugaacagauuccacuugu

SEQ ID NO: 1135311 - RNA, 19 nt, Homo sapiens
ucacaaacuacuuccauag

SEQ ID NO: 1135312 - RNA, 19 nt, Homo sapiens
gccagauacuuuccuuucu

SEQ ID NO: 1135313 - RNA, 19 nt, Homo sapiens
cucagucuaucucaauaaa

SEQ ID NO: 1135314 - RNA, 19 nt, Homo sapiens
gaagaaugucucucaaucc

SEQ ID NO: 1135315 - RNA, 19 nt, Homo sapiens
gaccucagucuaucucaau

SEQ ID NO: 1135316 - RNA, 19 nt, Homo sapiens
aaaggaccaugaaguugca

SEQ ID NO: 1135317 - RNA, 19 nt, Homo sapiens
uguuacaaguugaguugaa

SEQ ID NO: 1135318 - RNA, 19 nt, Homo sapiens
gaaaauguaccuauugaac

SEQ ID NO: 1135319 - RNA, 19 nt, Homo sapiens
cagcaaagugggagaucaa

SEQ ID NO: 1135320 - RNA, 19 nt, Homo sapiens
cauuuacuacuuucuggua

SEQ ID NO: 1135321 - RNA, 19 nt, Homo sapiens
gcaccugggaaccaaacaa

SEQ ID NO: 1135322 - RNA, 19 nt, Homo sapiens
aaugaagaaugucucucaa

SEQ ID NO: 1135323 - RNA, 19 nt, Homo sapiens
aaauacagagggcaauaug

SEQ ID NO: 1135324 - RNA, 19 nt, Homo sapiens
gaucaaaaugucucaaaug

SEQ ID NO: 1135325 - RNA, 19 nt, Homo sapiens
ucaauccaccuauauuucu

SEQ ID NO: 1135326 - RNA, 19 nt, Homo sapiens
acaaacuacuuccauagcu

SEQ ID NO: 1135327 - RNA, 19 nt, Homo sapiens
gcaaaaguacugcuauaca

SEQ ID NO: 1135328 - RNA, 19 nt, Homo sapiens
gaaacagauggcaaaagua

SEQ ID NO: 1135329 - RNA, 19 nt, Homo sapiens
ugaacagauuccacuugug

SEQ ID NO: 1135330 - RNA, 19 nt, Homo sapiens
aaacagucacaaacuacuu

SEQ ID NO: 1135331 - RNA, 19 nt, Homo sapiens
guucuacugcuauacaugu

SEQ ID NO: 1135332 - RNA, 19 nt, Homo sapiens
uguggugguuccagaaugu

SEQ ID NO: 1135333 - RNA, 19 nt, Homo sapiens
ucagcaaagugggagauca

SEQ ID NO: 1135334 - RNA, 19 nt, Homo sapiens
guugauaaagaaugccaaa

SEQ ID NO: 1135335 - RNA, 19 nt, Homo sapiens
ugguuugaaugaagaaugu

SEQ ID NO: 1135336 - RNA, 19 nt, Homo sapiens
aaaggaaagccagauacuu

SEQ ID NO: 1135337 - RNA, 19 nt, Homo sapiens
ugacaagccaucuuuuaaa

SEQ ID NO: 1135338 - RNA, 19 nt, Homo sapiens
uggcaaaaguacugcuaua

SEQ ID NO: 1135339 - RNA, 19 nt, Homo sapiens
ugacaucauuaaacaucca

SEQ ID NO: 1135340 - RNA, 19 nt, Homo sapiens
ucucaaacgaagugaagaa

SEQ ID NO: 1135341 - RNA, 19 nt, Homo sapiens
caccugggaaccaaacaaa

SEQ ID NO: 1135342 - RNA, 19 nt, Homo sapiens
gacaagccaucuuuuaaac

SEQ ID NO: 1135343 - RNA, 19 nt, Homo sapiens
ccucagucuaucucaauaa

SEQ ID NO: 1135344 - RNA, 19 nt, Homo sapiens
caaagugggagaucaaaau

SEQ ID NO: 1135345 - RNA, 19 nt, Homo sapiens
caauccaccuauauuucuc

SEQ ID NO: 1135346 - RNA, 19 nt, Homo sapiens
gggcaauaugacaaucuuu

SEQ ID NO: 1135347 - RNA, 19 nt, Homo sapiens
gaagaaagcuggacauuua

SEQ ID NO: 1135348 - RNA, 19 nt, Homo sapiens
gcaaauagaugacauaaug

SEQ ID NO: 1135349 - RNA, 19 nt, Homo sapiens
gaagaaaugccucagcuua

SEQ ID NO: 1135350 - RNA, 19 nt, Homo sapiens
gguaauaggugguaacuug

SEQ ID NO: 1135351 - RNA, 19 nt, Homo sapiens
gaagaagacuggaaaugug

SEQ ID NO: 1135352 - RNA, 19 nt, Homo sapiens
gagcuuugcuuucuauuga

SEQ ID NO: 1135353 - RNA, 19 nt, Homo sapiens
gaagcgcccuuucauugua

SEQ ID NO: 1135354 - RNA, 19 nt, Homo sapiens
gaacauuucuggugagaca

SEQ ID NO: 1135355 - RNA, 19 nt, Homo sapiens
gaaggaagcagaauuugaa

SEQ ID NO: 1135356 - RNA, 19 nt, Homo sapiens
gaagaucccaaagaaauua

SEQ ID NO: 1135357 - RNA, 19 nt, Homo sapiens
caacuccgcucacccauga

SEQ ID NO: 1135358 - RNA, 19 nt, Homo sapiens
gcagagauuucuucaaaca

SEQ ID NO: 1135359 - RNA, 19 nt, Homo sapiens
guaaugaaaggcaguaaua

SEQ ID NO: 1135360 - RNA, 19 nt, Homo sapiens
gagcaguacuccagaaaug

SEQ ID NO: 1135361 - RNA, 19 nt, Homo sapiens
ccgcaaagcuggaugaaga

SEQ ID NO: 1135362 - RNA, 19 nt, Homo sapiens
agaagaagaucacaaaugu

SEQ ID NO: 1135363 - RNA, 19 nt, Homo sapiens
gaaaggcaguaauagaaau

SEQ ID NO: 1135364 - RNA, 19 nt, Homo sapiens
gccgagauaucuucaagua

SEQ ID NO: 1135365 - RNA, 19 nt, Homo sapiens
ggaagaaucaaagcuaaua

SEQ ID NO: 1135366 - RNA, 19 nt, Homo sapiens
aaagcuggaugaagaauuu

SEQ ID NO: 1135367 - RNA, 19 nt, Homo sapiens
ccaaagaaauuagaaagga

SEQ ID NO: 1135368 - RNA, 19 nt, Homo sapiens
gaaaggaagaguuagaaga

SEQ ID NO: 1135369 - RNA, 19 nt, Homo sapiens
ucaacagccucccucaaua

SEQ ID NO: 1135370 - RNA, 19 nt, Homo sapiens
gcaagaaguucaagaagac

SEQ ID NO: 1135371 - RNA, 19 nt, Homo sapiens
caaacaagccugugaaauc

SEQ ID NO: 1135372 - RNA, 19 nt, Homo sapiens
cgaggucacuaucauauga

SEQ ID NO: 1135373 - RNA, 19 nt, Homo sapiens
gaagaggaggauauugaua

SEQ ID NO: 1135374 - RNA, 19 nt, Homo sapiens
caacaacgcaagaaccuuu

SEQ ID NO: 1135375 - RNA, 19 nt, Homo sapiens
ggaagaagaggaagacgaa

SEQ ID NO: 1135376 - RNA, 19 nt, Homo sapiens
ccauggagccuguucauaa

SEQ ID NO: 1135377 - RNA, 19 nt, Homo sapiens
aaagugaaaucaagagaga

SEQ ID NO: 1135378 - RNA, 19 nt, Homo sapiens
gcaagaagguccgcacauc

SEQ ID NO: 1135379 - RNA, 19 nt, Homo sapiens
uugcagagauuucuucaaa

SEQ ID NO: 1135380 - RNA, 19 nt, Homo sapiens
ccacugaaaucacaaugga

SEQ ID NO: 1135381 - RNA, 19 nt, Homo sapiens
gacaaaugcucacacaaca

SEQ ID NO: 1135382 - RNA, 19 nt, Homo sapiens
ggaaauguguccucagaac

SEQ ID NO: 1135383 - RNA, 19 nt, Homo sapiens
gccaguagcaagauaauaa

SEQ ID NO: 1135384 - RNA, 19 nt, Homo sapiens
gaaugauccuggagcuuug

SEQ ID NO: 1135385 - RNA, 19 nt, Homo sapiens
gucaagaccuccagauuuc

SEQ ID NO: 1135386 - RNA, 19 nt, Homo sapiens
gaagaagaucacaaaugua

SEQ ID NO: 1135387 - RNA, 19 nt, Homo sapiens
ggaagaucccaaagaaauu

SEQ ID NO: 1135388 - RNA, 19 nt, Homo sapiens
acacagacauggccaagga

SEQ ID NO: 1135389 - RNA, 19 nt, Homo sapiens
aaacuccucugaucaugaa

SEQ ID NO: 1135390 - RNA, 19 nt, Homo sapiens
aauggaagaucccaaagaa

SEQ ID NO: 1135391 - RNA, 19 nt, Homo sapiens
aaacgaaagugucuucagu

SEQ ID NO: 1135392 - RNA, 19 nt, Homo sapiens
caugaaggguguuggaaug

SEQ ID NO: 1135393 - RNA, 19 nt, Homo sapiens
cgucauauauaccauugaa

SEQ ID NO: 1135394 - RNA, 19 nt, Homo sapiens
gaaagcaaagacugaagaa

SEQ ID NO: 1135395 - RNA, 19 nt, Homo sapiens
gcagaaauacacagacaug

SEQ ID NO: 1135396 - RNA, 19 nt, Homo sapiens
ccaagauacuagcugauug

SEQ ID NO: 1135397 - RNA, 19 nt, Homo sapiens
gagacagacugcaaugaca

SEQ ID NO: 1135398 - RNA, 19 nt, Homo sapiens
ggagcaagaaguucaagaa

SEQ ID NO: 1135399 - RNA, 19 nt, Homo sapiens
ggaaacuccucugaucaug

SEQ ID NO: 1135400 - RNA, 19 nt, Homo sapiens
cgagaggucuugcaaaggu

SEQ ID NO: 1135401 - RNA, 19 nt, Homo sapiens
caaaugggaggccugagua

SEQ ID NO: 1135402 - RNA, 19 nt, Homo sapiens
gcaaggaaaaccaagauua

SEQ ID NO: 1135403 - RNA, 19 nt, Homo sapiens
caacagccucccucaauau

SEQ ID NO: 1135404 - RNA, 19 nt, Homo sapiens
gaaaucaagagagaagaaa

SEQ ID NO: 1135405 - RNA, 19 nt, Homo sapiens
cagcuuaacuuuggaaugg

SEQ ID NO: 1135406 - RNA, 19 nt, Homo sapiens
gggcuguucuugauccaaa

SEQ ID NO: 1135407 - RNA, 19 nt, Homo sapiens
gcgagcuucucuccacuuu

SEQ ID NO: 1135408 - RNA, 19 nt, Homo sapiens
gaaacuccucugaucauga

SEQ ID NO: 1135409 - RNA, 19 nt, Homo sapiens
cgucagaagucaccauugu

SEQ ID NO: 1135410 - RNA, 19 nt, Homo sapiens
gaagaucacaaauguaguc

SEQ ID NO: 1135411 - RNA, 19 nt, Homo sapiens
aaaggaagaguuagaagaa

SEQ ID NO: 1135412 - RNA, 19 nt, Homo sapiens
ucagaagucaccauuguuu

SEQ ID NO: 1135413 - RNA, 19 nt, Homo sapiens
guagaaaggaucauaugug

SEQ ID NO: 1135414 - RNA, 19 nt, Homo sapiens
ugaauuacgucagaaguca

SEQ ID NO: 1135415 - RNA, 19 nt, Homo sapiens
ccgaggugcuaccaagaua

SEQ ID NO: 1135416 - RNA, 19 nt, Homo sapiens
gcugagggcuagcuacaca

SEQ ID NO: 1135417 - RNA, 19 nt, Homo sapiens
gaaggguguuggaaugaag

SEQ ID NO: 1135418 - RNA, 19 nt, Homo sapiens
gcauuaaacaagccagaaa

SEQ ID NO: 1135419 - RNA, 19 nt, Homo sapiens
guuagaagaagaucacaaa

SEQ ID NO: 1135420 - RNA, 19 nt, Homo sapiens
acagaaggaagcagaauuu

SEQ ID NO: 1135421 - RNA, 19 nt, Homo sapiens
gcaagauguuggugaaacu

SEQ ID NO: 1135422 - RNA, 19 nt, Homo sapiens
caacugagacagacugcaa

SEQ ID NO: 1135423 - RNA, 19 nt, Homo sapiens
gaucgacauggaaaugaua

SEQ ID NO: 1135424 - RNA, 19 nt, Homo sapiens
caaaauggaucgacaugga

SEQ ID NO: 1135425 - RNA, 19 nt, Homo sapiens
gaugacauaauggcuauaa

SEQ ID NO: 1135426 - RNA, 19 nt, Homo sapiens
aaacuagguuacagaagga

SEQ ID NO: 1135427 - RNA, 19 nt, Homo sapiens
ccaagaaagcaaagacuga

SEQ ID NO: 1135428 - RNA, 19 nt, Homo sapiens
caaaggaaaagcagaaaua

SEQ ID NO: 1135429 - RNA, 19 nt, Homo sapiens
ggaggauauugauaagguu

SEQ ID NO: 1135430 - RNA, 19 nt, Homo sapiens
agaaaugccugccgugucu

SEQ ID NO: 1135431 - RNA, 19 nt, Homo sapiens
guggagcaguguacaguga

SEQ ID NO: 1135432 - RNA, 19 nt, Homo sapiens
aagaggaggauauugauaa

SEQ ID NO: 1135433 - RNA, 19 nt, Homo sapiens
gagcagaaacagaaugauc

SEQ ID NO: 1135434 - RNA, 19 nt, Homo sapiens
ccagaaucuuugaggguaa

SEQ ID NO: 1135435 - RNA, 19 nt, Homo sapiens
ucaagaagacaaagccaaa

SEQ ID NO: 1135436 - RNA, 19 nt, Homo sapiens
acaaagcagugucaaacau

SEQ ID NO: 1135437 - RNA, 19 nt, Homo sapiens
agcaaagacugaagaaaug

SEQ ID NO: 1135438 - RNA, 19 nt, Homo sapiens
aagcaaagacugaagaaau

SEQ ID NO: 1135439 - RNA, 19 nt, Homo sapiens
gcaguaauagaaauaagga

SEQ ID NO: 1135440 - RNA, 19 nt, Homo sapiens
ugaaaggcaguaauagaaa

SEQ ID NO: 1135441 - RNA, 19 nt, Homo sapiens
ugaagaaagcuggacauuu

SEQ ID NO: 1135442 - RNA, 19 nt, Homo sapiens
ggaucgacauggaaaugau

SEQ ID NO: 1135443 - RNA, 19 nt, Homo sapiens
gaaauuagaaaggaagagu

SEQ ID NO: 1135444 - RNA, 19 nt, Homo sapiens
uagaugacauaauggcuau

SEQ ID NO: 1135445 - RNA, 19 nt, Homo sapiens
ucaguggcauccauugcua

SEQ ID NO: 1135446 - RNA, 19 nt, Homo sapiens
caaacaagcaacucuucuu

SEQ ID NO: 1135447 - RNA, 19 nt, Homo sapiens
gagaauuuguccagcauua

SEQ ID NO: 1135448 - RNA, 19 nt, Homo sapiens
ucacugacauuuaggaaua

SEQ ID NO: 1135449 - RNA, 19 nt, Homo sapiens
guaagaagaugucaacuca

SEQ ID NO: 1135450 - RNA, 19 nt, Homo sapiens
guccaaagcucucauugua

SEQ ID NO: 1135451 - RNA, 19 nt, Homo sapiens
aaacagagcaagaguuaua

SEQ ID NO: 1135452 - RNA, 19 nt, Homo sapiens
gcagaaaacuccacaacua

SEQ ID NO: 1135453 - RNA, 19 nt, Homo sapiens
gcacaaaugcuuucucuuc

SEQ ID NO: 1135454 - RNA, 19 nt, Homo sapiens
gugcggaucuccacgauuu

SEQ ID NO: 1135455 - RNA, 19 nt, Homo sapiens
gcaccuaagagcaauaaua

SEQ ID NO: 1135456 - RNA, 19 nt, Homo sapiens
gugaaugaaucaaugagua

SEQ ID NO: 1135457 - RNA, 19 nt, Homo sapiens
gcaaauauccacaaugaca

SEQ ID NO: 1135458 - RNA, 19 nt, Homo sapiens
uggcaaauauccacaauga

SEQ ID NO: 1135459 - RNA, 19 nt, Homo sapiens
gagcaagaguuauaaccuu

SEQ ID NO: 1135460 - RNA, 19 nt, Homo sapiens
caaaguccaugaucaguuc

SEQ ID NO: 1135461 - RNA, 19 nt, Homo sapiens
gaugucaacucaugcuuau

SEQ ID NO: 1135462 - RNA, 19 nt, Homo sapiens
uuaaugacguggcaaauau

SEQ ID NO: 1135463 - RNA, 19 nt, Homo sapiens
gcagugagccgagauggua

SEQ ID NO: 1135464 - RNA, 19 nt, Homo sapiens
ugaaacccgucucuacuaa

SEQ ID NO: 1135465 - RNA, 19 nt, Homo sapiens
cuauaaagcagcaacaaua

SEQ ID NO: 1135466 - RNA, 19 nt, Homo sapiens
gcccagaggucacauaaag

SEQ ID NO: 1135467 - RNA, 19 nt, Homo sapiens
ccaaagcucucauuguaca

SEQ ID NO: 1135468 - RNA, 19 nt, Homo sapiens
gaugagaaauaguauagca

SEQ ID NO: 1135469 - RNA, 19 nt, Homo sapiens
uaaccaaaguccaugauca

SEQ ID NO: 1135470 - RNA, 19 nt, Homo sapiens
guuauaaccuucagaugug

SEQ ID NO: 1135471 - RNA, 19 nt, Homo sapiens
ccagaagcaucuccucauu

SEQ ID NO: 1135472 - RNA, 19 nt, Homo sapiens
uuccaaaccuguuaucuuu

SEQ ID NO: 1135473 - RNA, 19 nt, Homo sapiens
gaaaagaugacucugauuu

SEQ ID NO: 1135474 - RNA, 19 nt, Homo sapiens
acaauaaugucacgaagga

SEQ ID NO: 1135475 - RNA, 19 nt, Homo sapiens
aaacccgucucuacuaauu

SEQ ID NO: 1135476 - RNA, 19 nt, Homo sapiens
guagaaaugucauguagac

SEQ ID NO: 1135477 - RNA, 19 nt, Homo sapiens
ccacacauccaaauuagaa

SEQ ID NO: 1135478 - RNA, 19 nt, Homo sapiens
agaugacucugauuuauug

SEQ ID NO: 1135479 - RNA, 19 nt, Homo sapiens
gagccgagcauacacguaa

SEQ ID NO: 1135480 - RNA, 19 nt, Homo sapiens
aaacucgacucuucuacuu

SEQ ID NO: 1135481 - RNA, 19 nt, Homo sapiens
gaacagugcucugaaucgu

SEQ ID NO: 1135482 - RNA, 19 nt, Homo sapiens
aagaagaugucaacucaug

SEQ ID NO: 1135483 - RNA, 19 nt, Homo sapiens
ugugagcuccgguaaauua

SEQ ID NO: 1135484 - RNA, 19 nt, Homo sapiens
gaguauggaaacuacauua

SEQ ID NO: 1135485 - RNA, 19 nt, Homo sapiens
ggaggagacugagguuaau

SEQ ID NO: 1135486 - RNA, 19 nt, Homo sapiens
ucacgaaggauuaagguaa

SEQ ID NO: 1135487 - RNA, 19 nt, Homo sapiens
uaaagcagcaacaauaaug

SEQ ID NO: 1135488 - RNA, 19 nt, Homo sapiens
caaaacagagcaagaguua

SEQ ID NO: 1135489 - RNA, 19 nt, Homo sapiens
gguccagucugcagaucua

SEQ ID NO: 1135490 - RNA, 19 nt, Homo sapiens
aaagaaggaugaacacucu

SEQ ID NO: 1135491 - RNA, 19 nt, Homo sapiens
ucacagaggaggagacuga

SEQ ID NO: 1135492 - RNA, 19 nt, Homo sapiens
gaacugugaaugaaucaau

SEQ ID NO: 1135493 - RNA, 19 nt, Homo sapiens
ggguagaaaugucauguag

SEQ ID NO: 1135494 - RNA, 19 nt, Homo sapiens
gcgcacagccuugaacaaa

SEQ ID NO: 1135495 - RNA, 19 nt, Homo sapiens
ccgcagagguguugaugug

SEQ ID NO: 1135496 - RNA, 19 nt, Homo sapiens
ucucaucacagcaucauua

SEQ ID NO: 1135497 - RNA, 19 nt, Homo sapiens
ccacagcccuagaaagaag

SEQ ID NO: 1135498 - RNA, 19 nt, Homo sapiens
ggauuaagguaaagaugag

SEQ ID NO: 1135499 - RNA, 19 nt, Homo sapiens
cacgaaggauuaagguaaa

SEQ ID NO: 1135500 - RNA, 19 nt, Homo sapiens
caaaugcuuucucuucaag

SEQ ID NO: 1135501 - RNA, 19 nt, Homo sapiens
gcacgagaauugccugaac

SEQ ID NO: 1135502 - RNA, 19 nt, Homo sapiens
gcaacaauaaugucacgaa

SEQ ID NO: 1135503 - RNA, 19 nt, Homo sapiens
cuaauuagcgcaugaauac

SEQ ID NO: 1135504 - RNA, 19 nt, Homo sapiens
gagccuaauuagcgcauga

SEQ ID NO: 1135505 - RNA, 19 nt, Homo sapiens
cacaaaugcuuucucuuca

SEQ ID NO: 1135506 - RNA, 19 nt, Homo sapiens
caacucaugcuuauaguca

SEQ ID NO: 1135507 - RNA, 19 nt, Homo sapiens
caagagcaccuaagagcaa

SEQ ID NO: 1135508 - RNA, 19 nt, Homo sapiens
caucacagcaucauuagga

SEQ ID NO: 1135509 - RNA, 19 nt, Homo sapiens
gaacaccagcugcaguaga

SEQ ID NO: 1135510 - RNA, 19 nt, Homo sapiens
guuaaugacguggcaaaua

SEQ ID NO: 1135511 - RNA, 19 nt, Homo sapiens
ggagcuggauccugacauc

SEQ ID NO: 1135512 - RNA, 19 nt, Homo sapiens
cacagcaucauuaggauua

SEQ ID NO: 1135513 - RNA, 19 nt, Homo sapiens
gcuacucuccggaugauuu

SEQ ID NO: 1135514 - RNA, 19 nt, Homo sapiens
gaagggaaacacgaacaaa

SEQ ID NO: 1135515 - RNA, 19 nt, Homo sapiens
gaagaccaccuaguccaaa

SEQ ID NO: 1135516 - RNA, 19 nt, Homo sapiens
ccuaagagcaauaauacaa

SEQ ID NO: 1135517 - RNA, 19 nt, Homo sapiens
gguagaagaggaagggaaa

SEQ ID NO: 1135518 - RNA, 19 nt, Homo sapiens
gaggucacauaaagcuuug

SEQ ID NO: 1135519 - RNA, 19 nt, Homo sapiens
cugcaagucuuuccuagug

SEQ ID NO: 1135520 - RNA, 19 nt, Homo sapiens
cgugugagcuccgguaaau

SEQ ID NO: 1135521 - RNA, 19 nt, Homo sapiens
acccgucucuacuaauuua

SEQ ID NO: 1135522 - RNA, 19 nt, Homo sapiens
ggagcaacaucucucuucu

SEQ ID NO: 1135523 - RNA, 19 nt, Homo sapiens
acaaaugcuuucucuucaa

SEQ ID NO: 1135524 - RNA, 19 nt, Homo sapiens
gugaaacccgucucuacua

SEQ ID NO: 1135525 - RNA, 19 nt, Homo sapiens
gaggcuggcacgcaccuua

SEQ ID NO: 1135526 - RNA, 19 nt, Homo sapiens
gaaucaaugaguauggaaa

SEQ ID NO: 1135527 - RNA, 19 nt, Homo sapiens
uaaggaauagagccuaauu

SEQ ID NO: 1135528 - RNA, 19 nt, Homo sapiens
ggacaugcccuagggaaca

SEQ ID NO: 1135529 - RNA, 19 nt, Homo sapiens
ggaagggaaacacgaacaa

SEQ ID NO: 1135530 - RNA, 19 nt, Homo sapiens
gagauuaaccaaaguccau

SEQ ID NO: 1135531 - RNA, 19 nt, Homo sapiens
gcucuucccacacaaaguu

SEQ ID NO: 1135532 - RNA, 19 nt, Homo sapiens
caaugaguauggaaacuac

SEQ ID NO: 1135533 - RNA, 19 nt, Homo sapiens
guugaacugugaaugaauc

SEQ ID NO: 1135534 - RNA, 19 nt, Homo sapiens
gugcacaaaugcuuucucu

SEQ ID NO: 1135535 - RNA, 19 nt, Homo sapiens
cauaacccaucaaauuucu

SEQ ID NO: 1135536 - RNA, 19 nt, Homo sapiens
gagcaccuaagagcaauaa

SEQ ID NO: 1135537 - RNA, 19 nt, Homo sapiens
gaauuuguccagcauuaca

SEQ ID NO: 1135538 - RNA, 19 nt, Homo sapiens
ggcagaauaggacccauuu

SEQ ID NO: 1135539 - RNA, 19 nt, Homo sapiens
aaccacagcccuagaaaga

SEQ ID NO: 1135540 - RNA, 19 nt, Homo sapiens
cagaagcauugaccuuaca

SEQ ID NO: 1135541 - RNA, 19 nt, Homo sapiens
gacaguuucugcaagucuu

SEQ ID NO: 1135542 - RNA, 19 nt, Homo sapiens
ucuguggugucaaggauuu

SEQ ID NO: 1135543 - RNA, 19 nt, Homo sapiens
ccaaaguccaugaucaguu

SEQ ID NO: 1135544 - RNA, 19 nt, Homo sapiens
gcgcaugaauacguguuga

SEQ ID NO: 1135545 - RNA, 19 nt, Homo sapiens
ccuaauuagcgcaugaaua

SEQ ID NO: 1135546 - RNA, 19 nt, Homo sapiens
gguauggcucccuuucuuu

SEQ ID NO: 1135547 - RNA, 19 nt, Homo sapiens
ucaguuagcuccauucaga

SEQ ID NO: 1135548 - RNA, 19 nt, Homo sapiens
gcauacagcucauguugga

SEQ ID NO: 1135549 - RNA, 19 nt, Homo sapiens
cagaacagccucagccuaa

SEQ ID NO: 1135550 - RNA, 19 nt, Homo sapiens
ggagaccuguucaguggaa

SEQ ID NO: 1135551 - RNA, 19 nt, Homo sapiens
gaauucaguuagcuccauu

SEQ ID NO: 1135552 - RNA, 19 nt, Homo sapiens
gaauucugguuguguuuca

SEQ ID NO: 1135553 - RNA, 19 nt, Homo sapiens
ugacagaaguaugauugga

SEQ ID NO: 1135554 - RNA, 19 nt, Homo sapiens
uguuucaacugcuguauug

SEQ ID NO: 1135555 - RNA, 19 nt, Homo sapiens
gugcauacagcucauguug

SEQ ID NO: 1135556 - RNA, 19 nt, Homo sapiens
cggauugacagaaguauga

SEQ ID NO: 1135557 - RNA, 19 nt, Homo sapiens
uggaaugccugccaauguc

SEQ ID NO: 1135558 - RNA, 19 nt, Homo sapiens
agaugcagcucguggauac

SEQ ID NO: 1135559 - RNA, 19 nt, Homo sapiens
gaacagccucagccuaaaa

SEQ ID NO: 1135560 - RNA, 19 nt, Homo sapiens
guggaaugccugccaaugu

SEQ ID NO: 1135561 - RNA, 19 nt, Homo sapiens
agaacagccucagccuaaa

SEQ ID NO: 1135562 - RNA, 19 nt, Homo sapiens
agaaccaaaugcaguccaa

SEQ ID NO: 1135563 - RNA, 19 nt, Homo sapiens
uuggagagcccacaaacuu

SEQ ID NO: 1135564 - RNA, 19 nt, Homo sapiens
uggagagcccacaaacuuu

SEQ ID NO: 1135565 - RNA, 19 nt, Homo sapiens
gacggcggauugacagaag

SEQ ID NO: 1135566 - RNA, 19 nt, Homo sapiens
ugaauucaguuagcuccau

SEQ ID NO: 1135567 - RNA, 19 nt, Homo sapiens
agugaauucugguuguguu

SEQ ID NO: 1135568 - RNA, 19 nt, Homo sapiens
gaccuguucaguggaauga

SEQ ID NO: 1135569 - RNA, 19 nt, Homo sapiens
cagaugcagcucguggaua

SEQ ID NO: 1135570 - RNA, 19 nt, Homo sapiens
gugaauucugguuguguuu

SEQ ID NO: 1135571 - RNA, 19 nt, Homo sapiens
uggauacgaaggcgggaua

SEQ ID NO: 1135572 - RNA, 19 nt, Homo sapiens
gauugacagaaguaugauu

SEQ ID NO: 1135573 - RNA, 19 nt, Homo sapiens
gaagagagcuugcuugcua

SEQ ID NO: 1135574 - RNA, 19 nt, Homo sapiens
gaucaaagcuggaagaaau

SEQ ID NO: 1135575 - RNA, 19 nt, Homo sapiens
gaaaagagcucaagaaaug

SEQ ID NO: 1135576 - RNA, 19 nt, Homo sapiens
ggacauaaauugcaaauac

SEQ ID NO: 1135577 - RNA, 19 nt, Homo sapiens
gaaggaagcagguaacaua

SEQ ID NO: 1135578 - RNA, 19 nt, Homo sapiens
gggaagacauuuacuauga

SEQ ID NO: 1135579 - RNA, 19 nt, Homo sapiens
aaucagagcuucagucuuu

SEQ ID NO: 1135580 - RNA, 19 nt, Homo sapiens
gaaacccuaucaacacuua

SEQ ID NO: 1135581 - RNA, 19 nt, Homo sapiens
ucaaagaacuuacuaggaa

SEQ ID NO: 1135582 - RNA, 19 nt, Homo sapiens
uaagaaaucugaacaggaa

SEQ ID NO: 1135583 - RNA, 19 nt, Homo sapiens
gaacaucauucuacccaaa

SEQ ID NO: 1135584 - RNA, 19 nt, Homo sapiens
gaacaucggucugugagaa

SEQ ID NO: 1135585 - RNA, 19 nt, Homo sapiens
gaaagagccauguuuguuu

SEQ ID NO: 1135586 - RNA, 19 nt, Homo sapiens
gaaagcagaccuagaagaa

SEQ ID NO: 1135587 - RNA, 19 nt, Homo sapiens
caacaucaaugaacagaga

SEQ ID NO: 1135588 - RNA, 19 nt, Homo sapiens
ggagaaagaauucaacaaa

SEQ ID NO: 1135589 - RNA, 19 nt, Homo sapiens
ggaagcagguaacauaaau

SEQ ID NO: 1135590 - RNA, 19 nt, Homo sapiens
gcugaaacacuuaagauua

SEQ ID NO: 1135591 - RNA, 19 nt, Homo sapiens
gcacaacuccugcaaauuc

SEQ ID NO: 1135592 - RNA, 19 nt, Homo sapiens
ccgagaggaucaaauaaua

SEQ ID NO: 1135593 - RNA, 19 nt, Homo sapiens
uaggagagcugaauuuaug

SEQ ID NO: 1135594 - RNA, 19 nt, Homo sapiens
gcaaauacaacucugcuuu

SEQ ID NO: 1135595 - RNA, 19 nt, Homo sapiens
ggacagacaccaccagaaa

SEQ ID NO: 1135596 - RNA, 19 nt, Homo sapiens
gaacugaaggacauaaauu

SEQ ID NO: 1135597 - RNA, 19 nt, Homo sapiens
ggauuccuaugacaacuua

SEQ ID NO: 1135598 - RNA, 19 nt, Homo sapiens
gagcuucucucacaguuga

SEQ ID NO: 1135599 - RNA, 19 nt, Homo sapiens
gcauguacagcuucaauua

SEQ ID NO: 1135600 - RNA, 19 nt, Homo sapiens
gacauuagccagaucauuu

SEQ ID NO: 1135601 - RNA, 19 nt, Homo sapiens
gagauggaaugccuuagaa

SEQ ID NO: 1135602 - RNA, 19 nt, Homo sapiens
aaacuuaccuucuuacuac

SEQ ID NO: 1135603 - RNA, 19 nt, Homo sapiens
ggaguaaucccacgaaguu

SEQ ID NO: 1135604 - RNA, 19 nt, Homo sapiens
ugaaucaacuuaagggaaa

SEQ ID NO: 1135605 - RNA, 19 nt, Homo sapiens
gaauagaagacugagauua

SEQ ID NO: 1135606 - RNA, 19 nt, Homo sapiens
gaaaagaagucucugauag

SEQ ID NO: 1135607 - RNA, 19 nt, Homo sapiens
uacagagacuccaaacuua

SEQ ID NO: 1135608 - RNA, 19 nt, Homo sapiens
gcagaguguugaucaagaa

SEQ ID NO: 1135609 - RNA, 19 nt, Homo sapiens
ucaagagacucaaacuaaa

SEQ ID NO: 1135610 - RNA, 19 nt, Homo sapiens
gaagacauuuacuaugaug

SEQ ID NO: 1135611 - RNA, 19 nt, Homo sapiens
gaagagagcagaguguuga

SEQ ID NO: 1135612 - RNA, 19 nt, Homo sapiens
gauaaucucagguuagaaa

SEQ ID NO: 1135613 - RNA, 19 nt, Homo sapiens
gcugaagaaugaacaagaa

SEQ ID NO: 1135614 - RNA, 19 nt, Homo sapiens
acaaggagcuuucuucagu

SEQ ID NO: 1135615 - RNA, 19 nt, Homo sapiens
gaacagugcaggaacaaau

SEQ ID NO: 1135616 - RNA, 19 nt, Homo sapiens
gagcuucagucuuugcaaa

SEQ ID NO: 1135617 - RNA, 19 nt, Homo sapiens
caaagaacuuacuaggaaa

SEQ ID NO: 1135618 - RNA, 19 nt, Homo sapiens
caaauaauacgcuuggaaa

SEQ ID NO: 1135619 - RNA, 19 nt, Homo sapiens
caugccgucuuuacaauua

SEQ ID NO: 1135620 - RNA, 19 nt, Homo sapiens
gaacaagaagaaaguauca

SEQ ID NO: 1135621 - RNA, 19 nt, Homo sapiens
gaagaaugaacaagaagaa

SEQ ID NO: 1135622 - RNA, 19 nt, Homo sapiens
gaucagaaucauccagaua

SEQ ID NO: 1135623 - RNA, 19 nt, Homo sapiens
gcaguugcgugaaauggaa

SEQ ID NO: 1135624 - RNA, 19 nt, Homo sapiens
gaacagaagaagaaugaau

SEQ ID NO: 1135625 - RNA, 19 nt, Homo sapiens
aggaagaacugaccaagaa

SEQ ID NO: 1135626 - RNA, 19 nt, Homo sapiens
aaagaagucucugauagaa

SEQ ID NO: 1135627 - RNA, 19 nt, Homo sapiens
ugaagaggcucaaagaaca

SEQ ID NO: 1135628 - RNA, 19 nt, Homo sapiens
caaagagccaagcugauua

SEQ ID NO: 1135629 - RNA, 19 nt, Homo sapiens
gaauagacguguggcauca

SEQ ID NO: 1135630 - RNA, 19 nt, Homo sapiens
gaagggagucuuuguuguu

SEQ ID NO: 1135631 - RNA, 19 nt, Homo sapiens
uaagggagcauaucaagaa

SEQ ID NO: 1135632 - RNA, 19 nt, Homo sapiens
gaagaaaugcugaaaauga

SEQ ID NO: 1135633 - RNA, 19 nt, Homo sapiens
ggaaguggauauucuggau

SEQ ID NO: 1135634 - RNA, 19 nt, Homo sapiens
ggaagcagguggagugucu

SEQ ID NO: 1135635 - RNA, 19 nt, Homo sapiens
aaacaaggcaguaguaaau

SEQ ID NO: 1135636 - RNA, 19 nt, Homo sapiens
ggaagaaauguaugaagaa

SEQ ID NO: 1135637 - RNA, 19 nt, Homo sapiens
gaacuucagcacaagcuaa

SEQ ID NO: 1135638 - RNA, 19 nt, Homo sapiens
gagaaagaauucaacaaac

SEQ ID NO: 1135639 - RNA, 19 nt, Homo sapiens
aagcgaaccuuaaucuuga

SEQ ID NO: 1135640 - RNA, 19 nt, Homo sapiens
caagaaaccuccaaaacuu

SEQ ID NO: 1135641 - RNA, 19 nt, Homo sapiens
gcuccaagcugaagugaag

SEQ ID NO: 1135642 - RNA, 19 nt, Homo sapiens
ggaagacauuuacuaugau

SEQ ID NO: 1135643 - RNA, 19 nt, Homo sapiens
uggaagaaauguaugaaga

SEQ ID NO: 1135644 - RNA, 19 nt, Homo sapiens
gaaagucagcaguuaauag

SEQ ID NO: 1135645 - RNA, 19 nt, Homo sapiens
aaagaaagaggaaguagaa

SEQ ID NO: 1135646 - RNA, 19 nt, Homo sapiens
aaacagccauaauugcaaa

SEQ ID NO: 1135647 - RNA, 19 nt, Homo sapiens
gcagaagggaugagauuga

SEQ ID NO: 1135648 - RNA, 19 nt, Homo sapiens
gaucugaaagaaacccuua

SEQ ID NO: 1135649 - RNA, 19 nt, Homo sapiens
gaacaaaugagugcucuuc

SEQ ID NO: 1135650 - RNA, 19 nt, Homo sapiens
auacaacucugcuuugguu

SEQ ID NO: 1135651 - RNA, 19 nt, Homo sapiens
gaaagagacggccaagugu

SEQ ID NO: 1135652 - RNA, 19 nt, Homo sapiens
ucugaaaucugaucugaau

SEQ ID NO: 1135653 - RNA, 19 nt, Homo sapiens
gagcaaagccugccuacag

SEQ ID NO: 1135654 - RNA, 19 nt, Homo sapiens
aaacgaaucaggagaaaga

SEQ ID NO: 1135655 - RNA, 19 nt, Homo sapiens
aaagagccauguuuguuug

SEQ ID NO: 1135656 - RNA, 19 nt, Homo sapiens
ggaagcaauguuauucuuu

SEQ ID NO: 1135657 - RNA, 19 nt, Homo sapiens
gaagaaagagagagaacau

SEQ ID NO: 1135658 - RNA, 19 nt, Homo sapiens
uaagacaccaccucacuuu

SEQ ID NO: 1135659 - RNA, 19 nt, Homo sapiens
guacagcuucaauuagaua

SEQ ID NO: 1135660 - RNA, 19 nt, Homo sapiens
caaacuggaugaagaagag

SEQ ID NO: 1135661 - RNA, 19 nt, Homo sapiens
ugcaaacacugagaaguua

SEQ ID NO: 1135662 - RNA, 19 nt, Homo sapiens
gagaauagaagacugagau

SEQ ID NO: 1135663 - RNA, 19 nt, Homo sapiens
ggagaaaaguaaugagauu

SEQ ID NO: 1135664 - RNA, 19 nt, Homo sapiens
ugaacauucugcauccaua

SEQ ID NO: 1135665 - RNA, 19 nt, Homo sapiens
ucagcuggaugauauuaaa

SEQ ID NO: 1135666 - RNA, 19 nt, Homo sapiens
ggaaagucagcaguuaaua

SEQ ID NO: 1135667 - RNA, 19 nt, Homo sapiens
gcaacuagaacaugugaug

SEQ ID NO: 1135668 - RNA, 19 nt, Homo sapiens
uagaagaccucacccucaa

SEQ ID NO: 1135669 - RNA, 19 nt, Homo sapiens
cuacagagacuccaaacuu

SEQ ID NO: 1135670 - RNA, 19 nt, Homo sapiens
acaacgagcagauauauga

SEQ ID NO: 1135671 - RNA, 19 nt, Homo sapiens
aagaacaacugagaucaaa

SEQ ID NO: 1135672 - RNA, 19 nt, Homo sapiens
cccaagaccuucacguuug

SEQ ID NO: 1135673 - RNA, 19 nt, Homo sapiens
ggaaagaucuagauuguua

SEQ ID NO: 1135674 - RNA, 19 nt, Homo sapiens
gcacauugaucuaucuaaa

SEQ ID NO: 1135675 - RNA, 19 nt, Homo sapiens
ggacgacgaugaggagcua

SEQ ID NO: 1135676 - RNA, 19 nt, Homo sapiens
agacucaacuugcaacugu

SEQ ID NO: 1135677 - RNA, 19 nt, Homo sapiens
gcuccuaacuggaagaucu

SEQ ID NO: 1135678 - RNA, 19 nt, Homo sapiens
cgacuccuuucaccaaauu

SEQ ID NO: 1135679 - RNA, 19 nt, Homo sapiens
gaacugcugauaauuugga

SEQ ID NO: 1135680 - RNA, 19 nt, Homo sapiens
ggaaagacucaacuugcaa

SEQ ID NO: 1135681 - RNA, 19 nt, Homo sapiens
cuggaaagaucuagauugu

SEQ ID NO: 1135682 - RNA, 19 nt, Homo sapiens
gggaccacuuccuuuauga

SEQ ID NO: 1135683 - RNA, 19 nt, Homo sapiens
acacuauccuuacuucugu

SEQ ID NO: 1135684 - RNA, 19 nt, Homo sapiens
gaagacagcaggagcucau

SEQ ID NO: 1135685 - RNA, 19 nt, Homo sapiens
ggacgaauugcucccgaaa

SEQ ID NO: 1135686 - RNA, 19 nt, Homo sapiens
uaugaaucccuauguauga

SEQ ID NO: 1135687 - RNA, 19 nt, Homo sapiens
cacuaugaaucccuaugua

SEQ ID NO: 1135688 - RNA, 19 nt, Homo sapiens
ugggauaaguuugaaauuc

SEQ ID NO: 1135689 - RNA, 19 nt, Homo sapiens
cggagaaguugcaaaugga

SEQ ID NO: 1135690 - RNA, 19 nt, Homo sapiens
uugaacugcugauaauuug

SEQ ID NO: 1135691 - RNA, 19 nt, Homo sapiens
cacauugucucauggaaag

SEQ ID NO: 1135692 - RNA, 19 nt, Homo sapiens
agaccuguguguguguuua

SEQ ID NO: 1135693 - RNA, 19 nt, Homo sapiens
uggaaagacucaacuugca

SEQ ID NO: 1135694 - RNA, 19 nt, Homo sapiens
ggagaauuauccccacauu

SEQ ID NO: 1135695 - RNA, 19 nt, Homo sapiens
uguuugaacugcugauaau

SEQ ID NO: 1135696 - RNA, 19 nt, Homo sapiens
gauuguuauugcuguuuga

SEQ ID NO: 1135697 - RNA, 19 nt, Homo sapiens
ccacauugucucauggaaa

SEQ ID NO: 1135698 - RNA, 19 nt, Homo sapiens
gaugugccccugaccauua

SEQ ID NO: 1135699 - RNA, 19 nt, Homo sapiens
gaaaggcgacgcggagaag

SEQ ID NO: 1135700 - RNA, 19 nt, Homo sapiens
gaucuagauuguuauugcu

SEQ ID NO: 1135701 - RNA, 19 nt, Homo sapiens
agacggagaaguugcaaau

SEQ ID NO: 1135702 - RNA, 19 nt, Homo sapiens
ggauugggaccacuuccuu

SEQ ID NO: 1135703 - RNA, 19 nt, Homo sapiens
acuggaagaucucacuuuc

SEQ ID NO: 1135704 - RNA, 19 nt, Homo sapiens
aaauugcuccuaacuggaa

SEQ ID NO: 1135705 - RNA, 19 nt, Homo sapiens
ucagugggauaaguuugaa

SEQ ID NO: 1135706 - RNA, 19 nt, Homo sapiens
acggagaaguugcaaaugg

SEQ ID NO: 1135707 - RNA, 19 nt, Homo sapiens
gauugggaccacuuccuuu

SEQ ID NO: 1135708 - RNA, 19 nt, Homo sapiens
ccacuaugaaucccuaugu

SEQ ID NO: 1135709 - RNA, 19 nt, Homo sapiens
gcccuccacacuauccuua

SEQ ID NO: 1135710 - RNA, 19 nt, Homo sapiens
cugcugauaauuuggauuu

SEQ ID NO: 1135711 - RNA, 19 nt, Homo sapiens
ugggaccacuuccuuuaug

SEQ ID NO: 1135712 - RNA, 19 nt, Homo sapiens
cauggaaagacucaacuug

SEQ ID NO: 1135713 - RNA, 19 nt, Homo sapiens
gaugaggagcuagaugaga

SEQ ID NO: 1135714 - RNA, 19 nt, Homo sapiens
uuacuucugucuccacucu

SEQ ID NO: 1135715 - RNA, 19 nt, Homo sapiens
gaccuguguguguguuuaa

SEQ ID NO: 1135716 - RNA, 19 nt, Homo sapiens
gacagcaggagcucauuuc

SEQ ID NO: 1135717 - RNA, 19 nt, Homo sapiens
cuaugaaucccuauguaug

SEQ ID NO: 1135718 - RNA, 19 nt, Homo sapiens
cgaaaggcgacgcggagaa

SEQ ID NO: 1135719 - RNA, 19 nt, Homo sapiens
acgaauugcucccgaaagg

SEQ ID NO: 1135720 - RNA, 19 nt, Homo sapiens
cagcagcggcagauacuuc

SEQ ID NO: 1135721 - RNA, 19 nt, Homo sapiens
agacagcaggagcucauuu

SEQ ID NO: 1135722 - RNA, 19 nt, Homo sapiens
ggaggaggacgacgaugag

SEQ ID NO: 1135723 - RNA, 19 nt, Homo sapiens
acagggcucucaggaggaa

SEQ ID NO: 1135724 - RNA, 19 nt, Homo sapiens
agaucuagauuguuauugc

SEQ ID NO: 1135725 - RNA, 19 nt, Homo sapiens
guguuugaacugcugauaa

SEQ ID NO: 1135726 - RNA, 19 nt, Homo sapiens
cuagauuguuauugcuguu

SEQ ID NO: 1135727 - RNA, 19 nt, Homo sapiens
gaccacuuccuuuaugauc

SEQ ID NO: 1135728 - RNA, 19 nt, Homo sapiens
ggaccacuuccuuuaugau

SEQ ID NO: 1135729 - RNA, 19 nt, Homo sapiens
gcucauuuccucugcacau

SEQ ID NO: 1135730 - RNA, 19 nt, Homo sapiens
uaacuuuggcacauugauc

SEQ ID NO: 1135731 - RNA, 19 nt, Homo sapiens
uggaggaggacgacgauga

SEQ ID NO: 1135732 - RNA, 19 nt, Homo sapiens
acgaugaggagcuagauga

SEQ ID NO: 1135733 - RNA, 19 nt, Homo sapiens
ucauuuccucugcacauuu

SEQ ID NO: 1135734 - RNA, 19 nt, Homo sapiens
uuaaagaauggaguuguug

SEQ ID NO: 1135735 - RNA, 19 nt, Homo sapiens
agauuguuauugcuguuug

SEQ ID NO: 1135736 - RNA, 19 nt, Homo sapiens
ccuggaaagaucuagauug

SEQ ID NO: 1135737 - RNA, 19 nt, Homo sapiens
ucuuugagacggagaaguu

SEQ ID NO: 1135738 - RNA, 19 nt, Homo sapiens
gaaacagacaaaaugcauu

SEQ ID NO: 1135739 - RNA, 19 nt, Homo sapiens
gggccugacggagauguuu

SEQ ID NO: 1135740 - RNA, 19 nt, Homo sapiens
ucagauagcuuuagugauu

SEQ ID NO: 1135741 - RNA, 19 nt, Homo sapiens
gaacuuauccugacugguu

SEQ ID NO: 1135742 - RNA, 19 nt, Homo sapiens
caagacaccuucaucuaaa

SEQ ID NO: 1135743 - RNA, 19 nt, Homo sapiens
ggaaggagauauuaaacau

SEQ ID NO: 1135744 - RNA, 19 nt, Homo sapiens
caaagagucaucagaauaa

SEQ ID NO: 1135745 - RNA, 19 nt, Homo sapiens
gcaacaaugugggacuaua

SEQ ID NO: 1135746 - RNA, 19 nt, Homo sapiens
ccacauaggacuaauuauu

SEQ ID NO: 1135747 - RNA, 19 nt, Homo sapiens
agacgaauauguuguucua

SEQ ID NO: 1135748 - RNA, 19 nt, Homo sapiens
gaaacaagccagaagaaca

SEQ ID NO: 1135749 - RNA, 19 nt, Homo sapiens
ucaaagagucaucagaaua

SEQ ID NO: 1135750 - RNA, 19 nt, Homo sapiens
ucaagacaccuucaucuaa

SEQ ID NO: 1135751 - RNA, 19 nt, Homo sapiens
caacugauguguuugaaaa

SEQ ID NO: 1135752 - RNA, 19 nt, Homo sapiens
aagaauggauccacuauag

SEQ ID NO: 1135753 - RNA, 19 nt, Homo sapiens
gagcaacaaugugggacua

SEQ ID NO: 1135754 - RNA, 19 nt, Homo sapiens
gaccaaaagugaacuauau

SEQ ID NO: 1135755 - RNA, 19 nt, Homo sapiens
aagcauccuugucuuuaua

SEQ ID NO: 1135756 - RNA, 19 nt, Homo sapiens
gaacacuugcuaucucuug

SEQ ID NO: 1135757 - RNA, 19 nt, Homo sapiens
gcagugggagcuucaauug

SEQ ID NO: 1135758 - RNA, 19 nt, Homo sapiens
agaauaacauggauugaag

SEQ ID NO: 1135759 - RNA, 19 nt, Homo sapiens
ggauggcaauggugauuuc

SEQ ID NO: 1135760 - RNA, 19 nt, Homo sapiens
gauauacuuuagugcuuug

SEQ ID NO: 1135761 - RNA, 19 nt, Homo sapiens
ggugauuucuucauuugau

SEQ ID NO: 1135762 - RNA, 19 nt, Homo sapiens
gcaagaauggauccacuau

SEQ ID NO: 1135763 - RNA, 19 nt, Homo sapiens
ucaggcauguugagauuug

SEQ ID NO: 1135764 - RNA, 19 nt, Homo sapiens
caagaauggauccacuaua

SEQ ID NO: 1135765 - RNA, 19 nt, Homo sapiens
gaauggauccacuauagca

SEQ ID NO: 1135766 - RNA, 19 nt, Homo sapiens
aaacaagccagaagaacaa

SEQ ID NO: 1135767 - RNA, 19 nt, Homo sapiens
cgaauauguuguucuaugg

SEQ ID NO: 1135768 - RNA, 19 nt, Homo sapiens
acgaauauguuguucuaug

SEQ ID NO: 1135769 - RNA, 19 nt, Homo sapiens
ggaguaauauuuuccuguu

SEQ ID NO: 1135770 - RNA, 19 nt, Homo sapiens
cauggaaggagauauuaaa

SEQ ID NO: 1135771 - RNA, 19 nt, Homo sapiens
ggacuccacauaggacuaa

SEQ ID NO: 1135772 - RNA, 19 nt, Homo sapiens
gaauaacauggauugaaga

SEQ ID NO: 1135773 - RNA, 19 nt, Homo sapiens
gugauauacuuuagugcuu

SEQ ID NO: 1135774 - RNA, 19 nt, Homo sapiens
cagaauaacauggauugaa

SEQ ID NO: 1135775 - RNA, 19 nt, Homo sapiens
gaaauucagauagcuuuag

SEQ ID NO: 1135776 - RNA, 19 nt, Homo sapiens
gggaaacaagccagaagaa

SEQ ID NO: 1135777 - RNA, 19 nt, Homo sapiens
gaaaaguggauguaacuga

SEQ ID NO: 1135778 - RNA, 19 nt, Homo sapiens
uuucaggcauguugagauu

SEQ ID NO: 1135779 - RNA, 19 nt, Homo sapiens
gcaaauuucaagacaccuu

SEQ ID NO: 1135780 - RNA, 19 nt, Homo sapiens
uggcaauggugauuucuuc

SEQ ID NO: 1135781 - RNA, 19 nt, Homo sapiens
gcaacugauguguuugaaa

SEQ ID NO: 1135782 - RNA, 19 nt, Homo sapiens
ggacuauacgauuccuauu

SEQ ID NO: 1135783 - RNA, 19 nt, Homo sapiens
gcgcucauuggcagacuua

SEQ ID NO: 1135784 - RNA, 19 nt, Homo sapiens
auuucuagguggaguaaua

SEQ ID NO: 1135785 - RNA, 19 nt, Homo sapiens
gaauauguuguucuaugga

SEQ ID NO: 1135786 - RNA, 19 nt, Homo sapiens
cagcaacugauguguuuga

SEQ ID NO: 1135787 - RNA, 19 nt, Homo sapiens
cagauagcuuuagugauug

SEQ ID NO: 1135788 - RNA, 19 nt, Homo sapiens
agacaccuucaucuaaaua

SEQ ID NO: 1135789 - RNA, 19 nt, Homo sapiens
gacuauacgauuccuauuc

SEQ ID NO: 1135790 - RNA, 19 nt, Homo sapiens
gugauugucuuuguguugu

SEQ ID NO: 1135791 - RNA, 19 nt, Homo sapiens
cuucaaagagucaucagaa

SEQ ID NO: 1135792 - RNA, 19 nt, Homo sapiens
uuggaugugucuuugcuaa

SEQ ID NO: 1135793 - RNA, 19 nt, Homo sapiens
cuccacauaggacuaauua

SEQ ID NO: 1135794 - RNA, 19 nt, Homo sapiens
uacgauuccuauucuagaa

SEQ ID NO: 1135795 - RNA, 19 nt, Homo sapiens
gggacuauacgauuccuau

SEQ ID NO: 1135796 - RNA, 19 nt, Homo sapiens
gguucaaguucuuucuuca

SEQ ID NO: 1135797 - RNA, 19 nt, Homo sapiens
ccaccgaagaggcaccaua

SEQ ID NO: 1135798 - RNA, 19 nt, Homo sapiens
cgauuccuauucuagaaau

SEQ ID NO: 1135799 - RNA, 19 nt, Homo sapiens
aaaaguggauguaacugaa

SEQ ID NO: 1135800 - RNA, 19 nt, Homo sapiens
ggauguuuguguuuuauug

SEQ ID NO: 1135801 - RNA, 19 nt, Homo sapiens
gugacucucuuuccacagu

SEQ ID NO: 1135802 - RNA, 19 nt, Homo sapiens
caacaaugugggacuauac

SEQ ID NO: 1135803 - RNA, 19 nt, Homo sapiens
ugacucucuuuccacagua

SEQ ID NO: 1135804 - RNA, 19 nt, Homo sapiens
gcaauggugauuucuucau

SEQ ID NO: 1135805 - RNA, 19 nt, Homo sapiens
uguguugucugcauuugga

SEQ ID NO: 1135806 - RNA, 19 nt, Homo sapiens
uuauugggauguuuguguu

SEQ ID NO: 1135807 - RNA, 19 nt, Homo sapiens
caagacugcaugucaucaa

SEQ ID NO: 1135808 - RNA, 19 nt, Homo sapiens
acuauacgauuccuauucu

SEQ ID NO: 1135809 - RNA, 19 nt, Homo sapiens
ggcaagaauggauccacua

SEQ ID NO: 1135810 - RNA, 19 nt, Homo sapiens
ggauuucuagguggaguaa

SEQ ID NO: 1135811 - RNA, 19 nt, Homo sapiens
ggaaacaagccagaagaac

SEQ ID NO: 1135812 - RNA, 19 nt, Homo sapiens
cugcugcuguuucauggaa

SEQ ID NO: 1135813 - RNA, 19 nt, Homo sapiens
ucuagguggaguaauauuu

SEQ ID NO: 1135814 - RNA, 19 nt, Homo sapiens
cuauacgauuccuauucua

SEQ ID NO: 1135815 - RNA, 19 nt, Homo sapiens
gcucauuggcagacuuaug

SEQ ID NO: 1135816 - RNA, 19 nt, Homo sapiens
ggcagugggagcuucaauu

SEQ ID NO: 1135817 - RNA, 19 nt, Homo sapiens
ucauggaaggagauauuaa

SEQ ID NO: 1135818 - RNA, 19 nt, Homo sapiens
caucagaauaacauggauu

SEQ ID NO: 1135819 - RNA, 19 nt, Homo sapiens
ggaugcuauugaugggaaa

SEQ ID NO: 1135820 - RNA, 19 nt, Homo sapiens
uucaauugccgcucgcuua

SEQ ID NO: 1135821 - RNA, 19 nt, Homo sapiens
ccgaacacuugcuaucucu

SEQ ID NO: 1135822 - RNA, 19 nt, Homo sapiens
gacugcaugucaucaagca

SEQ ID NO: 1135823 - RNA, 19 nt, Homo sapiens
aagacaccuucaucuaaau

SEQ ID NO: 1135824 - RNA, 19 nt, Homo sapiens
guucaaguucuuucuucaa

SEQ ID NO: 1135825 - RNA, 19 nt, Homo sapiens
gccgcucgcuuaggaacuu

SEQ ID NO: 1135826 - RNA, 19 nt, Homo sapiens
ggggccaggucuuuuguuu

SEQ ID NO: 1135827 - RNA, 19 nt, Homo sapiens
gcaccauacuggacauacc

SEQ ID NO: 1135828 - RNA, 19 nt, Homo sapiens
aauugccgcucgcuuagga

SEQ ID NO: 1135829 - RNA, 19 nt, Homo sapiens
uuucauggaaggagauauu

SEQ ID NO: 1135830 - RNA, 19 nt, Homo sapiens
uucaaagagucaucagaau

SEQ ID NO: 1135831 - RNA, 19 nt, Homo sapiens
ccgaagaggcaccauacug

SEQ ID NO: 1135832 - RNA, 19 nt, Homo sapiens
gucacuggaugcuauugau

SEQ ID NO: 1135833 - RNA, 19 nt, Homo sapiens
aaaguggauguaacugaaa

SEQ ID NO: 1135834 - RNA, 19 nt, Homo sapiens
auggugauuucuucauuug

SEQ ID NO: 1135835 - RNA, 19 nt, Homo sapiens
aaacucuuguuccccuuua

SEQ ID NO: 1135836 - RNA, 19 nt, Homo sapiens
uauccuccauggugguguu

SEQ ID NO: 1135837 - RNA, 19 nt, Homo sapiens
uagcuuuagugauugucuu

SEQ ID NO: 1135838 - RNA, 19 nt, Homo sapiens
auucagauagcuuuaguga

SEQ ID NO: 1135839 - RNA, 19 nt, Homo sapiens
gaugggaaacaagccagaa

SEQ ID NO: 1135840 - RNA, 19 nt, Homo sapiens
ggacauaauuucugaguuu

SEQ ID NO: 1135841 - RNA, 19 nt, Homo sapiens
ggacaacgcuugauuugaa

SEQ ID NO: 1135842 - RNA, 19 nt, Homo sapiens
gaucacaguuuguuaauug

SEQ ID NO: 1135843 - RNA, 19 nt, Homo sapiens
gaacagccaugaaauaagu

SEQ ID NO: 1135844 - RNA, 19 nt, Homo sapiens
gcacagaggugaugguaga

SEQ ID NO: 1135845 - RNA, 19 nt, Homo sapiens
ggaagaauguguuauguuc

SEQ ID NO: 1135846 - RNA, 19 nt, Homo sapiens
gaauguauauccugagaaa

SEQ ID NO: 1135847 - RNA, 19 nt, Homo sapiens
gggaacagcuugauuucua

SEQ ID NO: 1135848 - RNA, 19 nt, Homo sapiens
uaacuaagcuucuaaaugc

SEQ ID NO: 1135849 - RNA, 19 nt, Homo sapiens
caagauaccucauugaauc

SEQ ID NO: 1135850 - RNA, 19 nt, Homo sapiens
gaagaugauuuaccaguga

SEQ ID NO: 1135851 - RNA, 19 nt, Homo sapiens
gaauaucucuucccacuuc

SEQ ID NO: 1135852 - RNA, 19 nt, Homo sapiens
gcagagagccuuuggaaga

SEQ ID NO: 1135853 - RNA, 19 nt, Homo sapiens
ggaaugagcccuaccagaa

SEQ ID NO: 1135854 - RNA, 19 nt, Homo sapiens
ucagaacucuucagcauuu

SEQ ID NO: 1135855 - RNA, 19 nt, Homo sapiens
ggaguauggucaaaucuuu

SEQ ID NO: 1135856 - RNA, 19 nt, Homo sapiens
gccaagaacuuccagauug

SEQ ID NO: 1135857 - RNA, 19 nt, Homo sapiens
ccaagcagcugggauuaua

SEQ ID NO: 1135858 - RNA, 19 nt, Homo sapiens
gaacaacuacgaugacuug

SEQ ID NO: 1135859 - RNA, 19 nt, Homo sapiens
gcagaaauuugucuaguuc

SEQ ID NO: 1135860 - RNA, 19 nt, Homo sapiens
gcauuugugugauuccuua

SEQ ID NO: 1135861 - RNA, 19 nt, Homo sapiens
gguuauagccuguuagaua

SEQ ID NO: 1135862 - RNA, 19 nt, Homo sapiens
gagaacagcccaccuugua

SEQ ID NO: 1135863 - RNA, 19 nt, Homo sapiens
ggaaccaaauuuaagauug

SEQ ID NO: 1135864 - RNA, 19 nt, Homo sapiens
uaagagcgcuggaacauuc

SEQ ID NO: 1135865 - RNA, 19 nt, Homo sapiens
ggaagaugauccuguguau

SEQ ID NO: 1135866 - RNA, 19 nt, Homo sapiens
ugacugggcugccaagaaa

SEQ ID NO: 1135867 - RNA, 19 nt, Homo sapiens
gagaacagccaugaaauaa

SEQ ID NO: 1135868 - RNA, 19 nt, Homo sapiens
ggagacaucagcuuaauga

SEQ ID NO: 1135869 - RNA, 19 nt, Homo sapiens
caaauaauguggugacagu

SEQ ID NO: 1135870 - RNA, 19 nt, Homo sapiens
caacugaagucaaagaagu

SEQ ID NO: 1135871 - RNA, 19 nt, Homo sapiens
guucuaagaucuuguuguu

SEQ ID NO: 1135872 - RNA, 19 nt, Homo sapiens
ucuaauggguuguggcuua

SEQ ID NO: 1135873 - RNA, 19 nt, Homo sapiens
gaguuuauguagcuugaua

SEQ ID NO: 1135874 - RNA, 19 nt, Homo sapiens
gacaucagcuuaaugaaca

SEQ ID NO: 1135875 - RNA, 19 nt, Homo sapiens
caaauuacguguggcauau

SEQ ID NO: 1135876 - RNA, 19 nt, Homo sapiens
acacuaaacuggaaucuca

SEQ ID NO: 1135877 - RNA, 19 nt, Homo sapiens
caaaggauauuucccaucu

SEQ ID NO: 1135878 - RNA, 19 nt, Homo sapiens
gaaacagccucuacucucu

SEQ ID NO: 1135879 - RNA, 19 nt, Homo sapiens
ggacagcauuugauuuaca

SEQ ID NO: 1135880 - RNA, 19 nt, Homo sapiens
ccaagaacuuccagauuga

SEQ ID NO: 1135881 - RNA, 19 nt, Homo sapiens
gcccagagguccgacaaua

SEQ ID NO: 1135882 - RNA, 19 nt, Homo sapiens
gcucaggucacgucuaaua

SEQ ID NO: 1135883 - RNA, 19 nt, Homo sapiens
gaacaugggccugugcuuu

SEQ ID NO: 1135884 - RNA, 19 nt, Homo sapiens
gaagaaacugcaccguaua

SEQ ID NO: 1135885 - RNA, 19 nt, Homo sapiens
caaagaaguugaauaagac

SEQ ID NO: 1135886 - RNA, 19 nt, Homo sapiens
caaaguuaguggagacaaa

SEQ ID NO: 1135887 - RNA, 19 nt, Homo sapiens
gcacacaacucagaacucu

SEQ ID NO: 1135888 - RNA, 19 nt, Homo sapiens
ccacaggaauauauaccua

SEQ ID NO: 1135889 - RNA, 19 nt, Homo sapiens
agggaagugugauauauua

SEQ ID NO: 1135890 - RNA, 19 nt, Homo sapiens
agaagaaacugcaccguau

SEQ ID NO: 1135891 - RNA, 19 nt, Homo sapiens
ggacgaaggguaaagaaga

SEQ ID NO: 1135892 - RNA, 19 nt, Homo sapiens
gaaggaggcuaggacuuug

SEQ ID NO: 1135893 - RNA, 19 nt, Homo sapiens
caacuacgaugacuugucu

SEQ ID NO: 1135894 - RNA, 19 nt, Homo sapiens
uagaaggcauuaaugguuu

SEQ ID NO: 1135895 - RNA, 19 nt, Homo sapiens
gagcuaaaccacugagaaa

SEQ ID NO: 1135896 - RNA, 19 nt, Homo sapiens
ucaggucagucuuaauuaa

SEQ ID NO: 1135897 - RNA, 19 nt, Homo sapiens
gaaagcacccaucagcaaa

SEQ ID NO: 1135898 - RNA, 19 nt, Homo sapiens
ggaauuguguuuguucuca

SEQ ID NO: 1135899 - RNA, 19 nt, Homo sapiens
ggaaagcacccaucagcaa

SEQ ID NO: 1135900 - RNA, 19 nt, Homo sapiens
ggacacagggccaagcuuu

SEQ ID NO: 1135901 - RNA, 19 nt, Homo sapiens
cuaaauguguuuggaauug

SEQ ID NO: 1135902 - RNA, 19 nt, Homo sapiens
uuaaugagcuauguacuga

SEQ ID NO: 1135903 - RNA, 19 nt, Homo sapiens
gggaaaaucuuugaaauga

SEQ ID NO: 1135904 - RNA, 19 nt, Homo sapiens
ggagagagaagaagaaagu

SEQ ID NO: 1135905 - RNA, 19 nt, Homo sapiens
ggagagaguuuccuuuuga

SEQ ID NO: 1135906 - RNA, 19 nt, Homo sapiens
ggaacauucugccucuuga

SEQ ID NO: 1135907 - RNA, 19 nt, Homo sapiens
cugauggacuuaauucuaa

SEQ ID NO: 1135908 - RNA, 19 nt, Homo sapiens
gcacugaacagccucauca

SEQ ID NO: 1135909 - RNA, 19 nt, Homo sapiens
cagaaagaauucagcaaug

SEQ ID NO: 1135910 - RNA, 19 nt, Homo sapiens
gacgaaggguaaagaagaa

SEQ ID NO: 1135911 - RNA, 19 nt, Homo sapiens
ggacuuugagugacuuuaa

SEQ ID NO: 1135912 - RNA, 19 nt, Homo sapiens
caagaaaucucccaaaauc

SEQ ID NO: 1135913 - RNA, 19 nt, Homo sapiens
gaacaacaugagagacuuu

SEQ ID NO: 1135914 - RNA, 19 nt, Homo sapiens
gaaugagcccuaccagaaa

SEQ ID NO: 1135915 - RNA, 19 nt, Homo sapiens
caagaggauuuaagacuca

SEQ ID NO: 1135916 - RNA, 19 nt, Homo sapiens
guuacacggucuucaaauu

SEQ ID NO: 1135917 - RNA, 19 nt, Homo sapiens
ugagaacagccaugaaaua

SEQ ID NO: 1135918 - RNA, 19 nt, Homo sapiens
gaaagaauucagcaauguu

SEQ ID NO: 1135919 - RNA, 19 nt, Homo sapiens
gacagucucugaaugugaa

SEQ ID NO: 1135920 - RNA, 19 nt, Homo sapiens
caaccucggugcaguaauc

SEQ ID NO: 1135921 - RNA, 19 nt, Homo sapiens
ggaacucaagcacuuauuu

SEQ ID NO: 1135922 - RNA, 19 nt, Homo sapiens
ccacagaggauaaauuuca

SEQ ID NO: 1135923 - RNA, 19 nt, Homo sapiens
cgacgaaaauucauacuuu

SEQ ID NO: 1135924 - RNA, 19 nt, Homo sapiens
ugacaucacucccaauucu

SEQ ID NO: 1135925 - RNA, 19 nt, Homo sapiens
cuacaaaugcuuucuauca

SEQ ID NO: 1135926 - RNA, 19 nt, Homo sapiens
agaagaaagugaagaguca

SEQ ID NO: 1135927 - RNA, 19 nt, Homo sapiens
gcaggagacgcuacuauga

SEQ ID NO: 1135928 - RNA, 19 nt, Homo sapiens
auacugaccuucuaauuag

SEQ ID NO: 1135929 - RNA, 19 nt, Homo sapiens
gguuguggcuuacuuuguu

SEQ ID NO: 1135930 - RNA, 19 nt, Homo sapiens
uaaaagcaguccaguaaaa

SEQ ID NO: 1135931 - RNA, 19 nt, Homo sapiens
acaaauacaugugagaaga

SEQ ID NO: 1135932 - RNA, 19 nt, Homo sapiens
aaggauauuucccaucuaa

SEQ ID NO: 1135933 - RNA, 19 nt, Homo sapiens
ugagagacuuugucagcua

SEQ ID NO: 1135934 - RNA, 19 nt, Homo sapiens
gaucaccacuuaauuaacg

SEQ ID NO: 1135935 - RNA, 19 nt, Homo sapiens
gaaugagaauaaccaagug

SEQ ID NO: 1135936 - RNA, 19 nt, Homo sapiens
gcuagaggguggcuucaga

SEQ ID NO: 1135937 - RNA, 19 nt, Homo sapiens
uguaagaguuguccagcua

SEQ ID NO: 1135938 - RNA, 19 nt, Homo sapiens
acaaggacauggaagaaug

SEQ ID NO: 1135939 - RNA, 19 nt, Homo sapiens
cgacuuacauggucacagu

SEQ ID NO: 1135940 - RNA, 19 nt, Homo sapiens
gcauugggcucauguucua

SEQ ID NO: 1135941 - RNA, 19 nt, Homo sapiens
ggaaggaucacgugaaguu

SEQ ID NO: 1135942 - RNA, 19 nt, Homo sapiens
gcaguacccugaaggacaa

SEQ ID NO: 1135943 - RNA, 19 nt, Homo sapiens
gacauccgcuugacuccua

SEQ ID NO: 1135944 - RNA, 19 nt, Homo sapiens
gcaugaagcccaacacguu

SEQ ID NO: 1135945 - RNA, 19 nt, Homo sapiens
cgucuuugcuguccucuuu

SEQ ID NO: 1135946 - RNA, 19 nt, Homo sapiens
ccucugugcucaucaguuu

SEQ ID NO: 1135947 - RNA, 19 nt, Homo sapiens
uaacucugcugaccaugaa

SEQ ID NO: 1135948 - RNA, 19 nt, Homo sapiens
cagcuguacuuuauucuug

SEQ ID NO: 1135949 - RNA, 19 nt, Homo sapiens
gggcagcuguacuuuauuc

SEQ ID NO: 1135950 - RNA, 19 nt, Homo sapiens
gcuggaaccugcuguaugg

SEQ ID NO: 1135951 - RNA, 19 nt, Homo sapiens
gggcggagccuacuucaug

SEQ ID NO: 1135952 - RNA, 19 nt, Homo sapiens
cgggagccgugaugaauuu

SEQ ID NO: 1135953 - RNA, 19 nt, Homo sapiens
caccugcacugaucuguga

SEQ ID NO: 1135954 - RNA, 19 nt, Homo sapiens
gguccuagguuucuacgau

SEQ ID NO: 1135955 - RNA, 19 nt, Homo sapiens
ccacuguccuguccauguu

SEQ ID NO: 1135956 - RNA, 19 nt, Homo sapiens
caacagcaguacccugaag

SEQ ID NO: 1135957 - RNA, 19 nt, Homo sapiens
acacguugguccuagguuu

SEQ ID NO: 1135958 - RNA, 19 nt, Homo sapiens
gcacugcugagccaacuga

SEQ ID NO: 1135959 - RNA, 19 nt, Homo sapiens
caacuugggcgcuggcuau

SEQ ID NO: 1135960 - RNA, 19 nt, Homo sapiens
gugcccaggugaaggcuuu

SEQ ID NO: 1135961 - RNA, 19 nt, Homo sapiens
cugggcagcuguacuuuau

SEQ ID NO: 1135962 - RNA, 19 nt, Homo sapiens
ggagccuacuucaugauca

SEQ ID NO: 1135963 - RNA, 19 nt, Homo sapiens
cuaccuggcuaacgucugu

SEQ ID NO: 1135964 - RNA, 19 nt, Homo sapiens
ggcggagccuacuucauga

SEQ ID NO: 1135965 - RNA, 19 nt, Homo sapiens
gggccucauuccucacauu

SEQ ID NO: 1135966 - RNA, 19 nt, Homo sapiens
cccggaagcuguccaccuu

SEQ ID NO: 1135967 - RNA, 19 nt, Homo sapiens
ccgacgcccucaagaugaa

SEQ ID NO: 1135968 - RNA, 19 nt, Homo sapiens
ggugaaggcuuuuguggau

SEQ ID NO: 1135969 - RNA, 19 nt, Homo sapiens
acucugggcuaccucaguu

SEQ ID NO: 1135970 - RNA, 19 nt, Homo sapiens
ccucucaguugcaccaugu

SEQ ID NO: 1135971 - RNA, 19 nt, Homo sapiens
gcagcuguacuuuauucuu

SEQ ID NO: 1135972 - RNA, 19 nt, Homo sapiens
ucuuugcuguccucuuuaa

SEQ ID NO: 1135973 - RNA, 19 nt, Homo sapiens
ccggaaggaucacgugaag

SEQ ID NO: 1135974 - RNA, 19 nt, Homo sapiens
gaaggggacuuugugaaca

SEQ ID NO: 1135975 - RNA, 19 nt, Homo sapiens
ucaagaugaacaagaaugu

SEQ ID NO: 1135976 - RNA, 19 nt, Homo sapiens
ucacagcccucaccuuccu

SEQ ID NO: 1135977 - RNA, 19 nt, Homo sapiens
cccucaagaugaacaagaa

SEQ ID NO: 1135978 - RNA, 19 nt, Homo sapiens
gaauuuugccaacgucuuu

SEQ ID NO: 1135979 - RNA, 19 nt, Homo sapiens
gcugcugguugccuacuuc

SEQ ID NO: 1135980 - RNA, 19 nt, Homo sapiens
gggcagcauugggcucaug

SEQ ID NO: 1135981 - RNA, 19 nt, Homo sapiens
gcaucacgcccaccuccuu

SEQ ID NO: 1135982 - RNA, 19 nt, Homo sapiens
uggagucugugcuugaugu

SEQ ID NO: 1135983 - RNA, 19 nt, Homo sapiens
gguggagucugugcuugau

SEQ ID NO: 1135984 - RNA, 19 nt, Homo sapiens
gagccuacuucaugaucag

SEQ ID NO: 1135985 - RNA, 19 nt, Homo sapiens
caucacgcccaccuccuuu

SEQ ID NO: 1135986 - RNA, 19 nt, Homo sapiens
gcgcuacuggagacucuaa

SEQ ID NO: 1135987 - RNA, 19 nt, Homo sapiens
cugggaagcugaacacacu

SEQ ID NO: 1135988 - RNA, 19 nt, Homo sapiens
gaaggaucacgugaaguuc

SEQ ID NO: 1135989 - RNA, 19 nt, Homo sapiens
ggaugucugcggccucuuc

SEQ ID NO: 1135990 - RNA, 19 nt, Homo sapiens
ccugggcagcuguacuuua

SEQ ID NO: 1135991 - RNA, 19 nt, Homo sapiens
ccacuucaccggcuucaac

SEQ ID NO: 1135992 - RNA, 19 nt, Homo sapiens
cuaacucugcugaccauga

SEQ ID NO: 1135993 - RNA, 19 nt, Homo sapiens
gcugguugccuacuucauc

SEQ ID NO: 1135994 - RNA, 19 nt, Homo sapiens
gccgacgcccucaagauga

SEQ ID NO: 1135995 - RNA, 19 nt, Homo sapiens
uguggucacugucuucuac

SEQ ID NO: 1135996 - RNA, 19 nt, Homo sapiens
gguguugaucggaaucuau

SEQ ID NO: 1135997 - RNA, 19 nt, Homo sapiens
gcccucaccuuccuguacu

SEQ ID NO: 1135998 - RNA, 19 nt, Homo sapiens
ccuccugccugcucaugau

SEQ ID NO: 1135999 - RNA, 19 nt, Homo sapiens
uggcugcuguggucacugu

SEQ ID NO: 1136000 - RNA, 19 nt, Homo sapiens
agucugugcuugaugucuu

SEQ ID NO: 1136001 - RNA, 19 nt, Homo sapiens
ugacggacccggcuuucuc

SEQ ID NO: 1136002 - RNA, 19 nt, Homo sapiens
uggccaaccagcuuaagaa

SEQ ID NO: 1136003 - RNA, 19 nt, Homo sapiens
cagcauugggcucauguuc

SEQ ID NO: 1136004 - RNA, 19 nt, Homo sapiens
cuacaccuucuucgucuau

SEQ ID NO: 1136005 - RNA, 19 nt, Homo sapiens
caagaugaacaagaaugug

SEQ ID NO: 1136006 - RNA, 19 nt, Homo sapiens
ugaccucuuuggcgugauc

SEQ ID NO: 1136007 - RNA, 19 nt, Homo sapiens
cuucgucuauguccugcuu

SEQ ID NO: 1136008 - RNA, 19 nt, Homo sapiens
ccagaaacaugaacagaua

SEQ ID NO: 1136009 - RNA, 19 nt, Homo sapiens
gaaauaagcagaugaagau

SEQ ID NO: 1136010 - RNA, 19 nt, Homo sapiens
ugagggagcuguucgaguu

SEQ ID NO: 1136011 - RNA, 19 nt, Homo sapiens
ggaacgagaucugcuacaa

SEQ ID NO: 1136012 - RNA, 19 nt, Homo sapiens
uaacuccuuugcccaauaa

SEQ ID NO: 1136013 - RNA, 19 nt, Homo sapiens
ggugagaagugcaagaaug

SEQ ID NO: 1136014 - RNA, 19 nt, Homo sapiens
gggcaacgcgggaauauga

SEQ ID NO: 1136015 - RNA, 19 nt, Homo sapiens
gguccaacuucuucuauga

SEQ ID NO: 1136016 - RNA, 19 nt, Homo sapiens
cgaaauccauagagaugaa

SEQ ID NO: 1136017 - RNA, 19 nt, Homo sapiens
gaagauccacaaccugauu

SEQ ID NO: 1136018 - RNA, 19 nt, Homo sapiens
gccaacaagugcuccuuaa

SEQ ID NO: 1136019 - RNA, 19 nt, Homo sapiens
cagauacgauugugggauu

SEQ ID NO: 1136020 - RNA, 19 nt, Homo sapiens
ucaccgaccucuacauuca

SEQ ID NO: 1136021 - RNA, 19 nt, Homo sapiens
gaacagggaaugccagaca

SEQ ID NO: 1136022 - RNA, 19 nt, Homo sapiens
gugcaagaaugaagaugaa

SEQ ID NO: 1136023 - RNA, 19 nt, Homo sapiens
ggaagacgcccacuuggau

SEQ ID NO: 1136024 - RNA, 19 nt, Homo sapiens
gcacuuggcccgaaugaag

SEQ ID NO: 1136025 - RNA, 19 nt, Homo sapiens
caacagugaugucaacaac

SEQ ID NO: 1136026 - RNA, 19 nt, Homo sapiens
gcagagcgcggacuucaug

SEQ ID NO: 1136027 - RNA, 19 nt, Homo sapiens
gcugaauguuccuaaagaa

SEQ ID NO: 1136028 - RNA, 19 nt, Homo sapiens
gagaggugcugagcuaaca

SEQ ID NO: 1136029 - RNA, 19 nt, Homo sapiens
auaagcagaugaagaugaa

SEQ ID NO: 1136030 - RNA, 19 nt, Homo sapiens
gaauaugacagauccuuca

SEQ ID NO: 1136031 - RNA, 19 nt, Homo sapiens
gcagaggucgccaagaaga

SEQ ID NO: 1136032 - RNA, 19 nt, Homo sapiens
ugggagaggugcugagcua

SEQ ID NO: 1136033 - RNA, 19 nt, Homo sapiens
guagguguguguauguguu

SEQ ID NO: 1136034 - RNA, 19 nt, Homo sapiens
ugaaauaagcagaugaaga

SEQ ID NO: 1136035 - RNA, 19 nt, Homo sapiens
gaguuccacuucaugcaaa

SEQ ID NO: 1136036 - RNA, 19 nt, Homo sapiens
ugccugagauuguggauga

SEQ ID NO: 1136037 - RNA, 19 nt, Homo sapiens
guauguguuucuagaguga

SEQ ID NO: 1136038 - RNA, 19 nt, Homo sapiens
caacugguccaacuucuuc

SEQ ID NO: 1136039 - RNA, 19 nt, Homo sapiens
ccacugaagcagaugauga

SEQ ID NO: 1136040 - RNA, 19 nt, Homo sapiens
gagcuaacagugccaacaa

SEQ ID NO: 1136041 - RNA, 19 nt, Homo sapiens
uaucaucuguguaguaggu

SEQ ID NO: 1136042 - RNA, 19 nt, Homo sapiens
gcaaaacccagaaacauga

SEQ ID NO: 1136043 - RNA, 19 nt, Homo sapiens
gagcggaaggugccuguga

SEQ ID NO: 1136044 - RNA, 19 nt, Homo sapiens
gaacaagcagcacaaacag

SEQ ID NO: 1136045 - RNA, 19 nt, Homo sapiens
gugagaagugcaagaauga

SEQ ID NO: 1136046 - RNA, 19 nt, Homo sapiens
uuaacuccuuugcccaaua

SEQ ID NO: 1136047 - RNA, 19 nt, Homo sapiens
caaccugauucccgucaug

SEQ ID NO: 1136048 - RNA, 19 nt, Homo sapiens
aaacccaccugcagcacuu

SEQ ID NO: 1136049 - RNA, 19 nt, Homo sapiens
ggagcagauuggcauguuc

SEQ ID NO: 1136050 - RNA, 19 nt, Homo sapiens
gaugaaaacucucaacaac

SEQ ID NO: 1136051 - RNA, 19 nt, Homo sapiens
gaagaugaaagggcaacuu

SEQ ID NO: 1136052 - RNA, 19 nt, Homo sapiens
cauggaagacgcccacuug

SEQ ID NO: 1136053 - RNA, 19 nt, Homo sapiens
aacgagaucugcuacaaca

SEQ ID NO: 1136054 - RNA, 19 nt, Homo sapiens
ccaccuggcuaagaucuuc

SEQ ID NO: 1136055 - RNA, 19 nt, Homo sapiens
cguguguccucugaaauaa

SEQ ID NO: 1136056 - RNA, 19 nt, Homo sapiens
guagcgaggucguggugau

SEQ ID NO: 1136057 - RNA, 19 nt, Homo sapiens
ugaaaacucucaacaacga

SEQ ID NO: 1136058 - RNA, 19 nt, Homo sapiens
ccaguggacccuuuagaga

SEQ ID NO: 1136059 - RNA, 19 nt, Homo sapiens
gaggaggccuacagcaacu

SEQ ID NO: 1136060 - RNA, 19 nt, Homo sapiens
ccaggaugaugccuuuauc

SEQ ID NO: 1136061 - RNA, 19 nt, Homo sapiens
caacaagugcuccuuaagc

SEQ ID NO: 1136062 - RNA, 19 nt, Homo sapiens
uuccugaugugaauguuaa

SEQ ID NO: 1136063 - RNA, 19 nt, Homo sapiens
gaagugcaagaaugaagau

SEQ ID NO: 1136064 - RNA, 19 nt, Homo sapiens
caagguggcucuuuuggau

SEQ ID NO: 1136065 - RNA, 19 nt, Homo sapiens
gccaggagauucggaacga

SEQ ID NO: 1136066 - RNA, 19 nt, Homo sapiens
agaacaagcagcacaaaca

SEQ ID NO: 1136067 - RNA, 19 nt, Homo sapiens
ccguguguccucugaaaua

SEQ ID NO: 1136068 - RNA, 19 nt, Homo sapiens
gcuacgaggucaaggucau

SEQ ID NO: 1136069 - RNA, 19 nt, Homo sapiens
ccauagagaugaaguuccu

SEQ ID NO: 1136070 - RNA, 19 nt, Homo sapiens
ggcgaaauccauagagaug

SEQ ID NO: 1136071 - RNA, 19 nt, Homo sapiens
acgggaggcucuuugcaaa

SEQ ID NO: 1136072 - RNA, 19 nt, Homo sapiens
guguguauguguuucuaga

SEQ ID NO: 1136073 - RNA, 19 nt, Homo sapiens
uacagcaacuacugcaaga

SEQ ID NO: 1136074 - RNA, 19 nt, Homo sapiens
gcuacaacauccugguucu

SEQ ID NO: 1136075 - RNA, 19 nt, Homo sapiens
gaacgagaucugcuacaac

SEQ ID NO: 1136076 - RNA, 19 nt, Homo sapiens
uagagugagauuuguguuu

SEQ ID NO: 1136077 - RNA, 19 nt, Homo sapiens
caaucucuguucagugcaa

SEQ ID NO: 1136078 - RNA, 19 nt, Homo sapiens
ggugcagggucaggauaaa

SEQ ID NO: 1136079 - RNA, 19 nt, Homo sapiens
gaggguugguaaacagauc

SEQ ID NO: 1136080 - RNA, 19 nt, Homo sapiens
cccagagcaucaacaguga

SEQ ID NO: 1136081 - RNA, 19 nt, Homo sapiens
ucacagccgaggacauuga

SEQ ID NO: 1136082 - RNA, 19 nt, Homo sapiens
gcagauuggcauguucuug

SEQ ID NO: 1136083 - RNA, 19 nt, Homo sapiens
uguaguagguguguguaug

SEQ ID NO: 1136084 - RNA, 19 nt, Homo sapiens
gagaagugcaagaaugaag

SEQ ID NO: 1136085 - RNA, 19 nt, Homo sapiens
acagcugaauguuccuaaa

SEQ ID NO: 1136086 - RNA, 19 nt, Homo sapiens
guaguagguguguguaugu

SEQ ID NO: 1136087 - RNA, 19 nt, Homo sapiens
caguggacccuuuagagaa

SEQ ID NO: 1136088 - RNA, 19 nt, Homo sapiens
ggcgggacaaguuggaaua

SEQ ID NO: 1136089 - RNA, 19 nt, Homo sapiens
aauaagcagaugaagauga

SEQ ID NO: 1136090 - RNA, 19 nt, Homo sapiens
cacgguuucuguugcuaaa

SEQ ID NO: 1136091 - RNA, 19 nt, Homo sapiens
ccagcgcuuuccacgguuu

SEQ ID NO: 1136092 - RNA, 19 nt, Homo sapiens
cgagaucugcuacaacauc

SEQ ID NO: 1136093 - RNA, 19 nt, Homo sapiens
aaacaugaacagauacgau

SEQ ID NO: 1136094 - RNA, 19 nt, Homo sapiens
cgguuucuguugcuaaaug

SEQ ID NO: 1136095 - RNA, 19 nt, Homo sapiens
gcgaaauccauagagauga

SEQ ID NO: 1136096 - RNA, 19 nt, Homo sapiens
ggcugguucucaccuuuga

SEQ ID NO: 1136097 - RNA, 19 nt, Homo sapiens
guguauguguuucuagagu

SEQ ID NO: 1136098 - RNA, 19 nt, Homo sapiens
gaaggugcagggucaggau

SEQ ID NO: 1136099 - RNA, 19 nt, Homo sapiens
ccgagaagauccacaaccu

SEQ ID NO: 1136100 - RNA, 19 nt, Homo sapiens
ccaccgagaagauccacaa

SEQ ID NO: 1136101 - RNA, 19 nt, Homo sapiens
cgggcgaaauccauagaga

SEQ ID NO: 1136102 - RNA, 19 nt, Homo sapiens
gggucaggauaaacaugaa

SEQ ID NO: 1136103 - RNA, 19 nt, Homo sapiens
agaggcaggcccagcagua

SEQ ID NO: 1136104 - RNA, 19 nt, Homo sapiens
agagugagauuuguguuuu

SEQ ID NO: 1136105 - RNA, 19 nt, Homo sapiens
aacaugaacagauacgauu

SEQ ID NO: 1136106 - RNA, 19 nt, Homo sapiens
gggcaacuuuguuuucuuc

SEQ ID NO: 1136107 - RNA, 19 nt, Homo sapiens
gggcgaaauccauagagau

SEQ ID NO: 1136108 - RNA, 19 nt, Homo sapiens
ggacauuagucguuauauu

SEQ ID NO: 1136109 - RNA, 19 nt, Homo sapiens
gagaguacauuugcuuuaa

SEQ ID NO: 1136110 - RNA, 19 nt, Homo sapiens
caagugcgcuuugcaauau

SEQ ID NO: 1136111 - RNA, 19 nt, Homo sapiens
gagagcggcuggagaaaga

SEQ ID NO: 1136112 - RNA, 19 nt, Homo sapiens
ggagaguacauuugcuuua

SEQ ID NO: 1136113 - RNA, 19 nt, Homo sapiens
ggacaguaucguuuguuua

SEQ ID NO: 1136114 - RNA, 19 nt, Homo sapiens
gaauugcaguucagaaugg

SEQ ID NO: 1136115 - RNA, 19 nt, Homo sapiens
ggaagggacaguaucguuu

SEQ ID NO: 1136116 - RNA, 19 nt, Homo sapiens
gugauuggcugcaggaaga

SEQ ID NO: 1136117 - RNA, 19 nt, Homo sapiens
caguaucguuuguuuauga

SEQ ID NO: 1136118 - RNA, 19 nt, Homo sapiens
gggacaguaucguuuguuu

SEQ ID NO: 1136119 - RNA, 19 nt, Homo sapiens
gugauuggcugguuaaugg

SEQ ID NO: 1136120 - RNA, 19 nt, Homo sapiens
aucaacagcuucccuauuu

SEQ ID NO: 1136121 - RNA, 19 nt, Homo sapiens
gcaccaaaccuaaguccuu

SEQ ID NO: 1136122 - RNA, 19 nt, Homo sapiens
gacaguaucguuuguuuau

SEQ ID NO: 1136123 - RNA, 19 nt, Homo sapiens
cggaggagauguacauuca

SEQ ID NO: 1136124 - RNA, 19 nt, Homo sapiens
aaacucaggcccagaauug

SEQ ID NO: 1136125 - RNA, 19 nt, Homo sapiens
ccaagcaagucccuucaga

SEQ ID NO: 1136126 - RNA, 19 nt, Homo sapiens
gaagggacaguaucguuug

SEQ ID NO: 1136127 - RNA, 19 nt, Homo sapiens
ccaagugcgcuuugcaaua

SEQ ID NO: 1136128 - RNA, 19 nt, Homo sapiens
gagcucuggugcuuuaguu

SEQ ID NO: 1136129 - RNA, 19 nt, Homo sapiens
gaagugcacaggagccaaa

SEQ ID NO: 1136130 - RNA, 19 nt, Homo sapiens
caaagacucuggaggucau

SEQ ID NO: 1136131 - RNA, 19 nt, Homo sapiens
gggauggacuugugauugg

SEQ ID NO: 1136132 - RNA, 19 nt, Homo sapiens
uuaaagggauggacuugug

SEQ ID NO: 1136133 - RNA, 19 nt, Homo sapiens
gcugcugccuucacauuug

SEQ ID NO: 1136134 - RNA, 19 nt, Homo sapiens
ggaagaguccggaggagau

SEQ ID NO: 1136135 - RNA, 19 nt, Homo sapiens
uccgagcucuggugcuuua

SEQ ID NO: 1136136 - RNA, 19 nt, Homo sapiens
ggagcuuugugucgucuug

SEQ ID NO: 1136137 - RNA, 19 nt, Homo sapiens
gaaaugugaagaggucuga

SEQ ID NO: 1136138 - RNA, 19 nt, Homo sapiens
aacagggucugggacauua

SEQ ID NO: 1136139 - RNA, 19 nt, Homo sapiens
gauucgagcaucaggcuaa

SEQ ID NO: 1136140 - RNA, 19 nt, Homo sapiens
gcucuggaguucucucauc

SEQ ID NO: 1136141 - RNA, 19 nt, Homo sapiens
gagcccagaacccacauaa

SEQ ID NO: 1136142 - RNA, 19 nt, Homo sapiens
gugcacaggagccaaauga

SEQ ID NO: 1136143 - RNA, 19 nt, Homo sapiens
agauguacauucagcagaa

SEQ ID NO: 1136144 - RNA, 19 nt, Homo sapiens
gaggaaaagucaaaguguu

SEQ ID NO: 1136145 - RNA, 19 nt, Homo sapiens
ucugggacauuagucguua

SEQ ID NO: 1136146 - RNA, 19 nt, Homo sapiens
gcaccuguuugccugaagu

SEQ ID NO: 1136147 - RNA, 19 nt, Homo sapiens
cagcgucccuuggugagaa

SEQ ID NO: 1136148 - RNA, 19 nt, Homo sapiens
ccaucagccuguuccagaa

SEQ ID NO: 1136149 - RNA, 19 nt, Homo sapiens
ggcggcaccuuccuacuuc

SEQ ID NO: 1136150 - RNA, 19 nt, Homo sapiens
cugauuggcugcuuaaacu

SEQ ID NO: 1136151 - RNA, 19 nt, Homo sapiens
ugaaguuaauuuccagaag

SEQ ID NO: 1136152 - RNA, 19 nt, Homo sapiens
cagaauugcaguucagaau

SEQ ID NO: 1136153 - RNA, 19 nt, Homo sapiens
gagcaccuguuugccugaa

SEQ ID NO: 1136154 - RNA, 19 nt, Homo sapiens
gcccagaacccacauaaaa

SEQ ID NO: 1136155 - RNA, 19 nt, Homo sapiens
aguggugcguuuauaauug

SEQ ID NO: 1136156 - RNA, 19 nt, Homo sapiens
ggcuccauauuucaacuaa

SEQ ID NO: 1136157 - RNA, 19 nt, Homo sapiens
gaucacaggccuugcuuuu

SEQ ID NO: 1136158 - RNA, 19 nt, Homo sapiens
aaccaaaucuuuccccuuu

SEQ ID NO: 1136159 - RNA, 19 nt, Homo sapiens
acccagcucuguccucuug

SEQ ID NO: 1136160 - RNA, 19 nt, Homo sapiens
cgaugcguguguuugguuu

SEQ ID NO: 1136161 - RNA, 19 nt, Homo sapiens
gaaaccaagugcgcuuugc

SEQ ID NO: 1136162 - RNA, 19 nt, Homo sapiens
cugcaaagcccuuggaaca

SEQ ID NO: 1136163 - RNA, 19 nt, Homo sapiens
ucacaggccuugcuuuugu

SEQ ID NO: 1136164 - RNA, 19 nt, Homo sapiens
ggucugauuggcugcuuaa

SEQ ID NO: 1136165 - RNA, 19 nt, Homo sapiens
uauaucuguuggagaaaga

SEQ ID NO: 1136166 - RNA, 19 nt, Homo sapiens
caaacucaggcccagaauu

SEQ ID NO: 1136167 - RNA, 19 nt, Homo sapiens
uaucaacagcuucccuauu

SEQ ID NO: 1136168 - RNA, 19 nt, Homo sapiens
guguugcuguggcuccaua

SEQ ID NO: 1136169 - RNA, 19 nt, Homo sapiens
aaacagggucugggacauu

SEQ ID NO: 1136170 - RNA, 19 nt, Homo sapiens
uaaagggauggacuuguga

SEQ ID NO: 1136171 - RNA, 19 nt, Homo sapiens
cacccuggaugcuguugaa

SEQ ID NO: 1136172 - RNA, 19 nt, Homo sapiens
gcuccauauuucaacuaaa

SEQ ID NO: 1136173 - RNA, 19 nt, Homo sapiens
gaagaguccggaggagaug

SEQ ID NO: 1136174 - RNA, 19 nt, Homo sapiens
ccaccuggagaguacauuu

SEQ ID NO: 1136175 - RNA, 19 nt, Homo sapiens
gcuccugagugucaugaag

SEQ ID NO: 1136176 - RNA, 19 nt, Homo sapiens
ucucagaaccaaaucuuuc

SEQ ID NO: 1136177 - RNA, 19 nt, Homo sapiens
ccagugggacccucucaga

SEQ ID NO: 1136178 - RNA, 19 nt, Homo sapiens
ccagggaccgacagacuug

SEQ ID NO: 1136179 - RNA, 19 nt, Homo sapiens
ugacuccuguugccaugga

SEQ ID NO: 1136180 - RNA, 19 nt, Homo sapiens
uguguuugguuucccauug

SEQ ID NO: 1136181 - RNA, 19 nt, Homo sapiens
gucguuauauuugacuuga

SEQ ID NO: 1136182 - RNA, 19 nt, Homo sapiens
aaggugaguucuuucaucu

SEQ ID NO: 1136183 - RNA, 19 nt, Homo sapiens
gugugcaugugcuguguga

SEQ ID NO: 1136184 - RNA, 19 nt, Homo sapiens
gccaaacucaggcccagaa

SEQ ID NO: 1136185 - RNA, 19 nt, Homo sapiens
gaaaagaaagaaaccaagu

SEQ ID NO: 1136186 - RNA, 19 nt, Homo sapiens
cagguguucugcugauauc

SEQ ID NO: 1136187 - RNA, 19 nt, Homo sapiens
ccuguuugccugaaguuaa

SEQ ID NO: 1136188 - RNA, 19 nt, Homo sapiens
ggagagcggcuggagaaag

SEQ ID NO: 1136189 - RNA, 19 nt, Homo sapiens
gaugggaucaaaccugaca

SEQ ID NO: 1136190 - RNA, 19 nt, Homo sapiens
cggaagaccggaggcagua

SEQ ID NO: 1136191 - RNA, 19 nt, Homo sapiens
gugcuuuaguuaggucauu

SEQ ID NO: 1136192 - RNA, 19 nt, Homo sapiens
gggcagcgcaugugugcau

SEQ ID NO: 1136193 - RNA, 19 nt, Homo sapiens
guggugcguuuauaauugg

SEQ ID NO: 1136194 - RNA, 19 nt, Homo sapiens
caguggugcguuuauaauu

SEQ ID NO: 1136195 - RNA, 19 nt, Homo sapiens
ccaguggugcguuuauaau

SEQ ID NO: 1136196 - RNA, 19 nt, Homo sapiens
ugcggaagaugggaucaaa

SEQ ID NO: 1136197 - RNA, 19 nt, Homo sapiens
gcccagaauugcaguucag

SEQ ID NO: 1136198 - RNA, 19 nt, Homo sapiens
ccuucagacuggcccuuaa

SEQ ID NO: 1136199 - RNA, 19 nt, Homo sapiens
ggaccgacagacuugacaa

SEQ ID NO: 1136200 - RNA, 19 nt, Homo sapiens
gcccagcagaggcguacua

SEQ ID NO: 1136201 - RNA, 19 nt, Homo sapiens
gcucuggugcuuuaguuag

SEQ ID NO: 1136202 - RNA, 19 nt, Homo sapiens
ucuccgagcucuggugcuu

SEQ ID NO: 1136203 - RNA, 19 nt, Homo sapiens
aaggaggauucgagcauca

SEQ ID NO: 1136204 - RNA, 19 nt, Homo sapiens
gggcaggucuaguguuccu

SEQ ID NO: 1136205 - RNA, 19 nt, Homo sapiens
gauguacauucagcagaag

SEQ ID NO: 1136206 - RNA, 19 nt, Homo sapiens
agugcgcuuugcaauauuu

SEQ ID NO: 1136207 - RNA, 19 nt, Homo sapiens
caacagcuucccuauuuug

SEQ ID NO: 1136208 - RNA, 19 nt, Homo sapiens
cgacaaaugugauaccuua

SEQ ID NO: 1136209 - RNA, 19 nt, Homo sapiens
ggacguagaaugaaauuua

SEQ ID NO: 1136210 - RNA, 19 nt, Homo sapiens
gaaaugauguacuggauga

SEQ ID NO: 1136211 - RNA, 19 nt, Homo sapiens
ggaaagcacugcaaguaug

SEQ ID NO: 1136212 - RNA, 19 nt, Homo sapiens
ggaaugcugugguagagua

SEQ ID NO: 1136213 - RNA, 19 nt, Homo sapiens
ggacacaaaugauaucugu

SEQ ID NO: 1136214 - RNA, 19 nt, Homo sapiens
ggucaucucuuacauucua

SEQ ID NO: 1136215 - RNA, 19 nt, Homo sapiens
gaagauaguggauugagua

SEQ ID NO: 1136216 - RNA, 19 nt, Homo sapiens
ggccagcaguuucuauuua

SEQ ID NO: 1136217 - RNA, 19 nt, Homo sapiens
uaaccuggcuggugacgua

SEQ ID NO: 1136218 - RNA, 19 nt, Homo sapiens
ggagugaccucucugacuu

SEQ ID NO: 1136219 - RNA, 19 nt, Homo sapiens
uauacuagcucacaucuga

SEQ ID NO: 1136220 - RNA, 19 nt, Homo sapiens
gagaaaaccuucaacacua

SEQ ID NO: 1136221 - RNA, 19 nt, Homo sapiens
cugcagagcucacgacaaa

SEQ ID NO: 1136222 - RNA, 19 nt, Homo sapiens
acaagaagaugaagaggaa

SEQ ID NO: 1136223 - RNA, 19 nt, Homo sapiens
caguaaaggugaauucuug

SEQ ID NO: 1136224 - RNA, 19 nt, Homo sapiens
agacggcucuggugcaaua

SEQ ID NO: 1136225 - RNA, 19 nt, Homo sapiens
gauguacgcuauucuuuca

SEQ ID NO: 1136226 - RNA, 19 nt, Homo sapiens
ugauacugcuguucucuua

SEQ ID NO: 1136227 - RNA, 19 nt, Homo sapiens
agaauuaacucaacagauc

SEQ ID NO: 1136228 - RNA, 19 nt, Homo sapiens
caacgugaauaaacaaugu

SEQ ID NO: 1136229 - RNA, 19 nt, Homo sapiens
ggugaauucuugcuaaaug

SEQ ID NO: 1136230 - RNA, 19 nt, Homo sapiens
ugacaacuacuuagcuuua

SEQ ID NO: 1136231 - RNA, 19 nt, Homo sapiens
gaacacagccuacuaucag

SEQ ID NO: 1136232 - RNA, 19 nt, Homo sapiens
gcagacaacagaaugguuu

SEQ ID NO: 1136233 - RNA, 19 nt, Homo sapiens
cuaagucacugaaaggaaa

SEQ ID NO: 1136234 - RNA, 19 nt, Homo sapiens
caucugaagucaacaugaa

SEQ ID NO: 1136235 - RNA, 19 nt, Homo sapiens
gcaggaacauuuaauacag

SEQ ID NO: 1136236 - RNA, 19 nt, Homo sapiens
gccagcaguuucuauuuaa

SEQ ID NO: 1136237 - RNA, 19 nt, Homo sapiens
caucuacugugccaaauau

SEQ ID NO: 1136238 - RNA, 19 nt, Homo sapiens
ggacaucuacugugccaaa

SEQ ID NO: 1136239 - RNA, 19 nt, Homo sapiens
gaugacaacuacuuagcuu

SEQ ID NO: 1136240 - RNA, 19 nt, Homo sapiens
uauaaagacccaaguauug

SEQ ID NO: 1136241 - RNA, 19 nt, Homo sapiens
aaaggugaauucuugcuaa

SEQ ID NO: 1136242 - RNA, 19 nt, Homo sapiens
gcacugcaaguauggauuu

SEQ ID NO: 1136243 - RNA, 19 nt, Homo sapiens
cgaggcaagugaaauuauu

SEQ ID NO: 1136244 - RNA, 19 nt, Homo sapiens
acaacagaaugguuucaua

SEQ ID NO: 1136245 - RNA, 19 nt, Homo sapiens
uacaaaggcuaugucaaua

SEQ ID NO: 1136246 - RNA, 19 nt, Homo sapiens
caagcacuguuucuacaaa

SEQ ID NO: 1136247 - RNA, 19 nt, Homo sapiens
ggagaagggcuauuugugu

SEQ ID NO: 1136248 - RNA, 19 nt, Homo sapiens
gaagcaccaugcaguuugu

SEQ ID NO: 1136249 - RNA, 19 nt, Homo sapiens
aaacagacgaugacaacua

SEQ ID NO: 1136250 - RNA, 19 nt, Homo sapiens
gcagagcucacgacaaaug

SEQ ID NO: 1136251 - RNA, 19 nt, Homo sapiens
ggugcucucuaucuguuua

SEQ ID NO: 1136252 - RNA, 19 nt, Homo sapiens
ccacgaacguccacuucaa

SEQ ID NO: 1136253 - RNA, 19 nt, Homo sapiens
gauaguggauugaguacag

SEQ ID NO: 1136254 - RNA, 19 nt, Homo sapiens
gcacauuccggucucauga

SEQ ID NO: 1136255 - RNA, 19 nt, Homo sapiens
gcucacaucugaagucaac

SEQ ID NO: 1136256 - RNA, 19 nt, Homo sapiens
gaggcaagugaaauuauua

SEQ ID NO: 1136257 - RNA, 19 nt, Homo sapiens
cgauaauucuucaugcaaa

SEQ ID NO: 1136258 - RNA, 19 nt, Homo sapiens
ucucaggugugcccauaua

SEQ ID NO: 1136259 - RNA, 19 nt, Homo sapiens
cuacaaaggcuaugucaau

SEQ ID NO: 1136260 - RNA, 19 nt, Homo sapiens
gcaaaugcacacaucaaga

SEQ ID NO: 1136261 - RNA, 19 nt, Homo sapiens
gaagucaacaugaaguuuc

SEQ ID NO: 1136262 - RNA, 19 nt, Homo sapiens
caagagaaaguuaccauuc

SEQ ID NO: 1136263 - RNA, 19 nt, Homo sapiens
gaugacaacaacaaaugua

SEQ ID NO: 1136264 - RNA, 19 nt, Homo sapiens
gaacugggaaccauuugug

SEQ ID NO: 1136265 - RNA, 19 nt, Homo sapiens
guaacuagucuaccaguga

SEQ ID NO: 1136266 - RNA, 19 nt, Homo sapiens
ggauguaacuagucuacca

SEQ ID NO: 1136267 - RNA, 19 nt, Homo sapiens
cagggaaucugaucagcuu

SEQ ID NO: 1136268 - RNA, 19 nt, Homo sapiens
ggaaacagacgaugacaac

SEQ ID NO: 1136269 - RNA, 19 nt, Homo sapiens
uaaauacaguggaauucug

SEQ ID NO: 1136270 - RNA, 19 nt, Homo sapiens
gagcugggccauguguuua

SEQ ID NO: 1136271 - RNA, 19 nt, Homo sapiens
agagagcccucaacaggaa

SEQ ID NO: 1136272 - RNA, 19 nt, Homo sapiens
caccuucccuccucuuuga

SEQ ID NO: 1136273 - RNA, 19 nt, Homo sapiens
gcacacaucaagagaaagu

SEQ ID NO: 1136274 - RNA, 19 nt, Homo sapiens
ggccaggacacaaaugaua

SEQ ID NO: 1136275 - RNA, 19 nt, Homo sapiens
ggaagcaccaugcaguuug

SEQ ID NO: 1136276 - RNA, 19 nt, Homo sapiens
uagagacccugggcgaaua

SEQ ID NO: 1136277 - RNA, 19 nt, Homo sapiens
gaugggagggcuguuauuu

SEQ ID NO: 1136278 - RNA, 19 nt, Homo sapiens
aagagaaaguuaccauuca

SEQ ID NO: 1136279 - RNA, 19 nt, Homo sapiens
gaagguugaugaugguuuu

SEQ ID NO: 1136280 - RNA, 19 nt, Homo sapiens
gaacggaaacgaaaacuug

SEQ ID NO: 1136281 - RNA, 19 nt, Homo sapiens
gaacgcgacggagcauuaa

SEQ ID NO: 1136282 - RNA, 19 nt, Homo sapiens
cuagaucacucacuguugu

SEQ ID NO: 1136283 - RNA, 19 nt, Homo sapiens
ggagacuggucagagguaa

SEQ ID NO: 1136284 - RNA, 19 nt, Homo sapiens
gaaaagaggacccacagaa

SEQ ID NO: 1136285 - RNA, 19 nt, Homo sapiens
uaggucaucucuuacauuc

SEQ ID NO: 1136286 - RNA, 19 nt, Homo sapiens
uaagaugggagggcuguua

SEQ ID NO: 1136287 - RNA, 19 nt, Homo sapiens
gagaacccuuucccacgaa

SEQ ID NO: 1136288 - RNA, 19 nt, Homo sapiens
acacaucaagagaaaguua

SEQ ID NO: 1136289 - RNA, 19 nt, Homo sapiens
gaagggcuauuugugucaa

SEQ ID NO: 1136290 - RNA, 19 nt, Homo sapiens
ggaacacagccuacuauca

SEQ ID NO: 1136291 - RNA, 19 nt, Homo sapiens
gaagcuguucuauuaguga

SEQ ID NO: 1136292 - RNA, 19 nt, Homo sapiens
gcaagaaaauggggagaaa

SEQ ID NO: 1136293 - RNA, 19 nt, Homo sapiens
uaacucaacagaucgcauu

SEQ ID NO: 1136294 - RNA, 19 nt, Homo sapiens
uaaagaagaaggaguuaag

SEQ ID NO: 1136295 - RNA, 19 nt, Homo sapiens
caccaugacugucguacug

SEQ ID NO: 1136296 - RNA, 19 nt, Homo sapiens
gucaauacccgaaaugaug

SEQ ID NO: 1136297 - RNA, 19 nt, Homo sapiens
agacugagaagguugauga

SEQ ID NO: 1136298 - RNA, 19 nt, Homo sapiens
gacaacuacuuagcuuuau

SEQ ID NO: 1136299 - RNA, 19 nt, Homo sapiens
gaaggaccggugcaaguug

SEQ ID NO: 1136300 - RNA, 19 nt, Homo sapiens
guggaauucugaugaagga

SEQ ID NO: 1136301 - RNA, 19 nt, Homo sapiens
caacagaccagaaccaaaa

SEQ ID NO: 1136302 - RNA, 19 nt, Homo sapiens
ggaaccugcuccagaacau

SEQ ID NO: 1136303 - RNA, 19 nt, Homo sapiens
guucucaggugugcccaua

SEQ ID NO: 1136304 - RNA, 19 nt, Homo sapiens
uagccucuaucuauaaaga

SEQ ID NO: 1136305 - RNA, 19 nt, Homo sapiens
gaagaaaaccagagcaaga

SEQ ID NO: 1136306 - RNA, 19 nt, Homo sapiens
agaacgcgacggagcauua

SEQ ID NO: 1136307 - RNA, 19 nt, Homo sapiens
gacagcaaaugcacacauc

SEQ ID NO: 1136308 - RNA, 19 nt, Homo sapiens
gcacagggcugguacauug

SEQ ID NO: 1136309 - RNA, 19 nt, Homo sapiens
gaaagcaacucuccuaaag

SEQ ID NO: 1136310 - RNA, 19 nt, Homo sapiens
gcaaagagcugagagaauc

SEQ ID NO: 1136311 - RNA, 19 nt, Homo sapiens
gaaauucacuucuguuugg

SEQ ID NO: 1136312 - RNA, 19 nt, Homo sapiens
ccacacagcagcuuuguua

SEQ ID NO: 1136313 - RNA, 19 nt, Homo sapiens
ugacaaggcuucagcaaug

SEQ ID NO: 1136314 - RNA, 19 nt, Homo sapiens
gcacuagggcuaccucuuu

SEQ ID NO: 1136315 - RNA, 19 nt, Homo sapiens
cacaauugcucauuagaaa

SEQ ID NO: 1136316 - RNA, 19 nt, Homo sapiens
caacagagcauaacauucu

SEQ ID NO: 1136317 - RNA, 19 nt, Homo sapiens
gaguaaagagggaugaaua

SEQ ID NO: 1136318 - RNA, 19 nt, Homo sapiens
gaacagagguauggaacag

SEQ ID NO: 1136319 - RNA, 19 nt, Homo sapiens
ucacuuaacuguguaacuu

SEQ ID NO: 1136320 - RNA, 19 nt, Homo sapiens
acucucaccuccuucauua

SEQ ID NO: 1136321 - RNA, 19 nt, Homo sapiens
ggaaagcaacucuccuaaa

SEQ ID NO: 1136322 - RNA, 19 nt, Homo sapiens
aaacagggcccuaacuaaa

SEQ ID NO: 1136323 - RNA, 19 nt, Homo sapiens
aaacagggcccuaacuaaa

SEQ ID NO: 1136324 - RNA, 19 nt, Homo sapiens
ucccagaggucuagcauaa

SEQ ID NO: 1136325 - RNA, 19 nt, Homo sapiens
uaaacugggcccucacuua

SEQ ID NO: 1136326 - RNA, 19 nt, Homo sapiens
ccgaagcacuggacaaaga

SEQ ID NO: 1136327 - RNA, 19 nt, Homo sapiens
gcacaauugcucauuagaa

SEQ ID NO: 1136328 - RNA, 19 nt, Homo sapiens
caaggguucugauaaugaa

SEQ ID NO: 1136329 - RNA, 19 nt, Homo sapiens
aaacugggcccucacuuaa

SEQ ID NO: 1136330 - RNA, 19 nt, Homo sapiens
gacaaucagucaagcucua

SEQ ID NO: 1136331 - RNA, 19 nt, Homo sapiens
ccucaagucuucuacaaau

SEQ ID NO: 1136332 - RNA, 19 nt, Homo sapiens
gcuaugagcacuaccugua

SEQ ID NO: 1136333 - RNA, 19 nt, Homo sapiens
caacaaggacacaaagcua

SEQ ID NO: 1136334 - RNA, 19 nt, Homo sapiens
aaagagggaugaauaagca

SEQ ID NO: 1136335 - RNA, 19 nt, Homo sapiens
gaauucaguuuacagucaa

SEQ ID NO: 1136336 - RNA, 19 nt, Homo sapiens
ugaauucaguuuacaguca

SEQ ID NO: 1136337 - RNA, 19 nt, Homo sapiens
gagauaucaugcuucuauu

SEQ ID NO: 1136338 - RNA, 19 nt, Homo sapiens
cguaaguccuguauucauu

SEQ ID NO: 1136339 - RNA, 19 nt, Homo sapiens
cagccucccucacuucuuu

SEQ ID NO: 1136340 - RNA, 19 nt, Homo sapiens
gggcuacggugauguuuca

SEQ ID NO: 1136341 - RNA, 19 nt, Homo sapiens
gaugaaaccugucccuacu

SEQ ID NO: 1136342 - RNA, 19 nt, Homo sapiens
ccucauggcuuaucaggau

SEQ ID NO: 1136343 - RNA, 19 nt, Homo sapiens
cuucagagcuguacguuag

SEQ ID NO: 1136344 - RNA, 19 nt, Homo sapiens
ugaaaccugucccuacuga

SEQ ID NO: 1136345 - RNA, 19 nt, Homo sapiens
gggauaaaggaacaaauaa

SEQ ID NO: 1136346 - RNA, 19 nt, Homo sapiens
ggacaucuuguuucuaguu

SEQ ID NO: 1136347 - RNA, 19 nt, Homo sapiens
aaacaaagggcacagaaug

SEQ ID NO: 1136348 - RNA, 19 nt, Homo sapiens
ggaaagagcacuggauugg

SEQ ID NO: 1136349 - RNA, 19 nt, Homo sapiens
gcacaagacccagaauuag

SEQ ID NO: 1136350 - RNA, 19 nt, Homo sapiens
cagcagaaccuuuggauag

SEQ ID NO: 1136351 - RNA, 19 nt, Homo sapiens
gaggaaagagcacuggauu

SEQ ID NO: 1136352 - RNA, 19 nt, Homo sapiens
gcaggagaaucacuuguac

SEQ ID NO: 1136353 - RNA, 19 nt, Homo sapiens
ucagauuuauguccaaaga

SEQ ID NO: 1136354 - RNA, 19 nt, Homo sapiens
gaaggugggcagaauccua

SEQ ID NO: 1136355 - RNA, 19 nt, Homo sapiens
gaaugggaaagucuuguuu

SEQ ID NO: 1136356 - RNA, 19 nt, Homo sapiens
gaagaccuaugaggaaugg

SEQ ID NO: 1136357 - RNA, 19 nt, Homo sapiens
caagucacccuccugcuuu

SEQ ID NO: 1136358 - RNA, 19 nt, Homo sapiens
ggauagaaacccagcauuc

SEQ ID NO: 1136359 - RNA, 19 nt, Homo sapiens
ggacugggccauuacaauc

SEQ ID NO: 1136360 - RNA, 19 nt, Homo sapiens
ccagagacuuggcaaaugg

SEQ ID NO: 1136361 - RNA, 19 nt, Homo sapiens
uauuagcucugccuccuuu

SEQ ID NO: 1136362 - RNA, 19 nt, Homo sapiens
guauugcucuaccuaccua

SEQ ID NO: 1136363 - RNA, 19 nt, Homo sapiens
gcaagucacccuccugcuu

SEQ ID NO: 1136364 - RNA, 19 nt, Homo sapiens
gauagaaacccagcauuca

SEQ ID NO: 1136365 - RNA, 19 nt, Homo sapiens
ggacuaauuguucugaaau

SEQ ID NO: 1136366 - RNA, 19 nt, Homo sapiens
ggacucugcucuucuacag

SEQ ID NO: 1136367 - RNA, 19 nt, Homo sapiens
gaccaaggcacccauccua

SEQ ID NO: 1136368 - RNA, 19 nt, Homo sapiens
agagauaucaugcuucuau

SEQ ID NO: 1136369 - RNA, 19 nt, Homo sapiens
aagcaacucuccuaaaguc

SEQ ID NO: 1136370 - RNA, 19 nt, Homo sapiens
gccuaaauaucucucaaau

SEQ ID NO: 1136371 - RNA, 19 nt, Homo sapiens
ucccaggacugcccaauga

SEQ ID NO: 1136372 - RNA, 19 nt, Homo sapiens
ccuauugcauggcugaauu

SEQ ID NO: 1136373 - RNA, 19 nt, Homo sapiens
cauuagagauaucaugcuu

SEQ ID NO: 1136374 - RNA, 19 nt, Homo sapiens
caaagccucugggaagaau

SEQ ID NO: 1136375 - RNA, 19 nt, Homo sapiens
acagagguauggaacagaa

SEQ ID NO: 1136376 - RNA, 19 nt, Homo sapiens
gguaacagcauguccaauc

SEQ ID NO: 1136377 - RNA, 19 nt, Homo sapiens
uaugagcacuaccuguaaa

SEQ ID NO: 1136378 - RNA, 19 nt, Homo sapiens
gcacuggauuggacaucga

SEQ ID NO: 1136379 - RNA, 19 nt, Homo sapiens
ggaugguccuugugucugu

SEQ ID NO: 1136380 - RNA, 19 nt, Homo sapiens
ucagagcuguacguuagua

SEQ ID NO: 1136381 - RNA, 19 nt, Homo sapiens
ccauuacaaucaacaagga

SEQ ID NO: 1136382 - RNA, 19 nt, Homo sapiens
guaaacaaagggcacagaa

SEQ ID NO: 1136383 - RNA, 19 nt, Homo sapiens
aaaccagggcccuaacuaa

SEQ ID NO: 1136384 - RNA, 19 nt, Homo sapiens
aaaccagggcccuaacuaa

SEQ ID NO: 1136385 - RNA, 19 nt, Homo sapiens
gagagaauccugggaaagu

SEQ ID NO: 1136386 - RNA, 19 nt, Homo sapiens
acacagccaucguuauaca

SEQ ID NO: 1136387 - RNA, 19 nt, Homo sapiens
ggacaaagagagcuaugag

SEQ ID NO: 1136388 - RNA, 19 nt, Homo sapiens
guuggaagcugggcgauuc

SEQ ID NO: 1136389 - RNA, 19 nt, Homo sapiens
ggcaggagaaucacuugua

SEQ ID NO: 1136390 - RNA, 19 nt, Homo sapiens
acaagaaggugggcagaau

SEQ ID NO: 1136391 - RNA, 19 nt, Homo sapiens
gagccuaaauaucucucaa

SEQ ID NO: 1136392 - RNA, 19 nt, Homo sapiens
ggaaugggaaagucuuguu

SEQ ID NO: 1136393 - RNA, 19 nt, Homo sapiens
cguuaguacucugaaguua

SEQ ID NO: 1136394 - RNA, 19 nt, Homo sapiens
ucaagucuucuacaaauug

SEQ ID NO: 1136395 - RNA, 19 nt, Homo sapiens
gcacuaaaaucucucucuu

SEQ ID NO: 1136396 - RNA, 19 nt, Homo sapiens
ccagaggucuagcauaaaa

SEQ ID NO: 1136397 - RNA, 19 nt, Homo sapiens
uagaaacccagcauucaaa

SEQ ID NO: 1136398 - RNA, 19 nt, Homo sapiens
aaaucucucucuucuuaug

SEQ ID NO: 1136399 - RNA, 19 nt, Homo sapiens
gagcacuaccuguaaacaa

SEQ ID NO: 1136400 - RNA, 19 nt, Homo sapiens
guagugauccuuccugucu

SEQ ID NO: 1136401 - RNA, 19 nt, Homo sapiens
ggccacagcagacgcguaa

SEQ ID NO: 1136402 - RNA, 19 nt, Homo sapiens
gacaucuuguuucuaguug

SEQ ID NO: 1136403 - RNA, 19 nt, Homo sapiens
cccauaaccugaucguuuc

SEQ ID NO: 1136404 - RNA, 19 nt, Homo sapiens
gacaugugcuaaggacuug

SEQ ID NO: 1136405 - RNA, 19 nt, Homo sapiens
agaauuagacaaucaguca

SEQ ID NO: 1136406 - RNA, 19 nt, Homo sapiens
gggaaagcaacucuccuaa

SEQ ID NO: 1136407 - RNA, 19 nt, Homo sapiens
acgcguaaguccuguauuc

SEQ ID NO: 1136408 - RNA, 19 nt, Homo sapiens
ggaagaagcuuuaaaauuc

SEQ ID NO: 1136409 - RNA, 19 nt, Homo sapiens
gaacuaaacagcaaauuuc

SEQ ID NO: 1136410 - RNA, 19 nt, Homo sapiens
ggaacuaaacagcaaauuu

SEQ ID NO: 1136411 - RNA, 19 nt, Homo sapiens
gaauuuaggagacauaaga

SEQ ID NO: 1136412 - RNA, 19 nt, Homo sapiens
ggaauaauagcacuuguau

SEQ ID NO: 1136413 - RNA, 19 nt, Homo sapiens
caaauaagcauguugugau

SEQ ID NO: 1136414 - RNA, 19 nt, Homo sapiens
caacagcguuauugcaaca

SEQ ID NO: 1136415 - RNA, 19 nt, Homo sapiens
guacgugaaagacgaauuu

SEQ ID NO: 1136416 - RNA, 19 nt, Homo sapiens
aaugaaagguuaggaagaa

SEQ ID NO: 1136417 - RNA, 19 nt, Homo sapiens
ugaacaaauuggacaguug

SEQ ID NO: 1136418 - RNA, 19 nt, Homo sapiens
cuuaaugacuuucgugaug

SEQ ID NO: 1136419 - RNA, 19 nt, Homo sapiens
ccaauaggcaauuuaguau

SEQ ID NO: 1136420 - RNA, 19 nt, Homo sapiens
gauguacaauuccaacaag

SEQ ID NO: 1136421 - RNA, 19 nt, Homo sapiens
cccaauaggcaauuuagua

SEQ ID NO: 1136422 - RNA, 19 nt, Homo sapiens
cugcaucacuguucauuca

SEQ ID NO: 1136423 - RNA, 19 nt, Homo sapiens
guacaauuccaacaagguu

SEQ ID NO: 1136424 - RNA, 19 nt, Homo sapiens
ugacuuucgugaugaacaa

SEQ ID NO: 1136425 - RNA, 19 nt, Homo sapiens
gcaagaaugggagguguau

SEQ ID NO: 1136426 - RNA, 19 nt, Homo sapiens
uuaaugacuuucgugauga

SEQ ID NO: 1136427 - RNA, 19 nt, Homo sapiens
ucaaauaagcauguuguga

SEQ ID NO: 1136428 - RNA, 19 nt, Homo sapiens
auauuagucuucuggcuuu

SEQ ID NO: 1136429 - RNA, 19 nt, Homo sapiens
cuaaacagcaaauuucuag

SEQ ID NO: 1136430 - RNA, 19 nt, Homo sapiens
uaaugacuuucgugaugaa

SEQ ID NO: 1136431 - RNA, 19 nt, Homo sapiens
gcaucacuguucauucaca

SEQ ID NO: 1136432 - RNA, 19 nt, Homo sapiens
ugcaguauauggaucaaga

SEQ ID NO: 1136433 - RNA, 19 nt, Homo sapiens
caaugaaagguuaggaaga

SEQ ID NO: 1136434 - RNA, 19 nt, Homo sapiens
aaacccaauaggcaauuua

SEQ ID NO: 1136435 - RNA, 19 nt, Homo sapiens
caucaaauaagcauguugu

SEQ ID NO: 1136436 - RNA, 19 nt, Homo sapiens
cugagucuaugaaaccaaa

SEQ ID NO: 1136437 - RNA, 19 nt, Homo sapiens
cuuuaacugucauugguuu

SEQ ID NO: 1136438 - RNA, 19 nt, Homo sapiens
gguguaugcaacagcguua

SEQ ID NO: 1136439 - RNA, 19 nt, Homo sapiens
caucacuguucauucacaa

SEQ ID NO: 1136440 - RNA, 19 nt, Homo sapiens
agacaaaauucaacuggaa

SEQ ID NO: 1136441 - RNA, 19 nt, Homo sapiens
uggaauaauagcacuugua

SEQ ID NO: 1136442 - RNA, 19 nt, Homo sapiens
gucuauacaacaaagcuua

SEQ ID NO: 1136443 - RNA, 19 nt, Homo sapiens
gugaaagacgaauuuagga

SEQ ID NO: 1136444 - RNA, 19 nt, Homo sapiens
gcauguugugauaaugaua

SEQ ID NO: 1136445 - RNA, 19 nt, Homo sapiens
gcaacaggcuaacgaaaac

SEQ ID NO: 1136446 - RNA, 19 nt, Homo sapiens
guuaggaagaagcuuuaaa

SEQ ID NO: 1136447 - RNA, 19 nt, Homo sapiens
auaagaccguugguucuga

SEQ ID NO: 1136448 - RNA, 19 nt, Homo sapiens
ggcaauuuaguauuucuga

SEQ ID NO: 1136449 - RNA, 19 nt, Homo sapiens
aagcauguugugauaauga

SEQ ID NO: 1136450 - RNA, 19 nt, Homo sapiens
uaagcauguugugauaaug

SEQ ID NO: 1136451 - RNA, 19 nt, Homo sapiens
gaaugggagguguaugcaa

SEQ ID NO: 1136452 - RNA, 19 nt, Homo sapiens
gggcgaccaguacgugaaa

SEQ ID NO: 1136453 - RNA, 19 nt, Homo sapiens
guaugcaacagcguuauug

SEQ ID NO: 1136454 - RNA, 19 nt, Homo sapiens
ugauagauguacaauucca

SEQ ID NO: 1136455 - RNA, 19 nt, Homo sapiens
gacgaauuuaggagacaua

SEQ ID NO: 1136456 - RNA, 19 nt, Homo sapiens
uacaauuccaacaagguua

SEQ ID NO: 1136457 - RNA, 19 nt, Homo sapiens
guugugauaaugauagaug

SEQ ID NO: 1136458 - RNA, 19 nt, Homo sapiens
gaaagguuaggaagaagcu

SEQ ID NO: 1136459 - RNA, 19 nt, Homo sapiens
gauagauguacaauuccaa

SEQ ID NO: 1136460 - RNA, 19 nt, Homo sapiens
ggcacagcguuucuugcaa

SEQ ID NO: 1136461 - RNA, 19 nt, Homo sapiens
cgugaaagacgaauuuagg

SEQ ID NO: 1136462 - RNA, 19 nt, Homo sapiens
uacuuuaacugucauuggu

SEQ ID NO: 1136463 - RNA, 19 nt, Homo sapiens
cacaaugaaagguuaggaa

SEQ ID NO: 1136464 - RNA, 19 nt, Homo sapiens
ggauauuaugauugcagua

SEQ ID NO: 1136465 - RNA, 19 nt, Homo sapiens
guauuucugagucuaugaa

SEQ ID NO: 1136466 - RNA, 19 nt, Homo sapiens
agacauaagaccguugguu

SEQ ID NO: 1136467 - RNA, 19 nt, Homo sapiens
uaugauugcaguauaugga

SEQ ID NO: 1136468 - RNA, 19 nt, Homo sapiens
cgaggcacagcguuucuug

SEQ ID NO: 1136469 - RNA, 19 nt, Homo sapiens
acaauuccaacaagguuau

SEQ ID NO: 1136470 - RNA, 19 nt, Homo sapiens
cauaagaccguugguucug

SEQ ID NO: 1136471 - RNA, 19 nt, Homo sapiens
gauugcaguauauggauca

SEQ ID NO: 1136472 - RNA, 19 nt, Homo sapiens
caacagggcuucaaucaag

SEQ ID NO: 1136473 - RNA, 19 nt, Homo sapiens
caaagaagguuauagagau

SEQ ID NO: 1136474 - RNA, 19 nt, Homo sapiens
gaaagacucugugaaaaua

SEQ ID NO: 1136475 - RNA, 19 nt, Homo sapiens
gaugaaagacucugugaaa

SEQ ID NO: 1136476 - RNA, 19 nt, Homo sapiens
gcaaagcaguuacucuuca

SEQ ID NO: 1136477 - RNA, 19 nt, Homo sapiens
uaagaaaggugcagaaguc

SEQ ID NO: 1136478 - RNA, 19 nt, Homo sapiens
gcaaagacgagucaaagaa

SEQ ID NO: 1136479 - RNA, 19 nt, Homo sapiens
ggacguguuugacgaagaa

SEQ ID NO: 1136480 - RNA, 19 nt, Homo sapiens
ucaaacaccucaacuguag

SEQ ID NO: 1136481 - RNA, 19 nt, Homo sapiens
gcucaaacaucugaaauca

SEQ ID NO: 1136482 - RNA, 19 nt, Homo sapiens
gaaaggugcagaagucauu

SEQ ID NO: 1136483 - RNA, 19 nt, Homo sapiens
gaacagacagccaguuuag

SEQ ID NO: 1136484 - RNA, 19 nt, Homo sapiens
guucauauguagaauguug

SEQ ID NO: 1136485 - RNA, 19 nt, Homo sapiens
caccucaacuguaggguua

SEQ ID NO: 1136486 - RNA, 19 nt, Homo sapiens
caagagccauagugggaua

SEQ ID NO: 1136487 - RNA, 19 nt, Homo sapiens
ugggauagauuguucauau

SEQ ID NO: 1136488 - RNA, 19 nt, Homo sapiens
uggaauagaugcuggcaaa

SEQ ID NO: 1136489 - RNA, 19 nt, Homo sapiens
ggaacagacagccaguuua

SEQ ID NO: 1136490 - RNA, 19 nt, Homo sapiens
ugaugaagcuaaagaugaa

SEQ ID NO: 1136491 - RNA, 19 nt, Homo sapiens
ggaccuuugucauguaguu

SEQ ID NO: 1136492 - RNA, 19 nt, Homo sapiens
gauauggaccuuugucaug

SEQ ID NO: 1136493 - RNA, 19 nt, Homo sapiens
cagaacauuugguuuccua

SEQ ID NO: 1136494 - RNA, 19 nt, Homo sapiens
caaagcaguuacucuucaa

SEQ ID NO: 1136495 - RNA, 19 nt, Homo sapiens
gggcuucaaucaagguuau

SEQ ID NO: 1136496 - RNA, 19 nt, Homo sapiens
cagcgggaauggcagagua

SEQ ID NO: 1136497 - RNA, 19 nt, Homo sapiens
cgaggaacauugagugcuu

SEQ ID NO: 1136498 - RNA, 19 nt, Homo sapiens
gagcaugcacauucagaaa

SEQ ID NO: 1136499 - RNA, 19 nt, Homo sapiens
aaagaagguuauagagaug

SEQ ID NO: 1136500 - RNA, 19 nt, Homo sapiens
ucaaagaagguuauagaga

SEQ ID NO: 1136501 - RNA, 19 nt, Homo sapiens
ccuaucaguagauguauua

SEQ ID NO: 1136502 - RNA, 19 nt, Homo sapiens
gggauagauuguucauaug

SEQ ID NO: 1136503 - RNA, 19 nt, Homo sapiens
ugaagaguaugugcucaaa

SEQ ID NO: 1136504 - RNA, 19 nt, Homo sapiens
gaggaacauugagugcuuu

SEQ ID NO: 1136505 - RNA, 19 nt, Homo sapiens
ggauagauuguucauaugu

SEQ ID NO: 1136506 - RNA, 19 nt, Homo sapiens
aagaguaugugcucaaaca

SEQ ID NO: 1136507 - RNA, 19 nt, Homo sapiens
gggccuaucaguagaugua

SEQ ID NO: 1136508 - RNA, 19 nt, Homo sapiens
cagacagccaguuuaguua

SEQ ID NO: 1136509 - RNA, 19 nt, Homo sapiens
caucaaacaccucaacugu

SEQ ID NO: 1136510 - RNA, 19 nt, Homo sapiens
gugcagaagucauuuuaaa

SEQ ID NO: 1136511 - RNA, 19 nt, Homo sapiens
caacaccucaaacaacuau

SEQ ID NO: 1136512 - RNA, 19 nt, Homo sapiens
cgucccauguuguagauuu

SEQ ID NO: 1136513 - RNA, 19 nt, Homo sapiens
ggaugcaguuggccagugu

SEQ ID NO: 1136514 - RNA, 19 nt, Homo sapiens
acagacagccaguuuaguu

SEQ ID NO: 1136515 - RNA, 19 nt, Homo sapiens
gucccauguuguagauuua

SEQ ID NO: 1136516 - RNA, 19 nt, Homo sapiens
caaagacgagucaaagaag

SEQ ID NO: 1136517 - RNA, 19 nt, Homo sapiens
cagcugggccuaucaguag

SEQ ID NO: 1136518 - RNA, 19 nt, Homo sapiens
uuaaacagcugggccuauc

SEQ ID NO: 1136519 - RNA, 19 nt, Homo sapiens
ccacauggauuuuggaaca

SEQ ID NO: 1136520 - RNA, 19 nt, Homo sapiens
uauggaccuuugucaugua

SEQ ID NO: 1136521 - RNA, 19 nt, Homo sapiens
gcaguuggccagugugaag

SEQ ID NO: 1136522 - RNA, 19 nt, Homo sapiens
agacagccaguuuaguuaa

SEQ ID NO: 1136523 - RNA, 19 nt, Homo sapiens
ggacuccauugaggauaug

SEQ ID NO: 1136524 - RNA, 19 nt, Homo sapiens
uacaacaccucaaacaacu

SEQ ID NO: 1136525 - RNA, 19 nt, Homo sapiens
cacaggagcaugcacauuc

SEQ ID NO: 1136526 - RNA, 19 nt, Homo sapiens
acauuugguuuccuaacaa

SEQ ID NO: 1136527 - RNA, 19 nt, Homo sapiens
acaccucaaacaacuauaa

SEQ ID NO: 1136528 - RNA, 19 nt, Homo sapiens
ggagcaugcacauucagaa

SEQ ID NO: 1136529 - RNA, 19 nt, Homo sapiens
ggaauggcagaguaacaug

SEQ ID NO: 1136530 - RNA, 19 nt, Homo sapiens
gaacauugagugcuuugcu

SEQ ID NO: 1136531 - RNA, 19 nt, Homo sapiens
guacugguuucugcaucaa

SEQ ID NO: 1136532 - RNA, 19 nt, Homo sapiens
agucaaagaagguuauaga

SEQ ID NO: 1136533 - RNA, 19 nt, Homo sapiens
acaggagcaugcacauuca

SEQ ID NO: 1136534 - RNA, 19 nt, Homo sapiens
uugaggauauggaccuuug

SEQ ID NO: 1136535 - RNA, 19 nt, Homo sapiens
uggaacagacagccaguuu

SEQ ID NO: 1136536 - RNA, 19 nt, Homo sapiens
cgacuccgaggaacauuga

SEQ ID NO: 1136537 - RNA, 19 nt, Homo sapiens
ggacgacuccgaggaacau

SEQ ID NO: 1136538 - RNA, 19 nt, Homo sapiens
gaacauuugguuuccuaac

SEQ ID NO: 1136539 - RNA, 19 nt, Homo sapiens
uggcaaagcaguuacucuu

SEQ ID NO: 1136540 - RNA, 19 nt, Homo sapiens
ggauauggaccuuugucau

SEQ ID NO: 1136541 - RNA, 19 nt, Homo sapiens
gcaucaaacaccucaacug

SEQ ID NO: 1136542 - RNA, 19 nt, Homo sapiens
gaauagaugcuggcaaagc

SEQ ID NO: 1136543 - RNA, 19 nt, Homo sapiens
auagugggauagauuguuc

SEQ ID NO: 1136544 - RNA, 19 nt, Homo sapiens
gggacguguuugacgaaga

SEQ ID NO: 1136545 - RNA, 19 nt, Homo sapiens
gccuaucaguagauguauu

SEQ ID NO: 1136546 - RNA, 19 nt, Homo sapiens
gggaauggcagaguaacau

SEQ ID NO: 1136547 - RNA, 19 nt, Homo sapiens
uugaugaagcuaaagauga

SEQ ID NO: 1136548 - RNA, 19 nt, Homo sapiens
aacauuugguuuccuaaca

SEQ ID NO: 1136549 - RNA, 19 nt, Homo sapiens
uuacaacaccucaaacaac

SEQ ID NO: 1136550 - RNA, 19 nt, Homo sapiens
agacaaaggggacguguuu

SEQ ID NO: 1136551 - RNA, 19 nt, Homo sapiens
uccuaacaaucgaaauuug

SEQ ID NO: 1136552 - RNA, 19 nt, Homo sapiens
gcagaguaacaugcaaaga

SEQ ID NO: 1136553 - RNA, 19 nt, Homo sapiens
ucaacagggcuucaaucaa

SEQ ID NO: 1136554 - RNA, 19 nt, Homo sapiens
cagaguaacaugcaaagac

SEQ ID NO: 1136555 - RNA, 19 nt, Homo sapiens
cauuugguuuccuaacaau

SEQ ID NO: 1136556 - RNA, 19 nt, Homo sapiens
auauggaccuuugucaugu

SEQ ID NO: 1136557 - RNA, 19 nt, Homo sapiens
uggccagugugaagaguau

SEQ ID NO: 1136558 - RNA, 19 nt, Homo sapiens
ggcaaagcaguuacucuuc

SEQ ID NO: 1136559 - RNA, 19 nt, Homo sapiens
uguacugguuucugcauca

SEQ ID NO: 1136560 - RNA, 19 nt, Homo sapiens
gcuucaaucaagguuauaa

SEQ ID NO: 1136561 - RNA, 19 nt, Homo sapiens
acagcugggccuaucagua

SEQ ID NO: 1136562 - RNA, 19 nt, Homo sapiens
gccauagugggauagauug

SEQ ID NO: 1136563 - RNA, 19 nt, Homo sapiens
uaccuucccuuuucuaaug

SEQ ID NO: 1136564 - RNA, 19 nt, Homo sapiens
caccucaaacaacuauaaa

SEQ ID NO: 1136565 - RNA, 19 nt, Homo sapiens
gacgagucaaagaagguua

SEQ ID NO: 1136566 - RNA, 19 nt, Homo sapiens
uaaagaugaaagacucugu

SEQ ID NO: 1136567 - RNA, 19 nt, Homo sapiens
ucacuccaccgucccaugu

SEQ ID NO: 1136568 - RNA, 19 nt, Homo sapiens
gugaagaguaugugcucaa

SEQ ID NO: 1136569 - RNA, 19 nt, Homo sapiens
gagccauagugggauagau

SEQ ID NO: 1136570 - RNA, 19 nt, Homo sapiens
agaagguuauagagaugga

SEQ ID NO: 1136571 - RNA, 19 nt, Homo sapiens
gcagaagucauuuuaaacu

SEQ ID NO: 1136572 - RNA, 19 nt, Homo sapiens
gcacuuagcuuguucagau

SEQ ID NO: 1136573 - RNA, 19 nt, Homo sapiens
caacgugaaugcuguauuu

SEQ ID NO: 1136574 - RNA, 19 nt, Homo sapiens
agaaagagaugcaggauuu

SEQ ID NO: 1136575 - RNA, 19 nt, Homo sapiens
gcacaggccugguuuaaca

SEQ ID NO: 1136576 - RNA, 19 nt, Homo sapiens
ggaagacucuguuacugaa

SEQ ID NO: 1136577 - RNA, 19 nt, Homo sapiens
ugacuggucugcuugcuua

SEQ ID NO: 1136578 - RNA, 19 nt, Homo sapiens
gaagcucuguucucuauau

SEQ ID NO: 1136579 - RNA, 19 nt, Homo sapiens
guacuucaguguuuaaaga

SEQ ID NO: 1136580 - RNA, 19 nt, Homo sapiens
ggagagcaacuuuacuuua

SEQ ID NO: 1136581 - RNA, 19 nt, Homo sapiens
ggagaguuauuaucuagaa

SEQ ID NO: 1136582 - RNA, 19 nt, Homo sapiens
agaaugagcacaucuauaa

SEQ ID NO: 1136583 - RNA, 19 nt, Homo sapiens
gagagcaacuuuacuuuag

SEQ ID NO: 1136584 - RNA, 19 nt, Homo sapiens
ucaaagaaauggccaugaa

SEQ ID NO: 1136585 - RNA, 19 nt, Homo sapiens
ugaugaacauggugauuua

SEQ ID NO: 1136586 - RNA, 19 nt, Homo sapiens
ggacaucuauuaaagugau

SEQ ID NO: 1136587 - RNA, 19 nt, Homo sapiens
gaaauggccaugaauaugu

SEQ ID NO: 1136588 - RNA, 19 nt, Homo sapiens
gggagaugcugauaacaaa

SEQ ID NO: 1136589 - RNA, 19 nt, Homo sapiens
ggaaugaucuaugaaaucu

SEQ ID NO: 1136590 - RNA, 19 nt, Homo sapiens
guaacugcauggaaacuuu

SEQ ID NO: 1136591 - RNA, 19 nt, Homo sapiens
gagcuuuccuaaacuauug

SEQ ID NO: 1136592 - RNA, 19 nt, Homo sapiens
ggacacuguuguuuacauu

SEQ ID NO: 1136593 - RNA, 19 nt, Homo sapiens
agacaagacuuacugaaug

SEQ ID NO: 1136594 - RNA, 19 nt, Homo sapiens
gauaaugacuucgcugaau

SEQ ID NO: 1136595 - RNA, 19 nt, Homo sapiens
caacagagaaggcaaacaa

SEQ ID NO: 1136596 - RNA, 19 nt, Homo sapiens
aaaccaagauucugcaaau

SEQ ID NO: 1136597 - RNA, 19 nt, Homo sapiens
guagauaaccagauuguug

SEQ ID NO: 1136598 - RNA, 19 nt, Homo sapiens
uaagaaccgugcccgagua

SEQ ID NO: 1136599 - RNA, 19 nt, Homo sapiens
uuacagagauugaagauac

SEQ ID NO: 1136600 - RNA, 19 nt, Homo sapiens
agacauggauaccuacgua

SEQ ID NO: 1136601 - RNA, 19 nt, Homo sapiens
gagagaugcaaauguaaua

SEQ ID NO: 1136602 - RNA, 19 nt, Homo sapiens
gcucuguucucuauauuau

SEQ ID NO: 1136603 - RNA, 19 nt, Homo sapiens
acacuaugcugacaagauu

SEQ ID NO: 1136604 - RNA, 19 nt, Homo sapiens
auacaaagaugguucacuu

SEQ ID NO: 1136605 - RNA, 19 nt, Homo sapiens
acugagagaugcaaaugua

SEQ ID NO: 1136606 - RNA, 19 nt, Homo sapiens
ccaugaauauguguaagua

SEQ ID NO: 1136607 - RNA, 19 nt, Homo sapiens
aaagaaauggccaugaaua

SEQ ID NO: 1136608 - RNA, 19 nt, Homo sapiens
ccaagauucugcaaauaau

SEQ ID NO: 1136609 - RNA, 19 nt, Homo sapiens
gauugaagauaccuggaaa

SEQ ID NO: 1136610 - RNA, 19 nt, Homo sapiens
caacugagaaauccuuauu

SEQ ID NO: 1136611 - RNA, 19 nt, Homo sapiens
gaaccgugcccgaguagaa

SEQ ID NO: 1136612 - RNA, 19 nt, Homo sapiens
gacaagacuuacugaaugu

SEQ ID NO: 1136613 - RNA, 19 nt, Homo sapiens
gaagccaaguuugaugauu

SEQ ID NO: 1136614 - RNA, 19 nt, Homo sapiens
ggagggagauacugagagu

SEQ ID NO: 1136615 - RNA, 19 nt, Homo sapiens
cuauaaagacugacucuaa

SEQ ID NO: 1136616 - RNA, 19 nt, Homo sapiens
aaagggcucuguuucaaga

SEQ ID NO: 1136617 - RNA, 19 nt, Homo sapiens
gcucugaauucacaggaaa

SEQ ID NO: 1136618 - RNA, 19 nt, Homo sapiens
guaaagccaucccagagau

SEQ ID NO: 1136619 - RNA, 19 nt, Homo sapiens
gagaaggagcgaaucauga

SEQ ID NO: 1136620 - RNA, 19 nt, Homo sapiens
ugauggaacuaacaaagaa

SEQ ID NO: 1136621 - RNA, 19 nt, Homo sapiens
ccuaaagucccauacauuu

SEQ ID NO: 1136622 - RNA, 19 nt, Homo sapiens
ugaaauggcuauaaagacu

SEQ ID NO: 1136623 - RNA, 19 nt, Homo sapiens
ggaaugauggauacaaaga

SEQ ID NO: 1136624 - RNA, 19 nt, Homo sapiens
gugaucaagugcaaauaaa

SEQ ID NO: 1136625 - RNA, 19 nt, Homo sapiens
cagaacagcugggagaguu

SEQ ID NO: 1136626 - RNA, 19 nt, Homo sapiens
caaagugaaagccauguaa

SEQ ID NO: 1136627 - RNA, 19 nt, Homo sapiens
gagaaugagcacaucuaua

SEQ ID NO: 1136628 - RNA, 19 nt, Homo sapiens
gagcaacuuuacuuuagug

SEQ ID NO: 1136629 - RNA, 19 nt, Homo sapiens
gaugaagaauuugaagguu

SEQ ID NO: 1136630 - RNA, 19 nt, Homo sapiens
gcauuaggauacugacaug

SEQ ID NO: 1136631 - RNA, 19 nt, Homo sapiens
aaaccaagcaguugaaaug

SEQ ID NO: 1136632 - RNA, 19 nt, Homo sapiens
uaugaaaucuguguagguu

SEQ ID NO: 1136633 - RNA, 19 nt, Homo sapiens
aagccaaguuugaugauuu

SEQ ID NO: 1136634 - RNA, 19 nt, Homo sapiens
ugacuucgcugaauuugag

SEQ ID NO: 1136635 - RNA, 19 nt, Homo sapiens
gauggugacuggucugcuu

SEQ ID NO: 1136636 - RNA, 19 nt, Homo sapiens
uaggaagucuguaggcauu

SEQ ID NO: 1136637 - RNA, 19 nt, Homo sapiens
caguugaaauggcuauaaa

SEQ ID NO: 1136638 - RNA, 19 nt, Homo sapiens
gagacaagacuuacugaau

SEQ ID NO: 1136639 - RNA, 19 nt, Homo sapiens
ugaagguuaugaagacaaa

SEQ ID NO: 1136640 - RNA, 19 nt, Homo sapiens
guccauuucucaaccuuaa

SEQ ID NO: 1136641 - RNA, 19 nt, Homo sapiens
ugacacaugugcaaagaca

SEQ ID NO: 1136642 - RNA, 19 nt, Homo sapiens
gaaaguugaaccaggagaa

SEQ ID NO: 1136643 - RNA, 19 nt, Homo sapiens
ggaugaggaggacauagua

SEQ ID NO: 1136644 - RNA, 19 nt, Homo sapiens
ccagauacuucuucuagca

SEQ ID NO: 1136645 - RNA, 19 nt, Homo sapiens
uaagaucauuggucugugu

SEQ ID NO: 1136646 - RNA, 19 nt, Homo sapiens
ugaacauggugauuuauuc

SEQ ID NO: 1136647 - RNA, 19 nt, Homo sapiens
gaagacaaaccagauacuu

SEQ ID NO: 1136648 - RNA, 19 nt, Homo sapiens
caaaguugauagucuuagu

SEQ ID NO: 1136649 - RNA, 19 nt, Homo sapiens
aaaaugagcuuuccuaaac

SEQ ID NO: 1136650 - RNA, 19 nt, Homo sapiens
gaucauuggucugugugaa

SEQ ID NO: 1136651 - RNA, 19 nt, Homo sapiens
gaaacugacacaugugcaa

SEQ ID NO: 1136652 - RNA, 19 nt, Homo sapiens
ggaccauggcagcuaauuu

SEQ ID NO: 1136653 - RNA, 19 nt, Homo sapiens
auaacaaguugcugugaaa

SEQ ID NO: 1136654 - RNA, 19 nt, Homo sapiens
auagguagauaaccagauu

SEQ ID NO: 1136655 - RNA, 19 nt, Homo sapiens
gaauucacaggaaacauga

SEQ ID NO: 1136656 - RNA, 19 nt, Homo sapiens
uguaagcucugaauucaca

SEQ ID NO: 1136657 - RNA, 19 nt, Homo sapiens
auaaugacuucgcugaauu

SEQ ID NO: 1136658 - RNA, 19 nt, Homo sapiens
ugaaccauaugaugaugaa

SEQ ID NO: 1136659 - RNA, 19 nt, Homo sapiens
ucagggacccagaacauaa

SEQ ID NO: 1136660 - RNA, 19 nt, Homo sapiens
gcaguugaaauggcuauaa

SEQ ID NO: 1136661 - RNA, 19 nt, Homo sapiens
auaaccagauuguugcuuu

SEQ ID NO: 1136662 - RNA, 19 nt, Homo sapiens
ccuguaagcucugaauuca

SEQ ID NO: 1136663 - RNA, 19 nt, Homo sapiens
guucugaugccaccuguaa

SEQ ID NO: 1136664 - RNA, 19 nt, Homo sapiens
gagcagagaaggagcgaau

SEQ ID NO: 1136665 - RNA, 19 nt, Homo sapiens
aagaggacacuguuguuua

SEQ ID NO: 1136666 - RNA, 19 nt, Homo sapiens
uaaagcuaccugacacuaa

SEQ ID NO: 1136667 - RNA, 19 nt, Homo sapiens
ggagaaugagcacaucuau

SEQ ID NO: 1136668 - RNA, 19 nt, Homo sapiens
ucaccuagguaagaucauu

SEQ ID NO: 1136669 - RNA, 19 nt, Homo sapiens
gcagagaaggagcgaauca

SEQ ID NO: 1136670 - RNA, 19 nt, Homo sapiens
gaacauggugauuuauucu

SEQ ID NO: 1136671 - RNA, 19 nt, Homo sapiens
uaagaggacacuguuguuu

SEQ ID NO: 1136672 - RNA, 19 nt, Homo sapiens
ggacagggauggacgaauu

SEQ ID NO: 1136673 - RNA, 19 nt, Homo sapiens
gaaaacaccuggccucaau

SEQ ID NO: 1136674 - RNA, 19 nt, Homo sapiens
ccucaauguuggcuuguua

SEQ ID NO: 1136675 - RNA, 19 nt, Homo sapiens
ggauggcaccguagacuuu

SEQ ID NO: 1136676 - RNA, 19 nt, Homo sapiens
aauguuggcuuguuauguu

SEQ ID NO: 1136677 - RNA, 19 nt, Homo sapiens
ggaagaggagcaagaagga

SEQ ID NO: 1136678 - RNA, 19 nt, Homo sapiens
ucgaggaguuugacacuga

SEQ ID NO: 1136679 - RNA, 19 nt, Homo sapiens
cguagacuuugacgaguuu

SEQ ID NO: 1136680 - RNA, 19 nt, Homo sapiens
gacagggauggacgaauua

SEQ ID NO: 1136681 - RNA, 19 nt, Homo sapiens
ccaguggcaugaugaaugg

SEQ ID NO: 1136682 - RNA, 19 nt, Homo sapiens
gaacugauaggcccaaagc

SEQ ID NO: 1136683 - RNA, 19 nt, Homo sapiens
ggacuuugaggaguuugua

SEQ ID NO: 1136684 - RNA, 19 nt, Homo sapiens
caugaugaauggagaggau

SEQ ID NO: 1136685 - RNA, 19 nt, Homo sapiens
acaccuggccucaauguug

SEQ ID NO: 1136686 - RNA, 19 nt, Homo sapiens
gagcaagauuugggucucu

SEQ ID NO: 1136687 - RNA, 19 nt, Homo sapiens
caagcugccuggagaagac

SEQ ID NO: 1136688 - RNA, 19 nt, Homo sapiens
caggagggaauaucuguug

SEQ ID NO: 1136689 - RNA, 19 nt, Homo sapiens
gaugcucucccgccacuga

SEQ ID NO: 1136690 - RNA, 19 nt, Homo sapiens
gagaaguggaccucaaugg

SEQ ID NO: 1136691 - RNA, 19 nt, Homo sapiens
ccaggaagaggagcaagaa

SEQ ID NO: 1136692 - RNA, 19 nt, Homo sapiens
ggacgagaugcuccgagaa

SEQ ID NO: 1136693 - RNA, 19 nt, Homo sapiens
gcccaccguuccucagugu

SEQ ID NO: 1136694 - RNA, 19 nt, Homo sapiens
ugacgaguuugugaugaug

SEQ ID NO: 1136695 - RNA, 19 nt, Homo sapiens
ccguagacuuugacgaguu

SEQ ID NO: 1136696 - RNA, 19 nt, Homo sapiens
cuacaugcccaccgagaug

SEQ ID NO: 1136697 - RNA, 19 nt, Homo sapiens
ccaccguuccucaguguga

SEQ ID NO: 1136698 - RNA, 19 nt, Homo sapiens
gacgagaugcuccgagaag

SEQ ID NO: 1136699 - RNA, 19 nt, Homo sapiens
aaacaccuggccucaaugu

SEQ ID NO: 1136700 - RNA, 19 nt, Homo sapiens
guguggacuuugaggaguu

SEQ ID NO: 1136701 - RNA, 19 nt, Homo sapiens
cuuccacuacuuauguuua

SEQ ID NO: 1136702 - RNA, 19 nt, Homo sapiens
cgagaugcuccgagaagug

SEQ ID NO: 1136703 - RNA, 19 nt, Homo sapiens
cugcccacccucauccuua

SEQ ID NO: 1136704 - RNA, 19 nt, Homo sapiens
gggauggcaccguagacuu

SEQ ID NO: 1136705 - RNA, 19 nt, Homo sapiens
ucagugugagcaagauuug

SEQ ID NO: 1136706 - RNA, 19 nt, Homo sapiens
auguuggcuuguuauguua

SEQ ID NO: 1136707 - RNA, 19 nt, Homo sapiens
gauggcaccguagacuuug

SEQ ID NO: 1136708 - RNA, 19 nt, Homo sapiens
gcagcagggcccaaaucug

SEQ ID NO: 1136709 - RNA, 19 nt, Homo sapiens
gaacaaaccuggacugaaa

SEQ ID NO: 1136710 - RNA, 19 nt, Homo sapiens
gcaauccucucauuuggaa

SEQ ID NO: 1136711 - RNA, 19 nt, Homo sapiens
gaaucgaggugcuguuuua

SEQ ID NO: 1136712 - RNA, 19 nt, Homo sapiens
gagaagcucuugaacaaac

SEQ ID NO: 1136713 - RNA, 19 nt, Homo sapiens
gaacuuaguccuguuauag

SEQ ID NO: 1136714 - RNA, 19 nt, Homo sapiens
ucgagaagcucuugaacaa

SEQ ID NO: 1136715 - RNA, 19 nt, Homo sapiens
aaccuggacugaaauauaa

SEQ ID NO: 1136716 - RNA, 19 nt, Homo sapiens
uggaggagcugguggauga

SEQ ID NO: 1136717 - RNA, 19 nt, Homo sapiens
ccaaagaugauaaagguaa

SEQ ID NO: 1136718 - RNA, 19 nt, Homo sapiens
gaaacuggagggccuguaa

SEQ ID NO: 1136719 - RNA, 19 nt, Homo sapiens
gaagucuccucuuggcaaa

SEQ ID NO: 1136720 - RNA, 19 nt, Homo sapiens
auacucagcuucaacagaa

SEQ ID NO: 1136721 - RNA, 19 nt, Homo sapiens
aagagaagauccaagagaa

SEQ ID NO: 1136722 - RNA, 19 nt, Homo sapiens
gggaagccauccaagagaa

SEQ ID NO: 1136723 - RNA, 19 nt, Homo sapiens
gaaacucugccaacacuga

SEQ ID NO: 1136724 - RNA, 19 nt, Homo sapiens
gaucagaauaucacagaaa

SEQ ID NO: 1136725 - RNA, 19 nt, Homo sapiens
guucugauccguuuccaua

SEQ ID NO: 1136726 - RNA, 19 nt, Homo sapiens
caacuaggaucagaauauc

SEQ ID NO: 1136727 - RNA, 19 nt, Homo sapiens
gcuggaggaucccaagauu

SEQ ID NO: 1136728 - RNA, 19 nt, Homo sapiens
aaaccuggacugaaauaua

SEQ ID NO: 1136729 - RNA, 19 nt, Homo sapiens
ggucuuugacuuuaaauug

SEQ ID NO: 1136730 - RNA, 19 nt, Homo sapiens
uaucuggacgucuaucuua

SEQ ID NO: 1136731 - RNA, 19 nt, Homo sapiens
ugaacuuaguccuguuaua

SEQ ID NO: 1136732 - RNA, 19 nt, Homo sapiens
ccacucaugucccauuuua

SEQ ID NO: 1136733 - RNA, 19 nt, Homo sapiens
gacuuuaaauugagugaug

SEQ ID NO: 1136734 - RNA, 19 nt, Homo sapiens
ggccauugaugcaggauau

SEQ ID NO: 1136735 - RNA, 19 nt, Homo sapiens
cagugaagguggccauuga

SEQ ID NO: 1136736 - RNA, 19 nt, Homo sapiens
gagaaucgaggugcuguuu

SEQ ID NO: 1136737 - RNA, 19 nt, Homo sapiens
ggagacagagguuguagug

SEQ ID NO: 1136738 - RNA, 19 nt, Homo sapiens
gugacuaccuccacucaug

SEQ ID NO: 1136739 - RNA, 19 nt, Homo sapiens
caagagaagauccaagaga

SEQ ID NO: 1136740 - RNA, 19 nt, Homo sapiens
gaggauguaaagaucaaua

SEQ ID NO: 1136741 - RNA, 19 nt, Homo sapiens
uggaggaucccaagauuaa

SEQ ID NO: 1136742 - RNA, 19 nt, Homo sapiens
ugagcuaucuggacgucua

SEQ ID NO: 1136743 - RNA, 19 nt, Homo sapiens
ucaacuaggaucagaauau

SEQ ID NO: 1136744 - RNA, 19 nt, Homo sapiens
ucaggucuuugacuuuaaa

SEQ ID NO: 1136745 - RNA, 19 nt, Homo sapiens
guaaugccaucgguggaaa

SEQ ID NO: 1136746 - RNA, 19 nt, Homo sapiens
caggauaucggcacauuga

SEQ ID NO: 1136747 - RNA, 19 nt, Homo sapiens
gcaggagaauugcuugaac

SEQ ID NO: 1136748 - RNA, 19 nt, Homo sapiens
gugccuaugucuaucagaa

SEQ ID NO: 1136749 - RNA, 19 nt, Homo sapiens
auucaggucuuugacuuua

SEQ ID NO: 1136750 - RNA, 19 nt, Homo sapiens
ugagaacauucaggucuuu

SEQ ID NO: 1136751 - RNA, 19 nt, Homo sapiens
cagcacgcauuguugagaa

SEQ ID NO: 1136752 - RNA, 19 nt, Homo sapiens
cagccugucucuacuaaca

SEQ ID NO: 1136753 - RNA, 19 nt, Homo sapiens
gggaggaccuguucaucgu

SEQ ID NO: 1136754 - RNA, 19 nt, Homo sapiens
ugacugugccuaugucuau

SEQ ID NO: 1136755 - RNA, 19 nt, Homo sapiens
gaagguggccauugaugca

SEQ ID NO: 1136756 - RNA, 19 nt, Homo sapiens
ggacgucuaucuuauucac

SEQ ID NO: 1136757 - RNA, 19 nt, Homo sapiens
gaauauugagguugaaucu

SEQ ID NO: 1136758 - RNA, 19 nt, Homo sapiens
gcagaauauugagguugaa

SEQ ID NO: 1136759 - RNA, 19 nt, Homo sapiens
ucccuucgaugcagaauau

SEQ ID NO: 1136760 - RNA, 19 nt, Homo sapiens
ggaucagaauaucacagaa

SEQ ID NO: 1136761 - RNA, 19 nt, Homo sapiens
gaugcagaauauugagguu

SEQ ID NO: 1136762 - RNA, 19 nt, Homo sapiens
ugcagaauauugagguuga

SEQ ID NO: 1136763 - RNA, 19 nt, Homo sapiens
aagccaagaugcccauugu

SEQ ID NO: 1136764 - RNA, 19 nt, Homo sapiens
caccaaccauggccacguu

SEQ ID NO: 1136765 - RNA, 19 nt, Homo sapiens
gccuaugucuaucagaaug

SEQ ID NO: 1136766 - RNA, 19 nt, Homo sapiens
acacugaggauguaaagau

SEQ ID NO: 1136767 - RNA, 19 nt, Homo sapiens
ugccaacacugaggaugua

SEQ ID NO: 1136768 - RNA, 19 nt, Homo sapiens
ccucucauuuggaagacua

SEQ ID NO: 1136769 - RNA, 19 nt, Homo sapiens
uccaagggcaucaccguua

SEQ ID NO: 1136770 - RNA, 19 nt, Homo sapiens
guugcaauccucucauuug

SEQ ID NO: 1136771 - RNA, 19 nt, Homo sapiens
caaccauacucagcuucaa

SEQ ID NO: 1136772 - RNA, 19 nt, Homo sapiens
gaaaagcaacguucuugga

SEQ ID NO: 1136773 - RNA, 19 nt, Homo sapiens
gagauuauacaggagauuc

SEQ ID NO: 1136774 - RNA, 19 nt, Homo sapiens
gagggccuguaacguguug

SEQ ID NO: 1136775 - RNA, 19 nt, Homo sapiens
gcaaccauacucagcuuca

SEQ ID NO: 1136776 - RNA, 19 nt, Homo sapiens
gaagcgggaggaccuguuc

SEQ ID NO: 1136777 - RNA, 19 nt, Homo sapiens
guguugcaauccucucauu

SEQ ID NO: 1136778 - RNA, 19 nt, Homo sapiens
ccuguaacguguugcaauc

SEQ ID NO: 1136779 - RNA, 19 nt, Homo sapiens
acauucaggucuuugacuu

SEQ ID NO: 1136780 - RNA, 19 nt, Homo sapiens
ccaagggcaucaccguuac

SEQ ID NO: 1136781 - RNA, 19 nt, Homo sapiens
acaaaccuggacugaaaua

SEQ ID NO: 1136782 - RNA, 19 nt, Homo sapiens
gcagugaagguggccauug

SEQ ID NO: 1136783 - RNA, 19 nt, Homo sapiens
caacacugaggauguaaag

SEQ ID NO: 1136784 - RNA, 19 nt, Homo sapiens
ucgcaccacugcacucuag

SEQ ID NO: 1136785 - RNA, 19 nt, Homo sapiens
cccagguucugauccguuu

SEQ ID NO: 1136786 - RNA, 19 nt, Homo sapiens
ugaaagaagcagugaaggu

SEQ ID NO: 1136787 - RNA, 19 nt, Homo sapiens
gaccagccugucucuacua

SEQ ID NO: 1136788 - RNA, 19 nt, Homo sapiens
gaagccauccaagagaaga

SEQ ID NO: 1136789 - RNA, 19 nt, Homo sapiens
gacaccagcacgcauuguu

SEQ ID NO: 1136790 - RNA, 19 nt, Homo sapiens
gaaauauaaaccagugacu

SEQ ID NO: 1136791 - RNA, 19 nt, Homo sapiens
ucuaucagaaugaacauga

SEQ ID NO: 1136792 - RNA, 19 nt, Homo sapiens
ccagaggaaugugauuguc

SEQ ID NO: 1136793 - RNA, 19 nt, Homo sapiens
gguaaugccaucgguggaa

SEQ ID NO: 1136794 - RNA, 19 nt, Homo sapiens
guucaucgucagcaaguug

SEQ ID NO: 1136795 - RNA, 19 nt, Homo sapiens
gaacauucaggucuuugac

SEQ ID NO: 1136796 - RNA, 19 nt, Homo sapiens
agaggaaugugauugucau

SEQ ID NO: 1136797 - RNA, 19 nt, Homo sapiens
cuggacgucuaucuuauuc

SEQ ID NO: 1136798 - RNA, 19 nt, Homo sapiens
gcaggauaucggcacauug

SEQ ID NO: 1136799 - RNA, 19 nt, Homo sapiens
cugaggauguaaagaucaa

SEQ ID NO: 1136800 - RNA, 19 nt, Homo sapiens
gcaggacgugagacuucua

SEQ ID NO: 1136801 - RNA, 19 nt, Homo sapiens
caccagcacgcauuguuga

SEQ ID NO: 1136802 - RNA, 19 nt, Homo sapiens
ucugauccguuuccauauc

SEQ ID NO: 1136803 - RNA, 19 nt, Homo sapiens
cuaucagaaugaacaugaa

SEQ ID NO: 1136804 - RNA, 19 nt, Homo sapiens
guucaacuaggaucagaau

SEQ ID NO: 1136805 - RNA, 19 nt, Homo sapiens
caaccauggccacguuugu

SEQ ID NO: 1136806 - RNA, 19 nt, Homo sapiens
gccugucucuacuaacaau

SEQ ID NO: 1136807 - RNA, 19 nt, Homo sapiens
ggcugaggcaggagaauug

SEQ ID NO: 1136808 - RNA, 19 nt, Homo sapiens
ccaggagacagagguugua

SEQ ID NO: 1136809 - RNA, 19 nt, Homo sapiens
gaagagaaaucaccaaucu

SEQ ID NO: 1136810 - RNA, 19 nt, Homo sapiens
gaucagaacuacauuaaca

SEQ ID NO: 1136811 - RNA, 19 nt, Homo sapiens
aaacagacauggucauaaa

SEQ ID NO: 1136812 - RNA, 19 nt, Homo sapiens
caggaaaucugcauagaaa

SEQ ID NO: 1136813 - RNA, 19 nt, Homo sapiens
ccaagaagacacuauaaua

SEQ ID NO: 1136814 - RNA, 19 nt, Homo sapiens
gauggugaauacuuucuua

SEQ ID NO: 1136815 - RNA, 19 nt, Homo sapiens
ucaccaaucuccauuaaug

SEQ ID NO: 1136816 - RNA, 19 nt, Homo sapiens
uagaaacacuuaggcuuua

SEQ ID NO: 1136817 - RNA, 19 nt, Homo sapiens
gaacuacauuaacaccaaa

SEQ ID NO: 1136818 - RNA, 19 nt, Homo sapiens
gaagaagcaccuagaagaa

SEQ ID NO: 1136819 - RNA, 19 nt, Homo sapiens
ugaacgaucucgcuccuuu

SEQ ID NO: 1136820 - RNA, 19 nt, Homo sapiens
agaagcaccuagaagaaua

SEQ ID NO: 1136821 - RNA, 19 nt, Homo sapiens
gcagacacuguucuauuua

SEQ ID NO: 1136822 - RNA, 19 nt, Homo sapiens
cagguucaauuguacuuua

SEQ ID NO: 1136823 - RNA, 19 nt, Homo sapiens
gcaagucgaucgaggucaa

SEQ ID NO: 1136824 - RNA, 19 nt, Homo sapiens
gaacauacagcucgagauc

SEQ ID NO: 1136825 - RNA, 19 nt, Homo sapiens
ggacaggcgugaacgaucu

SEQ ID NO: 1136826 - RNA, 19 nt, Homo sapiens
ccucauaagaucauuguua

SEQ ID NO: 1136827 - RNA, 19 nt, Homo sapiens
ggugaauacuuucuuaaca

SEQ ID NO: 1136828 - RNA, 19 nt, Homo sapiens
caauguguuuguucgauuu

SEQ ID NO: 1136829 - RNA, 19 nt, Homo sapiens
caaacugccuggaauuaca

SEQ ID NO: 1136830 - RNA, 19 nt, Homo sapiens
cgaagaagcaccuagaaga

SEQ ID NO: 1136831 - RNA, 19 nt, Homo sapiens
ccaaaucuuucgucaaaca

SEQ ID NO: 1136832 - RNA, 19 nt, Homo sapiens
cuccaaaucuuucgucaaa

SEQ ID NO: 1136833 - RNA, 19 nt, Homo sapiens
cagacacuguucuauuuaa

SEQ ID NO: 1136834 - RNA, 19 nt, Homo sapiens
gaaaucaccaaucuccauu

SEQ ID NO: 1136835 - RNA, 19 nt, Homo sapiens
gaaugugaacguaaucaaa

SEQ ID NO: 1136836 - RNA, 19 nt, Homo sapiens
ggagggugcuaaaggaguu

SEQ ID NO: 1136837 - RNA, 19 nt, Homo sapiens
ugcagacacuguucuauuu

SEQ ID NO: 1136838 - RNA, 19 nt, Homo sapiens
gaaacacuuaggcuuuaua

SEQ ID NO: 1136839 - RNA, 19 nt, Homo sapiens
aaagacagcaagagaagua

SEQ ID NO: 1136840 - RNA, 19 nt, Homo sapiens
gaagaggaaauccaggaaa

SEQ ID NO: 1136841 - RNA, 19 nt, Homo sapiens
ggaaaucugcauagaaaca

SEQ ID NO: 1136842 - RNA, 19 nt, Homo sapiens
agaaauagcagaagugcaa

SEQ ID NO: 1136843 - RNA, 19 nt, Homo sapiens
aaucaccaaucuccauuaa

SEQ ID NO: 1136844 - RNA, 19 nt, Homo sapiens
gcauaccagagaugauuua

SEQ ID NO: 1136845 - RNA, 19 nt, Homo sapiens
ugaaagcccucgaagacau

SEQ ID NO: 1136846 - RNA, 19 nt, Homo sapiens
gggcagguguuguuucauc

SEQ ID NO: 1136847 - RNA, 19 nt, Homo sapiens
gagcgugaauucuguaaaa

SEQ ID NO: 1136848 - RNA, 19 nt, Homo sapiens
gcacaggcgcugacuuugu

SEQ ID NO: 1136849 - RNA, 19 nt, Homo sapiens
aaaguagccuuacaagaag

SEQ ID NO: 1136850 - RNA, 19 nt, Homo sapiens
gccaaacuaugaauuacug

SEQ ID NO: 1136851 - RNA, 19 nt, Homo sapiens
ccaauguguuuguucgauu

SEQ ID NO: 1136852 - RNA, 19 nt, Homo sapiens
gcagagaggagggugcuaa

SEQ ID NO: 1136853 - RNA, 19 nt, Homo sapiens
gaagcaccuagaagaauaa

SEQ ID NO: 1136854 - RNA, 19 nt, Homo sapiens
acauacagcucgagaucaa

SEQ ID NO: 1136855 - RNA, 19 nt, Homo sapiens
aguaaaagcugaagagaaa

SEQ ID NO: 1136856 - RNA, 19 nt, Homo sapiens
gcuauggcuuguauuaauc

SEQ ID NO: 1136857 - RNA, 19 nt, Homo sapiens
aaaaguagccuuacaagaa

SEQ ID NO: 1136858 - RNA, 19 nt, Homo sapiens
cuuacaagaagccaaauua

SEQ ID NO: 1136859 - RNA, 19 nt, Homo sapiens
ucaaacagacauggucaua

SEQ ID NO: 1136860 - RNA, 19 nt, Homo sapiens
caagagaaguagaaauagc

SEQ ID NO: 1136861 - RNA, 19 nt, Homo sapiens
agcaagagaaguagaaaua

SEQ ID NO: 1136862 - RNA, 19 nt, Homo sapiens
agaacuacauuaacaccaa

SEQ ID NO: 1136863 - RNA, 19 nt, Homo sapiens
cugcaucaguucuugguuu

SEQ ID NO: 1136864 - RNA, 19 nt, Homo sapiens
aagaggaaauccaggaaau

SEQ ID NO: 1136865 - RNA, 19 nt, Homo sapiens
uuacaagucuuagaaugug

SEQ ID NO: 1136866 - RNA, 19 nt, Homo sapiens
gcuaaaggaguugggauuu

SEQ ID NO: 1136867 - RNA, 19 nt, Homo sapiens
gcaccuagaagaauaagag

SEQ ID NO: 1136868 - RNA, 19 nt, Homo sapiens
cccuagcaguaucuaauua

SEQ ID NO: 1136869 - RNA, 19 nt, Homo sapiens
gagucgaucuggaacauac

SEQ ID NO: 1136870 - RNA, 19 nt, Homo sapiens
ccauuaaugugaagacagu

SEQ ID NO: 1136871 - RNA, 19 nt, Homo sapiens
gaaacccucuaggucucua

SEQ ID NO: 1136872 - RNA, 19 nt, Homo sapiens
gcaaaacugauuaggauuu

SEQ ID NO: 1136873 - RNA, 19 nt, Homo sapiens
ccaagaaacacaggcauga

SEQ ID NO: 1136874 - RNA, 19 nt, Homo sapiens
caaacagacauggucauaa

SEQ ID NO: 1136875 - RNA, 19 nt, Homo sapiens
gaucacauacuccaagaag

SEQ ID NO: 1136876 - RNA, 19 nt, Homo sapiens
ucaagaacacgaucacguu

SEQ ID NO: 1136877 - RNA, 19 nt, Homo sapiens
gcagcuagagcacuucaga

SEQ ID NO: 1136878 - RNA, 19 nt, Homo sapiens
guugcuauggcuuguauua

SEQ ID NO: 1136879 - RNA, 19 nt, Homo sapiens
ucaagcauccucauaagau

SEQ ID NO: 1136880 - RNA, 19 nt, Homo sapiens
agaggagggugcuaaagga

SEQ ID NO: 1136881 - RNA, 19 nt, Homo sapiens
gagccugcaucaguucuug

SEQ ID NO: 1136882 - RNA, 19 nt, Homo sapiens
uuacaugaaugacagucuu

SEQ ID NO: 1136883 - RNA, 19 nt, Homo sapiens
caagcauccucauaagauc

SEQ ID NO: 1136884 - RNA, 19 nt, Homo sapiens
ggcagucgcucaggacaug

SEQ ID NO: 1136885 - RNA, 19 nt, Homo sapiens
ucgaagacaucauaaucau

SEQ ID NO: 1136886 - RNA, 19 nt, Homo sapiens
ccaggaaaucugcauagaa

SEQ ID NO: 1136887 - RNA, 19 nt, Homo sapiens
gcaagagaaguagaaauag

SEQ ID NO: 1136888 - RNA, 19 nt, Homo sapiens
caaaagcccuuacaauggu

SEQ ID NO: 1136889 - RNA, 19 nt, Homo sapiens
caaucuccauuaaugugaa

SEQ ID NO: 1136890 - RNA, 19 nt, Homo sapiens
auagaaacacuuaggcuuu

SEQ ID NO: 1136891 - RNA, 19 nt, Homo sapiens
gaggacaguuucuuuugaa

SEQ ID NO: 1136892 - RNA, 19 nt, Homo sapiens
aagaaacacaggcaugaaa

SEQ ID NO: 1136893 - RNA, 19 nt, Homo sapiens
gagaggagggugcuaaagg

SEQ ID NO: 1136894 - RNA, 19 nt, Homo sapiens
gugaauacuuucuuaacac

SEQ ID NO: 1136895 - RNA, 19 nt, Homo sapiens
cacaggcgcugacuuuguc

SEQ ID NO: 1136896 - RNA, 19 nt, Homo sapiens
gaacgaucucgcuccuuug

SEQ ID NO: 1136897 - RNA, 19 nt, Homo sapiens
uagaucacauacuccaaga

SEQ ID NO: 1136898 - RNA, 19 nt, Homo sapiens
guuucgagauuguugcuau

SEQ ID NO: 1136899 - RNA, 19 nt, Homo sapiens
gaggaaauccaggaaaucu

SEQ ID NO: 1136900 - RNA, 19 nt, Homo sapiens
gguucaaacugccuggaau

SEQ ID NO: 1136901 - RNA, 19 nt, Homo sapiens
ccuagaagaauaagagaug

SEQ ID NO: 1136902 - RNA, 19 nt, Homo sapiens
cuuagaaugugaacguaau

SEQ ID NO: 1136903 - RNA, 19 nt, Homo sapiens
ugcuauggcuuguauuaau

SEQ ID NO: 1136904 - RNA, 19 nt, Homo sapiens
uaaaggaguugggauuuug

SEQ ID NO: 1136905 - RNA, 19 nt, Homo sapiens
caagaaacacaggcaugaa

SEQ ID NO: 1136906 - RNA, 19 nt, Homo sapiens
aauaauaggcggagucgau

SEQ ID NO: 1136907 - RNA, 19 nt, Homo sapiens
agaaguagaaauagcagaa

SEQ ID NO: 1136908 - RNA, 19 nt, Homo sapiens
aaaagaaccugaggauaga

SEQ ID NO: 1136909 - RNA, 19 nt, Homo sapiens
gaaucaaucuugccaaaua

SEQ ID NO: 1136910 - RNA, 19 nt, Homo sapiens
ugaaaggucugguggauaa

SEQ ID NO: 1136911 - RNA, 19 nt, Homo sapiens
guauuaaacuugcugcaua

SEQ ID NO: 1136912 - RNA, 19 nt, Homo sapiens
gagaacaccuuggucauga

SEQ ID NO: 1136913 - RNA, 19 nt, Homo sapiens
ucaagcagcuguugcaaug

SEQ ID NO: 1136914 - RNA, 19 nt, Homo sapiens
gaucucugcuggccaguuu

SEQ ID NO: 1136915 - RNA, 19 nt, Homo sapiens
gagagauuguguggauuua

SEQ ID NO: 1136916 - RNA, 19 nt, Homo sapiens
gcagagaccacgacuguau

SEQ ID NO: 1136917 - RNA, 19 nt, Homo sapiens
ggacuuggaaucaaucuug

SEQ ID NO: 1136918 - RNA, 19 nt, Homo sapiens
ggagagauuguguggauuu

SEQ ID NO: 1136919 - RNA, 19 nt, Homo sapiens
gggaguguguccugaagaa

SEQ ID NO: 1136920 - RNA, 19 nt, Homo sapiens
gagauuguguggauuuaag

SEQ ID NO: 1136921 - RNA, 19 nt, Homo sapiens
uaaacuugcugcauaucuu

SEQ ID NO: 1136922 - RNA, 19 nt, Homo sapiens
gaugugcauuuguguguga

SEQ ID NO: 1136923 - RNA, 19 nt, Homo sapiens
ggaccugguuucagaaugg

SEQ ID NO: 1136924 - RNA, 19 nt, Homo sapiens
ccagguuggugagcauuua

SEQ ID NO: 1136925 - RNA, 19 nt, Homo sapiens
gcaguggucugggauaagu

SEQ ID NO: 1136926 - RNA, 19 nt, Homo sapiens
gauucugcaugucuuguaa

SEQ ID NO: 1136927 - RNA, 19 nt, Homo sapiens
guuguuaguuuacuccauu

SEQ ID NO: 1136928 - RNA, 19 nt, Homo sapiens
uaugggaccugguuucaga

SEQ ID NO: 1136929 - RNA, 19 nt, Homo sapiens
uaucuguccuugaaacuug

SEQ ID NO: 1136930 - RNA, 19 nt, Homo sapiens
guggucagguugaacauga

SEQ ID NO: 1136931 - RNA, 19 nt, Homo sapiens
gaacaccuuggucaugaaa

SEQ ID NO: 1136932 - RNA, 19 nt, Homo sapiens
gcauuugugugugauguug

SEQ ID NO: 1136933 - RNA, 19 nt, Homo sapiens
acauuugacuguagcauug

SEQ ID NO: 1136934 - RNA, 19 nt, Homo sapiens
gauaacaauagcaaaguga

SEQ ID NO: 1136935 - RNA, 19 nt, Homo sapiens
guagagacagcuguagaua

SEQ ID NO: 1136936 - RNA, 19 nt, Homo sapiens
gaagccugcagucacuuua

SEQ ID NO: 1136937 - RNA, 19 nt, Homo sapiens
agagacagcuguagauaac

SEQ ID NO: 1136938 - RNA, 19 nt, Homo sapiens
agacagcuguagauaacaa

SEQ ID NO: 1136939 - RNA, 19 nt, Homo sapiens
uggaaucaaucuugccaaa

SEQ ID NO: 1136940 - RNA, 19 nt, Homo sapiens
ccuguugucauuuauguua

SEQ ID NO: 1136941 - RNA, 19 nt, Homo sapiens
caaccacauuugacuguag

SEQ ID NO: 1136942 - RNA, 19 nt, Homo sapiens
gaagggaguguguccugaa

SEQ ID NO: 1136943 - RNA, 19 nt, Homo sapiens
auugauaucuguccuugaa

SEQ ID NO: 1136944 - RNA, 19 nt, Homo sapiens
cgacaauacgucucucuga

SEQ ID NO: 1136945 - RNA, 19 nt, Homo sapiens
gaagucaagggaacagaug

SEQ ID NO: 1136946 - RNA, 19 nt, Homo sapiens
guguagugcugcuguguau

SEQ ID NO: 1136947 - RNA, 19 nt, Homo sapiens
gaaggagccaguagagaca

SEQ ID NO: 1136948 - RNA, 19 nt, Homo sapiens
aagcagcuguugcaauguu

SEQ ID NO: 1136949 - RNA, 19 nt, Homo sapiens
cauauggacuuggaaucaa

SEQ ID NO: 1136950 - RNA, 19 nt, Homo sapiens
uguguccuguugucauuua

SEQ ID NO: 1136951 - RNA, 19 nt, Homo sapiens
gaggaaggccuguaagaac

SEQ ID NO: 1136952 - RNA, 19 nt, Homo sapiens
guagauaacaauagcaaag

SEQ ID NO: 1136953 - RNA, 19 nt, Homo sapiens
cuguaucacucauugcuuu

SEQ ID NO: 1136954 - RNA, 19 nt, Homo sapiens
uagcagagaccacgacugu

SEQ ID NO: 1136955 - RNA, 19 nt, Homo sapiens
caggcaucguugagcauua

SEQ ID NO: 1136956 - RNA, 19 nt, Homo sapiens
aaaaggugcuucugaguga

SEQ ID NO: 1136957 - RNA, 19 nt, Homo sapiens
gagcauguggucagguuga

SEQ ID NO: 1136958 - RNA, 19 nt, Homo sapiens
uagagacagcuguagauaa

SEQ ID NO: 1136959 - RNA, 19 nt, Homo sapiens
ccaaccacauuugacugua

SEQ ID NO: 1136960 - RNA, 19 nt, Homo sapiens
cgagucaaguggcucacaa

SEQ ID NO: 1136961 - RNA, 19 nt, Homo sapiens
gcauuaacacucugugaca

SEQ ID NO: 1136962 - RNA, 19 nt, Homo sapiens
gagcauuaacacucuguga

SEQ ID NO: 1136963 - RNA, 19 nt, Homo sapiens
gauagcaaucuucaugaug

SEQ ID NO: 1136964 - RNA, 19 nt, Homo sapiens
cugccacccucuugucuuu

SEQ ID NO: 1136965 - RNA, 19 nt, Homo sapiens
guagugcugcuguguauca

SEQ ID NO: 1136966 - RNA, 19 nt, Homo sapiens
ugaacacucuccaggaucu

SEQ ID NO: 1136967 - RNA, 19 nt, Homo sapiens
ccacccauauggacuugga

SEQ ID NO: 1136968 - RNA, 19 nt, Homo sapiens
gaacucugaacgacaauac

SEQ ID NO: 1136969 - RNA, 19 nt, Homo sapiens
ugauagcaaucuucaugau

SEQ ID NO: 1136970 - RNA, 19 nt, Homo sapiens
gcagcuguugcaauguuua

SEQ ID NO: 1136971 - RNA, 19 nt, Homo sapiens
gguauuaugggaccugguu

SEQ ID NO: 1136972 - RNA, 19 nt, Homo sapiens
caccuccucuggauuuguu

SEQ ID NO: 1136973 - RNA, 19 nt, Homo sapiens
ccuguggccuugcugaaga

SEQ ID NO: 1136974 - RNA, 19 nt, Homo sapiens
gagcagagaccccuuuguu

SEQ ID NO: 1136975 - RNA, 19 nt, Homo sapiens
uugcaucuguguccuguug

SEQ ID NO: 1136976 - RNA, 19 nt, Homo sapiens
aggcaucguugagcauuaa

SEQ ID NO: 1136977 - RNA, 19 nt, Homo sapiens
ucaaaagaccaagguauua

SEQ ID NO: 1136978 - RNA, 19 nt, Homo sapiens
caacuccugucccucacau

SEQ ID NO: 1136979 - RNA, 19 nt, Homo sapiens
uaucacucauugcuuugaa

SEQ ID NO: 1136980 - RNA, 19 nt, Homo sapiens
uggcaguggucugggauaa

SEQ ID NO: 1136981 - RNA, 19 nt, Homo sapiens
uuggagagauuguguggau

SEQ ID NO: 1136982 - RNA, 19 nt, Homo sapiens
gcaaugcugccacccucuu

SEQ ID NO: 1136983 - RNA, 19 nt, Homo sapiens
gacagcaugugcaucuucu

SEQ ID NO: 1136984 - RNA, 19 nt, Homo sapiens
agauaacaauagcaaagug

SEQ ID NO: 1136985 - RNA, 19 nt, Homo sapiens
gauuuaagagaccuggauu

SEQ ID NO: 1136986 - RNA, 19 nt, Homo sapiens
ggaaucaaucuugccaaau

SEQ ID NO: 1136987 - RNA, 19 nt, Homo sapiens
ucuguguccuguugucauu

SEQ ID NO: 1136988 - RNA, 19 nt, Homo sapiens
acugguugcugugaugaua

SEQ ID NO: 1136989 - RNA, 19 nt, Homo sapiens
cgagaacaccuuggucaug

SEQ ID NO: 1136990 - RNA, 19 nt, Homo sapiens
ccauauggacuuggaauca

SEQ ID NO: 1136991 - RNA, 19 nt, Homo sapiens
gggaugugcauuugugugu

SEQ ID NO: 1136992 - RNA, 19 nt, Homo sapiens
gagaggggaugugcauuug

SEQ ID NO: 1136993 - RNA, 19 nt, Homo sapiens
guccuguugucauuuaugu

SEQ ID NO: 1136994 - RNA, 19 nt, Homo sapiens
gccacccucuugucuuuca

SEQ ID NO: 1136995 - RNA, 19 nt, Homo sapiens
caccucauguuaagagaag

SEQ ID NO: 1136996 - RNA, 19 nt, Homo sapiens
guuggccucuugagcaugu

SEQ ID NO: 1136997 - RNA, 19 nt, Homo sapiens
acaccuuggucaugaaagu

SEQ ID NO: 1136998 - RNA, 19 nt, Homo sapiens
ugauaucuguccuugaaac

SEQ ID NO: 1136999 - RNA, 19 nt, Homo sapiens
ggauuuaagagaccuggau

SEQ ID NO: 1137000 - RNA, 19 nt, Homo sapiens
aaacuugcugcauaucuug

SEQ ID NO: 1137001 - RNA, 19 nt, Homo sapiens
uuucuucaccucauguuaa

SEQ ID NO: 1137002 - RNA, 19 nt, Homo sapiens
gugauagcaaucuucauga

SEQ ID NO: 1137003 - RNA, 19 nt, Homo sapiens
agaggaaggccuguaagaa

SEQ ID NO: 1137004 - RNA, 19 nt, Homo sapiens
gacgacagcaugugcaucu

SEQ ID NO: 1137005 - RNA, 19 nt, Homo sapiens
agucauccacgcucaguuu

SEQ ID NO: 1137006 - RNA, 19 nt, Homo sapiens
uuuacuccauucuuuguga

SEQ ID NO: 1137007 - RNA, 19 nt, Homo sapiens
gggaccugguuucagaaug

SEQ ID NO: 1137008 - RNA, 19 nt, Homo sapiens
cgaagccugcagucacuuu

SEQ ID NO: 1137009 - RNA, 19 nt, Homo sapiens
gaguggagcucccaucuua

SEQ ID NO: 1137010 - RNA, 19 nt, Homo sapiens
cgacauacuugauacauuu

SEQ ID NO: 1137011 - RNA, 19 nt, Homo sapiens
gaaacaagaaugcaaguaa

SEQ ID NO: 1137012 - RNA, 19 nt, Homo sapiens
gaauacaccugcaagcauu

SEQ ID NO: 1137013 - RNA, 19 nt, Homo sapiens
ccacaggacuacauuaauu

SEQ ID NO: 1137014 - RNA, 19 nt, Homo sapiens
gaacuacaaagcugaauuu

SEQ ID NO: 1137015 - RNA, 19 nt, Homo sapiens
agaaauagcacuccauuaa

SEQ ID NO: 1137016 - RNA, 19 nt, Homo sapiens
gaaugcaaguaacaucuuu

SEQ ID NO: 1137017 - RNA, 19 nt, Homo sapiens
caacgaagcuuggaaaguc

SEQ ID NO: 1137018 - RNA, 19 nt, Homo sapiens
ggacuuagaaucuguguug

SEQ ID NO: 1137019 - RNA, 19 nt, Homo sapiens
ggaaagguguaagaaacua

SEQ ID NO: 1137020 - RNA, 19 nt, Homo sapiens
gcaaguaacaucuuucuuc

SEQ ID NO: 1137021 - RNA, 19 nt, Homo sapiens
aaacaugccuaaauugguu

SEQ ID NO: 1137022 - RNA, 19 nt, Homo sapiens
gaaggaaacgugauagaga

SEQ ID NO: 1137023 - RNA, 19 nt, Homo sapiens
gaugauaacuccguuguag

SEQ ID NO: 1137024 - RNA, 19 nt, Homo sapiens
gaacucuuacggcaauuua

SEQ ID NO: 1137025 - RNA, 19 nt, Homo sapiens
ggacaacagcgaugagaaa

SEQ ID NO: 1137026 - RNA, 19 nt, Homo sapiens
gaaguuccaaagaugauua

SEQ ID NO: 1137027 - RNA, 19 nt, Homo sapiens
guaagaaacuaggaaacaa

SEQ ID NO: 1137028 - RNA, 19 nt, Homo sapiens
ccaagcaaauuuguccuua

SEQ ID NO: 1137029 - RNA, 19 nt, Homo sapiens
gaacuugacucagcaggau

SEQ ID NO: 1137030 - RNA, 19 nt, Homo sapiens
gaaaagcugucuauuaauc

SEQ ID NO: 1137031 - RNA, 19 nt, Homo sapiens
ccgaaaagcugucuauuaa

SEQ ID NO: 1137032 - RNA, 19 nt, Homo sapiens
ugaaugcacucacucuuga

SEQ ID NO: 1137033 - RNA, 19 nt, Homo sapiens
caaagaaacccuaaauaag

SEQ ID NO: 1137034 - RNA, 19 nt, Homo sapiens
aaggaaacaugccuaaauu

SEQ ID NO: 1137035 - RNA, 19 nt, Homo sapiens
gcacaugacuccagaucgu

SEQ ID NO: 1137036 - RNA, 19 nt, Homo sapiens
uagaggagcucaaccaauc

SEQ ID NO: 1137037 - RNA, 19 nt, Homo sapiens
ccacaaggucuauggauuu

SEQ ID NO: 1137038 - RNA, 19 nt, Homo sapiens
ggugauggcucagauccua

SEQ ID NO: 1137039 - RNA, 19 nt, Homo sapiens
uaaagagugugaugaaucu

SEQ ID NO: 1137040 - RNA, 19 nt, Homo sapiens
cugcugcccugaacucuua

SEQ ID NO: 1137041 - RNA, 19 nt, Homo sapiens
gaaagacagcugcauuugu

SEQ ID NO: 1137042 - RNA, 19 nt, Homo sapiens
agaaugcugucauauuuga

SEQ ID NO: 1137043 - RNA, 19 nt, Homo sapiens
gaucgugcauuugaagauu

SEQ ID NO: 1137044 - RNA, 19 nt, Homo sapiens
ggacagcuccagaaggaaa

SEQ ID NO: 1137045 - RNA, 19 nt, Homo sapiens
agaaagcgaggucaaauuu

SEQ ID NO: 1137046 - RNA, 19 nt, Homo sapiens
uagaauacaucaagaagca

SEQ ID NO: 1137047 - RNA, 19 nt, Homo sapiens
ucacacgucucaaucucua

SEQ ID NO: 1137048 - RNA, 19 nt, Homo sapiens
gcagaaauagcacuccauu

SEQ ID NO: 1137049 - RNA, 19 nt, Homo sapiens
gccaggagacguaccuuua

SEQ ID NO: 1137050 - RNA, 19 nt, Homo sapiens
uaacaaauuccucuccaaa

SEQ ID NO: 1137051 - RNA, 19 nt, Homo sapiens
caaggaaacaugccuaaau

SEQ ID NO: 1137052 - RNA, 19 nt, Homo sapiens
gagaaagcgaggucaaauu

SEQ ID NO: 1137053 - RNA, 19 nt, Homo sapiens
caaguaacaucuuucuucu

SEQ ID NO: 1137054 - RNA, 19 nt, Homo sapiens
aaaaggagcuguugaacuu

SEQ ID NO: 1137055 - RNA, 19 nt, Homo sapiens
ccacuuccaugacuucuca

SEQ ID NO: 1137056 - RNA, 19 nt, Homo sapiens
gaucggagacccacuagug

SEQ ID NO: 1137057 - RNA, 19 nt, Homo sapiens
cauccauccugaaauguaa

SEQ ID NO: 1137058 - RNA, 19 nt, Homo sapiens
gacguaccuuuaccacaua

SEQ ID NO: 1137059 - RNA, 19 nt, Homo sapiens
gauccuagagcaucugaaa

SEQ ID NO: 1137060 - RNA, 19 nt, Homo sapiens
cagaaagacagcugcauuu

SEQ ID NO: 1137061 - RNA, 19 nt, Homo sapiens
ccugaaauguaacaaauuc

SEQ ID NO: 1137062 - RNA, 19 nt, Homo sapiens
ggaaacaugccuaaauugg

SEQ ID NO: 1137063 - RNA, 19 nt, Homo sapiens
caaaugacacggccaagga

SEQ ID NO: 1137064 - RNA, 19 nt, Homo sapiens
gaauacaucaagaagcaaa

SEQ ID NO: 1137065 - RNA, 19 nt, Homo sapiens
gauuaaagagugugaugaa

SEQ ID NO: 1137066 - RNA, 19 nt, Homo sapiens
gccacaaggucuauggauu

SEQ ID NO: 1137067 - RNA, 19 nt, Homo sapiens
caagcaaauuuguccuuau

SEQ ID NO: 1137068 - RNA, 19 nt, Homo sapiens
gaaagcgaggucaaauuug

SEQ ID NO: 1137069 - RNA, 19 nt, Homo sapiens
caagagagaaacaagaaug

SEQ ID NO: 1137070 - RNA, 19 nt, Homo sapiens
ucacagagucaaagacaaa

SEQ ID NO: 1137071 - RNA, 19 nt, Homo sapiens
ggaaagucaucacuaagcu

SEQ ID NO: 1137072 - RNA, 19 nt, Homo sapiens
gagagugaccgacuucaga

SEQ ID NO: 1137073 - RNA, 19 nt, Homo sapiens
guaacaaauuccucuccaa

SEQ ID NO: 1137074 - RNA, 19 nt, Homo sapiens
uggaggagcuggaugacuu

SEQ ID NO: 1137075 - RNA, 19 nt, Homo sapiens
gaaacgugauagagaugau

SEQ ID NO: 1137076 - RNA, 19 nt, Homo sapiens
gaagaaaugggaguuguca

SEQ ID NO: 1137077 - RNA, 19 nt, Homo sapiens
agacguaccuuuaccacau

SEQ ID NO: 1137078 - RNA, 19 nt, Homo sapiens
ggauagccgcagcgucuua

SEQ ID NO: 1137079 - RNA, 19 nt, Homo sapiens
cuuggaaagucaucacuaa

SEQ ID NO: 1137080 - RNA, 19 nt, Homo sapiens
aaagugaaccggaaaggaa

SEQ ID NO: 1137081 - RNA, 19 nt, Homo sapiens
gauggaaagguguaagaaa

SEQ ID NO: 1137082 - RNA, 19 nt, Homo sapiens
ggaggcauccauccugaaa

SEQ ID NO: 1137083 - RNA, 19 nt, Homo sapiens
aaauagcacuccauuaacu

SEQ ID NO: 1137084 - RNA, 19 nt, Homo sapiens
gaaauagcacuccauuaac

SEQ ID NO: 1137085 - RNA, 19 nt, Homo sapiens
gaagcagucucuguguugu

SEQ ID NO: 1137086 - RNA, 19 nt, Homo sapiens
ggaguugucagagcauuaa

SEQ ID NO: 1137087 - RNA, 19 nt, Homo sapiens
gaacccacaggacuacauu

SEQ ID NO: 1137088 - RNA, 19 nt, Homo sapiens
gcuguugaauucugugaug

SEQ ID NO: 1137089 - RNA, 19 nt, Homo sapiens
ugaccgagaugauggaaag

SEQ ID NO: 1137090 - RNA, 19 nt, Homo sapiens
gcauccauccugaaaugua

SEQ ID NO: 1137091 - RNA, 19 nt, Homo sapiens
ggacuaucacccucugaaa

SEQ ID NO: 1137092 - RNA, 19 nt, Homo sapiens
gcucuugauuggacuuaga

SEQ ID NO: 1137093 - RNA, 19 nt, Homo sapiens
gcaauuuagguuucucauu

SEQ ID NO: 1137094 - RNA, 19 nt, Homo sapiens
agaaaagaaugcugucaua

SEQ ID NO: 1137095 - RNA, 19 nt, Homo sapiens
caucuuaccuccccuugua

SEQ ID NO: 1137096 - RNA, 19 nt, Homo sapiens
gaaacaugccuaaauuggu

SEQ ID NO: 1137097 - RNA, 19 nt, Homo sapiens
cgucuuaccagaucacuuu

SEQ ID NO: 1137098 - RNA, 19 nt, Homo sapiens
gaaagugaaccggaaagga

SEQ ID NO: 1137099 - RNA, 19 nt, Homo sapiens
ggagaaagcgaggucaaau

SEQ ID NO: 1137100 - RNA, 19 nt, Homo sapiens
ccagaaagacagcugcauu

SEQ ID NO: 1137101 - RNA, 19 nt, Homo sapiens
ggaauacaccugcaagcau

SEQ ID NO: 1137102 - RNA, 19 nt, Homo sapiens
ucaaagacaaagaaaguga

SEQ ID NO: 1137103 - RNA, 19 nt, Homo sapiens
gacuccagaucgugcauuu

SEQ ID NO: 1137104 - RNA, 19 nt, Homo sapiens
ccuuggcacuccaggaaua

SEQ ID NO: 1137105 - RNA, 19 nt, Homo sapiens
ugaagaacccacaggacua

SEQ ID NO: 1137106 - RNA, 19 nt, Homo sapiens
ccaguguuauucaguucua

SEQ ID NO: 1137107 - RNA, 19 nt, Homo sapiens
ggaacuacaaagcugaauu

SEQ ID NO: 1137108 - RNA, 19 nt, Homo sapiens
ggaacuguguuaccugaac

SEQ ID NO: 1137109 - RNA, 19 nt, Homo sapiens
ccacuuggcuauuuacuua

SEQ ID NO: 1137110 - RNA, 19 nt, Homo sapiens
gauagugacucaucaaugu

SEQ ID NO: 1137111 - RNA, 19 nt, Homo sapiens
ggaccaauccaaaggcuaa

SEQ ID NO: 1137112 - RNA, 19 nt, Homo sapiens
ggaccaaucggaagccuaa

SEQ ID NO: 1137113 - RNA, 19 nt, Homo sapiens
agacaccucuccuuuacaa

SEQ ID NO: 1137114 - RNA, 19 nt, Homo sapiens
gcaaggcggcucuguuugu

SEQ ID NO: 1137115 - RNA, 19 nt, Homo sapiens
ggagaccgacauccucuuu

SEQ ID NO: 1137116 - RNA, 19 nt, Homo sapiens
gcuaagugauagugacuca

SEQ ID NO: 1137117 - RNA, 19 nt, Homo sapiens
gagcaucgcagacuugaca

SEQ ID NO: 1137118 - RNA, 19 nt, Homo sapiens
cagguggccuuauuucuuc

SEQ ID NO: 1137119 - RNA, 19 nt, Homo sapiens
guccuuccguacuuaauaa

SEQ ID NO: 1137120 - RNA, 19 nt, Homo sapiens
uaaguaauagugacccuuu

SEQ ID NO: 1137121 - RNA, 19 nt, Homo sapiens
gaccuguccuuccguacuu

SEQ ID NO: 1137122 - RNA, 19 nt, Homo sapiens
gugcccacuuggcuauuua

SEQ ID NO: 1137123 - RNA, 19 nt, Homo sapiens
ggaaccacaacccuuauug

SEQ ID NO: 1137124 - RNA, 19 nt, Homo sapiens
ggagagcaucgcagacuug

SEQ ID NO: 1137125 - RNA, 19 nt, Homo sapiens
cggcaaggcggcucuguuu

SEQ ID NO: 1137126 - RNA, 19 nt, Homo sapiens
ccagguggccuuauuucuu

SEQ ID NO: 1137127 - RNA, 19 nt, Homo sapiens
caaggcggcucuguuugug

SEQ ID NO: 1137128 - RNA, 19 nt, Homo sapiens
gguuucagucaguaaauaa

SEQ ID NO: 1137129 - RNA, 19 nt, Homo sapiens
auccaaaggcuaagugaua

SEQ ID NO: 1137130 - RNA, 19 nt, Homo sapiens
gacgaugacccucgcaugu

SEQ ID NO: 1137131 - RNA, 19 nt, Homo sapiens
gacaguggccccuugauaa

SEQ ID NO: 1137132 - RNA, 19 nt, Homo sapiens
gcccuuggguccuugucaa

SEQ ID NO: 1137133 - RNA, 19 nt, Homo sapiens
cgagccauguuaagcacaa

SEQ ID NO: 1137134 - RNA, 19 nt, Homo sapiens
uaagugauagugacucauc

SEQ ID NO: 1137135 - RNA, 19 nt, Homo sapiens
cucuaucccugaguacuua

SEQ ID NO: 1137136 - RNA, 19 nt, Homo sapiens
ccuggugccugcugaagau

SEQ ID NO: 1137137 - RNA, 19 nt, Homo sapiens
gguccagguuucagucagu

SEQ ID NO: 1137138 - RNA, 19 nt, Homo sapiens
gcugaagauucccucuauc

SEQ ID NO: 1137139 - RNA, 19 nt, Homo sapiens
agaccgacauccucuuugg

SEQ ID NO: 1137140 - RNA, 19 nt, Homo sapiens
gggaaccacaacccuuauu

SEQ ID NO: 1137141 - RNA, 19 nt, Homo sapiens
ucgagugcaucacggagaa

SEQ ID NO: 1137142 - RNA, 19 nt, Homo sapiens
ccuuauuucuucccuguca

SEQ ID NO: 1137143 - RNA, 19 nt, Homo sapiens
gagagcaucgcagacuuga

SEQ ID NO: 1137144 - RNA, 19 nt, Homo sapiens
guccagguuucagucagua

SEQ ID NO: 1137145 - RNA, 19 nt, Homo sapiens
ugcugaagauucccucuau

SEQ ID NO: 1137146 - RNA, 19 nt, Homo sapiens
gcacaaccggcuccuuggu

SEQ ID NO: 1137147 - RNA, 19 nt, Homo sapiens
agguuucagucaguaaaua

SEQ ID NO: 1137148 - RNA, 19 nt, Homo sapiens
gagcccgaguggaccaauc

SEQ ID NO: 1137149 - RNA, 19 nt, Homo sapiens
caaaggcuaagugauagug

SEQ ID NO: 1137150 - RNA, 19 nt, Homo sapiens
uccaaaggcuaagugauag

SEQ ID NO: 1137151 - RNA, 19 nt, Homo sapiens
ccaaucggaagccuaagug

SEQ ID NO: 1137152 - RNA, 19 nt, Homo sapiens
ucacgagccauguuaagca

SEQ ID NO: 1137153 - RNA, 19 nt, Homo sapiens
cgugcccacuuggcuauuu

SEQ ID NO: 1137154 - RNA, 19 nt, Homo sapiens
ucacggagaacuucagcau

SEQ ID NO: 1137155 - RNA, 19 nt, Homo sapiens
gcugcggcaugaccacugu

SEQ ID NO: 1137156 - RNA, 19 nt, Homo sapiens
uguccuuccguacuuaaua

SEQ ID NO: 1137157 - RNA, 19 nt, Homo sapiens
ccuaaagacaccucuccuu

SEQ ID NO: 1137158 - RNA, 19 nt, Homo sapiens
ccagguuucagucaguaaa

SEQ ID NO: 1137159 - RNA, 19 nt, Homo sapiens
ccagaggucuagggaacca

SEQ ID NO: 1137160 - RNA, 19 nt, Homo sapiens
gagaccgacauccucuuug

SEQ ID NO: 1137161 - RNA, 19 nt, Homo sapiens
uccagaagccugagagaca

SEQ ID NO: 1137162 - RNA, 19 nt, Homo sapiens
uggagagcaucgcagacuu

SEQ ID NO: 1137163 - RNA, 19 nt, Homo sapiens
gaagccuaagugacgauga

SEQ ID NO: 1137164 - RNA, 19 nt, Homo sapiens
caauccaaaggcuaaguga

SEQ ID NO: 1137165 - RNA, 19 nt, Homo sapiens
gggcuacgacgagcacuuc

SEQ ID NO: 1137166 - RNA, 19 nt, Homo sapiens
gcuccuugguccaguucug

SEQ ID NO: 1137167 - RNA, 19 nt, Homo sapiens
gaagcacucucccuuguuc

SEQ ID NO: 1137168 - RNA, 19 nt, Homo sapiens
ggagagagcgcgaaacuca

SEQ ID NO: 1137169 - RNA, 19 nt, Homo sapiens
ggucugggcuucugcauca

SEQ ID NO: 1137170 - RNA, 19 nt, Homo sapiens
caacagaguuuucggcuuu

SEQ ID NO: 1137171 - RNA, 19 nt, Homo sapiens
ucaaaucucucccaacucu

SEQ ID NO: 1137172 - RNA, 19 nt, Homo sapiens
uagugaagcugcagacuga

SEQ ID NO: 1137173 - RNA, 19 nt, Homo sapiens
gaacccugcuccucucugu

SEQ ID NO: 1137174 - RNA, 19 nt, Homo sapiens
uuucaaaucucuccuuuca

SEQ ID NO: 1137175 - RNA, 19 nt, Homo sapiens
ucaagguccuccucuagaa

SEQ ID NO: 1137176 - RNA, 19 nt, Homo sapiens
caugggaucuggagcaaau

SEQ ID NO: 1137177 - RNA, 19 nt, Homo sapiens
gggcagagccugaggagau

SEQ ID NO: 1137178 - RNA, 19 nt, Homo sapiens
gcucccaucuccuuucaga

SEQ ID NO: 1137179 - RNA, 19 nt, Homo sapiens
gcaguacguguuccuaauu

SEQ ID NO: 1137180 - RNA, 19 nt, Homo sapiens
ccucuuuccuucccaauug

SEQ ID NO: 1137181 - RNA, 19 nt, Homo sapiens
gcaccaaauuucucaagac

SEQ ID NO: 1137182 - RNA, 19 nt, Homo sapiens
gguuucaaaucucuccuuu

SEQ ID NO: 1137183 - RNA, 19 nt, Homo sapiens
uuucaaggauacccaaauu

SEQ ID NO: 1137184 - RNA, 19 nt, Homo sapiens
caacauccacucuaaacau

SEQ ID NO: 1137185 - RNA, 19 nt, Homo sapiens
cuauggaggugucaucuuc

SEQ ID NO: 1137186 - RNA, 19 nt, Homo sapiens
ucacgucuaugccagucua

SEQ ID NO: 1137187 - RNA, 19 nt, Homo sapiens
acagcgaaauggaggauga

SEQ ID NO: 1137188 - RNA, 19 nt, Homo sapiens
aagaagcacucucccuugu

SEQ ID NO: 1137189 - RNA, 19 nt, Homo sapiens
caguacguguuccuaauug

SEQ ID NO: 1137190 - RNA, 19 nt, Homo sapiens
ggcaguacguguuccuaau

SEQ ID NO: 1137191 - RNA, 19 nt, Homo sapiens
ccaccaacgugcgcaaguu

SEQ ID NO: 1137192 - RNA, 19 nt, Homo sapiens
gcuucgggaucuucuggua

SEQ ID NO: 1137193 - RNA, 19 nt, Homo sapiens
ggaggaguuucggaagcua

SEQ ID NO: 1137194 - RNA, 19 nt, Homo sapiens
ccucauacacggcuccuuu

SEQ ID NO: 1137195 - RNA, 19 nt, Homo sapiens
ccucagugguuucaaaucu

SEQ ID NO: 1137196 - RNA, 19 nt, Homo sapiens
ugucaaauccucuuuccuu

SEQ ID NO: 1137197 - RNA, 19 nt, Homo sapiens
caggaggauuuaucuguca

SEQ ID NO: 1137198 - RNA, 19 nt, Homo sapiens
ccaugugccucccacugaa

SEQ ID NO: 1137199 - RNA, 19 nt, Homo sapiens
uacauuaucgccaucauga

SEQ ID NO: 1137200 - RNA, 19 nt, Homo sapiens
uuucaaaucucucccaacu

SEQ ID NO: 1137201 - RNA, 19 nt, Homo sapiens
ucagauuccaggaggauuu

SEQ ID NO: 1137202 - RNA, 19 nt, Homo sapiens
caccagcguuucugaugga

SEQ ID NO: 1137203 - RNA, 19 nt, Homo sapiens
ccacacacagcacauuuca

SEQ ID NO: 1137204 - RNA, 19 nt, Homo sapiens
ccaacucuguucugcaucu

SEQ ID NO: 1137205 - RNA, 19 nt, Homo sapiens
aggcuaaccuuugagauca

SEQ ID NO: 1137206 - RNA, 19 nt, Homo sapiens
ggaccuccauuccacucau

SEQ ID NO: 1137207 - RNA, 19 nt, Homo sapiens
gaucuucugguaccuguuc

SEQ ID NO: 1137208 - RNA, 19 nt, Homo sapiens
cuagaaguuucaaaucucu

SEQ ID NO: 1137209 - RNA, 19 nt, Homo sapiens
gccagucuaugccaucauc

SEQ ID NO: 1137210 - RNA, 19 nt, Homo sapiens
gcaacauccacucuaaaca

SEQ ID NO: 1137211 - RNA, 19 nt, Homo sapiens
ccagggacucucaggcuaa

SEQ ID NO: 1137212 - RNA, 19 nt, Homo sapiens
ggccacacacagcacauuu

SEQ ID NO: 1137213 - RNA, 19 nt, Homo sapiens
cagcucccaucuccuuuca

SEQ ID NO: 1137214 - RNA, 19 nt, Homo sapiens
cuuacucucucuugugguu

SEQ ID NO: 1137215 - RNA, 19 nt, Homo sapiens
ggcagagccugaggagaug

SEQ ID NO: 1137216 - RNA, 19 nt, Homo sapiens
cagauuccaggaggauuua

SEQ ID NO: 1137217 - RNA, 19 nt, Homo sapiens
cugcgaaagcaccaaauuu

SEQ ID NO: 1137218 - RNA, 19 nt, Homo sapiens
gcacuauggaggugucauc

SEQ ID NO: 1137219 - RNA, 19 nt, Homo sapiens
ggaguggcaguacguguuc

SEQ ID NO: 1137220 - RNA, 19 nt, Homo sapiens
aacauccacucuaaacaug

SEQ ID NO: 1137221 - RNA, 19 nt, Homo sapiens
ccgauuccgugcccacuuc

SEQ ID NO: 1137222 - RNA, 19 nt, Homo sapiens
uuccagggauugauucuca

SEQ ID NO: 1137223 - RNA, 19 nt, Homo sapiens
ucuagaaguuucaaaucuc

SEQ ID NO: 1137224 - RNA, 19 nt, Homo sapiens
uuauuugaauggacaguuc

SEQ ID NO: 1137225 - RNA, 19 nt, Homo sapiens
ggaagccacgcugcuguug

SEQ ID NO: 1137226 - RNA, 19 nt, Homo sapiens
gggcuucugcaucagcuuu

SEQ ID NO: 1137227 - RNA, 19 nt, Homo sapiens
gagaugagcgaggagaagu

SEQ ID NO: 1137228 - RNA, 19 nt, Homo sapiens
cuauggcugugucaucuuc

SEQ ID NO: 1137229 - RNA, 19 nt, Homo sapiens
ggaggauuuaucugucaaa

SEQ ID NO: 1137230 - RNA, 19 nt, Homo sapiens
ucagugguuucaaaucucu

SEQ ID NO: 1137231 - RNA, 19 nt, Homo sapiens
ucgucuccauggucaauaa

SEQ ID NO: 1137232 - RNA, 19 nt, Homo sapiens
cucccucgccgcuacauua

SEQ ID NO: 1137233 - RNA, 19 nt, Homo sapiens
ggaggaggagcgcaaguac

SEQ ID NO: 1137234 - RNA, 19 nt, Homo sapiens
ggauggagcucuguuuucu

SEQ ID NO: 1137235 - RNA, 19 nt, Homo sapiens
gugcaguacucaggaugga

SEQ ID NO: 1137236 - RNA, 19 nt, Homo sapiens
gccaugggaucuggagcaa

SEQ ID NO: 1137237 - RNA, 19 nt, Homo sapiens
ggccaugacuaagcacaag

SEQ ID NO: 1137238 - RNA, 19 nt, Homo sapiens
aauucaagguccuccucua

SEQ ID NO: 1137239 - RNA, 19 nt, Homo sapiens
cugccucagugguuucaaa

SEQ ID NO: 1137240 - RNA, 19 nt, Homo sapiens
gcagugacgacagcgaaau

SEQ ID NO: 1137241 - RNA, 19 nt, Homo sapiens
gcuacauugucacucagau

SEQ ID NO: 1137242 - RNA, 19 nt, Homo sapiens
caucaucguggccaacuuc

SEQ ID NO: 1137243 - RNA, 19 nt, Homo sapiens
cuacauugucacucagauu

SEQ ID NO: 1137244 - RNA, 19 nt, Homo sapiens
ccacuauggcugugucauc

SEQ ID NO: 1137245 - RNA, 19 nt, Homo sapiens
caacucuguucugcaucuu

SEQ ID NO: 1137246 - RNA, 19 nt, Homo sapiens
ucccaacucuguucugcau

SEQ ID NO: 1137247 - RNA, 19 nt, Homo sapiens
caggcuaaccuuugagauc

SEQ ID NO: 1137248 - RNA, 19 nt, Homo sapiens
gagccgccaccauggaguu

SEQ ID NO: 1137249 - RNA, 19 nt, Homo sapiens
gaugagcgaggagaagugu

SEQ ID NO: 1137250 - RNA, 19 nt, Homo sapiens
ugaaccaccuggacauagc

SEQ ID NO: 1137251 - RNA, 19 nt, Homo sapiens
agagagcgcgaaacucaug

SEQ ID NO: 1137252 - RNA, 19 nt, Homo sapiens
caucggagagagcgcgaaa

SEQ ID NO: 1137253 - RNA, 19 nt, Homo sapiens
cggaggaggagcgcaagua

SEQ ID NO: 1137254 - RNA, 19 nt, Homo sapiens
ucaggauggagcucuguuu

SEQ ID NO: 1137255 - RNA, 19 nt, Homo sapiens
cauaaugucuggggaaaca

SEQ ID NO: 1137256 - RNA, 19 nt, Homo sapiens
gccauuccagggauugauu

SEQ ID NO: 1137257 - RNA, 19 nt, Homo sapiens
gugcagaaagcccaguuca

SEQ ID NO: 1137258 - RNA, 19 nt, Homo sapiens
gaccuccauuccacucauc

SEQ ID NO: 1137259 - RNA, 19 nt, Homo sapiens
ggagaugagcgaggagaag

SEQ ID NO: 1137260 - RNA, 19 nt, Homo sapiens
ggcaacauccacucuaaac

SEQ ID NO: 1137261 - RNA, 19 nt, Homo sapiens
cucccuagcuuagcauaau

SEQ ID NO: 1137262 - RNA, 19 nt, Homo sapiens
ggacaguucgaccucuuac

SEQ ID NO: 1137263 - RNA, 19 nt, Homo sapiens
gaggaggagcgcaaguaca

SEQ ID NO: 1137264 - RNA, 19 nt, Homo sapiens
gaggauuuaucugucaaaa

SEQ ID NO: 1137265 - RNA, 19 nt, Homo sapiens
cucuagaaguuucaaaucu

SEQ ID NO: 1137266 - RNA, 19 nt, Homo sapiens
ccucgccgcuacauuaucg

SEQ ID NO: 1137267 - RNA, 19 nt, Homo sapiens
gaauggagcuguuagaaau

SEQ ID NO: 1137268 - RNA, 19 nt, Homo sapiens
gaagaaaacugauggcuaa

SEQ ID NO: 1137269 - RNA, 19 nt, Homo sapiens
gaauagguguaucaaguaa

SEQ ID NO: 1137270 - RNA, 19 nt, Homo sapiens
gaaacaagccguggaauag

SEQ ID NO: 1137271 - RNA, 19 nt, Homo sapiens
ggaauagguguaucaagua

SEQ ID NO: 1137272 - RNA, 19 nt, Homo sapiens
guuaguguuucuagcauua

SEQ ID NO: 1137273 - RNA, 19 nt, Homo sapiens
gaaaggaaggcgucuguug

SEQ ID NO: 1137274 - RNA, 19 nt, Homo sapiens
gaagauggaacucgaaauc

SEQ ID NO: 1137275 - RNA, 19 nt, Homo sapiens
gaacaaccaacauugacuu

SEQ ID NO: 1137276 - RNA, 19 nt, Homo sapiens
ggagaaagcgcaggcuaaa

SEQ ID NO: 1137277 - RNA, 19 nt, Homo sapiens
acagauggaccaaagguua

SEQ ID NO: 1137278 - RNA, 19 nt, Homo sapiens
uggcuaaguuugcaugaaa

SEQ ID NO: 1137279 - RNA, 19 nt, Homo sapiens
uggaauagguguaucaagu

SEQ ID NO: 1137280 - RNA, 19 nt, Homo sapiens
gugcggaaguccugaguug

SEQ ID NO: 1137281 - RNA, 19 nt, Homo sapiens
agaaacaagccguggaaua

SEQ ID NO: 1137282 - RNA, 19 nt, Homo sapiens
caugaaaacugcacuuuau

SEQ ID NO: 1137283 - RNA, 19 nt, Homo sapiens
cgaauggagcuguuagaaa

SEQ ID NO: 1137284 - RNA, 19 nt, Homo sapiens
uagcacagauggaccaaag

SEQ ID NO: 1137285 - RNA, 19 nt, Homo sapiens
guagcaaagccaauacaaa

SEQ ID NO: 1137286 - RNA, 19 nt, Homo sapiens
uaugagagauagcacagau

SEQ ID NO: 1137287 - RNA, 19 nt, Homo sapiens
aaaggaaggcgucuguuga

SEQ ID NO: 1137288 - RNA, 19 nt, Homo sapiens
aaaccuacccagcaaagaa

SEQ ID NO: 1137289 - RNA, 19 nt, Homo sapiens
aacauugacuugccagcua

SEQ ID NO: 1137290 - RNA, 19 nt, Homo sapiens
cguaggagguggagguugu

SEQ ID NO: 1137291 - RNA, 19 nt, Homo sapiens
gaacuguauuccuguuuug

SEQ ID NO: 1137292 - RNA, 19 nt, Homo sapiens
ggagguggagguuguggaa

SEQ ID NO: 1137293 - RNA, 19 nt, Homo sapiens
cagcuagucucagaacugu

SEQ ID NO: 1137294 - RNA, 19 nt, Homo sapiens
gcagauggagggacagauc

SEQ ID NO: 1137295 - RNA, 19 nt, Homo sapiens
gagaggcgcuacggguuca

SEQ ID NO: 1137296 - RNA, 19 nt, Homo sapiens
gcacagauggaccaaaggu

SEQ ID NO: 1137297 - RNA, 19 nt, Homo sapiens
auagguguaucaaguaaug

SEQ ID NO: 1137298 - RNA, 19 nt, Homo sapiens
gaagcucucggucccauuc

SEQ ID NO: 1137299 - RNA, 19 nt, Homo sapiens
ccaacuacgugaacgacau

SEQ ID NO: 1137300 - RNA, 19 nt, Homo sapiens
aggugaagauguccaacua

SEQ ID NO: 1137301 - RNA, 19 nt, Homo sapiens
uauggacuguggauaccua

SEQ ID NO: 1137302 - RNA, 19 nt, Homo sapiens
caaguuaguguuucuagca

SEQ ID NO: 1137303 - RNA, 19 nt, Homo sapiens
gcaugaaaacugcacuuua

SEQ ID NO: 1137304 - RNA, 19 nt, Homo sapiens
aaagaaacaagccguggaa

SEQ ID NO: 1137305 - RNA, 19 nt, Homo sapiens
agcgaaagcucuaggaaca

SEQ ID NO: 1137306 - RNA, 19 nt, Homo sapiens
aaagguaacagaagaugga

SEQ ID NO: 1137307 - RNA, 19 nt, Homo sapiens
cgucuuacguuccgaaagg

SEQ ID NO: 1137308 - RNA, 19 nt, Homo sapiens
cuaaagcugccacagaaga

SEQ ID NO: 1137309 - RNA, 19 nt, Homo sapiens
uaaagccgcaggugaagau

SEQ ID NO: 1137310 - RNA, 19 nt, Homo sapiens
gcagauaugagagauagca

SEQ ID NO: 1137311 - RNA, 19 nt, Homo sapiens
gguggagguuguggaauuc

SEQ ID NO: 1137312 - RNA, 19 nt, Homo sapiens
uagcaaagccaauacaaaa

SEQ ID NO: 1137313 - RNA, 19 nt, Homo sapiens
cgaaagcucuaggaacaac

SEQ ID NO: 1137314 - RNA, 19 nt, Homo sapiens
gcagcgaaagcucuaggaa

SEQ ID NO: 1137315 - RNA, 19 nt, Homo sapiens
ggguacuugugcauuuaaa

SEQ ID NO: 1137316 - RNA, 19 nt, Homo sapiens
uaggaacaaccaacauuga

SEQ ID NO: 1137317 - RNA, 19 nt, Homo sapiens
ggaacucgaaaucccaaug

SEQ ID NO: 1137318 - RNA, 19 nt, Homo sapiens
agguggagguuguggaauu

SEQ ID NO: 1137319 - RNA, 19 nt, Homo sapiens
gaggagcacagcagaugga

SEQ ID NO: 1137320 - RNA, 19 nt, Homo sapiens
cagaagauggaacucgaaa

SEQ ID NO: 1137321 - RNA, 19 nt, Homo sapiens
cggagaaagcgcaggcuaa

SEQ ID NO: 1137322 - RNA, 19 nt, Homo sapiens
gugggagucuuuuguauau

SEQ ID NO: 1137323 - RNA, 19 nt, Homo sapiens
cauuaucccaucccuuuga

SEQ ID NO: 1137324 - RNA, 19 nt, Homo sapiens
cggaaaagguaacagaaga

SEQ ID NO: 1137325 - RNA, 19 nt, Homo sapiens
cuaggaacaaccaacauug

SEQ ID NO: 1137326 - RNA, 19 nt, Homo sapiens
ggaacaaccaacauugacu

SEQ ID NO: 1137327 - RNA, 19 nt, Homo sapiens
cagauggaccaaagguuau

SEQ ID NO: 1137328 - RNA, 19 nt, Homo sapiens
uugcagauaugagagauag

SEQ ID NO: 1137329 - RNA, 19 nt, Homo sapiens
agguuucucuugcagauau

SEQ ID NO: 1137330 - RNA, 19 nt, Homo sapiens
agcauuaucccaucccuuu

SEQ ID NO: 1137331 - RNA, 19 nt, Homo sapiens
caacuacgugaacgacaug

SEQ ID NO: 1137332 - RNA, 19 nt, Homo sapiens
ccauauggacuguggauac

SEQ ID NO: 1137333 - RNA, 19 nt, Homo sapiens
gguaacagaagauggaacu

SEQ ID NO: 1137334 - RNA, 19 nt, Homo sapiens
ucuaggaacaaccaacauu

SEQ ID NO: 1137335 - RNA, 19 nt, Homo sapiens
gcucuaggaacaaccaaca

SEQ ID NO: 1137336 - RNA, 19 nt, Homo sapiens
caaugcagcgaaagcucua

SEQ ID NO: 1137337 - RNA, 19 nt, Homo sapiens
uuagguuucucuugcagau

SEQ ID NO: 1137338 - RNA, 19 nt, Homo sapiens
gaggcuugcgggauccuuu

SEQ ID NO: 1137339 - RNA, 19 nt, Homo sapiens
ugaacuguauuccuguuuu

SEQ ID NO: 1137340 - RNA, 19 nt, Homo sapiens
cgggauccuuuccggagaa

SEQ ID NO: 1137341 - RNA, 19 nt, Homo sapiens
gaucgaauggagcuguuag

SEQ ID NO: 1137342 - RNA, 19 nt, Homo sapiens
gggagucuuuuguauauag

SEQ ID NO: 1137343 - RNA, 19 nt, Homo sapiens
gcauuaucccaucccuuug

SEQ ID NO: 1137344 - RNA, 19 nt, Homo sapiens
agaaagcgcaggcuaaagc

SEQ ID NO: 1137345 - RNA, 19 nt, Homo sapiens
guucgaaagcagggacuaa

SEQ ID NO: 1137346 - RNA, 19 nt, Homo sapiens
gcggaaguccugaguugag

SEQ ID NO: 1137347 - RNA, 19 nt, Homo sapiens
ggacuaaaagccccacuuc

SEQ ID NO: 1137348 - RNA, 19 nt, Homo sapiens
gaaaagguaacagaagaug

SEQ ID NO: 1137349 - RNA, 19 nt, Homo sapiens
aacaagccguggaauaggu

SEQ ID NO: 1137350 - RNA, 19 nt, Homo sapiens
aauggagcuguuagaaaua

SEQ ID NO: 1137351 - RNA, 19 nt, Homo sapiens
cagggguacuugugcauuu

SEQ ID NO: 1137352 - RNA, 19 nt, Homo sapiens
ugaaaacugcacuuuauug

SEQ ID NO: 1137353 - RNA, 19 nt, Homo sapiens
gcuuuggucgcacagugua

SEQ ID NO: 1137354 - RNA, 19 nt, Homo sapiens
ccaagaagcuggaacauua

SEQ ID NO: 1137355 - RNA, 19 nt, Homo sapiens
gagagagacuggauuauua

SEQ ID NO: 1137356 - RNA, 19 nt, Homo sapiens
aaacagagcuagaauguga

SEQ ID NO: 1137357 - RNA, 19 nt, Homo sapiens
gaaaauagauccccuuaaa

SEQ ID NO: 1137358 - RNA, 19 nt, Homo sapiens
gaaagguacuguccaagaa

SEQ ID NO: 1137359 - RNA, 19 nt, Homo sapiens
gagcaaugguucacauaaa

SEQ ID NO: 1137360 - RNA, 19 nt, Homo sapiens
gcaaugaaaugaagaaagg

SEQ ID NO: 1137361 - RNA, 19 nt, Homo sapiens
gaagagagauuuucaggaa

SEQ ID NO: 1137362 - RNA, 19 nt, Homo sapiens
gcuagaaugugaugucuga

SEQ ID NO: 1137363 - RNA, 19 nt, Homo sapiens
agacaugaaugaaguauug

SEQ ID NO: 1137364 - RNA, 19 nt, Homo sapiens
guaagaaucugaaggacau

SEQ ID NO: 1137365 - RNA, 19 nt, Homo sapiens
gaucaaaccugccagaaaa

SEQ ID NO: 1137366 - RNA, 19 nt, Homo sapiens
gaagaagcagcccugaaua

SEQ ID NO: 1137367 - RNA, 19 nt, Homo sapiens
gaaacugauuuguaacuca

SEQ ID NO: 1137368 - RNA, 19 nt, Homo sapiens
gaagaugcauuacauaagc

SEQ ID NO: 1137369 - RNA, 19 nt, Homo sapiens
ggagagaagcgaagcguuu

SEQ ID NO: 1137370 - RNA, 19 nt, Homo sapiens
gaagucaucgggaaaggua

SEQ ID NO: 1137371 - RNA, 19 nt, Homo sapiens
uccagaaacugauuuguaa

SEQ ID NO: 1137372 - RNA, 19 nt, Homo sapiens
gcagaucccucagcaggaa

SEQ ID NO: 1137373 - RNA, 19 nt, Homo sapiens
agaauaaacuggacaccuu

SEQ ID NO: 1137374 - RNA, 19 nt, Homo sapiens
acacacugguuuacucaua

SEQ ID NO: 1137375 - RNA, 19 nt, Homo sapiens
gcaaagagacaugaaugaa

SEQ ID NO: 1137376 - RNA, 19 nt, Homo sapiens
aagcagcccugaauaaaug

SEQ ID NO: 1137377 - RNA, 19 nt, Homo sapiens
ggaaagguacuguccaaga

SEQ ID NO: 1137378 - RNA, 19 nt, Homo sapiens
aaagagacaugaaugaagu

SEQ ID NO: 1137379 - RNA, 19 nt, Homo sapiens
ggauuugauuugugagaaa

SEQ ID NO: 1137380 - RNA, 19 nt, Homo sapiens
gcuacagagugauggauuu

SEQ ID NO: 1137381 - RNA, 19 nt, Homo sapiens
uggaaugacuccucuaaug

SEQ ID NO: 1137382 - RNA, 19 nt, Homo sapiens
gaacauuauuauccagcaa

SEQ ID NO: 1137383 - RNA, 19 nt, Homo sapiens
ggucucaaguugccucauu

SEQ ID NO: 1137384 - RNA, 19 nt, Homo sapiens
gaaaagggagcaaguaaaa

SEQ ID NO: 1137385 - RNA, 19 nt, Homo sapiens
gaagcagcccugaauaaau

SEQ ID NO: 1137386 - RNA, 19 nt, Homo sapiens
gcaagaagcuggaaaacuc

SEQ ID NO: 1137387 - RNA, 19 nt, Homo sapiens
gcaaccagaggcugaagua

SEQ ID NO: 1137388 - RNA, 19 nt, Homo sapiens
auacacagcccucauguuu

SEQ ID NO: 1137389 - RNA, 19 nt, Homo sapiens
gcaagaauguucgugucaa

SEQ ID NO: 1137390 - RNA, 19 nt, Homo sapiens
gaaguagguaucucucaaa

SEQ ID NO: 1137391 - RNA, 19 nt, Homo sapiens
aauaaaugcuacagaguga

SEQ ID NO: 1137392 - RNA, 19 nt, Homo sapiens
ugaaugaaguauuggcuau

SEQ ID NO: 1137393 - RNA, 19 nt, Homo sapiens
caauacagacgcaucguuu

SEQ ID NO: 1137394 - RNA, 19 nt, Homo sapiens
gcuauaagcuuuucaugga

SEQ ID NO: 1137395 - RNA, 19 nt, Homo sapiens
gagccgauguaaauuguca

SEQ ID NO: 1137396 - RNA, 19 nt, Homo sapiens
gaagcuggaacauuauuau

SEQ ID NO: 1137397 - RNA, 19 nt, Homo sapiens
agaaggagcuacuggaagu

SEQ ID NO: 1137398 - RNA, 19 nt, Homo sapiens
ggagcaaugguucacauaa

SEQ ID NO: 1137399 - RNA, 19 nt, Homo sapiens
ggacgagaauggaaugacu

SEQ ID NO: 1137400 - RNA, 19 nt, Homo sapiens
gaaagccugaguuaucuug

SEQ ID NO: 1137401 - RNA, 19 nt, Homo sapiens
ucucucagcguaugcauua

SEQ ID NO: 1137402 - RNA, 19 nt, Homo sapiens
gcauuguccucaccuuguu

SEQ ID NO: 1137403 - RNA, 19 nt, Homo sapiens
ugaaguagguaucucucaa

SEQ ID NO: 1137404 - RNA, 19 nt, Homo sapiens
guaauaaagacaucacaug

SEQ ID NO: 1137405 - RNA, 19 nt, Homo sapiens
ggagaaggagcuacuggaa

SEQ ID NO: 1137406 - RNA, 19 nt, Homo sapiens
aagcgaagcugaguuggaa

SEQ ID NO: 1137407 - RNA, 19 nt, Homo sapiens
gcagcugguucgaagcauu

SEQ ID NO: 1137408 - RNA, 19 nt, Homo sapiens
agaaauguaugaagcaaag

SEQ ID NO: 1137409 - RNA, 19 nt, Homo sapiens
cgagagagacuggauuauu

SEQ ID NO: 1137410 - RNA, 19 nt, Homo sapiens
cagcaauuguuucaaagga

SEQ ID NO: 1137411 - RNA, 19 nt, Homo sapiens
gauuccacauuucauagaa

SEQ ID NO: 1137412 - RNA, 19 nt, Homo sapiens
acagacgcaucguuucuuu

SEQ ID NO: 1137413 - RNA, 19 nt, Homo sapiens
uaagcuguaucuuucagaa

SEQ ID NO: 1137414 - RNA, 19 nt, Homo sapiens
ugauggauuugauuuguga

SEQ ID NO: 1137415 - RNA, 19 nt, Homo sapiens
gaauguucgugucaacugu

SEQ ID NO: 1137416 - RNA, 19 nt, Homo sapiens
ucugauggcuuuccagugu

SEQ ID NO: 1137417 - RNA, 19 nt, Homo sapiens
aaagacaucacauggguaa

SEQ ID NO: 1137418 - RNA, 19 nt, Homo sapiens
aaugugaugucugaagaua

SEQ ID NO: 1137419 - RNA, 19 nt, Homo sapiens
agaaugugaugucugaaga

SEQ ID NO: 1137420 - RNA, 19 nt, Homo sapiens
gagacuggauuauuacacu

SEQ ID NO: 1137421 - RNA, 19 nt, Homo sapiens
ugugaugucugaagauaau

SEQ ID NO: 1137422 - RNA, 19 nt, Homo sapiens
gcgguuggcuacucagugu

SEQ ID NO: 1137423 - RNA, 19 nt, Homo sapiens
gaauacagguuuucaagca

SEQ ID NO: 1137424 - RNA, 19 nt, Homo sapiens
acaggugucugaggaguaa

SEQ ID NO: 1137425 - RNA, 19 nt, Homo sapiens
cacacugguuuacucauaa

SEQ ID NO: 1137426 - RNA, 19 nt, Homo sapiens
gcaaugguucacauaaaga

SEQ ID NO: 1137427 - RNA, 19 nt, Homo sapiens
ugaaagcgaagcugaguug

SEQ ID NO: 1137428 - RNA, 19 nt, Homo sapiens
ugaaggacauuuacgaaaa

SEQ ID NO: 1137429 - RNA, 19 nt, Homo sapiens
gaagcaaagagacaugaau

SEQ ID NO: 1137430 - RNA, 19 nt, Homo sapiens
aagaagcagcccugaauaa

SEQ ID NO: 1137431 - RNA, 19 nt, Homo sapiens
guccugcggugauauucua

SEQ ID NO: 1137432 - RNA, 19 nt, Homo sapiens
ggaaggaaagaaagaaucu

SEQ ID NO: 1137433 - RNA, 19 nt, Homo sapiens
guucugaucccacugcauu

SEQ ID NO: 1137434 - RNA, 19 nt, Homo sapiens
gcauugcuccuguugaaau

SEQ ID NO: 1137435 - RNA, 19 nt, Homo sapiens
cuaugaagaugcauuacau

SEQ ID NO: 1137436 - RNA, 19 nt, Homo sapiens
caccugaaagccugaguua

SEQ ID NO: 1137437 - RNA, 19 nt, Homo sapiens
ugccauaguucagcuaauu

SEQ ID NO: 1137438 - RNA, 19 nt, Homo sapiens
caaagagacaugaaugaag

SEQ ID NO: 1137439 - RNA, 19 nt, Homo sapiens
ggaaugacuccucuaaugc

SEQ ID NO: 1137440 - RNA, 19 nt, Homo sapiens
ccugaguuaucuugcuaua

SEQ ID NO: 1137441 - RNA, 19 nt, Homo sapiens
ccugaacacucugaacuug

SEQ ID NO: 1137442 - RNA, 19 nt, Homo sapiens
gcagaacagguguggaaga

SEQ ID NO: 1137443 - RNA, 19 nt, Homo sapiens
aaugaaguauuggcuauga

SEQ ID NO: 1137444 - RNA, 19 nt, Homo sapiens
uugcugcacuuucugguaa

SEQ ID NO: 1137445 - RNA, 19 nt, Homo sapiens
acacagcccucauguuugc

SEQ ID NO: 1137446 - RNA, 19 nt, Homo sapiens
ccugaaagccugaguuauc

SEQ ID NO: 1137447 - RNA, 19 nt, Homo sapiens
uacagaggguaguuagaaa

SEQ ID NO: 1137448 - RNA, 19 nt, Homo sapiens
ccuauugauuucuguucua

SEQ ID NO: 1137449 - RNA, 19 nt, Homo sapiens
agaagaagcagcccugaau

SEQ ID NO: 1137450 - RNA, 19 nt, Homo sapiens
ucgugaugcuuguaaauga

SEQ ID NO: 1137451 - RNA, 19 nt, Homo sapiens
gaaugacuccucuaaugca

SEQ ID NO: 1137452 - RNA, 19 nt, Homo sapiens
uuaaacagagcuagaaugu

SEQ ID NO: 1137453 - RNA, 19 nt, Homo sapiens
gagcacuuccuuuccagaa

SEQ ID NO: 1137454 - RNA, 19 nt, Homo sapiens
gaacauggcuucaauuaag

SEQ ID NO: 1137455 - RNA, 19 nt, Homo sapiens
cuucaaagguuuacucuua

SEQ ID NO: 1137456 - RNA, 19 nt, Homo sapiens
uaaaguugcuggagaguaa

SEQ ID NO: 1137457 - RNA, 19 nt, Homo sapiens
uaaauuaccuuggcgauug

SEQ ID NO: 1137458 - RNA, 19 nt, Homo sapiens
uaaaucaucucaggacuuu

SEQ ID NO: 1137459 - RNA, 19 nt, Homo sapiens
ucaaaggacuguaaauuuc

SEQ ID NO: 1137460 - RNA, 19 nt, Homo sapiens
gaagauggcucaaaauaug

SEQ ID NO: 1137461 - RNA, 19 nt, Homo sapiens
gaauucaguucaccuaaug

SEQ ID NO: 1137462 - RNA, 19 nt, Homo sapiens
ccaggcauaucgucaguua

SEQ ID NO: 1137463 - RNA, 19 nt, Homo sapiens
ggacauggcgugcggcuuu

SEQ ID NO: 1137464 - RNA, 19 nt, Homo sapiens
cagcaucucuuugaaguuu

SEQ ID NO: 1137465 - RNA, 19 nt, Homo sapiens
agaagaagauugugguuga

SEQ ID NO: 1137466 - RNA, 19 nt, Homo sapiens
gcacgugcccuuuggagua

SEQ ID NO: 1137467 - RNA, 19 nt, Homo sapiens
ggacaucaaguaauaagaa

SEQ ID NO: 1137468 - RNA, 19 nt, Homo sapiens
gaagaggagaugucacuuu

SEQ ID NO: 1137469 - RNA, 19 nt, Homo sapiens
gaccagauauucaaguuca

SEQ ID NO: 1137470 - RNA, 19 nt, Homo sapiens
ggauaugacugggcagaaa

SEQ ID NO: 1137471 - RNA, 19 nt, Homo sapiens
gaauaacaccuguauguag

SEQ ID NO: 1137472 - RNA, 19 nt, Homo sapiens
ggaauaacaccuguaugua

SEQ ID NO: 1137473 - RNA, 19 nt, Homo sapiens
gagaagcuaagaugugaua

SEQ ID NO: 1137474 - RNA, 19 nt, Homo sapiens
ucgacgaggugcuuuauaa

SEQ ID NO: 1137475 - RNA, 19 nt, Homo sapiens
cagaacauggcuucaauua

SEQ ID NO: 1137476 - RNA, 19 nt, Homo sapiens
cagagaagcuaagauguga

SEQ ID NO: 1137477 - RNA, 19 nt, Homo sapiens
aagaagaaguagcugauuu

SEQ ID NO: 1137478 - RNA, 19 nt, Homo sapiens
gaagaagauugugguugaa

SEQ ID NO: 1137479 - RNA, 19 nt, Homo sapiens
gaagaguacauucggguuu

SEQ ID NO: 1137480 - RNA, 19 nt, Homo sapiens
caaagacagugcuacaaca

SEQ ID NO: 1137481 - RNA, 19 nt, Homo sapiens
gucaaaggacuguaaauuu

SEQ ID NO: 1137482 - RNA, 19 nt, Homo sapiens
ccaagagacuagcagagaa

SEQ ID NO: 1137483 - RNA, 19 nt, Homo sapiens
guagaucucucugggaaug

SEQ ID NO: 1137484 - RNA, 19 nt, Homo sapiens
gaacggcuguaguagaucu

SEQ ID NO: 1137485 - RNA, 19 nt, Homo sapiens
ggucaaaggacuguaaauu

SEQ ID NO: 1137486 - RNA, 19 nt, Homo sapiens
gcagagaagcuaagaugug

SEQ ID NO: 1137487 - RNA, 19 nt, Homo sapiens
uaaagaagcagcagaugau

SEQ ID NO: 1137488 - RNA, 19 nt, Homo sapiens
uaagacaacuaaagaacuc

SEQ ID NO: 1137489 - RNA, 19 nt, Homo sapiens
ggaagagacuuuuggaugu

SEQ ID NO: 1137490 - RNA, 19 nt, Homo sapiens
caacuaaagaacucaagaa

SEQ ID NO: 1137491 - RNA, 19 nt, Homo sapiens
uagaucgaauggacaagua

SEQ ID NO: 1137492 - RNA, 19 nt, Homo sapiens
aagaguacauucggguuua

SEQ ID NO: 1137493 - RNA, 19 nt, Homo sapiens
gaagauugugguugaauuc

SEQ ID NO: 1137494 - RNA, 19 nt, Homo sapiens
ucgcagcacucauuauuca

SEQ ID NO: 1137495 - RNA, 19 nt, Homo sapiens
gcuauugcuugccagcuuu

SEQ ID NO: 1137496 - RNA, 19 nt, Homo sapiens
cgaggugcuuuauaaauca

SEQ ID NO: 1137497 - RNA, 19 nt, Homo sapiens
gcucgcagcacucauuauu

SEQ ID NO: 1137498 - RNA, 19 nt, Homo sapiens
cgaauggacaaguauaauu

SEQ ID NO: 1137499 - RNA, 19 nt, Homo sapiens
gaucgaauggacaaguaua

SEQ ID NO: 1137500 - RNA, 19 nt, Homo sapiens
gaaaucaguacuggucaaa

SEQ ID NO: 1137501 - RNA, 19 nt, Homo sapiens
gugauacaguggugaguga

SEQ ID NO: 1137502 - RNA, 19 nt, Homo sapiens
ggauguggguaccugaaug

SEQ ID NO: 1137503 - RNA, 19 nt, Homo sapiens
guucuaccaucauaggaaa

SEQ ID NO: 1137504 - RNA, 19 nt, Homo sapiens
uaucgucaguuaccuucua

SEQ ID NO: 1137505 - RNA, 19 nt, Homo sapiens
guggguaccugaaugacuu

SEQ ID NO: 1137506 - RNA, 19 nt, Homo sapiens
aagaggagaugucacuuuc

SEQ ID NO: 1137507 - RNA, 19 nt, Homo sapiens
ugaugggacuucucucuau

SEQ ID NO: 1137508 - RNA, 19 nt, Homo sapiens
cagcaaguauuccaaaugc

SEQ ID NO: 1137509 - RNA, 19 nt, Homo sapiens
gaugggacuucucucuaug

SEQ ID NO: 1137510 - RNA, 19 nt, Homo sapiens
agaagcagcagaugauaaa

SEQ ID NO: 1137511 - RNA, 19 nt, Homo sapiens
agaagauugugguugaauu

SEQ ID NO: 1137512 - RNA, 19 nt, Homo sapiens
uaacaaagacagugcuaca

SEQ ID NO: 1137513 - RNA, 19 nt, Homo sapiens
guacuguaaugcgaaguga

SEQ ID NO: 1137514 - RNA, 19 nt, Homo sapiens
gcaucucuuugaaguuuau

SEQ ID NO: 1137515 - RNA, 19 nt, Homo sapiens
caaaggacuguaaauuuca

SEQ ID NO: 1137516 - RNA, 19 nt, Homo sapiens
caauuaaggaugcuacaga

SEQ ID NO: 1137517 - RNA, 19 nt, Homo sapiens
uaucugcaguuccaauuuc

SEQ ID NO: 1137518 - RNA, 19 nt, Homo sapiens
gauuggaacugggcgaugu

SEQ ID NO: 1137519 - RNA, 19 nt, Homo sapiens
ggaaugaagacucgaagag

SEQ ID NO: 1137520 - RNA, 19 nt, Homo sapiens
uuacaagcgucugggagua

SEQ ID NO: 1137521 - RNA, 19 nt, Homo sapiens
uuucaaagcuguccguucu

SEQ ID NO: 1137522 - RNA, 19 nt, Homo sapiens
acucuuaucugacuacaag

SEQ ID NO: 1137523 - RNA, 19 nt, Homo sapiens
uaaggaugcuacagaacau

SEQ ID NO: 1137524 - RNA, 19 nt, Homo sapiens
aauuaaggaugcuacagaa

SEQ ID NO: 1137525 - RNA, 19 nt, Homo sapiens
ggacuccuacugagaacaa

SEQ ID NO: 1137526 - RNA, 19 nt, Homo sapiens
gggaguauauuuugaugaa

SEQ ID NO: 1137527 - RNA, 19 nt, Homo sapiens
ggaguucuuccaacgauug

SEQ ID NO: 1137528 - RNA, 19 nt, Homo sapiens
agacagugcuacaacaagu

SEQ ID NO: 1137529 - RNA, 19 nt, Homo sapiens
guauguaggauguaauuuc

SEQ ID NO: 1137530 - RNA, 19 nt, Homo sapiens
uggaauaacaccuguaugu

SEQ ID NO: 1137531 - RNA, 19 nt, Homo sapiens
aagguuuacucuuaucuga

SEQ ID NO: 1137532 - RNA, 19 nt, Homo sapiens
uacagaacauggcuucaau

SEQ ID NO: 1137533 - RNA, 19 nt, Homo sapiens
gcacuuucacuguggcaaa

SEQ ID NO: 1137534 - RNA, 19 nt, Homo sapiens
ucaaagcuguccguucugu

SEQ ID NO: 1137535 - RNA, 19 nt, Homo sapiens
gacgaggugcuuuauaaau

SEQ ID NO: 1137536 - RNA, 19 nt, Homo sapiens
acaagcgucugggaguaua

SEQ ID NO: 1137537 - RNA, 19 nt, Homo sapiens
ugaaaucaguacuggucaa

SEQ ID NO: 1137538 - RNA, 19 nt, Homo sapiens
gaagcuaagaugugauaca

SEQ ID NO: 1137539 - RNA, 19 nt, Homo sapiens
gauguggguaccugaauga

SEQ ID NO: 1137540 - RNA, 19 nt, Homo sapiens
gaccauucaagaccagaua

SEQ ID NO: 1137541 - RNA, 19 nt, Homo sapiens
ucaaagguuuacucuuauc

SEQ ID NO: 1137542 - RNA, 19 nt, Homo sapiens
auucaggacuucaaagguu

SEQ ID NO: 1137543 - RNA, 19 nt, Homo sapiens
aggaacggcuguaguagau

SEQ ID NO: 1137544 - RNA, 19 nt, Homo sapiens
ggaacugggcgaugugcaa

SEQ ID NO: 1137545 - RNA, 19 nt, Homo sapiens
gauugugguugaauucagu

SEQ ID NO: 1137546 - RNA, 19 nt, Homo sapiens
caacaaguaauugaagaug

SEQ ID NO: 1137547 - RNA, 19 nt, Homo sapiens
gcaguuccaauuucccaaa

SEQ ID NO: 1137548 - RNA, 19 nt, Homo sapiens
acgaggugcuuuauaaauc

SEQ ID NO: 1137549 - RNA, 19 nt, Homo sapiens
cgacgaggugcuuuauaaa

SEQ ID NO: 1137550 - RNA, 19 nt, Homo sapiens
uuucgggacuugagcauug

SEQ ID NO: 1137551 - RNA, 19 nt, Homo sapiens
aagaccagauauucaaguu

SEQ ID NO: 1137552 - RNA, 19 nt, Homo sapiens
uaauaaagaagcagcagau

SEQ ID NO: 1137553 - RNA, 19 nt, Homo sapiens
gcaaaucucaaagaagcuu

SEQ ID NO: 1137554 - RNA, 19 nt, Homo sapiens
ugacaaagcuuuagagaaa

SEQ ID NO: 1137555 - RNA, 19 nt, Homo sapiens
ccagugauguguuuaauua

SEQ ID NO: 1137556 - RNA, 19 nt, Homo sapiens
gcaauaagcccuuuccuuu

SEQ ID NO: 1137557 - RNA, 19 nt, Homo sapiens
gaaacuaucccuaaaugua

SEQ ID NO: 1137558 - RNA, 19 nt, Homo sapiens
gaagaaacaugaaguuaca

SEQ ID NO: 1137559 - RNA, 19 nt, Homo sapiens
aaauaucgcugguuucaua

SEQ ID NO: 1137560 - RNA, 19 nt, Homo sapiens
ugagaacucuuacauagua

SEQ ID NO: 1137561 - RNA, 19 nt, Homo sapiens
gaagagaauugacucguau

SEQ ID NO: 1137562 - RNA, 19 nt, Homo sapiens
ggacaggaauugaagaaga

SEQ ID NO: 1137563 - RNA, 19 nt, Homo sapiens
cagaagaacuuucacauca

SEQ ID NO: 1137564 - RNA, 19 nt, Homo sapiens
gaagacaaaugcaaaccaa

SEQ ID NO: 1137565 - RNA, 19 nt, Homo sapiens
gaagaacuuucacaucaug

SEQ ID NO: 1137566 - RNA, 19 nt, Homo sapiens
uaaaugcacugcuggugua

SEQ ID NO: 1137567 - RNA, 19 nt, Homo sapiens
gaacgaaugccaaaucaga

SEQ ID NO: 1137568 - RNA, 19 nt, Homo sapiens
ucacugagcuguaacaaag

SEQ ID NO: 1137569 - RNA, 19 nt, Homo sapiens
cauaaagucugaugugguu

SEQ ID NO: 1137570 - RNA, 19 nt, Homo sapiens
ccaaauacacuacagaauu

SEQ ID NO: 1137571 - RNA, 19 nt, Homo sapiens
ugacauggcuuccagaauc

SEQ ID NO: 1137572 - RNA, 19 nt, Homo sapiens
cacauucacuucuauauug

SEQ ID NO: 1137573 - RNA, 19 nt, Homo sapiens
acagaaagcugaaaggaau

SEQ ID NO: 1137574 - RNA, 19 nt, Homo sapiens
gcacaucauuccucauugu

SEQ ID NO: 1137575 - RNA, 19 nt, Homo sapiens
caacuuuggucauaugaga

SEQ ID NO: 1137576 - RNA, 19 nt, Homo sapiens
gaauacauguacaacuuug

SEQ ID NO: 1137577 - RNA, 19 nt, Homo sapiens
cagaaucacugagcuguaa

SEQ ID NO: 1137578 - RNA, 19 nt, Homo sapiens
agauuuagcucauggauau

SEQ ID NO: 1137579 - RNA, 19 nt, Homo sapiens
gcacugcugguguaaauaa

SEQ ID NO: 1137580 - RNA, 19 nt, Homo sapiens
ugaaaucuauucugcauuc

SEQ ID NO: 1137581 - RNA, 19 nt, Homo sapiens
gcagagaauuccuugaaag

SEQ ID NO: 1137582 - RNA, 19 nt, Homo sapiens
aauaagcccuuuccuuuga

SEQ ID NO: 1137583 - RNA, 19 nt, Homo sapiens
gaaagaaagaauucaccua

SEQ ID NO: 1137584 - RNA, 19 nt, Homo sapiens
gcagaagcauguugaugug

SEQ ID NO: 1137585 - RNA, 19 nt, Homo sapiens
guacaacuuuggucauaug

SEQ ID NO: 1137586 - RNA, 19 nt, Homo sapiens
gguuguaucuuguaucaga

SEQ ID NO: 1137587 - RNA, 19 nt, Homo sapiens
gagauacucaguugaauug

SEQ ID NO: 1137588 - RNA, 19 nt, Homo sapiens
gcacauucacuucuauauu

SEQ ID NO: 1137589 - RNA, 19 nt, Homo sapiens
uagaaacuaucccuaaaug

SEQ ID NO: 1137590 - RNA, 19 nt, Homo sapiens
cgucggagguuaagauuau

SEQ ID NO: 1137591 - RNA, 19 nt, Homo sapiens
agaaggagauacucaguug

SEQ ID NO: 1137592 - RNA, 19 nt, Homo sapiens
gauguucacuccaaauaca

SEQ ID NO: 1137593 - RNA, 19 nt, Homo sapiens
gugcauauuugaacuacaa

SEQ ID NO: 1137594 - RNA, 19 nt, Homo sapiens
agaagagaauugacucgua

SEQ ID NO: 1137595 - RNA, 19 nt, Homo sapiens
ugacacaccuccaacuuca

SEQ ID NO: 1137596 - RNA, 19 nt, Homo sapiens
ggcaauugcuccugcugua

SEQ ID NO: 1137597 - RNA, 19 nt, Homo sapiens
caauaguggugccaaauca

SEQ ID NO: 1137598 - RNA, 19 nt, Homo sapiens
cccaagaguuuauguuuau

SEQ ID NO: 1137599 - RNA, 19 nt, Homo sapiens
ccaguaaguuaaguuguaa

SEQ ID NO: 1137600 - RNA, 19 nt, Homo sapiens
cagaauguauugacuaugg

SEQ ID NO: 1137601 - RNA, 19 nt, Homo sapiens
uaaaucaguggguaucaua

SEQ ID NO: 1137602 - RNA, 19 nt, Homo sapiens
gggaacgaaugccaaauca

SEQ ID NO: 1137603 - RNA, 19 nt, Homo sapiens
cugcugguguaaauaauua

SEQ ID NO: 1137604 - RNA, 19 nt, Homo sapiens
cauaggcagugaugaagaa

SEQ ID NO: 1137605 - RNA, 19 nt, Homo sapiens
gaaccgaucccuucucucu

SEQ ID NO: 1137606 - RNA, 19 nt, Homo sapiens
ucccaagaguuuauguuua

SEQ ID NO: 1137607 - RNA, 19 nt, Homo sapiens
gaaguugauagccugguua

SEQ ID NO: 1137608 - RNA, 19 nt, Homo sapiens
aagauuccauuuccaguuu

SEQ ID NO: 1137609 - RNA, 19 nt, Homo sapiens
uaugaggguuugaaagaaa

SEQ ID NO: 1137610 - RNA, 19 nt, Homo sapiens
ugauauaccacucugauaa

SEQ ID NO: 1137611 - RNA, 19 nt, Homo sapiens
guaagucuguugguuguau

SEQ ID NO: 1137612 - RNA, 19 nt, Homo sapiens
ggagauacucaguugaauu

SEQ ID NO: 1137613 - RNA, 19 nt, Homo sapiens
guaagacuugugcuuguua

SEQ ID NO: 1137614 - RNA, 19 nt, Homo sapiens
cuaagcacauucacuucua

SEQ ID NO: 1137615 - RNA, 19 nt, Homo sapiens
cccaguaaguuaaguugua

SEQ ID NO: 1137616 - RNA, 19 nt, Homo sapiens
gagcaucuguagagcugaa

SEQ ID NO: 1137617 - RNA, 19 nt, Homo sapiens
cuguagagcugaaaguauu

SEQ ID NO: 1137618 - RNA, 19 nt, Homo sapiens
uaauugcucuagugcauau

SEQ ID NO: 1137619 - RNA, 19 nt, Homo sapiens
gcgcagagaauuccuugaa

SEQ ID NO: 1137620 - RNA, 19 nt, Homo sapiens
cauagccagugauguguuu

SEQ ID NO: 1137621 - RNA, 19 nt, Homo sapiens
caugggagcauccaaauau

SEQ ID NO: 1137622 - RNA, 19 nt, Homo sapiens
gaagcauguugaugugaau

SEQ ID NO: 1137623 - RNA, 19 nt, Homo sapiens
gaaacaugaaguuacacua

SEQ ID NO: 1137624 - RNA, 19 nt, Homo sapiens
uguguacugugguuuauuu

SEQ ID NO: 1137625 - RNA, 19 nt, Homo sapiens
gauacucaguugaauugga

SEQ ID NO: 1137626 - RNA, 19 nt, Homo sapiens
gacuucagguaccagcuua

SEQ ID NO: 1137627 - RNA, 19 nt, Homo sapiens
ugacauaggcagugaugaa

SEQ ID NO: 1137628 - RNA, 19 nt, Homo sapiens
cagaaucccaguaaguuaa

SEQ ID NO: 1137629 - RNA, 19 nt, Homo sapiens
ggugccaaaucaaauggua

SEQ ID NO: 1137630 - RNA, 19 nt, Homo sapiens
ggaggauaauuucuuaaac

SEQ ID NO: 1137631 - RNA, 19 nt, Homo sapiens
caauaagcccuuuccuuug

SEQ ID NO: 1137632 - RNA, 19 nt, Homo sapiens
ucagaaucccaguaaguua

SEQ ID NO: 1137633 - RNA, 19 nt, Homo sapiens
ucaaauguaugaacugcau

SEQ ID NO: 1137634 - RNA, 19 nt, Homo sapiens
ggguguaccuaugaaauug

SEQ ID NO: 1137635 - RNA, 19 nt, Homo sapiens
aaaccaaagcaacuuagua

SEQ ID NO: 1137636 - RNA, 19 nt, Homo sapiens
gcagaagaacuuucacauc

SEQ ID NO: 1137637 - RNA, 19 nt, Homo sapiens
gggaguuacugaucaucuu

SEQ ID NO: 1137638 - RNA, 19 nt, Homo sapiens
gagauuuagcucauggaua

SEQ ID NO: 1137639 - RNA, 19 nt, Homo sapiens
gacauggcuuccagaauca

SEQ ID NO: 1137640 - RNA, 19 nt, Homo sapiens
gcauguugaugugaauuau

SEQ ID NO: 1137641 - RNA, 19 nt, Homo sapiens
gacagaaagcugaaaggaa

SEQ ID NO: 1137642 - RNA, 19 nt, Homo sapiens
gauacuaugugcccuucau

SEQ ID NO: 1137643 - RNA, 19 nt, Homo sapiens
ggaauuauaaugggaaaca

SEQ ID NO: 1137644 - RNA, 19 nt, Homo sapiens
gaaaaugcugggaauuaua

SEQ ID NO: 1137645 - RNA, 19 nt, Homo sapiens
aaccaaagcaacuuaguaa

SEQ ID NO: 1137646 - RNA, 19 nt, Homo sapiens
gaggauaauuucuuaaacc

SEQ ID NO: 1137647 - RNA, 19 nt, Homo sapiens
gacaggaauugaagaagag

SEQ ID NO: 1137648 - RNA, 19 nt, Homo sapiens
gaauguauugacuauggua

SEQ ID NO: 1137649 - RNA, 19 nt, Homo sapiens
ccaaauaucgcugguuuca

SEQ ID NO: 1137650 - RNA, 19 nt, Homo sapiens
gaacuuucacaucaugaga

SEQ ID NO: 1137651 - RNA, 19 nt, Homo sapiens
uaagccacauuucuaaagu

SEQ ID NO: 1137652 - RNA, 19 nt, Homo sapiens
ccagaaagcaaaauugaua

SEQ ID NO: 1137653 - RNA, 19 nt, Homo sapiens
gauccucuauuaccauucu

SEQ ID NO: 1137654 - RNA, 19 nt, Homo sapiens
caaggaagauguaaggaaa

SEQ ID NO: 1137655 - RNA, 19 nt, Homo sapiens
cuagagaccuugauguuaa

SEQ ID NO: 1137656 - RNA, 19 nt, Homo sapiens
aaacauaccucaagcuuca

SEQ ID NO: 1137657 - RNA, 19 nt, Homo sapiens
ugaaagaacuagguaauga

SEQ ID NO: 1137658 - RNA, 19 nt, Homo sapiens
gaaagaccacuaagaugua

SEQ ID NO: 1137659 - RNA, 19 nt, Homo sapiens
ccacuaagauguaacuguu

SEQ ID NO: 1137660 - RNA, 19 nt, Homo sapiens
ggaaagaccacuaagaugu

SEQ ID NO: 1137661 - RNA, 19 nt, Homo sapiens
gggaguggauuaaugauuc

SEQ ID NO: 1137662 - RNA, 19 nt, Homo sapiens
gaaaagagaggauguacua

SEQ ID NO: 1137663 - RNA, 19 nt, Homo sapiens
cagcagaagauacuaauuu

SEQ ID NO: 1137664 - RNA, 19 nt, Homo sapiens
gauaaacauuucgcauuga

SEQ ID NO: 1137665 - RNA, 19 nt, Homo sapiens
uaagagaggcauuuacuga

SEQ ID NO: 1137666 - RNA, 19 nt, Homo sapiens
agauaaacauuucgcauug

SEQ ID NO: 1137667 - RNA, 19 nt, Homo sapiens
gcaaggaagauguaaggaa

SEQ ID NO: 1137668 - RNA, 19 nt, Homo sapiens
gaaguucuauucaguuuug

SEQ ID NO: 1137669 - RNA, 19 nt, Homo sapiens
gcaaauugaacuucuggaa

SEQ ID NO: 1137670 - RNA, 19 nt, Homo sapiens
gauacuaauucaucagcaa

SEQ ID NO: 1137671 - RNA, 19 nt, Homo sapiens
agauguaacuguuguuguu

SEQ ID NO: 1137672 - RNA, 19 nt, Homo sapiens
gaaccacccucaaaauaga

SEQ ID NO: 1137673 - RNA, 19 nt, Homo sapiens
guaccaguagguuauguua

SEQ ID NO: 1137674 - RNA, 19 nt, Homo sapiens
agucauaacucuggaaaga

SEQ ID NO: 1137675 - RNA, 19 nt, Homo sapiens
gaaaguaguaacauguaug

SEQ ID NO: 1137676 - RNA, 19 nt, Homo sapiens
gcaccaccaccaccauuaa

SEQ ID NO: 1137677 - RNA, 19 nt, Homo sapiens
ggaccucccggacauauug

SEQ ID NO: 1137678 - RNA, 19 nt, Homo sapiens
gaugauuggugccuguuuc

SEQ ID NO: 1137679 - RNA, 19 nt, Homo sapiens
aaagagaggauguacuaaa

SEQ ID NO: 1137680 - RNA, 19 nt, Homo sapiens
gcacccaugucuaacaaag

SEQ ID NO: 1137681 - RNA, 19 nt, Homo sapiens
aaagaccacuaagauguaa

SEQ ID NO: 1137682 - RNA, 19 nt, Homo sapiens
ccaauucccuagagaccuu

SEQ ID NO: 1137683 - RNA, 19 nt, Homo sapiens
gaagucauaacucuggaaa

SEQ ID NO: 1137684 - RNA, 19 nt, Homo sapiens
uggaaguucuauucaguuu

SEQ ID NO: 1137685 - RNA, 19 nt, Homo sapiens
ggaauacuuaagucagaua

SEQ ID NO: 1137686 - RNA, 19 nt, Homo sapiens
ccuugaggauuacugauaa

SEQ ID NO: 1137687 - RNA, 19 nt, Homo sapiens
ugaaagccgugaugauugg

SEQ ID NO: 1137688 - RNA, 19 nt, Homo sapiens
gaaaucaagaacagcuuug

SEQ ID NO: 1137689 - RNA, 19 nt, Homo sapiens
agagaggcauuuacugaug

SEQ ID NO: 1137690 - RNA, 19 nt, Homo sapiens
uagagaccuugauguuaaa

SEQ ID NO: 1137691 - RNA, 19 nt, Homo sapiens
ucuaaacgguuccuuccuu

SEQ ID NO: 1137692 - RNA, 19 nt, Homo sapiens
ccagugaaccacccucaaa

SEQ ID NO: 1137693 - RNA, 19 nt, Homo sapiens
gccaggauuggaauacuua

SEQ ID NO: 1137694 - RNA, 19 nt, Homo sapiens
ccucauugacuacauguuu

SEQ ID NO: 1137695 - RNA, 19 nt, Homo sapiens
ccuagagaccuugauguua

SEQ ID NO: 1137696 - RNA, 19 nt, Homo sapiens
ccaagcuccuccuggugua

SEQ ID NO: 1137697 - RNA, 19 nt, Homo sapiens
ccucaagcuucacagauau

SEQ ID NO: 1137698 - RNA, 19 nt, Homo sapiens
gauuaaugauuccggaucu

SEQ ID NO: 1137699 - RNA, 19 nt, Homo sapiens
aaugaaagccgugaugauu

SEQ ID NO: 1137700 - RNA, 19 nt, Homo sapiens
ggauuggaauacuuaaguc

SEQ ID NO: 1137701 - RNA, 19 nt, Homo sapiens
cuguggaacucauuuaaau

SEQ ID NO: 1137702 - RNA, 19 nt, Homo sapiens
uaaugugggucgagaaguc

SEQ ID NO: 1137703 - RNA, 19 nt, Homo sapiens
ccuuuuaccuugaggauua

SEQ ID NO: 1137704 - RNA, 19 nt, Homo sapiens
guggaacucauuuaaauuc

SEQ ID NO: 1137705 - RNA, 19 nt, Homo sapiens
guauugcggguguugauuu

SEQ ID NO: 1137706 - RNA, 19 nt, Homo sapiens
uaaacuguccgccaggauu

SEQ ID NO: 1137707 - RNA, 19 nt, Homo sapiens
aauggagaaugaagccuuu

SEQ ID NO: 1137708 - RNA, 19 nt, Homo sapiens
uacugaugcugacaacuuu

SEQ ID NO: 1137709 - RNA, 19 nt, Homo sapiens
accucaagcuucacagaua

SEQ ID NO: 1137710 - RNA, 19 nt, Homo sapiens
ccuguuuccucauugacua

SEQ ID NO: 1137711 - RNA, 19 nt, Homo sapiens
ccaugucuaacaaaguuua

SEQ ID NO: 1137712 - RNA, 19 nt, Homo sapiens
acccaugucuaacaaaguu

SEQ ID NO: 1137713 - RNA, 19 nt, Homo sapiens
ggagauagaaauccaagcu

SEQ ID NO: 1137714 - RNA, 19 nt, Homo sapiens
gcuuugggcagaggauuua

SEQ ID NO: 1137715 - RNA, 19 nt, Homo sapiens
ugaaaucaagaacagcuuu

SEQ ID NO: 1137716 - RNA, 19 nt, Homo sapiens
cagcuggcauuccuguuca

SEQ ID NO: 1137717 - RNA, 19 nt, Homo sapiens
gaaagaacuagguaaugac

SEQ ID NO: 1137718 - RNA, 19 nt, Homo sapiens
uuacugaugcugacaacuu

SEQ ID NO: 1137719 - RNA, 19 nt, Homo sapiens
aagagaggauguacuaaaa

SEQ ID NO: 1137720 - RNA, 19 nt, Homo sapiens
gcagcagaagauacuaauu

SEQ ID NO: 1137721 - RNA, 19 nt, Homo sapiens
cauauugucuacccuaagc

SEQ ID NO: 1137722 - RNA, 19 nt, Homo sapiens
gucgagaagucauaacucu

SEQ ID NO: 1137723 - RNA, 19 nt, Homo sapiens
cuucacagauauaggacuu

SEQ ID NO: 1137724 - RNA, 19 nt, Homo sapiens
uguaugaaaucaagaacag

SEQ ID NO: 1137725 - RNA, 19 nt, Homo sapiens
acuaagauguaacuguugu

SEQ ID NO: 1137726 - RNA, 19 nt, Homo sapiens
gauaaugugggucgagaag

SEQ ID NO: 1137727 - RNA, 19 nt, Homo sapiens
agcagaagauacuaauuuc

SEQ ID NO: 1137728 - RNA, 19 nt, Homo sapiens
gcugacaacuuuggaaucc

SEQ ID NO: 1137729 - RNA, 19 nt, Homo sapiens
uaagauguaacuguuguug

SEQ ID NO: 1137730 - RNA, 19 nt, Homo sapiens
gggcagaggauuuauuuug

SEQ ID NO: 1137731 - RNA, 19 nt, Homo sapiens
uaucuguggaacucauuua

SEQ ID NO: 1137732 - RNA, 19 nt, Homo sapiens
gugugggaguggauuaaug

SEQ ID NO: 1137733 - RNA, 19 nt, Homo sapiens
gugccuguuuccucauuga

SEQ ID NO: 1137734 - RNA, 19 nt, Homo sapiens
ucacagauauaggacuucu

SEQ ID NO: 1137735 - RNA, 19 nt, Homo sapiens
gugguuggcaggauuucua

SEQ ID NO: 1137736 - RNA, 19 nt, Homo sapiens
uggcacccaugucuaacaa

SEQ ID NO: 1137737 - RNA, 19 nt, Homo sapiens
ucuggaaguucuauucagu

SEQ ID NO: 1137738 - RNA, 19 nt, Homo sapiens
uuggaauacuuaagucaga

SEQ ID NO: 1137739 - RNA, 19 nt, Homo sapiens
uuaaugauuccggaucuuu

SEQ ID NO: 1137740 - RNA, 19 nt, Homo sapiens
gugaaccacccucaaaaua

SEQ ID NO: 1137741 - RNA, 19 nt, Homo sapiens
cgcauugaauauuuacaug

SEQ ID NO: 1137742 - RNA, 19 nt, Homo sapiens
aaacuguccgccaggauug

SEQ ID NO: 1137743 - RNA, 19 nt, Homo sapiens
aaacgguuccuuccuucuu

SEQ ID NO: 1137744 - RNA, 19 nt, Homo sapiens
cgccaggauuggaauacuu

SEQ ID NO: 1137745 - RNA, 19 nt, Homo sapiens
gauguaacuguuguuguug

SEQ ID NO: 1137746 - RNA, 19 nt, Homo sapiens
cuggaaagaccacuaagau

SEQ ID NO: 1137747 - RNA, 19 nt, Homo sapiens
uaaugauuccggaucuuug

SEQ ID NO: 1137748 - RNA, 19 nt, Homo sapiens
gguguugauuuugagauua

SEQ ID NO: 1137749 - RNA, 19 nt, Homo sapiens
uguaucgugugcagcugua

SEQ ID NO: 1137750 - RNA, 19 nt, Homo sapiens
gaauacuuaagucagauag

SEQ ID NO: 1137751 - RNA, 19 nt, Homo sapiens
gcauuccuguucaaaauca

SEQ ID NO: 1137752 - RNA, 19 nt, Homo sapiens
uggaaagaccacuaagaug

SEQ ID NO: 1137753 - RNA, 19 nt, Homo sapiens
gauuggaauacuuaaguca

SEQ ID NO: 1137754 - RNA, 19 nt, Homo sapiens
gcacagacaccaacuuuga

SEQ ID NO: 1137755 - RNA, 19 nt, Homo sapiens
ccacauuccucauugacua

SEQ ID NO: 1137756 - RNA, 19 nt, Homo sapiens
gaacuaagccacccagaca

SEQ ID NO: 1137757 - RNA, 19 nt, Homo sapiens
cauaucagcuuucacacuu

SEQ ID NO: 1137758 - RNA, 19 nt, Homo sapiens
gcaucugcuuggccaauua

SEQ ID NO: 1137759 - RNA, 19 nt, Homo sapiens
ggagccacauuccucauug

SEQ ID NO: 1137760 - RNA, 19 nt, Homo sapiens
ccucugccgucaccaguua

SEQ ID NO: 1137761 - RNA, 19 nt, Homo sapiens
acacaggcauaucagcuuu

SEQ ID NO: 1137762 - RNA, 19 nt, Homo sapiens
caaagacgguggauauagc

SEQ ID NO: 1137763 - RNA, 19 nt, Homo sapiens
gagccacauuccucauuga

SEQ ID NO: 1137764 - RNA, 19 nt, Homo sapiens
gacuacauguucuuugaga

SEQ ID NO: 1137765 - RNA, 19 nt, Homo sapiens
ggagaccuguaaucgguau

SEQ ID NO: 1137766 - RNA, 19 nt, Homo sapiens
gcugcaucuuuauauguua

SEQ ID NO: 1137767 - RNA, 19 nt, Homo sapiens
ggugaagacucgggaugaa

SEQ ID NO: 1137768 - RNA, 19 nt, Homo sapiens
ccaacuuccucucccacua

SEQ ID NO: 1137769 - RNA, 19 nt, Homo sapiens
cgagaagcccucacagaug

SEQ ID NO: 1137770 - RNA, 19 nt, Homo sapiens
ggcugcaucuuuauauguu

SEQ ID NO: 1137771 - RNA, 19 nt, Homo sapiens
gcagcugccucuccgucuu

SEQ ID NO: 1137772 - RNA, 19 nt, Homo sapiens
uaucagcuuucacacuuuc

SEQ ID NO: 1137773 - RNA, 19 nt, Homo sapiens
ccaccucccuacccuguca

SEQ ID NO: 1137774 - RNA, 19 nt, Homo sapiens
cagacaccaucaucucgaa

SEQ ID NO: 1137775 - RNA, 19 nt, Homo sapiens
ccaaagacgguggauauag

SEQ ID NO: 1137776 - RNA, 19 nt, Homo sapiens
uugacuacauguucuuuga

SEQ ID NO: 1137777 - RNA, 19 nt, Homo sapiens
ccaccaggcaccaccauug

SEQ ID NO: 1137778 - RNA, 19 nt, Homo sapiens
gcagauugaucagauuuug

SEQ ID NO: 1137779 - RNA, 19 nt, Homo sapiens
ccucagaccauggcacuuu

SEQ ID NO: 1137780 - RNA, 19 nt, Homo sapiens
ggaugccgaucgccagaca

SEQ ID NO: 1137781 - RNA, 19 nt, Homo sapiens
ggugcagauugaucagauu

SEQ ID NO: 1137782 - RNA, 19 nt, Homo sapiens
ucacagaugcagaugacuu

SEQ ID NO: 1137783 - RNA, 19 nt, Homo sapiens
ccgagaagcccucacagau

SEQ ID NO: 1137784 - RNA, 19 nt, Homo sapiens
gugcagauugaucagauuu

SEQ ID NO: 1137785 - RNA, 19 nt, Homo sapiens
ccaaaggaggccucuggaa

SEQ ID NO: 1137786 - RNA, 19 nt, Homo sapiens
cacagaugcagaugacuuu

SEQ ID NO: 1137787 - RNA, 19 nt, Homo sapiens
uggcacagacaccaacuuu

SEQ ID NO: 1137788 - RNA, 19 nt, Homo sapiens
cgauuccugugccuuaugu

SEQ ID NO: 1137789 - RNA, 19 nt, Homo sapiens
gaauuccuggugcagauug

SEQ ID NO: 1137790 - RNA, 19 nt, Homo sapiens
gcuggugcuugcugcgauu

SEQ ID NO: 1137791 - RNA, 19 nt, Homo sapiens
caacuuccucucccacuag

SEQ ID NO: 1137792 - RNA, 19 nt, Homo sapiens
gggagccacauuccucauu

SEQ ID NO: 1137793 - RNA, 19 nt, Homo sapiens
ccucacagaugcagaugac

SEQ ID NO: 1137794 - RNA, 19 nt, Homo sapiens
gaccuguaaucgguaugaa

SEQ ID NO: 1137795 - RNA, 19 nt, Homo sapiens
ucgaauuccuggugcagau

SEQ ID NO: 1137796 - RNA, 19 nt, Homo sapiens
ccucauugacuacauguuc

SEQ ID NO: 1137797 - RNA, 19 nt, Homo sapiens
ugacuuuggccuacaguuc

SEQ ID NO: 1137798 - RNA, 19 nt, Homo sapiens
accgugaggugcugcguuu

SEQ ID NO: 1137799 - RNA, 19 nt, Homo sapiens
gggcaagcugcaccaaaga

SEQ ID NO: 1137800 - RNA, 19 nt, Homo sapiens
gcauaucagcuuucacacu

SEQ ID NO: 1137801 - RNA, 19 nt, Homo sapiens
ugaagacucgggaugaauc

SEQ ID NO: 1137802 - RNA, 19 nt, Homo sapiens
gaaggcugagcgaguggaa

SEQ ID NO: 1137803 - RNA, 19 nt, Homo sapiens
cagcugccucuccgucuuu

SEQ ID NO: 1137804 - RNA, 19 nt, Homo sapiens
accaucaccucgaccagaa

SEQ ID NO: 1137805 - RNA, 19 nt, Homo sapiens
cugcgauuccugugccuua

SEQ ID NO: 1137806 - RNA, 19 nt, Homo sapiens
ucccauggcaggcuacuug

SEQ ID NO: 1137807 - RNA, 19 nt, Homo sapiens
acaggcauaucagcuuuca

SEQ ID NO: 1137808 - RNA, 19 nt, Homo sapiens
caaggagggguauguauga

SEQ ID NO: 1137809 - RNA, 19 nt, Homo sapiens
agggcaagcugcaccaaag

SEQ ID NO: 1137810 - RNA, 19 nt, Homo sapiens
aggcauaucagcuuucaca

SEQ ID NO: 1137811 - RNA, 19 nt, Homo sapiens
aaggcugcaucuuuauaug

SEQ ID NO: 1137812 - RNA, 19 nt, Homo sapiens
cagggccucugcuccaaag

SEQ ID NO: 1137813 - RNA, 19 nt, Homo sapiens
caccauuggccacgugcua

SEQ ID NO: 1137814 - RNA, 19 nt, Homo sapiens
ugacagagguuaaggauga

SEQ ID NO: 1137815 - RNA, 19 nt, Homo sapiens
gcuauuaccuaucaaauug

SEQ ID NO: 1137816 - RNA, 19 nt, Homo sapiens
gaaaagagaugauguugaa

SEQ ID NO: 1137817 - RNA, 19 nt, Homo sapiens
agaaagaacugauuccaaa

SEQ ID NO: 1137818 - RNA, 19 nt, Homo sapiens
aaagagagcuauuaccuau

SEQ ID NO: 1137819 - RNA, 19 nt, Homo sapiens
uagaaaggcuuguuaccua

SEQ ID NO: 1137820 - RNA, 19 nt, Homo sapiens
guaaagaagagcaacguua

SEQ ID NO: 1137821 - RNA, 19 nt, Homo sapiens
ggaugaugcuguaaagaaa

SEQ ID NO: 1137822 - RNA, 19 nt, Homo sapiens
gccagauacuuguuaauaa

SEQ ID NO: 1137823 - RNA, 19 nt, Homo sapiens
ccaauauucuguugaaguu

SEQ ID NO: 1137824 - RNA, 19 nt, Homo sapiens
gaagcuguccucagaaauu

SEQ ID NO: 1137825 - RNA, 19 nt, Homo sapiens
gcuaagggcuggaaugaag

SEQ ID NO: 1137826 - RNA, 19 nt, Homo sapiens
ggauuuggcuaaaguuuca

SEQ ID NO: 1137827 - RNA, 19 nt, Homo sapiens
gaaauuugaucaacaagcu

SEQ ID NO: 1137828 - RNA, 19 nt, Homo sapiens
gaaugcaucuuugacaguu

SEQ ID NO: 1137829 - RNA, 19 nt, Homo sapiens
gaagagcaacguuauagug

SEQ ID NO: 1137830 - RNA, 19 nt, Homo sapiens
cgacgaagauggagggaau

SEQ ID NO: 1137831 - RNA, 19 nt, Homo sapiens
cagaagcuguccucagaaa

SEQ ID NO: 1137832 - RNA, 19 nt, Homo sapiens
uagaagaccugaaagucaa

SEQ ID NO: 1137833 - RNA, 19 nt, Homo sapiens
ggaaucaccagaacucuug

SEQ ID NO: 1137834 - RNA, 19 nt, Homo sapiens
ggagcgcgcugcuguuuag

SEQ ID NO: 1137835 - RNA, 19 nt, Homo sapiens
ggccagauacuuguuaaua

SEQ ID NO: 1137836 - RNA, 19 nt, Homo sapiens
gaaauucgucaucuguuga

SEQ ID NO: 1137837 - RNA, 19 nt, Homo sapiens
gagaugauguugaaguuuu

SEQ ID NO: 1137838 - RNA, 19 nt, Homo sapiens
ggaaauuugucuggguuau

SEQ ID NO: 1137839 - RNA, 19 nt, Homo sapiens
caaagagagcuauuaccua

SEQ ID NO: 1137840 - RNA, 19 nt, Homo sapiens
ccaccaagcccaaaccaaa

SEQ ID NO: 1137841 - RNA, 19 nt, Homo sapiens
ggagcuccgugcaaaguga

SEQ ID NO: 1137842 - RNA, 19 nt, Homo sapiens
gaacauguguaacuuuuca

SEQ ID NO: 1137843 - RNA, 19 nt, Homo sapiens
gaaauuucacaguucauug

SEQ ID NO: 1137844 - RNA, 19 nt, Homo sapiens
uaaagaagagcaacguuau

SEQ ID NO: 1137845 - RNA, 19 nt, Homo sapiens
agagagcuauuaccuauca

SEQ ID NO: 1137846 - RNA, 19 nt, Homo sapiens
ggcaaaagcuaaagagaaa

SEQ ID NO: 1137847 - RNA, 19 nt, Homo sapiens
gcugauagaagaccugaaa

SEQ ID NO: 1137848 - RNA, 19 nt, Homo sapiens
ggugggagcuccgugcaaa

SEQ ID NO: 1137849 - RNA, 19 nt, Homo sapiens
aaauuugucuggguuauug

SEQ ID NO: 1137850 - RNA, 19 nt, Homo sapiens
agaaauucgucaucuguug

SEQ ID NO: 1137851 - RNA, 19 nt, Homo sapiens
aggaugagcuggagccauu

SEQ ID NO: 1137852 - RNA, 19 nt, Homo sapiens
ugaaggauuuggcuaaagu

SEQ ID NO: 1137853 - RNA, 19 nt, Homo sapiens
ggaaauuucacaguucauu

SEQ ID NO: 1137854 - RNA, 19 nt, Homo sapiens
aagcaaaacugaaguacua

SEQ ID NO: 1137855 - RNA, 19 nt, Homo sapiens
aaaggaagccaauacuuga

SEQ ID NO: 1137856 - RNA, 19 nt, Homo sapiens
gcugcugccugugcuguua

SEQ ID NO: 1137857 - RNA, 19 nt, Homo sapiens
guaaagaaagaacugauuc

SEQ ID NO: 1137858 - RNA, 19 nt, Homo sapiens
uuagggaaauuucacaguu

SEQ ID NO: 1137859 - RNA, 19 nt, Homo sapiens
gaaauagaagacaggcaaa

SEQ ID NO: 1137860 - RNA, 19 nt, Homo sapiens
ggagaaugccgaugaugau

SEQ ID NO: 1137861 - RNA, 19 nt, Homo sapiens
ggaggagaaugccgaugau

SEQ ID NO: 1137862 - RNA, 19 nt, Homo sapiens
gaaauuugucuggguuauu

SEQ ID NO: 1137863 - RNA, 19 nt, Homo sapiens
gcaaagagagcuauuaccu

SEQ ID NO: 1137864 - RNA, 19 nt, Homo sapiens
uaaggaugaugcuguaaag

SEQ ID NO: 1137865 - RNA, 19 nt, Homo sapiens
cuuguuaccuaccgaaauu

SEQ ID NO: 1137866 - RNA, 19 nt, Homo sapiens
aaagaagagcaacguuaua

SEQ ID NO: 1137867 - RNA, 19 nt, Homo sapiens
cgaaaggaaucaccagaac

SEQ ID NO: 1137868 - RNA, 19 nt, Homo sapiens
aguauuagcuuagggaaau

SEQ ID NO: 1137869 - RNA, 19 nt, Homo sapiens
agagagaaguucagaagag

SEQ ID NO: 1137870 - RNA, 19 nt, Homo sapiens
aagagaugauguugaaguu

SEQ ID NO: 1137871 - RNA, 19 nt, Homo sapiens
gcaauaugaaggugcuuga

SEQ ID NO: 1137872 - RNA, 19 nt, Homo sapiens
ggaggaggcacagaucauu

SEQ ID NO: 1137873 - RNA, 19 nt, Homo sapiens
uacaaccucuacuugaauu

SEQ ID NO: 1137874 - RNA, 19 nt, Homo sapiens
gauagaagaccugaaaguc

SEQ ID NO: 1137875 - RNA, 19 nt, Homo sapiens
gcgaaaggaaucaccagaa

SEQ ID NO: 1137876 - RNA, 19 nt, Homo sapiens
gaaugccgaugaugauggu

SEQ ID NO: 1137877 - RNA, 19 nt, Homo sapiens
gaucaggagucugcaaacu

SEQ ID NO: 1137878 - RNA, 19 nt, Homo sapiens
guacaaccucuacuugaau

SEQ ID NO: 1137879 - RNA, 19 nt, Homo sapiens
gaacuaugggagcaauaug

SEQ ID NO: 1137880 - RNA, 19 nt, Homo sapiens
aaauagcacugaagaacag

SEQ ID NO: 1137881 - RNA, 19 nt, Homo sapiens
uggagaugauuuaggauug

SEQ ID NO: 1137882 - RNA, 19 nt, Homo sapiens
ggacaccagcuacuaccaa

SEQ ID NO: 1137883 - RNA, 19 nt, Homo sapiens
aagagaagcugaaaauguu

SEQ ID NO: 1137884 - RNA, 19 nt, Homo sapiens
auaugaaggugcuugagaa

SEQ ID NO: 1137885 - RNA, 19 nt, Homo sapiens
gaagacaggcaaaagcuaa

SEQ ID NO: 1137886 - RNA, 19 nt, Homo sapiens
ggaccaaguacaaccucua

SEQ ID NO: 1137887 - RNA, 19 nt, Homo sapiens
uaagaacuaugggagcaau

SEQ ID NO: 1137888 - RNA, 19 nt, Homo sapiens
aauuauugcucgaacauca

SEQ ID NO: 1137889 - RNA, 19 nt, Homo sapiens
uagggaaauuucacaguuc

SEQ ID NO: 1137890 - RNA, 19 nt, Homo sapiens
gaucgcaaucccagaguga

SEQ ID NO: 1137891 - RNA, 19 nt, Homo sapiens
aaccaaagucuguuucaaa

SEQ ID NO: 1137892 - RNA, 19 nt, Homo sapiens
uguugacacuuaaggauga

SEQ ID NO: 1137893 - RNA, 19 nt, Homo sapiens
gaaguucagaagagccaaa

SEQ ID NO: 1137894 - RNA, 19 nt, Homo sapiens
ugagcuggagccauuguua

SEQ ID NO: 1137895 - RNA, 19 nt, Homo sapiens
gcaacguuauaguggugaa

SEQ ID NO: 1137896 - RNA, 19 nt, Homo sapiens
ucgugaaguucguaaagaa

SEQ ID NO: 1137897 - RNA, 19 nt, Homo sapiens
uauuugauccugaaagcua

SEQ ID NO: 1137898 - RNA, 19 nt, Homo sapiens
cgugaaggauuuggcuaaa

SEQ ID NO: 1137899 - RNA, 19 nt, Homo sapiens
gcaagaggaugauuuuggu

SEQ ID NO: 1137900 - RNA, 19 nt, Homo sapiens
ggacgaugaggacgacgaa

SEQ ID NO: 1137901 - RNA, 19 nt, Homo sapiens
cccuagauauggacgauga

SEQ ID NO: 1137902 - RNA, 19 nt, Homo sapiens
gagcuauuaccuaucaaau

SEQ ID NO: 1137903 - RNA, 19 nt, Homo sapiens
aucagaagcuguccucaga

SEQ ID NO: 1137904 - RNA, 19 nt, Homo sapiens
gaaaaggaagccaauacuu

SEQ ID NO: 1137905 - RNA, 19 nt, Homo sapiens
gaaaggaaucaccagaacu

SEQ ID NO: 1137906 - RNA, 19 nt, Homo sapiens
gaaggauuuggcuaaaguu

SEQ ID NO: 1137907 - RNA, 19 nt, Homo sapiens
cagaggaggaggaaagaga

SEQ ID NO: 1137908 - RNA, 19 nt, Homo sapiens
acguuauaguggugaauua

SEQ ID NO: 1137909 - RNA, 19 nt, Homo sapiens
gaaaauagcacugaagaac

SEQ ID NO: 1137910 - RNA, 19 nt, Homo sapiens
acuuaaggaugaugcugua

SEQ ID NO: 1137911 - RNA, 19 nt, Homo sapiens
gucauagaaaggcuuguua

SEQ ID NO: 1137912 - RNA, 19 nt, Homo sapiens
ggagaugauuuaggauugc

SEQ ID NO: 1137913 - RNA, 19 nt, Homo sapiens
cuaaagagaaagaaagaag

SEQ ID NO: 1137914 - RNA, 19 nt, Homo sapiens
ccaaaucccugacucaaua

SEQ ID NO: 1137915 - RNA, 19 nt, Homo sapiens
gaacuguacugcugcauuu

SEQ ID NO: 1137916 - RNA, 19 nt, Homo sapiens
gcacauggguuauaaugag

SEQ ID NO: 1137917 - RNA, 19 nt, Homo sapiens
gggagcacauggguuauaa

SEQ ID NO: 1137918 - RNA, 19 nt, Homo sapiens
gcacucaccauccuuauca

SEQ ID NO: 1137919 - RNA, 19 nt, Homo sapiens
ggccagacaucguacucua

SEQ ID NO: 1137920 - RNA, 19 nt, Homo sapiens
gcuguuccgugaccucuuu

SEQ ID NO: 1137921 - RNA, 19 nt, Homo sapiens
ccagacaucguacucuaua

SEQ ID NO: 1137922 - RNA, 19 nt, Homo sapiens
ggcuuuggcuguuaccuuu

SEQ ID NO: 1137923 - RNA, 19 nt, Homo sapiens
guggacagaugccuaccua

SEQ ID NO: 1137924 - RNA, 19 nt, Homo sapiens
gagcacauggguuauaaug

SEQ ID NO: 1137925 - RNA, 19 nt, Homo sapiens
ccaccugaguuaucuccua

SEQ ID NO: 1137926 - RNA, 19 nt, Homo sapiens
gggauucucagucgaguuu

SEQ ID NO: 1137927 - RNA, 19 nt, Homo sapiens
ucaauaaaguaagcgugua

SEQ ID NO: 1137928 - RNA, 19 nt, Homo sapiens
ccacaagggagcacucauu

SEQ ID NO: 1137929 - RNA, 19 nt, Homo sapiens
ucaugaaccugcauuacug

SEQ ID NO: 1137930 - RNA, 19 nt, Homo sapiens
gcaggaggcccuacagaca

SEQ ID NO: 1137931 - RNA, 19 nt, Homo sapiens
caacagcacucaccauccu

SEQ ID NO: 1137932 - RNA, 19 nt, Homo sapiens
aggccaagaucacagagua

SEQ ID NO: 1137933 - RNA, 19 nt, Homo sapiens
uaaaguaagcguguaccua

SEQ ID NO: 1137934 - RNA, 19 nt, Homo sapiens
cuacacacccuaacuaaag

SEQ ID NO: 1137935 - RNA, 19 nt, Homo sapiens
ucaccauccuuaucaugaa

SEQ ID NO: 1137936 - RNA, 19 nt, Homo sapiens
caucguacucuauaacaaa

SEQ ID NO: 1137937 - RNA, 19 nt, Homo sapiens
caagggagcacucauuguc

SEQ ID NO: 1137938 - RNA, 19 nt, Homo sapiens
cuuccuagguggcugcuuu

SEQ ID NO: 1137939 - RNA, 19 nt, Homo sapiens
gaucacagaguacagucuu

SEQ ID NO: 1137940 - RNA, 19 nt, Homo sapiens
ccacagcuccuccagaaag

SEQ ID NO: 1137941 - RNA, 19 nt, Homo sapiens
cagacaucguacucuauaa

SEQ ID NO: 1137942 - RNA, 19 nt, Homo sapiens
ccaagugguugcuggucuu

SEQ ID NO: 1137943 - RNA, 19 nt, Homo sapiens
ggaaaagggucggggauuc

SEQ ID NO: 1137944 - RNA, 19 nt, Homo sapiens
acacuugacuucacaaucc

SEQ ID NO: 1137945 - RNA, 19 nt, Homo sapiens
agccacagcuccuccagaa

SEQ ID NO: 1137946 - RNA, 19 nt, Homo sapiens
gugcugacccuguaucugu

SEQ ID NO: 1137947 - RNA, 19 nt, Homo sapiens
aaugagaaacugaacugua

SEQ ID NO: 1137948 - RNA, 19 nt, Homo sapiens
caaaggccaagaucacaga

SEQ ID NO: 1137949 - RNA, 19 nt, Homo sapiens
cggcaggaguggacagaug

SEQ ID NO: 1137950 - RNA, 19 nt, Homo sapiens
ggagggacagaauuguuug

SEQ ID NO: 1137951 - RNA, 19 nt, Homo sapiens
ugagacacuugacuucaca

SEQ ID NO: 1137952 - RNA, 19 nt, Homo sapiens
guaagcguguaccuagcaa

SEQ ID NO: 1137953 - RNA, 19 nt, Homo sapiens
caaaucccugacucaauaa

SEQ ID NO: 1137954 - RNA, 19 nt, Homo sapiens
gagcaggaggcccuacaga

SEQ ID NO: 1137955 - RNA, 19 nt, Homo sapiens
acagaugccuaccuacgau

SEQ ID NO: 1137956 - RNA, 19 nt, Homo sapiens
cacauggguuauaaugaga

SEQ ID NO: 1137957 - RNA, 19 nt, Homo sapiens
agggagcacucauugucua

SEQ ID NO: 1137958 - RNA, 19 nt, Homo sapiens
gcucaccgucuuccaguug

SEQ ID NO: 1137959 - RNA, 19 nt, Homo sapiens
cauggguuauaaugagaaa

SEQ ID NO: 1137960 - RNA, 19 nt, Homo sapiens
gcagggcuuuggcuguuac

SEQ ID NO: 1137961 - RNA, 19 nt, Homo sapiens
augagaaacugaacuguac

SEQ ID NO: 1137962 - RNA, 19 nt, Homo sapiens
aguacuacauggccacuau

SEQ ID NO: 1137963 - RNA, 19 nt, Homo sapiens
gacagaugccuaccuacga

SEQ ID NO: 1137964 - RNA, 19 nt, Homo sapiens
uggagggacagaauuguuu

SEQ ID NO: 1137965 - RNA, 19 nt, Homo sapiens
cacccuaacuaaaggaagu

SEQ ID NO: 1137966 - RNA, 19 nt, Homo sapiens
cacaagggagcacucauug

SEQ ID NO: 1137967 - RNA, 19 nt, Homo sapiens
aggaggcccuacagacauu

SEQ ID NO: 1137968 - RNA, 19 nt, Homo sapiens
ccuaagauccugagacacu

SEQ ID NO: 1137969 - RNA, 19 nt, Homo sapiens
uuuccugucuuccuuccua

SEQ ID NO: 1137970 - RNA, 19 nt, Homo sapiens
cuccuaagauccugagaca

SEQ ID NO: 1137971 - RNA, 19 nt, Homo sapiens
gagaaacugaacuguacug

SEQ ID NO: 1137972 - RNA, 19 nt, Homo sapiens
ugucuacacacccuaacua

SEQ ID NO: 1137973 - RNA, 19 nt, Homo sapiens
gcaccacguagccaccauu

SEQ ID NO: 1137974 - RNA, 19 nt, Homo sapiens
uggcggacuucguggagaa

SEQ ID NO: 1137975 - RNA, 19 nt, Homo sapiens
caagaucacagaguacagu

SEQ ID NO: 1137976 - RNA, 19 nt, Homo sapiens
cuaagauccugagacacuu

SEQ ID NO: 1137977 - RNA, 19 nt, Homo sapiens
acagcacucaccauccuua

SEQ ID NO: 1137978 - RNA, 19 nt, Homo sapiens
gacaucguacucuauaaca

SEQ ID NO: 1137979 - RNA, 19 nt, Homo sapiens
uugcagggcuuuggcuguu

SEQ ID NO: 1137980 - RNA, 19 nt, Homo sapiens
gguuauaaugagaaacuga

SEQ ID NO: 1137981 - RNA, 19 nt, Homo sapiens
ugaacuguacugcugcauu

SEQ ID NO: 1137982 - RNA, 19 nt, Homo sapiens
gagcacucauugucuacac

SEQ ID NO: 1137983 - RNA, 19 nt, Homo sapiens
ggcuggcucucaagcuguu

SEQ ID NO: 1137984 - RNA, 19 nt, Homo sapiens
acaucguacucuauaacaa

SEQ ID NO: 1137985 - RNA, 19 nt, Homo sapiens
caauaaaguaagcguguac

SEQ ID NO: 1137986 - RNA, 19 nt, Homo sapiens
cuacaaaggccaagaucac

SEQ ID NO: 1137987 - RNA, 19 nt, Homo sapiens
gggcuuuggcuguuaccuu

SEQ ID NO: 1137988 - RNA, 19 nt, Homo sapiens
uaagauccugagacacuug

SEQ ID NO: 1137989 - RNA, 19 nt, Homo sapiens
gucuacacacccuaacuaa

SEQ ID NO: 1137990 - RNA, 19 nt, Homo sapiens
ugaccucuuugccaacuac

SEQ ID NO: 1137991 - RNA, 19 nt, Homo sapiens
gagaagagacugauaaauu

SEQ ID NO: 1137992 - RNA, 19 nt, Homo sapiens
ggugguaucuugucuguuu

SEQ ID NO: 1137993 - RNA, 19 nt, Homo sapiens
gugcaucgcuuuagaagaa

SEQ ID NO: 1137994 - RNA, 19 nt, Homo sapiens
gauaucaguuccauguaua

SEQ ID NO: 1137995 - RNA, 19 nt, Homo sapiens
gauaucaguugccuguaua

SEQ ID NO: 1137996 - RNA, 19 nt, Homo sapiens
gauaucaguucccuguaua

SEQ ID NO: 1137997 - RNA, 19 nt, Homo sapiens
gauaucaguugccuguaua

SEQ ID NO: 1137998 - RNA, 19 nt, Homo sapiens
gauaucaguucccuguaua

SEQ ID NO: 1137999 - RNA, 19 nt, Homo sapiens
gauaucaguugccuguaua

SEQ ID NO: 1138000 - RNA, 19 nt, Homo sapiens
gauaucaguucccuguaua

SEQ ID NO: 1138001 - RNA, 19 nt, Homo sapiens
gauaucaguugccuguaua

SEQ ID NO: 1138002 - RNA, 19 nt, Homo sapiens
gauaucaguucccuguaua

SEQ ID NO: 1138003 - RNA, 19 nt, Homo sapiens
gauaucaguugccuguaua

SEQ ID NO: 1138004 - RNA, 19 nt, Homo sapiens
gauaucaguugccuguaua

SEQ ID NO: 1138005 - RNA, 19 nt, Homo sapiens
ggauuuguuucguuuguua

SEQ ID NO: 1138006 - RNA, 19 nt, Homo sapiens
gaagaaguuuggcaguauu

SEQ ID NO: 1138007 - RNA, 19 nt, Homo sapiens
gauaguaggaucacagaua

SEQ ID NO: 1138008 - RNA, 19 nt, Homo sapiens
ggauaucaguuccauguau

SEQ ID NO: 1138009 - RNA, 19 nt, Homo sapiens
agaagagacugauaaauuc

SEQ ID NO: 1138010 - RNA, 19 nt, Homo sapiens
gucaguugcuuguauauaa

SEQ ID NO: 1138011 - RNA, 19 nt, Homo sapiens
gaugucaguugcuuguaua

SEQ ID NO: 1138012 - RNA, 19 nt, Homo sapiens
ggauaucaguugccuguau

SEQ ID NO: 1138013 - RNA, 19 nt, Homo sapiens
ggauaucaguucccuguau

SEQ ID NO: 1138014 - RNA, 19 nt, Homo sapiens
ggauaucaguugccuguau

SEQ ID NO: 1138015 - RNA, 19 nt, Homo sapiens
ggauaucaguucccuguau

SEQ ID NO: 1138016 - RNA, 19 nt, Homo sapiens
ggauaucaguugccuguau

SEQ ID NO: 1138017 - RNA, 19 nt, Homo sapiens
ggauaucaguucccuguau

SEQ ID NO: 1138018 - RNA, 19 nt, Homo sapiens
ggauaucaguugccuguau

SEQ ID NO: 1138019 - RNA, 19 nt, Homo sapiens
ggauaucaguucccuguau

SEQ ID NO: 1138020 - RNA, 19 nt, Homo sapiens
ggauaucaguugccuguau

SEQ ID NO: 1138021 - RNA, 19 nt, Homo sapiens
ggauaucaguugccuguau

SEQ ID NO: 1138022 - RNA, 19 nt, Homo sapiens
gaacugguguguccaaagg

SEQ ID NO: 1138023 - RNA, 19 nt, Homo sapiens
uaaauuccguuguuacuca

SEQ ID NO: 1138024 - RNA, 19 nt, Homo sapiens
ccucucagcuaucuaguuu

SEQ ID NO: 1138025 - RNA, 19 nt, Homo sapiens
gaaguuuggcaguauuuaa

SEQ ID NO: 1138026 - RNA, 19 nt, Homo sapiens
uagaagaaguuuggcagua

SEQ ID NO: 1138027 - RNA, 19 nt, Homo sapiens
gagcaaaggagaaaucugu

SEQ ID NO: 1138028 - RNA, 19 nt, Homo sapiens
ggaugucaguugcuuguau

SEQ ID NO: 1138029 - RNA, 19 nt, Homo sapiens
gcagccacguccuuuggua

SEQ ID NO: 1138030 - RNA, 19 nt, Homo sapiens
ccacguccuuugguaguua

SEQ ID NO: 1138031 - RNA, 19 nt, Homo sapiens
ggaugaaacugagauugga

SEQ ID NO: 1138032 - RNA, 19 nt, Homo sapiens
ucaguugccuguauauaau

SEQ ID NO: 1138033 - RNA, 19 nt, Homo sapiens
ucaguugccuguauauaau

SEQ ID NO: 1138034 - RNA, 19 nt, Homo sapiens
ucaguugccuguauauaau

SEQ ID NO: 1138035 - RNA, 19 nt, Homo sapiens
caugggaaguugcugguuu

SEQ ID NO: 1138036 - RNA, 19 nt, Homo sapiens
ccagagaagagacugauaa

SEQ ID NO: 1138037 - RNA, 19 nt, Homo sapiens
ucaggucacugcuggauau

SEQ ID NO: 1138038 - RNA, 19 nt, Homo sapiens
ucaggucacugcuggauau

SEQ ID NO: 1138039 - RNA, 19 nt, Homo sapiens
ucaguugccuguauacaau

SEQ ID NO: 1138040 - RNA, 19 nt, Homo sapiens
ucaguucccuguauacaau

SEQ ID NO: 1138041 - RNA, 19 nt, Homo sapiens
ucaguugccuguauacaau

SEQ ID NO: 1138042 - RNA, 19 nt, Homo sapiens
ucaguucccuguauacaau

SEQ ID NO: 1138043 - RNA, 19 nt, Homo sapiens
ucaguugccuguauacaau

SEQ ID NO: 1138044 - RNA, 19 nt, Homo sapiens
ucaguucccuguauacaau

SEQ ID NO: 1138045 - RNA, 19 nt, Homo sapiens
ucaguucccuguauacaau

SEQ ID NO: 1138046 - RNA, 19 nt, Homo sapiens
cagauacauuuccauggua

SEQ ID NO: 1138047 - RNA, 19 nt, Homo sapiens
uauccaagaucaccauuuc

SEQ ID NO: 1138048 - RNA, 19 nt, Homo sapiens
ggaaguugcugguuuugaa

SEQ ID NO: 1138049 - RNA, 19 nt, Homo sapiens
gaucacagauacauuucca

SEQ ID NO: 1138050 - RNA, 19 nt, Homo sapiens
caccaugucugcugcaaau

SEQ ID NO: 1138051 - RNA, 19 nt, Homo sapiens
gaccgaagcauacaaaugg

SEQ ID NO: 1138052 - RNA, 19 nt, Homo sapiens
gcuauggauuuguuucguu

SEQ ID NO: 1138053 - RNA, 19 nt, Homo sapiens
ucagcuaucuaguuucaug

SEQ ID NO: 1138054 - RNA, 19 nt, Homo sapiens
agaagaaguuuggcaguau

SEQ ID NO: 1138055 - RNA, 19 nt, Homo sapiens
ggaccgaagcauacaaaug

SEQ ID NO: 1138056 - RNA, 19 nt, Homo sapiens
cugauaaauuccguuguua

SEQ ID NO: 1138057 - RNA, 19 nt, Homo sapiens
uacaaauggugguaucuug

SEQ ID NO: 1138058 - RNA, 19 nt, Homo sapiens
ucaguuccauguauacaau

SEQ ID NO: 1138059 - RNA, 19 nt, Homo sapiens
gaaagaagugaagauaauc

SEQ ID NO: 1138060 - RNA, 19 nt, Homo sapiens
gugaaagaagugaagauaa

SEQ ID NO: 1138061 - RNA, 19 nt, Homo sapiens
guaaaucacacugaaacuu

SEQ ID NO: 1138062 - RNA, 19 nt, Homo sapiens
uauccaaguucaccauuuc

SEQ ID NO: 1138063 - RNA, 19 nt, Homo sapiens
uaggaucacagauacauuu

SEQ ID NO: 1138064 - RNA, 19 nt, Homo sapiens
cuauggauuuguuucguuu

SEQ ID NO: 1138065 - RNA, 19 nt, Homo sapiens
ucucagcuaucuaguuuca

SEQ ID NO: 1138066 - RNA, 19 nt, Homo sapiens
acugauaaauuccguuguu

SEQ ID NO: 1138067 - RNA, 19 nt, Homo sapiens
ucaagucgccacuggauau

SEQ ID NO: 1138068 - RNA, 19 nt, Homo sapiens
ucaagucgccacuggauau

SEQ ID NO: 1138069 - RNA, 19 nt, Homo sapiens
ucaagucgccacuggauau

SEQ ID NO: 1138070 - RNA, 19 nt, Homo sapiens
uaucagccauuuccugcuu

SEQ ID NO: 1138071 - RNA, 19 nt, Homo sapiens
ucaagucgccacuggauau

SEQ ID NO: 1138072 - RNA, 19 nt, Homo sapiens
uaucagccauuuccugcuu

SEQ ID NO: 1138073 - RNA, 19 nt, Homo sapiens
guuaugugcucgucaugug

SEQ ID NO: 1138074 - RNA, 19 nt, Homo sapiens
acagauacauuuccauggu

SEQ ID NO: 1138075 - RNA, 19 nt, Homo sapiens
agauacauuuccaugguaa

SEQ ID NO: 1138076 - RNA, 19 nt, Homo sapiens
cagagaagagacugauaaa

SEQ ID NO: 1138077 - RNA, 19 nt, Homo sapiens
uaucuugucuguuuaaucc

SEQ ID NO: 1138078 - RNA, 19 nt, Homo sapiens
uguauacaauuaccagaug

SEQ ID NO: 1138079 - RNA, 19 nt, Homo sapiens
gguguuaccagaaggcaaa

SEQ ID NO: 1138080 - RNA, 19 nt, Homo sapiens
gauaaauuccguuguuacu

SEQ ID NO: 1138081 - RNA, 19 nt, Homo sapiens
ggugaaacacugccucugu

SEQ ID NO: 1138082 - RNA, 19 nt, Homo sapiens
ggcaguauuuaaaucuguu

SEQ ID NO: 1138083 - RNA, 19 nt, Homo sapiens
aagagugcaucgcuuuaga

SEQ ID NO: 1138084 - RNA, 19 nt, Homo sapiens
gugguaucuugucuguuua

SEQ ID NO: 1138085 - RNA, 19 nt, Homo sapiens
uauccaaauucaccaguuc

SEQ ID NO: 1138086 - RNA, 19 nt, Homo sapiens
uauccaaauucaccaguuc

SEQ ID NO: 1138087 - RNA, 19 nt, Homo sapiens
uauccaaauucaccaguuc

SEQ ID NO: 1138088 - RNA, 19 nt, Homo sapiens
aagauaaucacgaaucgaa

SEQ ID NO: 1138089 - RNA, 19 nt, Homo sapiens
ggucaccacuggauaucag

SEQ ID NO: 1138090 - RNA, 19 nt, Homo sapiens
ggucaccacuggauaucag

SEQ ID NO: 1138091 - RNA, 19 nt, Homo sapiens
guauugagcuuugcauuua

SEQ ID NO: 1138092 - RNA, 19 nt, Homo sapiens
gagaagagacugauaaauu

SEQ ID NO: 1138093 - RNA, 19 nt, Homo sapiens
ggugguaucuugucuguuu

SEQ ID NO: 1138094 - RNA, 19 nt, Homo sapiens
gugcaucgcuuuagaagaa

SEQ ID NO: 1138095 - RNA, 19 nt, Homo sapiens
gauaucaguuccauguaua

SEQ ID NO: 1138096 - RNA, 19 nt, Homo sapiens
gauaucaguugccuguaua

SEQ ID NO: 1138097 - RNA, 19 nt, Homo sapiens
gauaucaguugccuguaua

SEQ ID NO: 1138098 - RNA, 19 nt, Homo sapiens
gauaucaguugccuguaua

SEQ ID NO: 1138099 - RNA, 19 nt, Homo sapiens
gauaucaguugccuguaua

SEQ ID NO: 1138100 - RNA, 19 nt, Homo sapiens
gauaucaguugccuguaua

SEQ ID NO: 1138101 - RNA, 19 nt, Homo sapiens
gauaucaguugccuguaua

SEQ ID NO: 1138102 - RNA, 19 nt, Homo sapiens
gauaucaguugccuguaua

SEQ ID NO: 1138103 - RNA, 19 nt, Homo sapiens
gauaucaguugccuguaua

SEQ ID NO: 1138104 - RNA, 19 nt, Homo sapiens
gauaucaguucccuguaua

SEQ ID NO: 1138105 - RNA, 19 nt, Homo sapiens
gauaucaguugccuguaua

SEQ ID NO: 1138106 - RNA, 19 nt, Homo sapiens
gauaucaguucccuguaua

SEQ ID NO: 1138107 - RNA, 19 nt, Homo sapiens
gauaucaguugccuguaua

SEQ ID NO: 1138108 - RNA, 19 nt, Homo sapiens
gauaucaguugccuguaua

SEQ ID NO: 1138109 - RNA, 19 nt, Homo sapiens
ggauuuguuucguuuguua

SEQ ID NO: 1138110 - RNA, 19 nt, Homo sapiens
gaagaaguuuggcaguauu

SEQ ID NO: 1138111 - RNA, 19 nt, Homo sapiens
gauaguaggaucacagaua

SEQ ID NO: 1138112 - RNA, 19 nt, Homo sapiens
ggauaucaguuccauguau

SEQ ID NO: 1138113 - RNA, 19 nt, Homo sapiens
agaagagacugauaaauuc

SEQ ID NO: 1138114 - RNA, 19 nt, Homo sapiens
gucaguugcuuguauauaa

SEQ ID NO: 1138115 - RNA, 19 nt, Homo sapiens
gaugucaguugcuuguaua

SEQ ID NO: 1138116 - RNA, 19 nt, Homo sapiens
gcauuucacuucuccaaga

SEQ ID NO: 1138117 - RNA, 19 nt, Homo sapiens
ggauaucaguugccuguau

SEQ ID NO: 1138118 - RNA, 19 nt, Homo sapiens
ggauaucaguugccuguau

SEQ ID NO: 1138119 - RNA, 19 nt, Homo sapiens
ggauaucaguugccuguau

SEQ ID NO: 1138120 - RNA, 19 nt, Homo sapiens
ggauaucaguugccuguau

SEQ ID NO: 1138121 - RNA, 19 nt, Homo sapiens
ggauaucaguugccuguau

SEQ ID NO: 1138122 - RNA, 19 nt, Homo sapiens
ggauaucaguugccuguau

SEQ ID NO: 1138123 - RNA, 19 nt, Homo sapiens
ggauaucaguugccuguau

SEQ ID NO: 1138124 - RNA, 19 nt, Homo sapiens
ggauaucaguugccuguau

SEQ ID NO: 1138125 - RNA, 19 nt, Homo sapiens
ggauaucaguucccuguau

SEQ ID NO: 1138126 - RNA, 19 nt, Homo sapiens
ggauaucaguugccuguau

SEQ ID NO: 1138127 - RNA, 19 nt, Homo sapiens
ggauaucaguucccuguau

SEQ ID NO: 1138128 - RNA, 19 nt, Homo sapiens
ggauaucaguugccuguau

SEQ ID NO: 1138129 - RNA, 19 nt, Homo sapiens
ggauaucaguugccuguau

SEQ ID NO: 1138130 - RNA, 19 nt, Homo sapiens
gaacugguguguccaaagg

SEQ ID NO: 1138131 - RNA, 19 nt, Homo sapiens
uaaauuccguuguuacuca

SEQ ID NO: 1138132 - RNA, 19 nt, Homo sapiens
caaauaaucgagacugaaa

SEQ ID NO: 1138133 - RNA, 19 nt, Homo sapiens
ccucucagcuaucuaguuu

SEQ ID NO: 1138134 - RNA, 19 nt, Homo sapiens
gaaguuuggcaguauuuaa

SEQ ID NO: 1138135 - RNA, 19 nt, Homo sapiens
uagaagaaguuuggcagua

SEQ ID NO: 1138136 - RNA, 19 nt, Homo sapiens
gagcaaaggagaaaucugu

SEQ ID NO: 1138137 - RNA, 19 nt, Homo sapiens
gcaaauacugacuuucaaa

SEQ ID NO: 1138138 - RNA, 19 nt, Homo sapiens
ggaugucaguugcuuguau

SEQ ID NO: 1138139 - RNA, 19 nt, Homo sapiens
gcagccacguccuuuggua

SEQ ID NO: 1138140 - RNA, 19 nt, Homo sapiens
gaacacaagcauuucacuu

SEQ ID NO: 1138141 - RNA, 19 nt, Homo sapiens
ccacguccuuugguaguua

SEQ ID NO: 1138142 - RNA, 19 nt, Homo sapiens
ggaugaaacugagauugga

SEQ ID NO: 1138143 - RNA, 19 nt, Homo sapiens
gagcuuugcauuuaugauu

SEQ ID NO: 1138144 - RNA, 19 nt, Homo sapiens
ucaguugccuguauauaau

SEQ ID NO: 1138145 - RNA, 19 nt, Homo sapiens
ucaguugccuguauauaau

SEQ ID NO: 1138146 - RNA, 19 nt, Homo sapiens
ucaguugccuguauauaau

SEQ ID NO: 1138147 - RNA, 19 nt, Homo sapiens
ucaguugccuguauauaau

SEQ ID NO: 1138148 - RNA, 19 nt, Homo sapiens
ucaguugccuguauauaau

SEQ ID NO: 1138149 - RNA, 19 nt, Homo sapiens
ucaguugccuguauauaau

SEQ ID NO: 1138150 - RNA, 19 nt, Homo sapiens
ucaguugccuguauauaau

SEQ ID NO: 1138151 - RNA, 19 nt, Homo sapiens
ucaguugccuguauauaau

SEQ ID NO: 1138152 - RNA, 19 nt, Homo sapiens
ucaguugccuguauauaau

SEQ ID NO: 1138153 - RNA, 19 nt, Homo sapiens
ucaguugccuguauauaau

SEQ ID NO: 1138154 - RNA, 19 nt, Homo sapiens
caugggaaguugcugguuu

SEQ ID NO: 1138155 - RNA, 19 nt, Homo sapiens
ccagagaagagacugauaa

SEQ ID NO: 1138156 - RNA, 19 nt, Homo sapiens
ucaggucacugcuggauau

SEQ ID NO: 1138157 - RNA, 19 nt, Homo sapiens
ucaggucacugcuggauau

SEQ ID NO: 1138158 - RNA, 19 nt, Homo sapiens
ucaguugccuguauacaau

SEQ ID NO: 1138159 - RNA, 19 nt, Homo sapiens
ucaguucccuguauacaau

SEQ ID NO: 1138160 - RNA, 19 nt, Homo sapiens
ucaguucccuguauacaau

SEQ ID NO: 1138161 - RNA, 19 nt, Homo sapiens
cagauacauuuccauggua

SEQ ID NO: 1138162 - RNA, 19 nt, Homo sapiens
uauccaagaucaccauuuc

SEQ ID NO: 1138163 - RNA, 19 nt, Homo sapiens
ggaaguugcugguuuugaa

SEQ ID NO: 1138164 - RNA, 19 nt, Homo sapiens
gaucacagauacauuucca

SEQ ID NO: 1138165 - RNA, 19 nt, Homo sapiens
caccaugucugcugcaaau

SEQ ID NO: 1138166 - RNA, 19 nt, Homo sapiens
aaucgagacugaaagaaug

SEQ ID NO: 1138167 - RNA, 19 nt, Homo sapiens
gaaacuguucuucauuaga

SEQ ID NO: 1138168 - RNA, 19 nt, Homo sapiens
gaccgaagcauacaaaugg

SEQ ID NO: 1138169 - RNA, 19 nt, Homo sapiens
gcuauggauuuguuucguu

SEQ ID NO: 1138170 - RNA, 19 nt, Homo sapiens
ucagcuaucuaguuucaug

SEQ ID NO: 1138171 - RNA, 19 nt, Homo sapiens
agaagaaguuuggcaguau

SEQ ID NO: 1138172 - RNA, 19 nt, Homo sapiens
ggaccgaagcauacaaaug

SEQ ID NO: 1138173 - RNA, 19 nt, Homo sapiens
cugauaaauuccguuguua

SEQ ID NO: 1138174 - RNA, 19 nt, Homo sapiens
uacaaauggugguaucuug

SEQ ID NO: 1138175 - RNA, 19 nt, Homo sapiens
ucaguuccauguauacaau

SEQ ID NO: 1138176 - RNA, 19 nt, Homo sapiens
gaaagaagugaagauaauc

SEQ ID NO: 1138177 - RNA, 19 nt, Homo sapiens
gugaaagaagugaagauaa

SEQ ID NO: 1138178 - RNA, 19 nt, Homo sapiens
aaaccugauuugaaagcua

SEQ ID NO: 1138179 - RNA, 19 nt, Homo sapiens
guaaaucacacugaaacuu

SEQ ID NO: 1138180 - RNA, 19 nt, Homo sapiens
uauccaaguucaccauuuc

SEQ ID NO: 1138181 - RNA, 19 nt, Homo sapiens
uauccaaguucaccauuuc

SEQ ID NO: 1138182 - RNA, 19 nt, Homo sapiens
uauccaaguucaccauuuc

SEQ ID NO: 1138183 - RNA, 19 nt, Homo sapiens
uauccaaguucaccauuuc

SEQ ID NO: 1138184 - RNA, 19 nt, Homo sapiens
uauccaaguucaccauuuc

SEQ ID NO: 1138185 - RNA, 19 nt, Homo sapiens
uauccaaguucaccauuuc

SEQ ID NO: 1138186 - RNA, 19 nt, Homo sapiens
uauccaaguucaccauuuc

SEQ ID NO: 1138187 - RNA, 19 nt, Homo sapiens
uauccaaguucaccauuuc

SEQ ID NO: 1138188 - RNA, 19 nt, Homo sapiens
uaggaucacagauacauuu

SEQ ID NO: 1138189 - RNA, 19 nt, Homo sapiens
cuauggauuuguuucguuu

SEQ ID NO: 1138190 - RNA, 19 nt, Homo sapiens
ucucagcuaucuaguuuca

SEQ ID NO: 1138191 - RNA, 19 nt, Homo sapiens
ggacugggcuccucucgaa

SEQ ID NO: 1138192 - RNA, 19 nt, Homo sapiens
gcaccaagaucaaggagau

SEQ ID NO: 1138193 - RNA, 19 nt, Homo sapiens
caagggagcaguuguaaga

SEQ ID NO: 1138194 - RNA, 19 nt, Homo sapiens
cgccagaucugcgcuguua

SEQ ID NO: 1138195 - RNA, 19 nt, Homo sapiens
gaacgcaucaccaccauca

SEQ ID NO: 1138196 - RNA, 19 nt, Homo sapiens
uuacacagcucgugagaca

SEQ ID NO: 1138197 - RNA, 19 nt, Homo sapiens
gaagaagggcgagacugua

SEQ ID NO: 1138198 - RNA, 19 nt, Homo sapiens
ggaagaagggcgagacugu

SEQ ID NO: 1138199 - RNA, 19 nt, Homo sapiens
caugauugcuuucaaacug

SEQ ID NO: 1138200 - RNA, 19 nt, Homo sapiens
ccucaucacugccugucua

SEQ ID NO: 1138201 - RNA, 19 nt, Homo sapiens
ccauguaugugcuuauugu

SEQ ID NO: 1138202 - RNA, 19 nt, Homo sapiens
ggccuacacugccaagaug

SEQ ID NO: 1138203 - RNA, 19 nt, Homo sapiens
gggcaagggagcaguugua

SEQ ID NO: 1138204 - RNA, 19 nt, Homo sapiens
caagauggcagcagcuaau

SEQ ID NO: 1138205 - RNA, 19 nt, Homo sapiens
gcagcaagaucagcgagau

SEQ ID NO: 1138206 - RNA, 19 nt, Homo sapiens
ggaaggaagugggcagcau

SEQ ID NO: 1138207 - RNA, 19 nt, Homo sapiens
gcaaaugguggaaaugucu

SEQ ID NO: 1138208 - RNA, 19 nt, Homo sapiens
guaagggaaaggcuaggua

SEQ ID NO: 1138209 - RNA, 19 nt, Homo sapiens
ucagcucugugcuuggaua

SEQ ID NO: 1138210 - RNA, 19 nt, Homo sapiens
gacuacgggugcccaggua

SEQ ID NO: 1138211 - RNA, 19 nt, Homo sapiens
caaacuggaugaggaccuu

SEQ ID NO: 1138212 - RNA, 19 nt, Homo sapiens
gcacacagaccagcucaca

SEQ ID NO: 1138213 - RNA, 19 nt, Homo sapiens
ccgagccucucccuaggua

SEQ ID NO: 1138214 - RNA, 19 nt, Homo sapiens
caagguccaugcagucucu

SEQ ID NO: 1138215 - RNA, 19 nt, Homo sapiens
gaauuuguauccccuucua

SEQ ID NO: 1138216 - RNA, 19 nt, Homo sapiens
gcucgugagacacacauaa

SEQ ID NO: 1138217 - RNA, 19 nt, Homo sapiens
caagggagcagggaagaug

SEQ ID NO: 1138218 - RNA, 19 nt, Homo sapiens
aagaagggcgagacuguaa

SEQ ID NO: 1138219 - RNA, 19 nt, Homo sapiens
ggaagugggcagcaucauc

SEQ ID NO: 1138220 - RNA, 19 nt, Homo sapiens
aggcugagcggcagaaauu

SEQ ID NO: 1138221 - RNA, 19 nt, Homo sapiens
uaccauguaugugcuuauu

SEQ ID NO: 1138222 - RNA, 19 nt, Homo sapiens
uaagcacccuggucagagu

SEQ ID NO: 1138223 - RNA, 19 nt, Homo sapiens
gaacuggcugggcuuguca

SEQ ID NO: 1138224 - RNA, 19 nt, Homo sapiens
ggagaucccugccccacuu

SEQ ID NO: 1138225 - RNA, 19 nt, Homo sapiens
gaagggcgagacuguaaag

SEQ ID NO: 1138226 - RNA, 19 nt, Homo sapiens
ccaucucccucuccaacuu

SEQ ID NO: 1138227 - RNA, 19 nt, Homo sapiens
ggaaggcuggcaccaagau

SEQ ID NO: 1138228 - RNA, 19 nt, Homo sapiens
gggaguucuuucucucaga

SEQ ID NO: 1138229 - RNA, 19 nt, Homo sapiens
gggagcaggugaggaugga

SEQ ID NO: 1138230 - RNA, 19 nt, Homo sapiens
gcgagacuguaaagcgaau

SEQ ID NO: 1138231 - RNA, 19 nt, Homo sapiens
ccucagcucugugcuugga

SEQ ID NO: 1138232 - RNA, 19 nt, Homo sapiens
ggagaugggaauuuguauc

SEQ ID NO: 1138233 - RNA, 19 nt, Homo sapiens
gcagcaucaucgggaagaa

SEQ ID NO: 1138234 - RNA, 19 nt, Homo sapiens
ggcaagggagcaguuguaa

SEQ ID NO: 1138235 - RNA, 19 nt, Homo sapiens
cauaagcacccuggucaga

SEQ ID NO: 1138236 - RNA, 19 nt, Homo sapiens
ccaagauggcagcagcuaa

SEQ ID NO: 1138237 - RNA, 19 nt, Homo sapiens
cuccaugauugcuuucaaa

SEQ ID NO: 1138238 - RNA, 19 nt, Homo sapiens
ucaagcccaugcccuucuu

SEQ ID NO: 1138239 - RNA, 19 nt, Homo sapiens
gauuugauuggcuguguga

SEQ ID NO: 1138240 - RNA, 19 nt, Homo sapiens
cagucuccaugauugcuuu

SEQ ID NO: 1138241 - RNA, 19 nt, Homo sapiens
cagccucgccugacagaau

SEQ ID NO: 1138242 - RNA, 19 nt, Homo sapiens
ccagaucugcgcuguuauc

SEQ ID NO: 1138243 - RNA, 19 nt, Homo sapiens
uaauucucaucacucuuug

SEQ ID NO: 1138244 - RNA, 19 nt, Homo sapiens
gagaugggaauuuguaucc

SEQ ID NO: 1138245 - RNA, 19 nt, Homo sapiens
ugaacuggcugggcuuguc

SEQ ID NO: 1138246 - RNA, 19 nt, Homo sapiens
gcagcuaaugggagcaaga

SEQ ID NO: 1138247 - RNA, 19 nt, Homo sapiens
caagaucgggaaccaagca

SEQ ID NO: 1138248 - RNA, 19 nt, Homo sapiens
ccuaccauguaugugcuua

SEQ ID NO: 1138249 - RNA, 19 nt, Homo sapiens
gugcugcuccugcaaaugg

SEQ ID NO: 1138250 - RNA, 19 nt, Homo sapiens
acacagcucgugagacaca

SEQ ID NO: 1138251 - RNA, 19 nt, Homo sapiens
gaggccagcugagguacag

SEQ ID NO: 1138252 - RNA, 19 nt, Homo sapiens
ccaugcccuucuuggcuuu

SEQ ID NO: 1138253 - RNA, 19 nt, Homo sapiens
caacuucaucggccucaag

SEQ ID NO: 1138254 - RNA, 19 nt, Homo sapiens
cuuuggagaugggaauuug

SEQ ID NO: 1138255 - RNA, 19 nt, Homo sapiens
cccaccaccugcagauuuc

SEQ ID NO: 1138256 - RNA, 19 nt, Homo sapiens
cagcuaaugggagcaagaa

SEQ ID NO: 1138257 - RNA, 19 nt, Homo sapiens
gcucacaggaguucuuggu

SEQ ID NO: 1138258 - RNA, 19 nt, Homo sapiens
gaccagcucacaggaguuc

SEQ ID NO: 1138259 - RNA, 19 nt, Homo sapiens
gcaagggagcaguuguaag

SEQ ID NO: 1138260 - RNA, 19 nt, Homo sapiens
gcaggugaggauggaguuu

SEQ ID NO: 1138261 - RNA, 19 nt, Homo sapiens
gcagugcccggaucaccau

SEQ ID NO: 1138262 - RNA, 19 nt, Homo sapiens
uacccugccuccaucuaug

SEQ ID NO: 1138263 - RNA, 19 nt, Homo sapiens
caucacugccugucuagag

SEQ ID NO: 1138264 - RNA, 19 nt, Homo sapiens
ucagcgagauccggcagau

SEQ ID NO: 1138265 - RNA, 19 nt, Homo sapiens
uaugggagcagccagaagu

SEQ ID NO: 1138266 - RNA, 19 nt, Homo sapiens
gcaccaagaucaaggagau

SEQ ID NO: 1138267 - RNA, 19 nt, Homo sapiens
cgccagaucugcgcuguua

SEQ ID NO: 1138268 - RNA, 19 nt, Homo sapiens
gaacgcaucaccaccauca

SEQ ID NO: 1138269 - RNA, 19 nt, Homo sapiens
gaagaagggcgagacugua

SEQ ID NO: 1138270 - RNA, 19 nt, Homo sapiens
ggaagaagggcgagacugu

SEQ ID NO: 1138271 - RNA, 19 nt, Homo sapiens
caugauugcuuucaaacug

SEQ ID NO: 1138272 - RNA, 19 nt, Homo sapiens
ccucaucacugccugucua

SEQ ID NO: 1138273 - RNA, 19 nt, Homo sapiens
ggccuacacugccaagaug

SEQ ID NO: 1138274 - RNA, 19 nt, Homo sapiens
caagauggcagcagcuaau

SEQ ID NO: 1138275 - RNA, 19 nt, Homo sapiens
gcagcaagaucagcgagau

SEQ ID NO: 1138276 - RNA, 19 nt, Homo sapiens
ggaaggaagugggcagcau

SEQ ID NO: 1138277 - RNA, 19 nt, Homo sapiens
gcaaaugguggaaaugucu

SEQ ID NO: 1138278 - RNA, 19 nt, Homo sapiens
ucagcucugugcuuggaua

SEQ ID NO: 1138279 - RNA, 19 nt, Homo sapiens
gacuacgggugcccaggua

SEQ ID NO: 1138280 - RNA, 19 nt, Homo sapiens
caaacuggaugaggaccuu

SEQ ID NO: 1138281 - RNA, 19 nt, Homo sapiens
gcacacagaccagcucaca

SEQ ID NO: 1138282 - RNA, 19 nt, Homo sapiens
ccgagccucucccuaggua

SEQ ID NO: 1138283 - RNA, 19 nt, Homo sapiens
guucgcagcugaugucacu

SEQ ID NO: 1138284 - RNA, 19 nt, Homo sapiens
aagaagggcgagacuguaa

SEQ ID NO: 1138285 - RNA, 19 nt, Homo sapiens
ggaagugggcagcaucauc

SEQ ID NO: 1138286 - RNA, 19 nt, Homo sapiens
aggcugagcggcagaaauu

SEQ ID NO: 1138287 - RNA, 19 nt, Homo sapiens
gaacuggcugggcuuguca

SEQ ID NO: 1138288 - RNA, 19 nt, Homo sapiens
gaagggcgagacuguaaag

SEQ ID NO: 1138289 - RNA, 19 nt, Homo sapiens
ccaucucccucuccaacuu

SEQ ID NO: 1138290 - RNA, 19 nt, Homo sapiens
ggaaggcuggcaccaagau

SEQ ID NO: 1138291 - RNA, 19 nt, Homo sapiens
gggaguucuuucucucaga

SEQ ID NO: 1138292 - RNA, 19 nt, Homo sapiens
gcugaugucacucgcaguu

SEQ ID NO: 1138293 - RNA, 19 nt, Homo sapiens
gcgagacuguaaagcgaau

SEQ ID NO: 1138294 - RNA, 19 nt, Homo sapiens
ugaugucacucgcaguugu

SEQ ID NO: 1138295 - RNA, 19 nt, Homo sapiens
ccucagcucugugcuugga

SEQ ID NO: 1138296 - RNA, 19 nt, Homo sapiens
gcagcaucaucgggaagaa

SEQ ID NO: 1138297 - RNA, 19 nt, Homo sapiens
ccaagauggcagcagcuaa

SEQ ID NO: 1138298 - RNA, 19 nt, Homo sapiens
cuccaugauugcuuucaaa

SEQ ID NO: 1138299 - RNA, 19 nt, Homo sapiens
ucaagcccaugcccuucuu

SEQ ID NO: 1138300 - RNA, 19 nt, Homo sapiens
gauuugauuggcuguguga

SEQ ID NO: 1138301 - RNA, 19 nt, Homo sapiens
cagucuccaugauugcuuu

SEQ ID NO: 1138302 - RNA, 19 nt, Homo sapiens
cagccucgccugacagaau

SEQ ID NO: 1138303 - RNA, 19 nt, Homo sapiens
ccagaucugcgcuguuauc

SEQ ID NO: 1138304 - RNA, 19 nt, Homo sapiens
ugaacuggcugggcuuguc

SEQ ID NO: 1138305 - RNA, 19 nt, Homo sapiens
gcagcuaaugggagcaaga

SEQ ID NO: 1138306 - RNA, 19 nt, Homo sapiens
caagaucgggaaccaagca

SEQ ID NO: 1138307 - RNA, 19 nt, Homo sapiens
aaggagauccgagagacua

SEQ ID NO: 1138308 - RNA, 19 nt, Homo sapiens
gugcugcuccugcaaaugg

SEQ ID NO: 1138309 - RNA, 19 nt, Homo sapiens
gaggccagcugagguacag

SEQ ID NO: 1138310 - RNA, 19 nt, Homo sapiens
ccaugcccuucuuggcuuu

SEQ ID NO: 1138311 - RNA, 19 nt, Homo sapiens
caacuucaucggccucaag

SEQ ID NO: 1138312 - RNA, 19 nt, Homo sapiens
cccaccaccugcagauuuc

SEQ ID NO: 1138313 - RNA, 19 nt, Homo sapiens
cagcuaaugggagcaagaa

SEQ ID NO: 1138314 - RNA, 19 nt, Homo sapiens
gcucacaggaguucuuggu

SEQ ID NO: 1138315 - RNA, 19 nt, Homo sapiens
gaccagcucacaggaguuc

SEQ ID NO: 1138316 - RNA, 19 nt, Homo sapiens
gcagugcccggaucaccau

SEQ ID NO: 1138317 - RNA, 19 nt, Homo sapiens
uacccugccuccaucuaug

SEQ ID NO: 1138318 - RNA, 19 nt, Homo sapiens
caucacugccugucuagag

SEQ ID NO: 1138319 - RNA, 19 nt, Homo sapiens
ucagcgagauccggcagau

SEQ ID NO: 1138320 - RNA, 19 nt, Homo sapiens
ggacugggcuccucucgaa

SEQ ID NO: 1138321 - RNA, 19 nt, Homo sapiens
gcaccaagaucaaggagau

SEQ ID NO: 1138322 - RNA, 19 nt, Homo sapiens
cgccagaucugcgcuguua

SEQ ID NO: 1138323 - RNA, 19 nt, Homo sapiens
gaacgcaucaccaccauca

SEQ ID NO: 1138324 - RNA, 19 nt, Homo sapiens
uuacacagcucgugagaca

SEQ ID NO: 1138325 - RNA, 19 nt, Homo sapiens
gaagaagggcgagacugua

SEQ ID NO: 1138326 - RNA, 19 nt, Homo sapiens
ggaagaagggcgagacugu

SEQ ID NO: 1138327 - RNA, 19 nt, Homo sapiens
caugauugcuuucaaacug

SEQ ID NO: 1138328 - RNA, 19 nt, Homo sapiens
ccucaucacugccugucua

SEQ ID NO: 1138329 - RNA, 19 nt, Homo sapiens
ccauguaugugcuuauugu

SEQ ID NO: 1138330 - RNA, 19 nt, Homo sapiens
ggccuacacugccaagaug

SEQ ID NO: 1138331 - RNA, 19 nt, Homo sapiens
caagauggcagcagcuaau

SEQ ID NO: 1138332 - RNA, 19 nt, Homo sapiens
gcagcaagaucagcgagau

SEQ ID NO: 1138333 - RNA, 19 nt, Homo sapiens
ggaaggaagugggcagcau

SEQ ID NO: 1138334 - RNA, 19 nt, Homo sapiens
gcaaaugguggaaaugucu

SEQ ID NO: 1138335 - RNA, 19 nt, Homo sapiens
guaagggaaaggcuaggua

SEQ ID NO: 1138336 - RNA, 19 nt, Homo sapiens
ucagcucugugcuuggaua

SEQ ID NO: 1138337 - RNA, 19 nt, Homo sapiens
gacuacgggugcccaggua

SEQ ID NO: 1138338 - RNA, 19 nt, Homo sapiens
caaacuggaugaggaccuu

SEQ ID NO: 1138339 - RNA, 19 nt, Homo sapiens
gcacacagaccagcucaca

SEQ ID NO: 1138340 - RNA, 19 nt, Homo sapiens
ccgagccucucccuaggua

SEQ ID NO: 1138341 - RNA, 19 nt, Homo sapiens
caagguccaugcagucucu

SEQ ID NO: 1138342 - RNA, 19 nt, Homo sapiens
gaauuuguauccccuucua

SEQ ID NO: 1138343 - RNA, 19 nt, Homo sapiens
gcucgugagacacacauaa

SEQ ID NO: 1138344 - RNA, 19 nt, Homo sapiens
caagggagcagggaagaug

SEQ ID NO: 1138345 - RNA, 19 nt, Homo sapiens
aagaagggcgagacuguaa

SEQ ID NO: 1138346 - RNA, 19 nt, Homo sapiens
ggaagugggcagcaucauc

SEQ ID NO: 1138347 - RNA, 19 nt, Homo sapiens
aggcugagcggcagaaauu

SEQ ID NO: 1138348 - RNA, 19 nt, Homo sapiens
uaccauguaugugcuuauu

SEQ ID NO: 1138349 - RNA, 19 nt, Homo sapiens
uaagcacccuggucagagu

SEQ ID NO: 1138350 - RNA, 19 nt, Homo sapiens
gaacuggcugggcuuguca

SEQ ID NO: 1138351 - RNA, 19 nt, Homo sapiens
ggagaucccugccccacuu

SEQ ID NO: 1138352 - RNA, 19 nt, Homo sapiens
gaagggcgagacuguaaag

SEQ ID NO: 1138353 - RNA, 19 nt, Homo sapiens
ccaucucccucuccaacuu

SEQ ID NO: 1138354 - RNA, 19 nt, Homo sapiens
ggaaggcuggcaccaagau

SEQ ID NO: 1138355 - RNA, 19 nt, Homo sapiens
gggaguucuuucucucaga

SEQ ID NO: 1138356 - RNA, 19 nt, Homo sapiens
gggagcaggugaggaugga

SEQ ID NO: 1138357 - RNA, 19 nt, Homo sapiens
gcgagacuguaaagcgaau

SEQ ID NO: 1138358 - RNA, 19 nt, Homo sapiens
ccucagcucugugcuugga

SEQ ID NO: 1138359 - RNA, 19 nt, Homo sapiens
ggagaugggaauuuguauc

SEQ ID NO: 1138360 - RNA, 19 nt, Homo sapiens
gcagcaucaucgggaagaa

SEQ ID NO: 1138361 - RNA, 19 nt, Homo sapiens
cauaagcacccuggucaga

SEQ ID NO: 1138362 - RNA, 19 nt, Homo sapiens
ccaagauggcagcagcuaa

SEQ ID NO: 1138363 - RNA, 19 nt, Homo sapiens
cuccaugauugcuuucaaa

SEQ ID NO: 1138364 - RNA, 19 nt, Homo sapiens
ucaagcccaugcccuucuu

SEQ ID NO: 1138365 - RNA, 19 nt, Homo sapiens
gauuugauuggcuguguga

SEQ ID NO: 1138366 - RNA, 19 nt, Homo sapiens
cagucuccaugauugcuuu

SEQ ID NO: 1138367 - RNA, 19 nt, Homo sapiens
cagccucgccugacagaau

SEQ ID NO: 1138368 - RNA, 19 nt, Homo sapiens
uaauucucaucacucuuug

SEQ ID NO: 1138369 - RNA, 19 nt, Homo sapiens
gagaugggaauuuguaucc

SEQ ID NO: 1138370 - RNA, 19 nt, Homo sapiens
ccagaucugcgcuguuauc

SEQ ID NO: 1138371 - RNA, 19 nt, Homo sapiens
ugaacuggcugggcuuguc

SEQ ID NO: 1138372 - RNA, 19 nt, Homo sapiens
gcagcuaaugggagcaaga

SEQ ID NO: 1138373 - RNA, 19 nt, Homo sapiens
ccuaccauguaugugcuua

SEQ ID NO: 1138374 - RNA, 19 nt, Homo sapiens
caagaucgggaaccaagca

SEQ ID NO: 1138375 - RNA, 19 nt, Homo sapiens
aaggagauccgagagacua

SEQ ID NO: 1138376 - RNA, 19 nt, Homo sapiens
gugcugcuccugcaaaugg

SEQ ID NO: 1138377 - RNA, 19 nt, Homo sapiens
acacagcucgugagacaca

SEQ ID NO: 1138378 - RNA, 19 nt, Homo sapiens
gaggccagcugagguacag

SEQ ID NO: 1138379 - RNA, 19 nt, Homo sapiens
ccaugcccuucuuggcuuu

SEQ ID NO: 1138380 - RNA, 19 nt, Homo sapiens
cuuuggagaugggaauuug

SEQ ID NO: 1138381 - RNA, 19 nt, Homo sapiens
caacuucaucggccucaag

SEQ ID NO: 1138382 - RNA, 19 nt, Homo sapiens
cccaccaccugcagauuuc

SEQ ID NO: 1138383 - RNA, 19 nt, Homo sapiens
cagcuaaugggagcaagaa

SEQ ID NO: 1138384 - RNA, 19 nt, Homo sapiens
gcucacaggaguucuuggu

SEQ ID NO: 1138385 - RNA, 19 nt, Homo sapiens
gaccagcucacaggaguuc

SEQ ID NO: 1138386 - RNA, 19 nt, Homo sapiens
gcaggugaggauggaguuu

SEQ ID NO: 1138387 - RNA, 19 nt, Homo sapiens
gcagugcccggaucaccau

SEQ ID NO: 1138388 - RNA, 19 nt, Homo sapiens
uacccugccuccaucuaug

SEQ ID NO: 1138389 - RNA, 19 nt, Homo sapiens
caucacugccugucuagag

SEQ ID NO: 1138390 - RNA, 19 nt, Homo sapiens
ucagcgagauccggcagau

SEQ ID NO: 1138391 - RNA, 19 nt, Homo sapiens
gcaccaagaucaaggagau

SEQ ID NO: 1138392 - RNA, 19 nt, Homo sapiens
uggcagaacucaaauggaa

SEQ ID NO: 1138393 - RNA, 19 nt, Homo sapiens
cgccagaucugcgcuguua

SEQ ID NO: 1138394 - RNA, 19 nt, Homo sapiens
gaacgcaucaccaccauca

SEQ ID NO: 1138395 - RNA, 19 nt, Homo sapiens
gaagaagggcgagacugua

SEQ ID NO: 1138396 - RNA, 19 nt, Homo sapiens
ggaagaagggcgagacugu

SEQ ID NO: 1138397 - RNA, 19 nt, Homo sapiens
caugauugcuuucaaacug

SEQ ID NO: 1138398 - RNA, 19 nt, Homo sapiens
ccucaucacugccugucua

SEQ ID NO: 1138399 - RNA, 19 nt, Homo sapiens
ggccuacacugccaagaug

SEQ ID NO: 1138400 - RNA, 19 nt, Homo sapiens
caagauggcagcagcuaau

SEQ ID NO: 1138401 - RNA, 19 nt, Homo sapiens
gcagcaagaucagcgagau

SEQ ID NO: 1138402 - RNA, 19 nt, Homo sapiens
ggaaggaagugggcagcau

SEQ ID NO: 1138403 - RNA, 19 nt, Homo sapiens
gcaaaugguggaaaugucu

SEQ ID NO: 1138404 - RNA, 19 nt, Homo sapiens
ucagcucugugcuuggaua

SEQ ID NO: 1138405 - RNA, 19 nt, Homo sapiens
gacuacgggugcccaggua

SEQ ID NO: 1138406 - RNA, 19 nt, Homo sapiens
caaacuggaugaggaccuu

SEQ ID NO: 1138407 - RNA, 19 nt, Homo sapiens
gcacacagaccagcucaca

SEQ ID NO: 1138408 - RNA, 19 nt, Homo sapiens
ccgagccucucccuaggua

SEQ ID NO: 1138409 - RNA, 19 nt, Homo sapiens
aagaagggcgagacuguaa

SEQ ID NO: 1138410 - RNA, 19 nt, Homo sapiens
ggaagugggcagcaucauc

SEQ ID NO: 1138411 - RNA, 19 nt, Homo sapiens
aggcugagcggcagaaauu

SEQ ID NO: 1138412 - RNA, 19 nt, Homo sapiens
gaacuggcugggcuuguca

SEQ ID NO: 1138413 - RNA, 19 nt, Homo sapiens
gaagggcgagacuguaaag

SEQ ID NO: 1138414 - RNA, 19 nt, Homo sapiens
ccaucucccucuccaacuu

SEQ ID NO: 1138415 - RNA, 19 nt, Homo sapiens
ggaaggcuggcaccaagau

SEQ ID NO: 1138416 - RNA, 19 nt, Homo sapiens
gggaguucuuucucucaga

SEQ ID NO: 1138417 - RNA, 19 nt, Homo sapiens
gcgagacuguaaagcgaau

SEQ ID NO: 1138418 - RNA, 19 nt, Homo sapiens
ccucagcucugugcuugga

SEQ ID NO: 1138419 - RNA, 19 nt, Homo sapiens
gcagcaucaucgggaagaa

SEQ ID NO: 1138420 - RNA, 19 nt, Homo sapiens
ccaagauggcagcagcuaa

SEQ ID NO: 1138421 - RNA, 19 nt, Homo sapiens
cuccaugauugcuuucaaa

SEQ ID NO: 1138422 - RNA, 19 nt, Homo sapiens
ucaagcccaugcccuucuu

SEQ ID NO: 1138423 - RNA, 19 nt, Homo sapiens
gauuugauuggcuguguga

SEQ ID NO: 1138424 - RNA, 19 nt, Homo sapiens
cagucuccaugauugcuuu

SEQ ID NO: 1138425 - RNA, 19 nt, Homo sapiens
cagccucgccugacagaau

SEQ ID NO: 1138426 - RNA, 19 nt, Homo sapiens
ccagaucugcgcuguuauc

SEQ ID NO: 1138427 - RNA, 19 nt, Homo sapiens
ugaacuggcugggcuuguc

SEQ ID NO: 1138428 - RNA, 19 nt, Homo sapiens
gcagcuaaugggagcaaga

SEQ ID NO: 1138429 - RNA, 19 nt, Homo sapiens
caagaucgggaaccaagca

SEQ ID NO: 1138430 - RNA, 19 nt, Homo sapiens
aaggagauccgagagacua

SEQ ID NO: 1138431 - RNA, 19 nt, Homo sapiens
gugcugcuccugcaaaugg

SEQ ID NO: 1138432 - RNA, 19 nt, Homo sapiens
gaggccagcugagguacag

SEQ ID NO: 1138433 - RNA, 19 nt, Homo sapiens
ccaugcccuucuuggcuuu

SEQ ID NO: 1138434 - RNA, 19 nt, Homo sapiens
caacuucaucggccucaag

SEQ ID NO: 1138435 - RNA, 19 nt, Homo sapiens
uggagucccuguggcagaa

SEQ ID NO: 1138436 - RNA, 19 nt, Homo sapiens
cccaccaccugcagauuuc

SEQ ID NO: 1138437 - RNA, 19 nt, Homo sapiens
cagcuaaugggagcaagaa

SEQ ID NO: 1138438 - RNA, 19 nt, Homo sapiens
gcucacaggaguucuuggu

SEQ ID NO: 1138439 - RNA, 19 nt, Homo sapiens
gaccagcucacaggaguuc

SEQ ID NO: 1138440 - RNA, 19 nt, Homo sapiens
gcagugcccggaucaccau

SEQ ID NO: 1138441 - RNA, 19 nt, Homo sapiens
uacccugccuccaucuaug

SEQ ID NO: 1138442 - RNA, 19 nt, Homo sapiens
caucacugccugucuagag

SEQ ID NO: 1138443 - RNA, 19 nt, Homo sapiens
ucagcgagauccggcagau

SEQ ID NO: 1138444 - RNA, 19 nt, Homo sapiens
ggagaaaccuguucccaaa

SEQ ID NO: 1138445 - RNA, 19 nt, Homo sapiens
caaauuaacuggucaagug

SEQ ID NO: 1138446 - RNA, 19 nt, Homo sapiens
ggaaggaagugaagauuga

SEQ ID NO: 1138447 - RNA, 19 nt, Homo sapiens
gagaugacaugguuuguga

SEQ ID NO: 1138448 - RNA, 19 nt, Homo sapiens
ggagagaccucaugcagau

SEQ ID NO: 1138449 - RNA, 19 nt, Homo sapiens
ccacguaccucggagauuu

SEQ ID NO: 1138450 - RNA, 19 nt, Homo sapiens
gaacagccacagccaagua

SEQ ID NO: 1138451 - RNA, 19 nt, Homo sapiens
ucagaaaccuggagcaguu

SEQ ID NO: 1138452 - RNA, 19 nt, Homo sapiens
caaguacaagugcaaauua

SEQ ID NO: 1138453 - RNA, 19 nt, Homo sapiens
gaaucaaaguugugggaaa

SEQ ID NO: 1138454 - RNA, 19 nt, Homo sapiens
gaagaacgucggagacaaa

SEQ ID NO: 1138455 - RNA, 19 nt, Homo sapiens
caagaaagaugaggauauc

SEQ ID NO: 1138456 - RNA, 19 nt, Homo sapiens
gcucgaauccuucauaaga

SEQ ID NO: 1138457 - RNA, 19 nt, Homo sapiens
ccaaacagaaugagaauga

SEQ ID NO: 1138458 - RNA, 19 nt, Homo sapiens
ccagggagaugacaugguu

SEQ ID NO: 1138459 - RNA, 19 nt, Homo sapiens
ggcacaagcuguuucagaa

SEQ ID NO: 1138460 - RNA, 19 nt, Homo sapiens
caaugcagcagcuuaauuu

SEQ ID NO: 1138461 - RNA, 19 nt, Homo sapiens
gugaucaacuuuaagaaga

SEQ ID NO: 1138462 - RNA, 19 nt, Homo sapiens
agaccaagauccauuguga

SEQ ID NO: 1138463 - RNA, 19 nt, Homo sapiens
gaagauugacccaaauaug

SEQ ID NO: 1138464 - RNA, 19 nt, Homo sapiens
gucaagcuguggcaaauuu

SEQ ID NO: 1138465 - RNA, 19 nt, Homo sapiens
caaaguccuugauaucaug

SEQ ID NO: 1138466 - RNA, 19 nt, Homo sapiens
gcacauugguuucuguucu

SEQ ID NO: 1138467 - RNA, 19 nt, Homo sapiens
gaaccgucguccugagauu

SEQ ID NO: 1138468 - RNA, 19 nt, Homo sapiens
gagcagacuggaaaucuaa

SEQ ID NO: 1138469 - RNA, 19 nt, Homo sapiens
caaagggaaucaaaguugu

SEQ ID NO: 1138470 - RNA, 19 nt, Homo sapiens
agauugagcuggaagaaga

SEQ ID NO: 1138471 - RNA, 19 nt, Homo sapiens
gcacaacucuuggauugag

SEQ ID NO: 1138472 - RNA, 19 nt, Homo sapiens
gaagaagacauguauaagg

SEQ ID NO: 1138473 - RNA, 19 nt, Homo sapiens
cagcugcccuggagauuga

SEQ ID NO: 1138474 - RNA, 19 nt, Homo sapiens
guucuucacucgcgacuga

SEQ ID NO: 1138475 - RNA, 19 nt, Homo sapiens
ggaggaaaaucuugauaaa

SEQ ID NO: 1138476 - RNA, 19 nt, Homo sapiens
cagaaagaauuugaaguga

SEQ ID NO: 1138477 - RNA, 19 nt, Homo sapiens
gaaccaguacccagaaaga

SEQ ID NO: 1138478 - RNA, 19 nt, Homo sapiens
ccguuuagcucgacagauu

SEQ ID NO: 1138479 - RNA, 19 nt, Homo sapiens
gaggaugugaucaacuuua

SEQ ID NO: 1138480 - RNA, 19 nt, Homo sapiens
ucauugaccucacaaggaa

SEQ ID NO: 1138481 - RNA, 19 nt, Homo sapiens
gaaagucuagcucaccaaa

SEQ ID NO: 1138482 - RNA, 19 nt, Homo sapiens
acaaaacgcucaagaaaga

SEQ ID NO: 1138483 - RNA, 19 nt, Homo sapiens
gagaaaggcacaagcuguu

SEQ ID NO: 1138484 - RNA, 19 nt, Homo sapiens
uugaggaauugacagauua

SEQ ID NO: 1138485 - RNA, 19 nt, Homo sapiens
cugcacaacucuuggauug

SEQ ID NO: 1138486 - RNA, 19 nt, Homo sapiens
gaccaggcguugcucuuug

SEQ ID NO: 1138487 - RNA, 19 nt, Homo sapiens
ucagaaagcagauguguca

SEQ ID NO: 1138488 - RNA, 19 nt, Homo sapiens
agacauggauuccugaagu

SEQ ID NO: 1138489 - RNA, 19 nt, Homo sapiens
ccagaaagaauuugaagug

SEQ ID NO: 1138490 - RNA, 19 nt, Homo sapiens
gaugugaucaacuuuaaga

SEQ ID NO: 1138491 - RNA, 19 nt, Homo sapiens
ugacaugguuugugaugau

SEQ ID NO: 1138492 - RNA, 19 nt, Homo sapiens
gaaugagaaugaggaggaa

SEQ ID NO: 1138493 - RNA, 19 nt, Homo sapiens
gacauggauuccugaaguu

SEQ ID NO: 1138494 - RNA, 19 nt, Homo sapiens
agaagaagaagacaaagaa

SEQ ID NO: 1138495 - RNA, 19 nt, Homo sapiens
agaagaagaagaagacaaa

SEQ ID NO: 1138496 - RNA, 19 nt, Homo sapiens
uggaagaagacauguauaa

SEQ ID NO: 1138497 - RNA, 19 nt, Homo sapiens
ucaaggagcgaauccguuu

SEQ ID NO: 1138498 - RNA, 19 nt, Homo sapiens
auaaagagcagacuggaaa

SEQ ID NO: 1138499 - RNA, 19 nt, Homo sapiens
uccagcaugucauccauua

SEQ ID NO: 1138500 - RNA, 19 nt, Homo sapiens
caagauccauugugagacu

SEQ ID NO: 1138501 - RNA, 19 nt, Homo sapiens
gcagaugugucagcuugga

SEQ ID NO: 1138502 - RNA, 19 nt, Homo sapiens
cacaagcuguuucagaaga

SEQ ID NO: 1138503 - RNA, 19 nt, Homo sapiens
ccaagcagaagaagaagaa

SEQ ID NO: 1138504 - RNA, 19 nt, Homo sapiens
gcaguuugcccgucuggaa

SEQ ID NO: 1138505 - RNA, 19 nt, Homo sapiens
gaaagacuucuacuuguac

SEQ ID NO: 1138506 - RNA, 19 nt, Homo sapiens
auaagaagcacaccaagaa

SEQ ID NO: 1138507 - RNA, 19 nt, Homo sapiens
ugcuagagaugcucaauga

SEQ ID NO: 1138508 - RNA, 19 nt, Homo sapiens
aacaguaucuccugcauca

SEQ ID NO: 1138509 - RNA, 19 nt, Homo sapiens
uaacagagaccaagaucca

SEQ ID NO: 1138510 - RNA, 19 nt, Homo sapiens
aaaggaagcacccaagaga

SEQ ID NO: 1138511 - RNA, 19 nt, Homo sapiens
ccuccagucucuucucaaa

SEQ ID NO: 1138512 - RNA, 19 nt, Homo sapiens
ggaguaagaauucaaugca

SEQ ID NO: 1138513 - RNA, 19 nt, Homo sapiens
acaaagggaaucaaaguug

SEQ ID NO: 1138514 - RNA, 19 nt, Homo sapiens
aagucuagcucaccaaaga

SEQ ID NO: 1138515 - RNA, 19 nt, Homo sapiens
aggaugugaucaacuuuaa

SEQ ID NO: 1138516 - RNA, 19 nt, Homo sapiens
gaacugcucgagcuaccaa

SEQ ID NO: 1138517 - RNA, 19 nt, Homo sapiens
ucucugggcuccucaaagu

SEQ ID NO: 1138518 - RNA, 19 nt, Homo sapiens
gauaaagagcagacuggaa

SEQ ID NO: 1138519 - RNA, 19 nt, Homo sapiens
ggccggagcugagacuaga

SEQ ID NO: 1138520 - RNA, 19 nt, Homo sapiens
auaggcuucuuguguguua

SEQ ID NO: 1138521 - RNA, 19 nt, Homo sapiens
gugaagauugacccaaaua

SEQ ID NO: 1138522 - RNA, 19 nt, Homo sapiens
ucuguucucuggcuauuug

SEQ ID NO: 1138523 - RNA, 19 nt, Homo sapiens
agacaaagaagccgaagga

SEQ ID NO: 1138524 - RNA, 19 nt, Homo sapiens
ucaagaaagaugaggauau

SEQ ID NO: 1138525 - RNA, 19 nt, Homo sapiens
ggccgcagcuuaguguuug

SEQ ID NO: 1138526 - RNA, 19 nt, Homo sapiens
ggaaaacucuugccuuugc

SEQ ID NO: 1138527 - RNA, 19 nt, Homo sapiens
ccaagaaucccuccagucu

SEQ ID NO: 1138528 - RNA, 19 nt, Homo sapiens
ccaaguacaagugcaaauu

SEQ ID NO: 1138529 - RNA, 19 nt, Homo sapiens
gacaaagggaaucaaaguu

SEQ ID NO: 1138530 - RNA, 19 nt, Homo sapiens
ggaagaagacauguauaag

SEQ ID NO: 1138531 - RNA, 19 nt, Homo sapiens
gcuggaagaagacauguau

SEQ ID NO: 1138532 - RNA, 19 nt, Homo sapiens
gcagucaagcuguggcaaa

SEQ ID NO: 1138533 - RNA, 19 nt, Homo sapiens
agagcagacuggaaaucua

SEQ ID NO: 1138534 - RNA, 19 nt, Homo sapiens
uaagaagcacaccaagaaa

SEQ ID NO: 1138535 - RNA, 19 nt, Homo sapiens
ccaauacaacccaaagaga

SEQ ID NO: 1138536 - RNA, 19 nt, Homo sapiens
gcugugggaauuaauuaaa

SEQ ID NO: 1138537 - RNA, 19 nt, Homo sapiens
aagugaagauugacccaaa

SEQ ID NO: 1138538 - RNA, 19 nt, Homo sapiens
gguccaaacugcuccaaaa

SEQ ID NO: 1138539 - RNA, 19 nt, Homo sapiens
gaauguccacgcagaaaca

SEQ ID NO: 1138540 - RNA, 19 nt, Homo sapiens
aaacaggaguuggaugaca

SEQ ID NO: 1138541 - RNA, 19 nt, Homo sapiens
ugacgaugaugcuggugaa

SEQ ID NO: 1138542 - RNA, 19 nt, Homo sapiens
ccaguacccagaaagaauu

SEQ ID NO: 1138543 - RNA, 19 nt, Homo sapiens
aagaaucccuccagucucu

SEQ ID NO: 1138544 - RNA, 19 nt, Homo sapiens
ggaaauagauaacgaaagu

SEQ ID NO: 1138545 - RNA, 19 nt, Homo sapiens
ccaaaugucucucaaauau

SEQ ID NO: 1138546 - RNA, 19 nt, Homo sapiens
ggacgaaaguguacagaaa

SEQ ID NO: 1138547 - RNA, 19 nt, Homo sapiens
gaggaauggucuaauaaua

SEQ ID NO: 1138548 - RNA, 19 nt, Homo sapiens
gaaauaaggcacacaauga

SEQ ID NO: 1138549 - RNA, 19 nt, Homo sapiens
guugaaagcugucaguuaa

SEQ ID NO: 1138550 - RNA, 19 nt, Homo sapiens
ggacagaguaguaucaaua

SEQ ID NO: 1138551 - RNA, 19 nt, Homo sapiens
gaagaaauguggacuuuac

SEQ ID NO: 1138552 - RNA, 19 nt, Homo sapiens
gauaauagcuguguucaag

SEQ ID NO: 1138553 - RNA, 19 nt, Homo sapiens
gcauguaucucuuaaggaa

SEQ ID NO: 1138554 - RNA, 19 nt, Homo sapiens
caucuaauguuccauguuu

SEQ ID NO: 1138555 - RNA, 19 nt, Homo sapiens
ucacacaacugccuuagaa

SEQ ID NO: 1138556 - RNA, 19 nt, Homo sapiens
ucacacaacugccuuagaa

SEQ ID NO: 1138557 - RNA, 19 nt, Homo sapiens
gaaacgugauugucauuug

SEQ ID NO: 1138558 - RNA, 19 nt, Homo sapiens
cauaaacucugcagacaaa

SEQ ID NO: 1138559 - RNA, 19 nt, Homo sapiens
caagauagauaccacauca

SEQ ID NO: 1138560 - RNA, 19 nt, Homo sapiens
gaacuaaagcuucaggaaa

SEQ ID NO: 1138561 - RNA, 19 nt, Homo sapiens
ggagaugacuaaacuuaau

SEQ ID NO: 1138562 - RNA, 19 nt, Homo sapiens
caacaacucuuugcugcua

SEQ ID NO: 1138563 - RNA, 19 nt, Homo sapiens
gaacauacccgugaaagga

SEQ ID NO: 1138564 - RNA, 19 nt, Homo sapiens
uaauacagcucuagauuuc

SEQ ID NO: 1138565 - RNA, 19 nt, Homo sapiens
gccaugcucuuaugugaua

SEQ ID NO: 1138566 - RNA, 19 nt, Homo sapiens
gaaauaaaccauagaccuu

SEQ ID NO: 1138567 - RNA, 19 nt, Homo sapiens
gaacaaagacaaagauugg

SEQ ID NO: 1138568 - RNA, 19 nt, Homo sapiens
uagcaaagauucaggcauu

SEQ ID NO: 1138569 - RNA, 19 nt, Homo sapiens
guaaggagauguucuuugg

SEQ ID NO: 1138570 - RNA, 19 nt, Homo sapiens
gauuauauguucagaggaa

SEQ ID NO: 1138571 - RNA, 19 nt, Homo sapiens
gcaacaagccauaauauag

SEQ ID NO: 1138572 - RNA, 19 nt, Homo sapiens
gaccaaaugucucucaaau

SEQ ID NO: 1138573 - RNA, 19 nt, Homo sapiens
gcaaugacuuuauggacuu

SEQ ID NO: 1138574 - RNA, 19 nt, Homo sapiens
cgagucagcuuugcagaua

SEQ ID NO: 1138575 - RNA, 19 nt, Homo sapiens
gcaaaugacagccagcuaa

SEQ ID NO: 1138576 - RNA, 19 nt, Homo sapiens
guggagugcuuaaaucuaa

SEQ ID NO: 1138577 - RNA, 19 nt, Homo sapiens
gaaccuaaguccuucucaa

SEQ ID NO: 1138578 - RNA, 19 nt, Homo sapiens
gauauuacccagaguugua

SEQ ID NO: 1138579 - RNA, 19 nt, Homo sapiens
ccacaucauuucuagcuaa

SEQ ID NO: 1138580 - RNA, 19 nt, Homo sapiens
aaagugcccuggaggauaa

SEQ ID NO: 1138581 - RNA, 19 nt, Homo sapiens
agagguagcugauaacaug

SEQ ID NO: 1138582 - RNA, 19 nt, Homo sapiens
gaaagugaccgucuaguag

SEQ ID NO: 1138583 - RNA, 19 nt, Homo sapiens
agacagaccuaacuuugaa

SEQ ID NO: 1138584 - RNA, 19 nt, Homo sapiens
gagccacacuguugucauu

SEQ ID NO: 1138585 - RNA, 19 nt, Homo sapiens
gauaaucccauaagugaaa

SEQ ID NO: 1138586 - RNA, 19 nt, Homo sapiens
agagagaccuguuagaaga

SEQ ID NO: 1138587 - RNA, 19 nt, Homo sapiens
guuauuuccuguacugaua

SEQ ID NO: 1138588 - RNA, 19 nt, Homo sapiens
gaggagaacauggacauua

SEQ ID NO: 1138589 - RNA, 19 nt, Homo sapiens
gaagaaaacccuaaauuug

SEQ ID NO: 1138590 - RNA, 19 nt, Homo sapiens
gaaaugacagagucccaua

SEQ ID NO: 1138591 - RNA, 19 nt, Homo sapiens
uaacaacaaugaacagaca

SEQ ID NO: 1138592 - RNA, 19 nt, Homo sapiens
ggaaauaaggcacacaaug

SEQ ID NO: 1138593 - RNA, 19 nt, Homo sapiens
uagaagaaauguggacuuu

SEQ ID NO: 1138594 - RNA, 19 nt, Homo sapiens
caacugccuuagaauguaa

SEQ ID NO: 1138595 - RNA, 19 nt, Homo sapiens
gaaagugcccuggaggaua

SEQ ID NO: 1138596 - RNA, 19 nt, Homo sapiens
caacugccuuagaauguaa

SEQ ID NO: 1138597 - RNA, 19 nt, Homo sapiens
gugcuuaaaucuaacugua

SEQ ID NO: 1138598 - RNA, 19 nt, Homo sapiens
cauauuaccagaagucaua

SEQ ID NO: 1138599 - RNA, 19 nt, Homo sapiens
ggaauccaaugcuuugaga

SEQ ID NO: 1138600 - RNA, 19 nt, Homo sapiens
gaaggaagaaguuauucaa

SEQ ID NO: 1138601 - RNA, 19 nt, Homo sapiens
gacggagucucauaugaaa

SEQ ID NO: 1138602 - RNA, 19 nt, Homo sapiens
caaaugaaagucuauguug

SEQ ID NO: 1138603 - RNA, 19 nt, Homo sapiens
gaaguuauucaaaccagua

SEQ ID NO: 1138604 - RNA, 19 nt, Homo sapiens
uaauagcuguguucaagaa

SEQ ID NO: 1138605 - RNA, 19 nt, Homo sapiens
gcaggaacuucugaaacua

SEQ ID NO: 1138606 - RNA, 19 nt, Homo sapiens
ccauagaccuuuauuagag

SEQ ID NO: 1138607 - RNA, 19 nt, Homo sapiens
ucacgggaaucuaaaggua

SEQ ID NO: 1138608 - RNA, 19 nt, Homo sapiens
cagaaggaguuuucaauua

SEQ ID NO: 1138609 - RNA, 19 nt, Homo sapiens
gaucaauucuucagacucu

SEQ ID NO: 1138610 - RNA, 19 nt, Homo sapiens
gaaaucuauuggcuaauca

SEQ ID NO: 1138611 - RNA, 19 nt, Homo sapiens
gauuaaggauccacgaaau

SEQ ID NO: 1138612 - RNA, 19 nt, Homo sapiens
gaacagacagaccuaacuu

SEQ ID NO: 1138613 - RNA, 19 nt, Homo sapiens
ccaaugcuuugagaaauaa

SEQ ID NO: 1138614 - RNA, 19 nt, Homo sapiens
cuaaguccuucucaauaua

SEQ ID NO: 1138615 - RNA, 19 nt, Homo sapiens
gaaagucuauguugaugac

SEQ ID NO: 1138616 - RNA, 19 nt, Homo sapiens
cacgaaaucuauuggcuaa

SEQ ID NO: 1138617 - RNA, 19 nt, Homo sapiens
ggaauggucuaauaauagg

SEQ ID NO: 1138618 - RNA, 19 nt, Homo sapiens
ggacaguucucuaugaaaa

SEQ ID NO: 1138619 - RNA, 19 nt, Homo sapiens
uaaagauucuccucaguca

SEQ ID NO: 1138620 - RNA, 19 nt, Homo sapiens
cagcagagccugucaaauc

SEQ ID NO: 1138621 - RNA, 19 nt, Homo sapiens
uaaucaggaugccagaaua

SEQ ID NO: 1138622 - RNA, 19 nt, Homo sapiens
caaaugcauguaucucuua

SEQ ID NO: 1138623 - RNA, 19 nt, Homo sapiens
gaacagugccucuucuaca

SEQ ID NO: 1138624 - RNA, 19 nt, Homo sapiens
ccuaaguccuucucaauau

SEQ ID NO: 1138625 - RNA, 19 nt, Homo sapiens
gaaagcugucaguuaaaua

SEQ ID NO: 1138626 - RNA, 19 nt, Homo sapiens
gaaaguguacagaaaccua

SEQ ID NO: 1138627 - RNA, 19 nt, Homo sapiens
uaaagaggacuuccauuug

SEQ ID NO: 1138628 - RNA, 19 nt, Homo sapiens
gaaagaacagacagaccua

SEQ ID NO: 1138629 - RNA, 19 nt, Homo sapiens
acaaagagccacacuguug

SEQ ID NO: 1138630 - RNA, 19 nt, Homo sapiens
aaaggaaacaugcaaauga

SEQ ID NO: 1138631 - RNA, 19 nt, Homo sapiens
uuacugggaugaacacauu

SEQ ID NO: 1138632 - RNA, 19 nt, Homo sapiens
gagaaagucagaaauggaa

SEQ ID NO: 1138633 - RNA, 19 nt, Homo sapiens
ccagagcaauuacuugaau

SEQ ID NO: 1138634 - RNA, 19 nt, Homo sapiens
gcucuagauuuccacagua

SEQ ID NO: 1138635 - RNA, 19 nt, Homo sapiens
ucaggacaguucucuauga

SEQ ID NO: 1138636 - RNA, 19 nt, Homo sapiens
cagccaauauucagacauu

SEQ ID NO: 1138637 - RNA, 19 nt, Homo sapiens
uagauaaucccauaaguga

SEQ ID NO: 1138638 - RNA, 19 nt, Homo sapiens
gacaucaagucacacugua

SEQ ID NO: 1138639 - RNA, 19 nt, Homo sapiens
gaaaggaaacaugcaaaug

SEQ ID NO: 1138640 - RNA, 19 nt, Homo sapiens
uaacaaagagccacacugu

SEQ ID NO: 1138641 - RNA, 19 nt, Homo sapiens
guacuaggccagaauucua

SEQ ID NO: 1138642 - RNA, 19 nt, Homo sapiens
gacauuaccaagagucaua

SEQ ID NO: 1138643 - RNA, 19 nt, Homo sapiens
ccauggaaaugaccaaaug

SEQ ID NO: 1138644 - RNA, 19 nt, Homo sapiens
gagaggagauugaguauuu

SEQ ID NO: 1138645 - RNA, 19 nt, Homo sapiens
ggaaauagauaacgaaagu

SEQ ID NO: 1138646 - RNA, 19 nt, Homo sapiens
ccaaaugucucucaaauau

SEQ ID NO: 1138647 - RNA, 19 nt, Homo sapiens
ggacgaaaguguacagaaa

SEQ ID NO: 1138648 - RNA, 19 nt, Homo sapiens
gaggaauggucuaauaaua

SEQ ID NO: 1138649 - RNA, 19 nt, Homo sapiens
gggagaaacuucaaauaaa

SEQ ID NO: 1138650 - RNA, 19 nt, Homo sapiens
gaaauaaggcacacaauga

SEQ ID NO: 1138651 - RNA, 19 nt, Homo sapiens
guugaaagcugucaguuaa

SEQ ID NO: 1138652 - RNA, 19 nt, Homo sapiens
ggacagaguaguaucaaua

SEQ ID NO: 1138653 - RNA, 19 nt, Homo sapiens
gaagaaauguggacuuuac

SEQ ID NO: 1138654 - RNA, 19 nt, Homo sapiens
gauaauagcuguguucaag

SEQ ID NO: 1138655 - RNA, 19 nt, Homo sapiens
gcauguaucucuuaaggaa

SEQ ID NO: 1138656 - RNA, 19 nt, Homo sapiens
gacccaagauacagauuua

SEQ ID NO: 1138657 - RNA, 19 nt, Homo sapiens
gaacguggguacaagaaga

SEQ ID NO: 1138658 - RNA, 19 nt, Homo sapiens
gauaagcuguugguugaua

SEQ ID NO: 1138659 - RNA, 19 nt, Homo sapiens
caucuaauguuccauguuu

SEQ ID NO: 1138660 - RNA, 19 nt, Homo sapiens
ucacacaacugccuuagaa

SEQ ID NO: 1138661 - RNA, 19 nt, Homo sapiens
ucacacaacugccuuagaa

SEQ ID NO: 1138662 - RNA, 19 nt, Homo sapiens
gaaacgugauugucauuug

SEQ ID NO: 1138663 - RNA, 19 nt, Homo sapiens
cauaaacucugcagacaaa

SEQ ID NO: 1138664 - RNA, 19 nt, Homo sapiens
caagauagauaccacauca

SEQ ID NO: 1138665 - RNA, 19 nt, Homo sapiens
ggagaaacuucaaauaaag

SEQ ID NO: 1138666 - RNA, 19 nt, Homo sapiens
gaacuaaagcuucaggaaa

SEQ ID NO: 1138667 - RNA, 19 nt, Homo sapiens
aagaggagcuucaaagaaa

SEQ ID NO: 1138668 - RNA, 19 nt, Homo sapiens
ggagaugacuaaacuuaau

SEQ ID NO: 1138669 - RNA, 19 nt, Homo sapiens
caacaacucuuugcugcua

SEQ ID NO: 1138670 - RNA, 19 nt, Homo sapiens
gaacauacccgugaaagga

SEQ ID NO: 1138671 - RNA, 19 nt, Homo sapiens
aaauagaacugaagagcua

SEQ ID NO: 1138672 - RNA, 19 nt, Homo sapiens
gcagacccuugcucaaaua

SEQ ID NO: 1138673 - RNA, 19 nt, Homo sapiens
uaauacagcucuagauuuc

SEQ ID NO: 1138674 - RNA, 19 nt, Homo sapiens
gagaacaacuaccugaaga

SEQ ID NO: 1138675 - RNA, 19 nt, Homo sapiens
gaaccaagauaagcuguug

SEQ ID NO: 1138676 - RNA, 19 nt, Homo sapiens
gccaugcucuuaugugaua

SEQ ID NO: 1138677 - RNA, 19 nt, Homo sapiens
gaugggagaauaacaauaa

SEQ ID NO: 1138678 - RNA, 19 nt, Homo sapiens
gaaauaaaccauagaccuu

SEQ ID NO: 1138679 - RNA, 19 nt, Homo sapiens
gaacaaagacaaagauugg

SEQ ID NO: 1138680 - RNA, 19 nt, Homo sapiens
ucacugagauggaaacaga

SEQ ID NO: 1138681 - RNA, 19 nt, Homo sapiens
gaaaaggccuugauugaga

SEQ ID NO: 1138682 - RNA, 19 nt, Homo sapiens
uagcaaagauucaggcauu

SEQ ID NO: 1138683 - RNA, 19 nt, Homo sapiens
guaaggagauguucuuugg

SEQ ID NO: 1138684 - RNA, 19 nt, Homo sapiens
gauuauauguucagaggaa

SEQ ID NO: 1138685 - RNA, 19 nt, Homo sapiens
gcaacaagccauaauauag

SEQ ID NO: 1138686 - RNA, 19 nt, Homo sapiens
gaccaaaugucucucaaau

SEQ ID NO: 1138687 - RNA, 19 nt, Homo sapiens
gcaaugacuuuauggacuu

SEQ ID NO: 1138688 - RNA, 19 nt, Homo sapiens
cgagucagcuuugcagaua

SEQ ID NO: 1138689 - RNA, 19 nt, Homo sapiens
aagauaagcuguugguuga

SEQ ID NO: 1138690 - RNA, 19 nt, Homo sapiens
gcaaaugacagccagcuaa

SEQ ID NO: 1138691 - RNA, 19 nt, Homo sapiens
guggagugcuuaaaucuaa

SEQ ID NO: 1138692 - RNA, 19 nt, Homo sapiens
ggaccaaauuauaaccuaa

SEQ ID NO: 1138693 - RNA, 19 nt, Homo sapiens
gaaccuaaguccuucucaa

SEQ ID NO: 1138694 - RNA, 19 nt, Homo sapiens
gauauuacccagaguugua

SEQ ID NO: 1138695 - RNA, 19 nt, Homo sapiens
ccacaucauuucuagcuaa

SEQ ID NO: 1138696 - RNA, 19 nt, Homo sapiens
aaagugcccuggaggauaa

SEQ ID NO: 1138697 - RNA, 19 nt, Homo sapiens
agagguagcugauaacaug

SEQ ID NO: 1138698 - RNA, 19 nt, Homo sapiens
gaaagugaccgucuaguag

SEQ ID NO: 1138699 - RNA, 19 nt, Homo sapiens
agacagaccuaacuuugaa

SEQ ID NO: 1138700 - RNA, 19 nt, Homo sapiens
agagagaccuguuagaaga

SEQ ID NO: 1138701 - RNA, 19 nt, Homo sapiens
gauaaucccauaagugaaa

SEQ ID NO: 1138702 - RNA, 19 nt, Homo sapiens
gaaaugagagcugcagaaa

SEQ ID NO: 1138703 - RNA, 19 nt, Homo sapiens
cagaagaccugauguuaag

SEQ ID NO: 1138704 - RNA, 19 nt, Homo sapiens
guuauuuccuguacugaua

SEQ ID NO: 1138705 - RNA, 19 nt, Homo sapiens
gaggagaacauggacauua

SEQ ID NO: 1138706 - RNA, 19 nt, Homo sapiens
gaagaaaacccuaaauuug

SEQ ID NO: 1138707 - RNA, 19 nt, Homo sapiens
gaaaugacagagucccaua

SEQ ID NO: 1138708 - RNA, 19 nt, Homo sapiens
uaacaacaaugaacagaca

SEQ ID NO: 1138709 - RNA, 19 nt, Homo sapiens
ggaaauaaggcacacaaug

SEQ ID NO: 1138710 - RNA, 19 nt, Homo sapiens
uagaagaaauguggacuuu

SEQ ID NO: 1138711 - RNA, 19 nt, Homo sapiens
caacugccuuagaauguaa

SEQ ID NO: 1138712 - RNA, 19 nt, Homo sapiens
gaaagugcccuggaggaua

SEQ ID NO: 1138713 - RNA, 19 nt, Homo sapiens
caacugccuuagaauguaa

SEQ ID NO: 1138714 - RNA, 19 nt, Homo sapiens
gugcuuaaaucuaacugua

SEQ ID NO: 1138715 - RNA, 19 nt, Homo sapiens
gagccacacugucgucauu

SEQ ID NO: 1138716 - RNA, 19 nt, Homo sapiens
cauauuaccagaagucaua

SEQ ID NO: 1138717 - RNA, 19 nt, Homo sapiens
ggaauccaaugcuuugaga

SEQ ID NO: 1138718 - RNA, 19 nt, Homo sapiens
gaaggaagaaguuauucaa

SEQ ID NO: 1138719 - RNA, 19 nt, Homo sapiens
gacggagucucauaugaaa

SEQ ID NO: 1138720 - RNA, 19 nt, Homo sapiens
acaacuaccugaagaaugu

SEQ ID NO: 1138721 - RNA, 19 nt, Homo sapiens
gaccugauguuaagucaau

SEQ ID NO: 1138722 - RNA, 19 nt, Homo sapiens
caaauggaaucacaguuuc

SEQ ID NO: 1138723 - RNA, 19 nt, Homo sapiens
caaaugaaagucuauguug

SEQ ID NO: 1138724 - RNA, 19 nt, Homo sapiens
gaaguuauucaaaccagua

SEQ ID NO: 1138725 - RNA, 19 nt, Homo sapiens
uaauagcuguguucaagaa

SEQ ID NO: 1138726 - RNA, 19 nt, Homo sapiens
gcaggaacuucugaaacua

SEQ ID NO: 1138727 - RNA, 19 nt, Homo sapiens
ccauagaccuuuauuagag

SEQ ID NO: 1138728 - RNA, 19 nt, Homo sapiens
ucacgggaaucuaaaggua

SEQ ID NO: 1138729 - RNA, 19 nt, Homo sapiens
cagaaggaguuuucaauua

SEQ ID NO: 1138730 - RNA, 19 nt, Homo sapiens
gaucaauucuucagacucu

SEQ ID NO: 1138731 - RNA, 19 nt, Homo sapiens
gaaaucuauuggcuaauca

SEQ ID NO: 1138732 - RNA, 19 nt, Homo sapiens
gauuaaggauccacgaaau

SEQ ID NO: 1138733 - RNA, 19 nt, Homo sapiens
gaacagacagaccuaacuu

SEQ ID NO: 1138734 - RNA, 19 nt, Homo sapiens
ccaaugcuuugagaaauaa

SEQ ID NO: 1138735 - RNA, 19 nt, Homo sapiens
cuaaguccuucucaauaua

SEQ ID NO: 1138736 - RNA, 19 nt, Homo sapiens
gaaagucuauguugaugac

SEQ ID NO: 1138737 - RNA, 19 nt, Homo sapiens
cacgaaaucuauuggcuaa

SEQ ID NO: 1138738 - RNA, 19 nt, Homo sapiens
ggaauggucuaauaauagg

SEQ ID NO: 1138739 - RNA, 19 nt, Homo sapiens
ggacaguucucuaugaaaa

SEQ ID NO: 1138740 - RNA, 19 nt, Homo sapiens
uaaagauucuccucaguca

SEQ ID NO: 1138741 - RNA, 19 nt, Homo sapiens
cagcagagccugucaaauc

SEQ ID NO: 1138742 - RNA, 19 nt, Homo sapiens
uaaucaggaugccagaaua

SEQ ID NO: 1138743 - RNA, 19 nt, Homo sapiens
caaaugcauguaucucuua

SEQ ID NO: 1138744 - RNA, 19 nt, Homo sapiens
gagaggagauugaguauuu

SEQ ID NO: 1138745 - RNA, 19 nt, Homo sapiens
ggaaauagauaacgaaagu

SEQ ID NO: 1138746 - RNA, 19 nt, Homo sapiens
ccaaaugucucucaaauau

SEQ ID NO: 1138747 - RNA, 19 nt, Homo sapiens
ggacgaaaguguacagaaa

SEQ ID NO: 1138748 - RNA, 19 nt, Homo sapiens
gaggaauggucuaauaaua

SEQ ID NO: 1138749 - RNA, 19 nt, Homo sapiens
gggagaaacuucaaauaaa

SEQ ID NO: 1138750 - RNA, 19 nt, Homo sapiens
gaaauaaggcacacaauga

SEQ ID NO: 1138751 - RNA, 19 nt, Homo sapiens
guugaaagcugucaguuaa

SEQ ID NO: 1138752 - RNA, 19 nt, Homo sapiens
ggacagaguaguaucaaua

SEQ ID NO: 1138753 - RNA, 19 nt, Homo sapiens
gaagaaauguggacuuuac

SEQ ID NO: 1138754 - RNA, 19 nt, Homo sapiens
gauaauagcuguguucaag

SEQ ID NO: 1138755 - RNA, 19 nt, Homo sapiens
gcauguaucucuuaaggaa

SEQ ID NO: 1138756 - RNA, 19 nt, Homo sapiens
gacccaagauacagauuua

SEQ ID NO: 1138757 - RNA, 19 nt, Homo sapiens
gaacguggguacaagaaga

SEQ ID NO: 1138758 - RNA, 19 nt, Homo sapiens
gauaagcuguugguugaua

SEQ ID NO: 1138759 - RNA, 19 nt, Homo sapiens
caucuaauguuccauguuu

SEQ ID NO: 1138760 - RNA, 19 nt, Homo sapiens
ucacacaacugccuuagaa

SEQ ID NO: 1138761 - RNA, 19 nt, Homo sapiens
ucacacaacugccuuagaa

SEQ ID NO: 1138762 - RNA, 19 nt, Homo sapiens
gaaacgugauugucauuug

SEQ ID NO: 1138763 - RNA, 19 nt, Homo sapiens
cauaaacucugcagacaaa

SEQ ID NO: 1138764 - RNA, 19 nt, Homo sapiens
caagauagauaccacauca

SEQ ID NO: 1138765 - RNA, 19 nt, Homo sapiens
ggagaaacuucaaauaaag

SEQ ID NO: 1138766 - RNA, 19 nt, Homo sapiens
gaacuaaagcuucaggaaa

SEQ ID NO: 1138767 - RNA, 19 nt, Homo sapiens
aagaggagcuucaaagaaa

SEQ ID NO: 1138768 - RNA, 19 nt, Homo sapiens
ggagaugacuaaacuuaau

SEQ ID NO: 1138769 - RNA, 19 nt, Homo sapiens
caacaacucuuugcugcua

SEQ ID NO: 1138770 - RNA, 19 nt, Homo sapiens
gaacauacccgugaaagga

SEQ ID NO: 1138771 - RNA, 19 nt, Homo sapiens
aaauagaacugaagagcua

SEQ ID NO: 1138772 - RNA, 19 nt, Homo sapiens
gcagacccuugcucaaaua

SEQ ID NO: 1138773 - RNA, 19 nt, Homo sapiens
uaauacagcucuagauuuc

SEQ ID NO: 1138774 - RNA, 19 nt, Homo sapiens
gagaacaacuaccugaaga

SEQ ID NO: 1138775 - RNA, 19 nt, Homo sapiens
gaaccaagauaagcuguug

SEQ ID NO: 1138776 - RNA, 19 nt, Homo sapiens
gccaugcucuuaugugaua

SEQ ID NO: 1138777 - RNA, 19 nt, Homo sapiens
gaugggagaauaacaauaa

SEQ ID NO: 1138778 - RNA, 19 nt, Homo sapiens
gaaauaaaccauagaccuu

SEQ ID NO: 1138779 - RNA, 19 nt, Homo sapiens
gaacaaagacaaagauugg

SEQ ID NO: 1138780 - RNA, 19 nt, Homo sapiens
ucacugagauggaaacaga

SEQ ID NO: 1138781 - RNA, 19 nt, Homo sapiens
gaaaaggccuugauugaga

SEQ ID NO: 1138782 - RNA, 19 nt, Homo sapiens
uagcaaagauucaggcauu

SEQ ID NO: 1138783 - RNA, 19 nt, Homo sapiens
guaaggagauguucuuugg

SEQ ID NO: 1138784 - RNA, 19 nt, Homo sapiens
gauuauauguucagaggaa

SEQ ID NO: 1138785 - RNA, 19 nt, Homo sapiens
gcaacaagccauaauauag

SEQ ID NO: 1138786 - RNA, 19 nt, Homo sapiens
gaccaaaugucucucaaau

SEQ ID NO: 1138787 - RNA, 19 nt, Homo sapiens
gcaaugacuuuauggacuu

SEQ ID NO: 1138788 - RNA, 19 nt, Homo sapiens
cgagucagcuuugcagaua

SEQ ID NO: 1138789 - RNA, 19 nt, Homo sapiens
aagauaagcuguugguuga

SEQ ID NO: 1138790 - RNA, 19 nt, Homo sapiens
gcaaaugacagccagcuaa

SEQ ID NO: 1138791 - RNA, 19 nt, Homo sapiens
guggagugcuuaaaucuaa

SEQ ID NO: 1138792 - RNA, 19 nt, Homo sapiens
ggaccaaauuauaaccuaa

SEQ ID NO: 1138793 - RNA, 19 nt, Homo sapiens
gaaccuaaguccuucucaa

SEQ ID NO: 1138794 - RNA, 19 nt, Homo sapiens
gauauuacccagaguugua

SEQ ID NO: 1138795 - RNA, 19 nt, Homo sapiens
ccacaucauuucuagcuaa

SEQ ID NO: 1138796 - RNA, 19 nt, Homo sapiens
aaagugcccuggaggauaa

SEQ ID NO: 1138797 - RNA, 19 nt, Homo sapiens
agagguagcugauaacaug

SEQ ID NO: 1138798 - RNA, 19 nt, Homo sapiens
gaaagugaccgucuaguag

SEQ ID NO: 1138799 - RNA, 19 nt, Homo sapiens
agacagaccuaacuuugaa

SEQ ID NO: 1138800 - RNA, 19 nt, Homo sapiens
gagccacacuguugucauu

SEQ ID NO: 1138801 - RNA, 19 nt, Homo sapiens
gauaaucccauaagugaaa

SEQ ID NO: 1138802 - RNA, 19 nt, Homo sapiens
agagagaccuguuagaaga

SEQ ID NO: 1138803 - RNA, 19 nt, Homo sapiens
gaaaugagagcugcagaaa

SEQ ID NO: 1138804 - RNA, 19 nt, Homo sapiens
cagaagaccugauguuaag

SEQ ID NO: 1138805 - RNA, 19 nt, Homo sapiens
guuauuuccuguacugaua

SEQ ID NO: 1138806 - RNA, 19 nt, Homo sapiens
gaggagaacauggacauua

SEQ ID NO: 1138807 - RNA, 19 nt, Homo sapiens
gaagaaaacccuaaauuug

SEQ ID NO: 1138808 - RNA, 19 nt, Homo sapiens
gaaaugacagagucccaua

SEQ ID NO: 1138809 - RNA, 19 nt, Homo sapiens
uaacaacaaugaacagaca

SEQ ID NO: 1138810 - RNA, 19 nt, Homo sapiens
gaacaaccaagcagaaugu

SEQ ID NO: 1138811 - RNA, 19 nt, Homo sapiens
ggaaauaaggcacacaaug

SEQ ID NO: 1138812 - RNA, 19 nt, Homo sapiens
uagaagaaauguggacuuu

SEQ ID NO: 1138813 - RNA, 19 nt, Homo sapiens
caacugccuuagaauguaa

SEQ ID NO: 1138814 - RNA, 19 nt, Homo sapiens
gaaagugcccuggaggaua

SEQ ID NO: 1138815 - RNA, 19 nt, Homo sapiens
caacugccuuagaauguaa

SEQ ID NO: 1138816 - RNA, 19 nt, Homo sapiens
gugcuuaaaucuaacugua

SEQ ID NO: 1138817 - RNA, 19 nt, Homo sapiens
cauauuaccagaagucaua

SEQ ID NO: 1138818 - RNA, 19 nt, Homo sapiens
ggaauccaaugcuuugaga

SEQ ID NO: 1138819 - RNA, 19 nt, Homo sapiens
gaaggaagaaguuauucaa

SEQ ID NO: 1138820 - RNA, 19 nt, Homo sapiens
gacggagucucauaugaaa

SEQ ID NO: 1138821 - RNA, 19 nt, Homo sapiens
acaacuaccugaagaaugu

SEQ ID NO: 1138822 - RNA, 19 nt, Homo sapiens
gaccugauguuaagucaau

SEQ ID NO: 1138823 - RNA, 19 nt, Homo sapiens
caaauggaaucacaguuuc

SEQ ID NO: 1138824 - RNA, 19 nt, Homo sapiens
caaaugaaagucuauguug

SEQ ID NO: 1138825 - RNA, 19 nt, Homo sapiens
gaaguuauucaaaccagua

SEQ ID NO: 1138826 - RNA, 19 nt, Homo sapiens
uaauagcuguguucaagaa

SEQ ID NO: 1138827 - RNA, 19 nt, Homo sapiens
gcaggaacuucugaaacua

SEQ ID NO: 1138828 - RNA, 19 nt, Homo sapiens
ccauagaccuuuauuagag

SEQ ID NO: 1138829 - RNA, 19 nt, Homo sapiens
ucacgggaaucuaaaggua

SEQ ID NO: 1138830 - RNA, 19 nt, Homo sapiens
cagaaggaguuuucaauua

SEQ ID NO: 1138831 - RNA, 19 nt, Homo sapiens
gaucaauucuucagacucu

SEQ ID NO: 1138832 - RNA, 19 nt, Homo sapiens
gaaaucuauuggcuaauca

SEQ ID NO: 1138833 - RNA, 19 nt, Homo sapiens
gauuaaggauccacgaaau

SEQ ID NO: 1138834 - RNA, 19 nt, Homo sapiens
gaacagacagaccuaacuu

SEQ ID NO: 1138835 - RNA, 19 nt, Homo sapiens
ccaaugcuuugagaaauaa

SEQ ID NO: 1138836 - RNA, 19 nt, Homo sapiens
cuaaguccuucucaauaua

SEQ ID NO: 1138837 - RNA, 19 nt, Homo sapiens
gaaagucuauguugaugac

SEQ ID NO: 1138838 - RNA, 19 nt, Homo sapiens
cacgaaaucuauuggcuaa

SEQ ID NO: 1138839 - RNA, 19 nt, Homo sapiens
ggaauggucuaauaauagg

SEQ ID NO: 1138840 - RNA, 19 nt, Homo sapiens
ggacaguucucuaugaaaa

SEQ ID NO: 1138841 - RNA, 19 nt, Homo sapiens
uaaagauucuccucaguca

SEQ ID NO: 1138842 - RNA, 19 nt, Homo sapiens
cagcagagccugucaaauc

SEQ ID NO: 1138843 - RNA, 19 nt, Homo sapiens
uaaucaggaugccagaaua

SEQ ID NO: 1138844 - RNA, 19 nt, Homo sapiens
ugagaaagaucaugaauug

SEQ ID NO: 1138845 - RNA, 19 nt, Homo sapiens
caacaagaauugcaacauu

SEQ ID NO: 1138846 - RNA, 19 nt, Homo sapiens
gcaaagcauccuacuauua

SEQ ID NO: 1138847 - RNA, 19 nt, Homo sapiens
gaacguagguacauagaag

SEQ ID NO: 1138848 - RNA, 19 nt, Homo sapiens
ggaauggucugguacaugu

SEQ ID NO: 1138849 - RNA, 19 nt, Homo sapiens
uaaacaaucuucacacgaa

SEQ ID NO: 1138850 - RNA, 19 nt, Homo sapiens
ggauaucucucaauuaaag

SEQ ID NO: 1138851 - RNA, 19 nt, Homo sapiens
gcaacuacuuuaagagauu

SEQ ID NO: 1138852 - RNA, 19 nt, Homo sapiens
ugggauaucucucaauuaa

SEQ ID NO: 1138853 - RNA, 19 nt, Homo sapiens
gaaauuagcaagguuggua

SEQ ID NO: 1138854 - RNA, 19 nt, Homo sapiens
gauccacgguuccuucuuu

SEQ ID NO: 1138855 - RNA, 19 nt, Homo sapiens
gaaaauauguggacuguca

SEQ ID NO: 1138856 - RNA, 19 nt, Homo sapiens
gcaaaucauucuuuaccuu

SEQ ID NO: 1138857 - RNA, 19 nt, Homo sapiens
ggaccgaguugauuauuca

SEQ ID NO: 1138858 - RNA, 19 nt, Homo sapiens
ucaaagugauguaauguga

SEQ ID NO: 1138859 - RNA, 19 nt, Homo sapiens
gaagaaagcauuggagaga

SEQ ID NO: 1138860 - RNA, 19 nt, Homo sapiens
ggaaugguuuguccuauca

SEQ ID NO: 1138861 - RNA, 19 nt, Homo sapiens
ggagagagugcaaaucuuu

SEQ ID NO: 1138862 - RNA, 19 nt, Homo sapiens
gcaugcagcuauucuguug

SEQ ID NO: 1138863 - RNA, 19 nt, Homo sapiens
ggaauaucuugcaguguuu

SEQ ID NO: 1138864 - RNA, 19 nt, Homo sapiens
gaaagaggaauuuguacaa

SEQ ID NO: 1138865 - RNA, 19 nt, Homo sapiens
caacaucucauccuacaaa

SEQ ID NO: 1138866 - RNA, 19 nt, Homo sapiens
ggaagucuuuggauuugaa

SEQ ID NO: 1138867 - RNA, 19 nt, Homo sapiens
guacauagaagaaagcauu

SEQ ID NO: 1138868 - RNA, 19 nt, Homo sapiens
ucuaccaacucuccuauua

SEQ ID NO: 1138869 - RNA, 19 nt, Homo sapiens
ccaaugagacuuucugauu

SEQ ID NO: 1138870 - RNA, 19 nt, Homo sapiens
gaggaagucuuuggauuug

SEQ ID NO: 1138871 - RNA, 19 nt, Homo sapiens
gcaagcagauucuuucaac

SEQ ID NO: 1138872 - RNA, 19 nt, Homo sapiens
gaaguuggcugcgucaagu

SEQ ID NO: 1138873 - RNA, 19 nt, Homo sapiens
gauguaaacuugcaagcau

SEQ ID NO: 1138874 - RNA, 19 nt, Homo sapiens
guacaagacucacauagcu

SEQ ID NO: 1138875 - RNA, 19 nt, Homo sapiens
gguuguaacuugcauuaga

SEQ ID NO: 1138876 - RNA, 19 nt, Homo sapiens
gcacaaacacuuauuucug

SEQ ID NO: 1138877 - RNA, 19 nt, Homo sapiens
aauggucucucucuauaua

SEQ ID NO: 1138878 - RNA, 19 nt, Homo sapiens
cacaaacacuuauuucugu

SEQ ID NO: 1138879 - RNA, 19 nt, Homo sapiens
aagaugaacucgaugaaga

SEQ ID NO: 1138880 - RNA, 19 nt, Homo sapiens
gccagucuaugcaauaauu

SEQ ID NO: 1138881 - RNA, 19 nt, Homo sapiens
aaagagaacauguaaguug

SEQ ID NO: 1138882 - RNA, 19 nt, Homo sapiens
gaaguuccaucauuuccau

SEQ ID NO: 1138883 - RNA, 19 nt, Homo sapiens
ggagcugccauacuucuua

SEQ ID NO: 1138884 - RNA, 19 nt, Homo sapiens
gcaaggucaucaaggagaa

SEQ ID NO: 1138885 - RNA, 19 nt, Homo sapiens
caagauagcacacagaagu

SEQ ID NO: 1138886 - RNA, 19 nt, Homo sapiens
gcagugggauucaguggau

SEQ ID NO: 1138887 - RNA, 19 nt, Homo sapiens
gaagcaagcagauucuuuc

SEQ ID NO: 1138888 - RNA, 19 nt, Homo sapiens
cuucuuaccucuacccuaa

SEQ ID NO: 1138889 - RNA, 19 nt, Homo sapiens
gaaaagaggggcuaaagaa

SEQ ID NO: 1138890 - RNA, 19 nt, Homo sapiens
ugaagaacguagguacaua

SEQ ID NO: 1138891 - RNA, 19 nt, Homo sapiens
ggagaaagccaaauucaac

SEQ ID NO: 1138892 - RNA, 19 nt, Homo sapiens
gaaguacaagacucacaua

SEQ ID NO: 1138893 - RNA, 19 nt, Homo sapiens
cagcuauucuguuguauuc

SEQ ID NO: 1138894 - RNA, 19 nt, Homo sapiens
guugggauaucucucaauu

SEQ ID NO: 1138895 - RNA, 19 nt, Homo sapiens
ggaggaaacaagugaagaa

SEQ ID NO: 1138896 - RNA, 19 nt, Homo sapiens
ugucaucuuugucagaaua

SEQ ID NO: 1138897 - RNA, 19 nt, Homo sapiens
uggcuggucuucaguguuu

SEQ ID NO: 1138898 - RNA, 19 nt, Homo sapiens
gcaagaauggaauccguaa

SEQ ID NO: 1138899 - RNA, 19 nt, Homo sapiens
uagcguaucacauaacuuu

SEQ ID NO: 1138900 - RNA, 19 nt, Homo sapiens
gucguuggcuauucucaua

SEQ ID NO: 1138901 - RNA, 19 nt, Homo sapiens
caacuacgacagugagaaa

SEQ ID NO: 1138902 - RNA, 19 nt, Homo sapiens
ccacaaagaaucuaauaag

SEQ ID NO: 1138903 - RNA, 19 nt, Homo sapiens
aagagaacauguaaguuga

SEQ ID NO: 1138904 - RNA, 19 nt, Homo sapiens
ugaaagagaacauguaagu

SEQ ID NO: 1138905 - RNA, 19 nt, Homo sapiens
aggaauaucuugcaguguu

SEQ ID NO: 1138906 - RNA, 19 nt, Homo sapiens
ugaacucgaugaagaaaca

SEQ ID NO: 1138907 - RNA, 19 nt, Homo sapiens
uagcauacaccuaauguug

SEQ ID NO: 1138908 - RNA, 19 nt, Homo sapiens
aaaauggucucucucuaua

SEQ ID NO: 1138909 - RNA, 19 nt, Homo sapiens
guuguaacuugcauuagaa

SEQ ID NO: 1138910 - RNA, 19 nt, Homo sapiens
ccauuuaccuaauaguaug

SEQ ID NO: 1138911 - RNA, 19 nt, Homo sapiens
gaaagagaacauguaaguu

SEQ ID NO: 1138912 - RNA, 19 nt, Homo sapiens
ugaggaagucuuuggauuu

SEQ ID NO: 1138913 - RNA, 19 nt, Homo sapiens
gaagaacguagguacauag

SEQ ID NO: 1138914 - RNA, 19 nt, Homo sapiens
caaagcauccuacuauuac

SEQ ID NO: 1138915 - RNA, 19 nt, Homo sapiens
gcccgcaacuacuuuaaga

SEQ ID NO: 1138916 - RNA, 19 nt, Homo sapiens
cuggauauuugaucuguuu

SEQ ID NO: 1138917 - RNA, 19 nt, Homo sapiens
aaccgcaucuacccaaaua

SEQ ID NO: 1138918 - RNA, 19 nt, Homo sapiens
cuacuuucauagagucaua

SEQ ID NO: 1138919 - RNA, 19 nt, Homo sapiens
gcuccaagauaugccagua

SEQ ID NO: 1138920 - RNA, 19 nt, Homo sapiens
gauuugcuauaucugguuu

SEQ ID NO: 1138921 - RNA, 19 nt, Homo sapiens
uuucggagcugccauacuu

SEQ ID NO: 1138922 - RNA, 19 nt, Homo sapiens
aaacaaucuucacacgaaa

SEQ ID NO: 1138923 - RNA, 19 nt, Homo sapiens
acuaucagcuacaaaguug

SEQ ID NO: 1138924 - RNA, 19 nt, Homo sapiens
gcaaugacaaagaauaagu

SEQ ID NO: 1138925 - RNA, 19 nt, Homo sapiens
guagguacauagaagaaag

SEQ ID NO: 1138926 - RNA, 19 nt, Homo sapiens
ucaaggagaaagccaaauu

SEQ ID NO: 1138927 - RNA, 19 nt, Homo sapiens
guaguuacccauuggauuc

SEQ ID NO: 1138928 - RNA, 19 nt, Homo sapiens
aagaauaagucacgugaag

SEQ ID NO: 1138929 - RNA, 19 nt, Homo sapiens
gugcaaugacaaagaauaa

SEQ ID NO: 1138930 - RNA, 19 nt, Homo sapiens
gccuuuagcuggcauucuu

SEQ ID NO: 1138931 - RNA, 19 nt, Homo sapiens
caugggauauggagcaaau

SEQ ID NO: 1138932 - RNA, 19 nt, Homo sapiens
acagggugcuggagaagaa

SEQ ID NO: 1138933 - RNA, 19 nt, Homo sapiens
auaaggaccgaguugauua

SEQ ID NO: 1138934 - RNA, 19 nt, Homo sapiens
agaaagaucaugaauugug

SEQ ID NO: 1138935 - RNA, 19 nt, Homo sapiens
gugccacacuuaguaauga

SEQ ID NO: 1138936 - RNA, 19 nt, Homo sapiens
uuagucagccagcauauuu

SEQ ID NO: 1138937 - RNA, 19 nt, Homo sapiens
uuacauccaugccagucua

SEQ ID NO: 1138938 - RNA, 19 nt, Homo sapiens
gcuuuggaauggucuggua

SEQ ID NO: 1138939 - RNA, 19 nt, Homo sapiens
cagagugcauuauggaugu

SEQ ID NO: 1138940 - RNA, 19 nt, Homo sapiens
gcaauccucgccuuuccua

SEQ ID NO: 1138941 - RNA, 19 nt, Homo sapiens
aaagugauguaaugugauc

SEQ ID NO: 1138942 - RNA, 19 nt, Homo sapiens
ugucuauucuggauauuug

SEQ ID NO: 1138943 - RNA, 19 nt, Homo sapiens
gaauugcaacauuugugua

SEQ ID NO: 1138944 - RNA, 19 nt, Homo sapiens
gaaccagggucucucuuua

SEQ ID NO: 1138945 - RNA, 19 nt, Homo sapiens
gagcacagcauuaaaguuu

SEQ ID NO: 1138946 - RNA, 19 nt, Homo sapiens
gaccuaagauggaaugugu

SEQ ID NO: 1138947 - RNA, 19 nt, Homo sapiens
gggauugccugaaccaaga

SEQ ID NO: 1138948 - RNA, 19 nt, Homo sapiens
gcacagcauuaaaguuugg

SEQ ID NO: 1138949 - RNA, 19 nt, Homo sapiens
ggaaccagggucucucuuu

SEQ ID NO: 1138950 - RNA, 19 nt, Homo sapiens
gaaggugauucuccuaggu

SEQ ID NO: 1138951 - RNA, 19 nt, Homo sapiens
guugcaagcucaggccuuu

SEQ ID NO: 1138952 - RNA, 19 nt, Homo sapiens
gguccacacugguuuccuu

SEQ ID NO: 1138953 - RNA, 19 nt, Homo sapiens
gggcugcauuguauucuca

SEQ ID NO: 1138954 - RNA, 19 nt, Homo sapiens
gcauggccauccucagcuu

SEQ ID NO: 1138955 - RNA, 19 nt, Homo sapiens
gcacaucagcaucuucuac

SEQ ID NO: 1138956 - RNA, 19 nt, Homo sapiens
ggagcugccugcugugaac

SEQ ID NO: 1138957 - RNA, 19 nt, Homo sapiens
ggacuccaucgacgccaua

SEQ ID NO: 1138958 - RNA, 19 nt, Homo sapiens
caaguuugcugggcuuugg

SEQ ID NO: 1138959 - RNA, 19 nt, Homo sapiens
uuucagagcacagcauuaa

SEQ ID NO: 1138960 - RNA, 19 nt, Homo sapiens
gaguccagccugaguguug

SEQ ID NO: 1138961 - RNA, 19 nt, Homo sapiens
ucagagcacagcauuaaag

SEQ ID NO: 1138962 - RNA, 19 nt, Homo sapiens
ccagagggcaggagucaag

SEQ ID NO: 1138963 - RNA, 19 nt, Homo sapiens
gugccuaccagacgauuga

SEQ ID NO: 1138964 - RNA, 19 nt, Homo sapiens
caaccuccagccucccuuu

SEQ ID NO: 1138965 - RNA, 19 nt, Homo sapiens
gagggcaggagucaagaug

SEQ ID NO: 1138966 - RNA, 19 nt, Homo sapiens
gcccgcagaucccuuugca

SEQ ID NO: 1138967 - RNA, 19 nt, Homo sapiens
ggucucucuuuaccuccua

SEQ ID NO: 1138968 - RNA, 19 nt, Homo sapiens
ugcaagcucaggccuuuaa

SEQ ID NO: 1138969 - RNA, 19 nt, Homo sapiens
uugcugggcuuugguggaa

SEQ ID NO: 1138970 - RNA, 19 nt, Homo sapiens
ggaccuaagauggaaugug

SEQ ID NO: 1138971 - RNA, 19 nt, Homo sapiens
gaagaccaguuuaagaaua

SEQ ID NO: 1138972 - RNA, 19 nt, Homo sapiens
gaagucaucucaagaacaa

SEQ ID NO: 1138973 - RNA, 19 nt, Homo sapiens
ccacauagcuaucuguuau

SEQ ID NO: 1138974 - RNA, 19 nt, Homo sapiens
caccauaugugcauuauuu

SEQ ID NO: 1138975 - RNA, 19 nt, Homo sapiens
cccauuaacucaucauuua

SEQ ID NO: 1138976 - RNA, 19 nt, Homo sapiens
ggagaugaaugcacuagaa

SEQ ID NO: 1138977 - RNA, 19 nt, Homo sapiens
gaaagacaauggugaauac

SEQ ID NO: 1138978 - RNA, 19 nt, Homo sapiens
caagagagaugagauaaau

SEQ ID NO: 1138979 - RNA, 19 nt, Homo sapiens
gauggaagcuggacacaug

SEQ ID NO: 1138980 - RNA, 19 nt, Homo sapiens
caacaucccuacaaggaaa

SEQ ID NO: 1138981 - RNA, 19 nt, Homo sapiens
cagagagacuugaauguaa

SEQ ID NO: 1138982 - RNA, 19 nt, Homo sapiens
gcuaggacuuggccauuua

SEQ ID NO: 1138983 - RNA, 19 nt, Homo sapiens
ugaaugcacuagaaagaua

SEQ ID NO: 1138984 - RNA, 19 nt, Homo sapiens
caagaaaugugagcauauu

SEQ ID NO: 1138985 - RNA, 19 nt, Homo sapiens
gaagugacguuuguauaau

SEQ ID NO: 1138986 - RNA, 19 nt, Homo sapiens
caguauggcuccacccuua

SEQ ID NO: 1138987 - RNA, 19 nt, Homo sapiens
ucacuaacuugguguauga

SEQ ID NO: 1138988 - RNA, 19 nt, Homo sapiens
ggaaagacaauggugaaua

SEQ ID NO: 1138989 - RNA, 19 nt, Homo sapiens
gcagagagacuugaaugua

SEQ ID NO: 1138990 - RNA, 19 nt, Homo sapiens
gcaggucuguuacauaugu

SEQ ID NO: 1138991 - RNA, 19 nt, Homo sapiens
gaaguucucccagauagua

SEQ ID NO: 1138992 - RNA, 19 nt, Homo sapiens
gugcaggucuguuacauau

SEQ ID NO: 1138993 - RNA, 19 nt, Homo sapiens
ccucuguccuucuauaaua

SEQ ID NO: 1138994 - RNA, 19 nt, Homo sapiens
uauaggaucucauuacugu

SEQ ID NO: 1138995 - RNA, 19 nt, Homo sapiens
ucacaccuauguucucuuu

SEQ ID NO: 1138996 - RNA, 19 nt, Homo sapiens
cauuuaaccucucuaaguu

SEQ ID NO: 1138997 - RNA, 19 nt, Homo sapiens
gcaaaacccuucacaccua

SEQ ID NO: 1138998 - RNA, 19 nt, Homo sapiens
gaacagagaacaagaaagc

SEQ ID NO: 1138999 - RNA, 19 nt, Homo sapiens
gagaagugacguuuguaua

SEQ ID NO: 1139000 - RNA, 19 nt, Homo sapiens
gcacuaugcugccucucaa

SEQ ID NO: 1139001 - RNA, 19 nt, Homo sapiens
gagccaagguugcaaucuu

SEQ ID NO: 1139002 - RNA, 19 nt, Homo sapiens
gaaaucaucaacaggagaa

SEQ ID NO: 1139003 - RNA, 19 nt, Homo sapiens
gggaacaaauuaccaucuu

SEQ ID NO: 1139004 - RNA, 19 nt, Homo sapiens
gaagucaaugggaaagaua

SEQ ID NO: 1139005 - RNA, 19 nt, Homo sapiens
ggaacaaauuaccaucuuc

SEQ ID NO: 1139006 - RNA, 19 nt, Homo sapiens
aaacaagagagaugagaua

SEQ ID NO: 1139007 - RNA, 19 nt, Homo sapiens
agaagugacguuuguauaa

SEQ ID NO: 1139008 - RNA, 19 nt, Homo sapiens
gagaugagcaccauaugug

SEQ ID NO: 1139009 - RNA, 19 nt, Homo sapiens
ucucaagacucccuuaugu

SEQ ID NO: 1139010 - RNA, 19 nt, Homo sapiens
gcacuagaaagauauguug

SEQ ID NO: 1139011 - RNA, 19 nt, Homo sapiens
cuacacagguugccaaugg

SEQ ID NO: 1139012 - RNA, 19 nt, Homo sapiens
caugagaagugacguuugu

SEQ ID NO: 1139013 - RNA, 19 nt, Homo sapiens
gaacaaaagacaacugaaa

SEQ ID NO: 1139014 - RNA, 19 nt, Homo sapiens
gaaugaugguuuccagcuu

SEQ ID NO: 1139015 - RNA, 19 nt, Homo sapiens
ccaauaaguuguggaaagu

SEQ ID NO: 1139016 - RNA, 19 nt, Homo sapiens
acaccuauguucucuuuau

SEQ ID NO: 1139017 - RNA, 19 nt, Homo sapiens
gaugaaugcacuagaaaga

SEQ ID NO: 1139018 - RNA, 19 nt, Homo sapiens
ggacuuggccauuuacaca

SEQ ID NO: 1139019 - RNA, 19 nt, Homo sapiens
caaguguucucauuguuca

SEQ ID NO: 1139020 - RNA, 19 nt, Homo sapiens
uaaguuugcuugccucauc

SEQ ID NO: 1139021 - RNA, 19 nt, Homo sapiens
gcauuucauucaccaauag

SEQ ID NO: 1139022 - RNA, 19 nt, Homo sapiens
auaaagaacucggcaacuu

SEQ ID NO: 1139023 - RNA, 19 nt, Homo sapiens
gaaaagcacagaugauuau

SEQ ID NO: 1139024 - RNA, 19 nt, Homo sapiens
guugagguguuacuaauag

SEQ ID NO: 1139025 - RNA, 19 nt, Homo sapiens
ucaauccacuuuauagaca

SEQ ID NO: 1139026 - RNA, 19 nt, Homo sapiens
uagcauaauucacauugga

SEQ ID NO: 1139027 - RNA, 19 nt, Homo sapiens
gaauagugccgcaauaaac

SEQ ID NO: 1139028 - RNA, 19 nt, Homo sapiens
gauaguuugcucagaauga

SEQ ID NO: 1139029 - RNA, 19 nt, Homo sapiens
acaaugugcaggucuguua

SEQ ID NO: 1139030 - RNA, 19 nt, Homo sapiens
uuauggacccuacuuauuu

SEQ ID NO: 1139031 - RNA, 19 nt, Homo sapiens
ccucaucugucaaacaaga

SEQ ID NO: 1139032 - RNA, 19 nt, Homo sapiens
aaagauauguugccagcau

SEQ ID NO: 1139033 - RNA, 19 nt, Homo sapiens
caccuauguucucuuuaua

SEQ ID NO: 1139034 - RNA, 19 nt, Homo sapiens
ugggaaagauaguaguaaa

SEQ ID NO: 1139035 - RNA, 19 nt, Homo sapiens
guauaucuccuaaugcuau

SEQ ID NO: 1139036 - RNA, 19 nt, Homo sapiens
gagaugaaugcacuagaaa

SEQ ID NO: 1139037 - RNA, 19 nt, Homo sapiens
gccaaugguuugugacugu

SEQ ID NO: 1139038 - RNA, 19 nt, Homo sapiens
guucaauucccaccuauga

SEQ ID NO: 1139039 - RNA, 19 nt, Homo sapiens
gagaagacuuuuagaagga

SEQ ID NO: 1139040 - RNA, 19 nt, Homo sapiens
gcaauuauggacccuacuu

SEQ ID NO: 1139041 - RNA, 19 nt, Homo sapiens
gaauuucuauuugggagau

SEQ ID NO: 1139042 - RNA, 19 nt, Homo sapiens
gaguuuccagucauuguua

SEQ ID NO: 1139043 - RNA, 19 nt, Homo sapiens
ggaagaccaguuuaagaau

SEQ ID NO: 1139044 - RNA, 19 nt, Homo sapiens
uagcguagaucuccauuuu

SEQ ID NO: 1139045 - RNA, 19 nt, Homo sapiens
caauuauggacccuacuua

SEQ ID NO: 1139046 - RNA, 19 nt, Homo sapiens
ugaguuacuucauuagcaa

SEQ ID NO: 1139047 - RNA, 19 nt, Homo sapiens
gggaaaaucuacacagguu

SEQ ID NO: 1139048 - RNA, 19 nt, Homo sapiens
ucaucuaugucccuacaaa

SEQ ID NO: 1139049 - RNA, 19 nt, Homo sapiens
uaggaucucauuacuguuu

SEQ ID NO: 1139050 - RNA, 19 nt, Homo sapiens
gagccucucucccugaucu

SEQ ID NO: 1139051 - RNA, 19 nt, Homo sapiens
gcuuugagaccaagaaaug

SEQ ID NO: 1139052 - RNA, 19 nt, Homo sapiens
gcuccacccuuaggucaaa

SEQ ID NO: 1139053 - RNA, 19 nt, Homo sapiens
ccaagucuuugcuauugug

SEQ ID NO: 1139054 - RNA, 19 nt, Homo sapiens
aguauuccaugguguauau

SEQ ID NO: 1139055 - RNA, 19 nt, Homo sapiens
gcgauaguuugcucagaau

SEQ ID NO: 1139056 - RNA, 19 nt, Homo sapiens
uuccugaguuacuucauua

SEQ ID NO: 1139057 - RNA, 19 nt, Homo sapiens
acagaugauuauccguaua

SEQ ID NO: 1139058 - RNA, 19 nt, Homo sapiens
aaaagugccugggauauuu

SEQ ID NO: 1139059 - RNA, 19 nt, Homo sapiens
ugaauagugccgcaauaaa

SEQ ID NO: 1139060 - RNA, 19 nt, Homo sapiens
gugaauagugccgcaauaa

SEQ ID NO: 1139061 - RNA, 19 nt, Homo sapiens
uagaaaagguucaaucugu

SEQ ID NO: 1139062 - RNA, 19 nt, Homo sapiens
uaauagaguuuccagucau

SEQ ID NO: 1139063 - RNA, 19 nt, Homo sapiens
gaagcuggacacaugagaa

SEQ ID NO: 1139064 - RNA, 19 nt, Homo sapiens
uaaagaacucggcaacuuc

SEQ ID NO: 1139065 - RNA, 19 nt, Homo sapiens
ccagucaauccacuuuaua

SEQ ID NO: 1139066 - RNA, 19 nt, Homo sapiens
uuaauccagucuaccauug

SEQ ID NO: 1139067 - RNA, 19 nt, Homo sapiens
gaaaagguucaaucuguuu

SEQ ID NO: 1139068 - RNA, 19 nt, Homo sapiens
caacucacccuugaaguca

SEQ ID NO: 1139069 - RNA, 19 nt, Homo sapiens
acacacauacucacucuau

SEQ ID NO: 1139070 - RNA, 19 nt, Homo sapiens
ucaagacucccuuaugugu

SEQ ID NO: 1139071 - RNA, 19 nt, Homo sapiens
gaaguggaaugguuuguua

SEQ ID NO: 1139072 - RNA, 19 nt, Homo sapiens
gcaaauauccuaugccaaa

SEQ ID NO: 1139073 - RNA, 19 nt, Homo sapiens
gaaaagcugugacucauua

SEQ ID NO: 1139074 - RNA, 19 nt, Homo sapiens
ggucacagaugccuuauau

SEQ ID NO: 1139075 - RNA, 19 nt, Homo sapiens
ggaaaucagacaaacaaua

SEQ ID NO: 1139076 - RNA, 19 nt, Homo sapiens
caacauguccucauacuga

SEQ ID NO: 1139077 - RNA, 19 nt, Homo sapiens
ugaaagaucuccaccacaa

SEQ ID NO: 1139078 - RNA, 19 nt, Homo sapiens
ucucuaagauugccuagua

SEQ ID NO: 1139079 - RNA, 19 nt, Homo sapiens
cuaauuaacuugcuucugu

SEQ ID NO: 1139080 - RNA, 19 nt, Homo sapiens
ccacaacguucaagauaga

SEQ ID NO: 1139081 - RNA, 19 nt, Homo sapiens
ucacagaugccuuauauau

SEQ ID NO: 1139082 - RNA, 19 nt, Homo sapiens
aaagaaagccugaguguuc

SEQ ID NO: 1139083 - RNA, 19 nt, Homo sapiens
ggagcuugcuuccucauug

SEQ ID NO: 1139084 - RNA, 19 nt, Homo sapiens
caaauuccaccgcugcuua

SEQ ID NO: 1139085 - RNA, 19 nt, Homo sapiens
caagaucucugagcaacuu

SEQ ID NO: 1139086 - RNA, 19 nt, Homo sapiens
gaaaaugaauccagaguuc

SEQ ID NO: 1139087 - RNA, 19 nt, Homo sapiens
gaagaugaaagccaugauu

SEQ ID NO: 1139088 - RNA, 19 nt, Homo sapiens
gguaucagccuggcaaaua

SEQ ID NO: 1139089 - RNA, 19 nt, Homo sapiens
gcaggcggauuaauuggaa

SEQ ID NO: 1139090 - RNA, 19 nt, Homo sapiens
auccagaguucucauauua

SEQ ID NO: 1139091 - RNA, 19 nt, Homo sapiens
aaaucagucuguuccaaua

SEQ ID NO: 1139092 - RNA, 19 nt, Homo sapiens
gaaucagacuaucaggaaa

SEQ ID NO: 1139093 - RNA, 19 nt, Homo sapiens
gaucaggagcugccuauau

SEQ ID NO: 1139094 - RNA, 19 nt, Homo sapiens
ccagaguucucauauuaau

SEQ ID NO: 1139095 - RNA, 19 nt, Homo sapiens
gagcuugcuuccucauuga

SEQ ID NO: 1139096 - RNA, 19 nt, Homo sapiens
gacauucacuucccacuag

SEQ ID NO: 1139097 - RNA, 19 nt, Homo sapiens
caaaucccuugauggcaua

SEQ ID NO: 1139098 - RNA, 19 nt, Homo sapiens
cagaagagaucauuguuuu

SEQ ID NO: 1139099 - RNA, 19 nt, Homo sapiens
gaaggcagaaucagacuau

SEQ ID NO: 1139100 - RNA, 19 nt, Homo sapiens
uggaaaugaugacauguuu

SEQ ID NO: 1139101 - RNA, 19 nt, Homo sapiens
ggagcugccuauauaugaa

SEQ ID NO: 1139102 - RNA, 19 nt, Homo sapiens
ucaguuauuugcaagugua

SEQ ID NO: 1139103 - RNA, 19 nt, Homo sapiens
agucagcacucaguuauuu

SEQ ID NO: 1139104 - RNA, 19 nt, Homo sapiens
gaaagaaaaugugaugaga

SEQ ID NO: 1139105 - RNA, 19 nt, Homo sapiens
cgaagacacagaugacuuu

SEQ ID NO: 1139106 - RNA, 19 nt, Homo sapiens
guaucagccuggcaaauau

SEQ ID NO: 1139107 - RNA, 19 nt, Homo sapiens
gaaagccugaguguucuua

SEQ ID NO: 1139108 - RNA, 19 nt, Homo sapiens
aaaauaaccuggcuucuau

SEQ ID NO: 1139109 - RNA, 19 nt, Homo sapiens
cuagaucccuguauuccaa

SEQ ID NO: 1139110 - RNA, 19 nt, Homo sapiens
aucaggagcugccuauaua

SEQ ID NO: 1139111 - RNA, 19 nt, Homo sapiens
uaaguugccagaucucuaa

SEQ ID NO: 1139112 - RNA, 19 nt, Homo sapiens
gccgagaaaucaugacaau

SEQ ID NO: 1139113 - RNA, 19 nt, Homo sapiens
gcaugccaguaaauaauau

SEQ ID NO: 1139114 - RNA, 19 nt, Homo sapiens
cagaugacuuuaccaggaa

SEQ ID NO: 1139115 - RNA, 19 nt, Homo sapiens
gaagacacagaugacuuua

SEQ ID NO: 1139116 - RNA, 19 nt, Homo sapiens
cacagaugccuuauauaua

SEQ ID NO: 1139117 - RNA, 19 nt, Homo sapiens
cuaagaagguacuacuugu

SEQ ID NO: 1139118 - RNA, 19 nt, Homo sapiens
uacauguucuucagcauuu

SEQ ID NO: 1139119 - RNA, 19 nt, Homo sapiens
gccaguaaauaauauguag

SEQ ID NO: 1139120 - RNA, 19 nt, Homo sapiens
ccaguaccuucccuuugua

SEQ ID NO: 1139121 - RNA, 19 nt, Homo sapiens
ucacuggcauggaugauca

SEQ ID NO: 1139122 - RNA, 19 nt, Homo sapiens
uaagaagguacuacuugua

SEQ ID NO: 1139123 - RNA, 19 nt, Homo sapiens
gcagacagaaauaaugaug

SEQ ID NO: 1139124 - RNA, 19 nt, Homo sapiens
caccacaacguucaagaua

SEQ ID NO: 1139125 - RNA, 19 nt, Homo sapiens
gagaaaucaugacaaugca

SEQ ID NO: 1139126 - RNA, 19 nt, Homo sapiens
aaagugaaagcgacaaauu

SEQ ID NO: 1139127 - RNA, 19 nt, Homo sapiens
ccagaagagaucauuguuu

SEQ ID NO: 1139128 - RNA, 19 nt, Homo sapiens
uaaaauaaguugccagauc

SEQ ID NO: 1139129 - RNA, 19 nt, Homo sapiens
caacaucggcaguauuauc

SEQ ID NO: 1139130 - RNA, 19 nt, Homo sapiens
ggaauacuuaguucaguug

SEQ ID NO: 1139131 - RNA, 19 nt, Homo sapiens
caacuccuauggcaaacug

SEQ ID NO: 1139132 - RNA, 19 nt, Homo sapiens
ccaaaucagucuguuccaa

SEQ ID NO: 1139133 - RNA, 19 nt, Homo sapiens
ccuauaaugaugucugaua

SEQ ID NO: 1139134 - RNA, 19 nt, Homo sapiens
uccaacaucggcaguauua

SEQ ID NO: 1139135 - RNA, 19 nt, Homo sapiens
gcagggcgguguacagcau

SEQ ID NO: 1139136 - RNA, 19 nt, Homo sapiens
gaaaugaugacauguuuug

SEQ ID NO: 1139137 - RNA, 19 nt, Homo sapiens
ggucuggaauacuuaguuc

SEQ ID NO: 1139138 - RNA, 19 nt, Homo sapiens
aaucguaaguagacuaugu

SEQ ID NO: 1139139 - RNA, 19 nt, Homo sapiens
ggucuuagccuacaguucu

SEQ ID NO: 1139140 - RNA, 19 nt, Homo sapiens
guaucuacacagaguaaua

SEQ ID NO: 1139141 - RNA, 19 nt, Homo sapiens
cauuaacccaguaaacaua

SEQ ID NO: 1139142 - RNA, 19 nt, Homo sapiens
ucaauugaguaucucucua

SEQ ID NO: 1139143 - RNA, 19 nt, Homo sapiens
aaacaacucagaccagaug

SEQ ID NO: 1139144 - RNA, 19 nt, Homo sapiens
uugaguaucucucuaguag

SEQ ID NO: 1139145 - RNA, 19 nt, Homo sapiens
gcaagaacacaaucuaaaa

SEQ ID NO: 1139146 - RNA, 19 nt, Homo sapiens
caaauauccuaugccaaau

SEQ ID NO: 1139147 - RNA, 19 nt, Homo sapiens
uagcauaagacgugauauu

SEQ ID NO: 1139148 - RNA, 19 nt, Homo sapiens
uugcuucuguugcacuuua

SEQ ID NO: 1139149 - RNA, 19 nt, Homo sapiens
uggcagaugcugaccauuu

SEQ ID NO: 1139150 - RNA, 19 nt, Homo sapiens
gcaaucguaaguagacuau

SEQ ID NO: 1139151 - RNA, 19 nt, Homo sapiens
cauaguguauaagugagua

SEQ ID NO: 1139152 - RNA, 19 nt, Homo sapiens
gaauccagaguucucauau

SEQ ID NO: 1139153 - RNA, 19 nt, Homo sapiens
cgagaaaucaugacaaugc

SEQ ID NO: 1139154 - RNA, 19 nt, Homo sapiens
cccaguaccuucccuuugu

SEQ ID NO: 1139155 - RNA, 19 nt, Homo sapiens
uaggaaaucagacaaacaa

SEQ ID NO: 1139156 - RNA, 19 nt, Homo sapiens
ugaacagccugcaggugaa

SEQ ID NO: 1139157 - RNA, 19 nt, Homo sapiens
cuucugcugcugcuuauua

SEQ ID NO: 1139158 - RNA, 19 nt, Homo sapiens
aagcauaguguauaaguga

SEQ ID NO: 1139159 - RNA, 19 nt, Homo sapiens
gcuuaauacugcuuugcuu

SEQ ID NO: 1139160 - RNA, 19 nt, Homo sapiens
gaagcuugcauuuaauaca

SEQ ID NO: 1139161 - RNA, 19 nt, Homo sapiens
gcaggcagacagaaauaau

SEQ ID NO: 1139162 - RNA, 19 nt, Homo sapiens
gaacagccugcaggugaaa

SEQ ID NO: 1139163 - RNA, 19 nt, Homo sapiens
aaacaugagauaagggaaa

SEQ ID NO: 1139164 - RNA, 19 nt, Homo sapiens
gagagugggcuugcaagaa

SEQ ID NO: 1139165 - RNA, 19 nt, Homo sapiens
cacuagaccuggaugugaa

SEQ ID NO: 1139166 - RNA, 19 nt, Homo sapiens
gaaugccuaucggacacua

SEQ ID NO: 1139167 - RNA, 19 nt, Homo sapiens
caaaucagucuguuccaau

SEQ ID NO: 1139168 - RNA, 19 nt, Homo sapiens
agaaucagacuaucaggaa

SEQ ID NO: 1139169 - RNA, 19 nt, Homo sapiens
ccaguaaacauauacaaag

SEQ ID NO: 1139170 - RNA, 19 nt, Homo sapiens
cugaauacaguucucauuu

SEQ ID NO: 1139171 - RNA, 19 nt, Homo sapiens
ggaagaagcugccaagauc

SEQ ID NO: 1139172 - RNA, 19 nt, Homo sapiens
gaaccuggauugucugauu

SEQ ID NO: 1139173 - RNA, 19 nt, Homo sapiens
ccaaauugcuuaugaaguu

SEQ ID NO: 1139174 - RNA, 19 nt, Homo sapiens
gaacacguguacaggguuu

SEQ ID NO: 1139175 - RNA, 19 nt, Homo sapiens
caaccacuaucucuucuuu

SEQ ID NO: 1139176 - RNA, 19 nt, Homo sapiens
caagaucccugucguagug

SEQ ID NO: 1139177 - RNA, 19 nt, Homo sapiens
gaauguauuuggguuguuu

SEQ ID NO: 1139178 - RNA, 19 nt, Homo sapiens
gaggaacagccaagucuua

SEQ ID NO: 1139179 - RNA, 19 nt, Homo sapiens
gaggauguguugcgcauug

SEQ ID NO: 1139180 - RNA, 19 nt, Homo sapiens
gacaggagauuggugcuaa

SEQ ID NO: 1139181 - RNA, 19 nt, Homo sapiens
guacccaggucuucucuga

SEQ ID NO: 1139182 - RNA, 19 nt, Homo sapiens
ggguuuaugucacaacuuu

SEQ ID NO: 1139183 - RNA, 19 nt, Homo sapiens
gaauuccuccacuuucuua

SEQ ID NO: 1139184 - RNA, 19 nt, Homo sapiens
guacaggguuuaugucaca

SEQ ID NO: 1139185 - RNA, 19 nt, Homo sapiens
gagaaggacaguagggaua

SEQ ID NO: 1139186 - RNA, 19 nt, Homo sapiens
ggaagcaguuggcuaucuu

SEQ ID NO: 1139187 - RNA, 19 nt, Homo sapiens
ugauauaacuuccuugcuu

SEQ ID NO: 1139188 - RNA, 19 nt, Homo sapiens
gaagauauaaagagaguuc

SEQ ID NO: 1139189 - RNA, 19 nt, Homo sapiens
uaucuuggcugaccuagug

SEQ ID NO: 1139190 - RNA, 19 nt, Homo sapiens
ggagauccacaaccuuuaa

SEQ ID NO: 1139191 - RNA, 19 nt, Homo sapiens
gcaugaaguuuggcauuug

SEQ ID NO: 1139192 - RNA, 19 nt, Homo sapiens
ccaaggcugcucaggauua

SEQ ID NO: 1139193 - RNA, 19 nt, Homo sapiens
ugagaggucugguguguuc

SEQ ID NO: 1139194 - RNA, 19 nt, Homo sapiens
ugggagccauucuauauaa

SEQ ID NO: 1139195 - RNA, 19 nt, Homo sapiens
ggaguuugacuuccucuuu

SEQ ID NO: 1139196 - RNA, 19 nt, Homo sapiens
gcugggagccauucuauau

SEQ ID NO: 1139197 - RNA, 19 nt, Homo sapiens
ccacgaggaugaaucagau

SEQ ID NO: 1139198 - RNA, 19 nt, Homo sapiens
acauuggagugcuucauua

SEQ ID NO: 1139199 - RNA, 19 nt, Homo sapiens
acaggaagauauaaagaga

SEQ ID NO: 1139200 - RNA, 19 nt, Homo sapiens
caagaucuuugcaguucaa

SEQ ID NO: 1139201 - RNA, 19 nt, Homo sapiens
gcuaaagcaugaaguuugg

SEQ ID NO: 1139202 - RNA, 19 nt, Homo sapiens
gaagagguggugcccauga

SEQ ID NO: 1139203 - RNA, 19 nt, Homo sapiens
gagcaucgacucaaauauc

SEQ ID NO: 1139204 - RNA, 19 nt, Homo sapiens
ggacugggaaccuggauug

SEQ ID NO: 1139205 - RNA, 19 nt, Homo sapiens
auacaaagccagagacauu

SEQ ID NO: 1139206 - RNA, 19 nt, Homo sapiens
gguacuaacucagagauuc

SEQ ID NO: 1139207 - RNA, 19 nt, Homo sapiens
ggacggagaaggacaguag

SEQ ID NO: 1139208 - RNA, 19 nt, Homo sapiens
ugaaauuuguagcaucuga

SEQ ID NO: 1139209 - RNA, 19 nt, Homo sapiens
ugacaaagaagccaucaug

SEQ ID NO: 1139210 - RNA, 19 nt, Homo sapiens
gaagccugguugaaaugaa

SEQ ID NO: 1139211 - RNA, 19 nt, Homo sapiens
caugaaggauuccacuuuc

SEQ ID NO: 1139212 - RNA, 19 nt, Homo sapiens
gaacagccaagucuuacau

SEQ ID NO: 1139213 - RNA, 19 nt, Homo sapiens
acgaagaccuuguucugaa

SEQ ID NO: 1139214 - RNA, 19 nt, Homo sapiens
ccgaguugcugcucauuga

SEQ ID NO: 1139215 - RNA, 19 nt, Homo sapiens
cgagauaggcaauacgaaa

SEQ ID NO: 1139216 - RNA, 19 nt, Homo sapiens
uggcugaccuagugaaaga

SEQ ID NO: 1139217 - RNA, 19 nt, Homo sapiens
ccaggaaucucugcaaugg

SEQ ID NO: 1139218 - RNA, 19 nt, Homo sapiens
gguaugaugaggauagaaa

SEQ ID NO: 1139219 - RNA, 19 nt, Homo sapiens
cagaacaugccagugauua

SEQ ID NO: 1139220 - RNA, 19 nt, Homo sapiens
ggauuccacuuucccuaug

SEQ ID NO: 1139221 - RNA, 19 nt, Homo sapiens
guaccaagucuuacaugaa

SEQ ID NO: 1139222 - RNA, 19 nt, Homo sapiens
gcauauaucaaucgccuau

SEQ ID NO: 1139223 - RNA, 19 nt, Homo sapiens
acccaaaucugaauuaugg

SEQ ID NO: 1139224 - RNA, 19 nt, Homo sapiens
gcaguucaaucgaccacau

SEQ ID NO: 1139225 - RNA, 19 nt, Homo sapiens
gggagccauucuauauaaa

SEQ ID NO: 1139226 - RNA, 19 nt, Homo sapiens
uaaaucggcuuggauguac

SEQ ID NO: 1139227 - RNA, 19 nt, Homo sapiens
cgaagaccuuguucugaau

SEQ ID NO: 1139228 - RNA, 19 nt, Homo sapiens
ugaauggucuguggaagau

SEQ ID NO: 1139229 - RNA, 19 nt, Homo sapiens
cgaauucaccaccgacaaa

SEQ ID NO: 1139230 - RNA, 19 nt, Homo sapiens
cgacucaaauaucaguguu

SEQ ID NO: 1139231 - RNA, 19 nt, Homo sapiens
uaacucagagauucaagaa

SEQ ID NO: 1139232 - RNA, 19 nt, Homo sapiens
cagcagugguucccggauu

SEQ ID NO: 1139233 - RNA, 19 nt, Homo sapiens
aauggucuguggaagauuu

SEQ ID NO: 1139234 - RNA, 19 nt, Homo sapiens
ggucugguguguuccuaga

SEQ ID NO: 1139235 - RNA, 19 nt, Homo sapiens
acacgauucuuaccacuca

SEQ ID NO: 1139236 - RNA, 19 nt, Homo sapiens
uaccaagucuuacaugaag

SEQ ID NO: 1139237 - RNA, 19 nt, Homo sapiens
ugaccuagugaaagauuua

SEQ ID NO: 1139238 - RNA, 19 nt, Homo sapiens
ucugagagaagcuauaauu

SEQ ID NO: 1139239 - RNA, 19 nt, Homo sapiens
gaagacccaaaucugaauu

SEQ ID NO: 1139240 - RNA, 19 nt, Homo sapiens
ucugaugccugguaugaug

SEQ ID NO: 1139241 - RNA, 19 nt, Homo sapiens
ggagauuggugcuaauacg

SEQ ID NO: 1139242 - RNA, 19 nt, Homo sapiens
gagccucucuccaaauugc

SEQ ID NO: 1139243 - RNA, 19 nt, Homo sapiens
gacauuggagugcuucauu

SEQ ID NO: 1139244 - RNA, 19 nt, Homo sapiens
ggaauguauuuggguuguu

SEQ ID NO: 1139245 - RNA, 19 nt, Homo sapiens
agccucagaugcugugaua

SEQ ID NO: 1139246 - RNA, 19 nt, Homo sapiens
gauuccacuuucccuauga

SEQ ID NO: 1139247 - RNA, 19 nt, Homo sapiens
agucuuacaugaaggauuc

SEQ ID NO: 1139248 - RNA, 19 nt, Homo sapiens
ucaauggcauauaucaauc

SEQ ID NO: 1139249 - RNA, 19 nt, Homo sapiens
cagaugugguggagaggaa

SEQ ID NO: 1139250 - RNA, 19 nt, Homo sapiens
acagauugcuuggucagaa

SEQ ID NO: 1139251 - RNA, 19 nt, Homo sapiens
gggaauguauuuggguugu

SEQ ID NO: 1139252 - RNA, 19 nt, Homo sapiens
gcuguuugggcauuaauuu

SEQ ID NO: 1139253 - RNA, 19 nt, Homo sapiens
gaccaagcuuuguccaagu

SEQ ID NO: 1139254 - RNA, 19 nt, Homo sapiens
caaauugcuuaugaaguuc

SEQ ID NO: 1139255 - RNA, 19 nt, Homo sapiens
ggcagacacuccagaacau

SEQ ID NO: 1139256 - RNA, 19 nt, Homo sapiens
uccaagaucuuugcaguuc

SEQ ID NO: 1139257 - RNA, 19 nt, Homo sapiens
gaacuaaaugacaggagau

SEQ ID NO: 1139258 - RNA, 19 nt, Homo sapiens
ucauagacuuucgacauug

SEQ ID NO: 1139259 - RNA, 19 nt, Homo sapiens
gagaggaacagccaagucu

SEQ ID NO: 1139260 - RNA, 19 nt, Homo sapiens
guucugaaugaaacucuua

SEQ ID NO: 1139261 - RNA, 19 nt, Homo sapiens
guuuaugcauggauuggaa

SEQ ID NO: 1139262 - RNA, 19 nt, Homo sapiens
gaccaggacuagagaagcu

SEQ ID NO: 1139263 - RNA, 19 nt, Homo sapiens
uuaaaucggcuuggaugua

SEQ ID NO: 1139264 - RNA, 19 nt, Homo sapiens
gaacccauggcuaggauca

SEQ ID NO: 1139265 - RNA, 19 nt, Homo sapiens
gaauuauggacuuguuguu

SEQ ID NO: 1139266 - RNA, 19 nt, Homo sapiens
ggaacagaaucaggagagu

SEQ ID NO: 1139267 - RNA, 19 nt, Homo sapiens
gcaccaaaaugauauaacu

SEQ ID NO: 1139268 - RNA, 19 nt, Homo sapiens
gaaaaggggaacagaauca

SEQ ID NO: 1139269 - RNA, 19 nt, Homo sapiens
aagccugguugaaaugaaa

SEQ ID NO: 1139270 - RNA, 19 nt, Homo sapiens
cugggacucuucuucauau

SEQ ID NO: 1139271 - RNA, 19 nt, Homo sapiens
gaagggaccuagaaaguua

SEQ ID NO: 1139272 - RNA, 19 nt, Homo sapiens
gaaaugauguggaagauga

SEQ ID NO: 1139273 - RNA, 19 nt, Homo sapiens
gcacagagucuuauaguua

SEQ ID NO: 1139274 - RNA, 19 nt, Homo sapiens
gaacugggcuuguccaaau

SEQ ID NO: 1139275 - RNA, 19 nt, Homo sapiens
ggacaacagugaaguuaaa

SEQ ID NO: 1139276 - RNA, 19 nt, Homo sapiens
ggagaugaauggaaaguuu

SEQ ID NO: 1139277 - RNA, 19 nt, Homo sapiens
gcacugacccuucucaaua

SEQ ID NO: 1139278 - RNA, 19 nt, Homo sapiens
guacagaaguuuaagagaa

SEQ ID NO: 1139279 - RNA, 19 nt, Homo sapiens
gaacucugcuuauguaaau

SEQ ID NO: 1139280 - RNA, 19 nt, Homo sapiens
caagaucacuguuguagaa

SEQ ID NO: 1139281 - RNA, 19 nt, Homo sapiens
guagaacucugcuuaugua

SEQ ID NO: 1139282 - RNA, 19 nt, Homo sapiens
gaaaguuacugauucauuc

SEQ ID NO: 1139283 - RNA, 19 nt, Homo sapiens
ggaaagcaauacaaucaaa

SEQ ID NO: 1139284 - RNA, 19 nt, Homo sapiens
gcaaggagaccagaauuua

SEQ ID NO: 1139285 - RNA, 19 nt, Homo sapiens
ggaacaaacagacauauuu

SEQ ID NO: 1139286 - RNA, 19 nt, Homo sapiens
ggaguugucuauaguuuau

SEQ ID NO: 1139287 - RNA, 19 nt, Homo sapiens
cuacagaacuuaugaugga

SEQ ID NO: 1139288 - RNA, 19 nt, Homo sapiens
gcaauacaaucaaagugaa

SEQ ID NO: 1139289 - RNA, 19 nt, Homo sapiens
caaaugagguaauaugagu

SEQ ID NO: 1139290 - RNA, 19 nt, Homo sapiens
gagaacaugcuaagucuaa

SEQ ID NO: 1139291 - RNA, 19 nt, Homo sapiens
ggaauaccauuuagaacug

SEQ ID NO: 1139292 - RNA, 19 nt, Homo sapiens
gacauggacugcugagaaa

SEQ ID NO: 1139293 - RNA, 19 nt, Homo sapiens
gaacaaacuauaccuacuu

SEQ ID NO: 1139294 - RNA, 19 nt, Homo sapiens
ucaugugacugauucaaua

SEQ ID NO: 1139295 - RNA, 19 nt, Homo sapiens
gccaauaggagaucaauuu

SEQ ID NO: 1139296 - RNA, 19 nt, Homo sapiens
ggacagauaaucagcaaug

SEQ ID NO: 1139297 - RNA, 19 nt, Homo sapiens
cacagagucuuauaguuaa

SEQ ID NO: 1139298 - RNA, 19 nt, Homo sapiens
gcagauauaaauacgguuu

SEQ ID NO: 1139299 - RNA, 19 nt, Homo sapiens
ccuacuagcugucucuuga

SEQ ID NO: 1139300 - RNA, 19 nt, Homo sapiens
uaacuuggauagcccuuug

SEQ ID NO: 1139301 - RNA, 19 nt, Homo sapiens
gauguaaauucccuucuca

SEQ ID NO: 1139302 - RNA, 19 nt, Homo sapiens
gguguuagcagauauaaau

SEQ ID NO: 1139303 - RNA, 19 nt, Homo sapiens
aagaggauccgauuugaua

SEQ ID NO: 1139304 - RNA, 19 nt, Homo sapiens
cuaagggcaucaugaggua

SEQ ID NO: 1139305 - RNA, 19 nt, Homo sapiens
gacuauauuucccaaguga

SEQ ID NO: 1139306 - RNA, 19 nt, Homo sapiens
gaacuaagggcaucaugag

SEQ ID NO: 1139307 - RNA, 19 nt, Homo sapiens
ccuagaaaguuacugauuc

SEQ ID NO: 1139308 - RNA, 19 nt, Homo sapiens
caucuuccuucaauucaaa

SEQ ID NO: 1139309 - RNA, 19 nt, Homo sapiens
caugcuaagucuaaucauu

SEQ ID NO: 1139310 - RNA, 19 nt, Homo sapiens
ggaccuagaaaguuacuga

SEQ ID NO: 1139311 - RNA, 19 nt, Homo sapiens
guaaauucccuucucaaau

SEQ ID NO: 1139312 - RNA, 19 nt, Homo sapiens
cuagaaaguuacugauuca

SEQ ID NO: 1139313 - RNA, 19 nt, Homo sapiens
gauccgauuugauaaccaa

SEQ ID NO: 1139314 - RNA, 19 nt, Homo sapiens
ccaggaauaccauuuagaa

SEQ ID NO: 1139315 - RNA, 19 nt, Homo sapiens
cacugacccuucucaauaa

SEQ ID NO: 1139316 - RNA, 19 nt, Homo sapiens
gggcuuguccaaauucuuu

SEQ ID NO: 1139317 - RNA, 19 nt, Homo sapiens
uaaaaugggugucuacaga

SEQ ID NO: 1139318 - RNA, 19 nt, Homo sapiens
cuucaggauuguucauaua

SEQ ID NO: 1139319 - RNA, 19 nt, Homo sapiens
cacuuaaacucgagucuga

SEQ ID NO: 1139320 - RNA, 19 nt, Homo sapiens
aagcugcuguccuuacuaa

SEQ ID NO: 1139321 - RNA, 19 nt, Homo sapiens
uaagagaacaugcuaaguc

SEQ ID NO: 1139322 - RNA, 19 nt, Homo sapiens
guucuuggccacauuguuu

SEQ ID NO: 1139323 - RNA, 19 nt, Homo sapiens
aaaguagccaguagaagua

SEQ ID NO: 1139324 - RNA, 19 nt, Homo sapiens
caggaaagcaauacaauca

SEQ ID NO: 1139325 - RNA, 19 nt, Homo sapiens
ucaaggacauucccaaagg

SEQ ID NO: 1139326 - RNA, 19 nt, Homo sapiens
auaacaagcugcuguccuu

SEQ ID NO: 1139327 - RNA, 19 nt, Homo sapiens
gaaguuaaauggcaaaagg

SEQ ID NO: 1139328 - RNA, 19 nt, Homo sapiens
ugaccucucugaaagugaa

SEQ ID NO: 1139329 - RNA, 19 nt, Homo sapiens
acuaagagauguauauguc

SEQ ID NO: 1139330 - RNA, 19 nt, Homo sapiens
ccaaaggaguucagauugc

SEQ ID NO: 1139331 - RNA, 19 nt, Homo sapiens
uggaaaguuuguaagguuu

SEQ ID NO: 1139332 - RNA, 19 nt, Homo sapiens
cagauaaucagcaaugaga

SEQ ID NO: 1139333 - RNA, 19 nt, Homo sapiens
ccuccugacuccuauaaga

SEQ ID NO: 1139334 - RNA, 19 nt, Homo sapiens
gaacuggaggauguaaauu

SEQ ID NO: 1139335 - RNA, 19 nt, Homo sapiens
gaacaugcuaagucuaauc

SEQ ID NO: 1139336 - RNA, 19 nt, Homo sapiens
ggagggaggcagaguaaca

SEQ ID NO: 1139337 - RNA, 19 nt, Homo sapiens
agaaaucgaggaagaaguu

SEQ ID NO: 1139338 - RNA, 19 nt, Homo sapiens
gcaaugagacauagugacu

SEQ ID NO: 1139339 - RNA, 19 nt, Homo sapiens
gacagauaaucagcaauga

SEQ ID NO: 1139340 - RNA, 19 nt, Homo sapiens
uaggaugguuuguucuuug

SEQ ID NO: 1139341 - RNA, 19 nt, Homo sapiens
ggauguaaauucccuucuc

SEQ ID NO: 1139342 - RNA, 19 nt, Homo sapiens
acaagaauaucaaggacau

SEQ ID NO: 1139343 - RNA, 19 nt, Homo sapiens
caacagugaaguuaaaugg

SEQ ID NO: 1139344 - RNA, 19 nt, Homo sapiens
cugacacauuccaguauua

SEQ ID NO: 1139345 - RNA, 19 nt, Homo sapiens
aauaagaggauccgauuug

SEQ ID NO: 1139346 - RNA, 19 nt, Homo sapiens
aggcaauacuuaagacuau

SEQ ID NO: 1139347 - RNA, 19 nt, Homo sapiens
gaggcaauacuuaagacua

SEQ ID NO: 1139348 - RNA, 19 nt, Homo sapiens
gaggggagaugaauggaaa

SEQ ID NO: 1139349 - RNA, 19 nt, Homo sapiens
gggaacaaacagacauauu

SEQ ID NO: 1139350 - RNA, 19 nt, Homo sapiens
ucagaauccuacucguauu

SEQ ID NO: 1139351 - RNA, 19 nt, Homo sapiens
gagcacagagucuuauagu

SEQ ID NO: 1139352 - RNA, 19 nt, Homo sapiens
cagaauccuacucguauuu

SEQ ID NO: 1139353 - RNA, 19 nt, Homo sapiens
caggacaacagugaaguua

SEQ ID NO: 1139354 - RNA, 19 nt, Homo sapiens
cuauaagacuggcauugug

SEQ ID NO: 1139355 - RNA, 19 nt, Homo sapiens
gaggagacacugaaagaag

SEQ ID NO: 1139356 - RNA, 19 nt, Homo sapiens
acaaaacgauuuccuaugu

SEQ ID NO: 1139357 - RNA, 19 nt, Homo sapiens
agacauggacugcugagaa

SEQ ID NO: 1139358 - RNA, 19 nt, Homo sapiens
gaucacuguuguagaagca

SEQ ID NO: 1139359 - RNA, 19 nt, Homo sapiens
gagaugaauggaaaguuug

SEQ ID NO: 1139360 - RNA, 19 nt, Homo sapiens
gaaagcaauacaaucaaag

SEQ ID NO: 1139361 - RNA, 19 nt, Homo sapiens
caauaaccauaaacucucu

SEQ ID NO: 1139362 - RNA, 19 nt, Homo sapiens
guaguacugacucguguuu

SEQ ID NO: 1139363 - RNA, 19 nt, Homo sapiens
gaauggaaaguuuguaagg

SEQ ID NO: 1139364 - RNA, 19 nt, Homo sapiens
guagccaguagaaguauaa

SEQ ID NO: 1139365 - RNA, 19 nt, Homo sapiens
auaagaggauccgauuuga

SEQ ID NO: 1139366 - RNA, 19 nt, Homo sapiens
aggagacacugaaagaaga

SEQ ID NO: 1139367 - RNA, 19 nt, Homo sapiens
gauugagggccauaacuug

SEQ ID NO: 1139368 - RNA, 19 nt, Homo sapiens
ccaauaggagaucaauuug

SEQ ID NO: 1139369 - RNA, 19 nt, Homo sapiens
gaaaaucgcccaggaauac

SEQ ID NO: 1139370 - RNA, 19 nt, Homo sapiens
gugguucgguacagaaguu

SEQ ID NO: 1139371 - RNA, 19 nt, Homo sapiens
agacauagcuccauagaau

SEQ ID NO: 1139372 - RNA, 19 nt, Homo sapiens
ggaaggagcuggagaaagc

SEQ ID NO: 1139373 - RNA, 19 nt, Homo sapiens
gaaacugaaucacaccaaa

SEQ ID NO: 1139374 - RNA, 19 nt, Homo sapiens
ccaaggaggugucagagaa

SEQ ID NO: 1139375 - RNA, 19 nt, Homo sapiens
acacucuucugaacuauua

SEQ ID NO: 1139376 - RNA, 19 nt, Homo sapiens
cagcagagcuagcaucguu

SEQ ID NO: 1139377 - RNA, 19 nt, Homo sapiens
gcacauuuccuuuggauga

SEQ ID NO: 1139378 - RNA, 19 nt, Homo sapiens
gagugacagucucuacuua

SEQ ID NO: 1139379 - RNA, 19 nt, Homo sapiens
gaacaccaagcccaauaua

SEQ ID NO: 1139380 - RNA, 19 nt, Homo sapiens
cagaagacaucaagagguu

SEQ ID NO: 1139381 - RNA, 19 nt, Homo sapiens
caaaggaaagcuuggauaa

SEQ ID NO: 1139382 - RNA, 19 nt, Homo sapiens
cauagaagccucuguaaga

SEQ ID NO: 1139383 - RNA, 19 nt, Homo sapiens
cagagaagcagcaguuaua

SEQ ID NO: 1139384 - RNA, 19 nt, Homo sapiens
ugaacacucuucugaacua

SEQ ID NO: 1139385 - RNA, 19 nt, Homo sapiens
cgucaggcauugagacaua

SEQ ID NO: 1139386 - RNA, 19 nt, Homo sapiens
aaacucagccuuccagaaa

SEQ ID NO: 1139387 - RNA, 19 nt, Homo sapiens
gaagggaacaggcaucaug

SEQ ID NO: 1139388 - RNA, 19 nt, Homo sapiens
gaacagcccagaugaccuu

SEQ ID NO: 1139389 - RNA, 19 nt, Homo sapiens
gcaauuggccucuggaagu

SEQ ID NO: 1139390 - RNA, 19 nt, Homo sapiens
aaagcaacgucgaguguuu

SEQ ID NO: 1139391 - RNA, 19 nt, Homo sapiens
gaugaacacucuucugaac

SEQ ID NO: 1139392 - RNA, 19 nt, Homo sapiens
gagcaacacgugccagaaa

SEQ ID NO: 1139393 - RNA, 19 nt, Homo sapiens
ccaaagagaaacugaauca

SEQ ID NO: 1139394 - RNA, 19 nt, Homo sapiens
cagguccacugaucacaua

SEQ ID NO: 1139395 - RNA, 19 nt, Homo sapiens
gaaaggccagcgucagaaa

SEQ ID NO: 1139396 - RNA, 19 nt, Homo sapiens
gacagucucuacuuacaga

SEQ ID NO: 1139397 - RNA, 19 nt, Homo sapiens
gaagacaucaagagguuug

SEQ ID NO: 1139398 - RNA, 19 nt, Homo sapiens
ucacauagaagccucugua

SEQ ID NO: 1139399 - RNA, 19 nt, Homo sapiens
agaagcagcaguuauauga

SEQ ID NO: 1139400 - RNA, 19 nt, Homo sapiens
aaggaaagcuuggauaauc

SEQ ID NO: 1139401 - RNA, 19 nt, Homo sapiens
gcucagaggagaccuauca

SEQ ID NO: 1139402 - RNA, 19 nt, Homo sapiens
caauauagacaucccuaaa

SEQ ID NO: 1139403 - RNA, 19 nt, Homo sapiens
ccagggcacuuuaugacaa

SEQ ID NO: 1139404 - RNA, 19 nt, Homo sapiens
gaacacucuucugaacuau

SEQ ID NO: 1139405 - RNA, 19 nt, Homo sapiens
gcauccugcuugaaacaaa

SEQ ID NO: 1139406 - RNA, 19 nt, Homo sapiens
ccgcggagaucaucacuca

SEQ ID NO: 1139407 - RNA, 19 nt, Homo sapiens
uggaaguucuugugacuga

SEQ ID NO: 1139408 - RNA, 19 nt, Homo sapiens
caauuggccucuggaaguu

SEQ ID NO: 1139409 - RNA, 19 nt, Homo sapiens
ccuucaagcuucucugauu

SEQ ID NO: 1139410 - RNA, 19 nt, Homo sapiens
ggaauggauuuaugacacu

SEQ ID NO: 1139411 - RNA, 19 nt, Homo sapiens
gacaguaaccuucagaaca

SEQ ID NO: 1139412 - RNA, 19 nt, Homo sapiens
gauaucagugacuaccuua

SEQ ID NO: 1139413 - RNA, 19 nt, Homo sapiens
ccggacagauuaucagguu

SEQ ID NO: 1139414 - RNA, 19 nt, Homo sapiens
acaccaagcccaauauaga

SEQ ID NO: 1139415 - RNA, 19 nt, Homo sapiens
cugagaagcuggagcaaca

SEQ ID NO: 1139416 - RNA, 19 nt, Homo sapiens
cagcuccacuuucuacaau

SEQ ID NO: 1139417 - RNA, 19 nt, Homo sapiens
gugacuaccuuaagaagag

SEQ ID NO: 1139418 - RNA, 19 nt, Homo sapiens
gguuucacauagcaaauga

SEQ ID NO: 1139419 - RNA, 19 nt, Homo sapiens
caacgucgaguguuucuca

SEQ ID NO: 1139420 - RNA, 19 nt, Homo sapiens
ccagaagcaugcagugaca

SEQ ID NO: 1139421 - RNA, 19 nt, Homo sapiens
gcggagaucaucacucaga

SEQ ID NO: 1139422 - RNA, 19 nt, Homo sapiens
cagaacaccaagcccaaua

SEQ ID NO: 1139423 - RNA, 19 nt, Homo sapiens
uaccaaauccucagaaauc

SEQ ID NO: 1139424 - RNA, 19 nt, Homo sapiens
acguagcgcuggccacuaa

SEQ ID NO: 1139425 - RNA, 19 nt, Homo sapiens
ucaaagccaucagcgcauu

SEQ ID NO: 1139426 - RNA, 19 nt, Homo sapiens
aaagagaaacugaaucaca

SEQ ID NO: 1139427 - RNA, 19 nt, Homo sapiens
ggaaaggccagcgucagaa

SEQ ID NO: 1139428 - RNA, 19 nt, Homo sapiens
ccacaucaccgacaugaag

SEQ ID NO: 1139429 - RNA, 19 nt, Homo sapiens
acaguaaccuucagaacag

SEQ ID NO: 1139430 - RNA, 19 nt, Homo sapiens
cuccacaacugaauaacaa

SEQ ID NO: 1139431 - RNA, 19 nt, Homo sapiens
gagaagcagcaguuauaug

SEQ ID NO: 1139432 - RNA, 19 nt, Homo sapiens
augcagaauuuaaguguga

SEQ ID NO: 1139433 - RNA, 19 nt, Homo sapiens
acaaaggaaagcuuggaua

SEQ ID NO: 1139434 - RNA, 19 nt, Homo sapiens
cauaauuccucaugguucu

SEQ ID NO: 1139435 - RNA, 19 nt, Homo sapiens
gaggguugguggaaguguu

SEQ ID NO: 1139436 - RNA, 19 nt, Homo sapiens
caacacacgcggcaguuca

SEQ ID NO: 1139437 - RNA, 19 nt, Homo sapiens
cagaauccuggcccucuua

SEQ ID NO: 1139438 - RNA, 19 nt, Homo sapiens
acucagccuuccagaaauu

SEQ ID NO: 1139439 - RNA, 19 nt, Homo sapiens
aagcagcaguuauaugaca

SEQ ID NO: 1139440 - RNA, 19 nt, Homo sapiens
ugaaggagccagagaagca

SEQ ID NO: 1139441 - RNA, 19 nt, Homo sapiens
gcaagcuggucaucauggu

SEQ ID NO: 1139442 - RNA, 19 nt, Homo sapiens
ucacuccacaacugaauaa

SEQ ID NO: 1139443 - RNA, 19 nt, Homo sapiens
ugauaucagugacuaccuu

SEQ ID NO: 1139444 - RNA, 19 nt, Homo sapiens
agagcaagcuggucaucau

SEQ ID NO: 1139445 - RNA, 19 nt, Homo sapiens
guccacugaucacauagaa

SEQ ID NO: 1139446 - RNA, 19 nt, Homo sapiens
gugacagucucuacuuaca

SEQ ID NO: 1139447 - RNA, 19 nt, Homo sapiens
ucuuauggcuuucuuguac

SEQ ID NO: 1139448 - RNA, 19 nt, Homo sapiens
gcaaagggaagaugaacac

SEQ ID NO: 1139449 - RNA, 19 nt, Homo sapiens
ccucagaaaucggaaugga

SEQ ID NO: 1139450 - RNA, 19 nt, Homo sapiens
caagaaggcaggacuccau

SEQ ID NO: 1139451 - RNA, 19 nt, Homo sapiens
gacauagcuccauagaauu

SEQ ID NO: 1139452 - RNA, 19 nt, Homo sapiens
gaauccuggcccucuuaua

SEQ ID NO: 1139453 - RNA, 19 nt, Homo sapiens
aagggaagaugaacacucu

SEQ ID NO: 1139454 - RNA, 19 nt, Homo sapiens
ccacuaagcaaagggaaga

SEQ ID NO: 1139455 - RNA, 19 nt, Homo sapiens
gaacacugccggcuguacu

SEQ ID NO: 1139456 - RNA, 19 nt, Homo sapiens
gcagagcuagcaucguuuc

SEQ ID NO: 1139457 - RNA, 19 nt, Homo sapiens
ccagaggcacauuuccuuu

SEQ ID NO: 1139458 - RNA, 19 nt, Homo sapiens
gaagcaugcagugacauug

SEQ ID NO: 1139459 - RNA, 19 nt, Homo sapiens
uacagcacauuaccaaauc

SEQ ID NO: 1139460 - RNA, 19 nt, Homo sapiens
uuacagcacauuaccaaau

SEQ ID NO: 1139461 - RNA, 19 nt, Homo sapiens
ugauggcucugcagcacaa

SEQ ID NO: 1139462 - RNA, 19 nt, Homo sapiens
acaaugugcccaugcagaa

SEQ ID NO: 1139463 - RNA, 19 nt, Homo sapiens
ccagagaagcagcaguuau

SEQ ID NO: 1139464 - RNA, 19 nt, Homo sapiens
acacugggaugaggacugu

SEQ ID NO: 1139465 - RNA, 19 nt, Homo sapiens
ccacaacugaauaacaaug

SEQ ID NO: 1139466 - RNA, 19 nt, Homo sapiens
cagcuuugcggaagaauca

SEQ ID NO: 1139467 - RNA, 19 nt, Homo sapiens
gguuacagcacauuaccaa

SEQ ID NO: 1139468 - RNA, 19 nt, Homo sapiens
cuacugcccaagucuauga

SEQ ID NO: 1139469 - RNA, 19 nt, Homo sapiens
uaugacaacugcccugacu

SEQ ID NO: 1139470 - RNA, 19 nt, Homo sapiens
cuaaagcaacgucgagugu

SEQ ID NO: 1139471 - RNA, 19 nt, Homo sapiens
gaacuuaacuaucggcuuu

SEQ ID NO: 1139472 - RNA, 19 nt, Homo sapiens
ggaccaaacuccuucaaua

SEQ ID NO: 1139473 - RNA, 19 nt, Homo sapiens
ucucuuaacucccuuauua

SEQ ID NO: 1139474 - RNA, 19 nt, Homo sapiens
caacaaagccuacaaagau

SEQ ID NO: 1139475 - RNA, 19 nt, Homo sapiens
cuacaaagaucuccaaguu

SEQ ID NO: 1139476 - RNA, 19 nt, Homo sapiens
gaagaugcacuuucuguaa

SEQ ID NO: 1139477 - RNA, 19 nt, Homo sapiens
gcgaucagcugaagaagaa

SEQ ID NO: 1139478 - RNA, 19 nt, Homo sapiens
guaagacaauggaaaugua

SEQ ID NO: 1139479 - RNA, 19 nt, Homo sapiens
gaauugaacuuaacuaucg

SEQ ID NO: 1139480 - RNA, 19 nt, Homo sapiens
ggaaaugccuccagaagca

SEQ ID NO: 1139481 - RNA, 19 nt, Homo sapiens
gcaaaguuacugucuauuu

SEQ ID NO: 1139482 - RNA, 19 nt, Homo sapiens
gguaauaacuccagagaag

SEQ ID NO: 1139483 - RNA, 19 nt, Homo sapiens
ggaggcagcuucagacugu

SEQ ID NO: 1139484 - RNA, 19 nt, Homo sapiens
gaagcaaaguuacugucua

SEQ ID NO: 1139485 - RNA, 19 nt, Homo sapiens
uaacauaccucuccuacgu

SEQ ID NO: 1139486 - RNA, 19 nt, Homo sapiens
uaaacuagguauugcauug

SEQ ID NO: 1139487 - RNA, 19 nt, Homo sapiens
gaacagccuuauagagaga

SEQ ID NO: 1139488 - RNA, 19 nt, Homo sapiens
gaaugugcuucucuuguuu

SEQ ID NO: 1139489 - RNA, 19 nt, Homo sapiens
guaaggaagcuguuucuuu

SEQ ID NO: 1139490 - RNA, 19 nt, Homo sapiens
uaagagggaagcaaaguua

SEQ ID NO: 1139491 - RNA, 19 nt, Homo sapiens
uaaagaaacuguuccaacu

SEQ ID NO: 1139492 - RNA, 19 nt, Homo sapiens
agaauaagcccaaguaaga

SEQ ID NO: 1139493 - RNA, 19 nt, Homo sapiens
caccacauauacuuuguua

SEQ ID NO: 1139494 - RNA, 19 nt, Homo sapiens
gagagggaguauuguauug

SEQ ID NO: 1139495 - RNA, 19 nt, Homo sapiens
aaucagaaaugguaccuuu

SEQ ID NO: 1139496 - RNA, 19 nt, Homo sapiens
gaccaaacuccuucaauaa

SEQ ID NO: 1139497 - RNA, 19 nt, Homo sapiens
gaagcagccuguguauauu

SEQ ID NO: 1139498 - RNA, 19 nt, Homo sapiens
gaacuugaggcaaaucgua

SEQ ID NO: 1139499 - RNA, 19 nt, Homo sapiens
caccagaacuugaggcaaa

SEQ ID NO: 1139500 - RNA, 19 nt, Homo sapiens
ggucuugucuaucuucauu

SEQ ID NO: 1139501 - RNA, 19 nt, Homo sapiens
uuacugaacuauugacuga

SEQ ID NO: 1139502 - RNA, 19 nt, Homo sapiens
gcaaagaugaggaugaaga

SEQ ID NO: 1139503 - RNA, 19 nt, Homo sapiens
ggaaauguauauagaacuc

SEQ ID NO: 1139504 - RNA, 19 nt, Homo sapiens
ccacauauacuuuguuaga

SEQ ID NO: 1139505 - RNA, 19 nt, Homo sapiens
gaaaaugcaucuucaaaca

SEQ ID NO: 1139506 - RNA, 19 nt, Homo sapiens
cuuaugaacuccaauuuga

SEQ ID NO: 1139507 - RNA, 19 nt, Homo sapiens
uaaggaagcuguuucuuuu

SEQ ID NO: 1139508 - RNA, 19 nt, Homo sapiens
cggaggaccugaagaagaa

SEQ ID NO: 1139509 - RNA, 19 nt, Homo sapiens
ugaaugugcuucucuuguu

SEQ ID NO: 1139510 - RNA, 19 nt, Homo sapiens
uacagacgcuuagcucuua

SEQ ID NO: 1139511 - RNA, 19 nt, Homo sapiens
guaggcaaacuaucaauuu

SEQ ID NO: 1139512 - RNA, 19 nt, Homo sapiens
gaagcgaucagcugaagaa

SEQ ID NO: 1139513 - RNA, 19 nt, Homo sapiens
ugacugagaugaaugucuu

SEQ ID NO: 1139514 - RNA, 19 nt, Homo sapiens
uuccaaagguuacagauaa

SEQ ID NO: 1139515 - RNA, 19 nt, Homo sapiens
gugguacacuaauaaauga

SEQ ID NO: 1139516 - RNA, 19 nt, Homo sapiens
agaagcagccuguguauau

SEQ ID NO: 1139517 - RNA, 19 nt, Homo sapiens
uuuggaaucucaccacaua

SEQ ID NO: 1139518 - RNA, 19 nt, Homo sapiens
caaguaagccuaaagaaac

SEQ ID NO: 1139519 - RNA, 19 nt, Homo sapiens
ucaaguaagccuaaagaaa

SEQ ID NO: 1139520 - RNA, 19 nt, Homo sapiens
uuaacuaucggcuuucuua

SEQ ID NO: 1139521 - RNA, 19 nt, Homo sapiens
guaagcauuuccaccagaa

SEQ ID NO: 1139522 - RNA, 19 nt, Homo sapiens
gcuaguuccuguaagcauu

SEQ ID NO: 1139523 - RNA, 19 nt, Homo sapiens
cuaccaaaguaaaucagua

SEQ ID NO: 1139524 - RNA, 19 nt, Homo sapiens
gagaugaaugucuuuacua

SEQ ID NO: 1139525 - RNA, 19 nt, Homo sapiens
ggaagaaaauguuacugaa

SEQ ID NO: 1139526 - RNA, 19 nt, Homo sapiens
gaagcaaagaugaggauga

SEQ ID NO: 1139527 - RNA, 19 nt, Homo sapiens
gaucaaguaagccuaaaga

SEQ ID NO: 1139528 - RNA, 19 nt, Homo sapiens
agaaaugacugagaugaau

SEQ ID NO: 1139529 - RNA, 19 nt, Homo sapiens
gagaaaugacugagaugaa

SEQ ID NO: 1139530 - RNA, 19 nt, Homo sapiens
cuuaaugggucuugucuau

SEQ ID NO: 1139531 - RNA, 19 nt, Homo sapiens
caucauaaacuagguauug

SEQ ID NO: 1139532 - RNA, 19 nt, Homo sapiens
aagcaaaguuacugucuau

SEQ ID NO: 1139533 - RNA, 19 nt, Homo sapiens
uuaacucccuuauuaccua

SEQ ID NO: 1139534 - RNA, 19 nt, Homo sapiens
acacaacuauuagcacauu

SEQ ID NO: 1139535 - RNA, 19 nt, Homo sapiens
agaugaggaugaagaauau

SEQ ID NO: 1139536 - RNA, 19 nt, Homo sapiens
aagcaaagaugaggaugaa

SEQ ID NO: 1139537 - RNA, 19 nt, Homo sapiens
guagucagacgacaaagaa

SEQ ID NO: 1139538 - RNA, 19 nt, Homo sapiens
gagaagcgaucagcugaag

SEQ ID NO: 1139539 - RNA, 19 nt, Homo sapiens
caaguaagacaauggaaau

SEQ ID NO: 1139540 - RNA, 19 nt, Homo sapiens
gaacuauugacugaaagua

SEQ ID NO: 1139541 - RNA, 19 nt, Homo sapiens
gaaacuguuccaacucuug

SEQ ID NO: 1139542 - RNA, 19 nt, Homo sapiens
uaaugggucuugucuaucu

SEQ ID NO: 1139543 - RNA, 19 nt, Homo sapiens
gcaagcaguuaacucucuu

SEQ ID NO: 1139544 - RNA, 19 nt, Homo sapiens
aagaugaggaugaagaaua

SEQ ID NO: 1139545 - RNA, 19 nt, Homo sapiens
gaaaugacugagaugaaug

SEQ ID NO: 1139546 - RNA, 19 nt, Homo sapiens
agagagaaaugacugagau

SEQ ID NO: 1139547 - RNA, 19 nt, Homo sapiens
cagagaagcagccugugua

SEQ ID NO: 1139548 - RNA, 19 nt, Homo sapiens
guauauuccuaacacuuug

SEQ ID NO: 1139549 - RNA, 19 nt, Homo sapiens
gagagagggaguauuguau

SEQ ID NO: 1139550 - RNA, 19 nt, Homo sapiens
gugauuaguuuccaaaggu

SEQ ID NO: 1139551 - RNA, 19 nt, Homo sapiens
guaacuuugucuaaggauu

SEQ ID NO: 1139552 - RNA, 19 nt, Homo sapiens
caaagaugaggaugaagaa

SEQ ID NO: 1139553 - RNA, 19 nt, Homo sapiens
ccaacaaagccuacaaaga

SEQ ID NO: 1139554 - RNA, 19 nt, Homo sapiens
gagaagcagccuguguaua

SEQ ID NO: 1139555 - RNA, 19 nt, Homo sapiens
ccaaguaagacaauggaaa

SEQ ID NO: 1139556 - RNA, 19 nt, Homo sapiens
ugaggcaaaucguaaggaa

SEQ ID NO: 1139557 - RNA, 19 nt, Homo sapiens
uaacucccuuauuaccuaa

SEQ ID NO: 1139558 - RNA, 19 nt, Homo sapiens
ccaaagguuacagauaaua

SEQ ID NO: 1139559 - RNA, 19 nt, Homo sapiens
gaagggauacaccaacauc

SEQ ID NO: 1139560 - RNA, 19 nt, Homo sapiens
cuugaaaacuccuacaaua

SEQ ID NO: 1139561 - RNA, 19 nt, Homo sapiens
uggaaucucaccacauaua

SEQ ID NO: 1139562 - RNA, 19 nt, Homo sapiens
uaauguaggcaaacuauca

SEQ ID NO: 1139563 - RNA, 19 nt, Homo sapiens
caaguuuggauuugccaua

SEQ ID NO: 1139564 - RNA, 19 nt, Homo sapiens
acugaacuauugacugaaa

SEQ ID NO: 1139565 - RNA, 19 nt, Homo sapiens
auagagagagggaguauug

SEQ ID NO: 1139566 - RNA, 19 nt, Homo sapiens
caacaucagcuggaccaaa

SEQ ID NO: 1139567 - RNA, 19 nt, Homo sapiens
gcugcuugcugaggucuuu

SEQ ID NO: 1139568 - RNA, 19 nt, Homo sapiens
cugccgaccucccaacaaa

SEQ ID NO: 1139569 - RNA, 19 nt, Homo sapiens
ugagaugaaugucuuuacu

SEQ ID NO: 1139570 - RNA, 19 nt, Homo sapiens
auaguccacuucaccuuaa

SEQ ID NO: 1139571 - RNA, 19 nt, Homo sapiens
aaucaaagcucccuaauau

SEQ ID NO: 1139572 - RNA, 19 nt, Homo sapiens
gaauugccuucuaauguua

SEQ ID NO: 1139573 - RNA, 19 nt, Homo sapiens
gagaaggacugcacuuaga

SEQ ID NO: 1139574 - RNA, 19 nt, Homo sapiens
gaagagacaagcucaguuu

SEQ ID NO: 1139575 - RNA, 19 nt, Homo sapiens
gaagaagccaacaaugaua

SEQ ID NO: 1139576 - RNA, 19 nt, Homo sapiens
ugaaugagcuucugaccuu

SEQ ID NO: 1139577 - RNA, 19 nt, Homo sapiens
ggaaggauuaugugaauuu

SEQ ID NO: 1139578 - RNA, 19 nt, Homo sapiens
ccacuuaugcugcaauaua

SEQ ID NO: 1139579 - RNA, 19 nt, Homo sapiens
ugaauugccuucuaauguu

SEQ ID NO: 1139580 - RNA, 19 nt, Homo sapiens
gaagauauucugugaagug

SEQ ID NO: 1139581 - RNA, 19 nt, Homo sapiens
uuaagcagcucccacaauu

SEQ ID NO: 1139582 - RNA, 19 nt, Homo sapiens
gggacaggcucaaccaauu

SEQ ID NO: 1139583 - RNA, 19 nt, Homo sapiens
ggagugaagucucaaugau

SEQ ID NO: 1139584 - RNA, 19 nt, Homo sapiens
gaacgaaaugugccauaaa

SEQ ID NO: 1139585 - RNA, 19 nt, Homo sapiens
gauuauuccuggauuguga

SEQ ID NO: 1139586 - RNA, 19 nt, Homo sapiens
gaaucagaaugagaagaua

SEQ ID NO: 1139587 - RNA, 19 nt, Homo sapiens
uaacauacaggacaaauag

SEQ ID NO: 1139588 - RNA, 19 nt, Homo sapiens
gcgggacucuuucuucuug

SEQ ID NO: 1139589 - RNA, 19 nt, Homo sapiens
agugaagucucaaugauaa

SEQ ID NO: 1139590 - RNA, 19 nt, Homo sapiens
gagugaagucucaaugaua

SEQ ID NO: 1139591 - RNA, 19 nt, Homo sapiens
gggagaagcuuuuacagaa

SEQ ID NO: 1139592 - RNA, 19 nt, Homo sapiens
ugagugggcugcugaggaa

SEQ ID NO: 1139593 - RNA, 19 nt, Homo sapiens
uaauauacaccaucccuaa

SEQ ID NO: 1139594 - RNA, 19 nt, Homo sapiens
ugaacgaaaugugccauaa

SEQ ID NO: 1139595 - RNA, 19 nt, Homo sapiens
gaggugaacuuaacaaaau

SEQ ID NO: 1139596 - RNA, 19 nt, Homo sapiens
ucaccucgggcaaauauua

SEQ ID NO: 1139597 - RNA, 19 nt, Homo sapiens
caacaaugauaucuuucug

SEQ ID NO: 1139598 - RNA, 19 nt, Homo sapiens
caauuccgagugcauauua

SEQ ID NO: 1139599 - RNA, 19 nt, Homo sapiens
gcucauaggauggagauuu

SEQ ID NO: 1139600 - RNA, 19 nt, Homo sapiens
caucagguuucauuguauu

SEQ ID NO: 1139601 - RNA, 19 nt, Homo sapiens
gaccagagacaaaucagaa

SEQ ID NO: 1139602 - RNA, 19 nt, Homo sapiens
gagcuuuguugauguuaau

SEQ ID NO: 1139603 - RNA, 19 nt, Homo sapiens
gaacaccgggagaagcuuu

SEQ ID NO: 1139604 - RNA, 19 nt, Homo sapiens
aaugauaacugggaaaugu

SEQ ID NO: 1139605 - RNA, 19 nt, Homo sapiens
uaaucaaagcucccuaaua

SEQ ID NO: 1139606 - RNA, 19 nt, Homo sapiens
ccuauugacuuuaaaccaa

SEQ ID NO: 1139607 - RNA, 19 nt, Homo sapiens
uaaucuauccuuugaggua

SEQ ID NO: 1139608 - RNA, 19 nt, Homo sapiens
ucaaagcucccuaauauac

SEQ ID NO: 1139609 - RNA, 19 nt, Homo sapiens
agacaaaucagaaaugugu

SEQ ID NO: 1139610 - RNA, 19 nt, Homo sapiens
gcauguguauuggauguga

SEQ ID NO: 1139611 - RNA, 19 nt, Homo sapiens
caagauguacccuauuuca

SEQ ID NO: 1139612 - RNA, 19 nt, Homo sapiens
uaaaccagauguggagcua

SEQ ID NO: 1139613 - RNA, 19 nt, Homo sapiens
acacuuauccaucagguuu

SEQ ID NO: 1139614 - RNA, 19 nt, Homo sapiens
guauacguauugguucuuu

SEQ ID NO: 1139615 - RNA, 19 nt, Homo sapiens
uauacaccaucccuaauug

SEQ ID NO: 1139616 - RNA, 19 nt, Homo sapiens
gagaagaaucagaaugaga

SEQ ID NO: 1139617 - RNA, 19 nt, Homo sapiens
gcacucacagggagacaaa

SEQ ID NO: 1139618 - RNA, 19 nt, Homo sapiens
ggcaagacaucccauuucu

SEQ ID NO: 1139619 - RNA, 19 nt, Homo sapiens
ggaaacaugaauucuggaa

SEQ ID NO: 1139620 - RNA, 19 nt, Homo sapiens
ggagaaggacugcacuuag

SEQ ID NO: 1139621 - RNA, 19 nt, Homo sapiens
ccacaauuggguucuuaua

SEQ ID NO: 1139622 - RNA, 19 nt, Homo sapiens
uccaucagguuucauugua

SEQ ID NO: 1139623 - RNA, 19 nt, Homo sapiens
agaagaaucagaaugagaa

SEQ ID NO: 1139624 - RNA, 19 nt, Homo sapiens
agccaacaaugauaucuuu

SEQ ID NO: 1139625 - RNA, 19 nt, Homo sapiens
ugaagaagccaacaaugau

SEQ ID NO: 1139626 - RNA, 19 nt, Homo sapiens
ggagaagcuuuuacagaaa

SEQ ID NO: 1139627 - RNA, 19 nt, Homo sapiens
ucacagacaccgucccauu

SEQ ID NO: 1139628 - RNA, 19 nt, Homo sapiens
uaaaagaacuccaggaaac

SEQ ID NO: 1139629 - RNA, 19 nt, Homo sapiens
cacuuaugcugcaauauau

SEQ ID NO: 1139630 - RNA, 19 nt, Homo sapiens
uacccaggaucucacauuu

SEQ ID NO: 1139631 - RNA, 19 nt, Homo sapiens
ggacaggcucaaccaauuc

SEQ ID NO: 1139632 - RNA, 19 nt, Homo sapiens
augaggagcugaacgaaau

SEQ ID NO: 1139633 - RNA, 19 nt, Homo sapiens
cacaauuggguucuuauaa

SEQ ID NO: 1139634 - RNA, 19 nt, Homo sapiens
auauuacucugcaucauga

SEQ ID NO: 1139635 - RNA, 19 nt, Homo sapiens
gaauuuaaggcuagaagca

SEQ ID NO: 1139636 - RNA, 19 nt, Homo sapiens
gaaaccaccagaaccagau

SEQ ID NO: 1139637 - RNA, 19 nt, Homo sapiens
gaucucacauuugcuuaag

SEQ ID NO: 1139638 - RNA, 19 nt, Homo sapiens
agagacaaaucagaaaugu

SEQ ID NO: 1139639 - RNA, 19 nt, Homo sapiens
uugagaagcauguguauug

SEQ ID NO: 1139640 - RNA, 19 nt, Homo sapiens
gcugaaaacgcuaaaagua

SEQ ID NO: 1139641 - RNA, 19 nt, Homo sapiens
ugucuugaauugccuucua

SEQ ID NO: 1139642 - RNA, 19 nt, Homo sapiens
aucaagauguacccuauuu

SEQ ID NO: 1139643 - RNA, 19 nt, Homo sapiens
gaauguaugaggagcugaa

SEQ ID NO: 1139644 - RNA, 19 nt, Homo sapiens
caauauaucccaaaaccua

SEQ ID NO: 1139645 - RNA, 19 nt, Homo sapiens
agaagcauguguauuggau

SEQ ID NO: 1139646 - RNA, 19 nt, Homo sapiens
ggaucucacauuugcuuaa

SEQ ID NO: 1139647 - RNA, 19 nt, Homo sapiens
caauuagagcugaguauca

SEQ ID NO: 1139648 - RNA, 19 nt, Homo sapiens
gcaauuagagcugaguauc

SEQ ID NO: 1139649 - RNA, 19 nt, Homo sapiens
cuggaaggauuaugugaau

SEQ ID NO: 1139650 - RNA, 19 nt, Homo sapiens
ccaucagguuucauuguau

SEQ ID NO: 1139651 - RNA, 19 nt, Homo sapiens
guacccaggaucucacauu

SEQ ID NO: 1139652 - RNA, 19 nt, Homo sapiens
ggcuaagacugugagcuuu

SEQ ID NO: 1139653 - RNA, 19 nt, Homo sapiens
guuaaucaaagcucccuaa

SEQ ID NO: 1139654 - RNA, 19 nt, Homo sapiens
acugugagcuuuguugaug

SEQ ID NO: 1139655 - RNA, 19 nt, Homo sapiens
guaggggacuccuggaauu

SEQ ID NO: 1139656 - RNA, 19 nt, Homo sapiens
gcacuuagaacugcauuuu

SEQ ID NO: 1139657 - RNA, 19 nt, Homo sapiens
gggagacaaagaagauauu

SEQ ID NO: 1139658 - RNA, 19 nt, Homo sapiens
aaucuauccuuugagguaa

SEQ ID NO: 1139659 - RNA, 19 nt, Homo sapiens
gcuaaaaguauacguauug

SEQ ID NO: 1139660 - RNA, 19 nt, Homo sapiens
gucuugaauugccuucuaa

SEQ ID NO: 1139661 - RNA, 19 nt, Homo sapiens
ugagcuuuguugauguuaa

SEQ ID NO: 1139662 - RNA, 19 nt, Homo sapiens
gcuaagacugugagcuuug

SEQ ID NO: 1139663 - RNA, 19 nt, Homo sapiens
ucaguacggcagugaauga

SEQ ID NO: 1139664 - RNA, 19 nt, Homo sapiens
uuuggugucuguaauaugu

SEQ ID NO: 1139665 - RNA, 19 nt, Homo sapiens
gcagugaaugagcuucuga

SEQ ID NO: 1139666 - RNA, 19 nt, Homo sapiens
gaacuccaggaaacaugaa

SEQ ID NO: 1139667 - RNA, 19 nt, Homo sapiens
ugauaacugggaaauguuu

SEQ ID NO: 1139668 - RNA, 19 nt, Homo sapiens
aagcauguguauuggaugu

SEQ ID NO: 1139669 - RNA, 19 nt, Homo sapiens
cauauuacucugcaucaug

SEQ ID NO: 1139670 - RNA, 19 nt, Homo sapiens
gcauauuacucugcaucau

SEQ ID NO: 1139671 - RNA, 19 nt, Homo sapiens
ggagagaagugucacauuu

SEQ ID NO: 1139672 - RNA, 19 nt, Homo sapiens
gaacaugucuauggacuuu

SEQ ID NO: 1139673 - RNA, 19 nt, Homo sapiens
uggaauaccuuaugcauuu

SEQ ID NO: 1139674 - RNA, 19 nt, Homo sapiens
aaucucauguccucaauua

SEQ ID NO: 1139675 - RNA, 19 nt, Homo sapiens
gggcuuaucucuccuuuca

SEQ ID NO: 1139676 - RNA, 19 nt, Homo sapiens
gaaguggugugaugaagga

SEQ ID NO: 1139677 - RNA, 19 nt, Homo sapiens
ggcauagccuaguuuguua

SEQ ID NO: 1139678 - RNA, 19 nt, Homo sapiens
aauagaaacuggaaaguga

SEQ ID NO: 1139679 - RNA, 19 nt, Homo sapiens
gaggauuucccuucaauaa

SEQ ID NO: 1139680 - RNA, 19 nt, Homo sapiens
caaugcaccugcuaaagaa

SEQ ID NO: 1139681 - RNA, 19 nt, Homo sapiens
guagcuaacuuccuucgaa

SEQ ID NO: 1139682 - RNA, 19 nt, Homo sapiens
ucaaggaacucaagguuuc

SEQ ID NO: 1139683 - RNA, 19 nt, Homo sapiens
gggcacagccaccuuuaua

SEQ ID NO: 1139684 - RNA, 19 nt, Homo sapiens
ugaaguuuaucacuccuua

SEQ ID NO: 1139685 - RNA, 19 nt, Homo sapiens
aaacacagaaagcacauua

SEQ ID NO: 1139686 - RNA, 19 nt, Homo sapiens
aaacccaccuguacagaaa

SEQ ID NO: 1139687 - RNA, 19 nt, Homo sapiens
ggaagcauaugcacugaag

SEQ ID NO: 1139688 - RNA, 19 nt, Homo sapiens
gcucagauguuacuguauc

SEQ ID NO: 1139689 - RNA, 19 nt, Homo sapiens
guacaagguccucauagaa

SEQ ID NO: 1139690 - RNA, 19 nt, Homo sapiens
aaacagaagaggaagcaua

SEQ ID NO: 1139691 - RNA, 19 nt, Homo sapiens
gggcauagccuaguuuguu

SEQ ID NO: 1139692 - RNA, 19 nt, Homo sapiens
gcuuaucucuccuuucaug

SEQ ID NO: 1139693 - RNA, 19 nt, Homo sapiens
ucggguggcugcuuaagua

SEQ ID NO: 1139694 - RNA, 19 nt, Homo sapiens
ucucauguccucaauuaua

SEQ ID NO: 1139695 - RNA, 19 nt, Homo sapiens
aaacuaugcuggcugugaa

SEQ ID NO: 1139696 - RNA, 19 nt, Homo sapiens
ucugguagcucaauggauu

SEQ ID NO: 1139697 - RNA, 19 nt, Homo sapiens
aaagugaaguggugugaug

SEQ ID NO: 1139698 - RNA, 19 nt, Homo sapiens
gagggaauguuuucaaauu

SEQ ID NO: 1139699 - RNA, 19 nt, Homo sapiens
gaaacuaugcuggcuguga

SEQ ID NO: 1139700 - RNA, 19 nt, Homo sapiens
ggaaucugcagcuuauaaa

SEQ ID NO: 1139701 - RNA, 19 nt, Homo sapiens
gaaugcacuucagucagua

SEQ ID NO: 1139702 - RNA, 19 nt, Homo sapiens
ccgcuaugcuggugauaaa

SEQ ID NO: 1139703 - RNA, 19 nt, Homo sapiens
gagugaacaugucuaugga

SEQ ID NO: 1139704 - RNA, 19 nt, Homo sapiens
ggaauaccuuaugcauuug

SEQ ID NO: 1139705 - RNA, 19 nt, Homo sapiens
caacuccucucuucuuaac

SEQ ID NO: 1139706 - RNA, 19 nt, Homo sapiens
gauagacugugguauucau

SEQ ID NO: 1139707 - RNA, 19 nt, Homo sapiens
acaugucuauggacuuuaa

SEQ ID NO: 1139708 - RNA, 19 nt, Homo sapiens
caggucaacugccauagga

SEQ ID NO: 1139709 - RNA, 19 nt, Homo sapiens
uagcuaacuuccuucgaaa

SEQ ID NO: 1139710 - RNA, 19 nt, Homo sapiens
ccacgcaauuugacuuugu

SEQ ID NO: 1139711 - RNA, 19 nt, Homo sapiens
gccauaggauucugagcaa

SEQ ID NO: 1139712 - RNA, 19 nt, Homo sapiens
ggaccagccuccacaacgu

SEQ ID NO: 1139713 - RNA, 19 nt, Homo sapiens
uacuguaucccuauucuua

SEQ ID NO: 1139714 - RNA, 19 nt, Homo sapiens
cauguucucuauuggaaga

SEQ ID NO: 1139715 - RNA, 19 nt, Homo sapiens
acaagguccucauagaaga

SEQ ID NO: 1139716 - RNA, 19 nt, Homo sapiens
cucauguccucaauuauaa

SEQ ID NO: 1139717 - RNA, 19 nt, Homo sapiens
gagaagggcagcugcuuag

SEQ ID NO: 1139718 - RNA, 19 nt, Homo sapiens
acaaugcaccugcuaaaga

SEQ ID NO: 1139719 - RNA, 19 nt, Homo sapiens
ugcauuugcuuucgaacua

SEQ ID NO: 1139720 - RNA, 19 nt, Homo sapiens
ugcauaugcucagauguua

SEQ ID NO: 1139721 - RNA, 19 nt, Homo sapiens
ggcagacgaucacgacuca

SEQ ID NO: 1139722 - RNA, 19 nt, Homo sapiens
agcaguaucuccuauguau

SEQ ID NO: 1139723 - RNA, 19 nt, Homo sapiens
gaggaagcauaugcacuga

SEQ ID NO: 1139724 - RNA, 19 nt, Homo sapiens
gggcagcugcuuagaguga

SEQ ID NO: 1139725 - RNA, 19 nt, Homo sapiens
gaagugaaggcuguagcua

SEQ ID NO: 1139726 - RNA, 19 nt, Homo sapiens
gaguggaugccaauagaaa

SEQ ID NO: 1139727 - RNA, 19 nt, Homo sapiens
auucacauguucucuauug

SEQ ID NO: 1139728 - RNA, 19 nt, Homo sapiens
uguggaaucugcagcuuau

SEQ ID NO: 1139729 - RNA, 19 nt, Homo sapiens
gaaacuggaaagugaagug

SEQ ID NO: 1139730 - RNA, 19 nt, Homo sapiens
aaagagcuguuuggauaga

SEQ ID NO: 1139731 - RNA, 19 nt, Homo sapiens
ucauucacauguucucuau

SEQ ID NO: 1139732 - RNA, 19 nt, Homo sapiens
ggucaacugccauaggauu

SEQ ID NO: 1139733 - RNA, 19 nt, Homo sapiens
gcucaggucaacugccaua

SEQ ID NO: 1139734 - RNA, 19 nt, Homo sapiens
ggaaagugaagugguguga

SEQ ID NO: 1139735 - RNA, 19 nt, Homo sapiens
ggucaaggaacucaagguu

SEQ ID NO: 1139736 - RNA, 19 nt, Homo sapiens
cacauguucucuauuggaa

SEQ ID NO: 1139737 - RNA, 19 nt, Homo sapiens
acagccaccuuuauaacaa

SEQ ID NO: 1139738 - RNA, 19 nt, Homo sapiens
gcacagccaccuuuauaac

SEQ ID NO: 1139739 - RNA, 19 nt, Homo sapiens
ugaaggcuguagcuaacuu

SEQ ID NO: 1139740 - RNA, 19 nt, Homo sapiens
ccagcaguaucuccuaugu

SEQ ID NO: 1139741 - RNA, 19 nt, Homo sapiens
ggugauaaagugauaagau

SEQ ID NO: 1139742 - RNA, 19 nt, Homo sapiens
gaaccugugcgguguguag

SEQ ID NO: 1139743 - RNA, 19 nt, Homo sapiens
gaccaagucguaauagcaa

SEQ ID NO: 1139744 - RNA, 19 nt, Homo sapiens
uaaaucucauguccucaau

SEQ ID NO: 1139745 - RNA, 19 nt, Homo sapiens
ucacaaugcaccugcuaaa

SEQ ID NO: 1139746 - RNA, 19 nt, Homo sapiens
uggaguggaugccaauaga

SEQ ID NO: 1139747 - RNA, 19 nt, Homo sapiens
uguuuaacgucgauggaua

SEQ ID NO: 1139748 - RNA, 19 nt, Homo sapiens
gaucauaugagggaagaug

SEQ ID NO: 1139749 - RNA, 19 nt, Homo sapiens
guuuaucacuccuuagaag

SEQ ID NO: 1139750 - RNA, 19 nt, Homo sapiens
caguaucuccuauguauca

SEQ ID NO: 1139751 - RNA, 19 nt, Homo sapiens
agagaagggcagcugcuua

SEQ ID NO: 1139752 - RNA, 19 nt, Homo sapiens
uaaagaaaugucccugaga

SEQ ID NO: 1139753 - RNA, 19 nt, Homo sapiens
uuauaaagcugugaaugca

SEQ ID NO: 1139754 - RNA, 19 nt, Homo sapiens
guaucccuauucuuacaaa

SEQ ID NO: 1139755 - RNA, 19 nt, Homo sapiens
ggcuguagcuaacuuccuu

SEQ ID NO: 1139756 - RNA, 19 nt, Homo sapiens
aaucugagccggaagugaa

SEQ ID NO: 1139757 - RNA, 19 nt, Homo sapiens
uaucacuccuuagaagaaa

SEQ ID NO: 1139758 - RNA, 19 nt, Homo sapiens
ccaguacaagguccucaua

SEQ ID NO: 1139759 - RNA, 19 nt, Homo sapiens
cauaugcacugaagaaaau

SEQ ID NO: 1139760 - RNA, 19 nt, Homo sapiens
ccuuguagcuggagagaag

SEQ ID NO: 1139761 - RNA, 19 nt, Homo sapiens
uagccuaguuuguuauaag

SEQ ID NO: 1139762 - RNA, 19 nt, Homo sapiens
uucaacuccucucuucuua

SEQ ID NO: 1139763 - RNA, 19 nt, Homo sapiens
caaacccaccuguacagaa

SEQ ID NO: 1139764 - RNA, 19 nt, Homo sapiens
caauagaaacuggaaagug

SEQ ID NO: 1139765 - RNA, 19 nt, Homo sapiens
uggauagacugugguauuc

SEQ ID NO: 1139766 - RNA, 19 nt, Homo sapiens
aguacaagguccucauaga

SEQ ID NO: 1139767 - RNA, 19 nt, Homo sapiens
gaagggcagcugcuuagag

SEQ ID NO: 1139768 - RNA, 19 nt, Homo sapiens
ggcacagccaccuuuauaa

SEQ ID NO: 1139769 - RNA, 19 nt, Homo sapiens
gagaaccugugcggugugu

SEQ ID NO: 1139770 - RNA, 19 nt, Homo sapiens
uggaaucugcagcuuauaa

SEQ ID NO: 1139771 - RNA, 19 nt, Homo sapiens
ccacagauguccuuugaug

SEQ ID NO: 1139772 - RNA, 19 nt, Homo sapiens
gcucaaaggcaucauuaua

SEQ ID NO: 1139773 - RNA, 19 nt, Homo sapiens
gcugaugcgugauagcuua

SEQ ID NO: 1139774 - RNA, 19 nt, Homo sapiens
ccacagacacacuuuauuu

SEQ ID NO: 1139775 - RNA, 19 nt, Homo sapiens
ggaugaggcuccagagaga

SEQ ID NO: 1139776 - RNA, 19 nt, Homo sapiens
gagaugagacuguacaaga

SEQ ID NO: 1139777 - RNA, 19 nt, Homo sapiens
uggguaaucuggucaguaa

SEQ ID NO: 1139778 - RNA, 19 nt, Homo sapiens
ugaaagugaugcagaugaa

SEQ ID NO: 1139779 - RNA, 19 nt, Homo sapiens
gaaacuauuugugggcuau

SEQ ID NO: 1139780 - RNA, 19 nt, Homo sapiens
gggagaggaugaugacuca

SEQ ID NO: 1139781 - RNA, 19 nt, Homo sapiens
ccaaguuuguugaaaguga

SEQ ID NO: 1139782 - RNA, 19 nt, Homo sapiens
uaaguccgaugccagaauu

SEQ ID NO: 1139783 - RNA, 19 nt, Homo sapiens
agacacacuuuauuuccua

SEQ ID NO: 1139784 - RNA, 19 nt, Homo sapiens
ucaaaugucuaucaucucu

SEQ ID NO: 1139785 - RNA, 19 nt, Homo sapiens
cagugaagauguacgacua

SEQ ID NO: 1139786 - RNA, 19 nt, Homo sapiens
cagauguccuuugaugaua

SEQ ID NO: 1139787 - RNA, 19 nt, Homo sapiens
gagauuugaguucuucuuu

SEQ ID NO: 1139788 - RNA, 19 nt, Homo sapiens
gccagaauuuggagauuug

SEQ ID NO: 1139789 - RNA, 19 nt, Homo sapiens
ggaccgaccgcuccaaguu

SEQ ID NO: 1139790 - RNA, 19 nt, Homo sapiens
gcuucuaacuaguguugua

SEQ ID NO: 1139791 - RNA, 19 nt, Homo sapiens
cuagggcgcuguggaaauu

SEQ ID NO: 1139792 - RNA, 19 nt, Homo sapiens
ggccaaggcucccauagag

SEQ ID NO: 1139793 - RNA, 19 nt, Homo sapiens
gaggugaccaucugcaauu

SEQ ID NO: 1139794 - RNA, 19 nt, Homo sapiens
ggagccagaucagaccuuu

SEQ ID NO: 1139795 - RNA, 19 nt, Homo sapiens
acaagaauauuccacagau

SEQ ID NO: 1139796 - RNA, 19 nt, Homo sapiens
gauguacgacuaccuguug

SEQ ID NO: 1139797 - RNA, 19 nt, Homo sapiens
gagcagauacgacaaaggu

SEQ ID NO: 1139798 - RNA, 19 nt, Homo sapiens
ggaucuuacaggagaauua

SEQ ID NO: 1139799 - RNA, 19 nt, Homo sapiens
ccaagugucauguugcuuu

SEQ ID NO: 1139800 - RNA, 19 nt, Homo sapiens
ucuaucaucucucaauuca

SEQ ID NO: 1139801 - RNA, 19 nt, Homo sapiens
caagaauauuccacagaug

SEQ ID NO: 1139802 - RNA, 19 nt, Homo sapiens
agaugagacuguacaagaa

SEQ ID NO: 1139803 - RNA, 19 nt, Homo sapiens
ugacuaauaagcuuccuaa

SEQ ID NO: 1139804 - RNA, 19 nt, Homo sapiens
caagugucauguugcuuug

SEQ ID NO: 1139805 - RNA, 19 nt, Homo sapiens
ccucugagaugagacugua

SEQ ID NO: 1139806 - RNA, 19 nt, Homo sapiens
gcuccaaguuuguugaaag

SEQ ID NO: 1139807 - RNA, 19 nt, Homo sapiens
gaauuagaguaugcuacaa

SEQ ID NO: 1139808 - RNA, 19 nt, Homo sapiens
cucaaaggcaucauuauaa

SEQ ID NO: 1139809 - RNA, 19 nt, Homo sapiens
gguaaucuggucaguaaga

SEQ ID NO: 1139810 - RNA, 19 nt, Homo sapiens
gagcggcugcaaugccuua

SEQ ID NO: 1139811 - RNA, 19 nt, Homo sapiens
gaaagggagccagaucaga

SEQ ID NO: 1139812 - RNA, 19 nt, Homo sapiens
gcaagauuguugugugacu

SEQ ID NO: 1139813 - RNA, 19 nt, Homo sapiens
gauuccaagugucauguug

SEQ ID NO: 1139814 - RNA, 19 nt, Homo sapiens
gaauuuggagauuugaguu

SEQ ID NO: 1139815 - RNA, 19 nt, Homo sapiens
cauguguccugugguuaua

SEQ ID NO: 1139816 - RNA, 19 nt, Homo sapiens
uaaauccuugccagacuua

SEQ ID NO: 1139817 - RNA, 19 nt, Homo sapiens
uggcaagauuguuguguga

SEQ ID NO: 1139818 - RNA, 19 nt, Homo sapiens
aaaugucuaucaucucuca

SEQ ID NO: 1139819 - RNA, 19 nt, Homo sapiens
aaaccuggccuacggaaga

SEQ ID NO: 1139820 - RNA, 19 nt, Homo sapiens
gacacgaggugaccaucug

SEQ ID NO: 1139821 - RNA, 19 nt, Homo sapiens
ccauagaggcgcuguguca

SEQ ID NO: 1139822 - RNA, 19 nt, Homo sapiens
gacacacuuuauuuccuaa

SEQ ID NO: 1139823 - RNA, 19 nt, Homo sapiens
gaccgaccgcuccaaguuu

SEQ ID NO: 1139824 - RNA, 19 nt, Homo sapiens
gcauggggaucauuucuau

SEQ ID NO: 1139825 - RNA, 19 nt, Homo sapiens
caagauuguugugugacuu

SEQ ID NO: 1139826 - RNA, 19 nt, Homo sapiens
gccaugugauuccaagugu

SEQ ID NO: 1139827 - RNA, 19 nt, Homo sapiens
agucugaaccgggaucuua

SEQ ID NO: 1139828 - RNA, 19 nt, Homo sapiens
uuccacagauguccuuuga

SEQ ID NO: 1139829 - RNA, 19 nt, Homo sapiens
gaugagacuguacaagaau

SEQ ID NO: 1139830 - RNA, 19 nt, Homo sapiens
aagcucaaaggcaucauua

SEQ ID NO: 1139831 - RNA, 19 nt, Homo sapiens
ccacugggaggguugugua

SEQ ID NO: 1139832 - RNA, 19 nt, Homo sapiens
guccuuugaugauacagaa

SEQ ID NO: 1139833 - RNA, 19 nt, Homo sapiens
caaguuuguugaaagugau

SEQ ID NO: 1139834 - RNA, 19 nt, Homo sapiens
ugccagaauuuggagauuu

SEQ ID NO: 1139835 - RNA, 19 nt, Homo sapiens
gagaggaugaugacucaca

SEQ ID NO: 1139836 - RNA, 19 nt, Homo sapiens
acacuugcuuuuccaguua

SEQ ID NO: 1139837 - RNA, 19 nt, Homo sapiens
gaccaucugcaauuacgaa

SEQ ID NO: 1139838 - RNA, 19 nt, Homo sapiens
ugucuaucaucucucaauu

SEQ ID NO: 1139839 - RNA, 19 nt, Homo sapiens
cugccaagcuuugucuuug

SEQ ID NO: 1139840 - RNA, 19 nt, Homo sapiens
ggagaauuagaguaugcua

SEQ ID NO: 1139841 - RNA, 19 nt, Homo sapiens
uacaggagaauuagaguau

SEQ ID NO: 1139842 - RNA, 19 nt, Homo sapiens
gaucuuacaggagaauuag

SEQ ID NO: 1139843 - RNA, 19 nt, Homo sapiens
aaagugaugcagaugaaga

SEQ ID NO: 1139844 - RNA, 19 nt, Homo sapiens
gauuugaguucuucuuuuc

SEQ ID NO: 1139845 - RNA, 19 nt, Homo sapiens
caguuaauguggccaugug

SEQ ID NO: 1139846 - RNA, 19 nt, Homo sapiens
gaggcgcugugucagugaa

SEQ ID NO: 1139847 - RNA, 19 nt, Homo sapiens
cagaaagggagccagauca

SEQ ID NO: 1139848 - RNA, 19 nt, Homo sapiens
gauguccuuugaugauaca

SEQ ID NO: 1139849 - RNA, 19 nt, Homo sapiens
auaaauccuugccagacuu

SEQ ID NO: 1139850 - RNA, 19 nt, Homo sapiens
caucuggcagucauggaua

SEQ ID NO: 1139851 - RNA, 19 nt, Homo sapiens
augagacuguacaagaaua

SEQ ID NO: 1139852 - RNA, 19 nt, Homo sapiens
caggagaauuagaguaugc

SEQ ID NO: 1139853 - RNA, 19 nt, Homo sapiens
gagccagaucagaccuuua

SEQ ID NO: 1139854 - RNA, 19 nt, Homo sapiens
acagauguccuuugaugau

SEQ ID NO: 1139855 - RNA, 19 nt, Homo sapiens
aagaauauuccacagaugu

SEQ ID NO: 1139856 - RNA, 19 nt, Homo sapiens
ggagauuugaguucuucuu

SEQ ID NO: 1139857 - RNA, 19 nt, Homo sapiens
agaauuagaguaugcuaca

SEQ ID NO: 1139858 - RNA, 19 nt, Homo sapiens
guaaguccgaugccagaau

SEQ ID NO: 1139859 - RNA, 19 nt, Homo sapiens
auuguugugugacuuguuu

SEQ ID NO: 1139860 - RNA, 19 nt, Homo sapiens
uuaauguggccaugugauu

SEQ ID NO: 1139861 - RNA, 19 nt, Homo sapiens
uuacaggagaauuagagua

SEQ ID NO: 1139862 - RNA, 19 nt, Homo sapiens
aauaaauccuugccagacu

SEQ ID NO: 1139863 - RNA, 19 nt, Homo sapiens
caagcucaaaggcaucauu

SEQ ID NO: 1139864 - RNA, 19 nt, Homo sapiens
gguggcaucuggcagucau

SEQ ID NO: 1139865 - RNA, 19 nt, Homo sapiens
aggugaccaucugcaauua

SEQ ID NO: 1139866 - RNA, 19 nt, Homo sapiens
gggaaggacaaagggauga

SEQ ID NO: 1139867 - RNA, 19 nt, Homo sapiens
uagcuucuaacuaguguug

SEQ ID NO: 1139868 - RNA, 19 nt, Homo sapiens
cggauuguguuaguaguag

SEQ ID NO: 1139869 - RNA, 19 nt, Homo sapiens
cacagccucugccaagcuu

SEQ ID NO: 1139870 - RNA, 19 nt, Homo sapiens
cacagacacacuuuauuuc

SEQ ID NO: 1139871 - RNA, 19 nt, Homo sapiens
gaaagaaugugaagaagug

SEQ ID NO: 1139872 - RNA, 19 nt, Homo sapiens
gagaagaugugcauugaaa

SEQ ID NO: 1139873 - RNA, 19 nt, Homo sapiens
ggagaugacugaagauuug

SEQ ID NO: 1139874 - RNA, 19 nt, Homo sapiens
ggagagaguugaagauuug

SEQ ID NO: 1139875 - RNA, 19 nt, Homo sapiens
gggcagagcugaaggaaga

SEQ ID NO: 1139876 - RNA, 19 nt, Homo sapiens
ugaaggagcuuucuuggaa

SEQ ID NO: 1139877 - RNA, 19 nt, Homo sapiens
gcucaaagauguugcuuau

SEQ ID NO: 1139878 - RNA, 19 nt, Homo sapiens
ccucugaccuggaccauua

SEQ ID NO: 1139879 - RNA, 19 nt, Homo sapiens
caacggaucuauucaagug

SEQ ID NO: 1139880 - RNA, 19 nt, Homo sapiens
gaauagguguucaaggaaa

SEQ ID NO: 1139881 - RNA, 19 nt, Homo sapiens
ucaggagacuugccaguua

SEQ ID NO: 1139882 - RNA, 19 nt, Homo sapiens
gaucucaucugaagaggaa

SEQ ID NO: 1139883 - RNA, 19 nt, Homo sapiens
gagguugacucgacuacua

SEQ ID NO: 1139884 - RNA, 19 nt, Homo sapiens
caaagaauccucugaacaa

SEQ ID NO: 1139885 - RNA, 19 nt, Homo sapiens
gaaagaauagaauggagua

SEQ ID NO: 1139886 - RNA, 19 nt, Homo sapiens
gaagugaugucugaugaga

SEQ ID NO: 1139887 - RNA, 19 nt, Homo sapiens
gaagaugugcauugaaauu

SEQ ID NO: 1139888 - RNA, 19 nt, Homo sapiens
gauuggagcugguggagaa

SEQ ID NO: 1139889 - RNA, 19 nt, Homo sapiens
ucaaagauguugcuuaugg

SEQ ID NO: 1139890 - RNA, 19 nt, Homo sapiens
uacuagaccucaagaauaa

SEQ ID NO: 1139891 - RNA, 19 nt, Homo sapiens
gaacucaacccaguccaua

SEQ ID NO: 1139892 - RNA, 19 nt, Homo sapiens
gaaaauugcugaaugacaa

SEQ ID NO: 1139893 - RNA, 19 nt, Homo sapiens
gagcuuccauuaaagagaa

SEQ ID NO: 1139894 - RNA, 19 nt, Homo sapiens
gaacagagaagcucauugg

SEQ ID NO: 1139895 - RNA, 19 nt, Homo sapiens
aagaauagguguucaagga

SEQ ID NO: 1139896 - RNA, 19 nt, Homo sapiens
gaaagaaagcccaggucua

SEQ ID NO: 1139897 - RNA, 19 nt, Homo sapiens
gaggugaaguagccaguaa

SEQ ID NO: 1139898 - RNA, 19 nt, Homo sapiens
acaaggagaugacugaaga

SEQ ID NO: 1139899 - RNA, 19 nt, Homo sapiens
ucaagcagcuggaagguau

SEQ ID NO: 1139900 - RNA, 19 nt, Homo sapiens
gcaacaggaugagaucaaa

SEQ ID NO: 1139901 - RNA, 19 nt, Homo sapiens
cuaaaugaguugcaaguau

SEQ ID NO: 1139902 - RNA, 19 nt, Homo sapiens
gaacgaaaauugcugaaug

SEQ ID NO: 1139903 - RNA, 19 nt, Homo sapiens
cuucauaggugauggcuuu

SEQ ID NO: 1139904 - RNA, 19 nt, Homo sapiens
gcuucgagcuuccauuaaa

SEQ ID NO: 1139905 - RNA, 19 nt, Homo sapiens
uaaaugaguugcaaguauc

SEQ ID NO: 1139906 - RNA, 19 nt, Homo sapiens
cagagaagaugugcauuga

SEQ ID NO: 1139907 - RNA, 19 nt, Homo sapiens
cauugaagcuggccaguau

SEQ ID NO: 1139908 - RNA, 19 nt, Homo sapiens
gcaagaaggcugugagcuu

SEQ ID NO: 1139909 - RNA, 19 nt, Homo sapiens
guacaaauucuacgaccua

SEQ ID NO: 1139910 - RNA, 19 nt, Homo sapiens
gcaccuauuccuucuauga

SEQ ID NO: 1139911 - RNA, 19 nt, Homo sapiens
cuacuagaccucaagaaua

SEQ ID NO: 1139912 - RNA, 19 nt, Homo sapiens
gaacuggaggcaaugauga

SEQ ID NO: 1139913 - RNA, 19 nt, Homo sapiens
aaaccuugcuccagaagaa

SEQ ID NO: 1139914 - RNA, 19 nt, Homo sapiens
guagagcugauucgacuua

SEQ ID NO: 1139915 - RNA, 19 nt, Homo sapiens
ucagaaggcugcagagcuu

SEQ ID NO: 1139916 - RNA, 19 nt, Homo sapiens
gaggauaaaguggauauuu

SEQ ID NO: 1139917 - RNA, 19 nt, Homo sapiens
caagagcuagacauuguua

SEQ ID NO: 1139918 - RNA, 19 nt, Homo sapiens
gagauauucuagagcaaga

SEQ ID NO: 1139919 - RNA, 19 nt, Homo sapiens
gcuagagacuguggagaaa

SEQ ID NO: 1139920 - RNA, 19 nt, Homo sapiens
ucgcgaagaucacauguug

SEQ ID NO: 1139921 - RNA, 19 nt, Homo sapiens
agaacgagcuguggauuga

SEQ ID NO: 1139922 - RNA, 19 nt, Homo sapiens
cauaggugauggcuuuaaa

SEQ ID NO: 1139923 - RNA, 19 nt, Homo sapiens
cugaacagcucaaagaugu

SEQ ID NO: 1139924 - RNA, 19 nt, Homo sapiens
gaucaaggacauuuaaagu

SEQ ID NO: 1139925 - RNA, 19 nt, Homo sapiens
gccaugaccuuccaacauc

SEQ ID NO: 1139926 - RNA, 19 nt, Homo sapiens
gacaaaagcugacaaugau

SEQ ID NO: 1139927 - RNA, 19 nt, Homo sapiens
ggaaguagagcuccuccaa

SEQ ID NO: 1139928 - RNA, 19 nt, Homo sapiens
gacaaacucuuagaaagca

SEQ ID NO: 1139929 - RNA, 19 nt, Homo sapiens
uaacagugcccacaucaug

SEQ ID NO: 1139930 - RNA, 19 nt, Homo sapiens
ucacccagcuguauugcaa

SEQ ID NO: 1139931 - RNA, 19 nt, Homo sapiens
gaaguagagcuccuccaaa

SEQ ID NO: 1139932 - RNA, 19 nt, Homo sapiens
gagcugauucgacuuaaga

SEQ ID NO: 1139933 - RNA, 19 nt, Homo sapiens
gacaguuucuuucgacuuc

SEQ ID NO: 1139934 - RNA, 19 nt, Homo sapiens
uaggaaggcugaagguuuc

SEQ ID NO: 1139935 - RNA, 19 nt, Homo sapiens
caguaucgaucuaagagaa

SEQ ID NO: 1139936 - RNA, 19 nt, Homo sapiens
caaggacaguucaaagauc

SEQ ID NO: 1139937 - RNA, 19 nt, Homo sapiens
ccauggagaugaggauaaa

SEQ ID NO: 1139938 - RNA, 19 nt, Homo sapiens
uaaggcagauucagagaag

SEQ ID NO: 1139939 - RNA, 19 nt, Homo sapiens
uggaguaucuuagccuuaa

SEQ ID NO: 1139940 - RNA, 19 nt, Homo sapiens
caggauggauuugcuuuga

SEQ ID NO: 1139941 - RNA, 19 nt, Homo sapiens
gagcaugcgacaaaugaaa

SEQ ID NO: 1139942 - RNA, 19 nt, Homo sapiens
gaaauauccuaaggcagau

SEQ ID NO: 1139943 - RNA, 19 nt, Homo sapiens
gauaauagagaucacaaag

SEQ ID NO: 1139944 - RNA, 19 nt, Homo sapiens
ggaggacaguuucuuucga

SEQ ID NO: 1139945 - RNA, 19 nt, Homo sapiens
ggaugaaccgggaggaauu

SEQ ID NO: 1139946 - RNA, 19 nt, Homo sapiens
uuaaggagcaugcgacaaa

SEQ ID NO: 1139947 - RNA, 19 nt, Homo sapiens
ucacugacccugcagagaa

SEQ ID NO: 1139948 - RNA, 19 nt, Homo sapiens
ggauggauuugcuuugaca

SEQ ID NO: 1139949 - RNA, 19 nt, Homo sapiens
caucugaacagcucaaaga

SEQ ID NO: 1139950 - RNA, 19 nt, Homo sapiens
gaaggaguuucaggagaga

SEQ ID NO: 1139951 - RNA, 19 nt, Homo sapiens
ugacaaagaauccucugaa

SEQ ID NO: 1139952 - RNA, 19 nt, Homo sapiens
ccugagagcuuccugaaac

SEQ ID NO: 1139953 - RNA, 19 nt, Homo sapiens
gaaacugucccaggugcua

SEQ ID NO: 1139954 - RNA, 19 nt, Homo sapiens
aaauguggccuaaagauga

SEQ ID NO: 1139955 - RNA, 19 nt, Homo sapiens
gagaaaauguggccuaaag

SEQ ID NO: 1139956 - RNA, 19 nt, Homo sapiens
uaucuuagccuuaacaucu

SEQ ID NO: 1139957 - RNA, 19 nt, Homo sapiens
ggagaaggagcaccagguu

SEQ ID NO: 1139958 - RNA, 19 nt, Homo sapiens
ucucucagcugcaggauca

SEQ ID NO: 1139959 - RNA, 19 nt, Homo sapiens
ugaagucagugaagcacaa

SEQ ID NO: 1139960 - RNA, 19 nt, Homo sapiens
agaauagaauggaguaucu

SEQ ID NO: 1139961 - RNA, 19 nt, Homo sapiens
ggccuugucuauacauguu

SEQ ID NO: 1139962 - RNA, 19 nt, Homo sapiens
ggaauuggaggacaguuuc

SEQ ID NO: 1139963 - RNA, 19 nt, Homo sapiens
ucagaagcauaaacaggaa

SEQ ID NO: 1139964 - RNA, 19 nt, Homo sapiens
ucaccaacauacuucagaa

SEQ ID NO: 1139965 - RNA, 19 nt, Homo sapiens
gguucuaacagcauaauuu

SEQ ID NO: 1139966 - RNA, 19 nt, Homo sapiens
gaaggcgguuucuguucga

SEQ ID NO: 1139967 - RNA, 19 nt, Homo sapiens
gacaaagaauccucugaac

SEQ ID NO: 1139968 - RNA, 19 nt, Homo sapiens
gagaaagaaaggagaagga

SEQ ID NO: 1139969 - RNA, 19 nt, Homo sapiens
ggagauacccaaccuacca

SEQ ID NO: 1139970 - RNA, 19 nt, Homo sapiens
ccagggacaugcuuauucu

SEQ ID NO: 1139971 - RNA, 19 nt, Homo sapiens
caaggaagcuuuauucuuu

SEQ ID NO: 1139972 - RNA, 19 nt, Homo sapiens
gaagcaaucugcauucaua

SEQ ID NO: 1139973 - RNA, 19 nt, Homo sapiens
ucacaaagcagaagaauua

SEQ ID NO: 1139974 - RNA, 19 nt, Homo sapiens
ggagcuaugugaauuuaua

SEQ ID NO: 1139975 - RNA, 19 nt, Homo sapiens
caaaugcuguuucauggua

SEQ ID NO: 1139976 - RNA, 19 nt, Homo sapiens
caagauagacuuugcagaa

SEQ ID NO: 1139977 - RNA, 19 nt, Homo sapiens
caaauucagcuacaagaua

SEQ ID NO: 1139978 - RNA, 19 nt, Homo sapiens
caaguaccauaucagcuua

SEQ ID NO: 1139979 - RNA, 19 nt, Homo sapiens
ugaaguugcuaaucucuuu

SEQ ID NO: 1139980 - RNA, 19 nt, Homo sapiens
aaaguggccuccauauaaa

SEQ ID NO: 1139981 - RNA, 19 nt, Homo sapiens
gggagaaugugaauacuca

SEQ ID NO: 1139982 - RNA, 19 nt, Homo sapiens
gauagacuuugcagaaaug

SEQ ID NO: 1139983 - RNA, 19 nt, Homo sapiens
gcagaaaugaagcaaauga

SEQ ID NO: 1139984 - RNA, 19 nt, Homo sapiens
gaaaugaagcaaaugaauc

SEQ ID NO: 1139985 - RNA, 19 nt, Homo sapiens
ggaaguggcacauguuuca

SEQ ID NO: 1139986 - RNA, 19 nt, Homo sapiens
ucagucaucuagccacuaa

SEQ ID NO: 1139987 - RNA, 19 nt, Homo sapiens
gcaaagaugacauaaagca

SEQ ID NO: 1139988 - RNA, 19 nt, Homo sapiens
ccagagauguuucacaaag

SEQ ID NO: 1139989 - RNA, 19 nt, Homo sapiens
ggaagcgaauccagagaug

SEQ ID NO: 1139990 - RNA, 19 nt, Homo sapiens
ccaaaucuauccugaguac

SEQ ID NO: 1139991 - RNA, 19 nt, Homo sapiens
cugcaaagaugacauaaag

SEQ ID NO: 1139992 - RNA, 19 nt, Homo sapiens
gacgggagcuaugugaauu

SEQ ID NO: 1139993 - RNA, 19 nt, Homo sapiens
gauuggagaauaaauggua

SEQ ID NO: 1139994 - RNA, 19 nt, Homo sapiens
ucaguuagcagugaagaua

SEQ ID NO: 1139995 - RNA, 19 nt, Homo sapiens
ggucaaggaagcuuuauuc

SEQ ID NO: 1139996 - RNA, 19 nt, Homo sapiens
gacauggacacgucagaua

SEQ ID NO: 1139997 - RNA, 19 nt, Homo sapiens
cgggagcuaugugaauuua

SEQ ID NO: 1139998 - RNA, 19 nt, Homo sapiens
gaacacauuccaaauucau

SEQ ID NO: 1139999 - RNA, 19 nt, Homo sapiens
aaauucagcuacaagauag

SEQ ID NO: 1140000 - RNA, 19 nt, Homo sapiens
aaaaguggccuccauauaa

SEQ ID NO: 1140001 - RNA, 19 nt, Homo sapiens
caugcgaccuccuuccaaa

SEQ ID NO: 1140002 - RNA, 19 nt, Homo sapiens
gaaccuauuuugcuagaga

SEQ ID NO: 1140003 - RNA, 19 nt, Homo sapiens
aagauagacuuugcagaaa

SEQ ID NO: 1140004 - RNA, 19 nt, Homo sapiens
cuagagaugcugcuuauuc

SEQ ID NO: 1140005 - RNA, 19 nt, Homo sapiens
uauacauggugcugucuuu

SEQ ID NO: 1140006 - RNA, 19 nt, Homo sapiens
caaucugcauucauaacuu

SEQ ID NO: 1140007 - RNA, 19 nt, Homo sapiens
uaucagugcuuucaguuac

SEQ ID NO: 1140008 - RNA, 19 nt, Homo sapiens
cuugauagacuuucauuga

SEQ ID NO: 1140009 - RNA, 19 nt, Homo sapiens
uaaagcaugggaacacauu

SEQ ID NO: 1140010 - RNA, 19 nt, Homo sapiens
gaucgcaaccgaauuaaaa

SEQ ID NO: 1140011 - RNA, 19 nt, Homo sapiens
acaaugaaguggaugacau

SEQ ID NO: 1140012 - RNA, 19 nt, Homo sapiens
ucaaggaagcuuuauucuu

SEQ ID NO: 1140013 - RNA, 19 nt, Homo sapiens
gcauucauaacuuugauug

SEQ ID NO: 1140014 - RNA, 19 nt, Homo sapiens
ucaaguaccauaucagcuu

SEQ ID NO: 1140015 - RNA, 19 nt, Homo sapiens
caaacaaugaaguggauga

SEQ ID NO: 1140016 - RNA, 19 nt, Homo sapiens
gguuugcucuucagucauc

SEQ ID NO: 1140017 - RNA, 19 nt, Homo sapiens
agauagacuuugcagaaau

SEQ ID NO: 1140018 - RNA, 19 nt, Homo sapiens
ucuagccacuaaauguuaa

SEQ ID NO: 1140019 - RNA, 19 nt, Homo sapiens
aaccaaaucuauccugagu

SEQ ID NO: 1140020 - RNA, 19 nt, Homo sapiens
gcuacaagauagacuuugc

SEQ ID NO: 1140021 - RNA, 19 nt, Homo sapiens
aaaggaaccuauuuugcua

SEQ ID NO: 1140022 - RNA, 19 nt, Homo sapiens
uaaugaaguugcuaaucuc

SEQ ID NO: 1140023 - RNA, 19 nt, Homo sapiens
ccaccacacugggagaaug

SEQ ID NO: 1140024 - RNA, 19 nt, Homo sapiens
aagguuugcucuucaguca

SEQ ID NO: 1140025 - RNA, 19 nt, Homo sapiens
gguggucaaggaagcuuua

SEQ ID NO: 1140026 - RNA, 19 nt, Homo sapiens
ucauugauuucacuuccaa

SEQ ID NO: 1140027 - RNA, 19 nt, Homo sapiens
cauaaagcaugggaacaca

SEQ ID NO: 1140028 - RNA, 19 nt, Homo sapiens
gcacaaucaaacacaugaa

SEQ ID NO: 1140029 - RNA, 19 nt, Homo sapiens
caucuagccacuaaauguu

SEQ ID NO: 1140030 - RNA, 19 nt, Homo sapiens
gcaaucugcauucauaacu

SEQ ID NO: 1140031 - RNA, 19 nt, Homo sapiens
gugaauuuguggaagcaau

SEQ ID NO: 1140032 - RNA, 19 nt, Homo sapiens
aaaucucgguggucaagga

SEQ ID NO: 1140033 - RNA, 19 nt, Homo sapiens
aaaucuauccugaguacuu

SEQ ID NO: 1140034 - RNA, 19 nt, Homo sapiens
ccaaagacgggagcuaugu

SEQ ID NO: 1140035 - RNA, 19 nt, Homo sapiens
uaccagcagugaauuugug

SEQ ID NO: 1140036 - RNA, 19 nt, Homo sapiens
ucagagaauucaaaaccua

SEQ ID NO: 1140037 - RNA, 19 nt, Homo sapiens
ggaucgcaaccgaauuaaa

SEQ ID NO: 1140038 - RNA, 19 nt, Homo sapiens
aaagacauacugacuccaa

SEQ ID NO: 1140039 - RNA, 19 nt, Homo sapiens
ugacagcuguguggaugau

SEQ ID NO: 1140040 - RNA, 19 nt, Homo sapiens
agagauguuucacaaagca

SEQ ID NO: 1140041 - RNA, 19 nt, Homo sapiens
uuauuccucugcacaauca

SEQ ID NO: 1140042 - RNA, 19 nt, Homo sapiens
aaacgaggccaucccuaug

SEQ ID NO: 1140043 - RNA, 19 nt, Homo sapiens
cagaaaugaagcaaaugaa

SEQ ID NO: 1140044 - RNA, 19 nt, Homo sapiens
caaugaaguggaugacaug

SEQ ID NO: 1140045 - RNA, 19 nt, Homo sapiens
ccuuguggcuccauuucuu

SEQ ID NO: 1140046 - RNA, 19 nt, Homo sapiens
ucaucuagccacuaaaugu

SEQ ID NO: 1140047 - RNA, 19 nt, Homo sapiens
aaucuauccugaguacuug

SEQ ID NO: 1140048 - RNA, 19 nt, Homo sapiens
auccagagauguuucacaa

SEQ ID NO: 1140049 - RNA, 19 nt, Homo sapiens
aacaaacaaugaaguggau

SEQ ID NO: 1140050 - RNA, 19 nt, Homo sapiens
aaagacgggagcuauguga

SEQ ID NO: 1140051 - RNA, 19 nt, Homo sapiens
gaaguugcuaaucucuuug

SEQ ID NO: 1140052 - RNA, 19 nt, Homo sapiens
aagacauacugacuccaaa

SEQ ID NO: 1140053 - RNA, 19 nt, Homo sapiens
gggaagcgaauccagagau

SEQ ID NO: 1140054 - RNA, 19 nt, Homo sapiens
ugcuagagaugcugcuuau

SEQ ID NO: 1140055 - RNA, 19 nt, Homo sapiens
auggaucgcaaccgaauua

SEQ ID NO: 1140056 - RNA, 19 nt, Homo sapiens
ggaagcaaucugcauucau

SEQ ID NO: 1140057 - RNA, 19 nt, Homo sapiens
ugccucagauuaaugaaca

SEQ ID NO: 1140058 - RNA, 19 nt, Homo sapiens
ggaguucuuuugcaggaaa

SEQ ID NO: 1140059 - RNA, 19 nt, Homo sapiens
cuaucagugcuuucaguua

SEQ ID NO: 1140060 - RNA, 19 nt, Homo sapiens
cagcuacaagauagacuuu

SEQ ID NO: 1140061 - RNA, 19 nt, Homo sapiens
gcagugaagauaucgaaaa

SEQ ID NO: 1140062 - RNA, 19 nt, Homo sapiens
aagcgaauccagagauguu

SEQ ID NO: 1140063 - RNA, 19 nt, Homo sapiens
cugaguacuugauagacuu

SEQ ID NO: 1140064 - RNA, 19 nt, Homo sapiens
agucguuucugcaaagaug

SEQ ID NO: 1140065 - RNA, 19 nt, Homo sapiens
acauggugcugucuuugga

SEQ ID NO: 1140066 - RNA, 19 nt, Homo sapiens
cagcagugaauuuguggaa

SEQ ID NO: 1140067 - RNA, 19 nt, Homo sapiens
gguaccagcagugaauuug

SEQ ID NO: 1140068 - RNA, 19 nt, Homo sapiens
caugguaccagcagugaau

SEQ ID NO: 1140069 - RNA, 19 nt, Homo sapiens
gcuuauuccucugcacaau

SEQ ID NO: 1140070 - RNA, 19 nt, Homo sapiens
gagaaugugaauacucaag

SEQ ID NO: 1140071 - RNA, 19 nt, Homo sapiens
gagaauagaugcaaacaag

SEQ ID NO: 1140072 - RNA, 19 nt, Homo sapiens
gaacuagaucuguugcuua

SEQ ID NO: 1140073 - RNA, 19 nt, Homo sapiens
gaacagggaaauuauucua

SEQ ID NO: 1140074 - RNA, 19 nt, Homo sapiens
gcaaacaaggcaugcauuu

SEQ ID NO: 1140075 - RNA, 19 nt, Homo sapiens
cuagaucuguugcuuaauu

SEQ ID NO: 1140076 - RNA, 19 nt, Homo sapiens
gaaagauugucucuaacug

SEQ ID NO: 1140077 - RNA, 19 nt, Homo sapiens
uaacugggaucgauaucaa

SEQ ID NO: 1140078 - RNA, 19 nt, Homo sapiens
aagcuaguguguuccauua

SEQ ID NO: 1140079 - RNA, 19 nt, Homo sapiens
gaaagaaugggauagugaa

SEQ ID NO: 1140080 - RNA, 19 nt, Homo sapiens
gaaagaauacauugaagca

SEQ ID NO: 1140081 - RNA, 19 nt, Homo sapiens
gauagacucuggcccuugu

SEQ ID NO: 1140082 - RNA, 19 nt, Homo sapiens
caacguugcugccgaacug

SEQ ID NO: 1140083 - RNA, 19 nt, Homo sapiens
gagaaagaaugggauagug

SEQ ID NO: 1140084 - RNA, 19 nt, Homo sapiens
gagaagagaaugaugaaca

SEQ ID NO: 1140085 - RNA, 19 nt, Homo sapiens
gaaccugagcaaccaagua

SEQ ID NO: 1140086 - RNA, 19 nt, Homo sapiens
gcuaguguguuccauuaug

SEQ ID NO: 1140087 - RNA, 19 nt, Homo sapiens
gcagagaccuauggagaag

SEQ ID NO: 1140088 - RNA, 19 nt, Homo sapiens
aagaagaacuagaucuguu

SEQ ID NO: 1140089 - RNA, 19 nt, Homo sapiens
uaaugaaaguggagaguca

SEQ ID NO: 1140090 - RNA, 19 nt, Homo sapiens
aaucuugguugccuucuaa

SEQ ID NO: 1140091 - RNA, 19 nt, Homo sapiens
gcaaccaaguaccuccaaa

SEQ ID NO: 1140092 - RNA, 19 nt, Homo sapiens
uuauguggauagugaguua

SEQ ID NO: 1140093 - RNA, 19 nt, Homo sapiens
gaaaguggagagucacaga

SEQ ID NO: 1140094 - RNA, 19 nt, Homo sapiens
ggaagaagaacuagaucug

SEQ ID NO: 1140095 - RNA, 19 nt, Homo sapiens
acaagcaugucucaagcua

SEQ ID NO: 1140096 - RNA, 19 nt, Homo sapiens
aacuagaucuguugcuuaa

SEQ ID NO: 1140097 - RNA, 19 nt, Homo sapiens
gaagaagaacuagaucugu

SEQ ID NO: 1140098 - RNA, 19 nt, Homo sapiens
gaggagaaagaaugggaua

SEQ ID NO: 1140099 - RNA, 19 nt, Homo sapiens
gaugaacagggaaauuauu

SEQ ID NO: 1140100 - RNA, 19 nt, Homo sapiens
gagaccauuuggaagaaga

SEQ ID NO: 1140101 - RNA, 19 nt, Homo sapiens
ucuuugagcugaaaucugu

SEQ ID NO: 1140102 - RNA, 19 nt, Homo sapiens
aaacaaggcaugcauuugg

SEQ ID NO: 1140103 - RNA, 19 nt, Homo sapiens
ggacagcaugauuuccuaa

SEQ ID NO: 1140104 - RNA, 19 nt, Homo sapiens
ccaaagagaacugaugaug

SEQ ID NO: 1140105 - RNA, 19 nt, Homo sapiens
gcagcuuguugcauuuguu

SEQ ID NO: 1140106 - RNA, 19 nt, Homo sapiens
ggacucauucucacaguuc

SEQ ID NO: 1140107 - RNA, 19 nt, Homo sapiens
cagaugcugcugcugguua

SEQ ID NO: 1140108 - RNA, 19 nt, Homo sapiens
gguccaagaggaagaaguu

SEQ ID NO: 1140109 - RNA, 19 nt, Homo sapiens
caggagaccauuuggaaga

SEQ ID NO: 1140110 - RNA, 19 nt, Homo sapiens
ggagaaagaaugggauagu

SEQ ID NO: 1140111 - RNA, 19 nt, Homo sapiens
ggaggugguccaagaggaa

SEQ ID NO: 1140112 - RNA, 19 nt, Homo sapiens
agaaagaaugggauaguga

SEQ ID NO: 1140113 - RNA, 19 nt, Homo sapiens
aagcaugucucaagcuagu

SEQ ID NO: 1140114 - RNA, 19 nt, Homo sapiens
aaacauggaaccugagcaa

SEQ ID NO: 1140115 - RNA, 19 nt, Homo sapiens
agaacuagaucuguugcuu

SEQ ID NO: 1140116 - RNA, 19 nt, Homo sapiens
ggauagugaguuauugguu

SEQ ID NO: 1140117 - RNA, 19 nt, Homo sapiens
gauuucaguguccuccuua

SEQ ID NO: 1140118 - RNA, 19 nt, Homo sapiens
ccaagaggaagaaguuugu

SEQ ID NO: 1140119 - RNA, 19 nt, Homo sapiens
ccaggguacaguuccuuua

SEQ ID NO: 1140120 - RNA, 19 nt, Homo sapiens
cuaauagauuuccuuaagg

SEQ ID NO: 1140121 - RNA, 19 nt, Homo sapiens
caucugaaagaauacauug

SEQ ID NO: 1140122 - RNA, 19 nt, Homo sapiens
aaccaucugugacugaaga

SEQ ID NO: 1140123 - RNA, 19 nt, Homo sapiens
gaucuguugcuuaauuuag

SEQ ID NO: 1140124 - RNA, 19 nt, Homo sapiens
ccauuuggaagaagaacua

SEQ ID NO: 1140125 - RNA, 19 nt, Homo sapiens
gcccaucuuugagcugaaa

SEQ ID NO: 1140126 - RNA, 19 nt, Homo sapiens
aaaagugccugaagcaaau

SEQ ID NO: 1140127 - RNA, 19 nt, Homo sapiens
ggaccugaaauccaaggaa

SEQ ID NO: 1140128 - RNA, 19 nt, Homo sapiens
uacaguuccuuuagagguu

SEQ ID NO: 1140129 - RNA, 19 nt, Homo sapiens
gggacucauucucacaguu

SEQ ID NO: 1140130 - RNA, 19 nt, Homo sapiens
caggugaaaccaaagagaa

SEQ ID NO: 1140131 - RNA, 19 nt, Homo sapiens
ggguacaguuccuuuagag

SEQ ID NO: 1140132 - RNA, 19 nt, Homo sapiens
caagcuaguguguuccauu

SEQ ID NO: 1140133 - RNA, 19 nt, Homo sapiens
agaagagaaugaugaacag

SEQ ID NO: 1140134 - RNA, 19 nt, Homo sapiens
augaugaacagggaaauua

SEQ ID NO: 1140135 - RNA, 19 nt, Homo sapiens
gcagucagcaggagaccau

SEQ ID NO: 1140136 - RNA, 19 nt, Homo sapiens
caaaacagaauucagcauu

SEQ ID NO: 1140137 - RNA, 19 nt, Homo sapiens
caaaugcuggucuguccaa

SEQ ID NO: 1140138 - RNA, 19 nt, Homo sapiens
gcugcugguuaagagaaua

SEQ ID NO: 1140139 - RNA, 19 nt, Homo sapiens
ggaccagccaguuuacaag

SEQ ID NO: 1140140 - RNA, 19 nt, Homo sapiens
gaggaagaaguuugugcaa

SEQ ID NO: 1140141 - RNA, 19 nt, Homo sapiens
guuaagagaauagaugcaa

SEQ ID NO: 1140142 - RNA, 19 nt, Homo sapiens
agaugcugcugcugguuaa

SEQ ID NO: 1140143 - RNA, 19 nt, Homo sapiens
agaggucaauaaugaaagu

SEQ ID NO: 1140144 - RNA, 19 nt, Homo sapiens
cagcuuguugcauuuguuu

SEQ ID NO: 1140145 - RNA, 19 nt, Homo sapiens
aaaucuugguugccuucua

SEQ ID NO: 1140146 - RNA, 19 nt, Homo sapiens
gacagcaugauuuccuaaa

SEQ ID NO: 1140147 - RNA, 19 nt, Homo sapiens
uaccagaucagacgucuca

SEQ ID NO: 1140148 - RNA, 19 nt, Homo sapiens
agaagaacuagaucuguug

SEQ ID NO: 1140149 - RNA, 19 nt, Homo sapiens
aaaccaaagagaacugaug

SEQ ID NO: 1140150 - RNA, 19 nt, Homo sapiens
uggacagcaugauuuccua

SEQ ID NO: 1140151 - RNA, 19 nt, Homo sapiens
gaugacagcgaugcagaga

SEQ ID NO: 1140152 - RNA, 19 nt, Homo sapiens
ggagaccauuuggaagaag

SEQ ID NO: 1140153 - RNA, 19 nt, Homo sapiens
ccgguuugcugaggagaaa

SEQ ID NO: 1140154 - RNA, 19 nt, Homo sapiens
cuuaagggcaggagauaga

SEQ ID NO: 1140155 - RNA, 19 nt, Homo sapiens
cuucaggaccagccaguuu

SEQ ID NO: 1140156 - RNA, 19 nt, Homo sapiens
uaacggcaggugggcauaa

SEQ ID NO: 1140157 - RNA, 19 nt, Homo sapiens
cauggaaccugagcaacca

SEQ ID NO: 1140158 - RNA, 19 nt, Homo sapiens
aaccaaagagaacugauga

SEQ ID NO: 1140159 - RNA, 19 nt, Homo sapiens
agaaugggauagugaagcu

SEQ ID NO: 1140160 - RNA, 19 nt, Homo sapiens
agccaguguuuacagcaua

SEQ ID NO: 1140161 - RNA, 19 nt, Homo sapiens
uguuugacaucugaaagaa

SEQ ID NO: 1140162 - RNA, 19 nt, Homo sapiens
ucacagaggggaacagauu

SEQ ID NO: 1140163 - RNA, 19 nt, Homo sapiens
ugaugaacagggaaauuau

SEQ ID NO: 1140164 - RNA, 19 nt, Homo sapiens
gaugauggcaagggauuag

SEQ ID NO: 1140165 - RNA, 19 nt, Homo sapiens
cauuuuauguggauaguga

SEQ ID NO: 1140166 - RNA, 19 nt, Homo sapiens
gaauucagcauuuuaugug

SEQ ID NO: 1140167 - RNA, 19 nt, Homo sapiens
cugaaagaauacauugaag

SEQ ID NO: 1140168 - RNA, 19 nt, Homo sapiens
gucucaagcuaguguguuc

SEQ ID NO: 1140169 - RNA, 19 nt, Homo sapiens
agagaccuauggagaagag

SEQ ID NO: 1140170 - RNA, 19 nt, Homo sapiens
gcaugucucaagcuagugu

SEQ ID NO: 1140171 - RNA, 19 nt, Homo sapiens
gaacuuugccuccaucuua

SEQ ID NO: 1140172 - RNA, 19 nt, Homo sapiens
gaaagagccugacagaaug

SEQ ID NO: 1140173 - RNA, 19 nt, Homo sapiens
gagaaggacuuggagaaua

SEQ ID NO: 1140174 - RNA, 19 nt, Homo sapiens
gaaagagaagagcuuauua

SEQ ID NO: 1140175 - RNA, 19 nt, Homo sapiens
gaagagaaaugaugcuaca

SEQ ID NO: 1140176 - RNA, 19 nt, Homo sapiens
gcuauggaguguucuauaa

SEQ ID NO: 1140177 - RNA, 19 nt, Homo sapiens
gaaaugaucauccaguuug

SEQ ID NO: 1140178 - RNA, 19 nt, Homo sapiens
gaagcuacgucuauguauu

SEQ ID NO: 1140179 - RNA, 19 nt, Homo sapiens
ggaccugacuggcauagaa

SEQ ID NO: 1140180 - RNA, 19 nt, Homo sapiens
gggagaagauguaccugua

SEQ ID NO: 1140181 - RNA, 19 nt, Homo sapiens
acaggaagcugcuauauca

SEQ ID NO: 1140182 - RNA, 19 nt, Homo sapiens
gaacacagcaacaacaaga

SEQ ID NO: 1140183 - RNA, 19 nt, Homo sapiens
ggaagcaguugauccagaa

SEQ ID NO: 1140184 - RNA, 19 nt, Homo sapiens
cagccuaccuuaucaauau

SEQ ID NO: 1140185 - RNA, 19 nt, Homo sapiens
agaaggacuuggagaauaa

SEQ ID NO: 1140186 - RNA, 19 nt, Homo sapiens
guucaguucugcagguuua

SEQ ID NO: 1140187 - RNA, 19 nt, Homo sapiens
caacagcagucaucaucaa

SEQ ID NO: 1140188 - RNA, 19 nt, Homo sapiens
gcagaugcaaauuaaguua

SEQ ID NO: 1140189 - RNA, 19 nt, Homo sapiens
ucagaaacuucaagcuuaa

SEQ ID NO: 1140190 - RNA, 19 nt, Homo sapiens
gaaacugacucugcccauu

SEQ ID NO: 1140191 - RNA, 19 nt, Homo sapiens
aaagugggaucuaucauga

SEQ ID NO: 1140192 - RNA, 19 nt, Homo sapiens
agaaagagauguacgagau

SEQ ID NO: 1140193 - RNA, 19 nt, Homo sapiens
caaaguuccuaccaagaaa

SEQ ID NO: 1140194 - RNA, 19 nt, Homo sapiens
gcagauaaccaucauuuua

SEQ ID NO: 1140195 - RNA, 19 nt, Homo sapiens
gaccgaagcuggagaaacu

SEQ ID NO: 1140196 - RNA, 19 nt, Homo sapiens
caucccaucuucuguaauu

SEQ ID NO: 1140197 - RNA, 19 nt, Homo sapiens
gcgaucaccuccgacuuua

SEQ ID NO: 1140198 - RNA, 19 nt, Homo sapiens
gcagggcgguuccaacaga

SEQ ID NO: 1140199 - RNA, 19 nt, Homo sapiens
ggaagcugcuauaucaaga

SEQ ID NO: 1140200 - RNA, 19 nt, Homo sapiens
gaaggucgacuauguacuu

SEQ ID NO: 1140201 - RNA, 19 nt, Homo sapiens
cucagaaacuucaagcuua

SEQ ID NO: 1140202 - RNA, 19 nt, Homo sapiens
cagaaugccuucaccaugu

SEQ ID NO: 1140203 - RNA, 19 nt, Homo sapiens
gggauuauauacaucauuc

SEQ ID NO: 1140204 - RNA, 19 nt, Homo sapiens
agaaagagccugacagaau

SEQ ID NO: 1140205 - RNA, 19 nt, Homo sapiens
aagauaaacugaccuggaa

SEQ ID NO: 1140206 - RNA, 19 nt, Homo sapiens
cuauugaccucaucagaaa

SEQ ID NO: 1140207 - RNA, 19 nt, Homo sapiens
gacuggagcuugagaagga

SEQ ID NO: 1140208 - RNA, 19 nt, Homo sapiens
ggaaaugaucauccaguuu

SEQ ID NO: 1140209 - RNA, 19 nt, Homo sapiens
gcgaccagaucaagaaaga

SEQ ID NO: 1140210 - RNA, 19 nt, Homo sapiens
gcuguaagaaccaaagaua

SEQ ID NO: 1140211 - RNA, 19 nt, Homo sapiens
gugcaacaauugaagaaga

SEQ ID NO: 1140212 - RNA, 19 nt, Homo sapiens
gagugauuguguuucuuua

SEQ ID NO: 1140213 - RNA, 19 nt, Homo sapiens
agaggaaggucgacuaugu

SEQ ID NO: 1140214 - RNA, 19 nt, Homo sapiens
ccaaugagccuguguccuu

SEQ ID NO: 1140215 - RNA, 19 nt, Homo sapiens
ggaaggaagagaaaugaug

SEQ ID NO: 1140216 - RNA, 19 nt, Homo sapiens
caagaaagagaagagcuua

SEQ ID NO: 1140217 - RNA, 19 nt, Homo sapiens
ggagugauuguguuucuuu

SEQ ID NO: 1140218 - RNA, 19 nt, Homo sapiens
caccaucauuucugacuuu

SEQ ID NO: 1140219 - RNA, 19 nt, Homo sapiens
uucgaaagcugaaagauga

SEQ ID NO: 1140220 - RNA, 19 nt, Homo sapiens
aaccaaaguucgagagaaa

SEQ ID NO: 1140221 - RNA, 19 nt, Homo sapiens
gcucugucaucaacaacua

SEQ ID NO: 1140222 - RNA, 19 nt, Homo sapiens
cagcaacgcuuuugucauu

SEQ ID NO: 1140223 - RNA, 19 nt, Homo sapiens
ugaggaugaugaagauaaa

SEQ ID NO: 1140224 - RNA, 19 nt, Homo sapiens
gcagcucugucaucaacaa

SEQ ID NO: 1140225 - RNA, 19 nt, Homo sapiens
ugaaagaggagcaugagaa

SEQ ID NO: 1140226 - RNA, 19 nt, Homo sapiens
cccgaacccuuaugaguuu

SEQ ID NO: 1140227 - RNA, 19 nt, Homo sapiens
gaggaaggucgacuaugua

SEQ ID NO: 1140228 - RNA, 19 nt, Homo sapiens
gaaagaggagcaugagaag

SEQ ID NO: 1140229 - RNA, 19 nt, Homo sapiens
agaagaacgugcccaggaa

SEQ ID NO: 1140230 - RNA, 19 nt, Homo sapiens
cauagaagaggaagaagaa

SEQ ID NO: 1140231 - RNA, 19 nt, Homo sapiens
caaccacacccucuccuuu

SEQ ID NO: 1140232 - RNA, 19 nt, Homo sapiens
gaacgugcccaggaacauu

SEQ ID NO: 1140233 - RNA, 19 nt, Homo sapiens
gugauuguguuucuuuaug

SEQ ID NO: 1140234 - RNA, 19 nt, Homo sapiens
gaggcagcauugcaaagaa

SEQ ID NO: 1140235 - RNA, 19 nt, Homo sapiens
ucaaaguuccuaccaagaa

SEQ ID NO: 1140236 - RNA, 19 nt, Homo sapiens
ggaggaauuugagcacaau

SEQ ID NO: 1140237 - RNA, 19 nt, Homo sapiens
ggagcuaaaugcagauaac

SEQ ID NO: 1140238 - RNA, 19 nt, Homo sapiens
ccaaguggcucaccaaaau

SEQ ID NO: 1140239 - RNA, 19 nt, Homo sapiens
gagagaaaaugcuaaagga

SEQ ID NO: 1140240 - RNA, 19 nt, Homo sapiens
ucucugaucgcaaacaaua

SEQ ID NO: 1140241 - RNA, 19 nt, Homo sapiens
gggaggaauuugagcacaa

SEQ ID NO: 1140242 - RNA, 19 nt, Homo sapiens
ucucagcagaugcaaauua

SEQ ID NO: 1140243 - RNA, 19 nt, Homo sapiens
aaagaaagagccugacaga

SEQ ID NO: 1140244 - RNA, 19 nt, Homo sapiens
ggacaucagcgaccagauc

SEQ ID NO: 1140245 - RNA, 19 nt, Homo sapiens
gaaccaaagauaucggaau

SEQ ID NO: 1140246 - RNA, 19 nt, Homo sapiens
gcauagaagaggaagaaga

SEQ ID NO: 1140247 - RNA, 19 nt, Homo sapiens
ucuauaaguuccaaccuau

SEQ ID NO: 1140248 - RNA, 19 nt, Homo sapiens
acaacacgauggguauuaa

SEQ ID NO: 1140249 - RNA, 19 nt, Homo sapiens
gaccagaucaagaaagaga

SEQ ID NO: 1140250 - RNA, 19 nt, Homo sapiens
caacaacgucauugaagug

SEQ ID NO: 1140251 - RNA, 19 nt, Homo sapiens
cgaugaggaugaugaagau

SEQ ID NO: 1140252 - RNA, 19 nt, Homo sapiens
gaaaccaaaguucgagaga

SEQ ID NO: 1140253 - RNA, 19 nt, Homo sapiens
uuaacucucugaucgcaaa

SEQ ID NO: 1140254 - RNA, 19 nt, Homo sapiens
gaauuugagcacaaucuga

SEQ ID NO: 1140255 - RNA, 19 nt, Homo sapiens
ugaccagccuaccuuauca

SEQ ID NO: 1140256 - RNA, 19 nt, Homo sapiens
cucagcagaugcaaauuaa

SEQ ID NO: 1140257 - RNA, 19 nt, Homo sapiens
cagcagcucugucaucaac

SEQ ID NO: 1140258 - RNA, 19 nt, Homo sapiens
gcucucagcacaccaaugu

SEQ ID NO: 1140259 - RNA, 19 nt, Homo sapiens
ucauggagcucugcauuca

SEQ ID NO: 1140260 - RNA, 19 nt, Homo sapiens
gcgaugaggaugaugaaga

SEQ ID NO: 1140261 - RNA, 19 nt, Homo sapiens
gaacauuccaggccugagu

SEQ ID NO: 1140262 - RNA, 19 nt, Homo sapiens
gauauucccagcagagaga

SEQ ID NO: 1140263 - RNA, 19 nt, Homo sapiens
uuauggaugugcaacaauu

SEQ ID NO: 1140264 - RNA, 19 nt, Homo sapiens
guaauuggagugauugugu

SEQ ID NO: 1140265 - RNA, 19 nt, Homo sapiens
gcugcuauaucaagaaugg

SEQ ID NO: 1140266 - RNA, 19 nt, Homo sapiens
cagaggacgauaugaauga

SEQ ID NO: 1140267 - RNA, 19 nt, Homo sapiens
ggaggcagcauugcaaaga

SEQ ID NO: 1140268 - RNA, 19 nt, Homo sapiens
cagagaggcagaauucuug

SEQ ID NO: 1140269 - RNA, 19 nt, Homo sapiens
ggcaaguucucuguuauca

SEQ ID NO: 1140270 - RNA, 19 nt, Homo sapiens
cagaacaacaucuuugaga

SEQ ID NO: 1140271 - RNA, 19 nt, Homo sapiens
gcagagugcuuuccuauaa

SEQ ID NO: 1140272 - RNA, 19 nt, Homo sapiens
gaaauccugucaaagaaua

SEQ ID NO: 1140273 - RNA, 19 nt, Homo sapiens
gaaaucaggugaaguagau

SEQ ID NO: 1140274 - RNA, 19 nt, Homo sapiens
gagaggaacuauuuaaaug

SEQ ID NO: 1140275 - RNA, 19 nt, Homo sapiens
ggaaagguuuguccaggua

SEQ ID NO: 1140276 - RNA, 19 nt, Homo sapiens
gaaacucucuuaaauuugg

SEQ ID NO: 1140277 - RNA, 19 nt, Homo sapiens
gaagagcaauuagaaguug

SEQ ID NO: 1140278 - RNA, 19 nt, Homo sapiens
gcaauaguuucaucaauuc

SEQ ID NO: 1140279 - RNA, 19 nt, Homo sapiens
ugaagaccaugcauaauuu

SEQ ID NO: 1140280 - RNA, 19 nt, Homo sapiens
gaaaauaaauggucgaaug

SEQ ID NO: 1140281 - RNA, 19 nt, Homo sapiens
guacaugggccaaagcuua

SEQ ID NO: 1140282 - RNA, 19 nt, Homo sapiens
ggcagaagaugauuguuaa

SEQ ID NO: 1140283 - RNA, 19 nt, Homo sapiens
guagaaauccugucaaaga

SEQ ID NO: 1140284 - RNA, 19 nt, Homo sapiens
gcacuaaacccuuauagau

SEQ ID NO: 1140285 - RNA, 19 nt, Homo sapiens
ggaagaucauuucuacauu

SEQ ID NO: 1140286 - RNA, 19 nt, Homo sapiens
caggugcaauccuuaauua

SEQ ID NO: 1140287 - RNA, 19 nt, Homo sapiens
gaaagauucugcaauagag

SEQ ID NO: 1140288 - RNA, 19 nt, Homo sapiens
gaaaaucacugacagauca

SEQ ID NO: 1140289 - RNA, 19 nt, Homo sapiens
gagacaagguauugaaaug

SEQ ID NO: 1140290 - RNA, 19 nt, Homo sapiens
gcacugaaauggugggaau

SEQ ID NO: 1140291 - RNA, 19 nt, Homo sapiens
caaguuauguggauauugu

SEQ ID NO: 1140292 - RNA, 19 nt, Homo sapiens
caaggaagaucauuucuac

SEQ ID NO: 1140293 - RNA, 19 nt, Homo sapiens
ucacugagacugauucuaa

SEQ ID NO: 1140294 - RNA, 19 nt, Homo sapiens
gaauggaggagcaaaguuu

SEQ ID NO: 1140295 - RNA, 19 nt, Homo sapiens
gaagaaaguuuuaccauuc

SEQ ID NO: 1140296 - RNA, 19 nt, Homo sapiens
ggaagaaucauguuuaugg

SEQ ID NO: 1140297 - RNA, 19 nt, Homo sapiens
uuaaagcacuucaugaaug

SEQ ID NO: 1140298 - RNA, 19 nt, Homo sapiens
ggaguaaauugaaagaauc

SEQ ID NO: 1140299 - RNA, 19 nt, Homo sapiens
gaccaagaauuaugagaug

SEQ ID NO: 1140300 - RNA, 19 nt, Homo sapiens
gaagaugauuguuaaacuc

SEQ ID NO: 1140301 - RNA, 19 nt, Homo sapiens
caauagagagagagaauuu

SEQ ID NO: 1140302 - RNA, 19 nt, Homo sapiens
ugucaaagguuucaugaug

SEQ ID NO: 1140303 - RNA, 19 nt, Homo sapiens
gaacagagaaaguuagaag

SEQ ID NO: 1140304 - RNA, 19 nt, Homo sapiens
gaucagugcagcccagaua

SEQ ID NO: 1140305 - RNA, 19 nt, Homo sapiens
ggaaaggaaacuugauuau

SEQ ID NO: 1140306 - RNA, 19 nt, Homo sapiens
gggaaaggaaacuugauua

SEQ ID NO: 1140307 - RNA, 19 nt, Homo sapiens
uagaaauccugucaaagaa

SEQ ID NO: 1140308 - RNA, 19 nt, Homo sapiens
ucaagugugucaaagguuu

SEQ ID NO: 1140309 - RNA, 19 nt, Homo sapiens
gcaauuagaaguuguccaa

SEQ ID NO: 1140310 - RNA, 19 nt, Homo sapiens
cuuauaaacugguggcuuu

SEQ ID NO: 1140311 - RNA, 19 nt, Homo sapiens
gagggcauuuggugucaua

SEQ ID NO: 1140312 - RNA, 19 nt, Homo sapiens
gcgcaggaguaaauugaaa

SEQ ID NO: 1140313 - RNA, 19 nt, Homo sapiens
gcacugaaauauacauugc

SEQ ID NO: 1140314 - RNA, 19 nt, Homo sapiens
caagauacaugugugugaa

SEQ ID NO: 1140315 - RNA, 19 nt, Homo sapiens
acuaaacccuuauagauug

SEQ ID NO: 1140316 - RNA, 19 nt, Homo sapiens
gaagaaucauguuuauggu

SEQ ID NO: 1140317 - RNA, 19 nt, Homo sapiens
uaaauucuccuguuucaga

SEQ ID NO: 1140318 - RNA, 19 nt, Homo sapiens
ccacucaaauuuccuguuc

SEQ ID NO: 1140319 - RNA, 19 nt, Homo sapiens
ggacuucuguaagcauaaa

SEQ ID NO: 1140320 - RNA, 19 nt, Homo sapiens
gacaagguauugaaaugga

SEQ ID NO: 1140321 - RNA, 19 nt, Homo sapiens
caaauuuccuguucaagag

SEQ ID NO: 1140322 - RNA, 19 nt, Homo sapiens
ugacucaguuuauagaaga

SEQ ID NO: 1140323 - RNA, 19 nt, Homo sapiens
uaacaacacuaaagacaac

SEQ ID NO: 1140324 - RNA, 19 nt, Homo sapiens
caugacaucacaacaauaa

SEQ ID NO: 1140325 - RNA, 19 nt, Homo sapiens
uccaacaggugguacuuua

SEQ ID NO: 1140326 - RNA, 19 nt, Homo sapiens
cagagaaaguuagaagaaa

SEQ ID NO: 1140327 - RNA, 19 nt, Homo sapiens
aaagagauguggagcugaa

SEQ ID NO: 1140328 - RNA, 19 nt, Homo sapiens
ccucagcgauuaugauaga

SEQ ID NO: 1140329 - RNA, 19 nt, Homo sapiens
uaacuggccacaagaauga

SEQ ID NO: 1140330 - RNA, 19 nt, Homo sapiens
caaaugugcuuguucuuuu

SEQ ID NO: 1140331 - RNA, 19 nt, Homo sapiens
uaucacacauggacacuug

SEQ ID NO: 1140332 - RNA, 19 nt, Homo sapiens
gcaauuggaaggauuuaug

SEQ ID NO: 1140333 - RNA, 19 nt, Homo sapiens
cagaagacguuuuagauuu

SEQ ID NO: 1140334 - RNA, 19 nt, Homo sapiens
gaacccagcgcaggaguaa

SEQ ID NO: 1140335 - RNA, 19 nt, Homo sapiens
gaccaugcauaauuugaga

SEQ ID NO: 1140336 - RNA, 19 nt, Homo sapiens
ugaaugaugugaagaaggu

SEQ ID NO: 1140337 - RNA, 19 nt, Homo sapiens
gguacuauuuggcauguga

SEQ ID NO: 1140338 - RNA, 19 nt, Homo sapiens
gagaaucuguagaagcaau

SEQ ID NO: 1140339 - RNA, 19 nt, Homo sapiens
ccaagucaguucagagaau

SEQ ID NO: 1140340 - RNA, 19 nt, Homo sapiens
aaaacgcccuucauuaaua

SEQ ID NO: 1140341 - RNA, 19 nt, Homo sapiens
ggaagucagugcuuagaac

SEQ ID NO: 1140342 - RNA, 19 nt, Homo sapiens
gaagcaauuggaaggauuu

SEQ ID NO: 1140343 - RNA, 19 nt, Homo sapiens
acaaacaccaagcuaauaa

SEQ ID NO: 1140344 - RNA, 19 nt, Homo sapiens
gaucauuucuacauuucug

SEQ ID NO: 1140345 - RNA, 19 nt, Homo sapiens
ccacaaaucaagauacaug

SEQ ID NO: 1140346 - RNA, 19 nt, Homo sapiens
gcugagaggaacuauuuaa

SEQ ID NO: 1140347 - RNA, 19 nt, Homo sapiens
gugaggaaauuaaaguuca

SEQ ID NO: 1140348 - RNA, 19 nt, Homo sapiens
ugaaguagauuuacaucag

SEQ ID NO: 1140349 - RNA, 19 nt, Homo sapiens
ugagggcuguguaaaggua

SEQ ID NO: 1140350 - RNA, 19 nt, Homo sapiens
ccucuaggcuauuccacua

SEQ ID NO: 1140351 - RNA, 19 nt, Homo sapiens
uuaccgugcuuuauagaaa

SEQ ID NO: 1140352 - RNA, 19 nt, Homo sapiens
gcacuugcauauuaauaac

SEQ ID NO: 1140353 - RNA, 19 nt, Homo sapiens
ggugcaauccuuaauuaaa

SEQ ID NO: 1140354 - RNA, 19 nt, Homo sapiens
gcagcucaauccacaaauc

SEQ ID NO: 1140355 - RNA, 19 nt, Homo sapiens
gcccaggacuucggaacua

SEQ ID NO: 1140356 - RNA, 19 nt, Homo sapiens
gaugauaagacuaagaaug

SEQ ID NO: 1140357 - RNA, 19 nt, Homo sapiens
uggcagaagaugauuguua

SEQ ID NO: 1140358 - RNA, 19 nt, Homo sapiens
uccaagcacuaaacccuua

SEQ ID NO: 1140359 - RNA, 19 nt, Homo sapiens
aacaacagcucccuuagug

SEQ ID NO: 1140360 - RNA, 19 nt, Homo sapiens
acaaucaacugccauccaa

SEQ ID NO: 1140361 - RNA, 19 nt, Homo sapiens
gcaaagcagggaagacaga

SEQ ID NO: 1140362 - RNA, 19 nt, Homo sapiens
uuaauaugccucaguguaa

SEQ ID NO: 1140363 - RNA, 19 nt, Homo sapiens
aaacgcccuucauuaauau

SEQ ID NO: 1140364 - RNA, 19 nt, Homo sapiens
ggcauuuggugucauaaga

SEQ ID NO: 1140365 - RNA, 19 nt, Homo sapiens
acugacagaucaagaugua

SEQ ID NO: 1140366 - RNA, 19 nt, Homo sapiens
guaacuccauuaaacaaag

SEQ ID NO: 1140367 - RNA, 19 nt, Homo sapiens
caugauaugucagaggaaa

SEQ ID NO: 1140368 - RNA, 19 nt, Homo sapiens
ugacagaucaagauguaaa

SEQ ID NO: 1140369 - RNA, 19 nt, Homo sapiens
uugcagauguguaccauga

SEQ ID NO: 1140370 - RNA, 19 nt, Homo sapiens
ggaccaagaauuaugagau

SEQ ID NO: 1140371 - RNA, 19 nt, Homo sapiens
ggacaaccauauagaauua

SEQ ID NO: 1140372 - RNA, 19 nt, Homo sapiens
gcaaagauaugacgguaaa

SEQ ID NO: 1140373 - RNA, 19 nt, Homo sapiens
aaucacagcucuaaaguua

SEQ ID NO: 1140374 - RNA, 19 nt, Homo sapiens
ugagaagucuguuugauua

SEQ ID NO: 1140375 - RNA, 19 nt, Homo sapiens
gagcagaucugaacuuaug

SEQ ID NO: 1140376 - RNA, 19 nt, Homo sapiens
gcacauggaugaugaagga

SEQ ID NO: 1140377 - RNA, 19 nt, Homo sapiens
gcagagauauuuccuuuag

SEQ ID NO: 1140378 - RNA, 19 nt, Homo sapiens
gaaacucgcuaagguuaaa

SEQ ID NO: 1140379 - RNA, 19 nt, Homo sapiens
gaaacuggauuuaaacaag

SEQ ID NO: 1140380 - RNA, 19 nt, Homo sapiens
ugacugaccuuaaguguuc

SEQ ID NO: 1140381 - RNA, 19 nt, Homo sapiens
gcucuaaaguuaauucaga

SEQ ID NO: 1140382 - RNA, 19 nt, Homo sapiens
gcaacugucuggaaacuuc

SEQ ID NO: 1140383 - RNA, 19 nt, Homo sapiens
gaagagugcccuguguuua

SEQ ID NO: 1140384 - RNA, 19 nt, Homo sapiens
gaaguuuacucaugcuuuc

SEQ ID NO: 1140385 - RNA, 19 nt, Homo sapiens
ccaagcaacugucuggaaa

SEQ ID NO: 1140386 - RNA, 19 nt, Homo sapiens
gguaaaguaugacucaaga

SEQ ID NO: 1140387 - RNA, 19 nt, Homo sapiens
ugaaggaacucagcauuga

SEQ ID NO: 1140388 - RNA, 19 nt, Homo sapiens
ggaaggaagagaaguuaaa

SEQ ID NO: 1140389 - RNA, 19 nt, Homo sapiens
ggacaaagcagaccaugca

SEQ ID NO: 1140390 - RNA, 19 nt, Homo sapiens
ucacagcucuaaaguuaau

SEQ ID NO: 1140391 - RNA, 19 nt, Homo sapiens
caacuaauccugaaagaag

SEQ ID NO: 1140392 - RNA, 19 nt, Homo sapiens
ggaagagugcccuguguuu

SEQ ID NO: 1140393 - RNA, 19 nt, Homo sapiens
uggcagagauauuuccuuu

SEQ ID NO: 1140394 - RNA, 19 nt, Homo sapiens
ggagaaacaagauuuaaca

SEQ ID NO: 1140395 - RNA, 19 nt, Homo sapiens
gaaccuacaggaucaucua

SEQ ID NO: 1140396 - RNA, 19 nt, Homo sapiens
ucacggugcuuacaugaga

SEQ ID NO: 1140397 - RNA, 19 nt, Homo sapiens
uaaauggacugacugaaac

SEQ ID NO: 1140398 - RNA, 19 nt, Homo sapiens
uuacuucucuccucugcua

SEQ ID NO: 1140399 - RNA, 19 nt, Homo sapiens
cuaaauggacugacugaaa

SEQ ID NO: 1140400 - RNA, 19 nt, Homo sapiens
guaugaaccuacaggauca

SEQ ID NO: 1140401 - RNA, 19 nt, Homo sapiens
gaggaaggaagagaaguua

SEQ ID NO: 1140402 - RNA, 19 nt, Homo sapiens
gauugcacauggaugauga

SEQ ID NO: 1140403 - RNA, 19 nt, Homo sapiens
gcauggagaaacaagauuu

SEQ ID NO: 1140404 - RNA, 19 nt, Homo sapiens
cccaguacauguuuauauu

SEQ ID NO: 1140405 - RNA, 19 nt, Homo sapiens
gggaugagucucuuuauca

SEQ ID NO: 1140406 - RNA, 19 nt, Homo sapiens
gguuaaaucugcaucaaaa

SEQ ID NO: 1140407 - RNA, 19 nt, Homo sapiens
cugagcagaucugaacuua

SEQ ID NO: 1140408 - RNA, 19 nt, Homo sapiens
cagcgguauuccaggauua

SEQ ID NO: 1140409 - RNA, 19 nt, Homo sapiens
gccagugucuuaguuguga

SEQ ID NO: 1140410 - RNA, 19 nt, Homo sapiens
gaaggaacucagcauugaa

SEQ ID NO: 1140411 - RNA, 19 nt, Homo sapiens
gaugaaggaacucagcauu

SEQ ID NO: 1140412 - RNA, 19 nt, Homo sapiens
ccuacaggaucaucuaaau

SEQ ID NO: 1140413 - RNA, 19 nt, Homo sapiens
gacugaaacucgcuaaggu

SEQ ID NO: 1140414 - RNA, 19 nt, Homo sapiens
ggaagagaaguuaaaccaa

SEQ ID NO: 1140415 - RNA, 19 nt, Homo sapiens
aaugugaaguuuacucaug

SEQ ID NO: 1140416 - RNA, 19 nt, Homo sapiens
ggaaccauagccacauaaa

SEQ ID NO: 1140417 - RNA, 19 nt, Homo sapiens
gaaaaugcguggaauagac

SEQ ID NO: 1140418 - RNA, 19 nt, Homo sapiens
gauaugacgguaaaguaug

SEQ ID NO: 1140419 - RNA, 19 nt, Homo sapiens
gaaaauaauccaaggacaa

SEQ ID NO: 1140420 - RNA, 19 nt, Homo sapiens
cauggagaaacaagauuua

SEQ ID NO: 1140421 - RNA, 19 nt, Homo sapiens
gaaggcaaagcgcuaagug

SEQ ID NO: 1140422 - RNA, 19 nt, Homo sapiens
gaaauacgggguuguagaa

SEQ ID NO: 1140423 - RNA, 19 nt, Homo sapiens
cugaaacucgcuaagguua

SEQ ID NO: 1140424 - RNA, 19 nt, Homo sapiens
gugcuuagaagaaagaaug

SEQ ID NO: 1140425 - RNA, 19 nt, Homo sapiens
gagucacggugcuuacaug

SEQ ID NO: 1140426 - RNA, 19 nt, Homo sapiens
cauaaacuuugaggaagga

SEQ ID NO: 1140427 - RNA, 19 nt, Homo sapiens
aaacuucuuuggcagagau

SEQ ID NO: 1140428 - RNA, 19 nt, Homo sapiens
gaaacuucuuuggcagaga

SEQ ID NO: 1140429 - RNA, 19 nt, Homo sapiens
ccauuggcuuuauuuacuu

SEQ ID NO: 1140430 - RNA, 19 nt, Homo sapiens
acagggaugagucucuuua

SEQ ID NO: 1140431 - RNA, 19 nt, Homo sapiens
caugagaagucuguuugau

SEQ ID NO: 1140432 - RNA, 19 nt, Homo sapiens
aagauaugacgguaaagua

SEQ ID NO: 1140433 - RNA, 19 nt, Homo sapiens
uuaccacccugcuagaugu

SEQ ID NO: 1140434 - RNA, 19 nt, Homo sapiens
guagaaggcaaagcgcuaa

SEQ ID NO: 1140435 - RNA, 19 nt, Homo sapiens
auaugacgguaaaguauga

SEQ ID NO: 1140436 - RNA, 19 nt, Homo sapiens
ccaguacauguuuauauug

SEQ ID NO: 1140437 - RNA, 19 nt, Homo sapiens
ugaaguuuacucaugcuuu

SEQ ID NO: 1140438 - RNA, 19 nt, Homo sapiens
gaaggaagagaaguuaaac

SEQ ID NO: 1140439 - RNA, 19 nt, Homo sapiens
ccaaggacaaggaguagau

SEQ ID NO: 1140440 - RNA, 19 nt, Homo sapiens
gucagucacucccaauaca

SEQ ID NO: 1140441 - RNA, 19 nt, Homo sapiens
caagauuuaacaaggagaa

SEQ ID NO: 1140442 - RNA, 19 nt, Homo sapiens
ggaguagaugaaccucuuu

SEQ ID NO: 1140443 - RNA, 19 nt, Homo sapiens
aaacuuuaauggacaacca

SEQ ID NO: 1140444 - RNA, 19 nt, Homo sapiens
guucaguguauuuguauga

SEQ ID NO: 1140445 - RNA, 19 nt, Homo sapiens
acgguucaguguauuugua

SEQ ID NO: 1140446 - RNA, 19 nt, Homo sapiens
aggaguagaugaaccucuu

SEQ ID NO: 1140447 - RNA, 19 nt, Homo sapiens
gagaagucuguuugauuau

SEQ ID NO: 1140448 - RNA, 19 nt, Homo sapiens
auuagcagccagugucuua

SEQ ID NO: 1140449 - RNA, 19 nt, Homo sapiens
ggaacucagcauugaaagu

SEQ ID NO: 1140450 - RNA, 19 nt, Homo sapiens
gaucaucuaaauggacuga

SEQ ID NO: 1140451 - RNA, 19 nt, Homo sapiens
ugaggaaggaagagaaguu

SEQ ID NO: 1140452 - RNA, 19 nt, Homo sapiens
ugaaagaagcggaucaaaa

SEQ ID NO: 1140453 - RNA, 19 nt, Homo sapiens
gucaacuaauccugaaaga

SEQ ID NO: 1140454 - RNA, 19 nt, Homo sapiens
gggaagagugcccuguguu

SEQ ID NO: 1140455 - RNA, 19 nt, Homo sapiens
uaauggcuauugguaagau

SEQ ID NO: 1140456 - RNA, 19 nt, Homo sapiens
uuuaauggcuauugguaag

SEQ ID NO: 1140457 - RNA, 19 nt, Homo sapiens
caacgguucaguguauuug

SEQ ID NO: 1140458 - RNA, 19 nt, Homo sapiens
ccaacgguucaguguauuu

SEQ ID NO: 1140459 - RNA, 19 nt, Homo sapiens
ggacaaggaguagaugaac

SEQ ID NO: 1140460 - RNA, 19 nt, Homo sapiens
uuacaugagaagucuguuu

SEQ ID NO: 1140461 - RNA, 19 nt, Homo sapiens
gcagccagugucuuaguug

SEQ ID NO: 1140462 - RNA, 19 nt, Homo sapiens
agauaugacgguaaaguau

SEQ ID NO: 1140463 - RNA, 19 nt, Homo sapiens
aaggaacucagcauugaaa

SEQ ID NO: 1140464 - RNA, 19 nt, Homo sapiens
uggacaaccauauagaauu

SEQ ID NO: 1140465 - RNA, 19 nt, Homo sapiens
ugaaacucgcuaagguuaa

SEQ ID NO: 1140466 - RNA, 19 nt, Homo sapiens
gugcuuacaugagaagucu

SEQ ID NO: 1140467 - RNA, 19 nt, Homo sapiens
uaaaguaugacucaagacu

SEQ ID NO: 1140468 - RNA, 19 nt, Homo sapiens
ggcagagauauuuccuuua

SEQ ID NO: 1140469 - RNA, 19 nt, Homo sapiens
gaacaguuuucccaaggau

SEQ ID NO: 1140470 - RNA, 19 nt, Homo sapiens
aauccaaggacaaggagua

SEQ ID NO: 1140471 - RNA, 19 nt, Homo sapiens
ggacauguaucucaaauuu

SEQ ID NO: 1140472 - RNA, 19 nt, Homo sapiens
gaugagaccuguucuugua

SEQ ID NO: 1140473 - RNA, 19 nt, Homo sapiens
gaaaguggguuuaugcaaa

SEQ ID NO: 1140474 - RNA, 19 nt, Homo sapiens
uaucauggcuuccucaaua

SEQ ID NO: 1140475 - RNA, 19 nt, Homo sapiens
ucaauccucugcucuauua

SEQ ID NO: 1140476 - RNA, 19 nt, Homo sapiens
ggagagagguucuaacaca

SEQ ID NO: 1140477 - RNA, 19 nt, Homo sapiens
gcaguucuccuucccauua

SEQ ID NO: 1140478 - RNA, 19 nt, Homo sapiens
gaacggcagugucacauca

SEQ ID NO: 1140479 - RNA, 19 nt, Homo sapiens
cugaagaaauugaagcuua

SEQ ID NO: 1140480 - RNA, 19 nt, Homo sapiens
gaagauugguugaaagucu

SEQ ID NO: 1140481 - RNA, 19 nt, Homo sapiens
uuacaucacucccaacaaa

SEQ ID NO: 1140482 - RNA, 19 nt, Homo sapiens
gcaaagacaaaguguguuu

SEQ ID NO: 1140483 - RNA, 19 nt, Homo sapiens
ccacuacccuuguaaacuu

SEQ ID NO: 1140484 - RNA, 19 nt, Homo sapiens
gaaggcaacccuauuucua

SEQ ID NO: 1140485 - RNA, 19 nt, Homo sapiens
ggaaggcuguccuauaaca

SEQ ID NO: 1140486 - RNA, 19 nt, Homo sapiens
gcaaagacagacugcauaa

SEQ ID NO: 1140487 - RNA, 19 nt, Homo sapiens
aaagagaacuggcaauaag

SEQ ID NO: 1140488 - RNA, 19 nt, Homo sapiens
ggagaaggauuggagcaaa

SEQ ID NO: 1140489 - RNA, 19 nt, Homo sapiens
uaucagaaauggaaccaaa

SEQ ID NO: 1140490 - RNA, 19 nt, Homo sapiens
ccaucaggcuuucuaaauu

SEQ ID NO: 1140491 - RNA, 19 nt, Homo sapiens
guacagcaguauuuauuuc

SEQ ID NO: 1140492 - RNA, 19 nt, Homo sapiens
ggaaggaagaauuucauuu

SEQ ID NO: 1140493 - RNA, 19 nt, Homo sapiens
gaaaggaaacaagaguaua

SEQ ID NO: 1140494 - RNA, 19 nt, Homo sapiens
gcacauuggauccuacuuu

SEQ ID NO: 1140495 - RNA, 19 nt, Homo sapiens
gauauggcauucugaaagu

SEQ ID NO: 1140496 - RNA, 19 nt, Homo sapiens
ccaggaagauugguugaaa

SEQ ID NO: 1140497 - RNA, 19 nt, Homo sapiens
ccuaggaaaugaaagaauu

SEQ ID NO: 1140498 - RNA, 19 nt, Homo sapiens
uaacaaagcagcaucaagu

SEQ ID NO: 1140499 - RNA, 19 nt, Homo sapiens
gcaggauuaugucuuauuc

SEQ ID NO: 1140500 - RNA, 19 nt, Homo sapiens
gaaauugaagcuuagagaa

SEQ ID NO: 1140501 - RNA, 19 nt, Homo sapiens
gaaacaaggcuaaggauac

SEQ ID NO: 1140502 - RNA, 19 nt, Homo sapiens
gaaaguagggagggacuaa

SEQ ID NO: 1140503 - RNA, 19 nt, Homo sapiens
ucagaucuccuguucauaa

SEQ ID NO: 1140504 - RNA, 19 nt, Homo sapiens
gccaggcacuuuacauuug

SEQ ID NO: 1140505 - RNA, 19 nt, Homo sapiens
gcacugaccaccaucauca

SEQ ID NO: 1140506 - RNA, 19 nt, Homo sapiens
gggaaagacuaacugugaa

SEQ ID NO: 1140507 - RNA, 19 nt, Homo sapiens
ggaaggcacugaccaccau

SEQ ID NO: 1140508 - RNA, 19 nt, Homo sapiens
ggaaacaagaguauaagga

SEQ ID NO: 1140509 - RNA, 19 nt, Homo sapiens
ggaaaugaaagaauugugu

SEQ ID NO: 1140510 - RNA, 19 nt, Homo sapiens
caucaggcuuucuaaauuc

SEQ ID NO: 1140511 - RNA, 19 nt, Homo sapiens
caaagcacauuggauccua

SEQ ID NO: 1140512 - RNA, 19 nt, Homo sapiens
gagaaaggaaacaagagua

SEQ ID NO: 1140513 - RNA, 19 nt, Homo sapiens
gaucauucggguucuguua

SEQ ID NO: 1140514 - RNA, 19 nt, Homo sapiens
gagcagaacggcaguguca

SEQ ID NO: 1140515 - RNA, 19 nt, Homo sapiens
ccugcaggauuaugucuua

SEQ ID NO: 1140516 - RNA, 19 nt, Homo sapiens
aauggcaccuucagcaaua

SEQ ID NO: 1140517 - RNA, 19 nt, Homo sapiens
gaagaugaguagggagaug

SEQ ID NO: 1140518 - RNA, 19 nt, Homo sapiens
ggaaagacuaacugugaaa

SEQ ID NO: 1140519 - RNA, 19 nt, Homo sapiens
agaagcacauccuaagauu

SEQ ID NO: 1140520 - RNA, 19 nt, Homo sapiens
ccugugggcugaaauauca

SEQ ID NO: 1140521 - RNA, 19 nt, Homo sapiens
guaaggacagugagagaaa

SEQ ID NO: 1140522 - RNA, 19 nt, Homo sapiens
cuaaggauacuaccaacua

SEQ ID NO: 1140523 - RNA, 19 nt, Homo sapiens
ucaaggacauguaucucaa

SEQ ID NO: 1140524 - RNA, 19 nt, Homo sapiens
gaaaagaagcacauccuaa

SEQ ID NO: 1140525 - RNA, 19 nt, Homo sapiens
gccaaugccugcuucaauc

SEQ ID NO: 1140526 - RNA, 19 nt, Homo sapiens
gaucaucaaggacauguau

SEQ ID NO: 1140527 - RNA, 19 nt, Homo sapiens
gcaacccuauuucuacugu

SEQ ID NO: 1140528 - RNA, 19 nt, Homo sapiens
gaggugauauggcauucug

SEQ ID NO: 1140529 - RNA, 19 nt, Homo sapiens
ugaagaaauugaagcuuag

SEQ ID NO: 1140530 - RNA, 19 nt, Homo sapiens
gcaaauagcaaaaguuguu

SEQ ID NO: 1140531 - RNA, 19 nt, Homo sapiens
uuucaguuguugagucuua

SEQ ID NO: 1140532 - RNA, 19 nt, Homo sapiens
uauaagaaguccacaucug

SEQ ID NO: 1140533 - RNA, 19 nt, Homo sapiens
caacauguacagcaguauu

SEQ ID NO: 1140534 - RNA, 19 nt, Homo sapiens
gaagcuuguuuaaguuuac

SEQ ID NO: 1140535 - RNA, 19 nt, Homo sapiens
guacugacaacaauugaau

SEQ ID NO: 1140536 - RNA, 19 nt, Homo sapiens
ugaaacaaggcuaaggaua

SEQ ID NO: 1140537 - RNA, 19 nt, Homo sapiens
uaacauuuccgcagaagau

SEQ ID NO: 1140538 - RNA, 19 nt, Homo sapiens
gguugaaagucugaauaaa

SEQ ID NO: 1140539 - RNA, 19 nt, Homo sapiens
gagaugcugccuucccuuu

SEQ ID NO: 1140540 - RNA, 19 nt, Homo sapiens
guagagggcaaauagcaaa

SEQ ID NO: 1140541 - RNA, 19 nt, Homo sapiens
gaccuguucuuguauccuu

SEQ ID NO: 1140542 - RNA, 19 nt, Homo sapiens
guuagugugugguugagaa

SEQ ID NO: 1140543 - RNA, 19 nt, Homo sapiens
ggaaaguggguuuaugcaa

SEQ ID NO: 1140544 - RNA, 19 nt, Homo sapiens
gaucuccuguucauaagca

SEQ ID NO: 1140545 - RNA, 19 nt, Homo sapiens
guaaaggguggaggugaua

SEQ ID NO: 1140546 - RNA, 19 nt, Homo sapiens
ccaaagcucugaguuccau

SEQ ID NO: 1140547 - RNA, 19 nt, Homo sapiens
cagcaucaagucccaagua

SEQ ID NO: 1140548 - RNA, 19 nt, Homo sapiens
gaucaucuucuucuugugu

SEQ ID NO: 1140549 - RNA, 19 nt, Homo sapiens
gucaacauguacagcagua

SEQ ID NO: 1140550 - RNA, 19 nt, Homo sapiens
acacagcuaguaagaguuu

SEQ ID NO: 1140551 - RNA, 19 nt, Homo sapiens
caacuacuaucaccaugac

SEQ ID NO: 1140552 - RNA, 19 nt, Homo sapiens
cuugagauauagccaacua

SEQ ID NO: 1140553 - RNA, 19 nt, Homo sapiens
gcaauaacaacagcaggaa

SEQ ID NO: 1140554 - RNA, 19 nt, Homo sapiens
aaagacagacugcauaaag

SEQ ID NO: 1140555 - RNA, 19 nt, Homo sapiens
uaucuuagaggcuccaauu

SEQ ID NO: 1140556 - RNA, 19 nt, Homo sapiens
caaaagagaacuggcaaua

SEQ ID NO: 1140557 - RNA, 19 nt, Homo sapiens
ccucugcucuauuacuuug

SEQ ID NO: 1140558 - RNA, 19 nt, Homo sapiens
cugcauaaagcuuugguua

SEQ ID NO: 1140559 - RNA, 19 nt, Homo sapiens
cgacauggaaaguggguuu

SEQ ID NO: 1140560 - RNA, 19 nt, Homo sapiens
ucauucggguucuguuaaa

SEQ ID NO: 1140561 - RNA, 19 nt, Homo sapiens
aaacaaggcuaaggauacu

SEQ ID NO: 1140562 - RNA, 19 nt, Homo sapiens
ccacagaaggcaaagacaa

SEQ ID NO: 1140563 - RNA, 19 nt, Homo sapiens
gaaaaggccauccacagaa

SEQ ID NO: 1140564 - RNA, 19 nt, Homo sapiens
cugcagaccaugaacuaua

SEQ ID NO: 1140565 - RNA, 19 nt, Homo sapiens
gcacuuuacauuuguugau

SEQ ID NO: 1140566 - RNA, 19 nt, Homo sapiens
gagaaggauuggagcaaaa

SEQ ID NO: 1140567 - RNA, 19 nt, Homo sapiens
caucuucauucacucauag

SEQ ID NO: 1140568 - RNA, 19 nt, Homo sapiens
cauuucagaucuccuguuc

SEQ ID NO: 1140569 - RNA, 19 nt, Homo sapiens
uaagucagucaucauacua

SEQ ID NO: 1140570 - RNA, 19 nt, Homo sapiens
caaauggcaccuucagcaa

SEQ ID NO: 1140571 - RNA, 19 nt, Homo sapiens
ggacaagguugacugcuua

SEQ ID NO: 1140572 - RNA, 19 nt, Homo sapiens
gcaaagaccugugaagcua

SEQ ID NO: 1140573 - RNA, 19 nt, Homo sapiens
ugugaagucuguaguguuu

SEQ ID NO: 1140574 - RNA, 19 nt, Homo sapiens
gagaggaggccgagcagaa

SEQ ID NO: 1140575 - RNA, 19 nt, Homo sapiens
gggacaagguugacugcuu

SEQ ID NO: 1140576 - RNA, 19 nt, Homo sapiens
ggugaugucugcaaagucu

SEQ ID NO: 1140577 - RNA, 19 nt, Homo sapiens
ugaagucuguaguguuuga

SEQ ID NO: 1140578 - RNA, 19 nt, Homo sapiens
ucagaugccuguccuugga

SEQ ID NO: 1140579 - RNA, 19 nt, Homo sapiens
gcuccugucugcacugaga

SEQ ID NO: 1140580 - RNA, 19 nt, Homo sapiens
gaggaggccgagcagaaua

SEQ ID NO: 1140581 - RNA, 19 nt, Homo sapiens
ugagggaauucagcaaaga

SEQ ID NO: 1140582 - RNA, 19 nt, Homo sapiens
caagguugacugcuuagga

SEQ ID NO: 1140583 - RNA, 19 nt, Homo sapiens
ggugagggaauucagcaaa

SEQ ID NO: 1140584 - RNA, 19 nt, Homo sapiens
agaauacaccccagaguua

SEQ ID NO: 1140585 - RNA, 19 nt, Homo sapiens
gaugagggaagaugagaag

SEQ ID NO: 1140586 - RNA, 19 nt, Homo sapiens
gugagggaauucagcaaag

SEQ ID NO: 1140587 - RNA, 19 nt, Homo sapiens
gagaugagggaagaugaga

SEQ ID NO: 1140588 - RNA, 19 nt, Homo sapiens
aaagaccugugaagcuaca

SEQ ID NO: 1140589 - RNA, 19 nt, Homo sapiens
gggagaugagggaagauga

SEQ ID NO: 1140590 - RNA, 19 nt, Homo sapiens
ucagcagugugaagucugu

SEQ ID NO: 1140591 - RNA, 19 nt, Homo sapiens
cagcuccugucugcacuga

SEQ ID NO: 1140592 - RNA, 19 nt, Homo sapiens
ggagaugagggaagaugag

SEQ ID NO: 1140593 - RNA, 19 nt, Homo sapiens
gcuuuguccuggcuuccuu

SEQ ID NO: 1140594 - RNA, 19 nt, Homo sapiens
gagcuucucagaguggaau

SEQ ID NO: 1140595 - RNA, 19 nt, Homo sapiens
ggaagagauuuguggauua

SEQ ID NO: 1140596 - RNA, 19 nt, Homo sapiens
gaaaugcucucaauaccaa

SEQ ID NO: 1140597 - RNA, 19 nt, Homo sapiens
gaagagauuuguggauuaa

SEQ ID NO: 1140598 - RNA, 19 nt, Homo sapiens
gaaagcagcaguuaaaguu

SEQ ID NO: 1140599 - RNA, 19 nt, Homo sapiens
gcagaaagcagcaguuaaa

SEQ ID NO: 1140600 - RNA, 19 nt, Homo sapiens
guaauuaugucucuggauu

SEQ ID NO: 1140601 - RNA, 19 nt, Homo sapiens
ggccagaucugcuuuagaa

SEQ ID NO: 1140602 - RNA, 19 nt, Homo sapiens
ucacggagcuaauucauau

SEQ ID NO: 1140603 - RNA, 19 nt, Homo sapiens
gagaguaguucaauggauu

SEQ ID NO: 1140604 - RNA, 19 nt, Homo sapiens
gaauacagcaaacagauuu

SEQ ID NO: 1140605 - RNA, 19 nt, Homo sapiens
gaauauggcauuucaguau

SEQ ID NO: 1140606 - RNA, 19 nt, Homo sapiens
gcaaauggacaggaaauaa

SEQ ID NO: 1140607 - RNA, 19 nt, Homo sapiens
guacaugacagcuggaaua

SEQ ID NO: 1140608 - RNA, 19 nt, Homo sapiens
ggaaucagguagugucaga

SEQ ID NO: 1140609 - RNA, 19 nt, Homo sapiens
ccucaugucucuggauuua

SEQ ID NO: 1140610 - RNA, 19 nt, Homo sapiens
gauaagaugcuuuagauca

SEQ ID NO: 1140611 - RNA, 19 nt, Homo sapiens
gccuauagauuuagcuuaa

SEQ ID NO: 1140612 - RNA, 19 nt, Homo sapiens
ccacagacauccaauuaca

SEQ ID NO: 1140613 - RNA, 19 nt, Homo sapiens
gaucagagaggcucaagaa

SEQ ID NO: 1140614 - RNA, 19 nt, Homo sapiens
gaacaccguugacaagaag

SEQ ID NO: 1140615 - RNA, 19 nt, Homo sapiens
ucaugucucuggauuuaua

SEQ ID NO: 1140616 - RNA, 19 nt, Homo sapiens
caagaaggcugaguuuaca

SEQ ID NO: 1140617 - RNA, 19 nt, Homo sapiens
aaucaaagcuggcaaaggu

SEQ ID NO: 1140618 - RNA, 19 nt, Homo sapiens
aaacucagcuccuguaguc

SEQ ID NO: 1140619 - RNA, 19 nt, Homo sapiens
ugaaagacaugcaauuugg

SEQ ID NO: 1140620 - RNA, 19 nt, Homo sapiens
ucauauugcucuccuugua

SEQ ID NO: 1140621 - RNA, 19 nt, Homo sapiens
gaagauuggacuaugcuaa

SEQ ID NO: 1140622 - RNA, 19 nt, Homo sapiens
caaggaguauaucaugaaa

SEQ ID NO: 1140623 - RNA, 19 nt, Homo sapiens
ggaauagccuccaguugag

SEQ ID NO: 1140624 - RNA, 19 nt, Homo sapiens
caccacgccuggcuaauuu

SEQ ID NO: 1140625 - RNA, 19 nt, Homo sapiens
caucaggaauuucuuggaa

SEQ ID NO: 1140626 - RNA, 19 nt, Homo sapiens
aaacucagcuaccuuucuu

SEQ ID NO: 1140627 - RNA, 19 nt, Homo sapiens
ccgaguagcuggaauuaca

SEQ ID NO: 1140628 - RNA, 19 nt, Homo sapiens
ccaaagugcugggauuaga

SEQ ID NO: 1140629 - RNA, 19 nt, Homo sapiens
guacaucgugggauaguaa

SEQ ID NO: 1140630 - RNA, 19 nt, Homo sapiens
ggaagccaccuuacucuga

SEQ ID NO: 1140631 - RNA, 19 nt, Homo sapiens
gagacuuucuucuagcaaa

SEQ ID NO: 1140632 - RNA, 19 nt, Homo sapiens
gaucuacucaugucaaaga

SEQ ID NO: 1140633 - RNA, 19 nt, Homo sapiens
ggaaaguuauaucacagau

SEQ ID NO: 1140634 - RNA, 19 nt, Homo sapiens
guacaaggaguauaucaug

SEQ ID NO: 1140635 - RNA, 19 nt, Homo sapiens
uggauaagaugcuuuagau

SEQ ID NO: 1140636 - RNA, 19 nt, Homo sapiens
ggaauucauuggugagagu

SEQ ID NO: 1140637 - RNA, 19 nt, Homo sapiens
cuauugaccugugucguua

SEQ ID NO: 1140638 - RNA, 19 nt, Homo sapiens
gcagagaucacggagcuaa

SEQ ID NO: 1140639 - RNA, 19 nt, Homo sapiens
caucugguuugcuguauga

SEQ ID NO: 1140640 - RNA, 19 nt, Homo sapiens
aaugaguucugcuuucuuu

SEQ ID NO: 1140641 - RNA, 19 nt, Homo sapiens
uuugaggccuauagauuua

SEQ ID NO: 1140642 - RNA, 19 nt, Homo sapiens
ggcaugcaaugaagagaaa

SEQ ID NO: 1140643 - RNA, 19 nt, Homo sapiens
ggauuaaacagaucagaga

SEQ ID NO: 1140644 - RNA, 19 nt, Homo sapiens
guaaagcuacagagguuaa

SEQ ID NO: 1140645 - RNA, 19 nt, Homo sapiens
ggagaguaguucaauggau

SEQ ID NO: 1140646 - RNA, 19 nt, Homo sapiens
gcagucgcagaaauaauua

SEQ ID NO: 1140647 - RNA, 19 nt, Homo sapiens
cuaaaugaguucugcuuuc

SEQ ID NO: 1140648 - RNA, 19 nt, Homo sapiens
gggaucuacucaugucaaa

SEQ ID NO: 1140649 - RNA, 19 nt, Homo sapiens
gaaggcugaguuuacauaa

SEQ ID NO: 1140650 - RNA, 19 nt, Homo sapiens
gaauauaagcaaucucaca

SEQ ID NO: 1140651 - RNA, 19 nt, Homo sapiens
gaacaccaagguuguggaa

SEQ ID NO: 1140652 - RNA, 19 nt, Homo sapiens
gaaccacagacauccaauu

SEQ ID NO: 1140653 - RNA, 19 nt, Homo sapiens
guaauacuuugguuuaagg

SEQ ID NO: 1140654 - RNA, 19 nt, Homo sapiens
uggaagagauuuguggauu

SEQ ID NO: 1140655 - RNA, 19 nt, Homo sapiens
ucagugggaucuacucaug

SEQ ID NO: 1140656 - RNA, 19 nt, Homo sapiens
ucacugaaauuggcuuaau

SEQ ID NO: 1140657 - RNA, 19 nt, Homo sapiens
gccgaaaaguugccaaaua

SEQ ID NO: 1140658 - RNA, 19 nt, Homo sapiens
uaaaugaguucugcuuucu

SEQ ID NO: 1140659 - RNA, 19 nt, Homo sapiens
agucuuacaucaggaauuu

SEQ ID NO: 1140660 - RNA, 19 nt, Homo sapiens
gaauaucgacuuggaagga

SEQ ID NO: 1140661 - RNA, 19 nt, Homo sapiens
gaguggagacuuucuucua

SEQ ID NO: 1140662 - RNA, 19 nt, Homo sapiens
ucauuaacuuccacaaaga

SEQ ID NO: 1140663 - RNA, 19 nt, Homo sapiens
ugaucuagauugaaacuca

SEQ ID NO: 1140664 - RNA, 19 nt, Homo sapiens
gacaagaaggcugaguuua

SEQ ID NO: 1140665 - RNA, 19 nt, Homo sapiens
gagcugggacuguuguuug

SEQ ID NO: 1140666 - RNA, 19 nt, Homo sapiens
agauuuagcuuaagagaac

SEQ ID NO: 1140667 - RNA, 19 nt, Homo sapiens
aaccacagacauccaauua

SEQ ID NO: 1140668 - RNA, 19 nt, Homo sapiens
aaaggaagauuggacuaug

SEQ ID NO: 1140669 - RNA, 19 nt, Homo sapiens
ugacaagaaggcugaguuu

SEQ ID NO: 1140670 - RNA, 19 nt, Homo sapiens
gcacuugccacguuaucuu

SEQ ID NO: 1140671 - RNA, 19 nt, Homo sapiens
gcucaaacacuacaugaag

SEQ ID NO: 1140672 - RNA, 19 nt, Homo sapiens
gugcugagcugggacuguu

SEQ ID NO: 1140673 - RNA, 19 nt, Homo sapiens
gcuauugaccugugucguu

SEQ ID NO: 1140674 - RNA, 19 nt, Homo sapiens
ggugugacuucagcuauug

SEQ ID NO: 1140675 - RNA, 19 nt, Homo sapiens
cugccaagcugcaauggaa

SEQ ID NO: 1140676 - RNA, 19 nt, Homo sapiens
uauccugaguggagacuuu

SEQ ID NO: 1140677 - RNA, 19 nt, Homo sapiens
uaagaugcuuuagaucaga

SEQ ID NO: 1140678 - RNA, 19 nt, Homo sapiens
caaacacuacaugaaguua

SEQ ID NO: 1140679 - RNA, 19 nt, Homo sapiens
gcuaaaugaguucugcuuu

SEQ ID NO: 1140680 - RNA, 19 nt, Homo sapiens
uaugcuaaguugcgagaaa

SEQ ID NO: 1140681 - RNA, 19 nt, Homo sapiens
ggaauuagcaaagcaugau

SEQ ID NO: 1140682 - RNA, 19 nt, Homo sapiens
uacaaggaguauaucauga

SEQ ID NO: 1140683 - RNA, 19 nt, Homo sapiens
ccauggauaagaugcuuua

SEQ ID NO: 1140684 - RNA, 19 nt, Homo sapiens
agaacaccguugacaagaa

SEQ ID NO: 1140685 - RNA, 19 nt, Homo sapiens
ccagugacuccaugacuuu

SEQ ID NO: 1140686 - RNA, 19 nt, Homo sapiens
gcaauggaauuagcaaagc

SEQ ID NO: 1140687 - RNA, 19 nt, Homo sapiens
cauggugccuuacuagcaa

SEQ ID NO: 1140688 - RNA, 19 nt, Homo sapiens
gcaaugaagagaaaaugua

SEQ ID NO: 1140689 - RNA, 19 nt, Homo sapiens
gcaggugucaagagaaaug

SEQ ID NO: 1140690 - RNA, 19 nt, Homo sapiens
cugcaggugucaagagaaa

SEQ ID NO: 1140691 - RNA, 19 nt, Homo sapiens
caaauggacaggaaauaag

SEQ ID NO: 1140692 - RNA, 19 nt, Homo sapiens
gcgacgagcucagcaacau

SEQ ID NO: 1140693 - RNA, 19 nt, Homo sapiens
ccuuguacaucgugggaua

SEQ ID NO: 1140694 - RNA, 19 nt, Homo sapiens
cuacucaugucaaagaagu

SEQ ID NO: 1140695 - RNA, 19 nt, Homo sapiens
caacagaaucgcaaacuua

SEQ ID NO: 1140696 - RNA, 19 nt, Homo sapiens
gaacagauggccuuauauu

SEQ ID NO: 1140697 - RNA, 19 nt, Homo sapiens
cgaaggagcuccaggaaga

SEQ ID NO: 1140698 - RNA, 19 nt, Homo sapiens
gaacaaaugcucuggaaug

SEQ ID NO: 1140699 - RNA, 19 nt, Homo sapiens
cagcaaggcuuccauugaa

SEQ ID NO: 1140700 - RNA, 19 nt, Homo sapiens
gcugcuacauguacuauuu

SEQ ID NO: 1140701 - RNA, 19 nt, Homo sapiens
agucaaagaucuauuccua

SEQ ID NO: 1140702 - RNA, 19 nt, Homo sapiens
gcaacagaaucgcaaacuu

SEQ ID NO: 1140703 - RNA, 19 nt, Homo sapiens
ucaaagaucuauuccuaca

SEQ ID NO: 1140704 - RNA, 19 nt, Homo sapiens
aaagaucuauuccuacaug

SEQ ID NO: 1140705 - RNA, 19 nt, Homo sapiens
uugaacagauggccuuaua

SEQ ID NO: 1140706 - RNA, 19 nt, Homo sapiens
gcagcaaggcuuccauuga

SEQ ID NO: 1140707 - RNA, 19 nt, Homo sapiens
gaaggaagaaggaaugaag

SEQ ID NO: 1140708 - RNA, 19 nt, Homo sapiens
aagccgagcugcagucuga

SEQ ID NO: 1140709 - RNA, 19 nt, Homo sapiens
gcggauuacuucagauguu

SEQ ID NO: 1140710 - RNA, 19 nt, Homo sapiens
gagcugcagucugaagaaa

SEQ ID NO: 1140711 - RNA, 19 nt, Homo sapiens
gaucaccgacgccaagaaa

SEQ ID NO: 1140712 - RNA, 19 nt, Homo sapiens
ggacaaagugcccucaaag

SEQ ID NO: 1140713 - RNA, 19 nt, Homo sapiens
aaaccaaacugcacgacau

SEQ ID NO: 1140714 - RNA, 19 nt, Homo sapiens
gcaaacuuacggauuucua

SEQ ID NO: 1140715 - RNA, 19 nt, Homo sapiens
guacggagcgccaugaagu

SEQ ID NO: 1140716 - RNA, 19 nt, Homo sapiens
ccgaacaaaugcucuggaa

SEQ ID NO: 1140717 - RNA, 19 nt, Homo sapiens
ccacuuucccuucuucaaa

SEQ ID NO: 1140718 - RNA, 19 nt, Homo sapiens
ggaugcaacuagagagaca

SEQ ID NO: 1140719 - RNA, 19 nt, Homo sapiens
gcaacuagagagacaaauc

SEQ ID NO: 1140720 - RNA, 19 nt, Homo sapiens
cggauuacuucagauguuu

SEQ ID NO: 1140721 - RNA, 19 nt, Homo sapiens
agagacaaaucgccuagga

SEQ ID NO: 1140722 - RNA, 19 nt, Homo sapiens
cggcguaccucaccucauc

SEQ ID NO: 1140723 - RNA, 19 nt, Homo sapiens
gauugaaagugggaaggaa

SEQ ID NO: 1140724 - RNA, 19 nt, Homo sapiens
gaagaaaggaaaagaauag

SEQ ID NO: 1140725 - RNA, 19 nt, Homo sapiens
uaagaugccuuuucacugu

SEQ ID NO: 1140726 - RNA, 19 nt, Homo sapiens
aacagauggccuuauauua

SEQ ID NO: 1140727 - RNA, 19 nt, Homo sapiens
gaaaggaaaagaauagaug

SEQ ID NO: 1140728 - RNA, 19 nt, Homo sapiens
aaacuccacccucaucuug

SEQ ID NO: 1140729 - RNA, 19 nt, Homo sapiens
acagauggccuuauauuac

SEQ ID NO: 1140730 - RNA, 19 nt, Homo sapiens
uacaugagcccgaacaaau

SEQ ID NO: 1140731 - RNA, 19 nt, Homo sapiens
caggaaacgagaagagaaa

SEQ ID NO: 1140732 - RNA, 19 nt, Homo sapiens
gugccuuugugguggaaua

SEQ ID NO: 1140733 - RNA, 19 nt, Homo sapiens
gaacugccaaaccaaacug

SEQ ID NO: 1140734 - RNA, 19 nt, Homo sapiens
gagacaaaucgccuaggaa

SEQ ID NO: 1140735 - RNA, 19 nt, Homo sapiens
cuaggaagacugaucaauc

SEQ ID NO: 1140736 - RNA, 19 nt, Homo sapiens
gcugcagucugaagaaagg

SEQ ID NO: 1140737 - RNA, 19 nt, Homo sapiens
aggacaaagugcccucaaa

SEQ ID NO: 1140738 - RNA, 19 nt, Homo sapiens
ggaaggaagaaggaaugaa

SEQ ID NO: 1140739 - RNA, 19 nt, Homo sapiens
cuuagcggauuacuucaga

SEQ ID NO: 1140740 - RNA, 19 nt, Homo sapiens
ccacccucaucuugugauu

SEQ ID NO: 1140741 - RNA, 19 nt, Homo sapiens
gaaguccgaggaacagaag

SEQ ID NO: 1140742 - RNA, 19 nt, Homo sapiens
aagguggacuugaacagau

SEQ ID NO: 1140743 - RNA, 19 nt, Homo sapiens
ccuuuucacuguaguauuu

SEQ ID NO: 1140744 - RNA, 19 nt, Homo sapiens
gacaaaucgccuaggaaga

SEQ ID NO: 1140745 - RNA, 19 nt, Homo sapiens
gcaguacggagcgccauga

SEQ ID NO: 1140746 - RNA, 19 nt, Homo sapiens
gaaacgagaagagaaaaga

SEQ ID NO: 1140747 - RNA, 19 nt, Homo sapiens
cagauggccuuauauuacc

SEQ ID NO: 1140748 - RNA, 19 nt, Homo sapiens
gacaaagugcccucaaagg

SEQ ID NO: 1140749 - RNA, 19 nt, Homo sapiens
caacuagagagacaaaucg

SEQ ID NO: 1140750 - RNA, 19 nt, Homo sapiens
cugcguggaugcaacuaga

SEQ ID NO: 1140751 - RNA, 19 nt, Homo sapiens
cuacaugagcccgaacaaa

SEQ ID NO: 1140752 - RNA, 19 nt, Homo sapiens
aggaacagaagaucaaaga

SEQ ID NO: 1140753 - RNA, 19 nt, Homo sapiens
gaaagugggaaggaagaag

SEQ ID NO: 1140754 - RNA, 19 nt, Homo sapiens
gcagucugaagaaaggaaa

SEQ ID NO: 1140755 - RNA, 19 nt, Homo sapiens
aucgcaaacuuacggauuu

SEQ ID NO: 1140756 - RNA, 19 nt, Homo sapiens
ccacgggcugcuacaugua

SEQ ID NO: 1140757 - RNA, 19 nt, Homo sapiens
ggcagucaaagaucuauuc

SEQ ID NO: 1140758 - RNA, 19 nt, Homo sapiens
gggaaggaagaaggaauga

SEQ ID NO: 1140759 - RNA, 19 nt, Homo sapiens
ccgaggaacagaagaucaa

SEQ ID NO: 1140760 - RNA, 19 nt, Homo sapiens
acaugagcccgaacaaaug

SEQ ID NO: 1140761 - RNA, 19 nt, Homo sapiens
acaggaaacgagaagagaa

SEQ ID NO: 1140762 - RNA, 19 nt, Homo sapiens
uguuacagguuuccaaggu

SEQ ID NO: 1140763 - RNA, 19 nt, Homo sapiens
guauuuaccgggcagucaa

SEQ ID NO: 1140764 - RNA, 19 nt, Homo sapiens
agaaacgggaggcucugua

SEQ ID NO: 1140765 - RNA, 19 nt, Homo sapiens
uuacacaucacgaagucaa

SEQ ID NO: 1140766 - RNA, 19 nt, Homo sapiens
caaaucgccuaggaagacu

SEQ ID NO: 1140767 - RNA, 19 nt, Homo sapiens
uccacgggcugcuacaugu

SEQ ID NO: 1140768 - RNA, 19 nt, Homo sapiens
caaacuuacggauuucuac

SEQ ID NO: 1140769 - RNA, 19 nt, Homo sapiens
ugaaguccgaggaacagaa

SEQ ID NO: 1140770 - RNA, 19 nt, Homo sapiens
ggaacugccaaaccaaacu

SEQ ID NO: 1140771 - RNA, 19 nt, Homo sapiens
acaaaucgccuaggaagac

SEQ ID NO: 1140772 - RNA, 19 nt, Homo sapiens
gaacagagcacaauaagaa

SEQ ID NO: 1140773 - RNA, 19 nt, Homo sapiens
gagaagagcuugaaguugu

SEQ ID NO: 1140774 - RNA, 19 nt, Homo sapiens
ggaagugcguuuaugacaa

SEQ ID NO: 1140775 - RNA, 19 nt, Homo sapiens
gcggagcacuguucaauuc

SEQ ID NO: 1140776 - RNA, 19 nt, Homo sapiens
gaagugcguuuaugacaag

SEQ ID NO: 1140777 - RNA, 19 nt, Homo sapiens
gagcgugcgugcugaggua

SEQ ID NO: 1140778 - RNA, 19 nt, Homo sapiens
gagaagcuaugugaugcua

SEQ ID NO: 1140779 - RNA, 19 nt, Homo sapiens
caacucuggugaaaccuuu

SEQ ID NO: 1140780 - RNA, 19 nt, Homo sapiens
gaaaggacaaauggugaua

SEQ ID NO: 1140781 - RNA, 19 nt, Homo sapiens
gcagauguuuacuuggaaa

SEQ ID NO: 1140782 - RNA, 19 nt, Homo sapiens
uaucgaagcugccauaggu

SEQ ID NO: 1140783 - RNA, 19 nt, Homo sapiens
aaagagaccucgccucaag

SEQ ID NO: 1140784 - RNA, 19 nt, Homo sapiens
aaaugcagauguuuacuug

SEQ ID NO: 1140785 - RNA, 19 nt, Homo sapiens
ggacacacagaaauauaaa

SEQ ID NO: 1140786 - RNA, 19 nt, Homo sapiens
ggcacgcucugcauaauga

SEQ ID NO: 1140787 - RNA, 19 nt, Homo sapiens
ggucugaaaccuggucuua

SEQ ID NO: 1140788 - RNA, 19 nt, Homo sapiens
ggauaucgaagcugccaua

SEQ ID NO: 1140789 - RNA, 19 nt, Homo sapiens
gaacuuugagcauuuaucu

SEQ ID NO: 1140790 - RNA, 19 nt, Homo sapiens
gggacacacagaaauauaa

SEQ ID NO: 1140791 - RNA, 19 nt, Homo sapiens
cauaagaagcggaaagcua

SEQ ID NO: 1140792 - RNA, 19 nt, Homo sapiens
gaaggaaguggcagagaug

SEQ ID NO: 1140793 - RNA, 19 nt, Homo sapiens
gggagaagagcuugaaguu

SEQ ID NO: 1140794 - RNA, 19 nt, Homo sapiens
ggacaucgagcauaagaag

SEQ ID NO: 1140795 - RNA, 19 nt, Homo sapiens
aagaguggcugcugaaaca

SEQ ID NO: 1140796 - RNA, 19 nt, Homo sapiens
cuaaagguacuauuucuug

SEQ ID NO: 1140797 - RNA, 19 nt, Homo sapiens
auaagaagcggaaagcuaa

SEQ ID NO: 1140798 - RNA, 19 nt, Homo sapiens
acaccgaggaugcgauuua

SEQ ID NO: 1140799 - RNA, 19 nt, Homo sapiens
guuugaacuuugagcauuu

SEQ ID NO: 1140800 - RNA, 19 nt, Homo sapiens
aaggacaaauggugauauu

SEQ ID NO: 1140801 - RNA, 19 nt, Homo sapiens
gaaaggaaccaaggaaagg

SEQ ID NO: 1140802 - RNA, 19 nt, Homo sapiens
gaaccaaggaaaggacaaa

SEQ ID NO: 1140803 - RNA, 19 nt, Homo sapiens
gagacuacuuucagagaag

SEQ ID NO: 1140804 - RNA, 19 nt, Homo sapiens
ugagacuacuuucagagaa

SEQ ID NO: 1140805 - RNA, 19 nt, Homo sapiens
ggagaagagcuugaaguug

SEQ ID NO: 1140806 - RNA, 19 nt, Homo sapiens
cgaggaagacaucugguuu

SEQ ID NO: 1140807 - RNA, 19 nt, Homo sapiens
uaagaaaggaaccaaggaa

SEQ ID NO: 1140808 - RNA, 19 nt, Homo sapiens
caccgaggaugcgauuuaa

SEQ ID NO: 1140809 - RNA, 19 nt, Homo sapiens
gaggaagacaucugguuug

SEQ ID NO: 1140810 - RNA, 19 nt, Homo sapiens
gaggggacaucgagcauaa

SEQ ID NO: 1140811 - RNA, 19 nt, Homo sapiens
agaaggaaguggcagagau

SEQ ID NO: 1140812 - RNA, 19 nt, Homo sapiens
ggaacuagagccaggaaca

SEQ ID NO: 1140813 - RNA, 19 nt, Homo sapiens
ggaacagagcacaauaaga

SEQ ID NO: 1140814 - RNA, 19 nt, Homo sapiens
ccuccuuccucuugacuuu

SEQ ID NO: 1140815 - RNA, 19 nt, Homo sapiens
ggacccaccggauaucgaa

SEQ ID NO: 1140816 - RNA, 19 nt, Homo sapiens
gcacggugacugcgguuau

SEQ ID NO: 1140817 - RNA, 19 nt, Homo sapiens
caaaggcaccagaagacuu

SEQ ID NO: 1140818 - RNA, 19 nt, Homo sapiens
agaagagcuugaaguuguu

SEQ ID NO: 1140819 - RNA, 19 nt, Homo sapiens
aggaagacaucugguuuga

SEQ ID NO: 1140820 - RNA, 19 nt, Homo sapiens
gaccaggugucugcaguca

SEQ ID NO: 1140821 - RNA, 19 nt, Homo sapiens
ggaaaggacaaauggugau

SEQ ID NO: 1140822 - RNA, 19 nt, Homo sapiens
ccaaaauuauccagcaaaa

SEQ ID NO: 1140823 - RNA, 19 nt, Homo sapiens
gcagaggcuucuccccaua

SEQ ID NO: 1140824 - RNA, 19 nt, Homo sapiens
gaucacaucuccccagagu

SEQ ID NO: 1140825 - RNA, 19 nt, Homo sapiens
gcagggagaagagcuugaa

SEQ ID NO: 1140826 - RNA, 19 nt, Homo sapiens
guggaacagagcacaauaa

SEQ ID NO: 1140827 - RNA, 19 nt, Homo sapiens
gcugaagggcagaauucua

SEQ ID NO: 1140828 - RNA, 19 nt, Homo sapiens
ccaaggaaaggacaaaugg

SEQ ID NO: 1140829 - RNA, 19 nt, Homo sapiens
gaccucgccucaagugaag

SEQ ID NO: 1140830 - RNA, 19 nt, Homo sapiens
ucugaaaccuggucuuacu

SEQ ID NO: 1140831 - RNA, 19 nt, Homo sapiens
gguacuauuucuugaucau

SEQ ID NO: 1140832 - RNA, 19 nt, Homo sapiens
gggaagugcguuuaugaca

SEQ ID NO: 1140833 - RNA, 19 nt, Homo sapiens
gcaagaguggcugcugaaa

SEQ ID NO: 1140834 - RNA, 19 nt, Homo sapiens
gacgcucacucggaagaaa

SEQ ID NO: 1140835 - RNA, 19 nt, Homo sapiens
cguuugaacuuugagcauu

SEQ ID NO: 1140836 - RNA, 19 nt, Homo sapiens
ggucucuuccggagucuuu

SEQ ID NO: 1140837 - RNA, 19 nt, Homo sapiens
uuucaagagucaaguaaag

SEQ ID NO: 1140838 - RNA, 19 nt, Homo sapiens
gaagggcagaauucuagug

SEQ ID NO: 1140839 - RNA, 19 nt, Homo sapiens
augcagauguuuacuugga

SEQ ID NO: 1140840 - RNA, 19 nt, Homo sapiens
cggccaagauagcgaggaa

SEQ ID NO: 1140841 - RNA, 19 nt, Homo sapiens
gaguggcugcugaaacaaa

SEQ ID NO: 1140842 - RNA, 19 nt, Homo sapiens
gagcauaagaagcggaaag

SEQ ID NO: 1140843 - RNA, 19 nt, Homo sapiens
gaggagaugccggcaggaa

SEQ ID NO: 1140844 - RNA, 19 nt, Homo sapiens
ggagcacuguucaauucag

SEQ ID NO: 1140845 - RNA, 19 nt, Homo sapiens
auaaaccuuucaagaguca

SEQ ID NO: 1140846 - RNA, 19 nt, Homo sapiens
uaugggaagugcguuuaug

SEQ ID NO: 1140847 - RNA, 19 nt, Homo sapiens
aagaaaggaaccaaggaaa

SEQ ID NO: 1140848 - RNA, 19 nt, Homo sapiens
gagcacaauaagaaaggaa

SEQ ID NO: 1140849 - RNA, 19 nt, Homo sapiens
uuacuguccauguguguuu

SEQ ID NO: 1140850 - RNA, 19 nt, Homo sapiens
agaaaagccucuugucauc

SEQ ID NO: 1140851 - RNA, 19 nt, Homo sapiens
gcagugacgacgccuagca

SEQ ID NO: 1140852 - RNA, 19 nt, Homo sapiens
cgggacacacagaaauaua

SEQ ID NO: 1140853 - RNA, 19 nt, Homo sapiens
gacaaguacgucaaaccaa

SEQ ID NO: 1140854 - RNA, 19 nt, Homo sapiens
cacggugacugcgguuauu

SEQ ID NO: 1140855 - RNA, 19 nt, Homo sapiens
gcaacucuggugaaaccuu

SEQ ID NO: 1140856 - RNA, 19 nt, Homo sapiens
agacuacuuucagagaaga

SEQ ID NO: 1140857 - RNA, 19 nt, Homo sapiens
aagguacuauuucuugauc

SEQ ID NO: 1140858 - RNA, 19 nt, Homo sapiens
gccucagccucgugaaaga

SEQ ID NO: 1140859 - RNA, 19 nt, Homo sapiens
gaacuagagccaggaacag

SEQ ID NO: 1140860 - RNA, 19 nt, Homo sapiens
ggcuguacgucauggugaa

SEQ ID NO: 1140861 - RNA, 19 nt, Homo sapiens
gaaccucaagcagggagaa

SEQ ID NO: 1140862 - RNA, 19 nt, Homo sapiens
caagauagcgaggaaacag

SEQ ID NO: 1140863 - RNA, 19 nt, Homo sapiens
ggagaugccggcaggaaaa

SEQ ID NO: 1140864 - RNA, 19 nt, Homo sapiens
gcacuguucaauucaggau

SEQ ID NO: 1140865 - RNA, 19 nt, Homo sapiens
agaccucgccucaagugaa

SEQ ID NO: 1140866 - RNA, 19 nt, Homo sapiens
agaaaggaaccaaggaaag

SEQ ID NO: 1140867 - RNA, 19 nt, Homo sapiens
gcuaagccggguccuguca

SEQ ID NO: 1140868 - RNA, 19 nt, Homo sapiens
ggucuuacuguccaugugu

SEQ ID NO: 1140869 - RNA, 19 nt, Homo sapiens
cugaagggcagaauucuag

SEQ ID NO: 1140870 - RNA, 19 nt, Homo sapiens
ccuuagccuuggacuguga

SEQ ID NO: 1140871 - RNA, 19 nt, Homo sapiens
gggcagacacaccgaggau

SEQ ID NO: 1140872 - RNA, 19 nt, Homo sapiens
ggagguggccuauaacuua

SEQ ID NO: 1140873 - RNA, 19 nt, Homo sapiens
gacaggagguggccuauaa

SEQ ID NO: 1140874 - RNA, 19 nt, Homo sapiens
caacauagcaccuguagau

SEQ ID NO: 1140875 - RNA, 19 nt, Homo sapiens
gagauggcguuuaaugauu

SEQ ID NO: 1140876 - RNA, 19 nt, Homo sapiens
gauggcagacucuuuaaua

SEQ ID NO: 1140877 - RNA, 19 nt, Homo sapiens
agagugagauggcguuuaa

SEQ ID NO: 1140878 - RNA, 19 nt, Homo sapiens
ggaaaugacacauacagaa

SEQ ID NO: 1140879 - RNA, 19 nt, Homo sapiens
gauaaguaccguugaguuu

SEQ ID NO: 1140880 - RNA, 19 nt, Homo sapiens
gaaaugacacauacagaau

SEQ ID NO: 1140881 - RNA, 19 nt, Homo sapiens
ggucagaguuuguaauugg

SEQ ID NO: 1140882 - RNA, 19 nt, Homo sapiens
caacaacugugaacauuuu

SEQ ID NO: 1140883 - RNA, 19 nt, Homo sapiens
ugaaggauguugugggaaa

SEQ ID NO: 1140884 - RNA, 19 nt, Homo sapiens
gccuauaacuuacuuguca

SEQ ID NO: 1140885 - RNA, 19 nt, Homo sapiens
aaaugcagcucuugaagga

SEQ ID NO: 1140886 - RNA, 19 nt, Homo sapiens
aaugauugcuucaguuuga

SEQ ID NO: 1140887 - RNA, 19 nt, Homo sapiens
gcacugggcccuguacuug

SEQ ID NO: 1140888 - RNA, 19 nt, Homo sapiens
guacuugggugaugguuac

SEQ ID NO: 1140889 - RNA, 19 nt, Homo sapiens
uaaguaccguugaguuugu

SEQ ID NO: 1140890 - RNA, 19 nt, Homo sapiens
gcaguaaggcccuggugaa

SEQ ID NO: 1140891 - RNA, 19 nt, Homo sapiens
caucauuacuguuccagau

SEQ ID NO: 1140892 - RNA, 19 nt, Homo sapiens
gucaacaacugugaacauu

SEQ ID NO: 1140893 - RNA, 19 nt, Homo sapiens
ugacauugcuucgcuaugg

SEQ ID NO: 1140894 - RNA, 19 nt, Homo sapiens
ucauaaagcggucagaguu

SEQ ID NO: 1140895 - RNA, 19 nt, Homo sapiens
gaaggauguugugggaaau

SEQ ID NO: 1140896 - RNA, 19 nt, Homo sapiens
cauaaagcggucagaguuu

SEQ ID NO: 1140897 - RNA, 19 nt, Homo sapiens
guaaggcccuggugaaaau

SEQ ID NO: 1140898 - RNA, 19 nt, Homo sapiens
ggacaggagguggccuaua

SEQ ID NO: 1140899 - RNA, 19 nt, Homo sapiens
gcggucagaguuuguaauu

SEQ ID NO: 1140900 - RNA, 19 nt, Homo sapiens
auaaagcggucagaguuug

SEQ ID NO: 1140901 - RNA, 19 nt, Homo sapiens
agauggcguuuaaugauug

SEQ ID NO: 1140902 - RNA, 19 nt, Homo sapiens
ucauuacuguuccagauuc

SEQ ID NO: 1140903 - RNA, 19 nt, Homo sapiens
gccaaccgagcgauaagua

SEQ ID NO: 1140904 - RNA, 19 nt, Homo sapiens
ugagauggcguuuaaugau

SEQ ID NO: 1140905 - RNA, 19 nt, Homo sapiens
gugagauggcguuuaauga

SEQ ID NO: 1140906 - RNA, 19 nt, Homo sapiens
gagguggccuauaacuuac

SEQ ID NO: 1140907 - RNA, 19 nt, Homo sapiens
auggcagacucuuuaauaa

SEQ ID NO: 1140908 - RNA, 19 nt, Homo sapiens
gcaggccaaccgagcgaua

SEQ ID NO: 1140909 - RNA, 19 nt, Homo sapiens
gacauugcuucgcuaugga

SEQ ID NO: 1140910 - RNA, 19 nt, Homo sapiens
gagagugagauggcguuua

SEQ ID NO: 1140911 - RNA, 19 nt, Homo sapiens
ucaacaacugugaacauuu

SEQ ID NO: 1140912 - RNA, 19 nt, Homo sapiens
caauaaauacgaugaaacg

SEQ ID NO: 1140913 - RNA, 19 nt, Homo sapiens
gauggauggcagacucuuu

SEQ ID NO: 1140914 - RNA, 19 nt, Homo sapiens
gggaaaugacacauacaga

SEQ ID NO: 1140915 - RNA, 19 nt, Homo sapiens
cgauaaguaccguugaguu

SEQ ID NO: 1140916 - RNA, 19 nt, Homo sapiens
aaccuggggugaauacuua

SEQ ID NO: 1140917 - RNA, 19 nt, Homo sapiens
ugguuacguuaucaacaua

SEQ ID NO: 1140918 - RNA, 19 nt, Homo sapiens
guuuaaugauugcuucagu

SEQ ID NO: 1140919 - RNA, 19 nt, Homo sapiens
uggcauuccugcguccuuu

SEQ ID NO: 1140920 - RNA, 19 nt, Homo sapiens
aaagaaaccuggggugaau

SEQ ID NO: 1140921 - RNA, 19 nt, Homo sapiens
ggacaaagagcaaaauacu

SEQ ID NO: 1140922 - RNA, 19 nt, Homo sapiens
gcugcgaggccaagagaga

SEQ ID NO: 1140923 - RNA, 19 nt, Homo sapiens
gguggccuauaacuuacuu

SEQ ID NO: 1140924 - RNA, 19 nt, Homo sapiens
caguaaggcccuggugaaa

SEQ ID NO: 1140925 - RNA, 19 nt, Homo sapiens
auggauggcagacucuuua

SEQ ID NO: 1140926 - RNA, 19 nt, Homo sapiens
guuccagauuccuaugaug

SEQ ID NO: 1140927 - RNA, 19 nt, Homo sapiens
gugaacauuuugugacauu

SEQ ID NO: 1140928 - RNA, 19 nt, Homo sapiens
ugacacauacagaauaaac

SEQ ID NO: 1140929 - RNA, 19 nt, Homo sapiens
ccuauaacuuacuugucaa

SEQ ID NO: 1140930 - RNA, 19 nt, Homo sapiens
ccagauuccuaugauggau

SEQ ID NO: 1140931 - RNA, 19 nt, Homo sapiens
uuccugggcuuguuuccaa

SEQ ID NO: 1140932 - RNA, 19 nt, Homo sapiens
gggugaugguuacguuauc

SEQ ID NO: 1140933 - RNA, 19 nt, Homo sapiens
uuacaagcgccaagucugu

SEQ ID NO: 1140934 - RNA, 19 nt, Homo sapiens
ggauggcagacucuuuaau

SEQ ID NO: 1140935 - RNA, 19 nt, Homo sapiens
ucucauuccugggcuuguu

SEQ ID NO: 1140936 - RNA, 19 nt, Homo sapiens
gagcgauaaguaccguuga

SEQ ID NO: 1140937 - RNA, 19 nt, Homo sapiens
gucagaguuuguaauugga

SEQ ID NO: 1140938 - RNA, 19 nt, Homo sapiens
gaugguuacguuaucaaca

SEQ ID NO: 1140939 - RNA, 19 nt, Homo sapiens
gaaaaugcagcucuugaag

SEQ ID NO: 1140940 - RNA, 19 nt, Homo sapiens
gcccuguacuugggugaug

SEQ ID NO: 1140941 - RNA, 19 nt, Homo sapiens
gaauuugggaggaggaaaa

SEQ ID NO: 1140942 - RNA, 19 nt, Homo sapiens
aagucuguauucagcagua

SEQ ID NO: 1140943 - RNA, 19 nt, Homo sapiens
gauguugugggaaaugaca

SEQ ID NO: 1140944 - RNA, 19 nt, Homo sapiens
ggcauuccugcguccuuua

SEQ ID NO: 1140945 - RNA, 19 nt, Homo sapiens
cagcugcgaggccaagaga

SEQ ID NO: 1140946 - RNA, 19 nt, Homo sapiens
uaucaacauagcaccugua

SEQ ID NO: 1140947 - RNA, 19 nt, Homo sapiens
gaacugaggaagauuauaa

SEQ ID NO: 1140948 - RNA, 19 nt, Homo sapiens
gaauggaacugaggaagau

SEQ ID NO: 1140949 - RNA, 19 nt, Homo sapiens
gagacuguccugaaagaaa

SEQ ID NO: 1140950 - RNA, 19 nt, Homo sapiens
uaaccaagcaccagaccua

SEQ ID NO: 1140951 - RNA, 19 nt, Homo sapiens
ggaauggaacugaggaaga

SEQ ID NO: 1140952 - RNA, 19 nt, Homo sapiens
gaggaagauuauaacuuug

SEQ ID NO: 1140953 - RNA, 19 nt, Homo sapiens
gcccuggacucuaccaaug

SEQ ID NO: 1140954 - RNA, 19 nt, Homo sapiens
gaccuuuccuugcccuuug

SEQ ID NO: 1140955 - RNA, 19 nt, Homo sapiens
gcauugagcaacacacaga

SEQ ID NO: 1140956 - RNA, 19 nt, Homo sapiens
ccucuuggcugcagaaguc

SEQ ID NO: 1140957 - RNA, 19 nt, Homo sapiens
agacuguccugaaagaaau

SEQ ID NO: 1140958 - RNA, 19 nt, Homo sapiens
ggaagauuauaacuuuguc

SEQ ID NO: 1140959 - RNA, 19 nt, Homo sapiens
gcccuuugguuccagauau

SEQ ID NO: 1140960 - RNA, 19 nt, Homo sapiens
gggagaagagggccuguug

SEQ ID NO: 1140961 - RNA, 19 nt, Homo sapiens
aagagggccuguugcauca

SEQ ID NO: 1140962 - RNA, 19 nt, Homo sapiens
gagaagagggccuguugca

SEQ ID NO: 1140963 - RNA, 19 nt, Homo sapiens
ccucagcccuggacucuac

SEQ ID NO: 1140964 - RNA, 19 nt, Homo sapiens
cuucaugcccuaucacaaa

SEQ ID NO: 1140965 - RNA, 19 nt, Homo sapiens
ggaccaaugccaucacucu

SEQ ID NO: 1140966 - RNA, 19 nt, Homo sapiens
gaagguguccaagcagaga

SEQ ID NO: 1140967 - RNA, 19 nt, Homo sapiens
gagcaacacacagauuugu

SEQ ID NO: 1140968 - RNA, 19 nt, Homo sapiens
uuugagagcugaggguuga

SEQ ID NO: 1140969 - RNA, 19 nt, Homo sapiens
ugaggaggcccgaauguuc

SEQ ID NO: 1140970 - RNA, 19 nt, Homo sapiens
gcugaggguugagggcauu

SEQ ID NO: 1140971 - RNA, 19 nt, Homo sapiens
gaacagcauccggaccaau

SEQ ID NO: 1140972 - RNA, 19 nt, Homo sapiens
gggaagaccaaucuacucu

SEQ ID NO: 1140973 - RNA, 19 nt, Homo sapiens
ggaacugaggaagauuaua

SEQ ID NO: 1140974 - RNA, 19 nt, Homo sapiens
ggaccuuuccuugcccuuu

SEQ ID NO: 1140975 - RNA, 19 nt, Homo sapiens
uugagacuguccugaaaga

SEQ ID NO: 1140976 - RNA, 19 nt, Homo sapiens
cuuugagacuguccugaaa

SEQ ID NO: 1140977 - RNA, 19 nt, Homo sapiens
ccuggacucuaccaauguu

SEQ ID NO: 1140978 - RNA, 19 nt, Homo sapiens
uugcgaagguguccaagca

SEQ ID NO: 1140979 - RNA, 19 nt, Homo sapiens
ccacugaggaggcccgaau

SEQ ID NO: 1140980 - RNA, 19 nt, Homo sapiens
ggcugaaggagcucuauga

SEQ ID NO: 1140981 - RNA, 19 nt, Homo sapiens
auguugagcuagccuuuga

SEQ ID NO: 1140982 - RNA, 19 nt, Homo sapiens
caauguugagcuagccuuu

SEQ ID NO: 1140983 - RNA, 19 nt, Homo sapiens
gaaggagcucuaugaccau

SEQ ID NO: 1140984 - RNA, 19 nt, Homo sapiens
gauucacgcgcaaugaguu

SEQ ID NO: 1140985 - RNA, 19 nt, Homo sapiens
gcucuaugaccaugcugaa

SEQ ID NO: 1140986 - RNA, 19 nt, Homo sapiens
ggagcucuaugaccaugcu

SEQ ID NO: 1140987 - RNA, 19 nt, Homo sapiens
cacccgcacugugauguug

SEQ ID NO: 1140988 - RNA, 19 nt, Homo sapiens
ugagcuagccuuugagacu

SEQ ID NO: 1140989 - RNA, 19 nt, Homo sapiens
ccaagcaccagaccuaugc

SEQ ID NO: 1140990 - RNA, 19 nt, Homo sapiens
uugagcaacacacagauuu

SEQ ID NO: 1140991 - RNA, 19 nt, Homo sapiens
acaauggacugcucuuccu

SEQ ID NO: 1140992 - RNA, 19 nt, Homo sapiens
ugagcaacacacagauuug

SEQ ID NO: 1140993 - RNA, 19 nt, Homo sapiens
gggcauugagcaacacaca

SEQ ID NO: 1140994 - RNA, 19 nt, Homo sapiens
ggaaagaacuuaaacaaag

SEQ ID NO: 1140995 - RNA, 19 nt, Homo sapiens
aaacaaaucuucagaguga

SEQ ID NO: 1140996 - RNA, 19 nt, Homo sapiens
gaaugcaucugaccgauuu

SEQ ID NO: 1140997 - RNA, 19 nt, Homo sapiens
gaaauacgaccacaaauuc

SEQ ID NO: 1140998 - RNA, 19 nt, Homo sapiens
gaaaugggcaugcugaauu

SEQ ID NO: 1140999 - RNA, 19 nt, Homo sapiens
ggagaacugugaaagauau

SEQ ID NO: 1141000 - RNA, 19 nt, Homo sapiens
ggaucaaacucgccauuaa

SEQ ID NO: 1141001 - RNA, 19 nt, Homo sapiens
gaacaagggcaaagacauu

SEQ ID NO: 1141002 - RNA, 19 nt, Homo sapiens
ucacggagcugcugcugaa

SEQ ID NO: 1141003 - RNA, 19 nt, Homo sapiens
ugaaggaaaucaagcaaga

SEQ ID NO: 1141004 - RNA, 19 nt, Homo sapiens
ggaaugauuugguccgaau

SEQ ID NO: 1141005 - RNA, 19 nt, Homo sapiens
gaaguuaucuaugcaaugc

SEQ ID NO: 1141006 - RNA, 19 nt, Homo sapiens
caaacucgccauuaaauau

SEQ ID NO: 1141007 - RNA, 19 nt, Homo sapiens
gaucaaacucgccauuaaa

SEQ ID NO: 1141008 - RNA, 19 nt, Homo sapiens
cagaagagguggaagcaau

SEQ ID NO: 1141009 - RNA, 19 nt, Homo sapiens
ccaagacccuuaacuucaa

SEQ ID NO: 1141010 - RNA, 19 nt, Homo sapiens
gagaagggcaccagucuga

SEQ ID NO: 1141011 - RNA, 19 nt, Homo sapiens
cggcuuaucugaaguaauc

SEQ ID NO: 1141012 - RNA, 19 nt, Homo sapiens
ugaaauacgaccacaaauu

SEQ ID NO: 1141013 - RNA, 19 nt, Homo sapiens
uguggaaccugcuagauuu

SEQ ID NO: 1141014 - RNA, 19 nt, Homo sapiens
caacauugagacugaauuu

SEQ ID NO: 1141015 - RNA, 19 nt, Homo sapiens
gcgagaaguuuggaaagaa

SEQ ID NO: 1141016 - RNA, 19 nt, Homo sapiens
gaggagcccuuucaugaag

SEQ ID NO: 1141017 - RNA, 19 nt, Homo sapiens
gaaauuccuggcugucuuu

SEQ ID NO: 1141018 - RNA, 19 nt, Homo sapiens
guuuguagcucaugcaguu

SEQ ID NO: 1141019 - RNA, 19 nt, Homo sapiens
ugagcaagcccaccagaua

SEQ ID NO: 1141020 - RNA, 19 nt, Homo sapiens
gaacucuaccugcuccuuu

SEQ ID NO: 1141021 - RNA, 19 nt, Homo sapiens
acacaacgcugagggagaa

SEQ ID NO: 1141022 - RNA, 19 nt, Homo sapiens
caaauacaacccagcguuu

SEQ ID NO: 1141023 - RNA, 19 nt, Homo sapiens
gcugaaauacgaccacaaa

SEQ ID NO: 1141024 - RNA, 19 nt, Homo sapiens
uguucaaccuguacucuua

SEQ ID NO: 1141025 - RNA, 19 nt, Homo sapiens
gagcuucucucgcauugca

SEQ ID NO: 1141026 - RNA, 19 nt, Homo sapiens
gaacgauuacaggaaguua

SEQ ID NO: 1141027 - RNA, 19 nt, Homo sapiens
uggcagaccugauucaaca

SEQ ID NO: 1141028 - RNA, 19 nt, Homo sapiens
gaagugggucuuaggaaug

SEQ ID NO: 1141029 - RNA, 19 nt, Homo sapiens
gcaaugagugcaccgagaa

SEQ ID NO: 1141030 - RNA, 19 nt, Homo sapiens
ugacagcaaauaacacuuu

SEQ ID NO: 1141031 - RNA, 19 nt, Homo sapiens
ugaagugggucuuaggaau

SEQ ID NO: 1141032 - RNA, 19 nt, Homo sapiens
ggaaaucaagcaagauauc

SEQ ID NO: 1141033 - RNA, 19 nt, Homo sapiens
gaagagguggaagcaauuu

SEQ ID NO: 1141034 - RNA, 19 nt, Homo sapiens
uagccaacauugagacuga

SEQ ID NO: 1141035 - RNA, 19 nt, Homo sapiens
gaagggcucuacgcgauag

SEQ ID NO: 1141036 - RNA, 19 nt, Homo sapiens
caaacgaaaccuucacaga

SEQ ID NO: 1141037 - RNA, 19 nt, Homo sapiens
ggcgagugcugccuacuug

SEQ ID NO: 1141038 - RNA, 19 nt, Homo sapiens
ggaagggcucuacgcgaua

SEQ ID NO: 1141039 - RNA, 19 nt, Homo sapiens
ucaaacucgccauuaaaua

SEQ ID NO: 1141040 - RNA, 19 nt, Homo sapiens
caugaacgccuacaaagga

SEQ ID NO: 1141041 - RNA, 19 nt, Homo sapiens
aaagauacguccugaaagc

SEQ ID NO: 1141042 - RNA, 19 nt, Homo sapiens
gaaaaucugacagcaaaua

SEQ ID NO: 1141043 - RNA, 19 nt, Homo sapiens
cgagaacauuggcuacguu

SEQ ID NO: 1141044 - RNA, 19 nt, Homo sapiens
cuaccgaggugccaaauac

SEQ ID NO: 1141045 - RNA, 19 nt, Homo sapiens
gggagaacugugaaagaua

SEQ ID NO: 1141046 - RNA, 19 nt, Homo sapiens
agacugaauuuaagaacga

SEQ ID NO: 1141047 - RNA, 19 nt, Homo sapiens
gccaaaagcugugaaaaug

SEQ ID NO: 1141048 - RNA, 19 nt, Homo sapiens
gcaaaacucuggcugucuu

SEQ ID NO: 1141049 - RNA, 19 nt, Homo sapiens
gaaguucgcccgagcaaaa

SEQ ID NO: 1141050 - RNA, 19 nt, Homo sapiens
gcgcaugaacgccuacaaa

SEQ ID NO: 1141051 - RNA, 19 nt, Homo sapiens
uuacuuugaugaaggaaga

SEQ ID NO: 1141052 - RNA, 19 nt, Homo sapiens
ugaaauuccuggcugucuu

SEQ ID NO: 1141053 - RNA, 19 nt, Homo sapiens
ggagcucagcaacgaguua

SEQ ID NO: 1141054 - RNA, 19 nt, Homo sapiens
cugaggagcccuuucauga

SEQ ID NO: 1141055 - RNA, 19 nt, Homo sapiens
aaggaaaucaagcaagaua

SEQ ID NO: 1141056 - RNA, 19 nt, Homo sapiens
aaaugggcaugcugaauuc

SEQ ID NO: 1141057 - RNA, 19 nt, Homo sapiens
aucaagaugugccucauaa

SEQ ID NO: 1141058 - RNA, 19 nt, Homo sapiens
ggaugcagauguggaaugg

SEQ ID NO: 1141059 - RNA, 19 nt, Homo sapiens
aaauacaacccagcguuua

SEQ ID NO: 1141060 - RNA, 19 nt, Homo sapiens
aaggcgagcugaaggaaau

SEQ ID NO: 1141061 - RNA, 19 nt, Homo sapiens
uaaugagaaucaagaugug

SEQ ID NO: 1141062 - RNA, 19 nt, Homo sapiens
ggaggaugcagauguggaa

SEQ ID NO: 1141063 - RNA, 19 nt, Homo sapiens
ccacggaggcacagcugua

SEQ ID NO: 1141064 - RNA, 19 nt, Homo sapiens
caaaacaaaucuucagagu

SEQ ID NO: 1141065 - RNA, 19 nt, Homo sapiens
gcgcgacgacgacuucuau

SEQ ID NO: 1141066 - RNA, 19 nt, Homo sapiens
gaaggcgagcugaaggaaa

SEQ ID NO: 1141067 - RNA, 19 nt, Homo sapiens
ugaggaggaugcagaugug

SEQ ID NO: 1141068 - RNA, 19 nt, Homo sapiens
ggagcccuuucaugaaguu

SEQ ID NO: 1141069 - RNA, 19 nt, Homo sapiens
gaaaaucucucaggcuuac

SEQ ID NO: 1141070 - RNA, 19 nt, Homo sapiens
gaaaucaagcaagauaucu

SEQ ID NO: 1141071 - RNA, 19 nt, Homo sapiens
gaggaacagcaccuucaaa

SEQ ID NO: 1141072 - RNA, 19 nt, Homo sapiens
gcaacgaguuagccagacu

SEQ ID NO: 1141073 - RNA, 19 nt, Homo sapiens
gaaaaugaccuugaaaugg

SEQ ID NO: 1141074 - RNA, 19 nt, Homo sapiens
gauuauuaguugugaaugc

SEQ ID NO: 1141075 - RNA, 19 nt, Homo sapiens
gaaguucguugcucauccu

SEQ ID NO: 1141076 - RNA, 19 nt, Homo sapiens
caaauucaucgagaacauu

SEQ ID NO: 1141077 - RNA, 19 nt, Homo sapiens
acaaauucaucgagaacau

SEQ ID NO: 1141078 - RNA, 19 nt, Homo sapiens
gucuaucgcugugaaauuc

SEQ ID NO: 1141079 - RNA, 19 nt, Homo sapiens
gccauuaaauaugaaguca

SEQ ID NO: 1141080 - RNA, 19 nt, Homo sapiens
aaacggugaugugaacuuc

SEQ ID NO: 1141081 - RNA, 19 nt, Homo sapiens
ggaaguuaucuaugcaaug

SEQ ID NO: 1141082 - RNA, 19 nt, Homo sapiens
cauugagacugaauuuaag

SEQ ID NO: 1141083 - RNA, 19 nt, Homo sapiens
gaggaguccaagacccuua

SEQ ID NO: 1141084 - RNA, 19 nt, Homo sapiens
cggagcugcugcugaagaa

SEQ ID NO: 1141085 - RNA, 19 nt, Homo sapiens
cugcaaaucuaaggccaaa

SEQ ID NO: 1141086 - RNA, 19 nt, Homo sapiens
augcagauguggaauggaa

SEQ ID NO: 1141087 - RNA, 19 nt, Homo sapiens
cauauucggcuuaucugaa

SEQ ID NO: 1141088 - RNA, 19 nt, Homo sapiens
ugaccgauuugaagguguu

SEQ ID NO: 1141089 - RNA, 19 nt, Homo sapiens
cgacaucacgcccaucauc

SEQ ID NO: 1141090 - RNA, 19 nt, Homo sapiens
gagcaagcccaccagauac

SEQ ID NO: 1141091 - RNA, 19 nt, Homo sapiens
gaaucaagaugugccucau

SEQ ID NO: 1141092 - RNA, 19 nt, Homo sapiens
gaugaaggaagaacucuac

SEQ ID NO: 1141093 - RNA, 19 nt, Homo sapiens
cuaauagccaugauaaaca

SEQ ID NO: 1141094 - RNA, 19 nt, Homo sapiens
gggaggaccugcaacauuu

SEQ ID NO: 1141095 - RNA, 19 nt, Homo sapiens
ggauguagcccuuauuuaa

SEQ ID NO: 1141096 - RNA, 19 nt, Homo sapiens
gcacaggacccacagauau

SEQ ID NO: 1141097 - RNA, 19 nt, Homo sapiens
cauccagucuuucuacaua

SEQ ID NO: 1141098 - RNA, 19 nt, Homo sapiens
gcuguuggcugcaguauuc

SEQ ID NO: 1141099 - RNA, 19 nt, Homo sapiens
cgacauugguuauaacuuc

SEQ ID NO: 1141100 - RNA, 19 nt, Homo sapiens
acucauagcuggacauuca

SEQ ID NO: 1141101 - RNA, 19 nt, Homo sapiens
ccaagggccuccaaacuca

SEQ ID NO: 1141102 - RNA, 19 nt, Homo sapiens
gaacaaaacacaagcuaaa

SEQ ID NO: 1141103 - RNA, 19 nt, Homo sapiens
gcuacuugguugugaguuu

SEQ ID NO: 1141104 - RNA, 19 nt, Homo sapiens
cagcuuggcucaacaccuu

SEQ ID NO: 1141105 - RNA, 19 nt, Homo sapiens
ggagaccacuguccaggau

SEQ ID NO: 1141106 - RNA, 19 nt, Homo sapiens
cuacugauguuuauuagag

SEQ ID NO: 1141107 - RNA, 19 nt, Homo sapiens
caccuggccucauuucaaa

SEQ ID NO: 1141108 - RNA, 19 nt, Homo sapiens
caacaucucccugggcuuu

SEQ ID NO: 1141109 - RNA, 19 nt, Homo sapiens
cauccacacucuccagauu

SEQ ID NO: 1141110 - RNA, 19 nt, Homo sapiens
gaaauuuaauggguucuac

SEQ ID NO: 1141111 - RNA, 19 nt, Homo sapiens
cagcagugucugaaauuua

SEQ ID NO: 1141112 - RNA, 19 nt, Homo sapiens
gcaccuggccucauuucaa

SEQ ID NO: 1141113 - RNA, 19 nt, Homo sapiens
gaagguguuggcuggaaua

SEQ ID NO: 1141114 - RNA, 19 nt, Homo sapiens
ggugugauguggccuacaa

SEQ ID NO: 1141115 - RNA, 19 nt, Homo sapiens
ccagauuucuucucuccuu

SEQ ID NO: 1141116 - RNA, 19 nt, Homo sapiens
caugcgacauugguuauaa

SEQ ID NO: 1141117 - RNA, 19 nt, Homo sapiens
gcucaagucaugcgacauu

SEQ ID NO: 1141118 - RNA, 19 nt, Homo sapiens
aacacaagcuaaacaggua

SEQ ID NO: 1141119 - RNA, 19 nt, Homo sapiens
gauguagcccuuauuuaau

SEQ ID NO: 1141120 - RNA, 19 nt, Homo sapiens
cagauuucuucucuccuua

SEQ ID NO: 1141121 - RNA, 19 nt, Homo sapiens
uagacaggcucaagucaug

SEQ ID NO: 1141122 - RNA, 19 nt, Homo sapiens
ccagugaauguccuuguua

SEQ ID NO: 1141123 - RNA, 19 nt, Homo sapiens
agcagugucugaaauuuaa

SEQ ID NO: 1141124 - RNA, 19 nt, Homo sapiens
guaccugacucccaacuac

SEQ ID NO: 1141125 - RNA, 19 nt, Homo sapiens
ugaauguccuuguuauaca

SEQ ID NO: 1141126 - RNA, 19 nt, Homo sapiens
cgaaguauggcaucauuau

SEQ ID NO: 1141127 - RNA, 19 nt, Homo sapiens
gaacugcaggcccaucaug

SEQ ID NO: 1141128 - RNA, 19 nt, Homo sapiens
cuuccuugcuuacacauaa

SEQ ID NO: 1141129 - RNA, 19 nt, Homo sapiens
uuaauggguucuacugaug

SEQ ID NO: 1141130 - RNA, 19 nt, Homo sapiens
gaggaacuguguuuuauuc

SEQ ID NO: 1141131 - RNA, 19 nt, Homo sapiens
gcugguucuuguuucauuu

SEQ ID NO: 1141132 - RNA, 19 nt, Homo sapiens
agacaagccugaagaagcu

SEQ ID NO: 1141133 - RNA, 19 nt, Homo sapiens
gguguuggcuggaauaucc

SEQ ID NO: 1141134 - RNA, 19 nt, Homo sapiens
gaacaucucccagcucacu

SEQ ID NO: 1141135 - RNA, 19 nt, Homo sapiens
ggacauccagucuuucuac

SEQ ID NO: 1141136 - RNA, 19 nt, Homo sapiens
gccagugaauguccuuguu

SEQ ID NO: 1141137 - RNA, 19 nt, Homo sapiens
gggcaggcuuuguacaaca

SEQ ID NO: 1141138 - RNA, 19 nt, Homo sapiens
ccugcaacauuucugauga

SEQ ID NO: 1141139 - RNA, 19 nt, Homo sapiens
ggaccugcaacauuucuga

SEQ ID NO: 1141140 - RNA, 19 nt, Homo sapiens
caacaacagugggugugau

SEQ ID NO: 1141141 - RNA, 19 nt, Homo sapiens
ugucuauccuugcuacuug

SEQ ID NO: 1141142 - RNA, 19 nt, Homo sapiens
gcgaaguauggcaucauua

SEQ ID NO: 1141143 - RNA, 19 nt, Homo sapiens
cagugaauguccuuguuau

SEQ ID NO: 1141144 - RNA, 19 nt, Homo sapiens
gaacuguguuuuauucauc

SEQ ID NO: 1141145 - RNA, 19 nt, Homo sapiens
gacaaugggcugguucuug

SEQ ID NO: 1141146 - RNA, 19 nt, Homo sapiens
gacauucacagcccucuga

SEQ ID NO: 1141147 - RNA, 19 nt, Homo sapiens
uccaguaccuauuugagaa

SEQ ID NO: 1141148 - RNA, 19 nt, Homo sapiens
agaccacuguccaggauga

SEQ ID NO: 1141149 - RNA, 19 nt, Homo sapiens
cagcugaccacgccaguga

SEQ ID NO: 1141150 - RNA, 19 nt, Homo sapiens
uuucuucucuccuuacuuc

SEQ ID NO: 1141151 - RNA, 19 nt, Homo sapiens
gaaguauggcaucauuauc

SEQ ID NO: 1141152 - RNA, 19 nt, Homo sapiens
cagaagacaagccugaaga

SEQ ID NO: 1141153 - RNA, 19 nt, Homo sapiens
gggcuccaguaccuauuug

SEQ ID NO: 1141154 - RNA, 19 nt, Homo sapiens
gaagacaagccugaagaag

SEQ ID NO: 1141155 - RNA, 19 nt, Homo sapiens
ccagaagggccaccuguca

SEQ ID NO: 1141156 - RNA, 19 nt, Homo sapiens
guaccuauuugagaacauc

SEQ ID NO: 1141157 - RNA, 19 nt, Homo sapiens
gggaggaacuguguuuuau

SEQ ID NO: 1141158 - RNA, 19 nt, Homo sapiens
ggccaccugucauccaguu

SEQ ID NO: 1141159 - RNA, 19 nt, Homo sapiens
gaauguccuuguuauacac

SEQ ID NO: 1141160 - RNA, 19 nt, Homo sapiens
ggcugguucuuguuucauu

SEQ ID NO: 1141161 - RNA, 19 nt, Homo sapiens
gcuguggcuucuugucuuc

SEQ ID NO: 1141162 - RNA, 19 nt, Homo sapiens
gaguccagauuucuucucu

SEQ ID NO: 1141163 - RNA, 19 nt, Homo sapiens
uccgggacauccagucuuu

SEQ ID NO: 1141164 - RNA, 19 nt, Homo sapiens
aagcuaaacagguaucaga

SEQ ID NO: 1141165 - RNA, 19 nt, Homo sapiens
gaagcuguuggcugcagua

SEQ ID NO: 1141166 - RNA, 19 nt, Homo sapiens
ggguucuacugauguuuau

SEQ ID NO: 1141167 - RNA, 19 nt, Homo sapiens
uaucaccccucacccauaa

SEQ ID NO: 1141168 - RNA, 19 nt, Homo sapiens
ugauguggccuacaacuuc

SEQ ID NO: 1141169 - RNA, 19 nt, Homo sapiens
caacagugggugugaugug

SEQ ID NO: 1141170 - RNA, 19 nt, Homo sapiens
uggcugucauuauuuauag

SEQ ID NO: 1141171 - RNA, 19 nt, Homo sapiens
gcagaagacaagccugaag

SEQ ID NO: 1141172 - RNA, 19 nt, Homo sapiens
caccuaugcuguccagaag

SEQ ID NO: 1141173 - RNA, 19 nt, Homo sapiens
ucaccuaugcuguccagaa

SEQ ID NO: 1141174 - RNA, 19 nt, Homo sapiens
caggguguaugaagguguu

SEQ ID NO: 1141175 - RNA, 19 nt, Homo sapiens
caucauguccacaacaaca

SEQ ID NO: 1141176 - RNA, 19 nt, Homo sapiens
auguagcccuuauuuaaug

SEQ ID NO: 1141177 - RNA, 19 nt, Homo sapiens
guucuuguuucauuucucu

SEQ ID NO: 1141178 - RNA, 19 nt, Homo sapiens
cgggaggaccugcaacauu

SEQ ID NO: 1141179 - RNA, 19 nt, Homo sapiens
uggaaaaccuaaucaccua

SEQ ID NO: 1141180 - RNA, 19 nt, Homo sapiens
ugaccacgccagugaaugu

SEQ ID NO: 1141181 - RNA, 19 nt, Homo sapiens
gugaauguccuuguuauac

SEQ ID NO: 1141182 - RNA, 19 nt, Homo sapiens
uuuaauggguucuacugau

SEQ ID NO: 1141183 - RNA, 19 nt, Homo sapiens
uggauguagcccuuauuua

SEQ ID NO: 1141184 - RNA, 19 nt, Homo sapiens
gauguggcccgaaccuugu

SEQ ID NO: 1141185 - RNA, 19 nt, Homo sapiens
gacauccagucuuucuaca

SEQ ID NO: 1141186 - RNA, 19 nt, Homo sapiens
gaugauggcaggguguaug

SEQ ID NO: 1141187 - RNA, 19 nt, Homo sapiens
cccaucauguccacaacaa

SEQ ID NO: 1141188 - RNA, 19 nt, Homo sapiens
uggguucuacugauguuua

SEQ ID NO: 1141189 - RNA, 19 nt, Homo sapiens
ggggaggaacuguguuuua

SEQ ID NO: 1141190 - RNA, 19 nt, Homo sapiens
cuacuugguugugaguuuc

SEQ ID NO: 1141191 - RNA, 19 nt, Homo sapiens
ugaagguguuggcuggaau

SEQ ID NO: 1141192 - RNA, 19 nt, Homo sapiens
ggaacaaaacacaagcuaa

SEQ ID NO: 1141193 - RNA, 19 nt, Homo sapiens
acagguauaccacccaaug

SEQ ID NO: 1141194 - RNA, 19 nt, Homo sapiens
gauguugucuugagaaauu

SEQ ID NO: 1141195 - RNA, 19 nt, Homo sapiens
gagaagauaugaaagaugu

SEQ ID NO: 1141196 - RNA, 19 nt, Homo sapiens
gaggauagcuucaauaugc

SEQ ID NO: 1141197 - RNA, 19 nt, Homo sapiens
ggauguggcucuagaauuc

SEQ ID NO: 1141198 - RNA, 19 nt, Homo sapiens
guauagggaugugauguua

SEQ ID NO: 1141199 - RNA, 19 nt, Homo sapiens
aaacaugccucccacagaa

SEQ ID NO: 1141200 - RNA, 19 nt, Homo sapiens
gaaauuacgcuuaaggaau

SEQ ID NO: 1141201 - RNA, 19 nt, Homo sapiens
gaagacagccaaacacuca

SEQ ID NO: 1141202 - RNA, 19 nt, Homo sapiens
uguccuaacuccaugaaua

SEQ ID NO: 1141203 - RNA, 19 nt, Homo sapiens
gcagguauugcgagauuua

SEQ ID NO: 1141204 - RNA, 19 nt, Homo sapiens
aaauuacgcuuaaggaaug

SEQ ID NO: 1141205 - RNA, 19 nt, Homo sapiens
gaauaugaaaggaagauug

SEQ ID NO: 1141206 - RNA, 19 nt, Homo sapiens
cagcccgaguucugaauua

SEQ ID NO: 1141207 - RNA, 19 nt, Homo sapiens
acucagcuuugucuucuua

SEQ ID NO: 1141208 - RNA, 19 nt, Homo sapiens
gggaugugauguuagagaa

SEQ ID NO: 1141209 - RNA, 19 nt, Homo sapiens
cuugagaaauuacgcuuaa

SEQ ID NO: 1141210 - RNA, 19 nt, Homo sapiens
gaagauaugaaagauguug

SEQ ID NO: 1141211 - RNA, 19 nt, Homo sapiens
ggaaagagcccuggaacgu

SEQ ID NO: 1141212 - RNA, 19 nt, Homo sapiens
gcucagcggaguuuguaua

SEQ ID NO: 1141213 - RNA, 19 nt, Homo sapiens
cuaacuccaugaauagaaa

SEQ ID NO: 1141214 - RNA, 19 nt, Homo sapiens
gaaauuguggccaugugaa

SEQ ID NO: 1141215 - RNA, 19 nt, Homo sapiens
ggaaauuguggccauguga

SEQ ID NO: 1141216 - RNA, 19 nt, Homo sapiens
gcugagaagauaugaaaga

SEQ ID NO: 1141217 - RNA, 19 nt, Homo sapiens
gcuuugucuucuuaucuua

SEQ ID NO: 1141218 - RNA, 19 nt, Homo sapiens
aggaaugacugggaaauug

SEQ ID NO: 1141219 - RNA, 19 nt, Homo sapiens
ccaucgagcugcuuugaag

SEQ ID NO: 1141220 - RNA, 19 nt, Homo sapiens
gagaaauuacgcuuaagga

SEQ ID NO: 1141221 - RNA, 19 nt, Homo sapiens
ggaaugacugggaaauugu

SEQ ID NO: 1141222 - RNA, 19 nt, Homo sapiens
ucagggauguggcucuaga

SEQ ID NO: 1141223 - RNA, 19 nt, Homo sapiens
gauguuagagaacuacaga

SEQ ID NO: 1141224 - RNA, 19 nt, Homo sapiens
cugcagguauugcgagauu

SEQ ID NO: 1141225 - RNA, 19 nt, Homo sapiens
gcugggaaaugggacuauu

SEQ ID NO: 1141226 - RNA, 19 nt, Homo sapiens
ugaagacccugcggagguu

SEQ ID NO: 1141227 - RNA, 19 nt, Homo sapiens
gaacgugaacacagagaag

SEQ ID NO: 1141228 - RNA, 19 nt, Homo sapiens
gugaggauagcuucaauau

SEQ ID NO: 1141229 - RNA, 19 nt, Homo sapiens
auagggaugugauguuaga

SEQ ID NO: 1141230 - RNA, 19 nt, Homo sapiens
gggaaauuguggccaugug

SEQ ID NO: 1141231 - RNA, 19 nt, Homo sapiens
ccuggaacgugaacacaga

SEQ ID NO: 1141232 - RNA, 19 nt, Homo sapiens
agauuguucuuccauguug

SEQ ID NO: 1141233 - RNA, 19 nt, Homo sapiens
gcauguaaagcccacagaa

SEQ ID NO: 1141234 - RNA, 19 nt, Homo sapiens
gggauguggcucuagaauu

SEQ ID NO: 1141235 - RNA, 19 nt, Homo sapiens
gaacuacagaaaccugauc

SEQ ID NO: 1141236 - RNA, 19 nt, Homo sapiens
aaagugaugcugagaagau

SEQ ID NO: 1141237 - RNA, 19 nt, Homo sapiens
cagccaaacacucagcuuu

SEQ ID NO: 1141238 - RNA, 19 nt, Homo sapiens
caaggaaagagcccuggaa

SEQ ID NO: 1141239 - RNA, 19 nt, Homo sapiens
ggugaggauagcuucaaua

SEQ ID NO: 1141240 - RNA, 19 nt, Homo sapiens
gaugugauguuagagaacu

SEQ ID NO: 1141241 - RNA, 19 nt, Homo sapiens
gguauugcgagauuuauag

SEQ ID NO: 1141242 - RNA, 19 nt, Homo sapiens
cagagaagacagccaaaca

SEQ ID NO: 1141243 - RNA, 19 nt, Homo sapiens
gaagcagaagcauguaaag

SEQ ID NO: 1141244 - RNA, 19 nt, Homo sapiens
cagaagcagaagcauguaa

SEQ ID NO: 1141245 - RNA, 19 nt, Homo sapiens
cugccaugauucuaaguuu

SEQ ID NO: 1141246 - RNA, 19 nt, Homo sapiens
agaaauuacgcuuaaggaa

SEQ ID NO: 1141247 - RNA, 19 nt, Homo sapiens
cugcaaguuucauuccaaa

SEQ ID NO: 1141248 - RNA, 19 nt, Homo sapiens
acacucagcuuugucuucu

SEQ ID NO: 1141249 - RNA, 19 nt, Homo sapiens
gagaagacagccaaacacu

SEQ ID NO: 1141250 - RNA, 19 nt, Homo sapiens
aagugaugcugagaagaua

SEQ ID NO: 1141251 - RNA, 19 nt, Homo sapiens
cagcucagcggaguuugua

SEQ ID NO: 1141252 - RNA, 19 nt, Homo sapiens
gaccaucgagcugcuuuga

SEQ ID NO: 1141253 - RNA, 19 nt, Homo sapiens
ggaacgugaacacagagaa

SEQ ID NO: 1141254 - RNA, 19 nt, Homo sapiens
agaagcagaagcauguaaa

SEQ ID NO: 1141255 - RNA, 19 nt, Homo sapiens
gaaugacugggaaauugug

SEQ ID NO: 1141256 - RNA, 19 nt, Homo sapiens
gcaauuccuauuucacagu

SEQ ID NO: 1141257 - RNA, 19 nt, Homo sapiens
uagcuucaauaugcaauuc

SEQ ID NO: 1141258 - RNA, 19 nt, Homo sapiens
uaugaaaggaagauuguuc

SEQ ID NO: 1141259 - RNA, 19 nt, Homo sapiens
uuagagaacuacagaaacc

SEQ ID NO: 1141260 - RNA, 19 nt, Homo sapiens
gaucucccuuggugaggau

SEQ ID NO: 1141261 - RNA, 19 nt, Homo sapiens
uguuagagaacuacagaaa

SEQ ID NO: 1141262 - RNA, 19 nt, Homo sapiens
cugagaagauaugaaagau

SEQ ID NO: 1141263 - RNA, 19 nt, Homo sapiens
ccugcaaguuucauuccaa

SEQ ID NO: 1141264 - RNA, 19 nt, Homo sapiens
ucacagucuugcuaugucu

SEQ ID NO: 1141265 - RNA, 19 nt, Homo sapiens
ucauuugguuguccuaacu

SEQ ID NO: 1141266 - RNA, 19 nt, Homo sapiens
guucuuccauguugguuuu

SEQ ID NO: 1141267 - RNA, 19 nt, Homo sapiens
gcccgaguucugaauuaaa

SEQ ID NO: 1141268 - RNA, 19 nt, Homo sapiens
cccagaagcagaagcaugu

SEQ ID NO: 1141269 - RNA, 19 nt, Homo sapiens
ggauagcuucaauaugcaa

SEQ ID NO: 1141270 - RNA, 19 nt, Homo sapiens
ugagaagauaugaaagaug

SEQ ID NO: 1141271 - RNA, 19 nt, Homo sapiens
augcugagaagauaugaaa

SEQ ID NO: 1141272 - RNA, 19 nt, Homo sapiens
ccuaacuccaugaauagaa

SEQ ID NO: 1141273 - RNA, 19 nt, Homo sapiens
guccuaacuccaugaauag

SEQ ID NO: 1141274 - RNA, 19 nt, Homo sapiens
cuauuucacagucuugcua

SEQ ID NO: 1141275 - RNA, 19 nt, Homo sapiens
gaaguaauguggccaagua

SEQ ID NO: 1141276 - RNA, 19 nt, Homo sapiens
gaacagaagucaagacauc

SEQ ID NO: 1141277 - RNA, 19 nt, Homo sapiens
aaagagaccugcugauaaa

SEQ ID NO: 1141278 - RNA, 19 nt, Homo sapiens
gaagugaguugaccagaga

SEQ ID NO: 1141279 - RNA, 19 nt, Homo sapiens
uaacugaucuuugcagaaa

SEQ ID NO: 1141280 - RNA, 19 nt, Homo sapiens
gucaagacauccacaguua

SEQ ID NO: 1141281 - RNA, 19 nt, Homo sapiens
gaagaaagcugcccaaaag

SEQ ID NO: 1141282 - RNA, 19 nt, Homo sapiens
gaaggaagcugaaaagaga

SEQ ID NO: 1141283 - RNA, 19 nt, Homo sapiens
gcaagguccucacaacuga

SEQ ID NO: 1141284 - RNA, 19 nt, Homo sapiens
ggaagcagcagccaacuaa

SEQ ID NO: 1141285 - RNA, 19 nt, Homo sapiens
ccaccgagauugucauaaa

SEQ ID NO: 1141286 - RNA, 19 nt, Homo sapiens
gcacuagguuucuugcauu

SEQ ID NO: 1141287 - RNA, 19 nt, Homo sapiens
gauuacagauggucaagaa

SEQ ID NO: 1141288 - RNA, 19 nt, Homo sapiens
gaguaaagauucugcugaa

SEQ ID NO: 1141289 - RNA, 19 nt, Homo sapiens
gaguugauauuccaaagaa

SEQ ID NO: 1141290 - RNA, 19 nt, Homo sapiens
gaaaauggaggaaguauaa

SEQ ID NO: 1141291 - RNA, 19 nt, Homo sapiens
acacagucaucucccauua

SEQ ID NO: 1141292 - RNA, 19 nt, Homo sapiens
ucaaagauccauugguuaa

SEQ ID NO: 1141293 - RNA, 19 nt, Homo sapiens
uggcugaccuuuccaguuu

SEQ ID NO: 1141294 - RNA, 19 nt, Homo sapiens
agacaucacugaaggaguu

SEQ ID NO: 1141295 - RNA, 19 nt, Homo sapiens
aaucacagcucaaugcuau

SEQ ID NO: 1141296 - RNA, 19 nt, Homo sapiens
gucaguaacuaguggcuua

SEQ ID NO: 1141297 - RNA, 19 nt, Homo sapiens
ugucaaagauccauugguu

SEQ ID NO: 1141298 - RNA, 19 nt, Homo sapiens
gaaaagagaccugcugaua

SEQ ID NO: 1141299 - RNA, 19 nt, Homo sapiens
gcaaucaauuaguagaaug

SEQ ID NO: 1141300 - RNA, 19 nt, Homo sapiens
ggaaguauaacugaucuuu

SEQ ID NO: 1141301 - RNA, 19 nt, Homo sapiens
ggauuggccugcguuguuu

SEQ ID NO: 1141302 - RNA, 19 nt, Homo sapiens
ugagagaauugccaaguug

SEQ ID NO: 1141303 - RNA, 19 nt, Homo sapiens
gaauggaaauaguggaaca

SEQ ID NO: 1141304 - RNA, 19 nt, Homo sapiens
gaaacuaaacugaaacaag

SEQ ID NO: 1141305 - RNA, 19 nt, Homo sapiens
caagacauccacaguuauu

SEQ ID NO: 1141306 - RNA, 19 nt, Homo sapiens
ucaaugcuaugaagcgauu

SEQ ID NO: 1141307 - RNA, 19 nt, Homo sapiens
ggccuuagucgcucaguua

SEQ ID NO: 1141308 - RNA, 19 nt, Homo sapiens
uagcaaggauuuaccuaug

SEQ ID NO: 1141309 - RNA, 19 nt, Homo sapiens
aaagauccauugguuaaga

SEQ ID NO: 1141310 - RNA, 19 nt, Homo sapiens
caaaauagguuccaauaac

SEQ ID NO: 1141311 - RNA, 19 nt, Homo sapiens
gaccagugcugaugauuuu

SEQ ID NO: 1141312 - RNA, 19 nt, Homo sapiens
caaagaaaccuagauugga

SEQ ID NO: 1141313 - RNA, 19 nt, Homo sapiens
caacuaagugggaauggaa

SEQ ID NO: 1141314 - RNA, 19 nt, Homo sapiens
ugaaacaagagacaacuuu

SEQ ID NO: 1141315 - RNA, 19 nt, Homo sapiens
ugacuggucuggcaacauc

SEQ ID NO: 1141316 - RNA, 19 nt, Homo sapiens
agagaaggaugagagaauu

SEQ ID NO: 1141317 - RNA, 19 nt, Homo sapiens
gaaguauaacugaucuuug

SEQ ID NO: 1141318 - RNA, 19 nt, Homo sapiens
gugaggccaucuacugaaa

SEQ ID NO: 1141319 - RNA, 19 nt, Homo sapiens
gcuaugaagcgauuacaga

SEQ ID NO: 1141320 - RNA, 19 nt, Homo sapiens
ucaggaaauucuucuagug

SEQ ID NO: 1141321 - RNA, 19 nt, Homo sapiens
cgauguaccagacaaauga

SEQ ID NO: 1141322 - RNA, 19 nt, Homo sapiens
gggauuggccugcguuguu

SEQ ID NO: 1141323 - RNA, 19 nt, Homo sapiens
ggagaccagugcugaugau

SEQ ID NO: 1141324 - RNA, 19 nt, Homo sapiens
uaagagaacagaagucaag

SEQ ID NO: 1141325 - RNA, 19 nt, Homo sapiens
guuaagaaaccagaaacua

SEQ ID NO: 1141326 - RNA, 19 nt, Homo sapiens
gguggcaucuggcaaucaa

SEQ ID NO: 1141327 - RNA, 19 nt, Homo sapiens
gaggaaguauaacugaucu

SEQ ID NO: 1141328 - RNA, 19 nt, Homo sapiens
gagaacagaagucaagaca

SEQ ID NO: 1141329 - RNA, 19 nt, Homo sapiens
caacuuuucuagcguuuaa

SEQ ID NO: 1141330 - RNA, 19 nt, Homo sapiens
ugaaaagaauggcucaaaa

SEQ ID NO: 1141331 - RNA, 19 nt, Homo sapiens
ggagugccauaaucucuac

SEQ ID NO: 1141332 - RNA, 19 nt, Homo sapiens
ugaaggaguugauauucca

SEQ ID NO: 1141333 - RNA, 19 nt, Homo sapiens
cagcaaaacuacuucagaa

SEQ ID NO: 1141334 - RNA, 19 nt, Homo sapiens
gaggccaucuacugaaaca

SEQ ID NO: 1141335 - RNA, 19 nt, Homo sapiens
cuuagucgcucaguuaguu

SEQ ID NO: 1141336 - RNA, 19 nt, Homo sapiens
accagaaacuaaacugaaa

SEQ ID NO: 1141337 - RNA, 19 nt, Homo sapiens
ggcaaucaauuaguagaau

SEQ ID NO: 1141338 - RNA, 19 nt, Homo sapiens
gaaaccagaaacacaguca

SEQ ID NO: 1141339 - RNA, 19 nt, Homo sapiens
ggaggaaguauaacugauc

SEQ ID NO: 1141340 - RNA, 19 nt, Homo sapiens
ggaaauaguggaacaucag

SEQ ID NO: 1141341 - RNA, 19 nt, Homo sapiens
ccucacaacugaaaaggua

SEQ ID NO: 1141342 - RNA, 19 nt, Homo sapiens
gggcauugauuccaguuac

SEQ ID NO: 1141343 - RNA, 19 nt, Homo sapiens
guaaagaaggaagcugaaa

SEQ ID NO: 1141344 - RNA, 19 nt, Homo sapiens
gcaauggcugcuacuguga

SEQ ID NO: 1141345 - RNA, 19 nt, Homo sapiens
uacagauggucaagaagaa

SEQ ID NO: 1141346 - RNA, 19 nt, Homo sapiens
gaaucacagcucaaugcua

SEQ ID NO: 1141347 - RNA, 19 nt, Homo sapiens
gagaaggaugagagaauug

SEQ ID NO: 1141348 - RNA, 19 nt, Homo sapiens
gaaaccagaaacuaaacug

SEQ ID NO: 1141349 - RNA, 19 nt, Homo sapiens
ggaguugauauuccaaaga

SEQ ID NO: 1141350 - RNA, 19 nt, Homo sapiens
gaaagcugcccaaaagaaa

SEQ ID NO: 1141351 - RNA, 19 nt, Homo sapiens
acuaguggcuuaacuggau

SEQ ID NO: 1141352 - RNA, 19 nt, Homo sapiens
uaacuccagcugucaaaga

SEQ ID NO: 1141353 - RNA, 19 nt, Homo sapiens
ugucaggagugccauaauc

SEQ ID NO: 1141354 - RNA, 19 nt, Homo sapiens
ccaaaguagcaaggauuua

SEQ ID NO: 1141355 - RNA, 19 nt, Homo sapiens
ccaguuaccguccaucuca

SEQ ID NO: 1141356 - RNA, 19 nt, Homo sapiens
caaaguagcaaggauuuac

SEQ ID NO: 1141357 - RNA, 19 nt, Homo sapiens
uuacagauggucaagaaga

SEQ ID NO: 1141358 - RNA, 19 nt, Homo sapiens
cagagaaggaugagagaau

SEQ ID NO: 1141359 - RNA, 19 nt, Homo sapiens
gggaauggaaauaguggaa

SEQ ID NO: 1141360 - RNA, 19 nt, Homo sapiens
ccaacuaagugggaaugga

SEQ ID NO: 1141361 - RNA, 19 nt, Homo sapiens
gaaacaagagacaacuuuu

SEQ ID NO: 1141362 - RNA, 19 nt, Homo sapiens
gucaaagauccauugguua

SEQ ID NO: 1141363 - RNA, 19 nt, Homo sapiens
aaguauaacugaucuuugc

SEQ ID NO: 1141364 - RNA, 19 nt, Homo sapiens
guagcaaggauuuaccuau

SEQ ID NO: 1141365 - RNA, 19 nt, Homo sapiens
gauauuccaaagaaaccua

SEQ ID NO: 1141366 - RNA, 19 nt, Homo sapiens
guaaagauucugcugaaaa

SEQ ID NO: 1141367 - RNA, 19 nt, Homo sapiens
caacuucacaagaaucaca

SEQ ID NO: 1141368 - RNA, 19 nt, Homo sapiens
ucagaaaccaccgcagaaa

SEQ ID NO: 1141369 - RNA, 19 nt, Homo sapiens
gaaugucaggagugccaua

SEQ ID NO: 1141370 - RNA, 19 nt, Homo sapiens
aaaccuagauuggagaaac

SEQ ID NO: 1141371 - RNA, 19 nt, Homo sapiens
acauuuccauuaagcaaga

SEQ ID NO: 1141372 - RNA, 19 nt, Homo sapiens
cuagguuucuugcauucaa

SEQ ID NO: 1141373 - RNA, 19 nt, Homo sapiens
gaaaccagccccugcaguu

SEQ ID NO: 1141374 - RNA, 19 nt, Homo sapiens
ggcaucuggcaaucaauua

SEQ ID NO: 1141375 - RNA, 19 nt, Homo sapiens
ugagaaagauuaagcauga

SEQ ID NO: 1141376 - RNA, 19 nt, Homo sapiens
ccagaaaccuuacagcaaa

SEQ ID NO: 1141377 - RNA, 19 nt, Homo sapiens
gcaaucagcugagaucaca

SEQ ID NO: 1141378 - RNA, 19 nt, Homo sapiens
ugacacagcccucaacaaa

SEQ ID NO: 1141379 - RNA, 19 nt, Homo sapiens
ugaaguguaucccuaagaa

SEQ ID NO: 1141380 - RNA, 19 nt, Homo sapiens
caaaucaccuguacuuggu

SEQ ID NO: 1141381 - RNA, 19 nt, Homo sapiens
gcgagcaccuguaauguca

SEQ ID NO: 1141382 - RNA, 19 nt, Homo sapiens
gaaagcagcauagagaaug

SEQ ID NO: 1141383 - RNA, 19 nt, Homo sapiens
aaagcaagcugaagacauc

SEQ ID NO: 1141384 - RNA, 19 nt, Homo sapiens
cagcauagagaaugagaua

SEQ ID NO: 1141385 - RNA, 19 nt, Homo sapiens
ugagauagccguccugaga

SEQ ID NO: 1141386 - RNA, 19 nt, Homo sapiens
caggaggacuguuugaguu

SEQ ID NO: 1141387 - RNA, 19 nt, Homo sapiens
gaucagugacuuuggauug

SEQ ID NO: 1141388 - RNA, 19 nt, Homo sapiens
gaugaggaguccaaaauaa

SEQ ID NO: 1141389 - RNA, 19 nt, Homo sapiens
gcagcagccuggacaguuc

SEQ ID NO: 1141390 - RNA, 19 nt, Homo sapiens
ggagaaggacccgaauaaa

SEQ ID NO: 1141391 - RNA, 19 nt, Homo sapiens
ccgaaaaucucuuguacua

SEQ ID NO: 1141392 - RNA, 19 nt, Homo sapiens
ggaagacauuuaugaaagc

SEQ ID NO: 1141393 - RNA, 19 nt, Homo sapiens
gggcaaaggagaugugaug

SEQ ID NO: 1141394 - RNA, 19 nt, Homo sapiens
ggaaagcagcauagagaau

SEQ ID NO: 1141395 - RNA, 19 nt, Homo sapiens
ccuguaaucccaacacuuu

SEQ ID NO: 1141396 - RNA, 19 nt, Homo sapiens
uggaagacauuuaugaaag

SEQ ID NO: 1141397 - RNA, 19 nt, Homo sapiens
gagaaggacccgaauaaaa

SEQ ID NO: 1141398 - RNA, 19 nt, Homo sapiens
cugaagacaucaagaagau

SEQ ID NO: 1141399 - RNA, 19 nt, Homo sapiens
cagccugggugacagauug

SEQ ID NO: 1141400 - RNA, 19 nt, Homo sapiens
gcaggagaaucacuugaac

SEQ ID NO: 1141401 - RNA, 19 nt, Homo sapiens
gaaaccccaucucuacuaa

SEQ ID NO: 1141402 - RNA, 19 nt, Homo sapiens
caggcgcuuucuauacuua

SEQ ID NO: 1141403 - RNA, 19 nt, Homo sapiens
ggaaccugauggagaagga

SEQ ID NO: 1141404 - RNA, 19 nt, Homo sapiens
gaagacaucaagaagaucu

SEQ ID NO: 1141405 - RNA, 19 nt, Homo sapiens
guacuacagucaagaugag

SEQ ID NO: 1141406 - RNA, 19 nt, Homo sapiens
gagaaagauuaagcaugaa

SEQ ID NO: 1141407 - RNA, 19 nt, Homo sapiens
uguacuaucuccacagaau

SEQ ID NO: 1141408 - RNA, 19 nt, Homo sapiens
gcucuuugcugugaagugu

SEQ ID NO: 1141409 - RNA, 19 nt, Homo sapiens
caaggcggaauaugaguuu

SEQ ID NO: 1141410 - RNA, 19 nt, Homo sapiens
gcccaaaucaccuguacuu

SEQ ID NO: 1141411 - RNA, 19 nt, Homo sapiens
gagauagccguccugagaa

SEQ ID NO: 1141412 - RNA, 19 nt, Homo sapiens
aaagcagcauagagaauga

SEQ ID NO: 1141413 - RNA, 19 nt, Homo sapiens
uggagaaggacccgaauaa

SEQ ID NO: 1141414 - RNA, 19 nt, Homo sapiens
ggaggacuguuugaguuca

SEQ ID NO: 1141415 - RNA, 19 nt, Homo sapiens
gcaggaggacuguuugagu

SEQ ID NO: 1141416 - RNA, 19 nt, Homo sapiens
gccaggcgcuuucuauacu

SEQ ID NO: 1141417 - RNA, 19 nt, Homo sapiens
cagaaucccucagcugaca

SEQ ID NO: 1141418 - RNA, 19 nt, Homo sapiens
agauagccguccugagaaa

SEQ ID NO: 1141419 - RNA, 19 nt, Homo sapiens
gcugaagacaucaagaaga

SEQ ID NO: 1141420 - RNA, 19 nt, Homo sapiens
gcaacuggcaagcucuuug

SEQ ID NO: 1141421 - RNA, 19 nt, Homo sapiens
gcaaggaaagcagcauaga

SEQ ID NO: 1141422 - RNA, 19 nt, Homo sapiens
gggcaaggaaagcagcaua

SEQ ID NO: 1141423 - RNA, 19 nt, Homo sapiens
ccaaaauaaugaucaguga

SEQ ID NO: 1141424 - RNA, 19 nt, Homo sapiens
aaggaaagcagcauagaga

SEQ ID NO: 1141425 - RNA, 19 nt, Homo sapiens
gcaccuguaaugucagcua

SEQ ID NO: 1141426 - RNA, 19 nt, Homo sapiens
cuaugucgcuccugaaguc

SEQ ID NO: 1141427 - RNA, 19 nt, Homo sapiens
gcaaaggagaugugauguc

SEQ ID NO: 1141428 - RNA, 19 nt, Homo sapiens
ccccaucucuacuaaaaua

SEQ ID NO: 1141429 - RNA, 19 nt, Homo sapiens
aaauauuguugcccuggaa

SEQ ID NO: 1141430 - RNA, 19 nt, Homo sapiens
ggcaggagaaucacuugaa

SEQ ID NO: 1141431 - RNA, 19 nt, Homo sapiens
gagcaaauggagacaagca

SEQ ID NO: 1141432 - RNA, 19 nt, Homo sapiens
gagaagggguuuuauacag

SEQ ID NO: 1141433 - RNA, 19 nt, Homo sapiens
ggacaguucaaaugcaagu

SEQ ID NO: 1141434 - RNA, 19 nt, Homo sapiens
aaugaucagugacuuugga

SEQ ID NO: 1141435 - RNA, 19 nt, Homo sapiens
ugaggcaggaggacuguuu

SEQ ID NO: 1141436 - RNA, 19 nt, Homo sapiens
gcgcugaagggcaaggaaa

SEQ ID NO: 1141437 - RNA, 19 nt, Homo sapiens
cguguacuaucuccacaga

SEQ ID NO: 1141438 - RNA, 19 nt, Homo sapiens
gcauagagaaugagauagc

SEQ ID NO: 1141439 - RNA, 19 nt, Homo sapiens
ggaagcggagguugcaauc

SEQ ID NO: 1141440 - RNA, 19 nt, Homo sapiens
agaccagccugaccaacau

SEQ ID NO: 1141441 - RNA, 19 nt, Homo sapiens
cugaaguccucgcccagaa

SEQ ID NO: 1141442 - RNA, 19 nt, Homo sapiens
ccuguaaugucagcuacuu

SEQ ID NO: 1141443 - RNA, 19 nt, Homo sapiens
uguuugaguucaggaguuu

SEQ ID NO: 1141444 - RNA, 19 nt, Homo sapiens
gguuuuagcugaagagaag

SEQ ID NO: 1141445 - RNA, 19 nt, Homo sapiens
ccaggcgcuuucuauacuu

SEQ ID NO: 1141446 - RNA, 19 nt, Homo sapiens
aagcugaagacaucaagaa

SEQ ID NO: 1141447 - RNA, 19 nt, Homo sapiens
cagaaaccuuacagcaaag

SEQ ID NO: 1141448 - RNA, 19 nt, Homo sapiens
gcacucugauccgccaagu

SEQ ID NO: 1141449 - RNA, 19 nt, Homo sapiens
caguucaaaugcaaguguu

SEQ ID NO: 1141450 - RNA, 19 nt, Homo sapiens
caagcucuuugcugugaag

SEQ ID NO: 1141451 - RNA, 19 nt, Homo sapiens
caaggaaagcagcauagag

SEQ ID NO: 1141452 - RNA, 19 nt, Homo sapiens
agagcuguuugaccggaua

SEQ ID NO: 1141453 - RNA, 19 nt, Homo sapiens
guggcgagcaccuguaaug

SEQ ID NO: 1141454 - RNA, 19 nt, Homo sapiens
caugcgacccuaggacuuu

SEQ ID NO: 1141455 - RNA, 19 nt, Homo sapiens
gccgagcaccuccuguuug

SEQ ID NO: 1141456 - RNA, 19 nt, Homo sapiens
aagagcaaauggagacaag

SEQ ID NO: 1141457 - RNA, 19 nt, Homo sapiens
cuggaagacauuuaugaaa

SEQ ID NO: 1141458 - RNA, 19 nt, Homo sapiens
ccuggaagacauuuaugaa

SEQ ID NO: 1141459 - RNA, 19 nt, Homo sapiens
aagcggagguugcaaucag

SEQ ID NO: 1141460 - RNA, 19 nt, Homo sapiens
uauacuuaaucccauguca

SEQ ID NO: 1141461 - RNA, 19 nt, Homo sapiens
gaaggacccgaauaaaaga

SEQ ID NO: 1141462 - RNA, 19 nt, Homo sapiens
ggagugauugccuacaucu

SEQ ID NO: 1141463 - RNA, 19 nt, Homo sapiens
ugaaguccucgcccagaaa

SEQ ID NO: 1141464 - RNA, 19 nt, Homo sapiens
gaaguguaucccuaagaag

SEQ ID NO: 1141465 - RNA, 19 nt, Homo sapiens
cuggacaguucaaaugcaa

SEQ ID NO: 1141466 - RNA, 19 nt, Homo sapiens
uucggaaccugauggagaa

SEQ ID NO: 1141467 - RNA, 19 nt, Homo sapiens
agugauugccuacaucuug

SEQ ID NO: 1141468 - RNA, 19 nt, Homo sapiens
cccagaaaccuuacagcaa

SEQ ID NO: 1141469 - RNA, 19 nt, Homo sapiens
ccgagcaccuccuguuugc

SEQ ID NO: 1141470 - RNA, 19 nt, Homo sapiens
aaaagacugugcguaugua

SEQ ID NO: 1141471 - RNA, 19 nt, Homo sapiens
auggaucgcuggugacaca

SEQ ID NO: 1141472 - RNA, 19 nt, Homo sapiens
ucaaggcggaauaugaguu

SEQ ID NO: 1141473 - RNA, 19 nt, Homo sapiens
guacuaucuccacagaaug

SEQ ID NO: 1141474 - RNA, 19 nt, Homo sapiens
cgaagugguuuuagcugaa

SEQ ID NO: 1141475 - RNA, 19 nt, Homo sapiens
ugagaaagauuaagcauga

SEQ ID NO: 1141476 - RNA, 19 nt, Homo sapiens
ccagaaaccuuacagcaaa

SEQ ID NO: 1141477 - RNA, 19 nt, Homo sapiens
gguuucaacuggauuauuu

SEQ ID NO: 1141478 - RNA, 19 nt, Homo sapiens
gaacggaccuucuuauucc

SEQ ID NO: 1141479 - RNA, 19 nt, Homo sapiens
gagaacagcagaaauaaga

SEQ ID NO: 1141480 - RNA, 19 nt, Homo sapiens
cauaggaucuggugcugua

SEQ ID NO: 1141481 - RNA, 19 nt, Homo sapiens
ggaagucugugcccgagaa

SEQ ID NO: 1141482 - RNA, 19 nt, Homo sapiens
agaaguauguccuuuguau

SEQ ID NO: 1141483 - RNA, 19 nt, Homo sapiens
ugacacagcccucaacaaa

SEQ ID NO: 1141484 - RNA, 19 nt, Homo sapiens
uaagaaguauguccuuugu

SEQ ID NO: 1141485 - RNA, 19 nt, Homo sapiens
ugaaguguaucccuaagaa

SEQ ID NO: 1141486 - RNA, 19 nt, Homo sapiens
caaaucaccuguacuuggu

SEQ ID NO: 1141487 - RNA, 19 nt, Homo sapiens
gaaagcagcauagagaaug

SEQ ID NO: 1141488 - RNA, 19 nt, Homo sapiens
cagcauagagaaugagaua

SEQ ID NO: 1141489 - RNA, 19 nt, Homo sapiens
aaagcaagcugaagacauc

SEQ ID NO: 1141490 - RNA, 19 nt, Homo sapiens
uugcaaagcucuaacugaa

SEQ ID NO: 1141491 - RNA, 19 nt, Homo sapiens
ugagauagccguccugaga

SEQ ID NO: 1141492 - RNA, 19 nt, Homo sapiens
gaucagugacuuuggauug

SEQ ID NO: 1141493 - RNA, 19 nt, Homo sapiens
gaugaggaguccaaaauaa

SEQ ID NO: 1141494 - RNA, 19 nt, Homo sapiens
gcagcagccuggacaguuc

SEQ ID NO: 1141495 - RNA, 19 nt, Homo sapiens
caaaggagaauuuaaaggu

SEQ ID NO: 1141496 - RNA, 19 nt, Homo sapiens
ggagaaggacccgaauaaa

SEQ ID NO: 1141497 - RNA, 19 nt, Homo sapiens
ccgaaaaucucuuguacua

SEQ ID NO: 1141498 - RNA, 19 nt, Homo sapiens
ccucaaaggagaauuuaaa

SEQ ID NO: 1141499 - RNA, 19 nt, Homo sapiens
ggaagacauuuaugaaagc

SEQ ID NO: 1141500 - RNA, 19 nt, Homo sapiens
guaguuucauuucuucuuc

SEQ ID NO: 1141501 - RNA, 19 nt, Homo sapiens
gggcaaaggagaugugaug

SEQ ID NO: 1141502 - RNA, 19 nt, Homo sapiens
ggaaagcagcauagagaau

SEQ ID NO: 1141503 - RNA, 19 nt, Homo sapiens
guucauuucucacaaacug

SEQ ID NO: 1141504 - RNA, 19 nt, Homo sapiens
cuacugcaauucugaagug

SEQ ID NO: 1141505 - RNA, 19 nt, Homo sapiens
uggaagacauuuaugaaag

SEQ ID NO: 1141506 - RNA, 19 nt, Homo sapiens
cugaagacaucaagaagau

SEQ ID NO: 1141507 - RNA, 19 nt, Homo sapiens
gagaaggacccgaauaaaa

SEQ ID NO: 1141508 - RNA, 19 nt, Homo sapiens
gcaggagaauugcuugaac

SEQ ID NO: 1141509 - RNA, 19 nt, Homo sapiens
uaacugaacggaccuucuu

SEQ ID NO: 1141510 - RNA, 19 nt, Homo sapiens
gcagugcacucuggaagca

SEQ ID NO: 1141511 - RNA, 19 nt, Homo sapiens
ggaaccugauggagaagga

SEQ ID NO: 1141512 - RNA, 19 nt, Homo sapiens
guacuacagucaagaugag

SEQ ID NO: 1141513 - RNA, 19 nt, Homo sapiens
gaagacaucaagaagaucu

SEQ ID NO: 1141514 - RNA, 19 nt, Homo sapiens
gagaaagauuaagcaugaa

SEQ ID NO: 1141515 - RNA, 19 nt, Homo sapiens
uguacuaucuccacagaau

SEQ ID NO: 1141516 - RNA, 19 nt, Homo sapiens
cccgagaacagcagaaaua

SEQ ID NO: 1141517 - RNA, 19 nt, Homo sapiens
gcucuuugcugugaagugu

SEQ ID NO: 1141518 - RNA, 19 nt, Homo sapiens
caaggcggaauaugaguuu

SEQ ID NO: 1141519 - RNA, 19 nt, Homo sapiens
gcccaaaucaccuguacuu

SEQ ID NO: 1141520 - RNA, 19 nt, Homo sapiens
gagauagccguccugagaa

SEQ ID NO: 1141521 - RNA, 19 nt, Homo sapiens
aaagcagcauagagaauga

SEQ ID NO: 1141522 - RNA, 19 nt, Homo sapiens
uggagaaggacccgaauaa

SEQ ID NO: 1141523 - RNA, 19 nt, Homo sapiens
gaucuggugcuguauauac

SEQ ID NO: 1141524 - RNA, 19 nt, Homo sapiens
ugaacggaccuucuuauuc

SEQ ID NO: 1141525 - RNA, 19 nt, Homo sapiens
auacgaaucuugcaaagcu

SEQ ID NO: 1141526 - RNA, 19 nt, Homo sapiens
gaaguguucauuucucaca

SEQ ID NO: 1141527 - RNA, 19 nt, Homo sapiens
gcaacuggcaagcucuuug

SEQ ID NO: 1141528 - RNA, 19 nt, Homo sapiens
agauagccguccugagaaa

SEQ ID NO: 1141529 - RNA, 19 nt, Homo sapiens
gcugaagacaucaagaaga

SEQ ID NO: 1141530 - RNA, 19 nt, Homo sapiens
gcaaggaaagcagcauaga

SEQ ID NO: 1141531 - RNA, 19 nt, Homo sapiens
gggcaaggaaagcagcaua

SEQ ID NO: 1141532 - RNA, 19 nt, Homo sapiens
aaccgucuaugguguguuu

SEQ ID NO: 1141533 - RNA, 19 nt, Homo sapiens
ccaaaauaaugaucaguga

SEQ ID NO: 1141534 - RNA, 19 nt, Homo sapiens
aaggaaagcagcauagaga

SEQ ID NO: 1141535 - RNA, 19 nt, Homo sapiens
gggcgcugauuucauagga

SEQ ID NO: 1141536 - RNA, 19 nt, Homo sapiens
aaagguuucaacuggauua

SEQ ID NO: 1141537 - RNA, 19 nt, Homo sapiens
guagguaaccgucuauggu

SEQ ID NO: 1141538 - RNA, 19 nt, Homo sapiens
cugcaauucugaaguguuc

SEQ ID NO: 1141539 - RNA, 19 nt, Homo sapiens
ggacuggaagaccgaaguu

SEQ ID NO: 1141540 - RNA, 19 nt, Homo sapiens
cuaugucgcuccugaaguc

SEQ ID NO: 1141541 - RNA, 19 nt, Homo sapiens
gcaaaggagaugugauguc

SEQ ID NO: 1141542 - RNA, 19 nt, Homo sapiens
gaucagccgggugcaauga

SEQ ID NO: 1141543 - RNA, 19 nt, Homo sapiens
cuuccacgcucuguaguuu

SEQ ID NO: 1141544 - RNA, 19 nt, Homo sapiens
aaauauuguugcccuggaa

SEQ ID NO: 1141545 - RNA, 19 nt, Homo sapiens
cuaaguuacaugaccuaua

SEQ ID NO: 1141546 - RNA, 19 nt, Homo sapiens
guaaauauugugcauuagg

SEQ ID NO: 1141547 - RNA, 19 nt, Homo sapiens
caguguagguaaccgucua

SEQ ID NO: 1141548 - RNA, 19 nt, Homo sapiens
gcucuguaguuucauuucu

SEQ ID NO: 1141549 - RNA, 19 nt, Homo sapiens
gagcaaauggagacaagca

SEQ ID NO: 1141550 - RNA, 19 nt, Homo sapiens
gagaagggguuuuauacag

SEQ ID NO: 1141551 - RNA, 19 nt, Homo sapiens
ggacaguucaaaugcaagu

SEQ ID NO: 1141552 - RNA, 19 nt, Homo sapiens
aaugaucagugacuuugga

SEQ ID NO: 1141553 - RNA, 19 nt, Homo sapiens
ggaaacugcagaggaggaa

SEQ ID NO: 1141554 - RNA, 19 nt, Homo sapiens
gaucacaaggucaggagau

SEQ ID NO: 1141555 - RNA, 19 nt, Homo sapiens
gaaguauguccuuuguauc

SEQ ID NO: 1141556 - RNA, 19 nt, Homo sapiens
gguaaauauugugcauuag

SEQ ID NO: 1141557 - RNA, 19 nt, Homo sapiens
cguguacuaucuccacaga

SEQ ID NO: 1141558 - RNA, 19 nt, Homo sapiens
ggcgagagcgaaagaggaa

SEQ ID NO: 1141559 - RNA, 19 nt, Homo sapiens
gcgcugaagggcaaggaaa

SEQ ID NO: 1141560 - RNA, 19 nt, Homo sapiens
gcauagagaaugagauagc

SEQ ID NO: 1141561 - RNA, 19 nt, Homo sapiens
ccgagaacagcagaaauaa

SEQ ID NO: 1141562 - RNA, 19 nt, Homo sapiens
caccaucguuuccacucuu

SEQ ID NO: 1141563 - RNA, 19 nt, Homo sapiens
gcaccuuccacgcucugua

SEQ ID NO: 1141564 - RNA, 19 nt, Homo sapiens
uuaagaaguauguccuuug

SEQ ID NO: 1141565 - RNA, 19 nt, Homo sapiens
cugaaguccucgcccagaa

SEQ ID NO: 1141566 - RNA, 19 nt, Homo sapiens
aagcugaagacaucaagaa

SEQ ID NO: 1141567 - RNA, 19 nt, Homo sapiens
cagaaaccuuacagcaaag

SEQ ID NO: 1141568 - RNA, 19 nt, Homo sapiens
gguuuuagcugaagagaag

SEQ ID NO: 1141569 - RNA, 19 nt, Homo sapiens
gcacucugauccgccaagu

SEQ ID NO: 1141570 - RNA, 19 nt, Homo sapiens
guauguccuuuguaucucu

SEQ ID NO: 1141571 - RNA, 19 nt, Homo sapiens
gaaucuugcaaagcucuaa

SEQ ID NO: 1141572 - RNA, 19 nt, Homo sapiens
ucauuucucacaaacugua

SEQ ID NO: 1141573 - RNA, 19 nt, Homo sapiens
caagcucuuugcugugaag

SEQ ID NO: 1141574 - RNA, 19 nt, Homo sapiens
caguucaaaugcaaguguu

SEQ ID NO: 1141575 - RNA, 19 nt, Homo sapiens
gacgugaucucauuucuuu

SEQ ID NO: 1141576 - RNA, 19 nt, Homo sapiens
caaaggacgugaucucauu

SEQ ID NO: 1141577 - RNA, 19 nt, Homo sapiens
ggagugagaugaguaauuc

SEQ ID NO: 1141578 - RNA, 19 nt, Homo sapiens
gcagguaguuuguuugaga

SEQ ID NO: 1141579 - RNA, 19 nt, Homo sapiens
ccgcauaaaugucuucuuu

SEQ ID NO: 1141580 - RNA, 19 nt, Homo sapiens
gauaauacuugcuccaugu

SEQ ID NO: 1141581 - RNA, 19 nt, Homo sapiens
ggauaaggaugcacuggaa

SEQ ID NO: 1141582 - RNA, 19 nt, Homo sapiens
gaacagaacgcuugcaucu

SEQ ID NO: 1141583 - RNA, 19 nt, Homo sapiens
gaacaugugguauuuacuu

SEQ ID NO: 1141584 - RNA, 19 nt, Homo sapiens
agagaagagucuauuauga

SEQ ID NO: 1141585 - RNA, 19 nt, Homo sapiens
cugaacaccugcaagaaua

SEQ ID NO: 1141586 - RNA, 19 nt, Homo sapiens
gagaacaugugguauuuac

SEQ ID NO: 1141587 - RNA, 19 nt, Homo sapiens
gugagaacaugugguauuu

SEQ ID NO: 1141588 - RNA, 19 nt, Homo sapiens
gaagagaagggaagagaga

SEQ ID NO: 1141589 - RNA, 19 nt, Homo sapiens
caagugagaacauguggua

SEQ ID NO: 1141590 - RNA, 19 nt, Homo sapiens
gaagagagaagagucuauu

SEQ ID NO: 1141591 - RNA, 19 nt, Homo sapiens
uaaaguacuugauguaguc

SEQ ID NO: 1141592 - RNA, 19 nt, Homo sapiens
uggaagaacugccagaaug

SEQ ID NO: 1141593 - RNA, 19 nt, Homo sapiens
guaaaguacuugauguagu

SEQ ID NO: 1141594 - RNA, 19 nt, Homo sapiens
gagagaagagucuauuaug

SEQ ID NO: 1141595 - RNA, 19 nt, Homo sapiens
gguaugacaagaaagauaa

SEQ ID NO: 1141596 - RNA, 19 nt, Homo sapiens
guugauggauauuugguuu

SEQ ID NO: 1141597 - RNA, 19 nt, Homo sapiens
ugaagacaaucagaacuuu

SEQ ID NO: 1141598 - RNA, 19 nt, Homo sapiens
gggaaacaauaacaacuuc

SEQ ID NO: 1141599 - RNA, 19 nt, Homo sapiens
gcauaaaugucuucuuuug

SEQ ID NO: 1141600 - RNA, 19 nt, Homo sapiens
gaugaucacugguguugag

SEQ ID NO: 1141601 - RNA, 19 nt, Homo sapiens
guaguuuguuugagagauu

SEQ ID NO: 1141602 - RNA, 19 nt, Homo sapiens
ggacagugccuuaguuugg

SEQ ID NO: 1141603 - RNA, 19 nt, Homo sapiens
ccgcaugcauuagcuauuu

SEQ ID NO: 1141604 - RNA, 19 nt, Homo sapiens
acagaacgcuugcaucuac

SEQ ID NO: 1141605 - RNA, 19 nt, Homo sapiens
caugggaucuucuggacuu

SEQ ID NO: 1141606 - RNA, 19 nt, Homo sapiens
aaagggauguguguacaaa

SEQ ID NO: 1141607 - RNA, 19 nt, Homo sapiens
aauaaacgcuuucccugau

SEQ ID NO: 1141608 - RNA, 19 nt, Homo sapiens
gaucacugguguugagcuu

SEQ ID NO: 1141609 - RNA, 19 nt, Homo sapiens
ggaauuggcacacucucuu

SEQ ID NO: 1141610 - RNA, 19 nt, Homo sapiens
gagaagagucuauuaugag

SEQ ID NO: 1141611 - RNA, 19 nt, Homo sapiens
ggagugaagacaaucagaa

SEQ ID NO: 1141612 - RNA, 19 nt, Homo sapiens
gcacaauauccauccguuu

SEQ ID NO: 1141613 - RNA, 19 nt, Homo sapiens
guaaauagugcugcaguga

SEQ ID NO: 1141614 - RNA, 19 nt, Homo sapiens
ucaagggagugaagacaau

SEQ ID NO: 1141615 - RNA, 19 nt, Homo sapiens
ggaagaacugccagaaugu

SEQ ID NO: 1141616 - RNA, 19 nt, Homo sapiens
uaaacgcuuucccugauug

SEQ ID NO: 1141617 - RNA, 19 nt, Homo sapiens
guacaaaggacagacaaug

SEQ ID NO: 1141618 - RNA, 19 nt, Homo sapiens
gggugcagguaguuuguuu

SEQ ID NO: 1141619 - RNA, 19 nt, Homo sapiens
gaagacaaucagaacuuug

SEQ ID NO: 1141620 - RNA, 19 nt, Homo sapiens
uaacaacuuccaauccaaa

SEQ ID NO: 1141621 - RNA, 19 nt, Homo sapiens
ugacuggcaugagauggua

SEQ ID NO: 1141622 - RNA, 19 nt, Homo sapiens
gaacaccugcaagaauaaa

SEQ ID NO: 1141623 - RNA, 19 nt, Homo sapiens
gaaagggauguguguacaa

SEQ ID NO: 1141624 - RNA, 19 nt, Homo sapiens
caauuuacauucccaacag

SEQ ID NO: 1141625 - RNA, 19 nt, Homo sapiens
cauaguauuccauggcaua

SEQ ID NO: 1141626 - RNA, 19 nt, Homo sapiens
cuauuuauccugaugcuuu

SEQ ID NO: 1141627 - RNA, 19 nt, Homo sapiens
gcugagugauugacaucuu

SEQ ID NO: 1141628 - RNA, 19 nt, Homo sapiens
gcagguuuguuacauaggu

SEQ ID NO: 1141629 - RNA, 19 nt, Homo sapiens
gggcaugggugcagguagu

SEQ ID NO: 1141630 - RNA, 19 nt, Homo sapiens
cauuacacuuugcagagua

SEQ ID NO: 1141631 - RNA, 19 nt, Homo sapiens
gaguguauacccaguaaug

SEQ ID NO: 1141632 - RNA, 19 nt, Homo sapiens
ugauggauauuugguuuga

SEQ ID NO: 1141633 - RNA, 19 nt, Homo sapiens
aguauuccauggcauauau

SEQ ID NO: 1141634 - RNA, 19 nt, Homo sapiens
uaguuuggauccucuagaa

SEQ ID NO: 1141635 - RNA, 19 nt, Homo sapiens
caagauguaugcgaaaugc

SEQ ID NO: 1141636 - RNA, 19 nt, Homo sapiens
uggauccucuagaaacuaa

SEQ ID NO: 1141637 - RNA, 19 nt, Homo sapiens
gacagugccuuaguuugga

SEQ ID NO: 1141638 - RNA, 19 nt, Homo sapiens
caguuucacucucagcauu

SEQ ID NO: 1141639 - RNA, 19 nt, Homo sapiens
gacaaugccaggacaacaa

SEQ ID NO: 1141640 - RNA, 19 nt, Homo sapiens
cuagaucuuucaggaauug

SEQ ID NO: 1141641 - RNA, 19 nt, Homo sapiens
ggugcuauucguccucuua

SEQ ID NO: 1141642 - RNA, 19 nt, Homo sapiens
ggauaacggcuuccagcuu

SEQ ID NO: 1141643 - RNA, 19 nt, Homo sapiens
gauuugcauuucucugaug

SEQ ID NO: 1141644 - RNA, 19 nt, Homo sapiens
guaaaagcauucauguuuc

SEQ ID NO: 1141645 - RNA, 19 nt, Homo sapiens
ccugcagguuuguuacaua

SEQ ID NO: 1141646 - RNA, 19 nt, Homo sapiens
auuaugagcugguuacuac

SEQ ID NO: 1141647 - RNA, 19 nt, Homo sapiens
gggagugagaugaguaauu

SEQ ID NO: 1141648 - RNA, 19 nt, Homo sapiens
gcaaaggacgugaucucau

SEQ ID NO: 1141649 - RNA, 19 nt, Homo sapiens
ggaagagagaagagucuau

SEQ ID NO: 1141650 - RNA, 19 nt, Homo sapiens
cagaguaagggaucauuga

SEQ ID NO: 1141651 - RNA, 19 nt, Homo sapiens
gcagaguaagggaucauug

SEQ ID NO: 1141652 - RNA, 19 nt, Homo sapiens
gaagaacugccagaaugug

SEQ ID NO: 1141653 - RNA, 19 nt, Homo sapiens
aauaacaacuuccaaucca

SEQ ID NO: 1141654 - RNA, 19 nt, Homo sapiens
caagaaagggaugugugua

SEQ ID NO: 1141655 - RNA, 19 nt, Homo sapiens
uaaauagugcugcagugaa

SEQ ID NO: 1141656 - RNA, 19 nt, Homo sapiens
ggacgugaucucauuucuu

SEQ ID NO: 1141657 - RNA, 19 nt, Homo sapiens
cgcaugcauuagcuauuua

SEQ ID NO: 1141658 - RNA, 19 nt, Homo sapiens
cugcaagaauaaacgcuuu

SEQ ID NO: 1141659 - RNA, 19 nt, Homo sapiens
gaaacaauaacaacuucca

SEQ ID NO: 1141660 - RNA, 19 nt, Homo sapiens
cacacucucuuccacaaug

SEQ ID NO: 1141661 - RNA, 19 nt, Homo sapiens
gagaagggaagagagaaga

SEQ ID NO: 1141662 - RNA, 19 nt, Homo sapiens
gaaacuaacccugggaaaa

SEQ ID NO: 1141663 - RNA, 19 nt, Homo sapiens
gugaagacaaucagaacuu

SEQ ID NO: 1141664 - RNA, 19 nt, Homo sapiens
cugagugauugacaucuuu

SEQ ID NO: 1141665 - RNA, 19 nt, Homo sapiens
ucugaguacuguuccugua

SEQ ID NO: 1141666 - RNA, 19 nt, Homo sapiens
aauacuugcuccauguuug

SEQ ID NO: 1141667 - RNA, 19 nt, Homo sapiens
ggugguaugacaagaaaga

SEQ ID NO: 1141668 - RNA, 19 nt, Homo sapiens
guucaucucccacuugcaa

SEQ ID NO: 1141669 - RNA, 19 nt, Homo sapiens
agagagaagagucuauuau

SEQ ID NO: 1141670 - RNA, 19 nt, Homo sapiens
gggaagagaagggaagaga

SEQ ID NO: 1141671 - RNA, 19 nt, Homo sapiens
ccaagaaagggaugugugu

SEQ ID NO: 1141672 - RNA, 19 nt, Homo sapiens
aaagccaacugccugaaca

SEQ ID NO: 1141673 - RNA, 19 nt, Homo sapiens
ggcacacucucuuccacaa

SEQ ID NO: 1141674 - RNA, 19 nt, Homo sapiens
aaauagugcugcagugaac

SEQ ID NO: 1141675 - RNA, 19 nt, Homo sapiens
gaggagagauugaauuuga

SEQ ID NO: 1141676 - RNA, 19 nt, Homo sapiens
gaagugaaauuguugagaa

SEQ ID NO: 1141677 - RNA, 19 nt, Homo sapiens
gaaagaagcacaacuugaa

SEQ ID NO: 1141678 - RNA, 19 nt, Homo sapiens
aaagagagcuugaggcaaa

SEQ ID NO: 1141679 - RNA, 19 nt, Homo sapiens
ccaauuagaagcugaaaua

SEQ ID NO: 1141680 - RNA, 19 nt, Homo sapiens
gaagggaccugcucaugau

SEQ ID NO: 1141681 - RNA, 19 nt, Homo sapiens
gaucaagauucccuaaaga

SEQ ID NO: 1141682 - RNA, 19 nt, Homo sapiens
gaucugaaaucugaacuga

SEQ ID NO: 1141683 - RNA, 19 nt, Homo sapiens
gaaaaguucuccuccuuaa

SEQ ID NO: 1141684 - RNA, 19 nt, Homo sapiens
gagaggagagauugaauuu

SEQ ID NO: 1141685 - RNA, 19 nt, Homo sapiens
ggccuuggcauuucaauua

SEQ ID NO: 1141686 - RNA, 19 nt, Homo sapiens
gagacuagcugccaaguac

SEQ ID NO: 1141687 - RNA, 19 nt, Homo sapiens
ggacaucguuaccguuugu

SEQ ID NO: 1141688 - RNA, 19 nt, Homo sapiens
ggacacaaagcauaaagaa

SEQ ID NO: 1141689 - RNA, 19 nt, Homo sapiens
ugacggugcuucaaaauua

SEQ ID NO: 1141690 - RNA, 19 nt, Homo sapiens
ggagaaggaguucgacaaa

SEQ ID NO: 1141691 - RNA, 19 nt, Homo sapiens
aagcggacaucacuuauga

SEQ ID NO: 1141692 - RNA, 19 nt, Homo sapiens
uggaggagcuggaaagaga

SEQ ID NO: 1141693 - RNA, 19 nt, Homo sapiens
agaaagaaguacaugauca

SEQ ID NO: 1141694 - RNA, 19 nt, Homo sapiens
ggagaaagaaguacaugau

SEQ ID NO: 1141695 - RNA, 19 nt, Homo sapiens
gaagcuguaacuauucuuu

SEQ ID NO: 1141696 - RNA, 19 nt, Homo sapiens
caacggaguuaaccuaagg

SEQ ID NO: 1141697 - RNA, 19 nt, Homo sapiens
ugaaguggauucugaugau

SEQ ID NO: 1141698 - RNA, 19 nt, Homo sapiens
gagauugaauuugaaguag

SEQ ID NO: 1141699 - RNA, 19 nt, Homo sapiens
cagaggacguaaugacuug

SEQ ID NO: 1141700 - RNA, 19 nt, Homo sapiens
ucuccaggcugaaguauau

SEQ ID NO: 1141701 - RNA, 19 nt, Homo sapiens
agaaguacaugaucagcuu

SEQ ID NO: 1141702 - RNA, 19 nt, Homo sapiens
guuuguaccuugaugaguu

SEQ ID NO: 1141703 - RNA, 19 nt, Homo sapiens
gaaguggauucugaugaug

SEQ ID NO: 1141704 - RNA, 19 nt, Homo sapiens
aagcugaagugaaauuguu

SEQ ID NO: 1141705 - RNA, 19 nt, Homo sapiens
gugaaacuccgcuagauga

SEQ ID NO: 1141706 - RNA, 19 nt, Homo sapiens
uaagggacacaaagcauaa

SEQ ID NO: 1141707 - RNA, 19 nt, Homo sapiens
gcaggaaggguccaacaga

SEQ ID NO: 1141708 - RNA, 19 nt, Homo sapiens
ucugaaaucugaacugaca

SEQ ID NO: 1141709 - RNA, 19 nt, Homo sapiens
aaacguagaguaugaagau

SEQ ID NO: 1141710 - RNA, 19 nt, Homo sapiens
gcagagaggagagauugaa

SEQ ID NO: 1141711 - RNA, 19 nt, Homo sapiens
gcagaggacguaaugacuu

SEQ ID NO: 1141712 - RNA, 19 nt, Homo sapiens
guaacugacacacaugaaa

SEQ ID NO: 1141713 - RNA, 19 nt, Homo sapiens
guaccuugaugaguuagaa

SEQ ID NO: 1141714 - RNA, 19 nt, Homo sapiens
agagaucgauccagaccaa

SEQ ID NO: 1141715 - RNA, 19 nt, Homo sapiens
caugaaggccuuggcauuu

SEQ ID NO: 1141716 - RNA, 19 nt, Homo sapiens
ugaagggaccugcucauga

SEQ ID NO: 1141717 - RNA, 19 nt, Homo sapiens
gcauaaagaagcuguaacu

SEQ ID NO: 1141718 - RNA, 19 nt, Homo sapiens
gagaaggaguucgacaaag

SEQ ID NO: 1141719 - RNA, 19 nt, Homo sapiens
ucaagauucccuaaagaaa

SEQ ID NO: 1141720 - RNA, 19 nt, Homo sapiens
ugaaagaagcacaacuuga

SEQ ID NO: 1141721 - RNA, 19 nt, Homo sapiens
ugguggaucugaaaucuga

SEQ ID NO: 1141722 - RNA, 19 nt, Homo sapiens
gaaagaaguacaugaucag

SEQ ID NO: 1141723 - RNA, 19 nt, Homo sapiens
ugcacacucuguaucauaa

SEQ ID NO: 1141724 - RNA, 19 nt, Homo sapiens
cuaagggacacaaagcaua

SEQ ID NO: 1141725 - RNA, 19 nt, Homo sapiens
ugaucaagauucccuaaag

SEQ ID NO: 1141726 - RNA, 19 nt, Homo sapiens
gaaccaauuagaagcugaa

SEQ ID NO: 1141727 - RNA, 19 nt, Homo sapiens
caggaaggguccaacagau

SEQ ID NO: 1141728 - RNA, 19 nt, Homo sapiens
caagugaaacuccgcuaga

SEQ ID NO: 1141729 - RNA, 19 nt, Homo sapiens
guacuuggauaaggaacug

SEQ ID NO: 1141730 - RNA, 19 nt, Homo sapiens
gagaaagaaguacaugauc

SEQ ID NO: 1141731 - RNA, 19 nt, Homo sapiens
uuauguggcuccugaagug

SEQ ID NO: 1141732 - RNA, 19 nt, Homo sapiens
ggaaggguccaacagauac

SEQ ID NO: 1141733 - RNA, 19 nt, Homo sapiens
agccugagcuccugcuuug

SEQ ID NO: 1141734 - RNA, 19 nt, Homo sapiens
caauugcuaggacgagaua

SEQ ID NO: 1141735 - RNA, 19 nt, Homo sapiens
gaaaguuguuuuggagaaa

SEQ ID NO: 1141736 - RNA, 19 nt, Homo sapiens
gaaguacaugaucagcuuu

SEQ ID NO: 1141737 - RNA, 19 nt, Homo sapiens
ggugcuaguugcaaagaca

SEQ ID NO: 1141738 - RNA, 19 nt, Homo sapiens
gauaaggaacuggcaggaa

SEQ ID NO: 1141739 - RNA, 19 nt, Homo sapiens
guagacauauagcuguucu

SEQ ID NO: 1141740 - RNA, 19 nt, Homo sapiens
uuuguaccuugaugaguua

SEQ ID NO: 1141741 - RNA, 19 nt, Homo sapiens
cagcagagaggagagauug

SEQ ID NO: 1141742 - RNA, 19 nt, Homo sapiens
agaaggaguucgacaaagc

SEQ ID NO: 1141743 - RNA, 19 nt, Homo sapiens
gaagcugaagugaaauugu

SEQ ID NO: 1141744 - RNA, 19 nt, Homo sapiens
ggcuggaggugcuggagaa

SEQ ID NO: 1141745 - RNA, 19 nt, Homo sapiens
cuccugaaguggauucuga

SEQ ID NO: 1141746 - RNA, 19 nt, Homo sapiens
uggaggugcuggagaagga

SEQ ID NO: 1141747 - RNA, 19 nt, Homo sapiens
gcacacucuguaucauaaa

SEQ ID NO: 1141748 - RNA, 19 nt, Homo sapiens
guggacaucguuaccguuu

SEQ ID NO: 1141749 - RNA, 19 nt, Homo sapiens
uagaugacggugcuucaaa

SEQ ID NO: 1141750 - RNA, 19 nt, Homo sapiens
cauaaagaagcuguaacua

SEQ ID NO: 1141751 - RNA, 19 nt, Homo sapiens
gguccaacagauacaauug

SEQ ID NO: 1141752 - RNA, 19 nt, Homo sapiens
aaugaaagaagcacaacuu

SEQ ID NO: 1141753 - RNA, 19 nt, Homo sapiens
gcacaguugguggaucuga

SEQ ID NO: 1141754 - RNA, 19 nt, Homo sapiens
ugucucaaaucaaccacaa

SEQ ID NO: 1141755 - RNA, 19 nt, Homo sapiens
ggugguaacccuggugcua

SEQ ID NO: 1141756 - RNA, 19 nt, Homo sapiens
ggagagauugaauuugaag

SEQ ID NO: 1141757 - RNA, 19 nt, Homo sapiens
aauuacaggugggaaagaa

SEQ ID NO: 1141758 - RNA, 19 nt, Homo sapiens
ucaugaaggccuuggcauu

SEQ ID NO: 1141759 - RNA, 19 nt, Homo sapiens
aggaaggguccaacagaua

SEQ ID NO: 1141760 - RNA, 19 nt, Homo sapiens
gaucugcacacucuguauc

SEQ ID NO: 1141761 - RNA, 19 nt, Homo sapiens
aaagaagcuguaacuauuc

SEQ ID NO: 1141762 - RNA, 19 nt, Homo sapiens
caagauucccuaaagaaaa

SEQ ID NO: 1141763 - RNA, 19 nt, Homo sapiens
gaaacgaccaaugcaagca

SEQ ID NO: 1141764 - RNA, 19 nt, Homo sapiens
ccaagcagagaaaguuguu

SEQ ID NO: 1141765 - RNA, 19 nt, Homo sapiens
gaugaucugcacacucugu

SEQ ID NO: 1141766 - RNA, 19 nt, Homo sapiens
caagcuggaggcacaguug

SEQ ID NO: 1141767 - RNA, 19 nt, Homo sapiens
cgagacuagcugccaagua

SEQ ID NO: 1141768 - RNA, 19 nt, Homo sapiens
caaagugcugacucuggua

SEQ ID NO: 1141769 - RNA, 19 nt, Homo sapiens
accaagcggacaucacuua

SEQ ID NO: 1141770 - RNA, 19 nt, Homo sapiens
uugcacagcuuugccacaa

SEQ ID NO: 1141771 - RNA, 19 nt, Homo sapiens
uuccaauccucaucucuga

SEQ ID NO: 1141772 - RNA, 19 nt, Homo sapiens
aaaguucuccuccuuaagg

SEQ ID NO: 1141773 - RNA, 19 nt, Homo sapiens
cagaaacccaagcagagaa

SEQ ID NO: 1141774 - RNA, 19 nt, Homo sapiens
caagcggacaucacuuaug

SEQ ID NO: 1141775 - RNA, 19 nt, Homo sapiens
ggacaaagcuacugagaug

SEQ ID NO: 1141776 - RNA, 19 nt, Homo sapiens
ggaaauggcuucuuuaaac

SEQ ID NO: 1141777 - RNA, 19 nt, Homo sapiens
gaaauggcuucuuuaaacu

SEQ ID NO: 1141778 - RNA, 19 nt, Homo sapiens
gcagaagaguacaaagugu

SEQ ID NO: 1141779 - RNA, 19 nt, Homo sapiens
gcacugguucucaaacuuu

SEQ ID NO: 1141780 - RNA, 19 nt, Homo sapiens
aaauacacaugcacacaaa

SEQ ID NO: 1141781 - RNA, 19 nt, Homo sapiens
ccacugaggccuaauacaa

SEQ ID NO: 1141782 - RNA, 19 nt, Homo sapiens
cuacugagaugccuguuca

SEQ ID NO: 1141783 - RNA, 19 nt, Homo sapiens
gagcuuugcuuauauuuug

SEQ ID NO: 1141784 - RNA, 19 nt, Homo sapiens
cuaaagcacugguucucaa

SEQ ID NO: 1141785 - RNA, 19 nt, Homo sapiens
ugaugaagcugugaccaaa

SEQ ID NO: 1141786 - RNA, 19 nt, Homo sapiens
ggguggcaauuccagcuua

SEQ ID NO: 1141787 - RNA, 19 nt, Homo sapiens
gccaacagcuccucaacca

SEQ ID NO: 1141788 - RNA, 19 nt, Homo sapiens
cuacauucuuucucgcaua

SEQ ID NO: 1141789 - RNA, 19 nt, Homo sapiens
ggucucugcugcugaugaa

SEQ ID NO: 1141790 - RNA, 19 nt, Homo sapiens
ccgcugguguacuacuuua

SEQ ID NO: 1141791 - RNA, 19 nt, Homo sapiens
uggcuaaccucgucaucuu

SEQ ID NO: 1141792 - RNA, 19 nt, Homo sapiens
uaaauacacaugcacacaa

SEQ ID NO: 1141793 - RNA, 19 nt, Homo sapiens
gcugggcacuuggaccuuu

SEQ ID NO: 1141794 - RNA, 19 nt, Homo sapiens
cugguuagauggaacagaa

SEQ ID NO: 1141795 - RNA, 19 nt, Homo sapiens
caacaacauccaaguccaa

SEQ ID NO: 1141796 - RNA, 19 nt, Homo sapiens
caacgcagaagaguacaaa

SEQ ID NO: 1141797 - RNA, 19 nt, Homo sapiens
auacaagaguuccuaugga

SEQ ID NO: 1141798 - RNA, 19 nt, Homo sapiens
gcgacgagcuguggaaagg

SEQ ID NO: 1141799 - RNA, 19 nt, Homo sapiens
uuccaggccuccuccauuu

SEQ ID NO: 1141800 - RNA, 19 nt, Homo sapiens
gcuggaaauggcuucuuua

SEQ ID NO: 1141801 - RNA, 19 nt, Homo sapiens
ggcagaagaggacgaaaug

SEQ ID NO: 1141802 - RNA, 19 nt, Homo sapiens
gauacuuaccauacuagaa

SEQ ID NO: 1141803 - RNA, 19 nt, Homo sapiens
gggcagaagaggacgaaau

SEQ ID NO: 1141804 - RNA, 19 nt, Homo sapiens
uggacccgcugguguacua

SEQ ID NO: 1141805 - RNA, 19 nt, Homo sapiens
guacggcagcugcaucuuc

SEQ ID NO: 1141806 - RNA, 19 nt, Homo sapiens
uaaagcacugguucucaaa

SEQ ID NO: 1141807 - RNA, 19 nt, Homo sapiens
ucaccacugaggccuaaua

SEQ ID NO: 1141808 - RNA, 19 nt, Homo sapiens
cugaagagcaccagguuug

SEQ ID NO: 1141809 - RNA, 19 nt, Homo sapiens
ccacuuuggcacgauguua

SEQ ID NO: 1141810 - RNA, 19 nt, Homo sapiens
gcaaggcaaaacuaacuua

SEQ ID NO: 1141811 - RNA, 19 nt, Homo sapiens
gcauuaaacugcuaaaagc

SEQ ID NO: 1141812 - RNA, 19 nt, Homo sapiens
gcagcugcaucuuccugau

SEQ ID NO: 1141813 - RNA, 19 nt, Homo sapiens
uggaaauggcuucuuuaaa

SEQ ID NO: 1141814 - RNA, 19 nt, Homo sapiens
ugaccucccucugcuuguu

SEQ ID NO: 1141815 - RNA, 19 nt, Homo sapiens
gaaggugggcugggcacuu

SEQ ID NO: 1141816 - RNA, 19 nt, Homo sapiens
guggugagcguguacaugu

SEQ ID NO: 1141817 - RNA, 19 nt, Homo sapiens
acugaggccuaauacaaga

SEQ ID NO: 1141818 - RNA, 19 nt, Homo sapiens
ggauuccgcccucugaaca

SEQ ID NO: 1141819 - RNA, 19 nt, Homo sapiens
cuggaaauggcuucuuuaa

SEQ ID NO: 1141820 - RNA, 19 nt, Homo sapiens
ugcuggaaauggcuucuuu

SEQ ID NO: 1141821 - RNA, 19 nt, Homo sapiens
uagcaacgcagaagaguac

SEQ ID NO: 1141822 - RNA, 19 nt, Homo sapiens
aaggugggcugggcacuug

SEQ ID NO: 1141823 - RNA, 19 nt, Homo sapiens
ucuuagaaauugaggaucu

SEQ ID NO: 1141824 - RNA, 19 nt, Homo sapiens
guuauccuuucuuccauca

SEQ ID NO: 1141825 - RNA, 19 nt, Homo sapiens
gcugaagagcaccagguuu

SEQ ID NO: 1141826 - RNA, 19 nt, Homo sapiens
ucuuccagaugaacaugua

SEQ ID NO: 1141827 - RNA, 19 nt, Homo sapiens
ccguucgucucuccuacua

SEQ ID NO: 1141828 - RNA, 19 nt, Homo sapiens
ccaggauuccgcccucuga

SEQ ID NO: 1141829 - RNA, 19 nt, Homo sapiens
ucuccuuuguccagaguaa

SEQ ID NO: 1141830 - RNA, 19 nt, Homo sapiens
uauccuuucuuccaucaca

SEQ ID NO: 1141831 - RNA, 19 nt, Homo sapiens
uggcuucuuuaaacuguga

SEQ ID NO: 1141832 - RNA, 19 nt, Homo sapiens
acaggucucugcugcugau

SEQ ID NO: 1141833 - RNA, 19 nt, Homo sapiens
gcgcucauccugguguuug

SEQ ID NO: 1141834 - RNA, 19 nt, Homo sapiens
ccuaauacaagaguuccua

SEQ ID NO: 1141835 - RNA, 19 nt, Homo sapiens
gaccucccucugcuuguuu

SEQ ID NO: 1141836 - RNA, 19 nt, Homo sapiens
uacauucuuucucgcauag

SEQ ID NO: 1141837 - RNA, 19 nt, Homo sapiens
gcaacgcagaagaguacaa

SEQ ID NO: 1141838 - RNA, 19 nt, Homo sapiens
gguggcaauuccagcuuag

SEQ ID NO: 1141839 - RNA, 19 nt, Homo sapiens
uguccugacuaccgaccua

SEQ ID NO: 1141840 - RNA, 19 nt, Homo sapiens
ucucguuucucucuucucu

SEQ ID NO: 1141841 - RNA, 19 nt, Homo sapiens
gcuccucaaccaacaguuc

SEQ ID NO: 1141842 - RNA, 19 nt, Homo sapiens
uaauacaagaguuccuaug

SEQ ID NO: 1141843 - RNA, 19 nt, Homo sapiens
ucugcugacuucugucuag

SEQ ID NO: 1141844 - RNA, 19 nt, Homo sapiens
gcagccauagcccacauuc

SEQ ID NO: 1141845 - RNA, 19 nt, Homo sapiens
ccaggccuccuccauuuua

SEQ ID NO: 1141846 - RNA, 19 nt, Homo sapiens
cauucuuucucgcauagug

SEQ ID NO: 1141847 - RNA, 19 nt, Homo sapiens
cuguucaucugcugacuuc

SEQ ID NO: 1141848 - RNA, 19 nt, Homo sapiens
aauggcuucuuuaaacugu

SEQ ID NO: 1141849 - RNA, 19 nt, Homo sapiens
cgcagaagaguacaaagug

SEQ ID NO: 1141850 - RNA, 19 nt, Homo sapiens
ggugagcguguacaugugu

SEQ ID NO: 1141851 - RNA, 19 nt, Homo sapiens
ggaaaucucuccaugguua

SEQ ID NO: 1141852 - RNA, 19 nt, Homo sapiens
gaaaguguauucgcaguua

SEQ ID NO: 1141853 - RNA, 19 nt, Homo sapiens
caucagagcuuauuuggaa

SEQ ID NO: 1141854 - RNA, 19 nt, Homo sapiens
uaucagugcuguuauguua

SEQ ID NO: 1141855 - RNA, 19 nt, Homo sapiens
gcaaugcaauuaugagaaa

SEQ ID NO: 1141856 - RNA, 19 nt, Homo sapiens
ggaaaguguuacagaauuu

SEQ ID NO: 1141857 - RNA, 19 nt, Homo sapiens
caaauggucuuacugagaa

SEQ ID NO: 1141858 - RNA, 19 nt, Homo sapiens
gcagaaaucuauaaucagu

SEQ ID NO: 1141859 - RNA, 19 nt, Homo sapiens
gagaauaucugggagcaaa

SEQ ID NO: 1141860 - RNA, 19 nt, Homo sapiens
ggaggaaguuucuauugaa

SEQ ID NO: 1141861 - RNA, 19 nt, Homo sapiens
gaaacagagugcucagaaa

SEQ ID NO: 1141862 - RNA, 19 nt, Homo sapiens
gcacgaagcugcaaaagaa

SEQ ID NO: 1141863 - RNA, 19 nt, Homo sapiens
caaagaagaccaugaaaga

SEQ ID NO: 1141864 - RNA, 19 nt, Homo sapiens
gaaaguggcucaugaacac

SEQ ID NO: 1141865 - RNA, 19 nt, Homo sapiens
ggaaguuucuauugaaguu

SEQ ID NO: 1141866 - RNA, 19 nt, Homo sapiens
guaauugacugguugguau

SEQ ID NO: 1141867 - RNA, 19 nt, Homo sapiens
gcuggaaacuguaccauga

SEQ ID NO: 1141868 - RNA, 19 nt, Homo sapiens
gauauuuccugcauucuug

SEQ ID NO: 1141869 - RNA, 19 nt, Homo sapiens
gaagcugcauccaugagua

SEQ ID NO: 1141870 - RNA, 19 nt, Homo sapiens
gaaacaaggcaaugcaauu

SEQ ID NO: 1141871 - RNA, 19 nt, Homo sapiens
ccagggacuugacccauua

SEQ ID NO: 1141872 - RNA, 19 nt, Homo sapiens
gaagaacucccuagagaau

SEQ ID NO: 1141873 - RNA, 19 nt, Homo sapiens
ggaagcccaugaaaccuuu

SEQ ID NO: 1141874 - RNA, 19 nt, Homo sapiens
ggaggcugcuggcuucuuu

SEQ ID NO: 1141875 - RNA, 19 nt, Homo sapiens
uagagaagaugaaguuaga

SEQ ID NO: 1141876 - RNA, 19 nt, Homo sapiens
ggacaggaguggcuuugga

SEQ ID NO: 1141877 - RNA, 19 nt, Homo sapiens
caugaaaccuuuaaugagu

SEQ ID NO: 1141878 - RNA, 19 nt, Homo sapiens
aaacaaggcaaugcaauua

SEQ ID NO: 1141879 - RNA, 19 nt, Homo sapiens
ggaagagaaucaagaacau

SEQ ID NO: 1141880 - RNA, 19 nt, Homo sapiens
ugaaagaacacaucaaaug

SEQ ID NO: 1141881 - RNA, 19 nt, Homo sapiens
ggaguuggcuaaagaagca

SEQ ID NO: 1141882 - RNA, 19 nt, Homo sapiens
ggacaccugcuucgcuuua

SEQ ID NO: 1141883 - RNA, 19 nt, Homo sapiens
ggauagagaagaugaaguu

SEQ ID NO: 1141884 - RNA, 19 nt, Homo sapiens
gcagcugacuucuuacguu

SEQ ID NO: 1141885 - RNA, 19 nt, Homo sapiens
uaaggaaguugcugcagaa

SEQ ID NO: 1141886 - RNA, 19 nt, Homo sapiens
cauacgauauugcacagua

SEQ ID NO: 1141887 - RNA, 19 nt, Homo sapiens
gaaagaacacaucaaaugg

SEQ ID NO: 1141888 - RNA, 19 nt, Homo sapiens
gaaaauguauaacgucuug

SEQ ID NO: 1141889 - RNA, 19 nt, Homo sapiens
ggaugaaacugaagaacuc

SEQ ID NO: 1141890 - RNA, 19 nt, Homo sapiens
gauacgagagagcaauuua

SEQ ID NO: 1141891 - RNA, 19 nt, Homo sapiens
uaacugggcagcugcauuu

SEQ ID NO: 1141892 - RNA, 19 nt, Homo sapiens
ggaaacagagugcucagaa

SEQ ID NO: 1141893 - RNA, 19 nt, Homo sapiens
ggagcaaacuggacguuag

SEQ ID NO: 1141894 - RNA, 19 nt, Homo sapiens
ucugugugcuuguuaauaa

SEQ ID NO: 1141895 - RNA, 19 nt, Homo sapiens
guagauugguuagagagua

SEQ ID NO: 1141896 - RNA, 19 nt, Homo sapiens
ucagagggauucacuuguu

SEQ ID NO: 1141897 - RNA, 19 nt, Homo sapiens
ccagauauuuccugcauuc

SEQ ID NO: 1141898 - RNA, 19 nt, Homo sapiens
ucaggaaugccuacaguua

SEQ ID NO: 1141899 - RNA, 19 nt, Homo sapiens
uaccaugacccuaauguua

SEQ ID NO: 1141900 - RNA, 19 nt, Homo sapiens
aacggcagcugacuucuua

SEQ ID NO: 1141901 - RNA, 19 nt, Homo sapiens
uagagaggaugccaaagaa

SEQ ID NO: 1141902 - RNA, 19 nt, Homo sapiens
uaaagaagcagauuuggau

SEQ ID NO: 1141903 - RNA, 19 nt, Homo sapiens
gcacaacgacucuguaaac

SEQ ID NO: 1141904 - RNA, 19 nt, Homo sapiens
gcugcuggcuucuuuguau

SEQ ID NO: 1141905 - RNA, 19 nt, Homo sapiens
ggaaguugcugcagaagcu

SEQ ID NO: 1141906 - RNA, 19 nt, Homo sapiens
uauaacgucuuguuguuug

SEQ ID NO: 1141907 - RNA, 19 nt, Homo sapiens
gagagaaacauacaaaucu

SEQ ID NO: 1141908 - RNA, 19 nt, Homo sapiens
cugaagaacucccuagaga

SEQ ID NO: 1141909 - RNA, 19 nt, Homo sapiens
aaagucagcuggugguaga

SEQ ID NO: 1141910 - RNA, 19 nt, Homo sapiens
gagaagaugaaguuagauu

SEQ ID NO: 1141911 - RNA, 19 nt, Homo sapiens
gaauacagucugcauuaga

SEQ ID NO: 1141912 - RNA, 19 nt, Homo sapiens
guuccgggcuguucacaaa

SEQ ID NO: 1141913 - RNA, 19 nt, Homo sapiens
ugaagggaauccauauaga

SEQ ID NO: 1141914 - RNA, 19 nt, Homo sapiens
gauaucagcguuucucugu

SEQ ID NO: 1141915 - RNA, 19 nt, Homo sapiens
acaguuagcagauauggua

SEQ ID NO: 1141916 - RNA, 19 nt, Homo sapiens
uggaaaguguuacagaauu

SEQ ID NO: 1141917 - RNA, 19 nt, Homo sapiens
agacauugaugguuugaug

SEQ ID NO: 1141918 - RNA, 19 nt, Homo sapiens
caugaaagaacacaucaaa

SEQ ID NO: 1141919 - RNA, 19 nt, Homo sapiens
gagaggaugccaaagaaga

SEQ ID NO: 1141920 - RNA, 19 nt, Homo sapiens
gaggguggaugguggaugu

SEQ ID NO: 1141921 - RNA, 19 nt, Homo sapiens
ggacccugaugcucccaua

SEQ ID NO: 1141922 - RNA, 19 nt, Homo sapiens
gaacacaucaaauggucuu

SEQ ID NO: 1141923 - RNA, 19 nt, Homo sapiens
gguuuaagcauaugaauuc

SEQ ID NO: 1141924 - RNA, 19 nt, Homo sapiens
gaaaauucuuggcaucaaa

SEQ ID NO: 1141925 - RNA, 19 nt, Homo sapiens
gaagagaaucaagaacauu

SEQ ID NO: 1141926 - RNA, 19 nt, Homo sapiens
uagagaguauugccaaaga

SEQ ID NO: 1141927 - RNA, 19 nt, Homo sapiens
caucaaauggucuuacuga

SEQ ID NO: 1141928 - RNA, 19 nt, Homo sapiens
gaguggcuuuggagagaua

SEQ ID NO: 1141929 - RNA, 19 nt, Homo sapiens
ugggagacauugaugguuu

SEQ ID NO: 1141930 - RNA, 19 nt, Homo sapiens
aaugagugguuuaagcaua

SEQ ID NO: 1141931 - RNA, 19 nt, Homo sapiens
gaacaaggaauggaaaguc

SEQ ID NO: 1141932 - RNA, 19 nt, Homo sapiens
gagaauauucgaaagaaag

SEQ ID NO: 1141933 - RNA, 19 nt, Homo sapiens
gaagaugaaguuagauuac

SEQ ID NO: 1141934 - RNA, 19 nt, Homo sapiens
aauacagucugcauuagaa

SEQ ID NO: 1141935 - RNA, 19 nt, Homo sapiens
gaaaacaucugugguaguc

SEQ ID NO: 1141936 - RNA, 19 nt, Homo sapiens
uguauaacgucuuguuguu

SEQ ID NO: 1141937 - RNA, 19 nt, Homo sapiens
cgagaacauuugugcauca

SEQ ID NO: 1141938 - RNA, 19 nt, Homo sapiens
ucauuugccucaagaccua

SEQ ID NO: 1141939 - RNA, 19 nt, Homo sapiens
agaacucccuagagaauau

SEQ ID NO: 1141940 - RNA, 19 nt, Homo sapiens
aggaagagcuaaggaaguu

SEQ ID NO: 1141941 - RNA, 19 nt, Homo sapiens
acaaggcaaugcaauuaug

SEQ ID NO: 1141942 - RNA, 19 nt, Homo sapiens
gaagcagauuuggauguug

SEQ ID NO: 1141943 - RNA, 19 nt, Homo sapiens
gaggaaguuucuauugaag

SEQ ID NO: 1141944 - RNA, 19 nt, Homo sapiens
aggaggaaguuucuauuga

SEQ ID NO: 1141945 - RNA, 19 nt, Homo sapiens
gaguuuagcaaauggcuuu

SEQ ID NO: 1141946 - RNA, 19 nt, Homo sapiens
gcaaacuggacguuagaaa

SEQ ID NO: 1141947 - RNA, 19 nt, Homo sapiens
uugaugaucuggauagaga

SEQ ID NO: 1141948 - RNA, 19 nt, Homo sapiens
uuacuaaggcagccagaua

SEQ ID NO: 1141949 - RNA, 19 nt, Homo sapiens
caguauaacagaagaugua

SEQ ID NO: 1141950 - RNA, 19 nt, Homo sapiens
uaucagcguuucucugugu

SEQ ID NO: 1141951 - RNA, 19 nt, Homo sapiens
ggacagagagccacagaua

SEQ ID NO: 1141952 - RNA, 19 nt, Homo sapiens
gagaugaguugcuggauga

SEQ ID NO: 1141953 - RNA, 19 nt, Homo sapiens
gcgcaucacugacugcuau

SEQ ID NO: 1141954 - RNA, 19 nt, Homo sapiens
ccacccagcuucccauuau

SEQ ID NO: 1141955 - RNA, 19 nt, Homo sapiens
ccuaugaucucaaccaaau

SEQ ID NO: 1141956 - RNA, 19 nt, Homo sapiens
gcagaugugugucaacuac

SEQ ID NO: 1141957 - RNA, 19 nt, Homo sapiens
gguccucucucaaccacua

SEQ ID NO: 1141958 - RNA, 19 nt, Homo sapiens
ccaacaagcgcaucacuga

SEQ ID NO: 1141959 - RNA, 19 nt, Homo sapiens
ccaaauauccggagcucuu

SEQ ID NO: 1141960 - RNA, 19 nt, Homo sapiens
acagaugagugccagauug

SEQ ID NO: 1141961 - RNA, 19 nt, Homo sapiens
ccacuagacuuggcucuca

SEQ ID NO: 1141962 - RNA, 19 nt, Homo sapiens
gaccaaggauacaccaaag

SEQ ID NO: 1141963 - RNA, 19 nt, Homo sapiens
gagcaagagcccaacagaa

SEQ ID NO: 1141964 - RNA, 19 nt, Homo sapiens
aaccagaccucacccauca

SEQ ID NO: 1141965 - RNA, 19 nt, Homo sapiens
gcagccaacuauccagauc

SEQ ID NO: 1141966 - RNA, 19 nt, Homo sapiens
ggaccucggagaugaguug

SEQ ID NO: 1141967 - RNA, 19 nt, Homo sapiens
gcacccagaccaccacuca

SEQ ID NO: 1141968 - RNA, 19 nt, Homo sapiens
ccaccagccuccugugauc

SEQ ID NO: 1141969 - RNA, 19 nt, Homo sapiens
gcuggggucuucuccaaua

SEQ ID NO: 1141970 - RNA, 19 nt, Homo sapiens
ggagcaagagcccaacaga

SEQ ID NO: 1141971 - RNA, 19 nt, Homo sapiens
gggaggaugaggaagauga

SEQ ID NO: 1141972 - RNA, 19 nt, Homo sapiens
ggauacaccaaagcccuua

SEQ ID NO: 1141973 - RNA, 19 nt, Homo sapiens
gcagaaccagcgugugaug

SEQ ID NO: 1141974 - RNA, 19 nt, Homo sapiens
ccacucauuugccuggaau

SEQ ID NO: 1141975 - RNA, 19 nt, Homo sapiens
ggucuucuccaauaaaugg

SEQ ID NO: 1141976 - RNA, 19 nt, Homo sapiens
cagccaggguccucucuca

SEQ ID NO: 1141977 - RNA, 19 nt, Homo sapiens
ugaccaaggauacaccaaa

SEQ ID NO: 1141978 - RNA, 19 nt, Homo sapiens
cccaggaccucggagauga

SEQ ID NO: 1141979 - RNA, 19 nt, Homo sapiens
ggaggaugaggaagaugaa

SEQ ID NO: 1141980 - RNA, 19 nt, Homo sapiens
uaaauggggugucaaccuu

SEQ ID NO: 1141981 - RNA, 19 nt, Homo sapiens
caccuggucuccacagagu

SEQ ID NO: 1141982 - RNA, 19 nt, Homo sapiens
ccagaccaccacucauuug

SEQ ID NO: 1141983 - RNA, 19 nt, Homo sapiens
gggcugcgaacacgaaugu

SEQ ID NO: 1141984 - RNA, 19 nt, Homo sapiens
cagcagaugugugucaacu

SEQ ID NO: 1141985 - RNA, 19 nt, Homo sapiens
cgugaucgcagccaacuau

SEQ ID NO: 1141986 - RNA, 19 nt, Homo sapiens
cuacgcagccgccugacuu

SEQ ID NO: 1141987 - RNA, 19 nt, Homo sapiens
guugguggcuucgaguguu

SEQ ID NO: 1141988 - RNA, 19 nt, Homo sapiens
cugcagaaccagcguguga

SEQ ID NO: 1141989 - RNA, 19 nt, Homo sapiens
ggugccaacgugugucuuu

SEQ ID NO: 1141990 - RNA, 19 nt, Homo sapiens
cugcccagcuggacagaug

SEQ ID NO: 1141991 - RNA, 19 nt, Homo sapiens
gaggacagagagccacaga

SEQ ID NO: 1141992 - RNA, 19 nt, Homo sapiens
ggcuucgaguguuauugua

SEQ ID NO: 1141993 - RNA, 19 nt, Homo sapiens
gcacccaacaagcgcauca

SEQ ID NO: 1141994 - RNA, 19 nt, Homo sapiens
gaucgcagccaacuaucca

SEQ ID NO: 1141995 - RNA, 19 nt, Homo sapiens
uugguggcuucgaguguua

SEQ ID NO: 1141996 - RNA, 19 nt, Homo sapiens
caacugcccagcccucucu

SEQ ID NO: 1141997 - RNA, 19 nt, Homo sapiens
ugccuggaaucccaccuaa

SEQ ID NO: 1141998 - RNA, 19 nt, Homo sapiens
ccacacacccagcuuuguc

SEQ ID NO: 1141999 - RNA, 19 nt, Homo sapiens
gagcuucccagaggacaga

SEQ ID NO: 1142000 - RNA, 19 nt, Homo sapiens
acacggcuuucaccaacug

SEQ ID NO: 1142001 - RNA, 19 nt, Homo sapiens
gauacaccaaagcccuuaa

SEQ ID NO: 1142002 - RNA, 19 nt, Homo sapiens
gccacccagcuucccauua

SEQ ID NO: 1142003 - RNA, 19 nt, Homo sapiens
ccuggucuccacagaguuu

SEQ ID NO: 1142004 - RNA, 19 nt, Homo sapiens
caaauauccggagcucuuc

SEQ ID NO: 1142005 - RNA, 19 nt, Homo sapiens
gggaccaggacacggcuuu

SEQ ID NO: 1142006 - RNA, 19 nt, Homo sapiens
gccagcagaugugugucaa

SEQ ID NO: 1142007 - RNA, 19 nt, Homo sapiens
cgugcgagcagcaguguga

SEQ ID NO: 1142008 - RNA, 19 nt, Homo sapiens
cagcugcuacgcucucuuc

SEQ ID NO: 1142009 - RNA, 19 nt, Homo sapiens
gcgcucgugaccaaggaua

SEQ ID NO: 1142010 - RNA, 19 nt, Homo sapiens
gaccaggacacggcuuuca

SEQ ID NO: 1142011 - RNA, 19 nt, Homo sapiens
ccaacccgguauucucucu

SEQ ID NO: 1142012 - RNA, 19 nt, Homo sapiens
gagaugagauggugguuua

SEQ ID NO: 1142013 - RNA, 19 nt, Homo sapiens
ggacuugccugauaaauau

SEQ ID NO: 1142014 - RNA, 19 nt, Homo sapiens
gaaggagcaucuuugaaua

SEQ ID NO: 1142015 - RNA, 19 nt, Homo sapiens
gaaagucuaugcugucaaa

SEQ ID NO: 1142016 - RNA, 19 nt, Homo sapiens
acacuuaacucacuucuuu

SEQ ID NO: 1142017 - RNA, 19 nt, Homo sapiens
guaaaucccuggaaguaaa

SEQ ID NO: 1142018 - RNA, 19 nt, Homo sapiens
ggagggaagucaaauaaga

SEQ ID NO: 1142019 - RNA, 19 nt, Homo sapiens
ggaacagacucacagauug

SEQ ID NO: 1142020 - RNA, 19 nt, Homo sapiens
ggacauacaauaaaucuga

SEQ ID NO: 1142021 - RNA, 19 nt, Homo sapiens
gcagugagcucagauagug

SEQ ID NO: 1142022 - RNA, 19 nt, Homo sapiens
gaacuaacauaacuaacuc

SEQ ID NO: 1142023 - RNA, 19 nt, Homo sapiens
gaaaguccuucacuacaug

SEQ ID NO: 1142024 - RNA, 19 nt, Homo sapiens
ugacacaucucuaguacuu

SEQ ID NO: 1142025 - RNA, 19 nt, Homo sapiens
gaacaacaaccuaaucuca

SEQ ID NO: 1142026 - RNA, 19 nt, Homo sapiens
cuccauagcuaccaaguua

SEQ ID NO: 1142027 - RNA, 19 nt, Homo sapiens
gcagagagcuaugaucauc

SEQ ID NO: 1142028 - RNA, 19 nt, Homo sapiens
cagauucccuuacacuuaa

SEQ ID NO: 1142029 - RNA, 19 nt, Homo sapiens
acacauaccuugguucuga

SEQ ID NO: 1142030 - RNA, 19 nt, Homo sapiens
gaacuuaaugguagaauuc

SEQ ID NO: 1142031 - RNA, 19 nt, Homo sapiens
gcaaagcaccugagugguu

SEQ ID NO: 1142032 - RNA, 19 nt, Homo sapiens
ugacacagguuaacuaaag

SEQ ID NO: 1142033 - RNA, 19 nt, Homo sapiens
ggaagcauguaaacagcua

SEQ ID NO: 1142034 - RNA, 19 nt, Homo sapiens
cagcuugguuuguuaaauu

SEQ ID NO: 1142035 - RNA, 19 nt, Homo sapiens
gcugugaucuaacauuuau

SEQ ID NO: 1142036 - RNA, 19 nt, Homo sapiens
aaaccuaccugaacuuaau

SEQ ID NO: 1142037 - RNA, 19 nt, Homo sapiens
agaagaggcugugaucuaa

SEQ ID NO: 1142038 - RNA, 19 nt, Homo sapiens
uaacuaaagucaagauugg

SEQ ID NO: 1142039 - RNA, 19 nt, Homo sapiens
gaagaugacaccaaguuga

SEQ ID NO: 1142040 - RNA, 19 nt, Homo sapiens
ugaaacagcagaagaacua

SEQ ID NO: 1142041 - RNA, 19 nt, Homo sapiens
ccacaguuguuuacuuuga

SEQ ID NO: 1142042 - RNA, 19 nt, Homo sapiens
uaaacucucugcauggauu

SEQ ID NO: 1142043 - RNA, 19 nt, Homo sapiens
gcaauaagauaugcacaca

SEQ ID NO: 1142044 - RNA, 19 nt, Homo sapiens
caaguuaaccugcucuaaa

SEQ ID NO: 1142045 - RNA, 19 nt, Homo sapiens
gcagcaagcagaaugaauu

SEQ ID NO: 1142046 - RNA, 19 nt, Homo sapiens
caauaaaucugagaaaguc

SEQ ID NO: 1142047 - RNA, 19 nt, Homo sapiens
gccaaucucugucuccaaa

SEQ ID NO: 1142048 - RNA, 19 nt, Homo sapiens
ccagauucccuuacacuua

SEQ ID NO: 1142049 - RNA, 19 nt, Homo sapiens
ccucauggcuauagaguug

SEQ ID NO: 1142050 - RNA, 19 nt, Homo sapiens
gcauggauucucaguguua

SEQ ID NO: 1142051 - RNA, 19 nt, Homo sapiens
ucacuugcaucuucacaaa

SEQ ID NO: 1142052 - RNA, 19 nt, Homo sapiens
ggcaaagcccgcauaauuu

SEQ ID NO: 1142053 - RNA, 19 nt, Homo sapiens
caacucugauugucacuug

SEQ ID NO: 1142054 - RNA, 19 nt, Homo sapiens
gggcugugcuucccucauu

SEQ ID NO: 1142055 - RNA, 19 nt, Homo sapiens
cagaagaacuaacauaacu

SEQ ID NO: 1142056 - RNA, 19 nt, Homo sapiens
uuuagaagcuugaaaggaa

SEQ ID NO: 1142057 - RNA, 19 nt, Homo sapiens
gguauucucuccaucuguu

SEQ ID NO: 1142058 - RNA, 19 nt, Homo sapiens
gagacggccuucagaacaa

SEQ ID NO: 1142059 - RNA, 19 nt, Homo sapiens
gagaaagucuaugcuguca

SEQ ID NO: 1142060 - RNA, 19 nt, Homo sapiens
gaaugaauuuggacucagu

SEQ ID NO: 1142061 - RNA, 19 nt, Homo sapiens
gcauugucuuugccuauaa

SEQ ID NO: 1142062 - RNA, 19 nt, Homo sapiens
uaacucacuucuuucuuug

SEQ ID NO: 1142063 - RNA, 19 nt, Homo sapiens
gauugucacuugcaucuuc

SEQ ID NO: 1142064 - RNA, 19 nt, Homo sapiens
ucacugcccuguucugaug

SEQ ID NO: 1142065 - RNA, 19 nt, Homo sapiens
ucaauggucugcucuguag

SEQ ID NO: 1142066 - RNA, 19 nt, Homo sapiens
cgaaggagcaucuuugaau

SEQ ID NO: 1142067 - RNA, 19 nt, Homo sapiens
ccgaagaucaccacacaua

SEQ ID NO: 1142068 - RNA, 19 nt, Homo sapiens
ggaguggcauuccgaagau

SEQ ID NO: 1142069 - RNA, 19 nt, Homo sapiens
aagcaaaccuacaccagaa

SEQ ID NO: 1142070 - RNA, 19 nt, Homo sapiens
gagggcuccuugagacaua

SEQ ID NO: 1142071 - RNA, 19 nt, Homo sapiens
aggcaaagcccgcauaauu

SEQ ID NO: 1142072 - RNA, 19 nt, Homo sapiens
gcgaggacuuccaggauga

SEQ ID NO: 1142073 - RNA, 19 nt, Homo sapiens
ggacaaccacagcuauuau

SEQ ID NO: 1142074 - RNA, 19 nt, Homo sapiens
uauacagccuuguuuaaug

SEQ ID NO: 1142075 - RNA, 19 nt, Homo sapiens
gcuaugcgcagccacauuu

SEQ ID NO: 1142076 - RNA, 19 nt, Homo sapiens
ucaaauaagaggagagaaa

SEQ ID NO: 1142077 - RNA, 19 nt, Homo sapiens
ggaccacguuuaucuccaa

SEQ ID NO: 1142078 - RNA, 19 nt, Homo sapiens
ggaugagucugguuauugg

SEQ ID NO: 1142079 - RNA, 19 nt, Homo sapiens
gggaacagccuccagcuau

SEQ ID NO: 1142080 - RNA, 19 nt, Homo sapiens
cugcaaaccagcuaaauuu

SEQ ID NO: 1142081 - RNA, 19 nt, Homo sapiens
uggacacgcugccagauaa

SEQ ID NO: 1142082 - RNA, 19 nt, Homo sapiens
ggaacagccuccagcuauc

SEQ ID NO: 1142083 - RNA, 19 nt, Homo sapiens
aauaagauaugcacacaca

SEQ ID NO: 1142084 - RNA, 19 nt, Homo sapiens
gcagguggauucuguugag

SEQ ID NO: 1142085 - RNA, 19 nt, Homo sapiens
caaggguucucuucugugu

SEQ ID NO: 1142086 - RNA, 19 nt, Homo sapiens
gcaaggaugcccaaagaca

SEQ ID NO: 1142087 - RNA, 19 nt, Homo sapiens
aaaacuaacucugggauua

SEQ ID NO: 1142088 - RNA, 19 nt, Homo sapiens
ucucuucugugucuuguaa

SEQ ID NO: 1142089 - RNA, 19 nt, Homo sapiens
auaaagagaucccuauguc

SEQ ID NO: 1142090 - RNA, 19 nt, Homo sapiens
cacuaaagcuaaccauuca

SEQ ID NO: 1142091 - RNA, 19 nt, Homo sapiens
ccacuaaagcuaaccauuc

SEQ ID NO: 1142092 - RNA, 19 nt, Homo sapiens
acacacaggugguaaaugc

SEQ ID NO: 1142093 - RNA, 19 nt, Homo sapiens
gaaaacgugugcuagaguu

SEQ ID NO: 1142094 - RNA, 19 nt, Homo sapiens
gagaugcuugguucuauuu

SEQ ID NO: 1142095 - RNA, 19 nt, Homo sapiens
gaagacaagggcaguuuca

SEQ ID NO: 1142096 - RNA, 19 nt, Homo sapiens
ggacagucuuugugguuca

SEQ ID NO: 1142097 - RNA, 19 nt, Homo sapiens
gaacagacucacagauugg

SEQ ID NO: 1142098 - RNA, 19 nt, Homo sapiens
aaauggguaugacuaagaa

SEQ ID NO: 1142099 - RNA, 19 nt, Homo sapiens
cgaggcaucuggaacuuuc

SEQ ID NO: 1142100 - RNA, 19 nt, Homo sapiens
ggccaucugccgccaaaua

SEQ ID NO: 1142101 - RNA, 19 nt, Homo sapiens
accaauaacuucugcauca

SEQ ID NO: 1142102 - RNA, 19 nt, Homo sapiens
cagcagaagaacuaacaua

SEQ ID NO: 1142103 - RNA, 19 nt, Homo sapiens
guauucauguguuuagugu

SEQ ID NO: 1142104 - RNA, 19 nt, Homo sapiens
gcucuuccuugccugguuu

SEQ ID NO: 1142105 - RNA, 19 nt, Homo sapiens
uuaaccugcucuaaacuuu

SEQ ID NO: 1142106 - RNA, 19 nt, Homo sapiens
gaauuuggacucaguuaca

SEQ ID NO: 1142107 - RNA, 19 nt, Homo sapiens
gcaaagcccgcauaauuuu

SEQ ID NO: 1142108 - RNA, 19 nt, Homo sapiens
gaggagguuuggcuauugu

SEQ ID NO: 1142109 - RNA, 19 nt, Homo sapiens
ggagacggccuucagaaca

SEQ ID NO: 1142110 - RNA, 19 nt, Homo sapiens
ggucuuguccuuugauuuc

SEQ ID NO: 1142111 - RNA, 19 nt, Homo sapiens
cuuagaaaguccuucacua

SEQ ID NO: 1142112 - RNA, 19 nt, Homo sapiens
gcaacaaccucguuaacuc

SEQ ID NO: 1142113 - RNA, 19 nt, Homo sapiens
gaggauggcugcauguauc

SEQ ID NO: 1142114 - RNA, 19 nt, Homo sapiens
ccucugaccucauaaccua

SEQ ID NO: 1142115 - RNA, 19 nt, Homo sapiens
ccacacacaaucauucaua

SEQ ID NO: 1142116 - RNA, 19 nt, Homo sapiens
gaacugcaauaggaaagau

SEQ ID NO: 1142117 - RNA, 19 nt, Homo sapiens
gauuggaccacaucgaaua

SEQ ID NO: 1142118 - RNA, 19 nt, Homo sapiens
gcgcugcucugccaguuug

SEQ ID NO: 1142119 - RNA, 19 nt, Homo sapiens
ggucaugagcgcgguauua

SEQ ID NO: 1142120 - RNA, 19 nt, Homo sapiens
ggaccaccauuaugacaca

SEQ ID NO: 1142121 - RNA, 19 nt, Homo sapiens
gguuugcccuuccugcuaa

SEQ ID NO: 1142122 - RNA, 19 nt, Homo sapiens
gaaccacaccagacaaauc

SEQ ID NO: 1142123 - RNA, 19 nt, Homo sapiens
acugagaacugcaauagga

SEQ ID NO: 1142124 - RNA, 19 nt, Homo sapiens
acacguugaugcucauuga

SEQ ID NO: 1142125 - RNA, 19 nt, Homo sapiens
gcucaagaacccacugauu

SEQ ID NO: 1142126 - RNA, 19 nt, Homo sapiens
gaagaccaccauccacuca

SEQ ID NO: 1142127 - RNA, 19 nt, Homo sapiens
auucauaucuacucaccua

SEQ ID NO: 1142128 - RNA, 19 nt, Homo sapiens
caggaggacuucugcaaca

SEQ ID NO: 1142129 - RNA, 19 nt, Homo sapiens
ggaccacacacuguuauga

SEQ ID NO: 1142130 - RNA, 19 nt, Homo sapiens
ccucggaccugugcaauag

SEQ ID NO: 1142131 - RNA, 19 nt, Homo sapiens
ggaggauggcugcauguau

SEQ ID NO: 1142132 - RNA, 19 nt, Homo sapiens
acacucaaccucccucuga

SEQ ID NO: 1142133 - RNA, 19 nt, Homo sapiens
ggcaucuucuccaaucuga

SEQ ID NO: 1142134 - RNA, 19 nt, Homo sapiens
ccagucugcuugucuaugg

SEQ ID NO: 1142135 - RNA, 19 nt, Homo sapiens
cauaucuacucaccuaaca

SEQ ID NO: 1142136 - RNA, 19 nt, Homo sapiens
guugcaaccugcucaaugg

SEQ ID NO: 1142137 - RNA, 19 nt, Homo sapiens
cacacacaaucauucauau

SEQ ID NO: 1142138 - RNA, 19 nt, Homo sapiens
agacgcugcugcucauaga

SEQ ID NO: 1142139 - RNA, 19 nt, Homo sapiens
ggagaccggcaguguccua

SEQ ID NO: 1142140 - RNA, 19 nt, Homo sapiens
gcucaaaauucccagaaga

SEQ ID NO: 1142141 - RNA, 19 nt, Homo sapiens
uuaacucccucccgcuuug

SEQ ID NO: 1142142 - RNA, 19 nt, Homo sapiens
ccacaucgaauaccgagau

SEQ ID NO: 1142143 - RNA, 19 nt, Homo sapiens
cauccggacuugcccuaug

SEQ ID NO: 1142144 - RNA, 19 nt, Homo sapiens
cacaaucauucauaucuac

SEQ ID NO: 1142145 - RNA, 19 nt, Homo sapiens
ccagacaaaucgggaucuu

SEQ ID NO: 1142146 - RNA, 19 nt, Homo sapiens
cucaagaacccacugauug

SEQ ID NO: 1142147 - RNA, 19 nt, Homo sapiens
cagacccuguccuuucaaa

SEQ ID NO: 1142148 - RNA, 19 nt, Homo sapiens
ugacugagaacugcaauag

SEQ ID NO: 1142149 - RNA, 19 nt, Homo sapiens
gaccacacacuguuaugau

SEQ ID NO: 1142150 - RNA, 19 nt, Homo sapiens
gauggcugcauguaucuga

SEQ ID NO: 1142151 - RNA, 19 nt, Homo sapiens
ccuuccagcuucuuguuga

SEQ ID NO: 1142152 - RNA, 19 nt, Homo sapiens
ucaagaacccacugauugg

SEQ ID NO: 1142153 - RNA, 19 nt, Homo sapiens
ggccuggagucucucacuu

SEQ ID NO: 1142154 - RNA, 19 nt, Homo sapiens
uaugacacacggaaacuug

SEQ ID NO: 1142155 - RNA, 19 nt, Homo sapiens
caaugggacacaggaaauu

SEQ ID NO: 1142156 - RNA, 19 nt, Homo sapiens
caccagauucuuucccauu

SEQ ID NO: 1142157 - RNA, 19 nt, Homo sapiens
agacaaaucgggaucuucu

SEQ ID NO: 1142158 - RNA, 19 nt, Homo sapiens
guuaugauggguacauuca

SEQ ID NO: 1142159 - RNA, 19 nt, Homo sapiens
caugagcgcgguauuacug

SEQ ID NO: 1142160 - RNA, 19 nt, Homo sapiens
gcagacccaggauccuuga

SEQ ID NO: 1142161 - RNA, 19 nt, Homo sapiens
ucaaugggacacaggaaau

SEQ ID NO: 1142162 - RNA, 19 nt, Homo sapiens
caagaacccacugauugga

SEQ ID NO: 1142163 - RNA, 19 nt, Homo sapiens
ugagaacugcaauaggaaa

SEQ ID NO: 1142164 - RNA, 19 nt, Homo sapiens
ggcaguguccuaccugugu

SEQ ID NO: 1142165 - RNA, 19 nt, Homo sapiens
ccagauucuuucccauucu

SEQ ID NO: 1142166 - RNA, 19 nt, Homo sapiens
gccucucccugaucuccua

SEQ ID NO: 1142167 - RNA, 19 nt, Homo sapiens
guuaacucccucccgcuuu

SEQ ID NO: 1142168 - RNA, 19 nt, Homo sapiens
gagacgcugcugcucauag

SEQ ID NO: 1142169 - RNA, 19 nt, Homo sapiens
cacacaaucauucauaucu

SEQ ID NO: 1142170 - RNA, 19 nt, Homo sapiens
gaacucccucccuccucaa

SEQ ID NO: 1142171 - RNA, 19 nt, Homo sapiens
gugcuuguggccuccuaua

SEQ ID NO: 1142172 - RNA, 19 nt, Homo sapiens
ggagacgcugcugcucaua

SEQ ID NO: 1142173 - RNA, 19 nt, Homo sapiens
gagaacugcaauaggaaag

SEQ ID NO: 1142174 - RNA, 19 nt, Homo sapiens
gccaggaggacuucugcaa

SEQ ID NO: 1142175 - RNA, 19 nt, Homo sapiens
caguucagcauguguggaa

SEQ ID NO: 1142176 - RNA, 19 nt, Homo sapiens
ccacugauuggaccacauc

SEQ ID NO: 1142177 - RNA, 19 nt, Homo sapiens
ggacggcccucaacacaua

SEQ ID NO: 1142178 - RNA, 19 nt, Homo sapiens
caugaucaaugcugacuuu

SEQ ID NO: 1142179 - RNA, 19 nt, Homo sapiens
gagauggccuggagagugu

SEQ ID NO: 1142180 - RNA, 19 nt, Homo sapiens
gguagaagaggccaaauug

SEQ ID NO: 1142181 - RNA, 19 nt, Homo sapiens
ccaugaagcuuacggagau

SEQ ID NO: 1142182 - RNA, 19 nt, Homo sapiens
gcacuacgaggaccaaguu

SEQ ID NO: 1142183 - RNA, 19 nt, Homo sapiens
aaacgccacugucucuaaa

SEQ ID NO: 1142184 - RNA, 19 nt, Homo sapiens
gaccucaagugaaaugaug

SEQ ID NO: 1142185 - RNA, 19 nt, Homo sapiens
uaacgcggacaaugaauuu

SEQ ID NO: 1142186 - RNA, 19 nt, Homo sapiens
gaagaugggaggcuugaca

SEQ ID NO: 1142187 - RNA, 19 nt, Homo sapiens
gaucaaugcugacuuuugu

SEQ ID NO: 1142188 - RNA, 19 nt, Homo sapiens
gauaaacgccacugucucu

SEQ ID NO: 1142189 - RNA, 19 nt, Homo sapiens
uaaacgccacugucucuaa

SEQ ID NO: 1142190 - RNA, 19 nt, Homo sapiens
ucuggcagcuggcuucuug

SEQ ID NO: 1142191 - RNA, 19 nt, Homo sapiens
guggagagcaugaucaaug

SEQ ID NO: 1142192 - RNA, 19 nt, Homo sapiens
guagaagaggccaaauuga

SEQ ID NO: 1142193 - RNA, 19 nt, Homo sapiens
ggccguaacuggguacaau

SEQ ID NO: 1142194 - RNA, 19 nt, Homo sapiens
ggcagacacucaggccuaa

SEQ ID NO: 1142195 - RNA, 19 nt, Homo sapiens
ucagaccucuucgccauga

SEQ ID NO: 1142196 - RNA, 19 nt, Homo sapiens
guaacgcggacaaugaauu

SEQ ID NO: 1142197 - RNA, 19 nt, Homo sapiens
acaguaacgcggacaauga

SEQ ID NO: 1142198 - RNA, 19 nt, Homo sapiens
gcaacaggaggcugggaaa

SEQ ID NO: 1142199 - RNA, 19 nt, Homo sapiens
ggacuugccacccaugaag

SEQ ID NO: 1142200 - RNA, 19 nt, Homo sapiens
ggguagaagaggccaaauu

SEQ ID NO: 1142201 - RNA, 19 nt, Homo sapiens
caaaguccaagacacaugu

SEQ ID NO: 1142202 - RNA, 19 nt, Homo sapiens
cagcacccuuggcaccuuu

SEQ ID NO: 1142203 - RNA, 19 nt, Homo sapiens
cuucaaugcugcacucaca

SEQ ID NO: 1142204 - RNA, 19 nt, Homo sapiens
gggccgugcucaucuccuu

SEQ ID NO: 1142205 - RNA, 19 nt, Homo sapiens
gacaugguccacauccaaa

SEQ ID NO: 1142206 - RNA, 19 nt, Homo sapiens
uagaagaggccaaauugag

SEQ ID NO: 1142207 - RNA, 19 nt, Homo sapiens
caccggagcaaccacagua

SEQ ID NO: 1142208 - RNA, 19 nt, Homo sapiens
ccucuuugcugucuuuguc

SEQ ID NO: 1142209 - RNA, 19 nt, Homo sapiens
acaggaggcugggaaaugg

SEQ ID NO: 1142210 - RNA, 19 nt, Homo sapiens
ugacaugguccacauccaa

SEQ ID NO: 1142211 - RNA, 19 nt, Homo sapiens
cguccucuuugcugucuuu

SEQ ID NO: 1142212 - RNA, 19 nt, Homo sapiens
caacccgacugcccuacca

SEQ ID NO: 1142213 - RNA, 19 nt, Homo sapiens
ccaugacuauccacaccuu

SEQ ID NO: 1142214 - RNA, 19 nt, Homo sapiens
gcaagaagggagccaugag

SEQ ID NO: 1142215 - RNA, 19 nt, Homo sapiens
ccacugccguccucuuugc

SEQ ID NO: 1142216 - RNA, 19 nt, Homo sapiens
ucacgcccauccuugaauc

SEQ ID NO: 1142217 - RNA, 19 nt, Homo sapiens
guggggaccucaagugaaa

SEQ ID NO: 1142218 - RNA, 19 nt, Homo sapiens
caguaacgcggacaaugaa

SEQ ID NO: 1142219 - RNA, 19 nt, Homo sapiens
caaauugaggcacccaagu

SEQ ID NO: 1142220 - RNA, 19 nt, Homo sapiens
ggaccaucuuccuguggau

SEQ ID NO: 1142221 - RNA, 19 nt, Homo sapiens
gccguaacuggguacaaua

SEQ ID NO: 1142222 - RNA, 19 nt, Homo sapiens
ggaccucaagugaaaugau

SEQ ID NO: 1142223 - RNA, 19 nt, Homo sapiens
gggaagaugggaggcuuga

SEQ ID NO: 1142224 - RNA, 19 nt, Homo sapiens
gggcuuuggcuuccucaug

SEQ ID NO: 1142225 - RNA, 19 nt, Homo sapiens
gugauaaacgccacugucu

SEQ ID NO: 1142226 - RNA, 19 nt, Homo sapiens
caacaggaggcugggaaau

SEQ ID NO: 1142227 - RNA, 19 nt, Homo sapiens
cuucuggccuagcuucaau

SEQ ID NO: 1142228 - RNA, 19 nt, Homo sapiens
aaauugaggcacccaagug

SEQ ID NO: 1142229 - RNA, 19 nt, Homo sapiens
uggcgagcaugaggauaaa

SEQ ID NO: 1142230 - RNA, 19 nt, Homo sapiens
cuggcgagcaugaggauaa

SEQ ID NO: 1142231 - RNA, 19 nt, Homo sapiens
ggugcuguuuggcaucaau

SEQ ID NO: 1142232 - RNA, 19 nt, Homo sapiens
ucaaaguccaagacacaug

SEQ ID NO: 1142233 - RNA, 19 nt, Homo sapiens
uggcaucaaugaguuugug

SEQ ID NO: 1142234 - RNA, 19 nt, Homo sapiens
ggaauucgcuggaaaugca

SEQ ID NO: 1142235 - RNA, 19 nt, Homo sapiens
gauaaaccccucccaauua

SEQ ID NO: 1142236 - RNA, 19 nt, Homo sapiens
agaagcaccuggagaguug

SEQ ID NO: 1142237 - RNA, 19 nt, Homo sapiens
agaauagugcuguguguua

SEQ ID NO: 1142238 - RNA, 19 nt, Homo sapiens
gauucugacucaauuaaag

SEQ ID NO: 1142239 - RNA, 19 nt, Homo sapiens
gcucaugaccauuguguau

SEQ ID NO: 1142240 - RNA, 19 nt, Homo sapiens
gaauagugcuguguguuac

SEQ ID NO: 1142241 - RNA, 19 nt, Homo sapiens
agacaucucucagcacuuc

SEQ ID NO: 1142242 - RNA, 19 nt, Homo sapiens
agacugaggcagagaauug

SEQ ID NO: 1142243 - RNA, 19 nt, Homo sapiens
gcauuucuacacuuuguuu

SEQ ID NO: 1142244 - RNA, 19 nt, Homo sapiens
gagcuggaguucguucaga

SEQ ID NO: 1142245 - RNA, 19 nt, Homo sapiens
guauagcauuucuacacuu

SEQ ID NO: 1142246 - RNA, 19 nt, Homo sapiens
guacacacccagagaugga

SEQ ID NO: 1142247 - RNA, 19 nt, Homo sapiens
uagcauuucuacacuuugu

SEQ ID NO: 1142248 - RNA, 19 nt, Homo sapiens
ggaguucguucagaauagu

SEQ ID NO: 1142249 - RNA, 19 nt, Homo sapiens
ucaugaccauuguguauag

SEQ ID NO: 1142250 - RNA, 19 nt, Homo sapiens
gaagccagaggcagagguu

SEQ ID NO: 1142251 - RNA, 19 nt, Homo sapiens
gaaaccccaucucuccuaa

SEQ ID NO: 1142252 - RNA, 19 nt, Homo sapiens
ucagaauagugcugugugu

SEQ ID NO: 1142253 - RNA, 19 nt, Homo sapiens
gaauggagagcuggaguuc

SEQ ID NO: 1142254 - RNA, 19 nt, Homo sapiens
ucucagcacuucccucucu

SEQ ID NO: 1142255 - RNA, 19 nt, Homo sapiens
ggcagagaauugcuugaag

SEQ ID NO: 1142256 - RNA, 19 nt, Homo sapiens
ggugacgggugguguaggu

SEQ ID NO: 1142257 - RNA, 19 nt, Homo sapiens
ccuuguagcucaugaccau

SEQ ID NO: 1142258 - RNA, 19 nt, Homo sapiens
aggcagagguugcaaugag

SEQ ID NO: 1142259 - RNA, 19 nt, Homo sapiens
ccuguaaucccagcacuuu

SEQ ID NO: 1142260 - RNA, 19 nt, Homo sapiens
guagguacacacccagaga

SEQ ID NO: 1142261 - RNA, 19 nt, Homo sapiens
gagcacugcagaucagcaa

SEQ ID NO: 1142262 - RNA, 19 nt, Homo sapiens
gauggagcacugcagauca

SEQ ID NO: 1142263 - RNA, 19 nt, Homo sapiens
agggaggguucaacucuga

SEQ ID NO: 1142264 - RNA, 19 nt, Homo sapiens
auaaaccccucccaauuaa

SEQ ID NO: 1142265 - RNA, 19 nt, Homo sapiens
cagaagcaccuggagaguu

SEQ ID NO: 1142266 - RNA, 19 nt, Homo sapiens
ccugggaauucgcuggaaa

SEQ ID NO: 1142267 - RNA, 19 nt, Homo sapiens
aaaggugacggguggugua

SEQ ID NO: 1142268 - RNA, 19 nt, Homo sapiens
cgagaacugccuuggugaa

SEQ ID NO: 1142269 - RNA, 19 nt, Homo sapiens
ccucccaauuaaugcauuu

SEQ ID NO: 1142270 - RNA, 19 nt, Homo sapiens
cuggagaguuggagagcuu

SEQ ID NO: 1142271 - RNA, 19 nt, Homo sapiens
accauuguguauagcauuu

SEQ ID NO: 1142272 - RNA, 19 nt, Homo sapiens
gaccauuguguauagcauu

SEQ ID NO: 1142273 - RNA, 19 nt, Homo sapiens
uggaguucguucagaauag

SEQ ID NO: 1142274 - RNA, 19 nt, Homo sapiens
ggagacugaggcagagaau

SEQ ID NO: 1142275 - RNA, 19 nt, Homo sapiens
ggaggguucaacucugaga

SEQ ID NO: 1142276 - RNA, 19 nt, Homo sapiens
gagaacugccuuggugaag

SEQ ID NO: 1142277 - RNA, 19 nt, Homo sapiens
ucuugguccuuggcaauaa

SEQ ID NO: 1142278 - RNA, 19 nt, Homo sapiens
cgacucccauacccugaag

SEQ ID NO: 1142279 - RNA, 19 nt, Homo sapiens
gaccaaagaugagaaagua

SEQ ID NO: 1142280 - RNA, 19 nt, Homo sapiens
gaaagugccuuccugagau

SEQ ID NO: 1142281 - RNA, 19 nt, Homo sapiens
gaaacgccuucucauacua

SEQ ID NO: 1142282 - RNA, 19 nt, Homo sapiens
ggacaucccuguggaguuc

SEQ ID NO: 1142283 - RNA, 19 nt, Homo sapiens
gagcaacaguggcaucaga

SEQ ID NO: 1142284 - RNA, 19 nt, Homo sapiens
gaucaaguauuccuacgau

SEQ ID NO: 1142285 - RNA, 19 nt, Homo sapiens
cagcaucccuguagaaaca

SEQ ID NO: 1142286 - RNA, 19 nt, Homo sapiens
cagcaccuuugguaaauaa

SEQ ID NO: 1142287 - RNA, 19 nt, Homo sapiens
uggccaagcucuacaugua

SEQ ID NO: 1142288 - RNA, 19 nt, Homo sapiens
ggaaacgccuucucauacu

SEQ ID NO: 1142289 - RNA, 19 nt, Homo sapiens
ugaaggagcccaucgaaga

SEQ ID NO: 1142290 - RNA, 19 nt, Homo sapiens
gagaguacgcccauuguga

SEQ ID NO: 1142291 - RNA, 19 nt, Homo sapiens
cgaacaaccuggagaccuu

SEQ ID NO: 1142292 - RNA, 19 nt, Homo sapiens
gagcagcugagaagaaauu

SEQ ID NO: 1142293 - RNA, 19 nt, Homo sapiens
uaaauaaagcagcaucuga

SEQ ID NO: 1142294 - RNA, 19 nt, Homo sapiens
caacagcaccgucuacauc

SEQ ID NO: 1142295 - RNA, 19 nt, Homo sapiens
ccaaagaugagaaaguauu

SEQ ID NO: 1142296 - RNA, 19 nt, Homo sapiens
ggaggcccauugccaguga

SEQ ID NO: 1142297 - RNA, 19 nt, Homo sapiens
uccagaagaucaaguauuc

SEQ ID NO: 1142298 - RNA, 19 nt, Homo sapiens
gugcuugccucguaugaga

SEQ ID NO: 1142299 - RNA, 19 nt, Homo sapiens
gaggugugcugcuuugaca

SEQ ID NO: 1142300 - RNA, 19 nt, Homo sapiens
gggaaacgccuucucauac

SEQ ID NO: 1142301 - RNA, 19 nt, Homo sapiens
ugaccacgcuacagauguu

SEQ ID NO: 1142302 - RNA, 19 nt, Homo sapiens
ccgagcagcugagaagaaa

SEQ ID NO: 1142303 - RNA, 19 nt, Homo sapiens
ugaaagugccuuccugaga

SEQ ID NO: 1142304 - RNA, 19 nt, Homo sapiens
caagccagcaccuuuggua

SEQ ID NO: 1142305 - RNA, 19 nt, Homo sapiens
gcagaaggaguuugucauc

SEQ ID NO: 1142306 - RNA, 19 nt, Homo sapiens
ccaccuucgccaucaauua

SEQ ID NO: 1142307 - RNA, 19 nt, Homo sapiens
gcgaguggcgcuccauuga

SEQ ID NO: 1142308 - RNA, 19 nt, Homo sapiens
ggacgcugaccaaagauga

SEQ ID NO: 1142309 - RNA, 19 nt, Homo sapiens
caaguucgucggcuucauu

SEQ ID NO: 1142310 - RNA, 19 nt, Homo sapiens
ccagugcccugaagcgaau

SEQ ID NO: 1142311 - RNA, 19 nt, Homo sapiens
gccagcaccuuugguaaau

SEQ ID NO: 1142312 - RNA, 19 nt, Homo sapiens
ugaaggagcugggcuacgu

SEQ ID NO: 1142313 - RNA, 19 nt, Homo sapiens
cagaaggaguuugucauca

SEQ ID NO: 1142314 - RNA, 19 nt, Homo sapiens
ggaccggauucaacacauc

SEQ ID NO: 1142315 - RNA, 19 nt, Homo sapiens
ucuggugccuggaugagua

SEQ ID NO: 1142316 - RNA, 19 nt, Homo sapiens
ccagcaccuuugguaaaua

SEQ ID NO: 1142317 - RNA, 19 nt, Homo sapiens
ggacgagaguacgcccauu

SEQ ID NO: 1142318 - RNA, 19 nt, Homo sapiens
acuggacgcugaccaaaga

SEQ ID NO: 1142319 - RNA, 19 nt, Homo sapiens
cgacuucaacagccaguuu

SEQ ID NO: 1142320 - RNA, 19 nt, Homo sapiens
gaggugcuguccuucgaau

SEQ ID NO: 1142321 - RNA, 19 nt, Homo sapiens
acgaugcccuggagaagaa

SEQ ID NO: 1142322 - RNA, 19 nt, Homo sapiens
caccagcgcuuucauuuug

SEQ ID NO: 1142323 - RNA, 19 nt, Homo sapiens
cuggagaccuucaucuuca

SEQ ID NO: 1142324 - RNA, 19 nt, Homo sapiens
caaagaugagaaaguauuc

SEQ ID NO: 1142325 - RNA, 19 nt, Homo sapiens
gaaccgcuacaagcuguuu

SEQ ID NO: 1142326 - RNA, 19 nt, Homo sapiens
cagcagaugcggaacaugu

SEQ ID NO: 1142327 - RNA, 19 nt, Homo sapiens
ugggaaacgccuucucaua

SEQ ID NO: 1142328 - RNA, 19 nt, Homo sapiens
ccuccaagcucucauccau

SEQ ID NO: 1142329 - RNA, 19 nt, Homo sapiens
ggagugcagccucaaguuc

SEQ ID NO: 1142330 - RNA, 19 nt, Homo sapiens
gcaacaaggccgagauggu

SEQ ID NO: 1142331 - RNA, 19 nt, Homo sapiens
ccaggaagacucagagauc

SEQ ID NO: 1142332 - RNA, 19 nt, Homo sapiens
guacgcccauugugaaacu

SEQ ID NO: 1142333 - RNA, 19 nt, Homo sapiens
gaaacucugcacuccaugu

SEQ ID NO: 1142334 - RNA, 19 nt, Homo sapiens
ccgaaacucugcacuccau

SEQ ID NO: 1142335 - RNA, 19 nt, Homo sapiens
ggauugaagguaccaagga

SEQ ID NO: 1142336 - RNA, 19 nt, Homo sapiens
gauccgagcagcugagaag

SEQ ID NO: 1142337 - RNA, 19 nt, Homo sapiens
ccaccgaccucugcuacau

SEQ ID NO: 1142338 - RNA, 19 nt, Homo sapiens
ggacuggacgcugaccaaa

SEQ ID NO: 1142339 - RNA, 19 nt, Homo sapiens
gagcaacaaggccgagaug

SEQ ID NO: 1142340 - RNA, 19 nt, Homo sapiens
ugagauggcagugcuggua

SEQ ID NO: 1142341 - RNA, 19 nt, Homo sapiens
aaagugccuuccugagaug

SEQ ID NO: 1142342 - RNA, 19 nt, Homo sapiens
uggagagccugcccgagaa

SEQ ID NO: 1142343 - RNA, 19 nt, Homo sapiens
gagccaagccuggucaaca

SEQ ID NO: 1142344 - RNA, 19 nt, Homo sapiens
ccgagaagcaggagcaguu

SEQ ID NO: 1142345 - RNA, 19 nt, Homo sapiens
gacgagaguacgcccauug

SEQ ID NO: 1142346 - RNA, 19 nt, Homo sapiens
cccaggagcugcacuucau

SEQ ID NO: 1142347 - RNA, 19 nt, Homo sapiens
uguccgugcuugccucgua

SEQ ID NO: 1142348 - RNA, 19 nt, Homo sapiens
cgcugcagcugccuaugua

SEQ ID NO: 1142349 - RNA, 19 nt, Homo sapiens
gggaguccgugccacagau

SEQ ID NO: 1142350 - RNA, 19 nt, Homo sapiens
ccaagcagaaggaguuugu

SEQ ID NO: 1142351 - RNA, 19 nt, Homo sapiens
uauuucagguguucugugu

SEQ ID NO: 1142352 - RNA, 19 nt, Homo sapiens
ccaacaucuucaaccugua

SEQ ID NO: 1142353 - RNA, 19 nt, Homo sapiens
ucaagauccuggcgcucaa

SEQ ID NO: 1142354 - RNA, 19 nt, Homo sapiens
ucucggagcuuuucaagga

SEQ ID NO: 1142355 - RNA, 19 nt, Homo sapiens
gaaauuugggagcaacaag

SEQ ID NO: 1142356 - RNA, 19 nt, Homo sapiens
cuacgugacccucaugugu

SEQ ID NO: 1142357 - RNA, 19 nt, Homo sapiens
ggcuugaggugcuguccuu

SEQ ID NO: 1142358 - RNA, 19 nt, Homo sapiens
gcagcugccuauguaugga

SEQ ID NO: 1142359 - RNA, 19 nt, Homo sapiens
gaguacgcccauugugaaa

SEQ ID NO: 1142360 - RNA, 19 nt, Homo sapiens
agaguacgcccauugugaa

SEQ ID NO: 1142361 - RNA, 19 nt, Homo sapiens
cagcugagaagaaauuugg

SEQ ID NO: 1142362 - RNA, 19 nt, Homo sapiens
agaagaaauuugggagcaa

SEQ ID NO: 1142363 - RNA, 19 nt, Homo sapiens
ggugcuguccuucgaauuc

SEQ ID NO: 1142364 - RNA, 19 nt, Homo sapiens
gaaggagcccaucgaagac

SEQ ID NO: 1142365 - RNA, 19 nt, Homo sapiens
guaaauaaagcagcaucug

SEQ ID NO: 1142366 - RNA, 19 nt, Homo sapiens
gcaagcugcugcgcaccau

SEQ ID NO: 1142367 - RNA, 19 nt, Homo sapiens
ggaguucaagcuggucauu

SEQ ID NO: 1142368 - RNA, 19 nt, Homo sapiens
gcuccucgcccgacuucaa

SEQ ID NO: 1142369 - RNA, 19 nt, Homo sapiens
gcaacaagccccacaugau

SEQ ID NO: 1142370 - RNA, 19 nt, Homo sapiens
caacaucuucaaccuguac

SEQ ID NO: 1142371 - RNA, 19 nt, Homo sapiens
ggucgaggugugcugcuuu

SEQ ID NO: 1142372 - RNA, 19 nt, Homo sapiens
gagggugacugcgaacaac

SEQ ID NO: 1142373 - RNA, 19 nt, Homo sapiens
cgcuacagauguucaagau

SEQ ID NO: 1142374 - RNA, 19 nt, Homo sapiens
cgagaucucccgggaagga

SEQ ID NO: 1142375 - RNA, 19 nt, Homo sapiens
gucgaggugugcugcuuug

SEQ ID NO: 1142376 - RNA, 19 nt, Homo sapiens
gccaagcucuacauguacu

SEQ ID NO: 1142377 - RNA, 19 nt, Homo sapiens
gccuauguauggauugaag

SEQ ID NO: 1142378 - RNA, 19 nt, Homo sapiens
gguguggagucuggcaguu

SEQ ID NO: 1142379 - RNA, 19 nt, Homo sapiens
gaaaugcccuucuaccuuu

SEQ ID NO: 1142380 - RNA, 19 nt, Homo sapiens
gaagauuucugcuuugaug

SEQ ID NO: 1142381 - RNA, 19 nt, Homo sapiens
caaaggagccgucugacua

SEQ ID NO: 1142382 - RNA, 19 nt, Homo sapiens
gauugaaggugguugguuu

SEQ ID NO: 1142383 - RNA, 19 nt, Homo sapiens
gaaaugcucucuguguguu

SEQ ID NO: 1142384 - RNA, 19 nt, Homo sapiens
ggacugugcuauuucuguu

SEQ ID NO: 1142385 - RNA, 19 nt, Homo sapiens
caguauuucugcacucuua

SEQ ID NO: 1142386 - RNA, 19 nt, Homo sapiens
gggaaagauuacuuaguuu

SEQ ID NO: 1142387 - RNA, 19 nt, Homo sapiens
gagauacuauacccuagaa

SEQ ID NO: 1142388 - RNA, 19 nt, Homo sapiens
caaauucgagcaccaguuu

SEQ ID NO: 1142389 - RNA, 19 nt, Homo sapiens
ggaaagauuacuuaguuug

SEQ ID NO: 1142390 - RNA, 19 nt, Homo sapiens
ggggaaagauuacuuaguu

SEQ ID NO: 1142391 - RNA, 19 nt, Homo sapiens
ggccauagccacccuuuga

SEQ ID NO: 1142392 - RNA, 19 nt, Homo sapiens
ugauuguucucauaacgua

SEQ ID NO: 1142393 - RNA, 19 nt, Homo sapiens
aauggcagguggugcauaa

SEQ ID NO: 1142394 - RNA, 19 nt, Homo sapiens
gaaagauuacuuaguuugg

SEQ ID NO: 1142395 - RNA, 19 nt, Homo sapiens
ggagcaggaugaacugucu

SEQ ID NO: 1142396 - RNA, 19 nt, Homo sapiens
ucucgaagaucuggucaaa

SEQ ID NO: 1142397 - RNA, 19 nt, Homo sapiens
gucgauggcuggugugguu

SEQ ID NO: 1142398 - RNA, 19 nt, Homo sapiens
ccagaaugaucagauugaa

SEQ ID NO: 1142399 - RNA, 19 nt, Homo sapiens
ugaaaugcccuucuaccuu

SEQ ID NO: 1142400 - RNA, 19 nt, Homo sapiens
ugucuaacauggagaaaca

SEQ ID NO: 1142401 - RNA, 19 nt, Homo sapiens
cauggaaguugcgaggaua

SEQ ID NO: 1142402 - RNA, 19 nt, Homo sapiens
gaaccaggcggugaauuuc

SEQ ID NO: 1142403 - RNA, 19 nt, Homo sapiens
acugugcuauuucuguuua

SEQ ID NO: 1142404 - RNA, 19 nt, Homo sapiens
aaagagaggggaaagauua

SEQ ID NO: 1142405 - RNA, 19 nt, Homo sapiens
gauaugcugcuccaggaaa

SEQ ID NO: 1142406 - RNA, 19 nt, Homo sapiens
cuguauagcucguaaugau

SEQ ID NO: 1142407 - RNA, 19 nt, Homo sapiens
agaaccaggcggugaauuu

SEQ ID NO: 1142408 - RNA, 19 nt, Homo sapiens
cgaaaaggccaaaauuaaa

SEQ ID NO: 1142409 - RNA, 19 nt, Homo sapiens
ucgguggacugugcuauuu

SEQ ID NO: 1142410 - RNA, 19 nt, Homo sapiens
uccaggaaauggcagauga

SEQ ID NO: 1142411 - RNA, 19 nt, Homo sapiens
caaauggaagacacgauga

SEQ ID NO: 1142412 - RNA, 19 nt, Homo sapiens
ccuucuaccuuuggguuua

SEQ ID NO: 1142413 - RNA, 19 nt, Homo sapiens
ucaguuuccugcccagaau

SEQ ID NO: 1142414 - RNA, 19 nt, Homo sapiens
uagcuggauucuaaaguuc

SEQ ID NO: 1142415 - RNA, 19 nt, Homo sapiens
cgacauugaagaccaugaa

SEQ ID NO: 1142416 - RNA, 19 nt, Homo sapiens
gcaaggugaccaagucgau

SEQ ID NO: 1142417 - RNA, 19 nt, Homo sapiens
ggcggugaauuucuugaga

SEQ ID NO: 1142418 - RNA, 19 nt, Homo sapiens
ccgaaaaggccaaaauuaa

SEQ ID NO: 1142419 - RNA, 19 nt, Homo sapiens
gaccaugaaucuggagaag

SEQ ID NO: 1142420 - RNA, 19 nt, Homo sapiens
ggagccgucugacuauguc

SEQ ID NO: 1142421 - RNA, 19 nt, Homo sapiens
ccauagccacccuuugaaa

SEQ ID NO: 1142422 - RNA, 19 nt, Homo sapiens
gaagggcaacauggaaguu

SEQ ID NO: 1142423 - RNA, 19 nt, Homo sapiens
gccaaagaacugaguagga

SEQ ID NO: 1142424 - RNA, 19 nt, Homo sapiens
gguggacugugcuauuucu

SEQ ID NO: 1142425 - RNA, 19 nt, Homo sapiens
gauacuauacccuagaaac

SEQ ID NO: 1142426 - RNA, 19 nt, Homo sapiens
gaagaaccaggcggugaau

SEQ ID NO: 1142427 - RNA, 19 nt, Homo sapiens
aaaggagccgucugacuau

SEQ ID NO: 1142428 - RNA, 19 nt, Homo sapiens
ucagaagggcaacauggaa

SEQ ID NO: 1142429 - RNA, 19 nt, Homo sapiens
augcugaaaugcccuucua

SEQ ID NO: 1142430 - RNA, 19 nt, Homo sapiens
ccuuugaaaugcucucugu

SEQ ID NO: 1142431 - RNA, 19 nt, Homo sapiens
ugaaaugcucucugugugu

SEQ ID NO: 1142432 - RNA, 19 nt, Homo sapiens
cgauggaugcgacauugaa

SEQ ID NO: 1142433 - RNA, 19 nt, Homo sapiens
gccgaaaaggccaaaauua

SEQ ID NO: 1142434 - RNA, 19 nt, Homo sapiens
gaauggcagguggugcaua

SEQ ID NO: 1142435 - RNA, 19 nt, Homo sapiens
gcucguaaugaugguauuu

SEQ ID NO: 1142436 - RNA, 19 nt, Homo sapiens
caggaugaacugucucaga

SEQ ID NO: 1142437 - RNA, 19 nt, Homo sapiens
cauugaagaccaugaaucu

SEQ ID NO: 1142438 - RNA, 19 nt, Homo sapiens
cauagccacccuuugaaau

SEQ ID NO: 1142439 - RNA, 19 nt, Homo sapiens
agaagaaccaggcggugaa

SEQ ID NO: 1142440 - RNA, 19 nt, Homo sapiens
agacgcagcaaauggaaga

SEQ ID NO: 1142441 - RNA, 19 nt, Homo sapiens
ucguguauaugaaucuuuc

SEQ ID NO: 1142442 - RNA, 19 nt, Homo sapiens
acauggaaguugcgaggau

SEQ ID NO: 1142443 - RNA, 19 nt, Homo sapiens
cuguuuauccuuuggguuu

SEQ ID NO: 1142444 - RNA, 19 nt, Homo sapiens
gaggauacacgccgaaaau

SEQ ID NO: 1142445 - RNA, 19 nt, Homo sapiens
ucuguguguuagagagaua

SEQ ID NO: 1142446 - RNA, 19 nt, Homo sapiens
ccuucgggaucaaguguga

SEQ ID NO: 1142447 - RNA, 19 nt, Homo sapiens
gccucgaccucaacaugga

SEQ ID NO: 1142448 - RNA, 19 nt, Homo sapiens
gggccucgaccucaacaug

SEQ ID NO: 1142449 - RNA, 19 nt, Homo sapiens
gugagacugcaaaugauug

SEQ ID NO: 1142450 - RNA, 19 nt, Homo sapiens
gcuggauucuaaaguucug

SEQ ID NO: 1142451 - RNA, 19 nt, Homo sapiens
gccauagccacccuuugaa

SEQ ID NO: 1142452 - RNA, 19 nt, Homo sapiens
ggauaugcugcuccaggaa

SEQ ID NO: 1142453 - RNA, 19 nt, Homo sapiens
gaucagauugaaggugguu

SEQ ID NO: 1142454 - RNA, 19 nt, Homo sapiens
gcccagaaugaucagauug

SEQ ID NO: 1142455 - RNA, 19 nt, Homo sapiens
ucgaagaucuggucaaaac

SEQ ID NO: 1142456 - RNA, 19 nt, Homo sapiens
gagguuuccuggccauagc

SEQ ID NO: 1142457 - RNA, 19 nt, Homo sapiens
agacugcaaaugauuguuc

SEQ ID NO: 1142458 - RNA, 19 nt, Homo sapiens
uggcuggugugguuaaguc

SEQ ID NO: 1142459 - RNA, 19 nt, Homo sapiens
acgccagaaugcugaaaug

SEQ ID NO: 1142460 - RNA, 19 nt, Homo sapiens
gacugcaaaugauuguucu

SEQ ID NO: 1142461 - RNA, 19 nt, Homo sapiens
cccagaaugaucagauuga

SEQ ID NO: 1142462 - RNA, 19 nt, Homo sapiens
ugcccagaaugaucagauu

SEQ ID NO: 1142463 - RNA, 19 nt, Homo sapiens
acuauacccuagaaacucu

SEQ ID NO: 1142464 - RNA, 19 nt, Homo sapiens
ccaaaggagccgucugacu

SEQ ID NO: 1142465 - RNA, 19 nt, Homo sapiens
gaagagguguuccgaauaa

SEQ ID NO: 1142466 - RNA, 19 nt, Homo sapiens
cagcagagcuucuuucuag

SEQ ID NO: 1142467 - RNA, 19 nt, Homo sapiens
gagaagagguguuccgaau

SEQ ID NO: 1142468 - RNA, 19 nt, Homo sapiens
agacagauauggaggcuaa

SEQ ID NO: 1142469 - RNA, 19 nt, Homo sapiens
ggagaagcauccuuguuug

SEQ ID NO: 1142470 - RNA, 19 nt, Homo sapiens
ucaaggagaugaugcaguu

SEQ ID NO: 1142471 - RNA, 19 nt, Homo sapiens
ccugaggccuucugguuua

SEQ ID NO: 1142472 - RNA, 19 nt, Homo sapiens
gggcgucccuuuccgcuuu

SEQ ID NO: 1142473 - RNA, 19 nt, Homo sapiens
ccacgaugcucaugaggaa

SEQ ID NO: 1142474 - RNA, 19 nt, Homo sapiens
gcaacaccaugucucaguu

SEQ ID NO: 1142475 - RNA, 19 nt, Homo sapiens
acacauuccuuucuacaga

SEQ ID NO: 1142476 - RNA, 19 nt, Homo sapiens
gcagggaugccuugccuuu

SEQ ID NO: 1142477 - RNA, 19 nt, Homo sapiens
gacccuauguucaacuuug

SEQ ID NO: 1142478 - RNA, 19 nt, Homo sapiens
gcccacacauuccuuucua

SEQ ID NO: 1142479 - RNA, 19 nt, Homo sapiens
cggagaagcauccuuguuu

SEQ ID NO: 1142480 - RNA, 19 nt, Homo sapiens
gccucaguguuacaaauua

SEQ ID NO: 1142481 - RNA, 19 nt, Homo sapiens
caaagggcguggugagcuu

SEQ ID NO: 1142482 - RNA, 19 nt, Homo sapiens
gagaagcauccuuguuuga

SEQ ID NO: 1142483 - RNA, 19 nt, Homo sapiens
gaacuccguccacuaacaa

SEQ ID NO: 1142484 - RNA, 19 nt, Homo sapiens
guucaacuuugugucauuu

SEQ ID NO: 1142485 - RNA, 19 nt, Homo sapiens
gcccaacacugacccuaug

SEQ ID NO: 1142486 - RNA, 19 nt, Homo sapiens
uagcggagacacuaaagua

SEQ ID NO: 1142487 - RNA, 19 nt, Homo sapiens
ucaaagggauugggaacga

SEQ ID NO: 1142488 - RNA, 19 nt, Homo sapiens
gaacgugagcggagaagca

SEQ ID NO: 1142489 - RNA, 19 nt, Homo sapiens
gaccggagguuugcauauc

SEQ ID NO: 1142490 - RNA, 19 nt, Homo sapiens
cuacgaggguaacauguuc

SEQ ID NO: 1142491 - RNA, 19 nt, Homo sapiens
gagagagcuuccaccugaa

SEQ ID NO: 1142492 - RNA, 19 nt, Homo sapiens
ccuuugggccucaguguua

SEQ ID NO: 1142493 - RNA, 19 nt, Homo sapiens
caaagggauugggaacgaa

SEQ ID NO: 1142494 - RNA, 19 nt, Homo sapiens
gcuccaaacucccugaacu

SEQ ID NO: 1142495 - RNA, 19 nt, Homo sapiens
acacugacccuauguucaa

SEQ ID NO: 1142496 - RNA, 19 nt, Homo sapiens
cagaggugguggagagcua

SEQ ID NO: 1142497 - RNA, 19 nt, Homo sapiens
cgaacuccguccacuaaca

SEQ ID NO: 1142498 - RNA, 19 nt, Homo sapiens
ggacuagaauaaaagaguu

SEQ ID NO: 1142499 - RNA, 19 nt, Homo sapiens
ggaagugguggcugaaauc

SEQ ID NO: 1142500 - RNA, 19 nt, Homo sapiens
agaccuacuugcugaaugu

SEQ ID NO: 1142501 - RNA, 19 nt, Homo sapiens
gagaccuacuugcugaaug

SEQ ID NO: 1142502 - RNA, 19 nt, Homo sapiens
gggccucaguguuacaaau

SEQ ID NO: 1142503 - RNA, 19 nt, Homo sapiens
ccacuccucucgccucaag

SEQ ID NO: 1142504 - RNA, 19 nt, Homo sapiens
guaucucuaucuucuguuc

SEQ ID NO: 1142505 - RNA, 19 nt, Homo sapiens
acacuaaaguaucucuauc

SEQ ID NO: 1142506 - RNA, 19 nt, Homo sapiens
gagaugaugcaguuugcuu

SEQ ID NO: 1142507 - RNA, 19 nt, Homo sapiens
gcagcagagcuucuuucua

SEQ ID NO: 1142508 - RNA, 19 nt, Homo sapiens
aaacgaacuccguccacua

SEQ ID NO: 1142509 - RNA, 19 nt, Homo sapiens
gacacuaaaguaucucuau

SEQ ID NO: 1142510 - RNA, 19 nt, Homo sapiens
cggagacacuaaaguaucu

SEQ ID NO: 1142511 - RNA, 19 nt, Homo sapiens
caagacguguacaguagca

SEQ ID NO: 1142512 - RNA, 19 nt, Homo sapiens
uccaagacguguacaguag

SEQ ID NO: 1142513 - RNA, 19 nt, Homo sapiens
agaagagguguuccgaaua

SEQ ID NO: 1142514 - RNA, 19 nt, Homo sapiens
guauuugauuugcuuccuu

SEQ ID NO: 1142515 - RNA, 19 nt, Homo sapiens
aaccaggucuucgcugaaa

SEQ ID NO: 1142516 - RNA, 19 nt, Homo sapiens
ggaccggagguuugcauau

SEQ ID NO: 1142517 - RNA, 19 nt, Homo sapiens
ucuaucuucuguucucuga

SEQ ID NO: 1142518 - RNA, 19 nt, Homo sapiens
guggugagcuucaaaagug

SEQ ID NO: 1142519 - RNA, 19 nt, Homo sapiens
gcuacgaggguaacauguu

SEQ ID NO: 1142520 - RNA, 19 nt, Homo sapiens
ggacuccucucagccuucu

SEQ ID NO: 1142521 - RNA, 19 nt, Homo sapiens
ccacacuggcccacacauu

SEQ ID NO: 1142522 - RNA, 19 nt, Homo sapiens
gugcuggccuuggagaaau

SEQ ID NO: 1142523 - RNA, 19 nt, Homo sapiens
gagcgagagcuacuacauc

SEQ ID NO: 1142524 - RNA, 19 nt, Homo sapiens
acaccucacugaacucucu

SEQ ID NO: 1142525 - RNA, 19 nt, Homo sapiens
uggaagugguggcugaaau

SEQ ID NO: 1142526 - RNA, 19 nt, Homo sapiens
aaucuguggacuagaauaa

SEQ ID NO: 1142527 - RNA, 19 nt, Homo sapiens
ggccucaguguuacaaauu

SEQ ID NO: 1142528 - RNA, 19 nt, Homo sapiens
cuaugaagcccacucacuu

SEQ ID NO: 1142529 - RNA, 19 nt, Homo sapiens
ggaacgagggccgaugaga

SEQ ID NO: 1142530 - RNA, 19 nt, Homo sapiens
uggaggcgauagagaccua

SEQ ID NO: 1142531 - RNA, 19 nt, Homo sapiens
gcacuuggaauucuuacac

SEQ ID NO: 1142532 - RNA, 19 nt, Homo sapiens
gcacacacacaaaaucuug

SEQ ID NO: 1142533 - RNA, 19 nt, Homo sapiens
aaguaucucuaucuucugu

SEQ ID NO: 1142534 - RNA, 19 nt, Homo sapiens
gcggagacacuaaaguauc

SEQ ID NO: 1142535 - RNA, 19 nt, Homo sapiens
gcggagaagcauccuuguu

SEQ ID NO: 1142536 - RNA, 19 nt, Homo sapiens
cgccgaggaugccaaggaa

SEQ ID NO: 1142537 - RNA, 19 nt, Homo sapiens
ggcgauagagaccuacuug

SEQ ID NO: 1142538 - RNA, 19 nt, Homo sapiens
ccaucaggcugggagagaa

SEQ ID NO: 1142539 - RNA, 19 nt, Homo sapiens
aacgaacuccguccacuaa

SEQ ID NO: 1142540 - RNA, 19 nt, Homo sapiens
gccaaaggaccggagguuu

SEQ ID NO: 1142541 - RNA, 19 nt, Homo sapiens
uaugaagcccacucacuug

SEQ ID NO: 1142542 - RNA, 19 nt, Homo sapiens
gaggugaacauccgcuaca

SEQ ID NO: 1142543 - RNA, 19 nt, Homo sapiens
gauccaagacguguacagu

SEQ ID NO: 1142544 - RNA, 19 nt, Homo sapiens
gaggaugccaaggaagaaa

SEQ ID NO: 1142545 - RNA, 19 nt, Homo sapiens
gaucccugcacuuggaauu

SEQ ID NO: 1142546 - RNA, 19 nt, Homo sapiens
gggccacgaugcucaugag

SEQ ID NO: 1142547 - RNA, 19 nt, Homo sapiens
caaccaggucuucgcugaa

SEQ ID NO: 1142548 - RNA, 19 nt, Homo sapiens
gcagcaucuuggcggaguu

SEQ ID NO: 1142549 - RNA, 19 nt, Homo sapiens
gggagaaaaucaaggagau

SEQ ID NO: 1142550 - RNA, 19 nt, Homo sapiens
ucaacuuugugucauuuac

SEQ ID NO: 1142551 - RNA, 19 nt, Homo sapiens
gacaggagaagagguguuc

SEQ ID NO: 1142552 - RNA, 19 nt, Homo sapiens
ccacacauuccuuucuaca

SEQ ID NO: 1142553 - RNA, 19 nt, Homo sapiens
ggcagagcuauaagcguua

SEQ ID NO: 1142554 - RNA, 19 nt, Homo sapiens
ccgaggaugccaaggaaga

SEQ ID NO: 1142555 - RNA, 19 nt, Homo sapiens
ucaggaacauccgcaaggu

SEQ ID NO: 1142556 - RNA, 19 nt, Homo sapiens
gauuuugucuuuucucuac

SEQ ID NO: 1142557 - RNA, 19 nt, Homo sapiens
ccuuguauuugauuugcuu

SEQ ID NO: 1142558 - RNA, 19 nt, Homo sapiens
ggacaagcaacuucuuuuc

SEQ ID NO: 1142559 - RNA, 19 nt, Homo sapiens
ggugcuggccuuggagaaa

SEQ ID NO: 1142560 - RNA, 19 nt, Homo sapiens
gauucuggaccacaagaug

SEQ ID NO: 1142561 - RNA, 19 nt, Homo sapiens
gagguguuccgaauaaagg

SEQ ID NO: 1142562 - RNA, 19 nt, Homo sapiens
ugucuuuucucuacaguuu

SEQ ID NO: 1142563 - RNA, 19 nt, Homo sapiens
ccacucacuugccauucca

SEQ ID NO: 1142564 - RNA, 19 nt, Homo sapiens
cgaagcggcgaaacucuca

SEQ ID NO: 1142565 - RNA, 19 nt, Homo sapiens
ggucauaccuuucuucguu

SEQ ID NO: 1142566 - RNA, 19 nt, Homo sapiens
caucuuugcucauguguua

SEQ ID NO: 1142567 - RNA, 19 nt, Homo sapiens
gggcuugucuuucuguuua

SEQ ID NO: 1142568 - RNA, 19 nt, Homo sapiens
gaacauguccuuugugaau

SEQ ID NO: 1142569 - RNA, 19 nt, Homo sapiens
gcagaaaggcuguuugaaa

SEQ ID NO: 1142570 - RNA, 19 nt, Homo sapiens
ggaagaacauguccuuugu

SEQ ID NO: 1142571 - RNA, 19 nt, Homo sapiens
guaaagccauuuucucuua

SEQ ID NO: 1142572 - RNA, 19 nt, Homo sapiens
ugaaguaaaucccuggaaa

SEQ ID NO: 1142573 - RNA, 19 nt, Homo sapiens
guaaggcacuacccagaga

SEQ ID NO: 1142574 - RNA, 19 nt, Homo sapiens
uauauaacgugcggucaua

SEQ ID NO: 1142575 - RNA, 19 nt, Homo sapiens
gagagacccuggauuaaaa

SEQ ID NO: 1142576 - RNA, 19 nt, Homo sapiens
ggacuuugcuggguuucuu

SEQ ID NO: 1142577 - RNA, 19 nt, Homo sapiens
ggaggaagauuuauuucac

SEQ ID NO: 1142578 - RNA, 19 nt, Homo sapiens
cagaaaggcuguuugaaaa

SEQ ID NO: 1142579 - RNA, 19 nt, Homo sapiens
ucacaaguaugucuacaca

SEQ ID NO: 1142580 - RNA, 19 nt, Homo sapiens
ccaaguugcuguauauuuu

SEQ ID NO: 1142581 - RNA, 19 nt, Homo sapiens
ucagguggguggagcagua

SEQ ID NO: 1142582 - RNA, 19 nt, Homo sapiens
ucugagagacccuggauua

SEQ ID NO: 1142583 - RNA, 19 nt, Homo sapiens
aagaacauguccuuuguga

SEQ ID NO: 1142584 - RNA, 19 nt, Homo sapiens
agagggaaguguaacauau

SEQ ID NO: 1142585 - RNA, 19 nt, Homo sapiens
gggaagaacauguccuuug

SEQ ID NO: 1142586 - RNA, 19 nt, Homo sapiens
caagggacuauuugaagua

SEQ ID NO: 1142587 - RNA, 19 nt, Homo sapiens
cgucuugucugugaucuuu

SEQ ID NO: 1142588 - RNA, 19 nt, Homo sapiens
aagagacggugaugaaguu

SEQ ID NO: 1142589 - RNA, 19 nt, Homo sapiens
ugaggaacauaaauucaug

SEQ ID NO: 1142590 - RNA, 19 nt, Homo sapiens
caaugggacucucuuugug

SEQ ID NO: 1142591 - RNA, 19 nt, Homo sapiens
aaacaaccauggccaggau

SEQ ID NO: 1142592 - RNA, 19 nt, Homo sapiens
ggagaacaugccuggauuu

SEQ ID NO: 1142593 - RNA, 19 nt, Homo sapiens
cuggaaacgugaagugaaa

SEQ ID NO: 1142594 - RNA, 19 nt, Homo sapiens
ugagagacccuggauuaaa

SEQ ID NO: 1142595 - RNA, 19 nt, Homo sapiens
cagcugcgguucccgaaug

SEQ ID NO: 1142596 - RNA, 19 nt, Homo sapiens
aguaacgucuugucuguga

SEQ ID NO: 1142597 - RNA, 19 nt, Homo sapiens
gaugggaggaagauuuauu

SEQ ID NO: 1142598 - RNA, 19 nt, Homo sapiens
guacagccucguccuagaa

SEQ ID NO: 1142599 - RNA, 19 nt, Homo sapiens
ccagcugucuccugcagaa

SEQ ID NO: 1142600 - RNA, 19 nt, Homo sapiens
uuaguaacgucuugucugu

SEQ ID NO: 1142601 - RNA, 19 nt, Homo sapiens
gaagcuccuugcacuugga

SEQ ID NO: 1142602 - RNA, 19 nt, Homo sapiens
gcauacaagggacuauuug

SEQ ID NO: 1142603 - RNA, 19 nt, Homo sapiens
gccaugaggaacauaaauu

SEQ ID NO: 1142604 - RNA, 19 nt, Homo sapiens
gguacagccucguccuaga

SEQ ID NO: 1142605 - RNA, 19 nt, Homo sapiens
ccaaugggacucucuuugu

SEQ ID NO: 1142606 - RNA, 19 nt, Homo sapiens
gguguucugcauccaaaua

SEQ ID NO: 1142607 - RNA, 19 nt, Homo sapiens
ugaccaugcuggaauugga

SEQ ID NO: 1142608 - RNA, 19 nt, Homo sapiens
ccugagagguggugggaau

SEQ ID NO: 1142609 - RNA, 19 nt, Homo sapiens
uggagaacaugccuggauu

SEQ ID NO: 1142610 - RNA, 19 nt, Homo sapiens
cuacguuucuggccugaug

SEQ ID NO: 1142611 - RNA, 19 nt, Homo sapiens
ccucucagcuucaaagaac

SEQ ID NO: 1142612 - RNA, 19 nt, Homo sapiens
acaaguaugucuacacacu

SEQ ID NO: 1142613 - RNA, 19 nt, Homo sapiens
gggaagcuccuugcacuug

SEQ ID NO: 1142614 - RNA, 19 nt, Homo sapiens
caccugggcuugucuuucu

SEQ ID NO: 1142615 - RNA, 19 nt, Homo sapiens
gucaagagacggugaugaa

SEQ ID NO: 1142616 - RNA, 19 nt, Homo sapiens
caggaugggaggaagauuu

SEQ ID NO: 1142617 - RNA, 19 nt, Homo sapiens
acaagggacuauuugaagu

SEQ ID NO: 1142618 - RNA, 19 nt, Homo sapiens
gaaaggcuguuugaaaauc

SEQ ID NO: 1142619 - RNA, 19 nt, Homo sapiens
uguaacauaucugccauga

SEQ ID NO: 1142620 - RNA, 19 nt, Homo sapiens
agacggugaugaaguuugu

SEQ ID NO: 1142621 - RNA, 19 nt, Homo sapiens
gggaggaagauuuauuuca

SEQ ID NO: 1142622 - RNA, 19 nt, Homo sapiens
gaagaacauguccuuugug

SEQ ID NO: 1142623 - RNA, 19 nt, Homo sapiens
gaaguaaaucccuggaaac

SEQ ID NO: 1142624 - RNA, 19 nt, Homo sapiens
ccacaugcaccuauuaguc

SEQ ID NO: 1142625 - RNA, 19 nt, Homo sapiens
uuuaagcucuuuagucaag

SEQ ID NO: 1142626 - RNA, 19 nt, Homo sapiens
acuguguucucaaggguua

SEQ ID NO: 1142627 - RNA, 19 nt, Homo sapiens
caagagacggugaugaagu

SEQ ID NO: 1142628 - RNA, 19 nt, Homo sapiens
caugcuggauuucuuaucu

SEQ ID NO: 1142629 - RNA, 19 nt, Homo sapiens
auacgaagagucuacguuu

SEQ ID NO: 1142630 - RNA, 19 nt, Homo sapiens
ccaugaugcugcuggaauc

SEQ ID NO: 1142631 - RNA, 19 nt, Homo sapiens
gcagggguccguuuaguaa

SEQ ID NO: 1142632 - RNA, 19 nt, Homo sapiens
ggacacagucgugguucaa

SEQ ID NO: 1142633 - RNA, 19 nt, Homo sapiens
ucagcgaggugcacgaaca

SEQ ID NO: 1142634 - RNA, 19 nt, Homo sapiens
cggagaagccugcaugauc

SEQ ID NO: 1142635 - RNA, 19 nt, Homo sapiens
gauacgaagagucuacguu

SEQ ID NO: 1142636 - RNA, 19 nt, Homo sapiens
acauguccuuugugaauga

SEQ ID NO: 1142637 - RNA, 19 nt, Homo sapiens
ggugaaauagagaccauug

SEQ ID NO: 1142638 - RNA, 19 nt, Homo sapiens
ggguuucuuucugugaaua

SEQ ID NO: 1142639 - RNA, 19 nt, Homo sapiens
ggcgugggcucuccauagu

SEQ ID NO: 1142640 - RNA, 19 nt, Homo sapiens
uagagggaaguguaacaua

SEQ ID NO: 1142641 - RNA, 19 nt, Homo sapiens
guucaaguguccacaugca

SEQ ID NO: 1142642 - RNA, 19 nt, Homo sapiens
gagaacaugccuggauuuc

SEQ ID NO: 1142643 - RNA, 19 nt, Homo sapiens
agauuuauuucaccgauuc

SEQ ID NO: 1142644 - RNA, 19 nt, Homo sapiens
aagggacuauuugaaguaa

SEQ ID NO: 1142645 - RNA, 19 nt, Homo sapiens
agaggacuuugcuggguuu

SEQ ID NO: 1142646 - RNA, 19 nt, Homo sapiens
cuggauuucuuaucugaga

SEQ ID NO: 1142647 - RNA, 19 nt, Homo sapiens
aggaugggaggaagauuua

SEQ ID NO: 1142648 - RNA, 19 nt, Homo sapiens
cgugggcucuccauagugu

SEQ ID NO: 1142649 - RNA, 19 nt, Homo sapiens
aacgugcggucauaccuuu

SEQ ID NO: 1142650 - RNA, 19 nt, Homo sapiens
ccaugaggaacauaaauuc

SEQ ID NO: 1142651 - RNA, 19 nt, Homo sapiens
gagggaaguguaacauauc

SEQ ID NO: 1142652 - RNA, 19 nt, Homo sapiens
cggaguccauagcacauau

SEQ ID NO: 1142653 - RNA, 19 nt, Homo sapiens
cauacaagggacuauuuga

SEQ ID NO: 1142654 - RNA, 19 nt, Homo sapiens
gcaaaacccgagaugauga

SEQ ID NO: 1142655 - RNA, 19 nt, Homo sapiens
cccaaguugcuguauauuu

SEQ ID NO: 1142656 - RNA, 19 nt, Homo sapiens
auacaagggacuauuugaa

SEQ ID NO: 1142657 - RNA, 19 nt, Homo sapiens
cugcuggaaucuccuauag

SEQ ID NO: 1142658 - RNA, 19 nt, Homo sapiens
gaaaauggugaaauagaga

SEQ ID NO: 1142659 - RNA, 19 nt, Homo sapiens
acacagucgugguucaagu

SEQ ID NO: 1142660 - RNA, 19 nt, Homo sapiens
cgaagagucuacguuucug

SEQ ID NO: 1142661 - RNA, 19 nt, Homo sapiens
aaugucaucuuugcucaug

SEQ ID NO: 1142662 - RNA, 19 nt, Homo sapiens
ggcgccugcuggaguauga

SEQ ID NO: 1142663 - RNA, 19 nt, Homo sapiens
agagaccauugcccgguuu

SEQ ID NO: 1142664 - RNA, 19 nt, Homo sapiens
ugauggagggcacagauga

SEQ ID NO: 1142665 - RNA, 19 nt, Homo sapiens
gagccuauguggagaagua

SEQ ID NO: 1142666 - RNA, 19 nt, Homo sapiens
gaacaaggacacagacauu

SEQ ID NO: 1142667 - RNA, 19 nt, Homo sapiens
gugcauacauggaggaaga

SEQ ID NO: 1142668 - RNA, 19 nt, Homo sapiens
gggcagggcuggaauucga

SEQ ID NO: 1142669 - RNA, 19 nt, Homo sapiens
cgacacaccugccgugaag

SEQ ID NO: 1142670 - RNA, 19 nt, Homo sapiens
gcagagccauccagcagau

SEQ ID NO: 1142671 - RNA, 19 nt, Homo sapiens
ggacagcccggucagcaaa

SEQ ID NO: 1142672 - RNA, 19 nt, Homo sapiens
acacagacauucccucagu

SEQ ID NO: 1142673 - RNA, 19 nt, Homo sapiens
caccaugccuccugucuca

SEQ ID NO: 1142674 - RNA, 19 nt, Homo sapiens
ccauugacaucuccaagug

SEQ ID NO: 1142675 - RNA, 19 nt, Homo sapiens
ccacagcgcuuugaugacu

SEQ ID NO: 1142676 - RNA, 19 nt, Homo sapiens
ccuccugucucaacacuga

SEQ ID NO: 1142677 - RNA, 19 nt, Homo sapiens
acccagagcugaccuaugg

SEQ ID NO: 1142678 - RNA, 19 nt, Homo sapiens
gcuacugcuucguguacua

SEQ ID NO: 1142679 - RNA, 19 nt, Homo sapiens
gcacaggggcaaagcaaua

SEQ ID NO: 1142680 - RNA, 19 nt, Homo sapiens
gugaugagccuguccaagu

SEQ ID NO: 1142681 - RNA, 19 nt, Homo sapiens
ugaugagccuguccaagug

SEQ ID NO: 1142682 - RNA, 19 nt, Homo sapiens
ucagcaaacugcaggucaa

SEQ ID NO: 1142683 - RNA, 19 nt, Homo sapiens
guggagaaguacaaguuca

SEQ ID NO: 1142684 - RNA, 19 nt, Homo sapiens
ggaacaaggacacagacau

SEQ ID NO: 1142685 - RNA, 19 nt, Homo sapiens
gccaagcccuucgucuuca

SEQ ID NO: 1142686 - RNA, 19 nt, Homo sapiens
acagcgcuuugaugacuuu

SEQ ID NO: 1142687 - RNA, 19 nt, Homo sapiens
gcgccaagcccuucgucuu

SEQ ID NO: 1142688 - RNA, 19 nt, Homo sapiens
gcgcuuugaugacuuucuc

SEQ ID NO: 1142689 - RNA, 19 nt, Homo sapiens
gccugggacugcugugaug

SEQ ID NO: 1142690 - RNA, 19 nt, Homo sapiens
agccagaugucacgcaugu

SEQ ID NO: 1142691 - RNA, 19 nt, Homo sapiens
gcaaacugcaggucaagcu

SEQ ID NO: 1142692 - RNA, 19 nt, Homo sapiens
ccagaugucacgcauguac

SEQ ID NO: 1142693 - RNA, 19 nt, Homo sapiens
ggccagcgccauugacauc

SEQ ID NO: 1142694 - RNA, 19 nt, Homo sapiens
uaaacuuccacucugcaaa

SEQ ID NO: 1142695 - RNA, 19 nt, Homo sapiens
gugcaaccgcuccuucuuc

SEQ ID NO: 1142696 - RNA, 19 nt, Homo sapiens
ccggugcccucaaguccuu

SEQ ID NO: 1142697 - RNA, 19 nt, Homo sapiens
gguccgcaacgacuacuau

SEQ ID NO: 1142698 - RNA, 19 nt, Homo sapiens
uccgcuggcugcagauuga

SEQ ID NO: 1142699 - RNA, 19 nt, Homo sapiens
acacugugccuuaaugucu

SEQ ID NO: 1142700 - RNA, 19 nt, Homo sapiens
ggagacccacagcgcuuug

SEQ ID NO: 1142701 - RNA, 19 nt, Homo sapiens
agauugagguccgcaacga

SEQ ID NO: 1142702 - RNA, 19 nt, Homo sapiens
cgcaggagguggugaugag

SEQ ID NO: 1142703 - RNA, 19 nt, Homo sapiens
acccacagcgcuuugauga

SEQ ID NO: 1142704 - RNA, 19 nt, Homo sapiens
ggacccagagcugaccuau

SEQ ID NO: 1142705 - RNA, 19 nt, Homo sapiens
ugccucaccuucaucaucu

SEQ ID NO: 1142706 - RNA, 19 nt, Homo sapiens
cacccggagugcauacaug

SEQ ID NO: 1142707 - RNA, 19 nt, Homo sapiens
gggcauaucuggaaucuga

SEQ ID NO: 1142708 - RNA, 19 nt, Homo sapiens
caaaugagauuauccaugu

SEQ ID NO: 1142709 - RNA, 19 nt, Homo sapiens
gauccaagcuauccagaaa

SEQ ID NO: 1142710 - RNA, 19 nt, Homo sapiens
caugugaacugcacgauaa

SEQ ID NO: 1142711 - RNA, 19 nt, Homo sapiens
ccacagugcuugauauuuc

SEQ ID NO: 1142712 - RNA, 19 nt, Homo sapiens
gcgcaaagcugaaugaaaa

SEQ ID NO: 1142713 - RNA, 19 nt, Homo sapiens
guucagaaguacaguaauu

SEQ ID NO: 1142714 - RNA, 19 nt, Homo sapiens
gaaugcaugugacuguaaa

SEQ ID NO: 1142715 - RNA, 19 nt, Homo sapiens
cagagucagucauugguua

SEQ ID NO: 1142716 - RNA, 19 nt, Homo sapiens
ggagagacauuaagaagac

SEQ ID NO: 1142717 - RNA, 19 nt, Homo sapiens
gagauuauccaugugguua

SEQ ID NO: 1142718 - RNA, 19 nt, Homo sapiens
cacauaagcuagaagaaga

SEQ ID NO: 1142719 - RNA, 19 nt, Homo sapiens
caaagcagaucgugacaag

SEQ ID NO: 1142720 - RNA, 19 nt, Homo sapiens
ggaguagguuugugcaguu

SEQ ID NO: 1142721 - RNA, 19 nt, Homo sapiens
aggcacagauagaucauua

SEQ ID NO: 1142722 - RNA, 19 nt, Homo sapiens
gcaugugacuguaaagcaa

SEQ ID NO: 1142723 - RNA, 19 nt, Homo sapiens
uaacuggacugaccuaaac

SEQ ID NO: 1142724 - RNA, 19 nt, Homo sapiens
ggucugacacuacugauuu

SEQ ID NO: 1142725 - RNA, 19 nt, Homo sapiens
gagcguaacagccuacauu

SEQ ID NO: 1142726 - RNA, 19 nt, Homo sapiens
gaacugcacgauaaaggaa

SEQ ID NO: 1142727 - RNA, 19 nt, Homo sapiens
cuagguguauugugacuuu

SEQ ID NO: 1142728 - RNA, 19 nt, Homo sapiens
gauggacggucagaagaaa

SEQ ID NO: 1142729 - RNA, 19 nt, Homo sapiens
gaguagguuugugcaguua

SEQ ID NO: 1142730 - RNA, 19 nt, Homo sapiens
uuaaagaugcuauggcuaa

SEQ ID NO: 1142731 - RNA, 19 nt, Homo sapiens
guuggugccuuguuuaaug

SEQ ID NO: 1142732 - RNA, 19 nt, Homo sapiens
gaccaucagcuuuaggaua

SEQ ID NO: 1142733 - RNA, 19 nt, Homo sapiens
gaaaugccacacacauaga

SEQ ID NO: 1142734 - RNA, 19 nt, Homo sapiens
caaagcacauaagcuagaa

SEQ ID NO: 1142735 - RNA, 19 nt, Homo sapiens
gcagugcaguuucacagau

SEQ ID NO: 1142736 - RNA, 19 nt, Homo sapiens
ucaguguuccuguuauuua

SEQ ID NO: 1142737 - RNA, 19 nt, Homo sapiens
ggaaugcaugugacuguaa

SEQ ID NO: 1142738 - RNA, 19 nt, Homo sapiens
acauagaacuccaacaaca

SEQ ID NO: 1142739 - RNA, 19 nt, Homo sapiens
gacgagaucauaccgguaa

SEQ ID NO: 1142740 - RNA, 19 nt, Homo sapiens
cugaggcacugguggaaua

SEQ ID NO: 1142741 - RNA, 19 nt, Homo sapiens
gacugacuguaguuaauuu

SEQ ID NO: 1142742 - RNA, 19 nt, Homo sapiens
cagaaucuauggcugaauc

SEQ ID NO: 1142743 - RNA, 19 nt, Homo sapiens
guauggauuuaaaccguaa

SEQ ID NO: 1142744 - RNA, 19 nt, Homo sapiens
gcugcuauguauggauuua

SEQ ID NO: 1142745 - RNA, 19 nt, Homo sapiens
gaaaacgcccaaaauaauu

SEQ ID NO: 1142746 - RNA, 19 nt, Homo sapiens
uaaagaugcuauggcuaaa

SEQ ID NO: 1142747 - RNA, 19 nt, Homo sapiens
gcacauaagcuagaagaag

SEQ ID NO: 1142748 - RNA, 19 nt, Homo sapiens
guguugauguggguauuua

SEQ ID NO: 1142749 - RNA, 19 nt, Homo sapiens
cagacugacuguaguuaau

SEQ ID NO: 1142750 - RNA, 19 nt, Homo sapiens
acacauagaacuccaacaa

SEQ ID NO: 1142751 - RNA, 19 nt, Homo sapiens
guagauugaugcagauuuu

SEQ ID NO: 1142752 - RNA, 19 nt, Homo sapiens
auuguaagcugcuauguau

SEQ ID NO: 1142753 - RNA, 19 nt, Homo sapiens
guacaguaauucugcucuu

SEQ ID NO: 1142754 - RNA, 19 nt, Homo sapiens
cuguugguaugcauaauua

SEQ ID NO: 1142755 - RNA, 19 nt, Homo sapiens
ccaacaacaucaauuucau

SEQ ID NO: 1142756 - RNA, 19 nt, Homo sapiens
ggagcacuaccaucuguuu

SEQ ID NO: 1142757 - RNA, 19 nt, Homo sapiens
gaagcgcaaagcugaauga

SEQ ID NO: 1142758 - RNA, 19 nt, Homo sapiens
uaucuaggacuugcaaaua

SEQ ID NO: 1142759 - RNA, 19 nt, Homo sapiens
ggaaucugaaguugcuaua

SEQ ID NO: 1142760 - RNA, 19 nt, Homo sapiens
aaacggguauuucaugucu

SEQ ID NO: 1142761 - RNA, 19 nt, Homo sapiens
uaaagcaaguccauaagcu

SEQ ID NO: 1142762 - RNA, 19 nt, Homo sapiens
ccaaagcacauaagcuaga

SEQ ID NO: 1142763 - RNA, 19 nt, Homo sapiens
guaaagcaggaaugacaaa

SEQ ID NO: 1142764 - RNA, 19 nt, Homo sapiens
gaacucaggcgccucuucu

SEQ ID NO: 1142765 - RNA, 19 nt, Homo sapiens
aaucugaaguugcuauauc

SEQ ID NO: 1142766 - RNA, 19 nt, Homo sapiens
accaucagcuuuaggauau

SEQ ID NO: 1142767 - RNA, 19 nt, Homo sapiens
aaacguggaaugcauguga

SEQ ID NO: 1142768 - RNA, 19 nt, Homo sapiens
agaggagacugcagacuuc

SEQ ID NO: 1142769 - RNA, 19 nt, Homo sapiens
gagauggacggucagaaga

SEQ ID NO: 1142770 - RNA, 19 nt, Homo sapiens
gaacuccaacaacaucaau

SEQ ID NO: 1142771 - RNA, 19 nt, Homo sapiens
aggaguugguucagaagua

SEQ ID NO: 1142772 - RNA, 19 nt, Homo sapiens
uaugguccguguagauuga

SEQ ID NO: 1142773 - RNA, 19 nt, Homo sapiens
uaaaggggauauucauuug

SEQ ID NO: 1142774 - RNA, 19 nt, Homo sapiens
ugaaaugccacacacauag

SEQ ID NO: 1142775 - RNA, 19 nt, Homo sapiens
cuauguuggugccuuguuu

SEQ ID NO: 1142776 - RNA, 19 nt, Homo sapiens
gaaguuugcaguguugaug

SEQ ID NO: 1142777 - RNA, 19 nt, Homo sapiens
caacaugaaaugccacaca

SEQ ID NO: 1142778 - RNA, 19 nt, Homo sapiens
aagcugcuauguauggauu

SEQ ID NO: 1142779 - RNA, 19 nt, Homo sapiens
ugucuugacugccaugugu

SEQ ID NO: 1142780 - RNA, 19 nt, Homo sapiens
ucacagaucguuguuagau

SEQ ID NO: 1142781 - RNA, 19 nt, Homo sapiens
ggacuugcaaauaagaaug

SEQ ID NO: 1142782 - RNA, 19 nt, Homo sapiens
gcucucauuucacucuuca

SEQ ID NO: 1142783 - RNA, 19 nt, Homo sapiens
uuucaugucucagggagua

SEQ ID NO: 1142784 - RNA, 19 nt, Homo sapiens
ggaguugguucagaaguac

SEQ ID NO: 1142785 - RNA, 19 nt, Homo sapiens
caguguuccuguuauuuau

SEQ ID NO: 1142786 - RNA, 19 nt, Homo sapiens
uaucuggaaucugaaguug

SEQ ID NO: 1142787 - RNA, 19 nt, Homo sapiens
uaggagcacuaccaucugu

SEQ ID NO: 1142788 - RNA, 19 nt, Homo sapiens
guguuccuguuauuuauga

SEQ ID NO: 1142789 - RNA, 19 nt, Homo sapiens
gauuuuggcucucauuuca

SEQ ID NO: 1142790 - RNA, 19 nt, Homo sapiens
gaagacuggagugguguuu

SEQ ID NO: 1142791 - RNA, 19 nt, Homo sapiens
cagaggagacugcagacuu

SEQ ID NO: 1142792 - RNA, 19 nt, Homo sapiens
agucauugguuauacaugu

SEQ ID NO: 1142793 - RNA, 19 nt, Homo sapiens
gcacugcgucagacuguuc

SEQ ID NO: 1142794 - RNA, 19 nt, Homo sapiens
uguucuagguguauuguga

SEQ ID NO: 1142795 - RNA, 19 nt, Homo sapiens
ucugugaccaucagcuuua

SEQ ID NO: 1142796 - RNA, 19 nt, Homo sapiens
agacuucgguugaggaaac

SEQ ID NO: 1142797 - RNA, 19 nt, Homo sapiens
acucaggcgccucuucuua

SEQ ID NO: 1142798 - RNA, 19 nt, Homo sapiens
aaucuauggcugaaucuaa

SEQ ID NO: 1142799 - RNA, 19 nt, Homo sapiens
guagguuugugcaguuaca

SEQ ID NO: 1142800 - RNA, 19 nt, Homo sapiens
guaguuccaaagcacauaa

SEQ ID NO: 1142801 - RNA, 19 nt, Homo sapiens
cagagaugguggagcuaga

SEQ ID NO: 1142802 - RNA, 19 nt, Homo sapiens
aucuaggacuugcaaauaa

SEQ ID NO: 1142803 - RNA, 19 nt, Homo sapiens
cuucaguguuccuguuauu

SEQ ID NO: 1142804 - RNA, 19 nt, Homo sapiens
gguauguucuagguguauu

SEQ ID NO: 1142805 - RNA, 19 nt, Homo sapiens
guguucaucaucuuaagua

SEQ ID NO: 1142806 - RNA, 19 nt, Homo sapiens
uuucacagaucguuguuag

SEQ ID NO: 1142807 - RNA, 19 nt, Homo sapiens
guacaaagauugcuuauga

SEQ ID NO: 1142808 - RNA, 19 nt, Homo sapiens
gaagagaaguuaguuagua

SEQ ID NO: 1142809 - RNA, 19 nt, Homo sapiens
gggcauaucuggaaucuga

SEQ ID NO: 1142810 - RNA, 19 nt, Homo sapiens
gaagauuccucaccugauu

SEQ ID NO: 1142811 - RNA, 19 nt, Homo sapiens
cuacagcucuuacuaaauu

SEQ ID NO: 1142812 - RNA, 19 nt, Homo sapiens
caucaaaggugcucuuauu

SEQ ID NO: 1142813 - RNA, 19 nt, Homo sapiens
ggaauauacugaccuagaa

SEQ ID NO: 1142814 - RNA, 19 nt, Homo sapiens
gaaaugggaucaucguuca

SEQ ID NO: 1142815 - RNA, 19 nt, Homo sapiens
gauccaagcuauccagaaa

SEQ ID NO: 1142816 - RNA, 19 nt, Homo sapiens
gaacauacaacccaaaguu

SEQ ID NO: 1142817 - RNA, 19 nt, Homo sapiens
guucaaacaucagaaguua

SEQ ID NO: 1142818 - RNA, 19 nt, Homo sapiens
aacagaagcuccuuauaua

SEQ ID NO: 1142819 - RNA, 19 nt, Homo sapiens
gaaagugaauugaaugaag

SEQ ID NO: 1142820 - RNA, 19 nt, Homo sapiens
caugugaacugcacgauaa

SEQ ID NO: 1142821 - RNA, 19 nt, Homo sapiens
gagcauaguuaaacccaaa

SEQ ID NO: 1142822 - RNA, 19 nt, Homo sapiens
guacugcaguuuauucaaa

SEQ ID NO: 1142823 - RNA, 19 nt, Homo sapiens
caaagaacaugaauaccuu

SEQ ID NO: 1142824 - RNA, 19 nt, Homo sapiens
gaagaauacuagcaccaaa

SEQ ID NO: 1142825 - RNA, 19 nt, Homo sapiens
aaagaaggcccaaauagua

SEQ ID NO: 1142826 - RNA, 19 nt, Homo sapiens
ccacagugcuugauauuuc

SEQ ID NO: 1142827 - RNA, 19 nt, Homo sapiens
gaagaagagaaguuaguua

SEQ ID NO: 1142828 - RNA, 19 nt, Homo sapiens
ggacuugguucaaacauca

SEQ ID NO: 1142829 - RNA, 19 nt, Homo sapiens
ggaggaauaugcagacuuc

SEQ ID NO: 1142830 - RNA, 19 nt, Homo sapiens
ggaagauagugauauguug

SEQ ID NO: 1142831 - RNA, 19 nt, Homo sapiens
gcgcaaagcugaaugaaaa

SEQ ID NO: 1142832 - RNA, 19 nt, Homo sapiens
guucagaaguacaguaauu

SEQ ID NO: 1142833 - RNA, 19 nt, Homo sapiens
ggauuucucugauuauuca

SEQ ID NO: 1142834 - RNA, 19 nt, Homo sapiens
caucagaaguuaugcaaga

SEQ ID NO: 1142835 - RNA, 19 nt, Homo sapiens
ggauggagcugggucauug

SEQ ID NO: 1142836 - RNA, 19 nt, Homo sapiens
gcagauagccuugagcaaa

SEQ ID NO: 1142837 - RNA, 19 nt, Homo sapiens
aaacagaagcuccuuauau

SEQ ID NO: 1142838 - RNA, 19 nt, Homo sapiens
gaaauuaaagagccugaaa

SEQ ID NO: 1142839 - RNA, 19 nt, Homo sapiens
ggaagcaugugaaagugaa

SEQ ID NO: 1142840 - RNA, 19 nt, Homo sapiens
gaacuaaaucuguggaaug

SEQ ID NO: 1142841 - RNA, 19 nt, Homo sapiens
cagagucagucauugguua

SEQ ID NO: 1142842 - RNA, 19 nt, Homo sapiens
ggagagacauuaagaagac

SEQ ID NO: 1142843 - RNA, 19 nt, Homo sapiens
ugaaccaguugacuuauuu

SEQ ID NO: 1142844 - RNA, 19 nt, Homo sapiens
uaaggaagauagugauaug

SEQ ID NO: 1142845 - RNA, 19 nt, Homo sapiens
gcucaguacugcaguuuau

SEQ ID NO: 1142846 - RNA, 19 nt, Homo sapiens
ggaaagccauauuuggaau

SEQ ID NO: 1142847 - RNA, 19 nt, Homo sapiens
ccaguugacuuauuuagug

SEQ ID NO: 1142848 - RNA, 19 nt, Homo sapiens
gaagaggccaugaguguau

SEQ ID NO: 1142849 - RNA, 19 nt, Homo sapiens
aaagagaguugcaguggaa

SEQ ID NO: 1142850 - RNA, 19 nt, Homo sapiens
uaaagaggaugaaguugug

SEQ ID NO: 1142851 - RNA, 19 nt, Homo sapiens
gaaacagaagcuccuuaua

SEQ ID NO: 1142852 - RNA, 19 nt, Homo sapiens
ggaauaugcagacuucaaa

SEQ ID NO: 1142853 - RNA, 19 nt, Homo sapiens
cacauaagcuagaagaaga

SEQ ID NO: 1142854 - RNA, 19 nt, Homo sapiens
gagauagagagcauaguua

SEQ ID NO: 1142855 - RNA, 19 nt, Homo sapiens
cagauuaugucacaacaga

SEQ ID NO: 1142856 - RNA, 19 nt, Homo sapiens
aggcacagauagaucauua

SEQ ID NO: 1142857 - RNA, 19 nt, Homo sapiens
uaaauuagccagggaauau

SEQ ID NO: 1142858 - RNA, 19 nt, Homo sapiens
ucacugagacuucauuuga

SEQ ID NO: 1142859 - RNA, 19 nt, Homo sapiens
uaacagagaagaauacuag

SEQ ID NO: 1142860 - RNA, 19 nt, Homo sapiens
uagaugaguucccuacauu

SEQ ID NO: 1142861 - RNA, 19 nt, Homo sapiens
gggaagaaauaaucgugaa

SEQ ID NO: 1142862 - RNA, 19 nt, Homo sapiens
gguaauuugucaacaguau

SEQ ID NO: 1142863 - RNA, 19 nt, Homo sapiens
ggucugacacuacugauuu

SEQ ID NO: 1142864 - RNA, 19 nt, Homo sapiens
gagcguaacagccuacauu

SEQ ID NO: 1142865 - RNA, 19 nt, Homo sapiens
ccuguuaccugaugaaguu

SEQ ID NO: 1142866 - RNA, 19 nt, Homo sapiens
gaggagcagucucauuguu

SEQ ID NO: 1142867 - RNA, 19 nt, Homo sapiens
gauuaugucacaacagaua

SEQ ID NO: 1142868 - RNA, 19 nt, Homo sapiens
gaagauuuauaccauugug

SEQ ID NO: 1142869 - RNA, 19 nt, Homo sapiens
cuacauugaucaguucuaa

SEQ ID NO: 1142870 - RNA, 19 nt, Homo sapiens
gaggaaagccauauuugga

SEQ ID NO: 1142871 - RNA, 19 nt, Homo sapiens
gaaguuacugguacaaaga

SEQ ID NO: 1142872 - RNA, 19 nt, Homo sapiens
caacaagaguuaccuacag

SEQ ID NO: 1142873 - RNA, 19 nt, Homo sapiens
gaacugcacgauaaaggaa

SEQ ID NO: 1142874 - RNA, 19 nt, Homo sapiens
uaagagaaacugaaacguu

SEQ ID NO: 1142875 - RNA, 19 nt, Homo sapiens
uaucacaugugcucccuuu

SEQ ID NO: 1142876 - RNA, 19 nt, Homo sapiens
cagaaucuauggacugaau

SEQ ID NO: 1142877 - RNA, 19 nt, Homo sapiens
cuagguguauugugacuuu

SEQ ID NO: 1142878 - RNA, 19 nt, Homo sapiens
ugaaggagcagccagguaa

SEQ ID NO: 1142879 - RNA, 19 nt, Homo sapiens
gcacagaauugccccauga

SEQ ID NO: 1142880 - RNA, 19 nt, Homo sapiens
gaaccaguugacuuauuua

SEQ ID NO: 1142881 - RNA, 19 nt, Homo sapiens
gcccagcucaucaccauua

SEQ ID NO: 1142882 - RNA, 19 nt, Homo sapiens
uuaaagaugcuauggcuaa

SEQ ID NO: 1142883 - RNA, 19 nt, Homo sapiens
guuggugccuuguuuaaug

SEQ ID NO: 1142884 - RNA, 19 nt, Homo sapiens
gaccaucagcuuuaggaua

SEQ ID NO: 1142885 - RNA, 19 nt, Homo sapiens
ugaaagaaagucucacuga

SEQ ID NO: 1142886 - RNA, 19 nt, Homo sapiens
gaagcuccuuauauaucua

SEQ ID NO: 1142887 - RNA, 19 nt, Homo sapiens
ucacaugugcucccuuuaa

SEQ ID NO: 1142888 - RNA, 19 nt, Homo sapiens
gaaaugccacacacauaga

SEQ ID NO: 1142889 - RNA, 19 nt, Homo sapiens
caaagcacauaagcuagaa

SEQ ID NO: 1142890 - RNA, 19 nt, Homo sapiens
gcagugcaguuucacagau

SEQ ID NO: 1142891 - RNA, 19 nt, Homo sapiens
ucaguguuccuguuauuua

SEQ ID NO: 1142892 - RNA, 19 nt, Homo sapiens
cacaaaagauacccuguua

SEQ ID NO: 1142893 - RNA, 19 nt, Homo sapiens
acauagaacuccaacaaca

SEQ ID NO: 1142894 - RNA, 19 nt, Homo sapiens
gacgagaucauaccgguaa

SEQ ID NO: 1142895 - RNA, 19 nt, Homo sapiens
cugaggcacugguggaaua

SEQ ID NO: 1142896 - RNA, 19 nt, Homo sapiens
cccaugaccuuucuuugaa

SEQ ID NO: 1142897 - RNA, 19 nt, Homo sapiens
aaagugaaauugcuaaugc

SEQ ID NO: 1142898 - RNA, 19 nt, Homo sapiens
gaaacugugaugcuuguga

SEQ ID NO: 1142899 - RNA, 19 nt, Homo sapiens
gaaugaaguuacugguaca

SEQ ID NO: 1142900 - RNA, 19 nt, Homo sapiens
gagcgaguaugggaaguga

SEQ ID NO: 1142901 - RNA, 19 nt, Homo sapiens
gguuuaagcuguacugaac

SEQ ID NO: 1142902 - RNA, 19 nt, Homo sapiens
gacugacuguaguuaauuu

SEQ ID NO: 1142903 - RNA, 19 nt, Homo sapiens
gaugaguucccuacauuga

SEQ ID NO: 1142904 - RNA, 19 nt, Homo sapiens
gcaguuuauucaaaugaug

SEQ ID NO: 1142905 - RNA, 19 nt, Homo sapiens
gcagccagguaacacuauu

SEQ ID NO: 1142906 - RNA, 19 nt, Homo sapiens
guacaggaagcaugugaaa

SEQ ID NO: 1142907 - RNA, 19 nt, Homo sapiens
gggcauaucuggaaucuga

SEQ ID NO: 1142908 - RNA, 19 nt, Homo sapiens
gauccaagcuauccagaaa

SEQ ID NO: 1142909 - RNA, 19 nt, Homo sapiens
caugugaacugcacgauaa

SEQ ID NO: 1142910 - RNA, 19 nt, Homo sapiens
ccacagugcuugauauuuc

SEQ ID NO: 1142911 - RNA, 19 nt, Homo sapiens
gcgcaaagcugaaugaaaa

SEQ ID NO: 1142912 - RNA, 19 nt, Homo sapiens
guucagaaguacaguaauu

SEQ ID NO: 1142913 - RNA, 19 nt, Homo sapiens
gaacuaaaucuguggaaug

SEQ ID NO: 1142914 - RNA, 19 nt, Homo sapiens
cagagucagucauugguua

SEQ ID NO: 1142915 - RNA, 19 nt, Homo sapiens
ggagagacauuaagaagac

SEQ ID NO: 1142916 - RNA, 19 nt, Homo sapiens
cacauaagcuagaagaaga

SEQ ID NO: 1142917 - RNA, 19 nt, Homo sapiens
aggcacagauagaucauua

SEQ ID NO: 1142918 - RNA, 19 nt, Homo sapiens
gaggagcagucucauuguu

SEQ ID NO: 1142919 - RNA, 19 nt, Homo sapiens
ggucugacacuacugauuu

SEQ ID NO: 1142920 - RNA, 19 nt, Homo sapiens
gagcguaacagccuacauu

SEQ ID NO: 1142921 - RNA, 19 nt, Homo sapiens
gaagauuuauaccauugug

SEQ ID NO: 1142922 - RNA, 19 nt, Homo sapiens
acauagaacuccaacauca

SEQ ID NO: 1142923 - RNA, 19 nt, Homo sapiens
gaacugcacgauaaaggaa

SEQ ID NO: 1142924 - RNA, 19 nt, Homo sapiens
cagaaucuauggacugaau

SEQ ID NO: 1142925 - RNA, 19 nt, Homo sapiens
cuagguguauugugacuuu

SEQ ID NO: 1142926 - RNA, 19 nt, Homo sapiens
uuaaagaugcuauggcuaa

SEQ ID NO: 1142927 - RNA, 19 nt, Homo sapiens
guuggugccuuguuuaaug

SEQ ID NO: 1142928 - RNA, 19 nt, Homo sapiens
gaccaucagcuuuaggaua

SEQ ID NO: 1142929 - RNA, 19 nt, Homo sapiens
gaaaugccacacacauaga

SEQ ID NO: 1142930 - RNA, 19 nt, Homo sapiens
caaagcacauaagcuagaa

SEQ ID NO: 1142931 - RNA, 19 nt, Homo sapiens
gcagugcaguuucacagau

SEQ ID NO: 1142932 - RNA, 19 nt, Homo sapiens
ucaguguuccuguuauuua

SEQ ID NO: 1142933 - RNA, 19 nt, Homo sapiens
gacgagaucauaccgguaa

SEQ ID NO: 1142934 - RNA, 19 nt, Homo sapiens
cugaggcacugguggaaua

SEQ ID NO: 1142935 - RNA, 19 nt, Homo sapiens
gguuuaagcuguacugaac

SEQ ID NO: 1142936 - RNA, 19 nt, Homo sapiens
gacugacuguaguuaauuu

SEQ ID NO: 1142937 - RNA, 19 nt, Homo sapiens
guauggauuuaaaccguaa

SEQ ID NO: 1142938 - RNA, 19 nt, Homo sapiens
gcugcuauguauggauuua

SEQ ID NO: 1142939 - RNA, 19 nt, Homo sapiens
gaaaacgcccaaaauaauu

SEQ ID NO: 1142940 - RNA, 19 nt, Homo sapiens
uaaagaugcuauggcuaaa

SEQ ID NO: 1142941 - RNA, 19 nt, Homo sapiens
gcacauaagcuagaagaag

SEQ ID NO: 1142942 - RNA, 19 nt, Homo sapiens
guguugauguggguauuua

SEQ ID NO: 1142943 - RNA, 19 nt, Homo sapiens
ggaaugcauugugaacugu

SEQ ID NO: 1142944 - RNA, 19 nt, Homo sapiens
cagacugacuguaguuaau

SEQ ID NO: 1142945 - RNA, 19 nt, Homo sapiens
guagauugaugcagauuuu

SEQ ID NO: 1142946 - RNA, 19 nt, Homo sapiens
auuguaagcugcuauguau

SEQ ID NO: 1142947 - RNA, 19 nt, Homo sapiens
guacaguaauucugcucuu

SEQ ID NO: 1142948 - RNA, 19 nt, Homo sapiens
ggaagaagaggaggaggaa

SEQ ID NO: 1142949 - RNA, 19 nt, Homo sapiens
ggagcacuaccaucuguuu

SEQ ID NO: 1142950 - RNA, 19 nt, Homo sapiens
gaagcgcaaagcugaauga

SEQ ID NO: 1142951 - RNA, 19 nt, Homo sapiens
uaucuaggacuugcaaaua

SEQ ID NO: 1142952 - RNA, 19 nt, Homo sapiens
ggaaucugaaguugcuaua

SEQ ID NO: 1142953 - RNA, 19 nt, Homo sapiens
gaacuccaacaucaauuuc

SEQ ID NO: 1142954 - RNA, 19 nt, Homo sapiens
cacagaaucuauggacuga

SEQ ID NO: 1142955 - RNA, 19 nt, Homo sapiens
ccaaagcacauaagcuaga

SEQ ID NO: 1142956 - RNA, 19 nt, Homo sapiens
guaaagcaggaaugacaaa

SEQ ID NO: 1142957 - RNA, 19 nt, Homo sapiens
gaacucaggcgccucuucu

SEQ ID NO: 1142958 - RNA, 19 nt, Homo sapiens
aaucugaaguugcuauauc

SEQ ID NO: 1142959 - RNA, 19 nt, Homo sapiens
accaucagcuuuaggauau

SEQ ID NO: 1142960 - RNA, 19 nt, Homo sapiens
aagcuguacugaacuaaau

SEQ ID NO: 1142961 - RNA, 19 nt, Homo sapiens
ggacuucggaaaugacuuc

SEQ ID NO: 1142962 - RNA, 19 nt, Homo sapiens
cuaaaucuguggaaugcau

SEQ ID NO: 1142963 - RNA, 19 nt, Homo sapiens
aggaguugguucagaagua

SEQ ID NO: 1142964 - RNA, 19 nt, Homo sapiens
uaugguccguguagauuga

SEQ ID NO: 1142965 - RNA, 19 nt, Homo sapiens
uaaaggggauauucauuug

SEQ ID NO: 1142966 - RNA, 19 nt, Homo sapiens
ucuauggacugaaucuaau

SEQ ID NO: 1142967 - RNA, 19 nt, Homo sapiens
ugaaaugccacacacauag

SEQ ID NO: 1142968 - RNA, 19 nt, Homo sapiens
cuauguuggugccuuguuu

SEQ ID NO: 1142969 - RNA, 19 nt, Homo sapiens
gaaguuugcaguguugaug

SEQ ID NO: 1142970 - RNA, 19 nt, Homo sapiens
caacaugaaaugccacaca

SEQ ID NO: 1142971 - RNA, 19 nt, Homo sapiens
aagcugcuauguauggauu

SEQ ID NO: 1142972 - RNA, 19 nt, Homo sapiens
ugucuugacugccaugugu

SEQ ID NO: 1142973 - RNA, 19 nt, Homo sapiens
ucacagaucguuguuagau

SEQ ID NO: 1142974 - RNA, 19 nt, Homo sapiens
ggacuugcaaauaagaaug

SEQ ID NO: 1142975 - RNA, 19 nt, Homo sapiens
gcucucauuucacucuuca

SEQ ID NO: 1142976 - RNA, 19 nt, Homo sapiens
ggaguugguucagaaguac

SEQ ID NO: 1142977 - RNA, 19 nt, Homo sapiens
cauugugguuuaagcugua

SEQ ID NO: 1142978 - RNA, 19 nt, Homo sapiens
caguguuccuguuauuuau

SEQ ID NO: 1142979 - RNA, 19 nt, Homo sapiens
uaucuggaaucugaaguug

SEQ ID NO: 1142980 - RNA, 19 nt, Homo sapiens
uuuaagcuguacugaacua

SEQ ID NO: 1142981 - RNA, 19 nt, Homo sapiens
ugaaucuaaugcuuccaaa

SEQ ID NO: 1142982 - RNA, 19 nt, Homo sapiens
acacauagaacuccaacau

SEQ ID NO: 1142983 - RNA, 19 nt, Homo sapiens
uaggagcacuaccaucugu

SEQ ID NO: 1142984 - RNA, 19 nt, Homo sapiens
guguuccuguuauuuauga

SEQ ID NO: 1142985 - RNA, 19 nt, Homo sapiens
gauuuuggcucucauuuca

SEQ ID NO: 1142986 - RNA, 19 nt, Homo sapiens
gaagacuggagugguguuu

SEQ ID NO: 1142987 - RNA, 19 nt, Homo sapiens
ggacgaggaggaagaagag

SEQ ID NO: 1142988 - RNA, 19 nt, Homo sapiens
agucauugguuauacaugu

SEQ ID NO: 1142989 - RNA, 19 nt, Homo sapiens
uguucuagguguauuguga

SEQ ID NO: 1142990 - RNA, 19 nt, Homo sapiens
ucugugaccaucagcuuua

SEQ ID NO: 1142991 - RNA, 19 nt, Homo sapiens
gaaugcauugugaacugua

SEQ ID NO: 1142992 - RNA, 19 nt, Homo sapiens
uggaaugcauugugaacug

SEQ ID NO: 1142993 - RNA, 19 nt, Homo sapiens
ugauggacuucggaaauga

SEQ ID NO: 1142994 - RNA, 19 nt, Homo sapiens
acucaggcgccucuucuua

SEQ ID NO: 1142995 - RNA, 19 nt, Homo sapiens
ucuguggaaugcauuguga

SEQ ID NO: 1142996 - RNA, 19 nt, Homo sapiens
ugaacuaaaucuguggaau

SEQ ID NO: 1142997 - RNA, 19 nt, Homo sapiens
uggaggugcuggagaggaa

SEQ ID NO: 1142998 - RNA, 19 nt, Homo sapiens
guaguuccaaagcacauaa

SEQ ID NO: 1142999 - RNA, 19 nt, Homo sapiens
cagagaugguggagcuaga

SEQ ID NO: 1143000 - RNA, 19 nt, Homo sapiens
aucuaggacuugcaaauaa

SEQ ID NO: 1143001 - RNA, 19 nt, Homo sapiens
cuucaguguuccuguuauu

SEQ ID NO: 1143002 - RNA, 19 nt, Homo sapiens
agaacuccaacaucaauuu

SEQ ID NO: 1143003 - RNA, 19 nt, Homo sapiens
aagaagaggaggaggaaga

SEQ ID NO: 1143004 - RNA, 19 nt, Homo sapiens
gguauguucuagguguauu

SEQ ID NO: 1143005 - RNA, 19 nt, Homo sapiens
guguucaucaucuuaagua

SEQ ID NO: 1143006 - RNA, 19 nt, Homo sapiens
uuucacagaucguuguuag

SEQ ID NO: 1143007 - RNA, 19 nt, Homo sapiens
cgacggcugucaucaguua

SEQ ID NO: 1143008 - RNA, 19 nt, Homo sapiens
ggacugacaugaagagagu

SEQ ID NO: 1143009 - RNA, 19 nt, Homo sapiens
cagcgaggccuucaacuua

SEQ ID NO: 1143010 - RNA, 19 nt, Homo sapiens
cagaaaggcucucaagcuu

SEQ ID NO: 1143011 - RNA, 19 nt, Homo sapiens
gaaggacccagaucucuuu

SEQ ID NO: 1143012 - RNA, 19 nt, Homo sapiens
gaagaagaauaccuguuca

SEQ ID NO: 1143013 - RNA, 19 nt, Homo sapiens
ggaacaagaucgacgucaa

SEQ ID NO: 1143014 - RNA, 19 nt, Homo sapiens
uaagauccaugauuuguuc

SEQ ID NO: 1143015 - RNA, 19 nt, Homo sapiens
ugaagagagugaaggagua

SEQ ID NO: 1143016 - RNA, 19 nt, Homo sapiens
gaucuggacugacaugaag

SEQ ID NO: 1143017 - RNA, 19 nt, Homo sapiens
gagacuacauggagaggaa

SEQ ID NO: 1143018 - RNA, 19 nt, Homo sapiens
caagauguauagugagaug

SEQ ID NO: 1143019 - RNA, 19 nt, Homo sapiens
gaacaagaucgacgucaau

SEQ ID NO: 1143020 - RNA, 19 nt, Homo sapiens
ggagcuggauuuccucaau

SEQ ID NO: 1143021 - RNA, 19 nt, Homo sapiens
agaagaaccugccuuugga

SEQ ID NO: 1143022 - RNA, 19 nt, Homo sapiens
gagcucauccugcguguga

SEQ ID NO: 1143023 - RNA, 19 nt, Homo sapiens
ggcaagauguauagugaga

SEQ ID NO: 1143024 - RNA, 19 nt, Homo sapiens
gagcacaagaagaagaaua

SEQ ID NO: 1143025 - RNA, 19 nt, Homo sapiens
ccaagaagaaccugccuuu

SEQ ID NO: 1143026 - RNA, 19 nt, Homo sapiens
gagcuggauuuccucaaug

SEQ ID NO: 1143027 - RNA, 19 nt, Homo sapiens
uagcugagcacaagaagaa

SEQ ID NO: 1143028 - RNA, 19 nt, Homo sapiens
uuauguggcuuguggauga

SEQ ID NO: 1143029 - RNA, 19 nt, Homo sapiens
gaucagccaucuccucaac

SEQ ID NO: 1143030 - RNA, 19 nt, Homo sapiens
ucccagaguuugaguuuau

SEQ ID NO: 1143031 - RNA, 19 nt, Homo sapiens
ugaagagugucccuuaugg

SEQ ID NO: 1143032 - RNA, 19 nt, Homo sapiens
ucucugaucuggacugaca

SEQ ID NO: 1143033 - RNA, 19 nt, Homo sapiens
ggacccagaucucuuucag

SEQ ID NO: 1143034 - RNA, 19 nt, Homo sapiens
ugggcaagauguauaguga

SEQ ID NO: 1143035 - RNA, 19 nt, Homo sapiens
ggucuuggcccuaauaugc

SEQ ID NO: 1143036 - RNA, 19 nt, Homo sapiens
ggaggaaugcugagaaggu

SEQ ID NO: 1143037 - RNA, 19 nt, Homo sapiens
ccucuggcaucuacuucua

SEQ ID NO: 1143038 - RNA, 19 nt, Homo sapiens
gcgaggccuucaacuuaug

SEQ ID NO: 1143039 - RNA, 19 nt, Homo sapiens
agaagaagaauaccuguuc

SEQ ID NO: 1143040 - RNA, 19 nt, Homo sapiens
cagccaagcucccgucacu

SEQ ID NO: 1143041 - RNA, 19 nt, Homo sapiens
ccacugaggacuuagagau

SEQ ID NO: 1143042 - RNA, 19 nt, Homo sapiens
caagaucgacgucaaugag

SEQ ID NO: 1143043 - RNA, 19 nt, Homo sapiens
gaagggaggaaugcugaga

SEQ ID NO: 1143044 - RNA, 19 nt, Homo sapiens
cuuggacccuaaugacuuu

SEQ ID NO: 1143045 - RNA, 19 nt, Homo sapiens
agaagaauaccuguucauu

SEQ ID NO: 1143046 - RNA, 19 nt, Homo sapiens
gcagcuguucccagaguuu

SEQ ID NO: 1143047 - RNA, 19 nt, Homo sapiens
ccagaaaggcucucaagcu

SEQ ID NO: 1143048 - RNA, 19 nt, Homo sapiens
aggcggagauuguccuguu

SEQ ID NO: 1143049 - RNA, 19 nt, Homo sapiens
gcucagaggaguacuugca

SEQ ID NO: 1143050 - RNA, 19 nt, Homo sapiens
ccugaagagugucccuuau

SEQ ID NO: 1143051 - RNA, 19 nt, Homo sapiens
gaugcucacggaagaauuc

SEQ ID NO: 1143052 - RNA, 19 nt, Homo sapiens
cugagaaggugucccagau

SEQ ID NO: 1143053 - RNA, 19 nt, Homo sapiens
aagaagaaccugccuuugg

SEQ ID NO: 1143054 - RNA, 19 nt, Homo sapiens
guucccugcuccacucuga

SEQ ID NO: 1143055 - RNA, 19 nt, Homo sapiens
gcagaucaaccuccaugag

SEQ ID NO: 1143056 - RNA, 19 nt, Homo sapiens
ugucaucaguuacgacuac

SEQ ID NO: 1143057 - RNA, 19 nt, Homo sapiens
uggaugaagccaagaagaa

SEQ ID NO: 1143058 - RNA, 19 nt, Homo sapiens
gcucaggcauuuugacuuc

SEQ ID NO: 1143059 - RNA, 19 nt, Homo sapiens
caagaagaaccugccuuug

SEQ ID NO: 1143060 - RNA, 19 nt, Homo sapiens
guucccagaguuugaguuu

SEQ ID NO: 1143061 - RNA, 19 nt, Homo sapiens
acuugcagcugagaucuaa

SEQ ID NO: 1143062 - RNA, 19 nt, Homo sapiens
gcuccuuucucaacauguc

SEQ ID NO: 1143063 - RNA, 19 nt, Homo sapiens
gaagagagugaaggaguac

SEQ ID NO: 1143064 - RNA, 19 nt, Homo sapiens
cgggaaaggcggagauugu

SEQ ID NO: 1143065 - RNA, 19 nt, Homo sapiens
caccugggcaagauguaua

SEQ ID NO: 1143066 - RNA, 19 nt, Homo sapiens
aagcagcuguucccagagu

SEQ ID NO: 1143067 - RNA, 19 nt, Homo sapiens
ugauggaggugcucguucu

SEQ ID NO: 1143068 - RNA, 19 nt, Homo sapiens
gaagguccagcacccaaag

SEQ ID NO: 1143069 - RNA, 19 nt, Homo sapiens
ucagcgaggccuucaacuu

SEQ ID NO: 1143070 - RNA, 19 nt, Homo sapiens
gcugagcacaagaagaaga

SEQ ID NO: 1143071 - RNA, 19 nt, Homo sapiens
cagcuccuuucucaacaug

SEQ ID NO: 1143072 - RNA, 19 nt, Homo sapiens
ggcggagauuguccuguug

SEQ ID NO: 1143073 - RNA, 19 nt, Homo sapiens
uacgacggcugucaucagu

SEQ ID NO: 1143074 - RNA, 19 nt, Homo sapiens
guacuuggacccuaaugac

SEQ ID NO: 1143075 - RNA, 19 nt, Homo sapiens
acuuagagauucgcaacaa

SEQ ID NO: 1143076 - RNA, 19 nt, Homo sapiens
cacugccacugaggacuua

SEQ ID NO: 1143077 - RNA, 19 nt, Homo sapiens
uuccagagcuucgaugaca

SEQ ID NO: 1143078 - RNA, 19 nt, Homo sapiens
ccaugggcuuuaccagaug

SEQ ID NO: 1143079 - RNA, 19 nt, Homo sapiens
gauguauagugagaugauc

SEQ ID NO: 1143080 - RNA, 19 nt, Homo sapiens
acugaggacuuagagauuc

SEQ ID NO: 1143081 - RNA, 19 nt, Homo sapiens
accaugggcuuuaccagau

SEQ ID NO: 1143082 - RNA, 19 nt, Homo sapiens
ucagccaucuccucaacca

SEQ ID NO: 1143083 - RNA, 19 nt, Homo sapiens
cuaagauccaugauuuguu

SEQ ID NO: 1143084 - RNA, 19 nt, Homo sapiens
gcacgggaaaggcggagau

SEQ ID NO: 1143085 - RNA, 19 nt, Homo sapiens
ccuaauaugcuggcuguuc

SEQ ID NO: 1143086 - RNA, 19 nt, Homo sapiens
gaucgugggacucggucaa

SEQ ID NO: 1143087 - RNA, 19 nt, Homo sapiens
ccaaaggugcgggcucaga

SEQ ID NO: 1143088 - RNA, 19 nt, Homo sapiens
ggaugaagccaagaagaac

SEQ ID NO: 1143089 - RNA, 19 nt, Homo sapiens
agcgaggccuucaacuuau

SEQ ID NO: 1143090 - RNA, 19 nt, Homo sapiens
ucuaagauccaugauuugu

SEQ ID NO: 1143091 - RNA, 19 nt, Homo sapiens
agaaggacccagaucucuu

SEQ ID NO: 1143092 - RNA, 19 nt, Homo sapiens
gccagcuccuuucucaaca

SEQ ID NO: 1143093 - RNA, 19 nt, Homo sapiens
accagaugcucacggaaga

SEQ ID NO: 1143094 - RNA, 19 nt, Homo sapiens
caaugacagagacuacaug

SEQ ID NO: 1143095 - RNA, 19 nt, Homo sapiens
ucacugccacugaggacuu

SEQ ID NO: 1143096 - RNA, 19 nt, Homo sapiens
gggaaaggcggagauuguc

SEQ ID NO: 1143097 - RNA, 19 nt, Homo sapiens
acaagaucgacgucaauga

SEQ ID NO: 1143098 - RNA, 19 nt, Homo sapiens
ggaaaugccuccauaaaua

SEQ ID NO: 1143099 - RNA, 19 nt, Homo sapiens
gaagaagaauuaagaguga

SEQ ID NO: 1143100 - RNA, 19 nt, Homo sapiens
ggauaaaguugucugauuu

SEQ ID NO: 1143101 - RNA, 19 nt, Homo sapiens
gaaauacacuguggugaaa

SEQ ID NO: 1143102 - RNA, 19 nt, Homo sapiens
caaacuccguuaugauaua

SEQ ID NO: 1143103 - RNA, 19 nt, Homo sapiens
gagcacggcuuuaauaagu

SEQ ID NO: 1143104 - RNA, 19 nt, Homo sapiens
ggaaacaaguugcagugaa

SEQ ID NO: 1143105 - RNA, 19 nt, Homo sapiens
ccuaacaagugucuuauuu

SEQ ID NO: 1143106 - RNA, 19 nt, Homo sapiens
gacaagcgauggccggaua

SEQ ID NO: 1143107 - RNA, 19 nt, Homo sapiens
ccucggacauccauucuua

SEQ ID NO: 1143108 - RNA, 19 nt, Homo sapiens
gaaacaaguugcagugaag

SEQ ID NO: 1143109 - RNA, 19 nt, Homo sapiens
gcucuaagcauaauuaaga

SEQ ID NO: 1143110 - RNA, 19 nt, Homo sapiens
gaacgccucuaguagcaaa

SEQ ID NO: 1143111 - RNA, 19 nt, Homo sapiens
ggaugaauuugcauguuaa

SEQ ID NO: 1143112 - RNA, 19 nt, Homo sapiens
gaugaggacaugagaauaa

SEQ ID NO: 1143113 - RNA, 19 nt, Homo sapiens
gaaaugccuccauaaauau

SEQ ID NO: 1143114 - RNA, 19 nt, Homo sapiens
ugacagacauugugacuca

SEQ ID NO: 1143115 - RNA, 19 nt, Homo sapiens
ccaggacuauguagaagua

SEQ ID NO: 1143116 - RNA, 19 nt, Homo sapiens
caaacuaccucaaagucaa

SEQ ID NO: 1143117 - RNA, 19 nt, Homo sapiens
caucaaagcuguauuucca

SEQ ID NO: 1143118 - RNA, 19 nt, Homo sapiens
gaauuugcauguuaacugu

SEQ ID NO: 1143119 - RNA, 19 nt, Homo sapiens
ccaaagaggugccgaagag

SEQ ID NO: 1143120 - RNA, 19 nt, Homo sapiens
ggaaauacacuguggugaa

SEQ ID NO: 1143121 - RNA, 19 nt, Homo sapiens
gaacagggcaagacguuug

SEQ ID NO: 1143122 - RNA, 19 nt, Homo sapiens
gagcaucaaagcuguauuu

SEQ ID NO: 1143123 - RNA, 19 nt, Homo sapiens
uggaugaauuugcauguua

SEQ ID NO: 1143124 - RNA, 19 nt, Homo sapiens
aaacaaacccugcaaggaa

SEQ ID NO: 1143125 - RNA, 19 nt, Homo sapiens
uaacaagugucuuauuugg

SEQ ID NO: 1143126 - RNA, 19 nt, Homo sapiens
acaccaaacucuugucuau

SEQ ID NO: 1143127 - RNA, 19 nt, Homo sapiens
ccacagccaucauauaaag

SEQ ID NO: 1143128 - RNA, 19 nt, Homo sapiens
ucaaauggguacaauguuc

SEQ ID NO: 1143129 - RNA, 19 nt, Homo sapiens
uggaagagcuacauaguca

SEQ ID NO: 1143130 - RNA, 19 nt, Homo sapiens
cagaaggacucaguacaaa

SEQ ID NO: 1143131 - RNA, 19 nt, Homo sapiens
gggaauacuuggccaacuu

SEQ ID NO: 1143132 - RNA, 19 nt, Homo sapiens
guacuuugaugucauguag

SEQ ID NO: 1143133 - RNA, 19 nt, Homo sapiens
cggauaaaguugucugauu

SEQ ID NO: 1143134 - RNA, 19 nt, Homo sapiens
ggcaucuucuugugucuua

SEQ ID NO: 1143135 - RNA, 19 nt, Homo sapiens
caugagacagauuguauua

SEQ ID NO: 1143136 - RNA, 19 nt, Homo sapiens
gauuaucacucacauuugg

SEQ ID NO: 1143137 - RNA, 19 nt, Homo sapiens
gaaacaaacccugcaagga

SEQ ID NO: 1143138 - RNA, 19 nt, Homo sapiens
gaaaugcuuccaccucuug

SEQ ID NO: 1143139 - RNA, 19 nt, Homo sapiens
gaaaauggcaguccuaaau

SEQ ID NO: 1143140 - RNA, 19 nt, Homo sapiens
caagacguuugguuucauu

SEQ ID NO: 1143141 - RNA, 19 nt, Homo sapiens
gaacuuugaauacugaaug

SEQ ID NO: 1143142 - RNA, 19 nt, Homo sapiens
gaagaggaaaucauugguu

SEQ ID NO: 1143143 - RNA, 19 nt, Homo sapiens
gagaacugcuuuucaauga

SEQ ID NO: 1143144 - RNA, 19 nt, Homo sapiens
gaaccgaugaugccauuug

SEQ ID NO: 1143145 - RNA, 19 nt, Homo sapiens
gaauagaaauagccacacu

SEQ ID NO: 1143146 - RNA, 19 nt, Homo sapiens
uacaaacuccguuaugaua

SEQ ID NO: 1143147 - RNA, 19 nt, Homo sapiens
gcaaggaaaccuccaucaa

SEQ ID NO: 1143148 - RNA, 19 nt, Homo sapiens
ccacaagagcagaaguuua

SEQ ID NO: 1143149 - RNA, 19 nt, Homo sapiens
gugcuaggaucauuggauu

SEQ ID NO: 1143150 - RNA, 19 nt, Homo sapiens
gcacggcuuuaauaaguca

SEQ ID NO: 1143151 - RNA, 19 nt, Homo sapiens
gagcagaggauucguguag

SEQ ID NO: 1143152 - RNA, 19 nt, Homo sapiens
ucaaucaccgucagcuuua

SEQ ID NO: 1143153 - RNA, 19 nt, Homo sapiens
gauauauccuagccacaug

SEQ ID NO: 1143154 - RNA, 19 nt, Homo sapiens
ggucauggaguuucuagaa

SEQ ID NO: 1143155 - RNA, 19 nt, Homo sapiens
accaaacucuugucuauau

SEQ ID NO: 1143156 - RNA, 19 nt, Homo sapiens
ggauucaguucccaaaaua

SEQ ID NO: 1143157 - RNA, 19 nt, Homo sapiens
gugcucaaguuuccaaaga

SEQ ID NO: 1143158 - RNA, 19 nt, Homo sapiens
caaagcaaaucgggcuauu

SEQ ID NO: 1143159 - RNA, 19 nt, Homo sapiens
gacucuagaggaugaauua

SEQ ID NO: 1143160 - RNA, 19 nt, Homo sapiens
ucagugcccuuucucaaau

SEQ ID NO: 1143161 - RNA, 19 nt, Homo sapiens
acaggcaucucuccacuga

SEQ ID NO: 1143162 - RNA, 19 nt, Homo sapiens
ggaauacuuggccaacuuu

SEQ ID NO: 1143163 - RNA, 19 nt, Homo sapiens
gagcaaaccaagugaauac

SEQ ID NO: 1143164 - RNA, 19 nt, Homo sapiens
uaaccaggacuauguagaa

SEQ ID NO: 1143165 - RNA, 19 nt, Homo sapiens
uaucagagagccucgagua

SEQ ID NO: 1143166 - RNA, 19 nt, Homo sapiens
caaaccaagugaauacagu

SEQ ID NO: 1143167 - RNA, 19 nt, Homo sapiens
ccgauuaucacucacauuu

SEQ ID NO: 1143168 - RNA, 19 nt, Homo sapiens
gucuagaucuucuugaaug

SEQ ID NO: 1143169 - RNA, 19 nt, Homo sapiens
gguggaagaagaauuaaga

SEQ ID NO: 1143170 - RNA, 19 nt, Homo sapiens
gcagaggauucguguaggu

SEQ ID NO: 1143171 - RNA, 19 nt, Homo sapiens
gcucucuccuaccuucaua

SEQ ID NO: 1143172 - RNA, 19 nt, Homo sapiens
gagaacagggcaagacguu

SEQ ID NO: 1143173 - RNA, 19 nt, Homo sapiens
gaggauccgggacaguuua

SEQ ID NO: 1143174 - RNA, 19 nt, Homo sapiens
ggugucccaugaacaguuu

SEQ ID NO: 1143175 - RNA, 19 nt, Homo sapiens
ccaaacucuugucuauauu

SEQ ID NO: 1143176 - RNA, 19 nt, Homo sapiens
uaggaacuuugaauacuga

SEQ ID NO: 1143177 - RNA, 19 nt, Homo sapiens
cauuguaucaguugaagua

SEQ ID NO: 1143178 - RNA, 19 nt, Homo sapiens
gcaaaaggccugugcauuc

SEQ ID NO: 1143179 - RNA, 19 nt, Homo sapiens
ccucagcccuccacuguca

SEQ ID NO: 1143180 - RNA, 19 nt, Homo sapiens
ccucuggagucuuuaauuc

SEQ ID NO: 1143181 - RNA, 19 nt, Homo sapiens
gcgaaaaguugcagaauag

SEQ ID NO: 1143182 - RNA, 19 nt, Homo sapiens
gaagagcuacauagucauc

SEQ ID NO: 1143183 - RNA, 19 nt, Homo sapiens
aggguaacauguaggauuu

SEQ ID NO: 1143184 - RNA, 19 nt, Homo sapiens
aacaaacccugcaaggaaa

SEQ ID NO: 1143185 - RNA, 19 nt, Homo sapiens
aaacagaggcuuuucuuaa

SEQ ID NO: 1143186 - RNA, 19 nt, Homo sapiens
guauuaaucgcuauuguuc

SEQ ID NO: 1143187 - RNA, 19 nt, Homo sapiens
ggcaagacguuugguuuca

SEQ ID NO: 1143188 - RNA, 19 nt, Homo sapiens
ggugugcacguuucauuaa

SEQ ID NO: 1143189 - RNA, 19 nt, Homo sapiens
uauccuaacaagugucuua

SEQ ID NO: 1143190 - RNA, 19 nt, Homo sapiens
guacaaacuccguuaugau

SEQ ID NO: 1143191 - RNA, 19 nt, Homo sapiens
ggacuauguagaaguagaa

SEQ ID NO: 1143192 - RNA, 19 nt, Homo sapiens
uaaaaugaccuucuacuga

SEQ ID NO: 1143193 - RNA, 19 nt, Homo sapiens
guaggccaauauagauuug

SEQ ID NO: 1143194 - RNA, 19 nt, Homo sapiens
uagaucuucuugaauguug

SEQ ID NO: 1143195 - RNA, 19 nt, Homo sapiens
ugaauuagcaagaggguau

SEQ ID NO: 1143196 - RNA, 19 nt, Homo sapiens
gaaggacucaguacaaacu

SEQ ID NO: 1143197 - RNA, 19 nt, Homo sapiens
ggacauccauucuuaaaac

SEQ ID NO: 1143198 - RNA, 19 nt, Homo sapiens
gaaaugcgaugguucaaca

SEQ ID NO: 1143199 - RNA, 19 nt, Homo sapiens
gaaaugagggcagcuguua

SEQ ID NO: 1143200 - RNA, 19 nt, Homo sapiens
gguagaagcucucgucgaa

SEQ ID NO: 1143201 - RNA, 19 nt, Homo sapiens
gggcugcacuggagaauuu

SEQ ID NO: 1143202 - RNA, 19 nt, Homo sapiens
gauagcaucuuauguagug

SEQ ID NO: 1143203 - RNA, 19 nt, Homo sapiens
cuaaaggacuaguaaguaa

SEQ ID NO: 1143204 - RNA, 19 nt, Homo sapiens
gaagaccacuaacggcuuu

SEQ ID NO: 1143205 - RNA, 19 nt, Homo sapiens
gaagcugucucugcugaua

SEQ ID NO: 1143206 - RNA, 19 nt, Homo sapiens
gaaagaacagcaacauuug

SEQ ID NO: 1143207 - RNA, 19 nt, Homo sapiens
gagcuuguccuuuaaguaa

SEQ ID NO: 1143208 - RNA, 19 nt, Homo sapiens
gauaauucaucccuaaaga

SEQ ID NO: 1143209 - RNA, 19 nt, Homo sapiens
uaaagaagcagcagagaaa

SEQ ID NO: 1143210 - RNA, 19 nt, Homo sapiens
aaacaccaguugugacuuu

SEQ ID NO: 1143211 - RNA, 19 nt, Homo sapiens
gcagagaaaugcgaugguu

SEQ ID NO: 1143212 - RNA, 19 nt, Homo sapiens
agaaagaacagcaacauuu

SEQ ID NO: 1143213 - RNA, 19 nt, Homo sapiens
ccaaguagcugggauuaca

SEQ ID NO: 1143214 - RNA, 19 nt, Homo sapiens
ugacggaguuucccucuug

SEQ ID NO: 1143215 - RNA, 19 nt, Homo sapiens
agaauuuacugguaggaua

SEQ ID NO: 1143216 - RNA, 19 nt, Homo sapiens
gaaaauagaguccaaaugu

SEQ ID NO: 1143217 - RNA, 19 nt, Homo sapiens
gcuaaaggacuaguaagua

SEQ ID NO: 1143218 - RNA, 19 nt, Homo sapiens
gagggcagcuguuaauuuu

SEQ ID NO: 1143219 - RNA, 19 nt, Homo sapiens
gaauuuacugguaggauaa

SEQ ID NO: 1143220 - RNA, 19 nt, Homo sapiens
ccucagggcuuauguccaa

SEQ ID NO: 1143221 - RNA, 19 nt, Homo sapiens
cgaaccagauggaugaaga

SEQ ID NO: 1143222 - RNA, 19 nt, Homo sapiens
gguguaguuuccacuguaa

SEQ ID NO: 1143223 - RNA, 19 nt, Homo sapiens
aacaagcccuucuguggua

SEQ ID NO: 1143224 - RNA, 19 nt, Homo sapiens
guaaagaagcagcagagaa

SEQ ID NO: 1143225 - RNA, 19 nt, Homo sapiens
gauuauggcuuagaagaag

SEQ ID NO: 1143226 - RNA, 19 nt, Homo sapiens
gauagacuccuuccagaau

SEQ ID NO: 1143227 - RNA, 19 nt, Homo sapiens
guacuguuguauuguucua

SEQ ID NO: 1143228 - RNA, 19 nt, Homo sapiens
ccaaagugcugggauuaca

SEQ ID NO: 1143229 - RNA, 19 nt, Homo sapiens
gcuuguccuuuaaguaauu

SEQ ID NO: 1143230 - RNA, 19 nt, Homo sapiens
gggauuguguuguucuugu

SEQ ID NO: 1143231 - RNA, 19 nt, Homo sapiens
uagacuccuuccagaauaa

SEQ ID NO: 1143232 - RNA, 19 nt, Homo sapiens
ggacagccauccguuucug

SEQ ID NO: 1143233 - RNA, 19 nt, Homo sapiens
ugagggcagcuguuaauuu

SEQ ID NO: 1143234 - RNA, 19 nt, Homo sapiens
ggauuauggcuuagaagaa

SEQ ID NO: 1143235 - RNA, 19 nt, Homo sapiens
cauaauauuggaaggauug

SEQ ID NO: 1143236 - RNA, 19 nt, Homo sapiens
auagacuccuuccagaaua

SEQ ID NO: 1143237 - RNA, 19 nt, Homo sapiens
gguaacagcaagagacaga

SEQ ID NO: 1143238 - RNA, 19 nt, Homo sapiens
caaguacugcuggaucaua

SEQ ID NO: 1143239 - RNA, 19 nt, Homo sapiens
uaauucaucccuaaagaga

SEQ ID NO: 1143240 - RNA, 19 nt, Homo sapiens
uguguugguucccauguaa

SEQ ID NO: 1143241 - RNA, 19 nt, Homo sapiens
gggauuauggcuuagaaga

SEQ ID NO: 1143242 - RNA, 19 nt, Homo sapiens
uuacauauuugcacuuggu

SEQ ID NO: 1143243 - RNA, 19 nt, Homo sapiens
ccacuguaacuguugagua

SEQ ID NO: 1143244 - RNA, 19 nt, Homo sapiens
gauggaugaagaccacuaa

SEQ ID NO: 1143245 - RNA, 19 nt, Homo sapiens
auucaucccuaaagagauu

SEQ ID NO: 1143246 - RNA, 19 nt, Homo sapiens
cagaaagaacagcaacauu

SEQ ID NO: 1143247 - RNA, 19 nt, Homo sapiens
ggauuguguuguucuugug

SEQ ID NO: 1143248 - RNA, 19 nt, Homo sapiens
cccuugggauuauggcuua

SEQ ID NO: 1143249 - RNA, 19 nt, Homo sapiens
ggccguuccuguuggauuc

SEQ ID NO: 1143250 - RNA, 19 nt, Homo sapiens
cgucgaaccagauggauga

SEQ ID NO: 1143251 - RNA, 19 nt, Homo sapiens
gcacuugguacuguuguau

SEQ ID NO: 1143252 - RNA, 19 nt, Homo sapiens
gugguggccuuuaugaagu

SEQ ID NO: 1143253 - RNA, 19 nt, Homo sapiens
acuggagaauuuacuggua

SEQ ID NO: 1143254 - RNA, 19 nt, Homo sapiens
caagagacagagcgacaug

SEQ ID NO: 1143255 - RNA, 19 nt, Homo sapiens
ugccucagccucccaagua

SEQ ID NO: 1143256 - RNA, 19 nt, Homo sapiens
guauuguucuaaagagcuu

SEQ ID NO: 1143257 - RNA, 19 nt, Homo sapiens
ucccgcagcagccaauuua

SEQ ID NO: 1143258 - RNA, 19 nt, Homo sapiens
ggaaggauuggucaucucu

SEQ ID NO: 1143259 - RNA, 19 nt, Homo sapiens
ggugguggccuuuaugaag

SEQ ID NO: 1143260 - RNA, 19 nt, Homo sapiens
cacuguaacuguugaguac

SEQ ID NO: 1143261 - RNA, 19 nt, Homo sapiens
gagacagagcgacaugaga

SEQ ID NO: 1143262 - RNA, 19 nt, Homo sapiens
aaggauuggucaucucugu

SEQ ID NO: 1143263 - RNA, 19 nt, Homo sapiens
agagaaaugcgaugguuca

SEQ ID NO: 1143264 - RNA, 19 nt, Homo sapiens
guaacuuuguggccaagag

SEQ ID NO: 1143265 - RNA, 19 nt, Homo sapiens
gugcccagccuaagccauu

SEQ ID NO: 1143266 - RNA, 19 nt, Homo sapiens
cuucugugguauuugcuuu

SEQ ID NO: 1143267 - RNA, 19 nt, Homo sapiens
gucauaauauuggaaggau

SEQ ID NO: 1143268 - RNA, 19 nt, Homo sapiens
ggucauaauauuggaagga

SEQ ID NO: 1143269 - RNA, 19 nt, Homo sapiens
acuugguacuguuguauug

SEQ ID NO: 1143270 - RNA, 19 nt, Homo sapiens
ccauugggagcaacaguga

SEQ ID NO: 1143271 - RNA, 19 nt, Homo sapiens
ugauagacuccuuccagaa

SEQ ID NO: 1143272 - RNA, 19 nt, Homo sapiens
ccacuaacggcuuuuguuu

SEQ ID NO: 1143273 - RNA, 19 nt, Homo sapiens
caacucccagguucaagug

SEQ ID NO: 1143274 - RNA, 19 nt, Homo sapiens
agguguaguuuccacugua

SEQ ID NO: 1143275 - RNA, 19 nt, Homo sapiens
ggccaagaguauuuucaaa

SEQ ID NO: 1143276 - RNA, 19 nt, Homo sapiens
gcccuucugugguauuugc

SEQ ID NO: 1143277 - RNA, 19 nt, Homo sapiens
aaugagggcagcuguuaau

SEQ ID NO: 1143278 - RNA, 19 nt, Homo sapiens
aaaugagggcagcuguuaa

SEQ ID NO: 1143279 - RNA, 19 nt, Homo sapiens
cggaguuucccucuuguug

SEQ ID NO: 1143280 - RNA, 19 nt, Homo sapiens
gagaaaugcgaugguucaa

SEQ ID NO: 1143281 - RNA, 19 nt, Homo sapiens
uugcugguguucauuguca

SEQ ID NO: 1143282 - RNA, 19 nt, Homo sapiens
aaugcuaaaggacuaguaa

SEQ ID NO: 1143283 - RNA, 19 nt, Homo sapiens
gacggaguuucccucuugu

SEQ ID NO: 1143284 - RNA, 19 nt, Homo sapiens
guuguauuguucuaaagag

SEQ ID NO: 1143285 - RNA, 19 nt, Homo sapiens
uauuugcacuugguacugu

SEQ ID NO: 1143286 - RNA, 19 nt, Homo sapiens
gacagagcgacaugagaga

SEQ ID NO: 1143287 - RNA, 19 nt, Homo sapiens
ggaaaauagaguccaaaug

SEQ ID NO: 1143288 - RNA, 19 nt, Homo sapiens
ucagaaagaacagcaacau

SEQ ID NO: 1143289 - RNA, 19 nt, Homo sapiens
aagaagcagcagagaaaug

SEQ ID NO: 1143290 - RNA, 19 nt, Homo sapiens
auuuagggauuguguuguu

SEQ ID NO: 1143291 - RNA, 19 nt, Homo sapiens
uggucaggcuagucucaaa

SEQ ID NO: 1143292 - RNA, 19 nt, Homo sapiens
gagaauuuacugguaggau

SEQ ID NO: 1143293 - RNA, 19 nt, Homo sapiens
gcaagagacagagcgacau

SEQ ID NO: 1143294 - RNA, 19 nt, Homo sapiens
uugguacuguuguauuguu

SEQ ID NO: 1143295 - RNA, 19 nt, Homo sapiens
aagcccuucugugguauuu

SEQ ID NO: 1143296 - RNA, 19 nt, Homo sapiens
gguaugaggaugguagaag

SEQ ID NO: 1143297 - RNA, 19 nt, Homo sapiens
augauagcaucuuauguag

SEQ ID NO: 1143298 - RNA, 19 nt, Homo sapiens
gaacauugguggaaaguuu

SEQ ID NO: 1143299 - RNA, 19 nt, Homo sapiens
gauaauaacuggugacaau

SEQ ID NO: 1143300 - RNA, 19 nt, Homo sapiens
gauaugaucccagaaauua

SEQ ID NO: 1143301 - RNA, 19 nt, Homo sapiens
gaagagccuuugugcauuu

SEQ ID NO: 1143302 - RNA, 19 nt, Homo sapiens
gagcugaacugggaagaua

SEQ ID NO: 1143303 - RNA, 19 nt, Homo sapiens
uuaaagagcuauacacuga

SEQ ID NO: 1143304 - RNA, 19 nt, Homo sapiens
ccacaauccuguucucuaa

SEQ ID NO: 1143305 - RNA, 19 nt, Homo sapiens
gacaauagaugugaguuaa

SEQ ID NO: 1143306 - RNA, 19 nt, Homo sapiens
caacagaccuugcacucaa

SEQ ID NO: 1143307 - RNA, 19 nt, Homo sapiens
gcucuuaucuuccuucaug

SEQ ID NO: 1143308 - RNA, 19 nt, Homo sapiens
ggaaguggcuuuggaaaca

SEQ ID NO: 1143309 - RNA, 19 nt, Homo sapiens
gcauucaucuugucacuga

SEQ ID NO: 1143310 - RNA, 19 nt, Homo sapiens
gaaccaagaucuucaaacg

SEQ ID NO: 1143311 - RNA, 19 nt, Homo sapiens
gaggagaggucgaauuuac

SEQ ID NO: 1143312 - RNA, 19 nt, Homo sapiens
ucuagaaggugauccauuu

SEQ ID NO: 1143313 - RNA, 19 nt, Homo sapiens
ggaagagccuuugugcauu

SEQ ID NO: 1143314 - RNA, 19 nt, Homo sapiens
gcacucaacuuugcugaau

SEQ ID NO: 1143315 - RNA, 19 nt, Homo sapiens
uaauaaagcugccaagcau

SEQ ID NO: 1143316 - RNA, 19 nt, Homo sapiens
ccucuggacuugcuguuua

SEQ ID NO: 1143317 - RNA, 19 nt, Homo sapiens
gcaccuuacuaucucauga

SEQ ID NO: 1143318 - RNA, 19 nt, Homo sapiens
ggacaccuaacacacaaua

SEQ ID NO: 1143319 - RNA, 19 nt, Homo sapiens
uaaacggacucucagaugu

SEQ ID NO: 1143320 - RNA, 19 nt, Homo sapiens
gagcccagcagcuuagaua

SEQ ID NO: 1143321 - RNA, 19 nt, Homo sapiens
gaacgaaccaagaucuuca

SEQ ID NO: 1143322 - RNA, 19 nt, Homo sapiens
gauguucucuccagcuuuc

SEQ ID NO: 1143323 - RNA, 19 nt, Homo sapiens
gaagacaagguuaauaaag

SEQ ID NO: 1143324 - RNA, 19 nt, Homo sapiens
gaggacaccuaacacacaa

SEQ ID NO: 1143325 - RNA, 19 nt, Homo sapiens
gaucagagaacagugcuuu

SEQ ID NO: 1143326 - RNA, 19 nt, Homo sapiens
uagagaaccuugugaugau

SEQ ID NO: 1143327 - RNA, 19 nt, Homo sapiens
uaagagacccagcaucuau

SEQ ID NO: 1143328 - RNA, 19 nt, Homo sapiens
gaaccaccauuuaccuuac

SEQ ID NO: 1143329 - RNA, 19 nt, Homo sapiens
gagaacagugcuuuaaaga

SEQ ID NO: 1143330 - RNA, 19 nt, Homo sapiens
ggauggugcugcugucuca

SEQ ID NO: 1143331 - RNA, 19 nt, Homo sapiens
gaacugaggacagaaaugg

SEQ ID NO: 1143332 - RNA, 19 nt, Homo sapiens
auacugaccuuucucuaga

SEQ ID NO: 1143333 - RNA, 19 nt, Homo sapiens
gaagcuaggaggaauggaa

SEQ ID NO: 1143334 - RNA, 19 nt, Homo sapiens
aaaguuugcucacaaucuu

SEQ ID NO: 1143335 - RNA, 19 nt, Homo sapiens
uagacuaucugaguaaaug

SEQ ID NO: 1143336 - RNA, 19 nt, Homo sapiens
acugcaagauggcaaauuu

SEQ ID NO: 1143337 - RNA, 19 nt, Homo sapiens
ugacaauagaugugaguua

SEQ ID NO: 1143338 - RNA, 19 nt, Homo sapiens
cauaagggaugggaucaga

SEQ ID NO: 1143339 - RNA, 19 nt, Homo sapiens
guggaaaguuugcucacaa

SEQ ID NO: 1143340 - RNA, 19 nt, Homo sapiens
ggaagcggauggcauucau

SEQ ID NO: 1143341 - RNA, 19 nt, Homo sapiens
caauagaugugaguuaaac

SEQ ID NO: 1143342 - RNA, 19 nt, Homo sapiens
gaacugggaagauaauaac

SEQ ID NO: 1143343 - RNA, 19 nt, Homo sapiens
ucagaggaauugauagcuu

SEQ ID NO: 1143344 - RNA, 19 nt, Homo sapiens
gaaaguuugcucacaaucu

SEQ ID NO: 1143345 - RNA, 19 nt, Homo sapiens
aaagagcuauacacugaga

SEQ ID NO: 1143346 - RNA, 19 nt, Homo sapiens
gaugaugucuccccaguga

SEQ ID NO: 1143347 - RNA, 19 nt, Homo sapiens
ucagagaacagugcuuuaa

SEQ ID NO: 1143348 - RNA, 19 nt, Homo sapiens
caucagaacuugguuuagg

SEQ ID NO: 1143349 - RNA, 19 nt, Homo sapiens
ggucugugcugggaucuau

SEQ ID NO: 1143350 - RNA, 19 nt, Homo sapiens
gaaaaugaagacaagguua

SEQ ID NO: 1143351 - RNA, 19 nt, Homo sapiens
caguuagacuaucugagua

SEQ ID NO: 1143352 - RNA, 19 nt, Homo sapiens
ggauugguuugcugauaug

SEQ ID NO: 1143353 - RNA, 19 nt, Homo sapiens
aagauuagccuuguacaaa

SEQ ID NO: 1143354 - RNA, 19 nt, Homo sapiens
aaacggacucucagaugua

SEQ ID NO: 1143355 - RNA, 19 nt, Homo sapiens
ugacagaggacaccuaaca

SEQ ID NO: 1143356 - RNA, 19 nt, Homo sapiens
gcugauaugaucccagaaa

SEQ ID NO: 1143357 - RNA, 19 nt, Homo sapiens
ggagguggaaucacugcua

SEQ ID NO: 1143358 - RNA, 19 nt, Homo sapiens
agagaacagugcuuuaaag

SEQ ID NO: 1143359 - RNA, 19 nt, Homo sapiens
caucuguguuugugaguga

SEQ ID NO: 1143360 - RNA, 19 nt, Homo sapiens
acaauccuguucucuaaau

SEQ ID NO: 1143361 - RNA, 19 nt, Homo sapiens
cccagcagcuuagauacua

SEQ ID NO: 1143362 - RNA, 19 nt, Homo sapiens
cuagagaaccuugugauga

SEQ ID NO: 1143363 - RNA, 19 nt, Homo sapiens
caguggcuguuaagaguuu

SEQ ID NO: 1143364 - RNA, 19 nt, Homo sapiens
gaagagugaagaggagaaa

SEQ ID NO: 1143365 - RNA, 19 nt, Homo sapiens
cuuacuaucucaugacuuc

SEQ ID NO: 1143366 - RNA, 19 nt, Homo sapiens
cugaguaaaugguucuuug

SEQ ID NO: 1143367 - RNA, 19 nt, Homo sapiens
gcugaaggcugggaagaag

SEQ ID NO: 1143368 - RNA, 19 nt, Homo sapiens
gaaguugugaauuucuuga

SEQ ID NO: 1143369 - RNA, 19 nt, Homo sapiens
ugaggaguauucagucaau

SEQ ID NO: 1143370 - RNA, 19 nt, Homo sapiens
acauauugcuggcucuuau

SEQ ID NO: 1143371 - RNA, 19 nt, Homo sapiens
ggaggagaacgaaccaaga

SEQ ID NO: 1143372 - RNA, 19 nt, Homo sapiens
gcucacaaucuuaaaugaa

SEQ ID NO: 1143373 - RNA, 19 nt, Homo sapiens
ggaugacgcagaccaaauc

SEQ ID NO: 1143374 - RNA, 19 nt, Homo sapiens
cagagaacagugcuuuaaa

SEQ ID NO: 1143375 - RNA, 19 nt, Homo sapiens
gaggagaacgaaccaagau

SEQ ID NO: 1143376 - RNA, 19 nt, Homo sapiens
aggagcagcugaagaaagu

SEQ ID NO: 1143377 - RNA, 19 nt, Homo sapiens
gaaguaggagacugacugu

SEQ ID NO: 1143378 - RNA, 19 nt, Homo sapiens
uggauugguuugcugauau

SEQ ID NO: 1143379 - RNA, 19 nt, Homo sapiens
agaaccaccauuuaccuua

SEQ ID NO: 1143380 - RNA, 19 nt, Homo sapiens
ggagaacgaaccaagaucu

SEQ ID NO: 1143381 - RNA, 19 nt, Homo sapiens
guuuaacauugaagaguga

SEQ ID NO: 1143382 - RNA, 19 nt, Homo sapiens
gaaguggcuuuggaaacau

SEQ ID NO: 1143383 - RNA, 19 nt, Homo sapiens
auaaagcugccaagcauuu

SEQ ID NO: 1143384 - RNA, 19 nt, Homo sapiens
gaggucgaauuuacugcuu

SEQ ID NO: 1143385 - RNA, 19 nt, Homo sapiens
ugaacugggaagauaauaa

SEQ ID NO: 1143386 - RNA, 19 nt, Homo sapiens
cagcggagcagaagccuau

SEQ ID NO: 1143387 - RNA, 19 nt, Homo sapiens
gcucugcaccuuacuaucu

SEQ ID NO: 1143388 - RNA, 19 nt, Homo sapiens
uaggaggaauggaaacugu

SEQ ID NO: 1143389 - RNA, 19 nt, Homo sapiens
ggagaggucgaauuuacug

SEQ ID NO: 1143390 - RNA, 19 nt, Homo sapiens
cugaggagaggucgaauuu

SEQ ID NO: 1143391 - RNA, 19 nt, Homo sapiens
gacugugagugcuggcuaa

SEQ ID NO: 1143392 - RNA, 19 nt, Homo sapiens
aaaagaagccaguaaaaga

SEQ ID NO: 1143393 - RNA, 19 nt, Homo sapiens
guuagacuaucugaguaaa

SEQ ID NO: 1143394 - RNA, 19 nt, Homo sapiens
cagaucugcuuggcuuuga

SEQ ID NO: 1143395 - RNA, 19 nt, Homo sapiens
aguacugccucacugcaua

SEQ ID NO: 1143396 - RNA, 19 nt, Homo sapiens
aauaacuggugacaauaga

SEQ ID NO: 1143397 - RNA, 19 nt, Homo sapiens
uaccugaacugaggacaga

SEQ ID NO: 1143398 - RNA, 19 nt, Homo sapiens
gcaaaacacuucuugauua

SEQ ID NO: 1143399 - RNA, 19 nt, Homo sapiens
ucaguuggcucauucuuua

SEQ ID NO: 1143400 - RNA, 19 nt, Homo sapiens
ggacacagaccuaauuaaa

SEQ ID NO: 1143401 - RNA, 19 nt, Homo sapiens
uaaagccugucauuacuua

SEQ ID NO: 1143402 - RNA, 19 nt, Homo sapiens
gaauaaaccucaagaaacg

SEQ ID NO: 1143403 - RNA, 19 nt, Homo sapiens
gaagacaccaucaaagaaa

SEQ ID NO: 1143404 - RNA, 19 nt, Homo sapiens
gaauguaaaugggagauga

SEQ ID NO: 1143405 - RNA, 19 nt, Homo sapiens
acacagaccuaauuaaaca

SEQ ID NO: 1143406 - RNA, 19 nt, Homo sapiens
gugcucaggugaaguagua

SEQ ID NO: 1143407 - RNA, 19 nt, Homo sapiens
gcacuuauaggaucugaaa

SEQ ID NO: 1143408 - RNA, 19 nt, Homo sapiens
gaaauuggacugcauuaca

SEQ ID NO: 1143409 - RNA, 19 nt, Homo sapiens
gacaagaccucagagauca

SEQ ID NO: 1143410 - RNA, 19 nt, Homo sapiens
gaugaaguuuccuaaucua

SEQ ID NO: 1143411 - RNA, 19 nt, Homo sapiens
aaacuuagauaucccuaga

SEQ ID NO: 1143412 - RNA, 19 nt, Homo sapiens
ggaagacaccaucaaagaa

SEQ ID NO: 1143413 - RNA, 19 nt, Homo sapiens
ucagugucauuucuucuua

SEQ ID NO: 1143414 - RNA, 19 nt, Homo sapiens
uuagauaucccuagaguuu

SEQ ID NO: 1143415 - RNA, 19 nt, Homo sapiens
guacaucagugucauuucu

SEQ ID NO: 1143416 - RNA, 19 nt, Homo sapiens
aaacagaaaugggacaaau

SEQ ID NO: 1143417 - RNA, 19 nt, Homo sapiens
gagaaacugaggaaacuuu

SEQ ID NO: 1143418 - RNA, 19 nt, Homo sapiens
gaaguaguauuugaagcuu

SEQ ID NO: 1143419 - RNA, 19 nt, Homo sapiens
guaccacucucagaauauu

SEQ ID NO: 1143420 - RNA, 19 nt, Homo sapiens
gcagucaccuuuggaaaca

SEQ ID NO: 1143421 - RNA, 19 nt, Homo sapiens
ccaacuaguuauugaaugu

SEQ ID NO: 1143422 - RNA, 19 nt, Homo sapiens
ggaaauggcaggcgacauc

SEQ ID NO: 1143423 - RNA, 19 nt, Homo sapiens
gaaguuuccuaaucuagag

SEQ ID NO: 1143424 - RNA, 19 nt, Homo sapiens
gcuaaguccuggcucaaau

SEQ ID NO: 1143425 - RNA, 19 nt, Homo sapiens
ggacugcauuacaagauuc

SEQ ID NO: 1143426 - RNA, 19 nt, Homo sapiens
aaauuggacugcauuacaa

SEQ ID NO: 1143427 - RNA, 19 nt, Homo sapiens
ugagauuucugccuuaaca

SEQ ID NO: 1143428 - RNA, 19 nt, Homo sapiens
gagaguacccagagaagga

SEQ ID NO: 1143429 - RNA, 19 nt, Homo sapiens
caggugaaguaguauuuga

SEQ ID NO: 1143430 - RNA, 19 nt, Homo sapiens
ggaagaggccccuuaauau

SEQ ID NO: 1143431 - RNA, 19 nt, Homo sapiens
ggaaagcggaaggauguaa

SEQ ID NO: 1143432 - RNA, 19 nt, Homo sapiens
gauguaaacuuagauaucc

SEQ ID NO: 1143433 - RNA, 19 nt, Homo sapiens
ggacuucgaagccaagaga

SEQ ID NO: 1143434 - RNA, 19 nt, Homo sapiens
caauucaucugccuccaau

SEQ ID NO: 1143435 - RNA, 19 nt, Homo sapiens
gcaaaggagacgacacaga

SEQ ID NO: 1143436 - RNA, 19 nt, Homo sapiens
gcacagccaggauugaaau

SEQ ID NO: 1143437 - RNA, 19 nt, Homo sapiens
gaaaugggacaaauagacu

SEQ ID NO: 1143438 - RNA, 19 nt, Homo sapiens
caaaugaugagccaacuag

SEQ ID NO: 1143439 - RNA, 19 nt, Homo sapiens
gcaaaugaugagccaacua

SEQ ID NO: 1143440 - RNA, 19 nt, Homo sapiens
uacuuaggaugcacuuaua

SEQ ID NO: 1143441 - RNA, 19 nt, Homo sapiens
cagcugaugcaaagaaauu

SEQ ID NO: 1143442 - RNA, 19 nt, Homo sapiens
cuuaaaaccuccacaauug

SEQ ID NO: 1143443 - RNA, 19 nt, Homo sapiens
ugagccaacuaguuauuga

SEQ ID NO: 1143444 - RNA, 19 nt, Homo sapiens
augaugagccaacuaguua

SEQ ID NO: 1143445 - RNA, 19 nt, Homo sapiens
gaugagaguacccagagaa

SEQ ID NO: 1143446 - RNA, 19 nt, Homo sapiens
gaaguuacuguggcuacua

SEQ ID NO: 1143447 - RNA, 19 nt, Homo sapiens
gaugagccaacuaguuauu

SEQ ID NO: 1143448 - RNA, 19 nt, Homo sapiens
ugaugaaguuuccuaaucu

SEQ ID NO: 1143449 - RNA, 19 nt, Homo sapiens
uaaagacaaagcacuauca

SEQ ID NO: 1143450 - RNA, 19 nt, Homo sapiens
ggacuugugcucaggugaa

SEQ ID NO: 1143451 - RNA, 19 nt, Homo sapiens
cccuuaauauccuggaaua

SEQ ID NO: 1143452 - RNA, 19 nt, Homo sapiens
uaugagauuucugccuuaa

SEQ ID NO: 1143453 - RNA, 19 nt, Homo sapiens
guaaaugggagaugagagu

SEQ ID NO: 1143454 - RNA, 19 nt, Homo sapiens
caagagaaacugaggaaac

SEQ ID NO: 1143455 - RNA, 19 nt, Homo sapiens
uggaagacaccaucaaaga

SEQ ID NO: 1143456 - RNA, 19 nt, Homo sapiens
caagaauaaaccucaagaa

SEQ ID NO: 1143457 - RNA, 19 nt, Homo sapiens
agacaaagcacuaucaaaa

SEQ ID NO: 1143458 - RNA, 19 nt, Homo sapiens
cuuaaccucugaagaagau

SEQ ID NO: 1143459 - RNA, 19 nt, Homo sapiens
gugagucauuuguacauca

SEQ ID NO: 1143460 - RNA, 19 nt, Homo sapiens
ggacaaauagacuugaaaa

SEQ ID NO: 1143461 - RNA, 19 nt, Homo sapiens
uuaugagauuucugccuua

SEQ ID NO: 1143462 - RNA, 19 nt, Homo sapiens
caaaacacuucuugauuag

SEQ ID NO: 1143463 - RNA, 19 nt, Homo sapiens
gaaugcacagccaggauug

SEQ ID NO: 1143464 - RNA, 19 nt, Homo sapiens
uaucuuaaagccugucauu

SEQ ID NO: 1143465 - RNA, 19 nt, Homo sapiens
gccagcugaugcaaagaaa

SEQ ID NO: 1143466 - RNA, 19 nt, Homo sapiens
agaauaaaccucaagaaac

SEQ ID NO: 1143467 - RNA, 19 nt, Homo sapiens
ucacugcagucaccuuugg

SEQ ID NO: 1143468 - RNA, 19 nt, Homo sapiens
ccugugauguaaacuuaga

SEQ ID NO: 1143469 - RNA, 19 nt, Homo sapiens
agacaagaccucagagauc

SEQ ID NO: 1143470 - RNA, 19 nt, Homo sapiens
cagugucauuucuucuuaa

SEQ ID NO: 1143471 - RNA, 19 nt, Homo sapiens
acagaaaugggacaaauag

SEQ ID NO: 1143472 - RNA, 19 nt, Homo sapiens
agaaggagaagccagcaaa

SEQ ID NO: 1143473 - RNA, 19 nt, Homo sapiens
caugccagcugaugcaaag

SEQ ID NO: 1143474 - RNA, 19 nt, Homo sapiens
gccaacuaguuauugaaug

SEQ ID NO: 1143475 - RNA, 19 nt, Homo sapiens
cagccaggauugaaauugg

SEQ ID NO: 1143476 - RNA, 19 nt, Homo sapiens
uuacuuaggaugcacuuau

SEQ ID NO: 1143477 - RNA, 19 nt, Homo sapiens
gauguaagagcuguucaug

SEQ ID NO: 1143478 - RNA, 19 nt, Homo sapiens
acacagacaagaccucaga

SEQ ID NO: 1143479 - RNA, 19 nt, Homo sapiens
cagcaaaggagacgacaca

SEQ ID NO: 1143480 - RNA, 19 nt, Homo sapiens
gaaauggcaggcgacauca

SEQ ID NO: 1143481 - RNA, 19 nt, Homo sapiens
gaagaggccccuuaauauc

SEQ ID NO: 1143482 - RNA, 19 nt, Homo sapiens
acucauacuacauucguua

SEQ ID NO: 1143483 - RNA, 19 nt, Homo sapiens
gaaagcggaaggauguaag

SEQ ID NO: 1143484 - RNA, 19 nt, Homo sapiens
aaggaaagcggaaggaugu

SEQ ID NO: 1143485 - RNA, 19 nt, Homo sapiens
caaaccaguauaucucaga

SEQ ID NO: 1143486 - RNA, 19 nt, Homo sapiens
aagagaaacugaggaaacu

SEQ ID NO: 1143487 - RNA, 19 nt, Homo sapiens
gccaagagaaacugaggaa

SEQ ID NO: 1143488 - RNA, 19 nt, Homo sapiens
uggacugcauuacaagauu

SEQ ID NO: 1143489 - RNA, 19 nt, Homo sapiens
gauugaaauuggacugcau

SEQ ID NO: 1143490 - RNA, 19 nt, Homo sapiens
caagaccucagagaucaaa

SEQ ID NO: 1143491 - RNA, 19 nt, Homo sapiens
cuuaaagccugucauuacu

SEQ ID NO: 1143492 - RNA, 19 nt, Homo sapiens
ugaaguuuccuaaucuaga

SEQ ID NO: 1143493 - RNA, 19 nt, Homo sapiens
uaaaugggagaugagagua

SEQ ID NO: 1143494 - RNA, 19 nt, Homo sapiens
augaugaaguuuccuaauc

SEQ ID NO: 1143495 - RNA, 19 nt, Homo sapiens
ugaaugcacagccaggauu

SEQ ID NO: 1143496 - RNA, 19 nt, Homo sapiens
uuacuguggcuacuauaaa

SEQ ID NO: 1143497 - RNA, 19 nt, Homo sapiens
guuacuguggcuacuauaa

SEQ ID NO: 1143498 - RNA, 19 nt, Homo sapiens
caaaggaaauguucauguu

SEQ ID NO: 1143499 - RNA, 19 nt, Homo sapiens
gcagauggaccuuuauuaa

SEQ ID NO: 1143500 - RNA, 19 nt, Homo sapiens
ugaaagaccuugugagugu

SEQ ID NO: 1143501 - RNA, 19 nt, Homo sapiens
ggccugaagucaauauuaa

SEQ ID NO: 1143502 - RNA, 19 nt, Homo sapiens
uguaauggcuuucggauug

SEQ ID NO: 1143503 - RNA, 19 nt, Homo sapiens
uuaagaauaucccagagua

SEQ ID NO: 1143504 - RNA, 19 nt, Homo sapiens
ccacucagcuacuaaaaua

SEQ ID NO: 1143505 - RNA, 19 nt, Homo sapiens
uaaagguucugaaaucuuc

SEQ ID NO: 1143506 - RNA, 19 nt, Homo sapiens
gaaagaccuugugagugua

SEQ ID NO: 1143507 - RNA, 19 nt, Homo sapiens
ggaccucuaugaagcuauu

SEQ ID NO: 1143508 - RNA, 19 nt, Homo sapiens
ccaaguguucuuauaguua

SEQ ID NO: 1143509 - RNA, 19 nt, Homo sapiens
gaaaagauccuuccacuca

SEQ ID NO: 1143510 - RNA, 19 nt, Homo sapiens
auccagagcucuucauuaa

SEQ ID NO: 1143511 - RNA, 19 nt, Homo sapiens
ccagagcucuucauuaaac

SEQ ID NO: 1143512 - RNA, 19 nt, Homo sapiens
gauaaggaauagauaaggu

SEQ ID NO: 1143513 - RNA, 19 nt, Homo sapiens
gaauaucccagaguaauug

SEQ ID NO: 1143514 - RNA, 19 nt, Homo sapiens
gcgcacaacaaccuuauuu

SEQ ID NO: 1143515 - RNA, 19 nt, Homo sapiens
uacccaugcuguuaaauuu

SEQ ID NO: 1143516 - RNA, 19 nt, Homo sapiens
gaccaaguguucuuauagu

SEQ ID NO: 1143517 - RNA, 19 nt, Homo sapiens
gcaaaggaaauguucaugu

SEQ ID NO: 1143518 - RNA, 19 nt, Homo sapiens
cagcugucgugaaaguuua

SEQ ID NO: 1143519 - RNA, 19 nt, Homo sapiens
gagugagcgucauaauauu

SEQ ID NO: 1143520 - RNA, 19 nt, Homo sapiens
agagugagcgucauaauau

SEQ ID NO: 1143521 - RNA, 19 nt, Homo sapiens
cagagugagcgucauaaua

SEQ ID NO: 1143522 - RNA, 19 nt, Homo sapiens
uuucuuuccuuaccucuua

SEQ ID NO: 1143523 - RNA, 19 nt, Homo sapiens
ugucacaaaugguucauau

SEQ ID NO: 1143524 - RNA, 19 nt, Homo sapiens
ccacagagugagcgucaua

SEQ ID NO: 1143525 - RNA, 19 nt, Homo sapiens
caaaugaaagaccuuguga

SEQ ID NO: 1143526 - RNA, 19 nt, Homo sapiens
caccugagccuccaacauu

SEQ ID NO: 1143527 - RNA, 19 nt, Homo sapiens
gcagcugucgugaaaguuu

SEQ ID NO: 1143528 - RNA, 19 nt, Homo sapiens
ucuagaacaugcuaaugaa

SEQ ID NO: 1143529 - RNA, 19 nt, Homo sapiens
uagugcagauggaccuuua

SEQ ID NO: 1143530 - RNA, 19 nt, Homo sapiens
guacccaugcuguuaaauu

SEQ ID NO: 1143531 - RNA, 19 nt, Homo sapiens
gccauuaucucauucuuuu

SEQ ID NO: 1143532 - RNA, 19 nt, Homo sapiens
uuacugagguaugaugauu

SEQ ID NO: 1143533 - RNA, 19 nt, Homo sapiens
uuucacagcugcagccauu

SEQ ID NO: 1143534 - RNA, 19 nt, Homo sapiens
ccaaaugggauuaguagug

SEQ ID NO: 1143535 - RNA, 19 nt, Homo sapiens
ggauuaguagugcugguua

SEQ ID NO: 1143536 - RNA, 19 nt, Homo sapiens
aaaccuaacaaaccuguaa

SEQ ID NO: 1143537 - RNA, 19 nt, Homo sapiens
uacaacuacucaauggaua

SEQ ID NO: 1143538 - RNA, 19 nt, Homo sapiens
gcacaacaaccuuauuucg

SEQ ID NO: 1143539 - RNA, 19 nt, Homo sapiens
cugcagccauuaucucauu

SEQ ID NO: 1143540 - RNA, 19 nt, Homo sapiens
acaaaccuguaauggcuuu

SEQ ID NO: 1143541 - RNA, 19 nt, Homo sapiens
gugcagcugucgugaaagu

SEQ ID NO: 1143542 - RNA, 19 nt, Homo sapiens
gaauccagagcucuucauu

SEQ ID NO: 1143543 - RNA, 19 nt, Homo sapiens
ucuggaagcaucagcauuu

SEQ ID NO: 1143544 - RNA, 19 nt, Homo sapiens
aaacuacaacuacucaaug

SEQ ID NO: 1143545 - RNA, 19 nt, Homo sapiens
uuuaaggccugaagucaau

SEQ ID NO: 1143546 - RNA, 19 nt, Homo sapiens
cggugcagcugucgugaaa

SEQ ID NO: 1143547 - RNA, 19 nt, Homo sapiens
uaagaauaucccagaguaa

SEQ ID NO: 1143548 - RNA, 19 nt, Homo sapiens
gcuguuaaauuugcaugau

SEQ ID NO: 1143549 - RNA, 19 nt, Homo sapiens
aaaguacccaugcuguuaa

SEQ ID NO: 1143550 - RNA, 19 nt, Homo sapiens
cuaaugaagagagaagaua

SEQ ID NO: 1143551 - RNA, 19 nt, Homo sapiens
uagaacaugcuaaugaaga

SEQ ID NO: 1143552 - RNA, 19 nt, Homo sapiens
guauccauguuucuuguuc

SEQ ID NO: 1143553 - RNA, 19 nt, Homo sapiens
uggcauauauugguuaucu

SEQ ID NO: 1143554 - RNA, 19 nt, Homo sapiens
ugguaacucuuucacuuug

SEQ ID NO: 1143555 - RNA, 19 nt, Homo sapiens
ugaguuggcucugacaagu

SEQ ID NO: 1143556 - RNA, 19 nt, Homo sapiens
uaugagauaugagaaacug

SEQ ID NO: 1143557 - RNA, 19 nt, Homo sapiens
ccauguuucuuguucuaga

SEQ ID NO: 1143558 - RNA, 19 nt, Homo sapiens
uaccgggaaucggccauua

SEQ ID NO: 1143559 - RNA, 19 nt, Homo sapiens
gaggugagaagccgaaugg

SEQ ID NO: 1143560 - RNA, 19 nt, Homo sapiens
gagaagauagcaguugcaa

SEQ ID NO: 1143561 - RNA, 19 nt, Homo sapiens
ucacuuugcguggcauaua

SEQ ID NO: 1143562 - RNA, 19 nt, Homo sapiens
agaauaucccagaguaauu

SEQ ID NO: 1143563 - RNA, 19 nt, Homo sapiens
gagcgcgcacuguguggua

SEQ ID NO: 1143564 - RNA, 19 nt, Homo sapiens
aauccagagcucuucauua

SEQ ID NO: 1143565 - RNA, 19 nt, Homo sapiens
gcauauauugguuaucuac

SEQ ID NO: 1143566 - RNA, 19 nt, Homo sapiens
ggcauauauugguuaucua

SEQ ID NO: 1143567 - RNA, 19 nt, Homo sapiens
caauggauaaggaauagau

SEQ ID NO: 1143568 - RNA, 19 nt, Homo sapiens
aaggaaauguucauguucu

SEQ ID NO: 1143569 - RNA, 19 nt, Homo sapiens
gaacaugcuaaugaagaga

SEQ ID NO: 1143570 - RNA, 19 nt, Homo sapiens
gaguuggcucugacaagua

SEQ ID NO: 1143571 - RNA, 19 nt, Homo sapiens
gagcucuucauuaaaccua

SEQ ID NO: 1143572 - RNA, 19 nt, Homo sapiens
caguauccauguuucuugu

SEQ ID NO: 1143573 - RNA, 19 nt, Homo sapiens
gauuaguagugcugguuag

SEQ ID NO: 1143574 - RNA, 19 nt, Homo sapiens
cuacaugcaauacaagaga

SEQ ID NO: 1143575 - RNA, 19 nt, Homo sapiens
uauagugucacaaaugguu

SEQ ID NO: 1143576 - RNA, 19 nt, Homo sapiens
gugcagauggaccuuuauu

SEQ ID NO: 1143577 - RNA, 19 nt, Homo sapiens
cuacaacuacucaauggau

SEQ ID NO: 1143578 - RNA, 19 nt, Homo sapiens
ucacagcugcagccauuau

SEQ ID NO: 1143579 - RNA, 19 nt, Homo sapiens
cauuaaaccuaacaaaccu

SEQ ID NO: 1143580 - RNA, 19 nt, Homo sapiens
cacuuugcguggcauauau

SEQ ID NO: 1143581 - RNA, 19 nt, Homo sapiens
gccagauaauaaaucauca

SEQ ID NO: 1143582 - RNA, 19 nt, Homo sapiens
aaaaguacccaugcuguua

SEQ ID NO: 1143583 - RNA, 19 nt, Homo sapiens
auugguaacucuuucacuu

SEQ ID NO: 1143584 - RNA, 19 nt, Homo sapiens
aaugaaagaccuugugagu

SEQ ID NO: 1143585 - RNA, 19 nt, Homo sapiens
uacaugcaauacaagagaa

SEQ ID NO: 1143586 - RNA, 19 nt, Homo sapiens
gaagccgaauggccuuggu

SEQ ID NO: 1143587 - RNA, 19 nt, Homo sapiens
acucaauggauaaggaaua

SEQ ID NO: 1143588 - RNA, 19 nt, Homo sapiens
acaacuacucaauggauaa

SEQ ID NO: 1143589 - RNA, 19 nt, Homo sapiens
ucaaaugaaagaccuugug

SEQ ID NO: 1143590 - RNA, 19 nt, Homo sapiens
aagaauaucccagaguaau

SEQ ID NO: 1143591 - RNA, 19 nt, Homo sapiens
guaauggcuuucggauugg

SEQ ID NO: 1143592 - RNA, 19 nt, Homo sapiens
uaaugaagagagaagauag

SEQ ID NO: 1143593 - RNA, 19 nt, Homo sapiens
agaacaugcuaaugaagag

SEQ ID NO: 1143594 - RNA, 19 nt, Homo sapiens
accaaguguucuuauaguu

SEQ ID NO: 1143595 - RNA, 19 nt, Homo sapiens
uuuauagugucacaaaugg

SEQ ID NO: 1143596 - RNA, 19 nt, Homo sapiens
aaaggaaauguucauguuc

SEQ ID NO: 1143597 - RNA, 19 nt, Homo sapiens
gcuaaugaagagagaagau

SEQ ID NO: 1143598 - RNA, 19 nt, Homo sapiens
gaaagcaaguucaacauau

SEQ ID NO: 1143599 - RNA, 19 nt, Homo sapiens
caaaggcgcuacucaucua

SEQ ID NO: 1143600 - RNA, 19 nt, Homo sapiens
ggaaagcaaguucaacaua

SEQ ID NO: 1143601 - RNA, 19 nt, Homo sapiens
gaauggagguugcacuguu

SEQ ID NO: 1143602 - RNA, 19 nt, Homo sapiens
aaacugaggaccacaauaa

SEQ ID NO: 1143603 - RNA, 19 nt, Homo sapiens
gcaacgauuauaagaguua

SEQ ID NO: 1143604 - RNA, 19 nt, Homo sapiens
uuucuuggcuuccuccuua

SEQ ID NO: 1143605 - RNA, 19 nt, Homo sapiens
gagaagaucagcagaaagu

SEQ ID NO: 1143606 - RNA, 19 nt, Homo sapiens
cagagaagaucagcagaaa

SEQ ID NO: 1143607 - RNA, 19 nt, Homo sapiens
uuucuucccuucccauuua

SEQ ID NO: 1143608 - RNA, 19 nt, Homo sapiens
gaacaacuggguagaaugg

SEQ ID NO: 1143609 - RNA, 19 nt, Homo sapiens
ggaccacaauaaagaaauc

SEQ ID NO: 1143610 - RNA, 19 nt, Homo sapiens
gugcaacgauuauaagagu

SEQ ID NO: 1143611 - RNA, 19 nt, Homo sapiens
ccacguagacugucaagau

SEQ ID NO: 1143612 - RNA, 19 nt, Homo sapiens
gcagcuuucuugcccuaaa

SEQ ID NO: 1143613 - RNA, 19 nt, Homo sapiens
gaccagagccccaggaaua

SEQ ID NO: 1143614 - RNA, 19 nt, Homo sapiens
ggaaaaccuuugccacgua

SEQ ID NO: 1143615 - RNA, 19 nt, Homo sapiens
uggauggguuugaggguua

SEQ ID NO: 1143616 - RNA, 19 nt, Homo sapiens
gcaaguucaacauaucaaa

SEQ ID NO: 1143617 - RNA, 19 nt, Homo sapiens
ggacuuggauggguuugag

SEQ ID NO: 1143618 - RNA, 19 nt, Homo sapiens
guuccugucuguuauuugu

SEQ ID NO: 1143619 - RNA, 19 nt, Homo sapiens
aaagcaaguucaacauauc

SEQ ID NO: 1143620 - RNA, 19 nt, Homo sapiens
gucaagaucugcugaaucc

SEQ ID NO: 1143621 - RNA, 19 nt, Homo sapiens
uggcugcccucuccagauu

SEQ ID NO: 1143622 - RNA, 19 nt, Homo sapiens
gacaaaggcgcuacucauc

SEQ ID NO: 1143623 - RNA, 19 nt, Homo sapiens
gcaagacccuaagaaccau

SEQ ID NO: 1143624 - RNA, 19 nt, Homo sapiens
gaagaucagcagaaagucu

SEQ ID NO: 1143625 - RNA, 19 nt, Homo sapiens
ggaugccgccugagaugaa

SEQ ID NO: 1143626 - RNA, 19 nt, Homo sapiens
gaugaacaacuggguagaa

SEQ ID NO: 1143627 - RNA, 19 nt, Homo sapiens
gcagugagugaguaaggaa

SEQ ID NO: 1143628 - RNA, 19 nt, Homo sapiens
gaggaccacaauaaagaaa

SEQ ID NO: 1143629 - RNA, 19 nt, Homo sapiens
aggcgcuacucaucuauuu

SEQ ID NO: 1143630 - RNA, 19 nt, Homo sapiens
ggugcaccguggagucauu

SEQ ID NO: 1143631 - RNA, 19 nt, Homo sapiens
ucagagaagaucagcagaa

SEQ ID NO: 1143632 - RNA, 19 nt, Homo sapiens
gaugccgccugagaugaaa

SEQ ID NO: 1143633 - RNA, 19 nt, Homo sapiens
uaaacugaggaccacaaua

SEQ ID NO: 1143634 - RNA, 19 nt, Homo sapiens
ugacaaaggcgcuacucau

SEQ ID NO: 1143635 - RNA, 19 nt, Homo sapiens
cacguagacugucaagauc

SEQ ID NO: 1143636 - RNA, 19 nt, Homo sapiens
ggaauaaaugguuuucuug

SEQ ID NO: 1143637 - RNA, 19 nt, Homo sapiens
caagacuccuguccucacu

SEQ ID NO: 1143638 - RNA, 19 nt, Homo sapiens
uauggccucuuccagauca

SEQ ID NO: 1143639 - RNA, 19 nt, Homo sapiens
ggaggacuuggauggguuu

SEQ ID NO: 1143640 - RNA, 19 nt, Homo sapiens
cugaggaccacaauaaaga

SEQ ID NO: 1143641 - RNA, 19 nt, Homo sapiens
gauucuucauuucuucuuc

SEQ ID NO: 1143642 - RNA, 19 nt, Homo sapiens
cagcuuucuugcccuaaau

SEQ ID NO: 1143643 - RNA, 19 nt, Homo sapiens
agacuccuguccucacuca

SEQ ID NO: 1143644 - RNA, 19 nt, Homo sapiens
guggaaagcaaguucaaca

SEQ ID NO: 1143645 - RNA, 19 nt, Homo sapiens
guaaacugaggaccacaau

SEQ ID NO: 1143646 - RNA, 19 nt, Homo sapiens
uccugucuguuauuuguaa

SEQ ID NO: 1143647 - RNA, 19 nt, Homo sapiens
gagcagugagugaguaagg

SEQ ID NO: 1143648 - RNA, 19 nt, Homo sapiens
acuauggccucuuccagau

SEQ ID NO: 1143649 - RNA, 19 nt, Homo sapiens
gcgcuacucaucuauuugg

SEQ ID NO: 1143650 - RNA, 19 nt, Homo sapiens
caaguucaacauaucaaag

SEQ ID NO: 1143651 - RNA, 19 nt, Homo sapiens
ugaggaccacaauaaagaa

SEQ ID NO: 1143652 - RNA, 19 nt, Homo sapiens
ccugguuccugucuguuau

SEQ ID NO: 1143653 - RNA, 19 nt, Homo sapiens
aauggagguugcacuguuc

SEQ ID NO: 1143654 - RNA, 19 nt, Homo sapiens
cguagacugucaagaucug

SEQ ID NO: 1143655 - RNA, 19 nt, Homo sapiens
gauuggaaacagccagguu

SEQ ID NO: 1143656 - RNA, 19 nt, Homo sapiens
cugccuccacuucauguua

SEQ ID NO: 1143657 - RNA, 19 nt, Homo sapiens
ugccuccacuucauguuau

SEQ ID NO: 1143658 - RNA, 19 nt, Homo sapiens
augaacaacuggguagaau

SEQ ID NO: 1143659 - RNA, 19 nt, Homo sapiens
cuacuggugcaacgauuau

SEQ ID NO: 1143660 - RNA, 19 nt, Homo sapiens
acaaaggcgcuacucaucu

SEQ ID NO: 1143661 - RNA, 19 nt, Homo sapiens
caacgauuauaagaguuac

SEQ ID NO: 1143662 - RNA, 19 nt, Homo sapiens
gugccuggcuuuuguggaa

SEQ ID NO: 1143663 - RNA, 19 nt, Homo sapiens
aaacauaacuaagccaaga

SEQ ID NO: 1143664 - RNA, 19 nt, Homo sapiens
gaggacacagccugcauga

SEQ ID NO: 1143665 - RNA, 19 nt, Homo sapiens
cugcaacucggaacucuga

SEQ ID NO: 1143666 - RNA, 19 nt, Homo sapiens
ugacgguggaggcagagua

SEQ ID NO: 1143667 - RNA, 19 nt, Homo sapiens
ugacacagcucucuuugua

SEQ ID NO: 1143668 - RNA, 19 nt, Homo sapiens
gcaaugagacgaccuauga

SEQ ID NO: 1143669 - RNA, 19 nt, Homo sapiens
gagaggagauggcuaauag

SEQ ID NO: 1143670 - RNA, 19 nt, Homo sapiens
gaaagccaauggaguccua

SEQ ID NO: 1143671 - RNA, 19 nt, Homo sapiens
ggaaagggagggagaguuu

SEQ ID NO: 1143672 - RNA, 19 nt, Homo sapiens
gauccuggcuuucuucuuc

SEQ ID NO: 1143673 - RNA, 19 nt, Homo sapiens
gaacgccacagaaguauga

SEQ ID NO: 1143674 - RNA, 19 nt, Homo sapiens
ccacacaccucacuugauc

SEQ ID NO: 1143675 - RNA, 19 nt, Homo sapiens
ggacgguguuugugucuga

SEQ ID NO: 1143676 - RNA, 19 nt, Homo sapiens
cgagaggccuuacuucaug

SEQ ID NO: 1143677 - RNA, 19 nt, Homo sapiens
gaucuucaaugccuucaug

SEQ ID NO: 1143678 - RNA, 19 nt, Homo sapiens
gcugaaagcugcagagaac

SEQ ID NO: 1143679 - RNA, 19 nt, Homo sapiens
gggcucaccugaaguccua

SEQ ID NO: 1143680 - RNA, 19 nt, Homo sapiens
gaacaagaccaacaagaag

SEQ ID NO: 1143681 - RNA, 19 nt, Homo sapiens
uggagaaguucaucaaauu

SEQ ID NO: 1143682 - RNA, 19 nt, Homo sapiens
cgauugcacucaucaaaga

SEQ ID NO: 1143683 - RNA, 19 nt, Homo sapiens
cuacaaggguguccugaug

SEQ ID NO: 1143684 - RNA, 19 nt, Homo sapiens
caaaggacccauuuacaau

SEQ ID NO: 1143685 - RNA, 19 nt, Homo sapiens
ccaacgaagcggucuauaa

SEQ ID NO: 1143686 - RNA, 19 nt, Homo sapiens
gcgcauauuugaagauuac

SEQ ID NO: 1143687 - RNA, 19 nt, Homo sapiens
caacgaagcggucuauaag

SEQ ID NO: 1143688 - RNA, 19 nt, Homo sapiens
ugagaaacaucaucagagu

SEQ ID NO: 1143689 - RNA, 19 nt, Homo sapiens
ucaaaggacccauuuacaa

SEQ ID NO: 1143690 - RNA, 19 nt, Homo sapiens
acaccucacuugauccuuu

SEQ ID NO: 1143691 - RNA, 19 nt, Homo sapiens
gaguggcuguccuggauaa

SEQ ID NO: 1143692 - RNA, 19 nt, Homo sapiens
gaguauccuugaagucauu

SEQ ID NO: 1143693 - RNA, 19 nt, Homo sapiens
gaagcggucuauaagaucu

SEQ ID NO: 1143694 - RNA, 19 nt, Homo sapiens
uauaagcaguucuguguuc

SEQ ID NO: 1143695 - RNA, 19 nt, Homo sapiens
ggagaggagauggcuaaua

SEQ ID NO: 1143696 - RNA, 19 nt, Homo sapiens
ugaacaagaccaacaagaa

SEQ ID NO: 1143697 - RNA, 19 nt, Homo sapiens
aaaggacccauuuacaaua

SEQ ID NO: 1143698 - RNA, 19 nt, Homo sapiens
gggcugcacggauaucaua

SEQ ID NO: 1143699 - RNA, 19 nt, Homo sapiens
gcauuccaaccacuaauaa

SEQ ID NO: 1143700 - RNA, 19 nt, Homo sapiens
gcguguaacugcauuccaa

SEQ ID NO: 1143701 - RNA, 19 nt, Homo sapiens
cagaguggcuguccuggau

SEQ ID NO: 1143702 - RNA, 19 nt, Homo sapiens
gcgaugagccuccuguuca

SEQ ID NO: 1143703 - RNA, 19 nt, Homo sapiens
gagaacaaacccuaucugu

SEQ ID NO: 1143704 - RNA, 19 nt, Homo sapiens
cgacuuccucugccaguua

SEQ ID NO: 1143705 - RNA, 19 nt, Homo sapiens
gggcauggcucccggaaaa

SEQ ID NO: 1143706 - RNA, 19 nt, Homo sapiens
acacagcucucuuuguaag

SEQ ID NO: 1143707 - RNA, 19 nt, Homo sapiens
ggaaggacgguguuugugu

SEQ ID NO: 1143708 - RNA, 19 nt, Homo sapiens
caccaccccucaauuauua

SEQ ID NO: 1143709 - RNA, 19 nt, Homo sapiens
gggcaaacuucugaucguu

SEQ ID NO: 1143710 - RNA, 19 nt, Homo sapiens
gagaacaaguuugccaagu

SEQ ID NO: 1143711 - RNA, 19 nt, Homo sapiens
gugcagaucauccguguga

SEQ ID NO: 1143712 - RNA, 19 nt, Homo sapiens
uaaagugccuauuguacag

SEQ ID NO: 1143713 - RNA, 19 nt, Homo sapiens
uggaggaccuggagaggaa

SEQ ID NO: 1143714 - RNA, 19 nt, Homo sapiens
agaacaaguuugccaagug

SEQ ID NO: 1143715 - RNA, 19 nt, Homo sapiens
ugaagucauuaucaucuug

SEQ ID NO: 1143716 - RNA, 19 nt, Homo sapiens
gcucugaugucucuuuggu

SEQ ID NO: 1143717 - RNA, 19 nt, Homo sapiens
ggccaggaaugccuucuuc

SEQ ID NO: 1143718 - RNA, 19 nt, Homo sapiens
aggaaugccuacaucauga

SEQ ID NO: 1143719 - RNA, 19 nt, Homo sapiens
ggagaaguucaucaaauuc

SEQ ID NO: 1143720 - RNA, 19 nt, Homo sapiens
ccucaugaccugucucaaa

SEQ ID NO: 1143721 - RNA, 19 nt, Homo sapiens
gcugggcuacggaauauuu

SEQ ID NO: 1143722 - RNA, 19 nt, Homo sapiens
uaucauaugcuguguguuc

SEQ ID NO: 1143723 - RNA, 19 nt, Homo sapiens
ggccuuacuucaugucuuc

SEQ ID NO: 1143724 - RNA, 19 nt, Homo sapiens
gugcugggcuacggaauau

SEQ ID NO: 1143725 - RNA, 19 nt, Homo sapiens
uaagagaggaaagaaacua

SEQ ID NO: 1143726 - RNA, 19 nt, Homo sapiens
ugcauuaaagggucuauua

SEQ ID NO: 1143727 - RNA, 19 nt, Homo sapiens
gaucguuggcuccuacuug

SEQ ID NO: 1143728 - RNA, 19 nt, Homo sapiens
gcaacucgccaugcgcaua

SEQ ID NO: 1143729 - RNA, 19 nt, Homo sapiens
ggagggaguuaggcugaau

SEQ ID NO: 1143730 - RNA, 19 nt, Homo sapiens
uaucauaggccuggucauu

SEQ ID NO: 1143731 - RNA, 19 nt, Homo sapiens
acgaagcggucuauaagau

SEQ ID NO: 1143732 - RNA, 19 nt, Homo sapiens
cuccacaccugaacaguug

SEQ ID NO: 1143733 - RNA, 19 nt, Homo sapiens
cagcgucuauggcaugugu

SEQ ID NO: 1143734 - RNA, 19 nt, Homo sapiens
gagaggccuuacuucaugu

SEQ ID NO: 1143735 - RNA, 19 nt, Homo sapiens
cuggagaaguucaucaaau

SEQ ID NO: 1143736 - RNA, 19 nt, Homo sapiens
gacagccccugcccauuua

SEQ ID NO: 1143737 - RNA, 19 nt, Homo sapiens
gcauuaaagggucuauuag

SEQ ID NO: 1143738 - RNA, 19 nt, Homo sapiens
caucaugauugccaucuac

SEQ ID NO: 1143739 - RNA, 19 nt, Homo sapiens
ucaaugccuucauguucuu

SEQ ID NO: 1143740 - RNA, 19 nt, Homo sapiens
gguacuggauuaucauagg

SEQ ID NO: 1143741 - RNA, 19 nt, Homo sapiens
ggaguuaggcugaauuucc

SEQ ID NO: 1143742 - RNA, 19 nt, Homo sapiens
ucuggugccuggagaaguu

SEQ ID NO: 1143743 - RNA, 19 nt, Homo sapiens
cucaugaccugucucaaau

SEQ ID NO: 1143744 - RNA, 19 nt, Homo sapiens
caacucgccaugcgcauau

SEQ ID NO: 1143745 - RNA, 19 nt, Homo sapiens
cagugaacacccacguuua

SEQ ID NO: 1143746 - RNA, 19 nt, Homo sapiens
ggugcugggcuacggaaua

SEQ ID NO: 1143747 - RNA, 19 nt, Homo sapiens
cuuccuggcugguauuaug

SEQ ID NO: 1143748 - RNA, 19 nt, Homo sapiens
ggacuuugaguacuauaag

SEQ ID NO: 1143749 - RNA, 19 nt, Homo sapiens
acagugaacacccacguuu

SEQ ID NO: 1143750 - RNA, 19 nt, Homo sapiens
agacugcgagaaacaagua

SEQ ID NO: 1143751 - RNA, 19 nt, Homo sapiens
agccagaucccaccaguuu

SEQ ID NO: 1143752 - RNA, 19 nt, Homo sapiens
gaaguucaucaaauuccuu

SEQ ID NO: 1143753 - RNA, 19 nt, Homo sapiens
agaccugguuggccuuuau

SEQ ID NO: 1143754 - RNA, 19 nt, Homo sapiens
gcagcucccgggacuuuga

SEQ ID NO: 1143755 - RNA, 19 nt, Homo sapiens
uuacuggguuccuauacug

SEQ ID NO: 1143756 - RNA, 19 nt, Homo sapiens
gaaugccuacaucaugauu

SEQ ID NO: 1143757 - RNA, 19 nt, Homo sapiens
gagcugcuggccacaguga

SEQ ID NO: 1143758 - RNA, 19 nt, Homo sapiens
cagcaccaccccucaauua

SEQ ID NO: 1143759 - RNA, 19 nt, Homo sapiens
uaaccuggacaugcauuaa

SEQ ID NO: 1143760 - RNA, 19 nt, Homo sapiens
gcucaagggccaccagaag

SEQ ID NO: 1143761 - RNA, 19 nt, Homo sapiens
gaacacccacguuuauucc

SEQ ID NO: 1143762 - RNA, 19 nt, Homo sapiens
aaggacccauuuacaauag

SEQ ID NO: 1143763 - RNA, 19 nt, Homo sapiens
aauaggggcugcacggaua

SEQ ID NO: 1143764 - RNA, 19 nt, Homo sapiens
ugaacacccacguuuauuc

SEQ ID NO: 1143765 - RNA, 19 nt, Homo sapiens
ugaaagcugcagagaacaa

SEQ ID NO: 1143766 - RNA, 19 nt, Homo sapiens
gacacagcucucuuuguaa

SEQ ID NO: 1143767 - RNA, 19 nt, Homo sapiens
gaacucagcuauacacaua

SEQ ID NO: 1143768 - RNA, 19 nt, Homo sapiens
uaacaaaugucucugauga

SEQ ID NO: 1143769 - RNA, 19 nt, Homo sapiens
gaaagucacaccauuauaa

SEQ ID NO: 1143770 - RNA, 19 nt, Homo sapiens
ggaauaggauaccagauuu

SEQ ID NO: 1143771 - RNA, 19 nt, Homo sapiens
gaacauacuuaguuucuca

SEQ ID NO: 1143772 - RNA, 19 nt, Homo sapiens
uaagcacccuucaguauua

SEQ ID NO: 1143773 - RNA, 19 nt, Homo sapiens
ugaauccgcugcuuuauaa

SEQ ID NO: 1143774 - RNA, 19 nt, Homo sapiens
guugggaguugauuuauua

SEQ ID NO: 1143775 - RNA, 19 nt, Homo sapiens
caaagugcauucugaguuu

SEQ ID NO: 1143776 - RNA, 19 nt, Homo sapiens
gaauaagaguacugacuaa

SEQ ID NO: 1143777 - RNA, 19 nt, Homo sapiens
gaacagagccaugucauau

SEQ ID NO: 1143778 - RNA, 19 nt, Homo sapiens
gaacugacacuagugaaua

SEQ ID NO: 1143779 - RNA, 19 nt, Homo sapiens
aaacuuaucuggugcauuc

SEQ ID NO: 1143780 - RNA, 19 nt, Homo sapiens
gaaaugaacaacugaagaa

SEQ ID NO: 1143781 - RNA, 19 nt, Homo sapiens
uaugggaucuguuauagua

SEQ ID NO: 1143782 - RNA, 19 nt, Homo sapiens
ccacauguguuguauuuga

SEQ ID NO: 1143783 - RNA, 19 nt, Homo sapiens
gcuauagucugguaucaaa

SEQ ID NO: 1143784 - RNA, 19 nt, Homo sapiens
caagugcucuuugaugaua

SEQ ID NO: 1143785 - RNA, 19 nt, Homo sapiens
ccugaaagcuugucacuga

SEQ ID NO: 1143786 - RNA, 19 nt, Homo sapiens
caagugaagugccuacuga

SEQ ID NO: 1143787 - RNA, 19 nt, Homo sapiens
caggguuucucuugaauua

SEQ ID NO: 1143788 - RNA, 19 nt, Homo sapiens
cuacuaaacugcuaaagga

SEQ ID NO: 1143789 - RNA, 19 nt, Homo sapiens
ggaaggagaugguucuagu

SEQ ID NO: 1143790 - RNA, 19 nt, Homo sapiens
gggaagacuuguuacauug

SEQ ID NO: 1143791 - RNA, 19 nt, Homo sapiens
caaaguguaucauguggaa

SEQ ID NO: 1143792 - RNA, 19 nt, Homo sapiens
ugaaacaggauacucauua

SEQ ID NO: 1143793 - RNA, 19 nt, Homo sapiens
guauaccucucaacaguuu

SEQ ID NO: 1143794 - RNA, 19 nt, Homo sapiens
guaaaucgggcaaauauga

SEQ ID NO: 1143795 - RNA, 19 nt, Homo sapiens
ucauaucacuuugcucuua

SEQ ID NO: 1143796 - RNA, 19 nt, Homo sapiens
ugacuaagcugccugaaag

SEQ ID NO: 1143797 - RNA, 19 nt, Homo sapiens
caaugaauccgcugcuuua

SEQ ID NO: 1143798 - RNA, 19 nt, Homo sapiens
uauaugggcuuacaaugaa

SEQ ID NO: 1143799 - RNA, 19 nt, Homo sapiens
gaaccucagugugaaacua

SEQ ID NO: 1143800 - RNA, 19 nt, Homo sapiens
guacuuaguuguugaaagg

SEQ ID NO: 1143801 - RNA, 19 nt, Homo sapiens
gcauugauguacuuaguug

SEQ ID NO: 1143802 - RNA, 19 nt, Homo sapiens
gaucaaagaaagcaaagaa

SEQ ID NO: 1143803 - RNA, 19 nt, Homo sapiens
aaacuuaggcuuugucuga

SEQ ID NO: 1143804 - RNA, 19 nt, Homo sapiens
gaauaaggcuaagaaccaa

SEQ ID NO: 1143805 - RNA, 19 nt, Homo sapiens
gaacaacucacagcacauu

SEQ ID NO: 1143806 - RNA, 19 nt, Homo sapiens
ucacuuugcucuuaccauu

SEQ ID NO: 1143807 - RNA, 19 nt, Homo sapiens
caaagucacagaugcuaua

SEQ ID NO: 1143808 - RNA, 19 nt, Homo sapiens
cuagggaguugaaguguuu

SEQ ID NO: 1143809 - RNA, 19 nt, Homo sapiens
agauaaaccucuacuugaa

SEQ ID NO: 1143810 - RNA, 19 nt, Homo sapiens
gaaacaggauacucauuac

SEQ ID NO: 1143811 - RNA, 19 nt, Homo sapiens
caaauucuauccucuaaac

SEQ ID NO: 1143812 - RNA, 19 nt, Homo sapiens
uauaacaggucaacaagug

SEQ ID NO: 1143813 - RNA, 19 nt, Homo sapiens
gaaagggugaugaaacuga

SEQ ID NO: 1143814 - RNA, 19 nt, Homo sapiens
gggaauuguucgaguugua

SEQ ID NO: 1143815 - RNA, 19 nt, Homo sapiens
gaaaacagcacaugugaaa

SEQ ID NO: 1143816 - RNA, 19 nt, Homo sapiens
ugaagugccuacugauauu

SEQ ID NO: 1143817 - RNA, 19 nt, Homo sapiens
ggguuuaacuccauuuguu

SEQ ID NO: 1143818 - RNA, 19 nt, Homo sapiens
caaaggacaauaacaaaug

SEQ ID NO: 1143819 - RNA, 19 nt, Homo sapiens
ccacacagcauaccucuga

SEQ ID NO: 1143820 - RNA, 19 nt, Homo sapiens
guaagagggucugcauuug

SEQ ID NO: 1143821 - RNA, 19 nt, Homo sapiens
ugaccaaagugcauucuga

SEQ ID NO: 1143822 - RNA, 19 nt, Homo sapiens
ggguuucucuugaauuauu

SEQ ID NO: 1143823 - RNA, 19 nt, Homo sapiens
gaaagcuugucacugauuc

SEQ ID NO: 1143824 - RNA, 19 nt, Homo sapiens
gaacuuauaaacagcgauu

SEQ ID NO: 1143825 - RNA, 19 nt, Homo sapiens
gcagaaagaacuuauaaac

SEQ ID NO: 1143826 - RNA, 19 nt, Homo sapiens
caaagaaagcaaagaauuc

SEQ ID NO: 1143827 - RNA, 19 nt, Homo sapiens
gcauugaacucagcuauac

SEQ ID NO: 1143828 - RNA, 19 nt, Homo sapiens
uauggaagauuaagucaug

SEQ ID NO: 1143829 - RNA, 19 nt, Homo sapiens
uaaauggcguccaaaguca

SEQ ID NO: 1143830 - RNA, 19 nt, Homo sapiens
gaaaugcagucucucucau

SEQ ID NO: 1143831 - RNA, 19 nt, Homo sapiens
ggaaguacauagggaagga

SEQ ID NO: 1143832 - RNA, 19 nt, Homo sapiens
gaaaccagaccucauagau

SEQ ID NO: 1143833 - RNA, 19 nt, Homo sapiens
uggcagauguuguguguga

SEQ ID NO: 1143834 - RNA, 19 nt, Homo sapiens
ugacauugcugccuuuaag

SEQ ID NO: 1143835 - RNA, 19 nt, Homo sapiens
gauaaaccucuacuugaaa

SEQ ID NO: 1143836 - RNA, 19 nt, Homo sapiens
ccagauaaaccucuacuug

SEQ ID NO: 1143837 - RNA, 19 nt, Homo sapiens
agaaauggcaguucaaaga

SEQ ID NO: 1143838 - RNA, 19 nt, Homo sapiens
ugaguauacugguuuaaga

SEQ ID NO: 1143839 - RNA, 19 nt, Homo sapiens
ugaguucuguuaggaauaa

SEQ ID NO: 1143840 - RNA, 19 nt, Homo sapiens
uaagguacaugccuauaca

SEQ ID NO: 1143841 - RNA, 19 nt, Homo sapiens
gagcauaugaucaacaaau

SEQ ID NO: 1143842 - RNA, 19 nt, Homo sapiens
gaagugccuacugauauua

SEQ ID NO: 1143843 - RNA, 19 nt, Homo sapiens
caacaagugcucuuugaug

SEQ ID NO: 1143844 - RNA, 19 nt, Homo sapiens
gaagacuuguuacauugug

SEQ ID NO: 1143845 - RNA, 19 nt, Homo sapiens
ggaaugguccuagcaaaga

SEQ ID NO: 1143846 - RNA, 19 nt, Homo sapiens
gggaguugauuuauuaagu

SEQ ID NO: 1143847 - RNA, 19 nt, Homo sapiens
guacaugccuauacagaac

SEQ ID NO: 1143848 - RNA, 19 nt, Homo sapiens
cagauaaaccucuacuuga

SEQ ID NO: 1143849 - RNA, 19 nt, Homo sapiens
caacugaaacugacaaugg

SEQ ID NO: 1143850 - RNA, 19 nt, Homo sapiens
gaaggagaugguucuagua

SEQ ID NO: 1143851 - RNA, 19 nt, Homo sapiens
ugccacauguguuguauuu

SEQ ID NO: 1143852 - RNA, 19 nt, Homo sapiens
aaagaagauuggagcauau

SEQ ID NO: 1143853 - RNA, 19 nt, Homo sapiens
ugggaagacuuguuacauu

SEQ ID NO: 1143854 - RNA, 19 nt, Homo sapiens
ugugaacuguuguuucuuu

SEQ ID NO: 1143855 - RNA, 19 nt, Homo sapiens
agauugagguuaacuuaga

SEQ ID NO: 1143856 - RNA, 19 nt, Homo sapiens
aacaagugcucuuugauga

SEQ ID NO: 1143857 - RNA, 19 nt, Homo sapiens
guaauaguuucaucugcuu

SEQ ID NO: 1143858 - RNA, 19 nt, Homo sapiens
gggaagguaaugauuguaa

SEQ ID NO: 1143859 - RNA, 19 nt, Homo sapiens
gcuauaguaugggaaggua

SEQ ID NO: 1143860 - RNA, 19 nt, Homo sapiens
guuaugggaagacuuguua

SEQ ID NO: 1143861 - RNA, 19 nt, Homo sapiens
acacugaaaugaacaacug

SEQ ID NO: 1143862 - RNA, 19 nt, Homo sapiens
gaguugaaguguuuacauc

SEQ ID NO: 1143863 - RNA, 19 nt, Homo sapiens
gacuaucucaguuguauuu

SEQ ID NO: 1143864 - RNA, 19 nt, Homo sapiens
aauagaaagucacaccauu

SEQ ID NO: 1143865 - RNA, 19 nt, Homo sapiens
gaugggaagaagacuguua

SEQ ID NO: 1143866 - RNA, 19 nt, Homo sapiens
aaccagaccucauagaugu

SEQ ID NO: 1143867 - RNA, 19 nt, Homo sapiens
caacauugcucgcacuuug

SEQ ID NO: 1143868 - RNA, 19 nt, Homo sapiens
gaaacaccuuugagggaua

SEQ ID NO: 1143869 - RNA, 19 nt, Homo sapiens
ggauguaccucacuuaaag

SEQ ID NO: 1143870 - RNA, 19 nt, Homo sapiens
gagaagaaccugcagauuc

SEQ ID NO: 1143871 - RNA, 19 nt, Homo sapiens
gaagcgcccuggucucuug

SEQ ID NO: 1143872 - RNA, 19 nt, Homo sapiens
ggaaggacguggcauccaa

SEQ ID NO: 1143873 - RNA, 19 nt, Homo sapiens
ggagauucuuguccuguuu

SEQ ID NO: 1143874 - RNA, 19 nt, Homo sapiens
gacaaggucaguuugaaua

SEQ ID NO: 1143875 - RNA, 19 nt, Homo sapiens
guaccucacuuaaagaugu

SEQ ID NO: 1143876 - RNA, 19 nt, Homo sapiens
ccaguuagcuucccuucug

SEQ ID NO: 1143877 - RNA, 19 nt, Homo sapiens
gcaacaagguccgccagaa

SEQ ID NO: 1143878 - RNA, 19 nt, Homo sapiens
gggagcagcuucugagauc

SEQ ID NO: 1143879 - RNA, 19 nt, Homo sapiens
ucccuuagcuucacacuug

SEQ ID NO: 1143880 - RNA, 19 nt, Homo sapiens
cagccugggugcaguuaua

SEQ ID NO: 1143881 - RNA, 19 nt, Homo sapiens
gagggcaccuggaacaaug

SEQ ID NO: 1143882 - RNA, 19 nt, Homo sapiens
caacaagguccgccagaaa

SEQ ID NO: 1143883 - RNA, 19 nt, Homo sapiens
cgugucagcuuccuuaaga

SEQ ID NO: 1143884 - RNA, 19 nt, Homo sapiens
ccuaggaguuugcuucuga

SEQ ID NO: 1143885 - RNA, 19 nt, Homo sapiens
ccaggagaauggagagaaa

SEQ ID NO: 1143886 - RNA, 19 nt, Homo sapiens
ggaguuugcuucugauagg

SEQ ID NO: 1143887 - RNA, 19 nt, Homo sapiens
gacaugaggacccgucuuu

SEQ ID NO: 1143888 - RNA, 19 nt, Homo sapiens
ggguuaaggugcagugaug

SEQ ID NO: 1143889 - RNA, 19 nt, Homo sapiens
agggucagcuuucccauuu

SEQ ID NO: 1143890 - RNA, 19 nt, Homo sapiens
aagcagcggugccaaguau

SEQ ID NO: 1143891 - RNA, 19 nt, Homo sapiens
gagauccaauggccuuguu

SEQ ID NO: 1143892 - RNA, 19 nt, Homo sapiens
ggacaaggucaguuugaau

SEQ ID NO: 1143893 - RNA, 19 nt, Homo sapiens
ggaauccaggacuguauuu

SEQ ID NO: 1143894 - RNA, 19 nt, Homo sapiens
gaauaucccagaacacagu

SEQ ID NO: 1143895 - RNA, 19 nt, Homo sapiens
ggagaagaaccugcagauu

SEQ ID NO: 1143896 - RNA, 19 nt, Homo sapiens
ucaggaugcugcagucugu

SEQ ID NO: 1143897 - RNA, 19 nt, Homo sapiens
ggaauguccugggcuccuu

SEQ ID NO: 1143898 - RNA, 19 nt, Homo sapiens
agacugggauugcauuugg

SEQ ID NO: 1143899 - RNA, 19 nt, Homo sapiens
uagaggaaauggacaaggu

SEQ ID NO: 1143900 - RNA, 19 nt, Homo sapiens
ggaugacaguagaggaaau

SEQ ID NO: 1143901 - RNA, 19 nt, Homo sapiens
uuugggagaugucaccuaa

SEQ ID NO: 1143902 - RNA, 19 nt, Homo sapiens
agccggagguggcgcuuua

SEQ ID NO: 1143903 - RNA, 19 nt, Homo sapiens
caaccaggaguccaacauu

SEQ ID NO: 1143904 - RNA, 19 nt, Homo sapiens
gcaaguaccgccacaacgu

SEQ ID NO: 1143905 - RNA, 19 nt, Homo sapiens
ggaacaauggccugcaaga

SEQ ID NO: 1143906 - RNA, 19 nt, Homo sapiens
gcagcggugccaaguauga

SEQ ID NO: 1143907 - RNA, 19 nt, Homo sapiens
gaaccuuuccuuccugcuu

SEQ ID NO: 1143908 - RNA, 19 nt, Homo sapiens
ggccaaaggcuaugguuuc

SEQ ID NO: 1143909 - RNA, 19 nt, Homo sapiens
cccuuuggcuuacuuggua

SEQ ID NO: 1143910 - RNA, 19 nt, Homo sapiens
uaaggcagguguugaagac

SEQ ID NO: 1143911 - RNA, 19 nt, Homo sapiens
gaaauggacaaggucaguu

SEQ ID NO: 1143912 - RNA, 19 nt, Homo sapiens
uaaccaggacauugauauu

SEQ ID NO: 1143913 - RNA, 19 nt, Homo sapiens
gcccuggucucuugagcuu

SEQ ID NO: 1143914 - RNA, 19 nt, Homo sapiens
gcauggugauccugcugaa

SEQ ID NO: 1143915 - RNA, 19 nt, Homo sapiens
gcagucugugcaauaauaa

SEQ ID NO: 1143916 - RNA, 19 nt, Homo sapiens
caaggucaguuugaauauc

SEQ ID NO: 1143917 - RNA, 19 nt, Homo sapiens
gggcaacacugaccuuucc

SEQ ID NO: 1143918 - RNA, 19 nt, Homo sapiens
ggcaugggcugggcauaga

SEQ ID NO: 1143919 - RNA, 19 nt, Homo sapiens
acaacgugcuggucaagga

SEQ ID NO: 1143920 - RNA, 19 nt, Homo sapiens
gagcacagaagcccaugga

SEQ ID NO: 1143921 - RNA, 19 nt, Homo sapiens
cagugaugauggccuguuu

SEQ ID NO: 1143922 - RNA, 19 nt, Homo sapiens
cuguagauguucuggauga

SEQ ID NO: 1143923 - RNA, 19 nt, Homo sapiens
aaccaggaguccaacauug

SEQ ID NO: 1143924 - RNA, 19 nt, Homo sapiens
gcgaguggcuggacaaccu

SEQ ID NO: 1143925 - RNA, 19 nt, Homo sapiens
gcucugggaccuaggaguu

SEQ ID NO: 1143926 - RNA, 19 nt, Homo sapiens
cgagaccuaugcugaugga

SEQ ID NO: 1143927 - RNA, 19 nt, Homo sapiens
uggcuuacuugguagaaga

SEQ ID NO: 1143928 - RNA, 19 nt, Homo sapiens
caucagggcccaccgaaag

SEQ ID NO: 1143929 - RNA, 19 nt, Homo sapiens
caccuaaccaggacauuga

SEQ ID NO: 1143930 - RNA, 19 nt, Homo sapiens
ccagccagguccggaauau

SEQ ID NO: 1143931 - RNA, 19 nt, Homo sapiens
ggacuuugaaccuuuccuu

SEQ ID NO: 1143932 - RNA, 19 nt, Homo sapiens
ggugagggccaaaggcuau

SEQ ID NO: 1143933 - RNA, 19 nt, Homo sapiens
ggaaauggacaaggucagu

SEQ ID NO: 1143934 - RNA, 19 nt, Homo sapiens
caggcaggguggccaaaga

SEQ ID NO: 1143935 - RNA, 19 nt, Homo sapiens
gcccacagcucugcaucug

SEQ ID NO: 1143936 - RNA, 19 nt, Homo sapiens
aaauggacaaggucaguuu

SEQ ID NO: 1143937 - RNA, 19 nt, Homo sapiens
gccuguagauguucuggau

SEQ ID NO: 1143938 - RNA, 19 nt, Homo sapiens
ccucagaccagcacagaga

SEQ ID NO: 1143939 - RNA, 19 nt, Homo sapiens
ggacguaccaaggccaguu

SEQ ID NO: 1143940 - RNA, 19 nt, Homo sapiens
caagggacgcuacggaauc

SEQ ID NO: 1143941 - RNA, 19 nt, Homo sapiens
gugaugcccugugaaaugg

SEQ ID NO: 1143942 - RNA, 19 nt, Homo sapiens
ugagguggcaggugucuau

SEQ ID NO: 1143943 - RNA, 19 nt, Homo sapiens
ccaagggccagggcgaaua

SEQ ID NO: 1143944 - RNA, 19 nt, Homo sapiens
guuugaauaucccagaaca

SEQ ID NO: 1143945 - RNA, 19 nt, Homo sapiens
uaaagagaucacaccguuu

SEQ ID NO: 1143946 - RNA, 19 nt, Homo sapiens
caaggagagcccagagaga

SEQ ID NO: 1143947 - RNA, 19 nt, Homo sapiens
gcuauggcaccgagaccua

SEQ ID NO: 1143948 - RNA, 19 nt, Homo sapiens
ccagaaggagggcaggauu

SEQ ID NO: 1143949 - RNA, 19 nt, Homo sapiens
aaccuuuccuuccugcuuu

SEQ ID NO: 1143950 - RNA, 19 nt, Homo sapiens
ucccuugccuguagauguu

SEQ ID NO: 1143951 - RNA, 19 nt, Homo sapiens
gaacaauggccugcaagac

SEQ ID NO: 1143952 - RNA, 19 nt, Homo sapiens
cggagauucuuguccuguu

SEQ ID NO: 1143953 - RNA, 19 nt, Homo sapiens
gggccaaaggcuaugguuu

SEQ ID NO: 1143954 - RNA, 19 nt, Homo sapiens
caagcagcggugccaagua

SEQ ID NO: 1143955 - RNA, 19 nt, Homo sapiens
cugcuguccucccuucauu

SEQ ID NO: 1143956 - RNA, 19 nt, Homo sapiens
ugugaugcccugugaaaug

SEQ ID NO: 1143957 - RNA, 19 nt, Homo sapiens
ccucccaccaguccaguua

SEQ ID NO: 1143958 - RNA, 19 nt, Homo sapiens
uggacaaggucaguuugaa

SEQ ID NO: 1143959 - RNA, 19 nt, Homo sapiens
accaggacauugauauuca

SEQ ID NO: 1143960 - RNA, 19 nt, Homo sapiens
ccaacaccauccucaucug

SEQ ID NO: 1143961 - RNA, 19 nt, Homo sapiens
guggacacauggcuucaag

SEQ ID NO: 1143962 - RNA, 19 nt, Homo sapiens
ggaaccuucucccuuagcu

SEQ ID NO: 1143963 - RNA, 19 nt, Homo sapiens
gauguaccucacuuaaaga

SEQ ID NO: 1143964 - RNA, 19 nt, Homo sapiens
ccugugaaauggcuugucu

SEQ ID NO: 1143965 - RNA, 19 nt, Homo sapiens
gaugacaguagaggaaaug

SEQ ID NO: 1143966 - RNA, 19 nt, Homo sapiens
aaggagagcccagagagaa

SEQ ID NO: 1143967 - RNA, 19 nt, Homo sapiens
ccaaggagcugaucaauaa

SEQ ID NO: 1143968 - RNA, 19 nt, Homo sapiens
gggaggaucucaauaaaga

SEQ ID NO: 1143969 - RNA, 19 nt, Homo sapiens
gcagaacacuaagauuaua

SEQ ID NO: 1143970 - RNA, 19 nt, Homo sapiens
gaagaagagaagaucaaua

SEQ ID NO: 1143971 - RNA, 19 nt, Homo sapiens
ggagaacauuaucgacauu

SEQ ID NO: 1143972 - RNA, 19 nt, Homo sapiens
ucgcagaacacuaagauua

SEQ ID NO: 1143973 - RNA, 19 nt, Homo sapiens
gaggaggugugccagacua

SEQ ID NO: 1143974 - RNA, 19 nt, Homo sapiens
gaaaccugcuaguggagaa

SEQ ID NO: 1143975 - RNA, 19 nt, Homo sapiens
gcacaaacacaacuuacug

SEQ ID NO: 1143976 - RNA, 19 nt, Homo sapiens
gcgaggagcaugaagaaga

SEQ ID NO: 1143977 - RNA, 19 nt, Homo sapiens
caagugauccucccaucuu

SEQ ID NO: 1143978 - RNA, 19 nt, Homo sapiens
gccaaggagcugaucaaua

SEQ ID NO: 1143979 - RNA, 19 nt, Homo sapiens
gaagaaacaggaucucacu

SEQ ID NO: 1143980 - RNA, 19 nt, Homo sapiens
ccgggaggaucucaauaaa

SEQ ID NO: 1143981 - RNA, 19 nt, Homo sapiens
gaacauuaucgacauuuac

SEQ ID NO: 1143982 - RNA, 19 nt, Homo sapiens
ggucuucggugcccacaag

SEQ ID NO: 1143983 - RNA, 19 nt, Homo sapiens
gaacuucacaguggguuuc

SEQ ID NO: 1143984 - RNA, 19 nt, Homo sapiens
aagugauccucccaucuua

SEQ ID NO: 1143985 - RNA, 19 nt, Homo sapiens
ggaggcagaagcaguuguu

SEQ ID NO: 1143986 - RNA, 19 nt, Homo sapiens
gagaacauuaucgacauuu

SEQ ID NO: 1143987 - RNA, 19 nt, Homo sapiens
gaccgcagcaucacccaaa

SEQ ID NO: 1143988 - RNA, 19 nt, Homo sapiens
cauggaagagccacaaaug

SEQ ID NO: 1143989 - RNA, 19 nt, Homo sapiens
uuacaaacgccagaagaaa

SEQ ID NO: 1143990 - RNA, 19 nt, Homo sapiens
uagccucgcagaacacuaa

SEQ ID NO: 1143991 - RNA, 19 nt, Homo sapiens
cgaggagcaugaagaagag

SEQ ID NO: 1143992 - RNA, 19 nt, Homo sapiens
caaccugugccgcaaaugu

SEQ ID NO: 1143993 - RNA, 19 nt, Homo sapiens
gccagacuaucgaggacaa

SEQ ID NO: 1143994 - RNA, 19 nt, Homo sapiens
gcauggacaaccuggagaa

SEQ ID NO: 1143995 - RNA, 19 nt, Homo sapiens
aagcagugaucacacagau

SEQ ID NO: 1143996 - RNA, 19 nt, Homo sapiens
uggacaaccuggagaagca

SEQ ID NO: 1143997 - RNA, 19 nt, Homo sapiens
ccacaaauggcgcuguauc

SEQ ID NO: 1143998 - RNA, 19 nt, Homo sapiens
uggagaacauuaucgacau

SEQ ID NO: 1143999 - RNA, 19 nt, Homo sapiens
cccgggaggaucucaauaa

SEQ ID NO: 1144000 - RNA, 19 nt, Homo sapiens
gugcgaggagcaugaagaa

SEQ ID NO: 1144001 - RNA, 19 nt, Homo sapiens
ggcagaagcaguuguuaac

SEQ ID NO: 1144002 - RNA, 19 nt, Homo sapiens
cgcagaacacuaagauuau

SEQ ID NO: 1144003 - RNA, 19 nt, Homo sapiens
ccacugcccaccauuuaca

SEQ ID NO: 1144004 - RNA, 19 nt, Homo sapiens
ucuacggccugcagcgaaa

SEQ ID NO: 1144005 - RNA, 19 nt, Homo sapiens
ggaggaucucaauaaagaa

SEQ ID NO: 1144006 - RNA, 19 nt, Homo sapiens
gaggcagaagcaguuguua

SEQ ID NO: 1144007 - RNA, 19 nt, Homo sapiens
cagacuaucgaggacaaua

SEQ ID NO: 1144008 - RNA, 19 nt, Homo sapiens
gcaugaagaagagaagauc

SEQ ID NO: 1144009 - RNA, 19 nt, Homo sapiens
ggaucucaauaaagaacuc

SEQ ID NO: 1144010 - RNA, 19 nt, Homo sapiens
auggagcaauucaccguaa

SEQ ID NO: 1144011 - RNA, 19 nt, Homo sapiens
caacuuacugcagccuuga

SEQ ID NO: 1144012 - RNA, 19 nt, Homo sapiens
acaaacgccagaagaaaca

SEQ ID NO: 1144013 - RNA, 19 nt, Homo sapiens
ggccucgaauccucuaugg

SEQ ID NO: 1144014 - RNA, 19 nt, Homo sapiens
aggcagaagcaguuguuaa

SEQ ID NO: 1144015 - RNA, 19 nt, Homo sapiens
cucccgagcucaagugauc

SEQ ID NO: 1144016 - RNA, 19 nt, Homo sapiens
gaggaucucaauaaagaac

SEQ ID NO: 1144017 - RNA, 19 nt, Homo sapiens
ggagcacguggccgaaaug

SEQ ID NO: 1144018 - RNA, 19 nt, Homo sapiens
augagagcauggagcaauu

SEQ ID NO: 1144019 - RNA, 19 nt, Homo sapiens
caucuuagccucgcagaac

SEQ ID NO: 1144020 - RNA, 19 nt, Homo sapiens
guggcacaaacacaacuua

SEQ ID NO: 1144021 - RNA, 19 nt, Homo sapiens
agaaacaggaucucacucu

SEQ ID NO: 1144022 - RNA, 19 nt, Homo sapiens
cagaagaaacaggaucuca

SEQ ID NO: 1144023 - RNA, 19 nt, Homo sapiens
gagagcauggagcaauuca

SEQ ID NO: 1144024 - RNA, 19 nt, Homo sapiens
ggccucauccgucaguaug

SEQ ID NO: 1144025 - RNA, 19 nt, Homo sapiens
gugcccaccugcucucucu

SEQ ID NO: 1144026 - RNA, 19 nt, Homo sapiens
ugaagaagagaagaucaau

SEQ ID NO: 1144027 - RNA, 19 nt, Homo sapiens
gagcaugaagaagagaaga

SEQ ID NO: 1144028 - RNA, 19 nt, Homo sapiens
uggagcacguggccgaaau

SEQ ID NO: 1144029 - RNA, 19 nt, Homo sapiens
ugcaagcagugaucacaca

SEQ ID NO: 1144030 - RNA, 19 nt, Homo sapiens
uuaucgacauuuacaagca

SEQ ID NO: 1144031 - RNA, 19 nt, Homo sapiens
uaugagagcauggagcaau

SEQ ID NO: 1144032 - RNA, 19 nt, Homo sapiens
gcuaguggagaacauuauc

SEQ ID NO: 1144033 - RNA, 19 nt, Homo sapiens
gaagaucccuuuacaauuu

SEQ ID NO: 1144034 - RNA, 19 nt, Homo sapiens
ggacuugccuagaauaaua

SEQ ID NO: 1144035 - RNA, 19 nt, Homo sapiens
gcagagagguggcaaauca

SEQ ID NO: 1144036 - RNA, 19 nt, Homo sapiens
gcaaguagcuuuccagaag

SEQ ID NO: 1144037 - RNA, 19 nt, Homo sapiens
uaagugggaugauuagaua

SEQ ID NO: 1144038 - RNA, 19 nt, Homo sapiens
gaaagugguugaaggauuc

SEQ ID NO: 1144039 - RNA, 19 nt, Homo sapiens
ggacaagacuuuaaaucau

SEQ ID NO: 1144040 - RNA, 19 nt, Homo sapiens
gaggaaagcugguggaaag

SEQ ID NO: 1144041 - RNA, 19 nt, Homo sapiens
gggcauaugucuaacuaaa

SEQ ID NO: 1144042 - RNA, 19 nt, Homo sapiens
gaaacuggcauaaacauga

SEQ ID NO: 1144043 - RNA, 19 nt, Homo sapiens
gaaagcugguggaaaguga

SEQ ID NO: 1144044 - RNA, 19 nt, Homo sapiens
cauaggagcuccaccauuc

SEQ ID NO: 1144045 - RNA, 19 nt, Homo sapiens
gaugacaacaguccucuua

SEQ ID NO: 1144046 - RNA, 19 nt, Homo sapiens
guacuauacuaccauguuu

SEQ ID NO: 1144047 - RNA, 19 nt, Homo sapiens
gcucaaaccugaccagaca

SEQ ID NO: 1144048 - RNA, 19 nt, Homo sapiens
gcagaaauaugucagaaac

SEQ ID NO: 1144049 - RNA, 19 nt, Homo sapiens
guauuaagguuucuggauu

SEQ ID NO: 1144050 - RNA, 19 nt, Homo sapiens
caguggagaucauuguuua

SEQ ID NO: 1144051 - RNA, 19 nt, Homo sapiens
gguagaagcuggcugagau

SEQ ID NO: 1144052 - RNA, 19 nt, Homo sapiens
uaagaaagccaaccaauca

SEQ ID NO: 1144053 - RNA, 19 nt, Homo sapiens
uagcugagaugacagauug

SEQ ID NO: 1144054 - RNA, 19 nt, Homo sapiens
acucaaaccucuguuauuu

SEQ ID NO: 1144055 - RNA, 19 nt, Homo sapiens
aaacauggcaggaguguaa

SEQ ID NO: 1144056 - RNA, 19 nt, Homo sapiens
gaggguaauuacaguagua

SEQ ID NO: 1144057 - RNA, 19 nt, Homo sapiens
ucauaaagcuucaaugucu

SEQ ID NO: 1144058 - RNA, 19 nt, Homo sapiens
gauugcugcugcuuaauuu

SEQ ID NO: 1144059 - RNA, 19 nt, Homo sapiens
caaggcaaauggugucaaa

SEQ ID NO: 1144060 - RNA, 19 nt, Homo sapiens
guaggaagaucccuuuaca

SEQ ID NO: 1144061 - RNA, 19 nt, Homo sapiens
uggaugggcucacuacuaa

SEQ ID NO: 1144062 - RNA, 19 nt, Homo sapiens
gagaaacgcaauucagaaa

SEQ ID NO: 1144063 - RNA, 19 nt, Homo sapiens
gcugauagaguaugucuuu

SEQ ID NO: 1144064 - RNA, 19 nt, Homo sapiens
caacaguccucuuacagau

SEQ ID NO: 1144065 - RNA, 19 nt, Homo sapiens
guacacacaugauaaggau

SEQ ID NO: 1144066 - RNA, 19 nt, Homo sapiens
gcauaaacaugauuguagu

SEQ ID NO: 1144067 - RNA, 19 nt, Homo sapiens
ggaagaucccuuuacaauu

SEQ ID NO: 1144068 - RNA, 19 nt, Homo sapiens
auaaggagccagugaaaua

SEQ ID NO: 1144069 - RNA, 19 nt, Homo sapiens
ccagugauguauucccaua

SEQ ID NO: 1144070 - RNA, 19 nt, Homo sapiens
gaaaaucgaugacaacagu

SEQ ID NO: 1144071 - RNA, 19 nt, Homo sapiens
caccuucccuugcagcuua

SEQ ID NO: 1144072 - RNA, 19 nt, Homo sapiens
gagcaaaacugcaucaaau

SEQ ID NO: 1144073 - RNA, 19 nt, Homo sapiens
gaugacagauugcuucucu

SEQ ID NO: 1144074 - RNA, 19 nt, Homo sapiens
ccacaggacuuugauuuua

SEQ ID NO: 1144075 - RNA, 19 nt, Homo sapiens
gaaagggugugugauuaca

SEQ ID NO: 1144076 - RNA, 19 nt, Homo sapiens
gcaaaacugcaucaaauua

SEQ ID NO: 1144077 - RNA, 19 nt, Homo sapiens
ggagaucauuguuuaggau

SEQ ID NO: 1144078 - RNA, 19 nt, Homo sapiens
gcugaggaauaauuaaaug

SEQ ID NO: 1144079 - RNA, 19 nt, Homo sapiens
gcaaaggucaacacaguau

SEQ ID NO: 1144080 - RNA, 19 nt, Homo sapiens
ggguuaggguuuaaagaaa

SEQ ID NO: 1144081 - RNA, 19 nt, Homo sapiens
agaacuguuugguugauua

SEQ ID NO: 1144082 - RNA, 19 nt, Homo sapiens
ucuccaaggucacuucuuu

SEQ ID NO: 1144083 - RNA, 19 nt, Homo sapiens
ggagaaacgcaauucagaa

SEQ ID NO: 1144084 - RNA, 19 nt, Homo sapiens
ugaagaaucccuagaggaa

SEQ ID NO: 1144085 - RNA, 19 nt, Homo sapiens
cagaguggauggaguacaa

SEQ ID NO: 1144086 - RNA, 19 nt, Homo sapiens
ugaauacgcuuuuccuuaa

SEQ ID NO: 1144087 - RNA, 19 nt, Homo sapiens
uaacuucaguggaauuuac

SEQ ID NO: 1144088 - RNA, 19 nt, Homo sapiens
caaggaaauugcagaccaa

SEQ ID NO: 1144089 - RNA, 19 nt, Homo sapiens
agaaagugguugaaggauu

SEQ ID NO: 1144090 - RNA, 19 nt, Homo sapiens
caggacggcucccucauug

SEQ ID NO: 1144091 - RNA, 19 nt, Homo sapiens
ggacgaagcccagaucaca

SEQ ID NO: 1144092 - RNA, 19 nt, Homo sapiens
uugaaagggugugugauua

SEQ ID NO: 1144093 - RNA, 19 nt, Homo sapiens
uaaggagacuaaugaaucu

SEQ ID NO: 1144094 - RNA, 19 nt, Homo sapiens
gaagcuggcugagauaaaa

SEQ ID NO: 1144095 - RNA, 19 nt, Homo sapiens
gaacuguuugguugauuaa

SEQ ID NO: 1144096 - RNA, 19 nt, Homo sapiens
ucaaucuucugucccagua

SEQ ID NO: 1144097 - RNA, 19 nt, Homo sapiens
ggagaaagccauuggaaaa

SEQ ID NO: 1144098 - RNA, 19 nt, Homo sapiens
gcaaaauacuggucucaga

SEQ ID NO: 1144099 - RNA, 19 nt, Homo sapiens
agaaagcccuaucgacuuc

SEQ ID NO: 1144100 - RNA, 19 nt, Homo sapiens
cugcuuaauugaaguguaa

SEQ ID NO: 1144101 - RNA, 19 nt, Homo sapiens
gaagccacgugauauaacu

SEQ ID NO: 1144102 - RNA, 19 nt, Homo sapiens
ugacaacaguccucuuaca

SEQ ID NO: 1144103 - RNA, 19 nt, Homo sapiens
gacauggucuggguacuau

SEQ ID NO: 1144104 - RNA, 19 nt, Homo sapiens
ucaaauacaugggacuuca

SEQ ID NO: 1144105 - RNA, 19 nt, Homo sapiens
ggagaagucugcaaaauac

SEQ ID NO: 1144106 - RNA, 19 nt, Homo sapiens
ccucauaacaguggaauuu

SEQ ID NO: 1144107 - RNA, 19 nt, Homo sapiens
gaaaggagaaagccauugg

SEQ ID NO: 1144108 - RNA, 19 nt, Homo sapiens
gcagugugguguagguguu

SEQ ID NO: 1144109 - RNA, 19 nt, Homo sapiens
ugacagccaucuacgacuu

SEQ ID NO: 1144110 - RNA, 19 nt, Homo sapiens
gcaggacggcucccucauu

SEQ ID NO: 1144111 - RNA, 19 nt, Homo sapiens
guguacaccuugcgagaaa

SEQ ID NO: 1144112 - RNA, 19 nt, Homo sapiens
gugggcagaucaacagaaa

SEQ ID NO: 1144113 - RNA, 19 nt, Homo sapiens
aagcaucauugaagcagua

SEQ ID NO: 1144114 - RNA, 19 nt, Homo sapiens
gugauuacaccauuguuaa

SEQ ID NO: 1144115 - RNA, 19 nt, Homo sapiens
agaaauaugucagaaacug

SEQ ID NO: 1144116 - RNA, 19 nt, Homo sapiens
gaaguguaauauagguugu

SEQ ID NO: 1144117 - RNA, 19 nt, Homo sapiens
gggaagccacgugauauaa

SEQ ID NO: 1144118 - RNA, 19 nt, Homo sapiens
caacauuucccuuauuugg

SEQ ID NO: 1144119 - RNA, 19 nt, Homo sapiens
cugcaacucucaacauuuc

SEQ ID NO: 1144120 - RNA, 19 nt, Homo sapiens
gagaguuagguauaucaua

SEQ ID NO: 1144121 - RNA, 19 nt, Homo sapiens
ucucuuaauuugaccauug

SEQ ID NO: 1144122 - RNA, 19 nt, Homo sapiens
caacucagaagcacauaga

SEQ ID NO: 1144123 - RNA, 19 nt, Homo sapiens
agacuguggugguggagua

SEQ ID NO: 1144124 - RNA, 19 nt, Homo sapiens
cggguacaauggugcuuua

SEQ ID NO: 1144125 - RNA, 19 nt, Homo sapiens
uuaaagccauucuguucuu

SEQ ID NO: 1144126 - RNA, 19 nt, Homo sapiens
uguacuauauccauacuug

SEQ ID NO: 1144127 - RNA, 19 nt, Homo sapiens
uaaggagcccaguaaguuu

SEQ ID NO: 1144128 - RNA, 19 nt, Homo sapiens
gaaagccaaccaaucacaa

SEQ ID NO: 1144129 - RNA, 19 nt, Homo sapiens
caauggugcuuuacccaau

SEQ ID NO: 1144130 - RNA, 19 nt, Homo sapiens
gacaggggcuggaaauaaa

SEQ ID NO: 1144131 - RNA, 19 nt, Homo sapiens
cgacaggaaugaaccuuac

SEQ ID NO: 1144132 - RNA, 19 nt, Homo sapiens
aagaaucccuagaggaaga

SEQ ID NO: 1144133 - RNA, 19 nt, Homo sapiens
caaccuagcucaaggauuu

SEQ ID NO: 1144134 - RNA, 19 nt, Homo sapiens
ggaaagacguuguagauga

SEQ ID NO: 1144135 - RNA, 19 nt, Homo sapiens
caagauggcucguuaauug

SEQ ID NO: 1144136 - RNA, 19 nt, Homo sapiens
gaaggaaagucgauuguau

SEQ ID NO: 1144137 - RNA, 19 nt, Homo sapiens
ucaaggaccucuagacuaa

SEQ ID NO: 1144138 - RNA, 19 nt, Homo sapiens
gaacacaggcuaauacuug

SEQ ID NO: 1144139 - RNA, 19 nt, Homo sapiens
gaaagcaaguccuguguug

SEQ ID NO: 1144140 - RNA, 19 nt, Homo sapiens
gaaagucgauuguauuuac

SEQ ID NO: 1144141 - RNA, 19 nt, Homo sapiens
ggaaauacuugaucccauu

SEQ ID NO: 1144142 - RNA, 19 nt, Homo sapiens
gaaagacguuguagaugaa

SEQ ID NO: 1144143 - RNA, 19 nt, Homo sapiens
gaaacgaauuguucacauu

SEQ ID NO: 1144144 - RNA, 19 nt, Homo sapiens
ucaaggauuugcaaaguua

SEQ ID NO: 1144145 - RNA, 19 nt, Homo sapiens
ggagaaggcugccaaaugg

SEQ ID NO: 1144146 - RNA, 19 nt, Homo sapiens
gaugagaacuccacuguca

SEQ ID NO: 1144147 - RNA, 19 nt, Homo sapiens
gaacggaauccucccuuua

SEQ ID NO: 1144148 - RNA, 19 nt, Homo sapiens
agucaaggcuccucacuua

SEQ ID NO: 1144149 - RNA, 19 nt, Homo sapiens
caccaugccuggcuaauuu

SEQ ID NO: 1144150 - RNA, 19 nt, Homo sapiens
cuacauacauucccuguug

SEQ ID NO: 1144151 - RNA, 19 nt, Homo sapiens
guagaaaccaguacacuuu

SEQ ID NO: 1144152 - RNA, 19 nt, Homo sapiens
guuacaagauggcucguua

SEQ ID NO: 1144153 - RNA, 19 nt, Homo sapiens
gcaauggguucacagaaga

SEQ ID NO: 1144154 - RNA, 19 nt, Homo sapiens
guacaaagcacuauaucaa

SEQ ID NO: 1144155 - RNA, 19 nt, Homo sapiens
gaacuagggagagaaauaa

SEQ ID NO: 1144156 - RNA, 19 nt, Homo sapiens
gaugucaguuccuuaauug

SEQ ID NO: 1144157 - RNA, 19 nt, Homo sapiens
caaguccuguguuguauuu

SEQ ID NO: 1144158 - RNA, 19 nt, Homo sapiens
guacauggcuaucauaacu

SEQ ID NO: 1144159 - RNA, 19 nt, Homo sapiens
gauuuaugcugcaggauuu

SEQ ID NO: 1144160 - RNA, 19 nt, Homo sapiens
caagugaucuucccaccuu

SEQ ID NO: 1144161 - RNA, 19 nt, Homo sapiens
gaaaugagagggcaugaau

SEQ ID NO: 1144162 - RNA, 19 nt, Homo sapiens
guucaucuguucacuguuu

SEQ ID NO: 1144163 - RNA, 19 nt, Homo sapiens
acagauauguuucagauug

SEQ ID NO: 1144164 - RNA, 19 nt, Homo sapiens
ggaacuagggagagaaaua

SEQ ID NO: 1144165 - RNA, 19 nt, Homo sapiens
gugaaugacuggucuaaau

SEQ ID NO: 1144166 - RNA, 19 nt, Homo sapiens
gggcauguguguucagaaa

SEQ ID NO: 1144167 - RNA, 19 nt, Homo sapiens
gaucgugaauguccuaugu

SEQ ID NO: 1144168 - RNA, 19 nt, Homo sapiens
guauuuagccuacgugaaa

SEQ ID NO: 1144169 - RNA, 19 nt, Homo sapiens
ccagguugcugccuucuuu

SEQ ID NO: 1144170 - RNA, 19 nt, Homo sapiens
ccaaagugcuggaauuaca

SEQ ID NO: 1144171 - RNA, 19 nt, Homo sapiens
gguaacaaauucucucaau

SEQ ID NO: 1144172 - RNA, 19 nt, Homo sapiens
gaaauacuugaucccauua

SEQ ID NO: 1144173 - RNA, 19 nt, Homo sapiens
ccaagucugggauauauua

SEQ ID NO: 1144174 - RNA, 19 nt, Homo sapiens
ucacuuagcuuucguuggu

SEQ ID NO: 1144175 - RNA, 19 nt, Homo sapiens
guaauucugucaucuaagu

SEQ ID NO: 1144176 - RNA, 19 nt, Homo sapiens
ccacaaguauagacaguug

SEQ ID NO: 1144177 - RNA, 19 nt, Homo sapiens
gaucuaaaggguugaauga

SEQ ID NO: 1144178 - RNA, 19 nt, Homo sapiens
gaagaggaaagacguugua

SEQ ID NO: 1144179 - RNA, 19 nt, Homo sapiens
gcuaaugccucuaguuaag

SEQ ID NO: 1144180 - RNA, 19 nt, Homo sapiens
cagcuaaugccucuaguua

SEQ ID NO: 1144181 - RNA, 19 nt, Homo sapiens
gaaaggagagugacuugau

SEQ ID NO: 1144182 - RNA, 19 nt, Homo sapiens
gcauuuggcaaguuuauuu

SEQ ID NO: 1144183 - RNA, 19 nt, Homo sapiens
gcucuggucauuugcauua

SEQ ID NO: 1144184 - RNA, 19 nt, Homo sapiens
ugugaugguuugcauaaua

SEQ ID NO: 1144185 - RNA, 19 nt, Homo sapiens
gaggauccuucuuguuauu

SEQ ID NO: 1144186 - RNA, 19 nt, Homo sapiens
gcucccagccucuuuauuu

SEQ ID NO: 1144187 - RNA, 19 nt, Homo sapiens
ggagugcaguggcgcaauu

SEQ ID NO: 1144188 - RNA, 19 nt, Homo sapiens
ugccauaucugugcacuua

SEQ ID NO: 1144189 - RNA, 19 nt, Homo sapiens
ccaguacacuuuuagauua

SEQ ID NO: 1144190 - RNA, 19 nt, Homo sapiens
acaaagcacuauaucaaga

SEQ ID NO: 1144191 - RNA, 19 nt, Homo sapiens
gaacuagaacacaggcuaa

SEQ ID NO: 1144192 - RNA, 19 nt, Homo sapiens
gacauagucuaauuugaug

SEQ ID NO: 1144193 - RNA, 19 nt, Homo sapiens
ucaguuggcuggugaacaa

SEQ ID NO: 1144194 - RNA, 19 nt, Homo sapiens
gaagucaaaguaauucuga

SEQ ID NO: 1144195 - RNA, 19 nt, Homo sapiens
cauuggagcuccucacuau

SEQ ID NO: 1144196 - RNA, 19 nt, Homo sapiens
gggauuauuuauuguguga

SEQ ID NO: 1144197 - RNA, 19 nt, Homo sapiens
gaauguucuugauagagua

SEQ ID NO: 1144198 - RNA, 19 nt, Homo sapiens
gaggaaagacguuguagau

SEQ ID NO: 1144199 - RNA, 19 nt, Homo sapiens
gcauuuagaagcuuuaaga

SEQ ID NO: 1144200 - RNA, 19 nt, Homo sapiens
acacagauauguuucagau

SEQ ID NO: 1144201 - RNA, 19 nt, Homo sapiens
agacuguggugguugaaua

SEQ ID NO: 1144202 - RNA, 19 nt, Homo sapiens
guauauaccuugugauggu

SEQ ID NO: 1144203 - RNA, 19 nt, Homo sapiens
gcucuaugcuucuguaagu

SEQ ID NO: 1144204 - RNA, 19 nt, Homo sapiens
ugacuggucuaaaugugua

SEQ ID NO: 1144205 - RNA, 19 nt, Homo sapiens
ugauaguaguuguguguua

SEQ ID NO: 1144206 - RNA, 19 nt, Homo sapiens
caaaggcaccacaaguaua

SEQ ID NO: 1144207 - RNA, 19 nt, Homo sapiens
gauauaaacugugguucau

SEQ ID NO: 1144208 - RNA, 19 nt, Homo sapiens
acagcgacauguauauuaa

SEQ ID NO: 1144209 - RNA, 19 nt, Homo sapiens
uguccagggucuuuaguua

SEQ ID NO: 1144210 - RNA, 19 nt, Homo sapiens
gauggagucuugcucuguu

SEQ ID NO: 1144211 - RNA, 19 nt, Homo sapiens
cuauucagaucgaguaauu

SEQ ID NO: 1144212 - RNA, 19 nt, Homo sapiens
ggaaagucgauuguauuua

SEQ ID NO: 1144213 - RNA, 19 nt, Homo sapiens
ucagaaaugugucaaagca

SEQ ID NO: 1144214 - RNA, 19 nt, Homo sapiens
ucaaagacagcuagaacua

SEQ ID NO: 1144215 - RNA, 19 nt, Homo sapiens
gcacuuacuaauucuguuu

SEQ ID NO: 1144216 - RNA, 19 nt, Homo sapiens
aaaggagagugacuugauu

SEQ ID NO: 1144217 - RNA, 19 nt, Homo sapiens
gcucaaggauuugcaaagu

SEQ ID NO: 1144218 - RNA, 19 nt, Homo sapiens
aaagacaacugccuauugg

SEQ ID NO: 1144219 - RNA, 19 nt, Homo sapiens
ucacagucuucucauguuu

SEQ ID NO: 1144220 - RNA, 19 nt, Homo sapiens
cggcugaucagaaguguua

SEQ ID NO: 1144221 - RNA, 19 nt, Homo sapiens
gacguguucuuauucauug

SEQ ID NO: 1144222 - RNA, 19 nt, Homo sapiens
cuaaggagauugccacagu

SEQ ID NO: 1144223 - RNA, 19 nt, Homo sapiens
uccagggucuuuaguuaua

SEQ ID NO: 1144224 - RNA, 19 nt, Homo sapiens
ccuaggcucuggauauuau

SEQ ID NO: 1144225 - RNA, 19 nt, Homo sapiens
ucagauguaucacaguuau

SEQ ID NO: 1144226 - RNA, 19 nt, Homo sapiens
cuaaaggguugaaugacaa

SEQ ID NO: 1144227 - RNA, 19 nt, Homo sapiens
gggagaaggcugccaaaug

SEQ ID NO: 1144228 - RNA, 19 nt, Homo sapiens
gcacugaucucggcucacu

SEQ ID NO: 1144229 - RNA, 19 nt, Homo sapiens
ccacuuuagucccuucauu

SEQ ID NO: 1144230 - RNA, 19 nt, Homo sapiens
ucauugggcuacauacauu

SEQ ID NO: 1144231 - RNA, 19 nt, Homo sapiens
gauaguaguuguguguuag

SEQ ID NO: 1144232 - RNA, 19 nt, Homo sapiens
gcacugcauggucuguuua

SEQ ID NO: 1144233 - RNA, 19 nt, Homo sapiens
cugcagagauguugauaug

SEQ ID NO: 1144234 - RNA, 19 nt, Homo sapiens
gcgacaacgucugcuauga

SEQ ID NO: 1144235 - RNA, 19 nt, Homo sapiens
guccugagcuggaauaggu

SEQ ID NO: 1144236 - RNA, 19 nt, Homo sapiens
ggaaagggaguaaaauaaa

SEQ ID NO: 1144237 - RNA, 19 nt, Homo sapiens
gaaguucugcagagauguu

SEQ ID NO: 1144238 - RNA, 19 nt, Homo sapiens
gaggaaagggaguaaaaua

SEQ ID NO: 1144239 - RNA, 19 nt, Homo sapiens
gaggaggcgugcacuaagg

SEQ ID NO: 1144240 - RNA, 19 nt, Homo sapiens
acaggaccauacccucuuu

SEQ ID NO: 1144241 - RNA, 19 nt, Homo sapiens
ucacggugcugguggucuu

SEQ ID NO: 1144242 - RNA, 19 nt, Homo sapiens
gcuucugggucuuccauau

SEQ ID NO: 1144243 - RNA, 19 nt, Homo sapiens
ugucuguccuccucccuaa

SEQ ID NO: 1144244 - RNA, 19 nt, Homo sapiens
ggacgagcaggccaaguuc

SEQ ID NO: 1144245 - RNA, 19 nt, Homo sapiens
gaugccagcucuccccuuu

SEQ ID NO: 1144246 - RNA, 19 nt, Homo sapiens
cuccucagccuucuccuua

SEQ ID NO: 1144247 - RNA, 19 nt, Homo sapiens
gcuugaaguucugcagaga

SEQ ID NO: 1144248 - RNA, 19 nt, Homo sapiens
uugaaguucugcagagaug

SEQ ID NO: 1144249 - RNA, 19 nt, Homo sapiens
ggaggaggcgugcacuaag

SEQ ID NO: 1144250 - RNA, 19 nt, Homo sapiens
cggaggaggcgugcacuaa

SEQ ID NO: 1144251 - RNA, 19 nt, Homo sapiens
gacaggaccauacccucuu

SEQ ID NO: 1144252 - RNA, 19 nt, Homo sapiens
cggacgagcaggccaaguu

SEQ ID NO: 1144253 - RNA, 19 nt, Homo sapiens
gcccucugcuguggucuga

SEQ ID NO: 1144254 - RNA, 19 nt, Homo sapiens
caagaggaaagggaguaaa

SEQ ID NO: 1144255 - RNA, 19 nt, Homo sapiens
gguaugggcaucaguuggu

SEQ ID NO: 1144256 - RNA, 19 nt, Homo sapiens
ucaagaggaaagggaguaa

SEQ ID NO: 1144257 - RNA, 19 nt, Homo sapiens
ccacucccucggucaugua

SEQ ID NO: 1144258 - RNA, 19 nt, Homo sapiens
ggaccauacccucuuugag

SEQ ID NO: 1144259 - RNA, 19 nt, Homo sapiens
caaauggggcuccuucuuc

SEQ ID NO: 1144260 - RNA, 19 nt, Homo sapiens
gcaaauggggcuccuucuu

SEQ ID NO: 1144261 - RNA, 19 nt, Homo sapiens
cgcaagugguggacugcuu

SEQ ID NO: 1144262 - RNA, 19 nt, Homo sapiens
gcggaaagcucuuauuugg

SEQ ID NO: 1144263 - RNA, 19 nt, Homo sapiens
cuacaaagcuuucucaaac

SEQ ID NO: 1144264 - RNA, 19 nt, Homo sapiens
guaagucugucuucuguug

SEQ ID NO: 1144265 - RNA, 19 nt, Homo sapiens
cgacggcacuugauaaugu

SEQ ID NO: 1144266 - RNA, 19 nt, Homo sapiens
uaacagcgcauuccuuuga

SEQ ID NO: 1144267 - RNA, 19 nt, Homo sapiens
gaacggcaggcucuugauu

SEQ ID NO: 1144268 - RNA, 19 nt, Homo sapiens
ggaccgacggcacuugaua

SEQ ID NO: 1144269 - RNA, 19 nt, Homo sapiens
ccaacgggcugcagaaugg

SEQ ID NO: 1144270 - RNA, 19 nt, Homo sapiens
cuaaacaaauccuuucaca

SEQ ID NO: 1144271 - RNA, 19 nt, Homo sapiens
gcuuguauuuccuuagauu

SEQ ID NO: 1144272 - RNA, 19 nt, Homo sapiens
cagcggaaagcucuuauuu

SEQ ID NO: 1144273 - RNA, 19 nt, Homo sapiens
gcucuugauuucaucuuug

SEQ ID NO: 1144274 - RNA, 19 nt, Homo sapiens
gagacuuagugcccuugua

SEQ ID NO: 1144275 - RNA, 19 nt, Homo sapiens
ggaccuguauugggaacaa

SEQ ID NO: 1144276 - RNA, 19 nt, Homo sapiens
ccuaacagcgcauuccuuu

SEQ ID NO: 1144277 - RNA, 19 nt, Homo sapiens
gggagugguucaccuuuua

SEQ ID NO: 1144278 - RNA, 19 nt, Homo sapiens
ugucugaccuugcuucaca

SEQ ID NO: 1144279 - RNA, 19 nt, Homo sapiens
agacuuagugcccuuguaa

SEQ ID NO: 1144280 - RNA, 19 nt, Homo sapiens
gaccgacggcacuugauaa

SEQ ID NO: 1144281 - RNA, 19 nt, Homo sapiens
gcucuuauuugggauuuua

SEQ ID NO: 1144282 - RNA, 19 nt, Homo sapiens
ugucuucuguugcuacuug

SEQ ID NO: 1144283 - RNA, 19 nt, Homo sapiens
cggcuuguauuuccuuaga

SEQ ID NO: 1144284 - RNA, 19 nt, Homo sapiens
ggaagugcccacggacgua

SEQ ID NO: 1144285 - RNA, 19 nt, Homo sapiens
acaaagcuuucucaaacug

SEQ ID NO: 1144286 - RNA, 19 nt, Homo sapiens
ccgcaaggauggaaaauga

SEQ ID NO: 1144287 - RNA, 19 nt, Homo sapiens
accagaagcuguaccacaa

SEQ ID NO: 1144288 - RNA, 19 nt, Homo sapiens
ggacugauugucugaccuu

SEQ ID NO: 1144289 - RNA, 19 nt, Homo sapiens
ggcgcugccuucucuuuga

SEQ ID NO: 1144290 - RNA, 19 nt, Homo sapiens
ccaccgcugucaucacugu

SEQ ID NO: 1144291 - RNA, 19 nt, Homo sapiens
aaaccugccucagcggaaa

SEQ ID NO: 1144292 - RNA, 19 nt, Homo sapiens
ggcaggcucuugauuucau

SEQ ID NO: 1144293 - RNA, 19 nt, Homo sapiens
cccaggaacuguaggaagu

SEQ ID NO: 1144294 - RNA, 19 nt, Homo sapiens
gaccauccugugugaguuu

SEQ ID NO: 1144295 - RNA, 19 nt, Homo sapiens
gcagaauggcuacguguac

SEQ ID NO: 1144296 - RNA, 19 nt, Homo sapiens
cggccaaccuugucguuca

SEQ ID NO: 1144297 - RNA, 19 nt, Homo sapiens
gauaacggagcacuaugga

SEQ ID NO: 1144298 - RNA, 19 nt, Homo sapiens
gagacccucuacaaagcuu

SEQ ID NO: 1144299 - RNA, 19 nt, Homo sapiens
accacaaccugcaggagua

SEQ ID NO: 1144300 - RNA, 19 nt, Homo sapiens
uuagugcccuuguaagucu

SEQ ID NO: 1144301 - RNA, 19 nt, Homo sapiens
gcugccuucucuuugauga

SEQ ID NO: 1144302 - RNA, 19 nt, Homo sapiens
ggcucuugauuucaucuuu

SEQ ID NO: 1144303 - RNA, 19 nt, Homo sapiens
gggacgcacagaaacauga

SEQ ID NO: 1144304 - RNA, 19 nt, Homo sapiens
guccuugagugaccagaga

SEQ ID NO: 1144305 - RNA, 19 nt, Homo sapiens
gcgcugccuucucuuugau

SEQ ID NO: 1144306 - RNA, 19 nt, Homo sapiens
uugagugaccagagacuua

SEQ ID NO: 1144307 - RNA, 19 nt, Homo sapiens
gcgcauuccuuugauuggu

SEQ ID NO: 1144308 - RNA, 19 nt, Homo sapiens
caccaccgcugucaucacu

SEQ ID NO: 1144309 - RNA, 19 nt, Homo sapiens
ugaugacucuuuccugcau

SEQ ID NO: 1144310 - RNA, 19 nt, Homo sapiens
ucuacaaagcuuucucaaa

SEQ ID NO: 1144311 - RNA, 19 nt, Homo sapiens
gacggcacuugauaaugug

SEQ ID NO: 1144312 - RNA, 19 nt, Homo sapiens
uccaaucauuugcuucaga

SEQ ID NO: 1144313 - RNA, 19 nt, Homo sapiens
ucucuuugaugacucuuuc

SEQ ID NO: 1144314 - RNA, 19 nt, Homo sapiens
uccagaccauccuguguga

SEQ ID NO: 1144315 - RNA, 19 nt, Homo sapiens
cagcgcauuccuuugauug

SEQ ID NO: 1144316 - RNA, 19 nt, Homo sapiens
acagcgcauuccuuugauu

SEQ ID NO: 1144317 - RNA, 19 nt, Homo sapiens
gcaggcucuugauuucauc

SEQ ID NO: 1144318 - RNA, 19 nt, Homo sapiens
ggaacgcgugcaucucugu

SEQ ID NO: 1144319 - RNA, 19 nt, Homo sapiens
uuguaagucugucuucugu

SEQ ID NO: 1144320 - RNA, 19 nt, Homo sapiens
caugucgggucccucuuuc

SEQ ID NO: 1144321 - RNA, 19 nt, Homo sapiens
ccucagcggaaagcucuua

SEQ ID NO: 1144322 - RNA, 19 nt, Homo sapiens
uacaaagcuuucucaaacu

SEQ ID NO: 1144323 - RNA, 19 nt, Homo sapiens
cagaauggcuacguguacu

SEQ ID NO: 1144324 - RNA, 19 nt, Homo sapiens
ucaugucgggucccucuuu

SEQ ID NO: 1144325 - RNA, 19 nt, Homo sapiens
ccaaccuugucguucauca

SEQ ID NO: 1144326 - RNA, 19 nt, Homo sapiens
acggcaggcucuugauuuc

SEQ ID NO: 1144327 - RNA, 19 nt, Homo sapiens
gggcgcugccuucucuuug

SEQ ID NO: 1144328 - RNA, 19 nt, Homo sapiens
ggggagugguucaccuuuu

SEQ ID NO: 1144329 - RNA, 19 nt, Homo sapiens
ggacgcacagaaacaugau

SEQ ID NO: 1144330 - RNA, 19 nt, Homo sapiens
ucccuugguuauuguaaau

SEQ ID NO: 1144331 - RNA, 19 nt, Homo sapiens
gccaacgggcugcagaaug

SEQ ID NO: 1144332 - RNA, 19 nt, Homo sapiens
ccgggacgaugagaguauu

SEQ ID NO: 1144333 - RNA, 19 nt, Homo sapiens
ggccaaccuugucguucau

SEQ ID NO: 1144334 - RNA, 19 nt, Homo sapiens
ggcccuacgucuccgucaa

SEQ ID NO: 1144335 - RNA, 19 nt, Homo sapiens
ccgaacggcaggcucuuga

SEQ ID NO: 1144336 - RNA, 19 nt, Homo sapiens
ccaccacgcccuauuucuc

SEQ ID NO: 1144337 - RNA, 19 nt, Homo sapiens
gaacagacauuuagguauc

SEQ ID NO: 1144338 - RNA, 19 nt, Homo sapiens
cagacuaacucucauaaua

SEQ ID NO: 1144339 - RNA, 19 nt, Homo sapiens
gaagaucucugccgaggaa

SEQ ID NO: 1144340 - RNA, 19 nt, Homo sapiens
gaacacaacuuuccugaac

SEQ ID NO: 1144341 - RNA, 19 nt, Homo sapiens
caagggaacuggcuauuau

SEQ ID NO: 1144342 - RNA, 19 nt, Homo sapiens
gagcugagaucaugccauu

SEQ ID NO: 1144343 - RNA, 19 nt, Homo sapiens
uaagaaaugucgaggguuu

SEQ ID NO: 1144344 - RNA, 19 nt, Homo sapiens
gagaagaccucaucuggau

SEQ ID NO: 1144345 - RNA, 19 nt, Homo sapiens
gcagugagcugagaucaug

SEQ ID NO: 1144346 - RNA, 19 nt, Homo sapiens
ggaauaucguggaguguaa

SEQ ID NO: 1144347 - RNA, 19 nt, Homo sapiens
gagaagaaggugaaagaua

SEQ ID NO: 1144348 - RNA, 19 nt, Homo sapiens
gcacguguccugacuguaa

SEQ ID NO: 1144349 - RNA, 19 nt, Homo sapiens
ggaagaagcugcggaaguc

SEQ ID NO: 1144350 - RNA, 19 nt, Homo sapiens
gcaccaaacucugcucuga

SEQ ID NO: 1144351 - RNA, 19 nt, Homo sapiens
agagacaacugcauacuuu

SEQ ID NO: 1144352 - RNA, 19 nt, Homo sapiens
gcgagaagauuucgucaga

SEQ ID NO: 1144353 - RNA, 19 nt, Homo sapiens
gagcaaaguuaacaaaucu

SEQ ID NO: 1144354 - RNA, 19 nt, Homo sapiens
agaggaagcugaccugauu

SEQ ID NO: 1144355 - RNA, 19 nt, Homo sapiens
ggaagauccucagcuauga

SEQ ID NO: 1144356 - RNA, 19 nt, Homo sapiens
ggaaggagcaacagugaaa

SEQ ID NO: 1144357 - RNA, 19 nt, Homo sapiens
ggaacuggcuauuauucaa

SEQ ID NO: 1144358 - RNA, 19 nt, Homo sapiens
ccaacaaccugaugaacuu

SEQ ID NO: 1144359 - RNA, 19 nt, Homo sapiens
gaacggcuagugaaaguaa

SEQ ID NO: 1144360 - RNA, 19 nt, Homo sapiens
gaaaguaacgugaaggaau

SEQ ID NO: 1144361 - RNA, 19 nt, Homo sapiens
gggaaagucucaugaaugg

SEQ ID NO: 1144362 - RNA, 19 nt, Homo sapiens
uaucucagguccuuucuaa

SEQ ID NO: 1144363 - RNA, 19 nt, Homo sapiens
gcaccuaucccaaguguga

SEQ ID NO: 1144364 - RNA, 19 nt, Homo sapiens
aaaguaacgugaaggaauu

SEQ ID NO: 1144365 - RNA, 19 nt, Homo sapiens
caucuguucuuaaguauga

SEQ ID NO: 1144366 - RNA, 19 nt, Homo sapiens
caaauuagccuccagaagu

SEQ ID NO: 1144367 - RNA, 19 nt, Homo sapiens
ggucagauguuuauucuac

SEQ ID NO: 1144368 - RNA, 19 nt, Homo sapiens
ccacauuuguuucuagauu

SEQ ID NO: 1144369 - RNA, 19 nt, Homo sapiens
ccaagaggaugaacaacuu

SEQ ID NO: 1144370 - RNA, 19 nt, Homo sapiens
cgacgaagcuagagaccaa

SEQ ID NO: 1144371 - RNA, 19 nt, Homo sapiens
aaacagaggcccauaguug

SEQ ID NO: 1144372 - RNA, 19 nt, Homo sapiens
gaagagcgagugcagauug

SEQ ID NO: 1144373 - RNA, 19 nt, Homo sapiens
agaagaaggugaaagauag

SEQ ID NO: 1144374 - RNA, 19 nt, Homo sapiens
ggagcaagaucauucauac

SEQ ID NO: 1144375 - RNA, 19 nt, Homo sapiens
ccacaggugcugccaaaua

SEQ ID NO: 1144376 - RNA, 19 nt, Homo sapiens
gaggagaguucgcugauag

SEQ ID NO: 1144377 - RNA, 19 nt, Homo sapiens
cgaagggccuacaugagua

SEQ ID NO: 1144378 - RNA, 19 nt, Homo sapiens
uaagggagcugaggaacaa

SEQ ID NO: 1144379 - RNA, 19 nt, Homo sapiens
uaagugaccuccgaaguga

SEQ ID NO: 1144380 - RNA, 19 nt, Homo sapiens
aacaguaccugcagaagua

SEQ ID NO: 1144381 - RNA, 19 nt, Homo sapiens
cuagaaaucaggccaauaa

SEQ ID NO: 1144382 - RNA, 19 nt, Homo sapiens
gcagaagaaucgcuuaaac

SEQ ID NO: 1144383 - RNA, 19 nt, Homo sapiens
ggaggagaguucgcugaua

SEQ ID NO: 1144384 - RNA, 19 nt, Homo sapiens
gauggaagccuugcaguuu

SEQ ID NO: 1144385 - RNA, 19 nt, Homo sapiens
cgaagaaacugggcuacaa

SEQ ID NO: 1144386 - RNA, 19 nt, Homo sapiens
uguaugaucuggccaagaa

SEQ ID NO: 1144387 - RNA, 19 nt, Homo sapiens
gcccuaauuugcagacuaa

SEQ ID NO: 1144388 - RNA, 19 nt, Homo sapiens
gaaggcaucuacaauuguc

SEQ ID NO: 1144389 - RNA, 19 nt, Homo sapiens
gaaggugaaagauagcaua

SEQ ID NO: 1144390 - RNA, 19 nt, Homo sapiens
gagcuucacuagccaggaa

SEQ ID NO: 1144391 - RNA, 19 nt, Homo sapiens
aaucauccaucuguucuua

SEQ ID NO: 1144392 - RNA, 19 nt, Homo sapiens
ccaacgagaucgaggaugu

SEQ ID NO: 1144393 - RNA, 19 nt, Homo sapiens
caugaaaucuaacuuccuu

SEQ ID NO: 1144394 - RNA, 19 nt, Homo sapiens
gacaugaccaggagaauga

SEQ ID NO: 1144395 - RNA, 19 nt, Homo sapiens
ggugaaagauagcauagca

SEQ ID NO: 1144396 - RNA, 19 nt, Homo sapiens
caagaucauucauacacuu

SEQ ID NO: 1144397 - RNA, 19 nt, Homo sapiens
gaacaguaccugcagaagu

SEQ ID NO: 1144398 - RNA, 19 nt, Homo sapiens
ggaagagaaaguuugauga

SEQ ID NO: 1144399 - RNA, 19 nt, Homo sapiens
ugaaugaacagaaggauga

SEQ ID NO: 1144400 - RNA, 19 nt, Homo sapiens
gaugaggucacccaaauau

SEQ ID NO: 1144401 - RNA, 19 nt, Homo sapiens
aaauuagccuccagaaguu

SEQ ID NO: 1144402 - RNA, 19 nt, Homo sapiens
gcacauaagcaacaucauc

SEQ ID NO: 1144403 - RNA, 19 nt, Homo sapiens
gaaagauagcauagcagua

SEQ ID NO: 1144404 - RNA, 19 nt, Homo sapiens
ggagaaucauccaucuguu

SEQ ID NO: 1144405 - RNA, 19 nt, Homo sapiens
uggaaggcaucuacaauug

SEQ ID NO: 1144406 - RNA, 19 nt, Homo sapiens
gaacugcuuaucccuuaaa

SEQ ID NO: 1144407 - RNA, 19 nt, Homo sapiens
ugguagagcugugcaagua

SEQ ID NO: 1144408 - RNA, 19 nt, Homo sapiens
gaauacagcccaggcagaa

SEQ ID NO: 1144409 - RNA, 19 nt, Homo sapiens
gcaggauagugaauggauu

SEQ ID NO: 1144410 - RNA, 19 nt, Homo sapiens
ccagaguguucuccaugua

SEQ ID NO: 1144411 - RNA, 19 nt, Homo sapiens
gcagaccgauucuaauugc

SEQ ID NO: 1144412 - RNA, 19 nt, Homo sapiens
cgaagggcguuuccaugaa

SEQ ID NO: 1144413 - RNA, 19 nt, Homo sapiens
ucccagaauuaaugucuua

SEQ ID NO: 1144414 - RNA, 19 nt, Homo sapiens
ggacaacuucgagacauuu

SEQ ID NO: 1144415 - RNA, 19 nt, Homo sapiens
ggaggcacgugauaagaca

SEQ ID NO: 1144416 - RNA, 19 nt, Homo sapiens
ccagcuugcuucugaaaug

SEQ ID NO: 1144417 - RNA, 19 nt, Homo sapiens
cauguaaguucacccaaga

SEQ ID NO: 1144418 - RNA, 19 nt, Homo sapiens
gccggaagauccucagcua

SEQ ID NO: 1144419 - RNA, 19 nt, Homo sapiens
ccaugaggcuagaccauug

SEQ ID NO: 1144420 - RNA, 19 nt, Homo sapiens
gugaaauccugaagcaguu

SEQ ID NO: 1144421 - RNA, 19 nt, Homo sapiens
ccaucuugguuguguguua

SEQ ID NO: 1144422 - RNA, 19 nt, Homo sapiens
gcaaauuaguggacagacu

SEQ ID NO: 1144423 - RNA, 19 nt, Homo sapiens
uaacagaaaguaacgugaa

SEQ ID NO: 1144424 - RNA, 19 nt, Homo sapiens
gaagucgccaucagauuga

SEQ ID NO: 1144425 - RNA, 19 nt, Homo sapiens
gcagagggaagagagauuu

SEQ ID NO: 1144426 - RNA, 19 nt, Homo sapiens
gaagggcguuuccaugaac

SEQ ID NO: 1144427 - RNA, 19 nt, Homo sapiens
gcagaauuccaaacgauug

SEQ ID NO: 1144428 - RNA, 19 nt, Homo sapiens
gagaaaacauguaaguuca

SEQ ID NO: 1144429 - RNA, 19 nt, Homo sapiens
caaagcuucugacuuccaa

SEQ ID NO: 1144430 - RNA, 19 nt, Homo sapiens
caccguaugugcccugaaa

SEQ ID NO: 1144431 - RNA, 19 nt, Homo sapiens
ucuacaaggugcaguuuga

SEQ ID NO: 1144432 - RNA, 19 nt, Homo sapiens
guggauaccuacacucuag

SEQ ID NO: 1144433 - RNA, 19 nt, Homo sapiens
gguacagacuaucauugaa

SEQ ID NO: 1144434 - RNA, 19 nt, Homo sapiens
gaauggagcuaaaaucaca

SEQ ID NO: 1144435 - RNA, 19 nt, Homo sapiens
ucuauaguguccagaauau

SEQ ID NO: 1144436 - RNA, 19 nt, Homo sapiens
cuacaugaaugaacagaag

SEQ ID NO: 1144437 - RNA, 19 nt, Homo sapiens
gaaacggagucuaagcuuu

SEQ ID NO: 1144438 - RNA, 19 nt, Homo sapiens
ugaaauaccuacaugagaa

SEQ ID NO: 1144439 - RNA, 19 nt, Homo sapiens
cagaagaacuuugcuaaga

SEQ ID NO: 1144440 - RNA, 19 nt, Homo sapiens
gagaaggccuugagucauc

SEQ ID NO: 1144441 - RNA, 19 nt, Homo sapiens
gcagugaaauaccuacaug

SEQ ID NO: 1144442 - RNA, 19 nt, Homo sapiens
ugaggaagcuacacaugaa

SEQ ID NO: 1144443 - RNA, 19 nt, Homo sapiens
gcucugaagugcaucaaga

SEQ ID NO: 1144444 - RNA, 19 nt, Homo sapiens
gggaagcucuuugcucuga

SEQ ID NO: 1144445 - RNA, 19 nt, Homo sapiens
gaaugagauugcuguguug

SEQ ID NO: 1144446 - RNA, 19 nt, Homo sapiens
gaacagaauggcaucaugu

SEQ ID NO: 1144447 - RNA, 19 nt, Homo sapiens
ggaacagaauggcaucaug

SEQ ID NO: 1144448 - RNA, 19 nt, Homo sapiens
agaaugagauugcuguguu

SEQ ID NO: 1144449 - RNA, 19 nt, Homo sapiens
ggacuuuauuugccacuug

SEQ ID NO: 1144450 - RNA, 19 nt, Homo sapiens
cuacguggcuccagaagug

SEQ ID NO: 1144451 - RNA, 19 nt, Homo sapiens
ggcaaugggucgaaaggaa

SEQ ID NO: 1144452 - RNA, 19 nt, Homo sapiens
ggaagaaacagaccaccaa

SEQ ID NO: 1144453 - RNA, 19 nt, Homo sapiens
ggagggcuacuaugaguuu

SEQ ID NO: 1144454 - RNA, 19 nt, Homo sapiens
gaagaugacugcaguuccu

SEQ ID NO: 1144455 - RNA, 19 nt, Homo sapiens
ugagauugcuguguugaaa

SEQ ID NO: 1144456 - RNA, 19 nt, Homo sapiens
acuggagucugucucauua

SEQ ID NO: 1144457 - RNA, 19 nt, Homo sapiens
ucaaggagggcuacuauga

SEQ ID NO: 1144458 - RNA, 19 nt, Homo sapiens
gaucaaggagggcuacuau

SEQ ID NO: 1144459 - RNA, 19 nt, Homo sapiens
cgucaucaccuacauauug

SEQ ID NO: 1144460 - RNA, 19 nt, Homo sapiens
gaucaagcaugaaaacauu

SEQ ID NO: 1144461 - RNA, 19 nt, Homo sapiens
gaaacucaagccucagaaa

SEQ ID NO: 1144462 - RNA, 19 nt, Homo sapiens
gaaaaccugcuuuaccuua

SEQ ID NO: 1144463 - RNA, 19 nt, Homo sapiens
gcaaguggagcagggcuua

SEQ ID NO: 1144464 - RNA, 19 nt, Homo sapiens
gaucaggagcuuucucaga

SEQ ID NO: 1144465 - RNA, 19 nt, Homo sapiens
gaggucaugguaccaguua

SEQ ID NO: 1144466 - RNA, 19 nt, Homo sapiens
gggcuuagcaggagcaguu

SEQ ID NO: 1144467 - RNA, 19 nt, Homo sapiens
gaacauugggagcaaagga

SEQ ID NO: 1144468 - RNA, 19 nt, Homo sapiens
gaaauaccuacaugagaau

SEQ ID NO: 1144469 - RNA, 19 nt, Homo sapiens
acagcagccuggagaauga

SEQ ID NO: 1144470 - RNA, 19 nt, Homo sapiens
uuccaaaccuggugucuau

SEQ ID NO: 1144471 - RNA, 19 nt, Homo sapiens
ugaagugcaucaagaaguc

SEQ ID NO: 1144472 - RNA, 19 nt, Homo sapiens
gaaacagaccaccaacauc

SEQ ID NO: 1144473 - RNA, 19 nt, Homo sapiens
ucaacugccuggucaaugg

SEQ ID NO: 1144474 - RNA, 19 nt, Homo sapiens
gcccagagguggagaacag

SEQ ID NO: 1144475 - RNA, 19 nt, Homo sapiens
acauauugcucuguggaua

SEQ ID NO: 1144476 - RNA, 19 nt, Homo sapiens
caugaucacugacuuuggu

SEQ ID NO: 1144477 - RNA, 19 nt, Homo sapiens
ggucaugguaccaguuaaa

SEQ ID NO: 1144478 - RNA, 19 nt, Homo sapiens
gaagcucuuugcucugaag

SEQ ID NO: 1144479 - RNA, 19 nt, Homo sapiens
caucguccacagagacuua

SEQ ID NO: 1144480 - RNA, 19 nt, Homo sapiens
ggucuugucggcagugaaa

SEQ ID NO: 1144481 - RNA, 19 nt, Homo sapiens
caacuccucugcucuucca

SEQ ID NO: 1144482 - RNA, 19 nt, Homo sapiens
gagucugucucauuaugug

SEQ ID NO: 1144483 - RNA, 19 nt, Homo sapiens
agaagaacuuugcuaagag

SEQ ID NO: 1144484 - RNA, 19 nt, Homo sapiens
gccacuugcuugagaagga

SEQ ID NO: 1144485 - RNA, 19 nt, Homo sapiens
ccaauuacccugccagcau

SEQ ID NO: 1144486 - RNA, 19 nt, Homo sapiens
gugagaaggccuugaguca

SEQ ID NO: 1144487 - RNA, 19 nt, Homo sapiens
ggaggaaggcagagcaagu

SEQ ID NO: 1144488 - RNA, 19 nt, Homo sapiens
gugaaauaccuacaugaga

SEQ ID NO: 1144489 - RNA, 19 nt, Homo sapiens
caagucggaggucauggua

SEQ ID NO: 1144490 - RNA, 19 nt, Homo sapiens
cuucaacucuggaggcaau

SEQ ID NO: 1144491 - RNA, 19 nt, Homo sapiens
cagccaaggacuuuauuug

SEQ ID NO: 1144492 - RNA, 19 nt, Homo sapiens
gaagaagaugacugcaguu

SEQ ID NO: 1144493 - RNA, 19 nt, Homo sapiens
ggacagcagccuggagaau

SEQ ID NO: 1144494 - RNA, 19 nt, Homo sapiens
caggagacauauucaacuc

SEQ ID NO: 1144495 - RNA, 19 nt, Homo sapiens
gcaauuuucaggagacaua

SEQ ID NO: 1144496 - RNA, 19 nt, Homo sapiens
gaagaaacggagucuaagc

SEQ ID NO: 1144497 - RNA, 19 nt, Homo sapiens
gagcaccacccacuacuac

SEQ ID NO: 1144498 - RNA, 19 nt, Homo sapiens
ugaccugccugcucuaugc

SEQ ID NO: 1144499 - RNA, 19 nt, Homo sapiens
gcguagaagccuuguugaa

SEQ ID NO: 1144500 - RNA, 19 nt, Homo sapiens
ggaagcucuuugcucugaa

SEQ ID NO: 1144501 - RNA, 19 nt, Homo sapiens
gaggaaggcagagcaagug

SEQ ID NO: 1144502 - RNA, 19 nt, Homo sapiens
uggagucugucucauuaug

SEQ ID NO: 1144503 - RNA, 19 nt, Homo sapiens
ccagcugccugaacauugg

SEQ ID NO: 1144504 - RNA, 19 nt, Homo sapiens
gaguuugagucuccauucu

SEQ ID NO: 1144505 - RNA, 19 nt, Homo sapiens
aaggagggcuacuaugagu

SEQ ID NO: 1144506 - RNA, 19 nt, Homo sapiens
augaagaaacggagucuaa

SEQ ID NO: 1144507 - RNA, 19 nt, Homo sapiens
agaaacagaccaccaacau

SEQ ID NO: 1144508 - RNA, 19 nt, Homo sapiens
gugccuaugucacugcaau

SEQ ID NO: 1144509 - RNA, 19 nt, Homo sapiens
ucccugcccugacccaauu

SEQ ID NO: 1144510 - RNA, 19 nt, Homo sapiens
agucuaagcuuuucgagaa

SEQ ID NO: 1144511 - RNA, 19 nt, Homo sapiens
gacagcagccuggagaaug

SEQ ID NO: 1144512 - RNA, 19 nt, Homo sapiens
gaagcugugagcaggagaa

SEQ ID NO: 1144513 - RNA, 19 nt, Homo sapiens
gaauggcaucguccacaga

SEQ ID NO: 1144514 - RNA, 19 nt, Homo sapiens
gggaucaggagcuuucuca

SEQ ID NO: 1144515 - RNA, 19 nt, Homo sapiens
ggagucugucucauuaugu

SEQ ID NO: 1144516 - RNA, 19 nt, Homo sapiens
gccuccagauccagaagaa

SEQ ID NO: 1144517 - RNA, 19 nt, Homo sapiens
gagcgguacaccugugaga

SEQ ID NO: 1144518 - RNA, 19 nt, Homo sapiens
gagaaugagauugcugugu

SEQ ID NO: 1144519 - RNA, 19 nt, Homo sapiens
gguggcaggucccucaacu

SEQ ID NO: 1144520 - RNA, 19 nt, Homo sapiens
uccagaagaacuuugcuaa

SEQ ID NO: 1144521 - RNA, 19 nt, Homo sapiens
caaggagggcuacuaugag

SEQ ID NO: 1144522 - RNA, 19 nt, Homo sapiens
ccaucggcgucaucaccua

SEQ ID NO: 1144523 - RNA, 19 nt, Homo sapiens
cguagaagccuuguugaag

SEQ ID NO: 1144524 - RNA, 19 nt, Homo sapiens
gcugggaucaggagcuuuc

SEQ ID NO: 1144525 - RNA, 19 nt, Homo sapiens
caauggcucccuccacauc

SEQ ID NO: 1144526 - RNA, 19 nt, Homo sapiens
ccucagaagcuucaacucu

SEQ ID NO: 1144527 - RNA, 19 nt, Homo sapiens
gccuaugucacugcaauuu

SEQ ID NO: 1144528 - RNA, 19 nt, Homo sapiens
ggaggucaugguaccaguu

SEQ ID NO: 1144529 - RNA, 19 nt, Homo sapiens
aaacggagucuaagcuuuu

SEQ ID NO: 1144530 - RNA, 19 nt, Homo sapiens
gucgaaaggaagaagauga

SEQ ID NO: 1144531 - RNA, 19 nt, Homo sapiens
gugcugggaucaggagcuu

SEQ ID NO: 1144532 - RNA, 19 nt, Homo sapiens
ccagaagaacuuugcuaag

SEQ ID NO: 1144533 - RNA, 19 nt, Homo sapiens
ccacuugcuugagaaggau

SEQ ID NO: 1144534 - RNA, 19 nt, Homo sapiens
gacccuggaggacaucuau

SEQ ID NO: 1144535 - RNA, 19 nt, Homo sapiens
uagaagccuuguugaagcu

SEQ ID NO: 1144536 - RNA, 19 nt, Homo sapiens
gggcuacuaugaguuugag

SEQ ID NO: 1144537 - RNA, 19 nt, Homo sapiens
ucacaacgacgaagucaua

SEQ ID NO: 1144538 - RNA, 19 nt, Homo sapiens
gagggugggcucuauauuu

SEQ ID NO: 1144539 - RNA, 19 nt, Homo sapiens
gacaagagcgugcgcauca

SEQ ID NO: 1144540 - RNA, 19 nt, Homo sapiens
gaccucaucuacaauguca

SEQ ID NO: 1144541 - RNA, 19 nt, Homo sapiens
cgacauguccuuccgcaaa

SEQ ID NO: 1144542 - RNA, 19 nt, Homo sapiens
ugagggcgcuggucaagga

SEQ ID NO: 1144543 - RNA, 19 nt, Homo sapiens
gcaagcagcgggaccugaa

SEQ ID NO: 1144544 - RNA, 19 nt, Homo sapiens
gcaaauuccggcauguguu

SEQ ID NO: 1144545 - RNA, 19 nt, Homo sapiens
ccacaauggcagccuguuu

SEQ ID NO: 1144546 - RNA, 19 nt, Homo sapiens
ucaugacugugccaagaaa

SEQ ID NO: 1144547 - RNA, 19 nt, Homo sapiens
cgucaugacugugccaaga

SEQ ID NO: 1144548 - RNA, 19 nt, Homo sapiens
ccagugcuaugaggacauu

SEQ ID NO: 1144549 - RNA, 19 nt, Homo sapiens
gacauguccuuccgcaaag

SEQ ID NO: 1144550 - RNA, 19 nt, Homo sapiens
caagaacgaccagugcuau

SEQ ID NO: 1144551 - RNA, 19 nt, Homo sapiens
caaauuccggcauguguuc

SEQ ID NO: 1144552 - RNA, 19 nt, Homo sapiens
acccugaccucaucuacaa

SEQ ID NO: 1144553 - RNA, 19 nt, Homo sapiens
ggagggugggcucuauauu

SEQ ID NO: 1144554 - RNA, 19 nt, Homo sapiens
gcgcccagcuuuccucacu

SEQ ID NO: 1144555 - RNA, 19 nt, Homo sapiens
gaaagucggaccucuucca

SEQ ID NO: 1144556 - RNA, 19 nt, Homo sapiens
ucaagaacgaccagugcua

SEQ ID NO: 1144557 - RNA, 19 nt, Homo sapiens
gcccagcuuuccucacugu

SEQ ID NO: 1144558 - RNA, 19 nt, Homo sapiens
cgacugguguccucacaac

SEQ ID NO: 1144559 - RNA, 19 nt, Homo sapiens
ccaaguuccuggcggugau

SEQ ID NO: 1144560 - RNA, 19 nt, Homo sapiens
gaacgaccagugcuaugag

SEQ ID NO: 1144561 - RNA, 19 nt, Homo sapiens
cagcgggaccugaagauca

SEQ ID NO: 1144562 - RNA, 19 nt, Homo sapiens
uguggcagaucccagagaa

SEQ ID NO: 1144563 - RNA, 19 nt, Homo sapiens
gggagggugggcucuauau

SEQ ID NO: 1144564 - RNA, 19 nt, Homo sapiens
ugcaugagcgcaaguguga

SEQ ID NO: 1144565 - RNA, 19 nt, Homo sapiens
gcagauggcaagguguuca

SEQ ID NO: 1144566 - RNA, 19 nt, Homo sapiens
ggcagccggucaagaacga

SEQ ID NO: 1144567 - RNA, 19 nt, Homo sapiens
cgacaacgugguacucauc

SEQ ID NO: 1144568 - RNA, 19 nt, Homo sapiens
gagcaaauuccggcaugug

SEQ ID NO: 1144569 - RNA, 19 nt, Homo sapiens
gcgacaacgugguacucau

SEQ ID NO: 1144570 - RNA, 19 nt, Homo sapiens
agaacgaccagugcuauga

SEQ ID NO: 1144571 - RNA, 19 nt, Homo sapiens
auucgcgugucccguguua

SEQ ID NO: 1144572 - RNA, 19 nt, Homo sapiens
uacauccacuuccugaaca

SEQ ID NO: 1144573 - RNA, 19 nt, Homo sapiens
caagagcgugcgcaucauc

SEQ ID NO: 1144574 - RNA, 19 nt, Homo sapiens
gaagcuggaggaggugaug

SEQ ID NO: 1144575 - RNA, 19 nt, Homo sapiens
gacagagccggugguggua

SEQ ID NO: 1144576 - RNA, 19 nt, Homo sapiens
agggugggcucuauauuuu

SEQ ID NO: 1144577 - RNA, 19 nt, Homo sapiens
ucgggcagccggucaagaa

SEQ ID NO: 1144578 - RNA, 19 nt, Homo sapiens
caccaccacugcugcugau

SEQ ID NO: 1144579 - RNA, 19 nt, Homo sapiens
ggucagcaagugcgagauc

SEQ ID NO: 1144580 - RNA, 19 nt, Homo sapiens
gccuggaggucagcaagug

SEQ ID NO: 1144581 - RNA, 19 nt, Homo sapiens
ccauggcccugcaggaacu

SEQ ID NO: 1144582 - RNA, 19 nt, Homo sapiens
ucuacaaugucagcuggaa

SEQ ID NO: 1144583 - RNA, 19 nt, Homo sapiens
gcaagggugacuccagcau

SEQ ID NO: 1144584 - RNA, 19 nt, Homo sapiens
uagaauaccugcugaagaa

SEQ ID NO: 1144585 - RNA, 19 nt, Homo sapiens
ggaaugcucuucgcuuuau

SEQ ID NO: 1144586 - RNA, 19 nt, Homo sapiens
ggacagaugcccugagauu

SEQ ID NO: 1144587 - RNA, 19 nt, Homo sapiens
guccagagcugccgacauu

SEQ ID NO: 1144588 - RNA, 19 nt, Homo sapiens
cgacauuucugcaacaaga

SEQ ID NO: 1144589 - RNA, 19 nt, Homo sapiens
ggagagggauccugauguc

SEQ ID NO: 1144590 - RNA, 19 nt, Homo sapiens
gauaaugucugugcugagu

SEQ ID NO: 1144591 - RNA, 19 nt, Homo sapiens
gaagguacaaguugcagaa

SEQ ID NO: 1144592 - RNA, 19 nt, Homo sapiens
gaaugaggagauugagaua

SEQ ID NO: 1144593 - RNA, 19 nt, Homo sapiens
gcaacaagaucuggaaugc

SEQ ID NO: 1144594 - RNA, 19 nt, Homo sapiens
gaacuggcagcacugguuu

SEQ ID NO: 1144595 - RNA, 19 nt, Homo sapiens
ggaaugaggagauugagau

SEQ ID NO: 1144596 - RNA, 19 nt, Homo sapiens
cugcagagcuggccauugu

SEQ ID NO: 1144597 - RNA, 19 nt, Homo sapiens
ugacacggcucaagucuac

SEQ ID NO: 1144598 - RNA, 19 nt, Homo sapiens
ggagauugagauaaacuuu

SEQ ID NO: 1144599 - RNA, 19 nt, Homo sapiens
gagggauccugauguccua

SEQ ID NO: 1144600 - RNA, 19 nt, Homo sapiens
gcugagaagcggaaauuug

SEQ ID NO: 1144601 - RNA, 19 nt, Homo sapiens
uaaugucugugcugaguga

SEQ ID NO: 1144602 - RNA, 19 nt, Homo sapiens
augaggagauugagauaaa

SEQ ID NO: 1144603 - RNA, 19 nt, Homo sapiens
gcuuuauccucaaugcuuu

SEQ ID NO: 1144604 - RNA, 19 nt, Homo sapiens
gcccugagauucacacucu

SEQ ID NO: 1144605 - RNA, 19 nt, Homo sapiens
gguacaaguugcagaagca

SEQ ID NO: 1144606 - RNA, 19 nt, Homo sapiens
gcccggagcucuaacucau

SEQ ID NO: 1144607 - RNA, 19 nt, Homo sapiens
gggaaaagauaaugucugu

SEQ ID NO: 1144608 - RNA, 19 nt, Homo sapiens
gcagggucuucaccgguuu

SEQ ID NO: 1144609 - RNA, 19 nt, Homo sapiens
ccagacgacucgcgauaca

SEQ ID NO: 1144610 - RNA, 19 nt, Homo sapiens
cuggaaugcucuucgcuuu

SEQ ID NO: 1144611 - RNA, 19 nt, Homo sapiens
caaccucugugacgucuac

SEQ ID NO: 1144612 - RNA, 19 nt, Homo sapiens
gcacugguuuucccauauu

SEQ ID NO: 1144613 - RNA, 19 nt, Homo sapiens
gauccagcuaccucuguua

SEQ ID NO: 1144614 - RNA, 19 nt, Homo sapiens
ccacguaccagcucaccaa

SEQ ID NO: 1144615 - RNA, 19 nt, Homo sapiens
ccggagcucuaacucauca

SEQ ID NO: 1144616 - RNA, 19 nt, Homo sapiens
uccggcagcugauggauga

SEQ ID NO: 1144617 - RNA, 19 nt, Homo sapiens
ugggacagaugcccugaga

SEQ ID NO: 1144618 - RNA, 19 nt, Homo sapiens
cgaggcagagguuguggua

SEQ ID NO: 1144619 - RNA, 19 nt, Homo sapiens
ggacgucagagacuaugug

SEQ ID NO: 1144620 - RNA, 19 nt, Homo sapiens
acagaugcccugagauuca

SEQ ID NO: 1144621 - RNA, 19 nt, Homo sapiens
ggaaacgggcagcgaccuu

SEQ ID NO: 1144622 - RNA, 19 nt, Homo sapiens
ggacacagacuggcuuggu

SEQ ID NO: 1144623 - RNA, 19 nt, Homo sapiens
gguagcagcggaacugaca

SEQ ID NO: 1144624 - RNA, 19 nt, Homo sapiens
guccaucgccuucauugug

SEQ ID NO: 1144625 - RNA, 19 nt, Homo sapiens
uggaaugcucuucgcuuua

SEQ ID NO: 1144626 - RNA, 19 nt, Homo sapiens
agaccuugcucguuucuac

SEQ ID NO: 1144627 - RNA, 19 nt, Homo sapiens
gcagggagaagaggacugu

SEQ ID NO: 1144628 - RNA, 19 nt, Homo sapiens
gauagaauaccugcugaag

SEQ ID NO: 1144629 - RNA, 19 nt, Homo sapiens
ggacucagaggcaacaaaa

SEQ ID NO: 1144630 - RNA, 19 nt, Homo sapiens
ccagagcugccgacauuuc

SEQ ID NO: 1144631 - RNA, 19 nt, Homo sapiens
gcagcuugauagccucaca

SEQ ID NO: 1144632 - RNA, 19 nt, Homo sapiens
cggcucaagucuacaugga

SEQ ID NO: 1144633 - RNA, 19 nt, Homo sapiens
gacgcugccuggagaugug

SEQ ID NO: 1144634 - RNA, 19 nt, Homo sapiens
ggaaccacaaggccagaga

SEQ ID NO: 1144635 - RNA, 19 nt, Homo sapiens
ccccagaccuugcucguuu

SEQ ID NO: 1144636 - RNA, 19 nt, Homo sapiens
gccggaagaugagcaaguc

SEQ ID NO: 1144637 - RNA, 19 nt, Homo sapiens
ugacugugguguccuugag

SEQ ID NO: 1144638 - RNA, 19 nt, Homo sapiens
gggaaugaggagauugaga

SEQ ID NO: 1144639 - RNA, 19 nt, Homo sapiens
cguaccagcucaccaaagc

SEQ ID NO: 1144640 - RNA, 19 nt, Homo sapiens
gaaugcucuucgcuuuauc

SEQ ID NO: 1144641 - RNA, 19 nt, Homo sapiens
aagcugagaagcggaaauu

SEQ ID NO: 1144642 - RNA, 19 nt, Homo sapiens
ggcagagguugugguagga

SEQ ID NO: 1144643 - RNA, 19 nt, Homo sapiens
ucacaguccugccgaugcu

SEQ ID NO: 1144644 - RNA, 19 nt, Homo sapiens
ccaucgccuucauugugua

SEQ ID NO: 1144645 - RNA, 19 nt, Homo sapiens
gacagaugcccugagauuc

SEQ ID NO: 1144646 - RNA, 19 nt, Homo sapiens
ggacccaagagacaucauc

SEQ ID NO: 1144647 - RNA, 19 nt, Homo sapiens
gaaugugcuggacccaaga

SEQ ID NO: 1144648 - RNA, 19 nt, Homo sapiens
caccacuucuggcuucaca

SEQ ID NO: 1144649 - RNA, 19 nt, Homo sapiens
ggguggagaugcaguugcu

SEQ ID NO: 1144650 - RNA, 19 nt, Homo sapiens
gacccaagagacaucauca

SEQ ID NO: 1144651 - RNA, 19 nt, Homo sapiens
cagcacugguuuucccaua

SEQ ID NO: 1144652 - RNA, 19 nt, Homo sapiens
agaacuggcagcacugguu

SEQ ID NO: 1144653 - RNA, 19 nt, Homo sapiens
gccgacauuucugcaacaa

SEQ ID NO: 1144654 - RNA, 19 nt, Homo sapiens
cugagaagcggaaauuugg

SEQ ID NO: 1144655 - RNA, 19 nt, Homo sapiens
gugcuggacccaagagaca

SEQ ID NO: 1144656 - RNA, 19 nt, Homo sapiens
ggaccaugcgcagggagaa

SEQ ID NO: 1144657 - RNA, 19 nt, Homo sapiens
uuuguccgcugccaggaaa

SEQ ID NO: 1144658 - RNA, 19 nt, Homo sapiens
gaacuuugaucacugcuua

SEQ ID NO: 1144659 - RNA, 19 nt, Homo sapiens
gauaguaccuugucuguau

SEQ ID NO: 1144660 - RNA, 19 nt, Homo sapiens
ggaggucacucaauucaaa

SEQ ID NO: 1144661 - RNA, 19 nt, Homo sapiens
gaucacugcuuacuaggua

SEQ ID NO: 1144662 - RNA, 19 nt, Homo sapiens
gagaggcccuggagucuaa

SEQ ID NO: 1144663 - RNA, 19 nt, Homo sapiens
gagacgccaucaauaaaua

SEQ ID NO: 1144664 - RNA, 19 nt, Homo sapiens
gaacgagacgccaucaaua

SEQ ID NO: 1144665 - RNA, 19 nt, Homo sapiens
gagcugagaucaugccauu

SEQ ID NO: 1144666 - RNA, 19 nt, Homo sapiens
gcagucagcuaugaugaua

SEQ ID NO: 1144667 - RNA, 19 nt, Homo sapiens
gcuccagccuuaucaguua

SEQ ID NO: 1144668 - RNA, 19 nt, Homo sapiens
ugaauucucugaucacaaa

SEQ ID NO: 1144669 - RNA, 19 nt, Homo sapiens
ggaccgagaucccuucaga

SEQ ID NO: 1144670 - RNA, 19 nt, Homo sapiens
guauaaagcuugcccuugu

SEQ ID NO: 1144671 - RNA, 19 nt, Homo sapiens
gaaguacgauucuggaagu

SEQ ID NO: 1144672 - RNA, 19 nt, Homo sapiens
uaaaggagaugguagauac

SEQ ID NO: 1144673 - RNA, 19 nt, Homo sapiens
gagccuuucuugcacuuua

SEQ ID NO: 1144674 - RNA, 19 nt, Homo sapiens
ggcuagagcuggagaugua

SEQ ID NO: 1144675 - RNA, 19 nt, Homo sapiens
gcuuagaggugcucacuga

SEQ ID NO: 1144676 - RNA, 19 nt, Homo sapiens
acagaaacuugucagauaa

SEQ ID NO: 1144677 - RNA, 19 nt, Homo sapiens
guagauaccguuagauuau

SEQ ID NO: 1144678 - RNA, 19 nt, Homo sapiens
ggaccauguuccucauuaa

SEQ ID NO: 1144679 - RNA, 19 nt, Homo sapiens
gguguuaacuuacuuugau

SEQ ID NO: 1144680 - RNA, 19 nt, Homo sapiens
guaccgagcugagaucaug

SEQ ID NO: 1144681 - RNA, 19 nt, Homo sapiens
ggacucagcucggaauucu

SEQ ID NO: 1144682 - RNA, 19 nt, Homo sapiens
ccaggaagcagauguugua

SEQ ID NO: 1144683 - RNA, 19 nt, Homo sapiens
gaagcacuccacaaacuaa

SEQ ID NO: 1144684 - RNA, 19 nt, Homo sapiens
caacacauaaccuuacuga

SEQ ID NO: 1144685 - RNA, 19 nt, Homo sapiens
uaagucuacugauuuggua

SEQ ID NO: 1144686 - RNA, 19 nt, Homo sapiens
gagagaugcuggcuacaca

SEQ ID NO: 1144687 - RNA, 19 nt, Homo sapiens
gaagcuggccuuuccauag

SEQ ID NO: 1144688 - RNA, 19 nt, Homo sapiens
uaccuugucuguauaagaa

SEQ ID NO: 1144689 - RNA, 19 nt, Homo sapiens
gcagcuaguucuucaugug

SEQ ID NO: 1144690 - RNA, 19 nt, Homo sapiens
gguaagaacuuugaucacu

SEQ ID NO: 1144691 - RNA, 19 nt, Homo sapiens
ggaaggagaggccagucua

SEQ ID NO: 1144692 - RNA, 19 nt, Homo sapiens
gggaagcuuugcuacuuug

SEQ ID NO: 1144693 - RNA, 19 nt, Homo sapiens
aggaaagcauucagcauuu

SEQ ID NO: 1144694 - RNA, 19 nt, Homo sapiens
ggauaaggacagaaacuug

SEQ ID NO: 1144695 - RNA, 19 nt, Homo sapiens
caggaaagcauucagcauu

SEQ ID NO: 1144696 - RNA, 19 nt, Homo sapiens
caucagccauugacagugu

SEQ ID NO: 1144697 - RNA, 19 nt, Homo sapiens
guacugcuuuaaaguuaga

SEQ ID NO: 1144698 - RNA, 19 nt, Homo sapiens
ugguaaaggugguuucuug

SEQ ID NO: 1144699 - RNA, 19 nt, Homo sapiens
guaaaggagaugguagaua

SEQ ID NO: 1144700 - RNA, 19 nt, Homo sapiens
uggcagaccuaauggauca

SEQ ID NO: 1144701 - RNA, 19 nt, Homo sapiens
cagaagcccucuccauugg

SEQ ID NO: 1144702 - RNA, 19 nt, Homo sapiens
ccagaagcccucuccauug

SEQ ID NO: 1144703 - RNA, 19 nt, Homo sapiens
uggaccauguuccucauua

SEQ ID NO: 1144704 - RNA, 19 nt, Homo sapiens
gauaaggacagaaacuugu

SEQ ID NO: 1144705 - RNA, 19 nt, Homo sapiens
ccaccgaggagaccaagua

SEQ ID NO: 1144706 - RNA, 19 nt, Homo sapiens
agccagugguguuaacuua

SEQ ID NO: 1144707 - RNA, 19 nt, Homo sapiens
gcccuggagucuaaaauua

SEQ ID NO: 1144708 - RNA, 19 nt, Homo sapiens
uaaaguaaaggagauggua

SEQ ID NO: 1144709 - RNA, 19 nt, Homo sapiens
ggccgaagcacuccacaaa

SEQ ID NO: 1144710 - RNA, 19 nt, Homo sapiens
aagcuggccuuuccauaga

SEQ ID NO: 1144711 - RNA, 19 nt, Homo sapiens
ccuaauggaucacugucuu

SEQ ID NO: 1144712 - RNA, 19 nt, Homo sapiens
uuucuaggcugaaccuuga

SEQ ID NO: 1144713 - RNA, 19 nt, Homo sapiens
guaaagaauguuuguacug

SEQ ID NO: 1144714 - RNA, 19 nt, Homo sapiens
gguaaagaauguuuguacu

SEQ ID NO: 1144715 - RNA, 19 nt, Homo sapiens
acaucugucuguccgcuua

SEQ ID NO: 1144716 - RNA, 19 nt, Homo sapiens
gcaccacuccgcacucuuc

SEQ ID NO: 1144717 - RNA, 19 nt, Homo sapiens
ggaaagcauucagcauuuu

SEQ ID NO: 1144718 - RNA, 19 nt, Homo sapiens
uagcagagccuuucuugca

SEQ ID NO: 1144719 - RNA, 19 nt, Homo sapiens
gggaccucauuaccuauuu

SEQ ID NO: 1144720 - RNA, 19 nt, Homo sapiens
uauaaagcuugcccuuguu

SEQ ID NO: 1144721 - RNA, 19 nt, Homo sapiens
gaaaccccgucucuacuaa

SEQ ID NO: 1144722 - RNA, 19 nt, Homo sapiens
uaaaggugguuucuugcau

SEQ ID NO: 1144723 - RNA, 19 nt, Homo sapiens
gcucggaauucuguauaga

SEQ ID NO: 1144724 - RNA, 19 nt, Homo sapiens
gcuuagucaucacaucauu

SEQ ID NO: 1144725 - RNA, 19 nt, Homo sapiens
guuacagaguggagaggua

SEQ ID NO: 1144726 - RNA, 19 nt, Homo sapiens
cuacugauuugguauaggu

SEQ ID NO: 1144727 - RNA, 19 nt, Homo sapiens
ugacaaaucauggcuuaga

SEQ ID NO: 1144728 - RNA, 19 nt, Homo sapiens
aacccaggcuucuuuauuc

SEQ ID NO: 1144729 - RNA, 19 nt, Homo sapiens
aaacccaggcuucuuuauu

SEQ ID NO: 1144730 - RNA, 19 nt, Homo sapiens
ugacauaggaaagguauau

SEQ ID NO: 1144731 - RNA, 19 nt, Homo sapiens
gaucucguuuugacaauaa

SEQ ID NO: 1144732 - RNA, 19 nt, Homo sapiens
ugaacacugucucaaauac

SEQ ID NO: 1144733 - RNA, 19 nt, Homo sapiens
auugacaaaucauggcuua

SEQ ID NO: 1144734 - RNA, 19 nt, Homo sapiens
aagaauguuuguacuguuc

SEQ ID NO: 1144735 - RNA, 19 nt, Homo sapiens
ccgaauggcugaagaucca

SEQ ID NO: 1144736 - RNA, 19 nt, Homo sapiens
guacgauucuggaaguuuu

SEQ ID NO: 1144737 - RNA, 19 nt, Homo sapiens
ccgaagcacuccacaaacu

SEQ ID NO: 1144738 - RNA, 19 nt, Homo sapiens
cagaagugccugcucuuga

SEQ ID NO: 1144739 - RNA, 19 nt, Homo sapiens
caucacaucauuucacugu

SEQ ID NO: 1144740 - RNA, 19 nt, Homo sapiens
gagagaaaauuaagucuac

SEQ ID NO: 1144741 - RNA, 19 nt, Homo sapiens
gacaaaucauggcuuagag

SEQ ID NO: 1144742 - RNA, 19 nt, Homo sapiens
cuggagauguaauugguuu

SEQ ID NO: 1144743 - RNA, 19 nt, Homo sapiens
uucaauggcuucaagacaa

SEQ ID NO: 1144744 - RNA, 19 nt, Homo sapiens
ugggaagcuuugcuacuuu

SEQ ID NO: 1144745 - RNA, 19 nt, Homo sapiens
ggcaugcuccucuuucuau

SEQ ID NO: 1144746 - RNA, 19 nt, Homo sapiens
gauaaguggagccucuuug

SEQ ID NO: 1144747 - RNA, 19 nt, Homo sapiens
cgaagcacuccacaaacua

SEQ ID NO: 1144748 - RNA, 19 nt, Homo sapiens
uuauuucucuucacugugu

SEQ ID NO: 1144749 - RNA, 19 nt, Homo sapiens
aacgagacgccaucaauaa

SEQ ID NO: 1144750 - RNA, 19 nt, Homo sapiens
auaagaagcuggccuuucc

SEQ ID NO: 1144751 - RNA, 19 nt, Homo sapiens
gaagauccagcagccuuga

SEQ ID NO: 1144752 - RNA, 19 nt, Homo sapiens
ggcuaaagcuacccauguc

SEQ ID NO: 1144753 - RNA, 19 nt, Homo sapiens
gcaugcuccucuuucuaug

SEQ ID NO: 1144754 - RNA, 19 nt, Homo sapiens
ggaagaagccauuuuguac

SEQ ID NO: 1144755 - RNA, 19 nt, Homo sapiens
gcugagaucaugccauuac

SEQ ID NO: 1144756 - RNA, 19 nt, Homo sapiens
uaccuuggcuuugacauag

SEQ ID NO: 1144757 - RNA, 19 nt, Homo sapiens
agaagugccugcucuugag

SEQ ID NO: 1144758 - RNA, 19 nt, Homo sapiens
ggaaguggaucaaacagua

SEQ ID NO: 1144759 - RNA, 19 nt, Homo sapiens
gaacaaguguccuucagaa

SEQ ID NO: 1144760 - RNA, 19 nt, Homo sapiens
gagaguaucuugcagaaau

SEQ ID NO: 1144761 - RNA, 19 nt, Homo sapiens
ggagugacaugaaguuuga

SEQ ID NO: 1144762 - RNA, 19 nt, Homo sapiens
ggcagaagguuauguaauu

SEQ ID NO: 1144763 - RNA, 19 nt, Homo sapiens
ggagaaauacuguuacauu

SEQ ID NO: 1144764 - RNA, 19 nt, Homo sapiens
caaauacaauucugaagga

SEQ ID NO: 1144765 - RNA, 19 nt, Homo sapiens
ucaaggaauuugccaagua

SEQ ID NO: 1144766 - RNA, 19 nt, Homo sapiens
gauacgacauggaaucauu

SEQ ID NO: 1144767 - RNA, 19 nt, Homo sapiens
gacagaaccuccacucaau

SEQ ID NO: 1144768 - RNA, 19 nt, Homo sapiens
uauagaagaugaugguuug

SEQ ID NO: 1144769 - RNA, 19 nt, Homo sapiens
gcagagggauuugaagaga

SEQ ID NO: 1144770 - RNA, 19 nt, Homo sapiens
caaggaauuugccaaguau

SEQ ID NO: 1144771 - RNA, 19 nt, Homo sapiens
gcagaagguuauguaauug

SEQ ID NO: 1144772 - RNA, 19 nt, Homo sapiens
gaaggacuaugaagaguac

SEQ ID NO: 1144773 - RNA, 19 nt, Homo sapiens
ucucagauguuguugauga

SEQ ID NO: 1144774 - RNA, 19 nt, Homo sapiens
gaagaaguuuguuauagac

SEQ ID NO: 1144775 - RNA, 19 nt, Homo sapiens
cagaagaaguuuguuauag

SEQ ID NO: 1144776 - RNA, 19 nt, Homo sapiens
ucaaugcgaucaaccagaa

SEQ ID NO: 1144777 - RNA, 19 nt, Homo sapiens
ggcauguucugauauguuu

SEQ ID NO: 1144778 - RNA, 19 nt, Homo sapiens
gcugcuagcugacaaauac

SEQ ID NO: 1144779 - RNA, 19 nt, Homo sapiens
caugaaguuugaacacuaa

SEQ ID NO: 1144780 - RNA, 19 nt, Homo sapiens
gagaauuacuacagauaca

SEQ ID NO: 1144781 - RNA, 19 nt, Homo sapiens
gaaguuuguuauagacguu

SEQ ID NO: 1144782 - RNA, 19 nt, Homo sapiens
gacauggaaucauugaaga

SEQ ID NO: 1144783 - RNA, 19 nt, Homo sapiens
ccugggaccugaaauauuc

SEQ ID NO: 1144784 - RNA, 19 nt, Homo sapiens
agacugggaucuuauggaa

SEQ ID NO: 1144785 - RNA, 19 nt, Homo sapiens
ccagaagaaguuuguuaua

SEQ ID NO: 1144786 - RNA, 19 nt, Homo sapiens
agaagaugaugguuuguug

SEQ ID NO: 1144787 - RNA, 19 nt, Homo sapiens
gauugcagguagagauauu

SEQ ID NO: 1144788 - RNA, 19 nt, Homo sapiens
guaugagaauuacuacaga

SEQ ID NO: 1144789 - RNA, 19 nt, Homo sapiens
ggaauccaaaugugacuuu

SEQ ID NO: 1144790 - RNA, 19 nt, Homo sapiens
ugugaggcauguucugaua

SEQ ID NO: 1144791 - RNA, 19 nt, Homo sapiens
ccaagaaggacuaugaaga

SEQ ID NO: 1144792 - RNA, 19 nt, Homo sapiens
agacguugguuacgaaaga

SEQ ID NO: 1144793 - RNA, 19 nt, Homo sapiens
cagagaguaucuugcagaa

SEQ ID NO: 1144794 - RNA, 19 nt, Homo sapiens
cuacauaugcuacaaagug

SEQ ID NO: 1144795 - RNA, 19 nt, Homo sapiens
gugcuguaauccaaaguuu

SEQ ID NO: 1144796 - RNA, 19 nt, Homo sapiens
caaaagccauuaaggagaa

SEQ ID NO: 1144797 - RNA, 19 nt, Homo sapiens
acaugaaguuugaacacua

SEQ ID NO: 1144798 - RNA, 19 nt, Homo sapiens
caagaaggacuaugaagag

SEQ ID NO: 1144799 - RNA, 19 nt, Homo sapiens
gaagcugcaucaaacacau

SEQ ID NO: 1144800 - RNA, 19 nt, Homo sapiens
guaccaggacucuacauug

SEQ ID NO: 1144801 - RNA, 19 nt, Homo sapiens
uauagacguugguuacgaa

SEQ ID NO: 1144802 - RNA, 19 nt, Homo sapiens
ugacagaaccuccacucaa

SEQ ID NO: 1144803 - RNA, 19 nt, Homo sapiens
ugaaggaauccaaauguga

SEQ ID NO: 1144804 - RNA, 19 nt, Homo sapiens
ggaacaaguguccuucaga

SEQ ID NO: 1144805 - RNA, 19 nt, Homo sapiens
gauaaaccuacauaugcua

SEQ ID NO: 1144806 - RNA, 19 nt, Homo sapiens
guucugauauguuuauagg

SEQ ID NO: 1144807 - RNA, 19 nt, Homo sapiens
guuauggagugcuguaauc

SEQ ID NO: 1144808 - RNA, 19 nt, Homo sapiens
gaugaaauacuuccuugca

SEQ ID NO: 1144809 - RNA, 19 nt, Homo sapiens
ugaggcauguucugauaug

SEQ ID NO: 1144810 - RNA, 19 nt, Homo sapiens
ggagugcuguaauccaaag

SEQ ID NO: 1144811 - RNA, 19 nt, Homo sapiens
guaauuggaagcugcauca

SEQ ID NO: 1144812 - RNA, 19 nt, Homo sapiens
guauaagaaugucguacuc

SEQ ID NO: 1144813 - RNA, 19 nt, Homo sapiens
aaacagagaguaucuugca

SEQ ID NO: 1144814 - RNA, 19 nt, Homo sapiens
gaaaacagagaguaucuug

SEQ ID NO: 1144815 - RNA, 19 nt, Homo sapiens
gaagccaucgauaaaccua

SEQ ID NO: 1144816 - RNA, 19 nt, Homo sapiens
gaauuacuacagauacaug

SEQ ID NO: 1144817 - RNA, 19 nt, Homo sapiens
acaccaagaaggacuauga

SEQ ID NO: 1144818 - RNA, 19 nt, Homo sapiens
cgauauagucaaggaauuu

SEQ ID NO: 1144819 - RNA, 19 nt, Homo sapiens
ggugaguguuggaugaaau

SEQ ID NO: 1144820 - RNA, 19 nt, Homo sapiens
guacaucuggcugauacua

SEQ ID NO: 1144821 - RNA, 19 nt, Homo sapiens
gaauuugccaaguaugaug

SEQ ID NO: 1144822 - RNA, 19 nt, Homo sapiens
ucaaacacaucccgauugc

SEQ ID NO: 1144823 - RNA, 19 nt, Homo sapiens
uaacguaccaggacucuac

SEQ ID NO: 1144824 - RNA, 19 nt, Homo sapiens
gaguaucuugcagaaauua

SEQ ID NO: 1144825 - RNA, 19 nt, Homo sapiens
cagagagucagcaaaggua

SEQ ID NO: 1144826 - RNA, 19 nt, Homo sapiens
gaaccugaggaccauuauu

SEQ ID NO: 1144827 - RNA, 19 nt, Homo sapiens
gcuacaaaguggccgauac

SEQ ID NO: 1144828 - RNA, 19 nt, Homo sapiens
gaagaugaugguuuguugu

SEQ ID NO: 1144829 - RNA, 19 nt, Homo sapiens
auacuaagcacgaauagau

SEQ ID NO: 1144830 - RNA, 19 nt, Homo sapiens
agauguuguugaugaagua

SEQ ID NO: 1144831 - RNA, 19 nt, Homo sapiens
aaccugaggaccauuauuu

SEQ ID NO: 1144832 - RNA, 19 nt, Homo sapiens
uaaauaucuucgagcugaa

SEQ ID NO: 1144833 - RNA, 19 nt, Homo sapiens
ccacauguuugcuagaaaa

SEQ ID NO: 1144834 - RNA, 19 nt, Homo sapiens
ccgauauagucaaggaauu

SEQ ID NO: 1144835 - RNA, 19 nt, Homo sapiens
caucaaacacaucccgauu

SEQ ID NO: 1144836 - RNA, 19 nt, Homo sapiens
cgacauggaaucauugaag

SEQ ID NO: 1144837 - RNA, 19 nt, Homo sapiens
gaucaaccagaagaaguuu

SEQ ID NO: 1144838 - RNA, 19 nt, Homo sapiens
aaagguaguugaccaagcu

SEQ ID NO: 1144839 - RNA, 19 nt, Homo sapiens
cgauaaaccuacauaugcu

SEQ ID NO: 1144840 - RNA, 19 nt, Homo sapiens
caucagagagucagcaaag

SEQ ID NO: 1144841 - RNA, 19 nt, Homo sapiens
aaaccuacauaugcuacaa

SEQ ID NO: 1144842 - RNA, 19 nt, Homo sapiens
aaccagaagaaguuuguua

SEQ ID NO: 1144843 - RNA, 19 nt, Homo sapiens
uaacggggauagucauuga

SEQ ID NO: 1144844 - RNA, 19 nt, Homo sapiens
gugaguguuggaugaaaua

SEQ ID NO: 1144845 - RNA, 19 nt, Homo sapiens
guucauuauuccuucaugu

SEQ ID NO: 1144846 - RNA, 19 nt, Homo sapiens
gaacacuaaacaguaaugu

SEQ ID NO: 1144847 - RNA, 19 nt, Homo sapiens
gcugacaaauacaauucug

SEQ ID NO: 1144848 - RNA, 19 nt, Homo sapiens
gauauagucaaggaauuug

SEQ ID NO: 1144849 - RNA, 19 nt, Homo sapiens
agaguaucuugcagaaauu

SEQ ID NO: 1144850 - RNA, 19 nt, Homo sapiens
acagaaccuccacucaaua

SEQ ID NO: 1144851 - RNA, 19 nt, Homo sapiens
aguguuggaugaaauacuu

SEQ ID NO: 1144852 - RNA, 19 nt, Homo sapiens
ugaacuuucuggagcuguu

SEQ ID NO: 1144853 - RNA, 19 nt, Homo sapiens
gacaugaaguuugaacacu

SEQ ID NO: 1144854 - RNA, 19 nt, Homo sapiens
gggaacaaguguccuucag

SEQ ID NO: 1144855 - RNA, 19 nt, Homo sapiens
agaagguuauguaauugga

SEQ ID NO: 1144856 - RNA, 19 nt, Homo sapiens
gggaucuuauggaaagguu

SEQ ID NO: 1144857 - RNA, 19 nt, Homo sapiens
auacuuccuugcaccauug

SEQ ID NO: 1144858 - RNA, 19 nt, Homo sapiens
gaagaacgccaacaacauu

SEQ ID NO: 1144859 - RNA, 19 nt, Homo sapiens
gaagaagcccauuccauuu

SEQ ID NO: 1144860 - RNA, 19 nt, Homo sapiens
cacagcaggugcaauauuu

SEQ ID NO: 1144861 - RNA, 19 nt, Homo sapiens
cagcgcaguuucugugaua

SEQ ID NO: 1144862 - RNA, 19 nt, Homo sapiens
guacgacuccucuuugauu

SEQ ID NO: 1144863 - RNA, 19 nt, Homo sapiens
uaucacagcaggugcaaua

SEQ ID NO: 1144864 - RNA, 19 nt, Homo sapiens
gauagcuagugccaucaua

SEQ ID NO: 1144865 - RNA, 19 nt, Homo sapiens
gaagaugacaggcgagaau

SEQ ID NO: 1144866 - RNA, 19 nt, Homo sapiens
gagaagaacgccaacaaca

SEQ ID NO: 1144867 - RNA, 19 nt, Homo sapiens
caacauuucugagaucuac

SEQ ID NO: 1144868 - RNA, 19 nt, Homo sapiens
ugacaacauuucugagauc

SEQ ID NO: 1144869 - RNA, 19 nt, Homo sapiens
gcagcugccucccacaagu

SEQ ID NO: 1144870 - RNA, 19 nt, Homo sapiens
gagcuggccuuuccuuuug

SEQ ID NO: 1144871 - RNA, 19 nt, Homo sapiens
gcagaacaugcacgauaaa

SEQ ID NO: 1144872 - RNA, 19 nt, Homo sapiens
cauuugagcccuauauuuc

SEQ ID NO: 1144873 - RNA, 19 nt, Homo sapiens
ccauuugagcccuauauuu

SEQ ID NO: 1144874 - RNA, 19 nt, Homo sapiens
aagggaaccugcagcuuga

SEQ ID NO: 1144875 - RNA, 19 nt, Homo sapiens
agaagcccauuccauuuga

SEQ ID NO: 1144876 - RNA, 19 nt, Homo sapiens
gauguacgacuccucuuug

SEQ ID NO: 1144877 - RNA, 19 nt, Homo sapiens
uguccagccugaacuuaaa

SEQ ID NO: 1144878 - RNA, 19 nt, Homo sapiens
agucaagccucacagaugu

SEQ ID NO: 1144879 - RNA, 19 nt, Homo sapiens
gagucaagccucacagaug

SEQ ID NO: 1144880 - RNA, 19 nt, Homo sapiens
ucacagcaggugcaauauu

SEQ ID NO: 1144881 - RNA, 19 nt, Homo sapiens
gggccuauuucaagaccaa

SEQ ID NO: 1144882 - RNA, 19 nt, Homo sapiens
gcuagugccaucauaggaa

SEQ ID NO: 1144883 - RNA, 19 nt, Homo sapiens
gcuugcugcucuacuucua

SEQ ID NO: 1144884 - RNA, 19 nt, Homo sapiens
guggucagcauugcacuua

SEQ ID NO: 1144885 - RNA, 19 nt, Homo sapiens
ggucagcauugcacuuaac

SEQ ID NO: 1144886 - RNA, 19 nt, Homo sapiens
aagaagcccauuccauuug

SEQ ID NO: 1144887 - RNA, 19 nt, Homo sapiens
ccacaaccauugcuaucac

SEQ ID NO: 1144888 - RNA, 19 nt, Homo sapiens
gcacaccaagaaggaauga

SEQ ID NO: 1144889 - RNA, 19 nt, Homo sapiens
gagcacaccaagaaggaau

SEQ ID NO: 1144890 - RNA, 19 nt, Homo sapiens
ccucuuugauugccagugu

SEQ ID NO: 1144891 - RNA, 19 nt, Homo sapiens
ggaaccugcagcuugacua

SEQ ID NO: 1144892 - RNA, 19 nt, Homo sapiens
ugucgugauucuucucuug

SEQ ID NO: 1144893 - RNA, 19 nt, Homo sapiens
ggagaagaacgccaacaac

SEQ ID NO: 1144894 - RNA, 19 nt, Homo sapiens
auucuugggcgucuucuua

SEQ ID NO: 1144895 - RNA, 19 nt, Homo sapiens
gguggcaaccgccgucuau

SEQ ID NO: 1144896 - RNA, 19 nt, Homo sapiens
gacaacauuucugagaucu

SEQ ID NO: 1144897 - RNA, 19 nt, Homo sapiens
gugccucauugcauucuug

SEQ ID NO: 1144898 - RNA, 19 nt, Homo sapiens
gacauucgcacccaacagu

SEQ ID NO: 1144899 - RNA, 19 nt, Homo sapiens
cuagugccaucauaggaau

SEQ ID NO: 1144900 - RNA, 19 nt, Homo sapiens
gaaccugcagcuugacuac

SEQ ID NO: 1144901 - RNA, 19 nt, Homo sapiens
ccuaccugcuggugacauu

SEQ ID NO: 1144902 - RNA, 19 nt, Homo sapiens
cagcugccucccacaagua

SEQ ID NO: 1144903 - RNA, 19 nt, Homo sapiens
uacgacuccucuuugauug

SEQ ID NO: 1144904 - RNA, 19 nt, Homo sapiens
gcaccucguggucagcauu

SEQ ID NO: 1144905 - RNA, 19 nt, Homo sapiens
augcuugucuuguccauuc

SEQ ID NO: 1144906 - RNA, 19 nt, Homo sapiens
ugguggagaucauucuguu

SEQ ID NO: 1144907 - RNA, 19 nt, Homo sapiens
caugguggcugggccuguu

SEQ ID NO: 1144908 - RNA, 19 nt, Homo sapiens
ccagaaguacugccacauc

SEQ ID NO: 1144909 - RNA, 19 nt, Homo sapiens
caacagucacgagaagaug

SEQ ID NO: 1144910 - RNA, 19 nt, Homo sapiens
uaaucacgcguaacaggaa

SEQ ID NO: 1144911 - RNA, 19 nt, Homo sapiens
agaagaacgccaacaacau

SEQ ID NO: 1144912 - RNA, 19 nt, Homo sapiens
uggaugccaugccagguau

SEQ ID NO: 1144913 - RNA, 19 nt, Homo sapiens
gaagcccauuccauuugag

SEQ ID NO: 1144914 - RNA, 19 nt, Homo sapiens
gcuacauucuguccacaac

SEQ ID NO: 1144915 - RNA, 19 nt, Homo sapiens
ccaugacaguggugacagu

SEQ ID NO: 1144916 - RNA, 19 nt, Homo sapiens
caacauugucgugauucuu

SEQ ID NO: 1144917 - RNA, 19 nt, Homo sapiens
ccaacagucacgagaagau

SEQ ID NO: 1144918 - RNA, 19 nt, Homo sapiens
gccaucauaggaaucauau

SEQ ID NO: 1144919 - RNA, 19 nt, Homo sapiens
cagcaggugcaauauuuua

SEQ ID NO: 1144920 - RNA, 19 nt, Homo sapiens
agugugggcuacauucugu

SEQ ID NO: 1144921 - RNA, 19 nt, Homo sapiens
gcgcuacgucuuguccuuu

SEQ ID NO: 1144922 - RNA, 19 nt, Homo sapiens
agauguacgacuccucuuu

SEQ ID NO: 1144923 - RNA, 19 nt, Homo sapiens
uggcugggaugcuugucuu

SEQ ID NO: 1144924 - RNA, 19 nt, Homo sapiens
gcaguuucugugauagcua

SEQ ID NO: 1144925 - RNA, 19 nt, Homo sapiens
ggcgcuacgucuuguccuu

SEQ ID NO: 1144926 - RNA, 19 nt, Homo sapiens
uagagcacaccaagaagga

SEQ ID NO: 1144927 - RNA, 19 nt, Homo sapiens
uugggcgucuucuuaauca

SEQ ID NO: 1144928 - RNA, 19 nt, Homo sapiens
uccuagagcacaccaagaa

SEQ ID NO: 1144929 - RNA, 19 nt, Homo sapiens
cacaaccauugcuaucaca

SEQ ID NO: 1144930 - RNA, 19 nt, Homo sapiens
ucugcuugcugcucuacuu

SEQ ID NO: 1144931 - RNA, 19 nt, Homo sapiens
gcgaggccuccuucuccua

SEQ ID NO: 1144932 - RNA, 19 nt, Homo sapiens
gagcaaagauggcuuccua

SEQ ID NO: 1144933 - RNA, 19 nt, Homo sapiens
caccauggcuggcuaauuu

SEQ ID NO: 1144934 - RNA, 19 nt, Homo sapiens
caacuucccuggcucaauu

SEQ ID NO: 1144935 - RNA, 19 nt, Homo sapiens
acacgcaccuucucacuua

SEQ ID NO: 1144936 - RNA, 19 nt, Homo sapiens
caacaugcccuguaauaaa

SEQ ID NO: 1144937 - RNA, 19 nt, Homo sapiens
ccuguacucucuuucauua

SEQ ID NO: 1144938 - RNA, 19 nt, Homo sapiens
ucaagaaggucuccuacuu

SEQ ID NO: 1144939 - RNA, 19 nt, Homo sapiens
ccagucaucgcuaauauua

SEQ ID NO: 1144940 - RNA, 19 nt, Homo sapiens
gcaaggaggucaucaucca

SEQ ID NO: 1144941 - RNA, 19 nt, Homo sapiens
gcaccuaugggaagaagua

SEQ ID NO: 1144942 - RNA, 19 nt, Homo sapiens
ccagugagcugagcauguu

SEQ ID NO: 1144943 - RNA, 19 nt, Homo sapiens
ugaaggagcuggaggaacu

SEQ ID NO: 1144944 - RNA, 19 nt, Homo sapiens
gcucauuguucccaucuug

SEQ ID NO: 1144945 - RNA, 19 nt, Homo sapiens
ggugagcccugguggauca

SEQ ID NO: 1144946 - RNA, 19 nt, Homo sapiens
ccacgccacugaccagcua

SEQ ID NO: 1144947 - RNA, 19 nt, Homo sapiens
uggaggaacugcagaacaa

SEQ ID NO: 1144948 - RNA, 19 nt, Homo sapiens
gaccaguccugcugagguu

SEQ ID NO: 1144949 - RNA, 19 nt, Homo sapiens
ccagucuuguucucaauuu

SEQ ID NO: 1144950 - RNA, 19 nt, Homo sapiens
ucaaacccauugcugagaa

SEQ ID NO: 1144951 - RNA, 19 nt, Homo sapiens
ucacaucaaugccaacuac

SEQ ID NO: 1144952 - RNA, 19 nt, Homo sapiens
ccaaagugcugggauuaca

SEQ ID NO: 1144953 - RNA, 19 nt, Homo sapiens
ucauuaaggucuugaaguc

SEQ ID NO: 1144954 - RNA, 19 nt, Homo sapiens
ggcaggaacuggcgcugaa

SEQ ID NO: 1144955 - RNA, 19 nt, Homo sapiens
gguccagcuugaugucuuu

SEQ ID NO: 1144956 - RNA, 19 nt, Homo sapiens
gggaggagcaggcuaggaa

SEQ ID NO: 1144957 - RNA, 19 nt, Homo sapiens
gccugcaccuggagaagua

SEQ ID NO: 1144958 - RNA, 19 nt, Homo sapiens
gcaugccuguacucucuuu

SEQ ID NO: 1144959 - RNA, 19 nt, Homo sapiens
ccacaggaaacaucaagaa

SEQ ID NO: 1144960 - RNA, 19 nt, Homo sapiens
gaacucgucccaccagaag

SEQ ID NO: 1144961 - RNA, 19 nt, Homo sapiens
gccuggagguggccaugua

SEQ ID NO: 1144962 - RNA, 19 nt, Homo sapiens
cuacuacacugugauguuc

SEQ ID NO: 1144963 - RNA, 19 nt, Homo sapiens
ccaacaugcccuguaauaa

SEQ ID NO: 1144964 - RNA, 19 nt, Homo sapiens
gagggccaguuccacauug

SEQ ID NO: 1144965 - RNA, 19 nt, Homo sapiens
agucaucgcuaauauuaca

SEQ ID NO: 1144966 - RNA, 19 nt, Homo sapiens
gaagaaggaaggcagacau

SEQ ID NO: 1144967 - RNA, 19 nt, Homo sapiens
gaggagacgcucaccauag

SEQ ID NO: 1144968 - RNA, 19 nt, Homo sapiens
ucugaggccuuaucugaug

SEQ ID NO: 1144969 - RNA, 19 nt, Homo sapiens
ccgaguagcugggauuaca

SEQ ID NO: 1144970 - RNA, 19 nt, Homo sapiens
ucucaugguuuguagguau

SEQ ID NO: 1144971 - RNA, 19 nt, Homo sapiens
agacuguccuggaaaguuc

SEQ ID NO: 1144972 - RNA, 19 nt, Homo sapiens
aggagacgcucaccauaga

SEQ ID NO: 1144973 - RNA, 19 nt, Homo sapiens
ccagccuuguucuuaauuu

SEQ ID NO: 1144974 - RNA, 19 nt, Homo sapiens
ggaagaaguaguccucucu

SEQ ID NO: 1144975 - RNA, 19 nt, Homo sapiens
cacaaacuuucucaugguu

SEQ ID NO: 1144976 - RNA, 19 nt, Homo sapiens
acacaaacuuucucauggu

SEQ ID NO: 1144977 - RNA, 19 nt, Homo sapiens
cccaacaugcccuguaaua

SEQ ID NO: 1144978 - RNA, 19 nt, Homo sapiens
gugcccagccuuguucuua

SEQ ID NO: 1144979 - RNA, 19 nt, Homo sapiens
gaagcacaacccagccaaa

SEQ ID NO: 1144980 - RNA, 19 nt, Homo sapiens
ggcagaacccuccaucaga

SEQ ID NO: 1144981 - RNA, 19 nt, Homo sapiens
caaggcggcuccccuguuu

SEQ ID NO: 1144982 - RNA, 19 nt, Homo sapiens
ugaacucccuggaccuuuc

SEQ ID NO: 1144983 - RNA, 19 nt, Homo sapiens
aaccacaggucucugaaug

SEQ ID NO: 1144984 - RNA, 19 nt, Homo sapiens
cagguagaguugagauuca

SEQ ID NO: 1144985 - RNA, 19 nt, Homo sapiens
ccgaggaaaucgagagcaa

SEQ ID NO: 1144986 - RNA, 19 nt, Homo sapiens
caaagucugcaucuggauu

SEQ ID NO: 1144987 - RNA, 19 nt, Homo sapiens
gaccuugcauccacagaag

SEQ ID NO: 1144988 - RNA, 19 nt, Homo sapiens
gaggaaaucgagagcaauc

SEQ ID NO: 1144989 - RNA, 19 nt, Homo sapiens
gcccagccuuguucuuaau

SEQ ID NO: 1144990 - RNA, 19 nt, Homo sapiens
gaaggaaggcagacaucuc

SEQ ID NO: 1144991 - RNA, 19 nt, Homo sapiens
gcaaugggguucacuaagg

SEQ ID NO: 1144992 - RNA, 19 nt, Homo sapiens
cgaggagacgcucaccaua

SEQ ID NO: 1144993 - RNA, 19 nt, Homo sapiens
gggagacuguccuggaaag

SEQ ID NO: 1144994 - RNA, 19 nt, Homo sapiens
ccacaucauccucuccaaa

SEQ ID NO: 1144995 - RNA, 19 nt, Homo sapiens
ggagggccaguuccacauu

SEQ ID NO: 1144996 - RNA, 19 nt, Homo sapiens
uuacacaaacuuucucaug

SEQ ID NO: 1144997 - RNA, 19 nt, Homo sapiens
ccacggccagucucucuuu

SEQ ID NO: 1144998 - RNA, 19 nt, Homo sapiens
cagcuucucauccaccuuu

SEQ ID NO: 1144999 - RNA, 19 nt, Homo sapiens
caucaaugccaacuacuuc

SEQ ID NO: 1145000 - RNA, 19 nt, Homo sapiens
gcaccgugguccaucacau

SEQ ID NO: 1145001 - RNA, 19 nt, Homo sapiens
gagacuguccuggaaaguu

SEQ ID NO: 1145002 - RNA, 19 nt, Homo sapiens
cagccagucuuguucucaa

SEQ ID NO: 1145003 - RNA, 19 nt, Homo sapiens
guaguccucucuuccuucu

SEQ ID NO: 1145004 - RNA, 19 nt, Homo sapiens
caucagcgacuucuacuac

SEQ ID NO: 1145005 - RNA, 19 nt, Homo sapiens
acauguggcuccaaagucu

SEQ ID NO: 1145006 - RNA, 19 nt, Homo sapiens
gagauucaaacccacaugu

SEQ ID NO: 1145007 - RNA, 19 nt, Homo sapiens
ccuggucccuggugaagga

SEQ ID NO: 1145008 - RNA, 19 nt, Homo sapiens
ccgggagacuguccuggaa

SEQ ID NO: 1145009 - RNA, 19 nt, Homo sapiens
gaacaagcuggugcacuca

SEQ ID NO: 1145010 - RNA, 19 nt, Homo sapiens
ggacauggaguggcuuuac

SEQ ID NO: 1145011 - RNA, 19 nt, Homo sapiens
aaagucugcaucuggauuu

SEQ ID NO: 1145012 - RNA, 19 nt, Homo sapiens
ucagggaagugaagugacu

SEQ ID NO: 1145013 - RNA, 19 nt, Homo sapiens
caccauagaagcccgauuc

SEQ ID NO: 1145014 - RNA, 19 nt, Homo sapiens
gcacaacccagccaaacac

SEQ ID NO: 1145015 - RNA, 19 nt, Homo sapiens
uuucugaggccuuaucuga

SEQ ID NO: 1145016 - RNA, 19 nt, Homo sapiens
cauccagucaucgcuaaua

SEQ ID NO: 1145017 - RNA, 19 nt, Homo sapiens
guccucagcccauuucaga

SEQ ID NO: 1145018 - RNA, 19 nt, Homo sapiens
gguggacaucggcuacaua

SEQ ID NO: 1145019 - RNA, 19 nt, Homo sapiens
gaagcuaacagggucuugu

SEQ ID NO: 1145020 - RNA, 19 nt, Homo sapiens
uguacucucuuucauuaag

SEQ ID NO: 1145021 - RNA, 19 nt, Homo sapiens
gggcagaacccuccaucag

SEQ ID NO: 1145022 - RNA, 19 nt, Homo sapiens
ggaggaacugcagaacaaa

SEQ ID NO: 1145023 - RNA, 19 nt, Homo sapiens
gaugaggauggcagcauga

SEQ ID NO: 1145024 - RNA, 19 nt, Homo sapiens
caacauggagguggacauc

SEQ ID NO: 1145025 - RNA, 19 nt, Homo sapiens
ccucggcccuuugugaaga

SEQ ID NO: 1145026 - RNA, 19 nt, Homo sapiens
gggcaaggaggucaucauc

SEQ ID NO: 1145027 - RNA, 19 nt, Homo sapiens
aggaaggccuuucaaacca

SEQ ID NO: 1145028 - RNA, 19 nt, Homo sapiens
ugcccagccuuguucuuaa

SEQ ID NO: 1145029 - RNA, 19 nt, Homo sapiens
caggcuagcucuucuaccu

SEQ ID NO: 1145030 - RNA, 19 nt, Homo sapiens
gaggaguucaaacccauug

SEQ ID NO: 1145031 - RNA, 19 nt, Homo sapiens
gaggagcaggcuaggaaga

SEQ ID NO: 1145032 - RNA, 19 nt, Homo sapiens
gggauuagcuuccucauuc

SEQ ID NO: 1145033 - RNA, 19 nt, Homo sapiens
gaaugcaucuguucuucua

SEQ ID NO: 1145034 - RNA, 19 nt, Homo sapiens
ggauggagaucaagauuag

SEQ ID NO: 1145035 - RNA, 19 nt, Homo sapiens
gugaauggcccacugaaua

SEQ ID NO: 1145036 - RNA, 19 nt, Homo sapiens
ggaauucagcuauuuauca

SEQ ID NO: 1145037 - RNA, 19 nt, Homo sapiens
agauuuagcucauuacaug

SEQ ID NO: 1145038 - RNA, 19 nt, Homo sapiens
gcagguggauggagaucaa

SEQ ID NO: 1145039 - RNA, 19 nt, Homo sapiens
aaacuucugucuccacuga

SEQ ID NO: 1145040 - RNA, 19 nt, Homo sapiens
acacaaagaacacucuaua

SEQ ID NO: 1145041 - RNA, 19 nt, Homo sapiens
ucaaagagauuuagcucau

SEQ ID NO: 1145042 - RNA, 19 nt, Homo sapiens
uaucauaacucuugcuaag

SEQ ID NO: 1145043 - RNA, 19 nt, Homo sapiens
uuacaaagcaucaaagaga

SEQ ID NO: 1145044 - RNA, 19 nt, Homo sapiens
gaaugacacuggauguaag

SEQ ID NO: 1145045 - RNA, 19 nt, Homo sapiens
cucauuacaugcagucuua

SEQ ID NO: 1145046 - RNA, 19 nt, Homo sapiens
caaagagauuuagcucauu

SEQ ID NO: 1145047 - RNA, 19 nt, Homo sapiens
ccaggaagaucuaauacca

SEQ ID NO: 1145048 - RNA, 19 nt, Homo sapiens
gacacuggauguaaguuug

SEQ ID NO: 1145049 - RNA, 19 nt, Homo sapiens
gaucuaauaccagagcuaa

SEQ ID NO: 1145050 - RNA, 19 nt, Homo sapiens
ucagacaaguucaggaaau

SEQ ID NO: 1145051 - RNA, 19 nt, Homo sapiens
acauacacauggccaguaa

SEQ ID NO: 1145052 - RNA, 19 nt, Homo sapiens
gaguugggauccugggaaa

SEQ ID NO: 1145053 - RNA, 19 nt, Homo sapiens
ugaaagucauggauacugu

SEQ ID NO: 1145054 - RNA, 19 nt, Homo sapiens
ggagacacauuaaaacuuc

SEQ ID NO: 1145055 - RNA, 19 nt, Homo sapiens
uggauacuguucuuacaaa

SEQ ID NO: 1145056 - RNA, 19 nt, Homo sapiens
ucauggaauucagcuauuu

SEQ ID NO: 1145057 - RNA, 19 nt, Homo sapiens
ugaaugacacuggauguaa

SEQ ID NO: 1145058 - RNA, 19 nt, Homo sapiens
caaagcaucaaagagauuu

SEQ ID NO: 1145059 - RNA, 19 nt, Homo sapiens
caacuggccuuggcuaacu

SEQ ID NO: 1145060 - RNA, 19 nt, Homo sapiens
ggauuagcuuccucauuca

SEQ ID NO: 1145061 - RNA, 19 nt, Homo sapiens
caucuguucuucuauuagu

SEQ ID NO: 1145062 - RNA, 19 nt, Homo sapiens
guuaaguccuucagacaag

SEQ ID NO: 1145063 - RNA, 19 nt, Homo sapiens
ggauacuguuacacaaaga

SEQ ID NO: 1145064 - RNA, 19 nt, Homo sapiens
gaaagucauggauacuguu

SEQ ID NO: 1145065 - RNA, 19 nt, Homo sapiens
cauggaauucagcuauuua

SEQ ID NO: 1145066 - RNA, 19 nt, Homo sapiens
acucauaucucucaguucu

SEQ ID NO: 1145067 - RNA, 19 nt, Homo sapiens
auacucauaucucucaguu

SEQ ID NO: 1145068 - RNA, 19 nt, Homo sapiens
ccaggccaguggauaguga

SEQ ID NO: 1145069 - RNA, 19 nt, Homo sapiens
gcagcaaguccaacacaau

SEQ ID NO: 1145070 - RNA, 19 nt, Homo sapiens
agggaauucuuuagagauu

SEQ ID NO: 1145071 - RNA, 19 nt, Homo sapiens
aaagucauggauacuguua

SEQ ID NO: 1145072 - RNA, 19 nt, Homo sapiens
ucauaucucucaguucugu

SEQ ID NO: 1145073 - RNA, 19 nt, Homo sapiens
agauacuucuuucugcuuu

SEQ ID NO: 1145074 - RNA, 19 nt, Homo sapiens
ugcaucuguucuucuauua

SEQ ID NO: 1145075 - RNA, 19 nt, Homo sapiens
cauggauacuguuacacaa

SEQ ID NO: 1145076 - RNA, 19 nt, Homo sapiens
guucuucuauuagugaaug

SEQ ID NO: 1145077 - RNA, 19 nt, Homo sapiens
agaacacucuauauaacug

SEQ ID NO: 1145078 - RNA, 19 nt, Homo sapiens
ggauagugaccaacucugu

SEQ ID NO: 1145079 - RNA, 19 nt, Homo sapiens
uacaaagcaucaaagagau

SEQ ID NO: 1145080 - RNA, 19 nt, Homo sapiens
caagguuuauugacuucug

SEQ ID NO: 1145081 - RNA, 19 nt, Homo sapiens
ggauacuguucuuacaaag

SEQ ID NO: 1145082 - RNA, 19 nt, Homo sapiens
ugacacuggauguaaguuu

SEQ ID NO: 1145083 - RNA, 19 nt, Homo sapiens
cagacaaguucaggaaauc

SEQ ID NO: 1145084 - RNA, 19 nt, Homo sapiens
gaacacucuauauaacugu

SEQ ID NO: 1145085 - RNA, 19 nt, Homo sapiens
ugaauggcccacugaauag

SEQ ID NO: 1145086 - RNA, 19 nt, Homo sapiens
ggauguaaguuugucuuuu

SEQ ID NO: 1145087 - RNA, 19 nt, Homo sapiens
guugggauccugggaaauu

SEQ ID NO: 1145088 - RNA, 19 nt, Homo sapiens
cacaaagaacacucuauau

SEQ ID NO: 1145089 - RNA, 19 nt, Homo sapiens
gccaguggauagugaccaa

SEQ ID NO: 1145090 - RNA, 19 nt, Homo sapiens
gauuagauccccaagguuu

SEQ ID NO: 1145091 - RNA, 19 nt, Homo sapiens
uggauggagaucaagauua

SEQ ID NO: 1145092 - RNA, 19 nt, Homo sapiens
cauuacaugcagucuuaua

SEQ ID NO: 1145093 - RNA, 19 nt, Homo sapiens
auacuguucuuacaaagca

SEQ ID NO: 1145094 - RNA, 19 nt, Homo sapiens
cuccacugaugacaagaua

SEQ ID NO: 1145095 - RNA, 19 nt, Homo sapiens
uguccaggaagaucuaaua

SEQ ID NO: 1145096 - RNA, 19 nt, Homo sapiens
aaacacucuuuccuaaucu

SEQ ID NO: 1145097 - RNA, 19 nt, Homo sapiens
caucugccuucucaaugga

SEQ ID NO: 1145098 - RNA, 19 nt, Homo sapiens
gauacuguuacacaaagaa

SEQ ID NO: 1145099 - RNA, 19 nt, Homo sapiens
aaaacacucuuuccuaauc

SEQ ID NO: 1145100 - RNA, 19 nt, Homo sapiens
guucuuacaaagcaucaaa

SEQ ID NO: 1145101 - RNA, 19 nt, Homo sapiens
uauggauacuguucuuaca

SEQ ID NO: 1145102 - RNA, 19 nt, Homo sapiens
augcaucuguucuucuauu

SEQ ID NO: 1145103 - RNA, 19 nt, Homo sapiens
caacauccccuagauuuug

SEQ ID NO: 1145104 - RNA, 19 nt, Homo sapiens
gcugagacccacggacuug

SEQ ID NO: 1145105 - RNA, 19 nt, Homo sapiens
gacaaguucaggaaaucaa

SEQ ID NO: 1145106 - RNA, 19 nt, Homo sapiens
agucauggauacuguuaca

SEQ ID NO: 1145107 - RNA, 19 nt, Homo sapiens
gaagccagagccacacaca

SEQ ID NO: 1145108 - RNA, 19 nt, Homo sapiens
caacacaaucacagcaaca

SEQ ID NO: 1145109 - RNA, 19 nt, Homo sapiens
cagcaaguccaacacaauc

SEQ ID NO: 1145110 - RNA, 19 nt, Homo sapiens
gagacccacggacuugauu

SEQ ID NO: 1145111 - RNA, 19 nt, Homo sapiens
gagauuuagcucauuacau

SEQ ID NO: 1145112 - RNA, 19 nt, Homo sapiens
acaaagcaucaaagagauu

SEQ ID NO: 1145113 - RNA, 19 nt, Homo sapiens
uggauacuguuacacaaag

SEQ ID NO: 1145114 - RNA, 19 nt, Homo sapiens
ggucuucuuccucuacaga

SEQ ID NO: 1145115 - RNA, 19 nt, Homo sapiens
uuuauugacuucuguuguc

SEQ ID NO: 1145116 - RNA, 19 nt, Homo sapiens
ccaugguccuuuucuuuaa

SEQ ID NO: 1145117 - RNA, 19 nt, Homo sapiens
cccacggacuugauucuca

SEQ ID NO: 1145118 - RNA, 19 nt, Homo sapiens
cuaguuauuugugauagca

SEQ ID NO: 1145119 - RNA, 19 nt, Homo sapiens
guuggucgccucauguuuc

SEQ ID NO: 1145120 - RNA, 19 nt, Homo sapiens
aaacccaggccaguggaua

SEQ ID NO: 1145121 - RNA, 19 nt, Homo sapiens
acaauuauggauacuguuc

SEQ ID NO: 1145122 - RNA, 19 nt, Homo sapiens
auuccuuucuccuuuguuu

SEQ ID NO: 1145123 - RNA, 19 nt, Homo sapiens
ucacagggugggcacaaga

SEQ ID NO: 1145124 - RNA, 19 nt, Homo sapiens
aauggcagcuuuuggauug

SEQ ID NO: 1145125 - RNA, 19 nt, Homo sapiens
cucagacaauggcagcuuu

SEQ ID NO: 1145126 - RNA, 19 nt, Homo sapiens
guggauggagaucaagauu

SEQ ID NO: 1145127 - RNA, 19 nt, Homo sapiens
ggccaguaaugcucuuguc

SEQ ID NO: 1145128 - RNA, 19 nt, Homo sapiens
auacacauggccaguaaug

SEQ ID NO: 1145129 - RNA, 19 nt, Homo sapiens
ccaugagucuuuucucuuc

SEQ ID NO: 1145130 - RNA, 19 nt, Homo sapiens
agacucuccugcagaccuu

SEQ ID NO: 1145131 - RNA, 19 nt, Homo sapiens
ccacugaugacaagauacu

SEQ ID NO: 1145132 - RNA, 19 nt, Homo sapiens
gaaagcagcuccaguuaca

SEQ ID NO: 1145133 - RNA, 19 nt, Homo sapiens
gaaccucacgcucaaauuc

SEQ ID NO: 1145134 - RNA, 19 nt, Homo sapiens
caacgacacauuugacauu

SEQ ID NO: 1145135 - RNA, 19 nt, Homo sapiens
ucucccagcucuaccuuua

SEQ ID NO: 1145136 - RNA, 19 nt, Homo sapiens
uccagagccucaucaauaa

SEQ ID NO: 1145137 - RNA, 19 nt, Homo sapiens
gaucucacccucuuggaaa

SEQ ID NO: 1145138 - RNA, 19 nt, Homo sapiens
caacuacaauauccucauc

SEQ ID NO: 1145139 - RNA, 19 nt, Homo sapiens
gggagcggcuggaauuugu

SEQ ID NO: 1145140 - RNA, 19 nt, Homo sapiens
cuccagagccucaucaaua

SEQ ID NO: 1145141 - RNA, 19 nt, Homo sapiens
acaagaaccucacgcucaa

SEQ ID NO: 1145142 - RNA, 19 nt, Homo sapiens
cgacacauuugacauugau

SEQ ID NO: 1145143 - RNA, 19 nt, Homo sapiens
cgaccccgcuuauuuauuu

SEQ ID NO: 1145144 - RNA, 19 nt, Homo sapiens
gaggagggccuggaccuuu

SEQ ID NO: 1145145 - RNA, 19 nt, Homo sapiens
gcaagcugaugcugcaagu

SEQ ID NO: 1145146 - RNA, 19 nt, Homo sapiens
uccacaagcuggucaaugu

SEQ ID NO: 1145147 - RNA, 19 nt, Homo sapiens
gcgacgaucucacccucuu

SEQ ID NO: 1145148 - RNA, 19 nt, Homo sapiens
cgaccugacugccguugga

SEQ ID NO: 1145149 - RNA, 19 nt, Homo sapiens
gaccuucgccgucgucuca

SEQ ID NO: 1145150 - RNA, 19 nt, Homo sapiens
ggaaagcagcuccaguuac

SEQ ID NO: 1145151 - RNA, 19 nt, Homo sapiens
gcaucgaggccaagaacuu

SEQ ID NO: 1145152 - RNA, 19 nt, Homo sapiens
ucaucagccucuucaucua

SEQ ID NO: 1145153 - RNA, 19 nt, Homo sapiens
gcuuccggcuccuguuuga

SEQ ID NO: 1145154 - RNA, 19 nt, Homo sapiens
gccgucgucucaaauacuu

SEQ ID NO: 1145155 - RNA, 19 nt, Homo sapiens
uaccuuuacuccuucauca

SEQ ID NO: 1145156 - RNA, 19 nt, Homo sapiens
gcagcuccaguuacaagaa

SEQ ID NO: 1145157 - RNA, 19 nt, Homo sapiens
ggcccuaucaugugaaguu

SEQ ID NO: 1145158 - RNA, 19 nt, Homo sapiens
cugcguggcugucaucuac

SEQ ID NO: 1145159 - RNA, 19 nt, Homo sapiens
ugaccuucuuccacaacua

SEQ ID NO: 1145160 - RNA, 19 nt, Homo sapiens
gugcagcucauccuguuug

SEQ ID NO: 1145161 - RNA, 19 nt, Homo sapiens
cagagccucaucaauaaug

SEQ ID NO: 1145162 - RNA, 19 nt, Homo sapiens
caaugucaccauccacuuc

SEQ ID NO: 1145163 - RNA, 19 nt, Homo sapiens
ugaucacguuugacaacaa

SEQ ID NO: 1145164 - RNA, 19 nt, Homo sapiens
ugagaucccggacugcuau

SEQ ID NO: 1145165 - RNA, 19 nt, Homo sapiens
uguuugggcucaguaauca

SEQ ID NO: 1145166 - RNA, 19 nt, Homo sapiens
cggugcagcucauccuguu

SEQ ID NO: 1145167 - RNA, 19 nt, Homo sapiens
ugugggagcggcuggaauu

SEQ ID NO: 1145168 - RNA, 19 nt, Homo sapiens
cagcuuccggcuccuguuu

SEQ ID NO: 1145169 - RNA, 19 nt, Homo sapiens
ccagcgaugugcucaccau

SEQ ID NO: 1145170 - RNA, 19 nt, Homo sapiens
cggcuggaauuugucaaug

SEQ ID NO: 1145171 - RNA, 19 nt, Homo sapiens
ucaugaagaucggcaucga

SEQ ID NO: 1145172 - RNA, 19 nt, Homo sapiens
ggcuggaauuugucaaugg

SEQ ID NO: 1145173 - RNA, 19 nt, Homo sapiens
uggggaggguguugaauaa

SEQ ID NO: 1145174 - RNA, 19 nt, Homo sapiens
ugacaacaaagcacacagu

SEQ ID NO: 1145175 - RNA, 19 nt, Homo sapiens
aacgacacauuugacauug

SEQ ID NO: 1145176 - RNA, 19 nt, Homo sapiens
gagaccgagcggcuucuga

SEQ ID NO: 1145177 - RNA, 19 nt, Homo sapiens
gagaucccggacugcuaua

SEQ ID NO: 1145178 - RNA, 19 nt, Homo sapiens
guaccaggccaucuuccau

SEQ ID NO: 1145179 - RNA, 19 nt, Homo sapiens
aggagggccuggaccuuuc

SEQ ID NO: 1145180 - RNA, 19 nt, Homo sapiens
uguucucgcucaucaaugg

SEQ ID NO: 1145181 - RNA, 19 nt, Homo sapiens
gagcggcuggaauuuguca

SEQ ID NO: 1145182 - RNA, 19 nt, Homo sapiens
gaacaucacggaagacuua

SEQ ID NO: 1145183 - RNA, 19 nt, Homo sapiens
gcaaugauauggcauguca

SEQ ID NO: 1145184 - RNA, 19 nt, Homo sapiens
ccacgaacguucugguuua

SEQ ID NO: 1145185 - RNA, 19 nt, Homo sapiens
agaaacagcugucaacauu

SEQ ID NO: 1145186 - RNA, 19 nt, Homo sapiens
agaagagccuuaacauaua

SEQ ID NO: 1145187 - RNA, 19 nt, Homo sapiens
ggacagauacaguacauuu

SEQ ID NO: 1145188 - RNA, 19 nt, Homo sapiens
gaaucucuaugcccuguua

SEQ ID NO: 1145189 - RNA, 19 nt, Homo sapiens
gaagagccuuaacauauau

SEQ ID NO: 1145190 - RNA, 19 nt, Homo sapiens
agaauuaccucaacgugua

SEQ ID NO: 1145191 - RNA, 19 nt, Homo sapiens
ccaagagaguucugaguaa

SEQ ID NO: 1145192 - RNA, 19 nt, Homo sapiens
gcaguuguaugacgaagaa

SEQ ID NO: 1145193 - RNA, 19 nt, Homo sapiens
ggacauggacuguggauau

SEQ ID NO: 1145194 - RNA, 19 nt, Homo sapiens
gaaaggaagaccucaagaa

SEQ ID NO: 1145195 - RNA, 19 nt, Homo sapiens
ccaauuuccuuauacguuu

SEQ ID NO: 1145196 - RNA, 19 nt, Homo sapiens
gauaauaguucugcagguu

SEQ ID NO: 1145197 - RNA, 19 nt, Homo sapiens
gccagaacauggaggaaua

SEQ ID NO: 1145198 - RNA, 19 nt, Homo sapiens
gaacaagcaguacgauuug

SEQ ID NO: 1145199 - RNA, 19 nt, Homo sapiens
caccugagcugcugcauga

SEQ ID NO: 1145200 - RNA, 19 nt, Homo sapiens
uuacaucccuggugucgua

SEQ ID NO: 1145201 - RNA, 19 nt, Homo sapiens
agaaauacgugaaccgauu

SEQ ID NO: 1145202 - RNA, 19 nt, Homo sapiens
caaucgcgcugcucacuuu

SEQ ID NO: 1145203 - RNA, 19 nt, Homo sapiens
caagagaguucugaguaaa

SEQ ID NO: 1145204 - RNA, 19 nt, Homo sapiens
uaaagaagaguaacacuug

SEQ ID NO: 1145205 - RNA, 19 nt, Homo sapiens
ggaccuggcucaacuggau

SEQ ID NO: 1145206 - RNA, 19 nt, Homo sapiens
gcacuuugacagagaauaa

SEQ ID NO: 1145207 - RNA, 19 nt, Homo sapiens
gauauggcaugucaucuuc

SEQ ID NO: 1145208 - RNA, 19 nt, Homo sapiens
gaagaccgccuuguaggua

SEQ ID NO: 1145209 - RNA, 19 nt, Homo sapiens
aagaagagccuuaacauau

SEQ ID NO: 1145210 - RNA, 19 nt, Homo sapiens
ggccuacgcucucgagaaa

SEQ ID NO: 1145211 - RNA, 19 nt, Homo sapiens
ccaaggcucugcugaacaa

SEQ ID NO: 1145212 - RNA, 19 nt, Homo sapiens
cagacaaccuaccuucuuu

SEQ ID NO: 1145213 - RNA, 19 nt, Homo sapiens
ugacacugcucccugaauu

SEQ ID NO: 1145214 - RNA, 19 nt, Homo sapiens
ggaagggcaggaaaugaua

SEQ ID NO: 1145215 - RNA, 19 nt, Homo sapiens
uaccugaccucacagagua

SEQ ID NO: 1145216 - RNA, 19 nt, Homo sapiens
ugucugacgucuuugauuu

SEQ ID NO: 1145217 - RNA, 19 nt, Homo sapiens
gagaugcagugcucccaaa

SEQ ID NO: 1145218 - RNA, 19 nt, Homo sapiens
cgagcugucugacgucuuu

SEQ ID NO: 1145219 - RNA, 19 nt, Homo sapiens
aaagaagagccuuaacaua

SEQ ID NO: 1145220 - RNA, 19 nt, Homo sapiens
ggacaaauuccucuuccuu

SEQ ID NO: 1145221 - RNA, 19 nt, Homo sapiens
ggcgcuggcuucaggaaua

SEQ ID NO: 1145222 - RNA, 19 nt, Homo sapiens
gagcccuucuuucuacuuu

SEQ ID NO: 1145223 - RNA, 19 nt, Homo sapiens
aaaggaagaccucaagaaa

SEQ ID NO: 1145224 - RNA, 19 nt, Homo sapiens
gagcuugucuccgaauuca

SEQ ID NO: 1145225 - RNA, 19 nt, Homo sapiens
ggaaauccacaauaacaau

SEQ ID NO: 1145226 - RNA, 19 nt, Homo sapiens
ggaaacaagagguaccaaa

SEQ ID NO: 1145227 - RNA, 19 nt, Homo sapiens
gaccacagacuacuuauag

SEQ ID NO: 1145228 - RNA, 19 nt, Homo sapiens
ccaaugugcugcugaccaa

SEQ ID NO: 1145229 - RNA, 19 nt, Homo sapiens
cagcugcaguuuacucauu

SEQ ID NO: 1145230 - RNA, 19 nt, Homo sapiens
gauaacaacccaaggcaau

SEQ ID NO: 1145231 - RNA, 19 nt, Homo sapiens
agaacaagcaguacgauuu

SEQ ID NO: 1145232 - RNA, 19 nt, Homo sapiens
gccaagagaguucugagua

SEQ ID NO: 1145233 - RNA, 19 nt, Homo sapiens
ccgaugagaucaacgucua

SEQ ID NO: 1145234 - RNA, 19 nt, Homo sapiens
ggaagacuuaggacagaua

SEQ ID NO: 1145235 - RNA, 19 nt, Homo sapiens
gucaaacaguucuuaguug

SEQ ID NO: 1145236 - RNA, 19 nt, Homo sapiens
gcacugaguacaaaugugu

SEQ ID NO: 1145237 - RNA, 19 nt, Homo sapiens
ccagaccacagacuacuua

SEQ ID NO: 1145238 - RNA, 19 nt, Homo sapiens
agaccaaccugcacuuguu

SEQ ID NO: 1145239 - RNA, 19 nt, Homo sapiens
gaugcuugcucuugggaaa

SEQ ID NO: 1145240 - RNA, 19 nt, Homo sapiens
uacaaggacuagacgcaua

SEQ ID NO: 1145241 - RNA, 19 nt, Homo sapiens
gcucaagacuaccaaguac

SEQ ID NO: 1145242 - RNA, 19 nt, Homo sapiens
gcaggcaggugugaacaug

SEQ ID NO: 1145243 - RNA, 19 nt, Homo sapiens
uuacuugacuugccugaug

SEQ ID NO: 1145244 - RNA, 19 nt, Homo sapiens
gagguccacuucccuuaga

SEQ ID NO: 1145245 - RNA, 19 nt, Homo sapiens
gaucugaggacaaggaaau

SEQ ID NO: 1145246 - RNA, 19 nt, Homo sapiens
gaagggcaggaaaugauaa

SEQ ID NO: 1145247 - RNA, 19 nt, Homo sapiens
aaagaagaguaacacuuga

SEQ ID NO: 1145248 - RNA, 19 nt, Homo sapiens
gcuaauacaggaaacaaga

SEQ ID NO: 1145249 - RNA, 19 nt, Homo sapiens
ccagugguaucuaaucuuc

SEQ ID NO: 1145250 - RNA, 19 nt, Homo sapiens
acccaaagcugcuggagaa

SEQ ID NO: 1145251 - RNA, 19 nt, Homo sapiens
ccuuauacguuuccauuga

SEQ ID NO: 1145252 - RNA, 19 nt, Homo sapiens
ggagcaaaacucagaauua

SEQ ID NO: 1145253 - RNA, 19 nt, Homo sapiens
guuaaagcaugccaagugu

SEQ ID NO: 1145254 - RNA, 19 nt, Homo sapiens
ccacugguguaugaaauga

SEQ ID NO: 1145255 - RNA, 19 nt, Homo sapiens
gauaacguguggcuucagu

SEQ ID NO: 1145256 - RNA, 19 nt, Homo sapiens
gcaaagugagcaugagguu

SEQ ID NO: 1145257 - RNA, 19 nt, Homo sapiens
caaagcugcuggagaaggu

SEQ ID NO: 1145258 - RNA, 19 nt, Homo sapiens
ccaaacaacgaccugagua

SEQ ID NO: 1145259 - RNA, 19 nt, Homo sapiens
gaugccaccuccucuguuc

SEQ ID NO: 1145260 - RNA, 19 nt, Homo sapiens
ucaggaagaccgccuugua

SEQ ID NO: 1145261 - RNA, 19 nt, Homo sapiens
cggagucccugaaacuauu

SEQ ID NO: 1145262 - RNA, 19 nt, Homo sapiens
caacguguacuuugucuuc

SEQ ID NO: 1145263 - RNA, 19 nt, Homo sapiens
ggacuagacgcauauuuac

SEQ ID NO: 1145264 - RNA, 19 nt, Homo sapiens
gcaccaaguacaaggacua

SEQ ID NO: 1145265 - RNA, 19 nt, Homo sapiens
gagagguccacuucccuua

SEQ ID NO: 1145266 - RNA, 19 nt, Homo sapiens
gaccaaccugcacuuguua

SEQ ID NO: 1145267 - RNA, 19 nt, Homo sapiens
ugaagacgauagaagacuu

SEQ ID NO: 1145268 - RNA, 19 nt, Homo sapiens
caagagaagaagucauuau

SEQ ID NO: 1145269 - RNA, 19 nt, Homo sapiens
gacauggacuguggauaug

SEQ ID NO: 1145270 - RNA, 19 nt, Homo sapiens
cagccaguuuagagaaaua

SEQ ID NO: 1145271 - RNA, 19 nt, Homo sapiens
gggcugggcuccacuucau

SEQ ID NO: 1145272 - RNA, 19 nt, Homo sapiens
caagcaguacgauuuguuu

SEQ ID NO: 1145273 - RNA, 19 nt, Homo sapiens
cgaacguucugguuuaaca

SEQ ID NO: 1145274 - RNA, 19 nt, Homo sapiens
ggucgacgccucugcagaa

SEQ ID NO: 1145275 - RNA, 19 nt, Homo sapiens
ugacgucuuugauuucuuc

SEQ ID NO: 1145276 - RNA, 19 nt, Homo sapiens
gaaauacgugaaccgauuc

SEQ ID NO: 1145277 - RNA, 19 nt, Homo sapiens
caguguaggucccaagaga

SEQ ID NO: 1145278 - RNA, 19 nt, Homo sapiens
caucgcaagucacagaaau

SEQ ID NO: 1145279 - RNA, 19 nt, Homo sapiens
cagcauggcguaucaggaa

SEQ ID NO: 1145280 - RNA, 19 nt, Homo sapiens
gggagugucuuacaguucu

SEQ ID NO: 1145281 - RNA, 19 nt, Homo sapiens
aaacagcugucaacauugc

SEQ ID NO: 1145282 - RNA, 19 nt, Homo sapiens
ucacagagcugccaauuua

SEQ ID NO: 1145283 - RNA, 19 nt, Homo sapiens
ggacauccaugacugauua

SEQ ID NO: 1145284 - RNA, 19 nt, Homo sapiens
gaaauaagcccucaaauca

SEQ ID NO: 1145285 - RNA, 19 nt, Homo sapiens
ggaaauagucucuuacaua

SEQ ID NO: 1145286 - RNA, 19 nt, Homo sapiens
caaagaaggucaugaguga

SEQ ID NO: 1145287 - RNA, 19 nt, Homo sapiens
gcaaauggcuggcguggaa

SEQ ID NO: 1145288 - RNA, 19 nt, Homo sapiens
gaaguccuaucucuauuua

SEQ ID NO: 1145289 - RNA, 19 nt, Homo sapiens
guauagauguugucaguua

SEQ ID NO: 1145290 - RNA, 19 nt, Homo sapiens
gaaaucagaggcauacuua

SEQ ID NO: 1145291 - RNA, 19 nt, Homo sapiens
gaacaggacucugaaguug

SEQ ID NO: 1145292 - RNA, 19 nt, Homo sapiens
ggaaguugcuuucugcuuu

SEQ ID NO: 1145293 - RNA, 19 nt, Homo sapiens
gaucaaggcuacucugaaa

SEQ ID NO: 1145294 - RNA, 19 nt, Homo sapiens
gauggaaucugucacauug

SEQ ID NO: 1145295 - RNA, 19 nt, Homo sapiens
caaggaaacuuaucucugu

SEQ ID NO: 1145296 - RNA, 19 nt, Homo sapiens
gcauaccucucacucauuu

SEQ ID NO: 1145297 - RNA, 19 nt, Homo sapiens
gagcaagucuggagaaaca

SEQ ID NO: 1145298 - RNA, 19 nt, Homo sapiens
ggacaaagaaugauccaaa

SEQ ID NO: 1145299 - RNA, 19 nt, Homo sapiens
gaaggaaagucacaaagca

SEQ ID NO: 1145300 - RNA, 19 nt, Homo sapiens
gcaaugaagucagcaaguu

SEQ ID NO: 1145301 - RNA, 19 nt, Homo sapiens
ggagaacaaacuuacauua

SEQ ID NO: 1145302 - RNA, 19 nt, Homo sapiens
gguagcaucuugucuuauu

SEQ ID NO: 1145303 - RNA, 19 nt, Homo sapiens
aaagugaaguggugaaauu

SEQ ID NO: 1145304 - RNA, 19 nt, Homo sapiens
ucacauagcuaauggaagu

SEQ ID NO: 1145305 - RNA, 19 nt, Homo sapiens
gaaugucuauagcaaguuu

SEQ ID NO: 1145306 - RNA, 19 nt, Homo sapiens
gagauauguucacuuguaa

SEQ ID NO: 1145307 - RNA, 19 nt, Homo sapiens
agagauauguucacuugua

SEQ ID NO: 1145308 - RNA, 19 nt, Homo sapiens
ccaaucagcuggcaaguca

SEQ ID NO: 1145309 - RNA, 19 nt, Homo sapiens
ggacuaaagcucucaagaa

SEQ ID NO: 1145310 - RNA, 19 nt, Homo sapiens
gagcaagugucauuaagug

SEQ ID NO: 1145311 - RNA, 19 nt, Homo sapiens
ggaaauaagcccucaaauc

SEQ ID NO: 1145312 - RNA, 19 nt, Homo sapiens
ccaacaugauucucuauuu

SEQ ID NO: 1145313 - RNA, 19 nt, Homo sapiens
gagauggucuguccgaaga

SEQ ID NO: 1145314 - RNA, 19 nt, Homo sapiens
uggaagagcugacaugaug

SEQ ID NO: 1145315 - RNA, 19 nt, Homo sapiens
gcaaguuccugugcuauug

SEQ ID NO: 1145316 - RNA, 19 nt, Homo sapiens
uuacagaaguggucagaaa

SEQ ID NO: 1145317 - RNA, 19 nt, Homo sapiens
caacagggaagaauuacua

SEQ ID NO: 1145318 - RNA, 19 nt, Homo sapiens
gaaacacaaucuagaccuu

SEQ ID NO: 1145319 - RNA, 19 nt, Homo sapiens
uuaggaaacugaagccaua

SEQ ID NO: 1145320 - RNA, 19 nt, Homo sapiens
guuacgagcuggacucauu

SEQ ID NO: 1145321 - RNA, 19 nt, Homo sapiens
uaugagaucugccucugua

SEQ ID NO: 1145322 - RNA, 19 nt, Homo sapiens
gagaagaccuuuuaugaga

SEQ ID NO: 1145323 - RNA, 19 nt, Homo sapiens
cuaaagcucucaagaagug

SEQ ID NO: 1145324 - RNA, 19 nt, Homo sapiens
uuacaggucuugauuccua

SEQ ID NO: 1145325 - RNA, 19 nt, Homo sapiens
gggagucauuugagauaua

SEQ ID NO: 1145326 - RNA, 19 nt, Homo sapiens
ccagugacuuugccguuua

SEQ ID NO: 1145327 - RNA, 19 nt, Homo sapiens
ugacaacagggaagaauua

SEQ ID NO: 1145328 - RNA, 19 nt, Homo sapiens
ggucaucccugcagacaug

SEQ ID NO: 1145329 - RNA, 19 nt, Homo sapiens
caagugacaucaaaguaug

SEQ ID NO: 1145330 - RNA, 19 nt, Homo sapiens
ugaaucaagugacaucaaa

SEQ ID NO: 1145331 - RNA, 19 nt, Homo sapiens
ggaaagaugaaucaaguga

SEQ ID NO: 1145332 - RNA, 19 nt, Homo sapiens
aaagugauguggauuucua

SEQ ID NO: 1145333 - RNA, 19 nt, Homo sapiens
gaaucuggcugagcaggua

SEQ ID NO: 1145334 - RNA, 19 nt, Homo sapiens
uuagagauauguucacuug

SEQ ID NO: 1145335 - RNA, 19 nt, Homo sapiens
caaguauucuuucaagguu

SEQ ID NO: 1145336 - RNA, 19 nt, Homo sapiens
gacuaaagcucucaagaag

SEQ ID NO: 1145337 - RNA, 19 nt, Homo sapiens
ggaaggcaccggauuguug

SEQ ID NO: 1145338 - RNA, 19 nt, Homo sapiens
ccaaucaaguuguggugua

SEQ ID NO: 1145339 - RNA, 19 nt, Homo sapiens
cuuagaggaugcaccauua

SEQ ID NO: 1145340 - RNA, 19 nt, Homo sapiens
aaacaaggccuucguacuu

SEQ ID NO: 1145341 - RNA, 19 nt, Homo sapiens
ggagaaacaacagaugaua

SEQ ID NO: 1145342 - RNA, 19 nt, Homo sapiens
aagauggccuggaagguua

SEQ ID NO: 1145343 - RNA, 19 nt, Homo sapiens
ccaaauccaacuguaauua

SEQ ID NO: 1145344 - RNA, 19 nt, Homo sapiens
gcaacugccugaacuuuac

SEQ ID NO: 1145345 - RNA, 19 nt, Homo sapiens
gcacagaaacagagaaaca

SEQ ID NO: 1145346 - RNA, 19 nt, Homo sapiens
gagcagacucccucucuuu

SEQ ID NO: 1145347 - RNA, 19 nt, Homo sapiens
gauuacaccucggcucuuu

SEQ ID NO: 1145348 - RNA, 19 nt, Homo sapiens
ccuagaacauuccaacaaa

SEQ ID NO: 1145349 - RNA, 19 nt, Homo sapiens
gagcugccaauuuauauuu

SEQ ID NO: 1145350 - RNA, 19 nt, Homo sapiens
gcaggacaguucauaaugg

SEQ ID NO: 1145351 - RNA, 19 nt, Homo sapiens
acuaggagaucuuauauuc

SEQ ID NO: 1145352 - RNA, 19 nt, Homo sapiens
gggaagaauuacuacuuga

SEQ ID NO: 1145353 - RNA, 19 nt, Homo sapiens
acaaugaccucagcagauu

SEQ ID NO: 1145354 - RNA, 19 nt, Homo sapiens
guggugguccuuacaauua

SEQ ID NO: 1145355 - RNA, 19 nt, Homo sapiens
gaaguugcuuucugcuuuc

SEQ ID NO: 1145356 - RNA, 19 nt, Homo sapiens
uacaauacccugagacuuu

SEQ ID NO: 1145357 - RNA, 19 nt, Homo sapiens
gggaaaugcuuuaaauggu

SEQ ID NO: 1145358 - RNA, 19 nt, Homo sapiens
cuagggaaaugcuuuaaau

SEQ ID NO: 1145359 - RNA, 19 nt, Homo sapiens
ggagucauuugagauauau

SEQ ID NO: 1145360 - RNA, 19 nt, Homo sapiens
gaaguggucagaaaucaga

SEQ ID NO: 1145361 - RNA, 19 nt, Homo sapiens
gaagcugucucugaagaug

SEQ ID NO: 1145362 - RNA, 19 nt, Homo sapiens
cuacacaaccuggaucuua

SEQ ID NO: 1145363 - RNA, 19 nt, Homo sapiens
ccaguaggauagaauguga

SEQ ID NO: 1145364 - RNA, 19 nt, Homo sapiens
uaugcuggcuuuaguugua

SEQ ID NO: 1145365 - RNA, 19 nt, Homo sapiens
gagcauuauuguauguuug

SEQ ID NO: 1145366 - RNA, 19 nt, Homo sapiens
guauaagcgcagcaaauua

SEQ ID NO: 1145367 - RNA, 19 nt, Homo sapiens
gguauaagcgcagcaaauu

SEQ ID NO: 1145368 - RNA, 19 nt, Homo sapiens
gaaguucuccggagccuau

SEQ ID NO: 1145369 - RNA, 19 nt, Homo sapiens
cuacaucaaggucuucuua

SEQ ID NO: 1145370 - RNA, 19 nt, Homo sapiens
gaaacuaaggccuuugaga

SEQ ID NO: 1145371 - RNA, 19 nt, Homo sapiens
ggaugacuaugccaaacaa

SEQ ID NO: 1145372 - RNA, 19 nt, Homo sapiens
gaauacgaacaacaaagua

SEQ ID NO: 1145373 - RNA, 19 nt, Homo sapiens
ggcugaagauguaggcaua

SEQ ID NO: 1145374 - RNA, 19 nt, Homo sapiens
aaaguaugcuaaccaauca

SEQ ID NO: 1145375 - RNA, 19 nt, Homo sapiens
gggaggaauuggucagcua

SEQ ID NO: 1145376 - RNA, 19 nt, Homo sapiens
ccagugaagugccucauuc

SEQ ID NO: 1145377 - RNA, 19 nt, Homo sapiens
caccagucauccagaauuu

SEQ ID NO: 1145378 - RNA, 19 nt, Homo sapiens
aaucauguaugcuggcuuu

SEQ ID NO: 1145379 - RNA, 19 nt, Homo sapiens
gguggagccuucauuggaa

SEQ ID NO: 1145380 - RNA, 19 nt, Homo sapiens
gaugagcauuauuguaugu

SEQ ID NO: 1145381 - RNA, 19 nt, Homo sapiens
gagcugacaugaugagcau

SEQ ID NO: 1145382 - RNA, 19 nt, Homo sapiens
gaaggauccuguucaaaua

SEQ ID NO: 1145383 - RNA, 19 nt, Homo sapiens
guacauugcucuaguuaaa

SEQ ID NO: 1145384 - RNA, 19 nt, Homo sapiens
gagaagaaguguuaaggaa

SEQ ID NO: 1145385 - RNA, 19 nt, Homo sapiens
ggacagggaugauugaugu

SEQ ID NO: 1145386 - RNA, 19 nt, Homo sapiens
gaaggagaauguucagaaa

SEQ ID NO: 1145387 - RNA, 19 nt, Homo sapiens
cagcaacucuccugacaua

SEQ ID NO: 1145388 - RNA, 19 nt, Homo sapiens
gaagagcacaguuuacuuu

SEQ ID NO: 1145389 - RNA, 19 nt, Homo sapiens
gcaauaacccuugaccuua

SEQ ID NO: 1145390 - RNA, 19 nt, Homo sapiens
ggauuuagauuuggaugua

SEQ ID NO: 1145391 - RNA, 19 nt, Homo sapiens
uaagauagguugaguugga

SEQ ID NO: 1145392 - RNA, 19 nt, Homo sapiens
gaauuuaaguccagaagau

SEQ ID NO: 1145393 - RNA, 19 nt, Homo sapiens
caaccuaucuuacauccaa

SEQ ID NO: 1145394 - RNA, 19 nt, Homo sapiens
gcagauaacucagauugga

SEQ ID NO: 1145395 - RNA, 19 nt, Homo sapiens
gauucaagauccagucaua

SEQ ID NO: 1145396 - RNA, 19 nt, Homo sapiens
caauggagcuugaagacaa

SEQ ID NO: 1145397 - RNA, 19 nt, Homo sapiens
ccacagaucuugccccuua

SEQ ID NO: 1145398 - RNA, 19 nt, Homo sapiens
gagcacaguuuacuuucuu

SEQ ID NO: 1145399 - RNA, 19 nt, Homo sapiens
uagaagcaauucacaugua

SEQ ID NO: 1145400 - RNA, 19 nt, Homo sapiens
uaagacagcuaccaauauc

SEQ ID NO: 1145401 - RNA, 19 nt, Homo sapiens
guaaugaauugaagaugga

SEQ ID NO: 1145402 - RNA, 19 nt, Homo sapiens
ccacuggcaucuguaauuu

SEQ ID NO: 1145403 - RNA, 19 nt, Homo sapiens
gauauugguagcugucuua

SEQ ID NO: 1145404 - RNA, 19 nt, Homo sapiens
ggucaaggguuauugcaau

SEQ ID NO: 1145405 - RNA, 19 nt, Homo sapiens
acaaugaagucuauggaaa

SEQ ID NO: 1145406 - RNA, 19 nt, Homo sapiens
caacagaaaggucaagcua

SEQ ID NO: 1145407 - RNA, 19 nt, Homo sapiens
cggcaucucugcuguggua

SEQ ID NO: 1145408 - RNA, 19 nt, Homo sapiens
cuaccaauaucaucaagaa

SEQ ID NO: 1145409 - RNA, 19 nt, Homo sapiens
caacucuccugacauaugu

SEQ ID NO: 1145410 - RNA, 19 nt, Homo sapiens
gcacaguggaagaugaaua

SEQ ID NO: 1145411 - RNA, 19 nt, Homo sapiens
uauagaaguugucugaaug

SEQ ID NO: 1145412 - RNA, 19 nt, Homo sapiens
acacagagauucagaugca

SEQ ID NO: 1145413 - RNA, 19 nt, Homo sapiens
gugguuagcuugaccuuuc

SEQ ID NO: 1145414 - RNA, 19 nt, Homo sapiens
guuagaagagcacaguuua

SEQ ID NO: 1145415 - RNA, 19 nt, Homo sapiens
gaaacaacaaugaagucua

SEQ ID NO: 1145416 - RNA, 19 nt, Homo sapiens
aagaagugccucacaguua

SEQ ID NO: 1145417 - RNA, 19 nt, Homo sapiens
gcacaaaguuuuaaugucu

SEQ ID NO: 1145418 - RNA, 19 nt, Homo sapiens
guaagacagcuaccaauau

SEQ ID NO: 1145419 - RNA, 19 nt, Homo sapiens
ccugagagaagaaguguua

SEQ ID NO: 1145420 - RNA, 19 nt, Homo sapiens
gagcagaaacaacaaugaa

SEQ ID NO: 1145421 - RNA, 19 nt, Homo sapiens
gaugauugauguuugaucu

SEQ ID NO: 1145422 - RNA, 19 nt, Homo sapiens
ugguagagcuggauuuaga

SEQ ID NO: 1145423 - RNA, 19 nt, Homo sapiens
ggagaucaaacaucaauca

SEQ ID NO: 1145424 - RNA, 19 nt, Homo sapiens
caacucaaccuaucuuaca

SEQ ID NO: 1145425 - RNA, 19 nt, Homo sapiens
ccuccaaacuuacuugaga

SEQ ID NO: 1145426 - RNA, 19 nt, Homo sapiens
acacuuacauucgccgaua

SEQ ID NO: 1145427 - RNA, 19 nt, Homo sapiens
ugacauauguugcuuuuga

SEQ ID NO: 1145428 - RNA, 19 nt, Homo sapiens
uaggagacauuaucugugu

SEQ ID NO: 1145429 - RNA, 19 nt, Homo sapiens
gcaacucuccugacauaug

SEQ ID NO: 1145430 - RNA, 19 nt, Homo sapiens
gugauggcgugcaguauug

SEQ ID NO: 1145431 - RNA, 19 nt, Homo sapiens
gcacacagagauucagaug

SEQ ID NO: 1145432 - RNA, 19 nt, Homo sapiens
uaaccacacugcgcaaguu

SEQ ID NO: 1145433 - RNA, 19 nt, Homo sapiens
aaucugaguuaucugcuaa

SEQ ID NO: 1145434 - RNA, 19 nt, Homo sapiens
uaaggaaccugcgcagugu

SEQ ID NO: 1145435 - RNA, 19 nt, Homo sapiens
ggugaugaauucuguugga

SEQ ID NO: 1145436 - RNA, 19 nt, Homo sapiens
gcagaaacaacaaugaagu

SEQ ID NO: 1145437 - RNA, 19 nt, Homo sapiens
gaacucaggaagugcauca

SEQ ID NO: 1145438 - RNA, 19 nt, Homo sapiens
ucaagauccagucauauuu

SEQ ID NO: 1145439 - RNA, 19 nt, Homo sapiens
gcuagaagcaauucacaug

SEQ ID NO: 1145440 - RNA, 19 nt, Homo sapiens
gaaacauuacuauccagaa

SEQ ID NO: 1145441 - RNA, 19 nt, Homo sapiens
gcucauaggagacauuauc

SEQ ID NO: 1145442 - RNA, 19 nt, Homo sapiens
gcauugcaauaacccuuga

SEQ ID NO: 1145443 - RNA, 19 nt, Homo sapiens
gaaaaucuuugucuucaag

SEQ ID NO: 1145444 - RNA, 19 nt, Homo sapiens
ggaguaagacagcuaccaa

SEQ ID NO: 1145445 - RNA, 19 nt, Homo sapiens
ucucugcugugguagauuu

SEQ ID NO: 1145446 - RNA, 19 nt, Homo sapiens
gaaaguuaugggaaagaaa

SEQ ID NO: 1145447 - RNA, 19 nt, Homo sapiens
uacaagaacucaggaagug

SEQ ID NO: 1145448 - RNA, 19 nt, Homo sapiens
aacaugaacucccaaaaua

SEQ ID NO: 1145449 - RNA, 19 nt, Homo sapiens
caaucugaguuaucugcua

SEQ ID NO: 1145450 - RNA, 19 nt, Homo sapiens
guagcugucuuacuccaau

SEQ ID NO: 1145451 - RNA, 19 nt, Homo sapiens
agagcuggauuuagauuug

SEQ ID NO: 1145452 - RNA, 19 nt, Homo sapiens
ggugguagagcuggauuua

SEQ ID NO: 1145453 - RNA, 19 nt, Homo sapiens
caagaagugccucacaguu

SEQ ID NO: 1145454 - RNA, 19 nt, Homo sapiens
gauguaagauagguugagu

SEQ ID NO: 1145455 - RNA, 19 nt, Homo sapiens
gcagaucugugggaggaau

SEQ ID NO: 1145456 - RNA, 19 nt, Homo sapiens
gccgauacauucuaaaauu

SEQ ID NO: 1145457 - RNA, 19 nt, Homo sapiens
ggacuuugcauugcuguug

SEQ ID NO: 1145458 - RNA, 19 nt, Homo sapiens
gaucaccuccuucaaugug

SEQ ID NO: 1145459 - RNA, 19 nt, Homo sapiens
agaagugccucacaguuag

SEQ ID NO: 1145460 - RNA, 19 nt, Homo sapiens
gagauucagaugcaaguga

SEQ ID NO: 1145461 - RNA, 19 nt, Homo sapiens
acacugcgcaaguuccuua

SEQ ID NO: 1145462 - RNA, 19 nt, Homo sapiens
agacaaagauuuuccuaga

SEQ ID NO: 1145463 - RNA, 19 nt, Homo sapiens
gauuucgguuagcagauaa

SEQ ID NO: 1145464 - RNA, 19 nt, Homo sapiens
agauuucgguuagcagaua

SEQ ID NO: 1145465 - RNA, 19 nt, Homo sapiens
acaguuagaugcaagaaac

SEQ ID NO: 1145466 - RNA, 19 nt, Homo sapiens
uagcagauaacucagauug

SEQ ID NO: 1145467 - RNA, 19 nt, Homo sapiens
uggaucaccuccuucaaug

SEQ ID NO: 1145468 - RNA, 19 nt, Homo sapiens
acagaaaggucaagcuaac

SEQ ID NO: 1145469 - RNA, 19 nt, Homo sapiens
gugcaguauuggaaacauu

SEQ ID NO: 1145470 - RNA, 19 nt, Homo sapiens
uagcuugaccuuucuguug

SEQ ID NO: 1145471 - RNA, 19 nt, Homo sapiens
agaaaguuaugggaaagaa

SEQ ID NO: 1145472 - RNA, 19 nt, Homo sapiens
caacaaugaagucuaugga

SEQ ID NO: 1145473 - RNA, 19 nt, Homo sapiens
cauguacauugcucuaguu

SEQ ID NO: 1145474 - RNA, 19 nt, Homo sapiens
gagaaauugcgaagggauu

SEQ ID NO: 1145475 - RNA, 19 nt, Homo sapiens
ucacuuucaucagcuauau

SEQ ID NO: 1145476 - RNA, 19 nt, Homo sapiens
agauuuggauguaagauag

SEQ ID NO: 1145477 - RNA, 19 nt, Homo sapiens
ggguuugccugccuuagug

SEQ ID NO: 1145478 - RNA, 19 nt, Homo sapiens
gcaguccuguugcauuucu

SEQ ID NO: 1145479 - RNA, 19 nt, Homo sapiens
caaugaacaugggcaaugg

SEQ ID NO: 1145480 - RNA, 19 nt, Homo sapiens
caguggaagaugaauauaa

SEQ ID NO: 1145481 - RNA, 19 nt, Homo sapiens
cauaggagacauuaucugu

SEQ ID NO: 1145482 - RNA, 19 nt, Homo sapiens
gcagacaucuagaauagua

SEQ ID NO: 1145483 - RNA, 19 nt, Homo sapiens
ccaaagugcuggaauuaua

SEQ ID NO: 1145484 - RNA, 19 nt, Homo sapiens
cagcaaaucuucugaaugu

SEQ ID NO: 1145485 - RNA, 19 nt, Homo sapiens
uaaagaaugugcuuacuug

SEQ ID NO: 1145486 - RNA, 19 nt, Homo sapiens
gaaagugguucucaugaug

SEQ ID NO: 1145487 - RNA, 19 nt, Homo sapiens
gaaccaauguauucaguau

SEQ ID NO: 1145488 - RNA, 19 nt, Homo sapiens
ggagauaaacguuucagua

SEQ ID NO: 1145489 - RNA, 19 nt, Homo sapiens
gagauaaacguuucaguaa

SEQ ID NO: 1145490 - RNA, 19 nt, Homo sapiens
ccacaacaaugaagagaaa

SEQ ID NO: 1145491 - RNA, 19 nt, Homo sapiens
agaaagagauccaaauugu

SEQ ID NO: 1145492 - RNA, 19 nt, Homo sapiens
gaaaugauggagcccuuua

SEQ ID NO: 1145493 - RNA, 19 nt, Homo sapiens
ugauagagauguagaguug

SEQ ID NO: 1145494 - RNA, 19 nt, Homo sapiens
gagcaaucauacugacaua

SEQ ID NO: 1145495 - RNA, 19 nt, Homo sapiens
gaaagagauccaaauugua

SEQ ID NO: 1145496 - RNA, 19 nt, Homo sapiens
uuagauacguugucuguuu

SEQ ID NO: 1145497 - RNA, 19 nt, Homo sapiens
ggaagaagaauauguggaa

SEQ ID NO: 1145498 - RNA, 19 nt, Homo sapiens
ggaaagcaaauuaaaguga

SEQ ID NO: 1145499 - RNA, 19 nt, Homo sapiens
gggaauucuuucuuacaua

SEQ ID NO: 1145500 - RNA, 19 nt, Homo sapiens
agucucagauucccauuua

SEQ ID NO: 1145501 - RNA, 19 nt, Homo sapiens
gaaucacuguccuuuaguu

SEQ ID NO: 1145502 - RNA, 19 nt, Homo sapiens
gcaaaucuucugaauguau

SEQ ID NO: 1145503 - RNA, 19 nt, Homo sapiens
guaguuuccuggaugguaa

SEQ ID NO: 1145504 - RNA, 19 nt, Homo sapiens
gcauacauuucccuccuuu

SEQ ID NO: 1145505 - RNA, 19 nt, Homo sapiens
ggagaugugguggguauua

SEQ ID NO: 1145506 - RNA, 19 nt, Homo sapiens
gaaccaaucacucuauaca

SEQ ID NO: 1145507 - RNA, 19 nt, Homo sapiens
gaacagcaaaucuucugaa

SEQ ID NO: 1145508 - RNA, 19 nt, Homo sapiens
uuaugaccaugucgaauua

SEQ ID NO: 1145509 - RNA, 19 nt, Homo sapiens
gugacaauaugcuuugaaa

SEQ ID NO: 1145510 - RNA, 19 nt, Homo sapiens
guaaagaauggaagaagaa

SEQ ID NO: 1145511 - RNA, 19 nt, Homo sapiens
gcauuugggcaguuuauuu

SEQ ID NO: 1145512 - RNA, 19 nt, Homo sapiens
uggcaaggaugcauacauu

SEQ ID NO: 1145513 - RNA, 19 nt, Homo sapiens
aagguuaacuugaaucaga

SEQ ID NO: 1145514 - RNA, 19 nt, Homo sapiens
cagcaucacuggaacuugu

SEQ ID NO: 1145515 - RNA, 19 nt, Homo sapiens
uggcagacaucuagaauag

SEQ ID NO: 1145516 - RNA, 19 nt, Homo sapiens
gauuuaugaugggcuauuu

SEQ ID NO: 1145517 - RNA, 19 nt, Homo sapiens
aaucauaggcacuuaguaa

SEQ ID NO: 1145518 - RNA, 19 nt, Homo sapiens
gcaaggaugcauacauuuc

SEQ ID NO: 1145519 - RNA, 19 nt, Homo sapiens
aagaaucacuguccuuuag

SEQ ID NO: 1145520 - RNA, 19 nt, Homo sapiens
aguaaguagugguugauua

SEQ ID NO: 1145521 - RNA, 19 nt, Homo sapiens
acccugaaguugugauuua

SEQ ID NO: 1145522 - RNA, 19 nt, Homo sapiens
gcucagagaauccugcaaa

SEQ ID NO: 1145523 - RNA, 19 nt, Homo sapiens
caaaugagcauggcaagga

SEQ ID NO: 1145524 - RNA, 19 nt, Homo sapiens
caucuacaguuggauaauu

SEQ ID NO: 1145525 - RNA, 19 nt, Homo sapiens
gaaguuuagaccucauuaa

SEQ ID NO: 1145526 - RNA, 19 nt, Homo sapiens
gacaguguauccaguuguu

SEQ ID NO: 1145527 - RNA, 19 nt, Homo sapiens
uaagaaucacuguccuuua

SEQ ID NO: 1145528 - RNA, 19 nt, Homo sapiens
cauuugggcaguuuauuua

SEQ ID NO: 1145529 - RNA, 19 nt, Homo sapiens
caaucauacugacauaaga

SEQ ID NO: 1145530 - RNA, 19 nt, Homo sapiens
agaauuauuugccuacugu

SEQ ID NO: 1145531 - RNA, 19 nt, Homo sapiens
cagaguaaguagugguuga

SEQ ID NO: 1145532 - RNA, 19 nt, Homo sapiens
cagcgcaccuuuacaucaa

SEQ ID NO: 1145533 - RNA, 19 nt, Homo sapiens
caacucagaagguuaacuu

SEQ ID NO: 1145534 - RNA, 19 nt, Homo sapiens
caaauuaaagugacuacug

SEQ ID NO: 1145535 - RNA, 19 nt, Homo sapiens
aaagagauccaaauuguag

SEQ ID NO: 1145536 - RNA, 19 nt, Homo sapiens
uguaaagaauggaagaaga

SEQ ID NO: 1145537 - RNA, 19 nt, Homo sapiens
cuaaggaaccaauguauuc

SEQ ID NO: 1145538 - RNA, 19 nt, Homo sapiens
aguagugguugauuaguaa

SEQ ID NO: 1145539 - RNA, 19 nt, Homo sapiens
uuaccucaauuucagagua

SEQ ID NO: 1145540 - RNA, 19 nt, Homo sapiens
uaaagugacuacuguuugc

SEQ ID NO: 1145541 - RNA, 19 nt, Homo sapiens
gagaauuauuugccuacug

SEQ ID NO: 1145542 - RNA, 19 nt, Homo sapiens
gcaaucauacugacauaag

SEQ ID NO: 1145543 - RNA, 19 nt, Homo sapiens
acauuucccuccuuuauca

SEQ ID NO: 1145544 - RNA, 19 nt, Homo sapiens
uauuugacaucuacaguug

SEQ ID NO: 1145545 - RNA, 19 nt, Homo sapiens
ugacuacuguuugcuauca

SEQ ID NO: 1145546 - RNA, 19 nt, Homo sapiens
ucaaacuccugaccucaug

SEQ ID NO: 1145547 - RNA, 19 nt, Homo sapiens
gaaacccuggcucuacuaa

SEQ ID NO: 1145548 - RNA, 19 nt, Homo sapiens
ucucagauucccauuuaua

SEQ ID NO: 1145549 - RNA, 19 nt, Homo sapiens
aaguagugguugauuagua

SEQ ID NO: 1145550 - RNA, 19 nt, Homo sapiens
gaauggaagaagaauaugu

SEQ ID NO: 1145551 - RNA, 19 nt, Homo sapiens
ugucuggcuuucuaucaua

SEQ ID NO: 1145552 - RNA, 19 nt, Homo sapiens
guaaguagugguugauuag

SEQ ID NO: 1145553 - RNA, 19 nt, Homo sapiens
ugaaaggagauaaacguuu

SEQ ID NO: 1145554 - RNA, 19 nt, Homo sapiens
ugacaucuacaguuggaua

SEQ ID NO: 1145555 - RNA, 19 nt, Homo sapiens
gaccaugucgaauuaaaug

SEQ ID NO: 1145556 - RNA, 19 nt, Homo sapiens
guauugguguugcaacuca

SEQ ID NO: 1145557 - RNA, 19 nt, Homo sapiens
ucagaagguuaacuugaau

SEQ ID NO: 1145558 - RNA, 19 nt, Homo sapiens
gcaggagaauggcuugaac

SEQ ID NO: 1145559 - RNA, 19 nt, Homo sapiens
uaccucaauuucagaguaa

SEQ ID NO: 1145560 - RNA, 19 nt, Homo sapiens
gcagucuauuucuguauca

SEQ ID NO: 1145561 - RNA, 19 nt, Homo sapiens
caguguauccaguuguuua

SEQ ID NO: 1145562 - RNA, 19 nt, Homo sapiens
uaaaguaucagggaaagug

SEQ ID NO: 1145563 - RNA, 19 nt, Homo sapiens
uuuccuggaugguaaagua

SEQ ID NO: 1145564 - RNA, 19 nt, Homo sapiens
cucagaagguuaacuugaa

SEQ ID NO: 1145565 - RNA, 19 nt, Homo sapiens
ggaaccaauguauucagua

SEQ ID NO: 1145566 - RNA, 19 nt, Homo sapiens
uagaaagagauccaaauug

SEQ ID NO: 1145567 - RNA, 19 nt, Homo sapiens
cugaaccaaucacucuaua

SEQ ID NO: 1145568 - RNA, 19 nt, Homo sapiens
ccugugaccugaaccaauc

SEQ ID NO: 1145569 - RNA, 19 nt, Homo sapiens
gguaaaguaucagggaaag

SEQ ID NO: 1145570 - RNA, 19 nt, Homo sapiens
uuaccuggccuauagauga

SEQ ID NO: 1145571 - RNA, 19 nt, Homo sapiens
guauccaguuguuuauguu

SEQ ID NO: 1145572 - RNA, 19 nt, Homo sapiens
aaggagaugugguggguau

SEQ ID NO: 1145573 - RNA, 19 nt, Homo sapiens
gugauuauuucaguucaga

SEQ ID NO: 1145574 - RNA, 19 nt, Homo sapiens
caccagacccaccaaauca

SEQ ID NO: 1145575 - RNA, 19 nt, Homo sapiens
gguuuaagcgauucucuug

SEQ ID NO: 1145576 - RNA, 19 nt, Homo sapiens
gccgagauaugcacagucu

SEQ ID NO: 1145577 - RNA, 19 nt, Homo sapiens
caaucacucuauacaucuu

SEQ ID NO: 1145578 - RNA, 19 nt, Homo sapiens
ccaugucgaauuaaaugua

SEQ ID NO: 1145579 - RNA, 19 nt, Homo sapiens
caaagugcuggaauuauag

SEQ ID NO: 1145580 - RNA, 19 nt, Homo sapiens
caacuagaaacaguacauu

SEQ ID NO: 1145581 - RNA, 19 nt, Homo sapiens
gggacaguguauccaguug

SEQ ID NO: 1145582 - RNA, 19 nt, Homo sapiens
gaacuuauaugacaucuug

SEQ ID NO: 1145583 - RNA, 19 nt, Homo sapiens
gcgaugagcuuuaacauuu

SEQ ID NO: 1145584 - RNA, 19 nt, Homo sapiens
caaaguugaugaccgaaua

SEQ ID NO: 1145585 - RNA, 19 nt, Homo sapiens
gaacuuggcagucauauuc

SEQ ID NO: 1145586 - RNA, 19 nt, Homo sapiens
gaaguuaaauccacucaag

SEQ ID NO: 1145587 - RNA, 19 nt, Homo sapiens
gaacuugaucgauacuuua

SEQ ID NO: 1145588 - RNA, 19 nt, Homo sapiens
uggaagaacuugaucgaua

SEQ ID NO: 1145589 - RNA, 19 nt, Homo sapiens
ugacagaaguccucacuga

SEQ ID NO: 1145590 - RNA, 19 nt, Homo sapiens
ugaaggaccucuuugaguu

SEQ ID NO: 1145591 - RNA, 19 nt, Homo sapiens
ucacaaugcugaccgauau

SEQ ID NO: 1145592 - RNA, 19 nt, Homo sapiens
ugaagugccugcugaagaa

SEQ ID NO: 1145593 - RNA, 19 nt, Homo sapiens
agucagagaugaaggagua

SEQ ID NO: 1145594 - RNA, 19 nt, Homo sapiens
gagguggacuguaaagaga

SEQ ID NO: 1145595 - RNA, 19 nt, Homo sapiens
ggaagaacuugaucgauac

SEQ ID NO: 1145596 - RNA, 19 nt, Homo sapiens
gaacuuugccucuacuuuc

SEQ ID NO: 1145597 - RNA, 19 nt, Homo sapiens
uaacaguucucaaucagau

SEQ ID NO: 1145598 - RNA, 19 nt, Homo sapiens
ucaaagagcagaaccagaa

SEQ ID NO: 1145599 - RNA, 19 nt, Homo sapiens
cgaugagcuuuaacauuua

SEQ ID NO: 1145600 - RNA, 19 nt, Homo sapiens
caucgaagcuugcuaugca

SEQ ID NO: 1145601 - RNA, 19 nt, Homo sapiens
caucaaggguggcaucgaa

SEQ ID NO: 1145602 - RNA, 19 nt, Homo sapiens
gcauggaacugugcaacaa

SEQ ID NO: 1145603 - RNA, 19 nt, Homo sapiens
gcgcugcucucaguuauug

SEQ ID NO: 1145604 - RNA, 19 nt, Homo sapiens
gcccagagcaggagaauug

SEQ ID NO: 1145605 - RNA, 19 nt, Homo sapiens
gugggcugcuccuguauua

SEQ ID NO: 1145606 - RNA, 19 nt, Homo sapiens
gaccauuccuacugggaua

SEQ ID NO: 1145607 - RNA, 19 nt, Homo sapiens
ggcauuugcucgcuauauu

SEQ ID NO: 1145608 - RNA, 19 nt, Homo sapiens
caagaccauuucaaaguug

SEQ ID NO: 1145609 - RNA, 19 nt, Homo sapiens
acaagaccauuucaaaguu

SEQ ID NO: 1145610 - RNA, 19 nt, Homo sapiens
ggaaugccaugcugaggau

SEQ ID NO: 1145611 - RNA, 19 nt, Homo sapiens
gaugcacucuccuggcuuu

SEQ ID NO: 1145612 - RNA, 19 nt, Homo sapiens
caaauggacacaccaagaa

SEQ ID NO: 1145613 - RNA, 19 nt, Homo sapiens
gagauuccauggagaucaa

SEQ ID NO: 1145614 - RNA, 19 nt, Homo sapiens
gcacacugcccacgucuug

SEQ ID NO: 1145615 - RNA, 19 nt, Homo sapiens
ggaucuagguauagugaga

SEQ ID NO: 1145616 - RNA, 19 nt, Homo sapiens
ucaaagcuuucuacauuca

SEQ ID NO: 1145617 - RNA, 19 nt, Homo sapiens
aggccaagcuccaguguuu

SEQ ID NO: 1145618 - RNA, 19 nt, Homo sapiens
gggaacaagucagagauga

SEQ ID NO: 1145619 - RNA, 19 nt, Homo sapiens
gaagaaagcaucgcagucu

SEQ ID NO: 1145620 - RNA, 19 nt, Homo sapiens
gacaagaccauuucaaagu

SEQ ID NO: 1145621 - RNA, 19 nt, Homo sapiens
uacgagagcaugaucaaua

SEQ ID NO: 1145622 - RNA, 19 nt, Homo sapiens
ggagcacauucaaagcuuu

SEQ ID NO: 1145623 - RNA, 19 nt, Homo sapiens
gagcgaaggucaggugcaa

SEQ ID NO: 1145624 - RNA, 19 nt, Homo sapiens
gcaaugccaggagaaguua

SEQ ID NO: 1145625 - RNA, 19 nt, Homo sapiens
uaacuaacuuccugucagu

SEQ ID NO: 1145626 - RNA, 19 nt, Homo sapiens
gaagccacacggucccuua

SEQ ID NO: 1145627 - RNA, 19 nt, Homo sapiens
gagaggagccuugacauca

SEQ ID NO: 1145628 - RNA, 19 nt, Homo sapiens
agagugggcugcuccugua

SEQ ID NO: 1145629 - RNA, 19 nt, Homo sapiens
ucaauaccaugcugaagga

SEQ ID NO: 1145630 - RNA, 19 nt, Homo sapiens
gcagaacuuggcagucaua

SEQ ID NO: 1145631 - RNA, 19 nt, Homo sapiens
agaacuugaucgauacuuu

SEQ ID NO: 1145632 - RNA, 19 nt, Homo sapiens
gaccaagaccuuucuagga

SEQ ID NO: 1145633 - RNA, 19 nt, Homo sapiens
caaagacaccaaacaacuu

SEQ ID NO: 1145634 - RNA, 19 nt, Homo sapiens
guugagagaugugacgaaa

SEQ ID NO: 1145635 - RNA, 19 nt, Homo sapiens
uaaagagauuggagacugu

SEQ ID NO: 1145636 - RNA, 19 nt, Homo sapiens
gagcugaaggcaucaaaga

SEQ ID NO: 1145637 - RNA, 19 nt, Homo sapiens
guaaggagacgcugagcaa

SEQ ID NO: 1145638 - RNA, 19 nt, Homo sapiens
gaaggaccucuuugaguug

SEQ ID NO: 1145639 - RNA, 19 nt, Homo sapiens
uaugacaucuuguuagaag

SEQ ID NO: 1145640 - RNA, 19 nt, Homo sapiens
ugacaccggucugauagaa

SEQ ID NO: 1145641 - RNA, 19 nt, Homo sapiens
gaacaagucagagaugaag

SEQ ID NO: 1145642 - RNA, 19 nt, Homo sapiens
gauauugacggcuuagaga

SEQ ID NO: 1145643 - RNA, 19 nt, Homo sapiens
uugaggagcucuaccauca

SEQ ID NO: 1145644 - RNA, 19 nt, Homo sapiens
ggacaccgcucugcagaac

SEQ ID NO: 1145645 - RNA, 19 nt, Homo sapiens
caacauggugcuaacaguu

SEQ ID NO: 1145646 - RNA, 19 nt, Homo sapiens
gaccgauauugacggcuua

SEQ ID NO: 1145647 - RNA, 19 nt, Homo sapiens
gcgccaggcuguucauaca

SEQ ID NO: 1145648 - RNA, 19 nt, Homo sapiens
guugaugaccgaauacaaa

SEQ ID NO: 1145649 - RNA, 19 nt, Homo sapiens
ucaagaggcugcacaagcu

SEQ ID NO: 1145650 - RNA, 19 nt, Homo sapiens
ccugccagcucauuauuga

SEQ ID NO: 1145651 - RNA, 19 nt, Homo sapiens
ucuuugagcuguugagaga

SEQ ID NO: 1145652 - RNA, 19 nt, Homo sapiens
gcagugaggauggaauuga

SEQ ID NO: 1145653 - RNA, 19 nt, Homo sapiens
gcaucgcagucucagcuuu

SEQ ID NO: 1145654 - RNA, 19 nt, Homo sapiens
gugcuguucucaccaauca

SEQ ID NO: 1145655 - RNA, 19 nt, Homo sapiens
cuauuggucuguccuguga

SEQ ID NO: 1145656 - RNA, 19 nt, Homo sapiens
cagcuggaauugugugaug

SEQ ID NO: 1145657 - RNA, 19 nt, Homo sapiens
ggacugccagggaguuuga

SEQ ID NO: 1145658 - RNA, 19 nt, Homo sapiens
ccaaauggacacaccaaga

SEQ ID NO: 1145659 - RNA, 19 nt, Homo sapiens
ggaacaagucagagaugaa

SEQ ID NO: 1145660 - RNA, 19 nt, Homo sapiens
cuccagaacuuauaugaca

SEQ ID NO: 1145661 - RNA, 19 nt, Homo sapiens
gguggacuguaaagagauu

SEQ ID NO: 1145662 - RNA, 19 nt, Homo sapiens
ggaggcugcuugccauaag

SEQ ID NO: 1145663 - RNA, 19 nt, Homo sapiens
ggcgagugcuguccucaga

SEQ ID NO: 1145664 - RNA, 19 nt, Homo sapiens
gauagaagucuggauaauc

SEQ ID NO: 1145665 - RNA, 19 nt, Homo sapiens
gaugaaggaguaccugguu

SEQ ID NO: 1145666 - RNA, 19 nt, Homo sapiens
uggaagcgcuggccuccuu

SEQ ID NO: 1145667 - RNA, 19 nt, Homo sapiens
gaacgcagacagccucuac

SEQ ID NO: 1145668 - RNA, 19 nt, Homo sapiens
ggaaacagcagcacaaccu

SEQ ID NO: 1145669 - RNA, 19 nt, Homo sapiens
gggcugcuccuguauuaga

SEQ ID NO: 1145670 - RNA, 19 nt, Homo sapiens
ggauggagacccuuguuca

SEQ ID NO: 1145671 - RNA, 19 nt, Homo sapiens
gcaucagugucaccacaga

SEQ ID NO: 1145672 - RNA, 19 nt, Homo sapiens
gcuccugucucucuccaau

SEQ ID NO: 1145673 - RNA, 19 nt, Homo sapiens
gcuaacaguucucaaucag

SEQ ID NO: 1145674 - RNA, 19 nt, Homo sapiens
ggucaaaguggagaagaaa

SEQ ID NO: 1145675 - RNA, 19 nt, Homo sapiens
gguguuacuccagaacuua

SEQ ID NO: 1145676 - RNA, 19 nt, Homo sapiens
ugaugacaccggucugaua

SEQ ID NO: 1145677 - RNA, 19 nt, Homo sapiens
cagugaggauggaauugaa

SEQ ID NO: 1145678 - RNA, 19 nt, Homo sapiens
ggagguggacuguaaagag

SEQ ID NO: 1145679 - RNA, 19 nt, Homo sapiens
uccaguguuugauguauuu

SEQ ID NO: 1145680 - RNA, 19 nt, Homo sapiens
gaccgaagcaugcaucaag

SEQ ID NO: 1145681 - RNA, 19 nt, Homo sapiens
acaccgcucugcagaacuu

SEQ ID NO: 1145682 - RNA, 19 nt, Homo sapiens
ggagaaaucugcugcaugu

SEQ ID NO: 1145683 - RNA, 19 nt, Homo sapiens
gaacagggaggcaauguaa

SEQ ID NO: 1145684 - RNA, 19 nt, Homo sapiens
gaacaucaguuuacccaau

SEQ ID NO: 1145685 - RNA, 19 nt, Homo sapiens
caacagaaauugccgguau

SEQ ID NO: 1145686 - RNA, 19 nt, Homo sapiens
gagaagaccugaggauuug

SEQ ID NO: 1145687 - RNA, 19 nt, Homo sapiens
gcauuuaacugcaucagaa

SEQ ID NO: 1145688 - RNA, 19 nt, Homo sapiens
uaaaugagcuaaugcagau

SEQ ID NO: 1145689 - RNA, 19 nt, Homo sapiens
caagagaucuaugaaguug

SEQ ID NO: 1145690 - RNA, 19 nt, Homo sapiens
ggacagcgguggcaagauc

SEQ ID NO: 1145691 - RNA, 19 nt, Homo sapiens
gaaagccauuugaggguuu

SEQ ID NO: 1145692 - RNA, 19 nt, Homo sapiens
gaaaucugcugcauguugu

SEQ ID NO: 1145693 - RNA, 19 nt, Homo sapiens
gugaauagaugauguugga

SEQ ID NO: 1145694 - RNA, 19 nt, Homo sapiens
ggagguagaaucaauaaga

SEQ ID NO: 1145695 - RNA, 19 nt, Homo sapiens
gcagauucauucauucaga

SEQ ID NO: 1145696 - RNA, 19 nt, Homo sapiens
gcaaggcuuucuuaagguu

SEQ ID NO: 1145697 - RNA, 19 nt, Homo sapiens
caaagucacuggccacauc

SEQ ID NO: 1145698 - RNA, 19 nt, Homo sapiens
acaaaccacaguaguauua

SEQ ID NO: 1145699 - RNA, 19 nt, Homo sapiens
ccagagagguuaagugucu

SEQ ID NO: 1145700 - RNA, 19 nt, Homo sapiens
gagaugaggugggcuugaa

SEQ ID NO: 1145701 - RNA, 19 nt, Homo sapiens
ccacauaaggcuauuuaaa

SEQ ID NO: 1145702 - RNA, 19 nt, Homo sapiens
gugaaacccuuaaucaauc

SEQ ID NO: 1145703 - RNA, 19 nt, Homo sapiens
gaggugggcuugaaaguac

SEQ ID NO: 1145704 - RNA, 19 nt, Homo sapiens
gcaauuucauuacucaaca

SEQ ID NO: 1145705 - RNA, 19 nt, Homo sapiens
gaggugaaauuggaaguug

SEQ ID NO: 1145706 - RNA, 19 nt, Homo sapiens
gggcacauguggaagcaaa

SEQ ID NO: 1145707 - RNA, 19 nt, Homo sapiens
caucagaaccaguaugaaa

SEQ ID NO: 1145708 - RNA, 19 nt, Homo sapiens
caauaagacucagugaaga

SEQ ID NO: 1145709 - RNA, 19 nt, Homo sapiens
gcagugagccaagaucgua

SEQ ID NO: 1145710 - RNA, 19 nt, Homo sapiens
uuacaguuguugcagauaa

SEQ ID NO: 1145711 - RNA, 19 nt, Homo sapiens
ugagaagaccugaggauuu

SEQ ID NO: 1145712 - RNA, 19 nt, Homo sapiens
gugcagugaugaggaauaa

SEQ ID NO: 1145713 - RNA, 19 nt, Homo sapiens
guaaagcagcauauucaaa

SEQ ID NO: 1145714 - RNA, 19 nt, Homo sapiens
gcaagagaucuaugaaguu

SEQ ID NO: 1145715 - RNA, 19 nt, Homo sapiens
gaaacccugccucuacuaa

SEQ ID NO: 1145716 - RNA, 19 nt, Homo sapiens
gggaggcaauguaaucaga

SEQ ID NO: 1145717 - RNA, 19 nt, Homo sapiens
acaaugaccuggcaccaau

SEQ ID NO: 1145718 - RNA, 19 nt, Homo sapiens
guggaucacuugaggaguu

SEQ ID NO: 1145719 - RNA, 19 nt, Homo sapiens
gaaugcaagagaucuauga

SEQ ID NO: 1145720 - RNA, 19 nt, Homo sapiens
ucagauuuaugccuuagaa

SEQ ID NO: 1145721 - RNA, 19 nt, Homo sapiens
guuaaucacccagcaauuu

SEQ ID NO: 1145722 - RNA, 19 nt, Homo sapiens
uaagugcagugaugaggaa

SEQ ID NO: 1145723 - RNA, 19 nt, Homo sapiens
gaugcuaagugcagugaug

SEQ ID NO: 1145724 - RNA, 19 nt, Homo sapiens
ccacuaggucaucuuauuu

SEQ ID NO: 1145725 - RNA, 19 nt, Homo sapiens
gcaccacuguuuuaaaauu

SEQ ID NO: 1145726 - RNA, 19 nt, Homo sapiens
ugacagagugaaacccuua

SEQ ID NO: 1145727 - RNA, 19 nt, Homo sapiens
ucacccagcaauuucauua

SEQ ID NO: 1145728 - RNA, 19 nt, Homo sapiens
agaaaccuuugacgucuuu

SEQ ID NO: 1145729 - RNA, 19 nt, Homo sapiens
gguaagggcacauguggaa

SEQ ID NO: 1145730 - RNA, 19 nt, Homo sapiens
uugcuaaacucgaucuaaa

SEQ ID NO: 1145731 - RNA, 19 nt, Homo sapiens
ccugggagauuguuaggaa

SEQ ID NO: 1145732 - RNA, 19 nt, Homo sapiens
ccacaaaccacaguaguau

SEQ ID NO: 1145733 - RNA, 19 nt, Homo sapiens
acaauucagucacucauuc

SEQ ID NO: 1145734 - RNA, 19 nt, Homo sapiens
gaagcucgguacugucaca

SEQ ID NO: 1145735 - RNA, 19 nt, Homo sapiens
ucuccagaguugcacauua

SEQ ID NO: 1145736 - RNA, 19 nt, Homo sapiens
ccaugaagaucccgcugaa

SEQ ID NO: 1145737 - RNA, 19 nt, Homo sapiens
aagaagagcggauugaaug

SEQ ID NO: 1145738 - RNA, 19 nt, Homo sapiens
cauucaagguucacuguug

SEQ ID NO: 1145739 - RNA, 19 nt, Homo sapiens
cagauucauucauucagaa

SEQ ID NO: 1145740 - RNA, 19 nt, Homo sapiens
gaauguaggccacaaacca

SEQ ID NO: 1145741 - RNA, 19 nt, Homo sapiens
ccugggaccuccucaacaa

SEQ ID NO: 1145742 - RNA, 19 nt, Homo sapiens
agacauggaagcuuagaaa

SEQ ID NO: 1145743 - RNA, 19 nt, Homo sapiens
ucaauaagacucagugaag

SEQ ID NO: 1145744 - RNA, 19 nt, Homo sapiens
ggaccgcacacccuuagaa

SEQ ID NO: 1145745 - RNA, 19 nt, Homo sapiens
cugcaaggcuuucuuaagg

SEQ ID NO: 1145746 - RNA, 19 nt, Homo sapiens
ccucgaagcucgguacugu

SEQ ID NO: 1145747 - RNA, 19 nt, Homo sapiens
gaagaucccgcugaacaau

SEQ ID NO: 1145748 - RNA, 19 nt, Homo sapiens
gagugaaacccuuaaucaa

SEQ ID NO: 1145749 - RNA, 19 nt, Homo sapiens
ugcaagagaucuaugaagu

SEQ ID NO: 1145750 - RNA, 19 nt, Homo sapiens
caagaagagcggauugaau

SEQ ID NO: 1145751 - RNA, 19 nt, Homo sapiens
ccagcaauuucauuacuca

SEQ ID NO: 1145752 - RNA, 19 nt, Homo sapiens
caagcaggguggacuucuu

SEQ ID NO: 1145753 - RNA, 19 nt, Homo sapiens
gcagugaugaggaauaaag

SEQ ID NO: 1145754 - RNA, 19 nt, Homo sapiens
ccaccacuaggucaucuua

SEQ ID NO: 1145755 - RNA, 19 nt, Homo sapiens
agagaucuaugaaguugga

SEQ ID NO: 1145756 - RNA, 19 nt, Homo sapiens
guuagacagugcagagaga

SEQ ID NO: 1145757 - RNA, 19 nt, Homo sapiens
uuaguugacuguguguuaa

SEQ ID NO: 1145758 - RNA, 19 nt, Homo sapiens
ggcuugacauucaggauga

SEQ ID NO: 1145759 - RNA, 19 nt, Homo sapiens
caguaaagcagcauauuca

SEQ ID NO: 1145760 - RNA, 19 nt, Homo sapiens
ugaaacccuuaaucaauca

SEQ ID NO: 1145761 - RNA, 19 nt, Homo sapiens
gauaauuuccagagacugu

SEQ ID NO: 1145762 - RNA, 19 nt, Homo sapiens
gccacaaaccacaguagua

SEQ ID NO: 1145763 - RNA, 19 nt, Homo sapiens
ugaugccacugaaguuuga

SEQ ID NO: 1145764 - RNA, 19 nt, Homo sapiens
gaagucauggguccucaga

SEQ ID NO: 1145765 - RNA, 19 nt, Homo sapiens
gagguagaaucaauaagac

SEQ ID NO: 1145766 - RNA, 19 nt, Homo sapiens
gcagagcauuuggcuguag

SEQ ID NO: 1145767 - RNA, 19 nt, Homo sapiens
agaaaucugcugcauguug

SEQ ID NO: 1145768 - RNA, 19 nt, Homo sapiens
cuacucuucucuccaguga

SEQ ID NO: 1145769 - RNA, 19 nt, Homo sapiens
gagauucugaugccacuga

SEQ ID NO: 1145770 - RNA, 19 nt, Homo sapiens
uuagggagguagaaucaau

SEQ ID NO: 1145771 - RNA, 19 nt, Homo sapiens
gaacgagcucuaugucgau

SEQ ID NO: 1145772 - RNA, 19 nt, Homo sapiens
gaaccaggagcuucagauc

SEQ ID NO: 1145773 - RNA, 19 nt, Homo sapiens
uagaugauguuggaaguca

SEQ ID NO: 1145774 - RNA, 19 nt, Homo sapiens
gggagucauuagugaauag

SEQ ID NO: 1145775 - RNA, 19 nt, Homo sapiens
guucuuggccucacggauu

SEQ ID NO: 1145776 - RNA, 19 nt, Homo sapiens
cccaggcucuccuuaguug

SEQ ID NO: 1145777 - RNA, 19 nt, Homo sapiens
ggucauuccacucugguuu

SEQ ID NO: 1145778 - RNA, 19 nt, Homo sapiens
gcacuggucauuccacucu

SEQ ID NO: 1145779 - RNA, 19 nt, Homo sapiens
ggugaaacccugccucuac

SEQ ID NO: 1145780 - RNA, 19 nt, Homo sapiens
agaaggaccauucaagguu

SEQ ID NO: 1145781 - RNA, 19 nt, Homo sapiens
aaagcagcauauucaaaug

SEQ ID NO: 1145782 - RNA, 19 nt, Homo sapiens
gcaaauaccugaaagauug

SEQ ID NO: 1145783 - RNA, 19 nt, Homo sapiens
gcauuauucugaaggauuu

SEQ ID NO: 1145784 - RNA, 19 nt, Homo sapiens
gagaagaauucagaagaaa

SEQ ID NO: 1145785 - RNA, 19 nt, Homo sapiens
caucagaacaguugccuua

SEQ ID NO: 1145786 - RNA, 19 nt, Homo sapiens
gaaaccucaucucuacuaa

SEQ ID NO: 1145787 - RNA, 19 nt, Homo sapiens
gcaaacaauucggcaaguu

SEQ ID NO: 1145788 - RNA, 19 nt, Homo sapiens
ggugaaaccucaucucuac

SEQ ID NO: 1145789 - RNA, 19 nt, Homo sapiens
gauacaauccggaugauga

SEQ ID NO: 1145790 - RNA, 19 nt, Homo sapiens
agagaagaauucagaagaa

SEQ ID NO: 1145791 - RNA, 19 nt, Homo sapiens
gaagaauucagaagaaaca

SEQ ID NO: 1145792 - RNA, 19 nt, Homo sapiens
gaugauuacucaaggcaau

SEQ ID NO: 1145793 - RNA, 19 nt, Homo sapiens
cagaacaguugccuuaaca

SEQ ID NO: 1145794 - RNA, 19 nt, Homo sapiens
aaacacaucagaacaguug

SEQ ID NO: 1145795 - RNA, 19 nt, Homo sapiens
guaagaaggcaacaaguuc

SEQ ID NO: 1145796 - RNA, 19 nt, Homo sapiens
uaaagcaguucguaagaag

SEQ ID NO: 1145797 - RNA, 19 nt, Homo sapiens
gcaauaugcagcucaagga

SEQ ID NO: 1145798 - RNA, 19 nt, Homo sapiens
uaacaaauggccaguagau

SEQ ID NO: 1145799 - RNA, 19 nt, Homo sapiens
uaacaauggacaacacaaa

SEQ ID NO: 1145800 - RNA, 19 nt, Homo sapiens
cauggcugcuucccgcuua

SEQ ID NO: 1145801 - RNA, 19 nt, Homo sapiens
uuaaagcaguucguaagaa

SEQ ID NO: 1145802 - RNA, 19 nt, Homo sapiens
acaaagcccagucuuacua

SEQ ID NO: 1145803 - RNA, 19 nt, Homo sapiens
gcaggagaaucacuugaac

SEQ ID NO: 1145804 - RNA, 19 nt, Homo sapiens
ugaaaccucaucucuacua

SEQ ID NO: 1145805 - RNA, 19 nt, Homo sapiens
ggcaagagaagaauucaga

SEQ ID NO: 1145806 - RNA, 19 nt, Homo sapiens
agcccagucuuacuauuua

SEQ ID NO: 1145807 - RNA, 19 nt, Homo sapiens
gaaagauugggcaagagaa

SEQ ID NO: 1145808 - RNA, 19 nt, Homo sapiens
ccugaaagauugggcaaga

SEQ ID NO: 1145809 - RNA, 19 nt, Homo sapiens
gaucgcaaauaccugaaag

SEQ ID NO: 1145810 - RNA, 19 nt, Homo sapiens
aaacauacccugcauuuug

SEQ ID NO: 1145811 - RNA, 19 nt, Homo sapiens
uuagggaaguguaaaucaa

SEQ ID NO: 1145812 - RNA, 19 nt, Homo sapiens
aaaugauucugaucgcaaa

SEQ ID NO: 1145813 - RNA, 19 nt, Homo sapiens
uguaguggcucaugcuugu

SEQ ID NO: 1145814 - RNA, 19 nt, Homo sapiens
gcaagagaagaauucagaa

SEQ ID NO: 1145815 - RNA, 19 nt, Homo sapiens
gaacaguugccuuaacacu

SEQ ID NO: 1145816 - RNA, 19 nt, Homo sapiens
uacaguauuuggugauaga

SEQ ID NO: 1145817 - RNA, 19 nt, Homo sapiens
caaacaauucggcaaguuc

SEQ ID NO: 1145818 - RNA, 19 nt, Homo sapiens
cguaagaaggcaacaaguu

SEQ ID NO: 1145819 - RNA, 19 nt, Homo sapiens
ugauagagagcaaaggaaa

SEQ ID NO: 1145820 - RNA, 19 nt, Homo sapiens
auaugcagcucaaggaguu

SEQ ID NO: 1145821 - RNA, 19 nt, Homo sapiens
gguggugcauugccuguag

SEQ ID NO: 1145822 - RNA, 19 nt, Homo sapiens
guuaaagcaguucguaaga

SEQ ID NO: 1145823 - RNA, 19 nt, Homo sapiens
ggugauagagagcaaagga

SEQ ID NO: 1145824 - RNA, 19 nt, Homo sapiens
guacaguauuuggugauag

SEQ ID NO: 1145825 - RNA, 19 nt, Homo sapiens
ucaaagucuccauguguuu

SEQ ID NO: 1145826 - RNA, 19 nt, Homo sapiens
gaaguggagguugcaguga

SEQ ID NO: 1145827 - RNA, 19 nt, Homo sapiens
ugugguagguggaucacuu

SEQ ID NO: 1145828 - RNA, 19 nt, Homo sapiens
ugucucagcaguucuuaaa

SEQ ID NO: 1145829 - RNA, 19 nt, Homo sapiens
ugaaagauugggcaagaga

SEQ ID NO: 1145830 - RNA, 19 nt, Homo sapiens
ggcaggagaaucacuugaa

SEQ ID NO: 1145831 - RNA, 19 nt, Homo sapiens
ucagaacaguugccuuaac

SEQ ID NO: 1145832 - RNA, 19 nt, Homo sapiens
aagagaagaauucagaaga

SEQ ID NO: 1145833 - RNA, 19 nt, Homo sapiens
acuaacaaauggccaguag

SEQ ID NO: 1145834 - RNA, 19 nt, Homo sapiens
uguacaguauuuggugaua

SEQ ID NO: 1145835 - RNA, 19 nt, Homo sapiens
aacaaguucuucuccucua

SEQ ID NO: 1145836 - RNA, 19 nt, Homo sapiens
caaagcccagucuuacuau

SEQ ID NO: 1145837 - RNA, 19 nt, Homo sapiens
gauuaacaauggacaacac

SEQ ID NO: 1145838 - RNA, 19 nt, Homo sapiens
gaugcuggacacaaucauu

SEQ ID NO: 1145839 - RNA, 19 nt, Homo sapiens
aguagaugcuggacacaau

SEQ ID NO: 1145840 - RNA, 19 nt, Homo sapiens
caagagaagaauucagaag

SEQ ID NO: 1145841 - RNA, 19 nt, Homo sapiens
acacaaagcccagucuuac

SEQ ID NO: 1145842 - RNA, 19 nt, Homo sapiens
aacacaaagcccagucuua

SEQ ID NO: 1145843 - RNA, 19 nt, Homo sapiens
caacacaaagcccagucuu

SEQ ID NO: 1145844 - RNA, 19 nt, Homo sapiens
uagggaaguguaaaucaaa

SEQ ID NO: 1145845 - RNA, 19 nt, Homo sapiens
aagcccagucuuacuauuu

SEQ ID NO: 1145846 - RNA, 19 nt, Homo sapiens
ggaugucucagcaguucuu

SEQ ID NO: 1145847 - RNA, 19 nt, Homo sapiens
gcccagucuuacuauuuau

SEQ ID NO: 1145848 - RNA, 19 nt, Homo sapiens
aaagcccagucuuacuauu

SEQ ID NO: 1145849 - RNA, 19 nt, Homo sapiens
uucaaagucuccauguguu

SEQ ID NO: 1145850 - RNA, 19 nt, Homo sapiens
gcggaccucugguggacau

SEQ ID NO: 1145851 - RNA, 19 nt, Homo sapiens
cgcaaauaccugaaagauu

SEQ ID NO: 1145852 - RNA, 19 nt, Homo sapiens
augcuggacacaaucauua

SEQ ID NO: 1145853 - RNA, 19 nt, Homo sapiens
cggcaaguuccaaaugauu

SEQ ID NO: 1145854 - RNA, 19 nt, Homo sapiens
aaccucaucucuacuaaaa

SEQ ID NO: 1145855 - RNA, 19 nt, Homo sapiens
cuuguaaucccaguacuuu

SEQ ID NO: 1145856 - RNA, 19 nt, Homo sapiens
aaucauuagggaaguguaa

SEQ ID NO: 1145857 - RNA, 19 nt, Homo sapiens
gaaggauuuugcaaacaau

SEQ ID NO: 1145858 - RNA, 19 nt, Homo sapiens
gcaaguuccaaaugauucu

SEQ ID NO: 1145859 - RNA, 19 nt, Homo sapiens
uguaaucccaguacuuuag

SEQ ID NO: 1145860 - RNA, 19 nt, Homo sapiens
acuaugaggucggguguag

SEQ ID NO: 1145861 - RNA, 19 nt, Homo sapiens
ggcaaguuccaaaugauuc

SEQ ID NO: 1145862 - RNA, 19 nt, Homo sapiens
agaaggauuuugcaaacaa

SEQ ID NO: 1145863 - RNA, 19 nt, Homo sapiens
uuaggaggcugugguaggu

SEQ ID NO: 1145864 - RNA, 19 nt, Homo sapiens
ggugacagagugagacagu

SEQ ID NO: 1145865 - RNA, 19 nt, Homo sapiens
aaaccucaucucuacuaaa

SEQ ID NO: 1145866 - RNA, 19 nt, Homo sapiens
ucacuugaggucaggaguu

SEQ ID NO: 1145867 - RNA, 19 nt, Homo sapiens
caauucggcaaguuccaaa

SEQ ID NO: 1145868 - RNA, 19 nt, Homo sapiens
uuucaaagucuccaugugu

SEQ ID NO: 1145869 - RNA, 19 nt, Homo sapiens
uaguggcucaugcuuguaa

SEQ ID NO: 1145870 - RNA, 19 nt, Homo sapiens
acacaaucauuagggaagu

SEQ ID NO: 1145871 - RNA, 19 nt, Homo sapiens
caaauggccaguagaugcu

SEQ ID NO: 1145872 - RNA, 19 nt, Homo sapiens
cacuugaggucaggaguuc

SEQ ID NO: 1145873 - RNA, 19 nt, Homo sapiens
uaugaggucggguguagug

SEQ ID NO: 1145874 - RNA, 19 nt, Homo sapiens
ugauucugaucgcaaauac

SEQ ID NO: 1145875 - RNA, 19 nt, Homo sapiens
ggagaaagcuguuuaugau

SEQ ID NO: 1145876 - RNA, 19 nt, Homo sapiens
gaucuuaccuccugauaaa

SEQ ID NO: 1145877 - RNA, 19 nt, Homo sapiens
ccaagaaacucaaccacua

SEQ ID NO: 1145878 - RNA, 19 nt, Homo sapiens
ggagaagcauugauugaug

SEQ ID NO: 1145879 - RNA, 19 nt, Homo sapiens
gcagcuacgucaccuauga

SEQ ID NO: 1145880 - RNA, 19 nt, Homo sapiens
gagaagcauugauugaugu

SEQ ID NO: 1145881 - RNA, 19 nt, Homo sapiens
gaaacucaaccacuaguga

SEQ ID NO: 1145882 - RNA, 19 nt, Homo sapiens
gcgagaaagaggaauauuu

SEQ ID NO: 1145883 - RNA, 19 nt, Homo sapiens
gagaaagcuguuuaugaua

SEQ ID NO: 1145884 - RNA, 19 nt, Homo sapiens
uaaccaggcccucuuacua

SEQ ID NO: 1145885 - RNA, 19 nt, Homo sapiens
gaaagcuguuuaugauauc

SEQ ID NO: 1145886 - RNA, 19 nt, Homo sapiens
acacguugacugcuuauua

SEQ ID NO: 1145887 - RNA, 19 nt, Homo sapiens
cuaacacguugacugcuua

SEQ ID NO: 1145888 - RNA, 19 nt, Homo sapiens
gagauacuguccauacaag

SEQ ID NO: 1145889 - RNA, 19 nt, Homo sapiens
gcuaacacguugacugcuu

SEQ ID NO: 1145890 - RNA, 19 nt, Homo sapiens
gcagcgagaaagaggaaua

SEQ ID NO: 1145891 - RNA, 19 nt, Homo sapiens
ccaacaaccucaugcuuac

SEQ ID NO: 1145892 - RNA, 19 nt, Homo sapiens
gaggcuggauaccacagua

SEQ ID NO: 1145893 - RNA, 19 nt, Homo sapiens
ggagauacuguccauacaa

SEQ ID NO: 1145894 - RNA, 19 nt, Homo sapiens
uacuagagcugguguuugu

SEQ ID NO: 1145895 - RNA, 19 nt, Homo sapiens
gcacucauugcaguuguua

SEQ ID NO: 1145896 - RNA, 19 nt, Homo sapiens
cacguugacugcuuauuau

SEQ ID NO: 1145897 - RNA, 19 nt, Homo sapiens
cccaacaaccucaugcuua

SEQ ID NO: 1145898 - RNA, 19 nt, Homo sapiens
ccagggagaagcauugauu

SEQ ID NO: 1145899 - RNA, 19 nt, Homo sapiens
caaccacuagugacaauga

SEQ ID NO: 1145900 - RNA, 19 nt, Homo sapiens
ccaacaagauguggcuaug

SEQ ID NO: 1145901 - RNA, 19 nt, Homo sapiens
ggacauggagaaagcuguu

SEQ ID NO: 1145902 - RNA, 19 nt, Homo sapiens
caaaugccgacaucacuga

SEQ ID NO: 1145903 - RNA, 19 nt, Homo sapiens
gguaggagacuauggagau

SEQ ID NO: 1145904 - RNA, 19 nt, Homo sapiens
gaagggagagaaaagauuu

SEQ ID NO: 1145905 - RNA, 19 nt, Homo sapiens
uggagaaagcuguuuauga

SEQ ID NO: 1145906 - RNA, 19 nt, Homo sapiens
gugcugaucugccucuucu

SEQ ID NO: 1145907 - RNA, 19 nt, Homo sapiens
gagaucuuaccuccugaua

SEQ ID NO: 1145908 - RNA, 19 nt, Homo sapiens
gaugaccaccccaauuuua

SEQ ID NO: 1145909 - RNA, 19 nt, Homo sapiens
ggaccagggacauggagaa

SEQ ID NO: 1145910 - RNA, 19 nt, Homo sapiens
caagaaacucaaccacuag

SEQ ID NO: 1145911 - RNA, 19 nt, Homo sapiens
gucauuggcugcucuacuc

SEQ ID NO: 1145912 - RNA, 19 nt, Homo sapiens
ccagggacauggagaaagc

SEQ ID NO: 1145913 - RNA, 19 nt, Homo sapiens
ugaccagccuccugacuac

SEQ ID NO: 1145914 - RNA, 19 nt, Homo sapiens
cugaguaugugcccaguca

SEQ ID NO: 1145915 - RNA, 19 nt, Homo sapiens
gggagaagcauugauugau

SEQ ID NO: 1145916 - RNA, 19 nt, Homo sapiens
uaucaccguugucuuccuu

SEQ ID NO: 1145917 - RNA, 19 nt, Homo sapiens
guaggagacuauggagauc

SEQ ID NO: 1145918 - RNA, 19 nt, Homo sapiens
ccagauggagagugacuug

SEQ ID NO: 1145919 - RNA, 19 nt, Homo sapiens
ccagugccaucguccagau

SEQ ID NO: 1145920 - RNA, 19 nt, Homo sapiens
gacuacuccuucuccaaga

SEQ ID NO: 1145921 - RNA, 19 nt, Homo sapiens
uaugugcccagucaucuuu

SEQ ID NO: 1145922 - RNA, 19 nt, Homo sapiens
ccaagagaagaacugauga

SEQ ID NO: 1145923 - RNA, 19 nt, Homo sapiens
ccaggucgcagucccaaau

SEQ ID NO: 1145924 - RNA, 19 nt, Homo sapiens
gaagccagggagaagcauu

SEQ ID NO: 1145925 - RNA, 19 nt, Homo sapiens
ccaagggcagcgagaaaga

SEQ ID NO: 1145926 - RNA, 19 nt, Homo sapiens
ccucaugcuuacgugauuu

SEQ ID NO: 1145927 - RNA, 19 nt, Homo sapiens
acauggagaaagcuguuua

SEQ ID NO: 1145928 - RNA, 19 nt, Homo sapiens
gaccagggacauggagaaa

SEQ ID NO: 1145929 - RNA, 19 nt, Homo sapiens
ggccaagggcagcgagaaa

SEQ ID NO: 1145930 - RNA, 19 nt, Homo sapiens
gcccuuccuuuccguguuc

SEQ ID NO: 1145931 - RNA, 19 nt, Homo sapiens
gggcagcgagaaagaggaa

SEQ ID NO: 1145932 - RNA, 19 nt, Homo sapiens
cagcacagcacucauugca

SEQ ID NO: 1145933 - RNA, 19 nt, Homo sapiens
ggagacuauggagaucuua

SEQ ID NO: 1145934 - RNA, 19 nt, Homo sapiens
gauacuguccauacaaggu

SEQ ID NO: 1145935 - RNA, 19 nt, Homo sapiens
cuagagcugguguuuguga

SEQ ID NO: 1145936 - RNA, 19 nt, Homo sapiens
ugaucugccucuucuccaa

SEQ ID NO: 1145937 - RNA, 19 nt, Homo sapiens
uccaagagaagaacugaug

SEQ ID NO: 1145938 - RNA, 19 nt, Homo sapiens
gaguaugugcccagucauc

SEQ ID NO: 1145939 - RNA, 19 nt, Homo sapiens
cagcacucauugcaguugu

SEQ ID NO: 1145940 - RNA, 19 nt, Homo sapiens
ggagccagcacagcacuca

SEQ ID NO: 1145941 - RNA, 19 nt, Homo sapiens
cgucaccuaugaaccuaca

SEQ ID NO: 1145942 - RNA, 19 nt, Homo sapiens
aggagacuauggagaucuu

SEQ ID NO: 1145943 - RNA, 19 nt, Homo sapiens
gugacuggccaacaagaug

SEQ ID NO: 1145944 - RNA, 19 nt, Homo sapiens
gagaugaauugcacuauuu

SEQ ID NO: 1145945 - RNA, 19 nt, Homo sapiens
ggucauagcugugcuguuu

SEQ ID NO: 1145946 - RNA, 19 nt, Homo sapiens
gaacucgaauccucuuuaa

SEQ ID NO: 1145947 - RNA, 19 nt, Homo sapiens
guacaucgcugucugaaau

SEQ ID NO: 1145948 - RNA, 19 nt, Homo sapiens
gaacauuggucugucuaua

SEQ ID NO: 1145949 - RNA, 19 nt, Homo sapiens
gagcuauguugccuaauua

SEQ ID NO: 1145950 - RNA, 19 nt, Homo sapiens
ccaagaauaucuacagaaa

SEQ ID NO: 1145951 - RNA, 19 nt, Homo sapiens
gagaauguauuuacuccua

SEQ ID NO: 1145952 - RNA, 19 nt, Homo sapiens
gaaaugcugucucuucaug

SEQ ID NO: 1145953 - RNA, 19 nt, Homo sapiens
ucucugaccuuacuuauaa

SEQ ID NO: 1145954 - RNA, 19 nt, Homo sapiens
gaagaaaccaaguaugaaa

SEQ ID NO: 1145955 - RNA, 19 nt, Homo sapiens
ggagcuauguugccuaauu

SEQ ID NO: 1145956 - RNA, 19 nt, Homo sapiens
ugaagaagguauuguugua

SEQ ID NO: 1145957 - RNA, 19 nt, Homo sapiens
ggaaucagcagaauaggua

SEQ ID NO: 1145958 - RNA, 19 nt, Homo sapiens
gauucucucuuaccaaaua

SEQ ID NO: 1145959 - RNA, 19 nt, Homo sapiens
agaaagaauuccuguguuu

SEQ ID NO: 1145960 - RNA, 19 nt, Homo sapiens
gaccagaauuaucaaauga

SEQ ID NO: 1145961 - RNA, 19 nt, Homo sapiens
gaauugcacuauuuaagga

SEQ ID NO: 1145962 - RNA, 19 nt, Homo sapiens
acaagcagcugacuuaugu

SEQ ID NO: 1145963 - RNA, 19 nt, Homo sapiens
gaugcuauauucugugaaa

SEQ ID NO: 1145964 - RNA, 19 nt, Homo sapiens
ggaugaaaguauugacaaa

SEQ ID NO: 1145965 - RNA, 19 nt, Homo sapiens
gauguaaacacuuggauuu

SEQ ID NO: 1145966 - RNA, 19 nt, Homo sapiens
ucaacaagcagcugacuua

SEQ ID NO: 1145967 - RNA, 19 nt, Homo sapiens
gaacaggaacacacagaaa

SEQ ID NO: 1145968 - RNA, 19 nt, Homo sapiens
guggaggaauuuaaugaua

SEQ ID NO: 1145969 - RNA, 19 nt, Homo sapiens
cagauacugugaaucauuu

SEQ ID NO: 1145970 - RNA, 19 nt, Homo sapiens
ggaaauguauacugauuac

SEQ ID NO: 1145971 - RNA, 19 nt, Homo sapiens
gaaacuuacugaacugcuu

SEQ ID NO: 1145972 - RNA, 19 nt, Homo sapiens
gugguaaagugaaauguaa

SEQ ID NO: 1145973 - RNA, 19 nt, Homo sapiens
acaagaagcuuuucaauga

SEQ ID NO: 1145974 - RNA, 19 nt, Homo sapiens
gauaagauacuaccagaug

SEQ ID NO: 1145975 - RNA, 19 nt, Homo sapiens
gagaugcuauauucuguga

SEQ ID NO: 1145976 - RNA, 19 nt, Homo sapiens
ggugaugacuguagaagga

SEQ ID NO: 1145977 - RNA, 19 nt, Homo sapiens
guuaggacuucaggaauua

SEQ ID NO: 1145978 - RNA, 19 nt, Homo sapiens
gaaguuaccucugugacau

SEQ ID NO: 1145979 - RNA, 19 nt, Homo sapiens
gcagcugacuuauguuuua

SEQ ID NO: 1145980 - RNA, 19 nt, Homo sapiens
ggaggaauuuaaugauaga

SEQ ID NO: 1145981 - RNA, 19 nt, Homo sapiens
ggaacucgaauccucuuua

SEQ ID NO: 1145982 - RNA, 19 nt, Homo sapiens
cgagggugguagaaauuua

SEQ ID NO: 1145983 - RNA, 19 nt, Homo sapiens
gugaagaaaccaaguauga

SEQ ID NO: 1145984 - RNA, 19 nt, Homo sapiens
gaagagaugaauugcacua

SEQ ID NO: 1145985 - RNA, 19 nt, Homo sapiens
gaagaagguauuguuguaa

SEQ ID NO: 1145986 - RNA, 19 nt, Homo sapiens
gaagaauugcagaagauuu

SEQ ID NO: 1145987 - RNA, 19 nt, Homo sapiens
gaaauuugcagaaccuaga

SEQ ID NO: 1145988 - RNA, 19 nt, Homo sapiens
uuuaagaggugcagaauca

SEQ ID NO: 1145989 - RNA, 19 nt, Homo sapiens
caaacuaugagaugucuuu

SEQ ID NO: 1145990 - RNA, 19 nt, Homo sapiens
cgaccagaauuaucaaaug

SEQ ID NO: 1145991 - RNA, 19 nt, Homo sapiens
agagaaaggucagcauuug

SEQ ID NO: 1145992 - RNA, 19 nt, Homo sapiens
gaaaaggggagaaucauuu

SEQ ID NO: 1145993 - RNA, 19 nt, Homo sapiens
ugaagcauaugaacauguu

SEQ ID NO: 1145994 - RNA, 19 nt, Homo sapiens
caucugugcugaaguuaga

SEQ ID NO: 1145995 - RNA, 19 nt, Homo sapiens
ggagaaacaggaauaagau

SEQ ID NO: 1145996 - RNA, 19 nt, Homo sapiens
gguauagaauaacccauug

SEQ ID NO: 1145997 - RNA, 19 nt, Homo sapiens
gacacgagccugaacauug

SEQ ID NO: 1145998 - RNA, 19 nt, Homo sapiens
ggagaaucauuuggaauca

SEQ ID NO: 1145999 - RNA, 19 nt, Homo sapiens
gauacuaccagauguaaau

SEQ ID NO: 1146000 - RNA, 19 nt, Homo sapiens
gaugaaaugcugucucuuc

SEQ ID NO: 1146001 - RNA, 19 nt, Homo sapiens
gugaaucauuugcuuauca

SEQ ID NO: 1146002 - RNA, 19 nt, Homo sapiens
gcaguuaggacuucaggaa

SEQ ID NO: 1146003 - RNA, 19 nt, Homo sapiens
ggaauaagaucugauuuuc

SEQ ID NO: 1146004 - RNA, 19 nt, Homo sapiens
cagaauagguagcaaaauu

SEQ ID NO: 1146005 - RNA, 19 nt, Homo sapiens
gaauguauuuacuccuaug

SEQ ID NO: 1146006 - RNA, 19 nt, Homo sapiens
gcaaacagauaagacugau

SEQ ID NO: 1146007 - RNA, 19 nt, Homo sapiens
agaauuucauggugcauuu

SEQ ID NO: 1146008 - RNA, 19 nt, Homo sapiens
aaaccuugcugcauggaaa

SEQ ID NO: 1146009 - RNA, 19 nt, Homo sapiens
caugaagaauugcagaaga

SEQ ID NO: 1146010 - RNA, 19 nt, Homo sapiens
gcauauagaagugauaguu

SEQ ID NO: 1146011 - RNA, 19 nt, Homo sapiens
aaacaggaauaagaucuga

SEQ ID NO: 1146012 - RNA, 19 nt, Homo sapiens
gaaggcccauacauagaug

SEQ ID NO: 1146013 - RNA, 19 nt, Homo sapiens
uagauuugaucccuucauu

SEQ ID NO: 1146014 - RNA, 19 nt, Homo sapiens
gaaguuagaauugaagcaa

SEQ ID NO: 1146015 - RNA, 19 nt, Homo sapiens
gugcugaaguuagaauuga

SEQ ID NO: 1146016 - RNA, 19 nt, Homo sapiens
agagaugaauugcacuauu

SEQ ID NO: 1146017 - RNA, 19 nt, Homo sapiens
acauaggccuucuuugcua

SEQ ID NO: 1146018 - RNA, 19 nt, Homo sapiens
cauagucuuucauuugcua

SEQ ID NO: 1146019 - RNA, 19 nt, Homo sapiens
uuacauuccagaucuguua

SEQ ID NO: 1146020 - RNA, 19 nt, Homo sapiens
ccaaguagaccagaacuga

SEQ ID NO: 1146021 - RNA, 19 nt, Homo sapiens
aagcagcaaugaagcauau

SEQ ID NO: 1146022 - RNA, 19 nt, Homo sapiens
uaagauacuaccagaugua

SEQ ID NO: 1146023 - RNA, 19 nt, Homo sapiens
gaauaucuacagaaacuuc

SEQ ID NO: 1146024 - RNA, 19 nt, Homo sapiens
gcagaaauuugcagaaccu

SEQ ID NO: 1146025 - RNA, 19 nt, Homo sapiens
gaugacaguccaccugaaa

SEQ ID NO: 1146026 - RNA, 19 nt, Homo sapiens
uaaagcauccuauaugagu

SEQ ID NO: 1146027 - RNA, 19 nt, Homo sapiens
ggugguagaaauuuacuuu

SEQ ID NO: 1146028 - RNA, 19 nt, Homo sapiens
guaaacacuuggauuuggu

SEQ ID NO: 1146029 - RNA, 19 nt, Homo sapiens
caaguguauuggugaagaa

SEQ ID NO: 1146030 - RNA, 19 nt, Homo sapiens
cguuuggucucacucauaa

SEQ ID NO: 1146031 - RNA, 19 nt, Homo sapiens
aaagaaagaauuccugugu

SEQ ID NO: 1146032 - RNA, 19 nt, Homo sapiens
gcugaaggcccauacauag

SEQ ID NO: 1146033 - RNA, 19 nt, Homo sapiens
guagaagagauucaaagaa

SEQ ID NO: 1146034 - RNA, 19 nt, Homo sapiens
auacaaacccaagcaguua

SEQ ID NO: 1146035 - RNA, 19 nt, Homo sapiens
gcaacagacugcagaucuc

SEQ ID NO: 1146036 - RNA, 19 nt, Homo sapiens
gcaaugaagcauauagaag

SEQ ID NO: 1146037 - RNA, 19 nt, Homo sapiens
acacuuggauuugguauag

SEQ ID NO: 1146038 - RNA, 19 nt, Homo sapiens
uaugaaagcaucagacuuc

SEQ ID NO: 1146039 - RNA, 19 nt, Homo sapiens
augauuaccugauguaugu

SEQ ID NO: 1146040 - RNA, 19 nt, Homo sapiens
gauuugaucccuucauugu

SEQ ID NO: 1146041 - RNA, 19 nt, Homo sapiens
ugcagaaccuagaaauaaa

SEQ ID NO: 1146042 - RNA, 19 nt, Homo sapiens
caaugaagcauauagaagu

SEQ ID NO: 1146043 - RNA, 19 nt, Homo sapiens
guauggagaaacaggaaua

SEQ ID NO: 1146044 - RNA, 19 nt, Homo sapiens
gaacagagguagccuaagu

SEQ ID NO: 1146045 - RNA, 19 nt, Homo sapiens
gagaugaauugcacuauuu

SEQ ID NO: 1146046 - RNA, 19 nt, Homo sapiens
ggucauagcugugcuguuu

SEQ ID NO: 1146047 - RNA, 19 nt, Homo sapiens
gaacucgaauccucuuuaa

SEQ ID NO: 1146048 - RNA, 19 nt, Homo sapiens
guacaucgcugucugaaau

SEQ ID NO: 1146049 - RNA, 19 nt, Homo sapiens
gaacauuggucugucuaua

SEQ ID NO: 1146050 - RNA, 19 nt, Homo sapiens
gagcuauguugccuaauua

SEQ ID NO: 1146051 - RNA, 19 nt, Homo sapiens
ccaagaauaucuacagaaa

SEQ ID NO: 1146052 - RNA, 19 nt, Homo sapiens
gagaauguauuuacuccua

SEQ ID NO: 1146053 - RNA, 19 nt, Homo sapiens
gaaaugcugucucuucaug

SEQ ID NO: 1146054 - RNA, 19 nt, Homo sapiens
ucucugaccuuacuuauaa

SEQ ID NO: 1146055 - RNA, 19 nt, Homo sapiens
gaagaaaccaaguaugaaa

SEQ ID NO: 1146056 - RNA, 19 nt, Homo sapiens
ggagcuauguugccuaauu

SEQ ID NO: 1146057 - RNA, 19 nt, Homo sapiens
ugaagaagguauuguugua

SEQ ID NO: 1146058 - RNA, 19 nt, Homo sapiens
ggaaucagcagaauaggua

SEQ ID NO: 1146059 - RNA, 19 nt, Homo sapiens
gauucucucuuaccaaaua

SEQ ID NO: 1146060 - RNA, 19 nt, Homo sapiens
agaaagaauuccuguguuu

SEQ ID NO: 1146061 - RNA, 19 nt, Homo sapiens
gaugaugaauccuuuguug

SEQ ID NO: 1146062 - RNA, 19 nt, Homo sapiens
gaccagaauuaucaaauga

SEQ ID NO: 1146063 - RNA, 19 nt, Homo sapiens
gaauugcacuauuuaagga

SEQ ID NO: 1146064 - RNA, 19 nt, Homo sapiens
ucucagagguucuugaauu

SEQ ID NO: 1146065 - RNA, 19 nt, Homo sapiens
acaagcagcugacuuaugu

SEQ ID NO: 1146066 - RNA, 19 nt, Homo sapiens
gaugcuauauucugugaaa

SEQ ID NO: 1146067 - RNA, 19 nt, Homo sapiens
ggaugaaaguauugacaaa

SEQ ID NO: 1146068 - RNA, 19 nt, Homo sapiens
gauguaaacacuuggauuu

SEQ ID NO: 1146069 - RNA, 19 nt, Homo sapiens
ucaacaagcagcugacuua

SEQ ID NO: 1146070 - RNA, 19 nt, Homo sapiens
guggaggaauuuaaugaua

SEQ ID NO: 1146071 - RNA, 19 nt, Homo sapiens
cagauacugugaaucauuu

SEQ ID NO: 1146072 - RNA, 19 nt, Homo sapiens
gaacugagaauaacauuac

SEQ ID NO: 1146073 - RNA, 19 nt, Homo sapiens
ggaaauguauacugauuac

SEQ ID NO: 1146074 - RNA, 19 nt, Homo sapiens
gaaacuuacugaacugcuu

SEQ ID NO: 1146075 - RNA, 19 nt, Homo sapiens
gugguaaagugaaauguaa

SEQ ID NO: 1146076 - RNA, 19 nt, Homo sapiens
acaagaagcuuuucaauga

SEQ ID NO: 1146077 - RNA, 19 nt, Homo sapiens
gauaagauacuaccagaug

SEQ ID NO: 1146078 - RNA, 19 nt, Homo sapiens
gagaugcuauauucuguga

SEQ ID NO: 1146079 - RNA, 19 nt, Homo sapiens
ggugaugacuguagaagga

SEQ ID NO: 1146080 - RNA, 19 nt, Homo sapiens
guuaggacuucaggaauua

SEQ ID NO: 1146081 - RNA, 19 nt, Homo sapiens
gaaguuaccucugugacau

SEQ ID NO: 1146082 - RNA, 19 nt, Homo sapiens
gcagcugacuuauguuuua

SEQ ID NO: 1146083 - RNA, 19 nt, Homo sapiens
ggaggaauuuaaugauaga

SEQ ID NO: 1146084 - RNA, 19 nt, Homo sapiens
ggaacucgaauccucuuua

SEQ ID NO: 1146085 - RNA, 19 nt, Homo sapiens
uaagaaggauucacaaggu

SEQ ID NO: 1146086 - RNA, 19 nt, Homo sapiens
cgagggugguagaaauuua

SEQ ID NO: 1146087 - RNA, 19 nt, Homo sapiens
gugaagaaaccaaguauga

SEQ ID NO: 1146088 - RNA, 19 nt, Homo sapiens
gaagagaugaauugcacua

SEQ ID NO: 1146089 - RNA, 19 nt, Homo sapiens
gacagaugaugaauccuuu

SEQ ID NO: 1146090 - RNA, 19 nt, Homo sapiens
gaagaagguauuguuguaa

SEQ ID NO: 1146091 - RNA, 19 nt, Homo sapiens
gaagaauugcagaagauuu

SEQ ID NO: 1146092 - RNA, 19 nt, Homo sapiens
gaaauuugcagaaccuaga

SEQ ID NO: 1146093 - RNA, 19 nt, Homo sapiens
uuuaagaggugcagaauca

SEQ ID NO: 1146094 - RNA, 19 nt, Homo sapiens
caaacuaugagaugucuuu

SEQ ID NO: 1146095 - RNA, 19 nt, Homo sapiens
cgaccagaauuaucaaaug

SEQ ID NO: 1146096 - RNA, 19 nt, Homo sapiens
agagaaaggucagcauuug

SEQ ID NO: 1146097 - RNA, 19 nt, Homo sapiens
gaaaaggggagaaucauuu

SEQ ID NO: 1146098 - RNA, 19 nt, Homo sapiens
ugaagcauaugaacauguu

SEQ ID NO: 1146099 - RNA, 19 nt, Homo sapiens
caucugugcugaaguuaga

SEQ ID NO: 1146100 - RNA, 19 nt, Homo sapiens
ggagaaacaggaauaagau

SEQ ID NO: 1146101 - RNA, 19 nt, Homo sapiens
gguauagaauaacccauug

SEQ ID NO: 1146102 - RNA, 19 nt, Homo sapiens
gacacgagccugaacauug

SEQ ID NO: 1146103 - RNA, 19 nt, Homo sapiens
ggagaaucauuuggaauca

SEQ ID NO: 1146104 - RNA, 19 nt, Homo sapiens
gauacuaccagauguaaau

SEQ ID NO: 1146105 - RNA, 19 nt, Homo sapiens
gaugaaaugcugucucuuc

SEQ ID NO: 1146106 - RNA, 19 nt, Homo sapiens
gugaaucauuugcuuauca

SEQ ID NO: 1146107 - RNA, 19 nt, Homo sapiens
gcaguuaggacuucaggaa

SEQ ID NO: 1146108 - RNA, 19 nt, Homo sapiens
ggaauaagaucugauuuuc

SEQ ID NO: 1146109 - RNA, 19 nt, Homo sapiens
cagaauagguagcaaaauu

SEQ ID NO: 1146110 - RNA, 19 nt, Homo sapiens
gaauguauuuacuccuaug

SEQ ID NO: 1146111 - RNA, 19 nt, Homo sapiens
gcaaacagauaagacugau

SEQ ID NO: 1146112 - RNA, 19 nt, Homo sapiens
agaauuucauggugcauuu

SEQ ID NO: 1146113 - RNA, 19 nt, Homo sapiens
aaaccuugcugcauggaaa

SEQ ID NO: 1146114 - RNA, 19 nt, Homo sapiens
caugaagaauugcagaaga

SEQ ID NO: 1146115 - RNA, 19 nt, Homo sapiens
gcauauagaagugauaguu

SEQ ID NO: 1146116 - RNA, 19 nt, Homo sapiens
acagggaugugacagauga

SEQ ID NO: 1146117 - RNA, 19 nt, Homo sapiens
guacagggaugugacagau

SEQ ID NO: 1146118 - RNA, 19 nt, Homo sapiens
cucagagguucuugaauua

SEQ ID NO: 1146119 - RNA, 19 nt, Homo sapiens
aaacaggaauaagaucuga

SEQ ID NO: 1146120 - RNA, 19 nt, Homo sapiens
guugaugaacugagaauaa

SEQ ID NO: 1146121 - RNA, 19 nt, Homo sapiens
gaugaauccuuuguugaug

SEQ ID NO: 1146122 - RNA, 19 nt, Homo sapiens
gaaggcccauacauagaug

SEQ ID NO: 1146123 - RNA, 19 nt, Homo sapiens
uagauuugaucccuucauu

SEQ ID NO: 1146124 - RNA, 19 nt, Homo sapiens
gaaguuagaauugaagcaa

SEQ ID NO: 1146125 - RNA, 19 nt, Homo sapiens
gugcugaaguuagaauuga

SEQ ID NO: 1146126 - RNA, 19 nt, Homo sapiens
agagaugaauugcacuauu

SEQ ID NO: 1146127 - RNA, 19 nt, Homo sapiens
acauaggccuucuuugcua

SEQ ID NO: 1146128 - RNA, 19 nt, Homo sapiens
cauagucuuucauuugcua

SEQ ID NO: 1146129 - RNA, 19 nt, Homo sapiens
uuacauuccagaucuguua

SEQ ID NO: 1146130 - RNA, 19 nt, Homo sapiens
ccaaguagaccagaacuga

SEQ ID NO: 1146131 - RNA, 19 nt, Homo sapiens
aagcagcaaugaagcauau

SEQ ID NO: 1146132 - RNA, 19 nt, Homo sapiens
uaagauacuaccagaugua

SEQ ID NO: 1146133 - RNA, 19 nt, Homo sapiens
gaauaucuacagaaacuuc

SEQ ID NO: 1146134 - RNA, 19 nt, Homo sapiens
gcagaaauuugcagaaccu

SEQ ID NO: 1146135 - RNA, 19 nt, Homo sapiens
gaugacaguccaccugaaa

SEQ ID NO: 1146136 - RNA, 19 nt, Homo sapiens
uaaagcauccuauaugagu

SEQ ID NO: 1146137 - RNA, 19 nt, Homo sapiens
ggugguagaaauuuacuuu

SEQ ID NO: 1146138 - RNA, 19 nt, Homo sapiens
guaaacacuuggauuuggu

SEQ ID NO: 1146139 - RNA, 19 nt, Homo sapiens
caaguguauuggugaagaa

SEQ ID NO: 1146140 - RNA, 19 nt, Homo sapiens
cguuuggucucacucauaa

SEQ ID NO: 1146141 - RNA, 19 nt, Homo sapiens
aaagaaagaauuccugugu

SEQ ID NO: 1146142 - RNA, 19 nt, Homo sapiens
gcugaaggcccauacauag

SEQ ID NO: 1146143 - RNA, 19 nt, Homo sapiens
guagaagagauucaaagaa

SEQ ID NO: 1146144 - RNA, 19 nt, Homo sapiens
gaucguggcugguuuguua

SEQ ID NO: 1146145 - RNA, 19 nt, Homo sapiens
agaaagagauucaggauua

SEQ ID NO: 1146146 - RNA, 19 nt, Homo sapiens
gugcaucucuucacaauua

SEQ ID NO: 1146147 - RNA, 19 nt, Homo sapiens
ggaauucaguucuuugaua

SEQ ID NO: 1146148 - RNA, 19 nt, Homo sapiens
gaaagaagauuuagaaggu

SEQ ID NO: 1146149 - RNA, 19 nt, Homo sapiens
gagaagagugucacaauua

SEQ ID NO: 1146150 - RNA, 19 nt, Homo sapiens
ggaaagagcauaagcuaaa

SEQ ID NO: 1146151 - RNA, 19 nt, Homo sapiens
gaacguaagacauuuguaa

SEQ ID NO: 1146152 - RNA, 19 nt, Homo sapiens
gaucauguaugguaaauuc

SEQ ID NO: 1146153 - RNA, 19 nt, Homo sapiens
ggauaaagcucuucuggau

SEQ ID NO: 1146154 - RNA, 19 nt, Homo sapiens
gaagacgccugauaauuuc

SEQ ID NO: 1146155 - RNA, 19 nt, Homo sapiens
gaaccuaacugugucagaa

SEQ ID NO: 1146156 - RNA, 19 nt, Homo sapiens
gcaauugaaucucucuuug

SEQ ID NO: 1146157 - RNA, 19 nt, Homo sapiens
ugaauaaguuccuacauga

SEQ ID NO: 1146158 - RNA, 19 nt, Homo sapiens
gaguauacuuggaucauaa

SEQ ID NO: 1146159 - RNA, 19 nt, Homo sapiens
ugaagacgccugauaauuu

SEQ ID NO: 1146160 - RNA, 19 nt, Homo sapiens
gcaauagcuuccuuaaaga

SEQ ID NO: 1146161 - RNA, 19 nt, Homo sapiens
gaacaguaguugcguuugu

SEQ ID NO: 1146162 - RNA, 19 nt, Homo sapiens
ggaggaaccuucugauuac

SEQ ID NO: 1146163 - RNA, 19 nt, Homo sapiens
gaagggcacuauagagaug

SEQ ID NO: 1146164 - RNA, 19 nt, Homo sapiens
gcuauugucucucccauga

SEQ ID NO: 1146165 - RNA, 19 nt, Homo sapiens
ucacagaacuggaugagau

SEQ ID NO: 1146166 - RNA, 19 nt, Homo sapiens
ggucaucgaacacuauuua

SEQ ID NO: 1146167 - RNA, 19 nt, Homo sapiens
caaucaacaugcauaauga

SEQ ID NO: 1146168 - RNA, 19 nt, Homo sapiens
ucacagaggguacaguuua

SEQ ID NO: 1146169 - RNA, 19 nt, Homo sapiens
gaauucaguucuuugauag

SEQ ID NO: 1146170 - RNA, 19 nt, Homo sapiens
gauuacagcugucaucauc

SEQ ID NO: 1146171 - RNA, 19 nt, Homo sapiens
gauaaggagucaagcuuuc

SEQ ID NO: 1146172 - RNA, 19 nt, Homo sapiens
gauguugccuauaaagcua

SEQ ID NO: 1146173 - RNA, 19 nt, Homo sapiens
gagaaaugaugaagaagca

SEQ ID NO: 1146174 - RNA, 19 nt, Homo sapiens
gaagauuccugcuguacca

SEQ ID NO: 1146175 - RNA, 19 nt, Homo sapiens
gcauuuggcuacuguaagu

SEQ ID NO: 1146176 - RNA, 19 nt, Homo sapiens
caaagaauaugggcuguca

SEQ ID NO: 1146177 - RNA, 19 nt, Homo sapiens
uaaacuggauucugauugu

SEQ ID NO: 1146178 - RNA, 19 nt, Homo sapiens
ugagaagagugucacaauu

SEQ ID NO: 1146179 - RNA, 19 nt, Homo sapiens
gauaagucauauacaccua

SEQ ID NO: 1146180 - RNA, 19 nt, Homo sapiens
uggaggaaccuucugauua

SEQ ID NO: 1146181 - RNA, 19 nt, Homo sapiens
guucaagacuagcagauau

SEQ ID NO: 1146182 - RNA, 19 nt, Homo sapiens
gacagccucuuaccauauu

SEQ ID NO: 1146183 - RNA, 19 nt, Homo sapiens
acaauucuguguaugguuu

SEQ ID NO: 1146184 - RNA, 19 nt, Homo sapiens
gcguauaagugcaauugaa

SEQ ID NO: 1146185 - RNA, 19 nt, Homo sapiens
gauccaagcauucgaauag

SEQ ID NO: 1146186 - RNA, 19 nt, Homo sapiens
caggucagcugaaugaaga

SEQ ID NO: 1146187 - RNA, 19 nt, Homo sapiens
gcacagcuuguuugaauug

SEQ ID NO: 1146188 - RNA, 19 nt, Homo sapiens
caucgaacacuauuuauug

SEQ ID NO: 1146189 - RNA, 19 nt, Homo sapiens
uaaagggaauucaguucuu

SEQ ID NO: 1146190 - RNA, 19 nt, Homo sapiens
ccaguauucugaaguuuau

SEQ ID NO: 1146191 - RNA, 19 nt, Homo sapiens
ggacugcaacucuauguau

SEQ ID NO: 1146192 - RNA, 19 nt, Homo sapiens
gaaagagauucaggauuag

SEQ ID NO: 1146193 - RNA, 19 nt, Homo sapiens
gccgauaacucaaaagaua

SEQ ID NO: 1146194 - RNA, 19 nt, Homo sapiens
gaaagagcauaagcuaaag

SEQ ID NO: 1146195 - RNA, 19 nt, Homo sapiens
uggaacugcugacacaaua

SEQ ID NO: 1146196 - RNA, 19 nt, Homo sapiens
gggaaagggucaacaguac

SEQ ID NO: 1146197 - RNA, 19 nt, Homo sapiens
ggacaugcaugccaacacu

SEQ ID NO: 1146198 - RNA, 19 nt, Homo sapiens
gagcauaagcuaaagaaag

SEQ ID NO: 1146199 - RNA, 19 nt, Homo sapiens
aaugacagaugagguauuu

SEQ ID NO: 1146200 - RNA, 19 nt, Homo sapiens
ugaagaagauguggaagau

SEQ ID NO: 1146201 - RNA, 19 nt, Homo sapiens
guuccuacaugaagguuaa

SEQ ID NO: 1146202 - RNA, 19 nt, Homo sapiens
uacgagaaaugaugaagaa

SEQ ID NO: 1146203 - RNA, 19 nt, Homo sapiens
agcaauagcuuccuuaaag

SEQ ID NO: 1146204 - RNA, 19 nt, Homo sapiens
caacccaaauccacuuuca

SEQ ID NO: 1146205 - RNA, 19 nt, Homo sapiens
gacucgaucuucaauuuau

SEQ ID NO: 1146206 - RNA, 19 nt, Homo sapiens
gaacaaugugugcuaccua

SEQ ID NO: 1146207 - RNA, 19 nt, Homo sapiens
ugacuuugcugucuuucuu

SEQ ID NO: 1146208 - RNA, 19 nt, Homo sapiens
ccaggugguugaaguuuga

SEQ ID NO: 1146209 - RNA, 19 nt, Homo sapiens
guaagacacugaagacacu

SEQ ID NO: 1146210 - RNA, 19 nt, Homo sapiens
ggucauaaacacagaaaga

SEQ ID NO: 1146211 - RNA, 19 nt, Homo sapiens
gcuuagcauuagugacuua

SEQ ID NO: 1146212 - RNA, 19 nt, Homo sapiens
gaaagguagucaaacuucu

SEQ ID NO: 1146213 - RNA, 19 nt, Homo sapiens
agaagagugucacaauuau

SEQ ID NO: 1146214 - RNA, 19 nt, Homo sapiens
ugaagacacugcagagcaa

SEQ ID NO: 1146215 - RNA, 19 nt, Homo sapiens
ggagaacaacccaaauuuc

SEQ ID NO: 1146216 - RNA, 19 nt, Homo sapiens
caacaugcauaaugaucug

SEQ ID NO: 1146217 - RNA, 19 nt, Homo sapiens
ggacagccucuuaccauau

SEQ ID NO: 1146218 - RNA, 19 nt, Homo sapiens
gcaacugaagggcguauaa

SEQ ID NO: 1146219 - RNA, 19 nt, Homo sapiens
gaaacagucagaaccaaau

SEQ ID NO: 1146220 - RNA, 19 nt, Homo sapiens
ugaaacagcaucaucauca

SEQ ID NO: 1146221 - RNA, 19 nt, Homo sapiens
aaagagagacagagaaaga

SEQ ID NO: 1146222 - RNA, 19 nt, Homo sapiens
gaauaaugaugugauagca

SEQ ID NO: 1146223 - RNA, 19 nt, Homo sapiens
guaagacauuuguaaacug

SEQ ID NO: 1146224 - RNA, 19 nt, Homo sapiens
gguaccaucuggaccuauu

SEQ ID NO: 1146225 - RNA, 19 nt, Homo sapiens
gcucugcuuuguacuauuc

SEQ ID NO: 1146226 - RNA, 19 nt, Homo sapiens
cuacaaguaccaaguguuu

SEQ ID NO: 1146227 - RNA, 19 nt, Homo sapiens
ugaagcaucgaacaucuua

SEQ ID NO: 1146228 - RNA, 19 nt, Homo sapiens
ugccaacacuuuagaagaa

SEQ ID NO: 1146229 - RNA, 19 nt, Homo sapiens
ugaguauacuuggaucaua

SEQ ID NO: 1146230 - RNA, 19 nt, Homo sapiens
ccugugagcagaaacaaua

SEQ ID NO: 1146231 - RNA, 19 nt, Homo sapiens
gaagagugucacaauuauu

SEQ ID NO: 1146232 - RNA, 19 nt, Homo sapiens
ucaguucuuugauaggaua

SEQ ID NO: 1146233 - RNA, 19 nt, Homo sapiens
cuaguucccuugucugcua

SEQ ID NO: 1146234 - RNA, 19 nt, Homo sapiens
ggucaacaguaccaugaga

SEQ ID NO: 1146235 - RNA, 19 nt, Homo sapiens
agaagaaauugcagauaug

SEQ ID NO: 1146236 - RNA, 19 nt, Homo sapiens
gaagaagcaguuguggaua

SEQ ID NO: 1146237 - RNA, 19 nt, Homo sapiens
gguugaaguuugaagaaga

SEQ ID NO: 1146238 - RNA, 19 nt, Homo sapiens
ugaccaguauucugaaguu

SEQ ID NO: 1146239 - RNA, 19 nt, Homo sapiens
ccaaucaacaugcauaaug

SEQ ID NO: 1146240 - RNA, 19 nt, Homo sapiens
uaaagaucguaaugacuug

SEQ ID NO: 1146241 - RNA, 19 nt, Homo sapiens
ccaacaggauucccauugu

SEQ ID NO: 1146242 - RNA, 19 nt, Homo sapiens
gaauaaguuccuacaugaa

SEQ ID NO: 1146243 - RNA, 19 nt, Homo sapiens
caaaagacccaaaucaaaa

SEQ ID NO: 1146244 - RNA, 19 nt, Homo sapiens
caacugaacuggcuuacuu

SEQ ID NO: 1146245 - RNA, 19 nt, Homo sapiens
caauguagcugucuccuuu

SEQ ID NO: 1146246 - RNA, 19 nt, Homo sapiens
acaggaaacucuucaagua

SEQ ID NO: 1146247 - RNA, 19 nt, Homo sapiens
caacagauaccaccaugua

SEQ ID NO: 1146248 - RNA, 19 nt, Homo sapiens
aaagaaugcugcuguaaug

SEQ ID NO: 1146249 - RNA, 19 nt, Homo sapiens
ugaacuggcuuacuuccua

SEQ ID NO: 1146250 - RNA, 19 nt, Homo sapiens
caagacaccuccaacagau

SEQ ID NO: 1146251 - RNA, 19 nt, Homo sapiens
gaaccaagcuccaaaacug

SEQ ID NO: 1146252 - RNA, 19 nt, Homo sapiens
ggugacauaugcacaguug

SEQ ID NO: 1146253 - RNA, 19 nt, Homo sapiens
ggagcucauuugacaugua

SEQ ID NO: 1146254 - RNA, 19 nt, Homo sapiens
gagagaacgugaccuuguc

SEQ ID NO: 1146255 - RNA, 19 nt, Homo sapiens
gcagggaccuacagauguc

SEQ ID NO: 1146256 - RNA, 19 nt, Homo sapiens
ggagagaacgugaccuugu

SEQ ID NO: 1146257 - RNA, 19 nt, Homo sapiens
ggcaucagucuucaucuua

SEQ ID NO: 1146258 - RNA, 19 nt, Homo sapiens
gaacauuccaggcugacuu

SEQ ID NO: 1146259 - RNA, 19 nt, Homo sapiens
ugggaaaccuucacucuca

SEQ ID NO: 1146260 - RNA, 19 nt, Homo sapiens
ucccugagcucuacaacaa

SEQ ID NO: 1146261 - RNA, 19 nt, Homo sapiens
gaacagggaggacucugau

SEQ ID NO: 1146262 - RNA, 19 nt, Homo sapiens
ggacaugugacucuucugu

SEQ ID NO: 1146263 - RNA, 19 nt, Homo sapiens
acucacaauuccagacaua

SEQ ID NO: 1146264 - RNA, 19 nt, Homo sapiens
gcaucagucuucaucuuag

SEQ ID NO: 1146265 - RNA, 19 nt, Homo sapiens
gcuaucauccucuucauca

SEQ ID NO: 1146266 - RNA, 19 nt, Homo sapiens
gaacucacaauuccagaca

SEQ ID NO: 1146267 - RNA, 19 nt, Homo sapiens
ccaagacaccuccaacaga

SEQ ID NO: 1146268 - RNA, 19 nt, Homo sapiens
caucauccucuucuucuuu

SEQ ID NO: 1146269 - RNA, 19 nt, Homo sapiens
gagcucauuugacauguac

SEQ ID NO: 1146270 - RNA, 19 nt, Homo sapiens
caucuucagucuguacaaa

SEQ ID NO: 1146271 - RNA, 19 nt, Homo sapiens
gcccacaauucucuauuuc

SEQ ID NO: 1146272 - RNA, 19 nt, Homo sapiens
uccaggagcucauuugaca

SEQ ID NO: 1146273 - RNA, 19 nt, Homo sapiens
ggagggaccuacacaugcu

SEQ ID NO: 1146274 - RNA, 19 nt, Homo sapiens
gaggacaugugacucuucu

SEQ ID NO: 1146275 - RNA, 19 nt, Homo sapiens
guugcuagcucccauguac

SEQ ID NO: 1146276 - RNA, 19 nt, Homo sapiens
gcccaccucuccaacugaa

SEQ ID NO: 1146277 - RNA, 19 nt, Homo sapiens
ggaccucaguggcuaucau

SEQ ID NO: 1146278 - RNA, 19 nt, Homo sapiens
ccacaauucucuauuucac

SEQ ID NO: 1146279 - RNA, 19 nt, Homo sapiens
ccucacaccacaaaucuga

SEQ ID NO: 1146280 - RNA, 19 nt, Homo sapiens
acaugugacucuucugugu

SEQ ID NO: 1146281 - RNA, 19 nt, Homo sapiens
agucagcagugaaacuuau

SEQ ID NO: 1146282 - RNA, 19 nt, Homo sapiens
cgucuuggguuuaccaucu

SEQ ID NO: 1146283 - RNA, 19 nt, Homo sapiens
ugaacaugccucucucuug

SEQ ID NO: 1146284 - RNA, 19 nt, Homo sapiens
ugacauaugcacaguugga

SEQ ID NO: 1146285 - RNA, 19 nt, Homo sapiens
cauugucuccugcccauaa

SEQ ID NO: 1146286 - RNA, 19 nt, Homo sapiens
ucaaguaguucaucuucac

SEQ ID NO: 1146287 - RNA, 19 nt, Homo sapiens
gcugucuccuuuucaaaua

SEQ ID NO: 1146288 - RNA, 19 nt, Homo sapiens
gcaaucacacugaggaacu

SEQ ID NO: 1146289 - RNA, 19 nt, Homo sapiens
caccacaaaucugaacaug

SEQ ID NO: 1146290 - RNA, 19 nt, Homo sapiens
aggaaacucuucaaguagu

SEQ ID NO: 1146291 - RNA, 19 nt, Homo sapiens
uggcuuacuuccuagucua

SEQ ID NO: 1146292 - RNA, 19 nt, Homo sapiens
gcuaagccaagaucauugu

SEQ ID NO: 1146293 - RNA, 19 nt, Homo sapiens
caaaugcuaagccaagauc

SEQ ID NO: 1146294 - RNA, 19 nt, Homo sapiens
cauuugacauguaccaucu

SEQ ID NO: 1146295 - RNA, 19 nt, Homo sapiens
cguggucacaggucuauuu

SEQ ID NO: 1146296 - RNA, 19 nt, Homo sapiens
cauaugcacaguuggauca

SEQ ID NO: 1146297 - RNA, 19 nt, Homo sapiens
acagggaggacucugauga

SEQ ID NO: 1146298 - RNA, 19 nt, Homo sapiens
agcccacaauucucuauuu

SEQ ID NO: 1146299 - RNA, 19 nt, Homo sapiens
cugugucgcucucgucuug

SEQ ID NO: 1146300 - RNA, 19 nt, Homo sapiens
gaggugacauaugcacagu

SEQ ID NO: 1146301 - RNA, 19 nt, Homo sapiens
aaacugguauccgcagaca

SEQ ID NO: 1146302 - RNA, 19 nt, Homo sapiens
caggagcucauuugacaug

SEQ ID NO: 1146303 - RNA, 19 nt, Homo sapiens
gaggaggacaugugacucu

SEQ ID NO: 1146304 - RNA, 19 nt, Homo sapiens
cagcagugaaacuuauaaa

SEQ ID NO: 1146305 - RNA, 19 nt, Homo sapiens
uguuucaccuuuccucaga

SEQ ID NO: 1146306 - RNA, 19 nt, Homo sapiens
aggcaucagucuucaucuu

SEQ ID NO: 1146307 - RNA, 19 nt, Homo sapiens
caggaaacucuucaaguag

SEQ ID NO: 1146308 - RNA, 19 nt, Homo sapiens
cucaugcuguuucaccuuu

SEQ ID NO: 1146309 - RNA, 19 nt, Homo sapiens
caggagagaacgugaccuu

SEQ ID NO: 1146310 - RNA, 19 nt, Homo sapiens
gccucucucuugcuuacaa

SEQ ID NO: 1146311 - RNA, 19 nt, Homo sapiens
cccauaagcaccacaguca

SEQ ID NO: 1146312 - RNA, 19 nt, Homo sapiens
gcucucgucuuggguuuac

SEQ ID NO: 1146313 - RNA, 19 nt, Homo sapiens
gguuuaccaucuucagucu

SEQ ID NO: 1146314 - RNA, 19 nt, Homo sapiens
caccugcacauucugauug

SEQ ID NO: 1146315 - RNA, 19 nt, Homo sapiens
cuccaugacucacccuaug

SEQ ID NO: 1146316 - RNA, 19 nt, Homo sapiens
gaucguggucacaggucua

SEQ ID NO: 1146317 - RNA, 19 nt, Homo sapiens
ucaccuuuccucagacuau

SEQ ID NO: 1146318 - RNA, 19 nt, Homo sapiens
ccucuuaacauggcacuga

SEQ ID NO: 1146319 - RNA, 19 nt, Homo sapiens
ugaacagggaggacucuga

SEQ ID NO: 1146320 - RNA, 19 nt, Homo sapiens
ccacugaaccaagcuccaa

SEQ ID NO: 1146321 - RNA, 19 nt, Homo sapiens
ugagacacgugcuguucca

SEQ ID NO: 1146322 - RNA, 19 nt, Homo sapiens
ucacaauuccagacauaca

SEQ ID NO: 1146323 - RNA, 19 nt, Homo sapiens
uuuaccaucuucagucugu

SEQ ID NO: 1146324 - RNA, 19 nt, Homo sapiens
acagauaccaccauguaca

SEQ ID NO: 1146325 - RNA, 19 nt, Homo sapiens
ggaggacaugugacucuuc

SEQ ID NO: 1146326 - RNA, 19 nt, Homo sapiens
gcagcaccaugucgcucau

SEQ ID NO: 1146327 - RNA, 19 nt, Homo sapiens
caccuuuccucagacuauu

SEQ ID NO: 1146328 - RNA, 19 nt, Homo sapiens
cucaggaggugacauaugc

SEQ ID NO: 1146329 - RNA, 19 nt, Homo sapiens
gugacccacugcuuguuuc

SEQ ID NO: 1146330 - RNA, 19 nt, Homo sapiens
gcagugcccagcgucaaug

SEQ ID NO: 1146331 - RNA, 19 nt, Homo sapiens
ucagcagugaaacuuauaa

SEQ ID NO: 1146332 - RNA, 19 nt, Homo sapiens
ucacaggaaacucuucaag

SEQ ID NO: 1146333 - RNA, 19 nt, Homo sapiens
ugacauguaccaucuaucc

SEQ ID NO: 1146334 - RNA, 19 nt, Homo sapiens
uuugacauguaccaucuau

SEQ ID NO: 1146335 - RNA, 19 nt, Homo sapiens
ucagucagcagugaaacuu

SEQ ID NO: 1146336 - RNA, 19 nt, Homo sapiens
cacaauuccagacauacaa

SEQ ID NO: 1146337 - RNA, 19 nt, Homo sapiens
uugcuuagcccacaauucu

SEQ ID NO: 1146338 - RNA, 19 nt, Homo sapiens
agaaugcugcuguaaugga

SEQ ID NO: 1146339 - RNA, 19 nt, Homo sapiens
ccacggagggaccuacaca

SEQ ID NO: 1146340 - RNA, 19 nt, Homo sapiens
gaggcugcaaucacacuga

SEQ ID NO: 1146341 - RNA, 19 nt, Homo sapiens
gcccaagacaccuccaaca

SEQ ID NO: 1146342 - RNA, 19 nt, Homo sapiens
agacaccugcacauucuga

SEQ ID NO: 1146343 - RNA, 19 nt, Homo sapiens
guucaucuucacccacuga

SEQ ID NO: 1146344 - RNA, 19 nt, Homo sapiens
ggaaggcgauggagucaua

SEQ ID NO: 1146345 - RNA, 19 nt, Homo sapiens
gaauacagcucacagagaa

SEQ ID NO: 1146346 - RNA, 19 nt, Homo sapiens
gagcagggauugcaacuuu

SEQ ID NO: 1146347 - RNA, 19 nt, Homo sapiens
gaacagcucaguuaccuua

SEQ ID NO: 1146348 - RNA, 19 nt, Homo sapiens
gaagauaucugugcuuuua

SEQ ID NO: 1146349 - RNA, 19 nt, Homo sapiens
gguggaaacuuguucauaa

SEQ ID NO: 1146350 - RNA, 19 nt, Homo sapiens
gagaguagcuuaguaguau

SEQ ID NO: 1146351 - RNA, 19 nt, Homo sapiens
uaaaggcagugauugauuu

SEQ ID NO: 1146352 - RNA, 19 nt, Homo sapiens
ggauggauauugacaguga

SEQ ID NO: 1146353 - RNA, 19 nt, Homo sapiens
ggacagacaacacgaguuu

SEQ ID NO: 1146354 - RNA, 19 nt, Homo sapiens
gaaguggacgucaagguua

SEQ ID NO: 1146355 - RNA, 19 nt, Homo sapiens
gaaauacaaugaagcuuac

SEQ ID NO: 1146356 - RNA, 19 nt, Homo sapiens
cagaggcccugaacagaua

SEQ ID NO: 1146357 - RNA, 19 nt, Homo sapiens
gaaggaggccgcuggcuuu

SEQ ID NO: 1146358 - RNA, 19 nt, Homo sapiens
gaaaagggauaggggauua

SEQ ID NO: 1146359 - RNA, 19 nt, Homo sapiens
aaucaugacuugaauguga

SEQ ID NO: 1146360 - RNA, 19 nt, Homo sapiens
ggagagagauaaccugucu

SEQ ID NO: 1146361 - RNA, 19 nt, Homo sapiens
gcagugaaaugagcaguga

SEQ ID NO: 1146362 - RNA, 19 nt, Homo sapiens
gauaaccugucugucauaa

SEQ ID NO: 1146363 - RNA, 19 nt, Homo sapiens
ggaaggaaguggacgucaa

SEQ ID NO: 1146364 - RNA, 19 nt, Homo sapiens
guaucuagguguucucaaa

SEQ ID NO: 1146365 - RNA, 19 nt, Homo sapiens
gagaaacgcaugugcuauu

SEQ ID NO: 1146366 - RNA, 19 nt, Homo sapiens
aaacacgcauucuuucuga

SEQ ID NO: 1146367 - RNA, 19 nt, Homo sapiens
aaacacaucuuugcaaaca

SEQ ID NO: 1146368 - RNA, 19 nt, Homo sapiens
gcaaggagcaguaugaaag

SEQ ID NO: 1146369 - RNA, 19 nt, Homo sapiens
gauggagaguagcuuagua

SEQ ID NO: 1146370 - RNA, 19 nt, Homo sapiens
ucagaauccuugaccgaua

SEQ ID NO: 1146371 - RNA, 19 nt, Homo sapiens
caacuugucucuggaagga

SEQ ID NO: 1146372 - RNA, 19 nt, Homo sapiens
gagauaaccugucugucau

SEQ ID NO: 1146373 - RNA, 19 nt, Homo sapiens
ccauugauguguugucauu

SEQ ID NO: 1146374 - RNA, 19 nt, Homo sapiens
ggacaagccacguacagaa

SEQ ID NO: 1146375 - RNA, 19 nt, Homo sapiens
ggagaguagcuuaguagua

SEQ ID NO: 1146376 - RNA, 19 nt, Homo sapiens
ggaaucugccauggaauua

SEQ ID NO: 1146377 - RNA, 19 nt, Homo sapiens
gacagugggucauauaagu

SEQ ID NO: 1146378 - RNA, 19 nt, Homo sapiens
agacacagauucaaacaca

SEQ ID NO: 1146379 - RNA, 19 nt, Homo sapiens
ggaaguggacgucaagguu

SEQ ID NO: 1146380 - RNA, 19 nt, Homo sapiens
gagcagcccuuuagcaaaa

SEQ ID NO: 1146381 - RNA, 19 nt, Homo sapiens
caaaucacaucccaacgau

SEQ ID NO: 1146382 - RNA, 19 nt, Homo sapiens
cugcaggacuggacuguuu

SEQ ID NO: 1146383 - RNA, 19 nt, Homo sapiens
gcacugaaguuuuguuguu

SEQ ID NO: 1146384 - RNA, 19 nt, Homo sapiens
gauaggggauuaccacuuu

SEQ ID NO: 1146385 - RNA, 19 nt, Homo sapiens
gacaggagcacaucuucua

SEQ ID NO: 1146386 - RNA, 19 nt, Homo sapiens
ggaggccgcuggcuuucuu

SEQ ID NO: 1146387 - RNA, 19 nt, Homo sapiens
gaaguugucugccucuacu

SEQ ID NO: 1146388 - RNA, 19 nt, Homo sapiens
gcagugagcagcccuuuag

SEQ ID NO: 1146389 - RNA, 19 nt, Homo sapiens
ucaguguuguuguucuuua

SEQ ID NO: 1146390 - RNA, 19 nt, Homo sapiens
cgaaagagcccagguauac

SEQ ID NO: 1146391 - RNA, 19 nt, Homo sapiens
caacaagaacauuuccaaa

SEQ ID NO: 1146392 - RNA, 19 nt, Homo sapiens
acagggagcucuaaucucu

SEQ ID NO: 1146393 - RNA, 19 nt, Homo sapiens
gauugcaacuuucaugauc

SEQ ID NO: 1146394 - RNA, 19 nt, Homo sapiens
aagaagauaucugugcuuu

SEQ ID NO: 1146395 - RNA, 19 nt, Homo sapiens
gagaaggaagggauggaua

SEQ ID NO: 1146396 - RNA, 19 nt, Homo sapiens
gcagaaagagagaagaugu

SEQ ID NO: 1146397 - RNA, 19 nt, Homo sapiens
ggaguuaucagagacauug

SEQ ID NO: 1146398 - RNA, 19 nt, Homo sapiens
gaugugaaauacaaugaag

SEQ ID NO: 1146399 - RNA, 19 nt, Homo sapiens
agaaagagagaagauguua

SEQ ID NO: 1146400 - RNA, 19 nt, Homo sapiens
ccaagacaguuguuucaca

SEQ ID NO: 1146401 - RNA, 19 nt, Homo sapiens
gagauuauaaggugauuuc

SEQ ID NO: 1146402 - RNA, 19 nt, Homo sapiens
uaaccugucugucauaacu

SEQ ID NO: 1146403 - RNA, 19 nt, Homo sapiens
gagagacgcuccugaucgu

SEQ ID NO: 1146404 - RNA, 19 nt, Homo sapiens
ggagguugguuugggauug

SEQ ID NO: 1146405 - RNA, 19 nt, Homo sapiens
gcacuguccugggaugaug

SEQ ID NO: 1146406 - RNA, 19 nt, Homo sapiens
cgacgcaccucucgauuac

SEQ ID NO: 1146407 - RNA, 19 nt, Homo sapiens
aaacaaagccacccaaacu

SEQ ID NO: 1146408 - RNA, 19 nt, Homo sapiens
ccaggaugguggaaacuug

SEQ ID NO: 1146409 - RNA, 19 nt, Homo sapiens
ucuagguguucucaaauaa

SEQ ID NO: 1146410 - RNA, 19 nt, Homo sapiens
aaacgcaugugcuauugga

SEQ ID NO: 1146411 - RNA, 19 nt, Homo sapiens
agacuucaguguuguuguu

SEQ ID NO: 1146412 - RNA, 19 nt, Homo sapiens
ucucggaucuugaaaccuu

SEQ ID NO: 1146413 - RNA, 19 nt, Homo sapiens
gguaggaucagaagauaug

SEQ ID NO: 1146414 - RNA, 19 nt, Homo sapiens
aaucugccauggaauuaaa

SEQ ID NO: 1146415 - RNA, 19 nt, Homo sapiens
gcagcaagucgucauguug

SEQ ID NO: 1146416 - RNA, 19 nt, Homo sapiens
cauauaaguuacugcuuuc

SEQ ID NO: 1146417 - RNA, 19 nt, Homo sapiens
agagauaaccugucuguca

SEQ ID NO: 1146418 - RNA, 19 nt, Homo sapiens
gugauuacaugguccuuca

SEQ ID NO: 1146419 - RNA, 19 nt, Homo sapiens
caugguuccugaugugaaa

SEQ ID NO: 1146420 - RNA, 19 nt, Homo sapiens
gagcagcuguccuacuucu

SEQ ID NO: 1146421 - RNA, 19 nt, Homo sapiens
ccucaacagugaugaagga

SEQ ID NO: 1146422 - RNA, 19 nt, Homo sapiens
gaaagagagaagauguuau

SEQ ID NO: 1146423 - RNA, 19 nt, Homo sapiens
gaagacacagauucaaaca

SEQ ID NO: 1146424 - RNA, 19 nt, Homo sapiens
uaaaggacagugggucaua

SEQ ID NO: 1146425 - RNA, 19 nt, Homo sapiens
agacugaaacgcaaacuga

SEQ ID NO: 1146426 - RNA, 19 nt, Homo sapiens
uguggaaucugccauggaa

SEQ ID NO: 1146427 - RNA, 19 nt, Homo sapiens
ggacgucaagguuauuuca

SEQ ID NO: 1146428 - RNA, 19 nt, Homo sapiens
cagagaaacgcaugugcua

SEQ ID NO: 1146429 - RNA, 19 nt, Homo sapiens
ccgacaggauggauauuga

SEQ ID NO: 1146430 - RNA, 19 nt, Homo sapiens
gaucccaucauuacuguug

SEQ ID NO: 1146431 - RNA, 19 nt, Homo sapiens
gagaacaucgaccucagaa

SEQ ID NO: 1146432 - RNA, 19 nt, Homo sapiens
gggaugaugagagauuaua

SEQ ID NO: 1146433 - RNA, 19 nt, Homo sapiens
agaaacgcaugugcuauug

SEQ ID NO: 1146434 - RNA, 19 nt, Homo sapiens
gaaacaaagccacccaaac

SEQ ID NO: 1146435 - RNA, 19 nt, Homo sapiens
ggaugaugagagauuauaa

SEQ ID NO: 1146436 - RNA, 19 nt, Homo sapiens
caagacugaagaauaugua

SEQ ID NO: 1146437 - RNA, 19 nt, Homo sapiens
guguagcuauuaaagauuc

SEQ ID NO: 1146438 - RNA, 19 nt, Homo sapiens
ccaaaucacaucccaacga

SEQ ID NO: 1146439 - RNA, 19 nt, Homo sapiens
gaaggaaguggacgucaag

SEQ ID NO: 1146440 - RNA, 19 nt, Homo sapiens
cagugggucauauaaguua

SEQ ID NO: 1146441 - RNA, 19 nt, Homo sapiens
gauguguugucauugaauc

SEQ ID NO: 1146442 - RNA, 19 nt, Homo sapiens
gagagauuauaaggugauu

SEQ ID NO: 1146443 - RNA, 19 nt, Homo sapiens
aaagcggcaugcagugaaa

SEQ ID NO: 1146444 - RNA, 19 nt, Homo sapiens
gcacugaugucacuuuaug

SEQ ID NO: 1146445 - RNA, 19 nt, Homo sapiens
gcugagcacuggaaacaua

SEQ ID NO: 1146446 - RNA, 19 nt, Homo sapiens
gaugcuaggugguuucuaa

SEQ ID NO: 1146447 - RNA, 19 nt, Homo sapiens
gagcuggccucucugcuaa

SEQ ID NO: 1146448 - RNA, 19 nt, Homo sapiens
caagacagaugggaaagaa

SEQ ID NO: 1146449 - RNA, 19 nt, Homo sapiens
guuaaucucugggaacuuu

SEQ ID NO: 1146450 - RNA, 19 nt, Homo sapiens
gcaaaugcaugcaaauacu

SEQ ID NO: 1146451 - RNA, 19 nt, Homo sapiens
agacucagaucccaauaaa

SEQ ID NO: 1146452 - RNA, 19 nt, Homo sapiens
ccucucaccugcuuucuuu

SEQ ID NO: 1146453 - RNA, 19 nt, Homo sapiens
ccacagagccugccuucaa

SEQ ID NO: 1146454 - RNA, 19 nt, Homo sapiens
ggaguggaguggaaaggaa

SEQ ID NO: 1146455 - RNA, 19 nt, Homo sapiens
gaugucacuuuauguagaa

SEQ ID NO: 1146456 - RNA, 19 nt, Homo sapiens
gcaaauugaguguggguuu

SEQ ID NO: 1146457 - RNA, 19 nt, Homo sapiens
ggaaacauaagaaggaaga

SEQ ID NO: 1146458 - RNA, 19 nt, Homo sapiens
uaugugaacuguagacuca

SEQ ID NO: 1146459 - RNA, 19 nt, Homo sapiens
acaaagcacugaagaagag

SEQ ID NO: 1146460 - RNA, 19 nt, Homo sapiens
ucagggaccucagcaacua

SEQ ID NO: 1146461 - RNA, 19 nt, Homo sapiens
ccaauaaagugcuguugca

SEQ ID NO: 1146462 - RNA, 19 nt, Homo sapiens
ggacuaaggacagccauga

SEQ ID NO: 1146463 - RNA, 19 nt, Homo sapiens
ggcauuaaggcaagaguua

SEQ ID NO: 1146464 - RNA, 19 nt, Homo sapiens
gaugugggcuuguguuuug

SEQ ID NO: 1146465 - RNA, 19 nt, Homo sapiens
ggaccugcguugccgucua

SEQ ID NO: 1146466 - RNA, 19 nt, Homo sapiens
ggagcuggccucucugcua

SEQ ID NO: 1146467 - RNA, 19 nt, Homo sapiens
gaccugcguugccgucuau

SEQ ID NO: 1146468 - RNA, 19 nt, Homo sapiens
gaacuuuggguuucuuauc

SEQ ID NO: 1146469 - RNA, 19 nt, Homo sapiens
ugggagauguagcaaauug

SEQ ID NO: 1146470 - RNA, 19 nt, Homo sapiens
aagaagaggucagggaaga

SEQ ID NO: 1146471 - RNA, 19 nt, Homo sapiens
gacagaugggaaagaauua

SEQ ID NO: 1146472 - RNA, 19 nt, Homo sapiens
gggcaucucccucaacaug

SEQ ID NO: 1146473 - RNA, 19 nt, Homo sapiens
agacagaugggaaagaauu

SEQ ID NO: 1146474 - RNA, 19 nt, Homo sapiens
caccagcccugcacugaug

SEQ ID NO: 1146475 - RNA, 19 nt, Homo sapiens
uggacaagcuggccaagga

SEQ ID NO: 1146476 - RNA, 19 nt, Homo sapiens
ccugggagauguagcaaau

SEQ ID NO: 1146477 - RNA, 19 nt, Homo sapiens
ugaugucacuuuauguaga

SEQ ID NO: 1146478 - RNA, 19 nt, Homo sapiens
ggagacaaagcacugaaga

SEQ ID NO: 1146479 - RNA, 19 nt, Homo sapiens
ccuggaaggugauguuugu

SEQ ID NO: 1146480 - RNA, 19 nt, Homo sapiens
agauaucuuucacacagua

SEQ ID NO: 1146481 - RNA, 19 nt, Homo sapiens
gaagaaggacaagcacuca

SEQ ID NO: 1146482 - RNA, 19 nt, Homo sapiens
gacaaagcacugaagaaga

SEQ ID NO: 1146483 - RNA, 19 nt, Homo sapiens
gcaucucccucaacaugug

SEQ ID NO: 1146484 - RNA, 19 nt, Homo sapiens
caucuucagccacuucuuu

SEQ ID NO: 1146485 - RNA, 19 nt, Homo sapiens
gcuaggugguuucuaagca

SEQ ID NO: 1146486 - RNA, 19 nt, Homo sapiens
cugcacugaugucacuuua

SEQ ID NO: 1146487 - RNA, 19 nt, Homo sapiens
gagacaaagcacugaagaa

SEQ ID NO: 1146488 - RNA, 19 nt, Homo sapiens
ccacagauuggcccagaaa

SEQ ID NO: 1146489 - RNA, 19 nt, Homo sapiens
ggacgcucuuccagacuga

SEQ ID NO: 1146490 - RNA, 19 nt, Homo sapiens
caacagacaggugaugaug

SEQ ID NO: 1146491 - RNA, 19 nt, Homo sapiens
ggagggaagggacuaagga

SEQ ID NO: 1146492 - RNA, 19 nt, Homo sapiens
gccuugcccuuccaacaaa

SEQ ID NO: 1146493 - RNA, 19 nt, Homo sapiens
uagaugacuuugaggacuu

SEQ ID NO: 1146494 - RNA, 19 nt, Homo sapiens
ucaaauccaggccaaguga

SEQ ID NO: 1146495 - RNA, 19 nt, Homo sapiens
ggaaggcugagcacuggaa

SEQ ID NO: 1146496 - RNA, 19 nt, Homo sapiens
aagcugauacuucuccuuu

SEQ ID NO: 1146497 - RNA, 19 nt, Homo sapiens
acucagaucccaauaaagu

SEQ ID NO: 1146498 - RNA, 19 nt, Homo sapiens
acucuguccuggcuuguuu

SEQ ID NO: 1146499 - RNA, 19 nt, Homo sapiens
gcacuggaaacauaagaag

SEQ ID NO: 1146500 - RNA, 19 nt, Homo sapiens
gcccaagaucccagcguua

SEQ ID NO: 1146501 - RNA, 19 nt, Homo sapiens
gaagaggucagggaagaag

SEQ ID NO: 1146502 - RNA, 19 nt, Homo sapiens
aacaggagcuggccucucu

SEQ ID NO: 1146503 - RNA, 19 nt, Homo sapiens
gggaaaggaagaagaacug

SEQ ID NO: 1146504 - RNA, 19 nt, Homo sapiens
gguguccucagauaucuuu

SEQ ID NO: 1146505 - RNA, 19 nt, Homo sapiens
gcugauacuucuccuuuug

SEQ ID NO: 1146506 - RNA, 19 nt, Homo sapiens
gaccggugccuugggauuu

SEQ ID NO: 1146507 - RNA, 19 nt, Homo sapiens
gggaugugggcuuguguuu

SEQ ID NO: 1146508 - RNA, 19 nt, Homo sapiens
uguuugguguccucagaua

SEQ ID NO: 1146509 - RNA, 19 nt, Homo sapiens
ggucagggaagaaggacaa

SEQ ID NO: 1146510 - RNA, 19 nt, Homo sapiens
gcaacagacaggugaugau

SEQ ID NO: 1146511 - RNA, 19 nt, Homo sapiens
gcuggccucucugcuaaga

SEQ ID NO: 1146512 - RNA, 19 nt, Homo sapiens
gagcugggccacagauugg

SEQ ID NO: 1146513 - RNA, 19 nt, Homo sapiens
uaaaagcaacgcaagaaaa

SEQ ID NO: 1146514 - RNA, 19 nt, Homo sapiens
caaauugaguguggguuuu

SEQ ID NO: 1146515 - RNA, 19 nt, Homo sapiens
gagcuuucauccucuugag

SEQ ID NO: 1146516 - RNA, 19 nt, Homo sapiens
agacaaagcacugaagaag

SEQ ID NO: 1146517 - RNA, 19 nt, Homo sapiens
ccucucugcuaagaacaua

SEQ ID NO: 1146518 - RNA, 19 nt, Homo sapiens
acaccgacguggacaugga

SEQ ID NO: 1146519 - RNA, 19 nt, Homo sapiens
ggauuugacuagaguugcu

SEQ ID NO: 1146520 - RNA, 19 nt, Homo sapiens
cugggcagcugaccaagga

SEQ ID NO: 1146521 - RNA, 19 nt, Homo sapiens
gggaacuuuggguuucuua

SEQ ID NO: 1146522 - RNA, 19 nt, Homo sapiens
ggagauguagcaaauugag

SEQ ID NO: 1146523 - RNA, 19 nt, Homo sapiens
cagaggagacugaggucaa

SEQ ID NO: 1146524 - RNA, 19 nt, Homo sapiens
gcuaugaugcuaggugguu

SEQ ID NO: 1146525 - RNA, 19 nt, Homo sapiens
gcccugcacugaugucacu

SEQ ID NO: 1146526 - RNA, 19 nt, Homo sapiens
cuucucagguggccucuca

SEQ ID NO: 1146527 - RNA, 19 nt, Homo sapiens
gcacucacagagcccaaga

SEQ ID NO: 1146528 - RNA, 19 nt, Homo sapiens
uuugaggacuucaucuuca

SEQ ID NO: 1146529 - RNA, 19 nt, Homo sapiens
gaaggcugagcacuggaaa

SEQ ID NO: 1146530 - RNA, 19 nt, Homo sapiens
ucuagggaguggaguggaa

SEQ ID NO: 1146531 - RNA, 19 nt, Homo sapiens
gagcaggagccagaacuca

SEQ ID NO: 1146532 - RNA, 19 nt, Homo sapiens
cuggggaagugauuaaaua

SEQ ID NO: 1146533 - RNA, 19 nt, Homo sapiens
gagcacuggaaacauaaga

SEQ ID NO: 1146534 - RNA, 19 nt, Homo sapiens
uagacucagaucccaauaa

SEQ ID NO: 1146535 - RNA, 19 nt, Homo sapiens
cggcuucaccucccuaugu

SEQ ID NO: 1146536 - RNA, 19 nt, Homo sapiens
acugaugucacuuuaugua

SEQ ID NO: 1146537 - RNA, 19 nt, Homo sapiens
ccuggaggguggacucugu

SEQ ID NO: 1146538 - RNA, 19 nt, Homo sapiens
ggagggccugacuuucuuu

SEQ ID NO: 1146539 - RNA, 19 nt, Homo sapiens
caggauggacccagaaucu

SEQ ID NO: 1146540 - RNA, 19 nt, Homo sapiens
gaguggaguggaaaggaaa

SEQ ID NO: 1146541 - RNA, 19 nt, Homo sapiens
ccaaggagaaccaggacau

SEQ ID NO: 1146542 - RNA, 19 nt, Homo sapiens
gcucaaauccaggccaagu

SEQ ID NO: 1146543 - RNA, 19 nt, Homo sapiens
ugugaacuguagacucaga

SEQ ID NO: 1146544 - RNA, 19 nt, Homo sapiens
ggaaaggacgcauggaaua

SEQ ID NO: 1146545 - RNA, 19 nt, Homo sapiens
ggacgugaccucaaacuuu

SEQ ID NO: 1146546 - RNA, 19 nt, Homo sapiens
uggaauaccucgugaaaug

SEQ ID NO: 1146547 - RNA, 19 nt, Homo sapiens
gagcuuggcauagugauuu

SEQ ID NO: 1146548 - RNA, 19 nt, Homo sapiens
uaacacggaccaaggcuuu

SEQ ID NO: 1146549 - RNA, 19 nt, Homo sapiens
ggaaagggaaagagagaug

SEQ ID NO: 1146550 - RNA, 19 nt, Homo sapiens
gcucgcagccuuugaggaa

SEQ ID NO: 1146551 - RNA, 19 nt, Homo sapiens
ggagggccuucgaaacaug

SEQ ID NO: 1146552 - RNA, 19 nt, Homo sapiens
cgucagcgggagaguauua

SEQ ID NO: 1146553 - RNA, 19 nt, Homo sapiens
gaggaaagggaaagagaga

SEQ ID NO: 1146554 - RNA, 19 nt, Homo sapiens
gacgugaccucaaacuuuu

SEQ ID NO: 1146555 - RNA, 19 nt, Homo sapiens
ggagcgggaucgagaaagg

SEQ ID NO: 1146556 - RNA, 19 nt, Homo sapiens
gaaaggacgcauggaauac

SEQ ID NO: 1146557 - RNA, 19 nt, Homo sapiens
gaauaccucgugaaaugga

SEQ ID NO: 1146558 - RNA, 19 nt, Homo sapiens
cauggaauaccucgugaaa

SEQ ID NO: 1146559 - RNA, 19 nt, Homo sapiens
gagucaacauggagcuuuc

SEQ ID NO: 1146560 - RNA, 19 nt, Homo sapiens
gaccgucaccauuaaggaa

SEQ ID NO: 1146561 - RNA, 19 nt, Homo sapiens
gggagggccuucgaaacau

SEQ ID NO: 1146562 - RNA, 19 nt, Homo sapiens
gacgucagcgggagaguau

SEQ ID NO: 1146563 - RNA, 19 nt, Homo sapiens
aggcaaaggccaaaacuua

SEQ ID NO: 1146564 - RNA, 19 nt, Homo sapiens
ggaagggauggucgcagaa

SEQ ID NO: 1146565 - RNA, 19 nt, Homo sapiens
ccagcagaguggaugacaa

SEQ ID NO: 1146566 - RNA, 19 nt, Homo sapiens
cgggagggccuucgaaaca

SEQ ID NO: 1146567 - RNA, 19 nt, Homo sapiens
gaagcggcgagucaacaug

SEQ ID NO: 1146568 - RNA, 19 nt, Homo sapiens
ggaagcggcgagucaacau

SEQ ID NO: 1146569 - RNA, 19 nt, Homo sapiens
ggagaguauuauggucugu

SEQ ID NO: 1146570 - RNA, 19 nt, Homo sapiens
ggaauaccucgugaaaugg

SEQ ID NO: 1146571 - RNA, 19 nt, Homo sapiens
ggugggauguggccuuuug

SEQ ID NO: 1146572 - RNA, 19 nt, Homo sapiens
gauggucgcagaaguacag

SEQ ID NO: 1146573 - RNA, 19 nt, Homo sapiens
cagcagaguggaugacaag

SEQ ID NO: 1146574 - RNA, 19 nt, Homo sapiens
cuuacgaguuucgaaguga

SEQ ID NO: 1146575 - RNA, 19 nt, Homo sapiens
cgagucaacauggagcuuu

SEQ ID NO: 1146576 - RNA, 19 nt, Homo sapiens
gaagggauggucgcagaag

SEQ ID NO: 1146577 - RNA, 19 nt, Homo sapiens
ggaucccuguggccagaau

SEQ ID NO: 1146578 - RNA, 19 nt, Homo sapiens
cggccagggugauaaagca

SEQ ID NO: 1146579 - RNA, 19 nt, Homo sapiens
cggaaaggacgcauggaau

SEQ ID NO: 1146580 - RNA, 19 nt, Homo sapiens
aaaccuuccuccucaaagc

SEQ ID NO: 1146581 - RNA, 19 nt, Homo sapiens
ucaccauuaaggaaaguaa

SEQ ID NO: 1146582 - RNA, 19 nt, Homo sapiens
ucgcagaaguacagcacau

SEQ ID NO: 1146583 - RNA, 19 nt, Homo sapiens
gcgugagcuuggcauagug

SEQ ID NO: 1146584 - RNA, 19 nt, Homo sapiens
gcauggaauaccucgugaa

SEQ ID NO: 1146585 - RNA, 19 nt, Homo sapiens
gggaagcggcgagucaaca

SEQ ID NO: 1146586 - RNA, 19 nt, Homo sapiens
agggauggucgcagaagua

SEQ ID NO: 1146587 - RNA, 19 nt, Homo sapiens
gagcgaagcuggauaacag

SEQ ID NO: 1146588 - RNA, 19 nt, Homo sapiens
aaacaaagauggcuauguc

SEQ ID NO: 1146589 - RNA, 19 nt, Homo sapiens
gaacguacaccucuuucuu

SEQ ID NO: 1146590 - RNA, 19 nt, Homo sapiens
guacaccucuuucuuaaac

SEQ ID NO: 1146591 - RNA, 19 nt, Homo sapiens
gcaccacgaugagcuguga

SEQ ID NO: 1146592 - RNA, 19 nt, Homo sapiens
gcagucaggccaccaacua

SEQ ID NO: 1146593 - RNA, 19 nt, Homo sapiens
uggaggaccuggacagaaa

SEQ ID NO: 1146594 - RNA, 19 nt, Homo sapiens
gcggaaauccuggguaauu

SEQ ID NO: 1146595 - RNA, 19 nt, Homo sapiens
aagcggaaauccuggguaa

SEQ ID NO: 1146596 - RNA, 19 nt, Homo sapiens
ggaaguggccaaggaauuc

SEQ ID NO: 1146597 - RNA, 19 nt, Homo sapiens
ggaccuggacagaaacaaa

SEQ ID NO: 1146598 - RNA, 19 nt, Homo sapiens
cuuaaaccauccugacaaa

SEQ ID NO: 1146599 - RNA, 19 nt, Homo sapiens
guaauuggaacauguuugu

SEQ ID NO: 1146600 - RNA, 19 nt, Homo sapiens
gaaacaaagauggcuaugu

SEQ ID NO: 1146601 - RNA, 19 nt, Homo sapiens
gaggauaagcaauaccuau

SEQ ID NO: 1146602 - RNA, 19 nt, Homo sapiens
gacgggaaguggccaagga

SEQ ID NO: 1146603 - RNA, 19 nt, Homo sapiens
cggaaauccuggguaauug

SEQ ID NO: 1146604 - RNA, 19 nt, Homo sapiens
ugacaaagggaaagggaaa

SEQ ID NO: 1146605 - RNA, 19 nt, Homo sapiens
gggaaguggccaaggaauu

SEQ ID NO: 1146606 - RNA, 19 nt, Homo sapiens
gcggagcgaagcuggauaa

SEQ ID NO: 1146607 - RNA, 19 nt, Homo sapiens
ucccagaggauaagcaaua

SEQ ID NO: 1146608 - RNA, 19 nt, Homo sapiens
gaaauccuggguaauugga

SEQ ID NO: 1146609 - RNA, 19 nt, Homo sapiens
acguacaccucuuucuuaa

SEQ ID NO: 1146610 - RNA, 19 nt, Homo sapiens
ccaaggaauucgaccaacu

SEQ ID NO: 1146611 - RNA, 19 nt, Homo sapiens
aacguacaccucuuucuua

SEQ ID NO: 1146612 - RNA, 19 nt, Homo sapiens
ggacaucgugauugcugaa

SEQ ID NO: 1146613 - RNA, 19 nt, Homo sapiens
guacgaccaugaggcuuuc

SEQ ID NO: 1146614 - RNA, 19 nt, Homo sapiens
auagaaguguuggaacgua

SEQ ID NO: 1146615 - RNA, 19 nt, Homo sapiens
gaacuuccaguacgaccau

SEQ ID NO: 1146616 - RNA, 19 nt, Homo sapiens
cugcuucuguugcuacuga

SEQ ID NO: 1146617 - RNA, 19 nt, Homo sapiens
caucaguucugcugcuucu

SEQ ID NO: 1146618 - RNA, 19 nt, Homo sapiens
ggaaauccuggguaauugg

SEQ ID NO: 1146619 - RNA, 19 nt, Homo sapiens
uaaaccauccugacaaagg

SEQ ID NO: 1146620 - RNA, 19 nt, Homo sapiens
uccgggaucugaacaagga

SEQ ID NO: 1146621 - RNA, 19 nt, Homo sapiens
ggaugcagagaccuacaaa

SEQ ID NO: 1146622 - RNA, 19 nt, Homo sapiens
agacggagaggcagcaguu

SEQ ID NO: 1146623 - RNA, 19 nt, Homo sapiens
cagaaacaaagauggcuau

SEQ ID NO: 1146624 - RNA, 19 nt, Homo sapiens
gccaggaguuguaguucuc

SEQ ID NO: 1146625 - RNA, 19 nt, Homo sapiens
cgugaggcguugugacuag

SEQ ID NO: 1146626 - RNA, 19 nt, Homo sapiens
gggaggggcugucauaguc

SEQ ID NO: 1146627 - RNA, 19 nt, Homo sapiens
caucgcggaucuguacuca

SEQ ID NO: 1146628 - RNA, 19 nt, Homo sapiens
ggccgaauugggcacauuu

SEQ ID NO: 1146629 - RNA, 19 nt, Homo sapiens
ucauagucccagaggauaa

SEQ ID NO: 1146630 - RNA, 19 nt, Homo sapiens
gguaauuggaacauguuug

SEQ ID NO: 1146631 - RNA, 19 nt, Homo sapiens
gauaacaggggaccgauga

SEQ ID NO: 1146632 - RNA, 19 nt, Homo sapiens
ccgaugauguggcgaccau

SEQ ID NO: 1146633 - RNA, 19 nt, Homo sapiens
ggagcgaagcuggauaaca

SEQ ID NO: 1146634 - RNA, 19 nt, Homo sapiens
gaccuggacagaaacaaag

SEQ ID NO: 1146635 - RNA, 19 nt, Homo sapiens
caaggaauucgaccaacuc

SEQ ID NO: 1146636 - RNA, 19 nt, Homo sapiens
ggccaaggaauucgaccaa

SEQ ID NO: 1146637 - RNA, 19 nt, Homo sapiens
gucauagucccagaggaua

SEQ ID NO: 1146638 - RNA, 19 nt, Homo sapiens
ggacuuccgggaucugaac

SEQ ID NO: 1146639 - RNA, 19 nt, Homo sapiens
cgacgacugccaggaguug

SEQ ID NO: 1146640 - RNA, 19 nt, Homo sapiens
gagcggagcgaagcuggau

SEQ ID NO: 1146641 - RNA, 19 nt, Homo sapiens
ugucauagucccagaggau

SEQ ID NO: 1146642 - RNA, 19 nt, Homo sapiens
ugacccggcaccacgauga

SEQ ID NO: 1146643 - RNA, 19 nt, Homo sapiens
cuggguaauuggaacaugu

SEQ ID NO: 1146644 - RNA, 19 nt, Homo sapiens
aggaguacaucgcggaucu

SEQ ID NO: 1146645 - RNA, 19 nt, Homo sapiens
guuggaacguacaccucuu

SEQ ID NO: 1146646 - RNA, 19 nt, Homo sapiens
gagaaacccuuuagaugua

SEQ ID NO: 1146647 - RNA, 19 nt, Homo sapiens
gaaagaaaccguacaaaug

SEQ ID NO: 1146648 - RNA, 19 nt, Homo sapiens
gcagagaacuuauaaagag

SEQ ID NO: 1146649 - RNA, 19 nt, Homo sapiens
ggaaggcgcauccauaaua

SEQ ID NO: 1146650 - RNA, 19 nt, Homo sapiens
caacuucagugcaagauuu

SEQ ID NO: 1146651 - RNA, 19 nt, Homo sapiens
gagagaaaccuuauaaaug

SEQ ID NO: 1146652 - RNA, 19 nt, Homo sapiens
ccacagagcuaauuuaacu

SEQ ID NO: 1146653 - RNA, 19 nt, Homo sapiens
ucaacaagcugcugucuau

SEQ ID NO: 1146654 - RNA, 19 nt, Homo sapiens
ugucagagcuuuguuguaa

SEQ ID NO: 1146655 - RNA, 19 nt, Homo sapiens
guacgaacauugugaaauc

SEQ ID NO: 1146656 - RNA, 19 nt, Homo sapiens
guaagccucucacuuugua

SEQ ID NO: 1146657 - RNA, 19 nt, Homo sapiens
gaagaaauguaaguugguu

SEQ ID NO: 1146658 - RNA, 19 nt, Homo sapiens
ccagagaacucauacuaga

SEQ ID NO: 1146659 - RNA, 19 nt, Homo sapiens
gaaggcgcauccauaauau

SEQ ID NO: 1146660 - RNA, 19 nt, Homo sapiens
ggagagaaaccuuauaaau

SEQ ID NO: 1146661 - RNA, 19 nt, Homo sapiens
gagcaaggauucaacuuca

SEQ ID NO: 1146662 - RNA, 19 nt, Homo sapiens
gaccauaacugggauguau

SEQ ID NO: 1146663 - RNA, 19 nt, Homo sapiens
ggaaaagccuucauucauu

SEQ ID NO: 1146664 - RNA, 19 nt, Homo sapiens
ggaaagaaaccguacaaau

SEQ ID NO: 1146665 - RNA, 19 nt, Homo sapiens
ggaagcagcccuugaaugu

SEQ ID NO: 1146666 - RNA, 19 nt, Homo sapiens
ggagagacauuugagagaa

SEQ ID NO: 1146667 - RNA, 19 nt, Homo sapiens
cauugaagcuugagagaaa

SEQ ID NO: 1146668 - RNA, 19 nt, Homo sapiens
caucagacaucaaagaguu

SEQ ID NO: 1146669 - RNA, 19 nt, Homo sapiens
ggagagagaccuuaugaau

SEQ ID NO: 1146670 - RNA, 19 nt, Homo sapiens
caucagcacucauuaaaca

SEQ ID NO: 1146671 - RNA, 19 nt, Homo sapiens
gcagaaucaugcaaaguug

SEQ ID NO: 1146672 - RNA, 19 nt, Homo sapiens
gcaaggaaaucaggagaga

SEQ ID NO: 1146673 - RNA, 19 nt, Homo sapiens
caacaucagagaacucaua

SEQ ID NO: 1146674 - RNA, 19 nt, Homo sapiens
gagagaaacccuuuagaug

SEQ ID NO: 1146675 - RNA, 19 nt, Homo sapiens
aaacagaccauaagcauga

SEQ ID NO: 1146676 - RNA, 19 nt, Homo sapiens
gccauaagcagguucuuua

SEQ ID NO: 1146677 - RNA, 19 nt, Homo sapiens
gagcacacaucuuguucaa

SEQ ID NO: 1146678 - RNA, 19 nt, Homo sapiens
gagagacauuugagagaaa

SEQ ID NO: 1146679 - RNA, 19 nt, Homo sapiens
gcugagggcuuacauccuu

SEQ ID NO: 1146680 - RNA, 19 nt, Homo sapiens
gagaaacccuaugagugua

SEQ ID NO: 1146681 - RNA, 19 nt, Homo sapiens
agacagaguucccaaagga

SEQ ID NO: 1146682 - RNA, 19 nt, Homo sapiens
guuguaagccucucacuuu

SEQ ID NO: 1146683 - RNA, 19 nt, Homo sapiens
ggagagaaacccuuuagau

SEQ ID NO: 1146684 - RNA, 19 nt, Homo sapiens
gcucaucccuugcaacaca

SEQ ID NO: 1146685 - RNA, 19 nt, Homo sapiens
ggauucaacuucagugcaa

SEQ ID NO: 1146686 - RNA, 19 nt, Homo sapiens
gaagcuggauccugcacaa

SEQ ID NO: 1146687 - RNA, 19 nt, Homo sapiens
caucagcucucauucaaca

SEQ ID NO: 1146688 - RNA, 19 nt, Homo sapiens
aagcagcccuugaauguga

SEQ ID NO: 1146689 - RNA, 19 nt, Homo sapiens
ggagacagauuuggcugaa

SEQ ID NO: 1146690 - RNA, 19 nt, Homo sapiens
uaaguuacguucacaugga

SEQ ID NO: 1146691 - RNA, 19 nt, Homo sapiens
gcaauaauagacagacuga

SEQ ID NO: 1146692 - RNA, 19 nt, Homo sapiens
ugaaaugccugagaaagga

SEQ ID NO: 1146693 - RNA, 19 nt, Homo sapiens
aaagaaaccguacaaaugu

SEQ ID NO: 1146694 - RNA, 19 nt, Homo sapiens
gagugaagccuuaugaaug

SEQ ID NO: 1146695 - RNA, 19 nt, Homo sapiens
agagagaccuuaugaaugc

SEQ ID NO: 1146696 - RNA, 19 nt, Homo sapiens
guucaaaguccuuagaauu

SEQ ID NO: 1146697 - RNA, 19 nt, Homo sapiens
guucaucucucaucagaca

SEQ ID NO: 1146698 - RNA, 19 nt, Homo sapiens
gagagagaccuuaugaaug

SEQ ID NO: 1146699 - RNA, 19 nt, Homo sapiens
uaacuaagcaucagagagu

SEQ ID NO: 1146700 - RNA, 19 nt, Homo sapiens
ggaaacagaccauaagcau

SEQ ID NO: 1146701 - RNA, 19 nt, Homo sapiens
gaaaagccuucauucauuc

SEQ ID NO: 1146702 - RNA, 19 nt, Homo sapiens
gcucaucccuaacuaagca

SEQ ID NO: 1146703 - RNA, 19 nt, Homo sapiens
agaaagagacccgaucuaa

SEQ ID NO: 1146704 - RNA, 19 nt, Homo sapiens
caagaagucccugagagua

SEQ ID NO: 1146705 - RNA, 19 nt, Homo sapiens
ggagugaagccuuaugaau

SEQ ID NO: 1146706 - RNA, 19 nt, Homo sapiens
auacuggagugaagccuua

SEQ ID NO: 1146707 - RNA, 19 nt, Homo sapiens
ggagagaaacccuaugagu

SEQ ID NO: 1146708 - RNA, 19 nt, Homo sapiens
gagaacucauacuagaauu

SEQ ID NO: 1146709 - RNA, 19 nt, Homo sapiens
caaagcagaaucaugcaaa

SEQ ID NO: 1146710 - RNA, 19 nt, Homo sapiens
gaaagcucaucccuugcaa

SEQ ID NO: 1146711 - RNA, 19 nt, Homo sapiens
gaagacagaguucccaaag

SEQ ID NO: 1146712 - RNA, 19 nt, Homo sapiens
ucacaugaauucacucucu

SEQ ID NO: 1146713 - RNA, 19 nt, Homo sapiens
agagaaauguucacucaca

SEQ ID NO: 1146714 - RNA, 19 nt, Homo sapiens
ggaaaucaggagagacauu

SEQ ID NO: 1146715 - RNA, 19 nt, Homo sapiens
gaacucauacuggagagaa

SEQ ID NO: 1146716 - RNA, 19 nt, Homo sapiens
gaaccuagucucacuuugg

SEQ ID NO: 1146717 - RNA, 19 nt, Homo sapiens
gaucauggagacagauuug

SEQ ID NO: 1146718 - RNA, 19 nt, Homo sapiens
ucaaggauguggccaugga

SEQ ID NO: 1146719 - RNA, 19 nt, Homo sapiens
gggcuuacauccuuaucau

SEQ ID NO: 1146720 - RNA, 19 nt, Homo sapiens
agagaaacccuuuagaugu

SEQ ID NO: 1146721 - RNA, 19 nt, Homo sapiens
ccauaugaaugcagugaau

SEQ ID NO: 1146722 - RNA, 19 nt, Homo sapiens
aagaaaaccuucacagaaa

SEQ ID NO: 1146723 - RNA, 19 nt, Homo sapiens
caccagagaacucauacua

SEQ ID NO: 1146724 - RNA, 19 nt, Homo sapiens
ccauaagcaugauguauac

SEQ ID NO: 1146725 - RNA, 19 nt, Homo sapiens
gggaugugaugcuggagaa

SEQ ID NO: 1146726 - RNA, 19 nt, Homo sapiens
gaacucauaccggagagaa

SEQ ID NO: 1146727 - RNA, 19 nt, Homo sapiens
ucagagaauucacguugga

SEQ ID NO: 1146728 - RNA, 19 nt, Homo sapiens
cagagaacuuauaaagaga

SEQ ID NO: 1146729 - RNA, 19 nt, Homo sapiens
ggaaaagcuucaaucagaa

SEQ ID NO: 1146730 - RNA, 19 nt, Homo sapiens
gaaagagacccgaucuaac

SEQ ID NO: 1146731 - RNA, 19 nt, Homo sapiens
guagguagcaguacgaaca

SEQ ID NO: 1146732 - RNA, 19 nt, Homo sapiens
gagaaaagccauaugaaug

SEQ ID NO: 1146733 - RNA, 19 nt, Homo sapiens
aaucuguccuuaucacuga

SEQ ID NO: 1146734 - RNA, 19 nt, Homo sapiens
uggaaaagcuucaaucaga

SEQ ID NO: 1146735 - RNA, 19 nt, Homo sapiens
ccauaacugggauguauaa

SEQ ID NO: 1146736 - RNA, 19 nt, Homo sapiens
agagaaacccuaugagugu

SEQ ID NO: 1146737 - RNA, 19 nt, Homo sapiens
gagaaaccuuauaaauguc

SEQ ID NO: 1146738 - RNA, 19 nt, Homo sapiens
agugaagccuuaugaaugu

SEQ ID NO: 1146739 - RNA, 19 nt, Homo sapiens
caacacaucagagaauuca

SEQ ID NO: 1146740 - RNA, 19 nt, Homo sapiens
caucaaagaacucauacug

SEQ ID NO: 1146741 - RNA, 19 nt, Homo sapiens
aaacaccagagaacucaua

SEQ ID NO: 1146742 - RNA, 19 nt, Homo sapiens
gagaaagagacccgaucua

SEQ ID NO: 1146743 - RNA, 19 nt, Homo sapiens
aagcagcuauucagacaug

SEQ ID NO: 1146744 - RNA, 19 nt, Homo sapiens
acaagcugcugucuauguu

SEQ ID NO: 1146745 - RNA, 19 nt, Homo sapiens
caguucaucucucaucaga

SEQ ID NO: 1146746 - RNA, 19 nt, Homo sapiens
ggagagaaauccuauauau

SEQ ID NO: 1146747 - RNA, 19 nt, Homo sapiens
gaacaugccuuauucaaca

SEQ ID NO: 1146748 - RNA, 19 nt, Homo sapiens
gaagaagucugaagaagug

SEQ ID NO: 1146749 - RNA, 19 nt, Homo sapiens
ggagagaaguguuauaaau

SEQ ID NO: 1146750 - RNA, 19 nt, Homo sapiens
ggaaagaguuuaggcauau

SEQ ID NO: 1146751 - RNA, 19 nt, Homo sapiens
gaagaagugcaauauguua

SEQ ID NO: 1146752 - RNA, 19 nt, Homo sapiens
uaaaggauauugccagauu

SEQ ID NO: 1146753 - RNA, 19 nt, Homo sapiens
gcucagaauuugucacuaa

SEQ ID NO: 1146754 - RNA, 19 nt, Homo sapiens
gagagacccuauaaaugua

SEQ ID NO: 1146755 - RNA, 19 nt, Homo sapiens
gcucauuccucaacccuua

SEQ ID NO: 1146756 - RNA, 19 nt, Homo sapiens
ggaagaaaccauauaaaug

SEQ ID NO: 1146757 - RNA, 19 nt, Homo sapiens
ggagagagacccuauaaau

SEQ ID NO: 1146758 - RNA, 19 nt, Homo sapiens
gaggauaugucuaaacuca

SEQ ID NO: 1146759 - RNA, 19 nt, Homo sapiens
gcucacuacuggagaaaua

SEQ ID NO: 1146760 - RNA, 19 nt, Homo sapiens
aaacauaacucaucaacuc

SEQ ID NO: 1146761 - RNA, 19 nt, Homo sapiens
gguaaaaccuucagucaua

SEQ ID NO: 1146762 - RNA, 19 nt, Homo sapiens
aggcauaucucaucccuua

SEQ ID NO: 1146763 - RNA, 19 nt, Homo sapiens
gggaaagaguuuaggcaua

SEQ ID NO: 1146764 - RNA, 19 nt, Homo sapiens
ggagagaaaccauauaaau

SEQ ID NO: 1146765 - RNA, 19 nt, Homo sapiens
ggagagaaaccauauaaau

SEQ ID NO: 1146766 - RNA, 19 nt, Homo sapiens
gaagaaacccauaccauca

SEQ ID NO: 1146767 - RNA, 19 nt, Homo sapiens
gaaaucguaugaaugugaa

SEQ ID NO: 1146768 - RNA, 19 nt, Homo sapiens
gagagaagccuuacaagug

SEQ ID NO: 1146769 - RNA, 19 nt, Homo sapiens
aaucaugucucauauggua

SEQ ID NO: 1146770 - RNA, 19 nt, Homo sapiens
caacugugauucccauauu

SEQ ID NO: 1146771 - RNA, 19 nt, Homo sapiens
agacaaggcgcaaaucuua

SEQ ID NO: 1146772 - RNA, 19 nt, Homo sapiens
gaagaaaccauauaaaugc

SEQ ID NO: 1146773 - RNA, 19 nt, Homo sapiens
gugcaaaucuuacucaaca

SEQ ID NO: 1146774 - RNA, 19 nt, Homo sapiens
gagagaaaccauauaaaug

SEQ ID NO: 1146775 - RNA, 19 nt, Homo sapiens
gagagaaaccauauaaaug

SEQ ID NO: 1146776 - RNA, 19 nt, Homo sapiens
ugacuacgaugauagacua

SEQ ID NO: 1146777 - RNA, 19 nt, Homo sapiens
caucaacucucuauuucaa

SEQ ID NO: 1146778 - RNA, 19 nt, Homo sapiens
aaggaaacuugacuucuua

SEQ ID NO: 1146779 - RNA, 19 nt, Homo sapiens
caacaucagagaacucaua

SEQ ID NO: 1146780 - RNA, 19 nt, Homo sapiens
caacaucagaggauucaua

SEQ ID NO: 1146781 - RNA, 19 nt, Homo sapiens
ggaaauccuuacuucaaga

SEQ ID NO: 1146782 - RNA, 19 nt, Homo sapiens
gagagaaacccuauaagug

SEQ ID NO: 1146783 - RNA, 19 nt, Homo sapiens
cagagaacaugccuuauuc

SEQ ID NO: 1146784 - RNA, 19 nt, Homo sapiens
ccaaagagaaaucguauga

SEQ ID NO: 1146785 - RNA, 19 nt, Homo sapiens
gaaaagcauucaaaccuaa

SEQ ID NO: 1146786 - RNA, 19 nt, Homo sapiens
ugacucagauucuagaaga

SEQ ID NO: 1146787 - RNA, 19 nt, Homo sapiens
acacuuauccuuugguaua

SEQ ID NO: 1146788 - RNA, 19 nt, Homo sapiens
guaugaaugugaagaaugu

SEQ ID NO: 1146789 - RNA, 19 nt, Homo sapiens
cagaaggaauuauacaaga

SEQ ID NO: 1146790 - RNA, 19 nt, Homo sapiens
ucaaagauguggcuguaga

SEQ ID NO: 1146791 - RNA, 19 nt, Homo sapiens
guacacuuauccuuuggua

SEQ ID NO: 1146792 - RNA, 19 nt, Homo sapiens
ccaaacaucguaauuaaug

SEQ ID NO: 1146793 - RNA, 19 nt, Homo sapiens
gggaagaaaccauauaaau

SEQ ID NO: 1146794 - RNA, 19 nt, Homo sapiens
gagagagacccuauaaaug

SEQ ID NO: 1146795 - RNA, 19 nt, Homo sapiens
ucagaguacuuaccuuauu

SEQ ID NO: 1146796 - RNA, 19 nt, Homo sapiens
ugccaaacaucguaauuaa

SEQ ID NO: 1146797 - RNA, 19 nt, Homo sapiens
caacaucauagaacacaua

SEQ ID NO: 1146798 - RNA, 19 nt, Homo sapiens
ggagagaaacccuauaagu

SEQ ID NO: 1146799 - RNA, 19 nt, Homo sapiens
acaguuugauacccaauua

SEQ ID NO: 1146800 - RNA, 19 nt, Homo sapiens
auacaagacugugacguua

SEQ ID NO: 1146801 - RNA, 19 nt, Homo sapiens
ggauaugucuaaacucaca

SEQ ID NO: 1146802 - RNA, 19 nt, Homo sapiens
cgagagcucugccuuaagu

SEQ ID NO: 1146803 - RNA, 19 nt, Homo sapiens
ccauauaaaugcagugugu

SEQ ID NO: 1146804 - RNA, 19 nt, Homo sapiens
gagagaaguguuauaaaug

SEQ ID NO: 1146805 - RNA, 19 nt, Homo sapiens
ugucuaaacucacaaagga

SEQ ID NO: 1146806 - RNA, 19 nt, Homo sapiens
ggauuugacucagauucua

SEQ ID NO: 1146807 - RNA, 19 nt, Homo sapiens
gaacacauacuggagagaa

SEQ ID NO: 1146808 - RNA, 19 nt, Homo sapiens
uuacagaacuauuggaaca

SEQ ID NO: 1146809 - RNA, 19 nt, Homo sapiens
ccaaagaaucgaugacauu

SEQ ID NO: 1146810 - RNA, 19 nt, Homo sapiens
gcugcuaacucuaccuuga

SEQ ID NO: 1146811 - RNA, 19 nt, Homo sapiens
gcagaaguaucagaaguag

SEQ ID NO: 1146812 - RNA, 19 nt, Homo sapiens
gcaauauguuagauacuca

SEQ ID NO: 1146813 - RNA, 19 nt, Homo sapiens
ccagagaacaugccuuauu

SEQ ID NO: 1146814 - RNA, 19 nt, Homo sapiens
caucagaggauucauaaug

SEQ ID NO: 1146815 - RNA, 19 nt, Homo sapiens
agucauaguucaucacuga

SEQ ID NO: 1146816 - RNA, 19 nt, Homo sapiens
gaaaguguuuagucagagu

SEQ ID NO: 1146817 - RNA, 19 nt, Homo sapiens
gucagaacauucagaagaa

SEQ ID NO: 1146818 - RNA, 19 nt, Homo sapiens
gauaagggaaacuucaauu

SEQ ID NO: 1146819 - RNA, 19 nt, Homo sapiens
ccucaucacuuaaucaaca

SEQ ID NO: 1146820 - RNA, 19 nt, Homo sapiens
ccauauaaaugcuuggaau

SEQ ID NO: 1146821 - RNA, 19 nt, Homo sapiens
gugcacaccuuacuauaca

SEQ ID NO: 1146822 - RNA, 19 nt, Homo sapiens
gcauaucucaucccuuauu

SEQ ID NO: 1146823 - RNA, 19 nt, Homo sapiens
gaaaagcccuacaucuaug

SEQ ID NO: 1146824 - RNA, 19 nt, Homo sapiens
cugaagaagugcaauaugu

SEQ ID NO: 1146825 - RNA, 19 nt, Homo sapiens
agagagacccuauaaaugu

SEQ ID NO: 1146826 - RNA, 19 nt, Homo sapiens
agagaagccuuacaagugu

SEQ ID NO: 1146827 - RNA, 19 nt, Homo sapiens
gaaguagugguauggauau

SEQ ID NO: 1146828 - RNA, 19 nt, Homo sapiens
gcagcagccuuugauauag

SEQ ID NO: 1146829 - RNA, 19 nt, Homo sapiens
gagaaaccauauaaaugca

SEQ ID NO: 1146830 - RNA, 19 nt, Homo sapiens
gcauucaaaccuaauugua

SEQ ID NO: 1146831 - RNA, 19 nt, Homo sapiens
ucaagcaguuggcucacua

SEQ ID NO: 1146832 - RNA, 19 nt, Homo sapiens
gaagugcaauauguuagau

SEQ ID NO: 1146833 - RNA, 19 nt, Homo sapiens
ccucaacccuuauucaaca

SEQ ID NO: 1146834 - RNA, 19 nt, Homo sapiens
ggagagaagccuuacaagu

SEQ ID NO: 1146835 - RNA, 19 nt, Homo sapiens
ucaaucaugucucauaugg

SEQ ID NO: 1146836 - RNA, 19 nt, Homo sapiens
caggauggcuaaaugacuu

SEQ ID NO: 1146837 - RNA, 19 nt, Homo sapiens
gagguuaggacuuggguaa

SEQ ID NO: 1146838 - RNA, 19 nt, Homo sapiens
gguggaaccuguguauaug

SEQ ID NO: 1146839 - RNA, 19 nt, Homo sapiens
gagagaaauccuauauaug

SEQ ID NO: 1146840 - RNA, 19 nt, Homo sapiens
cagacaggauggcuaaaug

SEQ ID NO: 1146841 - RNA, 19 nt, Homo sapiens
gauugacucuccugucugu

SEQ ID NO: 1146842 - RNA, 19 nt, Homo sapiens
gaccacccauguauacgaa

SEQ ID NO: 1146843 - RNA, 19 nt, Homo sapiens
caugagacuucaagcaguu

SEQ ID NO: 1146844 - RNA, 19 nt, Homo sapiens
gacacauacuggagagaaa

SEQ ID NO: 1146845 - RNA, 19 nt, Homo sapiens
ugucucauaugguauugua

SEQ ID NO: 1146846 - RNA, 19 nt, Homo sapiens
gaaagaagccuaaggaaua

SEQ ID NO: 1146847 - RNA, 19 nt, Homo sapiens
gaagaugacucaacaauau

SEQ ID NO: 1146848 - RNA, 19 nt, Homo sapiens
gagaacauuuccaguauua

SEQ ID NO: 1146849 - RNA, 19 nt, Homo sapiens
gaaacacaguucagaauuu

SEQ ID NO: 1146850 - RNA, 19 nt, Homo sapiens
gaaaggauacccagaguua

SEQ ID NO: 1146851 - RNA, 19 nt, Homo sapiens
gaucucagcugaaccaauu

SEQ ID NO: 1146852 - RNA, 19 nt, Homo sapiens
ugacacagauguucucuaa

SEQ ID NO: 1146853 - RNA, 19 nt, Homo sapiens
cacaagagcuguuauuuau

SEQ ID NO: 1146854 - RNA, 19 nt, Homo sapiens
gaaggagaguuucuuaaug

SEQ ID NO: 1146855 - RNA, 19 nt, Homo sapiens
gagggaaguuugagugaua

SEQ ID NO: 1146856 - RNA, 19 nt, Homo sapiens
gcagaggauucccaaagua

SEQ ID NO: 1146857 - RNA, 19 nt, Homo sapiens
cagauguucucuaagauua

SEQ ID NO: 1146858 - RNA, 19 nt, Homo sapiens
gaauugaagcugaaagaua

SEQ ID NO: 1146859 - RNA, 19 nt, Homo sapiens
agagaaggcuuagaaauaa

SEQ ID NO: 1146860 - RNA, 19 nt, Homo sapiens
gaacuaccauugauuacau

SEQ ID NO: 1146861 - RNA, 19 nt, Homo sapiens
gcucaagcaugcaguauga

SEQ ID NO: 1146862 - RNA, 19 nt, Homo sapiens
gagcucaucuugaaacuuc

SEQ ID NO: 1146863 - RNA, 19 nt, Homo sapiens
gaaguaagacaguagauga

SEQ ID NO: 1146864 - RNA, 19 nt, Homo sapiens
gaacggaguuaggaagaaa

SEQ ID NO: 1146865 - RNA, 19 nt, Homo sapiens
ggaauaaagucaucucucu

SEQ ID NO: 1146866 - RNA, 19 nt, Homo sapiens
acacagauguucucuaaga

SEQ ID NO: 1146867 - RNA, 19 nt, Homo sapiens
guacaaacaugacacagau

SEQ ID NO: 1146868 - RNA, 19 nt, Homo sapiens
uaacaguucugaauucaug

SEQ ID NO: 1146869 - RNA, 19 nt, Homo sapiens
gggcagcaguagcuaguua

SEQ ID NO: 1146870 - RNA, 19 nt, Homo sapiens
guucagaaguugauuguau

SEQ ID NO: 1146871 - RNA, 19 nt, Homo sapiens
gaugauggcauuucucuuu

SEQ ID NO: 1146872 - RNA, 19 nt, Homo sapiens
gaacuacacaauccuguuu

SEQ ID NO: 1146873 - RNA, 19 nt, Homo sapiens
gaagggaaccaaucacuga

SEQ ID NO: 1146874 - RNA, 19 nt, Homo sapiens
gaaaauaacuugcaguagu

SEQ ID NO: 1146875 - RNA, 19 nt, Homo sapiens
gagaagaauugaagcugaa

SEQ ID NO: 1146876 - RNA, 19 nt, Homo sapiens
ucacaagagcuguuauuua

SEQ ID NO: 1146877 - RNA, 19 nt, Homo sapiens
guucugaauucaugugaua

SEQ ID NO: 1146878 - RNA, 19 nt, Homo sapiens
caaaguaccgagucgaaua

SEQ ID NO: 1146879 - RNA, 19 nt, Homo sapiens
gcaaaggcaaauuaagaua

SEQ ID NO: 1146880 - RNA, 19 nt, Homo sapiens
ggagaacauuuccaguauu

SEQ ID NO: 1146881 - RNA, 19 nt, Homo sapiens
gaaaggggcucacaacgaa

SEQ ID NO: 1146882 - RNA, 19 nt, Homo sapiens
caagagcuguuauuuaucu

SEQ ID NO: 1146883 - RNA, 19 nt, Homo sapiens
aaagaagccuaaggaauaa

SEQ ID NO: 1146884 - RNA, 19 nt, Homo sapiens
gagaguuucuuaaugaugu

SEQ ID NO: 1146885 - RNA, 19 nt, Homo sapiens
aaggagaguuucuuaauga

SEQ ID NO: 1146886 - RNA, 19 nt, Homo sapiens
gggaguaacuaaugaagau

SEQ ID NO: 1146887 - RNA, 19 nt, Homo sapiens
agaagaagcuguguaugaa

SEQ ID NO: 1146888 - RNA, 19 nt, Homo sapiens
gaacauuuccaguauuaug

SEQ ID NO: 1146889 - RNA, 19 nt, Homo sapiens
aagagaaggcuuagaaaua

SEQ ID NO: 1146890 - RNA, 19 nt, Homo sapiens
ggacacauuauuagaauug

SEQ ID NO: 1146891 - RNA, 19 nt, Homo sapiens
caacagaagggcagcagua

SEQ ID NO: 1146892 - RNA, 19 nt, Homo sapiens
aaacaaacaugguggaucu

SEQ ID NO: 1146893 - RNA, 19 nt, Homo sapiens
gagguagagugggaaguua

SEQ ID NO: 1146894 - RNA, 19 nt, Homo sapiens
gacaguagaugacaauucu

SEQ ID NO: 1146895 - RNA, 19 nt, Homo sapiens
ggaaagaagccuaaggaau

SEQ ID NO: 1146896 - RNA, 19 nt, Homo sapiens
gacaucuugugauuucuua

SEQ ID NO: 1146897 - RNA, 19 nt, Homo sapiens
ucacggaauuuauguauag

SEQ ID NO: 1146898 - RNA, 19 nt, Homo sapiens
augaagaucuggaguguuu

SEQ ID NO: 1146899 - RNA, 19 nt, Homo sapiens
ggagauaagaaagauguua

SEQ ID NO: 1146900 - RNA, 19 nt, Homo sapiens
gcuagaaagucugaacauu

SEQ ID NO: 1146901 - RNA, 19 nt, Homo sapiens
ugagggagauaugauuaua

SEQ ID NO: 1146902 - RNA, 19 nt, Homo sapiens
ggauguccauguucaauca

SEQ ID NO: 1146903 - RNA, 19 nt, Homo sapiens
ucucuaagauuacuggaaa

SEQ ID NO: 1146904 - RNA, 19 nt, Homo sapiens
ugacagcgccugcaacuga

SEQ ID NO: 1146905 - RNA, 19 nt, Homo sapiens
gaaacuucauuuacagcaa

SEQ ID NO: 1146906 - RNA, 19 nt, Homo sapiens
gauaaugaucuacguacua

SEQ ID NO: 1146907 - RNA, 19 nt, Homo sapiens
gagaaugaguugaauacca

SEQ ID NO: 1146908 - RNA, 19 nt, Homo sapiens
acaagaagaugacucaaca

SEQ ID NO: 1146909 - RNA, 19 nt, Homo sapiens
gaacaggaaagcagaaaca

SEQ ID NO: 1146910 - RNA, 19 nt, Homo sapiens
aaucaccacuguccaaauu

SEQ ID NO: 1146911 - RNA, 19 nt, Homo sapiens
gggagaagauggacaagag

SEQ ID NO: 1146912 - RNA, 19 nt, Homo sapiens
gagaagacauaaaagagua

SEQ ID NO: 1146913 - RNA, 19 nt, Homo sapiens
gcacagagaagacauaaaa

SEQ ID NO: 1146914 - RNA, 19 nt, Homo sapiens
ugagaguacuucugaauca

SEQ ID NO: 1146915 - RNA, 19 nt, Homo sapiens
cuagaaagucugaacauuu

SEQ ID NO: 1146916 - RNA, 19 nt, Homo sapiens
gugaagcaaaggcaaauua

SEQ ID NO: 1146917 - RNA, 19 nt, Homo sapiens
uaaaauugguguccucaua

SEQ ID NO: 1146918 - RNA, 19 nt, Homo sapiens
uagcagugauuguggagua

SEQ ID NO: 1146919 - RNA, 19 nt, Homo sapiens
uagaagaagcuguguauga

SEQ ID NO: 1146920 - RNA, 19 nt, Homo sapiens
acacuggacuuguucagaa

SEQ ID NO: 1146921 - RNA, 19 nt, Homo sapiens
ccacugaaaccguugagua

SEQ ID NO: 1146922 - RNA, 19 nt, Homo sapiens
ccucaguccuauuuauuaa

SEQ ID NO: 1146923 - RNA, 19 nt, Homo sapiens
cggcaucccuucuguaugu

SEQ ID NO: 1146924 - RNA, 19 nt, Homo sapiens
ccaauuagaacacucugua

SEQ ID NO: 1146925 - RNA, 19 nt, Homo sapiens
gaagaaaugaagcugaaau

SEQ ID NO: 1146926 - RNA, 19 nt, Homo sapiens
ccaguauuaugccuaguaa

SEQ ID NO: 1146927 - RNA, 19 nt, Homo sapiens
gaguugacuuugaguaaug

SEQ ID NO: 1146928 - RNA, 19 nt, Homo sapiens
ggaaguagagguugugauc

SEQ ID NO: 1146929 - RNA, 19 nt, Homo sapiens
aagaaaggaugauggcauu

SEQ ID NO: 1146930 - RNA, 19 nt, Homo sapiens
gaauaaagucaucucucua

SEQ ID NO: 1146931 - RNA, 19 nt, Homo sapiens
agauaucacuguccuuuau

SEQ ID NO: 1146932 - RNA, 19 nt, Homo sapiens
ggaaaccaagucuauaaga

SEQ ID NO: 1146933 - RNA, 19 nt, Homo sapiens
gaaaucaucacagaaggaa

SEQ ID NO: 1146934 - RNA, 19 nt, Homo sapiens
gcucagcagucccaaagug

SEQ ID NO: 1146935 - RNA, 19 nt, Homo sapiens
ggaguugacuuugaguaau

SEQ ID NO: 1146936 - RNA, 19 nt, Homo sapiens
acaaagagaaggcuuagaa

SEQ ID NO: 1146937 - RNA, 19 nt, Homo sapiens
caggucacaucauauugua

SEQ ID NO: 1146938 - RNA, 19 nt, Homo sapiens
gcccuaaaguuccuaaaca

SEQ ID NO: 1146939 - RNA, 19 nt, Homo sapiens
aaaaggccauguauucuua

SEQ ID NO: 1146940 - RNA, 19 nt, Homo sapiens
aacauggacucgucacaua

SEQ ID NO: 1146941 - RNA, 19 nt, Homo sapiens
gaucuggaguguuuagaag

SEQ ID NO: 1146942 - RNA, 19 nt, Homo sapiens
gagaaggcuuagaaauaau

SEQ ID NO: 1146943 - RNA, 19 nt, Homo sapiens
gcaacuuucuucaucaucu

SEQ ID NO: 1146944 - RNA, 19 nt, Homo sapiens
ggaacggaguuaggaagaa

SEQ ID NO: 1146945 - RNA, 19 nt, Homo sapiens
agaguuauauugacgaaug

SEQ ID NO: 1146946 - RNA, 19 nt, Homo sapiens
gcacuggauugcuauauuu

SEQ ID NO: 1146947 - RNA, 19 nt, Homo sapiens
gaacaagguuugccaggau

SEQ ID NO: 1146948 - RNA, 19 nt, Homo sapiens
ggaacaaggucgcccacuu

SEQ ID NO: 1146949 - RNA, 19 nt, Homo sapiens
gagcagacuucuuuacuac

SEQ ID NO: 1146950 - RNA, 19 nt, Homo sapiens
cgagcagacuucuuuacua

SEQ ID NO: 1146951 - RNA, 19 nt, Homo sapiens
gaacaaggucgcccacuuc

SEQ ID NO: 1146952 - RNA, 19 nt, Homo sapiens
gcuugaaacuuccugagaa

SEQ ID NO: 1146953 - RNA, 19 nt, Homo sapiens
ggucacacgucccgucuug

SEQ ID NO: 1146954 - RNA, 19 nt, Homo sapiens
acacugcacuggauugcua

SEQ ID NO: 1146955 - RNA, 19 nt, Homo sapiens
caaguccucucacagaaga

SEQ ID NO: 1146956 - RNA, 19 nt, Homo sapiens
cugagaaacuguagcauau

SEQ ID NO: 1146957 - RNA, 19 nt, Homo sapiens
gacacgagcuuagaaagug

SEQ ID NO: 1146958 - RNA, 19 nt, Homo sapiens
ggacaggaaugcgguucaa

SEQ ID NO: 1146959 - RNA, 19 nt, Homo sapiens
ggguaucacucacaguuug

SEQ ID NO: 1146960 - RNA, 19 nt, Homo sapiens
cagaagaaccacacgauug

SEQ ID NO: 1146961 - RNA, 19 nt, Homo sapiens
ggagucgccauucuguuua

SEQ ID NO: 1146962 - RNA, 19 nt, Homo sapiens
uagagcauguuccaguuaa

SEQ ID NO: 1146963 - RNA, 19 nt, Homo sapiens
caaacccaguggcuugaaa

SEQ ID NO: 1146964 - RNA, 19 nt, Homo sapiens
aggagaagcugagcaacua

SEQ ID NO: 1146965 - RNA, 19 nt, Homo sapiens
gaaacuuccugagaaacug

SEQ ID NO: 1146966 - RNA, 19 nt, Homo sapiens
caacaucggagucgccauu

SEQ ID NO: 1146967 - RNA, 19 nt, Homo sapiens
gacauccacuccaccauca

SEQ ID NO: 1146968 - RNA, 19 nt, Homo sapiens
caacuuccccuaacagaua

SEQ ID NO: 1146969 - RNA, 19 nt, Homo sapiens
cccaguggcuugaaacuuc

SEQ ID NO: 1146970 - RNA, 19 nt, Homo sapiens
acagacgggugacaaguau

SEQ ID NO: 1146971 - RNA, 19 nt, Homo sapiens
gagcuuagaaaguggauuc

SEQ ID NO: 1146972 - RNA, 19 nt, Homo sapiens
gaugagcucaaguccagua

SEQ ID NO: 1146973 - RNA, 19 nt, Homo sapiens
gcaaguacaagcagaacau

SEQ ID NO: 1146974 - RNA, 19 nt, Homo sapiens
caggaucacugccaaagag

SEQ ID NO: 1146975 - RNA, 19 nt, Homo sapiens
ccaaggaggagggcaagua

SEQ ID NO: 1146976 - RNA, 19 nt, Homo sapiens
gcucggacgggcucaagua

SEQ ID NO: 1146977 - RNA, 19 nt, Homo sapiens
gagaaacuguagcauaucc

SEQ ID NO: 1146978 - RNA, 19 nt, Homo sapiens
ccugagaaacuguagcaua

SEQ ID NO: 1146979 - RNA, 19 nt, Homo sapiens
gaacagacgggugacaagu

SEQ ID NO: 1146980 - RNA, 19 nt, Homo sapiens
gaagggaucccggcacauc

SEQ ID NO: 1146981 - RNA, 19 nt, Homo sapiens
uuacuacacugcacuggau

SEQ ID NO: 1146982 - RNA, 19 nt, Homo sapiens
ucgccauucuguuuauuaa

SEQ ID NO: 1146983 - RNA, 19 nt, Homo sapiens
gcaacuaccggauggagau

SEQ ID NO: 1146984 - RNA, 19 nt, Homo sapiens
ccucacagcagcucagaaa

SEQ ID NO: 1146985 - RNA, 19 nt, Homo sapiens
cuugaaacuuccugagaaa

SEQ ID NO: 1146986 - RNA, 19 nt, Homo sapiens
ucacugcuuucucugucua

SEQ ID NO: 1146987 - RNA, 19 nt, Homo sapiens
gaaccacacgauuggguau

SEQ ID NO: 1146988 - RNA, 19 nt, Homo sapiens
gcagacuucuuuacuacac

SEQ ID NO: 1146989 - RNA, 19 nt, Homo sapiens
gccauucuguuuauuaacu

SEQ ID NO: 1146990 - RNA, 19 nt, Homo sapiens
cggagucgccauucuguuu

SEQ ID NO: 1146991 - RNA, 19 nt, Homo sapiens
gcaucggccuggagagcaa

SEQ ID NO: 1146992 - RNA, 19 nt, Homo sapiens
gagucgccauucuguuuau

SEQ ID NO: 1146993 - RNA, 19 nt, Homo sapiens
gaucacugccaaagaguuc

SEQ ID NO: 1146994 - RNA, 19 nt, Homo sapiens
ccagcaagauccgcgagaa

SEQ ID NO: 1146995 - RNA, 19 nt, Homo sapiens
gguccaaggcccagaacaa

SEQ ID NO: 1146996 - RNA, 19 nt, Homo sapiens
cgacggaggguccuacugu

SEQ ID NO: 1146997 - RNA, 19 nt, Homo sapiens
uauggacucugccuugcuu

SEQ ID NO: 1146998 - RNA, 19 nt, Homo sapiens
gguaacagcggacguuguc

SEQ ID NO: 1146999 - RNA, 19 nt, Homo sapiens
ggaaccgaguuacaugcau

SEQ ID NO: 1147000 - RNA, 19 nt, Homo sapiens
ccaaggcccagaacaagga

SEQ ID NO: 1147001 - RNA, 19 nt, Homo sapiens
gcgaguggacgcacggauu

SEQ ID NO: 1147002 - RNA, 19 nt, Homo sapiens
uugcuuugcuuauguuuag

SEQ ID NO: 1147003 - RNA, 19 nt, Homo sapiens
uggauucacugcuuucucu

SEQ ID NO: 1147004 - RNA, 19 nt, Homo sapiens
cggacgggcucaaguacga

SEQ ID NO: 1147005 - RNA, 19 nt, Homo sapiens
gaucuggaaccgaguuaca

SEQ ID NO: 1147006 - RNA, 19 nt, Homo sapiens
uuagagcauguuccaguua

SEQ ID NO: 1147007 - RNA, 19 nt, Homo sapiens
uugcuuauguuuagcuguu

SEQ ID NO: 1147008 - RNA, 19 nt, Homo sapiens
ucacucacaguuugccuuu

SEQ ID NO: 1147009 - RNA, 19 nt, Homo sapiens
ggagacgcauccccagaaa

SEQ ID NO: 1147010 - RNA, 19 nt, Homo sapiens
ugcacuggauugcuauauu

SEQ ID NO: 1147011 - RNA, 19 nt, Homo sapiens
cgacacgagcuuagaaagu

SEQ ID NO: 1147012 - RNA, 19 nt, Homo sapiens
cuguuucucugcuaccuuu

SEQ ID NO: 1147013 - RNA, 19 nt, Homo sapiens
gaggagaagcugagcaacu

SEQ ID NO: 1147014 - RNA, 19 nt, Homo sapiens
ggucaucgaggacgacauc

SEQ ID NO: 1147015 - RNA, 19 nt, Homo sapiens
gcagguccuucccucuucu

SEQ ID NO: 1147016 - RNA, 19 nt, Homo sapiens
uccaaguccucucacagaa

SEQ ID NO: 1147017 - RNA, 19 nt, Homo sapiens
ccacagugacuccgagauc

SEQ ID NO: 1147018 - RNA, 19 nt, Homo sapiens
gcuacgggaccgagaccua

SEQ ID NO: 1147019 - RNA, 19 nt, Homo sapiens
uuucacaucucuguacugu

SEQ ID NO: 1147020 - RNA, 19 nt, Homo sapiens
gagaugucgcgguagcaaa

SEQ ID NO: 1147021 - RNA, 19 nt, Homo sapiens
ugaaacccuugcugaggau

SEQ ID NO: 1147022 - RNA, 19 nt, Homo sapiens
gaccuccugugacgacauc

SEQ ID NO: 1147023 - RNA, 19 nt, Homo sapiens
gcaagcagagcuccuuucg

SEQ ID NO: 1147024 - RNA, 19 nt, Homo sapiens
gcagcaagcagagcuccuu

SEQ ID NO: 1147025 - RNA, 19 nt, Homo sapiens
ccgagauccucaagagcaa

SEQ ID NO: 1147026 - RNA, 19 nt, Homo sapiens
acagguuccuuauguuucu

SEQ ID NO: 1147027 - RNA, 19 nt, Homo sapiens
acagaagaaccacacgauu

SEQ ID NO: 1147028 - RNA, 19 nt, Homo sapiens
gcaagauccgcgagaaggu

SEQ ID NO: 1147029 - RNA, 19 nt, Homo sapiens
ccaagggccaaggcgaaua

SEQ ID NO: 1147030 - RNA, 19 nt, Homo sapiens
guacugugccugccucaac

SEQ ID NO: 1147031 - RNA, 19 nt, Homo sapiens
agaagaaccacacgauugg

SEQ ID NO: 1147032 - RNA, 19 nt, Homo sapiens
agagcauguuccaguuaaa

SEQ ID NO: 1147033 - RNA, 19 nt, Homo sapiens
gagauccucaagagcaaga

SEQ ID NO: 1147034 - RNA, 19 nt, Homo sapiens
cuucucccaugguuacuga

SEQ ID NO: 1147035 - RNA, 19 nt, Homo sapiens
gcgaguggaagaacgacaa

SEQ ID NO: 1147036 - RNA, 19 nt, Homo sapiens
ggcugaagcugcgcaaguc

SEQ ID NO: 1147037 - RNA, 19 nt, Homo sapiens
gggcugaagcugcgcaagu

SEQ ID NO: 1147038 - RNA, 19 nt, Homo sapiens
aaauagagaaaggguagaa

SEQ ID NO: 1147039 - RNA, 19 nt, Homo sapiens
ggaucacugccaaagaguu

SEQ ID NO: 1147040 - RNA, 19 nt, Homo sapiens
ccaagcagaaggcugagau

SEQ ID NO: 1147041 - RNA, 19 nt, Homo sapiens
gcuuauguuuagcuguuuc

SEQ ID NO: 1147042 - RNA, 19 nt, Homo sapiens
gggaucuggaaccgaguua

SEQ ID NO: 1147043 - RNA, 19 nt, Homo sapiens
cgaguggacgcacggauuc

SEQ ID NO: 1147044 - RNA, 19 nt, Homo sapiens
aacagacgggugacaagua

SEQ ID NO: 1147045 - RNA, 19 nt, Homo sapiens
gaagggaaagaccgcaacu

SEQ ID NO: 1147046 - RNA, 19 nt, Homo sapiens
gcaauaaacugcaaauaug

SEQ ID NO: 1147047 - RNA, 19 nt, Homo sapiens
caaguaacauugacuguaa

SEQ ID NO: 1147048 - RNA, 19 nt, Homo sapiens
gaucacaccuuacacagaa

SEQ ID NO: 1147049 - RNA, 19 nt, Homo sapiens
gggauggacuuaccagaua

SEQ ID NO: 1147050 - RNA, 19 nt, Homo sapiens
agaaauaucucaugugugu

SEQ ID NO: 1147051 - RNA, 19 nt, Homo sapiens
gguaaauucuucagccaua

SEQ ID NO: 1147052 - RNA, 19 nt, Homo sapiens
ccacacagcuccagucuca

SEQ ID NO: 1147053 - RNA, 19 nt, Homo sapiens
ggagaaaucagcucuuauu

SEQ ID NO: 1147054 - RNA, 19 nt, Homo sapiens
gaaauguguucaaggagaa

SEQ ID NO: 1147055 - RNA, 19 nt, Homo sapiens
gagaaaggccuuaugaaug

SEQ ID NO: 1147056 - RNA, 19 nt, Homo sapiens
gagaaaggccuuauaagug

SEQ ID NO: 1147057 - RNA, 19 nt, Homo sapiens
caaauaaaccucugaagau

SEQ ID NO: 1147058 - RNA, 19 nt, Homo sapiens
agccauagcuccaaccuua

SEQ ID NO: 1147059 - RNA, 19 nt, Homo sapiens
ggagaaaggccuuauaagu

SEQ ID NO: 1147060 - RNA, 19 nt, Homo sapiens
gggcauaguuggugcgaaa

SEQ ID NO: 1147061 - RNA, 19 nt, Homo sapiens
gagaaaucagcucuuauua

SEQ ID NO: 1147062 - RNA, 19 nt, Homo sapiens
ggaaaauucuuuagccaua

SEQ ID NO: 1147063 - RNA, 19 nt, Homo sapiens
agccaaagcucccaccuua

SEQ ID NO: 1147064 - RNA, 19 nt, Homo sapiens
caccagggaucacaccuua

SEQ ID NO: 1147065 - RNA, 19 nt, Homo sapiens
ggacaucauugcuuaccaa

SEQ ID NO: 1147066 - RNA, 19 nt, Homo sapiens
ggacaauguuaacuguaaa

SEQ ID NO: 1147067 - RNA, 19 nt, Homo sapiens
ggaauaugguaaagccaaa

SEQ ID NO: 1147068 - RNA, 19 nt, Homo sapiens
gaccuaauuuacacuauug

SEQ ID NO: 1147069 - RNA, 19 nt, Homo sapiens
caagagaaaggccuuauga

SEQ ID NO: 1147070 - RNA, 19 nt, Homo sapiens
gagcaaacaugaucuagcu

SEQ ID NO: 1147071 - RNA, 19 nt, Homo sapiens
gggaaagccuauagcagaa

SEQ ID NO: 1147072 - RNA, 19 nt, Homo sapiens
agacuucugugcuuucuuu

SEQ ID NO: 1147073 - RNA, 19 nt, Homo sapiens
gggaaggcuuacauuagua

SEQ ID NO: 1147074 - RNA, 19 nt, Homo sapiens
agaaaggccuuaugagugu

SEQ ID NO: 1147075 - RNA, 19 nt, Homo sapiens
ggagaaaggccuuaugagu

SEQ ID NO: 1147076 - RNA, 19 nt, Homo sapiens
ccaaagcucccaccuuauu

SEQ ID NO: 1147077 - RNA, 19 nt, Homo sapiens
ggagaaaggccuuaugagu

SEQ ID NO: 1147078 - RNA, 19 nt, Homo sapiens
ggaugggagugcauagaaa

SEQ ID NO: 1147079 - RNA, 19 nt, Homo sapiens
cagaagcacugagauaaug

SEQ ID NO: 1147080 - RNA, 19 nt, Homo sapiens
gcaaguaacauugacugua

SEQ ID NO: 1147081 - RNA, 19 nt, Homo sapiens
caccagagauuucauacug

SEQ ID NO: 1147082 - RNA, 19 nt, Homo sapiens
aaggagaaaucagcucuua

SEQ ID NO: 1147083 - RNA, 19 nt, Homo sapiens
gaauuggguucugucauga

SEQ ID NO: 1147084 - RNA, 19 nt, Homo sapiens
gcucugauuuauacaguga

SEQ ID NO: 1147085 - RNA, 19 nt, Homo sapiens
gcuagggucugcugggauu

SEQ ID NO: 1147086 - RNA, 19 nt, Homo sapiens
ggaaaauucuuuagccaaa

SEQ ID NO: 1147087 - RNA, 19 nt, Homo sapiens
gaaauucucaggaccuuca

SEQ ID NO: 1147088 - RNA, 19 nt, Homo sapiens
ccgcaacucuggccucauu

SEQ ID NO: 1147089 - RNA, 19 nt, Homo sapiens
caccagaccacuuacaaua

SEQ ID NO: 1147090 - RNA, 19 nt, Homo sapiens
auaaaccucugaagauuug

SEQ ID NO: 1147091 - RNA, 19 nt, Homo sapiens
ccauaacucuagccucauu

SEQ ID NO: 1147092 - RNA, 19 nt, Homo sapiens
guggaaauguguucaagga

SEQ ID NO: 1147093 - RNA, 19 nt, Homo sapiens
ucaauuguuugcucauuug

SEQ ID NO: 1147094 - RNA, 19 nt, Homo sapiens
ugaucuagcucucaccaaa

SEQ ID NO: 1147095 - RNA, 19 nt, Homo sapiens
agaaaggccuuaugaaugc

SEQ ID NO: 1147096 - RNA, 19 nt, Homo sapiens
gaaugugggaaaugcuuua

SEQ ID NO: 1147097 - RNA, 19 nt, Homo sapiens
gcaaagacacacuuguuca

SEQ ID NO: 1147098 - RNA, 19 nt, Homo sapiens
ggagaaagaccuuaugacu

SEQ ID NO: 1147099 - RNA, 19 nt, Homo sapiens
ggagaacuuugcacuugug

SEQ ID NO: 1147100 - RNA, 19 nt, Homo sapiens
caagauauccaacacaaca

SEQ ID NO: 1147101 - RNA, 19 nt, Homo sapiens
cuacagaagcacugagaua

SEQ ID NO: 1147102 - RNA, 19 nt, Homo sapiens
uggacaauguuaacuguaa

SEQ ID NO: 1147103 - RNA, 19 nt, Homo sapiens
gaugagcaccguauauuca

SEQ ID NO: 1147104 - RNA, 19 nt, Homo sapiens
cagcaagcauuuucuauaa

SEQ ID NO: 1147105 - RNA, 19 nt, Homo sapiens
ggaugacuguggcaaacaa

SEQ ID NO: 1147106 - RNA, 19 nt, Homo sapiens
ggaaaugcuuuagccacaa

SEQ ID NO: 1147107 - RNA, 19 nt, Homo sapiens
ccggguagauugagacuug

SEQ ID NO: 1147108 - RNA, 19 nt, Homo sapiens
acaaauaaaccucugaaga

SEQ ID NO: 1147109 - RNA, 19 nt, Homo sapiens
gggauuuccugacacgauu

SEQ ID NO: 1147110 - RNA, 19 nt, Homo sapiens
gcuccaaccuuauuguaca

SEQ ID NO: 1147111 - RNA, 19 nt, Homo sapiens
caggagaaaggccuuauaa

SEQ ID NO: 1147112 - RNA, 19 nt, Homo sapiens
ggaggaagggauggacuua

SEQ ID NO: 1147113 - RNA, 19 nt, Homo sapiens
ccagaaagcacacccaugu

SEQ ID NO: 1147114 - RNA, 19 nt, Homo sapiens
cugcaaauauguaaagugu

SEQ ID NO: 1147115 - RNA, 19 nt, Homo sapiens
cuacagguaaucaugaaua

SEQ ID NO: 1147116 - RNA, 19 nt, Homo sapiens
gcagaugagcaccguauau

SEQ ID NO: 1147117 - RNA, 19 nt, Homo sapiens
ggaaaagccuacagcagaa

SEQ ID NO: 1147118 - RNA, 19 nt, Homo sapiens
cugaaugcauggagucuuu

SEQ ID NO: 1147119 - RNA, 19 nt, Homo sapiens
gcaacauaauggagagaau

SEQ ID NO: 1147120 - RNA, 19 nt, Homo sapiens
gcguaguauuucaguauuu

SEQ ID NO: 1147121 - RNA, 19 nt, Homo sapiens
gucaagauauccaacacaa

SEQ ID NO: 1147122 - RNA, 19 nt, Homo sapiens
guugacagaucuaacuuuc

SEQ ID NO: 1147123 - RNA, 19 nt, Homo sapiens
cagaaaauaugucaucuug

SEQ ID NO: 1147124 - RNA, 19 nt, Homo sapiens
ccaaggagacuaugaugga

SEQ ID NO: 1147125 - RNA, 19 nt, Homo sapiens
caaaauaguugacagaucu

SEQ ID NO: 1147126 - RNA, 19 nt, Homo sapiens
ugacuuacuugucuuacug

SEQ ID NO: 1147127 - RNA, 19 nt, Homo sapiens
cuagagcucuugauggaau

SEQ ID NO: 1147128 - RNA, 19 nt, Homo sapiens
agcagaagcucccaucuug

SEQ ID NO: 1147129 - RNA, 19 nt, Homo sapiens
ccacaacuccagccucauu

SEQ ID NO: 1147130 - RNA, 19 nt, Homo sapiens
guauugcugcguaguauuu

SEQ ID NO: 1147131 - RNA, 19 nt, Homo sapiens
gcagggcucacucuccuaa

SEQ ID NO: 1147132 - RNA, 19 nt, Homo sapiens
cguggaaccuagcaaagaa

SEQ ID NO: 1147133 - RNA, 19 nt, Homo sapiens
gcucacgagugcaacaguu

SEQ ID NO: 1147134 - RNA, 19 nt, Homo sapiens
gagcacuggagaauucaua

SEQ ID NO: 1147135 - RNA, 19 nt, Homo sapiens
acaggaaccucagcaguga

SEQ ID NO: 1147136 - RNA, 19 nt, Homo sapiens
ggagcaaggccuuaugugu

SEQ ID NO: 1147137 - RNA, 19 nt, Homo sapiens
ggaccuuccuucgcgcuuu

SEQ ID NO: 1147138 - RNA, 19 nt, Homo sapiens
guaaagacacacuuguuca

SEQ ID NO: 1147139 - RNA, 19 nt, Homo sapiens
gaaaagccuucauucacuu

SEQ ID NO: 1147140 - RNA, 19 nt, Homo sapiens
cuacgcggcucucguggaa

SEQ ID NO: 1147141 - RNA, 19 nt, Homo sapiens
caacauaauggagagaauu

SEQ ID NO: 1147142 - RNA, 19 nt, Homo sapiens
ggagaggaauaugguaaag

SEQ ID NO: 1147143 - RNA, 19 nt, Homo sapiens
ggcggaagccaucuuauug

SEQ ID NO: 1147144 - RNA, 19 nt, Homo sapiens
gucuagagcucuugaugga

SEQ ID NO: 1147145 - RNA, 19 nt, Homo sapiens
gagaaaagccuuacguaug

SEQ ID NO: 1147146 - RNA, 19 nt, Homo sapiens
ggaaaaggguugauuuaaa

SEQ ID NO: 1147147 - RNA, 19 nt, Homo sapiens
gcuauuaucuccucugcaa

SEQ ID NO: 1147148 - RNA, 19 nt, Homo sapiens
gagaagcugugccucaguu

SEQ ID NO: 1147149 - RNA, 19 nt, Homo sapiens
gcaaguggcuggugaucgu

SEQ ID NO: 1147150 - RNA, 19 nt, Homo sapiens
cagacauccugagcuauua

SEQ ID NO: 1147151 - RNA, 19 nt, Homo sapiens
agacagggcucagcucaga

SEQ ID NO: 1147152 - RNA, 19 nt, Homo sapiens
gaggagacucugaauguga

SEQ ID NO: 1147153 - RNA, 19 nt, Homo sapiens
ggaggagacucugaaugug

SEQ ID NO: 1147154 - RNA, 19 nt, Homo sapiens
gcuccaauccagacccuua

SEQ ID NO: 1147155 - RNA, 19 nt, Homo sapiens
ccugggcucugaccacuaa

SEQ ID NO: 1147156 - RNA, 19 nt, Homo sapiens
ccacugugcucccauuucu

SEQ ID NO: 1147157 - RNA, 19 nt, Homo sapiens
gaaugugacagaaggaaau

SEQ ID NO: 1147158 - RNA, 19 nt, Homo sapiens
gcagguggcugaaaaugug

SEQ ID NO: 1147159 - RNA, 19 nt, Homo sapiens
gcauuggcaucgguuucua

SEQ ID NO: 1147160 - RNA, 19 nt, Homo sapiens
gcaacagugagaccaguga

SEQ ID NO: 1147161 - RNA, 19 nt, Homo sapiens
ccagugacgacuacgauga

SEQ ID NO: 1147162 - RNA, 19 nt, Homo sapiens
gugcgaagacgcccuggaa

SEQ ID NO: 1147163 - RNA, 19 nt, Homo sapiens
uggaggagacucugaaugu

SEQ ID NO: 1147164 - RNA, 19 nt, Homo sapiens
agaagccucugcuguccuu

SEQ ID NO: 1147165 - RNA, 19 nt, Homo sapiens
agucaugagucuccugguu

SEQ ID NO: 1147166 - RNA, 19 nt, Homo sapiens
acagguggcuggccuacgu

SEQ ID NO: 1147167 - RNA, 19 nt, Homo sapiens
uaacacucuuggccaugga

SEQ ID NO: 1147168 - RNA, 19 nt, Homo sapiens
caauccagacccuuauguu

SEQ ID NO: 1147169 - RNA, 19 nt, Homo sapiens
caacucguggcacuaacuu

SEQ ID NO: 1147170 - RNA, 19 nt, Homo sapiens
ucaggaauccaagcgcuuu

SEQ ID NO: 1147171 - RNA, 19 nt, Homo sapiens
guccuuggccuugggagua

SEQ ID NO: 1147172 - RNA, 19 nt, Homo sapiens
ggaauccaagcgcuuugug

SEQ ID NO: 1147173 - RNA, 19 nt, Homo sapiens
ugaaugugacagaaggaaa

SEQ ID NO: 1147174 - RNA, 19 nt, Homo sapiens
cugcuggucugccucuuca

SEQ ID NO: 1147175 - RNA, 19 nt, Homo sapiens
gcccucagcuugggugcau

SEQ ID NO: 1147176 - RNA, 19 nt, Homo sapiens
ucucaacucguggcacuaa

SEQ ID NO: 1147177 - RNA, 19 nt, Homo sapiens
ucaugagucuccugguucu

SEQ ID NO: 1147178 - RNA, 19 nt, Homo sapiens
ccacacacucagcaccauu

SEQ ID NO: 1147179 - RNA, 19 nt, Homo sapiens
cagacgaugacgacccuuu

SEQ ID NO: 1147180 - RNA, 19 nt, Homo sapiens
ugacgacuacgaugacaca

SEQ ID NO: 1147181 - RNA, 19 nt, Homo sapiens
ucagugacuucugcuccaa

SEQ ID NO: 1147182 - RNA, 19 nt, Homo sapiens
ccaauccagacccuuaugu

SEQ ID NO: 1147183 - RNA, 19 nt, Homo sapiens
gacgaugacgacccuuuca

SEQ ID NO: 1147184 - RNA, 19 nt, Homo sapiens
cccaagagcaggaauacca

SEQ ID NO: 1147185 - RNA, 19 nt, Homo sapiens
ucaaggagguggaauguua

SEQ ID NO: 1147186 - RNA, 19 nt, Homo sapiens
gaaaugcccuggaaauugg

SEQ ID NO: 1147187 - RNA, 19 nt, Homo sapiens
cagcagcacuccacuauga

SEQ ID NO: 1147188 - RNA, 19 nt, Homo sapiens
agacagagccagauuguuu

SEQ ID NO: 1147189 - RNA, 19 nt, Homo sapiens
gaaggauccuguugacugu

SEQ ID NO: 1147190 - RNA, 19 nt, Homo sapiens
gauaagaaguugcaaaaug

SEQ ID NO: 1147191 - RNA, 19 nt, Homo sapiens
gggagacgguguacgauga

SEQ ID NO: 1147192 - RNA, 19 nt, Homo sapiens
caagugguguuccgaaaug

SEQ ID NO: 1147193 - RNA, 19 nt, Homo sapiens
gaagauaagaaguugcaaa

SEQ ID NO: 1147194 - RNA, 19 nt, Homo sapiens
caagagaaagucaaucuau

SEQ ID NO: 1147195 - RNA, 19 nt, Homo sapiens
guaaguggcaucuguguug

SEQ ID NO: 1147196 - RNA, 19 nt, Homo sapiens
acacagagaacaccaguaa

SEQ ID NO: 1147197 - RNA, 19 nt, Homo sapiens
gagcagaccauguuugugu

SEQ ID NO: 1147198 - RNA, 19 nt, Homo sapiens
gaacgccgcuacucuacag

SEQ ID NO: 1147199 - RNA, 19 nt, Homo sapiens
cgaaaugcccuggaaauug

SEQ ID NO: 1147200 - RNA, 19 nt, Homo sapiens
caaccuggcugaacucaac

SEQ ID NO: 1147201 - RNA, 19 nt, Homo sapiens
ccagauuguuuagagguua

SEQ ID NO: 1147202 - RNA, 19 nt, Homo sapiens
gacagagccagauuguuua

SEQ ID NO: 1147203 - RNA, 19 nt, Homo sapiens
gagguggaauguuaugugu

SEQ ID NO: 1147204 - RNA, 19 nt, Homo sapiens
gcaaaaugcuauugugaau

SEQ ID NO: 1147205 - RNA, 19 nt, Homo sapiens
cgagaacgccgcuacucua

SEQ ID NO: 1147206 - RNA, 19 nt, Homo sapiens
agagaaagucaaucuauga

SEQ ID NO: 1147207 - RNA, 19 nt, Homo sapiens
ggagacagagccagauugu

SEQ ID NO: 1147208 - RNA, 19 nt, Homo sapiens
ucuaugagauucguaacaa

SEQ ID NO: 1147209 - RNA, 19 nt, Homo sapiens
aagagaaagucaaucuaug

SEQ ID NO: 1147210 - RNA, 19 nt, Homo sapiens
gaacaccaguaaggagaca

SEQ ID NO: 1147211 - RNA, 19 nt, Homo sapiens
gggucaguguucccaauuu

SEQ ID NO: 1147212 - RNA, 19 nt, Homo sapiens
gggcucaggccaagagaaa

SEQ ID NO: 1147213 - RNA, 19 nt, Homo sapiens
gcaaacgagaagauaagaa

SEQ ID NO: 1147214 - RNA, 19 nt, Homo sapiens
guucauguuugcuguaagu

SEQ ID NO: 1147215 - RNA, 19 nt, Homo sapiens
cagauuguuuagagguuaa

SEQ ID NO: 1147216 - RNA, 19 nt, Homo sapiens
gagaagauaagaaguugca

SEQ ID NO: 1147217 - RNA, 19 nt, Homo sapiens
guuccugguuggccaauau

SEQ ID NO: 1147218 - RNA, 19 nt, Homo sapiens
caaacgagaagauaagaag

SEQ ID NO: 1147219 - RNA, 19 nt, Homo sapiens
ugacugugguggugaucuu

SEQ ID NO: 1147220 - RNA, 19 nt, Homo sapiens
ccaagagaaagucaaucua

SEQ ID NO: 1147221 - RNA, 19 nt, Homo sapiens
caccugggauggcgcaaga

SEQ ID NO: 1147222 - RNA, 19 nt, Homo sapiens
ggagguggaauguuaugug

SEQ ID NO: 1147223 - RNA, 19 nt, Homo sapiens
guaaccaggccugcuauga

SEQ ID NO: 1147224 - RNA, 19 nt, Homo sapiens
ugacucugccuauguguga

SEQ ID NO: 1147225 - RNA, 19 nt, Homo sapiens
ccgcuacucuacagucuuc

SEQ ID NO: 1147226 - RNA, 19 nt, Homo sapiens
gcuguaaccaggccugcua

SEQ ID NO: 1147227 - RNA, 19 nt, Homo sapiens
ggucaguguucccaauuuu

SEQ ID NO: 1147228 - RNA, 19 nt, Homo sapiens
gccagauuguuuagagguu

SEQ ID NO: 1147229 - RNA, 19 nt, Homo sapiens
gaugagcagaccauguuug

SEQ ID NO: 1147230 - RNA, 19 nt, Homo sapiens
ccgaaaugcccuggaaauu

SEQ ID NO: 1147231 - RNA, 19 nt, Homo sapiens
acgagaagauaagaaguug

SEQ ID NO: 1147232 - RNA, 19 nt, Homo sapiens
gggcaaacgagaagauaag

SEQ ID NO: 1147233 - RNA, 19 nt, Homo sapiens
gagaaagucaaucuaugag

SEQ ID NO: 1147234 - RNA, 19 nt, Homo sapiens
gcaucaaggagguggaaug

SEQ ID NO: 1147235 - RNA, 19 nt, Homo sapiens
gcuucuacauuauccaagu

SEQ ID NO: 1147236 - RNA, 19 nt, Homo sapiens
ccagugacucugccuaugu

SEQ ID NO: 1147237 - RNA, 19 nt, Homo sapiens
gcaucuguguugugcucaa

SEQ ID NO: 1147238 - RNA, 19 nt, Homo sapiens
guguucauguuugcuguaa

SEQ ID NO: 1147239 - RNA, 19 nt, Homo sapiens
cagugacucugccuaugug

SEQ ID NO: 1147240 - RNA, 19 nt, Homo sapiens
gccaagagaaagucaaucu

SEQ ID NO: 1147241 - RNA, 19 nt, Homo sapiens
ccaucucccacauacguua

SEQ ID NO: 1147242 - RNA, 19 nt, Homo sapiens
ccacuaugaucggaaggau

SEQ ID NO: 1147243 - RNA, 19 nt, Homo sapiens
uuucuaguguucauguuug

SEQ ID NO: 1147244 - RNA, 19 nt, Homo sapiens
gaugaugagcagaccaugu

SEQ ID NO: 1147245 - RNA, 19 nt, Homo sapiens
gauccucauuguggccauu

SEQ ID NO: 1147246 - RNA, 19 nt, Homo sapiens
uaaguggcaucuguguugu

SEQ ID NO: 1147247 - RNA, 19 nt, Homo sapiens
caaggagguggaauguuau

SEQ ID NO: 1147248 - RNA, 19 nt, Homo sapiens
gcucaggccaagagaaagu

SEQ ID NO: 1147249 - RNA, 19 nt, Homo sapiens
gacugucuuucuaguguuc

SEQ ID NO: 1147250 - RNA, 19 nt, Homo sapiens
uccaagugguguuccgaaa

SEQ ID NO: 1147251 - RNA, 19 nt, Homo sapiens
agagccagauuguuuagag

SEQ ID NO: 1147252 - RNA, 19 nt, Homo sapiens
aaaaugcuauugugaaugg

SEQ ID NO: 1147253 - RNA, 19 nt, Homo sapiens
gagaacgccgcuacucuac

SEQ ID NO: 1147254 - RNA, 19 nt, Homo sapiens
acagagaacaccaguaagg

SEQ ID NO: 1147255 - RNA, 19 nt, Homo sapiens
ugaauggggugcugcagaa

SEQ ID NO: 1147256 - RNA, 19 nt, Homo sapiens
ggucuuccagaucauaaug

SEQ ID NO: 1147257 - RNA, 19 nt, Homo sapiens
caucaaggagguggaaugu

SEQ ID NO: 1147258 - RNA, 19 nt, Homo sapiens
gccaauauuuucucuaugg

SEQ ID NO: 1147259 - RNA, 19 nt, Homo sapiens
ccaagugguguuccgaaau

SEQ ID NO: 1147260 - RNA, 19 nt, Homo sapiens
gcagcacuccacuaugauc

SEQ ID NO: 1147261 - RNA, 19 nt, Homo sapiens
gagacgguguacgaugaug

SEQ ID NO: 1147262 - RNA, 19 nt, Homo sapiens
ccacacccaucaggucuac

SEQ ID NO: 1147263 - RNA, 19 nt, Homo sapiens
cagagaacaccaguaagga

SEQ ID NO: 1147264 - RNA, 19 nt, Homo sapiens
gcgagaacgccgcuacucu

SEQ ID NO: 1147265 - RNA, 19 nt, Homo sapiens
agaaagucaaucuaugaga

SEQ ID NO: 1147266 - RNA, 19 nt, Homo sapiens
uaaccaggccugcuaugac

SEQ ID NO: 1147267 - RNA, 19 nt, Homo sapiens
ggucuacgcacugcaucaa

SEQ ID NO: 1147268 - RNA, 19 nt, Homo sapiens
gcagcagcacuccacuaug

SEQ ID NO: 1147269 - RNA, 19 nt, Homo sapiens
aacgagaagauaagaaguu

SEQ ID NO: 1147270 - RNA, 19 nt, Homo sapiens
ggagacgguguacgaugau

SEQ ID NO: 1147271 - RNA, 19 nt, Homo sapiens
gcaaggaaauugugcuuua

SEQ ID NO: 1147272 - RNA, 19 nt, Homo sapiens
gaacaagacacccuaauaa

SEQ ID NO: 1147273 - RNA, 19 nt, Homo sapiens
ggaaguugcuugaauguug

SEQ ID NO: 1147274 - RNA, 19 nt, Homo sapiens
ggaaguuucuuuaccaauu

SEQ ID NO: 1147275 - RNA, 19 nt, Homo sapiens
gaaggaaguugcuugaaug

SEQ ID NO: 1147276 - RNA, 19 nt, Homo sapiens
gcacaacugucuuauuuua

SEQ ID NO: 1147277 - RNA, 19 nt, Homo sapiens
ggaaggaaguugcuugaau

SEQ ID NO: 1147278 - RNA, 19 nt, Homo sapiens
ccacaaacuucacauauca

SEQ ID NO: 1147279 - RNA, 19 nt, Homo sapiens
uuaaggaagucccuaauuu

SEQ ID NO: 1147280 - RNA, 19 nt, Homo sapiens
gagaguaucugggugauug

SEQ ID NO: 1147281 - RNA, 19 nt, Homo sapiens
uaaggaagucccuaauuua

SEQ ID NO: 1147282 - RNA, 19 nt, Homo sapiens
guaugagguugaugacuua

SEQ ID NO: 1147283 - RNA, 19 nt, Homo sapiens
ggucaagguuugcuacauu

SEQ ID NO: 1147284 - RNA, 19 nt, Homo sapiens
gugagaggaucaaauguuu

SEQ ID NO: 1147285 - RNA, 19 nt, Homo sapiens
ccaaucaggucaagguuug

SEQ ID NO: 1147286 - RNA, 19 nt, Homo sapiens
cuucaagucuucucuguuu

SEQ ID NO: 1147287 - RNA, 19 nt, Homo sapiens
ugacagugcuacauccuuu

SEQ ID NO: 1147288 - RNA, 19 nt, Homo sapiens
gaaguuucuuuaccaauuc

SEQ ID NO: 1147289 - RNA, 19 nt, Homo sapiens
gaagccauuucucuugauu

SEQ ID NO: 1147290 - RNA, 19 nt, Homo sapiens
gaaauggagucucaaagcu

SEQ ID NO: 1147291 - RNA, 19 nt, Homo sapiens
gaaauugugcuuuauccaa

SEQ ID NO: 1147292 - RNA, 19 nt, Homo sapiens
ccuucaagcuacuuuaaua

SEQ ID NO: 1147293 - RNA, 19 nt, Homo sapiens
augcacaacugucuuauuu

SEQ ID NO: 1147294 - RNA, 19 nt, Homo sapiens
gagagaaagagaacaauau

SEQ ID NO: 1147295 - RNA, 19 nt, Homo sapiens
ggacuuugauagcaacuuc

SEQ ID NO: 1147296 - RNA, 19 nt, Homo sapiens
ggaggaaguuucuuuacca

SEQ ID NO: 1147297 - RNA, 19 nt, Homo sapiens
ugaaauaucucugcugaag

SEQ ID NO: 1147298 - RNA, 19 nt, Homo sapiens
gaacaauauuugggagaga

SEQ ID NO: 1147299 - RNA, 19 nt, Homo sapiens
ccauaucccugugccguua

SEQ ID NO: 1147300 - RNA, 19 nt, Homo sapiens
ugaacaagacacccuaaua

SEQ ID NO: 1147301 - RNA, 19 nt, Homo sapiens
ccagggacgugcugcaauu

SEQ ID NO: 1147302 - RNA, 19 nt, Homo sapiens
uagcaaaucuucuggaaac

SEQ ID NO: 1147303 - RNA, 19 nt, Homo sapiens
gaugagagcagaagguaga

SEQ ID NO: 1147304 - RNA, 19 nt, Homo sapiens
caagacacccuaauaaugg

SEQ ID NO: 1147305 - RNA, 19 nt, Homo sapiens
gggaagggcugcaugaaaa

SEQ ID NO: 1147306 - RNA, 19 nt, Homo sapiens
ucaugaccuucaaagauua

SEQ ID NO: 1147307 - RNA, 19 nt, Homo sapiens
caaggaaauugugcuuuau

SEQ ID NO: 1147308 - RNA, 19 nt, Homo sapiens
gggaagcauugcaaggaaa

SEQ ID NO: 1147309 - RNA, 19 nt, Homo sapiens
ugaaugcacaacugucuua

SEQ ID NO: 1147310 - RNA, 19 nt, Homo sapiens
gaggaaguuucuuuaccaa

SEQ ID NO: 1147311 - RNA, 19 nt, Homo sapiens
gaacggcugccacguggaa

SEQ ID NO: 1147312 - RNA, 19 nt, Homo sapiens
uggaagcugugaagauaaa

SEQ ID NO: 1147313 - RNA, 19 nt, Homo sapiens
uuuggaagcugugaagaua

SEQ ID NO: 1147314 - RNA, 19 nt, Homo sapiens
aaacuugaaugcacaacug

SEQ ID NO: 1147315 - RNA, 19 nt, Homo sapiens
ggagguggagguugcagua

SEQ ID NO: 1147316 - RNA, 19 nt, Homo sapiens
gucaagguuugcuacauuu

SEQ ID NO: 1147317 - RNA, 19 nt, Homo sapiens
gcaggaggacugugaacaa

SEQ ID NO: 1147318 - RNA, 19 nt, Homo sapiens
aaacaguccuucaagucuu

SEQ ID NO: 1147319 - RNA, 19 nt, Homo sapiens
caacguauguaauuguaac

SEQ ID NO: 1147320 - RNA, 19 nt, Homo sapiens
gaaagagaacaauauuugg

SEQ ID NO: 1147321 - RNA, 19 nt, Homo sapiens
ugucacacacgaugaaaua

SEQ ID NO: 1147322 - RNA, 19 nt, Homo sapiens
uguaugagguugaugacuu

SEQ ID NO: 1147323 - RNA, 19 nt, Homo sapiens
guugaugucugaaguagca

SEQ ID NO: 1147324 - RNA, 19 nt, Homo sapiens
caaaccaucucuccaaagc

SEQ ID NO: 1147325 - RNA, 19 nt, Homo sapiens
caucaugaccuucaaagau

SEQ ID NO: 1147326 - RNA, 19 nt, Homo sapiens
gcaguaauggugcuacgaa

SEQ ID NO: 1147327 - RNA, 19 nt, Homo sapiens
caaugaagaugagcagauc

SEQ ID NO: 1147328 - RNA, 19 nt, Homo sapiens
gaaacacccacaaacuuca

SEQ ID NO: 1147329 - RNA, 19 nt, Homo sapiens
acaagacacccuaauaaug

SEQ ID NO: 1147330 - RNA, 19 nt, Homo sapiens
gaaugucacacacgaugaa

SEQ ID NO: 1147331 - RNA, 19 nt, Homo sapiens
ugacuuacgagacgcauuu

SEQ ID NO: 1147332 - RNA, 19 nt, Homo sapiens
gcaaugaagaugagcagau

SEQ ID NO: 1147333 - RNA, 19 nt, Homo sapiens
aaagagagagagagagaaa

SEQ ID NO: 1147334 - RNA, 19 nt, Homo sapiens
auaauggguugaugucuga

SEQ ID NO: 1147335 - RNA, 19 nt, Homo sapiens
ggugagaggaucaaauguu

SEQ ID NO: 1147336 - RNA, 19 nt, Homo sapiens
gcagaagguagauccuaaa

SEQ ID NO: 1147337 - RNA, 19 nt, Homo sapiens
gaaauaucucugcugaaga

SEQ ID NO: 1147338 - RNA, 19 nt, Homo sapiens
cgagacgcauuucguacuu

SEQ ID NO: 1147339 - RNA, 19 nt, Homo sapiens
uagaaacacccacaaacuu

SEQ ID NO: 1147340 - RNA, 19 nt, Homo sapiens
ggaccugggagcauccuaa

SEQ ID NO: 1147341 - RNA, 19 nt, Homo sapiens
cuucaacucucacuuucuu

SEQ ID NO: 1147342 - RNA, 19 nt, Homo sapiens
gagacgcauuucguacuuu

SEQ ID NO: 1147343 - RNA, 19 nt, Homo sapiens
gugcaaauagccaucauga

SEQ ID NO: 1147344 - RNA, 19 nt, Homo sapiens
gcaggagaaucgcuugaac

SEQ ID NO: 1147345 - RNA, 19 nt, Homo sapiens
ggaggacugugaacaagac

SEQ ID NO: 1147346 - RNA, 19 nt, Homo sapiens
caaguaacacaaacucuuc

SEQ ID NO: 1147347 - RNA, 19 nt, Homo sapiens
guacuuugggacuuugaua

SEQ ID NO: 1147348 - RNA, 19 nt, Homo sapiens
agagagaaagagaacaaua

SEQ ID NO: 1147349 - RNA, 19 nt, Homo sapiens
gagcagaagguagauccua

SEQ ID NO: 1147350 - RNA, 19 nt, Homo sapiens
gaaaugccaaucaggucaa

SEQ ID NO: 1147351 - RNA, 19 nt, Homo sapiens
aaucaugcgcuguauguuu

SEQ ID NO: 1147352 - RNA, 19 nt, Homo sapiens
ggagcauccuaaaguguca

SEQ ID NO: 1147353 - RNA, 19 nt, Homo sapiens
aaauaucucugcugaagac

SEQ ID NO: 1147354 - RNA, 19 nt, Homo sapiens
ucacuggacuuugguuauc

SEQ ID NO: 1147355 - RNA, 19 nt, Homo sapiens
ccaaucaugcgcuguaugu

SEQ ID NO: 1147356 - RNA, 19 nt, Homo sapiens
aucaugaccuucaaagauu

SEQ ID NO: 1147357 - RNA, 19 nt, Homo sapiens
aaauagccaucaugaccuu

SEQ ID NO: 1147358 - RNA, 19 nt, Homo sapiens
gaucccuauuugucucuuu

SEQ ID NO: 1147359 - RNA, 19 nt, Homo sapiens
gagggaggauggcuugaac

SEQ ID NO: 1147360 - RNA, 19 nt, Homo sapiens
aacacaaacucuuccauca

SEQ ID NO: 1147361 - RNA, 19 nt, Homo sapiens
gcuucuggcucacuuucaa

SEQ ID NO: 1147362 - RNA, 19 nt, Homo sapiens
gagcagauccacaggaaaa

SEQ ID NO: 1147363 - RNA, 19 nt, Homo sapiens
caagauccugucucucaaa

SEQ ID NO: 1147364 - RNA, 19 nt, Homo sapiens
ggaaugucacacacgauga

SEQ ID NO: 1147365 - RNA, 19 nt, Homo sapiens
acgaagccauuucucuuga

SEQ ID NO: 1147366 - RNA, 19 nt, Homo sapiens
gagagagagagaaagagaa

SEQ ID NO: 1147367 - RNA, 19 nt, Homo sapiens
ccaucucuccaaagcauua

SEQ ID NO: 1147368 - RNA, 19 nt, Homo sapiens
cccaaaccaucucuccaaa

SEQ ID NO: 1147369 - RNA, 19 nt, Homo sapiens
ucaaguaacacaaacucuu

SEQ ID NO: 1147370 - RNA, 19 nt, Homo sapiens
agacgcauuucguacuuug

SEQ ID NO: 1147371 - RNA, 19 nt, Homo sapiens
gaagaggaccauagaauuu

SEQ ID NO: 1147372 - RNA, 19 nt, Homo sapiens
uagaagcacuccugcaaua

SEQ ID NO: 1147373 - RNA, 19 nt, Homo sapiens
guauuaaccuuacaacaga

SEQ ID NO: 1147374 - RNA, 19 nt, Homo sapiens
gaagagcucuguguaucaa

SEQ ID NO: 1147375 - RNA, 19 nt, Homo sapiens
gaaugaauuuggaaucuuc

SEQ ID NO: 1147376 - RNA, 19 nt, Homo sapiens
gaagcaaacugcacauuuu

SEQ ID NO: 1147377 - RNA, 19 nt, Homo sapiens
gaagugcaccgguuuagaa

SEQ ID NO: 1147378 - RNA, 19 nt, Homo sapiens
gaaacgugaugaugagguu

SEQ ID NO: 1147379 - RNA, 19 nt, Homo sapiens
gagaauggaguauuugaaa

SEQ ID NO: 1147380 - RNA, 19 nt, Homo sapiens
ggacuuggaucaggaagga

SEQ ID NO: 1147381 - RNA, 19 nt, Homo sapiens
ggaggcgccugcuuucauu

SEQ ID NO: 1147382 - RNA, 19 nt, Homo sapiens
uuacauacccuuuaccuuu

SEQ ID NO: 1147383 - RNA, 19 nt, Homo sapiens
gauugcauuuccagaauuu

SEQ ID NO: 1147384 - RNA, 19 nt, Homo sapiens
gauagaagcauggaauuga

SEQ ID NO: 1147385 - RNA, 19 nt, Homo sapiens
gaagcuccauugccuccua

SEQ ID NO: 1147386 - RNA, 19 nt, Homo sapiens
gaagcacuccugcaauauu

SEQ ID NO: 1147387 - RNA, 19 nt, Homo sapiens
ggaaacuucugauacucuu

SEQ ID NO: 1147388 - RNA, 19 nt, Homo sapiens
ucuguaaguuugagcuuua

SEQ ID NO: 1147389 - RNA, 19 nt, Homo sapiens
ggaaugaauuuggaaucuu

SEQ ID NO: 1147390 - RNA, 19 nt, Homo sapiens
ucaugagaauggaguauuu

SEQ ID NO: 1147391 - RNA, 19 nt, Homo sapiens
gagcuuagggugcugauug

SEQ ID NO: 1147392 - RNA, 19 nt, Homo sapiens
uaucagaguuagaaacaga

SEQ ID NO: 1147393 - RNA, 19 nt, Homo sapiens
ggagagggucaacucguua

SEQ ID NO: 1147394 - RNA, 19 nt, Homo sapiens
ggauugcauuuccagaauu

SEQ ID NO: 1147395 - RNA, 19 nt, Homo sapiens
gcaaaagucuaucagaguu

SEQ ID NO: 1147396 - RNA, 19 nt, Homo sapiens
acagacaguugcauagauu

SEQ ID NO: 1147397 - RNA, 19 nt, Homo sapiens
gcagauagaagcauggaau

SEQ ID NO: 1147398 - RNA, 19 nt, Homo sapiens
agggaaacguuacuucuuu

SEQ ID NO: 1147399 - RNA, 19 nt, Homo sapiens
gauugaccaugcagaagaa

SEQ ID NO: 1147400 - RNA, 19 nt, Homo sapiens
gacaaacagggaaacguua

SEQ ID NO: 1147401 - RNA, 19 nt, Homo sapiens
gaaugaagcguaggaacuu

SEQ ID NO: 1147402 - RNA, 19 nt, Homo sapiens
uagaagagcucuguguauc

SEQ ID NO: 1147403 - RNA, 19 nt, Homo sapiens
ugaagaggaccauagaauu

SEQ ID NO: 1147404 - RNA, 19 nt, Homo sapiens
gaggaagaguugcuagaag

SEQ ID NO: 1147405 - RNA, 19 nt, Homo sapiens
gcugauugaugauucacaa

SEQ ID NO: 1147406 - RNA, 19 nt, Homo sapiens
guuuagagcuauagaagca

SEQ ID NO: 1147407 - RNA, 19 nt, Homo sapiens
ggaaugccugcgcaguuua

SEQ ID NO: 1147408 - RNA, 19 nt, Homo sapiens
uuagggugcugauugauga

SEQ ID NO: 1147409 - RNA, 19 nt, Homo sapiens
gcuagaagagcucugugua

SEQ ID NO: 1147410 - RNA, 19 nt, Homo sapiens
gcacagacaguugcauaga

SEQ ID NO: 1147411 - RNA, 19 nt, Homo sapiens
agggucaacucguuacaua

SEQ ID NO: 1147412 - RNA, 19 nt, Homo sapiens
gucagaaacaauaggauua

SEQ ID NO: 1147413 - RNA, 19 nt, Homo sapiens
ggauugaccaugcagaaga

SEQ ID NO: 1147414 - RNA, 19 nt, Homo sapiens
aggaagaguugcuagaaga

SEQ ID NO: 1147415 - RNA, 19 nt, Homo sapiens
guaaugaguaucacaguca

SEQ ID NO: 1147416 - RNA, 19 nt, Homo sapiens
ccagagauuugagauuuca

SEQ ID NO: 1147417 - RNA, 19 nt, Homo sapiens
agccagagauuugagauuu

SEQ ID NO: 1147418 - RNA, 19 nt, Homo sapiens
ucaugugaauuuccugauu

SEQ ID NO: 1147419 - RNA, 19 nt, Homo sapiens
aagcacuccugcaauauug

SEQ ID NO: 1147420 - RNA, 19 nt, Homo sapiens
uggaaugccugcgcaguuu

SEQ ID NO: 1147421 - RNA, 19 nt, Homo sapiens
gauugaugauucacaaagu

SEQ ID NO: 1147422 - RNA, 19 nt, Homo sapiens
caauaggauuaucaugaga

SEQ ID NO: 1147423 - RNA, 19 nt, Homo sapiens
gaugugauaugaggcaaca

SEQ ID NO: 1147424 - RNA, 19 nt, Homo sapiens
uuacaggaaacuucugaua

SEQ ID NO: 1147425 - RNA, 19 nt, Homo sapiens
acaauaggauuaucaugag

SEQ ID NO: 1147426 - RNA, 19 nt, Homo sapiens
ugacaaacagggaaacguu

SEQ ID NO: 1147427 - RNA, 19 nt, Homo sapiens
augggaaccuucucucuuu

SEQ ID NO: 1147428 - RNA, 19 nt, Homo sapiens
agaagcaaacugcacauuu

SEQ ID NO: 1147429 - RNA, 19 nt, Homo sapiens
acaggaaacuucugauacu

SEQ ID NO: 1147430 - RNA, 19 nt, Homo sapiens
caaacauucuucuguagac

SEQ ID NO: 1147431 - RNA, 19 nt, Homo sapiens
guauagagucagacacuug

SEQ ID NO: 1147432 - RNA, 19 nt, Homo sapiens
auagaagcauggaauugaa

SEQ ID NO: 1147433 - RNA, 19 nt, Homo sapiens
cagaagaaauggaguugcu

SEQ ID NO: 1147434 - RNA, 19 nt, Homo sapiens
cuauaguucuuugucagua

SEQ ID NO: 1147435 - RNA, 19 nt, Homo sapiens
ggaaaacuacuaccgauug

SEQ ID NO: 1147436 - RNA, 19 nt, Homo sapiens
aaauggaguugcuguugga

SEQ ID NO: 1147437 - RNA, 19 nt, Homo sapiens
guauuugaaagcugugaua

SEQ ID NO: 1147438 - RNA, 19 nt, Homo sapiens
uaugauggcuucuuuaccu

SEQ ID NO: 1147439 - RNA, 19 nt, Homo sapiens
gagugacccacaagucuuu

SEQ ID NO: 1147440 - RNA, 19 nt, Homo sapiens
agagugucuucugauauua

SEQ ID NO: 1147441 - RNA, 19 nt, Homo sapiens
caccgaaacgugaugauga

SEQ ID NO: 1147442 - RNA, 19 nt, Homo sapiens
ggagugacccacaagucuu

SEQ ID NO: 1147443 - RNA, 19 nt, Homo sapiens
uauagaagcacuccugcaa

SEQ ID NO: 1147444 - RNA, 19 nt, Homo sapiens
gaaccucugacgucucuca

SEQ ID NO: 1147445 - RNA, 19 nt, Homo sapiens
uggagagggucaacucguu

SEQ ID NO: 1147446 - RNA, 19 nt, Homo sapiens
cagcauguaaugaguauca

SEQ ID NO: 1147447 - RNA, 19 nt, Homo sapiens
cagacuggauggacuugga

SEQ ID NO: 1147448 - RNA, 19 nt, Homo sapiens
uagaaccucugacgucucu

SEQ ID NO: 1147449 - RNA, 19 nt, Homo sapiens
ggagaucuuggaugaggaa

SEQ ID NO: 1147450 - RNA, 19 nt, Homo sapiens
ccaaacauucuucuguaga

SEQ ID NO: 1147451 - RNA, 19 nt, Homo sapiens
gccagagauuugagauuuc

SEQ ID NO: 1147452 - RNA, 19 nt, Homo sapiens
uagcuauaguucuuuguca

SEQ ID NO: 1147453 - RNA, 19 nt, Homo sapiens
cacagacaguugcauagau

SEQ ID NO: 1147454 - RNA, 19 nt, Homo sapiens
aagcacagacaguugcaua

SEQ ID NO: 1147455 - RNA, 19 nt, Homo sapiens
caugggaaguggccucauc

SEQ ID NO: 1147456 - RNA, 19 nt, Homo sapiens
gagauuucagcauguaaug

SEQ ID NO: 1147457 - RNA, 19 nt, Homo sapiens
caacacaagcacagacagu

SEQ ID NO: 1147458 - RNA, 19 nt, Homo sapiens
gaaacuucugauacucuuu

SEQ ID NO: 1147459 - RNA, 19 nt, Homo sapiens
gggaaacguuacuucuuuu

SEQ ID NO: 1147460 - RNA, 19 nt, Homo sapiens
ggacuaaugggaguugcuu

SEQ ID NO: 1147461 - RNA, 19 nt, Homo sapiens
guauagggaauuauguuca

SEQ ID NO: 1147462 - RNA, 19 nt, Homo sapiens
ccuacaaacuuuaaaugcu

SEQ ID NO: 1147463 - RNA, 19 nt, Homo sapiens
ggucuucaagccagagauu

SEQ ID NO: 1147464 - RNA, 19 nt, Homo sapiens
uccauugccuccuaugaug

SEQ ID NO: 1147465 - RNA, 19 nt, Homo sapiens
cuagaagagcucuguguau

SEQ ID NO: 1147466 - RNA, 19 nt, Homo sapiens
uuugaaagcugugauaacu

SEQ ID NO: 1147467 - RNA, 19 nt, Homo sapiens
gaauggaguauuugaaagc

SEQ ID NO: 1147468 - RNA, 19 nt, Homo sapiens
agaauggaguauuugaaag

SEQ ID NO: 1147469 - RNA, 19 nt, Homo sapiens
cagauagaagcauggaauu

SEQ ID NO: 1147470 - RNA, 19 nt, Homo sapiens
gauuacaggaauuauguuc

SEQ ID NO: 1147471 - RNA, 19 nt, Homo sapiens
caaaggccaucucacauuu

SEQ ID NO: 1147472 - RNA, 19 nt, Homo sapiens
gaagcaauccucaccauuu

SEQ ID NO: 1147473 - RNA, 19 nt, Homo sapiens
gaaacuugauuccucuauu

SEQ ID NO: 1147474 - RNA, 19 nt, Homo sapiens
gaagacaugagaagacuuu

SEQ ID NO: 1147475 - RNA, 19 nt, Homo sapiens
agaagaagauguugaagug

SEQ ID NO: 1147476 - RNA, 19 nt, Homo sapiens
ugaaauuucuaggcuguua

SEQ ID NO: 1147477 - RNA, 19 nt, Homo sapiens
aaacuugauuccucuauug

SEQ ID NO: 1147478 - RNA, 19 nt, Homo sapiens
caacacagcacacuaguca

SEQ ID NO: 1147479 - RNA, 19 nt, Homo sapiens
ucaaguguguguuaccuuu

SEQ ID NO: 1147480 - RNA, 19 nt, Homo sapiens
ccaguucacucaggccuua

SEQ ID NO: 1147481 - RNA, 19 nt, Homo sapiens
ggacuacaauacuaaccuu

SEQ ID NO: 1147482 - RNA, 19 nt, Homo sapiens
ggccuuacuugaugucuuu

SEQ ID NO: 1147483 - RNA, 19 nt, Homo sapiens
gacaugagaagacuuuaaa

SEQ ID NO: 1147484 - RNA, 19 nt, Homo sapiens
gauccaagguacccaaagu

SEQ ID NO: 1147485 - RNA, 19 nt, Homo sapiens
ccaaagauacacucuauag

SEQ ID NO: 1147486 - RNA, 19 nt, Homo sapiens
aagauacacucuauagaug

SEQ ID NO: 1147487 - RNA, 19 nt, Homo sapiens
gaaauuuacagagccauga

SEQ ID NO: 1147488 - RNA, 19 nt, Homo sapiens
ccaaagcuauuagaaccaa

SEQ ID NO: 1147489 - RNA, 19 nt, Homo sapiens
ugucucacauucauuugua

SEQ ID NO: 1147490 - RNA, 19 nt, Homo sapiens
ucaaaggccaucucacauu

SEQ ID NO: 1147491 - RNA, 19 nt, Homo sapiens
agaaaccucucacuuacga

SEQ ID NO: 1147492 - RNA, 19 nt, Homo sapiens
caagguacccaaagucaga

SEQ ID NO: 1147493 - RNA, 19 nt, Homo sapiens
ucaauuaucugagguuguc

SEQ ID NO: 1147494 - RNA, 19 nt, Homo sapiens
ccacuguguuugaccacua

SEQ ID NO: 1147495 - RNA, 19 nt, Homo sapiens
ugccaaagauacacucuau

SEQ ID NO: 1147496 - RNA, 19 nt, Homo sapiens
ucguaaacccugccucuua

SEQ ID NO: 1147497 - RNA, 19 nt, Homo sapiens
gagaagaagauguugaagu

SEQ ID NO: 1147498 - RNA, 19 nt, Homo sapiens
gggcagacccuuuucauaa

SEQ ID NO: 1147499 - RNA, 19 nt, Homo sapiens
gaggguuucuuaacucaca

SEQ ID NO: 1147500 - RNA, 19 nt, Homo sapiens
ucugaaugcccgauuauaa

SEQ ID NO: 1147501 - RNA, 19 nt, Homo sapiens
gaaagaaaaccaucugaau

SEQ ID NO: 1147502 - RNA, 19 nt, Homo sapiens
uuucauaacucccucaagu

SEQ ID NO: 1147503 - RNA, 19 nt, Homo sapiens
caaagauacacucuauaga

SEQ ID NO: 1147504 - RNA, 19 nt, Homo sapiens
gacaaggcauuuuauauuc

SEQ ID NO: 1147505 - RNA, 19 nt, Homo sapiens
gaugugacuuggaaaauga

SEQ ID NO: 1147506 - RNA, 19 nt, Homo sapiens
gaucugcuucucugucgua

SEQ ID NO: 1147507 - RNA, 19 nt, Homo sapiens
caacacguaccucugaaug

SEQ ID NO: 1147508 - RNA, 19 nt, Homo sapiens
ccagcuuuccuccauguua

SEQ ID NO: 1147509 - RNA, 19 nt, Homo sapiens
acgugaagcugauaggaaa

SEQ ID NO: 1147510 - RNA, 19 nt, Homo sapiens
ccgcaagaaugaacugcaa

SEQ ID NO: 1147511 - RNA, 19 nt, Homo sapiens
gaacgugaagcugauagga

SEQ ID NO: 1147512 - RNA, 19 nt, Homo sapiens
gcaacgacgagaagaagau

SEQ ID NO: 1147513 - RNA, 19 nt, Homo sapiens
uguuagaugugacuuggaa

SEQ ID NO: 1147514 - RNA, 19 nt, Homo sapiens
aaaaccaucugaauuguug

SEQ ID NO: 1147515 - RNA, 19 nt, Homo sapiens
cagcauguuucuaccaaag

SEQ ID NO: 1147516 - RNA, 19 nt, Homo sapiens
gcaugccucacgugccuua

SEQ ID NO: 1147517 - RNA, 19 nt, Homo sapiens
ccucggacaugucuguaug

SEQ ID NO: 1147518 - RNA, 19 nt, Homo sapiens
guaagcaacaggacauauc

SEQ ID NO: 1147519 - RNA, 19 nt, Homo sapiens
aaaugaggguuucuuaacu

SEQ ID NO: 1147520 - RNA, 19 nt, Homo sapiens
gcuuaguaguggccugauu

SEQ ID NO: 1147521 - RNA, 19 nt, Homo sapiens
aggaauacgugcccacugu

SEQ ID NO: 1147522 - RNA, 19 nt, Homo sapiens
gcuggagccgcaagaauga

SEQ ID NO: 1147523 - RNA, 19 nt, Homo sapiens
guauugccacgacaaacua

SEQ ID NO: 1147524 - RNA, 19 nt, Homo sapiens
uacacucuauagaugcuua

SEQ ID NO: 1147525 - RNA, 19 nt, Homo sapiens
gaaugcccgauuauaagaa

SEQ ID NO: 1147526 - RNA, 19 nt, Homo sapiens
ugaaugcccgauuauaaga

SEQ ID NO: 1147527 - RNA, 19 nt, Homo sapiens
guacuaauuuccaguucac

SEQ ID NO: 1147528 - RNA, 19 nt, Homo sapiens
ucauagggacccagauuga

SEQ ID NO: 1147529 - RNA, 19 nt, Homo sapiens
gcaagaaugaacugcaaag

SEQ ID NO: 1147530 - RNA, 19 nt, Homo sapiens
agacaugagaagacuuuaa

SEQ ID NO: 1147531 - RNA, 19 nt, Homo sapiens
cagcuuuccuccauguuag

SEQ ID NO: 1147532 - RNA, 19 nt, Homo sapiens
aaacuugggacuacaauac

SEQ ID NO: 1147533 - RNA, 19 nt, Homo sapiens
gaauacgugcccacugugu

SEQ ID NO: 1147534 - RNA, 19 nt, Homo sapiens
agaagauguugaagugugu

SEQ ID NO: 1147535 - RNA, 19 nt, Homo sapiens
gacagggagagcagaguaa

SEQ ID NO: 1147536 - RNA, 19 nt, Homo sapiens
gcccagcuuuccuccaugu

SEQ ID NO: 1147537 - RNA, 19 nt, Homo sapiens
auaacucccucaagugugu

SEQ ID NO: 1147538 - RNA, 19 nt, Homo sapiens
cuauagaugcuuaguagug

SEQ ID NO: 1147539 - RNA, 19 nt, Homo sapiens
gauacacucuauagaugcu

SEQ ID NO: 1147540 - RNA, 19 nt, Homo sapiens
gccagaagcauccguacug

SEQ ID NO: 1147541 - RNA, 19 nt, Homo sapiens
ccucugagcccucccaaca

SEQ ID NO: 1147542 - RNA, 19 nt, Homo sapiens
aaaccugccugcugaugag

SEQ ID NO: 1147543 - RNA, 19 nt, Homo sapiens
gaagaagauguugaagugu

SEQ ID NO: 1147544 - RNA, 19 nt, Homo sapiens
caagaaugaacugcaaaga

SEQ ID NO: 1147545 - RNA, 19 nt, Homo sapiens
ccaaagucagacagaguaa

SEQ ID NO: 1147546 - RNA, 19 nt, Homo sapiens
ucacucaggccuuacuaau

SEQ ID NO: 1147547 - RNA, 19 nt, Homo sapiens
uugcuggccuuacuugaug

SEQ ID NO: 1147548 - RNA, 19 nt, Homo sapiens
agacagggagagcagagua

SEQ ID NO: 1147549 - RNA, 19 nt, Homo sapiens
cccguuugcuguauaugaa

SEQ ID NO: 1147550 - RNA, 19 nt, Homo sapiens
ccucauagggacccagauu

SEQ ID NO: 1147551 - RNA, 19 nt, Homo sapiens
ucauaacucccucaagugu

SEQ ID NO: 1147552 - RNA, 19 nt, Homo sapiens
gccaaagauacacucuaua

SEQ ID NO: 1147553 - RNA, 19 nt, Homo sapiens
cccaaagucagacagagua

SEQ ID NO: 1147554 - RNA, 19 nt, Homo sapiens
cucuauagaugcuuaguag

SEQ ID NO: 1147555 - RNA, 19 nt, Homo sapiens
uaagaagacaugagaagac

SEQ ID NO: 1147556 - RNA, 19 nt, Homo sapiens
uauaagaagacaugagaag

SEQ ID NO: 1147557 - RNA, 19 nt, Homo sapiens
ucugagcccucccaacaca

SEQ ID NO: 1147558 - RNA, 19 nt, Homo sapiens
gggcacgaccagaaaggaa

SEQ ID NO: 1147559 - RNA, 19 nt, Homo sapiens
aagcaauccucaccauuuu

SEQ ID NO: 1147560 - RNA, 19 nt, Homo sapiens
uuacgagcauggugugaag

SEQ ID NO: 1147561 - RNA, 19 nt, Homo sapiens
caaagucagacagaguaaa

SEQ ID NO: 1147562 - RNA, 19 nt, Homo sapiens
gaaaaccaucugaauuguu

SEQ ID NO: 1147563 - RNA, 19 nt, Homo sapiens
ucaugaacgugaagcugau

SEQ ID NO: 1147564 - RNA, 19 nt, Homo sapiens
cugcuucucugucguaaac

SEQ ID NO: 1147565 - RNA, 19 nt, Homo sapiens
uuugaccacuaugcaguua

SEQ ID NO: 1147566 - RNA, 19 nt, Homo sapiens
auacgugcccacuguguuu

SEQ ID NO: 1147567 - RNA, 19 nt, Homo sapiens
gacgagaagaagauguuga

SEQ ID NO: 1147568 - RNA, 19 nt, Homo sapiens
cuuaguaguggccugauuu

SEQ ID NO: 1147569 - RNA, 19 nt, Homo sapiens
aagaaaaccaucugaauug

SEQ ID NO: 1147570 - RNA, 19 nt, Homo sapiens
ccgauuauaagaagacaug

SEQ ID NO: 1147571 - RNA, 19 nt, Homo sapiens
gaacagcucugggagauaa

SEQ ID NO: 1147572 - RNA, 19 nt, Homo sapiens
gaaauaagaucaggcauau

SEQ ID NO: 1147573 - RNA, 19 nt, Homo sapiens
caacaccacugaaaucaua

SEQ ID NO: 1147574 - RNA, 19 nt, Homo sapiens
gaucaacaaugccuucuuu

SEQ ID NO: 1147575 - RNA, 19 nt, Homo sapiens
caacagaaauuucccaugu

SEQ ID NO: 1147576 - RNA, 19 nt, Homo sapiens
gaacaaagaaccaucugaa

SEQ ID NO: 1147577 - RNA, 19 nt, Homo sapiens
ccacugaaaucauaagcua

SEQ ID NO: 1147578 - RNA, 19 nt, Homo sapiens
gugcccaucuggauuauua

SEQ ID NO: 1147579 - RNA, 19 nt, Homo sapiens
ucacuuauaucacucugua

SEQ ID NO: 1147580 - RNA, 19 nt, Homo sapiens
ggugguggcucgcuuguuu

SEQ ID NO: 1147581 - RNA, 19 nt, Homo sapiens
uaaauguggucauguggua

SEQ ID NO: 1147582 - RNA, 19 nt, Homo sapiens
ugaaugugcuugaaaguga

SEQ ID NO: 1147583 - RNA, 19 nt, Homo sapiens
gcaauugcacuacugauuu

SEQ ID NO: 1147584 - RNA, 19 nt, Homo sapiens
ugaccaaacucuggaauuu

SEQ ID NO: 1147585 - RNA, 19 nt, Homo sapiens
ucagggaucuggcaacgua

SEQ ID NO: 1147586 - RNA, 19 nt, Homo sapiens
caacaaugccuucuuucua

SEQ ID NO: 1147587 - RNA, 19 nt, Homo sapiens
caacagagaagcaacagaa

SEQ ID NO: 1147588 - RNA, 19 nt, Homo sapiens
aacaaugccuucuuucuaa

SEQ ID NO: 1147589 - RNA, 19 nt, Homo sapiens
gcaaucagccauaagaaug

SEQ ID NO: 1147590 - RNA, 19 nt, Homo sapiens
ggaugacgcugaagauaag

SEQ ID NO: 1147591 - RNA, 19 nt, Homo sapiens
ccauaagaaugaacaagaa

SEQ ID NO: 1147592 - RNA, 19 nt, Homo sapiens
gaagggagggcauauuaau

SEQ ID NO: 1147593 - RNA, 19 nt, Homo sapiens
caaagaaccaucugaagug

SEQ ID NO: 1147594 - RNA, 19 nt, Homo sapiens
uccaaucugugcuaacuua

SEQ ID NO: 1147595 - RNA, 19 nt, Homo sapiens
guauaaauguggucaugug

SEQ ID NO: 1147596 - RNA, 19 nt, Homo sapiens
caacuaaucuguuuuccaa

SEQ ID NO: 1147597 - RNA, 19 nt, Homo sapiens
caugugguauuuguaguua

SEQ ID NO: 1147598 - RNA, 19 nt, Homo sapiens
gaggguaucauucugguuu

SEQ ID NO: 1147599 - RNA, 19 nt, Homo sapiens
cagagaagcaacagaaauu

SEQ ID NO: 1147600 - RNA, 19 nt, Homo sapiens
gaaguauuaacccaaauga

SEQ ID NO: 1147601 - RNA, 19 nt, Homo sapiens
agaaauaagaucaggcaua

SEQ ID NO: 1147602 - RNA, 19 nt, Homo sapiens
caacguagaagaaagaaca

SEQ ID NO: 1147603 - RNA, 19 nt, Homo sapiens
gaggugcaaucagccauaa

SEQ ID NO: 1147604 - RNA, 19 nt, Homo sapiens
gagaaaaguucccaacaga

SEQ ID NO: 1147605 - RNA, 19 nt, Homo sapiens
ggauaccaaugaagaauac

SEQ ID NO: 1147606 - RNA, 19 nt, Homo sapiens
gaaugugcuugaaagugaa

SEQ ID NO: 1147607 - RNA, 19 nt, Homo sapiens
gaagauaagugugaaaaca

SEQ ID NO: 1147608 - RNA, 19 nt, Homo sapiens
ugaaguggaugacgcugaa

SEQ ID NO: 1147609 - RNA, 19 nt, Homo sapiens
gaaaacaugaucacaauug

SEQ ID NO: 1147610 - RNA, 19 nt, Homo sapiens
caagagcagaucauauauu

SEQ ID NO: 1147611 - RNA, 19 nt, Homo sapiens
gacgaucacuuauaucacu

SEQ ID NO: 1147612 - RNA, 19 nt, Homo sapiens
gaauggcuaaggcagauuu

SEQ ID NO: 1147613 - RNA, 19 nt, Homo sapiens
caguggagaauacauauaa

SEQ ID NO: 1147614 - RNA, 19 nt, Homo sapiens
guagaagaaagaacaaaga

SEQ ID NO: 1147615 - RNA, 19 nt, Homo sapiens
gggauaccaaugaagaaua

SEQ ID NO: 1147616 - RNA, 19 nt, Homo sapiens
gagcagaucauauauuuug

SEQ ID NO: 1147617 - RNA, 19 nt, Homo sapiens
accaagagcagaucauaua

SEQ ID NO: 1147618 - RNA, 19 nt, Homo sapiens
aauaagaucaggcauaugu

SEQ ID NO: 1147619 - RNA, 19 nt, Homo sapiens
ggaaguauuaacccaaaug

SEQ ID NO: 1147620 - RNA, 19 nt, Homo sapiens
gagaagcaacagaaauuuc

SEQ ID NO: 1147621 - RNA, 19 nt, Homo sapiens
acaaugccuucuuucuaaa

SEQ ID NO: 1147622 - RNA, 19 nt, Homo sapiens
guccuacuuugcaauguaa

SEQ ID NO: 1147623 - RNA, 19 nt, Homo sapiens
cuucaaagaccuaaggaaa

SEQ ID NO: 1147624 - RNA, 19 nt, Homo sapiens
uaagaucaggcauauguau

SEQ ID NO: 1147625 - RNA, 19 nt, Homo sapiens
gccauaagaaugaacaaga

SEQ ID NO: 1147626 - RNA, 19 nt, Homo sapiens
agaaauuucccauguccua

SEQ ID NO: 1147627 - RNA, 19 nt, Homo sapiens
gaaaaguucccaacagaga

SEQ ID NO: 1147628 - RNA, 19 nt, Homo sapiens
ucugggagauaaagcauau

SEQ ID NO: 1147629 - RNA, 19 nt, Homo sapiens
uauacaggguggaauuuua

SEQ ID NO: 1147630 - RNA, 19 nt, Homo sapiens
acaagaaccggaucaacaa

SEQ ID NO: 1147631 - RNA, 19 nt, Homo sapiens
cagaauggcuaaggcagau

SEQ ID NO: 1147632 - RNA, 19 nt, Homo sapiens
gcauaugccugggauacca

SEQ ID NO: 1147633 - RNA, 19 nt, Homo sapiens
uggaugacgcugaagauaa

SEQ ID NO: 1147634 - RNA, 19 nt, Homo sapiens
acaaagaaccaucugaagu

SEQ ID NO: 1147635 - RNA, 19 nt, Homo sapiens
caaucagccauaagaauga

SEQ ID NO: 1147636 - RNA, 19 nt, Homo sapiens
guugaccauuucuacaauu

SEQ ID NO: 1147637 - RNA, 19 nt, Homo sapiens
caaaugauggguguuaauc

SEQ ID NO: 1147638 - RNA, 19 nt, Homo sapiens
ucaauuauacccaccaaca

SEQ ID NO: 1147639 - RNA, 19 nt, Homo sapiens
cugaagggcuguuguucug

SEQ ID NO: 1147640 - RNA, 19 nt, Homo sapiens
ugaagggagggcauauuaa

SEQ ID NO: 1147641 - RNA, 19 nt, Homo sapiens
caauugcacuacugauuuu

SEQ ID NO: 1147642 - RNA, 19 nt, Homo sapiens
uguccuacuuugcaaugua

SEQ ID NO: 1147643 - RNA, 19 nt, Homo sapiens
augaagggagggcauauua

SEQ ID NO: 1147644 - RNA, 19 nt, Homo sapiens
agaaccaucugaaguggau

SEQ ID NO: 1147645 - RNA, 19 nt, Homo sapiens
gaacaagaaccggaucaac

SEQ ID NO: 1147646 - RNA, 19 nt, Homo sapiens
ugaaauaccaagagcagau

SEQ ID NO: 1147647 - RNA, 19 nt, Homo sapiens
gcccaucuggauuauuaua

SEQ ID NO: 1147648 - RNA, 19 nt, Homo sapiens
aguauuaacccaaaugaug

SEQ ID NO: 1147649 - RNA, 19 nt, Homo sapiens
cucuguauaugacuaagua

SEQ ID NO: 1147650 - RNA, 19 nt, Homo sapiens
gggagggcauauuaaugau

SEQ ID NO: 1147651 - RNA, 19 nt, Homo sapiens
ggugcaaucagccauaaga

SEQ ID NO: 1147652 - RNA, 19 nt, Homo sapiens
ucauauacaggguggaauu

SEQ ID NO: 1147653 - RNA, 19 nt, Homo sapiens
ggucaugugguauuuguag

SEQ ID NO: 1147654 - RNA, 19 nt, Homo sapiens
guguauaaauguggucaug

SEQ ID NO: 1147655 - RNA, 19 nt, Homo sapiens
ccaagagcagaucauauau

SEQ ID NO: 1147656 - RNA, 19 nt, Homo sapiens
agggagggcauauuaauga

SEQ ID NO: 1147657 - RNA, 19 nt, Homo sapiens
gaucuggcaacguagaaga

SEQ ID NO: 1147658 - RNA, 19 nt, Homo sapiens
aaaguccaaucugugcuaa

SEQ ID NO: 1147659 - RNA, 19 nt, Homo sapiens
gguguagaaaucauugaaa

SEQ ID NO: 1147660 - RNA, 19 nt, Homo sapiens
guggucaugugguauuugu

SEQ ID NO: 1147661 - RNA, 19 nt, Homo sapiens
ccaccaacaccacugaaau

SEQ ID NO: 1147662 - RNA, 19 nt, Homo sapiens
gaaauaccaagagcagauc

SEQ ID NO: 1147663 - RNA, 19 nt, Homo sapiens
gcuuguuucucugauauuc

SEQ ID NO: 1147664 - RNA, 19 nt, Homo sapiens
ccaguggagaauacauaua

SEQ ID NO: 1147665 - RNA, 19 nt, Homo sapiens
aagaucaggcauauguaua

SEQ ID NO: 1147666 - RNA, 19 nt, Homo sapiens
caucaucauaguugcaauu

SEQ ID NO: 1147667 - RNA, 19 nt, Homo sapiens
ucgcuuguuucucugauau

SEQ ID NO: 1147668 - RNA, 19 nt, Homo sapiens
ggaauuuuauccuguuauc

SEQ ID NO: 1147669 - RNA, 19 nt, Homo sapiens
cauauacaggguggaauuu

SEQ ID NO: 1147670 - RNA, 19 nt, Homo sapiens
uggaauuacucauauacag

SEQ ID NO: 1147671 - RNA, 19 nt, Homo sapiens
ggagauacguugacgaaua

SEQ ID NO: 1147672 - RNA, 19 nt, Homo sapiens
gagcauagguugcauucuu

SEQ ID NO: 1147673 - RNA, 19 nt, Homo sapiens
gcaaaccguugaaggaauu

SEQ ID NO: 1147674 - RNA, 19 nt, Homo sapiens
ucaguggucuuacuauaua

SEQ ID NO: 1147675 - RNA, 19 nt, Homo sapiens
gaacaggcauuguaaacca

SEQ ID NO: 1147676 - RNA, 19 nt, Homo sapiens
aagaggagaucucauagua

SEQ ID NO: 1147677 - RNA, 19 nt, Homo sapiens
caagagaacaggcauugua

SEQ ID NO: 1147678 - RNA, 19 nt, Homo sapiens
caugaaagcuaucguggaa

SEQ ID NO: 1147679 - RNA, 19 nt, Homo sapiens
guucagaaauccaaguauu

SEQ ID NO: 1147680 - RNA, 19 nt, Homo sapiens
gcaaguauuuucaccauaa

SEQ ID NO: 1147681 - RNA, 19 nt, Homo sapiens
gaacaucacaguacuuugg

SEQ ID NO: 1147682 - RNA, 19 nt, Homo sapiens
gaagugcaacguaugauga

SEQ ID NO: 1147683 - RNA, 19 nt, Homo sapiens
gcacuuaaauaguacugau

SEQ ID NO: 1147684 - RNA, 19 nt, Homo sapiens
aaggaaaucuugacuacuu

SEQ ID NO: 1147685 - RNA, 19 nt, Homo sapiens
gauccaacucaaagaauua

SEQ ID NO: 1147686 - RNA, 19 nt, Homo sapiens
guacugaucccaauagugu

SEQ ID NO: 1147687 - RNA, 19 nt, Homo sapiens
cgaauccacugcaguaaau

SEQ ID NO: 1147688 - RNA, 19 nt, Homo sapiens
gaauuuaugcuuugucaug

SEQ ID NO: 1147689 - RNA, 19 nt, Homo sapiens
cgaagaauguuagaauaug

SEQ ID NO: 1147690 - RNA, 19 nt, Homo sapiens
guaaagagcaccuggcaau

SEQ ID NO: 1147691 - RNA, 19 nt, Homo sapiens
acacagauaucaaaguugu

SEQ ID NO: 1147692 - RNA, 19 nt, Homo sapiens
gagauacguugacgaauac

SEQ ID NO: 1147693 - RNA, 19 nt, Homo sapiens
ggaaaucuugacuacuuua

SEQ ID NO: 1147694 - RNA, 19 nt, Homo sapiens
ugaaggaauuuaugcuuug

SEQ ID NO: 1147695 - RNA, 19 nt, Homo sapiens
gcaaugauggaacgaauau

SEQ ID NO: 1147696 - RNA, 19 nt, Homo sapiens
ggacuuaguacuuacgauu

SEQ ID NO: 1147697 - RNA, 19 nt, Homo sapiens
uaucagaucugccagucaa

SEQ ID NO: 1147698 - RNA, 19 nt, Homo sapiens
gaagagccaccgaaggaaa

SEQ ID NO: 1147699 - RNA, 19 nt, Homo sapiens
ugacuacugugaaggauau

SEQ ID NO: 1147700 - RNA, 19 nt, Homo sapiens
aaucaguggucuuacuaua

SEQ ID NO: 1147701 - RNA, 19 nt, Homo sapiens
ggaaucaguggucuuacua

SEQ ID NO: 1147702 - RNA, 19 nt, Homo sapiens
gaaaugaaaugggaaucag

SEQ ID NO: 1147703 - RNA, 19 nt, Homo sapiens
gaauaugauccaacucaaa

SEQ ID NO: 1147704 - RNA, 19 nt, Homo sapiens
caccugaucugucaaagug

SEQ ID NO: 1147705 - RNA, 19 nt, Homo sapiens
caagaaaacgcaaguauuu

SEQ ID NO: 1147706 - RNA, 19 nt, Homo sapiens
aaacagcuuucugccauuu

SEQ ID NO: 1147707 - RNA, 19 nt, Homo sapiens
ggucauguuuguauugugu

SEQ ID NO: 1147708 - RNA, 19 nt, Homo sapiens
gcagauggcguaucagauc

SEQ ID NO: 1147709 - RNA, 19 nt, Homo sapiens
cggaagaggagaucucaua

SEQ ID NO: 1147710 - RNA, 19 nt, Homo sapiens
gaaggaauuuaugcuuugu

SEQ ID NO: 1147711 - RNA, 19 nt, Homo sapiens
agaacucacuguccugauu

SEQ ID NO: 1147712 - RNA, 19 nt, Homo sapiens
ucaggcagauggcguauca

SEQ ID NO: 1147713 - RNA, 19 nt, Homo sapiens
cauaguagcacacaagaga

SEQ ID NO: 1147714 - RNA, 19 nt, Homo sapiens
cacaacacaugauucagaa

SEQ ID NO: 1147715 - RNA, 19 nt, Homo sapiens
ccacaacacaugauucaga

SEQ ID NO: 1147716 - RNA, 19 nt, Homo sapiens
gaaaagauccaggaguaua

SEQ ID NO: 1147717 - RNA, 19 nt, Homo sapiens
gaacucacuguccugauug

SEQ ID NO: 1147718 - RNA, 19 nt, Homo sapiens
ugaaagcuaucguggaagu

SEQ ID NO: 1147719 - RNA, 19 nt, Homo sapiens
caucaccaguuuaaagaau

SEQ ID NO: 1147720 - RNA, 19 nt, Homo sapiens
agagauuacuuaagacugu

SEQ ID NO: 1147721 - RNA, 19 nt, Homo sapiens
uaccuuggaugaagcauug

SEQ ID NO: 1147722 - RNA, 19 nt, Homo sapiens
gaagcgcaauagacacugu

SEQ ID NO: 1147723 - RNA, 19 nt, Homo sapiens
ucaaagaauuaccuuggau

SEQ ID NO: 1147724 - RNA, 19 nt, Homo sapiens
ugauccaacucaaagaauu

SEQ ID NO: 1147725 - RNA, 19 nt, Homo sapiens
uagguugcauucuuauuga

SEQ ID NO: 1147726 - RNA, 19 nt, Homo sapiens
agaauuaccuuggaugaag

SEQ ID NO: 1147727 - RNA, 19 nt, Homo sapiens
ccaggaguauagaggauga

SEQ ID NO: 1147728 - RNA, 19 nt, Homo sapiens
gaaagcggguaucgaaucc

SEQ ID NO: 1147729 - RNA, 19 nt, Homo sapiens
gaaugacuacugugaagga

SEQ ID NO: 1147730 - RNA, 19 nt, Homo sapiens
caccauaaccagcuagauu

SEQ ID NO: 1147731 - RNA, 19 nt, Homo sapiens
agcauagguugcauucuua

SEQ ID NO: 1147732 - RNA, 19 nt, Homo sapiens
uaucgaauccacugcagua

SEQ ID NO: 1147733 - RNA, 19 nt, Homo sapiens
ccacaucaccaguuuaaag

SEQ ID NO: 1147734 - RNA, 19 nt, Homo sapiens
ugaagaacaugagaaacug

SEQ ID NO: 1147735 - RNA, 19 nt, Homo sapiens
gcugguagauauguuagga

SEQ ID NO: 1147736 - RNA, 19 nt, Homo sapiens
acacaguucugcugguaga

SEQ ID NO: 1147737 - RNA, 19 nt, Homo sapiens
caacguaugaugaugaaca

SEQ ID NO: 1147738 - RNA, 19 nt, Homo sapiens
guaaaccacaucaccaguu

SEQ ID NO: 1147739 - RNA, 19 nt, Homo sapiens
ccagcuagauugggaugaa

SEQ ID NO: 1147740 - RNA, 19 nt, Homo sapiens
aaagagcaccuggcaauga

SEQ ID NO: 1147741 - RNA, 19 nt, Homo sapiens
ggaagugcaacguaugaug

SEQ ID NO: 1147742 - RNA, 19 nt, Homo sapiens
gcaaaguuguagagugcau

SEQ ID NO: 1147743 - RNA, 19 nt, Homo sapiens
aauagacacuguucaaguc

SEQ ID NO: 1147744 - RNA, 19 nt, Homo sapiens
gaagaggagaucucauagu

SEQ ID NO: 1147745 - RNA, 19 nt, Homo sapiens
gaagagauuacuuaagacu

SEQ ID NO: 1147746 - RNA, 19 nt, Homo sapiens
ggaagucacaagcggaaga

SEQ ID NO: 1147747 - RNA, 19 nt, Homo sapiens
guuagaauaugauccaacu

SEQ ID NO: 1147748 - RNA, 19 nt, Homo sapiens
gaauauuaccuugguuuca

SEQ ID NO: 1147749 - RNA, 19 nt, Homo sapiens
gaucugccagucaauaaau

SEQ ID NO: 1147750 - RNA, 19 nt, Homo sapiens
ugugauugaucuugccuuu

SEQ ID NO: 1147751 - RNA, 19 nt, Homo sapiens
gagaacaggcauuguaaac

SEQ ID NO: 1147752 - RNA, 19 nt, Homo sapiens
gggaaucaguggucuuacu

SEQ ID NO: 1147753 - RNA, 19 nt, Homo sapiens
caauagacacuguucaagu

SEQ ID NO: 1147754 - RNA, 19 nt, Homo sapiens
aaaggaagcgcaauagaca

SEQ ID NO: 1147755 - RNA, 19 nt, Homo sapiens
ccacugcaguaaaucuuca

SEQ ID NO: 1147756 - RNA, 19 nt, Homo sapiens
ggaagaggagaucucauag

SEQ ID NO: 1147757 - RNA, 19 nt, Homo sapiens
aauagugucuuccgaugug

SEQ ID NO: 1147758 - RNA, 19 nt, Homo sapiens
gaagcagcucguucagaaa

SEQ ID NO: 1147759 - RNA, 19 nt, Homo sapiens
ucuaagagcaagauaugaa

SEQ ID NO: 1147760 - RNA, 19 nt, Homo sapiens
ugaccugguucgaagaaug

SEQ ID NO: 1147761 - RNA, 19 nt, Homo sapiens
aaauaguacugaucccaau

SEQ ID NO: 1147762 - RNA, 19 nt, Homo sapiens
guucuaagagcaagauaug

SEQ ID NO: 1147763 - RNA, 19 nt, Homo sapiens
caaaguggagacguucuaa

SEQ ID NO: 1147764 - RNA, 19 nt, Homo sapiens
ucagucaacuaaacauucu

SEQ ID NO: 1147765 - RNA, 19 nt, Homo sapiens
guucgaagaauguuagaau

SEQ ID NO: 1147766 - RNA, 19 nt, Homo sapiens
ugaugaagaacaugagaaa

SEQ ID NO: 1147767 - RNA, 19 nt, Homo sapiens
cagaucugccagucaauaa

SEQ ID NO: 1147768 - RNA, 19 nt, Homo sapiens
gaucuugccuuuuguacau

SEQ ID NO: 1147769 - RNA, 19 nt, Homo sapiens
aaagaauuaccuuggauga

SEQ ID NO: 1147770 - RNA, 19 nt, Homo sapiens
uagaauaugauccaacuca

SEQ ID NO: 1147771 - RNA, 19 nt, Homo sapiens
gaaucaagccucuuucuaa

SEQ ID NO: 1147772 - RNA, 19 nt, Homo sapiens
ggaaagaaauggugcagau

SEQ ID NO: 1147773 - RNA, 19 nt, Homo sapiens
gaacacaagcuacgguauu

SEQ ID NO: 1147774 - RNA, 19 nt, Homo sapiens
caaaagggcugauaguaaa

SEQ ID NO: 1147775 - RNA, 19 nt, Homo sapiens
aagcuacgguauuauguua

SEQ ID NO: 1147776 - RNA, 19 nt, Homo sapiens
gaaagaaauggugcagaua

SEQ ID NO: 1147777 - RNA, 19 nt, Homo sapiens
aaucaagccucuuucuaaa

SEQ ID NO: 1147778 - RNA, 19 nt, Homo sapiens
gcuaacuaaugccacauaa

SEQ ID NO: 1147779 - RNA, 19 nt, Homo sapiens
gguuucaucuacuccaaua

SEQ ID NO: 1147780 - RNA, 19 nt, Homo sapiens
aaagaaauggugcagauaa

SEQ ID NO: 1147781 - RNA, 19 nt, Homo sapiens
cagagagcauggaaagaaa

SEQ ID NO: 1147782 - RNA, 19 nt, Homo sapiens
gcaaaagggcugauaguaa

SEQ ID NO: 1147783 - RNA, 19 nt, Homo sapiens
gguauuauguuaacaccau

SEQ ID NO: 1147784 - RNA, 19 nt, Homo sapiens
aacacaagcuacgguauua

SEQ ID NO: 1147785 - RNA, 19 nt, Homo sapiens
caacagagagcauggaaag

SEQ ID NO: 1147786 - RNA, 19 nt, Homo sapiens
aagaaauggugcagauaaa

SEQ ID NO: 1147787 - RNA, 19 nt, Homo sapiens
ugaagaguccauaaacuuu

SEQ ID NO: 1147788 - RNA, 19 nt, Homo sapiens
aauaguaggugauuacaag

SEQ ID NO: 1147789 - RNA, 19 nt, Homo sapiens
caacaggguuucaucuacu

SEQ ID NO: 1147790 - RNA, 19 nt, Homo sapiens
cagauuucaugcuguuauu

SEQ ID NO: 1147791 - RNA, 19 nt, Homo sapiens
gaagcaaaaucaggaaauu

SEQ ID NO: 1147792 - RNA, 19 nt, Homo sapiens
ccaacaggguuucaucuac

SEQ ID NO: 1147793 - RNA, 19 nt, Homo sapiens
acagagagcauggaaagaa

SEQ ID NO: 1147794 - RNA, 19 nt, Homo sapiens
gggcugauaguaaaccaaa

SEQ ID NO: 1147795 - RNA, 19 nt, Homo sapiens
ugaaucaagccucuuucua

SEQ ID NO: 1147796 - RNA, 19 nt, Homo sapiens
ggaaauuuaagaacacaag

SEQ ID NO: 1147797 - RNA, 19 nt, Homo sapiens
gauuacaaggugcacagua

SEQ ID NO: 1147798 - RNA, 19 nt, Homo sapiens
gaagaguccauaaacuuuu

SEQ ID NO: 1147799 - RNA, 19 nt, Homo sapiens
caagcuacgguauuauguu

SEQ ID NO: 1147800 - RNA, 19 nt, Homo sapiens
agucagauuucaugcuguu

SEQ ID NO: 1147801 - RNA, 19 nt, Homo sapiens
gagagcauggaaagaaaug

SEQ ID NO: 1147802 - RNA, 19 nt, Homo sapiens
gacaacagagagcauggaa

SEQ ID NO: 1147803 - RNA, 19 nt, Homo sapiens
gcuacgguauuauguuaac

SEQ ID NO: 1147804 - RNA, 19 nt, Homo sapiens
cugaagaguccauaaacuu

SEQ ID NO: 1147805 - RNA, 19 nt, Homo sapiens
cgguagcucugugaaauca

SEQ ID NO: 1147806 - RNA, 19 nt, Homo sapiens
aaucugaagaguccauaaa

SEQ ID NO: 1147807 - RNA, 19 nt, Homo sapiens
uaguaaaccaaaccucaaa

SEQ ID NO: 1147808 - RNA, 19 nt, Homo sapiens
cacaagcuacgguauuaug

SEQ ID NO: 1147809 - RNA, 19 nt, Homo sapiens
ucaggaaauuuaagaacac

SEQ ID NO: 1147810 - RNA, 19 nt, Homo sapiens
ggagagggaagcaaaauca

SEQ ID NO: 1147811 - RNA, 19 nt, Homo sapiens
gagcauggaaagaaauggu

SEQ ID NO: 1147812 - RNA, 19 nt, Homo sapiens
ucagauuucaugcuguuau

SEQ ID NO: 1147813 - RNA, 19 nt, Homo sapiens
gcagacaacaggugaaacc

SEQ ID NO: 1147814 - RNA, 19 nt, Homo sapiens
ggcuaacuaaugccacaua

SEQ ID NO: 1147815 - RNA, 19 nt, Homo sapiens
uagcagacaacaggugaaa

SEQ ID NO: 1147816 - RNA, 19 nt, Homo sapiens
cuaacuaaugccacauaaa

SEQ ID NO: 1147817 - RNA, 19 nt, Homo sapiens
caauaguaggugauuacaa

SEQ ID NO: 1147818 - RNA, 19 nt, Homo sapiens
ucugaagaguccauaaacu

SEQ ID NO: 1147819 - RNA, 19 nt, Homo sapiens
caggaaauuuaagaacaca

SEQ ID NO: 1147820 - RNA, 19 nt, Homo sapiens
gaaauggugcagauaaaag

SEQ ID NO: 1147821 - RNA, 19 nt, Homo sapiens
agacaacaggugaaaccaa

SEQ ID NO: 1147822 - RNA, 19 nt, Homo sapiens
aaaccaaaccucaaaagga

SEQ ID NO: 1147823 - RNA, 19 nt, Homo sapiens
caacagaacucucaccaaa

SEQ ID NO: 1147824 - RNA, 19 nt, Homo sapiens
ucaagaacuuucaccagua

SEQ ID NO: 1147825 - RNA, 19 nt, Homo sapiens
uuaagaaccuacuuccuaa

SEQ ID NO: 1147826 - RNA, 19 nt, Homo sapiens
ggccagggaugaauauuug

SEQ ID NO: 1147827 - RNA, 19 nt, Homo sapiens
gagaggagcugggcuaugg

SEQ ID NO: 1147828 - RNA, 19 nt, Homo sapiens
gagcaacuguggccuggaa

SEQ ID NO: 1147829 - RNA, 19 nt, Homo sapiens
gcucaggaauucagugaug

SEQ ID NO: 1147830 - RNA, 19 nt, Homo sapiens
gaugaauauuugagggaua

SEQ ID NO: 1147831 - RNA, 19 nt, Homo sapiens
uguaagagccaaagaauug

SEQ ID NO: 1147832 - RNA, 19 nt, Homo sapiens
uaauggagcugggaauaug

SEQ ID NO: 1147833 - RNA, 19 nt, Homo sapiens
ccucaucucugcaaaguuc

SEQ ID NO: 1147834 - RNA, 19 nt, Homo sapiens
cuggauaucugguacuaaa

SEQ ID NO: 1147835 - RNA, 19 nt, Homo sapiens
gaaccuacuuccuaaucuc

SEQ ID NO: 1147836 - RNA, 19 nt, Homo sapiens
gagcugggcuaugggaaau

SEQ ID NO: 1147837 - RNA, 19 nt, Homo sapiens
aaacuugucuccucuacca

SEQ ID NO: 1147838 - RNA, 19 nt, Homo sapiens
gagaagcggccaagagugu

SEQ ID NO: 1147839 - RNA, 19 nt, Homo sapiens
cagcugcaaugacucuaaa

SEQ ID NO: 1147840 - RNA, 19 nt, Homo sapiens
caagaacuuucaccaguac

SEQ ID NO: 1147841 - RNA, 19 nt, Homo sapiens
gaaugaugguuguuuugua

SEQ ID NO: 1147842 - RNA, 19 nt, Homo sapiens
gagaacucccucuggaauu

SEQ ID NO: 1147843 - RNA, 19 nt, Homo sapiens
acagaacucucaccaaagg

SEQ ID NO: 1147844 - RNA, 19 nt, Homo sapiens
uuuaagaaccuacuuccua

SEQ ID NO: 1147845 - RNA, 19 nt, Homo sapiens
gggccagggaugaauauuu

SEQ ID NO: 1147846 - RNA, 19 nt, Homo sapiens
cagaggaugcucaggaauu

SEQ ID NO: 1147847 - RNA, 19 nt, Homo sapiens
gcugggcuaugggaaauga

SEQ ID NO: 1147848 - RNA, 19 nt, Homo sapiens
gggagaggcugaggagagu

SEQ ID NO: 1147849 - RNA, 19 nt, Homo sapiens
cugggaauauggcuggaua

SEQ ID NO: 1147850 - RNA, 19 nt, Homo sapiens
gcagcugcaaugacucuaa

SEQ ID NO: 1147851 - RNA, 19 nt, Homo sapiens
gacagaaugaugguuguuu

SEQ ID NO: 1147852 - RNA, 19 nt, Homo sapiens
ggagcugggcuaugggaaa

SEQ ID NO: 1147853 - RNA, 19 nt, Homo sapiens
gcugggugcuugggcauug

SEQ ID NO: 1147854 - RNA, 19 nt, Homo sapiens
agaacucccucuggaauuc

SEQ ID NO: 1147855 - RNA, 19 nt, Homo sapiens
gaagcggccaagaguguga

SEQ ID NO: 1147856 - RNA, 19 nt, Homo sapiens
agaggaugcucaggaauuc

SEQ ID NO: 1147857 - RNA, 19 nt, Homo sapiens
gaggagagugugacaugug

SEQ ID NO: 1147858 - RNA, 19 nt, Homo sapiens
ccaaaggaccagacacagu

SEQ ID NO: 1147859 - RNA, 19 nt, Homo sapiens
aauaauggagcugggaaua

SEQ ID NO: 1147860 - RNA, 19 nt, Homo sapiens
cgcagaggaugcucaggaa

SEQ ID NO: 1147861 - RNA, 19 nt, Homo sapiens
gcuugggcauugacagaau

SEQ ID NO: 1147862 - RNA, 19 nt, Homo sapiens
ggcuggauaucugguacua

SEQ ID NO: 1147863 - RNA, 19 nt, Homo sapiens
gaauaauggagcugggaau

SEQ ID NO: 1147864 - RNA, 19 nt, Homo sapiens
ugagaacucccucuggaau

SEQ ID NO: 1147865 - RNA, 19 nt, Homo sapiens
gcaacuguggccuggaaga

SEQ ID NO: 1147866 - RNA, 19 nt, Homo sapiens
guggagagggccauugaga

SEQ ID NO: 1147867 - RNA, 19 nt, Homo sapiens
ccaggucucugugcacucu

SEQ ID NO: 1147868 - RNA, 19 nt, Homo sapiens
acuguggccuggaagagaa

SEQ ID NO: 1147869 - RNA, 19 nt, Homo sapiens
acagaaugaugguuguuuu

SEQ ID NO: 1147870 - RNA, 19 nt, Homo sapiens
guguaagagccaaagaauu

SEQ ID NO: 1147871 - RNA, 19 nt, Homo sapiens
guccucaucucugcaaagu

SEQ ID NO: 1147872 - RNA, 19 nt, Homo sapiens
ugaggagagugugacaugu

SEQ ID NO: 1147873 - RNA, 19 nt, Homo sapiens
gagaggcugaggagagugu

SEQ ID NO: 1147874 - RNA, 19 nt, Homo sapiens
caccaaaggaccagacaca

SEQ ID NO: 1147875 - RNA, 19 nt, Homo sapiens
uaggacaacagaacucuca

SEQ ID NO: 1147876 - RNA, 19 nt, Homo sapiens
cugugggccuggagauaaa

SEQ ID NO: 1147877 - RNA, 19 nt, Homo sapiens
gcagaggaugcucaggaau

SEQ ID NO: 1147878 - RNA, 19 nt, Homo sapiens
agaaccuacuuccuaaucu

SEQ ID NO: 1147879 - RNA, 19 nt, Homo sapiens
ccagcuauaggacaacaga

SEQ ID NO: 1147880 - RNA, 19 nt, Homo sapiens
gcugaccccuucugagcua

SEQ ID NO: 1147881 - RNA, 19 nt, Homo sapiens
guugggccagggaugaaua

SEQ ID NO: 1147882 - RNA, 19 nt, Homo sapiens
gugcuugggcauugacaga

SEQ ID NO: 1147883 - RNA, 19 nt, Homo sapiens
ccuaaucucuuccccaauc

SEQ ID NO: 1147884 - RNA, 19 nt, Homo sapiens
ccuacuuccuaaucucuuc

SEQ ID NO: 1147885 - RNA, 19 nt, Homo sapiens
gccugcaccuguccucauc

SEQ ID NO: 1147886 - RNA, 19 nt, Homo sapiens
gacugugggccuggagaua

SEQ ID NO: 1147887 - RNA, 19 nt, Homo sapiens
uaaauaagcucucaugauc

SEQ ID NO: 1147888 - RNA, 19 nt, Homo sapiens
ggauacagcuggacaagaa

SEQ ID NO: 1147889 - RNA, 19 nt, Homo sapiens
guagguaaaucgaguauug

SEQ ID NO: 1147890 - RNA, 19 nt, Homo sapiens
ugaagaaggugguauaaau

SEQ ID NO: 1147891 - RNA, 19 nt, Homo sapiens
uaaagaaucucuaguguac

SEQ ID NO: 1147892 - RNA, 19 nt, Homo sapiens
gaagaagaguggaagugaa

SEQ ID NO: 1147893 - RNA, 19 nt, Homo sapiens
cagcauggcccaccuaaua

SEQ ID NO: 1147894 - RNA, 19 nt, Homo sapiens
aaacagaccuuguggagau

SEQ ID NO: 1147895 - RNA, 19 nt, Homo sapiens
ucacagaaauggaccaguu

SEQ ID NO: 1147896 - RNA, 19 nt, Homo sapiens
ggacuacgccgacucuauu

SEQ ID NO: 1147897 - RNA, 19 nt, Homo sapiens
ggauuaaguuguugaguag

SEQ ID NO: 1147898 - RNA, 19 nt, Homo sapiens
aaacaucaacccaacaaua

SEQ ID NO: 1147899 - RNA, 19 nt, Homo sapiens
gaagaaggugguauaaaug

SEQ ID NO: 1147900 - RNA, 19 nt, Homo sapiens
guaaagaaucucuagugua

SEQ ID NO: 1147901 - RNA, 19 nt, Homo sapiens
ugaaguaggugguccugaa

SEQ ID NO: 1147902 - RNA, 19 nt, Homo sapiens
ggauacguacaguaaauua

SEQ ID NO: 1147903 - RNA, 19 nt, Homo sapiens
gaagaauuccauccacuga

SEQ ID NO: 1147904 - RNA, 19 nt, Homo sapiens
gagaagucauggagagaga

SEQ ID NO: 1147905 - RNA, 19 nt, Homo sapiens
ggaagaagaguggaaguga

SEQ ID NO: 1147906 - RNA, 19 nt, Homo sapiens
agagggaguuguaucaauu

SEQ ID NO: 1147907 - RNA, 19 nt, Homo sapiens
gaaauggaccaguucuguu

SEQ ID NO: 1147908 - RNA, 19 nt, Homo sapiens
gaagagacauuuucaacau

SEQ ID NO: 1147909 - RNA, 19 nt, Homo sapiens
uagagaagcugcccggaau

SEQ ID NO: 1147910 - RNA, 19 nt, Homo sapiens
aggauuaaguuguugagua

SEQ ID NO: 1147911 - RNA, 19 nt, Homo sapiens
aauaagcucucaugaucaa

SEQ ID NO: 1147912 - RNA, 19 nt, Homo sapiens
ggaguuguaucaauuuaac

SEQ ID NO: 1147913 - RNA, 19 nt, Homo sapiens
gagaagcugcccggaauaa

SEQ ID NO: 1147914 - RNA, 19 nt, Homo sapiens
gaaagagcuucgacagcau

SEQ ID NO: 1147915 - RNA, 19 nt, Homo sapiens
gaaaagcaaguaucuauug

SEQ ID NO: 1147916 - RNA, 19 nt, Homo sapiens
ucugugaacuucuauuaug

SEQ ID NO: 1147917 - RNA, 19 nt, Homo sapiens
gaccaguucuguucuccaa

SEQ ID NO: 1147918 - RNA, 19 nt, Homo sapiens
aaugugaucuuaucgaugu

SEQ ID NO: 1147919 - RNA, 19 nt, Homo sapiens
aagaaucucuaguguacaa

SEQ ID NO: 1147920 - RNA, 19 nt, Homo sapiens
gaaguaggugguccugaaa

SEQ ID NO: 1147921 - RNA, 19 nt, Homo sapiens
uaggauacguacaguaaau

SEQ ID NO: 1147922 - RNA, 19 nt, Homo sapiens
ggacuacaucguuggcuuu

SEQ ID NO: 1147923 - RNA, 19 nt, Homo sapiens
uaggugguccugaaaguua

SEQ ID NO: 1147924 - RNA, 19 nt, Homo sapiens
aaggauaguuuaaguguag

SEQ ID NO: 1147925 - RNA, 19 nt, Homo sapiens
guaaggauaguuuaagugu

SEQ ID NO: 1147926 - RNA, 19 nt, Homo sapiens
gaagaguggaagugaagaa

SEQ ID NO: 1147927 - RNA, 19 nt, Homo sapiens
cugcagcuauaaucguuua

SEQ ID NO: 1147928 - RNA, 19 nt, Homo sapiens
uagccagucuugagucuug

SEQ ID NO: 1147929 - RNA, 19 nt, Homo sapiens
uaaagaauugggugaaaga

SEQ ID NO: 1147930 - RNA, 19 nt, Homo sapiens
ccuaggauacguacaguaa

SEQ ID NO: 1147931 - RNA, 19 nt, Homo sapiens
ucucagacuugaugaugaa

SEQ ID NO: 1147932 - RNA, 19 nt, Homo sapiens
uguaaagaaucucuagugu

SEQ ID NO: 1147933 - RNA, 19 nt, Homo sapiens
uuauaggacugauggaaau

SEQ ID NO: 1147934 - RNA, 19 nt, Homo sapiens
acaaagggacuacaucguu

SEQ ID NO: 1147935 - RNA, 19 nt, Homo sapiens
aaagacugcagcaaugaua

SEQ ID NO: 1147936 - RNA, 19 nt, Homo sapiens
ugagcuacauaaauuccua

SEQ ID NO: 1147937 - RNA, 19 nt, Homo sapiens
cuuagcauauguaaaguug

SEQ ID NO: 1147938 - RNA, 19 nt, Homo sapiens
gaguggaagugaagaaggu

SEQ ID NO: 1147939 - RNA, 19 nt, Homo sapiens
ucaagauggugaugguaga

SEQ ID NO: 1147940 - RNA, 19 nt, Homo sapiens
gaacauguuagccuaggau

SEQ ID NO: 1147941 - RNA, 19 nt, Homo sapiens
ccucucccuucucaacuua

SEQ ID NO: 1147942 - RNA, 19 nt, Homo sapiens
gagggaguuguaucaauuu

SEQ ID NO: 1147943 - RNA, 19 nt, Homo sapiens
gcacuuuugugguucuuaa

SEQ ID NO: 1147944 - RNA, 19 nt, Homo sapiens
uagagggaguuguaucaau

SEQ ID NO: 1147945 - RNA, 19 nt, Homo sapiens
gcauggcccaccuaauauu

SEQ ID NO: 1147946 - RNA, 19 nt, Homo sapiens
gaccuuguggagauuauaa

SEQ ID NO: 1147947 - RNA, 19 nt, Homo sapiens
gaugguaggauuaaguugu

SEQ ID NO: 1147948 - RNA, 19 nt, Homo sapiens
uccaaagacugcagcaaug

SEQ ID NO: 1147949 - RNA, 19 nt, Homo sapiens
ccaaacaucaacccaacaa

SEQ ID NO: 1147950 - RNA, 19 nt, Homo sapiens
gaagcugcccggaauaaac

SEQ ID NO: 1147951 - RNA, 19 nt, Homo sapiens
cugcagcaaugauauuuca

SEQ ID NO: 1147952 - RNA, 19 nt, Homo sapiens
ccaaagacugcagcaauga

SEQ ID NO: 1147953 - RNA, 19 nt, Homo sapiens
ccaguucuguucuccaaag

SEQ ID NO: 1147954 - RNA, 19 nt, Homo sapiens
gcgauaaacauaaaugaac

SEQ ID NO: 1147955 - RNA, 19 nt, Homo sapiens
cgacucuauucaugcaauu

SEQ ID NO: 1147956 - RNA, 19 nt, Homo sapiens
ugguauaaaugcugucaau

SEQ ID NO: 1147957 - RNA, 19 nt, Homo sapiens
uaauuuccuugguuucugu

SEQ ID NO: 1147958 - RNA, 19 nt, Homo sapiens
gggaguuguaucaauuuaa

SEQ ID NO: 1147959 - RNA, 19 nt, Homo sapiens
agggaguuguaucaauuua

SEQ ID NO: 1147960 - RNA, 19 nt, Homo sapiens
uggcccaccuaauauugua

SEQ ID NO: 1147961 - RNA, 19 nt, Homo sapiens
gaagacaguuuugauccaa

SEQ ID NO: 1147962 - RNA, 19 nt, Homo sapiens
ggcugcagcuauaaucguu

SEQ ID NO: 1147963 - RNA, 19 nt, Homo sapiens
gaaaagaaacagaccuugu

SEQ ID NO: 1147964 - RNA, 19 nt, Homo sapiens
gaagucauggagagagaug

SEQ ID NO: 1147965 - RNA, 19 nt, Homo sapiens
gacuagcaaugguuuaaaa

SEQ ID NO: 1147966 - RNA, 19 nt, Homo sapiens
cuacaucguuggcuuuuga

SEQ ID NO: 1147967 - RNA, 19 nt, Homo sapiens
agucugugaacuucuauua

SEQ ID NO: 1147968 - RNA, 19 nt, Homo sapiens
gggaaaagcaaguaucuau

SEQ ID NO: 1147969 - RNA, 19 nt, Homo sapiens
acacguuauuggcaccuuu

SEQ ID NO: 1147970 - RNA, 19 nt, Homo sapiens
ucaugugugugccaccaaa

SEQ ID NO: 1147971 - RNA, 19 nt, Homo sapiens
uuaaagaauugggugaaag

SEQ ID NO: 1147972 - RNA, 19 nt, Homo sapiens
gagcuacauaaauuccuaa

SEQ ID NO: 1147973 - RNA, 19 nt, Homo sapiens
gugaagaaggugguauaaa

SEQ ID NO: 1147974 - RNA, 19 nt, Homo sapiens
ggaagugaagaagguggua

SEQ ID NO: 1147975 - RNA, 19 nt, Homo sapiens
gauuucaucucugccaucu

SEQ ID NO: 1147976 - RNA, 19 nt, Homo sapiens
guuagagggaguuguauca

SEQ ID NO: 1147977 - RNA, 19 nt, Homo sapiens
caaugauauuucagucugu

SEQ ID NO: 1147978 - RNA, 19 nt, Homo sapiens
gcagcaaugauauuucagu

SEQ ID NO: 1147979 - RNA, 19 nt, Homo sapiens
agagagaugcaaaggacua

SEQ ID NO: 1147980 - RNA, 19 nt, Homo sapiens
agggucggcugcagcuaua

SEQ ID NO: 1147981 - RNA, 19 nt, Homo sapiens
gagggucggcugcagcuau

SEQ ID NO: 1147982 - RNA, 19 nt, Homo sapiens
uuucaucucugccaucucu

SEQ ID NO: 1147983 - RNA, 19 nt, Homo sapiens
guauggaugguaggauuaa

SEQ ID NO: 1147984 - RNA, 19 nt, Homo sapiens
ggaaaagcaaguaucuauu

SEQ ID NO: 1147985 - RNA, 19 nt, Homo sapiens
gaagugaagaaggugguau

SEQ ID NO: 1147986 - RNA, 19 nt, Homo sapiens
uaagcucucaugaucaaga

SEQ ID NO: 1147987 - RNA, 19 nt, Homo sapiens
gaacuucagucaacauauu

SEQ ID NO: 1147988 - RNA, 19 nt, Homo sapiens
gagagacccucguccuuua

SEQ ID NO: 1147989 - RNA, 19 nt, Homo sapiens
cagacaagcugcaggaauu

SEQ ID NO: 1147990 - RNA, 19 nt, Homo sapiens
gaguugagguuugcauaua

SEQ ID NO: 1147991 - RNA, 19 nt, Homo sapiens
gaaaucgugugcaccgaaa

SEQ ID NO: 1147992 - RNA, 19 nt, Homo sapiens
ggaagaagcuuggaucacu

SEQ ID NO: 1147993 - RNA, 19 nt, Homo sapiens
gcagaaccauguuggacuu

SEQ ID NO: 1147994 - RNA, 19 nt, Homo sapiens
ccacaguacuucuuagugu

SEQ ID NO: 1147995 - RNA, 19 nt, Homo sapiens
aaaccaugcugaagucauu

SEQ ID NO: 1147996 - RNA, 19 nt, Homo sapiens
aaaccaguaucacuuugua

SEQ ID NO: 1147997 - RNA, 19 nt, Homo sapiens
guaguacauuugaagauga

SEQ ID NO: 1147998 - RNA, 19 nt, Homo sapiens
cagcauaucaaucccaaua

SEQ ID NO: 1147999 - RNA, 19 nt, Homo sapiens
ucgguuugaugaugaauua

SEQ ID NO: 1148000 - RNA, 19 nt, Homo sapiens
gagcacuacuaacuccuaa

SEQ ID NO: 1148001 - RNA, 19 nt, Homo sapiens
guacacauuugacuuacug

SEQ ID NO: 1148002 - RNA, 19 nt, Homo sapiens
acuacuaacuccuaacuuu

SEQ ID NO: 1148003 - RNA, 19 nt, Homo sapiens
gcucagauauugucagcau

SEQ ID NO: 1148004 - RNA, 19 nt, Homo sapiens
gcauaucaaucccaauaag

SEQ ID NO: 1148005 - RNA, 19 nt, Homo sapiens
gacagguuauugaaacaaa

SEQ ID NO: 1148006 - RNA, 19 nt, Homo sapiens
caacagauccuagaagaca

SEQ ID NO: 1148007 - RNA, 19 nt, Homo sapiens
gguaguacauuugaagaug

SEQ ID NO: 1148008 - RNA, 19 nt, Homo sapiens
gcaggaauuccagggauua

SEQ ID NO: 1148009 - RNA, 19 nt, Homo sapiens
gggcauauucugucugaaa

SEQ ID NO: 1148010 - RNA, 19 nt, Homo sapiens
gaagagacugcaccuacuu

SEQ ID NO: 1148011 - RNA, 19 nt, Homo sapiens
guacuucaggauccuaaua

SEQ ID NO: 1148012 - RNA, 19 nt, Homo sapiens
aacaaaguaugaacuggua

SEQ ID NO: 1148013 - RNA, 19 nt, Homo sapiens
ccagaucgguuugaugaug

SEQ ID NO: 1148014 - RNA, 19 nt, Homo sapiens
ccuagaagacaguaugaua

SEQ ID NO: 1148015 - RNA, 19 nt, Homo sapiens
gcgggcauauucugucuga

SEQ ID NO: 1148016 - RNA, 19 nt, Homo sapiens
gaacugguaacaucaucaa

SEQ ID NO: 1148017 - RNA, 19 nt, Homo sapiens
ccuaaagcuuucagaagaa

SEQ ID NO: 1148018 - RNA, 19 nt, Homo sapiens
uaacuuugcccuccuccua

SEQ ID NO: 1148019 - RNA, 19 nt, Homo sapiens
ccaguaucacuuuguaaua

SEQ ID NO: 1148020 - RNA, 19 nt, Homo sapiens
guacugaagcagcauauca

SEQ ID NO: 1148021 - RNA, 19 nt, Homo sapiens
uugcaugaguuccugguua

SEQ ID NO: 1148022 - RNA, 19 nt, Homo sapiens
uccuaaagcuuucagaaga

SEQ ID NO: 1148023 - RNA, 19 nt, Homo sapiens
cacaguacuucuuagugua

SEQ ID NO: 1148024 - RNA, 19 nt, Homo sapiens
cagaucgguuugaugauga

SEQ ID NO: 1148025 - RNA, 19 nt, Homo sapiens
ggagggacagguuauugaa

SEQ ID NO: 1148026 - RNA, 19 nt, Homo sapiens
aguaugaacugguaacauc

SEQ ID NO: 1148027 - RNA, 19 nt, Homo sapiens
ggcauauucugucugaaau

SEQ ID NO: 1148028 - RNA, 19 nt, Homo sapiens
gcccacacgcuaugccuua

SEQ ID NO: 1148029 - RNA, 19 nt, Homo sapiens
guaccugggcaaucuguuu

SEQ ID NO: 1148030 - RNA, 19 nt, Homo sapiens
gaaccuuaaugaccaacag

SEQ ID NO: 1148031 - RNA, 19 nt, Homo sapiens
gaaaaccacaugaggaaaa

SEQ ID NO: 1148032 - RNA, 19 nt, Homo sapiens
gaaaauggugugacugauu

SEQ ID NO: 1148033 - RNA, 19 nt, Homo sapiens
aaccaccucugaagaaguu

SEQ ID NO: 1148034 - RNA, 19 nt, Homo sapiens
augaguuccugguuaauuu

SEQ ID NO: 1148035 - RNA, 19 nt, Homo sapiens
ugcaugaguuccugguuaa

SEQ ID NO: 1148036 - RNA, 19 nt, Homo sapiens
cuagaagacaguaugauau

SEQ ID NO: 1148037 - RNA, 19 nt, Homo sapiens
caugcugaagucauuauua

SEQ ID NO: 1148038 - RNA, 19 nt, Homo sapiens
acaggaguguccagaguug

SEQ ID NO: 1148039 - RNA, 19 nt, Homo sapiens
ucuggccaguugcauaaua

SEQ ID NO: 1148040 - RNA, 19 nt, Homo sapiens
caacuggagucuguuuuaa

SEQ ID NO: 1148041 - RNA, 19 nt, Homo sapiens
gcaacuggagucuguuuua

SEQ ID NO: 1148042 - RNA, 19 nt, Homo sapiens
ucaugcaacuggagucugu

SEQ ID NO: 1148043 - RNA, 19 nt, Homo sapiens
ggauuacuccaacugaaga

SEQ ID NO: 1148044 - RNA, 19 nt, Homo sapiens
guugagguuugcauauaug

SEQ ID NO: 1148045 - RNA, 19 nt, Homo sapiens
acacaaguuugauccagau

SEQ ID NO: 1148046 - RNA, 19 nt, Homo sapiens
gauccuagaagacaguaug

SEQ ID NO: 1148047 - RNA, 19 nt, Homo sapiens
gaggaaaacaaccauuuaa

SEQ ID NO: 1148048 - RNA, 19 nt, Homo sapiens
gagggacagguuauugaaa

SEQ ID NO: 1148049 - RNA, 19 nt, Homo sapiens
ggccaucuccacacaaguu

SEQ ID NO: 1148050 - RNA, 19 nt, Homo sapiens
accaacagauccuagaaga

SEQ ID NO: 1148051 - RNA, 19 nt, Homo sapiens
uuugggcacuguugaugua

SEQ ID NO: 1148052 - RNA, 19 nt, Homo sapiens
guggaaguuugcaugaguu

SEQ ID NO: 1148053 - RNA, 19 nt, Homo sapiens
agagagacccucguccuuu

SEQ ID NO: 1148054 - RNA, 19 nt, Homo sapiens
cuaaagcuuucagaagaau

SEQ ID NO: 1148055 - RNA, 19 nt, Homo sapiens
ggacagguuauugaaacaa

SEQ ID NO: 1148056 - RNA, 19 nt, Homo sapiens
gggacagguuauugaaaca

SEQ ID NO: 1148057 - RNA, 19 nt, Homo sapiens
ugaagagacugcaccuacu

SEQ ID NO: 1148058 - RNA, 19 nt, Homo sapiens
gcaugugcuuugugaaacu

SEQ ID NO: 1148059 - RNA, 19 nt, Homo sapiens
cauaucaaucccaauaaga

SEQ ID NO: 1148060 - RNA, 19 nt, Homo sapiens
ggaucacugucucaaagag

SEQ ID NO: 1148061 - RNA, 19 nt, Homo sapiens
gcacuacuaacuccuaacu

SEQ ID NO: 1148062 - RNA, 19 nt, Homo sapiens
ggcgauccauugcucuuuc

SEQ ID NO: 1148063 - RNA, 19 nt, Homo sapiens
cacuuucuaugccauuauu

SEQ ID NO: 1148064 - RNA, 19 nt, Homo sapiens
aaugggaaacuuuagcuuu

SEQ ID NO: 1148065 - RNA, 19 nt, Homo sapiens
ugaaacaaaguaugaacug

SEQ ID NO: 1148066 - RNA, 19 nt, Homo sapiens
gugaccacaguacuucuua

SEQ ID NO: 1148067 - RNA, 19 nt, Homo sapiens
ggaaaugguccuguuacuc

SEQ ID NO: 1148068 - RNA, 19 nt, Homo sapiens
cuggccaguugcauaauaa

SEQ ID NO: 1148069 - RNA, 19 nt, Homo sapiens
uuucauugacuccuuagua

SEQ ID NO: 1148070 - RNA, 19 nt, Homo sapiens
gcugaagucauuauuaagg

SEQ ID NO: 1148071 - RNA, 19 nt, Homo sapiens
gcacaguauauugaucauu

SEQ ID NO: 1148072 - RNA, 19 nt, Homo sapiens
gacugcaccuacuuucugu

SEQ ID NO: 1148073 - RNA, 19 nt, Homo sapiens
cacacgcuaugccuuaaau

SEQ ID NO: 1148074 - RNA, 19 nt, Homo sapiens
gcuccucggcgauccauug

SEQ ID NO: 1148075 - RNA, 19 nt, Homo sapiens
ggaacuucagucaacauau

SEQ ID NO: 1148076 - RNA, 19 nt, Homo sapiens
ggaauuccagggauuacuc

SEQ ID NO: 1148077 - RNA, 19 nt, Homo sapiens
cagaguugagguuugcaua

SEQ ID NO: 1148078 - RNA, 19 nt, Homo sapiens
augaagagauaaaccaagu

SEQ ID NO: 1148079 - RNA, 19 nt, Homo sapiens
caugaguuccugguuaauu

SEQ ID NO: 1148080 - RNA, 19 nt, Homo sapiens
auaaaccaguaucacuuug

SEQ ID NO: 1148081 - RNA, 19 nt, Homo sapiens
caucuccacacaaguuuga

SEQ ID NO: 1148082 - RNA, 19 nt, Homo sapiens
gaagaugaucaggaaguca

SEQ ID NO: 1148083 - RNA, 19 nt, Homo sapiens
gcccuccuccuaaagcuuu

SEQ ID NO: 1148084 - RNA, 19 nt, Homo sapiens
gaaaccaugcugaagucau

SEQ ID NO: 1148085 - RNA, 19 nt, Homo sapiens
gauguacugaagcagcaua

SEQ ID NO: 1148086 - RNA, 19 nt, Homo sapiens
gggcacuguugauguacug

SEQ ID NO: 1148087 - RNA, 19 nt, Homo sapiens
ggugagaaauugcaguuua

SEQ ID NO: 1148088 - RNA, 19 nt, Homo sapiens
uaaggaagaccaacaauuu

SEQ ID NO: 1148089 - RNA, 19 nt, Homo sapiens
ucacuaauauugacccuaa

SEQ ID NO: 1148090 - RNA, 19 nt, Homo sapiens
cuacaaggauuccaucaaa

SEQ ID NO: 1148091 - RNA, 19 nt, Homo sapiens
gagaauaugugguguuugg

SEQ ID NO: 1148092 - RNA, 19 nt, Homo sapiens
guauacaugugccauauug

SEQ ID NO: 1148093 - RNA, 19 nt, Homo sapiens
guauaaagaucgacuugga

SEQ ID NO: 1148094 - RNA, 19 nt, Homo sapiens
aaagcugucugugaaauua

SEQ ID NO: 1148095 - RNA, 19 nt, Homo sapiens
gaagcauuguccuacauaa

SEQ ID NO: 1148096 - RNA, 19 nt, Homo sapiens
ggaagaagaacgaaugguu

SEQ ID NO: 1148097 - RNA, 19 nt, Homo sapiens
cugccacgguuuauaauua

SEQ ID NO: 1148098 - RNA, 19 nt, Homo sapiens
gcagguuuguuacauaugu

SEQ ID NO: 1148099 - RNA, 19 nt, Homo sapiens
agagauaccuacaaggauu

SEQ ID NO: 1148100 - RNA, 19 nt, Homo sapiens
uagcagaauuucaagagaa

SEQ ID NO: 1148101 - RNA, 19 nt, Homo sapiens
gaaaucugcagacuuguau

SEQ ID NO: 1148102 - RNA, 19 nt, Homo sapiens
gaaguacugacugcaaaua

SEQ ID NO: 1148103 - RNA, 19 nt, Homo sapiens
gugagaauaugugguguuu

SEQ ID NO: 1148104 - RNA, 19 nt, Homo sapiens
gcaagggacuaugaagugu

SEQ ID NO: 1148105 - RNA, 19 nt, Homo sapiens
uaagagauaccuacaagga

SEQ ID NO: 1148106 - RNA, 19 nt, Homo sapiens
gaaugaugguuuccagcuu

SEQ ID NO: 1148107 - RNA, 19 nt, Homo sapiens
guaaggaagaccaacaauu

SEQ ID NO: 1148108 - RNA, 19 nt, Homo sapiens
gugagaaauugcaguuuau

SEQ ID NO: 1148109 - RNA, 19 nt, Homo sapiens
gaauagugccgaaauaaac

SEQ ID NO: 1148110 - RNA, 19 nt, Homo sapiens
ccugagagcccauuuaugu

SEQ ID NO: 1148111 - RNA, 19 nt, Homo sapiens
cccauuaacucgucauuuc

SEQ ID NO: 1148112 - RNA, 19 nt, Homo sapiens
ugagagcccauuuauguuu

SEQ ID NO: 1148113 - RNA, 19 nt, Homo sapiens
uaucauuguuggacauuug

SEQ ID NO: 1148114 - RNA, 19 nt, Homo sapiens
gauaguuugcugagaauga

SEQ ID NO: 1148115 - RNA, 19 nt, Homo sapiens
gugcagguuuguuacauau

SEQ ID NO: 1148116 - RNA, 19 nt, Homo sapiens
gaagaacgaaugguugaga

SEQ ID NO: 1148117 - RNA, 19 nt, Homo sapiens
cugcagacuuguauaaaga

SEQ ID NO: 1148118 - RNA, 19 nt, Homo sapiens
ugaaaaggcugcagaaauc

SEQ ID NO: 1148119 - RNA, 19 nt, Homo sapiens
ugugaauagugccgaaaua

SEQ ID NO: 1148120 - RNA, 19 nt, Homo sapiens
gaauaugugguguuugguu

SEQ ID NO: 1148121 - RNA, 19 nt, Homo sapiens
guauaucuccuaaugcuau

SEQ ID NO: 1148122 - RNA, 19 nt, Homo sapiens
guugagauguuucuggaau

SEQ ID NO: 1148123 - RNA, 19 nt, Homo sapiens
gaacgaaugguugagaugu

SEQ ID NO: 1148124 - RNA, 19 nt, Homo sapiens
aauaugugguguuugguuu

SEQ ID NO: 1148125 - RNA, 19 nt, Homo sapiens
ucagauggcgggacuaaga

SEQ ID NO: 1148126 - RNA, 19 nt, Homo sapiens
ugaauagugccgaaauaaa

SEQ ID NO: 1148127 - RNA, 19 nt, Homo sapiens
gugaauagugccgaaauaa

SEQ ID NO: 1148128 - RNA, 19 nt, Homo sapiens
uuacugccacgguuuauaa

SEQ ID NO: 1148129 - RNA, 19 nt, Homo sapiens
caagagaauguaaggaaga

SEQ ID NO: 1148130 - RNA, 19 nt, Homo sapiens
gaaaagcugucugugaaau

SEQ ID NO: 1148131 - RNA, 19 nt, Homo sapiens
uuaauccagucuaucauug

SEQ ID NO: 1148132 - RNA, 19 nt, Homo sapiens
gaacuggcacuuuucgaua

SEQ ID NO: 1148133 - RNA, 19 nt, Homo sapiens
ugagauguuucuggaauau

SEQ ID NO: 1148134 - RNA, 19 nt, Homo sapiens
ccaagucuuugcuauugug

SEQ ID NO: 1148135 - RNA, 19 nt, Homo sapiens
aguauuccaugguguauau

SEQ ID NO: 1148136 - RNA, 19 nt, Homo sapiens
uggaaguacugacugcaaa

SEQ ID NO: 1148137 - RNA, 19 nt, Homo sapiens
ggacuaagagauaccuaca

SEQ ID NO: 1148138 - RNA, 19 nt, Homo sapiens
gcgaagcauuguccuacau

SEQ ID NO: 1148139 - RNA, 19 nt, Homo sapiens
ugccacgguuuauaauuaa

SEQ ID NO: 1148140 - RNA, 19 nt, Homo sapiens
cgacuuggacuagaaauuc

SEQ ID NO: 1148141 - RNA, 19 nt, Homo sapiens
ccaccuaggagugagaaua

SEQ ID NO: 1148142 - RNA, 19 nt, Homo sapiens
cgaagcauuguccuacaua

SEQ ID NO: 1148143 - RNA, 19 nt, Homo sapiens
aaaggaagaagaacgaaug

SEQ ID NO: 1148144 - RNA, 19 nt, Homo sapiens
guccauguguucucauugu

SEQ ID NO: 1148145 - RNA, 19 nt, Homo sapiens
cauaguauuccauggugua

SEQ ID NO: 1148146 - RNA, 19 nt, Homo sapiens
acuaagagauaccuacaag

SEQ ID NO: 1148147 - RNA, 19 nt, Homo sapiens
ccaauguucggaaagcuuu

SEQ ID NO: 1148148 - RNA, 19 nt, Homo sapiens
gggccuagcagaauuucaa

SEQ ID NO: 1148149 - RNA, 19 nt, Homo sapiens
gcagacuuguauaaagauc

SEQ ID NO: 1148150 - RNA, 19 nt, Homo sapiens
agaaaucugcagacuugua

SEQ ID NO: 1148151 - RNA, 19 nt, Homo sapiens
aaucagaucagcaggcaaa

SEQ ID NO: 1148152 - RNA, 19 nt, Homo sapiens
agauguuucuggaauauca

SEQ ID NO: 1148153 - RNA, 19 nt, Homo sapiens
acgaaugguugagauguuu

SEQ ID NO: 1148154 - RNA, 19 nt, Homo sapiens
gacuaugaagugucagaua

SEQ ID NO: 1148155 - RNA, 19 nt, Homo sapiens
cuaggaagaaggaaacuau

SEQ ID NO: 1148156 - RNA, 19 nt, Homo sapiens
gugugcaugugucuuuaaa

SEQ ID NO: 1148157 - RNA, 19 nt, Homo sapiens
cgucauuucauuagguaua

SEQ ID NO: 1148158 - RNA, 19 nt, Homo sapiens
ugugcagguuuguuacaua

SEQ ID NO: 1148159 - RNA, 19 nt, Homo sapiens
ggaauuggaaguacugacu

SEQ ID NO: 1148160 - RNA, 19 nt, Homo sapiens
cauguguucucauuguuca

SEQ ID NO: 1148161 - RNA, 19 nt, Homo sapiens
uaacucgucauuucauuag

SEQ ID NO: 1148162 - RNA, 19 nt, Homo sapiens
gaucgacuuggacuagaaa

SEQ ID NO: 1148163 - RNA, 19 nt, Homo sapiens
uuccaagucuuugcuauug

SEQ ID NO: 1148164 - RNA, 19 nt, Homo sapiens
ucauccauguuccuacaaa

SEQ ID NO: 1148165 - RNA, 19 nt, Homo sapiens
cuagcagaauuucaagaga

SEQ ID NO: 1148166 - RNA, 19 nt, Homo sapiens
aaucugcagacuuguauaa

SEQ ID NO: 1148167 - RNA, 19 nt, Homo sapiens
aggaagaaggaaacuauuu

SEQ ID NO: 1148168 - RNA, 19 nt, Homo sapiens
ggaaguacugacugcaaau

SEQ ID NO: 1148169 - RNA, 19 nt, Homo sapiens
cagaucagcaggcaaaaua

SEQ ID NO: 1148170 - RNA, 19 nt, Homo sapiens
uugagauguuucuggaaua

SEQ ID NO: 1148171 - RNA, 19 nt, Homo sapiens
cuacaaaggacaugaacuc

SEQ ID NO: 1148172 - RNA, 19 nt, Homo sapiens
gaagcaagggacuaugaag

SEQ ID NO: 1148173 - RNA, 19 nt, Homo sapiens
gagagcccauuuauguuuu

SEQ ID NO: 1148174 - RNA, 19 nt, Homo sapiens
aauccagucuaucauuguu

SEQ ID NO: 1148175 - RNA, 19 nt, Homo sapiens
aagaagaacgaaugguuga

SEQ ID NO: 1148176 - RNA, 19 nt, Homo sapiens
caaaauaagcucauucaag

SEQ ID NO: 1148177 - RNA, 19 nt, Homo sapiens
aggauuccaucaaagcauu

SEQ ID NO: 1148178 - RNA, 19 nt, Homo sapiens
guucaauucccaccuagga

SEQ ID NO: 1148179 - RNA, 19 nt, Homo sapiens
uaugaagugucagauagug

SEQ ID NO: 1148180 - RNA, 19 nt, Homo sapiens
caccuaggagugagaauau

SEQ ID NO: 1148181 - RNA, 19 nt, Homo sapiens
caaugaagcaagggacuau

SEQ ID NO: 1148182 - RNA, 19 nt, Homo sapiens
gcaggaauuggaaguacug

SEQ ID NO: 1148183 - RNA, 19 nt, Homo sapiens
uuccuuacaucucaaugaa

SEQ ID NO: 1148184 - RNA, 19 nt, Homo sapiens
agacuuguauaaagaucga

SEQ ID NO: 1148185 - RNA, 19 nt, Homo sapiens
gaaugcagagagguugaaa

SEQ ID NO: 1148186 - RNA, 19 nt, Homo sapiens
agucuuugcuauugugaau

SEQ ID NO: 1148187 - RNA, 19 nt, Homo sapiens
uaagaacccuuggauguaa

SEQ ID NO: 1148188 - RNA, 19 nt, Homo sapiens
gaagacagccaagcucaua

SEQ ID NO: 1148189 - RNA, 19 nt, Homo sapiens
ugaauucugugaagaguaa

SEQ ID NO: 1148190 - RNA, 19 nt, Homo sapiens
guacucaacugacaaucaa

SEQ ID NO: 1148191 - RNA, 19 nt, Homo sapiens
caaagaaccugcacuuggu

SEQ ID NO: 1148192 - RNA, 19 nt, Homo sapiens
gauacucucuccaucagaa

SEQ ID NO: 1148193 - RNA, 19 nt, Homo sapiens
ugaggaagcccgucccuua

SEQ ID NO: 1148194 - RNA, 19 nt, Homo sapiens
gaagaguaaugugauugaa

SEQ ID NO: 1148195 - RNA, 19 nt, Homo sapiens
cagaagagaugagugaaau

SEQ ID NO: 1148196 - RNA, 19 nt, Homo sapiens
ucaaguuccuuccaaagaa

SEQ ID NO: 1148197 - RNA, 19 nt, Homo sapiens
gcacugauaagaaucuauu

SEQ ID NO: 1148198 - RNA, 19 nt, Homo sapiens
gcugaacccuguuguuuag

SEQ ID NO: 1148199 - RNA, 19 nt, Homo sapiens
ccacagcagucgcagaaug

SEQ ID NO: 1148200 - RNA, 19 nt, Homo sapiens
gcgaaaaccuccaagauau

SEQ ID NO: 1148201 - RNA, 19 nt, Homo sapiens
guuggagacucaagauauu

SEQ ID NO: 1148202 - RNA, 19 nt, Homo sapiens
gaaaguggcaagcuguaga

SEQ ID NO: 1148203 - RNA, 19 nt, Homo sapiens
gcagccaccuuggaccaua

SEQ ID NO: 1148204 - RNA, 19 nt, Homo sapiens
ggagaagauucccuugauc

SEQ ID NO: 1148205 - RNA, 19 nt, Homo sapiens
uagaaugccugaagcugaa

SEQ ID NO: 1148206 - RNA, 19 nt, Homo sapiens
gacuaucaguucuguuauu

SEQ ID NO: 1148207 - RNA, 19 nt, Homo sapiens
cagccaagcucauaaucga

SEQ ID NO: 1148208 - RNA, 19 nt, Homo sapiens
ugaccacaaugacaugaaa

SEQ ID NO: 1148209 - RNA, 19 nt, Homo sapiens
ucagugagaaguccagaua

SEQ ID NO: 1148210 - RNA, 19 nt, Homo sapiens
guuaacauguuugugauug

SEQ ID NO: 1148211 - RNA, 19 nt, Homo sapiens
gaugaccuguccauagaug

SEQ ID NO: 1148212 - RNA, 19 nt, Homo sapiens
ccaagucaauugccaacug

SEQ ID NO: 1148213 - RNA, 19 nt, Homo sapiens
aagacuaucaguucuguua

SEQ ID NO: 1148214 - RNA, 19 nt, Homo sapiens
caggauggaucuugaugug

SEQ ID NO: 1148215 - RNA, 19 nt, Homo sapiens
ggaccauaauuaaaucaag

SEQ ID NO: 1148216 - RNA, 19 nt, Homo sapiens
ccaccuuggaccauaauua

SEQ ID NO: 1148217 - RNA, 19 nt, Homo sapiens
gcaaagcagccaccuugga

SEQ ID NO: 1148218 - RNA, 19 nt, Homo sapiens
ccacaaugacaugaaauaa

SEQ ID NO: 1148219 - RNA, 19 nt, Homo sapiens
cuaagaacccuuggaugua

SEQ ID NO: 1148220 - RNA, 19 nt, Homo sapiens
acacagacaacaacaagaa

SEQ ID NO: 1148221 - RNA, 19 nt, Homo sapiens
ggaaagacccaggaagaca

SEQ ID NO: 1148222 - RNA, 19 nt, Homo sapiens
gaacauggacaagaucaag

SEQ ID NO: 1148223 - RNA, 19 nt, Homo sapiens
caccuuggaccauaauuaa

SEQ ID NO: 1148224 - RNA, 19 nt, Homo sapiens
caacacagacaacaacaag

SEQ ID NO: 1148225 - RNA, 19 nt, Homo sapiens
gcacaacacagacaacaac

SEQ ID NO: 1148226 - RNA, 19 nt, Homo sapiens
gagacauuccuuauaguug

SEQ ID NO: 1148227 - RNA, 19 nt, Homo sapiens
gcagacauguuggccaagu

SEQ ID NO: 1148228 - RNA, 19 nt, Homo sapiens
aaauaggccuaauaaagca

SEQ ID NO: 1148229 - RNA, 19 nt, Homo sapiens
gaaaaccuccaagauauuu

SEQ ID NO: 1148230 - RNA, 19 nt, Homo sapiens
gaggaagcccgucccuuau

SEQ ID NO: 1148231 - RNA, 19 nt, Homo sapiens
gguguaugcugcuuacuac

SEQ ID NO: 1148232 - RNA, 19 nt, Homo sapiens
uuaagaggauacaccaguu

SEQ ID NO: 1148233 - RNA, 19 nt, Homo sapiens
caggguggguuuccuagga

SEQ ID NO: 1148234 - RNA, 19 nt, Homo sapiens
uuugagacauuccuuauag

SEQ ID NO: 1148235 - RNA, 19 nt, Homo sapiens
agagaugagugaaaugcuu

SEQ ID NO: 1148236 - RNA, 19 nt, Homo sapiens
uggagaagauucccuugau

SEQ ID NO: 1148237 - RNA, 19 nt, Homo sapiens
gugguuaacauguuuguga

SEQ ID NO: 1148238 - RNA, 19 nt, Homo sapiens
guacaacggcucaaagaac

SEQ ID NO: 1148239 - RNA, 19 nt, Homo sapiens
ccaugaagacuaucaguuc

SEQ ID NO: 1148240 - RNA, 19 nt, Homo sapiens
gaaagagcaggauggaucu

SEQ ID NO: 1148241 - RNA, 19 nt, Homo sapiens
ccuuauaguuggagacuca

SEQ ID NO: 1148242 - RNA, 19 nt, Homo sapiens
ggaaaucgucagugagaag

SEQ ID NO: 1148243 - RNA, 19 nt, Homo sapiens
gaagagaugagugaaaugc

SEQ ID NO: 1148244 - RNA, 19 nt, Homo sapiens
caacaagaagcuggacuga

SEQ ID NO: 1148245 - RNA, 19 nt, Homo sapiens
gcaugcaaguccgcuaugu

SEQ ID NO: 1148246 - RNA, 19 nt, Homo sapiens
uaagaggauacaccaguuu

SEQ ID NO: 1148247 - RNA, 19 nt, Homo sapiens
gagcauuaguccucauucg

SEQ ID NO: 1148248 - RNA, 19 nt, Homo sapiens
cagccaccuuggaccauaa

SEQ ID NO: 1148249 - RNA, 19 nt, Homo sapiens
ccagaagagaugagugaaa

SEQ ID NO: 1148250 - RNA, 19 nt, Homo sapiens
ugaagacuaucaguucugu

SEQ ID NO: 1148251 - RNA, 19 nt, Homo sapiens
ugaagaguaaugugauuga

SEQ ID NO: 1148252 - RNA, 19 nt, Homo sapiens
ugaaaucuaccaugaaguc

SEQ ID NO: 1148253 - RNA, 19 nt, Homo sapiens
caucagaacauggacaaga

SEQ ID NO: 1148254 - RNA, 19 nt, Homo sapiens
ccagauacucucuccauca

SEQ ID NO: 1148255 - RNA, 19 nt, Homo sapiens
ccgcaucccucauaacaac

SEQ ID NO: 1148256 - RNA, 19 nt, Homo sapiens
ugugaagaguaaugugauu

SEQ ID NO: 1148257 - RNA, 19 nt, Homo sapiens
ugagacauuccuuauaguu

SEQ ID NO: 1148258 - RNA, 19 nt, Homo sapiens
uggcauuuguggcuucauu

SEQ ID NO: 1148259 - RNA, 19 nt, Homo sapiens
cuucagcucugcuccuaug

SEQ ID NO: 1148260 - RNA, 19 nt, Homo sapiens
ggacauugggcaugcaagu

SEQ ID NO: 1148261 - RNA, 19 nt, Homo sapiens
ggguguaugcugcuuacua

SEQ ID NO: 1148262 - RNA, 19 nt, Homo sapiens
acuaagaacccuuggaugu

SEQ ID NO: 1148263 - RNA, 19 nt, Homo sapiens
gcacccaccagucagguau

SEQ ID NO: 1148264 - RNA, 19 nt, Homo sapiens
gauggaucuugaugugguu

SEQ ID NO: 1148265 - RNA, 19 nt, Homo sapiens
agagcaggauggaucuuga

SEQ ID NO: 1148266 - RNA, 19 nt, Homo sapiens
ggcaguggcuuuuauagga

SEQ ID NO: 1148267 - RNA, 19 nt, Homo sapiens
gaaacucauauggaacaaa

SEQ ID NO: 1148268 - RNA, 19 nt, Homo sapiens
caugaagacuaucaguucu

SEQ ID NO: 1148269 - RNA, 19 nt, Homo sapiens
ggaagcccgucccuuaucc

SEQ ID NO: 1148270 - RNA, 19 nt, Homo sapiens
cagauacucucuccaucag

SEQ ID NO: 1148271 - RNA, 19 nt, Homo sapiens
uaacaacuucuaccgaaag

SEQ ID NO: 1148272 - RNA, 19 nt, Homo sapiens
auaacaacuucuaccgaaa

SEQ ID NO: 1148273 - RNA, 19 nt, Homo sapiens
cggauucucugcccacaag

SEQ ID NO: 1148274 - RNA, 19 nt, Homo sapiens
ucgcugaacccuguuguuu

SEQ ID NO: 1148275 - RNA, 19 nt, Homo sapiens
gacauuccuuauaguugga

SEQ ID NO: 1148276 - RNA, 19 nt, Homo sapiens
uagaaacucauauggaaca

SEQ ID NO: 1148277 - RNA, 19 nt, Homo sapiens
ggaaaacugugggcacuca

SEQ ID NO: 1148278 - RNA, 19 nt, Homo sapiens
gaaaucgucagugagaagu

SEQ ID NO: 1148279 - RNA, 19 nt, Homo sapiens
uacaacggcucaaagaacu

SEQ ID NO: 1148280 - RNA, 19 nt, Homo sapiens
guaaaagugaccacaauga

SEQ ID NO: 1148281 - RNA, 19 nt, Homo sapiens
gucaaguuccuuccaaaga

SEQ ID NO: 1148282 - RNA, 19 nt, Homo sapiens
cuacuaagaacccuuggau

SEQ ID NO: 1148283 - RNA, 19 nt, Homo sapiens
guggcaagcuguagaaaau

SEQ ID NO: 1148284 - RNA, 19 nt, Homo sapiens
cgcugaacccuguuguuua

SEQ ID NO: 1148285 - RNA, 19 nt, Homo sapiens
gcaggauggaucuugaugu

SEQ ID NO: 1148286 - RNA, 19 nt, Homo sapiens
gcuccuauguccgcuucaa

SEQ ID NO: 1148287 - RNA, 19 nt, Homo sapiens
ggacauagcuuuaauuauc

SEQ ID NO: 1148288 - RNA, 19 nt, Homo sapiens
gcaccaacaucugaauaaa

SEQ ID NO: 1148289 - RNA, 19 nt, Homo sapiens
cuaacuggauuuacacaaa

SEQ ID NO: 1148290 - RNA, 19 nt, Homo sapiens
ggaagaaggcagcaaagga

SEQ ID NO: 1148291 - RNA, 19 nt, Homo sapiens
gaauaaagccauuguucuc

SEQ ID NO: 1148292 - RNA, 19 nt, Homo sapiens
caugcaagauaaagaggua

SEQ ID NO: 1148293 - RNA, 19 nt, Homo sapiens
gacauuggcguucccauga

SEQ ID NO: 1148294 - RNA, 19 nt, Homo sapiens
ucauggagcuggcccugaa

SEQ ID NO: 1148295 - RNA, 19 nt, Homo sapiens
cccaauaccugaaaauuaa

SEQ ID NO: 1148296 - RNA, 19 nt, Homo sapiens
gcaaggugcagaaguagug

SEQ ID NO: 1148297 - RNA, 19 nt, Homo sapiens
ggaccuggccaacauguuc

SEQ ID NO: 1148298 - RNA, 19 nt, Homo sapiens
gaauauuuccgggacauug

SEQ ID NO: 1148299 - RNA, 19 nt, Homo sapiens
ggagguggaggaauauuuc

SEQ ID NO: 1148300 - RNA, 19 nt, Homo sapiens
ggacuucaaccugcuguga

SEQ ID NO: 1148301 - RNA, 19 nt, Homo sapiens
gggagguggaggaauauuu

SEQ ID NO: 1148302 - RNA, 19 nt, Homo sapiens
uaacuggauuuacacaaac

SEQ ID NO: 1148303 - RNA, 19 nt, Homo sapiens
ggcaccaacaucugaauaa

SEQ ID NO: 1148304 - RNA, 19 nt, Homo sapiens
uggccaacauguuccguuu

SEQ ID NO: 1148305 - RNA, 19 nt, Homo sapiens
gcaagauaaagagguaauu

SEQ ID NO: 1148306 - RNA, 19 nt, Homo sapiens
gcccaauaccugaaaauua

SEQ ID NO: 1148307 - RNA, 19 nt, Homo sapiens
caggugacguucccaugga

SEQ ID NO: 1148308 - RNA, 19 nt, Homo sapiens
acucauggacauagcuuua

SEQ ID NO: 1148309 - RNA, 19 nt, Homo sapiens
agauguucaugcaagauaa

SEQ ID NO: 1148310 - RNA, 19 nt, Homo sapiens
uuaagauguucaugcaaga

SEQ ID NO: 1148311 - RNA, 19 nt, Homo sapiens
gggcagaggcaccaacauc

SEQ ID NO: 1148312 - RNA, 19 nt, Homo sapiens
gaaccuccucucccacuuc

SEQ ID NO: 1148313 - RNA, 19 nt, Homo sapiens
ucauggacauagcuuuaau

SEQ ID NO: 1148314 - RNA, 19 nt, Homo sapiens
gcagggagaccaagaugac

SEQ ID NO: 1148315 - RNA, 19 nt, Homo sapiens
ccuggaagaugggacauuc

SEQ ID NO: 1148316 - RNA, 19 nt, Homo sapiens
gauguucaugcaagauaaa

SEQ ID NO: 1148317 - RNA, 19 nt, Homo sapiens
ccuucaucgugaccaauua

SEQ ID NO: 1148318 - RNA, 19 nt, Homo sapiens
ugaauaaagccauuguucu

SEQ ID NO: 1148319 - RNA, 19 nt, Homo sapiens
gccugggccuccacuaugu

SEQ ID NO: 1148320 - RNA, 19 nt, Homo sapiens
aagauguucaugcaagaua

SEQ ID NO: 1148321 - RNA, 19 nt, Homo sapiens
cuaggaagaaggcagcaaa

SEQ ID NO: 1148322 - RNA, 19 nt, Homo sapiens
aaggggagguggaggaaua

SEQ ID NO: 1148323 - RNA, 19 nt, Homo sapiens
gaccggauucgucccauuc

SEQ ID NO: 1148324 - RNA, 19 nt, Homo sapiens
ccucaugguggacaagaaa

SEQ ID NO: 1148325 - RNA, 19 nt, Homo sapiens
uggagaacaucaagaagcu

SEQ ID NO: 1148326 - RNA, 19 nt, Homo sapiens
ccaccuucaucgugaccaa

SEQ ID NO: 1148327 - RNA, 19 nt, Homo sapiens
cugaauaaagccauuguuc

SEQ ID NO: 1148328 - RNA, 19 nt, Homo sapiens
caagaaacugguggugguu

SEQ ID NO: 1148329 - RNA, 19 nt, Homo sapiens
accaacaucugaauaaagc

SEQ ID NO: 1148330 - RNA, 19 nt, Homo sapiens
cgugcacgaugccaagaug

SEQ ID NO: 1148331 - RNA, 19 nt, Homo sapiens
agacggaaagagcuacuug

SEQ ID NO: 1148332 - RNA, 19 nt, Homo sapiens
gccuggagaacaucaagaa

SEQ ID NO: 1148333 - RNA, 19 nt, Homo sapiens
gccaggagcaggaggucaa

SEQ ID NO: 1148334 - RNA, 19 nt, Homo sapiens
cauggacauagcuuuaauu

SEQ ID NO: 1148335 - RNA, 19 nt, Homo sapiens
acaucgggcugagcacuug

SEQ ID NO: 1148336 - RNA, 19 nt, Homo sapiens
gcacaaaggggacuucaac

SEQ ID NO: 1148337 - RNA, 19 nt, Homo sapiens
acgcugcccugcucaccaa

SEQ ID NO: 1148338 - RNA, 19 nt, Homo sapiens
ccuccucucccacuucuug

SEQ ID NO: 1148339 - RNA, 19 nt, Homo sapiens
gcucuccaccucgcucauu

SEQ ID NO: 1148340 - RNA, 19 nt, Homo sapiens
acccguagcauccgguuaa

SEQ ID NO: 1148341 - RNA, 19 nt, Homo sapiens
ggaagaugggacauucaag

SEQ ID NO: 1148342 - RNA, 19 nt, Homo sapiens
ggauuuacacaaacucacu

SEQ ID NO: 1148343 - RNA, 19 nt, Homo sapiens
uggucuaacuggauuuaca

SEQ ID NO: 1148344 - RNA, 19 nt, Homo sapiens
gggcuuacgccaccuucau

SEQ ID NO: 1148345 - RNA, 19 nt, Homo sapiens
ccgaaacccuaggaagaag

SEQ ID NO: 1148346 - RNA, 19 nt, Homo sapiens
cccgaaacccuaggaagaa

SEQ ID NO: 1148347 - RNA, 19 nt, Homo sapiens
gaaaugcaauugccacuug

SEQ ID NO: 1148348 - RNA, 19 nt, Homo sapiens
gaguagggcugauguguuu

SEQ ID NO: 1148349 - RNA, 19 nt, Homo sapiens
gcugauguguuuccuguua

SEQ ID NO: 1148350 - RNA, 19 nt, Homo sapiens
cagaaagacugaauguaaa

SEQ ID NO: 1148351 - RNA, 19 nt, Homo sapiens
caaauaggauuggucauug

SEQ ID NO: 1148352 - RNA, 19 nt, Homo sapiens
gcucaugaccuuaaacuug

SEQ ID NO: 1148353 - RNA, 19 nt, Homo sapiens
gaagauagugucugaguag

SEQ ID NO: 1148354 - RNA, 19 nt, Homo sapiens
gggauugugugucucauga

SEQ ID NO: 1148355 - RNA, 19 nt, Homo sapiens
ugagggagcuugauuuguc

SEQ ID NO: 1148356 - RNA, 19 nt, Homo sapiens
acaauucccuuucaaaucu

SEQ ID NO: 1148357 - RNA, 19 nt, Homo sapiens
caacaauucccuuucaaau

SEQ ID NO: 1148358 - RNA, 19 nt, Homo sapiens
gcaaggacgcccaagaaga

SEQ ID NO: 1148359 - RNA, 19 nt, Homo sapiens
caucaucacuggcguugug

SEQ ID NO: 1148360 - RNA, 19 nt, Homo sapiens
uaacuauacuugcgguuca

SEQ ID NO: 1148361 - RNA, 19 nt, Homo sapiens
cuucagcacuugcagguuu

SEQ ID NO: 1148362 - RNA, 19 nt, Homo sapiens
gaacgcugcauuuacaaga

SEQ ID NO: 1148363 - RNA, 19 nt, Homo sapiens
caaccugcgucaugccauu

SEQ ID NO: 1148364 - RNA, 19 nt, Homo sapiens
gcucugcacauuaauuaaa

SEQ ID NO: 1148365 - RNA, 19 nt, Homo sapiens
guguugcucugcacauuaa

SEQ ID NO: 1148366 - RNA, 19 nt, Homo sapiens
ucaaauaggauuggucauu

SEQ ID NO: 1148367 - RNA, 19 nt, Homo sapiens
agaagauagugucugagua

SEQ ID NO: 1148368 - RNA, 19 nt, Homo sapiens
ugucagucaucuacaaauu

SEQ ID NO: 1148369 - RNA, 19 nt, Homo sapiens
gggagaaccuaacuauacu

SEQ ID NO: 1148370 - RNA, 19 nt, Homo sapiens
gauugugugucucaugaug

SEQ ID NO: 1148371 - RNA, 19 nt, Homo sapiens
gacaaccucuggaaaugca

SEQ ID NO: 1148372 - RNA, 19 nt, Homo sapiens
cagcaaggacgcccaagaa

SEQ ID NO: 1148373 - RNA, 19 nt, Homo sapiens
gagaaccuaacuauacuug

SEQ ID NO: 1148374 - RNA, 19 nt, Homo sapiens
gagggagcuugauuuguca

SEQ ID NO: 1148375 - RNA, 19 nt, Homo sapiens
cuggagaaauuugucuaua

SEQ ID NO: 1148376 - RNA, 19 nt, Homo sapiens
ccaacaauucccuuucaaa

SEQ ID NO: 1148377 - RNA, 19 nt, Homo sapiens
guccaacaauucccuuuca

SEQ ID NO: 1148378 - RNA, 19 nt, Homo sapiens
ucaccagccugagagcuuu

SEQ ID NO: 1148379 - RNA, 19 nt, Homo sapiens
uaagccaccuucccacauc

SEQ ID NO: 1148380 - RNA, 19 nt, Homo sapiens
uacaccaucuuccugcuuu

SEQ ID NO: 1148381 - RNA, 19 nt, Homo sapiens
ccauuuaccuccucagacu

SEQ ID NO: 1148382 - RNA, 19 nt, Homo sapiens
uaccagcccugcccucuuc

SEQ ID NO: 1148383 - RNA, 19 nt, Homo sapiens
gcaagggcaggguucagaa

SEQ ID NO: 1148384 - RNA, 19 nt, Homo sapiens
acgcugcauuuacaagaua

SEQ ID NO: 1148385 - RNA, 19 nt, Homo sapiens
aaggugaacugcuccuguu

SEQ ID NO: 1148386 - RNA, 19 nt, Homo sapiens
caaggacaaccucuggaaa

SEQ ID NO: 1148387 - RNA, 19 nt, Homo sapiens
gcugagggagcuugauuug

SEQ ID NO: 1148388 - RNA, 19 nt, Homo sapiens
gaauccaugcccaguguga

SEQ ID NO: 1148389 - RNA, 19 nt, Homo sapiens
ccacuugcucggucuuaaa

SEQ ID NO: 1148390 - RNA, 19 nt, Homo sapiens
acccagaauucacuccuuu

SEQ ID NO: 1148391 - RNA, 19 nt, Homo sapiens
cucaugaccuuaaacuugu

SEQ ID NO: 1148392 - RNA, 19 nt, Homo sapiens
caaggacgcccaagaagac

SEQ ID NO: 1148393 - RNA, 19 nt, Homo sapiens
caagggcaggguucagaaa

SEQ ID NO: 1148394 - RNA, 19 nt, Homo sapiens
ggaaaugcaauugccacuu

SEQ ID NO: 1148395 - RNA, 19 nt, Homo sapiens
ucaaggacaaccucuggaa

SEQ ID NO: 1148396 - RNA, 19 nt, Homo sapiens
ugggagaaccuaacuauac

SEQ ID NO: 1148397 - RNA, 19 nt, Homo sapiens
gucagucaucuacaaauuu

SEQ ID NO: 1148398 - RNA, 19 nt, Homo sapiens
ccaaugauccugggaaggu

SEQ ID NO: 1148399 - RNA, 19 nt, Homo sapiens
gccacuugcucggucuuaa

SEQ ID NO: 1148400 - RNA, 19 nt, Homo sapiens
uaaaucuaacccagaauuc

SEQ ID NO: 1148401 - RNA, 19 nt, Homo sapiens
uccaugggcuucagcacuu

SEQ ID NO: 1148402 - RNA, 19 nt, Homo sapiens
aacucuggcuggagaaauu

SEQ ID NO: 1148403 - RNA, 19 nt, Homo sapiens
uugcucugcacauuaauua

SEQ ID NO: 1148404 - RNA, 19 nt, Homo sapiens
ggagaaccuaacuauacuu

SEQ ID NO: 1148405 - RNA, 19 nt, Homo sapiens
aggacaaccucuggaaaug

SEQ ID NO: 1148406 - RNA, 19 nt, Homo sapiens
auguaaagcugggcucuga

SEQ ID NO: 1148407 - RNA, 19 nt, Homo sapiens
guaaagcugggcucugagu

SEQ ID NO: 1148408 - RNA, 19 nt, Homo sapiens
cucgaacgcugcauuuaca

SEQ ID NO: 1148409 - RNA, 19 nt, Homo sapiens
ccaggcccuucguguguug

SEQ ID NO: 1148410 - RNA, 19 nt, Homo sapiens
gggagagacuugggagaac

SEQ ID NO: 1148411 - RNA, 19 nt, Homo sapiens
agacucgaacgcugcauuu

SEQ ID NO: 1148412 - RNA, 19 nt, Homo sapiens
gucaugccauugccacugu

SEQ ID NO: 1148413 - RNA, 19 nt, Homo sapiens
ggacuaacagacggcauca

SEQ ID NO: 1148414 - RNA, 19 nt, Homo sapiens
gcuggagaaauuugucuau

SEQ ID NO: 1148415 - RNA, 19 nt, Homo sapiens
ggacgcccaagaagacuca

SEQ ID NO: 1148416 - RNA, 19 nt, Homo sapiens
gaucgagcgcuccuggaau

SEQ ID NO: 1148417 - RNA, 19 nt, Homo sapiens
gacucgaacgcugcauuua

SEQ ID NO: 1148418 - RNA, 19 nt, Homo sapiens
ggucauugcaggccagaag

SEQ ID NO: 1148419 - RNA, 19 nt, Homo sapiens
ugaguagggcugauguguu

SEQ ID NO: 1148420 - RNA, 19 nt, Homo sapiens
gggcaggguucagaaagac

SEQ ID NO: 1148421 - RNA, 19 nt, Homo sapiens
guccugaggccuccugaga

SEQ ID NO: 1148422 - RNA, 19 nt, Homo sapiens
ggacaaccucuggaaaugc

SEQ ID NO: 1148423 - RNA, 19 nt, Homo sapiens
aaggacaaccucuggaaau

SEQ ID NO: 1148424 - RNA, 19 nt, Homo sapiens
ucuacgaggucagcaagga

SEQ ID NO: 1148425 - RNA, 19 nt, Homo sapiens
uuaauuaaagggucuacga

SEQ ID NO: 1148426 - RNA, 19 nt, Homo sapiens
gcugcccggacaaguguua

SEQ ID NO: 1148427 - RNA, 19 nt, Homo sapiens
gccaggcccuucguguguu

SEQ ID NO: 1148428 - RNA, 19 nt, Homo sapiens
ccugaggccuccugagaac

SEQ ID NO: 1148429 - RNA, 19 nt, Homo sapiens
cggcaucaucugugaauca

SEQ ID NO: 1148430 - RNA, 19 nt, Homo sapiens
ggcguugugugugggauug

SEQ ID NO: 1148431 - RNA, 19 nt, Homo sapiens
cauugccacugucaucauc

SEQ ID NO: 1148432 - RNA, 19 nt, Homo sapiens
gacggcaucaucugugaau

SEQ ID NO: 1148433 - RNA, 19 nt, Homo sapiens
gcacuugcagguuuuaaau

SEQ ID NO: 1148434 - RNA, 19 nt, Homo sapiens
cauugcaggccagaagaua

SEQ ID NO: 1148435 - RNA, 19 nt, Homo sapiens
aaauaggauuggucauugc

SEQ ID NO: 1148436 - RNA, 19 nt, Homo sapiens
caucuauggcugcaccuau

SEQ ID NO: 1148437 - RNA, 19 nt, Homo sapiens
agggcaggguucagaaaga

SEQ ID NO: 1148438 - RNA, 19 nt, Homo sapiens
gcauuuacaagauaaucag

SEQ ID NO: 1148439 - RNA, 19 nt, Homo sapiens
ugugugggauugugugucu

SEQ ID NO: 1148440 - RNA, 19 nt, Homo sapiens
agaaagacugaauguaaag

SEQ ID NO: 1148441 - RNA, 19 nt, Homo sapiens
gacagaagauggagaauau

SEQ ID NO: 1148442 - RNA, 19 nt, Homo sapiens
cagaggagcuauaguaauu

SEQ ID NO: 1148443 - RNA, 19 nt, Homo sapiens
ggacaacucuggaaacaag

SEQ ID NO: 1148444 - RNA, 19 nt, Homo sapiens
gaagacagcacucaaaguu

SEQ ID NO: 1148445 - RNA, 19 nt, Homo sapiens
gaaaguggccaaugugauu

SEQ ID NO: 1148446 - RNA, 19 nt, Homo sapiens
gcacaagucacaccagaaa

SEQ ID NO: 1148447 - RNA, 19 nt, Homo sapiens
gcacuggccuuucuucuac

SEQ ID NO: 1148448 - RNA, 19 nt, Homo sapiens
gcgcauggaugagcucuuu

SEQ ID NO: 1148449 - RNA, 19 nt, Homo sapiens
ggucugcuaugucaccuuu

SEQ ID NO: 1148450 - RNA, 19 nt, Homo sapiens
cagcugcccacaaguauua

SEQ ID NO: 1148451 - RNA, 19 nt, Homo sapiens
gugagauguuucccacuua

SEQ ID NO: 1148452 - RNA, 19 nt, Homo sapiens
ggugagauguuucccacuu

SEQ ID NO: 1148453 - RNA, 19 nt, Homo sapiens
gauggagaauauuccguuu

SEQ ID NO: 1148454 - RNA, 19 nt, Homo sapiens
aggaggagguggacuguuu

SEQ ID NO: 1148455 - RNA, 19 nt, Homo sapiens
ggcaggugcuguccuuauu

SEQ ID NO: 1148456 - RNA, 19 nt, Homo sapiens
cgacuaggccuccagauca

SEQ ID NO: 1148457 - RNA, 19 nt, Homo sapiens
gagaaaguggccaauguga

SEQ ID NO: 1148458 - RNA, 19 nt, Homo sapiens
uaauugcucucgccugaug

SEQ ID NO: 1148459 - RNA, 19 nt, Homo sapiens
ggagaaaguggccaaugug

SEQ ID NO: 1148460 - RNA, 19 nt, Homo sapiens
uggagaaaguggccaaugu

SEQ ID NO: 1148461 - RNA, 19 nt, Homo sapiens
caguucagcgugagaauuu

SEQ ID NO: 1148462 - RNA, 19 nt, Homo sapiens
ccaguagagaggaguauaa

SEQ ID NO: 1148463 - RNA, 19 nt, Homo sapiens
guaacacgcaguacagaga

SEQ ID NO: 1148464 - RNA, 19 nt, Homo sapiens
ugagauguuucccacuuau

SEQ ID NO: 1148465 - RNA, 19 nt, Homo sapiens
gggagcagcuggagaaaau

SEQ ID NO: 1148466 - RNA, 19 nt, Homo sapiens
agacagaagauggagaaua

SEQ ID NO: 1148467 - RNA, 19 nt, Homo sapiens
uaaacaagcaggccagagu

SEQ ID NO: 1148468 - RNA, 19 nt, Homo sapiens
gccagaggagcuauaguaa

SEQ ID NO: 1148469 - RNA, 19 nt, Homo sapiens
cagaagauggagaauauuc

SEQ ID NO: 1148470 - RNA, 19 nt, Homo sapiens
ggaggcagagcacaaguca

SEQ ID NO: 1148471 - RNA, 19 nt, Homo sapiens
uugagugucuucccuucua

SEQ ID NO: 1148472 - RNA, 19 nt, Homo sapiens
ggugaacccugucuaugac

SEQ ID NO: 1148473 - RNA, 19 nt, Homo sapiens
gaggagcuauaguaauugc

SEQ ID NO: 1148474 - RNA, 19 nt, Homo sapiens
ugccagaggagcuauagua

SEQ ID NO: 1148475 - RNA, 19 nt, Homo sapiens
gaagggcaacucccaagag

SEQ ID NO: 1148476 - RNA, 19 nt, Homo sapiens
ccacugcacuguguaacca

SEQ ID NO: 1148477 - RNA, 19 nt, Homo sapiens
ugagacagaagauggagaa

SEQ ID NO: 1148478 - RNA, 19 nt, Homo sapiens
gagccacugcacuguguaa

SEQ ID NO: 1148479 - RNA, 19 nt, Homo sapiens
ucugcaacaucuuugacua

SEQ ID NO: 1148480 - RNA, 19 nt, Homo sapiens
guagagaggaguauaaaau

SEQ ID NO: 1148481 - RNA, 19 nt, Homo sapiens
ucuggaaacaagccuauuu

SEQ ID NO: 1148482 - RNA, 19 nt, Homo sapiens
aaggacaacucuggaaaca

SEQ ID NO: 1148483 - RNA, 19 nt, Homo sapiens
gcauggaugagcucuuugu

SEQ ID NO: 1148484 - RNA, 19 nt, Homo sapiens
ucugcuaugucaccuuuau

SEQ ID NO: 1148485 - RNA, 19 nt, Homo sapiens
ggaggagguggacuguuug

SEQ ID NO: 1148486 - RNA, 19 nt, Homo sapiens
gcaggugcuguccuuauuc

SEQ ID NO: 1148487 - RNA, 19 nt, Homo sapiens
cuaccuuggugccucaguu

SEQ ID NO: 1148488 - RNA, 19 nt, Homo sapiens
cuucuagacuuucccaucu

SEQ ID NO: 1148489 - RNA, 19 nt, Homo sapiens
uggugaacccugucuauga

SEQ ID NO: 1148490 - RNA, 19 nt, Homo sapiens
ggcugggucugcuauguca

SEQ ID NO: 1148491 - RNA, 19 nt, Homo sapiens
gcuguggacuuggagaaag

SEQ ID NO: 1148492 - RNA, 19 nt, Homo sapiens
ccagaggagcuauaguaau

SEQ ID NO: 1148493 - RNA, 19 nt, Homo sapiens
aagagccacugcacugugu

SEQ ID NO: 1148494 - RNA, 19 nt, Homo sapiens
ucauucaggcagagaguaa

SEQ ID NO: 1148495 - RNA, 19 nt, Homo sapiens
uauaaggacaacucuggaa

SEQ ID NO: 1148496 - RNA, 19 nt, Homo sapiens
uggagaauauuccguuugc

SEQ ID NO: 1148497 - RNA, 19 nt, Homo sapiens
ccagcccagucaagagcua

SEQ ID NO: 1148498 - RNA, 19 nt, Homo sapiens
caguagagaggaguauaaa

SEQ ID NO: 1148499 - RNA, 19 nt, Homo sapiens
cgccagcugcccacaagua

SEQ ID NO: 1148500 - RNA, 19 nt, Homo sapiens
ugcuggagaucauugaguu

SEQ ID NO: 1148501 - RNA, 19 nt, Homo sapiens
ggcagagaguaaacaagca

SEQ ID NO: 1148502 - RNA, 19 nt, Homo sapiens
caugugcuacgccaucauu

SEQ ID NO: 1148503 - RNA, 19 nt, Homo sapiens
ccacaugcuacaccaguuc

SEQ ID NO: 1148504 - RNA, 19 nt, Homo sapiens
aggcagagcacaagucaca

SEQ ID NO: 1148505 - RNA, 19 nt, Homo sapiens
gagauguuucccacuuaug

SEQ ID NO: 1148506 - RNA, 19 nt, Homo sapiens
gacuaggccuccagaucag

SEQ ID NO: 1148507 - RNA, 19 nt, Homo sapiens
ccaguucagcgugagaauu

SEQ ID NO: 1148508 - RNA, 19 nt, Homo sapiens
auaaggacaacucuggaaa

SEQ ID NO: 1148509 - RNA, 19 nt, Homo sapiens
cugcaggacuguguguuca

SEQ ID NO: 1148510 - RNA, 19 nt, Homo sapiens
uaacacgcaguacagagau

SEQ ID NO: 1148511 - RNA, 19 nt, Homo sapiens
caacgccagcugcccacaa

SEQ ID NO: 1148512 - RNA, 19 nt, Homo sapiens
gcaagagccuggacgcauu

SEQ ID NO: 1148513 - RNA, 19 nt, Homo sapiens
ccacagauguauuuauugu

SEQ ID NO: 1148514 - RNA, 19 nt, Homo sapiens
ggccaaagcugccuucaag

SEQ ID NO: 1148515 - RNA, 19 nt, Homo sapiens
ggagcuuccuguccaaauu

SEQ ID NO: 1148516 - RNA, 19 nt, Homo sapiens
gaacgacugugcccagaag

SEQ ID NO: 1148517 - RNA, 19 nt, Homo sapiens
ggagaaggauguccaugca

SEQ ID NO: 1148518 - RNA, 19 nt, Homo sapiens
gcucugcggucucacugua

SEQ ID NO: 1148519 - RNA, 19 nt, Homo sapiens
gagcaaccgcuuuguagaa

SEQ ID NO: 1148520 - RNA, 19 nt, Homo sapiens
ucaaagagccagccgagaa

SEQ ID NO: 1148521 - RNA, 19 nt, Homo sapiens
gacccacgcugaaggaguu

SEQ ID NO: 1148522 - RNA, 19 nt, Homo sapiens
ugaaggagcuggagaucuc

SEQ ID NO: 1148523 - RNA, 19 nt, Homo sapiens
cacaaccucuacucaauga

SEQ ID NO: 1148524 - RNA, 19 nt, Homo sapiens
gcagaguggucagagagaa

SEQ ID NO: 1148525 - RNA, 19 nt, Homo sapiens
gaaguggucagcagacaug

SEQ ID NO: 1148526 - RNA, 19 nt, Homo sapiens
gggacgaugugguucuuug

SEQ ID NO: 1148527 - RNA, 19 nt, Homo sapiens
ggaggagauucagaucaaa

SEQ ID NO: 1148528 - RNA, 19 nt, Homo sapiens
caucucacguguacauaau

SEQ ID NO: 1148529 - RNA, 19 nt, Homo sapiens
cgacccagcuggaggaagu

SEQ ID NO: 1148530 - RNA, 19 nt, Homo sapiens
cacuguagauccugagaaa

SEQ ID NO: 1148531 - RNA, 19 nt, Homo sapiens
uggaggagauucagaucaa

SEQ ID NO: 1148532 - RNA, 19 nt, Homo sapiens
cauccuggcuuacaucgau

SEQ ID NO: 1148533 - RNA, 19 nt, Homo sapiens
ucacucaccucaagcugau

SEQ ID NO: 1148534 - RNA, 19 nt, Homo sapiens
ggccuggacuacauguauu

SEQ ID NO: 1148535 - RNA, 19 nt, Homo sapiens
ccugagcgcugaggaguau

SEQ ID NO: 1148536 - RNA, 19 nt, Homo sapiens
gagaaguggucagcagaca

SEQ ID NO: 1148537 - RNA, 19 nt, Homo sapiens
caagugagccgugcuaguc

SEQ ID NO: 1148538 - RNA, 19 nt, Homo sapiens
caacagaaaccaacauucc

SEQ ID NO: 1148539 - RNA, 19 nt, Homo sapiens
gcgcuugggcugccucauu

SEQ ID NO: 1148540 - RNA, 19 nt, Homo sapiens
ucgauggacuggagacaga

SEQ ID NO: 1148541 - RNA, 19 nt, Homo sapiens
uggaggaaguggagaagga

SEQ ID NO: 1148542 - RNA, 19 nt, Homo sapiens
ugacagaugggacgacgaa

SEQ ID NO: 1148543 - RNA, 19 nt, Homo sapiens
gagcuuccuguccaaauug

SEQ ID NO: 1148544 - RNA, 19 nt, Homo sapiens
caugagcaaccgcuuugua

SEQ ID NO: 1148545 - RNA, 19 nt, Homo sapiens
cgcuugggcugccucauuu

SEQ ID NO: 1148546 - RNA, 19 nt, Homo sapiens
ccacaaccucuacucaaug

SEQ ID NO: 1148547 - RNA, 19 nt, Homo sapiens
cccacaaccucuacucaau

SEQ ID NO: 1148548 - RNA, 19 nt, Homo sapiens
gcugaccgccuucgaguuc

SEQ ID NO: 1148549 - RNA, 19 nt, Homo sapiens
ccaacauccuggcuuacau

SEQ ID NO: 1148550 - RNA, 19 nt, Homo sapiens
gagccgugcuagucagagu

SEQ ID NO: 1148551 - RNA, 19 nt, Homo sapiens
caaccacugcccaacagaa

SEQ ID NO: 1148552 - RNA, 19 nt, Homo sapiens
gagcugaugaagcacuuug

SEQ ID NO: 1148553 - RNA, 19 nt, Homo sapiens
gggccuggacuacauguau

SEQ ID NO: 1148554 - RNA, 19 nt, Homo sapiens
caaagagccagccgagaag

SEQ ID NO: 1148555 - RNA, 19 nt, Homo sapiens
ucucacguguacauaauca

SEQ ID NO: 1148556 - RNA, 19 nt, Homo sapiens
ccaucucacguguacauaa

SEQ ID NO: 1148557 - RNA, 19 nt, Homo sapiens
caacauccuggcuuacauc

SEQ ID NO: 1148558 - RNA, 19 nt, Homo sapiens
agcaaccgcuuuguagaaa

SEQ ID NO: 1148559 - RNA, 19 nt, Homo sapiens
aaacgcuggugccccauua

SEQ ID NO: 1148560 - RNA, 19 nt, Homo sapiens
guccuuaccucugccuuca

SEQ ID NO: 1148561 - RNA, 19 nt, Homo sapiens
gcagccucauccacaacaa

SEQ ID NO: 1148562 - RNA, 19 nt, Homo sapiens
ucacguguacauaaucaga

SEQ ID NO: 1148563 - RNA, 19 nt, Homo sapiens
gggagcagacggucaaguc

SEQ ID NO: 1148564 - RNA, 19 nt, Homo sapiens
ugcagcagauggagcaguu

SEQ ID NO: 1148565 - RNA, 19 nt, Homo sapiens
ggacgcauucccugaggau

SEQ ID NO: 1148566 - RNA, 19 nt, Homo sapiens
ccccacagauguauuuauu

SEQ ID NO: 1148567 - RNA, 19 nt, Homo sapiens
ccaaagacccacgcugaag

SEQ ID NO: 1148568 - RNA, 19 nt, Homo sapiens
gaaaccaacauuccccaaa

SEQ ID NO: 1148569 - RNA, 19 nt, Homo sapiens
ggauuucugucggcacaag

SEQ ID NO: 1148570 - RNA, 19 nt, Homo sapiens
acgcauucccugaggauuu

SEQ ID NO: 1148571 - RNA, 19 nt, Homo sapiens
gaggagauucagaucaaag

SEQ ID NO: 1148572 - RNA, 19 nt, Homo sapiens
uguagaaaccaaccucuuc

SEQ ID NO: 1148573 - RNA, 19 nt, Homo sapiens
ucaaggccauucggagcuu

SEQ ID NO: 1148574 - RNA, 19 nt, Homo sapiens
ggcuacaggccaaggauga

SEQ ID NO: 1148575 - RNA, 19 nt, Homo sapiens
gcaaccgcuuuguagaaac

SEQ ID NO: 1148576 - RNA, 19 nt, Homo sapiens
cccggaagcuggacugaac

SEQ ID NO: 1148577 - RNA, 19 nt, Homo sapiens
gaguaucagcagaagauca

SEQ ID NO: 1148578 - RNA, 19 nt, Homo sapiens
caggccaucucacguguac

SEQ ID NO: 1148579 - RNA, 19 nt, Homo sapiens
gauggacuggagacagaaa

SEQ ID NO: 1148580 - RNA, 19 nt, Homo sapiens
acagaugggacgacgaaga

SEQ ID NO: 1148581 - RNA, 19 nt, Homo sapiens
caacagucaacacccagau

SEQ ID NO: 1148582 - RNA, 19 nt, Homo sapiens
caagagccuggacgcauuc

SEQ ID NO: 1148583 - RNA, 19 nt, Homo sapiens
caacgacugcagccucauc

SEQ ID NO: 1148584 - RNA, 19 nt, Homo sapiens
ccaacagaaaccaacauuc

SEQ ID NO: 1148585 - RNA, 19 nt, Homo sapiens
cuguagauccugagaaauc

SEQ ID NO: 1148586 - RNA, 19 nt, Homo sapiens
ucagcuuccuggucaacga

SEQ ID NO: 1148587 - RNA, 19 nt, Homo sapiens
caaccucuacucaaugaac

SEQ ID NO: 1148588 - RNA, 19 nt, Homo sapiens
ucaauguggagcugaugaa

SEQ ID NO: 1148589 - RNA, 19 nt, Homo sapiens
cgcauucccugaggauuuc

SEQ ID NO: 1148590 - RNA, 19 nt, Homo sapiens
uccaggagcugagcaagag

SEQ ID NO: 1148591 - RNA, 19 nt, Homo sapiens
ggccaucucacguguacau

SEQ ID NO: 1148592 - RNA, 19 nt, Homo sapiens
aaagacccacgcugaagga

SEQ ID NO: 1148593 - RNA, 19 nt, Homo sapiens
gagccagccgagaagcaaa

SEQ ID NO: 1148594 - RNA, 19 nt, Homo sapiens
gcaaaucacuaguuaagca

SEQ ID NO: 1148595 - RNA, 19 nt, Homo sapiens
uaaggaaggugaaauuguu

SEQ ID NO: 1148596 - RNA, 19 nt, Homo sapiens
gaaguagcccuaagauauu

SEQ ID NO: 1148597 - RNA, 19 nt, Homo sapiens
gauuaaagauucacagcaa

SEQ ID NO: 1148598 - RNA, 19 nt, Homo sapiens
gcacagaccauaagaaaca

SEQ ID NO: 1148599 - RNA, 19 nt, Homo sapiens
gaauagacaugaccaaagg

SEQ ID NO: 1148600 - RNA, 19 nt, Homo sapiens
uggcagagauugcuaugua

SEQ ID NO: 1148601 - RNA, 19 nt, Homo sapiens
accaagagaugccaaguua

SEQ ID NO: 1148602 - RNA, 19 nt, Homo sapiens
ggaauuacaggacaugaaa

SEQ ID NO: 1148603 - RNA, 19 nt, Homo sapiens
gaagaaaucaggacacaca

SEQ ID NO: 1148604 - RNA, 19 nt, Homo sapiens
ggaaguggcugaaaaguau

SEQ ID NO: 1148605 - RNA, 19 nt, Homo sapiens
cacagcaaaucacuaguua

SEQ ID NO: 1148606 - RNA, 19 nt, Homo sapiens
caagagaugccaaguuauu

SEQ ID NO: 1148607 - RNA, 19 nt, Homo sapiens
cauuuaagcuugcagaaga

SEQ ID NO: 1148608 - RNA, 19 nt, Homo sapiens
agaaguagcccuaagauau

SEQ ID NO: 1148609 - RNA, 19 nt, Homo sapiens
uaagaggcauugauuaaag

SEQ ID NO: 1148610 - RNA, 19 nt, Homo sapiens
ugaaguggaugaagaaaca

SEQ ID NO: 1148611 - RNA, 19 nt, Homo sapiens
agagauugcuauguacuua

SEQ ID NO: 1148612 - RNA, 19 nt, Homo sapiens
cagagaagcugucuuaagc

SEQ ID NO: 1148613 - RNA, 19 nt, Homo sapiens
acaaggaacuggaaagagu

SEQ ID NO: 1148614 - RNA, 19 nt, Homo sapiens
ggaaaggcaucagaagaag

SEQ ID NO: 1148615 - RNA, 19 nt, Homo sapiens
caagauuugcucaagauuu

SEQ ID NO: 1148616 - RNA, 19 nt, Homo sapiens
cuagaaaacugcuggauuu

SEQ ID NO: 1148617 - RNA, 19 nt, Homo sapiens
ggaguuaaaggauauaauc

SEQ ID NO: 1148618 - RNA, 19 nt, Homo sapiens
agaaggacgugcagaccua

SEQ ID NO: 1148619 - RNA, 19 nt, Homo sapiens
gagccaugauauuguugua

SEQ ID NO: 1148620 - RNA, 19 nt, Homo sapiens
ugagagccaugauauuguu

SEQ ID NO: 1148621 - RNA, 19 nt, Homo sapiens
agaaacagcagcuaucuug

SEQ ID NO: 1148622 - RNA, 19 nt, Homo sapiens
gaaaucaggacacacaaag

SEQ ID NO: 1148623 - RNA, 19 nt, Homo sapiens
gaaugagagccaugauauu

SEQ ID NO: 1148624 - RNA, 19 nt, Homo sapiens
cggcagaccuccagaccaa

SEQ ID NO: 1148625 - RNA, 19 nt, Homo sapiens
gaugccaaguuauuuacaa

SEQ ID NO: 1148626 - RNA, 19 nt, Homo sapiens
gaagaaguagcccuaagau

SEQ ID NO: 1148627 - RNA, 19 nt, Homo sapiens
uagcacagaccauaagaaa

SEQ ID NO: 1148628 - RNA, 19 nt, Homo sapiens
gaaaagcugcuaaaucuau

SEQ ID NO: 1148629 - RNA, 19 nt, Homo sapiens
agaagagucugacaguaug

SEQ ID NO: 1148630 - RNA, 19 nt, Homo sapiens
ggugaucccugagcaucua

SEQ ID NO: 1148631 - RNA, 19 nt, Homo sapiens
aaauguacacgaagaagua

SEQ ID NO: 1148632 - RNA, 19 nt, Homo sapiens
aaaggcaucagaagaagua

SEQ ID NO: 1148633 - RNA, 19 nt, Homo sapiens
caagagugaucugcauguu

SEQ ID NO: 1148634 - RNA, 19 nt, Homo sapiens
aaguagcccuaagauauua

SEQ ID NO: 1148635 - RNA, 19 nt, Homo sapiens
aaucacagauccauuuaag

SEQ ID NO: 1148636 - RNA, 19 nt, Homo sapiens
agagaugccaaguuauuua

SEQ ID NO: 1148637 - RNA, 19 nt, Homo sapiens
ugagguagcuuuugaacaa

SEQ ID NO: 1148638 - RNA, 19 nt, Homo sapiens
ggcagagggucucaggaaa

SEQ ID NO: 1148639 - RNA, 19 nt, Homo sapiens
gaccauaagaaacaacaaa

SEQ ID NO: 1148640 - RNA, 19 nt, Homo sapiens
guucugcccuccacguuug

SEQ ID NO: 1148641 - RNA, 19 nt, Homo sapiens
ggcagaggcuggaaucaag

SEQ ID NO: 1148642 - RNA, 19 nt, Homo sapiens
ggaauagacaugaccaaag

SEQ ID NO: 1148643 - RNA, 19 nt, Homo sapiens
aaacagcagcuaucuugaa

SEQ ID NO: 1148644 - RNA, 19 nt, Homo sapiens
gaaacagcagcuaucuuga

SEQ ID NO: 1148645 - RNA, 19 nt, Homo sapiens
gccaaucucauuacaauuc

SEQ ID NO: 1148646 - RNA, 19 nt, Homo sapiens
guucugcuuuggaguuaaa

SEQ ID NO: 1148647 - RNA, 19 nt, Homo sapiens
cgaagaaguagcccuaaga

SEQ ID NO: 1148648 - RNA, 19 nt, Homo sapiens
gaagaaacagcagcuaucu

SEQ ID NO: 1148649 - RNA, 19 nt, Homo sapiens
cagaagaaaucaggacaca

SEQ ID NO: 1148650 - RNA, 19 nt, Homo sapiens
aagaaaagcugcuaaaucu

SEQ ID NO: 1148651 - RNA, 19 nt, Homo sapiens
ugaaauuguugaaguggau

SEQ ID NO: 1148652 - RNA, 19 nt, Homo sapiens
gccuugaacugccagaaga

SEQ ID NO: 1148653 - RNA, 19 nt, Homo sapiens
agaaugagagccaugauau

SEQ ID NO: 1148654 - RNA, 19 nt, Homo sapiens
agacauggcugcacuucgu

SEQ ID NO: 1148655 - RNA, 19 nt, Homo sapiens
caucuuccuucugaucuuu

SEQ ID NO: 1148656 - RNA, 19 nt, Homo sapiens
cagcaaaucacuaguuaag

SEQ ID NO: 1148657 - RNA, 19 nt, Homo sapiens
gccaaguuauuuacaaugg

SEQ ID NO: 1148658 - RNA, 19 nt, Homo sapiens
aggcuggaaucaagaauga

SEQ ID NO: 1148659 - RNA, 19 nt, Homo sapiens
ucacagcaaaucacuaguu

SEQ ID NO: 1148660 - RNA, 19 nt, Homo sapiens
gggcaagagugaucugcau

SEQ ID NO: 1148661 - RNA, 19 nt, Homo sapiens
ccaaucucauuacaauuca

SEQ ID NO: 1148662 - RNA, 19 nt, Homo sapiens
cuacugccaucauacuaau

SEQ ID NO: 1148663 - RNA, 19 nt, Homo sapiens
aagaggcauugauuaaaga

SEQ ID NO: 1148664 - RNA, 19 nt, Homo sapiens
gcaagagugaucugcaugu

SEQ ID NO: 1148665 - RNA, 19 nt, Homo sapiens
caacauuucgccucuucaa

SEQ ID NO: 1148666 - RNA, 19 nt, Homo sapiens
cugccaaucucauuacaau

SEQ ID NO: 1148667 - RNA, 19 nt, Homo sapiens
ggaacuugcuguccuugcu

SEQ ID NO: 1148668 - RNA, 19 nt, Homo sapiens
gaccaaaggccagguggaa

SEQ ID NO: 1148669 - RNA, 19 nt, Homo sapiens
aggcauugauuaaagauuc

SEQ ID NO: 1148670 - RNA, 19 nt, Homo sapiens
aaacaaggaacuggaaaga

SEQ ID NO: 1148671 - RNA, 19 nt, Homo sapiens
aaugagagccaugauauug

SEQ ID NO: 1148672 - RNA, 19 nt, Homo sapiens
agagugaucugcauguuuu

SEQ ID NO: 1148673 - RNA, 19 nt, Homo sapiens
gaagagucugacaguauga

SEQ ID NO: 1148674 - RNA, 19 nt, Homo sapiens
ccaaguuauuuacaaugga

SEQ ID NO: 1148675 - RNA, 19 nt, Homo sapiens
ggcaggugcugaagagauc

SEQ ID NO: 1148676 - RNA, 19 nt, Homo sapiens
gaaguggcagagauugcua

SEQ ID NO: 1148677 - RNA, 19 nt, Homo sapiens
caggaaaggcaucagaaga

SEQ ID NO: 1148678 - RNA, 19 nt, Homo sapiens
gugucuggguggugcuuua

SEQ ID NO: 1148679 - RNA, 19 nt, Homo sapiens
acacgugacuggaauagac

SEQ ID NO: 1148680 - RNA, 19 nt, Homo sapiens
aaaguucuggugccacaua

SEQ ID NO: 1148681 - RNA, 19 nt, Homo sapiens
ucacagauccauuuaagcu

SEQ ID NO: 1148682 - RNA, 19 nt, Homo sapiens
ggaaggugaaauuguugaa

SEQ ID NO: 1148683 - RNA, 19 nt, Homo sapiens
ggucacugccaaucucauu

SEQ ID NO: 1148684 - RNA, 19 nt, Homo sapiens
aaucaggacacacaaaguu

SEQ ID NO: 1148685 - RNA, 19 nt, Homo sapiens
gaacugccagaagaaauca

SEQ ID NO: 1148686 - RNA, 19 nt, Homo sapiens
aagaaugagagccaugaua

SEQ ID NO: 1148687 - RNA, 19 nt, Homo sapiens
ucagaagaaguaacaguug

SEQ ID NO: 1148688 - RNA, 19 nt, Homo sapiens
aggaaaggcaucagaagaa

SEQ ID NO: 1148689 - RNA, 19 nt, Homo sapiens
acgcugagauacagaagga

SEQ ID NO: 1148690 - RNA, 19 nt, Homo sapiens
gaagcaugguggggaguua

SEQ ID NO: 1148691 - RNA, 19 nt, Homo sapiens
uaggaggacuuuugaggua

SEQ ID NO: 1148692 - RNA, 19 nt, Homo sapiens
gaaaggcaucagaagaagu

SEQ ID NO: 1148693 - RNA, 19 nt, Homo sapiens
gaaauggaacagagaagcu

SEQ ID NO: 1148694 - RNA, 19 nt, Homo sapiens
ucacguggcucuuuaguaa

SEQ ID NO: 1148695 - RNA, 19 nt, Homo sapiens
ggauauccguguucaagua

SEQ ID NO: 1148696 - RNA, 19 nt, Homo sapiens
cuaagagucuccugacaaa

SEQ ID NO: 1148697 - RNA, 19 nt, Homo sapiens
uaaccuacaucuuugucua

SEQ ID NO: 1148698 - RNA, 19 nt, Homo sapiens
gcugguaaccuacaucuuu

SEQ ID NO: 1148699 - RNA, 19 nt, Homo sapiens
cauguugucugccuuugua

SEQ ID NO: 1148700 - RNA, 19 nt, Homo sapiens
gcccagagccggaaacuga

SEQ ID NO: 1148701 - RNA, 19 nt, Homo sapiens
gcucgcagcuggugugcuu

SEQ ID NO: 1148702 - RNA, 19 nt, Homo sapiens
uaaagaaacagccucugaa

SEQ ID NO: 1148703 - RNA, 19 nt, Homo sapiens
gaucagaccuuccccuuca

SEQ ID NO: 1148704 - RNA, 19 nt, Homo sapiens
aaagaaacagccucugaaa

SEQ ID NO: 1148705 - RNA, 19 nt, Homo sapiens
gaaacagccucugaaaaga

SEQ ID NO: 1148706 - RNA, 19 nt, Homo sapiens
ccagaccucuuuccucagu

SEQ ID NO: 1148707 - RNA, 19 nt, Homo sapiens
gcuaucaucuuccugucau

SEQ ID NO: 1148708 - RNA, 19 nt, Homo sapiens
gcacgccaguggucagaag

SEQ ID NO: 1148709 - RNA, 19 nt, Homo sapiens
agaccucuuuccucaguaa

SEQ ID NO: 1148710 - RNA, 19 nt, Homo sapiens
gcugagguguccauguugu

SEQ ID NO: 1148711 - RNA, 19 nt, Homo sapiens
gcucuguguuggguacuuu

SEQ ID NO: 1148712 - RNA, 19 nt, Homo sapiens
guugucugccuuuguauaa

SEQ ID NO: 1148713 - RNA, 19 nt, Homo sapiens
gaggauauccguguucaag

SEQ ID NO: 1148714 - RNA, 19 nt, Homo sapiens
gcagaagagggcagcaguu

SEQ ID NO: 1148715 - RNA, 19 nt, Homo sapiens
ggccuaugcucaccuacug

SEQ ID NO: 1148716 - RNA, 19 nt, Homo sapiens
gaggcugugucaucacugu

SEQ ID NO: 1148717 - RNA, 19 nt, Homo sapiens
auaaagaaacagccucuga

SEQ ID NO: 1148718 - RNA, 19 nt, Homo sapiens
ugucgcagcuggugcuugu

SEQ ID NO: 1148719 - RNA, 19 nt, Homo sapiens
gggcagcaguuggcaguag

SEQ ID NO: 1148720 - RNA, 19 nt, Homo sapiens
ugaagguccucccuaagag

SEQ ID NO: 1148721 - RNA, 19 nt, Homo sapiens
ugucaucacugucaaagcu

SEQ ID NO: 1148722 - RNA, 19 nt, Homo sapiens
cagaagagggcagcaguug

SEQ ID NO: 1148723 - RNA, 19 nt, Homo sapiens
cugguaaccuacaucuuug

SEQ ID NO: 1148724 - RNA, 19 nt, Homo sapiens
ugaggaggauauccguguu

SEQ ID NO: 1148725 - RNA, 19 nt, Homo sapiens
gcuggccuaugcucaccua

SEQ ID NO: 1148726 - RNA, 19 nt, Homo sapiens
augcugagguguccauguu

SEQ ID NO: 1148727 - RNA, 19 nt, Homo sapiens
gcgagacguucugccauca

SEQ ID NO: 1148728 - RNA, 19 nt, Homo sapiens
ccuaagagucuccugacaa

SEQ ID NO: 1148729 - RNA, 19 nt, Homo sapiens
cugaagguccucccuaaga

SEQ ID NO: 1148730 - RNA, 19 nt, Homo sapiens
caucuucuccgcuaucauc

SEQ ID NO: 1148731 - RNA, 19 nt, Homo sapiens
gaagguccucccuaagagu

SEQ ID NO: 1148732 - RNA, 19 nt, Homo sapiens
ccucuuuccucaguaaugu

SEQ ID NO: 1148733 - RNA, 19 nt, Homo sapiens
ggaggaugccagagguuuc

SEQ ID NO: 1148734 - RNA, 19 nt, Homo sapiens
cuagggaagucaucucacu

SEQ ID NO: 1148735 - RNA, 19 nt, Homo sapiens
cccaugcccugagagaauu

SEQ ID NO: 1148736 - RNA, 19 nt, Homo sapiens
gugccaugcucgugguuuc

SEQ ID NO: 1148737 - RNA, 19 nt, Homo sapiens
gcaaguuuacaggcuggua

SEQ ID NO: 1148738 - RNA, 19 nt, Homo sapiens
cuucuccgcuaucaucuuc

SEQ ID NO: 1148739 - RNA, 19 nt, Homo sapiens
gaucaaugccccuguuuca

SEQ ID NO: 1148740 - RNA, 19 nt, Homo sapiens
gcuaugugcagaaccacuu

SEQ ID NO: 1148741 - RNA, 19 nt, Homo sapiens
uuauugaacaccucuaugu

SEQ ID NO: 1148742 - RNA, 19 nt, Homo sapiens
gcaugguugugcccucagu

SEQ ID NO: 1148743 - RNA, 19 nt, Homo sapiens
gaggaugccagagguuuca

SEQ ID NO: 1148744 - RNA, 19 nt, Homo sapiens
gcuggcaauuucgagagaa

SEQ ID NO: 1148745 - RNA, 19 nt, Homo sapiens
caaggaacucguggcagaa

SEQ ID NO: 1148746 - RNA, 19 nt, Homo sapiens
agaaacagccucugaaaag

SEQ ID NO: 1148747 - RNA, 19 nt, Homo sapiens
guuggguacuuugaucaau

SEQ ID NO: 1148748 - RNA, 19 nt, Homo sapiens
gcccuggcacgguguauuc

SEQ ID NO: 1148749 - RNA, 19 nt, Homo sapiens
gaggaggauauccguguuc

SEQ ID NO: 1148750 - RNA, 19 nt, Homo sapiens
ccaggccuguguagugucu

SEQ ID NO: 1148751 - RNA, 19 nt, Homo sapiens
caucucacuuggccuucug

SEQ ID NO: 1148752 - RNA, 19 nt, Homo sapiens
gcugugucaucacugucaa

SEQ ID NO: 1148753 - RNA, 19 nt, Homo sapiens
gccaucuucuccgcuauca

SEQ ID NO: 1148754 - RNA, 19 nt, Homo sapiens
gcaggaacuuuaggaauua

SEQ ID NO: 1148755 - RNA, 19 nt, Homo sapiens
aaagaugacuuccuuguuu

SEQ ID NO: 1148756 - RNA, 19 nt, Homo sapiens
gcacagcgauaacuucuuc

SEQ ID NO: 1148757 - RNA, 19 nt, Homo sapiens
gguggacucuuuauuaauu

SEQ ID NO: 1148758 - RNA, 19 nt, Homo sapiens
gauuaaagaugacuuccuu

SEQ ID NO: 1148759 - RNA, 19 nt, Homo sapiens
ggcaagcacuuuaaccuuu

SEQ ID NO: 1148760 - RNA, 19 nt, Homo sapiens
gaagagcaccauauccuuu

SEQ ID NO: 1148761 - RNA, 19 nt, Homo sapiens
gggcaucaguagaagaaua

SEQ ID NO: 1148762 - RNA, 19 nt, Homo sapiens
ucgauuaucuccuaaguga

SEQ ID NO: 1148763 - RNA, 19 nt, Homo sapiens
gagaauaaauugggugauc

SEQ ID NO: 1148764 - RNA, 19 nt, Homo sapiens
ugaauuugcuuucuaccaa

SEQ ID NO: 1148765 - RNA, 19 nt, Homo sapiens
uagccaagcuuugauuaaa

SEQ ID NO: 1148766 - RNA, 19 nt, Homo sapiens
aagguggacucuuuauuaa

SEQ ID NO: 1148767 - RNA, 19 nt, Homo sapiens
gcgauaacuucuucacaug

SEQ ID NO: 1148768 - RNA, 19 nt, Homo sapiens
caucucaacuccaaacugu

SEQ ID NO: 1148769 - RNA, 19 nt, Homo sapiens
ggauauagaagcagcagaa

SEQ ID NO: 1148770 - RNA, 19 nt, Homo sapiens
gcagaaaagucacuacaga

SEQ ID NO: 1148771 - RNA, 19 nt, Homo sapiens
ugcaggaacuuuaggaauu

SEQ ID NO: 1148772 - RNA, 19 nt, Homo sapiens
uaagguguauguagguuau

SEQ ID NO: 1148773 - RNA, 19 nt, Homo sapiens
guuaucaccuacuacuauu

SEQ ID NO: 1148774 - RNA, 19 nt, Homo sapiens
aaaggcaucucaacuccaa

SEQ ID NO: 1148775 - RNA, 19 nt, Homo sapiens
uaaauugggugaucaacac

SEQ ID NO: 1148776 - RNA, 19 nt, Homo sapiens
agaauuuacuggcaaguca

SEQ ID NO: 1148777 - RNA, 19 nt, Homo sapiens
gguuauugcaggaacuuua

SEQ ID NO: 1148778 - RNA, 19 nt, Homo sapiens
gucaugaauuugcuuucua

SEQ ID NO: 1148779 - RNA, 19 nt, Homo sapiens
ggaagagcaccauauccuu

SEQ ID NO: 1148780 - RNA, 19 nt, Homo sapiens
gaauaaauugggugaucaa

SEQ ID NO: 1148781 - RNA, 19 nt, Homo sapiens
acuggcaagucacauguua

SEQ ID NO: 1148782 - RNA, 19 nt, Homo sapiens
uaagugacagugaagauau

SEQ ID NO: 1148783 - RNA, 19 nt, Homo sapiens
gcaagcacuuuaaccuuuu

SEQ ID NO: 1148784 - RNA, 19 nt, Homo sapiens
ggccugaggugguuucucu

SEQ ID NO: 1148785 - RNA, 19 nt, Homo sapiens
agucacauguuaucaccua

SEQ ID NO: 1148786 - RNA, 19 nt, Homo sapiens
gcucaagaaauucgccuuu

SEQ ID NO: 1148787 - RNA, 19 nt, Homo sapiens
uaaagaugacuuccuuguu

SEQ ID NO: 1148788 - RNA, 19 nt, Homo sapiens
gauuaucuccuaagugaca

SEQ ID NO: 1148789 - RNA, 19 nt, Homo sapiens
ccaaacccauagauguguu

SEQ ID NO: 1148790 - RNA, 19 nt, Homo sapiens
ggucaugaauuugcuuucu

SEQ ID NO: 1148791 - RNA, 19 nt, Homo sapiens
cacauguuaucaccuacua

SEQ ID NO: 1148792 - RNA, 19 nt, Homo sapiens
gaccaggauucacccacuu

SEQ ID NO: 1148793 - RNA, 19 nt, Homo sapiens
aagaugacuuccuuguuug

SEQ ID NO: 1148794 - RNA, 19 nt, Homo sapiens
cagugaagauaugagaauu

SEQ ID NO: 1148795 - RNA, 19 nt, Homo sapiens
gauaacuucuucacaugcu

SEQ ID NO: 1148796 - RNA, 19 nt, Homo sapiens
agaauaaauugggugauca

SEQ ID NO: 1148797 - RNA, 19 nt, Homo sapiens
caaacccauagauguguua

SEQ ID NO: 1148798 - RNA, 19 nt, Homo sapiens
cuaccaaacccauagaugu

SEQ ID NO: 1148799 - RNA, 19 nt, Homo sapiens
cuaagugacagugaagaua

SEQ ID NO: 1148800 - RNA, 19 nt, Homo sapiens
cuucagagcauuucacuag

SEQ ID NO: 1148801 - RNA, 19 nt, Homo sapiens
auucuucgauuaucuccua

SEQ ID NO: 1148802 - RNA, 19 nt, Homo sapiens
caggaacuuuaggaauuaa

SEQ ID NO: 1148803 - RNA, 19 nt, Homo sapiens
gcucgggcaagcacuuuaa

SEQ ID NO: 1148804 - RNA, 19 nt, Homo sapiens
gggcaagcacuuuaaccuu

SEQ ID NO: 1148805 - RNA, 19 nt, Homo sapiens
ggugaucaacacacagaaa

SEQ ID NO: 1148806 - RNA, 19 nt, Homo sapiens
ugacagugaagauaugaga

SEQ ID NO: 1148807 - RNA, 19 nt, Homo sapiens
gauauagaagcagcagaaa

SEQ ID NO: 1148808 - RNA, 19 nt, Homo sapiens
guuaagguguauguagguu

SEQ ID NO: 1148809 - RNA, 19 nt, Homo sapiens
cuucacaugcuauuucaaa

SEQ ID NO: 1148810 - RNA, 19 nt, Homo sapiens
ucaugaauuugcuuucuac

SEQ ID NO: 1148811 - RNA, 19 nt, Homo sapiens
gcagaaaauaccauucaaa

SEQ ID NO: 1148812 - RNA, 19 nt, Homo sapiens
ggcaucaguagaagaauau

SEQ ID NO: 1148813 - RNA, 19 nt, Homo sapiens
gaugaguugccugcaguuu

SEQ ID NO: 1148814 - RNA, 19 nt, Homo sapiens
ggaacaguuucuuuuagga

SEQ ID NO: 1148815 - RNA, 19 nt, Homo sapiens
caaaugggaacaguuucuu

SEQ ID NO: 1148816 - RNA, 19 nt, Homo sapiens
caagcacuuuaaccuuuua

SEQ ID NO: 1148817 - RNA, 19 nt, Homo sapiens
ucuccuaagugacagugaa

SEQ ID NO: 1148818 - RNA, 19 nt, Homo sapiens
aaaugaggcacagcgauaa

SEQ ID NO: 1148819 - RNA, 19 nt, Homo sapiens
ugaguugccugcaguuuug

SEQ ID NO: 1148820 - RNA, 19 nt, Homo sapiens
gaauguuaagguguaugua

SEQ ID NO: 1148821 - RNA, 19 nt, Homo sapiens
uuaaagaugacuuccuugu

SEQ ID NO: 1148822 - RNA, 19 nt, Homo sapiens
gaacaguuucuuuuaggaa

SEQ ID NO: 1148823 - RNA, 19 nt, Homo sapiens
ucagagcauuucacuagac

SEQ ID NO: 1148824 - RNA, 19 nt, Homo sapiens
uaucaccuacuacuauuuc

SEQ ID NO: 1148825 - RNA, 19 nt, Homo sapiens
gcaagucacauguuaucac

SEQ ID NO: 1148826 - RNA, 19 nt, Homo sapiens
gcugaauguuaagguguau

SEQ ID NO: 1148827 - RNA, 19 nt, Homo sapiens
aaaugggaacaguuucuuu

SEQ ID NO: 1148828 - RNA, 19 nt, Homo sapiens
uaccaaacccauagaugug

SEQ ID NO: 1148829 - RNA, 19 nt, Homo sapiens
uguuaucaccuacuacuau

SEQ ID NO: 1148830 - RNA, 19 nt, Homo sapiens
ggaggccuucagagcauuu

SEQ ID NO: 1148831 - RNA, 19 nt, Homo sapiens
uuaagguguauguagguua

SEQ ID NO: 1148832 - RNA, 19 nt, Homo sapiens
caaauggagaauaaauugg

SEQ ID NO: 1148833 - RNA, 19 nt, Homo sapiens
uaacuucuucacaugcuau

SEQ ID NO: 1148834 - RNA, 19 nt, Homo sapiens
agcgauaacuucuucacau

SEQ ID NO: 1148835 - RNA, 19 nt, Homo sapiens
aaaaugaggcacagcgaua

SEQ ID NO: 1148836 - RNA, 19 nt, Homo sapiens
ccaaaugggaacaguuucu

SEQ ID NO: 1148837 - RNA, 19 nt, Homo sapiens
cugaggugguuucucuuga

SEQ ID NO: 1148838 - RNA, 19 nt, Homo sapiens
ugaggugguuucucuugag

SEQ ID NO: 1148839 - RNA, 19 nt, Homo sapiens
aaacuguugagacugcuuu

SEQ ID NO: 1148840 - RNA, 19 nt, Homo sapiens
acccauagauguguuaaac

SEQ ID NO: 1148841 - RNA, 19 nt, Homo sapiens
uuagccaagcuuugauuaa

SEQ ID NO: 1148842 - RNA, 19 nt, Homo sapiens
acagugaagauaugagaau

SEQ ID NO: 1148843 - RNA, 19 nt, Homo sapiens
gacagugaagauaugagaa

SEQ ID NO: 1148844 - RNA, 19 nt, Homo sapiens
ugaauguuaagguguaugu

SEQ ID NO: 1148845 - RNA, 19 nt, Homo sapiens
gaggcacagcgauaacuuc

SEQ ID NO: 1148846 - RNA, 19 nt, Homo sapiens
ucacuacagaccaggauuc

SEQ ID NO: 1148847 - RNA, 19 nt, Homo sapiens
gagaauuuacuggcaaguc

SEQ ID NO: 1148848 - RNA, 19 nt, Homo sapiens
aagugacagugaagauaug

SEQ ID NO: 1148849 - RNA, 19 nt, Homo sapiens
acuccaaacuguugagacu

SEQ ID NO: 1148850 - RNA, 19 nt, Homo sapiens
gaaaggcaaugacaaguuu

SEQ ID NO: 1148851 - RNA, 19 nt, Homo sapiens
gaacugauuugaccucgaa

SEQ ID NO: 1148852 - RNA, 19 nt, Homo sapiens
guccaaagaucucaaagua

SEQ ID NO: 1148853 - RNA, 19 nt, Homo sapiens
gcacuuugcucuuuuaaua

SEQ ID NO: 1148854 - RNA, 19 nt, Homo sapiens
cagcagagcucaagauugu

SEQ ID NO: 1148855 - RNA, 19 nt, Homo sapiens
cgacagaggugugaauaaa

SEQ ID NO: 1148856 - RNA, 19 nt, Homo sapiens
caacagacucuuaaacuaa

SEQ ID NO: 1148857 - RNA, 19 nt, Homo sapiens
cagaggagguuucaaagaa

SEQ ID NO: 1148858 - RNA, 19 nt, Homo sapiens
ggaaacaacagacucuuaa

SEQ ID NO: 1148859 - RNA, 19 nt, Homo sapiens
ccaaagaucucaaaguaag

SEQ ID NO: 1148860 - RNA, 19 nt, Homo sapiens
cagcagagaaguauuauuu

SEQ ID NO: 1148861 - RNA, 19 nt, Homo sapiens
uauauaagcucaugguaga

SEQ ID NO: 1148862 - RNA, 19 nt, Homo sapiens
gcuaauccgucguucuuaa

SEQ ID NO: 1148863 - RNA, 19 nt, Homo sapiens
guagaagaauuucaaggaa

SEQ ID NO: 1148864 - RNA, 19 nt, Homo sapiens
gagaggggcuccaauauuu

SEQ ID NO: 1148865 - RNA, 19 nt, Homo sapiens
ggaauacaaagaugagaua

SEQ ID NO: 1148866 - RNA, 19 nt, Homo sapiens
gaugauaccgaaaugcuua

SEQ ID NO: 1148867 - RNA, 19 nt, Homo sapiens
gaaauaggcauaucaaggu

SEQ ID NO: 1148868 - RNA, 19 nt, Homo sapiens
gcagagaaguauuauuugg

SEQ ID NO: 1148869 - RNA, 19 nt, Homo sapiens
ggaagcaccaugaauuaaa

SEQ ID NO: 1148870 - RNA, 19 nt, Homo sapiens
ugacagcagagaaguauua

SEQ ID NO: 1148871 - RNA, 19 nt, Homo sapiens
gcagagccaucgcaucaug

SEQ ID NO: 1148872 - RNA, 19 nt, Homo sapiens
gcaaaggcauaucaguuca

SEQ ID NO: 1148873 - RNA, 19 nt, Homo sapiens
uaacaaaucguccaaagau

SEQ ID NO: 1148874 - RNA, 19 nt, Homo sapiens
gugcaaauauucaguaugg

SEQ ID NO: 1148875 - RNA, 19 nt, Homo sapiens
gaaaucggauggagaacca

SEQ ID NO: 1148876 - RNA, 19 nt, Homo sapiens
acaacagacucuuaaacua

SEQ ID NO: 1148877 - RNA, 19 nt, Homo sapiens
gaagcaccaugaauuaaag

SEQ ID NO: 1148878 - RNA, 19 nt, Homo sapiens
aaaacaagguccaguaaua

SEQ ID NO: 1148879 - RNA, 19 nt, Homo sapiens
gggcagaggccaugaagaa

SEQ ID NO: 1148880 - RNA, 19 nt, Homo sapiens
gagauuaccaggcagauga

SEQ ID NO: 1148881 - RNA, 19 nt, Homo sapiens
ccaguaauagcaagucuua

SEQ ID NO: 1148882 - RNA, 19 nt, Homo sapiens
gcagagagggaacagcaua

SEQ ID NO: 1148883 - RNA, 19 nt, Homo sapiens
gagggaagcaccaugaauu

SEQ ID NO: 1148884 - RNA, 19 nt, Homo sapiens
gcaaauauucaguaugguu

SEQ ID NO: 1148885 - RNA, 19 nt, Homo sapiens
ggucagaggagguuucaaa

SEQ ID NO: 1148886 - RNA, 19 nt, Homo sapiens
guaauagcaagucuuagua

SEQ ID NO: 1148887 - RNA, 19 nt, Homo sapiens
gaaacaacagacucuuaaa

SEQ ID NO: 1148888 - RNA, 19 nt, Homo sapiens
ugacagugccaauaaauga

SEQ ID NO: 1148889 - RNA, 19 nt, Homo sapiens
cuuaguacauccucacuuu

SEQ ID NO: 1148890 - RNA, 19 nt, Homo sapiens
gaucgggaauacaaagaug

SEQ ID NO: 1148891 - RNA, 19 nt, Homo sapiens
caacgugguuuccuuguac

SEQ ID NO: 1148892 - RNA, 19 nt, Homo sapiens
guucacaaguaaucuguug

SEQ ID NO: 1148893 - RNA, 19 nt, Homo sapiens
cuacauaccuacaccuauc

SEQ ID NO: 1148894 - RNA, 19 nt, Homo sapiens
gaaaauuccagagcuauua

SEQ ID NO: 1148895 - RNA, 19 nt, Homo sapiens
gcaaaccaaaccauuauuc

SEQ ID NO: 1148896 - RNA, 19 nt, Homo sapiens
gagacacucugggaacuga

SEQ ID NO: 1148897 - RNA, 19 nt, Homo sapiens
uuaaaucuguuuccugugu

SEQ ID NO: 1148898 - RNA, 19 nt, Homo sapiens
gguagaagaauuucaagga

SEQ ID NO: 1148899 - RNA, 19 nt, Homo sapiens
gagcuauuauuuacuccuu

SEQ ID NO: 1148900 - RNA, 19 nt, Homo sapiens
gcaaugacaaguuuaacau

SEQ ID NO: 1148901 - RNA, 19 nt, Homo sapiens
gugccuugguugacuauuu

SEQ ID NO: 1148902 - RNA, 19 nt, Homo sapiens
ccuguuaaaugucaaccua

SEQ ID NO: 1148903 - RNA, 19 nt, Homo sapiens
caggaguucugccagguuu

SEQ ID NO: 1148904 - RNA, 19 nt, Homo sapiens
ucaacgugguuuccuugua

SEQ ID NO: 1148905 - RNA, 19 nt, Homo sapiens
ggaccugggugggaggaaa

SEQ ID NO: 1148906 - RNA, 19 nt, Homo sapiens
ccagagcuauuauuuacuc

SEQ ID NO: 1148907 - RNA, 19 nt, Homo sapiens
cagcagagccaucgcauca

SEQ ID NO: 1148908 - RNA, 19 nt, Homo sapiens
aaaucuguuuccuguguua

SEQ ID NO: 1148909 - RNA, 19 nt, Homo sapiens
gcacugacagagaaaugaa

SEQ ID NO: 1148910 - RNA, 19 nt, Homo sapiens
gaucucaaaguaaggguuu

SEQ ID NO: 1148911 - RNA, 19 nt, Homo sapiens
ugacugaguauggagauua

SEQ ID NO: 1148912 - RNA, 19 nt, Homo sapiens
ggcuuuagguagaagaauu

SEQ ID NO: 1148913 - RNA, 19 nt, Homo sapiens
aaaguggccuguugguuca

SEQ ID NO: 1148914 - RNA, 19 nt, Homo sapiens
gcucaagauuguagaaacu

SEQ ID NO: 1148915 - RNA, 19 nt, Homo sapiens
ccagccaaguggugaugua

SEQ ID NO: 1148916 - RNA, 19 nt, Homo sapiens
gggaagcaccaugaauuaa

SEQ ID NO: 1148917 - RNA, 19 nt, Homo sapiens
gaaugaaaggcaaugacaa

SEQ ID NO: 1148918 - RNA, 19 nt, Homo sapiens
gaagaaugaaaggcaauga

SEQ ID NO: 1148919 - RNA, 19 nt, Homo sapiens
uagcaagucuuaguacauc

SEQ ID NO: 1148920 - RNA, 19 nt, Homo sapiens
cagaggccaugaagaagug

SEQ ID NO: 1148921 - RNA, 19 nt, Homo sapiens
gggaacagcauaugcaaag

SEQ ID NO: 1148922 - RNA, 19 nt, Homo sapiens
ggaguucugccagguuuaa

SEQ ID NO: 1148923 - RNA, 19 nt, Homo sapiens
ugagaugacugaguaugga

SEQ ID NO: 1148924 - RNA, 19 nt, Homo sapiens
uuccugagaugacugagua

SEQ ID NO: 1148925 - RNA, 19 nt, Homo sapiens
ccuccucccuguuaaaugu

SEQ ID NO: 1148926 - RNA, 19 nt, Homo sapiens
ccugaaaacuuuagcauug

SEQ ID NO: 1148927 - RNA, 19 nt, Homo sapiens
caaaccaaaccauuauuca

SEQ ID NO: 1148928 - RNA, 19 nt, Homo sapiens
guacuugauccuccugaaa

SEQ ID NO: 1148929 - RNA, 19 nt, Homo sapiens
aaucauugcuggacuggau

SEQ ID NO: 1148930 - RNA, 19 nt, Homo sapiens
gcagaggccaugaagaagu

SEQ ID NO: 1148931 - RNA, 19 nt, Homo sapiens
gcagagcucaagauuguag

SEQ ID NO: 1148932 - RNA, 19 nt, Homo sapiens
caggaaaucggauggagaa

SEQ ID NO: 1148933 - RNA, 19 nt, Homo sapiens
ugaaaggcaaugacaaguu

SEQ ID NO: 1148934 - RNA, 19 nt, Homo sapiens
gaccucgaaugcuccuaaa

SEQ ID NO: 1148935 - RNA, 19 nt, Homo sapiens
guguuagucaguauucuua

SEQ ID NO: 1148936 - RNA, 19 nt, Homo sapiens
uguaacggaugaccauaug

SEQ ID NO: 1148937 - RNA, 19 nt, Homo sapiens
auaaugaguuccugagaca

SEQ ID NO: 1148938 - RNA, 19 nt, Homo sapiens
uggaaacaacagacucuua

SEQ ID NO: 1148939 - RNA, 19 nt, Homo sapiens
aauaacaaaucguccaaag

SEQ ID NO: 1148940 - RNA, 19 nt, Homo sapiens
aaauaggcauaucaagguu

SEQ ID NO: 1148941 - RNA, 19 nt, Homo sapiens
uaccuacaccuaucuauau

SEQ ID NO: 1148942 - RNA, 19 nt, Homo sapiens
ccgacagucuggaaaugaa

SEQ ID NO: 1148943 - RNA, 19 nt, Homo sapiens
uuuauuggcuuaaguaugc

SEQ ID NO: 1148944 - RNA, 19 nt, Homo sapiens
gaaacuguagccugagugu

SEQ ID NO: 1148945 - RNA, 19 nt, Homo sapiens
agggaagcaccaugaauua

SEQ ID NO: 1148946 - RNA, 19 nt, Homo sapiens
gcagaaugagccagaguuc

SEQ ID NO: 1148947 - RNA, 19 nt, Homo sapiens
gcaagguuuuccucauuuu

SEQ ID NO: 1148948 - RNA, 19 nt, Homo sapiens
uaaaucuguuuccuguguu

SEQ ID NO: 1148949 - RNA, 19 nt, Homo sapiens
agaaaaccauagcuaagua

SEQ ID NO: 1148950 - RNA, 19 nt, Homo sapiens
ucaaaccacuucuaaauga

SEQ ID NO: 1148951 - RNA, 19 nt, Homo sapiens
gaagggugccuguuacaua

SEQ ID NO: 1148952 - RNA, 19 nt, Homo sapiens
gcagagaccuggagaucga

SEQ ID NO: 1148953 - RNA, 19 nt, Homo sapiens
gaucaaaccacuucuaaau

SEQ ID NO: 1148954 - RNA, 19 nt, Homo sapiens
gaccauugauugauuguga

SEQ ID NO: 1148955 - RNA, 19 nt, Homo sapiens
gcaaguccauccuucaaau

SEQ ID NO: 1148956 - RNA, 19 nt, Homo sapiens
ucaggaacaugauauagaa

SEQ ID NO: 1148957 - RNA, 19 nt, Homo sapiens
gaauuaggcagaacagauu

SEQ ID NO: 1148958 - RNA, 19 nt, Homo sapiens
gaaugcauauugcccaaga

SEQ ID NO: 1148959 - RNA, 19 nt, Homo sapiens
gcuaaaggcuggauugacu

SEQ ID NO: 1148960 - RNA, 19 nt, Homo sapiens
gagaucaaaccacuucuaa

SEQ ID NO: 1148961 - RNA, 19 nt, Homo sapiens
caagaaacuuccaggacuu

SEQ ID NO: 1148962 - RNA, 19 nt, Homo sapiens
gaauuucuguauacucuuc

SEQ ID NO: 1148963 - RNA, 19 nt, Homo sapiens
cagaguuacugauuuauuc

SEQ ID NO: 1148964 - RNA, 19 nt, Homo sapiens
aaacuggccucuacuaucu

SEQ ID NO: 1148965 - RNA, 19 nt, Homo sapiens
ucaaaugaccacuccauaa

SEQ ID NO: 1148966 - RNA, 19 nt, Homo sapiens
gauaagaaugguacaagaa

SEQ ID NO: 1148967 - RNA, 19 nt, Homo sapiens
caacaucuuuagcugauca

SEQ ID NO: 1148968 - RNA, 19 nt, Homo sapiens
caaaugaccacuccauaau

SEQ ID NO: 1148969 - RNA, 19 nt, Homo sapiens
gcagaagggugccuguuac

SEQ ID NO: 1148970 - RNA, 19 nt, Homo sapiens
gagagcagcuuugaggaau

SEQ ID NO: 1148971 - RNA, 19 nt, Homo sapiens
gcaaauuggucaacaaaau

SEQ ID NO: 1148972 - RNA, 19 nt, Homo sapiens
ccacgucacuauuggaguu

SEQ ID NO: 1148973 - RNA, 19 nt, Homo sapiens
gugcauaguucugugguuu

SEQ ID NO: 1148974 - RNA, 19 nt, Homo sapiens
cgccugaacccuauaaaua

SEQ ID NO: 1148975 - RNA, 19 nt, Homo sapiens
gauccaaaccuacagaaug

SEQ ID NO: 1148976 - RNA, 19 nt, Homo sapiens
ccauggagguguccugcua

SEQ ID NO: 1148977 - RNA, 19 nt, Homo sapiens
cugcagcucuucuugaauu

SEQ ID NO: 1148978 - RNA, 19 nt, Homo sapiens
ggaacaugauauagaaaca

SEQ ID NO: 1148979 - RNA, 19 nt, Homo sapiens
ggaauuaggcagaacagau

SEQ ID NO: 1148980 - RNA, 19 nt, Homo sapiens
caaacucucuggccugaca

SEQ ID NO: 1148981 - RNA, 19 nt, Homo sapiens
ucaccgaggccuucaagua

SEQ ID NO: 1148982 - RNA, 19 nt, Homo sapiens
ggagaucgaaagacccaua

SEQ ID NO: 1148983 - RNA, 19 nt, Homo sapiens
gaaccacuuccaugccaua

SEQ ID NO: 1148984 - RNA, 19 nt, Homo sapiens
ccacugaaccucucucuag

SEQ ID NO: 1148985 - RNA, 19 nt, Homo sapiens
aaugaccacuccauaauau

SEQ ID NO: 1148986 - RNA, 19 nt, Homo sapiens
gaacucaagaauccuguga

SEQ ID NO: 1148987 - RNA, 19 nt, Homo sapiens
gcagggaaugggcuacaua

SEQ ID NO: 1148988 - RNA, 19 nt, Homo sapiens
ggaaggccuugugcucauu

SEQ ID NO: 1148989 - RNA, 19 nt, Homo sapiens
ugaccacuccauaauauaa

SEQ ID NO: 1148990 - RNA, 19 nt, Homo sapiens
gaaacuuccaggacuuuga

SEQ ID NO: 1148991 - RNA, 19 nt, Homo sapiens
gagcagcuuugaggaaugu

SEQ ID NO: 1148992 - RNA, 19 nt, Homo sapiens
uagacacgcuuucuuguag

SEQ ID NO: 1148993 - RNA, 19 nt, Homo sapiens
ugauaagaaugguacaaga

SEQ ID NO: 1148994 - RNA, 19 nt, Homo sapiens
gaaggccuugugcucauua

SEQ ID NO: 1148995 - RNA, 19 nt, Homo sapiens
ggacaauucgccugcaguu

SEQ ID NO: 1148996 - RNA, 19 nt, Homo sapiens
cccaagacaucaaccaaga

SEQ ID NO: 1148997 - RNA, 19 nt, Homo sapiens
gagcacgcgugucuguguu

SEQ ID NO: 1148998 - RNA, 19 nt, Homo sapiens
ccacuuccaugccauacug

SEQ ID NO: 1148999 - RNA, 19 nt, Homo sapiens
aaaugaccacuccauaaua

SEQ ID NO: 1149000 - RNA, 19 nt, Homo sapiens
gcauaguucugugguuuua

SEQ ID NO: 1149001 - RNA, 19 nt, Homo sapiens
acaauucgccugcaguuga

SEQ ID NO: 1149002 - RNA, 19 nt, Homo sapiens
uagccuggauuuaucauuc

SEQ ID NO: 1149003 - RNA, 19 nt, Homo sapiens
cuaguagccuggauuuauc

SEQ ID NO: 1149004 - RNA, 19 nt, Homo sapiens
gcauauugcccaagacauc

SEQ ID NO: 1149005 - RNA, 19 nt, Homo sapiens
caaaccacuucuaaaugau

SEQ ID NO: 1149006 - RNA, 19 nt, Homo sapiens
guaacauuccaacaucuuu

SEQ ID NO: 1149007 - RNA, 19 nt, Homo sapiens
guaaacuggccucuacuau

SEQ ID NO: 1149008 - RNA, 19 nt, Homo sapiens
gauauagaaacaacucaug

SEQ ID NO: 1149009 - RNA, 19 nt, Homo sapiens
gcacgcgugucuguguuug

SEQ ID NO: 1149010 - RNA, 19 nt, Homo sapiens
ucagucagauggaacucaa

SEQ ID NO: 1149011 - RNA, 19 nt, Homo sapiens
ccucggcucuggagaaagu

SEQ ID NO: 1149012 - RNA, 19 nt, Homo sapiens
ugacugggcagcuuccaaa

SEQ ID NO: 1149013 - RNA, 19 nt, Homo sapiens
gccuugugcucauuaaugu

SEQ ID NO: 1149014 - RNA, 19 nt, Homo sapiens
guaggccacugcauucucu

SEQ ID NO: 1149015 - RNA, 19 nt, Homo sapiens
acucaugcauggccacuga

SEQ ID NO: 1149016 - RNA, 19 nt, Homo sapiens
cagcagauuugcacucaac

SEQ ID NO: 1149017 - RNA, 19 nt, Homo sapiens
aaagugauuucaggagaga

SEQ ID NO: 1149018 - RNA, 19 nt, Homo sapiens
uaaacuggccucuacuauc

SEQ ID NO: 1149019 - RNA, 19 nt, Homo sapiens
ucuaguagccuggauuuau

SEQ ID NO: 1149020 - RNA, 19 nt, Homo sapiens
ccugaacccuauaaauaca

SEQ ID NO: 1149021 - RNA, 19 nt, Homo sapiens
gggccaaaaugauaacaaa

SEQ ID NO: 1149022 - RNA, 19 nt, Homo sapiens
gaucgaaagacccauacug

SEQ ID NO: 1149023 - RNA, 19 nt, Homo sapiens
uaagaaugguacaagaaac

SEQ ID NO: 1149024 - RNA, 19 nt, Homo sapiens
ccucuacucucguuaucug

SEQ ID NO: 1149025 - RNA, 19 nt, Homo sapiens
ucuggaccauugauugauu

SEQ ID NO: 1149026 - RNA, 19 nt, Homo sapiens
gauguucagcucacagaga

SEQ ID NO: 1149027 - RNA, 19 nt, Homo sapiens
uuagacacgcuuucuugua

SEQ ID NO: 1149028 - RNA, 19 nt, Homo sapiens
aagggugccuguuacauag

SEQ ID NO: 1149029 - RNA, 19 nt, Homo sapiens
uauccucucuugccagcuu

SEQ ID NO: 1149030 - RNA, 19 nt, Homo sapiens
cugaaccucucucuaguag

SEQ ID NO: 1149031 - RNA, 19 nt, Homo sapiens
cuacuaucuuuaacucaug

SEQ ID NO: 1149032 - RNA, 19 nt, Homo sapiens
gggaaugggcuacauacca

SEQ ID NO: 1149033 - RNA, 19 nt, Homo sapiens
uauuuuggcucaucacuuu

SEQ ID NO: 1149034 - RNA, 19 nt, Homo sapiens
ucucuggccugacaaccaa

SEQ ID NO: 1149035 - RNA, 19 nt, Homo sapiens
ugaggaauguggaaaauca

SEQ ID NO: 1149036 - RNA, 19 nt, Homo sapiens
gacacgcuuucuuguagug

SEQ ID NO: 1149037 - RNA, 19 nt, Homo sapiens
ucagauggaacucaagaau

SEQ ID NO: 1149038 - RNA, 19 nt, Homo sapiens
cuucuugaauuccuacaau

SEQ ID NO: 1149039 - RNA, 19 nt, Homo sapiens
caagacaucaaccaagaca

SEQ ID NO: 1149040 - RNA, 19 nt, Homo sapiens
caaaccuacagaaugcaua

SEQ ID NO: 1149041 - RNA, 19 nt, Homo sapiens
gauugauugugaccaguag

SEQ ID NO: 1149042 - RNA, 19 nt, Homo sapiens
uuaagggaauuaggcagaa

SEQ ID NO: 1149043 - RNA, 19 nt, Homo sapiens
gucaggaacaugauauaga

SEQ ID NO: 1149044 - RNA, 19 nt, Homo sapiens
caaccugcagcucuucuug

SEQ ID NO: 1149045 - RNA, 19 nt, Homo sapiens
ucagaucucuccauauccu

SEQ ID NO: 1149046 - RNA, 19 nt, Homo sapiens
ccucuacuaucuuuaacuc

SEQ ID NO: 1149047 - RNA, 19 nt, Homo sapiens
cucguuaucugaccucaug

SEQ ID NO: 1149048 - RNA, 19 nt, Homo sapiens
agauggaacucaagaaucc

SEQ ID NO: 1149049 - RNA, 19 nt, Homo sapiens
ggccuugugcucauuaaug

SEQ ID NO: 1149050 - RNA, 19 nt, Homo sapiens
ucaaaccacuucuaaauga

SEQ ID NO: 1149051 - RNA, 19 nt, Homo sapiens
gaacagccauuaacacagu

SEQ ID NO: 1149052 - RNA, 19 nt, Homo sapiens
gaagggugccuguuacaua

SEQ ID NO: 1149053 - RNA, 19 nt, Homo sapiens
ccagcuaaguuauguauuu

SEQ ID NO: 1149054 - RNA, 19 nt, Homo sapiens
gagugaaugugguuuaauu

SEQ ID NO: 1149055 - RNA, 19 nt, Homo sapiens
gcagagaccuggagaucga

SEQ ID NO: 1149056 - RNA, 19 nt, Homo sapiens
gaucaaaccacuucuaaau

SEQ ID NO: 1149057 - RNA, 19 nt, Homo sapiens
aaacagaccaguuauacua

SEQ ID NO: 1149058 - RNA, 19 nt, Homo sapiens
gaccauugauugauuguga

SEQ ID NO: 1149059 - RNA, 19 nt, Homo sapiens
gcaaguccauccuucaaau

SEQ ID NO: 1149060 - RNA, 19 nt, Homo sapiens
ucaggaacaugauauagaa

SEQ ID NO: 1149061 - RNA, 19 nt, Homo sapiens
aaauaaagcugcauauguc

SEQ ID NO: 1149062 - RNA, 19 nt, Homo sapiens
aaaggaaacagaccaguua

SEQ ID NO: 1149063 - RNA, 19 nt, Homo sapiens
gaauuaggcagaacagauu

SEQ ID NO: 1149064 - RNA, 19 nt, Homo sapiens
gaaugcauauugcccaaga

SEQ ID NO: 1149065 - RNA, 19 nt, Homo sapiens
acaggaagguggaaacaaa

SEQ ID NO: 1149066 - RNA, 19 nt, Homo sapiens
gagaaagggccaaucugua

SEQ ID NO: 1149067 - RNA, 19 nt, Homo sapiens
gaaugugguuuaauuacug

SEQ ID NO: 1149068 - RNA, 19 nt, Homo sapiens
gacauuggccucaaccaua

SEQ ID NO: 1149069 - RNA, 19 nt, Homo sapiens
gcuaaaggcuggauugacu

SEQ ID NO: 1149070 - RNA, 19 nt, Homo sapiens
cauaaauccuguuucaaug

SEQ ID NO: 1149071 - RNA, 19 nt, Homo sapiens
gagaucaaaccacuucuaa

SEQ ID NO: 1149072 - RNA, 19 nt, Homo sapiens
gcauaugucucauuguuac

SEQ ID NO: 1149073 - RNA, 19 nt, Homo sapiens
caagaaacuuccaggacuu

SEQ ID NO: 1149074 - RNA, 19 nt, Homo sapiens
gaauuucuguauacucuuc

SEQ ID NO: 1149075 - RNA, 19 nt, Homo sapiens
cagaguuacugauuuauuc

SEQ ID NO: 1149076 - RNA, 19 nt, Homo sapiens
ggagaccaacuaccacaua

SEQ ID NO: 1149077 - RNA, 19 nt, Homo sapiens
aaacuggccucuacuaucu

SEQ ID NO: 1149078 - RNA, 19 nt, Homo sapiens
ucaaaugaccacuccauaa

SEQ ID NO: 1149079 - RNA, 19 nt, Homo sapiens
gauaagaaugguacaagaa

SEQ ID NO: 1149080 - RNA, 19 nt, Homo sapiens
caacaucuuuagcugauca

SEQ ID NO: 1149081 - RNA, 19 nt, Homo sapiens
caaaugaccacuccauaau

SEQ ID NO: 1149082 - RNA, 19 nt, Homo sapiens
gccauuagaaagauuguua

SEQ ID NO: 1149083 - RNA, 19 nt, Homo sapiens
gcagaagggugccuguuac

SEQ ID NO: 1149084 - RNA, 19 nt, Homo sapiens
gagagcagcuuugaggaau

SEQ ID NO: 1149085 - RNA, 19 nt, Homo sapiens
gcaaauuggucaacaaaau

SEQ ID NO: 1149086 - RNA, 19 nt, Homo sapiens
gaaaugcugccuccuguuc

SEQ ID NO: 1149087 - RNA, 19 nt, Homo sapiens
uggaugagcuggcugaaau

SEQ ID NO: 1149088 - RNA, 19 nt, Homo sapiens
uaacauaucaugacauugg

SEQ ID NO: 1149089 - RNA, 19 nt, Homo sapiens
gugcauaguucugugguuu

SEQ ID NO: 1149090 - RNA, 19 nt, Homo sapiens
cgccugaacccuauaaaua

SEQ ID NO: 1149091 - RNA, 19 nt, Homo sapiens
gauccaaaccuacagaaug

SEQ ID NO: 1149092 - RNA, 19 nt, Homo sapiens
ggagaggaacagccauuaa

SEQ ID NO: 1149093 - RNA, 19 nt, Homo sapiens
ccauggagguguccugcua

SEQ ID NO: 1149094 - RNA, 19 nt, Homo sapiens
cugcagcucuucuugaauu

SEQ ID NO: 1149095 - RNA, 19 nt, Homo sapiens
gcacuuugcugucugucau

SEQ ID NO: 1149096 - RNA, 19 nt, Homo sapiens
ggaacaugauauagaaaca

SEQ ID NO: 1149097 - RNA, 19 nt, Homo sapiens
ggaauuaggcagaacagau

SEQ ID NO: 1149098 - RNA, 19 nt, Homo sapiens
caaacucucuggccugaca

SEQ ID NO: 1149099 - RNA, 19 nt, Homo sapiens
ggaaacagaccaguuauac

SEQ ID NO: 1149100 - RNA, 19 nt, Homo sapiens
ucaccgaggccuucaagua

SEQ ID NO: 1149101 - RNA, 19 nt, Homo sapiens
ggagaucgaaagacccaua

SEQ ID NO: 1149102 - RNA, 19 nt, Homo sapiens
ccauaaauccuguuucaau

SEQ ID NO: 1149103 - RNA, 19 nt, Homo sapiens
acauuggccucaaccauaa

SEQ ID NO: 1149104 - RNA, 19 nt, Homo sapiens
uaguagagauggaguuuca

SEQ ID NO: 1149105 - RNA, 19 nt, Homo sapiens
gaaccacuuccaugccaua

SEQ ID NO: 1149106 - RNA, 19 nt, Homo sapiens
ccacugaaccucucucuag

SEQ ID NO: 1149107 - RNA, 19 nt, Homo sapiens
aaugaccacuccauaauau

SEQ ID NO: 1149108 - RNA, 19 nt, Homo sapiens
gaacucaagaauccuguga

SEQ ID NO: 1149109 - RNA, 19 nt, Homo sapiens
gauaccagacauccacaua

SEQ ID NO: 1149110 - RNA, 19 nt, Homo sapiens
gcagggaaugggcuacaua

SEQ ID NO: 1149111 - RNA, 19 nt, Homo sapiens
ggaaggccuugugcucauu

SEQ ID NO: 1149112 - RNA, 19 nt, Homo sapiens
cugcauaugucucauuguu

SEQ ID NO: 1149113 - RNA, 19 nt, Homo sapiens
ggaaggggcuuuucagaca

SEQ ID NO: 1149114 - RNA, 19 nt, Homo sapiens
ugaccacuccauaauauaa

SEQ ID NO: 1149115 - RNA, 19 nt, Homo sapiens
gaaacuuccaggacuuuga

SEQ ID NO: 1149116 - RNA, 19 nt, Homo sapiens
gagaccaacuaccacauag

SEQ ID NO: 1149117 - RNA, 19 nt, Homo sapiens
ccaaagugcugggauuaca

SEQ ID NO: 1149118 - RNA, 19 nt, Homo sapiens
ugauaagaaugguacaaga

SEQ ID NO: 1149119 - RNA, 19 nt, Homo sapiens
ccacauauccacaagaagu

SEQ ID NO: 1149120 - RNA, 19 nt, Homo sapiens
gagcagcuuugaggaaugu

SEQ ID NO: 1149121 - RNA, 19 nt, Homo sapiens
uagacacgcuuucuuguag

SEQ ID NO: 1149122 - RNA, 19 nt, Homo sapiens
gaaggccuugugcucauua

SEQ ID NO: 1149123 - RNA, 19 nt, Homo sapiens
gcucaggguuacacaguuc

SEQ ID NO: 1149124 - RNA, 19 nt, Homo sapiens
gagguucugauacaacaua

SEQ ID NO: 1149125 - RNA, 19 nt, Homo sapiens
ggacaauucgccugcaguu

SEQ ID NO: 1149126 - RNA, 19 nt, Homo sapiens
aaccauaaauccuguuuca

SEQ ID NO: 1149127 - RNA, 19 nt, Homo sapiens
caaaggaaacagaccaguu

SEQ ID NO: 1149128 - RNA, 19 nt, Homo sapiens
uuacacaguuccaaaucuu

SEQ ID NO: 1149129 - RNA, 19 nt, Homo sapiens
cccaagacaucaaccaaga

SEQ ID NO: 1149130 - RNA, 19 nt, Homo sapiens
gagcacgcgugucuguguu

SEQ ID NO: 1149131 - RNA, 19 nt, Homo sapiens
ccacuuccaugccauacug

SEQ ID NO: 1149132 - RNA, 19 nt, Homo sapiens
aaaugaccacuccauaaua

SEQ ID NO: 1149133 - RNA, 19 nt, Homo sapiens
ggagagaaagggccaaucu

SEQ ID NO: 1149134 - RNA, 19 nt, Homo sapiens
ggagagguuuggccuaaaa

SEQ ID NO: 1149135 - RNA, 19 nt, Homo sapiens
gcauaguucugugguuuua

SEQ ID NO: 1149136 - RNA, 19 nt, Homo sapiens
acaauucgccugcaguuga

SEQ ID NO: 1149137 - RNA, 19 nt, Homo sapiens
uuacuggacucucuuagca

SEQ ID NO: 1149138 - RNA, 19 nt, Homo sapiens
uagccuggauuuaucauuc

SEQ ID NO: 1149139 - RNA, 19 nt, Homo sapiens
gaauuguggagaccaacua

SEQ ID NO: 1149140 - RNA, 19 nt, Homo sapiens
gcuggagggugagagaauu

SEQ ID NO: 1149141 - RNA, 19 nt, Homo sapiens
caaaccacuucuaaaugau

SEQ ID NO: 1149142 - RNA, 19 nt, Homo sapiens
cuaguagccuggauuuauc

SEQ ID NO: 1149143 - RNA, 19 nt, Homo sapiens
gcauauugcccaagacauc

SEQ ID NO: 1149144 - RNA, 19 nt, Homo sapiens
gauauagaaacaacucaug

SEQ ID NO: 1149145 - RNA, 19 nt, Homo sapiens
agccucaugucuacuguua

SEQ ID NO: 1149146 - RNA, 19 nt, Homo sapiens
caccauacccagcuaaguu

SEQ ID NO: 1149147 - RNA, 19 nt, Homo sapiens
uaccagacauccacauauc

SEQ ID NO: 1149148 - RNA, 19 nt, Homo sapiens
guaacauuccaacaucuuu

SEQ ID NO: 1149149 - RNA, 19 nt, Homo sapiens
guaaacuggccucuacuau

SEQ ID NO: 1149150 - RNA, 19 nt, Homo sapiens
gaagagauguccuaauauc

SEQ ID NO: 1149151 - RNA, 19 nt, Homo sapiens
uggaagagauguccuaaua

SEQ ID NO: 1149152 - RNA, 19 nt, Homo sapiens
ggaaaucauucagaacuuu

SEQ ID NO: 1149153 - RNA, 19 nt, Homo sapiens
acaauaaacuguagaggaa

SEQ ID NO: 1149154 - RNA, 19 nt, Homo sapiens
gagacuugcugguggguua

SEQ ID NO: 1149155 - RNA, 19 nt, Homo sapiens
uaacaggccucaccucuuc

SEQ ID NO: 1149156 - RNA, 19 nt, Homo sapiens
ggacucaacuauaaaucuu

SEQ ID NO: 1149157 - RNA, 19 nt, Homo sapiens
guaagagguuguuguaguu

SEQ ID NO: 1149158 - RNA, 19 nt, Homo sapiens
gccgagaccugaacuuuga

SEQ ID NO: 1149159 - RNA, 19 nt, Homo sapiens
gguaagagguuguuguagu

SEQ ID NO: 1149160 - RNA, 19 nt, Homo sapiens
ccaagcaccucaugaagau

SEQ ID NO: 1149161 - RNA, 19 nt, Homo sapiens
ggacaugcaggaaaucauu

SEQ ID NO: 1149162 - RNA, 19 nt, Homo sapiens
caaccuggauaacauugaa

SEQ ID NO: 1149163 - RNA, 19 nt, Homo sapiens
gcccagcgauccuuaccua

SEQ ID NO: 1149164 - RNA, 19 nt, Homo sapiens
acccuaaccuugaccuuua

SEQ ID NO: 1149165 - RNA, 19 nt, Homo sapiens
gaugugggacucaacuaua

SEQ ID NO: 1149166 - RNA, 19 nt, Homo sapiens
guaccuaaauuucucuaca

SEQ ID NO: 1149167 - RNA, 19 nt, Homo sapiens
ugaccgaggccuucaagua

SEQ ID NO: 1149168 - RNA, 19 nt, Homo sapiens
ggauaacauugaauuguac

SEQ ID NO: 1149169 - RNA, 19 nt, Homo sapiens
gaaauucugaguugauaca

SEQ ID NO: 1149170 - RNA, 19 nt, Homo sapiens
ggaagagauguccuaauau

SEQ ID NO: 1149171 - RNA, 19 nt, Homo sapiens
uggaaauucugaguugaua

SEQ ID NO: 1149172 - RNA, 19 nt, Homo sapiens
gaaaucauucagaacuuug

SEQ ID NO: 1149173 - RNA, 19 nt, Homo sapiens
ugaccuugaucuuugauug

SEQ ID NO: 1149174 - RNA, 19 nt, Homo sapiens
gauguccuaauaucucuua

SEQ ID NO: 1149175 - RNA, 19 nt, Homo sapiens
ggccucaccucuuccauuc

SEQ ID NO: 1149176 - RNA, 19 nt, Homo sapiens
ggaccagcuugcagacaug

SEQ ID NO: 1149177 - RNA, 19 nt, Homo sapiens
gaaguuggaaugggaguug

SEQ ID NO: 1149178 - RNA, 19 nt, Homo sapiens
ggacacuguugaaggucuu

SEQ ID NO: 1149179 - RNA, 19 nt, Homo sapiens
gguauggaccuacgugaau

SEQ ID NO: 1149180 - RNA, 19 nt, Homo sapiens
uuaggacucugaaggguau

SEQ ID NO: 1149181 - RNA, 19 nt, Homo sapiens
ccuacauccuggcgagaua

SEQ ID NO: 1149182 - RNA, 19 nt, Homo sapiens
guauggaccuacgugaaug

SEQ ID NO: 1149183 - RNA, 19 nt, Homo sapiens
cauccucuguccugaucua

SEQ ID NO: 1149184 - RNA, 19 nt, Homo sapiens
ggagagaccccaagucaga

SEQ ID NO: 1149185 - RNA, 19 nt, Homo sapiens
caagucagaaggagugaga

SEQ ID NO: 1149186 - RNA, 19 nt, Homo sapiens
ugcaggaaaucauucagaa

SEQ ID NO: 1149187 - RNA, 19 nt, Homo sapiens
ggucuuguccucaucaaca

SEQ ID NO: 1149188 - RNA, 19 nt, Homo sapiens
guccugcaguaccuaaauu

SEQ ID NO: 1149189 - RNA, 19 nt, Homo sapiens
ucgaggacaugcaggaaau

SEQ ID NO: 1149190 - RNA, 19 nt, Homo sapiens
gggcauaugcauccucugu

SEQ ID NO: 1149191 - RNA, 19 nt, Homo sapiens
gaggucuccuguugaaugg

SEQ ID NO: 1149192 - RNA, 19 nt, Homo sapiens
auacggcucugucacuuuc

SEQ ID NO: 1149193 - RNA, 19 nt, Homo sapiens
gaccgaggccuucaaguac

SEQ ID NO: 1149194 - RNA, 19 nt, Homo sapiens
augcagugguggaauguaa

SEQ ID NO: 1149195 - RNA, 19 nt, Homo sapiens
acauugaauuguacuggaa

SEQ ID NO: 1149196 - RNA, 19 nt, Homo sapiens
cacccaaccuggauaacau

SEQ ID NO: 1149197 - RNA, 19 nt, Homo sapiens
caucagacucucccuacuu

SEQ ID NO: 1149198 - RNA, 19 nt, Homo sapiens
agaccaagcaccucaugaa

SEQ ID NO: 1149199 - RNA, 19 nt, Homo sapiens
ugagaacccugaccccuaa

SEQ ID NO: 1149200 - RNA, 19 nt, Homo sapiens
cgagauaugcucuuaacca

SEQ ID NO: 1149201 - RNA, 19 nt, Homo sapiens
ggcgagauaugcucuuaac

SEQ ID NO: 1149202 - RNA, 19 nt, Homo sapiens
gcacccaaccuggauaaca

SEQ ID NO: 1149203 - RNA, 19 nt, Homo sapiens
gaaggucuuguccucauca

SEQ ID NO: 1149204 - RNA, 19 nt, Homo sapiens
aauaaacuguagaggaauc

SEQ ID NO: 1149205 - RNA, 19 nt, Homo sapiens
aagaugcagugguggaaug

SEQ ID NO: 1149206 - RNA, 19 nt, Homo sapiens
augugggacucaacuauaa

SEQ ID NO: 1149207 - RNA, 19 nt, Homo sapiens
ccauacggcucugucacuu

SEQ ID NO: 1149208 - RNA, 19 nt, Homo sapiens
guagcucagugugcaucua

SEQ ID NO: 1149209 - RNA, 19 nt, Homo sapiens
gagcguggaggugauauca

SEQ ID NO: 1149210 - RNA, 19 nt, Homo sapiens
gaacgaguguggggaagga

SEQ ID NO: 1149211 - RNA, 19 nt, Homo sapiens
ggacccagaccccuaaauu

SEQ ID NO: 1149212 - RNA, 19 nt, Homo sapiens
gggcauugggccaccguaa

SEQ ID NO: 1149213 - RNA, 19 nt, Homo sapiens
ggauaucaguacccaucuc

SEQ ID NO: 1149214 - RNA, 19 nt, Homo sapiens
uagcucagugugcaucuaa

SEQ ID NO: 1149215 - RNA, 19 nt, Homo sapiens
agaccucguuccucaagau

SEQ ID NO: 1149216 - RNA, 19 nt, Homo sapiens
aaacgcccagcgauccuua

SEQ ID NO: 1149217 - RNA, 19 nt, Homo sapiens
aggaaaucauucagaacuu

SEQ ID NO: 1149218 - RNA, 19 nt, Homo sapiens
gguggaauguaacucaaaa

SEQ ID NO: 1149219 - RNA, 19 nt, Homo sapiens
gaagaugcagugguggaau

SEQ ID NO: 1149220 - RNA, 19 nt, Homo sapiens
ggagaccaagcaccucaug

SEQ ID NO: 1149221 - RNA, 19 nt, Homo sapiens
ccacugcauccagccaaua

SEQ ID NO: 1149222 - RNA, 19 nt, Homo sapiens
cuggcgagauaugcucuua

SEQ ID NO: 1149223 - RNA, 19 nt, Homo sapiens
cagcgauccuuaccuacca

SEQ ID NO: 1149224 - RNA, 19 nt, Homo sapiens
gcagaucacagaggagaag

SEQ ID NO: 1149225 - RNA, 19 nt, Homo sapiens
gaccaagcaccucaugaag

SEQ ID NO: 1149226 - RNA, 19 nt, Homo sapiens
gagaccaagcaccucauga

SEQ ID NO: 1149227 - RNA, 19 nt, Homo sapiens
cagaggagaagccacuguu

SEQ ID NO: 1149228 - RNA, 19 nt, Homo sapiens
gagguggcuucucauuaac

SEQ ID NO: 1149229 - RNA, 19 nt, Homo sapiens
guccugaucuaggugucua

SEQ ID NO: 1149230 - RNA, 19 nt, Homo sapiens
gagcagcgagucuggaacu

SEQ ID NO: 1149231 - RNA, 19 nt, Homo sapiens
ggagaugauccuuggacau

SEQ ID NO: 1149232 - RNA, 19 nt, Homo sapiens
ucccuugcguccugcagua

SEQ ID NO: 1149233 - RNA, 19 nt, Homo sapiens
caggaaaucauucagaacu

SEQ ID NO: 1149234 - RNA, 19 nt, Homo sapiens
cccuaaccuugaccuuuaa

SEQ ID NO: 1149235 - RNA, 19 nt, Homo sapiens
ccgaggccuucaaguacuu

SEQ ID NO: 1149236 - RNA, 19 nt, Homo sapiens
ccucuuccauuccggagau

SEQ ID NO: 1149237 - RNA, 19 nt, Homo sapiens
gaggagagaccccaaguca

SEQ ID NO: 1149238 - RNA, 19 nt, Homo sapiens
ucagugugcaucuaaagug

SEQ ID NO: 1149239 - RNA, 19 nt, Homo sapiens
ccguuuggcugcacuaacu

SEQ ID NO: 1149240 - RNA, 19 nt, Homo sapiens
ggguauggaccuacgugaa

SEQ ID NO: 1149241 - RNA, 19 nt, Homo sapiens
ccucuguccugaucuaggu

SEQ ID NO: 1149242 - RNA, 19 nt, Homo sapiens
gugguggaauguaacucaa

SEQ ID NO: 1149243 - RNA, 19 nt, Homo sapiens
gggacucaacuauaaaucu

SEQ ID NO: 1149244 - RNA, 19 nt, Homo sapiens
gauaucaguacccaucucu

SEQ ID NO: 1149245 - RNA, 19 nt, Homo sapiens
gaggacaugcaggaaauca

SEQ ID NO: 1149246 - RNA, 19 nt, Homo sapiens
cuacuugucccauauuugc

SEQ ID NO: 1149247 - RNA, 19 nt, Homo sapiens
cgaugugggacucaacuau

SEQ ID NO: 1149248 - RNA, 19 nt, Homo sapiens
aucagacucucccuacuug

SEQ ID NO: 1149249 - RNA, 19 nt, Homo sapiens
aauuggaguugguguugga

SEQ ID NO: 1149250 - RNA, 19 nt, Homo sapiens
aaauaaagcuccaggauua

SEQ ID NO: 1149251 - RNA, 19 nt, Homo sapiens
ggucaaagaucacuuagua

SEQ ID NO: 1149252 - RNA, 19 nt, Homo sapiens
gaaguaagccuugauauaa

SEQ ID NO: 1149253 - RNA, 19 nt, Homo sapiens
gcaacgaugugccauguua

SEQ ID NO: 1149254 - RNA, 19 nt, Homo sapiens
ggauggaacugacagaaua

SEQ ID NO: 1149255 - RNA, 19 nt, Homo sapiens
gaacagaagagauuuguaa

SEQ ID NO: 1149256 - RNA, 19 nt, Homo sapiens
caauagaucugacuguuaa

SEQ ID NO: 1149257 - RNA, 19 nt, Homo sapiens
gaagaucacuguuauugga

SEQ ID NO: 1149258 - RNA, 19 nt, Homo sapiens
caaggaaucugaugagaaa

SEQ ID NO: 1149259 - RNA, 19 nt, Homo sapiens
guagaggccuugaauaauu

SEQ ID NO: 1149260 - RNA, 19 nt, Homo sapiens
gcagaucucuuauuguuug

SEQ ID NO: 1149261 - RNA, 19 nt, Homo sapiens
gcaauaauaugguuacuag

SEQ ID NO: 1149262 - RNA, 19 nt, Homo sapiens
ggaggaaccugugaugaua

SEQ ID NO: 1149263 - RNA, 19 nt, Homo sapiens
cagauugucuuaccucuua

SEQ ID NO: 1149264 - RNA, 19 nt, Homo sapiens
ggaaguaagccuugauaua

SEQ ID NO: 1149265 - RNA, 19 nt, Homo sapiens
gcaguagccuugauagauu

SEQ ID NO: 1149266 - RNA, 19 nt, Homo sapiens
acaauuaccucgcucauuu

SEQ ID NO: 1149267 - RNA, 19 nt, Homo sapiens
caacaggacugacuacuca

SEQ ID NO: 1149268 - RNA, 19 nt, Homo sapiens
uaaauggacucucuucuga

SEQ ID NO: 1149269 - RNA, 19 nt, Homo sapiens
ccaguuaucugagccauua

SEQ ID NO: 1149270 - RNA, 19 nt, Homo sapiens
gcaaguggauuacaucuca

SEQ ID NO: 1149271 - RNA, 19 nt, Homo sapiens
gcuaauaggauaccuguua

SEQ ID NO: 1149272 - RNA, 19 nt, Homo sapiens
gaacugauguugaaaauga

SEQ ID NO: 1149273 - RNA, 19 nt, Homo sapiens
gauauuuacuggacacuuu

SEQ ID NO: 1149274 - RNA, 19 nt, Homo sapiens
gcagugauccuacagauuu

SEQ ID NO: 1149275 - RNA, 19 nt, Homo sapiens
gacaagagaucaacucaug

SEQ ID NO: 1149276 - RNA, 19 nt, Homo sapiens
ggaaucaaaucuugcugua

SEQ ID NO: 1149277 - RNA, 19 nt, Homo sapiens
ccacaacaauguaauaaga

SEQ ID NO: 1149278 - RNA, 19 nt, Homo sapiens
ugacaaacaugcagcuuaa

SEQ ID NO: 1149279 - RNA, 19 nt, Homo sapiens
ggauggaucucuuucuaaa

SEQ ID NO: 1149280 - RNA, 19 nt, Homo sapiens
ugaugaagcugauauacua

SEQ ID NO: 1149281 - RNA, 19 nt, Homo sapiens
gaucaagaguuauaacaga

SEQ ID NO: 1149282 - RNA, 19 nt, Homo sapiens
guacagacuccuuuaauaa

SEQ ID NO: 1149283 - RNA, 19 nt, Homo sapiens
ggaggagaaucuuuguaua

SEQ ID NO: 1149284 - RNA, 19 nt, Homo sapiens
guacagaggguuaugauuu

SEQ ID NO: 1149285 - RNA, 19 nt, Homo sapiens
acaagcaccucucgcauua

SEQ ID NO: 1149286 - RNA, 19 nt, Homo sapiens
cagcucauaugcaauaaua

SEQ ID NO: 1149287 - RNA, 19 nt, Homo sapiens
caaaccagccagcuuauua

SEQ ID NO: 1149288 - RNA, 19 nt, Homo sapiens
ccaaagauacgguuacaua

SEQ ID NO: 1149289 - RNA, 19 nt, Homo sapiens
gauagaaucgguuacauuu

SEQ ID NO: 1149290 - RNA, 19 nt, Homo sapiens
caacuaaauuuggcucaua

SEQ ID NO: 1149291 - RNA, 19 nt, Homo sapiens
ggagaguacugcucauuug

SEQ ID NO: 1149292 - RNA, 19 nt, Homo sapiens
gguagaaguucaacaagaa

SEQ ID NO: 1149293 - RNA, 19 nt, Homo sapiens
uuuauuagcuggagguuua

SEQ ID NO: 1149294 - RNA, 19 nt, Homo sapiens
gcaaagaacuccccaguga

SEQ ID NO: 1149295 - RNA, 19 nt, Homo sapiens
aaauugggaucaagaguua

SEQ ID NO: 1149296 - RNA, 19 nt, Homo sapiens
caacauguccucagauauu

SEQ ID NO: 1149297 - RNA, 19 nt, Homo sapiens
gaaggaagccauggaagua

SEQ ID NO: 1149298 - RNA, 19 nt, Homo sapiens
gcucugggccuguguaaua

SEQ ID NO: 1149299 - RNA, 19 nt, Homo sapiens
ggaaggaaaugagaaccua

SEQ ID NO: 1149300 - RNA, 19 nt, Homo sapiens
ugacuuacauucagcaauu

SEQ ID NO: 1149301 - RNA, 19 nt, Homo sapiens
gaaaguauaucagaacaag

SEQ ID NO: 1149302 - RNA, 19 nt, Homo sapiens
gauagaaccacuuccauuu

SEQ ID NO: 1149303 - RNA, 19 nt, Homo sapiens
uuauauagcucaccauuug

SEQ ID NO: 1149304 - RNA, 19 nt, Homo sapiens
gcacuuuacuuguguguca

SEQ ID NO: 1149305 - RNA, 19 nt, Homo sapiens
ggaugaacauguauuugaa

SEQ ID NO: 1149306 - RNA, 19 nt, Homo sapiens
ggaaggagauagugaugau

SEQ ID NO: 1149307 - RNA, 19 nt, Homo sapiens
gcucaaagaugguuuaaaa

SEQ ID NO: 1149308 - RNA, 19 nt, Homo sapiens
ggaacaggcucuacagcuu

SEQ ID NO: 1149309 - RNA, 19 nt, Homo sapiens
ggaguuaguuuaugaagca

SEQ ID NO: 1149310 - RNA, 19 nt, Homo sapiens
uauaagcacucauucacua

SEQ ID NO: 1149311 - RNA, 19 nt, Homo sapiens
gagcuggaaucaaaucuug

SEQ ID NO: 1149312 - RNA, 19 nt, Homo sapiens
ggaggacaauaccugauaa

SEQ ID NO: 1149313 - RNA, 19 nt, Homo sapiens
gcugaagucucaaucuaaa

SEQ ID NO: 1149314 - RNA, 19 nt, Homo sapiens
ucagacaucuccucaaaga

SEQ ID NO: 1149315 - RNA, 19 nt, Homo sapiens
gaaguaugguaucaacuau

SEQ ID NO: 1149316 - RNA, 19 nt, Homo sapiens
gaacauuucaggguuuaua

SEQ ID NO: 1149317 - RNA, 19 nt, Homo sapiens
gcacagcaauugagaaugc

SEQ ID NO: 1149318 - RNA, 19 nt, Homo sapiens
guuaugagcugcuuguaga

SEQ ID NO: 1149319 - RNA, 19 nt, Homo sapiens
gauuacaucucacuaaaca

SEQ ID NO: 1149320 - RNA, 19 nt, Homo sapiens
ggauagggucuucauguua

SEQ ID NO: 1149321 - RNA, 19 nt, Homo sapiens
ccucaccaguccauuauua

SEQ ID NO: 1149322 - RNA, 19 nt, Homo sapiens
gcaaaugugcuugaagaua

SEQ ID NO: 1149323 - RNA, 19 nt, Homo sapiens
gcucuuaucagcauguuua

SEQ ID NO: 1149324 - RNA, 19 nt, Homo sapiens
gaaaagaguugagauaaug

SEQ ID NO: 1149325 - RNA, 19 nt, Homo sapiens
ggugagugcuccaguugua

SEQ ID NO: 1149326 - RNA, 19 nt, Homo sapiens
ccagugcaaugucaucaua

SEQ ID NO: 1149327 - RNA, 19 nt, Homo sapiens
ugacaaugcugaagggauu

SEQ ID NO: 1149328 - RNA, 19 nt, Homo sapiens
ggaggcagauuccauuuua

SEQ ID NO: 1149329 - RNA, 19 nt, Homo sapiens
aagcagaacugauguugaa

SEQ ID NO: 1149330 - RNA, 19 nt, Homo sapiens
caucauaaacagcaacuua

SEQ ID NO: 1149331 - RNA, 19 nt, Homo sapiens
acucagagcuuaaauagau

SEQ ID NO: 1149332 - RNA, 19 nt, Homo sapiens
ggaacagcuucucaucuuu

SEQ ID NO: 1149333 - RNA, 19 nt, Homo sapiens
gaauagaaccaucuucaga

SEQ ID NO: 1149334 - RNA, 19 nt, Homo sapiens
gauagugacuuuagaagag

SEQ ID NO: 1149335 - RNA, 19 nt, Homo sapiens
gaaguggaacucuguguuu

SEQ ID NO: 1149336 - RNA, 19 nt, Homo sapiens
caaaugugcuugaagauac

SEQ ID NO: 1149337 - RNA, 19 nt, Homo sapiens
gaggaaagaucugcauaug

SEQ ID NO: 1149338 - RNA, 19 nt, Homo sapiens
cagcuugaauuacccguua

SEQ ID NO: 1149339 - RNA, 19 nt, Homo sapiens
ccaaccagcugaagugcua

SEQ ID NO: 1149340 - RNA, 19 nt, Homo sapiens
uaggauaccuguuauuuca

SEQ ID NO: 1149341 - RNA, 19 nt, Homo sapiens
cauauaaacuccugguaga

SEQ ID NO: 1149342 - RNA, 19 nt, Homo sapiens
gaaagucaaugcucuuaac

SEQ ID NO: 1149343 - RNA, 19 nt, Homo sapiens
gcaguuaaccucaaagaau

SEQ ID NO: 1149344 - RNA, 19 nt, Homo sapiens
gaacucagggugaaaguau

SEQ ID NO: 1149345 - RNA, 19 nt, Homo sapiens
gacagaauaucuugcuuug

SEQ ID NO: 1149346 - RNA, 19 nt, Homo sapiens
caucuuaucuacgaaauga

SEQ ID NO: 1149347 - RNA, 19 nt, Homo sapiens
ggaugaaucuuugcuugaa

SEQ ID NO: 1149348 - RNA, 19 nt, Homo sapiens
gauacuggaugaaucuuug

SEQ ID NO: 1149349 - RNA, 19 nt, Homo sapiens
gggcugaagucucaaucua

SEQ ID NO: 1149350 - RNA, 19 nt, Homo sapiens
gcacaaagacucagcaauu

SEQ ID NO: 1149351 - RNA, 19 nt, Homo sapiens
gcauguggcugguaacuuu

SEQ ID NO: 1149352 - RNA, 19 nt, Homo sapiens
gcagaaauguugauaagca

SEQ ID NO: 1149353 - RNA, 19 nt, Homo sapiens
caucaaagcugucccuuca

SEQ ID NO: 1149354 - RNA, 19 nt, Homo sapiens
gcaaggagcucaccaucag

SEQ ID NO: 1149355 - RNA, 19 nt, Homo sapiens
caagaacaauagaagcuuu

SEQ ID NO: 1149356 - RNA, 19 nt, Homo sapiens
ucaagaaguucgcccagua

SEQ ID NO: 1149357 - RNA, 19 nt, Homo sapiens
gaauagggccucuuuaugg

SEQ ID NO: 1149358 - RNA, 19 nt, Homo sapiens
cacaaagacucagcaauuu

SEQ ID NO: 1149359 - RNA, 19 nt, Homo sapiens
gagaauagggccucuuuau

SEQ ID NO: 1149360 - RNA, 19 nt, Homo sapiens
gacaacaccuuggaugaaa

SEQ ID NO: 1149361 - RNA, 19 nt, Homo sapiens
gaauaucaggcgcgaauaa

SEQ ID NO: 1149362 - RNA, 19 nt, Homo sapiens
ggaauauguuagcguugua

SEQ ID NO: 1149363 - RNA, 19 nt, Homo sapiens
gcaccagccucuacuuugu

SEQ ID NO: 1149364 - RNA, 19 nt, Homo sapiens
caaaauauguguggagaua

SEQ ID NO: 1149365 - RNA, 19 nt, Homo sapiens
gcaagaagaggaaggagaa

SEQ ID NO: 1149366 - RNA, 19 nt, Homo sapiens
gcagugugguugugucuug

SEQ ID NO: 1149367 - RNA, 19 nt, Homo sapiens
ucagaggccuucuuucgaa

SEQ ID NO: 1149368 - RNA, 19 nt, Homo sapiens
ggacaaagaaggcaucaag

SEQ ID NO: 1149369 - RNA, 19 nt, Homo sapiens
ugcagaugcuuauguguua

SEQ ID NO: 1149370 - RNA, 19 nt, Homo sapiens
ggacagcggcaccuacauu

SEQ ID NO: 1149371 - RNA, 19 nt, Homo sapiens
ggaaggcacccaagaagga

SEQ ID NO: 1149372 - RNA, 19 nt, Homo sapiens
cagauuggcuacagagaga

SEQ ID NO: 1149373 - RNA, 19 nt, Homo sapiens
ucacguagccgucaaagug

SEQ ID NO: 1149374 - RNA, 19 nt, Homo sapiens
gaggucgucuccacacuga

SEQ ID NO: 1149375 - RNA, 19 nt, Homo sapiens
ccacgacaaugacuacuuc

SEQ ID NO: 1149376 - RNA, 19 nt, Homo sapiens
caucaagucugcucaaggu

SEQ ID NO: 1149377 - RNA, 19 nt, Homo sapiens
ccucuucagugcaggaaua

SEQ ID NO: 1149378 - RNA, 19 nt, Homo sapiens
ucaagcaacugggagauga

SEQ ID NO: 1149379 - RNA, 19 nt, Homo sapiens
caugagggcuugcaacagu

SEQ ID NO: 1149380 - RNA, 19 nt, Homo sapiens
gcgagaaggugaccaucga

SEQ ID NO: 1149381 - RNA, 19 nt, Homo sapiens
gcccacggcuacacauuga

SEQ ID NO: 1149382 - RNA, 19 nt, Homo sapiens
gcaaugaaacagcccaguu

SEQ ID NO: 1149383 - RNA, 19 nt, Homo sapiens
gcagaugcuuauguguuaa

SEQ ID NO: 1149384 - RNA, 19 nt, Homo sapiens
caagucagaggccuucuuu

SEQ ID NO: 1149385 - RNA, 19 nt, Homo sapiens
ccuggacucuuuacacaaa

SEQ ID NO: 1149386 - RNA, 19 nt, Homo sapiens
caaagaaggcaucaagcaa

SEQ ID NO: 1149387 - RNA, 19 nt, Homo sapiens
uggacaaccucaagaaguu

SEQ ID NO: 1149388 - RNA, 19 nt, Homo sapiens
gccaugccaucaacucgua

SEQ ID NO: 1149389 - RNA, 19 nt, Homo sapiens
gggaguaccugugcagugu

SEQ ID NO: 1149390 - RNA, 19 nt, Homo sapiens
ggugggcagugcugaauau

SEQ ID NO: 1149391 - RNA, 19 nt, Homo sapiens
gcucaucgaggacaaagaa

SEQ ID NO: 1149392 - RNA, 19 nt, Homo sapiens
ucaaagcugucccuucauc

SEQ ID NO: 1149393 - RNA, 19 nt, Homo sapiens
gcacaacggcaacuauaca

SEQ ID NO: 1149394 - RNA, 19 nt, Homo sapiens
gaaauguugauaagcaaga

SEQ ID NO: 1149395 - RNA, 19 nt, Homo sapiens
cugcagggcuggaacaaug

SEQ ID NO: 1149396 - RNA, 19 nt, Homo sapiens
ggagaauagggccucuuua

SEQ ID NO: 1149397 - RNA, 19 nt, Homo sapiens
caacguggccgucuucaag

SEQ ID NO: 1149398 - RNA, 19 nt, Homo sapiens
caagucugcucaaggugaa

SEQ ID NO: 1149399 - RNA, 19 nt, Homo sapiens
gcaaguacaccaucuucug

SEQ ID NO: 1149400 - RNA, 19 nt, Homo sapiens
ccaccacucuggaggaugu

SEQ ID NO: 1149401 - RNA, 19 nt, Homo sapiens
gaagccagggcacaaagaa

SEQ ID NO: 1149402 - RNA, 19 nt, Homo sapiens
ucaccaagcacaaguauag

SEQ ID NO: 1149403 - RNA, 19 nt, Homo sapiens
gcagugugcucuacaucca

SEQ ID NO: 1149404 - RNA, 19 nt, Homo sapiens
gcauccgcauguacucuuu

SEQ ID NO: 1149405 - RNA, 19 nt, Homo sapiens
gauccagcccuucgaauuc

SEQ ID NO: 1149406 - RNA, 19 nt, Homo sapiens
gcacagcgcggaacuuggu

SEQ ID NO: 1149407 - RNA, 19 nt, Homo sapiens
gcuuauguguuaauaccuu

SEQ ID NO: 1149408 - RNA, 19 nt, Homo sapiens
cagaaauguugauaagcaa

SEQ ID NO: 1149409 - RNA, 19 nt, Homo sapiens
gaguuuggcagaaauguug

SEQ ID NO: 1149410 - RNA, 19 nt, Homo sapiens
caccuuggaugaaagaugu

SEQ ID NO: 1149411 - RNA, 19 nt, Homo sapiens
ccaagaaggagcugcagaa

SEQ ID NO: 1149412 - RNA, 19 nt, Homo sapiens
cauguacucuuucaacaag

SEQ ID NO: 1149413 - RNA, 19 nt, Homo sapiens
ccaggacuuugccaucauu

SEQ ID NO: 1149414 - RNA, 19 nt, Homo sapiens
caugaacgccuguacauag

SEQ ID NO: 1149415 - RNA, 19 nt, Homo sapiens
ccaauccaguguccaggaa

SEQ ID NO: 1149416 - RNA, 19 nt, Homo sapiens
uggcagaaauguugauaag

SEQ ID NO: 1149417 - RNA, 19 nt, Homo sapiens
gggaugaugugaagaagcu

SEQ ID NO: 1149418 - RNA, 19 nt, Homo sapiens
ucacgggcuucgacauuga

SEQ ID NO: 1149419 - RNA, 19 nt, Homo sapiens
gcaccgacaucagcaaguc

SEQ ID NO: 1149420 - RNA, 19 nt, Homo sapiens
gggacacccuuaucaacug

SEQ ID NO: 1149421 - RNA, 19 nt, Homo sapiens
gaauuugacaguacaaguc

SEQ ID NO: 1149422 - RNA, 19 nt, Homo sapiens
cacccaaggucauguggaa

SEQ ID NO: 1149423 - RNA, 19 nt, Homo sapiens
gacagcggcaccuacauuu

SEQ ID NO: 1149424 - RNA, 19 nt, Homo sapiens
ggaguugcuucaauuugca

SEQ ID NO: 1149425 - RNA, 19 nt, Homo sapiens
gaacgccuguacauagaac

SEQ ID NO: 1149426 - RNA, 19 nt, Homo sapiens
gacauugaauacaagaaca

SEQ ID NO: 1149427 - RNA, 19 nt, Homo sapiens
caacauccgcgucaaagca

SEQ ID NO: 1149428 - RNA, 19 nt, Homo sapiens
gaacgcugccggcaagauc

SEQ ID NO: 1149429 - RNA, 19 nt, Homo sapiens
gauaagcaagaacaauaga

SEQ ID NO: 1149430 - RNA, 19 nt, Homo sapiens
gcauguacucuuucaacaa

SEQ ID NO: 1149431 - RNA, 19 nt, Homo sapiens
gcuucgacauugaauacaa

SEQ ID NO: 1149432 - RNA, 19 nt, Homo sapiens
gguaugccaucgccaccaa

SEQ ID NO: 1149433 - RNA, 19 nt, Homo sapiens
ggacaugcccauccguauc

SEQ ID NO: 1149434 - RNA, 19 nt, Homo sapiens
gcccaggacuuugccauca

SEQ ID NO: 1149435 - RNA, 19 nt, Homo sapiens
ccacaggcauccucauggu

SEQ ID NO: 1149436 - RNA, 19 nt, Homo sapiens
uccacgagcuauauaucua

SEQ ID NO: 1149437 - RNA, 19 nt, Homo sapiens
ccacaggcaccaacgagaa

SEQ ID NO: 1149438 - RNA, 19 nt, Homo sapiens
ugugacagaugcugaguuc

SEQ ID NO: 1149439 - RNA, 19 nt, Homo sapiens
caaaggcuaucgggucauc

SEQ ID NO: 1149440 - RNA, 19 nt, Homo sapiens
guacuggcgucuccuugca

SEQ ID NO: 1149441 - RNA, 19 nt, Homo sapiens
caaugaaacagcccaguuc

SEQ ID NO: 1149442 - RNA, 19 nt, Homo sapiens
gaggcuucgugcuacagua

SEQ ID NO: 1149443 - RNA, 19 nt, Homo sapiens
ugaggacucuggcuacuac

SEQ ID NO: 1149444 - RNA, 19 nt, Homo sapiens
caagaaguucgcccaguau

SEQ ID NO: 1149445 - RNA, 19 nt, Homo sapiens
gcagugaaccaagcaagga

SEQ ID NO: 1149446 - RNA, 19 nt, Homo sapiens
aagaggacaucggcuacua

SEQ ID NO: 1149447 - RNA, 19 nt, Homo sapiens
uauggcauguggcugguaa

SEQ ID NO: 1149448 - RNA, 19 nt, Homo sapiens
ccagcgccgugugcaauaa

SEQ ID NO: 1149449 - RNA, 19 nt, Homo sapiens
ugagacagaggcacaaaga

SEQ ID NO: 1149450 - RNA, 19 nt, Homo sapiens
ccacagaccuggaguauga

SEQ ID NO: 1149451 - RNA, 19 nt, Homo sapiens
gcaagaacaucuaccugaa

SEQ ID NO: 1149452 - RNA, 19 nt, Homo sapiens
gcaaguacgugguggacaa

SEQ ID NO: 1149453 - RNA, 19 nt, Homo sapiens
agaaggagguggacuuuga

SEQ ID NO: 1149454 - RNA, 19 nt, Homo sapiens
ggacacgucugugcucuuc

SEQ ID NO: 1149455 - RNA, 19 nt, Homo sapiens
gagccacgccgaccucuuu

SEQ ID NO: 1149456 - RNA, 19 nt, Homo sapiens
aggagaagguggccuauga

SEQ ID NO: 1149457 - RNA, 19 nt, Homo sapiens
ggacucagacuccgacuca

SEQ ID NO: 1149458 - RNA, 19 nt, Homo sapiens
ugcaauaaaucuccgguaa

SEQ ID NO: 1149459 - RNA, 19 nt, Homo sapiens
gagaagacgccaagaccaa

SEQ ID NO: 1149460 - RNA, 19 nt, Homo sapiens
ccaccaccaucaucccuaa

SEQ ID NO: 1149461 - RNA, 19 nt, Homo sapiens
gggauggcguccaagacua

SEQ ID NO: 1149462 - RNA, 19 nt, Homo sapiens
ggaaagcccgcucacuaga

SEQ ID NO: 1149463 - RNA, 19 nt, Homo sapiens
ggaaggacaagaccaagga

SEQ ID NO: 1149464 - RNA, 19 nt, Homo sapiens
gggacgaggaguguuauua

SEQ ID NO: 1149465 - RNA, 19 nt, Homo sapiens
ggacuacaacaccagguuu

SEQ ID NO: 1149466 - RNA, 19 nt, Homo sapiens
ggagaaggagguggacuuu

SEQ ID NO: 1149467 - RNA, 19 nt, Homo sapiens
aagaacaucuaccugaaug

SEQ ID NO: 1149468 - RNA, 19 nt, Homo sapiens
cggcagccacggccuauua

SEQ ID NO: 1149469 - RNA, 19 nt, Homo sapiens
ccaaggaagagaagaguga

SEQ ID NO: 1149470 - RNA, 19 nt, Homo sapiens
ccaaaacagugcaauaaau

SEQ ID NO: 1149471 - RNA, 19 nt, Homo sapiens
cgaggagugucucaaguuc

SEQ ID NO: 1149472 - RNA, 19 nt, Homo sapiens
gcccggaugugcuggaguu

SEQ ID NO: 1149473 - RNA, 19 nt, Homo sapiens
agaaacugcugcugaugga

SEQ ID NO: 1149474 - RNA, 19 nt, Homo sapiens
gaugcaagguucucagacu

SEQ ID NO: 1149475 - RNA, 19 nt, Homo sapiens
ccucuggcgucucuagaaa

SEQ ID NO: 1149476 - RNA, 19 nt, Homo sapiens
ggacgaggaguguuauuac

SEQ ID NO: 1149477 - RNA, 19 nt, Homo sapiens
cgugaagaccuuugagaaa

SEQ ID NO: 1149478 - RNA, 19 nt, Homo sapiens
gggcggauguggacuacuc

SEQ ID NO: 1149479 - RNA, 19 nt, Homo sapiens
cggaagggaccaagaagaa

SEQ ID NO: 1149480 - RNA, 19 nt, Homo sapiens
ucuagaaacugcugcugau

SEQ ID NO: 1149481 - RNA, 19 nt, Homo sapiens
caauaaaucuccgguaacc

SEQ ID NO: 1149482 - RNA, 19 nt, Homo sapiens
caagaacaucuaccugaau

SEQ ID NO: 1149483 - RNA, 19 nt, Homo sapiens
ggaaccucauggccgacua

SEQ ID NO: 1149484 - RNA, 19 nt, Homo sapiens
guccauccuuacagaguuu

SEQ ID NO: 1149485 - RNA, 19 nt, Homo sapiens
cacaguccauccuuacaga

SEQ ID NO: 1149486 - RNA, 19 nt, Homo sapiens
gaucuggaagguucgagaa

SEQ ID NO: 1149487 - RNA, 19 nt, Homo sapiens
gaucauccaggacaaugug

SEQ ID NO: 1149488 - RNA, 19 nt, Homo sapiens
ggaaaacccaagaagaaaa

SEQ ID NO: 1149489 - RNA, 19 nt, Homo sapiens
gaagcucugugaccccuuu

SEQ ID NO: 1149490 - RNA, 19 nt, Homo sapiens
caucaucccuaagcgaauc

SEQ ID NO: 1149491 - RNA, 19 nt, Homo sapiens
cggaugugcuggaguugga

SEQ ID NO: 1149492 - RNA, 19 nt, Homo sapiens
ggacaagaccaaggacaag

SEQ ID NO: 1149493 - RNA, 19 nt, Homo sapiens
gacagaucauccaggacaa

SEQ ID NO: 1149494 - RNA, 19 nt, Homo sapiens
aggaccagcucaaggagaa

SEQ ID NO: 1149495 - RNA, 19 nt, Homo sapiens
gcaauaaaucuccgguaac

SEQ ID NO: 1149496 - RNA, 19 nt, Homo sapiens
ccacuggccuucgacuaca

SEQ ID NO: 1149497 - RNA, 19 nt, Homo sapiens
gcuugucccagguuuguuu

SEQ ID NO: 1149498 - RNA, 19 nt, Homo sapiens
ugaacacccucaagaagcu

SEQ ID NO: 1149499 - RNA, 19 nt, Homo sapiens
ccauagagaaggcacugaa

SEQ ID NO: 1149500 - RNA, 19 nt, Homo sapiens
gcggugcccuggaauacgu

SEQ ID NO: 1149501 - RNA, 19 nt, Homo sapiens
cgcccacaguccauccuua

SEQ ID NO: 1149502 - RNA, 19 nt, Homo sapiens
ucuggaagguucgagaaga

SEQ ID NO: 1149503 - RNA, 19 nt, Homo sapiens
aagagaagagugaggagaa

SEQ ID NO: 1149504 - RNA, 19 nt, Homo sapiens
gaggagugccugcggaucu

SEQ ID NO: 1149505 - RNA, 19 nt, Homo sapiens
gggccgacccugagaucaa

SEQ ID NO: 1149506 - RNA, 19 nt, Homo sapiens
gcccuggacugcgagaugu

SEQ ID NO: 1149507 - RNA, 19 nt, Homo sapiens
acucggcccuggagaagga

SEQ ID NO: 1149508 - RNA, 19 nt, Homo sapiens
gaagcuaguggagcggaaa

SEQ ID NO: 1149509 - RNA, 19 nt, Homo sapiens
uuaaagaaacccauuaucc

SEQ ID NO: 1149510 - RNA, 19 nt, Homo sapiens
gaaagcccgcucacuagac

SEQ ID NO: 1149511 - RNA, 19 nt, Homo sapiens
acacaccugcucccaagaa

SEQ ID NO: 1149512 - RNA, 19 nt, Homo sapiens
ccuuacagaguuuaaagaa

SEQ ID NO: 1149513 - RNA, 19 nt, Homo sapiens
cggaaagcccgcucacuag

SEQ ID NO: 1149514 - RNA, 19 nt, Homo sapiens
ggaagggaccaagaagaag

SEQ ID NO: 1149515 - RNA, 19 nt, Homo sapiens
gcagccacccuccaaagag

SEQ ID NO: 1149516 - RNA, 19 nt, Homo sapiens
gggcagaagaggaggaucu

SEQ ID NO: 1149517 - RNA, 19 nt, Homo sapiens
gagaaggagguggacuuug

SEQ ID NO: 1149518 - RNA, 19 nt, Homo sapiens
gcgaugcaagguucucaga

SEQ ID NO: 1149519 - RNA, 19 nt, Homo sapiens
ggcagccacggccuauuaa

SEQ ID NO: 1149520 - RNA, 19 nt, Homo sapiens
ggccggaagggaccaagaa

SEQ ID NO: 1149521 - RNA, 19 nt, Homo sapiens
gucccagguuuguuugaga

SEQ ID NO: 1149522 - RNA, 19 nt, Homo sapiens
caaaacagugcaauaaauc

SEQ ID NO: 1149523 - RNA, 19 nt, Homo sapiens
gacccucucuccaacuacu

SEQ ID NO: 1149524 - RNA, 19 nt, Homo sapiens
gggagacccaguacaugug

SEQ ID NO: 1149525 - RNA, 19 nt, Homo sapiens
gccgugaacacccucaaga

SEQ ID NO: 1149526 - RNA, 19 nt, Homo sapiens
ggcagccacccuccaaaga

SEQ ID NO: 1149527 - RNA, 19 nt, Homo sapiens
uagagaaggcacugaacga

SEQ ID NO: 1149528 - RNA, 19 nt, Homo sapiens
ccaggaggccauagagaag

SEQ ID NO: 1149529 - RNA, 19 nt, Homo sapiens
gagugucucaaguucugua

SEQ ID NO: 1149530 - RNA, 19 nt, Homo sapiens
gcugaaaacacgcacauug

SEQ ID NO: 1149531 - RNA, 19 nt, Homo sapiens
ccgacuaccucagacagau

SEQ ID NO: 1149532 - RNA, 19 nt, Homo sapiens
aggagugucucaaguucug

SEQ ID NO: 1149533 - RNA, 19 nt, Homo sapiens
ucucagacucagaagauga

SEQ ID NO: 1149534 - RNA, 19 nt, Homo sapiens
gggcuugucccagguuugu

SEQ ID NO: 1149535 - RNA, 19 nt, Homo sapiens
gcgggcuugucccagguuu

SEQ ID NO: 1149536 - RNA, 19 nt, Homo sapiens
ggccgacccugagaucaag

SEQ ID NO: 1149537 - RNA, 19 nt, Homo sapiens
ccccaugccucuuccaaaa

SEQ ID NO: 1149538 - RNA, 19 nt, Homo sapiens
gcugccaagucgcaaagca

SEQ ID NO: 1149539 - RNA, 19 nt, Homo sapiens
aguaugacccucucuccaa

SEQ ID NO: 1149540 - RNA, 19 nt, Homo sapiens
ccaaccaggaggccauaga

SEQ ID NO: 1149541 - RNA, 19 nt, Homo sapiens
agaggaggaucgcccacau

SEQ ID NO: 1149542 - RNA, 19 nt, Homo sapiens
ucucccaccuuuccaagca

SEQ ID NO: 1149543 - RNA, 19 nt, Homo sapiens
gaggaucucccaccuuucc

SEQ ID NO: 1149544 - RNA, 19 nt, Homo sapiens
acgcuccacuggcuucuuc

SEQ ID NO: 1149545 - RNA, 19 nt, Homo sapiens
gccauugacugccccuauu

SEQ ID NO: 1149546 - RNA, 19 nt, Homo sapiens
caaccaggaggccauagag

SEQ ID NO: 1149547 - RNA, 19 nt, Homo sapiens
ucgaggagugucucaaguu

SEQ ID NO: 1149548 - RNA, 19 nt, Homo sapiens
ggacagagguucuuauuug

SEQ ID NO: 1149549 - RNA, 19 nt, Homo sapiens
gaacagagaaugugcaaua

SEQ ID NO: 1149550 - RNA, 19 nt, Homo sapiens
gaaacuagguccugccuuu

SEQ ID NO: 1149551 - RNA, 19 nt, Homo sapiens
ggaauuagcuauagaacug

SEQ ID NO: 1149552 - RNA, 19 nt, Homo sapiens
gaaguaagauguauagagu

SEQ ID NO: 1149553 - RNA, 19 nt, Homo sapiens
ugaaagcacuggauaaauu

SEQ ID NO: 1149554 - RNA, 19 nt, Homo sapiens
caaauuggcucuucgcaaa

SEQ ID NO: 1149555 - RNA, 19 nt, Homo sapiens
gaaauagacuuagacgaaa

SEQ ID NO: 1149556 - RNA, 19 nt, Homo sapiens
ggaaauagacuuagacgaa

SEQ ID NO: 1149557 - RNA, 19 nt, Homo sapiens
ccaaacagcucauggcaaa

SEQ ID NO: 1149558 - RNA, 19 nt, Homo sapiens
cuauagaacugcuuuguaa

SEQ ID NO: 1149559 - RNA, 19 nt, Homo sapiens
gaagaaagagguaugaaga

SEQ ID NO: 1149560 - RNA, 19 nt, Homo sapiens
ggaacugggucugggauua

SEQ ID NO: 1149561 - RNA, 19 nt, Homo sapiens
ccagaagacuccaguugua

SEQ ID NO: 1149562 - RNA, 19 nt, Homo sapiens
gaccucugcuguacaaaua

SEQ ID NO: 1149563 - RNA, 19 nt, Homo sapiens
gcugagguuugauuucuua

SEQ ID NO: 1149564 - RNA, 19 nt, Homo sapiens
caaauucauugagcacuua

SEQ ID NO: 1149565 - RNA, 19 nt, Homo sapiens
caaguuggguggacauaaa

SEQ ID NO: 1149566 - RNA, 19 nt, Homo sapiens
acagugagguggaucuuua

SEQ ID NO: 1149567 - RNA, 19 nt, Homo sapiens
aagaugggcucaauuauga

SEQ ID NO: 1149568 - RNA, 19 nt, Homo sapiens
gagauuagcaucccauuug

SEQ ID NO: 1149569 - RNA, 19 nt, Homo sapiens
gaaccuugcuucucauauc

SEQ ID NO: 1149570 - RNA, 19 nt, Homo sapiens
gagaugauguccuggcaaa

SEQ ID NO: 1149571 - RNA, 19 nt, Homo sapiens
ggacauaaaugagucaagu

SEQ ID NO: 1149572 - RNA, 19 nt, Homo sapiens
gaagaugggcucaauuaug

SEQ ID NO: 1149573 - RNA, 19 nt, Homo sapiens
gaaagacccucuguuugga

SEQ ID NO: 1149574 - RNA, 19 nt, Homo sapiens
gcucuucgcuugaaucugu

SEQ ID NO: 1149575 - RNA, 19 nt, Homo sapiens
gauauuugcugccgagaug

SEQ ID NO: 1149576 - RNA, 19 nt, Homo sapiens
ggaaagacccucuguuugg

SEQ ID NO: 1149577 - RNA, 19 nt, Homo sapiens
ggugaggucucccuaauca

SEQ ID NO: 1149578 - RNA, 19 nt, Homo sapiens
gguacgagaugcccaaguu

SEQ ID NO: 1149579 - RNA, 19 nt, Homo sapiens
uaucaaagaaggacgaaua

SEQ ID NO: 1149580 - RNA, 19 nt, Homo sapiens
ggaaauugaacagcgauua

SEQ ID NO: 1149581 - RNA, 19 nt, Homo sapiens
ugaagugccauuucuguua

SEQ ID NO: 1149582 - RNA, 19 nt, Homo sapiens
gaaagcacuggauaaauug

SEQ ID NO: 1149583 - RNA, 19 nt, Homo sapiens
aaauagagaucagcaagaa

SEQ ID NO: 1149584 - RNA, 19 nt, Homo sapiens
acucaaagcagccaacuua

SEQ ID NO: 1149585 - RNA, 19 nt, Homo sapiens
gaaagucaccugaggaagu

SEQ ID NO: 1149586 - RNA, 19 nt, Homo sapiens
ugucuucucucuucaguuu

SEQ ID NO: 1149587 - RNA, 19 nt, Homo sapiens
gcccugagcugaguccuuu

SEQ ID NO: 1149588 - RNA, 19 nt, Homo sapiens
gaaguugggcucuaagaau

SEQ ID NO: 1149589 - RNA, 19 nt, Homo sapiens
ucaagcagcugagggauga

SEQ ID NO: 1149590 - RNA, 19 nt, Homo sapiens
ggacaugacuaggaguguu

SEQ ID NO: 1149591 - RNA, 19 nt, Homo sapiens
gcagucaaguucuucuguu

SEQ ID NO: 1149592 - RNA, 19 nt, Homo sapiens
gaggugaggucucccuaau

SEQ ID NO: 1149593 - RNA, 19 nt, Homo sapiens
ggaauuuacccauagaaga

SEQ ID NO: 1149594 - RNA, 19 nt, Homo sapiens
gaagugccauuucuguuac

SEQ ID NO: 1149595 - RNA, 19 nt, Homo sapiens
uuuaagcgcuacuaaugua

SEQ ID NO: 1149596 - RNA, 19 nt, Homo sapiens
ggauuucucuuccaacagu

SEQ ID NO: 1149597 - RNA, 19 nt, Homo sapiens
caaccacucuggaauuuac

SEQ ID NO: 1149598 - RNA, 19 nt, Homo sapiens
caacauugcauacuugaau

SEQ ID NO: 1149599 - RNA, 19 nt, Homo sapiens
agaaugaggagaaguuuaa

SEQ ID NO: 1149600 - RNA, 19 nt, Homo sapiens
gauguguguuucuaaaguu

SEQ ID NO: 1149601 - RNA, 19 nt, Homo sapiens
ccacaacacccaacaugaa

SEQ ID NO: 1149602 - RNA, 19 nt, Homo sapiens
gaauagcgguaaggcuuga

SEQ ID NO: 1149603 - RNA, 19 nt, Homo sapiens
agagucagcuacagaaaga

SEQ ID NO: 1149604 - RNA, 19 nt, Homo sapiens
cgacugguccuguuaaaga

SEQ ID NO: 1149605 - RNA, 19 nt, Homo sapiens
gcuauuucuugauccauuu

SEQ ID NO: 1149606 - RNA, 19 nt, Homo sapiens
gaagaaugaggagaaguuu

SEQ ID NO: 1149607 - RNA, 19 nt, Homo sapiens
uaaaccuccugcucccuua

SEQ ID NO: 1149608 - RNA, 19 nt, Homo sapiens
gcaaagaaaacaucaauga

SEQ ID NO: 1149609 - RNA, 19 nt, Homo sapiens
gacagagguucuuauuugu

SEQ ID NO: 1149610 - RNA, 19 nt, Homo sapiens
gguuucugcucuucucaua

SEQ ID NO: 1149611 - RNA, 19 nt, Homo sapiens
guacugaaguugggcucua

SEQ ID NO: 1149612 - RNA, 19 nt, Homo sapiens
gcuccaugcuuucaaacuu

SEQ ID NO: 1149613 - RNA, 19 nt, Homo sapiens
ugaaucccgccaucaauua

SEQ ID NO: 1149614 - RNA, 19 nt, Homo sapiens
guuuggagcauuauuagua

SEQ ID NO: 1149615 - RNA, 19 nt, Homo sapiens
gcauauuugccuauucuuu

SEQ ID NO: 1149616 - RNA, 19 nt, Homo sapiens
agaaagagguaugaagaug

SEQ ID NO: 1149617 - RNA, 19 nt, Homo sapiens
gggaggagcuuaaaacuca

SEQ ID NO: 1149618 - RNA, 19 nt, Homo sapiens
ggaagaagucguacagagu

SEQ ID NO: 1149619 - RNA, 19 nt, Homo sapiens
gcaaacagcuggaaaagac

SEQ ID NO: 1149620 - RNA, 19 nt, Homo sapiens
ccaaauucauugagcacuu

SEQ ID NO: 1149621 - RNA, 19 nt, Homo sapiens
gacaugacuaggaguguua

SEQ ID NO: 1149622 - RNA, 19 nt, Homo sapiens
ggucccagcugccaaguag

SEQ ID NO: 1149623 - RNA, 19 nt, Homo sapiens
ccagguggccuccuuggua

SEQ ID NO: 1149624 - RNA, 19 nt, Homo sapiens
gcuauagaacugcuuugua

SEQ ID NO: 1149625 - RNA, 19 nt, Homo sapiens
cacaugaacugcacaccuu

SEQ ID NO: 1149626 - RNA, 19 nt, Homo sapiens
caaagaaggacgaauagca

SEQ ID NO: 1149627 - RNA, 19 nt, Homo sapiens
gggaugagcuacgauugga

SEQ ID NO: 1149628 - RNA, 19 nt, Homo sapiens
gaggagcggcagcagcuua

SEQ ID NO: 1149629 - RNA, 19 nt, Homo sapiens
aaacuuaacgggaaucuca

SEQ ID NO: 1149630 - RNA, 19 nt, Homo sapiens
aguaagauguauagaguug

SEQ ID NO: 1149631 - RNA, 19 nt, Homo sapiens
ggaaguaagauguauagag

SEQ ID NO: 1149632 - RNA, 19 nt, Homo sapiens
aaagucaccugaggaaguu

SEQ ID NO: 1149633 - RNA, 19 nt, Homo sapiens
gcaggaacaggaaauugaa

SEQ ID NO: 1149634 - RNA, 19 nt, Homo sapiens
ggacagcagggccuaucua

SEQ ID NO: 1149635 - RNA, 19 nt, Homo sapiens
cagggucaguuacauagaa

SEQ ID NO: 1149636 - RNA, 19 nt, Homo sapiens
ccacaaaauuggaagcuuu

SEQ ID NO: 1149637 - RNA, 19 nt, Homo sapiens
gaacugggucugggauuau

SEQ ID NO: 1149638 - RNA, 19 nt, Homo sapiens
guggugaaaugaucuggaa

SEQ ID NO: 1149639 - RNA, 19 nt, Homo sapiens
caauuuggguggcaguguu

SEQ ID NO: 1149640 - RNA, 19 nt, Homo sapiens
ugaggugccacaugaguua

SEQ ID NO: 1149641 - RNA, 19 nt, Homo sapiens
gauacgagcauugcagauu

SEQ ID NO: 1149642 - RNA, 19 nt, Homo sapiens
gccuaagccuggccuugua

SEQ ID NO: 1149643 - RNA, 19 nt, Homo sapiens
ggaagaaagacucaaagca

SEQ ID NO: 1149644 - RNA, 19 nt, Homo sapiens
ggaaggccaggcaaagaaa

SEQ ID NO: 1149645 - RNA, 19 nt, Homo sapiens
ggucugggauuauuuuaaa

SEQ ID NO: 1149646 - RNA, 19 nt, Homo sapiens
gaucuuuaccucugauaga

SEQ ID NO: 1149647 - RNA, 19 nt, Homo sapiens
cuuuaucccuuuccucuuu

SEQ ID NO: 1149648 - RNA, 19 nt, Homo sapiens
gaaauuaacaagcugcuaa

SEQ ID NO: 1149649 - RNA, 19 nt, Homo sapiens
ggagaagaaucaauuagug

SEQ ID NO: 1149650 - RNA, 19 nt, Homo sapiens
gaaaagaagucccaggaaa

SEQ ID NO: 1149651 - RNA, 19 nt, Homo sapiens
gagccaagaucgugccauu

SEQ ID NO: 1149652 - RNA, 19 nt, Homo sapiens
guacugaacugccuaaagc

SEQ ID NO: 1149653 - RNA, 19 nt, Homo sapiens
gcugggagguccugauuau

SEQ ID NO: 1149654 - RNA, 19 nt, Homo sapiens
guacuggcaugcaccugua

SEQ ID NO: 1149655 - RNA, 19 nt, Homo sapiens
gcagaccaaaguauaauuu

SEQ ID NO: 1149656 - RNA, 19 nt, Homo sapiens
ugaagaugaugguguuauu

SEQ ID NO: 1149657 - RNA, 19 nt, Homo sapiens
ugaccugaaugaugaaauu

SEQ ID NO: 1149658 - RNA, 19 nt, Homo sapiens
guacuaugguuaccuagau

SEQ ID NO: 1149659 - RNA, 19 nt, Homo sapiens
uuagagagcuguuugaaaa

SEQ ID NO: 1149660 - RNA, 19 nt, Homo sapiens
ugaguacuaugguuaccua

SEQ ID NO: 1149661 - RNA, 19 nt, Homo sapiens
ucagaaugcugguuuaggu

SEQ ID NO: 1149662 - RNA, 19 nt, Homo sapiens
gaacaggaauaugaaaaga

SEQ ID NO: 1149663 - RNA, 19 nt, Homo sapiens
gaagaugaugguguuauug

SEQ ID NO: 1149664 - RNA, 19 nt, Homo sapiens
ucaauuaguggcaaacauu

SEQ ID NO: 1149665 - RNA, 19 nt, Homo sapiens
gcaggagaaucacuugaac

SEQ ID NO: 1149666 - RNA, 19 nt, Homo sapiens
gaaaccccaugucuacuaa

SEQ ID NO: 1149667 - RNA, 19 nt, Homo sapiens
uuaccuagaugaagaugau

SEQ ID NO: 1149668 - RNA, 19 nt, Homo sapiens
cuaaaaugcuggaucauga

SEQ ID NO: 1149669 - RNA, 19 nt, Homo sapiens
gaaugcugguuuaggugaa

SEQ ID NO: 1149670 - RNA, 19 nt, Homo sapiens
gugagacucugucccacaa

SEQ ID NO: 1149671 - RNA, 19 nt, Homo sapiens
gaacuccuccagaaguaug

SEQ ID NO: 1149672 - RNA, 19 nt, Homo sapiens
cgacagaucauuggagaga

SEQ ID NO: 1149673 - RNA, 19 nt, Homo sapiens
guggguaguuggaaucuuc

SEQ ID NO: 1149674 - RNA, 19 nt, Homo sapiens
gcuacuguguggauccauu

SEQ ID NO: 1149675 - RNA, 19 nt, Homo sapiens
gaaggcuccugggguauua

SEQ ID NO: 1149676 - RNA, 19 nt, Homo sapiens
ggaagaggaggaagagauc

SEQ ID NO: 1149677 - RNA, 19 nt, Homo sapiens
agaugaagaugaugguguu

SEQ ID NO: 1149678 - RNA, 19 nt, Homo sapiens
gggagguccugauuaugga

SEQ ID NO: 1149679 - RNA, 19 nt, Homo sapiens
gagcugggagguccugauu

SEQ ID NO: 1149680 - RNA, 19 nt, Homo sapiens
caauuaguggcaaacauuu

SEQ ID NO: 1149681 - RNA, 19 nt, Homo sapiens
ucaugaaggcaaucgauuu

SEQ ID NO: 1149682 - RNA, 19 nt, Homo sapiens
gaccugaaugaugaaauua

SEQ ID NO: 1149683 - RNA, 19 nt, Homo sapiens
cccgagagguggagguuga

SEQ ID NO: 1149684 - RNA, 19 nt, Homo sapiens
gggagaagaaucaauuagu

SEQ ID NO: 1149685 - RNA, 19 nt, Homo sapiens
ggaaggcagccaggagaaa

SEQ ID NO: 1149686 - RNA, 19 nt, Homo sapiens
ggaggagucggacgaggaa

SEQ ID NO: 1149687 - RNA, 19 nt, Homo sapiens
agauuugccugguguuaga

SEQ ID NO: 1149688 - RNA, 19 nt, Homo sapiens
guaguuggaaucuucaguu

SEQ ID NO: 1149689 - RNA, 19 nt, Homo sapiens
gucacgaggucaagagaug

SEQ ID NO: 1149690 - RNA, 19 nt, Homo sapiens
ggaggaagagaucaacauc

SEQ ID NO: 1149691 - RNA, 19 nt, Homo sapiens
guuagagagcuguuugaaa

SEQ ID NO: 1149692 - RNA, 19 nt, Homo sapiens
aaagauuugccugguguua

SEQ ID NO: 1149693 - RNA, 19 nt, Homo sapiens
gagaaguggagacgacaga

SEQ ID NO: 1149694 - RNA, 19 nt, Homo sapiens
ugacggccuuagcaagauu

SEQ ID NO: 1149695 - RNA, 19 nt, Homo sapiens
caugacggccuuagcaaga

SEQ ID NO: 1149696 - RNA, 19 nt, Homo sapiens
gcgacaccauggcccgaaa

SEQ ID NO: 1149697 - RNA, 19 nt, Homo sapiens
ggcaggagaaucacuugaa

SEQ ID NO: 1149698 - RNA, 19 nt, Homo sapiens
agaaucaauuaguggcaaa

SEQ ID NO: 1149699 - RNA, 19 nt, Homo sapiens
ggcugccugugucuuauuu

SEQ ID NO: 1149700 - RNA, 19 nt, Homo sapiens
uucgugaccugaaugauga

SEQ ID NO: 1149701 - RNA, 19 nt, Homo sapiens
gaaguggagacgacagauc

SEQ ID NO: 1149702 - RNA, 19 nt, Homo sapiens
gaaggcagccaggagaaag

SEQ ID NO: 1149703 - RNA, 19 nt, Homo sapiens
ugaaggcaaucgauuuuga

SEQ ID NO: 1149704 - RNA, 19 nt, Homo sapiens
gaugaagaugaugguguua

SEQ ID NO: 1149705 - RNA, 19 nt, Homo sapiens
ggagacgacagaucauugg

SEQ ID NO: 1149706 - RNA, 19 nt, Homo sapiens
acacugggagguccggaua

SEQ ID NO: 1149707 - RNA, 19 nt, Homo sapiens
cuguguggauccauuuauu

SEQ ID NO: 1149708 - RNA, 19 nt, Homo sapiens
gacacgugcugagcucaug

SEQ ID NO: 1149709 - RNA, 19 nt, Homo sapiens
ggaaaaguuggcccuaaaa

SEQ ID NO: 1149710 - RNA, 19 nt, Homo sapiens
gagacucugucccacaaaa

SEQ ID NO: 1149711 - RNA, 19 nt, Homo sapiens
acacauauuuugcuacugu

SEQ ID NO: 1149712 - RNA, 19 nt, Homo sapiens
gagccgaguuaguggaaaa

SEQ ID NO: 1149713 - RNA, 19 nt, Homo sapiens
gagguuacaaguacuuugg

SEQ ID NO: 1149714 - RNA, 19 nt, Homo sapiens
aaugcuggaucaugaagga

SEQ ID NO: 1149715 - RNA, 19 nt, Homo sapiens
uaguuggaaucuucaguuc

SEQ ID NO: 1149716 - RNA, 19 nt, Homo sapiens
gaagaggaggaagagauca

SEQ ID NO: 1149717 - RNA, 19 nt, Homo sapiens
gguguuagagagcuguuug

SEQ ID NO: 1149718 - RNA, 19 nt, Homo sapiens
ccaagaucgugccauugca

SEQ ID NO: 1149719 - RNA, 19 nt, Homo sapiens
acccagggcugcagacaca

SEQ ID NO: 1149720 - RNA, 19 nt, Homo sapiens
gacgacagccagcagaagu

SEQ ID NO: 1149721 - RNA, 19 nt, Homo sapiens
caaucgauuuugaguacua

SEQ ID NO: 1149722 - RNA, 19 nt, Homo sapiens
gaaaaguuggcccuaaaau

SEQ ID NO: 1149723 - RNA, 19 nt, Homo sapiens
ccugaaugaugaaauuaac

SEQ ID NO: 1149724 - RNA, 19 nt, Homo sapiens
ggaacgaagacccuuucug

SEQ ID NO: 1149725 - RNA, 19 nt, Homo sapiens
gaacuggcugccugugucu

SEQ ID NO: 1149726 - RNA, 19 nt, Homo sapiens
gguagguuuuguacacaua

SEQ ID NO: 1149727 - RNA, 19 nt, Homo sapiens
ggaggaagaggaggaagag

SEQ ID NO: 1149728 - RNA, 19 nt, Homo sapiens
ggaggaggaagaggaggaa

SEQ ID NO: 1149729 - RNA, 19 nt, Homo sapiens
acugggagguccggauaaa

SEQ ID NO: 1149730 - RNA, 19 nt, Homo sapiens
ugguuuaggugaauuucga

SEQ ID NO: 1149731 - RNA, 19 nt, Homo sapiens
ccucgcagcaagagauuga

SEQ ID NO: 1149732 - RNA, 19 nt, Homo sapiens
augguuaccuagaugaaga

SEQ ID NO: 1149733 - RNA, 19 nt, Homo sapiens
gcucaugaaggcaaucgau

SEQ ID NO: 1149734 - RNA, 19 nt, Homo sapiens
caccauggcccgaaaugca

SEQ ID NO: 1149735 - RNA, 19 nt, Homo sapiens
gaggggagaagaaucaauu

SEQ ID NO: 1149736 - RNA, 19 nt, Homo sapiens
uguguggauccauuuauuu

SEQ ID NO: 1149737 - RNA, 19 nt, Homo sapiens
ggaagaggaggaggaagag

SEQ ID NO: 1149738 - RNA, 19 nt, Homo sapiens
ggcaaucgauuuugaguac

SEQ ID NO: 1149739 - RNA, 19 nt, Homo sapiens
gaaucuucaguuccuguga

SEQ ID NO: 1149740 - RNA, 19 nt, Homo sapiens
ggaaaagaagucccaggaa

SEQ ID NO: 1149741 - RNA, 19 nt, Homo sapiens
gccaagaucgugccauugc

SEQ ID NO: 1149742 - RNA, 19 nt, Homo sapiens
cuacuguguggauccauuu

SEQ ID NO: 1149743 - RNA, 19 nt, Homo sapiens
ggaacuccuccagaaguau

SEQ ID NO: 1149744 - RNA, 19 nt, Homo sapiens
aggaagaggaggaggaaga

SEQ ID NO: 1149745 - RNA, 19 nt, Homo sapiens
aaaggaagaggaggaggaa

SEQ ID NO: 1149746 - RNA, 19 nt, Homo sapiens
cuuuggaacaggaauauga

SEQ ID NO: 1149747 - RNA, 19 nt, Homo sapiens
cuucugggccuguggaguu

SEQ ID NO: 1149748 - RNA, 19 nt, Homo sapiens
gcaaauauguguauaacca

SEQ ID NO: 1149749 - RNA, 19 nt, Homo sapiens
uagcugaccugcucaagua

SEQ ID NO: 1149750 - RNA, 19 nt, Homo sapiens
gacaugugcuguuugcuaa

SEQ ID NO: 1149751 - RNA, 19 nt, Homo sapiens
ggacaugugcuguuugcua

SEQ ID NO: 1149752 - RNA, 19 nt, Homo sapiens
auucaaaccugguguauga

SEQ ID NO: 1149753 - RNA, 19 nt, Homo sapiens
gaugggcucugcucagcua

SEQ ID NO: 1149754 - RNA, 19 nt, Homo sapiens
cgacuggcuuugcaaauau

SEQ ID NO: 1149755 - RNA, 19 nt, Homo sapiens
gguaugaagauguaaauga

SEQ ID NO: 1149756 - RNA, 19 nt, Homo sapiens
ggucauuccuuaacugcuu

SEQ ID NO: 1149757 - RNA, 19 nt, Homo sapiens
uggaagguaugaagaugua

SEQ ID NO: 1149758 - RNA, 19 nt, Homo sapiens
gcacaaugggcccuuggua

SEQ ID NO: 1149759 - RNA, 19 nt, Homo sapiens
acaaagagaagccggagua

SEQ ID NO: 1149760 - RNA, 19 nt, Homo sapiens
uggcagagcggguuuguaa

SEQ ID NO: 1149761 - RNA, 19 nt, Homo sapiens
gaagguaugaagauguaaa

SEQ ID NO: 1149762 - RNA, 19 nt, Homo sapiens
gggccugaccgauagaaua

SEQ ID NO: 1149763 - RNA, 19 nt, Homo sapiens
gcuugggccuugugacauu

SEQ ID NO: 1149764 - RNA, 19 nt, Homo sapiens
gcagagcggguuuguaaca

SEQ ID NO: 1149765 - RNA, 19 nt, Homo sapiens
ggccugaccgauagaauaa

SEQ ID NO: 1149766 - RNA, 19 nt, Homo sapiens
uaccuguggucauuccuua

SEQ ID NO: 1149767 - RNA, 19 nt, Homo sapiens
acgacuggcuuugcaaaua

SEQ ID NO: 1149768 - RNA, 19 nt, Homo sapiens
ggccaaucaugaccuuuga

SEQ ID NO: 1149769 - RNA, 19 nt, Homo sapiens
caagaggugcuguuucaug

SEQ ID NO: 1149770 - RNA, 19 nt, Homo sapiens
gaacagccucaaauucaca

SEQ ID NO: 1149771 - RNA, 19 nt, Homo sapiens
caucuucuuucacuucuuc

SEQ ID NO: 1149772 - RNA, 19 nt, Homo sapiens
aagagaagccggaguagga

SEQ ID NO: 1149773 - RNA, 19 nt, Homo sapiens
gaacuucugggccaucauc

SEQ ID NO: 1149774 - RNA, 19 nt, Homo sapiens
caucauggccgucgacauc

SEQ ID NO: 1149775 - RNA, 19 nt, Homo sapiens
gcguccagcugguaaagga

SEQ ID NO: 1149776 - RNA, 19 nt, Homo sapiens
uuacggaaacgcacuuuga

SEQ ID NO: 1149777 - RNA, 19 nt, Homo sapiens
cgacaucuucuuucacuuc

SEQ ID NO: 1149778 - RNA, 19 nt, Homo sapiens
caacgacuggcuuugcaaa

SEQ ID NO: 1149779 - RNA, 19 nt, Homo sapiens
uucaagaggugcuguuuca

SEQ ID NO: 1149780 - RNA, 19 nt, Homo sapiens
gggcucugcucagcuauuc

SEQ ID NO: 1149781 - RNA, 19 nt, Homo sapiens
ucgagugggugaugugguu

SEQ ID NO: 1149782 - RNA, 19 nt, Homo sapiens
caaauucacagagcugguu

SEQ ID NO: 1149783 - RNA, 19 nt, Homo sapiens
ugaccgccacuacuccuua

SEQ ID NO: 1149784 - RNA, 19 nt, Homo sapiens
aagcuccgcuccuggaugu

SEQ ID NO: 1149785 - RNA, 19 nt, Homo sapiens
ucugggccaucaucaugua

SEQ ID NO: 1149786 - RNA, 19 nt, Homo sapiens
ucaccgcacucuacgucuu

SEQ ID NO: 1149787 - RNA, 19 nt, Homo sapiens
ggccgucgacaucuucuuu

SEQ ID NO: 1149788 - RNA, 19 nt, Homo sapiens
gggccaaucaugaccuuug

SEQ ID NO: 1149789 - RNA, 19 nt, Homo sapiens
gcacgaugguugccccaaa

SEQ ID NO: 1149790 - RNA, 19 nt, Homo sapiens
ucgcuggccuagccuauuc

SEQ ID NO: 1149791 - RNA, 19 nt, Homo sapiens
gaagcaggacaaagagaag

SEQ ID NO: 1149792 - RNA, 19 nt, Homo sapiens
gcagaagcaggacaaagag

SEQ ID NO: 1149793 - RNA, 19 nt, Homo sapiens
gggccaucaucauguacaa

SEQ ID NO: 1149794 - RNA, 19 nt, Homo sapiens
uaacugcuuuggccucaac

SEQ ID NO: 1149795 - RNA, 19 nt, Homo sapiens
gaccuuugaucgcuuccau

SEQ ID NO: 1149796 - RNA, 19 nt, Homo sapiens
guacauuggccggaagaug

SEQ ID NO: 1149797 - RNA, 19 nt, Homo sapiens
gcucugcucagcuauucuu

SEQ ID NO: 1149798 - RNA, 19 nt, Homo sapiens
agaagcaggacaaagagaa

SEQ ID NO: 1149799 - RNA, 19 nt, Homo sapiens
cgaccuggcugggaguaca

SEQ ID NO: 1149800 - RNA, 19 nt, Homo sapiens
gggcaucaagacagcauug

SEQ ID NO: 1149801 - RNA, 19 nt, Homo sapiens
agauggauguggcugacuu

SEQ ID NO: 1149802 - RNA, 19 nt, Homo sapiens
gacaucuucuuucacuucu

SEQ ID NO: 1149803 - RNA, 19 nt, Homo sapiens
gucgacaucuucuuucacu

SEQ ID NO: 1149804 - RNA, 19 nt, Homo sapiens
gagccugaacagccucaaa

SEQ ID NO: 1149805 - RNA, 19 nt, Homo sapiens
gucauuccuuaacugcuuu

SEQ ID NO: 1149806 - RNA, 19 nt, Homo sapiens
gacuggcuuugcaaauaug

SEQ ID NO: 1149807 - RNA, 19 nt, Homo sapiens
gaccgccacuacuccuuag

SEQ ID NO: 1149808 - RNA, 19 nt, Homo sapiens
ucgcaacgucaucaucuuu

SEQ ID NO: 1149809 - RNA, 19 nt, Homo sapiens
ccugaacagccucaaauuc

SEQ ID NO: 1149810 - RNA, 19 nt, Homo sapiens
agcagaagcaggacaaaga

SEQ ID NO: 1149811 - RNA, 19 nt, Homo sapiens
cuaccugcccuucuucuuc

SEQ ID NO: 1149812 - RNA, 19 nt, Homo sapiens
ugaugugguucaccuccuu

SEQ ID NO: 1149813 - RNA, 19 nt, Homo sapiens
gagcagaagcaggacaaag

SEQ ID NO: 1149814 - RNA, 19 nt, Homo sapiens
cgaauugaggccucucugu

SEQ ID NO: 1149815 - RNA, 19 nt, Homo sapiens
gccguccucuuugguguug

SEQ ID NO: 1149816 - RNA, 19 nt, Homo sapiens
cuccggacaugugcuguuu

SEQ ID NO: 1149817 - RNA, 19 nt, Homo sapiens
gauggggccugaccgauag

SEQ ID NO: 1149818 - RNA, 19 nt, Homo sapiens
ucuucuacauccucacuau

SEQ ID NO: 1149819 - RNA, 19 nt, Homo sapiens
ccagguggagccagugaga

SEQ ID NO: 1149820 - RNA, 19 nt, Homo sapiens
gaugugguucaccuccuuu

SEQ ID NO: 1149821 - RNA, 19 nt, Homo sapiens
ucuggaagguaugaagaug

SEQ ID NO: 1149822 - RNA, 19 nt, Homo sapiens
ggcaucaacgacuggcuuu

SEQ ID NO: 1149823 - RNA, 19 nt, Homo sapiens
uaccugcccuucuucuucu

SEQ ID NO: 1149824 - RNA, 19 nt, Homo sapiens
agccuggccuccuucaaga

SEQ ID NO: 1149825 - RNA, 19 nt, Homo sapiens
gccugaacagccucaaauu

SEQ ID NO: 1149826 - RNA, 19 nt, Homo sapiens
ggagcauuccgcugugauc

SEQ ID NO: 1149827 - RNA, 19 nt, Homo sapiens
ucauggccgucgacaucuu

SEQ ID NO: 1149828 - RNA, 19 nt, Homo sapiens
uugcuaaacucugcacgau

SEQ ID NO: 1149829 - RNA, 19 nt, Homo sapiens
ccacauuucuguaucauuu

SEQ ID NO: 1149830 - RNA, 19 nt, Homo sapiens
caacagacuucucgccaua

SEQ ID NO: 1149831 - RNA, 19 nt, Homo sapiens
caagaacguuuccauguuu

SEQ ID NO: 1149832 - RNA, 19 nt, Homo sapiens
gcaaugcaaugaaguugaa

SEQ ID NO: 1149833 - RNA, 19 nt, Homo sapiens
guaguuagauguuucaugu

SEQ ID NO: 1149834 - RNA, 19 nt, Homo sapiens
gauaugaccuccuacuuca

SEQ ID NO: 1149835 - RNA, 19 nt, Homo sapiens
gaaacaaugucacagagau

SEQ ID NO: 1149836 - RNA, 19 nt, Homo sapiens
ggagacaucgcguguauuu

SEQ ID NO: 1149837 - RNA, 19 nt, Homo sapiens
ucaaguaugucaacaaguu

SEQ ID NO: 1149838 - RNA, 19 nt, Homo sapiens
agaaggaucugaccacauu

SEQ ID NO: 1149839 - RNA, 19 nt, Homo sapiens
aaccacagcuggccacuua

SEQ ID NO: 1149840 - RNA, 19 nt, Homo sapiens
gagcaaaguuuccguugau

SEQ ID NO: 1149841 - RNA, 19 nt, Homo sapiens
gaacaucuuuggcgucauc

SEQ ID NO: 1149842 - RNA, 19 nt, Homo sapiens
ggaccacccuuaugucuuc

SEQ ID NO: 1149843 - RNA, 19 nt, Homo sapiens
ggaaagcagucccuucauc

SEQ ID NO: 1149844 - RNA, 19 nt, Homo sapiens
caauagccuuguagugaua

SEQ ID NO: 1149845 - RNA, 19 nt, Homo sapiens
gaaccaaaguugcacuauc

SEQ ID NO: 1149846 - RNA, 19 nt, Homo sapiens
ccaagaacguuuccauguu

SEQ ID NO: 1149847 - RNA, 19 nt, Homo sapiens
caucucagcuuacaccuau

SEQ ID NO: 1149848 - RNA, 19 nt, Homo sapiens
gaucauggcugguucuaac

SEQ ID NO: 1149849 - RNA, 19 nt, Homo sapiens
guauugaucuuguguucuu

SEQ ID NO: 1149850 - RNA, 19 nt, Homo sapiens
aaacagacaucccacaaca

SEQ ID NO: 1149851 - RNA, 19 nt, Homo sapiens
ccaguggccucaucaaaga

SEQ ID NO: 1149852 - RNA, 19 nt, Homo sapiens
ccuuaugucuucagugaua

SEQ ID NO: 1149853 - RNA, 19 nt, Homo sapiens
ucaggaagcuggagguguu

SEQ ID NO: 1149854 - RNA, 19 nt, Homo sapiens
ggauagauucuuucaggua

SEQ ID NO: 1149855 - RNA, 19 nt, Homo sapiens
ggacucaucuacaaguaca

SEQ ID NO: 1149856 - RNA, 19 nt, Homo sapiens
gagauuggcauccucauug

SEQ ID NO: 1149857 - RNA, 19 nt, Homo sapiens
gcucauugcuggacucauc

SEQ ID NO: 1149858 - RNA, 19 nt, Homo sapiens
gaaagcagucccuucauca

SEQ ID NO: 1149859 - RNA, 19 nt, Homo sapiens
gggacuggauagauucuuu

SEQ ID NO: 1149860 - RNA, 19 nt, Homo sapiens
gccaaagacugaaauugug

SEQ ID NO: 1149861 - RNA, 19 nt, Homo sapiens
gaggagacgcugcaauaaa

SEQ ID NO: 1149862 - RNA, 19 nt, Homo sapiens
ucagugauaugaccuccua

SEQ ID NO: 1149863 - RNA, 19 nt, Homo sapiens
guucuuuccuuuauuguug

SEQ ID NO: 1149864 - RNA, 19 nt, Homo sapiens
ucaaacagaugcauuuaac

SEQ ID NO: 1149865 - RNA, 19 nt, Homo sapiens
caggagacaucgcguguau

SEQ ID NO: 1149866 - RNA, 19 nt, Homo sapiens
ucgaaauccugcuggcuua

SEQ ID NO: 1149867 - RNA, 19 nt, Homo sapiens
uaucacaagucauucauca

SEQ ID NO: 1149868 - RNA, 19 nt, Homo sapiens
caaccgcaauggugaugaa

SEQ ID NO: 1149869 - RNA, 19 nt, Homo sapiens
gaucugaccacauuucugu

SEQ ID NO: 1149870 - RNA, 19 nt, Homo sapiens
agagcgacaucucagcuua

SEQ ID NO: 1149871 - RNA, 19 nt, Homo sapiens
gaaguagggagcaugaaga

SEQ ID NO: 1149872 - RNA, 19 nt, Homo sapiens
caauaaagguugggagaag

SEQ ID NO: 1149873 - RNA, 19 nt, Homo sapiens
gcacuccuaucgacaugga

SEQ ID NO: 1149874 - RNA, 19 nt, Homo sapiens
caagucauucaucaaguua

SEQ ID NO: 1149875 - RNA, 19 nt, Homo sapiens
gcagggcaaugcaaugaag

SEQ ID NO: 1149876 - RNA, 19 nt, Homo sapiens
caaaguuuccguugaugaa

SEQ ID NO: 1149877 - RNA, 19 nt, Homo sapiens
gcaaaguuuccguugauga

SEQ ID NO: 1149878 - RNA, 19 nt, Homo sapiens
ggaggagacgcugcaauaa

SEQ ID NO: 1149879 - RNA, 19 nt, Homo sapiens
acaagucgguggcagagaa

SEQ ID NO: 1149880 - RNA, 19 nt, Homo sapiens
ggagacagauccggagaag

SEQ ID NO: 1149881 - RNA, 19 nt, Homo sapiens
ucaauagccuuguagugau

SEQ ID NO: 1149882 - RNA, 19 nt, Homo sapiens
acaagucauucaucaaguu

SEQ ID NO: 1149883 - RNA, 19 nt, Homo sapiens
gaggcgugcucuguccuua

SEQ ID NO: 1149884 - RNA, 19 nt, Homo sapiens
cgagcaaccucuucucauc

SEQ ID NO: 1149885 - RNA, 19 nt, Homo sapiens
cggaggagacgcugcaaua

SEQ ID NO: 1149886 - RNA, 19 nt, Homo sapiens
ggugaucuccuccaacuug

SEQ ID NO: 1149887 - RNA, 19 nt, Homo sapiens
cagcuccguuguucuguuu

SEQ ID NO: 1149888 - RNA, 19 nt, Homo sapiens
uuccagagcugaugugaug

SEQ ID NO: 1149889 - RNA, 19 nt, Homo sapiens
caguagaccucccucugaa

SEQ ID NO: 1149890 - RNA, 19 nt, Homo sapiens
ggccacgcuuucgauauua

SEQ ID NO: 1149891 - RNA, 19 nt, Homo sapiens
ggacaaguuuggcgaagcu

SEQ ID NO: 1149892 - RNA, 19 nt, Homo sapiens
caguguaaguguucaguau

SEQ ID NO: 1149893 - RNA, 19 nt, Homo sapiens
caucggcucuuaugcaagu

SEQ ID NO: 1149894 - RNA, 19 nt, Homo sapiens
gaaagaauccagccaacac

SEQ ID NO: 1149895 - RNA, 19 nt, Homo sapiens
cgacauggaccacccuuau

SEQ ID NO: 1149896 - RNA, 19 nt, Homo sapiens
gauguuucauguccauuca

SEQ ID NO: 1149897 - RNA, 19 nt, Homo sapiens
ucacuguaguuagauguuu

SEQ ID NO: 1149898 - RNA, 19 nt, Homo sapiens
ugaauguuaucacaaguca

SEQ ID NO: 1149899 - RNA, 19 nt, Homo sapiens
acagacaucccacaacaaa

SEQ ID NO: 1149900 - RNA, 19 nt, Homo sapiens
gcaggcgucucuccucagu

SEQ ID NO: 1149901 - RNA, 19 nt, Homo sapiens
gcuguaucaacaucaauua

SEQ ID NO: 1149902 - RNA, 19 nt, Homo sapiens
gagcuggcgccacugagua

SEQ ID NO: 1149903 - RNA, 19 nt, Homo sapiens
gcaauaaagguugggagaa

SEQ ID NO: 1149904 - RNA, 19 nt, Homo sapiens
cagaugcauuuaaccaaga

SEQ ID NO: 1149905 - RNA, 19 nt, Homo sapiens
gcugguggcuccuacuaca

SEQ ID NO: 1149906 - RNA, 19 nt, Homo sapiens
gaggguugguucuuuccuu

SEQ ID NO: 1149907 - RNA, 19 nt, Homo sapiens
ggaguaugauggcaagaac

SEQ ID NO: 1149908 - RNA, 19 nt, Homo sapiens
caacgccaccugugaugaa

SEQ ID NO: 1149909 - RNA, 19 nt, Homo sapiens
gguugguucuuuccuuuau

SEQ ID NO: 1149910 - RNA, 19 nt, Homo sapiens
caucagacguggaggaacu

SEQ ID NO: 1149911 - RNA, 19 nt, Homo sapiens
ggaggccacgcuuucgaua

SEQ ID NO: 1149912 - RNA, 19 nt, Homo sapiens
aaccaaaguugcacuaucu

SEQ ID NO: 1149913 - RNA, 19 nt, Homo sapiens
aggagacgcugcaauaaag

SEQ ID NO: 1149914 - RNA, 19 nt, Homo sapiens
gcgaggucaucaccaucua

SEQ ID NO: 1149915 - RNA, 19 nt, Homo sapiens
cagcuuacaccuaugagaa

SEQ ID NO: 1149916 - RNA, 19 nt, Homo sapiens
ugaccacauuucuguauca

SEQ ID NO: 1149917 - RNA, 19 nt, Homo sapiens
ccagauggaugacaauagc

SEQ ID NO: 1149918 - RNA, 19 nt, Homo sapiens
cgaucugccuccuggguaa

SEQ ID NO: 1149919 - RNA, 19 nt, Homo sapiens
cauccugccucaguauuga

SEQ ID NO: 1149920 - RNA, 19 nt, Homo sapiens
ggcgugcucuguccuuaga

SEQ ID NO: 1149921 - RNA, 19 nt, Homo sapiens
ggaaguagggagcaugaag

SEQ ID NO: 1149922 - RNA, 19 nt, Homo sapiens
ccaguccugucuccucuga

SEQ ID NO: 1149923 - RNA, 19 nt, Homo sapiens
agacagauccggagaaggu

SEQ ID NO: 1149924 - RNA, 19 nt, Homo sapiens
ggaagugcaagaugcguau

SEQ ID NO: 1149925 - RNA, 19 nt, Homo sapiens
aggccacgcuuucgauauu

SEQ ID NO: 1149926 - RNA, 19 nt, Homo sapiens
caguauugaucuuguguuc

SEQ ID NO: 1149927 - RNA, 19 nt, Homo sapiens
ugcuacaugugcaauauuu

SEQ ID NO: 1149928 - RNA, 19 nt, Homo sapiens
agagcaaaguuuccguuga

SEQ ID NO: 1149929 - RNA, 19 nt, Homo sapiens
gaagagagccggaggaaga

SEQ ID NO: 1149930 - RNA, 19 nt, Homo sapiens
guagauacauggcagguaa

SEQ ID NO: 1149931 - RNA, 19 nt, Homo sapiens
guaaagugaugcuauguug

SEQ ID NO: 1149932 - RNA, 19 nt, Homo sapiens
gcacagauaccuucacuug

SEQ ID NO: 1149933 - RNA, 19 nt, Homo sapiens
gaaaacgacuucugauuug

SEQ ID NO: 1149934 - RNA, 19 nt, Homo sapiens
gaagacaaagguuaagaaa

SEQ ID NO: 1149935 - RNA, 19 nt, Homo sapiens
ggaacaagcugagggacaa

SEQ ID NO: 1149936 - RNA, 19 nt, Homo sapiens
gaugcuauguugucguuaa

SEQ ID NO: 1149937 - RNA, 19 nt, Homo sapiens
gaaaauggcagaaaugaaa

SEQ ID NO: 1149938 - RNA, 19 nt, Homo sapiens
gcaauugccuagacuccuu

SEQ ID NO: 1149939 - RNA, 19 nt, Homo sapiens
ggucugggcucucgucguu

SEQ ID NO: 1149940 - RNA, 19 nt, Homo sapiens
agaccaagcuccacgaaga

SEQ ID NO: 1149941 - RNA, 19 nt, Homo sapiens
gaaggaucacucucagaua

SEQ ID NO: 1149942 - RNA, 19 nt, Homo sapiens
ccaccagucugcagauuug

SEQ ID NO: 1149943 - RNA, 19 nt, Homo sapiens
ccacaggaccucaagauug

SEQ ID NO: 1149944 - RNA, 19 nt, Homo sapiens
gacagcggauccacaauau

SEQ ID NO: 1149945 - RNA, 19 nt, Homo sapiens
cauggcagguaacuguuua

SEQ ID NO: 1149946 - RNA, 19 nt, Homo sapiens
gcuguuacguggcacugua

SEQ ID NO: 1149947 - RNA, 19 nt, Homo sapiens
ugacagcggauccacaaua

SEQ ID NO: 1149948 - RNA, 19 nt, Homo sapiens
ugagugauguucagucaug

SEQ ID NO: 1149949 - RNA, 19 nt, Homo sapiens
ggaaggaucacucucagau

SEQ ID NO: 1149950 - RNA, 19 nt, Homo sapiens
ugucauggaugcccucauu

SEQ ID NO: 1149951 - RNA, 19 nt, Homo sapiens
cgagaucccugcagagcuu

SEQ ID NO: 1149952 - RNA, 19 nt, Homo sapiens
uguauucguuguucuguuu

SEQ ID NO: 1149953 - RNA, 19 nt, Homo sapiens
ugucgggccugcacagaua

SEQ ID NO: 1149954 - RNA, 19 nt, Homo sapiens
cacaggaccucaagauugu

SEQ ID NO: 1149955 - RNA, 19 nt, Homo sapiens
ccaaagugcugggauuaca

SEQ ID NO: 1149956 - RNA, 19 nt, Homo sapiens
gagcagaggaagcagaaga

SEQ ID NO: 1149957 - RNA, 19 nt, Homo sapiens
ggaagaggagggagaggaa

SEQ ID NO: 1149958 - RNA, 19 nt, Homo sapiens
ggaagugagugauguucag

SEQ ID NO: 1149959 - RNA, 19 nt, Homo sapiens
ggagugcaguggcgugauc

SEQ ID NO: 1149960 - RNA, 19 nt, Homo sapiens
augcggcaaugcugaauua

SEQ ID NO: 1149961 - RNA, 19 nt, Homo sapiens
gaaaauuacccgugucuug

SEQ ID NO: 1149962 - RNA, 19 nt, Homo sapiens
gugaugcuauguugucguu

SEQ ID NO: 1149963 - RNA, 19 nt, Homo sapiens
gugagaagacaaagguuaa

SEQ ID NO: 1149964 - RNA, 19 nt, Homo sapiens
cagcggauccacaauauuc

SEQ ID NO: 1149965 - RNA, 19 nt, Homo sapiens
gacggacacuuaccugaca

SEQ ID NO: 1149966 - RNA, 19 nt, Homo sapiens
acagucaugugccacguaa

SEQ ID NO: 1149967 - RNA, 19 nt, Homo sapiens
ccaauaaccaacagugaga

SEQ ID NO: 1149968 - RNA, 19 nt, Homo sapiens
aaugcugaauuauccguua

SEQ ID NO: 1149969 - RNA, 19 nt, Homo sapiens
caaagugauuuuacgguuu

SEQ ID NO: 1149970 - RNA, 19 nt, Homo sapiens
aaauaaagaggaaggauca

SEQ ID NO: 1149971 - RNA, 19 nt, Homo sapiens
acagauaccuucacuugcu

SEQ ID NO: 1149972 - RNA, 19 nt, Homo sapiens
gacaagcgccuggagaaga

SEQ ID NO: 1149973 - RNA, 19 nt, Homo sapiens
cuacaggugugugccacua

SEQ ID NO: 1149974 - RNA, 19 nt, Homo sapiens
gagaagacaaagguuaaga

SEQ ID NO: 1149975 - RNA, 19 nt, Homo sapiens
agaagaagcggcagagugu

SEQ ID NO: 1149976 - RNA, 19 nt, Homo sapiens
caccuggccucgcucaaga

SEQ ID NO: 1149977 - RNA, 19 nt, Homo sapiens
ggauggucuugaucucuug

SEQ ID NO: 1149978 - RNA, 19 nt, Homo sapiens
ucucgucguuggccuugua

SEQ ID NO: 1149979 - RNA, 19 nt, Homo sapiens
cguuggaccucucgaacaa

SEQ ID NO: 1149980 - RNA, 19 nt, Homo sapiens
agacaaagguuaagaaaac

SEQ ID NO: 1149981 - RNA, 19 nt, Homo sapiens
gggacaagcgccuggagaa

SEQ ID NO: 1149982 - RNA, 19 nt, Homo sapiens
aaggaucacucucagauac

SEQ ID NO: 1149983 - RNA, 19 nt, Homo sapiens
acaagcgccuggagaagau

SEQ ID NO: 1149984 - RNA, 19 nt, Homo sapiens
uggaugcccucauucugaa

SEQ ID NO: 1149985 - RNA, 19 nt, Homo sapiens
ugcagacggugaugugauu

SEQ ID NO: 1149986 - RNA, 19 nt, Homo sapiens
cgagcuccgugccgucaaa

SEQ ID NO: 1149987 - RNA, 19 nt, Homo sapiens
gaaaaccccguaccucuga

SEQ ID NO: 1149988 - RNA, 19 nt, Homo sapiens
ugacaacugccuccgagaa

SEQ ID NO: 1149989 - RNA, 19 nt, Homo sapiens
uggccucgcucaagacguu

SEQ ID NO: 1149990 - RNA, 19 nt, Homo sapiens
cggcaaugcugaauuaucc

SEQ ID NO: 1149991 - RNA, 19 nt, Homo sapiens
gugauuuccuucccaccaa

SEQ ID NO: 1149992 - RNA, 19 nt, Homo sapiens
gcucaaggagaucaauuuc

SEQ ID NO: 1149993 - RNA, 19 nt, Homo sapiens
uaacaagugccaccagucu

SEQ ID NO: 1149994 - RNA, 19 nt, Homo sapiens
aacgacuucugauuuguuu

SEQ ID NO: 1149995 - RNA, 19 nt, Homo sapiens
ugccucagccucccaagua

SEQ ID NO: 1149996 - RNA, 19 nt, Homo sapiens
ugaagccgaugcagucucu

SEQ ID NO: 1149997 - RNA, 19 nt, Homo sapiens
ggaucacucucagauacug

SEQ ID NO: 1149998 - RNA, 19 nt, Homo sapiens
auacauggcagguaacugu

SEQ ID NO: 1149999 - RNA, 19 nt, Homo sapiens
ugucagaauuaacuguuca

SEQ ID NO: 1150000 - RNA, 19 nt, Homo sapiens
ugcagucucuggacaacuu

SEQ ID NO: 1150001 - RNA, 19 nt, Homo sapiens
aaacgacuucugauuuguu

SEQ ID NO: 1150002 - RNA, 19 nt, Homo sapiens
agaagacaaagguuaagaa

SEQ ID NO: 1150003 - RNA, 19 nt, Homo sapiens
agugagaagacaaagguua

SEQ ID NO: 1150004 - RNA, 19 nt, Homo sapiens
ggauggaaaugaaaauuac

SEQ ID NO: 1150005 - RNA, 19 nt, Homo sapiens
gucguaaagugaugcuaug

SEQ ID NO: 1150006 - RNA, 19 nt, Homo sapiens
gcguuuguuuggccgguuu

SEQ ID NO: 1150007 - RNA, 19 nt, Homo sapiens
uugcaaggaugucauggau

SEQ ID NO: 1150008 - RNA, 19 nt, Homo sapiens
ggaugcagacggugaugug

SEQ ID NO: 1150009 - RNA, 19 nt, Homo sapiens
gagcaggacgugggagaug

SEQ ID NO: 1150010 - RNA, 19 nt, Homo sapiens
gaugggauuauucaagugu

SEQ ID NO: 1150011 - RNA, 19 nt, Homo sapiens
gcugaauuauccguuagau

SEQ ID NO: 1150012 - RNA, 19 nt, Homo sapiens
ccagaucccacaacgaauc

SEQ ID NO: 1150013 - RNA, 19 nt, Homo sapiens
gcagaccaagcuccacgaa

SEQ ID NO: 1150014 - RNA, 19 nt, Homo sapiens
ucaagugucagaauuaacu

SEQ ID NO: 1150015 - RNA, 19 nt, Homo sapiens
ccaacagugagaagacaaa

SEQ ID NO: 1150016 - RNA, 19 nt, Homo sapiens
gagacgggguuucaccauu

SEQ ID NO: 1150017 - RNA, 19 nt, Homo sapiens
ggacaagcgccuggagaag

SEQ ID NO: 1150018 - RNA, 19 nt, Homo sapiens
gccagggaaugcacucaag

SEQ ID NO: 1150019 - RNA, 19 nt, Homo sapiens
aaaacuacaugcaccauca

SEQ ID NO: 1150020 - RNA, 19 nt, Homo sapiens
guucugaaucauguagaua

SEQ ID NO: 1150021 - RNA, 19 nt, Homo sapiens
aaagugaugcuauguuguc

SEQ ID NO: 1150022 - RNA, 19 nt, Homo sapiens
agaugauucugucguaaag

SEQ ID NO: 1150023 - RNA, 19 nt, Homo sapiens
agacgggguuucaccauuu

SEQ ID NO: 1150024 - RNA, 19 nt, Homo sapiens
acaaccagcugagcgagau

SEQ ID NO: 1150025 - RNA, 19 nt, Homo sapiens
aggauggucuugaucucuu

SEQ ID NO: 1150026 - RNA, 19 nt, Homo sapiens
gauuuccuucccaccaaua

SEQ ID NO: 1150027 - RNA, 19 nt, Homo sapiens
agugagugauguucaguca

SEQ ID NO: 1150028 - RNA, 19 nt, Homo sapiens
guaacuguuuaugggagaa

SEQ ID NO: 1150029 - RNA, 19 nt, Homo sapiens
ggaaggagguugacauauu

SEQ ID NO: 1150030 - RNA, 19 nt, Homo sapiens
guacagauguugcagauaa

SEQ ID NO: 1150031 - RNA, 19 nt, Homo sapiens
gaaggagguugacauauuu

SEQ ID NO: 1150032 - RNA, 19 nt, Homo sapiens
cagaagaccugauuuauga

SEQ ID NO: 1150033 - RNA, 19 nt, Homo sapiens
gugcagaucuuaauucuuu

SEQ ID NO: 1150034 - RNA, 19 nt, Homo sapiens
ggaaugcacuucuaaaugu

SEQ ID NO: 1150035 - RNA, 19 nt, Homo sapiens
gaaagaacguggcuauaau

SEQ ID NO: 1150036 - RNA, 19 nt, Homo sapiens
guacagcuuuaccauauua

SEQ ID NO: 1150037 - RNA, 19 nt, Homo sapiens
cagauaagcugaacaguga

SEQ ID NO: 1150038 - RNA, 19 nt, Homo sapiens
gaaaugguguaaacuaaug

SEQ ID NO: 1150039 - RNA, 19 nt, Homo sapiens
ccagacagcucuuugauga

SEQ ID NO: 1150040 - RNA, 19 nt, Homo sapiens
gaacuaguuuccauacuga

SEQ ID NO: 1150041 - RNA, 19 nt, Homo sapiens
uaacugguauguugaagua

SEQ ID NO: 1150042 - RNA, 19 nt, Homo sapiens
gaugaucuguagacauuua

SEQ ID NO: 1150043 - RNA, 19 nt, Homo sapiens
uaaaucugcuucaaccuua

SEQ ID NO: 1150044 - RNA, 19 nt, Homo sapiens
gagcacagguggaguagaa

SEQ ID NO: 1150045 - RNA, 19 nt, Homo sapiens
gaacguggcuauaauggau

SEQ ID NO: 1150046 - RNA, 19 nt, Homo sapiens
gaacuagagugcacuuguu

SEQ ID NO: 1150047 - RNA, 19 nt, Homo sapiens
caagacggcugcugaacua

SEQ ID NO: 1150048 - RNA, 19 nt, Homo sapiens
gaaccaagaguguagauuu

SEQ ID NO: 1150049 - RNA, 19 nt, Homo sapiens
gcuauaauguucuuuguga

SEQ ID NO: 1150050 - RNA, 19 nt, Homo sapiens
ucagggagcuccauuuaaa

SEQ ID NO: 1150051 - RNA, 19 nt, Homo sapiens
gggcagagcuugaaauaag

SEQ ID NO: 1150052 - RNA, 19 nt, Homo sapiens
gggaaaugguguaaacuaa

SEQ ID NO: 1150053 - RNA, 19 nt, Homo sapiens
uaacucaccugacagcuuu

SEQ ID NO: 1150054 - RNA, 19 nt, Homo sapiens
gaacagcuucuccaccuua

SEQ ID NO: 1150055 - RNA, 19 nt, Homo sapiens
ggaaugggcucaugugucu

SEQ ID NO: 1150056 - RNA, 19 nt, Homo sapiens
gugaugaucuguagacauu

SEQ ID NO: 1150057 - RNA, 19 nt, Homo sapiens
cggaggauguauacaauua

SEQ ID NO: 1150058 - RNA, 19 nt, Homo sapiens
ggucugcucucauuuauuc

SEQ ID NO: 1150059 - RNA, 19 nt, Homo sapiens
gaaagcugguauugaugua

SEQ ID NO: 1150060 - RNA, 19 nt, Homo sapiens
ccacagaagaccugauuua

SEQ ID NO: 1150061 - RNA, 19 nt, Homo sapiens
caggauauauugaaccuuu

SEQ ID NO: 1150062 - RNA, 19 nt, Homo sapiens
gcaccugucuuucauuugu

SEQ ID NO: 1150063 - RNA, 19 nt, Homo sapiens
ggaaccagauggaacaaga

SEQ ID NO: 1150064 - RNA, 19 nt, Homo sapiens
ggucauauauaaggacuaa

SEQ ID NO: 1150065 - RNA, 19 nt, Homo sapiens
gaucauucuuccauacuuu

SEQ ID NO: 1150066 - RNA, 19 nt, Homo sapiens
gaacaaagagcagcgacua

SEQ ID NO: 1150067 - RNA, 19 nt, Homo sapiens
guacugagguuugaggaaa

SEQ ID NO: 1150068 - RNA, 19 nt, Homo sapiens
gaaguacagcuuuaccaua

SEQ ID NO: 1150069 - RNA, 19 nt, Homo sapiens
gaggagcacuuacucaugu

SEQ ID NO: 1150070 - RNA, 19 nt, Homo sapiens
gaguugagguauaaugaaa

SEQ ID NO: 1150071 - RNA, 19 nt, Homo sapiens
gaaguagugucuaaaagua

SEQ ID NO: 1150072 - RNA, 19 nt, Homo sapiens
gaaucugaauuuagccuuu

SEQ ID NO: 1150073 - RNA, 19 nt, Homo sapiens
gaaggaaucgauugaaaug

SEQ ID NO: 1150074 - RNA, 19 nt, Homo sapiens
gaaccuucuuggucaaauu

SEQ ID NO: 1150075 - RNA, 19 nt, Homo sapiens
caaaaugucuucaucugua

SEQ ID NO: 1150076 - RNA, 19 nt, Homo sapiens
gaagcaguaugaauuagau

SEQ ID NO: 1150077 - RNA, 19 nt, Homo sapiens
gaagugaagaacauuauug

SEQ ID NO: 1150078 - RNA, 19 nt, Homo sapiens
gaacaagaaaggaaacaug

SEQ ID NO: 1150079 - RNA, 19 nt, Homo sapiens
acuauaagcucaaagaaug

SEQ ID NO: 1150080 - RNA, 19 nt, Homo sapiens
ggaaggaucacucaugguu

SEQ ID NO: 1150081 - RNA, 19 nt, Homo sapiens
cagcagaccacguauuuaa

SEQ ID NO: 1150082 - RNA, 19 nt, Homo sapiens
agauucagguucucaauaa

SEQ ID NO: 1150083 - RNA, 19 nt, Homo sapiens
aaccaagaguguagauuua

SEQ ID NO: 1150084 - RNA, 19 nt, Homo sapiens
ggacagccuugauucacuu

SEQ ID NO: 1150085 - RNA, 19 nt, Homo sapiens
uuaaggaguugagguauaa

SEQ ID NO: 1150086 - RNA, 19 nt, Homo sapiens
ugaaagaacguggcuauaa

SEQ ID NO: 1150087 - RNA, 19 nt, Homo sapiens
gcacuggacuaacucuugu

SEQ ID NO: 1150088 - RNA, 19 nt, Homo sapiens
guaauggccuguuaugucu

SEQ ID NO: 1150089 - RNA, 19 nt, Homo sapiens
gaugugaaguugguacaaa

SEQ ID NO: 1150090 - RNA, 19 nt, Homo sapiens
gaacaagacggcugcugaa

SEQ ID NO: 1150091 - RNA, 19 nt, Homo sapiens
agaguggccugaugccuua

SEQ ID NO: 1150092 - RNA, 19 nt, Homo sapiens
acucauagccaaccaauaa

SEQ ID NO: 1150093 - RNA, 19 nt, Homo sapiens
gaaugcacuucuaaauguu

SEQ ID NO: 1150094 - RNA, 19 nt, Homo sapiens
agaggcaacuuauucauga

SEQ ID NO: 1150095 - RNA, 19 nt, Homo sapiens
guugauggcugugcaauau

SEQ ID NO: 1150096 - RNA, 19 nt, Homo sapiens
gacggcugcugaacuauuu

SEQ ID NO: 1150097 - RNA, 19 nt, Homo sapiens
gcagauaauuccaagaacu

SEQ ID NO: 1150098 - RNA, 19 nt, Homo sapiens
ucgccaaucuccugaagua

SEQ ID NO: 1150099 - RNA, 19 nt, Homo sapiens
ggcagcauauuaagaugua

SEQ ID NO: 1150100 - RNA, 19 nt, Homo sapiens
gggagaauuuggaacuauu

SEQ ID NO: 1150101 - RNA, 19 nt, Homo sapiens
ggucuuggauuauguuaca

SEQ ID NO: 1150102 - RNA, 19 nt, Homo sapiens
gaggauguauacaauuaug

SEQ ID NO: 1150103 - RNA, 19 nt, Homo sapiens
ucaugugucuuccgucuuu

SEQ ID NO: 1150104 - RNA, 19 nt, Homo sapiens
cagugaagcucucagaaug

SEQ ID NO: 1150105 - RNA, 19 nt, Homo sapiens
cgaagagccugcuaaccaa

SEQ ID NO: 1150106 - RNA, 19 nt, Homo sapiens
uaacuguuguugccauuga

SEQ ID NO: 1150107 - RNA, 19 nt, Homo sapiens
uauaaaggccagcuuguaa

SEQ ID NO: 1150108 - RNA, 19 nt, Homo sapiens
caagaaaggaaacauguug

SEQ ID NO: 1150109 - RNA, 19 nt, Homo sapiens
caauauuguucgucaaguu

SEQ ID NO: 1150110 - RNA, 19 nt, Homo sapiens
gaagaccugauuuaugaaa

SEQ ID NO: 1150111 - RNA, 19 nt, Homo sapiens
cugcaaugcugauaucgua

SEQ ID NO: 1150112 - RNA, 19 nt, Homo sapiens
ggagcugguuggacuaaug

SEQ ID NO: 1150113 - RNA, 19 nt, Homo sapiens
guaaacugaggcuaaauuu

SEQ ID NO: 1150114 - RNA, 19 nt, Homo sapiens
ugaauacucugaugugaag

SEQ ID NO: 1150115 - RNA, 19 nt, Homo sapiens
cggaaggaaucgauugaaa

SEQ ID NO: 1150116 - RNA, 19 nt, Homo sapiens
ggaccugucaucuaauaaa

SEQ ID NO: 1150117 - RNA, 19 nt, Homo sapiens
gcacauuaucugcacuaua

SEQ ID NO: 1150118 - RNA, 19 nt, Homo sapiens
aaguacagcuuuaccauau

SEQ ID NO: 1150119 - RNA, 19 nt, Homo sapiens
uuaaagaccagaaguuuga

SEQ ID NO: 1150120 - RNA, 19 nt, Homo sapiens
ggacagugauaaauugaac

SEQ ID NO: 1150121 - RNA, 19 nt, Homo sapiens
ccuacgaucugcauuaugu

SEQ ID NO: 1150122 - RNA, 19 nt, Homo sapiens
gaccagaggcaacuuauuc

SEQ ID NO: 1150123 - RNA, 19 nt, Homo sapiens
gacagggauugguguguuu

SEQ ID NO: 1150124 - RNA, 19 nt, Homo sapiens
ggaaggaaucgauugaaau

SEQ ID NO: 1150125 - RNA, 19 nt, Homo sapiens
gaaacuuccuuugauucuu

SEQ ID NO: 1150126 - RNA, 19 nt, Homo sapiens
cgagagcacuaaucgcuau

SEQ ID NO: 1150127 - RNA, 19 nt, Homo sapiens
gaacagcguauucucuuca

SEQ ID NO: 1150128 - RNA, 19 nt, Homo sapiens
ggaaacaugguaucacuca

SEQ ID NO: 1150129 - RNA, 19 nt, Homo sapiens
gaacaaauguggaaacuga

SEQ ID NO: 1150130 - RNA, 19 nt, Homo sapiens
ggauaaagcuacaggagaa

SEQ ID NO: 1150131 - RNA, 19 nt, Homo sapiens
ggacuuacuuucaugaguu

SEQ ID NO: 1150132 - RNA, 19 nt, Homo sapiens
caaauacugcucagaaaua

SEQ ID NO: 1150133 - RNA, 19 nt, Homo sapiens
ggagauauauuugagagaa

SEQ ID NO: 1150134 - RNA, 19 nt, Homo sapiens
uaaauuacguuccuccauu

SEQ ID NO: 1150135 - RNA, 19 nt, Homo sapiens
cagaggaacucaaguauuc

SEQ ID NO: 1150136 - RNA, 19 nt, Homo sapiens
gauaaugaauccagagguu

SEQ ID NO: 1150137 - RNA, 19 nt, Homo sapiens
gaacaaguacagaaugaaa

SEQ ID NO: 1150138 - RNA, 19 nt, Homo sapiens
uaaauacugugaccuaaga

SEQ ID NO: 1150139 - RNA, 19 nt, Homo sapiens
caauugagguggucacuga

SEQ ID NO: 1150140 - RNA, 19 nt, Homo sapiens
gaacucaaguauuccauag

SEQ ID NO: 1150141 - RNA, 19 nt, Homo sapiens
gaaccaagguggccaaacu

SEQ ID NO: 1150142 - RNA, 19 nt, Homo sapiens
gggauacgauggccaauau

SEQ ID NO: 1150143 - RNA, 19 nt, Homo sapiens
gaaaugaacacugcaaaga

SEQ ID NO: 1150144 - RNA, 19 nt, Homo sapiens
gauacgauggccaauauua

SEQ ID NO: 1150145 - RNA, 19 nt, Homo sapiens
gagcaaaguugaucagucu

SEQ ID NO: 1150146 - RNA, 19 nt, Homo sapiens
uaacagccuuucuagauga

SEQ ID NO: 1150147 - RNA, 19 nt, Homo sapiens
ggaaauggcuuuuaauaca

SEQ ID NO: 1150148 - RNA, 19 nt, Homo sapiens
gcagaacgagaguuuauuu

SEQ ID NO: 1150149 - RNA, 19 nt, Homo sapiens
guacgaugcuguuggaaug

SEQ ID NO: 1150150 - RNA, 19 nt, Homo sapiens
ggagcucugugucaacuuu

SEQ ID NO: 1150151 - RNA, 19 nt, Homo sapiens
gauauaagagggcuaagaa

SEQ ID NO: 1150152 - RNA, 19 nt, Homo sapiens
guugaucagucucuucaua

SEQ ID NO: 1150153 - RNA, 19 nt, Homo sapiens
gaacgagaguuuauuuuga

SEQ ID NO: 1150154 - RNA, 19 nt, Homo sapiens
caugagaggagauauauuu

SEQ ID NO: 1150155 - RNA, 19 nt, Homo sapiens
gcauguauccucugacaaa

SEQ ID NO: 1150156 - RNA, 19 nt, Homo sapiens
guaacagccuuucuagaug

SEQ ID NO: 1150157 - RNA, 19 nt, Homo sapiens
aaaguucagucaaagagua

SEQ ID NO: 1150158 - RNA, 19 nt, Homo sapiens
ggaucuauauuacuacaug

SEQ ID NO: 1150159 - RNA, 19 nt, Homo sapiens
ucagaaauauuaggaguug

SEQ ID NO: 1150160 - RNA, 19 nt, Homo sapiens
caagugaauaugccaaaua

SEQ ID NO: 1150161 - RNA, 19 nt, Homo sapiens
ggaauaugccucagugaug

SEQ ID NO: 1150162 - RNA, 19 nt, Homo sapiens
gccaaauacugcucagaaa

SEQ ID NO: 1150163 - RNA, 19 nt, Homo sapiens
uguggaaacugacuuugua

SEQ ID NO: 1150164 - RNA, 19 nt, Homo sapiens
ugagugagcuauguauuga

SEQ ID NO: 1150165 - RNA, 19 nt, Homo sapiens
gagcaugagaggagauaua

SEQ ID NO: 1150166 - RNA, 19 nt, Homo sapiens
gcagaaauguuuuaagaug

SEQ ID NO: 1150167 - RNA, 19 nt, Homo sapiens
gagaggagauauauuugag

SEQ ID NO: 1150168 - RNA, 19 nt, Homo sapiens
ugucuaaaguucagucaaa

SEQ ID NO: 1150169 - RNA, 19 nt, Homo sapiens
uuacuggccuggaaacuga

SEQ ID NO: 1150170 - RNA, 19 nt, Homo sapiens
ccugggaucuauauuacua

SEQ ID NO: 1150171 - RNA, 19 nt, Homo sapiens
gaaauguuguaucccugaa

SEQ ID NO: 1150172 - RNA, 19 nt, Homo sapiens
cagaugaugacaaguauaa

SEQ ID NO: 1150173 - RNA, 19 nt, Homo sapiens
gacagaugaugacaaguau

SEQ ID NO: 1150174 - RNA, 19 nt, Homo sapiens
agacagaugaugacaagua

SEQ ID NO: 1150175 - RNA, 19 nt, Homo sapiens
aaagacagaugaugacaag

SEQ ID NO: 1150176 - RNA, 19 nt, Homo sapiens
gaaguacgagcagcaagua

SEQ ID NO: 1150177 - RNA, 19 nt, Homo sapiens
caacuuugauccuuugucu

SEQ ID NO: 1150178 - RNA, 19 nt, Homo sapiens
uuucuggacugauaaauga

SEQ ID NO: 1150179 - RNA, 19 nt, Homo sapiens
uauaagagggcuaagaauu

SEQ ID NO: 1150180 - RNA, 19 nt, Homo sapiens
acagaaaccuaauccugaa

SEQ ID NO: 1150181 - RNA, 19 nt, Homo sapiens
gaaaggaccaugcuagacu

SEQ ID NO: 1150182 - RNA, 19 nt, Homo sapiens
agacagaggaacucaagua

SEQ ID NO: 1150183 - RNA, 19 nt, Homo sapiens
gaggaaaacaccauaauuu

SEQ ID NO: 1150184 - RNA, 19 nt, Homo sapiens
ggauggaaauggcuuuuaa

SEQ ID NO: 1150185 - RNA, 19 nt, Homo sapiens
ggaaugaaauacagaaacc

SEQ ID NO: 1150186 - RNA, 19 nt, Homo sapiens
ccagcuaccuuuggacauu

SEQ ID NO: 1150187 - RNA, 19 nt, Homo sapiens
ugacagaugcucauguuug

SEQ ID NO: 1150188 - RNA, 19 nt, Homo sapiens
caggcaaugucuuccuaua

SEQ ID NO: 1150189 - RNA, 19 nt, Homo sapiens
ccgcaugauucccaacuuu

SEQ ID NO: 1150190 - RNA, 19 nt, Homo sapiens
ugggauuucuggacugaua

SEQ ID NO: 1150191 - RNA, 19 nt, Homo sapiens
auaagagggcuaagaauuu

SEQ ID NO: 1150192 - RNA, 19 nt, Homo sapiens
ggacaugcuccacaauuuc

SEQ ID NO: 1150193 - RNA, 19 nt, Homo sapiens
gaaggaaaauacaaucaug

SEQ ID NO: 1150194 - RNA, 19 nt, Homo sapiens
uggccaaacuacucgguua

SEQ ID NO: 1150195 - RNA, 19 nt, Homo sapiens
gaaauacagaaaccuaauc

SEQ ID NO: 1150196 - RNA, 19 nt, Homo sapiens
gcaagugaauaugccaaau

SEQ ID NO: 1150197 - RNA, 19 nt, Homo sapiens
ggugaggacuuacuuucau

SEQ ID NO: 1150198 - RNA, 19 nt, Homo sapiens
gacagaugcucauguuugg

SEQ ID NO: 1150199 - RNA, 19 nt, Homo sapiens
gagaauuguucauuuacag

SEQ ID NO: 1150200 - RNA, 19 nt, Homo sapiens
aaagauggaagcccuauug

SEQ ID NO: 1150201 - RNA, 19 nt, Homo sapiens
gaacaccuaccaggaguug

SEQ ID NO: 1150202 - RNA, 19 nt, Homo sapiens
gaagcagaacgagaguuua

SEQ ID NO: 1150203 - RNA, 19 nt, Homo sapiens
ccacuagaaaguaauugua

SEQ ID NO: 1150204 - RNA, 19 nt, Homo sapiens
ggagaaguauugggacagu

SEQ ID NO: 1150205 - RNA, 19 nt, Homo sapiens
guuggugguuccaggauuu

SEQ ID NO: 1150206 - RNA, 19 nt, Homo sapiens
ccaucuuccugaacaagua

SEQ ID NO: 1150207 - RNA, 19 nt, Homo sapiens
gauauugagaugagcauga

SEQ ID NO: 1150208 - RNA, 19 nt, Homo sapiens
gacuuacuuucaugaguuu

SEQ ID NO: 1150209 - RNA, 19 nt, Homo sapiens
ucucagcgcucccaugauc

SEQ ID NO: 1150210 - RNA, 19 nt, Homo sapiens
gcaaugucuuccuauacug

SEQ ID NO: 1150211 - RNA, 19 nt, Homo sapiens
ugaagcagaacgagaguuu

SEQ ID NO: 1150212 - RNA, 19 nt, Homo sapiens
cguaacagccuuucuagau

SEQ ID NO: 1150213 - RNA, 19 nt, Homo sapiens
ggaugauaccuuccuugua

SEQ ID NO: 1150214 - RNA, 19 nt, Homo sapiens
cagcauguauccucugaca

SEQ ID NO: 1150215 - RNA, 19 nt, Homo sapiens
acuggcagauguagaagua

SEQ ID NO: 1150216 - RNA, 19 nt, Homo sapiens
ggauaucuuuggagugaag

SEQ ID NO: 1150217 - RNA, 19 nt, Homo sapiens
ggcaaugucuuccuauacu

SEQ ID NO: 1150218 - RNA, 19 nt, Homo sapiens
caucagauuugugcacaga

SEQ ID NO: 1150219 - RNA, 19 nt, Homo sapiens
agacagggguuuugaauau

SEQ ID NO: 1150220 - RNA, 19 nt, Homo sapiens
ccaaacuacucgguuauag

SEQ ID NO: 1150221 - RNA, 19 nt, Homo sapiens
cugaacaaguacagaauga

SEQ ID NO: 1150222 - RNA, 19 nt, Homo sapiens
uguauccucugacaaagaa

SEQ ID NO: 1150223 - RNA, 19 nt, Homo sapiens
uggcagauguagaaguaaa

SEQ ID NO: 1150224 - RNA, 19 nt, Homo sapiens
gguguacgaugcuguugga

SEQ ID NO: 1150225 - RNA, 19 nt, Homo sapiens
uaagagggcuaagaauuuu

SEQ ID NO: 1150226 - RNA, 19 nt, Homo sapiens
gcuggaugcugcaagugaa

SEQ ID NO: 1150227 - RNA, 19 nt, Homo sapiens
cagccuuucuagaugauuu

SEQ ID NO: 1150228 - RNA, 19 nt, Homo sapiens
caacuuucugccacacuua

SEQ ID NO: 1150229 - RNA, 19 nt, Homo sapiens
gaacauuuaugacuacauc

SEQ ID NO: 1150230 - RNA, 19 nt, Homo sapiens
aaacuggccuuaagucuau

SEQ ID NO: 1150231 - RNA, 19 nt, Homo sapiens
ggaaggagcagcagagaga

SEQ ID NO: 1150232 - RNA, 19 nt, Homo sapiens
cagcaacgaucguggacua

SEQ ID NO: 1150233 - RNA, 19 nt, Homo sapiens
ugacagcauuucucuuuga

SEQ ID NO: 1150234 - RNA, 19 nt, Homo sapiens
gcccugaccuuguccuuga

SEQ ID NO: 1150235 - RNA, 19 nt, Homo sapiens
aaucggaacugcauggaaa

SEQ ID NO: 1150236 - RNA, 19 nt, Homo sapiens
caugacagcauuucucuuu

SEQ ID NO: 1150237 - RNA, 19 nt, Homo sapiens
cccaacaguucuuaaauga

SEQ ID NO: 1150238 - RNA, 19 nt, Homo sapiens
gacaggagaugaugcuauc

SEQ ID NO: 1150239 - RNA, 19 nt, Homo sapiens
ggaacucgcccaucucuca

SEQ ID NO: 1150240 - RNA, 19 nt, Homo sapiens
cauccaagcucagaucugu

SEQ ID NO: 1150241 - RNA, 19 nt, Homo sapiens
gcauuucucuuugaggaau

SEQ ID NO: 1150242 - RNA, 19 nt, Homo sapiens
ggccuuaagucuauucaag

SEQ ID NO: 1150243 - RNA, 19 nt, Homo sapiens
uaaaauaucccaacaguuc

SEQ ID NO: 1150244 - RNA, 19 nt, Homo sapiens
caacgaucguggacuaucu

SEQ ID NO: 1150245 - RNA, 19 nt, Homo sapiens
cgacgcugcugcuagaugu

SEQ ID NO: 1150246 - RNA, 19 nt, Homo sapiens
ccagaacauuuaugacuac

SEQ ID NO: 1150247 - RNA, 19 nt, Homo sapiens
cagaagggacgauauuuua

SEQ ID NO: 1150248 - RNA, 19 nt, Homo sapiens
ucccaacaguucuuaaaug

SEQ ID NO: 1150249 - RNA, 19 nt, Homo sapiens
ucaugacgaugcaguuuca

SEQ ID NO: 1150250 - RNA, 19 nt, Homo sapiens
ucaguuaccuccgggugaa

SEQ ID NO: 1150251 - RNA, 19 nt, Homo sapiens
accagaacauuuaugacua

SEQ ID NO: 1150252 - RNA, 19 nt, Homo sapiens
gugcagaagggacgauauu

SEQ ID NO: 1150253 - RNA, 19 nt, Homo sapiens
guccgacgcugcugcuaga

SEQ ID NO: 1150254 - RNA, 19 nt, Homo sapiens
gcagaagggacgauauuuu

SEQ ID NO: 1150255 - RNA, 19 nt, Homo sapiens
ggcaacagguguacaucuc

SEQ ID NO: 1150256 - RNA, 19 nt, Homo sapiens
uaagucuauucaagcauga

SEQ ID NO: 1150257 - RNA, 19 nt, Homo sapiens
ggaugcaccugaaaacaga

SEQ ID NO: 1150258 - RNA, 19 nt, Homo sapiens
gcagacccaugcgggaugu

SEQ ID NO: 1150259 - RNA, 19 nt, Homo sapiens
ggugcacauuccugccaua

SEQ ID NO: 1150260 - RNA, 19 nt, Homo sapiens
cacguggacucccuuuaau

SEQ ID NO: 1150261 - RNA, 19 nt, Homo sapiens
gaaucggaacugcauggaa

SEQ ID NO: 1150262 - RNA, 19 nt, Homo sapiens
agggaaggcugcuguugga

SEQ ID NO: 1150263 - RNA, 19 nt, Homo sapiens
gagccuauccugaauuuug

SEQ ID NO: 1150264 - RNA, 19 nt, Homo sapiens
acugucaggucgaucauau

SEQ ID NO: 1150265 - RNA, 19 nt, Homo sapiens
ggagucucuuaauggcuuu

SEQ ID NO: 1150266 - RNA, 19 nt, Homo sapiens
ccaccagucugugcgaauc

SEQ ID NO: 1150267 - RNA, 19 nt, Homo sapiens
gacgauauuuuaugcauca

SEQ ID NO: 1150268 - RNA, 19 nt, Homo sapiens
ggagggaaggcugcuguug

SEQ ID NO: 1150269 - RNA, 19 nt, Homo sapiens
cgccugacaucaucuccaa

SEQ ID NO: 1150270 - RNA, 19 nt, Homo sapiens
acgaugcaguuucaaggaa

SEQ ID NO: 1150271 - RNA, 19 nt, Homo sapiens
gauguaaugcaccagaaca

SEQ ID NO: 1150272 - RNA, 19 nt, Homo sapiens
gacagcauuucucuuugag

SEQ ID NO: 1150273 - RNA, 19 nt, Homo sapiens
auucaagcaugacagcauu

SEQ ID NO: 1150274 - RNA, 19 nt, Homo sapiens
gaagggacgauauuuuaug

SEQ ID NO: 1150275 - RNA, 19 nt, Homo sapiens
ccuuaagucuauucaagca

SEQ ID NO: 1150276 - RNA, 19 nt, Homo sapiens
ccaacaguucuuaaaugaa

SEQ ID NO: 1150277 - RNA, 19 nt, Homo sapiens
uaucccaacaguucuuaaa

SEQ ID NO: 1150278 - RNA, 19 nt, Homo sapiens
cggauguaaugcaccagaa

SEQ ID NO: 1150279 - RNA, 19 nt, Homo sapiens
ccagccaccuucccuacca

SEQ ID NO: 1150280 - RNA, 19 nt, Homo sapiens
gcuguuggagucucuuaau

SEQ ID NO: 1150281 - RNA, 19 nt, Homo sapiens
ggacaugaagcugcaaggu

SEQ ID NO: 1150282 - RNA, 19 nt, Homo sapiens
gacgaugcaguuucaagga

SEQ ID NO: 1150283 - RNA, 19 nt, Homo sapiens
caccagaacauuuaugacu

SEQ ID NO: 1150284 - RNA, 19 nt, Homo sapiens
gcaacgaucguggacuauc

SEQ ID NO: 1150285 - RNA, 19 nt, Homo sapiens
guccugcgccucaguguca

SEQ ID NO: 1150286 - RNA, 19 nt, Homo sapiens
gcuaucccauggaggacau

SEQ ID NO: 1150287 - RNA, 19 nt, Homo sapiens
cauaugccgaggacgauga

SEQ ID NO: 1150288 - RNA, 19 nt, Homo sapiens
ccgagccacucaugacgau

SEQ ID NO: 1150289 - RNA, 19 nt, Homo sapiens
agacaggagaugaugcuau

SEQ ID NO: 1150290 - RNA, 19 nt, Homo sapiens
ggagacaggagaugaugcu

SEQ ID NO: 1150291 - RNA, 19 nt, Homo sapiens
ggaggccccugcagaaaca

SEQ ID NO: 1150292 - RNA, 19 nt, Homo sapiens
uaaaugaaaacuggccuua

SEQ ID NO: 1150293 - RNA, 19 nt, Homo sapiens
cagggccucuggagugaca

SEQ ID NO: 1150294 - RNA, 19 nt, Homo sapiens
cccaauuacucagcaggaa

SEQ ID NO: 1150295 - RNA, 19 nt, Homo sapiens
ggcugucgcuguucugcau

SEQ ID NO: 1150296 - RNA, 19 nt, Homo sapiens
gcgccucagugucaguuac

SEQ ID NO: 1150297 - RNA, 19 nt, Homo sapiens
cagcgggaaagcacaguga

SEQ ID NO: 1150298 - RNA, 19 nt, Homo sapiens
guucccgccugacaucauc

SEQ ID NO: 1150299 - RNA, 19 nt, Homo sapiens
aaacaaaggcgaaagauua

SEQ ID NO: 1150300 - RNA, 19 nt, Homo sapiens
gaagagaccucaguuguau

SEQ ID NO: 1150301 - RNA, 19 nt, Homo sapiens
ggaggaagaugcugaaugu

SEQ ID NO: 1150302 - RNA, 19 nt, Homo sapiens
ggaagaugcugaauguauu

SEQ ID NO: 1150303 - RNA, 19 nt, Homo sapiens
ggaagaagcaguacaauca

SEQ ID NO: 1150304 - RNA, 19 nt, Homo sapiens
aagauuaccuccaaagaua

SEQ ID NO: 1150305 - RNA, 19 nt, Homo sapiens
ggaaugagccagagagaaa

SEQ ID NO: 1150306 - RNA, 19 nt, Homo sapiens
caaccagucuugaaacaaa

SEQ ID NO: 1150307 - RNA, 19 nt, Homo sapiens
caagaaagaccaucaaguu

SEQ ID NO: 1150308 - RNA, 19 nt, Homo sapiens
gaaagaccaucaaguuuac

SEQ ID NO: 1150309 - RNA, 19 nt, Homo sapiens
caugaagacuugaacuuaa

SEQ ID NO: 1150310 - RNA, 19 nt, Homo sapiens
ccacagcgguauccaauug

SEQ ID NO: 1150311 - RNA, 19 nt, Homo sapiens
ggccauagcugugcagaaa

SEQ ID NO: 1150312 - RNA, 19 nt, Homo sapiens
caacagcucuagccugaug

SEQ ID NO: 1150313 - RNA, 19 nt, Homo sapiens
agaaagaccaucaaguuua

SEQ ID NO: 1150314 - RNA, 19 nt, Homo sapiens
caagaucccuuuccaacug

SEQ ID NO: 1150315 - RNA, 19 nt, Homo sapiens
gaaccagaguggacuuaug

SEQ ID NO: 1150316 - RNA, 19 nt, Homo sapiens
ugaccgaucugacaaguug

SEQ ID NO: 1150317 - RNA, 19 nt, Homo sapiens
gauguacuguuucagauug

SEQ ID NO: 1150318 - RNA, 19 nt, Homo sapiens
gaucagaggauaaaucaug

SEQ ID NO: 1150319 - RNA, 19 nt, Homo sapiens
gauuagagggucacauaua

SEQ ID NO: 1150320 - RNA, 19 nt, Homo sapiens
ggaagcagcgagcccuuua

SEQ ID NO: 1150321 - RNA, 19 nt, Homo sapiens
ggaaggcuauggaacuaga

SEQ ID NO: 1150322 - RNA, 19 nt, Homo sapiens
gaaacaaaggcgaaagauu

SEQ ID NO: 1150323 - RNA, 19 nt, Homo sapiens
gcaguaacccucauucuca

SEQ ID NO: 1150324 - RNA, 19 nt, Homo sapiens
gcaguaaguuucccuuugg

SEQ ID NO: 1150325 - RNA, 19 nt, Homo sapiens
ggaacuccaugacuccaaa

SEQ ID NO: 1150326 - RNA, 19 nt, Homo sapiens
ggcaaacgauucugggaaa

SEQ ID NO: 1150327 - RNA, 19 nt, Homo sapiens
gaaagauuaccuccaaaga

SEQ ID NO: 1150328 - RNA, 19 nt, Homo sapiens
ccagaugacuccaaugcaa

SEQ ID NO: 1150329 - RNA, 19 nt, Homo sapiens
caaagcagacggcaaagaa

SEQ ID NO: 1150330 - RNA, 19 nt, Homo sapiens
ucgacaagcugccaauaaa

SEQ ID NO: 1150331 - RNA, 19 nt, Homo sapiens
gugaugaugucccuuaaau

SEQ ID NO: 1150332 - RNA, 19 nt, Homo sapiens
gagcaccgcagaccuauga

SEQ ID NO: 1150333 - RNA, 19 nt, Homo sapiens
gggagaagaucacgaaggu

SEQ ID NO: 1150334 - RNA, 19 nt, Homo sapiens
gaaaaugccugauugacau

SEQ ID NO: 1150335 - RNA, 19 nt, Homo sapiens
ggcgaaagauuaccuccaa

SEQ ID NO: 1150336 - RNA, 19 nt, Homo sapiens
gcaucuguguguccaauau

SEQ ID NO: 1150337 - RNA, 19 nt, Homo sapiens
gaaagagcaagaaggcaaa

SEQ ID NO: 1150338 - RNA, 19 nt, Homo sapiens
gagcaugcccgaugugaug

SEQ ID NO: 1150339 - RNA, 19 nt, Homo sapiens
guauggaccucaacagaca

SEQ ID NO: 1150340 - RNA, 19 nt, Homo sapiens
ugaagagaccucaguugua

SEQ ID NO: 1150341 - RNA, 19 nt, Homo sapiens
gcagcgagcucccugaaaa

SEQ ID NO: 1150342 - RNA, 19 nt, Homo sapiens
gagagcaagucaaagaagu

SEQ ID NO: 1150343 - RNA, 19 nt, Homo sapiens
gaacuuaauacagcaagaa

SEQ ID NO: 1150344 - RNA, 19 nt, Homo sapiens
ccaugaagacuugaacuua

SEQ ID NO: 1150345 - RNA, 19 nt, Homo sapiens
gaagacagaaagcgaugaa

SEQ ID NO: 1150346 - RNA, 19 nt, Homo sapiens
gaacagcucggcagcaucu

SEQ ID NO: 1150347 - RNA, 19 nt, Homo sapiens
gaugccacauggaaagaaa

SEQ ID NO: 1150348 - RNA, 19 nt, Homo sapiens
auuagagggucacauauaa

SEQ ID NO: 1150349 - RNA, 19 nt, Homo sapiens
gaagaugcugaauguauug

SEQ ID NO: 1150350 - RNA, 19 nt, Homo sapiens
caggaaggcuauggaacua

SEQ ID NO: 1150351 - RNA, 19 nt, Homo sapiens
gcaagcaugugugagugaa

SEQ ID NO: 1150352 - RNA, 19 nt, Homo sapiens
gagacccucuguaaacuca

SEQ ID NO: 1150353 - RNA, 19 nt, Homo sapiens
ccacgagcauccagagaga

SEQ ID NO: 1150354 - RNA, 19 nt, Homo sapiens
gugcaggaguucaauagug

SEQ ID NO: 1150355 - RNA, 19 nt, Homo sapiens
gacaagcugccaauaaaga

SEQ ID NO: 1150356 - RNA, 19 nt, Homo sapiens
gcuuuggacacuauuaaua

SEQ ID NO: 1150357 - RNA, 19 nt, Homo sapiens
ggcgugagcuggcaaccaa

SEQ ID NO: 1150358 - RNA, 19 nt, Homo sapiens
gcaaaggcgacucugaaga

SEQ ID NO: 1150359 - RNA, 19 nt, Homo sapiens
gaugcugaauguauugaug

SEQ ID NO: 1150360 - RNA, 19 nt, Homo sapiens
caccgucacugccaaauca

SEQ ID NO: 1150361 - RNA, 19 nt, Homo sapiens
caaagucccuccggagcaa

SEQ ID NO: 1150362 - RNA, 19 nt, Homo sapiens
ggacauguacaaccaaagu

SEQ ID NO: 1150363 - RNA, 19 nt, Homo sapiens
ucagauggcucaguaugga

SEQ ID NO: 1150364 - RNA, 19 nt, Homo sapiens
gcaaguaucccagguaguc

SEQ ID NO: 1150365 - RNA, 19 nt, Homo sapiens
aagauuagagggucacaua

SEQ ID NO: 1150366 - RNA, 19 nt, Homo sapiens
gcaaugaugccgaaauguc

SEQ ID NO: 1150367 - RNA, 19 nt, Homo sapiens
agacgagacuccucugugu

SEQ ID NO: 1150368 - RNA, 19 nt, Homo sapiens
gaccgaaagcaguaaguuu

SEQ ID NO: 1150369 - RNA, 19 nt, Homo sapiens
guagaaagaaagagcaaga

SEQ ID NO: 1150370 - RNA, 19 nt, Homo sapiens
gaaccgcacagacgauaug

SEQ ID NO: 1150371 - RNA, 19 nt, Homo sapiens
ggagauguacaaccaguau

SEQ ID NO: 1150372 - RNA, 19 nt, Homo sapiens
caagguggaagaagcagua

SEQ ID NO: 1150373 - RNA, 19 nt, Homo sapiens
caagcaagccaguaaguuc

SEQ ID NO: 1150374 - RNA, 19 nt, Homo sapiens
ccacauggaaagaaacauu

SEQ ID NO: 1150375 - RNA, 19 nt, Homo sapiens
ccuaugagcccaacaagga

SEQ ID NO: 1150376 - RNA, 19 nt, Homo sapiens
uaugaugucuccuggugaa

SEQ ID NO: 1150377 - RNA, 19 nt, Homo sapiens
gaaaggaagcauuggaaac

SEQ ID NO: 1150378 - RNA, 19 nt, Homo sapiens
gcagaaaggaagcauugga

SEQ ID NO: 1150379 - RNA, 19 nt, Homo sapiens
gcacauucagacucacuuu

SEQ ID NO: 1150380 - RNA, 19 nt, Homo sapiens
gcgaaagauuaccuccaaa

SEQ ID NO: 1150381 - RNA, 19 nt, Homo sapiens
gcaagaaagaccaucaagu

SEQ ID NO: 1150382 - RNA, 19 nt, Homo sapiens
gcacaagaucccuuuccaa

SEQ ID NO: 1150383 - RNA, 19 nt, Homo sapiens
gggcagcacgcaaugauau

SEQ ID NO: 1150384 - RNA, 19 nt, Homo sapiens
cagcaggacucuggagaug

SEQ ID NO: 1150385 - RNA, 19 nt, Homo sapiens
acaaagaaacccucagaug

SEQ ID NO: 1150386 - RNA, 19 nt, Homo sapiens
aagaaagaccaucaaguuu

SEQ ID NO: 1150387 - RNA, 19 nt, Homo sapiens
caaaggagaagcccaagca

SEQ ID NO: 1150388 - RNA, 19 nt, Homo sapiens
gcacagacgauaugauggu

SEQ ID NO: 1150389 - RNA, 19 nt, Homo sapiens
ggaaucccgccucagauga

SEQ ID NO: 1150390 - RNA, 19 nt, Homo sapiens
gguugcaucugucaucugu

SEQ ID NO: 1150391 - RNA, 19 nt, Homo sapiens
gaaauguccauggcgcuuu

SEQ ID NO: 1150392 - RNA, 19 nt, Homo sapiens
guaaguuucccuuugguau

SEQ ID NO: 1150393 - RNA, 19 nt, Homo sapiens
guccacagaugagccagua

SEQ ID NO: 1150394 - RNA, 19 nt, Homo sapiens
gaacggaagcaacuuugag

SEQ ID NO: 1150395 - RNA, 19 nt, Homo sapiens
acaauaauguggaccugau

SEQ ID NO: 1150396 - RNA, 19 nt, Homo sapiens
caagcugccaauaaagaua

SEQ ID NO: 1150397 - RNA, 19 nt, Homo sapiens
acccacagcagccgaauua

SEQ ID NO: 1150398 - RNA, 19 nt, Homo sapiens
ucucaaagcagacggcaaa

SEQ ID NO: 1150399 - RNA, 19 nt, Homo sapiens
gaaggcaaauugacuuuaa

SEQ ID NO: 1150400 - RNA, 19 nt, Homo sapiens
aaacaaaggcgaaagauua

SEQ ID NO: 1150401 - RNA, 19 nt, Homo sapiens
gaagagaccucaguuguau

SEQ ID NO: 1150402 - RNA, 19 nt, Homo sapiens
ggaggaagaugcugaaugu

SEQ ID NO: 1150403 - RNA, 19 nt, Homo sapiens
ggaagaugcugaauguauu

SEQ ID NO: 1150404 - RNA, 19 nt, Homo sapiens
ggaagaagcaguacaauca

SEQ ID NO: 1150405 - RNA, 19 nt, Homo sapiens
aagauuaccuccaaagaua

SEQ ID NO: 1150406 - RNA, 19 nt, Homo sapiens
ggaaugagccagagagaaa

SEQ ID NO: 1150407 - RNA, 19 nt, Homo sapiens
caaccagucuugaaacaaa

SEQ ID NO: 1150408 - RNA, 19 nt, Homo sapiens
caagaaagaccaucaaguu

SEQ ID NO: 1150409 - RNA, 19 nt, Homo sapiens
gaaagaccaucaaguuuac

SEQ ID NO: 1150410 - RNA, 19 nt, Homo sapiens
caugaagacuugaacuuaa

SEQ ID NO: 1150411 - RNA, 19 nt, Homo sapiens
ccacagcgguauccaauug

SEQ ID NO: 1150412 - RNA, 19 nt, Homo sapiens
ggaaauaugagcagcauga

SEQ ID NO: 1150413 - RNA, 19 nt, Homo sapiens
ggccauagcugugcagaaa

SEQ ID NO: 1150414 - RNA, 19 nt, Homo sapiens
caacagcucuagccugaug

SEQ ID NO: 1150415 - RNA, 19 nt, Homo sapiens
agaaagaccaucaaguuua

SEQ ID NO: 1150416 - RNA, 19 nt, Homo sapiens
caagaucccuuuccaacug

SEQ ID NO: 1150417 - RNA, 19 nt, Homo sapiens
gaaccagaguggacuuaug

SEQ ID NO: 1150418 - RNA, 19 nt, Homo sapiens
ugaccgaucugacaaguug

SEQ ID NO: 1150419 - RNA, 19 nt, Homo sapiens
gauguacuguuucagauug

SEQ ID NO: 1150420 - RNA, 19 nt, Homo sapiens
gaucagaggauaaaucaug

SEQ ID NO: 1150421 - RNA, 19 nt, Homo sapiens
gauuagagggucacauaua

SEQ ID NO: 1150422 - RNA, 19 nt, Homo sapiens
ggaagcagcgagcccuuua

SEQ ID NO: 1150423 - RNA, 19 nt, Homo sapiens
ggaaggcuauggaacuaga

SEQ ID NO: 1150424 - RNA, 19 nt, Homo sapiens
gaaacaaaggcgaaagauu

SEQ ID NO: 1150425 - RNA, 19 nt, Homo sapiens
gcaguaacccucauucuca

SEQ ID NO: 1150426 - RNA, 19 nt, Homo sapiens
gcaguaaguuucccuuugg

SEQ ID NO: 1150427 - RNA, 19 nt, Homo sapiens
ggaacuccaugacuccaaa

SEQ ID NO: 1150428 - RNA, 19 nt, Homo sapiens
gaaagauuaccuccaaaga

SEQ ID NO: 1150429 - RNA, 19 nt, Homo sapiens
ccagaugacuccaaugcaa

SEQ ID NO: 1150430 - RNA, 19 nt, Homo sapiens
caaagcagacggcaaagaa

SEQ ID NO: 1150431 - RNA, 19 nt, Homo sapiens
uaaccaaaguugcugucua

SEQ ID NO: 1150432 - RNA, 19 nt, Homo sapiens
ucgacaagcugccaauaaa

SEQ ID NO: 1150433 - RNA, 19 nt, Homo sapiens
gugaugaugucccuuaaau

SEQ ID NO: 1150434 - RNA, 19 nt, Homo sapiens
gagcaccgcagaccuauga

SEQ ID NO: 1150435 - RNA, 19 nt, Homo sapiens
gggagaagaucacgaaggu

SEQ ID NO: 1150436 - RNA, 19 nt, Homo sapiens
gaaaaugccugauugacau

SEQ ID NO: 1150437 - RNA, 19 nt, Homo sapiens
ggcgaaagauuaccuccaa

SEQ ID NO: 1150438 - RNA, 19 nt, Homo sapiens
gcaucuguguguccaauau

SEQ ID NO: 1150439 - RNA, 19 nt, Homo sapiens
gaaagagcaagaaggcaaa

SEQ ID NO: 1150440 - RNA, 19 nt, Homo sapiens
gagcaugcccgaugugaug

SEQ ID NO: 1150441 - RNA, 19 nt, Homo sapiens
guauggaccucaacagaca

SEQ ID NO: 1150442 - RNA, 19 nt, Homo sapiens
ugaagagaccucaguugua

SEQ ID NO: 1150443 - RNA, 19 nt, Homo sapiens
gcagcgagcucccugaaaa

SEQ ID NO: 1150444 - RNA, 19 nt, Homo sapiens
gagagcaagucaaagaagu

SEQ ID NO: 1150445 - RNA, 19 nt, Homo sapiens
gaacuuaauacagcaagaa

SEQ ID NO: 1150446 - RNA, 19 nt, Homo sapiens
ccaugaagacuugaacuua

SEQ ID NO: 1150447 - RNA, 19 nt, Homo sapiens
gcagaugccaccucaguau

SEQ ID NO: 1150448 - RNA, 19 nt, Homo sapiens
gaagacagaaagcgaugaa

SEQ ID NO: 1150449 - RNA, 19 nt, Homo sapiens
gaacagcucggcagcaucu

SEQ ID NO: 1150450 - RNA, 19 nt, Homo sapiens
ggaaggcaaauugacuuua

SEQ ID NO: 1150451 - RNA, 19 nt, Homo sapiens
auuagagggucacauauaa

SEQ ID NO: 1150452 - RNA, 19 nt, Homo sapiens
gaagaugcugaauguauug

SEQ ID NO: 1150453 - RNA, 19 nt, Homo sapiens
caccgucacugucaaauca

SEQ ID NO: 1150454 - RNA, 19 nt, Homo sapiens
caggaaggcuauggaacua

SEQ ID NO: 1150455 - RNA, 19 nt, Homo sapiens
gcaagcaugugugagugaa

SEQ ID NO: 1150456 - RNA, 19 nt, Homo sapiens
gagacccucuguaaacuca

SEQ ID NO: 1150457 - RNA, 19 nt, Homo sapiens
ccacgagcauccagagaga

SEQ ID NO: 1150458 - RNA, 19 nt, Homo sapiens
gugcaggaguucaauagug

SEQ ID NO: 1150459 - RNA, 19 nt, Homo sapiens
gacaagcugccaauaaaga

SEQ ID NO: 1150460 - RNA, 19 nt, Homo sapiens
gcuuuggacacuauuaaua

SEQ ID NO: 1150461 - RNA, 19 nt, Homo sapiens
ggcgugagcuggcaaccaa

SEQ ID NO: 1150462 - RNA, 19 nt, Homo sapiens
gcaaaggcgacucugaaga

SEQ ID NO: 1150463 - RNA, 19 nt, Homo sapiens
gaugcugaauguauugaug

SEQ ID NO: 1150464 - RNA, 19 nt, Homo sapiens
caaagucccuccggagcaa

SEQ ID NO: 1150465 - RNA, 19 nt, Homo sapiens
ggacauguacaaccaaagu

SEQ ID NO: 1150466 - RNA, 19 nt, Homo sapiens
ucagauggcucaguaugga

SEQ ID NO: 1150467 - RNA, 19 nt, Homo sapiens
gcaaguaucccagguaguc

SEQ ID NO: 1150468 - RNA, 19 nt, Homo sapiens
gcaaaaggauggcuaaggu

SEQ ID NO: 1150469 - RNA, 19 nt, Homo sapiens
aagauuagagggucacaua

SEQ ID NO: 1150470 - RNA, 19 nt, Homo sapiens
gcaaugaugccgaaauguc

SEQ ID NO: 1150471 - RNA, 19 nt, Homo sapiens
agacgagacuccucugugu

SEQ ID NO: 1150472 - RNA, 19 nt, Homo sapiens
gaccgaaagcaguaaguuu

SEQ ID NO: 1150473 - RNA, 19 nt, Homo sapiens
guagaaagaaagagcaaga

SEQ ID NO: 1150474 - RNA, 19 nt, Homo sapiens
gaaccgcacagacgauaug

SEQ ID NO: 1150475 - RNA, 19 nt, Homo sapiens
ggagauguacaaccaguau

SEQ ID NO: 1150476 - RNA, 19 nt, Homo sapiens
caagguggaagaagcagua

SEQ ID NO: 1150477 - RNA, 19 nt, Homo sapiens
caagcaagccaguaaguuc

SEQ ID NO: 1150478 - RNA, 19 nt, Homo sapiens
ccuaugagcccaacaagga

SEQ ID NO: 1150479 - RNA, 19 nt, Homo sapiens
uaugaugucuccuggugaa

SEQ ID NO: 1150480 - RNA, 19 nt, Homo sapiens
ucaccacacugaguucaaa

SEQ ID NO: 1150481 - RNA, 19 nt, Homo sapiens
gaaaggaagcauuggaaac

SEQ ID NO: 1150482 - RNA, 19 nt, Homo sapiens
gcagaaaggaagcauugga

SEQ ID NO: 1150483 - RNA, 19 nt, Homo sapiens
gcacauucagacucacuuu

SEQ ID NO: 1150484 - RNA, 19 nt, Homo sapiens
gcgaaagauuaccuccaaa

SEQ ID NO: 1150485 - RNA, 19 nt, Homo sapiens
gcaagaaagaccaucaagu

SEQ ID NO: 1150486 - RNA, 19 nt, Homo sapiens
gcacaagaucccuuuccaa

SEQ ID NO: 1150487 - RNA, 19 nt, Homo sapiens
gggcagcacgcaaugauau

SEQ ID NO: 1150488 - RNA, 19 nt, Homo sapiens
acaaagaaacccucagaug

SEQ ID NO: 1150489 - RNA, 19 nt, Homo sapiens
aagaaagaccaucaaguuu

SEQ ID NO: 1150490 - RNA, 19 nt, Homo sapiens
caaaggagaagcccaagca

SEQ ID NO: 1150491 - RNA, 19 nt, Homo sapiens
gcacagacgauaugauggu

SEQ ID NO: 1150492 - RNA, 19 nt, Homo sapiens
ggaaucccgccucagauga

SEQ ID NO: 1150493 - RNA, 19 nt, Homo sapiens
uuaauguucuuucccaugu

SEQ ID NO: 1150494 - RNA, 19 nt, Homo sapiens
gguugcaucugucaucugu

SEQ ID NO: 1150495 - RNA, 19 nt, Homo sapiens
gaaauguccauggcgcuuu

SEQ ID NO: 1150496 - RNA, 19 nt, Homo sapiens
guaaguuucccuuugguau

SEQ ID NO: 1150497 - RNA, 19 nt, Homo sapiens
guccacagaugagccagua

SEQ ID NO: 1150498 - RNA, 19 nt, Homo sapiens
gaacggaagcaacuuugag

SEQ ID NO: 1150499 - RNA, 19 nt, Homo sapiens
gaacauagcuuacaaaugc

SEQ ID NO: 1150500 - RNA, 19 nt, Homo sapiens
gagaacaugugucaauuua

SEQ ID NO: 1150501 - RNA, 19 nt, Homo sapiens
ggaaacacaucauuacaaa

SEQ ID NO: 1150502 - RNA, 19 nt, Homo sapiens
ccacuaagauguagauauu

SEQ ID NO: 1150503 - RNA, 19 nt, Homo sapiens
caauagaaaugcaauguga

SEQ ID NO: 1150504 - RNA, 19 nt, Homo sapiens
ggaaauguuugauaucuca

SEQ ID NO: 1150505 - RNA, 19 nt, Homo sapiens
gaacaugugucaauuuaac

SEQ ID NO: 1150506 - RNA, 19 nt, Homo sapiens
caucacaucuauaguguuu

SEQ ID NO: 1150507 - RNA, 19 nt, Homo sapiens
ggaaaggguuuaguaucua

SEQ ID NO: 1150508 - RNA, 19 nt, Homo sapiens
caaacuugcuuuaaaggaa

SEQ ID NO: 1150509 - RNA, 19 nt, Homo sapiens
agaguaacauucaguagua

SEQ ID NO: 1150510 - RNA, 19 nt, Homo sapiens
ccaaaggcauugcaaguau

SEQ ID NO: 1150511 - RNA, 19 nt, Homo sapiens
gaaucuugcuaauuuggua

SEQ ID NO: 1150512 - RNA, 19 nt, Homo sapiens
guacauaguggcaguauug

SEQ ID NO: 1150513 - RNA, 19 nt, Homo sapiens
guacauaaguaaugcauac

SEQ ID NO: 1150514 - RNA, 19 nt, Homo sapiens
guucaaaccuucaauaacu

SEQ ID NO: 1150515 - RNA, 19 nt, Homo sapiens
gcacauuuaucaucagauc

SEQ ID NO: 1150516 - RNA, 19 nt, Homo sapiens
gagaauacccauacaaauc

SEQ ID NO: 1150517 - RNA, 19 nt, Homo sapiens
gcacauguuuacaggaaga

SEQ ID NO: 1150518 - RNA, 19 nt, Homo sapiens
caacucaucuuuuaaguga

SEQ ID NO: 1150519 - RNA, 19 nt, Homo sapiens
caaggaacauagcuuacaa

SEQ ID NO: 1150520 - RNA, 19 nt, Homo sapiens
gcacuaguuuaaucaacaa

SEQ ID NO: 1150521 - RNA, 19 nt, Homo sapiens
gaaaugcaaugugauaggu

SEQ ID NO: 1150522 - RNA, 19 nt, Homo sapiens
cuacuaagacaaagcuuua

SEQ ID NO: 1150523 - RNA, 19 nt, Homo sapiens
gaaaucaauccauaucaug

SEQ ID NO: 1150524 - RNA, 19 nt, Homo sapiens
caaaggcauugcaaguauu

SEQ ID NO: 1150525 - RNA, 19 nt, Homo sapiens
guaggaagaggaagcauuu

SEQ ID NO: 1150526 - RNA, 19 nt, Homo sapiens
caauaguaaugcaaacuug

SEQ ID NO: 1150527 - RNA, 19 nt, Homo sapiens
cugaaacucguaacaauua

SEQ ID NO: 1150528 - RNA, 19 nt, Homo sapiens
ucagagauaucaucacauc

SEQ ID NO: 1150529 - RNA, 19 nt, Homo sapiens
ucaauaacuugcucauuca

SEQ ID NO: 1150530 - RNA, 19 nt, Homo sapiens
gaucgggaaauguuugaua

SEQ ID NO: 1150531 - RNA, 19 nt, Homo sapiens
gaaaggguuuaguaucuac

SEQ ID NO: 1150532 - RNA, 19 nt, Homo sapiens
gaagaggaagcauuuagga

SEQ ID NO: 1150533 - RNA, 19 nt, Homo sapiens
gauaucaucacaucuauag

SEQ ID NO: 1150534 - RNA, 19 nt, Homo sapiens
ccagggaaacacaucauua

SEQ ID NO: 1150535 - RNA, 19 nt, Homo sapiens
cauccuaacugcauuucaa

SEQ ID NO: 1150536 - RNA, 19 nt, Homo sapiens
caugaugccuuuguauuug

SEQ ID NO: 1150537 - RNA, 19 nt, Homo sapiens
uaaaggaaccaaaggcauu

SEQ ID NO: 1150538 - RNA, 19 nt, Homo sapiens
aaaccaugaugccuuugua

SEQ ID NO: 1150539 - RNA, 19 nt, Homo sapiens
caaguaaccaauaguaaug

SEQ ID NO: 1150540 - RNA, 19 nt, Homo sapiens
gaggaagcauuuaggaaag

SEQ ID NO: 1150541 - RNA, 19 nt, Homo sapiens
caauccauaucauguuuga

SEQ ID NO: 1150542 - RNA, 19 nt, Homo sapiens
ccaugaugccuuuguauuu

SEQ ID NO: 1150543 - RNA, 19 nt, Homo sapiens
ccauucaucuauugccuuu

SEQ ID NO: 1150544 - RNA, 19 nt, Homo sapiens
acagagcccugcuuguuga

SEQ ID NO: 1150545 - RNA, 19 nt, Homo sapiens
ugucuuagcaucucacuuu

SEQ ID NO: 1150546 - RNA, 19 nt, Homo sapiens
uucaauaucugcuacugua

SEQ ID NO: 1150547 - RNA, 19 nt, Homo sapiens
caaaggguuucuaccugaa

SEQ ID NO: 1150548 - RNA, 19 nt, Homo sapiens
gaguaacauucaguaguaa

SEQ ID NO: 1150549 - RNA, 19 nt, Homo sapiens
gaaaagcugcacauguuua

SEQ ID NO: 1150550 - RNA, 19 nt, Homo sapiens
gggaaacacaucauuacaa

SEQ ID NO: 1150551 - RNA, 19 nt, Homo sapiens
gaaaacaacuaagauguag

SEQ ID NO: 1150552 - RNA, 19 nt, Homo sapiens
guaaggaaucuugcuaauu

SEQ ID NO: 1150553 - RNA, 19 nt, Homo sapiens
ggaaaacaacuaagaugua

SEQ ID NO: 1150554 - RNA, 19 nt, Homo sapiens
auagguguuucucuucuua

SEQ ID NO: 1150555 - RNA, 19 nt, Homo sapiens
uucaauaacuugcucauuc

SEQ ID NO: 1150556 - RNA, 19 nt, Homo sapiens
gauagguguuucucuucuu

SEQ ID NO: 1150557 - RNA, 19 nt, Homo sapiens
gaccucaaguaaccaauag

SEQ ID NO: 1150558 - RNA, 19 nt, Homo sapiens
acaaaugcaucagugugua

SEQ ID NO: 1150559 - RNA, 19 nt, Homo sapiens
cuacagagcccugcuuguu

SEQ ID NO: 1150560 - RNA, 19 nt, Homo sapiens
guauagaguuguuuuguug

SEQ ID NO: 1150561 - RNA, 19 nt, Homo sapiens
ucacaaauaacccuccauu

SEQ ID NO: 1150562 - RNA, 19 nt, Homo sapiens
caauaucugcuacuguaaa

SEQ ID NO: 1150563 - RNA, 19 nt, Homo sapiens
gguauuauccauuuaaggu

SEQ ID NO: 1150564 - RNA, 19 nt, Homo sapiens
agaggaagcauuuaggaaa

SEQ ID NO: 1150565 - RNA, 19 nt, Homo sapiens
cauggaaggccuacaauuc

SEQ ID NO: 1150566 - RNA, 19 nt, Homo sapiens
caagagaauacccauacaa

SEQ ID NO: 1150567 - RNA, 19 nt, Homo sapiens
caucagaucuuuuguacau

SEQ ID NO: 1150568 - RNA, 19 nt, Homo sapiens
cuuagcaucucacuuuaug

SEQ ID NO: 1150569 - RNA, 19 nt, Homo sapiens
gcauuuaggaaaggguuua

SEQ ID NO: 1150570 - RNA, 19 nt, Homo sapiens
gacaagagaauacccauac

SEQ ID NO: 1150571 - RNA, 19 nt, Homo sapiens
ugugauagguguuucucuu

SEQ ID NO: 1150572 - RNA, 19 nt, Homo sapiens
gcaauagaaaugcaaugug

SEQ ID NO: 1150573 - RNA, 19 nt, Homo sapiens
aggaaaggguuuaguaucu

SEQ ID NO: 1150574 - RNA, 19 nt, Homo sapiens
ggaacauagcuuacaaaug

SEQ ID NO: 1150575 - RNA, 19 nt, Homo sapiens
ucuauugccuuuauguugu

SEQ ID NO: 1150576 - RNA, 19 nt, Homo sapiens
ccucaaguaaccaauagua

SEQ ID NO: 1150577 - RNA, 19 nt, Homo sapiens
ucgaaaagcugcacauguu

SEQ ID NO: 1150578 - RNA, 19 nt, Homo sapiens
aaacacaucauuacaaagg

SEQ ID NO: 1150579 - RNA, 19 nt, Homo sapiens
gcaucucacuuuaugaaaa

SEQ ID NO: 1150580 - RNA, 19 nt, Homo sapiens
cuaacugcauuucaacuca

SEQ ID NO: 1150581 - RNA, 19 nt, Homo sapiens
gcaaugugauagguguuuc

SEQ ID NO: 1150582 - RNA, 19 nt, Homo sapiens
aagagaauacccauacaaa

SEQ ID NO: 1150583 - RNA, 19 nt, Homo sapiens
uagcaucucacuuuaugaa

SEQ ID NO: 1150584 - RNA, 19 nt, Homo sapiens
gaauacugacaagagaaua

SEQ ID NO: 1150585 - RNA, 19 nt, Homo sapiens
uaucaucacaucuauagug

SEQ ID NO: 1150586 - RNA, 19 nt, Homo sapiens
cugcacauguuuacaggaa

SEQ ID NO: 1150587 - RNA, 19 nt, Homo sapiens
cauaguggcaguauuguag

SEQ ID NO: 1150588 - RNA, 19 nt, Homo sapiens
gugcacauuuaucaucaga

SEQ ID NO: 1150589 - RNA, 19 nt, Homo sapiens
gagcauccuaacugcauuu

SEQ ID NO: 1150590 - RNA, 19 nt, Homo sapiens
acaaggugcugucgggaau

SEQ ID NO: 1150591 - RNA, 19 nt, Homo sapiens
uugaagcacuaguuuaauc

SEQ ID NO: 1150592 - RNA, 19 nt, Homo sapiens
uguugaagcacuaguuuaa

SEQ ID NO: 1150593 - RNA, 19 nt, Homo sapiens
gucuuagcaucucacuuua

SEQ ID NO: 1150594 - RNA, 19 nt, Homo sapiens
uguaaggaaucuugcuaau

SEQ ID NO: 1150595 - RNA, 19 nt, Homo sapiens
uacugaaacucguaacaau

SEQ ID NO: 1150596 - RNA, 19 nt, Homo sapiens
ccacauucgcccuuucuug

SEQ ID NO: 1150597 - RNA, 19 nt, Homo sapiens
uuucaaggaacauagcuua

SEQ ID NO: 1150598 - RNA, 19 nt, Homo sapiens
gaagcacuaguuuaaucaa

SEQ ID NO: 1150599 - RNA, 19 nt, Homo sapiens
gcaaugggcugccaagaaa

SEQ ID NO: 1150600 - RNA, 19 nt, Homo sapiens
guauauagcugugaguuua

SEQ ID NO: 1150601 - RNA, 19 nt, Homo sapiens
ggaaagaaguuauagaauc

SEQ ID NO: 1150602 - RNA, 19 nt, Homo sapiens
gaaguacacauuucuguua

SEQ ID NO: 1150603 - RNA, 19 nt, Homo sapiens
uaacgcacgugauugauua

SEQ ID NO: 1150604 - RNA, 19 nt, Homo sapiens
caacacaaauuauggcaaa

SEQ ID NO: 1150605 - RNA, 19 nt, Homo sapiens
caaauaggcucucugugaa

SEQ ID NO: 1150606 - RNA, 19 nt, Homo sapiens
gaacaccguuacccaauga

SEQ ID NO: 1150607 - RNA, 19 nt, Homo sapiens
gaaggaaacguagaaauuu

SEQ ID NO: 1150608 - RNA, 19 nt, Homo sapiens
gaagaaagagucaaugaga

SEQ ID NO: 1150609 - RNA, 19 nt, Homo sapiens
ccaccgagcucuucaguug

SEQ ID NO: 1150610 - RNA, 19 nt, Homo sapiens
ggacacauauguauaaacu

SEQ ID NO: 1150611 - RNA, 19 nt, Homo sapiens
acagagaggugucauggua

SEQ ID NO: 1150612 - RNA, 19 nt, Homo sapiens
gaucagagauuugucuuuc

SEQ ID NO: 1150613 - RNA, 19 nt, Homo sapiens
gauaggacaucaccauuuc

SEQ ID NO: 1150614 - RNA, 19 nt, Homo sapiens
gaaauccagucuuaaaucu

SEQ ID NO: 1150615 - RNA, 19 nt, Homo sapiens
cgaauuaagugucaccauu

SEQ ID NO: 1150616 - RNA, 19 nt, Homo sapiens
ggaaagagagagagaaaga

SEQ ID NO: 1150617 - RNA, 19 nt, Homo sapiens
gaccagcucuaucugcaua

SEQ ID NO: 1150618 - RNA, 19 nt, Homo sapiens
gaagacugccuuuacuuaa

SEQ ID NO: 1150619 - RNA, 19 nt, Homo sapiens
caaguacacucggauauug

SEQ ID NO: 1150620 - RNA, 19 nt, Homo sapiens
gcaauaacaaccuuugauu

SEQ ID NO: 1150621 - RNA, 19 nt, Homo sapiens
guuauaagguggaaggaaa

SEQ ID NO: 1150622 - RNA, 19 nt, Homo sapiens
ggauguggaugcagauuug

SEQ ID NO: 1150623 - RNA, 19 nt, Homo sapiens
cgaaauaacgcacgugauu

SEQ ID NO: 1150624 - RNA, 19 nt, Homo sapiens
uaggauaacuucacugaga

SEQ ID NO: 1150625 - RNA, 19 nt, Homo sapiens
gggaagaaaggauagaaua

SEQ ID NO: 1150626 - RNA, 19 nt, Homo sapiens
ccacuccaaucgauguuua

SEQ ID NO: 1150627 - RNA, 19 nt, Homo sapiens
gaucaugucucugcagaug

SEQ ID NO: 1150628 - RNA, 19 nt, Homo sapiens
gaaguggccugguccaagu

SEQ ID NO: 1150629 - RNA, 19 nt, Homo sapiens
gaaacaguagccaaagaua

SEQ ID NO: 1150630 - RNA, 19 nt, Homo sapiens
gcacucggucccuuauuua

SEQ ID NO: 1150631 - RNA, 19 nt, Homo sapiens
ugaacgagauauuccagua

SEQ ID NO: 1150632 - RNA, 19 nt, Homo sapiens
uaacugcucuugccaucaa

SEQ ID NO: 1150633 - RNA, 19 nt, Homo sapiens
ugaaguaccugcucagcuu

SEQ ID NO: 1150634 - RNA, 19 nt, Homo sapiens
ggacaaaacaguacaaauu

SEQ ID NO: 1150635 - RNA, 19 nt, Homo sapiens
caaaugauaucgcucacau

SEQ ID NO: 1150636 - RNA, 19 nt, Homo sapiens
ccacggacaugguagaaug

SEQ ID NO: 1150637 - RNA, 19 nt, Homo sapiens
uaacuaccgucugggaaua

SEQ ID NO: 1150638 - RNA, 19 nt, Homo sapiens
acaaauaggcucucuguga

SEQ ID NO: 1150639 - RNA, 19 nt, Homo sapiens
ggaagaaaggauagaauau

SEQ ID NO: 1150640 - RNA, 19 nt, Homo sapiens
ggauggcucuccuuaagug

SEQ ID NO: 1150641 - RNA, 19 nt, Homo sapiens
gaagagggaaggaaagaga

SEQ ID NO: 1150642 - RNA, 19 nt, Homo sapiens
acacaacuguccucauuga

SEQ ID NO: 1150643 - RNA, 19 nt, Homo sapiens
ggacugcuauggcuuccuu

SEQ ID NO: 1150644 - RNA, 19 nt, Homo sapiens
cuagcaauauguacaguaa

SEQ ID NO: 1150645 - RNA, 19 nt, Homo sapiens
ccgaauucauuguuucaua

SEQ ID NO: 1150646 - RNA, 19 nt, Homo sapiens
caacauuucuuuccuacag

SEQ ID NO: 1150647 - RNA, 19 nt, Homo sapiens
gaaagagucaaugagauuu

SEQ ID NO: 1150648 - RNA, 19 nt, Homo sapiens
caaucgauguuuaguguga

SEQ ID NO: 1150649 - RNA, 19 nt, Homo sapiens
agaaacaccacaaaugaua

SEQ ID NO: 1150650 - RNA, 19 nt, Homo sapiens
ugaagacugccuuuacuua

SEQ ID NO: 1150651 - RNA, 19 nt, Homo sapiens
uaacaaccuuugauuacug

SEQ ID NO: 1150652 - RNA, 19 nt, Homo sapiens
ccagagagaaggaaacgua

SEQ ID NO: 1150653 - RNA, 19 nt, Homo sapiens
caaauccuauugcuuaucu

SEQ ID NO: 1150654 - RNA, 19 nt, Homo sapiens
aaacaaagacaugggauuu

SEQ ID NO: 1150655 - RNA, 19 nt, Homo sapiens
ggaaagagagaaggaaaga

SEQ ID NO: 1150656 - RNA, 19 nt, Homo sapiens
gaauuaagugucaccauug

SEQ ID NO: 1150657 - RNA, 19 nt, Homo sapiens
ccaaguucauucacacaaa

SEQ ID NO: 1150658 - RNA, 19 nt, Homo sapiens
cagaguuccuguuaaguga

SEQ ID NO: 1150659 - RNA, 19 nt, Homo sapiens
caacuuagcacacgugaag

SEQ ID NO: 1150660 - RNA, 19 nt, Homo sapiens
ucuuaaaucucuccgcuaa

SEQ ID NO: 1150661 - RNA, 19 nt, Homo sapiens
gaaauaacgcacgugauug

SEQ ID NO: 1150662 - RNA, 19 nt, Homo sapiens
ggaacaagaacuacaagga

SEQ ID NO: 1150663 - RNA, 19 nt, Homo sapiens
agaaggaaacguagaaauu

SEQ ID NO: 1150664 - RNA, 19 nt, Homo sapiens
ccaaacaccaucaccauga

SEQ ID NO: 1150665 - RNA, 19 nt, Homo sapiens
gcucuggcccuuugaauau

SEQ ID NO: 1150666 - RNA, 19 nt, Homo sapiens
agagaaacaccacaaauga

SEQ ID NO: 1150667 - RNA, 19 nt, Homo sapiens
gacaagaggcgccaugaga

SEQ ID NO: 1150668 - RNA, 19 nt, Homo sapiens
cuacuucuaugccuucuau

SEQ ID NO: 1150669 - RNA, 19 nt, Homo sapiens
ugaccuauguucaagauca

SEQ ID NO: 1150670 - RNA, 19 nt, Homo sapiens
caauuuggauacuuugaug

SEQ ID NO: 1150671 - RNA, 19 nt, Homo sapiens
ccgaaauacuacucaguuu

SEQ ID NO: 1150672 - RNA, 19 nt, Homo sapiens
cgaauucauuguuucauag

SEQ ID NO: 1150673 - RNA, 19 nt, Homo sapiens
gagugauucucuguauaua

SEQ ID NO: 1150674 - RNA, 19 nt, Homo sapiens
ccaagaaacaguagccaaa

SEQ ID NO: 1150675 - RNA, 19 nt, Homo sapiens
uaagguggaaggaaacaua

SEQ ID NO: 1150676 - RNA, 19 nt, Homo sapiens
gaaguaccugcucagcuua

SEQ ID NO: 1150677 - RNA, 19 nt, Homo sapiens
gagauauuccaguauguuu

SEQ ID NO: 1150678 - RNA, 19 nt, Homo sapiens
gcacaacuugaacgagaua

SEQ ID NO: 1150679 - RNA, 19 nt, Homo sapiens
gaugaccuauguucaagau

SEQ ID NO: 1150680 - RNA, 19 nt, Homo sapiens
cggcugugcuuguucuuaa

SEQ ID NO: 1150681 - RNA, 19 nt, Homo sapiens
cuagaaauccagucuuaaa

SEQ ID NO: 1150682 - RNA, 19 nt, Homo sapiens
gaaaacggcugugcuuguu

SEQ ID NO: 1150683 - RNA, 19 nt, Homo sapiens
ggagaccacuguuuugaaa

SEQ ID NO: 1150684 - RNA, 19 nt, Homo sapiens
guacgguucugugcaaaga

SEQ ID NO: 1150685 - RNA, 19 nt, Homo sapiens
gagagaaggaaacguagaa

SEQ ID NO: 1150686 - RNA, 19 nt, Homo sapiens
gaacgaagagaucaugucu

SEQ ID NO: 1150687 - RNA, 19 nt, Homo sapiens
gaaacaccacaaaugauau

SEQ ID NO: 1150688 - RNA, 19 nt, Homo sapiens
ccaauguccuccugugguu

SEQ ID NO: 1150689 - RNA, 19 nt, Homo sapiens
cguguuagccuucaugaaa

SEQ ID NO: 1150690 - RNA, 19 nt, Homo sapiens
gaugacggcuugggugaug

SEQ ID NO: 1150691 - RNA, 19 nt, Homo sapiens
gaacgagauauuccaguau

SEQ ID NO: 1150692 - RNA, 19 nt, Homo sapiens
ccaaagaccagcucuaucu

SEQ ID NO: 1150693 - RNA, 19 nt, Homo sapiens
ccaaguauaaucccaaaga

SEQ ID NO: 1150694 - RNA, 19 nt, Homo sapiens
guaagaagcccgucauggu

SEQ ID NO: 1150695 - RNA, 19 nt, Homo sapiens
gcuauggcuuccuuuguug

SEQ ID NO: 1150696 - RNA, 19 nt, Homo sapiens
gaggugucaugguaagauu

SEQ ID NO: 1150697 - RNA, 19 nt, Homo sapiens
ggguuaaauuugagaguga

SEQ ID NO: 1150698 - RNA, 19 nt, Homo sapiens
gaaggaaacauaguagcaa

SEQ ID NO: 1150699 - RNA, 19 nt, Homo sapiens
ggaggaagcugcagaugua

SEQ ID NO: 1150700 - RNA, 19 nt, Homo sapiens
ccagauagcuuguuaagaa

SEQ ID NO: 1150701 - RNA, 19 nt, Homo sapiens
gcacauuccuggaucaaua

SEQ ID NO: 1150702 - RNA, 19 nt, Homo sapiens
agaagaagcugagcaauua

SEQ ID NO: 1150703 - RNA, 19 nt, Homo sapiens
gaaagccagugcacucuua

SEQ ID NO: 1150704 - RNA, 19 nt, Homo sapiens
gaauuaugcuugcuuguuu

SEQ ID NO: 1150705 - RNA, 19 nt, Homo sapiens
ggaagaagcugauguggau

SEQ ID NO: 1150706 - RNA, 19 nt, Homo sapiens
aaacagaccucuucacuug

SEQ ID NO: 1150707 - RNA, 19 nt, Homo sapiens
aaagaaagcccaaaucaua

SEQ ID NO: 1150708 - RNA, 19 nt, Homo sapiens
ccagugaacuuauaccaua

SEQ ID NO: 1150709 - RNA, 19 nt, Homo sapiens
gaauagauaugcccuagga

SEQ ID NO: 1150710 - RNA, 19 nt, Homo sapiens
gcaaguagcuuuuguaaau

SEQ ID NO: 1150711 - RNA, 19 nt, Homo sapiens
ugacaaagaugcaaagaug

SEQ ID NO: 1150712 - RNA, 19 nt, Homo sapiens
gaacaggagauacucaaua

SEQ ID NO: 1150713 - RNA, 19 nt, Homo sapiens
gaaagcaaauggugucaau

SEQ ID NO: 1150714 - RNA, 19 nt, Homo sapiens
gaaaggagaauuaaggaaa

SEQ ID NO: 1150715 - RNA, 19 nt, Homo sapiens
gaauuuggccuuguauuua

SEQ ID NO: 1150716 - RNA, 19 nt, Homo sapiens
guaagaaacucauuauugg

SEQ ID NO: 1150717 - RNA, 19 nt, Homo sapiens
gaagacaauuugcucugua

SEQ ID NO: 1150718 - RNA, 19 nt, Homo sapiens
gcagauguacuuuguauuu

SEQ ID NO: 1150719 - RNA, 19 nt, Homo sapiens
gaacagcagcuuaggcaua

SEQ ID NO: 1150720 - RNA, 19 nt, Homo sapiens
caaaccaacugaagaagaa

SEQ ID NO: 1150721 - RNA, 19 nt, Homo sapiens
gcagacauauucagguaaa

SEQ ID NO: 1150722 - RNA, 19 nt, Homo sapiens
gaagccauauguuuaaaga

SEQ ID NO: 1150723 - RNA, 19 nt, Homo sapiens
gaaugcuccugacuaauaa

SEQ ID NO: 1150724 - RNA, 19 nt, Homo sapiens
cuacuuugcugauauguuu

SEQ ID NO: 1150725 - RNA, 19 nt, Homo sapiens
gcacuucagccuucaauaa

SEQ ID NO: 1150726 - RNA, 19 nt, Homo sapiens
guaagaagcacccgaauug

SEQ ID NO: 1150727 - RNA, 19 nt, Homo sapiens
ggaauuuggccuuguauuu

SEQ ID NO: 1150728 - RNA, 19 nt, Homo sapiens
cgaaugcuccugacuaaua

SEQ ID NO: 1150729 - RNA, 19 nt, Homo sapiens
ccagaccgcuucacuugua

SEQ ID NO: 1150730 - RNA, 19 nt, Homo sapiens
gauaucuucuugcaucuaa

SEQ ID NO: 1150731 - RNA, 19 nt, Homo sapiens
ggacuugguuuggaacuuu

SEQ ID NO: 1150732 - RNA, 19 nt, Homo sapiens
caacaugaaucugcauauu

SEQ ID NO: 1150733 - RNA, 19 nt, Homo sapiens
ccaaguggauggucucaaa

SEQ ID NO: 1150734 - RNA, 19 nt, Homo sapiens
gaaauggacagcagagaaa

SEQ ID NO: 1150735 - RNA, 19 nt, Homo sapiens
ggacuuucaugcuuuagaa

SEQ ID NO: 1150736 - RNA, 19 nt, Homo sapiens
ggaaggagaagacaauuug

SEQ ID NO: 1150737 - RNA, 19 nt, Homo sapiens
agaaugaccugaugauaga

SEQ ID NO: 1150738 - RNA, 19 nt, Homo sapiens
gcaaagaaagcccaaauca

SEQ ID NO: 1150739 - RNA, 19 nt, Homo sapiens
guaagugguuugcuucuug

SEQ ID NO: 1150740 - RNA, 19 nt, Homo sapiens
gauaggccuucccagaaua

SEQ ID NO: 1150741 - RNA, 19 nt, Homo sapiens
gcaaacagucaauaaacua

SEQ ID NO: 1150742 - RNA, 19 nt, Homo sapiens
gacauuggaucauacuaaa

SEQ ID NO: 1150743 - RNA, 19 nt, Homo sapiens
aaaugaagguagagcaaua

SEQ ID NO: 1150744 - RNA, 19 nt, Homo sapiens
gaaagaguauugagaagac

SEQ ID NO: 1150745 - RNA, 19 nt, Homo sapiens
uaaagggaaaggagaauua

SEQ ID NO: 1150746 - RNA, 19 nt, Homo sapiens
gcugauauguuucuauugu

SEQ ID NO: 1150747 - RNA, 19 nt, Homo sapiens
gaaguucagugccuuaucu

SEQ ID NO: 1150748 - RNA, 19 nt, Homo sapiens
caacaugaguauaguuuag

SEQ ID NO: 1150749 - RNA, 19 nt, Homo sapiens
gaaagaagagcauguugug

SEQ ID NO: 1150750 - RNA, 19 nt, Homo sapiens
ggacugacguuagaguuug

SEQ ID NO: 1150751 - RNA, 19 nt, Homo sapiens
ggagagagcauccugguau

SEQ ID NO: 1150752 - RNA, 19 nt, Homo sapiens
caagaaagaguauugagaa

SEQ ID NO: 1150753 - RNA, 19 nt, Homo sapiens
gauauuacccuacacaugu

SEQ ID NO: 1150754 - RNA, 19 nt, Homo sapiens
gagaagaucuuugaguaag

SEQ ID NO: 1150755 - RNA, 19 nt, Homo sapiens
caauccagauagcuuguua

SEQ ID NO: 1150756 - RNA, 19 nt, Homo sapiens
caggagauacucaauauuu

SEQ ID NO: 1150757 - RNA, 19 nt, Homo sapiens
gcaaccagcuuagugcuau

SEQ ID NO: 1150758 - RNA, 19 nt, Homo sapiens
aagcauggauccugaugua

SEQ ID NO: 1150759 - RNA, 19 nt, Homo sapiens
ggagaauucugcaaacagu

SEQ ID NO: 1150760 - RNA, 19 nt, Homo sapiens
gcuacuaacuacccacauu

SEQ ID NO: 1150761 - RNA, 19 nt, Homo sapiens
gaagguggauguuguuugc

SEQ ID NO: 1150762 - RNA, 19 nt, Homo sapiens
aaacagaugugugcagcua

SEQ ID NO: 1150763 - RNA, 19 nt, Homo sapiens
aaacugaggccuugcgaua

SEQ ID NO: 1150764 - RNA, 19 nt, Homo sapiens
guaagaaaaugcaguguuu

SEQ ID NO: 1150765 - RNA, 19 nt, Homo sapiens
gagcauuuccuccauugua

SEQ ID NO: 1150766 - RNA, 19 nt, Homo sapiens
gaauggauaucuucuugca

SEQ ID NO: 1150767 - RNA, 19 nt, Homo sapiens
ggcgaaugcuccugacuaa

SEQ ID NO: 1150768 - RNA, 19 nt, Homo sapiens
gcaaagaacagcagcuuag

SEQ ID NO: 1150769 - RNA, 19 nt, Homo sapiens
aguaacaacucuaaacuga

SEQ ID NO: 1150770 - RNA, 19 nt, Homo sapiens
uggcuaaguuggaugauaa

SEQ ID NO: 1150771 - RNA, 19 nt, Homo sapiens
ugagugacuugguuuguuu

SEQ ID NO: 1150772 - RNA, 19 nt, Homo sapiens
aagcagagcucccuuccuu

SEQ ID NO: 1150773 - RNA, 19 nt, Homo sapiens
caaccugagugccaacauu

SEQ ID NO: 1150774 - RNA, 19 nt, Homo sapiens
gggaugaagauuguaauua

SEQ ID NO: 1150775 - RNA, 19 nt, Homo sapiens
gaagcuuugcuacauguua

SEQ ID NO: 1150776 - RNA, 19 nt, Homo sapiens
gaacuguuggcaauuauga

SEQ ID NO: 1150777 - RNA, 19 nt, Homo sapiens
uugagaagaucuuugagua

SEQ ID NO: 1150778 - RNA, 19 nt, Homo sapiens
caaagaagaaccugagaga

SEQ ID NO: 1150779 - RNA, 19 nt, Homo sapiens
caauaugcauuaccaaagu

SEQ ID NO: 1150780 - RNA, 19 nt, Homo sapiens
gcauucagcuuuacuacgu

SEQ ID NO: 1150781 - RNA, 19 nt, Homo sapiens
ugucacagcucaugcaguu

SEQ ID NO: 1150782 - RNA, 19 nt, Homo sapiens
aaaugaagcuugugaggau

SEQ ID NO: 1150783 - RNA, 19 nt, Homo sapiens
ggcccuaccucauauucua

SEQ ID NO: 1150784 - RNA, 19 nt, Homo sapiens
gcacgcgccaccuguauuu

SEQ ID NO: 1150785 - RNA, 19 nt, Homo sapiens
gaaacagaccucuucacuu

SEQ ID NO: 1150786 - RNA, 19 nt, Homo sapiens
ucaguaacuuccauugauu

SEQ ID NO: 1150787 - RNA, 19 nt, Homo sapiens
gaucuacuuugcugauaug

SEQ ID NO: 1150788 - RNA, 19 nt, Homo sapiens
guaaaguauugucuuggaa

SEQ ID NO: 1150789 - RNA, 19 nt, Homo sapiens
gauccagaauuaagacuuc

SEQ ID NO: 1150790 - RNA, 19 nt, Homo sapiens
guguuaacauccaauauga

SEQ ID NO: 1150791 - RNA, 19 nt, Homo sapiens
gaaguguuaacauccaaua

SEQ ID NO: 1150792 - RNA, 19 nt, Homo sapiens
gacuuuagcugccaugcaa

SEQ ID NO: 1150793 - RNA, 19 nt, Homo sapiens
uagcaaacacgaagacuuu

SEQ ID NO: 1150794 - RNA, 19 nt, Homo sapiens
ggucauaaccugcuguguu

SEQ ID NO: 1150795 - RNA, 19 nt, Homo sapiens
gcagugcaaguaauaguaa

SEQ ID NO: 1150796 - RNA, 19 nt, Homo sapiens
gaucagauuccuaucaaau

SEQ ID NO: 1150797 - RNA, 19 nt, Homo sapiens
caaaucagccagucacaga

SEQ ID NO: 1150798 - RNA, 19 nt, Homo sapiens
agaagagcauguugugaaa

SEQ ID NO: 1150799 - RNA, 19 nt, Homo sapiens
ggacaaggauaaaggaaua

SEQ ID NO: 1150800 - RNA, 19 nt, Homo sapiens
gcacaaagcacuuaaagaa

SEQ ID NO: 1150801 - RNA, 19 nt, Homo sapiens
gaaaggccaugaaauagaa

SEQ ID NO: 1150802 - RNA, 19 nt, Homo sapiens
gcaaauaaaucucauagca

SEQ ID NO: 1150803 - RNA, 19 nt, Homo sapiens
uaagaaaggccaugaaaua

SEQ ID NO: 1150804 - RNA, 19 nt, Homo sapiens
ucaaugaucugaagaguga

SEQ ID NO: 1150805 - RNA, 19 nt, Homo sapiens
gagagcaucuuguucauug

SEQ ID NO: 1150806 - RNA, 19 nt, Homo sapiens
gcaggagaaugaagaauug

SEQ ID NO: 1150807 - RNA, 19 nt, Homo sapiens
aauaacagcuguaguaaga

SEQ ID NO: 1150808 - RNA, 19 nt, Homo sapiens
gaagaacuguugcuuuauc

SEQ ID NO: 1150809 - RNA, 19 nt, Homo sapiens
aggaagaacuguugcuuua

SEQ ID NO: 1150810 - RNA, 19 nt, Homo sapiens
uauguaaccuuccauguuu

SEQ ID NO: 1150811 - RNA, 19 nt, Homo sapiens
aaagaauccucgaagcuua

SEQ ID NO: 1150812 - RNA, 19 nt, Homo sapiens
ccaaauguuucauguagaa

SEQ ID NO: 1150813 - RNA, 19 nt, Homo sapiens
acaaauaacagcuguagua

SEQ ID NO: 1150814 - RNA, 19 nt, Homo sapiens
gauuuaaccugucuucuuc

SEQ ID NO: 1150815 - RNA, 19 nt, Homo sapiens
gaauaaagaacgagaacaa

SEQ ID NO: 1150816 - RNA, 19 nt, Homo sapiens
cagcauugguugacaaauu

SEQ ID NO: 1150817 - RNA, 19 nt, Homo sapiens
gaaaagagcaggcaaaaga

SEQ ID NO: 1150818 - RNA, 19 nt, Homo sapiens
ggaagucauuggcuaguau

SEQ ID NO: 1150819 - RNA, 19 nt, Homo sapiens
gagaaggagucgaaaguca

SEQ ID NO: 1150820 - RNA, 19 nt, Homo sapiens
ggacaucaaguuaaugaaa

SEQ ID NO: 1150821 - RNA, 19 nt, Homo sapiens
caacaggacaucaaguuaa

SEQ ID NO: 1150822 - RNA, 19 nt, Homo sapiens
ggaaugaguuacaaacagu

SEQ ID NO: 1150823 - RNA, 19 nt, Homo sapiens
gcaugaaaccucuaaguug

SEQ ID NO: 1150824 - RNA, 19 nt, Homo sapiens
gagagaaucggcuuaaaga

SEQ ID NO: 1150825 - RNA, 19 nt, Homo sapiens
gcaaguugauacucauguu

SEQ ID NO: 1150826 - RNA, 19 nt, Homo sapiens
gucauuggcuaguauaauu

SEQ ID NO: 1150827 - RNA, 19 nt, Homo sapiens
uguuagagaucaagaauga

SEQ ID NO: 1150828 - RNA, 19 nt, Homo sapiens
gaaaagaaaucgcuugaag

SEQ ID NO: 1150829 - RNA, 19 nt, Homo sapiens
caugguaaaucuuguguug

SEQ ID NO: 1150830 - RNA, 19 nt, Homo sapiens
cauguuugcuucugauaaa

SEQ ID NO: 1150831 - RNA, 19 nt, Homo sapiens
ccucuaaguuggaaauuga

SEQ ID NO: 1150832 - RNA, 19 nt, Homo sapiens
gccaaaggauugcuucgaa

SEQ ID NO: 1150833 - RNA, 19 nt, Homo sapiens
gaagcuagccacucagaga

SEQ ID NO: 1150834 - RNA, 19 nt, Homo sapiens
gugaauauuugggucauuu

SEQ ID NO: 1150835 - RNA, 19 nt, Homo sapiens
uucaguggcuguacaaaua

SEQ ID NO: 1150836 - RNA, 19 nt, Homo sapiens
ccaaaggauugcuucgaaa

SEQ ID NO: 1150837 - RNA, 19 nt, Homo sapiens
agaaucggcuuaaagaguu

SEQ ID NO: 1150838 - RNA, 19 nt, Homo sapiens
gaacgagagaaucggcuua

SEQ ID NO: 1150839 - RNA, 19 nt, Homo sapiens
cuaacuaacuguguaaaga

SEQ ID NO: 1150840 - RNA, 19 nt, Homo sapiens
caacaacacagcauugguu

SEQ ID NO: 1150841 - RNA, 19 nt, Homo sapiens
gaucauguaucuagaacag

SEQ ID NO: 1150842 - RNA, 19 nt, Homo sapiens
gaagauuuacuuucugaga

SEQ ID NO: 1150843 - RNA, 19 nt, Homo sapiens
gaugaugcaguacuugaua

SEQ ID NO: 1150844 - RNA, 19 nt, Homo sapiens
aagccuggauuugauauua

SEQ ID NO: 1150845 - RNA, 19 nt, Homo sapiens
ggacaacaacacagcauug

SEQ ID NO: 1150846 - RNA, 19 nt, Homo sapiens
agagaaacuugaauugcua

SEQ ID NO: 1150847 - RNA, 19 nt, Homo sapiens
caaauaacagcuguaguaa

SEQ ID NO: 1150848 - RNA, 19 nt, Homo sapiens
cuaacacuauccuguaauu

SEQ ID NO: 1150849 - RNA, 19 nt, Homo sapiens
ggagaaugaagaauugaaa

SEQ ID NO: 1150850 - RNA, 19 nt, Homo sapiens
caugugagccuaacacuau

SEQ ID NO: 1150851 - RNA, 19 nt, Homo sapiens
guuguugucucccaaauuc

SEQ ID NO: 1150852 - RNA, 19 nt, Homo sapiens
caggcuauguguaaaugua

SEQ ID NO: 1150853 - RNA, 19 nt, Homo sapiens
gaucaagaaugagaaacug

SEQ ID NO: 1150854 - RNA, 19 nt, Homo sapiens
ggaguuagaaagccugaaa

SEQ ID NO: 1150855 - RNA, 19 nt, Homo sapiens
uagagaagcaaaucaauga

SEQ ID NO: 1150856 - RNA, 19 nt, Homo sapiens
uuacgugaccggcaaauaa

SEQ ID NO: 1150857 - RNA, 19 nt, Homo sapiens
gcuuaccgaugaugcagua

SEQ ID NO: 1150858 - RNA, 19 nt, Homo sapiens
acgaggagcuucuguggaa

SEQ ID NO: 1150859 - RNA, 19 nt, Homo sapiens
ugaaagcuguguuagagau

SEQ ID NO: 1150860 - RNA, 19 nt, Homo sapiens
gaagaugggaaacaaaaua

SEQ ID NO: 1150861 - RNA, 19 nt, Homo sapiens
uaaacuaaagccuggauuu

SEQ ID NO: 1150862 - RNA, 19 nt, Homo sapiens
gagaagcacuguuguuuuc

SEQ ID NO: 1150863 - RNA, 19 nt, Homo sapiens
gaauuaugaucaucuacca

SEQ ID NO: 1150864 - RNA, 19 nt, Homo sapiens
gagaaucggcuuaaagagu

SEQ ID NO: 1150865 - RNA, 19 nt, Homo sapiens
aaaccaaaguggauuuauc

SEQ ID NO: 1150866 - RNA, 19 nt, Homo sapiens
cauagcaaguugauacuca

SEQ ID NO: 1150867 - RNA, 19 nt, Homo sapiens
uaacagcuguaguaagaag

SEQ ID NO: 1150868 - RNA, 19 nt, Homo sapiens
gaagucauuggcuaguaua

SEQ ID NO: 1150869 - RNA, 19 nt, Homo sapiens
gccuaacacuauccuguaa

SEQ ID NO: 1150870 - RNA, 19 nt, Homo sapiens
guucagccaugucaguuga

SEQ ID NO: 1150871 - RNA, 19 nt, Homo sapiens
ucagggcccuauuaagauu

SEQ ID NO: 1150872 - RNA, 19 nt, Homo sapiens
aagagucgcuggagaagga

SEQ ID NO: 1150873 - RNA, 19 nt, Homo sapiens
gaaucggcuuaaagaguuu

SEQ ID NO: 1150874 - RNA, 19 nt, Homo sapiens
ggaggaagcacugaaacaa

SEQ ID NO: 1150875 - RNA, 19 nt, Homo sapiens
ugguaaaucuuguguuguu

SEQ ID NO: 1150876 - RNA, 19 nt, Homo sapiens
cgacuuccuucaggguuua

SEQ ID NO: 1150877 - RNA, 19 nt, Homo sapiens
gcuugaagauuuacuuucu

SEQ ID NO: 1150878 - RNA, 19 nt, Homo sapiens
aaagaaaucgcuugaagau

SEQ ID NO: 1150879 - RNA, 19 nt, Homo sapiens
cuucuugccugugguaaua

SEQ ID NO: 1150880 - RNA, 19 nt, Homo sapiens
guauguaaccuuccauguu

SEQ ID NO: 1150881 - RNA, 19 nt, Homo sapiens
uccaauacuucaucaugua

SEQ ID NO: 1150882 - RNA, 19 nt, Homo sapiens
ccucgaagcuuauguaucc

SEQ ID NO: 1150883 - RNA, 19 nt, Homo sapiens
ucaacaggacaucaaguua

SEQ ID NO: 1150884 - RNA, 19 nt, Homo sapiens
gagugaaaaugaugcuuua

SEQ ID NO: 1150885 - RNA, 19 nt, Homo sapiens
gcuggaauacucaagaauu

SEQ ID NO: 1150886 - RNA, 19 nt, Homo sapiens
ggaagagcuuugacuuguc

SEQ ID NO: 1150887 - RNA, 19 nt, Homo sapiens
aagcgacucucuauggaaa

SEQ ID NO: 1150888 - RNA, 19 nt, Homo sapiens
aaccaaauguuucauguag

SEQ ID NO: 1150889 - RNA, 19 nt, Homo sapiens
cauauacauuucagccaaa

SEQ ID NO: 1150890 - RNA, 19 nt, Homo sapiens
ucucagggcccuauuaaga

SEQ ID NO: 1150891 - RNA, 19 nt, Homo sapiens
cagagaaacuugaauugcu

SEQ ID NO: 1150892 - RNA, 19 nt, Homo sapiens
gggaggauagcgcucauuu

SEQ ID NO: 1150893 - RNA, 19 nt, Homo sapiens
uaaagaacgagaacaagga

SEQ ID NO: 1150894 - RNA, 19 nt, Homo sapiens
cuucuucccucccauuauu

SEQ ID NO: 1150895 - RNA, 19 nt, Homo sapiens
ccucugcuguguauuaaau

SEQ ID NO: 1150896 - RNA, 19 nt, Homo sapiens
gacaccuucuugugaguuu

SEQ ID NO: 1150897 - RNA, 19 nt, Homo sapiens
uggagaaacugguggacaa

SEQ ID NO: 1150898 - RNA, 19 nt, Homo sapiens
cuggaauacucaagaauug

SEQ ID NO: 1150899 - RNA, 19 nt, Homo sapiens
gaaaauaccuggaaucuuu

SEQ ID NO: 1150900 - RNA, 19 nt, Homo sapiens
gagaagaaauuccuguuaa

SEQ ID NO: 1150901 - RNA, 19 nt, Homo sapiens
gaaaggcccuguaaagaga

SEQ ID NO: 1150902 - RNA, 19 nt, Homo sapiens
gcacagcccucaacuacuu

SEQ ID NO: 1150903 - RNA, 19 nt, Homo sapiens
gcaaaugucugaugaagca

SEQ ID NO: 1150904 - RNA, 19 nt, Homo sapiens
ccacauaccuguacagaau

SEQ ID NO: 1150905 - RNA, 19 nt, Homo sapiens
gaaagggaguuagggcuua

SEQ ID NO: 1150906 - RNA, 19 nt, Homo sapiens
gaaauccaaucuuccguaa

SEQ ID NO: 1150907 - RNA, 19 nt, Homo sapiens
ucucagaaauggcaaguua

SEQ ID NO: 1150908 - RNA, 19 nt, Homo sapiens
ggacauccagcaaacauua

SEQ ID NO: 1150909 - RNA, 19 nt, Homo sapiens
gcaaucagcugugugcauu

SEQ ID NO: 1150910 - RNA, 19 nt, Homo sapiens
gaagaggagaaccauauua

SEQ ID NO: 1150911 - RNA, 19 nt, Homo sapiens
ggaacacguugucaaguuu

SEQ ID NO: 1150912 - RNA, 19 nt, Homo sapiens
gcaaaucccugaaauacag

SEQ ID NO: 1150913 - RNA, 19 nt, Homo sapiens
gcuaaaguaucaacuauca

SEQ ID NO: 1150914 - RNA, 19 nt, Homo sapiens
ggacuucaaugcuuucuuc

SEQ ID NO: 1150915 - RNA, 19 nt, Homo sapiens
guacagcgcuauuaauuac

SEQ ID NO: 1150916 - RNA, 19 nt, Homo sapiens
ccagauaguucccauucua

SEQ ID NO: 1150917 - RNA, 19 nt, Homo sapiens
gcaaccaauuuaagaacua

SEQ ID NO: 1150918 - RNA, 19 nt, Homo sapiens
uaaugucucugcacucuuu

SEQ ID NO: 1150919 - RNA, 19 nt, Homo sapiens
gggaguggcuaaaguauca

SEQ ID NO: 1150920 - RNA, 19 nt, Homo sapiens
gaugaggacuucaaugcuu

SEQ ID NO: 1150921 - RNA, 19 nt, Homo sapiens
gaaguggacugaagcuaca

SEQ ID NO: 1150922 - RNA, 19 nt, Homo sapiens
uggaaaggaucuucaguuu

SEQ ID NO: 1150923 - RNA, 19 nt, Homo sapiens
gcuggaagcccucaaguuu

SEQ ID NO: 1150924 - RNA, 19 nt, Homo sapiens
gaacccacaauacauuaua

SEQ ID NO: 1150925 - RNA, 19 nt, Homo sapiens
ggagaaccauauuaaagau

SEQ ID NO: 1150926 - RNA, 19 nt, Homo sapiens
cgaaugagcuuuuguguau

SEQ ID NO: 1150927 - RNA, 19 nt, Homo sapiens
ggagaagugugcccucaug

SEQ ID NO: 1150928 - RNA, 19 nt, Homo sapiens
ggucuucucuaagcuauuu

SEQ ID NO: 1150929 - RNA, 19 nt, Homo sapiens
ucauggagcugauugcaaa

SEQ ID NO: 1150930 - RNA, 19 nt, Homo sapiens
gcaucuggcuuucucaaga

SEQ ID NO: 1150931 - RNA, 19 nt, Homo sapiens
caagcaaacugucgaguag

SEQ ID NO: 1150932 - RNA, 19 nt, Homo sapiens
gaagggugcugaccacagu

SEQ ID NO: 1150933 - RNA, 19 nt, Homo sapiens
gaaacuucuugacaauuug

SEQ ID NO: 1150934 - RNA, 19 nt, Homo sapiens
gcaagcaaacugucgagua

SEQ ID NO: 1150935 - RNA, 19 nt, Homo sapiens
gagaagguguaucugaaga

SEQ ID NO: 1150936 - RNA, 19 nt, Homo sapiens
ggagauaagagcuguaaug

SEQ ID NO: 1150937 - RNA, 19 nt, Homo sapiens
gaacaauauuccugacuac

SEQ ID NO: 1150938 - RNA, 19 nt, Homo sapiens
ugaacaauauuccugacua

SEQ ID NO: 1150939 - RNA, 19 nt, Homo sapiens
ugucagauguugaugcuuu

SEQ ID NO: 1150940 - RNA, 19 nt, Homo sapiens
gaacuuugauaccaaggau

SEQ ID NO: 1150941 - RNA, 19 nt, Homo sapiens
gaagaaauuccuguuaaug

SEQ ID NO: 1150942 - RNA, 19 nt, Homo sapiens
cagaggauguagugacuuu

SEQ ID NO: 1150943 - RNA, 19 nt, Homo sapiens
cagaauuggugauguuuau

SEQ ID NO: 1150944 - RNA, 19 nt, Homo sapiens
ggagcaaaucccugaaaua

SEQ ID NO: 1150945 - RNA, 19 nt, Homo sapiens
cagcaagacuucuauacug

SEQ ID NO: 1150946 - RNA, 19 nt, Homo sapiens
gaagggacauccagcaaac

SEQ ID NO: 1150947 - RNA, 19 nt, Homo sapiens
ugacacaaauggagaagug

SEQ ID NO: 1150948 - RNA, 19 nt, Homo sapiens
gagcuacuccugacacaaa

SEQ ID NO: 1150949 - RNA, 19 nt, Homo sapiens
aaacuauucugucuagaug

SEQ ID NO: 1150950 - RNA, 19 nt, Homo sapiens
uuacagaccugggcaaaug

SEQ ID NO: 1150951 - RNA, 19 nt, Homo sapiens
aagaugggcuuuccuucua

SEQ ID NO: 1150952 - RNA, 19 nt, Homo sapiens
gaaauccugucccgugauc

SEQ ID NO: 1150953 - RNA, 19 nt, Homo sapiens
ggucuuauuuggagauguu

SEQ ID NO: 1150954 - RNA, 19 nt, Homo sapiens
gaagugugcccucauggaa

SEQ ID NO: 1150955 - RNA, 19 nt, Homo sapiens
gauguugccaugcauuaua

SEQ ID NO: 1150956 - RNA, 19 nt, Homo sapiens
ggaaacacagacagaauug

SEQ ID NO: 1150957 - RNA, 19 nt, Homo sapiens
ggaacggcaugucucgauu

SEQ ID NO: 1150958 - RNA, 19 nt, Homo sapiens
caaugacucuccugucuuc

SEQ ID NO: 1150959 - RNA, 19 nt, Homo sapiens
gagauguugccaugcauua

SEQ ID NO: 1150960 - RNA, 19 nt, Homo sapiens
agacagaauuggugauguu

SEQ ID NO: 1150961 - RNA, 19 nt, Homo sapiens
gaaguucacauuaagaauc

SEQ ID NO: 1150962 - RNA, 19 nt, Homo sapiens
gagcaaaucccugaaauac

SEQ ID NO: 1150963 - RNA, 19 nt, Homo sapiens
agaaacaccaucaaacuuu

SEQ ID NO: 1150964 - RNA, 19 nt, Homo sapiens
ggaggagguuugguagaaa

SEQ ID NO: 1150965 - RNA, 19 nt, Homo sapiens
gaugcucugucucgaauug

SEQ ID NO: 1150966 - RNA, 19 nt, Homo sapiens
uaagaacccacaauacauu

SEQ ID NO: 1150967 - RNA, 19 nt, Homo sapiens
gaaaugaucaagcgagagu

SEQ ID NO: 1150968 - RNA, 19 nt, Homo sapiens
gaggagaaccauauuaaag

SEQ ID NO: 1150969 - RNA, 19 nt, Homo sapiens
gagcacagcccucaacuac

SEQ ID NO: 1150970 - RNA, 19 nt, Homo sapiens
cggaggugcuggacaauga

SEQ ID NO: 1150971 - RNA, 19 nt, Homo sapiens
ccucauugcugguugcauu

SEQ ID NO: 1150972 - RNA, 19 nt, Homo sapiens
ugaagcaacuccucuccaa

SEQ ID NO: 1150973 - RNA, 19 nt, Homo sapiens
caagaugugucgugacuac

SEQ ID NO: 1150974 - RNA, 19 nt, Homo sapiens
guaaagagaggacauggau

SEQ ID NO: 1150975 - RNA, 19 nt, Homo sapiens
gguacaggcuacugcuaaa

SEQ ID NO: 1150976 - RNA, 19 nt, Homo sapiens
gcugaaaggcuuacagaug

SEQ ID NO: 1150977 - RNA, 19 nt, Homo sapiens
acaauuugcuugcgcuuau

SEQ ID NO: 1150978 - RNA, 19 nt, Homo sapiens
ggaguugcagcacugaaua

SEQ ID NO: 1150979 - RNA, 19 nt, Homo sapiens
gggaaacacagacagaauu

SEQ ID NO: 1150980 - RNA, 19 nt, Homo sapiens
ggccugacaugcuaauaga

SEQ ID NO: 1150981 - RNA, 19 nt, Homo sapiens
gagaguggccacagcauug

SEQ ID NO: 1150982 - RNA, 19 nt, Homo sapiens
gaggauguaguuguauuua

SEQ ID NO: 1150983 - RNA, 19 nt, Homo sapiens
gcuaagugcugaagagaac

SEQ ID NO: 1150984 - RNA, 19 nt, Homo sapiens
gaaauuccuguuaaugaug

SEQ ID NO: 1150985 - RNA, 19 nt, Homo sapiens
aaggagaggugaugagguu

SEQ ID NO: 1150986 - RNA, 19 nt, Homo sapiens
gaguuaauccauacagaaa

SEQ ID NO: 1150987 - RNA, 19 nt, Homo sapiens
gcucagccuuugucaacuu

SEQ ID NO: 1150988 - RNA, 19 nt, Homo sapiens
gaggauccguguggcuuaa

SEQ ID NO: 1150989 - RNA, 19 nt, Homo sapiens
uguguuugcuguugaauga

SEQ ID NO: 1150990 - RNA, 19 nt, Homo sapiens
aaacaaguaucagcaagug

SEQ ID NO: 1150991 - RNA, 19 nt, Homo sapiens
ggacacucuuuccaaacaa

SEQ ID NO: 1150992 - RNA, 19 nt, Homo sapiens
ggaagaggagaaccauauu

SEQ ID NO: 1150993 - RNA, 19 nt, Homo sapiens
agacggaggugcuggacaa

SEQ ID NO: 1150994 - RNA, 19 nt, Homo sapiens
gcaugaggauguuuguaca

SEQ ID NO: 1150995 - RNA, 19 nt, Homo sapiens
caaccucucuuggaacuca

SEQ ID NO: 1150996 - RNA, 19 nt, Homo sapiens
gaaguugggagucuugugu

SEQ ID NO: 1150997 - RNA, 19 nt, Homo sapiens
aagaauacaugccuucaca

SEQ ID NO: 1150998 - RNA, 19 nt, Homo sapiens
gcauggcgauggaucaagu

SEQ ID NO: 1150999 - RNA, 19 nt, Homo sapiens
ggaagaagaucgccucaga

SEQ ID NO: 1151000 - RNA, 19 nt, Homo sapiens
ggaccuggccugugaauuu

SEQ ID NO: 1151001 - RNA, 19 nt, Homo sapiens
gcaccuggcugcacaguau

SEQ ID NO: 1151002 - RNA, 19 nt, Homo sapiens
caaagaggcucaacgugaa

SEQ ID NO: 1151003 - RNA, 19 nt, Homo sapiens
gaagggaaccugaccauca

SEQ ID NO: 1151004 - RNA, 19 nt, Homo sapiens
ccaagcacauucuggauga

SEQ ID NO: 1151005 - RNA, 19 nt, Homo sapiens
gggaggagcugcaggagau

SEQ ID NO: 1151006 - RNA, 19 nt, Homo sapiens
ggaauagugugggcaguga

SEQ ID NO: 1151007 - RNA, 19 nt, Homo sapiens
gcagagagaaaugcauaua

SEQ ID NO: 1151008 - RNA, 19 nt, Homo sapiens
gcagcacccuaggcaguua

SEQ ID NO: 1151009 - RNA, 19 nt, Homo sapiens
ggacauagugaaucaguuc

SEQ ID NO: 1151010 - RNA, 19 nt, Homo sapiens
gcugauauccauccagauu

SEQ ID NO: 1151011 - RNA, 19 nt, Homo sapiens
gacgugaacauccggaaua

SEQ ID NO: 1151012 - RNA, 19 nt, Homo sapiens
ccaggaugcugauggauuc

SEQ ID NO: 1151013 - RNA, 19 nt, Homo sapiens
ccaacuaacaccaaugaaa

SEQ ID NO: 1151014 - RNA, 19 nt, Homo sapiens
guuaacagaucccacaagu

SEQ ID NO: 1151015 - RNA, 19 nt, Homo sapiens
gcccuggccuccugauuga

SEQ ID NO: 1151016 - RNA, 19 nt, Homo sapiens
ucaacaagcucgggcauca

SEQ ID NO: 1151017 - RNA, 19 nt, Homo sapiens
uccgagcgcucaaggauuu

SEQ ID NO: 1151018 - RNA, 19 nt, Homo sapiens
ccacgaggccgcacuguau

SEQ ID NO: 1151019 - RNA, 19 nt, Homo sapiens
gaccuggccugugaauuug

SEQ ID NO: 1151020 - RNA, 19 nt, Homo sapiens
gaacauccggaauacguau

SEQ ID NO: 1151021 - RNA, 19 nt, Homo sapiens
ccauccagauuuccaugua

SEQ ID NO: 1151022 - RNA, 19 nt, Homo sapiens
gcuaugaugugccuaccau

SEQ ID NO: 1151023 - RNA, 19 nt, Homo sapiens
agacggcgcuggacauagu

SEQ ID NO: 1151024 - RNA, 19 nt, Homo sapiens
gccacaagcugauauccau

SEQ ID NO: 1151025 - RNA, 19 nt, Homo sapiens
gauccucgccgucaagaau

SEQ ID NO: 1151026 - RNA, 19 nt, Homo sapiens
aagauuagcuuuccuucgu

SEQ ID NO: 1151027 - RNA, 19 nt, Homo sapiens
gcacccagcuggcauuuuc

SEQ ID NO: 1151028 - RNA, 19 nt, Homo sapiens
ugauauccauccagauuuc

SEQ ID NO: 1151029 - RNA, 19 nt, Homo sapiens
ggaaucagacacuguuaag

SEQ ID NO: 1151030 - RNA, 19 nt, Homo sapiens
gcaggugacaggaauagug

SEQ ID NO: 1151031 - RNA, 19 nt, Homo sapiens
caagaauggccacagagaa

SEQ ID NO: 1151032 - RNA, 19 nt, Homo sapiens
ccuggcagcugcacugaga

SEQ ID NO: 1151033 - RNA, 19 nt, Homo sapiens
caacuaacaccaaugaaaa

SEQ ID NO: 1151034 - RNA, 19 nt, Homo sapiens
gcacugagagccgcagaga

SEQ ID NO: 1151035 - RNA, 19 nt, Homo sapiens
gaaggacgcgcaggccauu

SEQ ID NO: 1151036 - RNA, 19 nt, Homo sapiens
ggucaaggccacaaagaca

SEQ ID NO: 1151037 - RNA, 19 nt, Homo sapiens
aagcagagagaaaugcaua

SEQ ID NO: 1151038 - RNA, 19 nt, Homo sapiens
cggagcaccuuugggagua

SEQ ID NO: 1151039 - RNA, 19 nt, Homo sapiens
aagggaaccugaccaucaa

SEQ ID NO: 1151040 - RNA, 19 nt, Homo sapiens
cgucaagaauggagaugug

SEQ ID NO: 1151041 - RNA, 19 nt, Homo sapiens
gcagcuagucgguggaaug

SEQ ID NO: 1151042 - RNA, 19 nt, Homo sapiens
cgaacuaagcccagagcua

SEQ ID NO: 1151043 - RNA, 19 nt, Homo sapiens
auuaugaggugucagaaau

SEQ ID NO: 1151044 - RNA, 19 nt, Homo sapiens
cuccugggcuccacaaaga

SEQ ID NO: 1151045 - RNA, 19 nt, Homo sapiens
cagcccaugucccaaguug

SEQ ID NO: 1151046 - RNA, 19 nt, Homo sapiens
gcaguuaugcuacccuuac

SEQ ID NO: 1151047 - RNA, 19 nt, Homo sapiens
ggaagccacaagcugauau

SEQ ID NO: 1151048 - RNA, 19 nt, Homo sapiens
ccaagaauggccacagaga

SEQ ID NO: 1151049 - RNA, 19 nt, Homo sapiens
cagagagaaaugcauauau

SEQ ID NO: 1151050 - RNA, 19 nt, Homo sapiens
aagaagaucgccucagaga

SEQ ID NO: 1151051 - RNA, 19 nt, Homo sapiens
gcucugagggcacuaaugg

SEQ ID NO: 1151052 - RNA, 19 nt, Homo sapiens
ccacaaagaggcucaacgu

SEQ ID NO: 1151053 - RNA, 19 nt, Homo sapiens
cuaccaggaugcugaugga

SEQ ID NO: 1151054 - RNA, 19 nt, Homo sapiens
gaacuaccaggaugcugau

SEQ ID NO: 1151055 - RNA, 19 nt, Homo sapiens
caacgugaacuaccaggau

SEQ ID NO: 1151056 - RNA, 19 nt, Homo sapiens
gaaccugaccaucaaacag

SEQ ID NO: 1151057 - RNA, 19 nt, Homo sapiens
cagccaagccgggaagauu

SEQ ID NO: 1151058 - RNA, 19 nt, Homo sapiens
ucgagggacuggagaaugg

SEQ ID NO: 1151059 - RNA, 19 nt, Homo sapiens
gcacaguauggacauuaug

SEQ ID NO: 1151060 - RNA, 19 nt, Homo sapiens
gcagugggguuaacagauc

SEQ ID NO: 1151061 - RNA, 19 nt, Homo sapiens
ggaccuccgcugcaucuca

SEQ ID NO: 1151062 - RNA, 19 nt, Homo sapiens
ccaagugccgggagagaga

SEQ ID NO: 1151063 - RNA, 19 nt, Homo sapiens
ggagaaggcccagcuacag

SEQ ID NO: 1151064 - RNA, 19 nt, Homo sapiens
gcuggagggugaggccaaa

SEQ ID NO: 1151065 - RNA, 19 nt, Homo sapiens
ucaggccacuguugacauc

SEQ ID NO: 1151066 - RNA, 19 nt, Homo sapiens
ggaaaucaagcagcuacug

SEQ ID NO: 1151067 - RNA, 19 nt, Homo sapiens
acccaugccuggucaacaa

SEQ ID NO: 1151068 - RNA, 19 nt, Homo sapiens
gaaggucaaggccacaaag

SEQ ID NO: 1151069 - RNA, 19 nt, Homo sapiens
acagaucccacaaguccua

SEQ ID NO: 1151070 - RNA, 19 nt, Homo sapiens
gcccaugucccaaguugug

SEQ ID NO: 1151071 - RNA, 19 nt, Homo sapiens
ggagcaccuuugggaguau

SEQ ID NO: 1151072 - RNA, 19 nt, Homo sapiens
ucaaggccacaaagacaaa

SEQ ID NO: 1151073 - RNA, 19 nt, Homo sapiens
ucccaggguuugaucgauu

SEQ ID NO: 1151074 - RNA, 19 nt, Homo sapiens
uaagcuuuguucuucacuu

SEQ ID NO: 1151075 - RNA, 19 nt, Homo sapiens
ggacgugaacauccggaau

SEQ ID NO: 1151076 - RNA, 19 nt, Homo sapiens
uggcccagcugcuucugaa

SEQ ID NO: 1151077 - RNA, 19 nt, Homo sapiens
cacaguauggacauuauga

SEQ ID NO: 1151078 - RNA, 19 nt, Homo sapiens
aguccuaacuuuucaauug

SEQ ID NO: 1151079 - RNA, 19 nt, Homo sapiens
acagaggacauguaaauac

SEQ ID NO: 1151080 - RNA, 19 nt, Homo sapiens
cggaaucagacacuguuaa

SEQ ID NO: 1151081 - RNA, 19 nt, Homo sapiens
gauuucaaccucacggaau

SEQ ID NO: 1151082 - RNA, 19 nt, Homo sapiens
gcgcaggccauucauaacu

SEQ ID NO: 1151083 - RNA, 19 nt, Homo sapiens
ggaugcugauggauucucu

SEQ ID NO: 1151084 - RNA, 19 nt, Homo sapiens
caaguugugccaagggaau

SEQ ID NO: 1151085 - RNA, 19 nt, Homo sapiens
ggaaccugaccaucaaaca

SEQ ID NO: 1151086 - RNA, 19 nt, Homo sapiens
aagcuuuguucuucacuuc

SEQ ID NO: 1151087 - RNA, 19 nt, Homo sapiens
cauccagauuuccauguag

SEQ ID NO: 1151088 - RNA, 19 nt, Homo sapiens
gguccgagcgcucaaggau

SEQ ID NO: 1151089 - RNA, 19 nt, Homo sapiens
caagguggcccagcugcuu

SEQ ID NO: 1151090 - RNA, 19 nt, Homo sapiens
gccgaaguccacugccuuu

SEQ ID NO: 1151091 - RNA, 19 nt, Homo sapiens
acgcgcaggccauucauaa

SEQ ID NO: 1151092 - RNA, 19 nt, Homo sapiens
gggagagccugaccccauu

SEQ ID NO: 1151093 - RNA, 19 nt, Homo sapiens
acugugaccugccgaaguc

SEQ ID NO: 1151094 - RNA, 19 nt, Homo sapiens
caguaugggucgugaacag

SEQ ID NO: 1151095 - RNA, 19 nt, Homo sapiens
gaagccacaagcugauauc

SEQ ID NO: 1151096 - RNA, 19 nt, Homo sapiens
ggugggcacugguguucca

SEQ ID NO: 1151097 - RNA, 19 nt, Homo sapiens
ugaacauccggaauacgua

SEQ ID NO: 1151098 - RNA, 19 nt, Homo sapiens
gugaacauccggaauacgu

SEQ ID NO: 1151099 - RNA, 19 nt, Homo sapiens
ggaaacaacuccacuguaa

SEQ ID NO: 1151100 - RNA, 19 nt, Homo sapiens
gaagaaugauggaauguuu

SEQ ID NO: 1151101 - RNA, 19 nt, Homo sapiens
caacuagucuuacuuauug

SEQ ID NO: 1151102 - RNA, 19 nt, Homo sapiens
ugaauuaucugcugucuuu

SEQ ID NO: 1151103 - RNA, 19 nt, Homo sapiens
gaagggaacucgagauguu

SEQ ID NO: 1151104 - RNA, 19 nt, Homo sapiens
ccacuuugauuauugcuua

SEQ ID NO: 1151105 - RNA, 19 nt, Homo sapiens
ucagauagcuaauuaggaa

SEQ ID NO: 1151106 - RNA, 19 nt, Homo sapiens
ugaauauggugaugaguua

SEQ ID NO: 1151107 - RNA, 19 nt, Homo sapiens
gaagaacaacugaauaaga

SEQ ID NO: 1151108 - RNA, 19 nt, Homo sapiens
ggaaggaaguaacugcaaa

SEQ ID NO: 1151109 - RNA, 19 nt, Homo sapiens
gcaaagaacaugguuuauu

SEQ ID NO: 1151110 - RNA, 19 nt, Homo sapiens
ggacaauaguguagguuau

SEQ ID NO: 1151111 - RNA, 19 nt, Homo sapiens
ucaccgagcuguagauaau

SEQ ID NO: 1151112 - RNA, 19 nt, Homo sapiens
uagaauaaacuccugcuua

SEQ ID NO: 1151113 - RNA, 19 nt, Homo sapiens
cuacagcucugaauuaucu

SEQ ID NO: 1151114 - RNA, 19 nt, Homo sapiens
aaacaggucagaagaauga

SEQ ID NO: 1151115 - RNA, 19 nt, Homo sapiens
ccucauuacugguggauaa

SEQ ID NO: 1151116 - RNA, 19 nt, Homo sapiens
gaagcugucuccaucuugu

SEQ ID NO: 1151117 - RNA, 19 nt, Homo sapiens
caacuccacuguaacuaga

SEQ ID NO: 1151118 - RNA, 19 nt, Homo sapiens
caagugcauugauauguga

SEQ ID NO: 1151119 - RNA, 19 nt, Homo sapiens
ccaaugaaccagaaacaaa

SEQ ID NO: 1151120 - RNA, 19 nt, Homo sapiens
cuucuucucucuuuacuaa

SEQ ID NO: 1151121 - RNA, 19 nt, Homo sapiens
aaacaguauucccaacuuu

SEQ ID NO: 1151122 - RNA, 19 nt, Homo sapiens
guccaguucucucauuuaa

SEQ ID NO: 1151123 - RNA, 19 nt, Homo sapiens
aaaggauaaucauggguua

SEQ ID NO: 1151124 - RNA, 19 nt, Homo sapiens
guugugaaaugaagaguga

SEQ ID NO: 1151125 - RNA, 19 nt, Homo sapiens
ccucauacaacuagucuua

SEQ ID NO: 1151126 - RNA, 19 nt, Homo sapiens
uagcaagcauuaaagcaaa

SEQ ID NO: 1151127 - RNA, 19 nt, Homo sapiens
uaaacugacucuaacaagu

SEQ ID NO: 1151128 - RNA, 19 nt, Homo sapiens
ccaagucuacuaagcauaa

SEQ ID NO: 1151129 - RNA, 19 nt, Homo sapiens
gaaggaaguguuugaaagu

SEQ ID NO: 1151130 - RNA, 19 nt, Homo sapiens
guauaucguuugugcuuug

SEQ ID NO: 1151131 - RNA, 19 nt, Homo sapiens
caagcaguaugagaguuua

SEQ ID NO: 1151132 - RNA, 19 nt, Homo sapiens
ucagaagaaugauggaaug

SEQ ID NO: 1151133 - RNA, 19 nt, Homo sapiens
ucacuuaaaugccaguugu

SEQ ID NO: 1151134 - RNA, 19 nt, Homo sapiens
ucacgucacugcacucuag

SEQ ID NO: 1151135 - RNA, 19 nt, Homo sapiens
ggauuggcaucgugcugua

SEQ ID NO: 1151136 - RNA, 19 nt, Homo sapiens
caacaagcacugucccaaa

SEQ ID NO: 1151137 - RNA, 19 nt, Homo sapiens
gcucuauaguugugaaaug

SEQ ID NO: 1151138 - RNA, 19 nt, Homo sapiens
gauaugugaaguagaauga

SEQ ID NO: 1151139 - RNA, 19 nt, Homo sapiens
aaagggauggugucacuua

SEQ ID NO: 1151140 - RNA, 19 nt, Homo sapiens
caaacaauagucagguuaa

SEQ ID NO: 1151141 - RNA, 19 nt, Homo sapiens
ucaaggaauuauaggacua

SEQ ID NO: 1151142 - RNA, 19 nt, Homo sapiens
ccaagaaucacaaccaaga

SEQ ID NO: 1151143 - RNA, 19 nt, Homo sapiens
guucaucagugucaacaug

SEQ ID NO: 1151144 - RNA, 19 nt, Homo sapiens
uauuagaccuuaagcuguu

SEQ ID NO: 1151145 - RNA, 19 nt, Homo sapiens
gaauugcagaggaaaguuu

SEQ ID NO: 1151146 - RNA, 19 nt, Homo sapiens
gcauugauaugugaaguag

SEQ ID NO: 1151147 - RNA, 19 nt, Homo sapiens
ccaagugcauugauaugug

SEQ ID NO: 1151148 - RNA, 19 nt, Homo sapiens
uaucugcugucuuuaguug

SEQ ID NO: 1151149 - RNA, 19 nt, Homo sapiens
cauucucucugacauuuaa

SEQ ID NO: 1151150 - RNA, 19 nt, Homo sapiens
ccaguucucucauuuaaaa

SEQ ID NO: 1151151 - RNA, 19 nt, Homo sapiens
agaaugaauugcagaggaa

SEQ ID NO: 1151152 - RNA, 19 nt, Homo sapiens
gcaucgugcuguauguuug

SEQ ID NO: 1151153 - RNA, 19 nt, Homo sapiens
uggaagaacaacugaauaa

SEQ ID NO: 1151154 - RNA, 19 nt, Homo sapiens
cgagcuggauaccauguuu

SEQ ID NO: 1151155 - RNA, 19 nt, Homo sapiens
uuggaacucugaaggauuu

SEQ ID NO: 1151156 - RNA, 19 nt, Homo sapiens
gcacuuuucuugcuuguug

SEQ ID NO: 1151157 - RNA, 19 nt, Homo sapiens
auaauagcauucucucuga

SEQ ID NO: 1151158 - RNA, 19 nt, Homo sapiens
aaaugaagacacugaagua

SEQ ID NO: 1151159 - RNA, 19 nt, Homo sapiens
agaaggaaguguuugaaag

SEQ ID NO: 1151160 - RNA, 19 nt, Homo sapiens
ggaggugucgguacuaaau

SEQ ID NO: 1151161 - RNA, 19 nt, Homo sapiens
cugcaaagaacaugguuua

SEQ ID NO: 1151162 - RNA, 19 nt, Homo sapiens
ggauaaucauggguuagaa

SEQ ID NO: 1151163 - RNA, 19 nt, Homo sapiens
gcuauguucuaucuucuuc

SEQ ID NO: 1151164 - RNA, 19 nt, Homo sapiens
cuuauucucugcucuauag

SEQ ID NO: 1151165 - RNA, 19 nt, Homo sapiens
gugaaaaucucuuccaguu

SEQ ID NO: 1151166 - RNA, 19 nt, Homo sapiens
ugaaagggauggugucacu

SEQ ID NO: 1151167 - RNA, 19 nt, Homo sapiens
ucaaacaauagucagguua

SEQ ID NO: 1151168 - RNA, 19 nt, Homo sapiens
ugaagacacugaaguacag

SEQ ID NO: 1151169 - RNA, 19 nt, Homo sapiens
guaauuacagucuacacaa

SEQ ID NO: 1151170 - RNA, 19 nt, Homo sapiens
ucacuagugucuaaugaag

SEQ ID NO: 1151171 - RNA, 19 nt, Homo sapiens
gagccaaggucacgucacu

SEQ ID NO: 1151172 - RNA, 19 nt, Homo sapiens
gaaauguuuggaacucuga

SEQ ID NO: 1151173 - RNA, 19 nt, Homo sapiens
gaagaugguggagcuagaa

SEQ ID NO: 1151174 - RNA, 19 nt, Homo sapiens
aaacaaggcguucaucagu

SEQ ID NO: 1151175 - RNA, 19 nt, Homo sapiens
ccagccaguuguucagaaa

SEQ ID NO: 1151176 - RNA, 19 nt, Homo sapiens
gaguagcagugauccuaga

SEQ ID NO: 1151177 - RNA, 19 nt, Homo sapiens
ggaauggaagaacaacuga

SEQ ID NO: 1151178 - RNA, 19 nt, Homo sapiens
gaacucugaaggauuuaga

SEQ ID NO: 1151179 - RNA, 19 nt, Homo sapiens
guucuggcaugaauuagau

SEQ ID NO: 1151180 - RNA, 19 nt, Homo sapiens
caagcacugucccaaagga

SEQ ID NO: 1151181 - RNA, 19 nt, Homo sapiens
caaugaaccagaaacaaau

SEQ ID NO: 1151182 - RNA, 19 nt, Homo sapiens
gaaugaaucguggguugaa

SEQ ID NO: 1151183 - RNA, 19 nt, Homo sapiens
ggcaacagaguaagacaaa

SEQ ID NO: 1151184 - RNA, 19 nt, Homo sapiens
aaucauggguuagaaggaa

SEQ ID NO: 1151185 - RNA, 19 nt, Homo sapiens
gaacuguuuugguuguuuu

SEQ ID NO: 1151186 - RNA, 19 nt, Homo sapiens
aaagugaacuguuuugguu

SEQ ID NO: 1151187 - RNA, 19 nt, Homo sapiens
gguacuaaauugaauaacg

SEQ ID NO: 1151188 - RNA, 19 nt, Homo sapiens
uuaaaugccaguugucuga

SEQ ID NO: 1151189 - RNA, 19 nt, Homo sapiens
caagugaugaaucuacauu

SEQ ID NO: 1151190 - RNA, 19 nt, Homo sapiens
ccgcugcucuugugacguu

SEQ ID NO: 1151191 - RNA, 19 nt, Homo sapiens
agacuuaaauagcucagau

SEQ ID NO: 1151192 - RNA, 19 nt, Homo sapiens
ugagguggguagauuacuu

SEQ ID NO: 1151193 - RNA, 19 nt, Homo sapiens
cacgguagcucacccuugu

SEQ ID NO: 1151194 - RNA, 19 nt, Homo sapiens
ucuaacaagugaugaaucu

SEQ ID NO: 1151195 - RNA, 19 nt, Homo sapiens
gcaggugccuuuuguuuca

SEQ ID NO: 1151196 - RNA, 19 nt, Homo sapiens
ucuaucuucuucucucuuu

SEQ ID NO: 1151197 - RNA, 19 nt, Homo sapiens
caguaugagaguuuaguua

SEQ ID NO: 1151198 - RNA, 19 nt, Homo sapiens
ggaaguaacugcaaaacac

SEQ ID NO: 1151199 - RNA, 19 nt, Homo sapiens
gaacauaugccacguuaaa

SEQ ID NO: 1151200 - RNA, 19 nt, Homo sapiens
gggaacauaugccacguua

SEQ ID NO: 1151201 - RNA, 19 nt, Homo sapiens
gcaauaagcaauucuaaug

SEQ ID NO: 1151202 - RNA, 19 nt, Homo sapiens
gcccaagucuuacauguug

SEQ ID NO: 1151203 - RNA, 19 nt, Homo sapiens
gugcuauucugccaaguua

SEQ ID NO: 1151204 - RNA, 19 nt, Homo sapiens
caacgaugguguccacauu

SEQ ID NO: 1151205 - RNA, 19 nt, Homo sapiens
ugacaacuacuuuaccuua

SEQ ID NO: 1151206 - RNA, 19 nt, Homo sapiens
acaacuagcuguagcaugu

SEQ ID NO: 1151207 - RNA, 19 nt, Homo sapiens
gauaaacuguggccaccuu

SEQ ID NO: 1151208 - RNA, 19 nt, Homo sapiens
ggccguaccuuucucuuug

SEQ ID NO: 1151209 - RNA, 19 nt, Homo sapiens
agucuuacauguuggcuua

SEQ ID NO: 1151210 - RNA, 19 nt, Homo sapiens
cagagcaccuuucuacaga

SEQ ID NO: 1151211 - RNA, 19 nt, Homo sapiens
uguguaggcuauauacuuu

SEQ ID NO: 1151212 - RNA, 19 nt, Homo sapiens
aguaacaggccauuucuua

SEQ ID NO: 1151213 - RNA, 19 nt, Homo sapiens
gcuccuaacuagaguaagu

SEQ ID NO: 1151214 - RNA, 19 nt, Homo sapiens
gauguccuauucauguaaa

SEQ ID NO: 1151215 - RNA, 19 nt, Homo sapiens
gacagucugguauuuauuu

SEQ ID NO: 1151216 - RNA, 19 nt, Homo sapiens
uagaaucaauuuccaaguc

SEQ ID NO: 1151217 - RNA, 19 nt, Homo sapiens
gaaucuuucuuugccauug

SEQ ID NO: 1151218 - RNA, 19 nt, Homo sapiens
ccaaguaacaggccauuuc

SEQ ID NO: 1151219 - RNA, 19 nt, Homo sapiens
gaaucaauuuccaagucaa

SEQ ID NO: 1151220 - RNA, 19 nt, Homo sapiens
caacccacauuuccugcuu

SEQ ID NO: 1151221 - RNA, 19 nt, Homo sapiens
aggcuuacaucagcaauaa

SEQ ID NO: 1151222 - RNA, 19 nt, Homo sapiens
uagauguccuauucaugua

SEQ ID NO: 1151223 - RNA, 19 nt, Homo sapiens
gaauugcuccuaacuagag

SEQ ID NO: 1151224 - RNA, 19 nt, Homo sapiens
cugcagggcuguuguguag

SEQ ID NO: 1151225 - RNA, 19 nt, Homo sapiens
gcccguguaauuauuguua

SEQ ID NO: 1151226 - RNA, 19 nt, Homo sapiens
ucaauguucuuggcccuaa

SEQ ID NO: 1151227 - RNA, 19 nt, Homo sapiens
caacuacuuuaccuuacau

SEQ ID NO: 1151228 - RNA, 19 nt, Homo sapiens
caucagcaauaagcaauuc

SEQ ID NO: 1151229 - RNA, 19 nt, Homo sapiens
caccacagaccaaagauga

SEQ ID NO: 1151230 - RNA, 19 nt, Homo sapiens
ggacagucugguauuuauu

SEQ ID NO: 1151231 - RNA, 19 nt, Homo sapiens
agaaucaauuuccaaguca

SEQ ID NO: 1151232 - RNA, 19 nt, Homo sapiens
gcccauguaugccuuugug

SEQ ID NO: 1151233 - RNA, 19 nt, Homo sapiens
ggaauugcuccuaacuaga

SEQ ID NO: 1151234 - RNA, 19 nt, Homo sapiens
gcagggcuguuguguagac

SEQ ID NO: 1151235 - RNA, 19 nt, Homo sapiens
uggacagucugguauuuau

SEQ ID NO: 1151236 - RNA, 19 nt, Homo sapiens
ggaguggacagucugguau

SEQ ID NO: 1151237 - RNA, 19 nt, Homo sapiens
uaauggcccuucccuacug

SEQ ID NO: 1151238 - RNA, 19 nt, Homo sapiens
gcaauucuaaugcaacgau

SEQ ID NO: 1151239 - RNA, 19 nt, Homo sapiens
uauccucgacuccaaagua

SEQ ID NO: 1151240 - RNA, 19 nt, Homo sapiens
ccacugaggauuucauuac

SEQ ID NO: 1151241 - RNA, 19 nt, Homo sapiens
cagcaauaagcaauucuaa

SEQ ID NO: 1151242 - RNA, 19 nt, Homo sapiens
ugccaggacuugagaagga

SEQ ID NO: 1151243 - RNA, 19 nt, Homo sapiens
acucuacccucuuggcaaa

SEQ ID NO: 1151244 - RNA, 19 nt, Homo sapiens
gacaacuacuuuaccuuac

SEQ ID NO: 1151245 - RNA, 19 nt, Homo sapiens
uuagauguccuauucaugu

SEQ ID NO: 1151246 - RNA, 19 nt, Homo sapiens
ugacugguuucaagcuuca

SEQ ID NO: 1151247 - RNA, 19 nt, Homo sapiens
guggccaccuugauuacaa

SEQ ID NO: 1151248 - RNA, 19 nt, Homo sapiens
guggacagucugguauuua

SEQ ID NO: 1151249 - RNA, 19 nt, Homo sapiens
gcugaggaguggacagucu

SEQ ID NO: 1151250 - RNA, 19 nt, Homo sapiens
gccacaaggccacgccaua

SEQ ID NO: 1151251 - RNA, 19 nt, Homo sapiens
auccauaccucaccacaga

SEQ ID NO: 1151252 - RNA, 19 nt, Homo sapiens
acaacuacuuuaccuuaca

SEQ ID NO: 1151253 - RNA, 19 nt, Homo sapiens
ucaucgugcccaagucuua

SEQ ID NO: 1151254 - RNA, 19 nt, Homo sapiens
ggcuauauacuuuaccauu

SEQ ID NO: 1151255 - RNA, 19 nt, Homo sapiens
gagcuccuccucauguuuc

SEQ ID NO: 1151256 - RNA, 19 nt, Homo sapiens
uggagcccaugccagguua

SEQ ID NO: 1151257 - RNA, 19 nt, Homo sapiens
gaacaacuagcuguagcau

SEQ ID NO: 1151258 - RNA, 19 nt, Homo sapiens
cccagugugugcccaugua

SEQ ID NO: 1151259 - RNA, 19 nt, Homo sapiens
gugagaacaacuagcugua

SEQ ID NO: 1151260 - RNA, 19 nt, Homo sapiens
gagcaccuuucuacagacu

SEQ ID NO: 1151261 - RNA, 19 nt, Homo sapiens
guccuugccugcucaugga

SEQ ID NO: 1151262 - RNA, 19 nt, Homo sapiens
ccucaccccugcuuauuaa

SEQ ID NO: 1151263 - RNA, 19 nt, Homo sapiens
ucgguagccuucacuuuua

SEQ ID NO: 1151264 - RNA, 19 nt, Homo sapiens
guuucaacauuccaucuuc

SEQ ID NO: 1151265 - RNA, 19 nt, Homo sapiens
caaguaacaggccauuucu

SEQ ID NO: 1151266 - RNA, 19 nt, Homo sapiens
uuagaggggugaugauaaa

SEQ ID NO: 1151267 - RNA, 19 nt, Homo sapiens
ggaaaacccugagucuaag

SEQ ID NO: 1151268 - RNA, 19 nt, Homo sapiens
gcuauucugccaaguuauc

SEQ ID NO: 1151269 - RNA, 19 nt, Homo sapiens
gugcccaagucuuacaugu

SEQ ID NO: 1151270 - RNA, 19 nt, Homo sapiens
gaccaccucuugauaaaag

SEQ ID NO: 1151271 - RNA, 19 nt, Homo sapiens
acauaugccacguuaaaga

SEQ ID NO: 1151272 - RNA, 19 nt, Homo sapiens
ccacaaggccacgccauag

SEQ ID NO: 1151273 - RNA, 19 nt, Homo sapiens
uuaccucccuccaggaaca

SEQ ID NO: 1151274 - RNA, 19 nt, Homo sapiens
uggaaaacccugagucuaa

SEQ ID NO: 1151275 - RNA, 19 nt, Homo sapiens
caauguucuuggcccuaaa

SEQ ID NO: 1151276 - RNA, 19 nt, Homo sapiens
acaaggccacgccauagaa

SEQ ID NO: 1151277 - RNA, 19 nt, Homo sapiens
caucugguuucuggugcua

SEQ ID NO: 1151278 - RNA, 19 nt, Homo sapiens
cuucagagcaccuuucuac

SEQ ID NO: 1151279 - RNA, 19 nt, Homo sapiens
ggaaucuuucuuugccauu

SEQ ID NO: 1151280 - RNA, 19 nt, Homo sapiens
uguguagacugcagacauc

SEQ ID NO: 1151281 - RNA, 19 nt, Homo sapiens
gccauagaaucaauuucca

SEQ ID NO: 1151282 - RNA, 19 nt, Homo sapiens
cacuuacucuacccucuug

SEQ ID NO: 1151283 - RNA, 19 nt, Homo sapiens
ccucgugucugcucauagg

SEQ ID NO: 1151284 - RNA, 19 nt, Homo sapiens
ccagguuacgguagucauu

SEQ ID NO: 1151285 - RNA, 19 nt, Homo sapiens
caccucgugucugcucaua

SEQ ID NO: 1151286 - RNA, 19 nt, Homo sapiens
cuaacagccugagccaugu

SEQ ID NO: 1151287 - RNA, 19 nt, Homo sapiens
caaguacccagcacagagu

SEQ ID NO: 1151288 - RNA, 19 nt, Homo sapiens
caauuuccaagucaauguu

SEQ ID NO: 1151289 - RNA, 19 nt, Homo sapiens
aaaagugcuugacugguuu

SEQ ID NO: 1151290 - RNA, 19 nt, Homo sapiens
gcauguguaggcuauauac

SEQ ID NO: 1151291 - RNA, 19 nt, Homo sapiens
gcauuccgguggugguuuu

SEQ ID NO: 1151292 - RNA, 19 nt, Homo sapiens
caauaagcaauucuaaugc

SEQ ID NO: 1151293 - RNA, 19 nt, Homo sapiens
ucagcaauaagcaauucua

SEQ ID NO: 1151294 - RNA, 19 nt, Homo sapiens
aguggacagucugguauuu

SEQ ID NO: 1151295 - RNA, 19 nt, Homo sapiens
gaguggacagucugguauu

SEQ ID NO: 1151296 - RNA, 19 nt, Homo sapiens
uugauuacaacccacauuu

SEQ ID NO: 1151297 - RNA, 19 nt, Homo sapiens
acuguggccaccuugauua

SEQ ID NO: 1151298 - RNA, 19 nt, Homo sapiens
gcaacgaugguguccacau

SEQ ID NO: 1151299 - RNA, 19 nt, Homo sapiens
gggagaagcuggauuauuu

SEQ ID NO: 1151300 - RNA, 19 nt, Homo sapiens
ggaaacaccucacuuuauu

SEQ ID NO: 1151301 - RNA, 19 nt, Homo sapiens
ggacagcgcucaugagaag

SEQ ID NO: 1151302 - RNA, 19 nt, Homo sapiens
gggcugagcuggagacuga

SEQ ID NO: 1151303 - RNA, 19 nt, Homo sapiens
gcggagagcucaucaacaa

SEQ ID NO: 1151304 - RNA, 19 nt, Homo sapiens
ggacuugcuuggaagauuu

SEQ ID NO: 1151305 - RNA, 19 nt, Homo sapiens
guacaucccucuguccaua

SEQ ID NO: 1151306 - RNA, 19 nt, Homo sapiens
ggagguagcugcaaucaac

SEQ ID NO: 1151307 - RNA, 19 nt, Homo sapiens
gaacacaaccacaaugaug

SEQ ID NO: 1151308 - RNA, 19 nt, Homo sapiens
gaauugagacggacuuuga

SEQ ID NO: 1151309 - RNA, 19 nt, Homo sapiens
gcuagucuguuucgaaauu

SEQ ID NO: 1151310 - RNA, 19 nt, Homo sapiens
gaccaaauauuucugaaca

SEQ ID NO: 1151311 - RNA, 19 nt, Homo sapiens
aaccaucggugcaaauuua

SEQ ID NO: 1151312 - RNA, 19 nt, Homo sapiens
gacagucaguguugccuua

SEQ ID NO: 1151313 - RNA, 19 nt, Homo sapiens
ucaacaacaucaaguacua

SEQ ID NO: 1151314 - RNA, 19 nt, Homo sapiens
ggaccuggcuguugacauc

SEQ ID NO: 1151315 - RNA, 19 nt, Homo sapiens
ggagaagcgugucagauag

SEQ ID NO: 1151316 - RNA, 19 nt, Homo sapiens
ugacgagucuguccuguga

SEQ ID NO: 1151317 - RNA, 19 nt, Homo sapiens
gcauuggacuugcuuggaa

SEQ ID NO: 1151318 - RNA, 19 nt, Homo sapiens
gcugguggcuagucuguuu

SEQ ID NO: 1151319 - RNA, 19 nt, Homo sapiens
ggaagaauuuugcugauuu

SEQ ID NO: 1151320 - RNA, 19 nt, Homo sapiens
ggacacagaccgugagaug

SEQ ID NO: 1151321 - RNA, 19 nt, Homo sapiens
ggacguggccaugaaagua

SEQ ID NO: 1151322 - RNA, 19 nt, Homo sapiens
gauaaggaucucagacuuu

SEQ ID NO: 1151323 - RNA, 19 nt, Homo sapiens
caacacgcguuuccguuug

SEQ ID NO: 1151324 - RNA, 19 nt, Homo sapiens
gaaacaccucacuuuauuu

SEQ ID NO: 1151325 - RNA, 19 nt, Homo sapiens
gggaaacaccucacuuuau

SEQ ID NO: 1151326 - RNA, 19 nt, Homo sapiens
caagagagaggaagaagga

SEQ ID NO: 1151327 - RNA, 19 nt, Homo sapiens
gaggcucauuaucuauuua

SEQ ID NO: 1151328 - RNA, 19 nt, Homo sapiens
gcagguccuuggcgaggua

SEQ ID NO: 1151329 - RNA, 19 nt, Homo sapiens
gaaauucgggaaaccaaga

SEQ ID NO: 1151330 - RNA, 19 nt, Homo sapiens
ccaggagccucaacaaauc

SEQ ID NO: 1151331 - RNA, 19 nt, Homo sapiens
caaauuuacagaagcagua

SEQ ID NO: 1151332 - RNA, 19 nt, Homo sapiens
gaaccuaccuuuggcuuuu

SEQ ID NO: 1151333 - RNA, 19 nt, Homo sapiens
ucaugaagaucccagaaga

SEQ ID NO: 1151334 - RNA, 19 nt, Homo sapiens
ucugugagcuccuauggaa

SEQ ID NO: 1151335 - RNA, 19 nt, Homo sapiens
gaaaccaucggugcaaauu

SEQ ID NO: 1151336 - RNA, 19 nt, Homo sapiens
ggacaacggccacaaguac

SEQ ID NO: 1151337 - RNA, 19 nt, Homo sapiens
gcucagaguuagagauaag

SEQ ID NO: 1151338 - RNA, 19 nt, Homo sapiens
guaaacaacacgcgcagaa

SEQ ID NO: 1151339 - RNA, 19 nt, Homo sapiens
aaacagaacacaaccacaa

SEQ ID NO: 1151340 - RNA, 19 nt, Homo sapiens
agaagggcauuacgagauu

SEQ ID NO: 1151341 - RNA, 19 nt, Homo sapiens
uggagaagcgugucagaua

SEQ ID NO: 1151342 - RNA, 19 nt, Homo sapiens
gagcgucaauggagaugug

SEQ ID NO: 1151343 - RNA, 19 nt, Homo sapiens
gagcagagagugaccaaca

SEQ ID NO: 1151344 - RNA, 19 nt, Homo sapiens
ggucacauuuggccagaga

SEQ ID NO: 1151345 - RNA, 19 nt, Homo sapiens
aacguuggcugcugccuua

SEQ ID NO: 1151346 - RNA, 19 nt, Homo sapiens
acacuggauuugauagaaa

SEQ ID NO: 1151347 - RNA, 19 nt, Homo sapiens
gggcguguaugagcaguuu

SEQ ID NO: 1151348 - RNA, 19 nt, Homo sapiens
cagcaucacugagcaggaa

SEQ ID NO: 1151349 - RNA, 19 nt, Homo sapiens
gaauuuugcugauuuggaa

SEQ ID NO: 1151350 - RNA, 19 nt, Homo sapiens
ccgagcagcugaccgcauu

SEQ ID NO: 1151351 - RNA, 19 nt, Homo sapiens
agaaagcucuggaaaccau

SEQ ID NO: 1151352 - RNA, 19 nt, Homo sapiens
ggaggaagaugaggcugau

SEQ ID NO: 1151353 - RNA, 19 nt, Homo sapiens
uccuucaacucaauucuua

SEQ ID NO: 1151354 - RNA, 19 nt, Homo sapiens
guacuacgacggcuucaug

SEQ ID NO: 1151355 - RNA, 19 nt, Homo sapiens
uaaaugugcuucagaucgu

SEQ ID NO: 1151356 - RNA, 19 nt, Homo sapiens
gccaggagccucaacaaau

SEQ ID NO: 1151357 - RNA, 19 nt, Homo sapiens
gcugaacaccggaccauga

SEQ ID NO: 1151358 - RNA, 19 nt, Homo sapiens
gagagugaccaacaguaaa

SEQ ID NO: 1151359 - RNA, 19 nt, Homo sapiens
ggagagcucaucaacaaca

SEQ ID NO: 1151360 - RNA, 19 nt, Homo sapiens
gcauguggcuccgucaauc

SEQ ID NO: 1151361 - RNA, 19 nt, Homo sapiens
uggcuagucuguuucgaaa

SEQ ID NO: 1151362 - RNA, 19 nt, Homo sapiens
gaugaaggaucggaugaag

SEQ ID NO: 1151363 - RNA, 19 nt, Homo sapiens
acacagaccgugagaugaa

SEQ ID NO: 1151364 - RNA, 19 nt, Homo sapiens
gaagggcauuacgagauug

SEQ ID NO: 1151365 - RNA, 19 nt, Homo sapiens
ugaaaguacucaacagcau

SEQ ID NO: 1151366 - RNA, 19 nt, Homo sapiens
gcugagagcauuggacuug

SEQ ID NO: 1151367 - RNA, 19 nt, Homo sapiens
gucgauggguccucagaaa

SEQ ID NO: 1151368 - RNA, 19 nt, Homo sapiens
ggauggcacucagcgaaug

SEQ ID NO: 1151369 - RNA, 19 nt, Homo sapiens
gagcuccuauggaaacauc

SEQ ID NO: 1151370 - RNA, 19 nt, Homo sapiens
gaacuacgccuugccuucu

SEQ ID NO: 1151371 - RNA, 19 nt, Homo sapiens
ccaacacgcguuuccguuu

SEQ ID NO: 1151372 - RNA, 19 nt, Homo sapiens
ccacaaugaugguauuuug

SEQ ID NO: 1151373 - RNA, 19 nt, Homo sapiens
cagaacacaaccacaauga

SEQ ID NO: 1151374 - RNA, 19 nt, Homo sapiens
gaagaauuuugcugauuug

SEQ ID NO: 1151375 - RNA, 19 nt, Homo sapiens
ucacugccauggaguaucu

SEQ ID NO: 1151376 - RNA, 19 nt, Homo sapiens
ccugggaccuggcuguuga

SEQ ID NO: 1151377 - RNA, 19 nt, Homo sapiens
uagcugcaaucaacccaaa

SEQ ID NO: 1151378 - RNA, 19 nt, Homo sapiens
ucaaguccuucaagcaguu

SEQ ID NO: 1151379 - RNA, 19 nt, Homo sapiens
gcccgucgaucuucgucua

SEQ ID NO: 1151380 - RNA, 19 nt, Homo sapiens
ugaagucucuuacgcuuuu

SEQ ID NO: 1151381 - RNA, 19 nt, Homo sapiens
ccaacgauguggccaagca

SEQ ID NO: 1151382 - RNA, 19 nt, Homo sapiens
gaacuacacgcaguacauc

SEQ ID NO: 1151383 - RNA, 19 nt, Homo sapiens
aaagaggcacugugagaaa

SEQ ID NO: 1151384 - RNA, 19 nt, Homo sapiens
agaggcucauuaucuauuu

SEQ ID NO: 1151385 - RNA, 19 nt, Homo sapiens
ccucuccuguucuguguuu

SEQ ID NO: 1151386 - RNA, 19 nt, Homo sapiens
ugucgugucuggaauguca

SEQ ID NO: 1151387 - RNA, 19 nt, Homo sapiens
gagaccggccuccucauga

SEQ ID NO: 1151388 - RNA, 19 nt, Homo sapiens
cacggaagauguucgacaa

SEQ ID NO: 1151389 - RNA, 19 nt, Homo sapiens
caucggaguuuccuuuaac

SEQ ID NO: 1151390 - RNA, 19 nt, Homo sapiens
gcagugagccuggccuugu

SEQ ID NO: 1151391 - RNA, 19 nt, Homo sapiens
aaacaccucacuuuauuuc

SEQ ID NO: 1151392 - RNA, 19 nt, Homo sapiens
cgaugcugcuggacacaaa

SEQ ID NO: 1151393 - RNA, 19 nt, Homo sapiens
ucaucggaguuuccuuuaa

SEQ ID NO: 1151394 - RNA, 19 nt, Homo sapiens
uugcagaaccugaguuuga

SEQ ID NO: 1151395 - RNA, 19 nt, Homo sapiens
caacccaaaucacccucuu

SEQ ID NO: 1151396 - RNA, 19 nt, Homo sapiens
gaugaagacagucaguguu

SEQ ID NO: 1151397 - RNA, 19 nt, Homo sapiens
ggaugaagacagucagugu

SEQ ID NO: 1151398 - RNA, 19 nt, Homo sapiens
guaagggucuccgcacucu

SEQ ID NO: 1151399 - RNA, 19 nt, Homo sapiens
gaagagaccuacaagaagu

SEQ ID NO: 1151400 - RNA, 19 nt, Homo sapiens
gaagugggcuccaggugaa

SEQ ID NO: 1151401 - RNA, 19 nt, Homo sapiens
ggaccugccuucuguguag

SEQ ID NO: 1151402 - RNA, 19 nt, Homo sapiens
gaacuugccaacuugauug

SEQ ID NO: 1151403 - RNA, 19 nt, Homo sapiens
guggagaacuugccaacuu

SEQ ID NO: 1151404 - RNA, 19 nt, Homo sapiens
gagaguggccugcuuaugu

SEQ ID NO: 1151405 - RNA, 19 nt, Homo sapiens
gcugagaaguggaaagugu

SEQ ID NO: 1151406 - RNA, 19 nt, Homo sapiens
gagcugagaccaggauuaa

SEQ ID NO: 1151407 - RNA, 19 nt, Homo sapiens
gcagcgaguugaagguuau

SEQ ID NO: 1151408 - RNA, 19 nt, Homo sapiens
ccaauuugcuggcauuaca

SEQ ID NO: 1151409 - RNA, 19 nt, Homo sapiens
aggagcaugugaaagauua

SEQ ID NO: 1151410 - RNA, 19 nt, Homo sapiens
ucucaucccuuccguuuau

SEQ ID NO: 1151411 - RNA, 19 nt, Homo sapiens
guucauggcugagcugaga

SEQ ID NO: 1151412 - RNA, 19 nt, Homo sapiens
gaggaaagaggaucacaga

SEQ ID NO: 1151413 - RNA, 19 nt, Homo sapiens
ggaaaaugauucacccaaa

SEQ ID NO: 1151414 - RNA, 19 nt, Homo sapiens
ccgaagagaccuacaagaa

SEQ ID NO: 1151415 - RNA, 19 nt, Homo sapiens
ucacauacccuucuuuuaa

SEQ ID NO: 1151416 - RNA, 19 nt, Homo sapiens
ccuccucucuguaauggua

SEQ ID NO: 1151417 - RNA, 19 nt, Homo sapiens
agccugcucuccuacauua

SEQ ID NO: 1151418 - RNA, 19 nt, Homo sapiens
ugugauugcuucaucugua

SEQ ID NO: 1151419 - RNA, 19 nt, Homo sapiens
acacucacccucugaauug

SEQ ID NO: 1151420 - RNA, 19 nt, Homo sapiens
ggcagcgaguugaagguua

SEQ ID NO: 1151421 - RNA, 19 nt, Homo sapiens
ccuguuagcuacauuugug

SEQ ID NO: 1151422 - RNA, 19 nt, Homo sapiens
gcaggagcaugugaaagau

SEQ ID NO: 1151423 - RNA, 19 nt, Homo sapiens
agaguggccugcuuauguu

SEQ ID NO: 1151424 - RNA, 19 nt, Homo sapiens
gaaaaugauucacccaaag

SEQ ID NO: 1151425 - RNA, 19 nt, Homo sapiens
caaggagaguggccugcuu

SEQ ID NO: 1151426 - RNA, 19 nt, Homo sapiens
caaagucacacagcaaguu

SEQ ID NO: 1151427 - RNA, 19 nt, Homo sapiens
gugauugcuucaucuguau

SEQ ID NO: 1151428 - RNA, 19 nt, Homo sapiens
uaaaccauuucuagcuguu

SEQ ID NO: 1151429 - RNA, 19 nt, Homo sapiens
cuugccaacuugauuguuu

SEQ ID NO: 1151430 - RNA, 19 nt, Homo sapiens
uggagaacuugccaacuug

SEQ ID NO: 1151431 - RNA, 19 nt, Homo sapiens
ccagaacgcuuggcauugc

SEQ ID NO: 1151432 - RNA, 19 nt, Homo sapiens
gaucacagagggaaaauga

SEQ ID NO: 1151433 - RNA, 19 nt, Homo sapiens
cgaagagaccuacaagaag

SEQ ID NO: 1151434 - RNA, 19 nt, Homo sapiens
ccucaccucuggccucuca

SEQ ID NO: 1151435 - RNA, 19 nt, Homo sapiens
aaccauuucuagcuguuaa

SEQ ID NO: 1151436 - RNA, 19 nt, Homo sapiens
ucccugaucuuccagacaa

SEQ ID NO: 1151437 - RNA, 19 nt, Homo sapiens
cacauucucuccaacucuu

SEQ ID NO: 1151438 - RNA, 19 nt, Homo sapiens
ggagaacuugccaacuuga

SEQ ID NO: 1151439 - RNA, 19 nt, Homo sapiens
uggcuggccuucuuaguag

SEQ ID NO: 1151440 - RNA, 19 nt, Homo sapiens
cccuacagauugugugauu

SEQ ID NO: 1151441 - RNA, 19 nt, Homo sapiens
ccguuuaguucugccuuua

SEQ ID NO: 1151442 - RNA, 19 nt, Homo sapiens
ggugggcagugguggaguu

SEQ ID NO: 1151443 - RNA, 19 nt, Homo sapiens
uguuaacccuauccagaaa

SEQ ID NO: 1151444 - RNA, 19 nt, Homo sapiens
gaaaaggguucuggcaaca

SEQ ID NO: 1151445 - RNA, 19 nt, Homo sapiens
ucccagacccuacagauug

SEQ ID NO: 1151446 - RNA, 19 nt, Homo sapiens
uuuggcaggugcucucuuu

SEQ ID NO: 1151447 - RNA, 19 nt, Homo sapiens
gcccuuaaaccauuucuag

SEQ ID NO: 1151448 - RNA, 19 nt, Homo sapiens
ccucucaucccuuccguuu

SEQ ID NO: 1151449 - RNA, 19 nt, Homo sapiens
ccuucuaccuccacuguau

SEQ ID NO: 1151450 - RNA, 19 nt, Homo sapiens
ggagaauccuucaaaaugc

SEQ ID NO: 1151451 - RNA, 19 nt, Homo sapiens
gguucaagcuggagaaucc

SEQ ID NO: 1151452 - RNA, 19 nt, Homo sapiens
ucucauaggcagcgaguug

SEQ ID NO: 1151453 - RNA, 19 nt, Homo sapiens
uacaagaaguugcguuugc

SEQ ID NO: 1151454 - RNA, 19 nt, Homo sapiens
ggagggaucugauuuucuc

SEQ ID NO: 1151455 - RNA, 19 nt, Homo sapiens
gaucacauacccuucuuuu

SEQ ID NO: 1151456 - RNA, 19 nt, Homo sapiens
gggcagugguggaguuugc

SEQ ID NO: 1151457 - RNA, 19 nt, Homo sapiens
gcgaguugaagguuauuga

SEQ ID NO: 1151458 - RNA, 19 nt, Homo sapiens
acccaagccugcucuccua

SEQ ID NO: 1151459 - RNA, 19 nt, Homo sapiens
gcuccucaccguuuaguuc

SEQ ID NO: 1151460 - RNA, 19 nt, Homo sapiens
gauguugcccuuaaaccau

SEQ ID NO: 1151461 - RNA, 19 nt, Homo sapiens
ccugcucuccuacauuaua

SEQ ID NO: 1151462 - RNA, 19 nt, Homo sapiens
ggcccaauuugcuggcauu

SEQ ID NO: 1151463 - RNA, 19 nt, Homo sapiens
aaggagaguggccugcuua

SEQ ID NO: 1151464 - RNA, 19 nt, Homo sapiens
ugcaggagcaugugaaaga

SEQ ID NO: 1151465 - RNA, 19 nt, Homo sapiens
caagccugcucuccuacau

SEQ ID NO: 1151466 - RNA, 19 nt, Homo sapiens
aguggaaagugugggauuu

SEQ ID NO: 1151467 - RNA, 19 nt, Homo sapiens
ccuacaagaaguugcguuu

SEQ ID NO: 1151468 - RNA, 19 nt, Homo sapiens
caauaaacgaaucaaacug

SEQ ID NO: 1151469 - RNA, 19 nt, Homo sapiens
gacaaacuaccuggauguu

SEQ ID NO: 1151470 - RNA, 19 nt, Homo sapiens
uagagccaguggagaacuu

SEQ ID NO: 1151471 - RNA, 19 nt, Homo sapiens
cuacaguccucugcuccuu

SEQ ID NO: 1151472 - RNA, 19 nt, Homo sapiens
ggagaguggccugcuuaug

SEQ ID NO: 1151473 - RNA, 19 nt, Homo sapiens
gugaucacauacccuucuu

SEQ ID NO: 1151474 - RNA, 19 nt, Homo sapiens
ggauguugcccuuaaacca

SEQ ID NO: 1151475 - RNA, 19 nt, Homo sapiens
acacccacauucucuccaa

SEQ ID NO: 1151476 - RNA, 19 nt, Homo sapiens
ugagcugagaccaggauua

SEQ ID NO: 1151477 - RNA, 19 nt, Homo sapiens
gccauucuuugcagagauc

SEQ ID NO: 1151478 - RNA, 19 nt, Homo sapiens
cacccuggccgacaucauu

SEQ ID NO: 1151479 - RNA, 19 nt, Homo sapiens
ucuggcuccucaccguuua

SEQ ID NO: 1151480 - RNA, 19 nt, Homo sapiens
gcugagaccaggauuaagc

SEQ ID NO: 1151481 - RNA, 19 nt, Homo sapiens
gcauuacagcugagugaca

SEQ ID NO: 1151482 - RNA, 19 nt, Homo sapiens
gcuggagaauccuucaaaa

SEQ ID NO: 1151483 - RNA, 19 nt, Homo sapiens
cuuaguaguuucauuucuc

SEQ ID NO: 1151484 - RNA, 19 nt, Homo sapiens
uuagcuacauuugugauca

SEQ ID NO: 1151485 - RNA, 19 nt, Homo sapiens
ccuggauguugcccuuaaa

SEQ ID NO: 1151486 - RNA, 19 nt, Homo sapiens
agacaaacuaccuggaugu

SEQ ID NO: 1151487 - RNA, 19 nt, Homo sapiens
agaacuugccaacuugauu

SEQ ID NO: 1151488 - RNA, 19 nt, Homo sapiens
cuggcuggccuucuuagua

SEQ ID NO: 1151489 - RNA, 19 nt, Homo sapiens
ggagcugcuuguucugcau

SEQ ID NO: 1151490 - RNA, 19 nt, Homo sapiens
guucaagggagauaagaag

SEQ ID NO: 1151491 - RNA, 19 nt, Homo sapiens
gucaauaaacgaaucaaac

SEQ ID NO: 1151492 - RNA, 19 nt, Homo sapiens
guacacucacccucugaau

SEQ ID NO: 1151493 - RNA, 19 nt, Homo sapiens
caacuccggagggaucuga

SEQ ID NO: 1151494 - RNA, 19 nt, Homo sapiens
cagccauucuuugcagaga

SEQ ID NO: 1151495 - RNA, 19 nt, Homo sapiens
gacccuacagauuguguga

SEQ ID NO: 1151496 - RNA, 19 nt, Homo sapiens
cccagacccuacagauugu

SEQ ID NO: 1151497 - RNA, 19 nt, Homo sapiens
gaguugaagguuauugagu

SEQ ID NO: 1151498 - RNA, 19 nt, Homo sapiens
caccagaggcccgaagaga

SEQ ID NO: 1151499 - RNA, 19 nt, Homo sapiens
gaccgaagcggcagcauua

SEQ ID NO: 1151500 - RNA, 19 nt, Homo sapiens
caacggugcuuucccagaa

SEQ ID NO: 1151501 - RNA, 19 nt, Homo sapiens
ccaagaagaucaaugucaa

SEQ ID NO: 1151502 - RNA, 19 nt, Homo sapiens
gaaaggacacgaagucuag

SEQ ID NO: 1151503 - RNA, 19 nt, Homo sapiens
gggcacaacuuugacguuu

SEQ ID NO: 1151504 - RNA, 19 nt, Homo sapiens
ggacaucaaggacaacaaa

SEQ ID NO: 1151505 - RNA, 19 nt, Homo sapiens
gcacaacuuugacguuucu

SEQ ID NO: 1151506 - RNA, 19 nt, Homo sapiens
gaauauaagcuaucaagag

SEQ ID NO: 1151507 - RNA, 19 nt, Homo sapiens
ccaugaagcuggugcugaa

SEQ ID NO: 1151508 - RNA, 19 nt, Homo sapiens
caacuuugacguuucuuaa

SEQ ID NO: 1151509 - RNA, 19 nt, Homo sapiens
ggucuccucuaucguguuu

SEQ ID NO: 1151510 - RNA, 19 nt, Homo sapiens
ggaaggagcccaugaagcu

SEQ ID NO: 1151511 - RNA, 19 nt, Homo sapiens
gggaggaccugcaggagau

SEQ ID NO: 1151512 - RNA, 19 nt, Homo sapiens
gugcuucucuccuaaguuc

SEQ ID NO: 1151513 - RNA, 19 nt, Homo sapiens
gcuacgagaacauugauuu

SEQ ID NO: 1151514 - RNA, 19 nt, Homo sapiens
gcagagaucagcggccuaa

SEQ ID NO: 1151515 - RNA, 19 nt, Homo sapiens
gacaauggcuacgagaaca

SEQ ID NO: 1151516 - RNA, 19 nt, Homo sapiens
cgagaacauugauuucauc

SEQ ID NO: 1151517 - RNA, 19 nt, Homo sapiens
ggacaucgugcaccaguuc

SEQ ID NO: 1151518 - RNA, 19 nt, Homo sapiens
gaacggcaacacggaauug

SEQ ID NO: 1151519 - RNA, 19 nt, Homo sapiens
ugacuggucuccucuaucg

SEQ ID NO: 1151520 - RNA, 19 nt, Homo sapiens
cccaagaacucgagguugu

SEQ ID NO: 1151521 - RNA, 19 nt, Homo sapiens
gaagccagcgccacacuca

SEQ ID NO: 1151522 - RNA, 19 nt, Homo sapiens
ccaccaagaagaucaaugu

SEQ ID NO: 1151523 - RNA, 19 nt, Homo sapiens
ggaccgaagcggcagcauu

SEQ ID NO: 1151524 - RNA, 19 nt, Homo sapiens
ugaccagccucaacgugaa

SEQ ID NO: 1151525 - RNA, 19 nt, Homo sapiens
guccaaggcuguguugugu

SEQ ID NO: 1151526 - RNA, 19 nt, Homo sapiens
ugaaaggacacgaagucua

SEQ ID NO: 1151527 - RNA, 19 nt, Homo sapiens
gagaucagcggccuaagca

SEQ ID NO: 1151528 - RNA, 19 nt, Homo sapiens
ggaagcagggcauguagca

SEQ ID NO: 1151529 - RNA, 19 nt, Homo sapiens
gcuacgaccugcccaccau

SEQ ID NO: 1151530 - RNA, 19 nt, Homo sapiens
ggacgcuucugcucauggu

SEQ ID NO: 1151531 - RNA, 19 nt, Homo sapiens
gaaaaccauuuaccaacug

SEQ ID NO: 1151532 - RNA, 19 nt, Homo sapiens
ggacaauggcuacgagaac

SEQ ID NO: 1151533 - RNA, 19 nt, Homo sapiens
ggaagggcugcauccauga

SEQ ID NO: 1151534 - RNA, 19 nt, Homo sapiens
gaacaccuacagccagaca

SEQ ID NO: 1151535 - RNA, 19 nt, Homo sapiens
caacggcaccagcccuuug

SEQ ID NO: 1151536 - RNA, 19 nt, Homo sapiens
cgucggcugucaauaaaca

SEQ ID NO: 1151537 - RNA, 19 nt, Homo sapiens
ccacacccaccuccaagaa

SEQ ID NO: 1151538 - RNA, 19 nt, Homo sapiens
ccacuguccguguaccaua

SEQ ID NO: 1151539 - RNA, 19 nt, Homo sapiens
gguagugccggcaguguga

SEQ ID NO: 1151540 - RNA, 19 nt, Homo sapiens
aagccggcaucgacauuaa

SEQ ID NO: 1151541 - RNA, 19 nt, Homo sapiens
cagaauauaagcuaucaag

SEQ ID NO: 1151542 - RNA, 19 nt, Homo sapiens
gggcgaccaaggauuauug

SEQ ID NO: 1151543 - RNA, 19 nt, Homo sapiens
caagccggcaucgacauua

SEQ ID NO: 1151544 - RNA, 19 nt, Homo sapiens
ugucugagaugcugcuaca

SEQ ID NO: 1151545 - RNA, 19 nt, Homo sapiens
ccuccgugcuucucuccua

SEQ ID NO: 1151546 - RNA, 19 nt, Homo sapiens
ggugaaggcggaggacgua

SEQ ID NO: 1151547 - RNA, 19 nt, Homo sapiens
cgaccaaggauuauugcaa

SEQ ID NO: 1151548 - RNA, 19 nt, Homo sapiens
ggagaucaagcagcuguug

SEQ ID NO: 1151549 - RNA, 19 nt, Homo sapiens
cacuguccguguaccauaa

SEQ ID NO: 1151550 - RNA, 19 nt, Homo sapiens
caccgccacuguccgugua

SEQ ID NO: 1151551 - RNA, 19 nt, Homo sapiens
ccgugaacaucccgucuga

SEQ ID NO: 1151552 - RNA, 19 nt, Homo sapiens
agacagcccuggacaucgu

SEQ ID NO: 1151553 - RNA, 19 nt, Homo sapiens
ucaauaaacagcaggaaac

SEQ ID NO: 1151554 - RNA, 19 nt, Homo sapiens
acuaugaugugucugagau

SEQ ID NO: 1151555 - RNA, 19 nt, Homo sapiens
gguccaaggcuguguugug

SEQ ID NO: 1151556 - RNA, 19 nt, Homo sapiens
gcggguggguuuggugaau

SEQ ID NO: 1151557 - RNA, 19 nt, Homo sapiens
ggcccagcauggucacuau

SEQ ID NO: 1151558 - RNA, 19 nt, Homo sapiens
ucaaugcccacgugaggaa

SEQ ID NO: 1151559 - RNA, 19 nt, Homo sapiens
gcugcgcucugcggaaaga

SEQ ID NO: 1151560 - RNA, 19 nt, Homo sapiens
gcagcauccuggacgacau

SEQ ID NO: 1151561 - RNA, 19 nt, Homo sapiens
gucaauaaacagcaggaaa

SEQ ID NO: 1151562 - RNA, 19 nt, Homo sapiens
aagucuagcuccggacaaa

SEQ ID NO: 1151563 - RNA, 19 nt, Homo sapiens
ggcacaacuuugacguuuc

SEQ ID NO: 1151564 - RNA, 19 nt, Homo sapiens
cuggauagcgggaucaaug

SEQ ID NO: 1151565 - RNA, 19 nt, Homo sapiens
acaacuuugacguuucuua

SEQ ID NO: 1151566 - RNA, 19 nt, Homo sapiens
ggguggguuuggugaaugu

SEQ ID NO: 1151567 - RNA, 19 nt, Homo sapiens
acgagaacauugauuucau

SEQ ID NO: 1151568 - RNA, 19 nt, Homo sapiens
ccaagccggcaucgacauu

SEQ ID NO: 1151569 - RNA, 19 nt, Homo sapiens
cagcauggucacuaugaug

SEQ ID NO: 1151570 - RNA, 19 nt, Homo sapiens
gcuguguuguguggucauu

SEQ ID NO: 1151571 - RNA, 19 nt, Homo sapiens
gggcuugcagcuccucuga

SEQ ID NO: 1151572 - RNA, 19 nt, Homo sapiens
cccagaauauaagcuauca

SEQ ID NO: 1151573 - RNA, 19 nt, Homo sapiens
cauggucacuaugaugugu

SEQ ID NO: 1151574 - RNA, 19 nt, Homo sapiens
ccgcaggugccgacaagaa

SEQ ID NO: 1151575 - RNA, 19 nt, Homo sapiens
acaagguguugguggacaa

SEQ ID NO: 1151576 - RNA, 19 nt, Homo sapiens
gggcgaggccauugucaag

SEQ ID NO: 1151577 - RNA, 19 nt, Homo sapiens
gugcggcugcugcuggaua

SEQ ID NO: 1151578 - RNA, 19 nt, Homo sapiens
cuuugcaccucgcagcuaa

SEQ ID NO: 1151579 - RNA, 19 nt, Homo sapiens
ccagcauggucacuaugau

SEQ ID NO: 1151580 - RNA, 19 nt, Homo sapiens
cagcuacggccaaggugaa

SEQ ID NO: 1151581 - RNA, 19 nt, Homo sapiens
ccguguggcuguccaugau

SEQ ID NO: 1151582 - RNA, 19 nt, Homo sapiens
aggcugcgcucugcggaaa

SEQ ID NO: 1151583 - RNA, 19 nt, Homo sapiens
cguggaagcagggcaugua

SEQ ID NO: 1151584 - RNA, 19 nt, Homo sapiens
ugcaggcgguggaggagaa

SEQ ID NO: 1151585 - RNA, 19 nt, Homo sapiens
cgugcuggccucagugaaa

SEQ ID NO: 1151586 - RNA, 19 nt, Homo sapiens
caaccgcagccaguccuuu

SEQ ID NO: 1151587 - RNA, 19 nt, Homo sapiens
cccagucucuugaagugau

SEQ ID NO: 1151588 - RNA, 19 nt, Homo sapiens
agaucugggugcugaggaa

SEQ ID NO: 1151589 - RNA, 19 nt, Homo sapiens
gaagucuagcuccggacaa

SEQ ID NO: 1151590 - RNA, 19 nt, Homo sapiens
cuacgagaacauugauuuc

SEQ ID NO: 1151591 - RNA, 19 nt, Homo sapiens
ccaaggauuauugcaacaa

SEQ ID NO: 1151592 - RNA, 19 nt, Homo sapiens
ggccacaucgacaucauca

SEQ ID NO: 1151593 - RNA, 19 nt, Homo sapiens
gcagaaacuggaggagaca

SEQ ID NO: 1151594 - RNA, 19 nt, Homo sapiens
ggccuaagcaucccugacu

SEQ ID NO: 1151595 - RNA, 19 nt, Homo sapiens
cggcaacacggaauugauc

SEQ ID NO: 1151596 - RNA, 19 nt, Homo sapiens
ggaauaaugucaucgcuuu

SEQ ID NO: 1151597 - RNA, 19 nt, Homo sapiens
gaaccucucucacaugaaa

SEQ ID NO: 1151598 - RNA, 19 nt, Homo sapiens
gaucuagacucuggaauaa

SEQ ID NO: 1151599 - RNA, 19 nt, Homo sapiens
gaacaaugcccaugccuuu

SEQ ID NO: 1151600 - RNA, 19 nt, Homo sapiens
gaagcaauauccucacuga

SEQ ID NO: 1151601 - RNA, 19 nt, Homo sapiens
ucacugcgauucaacaaua

SEQ ID NO: 1151602 - RNA, 19 nt, Homo sapiens
ggaaucuucuccugugaua

SEQ ID NO: 1151603 - RNA, 19 nt, Homo sapiens
gcauccaccucucacauua

SEQ ID NO: 1151604 - RNA, 19 nt, Homo sapiens
caaagugucuggaaagaug

SEQ ID NO: 1151605 - RNA, 19 nt, Homo sapiens
gcagagaggugguucaucu

SEQ ID NO: 1151606 - RNA, 19 nt, Homo sapiens
gcagagauaucaccauugg

SEQ ID NO: 1151607 - RNA, 19 nt, Homo sapiens
gcauugggcuaaacucuug

SEQ ID NO: 1151608 - RNA, 19 nt, Homo sapiens
gauuugaccuucucuuuca

SEQ ID NO: 1151609 - RNA, 19 nt, Homo sapiens
gcacaugacugccacaacu

SEQ ID NO: 1151610 - RNA, 19 nt, Homo sapiens
gcaagguccacaucauuua

SEQ ID NO: 1151611 - RNA, 19 nt, Homo sapiens
gagaagaucccagggcaua

SEQ ID NO: 1151612 - RNA, 19 nt, Homo sapiens
gaagaucccagggcauaua

SEQ ID NO: 1151613 - RNA, 19 nt, Homo sapiens
gcaccagcauguuuccaaa

SEQ ID NO: 1151614 - RNA, 19 nt, Homo sapiens
gcaaauggagguaggagaa

SEQ ID NO: 1151615 - RNA, 19 nt, Homo sapiens
aggaagagauggagauuga

SEQ ID NO: 1151616 - RNA, 19 nt, Homo sapiens
gagccaaagugucuggaaa

SEQ ID NO: 1151617 - RNA, 19 nt, Homo sapiens
gcccaugccuuuaauguca

SEQ ID NO: 1151618 - RNA, 19 nt, Homo sapiens
ucacuacauucuuacagua

SEQ ID NO: 1151619 - RNA, 19 nt, Homo sapiens
ccaggcacaucccaccuua

SEQ ID NO: 1151620 - RNA, 19 nt, Homo sapiens
gcacaggccaucaucagaa

SEQ ID NO: 1151621 - RNA, 19 nt, Homo sapiens
aaacaggcauagauagcua

SEQ ID NO: 1151622 - RNA, 19 nt, Homo sapiens
ccaucucacuacauucuua

SEQ ID NO: 1151623 - RNA, 19 nt, Homo sapiens
gcaaugcccacacugcuaa

SEQ ID NO: 1151624 - RNA, 19 nt, Homo sapiens
guauaauggcuaccaguua

SEQ ID NO: 1151625 - RNA, 19 nt, Homo sapiens
ggagacaugugcacacuac

SEQ ID NO: 1151626 - RNA, 19 nt, Homo sapiens
gcaacagccucugaaacaa

SEQ ID NO: 1151627 - RNA, 19 nt, Homo sapiens
acucugaaaugaugucuaa

SEQ ID NO: 1151628 - RNA, 19 nt, Homo sapiens
ccaaaccucuggaucaaca

SEQ ID NO: 1151629 - RNA, 19 nt, Homo sapiens
agagauaucuucgcugcua

SEQ ID NO: 1151630 - RNA, 19 nt, Homo sapiens
ggagggacauccacacagu

SEQ ID NO: 1151631 - RNA, 19 nt, Homo sapiens
gagcaagguccacaucauu

SEQ ID NO: 1151632 - RNA, 19 nt, Homo sapiens
gcaauguccaugccacuaa

SEQ ID NO: 1151633 - RNA, 19 nt, Homo sapiens
cacggacucugaagcaaua

SEQ ID NO: 1151634 - RNA, 19 nt, Homo sapiens
gagcagacguacagauucu

SEQ ID NO: 1151635 - RNA, 19 nt, Homo sapiens
gaagagauggagauugaug

SEQ ID NO: 1151636 - RNA, 19 nt, Homo sapiens
gagaugucccuaccacuaa

SEQ ID NO: 1151637 - RNA, 19 nt, Homo sapiens
caauguccaugccacaauu

SEQ ID NO: 1151638 - RNA, 19 nt, Homo sapiens
gccacagccucuagaguaa

SEQ ID NO: 1151639 - RNA, 19 nt, Homo sapiens
cuacuucucuauacauuuc

SEQ ID NO: 1151640 - RNA, 19 nt, Homo sapiens
ucuagacucuggaauaaug

SEQ ID NO: 1151641 - RNA, 19 nt, Homo sapiens
ccaauucuaaugcaagaua

SEQ ID NO: 1151642 - RNA, 19 nt, Homo sapiens
uagcguaucuugccaugug

SEQ ID NO: 1151643 - RNA, 19 nt, Homo sapiens
aagaguguaugguguauga

SEQ ID NO: 1151644 - RNA, 19 nt, Homo sapiens
ccuaagaccugcccugaca

SEQ ID NO: 1151645 - RNA, 19 nt, Homo sapiens
gaggagcaccagcauguuu

SEQ ID NO: 1151646 - RNA, 19 nt, Homo sapiens
gaaaccaccaccaaaggaa

SEQ ID NO: 1151647 - RNA, 19 nt, Homo sapiens
ccacacugcuaaugagaga

SEQ ID NO: 1151648 - RNA, 19 nt, Homo sapiens
ugaugacaauuccugauuu

SEQ ID NO: 1151649 - RNA, 19 nt, Homo sapiens
aguaauguccgcacaguua

SEQ ID NO: 1151650 - RNA, 19 nt, Homo sapiens
caucacagccucuggauca

SEQ ID NO: 1151651 - RNA, 19 nt, Homo sapiens
ggagcaagguccacaucau

SEQ ID NO: 1151652 - RNA, 19 nt, Homo sapiens
guugcgaacucuagaucua

SEQ ID NO: 1151653 - RNA, 19 nt, Homo sapiens
gagauaucuucgcugcuaa

SEQ ID NO: 1151654 - RNA, 19 nt, Homo sapiens
ccuguaagcggaauaauga

SEQ ID NO: 1151655 - RNA, 19 nt, Homo sapiens
ggagggaugcagaugaauu

SEQ ID NO: 1151656 - RNA, 19 nt, Homo sapiens
gcucaagacccaggaguaa

SEQ ID NO: 1151657 - RNA, 19 nt, Homo sapiens
gauguccuguccacaaaug

SEQ ID NO: 1151658 - RNA, 19 nt, Homo sapiens
gcaauguccaugccacaaa

SEQ ID NO: 1151659 - RNA, 19 nt, Homo sapiens
ggagugaugcccacccaaa

SEQ ID NO: 1151660 - RNA, 19 nt, Homo sapiens
gcuguccacuucagaguau

SEQ ID NO: 1151661 - RNA, 19 nt, Homo sapiens
caccaugucugcaccucua

SEQ ID NO: 1151662 - RNA, 19 nt, Homo sapiens
ugacaucuccagucuuuga

SEQ ID NO: 1151663 - RNA, 19 nt, Homo sapiens
gauucugcauucucaugua

SEQ ID NO: 1151664 - RNA, 19 nt, Homo sapiens
cagaagcuguuaccaccaa

SEQ ID NO: 1151665 - RNA, 19 nt, Homo sapiens
caaaugaugcccacagcuu

SEQ ID NO: 1151666 - RNA, 19 nt, Homo sapiens
ccaaugagcacccaagauc

SEQ ID NO: 1151667 - RNA, 19 nt, Homo sapiens
aguaaugccugccucacua

SEQ ID NO: 1151668 - RNA, 19 nt, Homo sapiens
gugauguccuguccacaaa

SEQ ID NO: 1151669 - RNA, 19 nt, Homo sapiens
gcccaaaccucuggaucaa

SEQ ID NO: 1151670 - RNA, 19 nt, Homo sapiens
uguagacucugaaaugaug

SEQ ID NO: 1151671 - RNA, 19 nt, Homo sapiens
aaauguagacucugaaaug

SEQ ID NO: 1151672 - RNA, 19 nt, Homo sapiens
uaucuucgcugcuaauguc

SEQ ID NO: 1151673 - RNA, 19 nt, Homo sapiens
gaucccagggcauauauga

SEQ ID NO: 1151674 - RNA, 19 nt, Homo sapiens
ggcaacagccucugaaaca

SEQ ID NO: 1151675 - RNA, 19 nt, Homo sapiens
gcaauguccacaccgcuaa

SEQ ID NO: 1151676 - RNA, 19 nt, Homo sapiens
gcggugagagccaagauuu

SEQ ID NO: 1151677 - RNA, 19 nt, Homo sapiens
cugcagagauaucaccauu

SEQ ID NO: 1151678 - RNA, 19 nt, Homo sapiens
gcacucugcuaccucuuag

SEQ ID NO: 1151679 - RNA, 19 nt, Homo sapiens
gagauagccacgccucuga

SEQ ID NO: 1151680 - RNA, 19 nt, Homo sapiens
gucaauacccuuacauuca

SEQ ID NO: 1151681 - RNA, 19 nt, Homo sapiens
cugcaucgcuaaugagaga

SEQ ID NO: 1151682 - RNA, 19 nt, Homo sapiens
cuaaugagagacacaguuu

SEQ ID NO: 1151683 - RNA, 19 nt, Homo sapiens
cauaaugugagcaguguuu

SEQ ID NO: 1151684 - RNA, 19 nt, Homo sapiens
gacaagcaccaucucacua

SEQ ID NO: 1151685 - RNA, 19 nt, Homo sapiens
ggagaagucuaggcaggau

SEQ ID NO: 1151686 - RNA, 19 nt, Homo sapiens
cuggaaagaugcucaguca

SEQ ID NO: 1151687 - RNA, 19 nt, Homo sapiens
gcacagaugaaagccauga

SEQ ID NO: 1151688 - RNA, 19 nt, Homo sapiens
caauguccaugccacaaau

SEQ ID NO: 1151689 - RNA, 19 nt, Homo sapiens
caauguccaugcugcaaau

SEQ ID NO: 1151690 - RNA, 19 nt, Homo sapiens
gcccacaggcucuaugaaa

SEQ ID NO: 1151691 - RNA, 19 nt, Homo sapiens
aauguagacucugaaauga

SEQ ID NO: 1151692 - RNA, 19 nt, Homo sapiens
cauugcaaauuacagauga

SEQ ID NO: 1151693 - RNA, 19 nt, Homo sapiens
cuacaguaagcauguguua

SEQ ID NO: 1151694 - RNA, 19 nt, Homo sapiens
ggaagcccugguucuauuu

SEQ ID NO: 1151695 - RNA, 19 nt, Homo sapiens
ggagauugaugaggagaag

SEQ ID NO: 1151696 - RNA, 19 nt, Homo sapiens
ggaccagggugaagauuua

SEQ ID NO: 1151697 - RNA, 19 nt, Homo sapiens
gaaauugccauguguauaa

SEQ ID NO: 1151698 - RNA, 19 nt, Homo sapiens
guuagaagcugacuguaaa

SEQ ID NO: 1151699 - RNA, 19 nt, Homo sapiens
ggaaggauggucagcauua

SEQ ID NO: 1151700 - RNA, 19 nt, Homo sapiens
caacggaagacauuuauuu

SEQ ID NO: 1151701 - RNA, 19 nt, Homo sapiens
gaacaaggaggaucuuaga

SEQ ID NO: 1151702 - RNA, 19 nt, Homo sapiens
acaacuggcugcacaaauu

SEQ ID NO: 1151703 - RNA, 19 nt, Homo sapiens
ggauagaaauugccaugug

SEQ ID NO: 1151704 - RNA, 19 nt, Homo sapiens
agaacaagcugaaacaugu

SEQ ID NO: 1151705 - RNA, 19 nt, Homo sapiens
gagggaagcucagaaagug

SEQ ID NO: 1151706 - RNA, 19 nt, Homo sapiens
gauagaaauugccaugugu

SEQ ID NO: 1151707 - RNA, 19 nt, Homo sapiens
ggacacaggaggagcuuaa

SEQ ID NO: 1151708 - RNA, 19 nt, Homo sapiens
gaacaugaagcgccucuug

SEQ ID NO: 1151709 - RNA, 19 nt, Homo sapiens
ggacugagaaggauaggaa

SEQ ID NO: 1151710 - RNA, 19 nt, Homo sapiens
acaaggagcuccagaacau

SEQ ID NO: 1151711 - RNA, 19 nt, Homo sapiens
gaaagugaaaccucuguga

SEQ ID NO: 1151712 - RNA, 19 nt, Homo sapiens
cuaaggagguguuacugaa

SEQ ID NO: 1151713 - RNA, 19 nt, Homo sapiens
ugauggagcugcagaacaa

SEQ ID NO: 1151714 - RNA, 19 nt, Homo sapiens
ccucaucucucuuauagug

SEQ ID NO: 1151715 - RNA, 19 nt, Homo sapiens
gaacuauccauccagauug

SEQ ID NO: 1151716 - RNA, 19 nt, Homo sapiens
cagaguauguuccagaaga

SEQ ID NO: 1151717 - RNA, 19 nt, Homo sapiens
gggcuucucugaccacaug

SEQ ID NO: 1151718 - RNA, 19 nt, Homo sapiens
gcuggaggauuauaaggaa

SEQ ID NO: 1151719 - RNA, 19 nt, Homo sapiens
gcugaagggucucgaggaa

SEQ ID NO: 1151720 - RNA, 19 nt, Homo sapiens
auucauaccucuccaaaga

SEQ ID NO: 1151721 - RNA, 19 nt, Homo sapiens
ggaugaagcagaagaggaa

SEQ ID NO: 1151722 - RNA, 19 nt, Homo sapiens
gaccacaugugcccaacuu

SEQ ID NO: 1151723 - RNA, 19 nt, Homo sapiens
gcacaaauuccaaaaguaa

SEQ ID NO: 1151724 - RNA, 19 nt, Homo sapiens
gugcccaacuucaauaaga

SEQ ID NO: 1151725 - RNA, 19 nt, Homo sapiens
aggcccagcuggaggauua

SEQ ID NO: 1151726 - RNA, 19 nt, Homo sapiens
ccauuucuuugcacaagua

SEQ ID NO: 1151727 - RNA, 19 nt, Homo sapiens
gagcugcgcgugcugcuuu

SEQ ID NO: 1151728 - RNA, 19 nt, Homo sapiens
gcuaacagaucgggugaau

SEQ ID NO: 1151729 - RNA, 19 nt, Homo sapiens
acaaggaguuggagaagau

SEQ ID NO: 1151730 - RNA, 19 nt, Homo sapiens
ggaggaaaaugacgaauuc

SEQ ID NO: 1151731 - RNA, 19 nt, Homo sapiens
gaagaugucagcccuugug

SEQ ID NO: 1151732 - RNA, 19 nt, Homo sapiens
cuacuggaauggaaagcua

SEQ ID NO: 1151733 - RNA, 19 nt, Homo sapiens
ggaaggcuguuuucacaaa

SEQ ID NO: 1151734 - RNA, 19 nt, Homo sapiens
gguuagaagcugacuguaa

SEQ ID NO: 1151735 - RNA, 19 nt, Homo sapiens
ucagguggaugaagcagaa

SEQ ID NO: 1151736 - RNA, 19 nt, Homo sapiens
gaugcagccucuagugaug

SEQ ID NO: 1151737 - RNA, 19 nt, Homo sapiens
ggaggaagguuaguuuggu

SEQ ID NO: 1151738 - RNA, 19 nt, Homo sapiens
gcaaaucaaacguucuuuc

SEQ ID NO: 1151739 - RNA, 19 nt, Homo sapiens
gaaggauggucagcauuag

SEQ ID NO: 1151740 - RNA, 19 nt, Homo sapiens
aagaggagcuuggagagaa

SEQ ID NO: 1151741 - RNA, 19 nt, Homo sapiens
ggacuccuccuauuuaugg

SEQ ID NO: 1151742 - RNA, 19 nt, Homo sapiens
gcaacaaggagcuccagaa

SEQ ID NO: 1151743 - RNA, 19 nt, Homo sapiens
caaacguucuuucccaauc

SEQ ID NO: 1151744 - RNA, 19 nt, Homo sapiens
cuagagccaucccaaguug

SEQ ID NO: 1151745 - RNA, 19 nt, Homo sapiens
uggaggagcuacagcgaaa

SEQ ID NO: 1151746 - RNA, 19 nt, Homo sapiens
gaagaugcagccucuagug

SEQ ID NO: 1151747 - RNA, 19 nt, Homo sapiens
ugauucaccuccauauuuc

SEQ ID NO: 1151748 - RNA, 19 nt, Homo sapiens
ggaccuggagugugacaaa

SEQ ID NO: 1151749 - RNA, 19 nt, Homo sapiens
uaacagaucgggugaaucg

SEQ ID NO: 1151750 - RNA, 19 nt, Homo sapiens
ggaaacagaguuagaugag

SEQ ID NO: 1151751 - RNA, 19 nt, Homo sapiens
ucucacggcuggaaacaga

SEQ ID NO: 1151752 - RNA, 19 nt, Homo sapiens
ggugaagauuuacgacaug

SEQ ID NO: 1151753 - RNA, 19 nt, Homo sapiens
ggagggaagcucagaaagu

SEQ ID NO: 1151754 - RNA, 19 nt, Homo sapiens
gggaagaggcaacggaaga

SEQ ID NO: 1151755 - RNA, 19 nt, Homo sapiens
aggaugcucuucuugcuuu

SEQ ID NO: 1151756 - RNA, 19 nt, Homo sapiens
gauaggaagggauagaaau

SEQ ID NO: 1151757 - RNA, 19 nt, Homo sapiens
gcugauagauggacuuucc

SEQ ID NO: 1151758 - RNA, 19 nt, Homo sapiens
agcgaaagcuggaugaaga

SEQ ID NO: 1151759 - RNA, 19 nt, Homo sapiens
ccguggagcugcuaacaga

SEQ ID NO: 1151760 - RNA, 19 nt, Homo sapiens
gaacaaggaguuggagaag

SEQ ID NO: 1151761 - RNA, 19 nt, Homo sapiens
ggauaggaagggauagaaa

SEQ ID NO: 1151762 - RNA, 19 nt, Homo sapiens
uuaaagaacuauccaucca

SEQ ID NO: 1151763 - RNA, 19 nt, Homo sapiens
gaagaggagcuuggagaga

SEQ ID NO: 1151764 - RNA, 19 nt, Homo sapiens
ggcagaguauguuccagaa

SEQ ID NO: 1151765 - RNA, 19 nt, Homo sapiens
gagaagaugcagccucuag

SEQ ID NO: 1151766 - RNA, 19 nt, Homo sapiens
ccaccaugcugcaguucaa

SEQ ID NO: 1151767 - RNA, 19 nt, Homo sapiens
gaggaaggcuguuuucaca

SEQ ID NO: 1151768 - RNA, 19 nt, Homo sapiens
ucaccuccauauuuccuaa

SEQ ID NO: 1151769 - RNA, 19 nt, Homo sapiens
guagggucaugauaaagug

SEQ ID NO: 1151770 - RNA, 19 nt, Homo sapiens
gauaaggaugcucuucuug

SEQ ID NO: 1151771 - RNA, 19 nt, Homo sapiens
gggaaauacccuauguuau

SEQ ID NO: 1151772 - RNA, 19 nt, Homo sapiens
gagauacucgccagguuga

SEQ ID NO: 1151773 - RNA, 19 nt, Homo sapiens
gagcucagauuuggaacuc

SEQ ID NO: 1151774 - RNA, 19 nt, Homo sapiens
ccuauauucuucugcaaau

SEQ ID NO: 1151775 - RNA, 19 nt, Homo sapiens
uccauugcaucacugcuua

SEQ ID NO: 1151776 - RNA, 19 nt, Homo sapiens
gaauggagaaggaggagau

SEQ ID NO: 1151777 - RNA, 19 nt, Homo sapiens
gcuaaggagguguuacuga

SEQ ID NO: 1151778 - RNA, 19 nt, Homo sapiens
gaugauucaccuccauauu

SEQ ID NO: 1151779 - RNA, 19 nt, Homo sapiens
cggaagacauuuauuucuc

SEQ ID NO: 1151780 - RNA, 19 nt, Homo sapiens
ggacuuugguagggucaug

SEQ ID NO: 1151781 - RNA, 19 nt, Homo sapiens
gacuguggauaugguuaua

SEQ ID NO: 1151782 - RNA, 19 nt, Homo sapiens
agauaaggaugcucuucuu

SEQ ID NO: 1151783 - RNA, 19 nt, Homo sapiens
gcaaggagauaaggaugcu

SEQ ID NO: 1151784 - RNA, 19 nt, Homo sapiens
agaaggauaggaagggaua

SEQ ID NO: 1151785 - RNA, 19 nt, Homo sapiens
gaccagaaagaccagcuaa

SEQ ID NO: 1151786 - RNA, 19 nt, Homo sapiens
gucgggagcuggaagaaca

SEQ ID NO: 1151787 - RNA, 19 nt, Homo sapiens
gggugaagauuuacgacau

SEQ ID NO: 1151788 - RNA, 19 nt, Homo sapiens
gacauuuauuucuccuuug

SEQ ID NO: 1151789 - RNA, 19 nt, Homo sapiens
gcuagagccaucccaaguu

SEQ ID NO: 1151790 - RNA, 19 nt, Homo sapiens
gaagaagcggcagaagcua

SEQ ID NO: 1151791 - RNA, 19 nt, Homo sapiens
ccagguagcaccauugaca

SEQ ID NO: 1151792 - RNA, 19 nt, Homo sapiens
ucccucaucucucuuauag

SEQ ID NO: 1151793 - RNA, 19 nt, Homo sapiens
cagaacaagcugaaacaug

SEQ ID NO: 1151794 - RNA, 19 nt, Homo sapiens
ugaggaggaagguuaguuu

SEQ ID NO: 1151795 - RNA, 19 nt, Homo sapiens
gggaagcucagaaagugaa

SEQ ID NO: 1151796 - RNA, 19 nt, Homo sapiens
gcucacagcugguggaaua

SEQ ID NO: 1151797 - RNA, 19 nt, Homo sapiens
guaaaugccucucuaggua

SEQ ID NO: 1151798 - RNA, 19 nt, Homo sapiens
ggaaggagguggcaucuga

SEQ ID NO: 1151799 - RNA, 19 nt, Homo sapiens
gacaaugcauuccuucuua

SEQ ID NO: 1151800 - RNA, 19 nt, Homo sapiens
ugaugaagcugccgaagua

SEQ ID NO: 1151801 - RNA, 19 nt, Homo sapiens
ggaaagugaugacgcuuau

SEQ ID NO: 1151802 - RNA, 19 nt, Homo sapiens
gcaggacgauuacaucuuc

SEQ ID NO: 1151803 - RNA, 19 nt, Homo sapiens
ggaagguucuggaaaguuc

SEQ ID NO: 1151804 - RNA, 19 nt, Homo sapiens
gcacagaaccaccagcaaa

SEQ ID NO: 1151805 - RNA, 19 nt, Homo sapiens
ggaggugguuccugucauu

SEQ ID NO: 1151806 - RNA, 19 nt, Homo sapiens
ggaaacugcagcucuguaa

SEQ ID NO: 1151807 - RNA, 19 nt, Homo sapiens
gcgcaggucucgcucauca

SEQ ID NO: 1151808 - RNA, 19 nt, Homo sapiens
gaaugacagugcagacguu

SEQ ID NO: 1151809 - RNA, 19 nt, Homo sapiens
gguggaauauaaagaagaa

SEQ ID NO: 1151810 - RNA, 19 nt, Homo sapiens
ugaugacgcuuauaaccua

SEQ ID NO: 1151811 - RNA, 19 nt, Homo sapiens
gauuacaucuucuuuaagg

SEQ ID NO: 1151812 - RNA, 19 nt, Homo sapiens
aaucagggauguuagugua

SEQ ID NO: 1151813 - RNA, 19 nt, Homo sapiens
guguaagucuauaggaaua

SEQ ID NO: 1151814 - RNA, 19 nt, Homo sapiens
gaacagcagcgugaucuug

SEQ ID NO: 1151815 - RNA, 19 nt, Homo sapiens
uuaauucucucugcuguuu

SEQ ID NO: 1151816 - RNA, 19 nt, Homo sapiens
ggacaccuuugcagggauu

SEQ ID NO: 1151817 - RNA, 19 nt, Homo sapiens
ggagacggcaccagaugua

SEQ ID NO: 1151818 - RNA, 19 nt, Homo sapiens
gagaugaccagcccuguga

SEQ ID NO: 1151819 - RNA, 19 nt, Homo sapiens
ggaaagugguguccaacgu

SEQ ID NO: 1151820 - RNA, 19 nt, Homo sapiens
gaccaaagaccacguguuc

SEQ ID NO: 1151821 - RNA, 19 nt, Homo sapiens
gaagggaaccggguggaaa

SEQ ID NO: 1151822 - RNA, 19 nt, Homo sapiens
aaagugaugacgcuuauaa

SEQ ID NO: 1151823 - RNA, 19 nt, Homo sapiens
caucugagacagccugaua

SEQ ID NO: 1151824 - RNA, 19 nt, Homo sapiens
gguaccagauggacaccua

SEQ ID NO: 1151825 - RNA, 19 nt, Homo sapiens
ccaccgucaucgacaauuu

SEQ ID NO: 1151826 - RNA, 19 nt, Homo sapiens
ggucugggcucuggaagga

SEQ ID NO: 1151827 - RNA, 19 nt, Homo sapiens
gggaaagugaugacgcuua

SEQ ID NO: 1151828 - RNA, 19 nt, Homo sapiens
ggacgagagucagguguuc

SEQ ID NO: 1151829 - RNA, 19 nt, Homo sapiens
ugagacagccugauacguu

SEQ ID NO: 1151830 - RNA, 19 nt, Homo sapiens
ggaucaauuucaagucaug

SEQ ID NO: 1151831 - RNA, 19 nt, Homo sapiens
gaacacggcaggccacgau

SEQ ID NO: 1151832 - RNA, 19 nt, Homo sapiens
aaauguacaucacgucaga

SEQ ID NO: 1151833 - RNA, 19 nt, Homo sapiens
guacaucacgucagacugu

SEQ ID NO: 1151834 - RNA, 19 nt, Homo sapiens
ggacgauuacaucuucuuu

SEQ ID NO: 1151835 - RNA, 19 nt, Homo sapiens
gcacauaacaaagagacaa

SEQ ID NO: 1151836 - RNA, 19 nt, Homo sapiens
gauguuaguguaagucuau

SEQ ID NO: 1151837 - RNA, 19 nt, Homo sapiens
ggaaccggguggaaaccaa

SEQ ID NO: 1151838 - RNA, 19 nt, Homo sapiens
caaaauacuacgucucuua

SEQ ID NO: 1151839 - RNA, 19 nt, Homo sapiens
gacgauuacaucuucuuua

SEQ ID NO: 1151840 - RNA, 19 nt, Homo sapiens
acaaagagacaaugcauuc

SEQ ID NO: 1151841 - RNA, 19 nt, Homo sapiens
cacagcugguggaauauaa

SEQ ID NO: 1151842 - RNA, 19 nt, Homo sapiens
cagcaaaccagacaaaaua

SEQ ID NO: 1151843 - RNA, 19 nt, Homo sapiens
gcacacagggacagacaug

SEQ ID NO: 1151844 - RNA, 19 nt, Homo sapiens
gaaacugcagcucuguaaa

SEQ ID NO: 1151845 - RNA, 19 nt, Homo sapiens
cccgagagaugcacagcua

SEQ ID NO: 1151846 - RNA, 19 nt, Homo sapiens
caucgacaauuucuacauc

SEQ ID NO: 1151847 - RNA, 19 nt, Homo sapiens
ggauguuaguguaagucua

SEQ ID NO: 1151848 - RNA, 19 nt, Homo sapiens
ccuagaaucagggauguua

SEQ ID NO: 1151849 - RNA, 19 nt, Homo sapiens
ucugccaacuucugguuua

SEQ ID NO: 1151850 - RNA, 19 nt, Homo sapiens
agucaugccucugcaguuu

SEQ ID NO: 1151851 - RNA, 19 nt, Homo sapiens
ucaaggccauguacgugaa

SEQ ID NO: 1151852 - RNA, 19 nt, Homo sapiens
gaucagcuuuugccuuaaa

SEQ ID NO: 1151853 - RNA, 19 nt, Homo sapiens
ggagguggcaucugagaca

SEQ ID NO: 1151854 - RNA, 19 nt, Homo sapiens
uaguguaagucuauaggaa

SEQ ID NO: 1151855 - RNA, 19 nt, Homo sapiens
gcuuauaaccuacaacaag

SEQ ID NO: 1151856 - RNA, 19 nt, Homo sapiens
gaaagugaugacgcuuaua

SEQ ID NO: 1151857 - RNA, 19 nt, Homo sapiens
cgaaguaugcauugccaaa

SEQ ID NO: 1151858 - RNA, 19 nt, Homo sapiens
cucacucucugucuuuaua

SEQ ID NO: 1151859 - RNA, 19 nt, Homo sapiens
aaacugcagcucuguaaau

SEQ ID NO: 1151860 - RNA, 19 nt, Homo sapiens
aggagccucucgagugaua

SEQ ID NO: 1151861 - RNA, 19 nt, Homo sapiens
uggacgggcugcugaguga

SEQ ID NO: 1151862 - RNA, 19 nt, Homo sapiens
ugaccgugcaggacgauua

SEQ ID NO: 1151863 - RNA, 19 nt, Homo sapiens
ccaaagaccacguguucug

SEQ ID NO: 1151864 - RNA, 19 nt, Homo sapiens
acaaugcauuccuucuuau

SEQ ID NO: 1151865 - RNA, 19 nt, Homo sapiens
uaacaaagagacaaugcau

SEQ ID NO: 1151866 - RNA, 19 nt, Homo sapiens
ggcaccagauguaccaguu

SEQ ID NO: 1151867 - RNA, 19 nt, Homo sapiens
gagccuucauccucuacaa

SEQ ID NO: 1151868 - RNA, 19 nt, Homo sapiens
ggagcuggaugccuacaac

SEQ ID NO: 1151869 - RNA, 19 nt, Homo sapiens
gcugguggaauauaaagaa

SEQ ID NO: 1151870 - RNA, 19 nt, Homo sapiens
cacaauugcuccgagaaga

SEQ ID NO: 1151871 - RNA, 19 nt, Homo sapiens
guacgucaccugcgcaauc

SEQ ID NO: 1151872 - RNA, 19 nt, Homo sapiens
gcaccagauguaccaguuu

SEQ ID NO: 1151873 - RNA, 19 nt, Homo sapiens
guacuaccacgcagacaug

SEQ ID NO: 1151874 - RNA, 19 nt, Homo sapiens
ggacaugaauggaaaacca

SEQ ID NO: 1151875 - RNA, 19 nt, Homo sapiens
ggacgcugacccugacuug

SEQ ID NO: 1151876 - RNA, 19 nt, Homo sapiens
gccaugcacauaacaaaga

SEQ ID NO: 1151877 - RNA, 19 nt, Homo sapiens
uuaguuaucuguggguuuc

SEQ ID NO: 1151878 - RNA, 19 nt, Homo sapiens
gaggccacccuacaaguug

SEQ ID NO: 1151879 - RNA, 19 nt, Homo sapiens
gcagacccguucagacacu

SEQ ID NO: 1151880 - RNA, 19 nt, Homo sapiens
caucaugggugcagguaac

SEQ ID NO: 1151881 - RNA, 19 nt, Homo sapiens
caucagcaaaccagacaaa

SEQ ID NO: 1151882 - RNA, 19 nt, Homo sapiens
ggcacccgcuccuuguuga

SEQ ID NO: 1151883 - RNA, 19 nt, Homo sapiens
ccacuuuggccgaucugua

SEQ ID NO: 1151884 - RNA, 19 nt, Homo sapiens
gugauguccugacuaccaa

SEQ ID NO: 1151885 - RNA, 19 nt, Homo sapiens
ucacagcugguggaauaua

SEQ ID NO: 1151886 - RNA, 19 nt, Homo sapiens
cuugucagcuccucacuca

SEQ ID NO: 1151887 - RNA, 19 nt, Homo sapiens
uugaucagcuuuugccuua

SEQ ID NO: 1151888 - RNA, 19 nt, Homo sapiens
ucacccggcugcucuccaa

SEQ ID NO: 1151889 - RNA, 19 nt, Homo sapiens
uacgugaaccuuacacuga

SEQ ID NO: 1151890 - RNA, 19 nt, Homo sapiens
ugaccacuccauuuaauuc

SEQ ID NO: 1151891 - RNA, 19 nt, Homo sapiens
ucagagaccugcggaaagc

SEQ ID NO: 1151892 - RNA, 19 nt, Homo sapiens
gccauguacgugaaccuua

SEQ ID NO: 1151893 - RNA, 19 nt, Homo sapiens
acaccuccaucccuuugaa

SEQ ID NO: 1151894 - RNA, 19 nt, Homo sapiens
caagagcgagugaccaaag

SEQ ID NO: 1151895 - RNA, 19 nt, Homo sapiens
caaugcauuccuucuuauu

SEQ ID NO: 1151896 - RNA, 19 nt, Homo sapiens
guacaggugucgagaagaa

SEQ ID NO: 1151897 - RNA, 19 nt, Homo sapiens
ggacucaggucacuaaugg

SEQ ID NO: 1151898 - RNA, 19 nt, Homo sapiens
ggaacuaacuggagaaggu

SEQ ID NO: 1151899 - RNA, 19 nt, Homo sapiens
gagcuccucugaauauuga

SEQ ID NO: 1151900 - RNA, 19 nt, Homo sapiens
gcaggcagaugggaagaua

SEQ ID NO: 1151901 - RNA, 19 nt, Homo sapiens
uaacaucucugacuucucu

SEQ ID NO: 1151902 - RNA, 19 nt, Homo sapiens
ggagugaucuagaaguguu

SEQ ID NO: 1151903 - RNA, 19 nt, Homo sapiens
gagaagagauugagaugac

SEQ ID NO: 1151904 - RNA, 19 nt, Homo sapiens
gcacagaagggcaugauga

SEQ ID NO: 1151905 - RNA, 19 nt, Homo sapiens
uagauucccugaagaacua

SEQ ID NO: 1151906 - RNA, 19 nt, Homo sapiens
cagcuuauccugcaacuaa

SEQ ID NO: 1151907 - RNA, 19 nt, Homo sapiens
ccaaagaccugcugaaagc

SEQ ID NO: 1151908 - RNA, 19 nt, Homo sapiens
ugaacuggauggagacuuu

SEQ ID NO: 1151909 - RNA, 19 nt, Homo sapiens
gcacagauaguaccaggaa

SEQ ID NO: 1151910 - RNA, 19 nt, Homo sapiens
ggacaugcaggccaacuuu

SEQ ID NO: 1151911 - RNA, 19 nt, Homo sapiens
ggaaggcccaggcagauaa

SEQ ID NO: 1151912 - RNA, 19 nt, Homo sapiens
gaacuggaagcaagaagaa

SEQ ID NO: 1151913 - RNA, 19 nt, Homo sapiens
gcaagccccuggagucuua

SEQ ID NO: 1151914 - RNA, 19 nt, Homo sapiens
gaacaugagucgggaguac

SEQ ID NO: 1151915 - RNA, 19 nt, Homo sapiens
ggaaguggcugggcuuagu

SEQ ID NO: 1151916 - RNA, 19 nt, Homo sapiens
gaagaaaggccucccuagu

SEQ ID NO: 1151917 - RNA, 19 nt, Homo sapiens
agaagaaggugaaguugga

SEQ ID NO: 1151918 - RNA, 19 nt, Homo sapiens
gcagagacacagcuagaaa

SEQ ID NO: 1151919 - RNA, 19 nt, Homo sapiens
gcacgugcaucaucaaggu

SEQ ID NO: 1151920 - RNA, 19 nt, Homo sapiens
gcaagaggccacagucaga

SEQ ID NO: 1151921 - RNA, 19 nt, Homo sapiens
gaaguguauuucuccuuga

SEQ ID NO: 1151922 - RNA, 19 nt, Homo sapiens
gaucuagaaguguuaauug

SEQ ID NO: 1151923 - RNA, 19 nt, Homo sapiens
gcagauugcuaccaaacuc

SEQ ID NO: 1151924 - RNA, 19 nt, Homo sapiens
ccucauagauucccugaag

SEQ ID NO: 1151925 - RNA, 19 nt, Homo sapiens
gugagaagauacaggaaga

SEQ ID NO: 1151926 - RNA, 19 nt, Homo sapiens
gaagaggaacacaaaggaa

SEQ ID NO: 1151927 - RNA, 19 nt, Homo sapiens
gcaguggccuuugaugugu

SEQ ID NO: 1151928 - RNA, 19 nt, Homo sapiens
ggaagucaagguaucauug

SEQ ID NO: 1151929 - RNA, 19 nt, Homo sapiens
uggcuuggcuugucuaugu

SEQ ID NO: 1151930 - RNA, 19 nt, Homo sapiens
cuaccaaacuccgaggaua

SEQ ID NO: 1151931 - RNA, 19 nt, Homo sapiens
ccgaaggagugaucuagaa

SEQ ID NO: 1151932 - RNA, 19 nt, Homo sapiens
gacuaggccuuucaacaga

SEQ ID NO: 1151933 - RNA, 19 nt, Homo sapiens
ggacuuacgccuuuggaau

SEQ ID NO: 1151934 - RNA, 19 nt, Homo sapiens
uuacuuuggugaacugaaa

SEQ ID NO: 1151935 - RNA, 19 nt, Homo sapiens
cagcuagccuacucccuuu

SEQ ID NO: 1151936 - RNA, 19 nt, Homo sapiens
uaggagggaugcagucuau

SEQ ID NO: 1151937 - RNA, 19 nt, Homo sapiens
gcccagagcuuaggaaagg

SEQ ID NO: 1151938 - RNA, 19 nt, Homo sapiens
gcuacuugcugaccauuuc

SEQ ID NO: 1151939 - RNA, 19 nt, Homo sapiens
gcagcuuccuugucacaga

SEQ ID NO: 1151940 - RNA, 19 nt, Homo sapiens
gagucaagcuccagaaugc

SEQ ID NO: 1151941 - RNA, 19 nt, Homo sapiens
gaacagcaagggcauugug

SEQ ID NO: 1151942 - RNA, 19 nt, Homo sapiens
ccucagggauccagacuuc

SEQ ID NO: 1151943 - RNA, 19 nt, Homo sapiens
gauguuacaaucugaguga

SEQ ID NO: 1151944 - RNA, 19 nt, Homo sapiens
caaccuaggcccuccuuga

SEQ ID NO: 1151945 - RNA, 19 nt, Homo sapiens
ggaagagugcuccaaguuc

SEQ ID NO: 1151946 - RNA, 19 nt, Homo sapiens
gcaagcccauuucuucucu

SEQ ID NO: 1151947 - RNA, 19 nt, Homo sapiens
gcccucaucuggugugguu

SEQ ID NO: 1151948 - RNA, 19 nt, Homo sapiens
ggaggucuguggagucaag

SEQ ID NO: 1151949 - RNA, 19 nt, Homo sapiens
ggaggugccugagaucauc

SEQ ID NO: 1151950 - RNA, 19 nt, Homo sapiens
acaggcaggugagaagaua

SEQ ID NO: 1151951 - RNA, 19 nt, Homo sapiens
agacacagcuagaaacaac

SEQ ID NO: 1151952 - RNA, 19 nt, Homo sapiens
ucagagagcccucaaagag

SEQ ID NO: 1151953 - RNA, 19 nt, Homo sapiens
ggagguggcuuggcuuguc

SEQ ID NO: 1151954 - RNA, 19 nt, Homo sapiens
cagagaagaaggugaaguu

SEQ ID NO: 1151955 - RNA, 19 nt, Homo sapiens
ggugcaccauccacaauga

SEQ ID NO: 1151956 - RNA, 19 nt, Homo sapiens
caacauucuuagugacuca

SEQ ID NO: 1151957 - RNA, 19 nt, Homo sapiens
caggguggcuguccucuag

SEQ ID NO: 1151958 - RNA, 19 nt, Homo sapiens
ugaaucagcucgucaucag

SEQ ID NO: 1151959 - RNA, 19 nt, Homo sapiens
gacccuggccucauagauu

SEQ ID NO: 1151960 - RNA, 19 nt, Homo sapiens
ucaggugacuccacaucuu

SEQ ID NO: 1151961 - RNA, 19 nt, Homo sapiens
caacuucucucgggcucuu

SEQ ID NO: 1151962 - RNA, 19 nt, Homo sapiens
aauggcagcuuccuuguca

SEQ ID NO: 1151963 - RNA, 19 nt, Homo sapiens
gaagcuguggugccaguuu

SEQ ID NO: 1151964 - RNA, 19 nt, Homo sapiens
ccaccuuccugcccucuga

SEQ ID NO: 1151965 - RNA, 19 nt, Homo sapiens
gaagauacaaguggaugga

SEQ ID NO: 1151966 - RNA, 19 nt, Homo sapiens
ggaaacgcccugugucucu

SEQ ID NO: 1151967 - RNA, 19 nt, Homo sapiens
gacuuacgccuuuggaauu

SEQ ID NO: 1151968 - RNA, 19 nt, Homo sapiens
ggucuggccuggugacucu

SEQ ID NO: 1151969 - RNA, 19 nt, Homo sapiens
gaugacugaugugcagauu

SEQ ID NO: 1151970 - RNA, 19 nt, Homo sapiens
ggugcaagauccagaacau

SEQ ID NO: 1151971 - RNA, 19 nt, Homo sapiens
ugacaugggccaaggauca

SEQ ID NO: 1151972 - RNA, 19 nt, Homo sapiens
gcaaggcgagggucaguca

SEQ ID NO: 1151973 - RNA, 19 nt, Homo sapiens
aaagaaagaugaggaaucc

SEQ ID NO: 1151974 - RNA, 19 nt, Homo sapiens
cggcaaagcugcgcgagau

SEQ ID NO: 1151975 - RNA, 19 nt, Homo sapiens
gguaacaucucugacuucu

SEQ ID NO: 1151976 - RNA, 19 nt, Homo sapiens
aaaggaagccacccaggaa

SEQ ID NO: 1151977 - RNA, 19 nt, Homo sapiens
ugaguccucugcaugaguu

SEQ ID NO: 1151978 - RNA, 19 nt, Homo sapiens
ugacugaugugcagauugc

SEQ ID NO: 1151979 - RNA, 19 nt, Homo sapiens
cagagucacccaccagaaa

SEQ ID NO: 1151980 - RNA, 19 nt, Homo sapiens
ucauugaacccauggauau

SEQ ID NO: 1151981 - RNA, 19 nt, Homo sapiens
cagcagcagcucugaugua

SEQ ID NO: 1151982 - RNA, 19 nt, Homo sapiens
gcucagcacucagguuugg

SEQ ID NO: 1151983 - RNA, 19 nt, Homo sapiens
gccacacacugcagcugua

SEQ ID NO: 1151984 - RNA, 19 nt, Homo sapiens
gcauuugccuggcccugau

SEQ ID NO: 1151985 - RNA, 19 nt, Homo sapiens
gaaaggcucccagcugagu

SEQ ID NO: 1151986 - RNA, 19 nt, Homo sapiens
gaggagacccagccgcuau

SEQ ID NO: 1151987 - RNA, 19 nt, Homo sapiens
gaaaggagguggggucaca

SEQ ID NO: 1151988 - RNA, 19 nt, Homo sapiens
ggagaagagauugagauga

SEQ ID NO: 1151989 - RNA, 19 nt, Homo sapiens
caucauugcucagcucaca

SEQ ID NO: 1151990 - RNA, 19 nt, Homo sapiens
gcccauuucuucucugagu

SEQ ID NO: 1151991 - RNA, 19 nt, Homo sapiens
ggagaaggugcacgaagga

SEQ ID NO: 1151992 - RNA, 19 nt, Homo sapiens
cuaccggccugcaaacaau

SEQ ID NO: 1151993 - RNA, 19 nt, Homo sapiens
gagaucaucccacuguauc

SEQ ID NO: 1151994 - RNA, 19 nt, Homo sapiens
gaaguuggagaagagauug

SEQ ID NO: 1151995 - RNA, 19 nt, Homo sapiens
guggagcaguuuccugaug

SEQ ID NO: 1151996 - RNA, 19 nt, Homo sapiens
ggaaauaucugcacuaucu

SEQ ID NO: 1151997 - RNA, 19 nt, Homo sapiens
caaagaagcucacagcauu

SEQ ID NO: 1151998 - RNA, 19 nt, Homo sapiens
ggaaggagguggacugaaa

SEQ ID NO: 1151999 - RNA, 19 nt, Homo sapiens
gcaaguaguuggagaguug

SEQ ID NO: 1152000 - RNA, 19 nt, Homo sapiens
gcaauacaacugugaaaua

SEQ ID NO: 1152001 - RNA, 19 nt, Homo sapiens
gaaauuggaucucuguuag

SEQ ID NO: 1152002 - RNA, 19 nt, Homo sapiens
gaagauggauuacugaaag

SEQ ID NO: 1152003 - RNA, 19 nt, Homo sapiens
gaagggaucuugcuauugg

SEQ ID NO: 1152004 - RNA, 19 nt, Homo sapiens
gaagagaugucugggauau

SEQ ID NO: 1152005 - RNA, 19 nt, Homo sapiens
uauaaaggcucuuggauug

SEQ ID NO: 1152006 - RNA, 19 nt, Homo sapiens
gaaagacuaugaagacauc

SEQ ID NO: 1152007 - RNA, 19 nt, Homo sapiens
gaagggagagaaagaauuu

SEQ ID NO: 1152008 - RNA, 19 nt, Homo sapiens
gaaaagaccugaaggguau

SEQ ID NO: 1152009 - RNA, 19 nt, Homo sapiens
ggaaugagcaguaucagaa

SEQ ID NO: 1152010 - RNA, 19 nt, Homo sapiens
ccaguaaccuuucuaugaa

SEQ ID NO: 1152011 - RNA, 19 nt, Homo sapiens
gcaauaccaugaacagaug

SEQ ID NO: 1152012 - RNA, 19 nt, Homo sapiens
aauggaagaugccaaauaa

SEQ ID NO: 1152013 - RNA, 19 nt, Homo sapiens
caacagaucguuucacaga

SEQ ID NO: 1152014 - RNA, 19 nt, Homo sapiens
ucacagcauuggaaauuaa

SEQ ID NO: 1152015 - RNA, 19 nt, Homo sapiens
ggaagaugccaaauaauga

SEQ ID NO: 1152016 - RNA, 19 nt, Homo sapiens
ugacuuggaugcucgagua

SEQ ID NO: 1152017 - RNA, 19 nt, Homo sapiens
ugaagggucucauuucuau

SEQ ID NO: 1152018 - RNA, 19 nt, Homo sapiens
gcaaacauucgaccuaauu

SEQ ID NO: 1152019 - RNA, 19 nt, Homo sapiens
cgaaauaaaucaguuguuc

SEQ ID NO: 1152020 - RNA, 19 nt, Homo sapiens
guugaaugcuguacaauau

SEQ ID NO: 1152021 - RNA, 19 nt, Homo sapiens
gaagaucugcauuguauau

SEQ ID NO: 1152022 - RNA, 19 nt, Homo sapiens
gaucccaaauacauugaua

SEQ ID NO: 1152023 - RNA, 19 nt, Homo sapiens
gaaaucuucaccaaacaua

SEQ ID NO: 1152024 - RNA, 19 nt, Homo sapiens
acagaucguuucacagaua

SEQ ID NO: 1152025 - RNA, 19 nt, Homo sapiens
gcacaagggauccaauuug

SEQ ID NO: 1152026 - RNA, 19 nt, Homo sapiens
guaugaagaccuugcuuua

SEQ ID NO: 1152027 - RNA, 19 nt, Homo sapiens
cagaagggaucuugcuauu

SEQ ID NO: 1152028 - RNA, 19 nt, Homo sapiens
gaaacuggaucuauacacu

SEQ ID NO: 1152029 - RNA, 19 nt, Homo sapiens
gaacagaaacagcaguaug

SEQ ID NO: 1152030 - RNA, 19 nt, Homo sapiens
ugagaagguuggaauuaaa

SEQ ID NO: 1152031 - RNA, 19 nt, Homo sapiens
gaagcucuauguacuguca

SEQ ID NO: 1152032 - RNA, 19 nt, Homo sapiens
gaaauguagucaaccaaag

SEQ ID NO: 1152033 - RNA, 19 nt, Homo sapiens
ggucucauuucuauuacua

SEQ ID NO: 1152034 - RNA, 19 nt, Homo sapiens
uaacauggaaugagcagua

SEQ ID NO: 1152035 - RNA, 19 nt, Homo sapiens
gaagcccaaucacugagua

SEQ ID NO: 1152036 - RNA, 19 nt, Homo sapiens
uagagaaccuugccauuuc

SEQ ID NO: 1152037 - RNA, 19 nt, Homo sapiens
gaccugaucguccagaaua

SEQ ID NO: 1152038 - RNA, 19 nt, Homo sapiens
ccacaugggcagcguguua

SEQ ID NO: 1152039 - RNA, 19 nt, Homo sapiens
gauacagucuaccuaaugu

SEQ ID NO: 1152040 - RNA, 19 nt, Homo sapiens
gaucugcauuguauaugaa

SEQ ID NO: 1152041 - RNA, 19 nt, Homo sapiens
guagauaccugcguacauc

SEQ ID NO: 1152042 - RNA, 19 nt, Homo sapiens
gaagugggccaaagauaau

SEQ ID NO: 1152043 - RNA, 19 nt, Homo sapiens
guauacagcuaucccaugu

SEQ ID NO: 1152044 - RNA, 19 nt, Homo sapiens
gcagacagaugaugcaaaa

SEQ ID NO: 1152045 - RNA, 19 nt, Homo sapiens
ucaagaagcucuauguacu

SEQ ID NO: 1152046 - RNA, 19 nt, Homo sapiens
gauccaauuugugccauaa

SEQ ID NO: 1152047 - RNA, 19 nt, Homo sapiens
uggauggugugcuugauua

SEQ ID NO: 1152048 - RNA, 19 nt, Homo sapiens
ggagagaaagaauuuauca

SEQ ID NO: 1152049 - RNA, 19 nt, Homo sapiens
gaaugucacuggagcuauc

SEQ ID NO: 1152050 - RNA, 19 nt, Homo sapiens
gaaguugacuaccagugau

SEQ ID NO: 1152051 - RNA, 19 nt, Homo sapiens
ggcagaggcuuaccacuuc

SEQ ID NO: 1152052 - RNA, 19 nt, Homo sapiens
gcaaagaaaggaaguaaac

SEQ ID NO: 1152053 - RNA, 19 nt, Homo sapiens
agagaugucugggauauga

SEQ ID NO: 1152054 - RNA, 19 nt, Homo sapiens
gauaauggaagaugccaaa

SEQ ID NO: 1152055 - RNA, 19 nt, Homo sapiens
ugaagugggccaaagauaa

SEQ ID NO: 1152056 - RNA, 19 nt, Homo sapiens
gagauacagucuaccuaau

SEQ ID NO: 1152057 - RNA, 19 nt, Homo sapiens
caaauaaugagacaugaga

SEQ ID NO: 1152058 - RNA, 19 nt, Homo sapiens
cgagauagccgagcacuga

SEQ ID NO: 1152059 - RNA, 19 nt, Homo sapiens
gauagcagccucgaaagaa

SEQ ID NO: 1152060 - RNA, 19 nt, Homo sapiens
caaacauucgaccuaauua

SEQ ID NO: 1152061 - RNA, 19 nt, Homo sapiens
gaaucagacucuugaaggu

SEQ ID NO: 1152062 - RNA, 19 nt, Homo sapiens
gaguaucaauucuggaugu

SEQ ID NO: 1152063 - RNA, 19 nt, Homo sapiens
gcguacaucucaaccaaug

SEQ ID NO: 1152064 - RNA, 19 nt, Homo sapiens
gauauuaaaggauccagaa

SEQ ID NO: 1152065 - RNA, 19 nt, Homo sapiens
ggaaauuaaucagaucaca

SEQ ID NO: 1152066 - RNA, 19 nt, Homo sapiens
gcucacagcauuggaaauu

SEQ ID NO: 1152067 - RNA, 19 nt, Homo sapiens
gcuguugauuccuuuauau

SEQ ID NO: 1152068 - RNA, 19 nt, Homo sapiens
ugaagaccuugcuuuagaa

SEQ ID NO: 1152069 - RNA, 19 nt, Homo sapiens
agaaauuggaucucuguua

SEQ ID NO: 1152070 - RNA, 19 nt, Homo sapiens
ggagaagacaagaauguau

SEQ ID NO: 1152071 - RNA, 19 nt, Homo sapiens
gcaaagaagcucacagcau

SEQ ID NO: 1152072 - RNA, 19 nt, Homo sapiens
uaauggaagaugccaaaua

SEQ ID NO: 1152073 - RNA, 19 nt, Homo sapiens
gaaaaucagccucauuauu

SEQ ID NO: 1152074 - RNA, 19 nt, Homo sapiens
guaugcaucucauuuacug

SEQ ID NO: 1152075 - RNA, 19 nt, Homo sapiens
gaacaagcagugacuacau

SEQ ID NO: 1152076 - RNA, 19 nt, Homo sapiens
gccgagcacugauugagaa

SEQ ID NO: 1152077 - RNA, 19 nt, Homo sapiens
gcaucuggguacuuugaaa

SEQ ID NO: 1152078 - RNA, 19 nt, Homo sapiens
gugagcaucuggguacuuu

SEQ ID NO: 1152079 - RNA, 19 nt, Homo sapiens
gcucuuggauugaggagau

SEQ ID NO: 1152080 - RNA, 19 nt, Homo sapiens
gaagggaaacugccaacau

SEQ ID NO: 1152081 - RNA, 19 nt, Homo sapiens
uuagaaaucuucaccaaac

SEQ ID NO: 1152082 - RNA, 19 nt, Homo sapiens
gaggaaaaguuaaaggaaa

SEQ ID NO: 1152083 - RNA, 19 nt, Homo sapiens
gaccaaaacccaugugaua

SEQ ID NO: 1152084 - RNA, 19 nt, Homo sapiens
gauauuguaccauuguuug

SEQ ID NO: 1152085 - RNA, 19 nt, Homo sapiens
acacuguaguuuaugcaua

SEQ ID NO: 1152086 - RNA, 19 nt, Homo sapiens
gcuguuugcuuugauaaug

SEQ ID NO: 1152087 - RNA, 19 nt, Homo sapiens
gauaguugguucaguggau

SEQ ID NO: 1152088 - RNA, 19 nt, Homo sapiens
gagaugaucaacaaucgaa

SEQ ID NO: 1152089 - RNA, 19 nt, Homo sapiens
agaaacagcaguaugaaga

SEQ ID NO: 1152090 - RNA, 19 nt, Homo sapiens
gaucuacucucugcuagca

SEQ ID NO: 1152091 - RNA, 19 nt, Homo sapiens
ugaaagaaauuggaucucu

SEQ ID NO: 1152092 - RNA, 19 nt, Homo sapiens
cuacuuugcugaucgacaa

SEQ ID NO: 1152093 - RNA, 19 nt, Homo sapiens
uucagaaacuggaucuaua

SEQ ID NO: 1152094 - RNA, 19 nt, Homo sapiens
uggaugagauauuaaagga

SEQ ID NO: 1152095 - RNA, 19 nt, Homo sapiens
gagaagacaagaauguaug

SEQ ID NO: 1152096 - RNA, 19 nt, Homo sapiens
gaacacagcuuauuaguga

SEQ ID NO: 1152097 - RNA, 19 nt, Homo sapiens
gagcauaucugagaaauga

SEQ ID NO: 1152098 - RNA, 19 nt, Homo sapiens
gauauucugucuuggauua

SEQ ID NO: 1152099 - RNA, 19 nt, Homo sapiens
gcagaagucuuacaucuug

SEQ ID NO: 1152100 - RNA, 19 nt, Homo sapiens
gagaaaccaugcaauuuaa

SEQ ID NO: 1152101 - RNA, 19 nt, Homo sapiens
gcagauaaauucuuguuga

SEQ ID NO: 1152102 - RNA, 19 nt, Homo sapiens
gagaagagccaaaguauug

SEQ ID NO: 1152103 - RNA, 19 nt, Homo sapiens
agaaauagcuggcuuaaca

SEQ ID NO: 1152104 - RNA, 19 nt, Homo sapiens
gaccagacccugugacuua

SEQ ID NO: 1152105 - RNA, 19 nt, Homo sapiens
gaacacaauucaaauacga

SEQ ID NO: 1152106 - RNA, 19 nt, Homo sapiens
gaacaagaaaucugacuuu

SEQ ID NO: 1152107 - RNA, 19 nt, Homo sapiens
ugaaauggcugcagauaga

SEQ ID NO: 1152108 - RNA, 19 nt, Homo sapiens
gcagguugauaguagauua

SEQ ID NO: 1152109 - RNA, 19 nt, Homo sapiens
uaacugggcuugaaacuuc

SEQ ID NO: 1152110 - RNA, 19 nt, Homo sapiens
gaaaacaucugcuccauga

SEQ ID NO: 1152111 - RNA, 19 nt, Homo sapiens
caaagcagauaaauucuug

SEQ ID NO: 1152112 - RNA, 19 nt, Homo sapiens
gcauggagcuucagaaagu

SEQ ID NO: 1152113 - RNA, 19 nt, Homo sapiens
gcaagaaucucagccaaga

SEQ ID NO: 1152114 - RNA, 19 nt, Homo sapiens
gaaagagaccuguggauug

SEQ ID NO: 1152115 - RNA, 19 nt, Homo sapiens
gauaguagauuaugucucu

SEQ ID NO: 1152116 - RNA, 19 nt, Homo sapiens
gaaguugguugauugucua

SEQ ID NO: 1152117 - RNA, 19 nt, Homo sapiens
gaagagcccucagauggaa

SEQ ID NO: 1152118 - RNA, 19 nt, Homo sapiens
gagcuaagcaccaugcaua

SEQ ID NO: 1152119 - RNA, 19 nt, Homo sapiens
gauaagguguccaacagaa

SEQ ID NO: 1152120 - RNA, 19 nt, Homo sapiens
ggaagcaggugcgauacua

SEQ ID NO: 1152121 - RNA, 19 nt, Homo sapiens
ccaagaacacagcuuauua

SEQ ID NO: 1152122 - RNA, 19 nt, Homo sapiens
cagauuuacucuuugcuua

SEQ ID NO: 1152123 - RNA, 19 nt, Homo sapiens
ccaagaagcugucacuauc

SEQ ID NO: 1152124 - RNA, 19 nt, Homo sapiens
gggacuagguaacacuuua

SEQ ID NO: 1152125 - RNA, 19 nt, Homo sapiens
gagacgcgcuccacagaaa

SEQ ID NO: 1152126 - RNA, 19 nt, Homo sapiens
uaaguuggcuucuccauuc

SEQ ID NO: 1152127 - RNA, 19 nt, Homo sapiens
gcaugagaauguuuaacua

SEQ ID NO: 1152128 - RNA, 19 nt, Homo sapiens
gagagucguucacaucaaa

SEQ ID NO: 1152129 - RNA, 19 nt, Homo sapiens
uaacuauacuggcuugauu

SEQ ID NO: 1152130 - RNA, 19 nt, Homo sapiens
ggagaauauuccuuaacua

SEQ ID NO: 1152131 - RNA, 19 nt, Homo sapiens
acacaagccucguugauau

SEQ ID NO: 1152132 - RNA, 19 nt, Homo sapiens
agagaaaccaugcaauuua

SEQ ID NO: 1152133 - RNA, 19 nt, Homo sapiens
aaagagaccuguggauuga

SEQ ID NO: 1152134 - RNA, 19 nt, Homo sapiens
gggcuucucuugagcauau

SEQ ID NO: 1152135 - RNA, 19 nt, Homo sapiens
guagugagaugauaacagu

SEQ ID NO: 1152136 - RNA, 19 nt, Homo sapiens
gaacagcagguugauagua

SEQ ID NO: 1152137 - RNA, 19 nt, Homo sapiens
gcacuuaugcugaugaaga

SEQ ID NO: 1152138 - RNA, 19 nt, Homo sapiens
aaagugagauucccacaga

SEQ ID NO: 1152139 - RNA, 19 nt, Homo sapiens
gagagaaaccaugcaauuu

SEQ ID NO: 1152140 - RNA, 19 nt, Homo sapiens
gccaagaucuguucacaca

SEQ ID NO: 1152141 - RNA, 19 nt, Homo sapiens
uaagaugguuguuggagaa

SEQ ID NO: 1152142 - RNA, 19 nt, Homo sapiens
gaaacuagccagcugugaa

SEQ ID NO: 1152143 - RNA, 19 nt, Homo sapiens
gaaacgugcucuucaucug

SEQ ID NO: 1152144 - RNA, 19 nt, Homo sapiens
gaguggauuucaagcauuu

SEQ ID NO: 1152145 - RNA, 19 nt, Homo sapiens
ugucauaacuuacagugaa

SEQ ID NO: 1152146 - RNA, 19 nt, Homo sapiens
ggaaggcuaugucugaaca

SEQ ID NO: 1152147 - RNA, 19 nt, Homo sapiens
gaaacaugguaacucaaga

SEQ ID NO: 1152148 - RNA, 19 nt, Homo sapiens
cuacauccaugacaccuuu

SEQ ID NO: 1152149 - RNA, 19 nt, Homo sapiens
gcagggaccuaaacuuugg

SEQ ID NO: 1152150 - RNA, 19 nt, Homo sapiens
ccaagguucuggcuucauu

SEQ ID NO: 1152151 - RNA, 19 nt, Homo sapiens
ugucugcugucauaacuua

SEQ ID NO: 1152152 - RNA, 19 nt, Homo sapiens
gugugcaaguuuccuauua

SEQ ID NO: 1152153 - RNA, 19 nt, Homo sapiens
acuaggaacuugaauguga

SEQ ID NO: 1152154 - RNA, 19 nt, Homo sapiens
gaacaaggucuggaaaugu

SEQ ID NO: 1152155 - RNA, 19 nt, Homo sapiens
ggaaguugguugauugucu

SEQ ID NO: 1152156 - RNA, 19 nt, Homo sapiens
ggaaugcaguggcgcaauc

SEQ ID NO: 1152157 - RNA, 19 nt, Homo sapiens
ccuaaguucuguuuccuuu

SEQ ID NO: 1152158 - RNA, 19 nt, Homo sapiens
ucacagcacuuuccagaag

SEQ ID NO: 1152159 - RNA, 19 nt, Homo sapiens
uauacuggcuugauuugaa

SEQ ID NO: 1152160 - RNA, 19 nt, Homo sapiens
gagaacagcagguugauag

SEQ ID NO: 1152161 - RNA, 19 nt, Homo sapiens
cagcagggaccuaaacuuu

SEQ ID NO: 1152162 - RNA, 19 nt, Homo sapiens
agacuuaccuaccaucuuc

SEQ ID NO: 1152163 - RNA, 19 nt, Homo sapiens
ggaaauguuuagacaggau

SEQ ID NO: 1152164 - RNA, 19 nt, Homo sapiens
caaugaggcuguugaaagg

SEQ ID NO: 1152165 - RNA, 19 nt, Homo sapiens
gaaauuccuagaucacuga

SEQ ID NO: 1152166 - RNA, 19 nt, Homo sapiens
aagcagaaguuacaagaau

SEQ ID NO: 1152167 - RNA, 19 nt, Homo sapiens
gaaaggagcccagcauguc

SEQ ID NO: 1152168 - RNA, 19 nt, Homo sapiens
gcgagcagguguucucaug

SEQ ID NO: 1152169 - RNA, 19 nt, Homo sapiens
ggauccagguguugacuau

SEQ ID NO: 1152170 - RNA, 19 nt, Homo sapiens
caagugcuccugagagaaa

SEQ ID NO: 1152171 - RNA, 19 nt, Homo sapiens
cagaaaguguggaggagaa

SEQ ID NO: 1152172 - RNA, 19 nt, Homo sapiens
aaagaguguuugcuuaaga

SEQ ID NO: 1152173 - RNA, 19 nt, Homo sapiens
ggagaagagccaaaguauu

SEQ ID NO: 1152174 - RNA, 19 nt, Homo sapiens
auagcuggcuuaacaauga

SEQ ID NO: 1152175 - RNA, 19 nt, Homo sapiens
gccuagguuucuuagauua

SEQ ID NO: 1152176 - RNA, 19 nt, Homo sapiens
gcaagcaccaccuaaugaa

SEQ ID NO: 1152177 - RNA, 19 nt, Homo sapiens
ggacagggacagcagagaa

SEQ ID NO: 1152178 - RNA, 19 nt, Homo sapiens
gaagauggcccugcuccuu

SEQ ID NO: 1152179 - RNA, 19 nt, Homo sapiens
ggaccuauaccaugggaaa

SEQ ID NO: 1152180 - RNA, 19 nt, Homo sapiens
cauaacaacacuagaagaa

SEQ ID NO: 1152181 - RNA, 19 nt, Homo sapiens
acagaaugcagaagucuua

SEQ ID NO: 1152182 - RNA, 19 nt, Homo sapiens
gaagacagaaugcagaagu

SEQ ID NO: 1152183 - RNA, 19 nt, Homo sapiens
cuagaucacugagagcuaa

SEQ ID NO: 1152184 - RNA, 19 nt, Homo sapiens
gaguguauguucacccuau

SEQ ID NO: 1152185 - RNA, 19 nt, Homo sapiens
gugcuuaagccacuguuua

SEQ ID NO: 1152186 - RNA, 19 nt, Homo sapiens
ccaaaucucuguggcuuca

SEQ ID NO: 1152187 - RNA, 19 nt, Homo sapiens
ccucauaacugggcuugaa

SEQ ID NO: 1152188 - RNA, 19 nt, Homo sapiens
caucaagacuuaccuacca

SEQ ID NO: 1152189 - RNA, 19 nt, Homo sapiens
ugaagagcuugucaucaaa

SEQ ID NO: 1152190 - RNA, 19 nt, Homo sapiens
ugagagaaaccaugcaauu

SEQ ID NO: 1152191 - RNA, 19 nt, Homo sapiens
gagaaacucuuggccuauc

SEQ ID NO: 1152192 - RNA, 19 nt, Homo sapiens
gcagcacgccggucuuuga

SEQ ID NO: 1152193 - RNA, 19 nt, Homo sapiens
ggacuagguaacacuuuaa

SEQ ID NO: 1152194 - RNA, 19 nt, Homo sapiens
uaaacugccagaaaucuuu

SEQ ID NO: 1152195 - RNA, 19 nt, Homo sapiens
gcagaaguuacaagaauau

SEQ ID NO: 1152196 - RNA, 19 nt, Homo sapiens
gaacacagcuuauuaguga

SEQ ID NO: 1152197 - RNA, 19 nt, Homo sapiens
gagcauaucugagaaauga

SEQ ID NO: 1152198 - RNA, 19 nt, Homo sapiens
gauauucugucuuggauua

SEQ ID NO: 1152199 - RNA, 19 nt, Homo sapiens
gcagaagucuuacaucuug

SEQ ID NO: 1152200 - RNA, 19 nt, Homo sapiens
gagaaaccaugcaauuuaa

SEQ ID NO: 1152201 - RNA, 19 nt, Homo sapiens
gcagauaaauucuuguuga

SEQ ID NO: 1152202 - RNA, 19 nt, Homo sapiens
gagaagagccaaaguauug

SEQ ID NO: 1152203 - RNA, 19 nt, Homo sapiens
agaaauagcuggcuuaaca

SEQ ID NO: 1152204 - RNA, 19 nt, Homo sapiens
gaccagacccugugacuua

SEQ ID NO: 1152205 - RNA, 19 nt, Homo sapiens
gaacacaauucaaauacga

SEQ ID NO: 1152206 - RNA, 19 nt, Homo sapiens
gaacaagaaaucugacuuu

SEQ ID NO: 1152207 - RNA, 19 nt, Homo sapiens
ugaaauggcugcagauaga

SEQ ID NO: 1152208 - RNA, 19 nt, Homo sapiens
gcagguugauaguagauua

SEQ ID NO: 1152209 - RNA, 19 nt, Homo sapiens
uaacugggcuugaaacuuc

SEQ ID NO: 1152210 - RNA, 19 nt, Homo sapiens
gaaaacaucugcuccauga

SEQ ID NO: 1152211 - RNA, 19 nt, Homo sapiens
caaagcagauaaauucuug

SEQ ID NO: 1152212 - RNA, 19 nt, Homo sapiens
gcauggagcuucagaaagu

SEQ ID NO: 1152213 - RNA, 19 nt, Homo sapiens
gcaagaaucucagccaaga

SEQ ID NO: 1152214 - RNA, 19 nt, Homo sapiens
gaaagagaccuguggauug

SEQ ID NO: 1152215 - RNA, 19 nt, Homo sapiens
gauaguagauuaugucucu

SEQ ID NO: 1152216 - RNA, 19 nt, Homo sapiens
gaaguugguugauugucua

SEQ ID NO: 1152217 - RNA, 19 nt, Homo sapiens
gaagagcccucagauggaa

SEQ ID NO: 1152218 - RNA, 19 nt, Homo sapiens
gagcuaagcaccaugcaua

SEQ ID NO: 1152219 - RNA, 19 nt, Homo sapiens
gauaagguguccaacagaa

SEQ ID NO: 1152220 - RNA, 19 nt, Homo sapiens
ggaagcaggugcgauacua

SEQ ID NO: 1152221 - RNA, 19 nt, Homo sapiens
ccaagaacacagcuuauua

SEQ ID NO: 1152222 - RNA, 19 nt, Homo sapiens
cagauuuacucuuugcuua

SEQ ID NO: 1152223 - RNA, 19 nt, Homo sapiens
ccaagaagcugucacuauc

SEQ ID NO: 1152224 - RNA, 19 nt, Homo sapiens
gggacuagguaacacuuua

SEQ ID NO: 1152225 - RNA, 19 nt, Homo sapiens
uaaguuggcuucuccauuc

SEQ ID NO: 1152226 - RNA, 19 nt, Homo sapiens
gcaugagaauguuuaacua

SEQ ID NO: 1152227 - RNA, 19 nt, Homo sapiens
gagagucguucacaucaaa

SEQ ID NO: 1152228 - RNA, 19 nt, Homo sapiens
uaacuauacuggcuugauu

SEQ ID NO: 1152229 - RNA, 19 nt, Homo sapiens
ggagaauauuccuuaacua

SEQ ID NO: 1152230 - RNA, 19 nt, Homo sapiens
acacaagccucguugauau

SEQ ID NO: 1152231 - RNA, 19 nt, Homo sapiens
agagaaaccaugcaauuua

SEQ ID NO: 1152232 - RNA, 19 nt, Homo sapiens
aaagagaccuguggauuga

SEQ ID NO: 1152233 - RNA, 19 nt, Homo sapiens
gggcuucucuugagcauau

SEQ ID NO: 1152234 - RNA, 19 nt, Homo sapiens
guagugagaugauaacagu

SEQ ID NO: 1152235 - RNA, 19 nt, Homo sapiens
gaacagcagguugauagua

SEQ ID NO: 1152236 - RNA, 19 nt, Homo sapiens
gcacuuaugcugaugaaga

SEQ ID NO: 1152237 - RNA, 19 nt, Homo sapiens
aaagugagauucccacaga

SEQ ID NO: 1152238 - RNA, 19 nt, Homo sapiens
gagagaaaccaugcaauuu

SEQ ID NO: 1152239 - RNA, 19 nt, Homo sapiens
gccaagaucuguucacaca

SEQ ID NO: 1152240 - RNA, 19 nt, Homo sapiens
uaagaugguuguuggagaa

SEQ ID NO: 1152241 - RNA, 19 nt, Homo sapiens
gaaacuagccagcugugaa

SEQ ID NO: 1152242 - RNA, 19 nt, Homo sapiens
gaaacgugcucuucaucug

SEQ ID NO: 1152243 - RNA, 19 nt, Homo sapiens
gaguggauuucaagcauuu

SEQ ID NO: 1152244 - RNA, 19 nt, Homo sapiens
ugucauaacuuacagugaa

SEQ ID NO: 1152245 - RNA, 19 nt, Homo sapiens
ggaaggcuaugucugaaca

SEQ ID NO: 1152246 - RNA, 19 nt, Homo sapiens
gaaacaugguaacucaaga

SEQ ID NO: 1152247 - RNA, 19 nt, Homo sapiens
cuacauccaugacaccuuu

SEQ ID NO: 1152248 - RNA, 19 nt, Homo sapiens
gcagggaccuaaacuuugg

SEQ ID NO: 1152249 - RNA, 19 nt, Homo sapiens
ccaagguucuggcuucauu

SEQ ID NO: 1152250 - RNA, 19 nt, Homo sapiens
ugucugcugucauaacuua

SEQ ID NO: 1152251 - RNA, 19 nt, Homo sapiens
gugugcaaguuuccuauua

SEQ ID NO: 1152252 - RNA, 19 nt, Homo sapiens
acuaggaacuugaauguga

SEQ ID NO: 1152253 - RNA, 19 nt, Homo sapiens
gaacaaggucuggaaaugu

SEQ ID NO: 1152254 - RNA, 19 nt, Homo sapiens
ggaaguugguugauugucu

SEQ ID NO: 1152255 - RNA, 19 nt, Homo sapiens
ccuaaguucuguuuccuuu

SEQ ID NO: 1152256 - RNA, 19 nt, Homo sapiens
ucacagcacuuuccagaag

SEQ ID NO: 1152257 - RNA, 19 nt, Homo sapiens
uauacuggcuugauuugaa

SEQ ID NO: 1152258 - RNA, 19 nt, Homo sapiens
gagaacagcagguugauag

SEQ ID NO: 1152259 - RNA, 19 nt, Homo sapiens
cagcagggaccuaaacuuu

SEQ ID NO: 1152260 - RNA, 19 nt, Homo sapiens
agacuuaccuaccaucuuc

SEQ ID NO: 1152261 - RNA, 19 nt, Homo sapiens
ggaaauguuuagacaggau

SEQ ID NO: 1152262 - RNA, 19 nt, Homo sapiens
caaugaggcuguugaaagg

SEQ ID NO: 1152263 - RNA, 19 nt, Homo sapiens
gaaauuccuagaucacuga

SEQ ID NO: 1152264 - RNA, 19 nt, Homo sapiens
aagcagaaguuacaagaau

SEQ ID NO: 1152265 - RNA, 19 nt, Homo sapiens
gaaaggagcccagcauguc

SEQ ID NO: 1152266 - RNA, 19 nt, Homo sapiens
gcgagcagguguucucaug

SEQ ID NO: 1152267 - RNA, 19 nt, Homo sapiens
ggauccagguguugacuau

SEQ ID NO: 1152268 - RNA, 19 nt, Homo sapiens
caagugcuccugagagaaa

SEQ ID NO: 1152269 - RNA, 19 nt, Homo sapiens
cagaaaguguggaggagaa

SEQ ID NO: 1152270 - RNA, 19 nt, Homo sapiens
aaagaguguuugcuuaaga

SEQ ID NO: 1152271 - RNA, 19 nt, Homo sapiens
ggacagggacagcagagaa

SEQ ID NO: 1152272 - RNA, 19 nt, Homo sapiens
ggagaagagccaaaguauu

SEQ ID NO: 1152273 - RNA, 19 nt, Homo sapiens
auagcuggcuuaacaauga

SEQ ID NO: 1152274 - RNA, 19 nt, Homo sapiens
gccuagguuucuuagauua

SEQ ID NO: 1152275 - RNA, 19 nt, Homo sapiens
gcaagcaccaccuaaugaa

SEQ ID NO: 1152276 - RNA, 19 nt, Homo sapiens
gaagauggcccugcuccuu

SEQ ID NO: 1152277 - RNA, 19 nt, Homo sapiens
ggaccuauaccaugggaaa

SEQ ID NO: 1152278 - RNA, 19 nt, Homo sapiens
cauaacaacacuagaagaa

SEQ ID NO: 1152279 - RNA, 19 nt, Homo sapiens
acagaaugcagaagucuua

SEQ ID NO: 1152280 - RNA, 19 nt, Homo sapiens
gaagacagaaugcagaagu

SEQ ID NO: 1152281 - RNA, 19 nt, Homo sapiens
cuagaucacugagagcuaa

SEQ ID NO: 1152282 - RNA, 19 nt, Homo sapiens
gaguguauguucacccuau

SEQ ID NO: 1152283 - RNA, 19 nt, Homo sapiens
gugcuuaagccacuguuua

SEQ ID NO: 1152284 - RNA, 19 nt, Homo sapiens
ccaaaucucuguggcuuca

SEQ ID NO: 1152285 - RNA, 19 nt, Homo sapiens
ccucauaacugggcuugaa

SEQ ID NO: 1152286 - RNA, 19 nt, Homo sapiens
caucaagacuuaccuacca

SEQ ID NO: 1152287 - RNA, 19 nt, Homo sapiens
ugaagagcuugucaucaaa

SEQ ID NO: 1152288 - RNA, 19 nt, Homo sapiens
ugagagaaaccaugcaauu

SEQ ID NO: 1152289 - RNA, 19 nt, Homo sapiens
gagaaacucuuggccuauc

SEQ ID NO: 1152290 - RNA, 19 nt, Homo sapiens
ggacuagguaacacuuuaa

SEQ ID NO: 1152291 - RNA, 19 nt, Homo sapiens
uaaacugccagaaaucuuu

SEQ ID NO: 1152292 - RNA, 19 nt, Homo sapiens
gcagaaguuacaagaauau

SEQ ID NO: 1152293 - RNA, 19 nt, Homo sapiens
ggaagagcccucagaugga

SEQ ID NO: 1152294 - RNA, 19 nt, Homo sapiens
gagccaaaguauugucuag

SEQ ID NO: 1152295 - RNA, 19 nt, Homo sapiens
caaagucaaagcagauaaa

SEQ ID NO: 1152296 - RNA, 19 nt, Homo sapiens
gcacaucccugaagacgau

SEQ ID NO: 1152297 - RNA, 19 nt, Homo sapiens
agacagaccuaguuucaaa

SEQ ID NO: 1152298 - RNA, 19 nt, Homo sapiens
gagcagaucuggugguucu

SEQ ID NO: 1152299 - RNA, 19 nt, Homo sapiens
uggaauugcuggagacuuu

SEQ ID NO: 1152300 - RNA, 19 nt, Homo sapiens
acagaaggcucacugauca

SEQ ID NO: 1152301 - RNA, 19 nt, Homo sapiens
gagccaagcccucacugua

SEQ ID NO: 1152302 - RNA, 19 nt, Homo sapiens
gcagcuuccuuggguguua

SEQ ID NO: 1152303 - RNA, 19 nt, Homo sapiens
ggaaugcagugccagcaau

SEQ ID NO: 1152304 - RNA, 19 nt, Homo sapiens
gaagaauauuuccaagaag

SEQ ID NO: 1152305 - RNA, 19 nt, Homo sapiens
ucaaggauguucucuacga

SEQ ID NO: 1152306 - RNA, 19 nt, Homo sapiens
gggccucucuccagauuga

SEQ ID NO: 1152307 - RNA, 19 nt, Homo sapiens
agacagagcuaggugugaa

SEQ ID NO: 1152308 - RNA, 19 nt, Homo sapiens
gcacuagcccucauguugu

SEQ ID NO: 1152309 - RNA, 19 nt, Homo sapiens
caucugggcuccuguggau

SEQ ID NO: 1152310 - RNA, 19 nt, Homo sapiens
gauuggaacagggaucuua

SEQ ID NO: 1152311 - RNA, 19 nt, Homo sapiens
gaauugacccugauuacgu

SEQ ID NO: 1152312 - RNA, 19 nt, Homo sapiens
ggaguggccguccuuguga

SEQ ID NO: 1152313 - RNA, 19 nt, Homo sapiens
ggcacuagcccucauguug

SEQ ID NO: 1152314 - RNA, 19 nt, Homo sapiens
ccagacagaccuaguuuca

SEQ ID NO: 1152315 - RNA, 19 nt, Homo sapiens
gcugugaacaucccuaaug

SEQ ID NO: 1152316 - RNA, 19 nt, Homo sapiens
caaccagacagaccuaguu

SEQ ID NO: 1152317 - RNA, 19 nt, Homo sapiens
gcaagaggaggaacacauc

SEQ ID NO: 1152318 - RNA, 19 nt, Homo sapiens
cugcagagauucagugucu

SEQ ID NO: 1152319 - RNA, 19 nt, Homo sapiens
gcacagaaggcucacugau

SEQ ID NO: 1152320 - RNA, 19 nt, Homo sapiens
gccaagcccucacuguaca

SEQ ID NO: 1152321 - RNA, 19 nt, Homo sapiens
gcugaggcauacccugcua

SEQ ID NO: 1152322 - RNA, 19 nt, Homo sapiens
cguggaagcuccgaggaaa

SEQ ID NO: 1152323 - RNA, 19 nt, Homo sapiens
gaccugaagcugagacaga

SEQ ID NO: 1152324 - RNA, 19 nt, Homo sapiens
cauauggaccugcaaagga

SEQ ID NO: 1152325 - RNA, 19 nt, Homo sapiens
caagcguccugaccgaaug

SEQ ID NO: 1152326 - RNA, 19 nt, Homo sapiens
gggagcauguggugacagu

SEQ ID NO: 1152327 - RNA, 19 nt, Homo sapiens
gcccaagggugccaauguc

SEQ ID NO: 1152328 - RNA, 19 nt, Homo sapiens
gagcugaucagaaggacau

SEQ ID NO: 1152329 - RNA, 19 nt, Homo sapiens
ggcccaaggaagaauauuu

SEQ ID NO: 1152330 - RNA, 19 nt, Homo sapiens
aggaugcccugggagaaua

SEQ ID NO: 1152331 - RNA, 19 nt, Homo sapiens
ugccaggccucaucaagga

SEQ ID NO: 1152332 - RNA, 19 nt, Homo sapiens
gcccucauguugucaccaa

SEQ ID NO: 1152333 - RNA, 19 nt, Homo sapiens
gcccaaggaagaauauuuc

SEQ ID NO: 1152334 - RNA, 19 nt, Homo sapiens
caagaacagcacagucaau

SEQ ID NO: 1152335 - RNA, 19 nt, Homo sapiens
ggauggcuacgucuuggaa

SEQ ID NO: 1152336 - RNA, 19 nt, Homo sapiens
guacgagugccgcguguuc

SEQ ID NO: 1152337 - RNA, 19 nt, Homo sapiens
ccaguggcccugagagaug

SEQ ID NO: 1152338 - RNA, 19 nt, Homo sapiens
gaaugcagugccagcaaug

SEQ ID NO: 1152339 - RNA, 19 nt, Homo sapiens
gaauauuuccaagaaguag

SEQ ID NO: 1152340 - RNA, 19 nt, Homo sapiens
acaggugaauaaacaaagu

SEQ ID NO: 1152341 - RNA, 19 nt, Homo sapiens
ccacucugcugugaacauc

SEQ ID NO: 1152342 - RNA, 19 nt, Homo sapiens
uuccuuggguguuacauga

SEQ ID NO: 1152343 - RNA, 19 nt, Homo sapiens
cccugcagcuggacaaguu

SEQ ID NO: 1152344 - RNA, 19 nt, Homo sapiens
cggccaacgucuccacuuc

SEQ ID NO: 1152345 - RNA, 19 nt, Homo sapiens
gaggaugcccugggagaau

SEQ ID NO: 1152346 - RNA, 19 nt, Homo sapiens
ccagaaaccccuccuguau

SEQ ID NO: 1152347 - RNA, 19 nt, Homo sapiens
cugcuaaccucaccuacag

SEQ ID NO: 1152348 - RNA, 19 nt, Homo sapiens
cggagcagaucuggugguu

SEQ ID NO: 1152349 - RNA, 19 nt, Homo sapiens
aggauguucucuacgaguu

SEQ ID NO: 1152350 - RNA, 19 nt, Homo sapiens
ucagcgaaaucgucuuguc

SEQ ID NO: 1152351 - RNA, 19 nt, Homo sapiens
ucagcgugcuagcucagaa

SEQ ID NO: 1152352 - RNA, 19 nt, Homo sapiens
uggcuuugauggugguuau

SEQ ID NO: 1152353 - RNA, 19 nt, Homo sapiens
ggacccuccuccuguuguc

SEQ ID NO: 1152354 - RNA, 19 nt, Homo sapiens
agggaagccugagguggua

SEQ ID NO: 1152355 - RNA, 19 nt, Homo sapiens
gugugugugugugaaguuu

SEQ ID NO: 1152356 - RNA, 19 nt, Homo sapiens
gcugucccaccucaucuuu

SEQ ID NO: 1152357 - RNA, 19 nt, Homo sapiens
gcccgguccuuugacugua

SEQ ID NO: 1152358 - RNA, 19 nt, Homo sapiens
aguggucccuucagcgaaa

SEQ ID NO: 1152359 - RNA, 19 nt, Homo sapiens
cacagaaggcucacugauc

SEQ ID NO: 1152360 - RNA, 19 nt, Homo sapiens
ccaagaacagcacagucaa

SEQ ID NO: 1152361 - RNA, 19 nt, Homo sapiens
gaccagcacaucccugaag

SEQ ID NO: 1152362 - RNA, 19 nt, Homo sapiens
cuaaugugaggcugugaaa

SEQ ID NO: 1152363 - RNA, 19 nt, Homo sapiens
caucuguggacgagaacua

SEQ ID NO: 1152364 - RNA, 19 nt, Homo sapiens
cccaagaacagcacaguca

SEQ ID NO: 1152365 - RNA, 19 nt, Homo sapiens
gcauauggaccugcaaagg

SEQ ID NO: 1152366 - RNA, 19 nt, Homo sapiens
ccacccggauccuccaucu

SEQ ID NO: 1152367 - RNA, 19 nt, Homo sapiens
ggugggcggagucugcuuu

SEQ ID NO: 1152368 - RNA, 19 nt, Homo sapiens
gaugaugccggcugcuaca

SEQ ID NO: 1152369 - RNA, 19 nt, Homo sapiens
gagacagagcuagguguga

SEQ ID NO: 1152370 - RNA, 19 nt, Homo sapiens
caccucaucuuuccuucgu

SEQ ID NO: 1152371 - RNA, 19 nt, Homo sapiens
cgugcuagcucagaacaag

SEQ ID NO: 1152372 - RNA, 19 nt, Homo sapiens
cucccaggauguuucauug

SEQ ID NO: 1152373 - RNA, 19 nt, Homo sapiens
gauuccugcuucccaucuu

SEQ ID NO: 1152374 - RNA, 19 nt, Homo sapiens
gaagagugagagcugaaac

SEQ ID NO: 1152375 - RNA, 19 nt, Homo sapiens
cuggcugacuggacacuga

SEQ ID NO: 1152376 - RNA, 19 nt, Homo sapiens
ccucuacucuccccgaauu

SEQ ID NO: 1152377 - RNA, 19 nt, Homo sapiens
ccucugcauugaagacauc

SEQ ID NO: 1152378 - RNA, 19 nt, Homo sapiens
ccaagcguccugaccgaau

SEQ ID NO: 1152379 - RNA, 19 nt, Homo sapiens
gggaaugcagugccagcaa

SEQ ID NO: 1152380 - RNA, 19 nt, Homo sapiens
aagaacagcacagucaaug

SEQ ID NO: 1152381 - RNA, 19 nt, Homo sapiens
ggguuugggucaccuuggu

SEQ ID NO: 1152382 - RNA, 19 nt, Homo sapiens
ggaauugcuggagacuuug

SEQ ID NO: 1152383 - RNA, 19 nt, Homo sapiens
gggcggagucugcuuucug

SEQ ID NO: 1152384 - RNA, 19 nt, Homo sapiens
ccacacccaguaccaguuc

SEQ ID NO: 1152385 - RNA, 19 nt, Homo sapiens
cauguugucaccaaugugu

SEQ ID NO: 1152386 - RNA, 19 nt, Homo sapiens
cagaagagugagagcugaa

SEQ ID NO: 1152387 - RNA, 19 nt, Homo sapiens
aaccagacagaccuaguuu

SEQ ID NO: 1152388 - RNA, 19 nt, Homo sapiens
cacuagcccucauguuguc

SEQ ID NO: 1152389 - RNA, 19 nt, Homo sapiens
ccaguucggccucuacucu

SEQ ID NO: 1152390 - RNA, 19 nt, Homo sapiens
ggaccagcacaucccugaa

SEQ ID NO: 1152391 - RNA, 19 nt, Homo sapiens
gaagaaaucaucucaguuu

SEQ ID NO: 1152392 - RNA, 19 nt, Homo sapiens
gcagacagguugaaauaaa

SEQ ID NO: 1152393 - RNA, 19 nt, Homo sapiens
caacaguaauccucucuua

SEQ ID NO: 1152394 - RNA, 19 nt, Homo sapiens
ggacggugcuuaauucaaa

SEQ ID NO: 1152395 - RNA, 19 nt, Homo sapiens
gcagaagcaugacuuuaaa

SEQ ID NO: 1152396 - RNA, 19 nt, Homo sapiens
uauagaagcuagacgguua

SEQ ID NO: 1152397 - RNA, 19 nt, Homo sapiens
gacaacagauugaagaauu

SEQ ID NO: 1152398 - RNA, 19 nt, Homo sapiens
ggaaagaacauauaaagga

SEQ ID NO: 1152399 - RNA, 19 nt, Homo sapiens
gaauuugacuguagcugua

SEQ ID NO: 1152400 - RNA, 19 nt, Homo sapiens
ggaaauccauucaaaccuu

SEQ ID NO: 1152401 - RNA, 19 nt, Homo sapiens
ggacagaugcagaaacuaa

SEQ ID NO: 1152402 - RNA, 19 nt, Homo sapiens
gaaauuggaaguuguaaga

SEQ ID NO: 1152403 - RNA, 19 nt, Homo sapiens
gaaauggccauguuuagaa

SEQ ID NO: 1152404 - RNA, 19 nt, Homo sapiens
ggacugauggcucgcauua

SEQ ID NO: 1152405 - RNA, 19 nt, Homo sapiens
caacagcugcuuagacaua

SEQ ID NO: 1152406 - RNA, 19 nt, Homo sapiens
ccacagaaauggccauguu

SEQ ID NO: 1152407 - RNA, 19 nt, Homo sapiens
ccagaggauuuaaagaaua

SEQ ID NO: 1152408 - RNA, 19 nt, Homo sapiens
acaauugccugauucuaua

SEQ ID NO: 1152409 - RNA, 19 nt, Homo sapiens
gaacuggagucacuaccuu

SEQ ID NO: 1152410 - RNA, 19 nt, Homo sapiens
gacaacagcugcuuagaca

SEQ ID NO: 1152411 - RNA, 19 nt, Homo sapiens
cacaagcucuuuaugaauu

SEQ ID NO: 1152412 - RNA, 19 nt, Homo sapiens
gaacuucacccuucauuag

SEQ ID NO: 1152413 - RNA, 19 nt, Homo sapiens
ggagcaaacugugaaagaa

SEQ ID NO: 1152414 - RNA, 19 nt, Homo sapiens
gaacauuagaggagcuuua

SEQ ID NO: 1152415 - RNA, 19 nt, Homo sapiens
acaaggaaauccauucaaa

SEQ ID NO: 1152416 - RNA, 19 nt, Homo sapiens
gaacacaguagaccuaguu

SEQ ID NO: 1152417 - RNA, 19 nt, Homo sapiens
aagcaugacuuuaaacuug

SEQ ID NO: 1152418 - RNA, 19 nt, Homo sapiens
agaacuaccucuucagaaa

SEQ ID NO: 1152419 - RNA, 19 nt, Homo sapiens
caacaggagucuuaguaau

SEQ ID NO: 1152420 - RNA, 19 nt, Homo sapiens
guaauccucucuuaaguuc

SEQ ID NO: 1152421 - RNA, 19 nt, Homo sapiens
gaaaggagcauguguacuc

SEQ ID NO: 1152422 - RNA, 19 nt, Homo sapiens
gagcauguguacuccauug

SEQ ID NO: 1152423 - RNA, 19 nt, Homo sapiens
guagaugacaaucaacuua

SEQ ID NO: 1152424 - RNA, 19 nt, Homo sapiens
caaagcagcguuacaguga

SEQ ID NO: 1152425 - RNA, 19 nt, Homo sapiens
guaaugaacuggagucacu

SEQ ID NO: 1152426 - RNA, 19 nt, Homo sapiens
gaaugacgccuuucuugaa

SEQ ID NO: 1152427 - RNA, 19 nt, Homo sapiens
caggaaugcugcuuacaaa

SEQ ID NO: 1152428 - RNA, 19 nt, Homo sapiens
gaaaaucacuugaaaacuc

SEQ ID NO: 1152429 - RNA, 19 nt, Homo sapiens
cacacaagcucuuuaugaa

SEQ ID NO: 1152430 - RNA, 19 nt, Homo sapiens
ugagcuuacugucuaaaua

SEQ ID NO: 1152431 - RNA, 19 nt, Homo sapiens
gaaacaaagcaaagaguau

SEQ ID NO: 1152432 - RNA, 19 nt, Homo sapiens
gaaacuaagaguccuaaau

SEQ ID NO: 1152433 - RNA, 19 nt, Homo sapiens
ccagagaaauuggaaguug

SEQ ID NO: 1152434 - RNA, 19 nt, Homo sapiens
ggcagaagcaugacuuuaa

SEQ ID NO: 1152435 - RNA, 19 nt, Homo sapiens
gaacacccuucauaucaag

SEQ ID NO: 1152436 - RNA, 19 nt, Homo sapiens
ggccuuggauuuaguauca

SEQ ID NO: 1152437 - RNA, 19 nt, Homo sapiens
aaaggaguauggauggaua

SEQ ID NO: 1152438 - RNA, 19 nt, Homo sapiens
gaggagagcugugguaaaa

SEQ ID NO: 1152439 - RNA, 19 nt, Homo sapiens
gcaugacuguugccuuuga

SEQ ID NO: 1152440 - RNA, 19 nt, Homo sapiens
caaagaguauugacuaacu

SEQ ID NO: 1152441 - RNA, 19 nt, Homo sapiens
ucacuaccuucuacuauug

SEQ ID NO: 1152442 - RNA, 19 nt, Homo sapiens
uggaagacuugucaaauug

SEQ ID NO: 1152443 - RNA, 19 nt, Homo sapiens
ggacacaguuuuguacaua

SEQ ID NO: 1152444 - RNA, 19 nt, Homo sapiens
ggaauuaguggacaaggaa

SEQ ID NO: 1152445 - RNA, 19 nt, Homo sapiens
acuauuggcuaccuucaua

SEQ ID NO: 1152446 - RNA, 19 nt, Homo sapiens
guacauauggaacaugaaa

SEQ ID NO: 1152447 - RNA, 19 nt, Homo sapiens
gaaaaggaauggcagguau

SEQ ID NO: 1152448 - RNA, 19 nt, Homo sapiens
cuaaagaugcaguacauaa

SEQ ID NO: 1152449 - RNA, 19 nt, Homo sapiens
gacaacagcuaaagaugca

SEQ ID NO: 1152450 - RNA, 19 nt, Homo sapiens
ggaacuucacccuucauua

SEQ ID NO: 1152451 - RNA, 19 nt, Homo sapiens
caaagucaaugcacaaacu

SEQ ID NO: 1152452 - RNA, 19 nt, Homo sapiens
gcacacacaagcucuuuau

SEQ ID NO: 1152453 - RNA, 19 nt, Homo sapiens
gagcaaacugugaaagaaa

SEQ ID NO: 1152454 - RNA, 19 nt, Homo sapiens
gauaacgaccuuucaaauc

SEQ ID NO: 1152455 - RNA, 19 nt, Homo sapiens
ugaugaagauuuccaguca

SEQ ID NO: 1152456 - RNA, 19 nt, Homo sapiens
gcccuuaucccuuuacaaa

SEQ ID NO: 1152457 - RNA, 19 nt, Homo sapiens
ugacgccuuucuugaauuu

SEQ ID NO: 1152458 - RNA, 19 nt, Homo sapiens
caugguauguccaguaugu

SEQ ID NO: 1152459 - RNA, 19 nt, Homo sapiens
ggacgcaggccuuugauca

SEQ ID NO: 1152460 - RNA, 19 nt, Homo sapiens
uagaagaauuugacuguag

SEQ ID NO: 1152461 - RNA, 19 nt, Homo sapiens
gagcuuacugucuaaauau

SEQ ID NO: 1152462 - RNA, 19 nt, Homo sapiens
ggaaugcugcuuacaaaca

SEQ ID NO: 1152463 - RNA, 19 nt, Homo sapiens
gaagaacuacccaagcaau

SEQ ID NO: 1152464 - RNA, 19 nt, Homo sapiens
gaagcuagacgguuagaca

SEQ ID NO: 1152465 - RNA, 19 nt, Homo sapiens
gcgagaagcuacaguacag

SEQ ID NO: 1152466 - RNA, 19 nt, Homo sapiens
ugaaauaccuaguccuuuu

SEQ ID NO: 1152467 - RNA, 19 nt, Homo sapiens
gcagacaacagcuaaagau

SEQ ID NO: 1152468 - RNA, 19 nt, Homo sapiens
cuaagaguccuaaauuuga

SEQ ID NO: 1152469 - RNA, 19 nt, Homo sapiens
gacuugaccuaggcaauaa

SEQ ID NO: 1152470 - RNA, 19 nt, Homo sapiens
acacacaagcucuuuauga

SEQ ID NO: 1152471 - RNA, 19 nt, Homo sapiens
gagcaugguauguccagua

SEQ ID NO: 1152472 - RNA, 19 nt, Homo sapiens
uuggaagacuugucaaauu

SEQ ID NO: 1152473 - RNA, 19 nt, Homo sapiens
gaaaucaucucaguuuuag

SEQ ID NO: 1152474 - RNA, 19 nt, Homo sapiens
caguagaccuaguuauuca

SEQ ID NO: 1152475 - RNA, 19 nt, Homo sapiens
aaggguaucuuuguuacua

SEQ ID NO: 1152476 - RNA, 19 nt, Homo sapiens
ggacaaggaaauccauuca

SEQ ID NO: 1152477 - RNA, 19 nt, Homo sapiens
ggugacaagccaucagaua

SEQ ID NO: 1152478 - RNA, 19 nt, Homo sapiens
gaacuacccaagcaauugu

SEQ ID NO: 1152479 - RNA, 19 nt, Homo sapiens
gaaaaugcugggaaaguua

SEQ ID NO: 1152480 - RNA, 19 nt, Homo sapiens
acgcaugacuguugccuuu

SEQ ID NO: 1152481 - RNA, 19 nt, Homo sapiens
gagaauuuccuuccagaau

SEQ ID NO: 1152482 - RNA, 19 nt, Homo sapiens
ucacacagcuccuaaaccu

SEQ ID NO: 1152483 - RNA, 19 nt, Homo sapiens
gcacugaccauccuuaaaa

SEQ ID NO: 1152484 - RNA, 19 nt, Homo sapiens
aaagcuguauuacuacuga

SEQ ID NO: 1152485 - RNA, 19 nt, Homo sapiens
gggagcagcagccguauga

SEQ ID NO: 1152486 - RNA, 19 nt, Homo sapiens
aagaagaaaucaucucagu

SEQ ID NO: 1152487 - RNA, 19 nt, Homo sapiens
gugacaagccaucagauaa

SEQ ID NO: 1152488 - RNA, 19 nt, Homo sapiens
guucaacugucaagcucua

SEQ ID NO: 1152489 - RNA, 19 nt, Homo sapiens
ucucuacgcuccaacaaau

SEQ ID NO: 1152490 - RNA, 19 nt, Homo sapiens
gaaguuaaagauguuggua

SEQ ID NO: 1152491 - RNA, 19 nt, Homo sapiens
gaacagaagucuccugauu

SEQ ID NO: 1152492 - RNA, 19 nt, Homo sapiens
gaacggaacccucuacauu

SEQ ID NO: 1152493 - RNA, 19 nt, Homo sapiens
gcaagcagcucucuguaug

SEQ ID NO: 1152494 - RNA, 19 nt, Homo sapiens
gcccugaaaugacuuguua

SEQ ID NO: 1152495 - RNA, 19 nt, Homo sapiens
guagacacaugcagaauga

SEQ ID NO: 1152496 - RNA, 19 nt, Homo sapiens
gacaaaggcuugcgaagga

SEQ ID NO: 1152497 - RNA, 19 nt, Homo sapiens
ccaaugaguucccugauga

SEQ ID NO: 1152498 - RNA, 19 nt, Homo sapiens
ggacaccaguuccugauga

SEQ ID NO: 1152499 - RNA, 19 nt, Homo sapiens
ggaaauagcaguggaguau

SEQ ID NO: 1152500 - RNA, 19 nt, Homo sapiens
aaacugacauggaaaucua

SEQ ID NO: 1152501 - RNA, 19 nt, Homo sapiens
ugagaacaauggucagaua

SEQ ID NO: 1152502 - RNA, 19 nt, Homo sapiens
gaacaucucagcagcaaga

SEQ ID NO: 1152503 - RNA, 19 nt, Homo sapiens
aaauagcaguggaguauaa

SEQ ID NO: 1152504 - RNA, 19 nt, Homo sapiens
gaacuacuaugaggucaga

SEQ ID NO: 1152505 - RNA, 19 nt, Homo sapiens
gaggaaugcuggacuggaa

SEQ ID NO: 1152506 - RNA, 19 nt, Homo sapiens
ggaaucaucuugaaguuuu

SEQ ID NO: 1152507 - RNA, 19 nt, Homo sapiens
uaagauggauacauuggaa

SEQ ID NO: 1152508 - RNA, 19 nt, Homo sapiens
gaccauauuuauacuguug

SEQ ID NO: 1152509 - RNA, 19 nt, Homo sapiens
ugaaaugacuuguuaaucg

SEQ ID NO: 1152510 - RNA, 19 nt, Homo sapiens
uuacagaugugauucguau

SEQ ID NO: 1152511 - RNA, 19 nt, Homo sapiens
cggaagaaauuuauuguag

SEQ ID NO: 1152512 - RNA, 19 nt, Homo sapiens
gcaagcggcuggaaaugca

SEQ ID NO: 1152513 - RNA, 19 nt, Homo sapiens
cggccaagaugcucauuaa

SEQ ID NO: 1152514 - RNA, 19 nt, Homo sapiens
gcagugcccuccaucuuca

SEQ ID NO: 1152515 - RNA, 19 nt, Homo sapiens
gaugagugccacaacuuua

SEQ ID NO: 1152516 - RNA, 19 nt, Homo sapiens
gauaugcaaccuccaauga

SEQ ID NO: 1152517 - RNA, 19 nt, Homo sapiens
ggacggaacaccacacaga

SEQ ID NO: 1152518 - RNA, 19 nt, Homo sapiens
ggacauagagcguggcaau

SEQ ID NO: 1152519 - RNA, 19 nt, Homo sapiens
ggagaugaguguuuacaac

SEQ ID NO: 1152520 - RNA, 19 nt, Homo sapiens
gcuagggaccauauuuaua

SEQ ID NO: 1152521 - RNA, 19 nt, Homo sapiens
ucagaagccuugcugcuau

SEQ ID NO: 1152522 - RNA, 19 nt, Homo sapiens
ccgccacacuggaguauaa

SEQ ID NO: 1152523 - RNA, 19 nt, Homo sapiens
uggaggagaugaguguuua

SEQ ID NO: 1152524 - RNA, 19 nt, Homo sapiens
aagccuugcugcuauauuu

SEQ ID NO: 1152525 - RNA, 19 nt, Homo sapiens
gcucagguuuguaagaaug

SEQ ID NO: 1152526 - RNA, 19 nt, Homo sapiens
gaugaugcauuguuugucu

SEQ ID NO: 1152527 - RNA, 19 nt, Homo sapiens
cagaagccuugcugcuaua

SEQ ID NO: 1152528 - RNA, 19 nt, Homo sapiens
gggugaaccuuguggagaa

SEQ ID NO: 1152529 - RNA, 19 nt, Homo sapiens
gagaagggaaucaucuuga

SEQ ID NO: 1152530 - RNA, 19 nt, Homo sapiens
caaguggaauuuggauuug

SEQ ID NO: 1152531 - RNA, 19 nt, Homo sapiens
gaaauagcaguggaguaua

SEQ ID NO: 1152532 - RNA, 19 nt, Homo sapiens
ggagagauccccucgauaa

SEQ ID NO: 1152533 - RNA, 19 nt, Homo sapiens
gaacacaucgcguuugcau

SEQ ID NO: 1152534 - RNA, 19 nt, Homo sapiens
ccaaugaugcguguacaua

SEQ ID NO: 1152535 - RNA, 19 nt, Homo sapiens
ccucucaccucuccagaaa

SEQ ID NO: 1152536 - RNA, 19 nt, Homo sapiens
cauccuggcuuucgucaug

SEQ ID NO: 1152537 - RNA, 19 nt, Homo sapiens
gauaugggaggaucucaaa

SEQ ID NO: 1152538 - RNA, 19 nt, Homo sapiens
gaauuuggauuuggagaag

SEQ ID NO: 1152539 - RNA, 19 nt, Homo sapiens
aaagaguccuggagaaaca

SEQ ID NO: 1152540 - RNA, 19 nt, Homo sapiens
ccaagaugcucauuaaagc

SEQ ID NO: 1152541 - RNA, 19 nt, Homo sapiens
gcacaaccacaucagauuc

SEQ ID NO: 1152542 - RNA, 19 nt, Homo sapiens
gaaacuauaagauggauac

SEQ ID NO: 1152543 - RNA, 19 nt, Homo sapiens
gagacaagcacacauguag

SEQ ID NO: 1152544 - RNA, 19 nt, Homo sapiens
gaaccagaaccucaucaau

SEQ ID NO: 1152545 - RNA, 19 nt, Homo sapiens
ggcagugucuucccauaau

SEQ ID NO: 1152546 - RNA, 19 nt, Homo sapiens
agaagggaaucaucuugaa

SEQ ID NO: 1152547 - RNA, 19 nt, Homo sapiens
caaugaugcguguacauaa

SEQ ID NO: 1152548 - RNA, 19 nt, Homo sapiens
gaaaugcaccacuccucuu

SEQ ID NO: 1152549 - RNA, 19 nt, Homo sapiens
ggaauuuggauuuggagaa

SEQ ID NO: 1152550 - RNA, 19 nt, Homo sapiens
gcauuccaguucccucuug

SEQ ID NO: 1152551 - RNA, 19 nt, Homo sapiens
gguggugccugcagccauu

SEQ ID NO: 1152552 - RNA, 19 nt, Homo sapiens
gaacgacaugggaagugua

SEQ ID NO: 1152553 - RNA, 19 nt, Homo sapiens
ggaugagugccacaacuuu

SEQ ID NO: 1152554 - RNA, 19 nt, Homo sapiens
aacacuaacuccuccaauu

SEQ ID NO: 1152555 - RNA, 19 nt, Homo sapiens
gggaccauauuuauacugu

SEQ ID NO: 1152556 - RNA, 19 nt, Homo sapiens
agggugaaguagagaaaua

SEQ ID NO: 1152557 - RNA, 19 nt, Homo sapiens
cagcuaugauggagucgaa

SEQ ID NO: 1152558 - RNA, 19 nt, Homo sapiens
ucaaagaguccuggagaaa

SEQ ID NO: 1152559 - RNA, 19 nt, Homo sapiens
gcagaaacuauaagaugga

SEQ ID NO: 1152560 - RNA, 19 nt, Homo sapiens
aagcacacauguaggaaug

SEQ ID NO: 1152561 - RNA, 19 nt, Homo sapiens
ucagcaagguucucaacug

SEQ ID NO: 1152562 - RNA, 19 nt, Homo sapiens
ccucaacgccuacaacuca

SEQ ID NO: 1152563 - RNA, 19 nt, Homo sapiens
ucgggaaaguuaccucaaa

SEQ ID NO: 1152564 - RNA, 19 nt, Homo sapiens
gacaagcacacauguagga

SEQ ID NO: 1152565 - RNA, 19 nt, Homo sapiens
gaauaggaaauagugguuu

SEQ ID NO: 1152566 - RNA, 19 nt, Homo sapiens
gagugauucgggaaaguua

SEQ ID NO: 1152567 - RNA, 19 nt, Homo sapiens
ugccaacguugcacuguuu

SEQ ID NO: 1152568 - RNA, 19 nt, Homo sapiens
gagugccacaacuuuauua

SEQ ID NO: 1152569 - RNA, 19 nt, Homo sapiens
gauauagacacaucacaca

SEQ ID NO: 1152570 - RNA, 19 nt, Homo sapiens
ggaccauauuuauacuguu

SEQ ID NO: 1152571 - RNA, 19 nt, Homo sapiens
gccaagaugcucauuaaag

SEQ ID NO: 1152572 - RNA, 19 nt, Homo sapiens
ucacgccacucaugcacaa

SEQ ID NO: 1152573 - RNA, 19 nt, Homo sapiens
gcagugucuucccauaauc

SEQ ID NO: 1152574 - RNA, 19 nt, Homo sapiens
gggcagugucuucccauaa

SEQ ID NO: 1152575 - RNA, 19 nt, Homo sapiens
gacaccaguuccugaugaa

SEQ ID NO: 1152576 - RNA, 19 nt, Homo sapiens
ggacugucacaauuccuuu

SEQ ID NO: 1152577 - RNA, 19 nt, Homo sapiens
gagcguggcaauacagaug

SEQ ID NO: 1152578 - RNA, 19 nt, Homo sapiens
aagcagcucucuguauguu

SEQ ID NO: 1152579 - RNA, 19 nt, Homo sapiens
cauccuccuuagaaagaua

SEQ ID NO: 1152580 - RNA, 19 nt, Homo sapiens
gaguggcucagguuuguaa

SEQ ID NO: 1152581 - RNA, 19 nt, Homo sapiens
guauaagaccaucaaggaa

SEQ ID NO: 1152582 - RNA, 19 nt, Homo sapiens
caagaguggcucagguuug

SEQ ID NO: 1152583 - RNA, 19 nt, Homo sapiens
ugccaaacaugccaacguu

SEQ ID NO: 1152584 - RNA, 19 nt, Homo sapiens
gccuacaacucacugacaa

SEQ ID NO: 1152585 - RNA, 19 nt, Homo sapiens
uaagcaagcggcuggaaau

SEQ ID NO: 1152586 - RNA, 19 nt, Homo sapiens
gggaaucaucuugaaguuu

SEQ ID NO: 1152587 - RNA, 19 nt, Homo sapiens
guacccaccagaccaagaa

SEQ ID NO: 1152588 - RNA, 19 nt, Homo sapiens
aaugaugcguguacauaau

SEQ ID NO: 1152589 - RNA, 19 nt, Homo sapiens
ccaccacucucaaaagaaa

SEQ ID NO: 1152590 - RNA, 19 nt, Homo sapiens
ggagugauucgggaaaguu

SEQ ID NO: 1152591 - RNA, 19 nt, Homo sapiens
gaaagaggcuugggaagaa

SEQ ID NO: 1152592 - RNA, 19 nt, Homo sapiens
ggagaugauugugcuauua

SEQ ID NO: 1152593 - RNA, 19 nt, Homo sapiens
agaagaagcucaacaucua

SEQ ID NO: 1152594 - RNA, 19 nt, Homo sapiens
caaguaagcuauagauugu

SEQ ID NO: 1152595 - RNA, 19 nt, Homo sapiens
gaaaagaaacugcucauua

SEQ ID NO: 1152596 - RNA, 19 nt, Homo sapiens
gaacauccauccggagaaa

SEQ ID NO: 1152597 - RNA, 19 nt, Homo sapiens
gaaccaagacucugaaaga

SEQ ID NO: 1152598 - RNA, 19 nt, Homo sapiens
gaauaucgcugaagaucug

SEQ ID NO: 1152599 - RNA, 19 nt, Homo sapiens
guggaaagauuacagauga

SEQ ID NO: 1152600 - RNA, 19 nt, Homo sapiens
cgaggacagucuugaaaua

SEQ ID NO: 1152601 - RNA, 19 nt, Homo sapiens
gacgcugacuauuguauua

SEQ ID NO: 1152602 - RNA, 19 nt, Homo sapiens
gugcagagcuccaauguac

SEQ ID NO: 1152603 - RNA, 19 nt, Homo sapiens
gaauaaaggacgcugacua

SEQ ID NO: 1152604 - RNA, 19 nt, Homo sapiens
aaacugcucauuacacuua

SEQ ID NO: 1152605 - RNA, 19 nt, Homo sapiens
gaaaacagcagaaaagaaa

SEQ ID NO: 1152606 - RNA, 19 nt, Homo sapiens
uaaaggacgcugacuauug

SEQ ID NO: 1152607 - RNA, 19 nt, Homo sapiens
ccaagacucugaaagacaa

SEQ ID NO: 1152608 - RNA, 19 nt, Homo sapiens
gcaggaacauggcacuuuc

SEQ ID NO: 1152609 - RNA, 19 nt, Homo sapiens
ggagaaaugaagagaauga

SEQ ID NO: 1152610 - RNA, 19 nt, Homo sapiens
ggaaagaggcuugggaaga

SEQ ID NO: 1152611 - RNA, 19 nt, Homo sapiens
guacaagugucggauguga

SEQ ID NO: 1152612 - RNA, 19 nt, Homo sapiens
aaaggacgcugacuauugu

SEQ ID NO: 1152613 - RNA, 19 nt, Homo sapiens
cgccaagacugucggaaua

SEQ ID NO: 1152614 - RNA, 19 nt, Homo sapiens
gcaacgaaaugaaccucuu

SEQ ID NO: 1152615 - RNA, 19 nt, Homo sapiens
gaaaauagaccgcgaacaa

SEQ ID NO: 1152616 - RNA, 19 nt, Homo sapiens
gaaaugaagagaaugaaag

SEQ ID NO: 1152617 - RNA, 19 nt, Homo sapiens
guuccacccuuucacauuu

SEQ ID NO: 1152618 - RNA, 19 nt, Homo sapiens
gaauuacugcuaucaggua

SEQ ID NO: 1152619 - RNA, 19 nt, Homo sapiens
gcgggaagcucuaaaauga

SEQ ID NO: 1152620 - RNA, 19 nt, Homo sapiens
caaccagaauuacugcuau

SEQ ID NO: 1152621 - RNA, 19 nt, Homo sapiens
gcuccaauguacccaguaa

SEQ ID NO: 1152622 - RNA, 19 nt, Homo sapiens
gcaugagcgucuucaccua

SEQ ID NO: 1152623 - RNA, 19 nt, Homo sapiens
guaagucgauccagguaca

SEQ ID NO: 1152624 - RNA, 19 nt, Homo sapiens
ggacuccaaugacaaugug

SEQ ID NO: 1152625 - RNA, 19 nt, Homo sapiens
gaagggagagggaaaugug

SEQ ID NO: 1152626 - RNA, 19 nt, Homo sapiens
gaagaaacucagcaaguca

SEQ ID NO: 1152627 - RNA, 19 nt, Homo sapiens
gcggcgaguuggacuauga

SEQ ID NO: 1152628 - RNA, 19 nt, Homo sapiens
ggagguaagcggcgaguug

SEQ ID NO: 1152629 - RNA, 19 nt, Homo sapiens
ucgaggugcuggacauuaa

SEQ ID NO: 1152630 - RNA, 19 nt, Homo sapiens
gaucugggucuggacauua

SEQ ID NO: 1152631 - RNA, 19 nt, Homo sapiens
ggagggacuuacuuucuag

SEQ ID NO: 1152632 - RNA, 19 nt, Homo sapiens
gagaagaagcucaacaucu

SEQ ID NO: 1152633 - RNA, 19 nt, Homo sapiens
uaacgccacugucaacauc

SEQ ID NO: 1152634 - RNA, 19 nt, Homo sapiens
ccaagacugucggaauaaa

SEQ ID NO: 1152635 - RNA, 19 nt, Homo sapiens
acaaguaagcuauagauug

SEQ ID NO: 1152636 - RNA, 19 nt, Homo sapiens
gaagaagcucaacaucuau

SEQ ID NO: 1152637 - RNA, 19 nt, Homo sapiens
gaagggaaacugcgugaag

SEQ ID NO: 1152638 - RNA, 19 nt, Homo sapiens
gcaagaagaaacucagcaa

SEQ ID NO: 1152639 - RNA, 19 nt, Homo sapiens
ccucaagucuuccuuuaag

SEQ ID NO: 1152640 - RNA, 19 nt, Homo sapiens
gcucuaaaaugaagcaaaa

SEQ ID NO: 1152641 - RNA, 19 nt, Homo sapiens
uaucgaaauuuccucuuug

SEQ ID NO: 1152642 - RNA, 19 nt, Homo sapiens
ggacagucuugaaauaucg

SEQ ID NO: 1152643 - RNA, 19 nt, Homo sapiens
gcaaguaacgguggagaug

SEQ ID NO: 1152644 - RNA, 19 nt, Homo sapiens
ucaguaaccugggcaugaa

SEQ ID NO: 1152645 - RNA, 19 nt, Homo sapiens
ucaccuacguuucuaucaa

SEQ ID NO: 1152646 - RNA, 19 nt, Homo sapiens
gcgaacaaaucugcaaaca

SEQ ID NO: 1152647 - RNA, 19 nt, Homo sapiens
gaccugauguuucuuaagc

SEQ ID NO: 1152648 - RNA, 19 nt, Homo sapiens
caacgaaaugaaccucuuu

SEQ ID NO: 1152649 - RNA, 19 nt, Homo sapiens
gaugguggaaggagucuuu

SEQ ID NO: 1152650 - RNA, 19 nt, Homo sapiens
ccggagaaaugaagagaau

SEQ ID NO: 1152651 - RNA, 19 nt, Homo sapiens
ggaccaccaucucucaucu

SEQ ID NO: 1152652 - RNA, 19 nt, Homo sapiens
agaagaaacucagcaaguc

SEQ ID NO: 1152653 - RNA, 19 nt, Homo sapiens
gcacggcccuacucaccau

SEQ ID NO: 1152654 - RNA, 19 nt, Homo sapiens
gagaugauugugcuauuau

SEQ ID NO: 1152655 - RNA, 19 nt, Homo sapiens
gaaggaaggacuggaagga

SEQ ID NO: 1152656 - RNA, 19 nt, Homo sapiens
guacaaguaagcuauagau

SEQ ID NO: 1152657 - RNA, 19 nt, Homo sapiens
cgccucaagucuuccuuua

SEQ ID NO: 1152658 - RNA, 19 nt, Homo sapiens
ugaaggaagcggugaguga

SEQ ID NO: 1152659 - RNA, 19 nt, Homo sapiens
aggaaggacuggaaggaaa

SEQ ID NO: 1152660 - RNA, 19 nt, Homo sapiens
cuuaugagcuggugaucga

SEQ ID NO: 1152661 - RNA, 19 nt, Homo sapiens
gaagaaaacagcagaaaag

SEQ ID NO: 1152662 - RNA, 19 nt, Homo sapiens
gaugauugugcuauuauug

SEQ ID NO: 1152663 - RNA, 19 nt, Homo sapiens
gcugacuauuguauuauug

SEQ ID NO: 1152664 - RNA, 19 nt, Homo sapiens
ggauauuagcuuaugugua

SEQ ID NO: 1152665 - RNA, 19 nt, Homo sapiens
caagaccgaccugauguuu

SEQ ID NO: 1152666 - RNA, 19 nt, Homo sapiens
gaggacagucuugaaauau

SEQ ID NO: 1152667 - RNA, 19 nt, Homo sapiens
aggagggacuuacuuucua

SEQ ID NO: 1152668 - RNA, 19 nt, Homo sapiens
guacggacacugagcacaa

SEQ ID NO: 1152669 - RNA, 19 nt, Homo sapiens
gagacagguuagagggaaa

SEQ ID NO: 1152670 - RNA, 19 nt, Homo sapiens
ugccagccguugacauuaa

SEQ ID NO: 1152671 - RNA, 19 nt, Homo sapiens
ucucucaucuccuccauca

SEQ ID NO: 1152672 - RNA, 19 nt, Homo sapiens
agaccgaccugauguuucu

SEQ ID NO: 1152673 - RNA, 19 nt, Homo sapiens
gagggaaccaagacucuga

SEQ ID NO: 1152674 - RNA, 19 nt, Homo sapiens
aaauagagcgaaagaggaa

SEQ ID NO: 1152675 - RNA, 19 nt, Homo sapiens
ggacgcugacuauuguauu

SEQ ID NO: 1152676 - RNA, 19 nt, Homo sapiens
uuagucgcguguacaagua

SEQ ID NO: 1152677 - RNA, 19 nt, Homo sapiens
gcucuuccauccugucagu

SEQ ID NO: 1152678 - RNA, 19 nt, Homo sapiens
gggccaucgucaccgguua

SEQ ID NO: 1152679 - RNA, 19 nt, Homo sapiens
gaggaaggaaggacuggaa

SEQ ID NO: 1152680 - RNA, 19 nt, Homo sapiens
aaaagaaacugcucauuac

SEQ ID NO: 1152681 - RNA, 19 nt, Homo sapiens
aauaaaggacgcugacuau

SEQ ID NO: 1152682 - RNA, 19 nt, Homo sapiens
ccagcagccugauaucauc

SEQ ID NO: 1152683 - RNA, 19 nt, Homo sapiens
gauuacagaugaggaaagg

SEQ ID NO: 1152684 - RNA, 19 nt, Homo sapiens
gaggagggacuuacuuucu

SEQ ID NO: 1152685 - RNA, 19 nt, Homo sapiens
ggacagagggaaccaagac

SEQ ID NO: 1152686 - RNA, 19 nt, Homo sapiens
gaauuacuacaccaucguu

SEQ ID NO: 1152687 - RNA, 19 nt, Homo sapiens
gcacugugguggcccuuuu

SEQ ID NO: 1152688 - RNA, 19 nt, Homo sapiens
aaagaggcuugggaagaaa

SEQ ID NO: 1152689 - RNA, 19 nt, Homo sapiens
cagcaagucagacaucaug

SEQ ID NO: 1152690 - RNA, 19 nt, Homo sapiens
ugacaacgcgccagagauc

SEQ ID NO: 1152691 - RNA, 19 nt, Homo sapiens
gaaagaggcuugggaagaa

SEQ ID NO: 1152692 - RNA, 19 nt, Homo sapiens
ggagaugauugugcuauua

SEQ ID NO: 1152693 - RNA, 19 nt, Homo sapiens
ucaaagacauucuguaguu

SEQ ID NO: 1152694 - RNA, 19 nt, Homo sapiens
agaagaagcucaacaucua

SEQ ID NO: 1152695 - RNA, 19 nt, Homo sapiens
gaaaagaaacugcucauua

SEQ ID NO: 1152696 - RNA, 19 nt, Homo sapiens
caucugaacugguaaagaa

SEQ ID NO: 1152697 - RNA, 19 nt, Homo sapiens
gcauaagucugauucuauu

SEQ ID NO: 1152698 - RNA, 19 nt, Homo sapiens
gcagaacuguagaaacuuu

SEQ ID NO: 1152699 - RNA, 19 nt, Homo sapiens
gaacauccauccggagaaa

SEQ ID NO: 1152700 - RNA, 19 nt, Homo sapiens
agaaacaucugaacuggua

SEQ ID NO: 1152701 - RNA, 19 nt, Homo sapiens
gaaccaagacucugaaaga

SEQ ID NO: 1152702 - RNA, 19 nt, Homo sapiens
gaauaucgcugaagaucug

SEQ ID NO: 1152703 - RNA, 19 nt, Homo sapiens
ccaaagauguagcuauuga

SEQ ID NO: 1152704 - RNA, 19 nt, Homo sapiens
guggaaagauuacagauga

SEQ ID NO: 1152705 - RNA, 19 nt, Homo sapiens
cgaggacagucuugaaaua

SEQ ID NO: 1152706 - RNA, 19 nt, Homo sapiens
ccaggaagccgacauagua

SEQ ID NO: 1152707 - RNA, 19 nt, Homo sapiens
gcucuaagcuacaaaauuu

SEQ ID NO: 1152708 - RNA, 19 nt, Homo sapiens
gcacaaagucgaccaacaa

SEQ ID NO: 1152709 - RNA, 19 nt, Homo sapiens
gacgcugacuauuguauua

SEQ ID NO: 1152710 - RNA, 19 nt, Homo sapiens
acagagcacugacuaugua

SEQ ID NO: 1152711 - RNA, 19 nt, Homo sapiens
gugcagagcuccaauguac

SEQ ID NO: 1152712 - RNA, 19 nt, Homo sapiens
gaauaaaggacgcugacua

SEQ ID NO: 1152713 - RNA, 19 nt, Homo sapiens
aaacugcucauuacacuua

SEQ ID NO: 1152714 - RNA, 19 nt, Homo sapiens
uaagaagucaucagucaua

SEQ ID NO: 1152715 - RNA, 19 nt, Homo sapiens
gaagucaucagucauauca

SEQ ID NO: 1152716 - RNA, 19 nt, Homo sapiens
gaaaacagcagaaaagaaa

SEQ ID NO: 1152717 - RNA, 19 nt, Homo sapiens
uguagucaguguuugauua

SEQ ID NO: 1152718 - RNA, 19 nt, Homo sapiens
caaaguguuuacuguacua

SEQ ID NO: 1152719 - RNA, 19 nt, Homo sapiens
uaaaggacgcugacuauug

SEQ ID NO: 1152720 - RNA, 19 nt, Homo sapiens
ccaagacucugaaagacaa

SEQ ID NO: 1152721 - RNA, 19 nt, Homo sapiens
caaagacauucuguaguuu

SEQ ID NO: 1152722 - RNA, 19 nt, Homo sapiens
gcaagcuauuccaacuuua

SEQ ID NO: 1152723 - RNA, 19 nt, Homo sapiens
gcaggaacauggcacuuuc

SEQ ID NO: 1152724 - RNA, 19 nt, Homo sapiens
ggaaagaggcuugggaaga

SEQ ID NO: 1152725 - RNA, 19 nt, Homo sapiens
ggagaaaugaagagaauga

SEQ ID NO: 1152726 - RNA, 19 nt, Homo sapiens
gcauacaguccacaucaua

SEQ ID NO: 1152727 - RNA, 19 nt, Homo sapiens
cagcaggccugagaaauga

SEQ ID NO: 1152728 - RNA, 19 nt, Homo sapiens
guacaagugucggauguga

SEQ ID NO: 1152729 - RNA, 19 nt, Homo sapiens
aaaggacgcugacuauugu

SEQ ID NO: 1152730 - RNA, 19 nt, Homo sapiens
gugcagaacuguagaaacu

SEQ ID NO: 1152731 - RNA, 19 nt, Homo sapiens
cgccaagacugucggaaua

SEQ ID NO: 1152732 - RNA, 19 nt, Homo sapiens
gaaucaugguacauuauug

SEQ ID NO: 1152733 - RNA, 19 nt, Homo sapiens
caaacuaucuaacaaucug

SEQ ID NO: 1152734 - RNA, 19 nt, Homo sapiens
gauggacugcugacuaaua

SEQ ID NO: 1152735 - RNA, 19 nt, Homo sapiens
gcaacgaaaugaaccucuu

SEQ ID NO: 1152736 - RNA, 19 nt, Homo sapiens
gaaaauagaccgcgaacaa

SEQ ID NO: 1152737 - RNA, 19 nt, Homo sapiens
gaaaugaagagaaugaaag

SEQ ID NO: 1152738 - RNA, 19 nt, Homo sapiens
ccaaagacaaacuuacuaa

SEQ ID NO: 1152739 - RNA, 19 nt, Homo sapiens
gaaaugugcagaacuguag

SEQ ID NO: 1152740 - RNA, 19 nt, Homo sapiens
gaauuacugcuaucaggua

SEQ ID NO: 1152741 - RNA, 19 nt, Homo sapiens
gcgggaagcucuaaaauga

SEQ ID NO: 1152742 - RNA, 19 nt, Homo sapiens
ucaccuguauuuguuguua

SEQ ID NO: 1152743 - RNA, 19 nt, Homo sapiens
ucauaucacucacacagaa

SEQ ID NO: 1152744 - RNA, 19 nt, Homo sapiens
uaucuuggccauccaguua

SEQ ID NO: 1152745 - RNA, 19 nt, Homo sapiens
caaccagaauuacugcuau

SEQ ID NO: 1152746 - RNA, 19 nt, Homo sapiens
gcuccaauguacccaguaa

SEQ ID NO: 1152747 - RNA, 19 nt, Homo sapiens
uggauggacugcugacuaa

SEQ ID NO: 1152748 - RNA, 19 nt, Homo sapiens
gauagaaucaugguacauu

SEQ ID NO: 1152749 - RNA, 19 nt, Homo sapiens
cuaacaaucugcauaaguc

SEQ ID NO: 1152750 - RNA, 19 nt, Homo sapiens
gaagccagucauaaagaua

SEQ ID NO: 1152751 - RNA, 19 nt, Homo sapiens
uuaaauggaugcauacagu

SEQ ID NO: 1152752 - RNA, 19 nt, Homo sapiens
gagucaucauggccaauua

SEQ ID NO: 1152753 - RNA, 19 nt, Homo sapiens
ggugcuggaugccuucuuu

SEQ ID NO: 1152754 - RNA, 19 nt, Homo sapiens
gcaugagcgucuucaccua

SEQ ID NO: 1152755 - RNA, 19 nt, Homo sapiens
guaagucgauccagguaca

SEQ ID NO: 1152756 - RNA, 19 nt, Homo sapiens
ggacuccaaugacaaugug

SEQ ID NO: 1152757 - RNA, 19 nt, Homo sapiens
agauguagcuauugauguu

SEQ ID NO: 1152758 - RNA, 19 nt, Homo sapiens
ugccaaagauguagcuauu

SEQ ID NO: 1152759 - RNA, 19 nt, Homo sapiens
agaaaugaguugaaaugug

SEQ ID NO: 1152760 - RNA, 19 nt, Homo sapiens
gaagaaacucagcaaguca

SEQ ID NO: 1152761 - RNA, 19 nt, Homo sapiens
gcggcgaguuggacuauga

SEQ ID NO: 1152762 - RNA, 19 nt, Homo sapiens
gagauagaaucaugguaca

SEQ ID NO: 1152763 - RNA, 19 nt, Homo sapiens
cgcaagcuauuccaacuuu

SEQ ID NO: 1152764 - RNA, 19 nt, Homo sapiens
gagaagccagucauaaaga

SEQ ID NO: 1152765 - RNA, 19 nt, Homo sapiens
gaacagggagauagugauc

SEQ ID NO: 1152766 - RNA, 19 nt, Homo sapiens
ggagguaagcggcgaguug

SEQ ID NO: 1152767 - RNA, 19 nt, Homo sapiens
ucgaggugcuggacauuaa

SEQ ID NO: 1152768 - RNA, 19 nt, Homo sapiens
gaucugggucuggacauua

SEQ ID NO: 1152769 - RNA, 19 nt, Homo sapiens
gagaagaagcucaacaucu

SEQ ID NO: 1152770 - RNA, 19 nt, Homo sapiens
uaacgccacugucaacauc

SEQ ID NO: 1152771 - RNA, 19 nt, Homo sapiens
ccaagacugucggaauaaa

SEQ ID NO: 1152772 - RNA, 19 nt, Homo sapiens
caugguacauuauuguuuc

SEQ ID NO: 1152773 - RNA, 19 nt, Homo sapiens
gagcacugacuauguacua

SEQ ID NO: 1152774 - RNA, 19 nt, Homo sapiens
gaagaagcucaacaucuau

SEQ ID NO: 1152775 - RNA, 19 nt, Homo sapiens
caauugcacugaggaaugu

SEQ ID NO: 1152776 - RNA, 19 nt, Homo sapiens
gcaagaagaaacucagcaa

SEQ ID NO: 1152777 - RNA, 19 nt, Homo sapiens
ccucaagucuuccuuuaag

SEQ ID NO: 1152778 - RNA, 19 nt, Homo sapiens
gcucuaaaaugaagcaaaa

SEQ ID NO: 1152779 - RNA, 19 nt, Homo sapiens
uaucgaaauuuccucuuug

SEQ ID NO: 1152780 - RNA, 19 nt, Homo sapiens
ggacagucuugaaauaucg

SEQ ID NO: 1152781 - RNA, 19 nt, Homo sapiens
uagcuuaaauguagucagu

SEQ ID NO: 1152782 - RNA, 19 nt, Homo sapiens
uuacagcacuaucuaucuu

SEQ ID NO: 1152783 - RNA, 19 nt, Homo sapiens
guugaaaugugcagaacug

SEQ ID NO: 1152784 - RNA, 19 nt, Homo sapiens
ucaccuacguuucuaucaa

SEQ ID NO: 1152785 - RNA, 19 nt, Homo sapiens
gcgaacaaaucugcaaaca

SEQ ID NO: 1152786 - RNA, 19 nt, Homo sapiens
gcaaguaacgguggagaug

SEQ ID NO: 1152787 - RNA, 19 nt, Homo sapiens
aaguuaagcuugccuuuua

SEQ ID NO: 1152788 - RNA, 19 nt, Homo sapiens
guagucaguguuugauuaa

SEQ ID NO: 1152789 - RNA, 19 nt, Homo sapiens
gcaaaguguuuacuguacu

SEQ ID NO: 1152790 - RNA, 19 nt, Homo sapiens
ccugagaaaugaguugaaa

SEQ ID NO: 1152791 - RNA, 19 nt, Homo sapiens
gguaauaacucuaucauga

SEQ ID NO: 1152792 - RNA, 19 nt, Homo sapiens
ggagaaagccucagaguuu

SEQ ID NO: 1152793 - RNA, 19 nt, Homo sapiens
ggaagaaggugaugcuaaa

SEQ ID NO: 1152794 - RNA, 19 nt, Homo sapiens
gagaucgucuguucaaaua

SEQ ID NO: 1152795 - RNA, 19 nt, Homo sapiens
gaaagggucuugcuaagga

SEQ ID NO: 1152796 - RNA, 19 nt, Homo sapiens
gaacgaaugagccagauua

SEQ ID NO: 1152797 - RNA, 19 nt, Homo sapiens
gaucgucuguucaaauaua

SEQ ID NO: 1152798 - RNA, 19 nt, Homo sapiens
gaaaacaucugagcaaaua

SEQ ID NO: 1152799 - RNA, 19 nt, Homo sapiens
gaagguaguugaaauucuu

SEQ ID NO: 1152800 - RNA, 19 nt, Homo sapiens
ccacacacauacauacaua

SEQ ID NO: 1152801 - RNA, 19 nt, Homo sapiens
ugaaagaacuugagaagca

SEQ ID NO: 1152802 - RNA, 19 nt, Homo sapiens
gaaggcagaccauguauga

SEQ ID NO: 1152803 - RNA, 19 nt, Homo sapiens
gaaggaaaccaaagcaauu

SEQ ID NO: 1152804 - RNA, 19 nt, Homo sapiens
gaagguaccacgagcuaua

SEQ ID NO: 1152805 - RNA, 19 nt, Homo sapiens
caaagaacauuaugaaagg

SEQ ID NO: 1152806 - RNA, 19 nt, Homo sapiens
ggaaacgguucacaaggaa

SEQ ID NO: 1152807 - RNA, 19 nt, Homo sapiens
ggcccaggcugaucaauuu

SEQ ID NO: 1152808 - RNA, 19 nt, Homo sapiens
agaagugacucccgaaauu

SEQ ID NO: 1152809 - RNA, 19 nt, Homo sapiens
gaaaguaccaccguucaaa

SEQ ID NO: 1152810 - RNA, 19 nt, Homo sapiens
ugacugagccugugaagaa

SEQ ID NO: 1152811 - RNA, 19 nt, Homo sapiens
gagaagcagaagagaauua

SEQ ID NO: 1152812 - RNA, 19 nt, Homo sapiens
gcaaauagaggaucaugau

SEQ ID NO: 1152813 - RNA, 19 nt, Homo sapiens
gagaaagccucagaguuug

SEQ ID NO: 1152814 - RNA, 19 nt, Homo sapiens
gaagagaagagacugaaga

SEQ ID NO: 1152815 - RNA, 19 nt, Homo sapiens
caaaggaacauucuagaga

SEQ ID NO: 1152816 - RNA, 19 nt, Homo sapiens
gaugugaccuuaaugaaac

SEQ ID NO: 1152817 - RNA, 19 nt, Homo sapiens
guaggaagguaguugaaau

SEQ ID NO: 1152818 - RNA, 19 nt, Homo sapiens
aggcacagcuugaaagaaa

SEQ ID NO: 1152819 - RNA, 19 nt, Homo sapiens
gagaggagacgcacuguga

SEQ ID NO: 1152820 - RNA, 19 nt, Homo sapiens
gcagaaggauccucgucuu

SEQ ID NO: 1152821 - RNA, 19 nt, Homo sapiens
guggaacacuggauaaaga

SEQ ID NO: 1152822 - RNA, 19 nt, Homo sapiens
gagaauuaccugcuagaaa

SEQ ID NO: 1152823 - RNA, 19 nt, Homo sapiens
gaaagucuggcuagaaaga

SEQ ID NO: 1152824 - RNA, 19 nt, Homo sapiens
gagcaugccuuagcaguca

SEQ ID NO: 1152825 - RNA, 19 nt, Homo sapiens
cgacacugcuuuacagaau

SEQ ID NO: 1152826 - RNA, 19 nt, Homo sapiens
gaugagacauaagcaggua

SEQ ID NO: 1152827 - RNA, 19 nt, Homo sapiens
acaccaaacuuaagcaaga

SEQ ID NO: 1152828 - RNA, 19 nt, Homo sapiens
agaaagaacuggaguacca

SEQ ID NO: 1152829 - RNA, 19 nt, Homo sapiens
ccauggagaugagacauaa

SEQ ID NO: 1152830 - RNA, 19 nt, Homo sapiens
gaugauuacucuuauuugg

SEQ ID NO: 1152831 - RNA, 19 nt, Homo sapiens
ggacauggaagaaguuugu

SEQ ID NO: 1152832 - RNA, 19 nt, Homo sapiens
guacucagcucaguuugau

SEQ ID NO: 1152833 - RNA, 19 nt, Homo sapiens
cgacaggaguugcugaugu

SEQ ID NO: 1152834 - RNA, 19 nt, Homo sapiens
aaacaauucucgagcugaa

SEQ ID NO: 1152835 - RNA, 19 nt, Homo sapiens
cucaggagcuggucaauga

SEQ ID NO: 1152836 - RNA, 19 nt, Homo sapiens
cgaaugagccagauuagug

SEQ ID NO: 1152837 - RNA, 19 nt, Homo sapiens
gaagagagagcaauucaac

SEQ ID NO: 1152838 - RNA, 19 nt, Homo sapiens
gccagaugcuugugaauuc

SEQ ID NO: 1152839 - RNA, 19 nt, Homo sapiens
ucaaaguacucacauucuu

SEQ ID NO: 1152840 - RNA, 19 nt, Homo sapiens
uagaccaucugcuccauaa

SEQ ID NO: 1152841 - RNA, 19 nt, Homo sapiens
acauacaccugguuuauuc

SEQ ID NO: 1152842 - RNA, 19 nt, Homo sapiens
gaaaggcgacagcaacuuc

SEQ ID NO: 1152843 - RNA, 19 nt, Homo sapiens
ugauugaucugcaggaaga

SEQ ID NO: 1152844 - RNA, 19 nt, Homo sapiens
ccaaagaacauuaugaaag

SEQ ID NO: 1152845 - RNA, 19 nt, Homo sapiens
gcaauaagcagcacaagac

SEQ ID NO: 1152846 - RNA, 19 nt, Homo sapiens
gaaagcagcauggaaaaua

SEQ ID NO: 1152847 - RNA, 19 nt, Homo sapiens
ugauuuauguggcuauuug

SEQ ID NO: 1152848 - RNA, 19 nt, Homo sapiens
aaaaugcucucuucuauga

SEQ ID NO: 1152849 - RNA, 19 nt, Homo sapiens
gucauucacuauagcauuu

SEQ ID NO: 1152850 - RNA, 19 nt, Homo sapiens
acaggaagcucgacuaguc

SEQ ID NO: 1152851 - RNA, 19 nt, Homo sapiens
gaaagaggaagaggagauu

SEQ ID NO: 1152852 - RNA, 19 nt, Homo sapiens
gguagauucugcaaugaug

SEQ ID NO: 1152853 - RNA, 19 nt, Homo sapiens
gacagcagcuuauccugau

SEQ ID NO: 1152854 - RNA, 19 nt, Homo sapiens
ucagauacuugguccuuga

SEQ ID NO: 1152855 - RNA, 19 nt, Homo sapiens
aggaaagucuggcuagaaa

SEQ ID NO: 1152856 - RNA, 19 nt, Homo sapiens
acacaagauuccagaaguu

SEQ ID NO: 1152857 - RNA, 19 nt, Homo sapiens
gaugaaaucuaugcagaag

SEQ ID NO: 1152858 - RNA, 19 nt, Homo sapiens
agaagagaauuaagaggaa

SEQ ID NO: 1152859 - RNA, 19 nt, Homo sapiens
ggagagacuacacaagauu

SEQ ID NO: 1152860 - RNA, 19 nt, Homo sapiens
guuagagaauuaccugcua

SEQ ID NO: 1152861 - RNA, 19 nt, Homo sapiens
acacucaguuugucuucua

SEQ ID NO: 1152862 - RNA, 19 nt, Homo sapiens
caccagaccucguccacuu

SEQ ID NO: 1152863 - RNA, 19 nt, Homo sapiens
aaaggaacauucuagagau

SEQ ID NO: 1152864 - RNA, 19 nt, Homo sapiens
ggaagguaguugaaauucu

SEQ ID NO: 1152865 - RNA, 19 nt, Homo sapiens
gagaagagacugaagaaaa

SEQ ID NO: 1152866 - RNA, 19 nt, Homo sapiens
guccagcaauucauuaaau

SEQ ID NO: 1152867 - RNA, 19 nt, Homo sapiens
gacaggaguugcugaugug

SEQ ID NO: 1152868 - RNA, 19 nt, Homo sapiens
uaugaaagaggaaagagua

SEQ ID NO: 1152869 - RNA, 19 nt, Homo sapiens
uggaagagauugagaaugc

SEQ ID NO: 1152870 - RNA, 19 nt, Homo sapiens
gggaagcagugguuguaug

SEQ ID NO: 1152871 - RNA, 19 nt, Homo sapiens
ccugagaugauuacucuua

SEQ ID NO: 1152872 - RNA, 19 nt, Homo sapiens
agaauuaccugcuagaaaa

SEQ ID NO: 1152873 - RNA, 19 nt, Homo sapiens
aacaacaacuggccacuga

SEQ ID NO: 1152874 - RNA, 19 nt, Homo sapiens
caaagaaaaucaacagugu

SEQ ID NO: 1152875 - RNA, 19 nt, Homo sapiens
cagaaggauccucgucuua

SEQ ID NO: 1152876 - RNA, 19 nt, Homo sapiens
uggaagaucuuggaaggaa

SEQ ID NO: 1152877 - RNA, 19 nt, Homo sapiens
gaauaauacacucaguuug

SEQ ID NO: 1152878 - RNA, 19 nt, Homo sapiens
gacagcaacuucguaggaa

SEQ ID NO: 1152879 - RNA, 19 nt, Homo sapiens
caauagccaaagaacauua

SEQ ID NO: 1152880 - RNA, 19 nt, Homo sapiens
uggaaacgguucacaagga

SEQ ID NO: 1152881 - RNA, 19 nt, Homo sapiens
gcaugaaggacauuccaaa

SEQ ID NO: 1152882 - RNA, 19 nt, Homo sapiens
gaaaccaaagcaauugaug

SEQ ID NO: 1152883 - RNA, 19 nt, Homo sapiens
gcagaggacagcagcuuau

SEQ ID NO: 1152884 - RNA, 19 nt, Homo sapiens
agcaacagcugauugagaa

SEQ ID NO: 1152885 - RNA, 19 nt, Homo sapiens
ggauaaagagaguggagaa

SEQ ID NO: 1152886 - RNA, 19 nt, Homo sapiens
gguuagacaccaaacuuaa

SEQ ID NO: 1152887 - RNA, 19 nt, Homo sapiens
gaaaagggaggcagaagaa

SEQ ID NO: 1152888 - RNA, 19 nt, Homo sapiens
ggacucagaaggaaaccaa

SEQ ID NO: 1152889 - RNA, 19 nt, Homo sapiens
gaacaacaacaggcaacuu

SEQ ID NO: 1152890 - RNA, 19 nt, Homo sapiens
gaguauaaccggaaacaag

SEQ ID NO: 1152891 - RNA, 19 nt, Homo sapiens
gaagguaaguguaaucuaa

SEQ ID NO: 1152892 - RNA, 19 nt, Homo sapiens
aaacaaagauuccgugauu

SEQ ID NO: 1152893 - RNA, 19 nt, Homo sapiens
gaagacaacuugguuaaau

SEQ ID NO: 1152894 - RNA, 19 nt, Homo sapiens
gguuguagcuucaucauug

SEQ ID NO: 1152895 - RNA, 19 nt, Homo sapiens
ggaaauggauguagaagcu

SEQ ID NO: 1152896 - RNA, 19 nt, Homo sapiens
gaagaaacccuugaggaaa

SEQ ID NO: 1152897 - RNA, 19 nt, Homo sapiens
gaacuggcagaacuuauaa

SEQ ID NO: 1152898 - RNA, 19 nt, Homo sapiens
uugcacagcuacuucauua

SEQ ID NO: 1152899 - RNA, 19 nt, Homo sapiens
gaucucaauucauuaccua

SEQ ID NO: 1152900 - RNA, 19 nt, Homo sapiens
gcacuacaccagccacuaa

SEQ ID NO: 1152901 - RNA, 19 nt, Homo sapiens
cugaaugccuugcaacuaa

SEQ ID NO: 1152902 - RNA, 19 nt, Homo sapiens
cacaagagcaccauacuuu

SEQ ID NO: 1152903 - RNA, 19 nt, Homo sapiens
acaugcagcuccuauauga

SEQ ID NO: 1152904 - RNA, 19 nt, Homo sapiens
gagaagcugccauugcaua

SEQ ID NO: 1152905 - RNA, 19 nt, Homo sapiens
ggauaaauaugagacugaa

SEQ ID NO: 1152906 - RNA, 19 nt, Homo sapiens
acacgaagaacuaagaaua

SEQ ID NO: 1152907 - RNA, 19 nt, Homo sapiens
gcuauuggaugaaagaaag

SEQ ID NO: 1152908 - RNA, 19 nt, Homo sapiens
aguagaagcuaguuuguug

SEQ ID NO: 1152909 - RNA, 19 nt, Homo sapiens
caacaugcagcuccuauau

SEQ ID NO: 1152910 - RNA, 19 nt, Homo sapiens
cauugaagcugcacuuuag

SEQ ID NO: 1152911 - RNA, 19 nt, Homo sapiens
caagagcaccauacuuuga

SEQ ID NO: 1152912 - RNA, 19 nt, Homo sapiens
gagauuccuucuugucaga

SEQ ID NO: 1152913 - RNA, 19 nt, Homo sapiens
auaaguagccgaacauuga

SEQ ID NO: 1152914 - RNA, 19 nt, Homo sapiens
caacuuugcucacuuuuga

SEQ ID NO: 1152915 - RNA, 19 nt, Homo sapiens
agacaaccaucuagaggaa

SEQ ID NO: 1152916 - RNA, 19 nt, Homo sapiens
ugaagaaacccuugaggaa

SEQ ID NO: 1152917 - RNA, 19 nt, Homo sapiens
gcacagcuacuucauuaca

SEQ ID NO: 1152918 - RNA, 19 nt, Homo sapiens
gagauuauucggcagauga

SEQ ID NO: 1152919 - RNA, 19 nt, Homo sapiens
aagaaacccuugaggaaau

SEQ ID NO: 1152920 - RNA, 19 nt, Homo sapiens
ugaacuggcagaacuuaua

SEQ ID NO: 1152921 - RNA, 19 nt, Homo sapiens
gauguagaagcucgacuua

SEQ ID NO: 1152922 - RNA, 19 nt, Homo sapiens
gaaagacaaccaucuagag

SEQ ID NO: 1152923 - RNA, 19 nt, Homo sapiens
aaacaguuaucaccagaug

SEQ ID NO: 1152924 - RNA, 19 nt, Homo sapiens
gaugugcaccgcuaucaaa

SEQ ID NO: 1152925 - RNA, 19 nt, Homo sapiens
gacaguuucuggaaguuau

SEQ ID NO: 1152926 - RNA, 19 nt, Homo sapiens
ggacaguuucuggaaguua

SEQ ID NO: 1152927 - RNA, 19 nt, Homo sapiens
gaacauugaagcugcacuu

SEQ ID NO: 1152928 - RNA, 19 nt, Homo sapiens
cuucacagauggagauuau

SEQ ID NO: 1152929 - RNA, 19 nt, Homo sapiens
caacagguaugacuuuagc

SEQ ID NO: 1152930 - RNA, 19 nt, Homo sapiens
auggagaucucaauucauu

SEQ ID NO: 1152931 - RNA, 19 nt, Homo sapiens
gcagacuccuuccuacauc

SEQ ID NO: 1152932 - RNA, 19 nt, Homo sapiens
aguguggucuuugguauua

SEQ ID NO: 1152933 - RNA, 19 nt, Homo sapiens
gaaaagcagcuaacaaaau

SEQ ID NO: 1152934 - RNA, 19 nt, Homo sapiens
gcacaagagcaccauacuu

SEQ ID NO: 1152935 - RNA, 19 nt, Homo sapiens
aaauagagaauccugauga

SEQ ID NO: 1152936 - RNA, 19 nt, Homo sapiens
uagaggaaauggauguaga

SEQ ID NO: 1152937 - RNA, 19 nt, Homo sapiens
aagagaagcugccauugca

SEQ ID NO: 1152938 - RNA, 19 nt, Homo sapiens
gaaaacagcuacgaacaca

SEQ ID NO: 1152939 - RNA, 19 nt, Homo sapiens
ccagaugguuguagcuuca

SEQ ID NO: 1152940 - RNA, 19 nt, Homo sapiens
ccaaaguuaagguuacuaa

SEQ ID NO: 1152941 - RNA, 19 nt, Homo sapiens
aggaaagaaugaagaauca

SEQ ID NO: 1152942 - RNA, 19 nt, Homo sapiens
gaugaacuggcagaacuua

SEQ ID NO: 1152943 - RNA, 19 nt, Homo sapiens
cuacaccagccacuaauaa

SEQ ID NO: 1152944 - RNA, 19 nt, Homo sapiens
gagaucagaguccaguaaa

SEQ ID NO: 1152945 - RNA, 19 nt, Homo sapiens
gaacacagaaagacaacca

SEQ ID NO: 1152946 - RNA, 19 nt, Homo sapiens
uuauaacgcuacacgaaga

SEQ ID NO: 1152947 - RNA, 19 nt, Homo sapiens
uuacugaacuaugugaaga

SEQ ID NO: 1152948 - RNA, 19 nt, Homo sapiens
gugaagacaacuugguuaa

SEQ ID NO: 1152949 - RNA, 19 nt, Homo sapiens
auagaggccuucaucauca

SEQ ID NO: 1152950 - RNA, 19 nt, Homo sapiens
uguagaagcucgacuuacu

SEQ ID NO: 1152951 - RNA, 19 nt, Homo sapiens
aaacagcuacgaacacaga

SEQ ID NO: 1152952 - RNA, 19 nt, Homo sapiens
ucaagggauugcacagcua

SEQ ID NO: 1152953 - RNA, 19 nt, Homo sapiens
gaaugccuugcaacuaaua

SEQ ID NO: 1152954 - RNA, 19 nt, Homo sapiens
ucccuaauguggaauaguu

SEQ ID NO: 1152955 - RNA, 19 nt, Homo sapiens
gaauguagugaauuagaug

SEQ ID NO: 1152956 - RNA, 19 nt, Homo sapiens
ccuauugaauguagugaau

SEQ ID NO: 1152957 - RNA, 19 nt, Homo sapiens
gcucagagucaucuacaga

SEQ ID NO: 1152958 - RNA, 19 nt, Homo sapiens
ggcagaacuuauaaauaug

SEQ ID NO: 1152959 - RNA, 19 nt, Homo sapiens
aauagagaauccugaugaa

SEQ ID NO: 1152960 - RNA, 19 nt, Homo sapiens
acagaaagacaaccaucua

SEQ ID NO: 1152961 - RNA, 19 nt, Homo sapiens
ucacagauggagauuauuc

SEQ ID NO: 1152962 - RNA, 19 nt, Homo sapiens
cuuccacccuuaccuauug

SEQ ID NO: 1152963 - RNA, 19 nt, Homo sapiens
gaaaugcaccagcacaaaa

SEQ ID NO: 1152964 - RNA, 19 nt, Homo sapiens
uaucuuaccaguucuacaa

SEQ ID NO: 1152965 - RNA, 19 nt, Homo sapiens
gaugaaagaaagauugaag

SEQ ID NO: 1152966 - RNA, 19 nt, Homo sapiens
cagaguagaagcuaguuug

SEQ ID NO: 1152967 - RNA, 19 nt, Homo sapiens
ccagauucaugcuucuaug

SEQ ID NO: 1152968 - RNA, 19 nt, Homo sapiens
cauagaggccuucaucauc

SEQ ID NO: 1152969 - RNA, 19 nt, Homo sapiens
guucuacaauguggauuug

SEQ ID NO: 1152970 - RNA, 19 nt, Homo sapiens
aaaagcagcuaacaaaauc

SEQ ID NO: 1152971 - RNA, 19 nt, Homo sapiens
agguaugacuuuagccuuu

SEQ ID NO: 1152972 - RNA, 19 nt, Homo sapiens
ggagaucucaauucauuac

SEQ ID NO: 1152973 - RNA, 19 nt, Homo sapiens
ggaacuucaugcucagagu

SEQ ID NO: 1152974 - RNA, 19 nt, Homo sapiens
caucauugguugcacuaca

SEQ ID NO: 1152975 - RNA, 19 nt, Homo sapiens
acauugaagcugcacuuua

SEQ ID NO: 1152976 - RNA, 19 nt, Homo sapiens
agagaauccugaugaacug

SEQ ID NO: 1152977 - RNA, 19 nt, Homo sapiens
gcguaucguuuucauuaua

SEQ ID NO: 1152978 - RNA, 19 nt, Homo sapiens
ugcaacagguaugacuuua

SEQ ID NO: 1152979 - RNA, 19 nt, Homo sapiens
ggauguagaagcucgacuu

SEQ ID NO: 1152980 - RNA, 19 nt, Homo sapiens
uacaguaacagaagagauu

SEQ ID NO: 1152981 - RNA, 19 nt, Homo sapiens
cagccucaguucaugauuc

SEQ ID NO: 1152982 - RNA, 19 nt, Homo sapiens
acaaccaucuagaggaaau

SEQ ID NO: 1152983 - RNA, 19 nt, Homo sapiens
gguaugacuuuagccuuuc

SEQ ID NO: 1152984 - RNA, 19 nt, Homo sapiens
ccaacaugcagcuccuaua

SEQ ID NO: 1152985 - RNA, 19 nt, Homo sapiens
ggucuuugguauuaacuac

SEQ ID NO: 1152986 - RNA, 19 nt, Homo sapiens
ggagauuauucggcagaug

SEQ ID NO: 1152987 - RNA, 19 nt, Homo sapiens
gugaaaagcagcuaacaaa

SEQ ID NO: 1152988 - RNA, 19 nt, Homo sapiens
ugaagaaagcucuguagca

SEQ ID NO: 1152989 - RNA, 19 nt, Homo sapiens
ucucacaccuuguuuuaaa

SEQ ID NO: 1152990 - RNA, 19 nt, Homo sapiens
acccuuaccuauugaaugu

SEQ ID NO: 1152991 - RNA, 19 nt, Homo sapiens
gagaugagcugcccuguga

SEQ ID NO: 1152992 - RNA, 19 nt, Homo sapiens
ugaaggagaugaagcaaua

SEQ ID NO: 1152993 - RNA, 19 nt, Homo sapiens
gaagugagcuggaggacau

SEQ ID NO: 1152994 - RNA, 19 nt, Homo sapiens
ggagaaagcugagcacugu

SEQ ID NO: 1152995 - RNA, 19 nt, Homo sapiens
gagauuugcucugacuuua

SEQ ID NO: 1152996 - RNA, 19 nt, Homo sapiens
agaaagguauguugucuaa

SEQ ID NO: 1152997 - RNA, 19 nt, Homo sapiens
ggagaaaguucagcaguau

SEQ ID NO: 1152998 - RNA, 19 nt, Homo sapiens
gaaagaagaguguacaauc

SEQ ID NO: 1152999 - RNA, 19 nt, Homo sapiens
ggaagaaggagucaacuug

SEQ ID NO: 1153000 - RNA, 19 nt, Homo sapiens
gauuugcucugacuuuauu

SEQ ID NO: 1153001 - RNA, 19 nt, Homo sapiens
gagaagcuguaccacauga

SEQ ID NO: 1153002 - RNA, 19 nt, Homo sapiens
ggacaacauucagagauau

SEQ ID NO: 1153003 - RNA, 19 nt, Homo sapiens
caugaaaucucugguuuau

SEQ ID NO: 1153004 - RNA, 19 nt, Homo sapiens
ccaaagagaucaucaaaau

SEQ ID NO: 1153005 - RNA, 19 nt, Homo sapiens
ggcaugaaaucucugguuu

SEQ ID NO: 1153006 - RNA, 19 nt, Homo sapiens
gggagaagcuguaccacau

SEQ ID NO: 1153007 - RNA, 19 nt, Homo sapiens
caacaacaauggcgaguac

SEQ ID NO: 1153008 - RNA, 19 nt, Homo sapiens
gaagaucuacuccaucaau

SEQ ID NO: 1153009 - RNA, 19 nt, Homo sapiens
agaaaguucagcaguauua

SEQ ID NO: 1153010 - RNA, 19 nt, Homo sapiens
ucacgaaagugcuggagaa

SEQ ID NO: 1153011 - RNA, 19 nt, Homo sapiens
uuaagcagcuggacgagaa

SEQ ID NO: 1153012 - RNA, 19 nt, Homo sapiens
aaugucaccuucuccuuua

SEQ ID NO: 1153013 - RNA, 19 nt, Homo sapiens
gcaugaaaucucugguuua

SEQ ID NO: 1153014 - RNA, 19 nt, Homo sapiens
gagacucgguccuguccua

SEQ ID NO: 1153015 - RNA, 19 nt, Homo sapiens
agaaugagcaggugaugua

SEQ ID NO: 1153016 - RNA, 19 nt, Homo sapiens
aaucaacacugaagucaug

SEQ ID NO: 1153017 - RNA, 19 nt, Homo sapiens
ggaggaggacuauggcuuu

SEQ ID NO: 1153018 - RNA, 19 nt, Homo sapiens
gaagacauccuggaaguuc

SEQ ID NO: 1153019 - RNA, 19 nt, Homo sapiens
ggccucagcuuccuacuca

SEQ ID NO: 1153020 - RNA, 19 nt, Homo sapiens
ccaagggugugaggcuuua

SEQ ID NO: 1153021 - RNA, 19 nt, Homo sapiens
uggagaaaguucagcagua

SEQ ID NO: 1153022 - RNA, 19 nt, Homo sapiens
ucgaagagaccaagcauuu

SEQ ID NO: 1153023 - RNA, 19 nt, Homo sapiens
uuaaggagcuggccaagag

SEQ ID NO: 1153024 - RNA, 19 nt, Homo sapiens
caacagaagguaguauuga

SEQ ID NO: 1153025 - RNA, 19 nt, Homo sapiens
uggacaacauucagagaua

SEQ ID NO: 1153026 - RNA, 19 nt, Homo sapiens
gcagcaacgugaugaacga

SEQ ID NO: 1153027 - RNA, 19 nt, Homo sapiens
ggacagcggauuaccauag

SEQ ID NO: 1153028 - RNA, 19 nt, Homo sapiens
ccacggacaucccuuugga

SEQ ID NO: 1153029 - RNA, 19 nt, Homo sapiens
ucauggagguggagaaugu

SEQ ID NO: 1153030 - RNA, 19 nt, Homo sapiens
ccacggcgguaaagauaga

SEQ ID NO: 1153031 - RNA, 19 nt, Homo sapiens
cgaaagugcuggagaacgu

SEQ ID NO: 1153032 - RNA, 19 nt, Homo sapiens
gaccaagcauuucccuaug

SEQ ID NO: 1153033 - RNA, 19 nt, Homo sapiens
caucaaugcucuccucaag

SEQ ID NO: 1153034 - RNA, 19 nt, Homo sapiens
ucaagacccugguggacaa

SEQ ID NO: 1153035 - RNA, 19 nt, Homo sapiens
acacugugcuuccagauuc

SEQ ID NO: 1153036 - RNA, 19 nt, Homo sapiens
acaaacagcuucgcaacga

SEQ ID NO: 1153037 - RNA, 19 nt, Homo sapiens
ccaagcauuucccuaugaa

SEQ ID NO: 1153038 - RNA, 19 nt, Homo sapiens
gccagaggauugccugcua

SEQ ID NO: 1153039 - RNA, 19 nt, Homo sapiens
gugcaacaauggcuucaug

SEQ ID NO: 1153040 - RNA, 19 nt, Homo sapiens
ucaagguccuguucucgaa

SEQ ID NO: 1153041 - RNA, 19 nt, Homo sapiens
gcaagaaguccaccaagag

SEQ ID NO: 1153042 - RNA, 19 nt, Homo sapiens
caaugucaccuucuccuuu

SEQ ID NO: 1153043 - RNA, 19 nt, Homo sapiens
aagaauaagugguuugucu

SEQ ID NO: 1153044 - RNA, 19 nt, Homo sapiens
ucagagauauguggaagau

SEQ ID NO: 1153045 - RNA, 19 nt, Homo sapiens
gagaugaagcaauauguca

SEQ ID NO: 1153046 - RNA, 19 nt, Homo sapiens
ggacaacgugcaccuggaa

SEQ ID NO: 1153047 - RNA, 19 nt, Homo sapiens
ggaccaugcuggaggacau

SEQ ID NO: 1153048 - RNA, 19 nt, Homo sapiens
ccacaucaaccucauggaa

SEQ ID NO: 1153049 - RNA, 19 nt, Homo sapiens
aggaagaucuacuccauca

SEQ ID NO: 1153050 - RNA, 19 nt, Homo sapiens
gcuuugacaucgaggagaa

SEQ ID NO: 1153051 - RNA, 19 nt, Homo sapiens
acaacacggccaagaauaa

SEQ ID NO: 1153052 - RNA, 19 nt, Homo sapiens
caacgucuucuaccacauu

SEQ ID NO: 1153053 - RNA, 19 nt, Homo sapiens
gccacgacaccaugaguua

SEQ ID NO: 1153054 - RNA, 19 nt, Homo sapiens
ggucagcccacccuucaaa

SEQ ID NO: 1153055 - RNA, 19 nt, Homo sapiens
gaggaggacuauggcuuug

SEQ ID NO: 1153056 - RNA, 19 nt, Homo sapiens
aaccacagcuuacaagagu

SEQ ID NO: 1153057 - RNA, 19 nt, Homo sapiens
gccaugugcuggagaagau

SEQ ID NO: 1153058 - RNA, 19 nt, Homo sapiens
ccuagaaauuggugaaauc

SEQ ID NO: 1153059 - RNA, 19 nt, Homo sapiens
aaagaaagguauguugucu

SEQ ID NO: 1153060 - RNA, 19 nt, Homo sapiens
ggcacgagauuugcucuga

SEQ ID NO: 1153061 - RNA, 19 nt, Homo sapiens
ggaaaagacuuggcucugu

SEQ ID NO: 1153062 - RNA, 19 nt, Homo sapiens
ccacagcuuacaagaguuu

SEQ ID NO: 1153063 - RNA, 19 nt, Homo sapiens
acaccaagcuggagagcau

SEQ ID NO: 1153064 - RNA, 19 nt, Homo sapiens
ggccaaagagaucaucaaa

SEQ ID NO: 1153065 - RNA, 19 nt, Homo sapiens
ccacgaaggccaaagagau

SEQ ID NO: 1153066 - RNA, 19 nt, Homo sapiens
gaagaugggacagcggauu

SEQ ID NO: 1153067 - RNA, 19 nt, Homo sapiens
caacggcucccucuacauc

SEQ ID NO: 1153068 - RNA, 19 nt, Homo sapiens
ccaugaggaugcccaggaa

SEQ ID NO: 1153069 - RNA, 19 nt, Homo sapiens
ggacuauggcuuugacauc

SEQ ID NO: 1153070 - RNA, 19 nt, Homo sapiens
gacaagcaccaguucaaga

SEQ ID NO: 1153071 - RNA, 19 nt, Homo sapiens
gcaugaacuugggaauguu

SEQ ID NO: 1153072 - RNA, 19 nt, Homo sapiens
gaagcuguaccacaugaug

SEQ ID NO: 1153073 - RNA, 19 nt, Homo sapiens
cgacaaccuucucgucuac

SEQ ID NO: 1153074 - RNA, 19 nt, Homo sapiens
cgagauuugcucugacuuu

SEQ ID NO: 1153075 - RNA, 19 nt, Homo sapiens
gcccaaggguggagauucu

SEQ ID NO: 1153076 - RNA, 19 nt, Homo sapiens
caccacggcgguaaagaua

SEQ ID NO: 1153077 - RNA, 19 nt, Homo sapiens
gcaccacggcgguaaagau

SEQ ID NO: 1153078 - RNA, 19 nt, Homo sapiens
ggaucuaccacacccauga

SEQ ID NO: 1153079 - RNA, 19 nt, Homo sapiens
ccacaacacggccaagaau

SEQ ID NO: 1153080 - RNA, 19 nt, Homo sapiens
gaaccacagcuuacaagag

SEQ ID NO: 1153081 - RNA, 19 nt, Homo sapiens
ggaaguucauaaggauuuc

SEQ ID NO: 1153082 - RNA, 19 nt, Homo sapiens
caaagaaagguauguuguc

SEQ ID NO: 1153083 - RNA, 19 nt, Homo sapiens
ucaaagaaagguauguugu

SEQ ID NO: 1153084 - RNA, 19 nt, Homo sapiens
gcuuccagguucacccuaa

SEQ ID NO: 1153085 - RNA, 19 nt, Homo sapiens
gagcucugccgccucauga

SEQ ID NO: 1153086 - RNA, 19 nt, Homo sapiens
caauaugucacccagauca

SEQ ID NO: 1153087 - RNA, 19 nt, Homo sapiens
ggaagaccaggcugauuca

SEQ ID NO: 1153088 - RNA, 19 nt, Homo sapiens
ugguggagcugaacaagau

SEQ ID NO: 1153089 - RNA, 19 nt, Homo sapiens
ucaaagaccgugauuacca

SEQ ID NO: 1153090 - RNA, 19 nt, Homo sapiens
ucgaagacauccuggaagu

SEQ ID NO: 1153091 - RNA, 19 nt, Homo sapiens
uaaagaagcugucauccua

SEQ ID NO: 1153092 - RNA, 19 nt, Homo sapiens
uaacauagguguguagaua

SEQ ID NO: 1153093 - RNA, 19 nt, Homo sapiens
ucaaaggagucaagauuua

SEQ ID NO: 1153094 - RNA, 19 nt, Homo sapiens
ggagacagcucuucaguuc

SEQ ID NO: 1153095 - RNA, 19 nt, Homo sapiens
ggauggaacuggcuucuuu

SEQ ID NO: 1153096 - RNA, 19 nt, Homo sapiens
aaaggaaacuucucaguaa

SEQ ID NO: 1153097 - RNA, 19 nt, Homo sapiens
gaaaggaaacuucucagua

SEQ ID NO: 1153098 - RNA, 19 nt, Homo sapiens
guaaaucacuugcaucaga

SEQ ID NO: 1153099 - RNA, 19 nt, Homo sapiens
gaaaauagcagaucgguua

SEQ ID NO: 1153100 - RNA, 19 nt, Homo sapiens
gaugauaaauggcgagauu

SEQ ID NO: 1153101 - RNA, 19 nt, Homo sapiens
uaaagaagauccucuagau

SEQ ID NO: 1153102 - RNA, 19 nt, Homo sapiens
agacagagaugauaugcua

SEQ ID NO: 1153103 - RNA, 19 nt, Homo sapiens
gauacaacauuggaacuua

SEQ ID NO: 1153104 - RNA, 19 nt, Homo sapiens
uaacacagguggauacaga

SEQ ID NO: 1153105 - RNA, 19 nt, Homo sapiens
gagcaaagcagaacaguug

SEQ ID NO: 1153106 - RNA, 19 nt, Homo sapiens
gaaaagauaucacuaggaa

SEQ ID NO: 1153107 - RNA, 19 nt, Homo sapiens
gcaaucagauacuuuagau

SEQ ID NO: 1153108 - RNA, 19 nt, Homo sapiens
ucacagcacuggcauauuc

SEQ ID NO: 1153109 - RNA, 19 nt, Homo sapiens
gaucaucauugccaaagaa

SEQ ID NO: 1153110 - RNA, 19 nt, Homo sapiens
gggaauggcugauauugau

SEQ ID NO: 1153111 - RNA, 19 nt, Homo sapiens
gagcagcccaucaguguua

SEQ ID NO: 1153112 - RNA, 19 nt, Homo sapiens
uaacagggaucuaauuagu

SEQ ID NO: 1153113 - RNA, 19 nt, Homo sapiens
gaugauagacgagguauuu

SEQ ID NO: 1153114 - RNA, 19 nt, Homo sapiens
gaacaaagugaaacuguau

SEQ ID NO: 1153115 - RNA, 19 nt, Homo sapiens
caagaaaccuagcaauagu

SEQ ID NO: 1153116 - RNA, 19 nt, Homo sapiens
gggacaggaugaaaccuua

SEQ ID NO: 1153117 - RNA, 19 nt, Homo sapiens
gcaaaccaguacaccagua

SEQ ID NO: 1153118 - RNA, 19 nt, Homo sapiens
ggaacuggcuucuuuaucg

SEQ ID NO: 1153119 - RNA, 19 nt, Homo sapiens
gaacagugucacaaugaua

SEQ ID NO: 1153120 - RNA, 19 nt, Homo sapiens
aagaagaccugucgccuuu

SEQ ID NO: 1153121 - RNA, 19 nt, Homo sapiens
gcacguaccuagucugaag

SEQ ID NO: 1153122 - RNA, 19 nt, Homo sapiens
ucagauaccagauuugaua

SEQ ID NO: 1153123 - RNA, 19 nt, Homo sapiens
gagccucucuucacaaaug

SEQ ID NO: 1153124 - RNA, 19 nt, Homo sapiens
gagaaagacauuugagaaa

SEQ ID NO: 1153125 - RNA, 19 nt, Homo sapiens
gugauaagcaguuuacuaa

SEQ ID NO: 1153126 - RNA, 19 nt, Homo sapiens
ggaaacuucucaguaaaga

SEQ ID NO: 1153127 - RNA, 19 nt, Homo sapiens
ugaaugagcagaccucuuu

SEQ ID NO: 1153128 - RNA, 19 nt, Homo sapiens
gagagagaaucugaacuuu

SEQ ID NO: 1153129 - RNA, 19 nt, Homo sapiens
gcaaauuaguugaagaaag

SEQ ID NO: 1153130 - RNA, 19 nt, Homo sapiens
gaaaaggcauuccaaguau

SEQ ID NO: 1153131 - RNA, 19 nt, Homo sapiens
gaaaucaaccaguccagaa

SEQ ID NO: 1153132 - RNA, 19 nt, Homo sapiens
gcagcaaccuaaacgaaga

SEQ ID NO: 1153133 - RNA, 19 nt, Homo sapiens
ggaagauucugugcuaaug

SEQ ID NO: 1153134 - RNA, 19 nt, Homo sapiens
gaacugaagaagugaggua

SEQ ID NO: 1153135 - RNA, 19 nt, Homo sapiens
cugagaagguuguagauuu

SEQ ID NO: 1153136 - RNA, 19 nt, Homo sapiens
aagaacaucucaaggcuuu

SEQ ID NO: 1153137 - RNA, 19 nt, Homo sapiens
ggagagagaaucugaacuu

SEQ ID NO: 1153138 - RNA, 19 nt, Homo sapiens
gcaucagucuuacaucuug

SEQ ID NO: 1153139 - RNA, 19 nt, Homo sapiens
gaagguuguagauuuguua

SEQ ID NO: 1153140 - RNA, 19 nt, Homo sapiens
gcucuucaguucccauaaa

SEQ ID NO: 1153141 - RNA, 19 nt, Homo sapiens
gagggaaguuuaacaucaa

SEQ ID NO: 1153142 - RNA, 19 nt, Homo sapiens
ggaagaagccgaaagaaaa

SEQ ID NO: 1153143 - RNA, 19 nt, Homo sapiens
gaagaccugucgccuuugu

SEQ ID NO: 1153144 - RNA, 19 nt, Homo sapiens
gaacuccaauaccugauuc

SEQ ID NO: 1153145 - RNA, 19 nt, Homo sapiens
caagaaagacuggaagauu

SEQ ID NO: 1153146 - RNA, 19 nt, Homo sapiens
ccacucaucuaauucauca

SEQ ID NO: 1153147 - RNA, 19 nt, Homo sapiens
aaacagugauacaacauug

SEQ ID NO: 1153148 - RNA, 19 nt, Homo sapiens
caguaacucugucaauauu

SEQ ID NO: 1153149 - RNA, 19 nt, Homo sapiens
gcagaucgguuaaaacuga

SEQ ID NO: 1153150 - RNA, 19 nt, Homo sapiens
gcacugacgucuccaucug

SEQ ID NO: 1153151 - RNA, 19 nt, Homo sapiens
ugagaagguuguagauuug

SEQ ID NO: 1153152 - RNA, 19 nt, Homo sapiens
gaacuggcuucuuuaucga

SEQ ID NO: 1153153 - RNA, 19 nt, Homo sapiens
cgagggaaguuuaacauca

SEQ ID NO: 1153154 - RNA, 19 nt, Homo sapiens
ggucuugaauauacaggua

SEQ ID NO: 1153155 - RNA, 19 nt, Homo sapiens
ucagaggucuucagugaug

SEQ ID NO: 1153156 - RNA, 19 nt, Homo sapiens
gugaaaguccgaaguaauu

SEQ ID NO: 1153157 - RNA, 19 nt, Homo sapiens
ggaucugugucgcaguuua

SEQ ID NO: 1153158 - RNA, 19 nt, Homo sapiens
acauagaacugaagaagug

SEQ ID NO: 1153159 - RNA, 19 nt, Homo sapiens
gcgcagacauacacuagga

SEQ ID NO: 1153160 - RNA, 19 nt, Homo sapiens
ccacaugccugaccaguac

SEQ ID NO: 1153161 - RNA, 19 nt, Homo sapiens
aaacuuugcuuggugcuaa

SEQ ID NO: 1153162 - RNA, 19 nt, Homo sapiens
gaauacaacaaucugauga

SEQ ID NO: 1153163 - RNA, 19 nt, Homo sapiens
gaaaggcaacgaagcuuau

SEQ ID NO: 1153164 - RNA, 19 nt, Homo sapiens
uaaaucacuugcaucagaa

SEQ ID NO: 1153165 - RNA, 19 nt, Homo sapiens
aagaaagacuggaagauuc

SEQ ID NO: 1153166 - RNA, 19 nt, Homo sapiens
caacuuacuacauagcaua

SEQ ID NO: 1153167 - RNA, 19 nt, Homo sapiens
gcgaaugcccaaccucaua

SEQ ID NO: 1153168 - RNA, 19 nt, Homo sapiens
gaaaucagcguuuugaauu

SEQ ID NO: 1153169 - RNA, 19 nt, Homo sapiens
aaacagaagaucaucauug

SEQ ID NO: 1153170 - RNA, 19 nt, Homo sapiens
gccgucagcucucacauga

SEQ ID NO: 1153171 - RNA, 19 nt, Homo sapiens
gucgagagguccacauaaa

SEQ ID NO: 1153172 - RNA, 19 nt, Homo sapiens
ggagucaagauuuaaguuu

SEQ ID NO: 1153173 - RNA, 19 nt, Homo sapiens
cgaagcaccucucaugauc

SEQ ID NO: 1153174 - RNA, 19 nt, Homo sapiens
caugaggacuuaaugaauc

SEQ ID NO: 1153175 - RNA, 19 nt, Homo sapiens
ggaagagucggaaaggaaa

SEQ ID NO: 1153176 - RNA, 19 nt, Homo sapiens
uaacagacgauugcacaua

SEQ ID NO: 1153177 - RNA, 19 nt, Homo sapiens
gaagcuggauuauguacag

SEQ ID NO: 1153178 - RNA, 19 nt, Homo sapiens
agaacaaagugaaacugua

SEQ ID NO: 1153179 - RNA, 19 nt, Homo sapiens
gaacgccuacgcaccagua

SEQ ID NO: 1153180 - RNA, 19 nt, Homo sapiens
gcaagaagaacucaacaag

SEQ ID NO: 1153181 - RNA, 19 nt, Homo sapiens
uguuaaugcuugcuugaua

SEQ ID NO: 1153182 - RNA, 19 nt, Homo sapiens
gauaagggcaagcgaguug

SEQ ID NO: 1153183 - RNA, 19 nt, Homo sapiens
ggaguggguuuacugaaca

SEQ ID NO: 1153184 - RNA, 19 nt, Homo sapiens
gaaguauuguccaagaagu

SEQ ID NO: 1153185 - RNA, 19 nt, Homo sapiens
ggacaauacaagaaagauu

SEQ ID NO: 1153186 - RNA, 19 nt, Homo sapiens
caagaugccuaccugaaag

SEQ ID NO: 1153187 - RNA, 19 nt, Homo sapiens
caaaaccuauucccaagua

SEQ ID NO: 1153188 - RNA, 19 nt, Homo sapiens
uuucaucccugucuuuaaa

SEQ ID NO: 1153189 - RNA, 19 nt, Homo sapiens
gcaccaucaccucagauua

SEQ ID NO: 1153190 - RNA, 19 nt, Homo sapiens
acaacaaucugaugagcaa

SEQ ID NO: 1153191 - RNA, 19 nt, Homo sapiens
caacaugccuggcuaauuu

SEQ ID NO: 1153192 - RNA, 19 nt, Homo sapiens
gaaggagaguugucuguua

SEQ ID NO: 1153193 - RNA, 19 nt, Homo sapiens
aaacauggcuccuuauaaa

SEQ ID NO: 1153194 - RNA, 19 nt, Homo sapiens
ccaagaaccuccacucuaa

SEQ ID NO: 1153195 - RNA, 19 nt, Homo sapiens
ugaaggaggugcuuauuaa

SEQ ID NO: 1153196 - RNA, 19 nt, Homo sapiens
guugagcacuuauugauua

SEQ ID NO: 1153197 - RNA, 19 nt, Homo sapiens
ggaacgagaugaucauguu

SEQ ID NO: 1153198 - RNA, 19 nt, Homo sapiens
gaccaucccuaacaaagua

SEQ ID NO: 1153199 - RNA, 19 nt, Homo sapiens
acaaaucacuccaaacaaa

SEQ ID NO: 1153200 - RNA, 19 nt, Homo sapiens
gaaacauggcuccuuauaa

SEQ ID NO: 1153201 - RNA, 19 nt, Homo sapiens
gaauauaauugcucugcuu

SEQ ID NO: 1153202 - RNA, 19 nt, Homo sapiens
ggaaacauggcuccuuaua

SEQ ID NO: 1153203 - RNA, 19 nt, Homo sapiens
ggaggaauuuaguuauuga

SEQ ID NO: 1153204 - RNA, 19 nt, Homo sapiens
ggaaggaugucucugucaa

SEQ ID NO: 1153205 - RNA, 19 nt, Homo sapiens
aaauguggcuguaaccuaa

SEQ ID NO: 1153206 - RNA, 19 nt, Homo sapiens
ucacuugaauggguaaaua

SEQ ID NO: 1153207 - RNA, 19 nt, Homo sapiens
gcucaucuguguuauugaa

SEQ ID NO: 1153208 - RNA, 19 nt, Homo sapiens
guuaguggcuuccuaugaa

SEQ ID NO: 1153209 - RNA, 19 nt, Homo sapiens
gaugucaaacugccaaaua

SEQ ID NO: 1153210 - RNA, 19 nt, Homo sapiens
ggagggaucucaaaguuuu

SEQ ID NO: 1153211 - RNA, 19 nt, Homo sapiens
caucaacuaugcagacuau

SEQ ID NO: 1153212 - RNA, 19 nt, Homo sapiens
caacagaugaagagaauau

SEQ ID NO: 1153213 - RNA, 19 nt, Homo sapiens
ccaaagugacucugagaua

SEQ ID NO: 1153214 - RNA, 19 nt, Homo sapiens
caacuaguccuugugauuu

SEQ ID NO: 1153215 - RNA, 19 nt, Homo sapiens
aagaguggcuggcagagua

SEQ ID NO: 1153216 - RNA, 19 nt, Homo sapiens
ucgaaucccucuuucauga

SEQ ID NO: 1153217 - RNA, 19 nt, Homo sapiens
caaagugacucugagauag

SEQ ID NO: 1153218 - RNA, 19 nt, Homo sapiens
gcauaugucuguccauuuu

SEQ ID NO: 1153219 - RNA, 19 nt, Homo sapiens
caggaggaauuuaguuauu

SEQ ID NO: 1153220 - RNA, 19 nt, Homo sapiens
ugaagaagaagcagacuaa

SEQ ID NO: 1153221 - RNA, 19 nt, Homo sapiens
ucagaaggcagaauuguuu

SEQ ID NO: 1153222 - RNA, 19 nt, Homo sapiens
gcuagaaauucaugacaau

SEQ ID NO: 1153223 - RNA, 19 nt, Homo sapiens
gagcuaagcacaagaucaa

SEQ ID NO: 1153224 - RNA, 19 nt, Homo sapiens
uaacugagccugugugaag

SEQ ID NO: 1153225 - RNA, 19 nt, Homo sapiens
uagcagggauuacagaaau

SEQ ID NO: 1153226 - RNA, 19 nt, Homo sapiens
gaagcauccuuucauucuu

SEQ ID NO: 1153227 - RNA, 19 nt, Homo sapiens
ggaccccucucuauuaaua

SEQ ID NO: 1153228 - RNA, 19 nt, Homo sapiens
gaaaucaggucuuuugcaa

SEQ ID NO: 1153229 - RNA, 19 nt, Homo sapiens
gaccagcauucucuucuug

SEQ ID NO: 1153230 - RNA, 19 nt, Homo sapiens
gaaucccucuuucaugaga

SEQ ID NO: 1153231 - RNA, 19 nt, Homo sapiens
gaaggaggugcuuauuaaa

SEQ ID NO: 1153232 - RNA, 19 nt, Homo sapiens
ccauuucucuuggauguaa

SEQ ID NO: 1153233 - RNA, 19 nt, Homo sapiens
auuaagaccuugcauaugu

SEQ ID NO: 1153234 - RNA, 19 nt, Homo sapiens
cccaaugaaugauauacua

SEQ ID NO: 1153235 - RNA, 19 nt, Homo sapiens
ugacaaaucacuccaaaca

SEQ ID NO: 1153236 - RNA, 19 nt, Homo sapiens
ggugagagaccauuucaga

SEQ ID NO: 1153237 - RNA, 19 nt, Homo sapiens
ggugugagguagagguaaa

SEQ ID NO: 1153238 - RNA, 19 nt, Homo sapiens
ugcaucagcuuaccuugua

SEQ ID NO: 1153239 - RNA, 19 nt, Homo sapiens
acucauugcucuccaugua

SEQ ID NO: 1153240 - RNA, 19 nt, Homo sapiens
uuaacaagcugauguagag

SEQ ID NO: 1153241 - RNA, 19 nt, Homo sapiens
cuccagaggucaucaacua

SEQ ID NO: 1153242 - RNA, 19 nt, Homo sapiens
ugagaagucuuuuggauaa

SEQ ID NO: 1153243 - RNA, 19 nt, Homo sapiens
aaucugagcaggagccuua

SEQ ID NO: 1153244 - RNA, 19 nt, Homo sapiens
cuaauccacugcccuaaga

SEQ ID NO: 1153245 - RNA, 19 nt, Homo sapiens
ccagaagcaucguggcauu

SEQ ID NO: 1153246 - RNA, 19 nt, Homo sapiens
gagccuugcugaguggaua

SEQ ID NO: 1153247 - RNA, 19 nt, Homo sapiens
uaugacaucuggcuacaug

SEQ ID NO: 1153248 - RNA, 19 nt, Homo sapiens
agaguugucuguuauguuc

SEQ ID NO: 1153249 - RNA, 19 nt, Homo sapiens
guaggcaaagcacuuguua

SEQ ID NO: 1153250 - RNA, 19 nt, Homo sapiens
gaacgagaugaucauguuu

SEQ ID NO: 1153251 - RNA, 19 nt, Homo sapiens
ggagaguugucuguuaugu

SEQ ID NO: 1153252 - RNA, 19 nt, Homo sapiens
gcagcuagguuuugaauuc

SEQ ID NO: 1153253 - RNA, 19 nt, Homo sapiens
gggcucgccuggagacauu

SEQ ID NO: 1153254 - RNA, 19 nt, Homo sapiens
caaucaagcucaccaugca

SEQ ID NO: 1153255 - RNA, 19 nt, Homo sapiens
ugaaggaagugaaaguauc

SEQ ID NO: 1153256 - RNA, 19 nt, Homo sapiens
gaugaaggaagugaaagua

SEQ ID NO: 1153257 - RNA, 19 nt, Homo sapiens
aaagaugcaugagacauug

SEQ ID NO: 1153258 - RNA, 19 nt, Homo sapiens
aaccauggauucugccuuu

SEQ ID NO: 1153259 - RNA, 19 nt, Homo sapiens
uugaauuccuaccuuguua

SEQ ID NO: 1153260 - RNA, 19 nt, Homo sapiens
ggugggaucuccugugagu

SEQ ID NO: 1153261 - RNA, 19 nt, Homo sapiens
gcagagaaagcuaaaugug

SEQ ID NO: 1153262 - RNA, 19 nt, Homo sapiens
gacagugacagauguguuu

SEQ ID NO: 1153263 - RNA, 19 nt, Homo sapiens
ucauugcucuccauguaaa

SEQ ID NO: 1153264 - RNA, 19 nt, Homo sapiens
ucagaugucuuagcaguca

SEQ ID NO: 1153265 - RNA, 19 nt, Homo sapiens
gaaugacagucgccucaag

SEQ ID NO: 1153266 - RNA, 19 nt, Homo sapiens
gugcagcugccuuauagua

SEQ ID NO: 1153267 - RNA, 19 nt, Homo sapiens
caaguguuguguaggcaaa

SEQ ID NO: 1153268 - RNA, 19 nt, Homo sapiens
uaaccuguggucauuauuu

SEQ ID NO: 1153269 - RNA, 19 nt, Homo sapiens
caacuaugcagacuauuca

SEQ ID NO: 1153270 - RNA, 19 nt, Homo sapiens
ggcaccagcugcaccugua

SEQ ID NO: 1153271 - RNA, 19 nt, Homo sapiens
gcucagacagcccuaaaga

SEQ ID NO: 1153272 - RNA, 19 nt, Homo sapiens
ccacuaaaacuccaucuua

SEQ ID NO: 1153273 - RNA, 19 nt, Homo sapiens
acauguagguagagaagaa

SEQ ID NO: 1153274 - RNA, 19 nt, Homo sapiens
agacagagcaggaaaugga

SEQ ID NO: 1153275 - RNA, 19 nt, Homo sapiens
ccagcugccucccuucuug

SEQ ID NO: 1153276 - RNA, 19 nt, Homo sapiens
cagagaaggcugccaguug

SEQ ID NO: 1153277 - RNA, 19 nt, Homo sapiens
gccaagaaccuccacucua

SEQ ID NO: 1153278 - RNA, 19 nt, Homo sapiens
ccaacuaguccuugugauu

SEQ ID NO: 1153279 - RNA, 19 nt, Homo sapiens
ucagcuaggagaccaguua

SEQ ID NO: 1153280 - RNA, 19 nt, Homo sapiens
ugugaaguaucucaucauu

SEQ ID NO: 1153281 - RNA, 19 nt, Homo sapiens
cuuauaaccuguggucauu

SEQ ID NO: 1153282 - RNA, 19 nt, Homo sapiens
gaauuccuaccuuguuauu

SEQ ID NO: 1153283 - RNA, 19 nt, Homo sapiens
cacuguauguggagaaauu

SEQ ID NO: 1153284 - RNA, 19 nt, Homo sapiens
aaucauggaugcaaagaag

SEQ ID NO: 1153285 - RNA, 19 nt, Homo sapiens
uaaacgagcuaagcacaag

SEQ ID NO: 1153286 - RNA, 19 nt, Homo sapiens
cucggaagcugaagaagaa

SEQ ID NO: 1153287 - RNA, 19 nt, Homo sapiens
gcuaggagaccaguuauuc

SEQ ID NO: 1153288 - RNA, 19 nt, Homo sapiens
gagccugugugaaguaucu

SEQ ID NO: 1153289 - RNA, 19 nt, Homo sapiens
caaguucccagacaucuau

SEQ ID NO: 1153290 - RNA, 19 nt, Homo sapiens
ucuguuauguucacuguau

SEQ ID NO: 1153291 - RNA, 19 nt, Homo sapiens
gcaauauucuggcaauuua

SEQ ID NO: 1153292 - RNA, 19 nt, Homo sapiens
caucaagucuuccacaaua

SEQ ID NO: 1153293 - RNA, 19 nt, Homo sapiens
guaaagaucugggacauga

SEQ ID NO: 1153294 - RNA, 19 nt, Homo sapiens
gcacaauguugaauguuaa

SEQ ID NO: 1153295 - RNA, 19 nt, Homo sapiens
agaaugagcuagcaaauga

SEQ ID NO: 1153296 - RNA, 19 nt, Homo sapiens
caacaucacugcaggaaau

SEQ ID NO: 1153297 - RNA, 19 nt, Homo sapiens
ugaauauccucuacacuua

SEQ ID NO: 1153298 - RNA, 19 nt, Homo sapiens
gcagcaagcgcucaaguua

SEQ ID NO: 1153299 - RNA, 19 nt, Homo sapiens
gaaagugauucuugucaga

SEQ ID NO: 1153300 - RNA, 19 nt, Homo sapiens
guaauggaauuucacguuu

SEQ ID NO: 1153301 - RNA, 19 nt, Homo sapiens
uaauggagcuguaauggaa

SEQ ID NO: 1153302 - RNA, 19 nt, Homo sapiens
ggagugacguaucuuagaa

SEQ ID NO: 1153303 - RNA, 19 nt, Homo sapiens
gaaacugacccaaauaugu

SEQ ID NO: 1153304 - RNA, 19 nt, Homo sapiens
guauauaugugguaaggaa

SEQ ID NO: 1153305 - RNA, 19 nt, Homo sapiens
auacaaaggugcuauccua

SEQ ID NO: 1153306 - RNA, 19 nt, Homo sapiens
acaauagggucauuccaua

SEQ ID NO: 1153307 - RNA, 19 nt, Homo sapiens
cagcuaauguguagugaaa

SEQ ID NO: 1153308 - RNA, 19 nt, Homo sapiens
agauagggauuaaggaaua

SEQ ID NO: 1153309 - RNA, 19 nt, Homo sapiens
aaauaagacugaaggguuu

SEQ ID NO: 1153310 - RNA, 19 nt, Homo sapiens
gaucauaccaggacaauag

SEQ ID NO: 1153311 - RNA, 19 nt, Homo sapiens
gaaagaaugagcuagcaaa

SEQ ID NO: 1153312 - RNA, 19 nt, Homo sapiens
ccagagaccuuucccuaug

SEQ ID NO: 1153313 - RNA, 19 nt, Homo sapiens
ucaagugucuauugcuuaa

SEQ ID NO: 1153314 - RNA, 19 nt, Homo sapiens
aaacagcccaguccucuua

SEQ ID NO: 1153315 - RNA, 19 nt, Homo sapiens
gaacagcagcuccaccaaa

SEQ ID NO: 1153316 - RNA, 19 nt, Homo sapiens
cagauaggcugaugguuau

SEQ ID NO: 1153317 - RNA, 19 nt, Homo sapiens
gcugaugguuauugccuua

SEQ ID NO: 1153318 - RNA, 19 nt, Homo sapiens
acagauaggcugaugguua

SEQ ID NO: 1153319 - RNA, 19 nt, Homo sapiens
aagaugagccucugcaaua

SEQ ID NO: 1153320 - RNA, 19 nt, Homo sapiens
gcuaauguguagugaaaga

SEQ ID NO: 1153321 - RNA, 19 nt, Homo sapiens
cuacuuccguuauuggaua

SEQ ID NO: 1153322 - RNA, 19 nt, Homo sapiens
aaacugacccaaauaugua

SEQ ID NO: 1153323 - RNA, 19 nt, Homo sapiens
gaacagcuaauguguagug

SEQ ID NO: 1153324 - RNA, 19 nt, Homo sapiens
gacaguagccacuuacaaa

SEQ ID NO: 1153325 - RNA, 19 nt, Homo sapiens
ggacuucucuagcgaccuu

SEQ ID NO: 1153326 - RNA, 19 nt, Homo sapiens
gcucuagaauguauuacuu

SEQ ID NO: 1153327 - RNA, 19 nt, Homo sapiens
gaaguuuaauugugcaaca

SEQ ID NO: 1153328 - RNA, 19 nt, Homo sapiens
gaauucaguuuguuaguac

SEQ ID NO: 1153329 - RNA, 19 nt, Homo sapiens
guaaggaaaugccgauucu

SEQ ID NO: 1153330 - RNA, 19 nt, Homo sapiens
gaugguuauugccuuauuu

SEQ ID NO: 1153331 - RNA, 19 nt, Homo sapiens
uagagggacugaaagguuu

SEQ ID NO: 1153332 - RNA, 19 nt, Homo sapiens
caauaauucccaacucaua

SEQ ID NO: 1153333 - RNA, 19 nt, Homo sapiens
gaaaaggucuguccauagu

SEQ ID NO: 1153334 - RNA, 19 nt, Homo sapiens
caaaggacaugaagguagu

SEQ ID NO: 1153335 - RNA, 19 nt, Homo sapiens
uaugguaucuccuaaagug

SEQ ID NO: 1153336 - RNA, 19 nt, Homo sapiens
gaauuggagugacguaucu

SEQ ID NO: 1153337 - RNA, 19 nt, Homo sapiens
ggacugaaagguuuaagga

SEQ ID NO: 1153338 - RNA, 19 nt, Homo sapiens
ggacaucggaggaaggaaa

SEQ ID NO: 1153339 - RNA, 19 nt, Homo sapiens
gcucuguccugcuaccuaa

SEQ ID NO: 1153340 - RNA, 19 nt, Homo sapiens
ugaauaugcaggcuaauuu

SEQ ID NO: 1153341 - RNA, 19 nt, Homo sapiens
aggcugauguuuccauaua

SEQ ID NO: 1153342 - RNA, 19 nt, Homo sapiens
gagcagauuuauugaaugc

SEQ ID NO: 1153343 - RNA, 19 nt, Homo sapiens
gugagcagauuuauugaau

SEQ ID NO: 1153344 - RNA, 19 nt, Homo sapiens
gaaaugaggagccugucuu

SEQ ID NO: 1153345 - RNA, 19 nt, Homo sapiens
gaaacagcauucuacuucu

SEQ ID NO: 1153346 - RNA, 19 nt, Homo sapiens
ugacugcauuucucuuaaa

SEQ ID NO: 1153347 - RNA, 19 nt, Homo sapiens
caagcacaauguugaaugu

SEQ ID NO: 1153348 - RNA, 19 nt, Homo sapiens
ugaaacagcauucuacuuc

SEQ ID NO: 1153349 - RNA, 19 nt, Homo sapiens
gaacuuacgaaaccagaga

SEQ ID NO: 1153350 - RNA, 19 nt, Homo sapiens
cuucgugucugcaauauga

SEQ ID NO: 1153351 - RNA, 19 nt, Homo sapiens
gaauaugcaggcuaauuug

SEQ ID NO: 1153352 - RNA, 19 nt, Homo sapiens
gagcuauaaucauccauca

SEQ ID NO: 1153353 - RNA, 19 nt, Homo sapiens
ccucuacacuuaguuauug

SEQ ID NO: 1153354 - RNA, 19 nt, Homo sapiens
gcucagacccaaggagaua

SEQ ID NO: 1153355 - RNA, 19 nt, Homo sapiens
gagcuguaauggaauuuca

SEQ ID NO: 1153356 - RNA, 19 nt, Homo sapiens
ccacugugaugcgaaauga

SEQ ID NO: 1153357 - RNA, 19 nt, Homo sapiens
cagcaaaacuuccccauga

SEQ ID NO: 1153358 - RNA, 19 nt, Homo sapiens
guucuuugcuccuauuugu

SEQ ID NO: 1153359 - RNA, 19 nt, Homo sapiens
gguaucuccuaaaguguaa

SEQ ID NO: 1153360 - RNA, 19 nt, Homo sapiens
aggcuaauuuguacagaua

SEQ ID NO: 1153361 - RNA, 19 nt, Homo sapiens
guacagacacuucacuuag

SEQ ID NO: 1153362 - RNA, 19 nt, Homo sapiens
ggaccgaccgcauuguaaa

SEQ ID NO: 1153363 - RNA, 19 nt, Homo sapiens
gauaaaccaucugcucauc

SEQ ID NO: 1153364 - RNA, 19 nt, Homo sapiens
caaggaggaaguuuauauu

SEQ ID NO: 1153365 - RNA, 19 nt, Homo sapiens
gaacugugguuuuguuuuc

SEQ ID NO: 1153366 - RNA, 19 nt, Homo sapiens
uguuaagcuuccuguauua

SEQ ID NO: 1153367 - RNA, 19 nt, Homo sapiens
gaucugcauuaaacauaga

SEQ ID NO: 1153368 - RNA, 19 nt, Homo sapiens
aaacagcauucuacuucuu

SEQ ID NO: 1153369 - RNA, 19 nt, Homo sapiens
gugaauauccucuacacuu

SEQ ID NO: 1153370 - RNA, 19 nt, Homo sapiens
cagagaccuuucccuauga

SEQ ID NO: 1153371 - RNA, 19 nt, Homo sapiens
gacaacagcaucaucaugu

SEQ ID NO: 1153372 - RNA, 19 nt, Homo sapiens
acacuuuguucuuguacua

SEQ ID NO: 1153373 - RNA, 19 nt, Homo sapiens
gaagcaagggguaauguua

SEQ ID NO: 1153374 - RNA, 19 nt, Homo sapiens
ccauagcuuucaaaccuuu

SEQ ID NO: 1153375 - RNA, 19 nt, Homo sapiens
cacaauaauucccaacuca

SEQ ID NO: 1153376 - RNA, 19 nt, Homo sapiens
uaacugaaacagcauucua

SEQ ID NO: 1153377 - RNA, 19 nt, Homo sapiens
gggaagacuuguucucucu

SEQ ID NO: 1153378 - RNA, 19 nt, Homo sapiens
ucaaagcagucacaaguac

SEQ ID NO: 1153379 - RNA, 19 nt, Homo sapiens
ugccgauucuucauuauaa

SEQ ID NO: 1153380 - RNA, 19 nt, Homo sapiens
ucaaggaggaaguuuauau

SEQ ID NO: 1153381 - RNA, 19 nt, Homo sapiens
agcacaauguugaauguua

SEQ ID NO: 1153382 - RNA, 19 nt, Homo sapiens
ugacaacaguacauauauc

SEQ ID NO: 1153383 - RNA, 19 nt, Homo sapiens
ggacaguagccacuuacaa

SEQ ID NO: 1153384 - RNA, 19 nt, Homo sapiens
aaaggcugauguuuccaua

SEQ ID NO: 1153385 - RNA, 19 nt, Homo sapiens
gacagcagacggauauuug

SEQ ID NO: 1153386 - RNA, 19 nt, Homo sapiens
aaucauccaucaagucuuc

SEQ ID NO: 1153387 - RNA, 19 nt, Homo sapiens
cauagugguucccugaaga

SEQ ID NO: 1153388 - RNA, 19 nt, Homo sapiens
ggacuaauauggaaaaggu

SEQ ID NO: 1153389 - RNA, 19 nt, Homo sapiens
cagcagcuccaccaaauga

SEQ ID NO: 1153390 - RNA, 19 nt, Homo sapiens
ggaaaggccggacgcuguu

SEQ ID NO: 1153391 - RNA, 19 nt, Homo sapiens
ccaaggagcugaagccaaa

SEQ ID NO: 1153392 - RNA, 19 nt, Homo sapiens
ggaagaaugugcuacaguu

SEQ ID NO: 1153393 - RNA, 19 nt, Homo sapiens
gaucggagcuggucaggau

SEQ ID NO: 1153394 - RNA, 19 nt, Homo sapiens
ggugaacuaucccaaagua

SEQ ID NO: 1153395 - RNA, 19 nt, Homo sapiens
ggacagcagcgaugccuua

SEQ ID NO: 1153396 - RNA, 19 nt, Homo sapiens
gcagauggacgaccuguuu

SEQ ID NO: 1153397 - RNA, 19 nt, Homo sapiens
gcaacucccucccauccua

SEQ ID NO: 1153398 - RNA, 19 nt, Homo sapiens
ggagaaauuucagcagauu

SEQ ID NO: 1153399 - RNA, 19 nt, Homo sapiens
gagagcagcugucaagaag

SEQ ID NO: 1153400 - RNA, 19 nt, Homo sapiens
ugaagaagcucaaguacca

SEQ ID NO: 1153401 - RNA, 19 nt, Homo sapiens
gaaggaagccaucauugug

SEQ ID NO: 1153402 - RNA, 19 nt, Homo sapiens
gggccuggaugcaagguua

SEQ ID NO: 1153403 - RNA, 19 nt, Homo sapiens
gguguaguguaaccauuua

SEQ ID NO: 1153404 - RNA, 19 nt, Homo sapiens
gugaagcuguugccaauga

SEQ ID NO: 1153405 - RNA, 19 nt, Homo sapiens
gggugaaucuccuuccuuu

SEQ ID NO: 1153406 - RNA, 19 nt, Homo sapiens
ccauggagcugguggagaa

SEQ ID NO: 1153407 - RNA, 19 nt, Homo sapiens
gagugaagcuguugccaau

SEQ ID NO: 1153408 - RNA, 19 nt, Homo sapiens
gggaaggugugugaacuuu

SEQ ID NO: 1153409 - RNA, 19 nt, Homo sapiens
gaucaugccgccuuugaaa

SEQ ID NO: 1153410 - RNA, 19 nt, Homo sapiens
gcacagccaucaccuucug

SEQ ID NO: 1153411 - RNA, 19 nt, Homo sapiens
guacgcagccucuccacua

SEQ ID NO: 1153412 - RNA, 19 nt, Homo sapiens
gagcagcugucaagaagca

SEQ ID NO: 1153413 - RNA, 19 nt, Homo sapiens
gaacagagaagcccuuacu

SEQ ID NO: 1153414 - RNA, 19 nt, Homo sapiens
gaaggaaccaccuggcuau

SEQ ID NO: 1153415 - RNA, 19 nt, Homo sapiens
gaacagcaccucacugacu

SEQ ID NO: 1153416 - RNA, 19 nt, Homo sapiens
ggacagaggacuaucucaa

SEQ ID NO: 1153417 - RNA, 19 nt, Homo sapiens
ggagagcagcugucaagaa

SEQ ID NO: 1153418 - RNA, 19 nt, Homo sapiens
ggaauuguaagcaagauug

SEQ ID NO: 1153419 - RNA, 19 nt, Homo sapiens
gagccagacuagccgauga

SEQ ID NO: 1153420 - RNA, 19 nt, Homo sapiens
agacagcucuuccuucgau

SEQ ID NO: 1153421 - RNA, 19 nt, Homo sapiens
guagcucucuggcucaaga

SEQ ID NO: 1153422 - RNA, 19 nt, Homo sapiens
cagaacagcaccucacuga

SEQ ID NO: 1153423 - RNA, 19 nt, Homo sapiens
gacagaggacuaucucaaa

SEQ ID NO: 1153424 - RNA, 19 nt, Homo sapiens
gaagaaugugcuacaguug

SEQ ID NO: 1153425 - RNA, 19 nt, Homo sapiens
ggaaccaccuggcuaugag

SEQ ID NO: 1153426 - RNA, 19 nt, Homo sapiens
caauuugccuccacuuagu

SEQ ID NO: 1153427 - RNA, 19 nt, Homo sapiens
ccacccagguugugucuca

SEQ ID NO: 1153428 - RNA, 19 nt, Homo sapiens
gcugugaagggagaaauua

SEQ ID NO: 1153429 - RNA, 19 nt, Homo sapiens
gaggagagcagcugucaag

SEQ ID NO: 1153430 - RNA, 19 nt, Homo sapiens
caagauugccaucacgaaa

SEQ ID NO: 1153431 - RNA, 19 nt, Homo sapiens
agaaugugcuacaguugaa

SEQ ID NO: 1153432 - RNA, 19 nt, Homo sapiens
uggcaggaaucccaauuug

SEQ ID NO: 1153433 - RNA, 19 nt, Homo sapiens
gagccaggguacuccaaug

SEQ ID NO: 1153434 - RNA, 19 nt, Homo sapiens
gaacuaucccaaaguagca

SEQ ID NO: 1153435 - RNA, 19 nt, Homo sapiens
gcgggaggcuucucuucug

SEQ ID NO: 1153436 - RNA, 19 nt, Homo sapiens
gcagugggguggugaaguu

SEQ ID NO: 1153437 - RNA, 19 nt, Homo sapiens
cgaaagccaaaguggauuu

SEQ ID NO: 1153438 - RNA, 19 nt, Homo sapiens
ggacaaagauggggaaggu

SEQ ID NO: 1153439 - RNA, 19 nt, Homo sapiens
ggacgaccuguuugacauu

SEQ ID NO: 1153440 - RNA, 19 nt, Homo sapiens
ggguaugguuggcauggaa

SEQ ID NO: 1153441 - RNA, 19 nt, Homo sapiens
gaaaaguccagccgcauuu

SEQ ID NO: 1153442 - RNA, 19 nt, Homo sapiens
ggagaaagacaagcagauc

SEQ ID NO: 1153443 - RNA, 19 nt, Homo sapiens
gcagcaagaaggccaagga

SEQ ID NO: 1153444 - RNA, 19 nt, Homo sapiens
caggugaacuaucccaaag

SEQ ID NO: 1153445 - RNA, 19 nt, Homo sapiens
ugaaggaagccaucauugu

SEQ ID NO: 1153446 - RNA, 19 nt, Homo sapiens
uuagugagcggaagaaugu

SEQ ID NO: 1153447 - RNA, 19 nt, Homo sapiens
cacgugugauugacaugua

SEQ ID NO: 1153448 - RNA, 19 nt, Homo sapiens
gauucggccucuccacaug

SEQ ID NO: 1153449 - RNA, 19 nt, Homo sapiens
cagcagcgaugccuuaucc

SEQ ID NO: 1153450 - RNA, 19 nt, Homo sapiens
gcuacaauuuggcuaaggu

SEQ ID NO: 1153451 - RNA, 19 nt, Homo sapiens
ccaccucuauccugcacaa

SEQ ID NO: 1153452 - RNA, 19 nt, Homo sapiens
gagcugaaguugcgaucac

SEQ ID NO: 1153453 - RNA, 19 nt, Homo sapiens
auucagagcggagaaauuu

SEQ ID NO: 1153454 - RNA, 19 nt, Homo sapiens
gcucagcacgggcgaugaa

SEQ ID NO: 1153455 - RNA, 19 nt, Homo sapiens
ugaagcaggagcugaaguu

SEQ ID NO: 1153456 - RNA, 19 nt, Homo sapiens
gcaaagccaacccaagucu

SEQ ID NO: 1153457 - RNA, 19 nt, Homo sapiens
caauuuggcuaagguaggu

SEQ ID NO: 1153458 - RNA, 19 nt, Homo sapiens
ccucggaauugcacuuugu

SEQ ID NO: 1153459 - RNA, 19 nt, Homo sapiens
ccacagggacccaccuugu

SEQ ID NO: 1153460 - RNA, 19 nt, Homo sapiens
ccacacucauuaagcaaag

SEQ ID NO: 1153461 - RNA, 19 nt, Homo sapiens
gggaucaugccgccuuuga

SEQ ID NO: 1153462 - RNA, 19 nt, Homo sapiens
ccaauuugccuccacuuag

SEQ ID NO: 1153463 - RNA, 19 nt, Homo sapiens
gagaagccauccccgaaga

SEQ ID NO: 1153464 - RNA, 19 nt, Homo sapiens
gcaccucccacccucauca

SEQ ID NO: 1153465 - RNA, 19 nt, Homo sapiens
gaaucuccuuccuuucucu

SEQ ID NO: 1153466 - RNA, 19 nt, Homo sapiens
gagccuaucaagaccaaau

SEQ ID NO: 1153467 - RNA, 19 nt, Homo sapiens
gaagcaggagcugaaguug

SEQ ID NO: 1153468 - RNA, 19 nt, Homo sapiens
gaagguggcagagcugaag

SEQ ID NO: 1153469 - RNA, 19 nt, Homo sapiens
gugaaucuccuuccuuucu

SEQ ID NO: 1153470 - RNA, 19 nt, Homo sapiens
ccagggcugagacagguua

SEQ ID NO: 1153471 - RNA, 19 nt, Homo sapiens
ccauggacaccucggaauu

SEQ ID NO: 1153472 - RNA, 19 nt, Homo sapiens
cggagaaauuucagcagau

SEQ ID NO: 1153473 - RNA, 19 nt, Homo sapiens
aagcaaagccaacccaagu

SEQ ID NO: 1153474 - RNA, 19 nt, Homo sapiens
auucugggcugacucauag

SEQ ID NO: 1153475 - RNA, 19 nt, Homo sapiens
ccugcuuccuggcuccuua

SEQ ID NO: 1153476 - RNA, 19 nt, Homo sapiens
cgggaggcuucucuucuga

SEQ ID NO: 1153477 - RNA, 19 nt, Homo sapiens
ucagagcggagaaauuuca

SEQ ID NO: 1153478 - RNA, 19 nt, Homo sapiens
caaccuggacgacaugaag

SEQ ID NO: 1153479 - RNA, 19 nt, Homo sapiens
ccacuggcuucacauucug

SEQ ID NO: 1153480 - RNA, 19 nt, Homo sapiens
cgaccuccauagccagaug

SEQ ID NO: 1153481 - RNA, 19 nt, Homo sapiens
uguuugacauucucauuca

SEQ ID NO: 1153482 - RNA, 19 nt, Homo sapiens
caccaaaacugagcugauu

SEQ ID NO: 1153483 - RNA, 19 nt, Homo sapiens
ugaagcuguugccaaugaa

SEQ ID NO: 1153484 - RNA, 19 nt, Homo sapiens
ccaggugaacuaucccaaa

SEQ ID NO: 1153485 - RNA, 19 nt, Homo sapiens
acagaggacuaucucaaac

SEQ ID NO: 1153486 - RNA, 19 nt, Homo sapiens
cagaagggccuggaugcaa

SEQ ID NO: 1153487 - RNA, 19 nt, Homo sapiens
ggaucaugccgccuuugaa

SEQ ID NO: 1153488 - RNA, 19 nt, Homo sapiens
aagaaugugcuacaguuga

SEQ ID NO: 1153489 - RNA, 19 nt, Homo sapiens
cccaauuugccuccacuua

SEQ ID NO: 1153490 - RNA, 19 nt, Homo sapiens
aaccagugcucguguccuu

SEQ ID NO: 1153491 - RNA, 19 nt, Homo sapiens
gaagagcauuugaggauua

SEQ ID NO: 1153492 - RNA, 19 nt, Homo sapiens
ggacacaccucuccacaau

SEQ ID NO: 1153493 - RNA, 19 nt, Homo sapiens
gcccaacacuaauuaauuu

SEQ ID NO: 1153494 - RNA, 19 nt, Homo sapiens
ggaagaagaugaugaugag

SEQ ID NO: 1153495 - RNA, 19 nt, Homo sapiens
gcccuaagaugauugcuaa

SEQ ID NO: 1153496 - RNA, 19 nt, Homo sapiens
ggaggagacugcugggaaa

SEQ ID NO: 1153497 - RNA, 19 nt, Homo sapiens
gaaggagcauggcaaguca

SEQ ID NO: 1153498 - RNA, 19 nt, Homo sapiens
ggagaaaaccagaccauua

SEQ ID NO: 1153499 - RNA, 19 nt, Homo sapiens
ugacaucccugacauugau

SEQ ID NO: 1153500 - RNA, 19 nt, Homo sapiens
acacaccucuccacaauuc

SEQ ID NO: 1153501 - RNA, 19 nt, Homo sapiens
cuaagaugauugcuaagaa

SEQ ID NO: 1153502 - RNA, 19 nt, Homo sapiens
gaaggaagaagaugaugau

SEQ ID NO: 1153503 - RNA, 19 nt, Homo sapiens
gagcauggcaagucaguga

SEQ ID NO: 1153504 - RNA, 19 nt, Homo sapiens
ggagucgucuucaucuuca

SEQ ID NO: 1153505 - RNA, 19 nt, Homo sapiens
ggugugaacuccaucaagu

SEQ ID NO: 1153506 - RNA, 19 nt, Homo sapiens
gaagaagaagagcauuuga

SEQ ID NO: 1153507 - RNA, 19 nt, Homo sapiens
ggaccaugcuggaacaucu

SEQ ID NO: 1153508 - RNA, 19 nt, Homo sapiens
ucuccaaccugaagaagaa

SEQ ID NO: 1153509 - RNA, 19 nt, Homo sapiens
gaggcccacugaccuguaa

SEQ ID NO: 1153510 - RNA, 19 nt, Homo sapiens
ggaagugaaucugaagaca

SEQ ID NO: 1153511 - RNA, 19 nt, Homo sapiens
gagaaaaccagaccauuaa

SEQ ID NO: 1153512 - RNA, 19 nt, Homo sapiens
guggaggccuucaacaaga

SEQ ID NO: 1153513 - RNA, 19 nt, Homo sapiens
gacuguggcuugugcuuug

SEQ ID NO: 1153514 - RNA, 19 nt, Homo sapiens
ucacaaggacuguaacuca

SEQ ID NO: 1153515 - RNA, 19 nt, Homo sapiens
gugcggaucaagaccauua

SEQ ID NO: 1153516 - RNA, 19 nt, Homo sapiens
uuucugagcccaacacuaa

SEQ ID NO: 1153517 - RNA, 19 nt, Homo sapiens
ggugcaaccuucaaagaca

SEQ ID NO: 1153518 - RNA, 19 nt, Homo sapiens
gggacaggcucucaggaau

SEQ ID NO: 1153519 - RNA, 19 nt, Homo sapiens
ccaaagugcccgucuguca

SEQ ID NO: 1153520 - RNA, 19 nt, Homo sapiens
agacauuucuguagucagu

SEQ ID NO: 1153521 - RNA, 19 nt, Homo sapiens
gacccuccauuccuccuuu

SEQ ID NO: 1153522 - RNA, 19 nt, Homo sapiens
aggccaagcugaucuacaa

SEQ ID NO: 1153523 - RNA, 19 nt, Homo sapiens
ggcauggacuggaacuuuc

SEQ ID NO: 1153524 - RNA, 19 nt, Homo sapiens
cugaggagcuggcuguuuc

SEQ ID NO: 1153525 - RNA, 19 nt, Homo sapiens
caagaacacccaucagucu

SEQ ID NO: 1153526 - RNA, 19 nt, Homo sapiens
gacacagucuucacucaca

SEQ ID NO: 1153527 - RNA, 19 nt, Homo sapiens
ucaacaagauccucaacag

SEQ ID NO: 1153528 - RNA, 19 nt, Homo sapiens
ccaagcugaucuacaagug

SEQ ID NO: 1153529 - RNA, 19 nt, Homo sapiens
gaagccagaaccaggugua

SEQ ID NO: 1153530 - RNA, 19 nt, Homo sapiens
gaagaccccugauuuugau

SEQ ID NO: 1153531 - RNA, 19 nt, Homo sapiens
cccaaucgcugcagcuuca

SEQ ID NO: 1153532 - RNA, 19 nt, Homo sapiens
ucagugucauugucaagaa

SEQ ID NO: 1153533 - RNA, 19 nt, Homo sapiens
gaaaaccagaccauuaaaa

SEQ ID NO: 1153534 - RNA, 19 nt, Homo sapiens
ccaacucacuggcacucaa

SEQ ID NO: 1153535 - RNA, 19 nt, Homo sapiens
gcccuggaguccuagugua

SEQ ID NO: 1153536 - RNA, 19 nt, Homo sapiens
gagcauuugaggauuauuc

SEQ ID NO: 1153537 - RNA, 19 nt, Homo sapiens
ucccugagcgugaugaaua

SEQ ID NO: 1153538 - RNA, 19 nt, Homo sapiens
gaggagucgucuucaucuu

SEQ ID NO: 1153539 - RNA, 19 nt, Homo sapiens
uguaggaagugaaucugaa

SEQ ID NO: 1153540 - RNA, 19 nt, Homo sapiens
ucugggaucugccgauaug

SEQ ID NO: 1153541 - RNA, 19 nt, Homo sapiens
ggugggaggaugggacuua

SEQ ID NO: 1153542 - RNA, 19 nt, Homo sapiens
caccagcgcaugcauaaga

SEQ ID NO: 1153543 - RNA, 19 nt, Homo sapiens
gcaugcacgugaacacaag

SEQ ID NO: 1153544 - RNA, 19 nt, Homo sapiens
uaagaugauugcuaagaac

SEQ ID NO: 1153545 - RNA, 19 nt, Homo sapiens
gaggaugggacuuagguau

SEQ ID NO: 1153546 - RNA, 19 nt, Homo sapiens
aagaagagcauuugaggau

SEQ ID NO: 1153547 - RNA, 19 nt, Homo sapiens
gcagccgccugauccuaga

SEQ ID NO: 1153548 - RNA, 19 nt, Homo sapiens
gcgacacagucuucacuca

SEQ ID NO: 1153549 - RNA, 19 nt, Homo sapiens
caucccagcuuccaaacuc

SEQ ID NO: 1153550 - RNA, 19 nt, Homo sapiens
acaagauccucaacagcaa

SEQ ID NO: 1153551 - RNA, 19 nt, Homo sapiens
ggacaggcucucaggaauc

SEQ ID NO: 1153552 - RNA, 19 nt, Homo sapiens
ugaagaagaagagcauuug

SEQ ID NO: 1153553 - RNA, 19 nt, Homo sapiens
gcuggaacaucucaagaac

SEQ ID NO: 1153554 - RNA, 19 nt, Homo sapiens
ggccaccucugcuuacaca

SEQ ID NO: 1153555 - RNA, 19 nt, Homo sapiens
gucaugcagugcucacauu

SEQ ID NO: 1153556 - RNA, 19 nt, Homo sapiens
gaauaucacaaggacugua

SEQ ID NO: 1153557 - RNA, 19 nt, Homo sapiens
ggaugggacuuagguaugc

SEQ ID NO: 1153558 - RNA, 19 nt, Homo sapiens
uguaaggucuguggcaaga

SEQ ID NO: 1153559 - RNA, 19 nt, Homo sapiens
gaggcgccaugucagaguu

SEQ ID NO: 1153560 - RNA, 19 nt, Homo sapiens
caccagcccuaagaugauu

SEQ ID NO: 1153561 - RNA, 19 nt, Homo sapiens
ggacugccaccagcccuaa

SEQ ID NO: 1153562 - RNA, 19 nt, Homo sapiens
cagaugaggacagcaauga

SEQ ID NO: 1153563 - RNA, 19 nt, Homo sapiens
ggaccuguuugcucauuuu

SEQ ID NO: 1153564 - RNA, 19 nt, Homo sapiens
gagggcaucaagcgaguuu

SEQ ID NO: 1153565 - RNA, 19 nt, Homo sapiens
gccaccagcccuaagauga

SEQ ID NO: 1153566 - RNA, 19 nt, Homo sapiens
gagcccaacacuaauuaau

SEQ ID NO: 1153567 - RNA, 19 nt, Homo sapiens
agaagagcauuugaggauu

SEQ ID NO: 1153568 - RNA, 19 nt, Homo sapiens
aaaggaccaugcuggaaca

SEQ ID NO: 1153569 - RNA, 19 nt, Homo sapiens
cagcaucccagcuuccaaa

SEQ ID NO: 1153570 - RNA, 19 nt, Homo sapiens
gggaugccuucucauugga

SEQ ID NO: 1153571 - RNA, 19 nt, Homo sapiens
cugcaacaccuacuucuga

SEQ ID NO: 1153572 - RNA, 19 nt, Homo sapiens
ugaaggaagaagaugauga

SEQ ID NO: 1153573 - RNA, 19 nt, Homo sapiens
aagugaaucugaagacaca

SEQ ID NO: 1153574 - RNA, 19 nt, Homo sapiens
uaacucagguccccucaga

SEQ ID NO: 1153575 - RNA, 19 nt, Homo sapiens
ugaccuccuugcugccuuu

SEQ ID NO: 1153576 - RNA, 19 nt, Homo sapiens
cuucaggcauggacuggaa

SEQ ID NO: 1153577 - RNA, 19 nt, Homo sapiens
guuuggcccuggaguccua

SEQ ID NO: 1153578 - RNA, 19 nt, Homo sapiens
gcauggcaagucagugaaa

SEQ ID NO: 1153579 - RNA, 19 nt, Homo sapiens
cuacugaggagucgucuuc

SEQ ID NO: 1153580 - RNA, 19 nt, Homo sapiens
caucaccuccucugccauu

SEQ ID NO: 1153581 - RNA, 19 nt, Homo sapiens
cuccauuccuccuuucuga

SEQ ID NO: 1153582 - RNA, 19 nt, Homo sapiens
agaaccagguguaggaagu

SEQ ID NO: 1153583 - RNA, 19 nt, Homo sapiens
cagcgugucagugucuuua

SEQ ID NO: 1153584 - RNA, 19 nt, Homo sapiens
gcuguucagugguguuugg

SEQ ID NO: 1153585 - RNA, 19 nt, Homo sapiens
ccaugucuguccugagugu

SEQ ID NO: 1153586 - RNA, 19 nt, Homo sapiens
gaaccugcucccugccuau

SEQ ID NO: 1153587 - RNA, 19 nt, Homo sapiens
ggaggaugggacuuaggua

SEQ ID NO: 1153588 - RNA, 19 nt, Homo sapiens
gccagaaccagguguagga

SEQ ID NO: 1153589 - RNA, 19 nt, Homo sapiens
gcuggggaguuuucauuaa

SEQ ID NO: 1153590 - RNA, 19 nt, Homo sapiens
gcuccugcaugcacgugaa

SEQ ID NO: 1153591 - RNA, 19 nt, Homo sapiens
gaaguuguguccacgaaga

SEQ ID NO: 1153592 - RNA, 19 nt, Homo sapiens
acaacgagcucuauaggaa

SEQ ID NO: 1153593 - RNA, 19 nt, Homo sapiens
caacagccaucugcuagaa

SEQ ID NO: 1153594 - RNA, 19 nt, Homo sapiens
agagggagcugaaacaaau

SEQ ID NO: 1153595 - RNA, 19 nt, Homo sapiens
gcccagagcuagugaacga

SEQ ID NO: 1153596 - RNA, 19 nt, Homo sapiens
gcccagaacuccacugaca

SEQ ID NO: 1153597 - RNA, 19 nt, Homo sapiens
uggagaaggucacggagaa

SEQ ID NO: 1153598 - RNA, 19 nt, Homo sapiens
gcaagcggcuguccuacac

SEQ ID NO: 1153599 - RNA, 19 nt, Homo sapiens
gaagagggagcugaaacaa

SEQ ID NO: 1153600 - RNA, 19 nt, Homo sapiens
gaggacaacgagcucuaua

SEQ ID NO: 1153601 - RNA, 19 nt, Homo sapiens
gcaugggccagcacuauga

SEQ ID NO: 1153602 - RNA, 19 nt, Homo sapiens
gagaagcugcgcaggauuc

SEQ ID NO: 1153603 - RNA, 19 nt, Homo sapiens
gcauucuuguugucucuga

SEQ ID NO: 1153604 - RNA, 19 nt, Homo sapiens
gcaaggacagccucaccaa

SEQ ID NO: 1153605 - RNA, 19 nt, Homo sapiens
aggaaggacugcaaucuag

SEQ ID NO: 1153606 - RNA, 19 nt, Homo sapiens
ggacaacgagcucuauagg

SEQ ID NO: 1153607 - RNA, 19 nt, Homo sapiens
ccgcagacauggagaaacu

SEQ ID NO: 1153608 - RNA, 19 nt, Homo sapiens
gcgcugagccacgagauug

SEQ ID NO: 1153609 - RNA, 19 nt, Homo sapiens
ccacgaagagggagcugaa

SEQ ID NO: 1153610 - RNA, 19 nt, Homo sapiens
augcaugcccugccaguua

SEQ ID NO: 1153611 - RNA, 19 nt, Homo sapiens
uagcuugcauucuuguugu

SEQ ID NO: 1153612 - RNA, 19 nt, Homo sapiens
gcagugacacagcccucua

SEQ ID NO: 1153613 - RNA, 19 nt, Homo sapiens
uaggaaggacugcaaucua

SEQ ID NO: 1153614 - RNA, 19 nt, Homo sapiens
gccacuaccuggagaucga

SEQ ID NO: 1153615 - RNA, 19 nt, Homo sapiens
cggagaagcugcgcaggau

SEQ ID NO: 1153616 - RNA, 19 nt, Homo sapiens
ggcccuccauuccugguuu

SEQ ID NO: 1153617 - RNA, 19 nt, Homo sapiens
ccacacacaagcucgagaa

SEQ ID NO: 1153618 - RNA, 19 nt, Homo sapiens
aggaggaacuggagaaggu

SEQ ID NO: 1153619 - RNA, 19 nt, Homo sapiens
gcagacauggagaaacuca

SEQ ID NO: 1153620 - RNA, 19 nt, Homo sapiens
guagcuugcauucuuguug

SEQ ID NO: 1153621 - RNA, 19 nt, Homo sapiens
cgaagagggagcugaaaca

SEQ ID NO: 1153622 - RNA, 19 nt, Homo sapiens
gacaucuacugcagugaca

SEQ ID NO: 1153623 - RNA, 19 nt, Homo sapiens
gcgugagccugcacaugga

SEQ ID NO: 1153624 - RNA, 19 nt, Homo sapiens
gacaacgagcucuauagga

SEQ ID NO: 1153625 - RNA, 19 nt, Homo sapiens
ucaccaaggcccagcucua

SEQ ID NO: 1153626 - RNA, 19 nt, Homo sapiens
gcuacaaggccgacagcuu

SEQ ID NO: 1153627 - RNA, 19 nt, Homo sapiens
gcaggauucagagcaacua

SEQ ID NO: 1153628 - RNA, 19 nt, Homo sapiens
ggagaagcugcgcaggauu

SEQ ID NO: 1153629 - RNA, 19 nt, Homo sapiens
ccacgucggaggagaagga

SEQ ID NO: 1153630 - RNA, 19 nt, Homo sapiens
gcucuacgccagcuacaag

SEQ ID NO: 1153631 - RNA, 19 nt, Homo sapiens
ccucaacagccaucugcua

SEQ ID NO: 1153632 - RNA, 19 nt, Homo sapiens
uugccaaggugcuggagaa

SEQ ID NO: 1153633 - RNA, 19 nt, Homo sapiens
ggauucagagcaacuacau

SEQ ID NO: 1153634 - RNA, 19 nt, Homo sapiens
gaaacaaauucggggcuau

SEQ ID NO: 1153635 - RNA, 19 nt, Homo sapiens
aagccaaggugaccaucga

SEQ ID NO: 1153636 - RNA, 19 nt, Homo sapiens
caaggugaccaucgacaag

SEQ ID NO: 1153637 - RNA, 19 nt, Homo sapiens
ccaaggugaccaucgacaa

SEQ ID NO: 1153638 - RNA, 19 nt, Homo sapiens
ucuguagcuugcauucuug

SEQ ID NO: 1153639 - RNA, 19 nt, Homo sapiens
aagagggagcugaaacaaa

SEQ ID NO: 1153640 - RNA, 19 nt, Homo sapiens
cugaaguuguguccacgaa

SEQ ID NO: 1153641 - RNA, 19 nt, Homo sapiens
cgucgcagcaggccaucua

SEQ ID NO: 1153642 - RNA, 19 nt, Homo sapiens
cuacaagggagacaucuac

SEQ ID NO: 1153643 - RNA, 19 nt, Homo sapiens
aaaagacaccgguggaaaa

SEQ ID NO: 1153644 - RNA, 19 nt, Homo sapiens
uacggaaccuugcucaacu

SEQ ID NO: 1153645 - RNA, 19 nt, Homo sapiens
aagcugcgcaggauucaga

SEQ ID NO: 1153646 - RNA, 19 nt, Homo sapiens
gggcccagaacuccacuga

SEQ ID NO: 1153647 - RNA, 19 nt, Homo sapiens
gagcugcccucggauuucc

SEQ ID NO: 1153648 - RNA, 19 nt, Homo sapiens
acauggcacugcagaggau

SEQ ID NO: 1153649 - RNA, 19 nt, Homo sapiens
gagggagcugaaacaaauu

SEQ ID NO: 1153650 - RNA, 19 nt, Homo sapiens
ccaacaacgaggagucugu

SEQ ID NO: 1153651 - RNA, 19 nt, Homo sapiens
cuccauuccugguuucugu

SEQ ID NO: 1153652 - RNA, 19 nt, Homo sapiens
cgucuuacucuaccucaga

SEQ ID NO: 1153653 - RNA, 19 nt, Homo sapiens
uucuguagcuugcauucuu

SEQ ID NO: 1153654 - RNA, 19 nt, Homo sapiens
ggccauaccuuacuauuua

SEQ ID NO: 1153655 - RNA, 19 nt, Homo sapiens
gcaaagacguggccacauu

SEQ ID NO: 1153656 - RNA, 19 nt, Homo sapiens
gagaugaaguggagaagua

SEQ ID NO: 1153657 - RNA, 19 nt, Homo sapiens
caagcaagauccauauaua

SEQ ID NO: 1153658 - RNA, 19 nt, Homo sapiens
acagggauguuaacuauua

SEQ ID NO: 1153659 - RNA, 19 nt, Homo sapiens
gaacacaugugaauccaau

SEQ ID NO: 1153660 - RNA, 19 nt, Homo sapiens
gaccuuaucuacccauuaa

SEQ ID NO: 1153661 - RNA, 19 nt, Homo sapiens
ggucgagacucuaucauaa

SEQ ID NO: 1153662 - RNA, 19 nt, Homo sapiens
gaagggacaggaagauuua

SEQ ID NO: 1153663 - RNA, 19 nt, Homo sapiens
agacaagccuccuguauga

SEQ ID NO: 1153664 - RNA, 19 nt, Homo sapiens
ggaauuugcuguugcacaa

SEQ ID NO: 1153665 - RNA, 19 nt, Homo sapiens
ugucacaacuucuucuuua

SEQ ID NO: 1153666 - RNA, 19 nt, Homo sapiens
aggaagaucuguugaaauu

SEQ ID NO: 1153667 - RNA, 19 nt, Homo sapiens
gacaaugacuguacaaauc

SEQ ID NO: 1153668 - RNA, 19 nt, Homo sapiens
ggauaaacacuucaacuuu

SEQ ID NO: 1153669 - RNA, 19 nt, Homo sapiens
gaucuuguauagaguguaa

SEQ ID NO: 1153670 - RNA, 19 nt, Homo sapiens
gcuccuggauauucauuua

SEQ ID NO: 1153671 - RNA, 19 nt, Homo sapiens
guaggaagaucuguugaaa

SEQ ID NO: 1153672 - RNA, 19 nt, Homo sapiens
cagcagagauguauagcaa

SEQ ID NO: 1153673 - RNA, 19 nt, Homo sapiens
ccacauuucuaauaaguug

SEQ ID NO: 1153674 - RNA, 19 nt, Homo sapiens
gugaaggcauugcuauuaa

SEQ ID NO: 1153675 - RNA, 19 nt, Homo sapiens
gaaccagcccauuucauaa

SEQ ID NO: 1153676 - RNA, 19 nt, Homo sapiens
gugcagguuuccuauguua

SEQ ID NO: 1153677 - RNA, 19 nt, Homo sapiens
gaaggcauguaaaguugaa

SEQ ID NO: 1153678 - RNA, 19 nt, Homo sapiens
ggaagggacaggaagauuu

SEQ ID NO: 1153679 - RNA, 19 nt, Homo sapiens
guaaaggccuuagcauaug

SEQ ID NO: 1153680 - RNA, 19 nt, Homo sapiens
ugacaucacuguggauaaa

SEQ ID NO: 1153681 - RNA, 19 nt, Homo sapiens
acaacuaagucuacaguaa

SEQ ID NO: 1153682 - RNA, 19 nt, Homo sapiens
gcagagauguauagcaaca

SEQ ID NO: 1153683 - RNA, 19 nt, Homo sapiens
ucucagauguguucuugua

SEQ ID NO: 1153684 - RNA, 19 nt, Homo sapiens
uaaggacacauaaggauua

SEQ ID NO: 1153685 - RNA, 19 nt, Homo sapiens
accacuagcucuucuaaua

SEQ ID NO: 1153686 - RNA, 19 nt, Homo sapiens
gaaguaaaccauguaaaug

SEQ ID NO: 1153687 - RNA, 19 nt, Homo sapiens
caaauugguucucaguaga

SEQ ID NO: 1153688 - RNA, 19 nt, Homo sapiens
caacuaagucuacaguaaa

SEQ ID NO: 1153689 - RNA, 19 nt, Homo sapiens
caacauaccgaguccauga

SEQ ID NO: 1153690 - RNA, 19 nt, Homo sapiens
caaccgaaauggagucaau

SEQ ID NO: 1153691 - RNA, 19 nt, Homo sapiens
gaauauggagugucaauca

SEQ ID NO: 1153692 - RNA, 19 nt, Homo sapiens
agacuuugcuuccuccuuu

SEQ ID NO: 1153693 - RNA, 19 nt, Homo sapiens
aaagauagacucucugcua

SEQ ID NO: 1153694 - RNA, 19 nt, Homo sapiens
gaagaucuguugaaauucc

SEQ ID NO: 1153695 - RNA, 19 nt, Homo sapiens
caguagauaugaaggcuuu

SEQ ID NO: 1153696 - RNA, 19 nt, Homo sapiens
aaaccagucuccaugugua

SEQ ID NO: 1153697 - RNA, 19 nt, Homo sapiens
ugaauacucuaacagcauu

SEQ ID NO: 1153698 - RNA, 19 nt, Homo sapiens
gggagaucauagugaguua

SEQ ID NO: 1153699 - RNA, 19 nt, Homo sapiens
ccagggaggugcagcaguu

SEQ ID NO: 1153700 - RNA, 19 nt, Homo sapiens
gauagacucucugcuagug

SEQ ID NO: 1153701 - RNA, 19 nt, Homo sapiens
ccaauaauaauguggcaua

SEQ ID NO: 1153702 - RNA, 19 nt, Homo sapiens
uagcauaugccaaggauaa

SEQ ID NO: 1153703 - RNA, 19 nt, Homo sapiens
ccacaacugucucuguuuc

SEQ ID NO: 1153704 - RNA, 19 nt, Homo sapiens
caacuuggauaaugagucu

SEQ ID NO: 1153705 - RNA, 19 nt, Homo sapiens
gaaaagguguuacggguau

SEQ ID NO: 1153706 - RNA, 19 nt, Homo sapiens
gcacaagcaagauccauau

SEQ ID NO: 1153707 - RNA, 19 nt, Homo sapiens
gagagcaaccagcuucuuu

SEQ ID NO: 1153708 - RNA, 19 nt, Homo sapiens
agucuaugcuucuuaauga

SEQ ID NO: 1153709 - RNA, 19 nt, Homo sapiens
caacauuaaggacacauaa

SEQ ID NO: 1153710 - RNA, 19 nt, Homo sapiens
gagacucuaucauaagaau

SEQ ID NO: 1153711 - RNA, 19 nt, Homo sapiens
gacauucgggugcuaauuu

SEQ ID NO: 1153712 - RNA, 19 nt, Homo sapiens
ugaaggcauugcuauuaaa

SEQ ID NO: 1153713 - RNA, 19 nt, Homo sapiens
uuaaagggcacacggauaa

SEQ ID NO: 1153714 - RNA, 19 nt, Homo sapiens
gcagguuuccuauguuauu

SEQ ID NO: 1153715 - RNA, 19 nt, Homo sapiens
gaauaaagggagaucauag

SEQ ID NO: 1153716 - RNA, 19 nt, Homo sapiens
agaaccagcccauuucaua

SEQ ID NO: 1153717 - RNA, 19 nt, Homo sapiens
gauauucauuuacgaccuu

SEQ ID NO: 1153718 - RNA, 19 nt, Homo sapiens
ccacuagcucuucuaauaa

SEQ ID NO: 1153719 - RNA, 19 nt, Homo sapiens
gaauuuaggaggacuuuua

SEQ ID NO: 1153720 - RNA, 19 nt, Homo sapiens
gguaugggauccaagaaca

SEQ ID NO: 1153721 - RNA, 19 nt, Homo sapiens
ggaaugcacacaagggauu

SEQ ID NO: 1153722 - RNA, 19 nt, Homo sapiens
aagaagauauugcuguguu

SEQ ID NO: 1153723 - RNA, 19 nt, Homo sapiens
acaggaagauuuauuguac

SEQ ID NO: 1153724 - RNA, 19 nt, Homo sapiens
cguaaaggccuuagcauau

SEQ ID NO: 1153725 - RNA, 19 nt, Homo sapiens
ucauuuggaucuuguauag

SEQ ID NO: 1153726 - RNA, 19 nt, Homo sapiens
ggccacaacugucucuguu

SEQ ID NO: 1153727 - RNA, 19 nt, Homo sapiens
gggcuaaugcuccuggaua

SEQ ID NO: 1153728 - RNA, 19 nt, Homo sapiens
uauaacaccucuuuguaca

SEQ ID NO: 1153729 - RNA, 19 nt, Homo sapiens
gacaggaagauuuauugua

SEQ ID NO: 1153730 - RNA, 19 nt, Homo sapiens
gggauaaacacuucaacuu

SEQ ID NO: 1153731 - RNA, 19 nt, Homo sapiens
gaaaaguuauggaacaugu

SEQ ID NO: 1153732 - RNA, 19 nt, Homo sapiens
agauggagcuugauagauc

SEQ ID NO: 1153733 - RNA, 19 nt, Homo sapiens
guggccacauuucuaauaa

SEQ ID NO: 1153734 - RNA, 19 nt, Homo sapiens
caaagacguggccacauuu

SEQ ID NO: 1153735 - RNA, 19 nt, Homo sapiens
caauugaagugacuaaucg

SEQ ID NO: 1153736 - RNA, 19 nt, Homo sapiens
uaacaccucuuuguacaca

SEQ ID NO: 1153737 - RNA, 19 nt, Homo sapiens
ggacagacaaauauuccuu

SEQ ID NO: 1153738 - RNA, 19 nt, Homo sapiens
ggauaaagaacuaguagca

SEQ ID NO: 1153739 - RNA, 19 nt, Homo sapiens
auaagaauauggaguguca

SEQ ID NO: 1153740 - RNA, 19 nt, Homo sapiens
ccaaguuugucauauaaag

SEQ ID NO: 1153741 - RNA, 19 nt, Homo sapiens
gaaguacaaccgaaaugga

SEQ ID NO: 1153742 - RNA, 19 nt, Homo sapiens
ucuaacggcugauugguau

SEQ ID NO: 1153743 - RNA, 19 nt, Homo sapiens
ggugcuaauuugugaagaa

SEQ ID NO: 1153744 - RNA, 19 nt, Homo sapiens
ggaccuuaucuacccauua

SEQ ID NO: 1153745 - RNA, 19 nt, Homo sapiens
gcagaagggaaauggauau

SEQ ID NO: 1153746 - RNA, 19 nt, Homo sapiens
ggaugaaagugauuguuuu

SEQ ID NO: 1153747 - RNA, 19 nt, Homo sapiens
gcaaaacuaaugaagcuua

SEQ ID NO: 1153748 - RNA, 19 nt, Homo sapiens
ugaaucaacugggaacaau

SEQ ID NO: 1153749 - RNA, 19 nt, Homo sapiens
gacauuguacucuguugua

SEQ ID NO: 1153750 - RNA, 19 nt, Homo sapiens
guggaaguauacauauuug

SEQ ID NO: 1153751 - RNA, 19 nt, Homo sapiens
gaaaccagucuccaugugu

SEQ ID NO: 1153752 - RNA, 19 nt, Homo sapiens
cgucagaaguccacgugaa

SEQ ID NO: 1153753 - RNA, 19 nt, Homo sapiens
aaugaugccuucacacaug

SEQ ID NO: 1153754 - RNA, 19 nt, Homo sapiens
gcacaccacugaagagauu

SEQ ID NO: 1153755 - RNA, 19 nt, Homo sapiens
ggaagagucuccaaggaaa

SEQ ID NO: 1153756 - RNA, 19 nt, Homo sapiens
gaaauugucuucuguuggu

SEQ ID NO: 1153757 - RNA, 19 nt, Homo sapiens
gaaagcagauguccugagu

SEQ ID NO: 1153758 - RNA, 19 nt, Homo sapiens
gcagugagcacacguauga

SEQ ID NO: 1153759 - RNA, 19 nt, Homo sapiens
ggacagugguaccagauga

SEQ ID NO: 1153760 - RNA, 19 nt, Homo sapiens
ggacucggcugaugaugga

SEQ ID NO: 1153761 - RNA, 19 nt, Homo sapiens
uccaggaacugcucaaaua

SEQ ID NO: 1153762 - RNA, 19 nt, Homo sapiens
ccagaucacuccaagaaga

SEQ ID NO: 1153763 - RNA, 19 nt, Homo sapiens
gaaaggagcagaaggucuu

SEQ ID NO: 1153764 - RNA, 19 nt, Homo sapiens
gaacaucggcaaugggauu

SEQ ID NO: 1153765 - RNA, 19 nt, Homo sapiens
ggacugagaccgugguuga

SEQ ID NO: 1153766 - RNA, 19 nt, Homo sapiens
cagaacauccaacgucuua

SEQ ID NO: 1153767 - RNA, 19 nt, Homo sapiens
ggaagaggaagaagaagaa

SEQ ID NO: 1153768 - RNA, 19 nt, Homo sapiens
cagaaagccugccugaaug

SEQ ID NO: 1153769 - RNA, 19 nt, Homo sapiens
aaagauagcccgacacuuc

SEQ ID NO: 1153770 - RNA, 19 nt, Homo sapiens
gaagaucaccaaggaugua

SEQ ID NO: 1153771 - RNA, 19 nt, Homo sapiens
ccacauugcuguccaguac

SEQ ID NO: 1153772 - RNA, 19 nt, Homo sapiens
aaacucagcccuccguuaa

SEQ ID NO: 1153773 - RNA, 19 nt, Homo sapiens
gcacacagccacaggugaa

SEQ ID NO: 1153774 - RNA, 19 nt, Homo sapiens
ccguauaugucccagaaua

SEQ ID NO: 1153775 - RNA, 19 nt, Homo sapiens
ccaacuaccugcucuccaa

SEQ ID NO: 1153776 - RNA, 19 nt, Homo sapiens
ggcaacaccugcuuucuca

SEQ ID NO: 1153777 - RNA, 19 nt, Homo sapiens
guaaacgaguagcauguau

SEQ ID NO: 1153778 - RNA, 19 nt, Homo sapiens
gcaaggacucggcugauga

SEQ ID NO: 1153779 - RNA, 19 nt, Homo sapiens
gaccugggauggcaagaug

SEQ ID NO: 1153780 - RNA, 19 nt, Homo sapiens
acuuauagcuuggaaauug

SEQ ID NO: 1153781 - RNA, 19 nt, Homo sapiens
gauguaggcuauccggaau

SEQ ID NO: 1153782 - RNA, 19 nt, Homo sapiens
ugacugggacgaagaguuu

SEQ ID NO: 1153783 - RNA, 19 nt, Homo sapiens
caaacucagcccuccguua

SEQ ID NO: 1153784 - RNA, 19 nt, Homo sapiens
cucaaauacucaucugaua

SEQ ID NO: 1153785 - RNA, 19 nt, Homo sapiens
caccaaggauguaggcuau

SEQ ID NO: 1153786 - RNA, 19 nt, Homo sapiens
ccaccguucugacugcuuu

SEQ ID NO: 1153787 - RNA, 19 nt, Homo sapiens
uaaacgaguagcauguaua

SEQ ID NO: 1153788 - RNA, 19 nt, Homo sapiens
cagcaggugggauguguua

SEQ ID NO: 1153789 - RNA, 19 nt, Homo sapiens
cuaagacggugaagcugaa

SEQ ID NO: 1153790 - RNA, 19 nt, Homo sapiens
ugucauguauggacucuau

SEQ ID NO: 1153791 - RNA, 19 nt, Homo sapiens
caucucaaaugcccaagga

SEQ ID NO: 1153792 - RNA, 19 nt, Homo sapiens
ggaggacgcgcaugaguuc

SEQ ID NO: 1153793 - RNA, 19 nt, Homo sapiens
cuacaugugugcuaaaugc

SEQ ID NO: 1153794 - RNA, 19 nt, Homo sapiens
caaguuggaucgucaaacg

SEQ ID NO: 1153795 - RNA, 19 nt, Homo sapiens
ggaagaggaagaggaagaa

SEQ ID NO: 1153796 - RNA, 19 nt, Homo sapiens
ccacuuggcccguccauag

SEQ ID NO: 1153797 - RNA, 19 nt, Homo sapiens
gagagaaugccuacaugug

SEQ ID NO: 1153798 - RNA, 19 nt, Homo sapiens
gcccgacacuuccgcuuug

SEQ ID NO: 1153799 - RNA, 19 nt, Homo sapiens
gcaggaagcggaggaggaa

SEQ ID NO: 1153800 - RNA, 19 nt, Homo sapiens
caaguggagcagauucuaa

SEQ ID NO: 1153801 - RNA, 19 nt, Homo sapiens
ccacacacaugccaaccau

SEQ ID NO: 1153802 - RNA, 19 nt, Homo sapiens
gaacauccaacgucuuaac

SEQ ID NO: 1153803 - RNA, 19 nt, Homo sapiens
gcaagagcuucuccuacca

SEQ ID NO: 1153804 - RNA, 19 nt, Homo sapiens
gccaauaguggauaaguug

SEQ ID NO: 1153805 - RNA, 19 nt, Homo sapiens
cuucaacgccuuccagaaa

SEQ ID NO: 1153806 - RNA, 19 nt, Homo sapiens
guccguauaugucccagaa

SEQ ID NO: 1153807 - RNA, 19 nt, Homo sapiens
ggagagaaugccuacaugu

SEQ ID NO: 1153808 - RNA, 19 nt, Homo sapiens
caccaccucuagccaacua

SEQ ID NO: 1153809 - RNA, 19 nt, Homo sapiens
caacaccugcuuucucaau

SEQ ID NO: 1153810 - RNA, 19 nt, Homo sapiens
gcucuucauugaccugugu

SEQ ID NO: 1153811 - RNA, 19 nt, Homo sapiens
gagagaagaggagaaacuu

SEQ ID NO: 1153812 - RNA, 19 nt, Homo sapiens
gcucaaauacucaucugau

SEQ ID NO: 1153813 - RNA, 19 nt, Homo sapiens
ucucugcgauucucaggaa

SEQ ID NO: 1153814 - RNA, 19 nt, Homo sapiens
agacgacccuggaaagaag

SEQ ID NO: 1153815 - RNA, 19 nt, Homo sapiens
uggaaauugucuucuguug

SEQ ID NO: 1153816 - RNA, 19 nt, Homo sapiens
cggaacuucuggucuguga

SEQ ID NO: 1153817 - RNA, 19 nt, Homo sapiens
gauaaagcuuacgggagaa

SEQ ID NO: 1153818 - RNA, 19 nt, Homo sapiens
gggaagaggaagaggaaga

SEQ ID NO: 1153819 - RNA, 19 nt, Homo sapiens
caucggcaaugggauuauu

SEQ ID NO: 1153820 - RNA, 19 nt, Homo sapiens
gcuguucuaucugcgaauu

SEQ ID NO: 1153821 - RNA, 19 nt, Homo sapiens
uccaacgucuuaacccuuu

SEQ ID NO: 1153822 - RNA, 19 nt, Homo sapiens
gaggaaaggagcagaaggu

SEQ ID NO: 1153823 - RNA, 19 nt, Homo sapiens
uaauggugauccugucaug

SEQ ID NO: 1153824 - RNA, 19 nt, Homo sapiens
caggagcgcuuacauucag

SEQ ID NO: 1153825 - RNA, 19 nt, Homo sapiens
ggagcuagucgccacaaga

SEQ ID NO: 1153826 - RNA, 19 nt, Homo sapiens
aaagagcaaauauguguug

SEQ ID NO: 1153827 - RNA, 19 nt, Homo sapiens
ccggcaagcugcgaauauu

SEQ ID NO: 1153828 - RNA, 19 nt, Homo sapiens
ucacuuauagcuuggaaau

SEQ ID NO: 1153829 - RNA, 19 nt, Homo sapiens
agaggaagaggaagaagaa

SEQ ID NO: 1153830 - RNA, 19 nt, Homo sapiens
ggaagaucaccaaggaugu

SEQ ID NO: 1153831 - RNA, 19 nt, Homo sapiens
gcgcaggacuccacaaccu

SEQ ID NO: 1153832 - RNA, 19 nt, Homo sapiens
agaagaacaucggcaaugg

SEQ ID NO: 1153833 - RNA, 19 nt, Homo sapiens
cgaauuccaggcucuaaga

SEQ ID NO: 1153834 - RNA, 19 nt, Homo sapiens
cuacuaccuugguccauca

SEQ ID NO: 1153835 - RNA, 19 nt, Homo sapiens
ccaugccaauaguggauaa

SEQ ID NO: 1153836 - RNA, 19 nt, Homo sapiens
gcuuggaaauugucuucug

SEQ ID NO: 1153837 - RNA, 19 nt, Homo sapiens
acucagcccuccguuaaga

SEQ ID NO: 1153838 - RNA, 19 nt, Homo sapiens
gaacugcucaaauacucau

SEQ ID NO: 1153839 - RNA, 19 nt, Homo sapiens
ggagagcgggagucugaug

SEQ ID NO: 1153840 - RNA, 19 nt, Homo sapiens
gaauuccaggcucuaagaa

SEQ ID NO: 1153841 - RNA, 19 nt, Homo sapiens
aaacgcaggcuacuaccuu

SEQ ID NO: 1153842 - RNA, 19 nt, Homo sapiens
gaacuucuggucugugacu

SEQ ID NO: 1153843 - RNA, 19 nt, Homo sapiens
auacucaucugauaaagcu

SEQ ID NO: 1153844 - RNA, 19 nt, Homo sapiens
cguauaugucccagaauaa

SEQ ID NO: 1153845 - RNA, 19 nt, Homo sapiens
caauaguggauaaguugaa

SEQ ID NO: 1153846 - RNA, 19 nt, Homo sapiens
gggaaggaaaagaaaauua

SEQ ID NO: 1153847 - RNA, 19 nt, Homo sapiens
cugagaccgugguugauga

SEQ ID NO: 1153848 - RNA, 19 nt, Homo sapiens
ucagucaggaugcuauuga

SEQ ID NO: 1153849 - RNA, 19 nt, Homo sapiens
acucaucugauaaagcuua

SEQ ID NO: 1153850 - RNA, 19 nt, Homo sapiens
agacacagcgggcaguaga

SEQ ID NO: 1153851 - RNA, 19 nt, Homo sapiens
ggagacacagcgggcagua

SEQ ID NO: 1153852 - RNA, 19 nt, Homo sapiens
gaugcaccaugccaauagu

SEQ ID NO: 1153853 - RNA, 19 nt, Homo sapiens
ccagacacccacacacaug

SEQ ID NO: 1153854 - RNA, 19 nt, Homo sapiens
gagaaaggcuguaucuuaa

SEQ ID NO: 1153855 - RNA, 19 nt, Homo sapiens
gaaaggcuguaucuuaauu

SEQ ID NO: 1153856 - RNA, 19 nt, Homo sapiens
agagaaaggcuguaucuua

SEQ ID NO: 1153857 - RNA, 19 nt, Homo sapiens
gaaauucuccaucgacauu

SEQ ID NO: 1153858 - RNA, 19 nt, Homo sapiens
gcacagaguucguggucuu

SEQ ID NO: 1153859 - RNA, 19 nt, Homo sapiens
ccacugagcucgucaagca

SEQ ID NO: 1153860 - RNA, 19 nt, Homo sapiens
gcaaggaagugucgguguu

SEQ ID NO: 1153861 - RNA, 19 nt, Homo sapiens
gagccaaccuugccuaugg

SEQ ID NO: 1153862 - RNA, 19 nt, Homo sapiens
ccaaggacaucaccaagug

SEQ ID NO: 1153863 - RNA, 19 nt, Homo sapiens
caaccucucuccuguggaa

SEQ ID NO: 1153864 - RNA, 19 nt, Homo sapiens
ccaagaugauuauaaagga

SEQ ID NO: 1153865 - RNA, 19 nt, Homo sapiens
ccaaggacguggcggugua

SEQ ID NO: 1153866 - RNA, 19 nt, Homo sapiens
gaagagccguaacgagaca

SEQ ID NO: 1153867 - RNA, 19 nt, Homo sapiens
ggagcuggauggcaaggaa

SEQ ID NO: 1153868 - RNA, 19 nt, Homo sapiens
gaccagaaccucccacuca

SEQ ID NO: 1153869 - RNA, 19 nt, Homo sapiens
gaccugggcuaccucauca

SEQ ID NO: 1153870 - RNA, 19 nt, Homo sapiens
caaugaccguggaggagua

SEQ ID NO: 1153871 - RNA, 19 nt, Homo sapiens
guaaccagccggugucuga

SEQ ID NO: 1153872 - RNA, 19 nt, Homo sapiens
ccaagaagggcgaugcuaa

SEQ ID NO: 1153873 - RNA, 19 nt, Homo sapiens
agaacuggaucgaggagua

SEQ ID NO: 1153874 - RNA, 19 nt, Homo sapiens
gaguggcucuaccuggaua

SEQ ID NO: 1153875 - RNA, 19 nt, Homo sapiens
ugagagcggagacccauua

SEQ ID NO: 1153876 - RNA, 19 nt, Homo sapiens
caucgacauugaaaccuuu

SEQ ID NO: 1153877 - RNA, 19 nt, Homo sapiens
gcguggagauccuggagaa

SEQ ID NO: 1153878 - RNA, 19 nt, Homo sapiens
ggagagaaaggcuguaucu

SEQ ID NO: 1153879 - RNA, 19 nt, Homo sapiens
ggaccuacaaccacacuga

SEQ ID NO: 1153880 - RNA, 19 nt, Homo sapiens
cagcaucgacgguuccuuu

SEQ ID NO: 1153881 - RNA, 19 nt, Homo sapiens
gguaugggcugagcaugga

SEQ ID NO: 1153882 - RNA, 19 nt, Homo sapiens
caacgaguauaagacagaa

SEQ ID NO: 1153883 - RNA, 19 nt, Homo sapiens
ugacaacuccagcaucuug

SEQ ID NO: 1153884 - RNA, 19 nt, Homo sapiens
caucauagaggacgagguu

SEQ ID NO: 1153885 - RNA, 19 nt, Homo sapiens
cgacacagaggaaauguuc

SEQ ID NO: 1153886 - RNA, 19 nt, Homo sapiens
gaaaagaaccagcugacaa

SEQ ID NO: 1153887 - RNA, 19 nt, Homo sapiens
caugacaacuccagcaucu

SEQ ID NO: 1153888 - RNA, 19 nt, Homo sapiens
gagguucucccagacauuu

SEQ ID NO: 1153889 - RNA, 19 nt, Homo sapiens
gccagaagcggaucgacua

SEQ ID NO: 1153890 - RNA, 19 nt, Homo sapiens
ucaccgaccucuuccucuu

SEQ ID NO: 1153891 - RNA, 19 nt, Homo sapiens
uaagauggcccaguucaau

SEQ ID NO: 1153892 - RNA, 19 nt, Homo sapiens
aggcacagcucaugcuuuc

SEQ ID NO: 1153893 - RNA, 19 nt, Homo sapiens
gaaggaggcacagcucaug

SEQ ID NO: 1153894 - RNA, 19 nt, Homo sapiens
gugacggccuggugcauga

SEQ ID NO: 1153895 - RNA, 19 nt, Homo sapiens
gcaagucuacaaccucuuc

SEQ ID NO: 1153896 - RNA, 19 nt, Homo sapiens
gaguggaggaugcagagua

SEQ ID NO: 1153897 - RNA, 19 nt, Homo sapiens
cauacaagcucugcaaggu

SEQ ID NO: 1153898 - RNA, 19 nt, Homo sapiens
ccaaccaccggaucaauga

SEQ ID NO: 1153899 - RNA, 19 nt, Homo sapiens
ggaucgaggaguacaagaa

SEQ ID NO: 1153900 - RNA, 19 nt, Homo sapiens
ccacaacgaguauaagaca

SEQ ID NO: 1153901 - RNA, 19 nt, Homo sapiens
gagcggagacccauuacca

SEQ ID NO: 1153902 - RNA, 19 nt, Homo sapiens
cagcagcagugccaguuca

SEQ ID NO: 1153903 - RNA, 19 nt, Homo sapiens
gcaagaggagcgacucauc

SEQ ID NO: 1153904 - RNA, 19 nt, Homo sapiens
agaaccagcugacaaucga

SEQ ID NO: 1153905 - RNA, 19 nt, Homo sapiens
augaugcccuugccaauga

SEQ ID NO: 1153906 - RNA, 19 nt, Homo sapiens
guggaggagucuuggaaug

SEQ ID NO: 1153907 - RNA, 19 nt, Homo sapiens
ggcuguaucuuaauuucug

SEQ ID NO: 1153908 - RNA, 19 nt, Homo sapiens
gguccagccugcaucuugu

SEQ ID NO: 1153909 - RNA, 19 nt, Homo sapiens
ugagaucaccgaccucuuc

SEQ ID NO: 1153910 - RNA, 19 nt, Homo sapiens
ccuacgagcuggauaccau

SEQ ID NO: 1153911 - RNA, 19 nt, Homo sapiens
ugggcuaccucaucaucua

SEQ ID NO: 1153912 - RNA, 19 nt, Homo sapiens
ggaagacacacaagauggu

SEQ ID NO: 1153913 - RNA, 19 nt, Homo sapiens
gcaagcggacccacgugaa

SEQ ID NO: 1153914 - RNA, 19 nt, Homo sapiens
ggaccugggcuaccucauc

SEQ ID NO: 1153915 - RNA, 19 nt, Homo sapiens
ugucuacccuaucaagaug

SEQ ID NO: 1153916 - RNA, 19 nt, Homo sapiens
gagaagucgcugcaaagug

SEQ ID NO: 1153917 - RNA, 19 nt, Homo sapiens
ucccugagcuggacauugg

SEQ ID NO: 1153918 - RNA, 19 nt, Homo sapiens
ccacaaugcagccuuccaa

SEQ ID NO: 1153919 - RNA, 19 nt, Homo sapiens
cacacaagauggucuguac

SEQ ID NO: 1153920 - RNA, 19 nt, Homo sapiens
uccgggagcuggagaagga

SEQ ID NO: 1153921 - RNA, 19 nt, Homo sapiens
ggagaagucgcugcaaagu

SEQ ID NO: 1153922 - RNA, 19 nt, Homo sapiens
caaugcagccuuccaagag

SEQ ID NO: 1153923 - RNA, 19 nt, Homo sapiens
gagcccagcagcagcaaug

SEQ ID NO: 1153924 - RNA, 19 nt, Homo sapiens
aguccaagaucgagagguu

SEQ ID NO: 1153925 - RNA, 19 nt, Homo sapiens
ccaucgacauugaaaccuu

SEQ ID NO: 1153926 - RNA, 19 nt, Homo sapiens
gcgcauacaagcucugcaa

SEQ ID NO: 1153927 - RNA, 19 nt, Homo sapiens
uggagcagcugaacaucau

SEQ ID NO: 1153928 - RNA, 19 nt, Homo sapiens
cccguaagauggcccaguu

SEQ ID NO: 1153929 - RNA, 19 nt, Homo sapiens
gaucgaggaguacaagaag

SEQ ID NO: 1153930 - RNA, 19 nt, Homo sapiens
ggacuccaagaugauuaua

SEQ ID NO: 1153931 - RNA, 19 nt, Homo sapiens
gggcagguuugacuuugag

SEQ ID NO: 1153932 - RNA, 19 nt, Homo sapiens
caagauccacgugcugcua

SEQ ID NO: 1153933 - RNA, 19 nt, Homo sapiens
gccagggacucggaugaga

SEQ ID NO: 1153934 - RNA, 19 nt, Homo sapiens
gcucaugcuuucccguaag

SEQ ID NO: 1153935 - RNA, 19 nt, Homo sapiens
auccuuggcugcuuccuuu

SEQ ID NO: 1153936 - RNA, 19 nt, Homo sapiens
ccucaaagccaagggagaa

SEQ ID NO: 1153937 - RNA, 19 nt, Homo sapiens
uuggagaagucgcugcaaa

SEQ ID NO: 1153938 - RNA, 19 nt, Homo sapiens
cauccagcaucgcccagaa

SEQ ID NO: 1153939 - RNA, 19 nt, Homo sapiens
gcucugggcaguacacaca

SEQ ID NO: 1153940 - RNA, 19 nt, Homo sapiens
guaagauggcccaguucaa

SEQ ID NO: 1153941 - RNA, 19 nt, Homo sapiens
gagaaaaccccgacguguu

SEQ ID NO: 1153942 - RNA, 19 nt, Homo sapiens
gauggcagagggaccagaa

SEQ ID NO: 1153943 - RNA, 19 nt, Homo sapiens
gguccggcuugucauggaa

SEQ ID NO: 1153944 - RNA, 19 nt, Homo sapiens
cagcagugccaguucauca

SEQ ID NO: 1153945 - RNA, 19 nt, Homo sapiens
ugacgggcagguucaugua

SEQ ID NO: 1153946 - RNA, 19 nt, Homo sapiens
gcaguugccacagugauuc

SEQ ID NO: 1153947 - RNA, 19 nt, Homo sapiens
caccaucgccaacguguuc

SEQ ID NO: 1153948 - RNA, 19 nt, Homo sapiens
aguggaggaugcagaguau

SEQ ID NO: 1153949 - RNA, 19 nt, Homo sapiens
uaaaacugaugcuggagaa

SEQ ID NO: 1153950 - RNA, 19 nt, Homo sapiens
gcccagcuguacaugauac

SEQ ID NO: 1153951 - RNA, 19 nt, Homo sapiens
uggcgcagcugaaguacag

SEQ ID NO: 1153952 - RNA, 19 nt, Homo sapiens
gagcagcugaacaucauag

SEQ ID NO: 1153953 - RNA, 19 nt, Homo sapiens
gaggcacagcucaugcuuu

SEQ ID NO: 1153954 - RNA, 19 nt, Homo sapiens
caagauguguccacuauua

SEQ ID NO: 1153955 - RNA, 19 nt, Homo sapiens
gaaauugucuccugcauuc

SEQ ID NO: 1153956 - RNA, 19 nt, Homo sapiens
gagcaaaucagaagacuua

SEQ ID NO: 1153957 - RNA, 19 nt, Homo sapiens
cuacagaacuuggaaauuu

SEQ ID NO: 1153958 - RNA, 19 nt, Homo sapiens
caaaucaaguccugaaauu

SEQ ID NO: 1153959 - RNA, 19 nt, Homo sapiens
gcagagaacuccauguuag

SEQ ID NO: 1153960 - RNA, 19 nt, Homo sapiens
aagagaagcuguuaucaaa

SEQ ID NO: 1153961 - RNA, 19 nt, Homo sapiens
agacauccaucuuucaaua

SEQ ID NO: 1153962 - RNA, 19 nt, Homo sapiens
gugaacaacuuacagauug

SEQ ID NO: 1153963 - RNA, 19 nt, Homo sapiens
gaaauggacuuccucaaaa

SEQ ID NO: 1153964 - RNA, 19 nt, Homo sapiens
acacuaagcuauuacaaug

SEQ ID NO: 1153965 - RNA, 19 nt, Homo sapiens
gaaaugggguccucacuaa

SEQ ID NO: 1153966 - RNA, 19 nt, Homo sapiens
gcacuuuccuguuguuuca

SEQ ID NO: 1153967 - RNA, 19 nt, Homo sapiens
gggaacagauuaaucacaa

SEQ ID NO: 1153968 - RNA, 19 nt, Homo sapiens
ggacugacauggaacaucu

SEQ ID NO: 1153969 - RNA, 19 nt, Homo sapiens
caaagagaguugcuggaaa

SEQ ID NO: 1153970 - RNA, 19 nt, Homo sapiens
gaacacaaacuccacaugu

SEQ ID NO: 1153971 - RNA, 19 nt, Homo sapiens
ucagaggauuuaaugguua

SEQ ID NO: 1153972 - RNA, 19 nt, Homo sapiens
gaccaacauucuuugcaua

SEQ ID NO: 1153973 - RNA, 19 nt, Homo sapiens
caccuuaccuuccuaaaga

SEQ ID NO: 1153974 - RNA, 19 nt, Homo sapiens
ugaauucucugucaggauu

SEQ ID NO: 1153975 - RNA, 19 nt, Homo sapiens
guggagcacuggcaccuua

SEQ ID NO: 1153976 - RNA, 19 nt, Homo sapiens
uguagaagcugaacuuuua

SEQ ID NO: 1153977 - RNA, 19 nt, Homo sapiens
gaaagaguaguuagugcua

SEQ ID NO: 1153978 - RNA, 19 nt, Homo sapiens
ucacaaauacccagaaaga

SEQ ID NO: 1153979 - RNA, 19 nt, Homo sapiens
caaaugauacugacagguu

SEQ ID NO: 1153980 - RNA, 19 nt, Homo sapiens
gaagcugauuccacuauuc

SEQ ID NO: 1153981 - RNA, 19 nt, Homo sapiens
agaagaagaugaauuagag

SEQ ID NO: 1153982 - RNA, 19 nt, Homo sapiens
acuguuaguuggauucuua

SEQ ID NO: 1153983 - RNA, 19 nt, Homo sapiens
acaaauaucaucaggguuu

SEQ ID NO: 1153984 - RNA, 19 nt, Homo sapiens
ugaaauggacuuccucaaa

SEQ ID NO: 1153985 - RNA, 19 nt, Homo sapiens
gcccuuacaccaauuauaa

SEQ ID NO: 1153986 - RNA, 19 nt, Homo sapiens
gagaguugcuggaaagagu

SEQ ID NO: 1153987 - RNA, 19 nt, Homo sapiens
gccaauguauuucagagaa

SEQ ID NO: 1153988 - RNA, 19 nt, Homo sapiens
ggaacagauuaaucacaaa

SEQ ID NO: 1153989 - RNA, 19 nt, Homo sapiens
ggaaacaguaauucaaaga

SEQ ID NO: 1153990 - RNA, 19 nt, Homo sapiens
uaaggcagauuugguaaga

SEQ ID NO: 1153991 - RNA, 19 nt, Homo sapiens
acacagacauccaucuuuc

SEQ ID NO: 1153992 - RNA, 19 nt, Homo sapiens
ggucauugauggagcaaau

SEQ ID NO: 1153993 - RNA, 19 nt, Homo sapiens
gccacaacuuauagaaaua

SEQ ID NO: 1153994 - RNA, 19 nt, Homo sapiens
gcaaaucagaagacuuaaa

SEQ ID NO: 1153995 - RNA, 19 nt, Homo sapiens
ggacauugcuacgcaucuu

SEQ ID NO: 1153996 - RNA, 19 nt, Homo sapiens
gcacuauuauggaaacagu

SEQ ID NO: 1153997 - RNA, 19 nt, Homo sapiens
gcagauagucguuuaggau

SEQ ID NO: 1153998 - RNA, 19 nt, Homo sapiens
gcuauuacaaugguacuua

SEQ ID NO: 1153999 - RNA, 19 nt, Homo sapiens
aaagauauuugcacugcuu

SEQ ID NO: 1154000 - RNA, 19 nt, Homo sapiens
cauguuggccaauguauuu

SEQ ID NO: 1154001 - RNA, 19 nt, Homo sapiens
aaagagaguugcuggaaag

SEQ ID NO: 1154002 - RNA, 19 nt, Homo sapiens
guccuuacguguuauauuc

SEQ ID NO: 1154003 - RNA, 19 nt, Homo sapiens
ccucaaggcucaaugucaa

SEQ ID NO: 1154004 - RNA, 19 nt, Homo sapiens
gauccugaauucucuguca

SEQ ID NO: 1154005 - RNA, 19 nt, Homo sapiens
uuacaacuguggugauaga

SEQ ID NO: 1154006 - RNA, 19 nt, Homo sapiens
acacuaagauggaccucaa

SEQ ID NO: 1154007 - RNA, 19 nt, Homo sapiens
ggaagauccucaguaucaa

SEQ ID NO: 1154008 - RNA, 19 nt, Homo sapiens
ccuggaagauccucaguau

SEQ ID NO: 1154009 - RNA, 19 nt, Homo sapiens
aaaugcaguuggcuucuuu

SEQ ID NO: 1154010 - RNA, 19 nt, Homo sapiens
gagcaaaggcaaaugauac

SEQ ID NO: 1154011 - RNA, 19 nt, Homo sapiens
gggaugauguaggauuaaa

SEQ ID NO: 1154012 - RNA, 19 nt, Homo sapiens
aggcaugagugaagcguua

SEQ ID NO: 1154013 - RNA, 19 nt, Homo sapiens
gucagcagauagucguuua

SEQ ID NO: 1154014 - RNA, 19 nt, Homo sapiens
ggaaauugucuccugcauu

SEQ ID NO: 1154015 - RNA, 19 nt, Homo sapiens
cuucuucucuaucaaguaa

SEQ ID NO: 1154016 - RNA, 19 nt, Homo sapiens
caaagacucugaggacagu

SEQ ID NO: 1154017 - RNA, 19 nt, Homo sapiens
ugaauuaugggaugaugua

SEQ ID NO: 1154018 - RNA, 19 nt, Homo sapiens
aacacaaacuccacaugua

SEQ ID NO: 1154019 - RNA, 19 nt, Homo sapiens
uaagagaagcuguuaucaa

SEQ ID NO: 1154020 - RNA, 19 nt, Homo sapiens
caaaggcaaaugauacuga

SEQ ID NO: 1154021 - RNA, 19 nt, Homo sapiens
gaugagcaaaggcaaauga

SEQ ID NO: 1154022 - RNA, 19 nt, Homo sapiens
ccacauacuuuucaauuug

SEQ ID NO: 1154023 - RNA, 19 nt, Homo sapiens
gaaauucaggagccaauca

SEQ ID NO: 1154024 - RNA, 19 nt, Homo sapiens
uggaagauccucaguauca

SEQ ID NO: 1154025 - RNA, 19 nt, Homo sapiens
agauagaagugacuagguu

SEQ ID NO: 1154026 - RNA, 19 nt, Homo sapiens
gaacuuggaaauuuacagu

SEQ ID NO: 1154027 - RNA, 19 nt, Homo sapiens
ucaauaaccuuuucagaug

SEQ ID NO: 1154028 - RNA, 19 nt, Homo sapiens
auccuaaccuccaaagaua

SEQ ID NO: 1154029 - RNA, 19 nt, Homo sapiens
ucaagaggccagaugauga

SEQ ID NO: 1154030 - RNA, 19 nt, Homo sapiens
gcaaagagagaggaguuga

SEQ ID NO: 1154031 - RNA, 19 nt, Homo sapiens
gaagauacaaagaccaagu

SEQ ID NO: 1154032 - RNA, 19 nt, Homo sapiens
cguguuauauucaggaaga

SEQ ID NO: 1154033 - RNA, 19 nt, Homo sapiens
gauagaagugacuagguuu

SEQ ID NO: 1154034 - RNA, 19 nt, Homo sapiens
gaucccaucucucuuugca

SEQ ID NO: 1154035 - RNA, 19 nt, Homo sapiens
gaaauuuacagucucaucu

SEQ ID NO: 1154036 - RNA, 19 nt, Homo sapiens
gguaagagaagcuguuauc

SEQ ID NO: 1154037 - RNA, 19 nt, Homo sapiens
aaucacaaauacccagaaa

SEQ ID NO: 1154038 - RNA, 19 nt, Homo sapiens
uccaaaaccuccagacuua

SEQ ID NO: 1154039 - RNA, 19 nt, Homo sapiens
cagauagucguuuaggaua

SEQ ID NO: 1154040 - RNA, 19 nt, Homo sapiens
ugucgaaugucagcagaua

SEQ ID NO: 1154041 - RNA, 19 nt, Homo sapiens
ggugaacaacuuacagauu

SEQ ID NO: 1154042 - RNA, 19 nt, Homo sapiens
caacaggcugggagaguuu

SEQ ID NO: 1154043 - RNA, 19 nt, Homo sapiens
aaacuccacauguaucuuu

SEQ ID NO: 1154044 - RNA, 19 nt, Homo sapiens
gaacauggacuggaugaac

SEQ ID NO: 1154045 - RNA, 19 nt, Homo sapiens
gauaaggcagauuugguaa

SEQ ID NO: 1154046 - RNA, 19 nt, Homo sapiens
gagagaaagagaaggaaug

SEQ ID NO: 1154047 - RNA, 19 nt, Homo sapiens
gauguaaugacgcugcuuu

SEQ ID NO: 1154048 - RNA, 19 nt, Homo sapiens
ugccacaacuuauagaaau

SEQ ID NO: 1154049 - RNA, 19 nt, Homo sapiens
caaaagccuugguaucauu

SEQ ID NO: 1154050 - RNA, 19 nt, Homo sapiens
ucaaguaacuggaaaagau

SEQ ID NO: 1154051 - RNA, 19 nt, Homo sapiens
caacuguggugauagaaaa

SEQ ID NO: 1154052 - RNA, 19 nt, Homo sapiens
gagaugaguuuguuauacc

SEQ ID NO: 1154053 - RNA, 19 nt, Homo sapiens
cgagaugaguuuguuauac

SEQ ID NO: 1154054 - RNA, 19 nt, Homo sapiens
gagaaugccuugucagaua

SEQ ID NO: 1154055 - RNA, 19 nt, Homo sapiens
uaacacgccuugaaauuua

SEQ ID NO: 1154056 - RNA, 19 nt, Homo sapiens
ugauagagguucauguuua

SEQ ID NO: 1154057 - RNA, 19 nt, Homo sapiens
gauagagguucauguuuaa

SEQ ID NO: 1154058 - RNA, 19 nt, Homo sapiens
uaauagaggugcauaauca

SEQ ID NO: 1154059 - RNA, 19 nt, Homo sapiens
ccacagauagcauuuauaa

SEQ ID NO: 1154060 - RNA, 19 nt, Homo sapiens
caaccucuuucacuuauuu

SEQ ID NO: 1154061 - RNA, 19 nt, Homo sapiens
aaagacaucugccgucgua

SEQ ID NO: 1154062 - RNA, 19 nt, Homo sapiens
ucacaacccugcuggauga

SEQ ID NO: 1154063 - RNA, 19 nt, Homo sapiens
ugacaucucuuccaaauac

SEQ ID NO: 1154064 - RNA, 19 nt, Homo sapiens
gauccaaccucuuucacuu

SEQ ID NO: 1154065 - RNA, 19 nt, Homo sapiens
gcaggcaucagaacuauuu

SEQ ID NO: 1154066 - RNA, 19 nt, Homo sapiens
caagcacgcuguuaaacuu

SEQ ID NO: 1154067 - RNA, 19 nt, Homo sapiens
guaggaugccuuucuauuu

SEQ ID NO: 1154068 - RNA, 19 nt, Homo sapiens
agacaagccuggcgaagaa

SEQ ID NO: 1154069 - RNA, 19 nt, Homo sapiens
caccaacucugcuaugaaa

SEQ ID NO: 1154070 - RNA, 19 nt, Homo sapiens
ggacugcaguuugcuuuga

SEQ ID NO: 1154071 - RNA, 19 nt, Homo sapiens
gcaacagccuggcggagaa

SEQ ID NO: 1154072 - RNA, 19 nt, Homo sapiens
gaaaaugacuuagaagaga

SEQ ID NO: 1154073 - RNA, 19 nt, Homo sapiens
ugagaaaguugccaaagug

SEQ ID NO: 1154074 - RNA, 19 nt, Homo sapiens
cacugcagcuuuaucuuua

SEQ ID NO: 1154075 - RNA, 19 nt, Homo sapiens
gcaguuaauuugcagaagu

SEQ ID NO: 1154076 - RNA, 19 nt, Homo sapiens
uagagaagcaguagcauuu

SEQ ID NO: 1154077 - RNA, 19 nt, Homo sapiens
gcuguuaaacuucaccuua

SEQ ID NO: 1154078 - RNA, 19 nt, Homo sapiens
cugaagaacuugacagaga

SEQ ID NO: 1154079 - RNA, 19 nt, Homo sapiens
gcacagacaccguaacaca

SEQ ID NO: 1154080 - RNA, 19 nt, Homo sapiens
ucaccuagagucacacuua

SEQ ID NO: 1154081 - RNA, 19 nt, Homo sapiens
guacaucagucaccuagag

SEQ ID NO: 1154082 - RNA, 19 nt, Homo sapiens
gauggucacuggccacuuc

SEQ ID NO: 1154083 - RNA, 19 nt, Homo sapiens
gaacagauuaacagucaga

SEQ ID NO: 1154084 - RNA, 19 nt, Homo sapiens
ccgaacagauuaacaguca

SEQ ID NO: 1154085 - RNA, 19 nt, Homo sapiens
acugacagcugacaccaua

SEQ ID NO: 1154086 - RNA, 19 nt, Homo sapiens
caacaacgaccagcccaua

SEQ ID NO: 1154087 - RNA, 19 nt, Homo sapiens
caguuaauuugcagaagua

SEQ ID NO: 1154088 - RNA, 19 nt, Homo sapiens
uaggaugccuuucuauuuc

SEQ ID NO: 1154089 - RNA, 19 nt, Homo sapiens
acucugggcuggacuguuu

SEQ ID NO: 1154090 - RNA, 19 nt, Homo sapiens
ggagcucacugcccacaug

SEQ ID NO: 1154091 - RNA, 19 nt, Homo sapiens
ggauuugaguguccauaug

SEQ ID NO: 1154092 - RNA, 19 nt, Homo sapiens
gaaggaagacgcccagaag

SEQ ID NO: 1154093 - RNA, 19 nt, Homo sapiens
gguauaacacgccuugaaa

SEQ ID NO: 1154094 - RNA, 19 nt, Homo sapiens
caaauaccauuacuugacu

SEQ ID NO: 1154095 - RNA, 19 nt, Homo sapiens
agaaggaagucgacaagga

SEQ ID NO: 1154096 - RNA, 19 nt, Homo sapiens
ggaagucgcagauccugaa

SEQ ID NO: 1154097 - RNA, 19 nt, Homo sapiens
gcucaaaggguuaagucua

SEQ ID NO: 1154098 - RNA, 19 nt, Homo sapiens
gaagauaccacagauagca

SEQ ID NO: 1154099 - RNA, 19 nt, Homo sapiens
ggaugcauaucuccagguu

SEQ ID NO: 1154100 - RNA, 19 nt, Homo sapiens
cuuaccagcuuaguuauaa

SEQ ID NO: 1154101 - RNA, 19 nt, Homo sapiens
uaaacuccuuaccagcuua

SEQ ID NO: 1154102 - RNA, 19 nt, Homo sapiens
caucugccgucguaucauu

SEQ ID NO: 1154103 - RNA, 19 nt, Homo sapiens
aaaggucacugagaaaguu

SEQ ID NO: 1154104 - RNA, 19 nt, Homo sapiens
uaccauuacuugacugaaa

SEQ ID NO: 1154105 - RNA, 19 nt, Homo sapiens
gcuauuccauauuguagga

SEQ ID NO: 1154106 - RNA, 19 nt, Homo sapiens
gaaagcaaaguaugauagu

SEQ ID NO: 1154107 - RNA, 19 nt, Homo sapiens
caacccugcuggaugagaa

SEQ ID NO: 1154108 - RNA, 19 nt, Homo sapiens
cauaugagaaccuuuguau

SEQ ID NO: 1154109 - RNA, 19 nt, Homo sapiens
uauaacacgccuugaaauu

SEQ ID NO: 1154110 - RNA, 19 nt, Homo sapiens
ggacagguggaacaaaguu

SEQ ID NO: 1154111 - RNA, 19 nt, Homo sapiens
ccgauaugcugaagaacuu

SEQ ID NO: 1154112 - RNA, 19 nt, Homo sapiens
ggaaggaagacgcccagaa

SEQ ID NO: 1154113 - RNA, 19 nt, Homo sapiens
caacuucccaacaugauga

SEQ ID NO: 1154114 - RNA, 19 nt, Homo sapiens
uaccacagauagcauuuau

SEQ ID NO: 1154115 - RNA, 19 nt, Homo sapiens
caagcugcaugcauuaaca

SEQ ID NO: 1154116 - RNA, 19 nt, Homo sapiens
ggaaauggaagggaaggaa

SEQ ID NO: 1154117 - RNA, 19 nt, Homo sapiens
guacuguauuuccuaaaca

SEQ ID NO: 1154118 - RNA, 19 nt, Homo sapiens
gacgagaaaccuaagcaaa

SEQ ID NO: 1154119 - RNA, 19 nt, Homo sapiens
agaagaacuccaacccuua

SEQ ID NO: 1154120 - RNA, 19 nt, Homo sapiens
gauuugaguguccauauga

SEQ ID NO: 1154121 - RNA, 19 nt, Homo sapiens
gaagcaccauuaugugacu

SEQ ID NO: 1154122 - RNA, 19 nt, Homo sapiens
agcuuuaucuuuaggcuua

SEQ ID NO: 1154123 - RNA, 19 nt, Homo sapiens
caaaggguuaagucuauuu

SEQ ID NO: 1154124 - RNA, 19 nt, Homo sapiens
cagaagauaccacagauag

SEQ ID NO: 1154125 - RNA, 19 nt, Homo sapiens
agaaaggacugcaguuugc

SEQ ID NO: 1154126 - RNA, 19 nt, Homo sapiens
gaggagaagugugacaucu

SEQ ID NO: 1154127 - RNA, 19 nt, Homo sapiens
uugagucccugcaggauuu

SEQ ID NO: 1154128 - RNA, 19 nt, Homo sapiens
gaaacauuaucugaaagca

SEQ ID NO: 1154129 - RNA, 19 nt, Homo sapiens
ugugacaucucuuccaaau

SEQ ID NO: 1154130 - RNA, 19 nt, Homo sapiens
ggaagucgacaaggagaaa

SEQ ID NO: 1154131 - RNA, 19 nt, Homo sapiens
gaagaacuccaacccuuac

SEQ ID NO: 1154132 - RNA, 19 nt, Homo sapiens
acacugcagcuuuaucuuu

SEQ ID NO: 1154133 - RNA, 19 nt, Homo sapiens
cucaaaggguuaagucuau

SEQ ID NO: 1154134 - RNA, 19 nt, Homo sapiens
auaugaaccuccauuuaug

SEQ ID NO: 1154135 - RNA, 19 nt, Homo sapiens
ucucacccuuucaucuuua

SEQ ID NO: 1154136 - RNA, 19 nt, Homo sapiens
cgagaagucugacauugac

SEQ ID NO: 1154137 - RNA, 19 nt, Homo sapiens
agaaugccuugucagauau

SEQ ID NO: 1154138 - RNA, 19 nt, Homo sapiens
aagaagaggagaaguguga

SEQ ID NO: 1154139 - RNA, 19 nt, Homo sapiens
gaacuccaacccuuacauc

SEQ ID NO: 1154140 - RNA, 19 nt, Homo sapiens
ccaaagccaccaucucaga

SEQ ID NO: 1154141 - RNA, 19 nt, Homo sapiens
guacuguggccacuccuuu

SEQ ID NO: 1154142 - RNA, 19 nt, Homo sapiens
ggguuaagucuauuugaaa

SEQ ID NO: 1154143 - RNA, 19 nt, Homo sapiens
uugaagcacuuuugcauua

SEQ ID NO: 1154144 - RNA, 19 nt, Homo sapiens
aaacgggauuuaguuguga

SEQ ID NO: 1154145 - RNA, 19 nt, Homo sapiens
gagaagcaguagcauuugc

SEQ ID NO: 1154146 - RNA, 19 nt, Homo sapiens
cagauuaacagucagauag

SEQ ID NO: 1154147 - RNA, 19 nt, Homo sapiens
gcgagaaugccuugucaga

SEQ ID NO: 1154148 - RNA, 19 nt, Homo sapiens
ucacugacgagaaaccuaa

SEQ ID NO: 1154149 - RNA, 19 nt, Homo sapiens
gcuccuugcuggaaaugga

SEQ ID NO: 1154150 - RNA, 19 nt, Homo sapiens
cccagaaggugcugaagug

SEQ ID NO: 1154151 - RNA, 19 nt, Homo sapiens
ucaaaggguuaagucuauu

SEQ ID NO: 1154152 - RNA, 19 nt, Homo sapiens
auaaucagcuguuguuacu

SEQ ID NO: 1154153 - RNA, 19 nt, Homo sapiens
gcuggacuguuuuguauaa

SEQ ID NO: 1154154 - RNA, 19 nt, Homo sapiens
gcaccuaucuggacaugaa

SEQ ID NO: 1154155 - RNA, 19 nt, Homo sapiens
gggcguagcuuuguuauug

SEQ ID NO: 1154156 - RNA, 19 nt, Homo sapiens
ccgauuaucucgcugcaua

SEQ ID NO: 1154157 - RNA, 19 nt, Homo sapiens
gaaccgaaauggacagaag

SEQ ID NO: 1154158 - RNA, 19 nt, Homo sapiens
ggaggccgauuucugcuuu

SEQ ID NO: 1154159 - RNA, 19 nt, Homo sapiens
gaagggagccugugauuuu

SEQ ID NO: 1154160 - RNA, 19 nt, Homo sapiens
ggagauugcccucaaguuc

SEQ ID NO: 1154161 - RNA, 19 nt, Homo sapiens
gcaaucagcugugcaugag

SEQ ID NO: 1154162 - RNA, 19 nt, Homo sapiens
gcaccuuucuuccgucugu

SEQ ID NO: 1154163 - RNA, 19 nt, Homo sapiens
ucacaaagcagcgcauuga

SEQ ID NO: 1154164 - RNA, 19 nt, Homo sapiens
gagaaagugaugcuaguug

SEQ ID NO: 1154165 - RNA, 19 nt, Homo sapiens
gcuucgaucuggccaaaga

SEQ ID NO: 1154166 - RNA, 19 nt, Homo sapiens
ugaagcacauggugaagga

SEQ ID NO: 1154167 - RNA, 19 nt, Homo sapiens
caaagcagcgcauugacuu

SEQ ID NO: 1154168 - RNA, 19 nt, Homo sapiens
gaugggcguagcuuuguua

SEQ ID NO: 1154169 - RNA, 19 nt, Homo sapiens
acagugaguuggccuucua

SEQ ID NO: 1154170 - RNA, 19 nt, Homo sapiens
gagcuacuuugaggagauu

SEQ ID NO: 1154171 - RNA, 19 nt, Homo sapiens
ggacaugaaccgcuucgau

SEQ ID NO: 1154172 - RNA, 19 nt, Homo sapiens
gggaugguguguuguaugg

SEQ ID NO: 1154173 - RNA, 19 nt, Homo sapiens
gcaagacugcgccagauuc

SEQ ID NO: 1154174 - RNA, 19 nt, Homo sapiens
ggaguuacagcuuccauuc

SEQ ID NO: 1154175 - RNA, 19 nt, Homo sapiens
agagagagcaccuuucuuc

SEQ ID NO: 1154176 - RNA, 19 nt, Homo sapiens
agaaggaagugcccaucuu

SEQ ID NO: 1154177 - RNA, 19 nt, Homo sapiens
guggagagcauuaaacugu

SEQ ID NO: 1154178 - RNA, 19 nt, Homo sapiens
gcauaaggcaagagcaaga

SEQ ID NO: 1154179 - RNA, 19 nt, Homo sapiens
ggagagcauuaaacugucu

SEQ ID NO: 1154180 - RNA, 19 nt, Homo sapiens
gggaucacuuccuggagaa

SEQ ID NO: 1154181 - RNA, 19 nt, Homo sapiens
gcaugagccugggcaagga

SEQ ID NO: 1154182 - RNA, 19 nt, Homo sapiens
ggagguggagagcauuaaa

SEQ ID NO: 1154183 - RNA, 19 nt, Homo sapiens
gcucucaccugcugauugc

SEQ ID NO: 1154184 - RNA, 19 nt, Homo sapiens
gaagguacggccacuagca

SEQ ID NO: 1154185 - RNA, 19 nt, Homo sapiens
gauggucggugguggugau

SEQ ID NO: 1154186 - RNA, 19 nt, Homo sapiens
gccuguaggugucccagaa

SEQ ID NO: 1154187 - RNA, 19 nt, Homo sapiens
gugagaaagugaugcuagu

SEQ ID NO: 1154188 - RNA, 19 nt, Homo sapiens
ucccagcucuucucucuca

SEQ ID NO: 1154189 - RNA, 19 nt, Homo sapiens
cgagagagagagagagaga

SEQ ID NO: 1154190 - RNA, 19 nt, Homo sapiens
gcccaaggccacaucuuug

SEQ ID NO: 1154191 - RNA, 19 nt, Homo sapiens
gauacacugcuccgcauug

SEQ ID NO: 1154192 - RNA, 19 nt, Homo sapiens
ggucggugguggugaugga

SEQ ID NO: 1154193 - RNA, 19 nt, Homo sapiens
ggcauugggugagaaagug

SEQ ID NO: 1154194 - RNA, 19 nt, Homo sapiens
guaggugucccagaaguga

SEQ ID NO: 1154195 - RNA, 19 nt, Homo sapiens
ggcagcgccucuuccaguu

SEQ ID NO: 1154196 - RNA, 19 nt, Homo sapiens
gacguaaggaugacgcaaa

SEQ ID NO: 1154197 - RNA, 19 nt, Homo sapiens
cagcgccucuuccaguuca

SEQ ID NO: 1154198 - RNA, 19 nt, Homo sapiens
agagagagagagcaccuuu

SEQ ID NO: 1154199 - RNA, 19 nt, Homo sapiens
aaucccagcucuucucucu

SEQ ID NO: 1154200 - RNA, 19 nt, Homo sapiens
gugcaagacugcgccagau

SEQ ID NO: 1154201 - RNA, 19 nt, Homo sapiens
gcgcaccuaucuggacaug

SEQ ID NO: 1154202 - RNA, 19 nt, Homo sapiens
auacacugcuccgcauuga

SEQ ID NO: 1154203 - RNA, 19 nt, Homo sapiens
ugauggagguggagagcau

SEQ ID NO: 1154204 - RNA, 19 nt, Homo sapiens
aggaggcucuggcugaguu

SEQ ID NO: 1154205 - RNA, 19 nt, Homo sapiens
caagacugcgccagauuca

SEQ ID NO: 1154206 - RNA, 19 nt, Homo sapiens
ugaaugcccagcuggagaa

SEQ ID NO: 1154207 - RNA, 19 nt, Homo sapiens
ugaagggagccugugauuu

SEQ ID NO: 1154208 - RNA, 19 nt, Homo sapiens
gaaaucugacccaauucca

SEQ ID NO: 1154209 - RNA, 19 nt, Homo sapiens
ugacccagagcuacuuuga

SEQ ID NO: 1154210 - RNA, 19 nt, Homo sapiens
ccgcuucgaucuggccaaa

SEQ ID NO: 1154211 - RNA, 19 nt, Homo sapiens
ucagggcucuuugcagcuu

SEQ ID NO: 1154212 - RNA, 19 nt, Homo sapiens
gagcgcauuaccagucuug

SEQ ID NO: 1154213 - RNA, 19 nt, Homo sapiens
ccacacacguccuguucac

SEQ ID NO: 1154214 - RNA, 19 nt, Homo sapiens
ccaaggccacaucuuugaa

SEQ ID NO: 1154215 - RNA, 19 nt, Homo sapiens
gagaaggaagugcccaucu

SEQ ID NO: 1154216 - RNA, 19 nt, Homo sapiens
gauguuccuugaccauacu

SEQ ID NO: 1154217 - RNA, 19 nt, Homo sapiens
acacugagcgggcugucuu

SEQ ID NO: 1154218 - RNA, 19 nt, Homo sapiens
guacgugcuaaaugaagaa

SEQ ID NO: 1154219 - RNA, 19 nt, Homo sapiens
uguacgugcuaaaugaaga

SEQ ID NO: 1154220 - RNA, 19 nt, Homo sapiens
gucagaggcuggggaguua

SEQ ID NO: 1154221 - RNA, 19 nt, Homo sapiens
cagaagguacggccacuag

SEQ ID NO: 1154222 - RNA, 19 nt, Homo sapiens
cuaccgagaagucagaaau

SEQ ID NO: 1154223 - RNA, 19 nt, Homo sapiens
gcucucagccagcgaaggu

SEQ ID NO: 1154224 - RNA, 19 nt, Homo sapiens
gaguguggguuggaacaag

SEQ ID NO: 1154225 - RNA, 19 nt, Homo sapiens
gcauugggugagaaaguga

SEQ ID NO: 1154226 - RNA, 19 nt, Homo sapiens
aguuacagcuuccauucug

SEQ ID NO: 1154227 - RNA, 19 nt, Homo sapiens
gggcauugggugagaaagu

SEQ ID NO: 1154228 - RNA, 19 nt, Homo sapiens
gagagagagcaccuuucuu

SEQ ID NO: 1154229 - RNA, 19 nt, Homo sapiens
cugaguuccugcagcgaaa

SEQ ID NO: 1154230 - RNA, 19 nt, Homo sapiens
ucacuuccuggagaaauuu

SEQ ID NO: 1154231 - RNA, 19 nt, Homo sapiens
gaucacuuccuggagaaau

SEQ ID NO: 1154232 - RNA, 19 nt, Homo sapiens
gggaguuacagcuuccauu

SEQ ID NO: 1154233 - RNA, 19 nt, Homo sapiens
gagagagagagcaccuuuc

SEQ ID NO: 1154234 - RNA, 19 nt, Homo sapiens
gcaaccugggcuacaguga

SEQ ID NO: 1154235 - RNA, 19 nt, Homo sapiens
gugcccaucuucacaaagc

SEQ ID NO: 1154236 - RNA, 19 nt, Homo sapiens
gcccugcuccggaucucua

SEQ ID NO: 1154237 - RNA, 19 nt, Homo sapiens
cccaaggccacaucuuuga

SEQ ID NO: 1154238 - RNA, 19 nt, Homo sapiens
gagaguguggguuggaaca

SEQ ID NO: 1154239 - RNA, 19 nt, Homo sapiens
agagagagagcaccuuucu

SEQ ID NO: 1154240 - RNA, 19 nt, Homo sapiens
gaucuggccaaagaguauu

SEQ ID NO: 1154241 - RNA, 19 nt, Homo sapiens
cgaucuggccaaagaguau

SEQ ID NO: 1154242 - RNA, 19 nt, Homo sapiens
cagggcucuuugcagcuua

SEQ ID NO: 1154243 - RNA, 19 nt, Homo sapiens
ccugaugggcguagcuuug

SEQ ID NO: 1154244 - RNA, 19 nt, Homo sapiens
ggauacacugcuccgcauu

SEQ ID NO: 1154245 - RNA, 19 nt, Homo sapiens
ggccuucgccuggaugaug

SEQ ID NO: 1154246 - RNA, 19 nt, Homo sapiens
agacugcgccagauucaag

SEQ ID NO: 1154247 - RNA, 19 nt, Homo sapiens
ugcccaaggccacaucuuu

SEQ ID NO: 1154248 - RNA, 19 nt, Homo sapiens
caaaaguucacaagauguu

SEQ ID NO: 1154249 - RNA, 19 nt, Homo sapiens
ugagaaagugaugcuaguu

SEQ ID NO: 1154250 - RNA, 19 nt, Homo sapiens
cugaagggagccugugauu

SEQ ID NO: 1154251 - RNA, 19 nt, Homo sapiens
aaccugggcuacagugagu

SEQ ID NO: 1154252 - RNA, 19 nt, Homo sapiens
ugaugggcguagcuuuguu

SEQ ID NO: 1154253 - RNA, 19 nt, Homo sapiens
cuacgugaaccgaaaugga

SEQ ID NO: 1154254 - RNA, 19 nt, Homo sapiens
ggacauagaugauuacguu

SEQ ID NO: 1154255 - RNA, 19 nt, Homo sapiens
ccaaugaguuugacaagua

SEQ ID NO: 1154256 - RNA, 19 nt, Homo sapiens
gcagugagcauguugguua

SEQ ID NO: 1154257 - RNA, 19 nt, Homo sapiens
gaaacaaacuaugaacuga

SEQ ID NO: 1154258 - RNA, 19 nt, Homo sapiens
ggaggaggcuauuguaaug

SEQ ID NO: 1154259 - RNA, 19 nt, Homo sapiens
cauaguaagugcuuucuuu

SEQ ID NO: 1154260 - RNA, 19 nt, Homo sapiens
gcuaaccacuuauuugauu

SEQ ID NO: 1154261 - RNA, 19 nt, Homo sapiens
ugaagggucugcaacauaa

SEQ ID NO: 1154262 - RNA, 19 nt, Homo sapiens
caaggagaguggauacaua

SEQ ID NO: 1154263 - RNA, 19 nt, Homo sapiens
gaagugagccgaagcauag

SEQ ID NO: 1154264 - RNA, 19 nt, Homo sapiens
ggaggaggcuggagagaga

SEQ ID NO: 1154265 - RNA, 19 nt, Homo sapiens
gaaagagcacccacaguaa

SEQ ID NO: 1154266 - RNA, 19 nt, Homo sapiens
gaggguguuugaucauuua

SEQ ID NO: 1154267 - RNA, 19 nt, Homo sapiens
ggaggaggauuuacauuca

SEQ ID NO: 1154268 - RNA, 19 nt, Homo sapiens
guaagugcuuucuuucuuu

SEQ ID NO: 1154269 - RNA, 19 nt, Homo sapiens
gguauuccuuugaguauuu

SEQ ID NO: 1154270 - RNA, 19 nt, Homo sapiens
gcagauaucucaggguaug

SEQ ID NO: 1154271 - RNA, 19 nt, Homo sapiens
gcagagucuuccaaguuua

SEQ ID NO: 1154272 - RNA, 19 nt, Homo sapiens
ggaggguguuugaucauuu

SEQ ID NO: 1154273 - RNA, 19 nt, Homo sapiens
gaaugcugcuggacacgua

SEQ ID NO: 1154274 - RNA, 19 nt, Homo sapiens
aaagaaggcugagcucauu

SEQ ID NO: 1154275 - RNA, 19 nt, Homo sapiens
ugaacuaucuggguuauug

SEQ ID NO: 1154276 - RNA, 19 nt, Homo sapiens
acauuaaccucuccacuuu

SEQ ID NO: 1154277 - RNA, 19 nt, Homo sapiens
gcaaagccauuggugauuc

SEQ ID NO: 1154278 - RNA, 19 nt, Homo sapiens
ggucuagccuugaucagaa

SEQ ID NO: 1154279 - RNA, 19 nt, Homo sapiens
ggagaaccauuaaucaucu

SEQ ID NO: 1154280 - RNA, 19 nt, Homo sapiens
agaaagagcacccacagua

SEQ ID NO: 1154281 - RNA, 19 nt, Homo sapiens
gauauucgcuaugucaaga

SEQ ID NO: 1154282 - RNA, 19 nt, Homo sapiens
uaaugaaacugagaacuga

SEQ ID NO: 1154283 - RNA, 19 nt, Homo sapiens
gaagcuggaugacaagauc

SEQ ID NO: 1154284 - RNA, 19 nt, Homo sapiens
gugaaaggauccuacaaga

SEQ ID NO: 1154285 - RNA, 19 nt, Homo sapiens
ucacucaguuguucagaaa

SEQ ID NO: 1154286 - RNA, 19 nt, Homo sapiens
ggaucuaggucacucaguu

SEQ ID NO: 1154287 - RNA, 19 nt, Homo sapiens
caaaguccauuucuguuca

SEQ ID NO: 1154288 - RNA, 19 nt, Homo sapiens
ggucagggcuaugauaaau

SEQ ID NO: 1154289 - RNA, 19 nt, Homo sapiens
ucagaaauguugaagugaa

SEQ ID NO: 1154290 - RNA, 19 nt, Homo sapiens
gaagaaaggguugauaauc

SEQ ID NO: 1154291 - RNA, 19 nt, Homo sapiens
gacaguggcuuuggucuug

SEQ ID NO: 1154292 - RNA, 19 nt, Homo sapiens
gcacggagaaccauuaauc

SEQ ID NO: 1154293 - RNA, 19 nt, Homo sapiens
gaagaaaccagaagcuaca

SEQ ID NO: 1154294 - RNA, 19 nt, Homo sapiens
cauagaugauuacguuuga

SEQ ID NO: 1154295 - RNA, 19 nt, Homo sapiens
ccacuuauuugauucuguu

SEQ ID NO: 1154296 - RNA, 19 nt, Homo sapiens
gaaaagaucacuauguuug

SEQ ID NO: 1154297 - RNA, 19 nt, Homo sapiens
gcaggcagauauucgcuau

SEQ ID NO: 1154298 - RNA, 19 nt, Homo sapiens
guagagauguauaccacuu

SEQ ID NO: 1154299 - RNA, 19 nt, Homo sapiens
gaagagggaacgaggaaga

SEQ ID NO: 1154300 - RNA, 19 nt, Homo sapiens
cagaaauguugaagugaaa

SEQ ID NO: 1154301 - RNA, 19 nt, Homo sapiens
gguguuugaucauuuaguu

SEQ ID NO: 1154302 - RNA, 19 nt, Homo sapiens
caagaggaaugaagacaag

SEQ ID NO: 1154303 - RNA, 19 nt, Homo sapiens
gaaagaggccaagaagaga

SEQ ID NO: 1154304 - RNA, 19 nt, Homo sapiens
ggaagaacauuuuacguau

SEQ ID NO: 1154305 - RNA, 19 nt, Homo sapiens
uugcaaaccugaagcacua

SEQ ID NO: 1154306 - RNA, 19 nt, Homo sapiens
acuaugaacugauuguuga

SEQ ID NO: 1154307 - RNA, 19 nt, Homo sapiens
gaagaugccaguaaugaag

SEQ ID NO: 1154308 - RNA, 19 nt, Homo sapiens
uaacugcccugccuacuac

SEQ ID NO: 1154309 - RNA, 19 nt, Homo sapiens
ugaaggauccauguuauuu

SEQ ID NO: 1154310 - RNA, 19 nt, Homo sapiens
gcagauauucgcuauguca

SEQ ID NO: 1154311 - RNA, 19 nt, Homo sapiens
ggagcacggagaaccauua

SEQ ID NO: 1154312 - RNA, 19 nt, Homo sapiens
ccaagggaagguacauuua

SEQ ID NO: 1154313 - RNA, 19 nt, Homo sapiens
ggaagaaaggguugauaau

SEQ ID NO: 1154314 - RNA, 19 nt, Homo sapiens
caacaacgcccugggagaa

SEQ ID NO: 1154315 - RNA, 19 nt, Homo sapiens
caaggaaauuguccaccaa

SEQ ID NO: 1154316 - RNA, 19 nt, Homo sapiens
cagaagacaucagaacaga

SEQ ID NO: 1154317 - RNA, 19 nt, Homo sapiens
gaaggauccauguuauuug

SEQ ID NO: 1154318 - RNA, 19 nt, Homo sapiens
ggcccgagcugaagcaguu

SEQ ID NO: 1154319 - RNA, 19 nt, Homo sapiens
gcaagcgggugaagacaag

SEQ ID NO: 1154320 - RNA, 19 nt, Homo sapiens
cggacaaccuuccuccuaa

SEQ ID NO: 1154321 - RNA, 19 nt, Homo sapiens
gaaaauuccuucugguuca

SEQ ID NO: 1154322 - RNA, 19 nt, Homo sapiens
gaagacgaaguguuuguga

SEQ ID NO: 1154323 - RNA, 19 nt, Homo sapiens
gagaagaaaccagaagcua

SEQ ID NO: 1154324 - RNA, 19 nt, Homo sapiens
cagugaagcccaagcauaa

SEQ ID NO: 1154325 - RNA, 19 nt, Homo sapiens
gaacggaguagagauguau

SEQ ID NO: 1154326 - RNA, 19 nt, Homo sapiens
caguggaacucaggguuua

SEQ ID NO: 1154327 - RNA, 19 nt, Homo sapiens
gggaugagguugugcacau

SEQ ID NO: 1154328 - RNA, 19 nt, Homo sapiens
acauuuaucuggaggcauu

SEQ ID NO: 1154329 - RNA, 19 nt, Homo sapiens
cuugagggaucauguguuu

SEQ ID NO: 1154330 - RNA, 19 nt, Homo sapiens
ugaguuugcuucaggcauu

SEQ ID NO: 1154331 - RNA, 19 nt, Homo sapiens
guaagacuguuugaauugu

SEQ ID NO: 1154332 - RNA, 19 nt, Homo sapiens
cagcagagucuuccaaguu

SEQ ID NO: 1154333 - RNA, 19 nt, Homo sapiens
gcaagacaguggcuuuggu

SEQ ID NO: 1154334 - RNA, 19 nt, Homo sapiens
ggagaagaguccagagaac

SEQ ID NO: 1154335 - RNA, 19 nt, Homo sapiens
gaggaaggccauacagaga

SEQ ID NO: 1154336 - RNA, 19 nt, Homo sapiens
ggacaaccuuccuccuaag

SEQ ID NO: 1154337 - RNA, 19 nt, Homo sapiens
ccacuuccauaacaagaga

SEQ ID NO: 1154338 - RNA, 19 nt, Homo sapiens
ccuaagaaacaaacuauga

SEQ ID NO: 1154339 - RNA, 19 nt, Homo sapiens
caaugaguuugacaaguau

SEQ ID NO: 1154340 - RNA, 19 nt, Homo sapiens
ggaacaggcagaugucaau

SEQ ID NO: 1154341 - RNA, 19 nt, Homo sapiens
gcaagaggaaugaagacaa

SEQ ID NO: 1154342 - RNA, 19 nt, Homo sapiens
acaccacccuccuucauga

SEQ ID NO: 1154343 - RNA, 19 nt, Homo sapiens
ccaacuaugaccaugcuua

SEQ ID NO: 1154344 - RNA, 19 nt, Homo sapiens
guguguaugugugaaauaa

SEQ ID NO: 1154345 - RNA, 19 nt, Homo sapiens
gugcuaaccacuuauuuga

SEQ ID NO: 1154346 - RNA, 19 nt, Homo sapiens
gaaguccacgcuccucauu

SEQ ID NO: 1154347 - RNA, 19 nt, Homo sapiens
cgcaagggcuggucacaga

SEQ ID NO: 1154348 - RNA, 19 nt, Homo sapiens
cauuccagcuccucuacua

SEQ ID NO: 1154349 - RNA, 19 nt, Homo sapiens
caagccuagugccacauua

SEQ ID NO: 1154350 - RNA, 19 nt, Homo sapiens
acaggcagaugucaaugaa

SEQ ID NO: 1154351 - RNA, 19 nt, Homo sapiens
ugucagcucuucaggaugu

SEQ ID NO: 1154352 - RNA, 19 nt, Homo sapiens
gcacccauccagacucaaa

SEQ ID NO: 1154353 - RNA, 19 nt, Homo sapiens
gcuuuggucuugugaagga

SEQ ID NO: 1154354 - RNA, 19 nt, Homo sapiens
gaaacagucuccuccuuua

SEQ ID NO: 1154355 - RNA, 19 nt, Homo sapiens
gcacgaaccuucauuuaug

SEQ ID NO: 1154356 - RNA, 19 nt, Homo sapiens
gaaugugacuccuuaaauu

SEQ ID NO: 1154357 - RNA, 19 nt, Homo sapiens
gcauuuagauugcguugua

SEQ ID NO: 1154358 - RNA, 19 nt, Homo sapiens
ugacaaagaugguggaauu

SEQ ID NO: 1154359 - RNA, 19 nt, Homo sapiens
gaagugcaauacuacaaua

SEQ ID NO: 1154360 - RNA, 19 nt, Homo sapiens
caucagaaguucauaauug

SEQ ID NO: 1154361 - RNA, 19 nt, Homo sapiens
ggagggagcugaaugugaa

SEQ ID NO: 1154362 - RNA, 19 nt, Homo sapiens
ggaggaggcuggccaaaga

SEQ ID NO: 1154363 - RNA, 19 nt, Homo sapiens
ccacagagcuauuuacauc

SEQ ID NO: 1154364 - RNA, 19 nt, Homo sapiens
cgaaagauaucaagagaug

SEQ ID NO: 1154365 - RNA, 19 nt, Homo sapiens
cgagauauaccaaacauua

SEQ ID NO: 1154366 - RNA, 19 nt, Homo sapiens
gagaaauccuguagcauga

SEQ ID NO: 1154367 - RNA, 19 nt, Homo sapiens
agacacagcuucagaaugu

SEQ ID NO: 1154368 - RNA, 19 nt, Homo sapiens
gaacgacacuucccaggau

SEQ ID NO: 1154369 - RNA, 19 nt, Homo sapiens
gcaguuggaugaauagaga

SEQ ID NO: 1154370 - RNA, 19 nt, Homo sapiens
acaaauggaugaugacaaa

SEQ ID NO: 1154371 - RNA, 19 nt, Homo sapiens
gaacugcauuuacuauugu

SEQ ID NO: 1154372 - RNA, 19 nt, Homo sapiens
gcaauuguuuacacacuuu

SEQ ID NO: 1154373 - RNA, 19 nt, Homo sapiens
gagaugaggugucccuaga

SEQ ID NO: 1154374 - RNA, 19 nt, Homo sapiens
gagaagaucuguggcuuuc

SEQ ID NO: 1154375 - RNA, 19 nt, Homo sapiens
ccucacaguuucuauagua

SEQ ID NO: 1154376 - RNA, 19 nt, Homo sapiens
uggcaucuguaaacuauua

SEQ ID NO: 1154377 - RNA, 19 nt, Homo sapiens
uggaggaguugaugacuua

SEQ ID NO: 1154378 - RNA, 19 nt, Homo sapiens
gaggaguucuucccuuuga

SEQ ID NO: 1154379 - RNA, 19 nt, Homo sapiens
ggaaacagucuccuccuuu

SEQ ID NO: 1154380 - RNA, 19 nt, Homo sapiens
uuagagagcuuacaaacug

SEQ ID NO: 1154381 - RNA, 19 nt, Homo sapiens
caaagaugguggaauugaa

SEQ ID NO: 1154382 - RNA, 19 nt, Homo sapiens
gggagcaugugcauuguuu

SEQ ID NO: 1154383 - RNA, 19 nt, Homo sapiens
gaagaaaucuaagugaacu

SEQ ID NO: 1154384 - RNA, 19 nt, Homo sapiens
uaaaccuccuggaucauua

SEQ ID NO: 1154385 - RNA, 19 nt, Homo sapiens
ugacuuagaugaagacaca

SEQ ID NO: 1154386 - RNA, 19 nt, Homo sapiens
caaagaaagcucucucuga

SEQ ID NO: 1154387 - RNA, 19 nt, Homo sapiens
guuaacacaugaaguagaa

SEQ ID NO: 1154388 - RNA, 19 nt, Homo sapiens
cagaugcacuucagaaaug

SEQ ID NO: 1154389 - RNA, 19 nt, Homo sapiens
caagggauauuuacugcuu

SEQ ID NO: 1154390 - RNA, 19 nt, Homo sapiens
ggacuuacaagcuuuaaug

SEQ ID NO: 1154391 - RNA, 19 nt, Homo sapiens
gaaaugaagaggaggaaga

SEQ ID NO: 1154392 - RNA, 19 nt, Homo sapiens
agaaagcucucucugaguu

SEQ ID NO: 1154393 - RNA, 19 nt, Homo sapiens
gcacagagaagauaaacau

SEQ ID NO: 1154394 - RNA, 19 nt, Homo sapiens
agucauuucugccuauuua

SEQ ID NO: 1154395 - RNA, 19 nt, Homo sapiens
ucuacugucugcuuauuua

SEQ ID NO: 1154396 - RNA, 19 nt, Homo sapiens
ggacauuucuguaaguuuu

SEQ ID NO: 1154397 - RNA, 19 nt, Homo sapiens
uguguaagcugucuuguug

SEQ ID NO: 1154398 - RNA, 19 nt, Homo sapiens
cuaauggacuuacaagaga

SEQ ID NO: 1154399 - RNA, 19 nt, Homo sapiens
caaauucaaccaagggaua

SEQ ID NO: 1154400 - RNA, 19 nt, Homo sapiens
gaauaacugcaaaggauuu

SEQ ID NO: 1154401 - RNA, 19 nt, Homo sapiens
caaguugcccugcgcuuua

SEQ ID NO: 1154402 - RNA, 19 nt, Homo sapiens
ucagauagcccauaacuca

SEQ ID NO: 1154403 - RNA, 19 nt, Homo sapiens
gaaaugcagcuagcuauug

SEQ ID NO: 1154404 - RNA, 19 nt, Homo sapiens
ucagaaauggcuucaguua

SEQ ID NO: 1154405 - RNA, 19 nt, Homo sapiens
gauugaggauuuauggaaa

SEQ ID NO: 1154406 - RNA, 19 nt, Homo sapiens
uuggaaagcuacaguaauu

SEQ ID NO: 1154407 - RNA, 19 nt, Homo sapiens
gaaaaguugugcauaaaga

SEQ ID NO: 1154408 - RNA, 19 nt, Homo sapiens
ugaacugcauuuacuauug

SEQ ID NO: 1154409 - RNA, 19 nt, Homo sapiens
gcccugcgcuuuaucgaaa

SEQ ID NO: 1154410 - RNA, 19 nt, Homo sapiens
ccaauagugucacaauuuc

SEQ ID NO: 1154411 - RNA, 19 nt, Homo sapiens
caucagagaagauaugaaa

SEQ ID NO: 1154412 - RNA, 19 nt, Homo sapiens
gaagaagacagauuuaguc

SEQ ID NO: 1154413 - RNA, 19 nt, Homo sapiens
ugacagaaacuaagaguau

SEQ ID NO: 1154414 - RNA, 19 nt, Homo sapiens
ccucuucccuuuauucuga

SEQ ID NO: 1154415 - RNA, 19 nt, Homo sapiens
ucaguuaacacaugaagua

SEQ ID NO: 1154416 - RNA, 19 nt, Homo sapiens
gaaauggcuucaguuaaca

SEQ ID NO: 1154417 - RNA, 19 nt, Homo sapiens
ugaacuggcugacuugaug

SEQ ID NO: 1154418 - RNA, 19 nt, Homo sapiens
agaaauggcuucaguuaac

SEQ ID NO: 1154419 - RNA, 19 nt, Homo sapiens
gcuaauugauaaaccagaa

SEQ ID NO: 1154420 - RNA, 19 nt, Homo sapiens
caaugcagauggauguuug

SEQ ID NO: 1154421 - RNA, 19 nt, Homo sapiens
gaaaugagacaguuuacag

SEQ ID NO: 1154422 - RNA, 19 nt, Homo sapiens
gaacgcagccgggaucaga

SEQ ID NO: 1154423 - RNA, 19 nt, Homo sapiens
ccugaugucuccuauaaau

SEQ ID NO: 1154424 - RNA, 19 nt, Homo sapiens
gaugaacaacugauacauu

SEQ ID NO: 1154425 - RNA, 19 nt, Homo sapiens
agaguuaaguuccauauag

SEQ ID NO: 1154426 - RNA, 19 nt, Homo sapiens
caacgacaguaaaccaguu

SEQ ID NO: 1154427 - RNA, 19 nt, Homo sapiens
uaaauaaccggaaccaaug

SEQ ID NO: 1154428 - RNA, 19 nt, Homo sapiens
agaggaaagugaugaauuc

SEQ ID NO: 1154429 - RNA, 19 nt, Homo sapiens
gaauugaaguagaggaaag

SEQ ID NO: 1154430 - RNA, 19 nt, Homo sapiens
guuaacaucuagggaguuu

SEQ ID NO: 1154431 - RNA, 19 nt, Homo sapiens
ggauucaggcaauuguuua

SEQ ID NO: 1154432 - RNA, 19 nt, Homo sapiens
caagcaaaguguacaaugg

SEQ ID NO: 1154433 - RNA, 19 nt, Homo sapiens
gaauucaucagagaagaua

SEQ ID NO: 1154434 - RNA, 19 nt, Homo sapiens
cuucuuaucuuuccacaga

SEQ ID NO: 1154435 - RNA, 19 nt, Homo sapiens
cagagcaucuucuuaucuu

SEQ ID NO: 1154436 - RNA, 19 nt, Homo sapiens
ccagauauccucucagugu

SEQ ID NO: 1154437 - RNA, 19 nt, Homo sapiens
gaagaucuguggcuuucag

SEQ ID NO: 1154438 - RNA, 19 nt, Homo sapiens
cagaaauguugcuguagaa

SEQ ID NO: 1154439 - RNA, 19 nt, Homo sapiens
gaaagccacgauggacuua

SEQ ID NO: 1154440 - RNA, 19 nt, Homo sapiens
ggcaacaaauugagaagau

SEQ ID NO: 1154441 - RNA, 19 nt, Homo sapiens
ucuagggaguuucugcuua

SEQ ID NO: 1154442 - RNA, 19 nt, Homo sapiens
gagguaggguugaggaaca

SEQ ID NO: 1154443 - RNA, 19 nt, Homo sapiens
gcucuucaaacaauacaua

SEQ ID NO: 1154444 - RNA, 19 nt, Homo sapiens
ugcaaaggauuuacgguuu

SEQ ID NO: 1154445 - RNA, 19 nt, Homo sapiens
cuaauugacuugauuucug

SEQ ID NO: 1154446 - RNA, 19 nt, Homo sapiens
aaacguaauugcacuacug

SEQ ID NO: 1154447 - RNA, 19 nt, Homo sapiens
gcuuucagauagcccauaa

SEQ ID NO: 1154448 - RNA, 19 nt, Homo sapiens
gcaaaaugauggaugaaau

SEQ ID NO: 1154449 - RNA, 19 nt, Homo sapiens
uaacacgcccaccucauaa

SEQ ID NO: 1154450 - RNA, 19 nt, Homo sapiens
gaagaugggaggagcuguu

SEQ ID NO: 1154451 - RNA, 19 nt, Homo sapiens
ggggaaaaguugugcauaa

SEQ ID NO: 1154452 - RNA, 19 nt, Homo sapiens
ccauauagcaacaaaguau

SEQ ID NO: 1154453 - RNA, 19 nt, Homo sapiens
cuuuaagccucgagauaua

SEQ ID NO: 1154454 - RNA, 19 nt, Homo sapiens
ccacagaccuccaggauaa

SEQ ID NO: 1154455 - RNA, 19 nt, Homo sapiens
gcacacaaaucaguucuug

SEQ ID NO: 1154456 - RNA, 19 nt, Homo sapiens
gaaagucaaugcugauagu

SEQ ID NO: 1154457 - RNA, 19 nt, Homo sapiens
ggaaaaggauauaggaaua

SEQ ID NO: 1154458 - RNA, 19 nt, Homo sapiens
gaaguacgagugcacaaua

SEQ ID NO: 1154459 - RNA, 19 nt, Homo sapiens
gaagaggaaugggagcuuu

SEQ ID NO: 1154460 - RNA, 19 nt, Homo sapiens
gaacagggcaucaaguuuc

SEQ ID NO: 1154461 - RNA, 19 nt, Homo sapiens
gcugugaguuuguguguuu

SEQ ID NO: 1154462 - RNA, 19 nt, Homo sapiens
gcacauccuuaucucauug

SEQ ID NO: 1154463 - RNA, 19 nt, Homo sapiens
gaauuaaugcacauccuua

SEQ ID NO: 1154464 - RNA, 19 nt, Homo sapiens
guaauaaugugauggcaau

SEQ ID NO: 1154465 - RNA, 19 nt, Homo sapiens
caaacaaacccuacaaaug

SEQ ID NO: 1154466 - RNA, 19 nt, Homo sapiens
agucaaugcugauaguuua

SEQ ID NO: 1154467 - RNA, 19 nt, Homo sapiens
gaauguaucgacuuucuuu

SEQ ID NO: 1154468 - RNA, 19 nt, Homo sapiens
gagauuauguccacuuaag

SEQ ID NO: 1154469 - RNA, 19 nt, Homo sapiens
gaagcauacuuggaacuaa

SEQ ID NO: 1154470 - RNA, 19 nt, Homo sapiens
gaaaccaacugacauacag

SEQ ID NO: 1154471 - RNA, 19 nt, Homo sapiens
guucauuaaucuuccguua

SEQ ID NO: 1154472 - RNA, 19 nt, Homo sapiens
gaaugcauccuuugagauu

SEQ ID NO: 1154473 - RNA, 19 nt, Homo sapiens
gcauucagauugcagauca

SEQ ID NO: 1154474 - RNA, 19 nt, Homo sapiens
aaagagaaaucaggacaaa

SEQ ID NO: 1154475 - RNA, 19 nt, Homo sapiens
ucucauugcuggcuucuuu

SEQ ID NO: 1154476 - RNA, 19 nt, Homo sapiens
gaucaucaguugagacaag

SEQ ID NO: 1154477 - RNA, 19 nt, Homo sapiens
gauugcagaucaucaguug

SEQ ID NO: 1154478 - RNA, 19 nt, Homo sapiens
caaaucaguucuugcuuca

SEQ ID NO: 1154479 - RNA, 19 nt, Homo sapiens
ggagucagauggacaacau

SEQ ID NO: 1154480 - RNA, 19 nt, Homo sapiens
aguguuagcuuccaucaaa

SEQ ID NO: 1154481 - RNA, 19 nt, Homo sapiens
ggaaagaugccauggaagu

SEQ ID NO: 1154482 - RNA, 19 nt, Homo sapiens
ggaguaccuuucacaucua

SEQ ID NO: 1154483 - RNA, 19 nt, Homo sapiens
gagaaaucaucaguuaaga

SEQ ID NO: 1154484 - RNA, 19 nt, Homo sapiens
cagaaugcauccuuugaga

SEQ ID NO: 1154485 - RNA, 19 nt, Homo sapiens
gagacaagccaccaagauu

SEQ ID NO: 1154486 - RNA, 19 nt, Homo sapiens
aaacaaacccuacaaaugc

SEQ ID NO: 1154487 - RNA, 19 nt, Homo sapiens
caucuucagcuaucucuua

SEQ ID NO: 1154488 - RNA, 19 nt, Homo sapiens
ggccaaccauggacuuauu

SEQ ID NO: 1154489 - RNA, 19 nt, Homo sapiens
gaauaucccaucauccuau

SEQ ID NO: 1154490 - RNA, 19 nt, Homo sapiens
gaacuaaugaaggguauau

SEQ ID NO: 1154491 - RNA, 19 nt, Homo sapiens
cgggaaagaugccauggaa

SEQ ID NO: 1154492 - RNA, 19 nt, Homo sapiens
aaucaguucuugcuucauu

SEQ ID NO: 1154493 - RNA, 19 nt, Homo sapiens
aaccagaacucggauguuu

SEQ ID NO: 1154494 - RNA, 19 nt, Homo sapiens
cagcugaccucgggaaaga

SEQ ID NO: 1154495 - RNA, 19 nt, Homo sapiens
guuaaacauucaugccaaa

SEQ ID NO: 1154496 - RNA, 19 nt, Homo sapiens
gugaaucggacaaauauga

SEQ ID NO: 1154497 - RNA, 19 nt, Homo sapiens
ucagcuaucucuuacacuu

SEQ ID NO: 1154498 - RNA, 19 nt, Homo sapiens
gauguacacugggaagaug

SEQ ID NO: 1154499 - RNA, 19 nt, Homo sapiens
uugcuucauucuccaauua

SEQ ID NO: 1154500 - RNA, 19 nt, Homo sapiens
aguaaggacugaaggagaa

SEQ ID NO: 1154501 - RNA, 19 nt, Homo sapiens
gauguaguaacuucaauga

SEQ ID NO: 1154502 - RNA, 19 nt, Homo sapiens
uguggguacuugcuaauaa

SEQ ID NO: 1154503 - RNA, 19 nt, Homo sapiens
uauguccacuuaagagaaa

SEQ ID NO: 1154504 - RNA, 19 nt, Homo sapiens
ucucccagcugacuucaaa

SEQ ID NO: 1154505 - RNA, 19 nt, Homo sapiens
guggguacuugcuaauaaa

SEQ ID NO: 1154506 - RNA, 19 nt, Homo sapiens
ccuggaauguaucgacuuu

SEQ ID NO: 1154507 - RNA, 19 nt, Homo sapiens
caaauaugacucccucaga

SEQ ID NO: 1154508 - RNA, 19 nt, Homo sapiens
caggugaaucggacaaaua

SEQ ID NO: 1154509 - RNA, 19 nt, Homo sapiens
guauuugaguuucugacaa

SEQ ID NO: 1154510 - RNA, 19 nt, Homo sapiens
ggagggaacacauguacau

SEQ ID NO: 1154511 - RNA, 19 nt, Homo sapiens
acagugagcugcagcacau

SEQ ID NO: 1154512 - RNA, 19 nt, Homo sapiens
cuggaacucugcacauuug

SEQ ID NO: 1154513 - RNA, 19 nt, Homo sapiens
gaaagaugccauggaagug

SEQ ID NO: 1154514 - RNA, 19 nt, Homo sapiens
aaacaggagccagaaguaa

SEQ ID NO: 1154515 - RNA, 19 nt, Homo sapiens
agaagggccucacaagaca

SEQ ID NO: 1154516 - RNA, 19 nt, Homo sapiens
gcuaauaaacaggugaauu

SEQ ID NO: 1154517 - RNA, 19 nt, Homo sapiens
caugacaagcugugaguuu

SEQ ID NO: 1154518 - RNA, 19 nt, Homo sapiens
gacugaaugucacuuaucu

SEQ ID NO: 1154519 - RNA, 19 nt, Homo sapiens
ggaggagaccaaucuggaa

SEQ ID NO: 1154520 - RNA, 19 nt, Homo sapiens
ccacuggcuucuucauugu

SEQ ID NO: 1154521 - RNA, 19 nt, Homo sapiens
aaagaagggccucacaaga

SEQ ID NO: 1154522 - RNA, 19 nt, Homo sapiens
uguaguaacuucaaugacu

SEQ ID NO: 1154523 - RNA, 19 nt, Homo sapiens
gugauggcaaucuuaauuu

SEQ ID NO: 1154524 - RNA, 19 nt, Homo sapiens
aaaugcaacuugugugaca

SEQ ID NO: 1154525 - RNA, 19 nt, Homo sapiens
gcaaauuuauccagaaaag

SEQ ID NO: 1154526 - RNA, 19 nt, Homo sapiens
cacaauagcccacgucaag

SEQ ID NO: 1154527 - RNA, 19 nt, Homo sapiens
cccacuggcuucuucauug

SEQ ID NO: 1154528 - RNA, 19 nt, Homo sapiens
ucauuaaucuuccguuagg

SEQ ID NO: 1154529 - RNA, 19 nt, Homo sapiens
cagcaccggcgacagauuu

SEQ ID NO: 1154530 - RNA, 19 nt, Homo sapiens
ggauauaggaauacucauc

SEQ ID NO: 1154531 - RNA, 19 nt, Homo sapiens
cagcugccagugauaauuu

SEQ ID NO: 1154532 - RNA, 19 nt, Homo sapiens
uugagauuauguccacuua

SEQ ID NO: 1154533 - RNA, 19 nt, Homo sapiens
cggcugggcucuguacuau

SEQ ID NO: 1154534 - RNA, 19 nt, Homo sapiens
gacgcaaauuuauccagaa

SEQ ID NO: 1154535 - RNA, 19 nt, Homo sapiens
agacaagccaccaagauug

SEQ ID NO: 1154536 - RNA, 19 nt, Homo sapiens
gcuggcuucuuuccaaguu

SEQ ID NO: 1154537 - RNA, 19 nt, Homo sapiens
gcugggcucuguacuaugc

SEQ ID NO: 1154538 - RNA, 19 nt, Homo sapiens
aagcauacuuggaacuaau

SEQ ID NO: 1154539 - RNA, 19 nt, Homo sapiens
cugaaugucacuuaucuuu

SEQ ID NO: 1154540 - RNA, 19 nt, Homo sapiens
aaacaaacaaacccuacaa

SEQ ID NO: 1154541 - RNA, 19 nt, Homo sapiens
gagggaacacauguacaua

SEQ ID NO: 1154542 - RNA, 19 nt, Homo sapiens
acgcaaauuuauccagaaa

SEQ ID NO: 1154543 - RNA, 19 nt, Homo sapiens
aagccgggaugauaaguga

SEQ ID NO: 1154544 - RNA, 19 nt, Homo sapiens
cgacccgguucgauuagaa

SEQ ID NO: 1154545 - RNA, 19 nt, Homo sapiens
gggaauuugugaccagaag

SEQ ID NO: 1154546 - RNA, 19 nt, Homo sapiens
gauauaggaauacucaucu

SEQ ID NO: 1154547 - RNA, 19 nt, Homo sapiens
accagagcaucgacacuua

SEQ ID NO: 1154548 - RNA, 19 nt, Homo sapiens
gauguuuauucuccagguu

SEQ ID NO: 1154549 - RNA, 19 nt, Homo sapiens
auaguuuacuggcaacauu

SEQ ID NO: 1154550 - RNA, 19 nt, Homo sapiens
uaggaauacucaucuuaca

SEQ ID NO: 1154551 - RNA, 19 nt, Homo sapiens
ugccagugauaauuuguuu

SEQ ID NO: 1154552 - RNA, 19 nt, Homo sapiens
gauauuggaaagauaaugg

SEQ ID NO: 1154553 - RNA, 19 nt, Homo sapiens
agacauugcugacauugac

SEQ ID NO: 1154554 - RNA, 19 nt, Homo sapiens
ucagaaagauggaaaguua

SEQ ID NO: 1154555 - RNA, 19 nt, Homo sapiens
caaaggagcuacaacuaua

SEQ ID NO: 1154556 - RNA, 19 nt, Homo sapiens
gagcaaaccuucagaaaga

SEQ ID NO: 1154557 - RNA, 19 nt, Homo sapiens
gauauuggcugaccuagaa

SEQ ID NO: 1154558 - RNA, 19 nt, Homo sapiens
gacaguaucugauugguuu

SEQ ID NO: 1154559 - RNA, 19 nt, Homo sapiens
gcaaugaaauaccaucuau

SEQ ID NO: 1154560 - RNA, 19 nt, Homo sapiens
agacauaccucaacacuau

SEQ ID NO: 1154561 - RNA, 19 nt, Homo sapiens
ggacacagauggcuuccuu

SEQ ID NO: 1154562 - RNA, 19 nt, Homo sapiens
gaacaaaucuguggaucca

SEQ ID NO: 1154563 - RNA, 19 nt, Homo sapiens
gcacauaggcuuguucuga

SEQ ID NO: 1154564 - RNA, 19 nt, Homo sapiens
gaaaggagagaccaauauu

SEQ ID NO: 1154565 - RNA, 19 nt, Homo sapiens
guuaguagaucaaacagaa

SEQ ID NO: 1154566 - RNA, 19 nt, Homo sapiens
ggacagacauaccucaaca

SEQ ID NO: 1154567 - RNA, 19 nt, Homo sapiens
agaaagauaugaucccaaa

SEQ ID NO: 1154568 - RNA, 19 nt, Homo sapiens
caucagagauaaugguuga

SEQ ID NO: 1154569 - RNA, 19 nt, Homo sapiens
uaaauaggcccauguaaau

SEQ ID NO: 1154570 - RNA, 19 nt, Homo sapiens
caaagaugcaguguaauua

SEQ ID NO: 1154571 - RNA, 19 nt, Homo sapiens
agaaugaucuggaauguca

SEQ ID NO: 1154572 - RNA, 19 nt, Homo sapiens
ggacggcaguggcagcuuu

SEQ ID NO: 1154573 - RNA, 19 nt, Homo sapiens
gauguuauccugauuguug

SEQ ID NO: 1154574 - RNA, 19 nt, Homo sapiens
guuggaguguuuaugauua

SEQ ID NO: 1154575 - RNA, 19 nt, Homo sapiens
ccauuaaguuggaguguuu

SEQ ID NO: 1154576 - RNA, 19 nt, Homo sapiens
acaaauaaguggaacaugu

SEQ ID NO: 1154577 - RNA, 19 nt, Homo sapiens
ggagcuaucugaauacagu

SEQ ID NO: 1154578 - RNA, 19 nt, Homo sapiens
gagcaugcuucuugccuuu

SEQ ID NO: 1154579 - RNA, 19 nt, Homo sapiens
gcauccaucuaacuguuua

SEQ ID NO: 1154580 - RNA, 19 nt, Homo sapiens
gaccacaacucauucaauc

SEQ ID NO: 1154581 - RNA, 19 nt, Homo sapiens
gaaaccaucuuccaugcau

SEQ ID NO: 1154582 - RNA, 19 nt, Homo sapiens
ugaaagaguuaguagauca

SEQ ID NO: 1154583 - RNA, 19 nt, Homo sapiens
aaggaucucuguagcguua

SEQ ID NO: 1154584 - RNA, 19 nt, Homo sapiens
ccacauguuuguaauuguu

SEQ ID NO: 1154585 - RNA, 19 nt, Homo sapiens
ccaaagaugcaguguaauu

SEQ ID NO: 1154586 - RNA, 19 nt, Homo sapiens
ggacauuuguagccaguau

SEQ ID NO: 1154587 - RNA, 19 nt, Homo sapiens
gaaauaugaucugagaaca

SEQ ID NO: 1154588 - RNA, 19 nt, Homo sapiens
agagaaauaugaucugaga

SEQ ID NO: 1154589 - RNA, 19 nt, Homo sapiens
gaaguuaucagaaaucaag

SEQ ID NO: 1154590 - RNA, 19 nt, Homo sapiens
gaagacagaauauuucauc

SEQ ID NO: 1154591 - RNA, 19 nt, Homo sapiens
acagauggcuuccuugaau

SEQ ID NO: 1154592 - RNA, 19 nt, Homo sapiens
ggcuggagcuaucugaaua

SEQ ID NO: 1154593 - RNA, 19 nt, Homo sapiens
cgagauggcuuaaagacau

SEQ ID NO: 1154594 - RNA, 19 nt, Homo sapiens
gauggaaaguuauuugaag

SEQ ID NO: 1154595 - RNA, 19 nt, Homo sapiens
cgaaagauaccugcacaua

SEQ ID NO: 1154596 - RNA, 19 nt, Homo sapiens
cagcaacuuugugauguua

SEQ ID NO: 1154597 - RNA, 19 nt, Homo sapiens
agccaaagaugcaguguaa

SEQ ID NO: 1154598 - RNA, 19 nt, Homo sapiens
ggccauauguuaguuaguu

SEQ ID NO: 1154599 - RNA, 19 nt, Homo sapiens
ggaccaugguggcuccuuu

SEQ ID NO: 1154600 - RNA, 19 nt, Homo sapiens
gaaagauaccugcacauag

SEQ ID NO: 1154601 - RNA, 19 nt, Homo sapiens
caaccuugacuuauugaua

SEQ ID NO: 1154602 - RNA, 19 nt, Homo sapiens
gagcacaguugguguagca

SEQ ID NO: 1154603 - RNA, 19 nt, Homo sapiens
caauguuccugaugaagaa

SEQ ID NO: 1154604 - RNA, 19 nt, Homo sapiens
aaagauaccugcacauagg

SEQ ID NO: 1154605 - RNA, 19 nt, Homo sapiens
gaaaagacuucgaugugaa

SEQ ID NO: 1154606 - RNA, 19 nt, Homo sapiens
ucacuaggcuuaccauuuu

SEQ ID NO: 1154607 - RNA, 19 nt, Homo sapiens
caaacuguccuacuaauca

SEQ ID NO: 1154608 - RNA, 19 nt, Homo sapiens
gagaacaauuagagaaaca

SEQ ID NO: 1154609 - RNA, 19 nt, Homo sapiens
cagauggcuuccuugaaua

SEQ ID NO: 1154610 - RNA, 19 nt, Homo sapiens
gaccugagcaugcuucuug

SEQ ID NO: 1154611 - RNA, 19 nt, Homo sapiens
ugaugugggucaaguauga

SEQ ID NO: 1154612 - RNA, 19 nt, Homo sapiens
gaagcggugugagcacuuu

SEQ ID NO: 1154613 - RNA, 19 nt, Homo sapiens
aaucaaagcugcauaucuc

SEQ ID NO: 1154614 - RNA, 19 nt, Homo sapiens
aaacaaacuguccuacuaa

SEQ ID NO: 1154615 - RNA, 19 nt, Homo sapiens
gaaacagauucaugcuugu

SEQ ID NO: 1154616 - RNA, 19 nt, Homo sapiens
caaguuguauucaguugga

SEQ ID NO: 1154617 - RNA, 19 nt, Homo sapiens
gcagcaacuuugugauguu

SEQ ID NO: 1154618 - RNA, 19 nt, Homo sapiens
caguagcucugaagaauuc

SEQ ID NO: 1154619 - RNA, 19 nt, Homo sapiens
ggaauccuaugacccacaa

SEQ ID NO: 1154620 - RNA, 19 nt, Homo sapiens
guacuugaaggcccuauuu

SEQ ID NO: 1154621 - RNA, 19 nt, Homo sapiens
gaucugagaacaaaucugu

SEQ ID NO: 1154622 - RNA, 19 nt, Homo sapiens
uaaguuggaguguuuauga

SEQ ID NO: 1154623 - RNA, 19 nt, Homo sapiens
cauaugauccauuaaguug

SEQ ID NO: 1154624 - RNA, 19 nt, Homo sapiens
uauguugaguucaguguaa

SEQ ID NO: 1154625 - RNA, 19 nt, Homo sapiens
gauucaugcuuguaucuug

SEQ ID NO: 1154626 - RNA, 19 nt, Homo sapiens
caaacagaauaguaggaaa

SEQ ID NO: 1154627 - RNA, 19 nt, Homo sapiens
uaaagacauugaacacugu

SEQ ID NO: 1154628 - RNA, 19 nt, Homo sapiens
gagauggcuuaaagacauu

SEQ ID NO: 1154629 - RNA, 19 nt, Homo sapiens
ggcaacaggugaaggaugu

SEQ ID NO: 1154630 - RNA, 19 nt, Homo sapiens
guucccggcuacuggauua

SEQ ID NO: 1154631 - RNA, 19 nt, Homo sapiens
caagagauugccaagagua

SEQ ID NO: 1154632 - RNA, 19 nt, Homo sapiens
uaagaaugaucuggaaugu

SEQ ID NO: 1154633 - RNA, 19 nt, Homo sapiens
gcccacagcuacacaaugg

SEQ ID NO: 1154634 - RNA, 19 nt, Homo sapiens
aaaacaaacuguccuacua

SEQ ID NO: 1154635 - RNA, 19 nt, Homo sapiens
guagaagacagaauauuuc

SEQ ID NO: 1154636 - RNA, 19 nt, Homo sapiens
cuacugauguugaaagagu

SEQ ID NO: 1154637 - RNA, 19 nt, Homo sapiens
aagcaaccuugacuuauug

SEQ ID NO: 1154638 - RNA, 19 nt, Homo sapiens
ccuagaaaaucaugcauua

SEQ ID NO: 1154639 - RNA, 19 nt, Homo sapiens
ucugauugguuuacuguuu

SEQ ID NO: 1154640 - RNA, 19 nt, Homo sapiens
aagaguagaagacagaaua

SEQ ID NO: 1154641 - RNA, 19 nt, Homo sapiens
ggagagaccaauauuugug

SEQ ID NO: 1154642 - RNA, 19 nt, Homo sapiens
aaugagaacuuccagagau

SEQ ID NO: 1154643 - RNA, 19 nt, Homo sapiens
uaccaucuauugccagaaa

SEQ ID NO: 1154644 - RNA, 19 nt, Homo sapiens
auaaauaggcccauguaaa

SEQ ID NO: 1154645 - RNA, 19 nt, Homo sapiens
uaauaaauaggcccaugua

SEQ ID NO: 1154646 - RNA, 19 nt, Homo sapiens
guugaacuccuuuagaauu

SEQ ID NO: 1154647 - RNA, 19 nt, Homo sapiens
cagagauaaugguugaauu

SEQ ID NO: 1154648 - RNA, 19 nt, Homo sapiens
ucaacacuauggaauccua

SEQ ID NO: 1154649 - RNA, 19 nt, Homo sapiens
caugauggcuggagcuauc

SEQ ID NO: 1154650 - RNA, 19 nt, Homo sapiens
gagcuacaacuauagagaa

SEQ ID NO: 1154651 - RNA, 19 nt, Homo sapiens
gcaaugaccugagcaugcu

SEQ ID NO: 1154652 - RNA, 19 nt, Homo sapiens
caaugacaccucaaaguga

SEQ ID NO: 1154653 - RNA, 19 nt, Homo sapiens
gauuauugcuagaaagaag

SEQ ID NO: 1154654 - RNA, 19 nt, Homo sapiens
caaagagacuguaauauug

SEQ ID NO: 1154655 - RNA, 19 nt, Homo sapiens
caaaugaacccaacaauaa

SEQ ID NO: 1154656 - RNA, 19 nt, Homo sapiens
ggagauucaucgaagauua

SEQ ID NO: 1154657 - RNA, 19 nt, Homo sapiens
guaauaagcuuagaaguuc

SEQ ID NO: 1154658 - RNA, 19 nt, Homo sapiens
guaaguaacugagagcaua

SEQ ID NO: 1154659 - RNA, 19 nt, Homo sapiens
ccaguaugcucuucuguua

SEQ ID NO: 1154660 - RNA, 19 nt, Homo sapiens
gaugauaaaugacucuuug

SEQ ID NO: 1154661 - RNA, 19 nt, Homo sapiens
caaaggacauauagaaaug

SEQ ID NO: 1154662 - RNA, 19 nt, Homo sapiens
cagaugaacucacaaauuc

SEQ ID NO: 1154663 - RNA, 19 nt, Homo sapiens
ugauaaagaucuuggcaua

SEQ ID NO: 1154664 - RNA, 19 nt, Homo sapiens
ucacagacuugaaauugua

SEQ ID NO: 1154665 - RNA, 19 nt, Homo sapiens
gaguguaugucucacaaua

SEQ ID NO: 1154666 - RNA, 19 nt, Homo sapiens
gcacaauccucaaauucuu

SEQ ID NO: 1154667 - RNA, 19 nt, Homo sapiens
ggacaugucauuaaacuga

SEQ ID NO: 1154668 - RNA, 19 nt, Homo sapiens
uggcugagcugcaaucuaa

SEQ ID NO: 1154669 - RNA, 19 nt, Homo sapiens
gaacugaagggaauauuga

SEQ ID NO: 1154670 - RNA, 19 nt, Homo sapiens
acagauaaguuccauauug

SEQ ID NO: 1154671 - RNA, 19 nt, Homo sapiens
gcaauucuaugcugaagga

SEQ ID NO: 1154672 - RNA, 19 nt, Homo sapiens
uaacagcccuccacagaga

SEQ ID NO: 1154673 - RNA, 19 nt, Homo sapiens
gaaguaaaggaccaaauaa

SEQ ID NO: 1154674 - RNA, 19 nt, Homo sapiens
ucaaggaacugggaaguaa

SEQ ID NO: 1154675 - RNA, 19 nt, Homo sapiens
guaacuaguugcucucauu

SEQ ID NO: 1154676 - RNA, 19 nt, Homo sapiens
cagauaaguuccauauuga

SEQ ID NO: 1154677 - RNA, 19 nt, Homo sapiens
guuaaauccuccagaagua

SEQ ID NO: 1154678 - RNA, 19 nt, Homo sapiens
gaagucaauuuaagugaug

SEQ ID NO: 1154679 - RNA, 19 nt, Homo sapiens
ugacaaagagacuguaaua

SEQ ID NO: 1154680 - RNA, 19 nt, Homo sapiens
gccaaugcauuucauguaa

SEQ ID NO: 1154681 - RNA, 19 nt, Homo sapiens
gaaaccagauugucuuugg

SEQ ID NO: 1154682 - RNA, 19 nt, Homo sapiens
ccaaauaacagcugugaaa

SEQ ID NO: 1154683 - RNA, 19 nt, Homo sapiens
gcugcaaucuaacacuuua

SEQ ID NO: 1154684 - RNA, 19 nt, Homo sapiens
ccacuggguucaauuuaaa

SEQ ID NO: 1154685 - RNA, 19 nt, Homo sapiens
gcuuagaaguucagauaaa

SEQ ID NO: 1154686 - RNA, 19 nt, Homo sapiens
guguaugucucacaauaua

SEQ ID NO: 1154687 - RNA, 19 nt, Homo sapiens
acacuuuacuguaccuuua

SEQ ID NO: 1154688 - RNA, 19 nt, Homo sapiens
agaagaagaugaauaaugg

SEQ ID NO: 1154689 - RNA, 19 nt, Homo sapiens
aagauuagguucaguagaa

SEQ ID NO: 1154690 - RNA, 19 nt, Homo sapiens
caagaauagugaacacauu

SEQ ID NO: 1154691 - RNA, 19 nt, Homo sapiens
gaagcuauccugaagaaga

SEQ ID NO: 1154692 - RNA, 19 nt, Homo sapiens
gauaaaugacucuuuggua

SEQ ID NO: 1154693 - RNA, 19 nt, Homo sapiens
cgacugacaucuucuggaa

SEQ ID NO: 1154694 - RNA, 19 nt, Homo sapiens
uaugauaccuugucacaug

SEQ ID NO: 1154695 - RNA, 19 nt, Homo sapiens
ggucaaaggacauauagaa

SEQ ID NO: 1154696 - RNA, 19 nt, Homo sapiens
gaacuagcauuugaauaca

SEQ ID NO: 1154697 - RNA, 19 nt, Homo sapiens
aaauaaaccugacuguaug

SEQ ID NO: 1154698 - RNA, 19 nt, Homo sapiens
ucaaaugaacccaacaaua

SEQ ID NO: 1154699 - RNA, 19 nt, Homo sapiens
ggaagcagcagaaacagaa

SEQ ID NO: 1154700 - RNA, 19 nt, Homo sapiens
gaaauccaacugaagcuuu

SEQ ID NO: 1154701 - RNA, 19 nt, Homo sapiens
ggcagcaaauucuuuauga

SEQ ID NO: 1154702 - RNA, 19 nt, Homo sapiens
gagcaaguaucaucucuac

SEQ ID NO: 1154703 - RNA, 19 nt, Homo sapiens
ccaacacucagcagaauua

SEQ ID NO: 1154704 - RNA, 19 nt, Homo sapiens
uaggaaagccagaaauuaa

SEQ ID NO: 1154705 - RNA, 19 nt, Homo sapiens
gauaggaaagccagaaauu

SEQ ID NO: 1154706 - RNA, 19 nt, Homo sapiens
agacuugccuuccugauga

SEQ ID NO: 1154707 - RNA, 19 nt, Homo sapiens
ugucacaucuccauacuga

SEQ ID NO: 1154708 - RNA, 19 nt, Homo sapiens
gcucagagacagugaacua

SEQ ID NO: 1154709 - RNA, 19 nt, Homo sapiens
caaugaaaccugacaaaga

SEQ ID NO: 1154710 - RNA, 19 nt, Homo sapiens
gaauuaaucaagcaccuaa

SEQ ID NO: 1154711 - RNA, 19 nt, Homo sapiens
gaacaucuccauccucaca

SEQ ID NO: 1154712 - RNA, 19 nt, Homo sapiens
caauugaucucuguauguu

SEQ ID NO: 1154713 - RNA, 19 nt, Homo sapiens
caauucaucuguuacuguu

SEQ ID NO: 1154714 - RNA, 19 nt, Homo sapiens
gcuauugcuuuccuauaaa

SEQ ID NO: 1154715 - RNA, 19 nt, Homo sapiens
acagugaacuagcauuuga

SEQ ID NO: 1154716 - RNA, 19 nt, Homo sapiens
ggucauaacguaucugaga

SEQ ID NO: 1154717 - RNA, 19 nt, Homo sapiens
gaaacugccuuacauugac

SEQ ID NO: 1154718 - RNA, 19 nt, Homo sapiens
ggaaugagagccaggauca

SEQ ID NO: 1154719 - RNA, 19 nt, Homo sapiens
agaaguaaaggaccaaaua

SEQ ID NO: 1154720 - RNA, 19 nt, Homo sapiens
gaggccagcugguuacaga

SEQ ID NO: 1154721 - RNA, 19 nt, Homo sapiens
gagcugcaaucuaacacuu

SEQ ID NO: 1154722 - RNA, 19 nt, Homo sapiens
auacagaacugaagggaau

SEQ ID NO: 1154723 - RNA, 19 nt, Homo sapiens
gagaagagcaaguaucauc

SEQ ID NO: 1154724 - RNA, 19 nt, Homo sapiens
gcaaauucuuuaugacagu

SEQ ID NO: 1154725 - RNA, 19 nt, Homo sapiens
ccugacagcuuuaaaucaa

SEQ ID NO: 1154726 - RNA, 19 nt, Homo sapiens
ugggauugcugacugguua

SEQ ID NO: 1154727 - RNA, 19 nt, Homo sapiens
gcucuucuguuaauaaugg

SEQ ID NO: 1154728 - RNA, 19 nt, Homo sapiens
gaucuuggcauacgaugaa

SEQ ID NO: 1154729 - RNA, 19 nt, Homo sapiens
ucaggaaacugggaaguga

SEQ ID NO: 1154730 - RNA, 19 nt, Homo sapiens
ccaagacugugguaagaug

SEQ ID NO: 1154731 - RNA, 19 nt, Homo sapiens
uaucuucucacuucacuua

SEQ ID NO: 1154732 - RNA, 19 nt, Homo sapiens
gcaggagauucaucgaaga

SEQ ID NO: 1154733 - RNA, 19 nt, Homo sapiens
uggagaauuucaccacaua

SEQ ID NO: 1154734 - RNA, 19 nt, Homo sapiens
ccaagagcuuugagacuga

SEQ ID NO: 1154735 - RNA, 19 nt, Homo sapiens
ggaaagcaguauccguauc

SEQ ID NO: 1154736 - RNA, 19 nt, Homo sapiens
cauaugaugucaaacagau

SEQ ID NO: 1154737 - RNA, 19 nt, Homo sapiens
ccagaugaacucacaaauu

SEQ ID NO: 1154738 - RNA, 19 nt, Homo sapiens
gugcauauacaguuaauga

SEQ ID NO: 1154739 - RNA, 19 nt, Homo sapiens
ggaagaaauaucugugcua

SEQ ID NO: 1154740 - RNA, 19 nt, Homo sapiens
uagggaaguuugggaguua

SEQ ID NO: 1154741 - RNA, 19 nt, Homo sapiens
ggaagggaauugcuauugc

SEQ ID NO: 1154742 - RNA, 19 nt, Homo sapiens
ggugagaauuagaaaugaa

SEQ ID NO: 1154743 - RNA, 19 nt, Homo sapiens
gaauuucaccacauagcua

SEQ ID NO: 1154744 - RNA, 19 nt, Homo sapiens
gaaugaggagcccguguuu

SEQ ID NO: 1154745 - RNA, 19 nt, Homo sapiens
gaguaaacguuugaugaau

SEQ ID NO: 1154746 - RNA, 19 nt, Homo sapiens
gaaugucaagggcagcuua

SEQ ID NO: 1154747 - RNA, 19 nt, Homo sapiens
gaugaauaauggaccguau

SEQ ID NO: 1154748 - RNA, 19 nt, Homo sapiens
ucacaucuccauacugaaa

SEQ ID NO: 1154749 - RNA, 19 nt, Homo sapiens
gcaauugaucucuguaugu

SEQ ID NO: 1154750 - RNA, 19 nt, Homo sapiens
guggucagccuacauagua

SEQ ID NO: 1154751 - RNA, 19 nt, Homo sapiens
gaaacugggaagugauaaa

SEQ ID NO: 1154752 - RNA, 19 nt, Homo sapiens
gcaucaagacauucaguuu

SEQ ID NO: 1154753 - RNA, 19 nt, Homo sapiens
cagaagaagaugaauaaug

SEQ ID NO: 1154754 - RNA, 19 nt, Homo sapiens
gaagaaagauggaacauuu

SEQ ID NO: 1154755 - RNA, 19 nt, Homo sapiens
gaaaauagcugcucaguua

SEQ ID NO: 1154756 - RNA, 19 nt, Homo sapiens
ggucacagaucuaucauaa

SEQ ID NO: 1154757 - RNA, 19 nt, Homo sapiens
gcaugaagccauagaauua

SEQ ID NO: 1154758 - RNA, 19 nt, Homo sapiens
ccaaggcucugauguauuu

SEQ ID NO: 1154759 - RNA, 19 nt, Homo sapiens
gaaagcagacugauacuaa

SEQ ID NO: 1154760 - RNA, 19 nt, Homo sapiens
ggaagaggaugaugauuug

SEQ ID NO: 1154761 - RNA, 19 nt, Homo sapiens
gagcagcaguugaggaaua

SEQ ID NO: 1154762 - RNA, 19 nt, Homo sapiens
gacauaaucucccuaguga

SEQ ID NO: 1154763 - RNA, 19 nt, Homo sapiens
gaaccucacuguagcauuc

SEQ ID NO: 1154764 - RNA, 19 nt, Homo sapiens
gaacaaccguggccagaau

SEQ ID NO: 1154765 - RNA, 19 nt, Homo sapiens
gaauacagauguguucauu

SEQ ID NO: 1154766 - RNA, 19 nt, Homo sapiens
gaaaguuggugucacaguu

SEQ ID NO: 1154767 - RNA, 19 nt, Homo sapiens
gcagacugauacuaaauuu

SEQ ID NO: 1154768 - RNA, 19 nt, Homo sapiens
gcuaauaugucaacacaau

SEQ ID NO: 1154769 - RNA, 19 nt, Homo sapiens
caucauggcaguucauuua

SEQ ID NO: 1154770 - RNA, 19 nt, Homo sapiens
acacaaagcaguaaaguuu

SEQ ID NO: 1154771 - RNA, 19 nt, Homo sapiens
guaaacaucuggauaaagg

SEQ ID NO: 1154772 - RNA, 19 nt, Homo sapiens
aagcaagcaucauaucuua

SEQ ID NO: 1154773 - RNA, 19 nt, Homo sapiens
gccagaaucucacccuaua

SEQ ID NO: 1154774 - RNA, 19 nt, Homo sapiens
ugaaggaaguaacugauuu

SEQ ID NO: 1154775 - RNA, 19 nt, Homo sapiens
gaagugacguuggguaugu

SEQ ID NO: 1154776 - RNA, 19 nt, Homo sapiens
guagaaauuugacagcauu

SEQ ID NO: 1154777 - RNA, 19 nt, Homo sapiens
agugaaagcuuggguaaua

SEQ ID NO: 1154778 - RNA, 19 nt, Homo sapiens
guuuauaucuucccuuuga

SEQ ID NO: 1154779 - RNA, 19 nt, Homo sapiens
gaagaacgaggacuuguga

SEQ ID NO: 1154780 - RNA, 19 nt, Homo sapiens
aaacacagacucuucuaua

SEQ ID NO: 1154781 - RNA, 19 nt, Homo sapiens
gcacauauuggaucauuug

SEQ ID NO: 1154782 - RNA, 19 nt, Homo sapiens
uagagucaauggaacuuua

SEQ ID NO: 1154783 - RNA, 19 nt, Homo sapiens
guagauuguuuacauguga

SEQ ID NO: 1154784 - RNA, 19 nt, Homo sapiens
gaacagggaaaugcacaua

SEQ ID NO: 1154785 - RNA, 19 nt, Homo sapiens
ccauuuagccaaucauaua

SEQ ID NO: 1154786 - RNA, 19 nt, Homo sapiens
gagugggauuugugauuua

SEQ ID NO: 1154787 - RNA, 19 nt, Homo sapiens
gagcaaauacgacaacuuc

SEQ ID NO: 1154788 - RNA, 19 nt, Homo sapiens
ucagaaggaucaaauagau

SEQ ID NO: 1154789 - RNA, 19 nt, Homo sapiens
gaugcaaacuguggauaaa

SEQ ID NO: 1154790 - RNA, 19 nt, Homo sapiens
uaaccaagcaagcaucaua

SEQ ID NO: 1154791 - RNA, 19 nt, Homo sapiens
ugaagugccuguguaauug

SEQ ID NO: 1154792 - RNA, 19 nt, Homo sapiens
gcucaucucgccaagaaua

SEQ ID NO: 1154793 - RNA, 19 nt, Homo sapiens
gaacagaagaacaggauuc

SEQ ID NO: 1154794 - RNA, 19 nt, Homo sapiens
uaacuuagguauggguaaa

SEQ ID NO: 1154795 - RNA, 19 nt, Homo sapiens
ugacagaacugaugguuuu

SEQ ID NO: 1154796 - RNA, 19 nt, Homo sapiens
gcaaacagauuagaaaaga

SEQ ID NO: 1154797 - RNA, 19 nt, Homo sapiens
cauaaucucccuagugaaa

SEQ ID NO: 1154798 - RNA, 19 nt, Homo sapiens
ggagcaaacagauuagaaa

SEQ ID NO: 1154799 - RNA, 19 nt, Homo sapiens
uauuugaccucauuaguug

SEQ ID NO: 1154800 - RNA, 19 nt, Homo sapiens
cacagacucuucuauaaau

SEQ ID NO: 1154801 - RNA, 19 nt, Homo sapiens
cacagaagauguagcaguu

SEQ ID NO: 1154802 - RNA, 19 nt, Homo sapiens
ggguuuauaucuucccuuu

SEQ ID NO: 1154803 - RNA, 19 nt, Homo sapiens
gaauaugacagaacugaug

SEQ ID NO: 1154804 - RNA, 19 nt, Homo sapiens
uuugagaacuagugaagua

SEQ ID NO: 1154805 - RNA, 19 nt, Homo sapiens
acagaaugcuaguuuaaug

SEQ ID NO: 1154806 - RNA, 19 nt, Homo sapiens
caacuucgcaacaaucuug

SEQ ID NO: 1154807 - RNA, 19 nt, Homo sapiens
acagggaaaugcacauauu

SEQ ID NO: 1154808 - RNA, 19 nt, Homo sapiens
gaaaggaggcggagcaaac

SEQ ID NO: 1154809 - RNA, 19 nt, Homo sapiens
ugagugggauuugugauuu

SEQ ID NO: 1154810 - RNA, 19 nt, Homo sapiens
ugccuuaggucacgccuua

SEQ ID NO: 1154811 - RNA, 19 nt, Homo sapiens
cauuggagcugcacugaug

SEQ ID NO: 1154812 - RNA, 19 nt, Homo sapiens
gaaggaaguaacugauuug

SEQ ID NO: 1154813 - RNA, 19 nt, Homo sapiens
gugaagugccuguguaauu

SEQ ID NO: 1154814 - RNA, 19 nt, Homo sapiens
aacacagacucuucuauaa

SEQ ID NO: 1154815 - RNA, 19 nt, Homo sapiens
aaagcagacugauacuaaa

SEQ ID NO: 1154816 - RNA, 19 nt, Homo sapiens
gaauccagguuaaaaguaa

SEQ ID NO: 1154817 - RNA, 19 nt, Homo sapiens
uucaugagauacuguguua

SEQ ID NO: 1154818 - RNA, 19 nt, Homo sapiens
caugugaagugccugugua

SEQ ID NO: 1154819 - RNA, 19 nt, Homo sapiens
ggaagagcgagagcaaaua

SEQ ID NO: 1154820 - RNA, 19 nt, Homo sapiens
aaacuagugugccaaaugg

SEQ ID NO: 1154821 - RNA, 19 nt, Homo sapiens
gagagcagcaguugaggaa

SEQ ID NO: 1154822 - RNA, 19 nt, Homo sapiens
gaauugcccgaacuucuuu

SEQ ID NO: 1154823 - RNA, 19 nt, Homo sapiens
ggauuuacaaugagaagaa

SEQ ID NO: 1154824 - RNA, 19 nt, Homo sapiens
gcaguucauuuacucuugu

SEQ ID NO: 1154825 - RNA, 19 nt, Homo sapiens
cagcagaaccucacuguag

SEQ ID NO: 1154826 - RNA, 19 nt, Homo sapiens
gagcaauucuauauuugag

SEQ ID NO: 1154827 - RNA, 19 nt, Homo sapiens
ccgcucaucucgccaagaa

SEQ ID NO: 1154828 - RNA, 19 nt, Homo sapiens
uaccaaggcucugauguau

SEQ ID NO: 1154829 - RNA, 19 nt, Homo sapiens
gaaguaguagugaaauugu

SEQ ID NO: 1154830 - RNA, 19 nt, Homo sapiens
gcaagcaucauaucuuaag

SEQ ID NO: 1154831 - RNA, 19 nt, Homo sapiens
gccuuuagcuauacucaga

SEQ ID NO: 1154832 - RNA, 19 nt, Homo sapiens
aaucuugaauccagguuaa

SEQ ID NO: 1154833 - RNA, 19 nt, Homo sapiens
gaaagcuuggguaauauau

SEQ ID NO: 1154834 - RNA, 19 nt, Homo sapiens
auacagauguguucauuac

SEQ ID NO: 1154835 - RNA, 19 nt, Homo sapiens
cuuguuaccucuuaauaug

SEQ ID NO: 1154836 - RNA, 19 nt, Homo sapiens
acacagacucuucuauaaa

SEQ ID NO: 1154837 - RNA, 19 nt, Homo sapiens
ccauugcaguuucccuuaa

SEQ ID NO: 1154838 - RNA, 19 nt, Homo sapiens
cuaagucaguugauaaucu

SEQ ID NO: 1154839 - RNA, 19 nt, Homo sapiens
caacacagaagauguagca

SEQ ID NO: 1154840 - RNA, 19 nt, Homo sapiens
ucaacacaaucuccaguau

SEQ ID NO: 1154841 - RNA, 19 nt, Homo sapiens
ucauucaacuucugugaug

SEQ ID NO: 1154842 - RNA, 19 nt, Homo sapiens
gcaagacagugauaaugcu

SEQ ID NO: 1154843 - RNA, 19 nt, Homo sapiens
acacagcaaucauucauac

SEQ ID NO: 1154844 - RNA, 19 nt, Homo sapiens
gaaauuugacagcauuaca

SEQ ID NO: 1154845 - RNA, 19 nt, Homo sapiens
gaagagcgagagcaaauac

SEQ ID NO: 1154846 - RNA, 19 nt, Homo sapiens
gggaagagcgagagcaaau

SEQ ID NO: 1154847 - RNA, 19 nt, Homo sapiens
gagcaagacagugauaaug

SEQ ID NO: 1154848 - RNA, 19 nt, Homo sapiens
uaaagcaguuucacagcau

SEQ ID NO: 1154849 - RNA, 19 nt, Homo sapiens
cauuuacucuugugccaaa

SEQ ID NO: 1154850 - RNA, 19 nt, Homo sapiens
ugaaagcuuggguaauaua

SEQ ID NO: 1154851 - RNA, 19 nt, Homo sapiens
ggaaaugcacauauuggau

SEQ ID NO: 1154852 - RNA, 19 nt, Homo sapiens
caagcaagcaucauaucuu

SEQ ID NO: 1154853 - RNA, 19 nt, Homo sapiens
ugaguuuccuauagaagaa

SEQ ID NO: 1154854 - RNA, 19 nt, Homo sapiens
ggacaucucugaucaagaa

SEQ ID NO: 1154855 - RNA, 19 nt, Homo sapiens
gaacaacaaugccuugaau

SEQ ID NO: 1154856 - RNA, 19 nt, Homo sapiens
caaacuguaugacauguua

SEQ ID NO: 1154857 - RNA, 19 nt, Homo sapiens
gaacagugccucccaauga

SEQ ID NO: 1154858 - RNA, 19 nt, Homo sapiens
uaacuacagugcucaauaa

SEQ ID NO: 1154859 - RNA, 19 nt, Homo sapiens
gaacugggaaucaacaaua

SEQ ID NO: 1154860 - RNA, 19 nt, Homo sapiens
uaaaucagcuguagcaugu

SEQ ID NO: 1154861 - RNA, 19 nt, Homo sapiens
gaagcagcauugaaacuuu

SEQ ID NO: 1154862 - RNA, 19 nt, Homo sapiens
caacugaauugaauguuug

SEQ ID NO: 1154863 - RNA, 19 nt, Homo sapiens
guagcaaucuggucuauag

SEQ ID NO: 1154864 - RNA, 19 nt, Homo sapiens
ggauaugucauuucuguaa

SEQ ID NO: 1154865 - RNA, 19 nt, Homo sapiens
ggcaauaucugcugagaca

SEQ ID NO: 1154866 - RNA, 19 nt, Homo sapiens
uuaguugacuguacuguaa

SEQ ID NO: 1154867 - RNA, 19 nt, Homo sapiens
acaguugucuauaugcuua

SEQ ID NO: 1154868 - RNA, 19 nt, Homo sapiens
uaacuugccugaacucaca

SEQ ID NO: 1154869 - RNA, 19 nt, Homo sapiens
gcuaugcccuggauaacuu

SEQ ID NO: 1154870 - RNA, 19 nt, Homo sapiens
guacuguaauguuguauca

SEQ ID NO: 1154871 - RNA, 19 nt, Homo sapiens
aaacuaccaccacucauua

SEQ ID NO: 1154872 - RNA, 19 nt, Homo sapiens
gaaaguuaauuccaauguc

SEQ ID NO: 1154873 - RNA, 19 nt, Homo sapiens
caaugcguguguauauaua

SEQ ID NO: 1154874 - RNA, 19 nt, Homo sapiens
ugacuguacuguaauguug

SEQ ID NO: 1154875 - RNA, 19 nt, Homo sapiens
uaaagaggcuuagaacaag

SEQ ID NO: 1154876 - RNA, 19 nt, Homo sapiens
gugcuaaacucaauaaugc

SEQ ID NO: 1154877 - RNA, 19 nt, Homo sapiens
uuaguguccuggaaaguua

SEQ ID NO: 1154878 - RNA, 19 nt, Homo sapiens
caauaaugcuguucuaacu

SEQ ID NO: 1154879 - RNA, 19 nt, Homo sapiens
gaggacggguggauauuuc

SEQ ID NO: 1154880 - RNA, 19 nt, Homo sapiens
gccagaaccugaaauuuac

SEQ ID NO: 1154881 - RNA, 19 nt, Homo sapiens
gaacacuugcaauaaugua

SEQ ID NO: 1154882 - RNA, 19 nt, Homo sapiens
uuaaagaggcuuagaacaa

SEQ ID NO: 1154883 - RNA, 19 nt, Homo sapiens
gucaugacgucaaacuuaa

SEQ ID NO: 1154884 - RNA, 19 nt, Homo sapiens
ugauaacccucacauaaca

SEQ ID NO: 1154885 - RNA, 19 nt, Homo sapiens
ccaaugucaugacgucaaa

SEQ ID NO: 1154886 - RNA, 19 nt, Homo sapiens
agccagaaccugaaauuua

SEQ ID NO: 1154887 - RNA, 19 nt, Homo sapiens
uguaucccaugcauaaaua

SEQ ID NO: 1154888 - RNA, 19 nt, Homo sapiens
uagaacacuugcaauaaug

SEQ ID NO: 1154889 - RNA, 19 nt, Homo sapiens
guaguaaggagcacaaaga

SEQ ID NO: 1154890 - RNA, 19 nt, Homo sapiens
ugucaugacgucaaacuua

SEQ ID NO: 1154891 - RNA, 19 nt, Homo sapiens
ucaagaagcuaaggcuaga

SEQ ID NO: 1154892 - RNA, 19 nt, Homo sapiens
ggagaggacggguggauau

SEQ ID NO: 1154893 - RNA, 19 nt, Homo sapiens
cacgacagcuucccaaauc

SEQ ID NO: 1154894 - RNA, 19 nt, Homo sapiens
gaauugaauguuugccuuu

SEQ ID NO: 1154895 - RNA, 19 nt, Homo sapiens
gcuaaggcuagacuuguua

SEQ ID NO: 1154896 - RNA, 19 nt, Homo sapiens
gaagcuaaggcuagacuug

SEQ ID NO: 1154897 - RNA, 19 nt, Homo sapiens
gaagcuauuacauguggua

SEQ ID NO: 1154898 - RNA, 19 nt, Homo sapiens
ucacucccauuggaaauaa

SEQ ID NO: 1154899 - RNA, 19 nt, Homo sapiens
aaacgucuguggaguguca

SEQ ID NO: 1154900 - RNA, 19 nt, Homo sapiens
caacccaggucgacacauc

SEQ ID NO: 1154901 - RNA, 19 nt, Homo sapiens
gccaaaagauuuaagagaa

SEQ ID NO: 1154902 - RNA, 19 nt, Homo sapiens
guccauugcuguguacuuu

SEQ ID NO: 1154903 - RNA, 19 nt, Homo sapiens
gcguaaaugucacaaccaa

SEQ ID NO: 1154904 - RNA, 19 nt, Homo sapiens
cuaacaggcaauagaaaua

SEQ ID NO: 1154905 - RNA, 19 nt, Homo sapiens
guugaaugauguuaguuga

SEQ ID NO: 1154906 - RNA, 19 nt, Homo sapiens
gaagccauccguagaaagu

SEQ ID NO: 1154907 - RNA, 19 nt, Homo sapiens
caauaacccuaaacucucu

SEQ ID NO: 1154908 - RNA, 19 nt, Homo sapiens
cagucgauguccaugaaua

SEQ ID NO: 1154909 - RNA, 19 nt, Homo sapiens
ugucauuucuguaagaguu

SEQ ID NO: 1154910 - RNA, 19 nt, Homo sapiens
gauaucggcacgacgguuu

SEQ ID NO: 1154911 - RNA, 19 nt, Homo sapiens
gcuugaugcugaacaacaa

SEQ ID NO: 1154912 - RNA, 19 nt, Homo sapiens
ccacauucuucaucaaagu

SEQ ID NO: 1154913 - RNA, 19 nt, Homo sapiens
gcuaguugcagugguaaua

SEQ ID NO: 1154914 - RNA, 19 nt, Homo sapiens
cauacaaauugaagacuca

SEQ ID NO: 1154915 - RNA, 19 nt, Homo sapiens
cgugagaucaguauccaua

SEQ ID NO: 1154916 - RNA, 19 nt, Homo sapiens
cuauaucuguguggcaaua

SEQ ID NO: 1154917 - RNA, 19 nt, Homo sapiens
caaaauaaaucagcuguag

SEQ ID NO: 1154918 - RNA, 19 nt, Homo sapiens
uaaaagaacugggaaucaa

SEQ ID NO: 1154919 - RNA, 19 nt, Homo sapiens
ugugguaacucagaggaua

SEQ ID NO: 1154920 - RNA, 19 nt, Homo sapiens
uccagaagcuauuacaugu

SEQ ID NO: 1154921 - RNA, 19 nt, Homo sapiens
guccaugaauacaaccuaa

SEQ ID NO: 1154922 - RNA, 19 nt, Homo sapiens
uaagauaacuguggaaacc

SEQ ID NO: 1154923 - RNA, 19 nt, Homo sapiens
gugggagggugguucauau

SEQ ID NO: 1154924 - RNA, 19 nt, Homo sapiens
uuauaguucuugcuaguug

SEQ ID NO: 1154925 - RNA, 19 nt, Homo sapiens
gcuaacaggcaauagaaau

SEQ ID NO: 1154926 - RNA, 19 nt, Homo sapiens
gauguuaguugacuguacu

SEQ ID NO: 1154927 - RNA, 19 nt, Homo sapiens
cgacacauccagaagcuau

SEQ ID NO: 1154928 - RNA, 19 nt, Homo sapiens
ggaaggugacagcgagaaa

SEQ ID NO: 1154929 - RNA, 19 nt, Homo sapiens
ccgcuuggcuuuccgaagu

SEQ ID NO: 1154930 - RNA, 19 nt, Homo sapiens
caagcuaacaggcaauaga

SEQ ID NO: 1154931 - RNA, 19 nt, Homo sapiens
cuacagugcucaauaaaau

SEQ ID NO: 1154932 - RNA, 19 nt, Homo sapiens
guaauggggucuauguuug

SEQ ID NO: 1154933 - RNA, 19 nt, Homo sapiens
gauaugucauuucuguaag

SEQ ID NO: 1154934 - RNA, 19 nt, Homo sapiens
aaucagcuguagcauguug

SEQ ID NO: 1154935 - RNA, 19 nt, Homo sapiens
cuaacuacagugcucaaua

SEQ ID NO: 1154936 - RNA, 19 nt, Homo sapiens
ccucuucaaucccacuaaa

SEQ ID NO: 1154937 - RNA, 19 nt, Homo sapiens
gcacgacgguuuuccuaga

SEQ ID NO: 1154938 - RNA, 19 nt, Homo sapiens
gguguauaaugaagacaga

SEQ ID NO: 1154939 - RNA, 19 nt, Homo sapiens
uagcguaucgcaaggguuu

SEQ ID NO: 1154940 - RNA, 19 nt, Homo sapiens
gagccagaaccugaaauuu

SEQ ID NO: 1154941 - RNA, 19 nt, Homo sapiens
ugacagcgagaaagacaaa

SEQ ID NO: 1154942 - RNA, 19 nt, Homo sapiens
auugauaacccucacauaa

SEQ ID NO: 1154943 - RNA, 19 nt, Homo sapiens
cagcuucccaaaucguuua

SEQ ID NO: 1154944 - RNA, 19 nt, Homo sapiens
aaagguguauuguuguauc

SEQ ID NO: 1154945 - RNA, 19 nt, Homo sapiens
gaaagacaaagaugguucu

SEQ ID NO: 1154946 - RNA, 19 nt, Homo sapiens
ucacaaacuguaugacaug

SEQ ID NO: 1154947 - RNA, 19 nt, Homo sapiens
guauccacauucuucauca

SEQ ID NO: 1154948 - RNA, 19 nt, Homo sapiens
caaccugucacacacaaug

SEQ ID NO: 1154949 - RNA, 19 nt, Homo sapiens
cauauauacucacacacau

SEQ ID NO: 1154950 - RNA, 19 nt, Homo sapiens
gggagggugguucauauga

SEQ ID NO: 1154951 - RNA, 19 nt, Homo sapiens
caguggacaucucugauca

SEQ ID NO: 1154952 - RNA, 19 nt, Homo sapiens
guaaaugucacaaccaaaa

SEQ ID NO: 1154953 - RNA, 19 nt, Homo sapiens
uaacaguugucuauaugcu

SEQ ID NO: 1154954 - RNA, 19 nt, Homo sapiens
gaagaaggccuuaaauuua

SEQ ID NO: 1154955 - RNA, 19 nt, Homo sapiens
gcaaagacauccacauaua

SEQ ID NO: 1154956 - RNA, 19 nt, Homo sapiens
ggaagaaggccuuaaauuu

SEQ ID NO: 1154957 - RNA, 19 nt, Homo sapiens
caacauggcuuccucuaaa

SEQ ID NO: 1154958 - RNA, 19 nt, Homo sapiens
uaaaggauuugacgcauua

SEQ ID NO: 1154959 - RNA, 19 nt, Homo sapiens
ggucaaagcugaggaguuu

SEQ ID NO: 1154960 - RNA, 19 nt, Homo sapiens
ggaagugccuggucauuga

SEQ ID NO: 1154961 - RNA, 19 nt, Homo sapiens
gaacaugauggauuucuua

SEQ ID NO: 1154962 - RNA, 19 nt, Homo sapiens
gcaaggagcagaagaagaa

SEQ ID NO: 1154963 - RNA, 19 nt, Homo sapiens
ggagcuagcugacuucaug

SEQ ID NO: 1154964 - RNA, 19 nt, Homo sapiens
ggaaagaauugagaccuaa

SEQ ID NO: 1154965 - RNA, 19 nt, Homo sapiens
caaccucggucaaguuuaa

SEQ ID NO: 1154966 - RNA, 19 nt, Homo sapiens
gaagaaccaucccaauuag

SEQ ID NO: 1154967 - RNA, 19 nt, Homo sapiens
ugaagaaccaucccaauua

SEQ ID NO: 1154968 - RNA, 19 nt, Homo sapiens
gagcugauguugacgcuuu

SEQ ID NO: 1154969 - RNA, 19 nt, Homo sapiens
caagacaguucucaggaua

SEQ ID NO: 1154970 - RNA, 19 nt, Homo sapiens
ugaagaagguucccaagaa

SEQ ID NO: 1154971 - RNA, 19 nt, Homo sapiens
ccaccuagcuuguaacgaa

SEQ ID NO: 1154972 - RNA, 19 nt, Homo sapiens
ggaagcagaucuuucuaug

SEQ ID NO: 1154973 - RNA, 19 nt, Homo sapiens
aaucugagguuaucaauga

SEQ ID NO: 1154974 - RNA, 19 nt, Homo sapiens
caaaccagcuucucccauu

SEQ ID NO: 1154975 - RNA, 19 nt, Homo sapiens
gaagggaggugaucaugca

SEQ ID NO: 1154976 - RNA, 19 nt, Homo sapiens
gaacaugccgugugaugaa

SEQ ID NO: 1154977 - RNA, 19 nt, Homo sapiens
acagagaacucaaagcaaa

SEQ ID NO: 1154978 - RNA, 19 nt, Homo sapiens
aagcagaucuuucuauguu

SEQ ID NO: 1154979 - RNA, 19 nt, Homo sapiens
ggccuuaaauuuacagaaa

SEQ ID NO: 1154980 - RNA, 19 nt, Homo sapiens
cgaagaagcucguuagaac

SEQ ID NO: 1154981 - RNA, 19 nt, Homo sapiens
gaagaagguucccaagaag

SEQ ID NO: 1154982 - RNA, 19 nt, Homo sapiens
gcagaucuuucuauguuug

SEQ ID NO: 1154983 - RNA, 19 nt, Homo sapiens
gggaaagaauugagaccua

SEQ ID NO: 1154984 - RNA, 19 nt, Homo sapiens
gagcuugaauugaaacguu

SEQ ID NO: 1154985 - RNA, 19 nt, Homo sapiens
ugugagaaguuguaacaua

SEQ ID NO: 1154986 - RNA, 19 nt, Homo sapiens
aaaguggaaucaacuauga

SEQ ID NO: 1154987 - RNA, 19 nt, Homo sapiens
gcucaggaguggugcgaua

SEQ ID NO: 1154988 - RNA, 19 nt, Homo sapiens
gugaagagagccaggauua

SEQ ID NO: 1154989 - RNA, 19 nt, Homo sapiens
gcauaucuuugacugauga

SEQ ID NO: 1154990 - RNA, 19 nt, Homo sapiens
gcgaugcccuccacaggua

SEQ ID NO: 1154991 - RNA, 19 nt, Homo sapiens
gggaaggccugucuaaagu

SEQ ID NO: 1154992 - RNA, 19 nt, Homo sapiens
gaugaggaguuucaacaga

SEQ ID NO: 1154993 - RNA, 19 nt, Homo sapiens
ggaaaguucucuggauuca

SEQ ID NO: 1154994 - RNA, 19 nt, Homo sapiens
gcaauaugguuccuuccuu

SEQ ID NO: 1154995 - RNA, 19 nt, Homo sapiens
caucacaccugcacauuuc

SEQ ID NO: 1154996 - RNA, 19 nt, Homo sapiens
cagaguugcugucuaagaa

SEQ ID NO: 1154997 - RNA, 19 nt, Homo sapiens
gaaggaagcagaucuuucu

SEQ ID NO: 1154998 - RNA, 19 nt, Homo sapiens
gaacagguuguggaaauaa

SEQ ID NO: 1154999 - RNA, 19 nt, Homo sapiens
gcucgauccucuccaguaa

SEQ ID NO: 1155000 - RNA, 19 nt, Homo sapiens
gggcaggccuugcagaaug

SEQ ID NO: 1155001 - RNA, 19 nt, Homo sapiens
caagugagcugauguugac

SEQ ID NO: 1155002 - RNA, 19 nt, Homo sapiens
gcagagacuugcuaaggau

SEQ ID NO: 1155003 - RNA, 19 nt, Homo sapiens
caucauggaucaguucaaa

SEQ ID NO: 1155004 - RNA, 19 nt, Homo sapiens
gugcaggccucucagcuuu

SEQ ID NO: 1155005 - RNA, 19 nt, Homo sapiens
gaguucagcucccuggaaa

SEQ ID NO: 1155006 - RNA, 19 nt, Homo sapiens
ggaaaccauugcacccaaa

SEQ ID NO: 1155007 - RNA, 19 nt, Homo sapiens
gaaauugaaaucugaagga

SEQ ID NO: 1155008 - RNA, 19 nt, Homo sapiens
caacaacgucugcuucuga

SEQ ID NO: 1155009 - RNA, 19 nt, Homo sapiens
gaaggccugucuaaaguca

SEQ ID NO: 1155010 - RNA, 19 nt, Homo sapiens
ccgaguggcucaucaguga

SEQ ID NO: 1155011 - RNA, 19 nt, Homo sapiens
ggacgucgggugcugauuu

SEQ ID NO: 1155012 - RNA, 19 nt, Homo sapiens
gaaaguggaaucaacuaug

SEQ ID NO: 1155013 - RNA, 19 nt, Homo sapiens
caggaaaguucucuggauu

SEQ ID NO: 1155014 - RNA, 19 nt, Homo sapiens
gaggaaaucuccacuucag

SEQ ID NO: 1155015 - RNA, 19 nt, Homo sapiens
ugaaggcacuggagagaga

SEQ ID NO: 1155016 - RNA, 19 nt, Homo sapiens
guacuggcaggaaccauua

SEQ ID NO: 1155017 - RNA, 19 nt, Homo sapiens
aggcagaguugcugucuaa

SEQ ID NO: 1155018 - RNA, 19 nt, Homo sapiens
gaauugagaccuaaaggau

SEQ ID NO: 1155019 - RNA, 19 nt, Homo sapiens
gaaacauuaugccccauua

SEQ ID NO: 1155020 - RNA, 19 nt, Homo sapiens
ugaaagagcgccuggauca

SEQ ID NO: 1155021 - RNA, 19 nt, Homo sapiens
ggaaacucauggaggaaau

SEQ ID NO: 1155022 - RNA, 19 nt, Homo sapiens
gaagagcagagcagacuga

SEQ ID NO: 1155023 - RNA, 19 nt, Homo sapiens
ggaacaugauggauuucuu

SEQ ID NO: 1155024 - RNA, 19 nt, Homo sapiens
gaaaacgcuuuauuaguga

SEQ ID NO: 1155025 - RNA, 19 nt, Homo sapiens
gaaaugugaucgugaacac

SEQ ID NO: 1155026 - RNA, 19 nt, Homo sapiens
cagggaaguuggaagcuuu

SEQ ID NO: 1155027 - RNA, 19 nt, Homo sapiens
gaucucaucggcuuagaaa

SEQ ID NO: 1155028 - RNA, 19 nt, Homo sapiens
uaaaguggucauaagguua

SEQ ID NO: 1155029 - RNA, 19 nt, Homo sapiens
ggacacaagcggagaggaa

SEQ ID NO: 1155030 - RNA, 19 nt, Homo sapiens
gaacuguggugcgccauca

SEQ ID NO: 1155031 - RNA, 19 nt, Homo sapiens
aagcauaucuuaggcagaa

SEQ ID NO: 1155032 - RNA, 19 nt, Homo sapiens
gaaaagcaacuaacaaaga

SEQ ID NO: 1155033 - RNA, 19 nt, Homo sapiens
ugaacagguuguggaaaua

SEQ ID NO: 1155034 - RNA, 19 nt, Homo sapiens
agacggaccuguuuaagag

SEQ ID NO: 1155035 - RNA, 19 nt, Homo sapiens
aagggaacaugauggauuu

SEQ ID NO: 1155036 - RNA, 19 nt, Homo sapiens
gaagguucccaagaaguua

SEQ ID NO: 1155037 - RNA, 19 nt, Homo sapiens
gacaaaugguccuuaugga

SEQ ID NO: 1155038 - RNA, 19 nt, Homo sapiens
gagcagaagaagaauauuc

SEQ ID NO: 1155039 - RNA, 19 nt, Homo sapiens
ggaggaggaugcccagaag

SEQ ID NO: 1155040 - RNA, 19 nt, Homo sapiens
uagaggagcuagcugacuu

SEQ ID NO: 1155041 - RNA, 19 nt, Homo sapiens
ggagcuguuugaaguuuau

SEQ ID NO: 1155042 - RNA, 19 nt, Homo sapiens
ggcagagacuugcuaagga

SEQ ID NO: 1155043 - RNA, 19 nt, Homo sapiens
gaaagaauugagaccuaaa

SEQ ID NO: 1155044 - RNA, 19 nt, Homo sapiens
caagggaacaugauggauu

SEQ ID NO: 1155045 - RNA, 19 nt, Homo sapiens
gagccacuuugacuuaaug

SEQ ID NO: 1155046 - RNA, 19 nt, Homo sapiens
gggcagaacgugaacauca

SEQ ID NO: 1155047 - RNA, 19 nt, Homo sapiens
ucacagaugauucuuaugu

SEQ ID NO: 1155048 - RNA, 19 nt, Homo sapiens
gaggagaacuaagagagau

SEQ ID NO: 1155049 - RNA, 19 nt, Homo sapiens
gagaggaagaugcagauga

SEQ ID NO: 1155050 - RNA, 19 nt, Homo sapiens
ggaaauaaaacuacgagua

SEQ ID NO: 1155051 - RNA, 19 nt, Homo sapiens
caaggaguauuugauugaa

SEQ ID NO: 1155052 - RNA, 19 nt, Homo sapiens
aaagaaaggcaauaugguu

SEQ ID NO: 1155053 - RNA, 19 nt, Homo sapiens
gaagccgucugccgugugu

SEQ ID NO: 1155054 - RNA, 19 nt, Homo sapiens
ugacgaaggugcacacuau

SEQ ID NO: 1155055 - RNA, 19 nt, Homo sapiens
acaaauggcucccagucua

SEQ ID NO: 1155056 - RNA, 19 nt, Homo sapiens
aaucuuaccucugaucuuu

SEQ ID NO: 1155057 - RNA, 19 nt, Homo sapiens
gaugaucuauaccuacuca

SEQ ID NO: 1155058 - RNA, 19 nt, Homo sapiens
ccaauauggacaauguuua

SEQ ID NO: 1155059 - RNA, 19 nt, Homo sapiens
gcuggaugaucuauaccua

SEQ ID NO: 1155060 - RNA, 19 nt, Homo sapiens
gcaggagaauugcuugaac

SEQ ID NO: 1155061 - RNA, 19 nt, Homo sapiens
gaaaccccaucucuacuaa

SEQ ID NO: 1155062 - RNA, 19 nt, Homo sapiens
gucugaaucuuaccucuga

SEQ ID NO: 1155063 - RNA, 19 nt, Homo sapiens
aaauuggccugagcacuuu

SEQ ID NO: 1155064 - RNA, 19 nt, Homo sapiens
uggacaauguuuaguguga

SEQ ID NO: 1155065 - RNA, 19 nt, Homo sapiens
cguaguggcugcuuacaag

SEQ ID NO: 1155066 - RNA, 19 nt, Homo sapiens
gagucugggugccugauga

SEQ ID NO: 1155067 - RNA, 19 nt, Homo sapiens
gccaauauggacaauguuu

SEQ ID NO: 1155068 - RNA, 19 nt, Homo sapiens
ccucugaucuuuccauugc

SEQ ID NO: 1155069 - RNA, 19 nt, Homo sapiens
cuacuuaugucugaaucuu

SEQ ID NO: 1155070 - RNA, 19 nt, Homo sapiens
ugagguggguggaucacuu

SEQ ID NO: 1155071 - RNA, 19 nt, Homo sapiens
gcucaugcccguaauuucu

SEQ ID NO: 1155072 - RNA, 19 nt, Homo sapiens
ggaaaaugcuggccaucug

SEQ ID NO: 1155073 - RNA, 19 nt, Homo sapiens
caauauggacaauguuuag

SEQ ID NO: 1155074 - RNA, 19 nt, Homo sapiens
uauaugcgguggcggacaa

SEQ ID NO: 1155075 - RNA, 19 nt, Homo sapiens
caaauggcucccagucuau

SEQ ID NO: 1155076 - RNA, 19 nt, Homo sapiens
gagaccagccugagcaaca

SEQ ID NO: 1155077 - RNA, 19 nt, Homo sapiens
cguaauuucugcacuuugg

SEQ ID NO: 1155078 - RNA, 19 nt, Homo sapiens
gugcuuaggccaggacuuu

SEQ ID NO: 1155079 - RNA, 19 nt, Homo sapiens
ucaggccucuucuguguca

SEQ ID NO: 1155080 - RNA, 19 nt, Homo sapiens
acucaggccucuucugugu

SEQ ID NO: 1155081 - RNA, 19 nt, Homo sapiens
caugauggaugugagugaa

SEQ ID NO: 1155082 - RNA, 19 nt, Homo sapiens
gcccguaauuucugcacuu

SEQ ID NO: 1155083 - RNA, 19 nt, Homo sapiens
uauggacaauguuuagugu

SEQ ID NO: 1155084 - RNA, 19 nt, Homo sapiens
gugggaaaaugguagaaua

SEQ ID NO: 1155085 - RNA, 19 nt, Homo sapiens
gacaauguuuagugugagu

SEQ ID NO: 1155086 - RNA, 19 nt, Homo sapiens
cguaugcaguuaagagcaa

SEQ ID NO: 1155087 - RNA, 19 nt, Homo sapiens
ucacuugacgucaggaguu

SEQ ID NO: 1155088 - RNA, 19 nt, Homo sapiens
aggccaauauggacaaugu

SEQ ID NO: 1155089 - RNA, 19 nt, Homo sapiens
ccagucaggccaauaugga

SEQ ID NO: 1155090 - RNA, 19 nt, Homo sapiens
gaaucuuaccucugaucuu

SEQ ID NO: 1155091 - RNA, 19 nt, Homo sapiens
acagucauuucccaggauu

SEQ ID NO: 1155092 - RNA, 19 nt, Homo sapiens
cuacucaggccucuucugu

SEQ ID NO: 1155093 - RNA, 19 nt, Homo sapiens
ccuccguaguggcugcuua

SEQ ID NO: 1155094 - RNA, 19 nt, Homo sapiens
gaccagccugagcaacaua

SEQ ID NO: 1155095 - RNA, 19 nt, Homo sapiens
gagguggguggaucacuug

SEQ ID NO: 1155096 - RNA, 19 nt, Homo sapiens
ggcugaggcaggagaauug

SEQ ID NO: 1155097 - RNA, 19 nt, Homo sapiens
ggcgguaccacagucauuu

SEQ ID NO: 1155098 - RNA, 19 nt, Homo sapiens
aaauggcucccagucuaua

SEQ ID NO: 1155099 - RNA, 19 nt, Homo sapiens
cccguaauuucugcacuuu

SEQ ID NO: 1155100 - RNA, 19 nt, Homo sapiens
gggcgguaccacagucauu

SEQ ID NO: 1155101 - RNA, 19 nt, Homo sapiens
ccuguaaucccagcacuug

SEQ ID NO: 1155102 - RNA, 19 nt, Homo sapiens
gcuaccaggagaugacgaa

SEQ ID NO: 1155103 - RNA, 19 nt, Homo sapiens
uaccucugaucuuuccauu

SEQ ID NO: 1155104 - RNA, 19 nt, Homo sapiens
caacgccuacaacgacaug

SEQ ID NO: 1155105 - RNA, 19 nt, Homo sapiens
uggaugaucuauaccuacu

SEQ ID NO: 1155106 - RNA, 19 nt, Homo sapiens
gagucaccguggagaccaa

SEQ ID NO: 1155107 - RNA, 19 nt, Homo sapiens
gcgcguaugcaguuaagag

SEQ ID NO: 1155108 - RNA, 19 nt, Homo sapiens
accaggagaugacgaaggu

SEQ ID NO: 1155109 - RNA, 19 nt, Homo sapiens
ggaaucucccaccuugauc

SEQ ID NO: 1155110 - RNA, 19 nt, Homo sapiens
ggcaggagaauugcuugaa

SEQ ID NO: 1155111 - RNA, 19 nt, Homo sapiens
uggaaucucccaccuugau

SEQ ID NO: 1155112 - RNA, 19 nt, Homo sapiens
ggagaccaaagaccagaag

SEQ ID NO: 1155113 - RNA, 19 nt, Homo sapiens
ugacauagcugggaaguuu

SEQ ID NO: 1155114 - RNA, 19 nt, Homo sapiens
cagcucaccuguauauuua

SEQ ID NO: 1155115 - RNA, 19 nt, Homo sapiens
gaagaagucgcuauaaauu

SEQ ID NO: 1155116 - RNA, 19 nt, Homo sapiens
ggaauagcaucucaaguga

SEQ ID NO: 1155117 - RNA, 19 nt, Homo sapiens
gcugaaagcucucgaaauc

SEQ ID NO: 1155118 - RNA, 19 nt, Homo sapiens
gcacaacucugguguccuu

SEQ ID NO: 1155119 - RNA, 19 nt, Homo sapiens
cacauaaguuugaguguua

SEQ ID NO: 1155120 - RNA, 19 nt, Homo sapiens
gaagaaugaugagaaggua

SEQ ID NO: 1155121 - RNA, 19 nt, Homo sapiens
gcugagcgaugaugccuua

SEQ ID NO: 1155122 - RNA, 19 nt, Homo sapiens
cagaagaagucgcuauaaa

SEQ ID NO: 1155123 - RNA, 19 nt, Homo sapiens
gugaagaacuccauggaaa

SEQ ID NO: 1155124 - RNA, 19 nt, Homo sapiens
cugagaaacucgucacuua

SEQ ID NO: 1155125 - RNA, 19 nt, Homo sapiens
gaaagaagaggaagaggaa

SEQ ID NO: 1155126 - RNA, 19 nt, Homo sapiens
gaacugaccccaacaauaa

SEQ ID NO: 1155127 - RNA, 19 nt, Homo sapiens
gaaaaugcuuccaaaagua

SEQ ID NO: 1155128 - RNA, 19 nt, Homo sapiens
guagaaaugugucaccuau

SEQ ID NO: 1155129 - RNA, 19 nt, Homo sapiens
gagagcaacugaagggaaa

SEQ ID NO: 1155130 - RNA, 19 nt, Homo sapiens
ucagagacaugaucagaaa

SEQ ID NO: 1155131 - RNA, 19 nt, Homo sapiens
ugaagaaucugacguaaag

SEQ ID NO: 1155132 - RNA, 19 nt, Homo sapiens
gcagauggcuuuucuauag

SEQ ID NO: 1155133 - RNA, 19 nt, Homo sapiens
gggaugaaauuccucaaga

SEQ ID NO: 1155134 - RNA, 19 nt, Homo sapiens
gaggaggagucucagaauu

SEQ ID NO: 1155135 - RNA, 19 nt, Homo sapiens
agacucagcucaccuguau

SEQ ID NO: 1155136 - RNA, 19 nt, Homo sapiens
gcauagcacuggaacuuuc

SEQ ID NO: 1155137 - RNA, 19 nt, Homo sapiens
uaauuugcauucccacaua

SEQ ID NO: 1155138 - RNA, 19 nt, Homo sapiens
cggaagaccugacugagaa

SEQ ID NO: 1155139 - RNA, 19 nt, Homo sapiens
ggugggaagucauugaauu

SEQ ID NO: 1155140 - RNA, 19 nt, Homo sapiens
caucucaaauggcgucuaa

SEQ ID NO: 1155141 - RNA, 19 nt, Homo sapiens
gcagggcgcaugacuauga

SEQ ID NO: 1155142 - RNA, 19 nt, Homo sapiens
gaugaggaaugggaaguuu

SEQ ID NO: 1155143 - RNA, 19 nt, Homo sapiens
gcucuuucuucaugucuua

SEQ ID NO: 1155144 - RNA, 19 nt, Homo sapiens
gagaaggcuuuguagaaau

SEQ ID NO: 1155145 - RNA, 19 nt, Homo sapiens
agagaaggcuuuguagaaa

SEQ ID NO: 1155146 - RNA, 19 nt, Homo sapiens
gagaaaaccucaaguaaag

SEQ ID NO: 1155147 - RNA, 19 nt, Homo sapiens
caacgagggacucaucaua

SEQ ID NO: 1155148 - RNA, 19 nt, Homo sapiens
ccucucggcugaugacaua

SEQ ID NO: 1155149 - RNA, 19 nt, Homo sapiens
ggaagaggaagaagagauu

SEQ ID NO: 1155150 - RNA, 19 nt, Homo sapiens
gguacucauuguccuguua

SEQ ID NO: 1155151 - RNA, 19 nt, Homo sapiens
gagggaugcugaucuugaa

SEQ ID NO: 1155152 - RNA, 19 nt, Homo sapiens
gaaacaggcugccauaacc

SEQ ID NO: 1155153 - RNA, 19 nt, Homo sapiens
agaaaugugucaccuaugu

SEQ ID NO: 1155154 - RNA, 19 nt, Homo sapiens
ccacacaggucaagacuac

SEQ ID NO: 1155155 - RNA, 19 nt, Homo sapiens
guggaugacugaagacuug

SEQ ID NO: 1155156 - RNA, 19 nt, Homo sapiens
ccacauaaguuugaguguu

SEQ ID NO: 1155157 - RNA, 19 nt, Homo sapiens
ggaaaucgagagugaguug

SEQ ID NO: 1155158 - RNA, 19 nt, Homo sapiens
uugaugagguggccauaua

SEQ ID NO: 1155159 - RNA, 19 nt, Homo sapiens
aaacaccuauuucuacuca

SEQ ID NO: 1155160 - RNA, 19 nt, Homo sapiens
cagccuacccucucaauuu

SEQ ID NO: 1155161 - RNA, 19 nt, Homo sapiens
gaggaugaauuaugaaacu

SEQ ID NO: 1155162 - RNA, 19 nt, Homo sapiens
gcucaccuguauauuuaaa

SEQ ID NO: 1155163 - RNA, 19 nt, Homo sapiens
cagagaaggcuuuguagaa

SEQ ID NO: 1155164 - RNA, 19 nt, Homo sapiens
ggaugaaauuccucaagau

SEQ ID NO: 1155165 - RNA, 19 nt, Homo sapiens
gaauggcuguuacccuaga

SEQ ID NO: 1155166 - RNA, 19 nt, Homo sapiens
gaggugccaucacggguaa

SEQ ID NO: 1155167 - RNA, 19 nt, Homo sapiens
gaaaugugucaccuaugua

SEQ ID NO: 1155168 - RNA, 19 nt, Homo sapiens
caacucugguguccuucua

SEQ ID NO: 1155169 - RNA, 19 nt, Homo sapiens
ugaaauuccucaagaugau

SEQ ID NO: 1155170 - RNA, 19 nt, Homo sapiens
cgaaaucgcccaggaaaug

SEQ ID NO: 1155171 - RNA, 19 nt, Homo sapiens
gcagaagaagucgcuauaa

SEQ ID NO: 1155172 - RNA, 19 nt, Homo sapiens
ccacagauuccgugaagaa

SEQ ID NO: 1155173 - RNA, 19 nt, Homo sapiens
gcagaugagacgcccauuu

SEQ ID NO: 1155174 - RNA, 19 nt, Homo sapiens
caagcaguuuggaguauug

SEQ ID NO: 1155175 - RNA, 19 nt, Homo sapiens
gaacuuuccuagaguaacg

SEQ ID NO: 1155176 - RNA, 19 nt, Homo sapiens
gccaggaccucacagacaa

SEQ ID NO: 1155177 - RNA, 19 nt, Homo sapiens
ggucaagacuacagagaag

SEQ ID NO: 1155178 - RNA, 19 nt, Homo sapiens
gaauaggugggaagucauu

SEQ ID NO: 1155179 - RNA, 19 nt, Homo sapiens
gaugagacgcccauuuguu

SEQ ID NO: 1155180 - RNA, 19 nt, Homo sapiens
gaaaucgcccaggaaauga

SEQ ID NO: 1155181 - RNA, 19 nt, Homo sapiens
uggaaagcaugaacacuga

SEQ ID NO: 1155182 - RNA, 19 nt, Homo sapiens
cggcagacaugcagaaagu

SEQ ID NO: 1155183 - RNA, 19 nt, Homo sapiens
agacaaagccauugcuaga

SEQ ID NO: 1155184 - RNA, 19 nt, Homo sapiens
ggagaaaaccucaaguaaa

SEQ ID NO: 1155185 - RNA, 19 nt, Homo sapiens
gaugaaauuccucaagaug

SEQ ID NO: 1155186 - RNA, 19 nt, Homo sapiens
cagaugagacgcccauuug

SEQ ID NO: 1155187 - RNA, 19 nt, Homo sapiens
guacaacuauuuugcagaa

SEQ ID NO: 1155188 - RNA, 19 nt, Homo sapiens
ucagcucaccuguauauuu

SEQ ID NO: 1155189 - RNA, 19 nt, Homo sapiens
ggaaacaggcugccauaac

SEQ ID NO: 1155190 - RNA, 19 nt, Homo sapiens
uguggaagauauagguuaa

SEQ ID NO: 1155191 - RNA, 19 nt, Homo sapiens
caagaugauuauuccugaa

SEQ ID NO: 1155192 - RNA, 19 nt, Homo sapiens
gaaagggaaagcaaaugga

SEQ ID NO: 1155193 - RNA, 19 nt, Homo sapiens
gaagggaaagggaaagcaa

SEQ ID NO: 1155194 - RNA, 19 nt, Homo sapiens
guuacuggcucuuucuuca

SEQ ID NO: 1155195 - RNA, 19 nt, Homo sapiens
ggaaagggaaagcaaaugg

SEQ ID NO: 1155196 - RNA, 19 nt, Homo sapiens
gggaggcgaugcagcugaa

SEQ ID NO: 1155197 - RNA, 19 nt, Homo sapiens
gcugggaaguuucaguuca

SEQ ID NO: 1155198 - RNA, 19 nt, Homo sapiens
ggaggagucucagaauucu

SEQ ID NO: 1155199 - RNA, 19 nt, Homo sapiens
uaacagagccccaguacaa

SEQ ID NO: 1155200 - RNA, 19 nt, Homo sapiens
caucuugaaacaccuauuu

SEQ ID NO: 1155201 - RNA, 19 nt, Homo sapiens
agaaggcuuuguagaaaug

SEQ ID NO: 1155202 - RNA, 19 nt, Homo sapiens
gaccuaucauuucaucaga

SEQ ID NO: 1155203 - RNA, 19 nt, Homo sapiens
ccacugacuuaauuaugau

SEQ ID NO: 1155204 - RNA, 19 nt, Homo sapiens
uccacugacuuaauuauga

SEQ ID NO: 1155205 - RNA, 19 nt, Homo sapiens
agaagaagucgcuauaaau

SEQ ID NO: 1155206 - RNA, 19 nt, Homo sapiens
gauagggcaggauuucgua

SEQ ID NO: 1155207 - RNA, 19 nt, Homo sapiens
gaugauuauuccugaaagu

SEQ ID NO: 1155208 - RNA, 19 nt, Homo sapiens
uggaauagcaucucaagug

SEQ ID NO: 1155209 - RNA, 19 nt, Homo sapiens
caucacggguaacuguuga

SEQ ID NO: 1155210 - RNA, 19 nt, Homo sapiens
gaaugcuaccucccaguuu

SEQ ID NO: 1155211 - RNA, 19 nt, Homo sapiens
aaaugaagaaucugacgua

SEQ ID NO: 1155212 - RNA, 19 nt, Homo sapiens
cuucaugucuuauuucucu

SEQ ID NO: 1155213 - RNA, 19 nt, Homo sapiens
gaaauaagcucccacaugu

SEQ ID NO: 1155214 - RNA, 19 nt, Homo sapiens
gcaaggagcuuauucgaaa

SEQ ID NO: 1155215 - RNA, 19 nt, Homo sapiens
gaaagagccuccaacuauu

SEQ ID NO: 1155216 - RNA, 19 nt, Homo sapiens
gaagguggcucaagcgaaa

SEQ ID NO: 1155217 - RNA, 19 nt, Homo sapiens
gaagacuuguucucaguua

SEQ ID NO: 1155218 - RNA, 19 nt, Homo sapiens
gcauucaccuuaucauuaa

SEQ ID NO: 1155219 - RNA, 19 nt, Homo sapiens
ggagugagauugaacaaga

SEQ ID NO: 1155220 - RNA, 19 nt, Homo sapiens
ugcaagagcuucaguauuu

SEQ ID NO: 1155221 - RNA, 19 nt, Homo sapiens
ggcaauacauguugguuua

SEQ ID NO: 1155222 - RNA, 19 nt, Homo sapiens
ggaaagguaugugaaauau

SEQ ID NO: 1155223 - RNA, 19 nt, Homo sapiens
gaaagugacacacauauga

SEQ ID NO: 1155224 - RNA, 19 nt, Homo sapiens
gcaugaagauuauaguuug

SEQ ID NO: 1155225 - RNA, 19 nt, Homo sapiens
gaaguggcaugaagauuau

SEQ ID NO: 1155226 - RNA, 19 nt, Homo sapiens
gaggauaacuggcgguuug

SEQ ID NO: 1155227 - RNA, 19 nt, Homo sapiens
gcagaaagcaguguauuaa

SEQ ID NO: 1155228 - RNA, 19 nt, Homo sapiens
cauaugacauuaccacuuu

SEQ ID NO: 1155229 - RNA, 19 nt, Homo sapiens
ggaagaaguugaaagagau

SEQ ID NO: 1155230 - RNA, 19 nt, Homo sapiens
ggacaagagcguugguuua

SEQ ID NO: 1155231 - RNA, 19 nt, Homo sapiens
ugaaagagauuccuaugga

SEQ ID NO: 1155232 - RNA, 19 nt, Homo sapiens
gggaagaaguugaaagaga

SEQ ID NO: 1155233 - RNA, 19 nt, Homo sapiens
gaagcaaccucugcagaaa

SEQ ID NO: 1155234 - RNA, 19 nt, Homo sapiens
gaaguucguugucauagug

SEQ ID NO: 1155235 - RNA, 19 nt, Homo sapiens
gcacagaaguucguuguca

SEQ ID NO: 1155236 - RNA, 19 nt, Homo sapiens
ugaaagagccuccaacuau

SEQ ID NO: 1155237 - RNA, 19 nt, Homo sapiens
gaaauaagagagaguguau

SEQ ID NO: 1155238 - RNA, 19 nt, Homo sapiens
gaaacuaaacgcucaaaga

SEQ ID NO: 1155239 - RNA, 19 nt, Homo sapiens
gaaagaucaaucagcauua

SEQ ID NO: 1155240 - RNA, 19 nt, Homo sapiens
ugagaaauguuagugcuua

SEQ ID NO: 1155241 - RNA, 19 nt, Homo sapiens
gccaaaugcuguuaaauca

SEQ ID NO: 1155242 - RNA, 19 nt, Homo sapiens
gaccagacauccaaggaaa

SEQ ID NO: 1155243 - RNA, 19 nt, Homo sapiens
ggacuacucuacaucacaa

SEQ ID NO: 1155244 - RNA, 19 nt, Homo sapiens
aaacgguuaucgcaacuua

SEQ ID NO: 1155245 - RNA, 19 nt, Homo sapiens
ugacaucucuguuacugaa

SEQ ID NO: 1155246 - RNA, 19 nt, Homo sapiens
cauaaaagcuguuucacua

SEQ ID NO: 1155247 - RNA, 19 nt, Homo sapiens
ccauugaggucaugagaaa

SEQ ID NO: 1155248 - RNA, 19 nt, Homo sapiens
caagagcguugguuuacaa

SEQ ID NO: 1155249 - RNA, 19 nt, Homo sapiens
ugaaucagaucaaauguca

SEQ ID NO: 1155250 - RNA, 19 nt, Homo sapiens
ugacacacauaugacauua

SEQ ID NO: 1155251 - RNA, 19 nt, Homo sapiens
uuauagaccuuacucauga

SEQ ID NO: 1155252 - RNA, 19 nt, Homo sapiens
agaaguggcaugaagauua

SEQ ID NO: 1155253 - RNA, 19 nt, Homo sapiens
gaaggaaauugguccagau

SEQ ID NO: 1155254 - RNA, 19 nt, Homo sapiens
cagaugaggagauaaauuu

SEQ ID NO: 1155255 - RNA, 19 nt, Homo sapiens
gaacaaaucugaaaaucca

SEQ ID NO: 1155256 - RNA, 19 nt, Homo sapiens
ggaacaguuugcagauaaa

SEQ ID NO: 1155257 - RNA, 19 nt, Homo sapiens
gcacauaagauuccgauca

SEQ ID NO: 1155258 - RNA, 19 nt, Homo sapiens
gcuguuaaaucaacugaga

SEQ ID NO: 1155259 - RNA, 19 nt, Homo sapiens
ucuaucagcuugccaaaga

SEQ ID NO: 1155260 - RNA, 19 nt, Homo sapiens
aaagcuaccuccaguguug

SEQ ID NO: 1155261 - RNA, 19 nt, Homo sapiens
gugcagcuguucuauggua

SEQ ID NO: 1155262 - RNA, 19 nt, Homo sapiens
gcauguccuugucuacuuu

SEQ ID NO: 1155263 - RNA, 19 nt, Homo sapiens
cacacaagcuccuggauug

SEQ ID NO: 1155264 - RNA, 19 nt, Homo sapiens
acuaaacgcucaaagagaa

SEQ ID NO: 1155265 - RNA, 19 nt, Homo sapiens
cuaagccucuugccacuuu

SEQ ID NO: 1155266 - RNA, 19 nt, Homo sapiens
gaaaucaucgucuugaaag

SEQ ID NO: 1155267 - RNA, 19 nt, Homo sapiens
uggaacaguuugcagauaa

SEQ ID NO: 1155268 - RNA, 19 nt, Homo sapiens
guacugcgauccucuccuu

SEQ ID NO: 1155269 - RNA, 19 nt, Homo sapiens
aaagguaugugaaauaugg

SEQ ID NO: 1155270 - RNA, 19 nt, Homo sapiens
gagaguguauucgaaaguu

SEQ ID NO: 1155271 - RNA, 19 nt, Homo sapiens
uaacugagggcauuaaugu

SEQ ID NO: 1155272 - RNA, 19 nt, Homo sapiens
gaacccuucuggaacaguu

SEQ ID NO: 1155273 - RNA, 19 nt, Homo sapiens
aaacuacccuacuucaaug

SEQ ID NO: 1155274 - RNA, 19 nt, Homo sapiens
caaacuacccuacuucaau

SEQ ID NO: 1155275 - RNA, 19 nt, Homo sapiens
ccaguauccucuucaggua

SEQ ID NO: 1155276 - RNA, 19 nt, Homo sapiens
ggcagaaagcaguguauua

SEQ ID NO: 1155277 - RNA, 19 nt, Homo sapiens
cuguggaacucaagcauua

SEQ ID NO: 1155278 - RNA, 19 nt, Homo sapiens
cuaaaccacugacaucuuc

SEQ ID NO: 1155279 - RNA, 19 nt, Homo sapiens
gagcuucaguauuuguuug

SEQ ID NO: 1155280 - RNA, 19 nt, Homo sapiens
gcaagagcuucaguauuug

SEQ ID NO: 1155281 - RNA, 19 nt, Homo sapiens
guaccuacaacaaugcuua

SEQ ID NO: 1155282 - RNA, 19 nt, Homo sapiens
cagaugacaugaauaugga

SEQ ID NO: 1155283 - RNA, 19 nt, Homo sapiens
aagcgaaacugaaggaaau

SEQ ID NO: 1155284 - RNA, 19 nt, Homo sapiens
caaaugcuguuaaaucaac

SEQ ID NO: 1155285 - RNA, 19 nt, Homo sapiens
gaacucaagcauuacauuc

SEQ ID NO: 1155286 - RNA, 19 nt, Homo sapiens
guacuacucagacuauuga

SEQ ID NO: 1155287 - RNA, 19 nt, Homo sapiens
ugaccuauguagccgauuu

SEQ ID NO: 1155288 - RNA, 19 nt, Homo sapiens
acaugaauauggaagagua

SEQ ID NO: 1155289 - RNA, 19 nt, Homo sapiens
gcagaaaucaucgucuuga

SEQ ID NO: 1155290 - RNA, 19 nt, Homo sapiens
aaacacagcccgugccuau

SEQ ID NO: 1155291 - RNA, 19 nt, Homo sapiens
ucccggacaugcugaaaua

SEQ ID NO: 1155292 - RNA, 19 nt, Homo sapiens
uacaaugacaucucuguua

SEQ ID NO: 1155293 - RNA, 19 nt, Homo sapiens
acaaggaaguauuagcaaa

SEQ ID NO: 1155294 - RNA, 19 nt, Homo sapiens
caacuuagacgaguguuug

SEQ ID NO: 1155295 - RNA, 19 nt, Homo sapiens
ggaaauugguccagaugac

SEQ ID NO: 1155296 - RNA, 19 nt, Homo sapiens
ucaguagccucuucucaug

SEQ ID NO: 1155297 - RNA, 19 nt, Homo sapiens
gcagcaagaugugagugaa

SEQ ID NO: 1155298 - RNA, 19 nt, Homo sapiens
gaacagcagcaagauguga

SEQ ID NO: 1155299 - RNA, 19 nt, Homo sapiens
gaaaauugucgaagucaua

SEQ ID NO: 1155300 - RNA, 19 nt, Homo sapiens
gaccugaaaugccuuguac

SEQ ID NO: 1155301 - RNA, 19 nt, Homo sapiens
ugaaauaagcucccacaug

SEQ ID NO: 1155302 - RNA, 19 nt, Homo sapiens
gaugaucacuccguaacug

SEQ ID NO: 1155303 - RNA, 19 nt, Homo sapiens
caacaaggaaguauuagca

SEQ ID NO: 1155304 - RNA, 19 nt, Homo sapiens
ucacagaugaggagauaaa

SEQ ID NO: 1155305 - RNA, 19 nt, Homo sapiens
gagcaugcugugauuguaa

SEQ ID NO: 1155306 - RNA, 19 nt, Homo sapiens
ucacaggacuacucuacau

SEQ ID NO: 1155307 - RNA, 19 nt, Homo sapiens
caaguacaaugacaucucu

SEQ ID NO: 1155308 - RNA, 19 nt, Homo sapiens
gaaaguugaaggaggaaau

SEQ ID NO: 1155309 - RNA, 19 nt, Homo sapiens
ggagggugauguugagcuu

SEQ ID NO: 1155310 - RNA, 19 nt, Homo sapiens
ugaaagaucaaucagcauu

SEQ ID NO: 1155311 - RNA, 19 nt, Homo sapiens
gauuaaggcauuccaugaa

SEQ ID NO: 1155312 - RNA, 19 nt, Homo sapiens
gcugagcccugccaugcaa

SEQ ID NO: 1155313 - RNA, 19 nt, Homo sapiens
ggacaccgcuggaagacua

SEQ ID NO: 1155314 - RNA, 19 nt, Homo sapiens
ccacuaagauguacaugaa

SEQ ID NO: 1155315 - RNA, 19 nt, Homo sapiens
gaggaaaugcggaaguuua

SEQ ID NO: 1155316 - RNA, 19 nt, Homo sapiens
caacgccuuuccuguguua

SEQ ID NO: 1155317 - RNA, 19 nt, Homo sapiens
ccacacaggugccucaguu

SEQ ID NO: 1155318 - RNA, 19 nt, Homo sapiens
uuaaagaaauccagaagga

SEQ ID NO: 1155319 - RNA, 19 nt, Homo sapiens
ccacacgacuauuauguug

SEQ ID NO: 1155320 - RNA, 19 nt, Homo sapiens
gaaaugcggaaguuuaaga

SEQ ID NO: 1155321 - RNA, 19 nt, Homo sapiens
gaagcaagcacaggucuuu

SEQ ID NO: 1155322 - RNA, 19 nt, Homo sapiens
ugaagcaacugcaggagaa

SEQ ID NO: 1155323 - RNA, 19 nt, Homo sapiens
gcaguuuccuccuccagaa

SEQ ID NO: 1155324 - RNA, 19 nt, Homo sapiens
gacuuaauccuucaaauga

SEQ ID NO: 1155325 - RNA, 19 nt, Homo sapiens
gaagaaagugcugcagaaa

SEQ ID NO: 1155326 - RNA, 19 nt, Homo sapiens
agaagaaagugcugcagaa

SEQ ID NO: 1155327 - RNA, 19 nt, Homo sapiens
gcauguaucacaccaaaga

SEQ ID NO: 1155328 - RNA, 19 nt, Homo sapiens
gagaugagacucuuuuaua

SEQ ID NO: 1155329 - RNA, 19 nt, Homo sapiens
uggagacaguuauggaaua

SEQ ID NO: 1155330 - RNA, 19 nt, Homo sapiens
ucaaagagcuccccgaguu

SEQ ID NO: 1155331 - RNA, 19 nt, Homo sapiens
cgacgacccugucuucauc

SEQ ID NO: 1155332 - RNA, 19 nt, Homo sapiens
gggacucgguuguguguug

SEQ ID NO: 1155333 - RNA, 19 nt, Homo sapiens
ggacagggaggcagaagug

SEQ ID NO: 1155334 - RNA, 19 nt, Homo sapiens
agaagccucugaccaagaa

SEQ ID NO: 1155335 - RNA, 19 nt, Homo sapiens
ucaccaggcugaagagcaa

SEQ ID NO: 1155336 - RNA, 19 nt, Homo sapiens
gcagagcccucaguuuguc

SEQ ID NO: 1155337 - RNA, 19 nt, Homo sapiens
ucacagccgucccagaugu

SEQ ID NO: 1155338 - RNA, 19 nt, Homo sapiens
agaagaagccucugaccaa

SEQ ID NO: 1155339 - RNA, 19 nt, Homo sapiens
gaaagacucgguggaggaa

SEQ ID NO: 1155340 - RNA, 19 nt, Homo sapiens
ccgcauguaucacaccaaa

SEQ ID NO: 1155341 - RNA, 19 nt, Homo sapiens
ggacgacgaucagaaagac

SEQ ID NO: 1155342 - RNA, 19 nt, Homo sapiens
ccaagaaggagaagaaagu

SEQ ID NO: 1155343 - RNA, 19 nt, Homo sapiens
uaugguggaugaugauuuc

SEQ ID NO: 1155344 - RNA, 19 nt, Homo sapiens
agagcucgaucccguauga

SEQ ID NO: 1155345 - RNA, 19 nt, Homo sapiens
gaggccuguugaagacuua

SEQ ID NO: 1155346 - RNA, 19 nt, Homo sapiens
uccgcaagcuggccucaua

SEQ ID NO: 1155347 - RNA, 19 nt, Homo sapiens
cagaaagggugaagcaacu

SEQ ID NO: 1155348 - RNA, 19 nt, Homo sapiens
gguacaagguggugaucau

SEQ ID NO: 1155349 - RNA, 19 nt, Homo sapiens
gaggagaccagaaucaagu

SEQ ID NO: 1155350 - RNA, 19 nt, Homo sapiens
ugacagaggagaccagaau

SEQ ID NO: 1155351 - RNA, 19 nt, Homo sapiens
cgaagaacaaguaaucaug

SEQ ID NO: 1155352 - RNA, 19 nt, Homo sapiens
gccaacgccuuuccugugu

SEQ ID NO: 1155353 - RNA, 19 nt, Homo sapiens
ccaacgggcugcgguacaa

SEQ ID NO: 1155354 - RNA, 19 nt, Homo sapiens
gcuaagaugcuggcacuga

SEQ ID NO: 1155355 - RNA, 19 nt, Homo sapiens
ggaggccuguugaagacuu

SEQ ID NO: 1155356 - RNA, 19 nt, Homo sapiens
aaaggacgacgaucagaaa

SEQ ID NO: 1155357 - RNA, 19 nt, Homo sapiens
gaagcucggcgaccucaug

SEQ ID NO: 1155358 - RNA, 19 nt, Homo sapiens
cggauggugugcugcuuaa

SEQ ID NO: 1155359 - RNA, 19 nt, Homo sapiens
gcacugggaaccgcaugua

SEQ ID NO: 1155360 - RNA, 19 nt, Homo sapiens
cagaaaaucuuagaacaga

SEQ ID NO: 1155361 - RNA, 19 nt, Homo sapiens
cugcagagcccucaguuug

SEQ ID NO: 1155362 - RNA, 19 nt, Homo sapiens
agacuuaauccuucaaaug

SEQ ID NO: 1155363 - RNA, 19 nt, Homo sapiens
ugaccaagaaggagaagaa

SEQ ID NO: 1155364 - RNA, 19 nt, Homo sapiens
ucaagaaacgcuacuacga

SEQ ID NO: 1155365 - RNA, 19 nt, Homo sapiens
gaucauuacucgguguuac

SEQ ID NO: 1155366 - RNA, 19 nt, Homo sapiens
agaggaaccugccacucaa

SEQ ID NO: 1155367 - RNA, 19 nt, Homo sapiens
caguuugucucccuuguuc

SEQ ID NO: 1155368 - RNA, 19 nt, Homo sapiens
gagcucaccaggcugaaga

SEQ ID NO: 1155369 - RNA, 19 nt, Homo sapiens
ggcugaagcucccaauucu

SEQ ID NO: 1155370 - RNA, 19 nt, Homo sapiens
uuauaccacuuccaagcua

SEQ ID NO: 1155371 - RNA, 19 nt, Homo sapiens
ggagaccacuaagauguac

SEQ ID NO: 1155372 - RNA, 19 nt, Homo sapiens
cgugggagccugugaguau

SEQ ID NO: 1155373 - RNA, 19 nt, Homo sapiens
ugccucaguuucucuauga

SEQ ID NO: 1155374 - RNA, 19 nt, Homo sapiens
uacagaagcugagugaagu

SEQ ID NO: 1155375 - RNA, 19 nt, Homo sapiens
agaaagugcugcagaaaau

SEQ ID NO: 1155376 - RNA, 19 nt, Homo sapiens
gaaggcugacugccaugaa

SEQ ID NO: 1155377 - RNA, 19 nt, Homo sapiens
ggauugaccgcuacaagca

SEQ ID NO: 1155378 - RNA, 19 nt, Homo sapiens
ggaggaaaugcggaaguuu

SEQ ID NO: 1155379 - RNA, 19 nt, Homo sapiens
ggugugcugcuuaaagaaa

SEQ ID NO: 1155380 - RNA, 19 nt, Homo sapiens
ggagugggcaucucaucug

SEQ ID NO: 1155381 - RNA, 19 nt, Homo sapiens
uaccaucccuggcaucaag

SEQ ID NO: 1155382 - RNA, 19 nt, Homo sapiens
ugacugugcauuucaacaa

SEQ ID NO: 1155383 - RNA, 19 nt, Homo sapiens
gggccuccuuccugcaauu

SEQ ID NO: 1155384 - RNA, 19 nt, Homo sapiens
ggacucgguuguguguugu

SEQ ID NO: 1155385 - RNA, 19 nt, Homo sapiens
gauccgguaugaaggaaac

SEQ ID NO: 1155386 - RNA, 19 nt, Homo sapiens
aagaacaaguaaucaugga

SEQ ID NO: 1155387 - RNA, 19 nt, Homo sapiens
cuacagaagcugagugaag

SEQ ID NO: 1155388 - RNA, 19 nt, Homo sapiens
gcuggcugcuuggaagaaa

SEQ ID NO: 1155389 - RNA, 19 nt, Homo sapiens
gagcccugguugcagagaa

SEQ ID NO: 1155390 - RNA, 19 nt, Homo sapiens
ugaccuaccugcgacagau

SEQ ID NO: 1155391 - RNA, 19 nt, Homo sapiens
cuucguggaucccaagaug

SEQ ID NO: 1155392 - RNA, 19 nt, Homo sapiens
gcaagcacaggucuuuaag

SEQ ID NO: 1155393 - RNA, 19 nt, Homo sapiens
aggaaaugcggaaguuuaa

SEQ ID NO: 1155394 - RNA, 19 nt, Homo sapiens
uggaggaaaugcggaaguu

SEQ ID NO: 1155395 - RNA, 19 nt, Homo sapiens
ucaagcugcucaucauguc

SEQ ID NO: 1155396 - RNA, 19 nt, Homo sapiens
ccacucaagcugcucauca

SEQ ID NO: 1155397 - RNA, 19 nt, Homo sapiens
ugucgaagaaggagaagaa

SEQ ID NO: 1155398 - RNA, 19 nt, Homo sapiens
aauaccugcuggcugagua

SEQ ID NO: 1155399 - RNA, 19 nt, Homo sapiens
acuaagauguacaugaaag

SEQ ID NO: 1155400 - RNA, 19 nt, Homo sapiens
ggacaaggacacguugaag

SEQ ID NO: 1155401 - RNA, 19 nt, Homo sapiens
ggucgucuccuaccagauc

SEQ ID NO: 1155402 - RNA, 19 nt, Homo sapiens
gggaaccgcauguaucaca

SEQ ID NO: 1155403 - RNA, 19 nt, Homo sapiens
ggaggaacgccuacaagac

SEQ ID NO: 1155404 - RNA, 19 nt, Homo sapiens
gugggaaggucaagaaacg

SEQ ID NO: 1155405 - RNA, 19 nt, Homo sapiens
aagaggaaccugccacuca

SEQ ID NO: 1155406 - RNA, 19 nt, Homo sapiens
uggaggacuucacccagaa

SEQ ID NO: 1155407 - RNA, 19 nt, Homo sapiens
gauggugugcugcuuaaag

SEQ ID NO: 1155408 - RNA, 19 nt, Homo sapiens
gaaggcugacgagguggua

SEQ ID NO: 1155409 - RNA, 19 nt, Homo sapiens
gguggagacaguuauggaa

SEQ ID NO: 1155410 - RNA, 19 nt, Homo sapiens
gcuccuggcuuugcuucug

SEQ ID NO: 1155411 - RNA, 19 nt, Homo sapiens
ucacuggcguauccuccuu

SEQ ID NO: 1155412 - RNA, 19 nt, Homo sapiens
gccgagacgucgcuuacca

SEQ ID NO: 1155413 - RNA, 19 nt, Homo sapiens
gaacaaagguugcagauuc

SEQ ID NO: 1155414 - RNA, 19 nt, Homo sapiens
gagaauaucugacauaaug

SEQ ID NO: 1155415 - RNA, 19 nt, Homo sapiens
gagcaucucuuucaacaua

SEQ ID NO: 1155416 - RNA, 19 nt, Homo sapiens
gaacagaacagauaagaaa

SEQ ID NO: 1155417 - RNA, 19 nt, Homo sapiens
gaacauaagcuagcaaauu

SEQ ID NO: 1155418 - RNA, 19 nt, Homo sapiens
gcaaugauccacaguuuaa

SEQ ID NO: 1155419 - RNA, 19 nt, Homo sapiens
cacauuagcuuccaaagaa

SEQ ID NO: 1155420 - RNA, 19 nt, Homo sapiens
uaaagacccugaucuguug

SEQ ID NO: 1155421 - RNA, 19 nt, Homo sapiens
gaacaaacacucccacaug

SEQ ID NO: 1155422 - RNA, 19 nt, Homo sapiens
ucaaagaacucaagcugaa

SEQ ID NO: 1155423 - RNA, 19 nt, Homo sapiens
gaaacucacacgacuauuu

SEQ ID NO: 1155424 - RNA, 19 nt, Homo sapiens
gaaaagaguugagcauuaa

SEQ ID NO: 1155425 - RNA, 19 nt, Homo sapiens
caaacuugcugcugaugua

SEQ ID NO: 1155426 - RNA, 19 nt, Homo sapiens
gagauugucuucagaauac

SEQ ID NO: 1155427 - RNA, 19 nt, Homo sapiens
ugagagaaguugagagaaa

SEQ ID NO: 1155428 - RNA, 19 nt, Homo sapiens
gaaaagaaguacagaauca

SEQ ID NO: 1155429 - RNA, 19 nt, Homo sapiens
ucacucagaugauguuuga

SEQ ID NO: 1155430 - RNA, 19 nt, Homo sapiens
ggaguuaauuugugacuuc

SEQ ID NO: 1155431 - RNA, 19 nt, Homo sapiens
gaaagaguccuuggugaaa

SEQ ID NO: 1155432 - RNA, 19 nt, Homo sapiens
gaaagagcgcagagugaua

SEQ ID NO: 1155433 - RNA, 19 nt, Homo sapiens
gcagcaaguugaaucagaa

SEQ ID NO: 1155434 - RNA, 19 nt, Homo sapiens
uaaaggaucagauuuguga

SEQ ID NO: 1155435 - RNA, 19 nt, Homo sapiens
guaaagacccugaucuguu

SEQ ID NO: 1155436 - RNA, 19 nt, Homo sapiens
caaacacucccacaugaua

SEQ ID NO: 1155437 - RNA, 19 nt, Homo sapiens
gagaaaguauagcagcaaa

SEQ ID NO: 1155438 - RNA, 19 nt, Homo sapiens
gaucuuaagaccaaacuuu

SEQ ID NO: 1155439 - RNA, 19 nt, Homo sapiens
gaugaggcuuuaacaagaa

SEQ ID NO: 1155440 - RNA, 19 nt, Homo sapiens
ugauggaucuccuuaagaa

SEQ ID NO: 1155441 - RNA, 19 nt, Homo sapiens
ccauugauauccuuagaaa

SEQ ID NO: 1155442 - RNA, 19 nt, Homo sapiens
ggaaagggaagauaaggaa

SEQ ID NO: 1155443 - RNA, 19 nt, Homo sapiens
gaacucaagcugaaacaga

SEQ ID NO: 1155444 - RNA, 19 nt, Homo sapiens
guacaaagccgugaaguca

SEQ ID NO: 1155445 - RNA, 19 nt, Homo sapiens
gaagccauacuaaauguuu

SEQ ID NO: 1155446 - RNA, 19 nt, Homo sapiens
aaacucacacgacuauuua

SEQ ID NO: 1155447 - RNA, 19 nt, Homo sapiens
uagcaaugauccacaguuu

SEQ ID NO: 1155448 - RNA, 19 nt, Homo sapiens
gcuuuaacgucagauaaua

SEQ ID NO: 1155449 - RNA, 19 nt, Homo sapiens
gaacaugaaauacugacaa

SEQ ID NO: 1155450 - RNA, 19 nt, Homo sapiens
gcacggacacuugcuagua

SEQ ID NO: 1155451 - RNA, 19 nt, Homo sapiens
gaaagcaggcuacaagauc

SEQ ID NO: 1155452 - RNA, 19 nt, Homo sapiens
gaaaugaaacuauccacau

SEQ ID NO: 1155453 - RNA, 19 nt, Homo sapiens
gaaacauucaucagacuuu

SEQ ID NO: 1155454 - RNA, 19 nt, Homo sapiens
gaacucuuaucaccuuguu

SEQ ID NO: 1155455 - RNA, 19 nt, Homo sapiens
ggaagaaaccauugauauc

SEQ ID NO: 1155456 - RNA, 19 nt, Homo sapiens
ugaagaacaugaaauacug

SEQ ID NO: 1155457 - RNA, 19 nt, Homo sapiens
gugagaauaucugacauaa

SEQ ID NO: 1155458 - RNA, 19 nt, Homo sapiens
guuccuggauugaauauug

SEQ ID NO: 1155459 - RNA, 19 nt, Homo sapiens
gcagugcauucaacuucua

SEQ ID NO: 1155460 - RNA, 19 nt, Homo sapiens
guaccacucuuauagaaca

SEQ ID NO: 1155461 - RNA, 19 nt, Homo sapiens
gcuguagcauaauuucuaa

SEQ ID NO: 1155462 - RNA, 19 nt, Homo sapiens
gagagaagguaugauuuua

SEQ ID NO: 1155463 - RNA, 19 nt, Homo sapiens
guuaauuugugacuucgua

SEQ ID NO: 1155464 - RNA, 19 nt, Homo sapiens
gaaggucguuuggaagaga

SEQ ID NO: 1155465 - RNA, 19 nt, Homo sapiens
gguaaaggaucagauuugu

SEQ ID NO: 1155466 - RNA, 19 nt, Homo sapiens
ggaaauauuugaggauguc

SEQ ID NO: 1155467 - RNA, 19 nt, Homo sapiens
aaagagagaagguaugauu

SEQ ID NO: 1155468 - RNA, 19 nt, Homo sapiens
aagcagaacagaacagaua

SEQ ID NO: 1155469 - RNA, 19 nt, Homo sapiens
guguuuaacuccucauuug

SEQ ID NO: 1155470 - RNA, 19 nt, Homo sapiens
cagaacauauacccagaaa

SEQ ID NO: 1155471 - RNA, 19 nt, Homo sapiens
gggaagccauacuaaaugu

SEQ ID NO: 1155472 - RNA, 19 nt, Homo sapiens
gcacaaucuuucuguucaa

SEQ ID NO: 1155473 - RNA, 19 nt, Homo sapiens
gcuaguauguugagagaag

SEQ ID NO: 1155474 - RNA, 19 nt, Homo sapiens
caccagauaugagcacuuu

SEQ ID NO: 1155475 - RNA, 19 nt, Homo sapiens
aaacgcacauaaagacauu

SEQ ID NO: 1155476 - RNA, 19 nt, Homo sapiens
guauaacaguccuaaagau

SEQ ID NO: 1155477 - RNA, 19 nt, Homo sapiens
ugacucagcugcgccauau

SEQ ID NO: 1155478 - RNA, 19 nt, Homo sapiens
ggugauggcacucuaacua

SEQ ID NO: 1155479 - RNA, 19 nt, Homo sapiens
ccugaucuguugcauguuu

SEQ ID NO: 1155480 - RNA, 19 nt, Homo sapiens
agaaaagaguugagcauua

SEQ ID NO: 1155481 - RNA, 19 nt, Homo sapiens
aaaucuagaugaggcuuua

SEQ ID NO: 1155482 - RNA, 19 nt, Homo sapiens
cauagaugcugcuaacugu

SEQ ID NO: 1155483 - RNA, 19 nt, Homo sapiens
uuaauuacguuccugauag

SEQ ID NO: 1155484 - RNA, 19 nt, Homo sapiens
gaaguuugucucugaagaa

SEQ ID NO: 1155485 - RNA, 19 nt, Homo sapiens
aacaaacacucccacauga

SEQ ID NO: 1155486 - RNA, 19 nt, Homo sapiens
caagaggaauugaacaaac

SEQ ID NO: 1155487 - RNA, 19 nt, Homo sapiens
gcaaguugaaucagaaaga

SEQ ID NO: 1155488 - RNA, 19 nt, Homo sapiens
acaggaaacagaacauaua

SEQ ID NO: 1155489 - RNA, 19 nt, Homo sapiens
caacaggaaacagaacaua

SEQ ID NO: 1155490 - RNA, 19 nt, Homo sapiens
ucaacuagcaguagacauu

SEQ ID NO: 1155491 - RNA, 19 nt, Homo sapiens
uaacaguccuaaagauuac

SEQ ID NO: 1155492 - RNA, 19 nt, Homo sapiens
gaauuaagcagaacagaac

SEQ ID NO: 1155493 - RNA, 19 nt, Homo sapiens
agacagagaacauaagcua

SEQ ID NO: 1155494 - RNA, 19 nt, Homo sapiens
gauuugugaugugagaaua

SEQ ID NO: 1155495 - RNA, 19 nt, Homo sapiens
gaaaguauagcagcaaaca

SEQ ID NO: 1155496 - RNA, 19 nt, Homo sapiens
gugaaaggauugccaaguc

SEQ ID NO: 1155497 - RNA, 19 nt, Homo sapiens
agaugaggcuuuaacaaga

SEQ ID NO: 1155498 - RNA, 19 nt, Homo sapiens
acaaagccgugaagucaga

SEQ ID NO: 1155499 - RNA, 19 nt, Homo sapiens
gcaagaggaauugaacaaa

SEQ ID NO: 1155500 - RNA, 19 nt, Homo sapiens
aaacaaugccuauagacaa

SEQ ID NO: 1155501 - RNA, 19 nt, Homo sapiens
gaaaccauugauauccuua

SEQ ID NO: 1155502 - RNA, 19 nt, Homo sapiens
gaagaacaugaaauacuga

SEQ ID NO: 1155503 - RNA, 19 nt, Homo sapiens
gagcgcagagugauauuga

SEQ ID NO: 1155504 - RNA, 19 nt, Homo sapiens
gaauggugguaaaggauca

SEQ ID NO: 1155505 - RNA, 19 nt, Homo sapiens
gauaauagagaacaaguac

SEQ ID NO: 1155506 - RNA, 19 nt, Homo sapiens
caaguauuaggucuucuua

SEQ ID NO: 1155507 - RNA, 19 nt, Homo sapiens
gcucgaaacauucaucaga

SEQ ID NO: 1155508 - RNA, 19 nt, Homo sapiens
gguauaacaguccuaaaga

SEQ ID NO: 1155509 - RNA, 19 nt, Homo sapiens
gacacuugcuaguauguug

SEQ ID NO: 1155510 - RNA, 19 nt, Homo sapiens
ggcacaaucuuucuguuca

SEQ ID NO: 1155511 - RNA, 19 nt, Homo sapiens
gagaacauaagcuagcaaa

SEQ ID NO: 1155512 - RNA, 19 nt, Homo sapiens
gaaacuauccacauuagcu

SEQ ID NO: 1155513 - RNA, 19 nt, Homo sapiens
gaagugacaugucugaaga

SEQ ID NO: 1155514 - RNA, 19 nt, Homo sapiens
gaaccgagaugcacuuuag

SEQ ID NO: 1155515 - RNA, 19 nt, Homo sapiens
ucagauagcuccucagaga

SEQ ID NO: 1155516 - RNA, 19 nt, Homo sapiens
ugacaugucugaagaagga

SEQ ID NO: 1155517 - RNA, 19 nt, Homo sapiens
ggacagcccacaccuuuga

SEQ ID NO: 1155518 - RNA, 19 nt, Homo sapiens
gugaggagcuauugacaga

SEQ ID NO: 1155519 - RNA, 19 nt, Homo sapiens
augcagagcugguacagua

SEQ ID NO: 1155520 - RNA, 19 nt, Homo sapiens
gcucuggguuuaauguauu

SEQ ID NO: 1155521 - RNA, 19 nt, Homo sapiens
gaagcugucucuggaggaa

SEQ ID NO: 1155522 - RNA, 19 nt, Homo sapiens
gagcggcauugaagacuau

SEQ ID NO: 1155523 - RNA, 19 nt, Homo sapiens
ggagcggcauugaagacua

SEQ ID NO: 1155524 - RNA, 19 nt, Homo sapiens
gaggagcuauugacagaca

SEQ ID NO: 1155525 - RNA, 19 nt, Homo sapiens
gaucagauagcuccucaga

SEQ ID NO: 1155526 - RNA, 19 nt, Homo sapiens
acaaguaacuccucuucau

SEQ ID NO: 1155527 - RNA, 19 nt, Homo sapiens
ggacaaggaggagcaggua

SEQ ID NO: 1155528 - RNA, 19 nt, Homo sapiens
caucaacucugucuuccau

SEQ ID NO: 1155529 - RNA, 19 nt, Homo sapiens
ggacagauggacacacaga

SEQ ID NO: 1155530 - RNA, 19 nt, Homo sapiens
agacuuggcugcccugcuu

SEQ ID NO: 1155531 - RNA, 19 nt, Homo sapiens
ugaaggaagugacaugucu

SEQ ID NO: 1155532 - RNA, 19 nt, Homo sapiens
caauaaagggucagaagug

SEQ ID NO: 1155533 - RNA, 19 nt, Homo sapiens
ccguggagcuccuggauga

SEQ ID NO: 1155534 - RNA, 19 nt, Homo sapiens
ccacuuauaagcagcguaa

SEQ ID NO: 1155535 - RNA, 19 nt, Homo sapiens
ccaaggaagugggagaugu

SEQ ID NO: 1155536 - RNA, 19 nt, Homo sapiens
gcacggagagcgagaagca

SEQ ID NO: 1155537 - RNA, 19 nt, Homo sapiens
gaagcagaacgccucauug

SEQ ID NO: 1155538 - RNA, 19 nt, Homo sapiens
ucucagacccucccuuuga

SEQ ID NO: 1155539 - RNA, 19 nt, Homo sapiens
gcguggaggugcacaagug

SEQ ID NO: 1155540 - RNA, 19 nt, Homo sapiens
cuacagcagugcaaguuca

SEQ ID NO: 1155541 - RNA, 19 nt, Homo sapiens
gagaagggaucagauagcu

SEQ ID NO: 1155542 - RNA, 19 nt, Homo sapiens
cagaaugcacugcuugaaa

SEQ ID NO: 1155543 - RNA, 19 nt, Homo sapiens
gggcagaggaggacaagga

SEQ ID NO: 1155544 - RNA, 19 nt, Homo sapiens
ggaagugacaugucugaag

SEQ ID NO: 1155545 - RNA, 19 nt, Homo sapiens
guggagaagggaucagaua

SEQ ID NO: 1155546 - RNA, 19 nt, Homo sapiens
ggaagugggagaugugauc

SEQ ID NO: 1155547 - RNA, 19 nt, Homo sapiens
ucccucagcucuggguuua

SEQ ID NO: 1155548 - RNA, 19 nt, Homo sapiens
ucaacguccugcucuucua

SEQ ID NO: 1155549 - RNA, 19 nt, Homo sapiens
gaacuggaucugcuucuac

SEQ ID NO: 1155550 - RNA, 19 nt, Homo sapiens
ggaaccgagaugcacuuua

SEQ ID NO: 1155551 - RNA, 19 nt, Homo sapiens
ccagugaggaugaggacua

SEQ ID NO: 1155552 - RNA, 19 nt, Homo sapiens
cgaagcagaacgccucauu

SEQ ID NO: 1155553 - RNA, 19 nt, Homo sapiens
ccgagugucuucugagauc

SEQ ID NO: 1155554 - RNA, 19 nt, Homo sapiens
ucaacucugucuuccaugu

SEQ ID NO: 1155555 - RNA, 19 nt, Homo sapiens
ccucagcucuggguuuaau

SEQ ID NO: 1155556 - RNA, 19 nt, Homo sapiens
ugaagacuauuuccaccau

SEQ ID NO: 1155557 - RNA, 19 nt, Homo sapiens
gagauccgcuaccgaaagc

SEQ ID NO: 1155558 - RNA, 19 nt, Homo sapiens
gaacgccucauuguggauu

SEQ ID NO: 1155559 - RNA, 19 nt, Homo sapiens
agaaugcacugcuugaaaa

SEQ ID NO: 1155560 - RNA, 19 nt, Homo sapiens
guucucaucagcauuguga

SEQ ID NO: 1155561 - RNA, 19 nt, Homo sapiens
ccauccagcugaaggaagu

SEQ ID NO: 1155562 - RNA, 19 nt, Homo sapiens
cuuauaagcagcguaauga

SEQ ID NO: 1155563 - RNA, 19 nt, Homo sapiens
caaguaacuccucuucauc

SEQ ID NO: 1155564 - RNA, 19 nt, Homo sapiens
gcagagcugguacaguaug

SEQ ID NO: 1155565 - RNA, 19 nt, Homo sapiens
cuggugaagucgcucauug

SEQ ID NO: 1155566 - RNA, 19 nt, Homo sapiens
ggaaacuguucagcaaacu

SEQ ID NO: 1155567 - RNA, 19 nt, Homo sapiens
uaaugaggacuuccggaaa

SEQ ID NO: 1155568 - RNA, 19 nt, Homo sapiens
ccaauaaagggucagaagu

SEQ ID NO: 1155569 - RNA, 19 nt, Homo sapiens
uggaucugcugcccaguga

SEQ ID NO: 1155570 - RNA, 19 nt, Homo sapiens
aagcagaacgccucauugu

SEQ ID NO: 1155571 - RNA, 19 nt, Homo sapiens
ggacuuccggaaacuguuc

SEQ ID NO: 1155572 - RNA, 19 nt, Homo sapiens
ggaggaaggcgggaaggau

SEQ ID NO: 1155573 - RNA, 19 nt, Homo sapiens
gcuauugacagacacaagu

SEQ ID NO: 1155574 - RNA, 19 nt, Homo sapiens
caaggaagugggagaugug

SEQ ID NO: 1155575 - RNA, 19 nt, Homo sapiens
cggaaacuguucagcaaac

SEQ ID NO: 1155576 - RNA, 19 nt, Homo sapiens
gcauuucuucacuuccuuu

SEQ ID NO: 1155577 - RNA, 19 nt, Homo sapiens
uccggaaacuguucagcaa

SEQ ID NO: 1155578 - RNA, 19 nt, Homo sapiens
ccucaucaacucugucuuc

SEQ ID NO: 1155579 - RNA, 19 nt, Homo sapiens
gugaggaugaggacuaugu

SEQ ID NO: 1155580 - RNA, 19 nt, Homo sapiens
aaugaggacuuccggaaac

SEQ ID NO: 1155581 - RNA, 19 nt, Homo sapiens
gaacucguggagcggcauu

SEQ ID NO: 1155582 - RNA, 19 nt, Homo sapiens
uaccaggacuacuucuaca

SEQ ID NO: 1155583 - RNA, 19 nt, Homo sapiens
acacaaguaacuccucuuc

SEQ ID NO: 1155584 - RNA, 19 nt, Homo sapiens
cagugaggaugaggacuau

SEQ ID NO: 1155585 - RNA, 19 nt, Homo sapiens
ccaacgccauccagaucug

SEQ ID NO: 1155586 - RNA, 19 nt, Homo sapiens
gcuccuggaugagaugaag

SEQ ID NO: 1155587 - RNA, 19 nt, Homo sapiens
cguggagccuggugaaguc

SEQ ID NO: 1155588 - RNA, 19 nt, Homo sapiens
gaggacuuccggaaacugu

SEQ ID NO: 1155589 - RNA, 19 nt, Homo sapiens
ggagaagggaucagauagc

SEQ ID NO: 1155590 - RNA, 19 nt, Homo sapiens
acaaggaggagcagguaga

SEQ ID NO: 1155591 - RNA, 19 nt, Homo sapiens
ggagagcgagaagcauuuc

SEQ ID NO: 1155592 - RNA, 19 nt, Homo sapiens
gcagcguaaugaggacuuc

SEQ ID NO: 1155593 - RNA, 19 nt, Homo sapiens
cuaggcagccggaacuuca

SEQ ID NO: 1155594 - RNA, 19 nt, Homo sapiens
cuauugacagacacaagua

SEQ ID NO: 1155595 - RNA, 19 nt, Homo sapiens
caugucacgcccaaccuuu

SEQ ID NO: 1155596 - RNA, 19 nt, Homo sapiens
gcugcuuccuccucaucuu

SEQ ID NO: 1155597 - RNA, 19 nt, Homo sapiens
ggccgacagugccccaaua

SEQ ID NO: 1155598 - RNA, 19 nt, Homo sapiens
caccaaggcaucacagucu

SEQ ID NO: 1155599 - RNA, 19 nt, Homo sapiens
agaagaugcagagcuggua

SEQ ID NO: 1155600 - RNA, 19 nt, Homo sapiens
gaaacuguucagcaaacuc

SEQ ID NO: 1155601 - RNA, 19 nt, Homo sapiens
cggagagcgagaagcauuu

SEQ ID NO: 1155602 - RNA, 19 nt, Homo sapiens
ggagaaccaucacuuaaau

SEQ ID NO: 1155603 - RNA, 19 nt, Homo sapiens
gaagcugagugcagagaua

SEQ ID NO: 1155604 - RNA, 19 nt, Homo sapiens
ggagucaacuuucucaaug

SEQ ID NO: 1155605 - RNA, 19 nt, Homo sapiens
gauauucuguucccuaaga

SEQ ID NO: 1155606 - RNA, 19 nt, Homo sapiens
ccucguacaugcacaaaua

SEQ ID NO: 1155607 - RNA, 19 nt, Homo sapiens
ggaaguggcugaaguuaac

SEQ ID NO: 1155608 - RNA, 19 nt, Homo sapiens
gaaggauucuagccuggua

SEQ ID NO: 1155609 - RNA, 19 nt, Homo sapiens
ccacauggauggacacuuc

SEQ ID NO: 1155610 - RNA, 19 nt, Homo sapiens
gaacaaguggucccaggua

SEQ ID NO: 1155611 - RNA, 19 nt, Homo sapiens
acacugggcuccaugauau

SEQ ID NO: 1155612 - RNA, 19 nt, Homo sapiens
guacaguugucagaaagua

SEQ ID NO: 1155613 - RNA, 19 nt, Homo sapiens
ggaagcaguggcugaauuu

SEQ ID NO: 1155614 - RNA, 19 nt, Homo sapiens
gcacaaauacacacucaug

SEQ ID NO: 1155615 - RNA, 19 nt, Homo sapiens
caagauuucucacuucauc

SEQ ID NO: 1155616 - RNA, 19 nt, Homo sapiens
gugcagagauacuucgauu

SEQ ID NO: 1155617 - RNA, 19 nt, Homo sapiens
acacggagcugauggaaca

SEQ ID NO: 1155618 - RNA, 19 nt, Homo sapiens
ggagaaacaggaauugcua

SEQ ID NO: 1155619 - RNA, 19 nt, Homo sapiens
agaaagugcugacgaagga

SEQ ID NO: 1155620 - RNA, 19 nt, Homo sapiens
ugauauccaucccuuugua

SEQ ID NO: 1155621 - RNA, 19 nt, Homo sapiens
uggagaagguggcagauga

SEQ ID NO: 1155622 - RNA, 19 nt, Homo sapiens
aaacaggaauugcuagagu

SEQ ID NO: 1155623 - RNA, 19 nt, Homo sapiens
gaaccaucacuuaaauuug

SEQ ID NO: 1155624 - RNA, 19 nt, Homo sapiens
gugagaaagugcugacgaa

SEQ ID NO: 1155625 - RNA, 19 nt, Homo sapiens
gaaaguacaacugaugguu

SEQ ID NO: 1155626 - RNA, 19 nt, Homo sapiens
acacacaugcauacacuua

SEQ ID NO: 1155627 - RNA, 19 nt, Homo sapiens
gcagagauacuucgauugg

SEQ ID NO: 1155628 - RNA, 19 nt, Homo sapiens
gauggaagaaucaccacua

SEQ ID NO: 1155629 - RNA, 19 nt, Homo sapiens
gaagguggcagaugagaag

SEQ ID NO: 1155630 - RNA, 19 nt, Homo sapiens
cggaagcaguggcugaauu

SEQ ID NO: 1155631 - RNA, 19 nt, Homo sapiens
gagcucgguuugcacuuga

SEQ ID NO: 1155632 - RNA, 19 nt, Homo sapiens
ggacaggcuuagagacaca

SEQ ID NO: 1155633 - RNA, 19 nt, Homo sapiens
guucucaguuucauugguu

SEQ ID NO: 1155634 - RNA, 19 nt, Homo sapiens
acccuacccucucuuauuu

SEQ ID NO: 1155635 - RNA, 19 nt, Homo sapiens
caggagaaccaucacuuaa

SEQ ID NO: 1155636 - RNA, 19 nt, Homo sapiens
ggaagaaucaccacuaagc

SEQ ID NO: 1155637 - RNA, 19 nt, Homo sapiens
gaagcaguggcugaauuua

SEQ ID NO: 1155638 - RNA, 19 nt, Homo sapiens
gaccaucagugagaaagug

SEQ ID NO: 1155639 - RNA, 19 nt, Homo sapiens
gggauuaccacacauuugu

SEQ ID NO: 1155640 - RNA, 19 nt, Homo sapiens
agucaacuuucucaaugua

SEQ ID NO: 1155641 - RNA, 19 nt, Homo sapiens
gauggcagcugugcagagu

SEQ ID NO: 1155642 - RNA, 19 nt, Homo sapiens
gagucaacuuucucaaugu

SEQ ID NO: 1155643 - RNA, 19 nt, Homo sapiens
acaggagaaccaucacuua

SEQ ID NO: 1155644 - RNA, 19 nt, Homo sapiens
ggauuggcaucuucaaggu

SEQ ID NO: 1155645 - RNA, 19 nt, Homo sapiens
ggauuccuguauucuguau

SEQ ID NO: 1155646 - RNA, 19 nt, Homo sapiens
gagaaccaucacuuaaauu

SEQ ID NO: 1155647 - RNA, 19 nt, Homo sapiens
gaugagagccagcaagaac

SEQ ID NO: 1155648 - RNA, 19 nt, Homo sapiens
ucacacacaugcauacacu

SEQ ID NO: 1155649 - RNA, 19 nt, Homo sapiens
aacaggaauugcuagagua

SEQ ID NO: 1155650 - RNA, 19 nt, Homo sapiens
aaccaucacuuaaauuugg

SEQ ID NO: 1155651 - RNA, 19 nt, Homo sapiens
guggguacccugucagaaa

SEQ ID NO: 1155652 - RNA, 19 nt, Homo sapiens
cagaugagaaguggaauga

SEQ ID NO: 1155653 - RNA, 19 nt, Homo sapiens
ugacuggauuggcaucuuc

SEQ ID NO: 1155654 - RNA, 19 nt, Homo sapiens
gaaagugguuuuggaggaa

SEQ ID NO: 1155655 - RNA, 19 nt, Homo sapiens
gcacacacacacucacaca

SEQ ID NO: 1155656 - RNA, 19 nt, Homo sapiens
gcaguuacaggaggagaaa

SEQ ID NO: 1155657 - RNA, 19 nt, Homo sapiens
gcaacugaaagaaguacaa

SEQ ID NO: 1155658 - RNA, 19 nt, Homo sapiens
gaauugcuagaguacauga

SEQ ID NO: 1155659 - RNA, 19 nt, Homo sapiens
guacaugcacaaauacaca

SEQ ID NO: 1155660 - RNA, 19 nt, Homo sapiens
gcagugccuucuaugacau

SEQ ID NO: 1155661 - RNA, 19 nt, Homo sapiens
gaaggaaaaggagcaguua

SEQ ID NO: 1155662 - RNA, 19 nt, Homo sapiens
ggucuuccgugccugaaag

SEQ ID NO: 1155663 - RNA, 19 nt, Homo sapiens
gcgcuuuccugcugagagu

SEQ ID NO: 1155664 - RNA, 19 nt, Homo sapiens
gaauuuauccccugaaagu

SEQ ID NO: 1155665 - RNA, 19 nt, Homo sapiens
gcuucugugugcccuguuu

SEQ ID NO: 1155666 - RNA, 19 nt, Homo sapiens
ggaguguccuaucuguaag

SEQ ID NO: 1155667 - RNA, 19 nt, Homo sapiens
caacuuacugcuuccugaa

SEQ ID NO: 1155668 - RNA, 19 nt, Homo sapiens
gggugaggaggccaacuua

SEQ ID NO: 1155669 - RNA, 19 nt, Homo sapiens
cagacaaggagcaaaguga

SEQ ID NO: 1155670 - RNA, 19 nt, Homo sapiens
auggaagaaucaccacuaa

SEQ ID NO: 1155671 - RNA, 19 nt, Homo sapiens
guauuugugccuucuguga

SEQ ID NO: 1155672 - RNA, 19 nt, Homo sapiens
cacacucccuugucugaug

SEQ ID NO: 1155673 - RNA, 19 nt, Homo sapiens
ggaggagaaacaggaauug

SEQ ID NO: 1155674 - RNA, 19 nt, Homo sapiens
gacaagguggcccagauga

SEQ ID NO: 1155675 - RNA, 19 nt, Homo sapiens
cacccuacccucucuuauu

SEQ ID NO: 1155676 - RNA, 19 nt, Homo sapiens
gcuccaugauauucuguuc

SEQ ID NO: 1155677 - RNA, 19 nt, Homo sapiens
gcagaugagaaguggaaug

SEQ ID NO: 1155678 - RNA, 19 nt, Homo sapiens
uaaauuuggaccugaagga

SEQ ID NO: 1155679 - RNA, 19 nt, Homo sapiens
cggagcugauggaacagua

SEQ ID NO: 1155680 - RNA, 19 nt, Homo sapiens
agaacggaaugaccugaug

SEQ ID NO: 1155681 - RNA, 19 nt, Homo sapiens
gcagcagcauggacaucau

SEQ ID NO: 1155682 - RNA, 19 nt, Homo sapiens
cccaagauuucucacuuca

SEQ ID NO: 1155683 - RNA, 19 nt, Homo sapiens
gcacacggagcugauggaa

SEQ ID NO: 1155684 - RNA, 19 nt, Homo sapiens
uggaguuuccguugguuua

SEQ ID NO: 1155685 - RNA, 19 nt, Homo sapiens
acacacacacucacacuca

SEQ ID NO: 1155686 - RNA, 19 nt, Homo sapiens
gcagacaaggagcaaagug

SEQ ID NO: 1155687 - RNA, 19 nt, Homo sapiens
ccugauauccaucccuuug

SEQ ID NO: 1155688 - RNA, 19 nt, Homo sapiens
agcaguggcugaauuuauc

SEQ ID NO: 1155689 - RNA, 19 nt, Homo sapiens
augauauucuguucccuaa

SEQ ID NO: 1155690 - RNA, 19 nt, Homo sapiens
cacacugggcuccaugaua

SEQ ID NO: 1155691 - RNA, 19 nt, Homo sapiens
acucggaggcugaagauga

SEQ ID NO: 1155692 - RNA, 19 nt, Homo sapiens
ugagcucgguuugcacuug

SEQ ID NO: 1155693 - RNA, 19 nt, Homo sapiens
aggagaaccaucacuuaaa

SEQ ID NO: 1155694 - RNA, 19 nt, Homo sapiens
uacagaaccagcucgauga

SEQ ID NO: 1155695 - RNA, 19 nt, Homo sapiens
ccugguugcuucugauaca

SEQ ID NO: 1155696 - RNA, 19 nt, Homo sapiens
ggcugaagaugagaaguca

SEQ ID NO: 1155697 - RNA, 19 nt, Homo sapiens
gaaacaggaauugcuagag

SEQ ID NO: 1155698 - RNA, 19 nt, Homo sapiens
cugguacaguugucagaaa

SEQ ID NO: 1155699 - RNA, 19 nt, Homo sapiens
aagacaagguggcccagau

SEQ ID NO: 1155700 - RNA, 19 nt, Homo sapiens
gcucuaccaguuccgauau

SEQ ID NO: 1155701 - RNA, 19 nt, Homo sapiens
gcaacagggagaccaugug

SEQ ID NO: 1155702 - RNA, 19 nt, Homo sapiens
gaaagaagcucucauugaa

SEQ ID NO: 1155703 - RNA, 19 nt, Homo sapiens
gaugauaucucuaaaggua

SEQ ID NO: 1155704 - RNA, 19 nt, Homo sapiens
gaauauaacugucagaugu

SEQ ID NO: 1155705 - RNA, 19 nt, Homo sapiens
guacaaagaucaagagaga

SEQ ID NO: 1155706 - RNA, 19 nt, Homo sapiens
gaaggaagauaacccugua

SEQ ID NO: 1155707 - RNA, 19 nt, Homo sapiens
gaagaacacugguaaugug

SEQ ID NO: 1155708 - RNA, 19 nt, Homo sapiens
gaagaacccaucaaguuua

SEQ ID NO: 1155709 - RNA, 19 nt, Homo sapiens
gaaaggaugauaucucuaa

SEQ ID NO: 1155710 - RNA, 19 nt, Homo sapiens
uaagacagauuccuugaaa

SEQ ID NO: 1155711 - RNA, 19 nt, Homo sapiens
gaagaugccuuuguuuaug

SEQ ID NO: 1155712 - RNA, 19 nt, Homo sapiens
ggaauaugcugaaggaaau

SEQ ID NO: 1155713 - RNA, 19 nt, Homo sapiens
ccaaggaacuaacaagaaa

SEQ ID NO: 1155714 - RNA, 19 nt, Homo sapiens
ggaagaacccaucaaguuu

SEQ ID NO: 1155715 - RNA, 19 nt, Homo sapiens
caaucagucuacagaauua

SEQ ID NO: 1155716 - RNA, 19 nt, Homo sapiens
gcuagggacugauuagaaa

SEQ ID NO: 1155717 - RNA, 19 nt, Homo sapiens
gcaggaauaugcugaagga

SEQ ID NO: 1155718 - RNA, 19 nt, Homo sapiens
gcuaaacaguugaauaugu

SEQ ID NO: 1155719 - RNA, 19 nt, Homo sapiens
caaagucaccugcguuuaa

SEQ ID NO: 1155720 - RNA, 19 nt, Homo sapiens
gaagagacccucaaucagu

SEQ ID NO: 1155721 - RNA, 19 nt, Homo sapiens
gaagaagagcuugaauaua

SEQ ID NO: 1155722 - RNA, 19 nt, Homo sapiens
gaaggugacucuuuguaca

SEQ ID NO: 1155723 - RNA, 19 nt, Homo sapiens
gaacagcuccagcagugua

SEQ ID NO: 1155724 - RNA, 19 nt, Homo sapiens
gaauggugcucuucacguu

SEQ ID NO: 1155725 - RNA, 19 nt, Homo sapiens
caaagagaauccuguacuu

SEQ ID NO: 1155726 - RNA, 19 nt, Homo sapiens
caaagagaauccuguacuu

SEQ ID NO: 1155727 - RNA, 19 nt, Homo sapiens
cagaagaugccuuuguuua

SEQ ID NO: 1155728 - RNA, 19 nt, Homo sapiens
ggaguaucuugguguauuu

SEQ ID NO: 1155729 - RNA, 19 nt, Homo sapiens
agaaggaucucaaggaaug

SEQ ID NO: 1155730 - RNA, 19 nt, Homo sapiens
ccagaaggaucucaaggaa

SEQ ID NO: 1155731 - RNA, 19 nt, Homo sapiens
agacagauuccuugaaaua

SEQ ID NO: 1155732 - RNA, 19 nt, Homo sapiens
caugaaaucugaugaugau

SEQ ID NO: 1155733 - RNA, 19 nt, Homo sapiens
caaauuauccuacagagau

SEQ ID NO: 1155734 - RNA, 19 nt, Homo sapiens
cagcugagcaacaacauua

SEQ ID NO: 1155735 - RNA, 19 nt, Homo sapiens
gaagauaacccuguaccaa

SEQ ID NO: 1155736 - RNA, 19 nt, Homo sapiens
uugaggagcuguuaagaaa

SEQ ID NO: 1155737 - RNA, 19 nt, Homo sapiens
gagaauuacuugggaaugu

SEQ ID NO: 1155738 - RNA, 19 nt, Homo sapiens
ugacccagcugcuugcuuu

SEQ ID NO: 1155739 - RNA, 19 nt, Homo sapiens
uaauggaaauccuaaccua

SEQ ID NO: 1155740 - RNA, 19 nt, Homo sapiens
uugcagcucucccuuauuu

SEQ ID NO: 1155741 - RNA, 19 nt, Homo sapiens
ugaaagaagcucucauuga

SEQ ID NO: 1155742 - RNA, 19 nt, Homo sapiens
gaaaauucaucuccacaaa

SEQ ID NO: 1155743 - RNA, 19 nt, Homo sapiens
gauauggauugcuuauguu

SEQ ID NO: 1155744 - RNA, 19 nt, Homo sapiens
ugauauggauugcuuaugu

SEQ ID NO: 1155745 - RNA, 19 nt, Homo sapiens
gaaaauggcucugcacuag

SEQ ID NO: 1155746 - RNA, 19 nt, Homo sapiens
gaauugcagcucucccuua

SEQ ID NO: 1155747 - RNA, 19 nt, Homo sapiens
gaagugugguccuuagaca

SEQ ID NO: 1155748 - RNA, 19 nt, Homo sapiens
gcaacaacauuagaagugu

SEQ ID NO: 1155749 - RNA, 19 nt, Homo sapiens
cagaagagacccucaauca

SEQ ID NO: 1155750 - RNA, 19 nt, Homo sapiens
gcaaguuuauauucccaaa

SEQ ID NO: 1155751 - RNA, 19 nt, Homo sapiens
aaauucaucuccacaaaug

SEQ ID NO: 1155752 - RNA, 19 nt, Homo sapiens
gguaauguguggaguaucu

SEQ ID NO: 1155753 - RNA, 19 nt, Homo sapiens
ggagaugauuucugagauc

SEQ ID NO: 1155754 - RNA, 19 nt, Homo sapiens
gaauuacuugggaauguua

SEQ ID NO: 1155755 - RNA, 19 nt, Homo sapiens
cuacagagaugcuaaacag

SEQ ID NO: 1155756 - RNA, 19 nt, Homo sapiens
caugaaaguuugaagaaca

SEQ ID NO: 1155757 - RNA, 19 nt, Homo sapiens
gaaaaccaauacauucgua

SEQ ID NO: 1155758 - RNA, 19 nt, Homo sapiens
ccucuucccuugagcagua

SEQ ID NO: 1155759 - RNA, 19 nt, Homo sapiens
gcaaggcauacauuuagua

SEQ ID NO: 1155760 - RNA, 19 nt, Homo sapiens
caucaaguuuagaggauuu

SEQ ID NO: 1155761 - RNA, 19 nt, Homo sapiens
acaaguaucucaggaugaa

SEQ ID NO: 1155762 - RNA, 19 nt, Homo sapiens
gcagaagaguuguguugca

SEQ ID NO: 1155763 - RNA, 19 nt, Homo sapiens
agacaagaaugccgaccua

SEQ ID NO: 1155764 - RNA, 19 nt, Homo sapiens
gaaauccuaaccuagauga

SEQ ID NO: 1155765 - RNA, 19 nt, Homo sapiens
auacgaaggugacucuuug

SEQ ID NO: 1155766 - RNA, 19 nt, Homo sapiens
aaacaggauuccagaagga

SEQ ID NO: 1155767 - RNA, 19 nt, Homo sapiens
cagagaugcuaaacaguug

SEQ ID NO: 1155768 - RNA, 19 nt, Homo sapiens
ccaauacauucguagaguu

SEQ ID NO: 1155769 - RNA, 19 nt, Homo sapiens
caagaaugccgaccuacaa

SEQ ID NO: 1155770 - RNA, 19 nt, Homo sapiens
agaagaagagcuugaauau

SEQ ID NO: 1155771 - RNA, 19 nt, Homo sapiens
gcccuguuguugcuaauuu

SEQ ID NO: 1155772 - RNA, 19 nt, Homo sapiens
uagaccagcugaaagaaga

SEQ ID NO: 1155773 - RNA, 19 nt, Homo sapiens
gguggucacuuucaaaucu

SEQ ID NO: 1155774 - RNA, 19 nt, Homo sapiens
gaaacagugcaaagacaaa

SEQ ID NO: 1155775 - RNA, 19 nt, Homo sapiens
gcugaaagaagcucucauu

SEQ ID NO: 1155776 - RNA, 19 nt, Homo sapiens
uuaaacugguggucacuuu

SEQ ID NO: 1155777 - RNA, 19 nt, Homo sapiens
aaagguauguggauucauc

SEQ ID NO: 1155778 - RNA, 19 nt, Homo sapiens
gaaaugugaaguccuggaa

SEQ ID NO: 1155779 - RNA, 19 nt, Homo sapiens
gaugaugauuggagugugu

SEQ ID NO: 1155780 - RNA, 19 nt, Homo sapiens
caacagcuagggacugauu

SEQ ID NO: 1155781 - RNA, 19 nt, Homo sapiens
gaacucaggcgcauaugca

SEQ ID NO: 1155782 - RNA, 19 nt, Homo sapiens
ggaugaaaucucaaugaaa

SEQ ID NO: 1155783 - RNA, 19 nt, Homo sapiens
agaauaacgagcaaguuua

SEQ ID NO: 1155784 - RNA, 19 nt, Homo sapiens
cgcuauagcuucaacaaug

SEQ ID NO: 1155785 - RNA, 19 nt, Homo sapiens
uaaccuagaugagacuguu

SEQ ID NO: 1155786 - RNA, 19 nt, Homo sapiens
cagaaugaaggaacaagua

SEQ ID NO: 1155787 - RNA, 19 nt, Homo sapiens
ugacaacccaggaaacaaa

SEQ ID NO: 1155788 - RNA, 19 nt, Homo sapiens
cagaauugguccacuuuag

SEQ ID NO: 1155789 - RNA, 19 nt, Homo sapiens
gacccaagaugcaacaaag

SEQ ID NO: 1155790 - RNA, 19 nt, Homo sapiens
gaugcuaaacaguugaaua

SEQ ID NO: 1155791 - RNA, 19 nt, Homo sapiens
aagaagaagagcuugaaua

SEQ ID NO: 1155792 - RNA, 19 nt, Homo sapiens
gaucaagagagaauuacuu

SEQ ID NO: 1155793 - RNA, 19 nt, Homo sapiens
gacaaagucaccugcguuu

SEQ ID NO: 1155794 - RNA, 19 nt, Homo sapiens
gaaugccgaccuacaaaga

SEQ ID NO: 1155795 - RNA, 19 nt, Homo sapiens
gaaagaauguggggaugaa

SEQ ID NO: 1155796 - RNA, 19 nt, Homo sapiens
gcugaaagaagacauggaa

SEQ ID NO: 1155797 - RNA, 19 nt, Homo sapiens
gaaacucgggccuucauuc

SEQ ID NO: 1155798 - RNA, 19 nt, Homo sapiens
gcaaagagaauccuguacu

SEQ ID NO: 1155799 - RNA, 19 nt, Homo sapiens
gcaaagagaauccuguacu

SEQ ID NO: 1155800 - RNA, 19 nt, Homo sapiens
gcacuagagucagaauugg

SEQ ID NO: 1155801 - RNA, 19 nt, Homo sapiens
gagcaguagugcaccuguu

SEQ ID NO: 1155802 - RNA, 19 nt, Homo sapiens
ggagagagauugagaacua

SEQ ID NO: 1155803 - RNA, 19 nt, Homo sapiens
gcaaaggccugucguagga

SEQ ID NO: 1155804 - RNA, 19 nt, Homo sapiens
gaugacagguggaaauuug

SEQ ID NO: 1155805 - RNA, 19 nt, Homo sapiens
ggacagaaacagaaagauu

SEQ ID NO: 1155806 - RNA, 19 nt, Homo sapiens
ucucaacacugucuaaauu

SEQ ID NO: 1155807 - RNA, 19 nt, Homo sapiens
uaagagagacgcuggagua

SEQ ID NO: 1155808 - RNA, 19 nt, Homo sapiens
ggagucaacuuuccaccaa

SEQ ID NO: 1155809 - RNA, 19 nt, Homo sapiens
ggagagagguaguguaaaa

SEQ ID NO: 1155810 - RNA, 19 nt, Homo sapiens
gacagagacuuaaggaaga

SEQ ID NO: 1155811 - RNA, 19 nt, Homo sapiens
gaacugagcuccccuaggu

SEQ ID NO: 1155812 - RNA, 19 nt, Homo sapiens
agaaugagacagagacuua

SEQ ID NO: 1155813 - RNA, 19 nt, Homo sapiens
gaagagagagagagagaga

SEQ ID NO: 1155814 - RNA, 19 nt, Homo sapiens
ggaagagacugagugugaa

SEQ ID NO: 1155815 - RNA, 19 nt, Homo sapiens
ggagaaggagcaacuagaa

SEQ ID NO: 1155816 - RNA, 19 nt, Homo sapiens
gccauugccucuuuuauua

SEQ ID NO: 1155817 - RNA, 19 nt, Homo sapiens
gcccagaaauggcucagaa

SEQ ID NO: 1155818 - RNA, 19 nt, Homo sapiens
cagauacgcugcugaccaa

SEQ ID NO: 1155819 - RNA, 19 nt, Homo sapiens
gaagggaaaucggaaagag

SEQ ID NO: 1155820 - RNA, 19 nt, Homo sapiens
gacagaaacagaaagauug

SEQ ID NO: 1155821 - RNA, 19 nt, Homo sapiens
ucaacacugucuaaauuug

SEQ ID NO: 1155822 - RNA, 19 nt, Homo sapiens
agaagcagcucuggaguug

SEQ ID NO: 1155823 - RNA, 19 nt, Homo sapiens
guaagagacaggagacaaa

SEQ ID NO: 1155824 - RNA, 19 nt, Homo sapiens
ggaggaagggagaaaguga

SEQ ID NO: 1155825 - RNA, 19 nt, Homo sapiens
gagagacgcuggaguaccu

SEQ ID NO: 1155826 - RNA, 19 nt, Homo sapiens
gaucagagggagacacaga

SEQ ID NO: 1155827 - RNA, 19 nt, Homo sapiens
cagaaagauuggagagaga

SEQ ID NO: 1155828 - RNA, 19 nt, Homo sapiens
gaagaucugggaccacuca

SEQ ID NO: 1155829 - RNA, 19 nt, Homo sapiens
cggcagagccagagagaaa

SEQ ID NO: 1155830 - RNA, 19 nt, Homo sapiens
gagagagauugagaacuau

SEQ ID NO: 1155831 - RNA, 19 nt, Homo sapiens
ccagaguccuuggaacuga

SEQ ID NO: 1155832 - RNA, 19 nt, Homo sapiens
gagaaagugagaagggaaa

SEQ ID NO: 1155833 - RNA, 19 nt, Homo sapiens
agagagagaccguaagaga

SEQ ID NO: 1155834 - RNA, 19 nt, Homo sapiens
ccugugagucugacaauaa

SEQ ID NO: 1155835 - RNA, 19 nt, Homo sapiens
gaacaccaccccuuacuug

SEQ ID NO: 1155836 - RNA, 19 nt, Homo sapiens
gaaugagacagagacuuaa

SEQ ID NO: 1155837 - RNA, 19 nt, Homo sapiens
agaaagaggaagagacuga

SEQ ID NO: 1155838 - RNA, 19 nt, Homo sapiens
caggagggaucccaaccuu

SEQ ID NO: 1155839 - RNA, 19 nt, Homo sapiens
gaagggagaaagugagaag

SEQ ID NO: 1155840 - RNA, 19 nt, Homo sapiens
agagagagagagagaauga

SEQ ID NO: 1155841 - RNA, 19 nt, Homo sapiens
ggagcaaaggccugucgua

SEQ ID NO: 1155842 - RNA, 19 nt, Homo sapiens
aaacaagauccacgccuuu

SEQ ID NO: 1155843 - RNA, 19 nt, Homo sapiens
gacagcagcuaagagacaa

SEQ ID NO: 1155844 - RNA, 19 nt, Homo sapiens
gagagauugagaacuauga

SEQ ID NO: 1155845 - RNA, 19 nt, Homo sapiens
aggaagagacugaguguga

SEQ ID NO: 1155846 - RNA, 19 nt, Homo sapiens
ggaagagacagagaucaga

SEQ ID NO: 1155847 - RNA, 19 nt, Homo sapiens
uaugagagacagcagcuaa

SEQ ID NO: 1155848 - RNA, 19 nt, Homo sapiens
agagagagggagagaauga

SEQ ID NO: 1155849 - RNA, 19 nt, Homo sapiens
uaaggaagagacccuguga

SEQ ID NO: 1155850 - RNA, 19 nt, Homo sapiens
ccagagagaaagaggaaga

SEQ ID NO: 1155851 - RNA, 19 nt, Homo sapiens
gcgcagaaaccaggaaugu

SEQ ID NO: 1155852 - RNA, 19 nt, Homo sapiens
gagucaacuuuccaccaaa

SEQ ID NO: 1155853 - RNA, 19 nt, Homo sapiens
ggcaugaggaccuacguuu

SEQ ID NO: 1155854 - RNA, 19 nt, Homo sapiens
auccgaggcuggcuucaua

SEQ ID NO: 1155855 - RNA, 19 nt, Homo sapiens
gcagagccagagagaaaga

SEQ ID NO: 1155856 - RNA, 19 nt, Homo sapiens
agagagagaaugagacaga

SEQ ID NO: 1155857 - RNA, 19 nt, Homo sapiens
gagcugggcaccuuaagag

SEQ ID NO: 1155858 - RNA, 19 nt, Homo sapiens
uuuggccgcugacaccuua

SEQ ID NO: 1155859 - RNA, 19 nt, Homo sapiens
ggaggggaaugguuucuau

SEQ ID NO: 1155860 - RNA, 19 nt, Homo sapiens
gcaggagcugggcaccuua

SEQ ID NO: 1155861 - RNA, 19 nt, Homo sapiens
auacgcugcugaccaaguu

SEQ ID NO: 1155862 - RNA, 19 nt, Homo sapiens
gcagcuaagagacaaagga

SEQ ID NO: 1155863 - RNA, 19 nt, Homo sapiens
agagacagcagcuaagaga

SEQ ID NO: 1155864 - RNA, 19 nt, Homo sapiens
gagcaggugaggagagaga

SEQ ID NO: 1155865 - RNA, 19 nt, Homo sapiens
ggagagaaugagugagaga

SEQ ID NO: 1155866 - RNA, 19 nt, Homo sapiens
gaaggagcaacuagaagca

SEQ ID NO: 1155867 - RNA, 19 nt, Homo sapiens
aggaggagauagaccagaa

SEQ ID NO: 1155868 - RNA, 19 nt, Homo sapiens
ggagacacagaaagugaga

SEQ ID NO: 1155869 - RNA, 19 nt, Homo sapiens
ggagcugggcaccuuaaga

SEQ ID NO: 1155870 - RNA, 19 nt, Homo sapiens
agacagagagagagagaga

SEQ ID NO: 1155871 - RNA, 19 nt, Homo sapiens
gaaagauuggagagagaga

SEQ ID NO: 1155872 - RNA, 19 nt, Homo sapiens
ggacacaggggaugacuga

SEQ ID NO: 1155873 - RNA, 19 nt, Homo sapiens
gacaggagacaaagagaca

SEQ ID NO: 1155874 - RNA, 19 nt, Homo sapiens
agagagagagagaccguaa

SEQ ID NO: 1155875 - RNA, 19 nt, Homo sapiens
gaagagacugagugugaag

SEQ ID NO: 1155876 - RNA, 19 nt, Homo sapiens
gauuuggacagaaacagaa

SEQ ID NO: 1155877 - RNA, 19 nt, Homo sapiens
ugacugagagacagagaga

SEQ ID NO: 1155878 - RNA, 19 nt, Homo sapiens
cuccagaggucgugguaga

SEQ ID NO: 1155879 - RNA, 19 nt, Homo sapiens
gugagcaggugaggagaga

SEQ ID NO: 1155880 - RNA, 19 nt, Homo sapiens
agagagagagaccguaaga

SEQ ID NO: 1155881 - RNA, 19 nt, Homo sapiens
gagaucagagggagacaca

SEQ ID NO: 1155882 - RNA, 19 nt, Homo sapiens
ugagagagagacuggaaga

SEQ ID NO: 1155883 - RNA, 19 nt, Homo sapiens
cugugagucugacaauaaa

SEQ ID NO: 1155884 - RNA, 19 nt, Homo sapiens
gcaguggcacagaaugaug

SEQ ID NO: 1155885 - RNA, 19 nt, Homo sapiens
gauugagaacuaugagaga

SEQ ID NO: 1155886 - RNA, 19 nt, Homo sapiens
agagagagagggagagaau

SEQ ID NO: 1155887 - RNA, 19 nt, Homo sapiens
gagaaggagcaacuagaag

SEQ ID NO: 1155888 - RNA, 19 nt, Homo sapiens
gagaagggaaaucggaaag

SEQ ID NO: 1155889 - RNA, 19 nt, Homo sapiens
gagauugagaacuaugaga

SEQ ID NO: 1155890 - RNA, 19 nt, Homo sapiens
agagagagacuggaagaga

SEQ ID NO: 1155891 - RNA, 19 nt, Homo sapiens
gccacccucugucacuuga

SEQ ID NO: 1155892 - RNA, 19 nt, Homo sapiens
ggaggagaaggagcaacua

SEQ ID NO: 1155893 - RNA, 19 nt, Homo sapiens
agagagagagagaaugaga

SEQ ID NO: 1155894 - RNA, 19 nt, Homo sapiens
gcaggugaggagagagauu

SEQ ID NO: 1155895 - RNA, 19 nt, Homo sapiens
agagagaccguaagagaca

SEQ ID NO: 1155896 - RNA, 19 nt, Homo sapiens
gaaagugagaagggaaauc

SEQ ID NO: 1155897 - RNA, 19 nt, Homo sapiens
aaaggaagagagagagaga

SEQ ID NO: 1155898 - RNA, 19 nt, Homo sapiens
cgccagcccucacuuaggu

SEQ ID NO: 1155899 - RNA, 19 nt, Homo sapiens
cugggcaccuuaagagaga

SEQ ID NO: 1155900 - RNA, 19 nt, Homo sapiens
uagaagcagcucuggaguu

SEQ ID NO: 1155901 - RNA, 19 nt, Homo sapiens
gaggagaaggagcaacuag

SEQ ID NO: 1155902 - RNA, 19 nt, Homo sapiens
aagcauggaugacauauua

SEQ ID NO: 1155903 - RNA, 19 nt, Homo sapiens
ucaaaccacucuucaauuu

SEQ ID NO: 1155904 - RNA, 19 nt, Homo sapiens
ggaugaaucuguugcaaga

SEQ ID NO: 1155905 - RNA, 19 nt, Homo sapiens
gcacaaaugucaccgucaa

SEQ ID NO: 1155906 - RNA, 19 nt, Homo sapiens
ggaaugguguggauugaga

SEQ ID NO: 1155907 - RNA, 19 nt, Homo sapiens
gaagaacuguugcccaaag

SEQ ID NO: 1155908 - RNA, 19 nt, Homo sapiens
ccaaaguguuaacuaguuu

SEQ ID NO: 1155909 - RNA, 19 nt, Homo sapiens
gccaaaguguuaacuaguu

SEQ ID NO: 1155910 - RNA, 19 nt, Homo sapiens
gauaagagaauuucagcaa

SEQ ID NO: 1155911 - RNA, 19 nt, Homo sapiens
ggagcaaacuggcuaacau

SEQ ID NO: 1155912 - RNA, 19 nt, Homo sapiens
caaacuggcuaacauucuu

SEQ ID NO: 1155913 - RNA, 19 nt, Homo sapiens
gcccuuacaugaagacuga

SEQ ID NO: 1155914 - RNA, 19 nt, Homo sapiens
cuggaugucuugaucaaua

SEQ ID NO: 1155915 - RNA, 19 nt, Homo sapiens
ccaaagcuauggaugaauc

SEQ ID NO: 1155916 - RNA, 19 nt, Homo sapiens
gcccagacuuccauuuauu

SEQ ID NO: 1155917 - RNA, 19 nt, Homo sapiens
gaucaggaaugguguggau

SEQ ID NO: 1155918 - RNA, 19 nt, Homo sapiens
gaacagugaacaaagcuau

SEQ ID NO: 1155919 - RNA, 19 nt, Homo sapiens
gaacuuguuacuugaagaa

SEQ ID NO: 1155920 - RNA, 19 nt, Homo sapiens
uaagagaauuucagcaaag

SEQ ID NO: 1155921 - RNA, 19 nt, Homo sapiens
gcccaaagcuauggaugaa

SEQ ID NO: 1155922 - RNA, 19 nt, Homo sapiens
gaaggagugucaggaagau

SEQ ID NO: 1155923 - RNA, 19 nt, Homo sapiens
ggucaaaccacucuucaau

SEQ ID NO: 1155924 - RNA, 19 nt, Homo sapiens
agaauuaagugacucaaag

SEQ ID NO: 1155925 - RNA, 19 nt, Homo sapiens
gaacuguugcccaaagcua

SEQ ID NO: 1155926 - RNA, 19 nt, Homo sapiens
gagcaaacuggcuaacauu

SEQ ID NO: 1155927 - RNA, 19 nt, Homo sapiens
gagaugcaguucggaguga

SEQ ID NO: 1155928 - RNA, 19 nt, Homo sapiens
auugagaacuuguuacuug

SEQ ID NO: 1155929 - RNA, 19 nt, Homo sapiens
uaaagaggaagaacuguug

SEQ ID NO: 1155930 - RNA, 19 nt, Homo sapiens
caagaaaacucugggauau

SEQ ID NO: 1155931 - RNA, 19 nt, Homo sapiens
uuucauggccaaaguguua

SEQ ID NO: 1155932 - RNA, 19 nt, Homo sapiens
guaaaagagcugucuauaa

SEQ ID NO: 1155933 - RNA, 19 nt, Homo sapiens
guaaagaggaagaacuguu

SEQ ID NO: 1155934 - RNA, 19 nt, Homo sapiens
aaaccacucuucaauuugg

SEQ ID NO: 1155935 - RNA, 19 nt, Homo sapiens
gaagacugaagauggguuu

SEQ ID NO: 1155936 - RNA, 19 nt, Homo sapiens
aaagugcuaucgagagguu

SEQ ID NO: 1155937 - RNA, 19 nt, Homo sapiens
gagaauuucagcaaagaug

SEQ ID NO: 1155938 - RNA, 19 nt, Homo sapiens
gcaagaaaacucugggaua

SEQ ID NO: 1155939 - RNA, 19 nt, Homo sapiens
gaagauacuuuggggauug

SEQ ID NO: 1155940 - RNA, 19 nt, Homo sapiens
ccagugcccuuacaugaag

SEQ ID NO: 1155941 - RNA, 19 nt, Homo sapiens
ucaguuauaucugugauca

SEQ ID NO: 1155942 - RNA, 19 nt, Homo sapiens
gugcccagacuuccauuua

SEQ ID NO: 1155943 - RNA, 19 nt, Homo sapiens
gcaggauugugguaguuuc

SEQ ID NO: 1155944 - RNA, 19 nt, Homo sapiens
gagaacuuguuacuugaag

SEQ ID NO: 1155945 - RNA, 19 nt, Homo sapiens
guagaaggagugucaggaa

SEQ ID NO: 1155946 - RNA, 19 nt, Homo sapiens
uaaauacggagacaucaau

SEQ ID NO: 1155947 - RNA, 19 nt, Homo sapiens
ggauugugguaguuucuuc

SEQ ID NO: 1155948 - RNA, 19 nt, Homo sapiens
caaguaucuuugaguuuca

SEQ ID NO: 1155949 - RNA, 19 nt, Homo sapiens
ccauuuauuuggccucuuc

SEQ ID NO: 1155950 - RNA, 19 nt, Homo sapiens
aggaaaugcuccaggaaga

SEQ ID NO: 1155951 - RNA, 19 nt, Homo sapiens
gggcaagcauggaugacau

SEQ ID NO: 1155952 - RNA, 19 nt, Homo sapiens
gaauuucagcaaagauguu

SEQ ID NO: 1155953 - RNA, 19 nt, Homo sapiens
ugugguaguuucuuccaaa

SEQ ID NO: 1155954 - RNA, 19 nt, Homo sapiens
gaauuaagugacucaaagu

SEQ ID NO: 1155955 - RNA, 19 nt, Homo sapiens
gcauggaugacauauuaau

SEQ ID NO: 1155956 - RNA, 19 nt, Homo sapiens
uggaugucuugaucaauaa

SEQ ID NO: 1155957 - RNA, 19 nt, Homo sapiens
caaaugucaccgucaaugu

SEQ ID NO: 1155958 - RNA, 19 nt, Homo sapiens
uuauaucugugaucaggaa

SEQ ID NO: 1155959 - RNA, 19 nt, Homo sapiens
augaaucuguugcaagaaa

SEQ ID NO: 1155960 - RNA, 19 nt, Homo sapiens
ggaagacugugcugaucac

SEQ ID NO: 1155961 - RNA, 19 nt, Homo sapiens
cauacacauuccacuguug

SEQ ID NO: 1155962 - RNA, 19 nt, Homo sapiens
gcaaacuggcuaacauucu

SEQ ID NO: 1155963 - RNA, 19 nt, Homo sapiens
cagcaggauugugguaguu

SEQ ID NO: 1155964 - RNA, 19 nt, Homo sapiens
aagagaauuucagcaaaga

SEQ ID NO: 1155965 - RNA, 19 nt, Homo sapiens
caggaaugguguggauuga

SEQ ID NO: 1155966 - RNA, 19 nt, Homo sapiens
guugcauccugguauugua

SEQ ID NO: 1155967 - RNA, 19 nt, Homo sapiens
guguuuguguggaaauuau

SEQ ID NO: 1155968 - RNA, 19 nt, Homo sapiens
uuucaaaacuccaguagaa

SEQ ID NO: 1155969 - RNA, 19 nt, Homo sapiens
uuagaaggcacaaauguca

SEQ ID NO: 1155970 - RNA, 19 nt, Homo sapiens
uugaugacuugaacaguga

SEQ ID NO: 1155971 - RNA, 19 nt, Homo sapiens
cuacaauguuugguguuug

SEQ ID NO: 1155972 - RNA, 19 nt, Homo sapiens
acuacaauguuugguguuu

SEQ ID NO: 1155973 - RNA, 19 nt, Homo sapiens
agagguacauguggguauu

SEQ ID NO: 1155974 - RNA, 19 nt, Homo sapiens
gucaaaccacucuucaauu

SEQ ID NO: 1155975 - RNA, 19 nt, Homo sapiens
gggaggcacauacacauuc

SEQ ID NO: 1155976 - RNA, 19 nt, Homo sapiens
acagugaacaaagcuauaa

SEQ ID NO: 1155977 - RNA, 19 nt, Homo sapiens
ggcaagcauggaugacaua

SEQ ID NO: 1155978 - RNA, 19 nt, Homo sapiens
guggauugagaacuuguua

SEQ ID NO: 1155979 - RNA, 19 nt, Homo sapiens
ggaagaacuguugcccaaa

SEQ ID NO: 1155980 - RNA, 19 nt, Homo sapiens
caauaacgcagggaucuuc

SEQ ID NO: 1155981 - RNA, 19 nt, Homo sapiens
acauacacauuccacuguu

SEQ ID NO: 1155982 - RNA, 19 nt, Homo sapiens
gcuuagaaggcacaaaugu

SEQ ID NO: 1155983 - RNA, 19 nt, Homo sapiens
gggaagacugugcugauca

SEQ ID NO: 1155984 - RNA, 19 nt, Homo sapiens
uggccaaaguguuaacuag

SEQ ID NO: 1155985 - RNA, 19 nt, Homo sapiens
uaagugacucaaagugcua

SEQ ID NO: 1155986 - RNA, 19 nt, Homo sapiens
cagaauuaagugacucaaa

SEQ ID NO: 1155987 - RNA, 19 nt, Homo sapiens
uugagaacuuguuacuuga

SEQ ID NO: 1155988 - RNA, 19 nt, Homo sapiens
ucaggaaugguguggauug

SEQ ID NO: 1155989 - RNA, 19 nt, Homo sapiens
ugagguagaaggaguguca

SEQ ID NO: 1155990 - RNA, 19 nt, Homo sapiens
ggauugagaacuuguuacu

SEQ ID NO: 1155991 - RNA, 19 nt, Homo sapiens
uaacugggcaagcauggau

SEQ ID NO: 1155992 - RNA, 19 nt, Homo sapiens
gguguggauugagaacuug

SEQ ID NO: 1155993 - RNA, 19 nt, Homo sapiens
agaaaacucugggauauca

SEQ ID NO: 1155994 - RNA, 19 nt, Homo sapiens
ggaagauacuuuggggauu

SEQ ID NO: 1155995 - RNA, 19 nt, Homo sapiens
gguguuuguguggaaauua

SEQ ID NO: 1155996 - RNA, 19 nt, Homo sapiens
ugaguuucauggccaaagu

SEQ ID NO: 1155997 - RNA, 19 nt, Homo sapiens
aauuauaacugggcaagca

SEQ ID NO: 1155998 - RNA, 19 nt, Homo sapiens
ggcuggaugucuugaucaa

SEQ ID NO: 1155999 - RNA, 19 nt, Homo sapiens
ccagacuuccauuuauuug

SEQ ID NO: 1156000 - RNA, 19 nt, Homo sapiens
ccagcaggauugugguagu

SEQ ID NO: 1156001 - RNA, 19 nt, Homo sapiens
agaaggagugucaggaaga

SEQ ID NO: 1156002 - RNA, 19 nt, Homo sapiens
cgacuaggaucacgauuua

SEQ ID NO: 1156003 - RNA, 19 nt, Homo sapiens
ccaaauggcuagaaaugua

SEQ ID NO: 1156004 - RNA, 19 nt, Homo sapiens
ggucugagauuuauggauu

SEQ ID NO: 1156005 - RNA, 19 nt, Homo sapiens
ggaucacgauuuagauaua

SEQ ID NO: 1156006 - RNA, 19 nt, Homo sapiens
gagaagaacuacggagaaa

SEQ ID NO: 1156007 - RNA, 19 nt, Homo sapiens
gaacuacggagaaaucaaa

SEQ ID NO: 1156008 - RNA, 19 nt, Homo sapiens
gagaaaugccuuaauaaug

SEQ ID NO: 1156009 - RNA, 19 nt, Homo sapiens
gcacauugguuggauggua

SEQ ID NO: 1156010 - RNA, 19 nt, Homo sapiens
ccacacacguaucauguaa

SEQ ID NO: 1156011 - RNA, 19 nt, Homo sapiens
gcacguagauuugacuuca

SEQ ID NO: 1156012 - RNA, 19 nt, Homo sapiens
gaacaggaacauacauuug

SEQ ID NO: 1156013 - RNA, 19 nt, Homo sapiens
acacguaucauguaacuua

SEQ ID NO: 1156014 - RNA, 19 nt, Homo sapiens
aaaggaagcuacagaugaa

SEQ ID NO: 1156015 - RNA, 19 nt, Homo sapiens
ccaccuagcgguucuauuu

SEQ ID NO: 1156016 - RNA, 19 nt, Homo sapiens
gagcuaacccgguauuuau

SEQ ID NO: 1156017 - RNA, 19 nt, Homo sapiens
uucaggagcuuguccauua

SEQ ID NO: 1156018 - RNA, 19 nt, Homo sapiens
acugagaaaugccuuaaua

SEQ ID NO: 1156019 - RNA, 19 nt, Homo sapiens
gaagauaaccagauuggau

SEQ ID NO: 1156020 - RNA, 19 nt, Homo sapiens
aagcagaaguguuuacuga

SEQ ID NO: 1156021 - RNA, 19 nt, Homo sapiens
gcaaagaacaggaacauac

SEQ ID NO: 1156022 - RNA, 19 nt, Homo sapiens
ccacauuguuuccuauuug

SEQ ID NO: 1156023 - RNA, 19 nt, Homo sapiens
gcaauuggcagcuuauaau

SEQ ID NO: 1156024 - RNA, 19 nt, Homo sapiens
ggagcuaacccgguauuua

SEQ ID NO: 1156025 - RNA, 19 nt, Homo sapiens
uguacuggcuaucuuaaua

SEQ ID NO: 1156026 - RNA, 19 nt, Homo sapiens
agaagaagcuguccugaag

SEQ ID NO: 1156027 - RNA, 19 nt, Homo sapiens
ucucaucgaucaggauuua

SEQ ID NO: 1156028 - RNA, 19 nt, Homo sapiens
gaagaacuacggagaaauc

SEQ ID NO: 1156029 - RNA, 19 nt, Homo sapiens
ugacuuaccuagaaaucaa

SEQ ID NO: 1156030 - RNA, 19 nt, Homo sapiens
uaaaggaagcuacagauga

SEQ ID NO: 1156031 - RNA, 19 nt, Homo sapiens
gcaguacuccacauuguuu

SEQ ID NO: 1156032 - RNA, 19 nt, Homo sapiens
gaaguugacugagaaaugc

SEQ ID NO: 1156033 - RNA, 19 nt, Homo sapiens
gcaagaagaucaacauccu

SEQ ID NO: 1156034 - RNA, 19 nt, Homo sapiens
gaaagaaggcccagcaaac

SEQ ID NO: 1156035 - RNA, 19 nt, Homo sapiens
gaaauggaaggaauacaga

SEQ ID NO: 1156036 - RNA, 19 nt, Homo sapiens
gacgaacucuacaaaugaa

SEQ ID NO: 1156037 - RNA, 19 nt, Homo sapiens
ggccgaagauaaccagauu

SEQ ID NO: 1156038 - RNA, 19 nt, Homo sapiens
gagaguuccuccugacuuc

SEQ ID NO: 1156039 - RNA, 19 nt, Homo sapiens
ccaccaggcuuccgggauu

SEQ ID NO: 1156040 - RNA, 19 nt, Homo sapiens
aaacaacgauuggugaugu

SEQ ID NO: 1156041 - RNA, 19 nt, Homo sapiens
ggacauagacuucauuucc

SEQ ID NO: 1156042 - RNA, 19 nt, Homo sapiens
aaccugaaguugaauauga

SEQ ID NO: 1156043 - RNA, 19 nt, Homo sapiens
cuacggagaaaucaaauaa

SEQ ID NO: 1156044 - RNA, 19 nt, Homo sapiens
gagaguguuuggucuugaa

SEQ ID NO: 1156045 - RNA, 19 nt, Homo sapiens
gaaaugccuuaauaauguc

SEQ ID NO: 1156046 - RNA, 19 nt, Homo sapiens
aaagaguucucaucgauca

SEQ ID NO: 1156047 - RNA, 19 nt, Homo sapiens
gggaaugacuauaguuugg

SEQ ID NO: 1156048 - RNA, 19 nt, Homo sapiens
gcgguucuauuuguucaua

SEQ ID NO: 1156049 - RNA, 19 nt, Homo sapiens
ugaauuggaugccuugcuu

SEQ ID NO: 1156050 - RNA, 19 nt, Homo sapiens
caauaaagcaagaagauca

SEQ ID NO: 1156051 - RNA, 19 nt, Homo sapiens
ggaacauacauuugucuuu

SEQ ID NO: 1156052 - RNA, 19 nt, Homo sapiens
gaaucuaauugaucacaca

SEQ ID NO: 1156053 - RNA, 19 nt, Homo sapiens
gaagcagugcauaagguua

SEQ ID NO: 1156054 - RNA, 19 nt, Homo sapiens
gagcauaguccugaacuug

SEQ ID NO: 1156055 - RNA, 19 nt, Homo sapiens
caagauauucucaguggaa

SEQ ID NO: 1156056 - RNA, 19 nt, Homo sapiens
gauaaacccugagaagaac

SEQ ID NO: 1156057 - RNA, 19 nt, Homo sapiens
gaaauuaauguggacacua

SEQ ID NO: 1156058 - RNA, 19 nt, Homo sapiens
gaaggaacgacuccgagaa

SEQ ID NO: 1156059 - RNA, 19 nt, Homo sapiens
cagcacaaguagcacauug

SEQ ID NO: 1156060 - RNA, 19 nt, Homo sapiens
ccuccugacuucaagagua

SEQ ID NO: 1156061 - RNA, 19 nt, Homo sapiens
gcugaaaccaauuaucuga

SEQ ID NO: 1156062 - RNA, 19 nt, Homo sapiens
gagauggaacuggcuauuu

SEQ ID NO: 1156063 - RNA, 19 nt, Homo sapiens
aaauuagacugucccuuug

SEQ ID NO: 1156064 - RNA, 19 nt, Homo sapiens
cagcaguacuccacauugu

SEQ ID NO: 1156065 - RNA, 19 nt, Homo sapiens
gcacagcaguacuccacau

SEQ ID NO: 1156066 - RNA, 19 nt, Homo sapiens
gauugaaugucaugagagu

SEQ ID NO: 1156067 - RNA, 19 nt, Homo sapiens
cagaguaucagaccacaaa

SEQ ID NO: 1156068 - RNA, 19 nt, Homo sapiens
ugaaggagauaccaaaauu

SEQ ID NO: 1156069 - RNA, 19 nt, Homo sapiens
gcuaacccgguauuuauuu

SEQ ID NO: 1156070 - RNA, 19 nt, Homo sapiens
gcuguagucucagguaaug

SEQ ID NO: 1156071 - RNA, 19 nt, Homo sapiens
gcauuuaccucaggcaucu

SEQ ID NO: 1156072 - RNA, 19 nt, Homo sapiens
agauaaacccugagaagaa

SEQ ID NO: 1156073 - RNA, 19 nt, Homo sapiens
caagauaaacccugagaag

SEQ ID NO: 1156074 - RNA, 19 nt, Homo sapiens
ggaagcuacagaugaauug

SEQ ID NO: 1156075 - RNA, 19 nt, Homo sapiens
gauucuaaguccaucauca

SEQ ID NO: 1156076 - RNA, 19 nt, Homo sapiens
gaucacgauuuagauauag

SEQ ID NO: 1156077 - RNA, 19 nt, Homo sapiens
caaaagaguucucaucgau

SEQ ID NO: 1156078 - RNA, 19 nt, Homo sapiens
gagaugggaaugacuauag

SEQ ID NO: 1156079 - RNA, 19 nt, Homo sapiens
aagcugaacuuggugacua

SEQ ID NO: 1156080 - RNA, 19 nt, Homo sapiens
uuacaacacuaaagagaag

SEQ ID NO: 1156081 - RNA, 19 nt, Homo sapiens
guuacaaauucccgaaaga

SEQ ID NO: 1156082 - RNA, 19 nt, Homo sapiens
cugagaaucuaauugauca

SEQ ID NO: 1156083 - RNA, 19 nt, Homo sapiens
gcugaauagcccagacuua

SEQ ID NO: 1156084 - RNA, 19 nt, Homo sapiens
ccaaaagcaugcaaacauu

SEQ ID NO: 1156085 - RNA, 19 nt, Homo sapiens
gcauaguccugaacuuguc

SEQ ID NO: 1156086 - RNA, 19 nt, Homo sapiens
ggugagagcauccuugauc

SEQ ID NO: 1156087 - RNA, 19 nt, Homo sapiens
gagcuuguccauuauuugu

SEQ ID NO: 1156088 - RNA, 19 nt, Homo sapiens
ucuaauugaucacacaguu

SEQ ID NO: 1156089 - RNA, 19 nt, Homo sapiens
uaucacaccugccgacagu

SEQ ID NO: 1156090 - RNA, 19 nt, Homo sapiens
guggugaaguugacugaga

SEQ ID NO: 1156091 - RNA, 19 nt, Homo sapiens
agacgaacucuacaaauga

SEQ ID NO: 1156092 - RNA, 19 nt, Homo sapiens
caagaguuguuugaucaga

SEQ ID NO: 1156093 - RNA, 19 nt, Homo sapiens
gaguaaauuuagagcuuuc

SEQ ID NO: 1156094 - RNA, 19 nt, Homo sapiens
ggaugguacugauguuagu

SEQ ID NO: 1156095 - RNA, 19 nt, Homo sapiens
caaagaacaggaacauaca

SEQ ID NO: 1156096 - RNA, 19 nt, Homo sapiens
ggaauacagaggucaaaca

SEQ ID NO: 1156097 - RNA, 19 nt, Homo sapiens
guaaacaugcagagaagga

SEQ ID NO: 1156098 - RNA, 19 nt, Homo sapiens
gcguaaacaugcagagaag

SEQ ID NO: 1156099 - RNA, 19 nt, Homo sapiens
gcacagcacagcaguacuc

SEQ ID NO: 1156100 - RNA, 19 nt, Homo sapiens
cguaucauguaacuuauca

SEQ ID NO: 1156101 - RNA, 19 nt, Homo sapiens
ugauugaaagcgacuauuu

SEQ ID NO: 1156102 - RNA, 19 nt, Homo sapiens
gaaugagccuuaccaauaa

SEQ ID NO: 1156103 - RNA, 19 nt, Homo sapiens
gugaauggcuuaaagauaa

SEQ ID NO: 1156104 - RNA, 19 nt, Homo sapiens
gaaagacgauucuauucaa

SEQ ID NO: 1156105 - RNA, 19 nt, Homo sapiens
gaacaaagaagaccauuau

SEQ ID NO: 1156106 - RNA, 19 nt, Homo sapiens
ucagacgacuucauaauua

SEQ ID NO: 1156107 - RNA, 19 nt, Homo sapiens
ucagaugacuggacucuua

SEQ ID NO: 1156108 - RNA, 19 nt, Homo sapiens
guaguaagcuuggauauau

SEQ ID NO: 1156109 - RNA, 19 nt, Homo sapiens
gagacuacauugaagguua

SEQ ID NO: 1156110 - RNA, 19 nt, Homo sapiens
gagggcaacuuucaccuua

SEQ ID NO: 1156111 - RNA, 19 nt, Homo sapiens
gcagaaggauccaaggaaa

SEQ ID NO: 1156112 - RNA, 19 nt, Homo sapiens
caguagagcuucuuauauu

SEQ ID NO: 1156113 - RNA, 19 nt, Homo sapiens
ccagaaacauaccaucaua

SEQ ID NO: 1156114 - RNA, 19 nt, Homo sapiens
agaaugagccuuaccaaua

SEQ ID NO: 1156115 - RNA, 19 nt, Homo sapiens
gaagaaggcagcacaauuc

SEQ ID NO: 1156116 - RNA, 19 nt, Homo sapiens
gagaguggcugcuacuuau

SEQ ID NO: 1156117 - RNA, 19 nt, Homo sapiens
caaagaagaccaugugauu

SEQ ID NO: 1156118 - RNA, 19 nt, Homo sapiens
gcaggauccuuucccauaa

SEQ ID NO: 1156119 - RNA, 19 nt, Homo sapiens
gaauuuaggcucugaggua

SEQ ID NO: 1156120 - RNA, 19 nt, Homo sapiens
gauauggugucuuugauga

SEQ ID NO: 1156121 - RNA, 19 nt, Homo sapiens
gcaguucacucucauuuca

SEQ ID NO: 1156122 - RNA, 19 nt, Homo sapiens
gcaaagauaagcagugaaa

SEQ ID NO: 1156123 - RNA, 19 nt, Homo sapiens
gaaagaggccugguccaua

SEQ ID NO: 1156124 - RNA, 19 nt, Homo sapiens
caagagcuguugcaagauu

SEQ ID NO: 1156125 - RNA, 19 nt, Homo sapiens
gcaaagaaguaauccaucu

SEQ ID NO: 1156126 - RNA, 19 nt, Homo sapiens
ccagaaauauugagucguu

SEQ ID NO: 1156127 - RNA, 19 nt, Homo sapiens
cagagacaguccagaaaua

SEQ ID NO: 1156128 - RNA, 19 nt, Homo sapiens
cgaguuagcuacuacagaa

SEQ ID NO: 1156129 - RNA, 19 nt, Homo sapiens
uaaauaagcagccagauau

SEQ ID NO: 1156130 - RNA, 19 nt, Homo sapiens
gaauguguccuucgacuaa

SEQ ID NO: 1156131 - RNA, 19 nt, Homo sapiens
gaguauugcacaucuauua

SEQ ID NO: 1156132 - RNA, 19 nt, Homo sapiens
ggaaugauuuggugaugga

SEQ ID NO: 1156133 - RNA, 19 nt, Homo sapiens
gaaguggccugauggaaag

SEQ ID NO: 1156134 - RNA, 19 nt, Homo sapiens
aauguuggcuguaauguaa

SEQ ID NO: 1156135 - RNA, 19 nt, Homo sapiens
gaaggaagcagaauacaca

SEQ ID NO: 1156136 - RNA, 19 nt, Homo sapiens
cagaucagcacaacauuua

SEQ ID NO: 1156137 - RNA, 19 nt, Homo sapiens
gcacagagacaguccagaa

SEQ ID NO: 1156138 - RNA, 19 nt, Homo sapiens
gaaguggcaucuccagaau

SEQ ID NO: 1156139 - RNA, 19 nt, Homo sapiens
ccaaucagacgacuucaua

SEQ ID NO: 1156140 - RNA, 19 nt, Homo sapiens
gaagaaguauuugagaaca

SEQ ID NO: 1156141 - RNA, 19 nt, Homo sapiens
guccauggaugacuuguuu

SEQ ID NO: 1156142 - RNA, 19 nt, Homo sapiens
uaaaggaugccaccuauga

SEQ ID NO: 1156143 - RNA, 19 nt, Homo sapiens
aaagaggccugguccauau

SEQ ID NO: 1156144 - RNA, 19 nt, Homo sapiens
cuucaaaccuagucuauau

SEQ ID NO: 1156145 - RNA, 19 nt, Homo sapiens
ggaaagggaacacugacua

SEQ ID NO: 1156146 - RNA, 19 nt, Homo sapiens
gauuccagcuucuugcuaa

SEQ ID NO: 1156147 - RNA, 19 nt, Homo sapiens
ggagguggcuagccgauuc

SEQ ID NO: 1156148 - RNA, 19 nt, Homo sapiens
uaacuaggcugcauaacag

SEQ ID NO: 1156149 - RNA, 19 nt, Homo sapiens
gaaagcaugggacaauauu

SEQ ID NO: 1156150 - RNA, 19 nt, Homo sapiens
aaagacagaccuaaaguuu

SEQ ID NO: 1156151 - RNA, 19 nt, Homo sapiens
caaagaagaccauuaugug

SEQ ID NO: 1156152 - RNA, 19 nt, Homo sapiens
gaagauggguauggagaau

SEQ ID NO: 1156153 - RNA, 19 nt, Homo sapiens
ggauaucccuuccuacagu

SEQ ID NO: 1156154 - RNA, 19 nt, Homo sapiens
gcaacuuucaccuuaauaa

SEQ ID NO: 1156155 - RNA, 19 nt, Homo sapiens
gaaccucauuuguccaugu

SEQ ID NO: 1156156 - RNA, 19 nt, Homo sapiens
uuucuaagcuguuucuuga

SEQ ID NO: 1156157 - RNA, 19 nt, Homo sapiens
acuaacaacugggaaauaa

SEQ ID NO: 1156158 - RNA, 19 nt, Homo sapiens
ggagucuucugccucuuaa

SEQ ID NO: 1156159 - RNA, 19 nt, Homo sapiens
ggauaaugaucgcgaggaa

SEQ ID NO: 1156160 - RNA, 19 nt, Homo sapiens
gaacacugacuaugccaaa

SEQ ID NO: 1156161 - RNA, 19 nt, Homo sapiens
gacagaaucucaggcagaa

SEQ ID NO: 1156162 - RNA, 19 nt, Homo sapiens
gcagccagcucuugauuac

SEQ ID NO: 1156163 - RNA, 19 nt, Homo sapiens
ucaauaagcagagagauuu

SEQ ID NO: 1156164 - RNA, 19 nt, Homo sapiens
gaugacuuguuuccuguuu

SEQ ID NO: 1156165 - RNA, 19 nt, Homo sapiens
gcagaucagcacaacauuu

SEQ ID NO: 1156166 - RNA, 19 nt, Homo sapiens
gcuggugccuugucacuga

SEQ ID NO: 1156167 - RNA, 19 nt, Homo sapiens
gaacacucuuguagcaaau

SEQ ID NO: 1156168 - RNA, 19 nt, Homo sapiens
gggccaggauuaggaauuu

SEQ ID NO: 1156169 - RNA, 19 nt, Homo sapiens
cuaaauaagcagccagaua

SEQ ID NO: 1156170 - RNA, 19 nt, Homo sapiens
ggaaccuacuucaaaccua

SEQ ID NO: 1156171 - RNA, 19 nt, Homo sapiens
ggaaauugacguccucuuc

SEQ ID NO: 1156172 - RNA, 19 nt, Homo sapiens
caaaguggcuacgagcuau

SEQ ID NO: 1156173 - RNA, 19 nt, Homo sapiens
gaggagcaguucacucuca

SEQ ID NO: 1156174 - RNA, 19 nt, Homo sapiens
ggauauauaagcagaguga

SEQ ID NO: 1156175 - RNA, 19 nt, Homo sapiens
cagcuuagcccuuguacaa

SEQ ID NO: 1156176 - RNA, 19 nt, Homo sapiens
gauaucccuuccuacagua

SEQ ID NO: 1156177 - RNA, 19 nt, Homo sapiens
guaaagaaggaaugauuug

SEQ ID NO: 1156178 - RNA, 19 nt, Homo sapiens
gaagacauuuacugggaau

SEQ ID NO: 1156179 - RNA, 19 nt, Homo sapiens
gaaagggaacacugacuau

SEQ ID NO: 1156180 - RNA, 19 nt, Homo sapiens
gccaguggguaauggauaa

SEQ ID NO: 1156181 - RNA, 19 nt, Homo sapiens
acaaggcaaugaacaaaga

SEQ ID NO: 1156182 - RNA, 19 nt, Homo sapiens
gagcaguucacucucauuu

SEQ ID NO: 1156183 - RNA, 19 nt, Homo sapiens
gaagaagcaauuccuaauc

SEQ ID NO: 1156184 - RNA, 19 nt, Homo sapiens
gaaacugucagaucauuca

SEQ ID NO: 1156185 - RNA, 19 nt, Homo sapiens
cccaagcagucaaugaaua

SEQ ID NO: 1156186 - RNA, 19 nt, Homo sapiens
gaauguuggcuguaaugua

SEQ ID NO: 1156187 - RNA, 19 nt, Homo sapiens
ggaaagcaugggacaauau

SEQ ID NO: 1156188 - RNA, 19 nt, Homo sapiens
gauguauucuggcauguuc

SEQ ID NO: 1156189 - RNA, 19 nt, Homo sapiens
caagcuguguuaccucauu

SEQ ID NO: 1156190 - RNA, 19 nt, Homo sapiens
ucaggccucuucucaguuu

SEQ ID NO: 1156191 - RNA, 19 nt, Homo sapiens
gggaagaacagguuaaaca

SEQ ID NO: 1156192 - RNA, 19 nt, Homo sapiens
ugagaacacucuuguagca

SEQ ID NO: 1156193 - RNA, 19 nt, Homo sapiens
aaacauggaguucuucuga

SEQ ID NO: 1156194 - RNA, 19 nt, Homo sapiens
uaacauaggugcucuuccu

SEQ ID NO: 1156195 - RNA, 19 nt, Homo sapiens
ccacgaaagaugcuuguuu

SEQ ID NO: 1156196 - RNA, 19 nt, Homo sapiens
guaacgaguucuggauuau

SEQ ID NO: 1156197 - RNA, 19 nt, Homo sapiens
agagccagguuauguagua

SEQ ID NO: 1156198 - RNA, 19 nt, Homo sapiens
gauaaagacagaccuaaag

SEQ ID NO: 1156199 - RNA, 19 nt, Homo sapiens
uauggugucuuugaugaua

SEQ ID NO: 1156200 - RNA, 19 nt, Homo sapiens
gaauacagaaucccaaaca

SEQ ID NO: 1156201 - RNA, 19 nt, Homo sapiens
accaagagcuguugcaaga

SEQ ID NO: 1156202 - RNA, 19 nt, Homo sapiens
gaacuacgccaaccauuua

SEQ ID NO: 1156203 - RNA, 19 nt, Homo sapiens
gaucagaaccaguuuauuu

SEQ ID NO: 1156204 - RNA, 19 nt, Homo sapiens
agauggaacugguaaauua

SEQ ID NO: 1156205 - RNA, 19 nt, Homo sapiens
gaaaauaggcugagauaua

SEQ ID NO: 1156206 - RNA, 19 nt, Homo sapiens
ggacagugauauucagauu

SEQ ID NO: 1156207 - RNA, 19 nt, Homo sapiens
uaucagagguuagaaguaa

SEQ ID NO: 1156208 - RNA, 19 nt, Homo sapiens
caccuacucuccacuaaua

SEQ ID NO: 1156209 - RNA, 19 nt, Homo sapiens
cagaguaagugaaauagaa

SEQ ID NO: 1156210 - RNA, 19 nt, Homo sapiens
aaaugaaucugcuuccuaa

SEQ ID NO: 1156211 - RNA, 19 nt, Homo sapiens
uaauagaccaggcaacuua

SEQ ID NO: 1156212 - RNA, 19 nt, Homo sapiens
gaaaugauaguacuugugu

SEQ ID NO: 1156213 - RNA, 19 nt, Homo sapiens
gaagguaccaacaaguuaa

SEQ ID NO: 1156214 - RNA, 19 nt, Homo sapiens
acaauuaugcccuuucuua

SEQ ID NO: 1156215 - RNA, 19 nt, Homo sapiens
ggacucaccuuguauucau

SEQ ID NO: 1156216 - RNA, 19 nt, Homo sapiens
gcaagacuuucacucagaa

SEQ ID NO: 1156217 - RNA, 19 nt, Homo sapiens
guccugaacuuaagaaaug

SEQ ID NO: 1156218 - RNA, 19 nt, Homo sapiens
ccaggcaacuuaccacuug

SEQ ID NO: 1156219 - RNA, 19 nt, Homo sapiens
gauaguacuugugugaauu

SEQ ID NO: 1156220 - RNA, 19 nt, Homo sapiens
gcugagauauaaggugaua

SEQ ID NO: 1156221 - RNA, 19 nt, Homo sapiens
aagcaggacucaccuugua

SEQ ID NO: 1156222 - RNA, 19 nt, Homo sapiens
ggcaauagucuuagucuuu

SEQ ID NO: 1156223 - RNA, 19 nt, Homo sapiens
caaaaugucugaaagauca

SEQ ID NO: 1156224 - RNA, 19 nt, Homo sapiens
aaaaccaucuccacaauua

SEQ ID NO: 1156225 - RNA, 19 nt, Homo sapiens
ggaaguuuauaaagccaaa

SEQ ID NO: 1156226 - RNA, 19 nt, Homo sapiens
caauguggcaauagucuua

SEQ ID NO: 1156227 - RNA, 19 nt, Homo sapiens
ggagacaauugcucuuauc

SEQ ID NO: 1156228 - RNA, 19 nt, Homo sapiens
cuccaugucugauaaauga

SEQ ID NO: 1156229 - RNA, 19 nt, Homo sapiens
guacuugugugaauugagu

SEQ ID NO: 1156230 - RNA, 19 nt, Homo sapiens
caauugcucuuauccuguu

SEQ ID NO: 1156231 - RNA, 19 nt, Homo sapiens
gaaaacagaguaagugaaa

SEQ ID NO: 1156232 - RNA, 19 nt, Homo sapiens
cgaagguaccaacaaguua

SEQ ID NO: 1156233 - RNA, 19 nt, Homo sapiens
ggagugauuuugcuaguuu

SEQ ID NO: 1156234 - RNA, 19 nt, Homo sapiens
gcaauagucuuagucuuuu

SEQ ID NO: 1156235 - RNA, 19 nt, Homo sapiens
ggcaagacuuucacucaga

SEQ ID NO: 1156236 - RNA, 19 nt, Homo sapiens
cauagaugauauugaggua

SEQ ID NO: 1156237 - RNA, 19 nt, Homo sapiens
uaaaugaaucugcuuccua

SEQ ID NO: 1156238 - RNA, 19 nt, Homo sapiens
gggagacaauugcucuuau

SEQ ID NO: 1156239 - RNA, 19 nt, Homo sapiens
aaggugauauugcuauuga

SEQ ID NO: 1156240 - RNA, 19 nt, Homo sapiens
gagauaagccccauaaaug

SEQ ID NO: 1156241 - RNA, 19 nt, Homo sapiens
cgaacugacugacaaugug

SEQ ID NO: 1156242 - RNA, 19 nt, Homo sapiens
uuaaaccuuuccaguguaa

SEQ ID NO: 1156243 - RNA, 19 nt, Homo sapiens
aauuaaaccuuuccagugu

SEQ ID NO: 1156244 - RNA, 19 nt, Homo sapiens
acagugauauucagauugu

SEQ ID NO: 1156245 - RNA, 19 nt, Homo sapiens
gcucuuauccuguuauagu

SEQ ID NO: 1156246 - RNA, 19 nt, Homo sapiens
gaacaaauuaagagaagag

SEQ ID NO: 1156247 - RNA, 19 nt, Homo sapiens
caagcuguccugaacuuaa

SEQ ID NO: 1156248 - RNA, 19 nt, Homo sapiens
ugagagaaauguacaagac

SEQ ID NO: 1156249 - RNA, 19 nt, Homo sapiens
uaccuaacauugacuuaug

SEQ ID NO: 1156250 - RNA, 19 nt, Homo sapiens
ggagauucaauguuacaaa

SEQ ID NO: 1156251 - RNA, 19 nt, Homo sapiens
uagaugcuaugcuaagaga

SEQ ID NO: 1156252 - RNA, 19 nt, Homo sapiens
gaguggauuugccuuacuu

SEQ ID NO: 1156253 - RNA, 19 nt, Homo sapiens
gagauggaacugguaaauu

SEQ ID NO: 1156254 - RNA, 19 nt, Homo sapiens
gguaccaacaaguuaauaa

SEQ ID NO: 1156255 - RNA, 19 nt, Homo sapiens
gcaggacucaccuuguauu

SEQ ID NO: 1156256 - RNA, 19 nt, Homo sapiens
gauauggaggacagugaua

SEQ ID NO: 1156257 - RNA, 19 nt, Homo sapiens
aacaaccaauggauaguaa

SEQ ID NO: 1156258 - RNA, 19 nt, Homo sapiens
cagaugagccacauuguag

SEQ ID NO: 1156259 - RNA, 19 nt, Homo sapiens
ggugaaaaucuccauauua

SEQ ID NO: 1156260 - RNA, 19 nt, Homo sapiens
uagaugauauugagguaca

SEQ ID NO: 1156261 - RNA, 19 nt, Homo sapiens
uuaauaacaucaccuacuc

SEQ ID NO: 1156262 - RNA, 19 nt, Homo sapiens
gugagucaaagcacuaaua

SEQ ID NO: 1156263 - RNA, 19 nt, Homo sapiens
ugauaguacuugugugaau

SEQ ID NO: 1156264 - RNA, 19 nt, Homo sapiens
uauucgagguguagacaaa

SEQ ID NO: 1156265 - RNA, 19 nt, Homo sapiens
aaacaaccaauggauagua

SEQ ID NO: 1156266 - RNA, 19 nt, Homo sapiens
ucagaugagccacauugua

SEQ ID NO: 1156267 - RNA, 19 nt, Homo sapiens
ucugguugccuauugauua

SEQ ID NO: 1156268 - RNA, 19 nt, Homo sapiens
gcuaagagaagugaauaau

SEQ ID NO: 1156269 - RNA, 19 nt, Homo sapiens
caaccuucaucgacacaug

SEQ ID NO: 1156270 - RNA, 19 nt, Homo sapiens
ccacaauuaugcccuuucu

SEQ ID NO: 1156271 - RNA, 19 nt, Homo sapiens
gaacccacugcuuuacauu

SEQ ID NO: 1156272 - RNA, 19 nt, Homo sapiens
gaugagccacauuguagaa

SEQ ID NO: 1156273 - RNA, 19 nt, Homo sapiens
gaacuucugguugccuauu

SEQ ID NO: 1156274 - RNA, 19 nt, Homo sapiens
gagaagugaauaaucuuuc

SEQ ID NO: 1156275 - RNA, 19 nt, Homo sapiens
agaacuacgccaaccauuu

SEQ ID NO: 1156276 - RNA, 19 nt, Homo sapiens
caauuaugcccuuucuuau

SEQ ID NO: 1156277 - RNA, 19 nt, Homo sapiens
gauaaauucaacuguggaa

SEQ ID NO: 1156278 - RNA, 19 nt, Homo sapiens
gaaccaguuuauuucuucu

SEQ ID NO: 1156279 - RNA, 19 nt, Homo sapiens
gugcuggaauucccugaga

SEQ ID NO: 1156280 - RNA, 19 nt, Homo sapiens
gauguuacaguucucauag

SEQ ID NO: 1156281 - RNA, 19 nt, Homo sapiens
gacugacaauguggcaaua

SEQ ID NO: 1156282 - RNA, 19 nt, Homo sapiens
gugaaaaucuccauauuac

SEQ ID NO: 1156283 - RNA, 19 nt, Homo sapiens
cagcacucccugauaaauu

SEQ ID NO: 1156284 - RNA, 19 nt, Homo sapiens
aaagaucagaaccaguuua

SEQ ID NO: 1156285 - RNA, 19 nt, Homo sapiens
ggaggacagugauauucag

SEQ ID NO: 1156286 - RNA, 19 nt, Homo sapiens
gaggaaacaccuuaaacag

SEQ ID NO: 1156287 - RNA, 19 nt, Homo sapiens
ugaggaaacaccuuaaaca

SEQ ID NO: 1156288 - RNA, 19 nt, Homo sapiens
gguugccuauugauuauuc

SEQ ID NO: 1156289 - RNA, 19 nt, Homo sapiens
ggcccaagcuguccugaac

SEQ ID NO: 1156290 - RNA, 19 nt, Homo sapiens
uaaagggugucagccacaa

SEQ ID NO: 1156291 - RNA, 19 nt, Homo sapiens
gcuuugauaaugccaauga

SEQ ID NO: 1156292 - RNA, 19 nt, Homo sapiens
gauaagccccauaaaugua

SEQ ID NO: 1156293 - RNA, 19 nt, Homo sapiens
ggagauaagccccauaaau

SEQ ID NO: 1156294 - RNA, 19 nt, Homo sapiens
caucaccagugcccaaagu

SEQ ID NO: 1156295 - RNA, 19 nt, Homo sapiens
gaagacaguauggauaugg

SEQ ID NO: 1156296 - RNA, 19 nt, Homo sapiens
guacagggacauaaaauug

SEQ ID NO: 1156297 - RNA, 19 nt, Homo sapiens
cuucuuaagagaccaauuu

SEQ ID NO: 1156298 - RNA, 19 nt, Homo sapiens
ucagaucuccuucacuuca

SEQ ID NO: 1156299 - RNA, 19 nt, Homo sapiens
cuucugaacccacugcuuu

SEQ ID NO: 1156300 - RNA, 19 nt, Homo sapiens
gauaaugccaaugagagaa

SEQ ID NO: 1156301 - RNA, 19 nt, Homo sapiens
ucagaaguguuccuuacag

SEQ ID NO: 1156302 - RNA, 19 nt, Homo sapiens
gaagugaacugaaacauug

SEQ ID NO: 1156303 - RNA, 19 nt, Homo sapiens
gaaugcaucuuagcaauua

SEQ ID NO: 1156304 - RNA, 19 nt, Homo sapiens
gaacagccuugcaaauuaa

SEQ ID NO: 1156305 - RNA, 19 nt, Homo sapiens
gcaauuaccugauuuccaa

SEQ ID NO: 1156306 - RNA, 19 nt, Homo sapiens
ggacgcaaguuaauuguuu

SEQ ID NO: 1156307 - RNA, 19 nt, Homo sapiens
guaacaaacucuagggaua

SEQ ID NO: 1156308 - RNA, 19 nt, Homo sapiens
ugagaacacuugccaauuu

SEQ ID NO: 1156309 - RNA, 19 nt, Homo sapiens
gaacugaaacauugucuaa

SEQ ID NO: 1156310 - RNA, 19 nt, Homo sapiens
ggaaagguguuaucacaga

SEQ ID NO: 1156311 - RNA, 19 nt, Homo sapiens
gcuaagugcuauauuauug

SEQ ID NO: 1156312 - RNA, 19 nt, Homo sapiens
cgucaaagccuguggauua

SEQ ID NO: 1156313 - RNA, 19 nt, Homo sapiens
agaacagccuugcaaauua

SEQ ID NO: 1156314 - RNA, 19 nt, Homo sapiens
gaaaggauaugagauugga

SEQ ID NO: 1156315 - RNA, 19 nt, Homo sapiens
caaguggcauuccuaguaa

SEQ ID NO: 1156316 - RNA, 19 nt, Homo sapiens
gcucuuaucuguaaacaca

SEQ ID NO: 1156317 - RNA, 19 nt, Homo sapiens
ggaacagccucuacuuuca

SEQ ID NO: 1156318 - RNA, 19 nt, Homo sapiens
gagaacacuugccaauuug

SEQ ID NO: 1156319 - RNA, 19 nt, Homo sapiens
caacgugacugucuuugga

SEQ ID NO: 1156320 - RNA, 19 nt, Homo sapiens
uagcaaaguuaauccagua

SEQ ID NO: 1156321 - RNA, 19 nt, Homo sapiens
ggagcucauuugauucaua

SEQ ID NO: 1156322 - RNA, 19 nt, Homo sapiens
uuuagaaacucuccuagua

SEQ ID NO: 1156323 - RNA, 19 nt, Homo sapiens
gaaagcaccacauacaaga

SEQ ID NO: 1156324 - RNA, 19 nt, Homo sapiens
ccaaguggcauuccuagua

SEQ ID NO: 1156325 - RNA, 19 nt, Homo sapiens
gaugucagauguacaguuc

SEQ ID NO: 1156326 - RNA, 19 nt, Homo sapiens
ugaaggaaguguaaagaau

SEQ ID NO: 1156327 - RNA, 19 nt, Homo sapiens
gcaaauuacuccagauggu

SEQ ID NO: 1156328 - RNA, 19 nt, Homo sapiens
ggauuaaacuucauugacu

SEQ ID NO: 1156329 - RNA, 19 nt, Homo sapiens
acaaacaaauguggagaua

SEQ ID NO: 1156330 - RNA, 19 nt, Homo sapiens
caaguuaauucuggaugua

SEQ ID NO: 1156331 - RNA, 19 nt, Homo sapiens
gcaaguuaauucuggaugu

SEQ ID NO: 1156332 - RNA, 19 nt, Homo sapiens
gaacauuggcaaguuaauu

SEQ ID NO: 1156333 - RNA, 19 nt, Homo sapiens
uaaaucugcucuucaaaca

SEQ ID NO: 1156334 - RNA, 19 nt, Homo sapiens
gcacaccaguggaguuugu

SEQ ID NO: 1156335 - RNA, 19 nt, Homo sapiens
ggagaacugucauccaagu

SEQ ID NO: 1156336 - RNA, 19 nt, Homo sapiens
cuccauaucuguuucaauu

SEQ ID NO: 1156337 - RNA, 19 nt, Homo sapiens
gaagauuucuccuccaaaa

SEQ ID NO: 1156338 - RNA, 19 nt, Homo sapiens
ucauggcauuugucaauua

SEQ ID NO: 1156339 - RNA, 19 nt, Homo sapiens
gaaggaaguguaaagaaug

SEQ ID NO: 1156340 - RNA, 19 nt, Homo sapiens
caaaguuaauccaguaauc

SEQ ID NO: 1156341 - RNA, 19 nt, Homo sapiens
ucacaucgccuuuguuaug

SEQ ID NO: 1156342 - RNA, 19 nt, Homo sapiens
gaauucacaucgccuuugu

SEQ ID NO: 1156343 - RNA, 19 nt, Homo sapiens
gaagagcccuuggccauac

SEQ ID NO: 1156344 - RNA, 19 nt, Homo sapiens
caagacacauucagaaguc

SEQ ID NO: 1156345 - RNA, 19 nt, Homo sapiens
ugacagaaaugcagacuac

SEQ ID NO: 1156346 - RNA, 19 nt, Homo sapiens
gacgcaaguuaauuguuua

SEQ ID NO: 1156347 - RNA, 19 nt, Homo sapiens
aggcuucucuguaauuuaa

SEQ ID NO: 1156348 - RNA, 19 nt, Homo sapiens
gaccauggauuucccaaag

SEQ ID NO: 1156349 - RNA, 19 nt, Homo sapiens
ugauugaagugaacugaaa

SEQ ID NO: 1156350 - RNA, 19 nt, Homo sapiens
gaugaugaguuauguaugc

SEQ ID NO: 1156351 - RNA, 19 nt, Homo sapiens
uaagaaagcaccacauaca

SEQ ID NO: 1156352 - RNA, 19 nt, Homo sapiens
gaccagacgugggcaaaga

SEQ ID NO: 1156353 - RNA, 19 nt, Homo sapiens
gaacgaaugcaucuuagca

SEQ ID NO: 1156354 - RNA, 19 nt, Homo sapiens
gagggaacauuggcaaguu

SEQ ID NO: 1156355 - RNA, 19 nt, Homo sapiens
gaaccuacauuuuauaugg

SEQ ID NO: 1156356 - RNA, 19 nt, Homo sapiens
gaacagccucuacuuucaa

SEQ ID NO: 1156357 - RNA, 19 nt, Homo sapiens
accaggagcucauuugauu

SEQ ID NO: 1156358 - RNA, 19 nt, Homo sapiens
ggacaccagcaucaucuuu

SEQ ID NO: 1156359 - RNA, 19 nt, Homo sapiens
gcaauuugacugugcuuga

SEQ ID NO: 1156360 - RNA, 19 nt, Homo sapiens
gaaggaugguuuggaagau

SEQ ID NO: 1156361 - RNA, 19 nt, Homo sapiens
gucaaagccuguggauuaa

SEQ ID NO: 1156362 - RNA, 19 nt, Homo sapiens
ugaagaguuucuccucauu

SEQ ID NO: 1156363 - RNA, 19 nt, Homo sapiens
ucacacaccuuguucaacu

SEQ ID NO: 1156364 - RNA, 19 nt, Homo sapiens
ccacaaauuuagaaacucu

SEQ ID NO: 1156365 - RNA, 19 nt, Homo sapiens
uagaacagccuugcaaauu

SEQ ID NO: 1156366 - RNA, 19 nt, Homo sapiens
aaacuucauugacuugaug

SEQ ID NO: 1156367 - RNA, 19 nt, Homo sapiens
gacaaugggucaacagcau

SEQ ID NO: 1156368 - RNA, 19 nt, Homo sapiens
gggacagcgugaaaggaua

SEQ ID NO: 1156369 - RNA, 19 nt, Homo sapiens
uaggaacgaaugcaucuua

SEQ ID NO: 1156370 - RNA, 19 nt, Homo sapiens
caacauguaacaaacucua

SEQ ID NO: 1156371 - RNA, 19 nt, Homo sapiens
ccacuuugaccauggauuu

SEQ ID NO: 1156372 - RNA, 19 nt, Homo sapiens
acacuugccaccugcauua

SEQ ID NO: 1156373 - RNA, 19 nt, Homo sapiens
gaccugcugugaagauuuc

SEQ ID NO: 1156374 - RNA, 19 nt, Homo sapiens
ggacaacacuggaaaaggu

SEQ ID NO: 1156375 - RNA, 19 nt, Homo sapiens
ugaccaauaagaccaauuu

SEQ ID NO: 1156376 - RNA, 19 nt, Homo sapiens
gcuauauuauuggcuguuu

SEQ ID NO: 1156377 - RNA, 19 nt, Homo sapiens
gaagaguuucuccucauug

SEQ ID NO: 1156378 - RNA, 19 nt, Homo sapiens
ccauggauuucccaaagaa

SEQ ID NO: 1156379 - RNA, 19 nt, Homo sapiens
ccacauacaagacacauuc

SEQ ID NO: 1156380 - RNA, 19 nt, Homo sapiens
agacaaguuuggauggaaa

SEQ ID NO: 1156381 - RNA, 19 nt, Homo sapiens
ccaauaagaccaauuucug

SEQ ID NO: 1156382 - RNA, 19 nt, Homo sapiens
gagcucauuugauucauac

SEQ ID NO: 1156383 - RNA, 19 nt, Homo sapiens
gugaagauuucuccuccaa

SEQ ID NO: 1156384 - RNA, 19 nt, Homo sapiens
gugaaaggauaugagauug

SEQ ID NO: 1156385 - RNA, 19 nt, Homo sapiens
ccuauuaccuuugcuaagu

SEQ ID NO: 1156386 - RNA, 19 nt, Homo sapiens
uagaaacucuccuaguagu

SEQ ID NO: 1156387 - RNA, 19 nt, Homo sapiens
gaugagaacacuugccaau

SEQ ID NO: 1156388 - RNA, 19 nt, Homo sapiens
gaacuucgucacagccuau

SEQ ID NO: 1156389 - RNA, 19 nt, Homo sapiens
cuaguaaguuggguagaaa

SEQ ID NO: 1156390 - RNA, 19 nt, Homo sapiens
caaagccuguggauuaaac

SEQ ID NO: 1156391 - RNA, 19 nt, Homo sapiens
gaguuucuccucauuguga

SEQ ID NO: 1156392 - RNA, 19 nt, Homo sapiens
cacuggcucuuaucuguaa

SEQ ID NO: 1156393 - RNA, 19 nt, Homo sapiens
uucaugagcccacaaauuu

SEQ ID NO: 1156394 - RNA, 19 nt, Homo sapiens
gugaacaaaugcuguaguc

SEQ ID NO: 1156395 - RNA, 19 nt, Homo sapiens
ugacaacccucccaagacu

SEQ ID NO: 1156396 - RNA, 19 nt, Homo sapiens
uuauauggcucauccaaca

SEQ ID NO: 1156397 - RNA, 19 nt, Homo sapiens
ugaagugaacugaaacauu

SEQ ID NO: 1156398 - RNA, 19 nt, Homo sapiens
acuagaguuugaccaauaa

SEQ ID NO: 1156399 - RNA, 19 nt, Homo sapiens
ggacagcgugaaaggauau

SEQ ID NO: 1156400 - RNA, 19 nt, Homo sapiens
gaggagacggagcaaauga

SEQ ID NO: 1156401 - RNA, 19 nt, Homo sapiens
aagaaucucugcugaaggu

SEQ ID NO: 1156402 - RNA, 19 nt, Homo sapiens
caacgaagcucuggaagaa

SEQ ID NO: 1156403 - RNA, 19 nt, Homo sapiens
guccuaagcuucaucuuua

SEQ ID NO: 1156404 - RNA, 19 nt, Homo sapiens
caaggaagcuggugcaguu

SEQ ID NO: 1156405 - RNA, 19 nt, Homo sapiens
gcacacaccuacauucugu

SEQ ID NO: 1156406 - RNA, 19 nt, Homo sapiens
gaagaauacugauguuuac

SEQ ID NO: 1156407 - RNA, 19 nt, Homo sapiens
guaaaccaguggaguauga

SEQ ID NO: 1156408 - RNA, 19 nt, Homo sapiens
gaagggagauggaagaaac

SEQ ID NO: 1156409 - RNA, 19 nt, Homo sapiens
ggaagaaacugaggagauc

SEQ ID NO: 1156410 - RNA, 19 nt, Homo sapiens
gaaaugcgggaauauauug

SEQ ID NO: 1156411 - RNA, 19 nt, Homo sapiens
ggaaaccucuaagaugaaa

SEQ ID NO: 1156412 - RNA, 19 nt, Homo sapiens
gcagaaggcccuauagaau

SEQ ID NO: 1156413 - RNA, 19 nt, Homo sapiens
ggagaaagcaugugauuac

SEQ ID NO: 1156414 - RNA, 19 nt, Homo sapiens
caaccaguuuccugagaua

SEQ ID NO: 1156415 - RNA, 19 nt, Homo sapiens
gaugaaagccuugcgauau

SEQ ID NO: 1156416 - RNA, 19 nt, Homo sapiens
ggacagaacuagugguacu

SEQ ID NO: 1156417 - RNA, 19 nt, Homo sapiens
ggaagcuggugcaguuauu

SEQ ID NO: 1156418 - RNA, 19 nt, Homo sapiens
gaagcuccgugcugccuaa

SEQ ID NO: 1156419 - RNA, 19 nt, Homo sapiens
gaaaggaauucuguacuac

SEQ ID NO: 1156420 - RNA, 19 nt, Homo sapiens
ccucaguucucauguauug

SEQ ID NO: 1156421 - RNA, 19 nt, Homo sapiens
gagccucaguucucaugua

SEQ ID NO: 1156422 - RNA, 19 nt, Homo sapiens
caacuaagcugccuauacc

SEQ ID NO: 1156423 - RNA, 19 nt, Homo sapiens
gcgggaauauauuguuaaa

SEQ ID NO: 1156424 - RNA, 19 nt, Homo sapiens
ccaaggaggcugagauuug

SEQ ID NO: 1156425 - RNA, 19 nt, Homo sapiens
gauauaggcuuuuccuuga

SEQ ID NO: 1156426 - RNA, 19 nt, Homo sapiens
guucacaacuucagguaga

SEQ ID NO: 1156427 - RNA, 19 nt, Homo sapiens
gggaggcaauggaagauga

SEQ ID NO: 1156428 - RNA, 19 nt, Homo sapiens
acaccuacauucuguuaaa

SEQ ID NO: 1156429 - RNA, 19 nt, Homo sapiens
gaaaaggcacucuaaauug

SEQ ID NO: 1156430 - RNA, 19 nt, Homo sapiens
uaaaugugauugaccacuu

SEQ ID NO: 1156431 - RNA, 19 nt, Homo sapiens
auacugauguuuaccugua

SEQ ID NO: 1156432 - RNA, 19 nt, Homo sapiens
uuggaaaccucuaagauga

SEQ ID NO: 1156433 - RNA, 19 nt, Homo sapiens
cagaaggcccuauagaauu

SEQ ID NO: 1156434 - RNA, 19 nt, Homo sapiens
agaaggcccuauagaauuc

SEQ ID NO: 1156435 - RNA, 19 nt, Homo sapiens
gcacauuguuuagcucuag

SEQ ID NO: 1156436 - RNA, 19 nt, Homo sapiens
gcaaccaguuuccugagau

SEQ ID NO: 1156437 - RNA, 19 nt, Homo sapiens
gguccuaagcuucaucuuu

SEQ ID NO: 1156438 - RNA, 19 nt, Homo sapiens
aaacaggccuggcaacaac

SEQ ID NO: 1156439 - RNA, 19 nt, Homo sapiens
gugauccagugcaauauga

SEQ ID NO: 1156440 - RNA, 19 nt, Homo sapiens
cuagaaaccaccaagauga

SEQ ID NO: 1156441 - RNA, 19 nt, Homo sapiens
caaggaggcugagauuugg

SEQ ID NO: 1156442 - RNA, 19 nt, Homo sapiens
ggcccgagcacauuguuua

SEQ ID NO: 1156443 - RNA, 19 nt, Homo sapiens
guacagggaggcaauggaa

SEQ ID NO: 1156444 - RNA, 19 nt, Homo sapiens
ugacagugauccagugcaa

SEQ ID NO: 1156445 - RNA, 19 nt, Homo sapiens
gaacuagugguacuugauc

SEQ ID NO: 1156446 - RNA, 19 nt, Homo sapiens
auucagagguuuccagcua

SEQ ID NO: 1156447 - RNA, 19 nt, Homo sapiens
uggauuggccagagaaaua

SEQ ID NO: 1156448 - RNA, 19 nt, Homo sapiens
ugaaggaucagagcaagua

SEQ ID NO: 1156449 - RNA, 19 nt, Homo sapiens
gcacuuccguacugccaau

SEQ ID NO: 1156450 - RNA, 19 nt, Homo sapiens
guauuuguguuccaguuau

SEQ ID NO: 1156451 - RNA, 19 nt, Homo sapiens
acagugauccagugcaaua

SEQ ID NO: 1156452 - RNA, 19 nt, Homo sapiens
gggagaaagcaugugauua

SEQ ID NO: 1156453 - RNA, 19 nt, Homo sapiens
gaauaucgcaaccaguuuc

SEQ ID NO: 1156454 - RNA, 19 nt, Homo sapiens
gugauuaccugcagauacu

SEQ ID NO: 1156455 - RNA, 19 nt, Homo sapiens
acgaagcucuggaagaaga

SEQ ID NO: 1156456 - RNA, 19 nt, Homo sapiens
gauucuaggccaaauauuc

SEQ ID NO: 1156457 - RNA, 19 nt, Homo sapiens
gguauuuguguuccaguua

SEQ ID NO: 1156458 - RNA, 19 nt, Homo sapiens
gcaauaugaguuuguaugg

SEQ ID NO: 1156459 - RNA, 19 nt, Homo sapiens
ugaaaugcgggaauauauu

SEQ ID NO: 1156460 - RNA, 19 nt, Homo sapiens
caacuccauuaguauuaug

SEQ ID NO: 1156461 - RNA, 19 nt, Homo sapiens
ccaacuccauuaguauuau

SEQ ID NO: 1156462 - RNA, 19 nt, Homo sapiens
gaagaugaggccaauagag

SEQ ID NO: 1156463 - RNA, 19 nt, Homo sapiens
gaagcuggugcaguuauuu

SEQ ID NO: 1156464 - RNA, 19 nt, Homo sapiens
ucagagguuuccagcuauu

SEQ ID NO: 1156465 - RNA, 19 nt, Homo sapiens
cccaagaucccaccuagaa

SEQ ID NO: 1156466 - RNA, 19 nt, Homo sapiens
gggaaaugcucuggaggau

SEQ ID NO: 1156467 - RNA, 19 nt, Homo sapiens
acacaccuacauucuguua

SEQ ID NO: 1156468 - RNA, 19 nt, Homo sapiens
gacaaagcaucuccuuggu

SEQ ID NO: 1156469 - RNA, 19 nt, Homo sapiens
ggaagaugaggccaauaga

SEQ ID NO: 1156470 - RNA, 19 nt, Homo sapiens
aauuucagcuucagcaguu

SEQ ID NO: 1156471 - RNA, 19 nt, Homo sapiens
gaugauucuaggccaaaua

SEQ ID NO: 1156472 - RNA, 19 nt, Homo sapiens
aagaauaucgcaaccaguu

SEQ ID NO: 1156473 - RNA, 19 nt, Homo sapiens
agucugaaaugcgggaaua

SEQ ID NO: 1156474 - RNA, 19 nt, Homo sapiens
ugaaaaggcacucuaaauu

SEQ ID NO: 1156475 - RNA, 19 nt, Homo sapiens
ugaaagccuugcgauaugu

SEQ ID NO: 1156476 - RNA, 19 nt, Homo sapiens
ugcugucucuguuguauuu

SEQ ID NO: 1156477 - RNA, 19 nt, Homo sapiens
aaacugaggagaucguaga

SEQ ID NO: 1156478 - RNA, 19 nt, Homo sapiens
ccacauucauggccugagu

SEQ ID NO: 1156479 - RNA, 19 nt, Homo sapiens
aagaugggccuccugauga

SEQ ID NO: 1156480 - RNA, 19 nt, Homo sapiens
agucagcgcuauauagaca

SEQ ID NO: 1156481 - RNA, 19 nt, Homo sapiens
caaacaggccuggcaacaa

SEQ ID NO: 1156482 - RNA, 19 nt, Homo sapiens
ggcaggcucucccucacuu

SEQ ID NO: 1156483 - RNA, 19 nt, Homo sapiens
aaagaugggccuccugaug

SEQ ID NO: 1156484 - RNA, 19 nt, Homo sapiens
aaaaggcacucuaaauugu

SEQ ID NO: 1156485 - RNA, 19 nt, Homo sapiens
aaaugugauugaccacuug

SEQ ID NO: 1156486 - RNA, 19 nt, Homo sapiens
ugagucagcgcuauauaga

SEQ ID NO: 1156487 - RNA, 19 nt, Homo sapiens
augcgggaauauauuguua

SEQ ID NO: 1156488 - RNA, 19 nt, Homo sapiens
uguggugucuggaaauguu

SEQ ID NO: 1156489 - RNA, 19 nt, Homo sapiens
gccaauagagcugauguug

SEQ ID NO: 1156490 - RNA, 19 nt, Homo sapiens
caaaggcuacugcgcacaa

SEQ ID NO: 1156491 - RNA, 19 nt, Homo sapiens
cagaacuagugguacuuga

SEQ ID NO: 1156492 - RNA, 19 nt, Homo sapiens
caaaauaugccccacauuc

SEQ ID NO: 1156493 - RNA, 19 nt, Homo sapiens
uagaagagagcccaaaugg

SEQ ID NO: 1156494 - RNA, 19 nt, Homo sapiens
cuuguugcauuaucuagaa

SEQ ID NO: 1156495 - RNA, 19 nt, Homo sapiens
ugagggcgcaagcaccuua

SEQ ID NO: 1156496 - RNA, 19 nt, Homo sapiens
augaaagccuugcgauaug

SEQ ID NO: 1156497 - RNA, 19 nt, Homo sapiens
gguguggugucuggaaaug

SEQ ID NO: 1156498 - RNA, 19 nt, Homo sapiens
gaucguagacaguccaaac

SEQ ID NO: 1156499 - RNA, 19 nt, Homo sapiens
ggaaucacuccuauacucu

SEQ ID NO: 1156500 - RNA, 19 nt, Homo sapiens
caggcucucccucacuuua

SEQ ID NO: 1156501 - RNA, 19 nt, Homo sapiens
uagaaaccaccaagaugaa

SEQ ID NO: 1156502 - RNA, 19 nt, Homo sapiens
gaacucaccucaaagagaa

SEQ ID NO: 1156503 - RNA, 19 nt, Homo sapiens
ugagaaagcucuugaaugg

SEQ ID NO: 1156504 - RNA, 19 nt, Homo sapiens
gagaagaccuacgaaugua

SEQ ID NO: 1156505 - RNA, 19 nt, Homo sapiens
ggaagauacuccugacuug

SEQ ID NO: 1156506 - RNA, 19 nt, Homo sapiens
ggagagaaguccacugaau

SEQ ID NO: 1156507 - RNA, 19 nt, Homo sapiens
gagcaucucuguaaacaca

SEQ ID NO: 1156508 - RNA, 19 nt, Homo sapiens
gcaaagagauccaguaccu

SEQ ID NO: 1156509 - RNA, 19 nt, Homo sapiens
cgaaaccaguccauccuua

SEQ ID NO: 1156510 - RNA, 19 nt, Homo sapiens
ugaauacgcucacuuguuc

SEQ ID NO: 1156511 - RNA, 19 nt, Homo sapiens
gagagaaguccacugaaua

SEQ ID NO: 1156512 - RNA, 19 nt, Homo sapiens
ggaaaucacacuaaagaga

SEQ ID NO: 1156513 - RNA, 19 nt, Homo sapiens
ggaaacacauuaggauuca

SEQ ID NO: 1156514 - RNA, 19 nt, Homo sapiens
ggaagaagaauguuugaug

SEQ ID NO: 1156515 - RNA, 19 nt, Homo sapiens
ucugugagcucgcaccuua

SEQ ID NO: 1156516 - RNA, 19 nt, Homo sapiens
caauagugguucccucuuu

SEQ ID NO: 1156517 - RNA, 19 nt, Homo sapiens
ggagaagaccuacgaaugu

SEQ ID NO: 1156518 - RNA, 19 nt, Homo sapiens
gaaaauuuguggccaauga

SEQ ID NO: 1156519 - RNA, 19 nt, Homo sapiens
ugacggaaaucacacuaaa

SEQ ID NO: 1156520 - RNA, 19 nt, Homo sapiens
gaaguccaguuccuguaaa

SEQ ID NO: 1156521 - RNA, 19 nt, Homo sapiens
cgcaagaacucaccucaaa

SEQ ID NO: 1156522 - RNA, 19 nt, Homo sapiens
ggauucacaucgucaagaa

SEQ ID NO: 1156523 - RNA, 19 nt, Homo sapiens
ggaagugacugcagaaagc

SEQ ID NO: 1156524 - RNA, 19 nt, Homo sapiens
ugacagauacuucuaguga

SEQ ID NO: 1156525 - RNA, 19 nt, Homo sapiens
gacuggaccucccguauga

SEQ ID NO: 1156526 - RNA, 19 nt, Homo sapiens
guaauaagaagacaucaga

SEQ ID NO: 1156527 - RNA, 19 nt, Homo sapiens
acauucagcucuuaacaaa

SEQ ID NO: 1156528 - RNA, 19 nt, Homo sapiens
ggucagcggcgaauucuuu

SEQ ID NO: 1156529 - RNA, 19 nt, Homo sapiens
cgagaggccuuacaagugu

SEQ ID NO: 1156530 - RNA, 19 nt, Homo sapiens
uaacgaccgugcauaugaa

SEQ ID NO: 1156531 - RNA, 19 nt, Homo sapiens
ggauugcacuuacucuuuc

SEQ ID NO: 1156532 - RNA, 19 nt, Homo sapiens
gaacguggaaggucaugaa

SEQ ID NO: 1156533 - RNA, 19 nt, Homo sapiens
gaaaccaguccauccuuaa

SEQ ID NO: 1156534 - RNA, 19 nt, Homo sapiens
ucaaagagcacgugaggaa

SEQ ID NO: 1156535 - RNA, 19 nt, Homo sapiens
gggagaagcccuacgaaug

SEQ ID NO: 1156536 - RNA, 19 nt, Homo sapiens
gguuauacuccucuaaaua

SEQ ID NO: 1156537 - RNA, 19 nt, Homo sapiens
caagaacucaccucaaaga

SEQ ID NO: 1156538 - RNA, 19 nt, Homo sapiens
ggaucguucuuaaacauga

SEQ ID NO: 1156539 - RNA, 19 nt, Homo sapiens
aauagugguucccucuuua

SEQ ID NO: 1156540 - RNA, 19 nt, Homo sapiens
gagagaaaucagugaagua

SEQ ID NO: 1156541 - RNA, 19 nt, Homo sapiens
gcguucaccuuguaaagaa

SEQ ID NO: 1156542 - RNA, 19 nt, Homo sapiens
caugagcguucaccuugua

SEQ ID NO: 1156543 - RNA, 19 nt, Homo sapiens
gaagaccuacgaauguaaa

SEQ ID NO: 1156544 - RNA, 19 nt, Homo sapiens
gcacuuacgcuaggagaaa

SEQ ID NO: 1156545 - RNA, 19 nt, Homo sapiens
cauaggagguuugugagaa

SEQ ID NO: 1156546 - RNA, 19 nt, Homo sapiens
caagaaacccguggaaugu

SEQ ID NO: 1156547 - RNA, 19 nt, Homo sapiens
gguauccacucucaucuuc

SEQ ID NO: 1156548 - RNA, 19 nt, Homo sapiens
caagagagacgcuacgaau

SEQ ID NO: 1156549 - RNA, 19 nt, Homo sapiens
gaauacgggauugcacuua

SEQ ID NO: 1156550 - RNA, 19 nt, Homo sapiens
cuagggagcaucucuguaa

SEQ ID NO: 1156551 - RNA, 19 nt, Homo sapiens
ggagaaaccguacgaaugc

SEQ ID NO: 1156552 - RNA, 19 nt, Homo sapiens
gggagaaaccguacgaaug

SEQ ID NO: 1156553 - RNA, 19 nt, Homo sapiens
gcaccucacucagcacaug

SEQ ID NO: 1156554 - RNA, 19 nt, Homo sapiens
ccaaugaagucuggaauac

SEQ ID NO: 1156555 - RNA, 19 nt, Homo sapiens
ucaagaaacccguggaaug

SEQ ID NO: 1156556 - RNA, 19 nt, Homo sapiens
agacuucuaucacaugaga

SEQ ID NO: 1156557 - RNA, 19 nt, Homo sapiens
gaauggggaucguucuuaa

SEQ ID NO: 1156558 - RNA, 19 nt, Homo sapiens
gggauugcacuuacucuuu

SEQ ID NO: 1156559 - RNA, 19 nt, Homo sapiens
gaggcguucucaucccaua

SEQ ID NO: 1156560 - RNA, 19 nt, Homo sapiens
gcacaugagcguucaccuu

SEQ ID NO: 1156561 - RNA, 19 nt, Homo sapiens
agagaaaacuguacaaaga

SEQ ID NO: 1156562 - RNA, 19 nt, Homo sapiens
cuugauaacguccuaauuu

SEQ ID NO: 1156563 - RNA, 19 nt, Homo sapiens
ccuuaagccucaucaagaa

SEQ ID NO: 1156564 - RNA, 19 nt, Homo sapiens
uaaggaagaagaauguuug

SEQ ID NO: 1156565 - RNA, 19 nt, Homo sapiens
ggaggaaacacauuaggau

SEQ ID NO: 1156566 - RNA, 19 nt, Homo sapiens
ccagggcgcuugugcagau

SEQ ID NO: 1156567 - RNA, 19 nt, Homo sapiens
gauccaguaccuaguauug

SEQ ID NO: 1156568 - RNA, 19 nt, Homo sapiens
caucaagaaagguuuguuu

SEQ ID NO: 1156569 - RNA, 19 nt, Homo sapiens
ugcagucauuccucaauua

SEQ ID NO: 1156570 - RNA, 19 nt, Homo sapiens
gggagcaucucuguaaaca

SEQ ID NO: 1156571 - RNA, 19 nt, Homo sapiens
guacgaaugcgaucacugu

SEQ ID NO: 1156572 - RNA, 19 nt, Homo sapiens
gaggaaacacauuaggauu

SEQ ID NO: 1156573 - RNA, 19 nt, Homo sapiens
gcgagaggccuuacaagug

SEQ ID NO: 1156574 - RNA, 19 nt, Homo sapiens
gaguggcccuugcuggauu

SEQ ID NO: 1156575 - RNA, 19 nt, Homo sapiens
gagauccaguaccuaguau

SEQ ID NO: 1156576 - RNA, 19 nt, Homo sapiens
agaaaucagugaaguaagg

SEQ ID NO: 1156577 - RNA, 19 nt, Homo sapiens
ccacggaacuugggagaag

SEQ ID NO: 1156578 - RNA, 19 nt, Homo sapiens
ggagaagcccuacgaaugc

SEQ ID NO: 1156579 - RNA, 19 nt, Homo sapiens
gcaagagaguagcuuucug

SEQ ID NO: 1156580 - RNA, 19 nt, Homo sapiens
ccagacuucuaucacauga

SEQ ID NO: 1156581 - RNA, 19 nt, Homo sapiens
gugguucccucuuuaagga

SEQ ID NO: 1156582 - RNA, 19 nt, Homo sapiens
ggugugcuaaucuaaauuu

SEQ ID NO: 1156583 - RNA, 19 nt, Homo sapiens
cagccaagagugacagaua

SEQ ID NO: 1156584 - RNA, 19 nt, Homo sapiens
gggaagauacuccugacuu

SEQ ID NO: 1156585 - RNA, 19 nt, Homo sapiens
agagaaaucagugaaguaa

SEQ ID NO: 1156586 - RNA, 19 nt, Homo sapiens
guaauaaugagcacacuag

SEQ ID NO: 1156587 - RNA, 19 nt, Homo sapiens
gagaagcucuuugugucau

SEQ ID NO: 1156588 - RNA, 19 nt, Homo sapiens
agacucacaugaacucuca

SEQ ID NO: 1156589 - RNA, 19 nt, Homo sapiens
gaccuacgaauguaaagaa

SEQ ID NO: 1156590 - RNA, 19 nt, Homo sapiens
caaacugacugccauucuc

SEQ ID NO: 1156591 - RNA, 19 nt, Homo sapiens
cuaauuuccuucuggacaa

SEQ ID NO: 1156592 - RNA, 19 nt, Homo sapiens
gauccuauucccagucgua

SEQ ID NO: 1156593 - RNA, 19 nt, Homo sapiens
gccaaugaagucuggaaua

SEQ ID NO: 1156594 - RNA, 19 nt, Homo sapiens
gagaaguccaguuccugua

SEQ ID NO: 1156595 - RNA, 19 nt, Homo sapiens
ggaaauccuuuggcgaucu

SEQ ID NO: 1156596 - RNA, 19 nt, Homo sapiens
agaugucgcuguggacuuu

SEQ ID NO: 1156597 - RNA, 19 nt, Homo sapiens
ugaaucuugugagcacuua

SEQ ID NO: 1156598 - RNA, 19 nt, Homo sapiens
cguggaaggucaugaaugg

SEQ ID NO: 1156599 - RNA, 19 nt, Homo sapiens
ggaagauacacacgcaaga

SEQ ID NO: 1156600 - RNA, 19 nt, Homo sapiens
gagccggucuuggagagaa

SEQ ID NO: 1156601 - RNA, 19 nt, Homo sapiens
gacucagaauuuccuguuu

SEQ ID NO: 1156602 - RNA, 19 nt, Homo sapiens
ucacugcuguucuauauua

SEQ ID NO: 1156603 - RNA, 19 nt, Homo sapiens
ggauaauacugcuauauga

SEQ ID NO: 1156604 - RNA, 19 nt, Homo sapiens
uaaguaagcuguuuagcaa

SEQ ID NO: 1156605 - RNA, 19 nt, Homo sapiens
ccagaagccugacauguuu

SEQ ID NO: 1156606 - RNA, 19 nt, Homo sapiens
ggcaagggcuguagacauu

SEQ ID NO: 1156607 - RNA, 19 nt, Homo sapiens
gagaugauggauagaauua

SEQ ID NO: 1156608 - RNA, 19 nt, Homo sapiens
gcauaccacucaucaaaug

SEQ ID NO: 1156609 - RNA, 19 nt, Homo sapiens
gcaagcaguugaagagaug

SEQ ID NO: 1156610 - RNA, 19 nt, Homo sapiens
ugacaaugauucaguaaug

SEQ ID NO: 1156611 - RNA, 19 nt, Homo sapiens
agacugagauaaacugaaa

SEQ ID NO: 1156612 - RNA, 19 nt, Homo sapiens
gaagaagucacagaucuaa

SEQ ID NO: 1156613 - RNA, 19 nt, Homo sapiens
cuaccacagugaauaaaua

SEQ ID NO: 1156614 - RNA, 19 nt, Homo sapiens
gcagauagcaguaguccaa

SEQ ID NO: 1156615 - RNA, 19 nt, Homo sapiens
cgaauucuguuaugcugua

SEQ ID NO: 1156616 - RNA, 19 nt, Homo sapiens
gaaagugaaagguuuaguu

SEQ ID NO: 1156617 - RNA, 19 nt, Homo sapiens
caaauggaaugcugaaagu

SEQ ID NO: 1156618 - RNA, 19 nt, Homo sapiens
gcacaugauuaguguuguu

SEQ ID NO: 1156619 - RNA, 19 nt, Homo sapiens
guccaaaccuugaauuuua

SEQ ID NO: 1156620 - RNA, 19 nt, Homo sapiens
gcacaaguaccauauuuua

SEQ ID NO: 1156621 - RNA, 19 nt, Homo sapiens
aaacacacauuccuaguag

SEQ ID NO: 1156622 - RNA, 19 nt, Homo sapiens
caaauccacuaguucaaga

SEQ ID NO: 1156623 - RNA, 19 nt, Homo sapiens
gaaaugugcauaccacuca

SEQ ID NO: 1156624 - RNA, 19 nt, Homo sapiens
agaaacaacugaagaaguc

SEQ ID NO: 1156625 - RNA, 19 nt, Homo sapiens
auacagaacugaggugaaa

SEQ ID NO: 1156626 - RNA, 19 nt, Homo sapiens
gagauaaacugaaaacuca

SEQ ID NO: 1156627 - RNA, 19 nt, Homo sapiens
caaagaagacagcauugaa

SEQ ID NO: 1156628 - RNA, 19 nt, Homo sapiens
gaagagaugauggauagaa

SEQ ID NO: 1156629 - RNA, 19 nt, Homo sapiens
cgaaacgaauucuguuaug

SEQ ID NO: 1156630 - RNA, 19 nt, Homo sapiens
gaaauuaagcaguaguuag

SEQ ID NO: 1156631 - RNA, 19 nt, Homo sapiens
aaacaaagaagacagcauu

SEQ ID NO: 1156632 - RNA, 19 nt, Homo sapiens
aaagggaguucaucuuaga

SEQ ID NO: 1156633 - RNA, 19 nt, Homo sapiens
gcaccaauaguuucccaua

SEQ ID NO: 1156634 - RNA, 19 nt, Homo sapiens
aaaggcaacucaaccagaa

SEQ ID NO: 1156635 - RNA, 19 nt, Homo sapiens
uaacaaauccacuaguuca

SEQ ID NO: 1156636 - RNA, 19 nt, Homo sapiens
uugaggugcuuguauauaa

SEQ ID NO: 1156637 - RNA, 19 nt, Homo sapiens
ccaaauccaugccaguguu

SEQ ID NO: 1156638 - RNA, 19 nt, Homo sapiens
uaucagaguucuuauguac

SEQ ID NO: 1156639 - RNA, 19 nt, Homo sapiens
ucaauaagcacaugauuag

SEQ ID NO: 1156640 - RNA, 19 nt, Homo sapiens
ucacuuuacucauggagaa

SEQ ID NO: 1156641 - RNA, 19 nt, Homo sapiens
guaaguucguuaugcuuga

SEQ ID NO: 1156642 - RNA, 19 nt, Homo sapiens
gcuuguauauaaucggaua

SEQ ID NO: 1156643 - RNA, 19 nt, Homo sapiens
agacaaagccagaaucuuc

SEQ ID NO: 1156644 - RNA, 19 nt, Homo sapiens
uuacacagguuuguuguug

SEQ ID NO: 1156645 - RNA, 19 nt, Homo sapiens
uggcacaaguaccauauuu

SEQ ID NO: 1156646 - RNA, 19 nt, Homo sapiens
ggaaauuguuggguacugu

SEQ ID NO: 1156647 - RNA, 19 nt, Homo sapiens
gugcauaccacucaucaaa

SEQ ID NO: 1156648 - RNA, 19 nt, Homo sapiens
caccaauaguuucccauaa

SEQ ID NO: 1156649 - RNA, 19 nt, Homo sapiens
gaaacgaauucuguuaugc

SEQ ID NO: 1156650 - RNA, 19 nt, Homo sapiens
guuccaagguuacguuuca

SEQ ID NO: 1156651 - RNA, 19 nt, Homo sapiens
cucaggagcuggcaucaaa

SEQ ID NO: 1156652 - RNA, 19 nt, Homo sapiens
cauguucucccaauaauga

SEQ ID NO: 1156653 - RNA, 19 nt, Homo sapiens
guaaguagcaacuauaaac

SEQ ID NO: 1156654 - RNA, 19 nt, Homo sapiens
uugaagagaugauggauag

SEQ ID NO: 1156655 - RNA, 19 nt, Homo sapiens
aaagaagacagcauugaaa

SEQ ID NO: 1156656 - RNA, 19 nt, Homo sapiens
cuuaacaaauccacuaguu

SEQ ID NO: 1156657 - RNA, 19 nt, Homo sapiens
ccacagugaauaaauagaa

SEQ ID NO: 1156658 - RNA, 19 nt, Homo sapiens
caugugcucugugcuauga

SEQ ID NO: 1156659 - RNA, 19 nt, Homo sapiens
gcagcagcauggaaauugu

SEQ ID NO: 1156660 - RNA, 19 nt, Homo sapiens
gaagacaaagccagaaucu

SEQ ID NO: 1156661 - RNA, 19 nt, Homo sapiens
accaauaguuucccauaaa

SEQ ID NO: 1156662 - RNA, 19 nt, Homo sapiens
gaacucuccucaccacaac

SEQ ID NO: 1156663 - RNA, 19 nt, Homo sapiens
cuucacugcuguucuauau

SEQ ID NO: 1156664 - RNA, 19 nt, Homo sapiens
acuacagacugcauuaauu

SEQ ID NO: 1156665 - RNA, 19 nt, Homo sapiens
acacagguuuguuguuguu

SEQ ID NO: 1156666 - RNA, 19 nt, Homo sapiens
gcucugugcuaugaguuaa

SEQ ID NO: 1156667 - RNA, 19 nt, Homo sapiens
gaagucacagaucuaaaga

SEQ ID NO: 1156668 - RNA, 19 nt, Homo sapiens
gcugauccauaaaccagaa

SEQ ID NO: 1156669 - RNA, 19 nt, Homo sapiens
ccauagucaguguuaauua

SEQ ID NO: 1156670 - RNA, 19 nt, Homo sapiens
guucuuauguacaguaugg

SEQ ID NO: 1156671 - RNA, 19 nt, Homo sapiens
gauccuguuucuacacaug

SEQ ID NO: 1156672 - RNA, 19 nt, Homo sapiens
cgaaccaguuguaguuuua

SEQ ID NO: 1156673 - RNA, 19 nt, Homo sapiens
gcagaagcagauagcagua

SEQ ID NO: 1156674 - RNA, 19 nt, Homo sapiens
gguaaaccaugugcucugu

SEQ ID NO: 1156675 - RNA, 19 nt, Homo sapiens
cauagucaguguuaauuac

SEQ ID NO: 1156676 - RNA, 19 nt, Homo sapiens
uccaacugcugauccauaa

SEQ ID NO: 1156677 - RNA, 19 nt, Homo sapiens
ggaggaugaaggcgaaauu

SEQ ID NO: 1156678 - RNA, 19 nt, Homo sapiens
uaguccaacugggauauua

SEQ ID NO: 1156679 - RNA, 19 nt, Homo sapiens
ugcaguaguuguauuguau

SEQ ID NO: 1156680 - RNA, 19 nt, Homo sapiens
uaagugacaagcacacauu

SEQ ID NO: 1156681 - RNA, 19 nt, Homo sapiens
gaaaguccaaaccuugaau

SEQ ID NO: 1156682 - RNA, 19 nt, Homo sapiens
aaacugaucaacccaaugu

SEQ ID NO: 1156683 - RNA, 19 nt, Homo sapiens
uaaagaggcaagcaguuga

SEQ ID NO: 1156684 - RNA, 19 nt, Homo sapiens
aguuugaggugcuuguaua

SEQ ID NO: 1156685 - RNA, 19 nt, Homo sapiens
ccuaguuacuguauuaagu

SEQ ID NO: 1156686 - RNA, 19 nt, Homo sapiens
ugcacaaguuccaagguua

SEQ ID NO: 1156687 - RNA, 19 nt, Homo sapiens
gguucuguauccaguguaa

SEQ ID NO: 1156688 - RNA, 19 nt, Homo sapiens
ucgaaaggcugcgaaagug

SEQ ID NO: 1156689 - RNA, 19 nt, Homo sapiens
ggcaagcaguugaagagau

SEQ ID NO: 1156690 - RNA, 19 nt, Homo sapiens
ucguuaugcuugacuguuu

SEQ ID NO: 1156691 - RNA, 19 nt, Homo sapiens
gugguaauguacuugaaug

SEQ ID NO: 1156692 - RNA, 19 nt, Homo sapiens
caacugaagaagucacaga

SEQ ID NO: 1156693 - RNA, 19 nt, Homo sapiens
gaauacagguucuuuucug

SEQ ID NO: 1156694 - RNA, 19 nt, Homo sapiens
aaacaagccgaaccaguug

SEQ ID NO: 1156695 - RNA, 19 nt, Homo sapiens
ccaauaguuucccauaaaa

SEQ ID NO: 1156696 - RNA, 19 nt, Homo sapiens
cuacagacugcauuaauuc

SEQ ID NO: 1156697 - RNA, 19 nt, Homo sapiens
cuuccuaaauuuggagaua

SEQ ID NO: 1156698 - RNA, 19 nt, Homo sapiens
gacaaugauucaguaaugg

SEQ ID NO: 1156699 - RNA, 19 nt, Homo sapiens
ugaagaagucacagaucua

SEQ ID NO: 1156700 - RNA, 19 nt, Homo sapiens
ucaaacucguagucccaua

SEQ ID NO: 1156701 - RNA, 19 nt, Homo sapiens
acacuuaacaaauccacua

SEQ ID NO: 1156702 - RNA, 19 nt, Homo sapiens
gcaaguucauuguggauua

SEQ ID NO: 1156703 - RNA, 19 nt, Homo sapiens
ccaacaagcuggacaagaa

SEQ ID NO: 1156704 - RNA, 19 nt, Homo sapiens
gcgcagggauugacuaauu

SEQ ID NO: 1156705 - RNA, 19 nt, Homo sapiens
gaauuugccuuaaacugaa

SEQ ID NO: 1156706 - RNA, 19 nt, Homo sapiens
ggaauuugccuuaaacuga

SEQ ID NO: 1156707 - RNA, 19 nt, Homo sapiens
caacugguguccuacauga

SEQ ID NO: 1156708 - RNA, 19 nt, Homo sapiens
caacaucuaugagguggua

SEQ ID NO: 1156709 - RNA, 19 nt, Homo sapiens
gaagaccccuccucaauuu

SEQ ID NO: 1156710 - RNA, 19 nt, Homo sapiens
ccaggaagguguaaacaau

SEQ ID NO: 1156711 - RNA, 19 nt, Homo sapiens
gcaccgaagucaucgacaa

SEQ ID NO: 1156712 - RNA, 19 nt, Homo sapiens
caagaggguugaccagaug

SEQ ID NO: 1156713 - RNA, 19 nt, Homo sapiens
ccacaucccugcacuacau

SEQ ID NO: 1156714 - RNA, 19 nt, Homo sapiens
caacuucacuguggccauu

SEQ ID NO: 1156715 - RNA, 19 nt, Homo sapiens
uauacgacguugacucuaa

SEQ ID NO: 1156716 - RNA, 19 nt, Homo sapiens
gccuuaaacugaaguaaau

SEQ ID NO: 1156717 - RNA, 19 nt, Homo sapiens
ggaaccuccuggacaaaga

SEQ ID NO: 1156718 - RNA, 19 nt, Homo sapiens
ggacccagcccuucucuuc

SEQ ID NO: 1156719 - RNA, 19 nt, Homo sapiens
gagagaucauccagcacua

SEQ ID NO: 1156720 - RNA, 19 nt, Homo sapiens
uaacagaugugacccuacu

SEQ ID NO: 1156721 - RNA, 19 nt, Homo sapiens
aggaagguguaaacaauaa

SEQ ID NO: 1156722 - RNA, 19 nt, Homo sapiens
gaagaacacccuaaaucca

SEQ ID NO: 1156723 - RNA, 19 nt, Homo sapiens
gggcagagccaauucaaca

SEQ ID NO: 1156724 - RNA, 19 nt, Homo sapiens
gcaguucugugccaacaag

SEQ ID NO: 1156725 - RNA, 19 nt, Homo sapiens
gcaccuuccuugacuacau

SEQ ID NO: 1156726 - RNA, 19 nt, Homo sapiens
ggaaaagccccucacgaua

SEQ ID NO: 1156727 - RNA, 19 nt, Homo sapiens
gaugcaaguucuagacaca

SEQ ID NO: 1156728 - RNA, 19 nt, Homo sapiens
ccuauuugcuuaccuguca

SEQ ID NO: 1156729 - RNA, 19 nt, Homo sapiens
ccaucaagguggaggugua

SEQ ID NO: 1156730 - RNA, 19 nt, Homo sapiens
gcccaaacccagggaguua

SEQ ID NO: 1156731 - RNA, 19 nt, Homo sapiens
ccacugugcgucauguaua

SEQ ID NO: 1156732 - RNA, 19 nt, Homo sapiens
gcugauggguuugcaggaa

SEQ ID NO: 1156733 - RNA, 19 nt, Homo sapiens
caacaagcuggacaagaaa

SEQ ID NO: 1156734 - RNA, 19 nt, Homo sapiens
gaccguaggccaugugaug

SEQ ID NO: 1156735 - RNA, 19 nt, Homo sapiens
cuacgacagugacaagaug

SEQ ID NO: 1156736 - RNA, 19 nt, Homo sapiens
gaggagcucagcaacugua

SEQ ID NO: 1156737 - RNA, 19 nt, Homo sapiens
gaaccuccguuuugaucua

SEQ ID NO: 1156738 - RNA, 19 nt, Homo sapiens
agagaucccugaccaacug

SEQ ID NO: 1156739 - RNA, 19 nt, Homo sapiens
gagacgugcuggcagagau

SEQ ID NO: 1156740 - RNA, 19 nt, Homo sapiens
ucacuguggccauugauuu

SEQ ID NO: 1156741 - RNA, 19 nt, Homo sapiens
gggaguucaccaccaguua

SEQ ID NO: 1156742 - RNA, 19 nt, Homo sapiens
ggacggcagccaugacuuc

SEQ ID NO: 1156743 - RNA, 19 nt, Homo sapiens
uggcaaacuuucuccauuc

SEQ ID NO: 1156744 - RNA, 19 nt, Homo sapiens
gaaaagccccucacgauag

SEQ ID NO: 1156745 - RNA, 19 nt, Homo sapiens
uaagaguccugauuuaucc

SEQ ID NO: 1156746 - RNA, 19 nt, Homo sapiens
acaagaggguugaccagau

SEQ ID NO: 1156747 - RNA, 19 nt, Homo sapiens
ccacacugcuccugcucuu

SEQ ID NO: 1156748 - RNA, 19 nt, Homo sapiens
caggaagguguaaacaaua

SEQ ID NO: 1156749 - RNA, 19 nt, Homo sapiens
ggagaggccaggugaaugg

SEQ ID NO: 1156750 - RNA, 19 nt, Homo sapiens
cccaagggauggagaacaa

SEQ ID NO: 1156751 - RNA, 19 nt, Homo sapiens
cgcagggauugacuaauuu

SEQ ID NO: 1156752 - RNA, 19 nt, Homo sapiens
cgacaucguccaguuugua

SEQ ID NO: 1156753 - RNA, 19 nt, Homo sapiens
ggagcagccugaggacaug

SEQ ID NO: 1156754 - RNA, 19 nt, Homo sapiens
gcucuaacccagccaggaa

SEQ ID NO: 1156755 - RNA, 19 nt, Homo sapiens
ccaaggaggccauugucaa

SEQ ID NO: 1156756 - RNA, 19 nt, Homo sapiens
gaaauguggcaccaucauc

SEQ ID NO: 1156757 - RNA, 19 nt, Homo sapiens
guagggaugucgccaccau

SEQ ID NO: 1156758 - RNA, 19 nt, Homo sapiens
guguggaauuugccuuaaa

SEQ ID NO: 1156759 - RNA, 19 nt, Homo sapiens
ggacccagaucaacuucac

SEQ ID NO: 1156760 - RNA, 19 nt, Homo sapiens
gcagggauugacuaauuug

SEQ ID NO: 1156761 - RNA, 19 nt, Homo sapiens
gcagagccaauucaacauc

SEQ ID NO: 1156762 - RNA, 19 nt, Homo sapiens
cacagguacuuccaugguu

SEQ ID NO: 1156763 - RNA, 19 nt, Homo sapiens
ugauuucacugccuccaau

SEQ ID NO: 1156764 - RNA, 19 nt, Homo sapiens
gcacagucacccugcuuuc

SEQ ID NO: 1156765 - RNA, 19 nt, Homo sapiens
cuaagaguccugauuuauc

SEQ ID NO: 1156766 - RNA, 19 nt, Homo sapiens
gcaugguggugguguuucu

SEQ ID NO: 1156767 - RNA, 19 nt, Homo sapiens
ucaguacgaugcaaguucu

SEQ ID NO: 1156768 - RNA, 19 nt, Homo sapiens
aggaaggccugaacaugug

SEQ ID NO: 1156769 - RNA, 19 nt, Homo sapiens
ucuauccugugcccgauuu

SEQ ID NO: 1156770 - RNA, 19 nt, Homo sapiens
caggauggcucccaguacu

SEQ ID NO: 1156771 - RNA, 19 nt, Homo sapiens
gcagagugucccacgaguu

SEQ ID NO: 1156772 - RNA, 19 nt, Homo sapiens
acaaagacauguuuuccaa

SEQ ID NO: 1156773 - RNA, 19 nt, Homo sapiens
guucugugcccgucucuga

SEQ ID NO: 1156774 - RNA, 19 nt, Homo sapiens
caaaggagggacccagauc

SEQ ID NO: 1156775 - RNA, 19 nt, Homo sapiens
cuggcaaacuuucuccauu

SEQ ID NO: 1156776 - RNA, 19 nt, Homo sapiens
guucauuguggauuacuuu

SEQ ID NO: 1156777 - RNA, 19 nt, Homo sapiens
acacugcuccugcucuuug

SEQ ID NO: 1156778 - RNA, 19 nt, Homo sapiens
uuucuuggccucacuuauu

SEQ ID NO: 1156779 - RNA, 19 nt, Homo sapiens
cagagugucccacgaguuc

SEQ ID NO: 1156780 - RNA, 19 nt, Homo sapiens
gagggacccagaucaacuu

SEQ ID NO: 1156781 - RNA, 19 nt, Homo sapiens
gagugcaccuuccuugacu

SEQ ID NO: 1156782 - RNA, 19 nt, Homo sapiens
gagccaauucaacaucuau

SEQ ID NO: 1156783 - RNA, 19 nt, Homo sapiens
ucacccacguggccaggaa

SEQ ID NO: 1156784 - RNA, 19 nt, Homo sapiens
agaagcagaaccuccguuu

SEQ ID NO: 1156785 - RNA, 19 nt, Homo sapiens
gccaauucaacaucuauga

SEQ ID NO: 1156786 - RNA, 19 nt, Homo sapiens
caaacauacccuaguccuu

SEQ ID NO: 1156787 - RNA, 19 nt, Homo sapiens
caucuggaggccugaguaa

SEQ ID NO: 1156788 - RNA, 19 nt, Homo sapiens
cccaauaccuggcucuaac

SEQ ID NO: 1156789 - RNA, 19 nt, Homo sapiens
ggagggacccagaucaacu

SEQ ID NO: 1156790 - RNA, 19 nt, Homo sapiens
gaagguguaaacaauaagg

SEQ ID NO: 1156791 - RNA, 19 nt, Homo sapiens
caaguucauuguggauuac

SEQ ID NO: 1156792 - RNA, 19 nt, Homo sapiens
ggccucaguuuccaugucu

SEQ ID NO: 1156793 - RNA, 19 nt, Homo sapiens
ucggugcugcucaucauua

SEQ ID NO: 1156794 - RNA, 19 nt, Homo sapiens
ucaugaagaacacccuaaa

SEQ ID NO: 1156795 - RNA, 19 nt, Homo sapiens
ccagauggccccagguuuu

SEQ ID NO: 1156796 - RNA, 19 nt, Homo sapiens
guacgaugcaaguucuaga

SEQ ID NO: 1156797 - RNA, 19 nt, Homo sapiens
caaggaggccauugucaac

SEQ ID NO: 1156798 - RNA, 19 nt, Homo sapiens
cagagccaauucaacaucu

SEQ ID NO: 1156799 - RNA, 19 nt, Homo sapiens
guccugauuuauccaaaca

SEQ ID NO: 1156800 - RNA, 19 nt, Homo sapiens
gaguccugauuuauccaaa

SEQ ID NO: 1156801 - RNA, 19 nt, Homo sapiens
ucuaagaguccugauuuau

SEQ ID NO: 1156802 - RNA, 19 nt, Homo sapiens
ggaauaggcuggcgagaua

SEQ ID NO: 1156803 - RNA, 19 nt, Homo sapiens
ggacgaagcucuagaugug

SEQ ID NO: 1156804 - RNA, 19 nt, Homo sapiens
ggaaggaccugaaccugaa

SEQ ID NO: 1156805 - RNA, 19 nt, Homo sapiens
caaagaggauccacaaguu

SEQ ID NO: 1156806 - RNA, 19 nt, Homo sapiens
guacaaaucugcgcuguuc

SEQ ID NO: 1156807 - RNA, 19 nt, Homo sapiens
gauggaaucugaaaugaag

SEQ ID NO: 1156808 - RNA, 19 nt, Homo sapiens
aaucugcgcuguucaauga

SEQ ID NO: 1156809 - RNA, 19 nt, Homo sapiens
ggaaagggcucgggucauc

SEQ ID NO: 1156810 - RNA, 19 nt, Homo sapiens
ugaaacaccagcucauuua

SEQ ID NO: 1156811 - RNA, 19 nt, Homo sapiens
ccaagaagccuaugagaga

SEQ ID NO: 1156812 - RNA, 19 nt, Homo sapiens
ggaaugagcccuucugucu

SEQ ID NO: 1156813 - RNA, 19 nt, Homo sapiens
gaucauguuuggagcuaaa

SEQ ID NO: 1156814 - RNA, 19 nt, Homo sapiens
acacauggguacaaauaaa

SEQ ID NO: 1156815 - RNA, 19 nt, Homo sapiens
gcucaugaguuuacagaga

SEQ ID NO: 1156816 - RNA, 19 nt, Homo sapiens
ggacagggccuauguuugg

SEQ ID NO: 1156817 - RNA, 19 nt, Homo sapiens
ccgcgucaaugcauauuua

SEQ ID NO: 1156818 - RNA, 19 nt, Homo sapiens
gguauuggaugacagauca

SEQ ID NO: 1156819 - RNA, 19 nt, Homo sapiens
cagaggagcugggcagaaa

SEQ ID NO: 1156820 - RNA, 19 nt, Homo sapiens
gcagauaagcugugccaaa

SEQ ID NO: 1156821 - RNA, 19 nt, Homo sapiens
gcagaaaggaguaggcauu

SEQ ID NO: 1156822 - RNA, 19 nt, Homo sapiens
gaaacaccagcucauuuaa

SEQ ID NO: 1156823 - RNA, 19 nt, Homo sapiens
gcuuaacccuggaauguau

SEQ ID NO: 1156824 - RNA, 19 nt, Homo sapiens
gcaacaugauaaagcauau

SEQ ID NO: 1156825 - RNA, 19 nt, Homo sapiens
gcaucugucuggcucauga

SEQ ID NO: 1156826 - RNA, 19 nt, Homo sapiens
gauaagcugugccaaagag

SEQ ID NO: 1156827 - RNA, 19 nt, Homo sapiens
cauaugauguccacuuuua

SEQ ID NO: 1156828 - RNA, 19 nt, Homo sapiens
guacuuugcuuucuaccau

SEQ ID NO: 1156829 - RNA, 19 nt, Homo sapiens
caaaggaagccauggcaaa

SEQ ID NO: 1156830 - RNA, 19 nt, Homo sapiens
ggaauggccgcuauuacaa

SEQ ID NO: 1156831 - RNA, 19 nt, Homo sapiens
agacacauggguacaaaua

SEQ ID NO: 1156832 - RNA, 19 nt, Homo sapiens
aaaugaaguuugacaagga

SEQ ID NO: 1156833 - RNA, 19 nt, Homo sapiens
gaccugaaccugaaguuug

SEQ ID NO: 1156834 - RNA, 19 nt, Homo sapiens
gaucacugccugccuggua

SEQ ID NO: 1156835 - RNA, 19 nt, Homo sapiens
gcuaacaacgucucccuaa

SEQ ID NO: 1156836 - RNA, 19 nt, Homo sapiens
ucagggaggucaguugauu

SEQ ID NO: 1156837 - RNA, 19 nt, Homo sapiens
ggacccagaugaugaacca

SEQ ID NO: 1156838 - RNA, 19 nt, Homo sapiens
gagcucagccuacaguaug

SEQ ID NO: 1156839 - RNA, 19 nt, Homo sapiens
cagauaagcugugccaaag

SEQ ID NO: 1156840 - RNA, 19 nt, Homo sapiens
guacauucauggugugaca

SEQ ID NO: 1156841 - RNA, 19 nt, Homo sapiens
aaacagggcacaggacuaa

SEQ ID NO: 1156842 - RNA, 19 nt, Homo sapiens
gggaagggcagacugugua

SEQ ID NO: 1156843 - RNA, 19 nt, Homo sapiens
gaccuaggcagcauuagaa

SEQ ID NO: 1156844 - RNA, 19 nt, Homo sapiens
uaagcaacaugauaaagca

SEQ ID NO: 1156845 - RNA, 19 nt, Homo sapiens
gagacggacugcugcaauc

SEQ ID NO: 1156846 - RNA, 19 nt, Homo sapiens
gugauggaaucugaaauga

SEQ ID NO: 1156847 - RNA, 19 nt, Homo sapiens
aagaggauccacaaguuua

SEQ ID NO: 1156848 - RNA, 19 nt, Homo sapiens
cagcuaccaugauccaaga

SEQ ID NO: 1156849 - RNA, 19 nt, Homo sapiens
uagcugugauggaaucuga

SEQ ID NO: 1156850 - RNA, 19 nt, Homo sapiens
gagcugggcagaaacaugu

SEQ ID NO: 1156851 - RNA, 19 nt, Homo sapiens
gaccagaccuaugauggau

SEQ ID NO: 1156852 - RNA, 19 nt, Homo sapiens
ccaaggaugugcagguuac

SEQ ID NO: 1156853 - RNA, 19 nt, Homo sapiens
ggacgauaccuaacaacga

SEQ ID NO: 1156854 - RNA, 19 nt, Homo sapiens
ccaaagaggauccacaagu

SEQ ID NO: 1156855 - RNA, 19 nt, Homo sapiens
ggacauguggccugugugu

SEQ ID NO: 1156856 - RNA, 19 nt, Homo sapiens
gagccuggacugucuauca

SEQ ID NO: 1156857 - RNA, 19 nt, Homo sapiens
aaagaggauccacaaguuu

SEQ ID NO: 1156858 - RNA, 19 nt, Homo sapiens
ggaccugaaccugaaguuu

SEQ ID NO: 1156859 - RNA, 19 nt, Homo sapiens
guggguacuuugcuuucua

SEQ ID NO: 1156860 - RNA, 19 nt, Homo sapiens
gcagguuuaucgggacuau

SEQ ID NO: 1156861 - RNA, 19 nt, Homo sapiens
gcugaccaauucacagugu

SEQ ID NO: 1156862 - RNA, 19 nt, Homo sapiens
acagacacauggguacaaa

SEQ ID NO: 1156863 - RNA, 19 nt, Homo sapiens
cccauggugucccugauaa

SEQ ID NO: 1156864 - RNA, 19 nt, Homo sapiens
gagagacugcuguggaaug

SEQ ID NO: 1156865 - RNA, 19 nt, Homo sapiens
gcuaaucgucggcucaaug

SEQ ID NO: 1156866 - RNA, 19 nt, Homo sapiens
gcagagcccgguauuggau

SEQ ID NO: 1156867 - RNA, 19 nt, Homo sapiens
guaaagcuaugggcuacca

SEQ ID NO: 1156868 - RNA, 19 nt, Homo sapiens
caggauaaguuuucuucua

SEQ ID NO: 1156869 - RNA, 19 nt, Homo sapiens
gacacauggguacaaauaa

SEQ ID NO: 1156870 - RNA, 19 nt, Homo sapiens
cuaggcagcauuagaauca

SEQ ID NO: 1156871 - RNA, 19 nt, Homo sapiens
ggugaccuaggcagcauua

SEQ ID NO: 1156872 - RNA, 19 nt, Homo sapiens
agguuuaucgggacuauua

SEQ ID NO: 1156873 - RNA, 19 nt, Homo sapiens
cagcuuaacccuggaaugu

SEQ ID NO: 1156874 - RNA, 19 nt, Homo sapiens
gcuguggaauggccgcuau

SEQ ID NO: 1156875 - RNA, 19 nt, Homo sapiens
cggcgacgguaccugauga

SEQ ID NO: 1156876 - RNA, 19 nt, Homo sapiens
ucaaugaacuauacuuccu

SEQ ID NO: 1156877 - RNA, 19 nt, Homo sapiens
caccaaggaugugcagguu

SEQ ID NO: 1156878 - RNA, 19 nt, Homo sapiens
gggccuguguggguacuuu

SEQ ID NO: 1156879 - RNA, 19 nt, Homo sapiens
cgacaugaucaauucugua

SEQ ID NO: 1156880 - RNA, 19 nt, Homo sapiens
gcugaugguuuccuaugag

SEQ ID NO: 1156881 - RNA, 19 nt, Homo sapiens
caaacagggcacaggacua

SEQ ID NO: 1156882 - RNA, 19 nt, Homo sapiens
aguuugugcugcagguuua

SEQ ID NO: 1156883 - RNA, 19 nt, Homo sapiens
gaaaggaguaggcauugcu

SEQ ID NO: 1156884 - RNA, 19 nt, Homo sapiens
gcacgagucacggcagcua

SEQ ID NO: 1156885 - RNA, 19 nt, Homo sapiens
gcccaaggcggcuucuuug

SEQ ID NO: 1156886 - RNA, 19 nt, Homo sapiens
uaucagcaccggacaguca

SEQ ID NO: 1156887 - RNA, 19 nt, Homo sapiens
gcagcauuagaaucacuua

SEQ ID NO: 1156888 - RNA, 19 nt, Homo sapiens
cgucaaugcauauuuaauc

SEQ ID NO: 1156889 - RNA, 19 nt, Homo sapiens
cucaugaguuuacagagaa

SEQ ID NO: 1156890 - RNA, 19 nt, Homo sapiens
ccagugugcagucugauga

SEQ ID NO: 1156891 - RNA, 19 nt, Homo sapiens
aaacuaucuuugagcugaa

SEQ ID NO: 1156892 - RNA, 19 nt, Homo sapiens
cuaaucgucggcucaauga

SEQ ID NO: 1156893 - RNA, 19 nt, Homo sapiens
cugaaacaccagcucauuu

SEQ ID NO: 1156894 - RNA, 19 nt, Homo sapiens
ucccuaagcaacaugauaa

SEQ ID NO: 1156895 - RNA, 19 nt, Homo sapiens
ccaauugugccaguaaaug

SEQ ID NO: 1156896 - RNA, 19 nt, Homo sapiens
gguccgugcucuccaaacu

SEQ ID NO: 1156897 - RNA, 19 nt, Homo sapiens
uguuaugucugaccagugu

SEQ ID NO: 1156898 - RNA, 19 nt, Homo sapiens
gaaucugaaaugaaguuug

SEQ ID NO: 1156899 - RNA, 19 nt, Homo sapiens
cugucuggcucaugaguuu

SEQ ID NO: 1156900 - RNA, 19 nt, Homo sapiens
ccacccaauugugccagua

SEQ ID NO: 1156901 - RNA, 19 nt, Homo sapiens
aauccagugugcagucuga

SEQ ID NO: 1156902 - RNA, 19 nt, Homo sapiens
gaaaggaaguggagcaauu

SEQ ID NO: 1156903 - RNA, 19 nt, Homo sapiens
gauuagaucuucucaauuc

SEQ ID NO: 1156904 - RNA, 19 nt, Homo sapiens
ggaaugagcuucuugaaac

SEQ ID NO: 1156905 - RNA, 19 nt, Homo sapiens
ccaaagagccggugucuga

SEQ ID NO: 1156906 - RNA, 19 nt, Homo sapiens
ggacuacagugaccaggaa

SEQ ID NO: 1156907 - RNA, 19 nt, Homo sapiens
ugaaguauauguugaagug

SEQ ID NO: 1156908 - RNA, 19 nt, Homo sapiens
gaccacauuugaaguauau

SEQ ID NO: 1156909 - RNA, 19 nt, Homo sapiens
gaagagcagcugccaaaga

SEQ ID NO: 1156910 - RNA, 19 nt, Homo sapiens
caaacgacgugaucucuuc

SEQ ID NO: 1156911 - RNA, 19 nt, Homo sapiens
cagcauaccugagaauaga

SEQ ID NO: 1156912 - RNA, 19 nt, Homo sapiens
guggacagccucacaguua

SEQ ID NO: 1156913 - RNA, 19 nt, Homo sapiens
guuuauugauggucgauua

SEQ ID NO: 1156914 - RNA, 19 nt, Homo sapiens
ggaaguggagcaauucuga

SEQ ID NO: 1156915 - RNA, 19 nt, Homo sapiens
gagcugcuucuguaucuua

SEQ ID NO: 1156916 - RNA, 19 nt, Homo sapiens
cagagaacuucccagcaua

SEQ ID NO: 1156917 - RNA, 19 nt, Homo sapiens
ccagagaacuucccagcau

SEQ ID NO: 1156918 - RNA, 19 nt, Homo sapiens
uuaacauccuggcagauua

SEQ ID NO: 1156919 - RNA, 19 nt, Homo sapiens
cggaggagccgaucacuuu

SEQ ID NO: 1156920 - RNA, 19 nt, Homo sapiens
ccucauaggaauccauuua

SEQ ID NO: 1156921 - RNA, 19 nt, Homo sapiens
ucacugacauugacagcaa

SEQ ID NO: 1156922 - RNA, 19 nt, Homo sapiens
gugacaaacuguaccauca

SEQ ID NO: 1156923 - RNA, 19 nt, Homo sapiens
ucgauuagaucuucucaau

SEQ ID NO: 1156924 - RNA, 19 nt, Homo sapiens
ggagaaagucagaaacaug

SEQ ID NO: 1156925 - RNA, 19 nt, Homo sapiens
cagaagagcagcugccaaa

SEQ ID NO: 1156926 - RNA, 19 nt, Homo sapiens
gaaaauauuugggguugaa

SEQ ID NO: 1156927 - RNA, 19 nt, Homo sapiens
gaaacauggcccuggauga

SEQ ID NO: 1156928 - RNA, 19 nt, Homo sapiens
gauggucgauuagaucuuc

SEQ ID NO: 1156929 - RNA, 19 nt, Homo sapiens
gcaaauccggccaugaaga

SEQ ID NO: 1156930 - RNA, 19 nt, Homo sapiens
gcuccaggaucaagcagaa

SEQ ID NO: 1156931 - RNA, 19 nt, Homo sapiens
gcucuccacuguccggaaa

SEQ ID NO: 1156932 - RNA, 19 nt, Homo sapiens
aaacagagauucggguucu

SEQ ID NO: 1156933 - RNA, 19 nt, Homo sapiens
ugacuuacgccguugcuuu

SEQ ID NO: 1156934 - RNA, 19 nt, Homo sapiens
gccaaucacaguccacuuu

SEQ ID NO: 1156935 - RNA, 19 nt, Homo sapiens
gaagguuucagugauguuu

SEQ ID NO: 1156936 - RNA, 19 nt, Homo sapiens
aagagccggugucugauaa

SEQ ID NO: 1156937 - RNA, 19 nt, Homo sapiens
gagaccacauuugaaguau

SEQ ID NO: 1156938 - RNA, 19 nt, Homo sapiens
gaacgccggauacucauca

SEQ ID NO: 1156939 - RNA, 19 nt, Homo sapiens
uguuuaauaugcccuguuu

SEQ ID NO: 1156940 - RNA, 19 nt, Homo sapiens
gcagcaaacucagcacucu

SEQ ID NO: 1156941 - RNA, 19 nt, Homo sapiens
gaaugagcuucuugaaacu

SEQ ID NO: 1156942 - RNA, 19 nt, Homo sapiens
guugguuuguuguuuguuu

SEQ ID NO: 1156943 - RNA, 19 nt, Homo sapiens
ggcccaggcugcuuucuuc

SEQ ID NO: 1156944 - RNA, 19 nt, Homo sapiens
agaaaagcauuacccauuu

SEQ ID NO: 1156945 - RNA, 19 nt, Homo sapiens
aagcaaauccggccaugaa

SEQ ID NO: 1156946 - RNA, 19 nt, Homo sapiens
agaccacauuugaaguaua

SEQ ID NO: 1156947 - RNA, 19 nt, Homo sapiens
gaaacucugcacaaacuuc

SEQ ID NO: 1156948 - RNA, 19 nt, Homo sapiens
guaaagaccaaagcaaauc

SEQ ID NO: 1156949 - RNA, 19 nt, Homo sapiens
ugaauacuguaaagaccaa

SEQ ID NO: 1156950 - RNA, 19 nt, Homo sapiens
ccucacaguuagccaaguu

SEQ ID NO: 1156951 - RNA, 19 nt, Homo sapiens
aaagagccggugucugaua

SEQ ID NO: 1156952 - RNA, 19 nt, Homo sapiens
ggcgaagguuucagugaug

SEQ ID NO: 1156953 - RNA, 19 nt, Homo sapiens
gaaacgcucugaaaaucga

SEQ ID NO: 1156954 - RNA, 19 nt, Homo sapiens
gccggauacucaucauuug

SEQ ID NO: 1156955 - RNA, 19 nt, Homo sapiens
agagaccacauuugaagua

SEQ ID NO: 1156956 - RNA, 19 nt, Homo sapiens
gagcaacaucgcaguggaa

SEQ ID NO: 1156957 - RNA, 19 nt, Homo sapiens
gaaguggagcaauucugaa

SEQ ID NO: 1156958 - RNA, 19 nt, Homo sapiens
ccagagaccacauuugaag

SEQ ID NO: 1156959 - RNA, 19 nt, Homo sapiens
gaauccagagaccacauuu

SEQ ID NO: 1156960 - RNA, 19 nt, Homo sapiens
ggacagguggcacucuuuc

SEQ ID NO: 1156961 - RNA, 19 nt, Homo sapiens
ggcuggagcgaguacauua

SEQ ID NO: 1156962 - RNA, 19 nt, Homo sapiens
ccaggaaguucuacagacu

SEQ ID NO: 1156963 - RNA, 19 nt, Homo sapiens
cgcaaaagaucaugcaaaa

SEQ ID NO: 1156964 - RNA, 19 nt, Homo sapiens
gacauugacagcaaacaga

SEQ ID NO: 1156965 - RNA, 19 nt, Homo sapiens
cggcgaagguuucagugau

SEQ ID NO: 1156966 - RNA, 19 nt, Homo sapiens
ucauaggaauccauuuaag

SEQ ID NO: 1156967 - RNA, 19 nt, Homo sapiens
guugguugguuuguuguuu

SEQ ID NO: 1156968 - RNA, 19 nt, Homo sapiens
uaauggagaaagucagaaa

SEQ ID NO: 1156969 - RNA, 19 nt, Homo sapiens
gcauaccugagaauagaaa

SEQ ID NO: 1156970 - RNA, 19 nt, Homo sapiens
ucagcgugcauucuuauuu

SEQ ID NO: 1156971 - RNA, 19 nt, Homo sapiens
caggacagguggcacucuu

SEQ ID NO: 1156972 - RNA, 19 nt, Homo sapiens
gcgaagguuucagugaugu

SEQ ID NO: 1156973 - RNA, 19 nt, Homo sapiens
ggccagagcguuccucaag

SEQ ID NO: 1156974 - RNA, 19 nt, Homo sapiens
ggacaccaacacccuggaa

SEQ ID NO: 1156975 - RNA, 19 nt, Homo sapiens
aaacauggcccuggaugau

SEQ ID NO: 1156976 - RNA, 19 nt, Homo sapiens
ucccaugcccuaccucaua

SEQ ID NO: 1156977 - RNA, 19 nt, Homo sapiens
cgccgcaucugcuggacua

SEQ ID NO: 1156978 - RNA, 19 nt, Homo sapiens
cagcgugcauucuuauuuu

SEQ ID NO: 1156979 - RNA, 19 nt, Homo sapiens
cuacuucuguuggaaaaua

SEQ ID NO: 1156980 - RNA, 19 nt, Homo sapiens
gagccggugucugauaauc

SEQ ID NO: 1156981 - RNA, 19 nt, Homo sapiens
guccacauguuguuaagag

SEQ ID NO: 1156982 - RNA, 19 nt, Homo sapiens
aagagcagcugccaaagac

SEQ ID NO: 1156983 - RNA, 19 nt, Homo sapiens
aaaucaacaugggcgagua

SEQ ID NO: 1156984 - RNA, 19 nt, Homo sapiens
cuaccgaaacgcucugaaa

SEQ ID NO: 1156985 - RNA, 19 nt, Homo sapiens
ucaaggcccaggcugcuuu

SEQ ID NO: 1156986 - RNA, 19 nt, Homo sapiens
cauaggaauccauuuaagu

SEQ ID NO: 1156987 - RNA, 19 nt, Homo sapiens
ucuugaaacucugcacaaa

SEQ ID NO: 1156988 - RNA, 19 nt, Homo sapiens
uggaaugagcuucuugaaa

SEQ ID NO: 1156989 - RNA, 19 nt, Homo sapiens
gguucgagguauuuuauaa

SEQ ID NO: 1156990 - RNA, 19 nt, Homo sapiens
gaccaggaaguucuacaga

SEQ ID NO: 1156991 - RNA, 19 nt, Homo sapiens
cagaaaagcauuacccauu

SEQ ID NO: 1156992 - RNA, 19 nt, Homo sapiens
cgccggauacucaucauuu

SEQ ID NO: 1156993 - RNA, 19 nt, Homo sapiens
uugaaacucugcacaaacu

SEQ ID NO: 1156994 - RNA, 19 nt, Homo sapiens
ggucugcggcgaugcucua

SEQ ID NO: 1156995 - RNA, 19 nt, Homo sapiens
gcuguacgaacgccggaua

SEQ ID NO: 1156996 - RNA, 19 nt, Homo sapiens
caucucagcgugcauucuu

SEQ ID NO: 1156997 - RNA, 19 nt, Homo sapiens
gcuggagcgaguacauuaa

SEQ ID NO: 1156998 - RNA, 19 nt, Homo sapiens
ggaccucuucaucacauug

SEQ ID NO: 1156999 - RNA, 19 nt, Homo sapiens
uaagcuaucuccccugguu

SEQ ID NO: 1157000 - RNA, 19 nt, Homo sapiens
guuguuaagagaccaaaga

SEQ ID NO: 1157001 - RNA, 19 nt, Homo sapiens
ccaaucacaguccacuuug

SEQ ID NO: 1157002 - RNA, 19 nt, Homo sapiens
gaaagacauuccacuauua

SEQ ID NO: 1157003 - RNA, 19 nt, Homo sapiens
gaaagaagauggcacugua

SEQ ID NO: 1157004 - RNA, 19 nt, Homo sapiens
caacaaagcacuaucauuu

SEQ ID NO: 1157005 - RNA, 19 nt, Homo sapiens
guacauaugucuugacuga

SEQ ID NO: 1157006 - RNA, 19 nt, Homo sapiens
uaucugggcuuaagaaaua

SEQ ID NO: 1157007 - RNA, 19 nt, Homo sapiens
gagcuguccuuucuuaaua

SEQ ID NO: 1157008 - RNA, 19 nt, Homo sapiens
caaccuauauccaaacuuu

SEQ ID NO: 1157009 - RNA, 19 nt, Homo sapiens
gaacaggcuuuauaugaau

SEQ ID NO: 1157010 - RNA, 19 nt, Homo sapiens
guugaaggguuacacauua

SEQ ID NO: 1157011 - RNA, 19 nt, Homo sapiens
gaagaagcauugagaagau

SEQ ID NO: 1157012 - RNA, 19 nt, Homo sapiens
ucaaugaugucuuuccaua

SEQ ID NO: 1157013 - RNA, 19 nt, Homo sapiens
gaggaagaguguagaaauu

SEQ ID NO: 1157014 - RNA, 19 nt, Homo sapiens
cagauaaccuuaccacuga

SEQ ID NO: 1157015 - RNA, 19 nt, Homo sapiens
gcaagcagauggucacaau

SEQ ID NO: 1157016 - RNA, 19 nt, Homo sapiens
ccacgucgauguaaauauu

SEQ ID NO: 1157017 - RNA, 19 nt, Homo sapiens
ugaaagacauuccacuauu

SEQ ID NO: 1157018 - RNA, 19 nt, Homo sapiens
ggaagaagaggaagaagaa

SEQ ID NO: 1157019 - RNA, 19 nt, Homo sapiens
gaaacucagucuuccaaug

SEQ ID NO: 1157020 - RNA, 19 nt, Homo sapiens
gcaauucaguucaacacaa

SEQ ID NO: 1157021 - RNA, 19 nt, Homo sapiens
ucaacugucugauguaauu

SEQ ID NO: 1157022 - RNA, 19 nt, Homo sapiens
acacuugacuucaucuuaa

SEQ ID NO: 1157023 - RNA, 19 nt, Homo sapiens
gaaacucaaguccaaauuu

SEQ ID NO: 1157024 - RNA, 19 nt, Homo sapiens
gguuugcacugagaaauua

SEQ ID NO: 1157025 - RNA, 19 nt, Homo sapiens
gaagagaaagugaaguuug

SEQ ID NO: 1157026 - RNA, 19 nt, Homo sapiens
ggucagguuuguauaugua

SEQ ID NO: 1157027 - RNA, 19 nt, Homo sapiens
ccaaauuucugcuuaauac

SEQ ID NO: 1157028 - RNA, 19 nt, Homo sapiens
ugaacaggcuuuauaugaa

SEQ ID NO: 1157029 - RNA, 19 nt, Homo sapiens
guacuuaccagaagauaaa

SEQ ID NO: 1157030 - RNA, 19 nt, Homo sapiens
cagaauggcaguagcuuua

SEQ ID NO: 1157031 - RNA, 19 nt, Homo sapiens
guaauugagugaagguuug

SEQ ID NO: 1157032 - RNA, 19 nt, Homo sapiens
ugacugagcuguccuuucu

SEQ ID NO: 1157033 - RNA, 19 nt, Homo sapiens
uggaccaggugaaauauua

SEQ ID NO: 1157034 - RNA, 19 nt, Homo sapiens
gauaagucauugcacuauu

SEQ ID NO: 1157035 - RNA, 19 nt, Homo sapiens
agagaggaauuaucuguuu

SEQ ID NO: 1157036 - RNA, 19 nt, Homo sapiens
gcucaacugucugauguaa

SEQ ID NO: 1157037 - RNA, 19 nt, Homo sapiens
uuacauggaucgucuucua

SEQ ID NO: 1157038 - RNA, 19 nt, Homo sapiens
ccugaaggaucucacauaa

SEQ ID NO: 1157039 - RNA, 19 nt, Homo sapiens
gaacuucucagccuuuaug

SEQ ID NO: 1157040 - RNA, 19 nt, Homo sapiens
guugauggguuaccuuaaa

SEQ ID NO: 1157041 - RNA, 19 nt, Homo sapiens
gauuagggaugcuguacuu

SEQ ID NO: 1157042 - RNA, 19 nt, Homo sapiens
guggaaguguugagaagua

SEQ ID NO: 1157043 - RNA, 19 nt, Homo sapiens
ugaaggaucucacauaaaa

SEQ ID NO: 1157044 - RNA, 19 nt, Homo sapiens
ggaguaaauucugguguga

SEQ ID NO: 1157045 - RNA, 19 nt, Homo sapiens
gaaauaagaaaccacuuca

SEQ ID NO: 1157046 - RNA, 19 nt, Homo sapiens
uaauggaccaggugaaaua

SEQ ID NO: 1157047 - RNA, 19 nt, Homo sapiens
acaaugaacaggcuuuaua

SEQ ID NO: 1157048 - RNA, 19 nt, Homo sapiens
gaagaagaaucugaagaag

SEQ ID NO: 1157049 - RNA, 19 nt, Homo sapiens
ggaagaagaaggugaagau

SEQ ID NO: 1157050 - RNA, 19 nt, Homo sapiens
gaucugcaauucaguucaa

SEQ ID NO: 1157051 - RNA, 19 nt, Homo sapiens
agaagucuguuaauaguga

SEQ ID NO: 1157052 - RNA, 19 nt, Homo sapiens
caaagauggucuguagaaa

SEQ ID NO: 1157053 - RNA, 19 nt, Homo sapiens
aagagaaagugaaguuuga

SEQ ID NO: 1157054 - RNA, 19 nt, Homo sapiens
aaacucaaguccaaauuuc

SEQ ID NO: 1157055 - RNA, 19 nt, Homo sapiens
ccauaugacugcaagaaau

SEQ ID NO: 1157056 - RNA, 19 nt, Homo sapiens
caaauagaguucaggaucu

SEQ ID NO: 1157057 - RNA, 19 nt, Homo sapiens
ugucaaagauggucuguag

SEQ ID NO: 1157058 - RNA, 19 nt, Homo sapiens
gcacugagaaauuagcauu

SEQ ID NO: 1157059 - RNA, 19 nt, Homo sapiens
ccaaaugcuucuuccaguu

SEQ ID NO: 1157060 - RNA, 19 nt, Homo sapiens
gagaggaauuaucuguuug

SEQ ID NO: 1157061 - RNA, 19 nt, Homo sapiens
gaaugaugcauguuauuga

SEQ ID NO: 1157062 - RNA, 19 nt, Homo sapiens
ggaaauaagaaaccacuuc

SEQ ID NO: 1157063 - RNA, 19 nt, Homo sapiens
agaagaaggugaagaugau

SEQ ID NO: 1157064 - RNA, 19 nt, Homo sapiens
cacaagagauccuuucagu

SEQ ID NO: 1157065 - RNA, 19 nt, Homo sapiens
aagauggucuguagaaaug

SEQ ID NO: 1157066 - RNA, 19 nt, Homo sapiens
gcagauauggauacuaaug

SEQ ID NO: 1157067 - RNA, 19 nt, Homo sapiens
gaagaacaggugaugagaa

SEQ ID NO: 1157068 - RNA, 19 nt, Homo sapiens
augcagauauggauacuaa

SEQ ID NO: 1157069 - RNA, 19 nt, Homo sapiens
caagaugcccaggaaauaa

SEQ ID NO: 1157070 - RNA, 19 nt, Homo sapiens
ugaagaugcugauaaugau

SEQ ID NO: 1157071 - RNA, 19 nt, Homo sapiens
ggacagaggaagaguguag

SEQ ID NO: 1157072 - RNA, 19 nt, Homo sapiens
ugaugaagaugcugauaau

SEQ ID NO: 1157073 - RNA, 19 nt, Homo sapiens
ucaaagauggucuguagaa

SEQ ID NO: 1157074 - RNA, 19 nt, Homo sapiens
uaaauucuggugugacuaa

SEQ ID NO: 1157075 - RNA, 19 nt, Homo sapiens
gaaaccacuucaugcagau

SEQ ID NO: 1157076 - RNA, 19 nt, Homo sapiens
ggaccaacagguggaaaua

SEQ ID NO: 1157077 - RNA, 19 nt, Homo sapiens
ggaagaggaagaagaggaa

SEQ ID NO: 1157078 - RNA, 19 nt, Homo sapiens
caaguuuguugagcuuuaa

SEQ ID NO: 1157079 - RNA, 19 nt, Homo sapiens
cagaugaccaugaauuuga

SEQ ID NO: 1157080 - RNA, 19 nt, Homo sapiens
uauccuagcucuuugucaa

SEQ ID NO: 1157081 - RNA, 19 nt, Homo sapiens
gaccagaauccuguuauuu

SEQ ID NO: 1157082 - RNA, 19 nt, Homo sapiens
acugagcuguccuuucuua

SEQ ID NO: 1157083 - RNA, 19 nt, Homo sapiens
ggaagaguguagaaauuuu

SEQ ID NO: 1157084 - RNA, 19 nt, Homo sapiens
gugggacccugaguacuua

SEQ ID NO: 1157085 - RNA, 19 nt, Homo sapiens
aaacucagucuuccaauga

SEQ ID NO: 1157086 - RNA, 19 nt, Homo sapiens
gaaguguugagaaguauga

SEQ ID NO: 1157087 - RNA, 19 nt, Homo sapiens
agaccaaccuauauccaaa

SEQ ID NO: 1157088 - RNA, 19 nt, Homo sapiens
ugaaagugcugcaucuagu

SEQ ID NO: 1157089 - RNA, 19 nt, Homo sapiens
gaaggccuauggaaaggau

SEQ ID NO: 1157090 - RNA, 19 nt, Homo sapiens
gaaaugauggaaggagaaa

SEQ ID NO: 1157091 - RNA, 19 nt, Homo sapiens
ugaccagaauccuguuauu

SEQ ID NO: 1157092 - RNA, 19 nt, Homo sapiens
gguuaaagcauucauaaag

SEQ ID NO: 1157093 - RNA, 19 nt, Homo sapiens
cagauucuuuguagccuuu

SEQ ID NO: 1157094 - RNA, 19 nt, Homo sapiens
gcuaauaaaguccgaacaa

SEQ ID NO: 1157095 - RNA, 19 nt, Homo sapiens
ugagaaggguguagaagca

SEQ ID NO: 1157096 - RNA, 19 nt, Homo sapiens
cugaagaagaugaagauua

SEQ ID NO: 1157097 - RNA, 19 nt, Homo sapiens
agaagaagaaucugaagaa

SEQ ID NO: 1157098 - RNA, 19 nt, Homo sapiens
ucaagaugcccaggaaaua

SEQ ID NO: 1157099 - RNA, 19 nt, Homo sapiens
auaauucccuucucccauu

SEQ ID NO: 1157100 - RNA, 19 nt, Homo sapiens
cagccacuauaacuugaua

SEQ ID NO: 1157101 - RNA, 19 nt, Homo sapiens
guuaaagcauucauaaagg

SEQ ID NO: 1157102 - RNA, 19 nt, Homo sapiens
gggaaggccuuuagacaua

SEQ ID NO: 1157103 - RNA, 19 nt, Homo sapiens
gggaaggccuuuagacaua

SEQ ID NO: 1157104 - RNA, 19 nt, Homo sapiens
agacauaguucauccuuua

SEQ ID NO: 1157105 - RNA, 19 nt, Homo sapiens
gaacaucagagaauucaua

SEQ ID NO: 1157106 - RNA, 19 nt, Homo sapiens
gaacaucagagaauucaua

SEQ ID NO: 1157107 - RNA, 19 nt, Homo sapiens
ugagaaaccuuaugaaugu

SEQ ID NO: 1157108 - RNA, 19 nt, Homo sapiens
cauaggaacugguuauauu

SEQ ID NO: 1157109 - RNA, 19 nt, Homo sapiens
ggucuucaguugugacuua

SEQ ID NO: 1157110 - RNA, 19 nt, Homo sapiens
gaauauaaccaguuccuuu

SEQ ID NO: 1157111 - RNA, 19 nt, Homo sapiens
gagaacuuguccuauauuu

SEQ ID NO: 1157112 - RNA, 19 nt, Homo sapiens
cagcagaccuucuuugguu

SEQ ID NO: 1157113 - RNA, 19 nt, Homo sapiens
gauaaacccuaugaaugua

SEQ ID NO: 1157114 - RNA, 19 nt, Homo sapiens
caacacagcuaauuuacuc

SEQ ID NO: 1157115 - RNA, 19 nt, Homo sapiens
gaacuuacucgacaugaaa

SEQ ID NO: 1157116 - RNA, 19 nt, Homo sapiens
ggacagauaucgguacaau

SEQ ID NO: 1157117 - RNA, 19 nt, Homo sapiens
ugagaaaccuuaugcaugu

SEQ ID NO: 1157118 - RNA, 19 nt, Homo sapiens
gugagaagcccuaugaaua

SEQ ID NO: 1157119 - RNA, 19 nt, Homo sapiens
gggaauuccuuuaguguug

SEQ ID NO: 1157120 - RNA, 19 nt, Homo sapiens
gaagacagcauugguacua

SEQ ID NO: 1157121 - RNA, 19 nt, Homo sapiens
gaaaguagcaaguuaugug

SEQ ID NO: 1157122 - RNA, 19 nt, Homo sapiens
gaccugaagugggauauuu

SEQ ID NO: 1157123 - RNA, 19 nt, Homo sapiens
ggagaacuacagcaacuua

SEQ ID NO: 1157124 - RNA, 19 nt, Homo sapiens
agucauagcugauauauac

SEQ ID NO: 1157125 - RNA, 19 nt, Homo sapiens
agacauaguucagcccuua

SEQ ID NO: 1157126 - RNA, 19 nt, Homo sapiens
ugagaaagcauuuggagua

SEQ ID NO: 1157127 - RNA, 19 nt, Homo sapiens
guaagaaacccuaugaaug

SEQ ID NO: 1157128 - RNA, 19 nt, Homo sapiens
gaacuuguccuauauuucu

SEQ ID NO: 1157129 - RNA, 19 nt, Homo sapiens
guaauugguuguuguuuca

SEQ ID NO: 1157130 - RNA, 19 nt, Homo sapiens
caaccaggauccaaaugaa

SEQ ID NO: 1157131 - RNA, 19 nt, Homo sapiens
gaaacccuaugaaugcaaa

SEQ ID NO: 1157132 - RNA, 19 nt, Homo sapiens
ucucagaguugacuuacua

SEQ ID NO: 1157133 - RNA, 19 nt, Homo sapiens
acaaauguaugcacuguga

SEQ ID NO: 1157134 - RNA, 19 nt, Homo sapiens
auagauaacuccaguaugu

SEQ ID NO: 1157135 - RNA, 19 nt, Homo sapiens
gaccaauucuuuacaguuc

SEQ ID NO: 1157136 - RNA, 19 nt, Homo sapiens
ccaaguagcugggauuaca

SEQ ID NO: 1157137 - RNA, 19 nt, Homo sapiens
uguuagauguugccaaaua

SEQ ID NO: 1157138 - RNA, 19 nt, Homo sapiens
aaacaucagcgcauucaua

SEQ ID NO: 1157139 - RNA, 19 nt, Homo sapiens
gaaagcauuuggaguaggu

SEQ ID NO: 1157140 - RNA, 19 nt, Homo sapiens
ggagaacucaugacaguga

SEQ ID NO: 1157141 - RNA, 19 nt, Homo sapiens
caacuucucucaggaggaa

SEQ ID NO: 1157142 - RNA, 19 nt, Homo sapiens
guagcucuauuucuaacua

SEQ ID NO: 1157143 - RNA, 19 nt, Homo sapiens
gcaguggugucaucucaga

SEQ ID NO: 1157144 - RNA, 19 nt, Homo sapiens
guauguagacguagaauug

SEQ ID NO: 1157145 - RNA, 19 nt, Homo sapiens
ggauggauuuaauagguaa

SEQ ID NO: 1157146 - RNA, 19 nt, Homo sapiens
ggcaaggacuucagauuuc

SEQ ID NO: 1157147 - RNA, 19 nt, Homo sapiens
ugagaaacccuacaaaugu

SEQ ID NO: 1157148 - RNA, 19 nt, Homo sapiens
gcauuuaucuguaggaaaa

SEQ ID NO: 1157149 - RNA, 19 nt, Homo sapiens
ggaauugacauacuaguuc

SEQ ID NO: 1157150 - RNA, 19 nt, Homo sapiens
guaacaacacagcuaauuu

SEQ ID NO: 1157151 - RNA, 19 nt, Homo sapiens
caucugauauauugagcua

SEQ ID NO: 1157152 - RNA, 19 nt, Homo sapiens
aaucaucucucucuuagga

SEQ ID NO: 1157153 - RNA, 19 nt, Homo sapiens
ggacgaugguguucugcaa

SEQ ID NO: 1157154 - RNA, 19 nt, Homo sapiens
gcaaggacuucagauuuca

SEQ ID NO: 1157155 - RNA, 19 nt, Homo sapiens
gaauaugggaauacaugua

SEQ ID NO: 1157156 - RNA, 19 nt, Homo sapiens
aauggaaaguagcaaguua

SEQ ID NO: 1157157 - RNA, 19 nt, Homo sapiens
gaugauaaacccuaugaau

SEQ ID NO: 1157158 - RNA, 19 nt, Homo sapiens
agacuuacgucagcccuua

SEQ ID NO: 1157159 - RNA, 19 nt, Homo sapiens
gaacaucagagaauucaca

SEQ ID NO: 1157160 - RNA, 19 nt, Homo sapiens
agaaaugacuggcaaagca

SEQ ID NO: 1157161 - RNA, 19 nt, Homo sapiens
gaaugggaauaucuggauu

SEQ ID NO: 1157162 - RNA, 19 nt, Homo sapiens
gucaggauauuugcuauuu

SEQ ID NO: 1157163 - RNA, 19 nt, Homo sapiens
ucaaagaguucaugauggu

SEQ ID NO: 1157164 - RNA, 19 nt, Homo sapiens
auaacggugugaaugauua

SEQ ID NO: 1157165 - RNA, 19 nt, Homo sapiens
caccaugaccggcuaauuu

SEQ ID NO: 1157166 - RNA, 19 nt, Homo sapiens
gaucacgagccacugguua

SEQ ID NO: 1157167 - RNA, 19 nt, Homo sapiens
ugccaaauauuucuccuuu

SEQ ID NO: 1157168 - RNA, 19 nt, Homo sapiens
guagaauugcuuagucaua

SEQ ID NO: 1157169 - RNA, 19 nt, Homo sapiens
gagaaaccuuaugaaugua

SEQ ID NO: 1157170 - RNA, 19 nt, Homo sapiens
gagaaagcauuuggaguag

SEQ ID NO: 1157171 - RNA, 19 nt, Homo sapiens
uaagaaacccuaugaaugc

SEQ ID NO: 1157172 - RNA, 19 nt, Homo sapiens
guacugggaugugaugaug

SEQ ID NO: 1157173 - RNA, 19 nt, Homo sapiens
caggauauuugcuauuuca

SEQ ID NO: 1157174 - RNA, 19 nt, Homo sapiens
caccacgccuguccgguua

SEQ ID NO: 1157175 - RNA, 19 nt, Homo sapiens
gagaauucauacuggagaa

SEQ ID NO: 1157176 - RNA, 19 nt, Homo sapiens
caucaaagaauucauagug

SEQ ID NO: 1157177 - RNA, 19 nt, Homo sapiens
uaaagaaugugagaaagca

SEQ ID NO: 1157178 - RNA, 19 nt, Homo sapiens
gguaagaaacccuaugaau

SEQ ID NO: 1157179 - RNA, 19 nt, Homo sapiens
gacuaagcauuuaucugua

SEQ ID NO: 1157180 - RNA, 19 nt, Homo sapiens
gcagaccuucuuugguuua

SEQ ID NO: 1157181 - RNA, 19 nt, Homo sapiens
cacacacacuauauacaua

SEQ ID NO: 1157182 - RNA, 19 nt, Homo sapiens
ugauaaacccuaugaaugu

SEQ ID NO: 1157183 - RNA, 19 nt, Homo sapiens
guucaucccugacuagaca

SEQ ID NO: 1157184 - RNA, 19 nt, Homo sapiens
gugagaaacccuacaaaug

SEQ ID NO: 1157185 - RNA, 19 nt, Homo sapiens
agaguugacuuacuagguu

SEQ ID NO: 1157186 - RNA, 19 nt, Homo sapiens
ccacacaugcacuacauaa

SEQ ID NO: 1157187 - RNA, 19 nt, Homo sapiens
guauauagugugugaugua

SEQ ID NO: 1157188 - RNA, 19 nt, Homo sapiens
uaaggaguguggaaaguuc

SEQ ID NO: 1157189 - RNA, 19 nt, Homo sapiens
gaacuugcucgucaucaga

SEQ ID NO: 1157190 - RNA, 19 nt, Homo sapiens
gagaaaccuuaugcaugua

SEQ ID NO: 1157191 - RNA, 19 nt, Homo sapiens
ugaaagaguuggaaaaguu

SEQ ID NO: 1157192 - RNA, 19 nt, Homo sapiens
ggauagauaacuccaguau

SEQ ID NO: 1157193 - RNA, 19 nt, Homo sapiens
aaagcaagauugacuuaca

SEQ ID NO: 1157194 - RNA, 19 nt, Homo sapiens
cauacuaguucuugagaug

SEQ ID NO: 1157195 - RNA, 19 nt, Homo sapiens
gauauguaauugguuguug

SEQ ID NO: 1157196 - RNA, 19 nt, Homo sapiens
gggaugugaugauggagaa

SEQ ID NO: 1157197 - RNA, 19 nt, Homo sapiens
agacuaagcauuuaucugu

SEQ ID NO: 1157198 - RNA, 19 nt, Homo sapiens
gaauugacauacuaguucu

SEQ ID NO: 1157199 - RNA, 19 nt, Homo sapiens
ucauggaauugacauacua

SEQ ID NO: 1157200 - RNA, 19 nt, Homo sapiens
ggagugcaguggugucauc

SEQ ID NO: 1157201 - RNA, 19 nt, Homo sapiens
guauauaguguauguguga

SEQ ID NO: 1157202 - RNA, 19 nt, Homo sapiens
ggaagaagauccugcagaa

SEQ ID NO: 1157203 - RNA, 19 nt, Homo sapiens
caaagcaaaugucaucaaa

SEQ ID NO: 1157204 - RNA, 19 nt, Homo sapiens
ggaccugucuguuggguuu

SEQ ID NO: 1157205 - RNA, 19 nt, Homo sapiens
ucacaggccucaucauuga

SEQ ID NO: 1157206 - RNA, 19 nt, Homo sapiens
gacaaucaauucugacuga

SEQ ID NO: 1157207 - RNA, 19 nt, Homo sapiens
gaccaacacugcacucaau

SEQ ID NO: 1157208 - RNA, 19 nt, Homo sapiens
gcccaaacccuuucucuuu

SEQ ID NO: 1157209 - RNA, 19 nt, Homo sapiens
gcucugggaugcacauuau

SEQ ID NO: 1157210 - RNA, 19 nt, Homo sapiens
gcuaugaccuggcagagau

SEQ ID NO: 1157211 - RNA, 19 nt, Homo sapiens
ggacauagagagaggaaau

SEQ ID NO: 1157212 - RNA, 19 nt, Homo sapiens
ggaugcacauuauugaaga

SEQ ID NO: 1157213 - RNA, 19 nt, Homo sapiens
gaacugaggagacaccaau

SEQ ID NO: 1157214 - RNA, 19 nt, Homo sapiens
ggaaaucgaggcugugaga

SEQ ID NO: 1157215 - RNA, 19 nt, Homo sapiens
ccauggaguuugcauuuga

SEQ ID NO: 1157216 - RNA, 19 nt, Homo sapiens
gcucaaugaugcggaguuu

SEQ ID NO: 1157217 - RNA, 19 nt, Homo sapiens
cggcugagcugaccaaugg

SEQ ID NO: 1157218 - RNA, 19 nt, Homo sapiens
gcacauuauugaagagaca

SEQ ID NO: 1157219 - RNA, 19 nt, Homo sapiens
gaauggcuacacuucuuua

SEQ ID NO: 1157220 - RNA, 19 nt, Homo sapiens
ccauuuaacuguccucaca

SEQ ID NO: 1157221 - RNA, 19 nt, Homo sapiens
gugcuuacauuuccacuca

SEQ ID NO: 1157222 - RNA, 19 nt, Homo sapiens
gagcaacaauggaguacca

SEQ ID NO: 1157223 - RNA, 19 nt, Homo sapiens
gcaggacccuauauggaau

SEQ ID NO: 1157224 - RNA, 19 nt, Homo sapiens
gaaaucugaugucucaacu

SEQ ID NO: 1157225 - RNA, 19 nt, Homo sapiens
gcagagcaacaauggagua

SEQ ID NO: 1157226 - RNA, 19 nt, Homo sapiens
gcucguguaucacagauuc

SEQ ID NO: 1157227 - RNA, 19 nt, Homo sapiens
gauccaggcugucuuugca

SEQ ID NO: 1157228 - RNA, 19 nt, Homo sapiens
agaagauccugcagaagaa

SEQ ID NO: 1157229 - RNA, 19 nt, Homo sapiens
gaggagacaccaaugcauu

SEQ ID NO: 1157230 - RNA, 19 nt, Homo sapiens
caugauuccuugacuccua

SEQ ID NO: 1157231 - RNA, 19 nt, Homo sapiens
ggaacaggcaugugacaga

SEQ ID NO: 1157232 - RNA, 19 nt, Homo sapiens
gggcagaggcugggaguuu

SEQ ID NO: 1157233 - RNA, 19 nt, Homo sapiens
gcuggcaccugaugugaga

SEQ ID NO: 1157234 - RNA, 19 nt, Homo sapiens
ugucucaacuggcacauga

SEQ ID NO: 1157235 - RNA, 19 nt, Homo sapiens
gcaaagcaaaugucaucaa

SEQ ID NO: 1157236 - RNA, 19 nt, Homo sapiens
ugacuuccuuggacuuuga

SEQ ID NO: 1157237 - RNA, 19 nt, Homo sapiens
ugaagucucuaggccuaua

SEQ ID NO: 1157238 - RNA, 19 nt, Homo sapiens
cuacacuucuuuaggaaug

SEQ ID NO: 1157239 - RNA, 19 nt, Homo sapiens
gaggagaaaucugaugucu

SEQ ID NO: 1157240 - RNA, 19 nt, Homo sapiens
cagccacccucccuucauu

SEQ ID NO: 1157241 - RNA, 19 nt, Homo sapiens
gaauggcaauagcuaugug

SEQ ID NO: 1157242 - RNA, 19 nt, Homo sapiens
aagaagauccugcagaaga

SEQ ID NO: 1157243 - RNA, 19 nt, Homo sapiens
ggagaaguguccuuaugac

SEQ ID NO: 1157244 - RNA, 19 nt, Homo sapiens
uggcuacacuucuuuagga

SEQ ID NO: 1157245 - RNA, 19 nt, Homo sapiens
ccuaagcccugcguacauu

SEQ ID NO: 1157246 - RNA, 19 nt, Homo sapiens
gaugugagacugcucuaug

SEQ ID NO: 1157247 - RNA, 19 nt, Homo sapiens
ccuaugaccugcucuuucu

SEQ ID NO: 1157248 - RNA, 19 nt, Homo sapiens
cgucucaucugccacauuc

SEQ ID NO: 1157249 - RNA, 19 nt, Homo sapiens
gaggugcccuguucucucu

SEQ ID NO: 1157250 - RNA, 19 nt, Homo sapiens
aaagggaggagaaaucuga

SEQ ID NO: 1157251 - RNA, 19 nt, Homo sapiens
gggcagcugucuccagauc

SEQ ID NO: 1157252 - RNA, 19 nt, Homo sapiens
gcacaugaagcccauucuu

SEQ ID NO: 1157253 - RNA, 19 nt, Homo sapiens
cggccuggcucguguauca

SEQ ID NO: 1157254 - RNA, 19 nt, Homo sapiens
cauccuaucugguccucuu

SEQ ID NO: 1157255 - RNA, 19 nt, Homo sapiens
ggaugaauggcaauagcua

SEQ ID NO: 1157256 - RNA, 19 nt, Homo sapiens
gcagcugucuccagaucau

SEQ ID NO: 1157257 - RNA, 19 nt, Homo sapiens
gcacagcuggcaccugaug

SEQ ID NO: 1157258 - RNA, 19 nt, Homo sapiens
gagccucccuugcugucuu

SEQ ID NO: 1157259 - RNA, 19 nt, Homo sapiens
ggacuuccuuccugaaagc

SEQ ID NO: 1157260 - RNA, 19 nt, Homo sapiens
caccauggaguuugcauuu

SEQ ID NO: 1157261 - RNA, 19 nt, Homo sapiens
ggaaagggaggagaaaucu

SEQ ID NO: 1157262 - RNA, 19 nt, Homo sapiens
gcagggaaagggaggagaa

SEQ ID NO: 1157263 - RNA, 19 nt, Homo sapiens
guaacacacaccuguauca

SEQ ID NO: 1157264 - RNA, 19 nt, Homo sapiens
ugugagagcagcagggaua

SEQ ID NO: 1157265 - RNA, 19 nt, Homo sapiens
aagcaggacagcacugaua

SEQ ID NO: 1157266 - RNA, 19 nt, Homo sapiens
cuacacagccacuagguau

SEQ ID NO: 1157267 - RNA, 19 nt, Homo sapiens
ugacuccuaugaccuuaug

SEQ ID NO: 1157268 - RNA, 19 nt, Homo sapiens
gggugaggaugacuguuau

SEQ ID NO: 1157269 - RNA, 19 nt, Homo sapiens
ggcagaggcugggaguuug

SEQ ID NO: 1157270 - RNA, 19 nt, Homo sapiens
cccaaacccuuucucuuuc

SEQ ID NO: 1157271 - RNA, 19 nt, Homo sapiens
ggaagcaggacagcacuga

SEQ ID NO: 1157272 - RNA, 19 nt, Homo sapiens
caagguguacuacuucuuc

SEQ ID NO: 1157273 - RNA, 19 nt, Homo sapiens
gggauuccauggccacaca

SEQ ID NO: 1157274 - RNA, 19 nt, Homo sapiens
gacccuauauggaauacca

SEQ ID NO: 1157275 - RNA, 19 nt, Homo sapiens
ucaaugaugcggaguuugu

SEQ ID NO: 1157276 - RNA, 19 nt, Homo sapiens
gggaaagggaggagaaauc

SEQ ID NO: 1157277 - RNA, 19 nt, Homo sapiens
gaagaugagggugaugaug

SEQ ID NO: 1157278 - RNA, 19 nt, Homo sapiens
guguggcccuugugaauca

SEQ ID NO: 1157279 - RNA, 19 nt, Homo sapiens
gaggaugaauggcaauagc

SEQ ID NO: 1157280 - RNA, 19 nt, Homo sapiens
ggagugcuuuaaccaugug

SEQ ID NO: 1157281 - RNA, 19 nt, Homo sapiens
ccccuaaccuaaacacuua

SEQ ID NO: 1157282 - RNA, 19 nt, Homo sapiens
aagaugagggugaugauga

SEQ ID NO: 1157283 - RNA, 19 nt, Homo sapiens
ccuccucccuccucuaugu

SEQ ID NO: 1157284 - RNA, 19 nt, Homo sapiens
uggcaacuauggcugcuau

SEQ ID NO: 1157285 - RNA, 19 nt, Homo sapiens
gaggaaaucgaggcuguga

SEQ ID NO: 1157286 - RNA, 19 nt, Homo sapiens
ccugaaagcccgucucauc

SEQ ID NO: 1157287 - RNA, 19 nt, Homo sapiens
ccagugcagugggugauga

SEQ ID NO: 1157288 - RNA, 19 nt, Homo sapiens
ccagagaugcaaagcaaau

SEQ ID NO: 1157289 - RNA, 19 nt, Homo sapiens
gugaggaugacuguuauuu

SEQ ID NO: 1157290 - RNA, 19 nt, Homo sapiens
ucaaugagccagccucucu

SEQ ID NO: 1157291 - RNA, 19 nt, Homo sapiens
cccauguggugaccucuuu

SEQ ID NO: 1157292 - RNA, 19 nt, Homo sapiens
ccauaugggcucaauguca

SEQ ID NO: 1157293 - RNA, 19 nt, Homo sapiens
ccaaacccuuucucuuucu

SEQ ID NO: 1157294 - RNA, 19 nt, Homo sapiens
cagaacaaaugcucuucca

SEQ ID NO: 1157295 - RNA, 19 nt, Homo sapiens
gauacaggacauagagaga

SEQ ID NO: 1157296 - RNA, 19 nt, Homo sapiens
gcacugauacaggacauag

SEQ ID NO: 1157297 - RNA, 19 nt, Homo sapiens
guaaaguugcacccacuga

SEQ ID NO: 1157298 - RNA, 19 nt, Homo sapiens
ucucagugccaacgacaua

SEQ ID NO: 1157299 - RNA, 19 nt, Homo sapiens
gcccagaacuacucaacac

SEQ ID NO: 1157300 - RNA, 19 nt, Homo sapiens
uauaugggacaaucaauuc

SEQ ID NO: 1157301 - RNA, 19 nt, Homo sapiens
cacaugaagcccauucuug

SEQ ID NO: 1157302 - RNA, 19 nt, Homo sapiens
gaaagucccugacaugaag

SEQ ID NO: 1157303 - RNA, 19 nt, Homo sapiens
caaagucugugaaaugaaa

SEQ ID NO: 1157304 - RNA, 19 nt, Homo sapiens
gaaacucccugaagugcaa

SEQ ID NO: 1157305 - RNA, 19 nt, Homo sapiens
gaaacucccugaggugaaa

SEQ ID NO: 1157306 - RNA, 19 nt, Homo sapiens
gaaggaagcagaaguucaa

SEQ ID NO: 1157307 - RNA, 19 nt, Homo sapiens
cuagauggcugccugcuuu

SEQ ID NO: 1157308 - RNA, 19 nt, Homo sapiens
gaaacuuccugagaugaaa

SEQ ID NO: 1157309 - RNA, 19 nt, Homo sapiens
gaaagucccugagaugaag

SEQ ID NO: 1157310 - RNA, 19 nt, Homo sapiens
gaagcucccugagaugaaa

SEQ ID NO: 1157311 - RNA, 19 nt, Homo sapiens
gaugaaacuuccugagaug

SEQ ID NO: 1157312 - RNA, 19 nt, Homo sapiens
caagggaccugaagugaag

SEQ ID NO: 1157313 - RNA, 19 nt, Homo sapiens
ggugaaaggucccagacuu

SEQ ID NO: 1157314 - RNA, 19 nt, Homo sapiens
gaaagugucagagaugaaa

SEQ ID NO: 1157315 - RNA, 19 nt, Homo sapiens
gaaagugucggagaugaaa

SEQ ID NO: 1157316 - RNA, 19 nt, Homo sapiens
gaaagucccagagaugaaa

SEQ ID NO: 1157317 - RNA, 19 nt, Homo sapiens
gaaagugccagagaugaaa

SEQ ID NO: 1157318 - RNA, 19 nt, Homo sapiens
gaaaugaaagucccugaca

SEQ ID NO: 1157319 - RNA, 19 nt, Homo sapiens
gagaugaaacuuccugaga

SEQ ID NO: 1157320 - RNA, 19 nt, Homo sapiens
agaggcagcugguggcuuu

SEQ ID NO: 1157321 - RNA, 19 nt, Homo sapiens
gcacuacgccugcugcaau

SEQ ID NO: 1157322 - RNA, 19 nt, Homo sapiens
gaaaugacaggcaagaagu

SEQ ID NO: 1157323 - RNA, 19 nt, Homo sapiens
cagaagggauggaauuugg

SEQ ID NO: 1157324 - RNA, 19 nt, Homo sapiens
gggcggaguugguggaaau

SEQ ID NO: 1157325 - RNA, 19 nt, Homo sapiens
caaaggugccugagaugaa

SEQ ID NO: 1157326 - RNA, 19 nt, Homo sapiens
uaacuagcacuaacccuaa

SEQ ID NO: 1157327 - RNA, 19 nt, Homo sapiens
ggaauuuggcuucaagaug

SEQ ID NO: 1157328 - RNA, 19 nt, Homo sapiens
gaugaaagucccugagaug

SEQ ID NO: 1157329 - RNA, 19 nt, Homo sapiens
acacuucccugccuagaga

SEQ ID NO: 1157330 - RNA, 19 nt, Homo sapiens
gggccgaccucaaguucaa

SEQ ID NO: 1157331 - RNA, 19 nt, Homo sapiens
caccaagccaugugaauaa

SEQ ID NO: 1157332 - RNA, 19 nt, Homo sapiens
ccaccaagccaugugaaua

SEQ ID NO: 1157333 - RNA, 19 nt, Homo sapiens
gcugaagguauccaaauuu

SEQ ID NO: 1157334 - RNA, 19 nt, Homo sapiens
cccaaagucugugaaauga

SEQ ID NO: 1157335 - RNA, 19 nt, Homo sapiens
gagaugaagcucccugaga

SEQ ID NO: 1157336 - RNA, 19 nt, Homo sapiens
aaaggugccugagaugaaa

SEQ ID NO: 1157337 - RNA, 19 nt, Homo sapiens
cgagugcccucuguugaaa

SEQ ID NO: 1157338 - RNA, 19 nt, Homo sapiens
gcuguugugugugugauaa

SEQ ID NO: 1157339 - RNA, 19 nt, Homo sapiens
gagagaagucacccaaguu

SEQ ID NO: 1157340 - RNA, 19 nt, Homo sapiens
gcccaaagucugugaaaug

SEQ ID NO: 1157341 - RNA, 19 nt, Homo sapiens
agaugaagcuuccaaaggu

SEQ ID NO: 1157342 - RNA, 19 nt, Homo sapiens
cugaagguauccaaauuug

SEQ ID NO: 1157343 - RNA, 19 nt, Homo sapiens
gauggaauuuggcuucaag

SEQ ID NO: 1157344 - RNA, 19 nt, Homo sapiens
cagggaagcugguaacacu

SEQ ID NO: 1157345 - RNA, 19 nt, Homo sapiens
ggucagcggcaucaacgua

SEQ ID NO: 1157346 - RNA, 19 nt, Homo sapiens
caaagugucagagaugaaa

SEQ ID NO: 1157347 - RNA, 19 nt, Homo sapiens
ccugagugcuggcccaauu

SEQ ID NO: 1157348 - RNA, 19 nt, Homo sapiens
gaaccaggaaagccagauu

SEQ ID NO: 1157349 - RNA, 19 nt, Homo sapiens
acaugaagcucccagagau

SEQ ID NO: 1157350 - RNA, 19 nt, Homo sapiens
agaugaagcucccugagau

SEQ ID NO: 1157351 - RNA, 19 nt, Homo sapiens
gagaugaaagucccugaga

SEQ ID NO: 1157352 - RNA, 19 nt, Homo sapiens
ucacuaacccaagcuaauu

SEQ ID NO: 1157353 - RNA, 19 nt, Homo sapiens
ggaaggaagcagaaguuca

SEQ ID NO: 1157354 - RNA, 19 nt, Homo sapiens
caagcccucuuccaaguuc

SEQ ID NO: 1157355 - RNA, 19 nt, Homo sapiens
gcagaagggauggaauuug

SEQ ID NO: 1157356 - RNA, 19 nt, Homo sapiens
gcgccgagccuuacaaagu

SEQ ID NO: 1157357 - RNA, 19 nt, Homo sapiens
gaguggcccuggacaaagu

SEQ ID NO: 1157358 - RNA, 19 nt, Homo sapiens
agagagaagucacccaagu

SEQ ID NO: 1157359 - RNA, 19 nt, Homo sapiens
gaugaaacucccugaagug

SEQ ID NO: 1157360 - RNA, 19 nt, Homo sapiens
cgaaagugccagagaugaa

SEQ ID NO: 1157361 - RNA, 19 nt, Homo sapiens
guacagcugccgaaagugu

SEQ ID NO: 1157362 - RNA, 19 nt, Homo sapiens
ggaagcagaaguucaaggu

SEQ ID NO: 1157363 - RNA, 19 nt, Homo sapiens
gagaugaaacucccugaag

SEQ ID NO: 1157364 - RNA, 19 nt, Homo sapiens
agaugaaacuuccugagau

SEQ ID NO: 1157365 - RNA, 19 nt, Homo sapiens
gagaugaagcuuccaaagg

SEQ ID NO: 1157366 - RNA, 19 nt, Homo sapiens
gagaugaaacucccaaagg

SEQ ID NO: 1157367 - RNA, 19 nt, Homo sapiens
gagaugaaacucccaaagg

SEQ ID NO: 1157368 - RNA, 19 nt, Homo sapiens
gagaugaaacucccaaagg

SEQ ID NO: 1157369 - RNA, 19 nt, Homo sapiens
gggcacucauggugaaaug

SEQ ID NO: 1157370 - RNA, 19 nt, Homo sapiens
acacuccuguugacucauu

SEQ ID NO: 1157371 - RNA, 19 nt, Homo sapiens
ccaggaagaggguggauug

SEQ ID NO: 1157372 - RNA, 19 nt, Homo sapiens
gagaugaaacucccuaaaa

SEQ ID NO: 1157373 - RNA, 19 nt, Homo sapiens
cuacacuccuguugacuca

SEQ ID NO: 1157374 - RNA, 19 nt, Homo sapiens
gcuucaagaugcccaagau

SEQ ID NO: 1157375 - RNA, 19 nt, Homo sapiens
gacaugaagcucccagaga

SEQ ID NO: 1157376 - RNA, 19 nt, Homo sapiens
ugaaagucccugacaugaa

SEQ ID NO: 1157377 - RNA, 19 nt, Homo sapiens
cggaguugguggaaauuau

SEQ ID NO: 1157378 - RNA, 19 nt, Homo sapiens
ugaaagucccugagaugaa

SEQ ID NO: 1157379 - RNA, 19 nt, Homo sapiens
ccgaaagugucagagauga

SEQ ID NO: 1157380 - RNA, 19 nt, Homo sapiens
ugcaggagcucguuucaca

SEQ ID NO: 1157381 - RNA, 19 nt, Homo sapiens
caaguacgaggacgcacua

SEQ ID NO: 1157382 - RNA, 19 nt, Homo sapiens
ggaagugcagcucccgaaa

SEQ ID NO: 1157383 - RNA, 19 nt, Homo sapiens
agaugaaacucccugaagu

SEQ ID NO: 1157384 - RNA, 19 nt, Homo sapiens
agaugaaacucccaaaggu

SEQ ID NO: 1157385 - RNA, 19 nt, Homo sapiens
agaugaaacucccaaaggu

SEQ ID NO: 1157386 - RNA, 19 nt, Homo sapiens
agaugaaacucccaaaggu

SEQ ID NO: 1157387 - RNA, 19 nt, Homo sapiens
ccaagggaccugaagugaa

SEQ ID NO: 1157388 - RNA, 19 nt, Homo sapiens
gcagcaggcucagaguaca

SEQ ID NO: 1157389 - RNA, 19 nt, Homo sapiens
gucaagcccucuuccaagu

SEQ ID NO: 1157390 - RNA, 19 nt, Homo sapiens
caagguggccaagcuggua

SEQ ID NO: 1157391 - RNA, 19 nt, Homo sapiens
agguagagcugcccaaagu

SEQ ID NO: 1157392 - RNA, 19 nt, Homo sapiens
gcccgcugcuccugaaguu

SEQ ID NO: 1157393 - RNA, 19 nt, Homo sapiens
ugacgucgaguucuccuuu

SEQ ID NO: 1157394 - RNA, 19 nt, Homo sapiens
gcaggucccagccgcuaaa

SEQ ID NO: 1157395 - RNA, 19 nt, Homo sapiens
uacgagaaguggccgaaga

SEQ ID NO: 1157396 - RNA, 19 nt, Homo sapiens
gggcagcaggcucagagua

SEQ ID NO: 1157397 - RNA, 19 nt, Homo sapiens
ggauggaauuuggcuucaa

SEQ ID NO: 1157398 - RNA, 19 nt, Homo sapiens
gaagugcagcucccgaaag

SEQ ID NO: 1157399 - RNA, 19 nt, Homo sapiens
ccaaaggugccugagauga

SEQ ID NO: 1157400 - RNA, 19 nt, Homo sapiens
uccaaguucuccuuaccua

SEQ ID NO: 1157401 - RNA, 19 nt, Homo sapiens
caugaagcucccagagaua

SEQ ID NO: 1157402 - RNA, 19 nt, Homo sapiens
cacaauagcuuuggauuua

SEQ ID NO: 1157403 - RNA, 19 nt, Homo sapiens
ggaaaacccuuuagaaaua

SEQ ID NO: 1157404 - RNA, 19 nt, Homo sapiens
gcauauagaaucccaauua

SEQ ID NO: 1157405 - RNA, 19 nt, Homo sapiens
gaacugagggugauagaua

SEQ ID NO: 1157406 - RNA, 19 nt, Homo sapiens
gcacaccucugaauauauu

SEQ ID NO: 1157407 - RNA, 19 nt, Homo sapiens
gaaguagaguuaaccuaua

SEQ ID NO: 1157408 - RNA, 19 nt, Homo sapiens
ggacagauacuacaaauga

SEQ ID NO: 1157409 - RNA, 19 nt, Homo sapiens
gauaggaacccauuugaua

SEQ ID NO: 1157410 - RNA, 19 nt, Homo sapiens
gaagagguguugcauauag

SEQ ID NO: 1157411 - RNA, 19 nt, Homo sapiens
gaacucgccugagauagua

SEQ ID NO: 1157412 - RNA, 19 nt, Homo sapiens
gaccuucccuuucuucuaa

SEQ ID NO: 1157413 - RNA, 19 nt, Homo sapiens
gaaaugagucuaaguagga

SEQ ID NO: 1157414 - RNA, 19 nt, Homo sapiens
gaaauacccugagcuagug

SEQ ID NO: 1157415 - RNA, 19 nt, Homo sapiens
gagguaagguuucucuuga

SEQ ID NO: 1157416 - RNA, 19 nt, Homo sapiens
ugauaacgcuccugaguuu

SEQ ID NO: 1157417 - RNA, 19 nt, Homo sapiens
caacauaacagugcagaua

SEQ ID NO: 1157418 - RNA, 19 nt, Homo sapiens
gauggagucucguaaaguu

SEQ ID NO: 1157419 - RNA, 19 nt, Homo sapiens
ccagagaacucgccugaga

SEQ ID NO: 1157420 - RNA, 19 nt, Homo sapiens
agaggucccuguuauauuu

SEQ ID NO: 1157421 - RNA, 19 nt, Homo sapiens
ccgaagagguguugcauau

SEQ ID NO: 1157422 - RNA, 19 nt, Homo sapiens
ggagagagcacucgacaga

SEQ ID NO: 1157423 - RNA, 19 nt, Homo sapiens
ggagguaaauccuaugaca

SEQ ID NO: 1157424 - RNA, 19 nt, Homo sapiens
ugaaacuguucucauguua

SEQ ID NO: 1157425 - RNA, 19 nt, Homo sapiens
gacccaaccuugagauuug

SEQ ID NO: 1157426 - RNA, 19 nt, Homo sapiens
gagcuucuuucuagauauu

SEQ ID NO: 1157427 - RNA, 19 nt, Homo sapiens
gcagauaucagaugucaau

SEQ ID NO: 1157428 - RNA, 19 nt, Homo sapiens
ucgaaaugguuacgucuua

SEQ ID NO: 1157429 - RNA, 19 nt, Homo sapiens
acacgaaagucacaugaaa

SEQ ID NO: 1157430 - RNA, 19 nt, Homo sapiens
ggaaguagaguuaaccuau

SEQ ID NO: 1157431 - RNA, 19 nt, Homo sapiens
aggcaaagguauuauguaa

SEQ ID NO: 1157432 - RNA, 19 nt, Homo sapiens
gagaagccauuguaagaca

SEQ ID NO: 1157433 - RNA, 19 nt, Homo sapiens
ggaaauacccugagcuagu

SEQ ID NO: 1157434 - RNA, 19 nt, Homo sapiens
guaaauguguuuguguuug

SEQ ID NO: 1157435 - RNA, 19 nt, Homo sapiens
ugagaaagcaaguagauuu

SEQ ID NO: 1157436 - RNA, 19 nt, Homo sapiens
uaaguaggaaguagaguua

SEQ ID NO: 1157437 - RNA, 19 nt, Homo sapiens
gaagcaagagcugaauaua

SEQ ID NO: 1157438 - RNA, 19 nt, Homo sapiens
gaguuaaccuauaguuuca

SEQ ID NO: 1157439 - RNA, 19 nt, Homo sapiens
ccaacucgcucacugucua

SEQ ID NO: 1157440 - RNA, 19 nt, Homo sapiens
cuauauagguaccaugaaa

SEQ ID NO: 1157441 - RNA, 19 nt, Homo sapiens
aaucagaggucccuguuau

SEQ ID NO: 1157442 - RNA, 19 nt, Homo sapiens
caacagcauuaaacaguca

SEQ ID NO: 1157443 - RNA, 19 nt, Homo sapiens
uguauucuaugucugguua

SEQ ID NO: 1157444 - RNA, 19 nt, Homo sapiens
gagaacggguacggugaua

SEQ ID NO: 1157445 - RNA, 19 nt, Homo sapiens
gcaagagcugaauauaaua

SEQ ID NO: 1157446 - RNA, 19 nt, Homo sapiens
agcaagagcugaauauaau

SEQ ID NO: 1157447 - RNA, 19 nt, Homo sapiens
gaacuaccacugauugcaa

SEQ ID NO: 1157448 - RNA, 19 nt, Homo sapiens
ucaaagagacauuuacaug

SEQ ID NO: 1157449 - RNA, 19 nt, Homo sapiens
cgugccauauccauuauua

SEQ ID NO: 1157450 - RNA, 19 nt, Homo sapiens
gaacugcucagguccguau

SEQ ID NO: 1157451 - RNA, 19 nt, Homo sapiens
cuacgugccauauccauua

SEQ ID NO: 1157452 - RNA, 19 nt, Homo sapiens
gaaucaugcuuuggacuug

SEQ ID NO: 1157453 - RNA, 19 nt, Homo sapiens
aaaugacagucuucucuuu

SEQ ID NO: 1157454 - RNA, 19 nt, Homo sapiens
gugaaacuguucucauguu

SEQ ID NO: 1157455 - RNA, 19 nt, Homo sapiens
cggguacggugauaauuaa

SEQ ID NO: 1157456 - RNA, 19 nt, Homo sapiens
gaacggguacggugauaau

SEQ ID NO: 1157457 - RNA, 19 nt, Homo sapiens
gcuaacaacucaaucucau

SEQ ID NO: 1157458 - RNA, 19 nt, Homo sapiens
gcauguauuaggcauauuu

SEQ ID NO: 1157459 - RNA, 19 nt, Homo sapiens
aaagagacauuuacauggu

SEQ ID NO: 1157460 - RNA, 19 nt, Homo sapiens
gacagggucuuacucuugu

SEQ ID NO: 1157461 - RNA, 19 nt, Homo sapiens
ucauguuacuucucaguuu

SEQ ID NO: 1157462 - RNA, 19 nt, Homo sapiens
uaacagugcagauaucaga

SEQ ID NO: 1157463 - RNA, 19 nt, Homo sapiens
gagaagcaagagcugaaua

SEQ ID NO: 1157464 - RNA, 19 nt, Homo sapiens
agagagcacucgacagaga

SEQ ID NO: 1157465 - RNA, 19 nt, Homo sapiens
cauacuacauuuccaagug

SEQ ID NO: 1157466 - RNA, 19 nt, Homo sapiens
ugacagucuucucuuugua

SEQ ID NO: 1157467 - RNA, 19 nt, Homo sapiens
aagcaagagcugaauauaa

SEQ ID NO: 1157468 - RNA, 19 nt, Homo sapiens
ucaggaaagugcacucuuc

SEQ ID NO: 1157469 - RNA, 19 nt, Homo sapiens
gagccucaacuaagauuaa

SEQ ID NO: 1157470 - RNA, 19 nt, Homo sapiens
ggaugcacaccucugaaua

SEQ ID NO: 1157471 - RNA, 19 nt, Homo sapiens
uaaccagccuuaucuaaaa

SEQ ID NO: 1157472 - RNA, 19 nt, Homo sapiens
uaaccuguugcauguauua

SEQ ID NO: 1157473 - RNA, 19 nt, Homo sapiens
guaggaagcaauaauguuc

SEQ ID NO: 1157474 - RNA, 19 nt, Homo sapiens
ggacguaggaagcaauaau

SEQ ID NO: 1157475 - RNA, 19 nt, Homo sapiens
gaaaauagaacucaguguu

SEQ ID NO: 1157476 - RNA, 19 nt, Homo sapiens
ucaggucgcuggacuacga

SEQ ID NO: 1157477 - RNA, 19 nt, Homo sapiens
gaaaacggagcacaacaua

SEQ ID NO: 1157478 - RNA, 19 nt, Homo sapiens
ucuaauccaugaauucaga

SEQ ID NO: 1157479 - RNA, 19 nt, Homo sapiens
gacagauacuacaaaugaa

SEQ ID NO: 1157480 - RNA, 19 nt, Homo sapiens
guucucauguuacuucaga

SEQ ID NO: 1157481 - RNA, 19 nt, Homo sapiens
aaguugagcuucuuucuag

SEQ ID NO: 1157482 - RNA, 19 nt, Homo sapiens
aaaauaaccuguugcaugu

SEQ ID NO: 1157483 - RNA, 19 nt, Homo sapiens
ucacaauagcuuuggauuu

SEQ ID NO: 1157484 - RNA, 19 nt, Homo sapiens
gcacuaggaaagaaauaga

SEQ ID NO: 1157485 - RNA, 19 nt, Homo sapiens
gugcagauaucagauguca

SEQ ID NO: 1157486 - RNA, 19 nt, Homo sapiens
gagcgaacgugagugugaa

SEQ ID NO: 1157487 - RNA, 19 nt, Homo sapiens
acacacacacauauguuua

SEQ ID NO: 1157488 - RNA, 19 nt, Homo sapiens
aagagaagccauuguaaga

SEQ ID NO: 1157489 - RNA, 19 nt, Homo sapiens
gguuacgucuuaugaagug

SEQ ID NO: 1157490 - RNA, 19 nt, Homo sapiens
gaaaugguuacgucuuaug

SEQ ID NO: 1157491 - RNA, 19 nt, Homo sapiens
ggugauagauauaaaugac

SEQ ID NO: 1157492 - RNA, 19 nt, Homo sapiens
cuaaguguguauucuaugu

SEQ ID NO: 1157493 - RNA, 19 nt, Homo sapiens
gaugcacaccucugaauau

SEQ ID NO: 1157494 - RNA, 19 nt, Homo sapiens
uuuaauggcuaacaacuca

SEQ ID NO: 1157495 - RNA, 19 nt, Homo sapiens
caccaugccuggcuaaucu

SEQ ID NO: 1157496 - RNA, 19 nt, Homo sapiens
aaacaagugaguucaaguu

SEQ ID NO: 1157497 - RNA, 19 nt, Homo sapiens
gacaggaggcucagaaaca

SEQ ID NO: 1157498 - RNA, 19 nt, Homo sapiens
gauaguaguugcuguuuuc

SEQ ID NO: 1157499 - RNA, 19 nt, Homo sapiens
gagcuaguguuggauaaag

SEQ ID NO: 1157500 - RNA, 19 nt, Homo sapiens
ccuauaguuucauuucuug

SEQ ID NO: 1157501 - RNA, 19 nt, Homo sapiens
gaaacaaugggaagacgau

SEQ ID NO: 1157502 - RNA, 19 nt, Homo sapiens
gaacaagugugauugcaaa

SEQ ID NO: 1157503 - RNA, 19 nt, Homo sapiens
caagacaccggaagaaaua

SEQ ID NO: 1157504 - RNA, 19 nt, Homo sapiens
gaugaagaccucagugaua

SEQ ID NO: 1157505 - RNA, 19 nt, Homo sapiens
gaacuggaauguacguugu

SEQ ID NO: 1157506 - RNA, 19 nt, Homo sapiens
ugauaagacuugaggauuu

SEQ ID NO: 1157507 - RNA, 19 nt, Homo sapiens
guaagaagauaugaaguug

SEQ ID NO: 1157508 - RNA, 19 nt, Homo sapiens
ccaugaggaugcacacuua

SEQ ID NO: 1157509 - RNA, 19 nt, Homo sapiens
gaaguuaacagacucaugu

SEQ ID NO: 1157510 - RNA, 19 nt, Homo sapiens
ugaaagggcuguuuaucug

SEQ ID NO: 1157511 - RNA, 19 nt, Homo sapiens
gcucagugcuggucaagau

SEQ ID NO: 1157512 - RNA, 19 nt, Homo sapiens
gaggaugcacacuuauuua

SEQ ID NO: 1157513 - RNA, 19 nt, Homo sapiens
cggaagaaauagaaagauu

SEQ ID NO: 1157514 - RNA, 19 nt, Homo sapiens
ggaagaaauagaaagauug

SEQ ID NO: 1157515 - RNA, 19 nt, Homo sapiens
uugcaucucuuggaaguua

SEQ ID NO: 1157516 - RNA, 19 nt, Homo sapiens
aagaagauaugaaguugga

SEQ ID NO: 1157517 - RNA, 19 nt, Homo sapiens
gaagaccucagugauauug

SEQ ID NO: 1157518 - RNA, 19 nt, Homo sapiens
gaagucagcacaacaagag

SEQ ID NO: 1157519 - RNA, 19 nt, Homo sapiens
caugugaacuggaauguac

SEQ ID NO: 1157520 - RNA, 19 nt, Homo sapiens
gccaagagccggagaaagu

SEQ ID NO: 1157521 - RNA, 19 nt, Homo sapiens
agaauugcaucucuuggaa

SEQ ID NO: 1157522 - RNA, 19 nt, Homo sapiens
gggcagaauugcaucucuu

SEQ ID NO: 1157523 - RNA, 19 nt, Homo sapiens
ccaggacuuuaaugacuuu

SEQ ID NO: 1157524 - RNA, 19 nt, Homo sapiens
ccaaggaacaagugugauu

SEQ ID NO: 1157525 - RNA, 19 nt, Homo sapiens
agacucaugugaacuggaa

SEQ ID NO: 1157526 - RNA, 19 nt, Homo sapiens
gauaagacuugaggauuuu

SEQ ID NO: 1157527 - RNA, 19 nt, Homo sapiens
gauugacagucgaugaaga

SEQ ID NO: 1157528 - RNA, 19 nt, Homo sapiens
uaaaagcugugccuucuga

SEQ ID NO: 1157529 - RNA, 19 nt, Homo sapiens
ugaggaugcacacuuauuu

SEQ ID NO: 1157530 - RNA, 19 nt, Homo sapiens
gcgauggauuucagucaga

SEQ ID NO: 1157531 - RNA, 19 nt, Homo sapiens
acacuuauuuauccagaga

SEQ ID NO: 1157532 - RNA, 19 nt, Homo sapiens
cgacagaaucccacugaga

SEQ ID NO: 1157533 - RNA, 19 nt, Homo sapiens
aaacccaggacuuuaauga

SEQ ID NO: 1157534 - RNA, 19 nt, Homo sapiens
guacaaaacccaggacuuu

SEQ ID NO: 1157535 - RNA, 19 nt, Homo sapiens
gaugcacacuuauuuaucc

SEQ ID NO: 1157536 - RNA, 19 nt, Homo sapiens
ggaacaagugugauugcaa

SEQ ID NO: 1157537 - RNA, 19 nt, Homo sapiens
guuaacagacucaugugaa

SEQ ID NO: 1157538 - RNA, 19 nt, Homo sapiens
ucaagacaccggaagaaau

SEQ ID NO: 1157539 - RNA, 19 nt, Homo sapiens
cuucucauguucuuccuuu

SEQ ID NO: 1157540 - RNA, 19 nt, Homo sapiens
caaaauaguuggggcaaau

SEQ ID NO: 1157541 - RNA, 19 nt, Homo sapiens
caaauccugauaagacuug

SEQ ID NO: 1157542 - RNA, 19 nt, Homo sapiens
agaccucagugauauugaa

SEQ ID NO: 1157543 - RNA, 19 nt, Homo sapiens
gauauugaaagggcuguuu

SEQ ID NO: 1157544 - RNA, 19 nt, Homo sapiens
augaagaccucagugauau

SEQ ID NO: 1157545 - RNA, 19 nt, Homo sapiens
aaacccaaauccugauaag

SEQ ID NO: 1157546 - RNA, 19 nt, Homo sapiens
caagauguccaaggaacaa

SEQ ID NO: 1157547 - RNA, 19 nt, Homo sapiens
gacagucccagauguugaa

SEQ ID NO: 1157548 - RNA, 19 nt, Homo sapiens
caaggaacaagugugauug

SEQ ID NO: 1157549 - RNA, 19 nt, Homo sapiens
ggaaguuaacagacucaug

SEQ ID NO: 1157550 - RNA, 19 nt, Homo sapiens
aaagauugacagucgauga

SEQ ID NO: 1157551 - RNA, 19 nt, Homo sapiens
aaaguuugcauacguacaa

SEQ ID NO: 1157552 - RNA, 19 nt, Homo sapiens
cucauguucuuccuuugua

SEQ ID NO: 1157553 - RNA, 19 nt, Homo sapiens
ggaugcacacuuauuuauc

SEQ ID NO: 1157554 - RNA, 19 nt, Homo sapiens
cagaauugcaucucuugga

SEQ ID NO: 1157555 - RNA, 19 nt, Homo sapiens
ggaggagaacacuuacugu

SEQ ID NO: 1157556 - RNA, 19 nt, Homo sapiens
ugcaggagcucaccaucau

SEQ ID NO: 1157557 - RNA, 19 nt, Homo sapiens
gugacucuguggaggagaa

SEQ ID NO: 1157558 - RNA, 19 nt, Homo sapiens
cauguucuuccuuuguaua

SEQ ID NO: 1157559 - RNA, 19 nt, Homo sapiens
cgauggauuucagucagaa

SEQ ID NO: 1157560 - RNA, 19 nt, Homo sapiens
gaucucacauauguuuguc

SEQ ID NO: 1157561 - RNA, 19 nt, Homo sapiens
guccaaggaacaaguguga

SEQ ID NO: 1157562 - RNA, 19 nt, Homo sapiens
uuaacagacucaugugaac

SEQ ID NO: 1157563 - RNA, 19 nt, Homo sapiens
ggaucucacauauguuugu

SEQ ID NO: 1157564 - RNA, 19 nt, Homo sapiens
gcaaaauaguuggggcaaa

SEQ ID NO: 1157565 - RNA, 19 nt, Homo sapiens
gaccucagugauauugaaa

SEQ ID NO: 1157566 - RNA, 19 nt, Homo sapiens
ccucagugauauugaaagg

SEQ ID NO: 1157567 - RNA, 19 nt, Homo sapiens
ggucaagauguccaaggaa

SEQ ID NO: 1157568 - RNA, 19 nt, Homo sapiens
cccaggacuuuaaugacuu

SEQ ID NO: 1157569 - RNA, 19 nt, Homo sapiens
acaguaagaagauaugaag

SEQ ID NO: 1157570 - RNA, 19 nt, Homo sapiens
ggagaguguugccaaaagu

SEQ ID NO: 1157571 - RNA, 19 nt, Homo sapiens
aaagcugugccuucugaaa

SEQ ID NO: 1157572 - RNA, 19 nt, Homo sapiens
ggcagaauugcaucucuug

SEQ ID NO: 1157573 - RNA, 19 nt, Homo sapiens
ugaagucagcacaacaaga

SEQ ID NO: 1157574 - RNA, 19 nt, Homo sapiens
cuguggaggagaacacuua

SEQ ID NO: 1157575 - RNA, 19 nt, Homo sapiens
aguccuuucuguuucuaaa

SEQ ID NO: 1157576 - RNA, 19 nt, Homo sapiens
uggucaagauguccaagga

SEQ ID NO: 1157577 - RNA, 19 nt, Homo sapiens
acaaaacccaggacuuuaa

SEQ ID NO: 1157578 - RNA, 19 nt, Homo sapiens
auauugaaagggcuguuua

SEQ ID NO: 1157579 - RNA, 19 nt, Homo sapiens
auaugaaguuggagagcuu

SEQ ID NO: 1157580 - RNA, 19 nt, Homo sapiens
gauguugaagucagcacaa

SEQ ID NO: 1157581 - RNA, 19 nt, Homo sapiens
gacaccggaagaaauagaa

SEQ ID NO: 1157582 - RNA, 19 nt, Homo sapiens
aauugcaucucuuggaagu

SEQ ID NO: 1157583 - RNA, 19 nt, Homo sapiens
aagauugacagucgaugaa

SEQ ID NO: 1157584 - RNA, 19 nt, Homo sapiens
ugaagaccucagugauauu

SEQ ID NO: 1157585 - RNA, 19 nt, Homo sapiens
ucauguucuuccuuuguau

SEQ ID NO: 1157586 - RNA, 19 nt, Homo sapiens
ucgaugaagaccucaguga

SEQ ID NO: 1157587 - RNA, 19 nt, Homo sapiens
cgaugaagaccucagugau

SEQ ID NO: 1157588 - RNA, 19 nt, Homo sapiens
gaacugugcuuauaacuuu

SEQ ID NO: 1157589 - RNA, 19 nt, Homo sapiens
ccacaaagauuucugguaa

SEQ ID NO: 1157590 - RNA, 19 nt, Homo sapiens
gaacaagugugauugcaaa

SEQ ID NO: 1157591 - RNA, 19 nt, Homo sapiens
ccagaaaucuuggaacuua

SEQ ID NO: 1157592 - RNA, 19 nt, Homo sapiens
caaauuagauucccuagga

SEQ ID NO: 1157593 - RNA, 19 nt, Homo sapiens
gaaguucgaucuuguaugu

SEQ ID NO: 1157594 - RNA, 19 nt, Homo sapiens
caaagaauguucacaauca

SEQ ID NO: 1157595 - RNA, 19 nt, Homo sapiens
caaagcagaugaaucaauu

SEQ ID NO: 1157596 - RNA, 19 nt, Homo sapiens
gguacuagaugcucuuaua

SEQ ID NO: 1157597 - RNA, 19 nt, Homo sapiens
uaucuaagcuucugaauuc

SEQ ID NO: 1157598 - RNA, 19 nt, Homo sapiens
ugagaaagauacugcauuu

SEQ ID NO: 1157599 - RNA, 19 nt, Homo sapiens
gaaagaaagagaagaacua

SEQ ID NO: 1157600 - RNA, 19 nt, Homo sapiens
gaaaccagccauuuaauug

SEQ ID NO: 1157601 - RNA, 19 nt, Homo sapiens
gcaggaaaccagccauuua

SEQ ID NO: 1157602 - RNA, 19 nt, Homo sapiens
caagcgaucagauuuauua

SEQ ID NO: 1157603 - RNA, 19 nt, Homo sapiens
gcaaucagcauauaacuau

SEQ ID NO: 1157604 - RNA, 19 nt, Homo sapiens
caagacaccggaagaaaua

SEQ ID NO: 1157605 - RNA, 19 nt, Homo sapiens
gaauuguccuagcuugaua

SEQ ID NO: 1157606 - RNA, 19 nt, Homo sapiens
gaugaagaccucagugaua

SEQ ID NO: 1157607 - RNA, 19 nt, Homo sapiens
uuacggaauuccaauguua

SEQ ID NO: 1157608 - RNA, 19 nt, Homo sapiens
cggaagaacugugcuuaua

SEQ ID NO: 1157609 - RNA, 19 nt, Homo sapiens
ggugcucccugaauuaaua

SEQ ID NO: 1157610 - RNA, 19 nt, Homo sapiens
gaauggaaaugucuaugga

SEQ ID NO: 1157611 - RNA, 19 nt, Homo sapiens
ggaagaacugugcuuauaa

SEQ ID NO: 1157612 - RNA, 19 nt, Homo sapiens
gaaacucuucugucuguua

SEQ ID NO: 1157613 - RNA, 19 nt, Homo sapiens
gaagauuccugcugauaag

SEQ ID NO: 1157614 - RNA, 19 nt, Homo sapiens
aaagugaaaucuacucuga

SEQ ID NO: 1157615 - RNA, 19 nt, Homo sapiens
agaaauacuuccucuggua

SEQ ID NO: 1157616 - RNA, 19 nt, Homo sapiens
ggaaaccagccauuuaauu

SEQ ID NO: 1157617 - RNA, 19 nt, Homo sapiens
aaugacagcugauguuaaa

SEQ ID NO: 1157618 - RNA, 19 nt, Homo sapiens
ggaaggcccaugagugaua

SEQ ID NO: 1157619 - RNA, 19 nt, Homo sapiens
gaucagcacuugagauuuu

SEQ ID NO: 1157620 - RNA, 19 nt, Homo sapiens
caagagcaguggaaguaaa

SEQ ID NO: 1157621 - RNA, 19 nt, Homo sapiens
ggaacucuauucuacauuc

SEQ ID NO: 1157622 - RNA, 19 nt, Homo sapiens
gaagaacugugcuuauaac

SEQ ID NO: 1157623 - RNA, 19 nt, Homo sapiens
gauacacuauugcuauuug

SEQ ID NO: 1157624 - RNA, 19 nt, Homo sapiens
ugaaagggcuguuuaucug

SEQ ID NO: 1157625 - RNA, 19 nt, Homo sapiens
ggauaccugugaauuuauu

SEQ ID NO: 1157626 - RNA, 19 nt, Homo sapiens
gaaagcaguguucaagaaa

SEQ ID NO: 1157627 - RNA, 19 nt, Homo sapiens
gaaauacuuccucugguaa

SEQ ID NO: 1157628 - RNA, 19 nt, Homo sapiens
ggacauucccaaauuuaaa

SEQ ID NO: 1157629 - RNA, 19 nt, Homo sapiens
agaaagcaguguucaagaa

SEQ ID NO: 1157630 - RNA, 19 nt, Homo sapiens
ugucaguucuugagauaua

SEQ ID NO: 1157631 - RNA, 19 nt, Homo sapiens
ccagucagauacacuauug

SEQ ID NO: 1157632 - RNA, 19 nt, Homo sapiens
gucaagauguagaauauga

SEQ ID NO: 1157633 - RNA, 19 nt, Homo sapiens
caacagcauuuauuuguac

SEQ ID NO: 1157634 - RNA, 19 nt, Homo sapiens
gagcagaaagagagacaua

SEQ ID NO: 1157635 - RNA, 19 nt, Homo sapiens
ggagauaaugugauuggua

SEQ ID NO: 1157636 - RNA, 19 nt, Homo sapiens
agagaaaugugcuaguaaa

SEQ ID NO: 1157637 - RNA, 19 nt, Homo sapiens
cuauugaacugacacauga

SEQ ID NO: 1157638 - RNA, 19 nt, Homo sapiens
gcucagugcuggucaagau

SEQ ID NO: 1157639 - RNA, 19 nt, Homo sapiens
cggaagaaauagaaagauu

SEQ ID NO: 1157640 - RNA, 19 nt, Homo sapiens
gaaggcccaugagugauaa

SEQ ID NO: 1157641 - RNA, 19 nt, Homo sapiens
gaauuccaauguuauagug

SEQ ID NO: 1157642 - RNA, 19 nt, Homo sapiens
ggaagaaauagaaagauug

SEQ ID NO: 1157643 - RNA, 19 nt, Homo sapiens
uuagagaaaugugcuagua

SEQ ID NO: 1157644 - RNA, 19 nt, Homo sapiens
gaaauggaacaauuagaga

SEQ ID NO: 1157645 - RNA, 19 nt, Homo sapiens
agaaagauuuguuggauca

SEQ ID NO: 1157646 - RNA, 19 nt, Homo sapiens
ggacuuggaaggugagaaa

SEQ ID NO: 1157647 - RNA, 19 nt, Homo sapiens
uuggauaccugugaauuua

SEQ ID NO: 1157648 - RNA, 19 nt, Homo sapiens
ggacgaaucagugucaauu

SEQ ID NO: 1157649 - RNA, 19 nt, Homo sapiens
uagaugcucuuauagauca

SEQ ID NO: 1157650 - RNA, 19 nt, Homo sapiens
gcaucuacuucagcaguua

SEQ ID NO: 1157651 - RNA, 19 nt, Homo sapiens
agaaagagagacauaauga

SEQ ID NO: 1157652 - RNA, 19 nt, Homo sapiens
ggaaauggaacaauuagag

SEQ ID NO: 1157653 - RNA, 19 nt, Homo sapiens
auaaagauguucuggcuau

SEQ ID NO: 1157654 - RNA, 19 nt, Homo sapiens
caggaaaccagccauuuaa

SEQ ID NO: 1157655 - RNA, 19 nt, Homo sapiens
ggaaacuccugugucaaga

SEQ ID NO: 1157656 - RNA, 19 nt, Homo sapiens
cagauacacuauugcuauu

SEQ ID NO: 1157657 - RNA, 19 nt, Homo sapiens
auugucagcuucucuauuu

SEQ ID NO: 1157658 - RNA, 19 nt, Homo sapiens
gauauaccgugugaagcua

SEQ ID NO: 1157659 - RNA, 19 nt, Homo sapiens
gaagaccucagugauauug

SEQ ID NO: 1157660 - RNA, 19 nt, Homo sapiens
gcagaaagagagacauaau

SEQ ID NO: 1157661 - RNA, 19 nt, Homo sapiens
aaacuccugugucaagaaa

SEQ ID NO: 1157662 - RNA, 19 nt, Homo sapiens
gcuggaaacucuucugucu

SEQ ID NO: 1157663 - RNA, 19 nt, Homo sapiens
ugagaaagauuuguuggau

SEQ ID NO: 1157664 - RNA, 19 nt, Homo sapiens
gagcaggagaagaaauaua

SEQ ID NO: 1157665 - RNA, 19 nt, Homo sapiens
gaaaauggacacaaugaaa

SEQ ID NO: 1157666 - RNA, 19 nt, Homo sapiens
gcacaacuuucccaaacag

SEQ ID NO: 1157667 - RNA, 19 nt, Homo sapiens
gcugcgaugucauuucuga

SEQ ID NO: 1157668 - RNA, 19 nt, Homo sapiens
gccaagagccggagaaagu

SEQ ID NO: 1157669 - RNA, 19 nt, Homo sapiens
gaaaugugcuaguaaaagu

SEQ ID NO: 1157670 - RNA, 19 nt, Homo sapiens
uagcaaaugugagaaugaa

SEQ ID NO: 1157671 - RNA, 19 nt, Homo sapiens
cgcaaagucugcccaagaa

SEQ ID NO: 1157672 - RNA, 19 nt, Homo sapiens
uaucaagcgaucagauuua

SEQ ID NO: 1157673 - RNA, 19 nt, Homo sapiens
aaugaugaaucuagucuga

SEQ ID NO: 1157674 - RNA, 19 nt, Homo sapiens
agaaagagaagaacuacuu

SEQ ID NO: 1157675 - RNA, 19 nt, Homo sapiens
ucacgaacucuaugcauuu

SEQ ID NO: 1157676 - RNA, 19 nt, Homo sapiens
ugaauccacuuguuuccaa

SEQ ID NO: 1157677 - RNA, 19 nt, Homo sapiens
uggaaacucuucugucugu

SEQ ID NO: 1157678 - RNA, 19 nt, Homo sapiens
aaaugucuauggaugcuuu

SEQ ID NO: 1157679 - RNA, 19 nt, Homo sapiens
ugaagauuccugcugauaa

SEQ ID NO: 1157680 - RNA, 19 nt, Homo sapiens
ggagaaagcaguguucaag

SEQ ID NO: 1157681 - RNA, 19 nt, Homo sapiens
uagagcaggagaagaaaua

SEQ ID NO: 1157682 - RNA, 19 nt, Homo sapiens
aaauuugccuguggaauau

SEQ ID NO: 1157683 - RNA, 19 nt, Homo sapiens
caaauagccgucugcgauu

SEQ ID NO: 1157684 - RNA, 19 nt, Homo sapiens
gaaacuuugcuaccuguug

SEQ ID NO: 1157685 - RNA, 19 nt, Homo sapiens
gaaugaaacuuugcuaccu

SEQ ID NO: 1157686 - RNA, 19 nt, Homo sapiens
gagcugcagccucuuuaaa

SEQ ID NO: 1157687 - RNA, 19 nt, Homo sapiens
ucugaauucuggaguauau

SEQ ID NO: 1157688 - RNA, 19 nt, Homo sapiens
gaaguacaguggauucaaa

SEQ ID NO: 1157689 - RNA, 19 nt, Homo sapiens
gcacauccuuucugauaaa

SEQ ID NO: 1157690 - RNA, 19 nt, Homo sapiens
ggaugugacuauuggauuu

SEQ ID NO: 1157691 - RNA, 19 nt, Homo sapiens
gaaaagaauugccaaguga

SEQ ID NO: 1157692 - RNA, 19 nt, Homo sapiens
gaagugagguaagaguaaa

SEQ ID NO: 1157693 - RNA, 19 nt, Homo sapiens
gaaggacucucuauuucug

SEQ ID NO: 1157694 - RNA, 19 nt, Homo sapiens
gggaccaucuggauucaua

SEQ ID NO: 1157695 - RNA, 19 nt, Homo sapiens
gcagugcucucuucucuca

SEQ ID NO: 1157696 - RNA, 19 nt, Homo sapiens
ggagauggcuauguguaaa

SEQ ID NO: 1157697 - RNA, 19 nt, Homo sapiens
gaacaccuuuggcuucuuc

SEQ ID NO: 1157698 - RNA, 19 nt, Homo sapiens
caaaauagaugugucagua

SEQ ID NO: 1157699 - RNA, 19 nt, Homo sapiens
ggugacugcugcuuauuaa

SEQ ID NO: 1157700 - RNA, 19 nt, Homo sapiens
guucugggcuuauuugaau

SEQ ID NO: 1157701 - RNA, 19 nt, Homo sapiens
gaaaugguugugcccuuua

SEQ ID NO: 1157702 - RNA, 19 nt, Homo sapiens
gaaugagccugaagacaag

SEQ ID NO: 1157703 - RNA, 19 nt, Homo sapiens
agaaggagguguugaguca

SEQ ID NO: 1157704 - RNA, 19 nt, Homo sapiens
gccaggagccuaauguuaa

SEQ ID NO: 1157705 - RNA, 19 nt, Homo sapiens
gaaggccuuuacagucuuu

SEQ ID NO: 1157706 - RNA, 19 nt, Homo sapiens
aagaaaagcugcaaagaaa

SEQ ID NO: 1157707 - RNA, 19 nt, Homo sapiens
ugaaugagccugaagacaa

SEQ ID NO: 1157708 - RNA, 19 nt, Homo sapiens
aagcacauccuuucugaua

SEQ ID NO: 1157709 - RNA, 19 nt, Homo sapiens
cuagacaucuccagaagug

SEQ ID NO: 1157710 - RNA, 19 nt, Homo sapiens
gauuggagauggcuaugug

SEQ ID NO: 1157711 - RNA, 19 nt, Homo sapiens
gaacaggagggauaaugga

SEQ ID NO: 1157712 - RNA, 19 nt, Homo sapiens
guggaaggacucucuauuu

SEQ ID NO: 1157713 - RNA, 19 nt, Homo sapiens
gaagaugugaauuacugua

SEQ ID NO: 1157714 - RNA, 19 nt, Homo sapiens
gaagaaaagcugcaaagaa

SEQ ID NO: 1157715 - RNA, 19 nt, Homo sapiens
ugaaaugguugugcccuuu

SEQ ID NO: 1157716 - RNA, 19 nt, Homo sapiens
caagugacaaguuuacauu

SEQ ID NO: 1157717 - RNA, 19 nt, Homo sapiens
ggaugaagaugugaauuac

SEQ ID NO: 1157718 - RNA, 19 nt, Homo sapiens
agucaugccuccuaaauca

SEQ ID NO: 1157719 - RNA, 19 nt, Homo sapiens
caggagggauaauggauug

SEQ ID NO: 1157720 - RNA, 19 nt, Homo sapiens
uggaaggacucucuauuuc

SEQ ID NO: 1157721 - RNA, 19 nt, Homo sapiens
uuaagcacauccuuucuga

SEQ ID NO: 1157722 - RNA, 19 nt, Homo sapiens
ggaaaagaauugccaagug

SEQ ID NO: 1157723 - RNA, 19 nt, Homo sapiens
uggaugaagaugugaauua

SEQ ID NO: 1157724 - RNA, 19 nt, Homo sapiens
agacaaggaugugacuauu

SEQ ID NO: 1157725 - RNA, 19 nt, Homo sapiens
ccagugguguggucaauca

SEQ ID NO: 1157726 - RNA, 19 nt, Homo sapiens
gacacaagaugguggaaag

SEQ ID NO: 1157727 - RNA, 19 nt, Homo sapiens
gaaugucaguagccucuca

SEQ ID NO: 1157728 - RNA, 19 nt, Homo sapiens
agaaggauccugacagcua

SEQ ID NO: 1157729 - RNA, 19 nt, Homo sapiens
ugagucaguuguauaagga

SEQ ID NO: 1157730 - RNA, 19 nt, Homo sapiens
uuucauaaaugccuuggaa

SEQ ID NO: 1157731 - RNA, 19 nt, Homo sapiens
cagcacugaugaccaagaa

SEQ ID NO: 1157732 - RNA, 19 nt, Homo sapiens
caaaggccaugggagagaa

SEQ ID NO: 1157733 - RNA, 19 nt, Homo sapiens
gagaaaguccuuggucaga

SEQ ID NO: 1157734 - RNA, 19 nt, Homo sapiens
aguaaagucuccaccagaa

SEQ ID NO: 1157735 - RNA, 19 nt, Homo sapiens
gacggaaugauguauuuaa

SEQ ID NO: 1157736 - RNA, 19 nt, Homo sapiens
gggugacugcugcuuauua

SEQ ID NO: 1157737 - RNA, 19 nt, Homo sapiens
ccaagaaggccuuuacagu

SEQ ID NO: 1157738 - RNA, 19 nt, Homo sapiens
gaugugaggcauaaaguuc

SEQ ID NO: 1157739 - RNA, 19 nt, Homo sapiens
acaaggaugugacuauugg

SEQ ID NO: 1157740 - RNA, 19 nt, Homo sapiens
uagccuacaucaucauaga

SEQ ID NO: 1157741 - RNA, 19 nt, Homo sapiens
gaugugacuauuggauuua

SEQ ID NO: 1157742 - RNA, 19 nt, Homo sapiens
gaaaacuaccugauauuga

SEQ ID NO: 1157743 - RNA, 19 nt, Homo sapiens
uaaagcaagacucugauga

SEQ ID NO: 1157744 - RNA, 19 nt, Homo sapiens
ggaaggacucucuauuucu

SEQ ID NO: 1157745 - RNA, 19 nt, Homo sapiens
ggagggcacgacugaauau

SEQ ID NO: 1157746 - RNA, 19 nt, Homo sapiens
gaggagggcacgacugaau

SEQ ID NO: 1157747 - RNA, 19 nt, Homo sapiens
auauugagaucacagagaa

SEQ ID NO: 1157748 - RNA, 19 nt, Homo sapiens
aagaaggccuuuacagucu

SEQ ID NO: 1157749 - RNA, 19 nt, Homo sapiens
caguguggauauuaacauu

SEQ ID NO: 1157750 - RNA, 19 nt, Homo sapiens
cacccaguguggauauuaa

SEQ ID NO: 1157751 - RNA, 19 nt, Homo sapiens
gagaacaggagggauaaug

SEQ ID NO: 1157752 - RNA, 19 nt, Homo sapiens
cauucagccuugauauuga

SEQ ID NO: 1157753 - RNA, 19 nt, Homo sapiens
ggcagugucauuucaguuu

SEQ ID NO: 1157754 - RNA, 19 nt, Homo sapiens
acacuucgcugugagaaca

SEQ ID NO: 1157755 - RNA, 19 nt, Homo sapiens
agauaacacuucgcuguga

SEQ ID NO: 1157756 - RNA, 19 nt, Homo sapiens
uggcugggcuuucauuaag

SEQ ID NO: 1157757 - RNA, 19 nt, Homo sapiens
acgacggaaugauguauuu

SEQ ID NO: 1157758 - RNA, 19 nt, Homo sapiens
gauauugagaucacagaga

SEQ ID NO: 1157759 - RNA, 19 nt, Homo sapiens
gaaaagcugcaaagaaaau

SEQ ID NO: 1157760 - RNA, 19 nt, Homo sapiens
gacaaggaugugacuauug

SEQ ID NO: 1157761 - RNA, 19 nt, Homo sapiens
cagcagggaugagaaaguc

SEQ ID NO: 1157762 - RNA, 19 nt, Homo sapiens
guacccaguuaccaaagau

SEQ ID NO: 1157763 - RNA, 19 nt, Homo sapiens
cuggauccaugguaucgua

SEQ ID NO: 1157764 - RNA, 19 nt, Homo sapiens
uagcacaagugagaauuuc

SEQ ID NO: 1157765 - RNA, 19 nt, Homo sapiens
gguggaaagucuaaaagaa

SEQ ID NO: 1157766 - RNA, 19 nt, Homo sapiens
aggaugaugugaggcauaa

SEQ ID NO: 1157767 - RNA, 19 nt, Homo sapiens
cagaagugagguaagagua

SEQ ID NO: 1157768 - RNA, 19 nt, Homo sapiens
ccuccuaaaucagaagaaa

SEQ ID NO: 1157769 - RNA, 19 nt, Homo sapiens
gguguugagucaguuguau

SEQ ID NO: 1157770 - RNA, 19 nt, Homo sapiens
caagaugguggaaagucua

SEQ ID NO: 1157771 - RNA, 19 nt, Homo sapiens
gaugugucaguauucauuu

SEQ ID NO: 1157772 - RNA, 19 nt, Homo sapiens
agcccugccugcugauuua

SEQ ID NO: 1157773 - RNA, 19 nt, Homo sapiens
gccuuuacagucuuuauuu

SEQ ID NO: 1157774 - RNA, 19 nt, Homo sapiens
agaagugagguaagaguaa

SEQ ID NO: 1157775 - RNA, 19 nt, Homo sapiens
gaagacaaggaugugacua

SEQ ID NO: 1157776 - RNA, 19 nt, Homo sapiens
ugugagaacaggagggaua

SEQ ID NO: 1157777 - RNA, 19 nt, Homo sapiens
cgacggaaugauguauuua

SEQ ID NO: 1157778 - RNA, 19 nt, Homo sapiens
gccuagaccguacaaagaa

SEQ ID NO: 1157779 - RNA, 19 nt, Homo sapiens
uaaaugccuuggaaaagaa

SEQ ID NO: 1157780 - RNA, 19 nt, Homo sapiens
uaaaagaaguacaguggau

SEQ ID NO: 1157781 - RNA, 19 nt, Homo sapiens
augaagaugugaauuacug

SEQ ID NO: 1157782 - RNA, 19 nt, Homo sapiens
gaccacaaggguuuaagga

SEQ ID NO: 1157783 - RNA, 19 nt, Homo sapiens
gagaauuucagaccacaag

SEQ ID NO: 1157784 - RNA, 19 nt, Homo sapiens
aagcaagacucugaugaca

SEQ ID NO: 1157785 - RNA, 19 nt, Homo sapiens
uuaccuggaugaagaugug

SEQ ID NO: 1157786 - RNA, 19 nt, Homo sapiens
gcagugucauuucaguuuu

SEQ ID NO: 1157787 - RNA, 19 nt, Homo sapiens
ugccauagcacaagugaga

SEQ ID NO: 1157788 - RNA, 19 nt, Homo sapiens
gaagaaagguuggauaaga

SEQ ID NO: 1157789 - RNA, 19 nt, Homo sapiens
gcaccucgaucauuuauuu

SEQ ID NO: 1157790 - RNA, 19 nt, Homo sapiens
gcuaaaggaugaguuaaua

SEQ ID NO: 1157791 - RNA, 19 nt, Homo sapiens
ggacauagaccucagaauu

SEQ ID NO: 1157792 - RNA, 19 nt, Homo sapiens
gaccaacgcuuacaaauag

SEQ ID NO: 1157793 - RNA, 19 nt, Homo sapiens
gaacuaacacccaaauuug

SEQ ID NO: 1157794 - RNA, 19 nt, Homo sapiens
ccucuaaccuucuuuauug

SEQ ID NO: 1157795 - RNA, 19 nt, Homo sapiens
ggaccaacgcuuacaaaua

SEQ ID NO: 1157796 - RNA, 19 nt, Homo sapiens
cagaagaugugaagauauu

SEQ ID NO: 1157797 - RNA, 19 nt, Homo sapiens
gggaugauauuaugaaguu

SEQ ID NO: 1157798 - RNA, 19 nt, Homo sapiens
ucaaguagcuucaucuuca

SEQ ID NO: 1157799 - RNA, 19 nt, Homo sapiens
gcacuuugcuuuaauuucu

SEQ ID NO: 1157800 - RNA, 19 nt, Homo sapiens
ggaagaguguguuuacgaa

SEQ ID NO: 1157801 - RNA, 19 nt, Homo sapiens
gaacuuagcaggcagacuu

SEQ ID NO: 1157802 - RNA, 19 nt, Homo sapiens
cagcauuggugccguguua

SEQ ID NO: 1157803 - RNA, 19 nt, Homo sapiens
gaaagaagagauagaacuu

SEQ ID NO: 1157804 - RNA, 19 nt, Homo sapiens
agaaauugcugaaacaaga

SEQ ID NO: 1157805 - RNA, 19 nt, Homo sapiens
caacuacaaugcagaaaca

SEQ ID NO: 1157806 - RNA, 19 nt, Homo sapiens
gacauagaccucagaauuu

SEQ ID NO: 1157807 - RNA, 19 nt, Homo sapiens
gaauggaacaacucaagua

SEQ ID NO: 1157808 - RNA, 19 nt, Homo sapiens
ggaagaauauaaggaugaa

SEQ ID NO: 1157809 - RNA, 19 nt, Homo sapiens
gagagaaauugcugaaaca

SEQ ID NO: 1157810 - RNA, 19 nt, Homo sapiens
gaaacuggcaucacugcua

SEQ ID NO: 1157811 - RNA, 19 nt, Homo sapiens
agagacagaugaagacaaa

SEQ ID NO: 1157812 - RNA, 19 nt, Homo sapiens
guacuuacaagccgauaua

SEQ ID NO: 1157813 - RNA, 19 nt, Homo sapiens
uggaagagauaguacaauu

SEQ ID NO: 1157814 - RNA, 19 nt, Homo sapiens
gauagacuucagcuaauua

SEQ ID NO: 1157815 - RNA, 19 nt, Homo sapiens
aaacuggcaucacugcuaa

SEQ ID NO: 1157816 - RNA, 19 nt, Homo sapiens
gcaaagaugagcagagaga

SEQ ID NO: 1157817 - RNA, 19 nt, Homo sapiens
ucucugagcugcaagaaug

SEQ ID NO: 1157818 - RNA, 19 nt, Homo sapiens
ugaagaauauccuaaacug

SEQ ID NO: 1157819 - RNA, 19 nt, Homo sapiens
uacagaagaugugaagaua

SEQ ID NO: 1157820 - RNA, 19 nt, Homo sapiens
ggacuugggaugauauuau

SEQ ID NO: 1157821 - RNA, 19 nt, Homo sapiens
gacuucagcuaauuacaaa

SEQ ID NO: 1157822 - RNA, 19 nt, Homo sapiens
agacuuaacuuuagaacuc

SEQ ID NO: 1157823 - RNA, 19 nt, Homo sapiens
gacagggccuugauagaau

SEQ ID NO: 1157824 - RNA, 19 nt, Homo sapiens
gaagaaaauuugccauaug

SEQ ID NO: 1157825 - RNA, 19 nt, Homo sapiens
agaaacauaugcauccuau

SEQ ID NO: 1157826 - RNA, 19 nt, Homo sapiens
ggacuucauucaugcuaau

SEQ ID NO: 1157827 - RNA, 19 nt, Homo sapiens
gaaagugccgacagcauug

SEQ ID NO: 1157828 - RNA, 19 nt, Homo sapiens
cacuggagauugacaagua

SEQ ID NO: 1157829 - RNA, 19 nt, Homo sapiens
agaguucacuggagauuga

SEQ ID NO: 1157830 - RNA, 19 nt, Homo sapiens
gaagaugugaagauauuug

SEQ ID NO: 1157831 - RNA, 19 nt, Homo sapiens
gaagaauauccuaaacuga

SEQ ID NO: 1157832 - RNA, 19 nt, Homo sapiens
agguuuagcugacagauuu

SEQ ID NO: 1157833 - RNA, 19 nt, Homo sapiens
uagcaaagaugagcagaga

SEQ ID NO: 1157834 - RNA, 19 nt, Homo sapiens
gaauagaguuggaaaagau

SEQ ID NO: 1157835 - RNA, 19 nt, Homo sapiens
gaggauacucuguucguaa

SEQ ID NO: 1157836 - RNA, 19 nt, Homo sapiens
agaacuaacacccaaauuu

SEQ ID NO: 1157837 - RNA, 19 nt, Homo sapiens
gauccagucugugguauca

SEQ ID NO: 1157838 - RNA, 19 nt, Homo sapiens
uggcaucacugcuaaugaa

SEQ ID NO: 1157839 - RNA, 19 nt, Homo sapiens
gaacacagagcuuaaaucc

SEQ ID NO: 1157840 - RNA, 19 nt, Homo sapiens
acaaauagcaacuacaaug

SEQ ID NO: 1157841 - RNA, 19 nt, Homo sapiens
ugacagggccuugauagaa

SEQ ID NO: 1157842 - RNA, 19 nt, Homo sapiens
cagaagaaauugagagacu

SEQ ID NO: 1157843 - RNA, 19 nt, Homo sapiens
gaugugaagauauuuguug

SEQ ID NO: 1157844 - RNA, 19 nt, Homo sapiens
gaagagauagaacuuagca

SEQ ID NO: 1157845 - RNA, 19 nt, Homo sapiens
caacucaaguagcuucauc

SEQ ID NO: 1157846 - RNA, 19 nt, Homo sapiens
gaacagaauggaacaacuc

SEQ ID NO: 1157847 - RNA, 19 nt, Homo sapiens
gcugacagauuugaagaau

SEQ ID NO: 1157848 - RNA, 19 nt, Homo sapiens
gaagaagagauuuacaaag

SEQ ID NO: 1157849 - RNA, 19 nt, Homo sapiens
aagaagagauagaacuuag

SEQ ID NO: 1157850 - RNA, 19 nt, Homo sapiens
ccaccucgauaauuguuga

SEQ ID NO: 1157851 - RNA, 19 nt, Homo sapiens
cgagaaagaaauagaucua

SEQ ID NO: 1157852 - RNA, 19 nt, Homo sapiens
gaagagauaguacaauucg

SEQ ID NO: 1157853 - RNA, 19 nt, Homo sapiens
cagaagaaccugaaauugg

SEQ ID NO: 1157854 - RNA, 19 nt, Homo sapiens
guaagcucccggugaauuu

SEQ ID NO: 1157855 - RNA, 19 nt, Homo sapiens
uauagaagccuuugacauc

SEQ ID NO: 1157856 - RNA, 19 nt, Homo sapiens
gcagagagaaauugcugaa

SEQ ID NO: 1157857 - RNA, 19 nt, Homo sapiens
ugaagacauugaaccuauu

SEQ ID NO: 1157858 - RNA, 19 nt, Homo sapiens
gcuccuaauuccuacuuga

SEQ ID NO: 1157859 - RNA, 19 nt, Homo sapiens
caaguacucgggauaguga

SEQ ID NO: 1157860 - RNA, 19 nt, Homo sapiens
gcagcaccucgaucauuua

SEQ ID NO: 1157861 - RNA, 19 nt, Homo sapiens
cagagaaacuggcaucacu

SEQ ID NO: 1157862 - RNA, 19 nt, Homo sapiens
gcaacaggaugaagaaaau

SEQ ID NO: 1157863 - RNA, 19 nt, Homo sapiens
ugauagacuucagcuaauu

SEQ ID NO: 1157864 - RNA, 19 nt, Homo sapiens
cagcuugcacuuugcuuua

SEQ ID NO: 1157865 - RNA, 19 nt, Homo sapiens
gaagaguguguuuacgaaa

SEQ ID NO: 1157866 - RNA, 19 nt, Homo sapiens
gacuugggaugauauuaug

SEQ ID NO: 1157867 - RNA, 19 nt, Homo sapiens
acagggccuugauagaaua

SEQ ID NO: 1157868 - RNA, 19 nt, Homo sapiens
gagccuugcuugcaguugu

SEQ ID NO: 1157869 - RNA, 19 nt, Homo sapiens
ggaagagauaguacaauuc

SEQ ID NO: 1157870 - RNA, 19 nt, Homo sapiens
cggaagaaagguuggauaa

SEQ ID NO: 1157871 - RNA, 19 nt, Homo sapiens
aaggaugaguuaauagcua

SEQ ID NO: 1157872 - RNA, 19 nt, Homo sapiens
ugaaagugccgacagcauu

SEQ ID NO: 1157873 - RNA, 19 nt, Homo sapiens
gaagacauugaaccuauuc

SEQ ID NO: 1157874 - RNA, 19 nt, Homo sapiens
acacagagguggcuuucca

SEQ ID NO: 1157875 - RNA, 19 nt, Homo sapiens
ggacgagaaagaaauagau

SEQ ID NO: 1157876 - RNA, 19 nt, Homo sapiens
cuacaaugcagaaacauau

SEQ ID NO: 1157877 - RNA, 19 nt, Homo sapiens
cacagaagaaccugaaauu

SEQ ID NO: 1157878 - RNA, 19 nt, Homo sapiens
gugaagauauuuguuggau

SEQ ID NO: 1157879 - RNA, 19 nt, Homo sapiens
ugcagcaccucgaucauuu

SEQ ID NO: 1157880 - RNA, 19 nt, Homo sapiens
acauagaccucagaauuuc

SEQ ID NO: 1157881 - RNA, 19 nt, Homo sapiens
uguagacacuggacauaga

SEQ ID NO: 1157882 - RNA, 19 nt, Homo sapiens
gauagaauagaguuggaaa

SEQ ID NO: 1157883 - RNA, 19 nt, Homo sapiens
gugggagacuuaacuuuag

SEQ ID NO: 1157884 - RNA, 19 nt, Homo sapiens
uugaagacauugaaccuau

SEQ ID NO: 1157885 - RNA, 19 nt, Homo sapiens
cuacuugacugguuguaca

SEQ ID NO: 1157886 - RNA, 19 nt, Homo sapiens
gaaguuagaaauugaugag

SEQ ID NO: 1157887 - RNA, 19 nt, Homo sapiens
cgaggauacucuguucgua

SEQ ID NO: 1157888 - RNA, 19 nt, Homo sapiens
gcacugagguucugguuua

SEQ ID NO: 1157889 - RNA, 19 nt, Homo sapiens
gaaagcaucuguguuuauu

SEQ ID NO: 1157890 - RNA, 19 nt, Homo sapiens
caacacagauuaugaguuc

SEQ ID NO: 1157891 - RNA, 19 nt, Homo sapiens
gagcaacucugcauuuaau

SEQ ID NO: 1157892 - RNA, 19 nt, Homo sapiens
gcucguggcuuucaacaaa

SEQ ID NO: 1157893 - RNA, 19 nt, Homo sapiens
ucauguaucuguccuuaua

SEQ ID NO: 1157894 - RNA, 19 nt, Homo sapiens
ggacaagcuugacuucuau

SEQ ID NO: 1157895 - RNA, 19 nt, Homo sapiens
gggacaagcuugacuucua

SEQ ID NO: 1157896 - RNA, 19 nt, Homo sapiens
aaacugcccugaauuaaau

SEQ ID NO: 1157897 - RNA, 19 nt, Homo sapiens
gaaaagggguagcucauuu

SEQ ID NO: 1157898 - RNA, 19 nt, Homo sapiens
ggaaaugagacacagcuua

SEQ ID NO: 1157899 - RNA, 19 nt, Homo sapiens
gaaaugagacacagcuuau

SEQ ID NO: 1157900 - RNA, 19 nt, Homo sapiens
agaagaagcuaaaggaaga

SEQ ID NO: 1157901 - RNA, 19 nt, Homo sapiens
agaagaaagugaagcagua

SEQ ID NO: 1157902 - RNA, 19 nt, Homo sapiens
ggucuuuacucccuaauga

SEQ ID NO: 1157903 - RNA, 19 nt, Homo sapiens
gagaagacauccucauugg

SEQ ID NO: 1157904 - RNA, 19 nt, Homo sapiens
uuaaauagcugcaaaugag

SEQ ID NO: 1157905 - RNA, 19 nt, Homo sapiens
gguggaggcugaagucauu

SEQ ID NO: 1157906 - RNA, 19 nt, Homo sapiens
gaacaacgacaccacagaa

SEQ ID NO: 1157907 - RNA, 19 nt, Homo sapiens
gagguucugguuuaaauua

SEQ ID NO: 1157908 - RNA, 19 nt, Homo sapiens
gaaagacauacgagacaua

SEQ ID NO: 1157909 - RNA, 19 nt, Homo sapiens
gcuaaggcauugauucaug

SEQ ID NO: 1157910 - RNA, 19 nt, Homo sapiens
gaacgggacagcucgcuuu

SEQ ID NO: 1157911 - RNA, 19 nt, Homo sapiens
aaucaguacuugcucauuu

SEQ ID NO: 1157912 - RNA, 19 nt, Homo sapiens
caacgugacuaccucaugu

SEQ ID NO: 1157913 - RNA, 19 nt, Homo sapiens
gaucucaucucggguguug

SEQ ID NO: 1157914 - RNA, 19 nt, Homo sapiens
ggacauggaugggccuuuc

SEQ ID NO: 1157915 - RNA, 19 nt, Homo sapiens
ggagaagacauccucauug

SEQ ID NO: 1157916 - RNA, 19 nt, Homo sapiens
ggaaaggaagaucagauuu

SEQ ID NO: 1157917 - RNA, 19 nt, Homo sapiens
caagauagaauacgguuug

SEQ ID NO: 1157918 - RNA, 19 nt, Homo sapiens
gcaacucugcauuuaauuu

SEQ ID NO: 1157919 - RNA, 19 nt, Homo sapiens
ucacaccucucccagacua

SEQ ID NO: 1157920 - RNA, 19 nt, Homo sapiens
uggaguaucugauccugua

SEQ ID NO: 1157921 - RNA, 19 nt, Homo sapiens
acaguaggcucuuagcauu

SEQ ID NO: 1157922 - RNA, 19 nt, Homo sapiens
ccgagcaacucugcauuua

SEQ ID NO: 1157923 - RNA, 19 nt, Homo sapiens
gaacugggcagacgcuguu

SEQ ID NO: 1157924 - RNA, 19 nt, Homo sapiens
gauaagaaaguggccauuu

SEQ ID NO: 1157925 - RNA, 19 nt, Homo sapiens
ccugaaagcaucuguguuu

SEQ ID NO: 1157926 - RNA, 19 nt, Homo sapiens
gaucacauaggaugcgaua

SEQ ID NO: 1157927 - RNA, 19 nt, Homo sapiens
caacgacaccacagaacua

SEQ ID NO: 1157928 - RNA, 19 nt, Homo sapiens
gaauaccaguuugcaguga

SEQ ID NO: 1157929 - RNA, 19 nt, Homo sapiens
ggaagcccaucuccacaga

SEQ ID NO: 1157930 - RNA, 19 nt, Homo sapiens
ucaaacagcuccacaucca

SEQ ID NO: 1157931 - RNA, 19 nt, Homo sapiens
guacggauuucggcuggua

SEQ ID NO: 1157932 - RNA, 19 nt, Homo sapiens
gcauggacaauguggaaua

SEQ ID NO: 1157933 - RNA, 19 nt, Homo sapiens
gcaccaaccuacuaauugc

SEQ ID NO: 1157934 - RNA, 19 nt, Homo sapiens
ucacuagcacuauauauga

SEQ ID NO: 1157935 - RNA, 19 nt, Homo sapiens
cagucaagauugucaacua

SEQ ID NO: 1157936 - RNA, 19 nt, Homo sapiens
agaauugucacuuguagua

SEQ ID NO: 1157937 - RNA, 19 nt, Homo sapiens
ccucagcccucucauagga

SEQ ID NO: 1157938 - RNA, 19 nt, Homo sapiens
ggaggucuuugcacaggaa

SEQ ID NO: 1157939 - RNA, 19 nt, Homo sapiens
ggaagugccugguuuugaa

SEQ ID NO: 1157940 - RNA, 19 nt, Homo sapiens
gagcgacacucgguacuuc

SEQ ID NO: 1157941 - RNA, 19 nt, Homo sapiens
gaaaggaagaucagauuuu

SEQ ID NO: 1157942 - RNA, 19 nt, Homo sapiens
cagacuaugucaucuuguu

SEQ ID NO: 1157943 - RNA, 19 nt, Homo sapiens
gggaaaggaagaucagauu

SEQ ID NO: 1157944 - RNA, 19 nt, Homo sapiens
gcaaugggcagguggugaa

SEQ ID NO: 1157945 - RNA, 19 nt, Homo sapiens
caucuugccuuugggauug

SEQ ID NO: 1157946 - RNA, 19 nt, Homo sapiens
acucacaguugauaagaaa

SEQ ID NO: 1157947 - RNA, 19 nt, Homo sapiens
aaacaagguguaucgagua

SEQ ID NO: 1157948 - RNA, 19 nt, Homo sapiens
gcucauuuauuugucugua

SEQ ID NO: 1157949 - RNA, 19 nt, Homo sapiens
ccauugaugccuuaaguuu

SEQ ID NO: 1157950 - RNA, 19 nt, Homo sapiens
gcaucuguguuuauuauac

SEQ ID NO: 1157951 - RNA, 19 nt, Homo sapiens
gaaugucucucagcacagu

SEQ ID NO: 1157952 - RNA, 19 nt, Homo sapiens
cuuuggagcuuccuaaguu

SEQ ID NO: 1157953 - RNA, 19 nt, Homo sapiens
gaagugcacagccuuaugg

SEQ ID NO: 1157954 - RNA, 19 nt, Homo sapiens
cuacugaggugcgaggaaa

SEQ ID NO: 1157955 - RNA, 19 nt, Homo sapiens
guaucuguccuuauaauga

SEQ ID NO: 1157956 - RNA, 19 nt, Homo sapiens
auaggagcauagaauguua

SEQ ID NO: 1157957 - RNA, 19 nt, Homo sapiens
aagaugcccucccuucuau

SEQ ID NO: 1157958 - RNA, 19 nt, Homo sapiens
gaagaaagugaagcaguau

SEQ ID NO: 1157959 - RNA, 19 nt, Homo sapiens
aaagaugcccucccuucua

SEQ ID NO: 1157960 - RNA, 19 nt, Homo sapiens
caauguggaauaccaguuu

SEQ ID NO: 1157961 - RNA, 19 nt, Homo sapiens
gcaagcaggcucugaaugc

SEQ ID NO: 1157962 - RNA, 19 nt, Homo sapiens
gggugucacucacuguuga

SEQ ID NO: 1157963 - RNA, 19 nt, Homo sapiens
cugaaagcaucuguguuua

SEQ ID NO: 1157964 - RNA, 19 nt, Homo sapiens
gcuggagcacgaccacuua

SEQ ID NO: 1157965 - RNA, 19 nt, Homo sapiens
ugacaaguguaaucaguac

SEQ ID NO: 1157966 - RNA, 19 nt, Homo sapiens
cagcucccaucauuacuug

SEQ ID NO: 1157967 - RNA, 19 nt, Homo sapiens
guguuagguuugugucuuu

SEQ ID NO: 1157968 - RNA, 19 nt, Homo sapiens
gagaggaaaacauggauua

SEQ ID NO: 1157969 - RNA, 19 nt, Homo sapiens
gcaaugggaggaagaaguc

SEQ ID NO: 1157970 - RNA, 19 nt, Homo sapiens
ggcaggacguggucauugu

SEQ ID NO: 1157971 - RNA, 19 nt, Homo sapiens
agaaggaccaggugacauu

SEQ ID NO: 1157972 - RNA, 19 nt, Homo sapiens
caugacaaguguaaucagu

SEQ ID NO: 1157973 - RNA, 19 nt, Homo sapiens
ggguagcucauuucaguuu

SEQ ID NO: 1157974 - RNA, 19 nt, Homo sapiens
ccucccuggucaccuauua

SEQ ID NO: 1157975 - RNA, 19 nt, Homo sapiens
gaucucuggcuacaaacua

SEQ ID NO: 1157976 - RNA, 19 nt, Homo sapiens
gauccagaggcucagaaua

SEQ ID NO: 1157977 - RNA, 19 nt, Homo sapiens
ccacguccaugcggaauca

SEQ ID NO: 1157978 - RNA, 19 nt, Homo sapiens
gaaggugcaggcaaagaug

SEQ ID NO: 1157979 - RNA, 19 nt, Homo sapiens
guguuaagcuaaggcauug

SEQ ID NO: 1157980 - RNA, 19 nt, Homo sapiens
gguauuaaucccuuuguca

SEQ ID NO: 1157981 - RNA, 19 nt, Homo sapiens
ugaaagcaucuguguuuau

SEQ ID NO: 1157982 - RNA, 19 nt, Homo sapiens
cagacagacuuaccugcuu

SEQ ID NO: 1157983 - RNA, 19 nt, Homo sapiens
agaaagugaagcaguauga

SEQ ID NO: 1157984 - RNA, 19 nt, Homo sapiens
caucacaggacgcccagua

SEQ ID NO: 1157985 - RNA, 19 nt, Homo sapiens
gaacccaacacagauuaug

SEQ ID NO: 1157986 - RNA, 19 nt, Homo sapiens
cuaaggcauugauucaugu

SEQ ID NO: 1157987 - RNA, 19 nt, Homo sapiens
cauaggagcauagaauguu

SEQ ID NO: 1157988 - RNA, 19 nt, Homo sapiens
gaaaggaugacucuuauuu

SEQ ID NO: 1157989 - RNA, 19 nt, Homo sapiens
ggagaaaggaugacucuua

SEQ ID NO: 1157990 - RNA, 19 nt, Homo sapiens
gagaaaggaugacucuuau

SEQ ID NO: 1157991 - RNA, 19 nt, Homo sapiens
gaauacggcuccaucaaga

SEQ ID NO: 1157992 - RNA, 19 nt, Homo sapiens
gaaggaacgugaggagauu

SEQ ID NO: 1157993 - RNA, 19 nt, Homo sapiens
gaaagucagucucgugcaa

SEQ ID NO: 1157994 - RNA, 19 nt, Homo sapiens
caucgagugucaucaauuu

SEQ ID NO: 1157995 - RNA, 19 nt, Homo sapiens
ccacuuacuuguucuaaau

SEQ ID NO: 1157996 - RNA, 19 nt, Homo sapiens
gcaagagcaucgcaacaug

SEQ ID NO: 1157997 - RNA, 19 nt, Homo sapiens
gaucuuaccagaggcauua

SEQ ID NO: 1157998 - RNA, 19 nt, Homo sapiens
gcugguagcgauauuaaua

SEQ ID NO: 1157999 - RNA, 19 nt, Homo sapiens
gcggaaagaagaaauauga

SEQ ID NO: 1158000 - RNA, 19 nt, Homo sapiens
gaagagcuuuaucgucaau

SEQ ID NO: 1158001 - RNA, 19 nt, Homo sapiens
gaacucuuguguuguuaau

SEQ ID NO: 1158002 - RNA, 19 nt, Homo sapiens
gaagcuaaaucuuucaacu

SEQ ID NO: 1158003 - RNA, 19 nt, Homo sapiens
gacuugaucuuccuuaaca

SEQ ID NO: 1158004 - RNA, 19 nt, Homo sapiens
gcuuauuccuuacaaaguu

SEQ ID NO: 1158005 - RNA, 19 nt, Homo sapiens
ccacagacauaguagagau

SEQ ID NO: 1158006 - RNA, 19 nt, Homo sapiens
ugaagagacugacaagauc

SEQ ID NO: 1158007 - RNA, 19 nt, Homo sapiens
gaaauuaugagcguuacaa

SEQ ID NO: 1158008 - RNA, 19 nt, Homo sapiens
gcacagugacggccaauag

SEQ ID NO: 1158009 - RNA, 19 nt, Homo sapiens
ccagaaauuaugagcguua

SEQ ID NO: 1158010 - RNA, 19 nt, Homo sapiens
uuacagagauagcuuugau

SEQ ID NO: 1158011 - RNA, 19 nt, Homo sapiens
ccaaggcuguguugcuuau

SEQ ID NO: 1158012 - RNA, 19 nt, Homo sapiens
gcaaucagccuccaagcau

SEQ ID NO: 1158013 - RNA, 19 nt, Homo sapiens
cugacaagaucaucaacua

SEQ ID NO: 1158014 - RNA, 19 nt, Homo sapiens
gcagcggaaagaagaaaua

SEQ ID NO: 1158015 - RNA, 19 nt, Homo sapiens
cagccagccucaacaaaga

SEQ ID NO: 1158016 - RNA, 19 nt, Homo sapiens
gugaggagauugccagaca

SEQ ID NO: 1158017 - RNA, 19 nt, Homo sapiens
gcccagggauggcagaaau

SEQ ID NO: 1158018 - RNA, 19 nt, Homo sapiens
gaucuuccuuaacacagaa

SEQ ID NO: 1158019 - RNA, 19 nt, Homo sapiens
cgaaaggcccguugauugu

SEQ ID NO: 1158020 - RNA, 19 nt, Homo sapiens
ggaaauccagagacgcuuu

SEQ ID NO: 1158021 - RNA, 19 nt, Homo sapiens
ggaaggagcggcugaugag

SEQ ID NO: 1158022 - RNA, 19 nt, Homo sapiens
guaccucacugcugaagag

SEQ ID NO: 1158023 - RNA, 19 nt, Homo sapiens
gaaaggcccguugauuguu

SEQ ID NO: 1158024 - RNA, 19 nt, Homo sapiens
ccgaaaggcccguugauug

SEQ ID NO: 1158025 - RNA, 19 nt, Homo sapiens
caaucagccuccaagcauu

SEQ ID NO: 1158026 - RNA, 19 nt, Homo sapiens
gcaaacagccagccucaac

SEQ ID NO: 1158027 - RNA, 19 nt, Homo sapiens
gcaagagcuucaggccaaa

SEQ ID NO: 1158028 - RNA, 19 nt, Homo sapiens
guagagauuugcgggauca

SEQ ID NO: 1158029 - RNA, 19 nt, Homo sapiens
cgagugucaucaauuucua

SEQ ID NO: 1158030 - RNA, 19 nt, Homo sapiens
gaagagacugacaagauca

SEQ ID NO: 1158031 - RNA, 19 nt, Homo sapiens
cgacagauacagagacaug

SEQ ID NO: 1158032 - RNA, 19 nt, Homo sapiens
gcccaaggcuguguugcuu

SEQ ID NO: 1158033 - RNA, 19 nt, Homo sapiens
ccauauggcuuuggagaca

SEQ ID NO: 1158034 - RNA, 19 nt, Homo sapiens
agacuuucgugaucuaaga

SEQ ID NO: 1158035 - RNA, 19 nt, Homo sapiens
ugagggaucuuagagacuu

SEQ ID NO: 1158036 - RNA, 19 nt, Homo sapiens
uaaggcagcggaaagaaga

SEQ ID NO: 1158037 - RNA, 19 nt, Homo sapiens
cuguguugcuuauuccuua

SEQ ID NO: 1158038 - RNA, 19 nt, Homo sapiens
gaaauccagagacgcuuug

SEQ ID NO: 1158039 - RNA, 19 nt, Homo sapiens
ggacgugagggaucuuaga

SEQ ID NO: 1158040 - RNA, 19 nt, Homo sapiens
cuuuggaacucuuguguug

SEQ ID NO: 1158041 - RNA, 19 nt, Homo sapiens
ggaacucuuguguuguuaa

SEQ ID NO: 1158042 - RNA, 19 nt, Homo sapiens
aggcauuacugaagcuaaa

SEQ ID NO: 1158043 - RNA, 19 nt, Homo sapiens
gugccucgcugaagacaca

SEQ ID NO: 1158044 - RNA, 19 nt, Homo sapiens
gagggaucuuagagacuuu

SEQ ID NO: 1158045 - RNA, 19 nt, Homo sapiens
uuggaacucuuguguuguu

SEQ ID NO: 1158046 - RNA, 19 nt, Homo sapiens
uuccacagguaucaacuuu

SEQ ID NO: 1158047 - RNA, 19 nt, Homo sapiens
uaauaaggcagcggaaaga

SEQ ID NO: 1158048 - RNA, 19 nt, Homo sapiens
gcaucgagugucaucaauu

SEQ ID NO: 1158049 - RNA, 19 nt, Homo sapiens
gccagaggccugugucuuc

SEQ ID NO: 1158050 - RNA, 19 nt, Homo sapiens
ccacacgaagggauccaua

SEQ ID NO: 1158051 - RNA, 19 nt, Homo sapiens
uaugagcguuacaagaaug

SEQ ID NO: 1158052 - RNA, 19 nt, Homo sapiens
gagcuuuaucgucaauauu

SEQ ID NO: 1158053 - RNA, 19 nt, Homo sapiens
ggaacggcguagagaagag

SEQ ID NO: 1158054 - RNA, 19 nt, Homo sapiens
ggacagcagagacauucga

SEQ ID NO: 1158055 - RNA, 19 nt, Homo sapiens
gaggaacggcguagagaag

SEQ ID NO: 1158056 - RNA, 19 nt, Homo sapiens
cugaagagacugacaagau

SEQ ID NO: 1158057 - RNA, 19 nt, Homo sapiens
gaugacuauugcaggagaa

SEQ ID NO: 1158058 - RNA, 19 nt, Homo sapiens
cuuagagacuuucgugauc

SEQ ID NO: 1158059 - RNA, 19 nt, Homo sapiens
uacugaagcuaaaucuuuc

SEQ ID NO: 1158060 - RNA, 19 nt, Homo sapiens
auuaugagcguuacaagaa

SEQ ID NO: 1158061 - RNA, 19 nt, Homo sapiens
aaaggcccguugauuguuc

SEQ ID NO: 1158062 - RNA, 19 nt, Homo sapiens
guagagaagagcuuuaucg

SEQ ID NO: 1158063 - RNA, 19 nt, Homo sapiens
caugagagacucccgagau

SEQ ID NO: 1158064 - RNA, 19 nt, Homo sapiens
ccaauucgaggaaguccaa

SEQ ID NO: 1158065 - RNA, 19 nt, Homo sapiens
aaacagccagccucaacaa

SEQ ID NO: 1158066 - RNA, 19 nt, Homo sapiens
uaugaccgauaccuacgaa

SEQ ID NO: 1158067 - RNA, 19 nt, Homo sapiens
cuaaauagagcuguuugga

SEQ ID NO: 1158068 - RNA, 19 nt, Homo sapiens
uggacuugaucuuccuuaa

SEQ ID NO: 1158069 - RNA, 19 nt, Homo sapiens
agagcuuuaucgucaauau

SEQ ID NO: 1158070 - RNA, 19 nt, Homo sapiens
ggagacagucgagauucaa

SEQ ID NO: 1158071 - RNA, 19 nt, Homo sapiens
gcaugguaguggacuugau

SEQ ID NO: 1158072 - RNA, 19 nt, Homo sapiens
ugaccgauaccuacgaaug

SEQ ID NO: 1158073 - RNA, 19 nt, Homo sapiens
ggcaucgagugucaucaau

SEQ ID NO: 1158074 - RNA, 19 nt, Homo sapiens
caauccaaguguacagaag

SEQ ID NO: 1158075 - RNA, 19 nt, Homo sapiens
gcaccugcuagcaacauga

SEQ ID NO: 1158076 - RNA, 19 nt, Homo sapiens
aaucagccuccaagcauuu

SEQ ID NO: 1158077 - RNA, 19 nt, Homo sapiens
uggagacagucgagauuca

SEQ ID NO: 1158078 - RNA, 19 nt, Homo sapiens
ugaauacggcuccaucaag

SEQ ID NO: 1158079 - RNA, 19 nt, Homo sapiens
gguaguggacuugaucuuc

SEQ ID NO: 1158080 - RNA, 19 nt, Homo sapiens
guucugugauuguggucaa

SEQ ID NO: 1158081 - RNA, 19 nt, Homo sapiens
guugauuguucugugauug

SEQ ID NO: 1158082 - RNA, 19 nt, Homo sapiens
gccgaaaggcccguugauu

SEQ ID NO: 1158083 - RNA, 19 nt, Homo sapiens
aaggaugacucuuauuuug

SEQ ID NO: 1158084 - RNA, 19 nt, Homo sapiens
gaccacagacauaguagag

SEQ ID NO: 1158085 - RNA, 19 nt, Homo sapiens
ggacuugaucuuccuuaac

SEQ ID NO: 1158086 - RNA, 19 nt, Homo sapiens
acgaauggaugacuauugc

SEQ ID NO: 1158087 - RNA, 19 nt, Homo sapiens
ccuggccuccucccacuua

SEQ ID NO: 1158088 - RNA, 19 nt, Homo sapiens
gcacagaauuuaaugcuaa

SEQ ID NO: 1158089 - RNA, 19 nt, Homo sapiens
gaacugaaaucccagaaga

SEQ ID NO: 1158090 - RNA, 19 nt, Homo sapiens
gcacagcuauauacuagua

SEQ ID NO: 1158091 - RNA, 19 nt, Homo sapiens
ggagauaacugcauuaaaa

SEQ ID NO: 1158092 - RNA, 19 nt, Homo sapiens
cauguaaccuugcuguuua

SEQ ID NO: 1158093 - RNA, 19 nt, Homo sapiens
gcacaaggauugccuaucu

SEQ ID NO: 1158094 - RNA, 19 nt, Homo sapiens
uaacaaaguugcuacaugu

SEQ ID NO: 1158095 - RNA, 19 nt, Homo sapiens
gagaaucacuuguggaugu

SEQ ID NO: 1158096 - RNA, 19 nt, Homo sapiens
gcaaaacgaugacauguaa

SEQ ID NO: 1158097 - RNA, 19 nt, Homo sapiens
guaaacaacaucuaccuua

SEQ ID NO: 1158098 - RNA, 19 nt, Homo sapiens
ccuaugagauuccagauuu

SEQ ID NO: 1158099 - RNA, 19 nt, Homo sapiens
gguguacacuuaugucuuu

SEQ ID NO: 1158100 - RNA, 19 nt, Homo sapiens
caucagacaucucgaaaga

SEQ ID NO: 1158101 - RNA, 19 nt, Homo sapiens
gauguucucuucaguaugu

SEQ ID NO: 1158102 - RNA, 19 nt, Homo sapiens
gcauccagcuguccuauug

SEQ ID NO: 1158103 - RNA, 19 nt, Homo sapiens
ggaauaacaggugauaaua

SEQ ID NO: 1158104 - RNA, 19 nt, Homo sapiens
gaagggauuuacagcauug

SEQ ID NO: 1158105 - RNA, 19 nt, Homo sapiens
ucaggaaggugacacgaua

SEQ ID NO: 1158106 - RNA, 19 nt, Homo sapiens
ggaagcagauggaagauac

SEQ ID NO: 1158107 - RNA, 19 nt, Homo sapiens
gaaaugugcaggauucuga

SEQ ID NO: 1158108 - RNA, 19 nt, Homo sapiens
uaacccagcugaucuugaa

SEQ ID NO: 1158109 - RNA, 19 nt, Homo sapiens
gcaaaguccaguuacauuu

SEQ ID NO: 1158110 - RNA, 19 nt, Homo sapiens
ucaaaugucuuuccuucuu

SEQ ID NO: 1158111 - RNA, 19 nt, Homo sapiens
ggauaaagauggagauguc

SEQ ID NO: 1158112 - RNA, 19 nt, Homo sapiens
gaaacuaccuugcaguaac

SEQ ID NO: 1158113 - RNA, 19 nt, Homo sapiens
aaauggagaucacaugaaa

SEQ ID NO: 1158114 - RNA, 19 nt, Homo sapiens
guacauggcucugaagcaa

SEQ ID NO: 1158115 - RNA, 19 nt, Homo sapiens
ggaagauaauguggcaaua

SEQ ID NO: 1158116 - RNA, 19 nt, Homo sapiens
gcccagauguccauaagaa

SEQ ID NO: 1158117 - RNA, 19 nt, Homo sapiens
gcucguaaccauaaagaua

SEQ ID NO: 1158118 - RNA, 19 nt, Homo sapiens
cgacacauguugaaagaug

SEQ ID NO: 1158119 - RNA, 19 nt, Homo sapiens
gaacuccucuguccuggau

SEQ ID NO: 1158120 - RNA, 19 nt, Homo sapiens
ggccagagcuugucuacau

SEQ ID NO: 1158121 - RNA, 19 nt, Homo sapiens
guauuugccuucauucuga

SEQ ID NO: 1158122 - RNA, 19 nt, Homo sapiens
aacaggagcugauuauauu

SEQ ID NO: 1158123 - RNA, 19 nt, Homo sapiens
caaaauagaugccaaauac

SEQ ID NO: 1158124 - RNA, 19 nt, Homo sapiens
ugagaaaucuagcugcauu

SEQ ID NO: 1158125 - RNA, 19 nt, Homo sapiens
gaccaaugcuggcacagaa

SEQ ID NO: 1158126 - RNA, 19 nt, Homo sapiens
gauagaaagcgaaaucuug

SEQ ID NO: 1158127 - RNA, 19 nt, Homo sapiens
caaaugucuuuccuucuuu

SEQ ID NO: 1158128 - RNA, 19 nt, Homo sapiens
gagaagggauuuacagcau

SEQ ID NO: 1158129 - RNA, 19 nt, Homo sapiens
uaacaggagcugauuauau

SEQ ID NO: 1158130 - RNA, 19 nt, Homo sapiens
caacugugauugaguguca

SEQ ID NO: 1158131 - RNA, 19 nt, Homo sapiens
caacaacaucagcaaauuu

SEQ ID NO: 1158132 - RNA, 19 nt, Homo sapiens
gauaaagcagcaucuguuu

SEQ ID NO: 1158133 - RNA, 19 nt, Homo sapiens
aaaggucucuacuacgaua

SEQ ID NO: 1158134 - RNA, 19 nt, Homo sapiens
caaggacacuauacaagga

SEQ ID NO: 1158135 - RNA, 19 nt, Homo sapiens
gcaacauugucugcuauaa

SEQ ID NO: 1158136 - RNA, 19 nt, Homo sapiens
uaaccuugcuguuuauugu

SEQ ID NO: 1158137 - RNA, 19 nt, Homo sapiens
gaauugaagaucaugcuaa

SEQ ID NO: 1158138 - RNA, 19 nt, Homo sapiens
ccaacaacaucagcaaauu

SEQ ID NO: 1158139 - RNA, 19 nt, Homo sapiens
gaauagaggacuacaaucu

SEQ ID NO: 1158140 - RNA, 19 nt, Homo sapiens
aaccuuugcugcuauauaa

SEQ ID NO: 1158141 - RNA, 19 nt, Homo sapiens
ccaguuacauuugauagaa

SEQ ID NO: 1158142 - RNA, 19 nt, Homo sapiens
gcaggacuuuggcaacauu

SEQ ID NO: 1158143 - RNA, 19 nt, Homo sapiens
ucuauccucugcacuguua

SEQ ID NO: 1158144 - RNA, 19 nt, Homo sapiens
ugaagacacuacuaaugaa

SEQ ID NO: 1158145 - RNA, 19 nt, Homo sapiens
caaggaagcagauggaaga

SEQ ID NO: 1158146 - RNA, 19 nt, Homo sapiens
ggucggcacuuuccacuuc

SEQ ID NO: 1158147 - RNA, 19 nt, Homo sapiens
gcaggcaacuaccggaaug

SEQ ID NO: 1158148 - RNA, 19 nt, Homo sapiens
gauaauguggcaauagaaa

SEQ ID NO: 1158149 - RNA, 19 nt, Homo sapiens
ugaagacuaucaaagcauu

SEQ ID NO: 1158150 - RNA, 19 nt, Homo sapiens
gauggaagauacaaagaag

SEQ ID NO: 1158151 - RNA, 19 nt, Homo sapiens
gaagacuggcaauucguua

SEQ ID NO: 1158152 - RNA, 19 nt, Homo sapiens
caauacaguuugccuggaa

SEQ ID NO: 1158153 - RNA, 19 nt, Homo sapiens
gcugaaagcaugauaagug

SEQ ID NO: 1158154 - RNA, 19 nt, Homo sapiens
uaaagggaauagaggacua

SEQ ID NO: 1158155 - RNA, 19 nt, Homo sapiens
gaacaaauaaagggaauag

SEQ ID NO: 1158156 - RNA, 19 nt, Homo sapiens
gccaauggauaaaggugua

SEQ ID NO: 1158157 - RNA, 19 nt, Homo sapiens
ucaaugacgcuaccuauga

SEQ ID NO: 1158158 - RNA, 19 nt, Homo sapiens
gaaggagagcuaccaauca

SEQ ID NO: 1158159 - RNA, 19 nt, Homo sapiens
ugacuucccugcucuauac

SEQ ID NO: 1158160 - RNA, 19 nt, Homo sapiens
acauggcucugaagcaaua

SEQ ID NO: 1158161 - RNA, 19 nt, Homo sapiens
uggagaauaugaagcaauu

SEQ ID NO: 1158162 - RNA, 19 nt, Homo sapiens
uaaacaacaucuaccuuag

SEQ ID NO: 1158163 - RNA, 19 nt, Homo sapiens
ucauaaaccuuugcugcua

SEQ ID NO: 1158164 - RNA, 19 nt, Homo sapiens
acacuuaugucuuucacaa

SEQ ID NO: 1158165 - RNA, 19 nt, Homo sapiens
ggaacaguagccaguauuu

SEQ ID NO: 1158166 - RNA, 19 nt, Homo sapiens
uaagauccauuugcaguau

SEQ ID NO: 1158167 - RNA, 19 nt, Homo sapiens
auagaggacuacaaucuuu

SEQ ID NO: 1158168 - RNA, 19 nt, Homo sapiens
gaacgugagacucggcuuu

SEQ ID NO: 1158169 - RNA, 19 nt, Homo sapiens
gaucagagccuagcaacau

SEQ ID NO: 1158170 - RNA, 19 nt, Homo sapiens
ccaccaaccucaugauucu

SEQ ID NO: 1158171 - RNA, 19 nt, Homo sapiens
ggaaauguuggcauaguga

SEQ ID NO: 1158172 - RNA, 19 nt, Homo sapiens
uaucuuaugccaugccuua

SEQ ID NO: 1158173 - RNA, 19 nt, Homo sapiens
gauaaucuaaccagcauug

SEQ ID NO: 1158174 - RNA, 19 nt, Homo sapiens
ggagauguccuagcaguga

SEQ ID NO: 1158175 - RNA, 19 nt, Homo sapiens
agacgguccuuucuggaua

SEQ ID NO: 1158176 - RNA, 19 nt, Homo sapiens
caggacaccuugccauguu

SEQ ID NO: 1158177 - RNA, 19 nt, Homo sapiens
gccaguauuugccuucauu

SEQ ID NO: 1158178 - RNA, 19 nt, Homo sapiens
aaauaagaccagccaguua

SEQ ID NO: 1158179 - RNA, 19 nt, Homo sapiens
caaauaagaccagccaguu

SEQ ID NO: 1158180 - RNA, 19 nt, Homo sapiens
aagauaauguggcaauaga

SEQ ID NO: 1158181 - RNA, 19 nt, Homo sapiens
uuaaacacuuccugaaaug

SEQ ID NO: 1158182 - RNA, 19 nt, Homo sapiens
aagcauugccuuauacuuu

SEQ ID NO: 1158183 - RNA, 19 nt, Homo sapiens
ggaaacuaccuugcaguaa

SEQ ID NO: 1158184 - RNA, 19 nt, Homo sapiens
gggaauagaggacuacaau

SEQ ID NO: 1158185 - RNA, 19 nt, Homo sapiens
gcauagugauguccuugga

SEQ ID NO: 1158186 - RNA, 19 nt, Homo sapiens
gagcugaccugccaaacac

SEQ ID NO: 1158187 - RNA, 19 nt, Homo sapiens
gcucuauacucagaauuga

SEQ ID NO: 1158188 - RNA, 19 nt, Homo sapiens
gaacauggcugcaacugua

SEQ ID NO: 1158189 - RNA, 19 nt, Homo sapiens
ggauaacccuuucaaauuu

SEQ ID NO: 1158190 - RNA, 19 nt, Homo sapiens
gaacgaaucucagaacuug

SEQ ID NO: 1158191 - RNA, 19 nt, Homo sapiens
gaugaacugucuggaauua

SEQ ID NO: 1158192 - RNA, 19 nt, Homo sapiens
gaaccuaaccgaucugaaa

SEQ ID NO: 1158193 - RNA, 19 nt, Homo sapiens
ccaaaugucugacuauaga

SEQ ID NO: 1158194 - RNA, 19 nt, Homo sapiens
gcaagagucuaccaacuga

SEQ ID NO: 1158195 - RNA, 19 nt, Homo sapiens
gagaugaugucuuaaacaa

SEQ ID NO: 1158196 - RNA, 19 nt, Homo sapiens
uacaggagcugaaggauaa

SEQ ID NO: 1158197 - RNA, 19 nt, Homo sapiens
caacuuacagcuacuauaa

SEQ ID NO: 1158198 - RNA, 19 nt, Homo sapiens
gaaauacaggaucaacuua

SEQ ID NO: 1158199 - RNA, 19 nt, Homo sapiens
ucucagaacuugaagauug

SEQ ID NO: 1158200 - RNA, 19 nt, Homo sapiens
gaaaggagagucaaagaau

SEQ ID NO: 1158201 - RNA, 19 nt, Homo sapiens
ggacauuucuggaauuaag

SEQ ID NO: 1158202 - RNA, 19 nt, Homo sapiens
gaugagaagucaauuucaa

SEQ ID NO: 1158203 - RNA, 19 nt, Homo sapiens
gaaagcagaaagagaagua

SEQ ID NO: 1158204 - RNA, 19 nt, Homo sapiens
gcgguaggcugccaucuuu

SEQ ID NO: 1158205 - RNA, 19 nt, Homo sapiens
gaaauuagaccagaugaga

SEQ ID NO: 1158206 - RNA, 19 nt, Homo sapiens
gaugaugucuuaaacaaag

SEQ ID NO: 1158207 - RNA, 19 nt, Homo sapiens
gaaaugagaagaaaccaau

SEQ ID NO: 1158208 - RNA, 19 nt, Homo sapiens
gaagauugguucucuaaaa

SEQ ID NO: 1158209 - RNA, 19 nt, Homo sapiens
gaagaacacaauacaagaa

SEQ ID NO: 1158210 - RNA, 19 nt, Homo sapiens
gcaacaaguucauucauac

SEQ ID NO: 1158211 - RNA, 19 nt, Homo sapiens
gaccaaagcccaucucuca

SEQ ID NO: 1158212 - RNA, 19 nt, Homo sapiens
gaacaugugaugaugagaa

SEQ ID NO: 1158213 - RNA, 19 nt, Homo sapiens
ggagauggauggcgacaca

SEQ ID NO: 1158214 - RNA, 19 nt, Homo sapiens
gaacacaauacaagaauuc

SEQ ID NO: 1158215 - RNA, 19 nt, Homo sapiens
aaaacgagaugaugucuua

SEQ ID NO: 1158216 - RNA, 19 nt, Homo sapiens
gaacuccaguaacucaaau

SEQ ID NO: 1158217 - RNA, 19 nt, Homo sapiens
gaagaaaccaaugcaagaa

SEQ ID NO: 1158218 - RNA, 19 nt, Homo sapiens
ggauaaaguagcugguaua

SEQ ID NO: 1158219 - RNA, 19 nt, Homo sapiens
gaugauaacuccagguacu

SEQ ID NO: 1158220 - RNA, 19 nt, Homo sapiens
ucccaaagcuucagcauca

SEQ ID NO: 1158221 - RNA, 19 nt, Homo sapiens
gagcuaacacccuuaucua

SEQ ID NO: 1158222 - RNA, 19 nt, Homo sapiens
gauaacccuuucaaauuuc

SEQ ID NO: 1158223 - RNA, 19 nt, Homo sapiens
gaagaaauuagaccagaug

SEQ ID NO: 1158224 - RNA, 19 nt, Homo sapiens
ggaagaaauuagaccagau

SEQ ID NO: 1158225 - RNA, 19 nt, Homo sapiens
gauaaaguagcugguauaa

SEQ ID NO: 1158226 - RNA, 19 nt, Homo sapiens
ucaaauggccucuguguca

SEQ ID NO: 1158227 - RNA, 19 nt, Homo sapiens
uaacucaaauggccucugu

SEQ ID NO: 1158228 - RNA, 19 nt, Homo sapiens
gcaacuguaaggaaacaua

SEQ ID NO: 1158229 - RNA, 19 nt, Homo sapiens
ucacaggcuucacugauga

SEQ ID NO: 1158230 - RNA, 19 nt, Homo sapiens
gcacagcugcucuauaaag

SEQ ID NO: 1158231 - RNA, 19 nt, Homo sapiens
gagagucaaagaaugauaa

SEQ ID NO: 1158232 - RNA, 19 nt, Homo sapiens
acaaugcaaucacaaguau

SEQ ID NO: 1158233 - RNA, 19 nt, Homo sapiens
uggauaacccuuucaaauu

SEQ ID NO: 1158234 - RNA, 19 nt, Homo sapiens
ucacugcaccuauuuagaa

SEQ ID NO: 1158235 - RNA, 19 nt, Homo sapiens
acacugcaauuaaaggaaa

SEQ ID NO: 1158236 - RNA, 19 nt, Homo sapiens
gauguggacccucagcaua

SEQ ID NO: 1158237 - RNA, 19 nt, Homo sapiens
ugagacagcuucaacaaaa

SEQ ID NO: 1158238 - RNA, 19 nt, Homo sapiens
agagaaagcagaaagagaa

SEQ ID NO: 1158239 - RNA, 19 nt, Homo sapiens
uaaagacccugcacaaagc

SEQ ID NO: 1158240 - RNA, 19 nt, Homo sapiens
gauauggacauuucuggaa

SEQ ID NO: 1158241 - RNA, 19 nt, Homo sapiens
gcaaucacaaguauuaaca

SEQ ID NO: 1158242 - RNA, 19 nt, Homo sapiens
caucaagacucaggagaau

SEQ ID NO: 1158243 - RNA, 19 nt, Homo sapiens
cagcugcucuauaaagaug

SEQ ID NO: 1158244 - RNA, 19 nt, Homo sapiens
auacaagaauuccacaaug

SEQ ID NO: 1158245 - RNA, 19 nt, Homo sapiens
caaucuacacugcaauuaa

SEQ ID NO: 1158246 - RNA, 19 nt, Homo sapiens
gaaagagaaguagcuguga

SEQ ID NO: 1158247 - RNA, 19 nt, Homo sapiens
agcaacaaguucauucaua

SEQ ID NO: 1158248 - RNA, 19 nt, Homo sapiens
aaaggagagucaaagaaug

SEQ ID NO: 1158249 - RNA, 19 nt, Homo sapiens
agagcuagaugaagauaug

SEQ ID NO: 1158250 - RNA, 19 nt, Homo sapiens
caagaacuccaguaacuca

SEQ ID NO: 1158251 - RNA, 19 nt, Homo sapiens
gugaaaacauccgaaaaua

SEQ ID NO: 1158252 - RNA, 19 nt, Homo sapiens
aaacaaaggaucagcaaca

SEQ ID NO: 1158253 - RNA, 19 nt, Homo sapiens
gaugaggccagacugcuuu

SEQ ID NO: 1158254 - RNA, 19 nt, Homo sapiens
ugaacugucuggaauuaca

SEQ ID NO: 1158255 - RNA, 19 nt, Homo sapiens
uaaccuggaugaacugucu

SEQ ID NO: 1158256 - RNA, 19 nt, Homo sapiens
gaaaacauccgaaaauaag

SEQ ID NO: 1158257 - RNA, 19 nt, Homo sapiens
cgaauucuccauccugauu

SEQ ID NO: 1158258 - RNA, 19 nt, Homo sapiens
uuugagagcuagaugaaga

SEQ ID NO: 1158259 - RNA, 19 nt, Homo sapiens
ggagcugaaggauaaagua

SEQ ID NO: 1158260 - RNA, 19 nt, Homo sapiens
guggauaacccuuucaaau

SEQ ID NO: 1158261 - RNA, 19 nt, Homo sapiens
gauaacgacaucucaggaa

SEQ ID NO: 1158262 - RNA, 19 nt, Homo sapiens
caaauugagcggcuugaga

SEQ ID NO: 1158263 - RNA, 19 nt, Homo sapiens
ugaaguagaacaugugaug

SEQ ID NO: 1158264 - RNA, 19 nt, Homo sapiens
ggaacgaaucucagaacuu

SEQ ID NO: 1158265 - RNA, 19 nt, Homo sapiens
uggaugaacugucuggaau

SEQ ID NO: 1158266 - RNA, 19 nt, Homo sapiens
ccucaaaguuaggaaagaa

SEQ ID NO: 1158267 - RNA, 19 nt, Homo sapiens
gcuacaaccacuacuaaug

SEQ ID NO: 1158268 - RNA, 19 nt, Homo sapiens
gcugccaucuuugcuguuu

SEQ ID NO: 1158269 - RNA, 19 nt, Homo sapiens
ggauguggauaacccuuuc

SEQ ID NO: 1158270 - RNA, 19 nt, Homo sapiens
gagaagucaauuucaagaa

SEQ ID NO: 1158271 - RNA, 19 nt, Homo sapiens
cgaagaacacaauacaaga

SEQ ID NO: 1158272 - RNA, 19 nt, Homo sapiens
caccaguucuccaacaaga

SEQ ID NO: 1158273 - RNA, 19 nt, Homo sapiens
ccaaagcccaucucucaug

SEQ ID NO: 1158274 - RNA, 19 nt, Homo sapiens
cacagcugcucuauaaaga

SEQ ID NO: 1158275 - RNA, 19 nt, Homo sapiens
ggagagucaaagaaugaua

SEQ ID NO: 1158276 - RNA, 19 nt, Homo sapiens
gaagauauggacauuucug

SEQ ID NO: 1158277 - RNA, 19 nt, Homo sapiens
gagaaaauccugcagcauu

SEQ ID NO: 1158278 - RNA, 19 nt, Homo sapiens
cacaaaagcuugaaguaga

SEQ ID NO: 1158279 - RNA, 19 nt, Homo sapiens
gcuacuauaagauguacua

SEQ ID NO: 1158280 - RNA, 19 nt, Homo sapiens
ccacaccaguucuccaaca

SEQ ID NO: 1158281 - RNA, 19 nt, Homo sapiens
cuacaaccacuacuaaugu

SEQ ID NO: 1158282 - RNA, 19 nt, Homo sapiens
gccaccaucuuugcuguuu

SEQ ID NO: 1158283 - RNA, 19 nt, Homo sapiens
acuauaagauguacuaagg

SEQ ID NO: 1158284 - RNA, 19 nt, Homo sapiens
ccagaugagaagucaauuu

SEQ ID NO: 1158285 - RNA, 19 nt, Homo sapiens
gaucugaaagcgccgaaga

SEQ ID NO: 1158286 - RNA, 19 nt, Homo sapiens
cagaugagaagucaauuuc

SEQ ID NO: 1158287 - RNA, 19 nt, Homo sapiens
agaagaaaccaaugcaaga

SEQ ID NO: 1158288 - RNA, 19 nt, Homo sapiens
gaacuuggcuggcauaaac

SEQ ID NO: 1158289 - RNA, 19 nt, Homo sapiens
gaaauuugccaacuccuua

SEQ ID NO: 1158290 - RNA, 19 nt, Homo sapiens
ggagaagccugucaaguuc

SEQ ID NO: 1158291 - RNA, 19 nt, Homo sapiens
ggacacgacuugagcagaa

SEQ ID NO: 1158292 - RNA, 19 nt, Homo sapiens
gcgguuaauuccugacuua

SEQ ID NO: 1158293 - RNA, 19 nt, Homo sapiens
ggaagaagcugggcgagau

SEQ ID NO: 1158294 - RNA, 19 nt, Homo sapiens
gaggagaccuggccacugu

SEQ ID NO: 1158295 - RNA, 19 nt, Homo sapiens
caucagcaaucagaaauuu

SEQ ID NO: 1158296 - RNA, 19 nt, Homo sapiens
uaauaaacccuuuggcuuu

SEQ ID NO: 1158297 - RNA, 19 nt, Homo sapiens
ggacaaggcgcugcaguuu

SEQ ID NO: 1158298 - RNA, 19 nt, Homo sapiens
guuaauuccugacuuaguu

SEQ ID NO: 1158299 - RNA, 19 nt, Homo sapiens
gaaacagcaccgugacuuu

SEQ ID NO: 1158300 - RNA, 19 nt, Homo sapiens
ucaagaagcugcaguccau

SEQ ID NO: 1158301 - RNA, 19 nt, Homo sapiens
ucaccuacguggucucuuu

SEQ ID NO: 1158302 - RNA, 19 nt, Homo sapiens
gggaagccgugcagaagaa

SEQ ID NO: 1158303 - RNA, 19 nt, Homo sapiens
gccgaaggcuacuacgaua

SEQ ID NO: 1158304 - RNA, 19 nt, Homo sapiens
gaucucugcugcucaacaa

SEQ ID NO: 1158305 - RNA, 19 nt, Homo sapiens
gcccugcaguggcgucuua

SEQ ID NO: 1158306 - RNA, 19 nt, Homo sapiens
gagguaaacauccagaauu

SEQ ID NO: 1158307 - RNA, 19 nt, Homo sapiens
uggaacagcugcaggagaa

SEQ ID NO: 1158308 - RNA, 19 nt, Homo sapiens
uugcugagcuggacaagaa

SEQ ID NO: 1158309 - RNA, 19 nt, Homo sapiens
uacaugaccucgacgcuuu

SEQ ID NO: 1158310 - RNA, 19 nt, Homo sapiens
guaaacauccagaauuuca

SEQ ID NO: 1158311 - RNA, 19 nt, Homo sapiens
ggagauugcugccccuaua

SEQ ID NO: 1158312 - RNA, 19 nt, Homo sapiens
ccagcgagguggcuaguga

SEQ ID NO: 1158313 - RNA, 19 nt, Homo sapiens
gaacagcgcaaagaggaaa

SEQ ID NO: 1158314 - RNA, 19 nt, Homo sapiens
cagacgaccuguugcagaa

SEQ ID NO: 1158315 - RNA, 19 nt, Homo sapiens
ggagaaggcugagcaugag

SEQ ID NO: 1158316 - RNA, 19 nt, Homo sapiens
agguaaacauccagaauuu

SEQ ID NO: 1158317 - RNA, 19 nt, Homo sapiens
aaagugccauggcugauga

SEQ ID NO: 1158318 - RNA, 19 nt, Homo sapiens
ggaggcagacgaccuguug

SEQ ID NO: 1158319 - RNA, 19 nt, Homo sapiens
ggccugaucucguggacuu

SEQ ID NO: 1158320 - RNA, 19 nt, Homo sapiens
gaaccaagaaaaccaguua

SEQ ID NO: 1158321 - RNA, 19 nt, Homo sapiens
agaaguccaucaucaccua

SEQ ID NO: 1158322 - RNA, 19 nt, Homo sapiens
uggaggugcucaugaacua

SEQ ID NO: 1158323 - RNA, 19 nt, Homo sapiens
gaucgaguguggccauaca

SEQ ID NO: 1158324 - RNA, 19 nt, Homo sapiens
gcccagcaauggaugcaaa

SEQ ID NO: 1158325 - RNA, 19 nt, Homo sapiens
cugcagcgcuuccuacaug

SEQ ID NO: 1158326 - RNA, 19 nt, Homo sapiens
agggagagcuggcugaaug

SEQ ID NO: 1158327 - RNA, 19 nt, Homo sapiens
ugagagccuuugagcauga

SEQ ID NO: 1158328 - RNA, 19 nt, Homo sapiens
aaagcuacaugaccaacuu

SEQ ID NO: 1158329 - RNA, 19 nt, Homo sapiens
uggagaagccugucaaguu

SEQ ID NO: 1158330 - RNA, 19 nt, Homo sapiens
gcaagagucagucgaucaa

SEQ ID NO: 1158331 - RNA, 19 nt, Homo sapiens
acaaggcgcugcaguuucu

SEQ ID NO: 1158332 - RNA, 19 nt, Homo sapiens
cgucaaagcucaaaacugu

SEQ ID NO: 1158333 - RNA, 19 nt, Homo sapiens
gcacuggauugccgagaag

SEQ ID NO: 1158334 - RNA, 19 nt, Homo sapiens
agagcuggcugaaugagaa

SEQ ID NO: 1158335 - RNA, 19 nt, Homo sapiens
ccucagagccaugcgguua

SEQ ID NO: 1158336 - RNA, 19 nt, Homo sapiens
gcacgagggcuuccuacug

SEQ ID NO: 1158337 - RNA, 19 nt, Homo sapiens
cucgggagcuucauaaguu

SEQ ID NO: 1158338 - RNA, 19 nt, Homo sapiens
ucagcaaacucaccaaguc

SEQ ID NO: 1158339 - RNA, 19 nt, Homo sapiens
aauaaacccuuuggcuuug

SEQ ID NO: 1158340 - RNA, 19 nt, Homo sapiens
caguggaggugcucaugaa

SEQ ID NO: 1158341 - RNA, 19 nt, Homo sapiens
ggaggcagccaugaagaaa

SEQ ID NO: 1158342 - RNA, 19 nt, Homo sapiens
ggucgugggugagccugua

SEQ ID NO: 1158343 - RNA, 19 nt, Homo sapiens
gcacaucuaccagcucuuc

SEQ ID NO: 1158344 - RNA, 19 nt, Homo sapiens
cacacuguauguaccuaua

SEQ ID NO: 1158345 - RNA, 19 nt, Homo sapiens
cagcuuauccggcgacaug

SEQ ID NO: 1158346 - RNA, 19 nt, Homo sapiens
ccagggacgugucaucagu

SEQ ID NO: 1158347 - RNA, 19 nt, Homo sapiens
cugcaaccgucgccucuuu

SEQ ID NO: 1158348 - RNA, 19 nt, Homo sapiens
caugaggccuuccgcaaag

SEQ ID NO: 1158349 - RNA, 19 nt, Homo sapiens
ugacccggcugcuggagaa

SEQ ID NO: 1158350 - RNA, 19 nt, Homo sapiens
gccuuuaccucacuuccaa

SEQ ID NO: 1158351 - RNA, 19 nt, Homo sapiens
ggccagacacuacccacua

SEQ ID NO: 1158352 - RNA, 19 nt, Homo sapiens
ucacgcggcuccuggaagu

SEQ ID NO: 1158353 - RNA, 19 nt, Homo sapiens
guggagaacuacgaggaaa

SEQ ID NO: 1158354 - RNA, 19 nt, Homo sapiens
ggacaagggcaaggacgaa

SEQ ID NO: 1158355 - RNA, 19 nt, Homo sapiens
gaugagguggagcagcuua

SEQ ID NO: 1158356 - RNA, 19 nt, Homo sapiens
ugccauggcugaugagauc

SEQ ID NO: 1158357 - RNA, 19 nt, Homo sapiens
ggacaacuuuggguaugag

SEQ ID NO: 1158358 - RNA, 19 nt, Homo sapiens
cacuauuucuccaagauga

SEQ ID NO: 1158359 - RNA, 19 nt, Homo sapiens
gcaauaacugagcuugaug

SEQ ID NO: 1158360 - RNA, 19 nt, Homo sapiens
ggaacugggcuucuacaag

SEQ ID NO: 1158361 - RNA, 19 nt, Homo sapiens
gagcuucagggacagauug

SEQ ID NO: 1158362 - RNA, 19 nt, Homo sapiens
gaugguggaugagcugauc

SEQ ID NO: 1158363 - RNA, 19 nt, Homo sapiens
gccaggacuuugagcaugu

SEQ ID NO: 1158364 - RNA, 19 nt, Homo sapiens
aggaguggcuggagaagau

SEQ ID NO: 1158365 - RNA, 19 nt, Homo sapiens
caucugggauauugacaag

SEQ ID NO: 1158366 - RNA, 19 nt, Homo sapiens
gcaaacugcgugccugcaa

SEQ ID NO: 1158367 - RNA, 19 nt, Homo sapiens
ccaaguccaaugccaacua

SEQ ID NO: 1158368 - RNA, 19 nt, Homo sapiens
guaaaugccacuucaugag

SEQ ID NO: 1158369 - RNA, 19 nt, Homo sapiens
gggugagccuguacugugu

SEQ ID NO: 1158370 - RNA, 19 nt, Homo sapiens
uucauaaguucuucaguga

SEQ ID NO: 1158371 - RNA, 19 nt, Homo sapiens
ucgagagccuggaccaaga

SEQ ID NO: 1158372 - RNA, 19 nt, Homo sapiens
gcugcuggauccugaagau

SEQ ID NO: 1158373 - RNA, 19 nt, Homo sapiens
gagcuugagcacuggauug

SEQ ID NO: 1158374 - RNA, 19 nt, Homo sapiens
ggaagcagagcaguuguuc

SEQ ID NO: 1158375 - RNA, 19 nt, Homo sapiens
caggacaacuuuggguaug

SEQ ID NO: 1158376 - RNA, 19 nt, Homo sapiens
uggagaaggcugagcauga

SEQ ID NO: 1158377 - RNA, 19 nt, Homo sapiens
caaguccaaugccaacuac

SEQ ID NO: 1158378 - RNA, 19 nt, Homo sapiens
agaugaagacagcugguua

SEQ ID NO: 1158379 - RNA, 19 nt, Homo sapiens
ggcgaucucugcugcucaa

SEQ ID NO: 1158380 - RNA, 19 nt, Homo sapiens
agggacagauugaggagaa

SEQ ID NO: 1158381 - RNA, 19 nt, Homo sapiens
agacugaggacaacagaga

SEQ ID NO: 1158382 - RNA, 19 nt, Homo sapiens
gagccuggaccaagagaug

SEQ ID NO: 1158383 - RNA, 19 nt, Homo sapiens
uaaacccuuuggcuuugaa

SEQ ID NO: 1158384 - RNA, 19 nt, Homo sapiens
ucgcugaggugaccgaagu

SEQ ID NO: 1158385 - RNA, 19 nt, Homo sapiens
gguggaagcagagcaguug

SEQ ID NO: 1158386 - RNA, 19 nt, Homo sapiens
ccuacgggcugagcugauu

SEQ ID NO: 1158387 - RNA, 19 nt, Homo sapiens
gcuggauccugaagaugug

SEQ ID NO: 1158388 - RNA, 19 nt, Homo sapiens
gcacagcuaugauuccuua

SEQ ID NO: 1158389 - RNA, 19 nt, Homo sapiens
ugacaaauaugcucaguuu

SEQ ID NO: 1158390 - RNA, 19 nt, Homo sapiens
agauagaccuggaaacaua

SEQ ID NO: 1158391 - RNA, 19 nt, Homo sapiens
gcaagauggcugagaaaua

SEQ ID NO: 1158392 - RNA, 19 nt, Homo sapiens
guucaaagcuauccaacuu

SEQ ID NO: 1158393 - RNA, 19 nt, Homo sapiens
gaaaggagaacuagguauu

SEQ ID NO: 1158394 - RNA, 19 nt, Homo sapiens
gaacaagaaaggagaacua

SEQ ID NO: 1158395 - RNA, 19 nt, Homo sapiens
caucgaggcuuccagaauu

SEQ ID NO: 1158396 - RNA, 19 nt, Homo sapiens
cagcuaugauuccuuauuu

SEQ ID NO: 1158397 - RNA, 19 nt, Homo sapiens
uguaaugccucgugaagua

SEQ ID NO: 1158398 - RNA, 19 nt, Homo sapiens
ucaggcagcucauaauuug

SEQ ID NO: 1158399 - RNA, 19 nt, Homo sapiens
caagauggcugagaaauac

SEQ ID NO: 1158400 - RNA, 19 nt, Homo sapiens
caauggaucugugauuaaa

SEQ ID NO: 1158401 - RNA, 19 nt, Homo sapiens
gaaaucugcuuuggugaug

SEQ ID NO: 1158402 - RNA, 19 nt, Homo sapiens
cauggucucuucuggauaa

SEQ ID NO: 1158403 - RNA, 19 nt, Homo sapiens
gccaugugauccauaauuu

SEQ ID NO: 1158404 - RNA, 19 nt, Homo sapiens
gaugauacaaccaugauuu

SEQ ID NO: 1158405 - RNA, 19 nt, Homo sapiens
caggagaccauuuauuaua

SEQ ID NO: 1158406 - RNA, 19 nt, Homo sapiens
cagcuuggauugacucauu

SEQ ID NO: 1158407 - RNA, 19 nt, Homo sapiens
aacaggagaccauuuauua

SEQ ID NO: 1158408 - RNA, 19 nt, Homo sapiens
cauuaccgcuucucucuuu

SEQ ID NO: 1158409 - RNA, 19 nt, Homo sapiens
caaaggcacugcugauuuu

SEQ ID NO: 1158410 - RNA, 19 nt, Homo sapiens
caacucgcuuaaucaagua

SEQ ID NO: 1158411 - RNA, 19 nt, Homo sapiens
cacugcagcuuaucaagua

SEQ ID NO: 1158412 - RNA, 19 nt, Homo sapiens
guaccuguuugugaacuua

SEQ ID NO: 1158413 - RNA, 19 nt, Homo sapiens
guagacagcuucuuaaacc

SEQ ID NO: 1158414 - RNA, 19 nt, Homo sapiens
ccaggaagcugcuaaaaga

SEQ ID NO: 1158415 - RNA, 19 nt, Homo sapiens
ucaaaggcacugcugauuu

SEQ ID NO: 1158416 - RNA, 19 nt, Homo sapiens
gcagaaagguauggugucu

SEQ ID NO: 1158417 - RNA, 19 nt, Homo sapiens
caccauaaaugaagcuaau

SEQ ID NO: 1158418 - RNA, 19 nt, Homo sapiens
aagcguaccuguuugugaa

SEQ ID NO: 1158419 - RNA, 19 nt, Homo sapiens
uaacaggagaccauuuauu

SEQ ID NO: 1158420 - RNA, 19 nt, Homo sapiens
gaccuggaaacauaaauuu

SEQ ID NO: 1158421 - RNA, 19 nt, Homo sapiens
ugauuugccucagacuuua

SEQ ID NO: 1158422 - RNA, 19 nt, Homo sapiens
caucuggauuuauuugcua

SEQ ID NO: 1158423 - RNA, 19 nt, Homo sapiens
uguaacaggagaccauuua

SEQ ID NO: 1158424 - RNA, 19 nt, Homo sapiens
acaacucgcuuaaucaagu

SEQ ID NO: 1158425 - RNA, 19 nt, Homo sapiens
aagcuaauguucuuucugu

SEQ ID NO: 1158426 - RNA, 19 nt, Homo sapiens
ucacgucuguuaccugaug

SEQ ID NO: 1158427 - RNA, 19 nt, Homo sapiens
gugauccacugccauguga

SEQ ID NO: 1158428 - RNA, 19 nt, Homo sapiens
caagaaaggagaacuaggu

SEQ ID NO: 1158429 - RNA, 19 nt, Homo sapiens
gaaguugucaagucucaga

SEQ ID NO: 1158430 - RNA, 19 nt, Homo sapiens
ccagaaaggaauugauuau

SEQ ID NO: 1158431 - RNA, 19 nt, Homo sapiens
caggagaggcgucugcuuu

SEQ ID NO: 1158432 - RNA, 19 nt, Homo sapiens
ggauacagcagccgguuug

SEQ ID NO: 1158433 - RNA, 19 nt, Homo sapiens
uuauacaacucgcuuaauc

SEQ ID NO: 1158434 - RNA, 19 nt, Homo sapiens
gcuaauguucuuucuguga

SEQ ID NO: 1158435 - RNA, 19 nt, Homo sapiens
ggaaaucugcuuuggugau

SEQ ID NO: 1158436 - RNA, 19 nt, Homo sapiens
ccgaaacaauggccuugaa

SEQ ID NO: 1158437 - RNA, 19 nt, Homo sapiens
ggcuuucccugcaggauuu

SEQ ID NO: 1158438 - RNA, 19 nt, Homo sapiens
gauagaccuggaaacauaa

SEQ ID NO: 1158439 - RNA, 19 nt, Homo sapiens
ucaaguaccaggagaacaa

SEQ ID NO: 1158440 - RNA, 19 nt, Homo sapiens
ggucucuucuggauaacuu

SEQ ID NO: 1158441 - RNA, 19 nt, Homo sapiens
gcugugcaauauuauacaa

SEQ ID NO: 1158442 - RNA, 19 nt, Homo sapiens
guugucaagucucagauug

SEQ ID NO: 1158443 - RNA, 19 nt, Homo sapiens
gagagagaguuuucaagaa

SEQ ID NO: 1158444 - RNA, 19 nt, Homo sapiens
auacaaccaugauuugcaa

SEQ ID NO: 1158445 - RNA, 19 nt, Homo sapiens
gaaaaccacuaaccuugau

SEQ ID NO: 1158446 - RNA, 19 nt, Homo sapiens
ucaauggaucugugauuaa

SEQ ID NO: 1158447 - RNA, 19 nt, Homo sapiens
cagcagaucccaacucagu

SEQ ID NO: 1158448 - RNA, 19 nt, Homo sapiens
gacgacagguuucaucaac

SEQ ID NO: 1158449 - RNA, 19 nt, Homo sapiens
uaucaaacagcuuggauug

SEQ ID NO: 1158450 - RNA, 19 nt, Homo sapiens
gccaagaucauccgaaaca

SEQ ID NO: 1158451 - RNA, 19 nt, Homo sapiens
auucaucgauggugauuau

SEQ ID NO: 1158452 - RNA, 19 nt, Homo sapiens
agaaagguauggugucucu

SEQ ID NO: 1158453 - RNA, 19 nt, Homo sapiens
cccaguagacagcuucuua

SEQ ID NO: 1158454 - RNA, 19 nt, Homo sapiens
gcccauauuuuguguguuu

SEQ ID NO: 1158455 - RNA, 19 nt, Homo sapiens
ccaguagacagcuucuuaa

SEQ ID NO: 1158456 - RNA, 19 nt, Homo sapiens
uaggcaagauggcugagaa

SEQ ID NO: 1158457 - RNA, 19 nt, Homo sapiens
gauaaagucaaucuucaag

SEQ ID NO: 1158458 - RNA, 19 nt, Homo sapiens
uauggugucucuaucacuu

SEQ ID NO: 1158459 - RNA, 19 nt, Homo sapiens
uucaggcaaucucaacuua

SEQ ID NO: 1158460 - RNA, 19 nt, Homo sapiens
gugauuauccugaaguugu

SEQ ID NO: 1158461 - RNA, 19 nt, Homo sapiens
gauccuggcacagcuauga

SEQ ID NO: 1158462 - RNA, 19 nt, Homo sapiens
uuucugugaugucauauga

SEQ ID NO: 1158463 - RNA, 19 nt, Homo sapiens
auuauaagcguaccuguuu

SEQ ID NO: 1158464 - RNA, 19 nt, Homo sapiens
uggauaacuuugaguggaa

SEQ ID NO: 1158465 - RNA, 19 nt, Homo sapiens
ggacacauuuacucaucag

SEQ ID NO: 1158466 - RNA, 19 nt, Homo sapiens
caagaucauccgaaacaau

SEQ ID NO: 1158467 - RNA, 19 nt, Homo sapiens
ggagaacaagaaaggagaa

SEQ ID NO: 1158468 - RNA, 19 nt, Homo sapiens
gcagaucccaacucagugu

SEQ ID NO: 1158469 - RNA, 19 nt, Homo sapiens
uaucaggcagcucauaauu

SEQ ID NO: 1158470 - RNA, 19 nt, Homo sapiens
gacaaacauuucaggaacu

SEQ ID NO: 1158471 - RNA, 19 nt, Homo sapiens
ggagagagaguuuucaaga

SEQ ID NO: 1158472 - RNA, 19 nt, Homo sapiens
ggacgacagguuucaucaa

SEQ ID NO: 1158473 - RNA, 19 nt, Homo sapiens
ucagauagaccuggaaaca

SEQ ID NO: 1158474 - RNA, 19 nt, Homo sapiens
gggacacauuuacucauca

SEQ ID NO: 1158475 - RNA, 19 nt, Homo sapiens
cagacaaacauuucaggaa

SEQ ID NO: 1158476 - RNA, 19 nt, Homo sapiens
ggauuggaucuacguggua

SEQ ID NO: 1158477 - RNA, 19 nt, Homo sapiens
aagcaaggcuauccaucau

SEQ ID NO: 1158478 - RNA, 19 nt, Homo sapiens
cuaauguucuuucugugau

SEQ ID NO: 1158479 - RNA, 19 nt, Homo sapiens
gauacaaccaugauuugca

SEQ ID NO: 1158480 - RNA, 19 nt, Homo sapiens
aaaccacuaaccuugauuu

SEQ ID NO: 1158481 - RNA, 19 nt, Homo sapiens
aaagcaaggcuauccauca

SEQ ID NO: 1158482 - RNA, 19 nt, Homo sapiens
aaagguauggugucucuau

SEQ ID NO: 1158483 - RNA, 19 nt, Homo sapiens
gaugaucuuucaggcaauc

SEQ ID NO: 1158484 - RNA, 19 nt, Homo sapiens
gaagaagagaagaaaauga

SEQ ID NO: 1158485 - RNA, 19 nt, Homo sapiens
ucacugaagaagagaagaa

SEQ ID NO: 1158486 - RNA, 19 nt, Homo sapiens
caaccaugauuugcaacug

SEQ ID NO: 1158487 - RNA, 19 nt, Homo sapiens
ccaagaucauccgaaacaa

SEQ ID NO: 1158488 - RNA, 19 nt, Homo sapiens
gaaaggaggccacagaaua

SEQ ID NO: 1158489 - RNA, 19 nt, Homo sapiens
gggaagacauguaaagaua

SEQ ID NO: 1158490 - RNA, 19 nt, Homo sapiens
gaacauaccagccugaauu

SEQ ID NO: 1158491 - RNA, 19 nt, Homo sapiens
ggacaaguguaaccuuuaa

SEQ ID NO: 1158492 - RNA, 19 nt, Homo sapiens
ggccugagcugcaugaaua

SEQ ID NO: 1158493 - RNA, 19 nt, Homo sapiens
gaccugagcugcaucguaa

SEQ ID NO: 1158494 - RNA, 19 nt, Homo sapiens
gaugagugcucuuuggaua

SEQ ID NO: 1158495 - RNA, 19 nt, Homo sapiens
caaagaagcuguggauuca

SEQ ID NO: 1158496 - RNA, 19 nt, Homo sapiens
gaaggcaaguguaguuuga

SEQ ID NO: 1158497 - RNA, 19 nt, Homo sapiens
ccaauucugugacaacaua

SEQ ID NO: 1158498 - RNA, 19 nt, Homo sapiens
ggaacucauugaagacaua

SEQ ID NO: 1158499 - RNA, 19 nt, Homo sapiens
caaccacccuggcacauuu

SEQ ID NO: 1158500 - RNA, 19 nt, Homo sapiens
guccaugacuguuugaaua

SEQ ID NO: 1158501 - RNA, 19 nt, Homo sapiens
gaccgcaccuguaaggaua

SEQ ID NO: 1158502 - RNA, 19 nt, Homo sapiens
caaggagucuguaguggaa

SEQ ID NO: 1158503 - RNA, 19 nt, Homo sapiens
ucagggagcuacuuccuuu

SEQ ID NO: 1158504 - RNA, 19 nt, Homo sapiens
gaucacggcuguagucaca

SEQ ID NO: 1158505 - RNA, 19 nt, Homo sapiens
ggucauaauugucuugaug

SEQ ID NO: 1158506 - RNA, 19 nt, Homo sapiens
caauacaaauguucugcua

SEQ ID NO: 1158507 - RNA, 19 nt, Homo sapiens
gcagauggcuuugcaccuu

SEQ ID NO: 1158508 - RNA, 19 nt, Homo sapiens
gagaagcacagcucaguaa

SEQ ID NO: 1158509 - RNA, 19 nt, Homo sapiens
cgagagauguuuccaagau

SEQ ID NO: 1158510 - RNA, 19 nt, Homo sapiens
caaacuacccaggcaauua

SEQ ID NO: 1158511 - RNA, 19 nt, Homo sapiens
guuuaucacuguugaguuu

SEQ ID NO: 1158512 - RNA, 19 nt, Homo sapiens
gcauucaccucucuucaga

SEQ ID NO: 1158513 - RNA, 19 nt, Homo sapiens
ugagaaccaucaggaaaua

SEQ ID NO: 1158514 - RNA, 19 nt, Homo sapiens
gcacgagaacgcugcauuu

SEQ ID NO: 1158515 - RNA, 19 nt, Homo sapiens
ggaaauguuuaucacuguu

SEQ ID NO: 1158516 - RNA, 19 nt, Homo sapiens
gcagggcugggaccuauua

SEQ ID NO: 1158517 - RNA, 19 nt, Homo sapiens
uaacagaugagaagucuug

SEQ ID NO: 1158518 - RNA, 19 nt, Homo sapiens
ccagagagacugcaucuug

SEQ ID NO: 1158519 - RNA, 19 nt, Homo sapiens
gaccagcacuaccagagaa

SEQ ID NO: 1158520 - RNA, 19 nt, Homo sapiens
cagagagacugcaucuuga

SEQ ID NO: 1158521 - RNA, 19 nt, Homo sapiens
aaaggaggccacagaauaa

SEQ ID NO: 1158522 - RNA, 19 nt, Homo sapiens
caggaaauacuuaaggaua

SEQ ID NO: 1158523 - RNA, 19 nt, Homo sapiens
gaggaggccuugccaccaa

SEQ ID NO: 1158524 - RNA, 19 nt, Homo sapiens
aaacauaacccaguguaaa

SEQ ID NO: 1158525 - RNA, 19 nt, Homo sapiens
gaaaccagaguucaauguu

SEQ ID NO: 1158526 - RNA, 19 nt, Homo sapiens
gcugggaccuauuaugaug

SEQ ID NO: 1158527 - RNA, 19 nt, Homo sapiens
caggacaaguguaaccuuu

SEQ ID NO: 1158528 - RNA, 19 nt, Homo sapiens
ccguaucagugacucauua

SEQ ID NO: 1158529 - RNA, 19 nt, Homo sapiens
gaagacauaguucgagaug

SEQ ID NO: 1158530 - RNA, 19 nt, Homo sapiens
aguguaaccuuuaagcuaa

SEQ ID NO: 1158531 - RNA, 19 nt, Homo sapiens
gcaguuguccuguuggauu

SEQ ID NO: 1158532 - RNA, 19 nt, Homo sapiens
gggcggaugucuuggauag

SEQ ID NO: 1158533 - RNA, 19 nt, Homo sapiens
gaaaaccucuucauccaau

SEQ ID NO: 1158534 - RNA, 19 nt, Homo sapiens
gggcugggaccuauuauga

SEQ ID NO: 1158535 - RNA, 19 nt, Homo sapiens
gaacacagugggcagcuau

SEQ ID NO: 1158536 - RNA, 19 nt, Homo sapiens
ccagaagcuuggaauaugu

SEQ ID NO: 1158537 - RNA, 19 nt, Homo sapiens
ccagaacuauuucaaguac

SEQ ID NO: 1158538 - RNA, 19 nt, Homo sapiens
gcaggaggauguagaugag

SEQ ID NO: 1158539 - RNA, 19 nt, Homo sapiens
gugaggacaucgaugaaug

SEQ ID NO: 1158540 - RNA, 19 nt, Homo sapiens
ucaaagaagcuguggauuc

SEQ ID NO: 1158541 - RNA, 19 nt, Homo sapiens
cgagaacgcugcauuuuau

SEQ ID NO: 1158542 - RNA, 19 nt, Homo sapiens
gaauauuccaggcaauuau

SEQ ID NO: 1158543 - RNA, 19 nt, Homo sapiens
ggauguagacugagaaugg

SEQ ID NO: 1158544 - RNA, 19 nt, Homo sapiens
ggacuaccaggaacucauu

SEQ ID NO: 1158545 - RNA, 19 nt, Homo sapiens
ggauucaguucaaguccaa

SEQ ID NO: 1158546 - RNA, 19 nt, Homo sapiens
caauggagguugugaucau

SEQ ID NO: 1158547 - RNA, 19 nt, Homo sapiens
ugacauaugaugaggacua

SEQ ID NO: 1158548 - RNA, 19 nt, Homo sapiens
gaguguacguggaccauca

SEQ ID NO: 1158549 - RNA, 19 nt, Homo sapiens
gagaagcggcuccguaaag

SEQ ID NO: 1158550 - RNA, 19 nt, Homo sapiens
ggaaacgugugcugucaac

SEQ ID NO: 1158551 - RNA, 19 nt, Homo sapiens
gcacuccugugacgauaca

SEQ ID NO: 1158552 - RNA, 19 nt, Homo sapiens
gacugcaucuugaccugua

SEQ ID NO: 1158553 - RNA, 19 nt, Homo sapiens
aaaccagaguucaauguuc

SEQ ID NO: 1158554 - RNA, 19 nt, Homo sapiens
gugucaaccuggugaauau

SEQ ID NO: 1158555 - RNA, 19 nt, Homo sapiens
ggaagacauguaaagauau

SEQ ID NO: 1158556 - RNA, 19 nt, Homo sapiens
gcugugaccgcaccuguaa

SEQ ID NO: 1158557 - RNA, 19 nt, Homo sapiens
gcggaugucuuggauagau

SEQ ID NO: 1158558 - RNA, 19 nt, Homo sapiens
gaggggagcugggagauuu

SEQ ID NO: 1158559 - RNA, 19 nt, Homo sapiens
gaaauguuuaucacuguug

SEQ ID NO: 1158560 - RNA, 19 nt, Homo sapiens
ccacugcaguuguccuguu

SEQ ID NO: 1158561 - RNA, 19 nt, Homo sapiens
ggaaaggaggccacagaau

SEQ ID NO: 1158562 - RNA, 19 nt, Homo sapiens
uggcugagcuggacuuugg

SEQ ID NO: 1158563 - RNA, 19 nt, Homo sapiens
gagagauguuuccaagauc

SEQ ID NO: 1158564 - RNA, 19 nt, Homo sapiens
ugaauauuccaggcaauua

SEQ ID NO: 1158565 - RNA, 19 nt, Homo sapiens
gggccagggucaugcagaa

SEQ ID NO: 1158566 - RNA, 19 nt, Homo sapiens
caaacauaacccaguguaa

SEQ ID NO: 1158567 - RNA, 19 nt, Homo sapiens
cccagaagcuuggaauaug

SEQ ID NO: 1158568 - RNA, 19 nt, Homo sapiens
uaaaugaaggcaaguguag

SEQ ID NO: 1158569 - RNA, 19 nt, Homo sapiens
ugacugcggcugcaagaaa

SEQ ID NO: 1158570 - RNA, 19 nt, Homo sapiens
guuccaaaguguccagguu

SEQ ID NO: 1158571 - RNA, 19 nt, Homo sapiens
ggucaaagaagcuguggau

SEQ ID NO: 1158572 - RNA, 19 nt, Homo sapiens
gaaccucgacguggcuaaa

SEQ ID NO: 1158573 - RNA, 19 nt, Homo sapiens
gcagcugccauccacagua

SEQ ID NO: 1158574 - RNA, 19 nt, Homo sapiens
accaggaacucauugaaga

SEQ ID NO: 1158575 - RNA, 19 nt, Homo sapiens
caaaugacuugugaaccau

SEQ ID NO: 1158576 - RNA, 19 nt, Homo sapiens
ccgagaagcggcuccguaa

SEQ ID NO: 1158577 - RNA, 19 nt, Homo sapiens
gagcuugaaacuaaccaaa

SEQ ID NO: 1158578 - RNA, 19 nt, Homo sapiens
cagcaggucugugugaaca

SEQ ID NO: 1158579 - RNA, 19 nt, Homo sapiens
aaccagaguucaauguuca

SEQ ID NO: 1158580 - RNA, 19 nt, Homo sapiens
gaaaaccaaugugucaguu

SEQ ID NO: 1158581 - RNA, 19 nt, Homo sapiens
caugacuguuugaauauuc

SEQ ID NO: 1158582 - RNA, 19 nt, Homo sapiens
guagucacaucugcaagga

SEQ ID NO: 1158583 - RNA, 19 nt, Homo sapiens
ccaugacuguuugaauauu

SEQ ID NO: 1158584 - RNA, 19 nt, Homo sapiens
aguacaagaugcacacaga

SEQ ID NO: 1158585 - RNA, 19 nt, Homo sapiens
agacucaccuguccuucug

SEQ ID NO: 1158586 - RNA, 19 nt, Homo sapiens
gaggaaggacaaaugacuu

SEQ ID NO: 1158587 - RNA, 19 nt, Homo sapiens
cagcacuccugugacgaua

SEQ ID NO: 1158588 - RNA, 19 nt, Homo sapiens
guacacaucugcuuuguuc

SEQ ID NO: 1158589 - RNA, 19 nt, Homo sapiens
ucacagagaugacaaacug

SEQ ID NO: 1158590 - RNA, 19 nt, Homo sapiens
gaacugagccaaaccuuca

SEQ ID NO: 1158591 - RNA, 19 nt, Homo sapiens
gagauaagaauccaaacua

SEQ ID NO: 1158592 - RNA, 19 nt, Homo sapiens
gagcaaaggagacaauauu

SEQ ID NO: 1158593 - RNA, 19 nt, Homo sapiens
ggaagaagcgguuggaguu

SEQ ID NO: 1158594 - RNA, 19 nt, Homo sapiens
gaggcuaguucuugucuaa

SEQ ID NO: 1158595 - RNA, 19 nt, Homo sapiens
cagcaucucuguccucuug

SEQ ID NO: 1158596 - RNA, 19 nt, Homo sapiens
ggacaaucccuuucacaaa

SEQ ID NO: 1158597 - RNA, 19 nt, Homo sapiens
ccaugaguauguauguuua

SEQ ID NO: 1158598 - RNA, 19 nt, Homo sapiens
aaacaaaccagcugccuuu

SEQ ID NO: 1158599 - RNA, 19 nt, Homo sapiens
gacaaucccuuucacaaac

SEQ ID NO: 1158600 - RNA, 19 nt, Homo sapiens
gauaagaauccaaacuaug

SEQ ID NO: 1158601 - RNA, 19 nt, Homo sapiens
ucaagacuguucuggaaug

SEQ ID NO: 1158602 - RNA, 19 nt, Homo sapiens
gagaguccguggcugaugu

SEQ ID NO: 1158603 - RNA, 19 nt, Homo sapiens
ugacaacacuuuuccauga

SEQ ID NO: 1158604 - RNA, 19 nt, Homo sapiens
ucucuguccucuugauuaa

SEQ ID NO: 1158605 - RNA, 19 nt, Homo sapiens
guuuaccugugccuaauaa

SEQ ID NO: 1158606 - RNA, 19 nt, Homo sapiens
acucaagacuguucuggaa

SEQ ID NO: 1158607 - RNA, 19 nt, Homo sapiens
aauauucccugcucacaga

SEQ ID NO: 1158608 - RNA, 19 nt, Homo sapiens
ggaagaggagggagacaga

SEQ ID NO: 1158609 - RNA, 19 nt, Homo sapiens
ggagggagacagagaagug

SEQ ID NO: 1158610 - RNA, 19 nt, Homo sapiens
gcacugaguauaccugcaa

SEQ ID NO: 1158611 - RNA, 19 nt, Homo sapiens
cuuuguaucuuguaccuuu

SEQ ID NO: 1158612 - RNA, 19 nt, Homo sapiens
gggauuagcuccgguuugc

SEQ ID NO: 1158613 - RNA, 19 nt, Homo sapiens
gggauuagcuccgguuugc

SEQ ID NO: 1158614 - RNA, 19 nt, Homo sapiens
caagacuguucuggaauga

SEQ ID NO: 1158615 - RNA, 19 nt, Homo sapiens
ccagagauaagaauccaaa

SEQ ID NO: 1158616 - RNA, 19 nt, Homo sapiens
cagcugccuuuguaucuug

SEQ ID NO: 1158617 - RNA, 19 nt, Homo sapiens
ggauuugggccagagauaa

SEQ ID NO: 1158618 - RNA, 19 nt, Homo sapiens
gaagaagcgguuggaguug

SEQ ID NO: 1158619 - RNA, 19 nt, Homo sapiens
guacagcagugagcaaagg

SEQ ID NO: 1158620 - RNA, 19 nt, Homo sapiens
ggccuaagccugggauuug

SEQ ID NO: 1158621 - RNA, 19 nt, Homo sapiens
cuacgugggaccugagaua

SEQ ID NO: 1158622 - RNA, 19 nt, Homo sapiens
ggacgaagccagggaagag

SEQ ID NO: 1158623 - RNA, 19 nt, Homo sapiens
gguuggaguuggaugacaa

SEQ ID NO: 1158624 - RNA, 19 nt, Homo sapiens
gggauuugggccagagaua

SEQ ID NO: 1158625 - RNA, 19 nt, Homo sapiens
gacaaacuggcauccuuga

SEQ ID NO: 1158626 - RNA, 19 nt, Homo sapiens
cagaaacgagcucgaagug

SEQ ID NO: 1158627 - RNA, 19 nt, Homo sapiens
gcaucucuguccucuugau

SEQ ID NO: 1158628 - RNA, 19 nt, Homo sapiens
uggcugaugucugcacuga

SEQ ID NO: 1158629 - RNA, 19 nt, Homo sapiens
gagguaucccugugccaaa

SEQ ID NO: 1158630 - RNA, 19 nt, Homo sapiens
cuaugaggcuaguucuugu

SEQ ID NO: 1158631 - RNA, 19 nt, Homo sapiens
gcagugagcaaaggagaca

SEQ ID NO: 1158632 - RNA, 19 nt, Homo sapiens
gaguacagcagugagcaaa

SEQ ID NO: 1158633 - RNA, 19 nt, Homo sapiens
caacaguggauugaguuug

SEQ ID NO: 1158634 - RNA, 19 nt, Homo sapiens
cuacaggcacugaguauac

SEQ ID NO: 1158635 - RNA, 19 nt, Homo sapiens
aggcaccucuguccaagga

SEQ ID NO: 1158636 - RNA, 19 nt, Homo sapiens
acgcucagcugccaacagu

SEQ ID NO: 1158637 - RNA, 19 nt, Homo sapiens
gcguggcgcucuucaccau

SEQ ID NO: 1158638 - RNA, 19 nt, Homo sapiens
ggucugguccugcgugauc

SEQ ID NO: 1158639 - RNA, 19 nt, Homo sapiens
ccacaaucccagguccaua

SEQ ID NO: 1158640 - RNA, 19 nt, Homo sapiens
guccaggccugucaaccau

SEQ ID NO: 1158641 - RNA, 19 nt, Homo sapiens
acaaucccuuucacaaaca

SEQ ID NO: 1158642 - RNA, 19 nt, Homo sapiens
gcaaaggagacaauauucc

SEQ ID NO: 1158643 - RNA, 19 nt, Homo sapiens
ccacacacaugcaguuccu

SEQ ID NO: 1158644 - RNA, 19 nt, Homo sapiens
agaagcuggugcuggagaa

SEQ ID NO: 1158645 - RNA, 19 nt, Homo sapiens
ccagcugccuuuguaucuu

SEQ ID NO: 1158646 - RNA, 19 nt, Homo sapiens
ccaacccgaucccaucucu

SEQ ID NO: 1158647 - RNA, 19 nt, Homo sapiens
gguccugcgugaucucaag

SEQ ID NO: 1158648 - RNA, 19 nt, Homo sapiens
gauuagcuccgguuugcau

SEQ ID NO: 1158649 - RNA, 19 nt, Homo sapiens
gauuagcuccgguuugcau

SEQ ID NO: 1158650 - RNA, 19 nt, Homo sapiens
ucagcucacgggccucaua

SEQ ID NO: 1158651 - RNA, 19 nt, Homo sapiens
gauuagcuccgguuugcau

SEQ ID NO: 1158652 - RNA, 19 nt, Homo sapiens
uauguuuaccugugccuaa

SEQ ID NO: 1158653 - RNA, 19 nt, Homo sapiens
ccagguccauacucuaggu

SEQ ID NO: 1158654 - RNA, 19 nt, Homo sapiens
cuucugaccugagcaccaa

SEQ ID NO: 1158655 - RNA, 19 nt, Homo sapiens
ggaguacagcagugagcaa

SEQ ID NO: 1158656 - RNA, 19 nt, Homo sapiens
gaagggagaaaggcagaag

SEQ ID NO: 1158657 - RNA, 19 nt, Homo sapiens
ccucugaacugagccaaac

SEQ ID NO: 1158658 - RNA, 19 nt, Homo sapiens
aacaguggauugaguuugg

SEQ ID NO: 1158659 - RNA, 19 nt, Homo sapiens
ccaacaguggauugaguuu

SEQ ID NO: 1158660 - RNA, 19 nt, Homo sapiens
ccagaaacgagcucgaagu

SEQ ID NO: 1158661 - RNA, 19 nt, Homo sapiens
ggccagagauaagaaucca

SEQ ID NO: 1158662 - RNA, 19 nt, Homo sapiens
agaagcgguuggaguugga

SEQ ID NO: 1158663 - RNA, 19 nt, Homo sapiens
guuccugcuugggugcuua

SEQ ID NO: 1158664 - RNA, 19 nt, Homo sapiens
gccaacaguggauugaguu

SEQ ID NO: 1158665 - RNA, 19 nt, Homo sapiens
gauuugggccagagauaag

SEQ ID NO: 1158666 - RNA, 19 nt, Homo sapiens
cugauuagcuccgguuugc

SEQ ID NO: 1158667 - RNA, 19 nt, Homo sapiens
caaucccuuucacaaacaa

SEQ ID NO: 1158668 - RNA, 19 nt, Homo sapiens
ucuccugccucugaacuga

SEQ ID NO: 1158669 - RNA, 19 nt, Homo sapiens
gggagacagagaagugguu

SEQ ID NO: 1158670 - RNA, 19 nt, Homo sapiens
uaccaugaguauguauguu

SEQ ID NO: 1158671 - RNA, 19 nt, Homo sapiens
gguccauacucuagguuuu

SEQ ID NO: 1158672 - RNA, 19 nt, Homo sapiens
augacaaacuggcauccuu

SEQ ID NO: 1158673 - RNA, 19 nt, Homo sapiens
gugagcaaaggagacaaua

SEQ ID NO: 1158674 - RNA, 19 nt, Homo sapiens
gcccuacaggcacugagua

SEQ ID NO: 1158675 - RNA, 19 nt, Homo sapiens
aaucccagguccauacucu

SEQ ID NO: 1158676 - RNA, 19 nt, Homo sapiens
gguccaggccugucaacca

SEQ ID NO: 1158677 - RNA, 19 nt, Homo sapiens
ggagaguccguggcugaug

SEQ ID NO: 1158678 - RNA, 19 nt, Homo sapiens
gagacucgcagcggaagug

SEQ ID NO: 1158679 - RNA, 19 nt, Homo sapiens
ucgcugaccgugagaggaa

SEQ ID NO: 1158680 - RNA, 19 nt, Homo sapiens
caucuucacucguguauua

SEQ ID NO: 1158681 - RNA, 19 nt, Homo sapiens
caacaaaucuggauauugg

SEQ ID NO: 1158682 - RNA, 19 nt, Homo sapiens
gaaacugacucuggauaua

SEQ ID NO: 1158683 - RNA, 19 nt, Homo sapiens
gaaaucaugugaaaugugu

SEQ ID NO: 1158684 - RNA, 19 nt, Homo sapiens
gcaaauagcugugguagag

SEQ ID NO: 1158685 - RNA, 19 nt, Homo sapiens
gaauguguguucucgauuu

SEQ ID NO: 1158686 - RNA, 19 nt, Homo sapiens
gaacaccucugcuuuaugc

SEQ ID NO: 1158687 - RNA, 19 nt, Homo sapiens
gaaaugacccugucugugu

SEQ ID NO: 1158688 - RNA, 19 nt, Homo sapiens
gguggcaucuguccuauuu

SEQ ID NO: 1158689 - RNA, 19 nt, Homo sapiens
ggacccaaauucagaagaa

SEQ ID NO: 1158690 - RNA, 19 nt, Homo sapiens
cuacacagauauugucaaa

SEQ ID NO: 1158691 - RNA, 19 nt, Homo sapiens
aguaaaggcuacacagaua

SEQ ID NO: 1158692 - RNA, 19 nt, Homo sapiens
ccacaccucuguuagcaaa

SEQ ID NO: 1158693 - RNA, 19 nt, Homo sapiens
cauauugccuaaccgauuu

SEQ ID NO: 1158694 - RNA, 19 nt, Homo sapiens
ccagaaccgucaacugaaa

SEQ ID NO: 1158695 - RNA, 19 nt, Homo sapiens
gauauuggagcccagcuua

SEQ ID NO: 1158696 - RNA, 19 nt, Homo sapiens
aagcauuucucacccauaa

SEQ ID NO: 1158697 - RNA, 19 nt, Homo sapiens
gaggaaaucaugaagaaau

SEQ ID NO: 1158698 - RNA, 19 nt, Homo sapiens
aagaggaaaucaugaagaa

SEQ ID NO: 1158699 - RNA, 19 nt, Homo sapiens
uggcaucuguccuauuuaa

SEQ ID NO: 1158700 - RNA, 19 nt, Homo sapiens
uaccucaguugcaauauuu

SEQ ID NO: 1158701 - RNA, 19 nt, Homo sapiens
ucacacggaugaagaagga

SEQ ID NO: 1158702 - RNA, 19 nt, Homo sapiens
gaaagaagaaaucggaagu

SEQ ID NO: 1158703 - RNA, 19 nt, Homo sapiens
caacaaacacagaggaaau

SEQ ID NO: 1158704 - RNA, 19 nt, Homo sapiens
gaaauuauucuacccuagu

SEQ ID NO: 1158705 - RNA, 19 nt, Homo sapiens
ggagguggcaucuguccua

SEQ ID NO: 1158706 - RNA, 19 nt, Homo sapiens
uguaucaagugcuguaauu

SEQ ID NO: 1158707 - RNA, 19 nt, Homo sapiens
gggcugauccaacaauuga

SEQ ID NO: 1158708 - RNA, 19 nt, Homo sapiens
aaaugacccugucugugua

SEQ ID NO: 1158709 - RNA, 19 nt, Homo sapiens
ccuaaccgauuugauauga

SEQ ID NO: 1158710 - RNA, 19 nt, Homo sapiens
aagaagaaaucggaaguga

SEQ ID NO: 1158711 - RNA, 19 nt, Homo sapiens
gcccuaggcuauagaagug

SEQ ID NO: 1158712 - RNA, 19 nt, Homo sapiens
ugugaaauguguaaagaug

SEQ ID NO: 1158713 - RNA, 19 nt, Homo sapiens
caugugaaauguguaaaga

SEQ ID NO: 1158714 - RNA, 19 nt, Homo sapiens
aaacugacucuggauauaa

SEQ ID NO: 1158715 - RNA, 19 nt, Homo sapiens
guuauugagucacauuugu

SEQ ID NO: 1158716 - RNA, 19 nt, Homo sapiens
aaauagcugugguagaguu

SEQ ID NO: 1158717 - RNA, 19 nt, Homo sapiens
guccuuaaaugaagaagau

SEQ ID NO: 1158718 - RNA, 19 nt, Homo sapiens
ccagaaggcgaaagaagaa

SEQ ID NO: 1158719 - RNA, 19 nt, Homo sapiens
gugaaguccuuaaaugaag

SEQ ID NO: 1158720 - RNA, 19 nt, Homo sapiens
caagugcuguaauuugaca

SEQ ID NO: 1158721 - RNA, 19 nt, Homo sapiens
guuaucaucagucuuugua

SEQ ID NO: 1158722 - RNA, 19 nt, Homo sapiens
gaaaucauggauacaucaa

SEQ ID NO: 1158723 - RNA, 19 nt, Homo sapiens
uaucaagugcuguaauuug

SEQ ID NO: 1158724 - RNA, 19 nt, Homo sapiens
guugcaauauuuacugguu

SEQ ID NO: 1158725 - RNA, 19 nt, Homo sapiens
gcacugucguuggccugua

SEQ ID NO: 1158726 - RNA, 19 nt, Homo sapiens
caagaggaaaucaugaaga

SEQ ID NO: 1158727 - RNA, 19 nt, Homo sapiens
uaucaucagucuuuguauc

SEQ ID NO: 1158728 - RNA, 19 nt, Homo sapiens
uuaccucaguugcaauauu

SEQ ID NO: 1158729 - RNA, 19 nt, Homo sapiens
uagacacagucaucagaaa

SEQ ID NO: 1158730 - RNA, 19 nt, Homo sapiens
ggaaaucaugugaaaugug

SEQ ID NO: 1158731 - RNA, 19 nt, Homo sapiens
uaaaggcuacacagauauu

SEQ ID NO: 1158732 - RNA, 19 nt, Homo sapiens
ggauacugcucuuacaaaa

SEQ ID NO: 1158733 - RNA, 19 nt, Homo sapiens
gccagaaggcgaaagaaga

SEQ ID NO: 1158734 - RNA, 19 nt, Homo sapiens
cugaguaauucacugguuu

SEQ ID NO: 1158735 - RNA, 19 nt, Homo sapiens
caaccacuuuaaccaacaa

SEQ ID NO: 1158736 - RNA, 19 nt, Homo sapiens
aaacagucaaccacuuuaa

SEQ ID NO: 1158737 - RNA, 19 nt, Homo sapiens
aaucauggauacaucaaca

SEQ ID NO: 1158738 - RNA, 19 nt, Homo sapiens
acucguguauuaagucauu

SEQ ID NO: 1158739 - RNA, 19 nt, Homo sapiens
uuucguggcauguaaauuu

SEQ ID NO: 1158740 - RNA, 19 nt, Homo sapiens
gcuuuaugcuguacaugga

SEQ ID NO: 1158741 - RNA, 19 nt, Homo sapiens
guaaaggcuacacagauau

SEQ ID NO: 1158742 - RNA, 19 nt, Homo sapiens
gagaaagugcacugucguu

SEQ ID NO: 1158743 - RNA, 19 nt, Homo sapiens
gaauucaaguaaggcaugu

SEQ ID NO: 1158744 - RNA, 19 nt, Homo sapiens
gcugaaugcaauauccaua

SEQ ID NO: 1158745 - RNA, 19 nt, Homo sapiens
ugaaguccuuaaaugaaga

SEQ ID NO: 1158746 - RNA, 19 nt, Homo sapiens
ugaguaauucacugguuua

SEQ ID NO: 1158747 - RNA, 19 nt, Homo sapiens
cuacucguaucgaacaaga

SEQ ID NO: 1158748 - RNA, 19 nt, Homo sapiens
ugaaugcaauauccauaca

SEQ ID NO: 1158749 - RNA, 19 nt, Homo sapiens
aaaccaagaggaaaucaug

SEQ ID NO: 1158750 - RNA, 19 nt, Homo sapiens
gugcuguaauuugacauuu

SEQ ID NO: 1158751 - RNA, 19 nt, Homo sapiens
gcugauccaacaauugaaa

SEQ ID NO: 1158752 - RNA, 19 nt, Homo sapiens
gcauugcugcggaacguuu

SEQ ID NO: 1158753 - RNA, 19 nt, Homo sapiens
caucaacaaaucuggauau

SEQ ID NO: 1158754 - RNA, 19 nt, Homo sapiens
ugcuauaaaucccuagaaa

SEQ ID NO: 1158755 - RNA, 19 nt, Homo sapiens
guagacacagucaucagaa

SEQ ID NO: 1158756 - RNA, 19 nt, Homo sapiens
uggaguugauguaaaugaa

SEQ ID NO: 1158757 - RNA, 19 nt, Homo sapiens
acaccucuguuagcaaauu

SEQ ID NO: 1158758 - RNA, 19 nt, Homo sapiens
ggaaaugaggucucuacca

SEQ ID NO: 1158759 - RNA, 19 nt, Homo sapiens
gcaucuguccuauuuaaag

SEQ ID NO: 1158760 - RNA, 19 nt, Homo sapiens
uuugugaaguccuuaaaug

SEQ ID NO: 1158761 - RNA, 19 nt, Homo sapiens
aggaaaucaugaagaaaug

SEQ ID NO: 1158762 - RNA, 19 nt, Homo sapiens
gucauucacuuuauauagg

SEQ ID NO: 1158763 - RNA, 19 nt, Homo sapiens
gaaggcgaaagaagaaauc

SEQ ID NO: 1158764 - RNA, 19 nt, Homo sapiens
ucuugguccuuauaaauga

SEQ ID NO: 1158765 - RNA, 19 nt, Homo sapiens
aggaacaccucugcuuuau

SEQ ID NO: 1158766 - RNA, 19 nt, Homo sapiens
ugaauaugauuggaaugga

SEQ ID NO: 1158767 - RNA, 19 nt, Homo sapiens
uagaguuccuacuucagaa

SEQ ID NO: 1158768 - RNA, 19 nt, Homo sapiens
ggauuuacuccucugaugu

SEQ ID NO: 1158769 - RNA, 19 nt, Homo sapiens
uugccuaaccgauuugaua

SEQ ID NO: 1158770 - RNA, 19 nt, Homo sapiens
ucacucguguauuaaguca

SEQ ID NO: 1158771 - RNA, 19 nt, Homo sapiens
gacucuggauauaauucua

SEQ ID NO: 1158772 - RNA, 19 nt, Homo sapiens
ugaaacugacucuggauau

SEQ ID NO: 1158773 - RNA, 19 nt, Homo sapiens
gcagcacacgggcaaauag

SEQ ID NO: 1158774 - RNA, 19 nt, Homo sapiens
ucaaucacacggaugaaga

SEQ ID NO: 1158775 - RNA, 19 nt, Homo sapiens
ucauauugccuaaccgauu

SEQ ID NO: 1158776 - RNA, 19 nt, Homo sapiens
caguugaaaucauggauac

SEQ ID NO: 1158777 - RNA, 19 nt, Homo sapiens
gaggaaaugaggucucuac

SEQ ID NO: 1158778 - RNA, 19 nt, Homo sapiens
gagguggcaucuguccuau

SEQ ID NO: 1158779 - RNA, 19 nt, Homo sapiens
gaugagcgagaguuucuuc

SEQ ID NO: 1158780 - RNA, 19 nt, Homo sapiens
gagagaagcuuuauaaaug

SEQ ID NO: 1158781 - RNA, 19 nt, Homo sapiens
gaacauuucuccuaagauu

SEQ ID NO: 1158782 - RNA, 19 nt, Homo sapiens
ggaauuggaugacuuguga

SEQ ID NO: 1158783 - RNA, 19 nt, Homo sapiens
gaagagaaaucccaugaau

SEQ ID NO: 1158784 - RNA, 19 nt, Homo sapiens
gagaaacccuuugaauaua

SEQ ID NO: 1158785 - RNA, 19 nt, Homo sapiens
ggagaaacccuuugaauau

SEQ ID NO: 1158786 - RNA, 19 nt, Homo sapiens
gagaagcccuauaaaugua

SEQ ID NO: 1158787 - RNA, 19 nt, Homo sapiens
gaacguacuugauguggaa

SEQ ID NO: 1158788 - RNA, 19 nt, Homo sapiens
ggagaaauccuaugaaugu

SEQ ID NO: 1158789 - RNA, 19 nt, Homo sapiens
caagucaguugcuauuaua

SEQ ID NO: 1158790 - RNA, 19 nt, Homo sapiens
gcuaugagcucugaauaaa

SEQ ID NO: 1158791 - RNA, 19 nt, Homo sapiens
gaucacaaauggaaaugaa

SEQ ID NO: 1158792 - RNA, 19 nt, Homo sapiens
gagaguugaugaccugaua

SEQ ID NO: 1158793 - RNA, 19 nt, Homo sapiens
gagaagcauuuaggcauua

SEQ ID NO: 1158794 - RNA, 19 nt, Homo sapiens
agagaaaccuuaugaaugu

SEQ ID NO: 1158795 - RNA, 19 nt, Homo sapiens
ucauacagcucauuuagaa

SEQ ID NO: 1158796 - RNA, 19 nt, Homo sapiens
gauaaugggaggugaauuu

SEQ ID NO: 1158797 - RNA, 19 nt, Homo sapiens
gagaagcccuaucagugua

SEQ ID NO: 1158798 - RNA, 19 nt, Homo sapiens
ggagagaagcuuuauaaau

SEQ ID NO: 1158799 - RNA, 19 nt, Homo sapiens
ggaccagacuucauacaga

SEQ ID NO: 1158800 - RNA, 19 nt, Homo sapiens
caaauacagugucauuguu

SEQ ID NO: 1158801 - RNA, 19 nt, Homo sapiens
gagaaacccuaugaaugua

SEQ ID NO: 1158802 - RNA, 19 nt, Homo sapiens
gagaaacccuaugaaugua

SEQ ID NO: 1158803 - RNA, 19 nt, Homo sapiens
gagaaacccuaugaaugua

SEQ ID NO: 1158804 - RNA, 19 nt, Homo sapiens
gagaaacccuaugaaugua

SEQ ID NO: 1158805 - RNA, 19 nt, Homo sapiens
gaagagaaacccuaugaau

SEQ ID NO: 1158806 - RNA, 19 nt, Homo sapiens
gagaaacccuaugaaugua

SEQ ID NO: 1158807 - RNA, 19 nt, Homo sapiens
gaagagaaacccuaugaau

SEQ ID NO: 1158808 - RNA, 19 nt, Homo sapiens
gaaaugaagcccuuugaau

SEQ ID NO: 1158809 - RNA, 19 nt, Homo sapiens
gaagucagaucucaauuuu

SEQ ID NO: 1158810 - RNA, 19 nt, Homo sapiens
ggaaaguucucucaguugu

SEQ ID NO: 1158811 - RNA, 19 nt, Homo sapiens
aaagguggcuuaauauuca

SEQ ID NO: 1158812 - RNA, 19 nt, Homo sapiens
augcaaagguggcuuaaua

SEQ ID NO: 1158813 - RNA, 19 nt, Homo sapiens
ggaaaauccuucuguaaaa

SEQ ID NO: 1158814 - RNA, 19 nt, Homo sapiens
guaauucuaugcaaguuug

SEQ ID NO: 1158815 - RNA, 19 nt, Homo sapiens
gagaggcccuauccaugua

SEQ ID NO: 1158816 - RNA, 19 nt, Homo sapiens
gagaaacccuacgaaugua

SEQ ID NO: 1158817 - RNA, 19 nt, Homo sapiens
ggagaagcccuauaaaugu

SEQ ID NO: 1158818 - RNA, 19 nt, Homo sapiens
gagagaaaccuuaugaaug

SEQ ID NO: 1158819 - RNA, 19 nt, Homo sapiens
uaucagagaucacaaaugg

SEQ ID NO: 1158820 - RNA, 19 nt, Homo sapiens
ggacaguagcauuaaauaa

SEQ ID NO: 1158821 - RNA, 19 nt, Homo sapiens
agagaaaccuuauggaugu

SEQ ID NO: 1158822 - RNA, 19 nt, Homo sapiens
ggagaacuauagccaucua

SEQ ID NO: 1158823 - RNA, 19 nt, Homo sapiens
gagagaaacccuaugaaug

SEQ ID NO: 1158824 - RNA, 19 nt, Homo sapiens
gagagaaacccuaugaaug

SEQ ID NO: 1158825 - RNA, 19 nt, Homo sapiens
gagagaaacccuaugaaug

SEQ ID NO: 1158826 - RNA, 19 nt, Homo sapiens
gaagagaaaccuuauggau

SEQ ID NO: 1158827 - RNA, 19 nt, Homo sapiens
ggaaaguuauucaaugagu

SEQ ID NO: 1158828 - RNA, 19 nt, Homo sapiens
gaagaaucccgaagaaugu

SEQ ID NO: 1158829 - RNA, 19 nt, Homo sapiens
guggaaaguuauucaauga

SEQ ID NO: 1158830 - RNA, 19 nt, Homo sapiens
guacaaauacagugucauu

SEQ ID NO: 1158831 - RNA, 19 nt, Homo sapiens
ucaaagcguuuaucugaga

SEQ ID NO: 1158832 - RNA, 19 nt, Homo sapiens
cgagaaacccuaugaaugu

SEQ ID NO: 1158833 - RNA, 19 nt, Homo sapiens
ggcaaaaccuucaauuuaa

SEQ ID NO: 1158834 - RNA, 19 nt, Homo sapiens
ggagagaaaccuuaugaau

SEQ ID NO: 1158835 - RNA, 19 nt, Homo sapiens
gcaaagguggcuuaauauu

SEQ ID NO: 1158836 - RNA, 19 nt, Homo sapiens
ucaaauagauuguguucca

SEQ ID NO: 1158837 - RNA, 19 nt, Homo sapiens
gagaaauccuaugaaugua

SEQ ID NO: 1158838 - RNA, 19 nt, Homo sapiens
gagagaaacccuacgaaug

SEQ ID NO: 1158839 - RNA, 19 nt, Homo sapiens
caucggacacuaauuuaua

SEQ ID NO: 1158840 - RNA, 19 nt, Homo sapiens
cuucagacaucaaagagua

SEQ ID NO: 1158841 - RNA, 19 nt, Homo sapiens
gaagucauuuagaagagaa

SEQ ID NO: 1158842 - RNA, 19 nt, Homo sapiens
uaucugcugucaaugauuu

SEQ ID NO: 1158843 - RNA, 19 nt, Homo sapiens
ggaaugcaaagguggcuua

SEQ ID NO: 1158844 - RNA, 19 nt, Homo sapiens
caucagagaauucauagaa

SEQ ID NO: 1158845 - RNA, 19 nt, Homo sapiens
ggagagaaacccuaugaau

SEQ ID NO: 1158846 - RNA, 19 nt, Homo sapiens
ggagagaaacccuaugaau

SEQ ID NO: 1158847 - RNA, 19 nt, Homo sapiens
ggagagaaacccuaugaau

SEQ ID NO: 1158848 - RNA, 19 nt, Homo sapiens
gagaaacccuaugaauguu

SEQ ID NO: 1158849 - RNA, 19 nt, Homo sapiens
gggaaauccuucagccaaa

SEQ ID NO: 1158850 - RNA, 19 nt, Homo sapiens
gcaaaacccugacugaaga

SEQ ID NO: 1158851 - RNA, 19 nt, Homo sapiens
ucagagaauucauagaaga

SEQ ID NO: 1158852 - RNA, 19 nt, Homo sapiens
gauggaagcuaugcuagga

SEQ ID NO: 1158853 - RNA, 19 nt, Homo sapiens
ggagaggagccguggauaa

SEQ ID NO: 1158854 - RNA, 19 nt, Homo sapiens
ggauaucugcugucaauga

SEQ ID NO: 1158855 - RNA, 19 nt, Homo sapiens
gccaguaacuuguuuuaua

SEQ ID NO: 1158856 - RNA, 19 nt, Homo sapiens
gaagucauaccucacugua

SEQ ID NO: 1158857 - RNA, 19 nt, Homo sapiens
uaugagcucugaauaaauc

SEQ ID NO: 1158858 - RNA, 19 nt, Homo sapiens
gaaauaugaacguacuuga

SEQ ID NO: 1158859 - RNA, 19 nt, Homo sapiens
gaaaucccaugaauguagu

SEQ ID NO: 1158860 - RNA, 19 nt, Homo sapiens
gggaaaagguaaaauggua

SEQ ID NO: 1158861 - RNA, 19 nt, Homo sapiens
gaaacccuaugaauguaau

SEQ ID NO: 1158862 - RNA, 19 nt, Homo sapiens
ucucagaaaucauaucuca

SEQ ID NO: 1158863 - RNA, 19 nt, Homo sapiens
gaaacccuaugaauguaau

SEQ ID NO: 1158864 - RNA, 19 nt, Homo sapiens
gaaacccuaugaauguaau

SEQ ID NO: 1158865 - RNA, 19 nt, Homo sapiens
ugucauaccucacuauaca

SEQ ID NO: 1158866 - RNA, 19 nt, Homo sapiens
gcaagucugcucucaguga

SEQ ID NO: 1158867 - RNA, 19 nt, Homo sapiens
gaggagaagcccuauaaau

SEQ ID NO: 1158868 - RNA, 19 nt, Homo sapiens
caaacgucaucauuaaguu

SEQ ID NO: 1158869 - RNA, 19 nt, Homo sapiens
aaggauaucugcugucaau

SEQ ID NO: 1158870 - RNA, 19 nt, Homo sapiens
caugaggacaguagcauua

SEQ ID NO: 1158871 - RNA, 19 nt, Homo sapiens
ccgaaagucuacucugauu

SEQ ID NO: 1158872 - RNA, 19 nt, Homo sapiens
uggagaaacccuuugaaua

SEQ ID NO: 1158873 - RNA, 19 nt, Homo sapiens
gaggugaauuuccauguca

SEQ ID NO: 1158874 - RNA, 19 nt, Homo sapiens
ugagaagcauuuaggcauu

SEQ ID NO: 1158875 - RNA, 19 nt, Homo sapiens
ggaaaauucuucucucaga

SEQ ID NO: 1158876 - RNA, 19 nt, Homo sapiens
gcgagaaacccuaugaaug

SEQ ID NO: 1158877 - RNA, 19 nt, Homo sapiens
aaaccuuccuuguaaauuc

SEQ ID NO: 1158878 - RNA, 19 nt, Homo sapiens
gaaaguucucucaguugua

SEQ ID NO: 1158879 - RNA, 19 nt, Homo sapiens
guggaaaguucucucaguu

SEQ ID NO: 1158880 - RNA, 19 nt, Homo sapiens
gcaaaugaguuaaagaaga

SEQ ID NO: 1158881 - RNA, 19 nt, Homo sapiens
gaucgaagcuggacacguu

SEQ ID NO: 1158882 - RNA, 19 nt, Homo sapiens
gcacuauugucaccagaaa

SEQ ID NO: 1158883 - RNA, 19 nt, Homo sapiens
ggaaguaccgggucccuuu

SEQ ID NO: 1158884 - RNA, 19 nt, Homo sapiens
ggucacaaguugccaucua

SEQ ID NO: 1158885 - RNA, 19 nt, Homo sapiens
caucaagauugcugacuuu

SEQ ID NO: 1158886 - RNA, 19 nt, Homo sapiens
caaaugaguuaaagaagag

SEQ ID NO: 1158887 - RNA, 19 nt, Homo sapiens
gugaggaguugaagccaua

SEQ ID NO: 1158888 - RNA, 19 nt, Homo sapiens
gagguugccaucaagauua

SEQ ID NO: 1158889 - RNA, 19 nt, Homo sapiens
aagcugaccuccaaacuga

SEQ ID NO: 1158890 - RNA, 19 nt, Homo sapiens
ucaccaagcugaccuccaa

SEQ ID NO: 1158891 - RNA, 19 nt, Homo sapiens
gagcaaaucaugaaagaca

SEQ ID NO: 1158892 - RNA, 19 nt, Homo sapiens
gagggaaacugaggaaauc

SEQ ID NO: 1158893 - RNA, 19 nt, Homo sapiens
ccaccaaccucuucaccaa

SEQ ID NO: 1158894 - RNA, 19 nt, Homo sapiens
guacgcaagugcuggagaa

SEQ ID NO: 1158895 - RNA, 19 nt, Homo sapiens
caguuucccugaauuauau

SEQ ID NO: 1158896 - RNA, 19 nt, Homo sapiens
ccuaaagacuggagaaucu

SEQ ID NO: 1158897 - RNA, 19 nt, Homo sapiens
ggagagcugcugagccuaa

SEQ ID NO: 1158898 - RNA, 19 nt, Homo sapiens
caagagaauugaggugaug

SEQ ID NO: 1158899 - RNA, 19 nt, Homo sapiens
ggaucaacaucggcuauga

SEQ ID NO: 1158900 - RNA, 19 nt, Homo sapiens
cgagaaguccgcaucauga

SEQ ID NO: 1158901 - RNA, 19 nt, Homo sapiens
cuaaacggcagaacucuaa

SEQ ID NO: 1158902 - RNA, 19 nt, Homo sapiens
aaagacaaauggaucaaca

SEQ ID NO: 1158903 - RNA, 19 nt, Homo sapiens
gcuguacucucgagcaaau

SEQ ID NO: 1158904 - RNA, 19 nt, Homo sapiens
caucaagauuaucgacaaa

SEQ ID NO: 1158905 - RNA, 19 nt, Homo sapiens
ggagggaaacugaggaaau

SEQ ID NO: 1158906 - RNA, 19 nt, Homo sapiens
gauucucccuuuaucauca

SEQ ID NO: 1158907 - RNA, 19 nt, Homo sapiens
gcccgucacuguugccaaa

SEQ ID NO: 1158908 - RNA, 19 nt, Homo sapiens
gcaaaucaugaaagacaaa

SEQ ID NO: 1158909 - RNA, 19 nt, Homo sapiens
gcagccuguugcccaauaa

SEQ ID NO: 1158910 - RNA, 19 nt, Homo sapiens
ggagguugccaucaagauu

SEQ ID NO: 1158911 - RNA, 19 nt, Homo sapiens
gcaaagggcagcggaguuc

SEQ ID NO: 1158912 - RNA, 19 nt, Homo sapiens
gaagcucuuugaggugauu

SEQ ID NO: 1158913 - RNA, 19 nt, Homo sapiens
ccaucaagauuaucgacaa

SEQ ID NO: 1158914 - RNA, 19 nt, Homo sapiens
gcgcaggcauagcgauuuc

SEQ ID NO: 1158915 - RNA, 19 nt, Homo sapiens
ucgagcaaaucaugaaaga

SEQ ID NO: 1158916 - RNA, 19 nt, Homo sapiens
cuggagaaguguuugacua

SEQ ID NO: 1158917 - RNA, 19 nt, Homo sapiens
cagcacagaagaaggauga

SEQ ID NO: 1158918 - RNA, 19 nt, Homo sapiens
agacgaaccugagagaauc

SEQ ID NO: 1158919 - RNA, 19 nt, Homo sapiens
gagagcugcugagccuaaa

SEQ ID NO: 1158920 - RNA, 19 nt, Homo sapiens
ggaaacugaggaaaucuuc

SEQ ID NO: 1158921 - RNA, 19 nt, Homo sapiens
gggcagggagggaaacuga

SEQ ID NO: 1158922 - RNA, 19 nt, Homo sapiens
gcucagcacagaagaagga

SEQ ID NO: 1158923 - RNA, 19 nt, Homo sapiens
ccaagagaauugaggugau

SEQ ID NO: 1158924 - RNA, 19 nt, Homo sapiens
gcuaugagggugaggaguu

SEQ ID NO: 1158925 - RNA, 19 nt, Homo sapiens
cagaagcuguuccgagaag

SEQ ID NO: 1158926 - RNA, 19 nt, Homo sapiens
gagaaguccgcaucaugaa

SEQ ID NO: 1158927 - RNA, 19 nt, Homo sapiens
cgcaagugcuggagaagug

SEQ ID NO: 1158928 - RNA, 19 nt, Homo sapiens
agacugagaagacgcugua

SEQ ID NO: 1158929 - RNA, 19 nt, Homo sapiens
gaagaggcgugggaaucca

SEQ ID NO: 1158930 - RNA, 19 nt, Homo sapiens
ccuguugcccaauaaauuu

SEQ ID NO: 1158931 - RNA, 19 nt, Homo sapiens
gagcugccgcugucaccua

SEQ ID NO: 1158932 - RNA, 19 nt, Homo sapiens
gagcugcugagccuaaaga

SEQ ID NO: 1158933 - RNA, 19 nt, Homo sapiens
caccuacguuugcacagaa

SEQ ID NO: 1158934 - RNA, 19 nt, Homo sapiens
gagagcauccugcggagau

SEQ ID NO: 1158935 - RNA, 19 nt, Homo sapiens
caacaucgugaagcucuuu

SEQ ID NO: 1158936 - RNA, 19 nt, Homo sapiens
ggaguuccucuuccaccua

SEQ ID NO: 1158937 - RNA, 19 nt, Homo sapiens
caagcuggcucggcacauc

SEQ ID NO: 1158938 - RNA, 19 nt, Homo sapiens
ccgggucccuuucuacaug

SEQ ID NO: 1158939 - RNA, 19 nt, Homo sapiens
gccaaguuccgacagauug

SEQ ID NO: 1158940 - RNA, 19 nt, Homo sapiens
cagacgaaccugagagaau

SEQ ID NO: 1158941 - RNA, 19 nt, Homo sapiens
gagccaaguuccgacagau

SEQ ID NO: 1158942 - RNA, 19 nt, Homo sapiens
gagaaguguuugacuaccu

SEQ ID NO: 1158943 - RNA, 19 nt, Homo sapiens
cugcaaaugaguuaaagaa

SEQ ID NO: 1158944 - RNA, 19 nt, Homo sapiens
gcagaagcuguuccgagaa

SEQ ID NO: 1158945 - RNA, 19 nt, Homo sapiens
caucuaccuugggaucaaa

SEQ ID NO: 1158946 - RNA, 19 nt, Homo sapiens
acaucaagauugcugacuu

SEQ ID NO: 1158947 - RNA, 19 nt, Homo sapiens
gaggccaacaucaagauug

SEQ ID NO: 1158948 - RNA, 19 nt, Homo sapiens
uuucggcugugcacuauug

SEQ ID NO: 1158949 - RNA, 19 nt, Homo sapiens
cgagccaaguuccgacaga

SEQ ID NO: 1158950 - RNA, 19 nt, Homo sapiens
ucagagaggcagauuccuu

SEQ ID NO: 1158951 - RNA, 19 nt, Homo sapiens
gaacucuaaccgcuguguu

SEQ ID NO: 1158952 - RNA, 19 nt, Homo sapiens
gaaguaccgggucccuuuc

SEQ ID NO: 1158953 - RNA, 19 nt, Homo sapiens
ggauggaacucggccucau

SEQ ID NO: 1158954 - RNA, 19 nt, Homo sapiens
gggcaccugaggagacuuu

SEQ ID NO: 1158955 - RNA, 19 nt, Homo sapiens
acaccuacguuugcacaga

SEQ ID NO: 1158956 - RNA, 19 nt, Homo sapiens
gucgggagguugccaucaa

SEQ ID NO: 1158957 - RNA, 19 nt, Homo sapiens
gccuguugcccaauaaauu

SEQ ID NO: 1158958 - RNA, 19 nt, Homo sapiens
gagcauccugcggagauuu

SEQ ID NO: 1158959 - RNA, 19 nt, Homo sapiens
gcaacucugccaaagucaa

SEQ ID NO: 1158960 - RNA, 19 nt, Homo sapiens
gggaauccaggcagugguu

SEQ ID NO: 1158961 - RNA, 19 nt, Homo sapiens
gggaaacugaggaaaucuu

SEQ ID NO: 1158962 - RNA, 19 nt, Homo sapiens
uugaggugauugagacuga

SEQ ID NO: 1158963 - RNA, 19 nt, Homo sapiens
ccaucuaccuugggaucaa

SEQ ID NO: 1158964 - RNA, 19 nt, Homo sapiens
uacccucgaucccucuaaa

SEQ ID NO: 1158965 - RNA, 19 nt, Homo sapiens
caagcugaccuccaaacug

SEQ ID NO: 1158966 - RNA, 19 nt, Homo sapiens
cagcggaguuccucuucca

SEQ ID NO: 1158967 - RNA, 19 nt, Homo sapiens
ggaguugaagccauacaca

SEQ ID NO: 1158968 - RNA, 19 nt, Homo sapiens
auguuacacuggacucuaa

SEQ ID NO: 1158969 - RNA, 19 nt, Homo sapiens
acucccagccaccauguua

SEQ ID NO: 1158970 - RNA, 19 nt, Homo sapiens
ccagaaguacaacgaagug

SEQ ID NO: 1158971 - RNA, 19 nt, Homo sapiens
gcagacgaaccugagagaa

SEQ ID NO: 1158972 - RNA, 19 nt, Homo sapiens
cccaacaaccucccuccua

SEQ ID NO: 1158973 - RNA, 19 nt, Homo sapiens
cuaugagggugaggaguug

SEQ ID NO: 1158974 - RNA, 19 nt, Homo sapiens
gaaagacaaauggaucaac

SEQ ID NO: 1158975 - RNA, 19 nt, Homo sapiens
ugcagccuguugcccaaua

SEQ ID NO: 1158976 - RNA, 19 nt, Homo sapiens
gagccuaaagacuggagaa

SEQ ID NO: 1158977 - RNA, 19 nt, Homo sapiens
cccaacagcucaaaauuag

SEQ ID NO: 1158978 - RNA, 19 nt, Homo sapiens
uuuaucaucaccucaguuu

SEQ ID NO: 1158979 - RNA, 19 nt, Homo sapiens
cuacacacgggaagaaauc

SEQ ID NO: 1158980 - RNA, 19 nt, Homo sapiens
ggaaagugauagagaaauu

SEQ ID NO: 1158981 - RNA, 19 nt, Homo sapiens
gaagguggcugagauaaga

SEQ ID NO: 1158982 - RNA, 19 nt, Homo sapiens
gacagaagcuggaggaguu

SEQ ID NO: 1158983 - RNA, 19 nt, Homo sapiens
ggaagaagguggcugagau

SEQ ID NO: 1158984 - RNA, 19 nt, Homo sapiens
gcagggaauuccucuacua

SEQ ID NO: 1158985 - RNA, 19 nt, Homo sapiens
gcucaucgcucagaagaaa

SEQ ID NO: 1158986 - RNA, 19 nt, Homo sapiens
gcauucagcuuucuguaug

SEQ ID NO: 1158987 - RNA, 19 nt, Homo sapiens
gaagaagguggcugagaua

SEQ ID NO: 1158988 - RNA, 19 nt, Homo sapiens
gaaccaggcauucagcuuu

SEQ ID NO: 1158989 - RNA, 19 nt, Homo sapiens
gagagagugugccuauuga

SEQ ID NO: 1158990 - RNA, 19 nt, Homo sapiens
gaagaaacgggaaauugaa

SEQ ID NO: 1158991 - RNA, 19 nt, Homo sapiens
acacaacucuuccugcauu

SEQ ID NO: 1158992 - RNA, 19 nt, Homo sapiens
uaacccagcauuugcauuu

SEQ ID NO: 1158993 - RNA, 19 nt, Homo sapiens
caacgaugguagcuucuug

SEQ ID NO: 1158994 - RNA, 19 nt, Homo sapiens
caacaaguuugccaacgau

SEQ ID NO: 1158995 - RNA, 19 nt, Homo sapiens
gcauggagauggauaagac

SEQ ID NO: 1158996 - RNA, 19 nt, Homo sapiens
cgagugccgugccguguaa

SEQ ID NO: 1158997 - RNA, 19 nt, Homo sapiens
gaaaggaagcacagaaguc

SEQ ID NO: 1158998 - RNA, 19 nt, Homo sapiens
cagacggccuuacuacuga

SEQ ID NO: 1158999 - RNA, 19 nt, Homo sapiens
ccaaggaggacgacgagua

SEQ ID NO: 1159000 - RNA, 19 nt, Homo sapiens
ccgagcagcugacaaagau

SEQ ID NO: 1159001 - RNA, 19 nt, Homo sapiens
gcacggcuaugacagugau

SEQ ID NO: 1159002 - RNA, 19 nt, Homo sapiens
gaaagugauagagaaauug

SEQ ID NO: 1159003 - RNA, 19 nt, Homo sapiens
agaagaaacgggaaauuga

SEQ ID NO: 1159004 - RNA, 19 nt, Homo sapiens
guacugacagccuccuuaa

SEQ ID NO: 1159005 - RNA, 19 nt, Homo sapiens
ccaacaaguuugccaacga

SEQ ID NO: 1159006 - RNA, 19 nt, Homo sapiens
caaaugcacacaacucuuc

SEQ ID NO: 1159007 - RNA, 19 nt, Homo sapiens
gacagccuccuuaaaguuu

SEQ ID NO: 1159008 - RNA, 19 nt, Homo sapiens
cagaagaaacgggaaauug

SEQ ID NO: 1159009 - RNA, 19 nt, Homo sapiens
caaggaggacgacgaguau

SEQ ID NO: 1159010 - RNA, 19 nt, Homo sapiens
agaagaagcagcugaagga

SEQ ID NO: 1159011 - RNA, 19 nt, Homo sapiens
ccauugcccuccagaacaa

SEQ ID NO: 1159012 - RNA, 19 nt, Homo sapiens
uaagaaaggaagcacagaa

SEQ ID NO: 1159013 - RNA, 19 nt, Homo sapiens
ucaagaacccagugaacaa

SEQ ID NO: 1159014 - RNA, 19 nt, Homo sapiens
gaagaggucccugcucauc

SEQ ID NO: 1159015 - RNA, 19 nt, Homo sapiens
gggccgagcagcugacaaa

SEQ ID NO: 1159016 - RNA, 19 nt, Homo sapiens
ggacgaagaggucaagaac

SEQ ID NO: 1159017 - RNA, 19 nt, Homo sapiens
gggaauuccucuacuacag

SEQ ID NO: 1159018 - RNA, 19 nt, Homo sapiens
cagacgagcuggaaaaguu

SEQ ID NO: 1159019 - RNA, 19 nt, Homo sapiens
caaggauaacccagcauuu

SEQ ID NO: 1159020 - RNA, 19 nt, Homo sapiens
gagugugccuauugacugu

SEQ ID NO: 1159021 - RNA, 19 nt, Homo sapiens
gcacuucaucggagacuuc

SEQ ID NO: 1159022 - RNA, 19 nt, Homo sapiens
ggagaaggcaguccaacag

SEQ ID NO: 1159023 - RNA, 19 nt, Homo sapiens
aaaguuggccagguucaua

SEQ ID NO: 1159024 - RNA, 19 nt, Homo sapiens
agagagagugugccuauug

SEQ ID NO: 1159025 - RNA, 19 nt, Homo sapiens
ugaaggagcagcaggagau

SEQ ID NO: 1159026 - RNA, 19 nt, Homo sapiens
gcucccaccugcugaacug

SEQ ID NO: 1159027 - RNA, 19 nt, Homo sapiens
gauaagaauagcagggaau

SEQ ID NO: 1159028 - RNA, 19 nt, Homo sapiens
ugacagccuccuuaaaguu

SEQ ID NO: 1159029 - RNA, 19 nt, Homo sapiens
ugaguguucuggaaauaca

SEQ ID NO: 1159030 - RNA, 19 nt, Homo sapiens
ugaugaagaugggcuggaa

SEQ ID NO: 1159031 - RNA, 19 nt, Homo sapiens
gcagcaguuucugaaguug

SEQ ID NO: 1159032 - RNA, 19 nt, Homo sapiens
ggacgaggaggaggacuau

SEQ ID NO: 1159033 - RNA, 19 nt, Homo sapiens
gcucagaagaaacgggaaa

SEQ ID NO: 1159034 - RNA, 19 nt, Homo sapiens
ccagacggccuuacuacug

SEQ ID NO: 1159035 - RNA, 19 nt, Homo sapiens
cagaaaaguuggccagguu

SEQ ID NO: 1159036 - RNA, 19 nt, Homo sapiens
ucaaggggcucggcuauga

SEQ ID NO: 1159037 - RNA, 19 nt, Homo sapiens
ggcagccucucagaaaguu

SEQ ID NO: 1159038 - RNA, 19 nt, Homo sapiens
cuacugaguguucuggaaa

SEQ ID NO: 1159039 - RNA, 19 nt, Homo sapiens
cagccaccgugaagaggaa

SEQ ID NO: 1159040 - RNA, 19 nt, Homo sapiens
agaaagccaagcagaauca

SEQ ID NO: 1159041 - RNA, 19 nt, Homo sapiens
aaucacaaaugcacacaac

SEQ ID NO: 1159042 - RNA, 19 nt, Homo sapiens
ggaaauugaagccaaaaug

SEQ ID NO: 1159043 - RNA, 19 nt, Homo sapiens
uacaaguacuaccgacaga

SEQ ID NO: 1159044 - RNA, 19 nt, Homo sapiens
ggcauucagcuuucuguau

SEQ ID NO: 1159045 - RNA, 19 nt, Homo sapiens
uggcugagauaagaaagga

SEQ ID NO: 1159046 - RNA, 19 nt, Homo sapiens
aaggauaacccagcauuug

SEQ ID NO: 1159047 - RNA, 19 nt, Homo sapiens
aaguagcuauggaggacua

SEQ ID NO: 1159048 - RNA, 19 nt, Homo sapiens
ugcagcaguuucugaaguu

SEQ ID NO: 1159049 - RNA, 19 nt, Homo sapiens
acagaaagccaagcagaau

SEQ ID NO: 1159050 - RNA, 19 nt, Homo sapiens
gggagaaggcaguccaaca

SEQ ID NO: 1159051 - RNA, 19 nt, Homo sapiens
gugaagaggaagcggaaga

SEQ ID NO: 1159052 - RNA, 19 nt, Homo sapiens
cauucagcuuucuguauga

SEQ ID NO: 1159053 - RNA, 19 nt, Homo sapiens
gaaccuugcagaaaaguug

SEQ ID NO: 1159054 - RNA, 19 nt, Homo sapiens
ggauaacccagcauuugca

SEQ ID NO: 1159055 - RNA, 19 nt, Homo sapiens
auggaggacuacaaggaua

SEQ ID NO: 1159056 - RNA, 19 nt, Homo sapiens
cacaacucuuccugcauuu

SEQ ID NO: 1159057 - RNA, 19 nt, Homo sapiens
gccgugccguguaauaaag

SEQ ID NO: 1159058 - RNA, 19 nt, Homo sapiens
acugaguguucuggaaaua

SEQ ID NO: 1159059 - RNA, 19 nt, Homo sapiens
gcgcuggcuucggcauuga

SEQ ID NO: 1159060 - RNA, 19 nt, Homo sapiens
gcaucaagaacccagugaa

SEQ ID NO: 1159061 - RNA, 19 nt, Homo sapiens
gccugaagaggauaaggua

SEQ ID NO: 1159062 - RNA, 19 nt, Homo sapiens
acaaggauaacccagcauu

SEQ ID NO: 1159063 - RNA, 19 nt, Homo sapiens
ccuggacuguggaauguuc

SEQ ID NO: 1159064 - RNA, 19 nt, Homo sapiens
ugaagaggauaagguagag

SEQ ID NO: 1159065 - RNA, 19 nt, Homo sapiens
caaguacuaccgacagaag

SEQ ID NO: 1159066 - RNA, 19 nt, Homo sapiens
ucacaaaugcacacaacuc

SEQ ID NO: 1159067 - RNA, 19 nt, Homo sapiens
uagagagagugugccuauu

SEQ ID NO: 1159068 - RNA, 19 nt, Homo sapiens
acgaggaggaggacuauga

SEQ ID NO: 1159069 - RNA, 19 nt, Homo sapiens
uuucagacgcccagaagaa

SEQ ID NO: 1159070 - RNA, 19 nt, Homo sapiens
gacagccuccugcaucuca

SEQ ID NO: 1159071 - RNA, 19 nt, Homo sapiens
gagcaguggcuggagauca

SEQ ID NO: 1159072 - RNA, 19 nt, Homo sapiens
gaaauugaagccaaaaugg

SEQ ID NO: 1159073 - RNA, 19 nt, Homo sapiens
ucagaagaaacgggaaauu

SEQ ID NO: 1159074 - RNA, 19 nt, Homo sapiens
gccgagcagcugacaaaga

SEQ ID NO: 1159075 - RNA, 19 nt, Homo sapiens
gaaaucacaaaugcacaca

SEQ ID NO: 1159076 - RNA, 19 nt, Homo sapiens
ccucgccucugucaguuca

SEQ ID NO: 1159077 - RNA, 19 nt, Homo sapiens
agcaguggcuggagaucaa

SEQ ID NO: 1159078 - RNA, 19 nt, Homo sapiens
cugcauuuccaacaaguuu

SEQ ID NO: 1159079 - RNA, 19 nt, Homo sapiens
gugccgugccguguaauaa

SEQ ID NO: 1159080 - RNA, 19 nt, Homo sapiens
guacggcacucauuucuua

SEQ ID NO: 1159081 - RNA, 19 nt, Homo sapiens
gaaagaagcucugucaagu

SEQ ID NO: 1159082 - RNA, 19 nt, Homo sapiens
gaauuuggguuacaugaaa

SEQ ID NO: 1159083 - RNA, 19 nt, Homo sapiens
aagaagcucugucaaguua

SEQ ID NO: 1159084 - RNA, 19 nt, Homo sapiens
ggacuuaauucuccaguug

SEQ ID NO: 1159085 - RNA, 19 nt, Homo sapiens
gaugacagcuccaaugaga

SEQ ID NO: 1159086 - RNA, 19 nt, Homo sapiens
cacaagaaaucaugaagua

SEQ ID NO: 1159087 - RNA, 19 nt, Homo sapiens
ccucagaucuguaaaguug

SEQ ID NO: 1159088 - RNA, 19 nt, Homo sapiens
gaaagaaccacaagaaauc

SEQ ID NO: 1159089 - RNA, 19 nt, Homo sapiens
ugacauugguucuuacuuu

SEQ ID NO: 1159090 - RNA, 19 nt, Homo sapiens
gcugggagcuggcuugaaa

SEQ ID NO: 1159091 - RNA, 19 nt, Homo sapiens
gggaauagguggaagacuu

SEQ ID NO: 1159092 - RNA, 19 nt, Homo sapiens
gaagaaagaagcucuguca

SEQ ID NO: 1159093 - RNA, 19 nt, Homo sapiens
gaagagucccugaccauuu

SEQ ID NO: 1159094 - RNA, 19 nt, Homo sapiens
ggaguaugcugacuucaug

SEQ ID NO: 1159095 - RNA, 19 nt, Homo sapiens
ggaaaggacuaacguggau

SEQ ID NO: 1159096 - RNA, 19 nt, Homo sapiens
gaaugcaacugcccugaug

SEQ ID NO: 1159097 - RNA, 19 nt, Homo sapiens
gaagcucugucaaguuaga

SEQ ID NO: 1159098 - RNA, 19 nt, Homo sapiens
gcacucagcuacaucacau

SEQ ID NO: 1159099 - RNA, 19 nt, Homo sapiens
gagacaauguguaggaaau

SEQ ID NO: 1159100 - RNA, 19 nt, Homo sapiens
gagaaagaaccacaagaaa

SEQ ID NO: 1159101 - RNA, 19 nt, Homo sapiens
ccaaugagacaaucuacua

SEQ ID NO: 1159102 - RNA, 19 nt, Homo sapiens
gcaucucucugucgaagaa

SEQ ID NO: 1159103 - RNA, 19 nt, Homo sapiens
agaaccagcugaaccauga

SEQ ID NO: 1159104 - RNA, 19 nt, Homo sapiens
caaacccuguggaauauga

SEQ ID NO: 1159105 - RNA, 19 nt, Homo sapiens
ugacugaucccucuaagaa

SEQ ID NO: 1159106 - RNA, 19 nt, Homo sapiens
ccacagcuaucucccaguu

SEQ ID NO: 1159107 - RNA, 19 nt, Homo sapiens
gcacucauuucuuacuuuc

SEQ ID NO: 1159108 - RNA, 19 nt, Homo sapiens
ccaaccaccugaacaucua

SEQ ID NO: 1159109 - RNA, 19 nt, Homo sapiens
ccaggacucugcacucuug

SEQ ID NO: 1159110 - RNA, 19 nt, Homo sapiens
ggaauagguggaagacuuu

SEQ ID NO: 1159111 - RNA, 19 nt, Homo sapiens
cuucagagcuccuuuccaa

SEQ ID NO: 1159112 - RNA, 19 nt, Homo sapiens
guugauuggugcuuucuaa

SEQ ID NO: 1159113 - RNA, 19 nt, Homo sapiens
ggagggcucuugcaaggau

SEQ ID NO: 1159114 - RNA, 19 nt, Homo sapiens
ggaaacacaagaaguacaa

SEQ ID NO: 1159115 - RNA, 19 nt, Homo sapiens
gccaaacccuguggaauau

SEQ ID NO: 1159116 - RNA, 19 nt, Homo sapiens
gaagcaggauagccgcauu

SEQ ID NO: 1159117 - RNA, 19 nt, Homo sapiens
ccacugugcuccagacaau

SEQ ID NO: 1159118 - RNA, 19 nt, Homo sapiens
caacuuggcucuggaaagg

SEQ ID NO: 1159119 - RNA, 19 nt, Homo sapiens
gaaguacaaccaacaggaa

SEQ ID NO: 1159120 - RNA, 19 nt, Homo sapiens
gagguacacuccaucuuca

SEQ ID NO: 1159121 - RNA, 19 nt, Homo sapiens
gcuacagccugcccuuuga

SEQ ID NO: 1159122 - RNA, 19 nt, Homo sapiens
gaagaaagacagagacaac

SEQ ID NO: 1159123 - RNA, 19 nt, Homo sapiens
caaggaagagauuaagaaa

SEQ ID NO: 1159124 - RNA, 19 nt, Homo sapiens
ggcaaacucuguagcuaau

SEQ ID NO: 1159125 - RNA, 19 nt, Homo sapiens
ugagaaagaaccacaagaa

SEQ ID NO: 1159126 - RNA, 19 nt, Homo sapiens
gaaaggagccaaggaagag

SEQ ID NO: 1159127 - RNA, 19 nt, Homo sapiens
gaaagaaaggagccaagga

SEQ ID NO: 1159128 - RNA, 19 nt, Homo sapiens
ccucuaagaauuuggguua

SEQ ID NO: 1159129 - RNA, 19 nt, Homo sapiens
ugagggcuuucaauucuaa

SEQ ID NO: 1159130 - RNA, 19 nt, Homo sapiens
ggcuuaagcuggccaacaa

SEQ ID NO: 1159131 - RNA, 19 nt, Homo sapiens
ugaaaaggcugcccgauga

SEQ ID NO: 1159132 - RNA, 19 nt, Homo sapiens
gaacaacuuggcucuggaa

SEQ ID NO: 1159133 - RNA, 19 nt, Homo sapiens
gagcguggcgagagaauga

SEQ ID NO: 1159134 - RNA, 19 nt, Homo sapiens
gagagacaauguguaggaa

SEQ ID NO: 1159135 - RNA, 19 nt, Homo sapiens
ccaaggaagagauuaagaa

SEQ ID NO: 1159136 - RNA, 19 nt, Homo sapiens
gaaugcaauugaaagaaag

SEQ ID NO: 1159137 - RNA, 19 nt, Homo sapiens
gaaucaagucccuggauga

SEQ ID NO: 1159138 - RNA, 19 nt, Homo sapiens
caccugaacaucuaaguaa

SEQ ID NO: 1159139 - RNA, 19 nt, Homo sapiens
acagggaggcuacaacuaa

SEQ ID NO: 1159140 - RNA, 19 nt, Homo sapiens
gacaguucauguuuaccua

SEQ ID NO: 1159141 - RNA, 19 nt, Homo sapiens
gagccaaggaagagauuaa

SEQ ID NO: 1159142 - RNA, 19 nt, Homo sapiens
gaagcaggcgagagagaaa

SEQ ID NO: 1159143 - RNA, 19 nt, Homo sapiens
ugccaaacccuguggaaua

SEQ ID NO: 1159144 - RNA, 19 nt, Homo sapiens
caguuggacuacccauaua

SEQ ID NO: 1159145 - RNA, 19 nt, Homo sapiens
ggagcaagagaauuugaaa

SEQ ID NO: 1159146 - RNA, 19 nt, Homo sapiens
acugaucccucuaagaauu

SEQ ID NO: 1159147 - RNA, 19 nt, Homo sapiens
agaaagaaccacaagaaau

SEQ ID NO: 1159148 - RNA, 19 nt, Homo sapiens
gagggcagcuuuccugacu

SEQ ID NO: 1159149 - RNA, 19 nt, Homo sapiens
agagaacaaaguacaguua

SEQ ID NO: 1159150 - RNA, 19 nt, Homo sapiens
gaguuuauccggaacauuc

SEQ ID NO: 1159151 - RNA, 19 nt, Homo sapiens
gaacauucgccuccuugga

SEQ ID NO: 1159152 - RNA, 19 nt, Homo sapiens
aaagaaaggagccaaggaa

SEQ ID NO: 1159153 - RNA, 19 nt, Homo sapiens
uaaguagccucagaucugu

SEQ ID NO: 1159154 - RNA, 19 nt, Homo sapiens
gaaccacaagaaaucauga

SEQ ID NO: 1159155 - RNA, 19 nt, Homo sapiens
uugagacaguucauguuua

SEQ ID NO: 1159156 - RNA, 19 nt, Homo sapiens
agucaguucugucuuggua

SEQ ID NO: 1159157 - RNA, 19 nt, Homo sapiens
ccaccgcgcucaggaguau

SEQ ID NO: 1159158 - RNA, 19 nt, Homo sapiens
ccugagggcuuucaauucu

SEQ ID NO: 1159159 - RNA, 19 nt, Homo sapiens
gcauugagguacacuccau

SEQ ID NO: 1159160 - RNA, 19 nt, Homo sapiens
gacaauguguaggaaaugu

SEQ ID NO: 1159161 - RNA, 19 nt, Homo sapiens
gaaccaugaaacaaacaaa

SEQ ID NO: 1159162 - RNA, 19 nt, Homo sapiens
caaacucuguagcuaaugg

SEQ ID NO: 1159163 - RNA, 19 nt, Homo sapiens
ggacuacccauauacucaa

SEQ ID NO: 1159164 - RNA, 19 nt, Homo sapiens
ugagacaguucauguuuac

SEQ ID NO: 1159165 - RNA, 19 nt, Homo sapiens
gcaagagaauuugaaaaga

SEQ ID NO: 1159166 - RNA, 19 nt, Homo sapiens
cuacggagccgaaucaagu

SEQ ID NO: 1159167 - RNA, 19 nt, Homo sapiens
cagcaacuaugacaaucug

SEQ ID NO: 1159168 - RNA, 19 nt, Homo sapiens
ggcacucauuucuuacuuu

SEQ ID NO: 1159169 - RNA, 19 nt, Homo sapiens
cuaaguagccucagaucug

SEQ ID NO: 1159170 - RNA, 19 nt, Homo sapiens
gggaggcuacaacuaagua

SEQ ID NO: 1159171 - RNA, 19 nt, Homo sapiens
ccaguuggacuacccauau

SEQ ID NO: 1159172 - RNA, 19 nt, Homo sapiens
caaguuagagagagacaau

SEQ ID NO: 1159173 - RNA, 19 nt, Homo sapiens
ggauagccgcauugaggua

SEQ ID NO: 1159174 - RNA, 19 nt, Homo sapiens
gagaagagucccugaccau

SEQ ID NO: 1159175 - RNA, 19 nt, Homo sapiens
gcugaaccaugaaacaaac

SEQ ID NO: 1159176 - RNA, 19 nt, Homo sapiens
caacuaaguagccucagau

SEQ ID NO: 1159177 - RNA, 19 nt, Homo sapiens
gcaugcugcucacccugaa

SEQ ID NO: 1159178 - RNA, 19 nt, Homo sapiens
gaugcuauccgggacuuaa

SEQ ID NO: 1159179 - RNA, 19 nt, Homo sapiens
ccaccugaacaucuaagua

SEQ ID NO: 1159180 - RNA, 19 nt, Homo sapiens
gaacagguaguaucuauuu

SEQ ID NO: 1159181 - RNA, 19 nt, Homo sapiens
gggaguauauuaccaaauu

SEQ ID NO: 1159182 - RNA, 19 nt, Homo sapiens
uaagaggccuguuguauau

SEQ ID NO: 1159183 - RNA, 19 nt, Homo sapiens
caucaaagcuccugaguca

SEQ ID NO: 1159184 - RNA, 19 nt, Homo sapiens
caaggaagauggaauacuu

SEQ ID NO: 1159185 - RNA, 19 nt, Homo sapiens
gaaacccugucucuacuaa

SEQ ID NO: 1159186 - RNA, 19 nt, Homo sapiens
gcacugacguggcucauuc

SEQ ID NO: 1159187 - RNA, 19 nt, Homo sapiens
gggagaagacauauauuua

SEQ ID NO: 1159188 - RNA, 19 nt, Homo sapiens
gagaagggcuacauaugga

SEQ ID NO: 1159189 - RNA, 19 nt, Homo sapiens
uauaaucacugcagaauca

SEQ ID NO: 1159190 - RNA, 19 nt, Homo sapiens
gcagcagcuuuaacucuua

SEQ ID NO: 1159191 - RNA, 19 nt, Homo sapiens
agacuucgaucaaaccaua

SEQ ID NO: 1159192 - RNA, 19 nt, Homo sapiens
gagauccucugccaucauu

SEQ ID NO: 1159193 - RNA, 19 nt, Homo sapiens
gaagauggaauacuuggaa

SEQ ID NO: 1159194 - RNA, 19 nt, Homo sapiens
gauuuccaguucucuaaua

SEQ ID NO: 1159195 - RNA, 19 nt, Homo sapiens
gaggaaacaugucgagauc

SEQ ID NO: 1159196 - RNA, 19 nt, Homo sapiens
guuuauuacuggucacuua

SEQ ID NO: 1159197 - RNA, 19 nt, Homo sapiens
aagcugcucuuuacuguuu

SEQ ID NO: 1159198 - RNA, 19 nt, Homo sapiens
ggagucagauucucuuucu

SEQ ID NO: 1159199 - RNA, 19 nt, Homo sapiens
gaaagucuccaccaaagga

SEQ ID NO: 1159200 - RNA, 19 nt, Homo sapiens
gaaagaaacaacuauaggu

SEQ ID NO: 1159201 - RNA, 19 nt, Homo sapiens
cuacuaugcucaaaucaga

SEQ ID NO: 1159202 - RNA, 19 nt, Homo sapiens
ggucuuugccgguuaagua

SEQ ID NO: 1159203 - RNA, 19 nt, Homo sapiens
ucacaaaggguauaguaaa

SEQ ID NO: 1159204 - RNA, 19 nt, Homo sapiens
gcaggucuuugccgguuaa

SEQ ID NO: 1159205 - RNA, 19 nt, Homo sapiens
cuaacagcaucuaucauaa

SEQ ID NO: 1159206 - RNA, 19 nt, Homo sapiens
gauggaauacuuggaauuu

SEQ ID NO: 1159207 - RNA, 19 nt, Homo sapiens
ccagagagaccauuaggaa

SEQ ID NO: 1159208 - RNA, 19 nt, Homo sapiens
ugagucaguuuccacuaua

SEQ ID NO: 1159209 - RNA, 19 nt, Homo sapiens
gaauucaggugcaggucuu

SEQ ID NO: 1159210 - RNA, 19 nt, Homo sapiens
ggaaacaugucgagaucag

SEQ ID NO: 1159211 - RNA, 19 nt, Homo sapiens
gaucccgccuccuauauca

SEQ ID NO: 1159212 - RNA, 19 nt, Homo sapiens
ggaguauauuaccaaauug

SEQ ID NO: 1159213 - RNA, 19 nt, Homo sapiens
gaugaaacccugucucuac

SEQ ID NO: 1159214 - RNA, 19 nt, Homo sapiens
aaagggagaagacauauau

SEQ ID NO: 1159215 - RNA, 19 nt, Homo sapiens
ccauugaucuuaauaaagc

SEQ ID NO: 1159216 - RNA, 19 nt, Homo sapiens
uaaagccacacaagccuua

SEQ ID NO: 1159217 - RNA, 19 nt, Homo sapiens
acuaacagcaucuaucaua

SEQ ID NO: 1159218 - RNA, 19 nt, Homo sapiens
caccaaagccgcagaggaa

SEQ ID NO: 1159219 - RNA, 19 nt, Homo sapiens
gcuguaauuuccagagaga

SEQ ID NO: 1159220 - RNA, 19 nt, Homo sapiens
ccaguucucuaauauucuu

SEQ ID NO: 1159221 - RNA, 19 nt, Homo sapiens
ggaauuuguuugucaugca

SEQ ID NO: 1159222 - RNA, 19 nt, Homo sapiens
gagucaguuuccacuauaa

SEQ ID NO: 1159223 - RNA, 19 nt, Homo sapiens
ggaaaagggagaagacaua

SEQ ID NO: 1159224 - RNA, 19 nt, Homo sapiens
ggaaagaaacaacuauagg

SEQ ID NO: 1159225 - RNA, 19 nt, Homo sapiens
auaagaggccuguuguaua

SEQ ID NO: 1159226 - RNA, 19 nt, Homo sapiens
aaagaaagucuccaccaaa

SEQ ID NO: 1159227 - RNA, 19 nt, Homo sapiens
aaacaacuauagguagcua

SEQ ID NO: 1159228 - RNA, 19 nt, Homo sapiens
gaccgagggcuuaaucaaa

SEQ ID NO: 1159229 - RNA, 19 nt, Homo sapiens
agucagauucucuuucuua

SEQ ID NO: 1159230 - RNA, 19 nt, Homo sapiens
ucaugcaccuucugaguau

SEQ ID NO: 1159231 - RNA, 19 nt, Homo sapiens
ggaccaguauugcgagaag

SEQ ID NO: 1159232 - RNA, 19 nt, Homo sapiens
ucucuugacuaccauuaaa

SEQ ID NO: 1159233 - RNA, 19 nt, Homo sapiens
aaacaggcauucagaacca

SEQ ID NO: 1159234 - RNA, 19 nt, Homo sapiens
gucagauucucuuucuuaa

SEQ ID NO: 1159235 - RNA, 19 nt, Homo sapiens
cauaauaagaggccuguug

SEQ ID NO: 1159236 - RNA, 19 nt, Homo sapiens
gguaggccauuagcauuga

SEQ ID NO: 1159237 - RNA, 19 nt, Homo sapiens
gauagucagcuucaccaaa

SEQ ID NO: 1159238 - RNA, 19 nt, Homo sapiens
aaaugagacuucgaucaaa

SEQ ID NO: 1159239 - RNA, 19 nt, Homo sapiens
gcaggagaauugcuugaac

SEQ ID NO: 1159240 - RNA, 19 nt, Homo sapiens
aagaaagucuccaccaaag

SEQ ID NO: 1159241 - RNA, 19 nt, Homo sapiens
ccacacaagccuuauguuc

SEQ ID NO: 1159242 - RNA, 19 nt, Homo sapiens
ccgagggcuuaaucaaaua

SEQ ID NO: 1159243 - RNA, 19 nt, Homo sapiens
uggaauacuuggaauuugu

SEQ ID NO: 1159244 - RNA, 19 nt, Homo sapiens
uagcuacacguacauaauu

SEQ ID NO: 1159245 - RNA, 19 nt, Homo sapiens
uaagggagcaacacguaaa

SEQ ID NO: 1159246 - RNA, 19 nt, Homo sapiens
ucagaaccauuccauugau

SEQ ID NO: 1159247 - RNA, 19 nt, Homo sapiens
acacaagccuuauguucuc

SEQ ID NO: 1159248 - RNA, 19 nt, Homo sapiens
gcucagaaacacuaaauac

SEQ ID NO: 1159249 - RNA, 19 nt, Homo sapiens
ggagguggagauugcagua

SEQ ID NO: 1159250 - RNA, 19 nt, Homo sapiens
aaugauugguggaugguuu

SEQ ID NO: 1159251 - RNA, 19 nt, Homo sapiens
ugacuaacagcaucuauca

SEQ ID NO: 1159252 - RNA, 19 nt, Homo sapiens
ccugcuaccuaguaauaaa

SEQ ID NO: 1159253 - RNA, 19 nt, Homo sapiens
ggaauacuuggaauuuguu

SEQ ID NO: 1159254 - RNA, 19 nt, Homo sapiens
gauguuguuucugugauug

SEQ ID NO: 1159255 - RNA, 19 nt, Homo sapiens
agaggccuguuguauauga

SEQ ID NO: 1159256 - RNA, 19 nt, Homo sapiens
cgaucaaaccauaagauuu

SEQ ID NO: 1159257 - RNA, 19 nt, Homo sapiens
gcaaacaggcauucagaac

SEQ ID NO: 1159258 - RNA, 19 nt, Homo sapiens
ggugauagagcaagacugu

SEQ ID NO: 1159259 - RNA, 19 nt, Homo sapiens
cuuauguucucaucucaaa

SEQ ID NO: 1159260 - RNA, 19 nt, Homo sapiens
gcuuaugccuguaauugca

SEQ ID NO: 1159261 - RNA, 19 nt, Homo sapiens
ccagagaagggcuacauau

SEQ ID NO: 1159262 - RNA, 19 nt, Homo sapiens
gcccuacuaugcucaaauc

SEQ ID NO: 1159263 - RNA, 19 nt, Homo sapiens
ucuacaagggaguauauua

SEQ ID NO: 1159264 - RNA, 19 nt, Homo sapiens
gcucuuuacuguuucuagu

SEQ ID NO: 1159265 - RNA, 19 nt, Homo sapiens
agaguaagcaggaaauuca

SEQ ID NO: 1159266 - RNA, 19 nt, Homo sapiens
aggaacagguaguaucuau

SEQ ID NO: 1159267 - RNA, 19 nt, Homo sapiens
uaucauagggccagaggaa

SEQ ID NO: 1159268 - RNA, 19 nt, Homo sapiens
uguuugaguuggaaagaaa

SEQ ID NO: 1159269 - RNA, 19 nt, Homo sapiens
guaagggagcaacacguaa

SEQ ID NO: 1159270 - RNA, 19 nt, Homo sapiens
ccauuagcauugauaucuu

SEQ ID NO: 1159271 - RNA, 19 nt, Homo sapiens
gcucaaaucagagguuuua

SEQ ID NO: 1159272 - RNA, 19 nt, Homo sapiens
caucuacccuaaaccaucu

SEQ ID NO: 1159273 - RNA, 19 nt, Homo sapiens
ggaacagguaguaucuauu

SEQ ID NO: 1159274 - RNA, 19 nt, Homo sapiens
cuauauguguaucuuccua

SEQ ID NO: 1159275 - RNA, 19 nt, Homo sapiens
caagggaguauauuaccaa

SEQ ID NO: 1159276 - RNA, 19 nt, Homo sapiens
gcucggcucagaaacacua

SEQ ID NO: 1159277 - RNA, 19 nt, Homo sapiens
auagucagcuucaccaaag

SEQ ID NO: 1159278 - RNA, 19 nt, Homo sapiens
gaaccauuccauugaucuu

SEQ ID NO: 1159279 - RNA, 19 nt, Homo sapiens
cagagaagggcuacauaug

SEQ ID NO: 1159280 - RNA, 19 nt, Homo sapiens
gaacaaaccucacagacuu

SEQ ID NO: 1159281 - RNA, 19 nt, Homo sapiens
ccacacagcugccucagaa

SEQ ID NO: 1159282 - RNA, 19 nt, Homo sapiens
agagcuaucuguagacuua

SEQ ID NO: 1159283 - RNA, 19 nt, Homo sapiens
gaaccuuccugcugugaug

SEQ ID NO: 1159284 - RNA, 19 nt, Homo sapiens
gaaccauccugaccuucuu

SEQ ID NO: 1159285 - RNA, 19 nt, Homo sapiens
gcaguccggugaagagcua

SEQ ID NO: 1159286 - RNA, 19 nt, Homo sapiens
guaacgggaucgacuacaa

SEQ ID NO: 1159287 - RNA, 19 nt, Homo sapiens
cagaacugcucgcggagua

SEQ ID NO: 1159288 - RNA, 19 nt, Homo sapiens
gguuggccuuucuuauuua

SEQ ID NO: 1159289 - RNA, 19 nt, Homo sapiens
caaggcauccugugaauuc

SEQ ID NO: 1159290 - RNA, 19 nt, Homo sapiens
ugaacuaccagaugaguaa

SEQ ID NO: 1159291 - RNA, 19 nt, Homo sapiens
gcaccuggcagcccacauu

SEQ ID NO: 1159292 - RNA, 19 nt, Homo sapiens
ugguuggccuuucuuauuu

SEQ ID NO: 1159293 - RNA, 19 nt, Homo sapiens
gaacugcaugaccuucuuu

SEQ ID NO: 1159294 - RNA, 19 nt, Homo sapiens
ggagaucgaugagcaugca

SEQ ID NO: 1159295 - RNA, 19 nt, Homo sapiens
auagagaacacuucacuuu

SEQ ID NO: 1159296 - RNA, 19 nt, Homo sapiens
cggaguaacugcaagaucu

SEQ ID NO: 1159297 - RNA, 19 nt, Homo sapiens
ggcaaggcauccugugaau

SEQ ID NO: 1159298 - RNA, 19 nt, Homo sapiens
ugcaugaacuaccagauga

SEQ ID NO: 1159299 - RNA, 19 nt, Homo sapiens
acgacuaccugcucaaguu

SEQ ID NO: 1159300 - RNA, 19 nt, Homo sapiens
gcagcucuccugugagguu

SEQ ID NO: 1159301 - RNA, 19 nt, Homo sapiens
guggugcacuggugacuuc

SEQ ID NO: 1159302 - RNA, 19 nt, Homo sapiens
gaaucuuggucggaaacaa

SEQ ID NO: 1159303 - RNA, 19 nt, Homo sapiens
guuagacacuccgccauuc

SEQ ID NO: 1159304 - RNA, 19 nt, Homo sapiens
cagcagggcccuuguuugg

SEQ ID NO: 1159305 - RNA, 19 nt, Homo sapiens
gcaaggcauccugugaauu

SEQ ID NO: 1159306 - RNA, 19 nt, Homo sapiens
gcgcguacgcagagaagaa

SEQ ID NO: 1159307 - RNA, 19 nt, Homo sapiens
gugcacuggugacuucaug

SEQ ID NO: 1159308 - RNA, 19 nt, Homo sapiens
ggccaccucucuccugaag

SEQ ID NO: 1159309 - RNA, 19 nt, Homo sapiens
ggcauccugugaauucaug

SEQ ID NO: 1159310 - RNA, 19 nt, Homo sapiens
gagccugguuggccuuucu

SEQ ID NO: 1159311 - RNA, 19 nt, Homo sapiens
ugaacgcggucaugaugca

SEQ ID NO: 1159312 - RNA, 19 nt, Homo sapiens
ccacugcccgucaccauca

SEQ ID NO: 1159313 - RNA, 19 nt, Homo sapiens
gggauccucuugguguaug

SEQ ID NO: 1159314 - RNA, 19 nt, Homo sapiens
gccagcagggcccuuguuu

SEQ ID NO: 1159315 - RNA, 19 nt, Homo sapiens
gagguugcacggcaucaga

SEQ ID NO: 1159316 - RNA, 19 nt, Homo sapiens
guaacugcaagaucuccua

SEQ ID NO: 1159317 - RNA, 19 nt, Homo sapiens
gggcccuuguuugggauua

SEQ ID NO: 1159318 - RNA, 19 nt, Homo sapiens
ggagagugcagagcuaucu

SEQ ID NO: 1159319 - RNA, 19 nt, Homo sapiens
ccuggagagugcagagcua

SEQ ID NO: 1159320 - RNA, 19 nt, Homo sapiens
cugguuggccuuucuuauu

SEQ ID NO: 1159321 - RNA, 19 nt, Homo sapiens
gcaccaucuucagguccua

SEQ ID NO: 1159322 - RNA, 19 nt, Homo sapiens
gcccguuccugggagauga

SEQ ID NO: 1159323 - RNA, 19 nt, Homo sapiens
guuggccuuucuuauuuau

SEQ ID NO: 1159324 - RNA, 19 nt, Homo sapiens
ccgccuacguggagacugu

SEQ ID NO: 1159325 - RNA, 19 nt, Homo sapiens
agagccaccucaaguccuu

SEQ ID NO: 1159326 - RNA, 19 nt, Homo sapiens
ggauccucuugguguauga

SEQ ID NO: 1159327 - RNA, 19 nt, Homo sapiens
ugaacaaaccucacagacu

SEQ ID NO: 1159328 - RNA, 19 nt, Homo sapiens
ggcacaugcuucccaaggu

SEQ ID NO: 1159329 - RNA, 19 nt, Homo sapiens
ccucucuccugaagccauu

SEQ ID NO: 1159330 - RNA, 19 nt, Homo sapiens
guagacuuaggaauacuug

SEQ ID NO: 1159331 - RNA, 19 nt, Homo sapiens
gcaccucaucgacaagcuu

SEQ ID NO: 1159332 - RNA, 19 nt, Homo sapiens
ggcacggcauggagaagau

SEQ ID NO: 1159333 - RNA, 19 nt, Homo sapiens
acaguaacgggaucgacua

SEQ ID NO: 1159334 - RNA, 19 nt, Homo sapiens
agacuuaggaauacuugau

SEQ ID NO: 1159335 - RNA, 19 nt, Homo sapiens
ucuguagacuuaggaauac

SEQ ID NO: 1159336 - RNA, 19 nt, Homo sapiens
gagaaccuuccugcuguga

SEQ ID NO: 1159337 - RNA, 19 nt, Homo sapiens
uggcaaggcauccugugaa

SEQ ID NO: 1159338 - RNA, 19 nt, Homo sapiens
ucaagagccaccucaaguc

SEQ ID NO: 1159339 - RNA, 19 nt, Homo sapiens
caucaagagccaccucaag

SEQ ID NO: 1159340 - RNA, 19 nt, Homo sapiens
ccuggaugguccugcauuc

SEQ ID NO: 1159341 - RNA, 19 nt, Homo sapiens
ggugaagagcuacgacuac

SEQ ID NO: 1159342 - RNA, 19 nt, Homo sapiens
ggccgguucugcaccaucu

SEQ ID NO: 1159343 - RNA, 19 nt, Homo sapiens
gacuuaggaauacuugaug

SEQ ID NO: 1159344 - RNA, 19 nt, Homo sapiens
ucaacgucaucgaguccuu

SEQ ID NO: 1159345 - RNA, 19 nt, Homo sapiens
ggcugcaccuggccuucaa

SEQ ID NO: 1159346 - RNA, 19 nt, Homo sapiens
ccaagccggucauggagaa

SEQ ID NO: 1159347 - RNA, 19 nt, Homo sapiens
gcagagaaaacguauuuau

SEQ ID NO: 1159348 - RNA, 19 nt, Homo sapiens
uagcagagaaaacguauuu

SEQ ID NO: 1159349 - RNA, 19 nt, Homo sapiens
ccgagacuguagcagagaa

SEQ ID NO: 1159350 - RNA, 19 nt, Homo sapiens
gccgagcgcguauuaacga

SEQ ID NO: 1159351 - RNA, 19 nt, Homo sapiens
ccgccguucugggcaagua

SEQ ID NO: 1159352 - RNA, 19 nt, Homo sapiens
ggaagcggcucaucacuga

SEQ ID NO: 1159353 - RNA, 19 nt, Homo sapiens
ccaagaaccucaggacaga

SEQ ID NO: 1159354 - RNA, 19 nt, Homo sapiens
ccuaugaggcaccacguaa

SEQ ID NO: 1159355 - RNA, 19 nt, Homo sapiens
cagaagcgagagcccauug

SEQ ID NO: 1159356 - RNA, 19 nt, Homo sapiens
uaugaggcaccacguaaga

SEQ ID NO: 1159357 - RNA, 19 nt, Homo sapiens
gcaucucuauccccuauga

SEQ ID NO: 1159358 - RNA, 19 nt, Homo sapiens
uggccggucucuccucuuc

SEQ ID NO: 1159359 - RNA, 19 nt, Homo sapiens
gaagcgagagcccauugcu

SEQ ID NO: 1159360 - RNA, 19 nt, Homo sapiens
gagcaaagcuggaggauuc

SEQ ID NO: 1159361 - RNA, 19 nt, Homo sapiens
ccacugaaguaaccaauaa

SEQ ID NO: 1159362 - RNA, 19 nt, Homo sapiens
gaacggaauugaagagcaa

SEQ ID NO: 1159363 - RNA, 19 nt, Homo sapiens
gcaccggccuccuccauuu

SEQ ID NO: 1159364 - RNA, 19 nt, Homo sapiens
caacugguguggcuacuug

SEQ ID NO: 1159365 - RNA, 19 nt, Homo sapiens
ggucuucacugguauuguu

SEQ ID NO: 1159366 - RNA, 19 nt, Homo sapiens
ucaaggagcccaaggauga

SEQ ID NO: 1159367 - RNA, 19 nt, Homo sapiens
ccauaauucuugccucuuu

SEQ ID NO: 1159368 - RNA, 19 nt, Homo sapiens
cuacugagccuuccugaaa

SEQ ID NO: 1159369 - RNA, 19 nt, Homo sapiens
ggaagaagccaucaaagag

SEQ ID NO: 1159370 - RNA, 19 nt, Homo sapiens
ggaccaucaugccuacuuu

SEQ ID NO: 1159371 - RNA, 19 nt, Homo sapiens
cagcuugcaugacuacuuu

SEQ ID NO: 1159372 - RNA, 19 nt, Homo sapiens
cagcgggucuucacuggua

SEQ ID NO: 1159373 - RNA, 19 nt, Homo sapiens
ggaggaagaagccaucaaa

SEQ ID NO: 1159374 - RNA, 19 nt, Homo sapiens
gaggagcgcuaaguuguug

SEQ ID NO: 1159375 - RNA, 19 nt, Homo sapiens
cacaauggcagccugauua

SEQ ID NO: 1159376 - RNA, 19 nt, Homo sapiens
gaucggaggccaaaggaaa

SEQ ID NO: 1159377 - RNA, 19 nt, Homo sapiens
ggauccaggucucuucuga

SEQ ID NO: 1159378 - RNA, 19 nt, Homo sapiens
aaacggagccuacugaaca

SEQ ID NO: 1159379 - RNA, 19 nt, Homo sapiens
gggccgaagugaugacuau

SEQ ID NO: 1159380 - RNA, 19 nt, Homo sapiens
ggugaaggcugcauacaac

SEQ ID NO: 1159381 - RNA, 19 nt, Homo sapiens
gugagaaggugcuggugaa

SEQ ID NO: 1159382 - RNA, 19 nt, Homo sapiens
ggagagccauaaccguuuc

SEQ ID NO: 1159383 - RNA, 19 nt, Homo sapiens
gagaggagcgcuaaguugu

SEQ ID NO: 1159384 - RNA, 19 nt, Homo sapiens
ggaguucucuucacuucag

SEQ ID NO: 1159385 - RNA, 19 nt, Homo sapiens
aagaggagguggucaagga

SEQ ID NO: 1159386 - RNA, 19 nt, Homo sapiens
ccuagaaccugcugucauc

SEQ ID NO: 1159387 - RNA, 19 nt, Homo sapiens
ccuguccucuuccaguuua

SEQ ID NO: 1159388 - RNA, 19 nt, Homo sapiens
ggguccaccucacuccuua

SEQ ID NO: 1159389 - RNA, 19 nt, Homo sapiens
ugagccaccugaacagauu

SEQ ID NO: 1159390 - RNA, 19 nt, Homo sapiens
gagcucagccucaguugau

SEQ ID NO: 1159391 - RNA, 19 nt, Homo sapiens
gaggacagcguucccaaug

SEQ ID NO: 1159392 - RNA, 19 nt, Homo sapiens
cauaauccgugguuucagu

SEQ ID NO: 1159393 - RNA, 19 nt, Homo sapiens
gcuccuguguucagaaugu

SEQ ID NO: 1159394 - RNA, 19 nt, Homo sapiens
gcacaggcucugcuagguu

SEQ ID NO: 1159395 - RNA, 19 nt, Homo sapiens
gauuuuggcuauagaguuu

SEQ ID NO: 1159396 - RNA, 19 nt, Homo sapiens
ccacuuaacaacuaaauac

SEQ ID NO: 1159397 - RNA, 19 nt, Homo sapiens
gggaaacggagccuacuga

SEQ ID NO: 1159398 - RNA, 19 nt, Homo sapiens
gaggaauuguaucguuguu

SEQ ID NO: 1159399 - RNA, 19 nt, Homo sapiens
auucuugccucuuuccaua

SEQ ID NO: 1159400 - RNA, 19 nt, Homo sapiens
ggaaacggagccuacugaa

SEQ ID NO: 1159401 - RNA, 19 nt, Homo sapiens
gcaagcagcagacacuucu

SEQ ID NO: 1159402 - RNA, 19 nt, Homo sapiens
ggccuugcguggaggguuu

SEQ ID NO: 1159403 - RNA, 19 nt, Homo sapiens
aggcacagcuucaacaucu

SEQ ID NO: 1159404 - RNA, 19 nt, Homo sapiens
gcccucaaccuugguauuu

SEQ ID NO: 1159405 - RNA, 19 nt, Homo sapiens
gagaugcuccagagggauu

SEQ ID NO: 1159406 - RNA, 19 nt, Homo sapiens
cuaagaagccaaggcauga

SEQ ID NO: 1159407 - RNA, 19 nt, Homo sapiens
ugacuaugacuccaagaaa

SEQ ID NO: 1159408 - RNA, 19 nt, Homo sapiens
gaaggaggaugggcuuuug

SEQ ID NO: 1159409 - RNA, 19 nt, Homo sapiens
uagaaagagcucaguguug

SEQ ID NO: 1159410 - RNA, 19 nt, Homo sapiens
gacuaugacuccaagaaac

SEQ ID NO: 1159411 - RNA, 19 nt, Homo sapiens
gguuucaguuugacuuugu

SEQ ID NO: 1159412 - RNA, 19 nt, Homo sapiens
gcaggaaacggacacugau

SEQ ID NO: 1159413 - RNA, 19 nt, Homo sapiens
agaacaagauccacacacu

SEQ ID NO: 1159414 - RNA, 19 nt, Homo sapiens
ccaaggaugaggcacagaa

SEQ ID NO: 1159415 - RNA, 19 nt, Homo sapiens
caccugaaccugagaagga

SEQ ID NO: 1159416 - RNA, 19 nt, Homo sapiens
gccggcaccuagcaacuga

SEQ ID NO: 1159417 - RNA, 19 nt, Homo sapiens
ccacaauggcagccugauu

SEQ ID NO: 1159418 - RNA, 19 nt, Homo sapiens
gugcagagcaggccaagca

SEQ ID NO: 1159419 - RNA, 19 nt, Homo sapiens
ucaaagaggagguggucaa

SEQ ID NO: 1159420 - RNA, 19 nt, Homo sapiens
ccaccucacuccuuacacu

SEQ ID NO: 1159421 - RNA, 19 nt, Homo sapiens
ccucuuccaguuuagaaua

SEQ ID NO: 1159422 - RNA, 19 nt, Homo sapiens
cgguuccacuuaacaacua

SEQ ID NO: 1159423 - RNA, 19 nt, Homo sapiens
aggaagaagccaucaaaga

SEQ ID NO: 1159424 - RNA, 19 nt, Homo sapiens
gcaucugaguuggcuauca

SEQ ID NO: 1159425 - RNA, 19 nt, Homo sapiens
caucugugacuuccuagaa

SEQ ID NO: 1159426 - RNA, 19 nt, Homo sapiens
ugagaggagcgcuaaguug

SEQ ID NO: 1159427 - RNA, 19 nt, Homo sapiens
ggagaaacagcgggucuuc

SEQ ID NO: 1159428 - RNA, 19 nt, Homo sapiens
cuagaaagagcucaguguu

SEQ ID NO: 1159429 - RNA, 19 nt, Homo sapiens
guuguugcaugcucuuugu

SEQ ID NO: 1159430 - RNA, 19 nt, Homo sapiens
auccaggucucuucugaaa

SEQ ID NO: 1159431 - RNA, 19 nt, Homo sapiens
guuaccagcuugcaugacu

SEQ ID NO: 1159432 - RNA, 19 nt, Homo sapiens
cauaauucuugccucuuuc

SEQ ID NO: 1159433 - RNA, 19 nt, Homo sapiens
ucccguggcuccuguguuc

SEQ ID NO: 1159434 - RNA, 19 nt, Homo sapiens
gcuagaaagagcucagugu

SEQ ID NO: 1159435 - RNA, 19 nt, Homo sapiens
gaauugaagagcaagacau

SEQ ID NO: 1159436 - RNA, 19 nt, Homo sapiens
acaauggcagccugauuaa

SEQ ID NO: 1159437 - RNA, 19 nt, Homo sapiens
ccagagggauuuuggcuau

SEQ ID NO: 1159438 - RNA, 19 nt, Homo sapiens
aggaggugcucuucggaaa

SEQ ID NO: 1159439 - RNA, 19 nt, Homo sapiens
guuuauaagaugcuacuga

SEQ ID NO: 1159440 - RNA, 19 nt, Homo sapiens
caccuccucuucugcaugu

SEQ ID NO: 1159441 - RNA, 19 nt, Homo sapiens
ugcaaacgcucuccaacca

SEQ ID NO: 1159442 - RNA, 19 nt, Homo sapiens
gcacgcccuggcuguguaa

SEQ ID NO: 1159443 - RNA, 19 nt, Homo sapiens
ggagcaagcagcagacacu

SEQ ID NO: 1159444 - RNA, 19 nt, Homo sapiens
gaaacggagccuacugaac

SEQ ID NO: 1159445 - RNA, 19 nt, Homo sapiens
gcaugcucuuuguggauga

SEQ ID NO: 1159446 - RNA, 19 nt, Homo sapiens
ggaggaauuguaucguugu

SEQ ID NO: 1159447 - RNA, 19 nt, Homo sapiens
uucccaaugucccaguuua

SEQ ID NO: 1159448 - RNA, 19 nt, Homo sapiens
cugagucucuuccaaacau

SEQ ID NO: 1159449 - RNA, 19 nt, Homo sapiens
ccucugagucucuuccaaa

SEQ ID NO: 1159450 - RNA, 19 nt, Homo sapiens
ggaauugaagagcaagaca

SEQ ID NO: 1159451 - RNA, 19 nt, Homo sapiens
acagcuggguggagaagga

SEQ ID NO: 1159452 - RNA, 19 nt, Homo sapiens
ccucaaaccagucagagau

SEQ ID NO: 1159453 - RNA, 19 nt, Homo sapiens
aggaugaggcacagaauga

SEQ ID NO: 1159454 - RNA, 19 nt, Homo sapiens
agacuggcauugauuugag

SEQ ID NO: 1159455 - RNA, 19 nt, Homo sapiens
gcacagcuucaacaucucu

SEQ ID NO: 1159456 - RNA, 19 nt, Homo sapiens
gccgaagugaugacuauga

SEQ ID NO: 1159457 - RNA, 19 nt, Homo sapiens
ggagcucagccucaguuga

SEQ ID NO: 1159458 - RNA, 19 nt, Homo sapiens
ucagugaacggaauugaag

SEQ ID NO: 1159459 - RNA, 19 nt, Homo sapiens
ucucuucacuucaggacau

SEQ ID NO: 1159460 - RNA, 19 nt, Homo sapiens
gaacauaggucuuggaaua

SEQ ID NO: 1159461 - RNA, 19 nt, Homo sapiens
gcacugagcucccagaucu

SEQ ID NO: 1159462 - RNA, 19 nt, Homo sapiens
caacagacgggacaacuug

SEQ ID NO: 1159463 - RNA, 19 nt, Homo sapiens
acauaggucuuggaauaaa

SEQ ID NO: 1159464 - RNA, 19 nt, Homo sapiens
ccagcuggaugcccauguu

SEQ ID NO: 1159465 - RNA, 19 nt, Homo sapiens
cagaacauaggucuuggaa

SEQ ID NO: 1159466 - RNA, 19 nt, Homo sapiens
ugugggaugugcugcaaga

SEQ ID NO: 1159467 - RNA, 19 nt, Homo sapiens
gaucaaagugugggaugug

SEQ ID NO: 1159468 - RNA, 19 nt, Homo sapiens
cggcugcugucaucgauca

SEQ ID NO: 1159469 - RNA, 19 nt, Homo sapiens
gcagugggacagccagaca

SEQ ID NO: 1159470 - RNA, 19 nt, Homo sapiens
ggaugugcugcaagacgua

SEQ ID NO: 1159471 - RNA, 19 nt, Homo sapiens
gaggcgagacacccacuuc

SEQ ID NO: 1159472 - RNA, 19 nt, Homo sapiens
cgaucaaagugugggaugu

SEQ ID NO: 1159473 - RNA, 19 nt, Homo sapiens
ggaaauaacuacacacuga

SEQ ID NO: 1159474 - RNA, 19 nt, Homo sapiens
aaacucagauuuacccaaa

SEQ ID NO: 1159475 - RNA, 19 nt, Homo sapiens
aaacaaagcggaaagaaga

SEQ ID NO: 1159476 - RNA, 19 nt, Homo sapiens
ucacgaagagcauuuauuu

SEQ ID NO: 1159477 - RNA, 19 nt, Homo sapiens
ggaauggagugcucauaau

SEQ ID NO: 1159478 - RNA, 19 nt, Homo sapiens
gcaaucaacucagagaugu

SEQ ID NO: 1159479 - RNA, 19 nt, Homo sapiens
gaauggagugcucauaauu

SEQ ID NO: 1159480 - RNA, 19 nt, Homo sapiens
ccaaaucacucaaguccau

SEQ ID NO: 1159481 - RNA, 19 nt, Homo sapiens
gcucauaauucagcauuug

SEQ ID NO: 1159482 - RNA, 19 nt, Homo sapiens
ccaagaaacucagauuuac

SEQ ID NO: 1159483 - RNA, 19 nt, Homo sapiens
gauauuauuuggucaucga

SEQ ID NO: 1159484 - RNA, 19 nt, Homo sapiens
gcagaggccuuugaacaca

SEQ ID NO: 1159485 - RNA, 19 nt, Homo sapiens
cuacucuguucauauguua

SEQ ID NO: 1159486 - RNA, 19 nt, Homo sapiens
ugacaauacugcagcucua

SEQ ID NO: 1159487 - RNA, 19 nt, Homo sapiens
ugaaacagguccaggaagu

SEQ ID NO: 1159488 - RNA, 19 nt, Homo sapiens
gaaacaaagcggaaagaag

SEQ ID NO: 1159489 - RNA, 19 nt, Homo sapiens
uccaagaaacucagauuua

SEQ ID NO: 1159490 - RNA, 19 nt, Homo sapiens
guccaugccuugaacaguu

SEQ ID NO: 1159491 - RNA, 19 nt, Homo sapiens
uacugcagcucuaccauuu

SEQ ID NO: 1159492 - RNA, 19 nt, Homo sapiens
ggucauuucuuuggagugu

SEQ ID NO: 1159493 - RNA, 19 nt, Homo sapiens
cuaccgagcuuacuacacu

SEQ ID NO: 1159494 - RNA, 19 nt, Homo sapiens
ugucugguaugucauggua

SEQ ID NO: 1159495 - RNA, 19 nt, Homo sapiens
cagaaggacuaccgagcuu

SEQ ID NO: 1159496 - RNA, 19 nt, Homo sapiens
ucauuucuuuggaguguuu

SEQ ID NO: 1159497 - RNA, 19 nt, Homo sapiens
ggauggauaaguucucuau

SEQ ID NO: 1159498 - RNA, 19 nt, Homo sapiens
uaacugugguugcuuucau

SEQ ID NO: 1159499 - RNA, 19 nt, Homo sapiens
gauauggguagcagucauu

SEQ ID NO: 1159500 - RNA, 19 nt, Homo sapiens
gcggaaagaagagucagua

SEQ ID NO: 1159501 - RNA, 19 nt, Homo sapiens
ccgacuggauccacauuga

SEQ ID NO: 1159502 - RNA, 19 nt, Homo sapiens
uaauucagcauuugcagaa

SEQ ID NO: 1159503 - RNA, 19 nt, Homo sapiens
ucugugggauggauaaguu

SEQ ID NO: 1159504 - RNA, 19 nt, Homo sapiens
gccuugaccucauugacaa

SEQ ID NO: 1159505 - RNA, 19 nt, Homo sapiens
gcuuugcaaucaacucaga

SEQ ID NO: 1159506 - RNA, 19 nt, Homo sapiens
uugcuggacucgugagaaa

SEQ ID NO: 1159507 - RNA, 19 nt, Homo sapiens
caacacauuuuccucauca

SEQ ID NO: 1159508 - RNA, 19 nt, Homo sapiens
gaucccgacucacgaagag

SEQ ID NO: 1159509 - RNA, 19 nt, Homo sapiens
acaguucccuacuacaugu

SEQ ID NO: 1159510 - RNA, 19 nt, Homo sapiens
ucccuacucuguucauaug

SEQ ID NO: 1159511 - RNA, 19 nt, Homo sapiens
caauuuaaucagacaguug

SEQ ID NO: 1159512 - RNA, 19 nt, Homo sapiens
ccuacucuguucauauguu

SEQ ID NO: 1159513 - RNA, 19 nt, Homo sapiens
ggcuugggcuuugcaauca

SEQ ID NO: 1159514 - RNA, 19 nt, Homo sapiens
gguccaagaaacucagauu

SEQ ID NO: 1159515 - RNA, 19 nt, Homo sapiens
aggaauggagugcucauaa

SEQ ID NO: 1159516 - RNA, 19 nt, Homo sapiens
gaaggacuaccgagcuuac

SEQ ID NO: 1159517 - RNA, 19 nt, Homo sapiens
cgacucacgaagagcauuu

SEQ ID NO: 1159518 - RNA, 19 nt, Homo sapiens
caucuccagaguauucaua

SEQ ID NO: 1159519 - RNA, 19 nt, Homo sapiens
guccaagaaacucagauuu

SEQ ID NO: 1159520 - RNA, 19 nt, Homo sapiens
guauucauagcaacacauu

SEQ ID NO: 1159521 - RNA, 19 nt, Homo sapiens
ggacuaccgagcuuacuac

SEQ ID NO: 1159522 - RNA, 19 nt, Homo sapiens
gcgcauccugugucuggua

SEQ ID NO: 1159523 - RNA, 19 nt, Homo sapiens
ugaaacaaagcggaaagaa

SEQ ID NO: 1159524 - RNA, 19 nt, Homo sapiens
uggcagaggccuuugaaca

SEQ ID NO: 1159525 - RNA, 19 nt, Homo sapiens
caaaucagugucugcaucu

SEQ ID NO: 1159526 - RNA, 19 nt, Homo sapiens
gaguauucauagcaacaca

SEQ ID NO: 1159527 - RNA, 19 nt, Homo sapiens
auggagugcucauaauuca

SEQ ID NO: 1159528 - RNA, 19 nt, Homo sapiens
gaaacagguccaggaaguc

SEQ ID NO: 1159529 - RNA, 19 nt, Homo sapiens
cccuaacugugguugcuuu

SEQ ID NO: 1159530 - RNA, 19 nt, Homo sapiens
ccagaucccgacucacgaa

SEQ ID NO: 1159531 - RNA, 19 nt, Homo sapiens
gcugugguccgugcccaua

SEQ ID NO: 1159532 - RNA, 19 nt, Homo sapiens
cauccugugucugguaugu

SEQ ID NO: 1159533 - RNA, 19 nt, Homo sapiens
uuacccaaaucacucaagu

SEQ ID NO: 1159534 - RNA, 19 nt, Homo sapiens
cugcaucuccagaguauuc

SEQ ID NO: 1159535 - RNA, 19 nt, Homo sapiens
gcccugagccacacugucu

SEQ ID NO: 1159536 - RNA, 19 nt, Homo sapiens
gggcuuugcaaucaacuca

SEQ ID NO: 1159537 - RNA, 19 nt, Homo sapiens
gguggcagaggccuuugaa

SEQ ID NO: 1159538 - RNA, 19 nt, Homo sapiens
gcugguggcagaggccuuu

SEQ ID NO: 1159539 - RNA, 19 nt, Homo sapiens
uccagaguauucauagcaa

SEQ ID NO: 1159540 - RNA, 19 nt, Homo sapiens
ucugugccuugaccucauu

SEQ ID NO: 1159541 - RNA, 19 nt, Homo sapiens
agaaggacuaccgagcuua

SEQ ID NO: 1159542 - RNA, 19 nt, Homo sapiens
gaaauacccucacauguua

SEQ ID NO: 1159543 - RNA, 19 nt, Homo sapiens
gaacagcuauccucucuug

SEQ ID NO: 1159544 - RNA, 19 nt, Homo sapiens
ucacagacccugagaaaua

SEQ ID NO: 1159545 - RNA, 19 nt, Homo sapiens
gcaccaugcucuucuauuc

SEQ ID NO: 1159546 - RNA, 19 nt, Homo sapiens
gcaccugccuuucucacua

SEQ ID NO: 1159547 - RNA, 19 nt, Homo sapiens
ggcagcaugugauucauuu

SEQ ID NO: 1159548 - RNA, 19 nt, Homo sapiens
agaaauacccucacauguu

SEQ ID NO: 1159549 - RNA, 19 nt, Homo sapiens
ggagaugguaggagaguuu

SEQ ID NO: 1159550 - RNA, 19 nt, Homo sapiens
gggaacagcuauccucucu

SEQ ID NO: 1159551 - RNA, 19 nt, Homo sapiens
cagaugaggucgacacaca

SEQ ID NO: 1159552 - RNA, 19 nt, Homo sapiens
cgucagcgcuuggagcuuu

SEQ ID NO: 1159553 - RNA, 19 nt, Homo sapiens
gaccugagcaucuguggaa

SEQ ID NO: 1159554 - RNA, 19 nt, Homo sapiens
gagaaauacccucacaugu

SEQ ID NO: 1159555 - RNA, 19 nt, Homo sapiens
uuucauuggugacccauaa

SEQ ID NO: 1159556 - RNA, 19 nt, Homo sapiens
ucguggaacuaaagaauga

SEQ ID NO: 1159557 - RNA, 19 nt, Homo sapiens
gagaguuuccuaggucuuu

SEQ ID NO: 1159558 - RNA, 19 nt, Homo sapiens
guggaugagaggaguaaua

SEQ ID NO: 1159559 - RNA, 19 nt, Homo sapiens
ggaucaguaucucaacauc

SEQ ID NO: 1159560 - RNA, 19 nt, Homo sapiens
gagaaggggaggauaagua

SEQ ID NO: 1159561 - RNA, 19 nt, Homo sapiens
gauguggucguggaacuaa

SEQ ID NO: 1159562 - RNA, 19 nt, Homo sapiens
ugucacagacccugagaaa

SEQ ID NO: 1159563 - RNA, 19 nt, Homo sapiens
agaaugaccugagcaucug

SEQ ID NO: 1159564 - RNA, 19 nt, Homo sapiens
ggauaaguaggcugggaaa

SEQ ID NO: 1159565 - RNA, 19 nt, Homo sapiens
gaucaguaucucaacauca

SEQ ID NO: 1159566 - RNA, 19 nt, Homo sapiens
ggucguggaacuaaagaau

SEQ ID NO: 1159567 - RNA, 19 nt, Homo sapiens
gggcagcaugugauucauu

SEQ ID NO: 1159568 - RNA, 19 nt, Homo sapiens
cacagacccugagaaauac

SEQ ID NO: 1159569 - RNA, 19 nt, Homo sapiens
uaaagaaugaccugagcau

SEQ ID NO: 1159570 - RNA, 19 nt, Homo sapiens
ggauguggucguggaacua

SEQ ID NO: 1159571 - RNA, 19 nt, Homo sapiens
aucaguaucucaacaucaa

SEQ ID NO: 1159572 - RNA, 19 nt, Homo sapiens
guggaucaguaucucaaca

SEQ ID NO: 1159573 - RNA, 19 nt, Homo sapiens
ccaugcucuucuauucuuu

SEQ ID NO: 1159574 - RNA, 19 nt, Homo sapiens
cagggcagcaugugauuca

SEQ ID NO: 1159575 - RNA, 19 nt, Homo sapiens
ucucuacucuacccagcuu

SEQ ID NO: 1159576 - RNA, 19 nt, Homo sapiens
gaguggaugagaggaguaa

SEQ ID NO: 1159577 - RNA, 19 nt, Homo sapiens
ugaggucgacacacaguug

SEQ ID NO: 1159578 - RNA, 19 nt, Homo sapiens
accaugcucuucuauucuu

SEQ ID NO: 1159579 - RNA, 19 nt, Homo sapiens
aagaaugaccugagcaucu

SEQ ID NO: 1159580 - RNA, 19 nt, Homo sapiens
ggucgacacacaguugcua

SEQ ID NO: 1159581 - RNA, 19 nt, Homo sapiens
gauggcuccuccuccucuu

SEQ ID NO: 1159582 - RNA, 19 nt, Homo sapiens
gaugaggucgacacacagu

SEQ ID NO: 1159583 - RNA, 19 nt, Homo sapiens
guaucucaacaucaaacua

SEQ ID NO: 1159584 - RNA, 19 nt, Homo sapiens
gcucagugguccgauacgu

SEQ ID NO: 1159585 - RNA, 19 nt, Homo sapiens
gauagaagcuggauucaug

SEQ ID NO: 1159586 - RNA, 19 nt, Homo sapiens
gaagauauauacucagcaa

SEQ ID NO: 1159587 - RNA, 19 nt, Homo sapiens
gaacgucucuaucaagaau

SEQ ID NO: 1159588 - RNA, 19 nt, Homo sapiens
gaauugaccucuaugaaag

SEQ ID NO: 1159589 - RNA, 19 nt, Homo sapiens
gaagaaaguacuagaagaa

SEQ ID NO: 1159590 - RNA, 19 nt, Homo sapiens
ggacauaucagguacauca

SEQ ID NO: 1159591 - RNA, 19 nt, Homo sapiens
ucaacuggauuucuagaua

SEQ ID NO: 1159592 - RNA, 19 nt, Homo sapiens
gaagacaugcugcuuugua

SEQ ID NO: 1159593 - RNA, 19 nt, Homo sapiens
agaccucacuauccuauua

SEQ ID NO: 1159594 - RNA, 19 nt, Homo sapiens
aagcaaggauguagaauug

SEQ ID NO: 1159595 - RNA, 19 nt, Homo sapiens
gaccagagaucguguugga

SEQ ID NO: 1159596 - RNA, 19 nt, Homo sapiens
ugaaacagauggagaagau

SEQ ID NO: 1159597 - RNA, 19 nt, Homo sapiens
gauccuagauaauugauag

SEQ ID NO: 1159598 - RNA, 19 nt, Homo sapiens
uagcagggccuucaaagua

SEQ ID NO: 1159599 - RNA, 19 nt, Homo sapiens
gagaucguguuggacauua

SEQ ID NO: 1159600 - RNA, 19 nt, Homo sapiens
cacaaaugauccuagauaa

SEQ ID NO: 1159601 - RNA, 19 nt, Homo sapiens
uaauacaccuguucgaaau

SEQ ID NO: 1159602 - RNA, 19 nt, Homo sapiens
gcauggcaguggugaguuu

SEQ ID NO: 1159603 - RNA, 19 nt, Homo sapiens
gugaagacaugcugcuuug

SEQ ID NO: 1159604 - RNA, 19 nt, Homo sapiens
guagaugaguacugcguuu

SEQ ID NO: 1159605 - RNA, 19 nt, Homo sapiens
ccaggagucugaggcuuua

SEQ ID NO: 1159606 - RNA, 19 nt, Homo sapiens
ugaagaaaguacuagaaga

SEQ ID NO: 1159607 - RNA, 19 nt, Homo sapiens
acacaaaugauccuagaua

SEQ ID NO: 1159608 - RNA, 19 nt, Homo sapiens
guucuuggcuucccauuag

SEQ ID NO: 1159609 - RNA, 19 nt, Homo sapiens
caacuggauuucuagauag

SEQ ID NO: 1159610 - RNA, 19 nt, Homo sapiens
ccuaaagccugguacuuga

SEQ ID NO: 1159611 - RNA, 19 nt, Homo sapiens
cgaaacaucacuauugcua

SEQ ID NO: 1159612 - RNA, 19 nt, Homo sapiens
cuacgaaacaucacuauug

SEQ ID NO: 1159613 - RNA, 19 nt, Homo sapiens
gaaaguacuagaagaauac

SEQ ID NO: 1159614 - RNA, 19 nt, Homo sapiens
gaucugaguuucgcuguuc

SEQ ID NO: 1159615 - RNA, 19 nt, Homo sapiens
gugagacccuguuucuaaa

SEQ ID NO: 1159616 - RNA, 19 nt, Homo sapiens
gaagcuggauucaugugau

SEQ ID NO: 1159617 - RNA, 19 nt, Homo sapiens
gggcuuggauuuggauauu

SEQ ID NO: 1159618 - RNA, 19 nt, Homo sapiens
gaaacaucacuauugcuaa

SEQ ID NO: 1159619 - RNA, 19 nt, Homo sapiens
gcagggccuucaaaguaaa

SEQ ID NO: 1159620 - RNA, 19 nt, Homo sapiens
gauaauacaccuguucgaa

SEQ ID NO: 1159621 - RNA, 19 nt, Homo sapiens
ggagcgcaaucgucaguau

SEQ ID NO: 1159622 - RNA, 19 nt, Homo sapiens
gaaagugucgcaucaaacu

SEQ ID NO: 1159623 - RNA, 19 nt, Homo sapiens
ggaccucuuuggagcugua

SEQ ID NO: 1159624 - RNA, 19 nt, Homo sapiens
ggaguaaaauuucaagaga

SEQ ID NO: 1159625 - RNA, 19 nt, Homo sapiens
gaacuggcccaucuguaga

SEQ ID NO: 1159626 - RNA, 19 nt, Homo sapiens
ucagaggaauauaaagcua

SEQ ID NO: 1159627 - RNA, 19 nt, Homo sapiens
agaauugaccucuaugaaa

SEQ ID NO: 1159628 - RNA, 19 nt, Homo sapiens
ggaauauaaagcuauggua

SEQ ID NO: 1159629 - RNA, 19 nt, Homo sapiens
uaucgaaagugucgcauca

SEQ ID NO: 1159630 - RNA, 19 nt, Homo sapiens
aagacaugcugcuuuguaa

SEQ ID NO: 1159631 - RNA, 19 nt, Homo sapiens
gcaaggauguagaauugac

SEQ ID NO: 1159632 - RNA, 19 nt, Homo sapiens
caaacucucuggcuaugca

SEQ ID NO: 1159633 - RNA, 19 nt, Homo sapiens
gacaugcugcuuuguaauu

SEQ ID NO: 1159634 - RNA, 19 nt, Homo sapiens
cuggaaagcuagauauugu

SEQ ID NO: 1159635 - RNA, 19 nt, Homo sapiens
ucgaaagugucgcaucaaa

SEQ ID NO: 1159636 - RNA, 19 nt, Homo sapiens
uuacacaaaugauccuaga

SEQ ID NO: 1159637 - RNA, 19 nt, Homo sapiens
uggagaagauauauacuca

SEQ ID NO: 1159638 - RNA, 19 nt, Homo sapiens
caacagaaaggguuaaagg

SEQ ID NO: 1159639 - RNA, 19 nt, Homo sapiens
acaugcugcuuuguaauua

SEQ ID NO: 1159640 - RNA, 19 nt, Homo sapiens
gcaaauacaaagcaaggau

SEQ ID NO: 1159641 - RNA, 19 nt, Homo sapiens
ucaggaacgucucuaucaa

SEQ ID NO: 1159642 - RNA, 19 nt, Homo sapiens
gccuuaaguucucuucauu

SEQ ID NO: 1159643 - RNA, 19 nt, Homo sapiens
caaguuuccuuuggauaau

SEQ ID NO: 1159644 - RNA, 19 nt, Homo sapiens
aaacaucacuauugcuaac

SEQ ID NO: 1159645 - RNA, 19 nt, Homo sapiens
uaaguucucuucauuacac

SEQ ID NO: 1159646 - RNA, 19 nt, Homo sapiens
agugagacccuguuucuaa

SEQ ID NO: 1159647 - RNA, 19 nt, Homo sapiens
aaacagauggagaagauau

SEQ ID NO: 1159648 - RNA, 19 nt, Homo sapiens
uuuagucgcucaccagcua

SEQ ID NO: 1159649 - RNA, 19 nt, Homo sapiens
cuccaaggccucuaugaua

SEQ ID NO: 1159650 - RNA, 19 nt, Homo sapiens
cgauggagauggagauuuu

SEQ ID NO: 1159651 - RNA, 19 nt, Homo sapiens
gaaacagauggagaagaua

SEQ ID NO: 1159652 - RNA, 19 nt, Homo sapiens
cauaugggcuuggauuugg

SEQ ID NO: 1159653 - RNA, 19 nt, Homo sapiens
gauagauccugugguucaa

SEQ ID NO: 1159654 - RNA, 19 nt, Homo sapiens
ggauuuggauauucucaac

SEQ ID NO: 1159655 - RNA, 19 nt, Homo sapiens
ggagaccucacuauccuau

SEQ ID NO: 1159656 - RNA, 19 nt, Homo sapiens
aaaggcugaugguaccuaa

SEQ ID NO: 1159657 - RNA, 19 nt, Homo sapiens
agcagggccuucaaaguaa

SEQ ID NO: 1159658 - RNA, 19 nt, Homo sapiens
uguccugccugcaacagua

SEQ ID NO: 1159659 - RNA, 19 nt, Homo sapiens
gaauuugagccacgcauag

SEQ ID NO: 1159660 - RNA, 19 nt, Homo sapiens
aaagcaaggauguagaauu

SEQ ID NO: 1159661 - RNA, 19 nt, Homo sapiens
cuagauagaagcuggauuc

SEQ ID NO: 1159662 - RNA, 19 nt, Homo sapiens
auugauagauccugugguu

SEQ ID NO: 1159663 - RNA, 19 nt, Homo sapiens
aggaacgucucuaucaaga

SEQ ID NO: 1159664 - RNA, 19 nt, Homo sapiens
gcgcuggccuucuggacau

SEQ ID NO: 1159665 - RNA, 19 nt, Homo sapiens
guccaucagaggaauauaa

SEQ ID NO: 1159666 - RNA, 19 nt, Homo sapiens
cuugaaccauccaugauug

SEQ ID NO: 1159667 - RNA, 19 nt, Homo sapiens
aaaguucagugacaucucu

SEQ ID NO: 1159668 - RNA, 19 nt, Homo sapiens
acaaagcaaggauguagaa

SEQ ID NO: 1159669 - RNA, 19 nt, Homo sapiens
agaggaauauaaagcuaug

SEQ ID NO: 1159670 - RNA, 19 nt, Homo sapiens
gauauuguccgcacagaac

SEQ ID NO: 1159671 - RNA, 19 nt, Homo sapiens
caucaaacucucuggcuau

SEQ ID NO: 1159672 - RNA, 19 nt, Homo sapiens
ugauagauccugugguuca

SEQ ID NO: 1159673 - RNA, 19 nt, Homo sapiens
guccugaacuggcccaucu

SEQ ID NO: 1159674 - RNA, 19 nt, Homo sapiens
ucacuauccuauuaugucu

SEQ ID NO: 1159675 - RNA, 19 nt, Homo sapiens
auaauacaccuguucgaaa

SEQ ID NO: 1159676 - RNA, 19 nt, Homo sapiens
caugaagaaaguacuagaa

SEQ ID NO: 1159677 - RNA, 19 nt, Homo sapiens
ugaacuggcccaucuguag

SEQ ID NO: 1159678 - RNA, 19 nt, Homo sapiens
guacuagaagaauacaaga

SEQ ID NO: 1159679 - RNA, 19 nt, Homo sapiens
cagauggagaagauauaua

SEQ ID NO: 1159680 - RNA, 19 nt, Homo sapiens
ccuuaaguucucuucauua

SEQ ID NO: 1159681 - RNA, 19 nt, Homo sapiens
ugguucaacuggauuucua

SEQ ID NO: 1159682 - RNA, 19 nt, Homo sapiens
ucacuauugcuaaccauga

SEQ ID NO: 1159683 - RNA, 19 nt, Homo sapiens
cuuaaguucucuucauuac

SEQ ID NO: 1159684 - RNA, 19 nt, Homo sapiens
caucuucugugaucagcau

SEQ ID NO: 1159685 - RNA, 19 nt, Homo sapiens
ggagauauauuauggagaa

SEQ ID NO: 1159686 - RNA, 19 nt, Homo sapiens
aaacagagauccacaacaa

SEQ ID NO: 1159687 - RNA, 19 nt, Homo sapiens
gagagagaaugacauagua

SEQ ID NO: 1159688 - RNA, 19 nt, Homo sapiens
gaccuggagugguuaauua

SEQ ID NO: 1159689 - RNA, 19 nt, Homo sapiens
gagcaggucuuagaaauga

SEQ ID NO: 1159690 - RNA, 19 nt, Homo sapiens
ggaagaggaugaggaagua

SEQ ID NO: 1159691 - RNA, 19 nt, Homo sapiens
uaauagagauggcuuguga

SEQ ID NO: 1159692 - RNA, 19 nt, Homo sapiens
caacucagaucgaaguaaa

SEQ ID NO: 1159693 - RNA, 19 nt, Homo sapiens
guaaggagauauauuaugg

SEQ ID NO: 1159694 - RNA, 19 nt, Homo sapiens
gagaaggaagagaauauua

SEQ ID NO: 1159695 - RNA, 19 nt, Homo sapiens
gaaagcaagaggaauguuu

SEQ ID NO: 1159696 - RNA, 19 nt, Homo sapiens
aaacaaggauaggacaaua

SEQ ID NO: 1159697 - RNA, 19 nt, Homo sapiens
guacuuugguuguauucua

SEQ ID NO: 1159698 - RNA, 19 nt, Homo sapiens
gagagcaggucuuagaaau

SEQ ID NO: 1159699 - RNA, 19 nt, Homo sapiens
gaugugcuccugucacuua

SEQ ID NO: 1159700 - RNA, 19 nt, Homo sapiens
gggaaacugucacaauuau

SEQ ID NO: 1159701 - RNA, 19 nt, Homo sapiens
aaacaaugguuaagaagga

SEQ ID NO: 1159702 - RNA, 19 nt, Homo sapiens
acaacaagcuuuucgauua

SEQ ID NO: 1159703 - RNA, 19 nt, Homo sapiens
caaaggaaauugaagacau

SEQ ID NO: 1159704 - RNA, 19 nt, Homo sapiens
ccaguuaguugauuuggaa

SEQ ID NO: 1159705 - RNA, 19 nt, Homo sapiens
gaagagcagaugaaagaaa

SEQ ID NO: 1159706 - RNA, 19 nt, Homo sapiens
gaaacugucacaauuaugu

SEQ ID NO: 1159707 - RNA, 19 nt, Homo sapiens
ggaagagaauauuaaccaa

SEQ ID NO: 1159708 - RNA, 19 nt, Homo sapiens
ggacacagucugcacauau

SEQ ID NO: 1159709 - RNA, 19 nt, Homo sapiens
uaagcguucuaaacaguua

SEQ ID NO: 1159710 - RNA, 19 nt, Homo sapiens
agagagagauggaaaauuu

SEQ ID NO: 1159711 - RNA, 19 nt, Homo sapiens
uagaagacacuacuacuuu

SEQ ID NO: 1159712 - RNA, 19 nt, Homo sapiens
aagaaccggugaaugauaa

SEQ ID NO: 1159713 - RNA, 19 nt, Homo sapiens
auacgaagaugacuuugaa

SEQ ID NO: 1159714 - RNA, 19 nt, Homo sapiens
aaagagagagaaugacaua

SEQ ID NO: 1159715 - RNA, 19 nt, Homo sapiens
gugaagagcuuagaaagag

SEQ ID NO: 1159716 - RNA, 19 nt, Homo sapiens
gugggcagcugcuaucaaa

SEQ ID NO: 1159717 - RNA, 19 nt, Homo sapiens
ggaaguaaggagauauauu

SEQ ID NO: 1159718 - RNA, 19 nt, Homo sapiens
gacaugaacaguagagaaa

SEQ ID NO: 1159719 - RNA, 19 nt, Homo sapiens
gagcaaaggaaauugaaga

SEQ ID NO: 1159720 - RNA, 19 nt, Homo sapiens
caagaaccggugaaugaua

SEQ ID NO: 1159721 - RNA, 19 nt, Homo sapiens
gcacgaagagcagaugaaa

SEQ ID NO: 1159722 - RNA, 19 nt, Homo sapiens
uaagaaagcaagaggaaug

SEQ ID NO: 1159723 - RNA, 19 nt, Homo sapiens
cagcauauuuccuucacaa

SEQ ID NO: 1159724 - RNA, 19 nt, Homo sapiens
gaggaaguaaggagauaua

SEQ ID NO: 1159725 - RNA, 19 nt, Homo sapiens
gcuaagcguucuaaacagu

SEQ ID NO: 1159726 - RNA, 19 nt, Homo sapiens
gaaagaaagacagacagaa

SEQ ID NO: 1159727 - RNA, 19 nt, Homo sapiens
aauggaagcugugaagaaa

SEQ ID NO: 1159728 - RNA, 19 nt, Homo sapiens
aaaggaaauugaagacaug

SEQ ID NO: 1159729 - RNA, 19 nt, Homo sapiens
ggaaugggaaaucuaauca

SEQ ID NO: 1159730 - RNA, 19 nt, Homo sapiens
ggaggaagaggaugaggaa

SEQ ID NO: 1159731 - RNA, 19 nt, Homo sapiens
agagauggcuugugagaag

SEQ ID NO: 1159732 - RNA, 19 nt, Homo sapiens
cauauuuccuucacaaaca

SEQ ID NO: 1159733 - RNA, 19 nt, Homo sapiens
uaaguucaaggaccaguua

SEQ ID NO: 1159734 - RNA, 19 nt, Homo sapiens
aaagcaagaggaauguuua

SEQ ID NO: 1159735 - RNA, 19 nt, Homo sapiens
gagagaaugacauaguauu

SEQ ID NO: 1159736 - RNA, 19 nt, Homo sapiens
uuacagcaccaccuauaua

SEQ ID NO: 1159737 - RNA, 19 nt, Homo sapiens
cgacagaaagaacuacaaa

SEQ ID NO: 1159738 - RNA, 19 nt, Homo sapiens
ccaggaauccaaacuagaa

SEQ ID NO: 1159739 - RNA, 19 nt, Homo sapiens
gcauucugauccugacaaa

SEQ ID NO: 1159740 - RNA, 19 nt, Homo sapiens
cagaagaacuaagaaagca

SEQ ID NO: 1159741 - RNA, 19 nt, Homo sapiens
uacaagacauugccaguca

SEQ ID NO: 1159742 - RNA, 19 nt, Homo sapiens
ggauaggacaauacuggua

SEQ ID NO: 1159743 - RNA, 19 nt, Homo sapiens
caaacuagaaagccagaaa

SEQ ID NO: 1159744 - RNA, 19 nt, Homo sapiens
gcuaacaagcuucuacaga

SEQ ID NO: 1159745 - RNA, 19 nt, Homo sapiens
agaauacgaagaugacuuu

SEQ ID NO: 1159746 - RNA, 19 nt, Homo sapiens
gaaggaaacggauggaaaa

SEQ ID NO: 1159747 - RNA, 19 nt, Homo sapiens
acgaagagcagaugaaaga

SEQ ID NO: 1159748 - RNA, 19 nt, Homo sapiens
gaauucagcgagcaaagga

SEQ ID NO: 1159749 - RNA, 19 nt, Homo sapiens
gcaccaagaaagaagauuc

SEQ ID NO: 1159750 - RNA, 19 nt, Homo sapiens
uugggaaacugucacaauu

SEQ ID NO: 1159751 - RNA, 19 nt, Homo sapiens
gaagcuaagcguucuaaac

SEQ ID NO: 1159752 - RNA, 19 nt, Homo sapiens
caacaagcuuuucgauuau

SEQ ID NO: 1159753 - RNA, 19 nt, Homo sapiens
gacacagucugcacauauc

SEQ ID NO: 1159754 - RNA, 19 nt, Homo sapiens
gaagacacuacuacuuuua

SEQ ID NO: 1159755 - RNA, 19 nt, Homo sapiens
uggagugguuaauuaauga

SEQ ID NO: 1159756 - RNA, 19 nt, Homo sapiens
gaaggaagagaauauuaac

SEQ ID NO: 1159757 - RNA, 19 nt, Homo sapiens
gaaauugaagacaugaaca

SEQ ID NO: 1159758 - RNA, 19 nt, Homo sapiens
uaaagggaaugggaaaucu

SEQ ID NO: 1159759 - RNA, 19 nt, Homo sapiens
gcugucaacucagaucgaa

SEQ ID NO: 1159760 - RNA, 19 nt, Homo sapiens
uaauggaagcugugaagaa

SEQ ID NO: 1159761 - RNA, 19 nt, Homo sapiens
cagcaccaccuauauaugu

SEQ ID NO: 1159762 - RNA, 19 nt, Homo sapiens
caccagugacuucaacaua

SEQ ID NO: 1159763 - RNA, 19 nt, Homo sapiens
gugcuccugucacuuacua

SEQ ID NO: 1159764 - RNA, 19 nt, Homo sapiens
aaaaggaccuggagugguu

SEQ ID NO: 1159765 - RNA, 19 nt, Homo sapiens
uugaagacaugaacaguag

SEQ ID NO: 1159766 - RNA, 19 nt, Homo sapiens
ggaccuggagugguuaauu

SEQ ID NO: 1159767 - RNA, 19 nt, Homo sapiens
ugggaaacugucacaauua

SEQ ID NO: 1159768 - RNA, 19 nt, Homo sapiens
cuuagggucuguguacuuu

SEQ ID NO: 1159769 - RNA, 19 nt, Homo sapiens
ugucagaagccaaaccuuu

SEQ ID NO: 1159770 - RNA, 19 nt, Homo sapiens
aagcuaagcguucuaaaca

SEQ ID NO: 1159771 - RNA, 19 nt, Homo sapiens
gaugaaagaaagacagaca

SEQ ID NO: 1159772 - RNA, 19 nt, Homo sapiens
gaacuucugaauuuacaag

SEQ ID NO: 1159773 - RNA, 19 nt, Homo sapiens
uuacacagcauauuuccuu

SEQ ID NO: 1159774 - RNA, 19 nt, Homo sapiens
guuaguugauuuggaaguu

SEQ ID NO: 1159775 - RNA, 19 nt, Homo sapiens
ccaccuauauaugucagaa

SEQ ID NO: 1159776 - RNA, 19 nt, Homo sapiens
agacagaagaacuaagaaa

SEQ ID NO: 1159777 - RNA, 19 nt, Homo sapiens
gcaaagauucaugcuguca

SEQ ID NO: 1159778 - RNA, 19 nt, Homo sapiens
ugacaucauuucuguacca

SEQ ID NO: 1159779 - RNA, 19 nt, Homo sapiens
gagcacaccaaacggcauu

SEQ ID NO: 1159780 - RNA, 19 nt, Homo sapiens
agaaggaaacggauggaaa

SEQ ID NO: 1159781 - RNA, 19 nt, Homo sapiens
gacagaagaacuaagaaag

SEQ ID NO: 1159782 - RNA, 19 nt, Homo sapiens
gugagaaggaagagaauau

SEQ ID NO: 1159783 - RNA, 19 nt, Homo sapiens
aagagcagaugaaagaaag

SEQ ID NO: 1159784 - RNA, 19 nt, Homo sapiens
gcuuuucgauuauggcuua

SEQ ID NO: 1159785 - RNA, 19 nt, Homo sapiens
ccacacaccucaugaaauu

SEQ ID NO: 1159786 - RNA, 19 nt, Homo sapiens
ccacugauauguaugauaa

SEQ ID NO: 1159787 - RNA, 19 nt, Homo sapiens
gaaauucucuuacacuagu

SEQ ID NO: 1159788 - RNA, 19 nt, Homo sapiens
gaagagaacauuuacaaag

SEQ ID NO: 1159789 - RNA, 19 nt, Homo sapiens
caaagugaccgcuguguaa

SEQ ID NO: 1159790 - RNA, 19 nt, Homo sapiens
gauaauggcucccucaacu

SEQ ID NO: 1159791 - RNA, 19 nt, Homo sapiens
ugacguggcugacugcaaa

SEQ ID NO: 1159792 - RNA, 19 nt, Homo sapiens
cagauuugcucaagaagaa

SEQ ID NO: 1159793 - RNA, 19 nt, Homo sapiens
gaacgacccagucaacuug

SEQ ID NO: 1159794 - RNA, 19 nt, Homo sapiens
ggaagaggcccuugaguca

SEQ ID NO: 1159795 - RNA, 19 nt, Homo sapiens
guuauucagugaugcauuu

SEQ ID NO: 1159796 - RNA, 19 nt, Homo sapiens
ccucagcgcuguuacuuga

SEQ ID NO: 1159797 - RNA, 19 nt, Homo sapiens
agaauaaccugaugagcuu

SEQ ID NO: 1159798 - RNA, 19 nt, Homo sapiens
ugaaauuccugacagagaa

SEQ ID NO: 1159799 - RNA, 19 nt, Homo sapiens
gacagcaccuucaaagaug

SEQ ID NO: 1159800 - RNA, 19 nt, Homo sapiens
gaguaaacaucgguggaua

SEQ ID NO: 1159801 - RNA, 19 nt, Homo sapiens
ugaaugggcugacgaucuu

SEQ ID NO: 1159802 - RNA, 19 nt, Homo sapiens
caagaagaauaaccugaug

SEQ ID NO: 1159803 - RNA, 19 nt, Homo sapiens
ugagcuuccucuaugauua

SEQ ID NO: 1159804 - RNA, 19 nt, Homo sapiens
uugaggagguggccuauaa

SEQ ID NO: 1159805 - RNA, 19 nt, Homo sapiens
ucgaugcucuucccagaua

SEQ ID NO: 1159806 - RNA, 19 nt, Homo sapiens
caauggagaugaugacagu

SEQ ID NO: 1159807 - RNA, 19 nt, Homo sapiens
ccagucaacuugcagaaau

SEQ ID NO: 1159808 - RNA, 19 nt, Homo sapiens
ccaaagccauccacaucaa

SEQ ID NO: 1159809 - RNA, 19 nt, Homo sapiens
ccaacaaagucaagagugu

SEQ ID NO: 1159810 - RNA, 19 nt, Homo sapiens
gggcaggaaugaccaagga

SEQ ID NO: 1159811 - RNA, 19 nt, Homo sapiens
acaacaucauucagcauua

SEQ ID NO: 1159812 - RNA, 19 nt, Homo sapiens
caaaggccaugaugagagu

SEQ ID NO: 1159813 - RNA, 19 nt, Homo sapiens
gagagucaauggagaugau

SEQ ID NO: 1159814 - RNA, 19 nt, Homo sapiens
cgaggaaucuuagucaaca

SEQ ID NO: 1159815 - RNA, 19 nt, Homo sapiens
gcccuucacugaggaguuu

SEQ ID NO: 1159816 - RNA, 19 nt, Homo sapiens
gcacugagcgccugguaca

SEQ ID NO: 1159817 - RNA, 19 nt, Homo sapiens
ccaagcagcgggucauuga

SEQ ID NO: 1159818 - RNA, 19 nt, Homo sapiens
guugacagcugccacaaag

SEQ ID NO: 1159819 - RNA, 19 nt, Homo sapiens
uggaagacguaccuagaaa

SEQ ID NO: 1159820 - RNA, 19 nt, Homo sapiens
caacauggacaacaacauc

SEQ ID NO: 1159821 - RNA, 19 nt, Homo sapiens
agagaguucugcuguaugu

SEQ ID NO: 1159822 - RNA, 19 nt, Homo sapiens
caacaaaggccaguucuac

SEQ ID NO: 1159823 - RNA, 19 nt, Homo sapiens
gggcugacgaucuuacuuu

SEQ ID NO: 1159824 - RNA, 19 nt, Homo sapiens
gagaacauuuacaaagucu

SEQ ID NO: 1159825 - RNA, 19 nt, Homo sapiens
ggagguggccuauaaugca

SEQ ID NO: 1159826 - RNA, 19 nt, Homo sapiens
gcaggaaugaccaaggaaa

SEQ ID NO: 1159827 - RNA, 19 nt, Homo sapiens
gaaaugcaagcgaggaauc

SEQ ID NO: 1159828 - RNA, 19 nt, Homo sapiens
gaacauuuacaaagucuac

SEQ ID NO: 1159829 - RNA, 19 nt, Homo sapiens
agaggaagaugcgcgauga

SEQ ID NO: 1159830 - RNA, 19 nt, Homo sapiens
auaaugcacuguccuuugu

SEQ ID NO: 1159831 - RNA, 19 nt, Homo sapiens
gccuugagcuuccucuaug

SEQ ID NO: 1159832 - RNA, 19 nt, Homo sapiens
cacacaaccucuccacaug

SEQ ID NO: 1159833 - RNA, 19 nt, Homo sapiens
caacaucauucagcauuac

SEQ ID NO: 1159834 - RNA, 19 nt, Homo sapiens
gggauucacagagcaauuu

SEQ ID NO: 1159835 - RNA, 19 nt, Homo sapiens
ccacaaaggccaugaugag

SEQ ID NO: 1159836 - RNA, 19 nt, Homo sapiens
caacuucagacaaaggauu

SEQ ID NO: 1159837 - RNA, 19 nt, Homo sapiens
gcaaugagacgaccuaccu

SEQ ID NO: 1159838 - RNA, 19 nt, Homo sapiens
gcacagacuuuuccucaca

SEQ ID NO: 1159839 - RNA, 19 nt, Homo sapiens
guggcugacugcaaagaaa

SEQ ID NO: 1159840 - RNA, 19 nt, Homo sapiens
agacagcaccuucaaagau

SEQ ID NO: 1159841 - RNA, 19 nt, Homo sapiens
gauuugcucaagaagaaua

SEQ ID NO: 1159842 - RNA, 19 nt, Homo sapiens
agacugaggagguguuuga

SEQ ID NO: 1159843 - RNA, 19 nt, Homo sapiens
ccucuaugauuacuacaug

SEQ ID NO: 1159844 - RNA, 19 nt, Homo sapiens
gccacucacuguuguauac

SEQ ID NO: 1159845 - RNA, 19 nt, Homo sapiens
ugaggaaugcgaucucuga

SEQ ID NO: 1159846 - RNA, 19 nt, Homo sapiens
gaaucuuagucaacaugga

SEQ ID NO: 1159847 - RNA, 19 nt, Homo sapiens
ucaugaaauuccugacaga

SEQ ID NO: 1159848 - RNA, 19 nt, Homo sapiens
aacaaugucaccaugguua

SEQ ID NO: 1159849 - RNA, 19 nt, Homo sapiens
ucacagagcaauuuguaag

SEQ ID NO: 1159850 - RNA, 19 nt, Homo sapiens
cagcaacaguggcgucaag

SEQ ID NO: 1159851 - RNA, 19 nt, Homo sapiens
ccaaggagaagcggauauu

SEQ ID NO: 1159852 - RNA, 19 nt, Homo sapiens
guucaucggcguaaacugu

SEQ ID NO: 1159853 - RNA, 19 nt, Homo sapiens
uguggaacgugaaugaaga

SEQ ID NO: 1159854 - RNA, 19 nt, Homo sapiens
gaggagguggccuauaaug

SEQ ID NO: 1159855 - RNA, 19 nt, Homo sapiens
cagucaacuugcagaaauu

SEQ ID NO: 1159856 - RNA, 19 nt, Homo sapiens
cacuaacgaucgacuggaa

SEQ ID NO: 1159857 - RNA, 19 nt, Homo sapiens
cuaaagaacgacccaguca

SEQ ID NO: 1159858 - RNA, 19 nt, Homo sapiens
agagaacauuuacaaaguc

SEQ ID NO: 1159859 - RNA, 19 nt, Homo sapiens
ggacccagcagcuccaaca

SEQ ID NO: 1159860 - RNA, 19 nt, Homo sapiens
ggaccucacuccccuugaa

SEQ ID NO: 1159861 - RNA, 19 nt, Homo sapiens
ucacuguuguauacauuuc

SEQ ID NO: 1159862 - RNA, 19 nt, Homo sapiens
aaauagcacuaacgaucga

SEQ ID NO: 1159863 - RNA, 19 nt, Homo sapiens
ggauguaaauagcacuaac

SEQ ID NO: 1159864 - RNA, 19 nt, Homo sapiens
ccucagcgcaggauguaaa

SEQ ID NO: 1159865 - RNA, 19 nt, Homo sapiens
cugaagagaacauuuacaa

SEQ ID NO: 1159866 - RNA, 19 nt, Homo sapiens
gaaguauggguucccugaa

SEQ ID NO: 1159867 - RNA, 19 nt, Homo sapiens
gagcaauuuguaaggguaa

SEQ ID NO: 1159868 - RNA, 19 nt, Homo sapiens
gauugacaccuaugacugu

SEQ ID NO: 1159869 - RNA, 19 nt, Homo sapiens
cccugaaccugcagauuga

SEQ ID NO: 1159870 - RNA, 19 nt, Homo sapiens
ccagacagcaccuucaaag

SEQ ID NO: 1159871 - RNA, 19 nt, Homo sapiens
ccaccacugauauguauga

SEQ ID NO: 1159872 - RNA, 19 nt, Homo sapiens
guacccagauuugcucaag

SEQ ID NO: 1159873 - RNA, 19 nt, Homo sapiens
gaugagagucaauggagau

SEQ ID NO: 1159874 - RNA, 19 nt, Homo sapiens
ggcugacgaucuuacuuug

SEQ ID NO: 1159875 - RNA, 19 nt, Homo sapiens
uauaaugcacuguccuuug

SEQ ID NO: 1159876 - RNA, 19 nt, Homo sapiens
acccagauuugcucaagaa

SEQ ID NO: 1159877 - RNA, 19 nt, Homo sapiens
uagcuguuauucagugaug

SEQ ID NO: 1159878 - RNA, 19 nt, Homo sapiens
acaaagugaccgcugugua

SEQ ID NO: 1159879 - RNA, 19 nt, Homo sapiens
cucaaccuuuggucaguua

SEQ ID NO: 1159880 - RNA, 19 nt, Homo sapiens
aagaggcccuugagucaca

SEQ ID NO: 1159881 - RNA, 19 nt, Homo sapiens
caucaagucaggcgaguca

SEQ ID NO: 1159882 - RNA, 19 nt, Homo sapiens
ucccugaagagaacauuua

SEQ ID NO: 1159883 - RNA, 19 nt, Homo sapiens
ucaagaguguggugauggu

SEQ ID NO: 1159884 - RNA, 19 nt, Homo sapiens
ucccucaacuccuuguuug

SEQ ID NO: 1159885 - RNA, 19 nt, Homo sapiens
ucacaaagaugaagaauca

SEQ ID NO: 1159886 - RNA, 19 nt, Homo sapiens
agaaugggauugaggauua

SEQ ID NO: 1159887 - RNA, 19 nt, Homo sapiens
gggaagaggaugugauuua

SEQ ID NO: 1159888 - RNA, 19 nt, Homo sapiens
gaagucacauuguaaaucu

SEQ ID NO: 1159889 - RNA, 19 nt, Homo sapiens
ggaagaggaugugauuuau

SEQ ID NO: 1159890 - RNA, 19 nt, Homo sapiens
gcaaaacccuauuguagua

SEQ ID NO: 1159891 - RNA, 19 nt, Homo sapiens
ggucaaaguucacaaagau

SEQ ID NO: 1159892 - RNA, 19 nt, Homo sapiens
ccaaaugaaugaacuacuu

SEQ ID NO: 1159893 - RNA, 19 nt, Homo sapiens
caccaucucuuauacuuaa

SEQ ID NO: 1159894 - RNA, 19 nt, Homo sapiens
gaacccaucccaauaaaga

SEQ ID NO: 1159895 - RNA, 19 nt, Homo sapiens
gaagagagagagacaagaa

SEQ ID NO: 1159896 - RNA, 19 nt, Homo sapiens
uaaagcaaguugacucuau

SEQ ID NO: 1159897 - RNA, 19 nt, Homo sapiens
gaagaggaugugauuuaua

SEQ ID NO: 1159898 - RNA, 19 nt, Homo sapiens
gagcaaaacuccaauacaa

SEQ ID NO: 1159899 - RNA, 19 nt, Homo sapiens
caggguagcugaccauguu

SEQ ID NO: 1159900 - RNA, 19 nt, Homo sapiens
aaaggaagauccagcaaau

SEQ ID NO: 1159901 - RNA, 19 nt, Homo sapiens
ucgggaaacuccuaacaua

SEQ ID NO: 1159902 - RNA, 19 nt, Homo sapiens
gagcucaccaucucuuaua

SEQ ID NO: 1159903 - RNA, 19 nt, Homo sapiens
gggcuuggauguaaggauu

SEQ ID NO: 1159904 - RNA, 19 nt, Homo sapiens
gcuuagaaguauuccuaua

SEQ ID NO: 1159905 - RNA, 19 nt, Homo sapiens
cuagaaacaucaaggaaga

SEQ ID NO: 1159906 - RNA, 19 nt, Homo sapiens
gaacacagaguacgacaca

SEQ ID NO: 1159907 - RNA, 19 nt, Homo sapiens
gaagagaguggacauuugu

SEQ ID NO: 1159908 - RNA, 19 nt, Homo sapiens
caaguugacucuauugucu

SEQ ID NO: 1159909 - RNA, 19 nt, Homo sapiens
gaaaggcauugugaaggaa

SEQ ID NO: 1159910 - RNA, 19 nt, Homo sapiens
ugacacauaucuugaaugg

SEQ ID NO: 1159911 - RNA, 19 nt, Homo sapiens
ccagaacccaucccaauaa

SEQ ID NO: 1159912 - RNA, 19 nt, Homo sapiens
gcaaacugaagaagaauga

SEQ ID NO: 1159913 - RNA, 19 nt, Homo sapiens
ugucugcccucaugaaauu

SEQ ID NO: 1159914 - RNA, 19 nt, Homo sapiens
gccaaugagucccauaaug

SEQ ID NO: 1159915 - RNA, 19 nt, Homo sapiens
gaaggucaaaguucacaaa

SEQ ID NO: 1159916 - RNA, 19 nt, Homo sapiens
gcacuaugcugagcuuaca

SEQ ID NO: 1159917 - RNA, 19 nt, Homo sapiens
caacaugccucacccucau

SEQ ID NO: 1159918 - RNA, 19 nt, Homo sapiens
agaaaggcauugugaagga

SEQ ID NO: 1159919 - RNA, 19 nt, Homo sapiens
ccagaagguuuaaucacuu

SEQ ID NO: 1159920 - RNA, 19 nt, Homo sapiens
gaagaaugaagaacguuga

SEQ ID NO: 1159921 - RNA, 19 nt, Homo sapiens
aaacaucaaggaagaauga

SEQ ID NO: 1159922 - RNA, 19 nt, Homo sapiens
gggaaacuccuaacauaug

SEQ ID NO: 1159923 - RNA, 19 nt, Homo sapiens
caaacaaacaccugugcua

SEQ ID NO: 1159924 - RNA, 19 nt, Homo sapiens
gacaagaagaguacauuga

SEQ ID NO: 1159925 - RNA, 19 nt, Homo sapiens
aggauuaucuucucucaga

SEQ ID NO: 1159926 - RNA, 19 nt, Homo sapiens
cagaacccaucccaauaaa

SEQ ID NO: 1159927 - RNA, 19 nt, Homo sapiens
uagcaggccugaccacaga

SEQ ID NO: 1159928 - RNA, 19 nt, Homo sapiens
aagaguacauugaagagaa

SEQ ID NO: 1159929 - RNA, 19 nt, Homo sapiens
gaaugucagcaaaccauaa

SEQ ID NO: 1159930 - RNA, 19 nt, Homo sapiens
uaucucugaugcuucuuua

SEQ ID NO: 1159931 - RNA, 19 nt, Homo sapiens
agaagagaguggacauuug

SEQ ID NO: 1159932 - RNA, 19 nt, Homo sapiens
gcaccugugugaccaaucu

SEQ ID NO: 1159933 - RNA, 19 nt, Homo sapiens
agucugaagucacauugua

SEQ ID NO: 1159934 - RNA, 19 nt, Homo sapiens
gaccgagucugaagucaca

SEQ ID NO: 1159935 - RNA, 19 nt, Homo sapiens
gaaugaagaacguugacuu

SEQ ID NO: 1159936 - RNA, 19 nt, Homo sapiens
ggaaacuccuaacauaugc

SEQ ID NO: 1159937 - RNA, 19 nt, Homo sapiens
aaagcaaguugacucuauu

SEQ ID NO: 1159938 - RNA, 19 nt, Homo sapiens
gagaguagacuucccagau

SEQ ID NO: 1159939 - RNA, 19 nt, Homo sapiens
gauugugaaugucagcaaa

SEQ ID NO: 1159940 - RNA, 19 nt, Homo sapiens
caagaagaguacauugaag

SEQ ID NO: 1159941 - RNA, 19 nt, Homo sapiens
gccagaacccaucccaaua

SEQ ID NO: 1159942 - RNA, 19 nt, Homo sapiens
gcaaggucacacauauuaa

SEQ ID NO: 1159943 - RNA, 19 nt, Homo sapiens
ugcaaggucacacauauua

SEQ ID NO: 1159944 - RNA, 19 nt, Homo sapiens
aaacaauucucggcccaaa

SEQ ID NO: 1159945 - RNA, 19 nt, Homo sapiens
acacaaucccucacacuaa

SEQ ID NO: 1159946 - RNA, 19 nt, Homo sapiens
gagagagacaagaagagua

SEQ ID NO: 1159947 - RNA, 19 nt, Homo sapiens
aagaggaugugauuuauac

SEQ ID NO: 1159948 - RNA, 19 nt, Homo sapiens
acucagggaucuacuaugu

SEQ ID NO: 1159949 - RNA, 19 nt, Homo sapiens
gauguaaggauuauaccaa

SEQ ID NO: 1159950 - RNA, 19 nt, Homo sapiens
cacaaucccucacacuaau

SEQ ID NO: 1159951 - RNA, 19 nt, Homo sapiens
gacacaaucccucacacua

SEQ ID NO: 1159952 - RNA, 19 nt, Homo sapiens
gaaugggauugaggauuau

SEQ ID NO: 1159953 - RNA, 19 nt, Homo sapiens
gaaaccccaucucuacuaa

SEQ ID NO: 1159954 - RNA, 19 nt, Homo sapiens
ucccagggcuuggauguaa

SEQ ID NO: 1159955 - RNA, 19 nt, Homo sapiens
uaaaggaagauccagcaaa

SEQ ID NO: 1159956 - RNA, 19 nt, Homo sapiens
gaagaagagaguggacauu

SEQ ID NO: 1159957 - RNA, 19 nt, Homo sapiens
agaguagacuucccagaug

SEQ ID NO: 1159958 - RNA, 19 nt, Homo sapiens
ucaaaguucacaaagauga

SEQ ID NO: 1159959 - RNA, 19 nt, Homo sapiens
gcaagaagaccaaaacaga

SEQ ID NO: 1159960 - RNA, 19 nt, Homo sapiens
cauuguaaaucuaguguag

SEQ ID NO: 1159961 - RNA, 19 nt, Homo sapiens
acagacaaguccagcagaa

SEQ ID NO: 1159962 - RNA, 19 nt, Homo sapiens
gcuauuugccuaugagaau

SEQ ID NO: 1159963 - RNA, 19 nt, Homo sapiens
acaagaagaguacauugaa

SEQ ID NO: 1159964 - RNA, 19 nt, Homo sapiens
caaggucacacauauuaau

SEQ ID NO: 1159965 - RNA, 19 nt, Homo sapiens
aaugcaaggucacacauau

SEQ ID NO: 1159966 - RNA, 19 nt, Homo sapiens
gugcuuagaaguauuccua

SEQ ID NO: 1159967 - RNA, 19 nt, Homo sapiens
gaagaguacauugaagaga

SEQ ID NO: 1159968 - RNA, 19 nt, Homo sapiens
ggcaguggguacuuguaaa

SEQ ID NO: 1159969 - RNA, 19 nt, Homo sapiens
gggcaguggguacuuguaa

SEQ ID NO: 1159970 - RNA, 19 nt, Homo sapiens
aaaaugggauugugaaugu

SEQ ID NO: 1159971 - RNA, 19 nt, Homo sapiens
caucaaggaagaaugaaga

SEQ ID NO: 1159972 - RNA, 19 nt, Homo sapiens
gucagugucuggaguuuca

SEQ ID NO: 1159973 - RNA, 19 nt, Homo sapiens
ccuaugagaauguuaucua

SEQ ID NO: 1159974 - RNA, 19 nt, Homo sapiens
ggaacccugucagcagaaa

SEQ ID NO: 1159975 - RNA, 19 nt, Homo sapiens
aagaauggcaccuguguga

SEQ ID NO: 1159976 - RNA, 19 nt, Homo sapiens
gggaauggcugcuuuugau

SEQ ID NO: 1159977 - RNA, 19 nt, Homo sapiens
gaccauguuuggcagauac

SEQ ID NO: 1159978 - RNA, 19 nt, Homo sapiens
gagacaagaagaguacauu

SEQ ID NO: 1159979 - RNA, 19 nt, Homo sapiens
gaaagugauaugaccuuca

SEQ ID NO: 1159980 - RNA, 19 nt, Homo sapiens
gagaaagugauaugaccuu

SEQ ID NO: 1159981 - RNA, 19 nt, Homo sapiens
agaccucccuaccaaguga

SEQ ID NO: 1159982 - RNA, 19 nt, Homo sapiens
gugcauggcccaaggacaa

SEQ ID NO: 1159983 - RNA, 19 nt, Homo sapiens
augcugagcuuacacuaau

SEQ ID NO: 1159984 - RNA, 19 nt, Homo sapiens
uuaaucacuucaucccaaa

SEQ ID NO: 1159985 - RNA, 19 nt, Homo sapiens
ggaauugguugaaguugaa

SEQ ID NO: 1159986 - RNA, 19 nt, Homo sapiens
gcucuucccugacuuauag

SEQ ID NO: 1159987 - RNA, 19 nt, Homo sapiens
gcacagcucuucccugacu

SEQ ID NO: 1159988 - RNA, 19 nt, Homo sapiens
gagguucucugcauguuug

SEQ ID NO: 1159989 - RNA, 19 nt, Homo sapiens
ugacacugcuguugagguu

SEQ ID NO: 1159990 - RNA, 19 nt, Homo sapiens
ccucugcucugcacaguga

SEQ ID NO: 1159991 - RNA, 19 nt, Homo sapiens
uuaagcaaguggaacauau

SEQ ID NO: 1159992 - RNA, 19 nt, Homo sapiens
gaugagcagggacaaauug

SEQ ID NO: 1159993 - RNA, 19 nt, Homo sapiens
cggaauugguugaaguuga

SEQ ID NO: 1159994 - RNA, 19 nt, Homo sapiens
acacugcuguugagguuug

SEQ ID NO: 1159995 - RNA, 19 nt, Homo sapiens
ggaagucggaauugguuga

SEQ ID NO: 1159996 - RNA, 19 nt, Homo sapiens
gguugaaguugaagaugau

SEQ ID NO: 1159997 - RNA, 19 nt, Homo sapiens
ggaugagcagggacaaauu

SEQ ID NO: 1159998 - RNA, 19 nt, Homo sapiens
aguugaagaugauguguau

SEQ ID NO: 1159999 - RNA, 19 nt, Homo sapiens
ugguugaaguugaagauga

SEQ ID NO: 1160000 - RNA, 19 nt, Homo sapiens
gcucugcacagugaaauga

SEQ ID NO: 1160001 - RNA, 19 nt, Homo sapiens
gaaaugaaaagucaaccuu

SEQ ID NO: 1160002 - RNA, 19 nt, Homo sapiens
ccagaaugcagagaagaaa

SEQ ID NO: 1160003 - RNA, 19 nt, Homo sapiens
gcagccagaaugcagagaa

SEQ ID NO: 1160004 - RNA, 19 nt, Homo sapiens
gccagaaugcagagaagaa

SEQ ID NO: 1160005 - RNA, 19 nt, Homo sapiens
gaagucggaauugguugaa

SEQ ID NO: 1160006 - RNA, 19 nt, Homo sapiens
ugacuuauaggcuuugaca

SEQ ID NO: 1160007 - RNA, 19 nt, Homo sapiens
uaagcaaguggaacauaug

SEQ ID NO: 1160008 - RNA, 19 nt, Homo sapiens
gcuuugacacugcuguuga

SEQ ID NO: 1160009 - RNA, 19 nt, Homo sapiens
uggaggagcagccagaaug

SEQ ID NO: 1160010 - RNA, 19 nt, Homo sapiens
ucugcacagugaaaugaaa

SEQ ID NO: 1160011 - RNA, 19 nt, Homo sapiens
aaauuaagcaaguggaaca

SEQ ID NO: 1160012 - RNA, 19 nt, Homo sapiens
gagcaugaagaagaguaaa

SEQ ID NO: 1160013 - RNA, 19 nt, Homo sapiens
acagugaaaugaaaaguca

SEQ ID NO: 1160014 - RNA, 19 nt, Homo sapiens
cagccagaaugcagagaag

SEQ ID NO: 1160015 - RNA, 19 nt, Homo sapiens
gaaguugaagaugaugugu

SEQ ID NO: 1160016 - RNA, 19 nt, Homo sapiens
uggaacauaugcccuuugc

SEQ ID NO: 1160017 - RNA, 19 nt, Homo sapiens
ucccugacuuauaggcuuu

SEQ ID NO: 1160018 - RNA, 19 nt, Homo sapiens
acagcucuucccugacuua

SEQ ID NO: 1160019 - RNA, 19 nt, Homo sapiens
ugagcaugaagaagaguaa

SEQ ID NO: 1160020 - RNA, 19 nt, Homo sapiens
gcauuuaguugaagaguua

SEQ ID NO: 1160021 - RNA, 19 nt, Homo sapiens
gcaaaugugcuuucuaaua

SEQ ID NO: 1160022 - RNA, 19 nt, Homo sapiens
gcaccaaaguucucgauuu

SEQ ID NO: 1160023 - RNA, 19 nt, Homo sapiens
gaagauaaccucaaucaug

SEQ ID NO: 1160024 - RNA, 19 nt, Homo sapiens
caaaugugcuuucuaauag

SEQ ID NO: 1160025 - RNA, 19 nt, Homo sapiens
gauugcauguugcuuauua

SEQ ID NO: 1160026 - RNA, 19 nt, Homo sapiens
guaaaucaaugguggauga

SEQ ID NO: 1160027 - RNA, 19 nt, Homo sapiens
gaaauugacuguagagcau

SEQ ID NO: 1160028 - RNA, 19 nt, Homo sapiens
gaaaagggaccaaaaguua

SEQ ID NO: 1160029 - RNA, 19 nt, Homo sapiens
gagcccagcuuuagucauu

SEQ ID NO: 1160030 - RNA, 19 nt, Homo sapiens
ggaaacuuaugcagaguaa

SEQ ID NO: 1160031 - RNA, 19 nt, Homo sapiens
ggaaagcucuaauauaugc

SEQ ID NO: 1160032 - RNA, 19 nt, Homo sapiens
caaauucccucaaagugaa

SEQ ID NO: 1160033 - RNA, 19 nt, Homo sapiens
caacuugugucguccagua

SEQ ID NO: 1160034 - RNA, 19 nt, Homo sapiens
uaacgcagguguagaauca

SEQ ID NO: 1160035 - RNA, 19 nt, Homo sapiens
caagauccaucgaccuuaa

SEQ ID NO: 1160036 - RNA, 19 nt, Homo sapiens
caaauaaagugguaucuac

SEQ ID NO: 1160037 - RNA, 19 nt, Homo sapiens
guagggcucugcaaauaaa

SEQ ID NO: 1160038 - RNA, 19 nt, Homo sapiens
caaggaaagcucuaauaua

SEQ ID NO: 1160039 - RNA, 19 nt, Homo sapiens
ccaagucucugggcuauuu

SEQ ID NO: 1160040 - RNA, 19 nt, Homo sapiens
gcaaauucccucaaaguga

SEQ ID NO: 1160041 - RNA, 19 nt, Homo sapiens
caagaucaguguuguacaa

SEQ ID NO: 1160042 - RNA, 19 nt, Homo sapiens
caagaagcauguucguauu

SEQ ID NO: 1160043 - RNA, 19 nt, Homo sapiens
caguagggcucugcaaaua

SEQ ID NO: 1160044 - RNA, 19 nt, Homo sapiens
uauaugcagugaugguuua

SEQ ID NO: 1160045 - RNA, 19 nt, Homo sapiens
gaacugagccuugguaaac

SEQ ID NO: 1160046 - RNA, 19 nt, Homo sapiens
gaggaaauuugcacagaug

SEQ ID NO: 1160047 - RNA, 19 nt, Homo sapiens
gaaaggguguggcaauuuu

SEQ ID NO: 1160048 - RNA, 19 nt, Homo sapiens
ccaauagauuucauucuug

SEQ ID NO: 1160049 - RNA, 19 nt, Homo sapiens
guagacuucugcacaugua

SEQ ID NO: 1160050 - RNA, 19 nt, Homo sapiens
uugcaaaugugcuuucuaa

SEQ ID NO: 1160051 - RNA, 19 nt, Homo sapiens
gguaaaccugucucuauua

SEQ ID NO: 1160052 - RNA, 19 nt, Homo sapiens
gcacagaugcugcuuugga

SEQ ID NO: 1160053 - RNA, 19 nt, Homo sapiens
gaagauuucuaccgcaaag

SEQ ID NO: 1160054 - RNA, 19 nt, Homo sapiens
cagcaaauuugacuugaau

SEQ ID NO: 1160055 - RNA, 19 nt, Homo sapiens
gcagcaaauuugacuugaa

SEQ ID NO: 1160056 - RNA, 19 nt, Homo sapiens
ucaauaacuuugucaagga

SEQ ID NO: 1160057 - RNA, 19 nt, Homo sapiens
gcaguccaccuguuuguaa

SEQ ID NO: 1160058 - RNA, 19 nt, Homo sapiens
gaguagaaauugacuaaac

SEQ ID NO: 1160059 - RNA, 19 nt, Homo sapiens
gcagugaugguuuaugaaa

SEQ ID NO: 1160060 - RNA, 19 nt, Homo sapiens
gaagcaagaucaguguugu

SEQ ID NO: 1160061 - RNA, 19 nt, Homo sapiens
ucuaauauaugcagugaug

SEQ ID NO: 1160062 - RNA, 19 nt, Homo sapiens
gccauugccuuccauguug

SEQ ID NO: 1160063 - RNA, 19 nt, Homo sapiens
gaucuaauguacuguaacu

SEQ ID NO: 1160064 - RNA, 19 nt, Homo sapiens
gcauguugcuuauuaggau

SEQ ID NO: 1160065 - RNA, 19 nt, Homo sapiens
gcacuuuaauaccaaacuu

SEQ ID NO: 1160066 - RNA, 19 nt, Homo sapiens
gcaaaucugcccuuacugu

SEQ ID NO: 1160067 - RNA, 19 nt, Homo sapiens
gaucaaauugucagaguga

SEQ ID NO: 1160068 - RNA, 19 nt, Homo sapiens
gagaucaaauugucagagu

SEQ ID NO: 1160069 - RNA, 19 nt, Homo sapiens
gaaucagaaaggaaacuua

SEQ ID NO: 1160070 - RNA, 19 nt, Homo sapiens
guuaugaccuauuuagcaa

SEQ ID NO: 1160071 - RNA, 19 nt, Homo sapiens
ccauacaucuauuuaagug

SEQ ID NO: 1160072 - RNA, 19 nt, Homo sapiens
uaucauggaucuaauguac

SEQ ID NO: 1160073 - RNA, 19 nt, Homo sapiens
caauaacuuugucaaggaa

SEQ ID NO: 1160074 - RNA, 19 nt, Homo sapiens
gaagcauguucguauuaga

SEQ ID NO: 1160075 - RNA, 19 nt, Homo sapiens
uagaggcaauugaaacauu

SEQ ID NO: 1160076 - RNA, 19 nt, Homo sapiens
ucaagaagcauguucguau

SEQ ID NO: 1160077 - RNA, 19 nt, Homo sapiens
acaaaugguuacuucugua

SEQ ID NO: 1160078 - RNA, 19 nt, Homo sapiens
gcucuaauauaugcaguga

SEQ ID NO: 1160079 - RNA, 19 nt, Homo sapiens
cauacacacuuucuaguuc

SEQ ID NO: 1160080 - RNA, 19 nt, Homo sapiens
ucaggcaaaugaacuauuc

SEQ ID NO: 1160081 - RNA, 19 nt, Homo sapiens
gagagguuaugucuucaga

SEQ ID NO: 1160082 - RNA, 19 nt, Homo sapiens
aaagauagaggcaauugaa

SEQ ID NO: 1160083 - RNA, 19 nt, Homo sapiens
gcaugaccauuaauuacug

SEQ ID NO: 1160084 - RNA, 19 nt, Homo sapiens
ugugugugauguucaaaua

SEQ ID NO: 1160085 - RNA, 19 nt, Homo sapiens
gaauaucccuuuucuucaa

SEQ ID NO: 1160086 - RNA, 19 nt, Homo sapiens
gcauugaauugcggcagua

SEQ ID NO: 1160087 - RNA, 19 nt, Homo sapiens
gcagaacugagccuuggua

SEQ ID NO: 1160088 - RNA, 19 nt, Homo sapiens
gagcaaauucccucaaagu

SEQ ID NO: 1160089 - RNA, 19 nt, Homo sapiens
aaagugguaucuacauuca

SEQ ID NO: 1160090 - RNA, 19 nt, Homo sapiens
ucaaggaaagcucuaauau

SEQ ID NO: 1160091 - RNA, 19 nt, Homo sapiens
gguaggaguuggugaaggu

SEQ ID NO: 1160092 - RNA, 19 nt, Homo sapiens
cuaucaggcuuguaauuga

SEQ ID NO: 1160093 - RNA, 19 nt, Homo sapiens
gaauugcggcaguaacauu

SEQ ID NO: 1160094 - RNA, 19 nt, Homo sapiens
gcaguuugccuccaugaga

SEQ ID NO: 1160095 - RNA, 19 nt, Homo sapiens
ucacugggacuuucauuga

SEQ ID NO: 1160096 - RNA, 19 nt, Homo sapiens
gaccucagcagcaaauuug

SEQ ID NO: 1160097 - RNA, 19 nt, Homo sapiens
ugucuugucuuuauuaugg

SEQ ID NO: 1160098 - RNA, 19 nt, Homo sapiens
ucagcaugaccauuaauua

SEQ ID NO: 1160099 - RNA, 19 nt, Homo sapiens
guugaagaguuaagcauuc

SEQ ID NO: 1160100 - RNA, 19 nt, Homo sapiens
gagaucgucaggcaaauga

SEQ ID NO: 1160101 - RNA, 19 nt, Homo sapiens
gagcucugguucaagaaug

SEQ ID NO: 1160102 - RNA, 19 nt, Homo sapiens
gauagaggcaauugaaaca

SEQ ID NO: 1160103 - RNA, 19 nt, Homo sapiens
ugguaaaccugucucuauu

SEQ ID NO: 1160104 - RNA, 19 nt, Homo sapiens
aaugagagaucaaauuguc

SEQ ID NO: 1160105 - RNA, 19 nt, Homo sapiens
guaaagauagaggcaauug

SEQ ID NO: 1160106 - RNA, 19 nt, Homo sapiens
gcauucaguuccauuaggu

SEQ ID NO: 1160107 - RNA, 19 nt, Homo sapiens
cagaggaaauuugcacaga

SEQ ID NO: 1160108 - RNA, 19 nt, Homo sapiens
ggccauaccgagcagauaa

SEQ ID NO: 1160109 - RNA, 19 nt, Homo sapiens
guaaagaagauaaccucaa

SEQ ID NO: 1160110 - RNA, 19 nt, Homo sapiens
gaauggggcuguccuuuca

SEQ ID NO: 1160111 - RNA, 19 nt, Homo sapiens
caggauaucaagccaauga

SEQ ID NO: 1160112 - RNA, 19 nt, Homo sapiens
uggcaucuauuuaggaguu

SEQ ID NO: 1160113 - RNA, 19 nt, Homo sapiens
ggaaagugauuuuaaaggu

SEQ ID NO: 1160114 - RNA, 19 nt, Homo sapiens
uguguaaguuugacaguau

SEQ ID NO: 1160115 - RNA, 19 nt, Homo sapiens
uaccagugcuucauccuau

SEQ ID NO: 1160116 - RNA, 19 nt, Homo sapiens
uuuauagccugguuaauca

SEQ ID NO: 1160117 - RNA, 19 nt, Homo sapiens
uagauugcauguugcuuau

SEQ ID NO: 1160118 - RNA, 19 nt, Homo sapiens
uaauguuucuuuccuguag

SEQ ID NO: 1160119 - RNA, 19 nt, Homo sapiens
cauuugaacaugcuucuaa

SEQ ID NO: 1160120 - RNA, 19 nt, Homo sapiens
gaaagacucuggcuucuga

SEQ ID NO: 1160121 - RNA, 19 nt, Homo sapiens
ggaagcagccucagaauuu

SEQ ID NO: 1160122 - RNA, 19 nt, Homo sapiens
ggagagaacagaacuauuu

SEQ ID NO: 1160123 - RNA, 19 nt, Homo sapiens
ggaguuugcuggacacuuu

SEQ ID NO: 1160124 - RNA, 19 nt, Homo sapiens
gcacuucgccugccucuuu

SEQ ID NO: 1160125 - RNA, 19 nt, Homo sapiens
gaggacaucuuaguucuga

SEQ ID NO: 1160126 - RNA, 19 nt, Homo sapiens
gagagaacagaacuauuua

SEQ ID NO: 1160127 - RNA, 19 nt, Homo sapiens
guaugaugguggugaauaa

SEQ ID NO: 1160128 - RNA, 19 nt, Homo sapiens
gaagagagugugggcuuua

SEQ ID NO: 1160129 - RNA, 19 nt, Homo sapiens
ggaagugacugggauagug

SEQ ID NO: 1160130 - RNA, 19 nt, Homo sapiens
gaacugaagaggaagcaaa

SEQ ID NO: 1160131 - RNA, 19 nt, Homo sapiens
gggcagcaguuaaagacua

SEQ ID NO: 1160132 - RNA, 19 nt, Homo sapiens
ggaagaaacccgaguacga

SEQ ID NO: 1160133 - RNA, 19 nt, Homo sapiens
gaagcagccucagaauuug

SEQ ID NO: 1160134 - RNA, 19 nt, Homo sapiens
gacccaaauuguaagcaua

SEQ ID NO: 1160135 - RNA, 19 nt, Homo sapiens
gaaaucauagcccucuaaa

SEQ ID NO: 1160136 - RNA, 19 nt, Homo sapiens
gcacugcucuuggacuuca

SEQ ID NO: 1160137 - RNA, 19 nt, Homo sapiens
aaucauagcccucuaaauc

SEQ ID NO: 1160138 - RNA, 19 nt, Homo sapiens
ggacagugcaggcaguauu

SEQ ID NO: 1160139 - RNA, 19 nt, Homo sapiens
acgcguaggucccgaagua

SEQ ID NO: 1160140 - RNA, 19 nt, Homo sapiens
ggguguggauggugaauga

SEQ ID NO: 1160141 - RNA, 19 nt, Homo sapiens
cagaaaccauggaagaugu

SEQ ID NO: 1160142 - RNA, 19 nt, Homo sapiens
ggcaugacccaaauuguaa

SEQ ID NO: 1160143 - RNA, 19 nt, Homo sapiens
caaacuacuugccacacuu

SEQ ID NO: 1160144 - RNA, 19 nt, Homo sapiens
ggacuucaccagcuguuau

SEQ ID NO: 1160145 - RNA, 19 nt, Homo sapiens
aaacucagaugggaucaug

SEQ ID NO: 1160146 - RNA, 19 nt, Homo sapiens
ucauagcccucuaaaucaa

SEQ ID NO: 1160147 - RNA, 19 nt, Homo sapiens
gaucucugaggacaucuua

SEQ ID NO: 1160148 - RNA, 19 nt, Homo sapiens
gaggagccacuucugaauu

SEQ ID NO: 1160149 - RNA, 19 nt, Homo sapiens
ggcaaagggugaagagagu

SEQ ID NO: 1160150 - RNA, 19 nt, Homo sapiens
gggcacugcucuuggacuu

SEQ ID NO: 1160151 - RNA, 19 nt, Homo sapiens
guucugagccuacuuacug

SEQ ID NO: 1160152 - RNA, 19 nt, Homo sapiens
gaugggaucauguggauuc

SEQ ID NO: 1160153 - RNA, 19 nt, Homo sapiens
gcaugacuauucagagaag

SEQ ID NO: 1160154 - RNA, 19 nt, Homo sapiens
cagaugggaucauguggau

SEQ ID NO: 1160155 - RNA, 19 nt, Homo sapiens
ccaggaagcagccucagaa

SEQ ID NO: 1160156 - RNA, 19 nt, Homo sapiens
ggaaggaaauccggaaacg

SEQ ID NO: 1160157 - RNA, 19 nt, Homo sapiens
uaagagagugguugggaaa

SEQ ID NO: 1160158 - RNA, 19 nt, Homo sapiens
gguccucucuaccuuugaa

SEQ ID NO: 1160159 - RNA, 19 nt, Homo sapiens
ccaccuuccugcccgcuuu

SEQ ID NO: 1160160 - RNA, 19 nt, Homo sapiens
gcaauaaauaacuguguca

SEQ ID NO: 1160161 - RNA, 19 nt, Homo sapiens
ccacuuuguagaaaucaua

SEQ ID NO: 1160162 - RNA, 19 nt, Homo sapiens
ugaagagagugugggcuuu

SEQ ID NO: 1160163 - RNA, 19 nt, Homo sapiens
gggaggagccacuucugaa

SEQ ID NO: 1160164 - RNA, 19 nt, Homo sapiens
gccacucuguucuuacuga

SEQ ID NO: 1160165 - RNA, 19 nt, Homo sapiens
gcucacucagcaauaaaua

SEQ ID NO: 1160166 - RNA, 19 nt, Homo sapiens
ugaugguggugaauaaaga

SEQ ID NO: 1160167 - RNA, 19 nt, Homo sapiens
gcuguucugagccuacuua

SEQ ID NO: 1160168 - RNA, 19 nt, Homo sapiens
gaggcugcaugacuauuca

SEQ ID NO: 1160169 - RNA, 19 nt, Homo sapiens
aaaguaugaugguggugaa

SEQ ID NO: 1160170 - RNA, 19 nt, Homo sapiens
ugagggcacugcucuugga

SEQ ID NO: 1160171 - RNA, 19 nt, Homo sapiens
cugcaugacuauucagaga

SEQ ID NO: 1160172 - RNA, 19 nt, Homo sapiens
gagaacagaacuauuuagg

SEQ ID NO: 1160173 - RNA, 19 nt, Homo sapiens
ggaggagccacuucugaau

SEQ ID NO: 1160174 - RNA, 19 nt, Homo sapiens
cauuccaccuccuaacaaa

SEQ ID NO: 1160175 - RNA, 19 nt, Homo sapiens
aggcaugacccaaauugua

SEQ ID NO: 1160176 - RNA, 19 nt, Homo sapiens
agugugggcuuuaggagaa

SEQ ID NO: 1160177 - RNA, 19 nt, Homo sapiens
gaccagggcaggauagaca

SEQ ID NO: 1160178 - RNA, 19 nt, Homo sapiens
gcgcuuugcuucguaacug

SEQ ID NO: 1160179 - RNA, 19 nt, Homo sapiens
agaggaagcaaacuacuug

SEQ ID NO: 1160180 - RNA, 19 nt, Homo sapiens
gaagagugucugcagaucu

SEQ ID NO: 1160181 - RNA, 19 nt, Homo sapiens
gggaccagccuaucucuag

SEQ ID NO: 1160182 - RNA, 19 nt, Homo sapiens
ccagaaaccauggaagaug

SEQ ID NO: 1160183 - RNA, 19 nt, Homo sapiens
ugacccgccuuacccagaa

SEQ ID NO: 1160184 - RNA, 19 nt, Homo sapiens
gugaaugaauuuggguaug

SEQ ID NO: 1160185 - RNA, 19 nt, Homo sapiens
agaaaucauagcccucuaa

SEQ ID NO: 1160186 - RNA, 19 nt, Homo sapiens
gacagugcaggcaguauug

SEQ ID NO: 1160187 - RNA, 19 nt, Homo sapiens
gauccugagagucugagua

SEQ ID NO: 1160188 - RNA, 19 nt, Homo sapiens
cugcuaggcaaguggauua

SEQ ID NO: 1160189 - RNA, 19 nt, Homo sapiens
gggccacuuuguagaaauc

SEQ ID NO: 1160190 - RNA, 19 nt, Homo sapiens
uuuaggguguuuguguuua

SEQ ID NO: 1160191 - RNA, 19 nt, Homo sapiens
uauuuaggguguuuguguu

SEQ ID NO: 1160192 - RNA, 19 nt, Homo sapiens
agaacuauuuaggguguuu

SEQ ID NO: 1160193 - RNA, 19 nt, Homo sapiens
gagagugugggcuuuagga

SEQ ID NO: 1160194 - RNA, 19 nt, Homo sapiens
aggagccacuucugaauuc

SEQ ID NO: 1160195 - RNA, 19 nt, Homo sapiens
ccagucgggccacuuugua

SEQ ID NO: 1160196 - RNA, 19 nt, Homo sapiens
ugaaugaauuuggguaugc

SEQ ID NO: 1160197 - RNA, 19 nt, Homo sapiens
uguggauggugaaugaauu

SEQ ID NO: 1160198 - RNA, 19 nt, Homo sapiens
acuugaggcugcaugacua

SEQ ID NO: 1160199 - RNA, 19 nt, Homo sapiens
ggagauccugagagucuga

SEQ ID NO: 1160200 - RNA, 19 nt, Homo sapiens
cuaacaaagagaauuccua

SEQ ID NO: 1160201 - RNA, 19 nt, Homo sapiens
guggauggugaaugaauuu

SEQ ID NO: 1160202 - RNA, 19 nt, Homo sapiens
caggagggccagugcagaa

SEQ ID NO: 1160203 - RNA, 19 nt, Homo sapiens
uuaggguguuuguguuuau

SEQ ID NO: 1160204 - RNA, 19 nt, Homo sapiens
caggagagaacagaacuau

SEQ ID NO: 1160205 - RNA, 19 nt, Homo sapiens
gcugcuggcuggaguuugc

SEQ ID NO: 1160206 - RNA, 19 nt, Homo sapiens
gaagaggaagcaaacuacu

SEQ ID NO: 1160207 - RNA, 19 nt, Homo sapiens
cugaagaggaagcaaacua

SEQ ID NO: 1160208 - RNA, 19 nt, Homo sapiens
ugacccaaauuguaagcau

SEQ ID NO: 1160209 - RNA, 19 nt, Homo sapiens
ggagccacuucugaauuca

SEQ ID NO: 1160210 - RNA, 19 nt, Homo sapiens
gauccaggagcaccuagga

SEQ ID NO: 1160211 - RNA, 19 nt, Homo sapiens
caaaggguccucucuaccu

SEQ ID NO: 1160212 - RNA, 19 nt, Homo sapiens
ugugaggcaugacccaaau

SEQ ID NO: 1160213 - RNA, 19 nt, Homo sapiens
ugaggcaugacccaaauug

SEQ ID NO: 1160214 - RNA, 19 nt, Homo sapiens
ccugagagucugaguagug

SEQ ID NO: 1160215 - RNA, 19 nt, Homo sapiens
cugcaucaccaggcaaaua

SEQ ID NO: 1160216 - RNA, 19 nt, Homo sapiens
uacugccacucuguucuua

SEQ ID NO: 1160217 - RNA, 19 nt, Homo sapiens
acucagcaauaaauaacug

SEQ ID NO: 1160218 - RNA, 19 nt, Homo sapiens
gggcauugaggguuucuag

SEQ ID NO: 1160219 - RNA, 19 nt, Homo sapiens
ucaggaagugacugggaua

SEQ ID NO: 1160220 - RNA, 19 nt, Homo sapiens
gggcuaggcuguuguuaua

SEQ ID NO: 1160221 - RNA, 19 nt, Homo sapiens
gaccaaaugugucaauaaa

SEQ ID NO: 1160222 - RNA, 19 nt, Homo sapiens
gcugaucccuguccagaaa

SEQ ID NO: 1160223 - RNA, 19 nt, Homo sapiens
ggaaugacagugcguguaa

SEQ ID NO: 1160224 - RNA, 19 nt, Homo sapiens
gcaacucucucccaaucaa

SEQ ID NO: 1160225 - RNA, 19 nt, Homo sapiens
agaggaagcugcucaagug

SEQ ID NO: 1160226 - RNA, 19 nt, Homo sapiens
ucaagaaacagaagaguug

SEQ ID NO: 1160227 - RNA, 19 nt, Homo sapiens
gaaacacugugaccuugca

SEQ ID NO: 1160228 - RNA, 19 nt, Homo sapiens
gaucucagucgaagaagaa

SEQ ID NO: 1160229 - RNA, 19 nt, Homo sapiens
ccaccacccuuuccugaga

SEQ ID NO: 1160230 - RNA, 19 nt, Homo sapiens
cagaaagccuuggaucuuc

SEQ ID NO: 1160231 - RNA, 19 nt, Homo sapiens
uagcaacucucucccaauc

SEQ ID NO: 1160232 - RNA, 19 nt, Homo sapiens
acugugaccuugcauugua

SEQ ID NO: 1160233 - RNA, 19 nt, Homo sapiens
gagaugcuccagauacuga

SEQ ID NO: 1160234 - RNA, 19 nt, Homo sapiens
gcucaaguguccuauggau

SEQ ID NO: 1160235 - RNA, 19 nt, Homo sapiens
ggcaacgucuccuccugua

SEQ ID NO: 1160236 - RNA, 19 nt, Homo sapiens
caucuucaccuucagcuuu

SEQ ID NO: 1160237 - RNA, 19 nt, Homo sapiens
gagggccauuucucuauug

SEQ ID NO: 1160238 - RNA, 19 nt, Homo sapiens
gugaagggcuaggcuguug

SEQ ID NO: 1160239 - RNA, 19 nt, Homo sapiens
caccagcgcuucagcaucu

SEQ ID NO: 1160240 - RNA, 19 nt, Homo sapiens
cagaccaaaugugucaaua

SEQ ID NO: 1160241 - RNA, 19 nt, Homo sapiens
ccagaaagccuuggaucuu

SEQ ID NO: 1160242 - RNA, 19 nt, Homo sapiens
gugaauuccugcuacuaug

SEQ ID NO: 1160243 - RNA, 19 nt, Homo sapiens
ucagauugccaaagauaaa

SEQ ID NO: 1160244 - RNA, 19 nt, Homo sapiens
gcuuggcccuuaggaauga

SEQ ID NO: 1160245 - RNA, 19 nt, Homo sapiens
gauacugacuggugugacu

SEQ ID NO: 1160246 - RNA, 19 nt, Homo sapiens
gcagaaugacuccgacugu

SEQ ID NO: 1160247 - RNA, 19 nt, Homo sapiens
gaagaaauuuugacaacag

SEQ ID NO: 1160248 - RNA, 19 nt, Homo sapiens
guggugaccuguccugauc

SEQ ID NO: 1160249 - RNA, 19 nt, Homo sapiens
ccuguagacucgaaaguuc

SEQ ID NO: 1160250 - RNA, 19 nt, Homo sapiens
ucugugcgcuuggcccuua

SEQ ID NO: 1160251 - RNA, 19 nt, Homo sapiens
uguggcaccuggauaagaa

SEQ ID NO: 1160252 - RNA, 19 nt, Homo sapiens
gaagggcuaggcuguuguu

SEQ ID NO: 1160253 - RNA, 19 nt, Homo sapiens
gaagaguugcccagaccaa

SEQ ID NO: 1160254 - RNA, 19 nt, Homo sapiens
ucucagaacacuacugcua

SEQ ID NO: 1160255 - RNA, 19 nt, Homo sapiens
caccacugcucuuggauuc

SEQ ID NO: 1160256 - RNA, 19 nt, Homo sapiens
ggugaauuccugcuacuau

SEQ ID NO: 1160257 - RNA, 19 nt, Homo sapiens
gagaggaagcugcucaagu

SEQ ID NO: 1160258 - RNA, 19 nt, Homo sapiens
ggacucccacuacaucaug

SEQ ID NO: 1160259 - RNA, 19 nt, Homo sapiens
gagcuuccaguuugcugua

SEQ ID NO: 1160260 - RNA, 19 nt, Homo sapiens
gggcaacacccagcacuga

SEQ ID NO: 1160261 - RNA, 19 nt, Homo sapiens
agaccgagcaguauaugaa

SEQ ID NO: 1160262 - RNA, 19 nt, Homo sapiens
gcgcuuggcccuuaggaau

SEQ ID NO: 1160263 - RNA, 19 nt, Homo sapiens
gcagcuccgugguguugga

SEQ ID NO: 1160264 - RNA, 19 nt, Homo sapiens
aaagcuccguguuccugua

SEQ ID NO: 1160265 - RNA, 19 nt, Homo sapiens
caucaugccaguuggaguu

SEQ ID NO: 1160266 - RNA, 19 nt, Homo sapiens
agaccaaaugugucaauaa

SEQ ID NO: 1160267 - RNA, 19 nt, Homo sapiens
gagccuuguuaguauccua

SEQ ID NO: 1160268 - RNA, 19 nt, Homo sapiens
cuuggagccuuguuaguau

SEQ ID NO: 1160269 - RNA, 19 nt, Homo sapiens
cccaaucaauguccagguu

SEQ ID NO: 1160270 - RNA, 19 nt, Homo sapiens
ccacugcucuuggauucug

SEQ ID NO: 1160271 - RNA, 19 nt, Homo sapiens
aacacaaggugguuacaga

SEQ ID NO: 1160272 - RNA, 19 nt, Homo sapiens
gacuguggcaccuggauaa

SEQ ID NO: 1160273 - RNA, 19 nt, Homo sapiens
acuaauagcuugggacaac

SEQ ID NO: 1160274 - RNA, 19 nt, Homo sapiens
uuugcuguguguuucauua

SEQ ID NO: 1160275 - RNA, 19 nt, Homo sapiens
ccuuggagccuuguuagua

SEQ ID NO: 1160276 - RNA, 19 nt, Homo sapiens
gaccgagcaguauaugaaa

SEQ ID NO: 1160277 - RNA, 19 nt, Homo sapiens
gcuguguguuucauuaucu

SEQ ID NO: 1160278 - RNA, 19 nt, Homo sapiens
ccaaaugugucaauaaaac

SEQ ID NO: 1160279 - RNA, 19 nt, Homo sapiens
acuaaggacccuccagaaa

SEQ ID NO: 1160280 - RNA, 19 nt, Homo sapiens
cuucagauugccaaagaua

SEQ ID NO: 1160281 - RNA, 19 nt, Homo sapiens
ucaaguguccuauggaucu

SEQ ID NO: 1160282 - RNA, 19 nt, Homo sapiens
cuacauuggagacaacuau

SEQ ID NO: 1160283 - RNA, 19 nt, Homo sapiens
gcccagaccaaauguguca

SEQ ID NO: 1160284 - RNA, 19 nt, Homo sapiens
gaacuucagauugccaaag

SEQ ID NO: 1160285 - RNA, 19 nt, Homo sapiens
ccaaucaauguccagguuu

SEQ ID NO: 1160286 - RNA, 19 nt, Homo sapiens
gcugaacacaaggugguua

SEQ ID NO: 1160287 - RNA, 19 nt, Homo sapiens
gaguugcccagaccaaaug

SEQ ID NO: 1160288 - RNA, 19 nt, Homo sapiens
gggcugcuccuacaacagu

SEQ ID NO: 1160289 - RNA, 19 nt, Homo sapiens
cgacuguggcaccuggaua

SEQ ID NO: 1160290 - RNA, 19 nt, Homo sapiens
gaauuccugcuacuaugga

SEQ ID NO: 1160291 - RNA, 19 nt, Homo sapiens
gaacacaaggugguuacag

SEQ ID NO: 1160292 - RNA, 19 nt, Homo sapiens
caaucaauguccagguuuu

SEQ ID NO: 1160293 - RNA, 19 nt, Homo sapiens
cuguuccaguuuccauuua

SEQ ID NO: 1160294 - RNA, 19 nt, Homo sapiens
gcuuccaguuugcuguaaa

SEQ ID NO: 1160295 - RNA, 19 nt, Homo sapiens
acacugugaccuugcauug

SEQ ID NO: 1160296 - RNA, 19 nt, Homo sapiens
gaggugaauuccugcuacu

SEQ ID NO: 1160297 - RNA, 19 nt, Homo sapiens
caugccaguuggaguugaa

SEQ ID NO: 1160298 - RNA, 19 nt, Homo sapiens
uguguuucauuaucucuug

SEQ ID NO: 1160299 - RNA, 19 nt, Homo sapiens
gucaagaaacagaagaguu

SEQ ID NO: 1160300 - RNA, 19 nt, Homo sapiens
caacgucuccuccuguacu

SEQ ID NO: 1160301 - RNA, 19 nt, Homo sapiens
aacuucagauugccaaaga

SEQ ID NO: 1160302 - RNA, 19 nt, Homo sapiens
uaaggacccuccagaaaag

SEQ ID NO: 1160303 - RNA, 19 nt, Homo sapiens
gagaccgagcaguauauga

SEQ ID NO: 1160304 - RNA, 19 nt, Homo sapiens
caaguguccuauggaucuu

SEQ ID NO: 1160305 - RNA, 19 nt, Homo sapiens
gcaaaggccccaugauucu

SEQ ID NO: 1160306 - RNA, 19 nt, Homo sapiens
ugaucucagucgaagaaga

SEQ ID NO: 1160307 - RNA, 19 nt, Homo sapiens
aaacuauggcucuuacuac

SEQ ID NO: 1160308 - RNA, 19 nt, Homo sapiens
ggagaccgagcaguauaug

SEQ ID NO: 1160309 - RNA, 19 nt, Homo sapiens
cuaaggacccuccagaaaa

SEQ ID NO: 1160310 - RNA, 19 nt, Homo sapiens
ccaccacugcucuuggauu

SEQ ID NO: 1160311 - RNA, 19 nt, Homo sapiens
guuguuauagcucugaaga

SEQ ID NO: 1160312 - RNA, 19 nt, Homo sapiens
uagcaaaggccccaugauu

SEQ ID NO: 1160313 - RNA, 19 nt, Homo sapiens
gaacccuacaguggagaaa

SEQ ID NO: 1160314 - RNA, 19 nt, Homo sapiens
gaaugacagugcguguaac

SEQ ID NO: 1160315 - RNA, 19 nt, Homo sapiens
ccgagaugcuccagauacu

SEQ ID NO: 1160316 - RNA, 19 nt, Homo sapiens
acaguggcccauccuggua

SEQ ID NO: 1160317 - RNA, 19 nt, Homo sapiens
cgccaccacugcucuugga

SEQ ID NO: 1160318 - RNA, 19 nt, Homo sapiens
gcagcugcuaugucacuga

SEQ ID NO: 1160319 - RNA, 19 nt, Homo sapiens
cugcucaaguguccuaugg

SEQ ID NO: 1160320 - RNA, 19 nt, Homo sapiens
gcugcugugucccaauuug

SEQ ID NO: 1160321 - RNA, 19 nt, Homo sapiens
gggaggcugugguucuugu

SEQ ID NO: 1160322 - RNA, 19 nt, Homo sapiens
caagggaggcugugguucu

SEQ ID NO: 1160323 - RNA, 19 nt, Homo sapiens
cagugcagcugcuauaagc

SEQ ID NO: 1160324 - RNA, 19 nt, Homo sapiens
gcugcaagcccugcuguuc

SEQ ID NO: 1160325 - RNA, 19 nt, Homo sapiens
gcugcaagcccugcuguuc

SEQ ID NO: 1160326 - RNA, 19 nt, Homo sapiens
aagggaggcugugguucuu

SEQ ID NO: 1160327 - RNA, 19 nt, Homo sapiens
ggaaggaauugucugauga

SEQ ID NO: 1160328 - RNA, 19 nt, Homo sapiens
gaaggaccgugaaccuaua

SEQ ID NO: 1160329 - RNA, 19 nt, Homo sapiens
gaacacaucagccucauga

SEQ ID NO: 1160330 - RNA, 19 nt, Homo sapiens
acacggacuuccuguauua

SEQ ID NO: 1160331 - RNA, 19 nt, Homo sapiens
ggaccuacaccuucuauga

SEQ ID NO: 1160332 - RNA, 19 nt, Homo sapiens
gcugacaccuucauguuug

SEQ ID NO: 1160333 - RNA, 19 nt, Homo sapiens
gaagcccagugaauauauu

SEQ ID NO: 1160334 - RNA, 19 nt, Homo sapiens
ggagaagcccagugaauau

SEQ ID NO: 1160335 - RNA, 19 nt, Homo sapiens
gggaaggaauugucugaug

SEQ ID NO: 1160336 - RNA, 19 nt, Homo sapiens
gaaaugugucuucagcuuu

SEQ ID NO: 1160337 - RNA, 19 nt, Homo sapiens
gaacagugccggcaagaag

SEQ ID NO: 1160338 - RNA, 19 nt, Homo sapiens
ggagcucagugccuuugua

SEQ ID NO: 1160339 - RNA, 19 nt, Homo sapiens
ggaugaagaugggaaggaa

SEQ ID NO: 1160340 - RNA, 19 nt, Homo sapiens
gcacacggacuuccuguau

SEQ ID NO: 1160341 - RNA, 19 nt, Homo sapiens
gcucagugccuuuguagaa

SEQ ID NO: 1160342 - RNA, 19 nt, Homo sapiens
gagaagcccagugaauaua

SEQ ID NO: 1160343 - RNA, 19 nt, Homo sapiens
guccaagacuuuagacuuc

SEQ ID NO: 1160344 - RNA, 19 nt, Homo sapiens
caacaagagugugaacauc

SEQ ID NO: 1160345 - RNA, 19 nt, Homo sapiens
gaagagggcaugaagacau

SEQ ID NO: 1160346 - RNA, 19 nt, Homo sapiens
uugcaaagcacccagaaua

SEQ ID NO: 1160347 - RNA, 19 nt, Homo sapiens
gagcagaagcugacaccuu

SEQ ID NO: 1160348 - RNA, 19 nt, Homo sapiens
gaaaccagcagauucucuu

SEQ ID NO: 1160349 - RNA, 19 nt, Homo sapiens
aaaugugucuucagcuuug

SEQ ID NO: 1160350 - RNA, 19 nt, Homo sapiens
agaaaugugucuucagcuu

SEQ ID NO: 1160351 - RNA, 19 nt, Homo sapiens
caggaaacccgagcugaua

SEQ ID NO: 1160352 - RNA, 19 nt, Homo sapiens
gugcacgacuucacagaug

SEQ ID NO: 1160353 - RNA, 19 nt, Homo sapiens
ccaaggauaugauuuucua

SEQ ID NO: 1160354 - RNA, 19 nt, Homo sapiens
gaaccuauagagauugaau

SEQ ID NO: 1160355 - RNA, 19 nt, Homo sapiens
gcaagaagugcaagagcuu

SEQ ID NO: 1160356 - RNA, 19 nt, Homo sapiens
ggaaacccgagcugauauu

SEQ ID NO: 1160357 - RNA, 19 nt, Homo sapiens
ccacucaggguauugauga

SEQ ID NO: 1160358 - RNA, 19 nt, Homo sapiens
gacaucauccggccuauca

SEQ ID NO: 1160359 - RNA, 19 nt, Homo sapiens
gugaaccuauagagauuga

SEQ ID NO: 1160360 - RNA, 19 nt, Homo sapiens
gcaggaaacccgagcugau

SEQ ID NO: 1160361 - RNA, 19 nt, Homo sapiens
ggacauaagagcagaagcu

SEQ ID NO: 1160362 - RNA, 19 nt, Homo sapiens
aagagggcaugaagacauu

SEQ ID NO: 1160363 - RNA, 19 nt, Homo sapiens
gaacaucaugcacgacaag

SEQ ID NO: 1160364 - RNA, 19 nt, Homo sapiens
guagagucccagaaacaaa

SEQ ID NO: 1160365 - RNA, 19 nt, Homo sapiens
gaaacccgagcugauauug

SEQ ID NO: 1160366 - RNA, 19 nt, Homo sapiens
ccgugaaccuauagagauu

SEQ ID NO: 1160367 - RNA, 19 nt, Homo sapiens
ugaaggaccgugaaccuau

SEQ ID NO: 1160368 - RNA, 19 nt, Homo sapiens
gcacccagaauaccaggaa

SEQ ID NO: 1160369 - RNA, 19 nt, Homo sapiens
aaagagaaaccagcagauu

SEQ ID NO: 1160370 - RNA, 19 nt, Homo sapiens
gcacccaaggauaugauuu

SEQ ID NO: 1160371 - RNA, 19 nt, Homo sapiens
gaugauuuccucaagaaca

SEQ ID NO: 1160372 - RNA, 19 nt, Homo sapiens
aggagaagcccagugaaua

SEQ ID NO: 1160373 - RNA, 19 nt, Homo sapiens
uggacagucugcagaaaug

SEQ ID NO: 1160374 - RNA, 19 nt, Homo sapiens
acaaaacuaugcugacaaa

SEQ ID NO: 1160375 - RNA, 19 nt, Homo sapiens
aauauuaucgggauccauu

SEQ ID NO: 1160376 - RNA, 19 nt, Homo sapiens
cucaggguauugaugauuu

SEQ ID NO: 1160377 - RNA, 19 nt, Homo sapiens
cacacggacuuccuguauu

SEQ ID NO: 1160378 - RNA, 19 nt, Homo sapiens
uauaccaccuugcaaagca

SEQ ID NO: 1160379 - RNA, 19 nt, Homo sapiens
gaagaugggaaggaauugu

SEQ ID NO: 1160380 - RNA, 19 nt, Homo sapiens
ggucaccucuggcuuuuau

SEQ ID NO: 1160381 - RNA, 19 nt, Homo sapiens
cuugaagccuuauaugaag

SEQ ID NO: 1160382 - RNA, 19 nt, Homo sapiens
gcugagugguggugacaag

SEQ ID NO: 1160383 - RNA, 19 nt, Homo sapiens
gaccgugaaccuauagaga

SEQ ID NO: 1160384 - RNA, 19 nt, Homo sapiens
agacuucauugaugugcuu

SEQ ID NO: 1160385 - RNA, 19 nt, Homo sapiens
ucuugaagccuuauaugaa

SEQ ID NO: 1160386 - RNA, 19 nt, Homo sapiens
ccacccacccaccuuugua

SEQ ID NO: 1160387 - RNA, 19 nt, Homo sapiens
caaagcacccagaauacca

SEQ ID NO: 1160388 - RNA, 19 nt, Homo sapiens
gaaggaauugucugaugag

SEQ ID NO: 1160389 - RNA, 19 nt, Homo sapiens
gacuuuagacuucauugau

SEQ ID NO: 1160390 - RNA, 19 nt, Homo sapiens
acaagagugugaacaucau

SEQ ID NO: 1160391 - RNA, 19 nt, Homo sapiens
ccacccaccuuuguagagu

SEQ ID NO: 1160392 - RNA, 19 nt, Homo sapiens
gcgcagaggguggacuuug

SEQ ID NO: 1160393 - RNA, 19 nt, Homo sapiens
uuccugaccaugugcauua

SEQ ID NO: 1160394 - RNA, 19 nt, Homo sapiens
caggagaagcccagugaau

SEQ ID NO: 1160395 - RNA, 19 nt, Homo sapiens
gaagccuuauaugaagauu

SEQ ID NO: 1160396 - RNA, 19 nt, Homo sapiens
ugacgccugccuuccauuu

SEQ ID NO: 1160397 - RNA, 19 nt, Homo sapiens
ggaacagugccggcaagaa

SEQ ID NO: 1160398 - RNA, 19 nt, Homo sapiens
cauuacaacccaacugugu

SEQ ID NO: 1160399 - RNA, 19 nt, Homo sapiens
aagagaaaccagcagauuc

SEQ ID NO: 1160400 - RNA, 19 nt, Homo sapiens
gagcucagugccuuuguag

SEQ ID NO: 1160401 - RNA, 19 nt, Homo sapiens
aaacaaaacuaugcugaca

SEQ ID NO: 1160402 - RNA, 19 nt, Homo sapiens
acuuuagacuucauugaug

SEQ ID NO: 1160403 - RNA, 19 nt, Homo sapiens
ucaagaacaaggcaaaguc

SEQ ID NO: 1160404 - RNA, 19 nt, Homo sapiens
cgccauggcugagaugaag

SEQ ID NO: 1160405 - RNA, 19 nt, Homo sapiens
ugucugccuuaucaauauu

SEQ ID NO: 1160406 - RNA, 19 nt, Homo sapiens
aagcugacaccuucauguu

SEQ ID NO: 1160407 - RNA, 19 nt, Homo sapiens
ggaagagggcaugaagaca

SEQ ID NO: 1160408 - RNA, 19 nt, Homo sapiens
cugcagaaaugugucuuca

SEQ ID NO: 1160409 - RNA, 19 nt, Homo sapiens
ucaacaagagugugaacau

SEQ ID NO: 1160410 - RNA, 19 nt, Homo sapiens
uuaucgggauccauuacaa

SEQ ID NO: 1160411 - RNA, 19 nt, Homo sapiens
ccaagacuuuagacuucau

SEQ ID NO: 1160412 - RNA, 19 nt, Homo sapiens
ucaggguauugaugauuuc

SEQ ID NO: 1160413 - RNA, 19 nt, Homo sapiens
gucaggagaagcccaguga

SEQ ID NO: 1160414 - RNA, 19 nt, Homo sapiens
gauguugcacgcaggacuu

SEQ ID NO: 1160415 - RNA, 19 nt, Homo sapiens
cuuuagacuucauugaugu

SEQ ID NO: 1160416 - RNA, 19 nt, Homo sapiens
cggacuuccuguauuaucu

SEQ ID NO: 1160417 - RNA, 19 nt, Homo sapiens
cucagugccuuuguagaaa

SEQ ID NO: 1160418 - RNA, 19 nt, Homo sapiens
ugaacaucaugcacgacaa

SEQ ID NO: 1160419 - RNA, 19 nt, Homo sapiens
caucuugaagccuuauaug

SEQ ID NO: 1160420 - RNA, 19 nt, Homo sapiens
ugagggccaugacacuaca

SEQ ID NO: 1160421 - RNA, 19 nt, Homo sapiens
gagggcaugaagacauuga

SEQ ID NO: 1160422 - RNA, 19 nt, Homo sapiens
gcugagcaaggaugaagau

SEQ ID NO: 1160423 - RNA, 19 nt, Homo sapiens
augauuuccucaagaacaa

SEQ ID NO: 1160424 - RNA, 19 nt, Homo sapiens
gcugucgcacccaaggaua

SEQ ID NO: 1160425 - RNA, 19 nt, Homo sapiens
uugucugccuuaucaauau

SEQ ID NO: 1160426 - RNA, 19 nt, Homo sapiens
gcaaagcacccagaauacc

SEQ ID NO: 1160427 - RNA, 19 nt, Homo sapiens
gaacuuaucuggacaggaa

SEQ ID NO: 1160428 - RNA, 19 nt, Homo sapiens
ggacggugcugcuggauuu

SEQ ID NO: 1160429 - RNA, 19 nt, Homo sapiens
gggaauuccugcaaguuua

SEQ ID NO: 1160430 - RNA, 19 nt, Homo sapiens
agaagaagcugacuccauu

SEQ ID NO: 1160431 - RNA, 19 nt, Homo sapiens
gcaauggccuggacuacau

SEQ ID NO: 1160432 - RNA, 19 nt, Homo sapiens
ccacuuacccucaaagaaa

SEQ ID NO: 1160433 - RNA, 19 nt, Homo sapiens
guacuacccuaucaauaug

SEQ ID NO: 1160434 - RNA, 19 nt, Homo sapiens
uaugauggcuuccacauuc

SEQ ID NO: 1160435 - RNA, 19 nt, Homo sapiens
ggccacagaugccagcuuu

SEQ ID NO: 1160436 - RNA, 19 nt, Homo sapiens
gggaugccaccgacaauua

SEQ ID NO: 1160437 - RNA, 19 nt, Homo sapiens
ggaaggagaacaaacugaa

SEQ ID NO: 1160438 - RNA, 19 nt, Homo sapiens
ccagcuuuaucaucaaaua

SEQ ID NO: 1160439 - RNA, 19 nt, Homo sapiens
gagaccagauggaguggaa

SEQ ID NO: 1160440 - RNA, 19 nt, Homo sapiens
cagaaagaaugcccuccua

SEQ ID NO: 1160441 - RNA, 19 nt, Homo sapiens
gaaaguguccaaucagauc

SEQ ID NO: 1160442 - RNA, 19 nt, Homo sapiens
gaugaucggugccuucaag

SEQ ID NO: 1160443 - RNA, 19 nt, Homo sapiens
gggacagccucucaucauu

SEQ ID NO: 1160444 - RNA, 19 nt, Homo sapiens
gcagaagcaugaaugacau

SEQ ID NO: 1160445 - RNA, 19 nt, Homo sapiens
ccagguggauaaaguuuga

SEQ ID NO: 1160446 - RNA, 19 nt, Homo sapiens
gaaagaaugcccuccuauc

SEQ ID NO: 1160447 - RNA, 19 nt, Homo sapiens
gcccagagcagaagcauga

SEQ ID NO: 1160448 - RNA, 19 nt, Homo sapiens
gaccagaagggacaucuuu

SEQ ID NO: 1160449 - RNA, 19 nt, Homo sapiens
aagccaaacuucaucacua

SEQ ID NO: 1160450 - RNA, 19 nt, Homo sapiens
gcaaaauccuacaaugaaa

SEQ ID NO: 1160451 - RNA, 19 nt, Homo sapiens
gcuucuggauuucaucuuu

SEQ ID NO: 1160452 - RNA, 19 nt, Homo sapiens
gagaguaaccggcaucauc

SEQ ID NO: 1160453 - RNA, 19 nt, Homo sapiens
gacagcagcauggaucuua

SEQ ID NO: 1160454 - RNA, 19 nt, Homo sapiens
caaacuucaucacuaccua

SEQ ID NO: 1160455 - RNA, 19 nt, Homo sapiens
gaaagcuggaccacacuaa

SEQ ID NO: 1160456 - RNA, 19 nt, Homo sapiens
guccaucucugccauccua

SEQ ID NO: 1160457 - RNA, 19 nt, Homo sapiens
ggagauuuccggaucagaa

SEQ ID NO: 1160458 - RNA, 19 nt, Homo sapiens
caccaacgcuucucuguac

SEQ ID NO: 1160459 - RNA, 19 nt, Homo sapiens
ggacccaaauauccggauu

SEQ ID NO: 1160460 - RNA, 19 nt, Homo sapiens
uuauaaagauucccaugga

SEQ ID NO: 1160461 - RNA, 19 nt, Homo sapiens
ggaggagauuuccggauca

SEQ ID NO: 1160462 - RNA, 19 nt, Homo sapiens
uggauacucugcagcauga

SEQ ID NO: 1160463 - RNA, 19 nt, Homo sapiens
gacaacauccucccagaga

SEQ ID NO: 1160464 - RNA, 19 nt, Homo sapiens
gaauacaaccguguucaau

SEQ ID NO: 1160465 - RNA, 19 nt, Homo sapiens
acaagaagaggaagagaaa

SEQ ID NO: 1160466 - RNA, 19 nt, Homo sapiens
gaccuggccuggauugaca

SEQ ID NO: 1160467 - RNA, 19 nt, Homo sapiens
ggacagccucucaucauuc

SEQ ID NO: 1160468 - RNA, 19 nt, Homo sapiens
ucagugacguggccuacaa

SEQ ID NO: 1160469 - RNA, 19 nt, Homo sapiens
gcaaauuacggacgucugu

SEQ ID NO: 1160470 - RNA, 19 nt, Homo sapiens
gauguucuguggaaucgau

SEQ ID NO: 1160471 - RNA, 19 nt, Homo sapiens
gcucauguccuucauccuu

SEQ ID NO: 1160472 - RNA, 19 nt, Homo sapiens
gacaagaagaggaagagaa

SEQ ID NO: 1160473 - RNA, 19 nt, Homo sapiens
gcugcaagcucuuccugau

SEQ ID NO: 1160474 - RNA, 19 nt, Homo sapiens
cuuaucagcuucaucuuca

SEQ ID NO: 1160475 - RNA, 19 nt, Homo sapiens
ggagucagccagguggaua

SEQ ID NO: 1160476 - RNA, 19 nt, Homo sapiens
gcuaccaucuggaccuguu

SEQ ID NO: 1160477 - RNA, 19 nt, Homo sapiens
ggacuucaagccaaacuuc

SEQ ID NO: 1160478 - RNA, 19 nt, Homo sapiens
ggaauuccugcaaguuuau

SEQ ID NO: 1160479 - RNA, 19 nt, Homo sapiens
ccacagaugccagcuuuau

SEQ ID NO: 1160480 - RNA, 19 nt, Homo sapiens
ggaaagcuggaccacacua

SEQ ID NO: 1160481 - RNA, 19 nt, Homo sapiens
ccuccucccucgguuauaa

SEQ ID NO: 1160482 - RNA, 19 nt, Homo sapiens
agaggaaguugcccugguu

SEQ ID NO: 1160483 - RNA, 19 nt, Homo sapiens
guucuucgguggccugugu

SEQ ID NO: 1160484 - RNA, 19 nt, Homo sapiens
ccacauugggcuuccagua

SEQ ID NO: 1160485 - RNA, 19 nt, Homo sapiens
ggaaaguguccaaucagau

SEQ ID NO: 1160486 - RNA, 19 nt, Homo sapiens
gagcaaaauccuacaauga

SEQ ID NO: 1160487 - RNA, 19 nt, Homo sapiens
gcccauccaccgcuccuua

SEQ ID NO: 1160488 - RNA, 19 nt, Homo sapiens
guggauaaaguuugaagaa

SEQ ID NO: 1160489 - RNA, 19 nt, Homo sapiens
gcuuugugcuccuuuaugg

SEQ ID NO: 1160490 - RNA, 19 nt, Homo sapiens
gguggccugugucuggaua

SEQ ID NO: 1160491 - RNA, 19 nt, Homo sapiens
gacaagaggaaaucugugu

SEQ ID NO: 1160492 - RNA, 19 nt, Homo sapiens
gcucccauccuaaagugua

SEQ ID NO: 1160493 - RNA, 19 nt, Homo sapiens
caaguacuacccuaucaau

SEQ ID NO: 1160494 - RNA, 19 nt, Homo sapiens
gacagccucucaucauucu

SEQ ID NO: 1160495 - RNA, 19 nt, Homo sapiens
caagaggaaaucuguguuc

SEQ ID NO: 1160496 - RNA, 19 nt, Homo sapiens
ugaagaagauccccaagga

SEQ ID NO: 1160497 - RNA, 19 nt, Homo sapiens
ggagaaggcugggguagga

SEQ ID NO: 1160498 - RNA, 19 nt, Homo sapiens
guacggagucuuccucuac

SEQ ID NO: 1160499 - RNA, 19 nt, Homo sapiens
ggaguuccgccucuggauu

SEQ ID NO: 1160500 - RNA, 19 nt, Homo sapiens
uugaugaauuucuggauga

SEQ ID NO: 1160501 - RNA, 19 nt, Homo sapiens
guacccacuuacccucaaa

SEQ ID NO: 1160502 - RNA, 19 nt, Homo sapiens
agacagacaagaagaggaa

SEQ ID NO: 1160503 - RNA, 19 nt, Homo sapiens
ccaugacccugacccugaa

SEQ ID NO: 1160504 - RNA, 19 nt, Homo sapiens
gaucggugccuucaaguac

SEQ ID NO: 1160505 - RNA, 19 nt, Homo sapiens
ggaugccaccgacaauuau

SEQ ID NO: 1160506 - RNA, 19 nt, Homo sapiens
ucacugccgucauugucaa

SEQ ID NO: 1160507 - RNA, 19 nt, Homo sapiens
ggcccauccucaucuuuga

SEQ ID NO: 1160508 - RNA, 19 nt, Homo sapiens
aaacacagaccagcggaaa

SEQ ID NO: 1160509 - RNA, 19 nt, Homo sapiens
ggacaguggcuccuuacca

SEQ ID NO: 1160510 - RNA, 19 nt, Homo sapiens
ucagccagguggauaaagu

SEQ ID NO: 1160511 - RNA, 19 nt, Homo sapiens
cuuccuggcucccauccua

SEQ ID NO: 1160512 - RNA, 19 nt, Homo sapiens
ugacgggaaucucugucuu

SEQ ID NO: 1160513 - RNA, 19 nt, Homo sapiens
gaaggagaacaaacugaag

SEQ ID NO: 1160514 - RNA, 19 nt, Homo sapiens
aguacuacccuaucaauau

SEQ ID NO: 1160515 - RNA, 19 nt, Homo sapiens
ccagaagggacaucuuuca

SEQ ID NO: 1160516 - RNA, 19 nt, Homo sapiens
gaguuccgccucuggauug

SEQ ID NO: 1160517 - RNA, 19 nt, Homo sapiens
gaucgcaggaauugaugaa

SEQ ID NO: 1160518 - RNA, 19 nt, Homo sapiens
ucauugagaagcagauuga

SEQ ID NO: 1160519 - RNA, 19 nt, Homo sapiens
acagaugccagcuuuauca

SEQ ID NO: 1160520 - RNA, 19 nt, Homo sapiens
acaacauccucccagagaa

SEQ ID NO: 1160521 - RNA, 19 nt, Homo sapiens
gaagaagcugacuccauuc

SEQ ID NO: 1160522 - RNA, 19 nt, Homo sapiens
uaaccggcaucaucgucuu

SEQ ID NO: 1160523 - RNA, 19 nt, Homo sapiens
auacaaccguguucaaugc

SEQ ID NO: 1160524 - RNA, 19 nt, Homo sapiens
uugcaacccucaugguaga

SEQ ID NO: 1160525 - RNA, 19 nt, Homo sapiens
gccucaagauggagacaga

SEQ ID NO: 1160526 - RNA, 19 nt, Homo sapiens
aaauauaucacccgcuuca

SEQ ID NO: 1160527 - RNA, 19 nt, Homo sapiens
gaacuuaucuggacaggaa

SEQ ID NO: 1160528 - RNA, 19 nt, Homo sapiens
ggacggugcugcuggauuu

SEQ ID NO: 1160529 - RNA, 19 nt, Homo sapiens
uaagauaaccuuccagaua

SEQ ID NO: 1160530 - RNA, 19 nt, Homo sapiens
gggaauuccugcaaguuua

SEQ ID NO: 1160531 - RNA, 19 nt, Homo sapiens
aagauaaccuuccagauaa

SEQ ID NO: 1160532 - RNA, 19 nt, Homo sapiens
agaagaagcugacuccauu

SEQ ID NO: 1160533 - RNA, 19 nt, Homo sapiens
gcaauggccuggacuacau

SEQ ID NO: 1160534 - RNA, 19 nt, Homo sapiens
ccacuuacccucaaagaaa

SEQ ID NO: 1160535 - RNA, 19 nt, Homo sapiens
guacuacccuaucaauaug

SEQ ID NO: 1160536 - RNA, 19 nt, Homo sapiens
uaugauggcuuccacauuc

SEQ ID NO: 1160537 - RNA, 19 nt, Homo sapiens
ggccacagaugccagcuuu

SEQ ID NO: 1160538 - RNA, 19 nt, Homo sapiens
gggaugccaccgacaauua

SEQ ID NO: 1160539 - RNA, 19 nt, Homo sapiens
ggaaggagaacaaacugaa

SEQ ID NO: 1160540 - RNA, 19 nt, Homo sapiens
ccagcuuuaucaucaaaua

SEQ ID NO: 1160541 - RNA, 19 nt, Homo sapiens
gagaccagauggaguggaa

SEQ ID NO: 1160542 - RNA, 19 nt, Homo sapiens
cagaaagaaugcccuccua

SEQ ID NO: 1160543 - RNA, 19 nt, Homo sapiens
gaaaguguccaaucagauc

SEQ ID NO: 1160544 - RNA, 19 nt, Homo sapiens
gaugaucggugccuucaag

SEQ ID NO: 1160545 - RNA, 19 nt, Homo sapiens
gggacagccucucaucauu

SEQ ID NO: 1160546 - RNA, 19 nt, Homo sapiens
gcagaagcaugaaugacau

SEQ ID NO: 1160547 - RNA, 19 nt, Homo sapiens
ccagguggauaaaguuuga

SEQ ID NO: 1160548 - RNA, 19 nt, Homo sapiens
gaaagaaugcccuccuauc

SEQ ID NO: 1160549 - RNA, 19 nt, Homo sapiens
gcccagagcagaagcauga

SEQ ID NO: 1160550 - RNA, 19 nt, Homo sapiens
gaccagaagggacaucuuu

SEQ ID NO: 1160551 - RNA, 19 nt, Homo sapiens
aagccaaacuucaucacua

SEQ ID NO: 1160552 - RNA, 19 nt, Homo sapiens
gcaaaauccuacaaugaaa

SEQ ID NO: 1160553 - RNA, 19 nt, Homo sapiens
gcuucuggauuucaucuuu

SEQ ID NO: 1160554 - RNA, 19 nt, Homo sapiens
gagaguaaccggcaucauc

SEQ ID NO: 1160555 - RNA, 19 nt, Homo sapiens
gacagcagcauggaucuua

SEQ ID NO: 1160556 - RNA, 19 nt, Homo sapiens
caaacuucaucacuaccua

SEQ ID NO: 1160557 - RNA, 19 nt, Homo sapiens
guccaucucugccauccua

SEQ ID NO: 1160558 - RNA, 19 nt, Homo sapiens
ggagauuuccggaucagaa

SEQ ID NO: 1160559 - RNA, 19 nt, Homo sapiens
gaaagcuggaccacacuaa

SEQ ID NO: 1160560 - RNA, 19 nt, Homo sapiens
caccaacgcuucucuguac

SEQ ID NO: 1160561 - RNA, 19 nt, Homo sapiens
ggacccaaauauccggauu

SEQ ID NO: 1160562 - RNA, 19 nt, Homo sapiens
uuauaaagauucccaugga

SEQ ID NO: 1160563 - RNA, 19 nt, Homo sapiens
uggauacucugcagcauga

SEQ ID NO: 1160564 - RNA, 19 nt, Homo sapiens
ggaggagauuuccggauca

SEQ ID NO: 1160565 - RNA, 19 nt, Homo sapiens
gacaacauccucccagaga

SEQ ID NO: 1160566 - RNA, 19 nt, Homo sapiens
gaauacaaccguguucaau

SEQ ID NO: 1160567 - RNA, 19 nt, Homo sapiens
acaagaagaggaagagaaa

SEQ ID NO: 1160568 - RNA, 19 nt, Homo sapiens
gaccuggccuggauugaca

SEQ ID NO: 1160569 - RNA, 19 nt, Homo sapiens
ggacagccucucaucauuc

SEQ ID NO: 1160570 - RNA, 19 nt, Homo sapiens
ucagugacguggccuacaa

SEQ ID NO: 1160571 - RNA, 19 nt, Homo sapiens
gcaaauuacggacgucugu

SEQ ID NO: 1160572 - RNA, 19 nt, Homo sapiens
gagcuaagaacacaaaguc

SEQ ID NO: 1160573 - RNA, 19 nt, Homo sapiens
ggacaugguucagaaacag

SEQ ID NO: 1160574 - RNA, 19 nt, Homo sapiens
gauguucuguggaaucgau

SEQ ID NO: 1160575 - RNA, 19 nt, Homo sapiens
gcucauguccuucauccuu

SEQ ID NO: 1160576 - RNA, 19 nt, Homo sapiens
gacaagaagaggaagagaa

SEQ ID NO: 1160577 - RNA, 19 nt, Homo sapiens
gcugcaagcucuuccugau

SEQ ID NO: 1160578 - RNA, 19 nt, Homo sapiens
cuuaucagcuucaucuuca

SEQ ID NO: 1160579 - RNA, 19 nt, Homo sapiens
aagaguugcugcuaccaaa

SEQ ID NO: 1160580 - RNA, 19 nt, Homo sapiens
ggagucagccagguggaua

SEQ ID NO: 1160581 - RNA, 19 nt, Homo sapiens
gcuaccaucuggaccuguu

SEQ ID NO: 1160582 - RNA, 19 nt, Homo sapiens
cucaugagcugauggaugu

SEQ ID NO: 1160583 - RNA, 19 nt, Homo sapiens
ggacuucaagccaaacuuc

SEQ ID NO: 1160584 - RNA, 19 nt, Homo sapiens
ggaauuccugcaaguuuau

SEQ ID NO: 1160585 - RNA, 19 nt, Homo sapiens
ccacagaugccagcuuuau

SEQ ID NO: 1160586 - RNA, 19 nt, Homo sapiens
ggaaagcuggaccacacua

SEQ ID NO: 1160587 - RNA, 19 nt, Homo sapiens
ccuccucccucgguuauaa

SEQ ID NO: 1160588 - RNA, 19 nt, Homo sapiens
agaggaaguugcccugguu

SEQ ID NO: 1160589 - RNA, 19 nt, Homo sapiens
guucuucgguggccugugu

SEQ ID NO: 1160590 - RNA, 19 nt, Homo sapiens
ccacauugggcuuccagua

SEQ ID NO: 1160591 - RNA, 19 nt, Homo sapiens
ggaaaguguccaaucagau

SEQ ID NO: 1160592 - RNA, 19 nt, Homo sapiens
gagcaaaauccuacaauga

SEQ ID NO: 1160593 - RNA, 19 nt, Homo sapiens
gcccauccaccgcuccuua

SEQ ID NO: 1160594 - RNA, 19 nt, Homo sapiens
guggauaaaguuugaagaa

SEQ ID NO: 1160595 - RNA, 19 nt, Homo sapiens
gcuuugugcuccuuuaugg

SEQ ID NO: 1160596 - RNA, 19 nt, Homo sapiens
gguggccugugucuggaua

SEQ ID NO: 1160597 - RNA, 19 nt, Homo sapiens
gacaagaggaaaucugugu

SEQ ID NO: 1160598 - RNA, 19 nt, Homo sapiens
gcucccauccuaaagugua

SEQ ID NO: 1160599 - RNA, 19 nt, Homo sapiens
caaguacuacccuaucaau

SEQ ID NO: 1160600 - RNA, 19 nt, Homo sapiens
gacagccucucaucauucu

SEQ ID NO: 1160601 - RNA, 19 nt, Homo sapiens
caagaggaaaucuguguuc

SEQ ID NO: 1160602 - RNA, 19 nt, Homo sapiens
gcugacaccaucacaguau

SEQ ID NO: 1160603 - RNA, 19 nt, Homo sapiens
ugaagaagauccccaagga

SEQ ID NO: 1160604 - RNA, 19 nt, Homo sapiens
agauaaccuuccagauaaa

SEQ ID NO: 1160605 - RNA, 19 nt, Homo sapiens
ggagaaggcugggguagga

SEQ ID NO: 1160606 - RNA, 19 nt, Homo sapiens
acaaagucaugaaggugaa

SEQ ID NO: 1160607 - RNA, 19 nt, Homo sapiens
guacggagucuuccucuac

SEQ ID NO: 1160608 - RNA, 19 nt, Homo sapiens
ggaguuccgccucuggauu

SEQ ID NO: 1160609 - RNA, 19 nt, Homo sapiens
uugaugaauuucuggauga

SEQ ID NO: 1160610 - RNA, 19 nt, Homo sapiens
guacccacuuacccucaaa

SEQ ID NO: 1160611 - RNA, 19 nt, Homo sapiens
ccagagcuaagaacacaaa

SEQ ID NO: 1160612 - RNA, 19 nt, Homo sapiens
agacagacaagaagaggaa

SEQ ID NO: 1160613 - RNA, 19 nt, Homo sapiens
ccaugacccugacccugaa

SEQ ID NO: 1160614 - RNA, 19 nt, Homo sapiens
cagcuaaagcagacaagaa

SEQ ID NO: 1160615 - RNA, 19 nt, Homo sapiens
gaucggugccuucaaguac

SEQ ID NO: 1160616 - RNA, 19 nt, Homo sapiens
ggaugccaccgacaauuau

SEQ ID NO: 1160617 - RNA, 19 nt, Homo sapiens
caggugggaguguaagaua

SEQ ID NO: 1160618 - RNA, 19 nt, Homo sapiens
ucacugccgucauugucaa

SEQ ID NO: 1160619 - RNA, 19 nt, Homo sapiens
ggcccauccucaucuuuga

SEQ ID NO: 1160620 - RNA, 19 nt, Homo sapiens
aaacacagaccagcggaaa

SEQ ID NO: 1160621 - RNA, 19 nt, Homo sapiens
ggacaguggcuccuuacca

SEQ ID NO: 1160622 - RNA, 19 nt, Homo sapiens
ucagccagguggauaaagu

SEQ ID NO: 1160623 - RNA, 19 nt, Homo sapiens
gcuaagaacacaaagucau

SEQ ID NO: 1160624 - RNA, 19 nt, Homo sapiens
cuuccuggcucccauccua

SEQ ID NO: 1160625 - RNA, 19 nt, Homo sapiens
ugacgggaaucucugucuu

SEQ ID NO: 1160626 - RNA, 19 nt, Homo sapiens
gaaggagaacaaacugaag

SEQ ID NO: 1160627 - RNA, 19 nt, Homo sapiens
gaacuuaucuggacaggaa

SEQ ID NO: 1160628 - RNA, 19 nt, Homo sapiens
ggacggugcugcuggauuu

SEQ ID NO: 1160629 - RNA, 19 nt, Homo sapiens
uaagauaaccuuccagaua

SEQ ID NO: 1160630 - RNA, 19 nt, Homo sapiens
gggaauuccugcaaguuua

SEQ ID NO: 1160631 - RNA, 19 nt, Homo sapiens
aagauaaccuuccagauaa

SEQ ID NO: 1160632 - RNA, 19 nt, Homo sapiens
gcaauggccuggacuacau

SEQ ID NO: 1160633 - RNA, 19 nt, Homo sapiens
ccacuuacccucaaagaaa

SEQ ID NO: 1160634 - RNA, 19 nt, Homo sapiens
guacuacccuaucaauaug

SEQ ID NO: 1160635 - RNA, 19 nt, Homo sapiens
uaugauggcuuccacauuc

SEQ ID NO: 1160636 - RNA, 19 nt, Homo sapiens
ggccacagaugccagcuuu

SEQ ID NO: 1160637 - RNA, 19 nt, Homo sapiens
gggaugccaccgacaauua

SEQ ID NO: 1160638 - RNA, 19 nt, Homo sapiens
ggaaggagaacaaacugaa

SEQ ID NO: 1160639 - RNA, 19 nt, Homo sapiens
ccagcuuuaucaucaaaua

SEQ ID NO: 1160640 - RNA, 19 nt, Homo sapiens
gagaccagauggaguggaa

SEQ ID NO: 1160641 - RNA, 19 nt, Homo sapiens
cagaaagaaugcccuccua

SEQ ID NO: 1160642 - RNA, 19 nt, Homo sapiens
gaaaguguccaaucagauc

SEQ ID NO: 1160643 - RNA, 19 nt, Homo sapiens
gaugaucggugccuucaag

SEQ ID NO: 1160644 - RNA, 19 nt, Homo sapiens
gggacagccucucaucauu

SEQ ID NO: 1160645 - RNA, 19 nt, Homo sapiens
gcagaagcaugaaugacau

SEQ ID NO: 1160646 - RNA, 19 nt, Homo sapiens
ccagguggauaaaguuuga

SEQ ID NO: 1160647 - RNA, 19 nt, Homo sapiens
gaaagaaugcccuccuauc

SEQ ID NO: 1160648 - RNA, 19 nt, Homo sapiens
gcccagagcagaagcauga

SEQ ID NO: 1160649 - RNA, 19 nt, Homo sapiens
gaccagaagggacaucuuu

SEQ ID NO: 1160650 - RNA, 19 nt, Homo sapiens
aagccaaacuucaucacua

SEQ ID NO: 1160651 - RNA, 19 nt, Homo sapiens
gcaaaauccuacaaugaaa

SEQ ID NO: 1160652 - RNA, 19 nt, Homo sapiens
gcuucuggauuucaucuuu

SEQ ID NO: 1160653 - RNA, 19 nt, Homo sapiens
gagaguaaccggcaucauc

SEQ ID NO: 1160654 - RNA, 19 nt, Homo sapiens
gacagcagcauggaucuua

SEQ ID NO: 1160655 - RNA, 19 nt, Homo sapiens
caaacuucaucacuaccua

SEQ ID NO: 1160656 - RNA, 19 nt, Homo sapiens
guccaucucugccauccua

SEQ ID NO: 1160657 - RNA, 19 nt, Homo sapiens
ggagauuuccggaucagaa

SEQ ID NO: 1160658 - RNA, 19 nt, Homo sapiens
gaaagcuggaccacacuaa

SEQ ID NO: 1160659 - RNA, 19 nt, Homo sapiens
caccaacgcuucucuguac

SEQ ID NO: 1160660 - RNA, 19 nt, Homo sapiens
ggacccaaauauccggauu

SEQ ID NO: 1160661 - RNA, 19 nt, Homo sapiens
uuauaaagauucccaugga

SEQ ID NO: 1160662 - RNA, 19 nt, Homo sapiens
uggauacucugcagcauga

SEQ ID NO: 1160663 - RNA, 19 nt, Homo sapiens
ggaggagauuuccggauca

SEQ ID NO: 1160664 - RNA, 19 nt, Homo sapiens
gacaacauccucccagaga

SEQ ID NO: 1160665 - RNA, 19 nt, Homo sapiens
gaauacaaccguguucaau

SEQ ID NO: 1160666 - RNA, 19 nt, Homo sapiens
acaagaagaggaagagaaa

SEQ ID NO: 1160667 - RNA, 19 nt, Homo sapiens
gaccuggccuggauugaca

SEQ ID NO: 1160668 - RNA, 19 nt, Homo sapiens
ggacagccucucaucauuc

SEQ ID NO: 1160669 - RNA, 19 nt, Homo sapiens
ucagugacguggccuacaa

SEQ ID NO: 1160670 - RNA, 19 nt, Homo sapiens
gcaaauuacggacgucugu

SEQ ID NO: 1160671 - RNA, 19 nt, Homo sapiens
gagcuaagaacacaaaguc

SEQ ID NO: 1160672 - RNA, 19 nt, Homo sapiens
ggacaugguucagaaacag

SEQ ID NO: 1160673 - RNA, 19 nt, Homo sapiens
gauguucuguggaaucgau

SEQ ID NO: 1160674 - RNA, 19 nt, Homo sapiens
gcucauguccuucauccuu

SEQ ID NO: 1160675 - RNA, 19 nt, Homo sapiens
gacaagaagaggaagagaa

SEQ ID NO: 1160676 - RNA, 19 nt, Homo sapiens
gcugcaagcucuuccugau

SEQ ID NO: 1160677 - RNA, 19 nt, Homo sapiens
cuuaucagcuucaucuuca

SEQ ID NO: 1160678 - RNA, 19 nt, Homo sapiens
ggagucagccagguggaua

SEQ ID NO: 1160679 - RNA, 19 nt, Homo sapiens
aagaguugcugcuaccaaa

SEQ ID NO: 1160680 - RNA, 19 nt, Homo sapiens
gcuaccaucuggaccuguu

SEQ ID NO: 1160681 - RNA, 19 nt, Homo sapiens
cucaugagcugauggaugu

SEQ ID NO: 1160682 - RNA, 19 nt, Homo sapiens
ggacuucaagccaaacuuc

SEQ ID NO: 1160683 - RNA, 19 nt, Homo sapiens
ggaauuccugcaaguuuau

SEQ ID NO: 1160684 - RNA, 19 nt, Homo sapiens
ccacagaugccagcuuuau

SEQ ID NO: 1160685 - RNA, 19 nt, Homo sapiens
ggaaagcuggaccacacua

SEQ ID NO: 1160686 - RNA, 19 nt, Homo sapiens
ccuccucccucgguuauaa

SEQ ID NO: 1160687 - RNA, 19 nt, Homo sapiens
agaggaaguugcccugguu

SEQ ID NO: 1160688 - RNA, 19 nt, Homo sapiens
guucuucgguggccugugu

SEQ ID NO: 1160689 - RNA, 19 nt, Homo sapiens
ccacauugggcuuccagua

SEQ ID NO: 1160690 - RNA, 19 nt, Homo sapiens
ggaaaguguccaaucagau

SEQ ID NO: 1160691 - RNA, 19 nt, Homo sapiens
gagcaaaauccuacaauga

SEQ ID NO: 1160692 - RNA, 19 nt, Homo sapiens
gcccauccaccgcuccuua

SEQ ID NO: 1160693 - RNA, 19 nt, Homo sapiens
guggauaaaguuugaagaa

SEQ ID NO: 1160694 - RNA, 19 nt, Homo sapiens
gcuuugugcuccuuuaugg

SEQ ID NO: 1160695 - RNA, 19 nt, Homo sapiens
gguggccugugucuggaua

SEQ ID NO: 1160696 - RNA, 19 nt, Homo sapiens
gacaagaggaaaucugugu

SEQ ID NO: 1160697 - RNA, 19 nt, Homo sapiens
gcucccauccuaaagugua

SEQ ID NO: 1160698 - RNA, 19 nt, Homo sapiens
caaguacuacccuaucaau

SEQ ID NO: 1160699 - RNA, 19 nt, Homo sapiens
gacagccucucaucauucu

SEQ ID NO: 1160700 - RNA, 19 nt, Homo sapiens
caagaggaaaucuguguuc

SEQ ID NO: 1160701 - RNA, 19 nt, Homo sapiens
ugaagaagauccccaagga

SEQ ID NO: 1160702 - RNA, 19 nt, Homo sapiens
gcugacaccaucacaguau

SEQ ID NO: 1160703 - RNA, 19 nt, Homo sapiens
agauaaccuuccagauaaa

SEQ ID NO: 1160704 - RNA, 19 nt, Homo sapiens
ggagaaggcugggguagga

SEQ ID NO: 1160705 - RNA, 19 nt, Homo sapiens
acaaagucaugaaggugaa

SEQ ID NO: 1160706 - RNA, 19 nt, Homo sapiens
guacggagucuuccucuac

SEQ ID NO: 1160707 - RNA, 19 nt, Homo sapiens
ggaguuccgccucuggauu

SEQ ID NO: 1160708 - RNA, 19 nt, Homo sapiens
uugaugaauuucuggauga

SEQ ID NO: 1160709 - RNA, 19 nt, Homo sapiens
guacccacuuacccucaaa

SEQ ID NO: 1160710 - RNA, 19 nt, Homo sapiens
ccagagcuaagaacacaaa

SEQ ID NO: 1160711 - RNA, 19 nt, Homo sapiens
agacagacaagaagaggaa

SEQ ID NO: 1160712 - RNA, 19 nt, Homo sapiens
ccaugacccugacccugaa

SEQ ID NO: 1160713 - RNA, 19 nt, Homo sapiens
gaucggugccuucaaguac

SEQ ID NO: 1160714 - RNA, 19 nt, Homo sapiens
caggugggaguguaagaua

SEQ ID NO: 1160715 - RNA, 19 nt, Homo sapiens
cagcuaaagcagacaagaa

SEQ ID NO: 1160716 - RNA, 19 nt, Homo sapiens
ggaugccaccgacaauuau

SEQ ID NO: 1160717 - RNA, 19 nt, Homo sapiens
ucacugccgucauugucaa

SEQ ID NO: 1160718 - RNA, 19 nt, Homo sapiens
ggcccauccucaucuuuga

SEQ ID NO: 1160719 - RNA, 19 nt, Homo sapiens
aaacacagaccagcggaaa

SEQ ID NO: 1160720 - RNA, 19 nt, Homo sapiens
ggacaguggcuccuuacca

SEQ ID NO: 1160721 - RNA, 19 nt, Homo sapiens
ucagccagguggauaaagu

SEQ ID NO: 1160722 - RNA, 19 nt, Homo sapiens
gcuaagaacacaaagucau

SEQ ID NO: 1160723 - RNA, 19 nt, Homo sapiens
ugaauggcauccaguucug

SEQ ID NO: 1160724 - RNA, 19 nt, Homo sapiens
cuuccuggcucccauccua

SEQ ID NO: 1160725 - RNA, 19 nt, Homo sapiens
ugacgggaaucucugucuu

SEQ ID NO: 1160726 - RNA, 19 nt, Homo sapiens
gaaggagaacaaacugaag

SEQ ID NO: 1160727 - RNA, 19 nt, Homo sapiens
gaacuuaucuggacaggaa

SEQ ID NO: 1160728 - RNA, 19 nt, Homo sapiens
ggacggugcugcuggauuu

SEQ ID NO: 1160729 - RNA, 19 nt, Homo sapiens
uaagauaaccuuccagaua

SEQ ID NO: 1160730 - RNA, 19 nt, Homo sapiens
gggaauuccugcaaguuua

SEQ ID NO: 1160731 - RNA, 19 nt, Homo sapiens
aagauaaccuuccagauaa

SEQ ID NO: 1160732 - RNA, 19 nt, Homo sapiens
gcaauggccuggacuacau

SEQ ID NO: 1160733 - RNA, 19 nt, Homo sapiens
ccacuuacccucaaagaaa

SEQ ID NO: 1160734 - RNA, 19 nt, Homo sapiens
guacuacccuaucaauaug

SEQ ID NO: 1160735 - RNA, 19 nt, Homo sapiens
uaugauggcuuccacauuc

SEQ ID NO: 1160736 - RNA, 19 nt, Homo sapiens
ggccacagaugccagcuuu

SEQ ID NO: 1160737 - RNA, 19 nt, Homo sapiens
gggaugccaccgacaauua

SEQ ID NO: 1160738 - RNA, 19 nt, Homo sapiens
ggaaggagaacaaacugaa

SEQ ID NO: 1160739 - RNA, 19 nt, Homo sapiens
ccagcuuuaucaucaaaua

SEQ ID NO: 1160740 - RNA, 19 nt, Homo sapiens
gagaccagauggaguggaa

SEQ ID NO: 1160741 - RNA, 19 nt, Homo sapiens
cagaaagaaugcccuccua

SEQ ID NO: 1160742 - RNA, 19 nt, Homo sapiens
gaaaguguccaaucagauc

SEQ ID NO: 1160743 - RNA, 19 nt, Homo sapiens
gaugaucggugccuucaag

SEQ ID NO: 1160744 - RNA, 19 nt, Homo sapiens
gggacagccucucaucauu

SEQ ID NO: 1160745 - RNA, 19 nt, Homo sapiens
gcagaagcaugaaugacau

SEQ ID NO: 1160746 - RNA, 19 nt, Homo sapiens
ccagguggauaaaguuuga

SEQ ID NO: 1160747 - RNA, 19 nt, Homo sapiens
gaaagaaugcccuccuauc

SEQ ID NO: 1160748 - RNA, 19 nt, Homo sapiens
gcccagagcagaagcauga

SEQ ID NO: 1160749 - RNA, 19 nt, Homo sapiens
gaccagaagggacaucuuu

SEQ ID NO: 1160750 - RNA, 19 nt, Homo sapiens
aagccaaacuucaucacua

SEQ ID NO: 1160751 - RNA, 19 nt, Homo sapiens
gcaaaauccuacaaugaaa

SEQ ID NO: 1160752 - RNA, 19 nt, Homo sapiens
gcuucuggauuucaucuuu

SEQ ID NO: 1160753 - RNA, 19 nt, Homo sapiens
gagaguaaccggcaucauc

SEQ ID NO: 1160754 - RNA, 19 nt, Homo sapiens
gacagcagcauggaucuua

SEQ ID NO: 1160755 - RNA, 19 nt, Homo sapiens
caaacuucaucacuaccua

SEQ ID NO: 1160756 - RNA, 19 nt, Homo sapiens
guccaucucugccauccua

SEQ ID NO: 1160757 - RNA, 19 nt, Homo sapiens
ggagauuuccggaucagaa

SEQ ID NO: 1160758 - RNA, 19 nt, Homo sapiens
gaaagcuggaccacacuaa

SEQ ID NO: 1160759 - RNA, 19 nt, Homo sapiens
caccaacgcuucucuguac

SEQ ID NO: 1160760 - RNA, 19 nt, Homo sapiens
ggacccaaauauccggauu

SEQ ID NO: 1160761 - RNA, 19 nt, Homo sapiens
uuauaaagauucccaugga

SEQ ID NO: 1160762 - RNA, 19 nt, Homo sapiens
uggauacucugcagcauga

SEQ ID NO: 1160763 - RNA, 19 nt, Homo sapiens
ggaggagauuuccggauca

SEQ ID NO: 1160764 - RNA, 19 nt, Homo sapiens
gacaacauccucccagaga

SEQ ID NO: 1160765 - RNA, 19 nt, Homo sapiens
gaauacaaccguguucaau

SEQ ID NO: 1160766 - RNA, 19 nt, Homo sapiens
acaagaagaggaagagaaa

SEQ ID NO: 1160767 - RNA, 19 nt, Homo sapiens
gaccuggccuggauugaca

SEQ ID NO: 1160768 - RNA, 19 nt, Homo sapiens
ggacagccucucaucauuc

SEQ ID NO: 1160769 - RNA, 19 nt, Homo sapiens
ucagugacguggccuacaa

SEQ ID NO: 1160770 - RNA, 19 nt, Homo sapiens
gcaaauuacggacgucugu

SEQ ID NO: 1160771 - RNA, 19 nt, Homo sapiens
gagcuaagaacacaaaguc

SEQ ID NO: 1160772 - RNA, 19 nt, Homo sapiens
ggacaugguucagaaacag

SEQ ID NO: 1160773 - RNA, 19 nt, Homo sapiens
gauguucuguggaaucgau

SEQ ID NO: 1160774 - RNA, 19 nt, Homo sapiens
gcucauguccuucauccuu

SEQ ID NO: 1160775 - RNA, 19 nt, Homo sapiens
gacaagaagaggaagagaa

SEQ ID NO: 1160776 - RNA, 19 nt, Homo sapiens
cuuaucagcuucaucuuca

SEQ ID NO: 1160777 - RNA, 19 nt, Homo sapiens
ggagucagccagguggaua

SEQ ID NO: 1160778 - RNA, 19 nt, Homo sapiens
aagaguugcugcuaccaaa

SEQ ID NO: 1160779 - RNA, 19 nt, Homo sapiens
gcuaccaucuggaccuguu

SEQ ID NO: 1160780 - RNA, 19 nt, Homo sapiens
cucaugagcugauggaugu

SEQ ID NO: 1160781 - RNA, 19 nt, Homo sapiens
ggacuucaagccaaacuuc

SEQ ID NO: 1160782 - RNA, 19 nt, Homo sapiens
ggaauuccugcaaguuuau

SEQ ID NO: 1160783 - RNA, 19 nt, Homo sapiens
ccacagaugccagcuuuau

SEQ ID NO: 1160784 - RNA, 19 nt, Homo sapiens
ggaaagcuggaccacacua

SEQ ID NO: 1160785 - RNA, 19 nt, Homo sapiens
ccuccucccucgguuauaa

SEQ ID NO: 1160786 - RNA, 19 nt, Homo sapiens
agaggaaguugcccugguu

SEQ ID NO: 1160787 - RNA, 19 nt, Homo sapiens
guucuucgguggccugugu

SEQ ID NO: 1160788 - RNA, 19 nt, Homo sapiens
ccacauugggcuuccagua

SEQ ID NO: 1160789 - RNA, 19 nt, Homo sapiens
ggaaaguguccaaucagau

SEQ ID NO: 1160790 - RNA, 19 nt, Homo sapiens
gagcaaaauccuacaauga

SEQ ID NO: 1160791 - RNA, 19 nt, Homo sapiens
gcccauccaccgcuccuua

SEQ ID NO: 1160792 - RNA, 19 nt, Homo sapiens
guggauaaaguuugaagaa

SEQ ID NO: 1160793 - RNA, 19 nt, Homo sapiens
gcuuugugcuccuuuaugg

SEQ ID NO: 1160794 - RNA, 19 nt, Homo sapiens
gguggccugugucuggaua

SEQ ID NO: 1160795 - RNA, 19 nt, Homo sapiens
gacaagaggaaaucugugu

SEQ ID NO: 1160796 - RNA, 19 nt, Homo sapiens
caaguacuacccuaucaau

SEQ ID NO: 1160797 - RNA, 19 nt, Homo sapiens
gacagccucucaucauucu

SEQ ID NO: 1160798 - RNA, 19 nt, Homo sapiens
caagaggaaaucuguguuc

SEQ ID NO: 1160799 - RNA, 19 nt, Homo sapiens
ugaagaagauccccaagga

SEQ ID NO: 1160800 - RNA, 19 nt, Homo sapiens
gcugacaccaucacaguau

SEQ ID NO: 1160801 - RNA, 19 nt, Homo sapiens
agauaaccuuccagauaaa

SEQ ID NO: 1160802 - RNA, 19 nt, Homo sapiens
ggagaaggcugggguagga

SEQ ID NO: 1160803 - RNA, 19 nt, Homo sapiens
acaaagucaugaaggugaa

SEQ ID NO: 1160804 - RNA, 19 nt, Homo sapiens
ggaguuccgccucuggauu

SEQ ID NO: 1160805 - RNA, 19 nt, Homo sapiens
uugaugaauuucuggauga

SEQ ID NO: 1160806 - RNA, 19 nt, Homo sapiens
guacccacuuacccucaaa

SEQ ID NO: 1160807 - RNA, 19 nt, Homo sapiens
ccagagcuaagaacacaaa

SEQ ID NO: 1160808 - RNA, 19 nt, Homo sapiens
agacagacaagaagaggaa

SEQ ID NO: 1160809 - RNA, 19 nt, Homo sapiens
ccaugacccugacccugaa

SEQ ID NO: 1160810 - RNA, 19 nt, Homo sapiens
gaucggugccuucaaguac

SEQ ID NO: 1160811 - RNA, 19 nt, Homo sapiens
caggugggaguguaagaua

SEQ ID NO: 1160812 - RNA, 19 nt, Homo sapiens
ggaugccaccgacaauuau

SEQ ID NO: 1160813 - RNA, 19 nt, Homo sapiens
cagcuaaagcagacaagaa

SEQ ID NO: 1160814 - RNA, 19 nt, Homo sapiens
ucacugccgucauugucaa

SEQ ID NO: 1160815 - RNA, 19 nt, Homo sapiens
ggcccauccucaucuuuga

SEQ ID NO: 1160816 - RNA, 19 nt, Homo sapiens
aaacacagaccagcggaaa

SEQ ID NO: 1160817 - RNA, 19 nt, Homo sapiens
ggacaguggcuccuuacca

SEQ ID NO: 1160818 - RNA, 19 nt, Homo sapiens
ucagccagguggauaaagu

SEQ ID NO: 1160819 - RNA, 19 nt, Homo sapiens
gcuaagaacacaaagucau

SEQ ID NO: 1160820 - RNA, 19 nt, Homo sapiens
cuuccuggcucccauccua

SEQ ID NO: 1160821 - RNA, 19 nt, Homo sapiens
ugacgggaaucucugucuu

SEQ ID NO: 1160822 - RNA, 19 nt, Homo sapiens
gaaggagaacaaacugaag

SEQ ID NO: 1160823 - RNA, 19 nt, Homo sapiens
aguacuacccuaucaauau

SEQ ID NO: 1160824 - RNA, 19 nt, Homo sapiens
gaguuccgccucuggauug

SEQ ID NO: 1160825 - RNA, 19 nt, Homo sapiens
gaucgcaggaauugaugaa

SEQ ID NO: 1160826 - RNA, 19 nt, Homo sapiens
ucauugagaagcagauuga

SEQ ID NO: 1160827 - RNA, 19 nt, Homo sapiens
gaacauaacaggaagguau

SEQ ID NO: 1160828 - RNA, 19 nt, Homo sapiens
gaugucaauucucuuguua

SEQ ID NO: 1160829 - RNA, 19 nt, Homo sapiens
gaaccagaaugaaucuuug

SEQ ID NO: 1160830 - RNA, 19 nt, Homo sapiens
ccaaggagauuuaacugaa

SEQ ID NO: 1160831 - RNA, 19 nt, Homo sapiens
gaaucaauguuaucagaug

SEQ ID NO: 1160832 - RNA, 19 nt, Homo sapiens
gugcacaacuggcaaagaa

SEQ ID NO: 1160833 - RNA, 19 nt, Homo sapiens
gacgagagcucagacugua

SEQ ID NO: 1160834 - RNA, 19 nt, Homo sapiens
gcaaucauaugaaguuucu

SEQ ID NO: 1160835 - RNA, 19 nt, Homo sapiens
caacagaaccagaaugaau

SEQ ID NO: 1160836 - RNA, 19 nt, Homo sapiens
gaagcugaaucaauguuau

SEQ ID NO: 1160837 - RNA, 19 nt, Homo sapiens
gagagaagcccuuuaugug

SEQ ID NO: 1160838 - RNA, 19 nt, Homo sapiens
ggagagaagcccuuuaugu

SEQ ID NO: 1160839 - RNA, 19 nt, Homo sapiens
ggagugaugucaauucucu

SEQ ID NO: 1160840 - RNA, 19 nt, Homo sapiens
gcaaacugcugagccacua

SEQ ID NO: 1160841 - RNA, 19 nt, Homo sapiens
ggaaugugcauaugagaaa

SEQ ID NO: 1160842 - RNA, 19 nt, Homo sapiens
uaucauuggcucugaauua

SEQ ID NO: 1160843 - RNA, 19 nt, Homo sapiens
caaggagauuuaacugaaa

SEQ ID NO: 1160844 - RNA, 19 nt, Homo sapiens
ugucuuaacugcaguaaau

SEQ ID NO: 1160845 - RNA, 19 nt, Homo sapiens
gaaaacaucuggugguuca

SEQ ID NO: 1160846 - RNA, 19 nt, Homo sapiens
gacaaggaaugaagcaaug

SEQ ID NO: 1160847 - RNA, 19 nt, Homo sapiens
gaacuggaagguuacauug

SEQ ID NO: 1160848 - RNA, 19 nt, Homo sapiens
gaucuacagccaagugaua

SEQ ID NO: 1160849 - RNA, 19 nt, Homo sapiens
gagcaacucuaucugaucu

SEQ ID NO: 1160850 - RNA, 19 nt, Homo sapiens
ggccagcucacuuuaaaua

SEQ ID NO: 1160851 - RNA, 19 nt, Homo sapiens
ggaagcugaaucaauguua

SEQ ID NO: 1160852 - RNA, 19 nt, Homo sapiens
gcaguaguuugcuugaaga

SEQ ID NO: 1160853 - RNA, 19 nt, Homo sapiens
gaaaagaagcucaagugua

SEQ ID NO: 1160854 - RNA, 19 nt, Homo sapiens
ucccggaacuggaagguua

SEQ ID NO: 1160855 - RNA, 19 nt, Homo sapiens
gaugaaauaauuccugcua

SEQ ID NO: 1160856 - RNA, 19 nt, Homo sapiens
gcaggaaugugcauaugag

SEQ ID NO: 1160857 - RNA, 19 nt, Homo sapiens
ccucaagacucaucgaaau

SEQ ID NO: 1160858 - RNA, 19 nt, Homo sapiens
guuaucagaugaguuagaa

SEQ ID NO: 1160859 - RNA, 19 nt, Homo sapiens
ggaaugaagcaaugacugu

SEQ ID NO: 1160860 - RNA, 19 nt, Homo sapiens
gcacaagacucugcuuuug

SEQ ID NO: 1160861 - RNA, 19 nt, Homo sapiens
gcacaacuggcaaagaaug

SEQ ID NO: 1160862 - RNA, 19 nt, Homo sapiens
gagcucagacuguacagaa

SEQ ID NO: 1160863 - RNA, 19 nt, Homo sapiens
gggaagagcauaguauuuc

SEQ ID NO: 1160864 - RNA, 19 nt, Homo sapiens
cauaugaaguuucugucuu

SEQ ID NO: 1160865 - RNA, 19 nt, Homo sapiens
gagcauaguauuuccuaga

SEQ ID NO: 1160866 - RNA, 19 nt, Homo sapiens
ggaacuggaagguuacauu

SEQ ID NO: 1160867 - RNA, 19 nt, Homo sapiens
uaacaggaagguaucauug

SEQ ID NO: 1160868 - RNA, 19 nt, Homo sapiens
gcaaauuucugggauagac

SEQ ID NO: 1160869 - RNA, 19 nt, Homo sapiens
gaaucagaagcuaaagaua

SEQ ID NO: 1160870 - RNA, 19 nt, Homo sapiens
cauuggcucugaauuaaau

SEQ ID NO: 1160871 - RNA, 19 nt, Homo sapiens
gcaacucuaucugaucuca

SEQ ID NO: 1160872 - RNA, 19 nt, Homo sapiens
ggagagaagccucaucagu

SEQ ID NO: 1160873 - RNA, 19 nt, Homo sapiens
gagcacagacaguagcauu

SEQ ID NO: 1160874 - RNA, 19 nt, Homo sapiens
uaggagagcuucuuuucua

SEQ ID NO: 1160875 - RNA, 19 nt, Homo sapiens
gaggcaaucauaugaaguu

SEQ ID NO: 1160876 - RNA, 19 nt, Homo sapiens
gaaccuaccaaauaccaau

SEQ ID NO: 1160877 - RNA, 19 nt, Homo sapiens
gaagcaggaaugugcauau

SEQ ID NO: 1160878 - RNA, 19 nt, Homo sapiens
ggauguggccguuccuuug

SEQ ID NO: 1160879 - RNA, 19 nt, Homo sapiens
ggaguuggcccaugacagu

SEQ ID NO: 1160880 - RNA, 19 nt, Homo sapiens
cggcuaauguuaccagaug

SEQ ID NO: 1160881 - RNA, 19 nt, Homo sapiens
gaauacguccaucccauug

SEQ ID NO: 1160882 - RNA, 19 nt, Homo sapiens
uuuggaagcugaaucaaug

SEQ ID NO: 1160883 - RNA, 19 nt, Homo sapiens
ccucuuuccugguauagaa

SEQ ID NO: 1160884 - RNA, 19 nt, Homo sapiens
aaaagaagcucaaguguac

SEQ ID NO: 1160885 - RNA, 19 nt, Homo sapiens
guacaguuuguucagaaua

SEQ ID NO: 1160886 - RNA, 19 nt, Homo sapiens
cagaugaguuagaauccaa

SEQ ID NO: 1160887 - RNA, 19 nt, Homo sapiens
gaagaagggagugauguca

SEQ ID NO: 1160888 - RNA, 19 nt, Homo sapiens
cgaaaugaccgcuccuuca

SEQ ID NO: 1160889 - RNA, 19 nt, Homo sapiens
gaaugcagucggcuaaugu

SEQ ID NO: 1160890 - RNA, 19 nt, Homo sapiens
gaucagacaaggaaugaag

SEQ ID NO: 1160891 - RNA, 19 nt, Homo sapiens
gaacuuguccccugaauag

SEQ ID NO: 1160892 - RNA, 19 nt, Homo sapiens
gggaggcaaucauaugaag

SEQ ID NO: 1160893 - RNA, 19 nt, Homo sapiens
ggcaguaguuugcuugaag

SEQ ID NO: 1160894 - RNA, 19 nt, Homo sapiens
aagcucaaguguacaguug

SEQ ID NO: 1160895 - RNA, 19 nt, Homo sapiens
ggaugaggcagaagauuca

SEQ ID NO: 1160896 - RNA, 19 nt, Homo sapiens
cuuguuacauucucccuuu

SEQ ID NO: 1160897 - RNA, 19 nt, Homo sapiens
agaagggagugaugucaau

SEQ ID NO: 1160898 - RNA, 19 nt, Homo sapiens
cacaacagaaccagaauga

SEQ ID NO: 1160899 - RNA, 19 nt, Homo sapiens
gaaaauguccaccuugguu

SEQ ID NO: 1160900 - RNA, 19 nt, Homo sapiens
gauguaggagagcuucuuu

SEQ ID NO: 1160901 - RNA, 19 nt, Homo sapiens
ggugcugacuccuggaaga

SEQ ID NO: 1160902 - RNA, 19 nt, Homo sapiens
ccacaagaguuacuaaacc

SEQ ID NO: 1160903 - RNA, 19 nt, Homo sapiens
ugcagaagguugugggaaa

SEQ ID NO: 1160904 - RNA, 19 nt, Homo sapiens
gcccaugacaguuugauug

SEQ ID NO: 1160905 - RNA, 19 nt, Homo sapiens
cuacaaaucauucuaacuc

SEQ ID NO: 1160906 - RNA, 19 nt, Homo sapiens
ugaugucaauucucuuguu

SEQ ID NO: 1160907 - RNA, 19 nt, Homo sapiens
gaagggagugaugucaauu

SEQ ID NO: 1160908 - RNA, 19 nt, Homo sapiens
gaggggagguuuuccuuug

SEQ ID NO: 1160909 - RNA, 19 nt, Homo sapiens
ggaagcaggaaugugcaua

SEQ ID NO: 1160910 - RNA, 19 nt, Homo sapiens
ugucaauucucuuguuaca

SEQ ID NO: 1160911 - RNA, 19 nt, Homo sapiens
gaaauaauuccugcuacca

SEQ ID NO: 1160912 - RNA, 19 nt, Homo sapiens
uguguuggcugaaguucuu

SEQ ID NO: 1160913 - RNA, 19 nt, Homo sapiens
gcaguaaauccacaagagu

SEQ ID NO: 1160914 - RNA, 19 nt, Homo sapiens
acaguagcauuccaugguu

SEQ ID NO: 1160915 - RNA, 19 nt, Homo sapiens
caccuaguacaacaucuua

SEQ ID NO: 1160916 - RNA, 19 nt, Homo sapiens
aguaaauccacaagaguua

SEQ ID NO: 1160917 - RNA, 19 nt, Homo sapiens
gggagcagcugggagucaa

SEQ ID NO: 1160918 - RNA, 19 nt, Homo sapiens
gaagcucaaguguacaguu

SEQ ID NO: 1160919 - RNA, 19 nt, Homo sapiens
gauagcacuucuuuuauuc

SEQ ID NO: 1160920 - RNA, 19 nt, Homo sapiens
ucagaaugcagucggcuaa

SEQ ID NO: 1160921 - RNA, 19 nt, Homo sapiens
cugaauagcuacagguuuu

SEQ ID NO: 1160922 - RNA, 19 nt, Homo sapiens
ucaccaggaaguugaguuu

SEQ ID NO: 1160923 - RNA, 19 nt, Homo sapiens
agaaccagaaugaaucuuu

SEQ ID NO: 1160924 - RNA, 19 nt, Homo sapiens
aauaccaccucaagacuca

SEQ ID NO: 1160925 - RNA, 19 nt, Homo sapiens
gacaguagcauuccauggu

SEQ ID NO: 1160926 - RNA, 19 nt, Homo sapiens
gguacaguuuguucagaau

SEQ ID NO: 1160927 - RNA, 19 nt, Homo sapiens
gaaccuaccugacacauga

SEQ ID NO: 1160928 - RNA, 19 nt, Homo sapiens
gaaggaauauuucaucuag

SEQ ID NO: 1160929 - RNA, 19 nt, Homo sapiens
gagaaagggugaccaagaa

SEQ ID NO: 1160930 - RNA, 19 nt, Homo sapiens
caucaucacugguuauaaa

SEQ ID NO: 1160931 - RNA, 19 nt, Homo sapiens
gaacugcccuuggagauag

SEQ ID NO: 1160932 - RNA, 19 nt, Homo sapiens
ccaagacucuggaauuguu

SEQ ID NO: 1160933 - RNA, 19 nt, Homo sapiens
gaucguggcuuucauuguc

SEQ ID NO: 1160934 - RNA, 19 nt, Homo sapiens
ggauggagguggacucuca

SEQ ID NO: 1160935 - RNA, 19 nt, Homo sapiens
gcaaggaagaguagauuug

SEQ ID NO: 1160936 - RNA, 19 nt, Homo sapiens
ggagaaagggugaccaaga

SEQ ID NO: 1160937 - RNA, 19 nt, Homo sapiens
cauaggaacugcccuugga

SEQ ID NO: 1160938 - RNA, 19 nt, Homo sapiens
caaaggaaccuaccugaca

SEQ ID NO: 1160939 - RNA, 19 nt, Homo sapiens
ccaagucccucgucacugu

SEQ ID NO: 1160940 - RNA, 19 nt, Homo sapiens
ucagcagacucucuacuuu

SEQ ID NO: 1160941 - RNA, 19 nt, Homo sapiens
gaguagauuuggagaggaa

SEQ ID NO: 1160942 - RNA, 19 nt, Homo sapiens
gaguacaccugcucaaucu

SEQ ID NO: 1160943 - RNA, 19 nt, Homo sapiens
ugacaccucucuuccauag

SEQ ID NO: 1160944 - RNA, 19 nt, Homo sapiens
gaucuucccuuuccucaac

SEQ ID NO: 1160945 - RNA, 19 nt, Homo sapiens
gccagaagcuguugcuaca

SEQ ID NO: 1160946 - RNA, 19 nt, Homo sapiens
gguaaaaccuucacuguca

SEQ ID NO: 1160947 - RNA, 19 nt, Homo sapiens
agagagcccuucgagauaa

SEQ ID NO: 1160948 - RNA, 19 nt, Homo sapiens
ggaacugcccuuggagaua

SEQ ID NO: 1160949 - RNA, 19 nt, Homo sapiens
ggacacggccaucaucaau

SEQ ID NO: 1160950 - RNA, 19 nt, Homo sapiens
ucggugacauuccagguua

SEQ ID NO: 1160951 - RNA, 19 nt, Homo sapiens
ccacagaagcccaucauca

SEQ ID NO: 1160952 - RNA, 19 nt, Homo sapiens
ggaggagagugaaguagag

SEQ ID NO: 1160953 - RNA, 19 nt, Homo sapiens
gagcucagcaucagcauca

SEQ ID NO: 1160954 - RNA, 19 nt, Homo sapiens
gcucaagugccaagugaaa

SEQ ID NO: 1160955 - RNA, 19 nt, Homo sapiens
aaaaggagcuucacugcaa

SEQ ID NO: 1160956 - RNA, 19 nt, Homo sapiens
ucaccaacccggacuugua

SEQ ID NO: 1160957 - RNA, 19 nt, Homo sapiens
gugcucaagugccaaguga

SEQ ID NO: 1160958 - RNA, 19 nt, Homo sapiens
caagaaggaauauuucauc

SEQ ID NO: 1160959 - RNA, 19 nt, Homo sapiens
aggcagacauaacaacaaa

SEQ ID NO: 1160960 - RNA, 19 nt, Homo sapiens
aggaagaucccaaugguaa

SEQ ID NO: 1160961 - RNA, 19 nt, Homo sapiens
ccacacaccugagcacuac

SEQ ID NO: 1160962 - RNA, 19 nt, Homo sapiens
gaagaugacccaggagagu

SEQ ID NO: 1160963 - RNA, 19 nt, Homo sapiens
ggaagaucccaaugguaaa

SEQ ID NO: 1160964 - RNA, 19 nt, Homo sapiens
caucacugguuauaaaucu

SEQ ID NO: 1160965 - RNA, 19 nt, Homo sapiens
gcuaggaauuccacagaag

SEQ ID NO: 1160966 - RNA, 19 nt, Homo sapiens
cgacaagaaggaauauuuc

SEQ ID NO: 1160967 - RNA, 19 nt, Homo sapiens
gggacgacaagaaggaaua

SEQ ID NO: 1160968 - RNA, 19 nt, Homo sapiens
gcagcuacaaggccuacua

SEQ ID NO: 1160969 - RNA, 19 nt, Homo sapiens
aagagagcccuucgagaua

SEQ ID NO: 1160970 - RNA, 19 nt, Homo sapiens
cagagcagcuucccagacu

SEQ ID NO: 1160971 - RNA, 19 nt, Homo sapiens
uacuacacccucaauguua

SEQ ID NO: 1160972 - RNA, 19 nt, Homo sapiens
ggagagugcccugaucuuc

SEQ ID NO: 1160973 - RNA, 19 nt, Homo sapiens
gaaccaugaaucucuaaag

SEQ ID NO: 1160974 - RNA, 19 nt, Homo sapiens
ggacucaucccugcaaugg

SEQ ID NO: 1160975 - RNA, 19 nt, Homo sapiens
gacaagaaggaauauuuca

SEQ ID NO: 1160976 - RNA, 19 nt, Homo sapiens
acuacacccucaauguuaa

SEQ ID NO: 1160977 - RNA, 19 nt, Homo sapiens
cuacuacacccucaauguu

SEQ ID NO: 1160978 - RNA, 19 nt, Homo sapiens
caacaugggcagcuacaag

SEQ ID NO: 1160979 - RNA, 19 nt, Homo sapiens
guacaccugcucaaucuuc

SEQ ID NO: 1160980 - RNA, 19 nt, Homo sapiens
aaaggagcuucacugcaaa

SEQ ID NO: 1160981 - RNA, 19 nt, Homo sapiens
cagcagccaggcagacaua

SEQ ID NO: 1160982 - RNA, 19 nt, Homo sapiens
acaggaagaucccaauggu

SEQ ID NO: 1160983 - RNA, 19 nt, Homo sapiens
gagagcccuucgagauaau

SEQ ID NO: 1160984 - RNA, 19 nt, Homo sapiens
gcagacauaacaacaaacu

SEQ ID NO: 1160985 - RNA, 19 nt, Homo sapiens
gcagggacccaggacugua

SEQ ID NO: 1160986 - RNA, 19 nt, Homo sapiens
acaccucucuuccauagca

SEQ ID NO: 1160987 - RNA, 19 nt, Homo sapiens
cagcagacucucuacuuug

SEQ ID NO: 1160988 - RNA, 19 nt, Homo sapiens
ugacagauccaccucucaa

SEQ ID NO: 1160989 - RNA, 19 nt, Homo sapiens
gagcagcuucccagacuuc

SEQ ID NO: 1160990 - RNA, 19 nt, Homo sapiens
cagaagcuguugcuacacu

SEQ ID NO: 1160991 - RNA, 19 nt, Homo sapiens
acgacaagaaggaauauuu

SEQ ID NO: 1160992 - RNA, 19 nt, Homo sapiens
acaccaacugcgaugauua

SEQ ID NO: 1160993 - RNA, 19 nt, Homo sapiens
ugugaaccaugaaucucua

SEQ ID NO: 1160994 - RNA, 19 nt, Homo sapiens
gcagcucggugacauucca

SEQ ID NO: 1160995 - RNA, 19 nt, Homo sapiens
agacauaacaacaaacuac

SEQ ID NO: 1160996 - RNA, 19 nt, Homo sapiens
acccaagacucuggaauug

SEQ ID NO: 1160997 - RNA, 19 nt, Homo sapiens
cgggaugguugucggcaaa

SEQ ID NO: 1160998 - RNA, 19 nt, Homo sapiens
aggaauauuucaucuagag

SEQ ID NO: 1160999 - RNA, 19 nt, Homo sapiens
ucggugggaucguggcuuu

SEQ ID NO: 1161000 - RNA, 19 nt, Homo sapiens
gaaagaucacgaggacuca

SEQ ID NO: 1161001 - RNA, 19 nt, Homo sapiens
cagccacccuaaacuguca

SEQ ID NO: 1161002 - RNA, 19 nt, Homo sapiens
ggcaggagcaggauuugga

SEQ ID NO: 1161003 - RNA, 19 nt, Homo sapiens
ucaagugccaagugaaaga

SEQ ID NO: 1161004 - RNA, 19 nt, Homo sapiens
gcaucagcaucagcaaugu

SEQ ID NO: 1161005 - RNA, 19 nt, Homo sapiens
ccacuccucccauggcauu

SEQ ID NO: 1161006 - RNA, 19 nt, Homo sapiens
ggacgacaagaaggaauau

SEQ ID NO: 1161007 - RNA, 19 nt, Homo sapiens
ccagcaacaugggcagcua

SEQ ID NO: 1161008 - RNA, 19 nt, Homo sapiens
gcccugaucuucccuuucc

SEQ ID NO: 1161009 - RNA, 19 nt, Homo sapiens
caacccgcauacaggaaga

SEQ ID NO: 1161010 - RNA, 19 nt, Homo sapiens
gaaagggugaccaagaacu

SEQ ID NO: 1161011 - RNA, 19 nt, Homo sapiens
aaagacacagccacccuaa

SEQ ID NO: 1161012 - RNA, 19 nt, Homo sapiens
uaaagggagcugacagauc

SEQ ID NO: 1161013 - RNA, 19 nt, Homo sapiens
ggguugcccucagcccuuu

SEQ ID NO: 1161014 - RNA, 19 nt, Homo sapiens
acacggccaucaucaaugc

SEQ ID NO: 1161015 - RNA, 19 nt, Homo sapiens
gcaccuaccacgccaucau

SEQ ID NO: 1161016 - RNA, 19 nt, Homo sapiens
cgaguacaccugcucaauc

SEQ ID NO: 1161017 - RNA, 19 nt, Homo sapiens
ccucgucacugugcuagga

SEQ ID NO: 1161018 - RNA, 19 nt, Homo sapiens
cagggacccaggacuguaa

SEQ ID NO: 1161019 - RNA, 19 nt, Homo sapiens
aaucgaauucagcugguua

SEQ ID NO: 1161020 - RNA, 19 nt, Homo sapiens
gcacagccaccagcaacau

SEQ ID NO: 1161021 - RNA, 19 nt, Homo sapiens
cacaccaacugcgaugauu

SEQ ID NO: 1161022 - RNA, 19 nt, Homo sapiens
caggaagaucccaauggua

SEQ ID NO: 1161023 - RNA, 19 nt, Homo sapiens
uacccaagacucuggaauu

SEQ ID NO: 1161024 - RNA, 19 nt, Homo sapiens
ucccagacuucuccaggaa

SEQ ID NO: 1161025 - RNA, 19 nt, Homo sapiens
ggaaccuaccugacacaug

SEQ ID NO: 1161026 - RNA, 19 nt, Homo sapiens
agacacagccacccuaaac

SEQ ID NO: 1161027 - RNA, 19 nt, Homo sapiens
ggagguacauuaagagcua

SEQ ID NO: 1161028 - RNA, 19 nt, Homo sapiens
ucacaaggcuuucuucaau

SEQ ID NO: 1161029 - RNA, 19 nt, Homo sapiens
gaacucaaagcgugcauua

SEQ ID NO: 1161030 - RNA, 19 nt, Homo sapiens
caacagugcuucccaaagu

SEQ ID NO: 1161031 - RNA, 19 nt, Homo sapiens
aaagcagacucaccuaaua

SEQ ID NO: 1161032 - RNA, 19 nt, Homo sapiens
gcaaaugucacaaggcuuu

SEQ ID NO: 1161033 - RNA, 19 nt, Homo sapiens
ggaagaggagguacauuaa

SEQ ID NO: 1161034 - RNA, 19 nt, Homo sapiens
gcaacccacugcuuaagaa

SEQ ID NO: 1161035 - RNA, 19 nt, Homo sapiens
gaagggauguuuuguaaga

SEQ ID NO: 1161036 - RNA, 19 nt, Homo sapiens
cagcagagcaugaccuuaa

SEQ ID NO: 1161037 - RNA, 19 nt, Homo sapiens
gauguucaauugaguacuu

SEQ ID NO: 1161038 - RNA, 19 nt, Homo sapiens
gcacuuuccuggugaugga

SEQ ID NO: 1161039 - RNA, 19 nt, Homo sapiens
caaaguggguggugugaag

SEQ ID NO: 1161040 - RNA, 19 nt, Homo sapiens
gaucagcuauguccaaacu

SEQ ID NO: 1161041 - RNA, 19 nt, Homo sapiens
ucauaaagggcuccucuua

SEQ ID NO: 1161042 - RNA, 19 nt, Homo sapiens
agcaugaccuuaaggguua

SEQ ID NO: 1161043 - RNA, 19 nt, Homo sapiens
gcagauggcugggcacucu

SEQ ID NO: 1161044 - RNA, 19 nt, Homo sapiens
aagaggagguacauuaaga

SEQ ID NO: 1161045 - RNA, 19 nt, Homo sapiens
ggaaagguguucgucauac

SEQ ID NO: 1161046 - RNA, 19 nt, Homo sapiens
caucagagaggucacauga

SEQ ID NO: 1161047 - RNA, 19 nt, Homo sapiens
gcacgaacaaugucuuuua

SEQ ID NO: 1161048 - RNA, 19 nt, Homo sapiens
aggaagaggagguacauua

SEQ ID NO: 1161049 - RNA, 19 nt, Homo sapiens
aaguauagcuaacuaguca

SEQ ID NO: 1161050 - RNA, 19 nt, Homo sapiens
caucuccaauuucuacauu

SEQ ID NO: 1161051 - RNA, 19 nt, Homo sapiens
cuugagggcuccaaaguau

SEQ ID NO: 1161052 - RNA, 19 nt, Homo sapiens
agaguuggccucagaauga

SEQ ID NO: 1161053 - RNA, 19 nt, Homo sapiens
caucguggccuauaaacaa

SEQ ID NO: 1161054 - RNA, 19 nt, Homo sapiens
gaaagguguucgucauacu

SEQ ID NO: 1161055 - RNA, 19 nt, Homo sapiens
uguaagaacuaccaacagu

SEQ ID NO: 1161056 - RNA, 19 nt, Homo sapiens
ggucuucucccgcugcuuu

SEQ ID NO: 1161057 - RNA, 19 nt, Homo sapiens
gaacuggugaccuaagcaa

SEQ ID NO: 1161058 - RNA, 19 nt, Homo sapiens
gcccugcucuacagccuuu

SEQ ID NO: 1161059 - RNA, 19 nt, Homo sapiens
gaagaggagguacauuaag

SEQ ID NO: 1161060 - RNA, 19 nt, Homo sapiens
gaauguggaagggauguuu

SEQ ID NO: 1161061 - RNA, 19 nt, Homo sapiens
ucagcuauguccaaacuca

SEQ ID NO: 1161062 - RNA, 19 nt, Homo sapiens
agagaaaugaagaugcuua

SEQ ID NO: 1161063 - RNA, 19 nt, Homo sapiens
ggagacaucauagagaaau

SEQ ID NO: 1161064 - RNA, 19 nt, Homo sapiens
gaaaugaagaugcuuaccu

SEQ ID NO: 1161065 - RNA, 19 nt, Homo sapiens
gagacaucauagagaaaug

SEQ ID NO: 1161066 - RNA, 19 nt, Homo sapiens
ugacauccaccuuguacaa

SEQ ID NO: 1161067 - RNA, 19 nt, Homo sapiens
gggcuccucuuauggaaag

SEQ ID NO: 1161068 - RNA, 19 nt, Homo sapiens
gcaggugggcuaugguaug

SEQ ID NO: 1161069 - RNA, 19 nt, Homo sapiens
aagcagacucaccuaauaa

SEQ ID NO: 1161070 - RNA, 19 nt, Homo sapiens
caaaguauagcuaacuagu

SEQ ID NO: 1161071 - RNA, 19 nt, Homo sapiens
gacacuggguucugugaca

SEQ ID NO: 1161072 - RNA, 19 nt, Homo sapiens
gaaaagcaaaaccccauaa

SEQ ID NO: 1161073 - RNA, 19 nt, Homo sapiens
cgugagcugugccucguuu

SEQ ID NO: 1161074 - RNA, 19 nt, Homo sapiens
gaaggaagaggagguacau

SEQ ID NO: 1161075 - RNA, 19 nt, Homo sapiens
cacaaggcuuucuucaaug

SEQ ID NO: 1161076 - RNA, 19 nt, Homo sapiens
uggaagggauguuuuguaa

SEQ ID NO: 1161077 - RNA, 19 nt, Homo sapiens
uccaaaguauagcuaacua

SEQ ID NO: 1161078 - RNA, 19 nt, Homo sapiens
ccucuuggcuuuugugaaa

SEQ ID NO: 1161079 - RNA, 19 nt, Homo sapiens
cuuugugggugcuaucaua

SEQ ID NO: 1161080 - RNA, 19 nt, Homo sapiens
gcuuugcucucuccuccuu

SEQ ID NO: 1161081 - RNA, 19 nt, Homo sapiens
ugugggugcuaucauauau

SEQ ID NO: 1161082 - RNA, 19 nt, Homo sapiens
gagucuuccuuaccuacaa

SEQ ID NO: 1161083 - RNA, 19 nt, Homo sapiens
ccgaucagcuauguccaaa

SEQ ID NO: 1161084 - RNA, 19 nt, Homo sapiens
uaaccuuguuuacuuggau

SEQ ID NO: 1161085 - RNA, 19 nt, Homo sapiens
acaaggcuuucuucaaugg

SEQ ID NO: 1161086 - RNA, 19 nt, Homo sapiens
cucaaagcgugcauuauca

SEQ ID NO: 1161087 - RNA, 19 nt, Homo sapiens
agccguagcagccgaauuu

SEQ ID NO: 1161088 - RNA, 19 nt, Homo sapiens
cagcuguccuuggcucuga

SEQ ID NO: 1161089 - RNA, 19 nt, Homo sapiens
ugauugggauggucuccuu

SEQ ID NO: 1161090 - RNA, 19 nt, Homo sapiens
ucuaccagcucaccaugga

SEQ ID NO: 1161091 - RNA, 19 nt, Homo sapiens
uggaaagguguucgucaua

SEQ ID NO: 1161092 - RNA, 19 nt, Homo sapiens
gggagccucucgguuggaa

SEQ ID NO: 1161093 - RNA, 19 nt, Homo sapiens
caccauugccuugcucuuu

SEQ ID NO: 1161094 - RNA, 19 nt, Homo sapiens
uuaagaagcaaaugucaca

SEQ ID NO: 1161095 - RNA, 19 nt, Homo sapiens
gagcucaggcccuugucuu

SEQ ID NO: 1161096 - RNA, 19 nt, Homo sapiens
acucaaagcgugcauuauc

SEQ ID NO: 1161097 - RNA, 19 nt, Homo sapiens
auggagacaucauagagaa

SEQ ID NO: 1161098 - RNA, 19 nt, Homo sapiens
uuagcaucguggccuauaa

SEQ ID NO: 1161099 - RNA, 19 nt, Homo sapiens
cuauaaacaagucccauug

SEQ ID NO: 1161100 - RNA, 19 nt, Homo sapiens
caagucccauugucaccau

SEQ ID NO: 1161101 - RNA, 19 nt, Homo sapiens
uagcaucguggccuauaaa

SEQ ID NO: 1161102 - RNA, 19 nt, Homo sapiens
uuugugggcuccugcuuug

SEQ ID NO: 1161103 - RNA, 19 nt, Homo sapiens
aaagggcuccucuuaugga

SEQ ID NO: 1161104 - RNA, 19 nt, Homo sapiens
acaaccauccgaucagcua

SEQ ID NO: 1161105 - RNA, 19 nt, Homo sapiens
cacgaacaaugucuuuuaa

SEQ ID NO: 1161106 - RNA, 19 nt, Homo sapiens
caacccacugcuuaagaaa

SEQ ID NO: 1161107 - RNA, 19 nt, Homo sapiens
gugcaggugggcuauggua

SEQ ID NO: 1161108 - RNA, 19 nt, Homo sapiens
gagaaaugaagaugcuuac

SEQ ID NO: 1161109 - RNA, 19 nt, Homo sapiens
ccuauaaacaagucccauu

SEQ ID NO: 1161110 - RNA, 19 nt, Homo sapiens
gcucucuccuccuuucucu

SEQ ID NO: 1161111 - RNA, 19 nt, Homo sapiens
ccgggcaucucuucaagca

SEQ ID NO: 1161112 - RNA, 19 nt, Homo sapiens
ugagggcuccaaaguauag

SEQ ID NO: 1161113 - RNA, 19 nt, Homo sapiens
agagccaucuccaauuucu

SEQ ID NO: 1161114 - RNA, 19 nt, Homo sapiens
uaaagggcuccucuuaugg

SEQ ID NO: 1161115 - RNA, 19 nt, Homo sapiens
accauugccuugcucuuug

SEQ ID NO: 1161116 - RNA, 19 nt, Homo sapiens
ccugggugcugugcugaaa

SEQ ID NO: 1161117 - RNA, 19 nt, Homo sapiens
gggaacuggugaccuaagc

SEQ ID NO: 1161118 - RNA, 19 nt, Homo sapiens
auagagaaaugaagaugcu

SEQ ID NO: 1161119 - RNA, 19 nt, Homo sapiens
cuggccaucauuccaauua

SEQ ID NO: 1161120 - RNA, 19 nt, Homo sapiens
ggguacaccaucuucauca

SEQ ID NO: 1161121 - RNA, 19 nt, Homo sapiens
caggugggcuaugguaugg

SEQ ID NO: 1161122 - RNA, 19 nt, Homo sapiens
ccauugccuugcucuuugu

SEQ ID NO: 1161123 - RNA, 19 nt, Homo sapiens
ggaaaagcaaaaccccaua

SEQ ID NO: 1161124 - RNA, 19 nt, Homo sapiens
aaugggauguucaauugag

SEQ ID NO: 1161125 - RNA, 19 nt, Homo sapiens
cagcgagccugccccuuuu

SEQ ID NO: 1161126 - RNA, 19 nt, Homo sapiens
cgucacaaccauccgauca

SEQ ID NO: 1161127 - RNA, 19 nt, Homo sapiens
gagaggaucugacgaacua

SEQ ID NO: 1161128 - RNA, 19 nt, Homo sapiens
ggaauaugguuguggauuu

SEQ ID NO: 1161129 - RNA, 19 nt, Homo sapiens
gaaagacagcgcucuaaua

SEQ ID NO: 1161130 - RNA, 19 nt, Homo sapiens
uaagaaaccuggauccaaa

SEQ ID NO: 1161131 - RNA, 19 nt, Homo sapiens
guacuuaguuucaagauuc

SEQ ID NO: 1161132 - RNA, 19 nt, Homo sapiens
ggaaaccaaucacaacuug

SEQ ID NO: 1161133 - RNA, 19 nt, Homo sapiens
ggaagcagcuauuacuaug

SEQ ID NO: 1161134 - RNA, 19 nt, Homo sapiens
ggacguaucauauaaaugu

SEQ ID NO: 1161135 - RNA, 19 nt, Homo sapiens
uaauaucccuccaucagua

SEQ ID NO: 1161136 - RNA, 19 nt, Homo sapiens
aaacauggcucagaaucua

SEQ ID NO: 1161137 - RNA, 19 nt, Homo sapiens
ugacuuacgugcauuuaaa

SEQ ID NO: 1161138 - RNA, 19 nt, Homo sapiens
gaaucuacaggucaaauua

SEQ ID NO: 1161139 - RNA, 19 nt, Homo sapiens
acaaagaacuaaagacaga

SEQ ID NO: 1161140 - RNA, 19 nt, Homo sapiens
gaagagaggaucugacgaa

SEQ ID NO: 1161141 - RNA, 19 nt, Homo sapiens
guacuacccuguaacacuu

SEQ ID NO: 1161142 - RNA, 19 nt, Homo sapiens
ggaauagaucugacuuuaa

SEQ ID NO: 1161143 - RNA, 19 nt, Homo sapiens
ucaaugucaucaccuauuu

SEQ ID NO: 1161144 - RNA, 19 nt, Homo sapiens
uaaguuuggugcuguauug

SEQ ID NO: 1161145 - RNA, 19 nt, Homo sapiens
aggaauagaucugacuuua

SEQ ID NO: 1161146 - RNA, 19 nt, Homo sapiens
uuaugugccuuuagucuua

SEQ ID NO: 1161147 - RNA, 19 nt, Homo sapiens
gcaaauacuccucuuagug

SEQ ID NO: 1161148 - RNA, 19 nt, Homo sapiens
ggaaguaacagaaacugaa

SEQ ID NO: 1161149 - RNA, 19 nt, Homo sapiens
caaggagacaucccucuua

SEQ ID NO: 1161150 - RNA, 19 nt, Homo sapiens
guacucgaaucacaaagaa

SEQ ID NO: 1161151 - RNA, 19 nt, Homo sapiens
gaauaugguuguggauuuc

SEQ ID NO: 1161152 - RNA, 19 nt, Homo sapiens
caaagugauuucuguaagu

SEQ ID NO: 1161153 - RNA, 19 nt, Homo sapiens
gaaagaauaaagcagcauu

SEQ ID NO: 1161154 - RNA, 19 nt, Homo sapiens
caacauguacuacccugua

SEQ ID NO: 1161155 - RNA, 19 nt, Homo sapiens
uuaacaagaugcagaguau

SEQ ID NO: 1161156 - RNA, 19 nt, Homo sapiens
caauauauauccaguacuc

SEQ ID NO: 1161157 - RNA, 19 nt, Homo sapiens
acagaauggucauguauau

SEQ ID NO: 1161158 - RNA, 19 nt, Homo sapiens
caacaaagugauuucugua

SEQ ID NO: 1161159 - RNA, 19 nt, Homo sapiens
ucacaauucuggucuagau

SEQ ID NO: 1161160 - RNA, 19 nt, Homo sapiens
aaucacaacuugccaugaa

SEQ ID NO: 1161161 - RNA, 19 nt, Homo sapiens
gcaggaagauuaauuuugu

SEQ ID NO: 1161162 - RNA, 19 nt, Homo sapiens
ggaacuggugcauguauuu

SEQ ID NO: 1161163 - RNA, 19 nt, Homo sapiens
aaacuaguguugcuauugu

SEQ ID NO: 1161164 - RNA, 19 nt, Homo sapiens
ugacauacgugccuuaaaa

SEQ ID NO: 1161165 - RNA, 19 nt, Homo sapiens
ccaguauggugauccagua

SEQ ID NO: 1161166 - RNA, 19 nt, Homo sapiens
aguccgaacucuaauauga

SEQ ID NO: 1161167 - RNA, 19 nt, Homo sapiens
ggugcuguauugaagauaa

SEQ ID NO: 1161168 - RNA, 19 nt, Homo sapiens
ugacaugacuuacgugcau

SEQ ID NO: 1161169 - RNA, 19 nt, Homo sapiens
aaagcauuguggaaucuua

SEQ ID NO: 1161170 - RNA, 19 nt, Homo sapiens
ugaaauggcauauguaaag

SEQ ID NO: 1161171 - RNA, 19 nt, Homo sapiens
cuauuugacuguucagaaa

SEQ ID NO: 1161172 - RNA, 19 nt, Homo sapiens
agacagcgcucuaauacag

SEQ ID NO: 1161173 - RNA, 19 nt, Homo sapiens
ggaaagcauuguggaaucu

SEQ ID NO: 1161174 - RNA, 19 nt, Homo sapiens
caacauccuuaugcugaaa

SEQ ID NO: 1161175 - RNA, 19 nt, Homo sapiens
aacaagaugcagaguauua

SEQ ID NO: 1161176 - RNA, 19 nt, Homo sapiens
ucuccuggcuuggaacuua

SEQ ID NO: 1161177 - RNA, 19 nt, Homo sapiens
gaaauggcauauguaaagg

SEQ ID NO: 1161178 - RNA, 19 nt, Homo sapiens
ggaacuagcaaccgaggaa

SEQ ID NO: 1161179 - RNA, 19 nt, Homo sapiens
aaaauuaccuggggaagua

SEQ ID NO: 1161180 - RNA, 19 nt, Homo sapiens
ccaaugguaaugauaguaa

SEQ ID NO: 1161181 - RNA, 19 nt, Homo sapiens
gacagaauggucauguaua

SEQ ID NO: 1161182 - RNA, 19 nt, Homo sapiens
ggucuagauucaguuauga

SEQ ID NO: 1161183 - RNA, 19 nt, Homo sapiens
gcagcuauuacuaugguua

SEQ ID NO: 1161184 - RNA, 19 nt, Homo sapiens
aguuauugcuuuaggcuua

SEQ ID NO: 1161185 - RNA, 19 nt, Homo sapiens
ucaguaguccgaacucuaa

SEQ ID NO: 1161186 - RNA, 19 nt, Homo sapiens
ugugggacguaucauauaa

SEQ ID NO: 1161187 - RNA, 19 nt, Homo sapiens
acaacaaagugauuucugu

SEQ ID NO: 1161188 - RNA, 19 nt, Homo sapiens
gcacugugaaagcauuuaa

SEQ ID NO: 1161189 - RNA, 19 nt, Homo sapiens
ccuguugguuagcaauuua

SEQ ID NO: 1161190 - RNA, 19 nt, Homo sapiens
gcccagaguccaguacuua

SEQ ID NO: 1161191 - RNA, 19 nt, Homo sapiens
ucacaaagaacuaaagaca

SEQ ID NO: 1161192 - RNA, 19 nt, Homo sapiens
guaguuacagccaauggua

SEQ ID NO: 1161193 - RNA, 19 nt, Homo sapiens
caagauucauagauucugu

SEQ ID NO: 1161194 - RNA, 19 nt, Homo sapiens
uguaaaggcagaguuguua

SEQ ID NO: 1161195 - RNA, 19 nt, Homo sapiens
agaagaggaucuacgaaca

SEQ ID NO: 1161196 - RNA, 19 nt, Homo sapiens
uaagaaagacagcgcucua

SEQ ID NO: 1161197 - RNA, 19 nt, Homo sapiens
ggguaugccuggagucuca

SEQ ID NO: 1161198 - RNA, 19 nt, Homo sapiens
guauggugauccaguaaau

SEQ ID NO: 1161199 - RNA, 19 nt, Homo sapiens
gaggaagcagcuauuacua

SEQ ID NO: 1161200 - RNA, 19 nt, Homo sapiens
acagauggcugauggaaac

SEQ ID NO: 1161201 - RNA, 19 nt, Homo sapiens
uagacagaauggucaugua

SEQ ID NO: 1161202 - RNA, 19 nt, Homo sapiens
caggugggaccaaaguuua

SEQ ID NO: 1161203 - RNA, 19 nt, Homo sapiens
gcgaaaauaugcaggaaga

SEQ ID NO: 1161204 - RNA, 19 nt, Homo sapiens
uaaaugucagcacuaagua

SEQ ID NO: 1161205 - RNA, 19 nt, Homo sapiens
guaaaggcagaguuguuaa

SEQ ID NO: 1161206 - RNA, 19 nt, Homo sapiens
ggagaaaaccaucaucuga

SEQ ID NO: 1161207 - RNA, 19 nt, Homo sapiens
ggagaugugcagcguguga

SEQ ID NO: 1161208 - RNA, 19 nt, Homo sapiens
cuagauggucagaauauuu

SEQ ID NO: 1161209 - RNA, 19 nt, Homo sapiens
uaaccaguuucaagcuuug

SEQ ID NO: 1161210 - RNA, 19 nt, Homo sapiens
uuuacuaccuuaggcuuua

SEQ ID NO: 1161211 - RNA, 19 nt, Homo sapiens
guguugcuauugugcauuu

SEQ ID NO: 1161212 - RNA, 19 nt, Homo sapiens
gaaaacuaguguugcuauu

SEQ ID NO: 1161213 - RNA, 19 nt, Homo sapiens
aaagacagcgcucuaauac

SEQ ID NO: 1161214 - RNA, 19 nt, Homo sapiens
ugauguucuucaccaaaua

SEQ ID NO: 1161215 - RNA, 19 nt, Homo sapiens
cguaaccaaccaauauaua

SEQ ID NO: 1161216 - RNA, 19 nt, Homo sapiens
ccaacauccuuaugcugaa

SEQ ID NO: 1161217 - RNA, 19 nt, Homo sapiens
gaugcagaguauuaauuuc

SEQ ID NO: 1161218 - RNA, 19 nt, Homo sapiens
gaagccauuuugucuguuu

SEQ ID NO: 1161219 - RNA, 19 nt, Homo sapiens
caaaauggcucuucuucag

SEQ ID NO: 1161220 - RNA, 19 nt, Homo sapiens
gacagaaaauguauggaaa

SEQ ID NO: 1161221 - RNA, 19 nt, Homo sapiens
ccucuucgguguuuaugga

SEQ ID NO: 1161222 - RNA, 19 nt, Homo sapiens
ggagacaucccucuuagcu

SEQ ID NO: 1161223 - RNA, 19 nt, Homo sapiens
gcauuggacccagcuauug

SEQ ID NO: 1161224 - RNA, 19 nt, Homo sapiens
ugacaccucaucuucguaa

SEQ ID NO: 1161225 - RNA, 19 nt, Homo sapiens
acaaagugauuucuguaag

SEQ ID NO: 1161226 - RNA, 19 nt, Homo sapiens
aaauggcucuucuucagau

SEQ ID NO: 1161227 - RNA, 19 nt, Homo sapiens
gggaugagcuggaaaggua

SEQ ID NO: 1161228 - RNA, 19 nt, Homo sapiens
ggccacagcuccucagauu

SEQ ID NO: 1161229 - RNA, 19 nt, Homo sapiens
caucugcacuuguaccauu

SEQ ID NO: 1161230 - RNA, 19 nt, Homo sapiens
ccagccaucugcacuugua

SEQ ID NO: 1161231 - RNA, 19 nt, Homo sapiens
caugagaaauaaacugguu

SEQ ID NO: 1161232 - RNA, 19 nt, Homo sapiens
ugacugugguccuauaaau

SEQ ID NO: 1161233 - RNA, 19 nt, Homo sapiens
ccacagcuccucagauuca

SEQ ID NO: 1161234 - RNA, 19 nt, Homo sapiens
gaguccagcugcagaagga

SEQ ID NO: 1161235 - RNA, 19 nt, Homo sapiens
ggaaggugaugcucgugau

SEQ ID NO: 1161236 - RNA, 19 nt, Homo sapiens
gcagaugcccugacagagu

SEQ ID NO: 1161237 - RNA, 19 nt, Homo sapiens
ucaggcagcuggagagaag

SEQ ID NO: 1161238 - RNA, 19 nt, Homo sapiens
gaggugggaugagcuggaa

SEQ ID NO: 1161239 - RNA, 19 nt, Homo sapiens
cccaguagccucuuucuug

SEQ ID NO: 1161240 - RNA, 19 nt, Homo sapiens
cagagucgguuuccuuugg

SEQ ID NO: 1161241 - RNA, 19 nt, Homo sapiens
gacagagucgguuuccuuu

SEQ ID NO: 1161242 - RNA, 19 nt, Homo sapiens
gagcagcuuuagccuucuu

SEQ ID NO: 1161243 - RNA, 19 nt, Homo sapiens
aggcugggauggcgaguaa

SEQ ID NO: 1161244 - RNA, 19 nt, Homo sapiens
gugagucucugcucuacau

SEQ ID NO: 1161245 - RNA, 19 nt, Homo sapiens
ugacagagucgguuuccuu

SEQ ID NO: 1161246 - RNA, 19 nt, Homo sapiens
gaaggugaugcucgugauu

SEQ ID NO: 1161247 - RNA, 19 nt, Homo sapiens
gcauucccuuucccucauu

SEQ ID NO: 1161248 - RNA, 19 nt, Homo sapiens
gcagggcugggucucagua

SEQ ID NO: 1161249 - RNA, 19 nt, Homo sapiens
uggaagaccuguccucacu

SEQ ID NO: 1161250 - RNA, 19 nt, Homo sapiens
gugcagaugcccugacaga

SEQ ID NO: 1161251 - RNA, 19 nt, Homo sapiens
gacugugguccuauaaauu

SEQ ID NO: 1161252 - RNA, 19 nt, Homo sapiens
ugagauggcugagcuucca

SEQ ID NO: 1161253 - RNA, 19 nt, Homo sapiens
uagccucuuucuugcguuu

SEQ ID NO: 1161254 - RNA, 19 nt, Homo sapiens
gcugggauggcgaguaaga

SEQ ID NO: 1161255 - RNA, 19 nt, Homo sapiens
ucuacaugcuggagaagug

SEQ ID NO: 1161256 - RNA, 19 nt, Homo sapiens
ggcauucccuuucccucau

SEQ ID NO: 1161257 - RNA, 19 nt, Homo sapiens
gugaugcucgugauugaug

SEQ ID NO: 1161258 - RNA, 19 nt, Homo sapiens
ggauggggcucuucugucu

SEQ ID NO: 1161259 - RNA, 19 nt, Homo sapiens
gcugacugugguccuauaa

SEQ ID NO: 1161260 - RNA, 19 nt, Homo sapiens
gggagcagaaucagaacug

SEQ ID NO: 1161261 - RNA, 19 nt, Homo sapiens
gcagcuggagagaagagaa

SEQ ID NO: 1161262 - RNA, 19 nt, Homo sapiens
ggcagugggagcagaauca

SEQ ID NO: 1161263 - RNA, 19 nt, Homo sapiens
ugacuucaucccagagaga

SEQ ID NO: 1161264 - RNA, 19 nt, Homo sapiens
ugucuguccugcuucuuca

SEQ ID NO: 1161265 - RNA, 19 nt, Homo sapiens
aggugaugcucgugauuga

SEQ ID NO: 1161266 - RNA, 19 nt, Homo sapiens
caucugugucugucuguug

SEQ ID NO: 1161267 - RNA, 19 nt, Homo sapiens
aaauaaacugguucugugu

SEQ ID NO: 1161268 - RNA, 19 nt, Homo sapiens
acugugguccuauaaauuc

SEQ ID NO: 1161269 - RNA, 19 nt, Homo sapiens
ucuguuggccuguaucugu

SEQ ID NO: 1161270 - RNA, 19 nt, Homo sapiens
gugguccuauaaauucaug

SEQ ID NO: 1161271 - RNA, 19 nt, Homo sapiens
agugggagcagaaucagaa

SEQ ID NO: 1161272 - RNA, 19 nt, Homo sapiens
gaagagagcagaccaggua

SEQ ID NO: 1161273 - RNA, 19 nt, Homo sapiens
caaggaaggaguagaauaa

SEQ ID NO: 1161274 - RNA, 19 nt, Homo sapiens
gaacuauauuugggcuuua

SEQ ID NO: 1161275 - RNA, 19 nt, Homo sapiens
ggaacuauauuugggcuuu

SEQ ID NO: 1161276 - RNA, 19 nt, Homo sapiens
gaccaaagcucgccuugag

SEQ ID NO: 1161277 - RNA, 19 nt, Homo sapiens
ggaagaagaagaagaggaa

SEQ ID NO: 1161278 - RNA, 19 nt, Homo sapiens
ccagacaccugaagggaaa

SEQ ID NO: 1161279 - RNA, 19 nt, Homo sapiens
gaaagcgucucuucuacca

SEQ ID NO: 1161280 - RNA, 19 nt, Homo sapiens
aaacacaucuccuucaucu

SEQ ID NO: 1161281 - RNA, 19 nt, Homo sapiens
ggaaacacaucuccuucau

SEQ ID NO: 1161282 - RNA, 19 nt, Homo sapiens
ggacccaacucaauacagu

SEQ ID NO: 1161283 - RNA, 19 nt, Homo sapiens
guuaugauguuccuauaga

SEQ ID NO: 1161284 - RNA, 19 nt, Homo sapiens
gcugaaagcgucucuucua

SEQ ID NO: 1161285 - RNA, 19 nt, Homo sapiens
gagcagaccagguacuuau

SEQ ID NO: 1161286 - RNA, 19 nt, Homo sapiens
ggaaggaguagaauaagga

SEQ ID NO: 1161287 - RNA, 19 nt, Homo sapiens
gagaggagguacugaagag

SEQ ID NO: 1161288 - RNA, 19 nt, Homo sapiens
ugacauggaucgcugaaag

SEQ ID NO: 1161289 - RNA, 19 nt, Homo sapiens
ugaaugacgcccuggauaa

SEQ ID NO: 1161290 - RNA, 19 nt, Homo sapiens
ugaagagcaugacaguauu

SEQ ID NO: 1161291 - RNA, 19 nt, Homo sapiens
ggaagaagauggggagaaa

SEQ ID NO: 1161292 - RNA, 19 nt, Homo sapiens
cagcuuaacugaagagcau

SEQ ID NO: 1161293 - RNA, 19 nt, Homo sapiens
gagcaucagugggaacuuc

SEQ ID NO: 1161294 - RNA, 19 nt, Homo sapiens
gagaaggggucccaagaaa

SEQ ID NO: 1161295 - RNA, 19 nt, Homo sapiens
gaagagcaugacaguauug

SEQ ID NO: 1161296 - RNA, 19 nt, Homo sapiens
ccaaggaaggaguagaaua

SEQ ID NO: 1161297 - RNA, 19 nt, Homo sapiens
gcucagggcaugugcauuc

SEQ ID NO: 1161298 - RNA, 19 nt, Homo sapiens
uggagaagcacgaggauaa

SEQ ID NO: 1161299 - RNA, 19 nt, Homo sapiens
gcaugacaguauugaggaa

SEQ ID NO: 1161300 - RNA, 19 nt, Homo sapiens
acacaucuccuucaucuca

SEQ ID NO: 1161301 - RNA, 19 nt, Homo sapiens
gggagaaaccuaagagaag

SEQ ID NO: 1161302 - RNA, 19 nt, Homo sapiens
ggagaagcacgaggauaaa

SEQ ID NO: 1161303 - RNA, 19 nt, Homo sapiens
uauuugggcuuuaucugaa

SEQ ID NO: 1161304 - RNA, 19 nt, Homo sapiens
agacuuggcuucucugacu

SEQ ID NO: 1161305 - RNA, 19 nt, Homo sapiens
cugaagagcaugacaguau

SEQ ID NO: 1161306 - RNA, 19 nt, Homo sapiens
agacgcagauucacagagu

SEQ ID NO: 1161307 - RNA, 19 nt, Homo sapiens
ggagaggagguacugaaga

SEQ ID NO: 1161308 - RNA, 19 nt, Homo sapiens
ccacauuacccuucuucaa

SEQ ID NO: 1161309 - RNA, 19 nt, Homo sapiens
acagcuucaugccacauua

SEQ ID NO: 1161310 - RNA, 19 nt, Homo sapiens
guccacaacuucaacuauc

SEQ ID NO: 1161311 - RNA, 19 nt, Homo sapiens
gaagcacgaggauaaaucu

SEQ ID NO: 1161312 - RNA, 19 nt, Homo sapiens
aagcucgccuugagagauu

SEQ ID NO: 1161313 - RNA, 19 nt, Homo sapiens
gaccgagagucuggaaaug

SEQ ID NO: 1161314 - RNA, 19 nt, Homo sapiens
gaaaccagacccgguggaa

SEQ ID NO: 1161315 - RNA, 19 nt, Homo sapiens
ccaacucaauacagucuuc

SEQ ID NO: 1161316 - RNA, 19 nt, Homo sapiens
agugggaacuucuccuuga

SEQ ID NO: 1161317 - RNA, 19 nt, Homo sapiens
caacuucaacuaucagucu

SEQ ID NO: 1161318 - RNA, 19 nt, Homo sapiens
uuguggagaugcuguguaa

SEQ ID NO: 1161319 - RNA, 19 nt, Homo sapiens
gaaacacaucuccuucauc

SEQ ID NO: 1161320 - RNA, 19 nt, Homo sapiens
ggaugcauggccugaauga

SEQ ID NO: 1161321 - RNA, 19 nt, Homo sapiens
agaagaagaggaagaagau

SEQ ID NO: 1161322 - RNA, 19 nt, Homo sapiens
agacuggccaggaacuaua

SEQ ID NO: 1161323 - RNA, 19 nt, Homo sapiens
ccucuaagacgcagauuca

SEQ ID NO: 1161324 - RNA, 19 nt, Homo sapiens
gugggaacuucuccuugaa

SEQ ID NO: 1161325 - RNA, 19 nt, Homo sapiens
caaggcuaaugccagagaa

SEQ ID NO: 1161326 - RNA, 19 nt, Homo sapiens
ugacaguauugaggaagaa

SEQ ID NO: 1161327 - RNA, 19 nt, Homo sapiens
auaaggagcaggcagagaa

SEQ ID NO: 1161328 - RNA, 19 nt, Homo sapiens
cccaaguauucaagaguuu

SEQ ID NO: 1161329 - RNA, 19 nt, Homo sapiens
gagaagcacgaggauaaau

SEQ ID NO: 1161330 - RNA, 19 nt, Homo sapiens
ccguuaugauguuccuaua

SEQ ID NO: 1161331 - RNA, 19 nt, Homo sapiens
agaagaagaagaggaagaa

SEQ ID NO: 1161332 - RNA, 19 nt, Homo sapiens
gagagcagaccagguacuu

SEQ ID NO: 1161333 - RNA, 19 nt, Homo sapiens
acauuacccuucuucaagu

SEQ ID NO: 1161334 - RNA, 19 nt, Homo sapiens
gagauucagggcucgaaga

SEQ ID NO: 1161335 - RNA, 19 nt, Homo sapiens
ccgagagucuggaaauguc

SEQ ID NO: 1161336 - RNA, 19 nt, Homo sapiens
cacauuacccuucuucaag

SEQ ID NO: 1161337 - RNA, 19 nt, Homo sapiens
guacugaagagcgacuaaa

SEQ ID NO: 1161338 - RNA, 19 nt, Homo sapiens
gaagaagaggaagaagaug

SEQ ID NO: 1161339 - RNA, 19 nt, Homo sapiens
gcauacggaacuccaagga

SEQ ID NO: 1161340 - RNA, 19 nt, Homo sapiens
ggaaaagggaggaguuaga

SEQ ID NO: 1161341 - RNA, 19 nt, Homo sapiens
ggucauauggaaacacauc

SEQ ID NO: 1161342 - RNA, 19 nt, Homo sapiens
aagaagaagaggaagaaga

SEQ ID NO: 1161343 - RNA, 19 nt, Homo sapiens
guauugaggaagaagaaga

SEQ ID NO: 1161344 - RNA, 19 nt, Homo sapiens
uaaggagcaggcagagaaa

SEQ ID NO: 1161345 - RNA, 19 nt, Homo sapiens
guggagaugcuguguaaag

SEQ ID NO: 1161346 - RNA, 19 nt, Homo sapiens
gaagagucaaggcuaaugc

SEQ ID NO: 1161347 - RNA, 19 nt, Homo sapiens
aaaagaagaugaccaaagc

SEQ ID NO: 1161348 - RNA, 19 nt, Homo sapiens
gagaugggagagcuaguca

SEQ ID NO: 1161349 - RNA, 19 nt, Homo sapiens
aaucaaaacugcagcaagu

SEQ ID NO: 1161350 - RNA, 19 nt, Homo sapiens
ccggaugcauggccugaau

SEQ ID NO: 1161351 - RNA, 19 nt, Homo sapiens
gcagaccagguacuuaugg

SEQ ID NO: 1161352 - RNA, 19 nt, Homo sapiens
guuagacucugggcaacau

SEQ ID NO: 1161353 - RNA, 19 nt, Homo sapiens
ccaucucuguccacaacuu

SEQ ID NO: 1161354 - RNA, 19 nt, Homo sapiens
gauaaccugaggcgaguca

SEQ ID NO: 1161355 - RNA, 19 nt, Homo sapiens
gaaugacgcccuggauaac

SEQ ID NO: 1161356 - RNA, 19 nt, Homo sapiens
cugaaugacgcccuggaua

SEQ ID NO: 1161357 - RNA, 19 nt, Homo sapiens
ugaccgagagucuggaaau

SEQ ID NO: 1161358 - RNA, 19 nt, Homo sapiens
caugugcauucaacuccuu

SEQ ID NO: 1161359 - RNA, 19 nt, Homo sapiens
cucgaagagucaaggcuaa

SEQ ID NO: 1161360 - RNA, 19 nt, Homo sapiens
gaagauggggagaaaccua

SEQ ID NO: 1161361 - RNA, 19 nt, Homo sapiens
cugaaagcgucucuucuac

SEQ ID NO: 1161362 - RNA, 19 nt, Homo sapiens
ugaggaagaagaagaagag

SEQ ID NO: 1161363 - RNA, 19 nt, Homo sapiens
gaugggagagcuagucaac

SEQ ID NO: 1161364 - RNA, 19 nt, Homo sapiens
ggagaugggagagcuaguc

SEQ ID NO: 1161365 - RNA, 19 nt, Homo sapiens
cuuccuagcccuccuuaug

SEQ ID NO: 1161366 - RNA, 19 nt, Homo sapiens
caagugggcgugucuuucg

SEQ ID NO: 1161367 - RNA, 19 nt, Homo sapiens
ugggagagcuagucaacac

SEQ ID NO: 1161368 - RNA, 19 nt, Homo sapiens
gacgcagauucacagaguu

SEQ ID NO: 1161369 - RNA, 19 nt, Homo sapiens
uauggaaacacaucuccuu

SEQ ID NO: 1161370 - RNA, 19 nt, Homo sapiens
uccacaacuucaacuauca

SEQ ID NO: 1161371 - RNA, 19 nt, Homo sapiens
ucucucagcccacaagcaa

SEQ ID NO: 1161372 - RNA, 19 nt, Homo sapiens
gaaaugaacuugcuuacua

SEQ ID NO: 1161373 - RNA, 19 nt, Homo sapiens
gaaggugacucaaagaaug

SEQ ID NO: 1161374 - RNA, 19 nt, Homo sapiens
gaacauuccucuacuuucu

SEQ ID NO: 1161375 - RNA, 19 nt, Homo sapiens
cagaagcacuuucaguaaa

SEQ ID NO: 1161376 - RNA, 19 nt, Homo sapiens
caaagaauauccagaaggu

SEQ ID NO: 1161377 - RNA, 19 nt, Homo sapiens
guacccaucucaaauguuc

SEQ ID NO: 1161378 - RNA, 19 nt, Homo sapiens
caagaacauuccucuacuu

SEQ ID NO: 1161379 - RNA, 19 nt, Homo sapiens
gaacuugcuuacuaaugug

SEQ ID NO: 1161380 - RNA, 19 nt, Homo sapiens
ugaacuugcuuacuaaugu

SEQ ID NO: 1161381 - RNA, 19 nt, Homo sapiens
caaauguucccaagauaaa

SEQ ID NO: 1161382 - RNA, 19 nt, Homo sapiens
gcaagaacauuccucuacu

SEQ ID NO: 1161383 - RNA, 19 nt, Homo sapiens
ggaggccacagaacaauaa

SEQ ID NO: 1161384 - RNA, 19 nt, Homo sapiens
gcaagcagaugggcgaauc

SEQ ID NO: 1161385 - RNA, 19 nt, Homo sapiens
ucaaauguucccaagauaa

SEQ ID NO: 1161386 - RNA, 19 nt, Homo sapiens
gcagcuagguugcaagaac

SEQ ID NO: 1161387 - RNA, 19 nt, Homo sapiens
ucucaaauguucccaagau

SEQ ID NO: 1161388 - RNA, 19 nt, Homo sapiens
ggaaauggaaaugaacuug

SEQ ID NO: 1161389 - RNA, 19 nt, Homo sapiens
agacaaggcucagcaucuu

SEQ ID NO: 1161390 - RNA, 19 nt, Homo sapiens
ggaggaggccacagaacaa

SEQ ID NO: 1161391 - RNA, 19 nt, Homo sapiens
caacagaagcacuuucagu

SEQ ID NO: 1161392 - RNA, 19 nt, Homo sapiens
gggaggaaaugccuuuaac

SEQ ID NO: 1161393 - RNA, 19 nt, Homo sapiens
gcucagcaucuugauauuu

SEQ ID NO: 1161394 - RNA, 19 nt, Homo sapiens
acagaagcacuuucaguaa

SEQ ID NO: 1161395 - RNA, 19 nt, Homo sapiens
gcuaagccuuggaaacagu

SEQ ID NO: 1161396 - RNA, 19 nt, Homo sapiens
aacagaagcacuuucagua

SEQ ID NO: 1161397 - RNA, 19 nt, Homo sapiens
gugcugaggccuaaauguu

SEQ ID NO: 1161398 - RNA, 19 nt, Homo sapiens
gacaacagaagcacuuuca

SEQ ID NO: 1161399 - RNA, 19 nt, Homo sapiens
gggcgaauccuacgacaca

SEQ ID NO: 1161400 - RNA, 19 nt, Homo sapiens
ccagagaugcuuagagaca

SEQ ID NO: 1161401 - RNA, 19 nt, Homo sapiens
cagcuagguugcaagaaca

SEQ ID NO: 1161402 - RNA, 19 nt, Homo sapiens
gcuggacgcggacacauga

SEQ ID NO: 1161403 - RNA, 19 nt, Homo sapiens
gggaggaggccacagaaca

SEQ ID NO: 1161404 - RNA, 19 nt, Homo sapiens
cucaaauguucccaagaua

SEQ ID NO: 1161405 - RNA, 19 nt, Homo sapiens
guauguacccaucucaaau

SEQ ID NO: 1161406 - RNA, 19 nt, Homo sapiens
cagaaggugacucaaagaa

SEQ ID NO: 1161407 - RNA, 19 nt, Homo sapiens
ccaagaauaucuggaaacg

SEQ ID NO: 1161408 - RNA, 19 nt, Homo sapiens
aaugugugauuccuaguug

SEQ ID NO: 1161409 - RNA, 19 nt, Homo sapiens
aagaacauuccucuacuuu

SEQ ID NO: 1161410 - RNA, 19 nt, Homo sapiens
cggaugugcugaggccuaa

SEQ ID NO: 1161411 - RNA, 19 nt, Homo sapiens
ggaaacaguugggaaaagu

SEQ ID NO: 1161412 - RNA, 19 nt, Homo sapiens
ggacaacagaagcacuuuc

SEQ ID NO: 1161413 - RNA, 19 nt, Homo sapiens
ccagggaggaaaugccuuu

SEQ ID NO: 1161414 - RNA, 19 nt, Homo sapiens
ggaaaugaacuugcuuacu

SEQ ID NO: 1161415 - RNA, 19 nt, Homo sapiens
ugcugaggccuaaauguua

SEQ ID NO: 1161416 - RNA, 19 nt, Homo sapiens
gcgaauccuacgacacaaa

SEQ ID NO: 1161417 - RNA, 19 nt, Homo sapiens
acagauuccucccaagucu

SEQ ID NO: 1161418 - RNA, 19 nt, Homo sapiens
gacccucacaguucacauu

SEQ ID NO: 1161419 - RNA, 19 nt, Homo sapiens
uccagaaggugacucaaag

SEQ ID NO: 1161420 - RNA, 19 nt, Homo sapiens
ugacguggccgaagguauc

SEQ ID NO: 1161421 - RNA, 19 nt, Homo sapiens
ugacagauuccucccaagu

SEQ ID NO: 1161422 - RNA, 19 nt, Homo sapiens
gaugugcugaggccuaaau

SEQ ID NO: 1161423 - RNA, 19 nt, Homo sapiens
guuugacccucacaguuca

SEQ ID NO: 1161424 - RNA, 19 nt, Homo sapiens
cgccuacgccugccuagaa

SEQ ID NO: 1161425 - RNA, 19 nt, Homo sapiens
uaaugugugauuccuaguu

SEQ ID NO: 1161426 - RNA, 19 nt, Homo sapiens
ugccaagaauaucuggaaa

SEQ ID NO: 1161427 - RNA, 19 nt, Homo sapiens
aaauggaaaugaacuugcu

SEQ ID NO: 1161428 - RNA, 19 nt, Homo sapiens
uauguacccaucucaaaug

SEQ ID NO: 1161429 - RNA, 19 nt, Homo sapiens
gaaacaguugggaaaagua

SEQ ID NO: 1161430 - RNA, 19 nt, Homo sapiens
ccagaaggugacucaaaga

SEQ ID NO: 1161431 - RNA, 19 nt, Homo sapiens
uacaaagaauauccagaag

SEQ ID NO: 1161432 - RNA, 19 nt, Homo sapiens
gagcaagaccccagagaug

SEQ ID NO: 1161433 - RNA, 19 nt, Homo sapiens
ggguggaacuaagaaaguc

SEQ ID NO: 1161434 - RNA, 19 nt, Homo sapiens
cagcuccacgagaccuuua

SEQ ID NO: 1161435 - RNA, 19 nt, Homo sapiens
gcucugggucccuguuuua

SEQ ID NO: 1161436 - RNA, 19 nt, Homo sapiens
gaggaggccacagaacaau

SEQ ID NO: 1161437 - RNA, 19 nt, Homo sapiens
ggcucagcaucuugauauu

SEQ ID NO: 1161438 - RNA, 19 nt, Homo sapiens
aggcucagcaucuugauau

SEQ ID NO: 1161439 - RNA, 19 nt, Homo sapiens
ccccagagaugcuuagaga

SEQ ID NO: 1161440 - RNA, 19 nt, Homo sapiens
agaaggugacucaaagaau

SEQ ID NO: 1161441 - RNA, 19 nt, Homo sapiens
ccucacaguucacauucag

SEQ ID NO: 1161442 - RNA, 19 nt, Homo sapiens
cugcuaagccuuggaaaca

SEQ ID NO: 1161443 - RNA, 19 nt, Homo sapiens
ugugugauuccuaguugua

SEQ ID NO: 1161444 - RNA, 19 nt, Homo sapiens
gacagauuccucccaaguc

SEQ ID NO: 1161445 - RNA, 19 nt, Homo sapiens
gcagcuccacgagaccuuu

SEQ ID NO: 1161446 - RNA, 19 nt, Homo sapiens
guaguuugacccucacagu

SEQ ID NO: 1161447 - RNA, 19 nt, Homo sapiens
gaugagaacuaaagagaaa

SEQ ID NO: 1161448 - RNA, 19 nt, Homo sapiens
gaaggaaacuccauguugu

SEQ ID NO: 1161449 - RNA, 19 nt, Homo sapiens
gaacaacgcggacuucauc

SEQ ID NO: 1161450 - RNA, 19 nt, Homo sapiens
cagguggccuucccauuua

SEQ ID NO: 1161451 - RNA, 19 nt, Homo sapiens
ggaaggaaacuccauguug

SEQ ID NO: 1161452 - RNA, 19 nt, Homo sapiens
gggcaaaggugaccagaag

SEQ ID NO: 1161453 - RNA, 19 nt, Homo sapiens
uuaagugccuucucuguga

SEQ ID NO: 1161454 - RNA, 19 nt, Homo sapiens
ggacagcucggccgucauu

SEQ ID NO: 1161455 - RNA, 19 nt, Homo sapiens
gcaaugaccucagacuucu

SEQ ID NO: 1161456 - RNA, 19 nt, Homo sapiens
gcgccuggguuccauguuu

SEQ ID NO: 1161457 - RNA, 19 nt, Homo sapiens
caucaucccuguggagauu

SEQ ID NO: 1161458 - RNA, 19 nt, Homo sapiens
caaguacgcagacccagua

SEQ ID NO: 1161459 - RNA, 19 nt, Homo sapiens
ggagggagggaaaggauuu

SEQ ID NO: 1161460 - RNA, 19 nt, Homo sapiens
gaaggcagcaggagucugu

SEQ ID NO: 1161461 - RNA, 19 nt, Homo sapiens
caauucaccugccuccuau

SEQ ID NO: 1161462 - RNA, 19 nt, Homo sapiens
ucagguggccuucccauuu

SEQ ID NO: 1161463 - RNA, 19 nt, Homo sapiens
gaauaugguuggccugcau

SEQ ID NO: 1161464 - RNA, 19 nt, Homo sapiens
uagcugaccugcuggacaa

SEQ ID NO: 1161465 - RNA, 19 nt, Homo sapiens
cugcuagccucgccaagua

SEQ ID NO: 1161466 - RNA, 19 nt, Homo sapiens
ugagagcccuagugugaug

SEQ ID NO: 1161467 - RNA, 19 nt, Homo sapiens
gcucggccgucauuacuca

SEQ ID NO: 1161468 - RNA, 19 nt, Homo sapiens
gaacgguggacaucaagug

SEQ ID NO: 1161469 - RNA, 19 nt, Homo sapiens
gaagacugcccaggccuuu

SEQ ID NO: 1161470 - RNA, 19 nt, Homo sapiens
gaccagaagucagcagcuu

SEQ ID NO: 1161471 - RNA, 19 nt, Homo sapiens
gcgaaugggcgagcucuuu

SEQ ID NO: 1161472 - RNA, 19 nt, Homo sapiens
gaagcguccucacguggau

SEQ ID NO: 1161473 - RNA, 19 nt, Homo sapiens
gcccaggccuuuguuagga

SEQ ID NO: 1161474 - RNA, 19 nt, Homo sapiens
gcccaggacucagacaaga

SEQ ID NO: 1161475 - RNA, 19 nt, Homo sapiens
acugagagcccuaguguga

SEQ ID NO: 1161476 - RNA, 19 nt, Homo sapiens
gcaaaggugaccagaaguc

SEQ ID NO: 1161477 - RNA, 19 nt, Homo sapiens
gugaugagaacuaaagaga

SEQ ID NO: 1161478 - RNA, 19 nt, Homo sapiens
ugggcgagcucuuugaaug

SEQ ID NO: 1161479 - RNA, 19 nt, Homo sapiens
ccauuuaagugccuucucu

SEQ ID NO: 1161480 - RNA, 19 nt, Homo sapiens
gaugucaaguggugauguc

SEQ ID NO: 1161481 - RNA, 19 nt, Homo sapiens
acaauucaccugccuccua

SEQ ID NO: 1161482 - RNA, 19 nt, Homo sapiens
gucaaguggugaugucguu

SEQ ID NO: 1161483 - RNA, 19 nt, Homo sapiens
uauccugccuuccaacugu

SEQ ID NO: 1161484 - RNA, 19 nt, Homo sapiens
gaaugggcgagcucuuuga

SEQ ID NO: 1161485 - RNA, 19 nt, Homo sapiens
uuacucagaucagcaagga

SEQ ID NO: 1161486 - RNA, 19 nt, Homo sapiens
cgaagccguugcccuuuua

SEQ ID NO: 1161487 - RNA, 19 nt, Homo sapiens
ugacugagagcccuagugu

SEQ ID NO: 1161488 - RNA, 19 nt, Homo sapiens
ggaagggucaggguagaga

SEQ ID NO: 1161489 - RNA, 19 nt, Homo sapiens
ucaccugccuccuaugucu

SEQ ID NO: 1161490 - RNA, 19 nt, Homo sapiens
uuucucugcugccaaauug

SEQ ID NO: 1161491 - RNA, 19 nt, Homo sapiens
caacgcggacuucaucauc

SEQ ID NO: 1161492 - RNA, 19 nt, Homo sapiens
cgaaugggcgagcucuuug

SEQ ID NO: 1161493 - RNA, 19 nt, Homo sapiens
gggaaggaaacuccauguu

SEQ ID NO: 1161494 - RNA, 19 nt, Homo sapiens
aaggaaacuccauguugua

SEQ ID NO: 1161495 - RNA, 19 nt, Homo sapiens
ccaaggcccaggacucaga

SEQ ID NO: 1161496 - RNA, 19 nt, Homo sapiens
uccaagcaaugaccucaga

SEQ ID NO: 1161497 - RNA, 19 nt, Homo sapiens
ugggaacgguggacaucaa

SEQ ID NO: 1161498 - RNA, 19 nt, Homo sapiens
ccaggccuuuguuaggaaa

SEQ ID NO: 1161499 - RNA, 19 nt, Homo sapiens
ggcgagcucuuugaaugug

SEQ ID NO: 1161500 - RNA, 19 nt, Homo sapiens
caccaggucuacguguuga

SEQ ID NO: 1161501 - RNA, 19 nt, Homo sapiens
gguuugacaacaugaguga

SEQ ID NO: 1161502 - RNA, 19 nt, Homo sapiens
ccaccaggucuacguguug

SEQ ID NO: 1161503 - RNA, 19 nt, Homo sapiens
gagaaagccagaccccuaa

SEQ ID NO: 1161504 - RNA, 19 nt, Homo sapiens
cccuuguggugccauauaa

SEQ ID NO: 1161505 - RNA, 19 nt, Homo sapiens
ccucgugguuugacaacau

SEQ ID NO: 1161506 - RNA, 19 nt, Homo sapiens
ugugugcuguucacugcua

SEQ ID NO: 1161507 - RNA, 19 nt, Homo sapiens
ucacucuucugcugugucu

SEQ ID NO: 1161508 - RNA, 19 nt, Homo sapiens
gugcucauccuggacaauu

SEQ ID NO: 1161509 - RNA, 19 nt, Homo sapiens
guacgcagacccaguagcu

SEQ ID NO: 1161510 - RNA, 19 nt, Homo sapiens
gggcgagcucuuugaaugu

SEQ ID NO: 1161511 - RNA, 19 nt, Homo sapiens
gaaagccagaccccuaaaa

SEQ ID NO: 1161512 - RNA, 19 nt, Homo sapiens
ccgugucagugccuucaaa

SEQ ID NO: 1161513 - RNA, 19 nt, Homo sapiens
gcccuagugugaugagaac

SEQ ID NO: 1161514 - RNA, 19 nt, Homo sapiens
gcucauccuggacaauuca

SEQ ID NO: 1161515 - RNA, 19 nt, Homo sapiens
ugaugagaacuaaagagaa

SEQ ID NO: 1161516 - RNA, 19 nt, Homo sapiens
gggcagcucccaggauauc

SEQ ID NO: 1161517 - RNA, 19 nt, Homo sapiens
cgccuggguuccauguuug

SEQ ID NO: 1161518 - RNA, 19 nt, Homo sapiens
aggaaacuccauguuguaa

SEQ ID NO: 1161519 - RNA, 19 nt, Homo sapiens
caagaucugcguggucauc

SEQ ID NO: 1161520 - RNA, 19 nt, Homo sapiens
ccaggacucagacaagauc

SEQ ID NO: 1161521 - RNA, 19 nt, Homo sapiens
gggagggagggaaaggauu

SEQ ID NO: 1161522 - RNA, 19 nt, Homo sapiens
ggaaacaccugagagcuua

SEQ ID NO: 1161523 - RNA, 19 nt, Homo sapiens
ccaaaucucucucccagua

SEQ ID NO: 1161524 - RNA, 19 nt, Homo sapiens
ggacaaauucuauguguau

SEQ ID NO: 1161525 - RNA, 19 nt, Homo sapiens
ccaaagugcugggauuaaa

SEQ ID NO: 1161526 - RNA, 19 nt, Homo sapiens
ggaaguuguuauuguggua

SEQ ID NO: 1161527 - RNA, 19 nt, Homo sapiens
gauugagucuucuuuaugg

SEQ ID NO: 1161528 - RNA, 19 nt, Homo sapiens
gugagagucugaucuuguu

SEQ ID NO: 1161529 - RNA, 19 nt, Homo sapiens
ggagacggacucuauguug

SEQ ID NO: 1161530 - RNA, 19 nt, Homo sapiens
ccgcagcccuuuccuaugu

SEQ ID NO: 1161531 - RNA, 19 nt, Homo sapiens
gaucugccgguucauuaua

SEQ ID NO: 1161532 - RNA, 19 nt, Homo sapiens
gaauugaugagcugucuug

SEQ ID NO: 1161533 - RNA, 19 nt, Homo sapiens
caccacacccggcuaauuu

SEQ ID NO: 1161534 - RNA, 19 nt, Homo sapiens
caacgaaggccugggcuuu

SEQ ID NO: 1161535 - RNA, 19 nt, Homo sapiens
ggagugcaguggcaugauc

SEQ ID NO: 1161536 - RNA, 19 nt, Homo sapiens
ucuaauaccugagccaaga

SEQ ID NO: 1161537 - RNA, 19 nt, Homo sapiens
cagaucugccgguucauua

SEQ ID NO: 1161538 - RNA, 19 nt, Homo sapiens
caagugauccucccaccuu

SEQ ID NO: 1161539 - RNA, 19 nt, Homo sapiens
gaaggugcgaggauuauag

SEQ ID NO: 1161540 - RNA, 19 nt, Homo sapiens
gcaccugacucuaauaccu

SEQ ID NO: 1161541 - RNA, 19 nt, Homo sapiens
uugaugagcugucuugauc

SEQ ID NO: 1161542 - RNA, 19 nt, Homo sapiens
caacuucucaggccucaga

SEQ ID NO: 1161543 - RNA, 19 nt, Homo sapiens
gcaguccucuccagaucug

SEQ ID NO: 1161544 - RNA, 19 nt, Homo sapiens
cagcgucacuggaaguugu

SEQ ID NO: 1161545 - RNA, 19 nt, Homo sapiens
gugaggagacggacucuau

SEQ ID NO: 1161546 - RNA, 19 nt, Homo sapiens
ugagucuucuuuauggaaa

SEQ ID NO: 1161547 - RNA, 19 nt, Homo sapiens
gaugagcugucuugaucuc

SEQ ID NO: 1161548 - RNA, 19 nt, Homo sapiens
ugugauuccuggcuucauu

SEQ ID NO: 1161549 - RNA, 19 nt, Homo sapiens
caccaugccuggcccuaug

SEQ ID NO: 1161550 - RNA, 19 nt, Homo sapiens
gagggcagcgucacuggaa

SEQ ID NO: 1161551 - RNA, 19 nt, Homo sapiens
gaaguuguuauugugguaa

SEQ ID NO: 1161552 - RNA, 19 nt, Homo sapiens
gccuacacguauuuguuaa

SEQ ID NO: 1161553 - RNA, 19 nt, Homo sapiens
cauccagccuacacguauu

SEQ ID NO: 1161554 - RNA, 19 nt, Homo sapiens
gcucacucgucccaaugaa

SEQ ID NO: 1161555 - RNA, 19 nt, Homo sapiens
uggacaaauucuaugugua

SEQ ID NO: 1161556 - RNA, 19 nt, Homo sapiens
cagccacugcccucucuua

SEQ ID NO: 1161557 - RNA, 19 nt, Homo sapiens
caugaaucgucuccggaaa

SEQ ID NO: 1161558 - RNA, 19 nt, Homo sapiens
gaggagacggacucuaugu

SEQ ID NO: 1161559 - RNA, 19 nt, Homo sapiens
ugaaucgucuccggaaaca

SEQ ID NO: 1161560 - RNA, 19 nt, Homo sapiens
ggcgaaagccauugagaca

SEQ ID NO: 1161561 - RNA, 19 nt, Homo sapiens
ccagugagagucugaucuu

SEQ ID NO: 1161562 - RNA, 19 nt, Homo sapiens
cuccagaucugccgguuca

SEQ ID NO: 1161563 - RNA, 19 nt, Homo sapiens
ccucagcccucuccugcau

SEQ ID NO: 1161564 - RNA, 19 nt, Homo sapiens
cacuggaaguuguuauugu

SEQ ID NO: 1161565 - RNA, 19 nt, Homo sapiens
ugauugagucuucuuuaug

SEQ ID NO: 1161566 - RNA, 19 nt, Homo sapiens
ccaccacacccggcuaauu

SEQ ID NO: 1161567 - RNA, 19 nt, Homo sapiens
agccuacacguauuuguua

SEQ ID NO: 1161568 - RNA, 19 nt, Homo sapiens
cagccuacacguauuuguu

SEQ ID NO: 1161569 - RNA, 19 nt, Homo sapiens
ugcccaggcuguuauggaa

SEQ ID NO: 1161570 - RNA, 19 nt, Homo sapiens
ccgcaguccucuccagauc

SEQ ID NO: 1161571 - RNA, 19 nt, Homo sapiens
uaccaucggugucuauacu

SEQ ID NO: 1161572 - RNA, 19 nt, Homo sapiens
ucugaaggugcgaggauua

SEQ ID NO: 1161573 - RNA, 19 nt, Homo sapiens
ggaguuuucuuucgguuuc

SEQ ID NO: 1161574 - RNA, 19 nt, Homo sapiens
caccgcagcccuuuccuau

SEQ ID NO: 1161575 - RNA, 19 nt, Homo sapiens
cggaaacaccugagagcuu

SEQ ID NO: 1161576 - RNA, 19 nt, Homo sapiens
caaagugcugggauuaaag

SEQ ID NO: 1161577 - RNA, 19 nt, Homo sapiens
gugauaauaacuuggacaa

SEQ ID NO: 1161578 - RNA, 19 nt, Homo sapiens
ucacuggaaguuguuauug

SEQ ID NO: 1161579 - RNA, 19 nt, Homo sapiens
gagcucacucgucccaaug

SEQ ID NO: 1161580 - RNA, 19 nt, Homo sapiens
uuggacaaauucuaugugu

SEQ ID NO: 1161581 - RNA, 19 nt, Homo sapiens
ccagaucugccgguucauu

SEQ ID NO: 1161582 - RNA, 19 nt, Homo sapiens
acuggaaguuguuauugug

SEQ ID NO: 1161583 - RNA, 19 nt, Homo sapiens
guaaugauugagucuucuu

SEQ ID NO: 1161584 - RNA, 19 nt, Homo sapiens
acccaggccucccaaagug

SEQ ID NO: 1161585 - RNA, 19 nt, Homo sapiens
ggcaugaucucggcucacu

SEQ ID NO: 1161586 - RNA, 19 nt, Homo sapiens
ugaaggugcgaggauuaua

SEQ ID NO: 1161587 - RNA, 19 nt, Homo sapiens
ucugccgguucauuauaua

SEQ ID NO: 1161588 - RNA, 19 nt, Homo sapiens
gagcuuaccaucggugucu

SEQ ID NO: 1161589 - RNA, 19 nt, Homo sapiens
cgccaucgguucaguucau

SEQ ID NO: 1161590 - RNA, 19 nt, Homo sapiens
cccauggguucaggaauug

SEQ ID NO: 1161591 - RNA, 19 nt, Homo sapiens
uucccacccucccuccuua

SEQ ID NO: 1161592 - RNA, 19 nt, Homo sapiens
uauguugcccaggcuguua

SEQ ID NO: 1161593 - RNA, 19 nt, Homo sapiens
uguggcaccugacucuaau

SEQ ID NO: 1161594 - RNA, 19 nt, Homo sapiens
agagcucacucgucccaau

SEQ ID NO: 1161595 - RNA, 19 nt, Homo sapiens
ucuccugcauccuccugua

SEQ ID NO: 1161596 - RNA, 19 nt, Homo sapiens
aaaucucucucccaguaca

SEQ ID NO: 1161597 - RNA, 19 nt, Homo sapiens
gugauuccuggcuucauuu

SEQ ID NO: 1161598 - RNA, 19 nt, Homo sapiens
cagugagagucugaucuug

SEQ ID NO: 1161599 - RNA, 19 nt, Homo sapiens
gaacuccugaccuggugau

SEQ ID NO: 1161600 - RNA, 19 nt, Homo sapiens
ccaccagaagcauuuacuu

SEQ ID NO: 1161601 - RNA, 19 nt, Homo sapiens
cacacugggugauaauaac

SEQ ID NO: 1161602 - RNA, 19 nt, Homo sapiens
uuaggccccucauuuaaaa

SEQ ID NO: 1161603 - RNA, 19 nt, Homo sapiens
gagcggaaccucacuguua

SEQ ID NO: 1161604 - RNA, 19 nt, Homo sapiens
gaaagugggugcagagaau

SEQ ID NO: 1161605 - RNA, 19 nt, Homo sapiens
ggaaagcucugcaggacuu

SEQ ID NO: 1161606 - RNA, 19 nt, Homo sapiens
gaagaucuccuaccgauau

SEQ ID NO: 1161607 - RNA, 19 nt, Homo sapiens
caugaaagcugaccugaug

SEQ ID NO: 1161608 - RNA, 19 nt, Homo sapiens
gacaagaacugcauucaca

SEQ ID NO: 1161609 - RNA, 19 nt, Homo sapiens
gaaccucacuguuaacuac

SEQ ID NO: 1161610 - RNA, 19 nt, Homo sapiens
gaucaaagcuagagugacu

SEQ ID NO: 1161611 - RNA, 19 nt, Homo sapiens
gaaccuauccuuguaaaga

SEQ ID NO: 1161612 - RNA, 19 nt, Homo sapiens
uaaacaagaggcuguauuu

SEQ ID NO: 1161613 - RNA, 19 nt, Homo sapiens
gauaggacaauuucuguaa

SEQ ID NO: 1161614 - RNA, 19 nt, Homo sapiens
gcaaugccaucuucaccuu

SEQ ID NO: 1161615 - RNA, 19 nt, Homo sapiens
gaaguaugauggcuacaca

SEQ ID NO: 1161616 - RNA, 19 nt, Homo sapiens
gaacugcauucacacagau

SEQ ID NO: 1161617 - RNA, 19 nt, Homo sapiens
ggagagacccaagugauuu

SEQ ID NO: 1161618 - RNA, 19 nt, Homo sapiens
aagcugaccugaugccuuu

SEQ ID NO: 1161619 - RNA, 19 nt, Homo sapiens
ccaaugagcccaccagaug

SEQ ID NO: 1161620 - RNA, 19 nt, Homo sapiens
gaucauguacuuaucagaa

SEQ ID NO: 1161621 - RNA, 19 nt, Homo sapiens
gaagaucauguacuuauca

SEQ ID NO: 1161622 - RNA, 19 nt, Homo sapiens
agacccaagugauuucaua

SEQ ID NO: 1161623 - RNA, 19 nt, Homo sapiens
cgaaggacuuggaaccuau

SEQ ID NO: 1161624 - RNA, 19 nt, Homo sapiens
gauuccaucugguguagaa

SEQ ID NO: 1161625 - RNA, 19 nt, Homo sapiens
augaugggcuugauucuuu

SEQ ID NO: 1161626 - RNA, 19 nt, Homo sapiens
cccaagugauuucauauga

SEQ ID NO: 1161627 - RNA, 19 nt, Homo sapiens
ccugaugccuuuccuguau

SEQ ID NO: 1161628 - RNA, 19 nt, Homo sapiens
ggguggauguggauaaaga

SEQ ID NO: 1161629 - RNA, 19 nt, Homo sapiens
cagaagaucauguacuuau

SEQ ID NO: 1161630 - RNA, 19 nt, Homo sapiens
ccaaacaauuguccucauc

SEQ ID NO: 1161631 - RNA, 19 nt, Homo sapiens
acaagaggcuguauuugag

SEQ ID NO: 1161632 - RNA, 19 nt, Homo sapiens
caaauacuccagugaagug

SEQ ID NO: 1161633 - RNA, 19 nt, Homo sapiens
aaucaaacaccaacaaaga

SEQ ID NO: 1161634 - RNA, 19 nt, Homo sapiens
ggagguacccaaauguguu

SEQ ID NO: 1161635 - RNA, 19 nt, Homo sapiens
cacaggagguacccaaaug

SEQ ID NO: 1161636 - RNA, 19 nt, Homo sapiens
gauuaaaggccuaccugaa

SEQ ID NO: 1161637 - RNA, 19 nt, Homo sapiens
ggaaagugggugcagagaa

SEQ ID NO: 1161638 - RNA, 19 nt, Homo sapiens
aaacaccaacaaagaagua

SEQ ID NO: 1161639 - RNA, 19 nt, Homo sapiens
uaaagaaacucugcaacac

SEQ ID NO: 1161640 - RNA, 19 nt, Homo sapiens
uguaaagaguuccuugaug

SEQ ID NO: 1161641 - RNA, 19 nt, Homo sapiens
ggacuuggaaccuauccuu

SEQ ID NO: 1161642 - RNA, 19 nt, Homo sapiens
ggauguggauaaagaaacu

SEQ ID NO: 1161643 - RNA, 19 nt, Homo sapiens
ggugggugcuggugccaaa

SEQ ID NO: 1161644 - RNA, 19 nt, Homo sapiens
aagagcgccuuuccaugua

SEQ ID NO: 1161645 - RNA, 19 nt, Homo sapiens
aacaagaggcuguauuuga

SEQ ID NO: 1161646 - RNA, 19 nt, Homo sapiens
ccaaaugccucccuuuuca

SEQ ID NO: 1161647 - RNA, 19 nt, Homo sapiens
cuuggaaccuauccuugua

SEQ ID NO: 1161648 - RNA, 19 nt, Homo sapiens
aaggauggcucagcacuug

SEQ ID NO: 1161649 - RNA, 19 nt, Homo sapiens
caaguuguuucaucuaggu

SEQ ID NO: 1161650 - RNA, 19 nt, Homo sapiens
gagguacccaaauguguuu

SEQ ID NO: 1161651 - RNA, 19 nt, Homo sapiens
ggauaaagaaacucugcaa

SEQ ID NO: 1161652 - RNA, 19 nt, Homo sapiens
guuaagaaguaugcagaug

SEQ ID NO: 1161653 - RNA, 19 nt, Homo sapiens
gauccugccugaagauggu

SEQ ID NO: 1161654 - RNA, 19 nt, Homo sapiens
cagaugcccugcaggagau

SEQ ID NO: 1161655 - RNA, 19 nt, Homo sapiens
cucagaagaucauguacuu

SEQ ID NO: 1161656 - RNA, 19 nt, Homo sapiens
gaaucaaacaccaacaaag

SEQ ID NO: 1161657 - RNA, 19 nt, Homo sapiens
gcuggacuaugagaagauu

SEQ ID NO: 1161658 - RNA, 19 nt, Homo sapiens
uuucaacacuucucuugga

SEQ ID NO: 1161659 - RNA, 19 nt, Homo sapiens
uccuaccgauaucuuauua

SEQ ID NO: 1161660 - RNA, 19 nt, Homo sapiens
guagaauggaucaaagcua

SEQ ID NO: 1161661 - RNA, 19 nt, Homo sapiens
aaacaauuguccucaucug

SEQ ID NO: 1161662 - RNA, 19 nt, Homo sapiens
gguguagaauggaucaaag

SEQ ID NO: 1161663 - RNA, 19 nt, Homo sapiens
agaguuccuugauggguaa

SEQ ID NO: 1161664 - RNA, 19 nt, Homo sapiens
caucuucaccuucccaaau

SEQ ID NO: 1161665 - RNA, 19 nt, Homo sapiens
agaacugcauucacacaga

SEQ ID NO: 1161666 - RNA, 19 nt, Homo sapiens
cuagaaaccuuccccuuug

SEQ ID NO: 1161667 - RNA, 19 nt, Homo sapiens
uugcugaguuugacuacaa

SEQ ID NO: 1161668 - RNA, 19 nt, Homo sapiens
caccaacaaagaaguauga

SEQ ID NO: 1161669 - RNA, 19 nt, Homo sapiens
ccagugagagacauuucua

SEQ ID NO: 1161670 - RNA, 19 nt, Homo sapiens
gauccaaggccaauaucau

SEQ ID NO: 1161671 - RNA, 19 nt, Homo sapiens
uauuauugcucucggaauc

SEQ ID NO: 1161672 - RNA, 19 nt, Homo sapiens
aagcuagagugacugaguu

SEQ ID NO: 1161673 - RNA, 19 nt, Homo sapiens
uggaaccuauccuuguaaa

SEQ ID NO: 1161674 - RNA, 19 nt, Homo sapiens
agcggaaccucacuguuaa

SEQ ID NO: 1161675 - RNA, 19 nt, Homo sapiens
guagagaagacauggaaag

SEQ ID NO: 1161676 - RNA, 19 nt, Homo sapiens
acgaaggacuuggaaccua

SEQ ID NO: 1161677 - RNA, 19 nt, Homo sapiens
cagcguuucugcgcaaguu

SEQ ID NO: 1161678 - RNA, 19 nt, Homo sapiens
cuacaaccgugugauucuu

SEQ ID NO: 1161679 - RNA, 19 nt, Homo sapiens
caccagauguccucaagac

SEQ ID NO: 1161680 - RNA, 19 nt, Homo sapiens
cagcuggacuaugagaaga

SEQ ID NO: 1161681 - RNA, 19 nt, Homo sapiens
acacagaugacgacgagaa

SEQ ID NO: 1161682 - RNA, 19 nt, Homo sapiens
caugucacaccuccaauga

SEQ ID NO: 1161683 - RNA, 19 nt, Homo sapiens
gagagacccaagugauuuc

SEQ ID NO: 1161684 - RNA, 19 nt, Homo sapiens
ggaaccucacuguuaacua

SEQ ID NO: 1161685 - RNA, 19 nt, Homo sapiens
auaaagaaacucugcaaca

SEQ ID NO: 1161686 - RNA, 19 nt, Homo sapiens
caagaggcuguauuugaga

SEQ ID NO: 1161687 - RNA, 19 nt, Homo sapiens
agaagaucauguacuuauc

SEQ ID NO: 1161688 - RNA, 19 nt, Homo sapiens
ggacuaugagaagauuaaa

SEQ ID NO: 1161689 - RNA, 19 nt, Homo sapiens
gaguugaacccagacaaga

SEQ ID NO: 1161690 - RNA, 19 nt, Homo sapiens
gcgcaaguuguuucaucua

SEQ ID NO: 1161691 - RNA, 19 nt, Homo sapiens
aaagaaacucugcaacaca

SEQ ID NO: 1161692 - RNA, 19 nt, Homo sapiens
caaaauagggucgaauuau

SEQ ID NO: 1161693 - RNA, 19 nt, Homo sapiens
ucaaagcuagagugacuga

SEQ ID NO: 1161694 - RNA, 19 nt, Homo sapiens
ccaaaauagggucgaauua

SEQ ID NO: 1161695 - RNA, 19 nt, Homo sapiens
gagcagcacgaaggacuug

SEQ ID NO: 1161696 - RNA, 19 nt, Homo sapiens
agaaucaaacaccaacaaa

SEQ ID NO: 1161697 - RNA, 19 nt, Homo sapiens
aagaggcuguauuugagaa

SEQ ID NO: 1161698 - RNA, 19 nt, Homo sapiens
aaacaagaggcuguauuug

SEQ ID NO: 1161699 - RNA, 19 nt, Homo sapiens
ucagaagaucauguacuua

SEQ ID NO: 1161700 - RNA, 19 nt, Homo sapiens
gccaaacaauuguccucau

SEQ ID NO: 1161701 - RNA, 19 nt, Homo sapiens
caagaacugcauucacaca

SEQ ID NO: 1161702 - RNA, 19 nt, Homo sapiens
gcaagugugauuccaucug

SEQ ID NO: 1161703 - RNA, 19 nt, Homo sapiens
ggaaacagcucuacuccaa

SEQ ID NO: 1161704 - RNA, 19 nt, Homo sapiens
gcaggcuguuucuguauua

SEQ ID NO: 1161705 - RNA, 19 nt, Homo sapiens
gcucagaaauggauuaucu

SEQ ID NO: 1161706 - RNA, 19 nt, Homo sapiens
ccacuucaauccagcaauu

SEQ ID NO: 1161707 - RNA, 19 nt, Homo sapiens
agagaaaccuggacacaug

SEQ ID NO: 1161708 - RNA, 19 nt, Homo sapiens
caacaacccugggaguuca

SEQ ID NO: 1161709 - RNA, 19 nt, Homo sapiens
ucaaagcccaagucaauaa

SEQ ID NO: 1161710 - RNA, 19 nt, Homo sapiens
ucucacagcuuuacaccaa

SEQ ID NO: 1161711 - RNA, 19 nt, Homo sapiens
aaacagcucuacuccaaca

SEQ ID NO: 1161712 - RNA, 19 nt, Homo sapiens
gauccuguguugccuguug

SEQ ID NO: 1161713 - RNA, 19 nt, Homo sapiens
ccucaaagcccaagucaau

SEQ ID NO: 1161714 - RNA, 19 nt, Homo sapiens
cuuauuagcugcauacagu

SEQ ID NO: 1161715 - RNA, 19 nt, Homo sapiens
ggcuguuucuguauuauuu

SEQ ID NO: 1161716 - RNA, 19 nt, Homo sapiens
gcaauuuccaccacuuuga

SEQ ID NO: 1161717 - RNA, 19 nt, Homo sapiens
caaaugcagugaguucugu

SEQ ID NO: 1161718 - RNA, 19 nt, Homo sapiens
ggaccaggcugcgagaaca

SEQ ID NO: 1161719 - RNA, 19 nt, Homo sapiens
agaacgggcugccaacaga

SEQ ID NO: 1161720 - RNA, 19 nt, Homo sapiens
cuuauucggaguacuauua

SEQ ID NO: 1161721 - RNA, 19 nt, Homo sapiens
ggacugccucucaacauug

SEQ ID NO: 1161722 - RNA, 19 nt, Homo sapiens
gggcaucacuaucccucaa

SEQ ID NO: 1161723 - RNA, 19 nt, Homo sapiens
uauaaacugcuuuggguaa

SEQ ID NO: 1161724 - RNA, 19 nt, Homo sapiens
ggucaagugugauuagacu

SEQ ID NO: 1161725 - RNA, 19 nt, Homo sapiens
gagcagaaggugauacaca

SEQ ID NO: 1161726 - RNA, 19 nt, Homo sapiens
caacauuguggcucagaaa

SEQ ID NO: 1161727 - RNA, 19 nt, Homo sapiens
acaaucaacuaagcccuuu

SEQ ID NO: 1161728 - RNA, 19 nt, Homo sapiens
cuggaucccucucaauuau

SEQ ID NO: 1161729 - RNA, 19 nt, Homo sapiens
gugauuagacuuuccugaa

SEQ ID NO: 1161730 - RNA, 19 nt, Homo sapiens
ucacacucauauugcuuaa

SEQ ID NO: 1161731 - RNA, 19 nt, Homo sapiens
gggaaaaugugcacucaug

SEQ ID NO: 1161732 - RNA, 19 nt, Homo sapiens
gucacaagaucauauccaa

SEQ ID NO: 1161733 - RNA, 19 nt, Homo sapiens
ggaucccucucaauuaucu

SEQ ID NO: 1161734 - RNA, 19 nt, Homo sapiens
ucacugugcuggagcucuu

SEQ ID NO: 1161735 - RNA, 19 nt, Homo sapiens
uuuaacagguguccuagug

SEQ ID NO: 1161736 - RNA, 19 nt, Homo sapiens
gaacagccagugggagguu

SEQ ID NO: 1161737 - RNA, 19 nt, Homo sapiens
aaacugagcagaaggugau

SEQ ID NO: 1161738 - RNA, 19 nt, Homo sapiens
ccaaaauggucauaaacuu

SEQ ID NO: 1161739 - RNA, 19 nt, Homo sapiens
caccaaagggcaucacuau

SEQ ID NO: 1161740 - RNA, 19 nt, Homo sapiens
ggagagcagagcaccaaga

SEQ ID NO: 1161741 - RNA, 19 nt, Homo sapiens
caaagcccaagucaauaaa

SEQ ID NO: 1161742 - RNA, 19 nt, Homo sapiens
ggaaaacaaucaacuaagc

SEQ ID NO: 1161743 - RNA, 19 nt, Homo sapiens
gaacgggcugccaacagaa

SEQ ID NO: 1161744 - RNA, 19 nt, Homo sapiens
ucugcaggcuguuucugua

SEQ ID NO: 1161745 - RNA, 19 nt, Homo sapiens
aaaagcaacucaacacuca

SEQ ID NO: 1161746 - RNA, 19 nt, Homo sapiens
ucucaauuaucucuggaaa

SEQ ID NO: 1161747 - RNA, 19 nt, Homo sapiens
gcagagcaccaagaucguu

SEQ ID NO: 1161748 - RNA, 19 nt, Homo sapiens
gagagcagagcaccaagau

SEQ ID NO: 1161749 - RNA, 19 nt, Homo sapiens
uguguugccuguugauuuc

SEQ ID NO: 1161750 - RNA, 19 nt, Homo sapiens
gcagaaggugauacacaga

SEQ ID NO: 1161751 - RNA, 19 nt, Homo sapiens
aagcccaagucaauaaaug

SEQ ID NO: 1161752 - RNA, 19 nt, Homo sapiens
cacaagaucauauccaaca

SEQ ID NO: 1161753 - RNA, 19 nt, Homo sapiens
acucaacacucauggucaa

SEQ ID NO: 1161754 - RNA, 19 nt, Homo sapiens
ggucuuggauauaaguaac

SEQ ID NO: 1161755 - RNA, 19 nt, Homo sapiens
ccaaagggcaucacuaucc

SEQ ID NO: 1161756 - RNA, 19 nt, Homo sapiens
auaaacugcuuuggguaaa

SEQ ID NO: 1161757 - RNA, 19 nt, Homo sapiens
ucacuaucccucaaagaga

SEQ ID NO: 1161758 - RNA, 19 nt, Homo sapiens
gcaucacuaucccucaaag

SEQ ID NO: 1161759 - RNA, 19 nt, Homo sapiens
gauacugugaaacaaacua

SEQ ID NO: 1161760 - RNA, 19 nt, Homo sapiens
aggacugccucucaacauu

SEQ ID NO: 1161761 - RNA, 19 nt, Homo sapiens
gagagaaaccuggacacau

SEQ ID NO: 1161762 - RNA, 19 nt, Homo sapiens
ccagcaauuuccaccacuu

SEQ ID NO: 1161763 - RNA, 19 nt, Homo sapiens
uagauacugugaaacaaac

SEQ ID NO: 1161764 - RNA, 19 nt, Homo sapiens
ucaacauuguggcucagaa

SEQ ID NO: 1161765 - RNA, 19 nt, Homo sapiens
cagaaggugauacacagaa

SEQ ID NO: 1161766 - RNA, 19 nt, Homo sapiens
gacugccucucaacauugu

SEQ ID NO: 1161767 - RNA, 19 nt, Homo sapiens
acuggaucccucucaauua

SEQ ID NO: 1161768 - RNA, 19 nt, Homo sapiens
cagcaauuuccaccacuuu

SEQ ID NO: 1161769 - RNA, 19 nt, Homo sapiens
gagaaaccuggacacaugu

SEQ ID NO: 1161770 - RNA, 19 nt, Homo sapiens
gcuagugugaauuugguaa

SEQ ID NO: 1161771 - RNA, 19 nt, Homo sapiens
gugauacacagaagggaaa

SEQ ID NO: 1161772 - RNA, 19 nt, Homo sapiens
cccaagucaauaaauguua

SEQ ID NO: 1161773 - RNA, 19 nt, Homo sapiens
gcccaagucaauaaauguu

SEQ ID NO: 1161774 - RNA, 19 nt, Homo sapiens
ccaacaacccugggaguuc

SEQ ID NO: 1161775 - RNA, 19 nt, Homo sapiens
ugugcuggagcucuuauua

SEQ ID NO: 1161776 - RNA, 19 nt, Homo sapiens
caguuuaacagguguccua

SEQ ID NO: 1161777 - RNA, 19 nt, Homo sapiens
uguuuacuaugagucguua

SEQ ID NO: 1161778 - RNA, 19 nt, Homo sapiens
uaucagccagucuuccaaa

SEQ ID NO: 1161779 - RNA, 19 nt, Homo sapiens
ucaauuaucucuggaaaac

SEQ ID NO: 1161780 - RNA, 19 nt, Homo sapiens
gcucuguguuuuggcauua

SEQ ID NO: 1161781 - RNA, 19 nt, Homo sapiens
ugcaggcuguuucuguauu

SEQ ID NO: 1161782 - RNA, 19 nt, Homo sapiens
agaaggugauacacagaag

SEQ ID NO: 1161783 - RNA, 19 nt, Homo sapiens
gguaaacugagcagaaggu

SEQ ID NO: 1161784 - RNA, 19 nt, Homo sapiens
cagccagucuuccaaaaug

SEQ ID NO: 1161785 - RNA, 19 nt, Homo sapiens
uucacggucuuggauauaa

SEQ ID NO: 1161786 - RNA, 19 nt, Homo sapiens
aaugugcacucaugcuagu

SEQ ID NO: 1161787 - RNA, 19 nt, Homo sapiens
uacuggaucccucucaauu

SEQ ID NO: 1161788 - RNA, 19 nt, Homo sapiens
caauuuccaccacuuugau

SEQ ID NO: 1161789 - RNA, 19 nt, Homo sapiens
ccaccguucuugggacugu

SEQ ID NO: 1161790 - RNA, 19 nt, Homo sapiens
aaacugcuuuggguaaacu

SEQ ID NO: 1161791 - RNA, 19 nt, Homo sapiens
gguggaaacagcucuacuc

SEQ ID NO: 1161792 - RNA, 19 nt, Homo sapiens
ggacacauguaccaaaacg

SEQ ID NO: 1161793 - RNA, 19 nt, Homo sapiens
uggguaaacugagcagaag

SEQ ID NO: 1161794 - RNA, 19 nt, Homo sapiens
acaccaaagggcaucacua

SEQ ID NO: 1161795 - RNA, 19 nt, Homo sapiens
ucacggucuuggauauaag

SEQ ID NO: 1161796 - RNA, 19 nt, Homo sapiens
ucggaguacuauuauccaa

SEQ ID NO: 1161797 - RNA, 19 nt, Homo sapiens
ggaaguguguggagauuua

SEQ ID NO: 1161798 - RNA, 19 nt, Homo sapiens
gaagaaaggcaaagaguuu

SEQ ID NO: 1161799 - RNA, 19 nt, Homo sapiens
guaugaagcuaguugauuu

SEQ ID NO: 1161800 - RNA, 19 nt, Homo sapiens
uaacaggccuuuauagaga

SEQ ID NO: 1161801 - RNA, 19 nt, Homo sapiens
aaacaaauccgccuaugua

SEQ ID NO: 1161802 - RNA, 19 nt, Homo sapiens
gaaagaacucaacaccuua

SEQ ID NO: 1161803 - RNA, 19 nt, Homo sapiens
gcaauagucugaccuugau

SEQ ID NO: 1161804 - RNA, 19 nt, Homo sapiens
ucagagagcuguucuucuu

SEQ ID NO: 1161805 - RNA, 19 nt, Homo sapiens
gagaggauaugaugagaau

SEQ ID NO: 1161806 - RNA, 19 nt, Homo sapiens
caaauccgccuauguauga

SEQ ID NO: 1161807 - RNA, 19 nt, Homo sapiens
agaaagaacucaacaccuu

SEQ ID NO: 1161808 - RNA, 19 nt, Homo sapiens
ugaaagauguggcugaguu

SEQ ID NO: 1161809 - RNA, 19 nt, Homo sapiens
gugggucuauucuucauua

SEQ ID NO: 1161810 - RNA, 19 nt, Homo sapiens
gaaaccagcuuggaauuuu

SEQ ID NO: 1161811 - RNA, 19 nt, Homo sapiens
uacaagaugugguuagaaa

SEQ ID NO: 1161812 - RNA, 19 nt, Homo sapiens
cucaacaccuuacgaguua

SEQ ID NO: 1161813 - RNA, 19 nt, Homo sapiens
aaaguucucuguagauuuc

SEQ ID NO: 1161814 - RNA, 19 nt, Homo sapiens
gauaauagaacuggaaaug

SEQ ID NO: 1161815 - RNA, 19 nt, Homo sapiens
gacagugggucuauucuuc

SEQ ID NO: 1161816 - RNA, 19 nt, Homo sapiens
gcuaguugauuuccaguug

SEQ ID NO: 1161817 - RNA, 19 nt, Homo sapiens
gaacuggaaaugauaaauc

SEQ ID NO: 1161818 - RNA, 19 nt, Homo sapiens
ggaaacaaauccgccuaug

SEQ ID NO: 1161819 - RNA, 19 nt, Homo sapiens
guauacagagucaacaaua

SEQ ID NO: 1161820 - RNA, 19 nt, Homo sapiens
gaagagcuccuauuuugua

SEQ ID NO: 1161821 - RNA, 19 nt, Homo sapiens
acacucgucuuagcacuua

SEQ ID NO: 1161822 - RNA, 19 nt, Homo sapiens
gaagacagguacaaaauag

SEQ ID NO: 1161823 - RNA, 19 nt, Homo sapiens
gaaacaaauccgccuaugu

SEQ ID NO: 1161824 - RNA, 19 nt, Homo sapiens
ggaagaaaggcaaagaguu

SEQ ID NO: 1161825 - RNA, 19 nt, Homo sapiens
gaaagauguggcugaguuu

SEQ ID NO: 1161826 - RNA, 19 nt, Homo sapiens
cagcaaaguuaauucaaca

SEQ ID NO: 1161827 - RNA, 19 nt, Homo sapiens
ccaagggucuaguguguuc

SEQ ID NO: 1161828 - RNA, 19 nt, Homo sapiens
gggcacaguuaugaaguuu

SEQ ID NO: 1161829 - RNA, 19 nt, Homo sapiens
acaaguaccuuuuaucuga

SEQ ID NO: 1161830 - RNA, 19 nt, Homo sapiens
gguacaagaugugguuaga

SEQ ID NO: 1161831 - RNA, 19 nt, Homo sapiens
cgucuuagcacuuacguuu

SEQ ID NO: 1161832 - RNA, 19 nt, Homo sapiens
gcuugaagagcuccuauuu

SEQ ID NO: 1161833 - RNA, 19 nt, Homo sapiens
agaaauggcuggcuaaaau

SEQ ID NO: 1161834 - RNA, 19 nt, Homo sapiens
uggcugaguuucuguauca

SEQ ID NO: 1161835 - RNA, 19 nt, Homo sapiens
guagauuucugaagugcau

SEQ ID NO: 1161836 - RNA, 19 nt, Homo sapiens
gcgaauuucucugauuugu

SEQ ID NO: 1161837 - RNA, 19 nt, Homo sapiens
gaaguucacaggcaauaca

SEQ ID NO: 1161838 - RNA, 19 nt, Homo sapiens
ggaaaacguugcucuuugu

SEQ ID NO: 1161839 - RNA, 19 nt, Homo sapiens
ucuaguccuuugcgaauuu

SEQ ID NO: 1161840 - RNA, 19 nt, Homo sapiens
uggaacaaauacaaaguga

SEQ ID NO: 1161841 - RNA, 19 nt, Homo sapiens
acacagagaggauaugaug

SEQ ID NO: 1161842 - RNA, 19 nt, Homo sapiens
guucaguucucccuuaugg

SEQ ID NO: 1161843 - RNA, 19 nt, Homo sapiens
guuaacaggccuuuauaga

SEQ ID NO: 1161844 - RNA, 19 nt, Homo sapiens
agaaugcuguggaacaaau

SEQ ID NO: 1161845 - RNA, 19 nt, Homo sapiens
ggucuaguguguucuuagu

SEQ ID NO: 1161846 - RNA, 19 nt, Homo sapiens
ugaagaauacaccaucauu

SEQ ID NO: 1161847 - RNA, 19 nt, Homo sapiens
ucacaaacccuuggaguca

SEQ ID NO: 1161848 - RNA, 19 nt, Homo sapiens
gcacaguuaugaaguuucc

SEQ ID NO: 1161849 - RNA, 19 nt, Homo sapiens
ggcaaaaucagcaaaguua

SEQ ID NO: 1161850 - RNA, 19 nt, Homo sapiens
uugcgaauuucucugauuu

SEQ ID NO: 1161851 - RNA, 19 nt, Homo sapiens
uuucuuaucuucugugcuu

SEQ ID NO: 1161852 - RNA, 19 nt, Homo sapiens
ggcaauagucugaccuuga

SEQ ID NO: 1161853 - RNA, 19 nt, Homo sapiens
cuagaaugcuguggaacaa

SEQ ID NO: 1161854 - RNA, 19 nt, Homo sapiens
ccaguugccucugaaguuc

SEQ ID NO: 1161855 - RNA, 19 nt, Homo sapiens
gccuguaucuucccuuugu

SEQ ID NO: 1161856 - RNA, 19 nt, Homo sapiens
gaaugcuguggaacaaaua

SEQ ID NO: 1161857 - RNA, 19 nt, Homo sapiens
gggaaaacguugcucuuug

SEQ ID NO: 1161858 - RNA, 19 nt, Homo sapiens
acaaacccuuggagucauu

SEQ ID NO: 1161859 - RNA, 19 nt, Homo sapiens
gagagcuguucuucuuguu

SEQ ID NO: 1161860 - RNA, 19 nt, Homo sapiens
gauguagggucaagguuuu

SEQ ID NO: 1161861 - RNA, 19 nt, Homo sapiens
ccuuauggcugccuuucaa

SEQ ID NO: 1161862 - RNA, 19 nt, Homo sapiens
caagaugugguuagaaaca

SEQ ID NO: 1161863 - RNA, 19 nt, Homo sapiens
uugaagagcuccuauuuug

SEQ ID NO: 1161864 - RNA, 19 nt, Homo sapiens
gccaucaccugaaaaguuu

SEQ ID NO: 1161865 - RNA, 19 nt, Homo sapiens
uaagguguaacuugaugua

SEQ ID NO: 1161866 - RNA, 19 nt, Homo sapiens
ggagaaauggcuggcuaaa

SEQ ID NO: 1161867 - RNA, 19 nt, Homo sapiens
uggagucauucccagauaa

SEQ ID NO: 1161868 - RNA, 19 nt, Homo sapiens
ggucuauucuucauuagcu

SEQ ID NO: 1161869 - RNA, 19 nt, Homo sapiens
ugaaaccagcuuggaauuu

SEQ ID NO: 1161870 - RNA, 19 nt, Homo sapiens
gaguuugaauucucacagu

SEQ ID NO: 1161871 - RNA, 19 nt, Homo sapiens
uuagagcgguuuaagucuu

SEQ ID NO: 1161872 - RNA, 19 nt, Homo sapiens
guuugaggcuucaguucuu

SEQ ID NO: 1161873 - RNA, 19 nt, Homo sapiens
gaaaugauaaauccccuaa

SEQ ID NO: 1161874 - RNA, 19 nt, Homo sapiens
gauuuccaguugcacuauu

SEQ ID NO: 1161875 - RNA, 19 nt, Homo sapiens
uuaauagccugcaauaagc

SEQ ID NO: 1161876 - RNA, 19 nt, Homo sapiens
ggaacaaauacaaagugaa

SEQ ID NO: 1161877 - RNA, 19 nt, Homo sapiens
gcacuuacguuucaaaagc

SEQ ID NO: 1161878 - RNA, 19 nt, Homo sapiens
ccacaugugaagacaggua

SEQ ID NO: 1161879 - RNA, 19 nt, Homo sapiens
gacacucagacguccauua

SEQ ID NO: 1161880 - RNA, 19 nt, Homo sapiens
gcuagaaugcuguggaaca

SEQ ID NO: 1161881 - RNA, 19 nt, Homo sapiens
acucagacguccauuacug

SEQ ID NO: 1161882 - RNA, 19 nt, Homo sapiens
ucuuagcacuuacguuuca

SEQ ID NO: 1161883 - RNA, 19 nt, Homo sapiens
uacauugucuaguccuuug

SEQ ID NO: 1161884 - RNA, 19 nt, Homo sapiens
ccacacagagaggauauga

SEQ ID NO: 1161885 - RNA, 19 nt, Homo sapiens
agagagcuguucuucuugu

SEQ ID NO: 1161886 - RNA, 19 nt, Homo sapiens
auucauugaugccaagaaa

SEQ ID NO: 1161887 - RNA, 19 nt, Homo sapiens
guuguuaacaggccuuuau

SEQ ID NO: 1161888 - RNA, 19 nt, Homo sapiens
cagagaggauaugaugaga

SEQ ID NO: 1161889 - RNA, 19 nt, Homo sapiens
gacaguaugggucugaaga

SEQ ID NO: 1161890 - RNA, 19 nt, Homo sapiens
guugcacuauuuccaguug

SEQ ID NO: 1161891 - RNA, 19 nt, Homo sapiens
caggcagacuccacacaga

SEQ ID NO: 1161892 - RNA, 19 nt, Homo sapiens
gugguagucuggaguugau

SEQ ID NO: 1161893 - RNA, 19 nt, Homo sapiens
gggaagaaaggcaaagagu

SEQ ID NO: 1161894 - RNA, 19 nt, Homo sapiens
gggcuauuguguuuguugu

SEQ ID NO: 1161895 - RNA, 19 nt, Homo sapiens
ggagucauucccagauaau

SEQ ID NO: 1161896 - RNA, 19 nt, Homo sapiens
ugauguagggucaagguuu

SEQ ID NO: 1161897 - RNA, 19 nt, Homo sapiens
gcacugagguaacaucuaa

SEQ ID NO: 1161898 - RNA, 19 nt, Homo sapiens
gagaauacguuaauugcua

SEQ ID NO: 1161899 - RNA, 19 nt, Homo sapiens
gaaugaagguguacaucua

SEQ ID NO: 1161900 - RNA, 19 nt, Homo sapiens
cuaauacgaugucauguua

SEQ ID NO: 1161901 - RNA, 19 nt, Homo sapiens
gaugagcccuaauauguaa

SEQ ID NO: 1161902 - RNA, 19 nt, Homo sapiens
gcaguugccuuaccaguga

SEQ ID NO: 1161903 - RNA, 19 nt, Homo sapiens
gcccuaauauguaagauuu

SEQ ID NO: 1161904 - RNA, 19 nt, Homo sapiens
gaaaucaguccauaacauu

SEQ ID NO: 1161905 - RNA, 19 nt, Homo sapiens
ggaagcagaugugcacgua

SEQ ID NO: 1161906 - RNA, 19 nt, Homo sapiens
gcaaguauguauauaugug

SEQ ID NO: 1161907 - RNA, 19 nt, Homo sapiens
gaaaguuaccgaaagauug

SEQ ID NO: 1161908 - RNA, 19 nt, Homo sapiens
gaagaaacuugguaaucau

SEQ ID NO: 1161909 - RNA, 19 nt, Homo sapiens
ucauugcccuugugauuua

SEQ ID NO: 1161910 - RNA, 19 nt, Homo sapiens
gaaagagucucaguucagu

SEQ ID NO: 1161911 - RNA, 19 nt, Homo sapiens
gagaugugguucuuaaugu

SEQ ID NO: 1161912 - RNA, 19 nt, Homo sapiens
gaauggaugugagaaaugu

SEQ ID NO: 1161913 - RNA, 19 nt, Homo sapiens
acagagaugugguucuuaa

SEQ ID NO: 1161914 - RNA, 19 nt, Homo sapiens
agaagaaacuugguaauca

SEQ ID NO: 1161915 - RNA, 19 nt, Homo sapiens
gcagacacauugggaagaa

SEQ ID NO: 1161916 - RNA, 19 nt, Homo sapiens
cagauuaacuuccauaggu

SEQ ID NO: 1161917 - RNA, 19 nt, Homo sapiens
aaacagagaugugguucuu

SEQ ID NO: 1161918 - RNA, 19 nt, Homo sapiens
aaagaccacugcacucaaa

SEQ ID NO: 1161919 - RNA, 19 nt, Homo sapiens
gaaacuugguaaucauugu

SEQ ID NO: 1161920 - RNA, 19 nt, Homo sapiens
gaacaaaauugggaaagaa

SEQ ID NO: 1161921 - RNA, 19 nt, Homo sapiens
uaacuuccauagguacaua

SEQ ID NO: 1161922 - RNA, 19 nt, Homo sapiens
ggaauggaguggaugaucu

SEQ ID NO: 1161923 - RNA, 19 nt, Homo sapiens
cagaugaugagaagacuua

SEQ ID NO: 1161924 - RNA, 19 nt, Homo sapiens
uuucauauuugccuccuua

SEQ ID NO: 1161925 - RNA, 19 nt, Homo sapiens
gcuaaauaccuaucuaaug

SEQ ID NO: 1161926 - RNA, 19 nt, Homo sapiens
gugucuagguuuauucuaa

SEQ ID NO: 1161927 - RNA, 19 nt, Homo sapiens
caagauuggacacaaagua

SEQ ID NO: 1161928 - RNA, 19 nt, Homo sapiens
gagauauucuugagcuugu

SEQ ID NO: 1161929 - RNA, 19 nt, Homo sapiens
gcagaguucuuugcagaug

SEQ ID NO: 1161930 - RNA, 19 nt, Homo sapiens
ugaaaucaguccauaacau

SEQ ID NO: 1161931 - RNA, 19 nt, Homo sapiens
uaucaaagaccaagguauu

SEQ ID NO: 1161932 - RNA, 19 nt, Homo sapiens
ggagggagauauucuugag

SEQ ID NO: 1161933 - RNA, 19 nt, Homo sapiens
aagaugagcccuaauaugu

SEQ ID NO: 1161934 - RNA, 19 nt, Homo sapiens
guacuaaaauggaaagcua

SEQ ID NO: 1161935 - RNA, 19 nt, Homo sapiens
gacacaaaguagagaguga

SEQ ID NO: 1161936 - RNA, 19 nt, Homo sapiens
ucagaagccuuguuauuuu

SEQ ID NO: 1161937 - RNA, 19 nt, Homo sapiens
ggccagugcugcugaggaa

SEQ ID NO: 1161938 - RNA, 19 nt, Homo sapiens
ucacuuugauaccaagauu

SEQ ID NO: 1161939 - RNA, 19 nt, Homo sapiens
ggagagaggccggaaugaa

SEQ ID NO: 1161940 - RNA, 19 nt, Homo sapiens
caguauuuauccugguuua

SEQ ID NO: 1161941 - RNA, 19 nt, Homo sapiens
guccauaacauuaagauga

SEQ ID NO: 1161942 - RNA, 19 nt, Homo sapiens
ccuguagugucuagguuua

SEQ ID NO: 1161943 - RNA, 19 nt, Homo sapiens
uagcacaguuugagaauac

SEQ ID NO: 1161944 - RNA, 19 nt, Homo sapiens
aaaucauacucuacccuua

SEQ ID NO: 1161945 - RNA, 19 nt, Homo sapiens
aagaguaucugcagacaca

SEQ ID NO: 1161946 - RNA, 19 nt, Homo sapiens
aaguagagagugaaaguua

SEQ ID NO: 1161947 - RNA, 19 nt, Homo sapiens
caaaguagagagugaaagu

SEQ ID NO: 1161948 - RNA, 19 nt, Homo sapiens
gcuuguugauggucacuuu

SEQ ID NO: 1161949 - RNA, 19 nt, Homo sapiens
gaugugguucuuaauguuu

SEQ ID NO: 1161950 - RNA, 19 nt, Homo sapiens
gguauuuccuucugcuuca

SEQ ID NO: 1161951 - RNA, 19 nt, Homo sapiens
cagaagccuuguuauuuua

SEQ ID NO: 1161952 - RNA, 19 nt, Homo sapiens
gaaagaccacugcacucaa

SEQ ID NO: 1161953 - RNA, 19 nt, Homo sapiens
auaccuaucuaaugugcua

SEQ ID NO: 1161954 - RNA, 19 nt, Homo sapiens
agauuaacuuccauaggua

SEQ ID NO: 1161955 - RNA, 19 nt, Homo sapiens
gagugaaaguuaccgaaag

SEQ ID NO: 1161956 - RNA, 19 nt, Homo sapiens
gagagaggccggaaugaag

SEQ ID NO: 1161957 - RNA, 19 nt, Homo sapiens
guaguugguagaagaaauu

SEQ ID NO: 1161958 - RNA, 19 nt, Homo sapiens
ggaaugaagguguacaucu

SEQ ID NO: 1161959 - RNA, 19 nt, Homo sapiens
ggaauggaugugagaaaug

SEQ ID NO: 1161960 - RNA, 19 nt, Homo sapiens
acauuaagaugagcccuaa

SEQ ID NO: 1161961 - RNA, 19 nt, Homo sapiens
uaagaugagcccuaauaug

SEQ ID NO: 1161962 - RNA, 19 nt, Homo sapiens
gaaagcuaguuuugagaaa

SEQ ID NO: 1161963 - RNA, 19 nt, Homo sapiens
gguagaagaaauugcuaaa

SEQ ID NO: 1161964 - RNA, 19 nt, Homo sapiens
agaguucuuugcagaugua

SEQ ID NO: 1161965 - RNA, 19 nt, Homo sapiens
gggcaaaguguaguuggua

SEQ ID NO: 1161966 - RNA, 19 nt, Homo sapiens
gcucagauuaacuuccaua

SEQ ID NO: 1161967 - RNA, 19 nt, Homo sapiens
ugaaaguuaccgaaagauu

SEQ ID NO: 1161968 - RNA, 19 nt, Homo sapiens
uaaagaguaucugcagaca

SEQ ID NO: 1161969 - RNA, 19 nt, Homo sapiens
cuaauccugccacguguua

SEQ ID NO: 1161970 - RNA, 19 nt, Homo sapiens
cagcuguauuucauauuug

SEQ ID NO: 1161971 - RNA, 19 nt, Homo sapiens
cgaaagaccacugcacuca

SEQ ID NO: 1161972 - RNA, 19 nt, Homo sapiens
gaugauccaggccguggua

SEQ ID NO: 1161973 - RNA, 19 nt, Homo sapiens
ggaaagaaaacucacuuga

SEQ ID NO: 1161974 - RNA, 19 nt, Homo sapiens
gugcuauguuuaucaaauc

SEQ ID NO: 1161975 - RNA, 19 nt, Homo sapiens
caacgcaggauuaacagau

SEQ ID NO: 1161976 - RNA, 19 nt, Homo sapiens
agugaaaguuaccgaaaga

SEQ ID NO: 1161977 - RNA, 19 nt, Homo sapiens
ucagugaacacaaaacuua

SEQ ID NO: 1161978 - RNA, 19 nt, Homo sapiens
aaagauugcagacagcauu

SEQ ID NO: 1161979 - RNA, 19 nt, Homo sapiens
agaugucccuggaucgaaa

SEQ ID NO: 1161980 - RNA, 19 nt, Homo sapiens
uggaauggaugugagaaau

SEQ ID NO: 1161981 - RNA, 19 nt, Homo sapiens
caaaguguaguugguagaa

SEQ ID NO: 1161982 - RNA, 19 nt, Homo sapiens
gcaaaguguaguugguaga

SEQ ID NO: 1161983 - RNA, 19 nt, Homo sapiens
uaacagaugaugagaagac

SEQ ID NO: 1161984 - RNA, 19 nt, Homo sapiens
guugauggucacuuugaua

SEQ ID NO: 1161985 - RNA, 19 nt, Homo sapiens
uucagaagccuuguuauuu

SEQ ID NO: 1161986 - RNA, 19 nt, Homo sapiens
ugaggaaacaggcugaaga

SEQ ID NO: 1161987 - RNA, 19 nt, Homo sapiens
cgaagaaaauguuaaagag

SEQ ID NO: 1161988 - RNA, 19 nt, Homo sapiens
uuauucagaagccuuguua

SEQ ID NO: 1161989 - RNA, 19 nt, Homo sapiens
gaugagaagacuuacuaca

SEQ ID NO: 1161990 - RNA, 19 nt, Homo sapiens
guucuuugcagauguaguu

SEQ ID NO: 1161991 - RNA, 19 nt, Homo sapiens
uggaguggaugaucugcaa

SEQ ID NO: 1161992 - RNA, 19 nt, Homo sapiens
agaugagcccuaauaugua

SEQ ID NO: 1161993 - RNA, 19 nt, Homo sapiens
gccacguguuaucauuaua

SEQ ID NO: 1161994 - RNA, 19 nt, Homo sapiens
agaugugguucuuaauguu

SEQ ID NO: 1161995 - RNA, 19 nt, Homo sapiens
ucauauuugccuccuuaua

SEQ ID NO: 1161996 - RNA, 19 nt, Homo sapiens
gaagauuauaacagcugua

SEQ ID NO: 1161997 - RNA, 19 nt, Homo sapiens
ucacaucucuggaaauuua

SEQ ID NO: 1161998 - RNA, 19 nt, Homo sapiens
gcaccugucuggauuguuu

SEQ ID NO: 1161999 - RNA, 19 nt, Homo sapiens
uaagugagaugguaugaaa

SEQ ID NO: 1162000 - RNA, 19 nt, Homo sapiens
gagggaagaugaguuauuu

SEQ ID NO: 1162001 - RNA, 19 nt, Homo sapiens
gcuaauacccaguuacuua

SEQ ID NO: 1162002 - RNA, 19 nt, Homo sapiens
gaaccuauaucgagagugu

SEQ ID NO: 1162003 - RNA, 19 nt, Homo sapiens
uaaaugauguugagcagaa

SEQ ID NO: 1162004 - RNA, 19 nt, Homo sapiens
gaaguucugcuacauuaua

SEQ ID NO: 1162005 - RNA, 19 nt, Homo sapiens
gagaguguguguauaugua

SEQ ID NO: 1162006 - RNA, 19 nt, Homo sapiens
guacugcuguuucguauga

SEQ ID NO: 1162007 - RNA, 19 nt, Homo sapiens
guuacaaccugaaggaaua

SEQ ID NO: 1162008 - RNA, 19 nt, Homo sapiens
gaacacagacaaagugcua

SEQ ID NO: 1162009 - RNA, 19 nt, Homo sapiens
gcaccaaacugccucaauc

SEQ ID NO: 1162010 - RNA, 19 nt, Homo sapiens
ccucuaaucuggauguuaa

SEQ ID NO: 1162011 - RNA, 19 nt, Homo sapiens
cuagaccucugguuaauuu

SEQ ID NO: 1162012 - RNA, 19 nt, Homo sapiens
ggucaguaguuucauguuu

SEQ ID NO: 1162013 - RNA, 19 nt, Homo sapiens
gcagggaggugaauacucu

SEQ ID NO: 1162014 - RNA, 19 nt, Homo sapiens
uaaauggcauggaguauag

SEQ ID NO: 1162015 - RNA, 19 nt, Homo sapiens
ggacacaacacagauaauu

SEQ ID NO: 1162016 - RNA, 19 nt, Homo sapiens
gaaguacugcuguuucgua

SEQ ID NO: 1162017 - RNA, 19 nt, Homo sapiens
gcagaauguuguacuugaa

SEQ ID NO: 1162018 - RNA, 19 nt, Homo sapiens
gggaagaugaguuauuuaa

SEQ ID NO: 1162019 - RNA, 19 nt, Homo sapiens
gaucagaaagugacauuug

SEQ ID NO: 1162020 - RNA, 19 nt, Homo sapiens
ugacacauaugaacacaga

SEQ ID NO: 1162021 - RNA, 19 nt, Homo sapiens
ggaggaacacuaugguuaa

SEQ ID NO: 1162022 - RNA, 19 nt, Homo sapiens
gggaggaacacuaugguua

SEQ ID NO: 1162023 - RNA, 19 nt, Homo sapiens
gaagaagacaccucuaauc

SEQ ID NO: 1162024 - RNA, 19 nt, Homo sapiens
ggaaagugcucagugaagu

SEQ ID NO: 1162025 - RNA, 19 nt, Homo sapiens
gguuaacccucucuugauu

SEQ ID NO: 1162026 - RNA, 19 nt, Homo sapiens
gaccucugguuaauuuaua

SEQ ID NO: 1162027 - RNA, 19 nt, Homo sapiens
guaaauggcauggaguaua

SEQ ID NO: 1162028 - RNA, 19 nt, Homo sapiens
ugaauacagucucaucuug

SEQ ID NO: 1162029 - RNA, 19 nt, Homo sapiens
gcacacccaugcacacuca

SEQ ID NO: 1162030 - RNA, 19 nt, Homo sapiens
gaacgucagugagaaaugg

SEQ ID NO: 1162031 - RNA, 19 nt, Homo sapiens
gaaagugcucagugaagua

SEQ ID NO: 1162032 - RNA, 19 nt, Homo sapiens
cagaugaaaucgauauuag

SEQ ID NO: 1162033 - RNA, 19 nt, Homo sapiens
aagcaggacuccagauaaa

SEQ ID NO: 1162034 - RNA, 19 nt, Homo sapiens
cagagaagaugucaaaguc

SEQ ID NO: 1162035 - RNA, 19 nt, Homo sapiens
ucuaguggguugaccuuua

SEQ ID NO: 1162036 - RNA, 19 nt, Homo sapiens
ucugaaagcuuuauacagu

SEQ ID NO: 1162037 - RNA, 19 nt, Homo sapiens
gguggaaagugcucaguga

SEQ ID NO: 1162038 - RNA, 19 nt, Homo sapiens
ggucaaccaugguaacaau

SEQ ID NO: 1162039 - RNA, 19 nt, Homo sapiens
aaagucacauccacaacua

SEQ ID NO: 1162040 - RNA, 19 nt, Homo sapiens
cccaguuacuuaugauuua

SEQ ID NO: 1162041 - RNA, 19 nt, Homo sapiens
gggagcaccugucuggauu

SEQ ID NO: 1162042 - RNA, 19 nt, Homo sapiens
gcccaguucugaaagcuuu

SEQ ID NO: 1162043 - RNA, 19 nt, Homo sapiens
gaauugaugucggucauag

SEQ ID NO: 1162044 - RNA, 19 nt, Homo sapiens
cagguuauacuuuagguua

SEQ ID NO: 1162045 - RNA, 19 nt, Homo sapiens
ggaggugaauacucuugaa

SEQ ID NO: 1162046 - RNA, 19 nt, Homo sapiens
gaagaaguacugcuguuuc

SEQ ID NO: 1162047 - RNA, 19 nt, Homo sapiens
caucgucgcuggcauucaa

SEQ ID NO: 1162048 - RNA, 19 nt, Homo sapiens
ggaguauagugcaaauuca

SEQ ID NO: 1162049 - RNA, 19 nt, Homo sapiens
gcacacucaugcacacaga

SEQ ID NO: 1162050 - RNA, 19 nt, Homo sapiens
caauaguucuuagcuuuga

SEQ ID NO: 1162051 - RNA, 19 nt, Homo sapiens
ggaagaaguacugcuguuu

SEQ ID NO: 1162052 - RNA, 19 nt, Homo sapiens
ggccuucucuccagacuau

SEQ ID NO: 1162053 - RNA, 19 nt, Homo sapiens
ugaaagcuuuauacaguug

SEQ ID NO: 1162054 - RNA, 19 nt, Homo sapiens
augaaguucugcuacauua

SEQ ID NO: 1162055 - RNA, 19 nt, Homo sapiens
cuaguggguugaccuuuaa

SEQ ID NO: 1162056 - RNA, 19 nt, Homo sapiens
uaagcgauuugaaacacua

SEQ ID NO: 1162057 - RNA, 19 nt, Homo sapiens
ggagggaagaugaguuauu

SEQ ID NO: 1162058 - RNA, 19 nt, Homo sapiens
ggaaaagcguggccacaaa

SEQ ID NO: 1162059 - RNA, 19 nt, Homo sapiens
gaaugaaguucugcuacau

SEQ ID NO: 1162060 - RNA, 19 nt, Homo sapiens
gcgccuggcuuaccuaucu

SEQ ID NO: 1162061 - RNA, 19 nt, Homo sapiens
gacacaacacagauaauuu

SEQ ID NO: 1162062 - RNA, 19 nt, Homo sapiens
guucuuagcuuugaaacuc

SEQ ID NO: 1162063 - RNA, 19 nt, Homo sapiens
gaggagcucucaauuuuau

SEQ ID NO: 1162064 - RNA, 19 nt, Homo sapiens
aaagaaauccaguuugugu

SEQ ID NO: 1162065 - RNA, 19 nt, Homo sapiens
uaaagccaguuagauagaa

SEQ ID NO: 1162066 - RNA, 19 nt, Homo sapiens
ucacauccacaacuaauga

SEQ ID NO: 1162067 - RNA, 19 nt, Homo sapiens
aggccaccauuauaauuua

SEQ ID NO: 1162068 - RNA, 19 nt, Homo sapiens
guaaagccaguuagauaga

SEQ ID NO: 1162069 - RNA, 19 nt, Homo sapiens
ccaaacugccucaauccua

SEQ ID NO: 1162070 - RNA, 19 nt, Homo sapiens
agaaaugggugccggagau

SEQ ID NO: 1162071 - RNA, 19 nt, Homo sapiens
agaaauccaguuuguguuu

SEQ ID NO: 1162072 - RNA, 19 nt, Homo sapiens
uguauuugcuguugauuca

SEQ ID NO: 1162073 - RNA, 19 nt, Homo sapiens
gaacacaaaacuugaaaga

SEQ ID NO: 1162074 - RNA, 19 nt, Homo sapiens
auaguuuccugaagcauuu

SEQ ID NO: 1162075 - RNA, 19 nt, Homo sapiens
ggugaauacucuugaaagg

SEQ ID NO: 1162076 - RNA, 19 nt, Homo sapiens
gugagaugguaugaaauaa

SEQ ID NO: 1162077 - RNA, 19 nt, Homo sapiens
aagguacgauuauacuuga

SEQ ID NO: 1162078 - RNA, 19 nt, Homo sapiens
ggguugaccuuuaaaugca

SEQ ID NO: 1162079 - RNA, 19 nt, Homo sapiens
gagaucagaaagugacauu

SEQ ID NO: 1162080 - RNA, 19 nt, Homo sapiens
guucuagaccucugguuaa

SEQ ID NO: 1162081 - RNA, 19 nt, Homo sapiens
guaggccaccauuauaauu

SEQ ID NO: 1162082 - RNA, 19 nt, Homo sapiens
caacacauuggaauugaug

SEQ ID NO: 1162083 - RNA, 19 nt, Homo sapiens
guuaacccucucuugauua

SEQ ID NO: 1162084 - RNA, 19 nt, Homo sapiens
uaggaggagcucucaauuu

SEQ ID NO: 1162085 - RNA, 19 nt, Homo sapiens
guaugaugcuggcaagaca

SEQ ID NO: 1162086 - RNA, 19 nt, Homo sapiens
ccaaagaagucuaaaagca

SEQ ID NO: 1162087 - RNA, 19 nt, Homo sapiens
caaagccgccuccuacauc

SEQ ID NO: 1162088 - RNA, 19 nt, Homo sapiens
caaguguaggccaccauua

SEQ ID NO: 1162089 - RNA, 19 nt, Homo sapiens
cacuuuggcugaacuacaa

SEQ ID NO: 1162090 - RNA, 19 nt, Homo sapiens
aaagguacgauuauacuug

SEQ ID NO: 1162091 - RNA, 19 nt, Homo sapiens
acacaaaacuugaaagaag

SEQ ID NO: 1162092 - RNA, 19 nt, Homo sapiens
ggaauugaugucggucaua

SEQ ID NO: 1162093 - RNA, 19 nt, Homo sapiens
cuguaaagccaguuagaua

SEQ ID NO: 1162094 - RNA, 19 nt, Homo sapiens
gaaaugggugccggagauu

SEQ ID NO: 1162095 - RNA, 19 nt, Homo sapiens
uuaagucggccaagaugua

SEQ ID NO: 1162096 - RNA, 19 nt, Homo sapiens
aagcaaguguuggucagua

SEQ ID NO: 1162097 - RNA, 19 nt, Homo sapiens
guaaugaacuugcuacuua

SEQ ID NO: 1162098 - RNA, 19 nt, Homo sapiens
guuaagaccucgacauuug

SEQ ID NO: 1162099 - RNA, 19 nt, Homo sapiens
guucugagauacuucaaua

SEQ ID NO: 1162100 - RNA, 19 nt, Homo sapiens
ggaaugaggucaccaagag

SEQ ID NO: 1162101 - RNA, 19 nt, Homo sapiens
gaacuugugccuaauuuga

SEQ ID NO: 1162102 - RNA, 19 nt, Homo sapiens
gcagggaugugaccuaugu

SEQ ID NO: 1162103 - RNA, 19 nt, Homo sapiens
ccaagagagugaauguaua

SEQ ID NO: 1162104 - RNA, 19 nt, Homo sapiens
gaugugaccuauguaauga

SEQ ID NO: 1162105 - RNA, 19 nt, Homo sapiens
gcaguuaucccuuauggaa

SEQ ID NO: 1162106 - RNA, 19 nt, Homo sapiens
uaaagagacugagaaagug

SEQ ID NO: 1162107 - RNA, 19 nt, Homo sapiens
aagaugcaguuaucccuua

SEQ ID NO: 1162108 - RNA, 19 nt, Homo sapiens
cuaaagagacugagaaagu

SEQ ID NO: 1162109 - RNA, 19 nt, Homo sapiens
caagagagugaauguauau

SEQ ID NO: 1162110 - RNA, 19 nt, Homo sapiens
ggaugugaccuauguaaug

SEQ ID NO: 1162111 - RNA, 19 nt, Homo sapiens
ugaaggagaucucuagaac

SEQ ID NO: 1162112 - RNA, 19 nt, Homo sapiens
agaaagugcugguggugaa

SEQ ID NO: 1162113 - RNA, 19 nt, Homo sapiens
ggaaauuugugaucaucuc

SEQ ID NO: 1162114 - RNA, 19 nt, Homo sapiens
aaaccugaguucugcauga

SEQ ID NO: 1162115 - RNA, 19 nt, Homo sapiens
gaagccagcuaaagagacu

SEQ ID NO: 1162116 - RNA, 19 nt, Homo sapiens
gaaagaugauaagaugaag

SEQ ID NO: 1162117 - RNA, 19 nt, Homo sapiens
gaacuuccucgaacuaaag

SEQ ID NO: 1162118 - RNA, 19 nt, Homo sapiens
ccucaaagaaagaugauaa

SEQ ID NO: 1162119 - RNA, 19 nt, Homo sapiens
gcugagucguuucuaguug

SEQ ID NO: 1162120 - RNA, 19 nt, Homo sapiens
aagaacuugugccuaauuu

SEQ ID NO: 1162121 - RNA, 19 nt, Homo sapiens
ugaccuauguaaugaacuu

SEQ ID NO: 1162122 - RNA, 19 nt, Homo sapiens
guuaguggauucacaagca

SEQ ID NO: 1162123 - RNA, 19 nt, Homo sapiens
uaauaucuaccuuguguga

SEQ ID NO: 1162124 - RNA, 19 nt, Homo sapiens
cgacauuugcucacagaaa

SEQ ID NO: 1162125 - RNA, 19 nt, Homo sapiens
gacauuugcucacagaaaa

SEQ ID NO: 1162126 - RNA, 19 nt, Homo sapiens
aaggagaucucuagaacca

SEQ ID NO: 1162127 - RNA, 19 nt, Homo sapiens
gcagaagccagcuaaagag

SEQ ID NO: 1162128 - RNA, 19 nt, Homo sapiens
auaucuaccuugugugauu

SEQ ID NO: 1162129 - RNA, 19 nt, Homo sapiens
gcugaguucugagauacuu

SEQ ID NO: 1162130 - RNA, 19 nt, Homo sapiens
uccaagggcugaguucuga

SEQ ID NO: 1162131 - RNA, 19 nt, Homo sapiens
cagaagaugaugcugagaa

SEQ ID NO: 1162132 - RNA, 19 nt, Homo sapiens
aaaagucgcugagucguuu

SEQ ID NO: 1162133 - RNA, 19 nt, Homo sapiens
caguuaagaccucgacauu

SEQ ID NO: 1162134 - RNA, 19 nt, Homo sapiens
cucaaugguugggaaauuu

SEQ ID NO: 1162135 - RNA, 19 nt, Homo sapiens
gugccuaauuugagucaug

SEQ ID NO: 1162136 - RNA, 19 nt, Homo sapiens
gggcugaguucugagauac

SEQ ID NO: 1162137 - RNA, 19 nt, Homo sapiens
guugggaaauuugugauca

SEQ ID NO: 1162138 - RNA, 19 nt, Homo sapiens
gagugaauguauauaaagc

SEQ ID NO: 1162139 - RNA, 19 nt, Homo sapiens
acucaaugguugggaaauu

SEQ ID NO: 1162140 - RNA, 19 nt, Homo sapiens
gaagcagaagccagcuaaa

SEQ ID NO: 1162141 - RNA, 19 nt, Homo sapiens
agaagaugaugcugagaag

SEQ ID NO: 1162142 - RNA, 19 nt, Homo sapiens
gaaugaggucaccaagaga

SEQ ID NO: 1162143 - RNA, 19 nt, Homo sapiens
gaucaugcucuguguuagu

SEQ ID NO: 1162144 - RNA, 19 nt, Homo sapiens
agaagcagaagccagcuaa

SEQ ID NO: 1162145 - RNA, 19 nt, Homo sapiens
gagaagcagaagccagcua

SEQ ID NO: 1162146 - RNA, 19 nt, Homo sapiens
augauaagaugaaggagau

SEQ ID NO: 1162147 - RNA, 19 nt, Homo sapiens
ccuguacuccucaaagaaa

SEQ ID NO: 1162148 - RNA, 19 nt, Homo sapiens
aaccuguacuccucaaaga

SEQ ID NO: 1162149 - RNA, 19 nt, Homo sapiens
cagcuaaagagacugagaa

SEQ ID NO: 1162150 - RNA, 19 nt, Homo sapiens
ucuguaaaguggaaaugau

SEQ ID NO: 1162151 - RNA, 19 nt, Homo sapiens
uaacaaugaauacgucucu

SEQ ID NO: 1162152 - RNA, 19 nt, Homo sapiens
caucaucaucuucuucaau

SEQ ID NO: 1162153 - RNA, 19 nt, Homo sapiens
gcucuguguuaguggauuc

SEQ ID NO: 1162154 - RNA, 19 nt, Homo sapiens
guggguguaugcagacuca

SEQ ID NO: 1162155 - RNA, 19 nt, Homo sapiens
gaugaaggagaucucuaga

SEQ ID NO: 1162156 - RNA, 19 nt, Homo sapiens
cugcaucuguaaaguggaa

SEQ ID NO: 1162157 - RNA, 19 nt, Homo sapiens
acaaugaauacgucucuug

SEQ ID NO: 1162158 - RNA, 19 nt, Homo sapiens
cagaagccagcuaaagaga

SEQ ID NO: 1162159 - RNA, 19 nt, Homo sapiens
gcaguuaagaccucgacau

SEQ ID NO: 1162160 - RNA, 19 nt, Homo sapiens
gaaauuugugaucaucucu

SEQ ID NO: 1162161 - RNA, 19 nt, Homo sapiens
aagcaaagaggguguccaa

SEQ ID NO: 1162162 - RNA, 19 nt, Homo sapiens
cuguaaaguggaaaugaua

SEQ ID NO: 1162163 - RNA, 19 nt, Homo sapiens
cugcaugacugagcucugu

SEQ ID NO: 1162164 - RNA, 19 nt, Homo sapiens
cuuauugccucaucaucau

SEQ ID NO: 1162165 - RNA, 19 nt, Homo sapiens
ugaacuugcuacuuauugc

SEQ ID NO: 1162166 - RNA, 19 nt, Homo sapiens
caagggcugaguucugaga

SEQ ID NO: 1162167 - RNA, 19 nt, Homo sapiens
ucaaugguugggaaauuug

SEQ ID NO: 1162168 - RNA, 19 nt, Homo sapiens
aagaugauaagaugaagga

SEQ ID NO: 1162169 - RNA, 19 nt, Homo sapiens
caaccuguacuccucaaag

SEQ ID NO: 1162170 - RNA, 19 nt, Homo sapiens
ccaggaaaaucaacagauc

SEQ ID NO: 1162171 - RNA, 19 nt, Homo sapiens
gcaaaccugaguucugcau

SEQ ID NO: 1162172 - RNA, 19 nt, Homo sapiens
agggcugaguucugagaua

SEQ ID NO: 1162173 - RNA, 19 nt, Homo sapiens
accaagagagugaauguau

SEQ ID NO: 1162174 - RNA, 19 nt, Homo sapiens
caucuucuucaaugacaaa

SEQ ID NO: 1162175 - RNA, 19 nt, Homo sapiens
aucaucaucuucuucaaug

SEQ ID NO: 1162176 - RNA, 19 nt, Homo sapiens
gcuacuuauugccucauca

SEQ ID NO: 1162177 - RNA, 19 nt, Homo sapiens
cugagauacuucaauagca

SEQ ID NO: 1162178 - RNA, 19 nt, Homo sapiens
agcagaagccagcuaaaga

SEQ ID NO: 1162179 - RNA, 19 nt, Homo sapiens
gggaugugaccuauguaau

SEQ ID NO: 1162180 - RNA, 19 nt, Homo sapiens
uaucuaccuugugugauuc

SEQ ID NO: 1162181 - RNA, 19 nt, Homo sapiens
gcucugucacucaaugguu

SEQ ID NO: 1162182 - RNA, 19 nt, Homo sapiens
uguuacagcaaccugauuu

SEQ ID NO: 1162183 - RNA, 19 nt, Homo sapiens
ccuggaagaauuaaauaca

SEQ ID NO: 1162184 - RNA, 19 nt, Homo sapiens
gaagcaugagacggaauga

SEQ ID NO: 1162185 - RNA, 19 nt, Homo sapiens
ugaagcaugagacggaaug

SEQ ID NO: 1162186 - RNA, 19 nt, Homo sapiens
uuaguggauucacaagcaa

SEQ ID NO: 1162187 - RNA, 19 nt, Homo sapiens
cugagucguuucuaguugu

SEQ ID NO: 1162188 - RNA, 19 nt, Homo sapiens
uugcagggaugugaccuau

SEQ ID NO: 1162189 - RNA, 19 nt, Homo sapiens
caacugggcuccucuguaa

SEQ ID NO: 1162190 - RNA, 19 nt, Homo sapiens
gaacacaucugcuggaagu

SEQ ID NO: 1162191 - RNA, 19 nt, Homo sapiens
gacauuacauccacuuaua

SEQ ID NO: 1162192 - RNA, 19 nt, Homo sapiens
gcaaggcucugaccaaguu

SEQ ID NO: 1162193 - RNA, 19 nt, Homo sapiens
gaacauuuauucucucaug

SEQ ID NO: 1162194 - RNA, 19 nt, Homo sapiens
uuacaaagcucauaaugga

SEQ ID NO: 1162195 - RNA, 19 nt, Homo sapiens
gagaagugcugaucaagga

SEQ ID NO: 1162196 - RNA, 19 nt, Homo sapiens
aaucacagaugaccuauuu

SEQ ID NO: 1162197 - RNA, 19 nt, Homo sapiens
gaagcuuucuuucaaggua

SEQ ID NO: 1162198 - RNA, 19 nt, Homo sapiens
uuaaaggacuuguaccaua

SEQ ID NO: 1162199 - RNA, 19 nt, Homo sapiens
gaacauccccgauuacuua

SEQ ID NO: 1162200 - RNA, 19 nt, Homo sapiens
ggauauaccuggcacaauc

SEQ ID NO: 1162201 - RNA, 19 nt, Homo sapiens
uaaagcaaaucacagauga

SEQ ID NO: 1162202 - RNA, 19 nt, Homo sapiens
gggaaugacuguuauaaag

SEQ ID NO: 1162203 - RNA, 19 nt, Homo sapiens
gggcuccucuguaaauaua

SEQ ID NO: 1162204 - RNA, 19 nt, Homo sapiens
gaacugaucgacaggauga

SEQ ID NO: 1162205 - RNA, 19 nt, Homo sapiens
ucaagucucugucaaguga

SEQ ID NO: 1162206 - RNA, 19 nt, Homo sapiens
gaaugaagaagaugcuaua

SEQ ID NO: 1162207 - RNA, 19 nt, Homo sapiens
gacaauagccgagcccuua

SEQ ID NO: 1162208 - RNA, 19 nt, Homo sapiens
cgauuuggcucaggauuua

SEQ ID NO: 1162209 - RNA, 19 nt, Homo sapiens
gaugaucucaguguuauua

SEQ ID NO: 1162210 - RNA, 19 nt, Homo sapiens
ccagaacccugcugacuga

SEQ ID NO: 1162211 - RNA, 19 nt, Homo sapiens
gcaaaucacagaugaccua

SEQ ID NO: 1162212 - RNA, 19 nt, Homo sapiens
aaacugagcauucuugauu

SEQ ID NO: 1162213 - RNA, 19 nt, Homo sapiens
ggacgaagacucagcaguu

SEQ ID NO: 1162214 - RNA, 19 nt, Homo sapiens
gaaggagacuuggacgauu

SEQ ID NO: 1162215 - RNA, 19 nt, Homo sapiens
ggaacuauccucuauuuca

SEQ ID NO: 1162216 - RNA, 19 nt, Homo sapiens
guggaacuauccucuauuu

SEQ ID NO: 1162217 - RNA, 19 nt, Homo sapiens
gcaauuugaugaugaugau

SEQ ID NO: 1162218 - RNA, 19 nt, Homo sapiens
cucagaaucuucacaauuu

SEQ ID NO: 1162219 - RNA, 19 nt, Homo sapiens
gggaauggauuacauaguc

SEQ ID NO: 1162220 - RNA, 19 nt, Homo sapiens
gccaagaauuugaagcuuu

SEQ ID NO: 1162221 - RNA, 19 nt, Homo sapiens
ggucaucacuugugcaauc

SEQ ID NO: 1162222 - RNA, 19 nt, Homo sapiens
ccuguaaccucuuucuuaa

SEQ ID NO: 1162223 - RNA, 19 nt, Homo sapiens
gaugaugaucucaguguua

SEQ ID NO: 1162224 - RNA, 19 nt, Homo sapiens
gaaaucgugugagcaguga

SEQ ID NO: 1162225 - RNA, 19 nt, Homo sapiens
gcacaucacaucuguaaca

SEQ ID NO: 1162226 - RNA, 19 nt, Homo sapiens
gaacugcccagaaaucgaa

SEQ ID NO: 1162227 - RNA, 19 nt, Homo sapiens
gaaugggaaugacuguuau

SEQ ID NO: 1162228 - RNA, 19 nt, Homo sapiens
guacagggaaugaagagua

SEQ ID NO: 1162229 - RNA, 19 nt, Homo sapiens
gcaccuguaagaacauuua

SEQ ID NO: 1162230 - RNA, 19 nt, Homo sapiens
ccacaaguuugauuucgaa

SEQ ID NO: 1162231 - RNA, 19 nt, Homo sapiens
gaaugacuguuauaaagca

SEQ ID NO: 1162232 - RNA, 19 nt, Homo sapiens
ggaaagaacccucugaaaa

SEQ ID NO: 1162233 - RNA, 19 nt, Homo sapiens
gcucauaauggauaacaua

SEQ ID NO: 1162234 - RNA, 19 nt, Homo sapiens
gacgaagacucagcaguuu

SEQ ID NO: 1162235 - RNA, 19 nt, Homo sapiens
caaguguuauccaaguuaa

SEQ ID NO: 1162236 - RNA, 19 nt, Homo sapiens
gaacuauccucuauuucag

SEQ ID NO: 1162237 - RNA, 19 nt, Homo sapiens
gaguggaacuauccucuau

SEQ ID NO: 1162238 - RNA, 19 nt, Homo sapiens
gaaaucgaagcccugauaa

SEQ ID NO: 1162239 - RNA, 19 nt, Homo sapiens
gugaucaacuccuggauau

SEQ ID NO: 1162240 - RNA, 19 nt, Homo sapiens
gaacagcucaccgcacuga

SEQ ID NO: 1162241 - RNA, 19 nt, Homo sapiens
uaacaaaccugaaaaccuu

SEQ ID NO: 1162242 - RNA, 19 nt, Homo sapiens
ccauaaacaucaauuccuu

SEQ ID NO: 1162243 - RNA, 19 nt, Homo sapiens
agacaggaaucuuugcaaa

SEQ ID NO: 1162244 - RNA, 19 nt, Homo sapiens
guacacagcaggacgaaga

SEQ ID NO: 1162245 - RNA, 19 nt, Homo sapiens
ggaauggauuacauaguca

SEQ ID NO: 1162246 - RNA, 19 nt, Homo sapiens
ugaagaaccuuacaaagcu

SEQ ID NO: 1162247 - RNA, 19 nt, Homo sapiens
gggaucaccuuugaccuuu

SEQ ID NO: 1162248 - RNA, 19 nt, Homo sapiens
ccaagaauuugaagcuuuc

SEQ ID NO: 1162249 - RNA, 19 nt, Homo sapiens
aaacaccacugagcaagaa

SEQ ID NO: 1162250 - RNA, 19 nt, Homo sapiens
gagaacacaucugcuggaa

SEQ ID NO: 1162251 - RNA, 19 nt, Homo sapiens
cagaugaccuauuuguaug

SEQ ID NO: 1162252 - RNA, 19 nt, Homo sapiens
ggaaugaagaguaguuuua

SEQ ID NO: 1162253 - RNA, 19 nt, Homo sapiens
ggaugaacgugcuagaaca

SEQ ID NO: 1162254 - RNA, 19 nt, Homo sapiens
gcucagaaucuucacaauu

SEQ ID NO: 1162255 - RNA, 19 nt, Homo sapiens
caaagcucauaauggauaa

SEQ ID NO: 1162256 - RNA, 19 nt, Homo sapiens
ugacuucuuugaacauuug

SEQ ID NO: 1162257 - RNA, 19 nt, Homo sapiens
acaaagcucauaauggaua

SEQ ID NO: 1162258 - RNA, 19 nt, Homo sapiens
caucacaucuguaacaaac

SEQ ID NO: 1162259 - RNA, 19 nt, Homo sapiens
uaaaggacuuguaccauac

SEQ ID NO: 1162260 - RNA, 19 nt, Homo sapiens
agaaugggaaugacuguua

SEQ ID NO: 1162261 - RNA, 19 nt, Homo sapiens
gagagggaauggauuacau

SEQ ID NO: 1162262 - RNA, 19 nt, Homo sapiens
gaaaagcaccuucacagaa

SEQ ID NO: 1162263 - RNA, 19 nt, Homo sapiens
gggaagcuuucauccagaa

SEQ ID NO: 1162264 - RNA, 19 nt, Homo sapiens
gcagggcuguaucuuuguu

SEQ ID NO: 1162265 - RNA, 19 nt, Homo sapiens
gaacauuugcccaauugug

SEQ ID NO: 1162266 - RNA, 19 nt, Homo sapiens
ggacauuacauccacuuau

SEQ ID NO: 1162267 - RNA, 19 nt, Homo sapiens
gguucaagccaaaguauaa

SEQ ID NO: 1162268 - RNA, 19 nt, Homo sapiens
ucuaugaucuguugauaca

SEQ ID NO: 1162269 - RNA, 19 nt, Homo sapiens
agaaaucgaagcccugaua

SEQ ID NO: 1162270 - RNA, 19 nt, Homo sapiens
gaauaagcaagauaucaga

SEQ ID NO: 1162271 - RNA, 19 nt, Homo sapiens
caccagggcuguuaugaag

SEQ ID NO: 1162272 - RNA, 19 nt, Homo sapiens
ucgaagcccugauaaagga

SEQ ID NO: 1162273 - RNA, 19 nt, Homo sapiens
gaaguccucugggauucaa

SEQ ID NO: 1162274 - RNA, 19 nt, Homo sapiens
ccugugaccuugaagaaau

SEQ ID NO: 1162275 - RNA, 19 nt, Homo sapiens
gagaguacauccaaaucag

SEQ ID NO: 1162276 - RNA, 19 nt, Homo sapiens
gaaauucugaaagccauaa

SEQ ID NO: 1162277 - RNA, 19 nt, Homo sapiens
gcaccucgcagcaguguau

SEQ ID NO: 1162278 - RNA, 19 nt, Homo sapiens
gaaggcuuguugcuccaaa

SEQ ID NO: 1162279 - RNA, 19 nt, Homo sapiens
ggaaggaccaacaccauca

SEQ ID NO: 1162280 - RNA, 19 nt, Homo sapiens
aaggagacuuggacgauuu

SEQ ID NO: 1162281 - RNA, 19 nt, Homo sapiens
ccuuugaccuuuccauuug

SEQ ID NO: 1162282 - RNA, 19 nt, Homo sapiens
ccaaguguuauccaaguua

SEQ ID NO: 1162283 - RNA, 19 nt, Homo sapiens
ggaaaaggcugcagaagac

SEQ ID NO: 1162284 - RNA, 19 nt, Homo sapiens
ugaaagccauaaacaucaa

SEQ ID NO: 1162285 - RNA, 19 nt, Homo sapiens
gcgaagaaguaaacaucau

SEQ ID NO: 1162286 - RNA, 19 nt, Homo sapiens
acugagcauucuugauuua

SEQ ID NO: 1162287 - RNA, 19 nt, Homo sapiens
caagagaguacauccaaau

SEQ ID NO: 1162288 - RNA, 19 nt, Homo sapiens
agacucagcaguuuauuga

SEQ ID NO: 1162289 - RNA, 19 nt, Homo sapiens
gaucaaaguugucaugaau

SEQ ID NO: 1162290 - RNA, 19 nt, Homo sapiens
guuacaaacuccauuacua

SEQ ID NO: 1162291 - RNA, 19 nt, Homo sapiens
ccaaggaggaggaguauaa

SEQ ID NO: 1162292 - RNA, 19 nt, Homo sapiens
cgacuggacuccuauguuc

SEQ ID NO: 1162293 - RNA, 19 nt, Homo sapiens
ggaucaaaguugucaugaa

SEQ ID NO: 1162294 - RNA, 19 nt, Homo sapiens
ccacugggaucaaaguugu

SEQ ID NO: 1162295 - RNA, 19 nt, Homo sapiens
caaacuagccguuacaaac

SEQ ID NO: 1162296 - RNA, 19 nt, Homo sapiens
ucaaaguugucaugaauac

SEQ ID NO: 1162297 - RNA, 19 nt, Homo sapiens
ccacaaccuguaccuguuu

SEQ ID NO: 1162298 - RNA, 19 nt, Homo sapiens
ucuauccgcucguuuguca

SEQ ID NO: 1162299 - RNA, 19 nt, Homo sapiens
gcgaauggcaccgcaagaa

SEQ ID NO: 1162300 - RNA, 19 nt, Homo sapiens
gcucccgacuggacuccua

SEQ ID NO: 1162301 - RNA, 19 nt, Homo sapiens
ggaggaguauaagcugaug

SEQ ID NO: 1162302 - RNA, 19 nt, Homo sapiens
caagaagcaagcagggauu

SEQ ID NO: 1162303 - RNA, 19 nt, Homo sapiens
gccguuacaaacuccauua

SEQ ID NO: 1162304 - RNA, 19 nt, Homo sapiens
ccaaacuagccguuacaaa

SEQ ID NO: 1162305 - RNA, 19 nt, Homo sapiens
ugaccggaauggagugugu

SEQ ID NO: 1162306 - RNA, 19 nt, Homo sapiens
guaccuguuugaccggaau

SEQ ID NO: 1162307 - RNA, 19 nt, Homo sapiens
uuccuggccuuccaaacua

SEQ ID NO: 1162308 - RNA, 19 nt, Homo sapiens
aaaguugucaugaauacug

SEQ ID NO: 1162309 - RNA, 19 nt, Homo sapiens
aaacuagccguuacaaacu

SEQ ID NO: 1162310 - RNA, 19 nt, Homo sapiens
acgggaugcucuucucuau

SEQ ID NO: 1162311 - RNA, 19 nt, Homo sapiens
uuacaaacuccauuacuac

SEQ ID NO: 1162312 - RNA, 19 nt, Homo sapiens
uccacaaccuguaccuguu

SEQ ID NO: 1162313 - RNA, 19 nt, Homo sapiens
gagcugguggugaagaauc

SEQ ID NO: 1162314 - RNA, 19 nt, Homo sapiens
cacaaccuguaccuguuug

SEQ ID NO: 1162315 - RNA, 19 nt, Homo sapiens
gggaucaaaguugucauga

SEQ ID NO: 1162316 - RNA, 19 nt, Homo sapiens
gcucguuugucagcaagau

SEQ ID NO: 1162317 - RNA, 19 nt, Homo sapiens
aggaguauaagcugaugua

SEQ ID NO: 1162318 - RNA, 19 nt, Homo sapiens
uggagcugguggugaagaa

SEQ ID NO: 1162319 - RNA, 19 nt, Homo sapiens
ugucugcacuacagcgaau

SEQ ID NO: 1162320 - RNA, 19 nt, Homo sapiens
cgaauggcaccgcaagaag

SEQ ID NO: 1162321 - RNA, 19 nt, Homo sapiens
aaguugucaugaauacuga

SEQ ID NO: 1162322 - RNA, 19 nt, Homo sapiens
caaauuaacugauguguug

SEQ ID NO: 1162323 - RNA, 19 nt, Homo sapiens
uaaaccagcuucauuagua

SEQ ID NO: 1162324 - RNA, 19 nt, Homo sapiens
gaagacauuuggaaacuaa

SEQ ID NO: 1162325 - RNA, 19 nt, Homo sapiens
gcagaaacaugaaauugaa

SEQ ID NO: 1162326 - RNA, 19 nt, Homo sapiens
ucagaagguuggaauauua

SEQ ID NO: 1162327 - RNA, 19 nt, Homo sapiens
guacagcuaucaaacagua

SEQ ID NO: 1162328 - RNA, 19 nt, Homo sapiens
ggaucuagcugcugacauu

SEQ ID NO: 1162329 - RNA, 19 nt, Homo sapiens
uaacugauguguugcugua

SEQ ID NO: 1162330 - RNA, 19 nt, Homo sapiens
gcacacagcacuucuucua

SEQ ID NO: 1162331 - RNA, 19 nt, Homo sapiens
gaaguuaauuugucaaugc

SEQ ID NO: 1162332 - RNA, 19 nt, Homo sapiens
gaagcugucaccuuaauaa

SEQ ID NO: 1162333 - RNA, 19 nt, Homo sapiens
gaaguggaaucuuucuguu

SEQ ID NO: 1162334 - RNA, 19 nt, Homo sapiens
ucgacuaucugauuguuua

SEQ ID NO: 1162335 - RNA, 19 nt, Homo sapiens
acacagcacuucuucuaaa

SEQ ID NO: 1162336 - RNA, 19 nt, Homo sapiens
gaaacaaggaagucuuaaa

SEQ ID NO: 1162337 - RNA, 19 nt, Homo sapiens
gaugauugcuccucuucuu

SEQ ID NO: 1162338 - RNA, 19 nt, Homo sapiens
gcgcuacucuguuaaaaua

SEQ ID NO: 1162339 - RNA, 19 nt, Homo sapiens
ggagauggccuaggcgaua

SEQ ID NO: 1162340 - RNA, 19 nt, Homo sapiens
uaugagagccugauugauu

SEQ ID NO: 1162341 - RNA, 19 nt, Homo sapiens
gaacuucgucgugaacuuu

SEQ ID NO: 1162342 - RNA, 19 nt, Homo sapiens
ggccucaucuguagaagaa

SEQ ID NO: 1162343 - RNA, 19 nt, Homo sapiens
uaaugaaagugcuacagaa

SEQ ID NO: 1162344 - RNA, 19 nt, Homo sapiens
gacaauaaugcuuggguua

SEQ ID NO: 1162345 - RNA, 19 nt, Homo sapiens
gagaauugcuuaucaaacc

SEQ ID NO: 1162346 - RNA, 19 nt, Homo sapiens
caagcaacaucucgauuca

SEQ ID NO: 1162347 - RNA, 19 nt, Homo sapiens
cgaauccgacuuagcaaua

SEQ ID NO: 1162348 - RNA, 19 nt, Homo sapiens
cauaugcgaauccgacuua

SEQ ID NO: 1162349 - RNA, 19 nt, Homo sapiens
caauaaugcuuggguuaga

SEQ ID NO: 1162350 - RNA, 19 nt, Homo sapiens
uaucaaaccuugugcaaaa

SEQ ID NO: 1162351 - RNA, 19 nt, Homo sapiens
ggagagagggauuacagaa

SEQ ID NO: 1162352 - RNA, 19 nt, Homo sapiens
gaauccgacuuagcaauau

SEQ ID NO: 1162353 - RNA, 19 nt, Homo sapiens
uggagaggcucauacuauu

SEQ ID NO: 1162354 - RNA, 19 nt, Homo sapiens
guuggaauauuacaaagug

SEQ ID NO: 1162355 - RNA, 19 nt, Homo sapiens
gaucagaagguuggaauau

SEQ ID NO: 1162356 - RNA, 19 nt, Homo sapiens
ccauggaucuguugcugaa

SEQ ID NO: 1162357 - RNA, 19 nt, Homo sapiens
ggaagucgcaugagagauc

SEQ ID NO: 1162358 - RNA, 19 nt, Homo sapiens
gagguaaaguucuuguaag

SEQ ID NO: 1162359 - RNA, 19 nt, Homo sapiens
gagagagggauuacagaaa

SEQ ID NO: 1162360 - RNA, 19 nt, Homo sapiens
cgagguaaaguucuuguaa

SEQ ID NO: 1162361 - RNA, 19 nt, Homo sapiens
gugauaaucuaccuuuaag

SEQ ID NO: 1162362 - RNA, 19 nt, Homo sapiens
gcaguacaaaucaucaauu

SEQ ID NO: 1162363 - RNA, 19 nt, Homo sapiens
acagaagcaucauacaaug

SEQ ID NO: 1162364 - RNA, 19 nt, Homo sapiens
cgaagacauuuggaaacua

SEQ ID NO: 1162365 - RNA, 19 nt, Homo sapiens
cgaaucggaucucuaugga

SEQ ID NO: 1162366 - RNA, 19 nt, Homo sapiens
gagauggccuaggcgauau

SEQ ID NO: 1162367 - RNA, 19 nt, Homo sapiens
uauuaaagcucgaccacau

SEQ ID NO: 1162368 - RNA, 19 nt, Homo sapiens
aauaaugccuacaucucua

SEQ ID NO: 1162369 - RNA, 19 nt, Homo sapiens
cuaguaagcuucgaagaca

SEQ ID NO: 1162370 - RNA, 19 nt, Homo sapiens
uguuaaaccagcuucauua

SEQ ID NO: 1162371 - RNA, 19 nt, Homo sapiens
gauacucaaugucuauucu

SEQ ID NO: 1162372 - RNA, 19 nt, Homo sapiens
gagccugauugauuuaaca

SEQ ID NO: 1162373 - RNA, 19 nt, Homo sapiens
ggagaggcucauacuauug

SEQ ID NO: 1162374 - RNA, 19 nt, Homo sapiens
gaagucgcaugagagauca

SEQ ID NO: 1162375 - RNA, 19 nt, Homo sapiens
acaaugcaccugugugaaa

SEQ ID NO: 1162376 - RNA, 19 nt, Homo sapiens
cagcacuucuucuaaauac

SEQ ID NO: 1162377 - RNA, 19 nt, Homo sapiens
gcaguacagcuaucaaaca

SEQ ID NO: 1162378 - RNA, 19 nt, Homo sapiens
guggagaggcucauacuau

SEQ ID NO: 1162379 - RNA, 19 nt, Homo sapiens
agagagggauuacagaaag

SEQ ID NO: 1162380 - RNA, 19 nt, Homo sapiens
augagagccugauugauuu

SEQ ID NO: 1162381 - RNA, 19 nt, Homo sapiens
aguagucacugccuauuau

SEQ ID NO: 1162382 - RNA, 19 nt, Homo sapiens
gcaccaggaagucgcauga

SEQ ID NO: 1162383 - RNA, 19 nt, Homo sapiens
gaaagcaccaguagucacu

SEQ ID NO: 1162384 - RNA, 19 nt, Homo sapiens
guagugaugcggauguuug

SEQ ID NO: 1162385 - RNA, 19 nt, Homo sapiens
aguggaaucuuucuguuau

SEQ ID NO: 1162386 - RNA, 19 nt, Homo sapiens
gaagagugcauuucaagcu

SEQ ID NO: 1162387 - RNA, 19 nt, Homo sapiens
auaagucuauugaggaaga

SEQ ID NO: 1162388 - RNA, 19 nt, Homo sapiens
aaauagagaugcaccucau

SEQ ID NO: 1162389 - RNA, 19 nt, Homo sapiens
ggagaacaccuuauuucag

SEQ ID NO: 1162390 - RNA, 19 nt, Homo sapiens
cuacaaugcaccuguguga

SEQ ID NO: 1162391 - RNA, 19 nt, Homo sapiens
cgauaucccugagcugaga

SEQ ID NO: 1162392 - RNA, 19 nt, Homo sapiens
cugcugacauugaagaaga

SEQ ID NO: 1162393 - RNA, 19 nt, Homo sapiens
ugaugcggauguuugauga

SEQ ID NO: 1162394 - RNA, 19 nt, Homo sapiens
acugauguguugcuguaua

SEQ ID NO: 1162395 - RNA, 19 nt, Homo sapiens
gauaaccaaauguaagaug

SEQ ID NO: 1162396 - RNA, 19 nt, Homo sapiens
ccucaucuguagaagaaga

SEQ ID NO: 1162397 - RNA, 19 nt, Homo sapiens
aaauucaucuuggcugcua

SEQ ID NO: 1162398 - RNA, 19 nt, Homo sapiens
cuacagaagcaucauacaa

SEQ ID NO: 1162399 - RNA, 19 nt, Homo sapiens
guugauguuuguagugaug

SEQ ID NO: 1162400 - RNA, 19 nt, Homo sapiens
gaccuacuccugugugaau

SEQ ID NO: 1162401 - RNA, 19 nt, Homo sapiens
gaaaauuugcgauggguuu

SEQ ID NO: 1162402 - RNA, 19 nt, Homo sapiens
gaagguuggaauauuacaa

SEQ ID NO: 1162403 - RNA, 19 nt, Homo sapiens
caaacucauugcccaugga

SEQ ID NO: 1162404 - RNA, 19 nt, Homo sapiens
gaacaccuuauuucagcuu

SEQ ID NO: 1162405 - RNA, 19 nt, Homo sapiens
guagucacugccuauuaua

SEQ ID NO: 1162406 - RNA, 19 nt, Homo sapiens
aaacaaggaagucuuaaac

SEQ ID NO: 1162407 - RNA, 19 nt, Homo sapiens
cugaaacaaggaagucuua

SEQ ID NO: 1162408 - RNA, 19 nt, Homo sapiens
ggacuaugagagccugauu

SEQ ID NO: 1162409 - RNA, 19 nt, Homo sapiens
gauauuugcagugccauug

SEQ ID NO: 1162410 - RNA, 19 nt, Homo sapiens
gaccaggcaguacaaauca

SEQ ID NO: 1162411 - RNA, 19 nt, Homo sapiens
gcugucaccuuaauaaaau

SEQ ID NO: 1162412 - RNA, 19 nt, Homo sapiens
uuacuuacuucggaaauag

SEQ ID NO: 1162413 - RNA, 19 nt, Homo sapiens
uuaagcggauaugugauaa

SEQ ID NO: 1162414 - RNA, 19 nt, Homo sapiens
uaacaucugauucucaagu

SEQ ID NO: 1162415 - RNA, 19 nt, Homo sapiens
uuugcgcgcuacucuguua

SEQ ID NO: 1162416 - RNA, 19 nt, Homo sapiens
ugcuaccggugaagaaaua

SEQ ID NO: 1162417 - RNA, 19 nt, Homo sapiens
gcgaaucggaucucuaugg

SEQ ID NO: 1162418 - RNA, 19 nt, Homo sapiens
uacagaagcaucauacaau

SEQ ID NO: 1162419 - RNA, 19 nt, Homo sapiens
cuuuguauccugucuuaua

SEQ ID NO: 1162420 - RNA, 19 nt, Homo sapiens
ucaggaauacccaagcauu

SEQ ID NO: 1162421 - RNA, 19 nt, Homo sapiens
aaaccagcuucauuaguag

SEQ ID NO: 1162422 - RNA, 19 nt, Homo sapiens
caaguaaucugcucuuuau

SEQ ID NO: 1162423 - RNA, 19 nt, Homo sapiens
ggauuaguauggccuauuu

SEQ ID NO: 1162424 - RNA, 19 nt, Homo sapiens
agucaaagcuuucugaauu

SEQ ID NO: 1162425 - RNA, 19 nt, Homo sapiens
guuaugggcucaaagaauu

SEQ ID NO: 1162426 - RNA, 19 nt, Homo sapiens
aaacagaagccuugaauug

SEQ ID NO: 1162427 - RNA, 19 nt, Homo sapiens
uagccaaacucacaaauug

SEQ ID NO: 1162428 - RNA, 19 nt, Homo sapiens
ggaaagcaguaaguucauu

SEQ ID NO: 1162429 - RNA, 19 nt, Homo sapiens
gaaaauggaaggauuagua

SEQ ID NO: 1162430 - RNA, 19 nt, Homo sapiens
ggaauuacuugauaagaac

SEQ ID NO: 1162431 - RNA, 19 nt, Homo sapiens
cuacugcacuugagcauga

SEQ ID NO: 1162432 - RNA, 19 nt, Homo sapiens
guccaaagauguaaguuau

SEQ ID NO: 1162433 - RNA, 19 nt, Homo sapiens
aaacaguagucaaagcuuu

SEQ ID NO: 1162434 - RNA, 19 nt, Homo sapiens
gaaagcaguaaguucauuu

SEQ ID NO: 1162435 - RNA, 19 nt, Homo sapiens
cacauuuccugcuuuauuu

SEQ ID NO: 1162436 - RNA, 19 nt, Homo sapiens
ggaggagagucgcuaccua

SEQ ID NO: 1162437 - RNA, 19 nt, Homo sapiens
gaagaaggaguacgugaug

SEQ ID NO: 1162438 - RNA, 19 nt, Homo sapiens
gggaagagacggaggauau

SEQ ID NO: 1162439 - RNA, 19 nt, Homo sapiens
acagaagccuugaauugaa

SEQ ID NO: 1162440 - RNA, 19 nt, Homo sapiens
ugaaaugacuaacuuugug

SEQ ID NO: 1162441 - RNA, 19 nt, Homo sapiens
uaucagggcuucugcuguu

SEQ ID NO: 1162442 - RNA, 19 nt, Homo sapiens
ggccacauuuccugcuuua

SEQ ID NO: 1162443 - RNA, 19 nt, Homo sapiens
cagaagccuugaauugaaa

SEQ ID NO: 1162444 - RNA, 19 nt, Homo sapiens
ucaaguaaucugcucuuua

SEQ ID NO: 1162445 - RNA, 19 nt, Homo sapiens
gggagaaacaguagucaaa

SEQ ID NO: 1162446 - RNA, 19 nt, Homo sapiens
guaaccaacuccuaaugau

SEQ ID NO: 1162447 - RNA, 19 nt, Homo sapiens
ccacauuuccugcuuuauu

SEQ ID NO: 1162448 - RNA, 19 nt, Homo sapiens
uaaccaacuccuaaugaua

SEQ ID NO: 1162449 - RNA, 19 nt, Homo sapiens
uuaaucgacugaagaagaa

SEQ ID NO: 1162450 - RNA, 19 nt, Homo sapiens
gaaacagaagccuugaauu

SEQ ID NO: 1162451 - RNA, 19 nt, Homo sapiens
gcacaacuguaaauguuuu

SEQ ID NO: 1162452 - RNA, 19 nt, Homo sapiens
ggagugaugaaccugcuua

SEQ ID NO: 1162453 - RNA, 19 nt, Homo sapiens
gaaaagaggcggagaaagu

SEQ ID NO: 1162454 - RNA, 19 nt, Homo sapiens
ccgauucacuacuuguuaa

SEQ ID NO: 1162455 - RNA, 19 nt, Homo sapiens
gaaauuccaaguguagauu

SEQ ID NO: 1162456 - RNA, 19 nt, Homo sapiens
gagcaugaauggguaguag

SEQ ID NO: 1162457 - RNA, 19 nt, Homo sapiens
uuaaaucucucugacaguu

SEQ ID NO: 1162458 - RNA, 19 nt, Homo sapiens
ugaaccugcuuauaccuaa

SEQ ID NO: 1162459 - RNA, 19 nt, Homo sapiens
gucaaagcuuucugaauug

SEQ ID NO: 1162460 - RNA, 19 nt, Homo sapiens
guaauugcauguacuuagg

SEQ ID NO: 1162461 - RNA, 19 nt, Homo sapiens
ggaggcgacucggaccuuu

SEQ ID NO: 1162462 - RNA, 19 nt, Homo sapiens
caacuucauggucuuguuu

SEQ ID NO: 1162463 - RNA, 19 nt, Homo sapiens
uugcacaacuguaaauguu

SEQ ID NO: 1162464 - RNA, 19 nt, Homo sapiens
gcuaaaagcaugaauguga

SEQ ID NO: 1162465 - RNA, 19 nt, Homo sapiens
gguaguagccaaacucaca

SEQ ID NO: 1162466 - RNA, 19 nt, Homo sapiens
aaccaacuccuaaugauaa

SEQ ID NO: 1162467 - RNA, 19 nt, Homo sapiens
gagaaacaguagucaaagc

SEQ ID NO: 1162468 - RNA, 19 nt, Homo sapiens
cuaacuuugugcuaucuuu

SEQ ID NO: 1162469 - RNA, 19 nt, Homo sapiens
cugaauuggucuuugguuu

SEQ ID NO: 1162470 - RNA, 19 nt, Homo sapiens
ucucuaacaugauauugga

SEQ ID NO: 1162471 - RNA, 19 nt, Homo sapiens
gaaaauggaauccuuguuc

SEQ ID NO: 1162472 - RNA, 19 nt, Homo sapiens
caucuucaccggacacauu

SEQ ID NO: 1162473 - RNA, 19 nt, Homo sapiens
ggagccggcugcaacuugu

SEQ ID NO: 1162474 - RNA, 19 nt, Homo sapiens
gugaugaaccugcuuauac

SEQ ID NO: 1162475 - RNA, 19 nt, Homo sapiens
aaagcuuucugaauugaga

SEQ ID NO: 1162476 - RNA, 19 nt, Homo sapiens
uuccuuacgucaauacuuu

SEQ ID NO: 1162477 - RNA, 19 nt, Homo sapiens
ggauauggacuuucugucu

SEQ ID NO: 1162478 - RNA, 19 nt, Homo sapiens
ugacuaacuuugugcuauc

SEQ ID NO: 1162479 - RNA, 19 nt, Homo sapiens
guugcuagauaauacgauu

SEQ ID NO: 1162480 - RNA, 19 nt, Homo sapiens
uguuuggguuucugaauuu

SEQ ID NO: 1162481 - RNA, 19 nt, Homo sapiens
gaaacaguagucaaagcuu

SEQ ID NO: 1162482 - RNA, 19 nt, Homo sapiens
guagccaaacucacaaauu

SEQ ID NO: 1162483 - RNA, 19 nt, Homo sapiens
gacggaggauauggacuuu

SEQ ID NO: 1162484 - RNA, 19 nt, Homo sapiens
cuuguucgcugcccucuga

SEQ ID NO: 1162485 - RNA, 19 nt, Homo sapiens
ugaaacagaagccuugaau

SEQ ID NO: 1162486 - RNA, 19 nt, Homo sapiens
gcauguacuuaggaucuau

SEQ ID NO: 1162487 - RNA, 19 nt, Homo sapiens
ucucugaccugcugcaaag

SEQ ID NO: 1162488 - RNA, 19 nt, Homo sapiens
gagauacuuugaaauucca

SEQ ID NO: 1162489 - RNA, 19 nt, Homo sapiens
gcagcaguuuggcgacgaa

SEQ ID NO: 1162490 - RNA, 19 nt, Homo sapiens
cacaguaaccaacuccuaa

SEQ ID NO: 1162491 - RNA, 19 nt, Homo sapiens
aauguagggucaaguaauc

SEQ ID NO: 1162492 - RNA, 19 nt, Homo sapiens
cuaccuacgggcagucuua

SEQ ID NO: 1162493 - RNA, 19 nt, Homo sapiens
cgucuucucuuaaaaugua

SEQ ID NO: 1162494 - RNA, 19 nt, Homo sapiens
gacugaagaagaaggagua

SEQ ID NO: 1162495 - RNA, 19 nt, Homo sapiens
guaaauguuuggguuucug

SEQ ID NO: 1162496 - RNA, 19 nt, Homo sapiens
gguaauugcauguacuuag

SEQ ID NO: 1162497 - RNA, 19 nt, Homo sapiens
ggaagagacggaggauaug

SEQ ID NO: 1162498 - RNA, 19 nt, Homo sapiens
gcaguuuggcgacgaagga

SEQ ID NO: 1162499 - RNA, 19 nt, Homo sapiens
ugucaaacuuaccuuagug

SEQ ID NO: 1162500 - RNA, 19 nt, Homo sapiens
cggaggauauggacuuucu

SEQ ID NO: 1162501 - RNA, 19 nt, Homo sapiens
caucacagcauauuuugua

SEQ ID NO: 1162502 - RNA, 19 nt, Homo sapiens
gaauuggucuuugguuucc

SEQ ID NO: 1162503 - RNA, 19 nt, Homo sapiens
gaggauauggacuuucugu

SEQ ID NO: 1162504 - RNA, 19 nt, Homo sapiens
aaaugcagcgcuucucuga

SEQ ID NO: 1162505 - RNA, 19 nt, Homo sapiens
ccaugucaaacuuaccuua

SEQ ID NO: 1162506 - RNA, 19 nt, Homo sapiens
uaaaauguagggucaagua

SEQ ID NO: 1162507 - RNA, 19 nt, Homo sapiens
guuuggguuucugaauuua

SEQ ID NO: 1162508 - RNA, 19 nt, Homo sapiens
ugagauacuuugaaauucc

SEQ ID NO: 1162509 - RNA, 19 nt, Homo sapiens
ggagaaacaguagucaaag

SEQ ID NO: 1162510 - RNA, 19 nt, Homo sapiens
aacagaagccuugaauuga

SEQ ID NO: 1162511 - RNA, 19 nt, Homo sapiens
gcuagauaauacgauuuga

SEQ ID NO: 1162512 - RNA, 19 nt, Homo sapiens
aaaucucucugacaguuuc

SEQ ID NO: 1162513 - RNA, 19 nt, Homo sapiens
uuacaccaugucaaacuua

SEQ ID NO: 1162514 - RNA, 19 nt, Homo sapiens
gucaaguaaucugcucuuu

SEQ ID NO: 1162515 - RNA, 19 nt, Homo sapiens
gaagagacggaggauaugg

SEQ ID NO: 1162516 - RNA, 19 nt, Homo sapiens
ucaacuucauggucuuguu

SEQ ID NO: 1162517 - RNA, 19 nt, Homo sapiens
uccagugcaucacagcaua

SEQ ID NO: 1162518 - RNA, 19 nt, Homo sapiens
caacucccuuacaccaugu

SEQ ID NO: 1162519 - RNA, 19 nt, Homo sapiens
cuuaaucgacugaagaaga

SEQ ID NO: 1162520 - RNA, 19 nt, Homo sapiens
uaucuuaaaguguccgauu

SEQ ID NO: 1162521 - RNA, 19 nt, Homo sapiens
uuuggugacuuagugauuu

SEQ ID NO: 1162522 - RNA, 19 nt, Homo sapiens
uaacagaaauucaggaugu

SEQ ID NO: 1162523 - RNA, 19 nt, Homo sapiens
aaauuuaacugguggcuua

SEQ ID NO: 1162524 - RNA, 19 nt, Homo sapiens
ggaaaccuuugcuugcuua

SEQ ID NO: 1162525 - RNA, 19 nt, Homo sapiens
ggaccaguauguuaaagaa

SEQ ID NO: 1162526 - RNA, 19 nt, Homo sapiens
aaagagaacugggaacauu

SEQ ID NO: 1162527 - RNA, 19 nt, Homo sapiens
agacuggacuucaugagua

SEQ ID NO: 1162528 - RNA, 19 nt, Homo sapiens
ggaggaagauccaugugau

SEQ ID NO: 1162529 - RNA, 19 nt, Homo sapiens
gauaauccaguaagucuuu

SEQ ID NO: 1162530 - RNA, 19 nt, Homo sapiens
ggacucagauuacagaaaa

SEQ ID NO: 1162531 - RNA, 19 nt, Homo sapiens
gaagagcacccaccacugu

SEQ ID NO: 1162532 - RNA, 19 nt, Homo sapiens
gagcaaaguuuucauguau

SEQ ID NO: 1162533 - RNA, 19 nt, Homo sapiens
gcaagagccugucagaacu

SEQ ID NO: 1162534 - RNA, 19 nt, Homo sapiens
cacagaaugggauuuauua

SEQ ID NO: 1162535 - RNA, 19 nt, Homo sapiens
gaaccuugauuaauaacag

SEQ ID NO: 1162536 - RNA, 19 nt, Homo sapiens
ucacucgucugcuuccuuu

SEQ ID NO: 1162537 - RNA, 19 nt, Homo sapiens
ggaaguggcauuucguuca

SEQ ID NO: 1162538 - RNA, 19 nt, Homo sapiens
uaacccggguggccaaauu

SEQ ID NO: 1162539 - RNA, 19 nt, Homo sapiens
caaugggaccaguauguua

SEQ ID NO: 1162540 - RNA, 19 nt, Homo sapiens
gauacugaaccuugauuaa

SEQ ID NO: 1162541 - RNA, 19 nt, Homo sapiens
caggaauucugccuaaguu

SEQ ID NO: 1162542 - RNA, 19 nt, Homo sapiens
ugucagaacuaccucaaga

SEQ ID NO: 1162543 - RNA, 19 nt, Homo sapiens
gaauuuuccucccagaaua

SEQ ID NO: 1162544 - RNA, 19 nt, Homo sapiens
ccauuugccuuaugcuuug

SEQ ID NO: 1162545 - RNA, 19 nt, Homo sapiens
caagaaaaccuaagaaaga

SEQ ID NO: 1162546 - RNA, 19 nt, Homo sapiens
aaacugaggcgucaagaug

SEQ ID NO: 1162547 - RNA, 19 nt, Homo sapiens
ucucaggaauucugccuaa

SEQ ID NO: 1162548 - RNA, 19 nt, Homo sapiens
gaggaucaguagcuguuau

SEQ ID NO: 1162549 - RNA, 19 nt, Homo sapiens
caguaagucuuuccucguu

SEQ ID NO: 1162550 - RNA, 19 nt, Homo sapiens
ccacagaaugggauuuauu

SEQ ID NO: 1162551 - RNA, 19 nt, Homo sapiens
gcugggauuugaggugaua

SEQ ID NO: 1162552 - RNA, 19 nt, Homo sapiens
gaacacgaucauuccauug

SEQ ID NO: 1162553 - RNA, 19 nt, Homo sapiens
gaagugcaaccacccaaug

SEQ ID NO: 1162554 - RNA, 19 nt, Homo sapiens
guuccuaacuucuugaaag

SEQ ID NO: 1162555 - RNA, 19 nt, Homo sapiens
ggagcaaaguuuucaugua

SEQ ID NO: 1162556 - RNA, 19 nt, Homo sapiens
ggcgagaccuggacaugga

SEQ ID NO: 1162557 - RNA, 19 nt, Homo sapiens
agaacucuaugaacaagaa

SEQ ID NO: 1162558 - RNA, 19 nt, Homo sapiens
uaaugauacugaaccuuga

SEQ ID NO: 1162559 - RNA, 19 nt, Homo sapiens
gguaaguauuucuauguca

SEQ ID NO: 1162560 - RNA, 19 nt, Homo sapiens
uaugcuuucuccugaauuu

SEQ ID NO: 1162561 - RNA, 19 nt, Homo sapiens
ggacugcucaccaacucua

SEQ ID NO: 1162562 - RNA, 19 nt, Homo sapiens
gauguaaagccacagaaug

SEQ ID NO: 1162563 - RNA, 19 nt, Homo sapiens
cagaccauuuggagaagua

SEQ ID NO: 1162564 - RNA, 19 nt, Homo sapiens
ugauuaggcugggauuuga

SEQ ID NO: 1162565 - RNA, 19 nt, Homo sapiens
gaaguggcauuucguucag

SEQ ID NO: 1162566 - RNA, 19 nt, Homo sapiens
aaccuuugcuugcuuacua

SEQ ID NO: 1162567 - RNA, 19 nt, Homo sapiens
gcacagccuugaugaucuc

SEQ ID NO: 1162568 - RNA, 19 nt, Homo sapiens
uggcagacaucuauaugga

SEQ ID NO: 1162569 - RNA, 19 nt, Homo sapiens
ggaauucugccuaaguugu

SEQ ID NO: 1162570 - RNA, 19 nt, Homo sapiens
ggccugaccggacacauaa

SEQ ID NO: 1162571 - RNA, 19 nt, Homo sapiens
guagggaacacgaucauuc

SEQ ID NO: 1162572 - RNA, 19 nt, Homo sapiens
gggaaaccuuugcuugcuu

SEQ ID NO: 1162573 - RNA, 19 nt, Homo sapiens
uagaagggauaacaguuca

SEQ ID NO: 1162574 - RNA, 19 nt, Homo sapiens
guagaagggauaacaguuc

SEQ ID NO: 1162575 - RNA, 19 nt, Homo sapiens
gcaauaagaugaauuuucc

SEQ ID NO: 1162576 - RNA, 19 nt, Homo sapiens
ucagaacuaccucaagaaa

SEQ ID NO: 1162577 - RNA, 19 nt, Homo sapiens
gaagugaaguacccuuuuc

SEQ ID NO: 1162578 - RNA, 19 nt, Homo sapiens
ccacauccuuucuaagcau

SEQ ID NO: 1162579 - RNA, 19 nt, Homo sapiens
gacuggacuucaugaguau

SEQ ID NO: 1162580 - RNA, 19 nt, Homo sapiens
ccaagaauggaguuccuaa

SEQ ID NO: 1162581 - RNA, 19 nt, Homo sapiens
gggaggaagauccauguga

SEQ ID NO: 1162582 - RNA, 19 nt, Homo sapiens
gaggacugcucaccaacuc

SEQ ID NO: 1162583 - RNA, 19 nt, Homo sapiens
guugaugucucuggaagug

SEQ ID NO: 1162584 - RNA, 19 nt, Homo sapiens
ggcaagagccugucagaac

SEQ ID NO: 1162585 - RNA, 19 nt, Homo sapiens
aagcagagccuggcgauug

SEQ ID NO: 1162586 - RNA, 19 nt, Homo sapiens
guggagaccucgggcauca

SEQ ID NO: 1162587 - RNA, 19 nt, Homo sapiens
uaccucagacuguuuguuu

SEQ ID NO: 1162588 - RNA, 19 nt, Homo sapiens
gaaacugaggcgucaagau

SEQ ID NO: 1162589 - RNA, 19 nt, Homo sapiens
ggaagugccaccuggaagu

SEQ ID NO: 1162590 - RNA, 19 nt, Homo sapiens
ggaagugccaccuggaagu

SEQ ID NO: 1162591 - RNA, 19 nt, Homo sapiens
gaaagagaacugggaacau

SEQ ID NO: 1162592 - RNA, 19 nt, Homo sapiens
caagagccugucagaacua

SEQ ID NO: 1162593 - RNA, 19 nt, Homo sapiens
cguccuggcucauuaacug

SEQ ID NO: 1162594 - RNA, 19 nt, Homo sapiens
ggacacauaauacgacaac

SEQ ID NO: 1162595 - RNA, 19 nt, Homo sapiens
ucagaggccuacacacuac

SEQ ID NO: 1162596 - RNA, 19 nt, Homo sapiens
ugauccgggugaagcaaua

SEQ ID NO: 1162597 - RNA, 19 nt, Homo sapiens
gggaagugaaguacccuuu

SEQ ID NO: 1162598 - RNA, 19 nt, Homo sapiens
aaagaacucuaugaacaag

SEQ ID NO: 1162599 - RNA, 19 nt, Homo sapiens
caacucuacuggcagacau

SEQ ID NO: 1162600 - RNA, 19 nt, Homo sapiens
uauauggacucagauuaca

SEQ ID NO: 1162601 - RNA, 19 nt, Homo sapiens
gcauuuuacuggaaacuga

SEQ ID NO: 1162602 - RNA, 19 nt, Homo sapiens
gccuguaccucucaagcuu

SEQ ID NO: 1162603 - RNA, 19 nt, Homo sapiens
ccagcucacucgucugcuu

SEQ ID NO: 1162604 - RNA, 19 nt, Homo sapiens
gccuggcgauugagaguga

SEQ ID NO: 1162605 - RNA, 19 nt, Homo sapiens
ggauguaaagccacagaau

SEQ ID NO: 1162606 - RNA, 19 nt, Homo sapiens
ggguaaguauuucuauguc

SEQ ID NO: 1162607 - RNA, 19 nt, Homo sapiens
ccucucaagcuuugcauuu

SEQ ID NO: 1162608 - RNA, 19 nt, Homo sapiens
acuaccacauccuuucuaa

SEQ ID NO: 1162609 - RNA, 19 nt, Homo sapiens
ggacaagaagacuggacuu

SEQ ID NO: 1162610 - RNA, 19 nt, Homo sapiens
gaaaacaaugggaccagua

SEQ ID NO: 1162611 - RNA, 19 nt, Homo sapiens
ggauaccucagacuguuug

SEQ ID NO: 1162612 - RNA, 19 nt, Homo sapiens
cagaaauucaggauguaaa

SEQ ID NO: 1162613 - RNA, 19 nt, Homo sapiens
gguaggguaaguauuucua

SEQ ID NO: 1162614 - RNA, 19 nt, Homo sapiens
gaagggauaacaguucaca

SEQ ID NO: 1162615 - RNA, 19 nt, Homo sapiens
ggaggaucaguagcuguua

SEQ ID NO: 1162616 - RNA, 19 nt, Homo sapiens
gacuuucagugcacccaaa

SEQ ID NO: 1162617 - RNA, 19 nt, Homo sapiens
uaggguaaguauuucuaug

SEQ ID NO: 1162618 - RNA, 19 nt, Homo sapiens
uuaaugacucugcaccuuu

SEQ ID NO: 1162619 - RNA, 19 nt, Homo sapiens
ucuauauggacucagauua

SEQ ID NO: 1162620 - RNA, 19 nt, Homo sapiens
uuugguaggguaaguauuu

SEQ ID NO: 1162621 - RNA, 19 nt, Homo sapiens
uaaugacucugcaccuuuu

SEQ ID NO: 1162622 - RNA, 19 nt, Homo sapiens
gcaauaagauucaaagcua

SEQ ID NO: 1162623 - RNA, 19 nt, Homo sapiens
gaacugaaaucccauauuc

SEQ ID NO: 1162624 - RNA, 19 nt, Homo sapiens
gaauaaagaugguguuguu

SEQ ID NO: 1162625 - RNA, 19 nt, Homo sapiens
gaagaaaucucugaaacga

SEQ ID NO: 1162626 - RNA, 19 nt, Homo sapiens
gaacaucacugcaaauagg

SEQ ID NO: 1162627 - RNA, 19 nt, Homo sapiens
gaaaggaccugaauucacu

SEQ ID NO: 1162628 - RNA, 19 nt, Homo sapiens
uaaaugaacuuuccuccuu

SEQ ID NO: 1162629 - RNA, 19 nt, Homo sapiens
gcaagauguuucucuauug

SEQ ID NO: 1162630 - RNA, 19 nt, Homo sapiens
ggagagagauuaaaugacu

SEQ ID NO: 1162631 - RNA, 19 nt, Homo sapiens
ggaguaggguacacacuaa

SEQ ID NO: 1162632 - RNA, 19 nt, Homo sapiens
gaacuuuccuccuuguaug

SEQ ID NO: 1162633 - RNA, 19 nt, Homo sapiens
aagcuaaucuggagcauaa

SEQ ID NO: 1162634 - RNA, 19 nt, Homo sapiens
guacagaagugggaacuga

SEQ ID NO: 1162635 - RNA, 19 nt, Homo sapiens
cagaaagucuucaaucuuc

SEQ ID NO: 1162636 - RNA, 19 nt, Homo sapiens
caugagaggugccgccaua

SEQ ID NO: 1162637 - RNA, 19 nt, Homo sapiens
gaaagaagagggcaaguca

SEQ ID NO: 1162638 - RNA, 19 nt, Homo sapiens
gaaaugaaacuguagcaau

SEQ ID NO: 1162639 - RNA, 19 nt, Homo sapiens
gcacauaaauacucagcau

SEQ ID NO: 1162640 - RNA, 19 nt, Homo sapiens
gugcuuacuucauuuguuu

SEQ ID NO: 1162641 - RNA, 19 nt, Homo sapiens
cagcugacauuaugacuau

SEQ ID NO: 1162642 - RNA, 19 nt, Homo sapiens
ugaauguguuggccucuua

SEQ ID NO: 1162643 - RNA, 19 nt, Homo sapiens
cauagcagauacucaguuu

SEQ ID NO: 1162644 - RNA, 19 nt, Homo sapiens
uaaacuacccuguuacuga

SEQ ID NO: 1162645 - RNA, 19 nt, Homo sapiens
uaaagaugguguuguugaa

SEQ ID NO: 1162646 - RNA, 19 nt, Homo sapiens
gguacacacuaacguuuaa

SEQ ID NO: 1162647 - RNA, 19 nt, Homo sapiens
aaacuacccuguuacugaa

SEQ ID NO: 1162648 - RNA, 19 nt, Homo sapiens
auucuuaacugucuccuua

SEQ ID NO: 1162649 - RNA, 19 nt, Homo sapiens
gaacugauggagagagauu

SEQ ID NO: 1162650 - RNA, 19 nt, Homo sapiens
gaauucagacuguguguug

SEQ ID NO: 1162651 - RNA, 19 nt, Homo sapiens
gagcuguuauucagauuug

SEQ ID NO: 1162652 - RNA, 19 nt, Homo sapiens
guagauauuugcucugauc

SEQ ID NO: 1162653 - RNA, 19 nt, Homo sapiens
uagcagauacucaguuuaa

SEQ ID NO: 1162654 - RNA, 19 nt, Homo sapiens
gcugaaacccaaacuauau

SEQ ID NO: 1162655 - RNA, 19 nt, Homo sapiens
uaacagggaucacaagcau

SEQ ID NO: 1162656 - RNA, 19 nt, Homo sapiens
uaauuuggcaggcuuauuu

SEQ ID NO: 1162657 - RNA, 19 nt, Homo sapiens
caacagaagagaagaaauc

SEQ ID NO: 1162658 - RNA, 19 nt, Homo sapiens
ggugucaugucccagauuu

SEQ ID NO: 1162659 - RNA, 19 nt, Homo sapiens
uuagaaagauugcugaaca

SEQ ID NO: 1162660 - RNA, 19 nt, Homo sapiens
aagccacgcugaacaguaa

SEQ ID NO: 1162661 - RNA, 19 nt, Homo sapiens
ccaaggaagugcgaucuga

SEQ ID NO: 1162662 - RNA, 19 nt, Homo sapiens
agaugaagcaugucuguua

SEQ ID NO: 1162663 - RNA, 19 nt, Homo sapiens
gcagcaguauauucugaaa

SEQ ID NO: 1162664 - RNA, 19 nt, Homo sapiens
acuggaaucugguuuauau

SEQ ID NO: 1162665 - RNA, 19 nt, Homo sapiens
ggaggaggaugacgacuac

SEQ ID NO: 1162666 - RNA, 19 nt, Homo sapiens
gaccugaauucacuagaga

SEQ ID NO: 1162667 - RNA, 19 nt, Homo sapiens
gaaacuguagcaauuaugu

SEQ ID NO: 1162668 - RNA, 19 nt, Homo sapiens
uggcuaaacucgaacauca

SEQ ID NO: 1162669 - RNA, 19 nt, Homo sapiens
gaacaucuggcaagaacga

SEQ ID NO: 1162670 - RNA, 19 nt, Homo sapiens
gaucugagcagccacaauc

SEQ ID NO: 1162671 - RNA, 19 nt, Homo sapiens
gugcagacccugucccuuu

SEQ ID NO: 1162672 - RNA, 19 nt, Homo sapiens
uguaagcagugggugauua

SEQ ID NO: 1162673 - RNA, 19 nt, Homo sapiens
ggaucacaagcaugaauua

SEQ ID NO: 1162674 - RNA, 19 nt, Homo sapiens
gagcauaaaggcacaguuc

SEQ ID NO: 1162675 - RNA, 19 nt, Homo sapiens
cuagagaauuugaaucugu

SEQ ID NO: 1162676 - RNA, 19 nt, Homo sapiens
cuuggaaguucuuugauuu

SEQ ID NO: 1162677 - RNA, 19 nt, Homo sapiens
cagcauuuacguaguauuu

SEQ ID NO: 1162678 - RNA, 19 nt, Homo sapiens
uauuugcucugaucaacua

SEQ ID NO: 1162679 - RNA, 19 nt, Homo sapiens
gaagauuaggugcauuuau

SEQ ID NO: 1162680 - RNA, 19 nt, Homo sapiens
ugaagcaugucuguuacua

SEQ ID NO: 1162681 - RNA, 19 nt, Homo sapiens
caagauguuucucuauugg

SEQ ID NO: 1162682 - RNA, 19 nt, Homo sapiens
ggaccugaauucacuagag

SEQ ID NO: 1162683 - RNA, 19 nt, Homo sapiens
gagaggugccgccauaguu

SEQ ID NO: 1162684 - RNA, 19 nt, Homo sapiens
aacagugccuuucuuugua

SEQ ID NO: 1162685 - RNA, 19 nt, Homo sapiens
aaacagugccuuucuuugu

SEQ ID NO: 1162686 - RNA, 19 nt, Homo sapiens
gcaaagccaaaucaaauag

SEQ ID NO: 1162687 - RNA, 19 nt, Homo sapiens
cagcaaaaguuaagaaaug

SEQ ID NO: 1162688 - RNA, 19 nt, Homo sapiens
ggaauuuauuugcuucaag

SEQ ID NO: 1162689 - RNA, 19 nt, Homo sapiens
gcaagaacgaaguguguau

SEQ ID NO: 1162690 - RNA, 19 nt, Homo sapiens
cuuaauaccuguuacuagu

SEQ ID NO: 1162691 - RNA, 19 nt, Homo sapiens
gaagugagaacaaugaaaa

SEQ ID NO: 1162692 - RNA, 19 nt, Homo sapiens
uaauuuguguugcuacuuc

SEQ ID NO: 1162693 - RNA, 19 nt, Homo sapiens
gaucacaagcaugaauuaa

SEQ ID NO: 1162694 - RNA, 19 nt, Homo sapiens
ccugagagcgauuugauuu

SEQ ID NO: 1162695 - RNA, 19 nt, Homo sapiens
acucagcauuuacguagua

SEQ ID NO: 1162696 - RNA, 19 nt, Homo sapiens
gcucugaucaacuagauga

SEQ ID NO: 1162697 - RNA, 19 nt, Homo sapiens
cgacuggaaucugguuuau

SEQ ID NO: 1162698 - RNA, 19 nt, Homo sapiens
gaguauacccagaaucaga

SEQ ID NO: 1162699 - RNA, 19 nt, Homo sapiens
gaugaagcaugucuguuac

SEQ ID NO: 1162700 - RNA, 19 nt, Homo sapiens
ugcaagauguuucucuauu

SEQ ID NO: 1162701 - RNA, 19 nt, Homo sapiens
gggaacugauggagagaga

SEQ ID NO: 1162702 - RNA, 19 nt, Homo sapiens
acagugccuuucuuuguaa

SEQ ID NO: 1162703 - RNA, 19 nt, Homo sapiens
ucugaaaugucucauagau

SEQ ID NO: 1162704 - RNA, 19 nt, Homo sapiens
ccgcaaagccaaaucaaau

SEQ ID NO: 1162705 - RNA, 19 nt, Homo sapiens
gggaguaggguacacacua

SEQ ID NO: 1162706 - RNA, 19 nt, Homo sapiens
gauacaaccuucccaugcu

SEQ ID NO: 1162707 - RNA, 19 nt, Homo sapiens
ucuuaacugucuccuuaua

SEQ ID NO: 1162708 - RNA, 19 nt, Homo sapiens
agucggcgcuggagaagaa

SEQ ID NO: 1162709 - RNA, 19 nt, Homo sapiens
ggauguugguggaguauac

SEQ ID NO: 1162710 - RNA, 19 nt, Homo sapiens
acagaagcuugcacgagua

SEQ ID NO: 1162711 - RNA, 19 nt, Homo sapiens
aacaguagaugaagcaugu

SEQ ID NO: 1162712 - RNA, 19 nt, Homo sapiens
cggcagcaguauauucuga

SEQ ID NO: 1162713 - RNA, 19 nt, Homo sapiens
gauauuugcucugaucaac

SEQ ID NO: 1162714 - RNA, 19 nt, Homo sapiens
ggguacacacuaacguuua

SEQ ID NO: 1162715 - RNA, 19 nt, Homo sapiens
guucagagacagaauaaca

SEQ ID NO: 1162716 - RNA, 19 nt, Homo sapiens
uaaaggcacaguucagaga

SEQ ID NO: 1162717 - RNA, 19 nt, Homo sapiens
agaaagaaccucagacucu

SEQ ID NO: 1162718 - RNA, 19 nt, Homo sapiens
caagucaugguuggaaaua

SEQ ID NO: 1162719 - RNA, 19 nt, Homo sapiens
ggaacugaaaucccauauu

SEQ ID NO: 1162720 - RNA, 19 nt, Homo sapiens
aaaagaggaucguagauau

SEQ ID NO: 1162721 - RNA, 19 nt, Homo sapiens
caaaagaggaucguagaua

SEQ ID NO: 1162722 - RNA, 19 nt, Homo sapiens
caacagaccauaucaguaa

SEQ ID NO: 1162723 - RNA, 19 nt, Homo sapiens
gaagcucuguuuacacaua

SEQ ID NO: 1162724 - RNA, 19 nt, Homo sapiens
gaaggcaacugucuuaagu

SEQ ID NO: 1162725 - RNA, 19 nt, Homo sapiens
gacuagaccugaaaugaaa

SEQ ID NO: 1162726 - RNA, 19 nt, Homo sapiens
gaucaaguuuccaauaugu

SEQ ID NO: 1162727 - RNA, 19 nt, Homo sapiens
ccacaucucuguuucuuca

SEQ ID NO: 1162728 - RNA, 19 nt, Homo sapiens
gggaucaaguuuccaauau

SEQ ID NO: 1162729 - RNA, 19 nt, Homo sapiens
gaccugaaaugaaagaguu

SEQ ID NO: 1162730 - RNA, 19 nt, Homo sapiens
gacuagcccucuugaguaa

SEQ ID NO: 1162731 - RNA, 19 nt, Homo sapiens
uaagggagacuauguuauu

SEQ ID NO: 1162732 - RNA, 19 nt, Homo sapiens
gguuugauauucagaaaga

SEQ ID NO: 1162733 - RNA, 19 nt, Homo sapiens
ccagauggcugcgcgcuuu

SEQ ID NO: 1162734 - RNA, 19 nt, Homo sapiens
ggcaaggccuucaacaaga

SEQ ID NO: 1162735 - RNA, 19 nt, Homo sapiens
ggaucaaguuuccaauaug

SEQ ID NO: 1162736 - RNA, 19 nt, Homo sapiens
caagggcccugaccucaug

SEQ ID NO: 1162737 - RNA, 19 nt, Homo sapiens
ggcaaggccuucagcaaga

SEQ ID NO: 1162738 - RNA, 19 nt, Homo sapiens
gcacuucagaccucaguaa

SEQ ID NO: 1162739 - RNA, 19 nt, Homo sapiens
agaguggucuguuacguuu

SEQ ID NO: 1162740 - RNA, 19 nt, Homo sapiens
gucaugaacugaaggcauu

SEQ ID NO: 1162741 - RNA, 19 nt, Homo sapiens
gggagacuauguuauuuua

SEQ ID NO: 1162742 - RNA, 19 nt, Homo sapiens
gcagcagguuugauauuca

SEQ ID NO: 1162743 - RNA, 19 nt, Homo sapiens
gagacuagaccugaaauga

SEQ ID NO: 1162744 - RNA, 19 nt, Homo sapiens
gcucgucccugauaaagca

SEQ ID NO: 1162745 - RNA, 19 nt, Homo sapiens
gaacuucuccagcacuuca

SEQ ID NO: 1162746 - RNA, 19 nt, Homo sapiens
caaagguccucccucuuca

SEQ ID NO: 1162747 - RNA, 19 nt, Homo sapiens
gaccuuagacuggguaauu

SEQ ID NO: 1162748 - RNA, 19 nt, Homo sapiens
ccgcaggccugucuuccua

SEQ ID NO: 1162749 - RNA, 19 nt, Homo sapiens
gcaaggccuucagcaagaa

SEQ ID NO: 1162750 - RNA, 19 nt, Homo sapiens
gcugggaaguccaagauca

SEQ ID NO: 1162751 - RNA, 19 nt, Homo sapiens
gaaagaaauaugcauggau

SEQ ID NO: 1162752 - RNA, 19 nt, Homo sapiens
gcucaggaaugugguguug

SEQ ID NO: 1162753 - RNA, 19 nt, Homo sapiens
ccaaagguccucccucuuc

SEQ ID NO: 1162754 - RNA, 19 nt, Homo sapiens
gcaggccugucuuccuauu

SEQ ID NO: 1162755 - RNA, 19 nt, Homo sapiens
ggaguuugccgguuguuug

SEQ ID NO: 1162756 - RNA, 19 nt, Homo sapiens
gcaaggccuucaacaagag

SEQ ID NO: 1162757 - RNA, 19 nt, Homo sapiens
caucaggguuccagacuag

SEQ ID NO: 1162758 - RNA, 19 nt, Homo sapiens
gaagcucgucccugauaaa

SEQ ID NO: 1162759 - RNA, 19 nt, Homo sapiens
gaaauaugcauggauucaa

SEQ ID NO: 1162760 - RNA, 19 nt, Homo sapiens
agacuagcccucuugagua

SEQ ID NO: 1162761 - RNA, 19 nt, Homo sapiens
gcagugcugugagaaguuc

SEQ ID NO: 1162762 - RNA, 19 nt, Homo sapiens
cgaagcucgucccugauaa

SEQ ID NO: 1162763 - RNA, 19 nt, Homo sapiens
ugaaugccaaaguuucuua

SEQ ID NO: 1162764 - RNA, 19 nt, Homo sapiens
ucaggaaugugguguugug

SEQ ID NO: 1162765 - RNA, 19 nt, Homo sapiens
gacugaagcucuguuuaca

SEQ ID NO: 1162766 - RNA, 19 nt, Homo sapiens
cauggccgcugguaacaga

SEQ ID NO: 1162767 - RNA, 19 nt, Homo sapiens
gcaaggccuucagccagaa

SEQ ID NO: 1162768 - RNA, 19 nt, Homo sapiens
ugauacuacugguugcuaa

SEQ ID NO: 1162769 - RNA, 19 nt, Homo sapiens
ccaacagaccauaucagua

SEQ ID NO: 1162770 - RNA, 19 nt, Homo sapiens
gaaccacaccggcgagaag

SEQ ID NO: 1162771 - RNA, 19 nt, Homo sapiens
cugaagcucuguuuacaca

SEQ ID NO: 1162772 - RNA, 19 nt, Homo sapiens
cagguuugauauucagaaa

SEQ ID NO: 1162773 - RNA, 19 nt, Homo sapiens
ccagagcgccuaccucauc

SEQ ID NO: 1162774 - RNA, 19 nt, Homo sapiens
ccgaagcucgucccugaua

SEQ ID NO: 1162775 - RNA, 19 nt, Homo sapiens
agacuagaccugaaaugaa

SEQ ID NO: 1162776 - RNA, 19 nt, Homo sapiens
ugugaaggcaacugucuua

SEQ ID NO: 1162777 - RNA, 19 nt, Homo sapiens
agaaagaaauaugcaugga

SEQ ID NO: 1162778 - RNA, 19 nt, Homo sapiens
aagggagacuauguuauuu

SEQ ID NO: 1162779 - RNA, 19 nt, Homo sapiens
ggaaguggcaggaguuugc

SEQ ID NO: 1162780 - RNA, 19 nt, Homo sapiens
gcaccaacagaccauauca

SEQ ID NO: 1162781 - RNA, 19 nt, Homo sapiens
ugcauggauucaauaagua

SEQ ID NO: 1162782 - RNA, 19 nt, Homo sapiens
gcaggaguuugccgguugu

SEQ ID NO: 1162783 - RNA, 19 nt, Homo sapiens
ggccauacuuuuaauuuug

SEQ ID NO: 1162784 - RNA, 19 nt, Homo sapiens
cuucauagguagugcuugu

SEQ ID NO: 1162785 - RNA, 19 nt, Homo sapiens
gcauggauucaauaaguau

SEQ ID NO: 1162786 - RNA, 19 nt, Homo sapiens
ugauaaagcaccaaaggau

SEQ ID NO: 1162787 - RNA, 19 nt, Homo sapiens
cgacugaagcucuguuuac

SEQ ID NO: 1162788 - RNA, 19 nt, Homo sapiens
ucaaguuuccaauauguga

SEQ ID NO: 1162789 - RNA, 19 nt, Homo sapiens
augcauggauucaauaagu

SEQ ID NO: 1162790 - RNA, 19 nt, Homo sapiens
gcacugacugggagacuag

SEQ ID NO: 1162791 - RNA, 19 nt, Homo sapiens
ucaguaacuucgagugagu

SEQ ID NO: 1162792 - RNA, 19 nt, Homo sapiens
gugcuugugucuugaugug

SEQ ID NO: 1162793 - RNA, 19 nt, Homo sapiens
cagcagcagguuugauauu

SEQ ID NO: 1162794 - RNA, 19 nt, Homo sapiens
aacagcagcagguuugaua

SEQ ID NO: 1162795 - RNA, 19 nt, Homo sapiens
ugccaaaguuucuuagagu

SEQ ID NO: 1162796 - RNA, 19 nt, Homo sapiens
ccagagcuccuaccucauc

SEQ ID NO: 1162797 - RNA, 19 nt, Homo sapiens
aagcucuguuuacacauaa

SEQ ID NO: 1162798 - RNA, 19 nt, Homo sapiens
gcucaguacccgcauguca

SEQ ID NO: 1162799 - RNA, 19 nt, Homo sapiens
uaacuacugcuuugaaugc

SEQ ID NO: 1162800 - RNA, 19 nt, Homo sapiens
uugaguaacuguccuagag

SEQ ID NO: 1162801 - RNA, 19 nt, Homo sapiens
cagacuagcccucuugagu

SEQ ID NO: 1162802 - RNA, 19 nt, Homo sapiens
caagaacuccucccucacu

SEQ ID NO: 1162803 - RNA, 19 nt, Homo sapiens
uaauuaagggagacuaugu

SEQ ID NO: 1162804 - RNA, 19 nt, Homo sapiens
gcucgucccucaccaucca

SEQ ID NO: 1162805 - RNA, 19 nt, Homo sapiens
gguccucccucuucauacu

SEQ ID NO: 1162806 - RNA, 19 nt, Homo sapiens
gguagugcuugugucuuga

SEQ ID NO: 1162807 - RNA, 19 nt, Homo sapiens
ccuuagacuggguaauuua

SEQ ID NO: 1162808 - RNA, 19 nt, Homo sapiens
guuugccgguuguuuguga

SEQ ID NO: 1162809 - RNA, 19 nt, Homo sapiens
cggcaaggccuucaacaag

SEQ ID NO: 1162810 - RNA, 19 nt, Homo sapiens
uaucaguaacuucgaguga

SEQ ID NO: 1162811 - RNA, 19 nt, Homo sapiens
gaagcaccaacagaccaua

SEQ ID NO: 1162812 - RNA, 19 nt, Homo sapiens
guuguaaacagcagacuuc

SEQ ID NO: 1162813 - RNA, 19 nt, Homo sapiens
agguagugcuugugucuug

SEQ ID NO: 1162814 - RNA, 19 nt, Homo sapiens
gcagguuugauauucagaa

SEQ ID NO: 1162815 - RNA, 19 nt, Homo sapiens
guaacuacugcuuugaaug

SEQ ID NO: 1162816 - RNA, 19 nt, Homo sapiens
uaaaugugaaggcaacugu

SEQ ID NO: 1162817 - RNA, 19 nt, Homo sapiens
gaguccagaugcagcuugu

SEQ ID NO: 1162818 - RNA, 19 nt, Homo sapiens
gcggcaaggccuucaacaa

SEQ ID NO: 1162819 - RNA, 19 nt, Homo sapiens
ggcacugacugggagacua

SEQ ID NO: 1162820 - RNA, 19 nt, Homo sapiens
agaugcagcuugucaccau

SEQ ID NO: 1162821 - RNA, 19 nt, Homo sapiens
acaucaggguuccagacua

SEQ ID NO: 1162822 - RNA, 19 nt, Homo sapiens
ccacauaaaugaugaguuu

SEQ ID NO: 1162823 - RNA, 19 nt, Homo sapiens
gaaccagucuucaacaaau

SEQ ID NO: 1162824 - RNA, 19 nt, Homo sapiens
gaaacccugucucuacuaa

SEQ ID NO: 1162825 - RNA, 19 nt, Homo sapiens
ccaaggaauugauuaugua

SEQ ID NO: 1162826 - RNA, 19 nt, Homo sapiens
gaaagaaaggaauguguaa

SEQ ID NO: 1162827 - RNA, 19 nt, Homo sapiens
caacauguaucauccugaa

SEQ ID NO: 1162828 - RNA, 19 nt, Homo sapiens
gugaagugcugaccaauug

SEQ ID NO: 1162829 - RNA, 19 nt, Homo sapiens
gaacuaauaggcuuaaauc

SEQ ID NO: 1162830 - RNA, 19 nt, Homo sapiens
gaaaggaauguguaaguga

SEQ ID NO: 1162831 - RNA, 19 nt, Homo sapiens
uggcagaacuggacaaaga

SEQ ID NO: 1162832 - RNA, 19 nt, Homo sapiens
aaauagaguugcaaucuug

SEQ ID NO: 1162833 - RNA, 19 nt, Homo sapiens
gugacuagaugcaauuaaa

SEQ ID NO: 1162834 - RNA, 19 nt, Homo sapiens
ggacauacuugaaacaaaa

SEQ ID NO: 1162835 - RNA, 19 nt, Homo sapiens
ucaauugcauccauauuug

SEQ ID NO: 1162836 - RNA, 19 nt, Homo sapiens
aaacaaggcugcuuuuaaa

SEQ ID NO: 1162837 - RNA, 19 nt, Homo sapiens
uagcaaguuugacugaaua

SEQ ID NO: 1162838 - RNA, 19 nt, Homo sapiens
agugaaagcugaaagaaga

SEQ ID NO: 1162839 - RNA, 19 nt, Homo sapiens
gaacugugacuuuaagaau

SEQ ID NO: 1162840 - RNA, 19 nt, Homo sapiens
uacaugaacugugacuuua

SEQ ID NO: 1162841 - RNA, 19 nt, Homo sapiens
ugccaaagcuacuaucauu

SEQ ID NO: 1162842 - RNA, 19 nt, Homo sapiens
cauguaucauccugaaaua

SEQ ID NO: 1162843 - RNA, 19 nt, Homo sapiens
gaaacaaggcugcuuuuaa

SEQ ID NO: 1162844 - RNA, 19 nt, Homo sapiens
gaaggcagcuuugcagcau

SEQ ID NO: 1162845 - RNA, 19 nt, Homo sapiens
uaggauugcuaucaguaua

SEQ ID NO: 1162846 - RNA, 19 nt, Homo sapiens
aaaggaauguguaagugaa

SEQ ID NO: 1162847 - RNA, 19 nt, Homo sapiens
gaaaacuacuuaugcagaa

SEQ ID NO: 1162848 - RNA, 19 nt, Homo sapiens
gagcuccucuugccuaagu

SEQ ID NO: 1162849 - RNA, 19 nt, Homo sapiens
uaaauguugugacuagaug

SEQ ID NO: 1162850 - RNA, 19 nt, Homo sapiens
gaaagcugaaagaagaaua

SEQ ID NO: 1162851 - RNA, 19 nt, Homo sapiens
ugaaagaaaggaaugugua

SEQ ID NO: 1162852 - RNA, 19 nt, Homo sapiens
cuacaugaacugugacuuu

SEQ ID NO: 1162853 - RNA, 19 nt, Homo sapiens
uaaccagucuuaaccaucu

SEQ ID NO: 1162854 - RNA, 19 nt, Homo sapiens
uagggaaugugguagguuu

SEQ ID NO: 1162855 - RNA, 19 nt, Homo sapiens
agaauaaccaggaugauga

SEQ ID NO: 1162856 - RNA, 19 nt, Homo sapiens
gcgggcagaucacuugaga

SEQ ID NO: 1162857 - RNA, 19 nt, Homo sapiens
ugaacuggauggucacgaa

SEQ ID NO: 1162858 - RNA, 19 nt, Homo sapiens
ccaaagcuacuaucauuca

SEQ ID NO: 1162859 - RNA, 19 nt, Homo sapiens
ccacuggacauacuugaaa

SEQ ID NO: 1162860 - RNA, 19 nt, Homo sapiens
gcauccauauuugcuguuu

SEQ ID NO: 1162861 - RNA, 19 nt, Homo sapiens
gaaccuuauucuuccuguu

SEQ ID NO: 1162862 - RNA, 19 nt, Homo sapiens
cagaaccagucuucaacaa

SEQ ID NO: 1162863 - RNA, 19 nt, Homo sapiens
ggacaaagagaaaagaaaa

SEQ ID NO: 1162864 - RNA, 19 nt, Homo sapiens
guaucauccugaaauauuc

SEQ ID NO: 1162865 - RNA, 19 nt, Homo sapiens
cauauuugcuguuuauagg

SEQ ID NO: 1162866 - RNA, 19 nt, Homo sapiens
gauacuucaucacucaaga

SEQ ID NO: 1162867 - RNA, 19 nt, Homo sapiens
guaagugaaagcugaaaga

SEQ ID NO: 1162868 - RNA, 19 nt, Homo sapiens
guaccgugacuguaacuuu

SEQ ID NO: 1162869 - RNA, 19 nt, Homo sapiens
gaauuuuggugaacuuuga

SEQ ID NO: 1162870 - RNA, 19 nt, Homo sapiens
gcaggagaaucgcuugaac

SEQ ID NO: 1162871 - RNA, 19 nt, Homo sapiens
aauaauagggaauguggua

SEQ ID NO: 1162872 - RNA, 19 nt, Homo sapiens
ggucccaggugauugugaa

SEQ ID NO: 1162873 - RNA, 19 nt, Homo sapiens
agaaaggaauguguaagug

SEQ ID NO: 1162874 - RNA, 19 nt, Homo sapiens
cuacuaucauucagugcua

SEQ ID NO: 1162875 - RNA, 19 nt, Homo sapiens
ggugaaacccugucucuac

SEQ ID NO: 1162876 - RNA, 19 nt, Homo sapiens
ccaauugccacuggacaua

SEQ ID NO: 1162877 - RNA, 19 nt, Homo sapiens
uauaucauguccacaguag

SEQ ID NO: 1162878 - RNA, 19 nt, Homo sapiens
gcaaguuugacugaauaua

SEQ ID NO: 1162879 - RNA, 19 nt, Homo sapiens
acauucaucuggauacuuc

SEQ ID NO: 1162880 - RNA, 19 nt, Homo sapiens
cauccauauuugcuguuua

SEQ ID NO: 1162881 - RNA, 19 nt, Homo sapiens
cacaguagauuuucaagaa

SEQ ID NO: 1162882 - RNA, 19 nt, Homo sapiens
uccaaggaauugauuaugu

SEQ ID NO: 1162883 - RNA, 19 nt, Homo sapiens
caugaacugugacuuuaag

SEQ ID NO: 1162884 - RNA, 19 nt, Homo sapiens
gaaaacauuugcgauggaa

SEQ ID NO: 1162885 - RNA, 19 nt, Homo sapiens
caguauaccuuuugcguuu

SEQ ID NO: 1162886 - RNA, 19 nt, Homo sapiens
aaagaagaauaaccaggau

SEQ ID NO: 1162887 - RNA, 19 nt, Homo sapiens
gaaaauggcagcaaacucu

SEQ ID NO: 1162888 - RNA, 19 nt, Homo sapiens
cacuugagaucaggaguuu

SEQ ID NO: 1162889 - RNA, 19 nt, Homo sapiens
cauaaaugaugaguuugug

SEQ ID NO: 1162890 - RNA, 19 nt, Homo sapiens
guuaccacauaaaugauga

SEQ ID NO: 1162891 - RNA, 19 nt, Homo sapiens
uacauccucuuauuuagug

SEQ ID NO: 1162892 - RNA, 19 nt, Homo sapiens
cuagcaaguuugacugaau

SEQ ID NO: 1162893 - RNA, 19 nt, Homo sapiens
agaagaauaaccaggauga

SEQ ID NO: 1162894 - RNA, 19 nt, Homo sapiens
acucaagacucugcauuug

SEQ ID NO: 1162895 - RNA, 19 nt, Homo sapiens
guacauccucuuauuuagu

SEQ ID NO: 1162896 - RNA, 19 nt, Homo sapiens
cuucaucacucaagacucu

SEQ ID NO: 1162897 - RNA, 19 nt, Homo sapiens
gagcugagacggugucacu

SEQ ID NO: 1162898 - RNA, 19 nt, Homo sapiens
uggacauacuugaaacaaa

SEQ ID NO: 1162899 - RNA, 19 nt, Homo sapiens
gcacauucaucuggauacu

SEQ ID NO: 1162900 - RNA, 19 nt, Homo sapiens
gcagaaccagucuucaaca

SEQ ID NO: 1162901 - RNA, 19 nt, Homo sapiens
gugaaacccugucucuacu

SEQ ID NO: 1162902 - RNA, 19 nt, Homo sapiens
ucaaucagacugugaacug

SEQ ID NO: 1162903 - RNA, 19 nt, Homo sapiens
gcugaaagaagaauaacca

SEQ ID NO: 1162904 - RNA, 19 nt, Homo sapiens
caaaugccaaagcuacuau

SEQ ID NO: 1162905 - RNA, 19 nt, Homo sapiens
gcagaacuggacaaagaga

SEQ ID NO: 1162906 - RNA, 19 nt, Homo sapiens
uuauguaccgugacuguaa

SEQ ID NO: 1162907 - RNA, 19 nt, Homo sapiens
gaugaugagagcuguggaa

SEQ ID NO: 1162908 - RNA, 19 nt, Homo sapiens
uaagugaaagcugaaagaa

SEQ ID NO: 1162909 - RNA, 19 nt, Homo sapiens
aguguuaccacauaaauga

SEQ ID NO: 1162910 - RNA, 19 nt, Homo sapiens
gcauuugggaaccuuauuc

SEQ ID NO: 1162911 - RNA, 19 nt, Homo sapiens
uuuaagagcagcgauugua

SEQ ID NO: 1162912 - RNA, 19 nt, Homo sapiens
gauuauguaccgugacugu

SEQ ID NO: 1162913 - RNA, 19 nt, Homo sapiens
ucaaaugccaaagcuacua

SEQ ID NO: 1162914 - RNA, 19 nt, Homo sapiens
ccuguaaucccagcacuuu

SEQ ID NO: 1162915 - RNA, 19 nt, Homo sapiens
uuaagagcagcgauuguaa

SEQ ID NO: 1162916 - RNA, 19 nt, Homo sapiens
uaucauguccacaguagau

SEQ ID NO: 1162917 - RNA, 19 nt, Homo sapiens
agcaaacucuucaggacaa

SEQ ID NO: 1162918 - RNA, 19 nt, Homo sapiens
cuugagaucaggaguuuga

SEQ ID NO: 1162919 - RNA, 19 nt, Homo sapiens
augaugaguuugugugguu

SEQ ID NO: 1162920 - RNA, 19 nt, Homo sapiens
uuucuggacuuauaacuac

SEQ ID NO: 1162921 - RNA, 19 nt, Homo sapiens
cuggauacuucaucacuca

SEQ ID NO: 1162922 - RNA, 19 nt, Homo sapiens
caacauaaguggcaucaua

SEQ ID NO: 1162923 - RNA, 19 nt, Homo sapiens
gagcugagaugauagauuu

SEQ ID NO: 1162924 - RNA, 19 nt, Homo sapiens
gaaauaucguugugaaguu

SEQ ID NO: 1162925 - RNA, 19 nt, Homo sapiens
caucauagcagccguagua

SEQ ID NO: 1162926 - RNA, 19 nt, Homo sapiens
aauauaaucuggcuucuug

SEQ ID NO: 1162927 - RNA, 19 nt, Homo sapiens
agacuccacuuuagagaua

SEQ ID NO: 1162928 - RNA, 19 nt, Homo sapiens
gaauccagcuccugaauac

SEQ ID NO: 1162929 - RNA, 19 nt, Homo sapiens
ggaaacgaaugcaaguaga

SEQ ID NO: 1162930 - RNA, 19 nt, Homo sapiens
gaauacacaugguuuaagg

SEQ ID NO: 1162931 - RNA, 19 nt, Homo sapiens
ggaacucugcaauuuaaua

SEQ ID NO: 1162932 - RNA, 19 nt, Homo sapiens
aaaucgagcugagaugaua

SEQ ID NO: 1162933 - RNA, 19 nt, Homo sapiens
aaacugacaucccaucuag

SEQ ID NO: 1162934 - RNA, 19 nt, Homo sapiens
ggaauccagcuccugaaua

SEQ ID NO: 1162935 - RNA, 19 nt, Homo sapiens
caacagcucauacacaaug

SEQ ID NO: 1162936 - RNA, 19 nt, Homo sapiens
gaaacugacaucccaucua

SEQ ID NO: 1162937 - RNA, 19 nt, Homo sapiens
cuggaacucugcaauuuaa

SEQ ID NO: 1162938 - RNA, 19 nt, Homo sapiens
ggaaauaucguugugaagu

SEQ ID NO: 1162939 - RNA, 19 nt, Homo sapiens
cauagcagccguaguaguu

SEQ ID NO: 1162940 - RNA, 19 nt, Homo sapiens
gcaguuccaucaugugaag

SEQ ID NO: 1162941 - RNA, 19 nt, Homo sapiens
cguaguaguuguggccuua

SEQ ID NO: 1162942 - RNA, 19 nt, Homo sapiens
gaaaggaguuggggcaaaa

SEQ ID NO: 1162943 - RNA, 19 nt, Homo sapiens
ccgcaauucuguuggauau

SEQ ID NO: 1162944 - RNA, 19 nt, Homo sapiens
ggaagaggauacagucacu

SEQ ID NO: 1162945 - RNA, 19 nt, Homo sapiens
gcaauucuguuggauaucg

SEQ ID NO: 1162946 - RNA, 19 nt, Homo sapiens
guuguggccuuagugauuu

SEQ ID NO: 1162947 - RNA, 19 nt, Homo sapiens
gcacacaaaauccuuuaua

SEQ ID NO: 1162948 - RNA, 19 nt, Homo sapiens
uacagucacucuggaagua

SEQ ID NO: 1162949 - RNA, 19 nt, Homo sapiens
caccugaacuugcuauuuu

SEQ ID NO: 1162950 - RNA, 19 nt, Homo sapiens
uaacucaccugaacuugcu

SEQ ID NO: 1162951 - RNA, 19 nt, Homo sapiens
gaaacgaaugcaaguagau

SEQ ID NO: 1162952 - RNA, 19 nt, Homo sapiens
gaacucugcaauuuaauac

SEQ ID NO: 1162953 - RNA, 19 nt, Homo sapiens
aaacuggaacucugcaauu

SEQ ID NO: 1162954 - RNA, 19 nt, Homo sapiens
ggagaauauuccugugaag

SEQ ID NO: 1162955 - RNA, 19 nt, Homo sapiens
acacaaagccgaucaaucc

SEQ ID NO: 1162956 - RNA, 19 nt, Homo sapiens
ucaacagacucuucaaggu

SEQ ID NO: 1162957 - RNA, 19 nt, Homo sapiens
caccaaagccaccguuguu

SEQ ID NO: 1162958 - RNA, 19 nt, Homo sapiens
uggagaauauuccugugaa

SEQ ID NO: 1162959 - RNA, 19 nt, Homo sapiens
gcguuucccuacccgcaua

SEQ ID NO: 1162960 - RNA, 19 nt, Homo sapiens
gaagugaugcggggaaaua

SEQ ID NO: 1162961 - RNA, 19 nt, Homo sapiens
guaccaagaggcuauuuua

SEQ ID NO: 1162962 - RNA, 19 nt, Homo sapiens
gaugaucucaacauaagug

SEQ ID NO: 1162963 - RNA, 19 nt, Homo sapiens
acuggacacuggagaauau

SEQ ID NO: 1162964 - RNA, 19 nt, Homo sapiens
accaacagcucauacacaa

SEQ ID NO: 1162965 - RNA, 19 nt, Homo sapiens
ggcauccguuugcuagaaa

SEQ ID NO: 1162966 - RNA, 19 nt, Homo sapiens
gacuguuuccuccagauua

SEQ ID NO: 1162967 - RNA, 19 nt, Homo sapiens
ucuaaagccacgacaauga

SEQ ID NO: 1162968 - RNA, 19 nt, Homo sapiens
gggaaacgaaugcaaguag

SEQ ID NO: 1162969 - RNA, 19 nt, Homo sapiens
acaaguagucacagcagua

SEQ ID NO: 1162970 - RNA, 19 nt, Homo sapiens
uuucaugacuacuaacuca

SEQ ID NO: 1162971 - RNA, 19 nt, Homo sapiens
gaggaaauggaauugguau

SEQ ID NO: 1162972 - RNA, 19 nt, Homo sapiens
caaagagguacacgaggaa

SEQ ID NO: 1162973 - RNA, 19 nt, Homo sapiens
cgacauuugcaaagaggua

SEQ ID NO: 1162974 - RNA, 19 nt, Homo sapiens
caaagccaccguuguuaca

SEQ ID NO: 1162975 - RNA, 19 nt, Homo sapiens
gaagcccgcaauucuguug

SEQ ID NO: 1162976 - RNA, 19 nt, Homo sapiens
aacuggaacucugcaauuu

SEQ ID NO: 1162977 - RNA, 19 nt, Homo sapiens
gaguggaacugugguagag

SEQ ID NO: 1162978 - RNA, 19 nt, Homo sapiens
cagauuagaguggaagaaa

SEQ ID NO: 1162979 - RNA, 19 nt, Homo sapiens
cgaggaaauggaauuggua

SEQ ID NO: 1162980 - RNA, 19 nt, Homo sapiens
caucuaaagccacgacaau

SEQ ID NO: 1162981 - RNA, 19 nt, Homo sapiens
caaacuggacacuggagaa

SEQ ID NO: 1162982 - RNA, 19 nt, Homo sapiens
auuaguggcuccagcaguu

SEQ ID NO: 1162983 - RNA, 19 nt, Homo sapiens
guaguuguggccuuaguga

SEQ ID NO: 1162984 - RNA, 19 nt, Homo sapiens
ggauacagucacucuggaa

SEQ ID NO: 1162985 - RNA, 19 nt, Homo sapiens
gcaauuuaauacuguuucc

SEQ ID NO: 1162986 - RNA, 19 nt, Homo sapiens
uggcauccguuugcuagaa

SEQ ID NO: 1162987 - RNA, 19 nt, Homo sapiens
ccugaauacacaugguuua

SEQ ID NO: 1162988 - RNA, 19 nt, Homo sapiens
cagcaguuccaucauguga

SEQ ID NO: 1162989 - RNA, 19 nt, Homo sapiens
ucacagcaguagaguacca

SEQ ID NO: 1162990 - RNA, 19 nt, Homo sapiens
ucaccugaacuugcuauuu

SEQ ID NO: 1162991 - RNA, 19 nt, Homo sapiens
cagucacucuggaaguauu

SEQ ID NO: 1162992 - RNA, 19 nt, Homo sapiens
cuucuugugucuggacuaa

SEQ ID NO: 1162993 - RNA, 19 nt, Homo sapiens
gguguaugcuaugcucaga

SEQ ID NO: 1162994 - RNA, 19 nt, Homo sapiens
ggggaaauaucguugugaa

SEQ ID NO: 1162995 - RNA, 19 nt, Homo sapiens
gcuagaaaaucccagacuu

SEQ ID NO: 1162996 - RNA, 19 nt, Homo sapiens
ccuuagugauuuccguuug

SEQ ID NO: 1162997 - RNA, 19 nt, Homo sapiens
gugaagcccgcaauucugu

SEQ ID NO: 1162998 - RNA, 19 nt, Homo sapiens
acuggaacucugcaauuua

SEQ ID NO: 1162999 - RNA, 19 nt, Homo sapiens
gacaaugagugaaaaugau

SEQ ID NO: 1163000 - RNA, 19 nt, Homo sapiens
uagcagccguaguaguugu

SEQ ID NO: 1163001 - RNA, 19 nt, Homo sapiens
acucugcaauuuaauacug

SEQ ID NO: 1163002 - RNA, 19 nt, Homo sapiens
gggaauccagcuccugaau

SEQ ID NO: 1163003 - RNA, 19 nt, Homo sapiens
gcgcggaccagacacaaag

SEQ ID NO: 1163004 - RNA, 19 nt, Homo sapiens
gauuagaguggaagaaacu

SEQ ID NO: 1163005 - RNA, 19 nt, Homo sapiens
gguacacgaggaaauggaa

SEQ ID NO: 1163006 - RNA, 19 nt, Homo sapiens
cccaaaagaccaacaagua

SEQ ID NO: 1163007 - RNA, 19 nt, Homo sapiens
ccgacucucugcuccuuuc

SEQ ID NO: 1163008 - RNA, 19 nt, Homo sapiens
ccaaagccaccguuguuac

SEQ ID NO: 1163009 - RNA, 19 nt, Homo sapiens
ggaaacugacaucccaucu

SEQ ID NO: 1163010 - RNA, 19 nt, Homo sapiens
gacacaaagccgaucaauc

SEQ ID NO: 1163011 - RNA, 19 nt, Homo sapiens
gcugagaugauagauuuca

SEQ ID NO: 1163012 - RNA, 19 nt, Homo sapiens
gagugucuccuuugucuac

SEQ ID NO: 1163013 - RNA, 19 nt, Homo sapiens
cgacaaugagugaaaauga

SEQ ID NO: 1163014 - RNA, 19 nt, Homo sapiens
aaacgaaugcaaguagaug

SEQ ID NO: 1163015 - RNA, 19 nt, Homo sapiens
cugaauacacaugguuuaa

SEQ ID NO: 1163016 - RNA, 19 nt, Homo sapiens
ucuugugucuggacuaagu

SEQ ID NO: 1163017 - RNA, 19 nt, Homo sapiens
gacccucgaccuccucaga

SEQ ID NO: 1163018 - RNA, 19 nt, Homo sapiens
acuacuaacucaccugaac

SEQ ID NO: 1163019 - RNA, 19 nt, Homo sapiens
ccacgacaaugagugaaaa

SEQ ID NO: 1163020 - RNA, 19 nt, Homo sapiens
gccacgacaaugagugaaa

SEQ ID NO: 1163021 - RNA, 19 nt, Homo sapiens
caaguagucacagcaguag

SEQ ID NO: 1163022 - RNA, 19 nt, Homo sapiens
ggagguugauuacuuuaua

SEQ ID NO: 1163023 - RNA, 19 nt, Homo sapiens
gaaggagagguauuucuua

SEQ ID NO: 1163024 - RNA, 19 nt, Homo sapiens
gcagauagcauauuauaca

SEQ ID NO: 1163025 - RNA, 19 nt, Homo sapiens
gaaauguucuugugaagcu

SEQ ID NO: 1163026 - RNA, 19 nt, Homo sapiens
cacuggcucuucuuaauua

SEQ ID NO: 1163027 - RNA, 19 nt, Homo sapiens
ggagagguauuucuuagag

SEQ ID NO: 1163028 - RNA, 19 nt, Homo sapiens
gcaguaggguccauuccaa

SEQ ID NO: 1163029 - RNA, 19 nt, Homo sapiens
ccgaguagcugggacuaua

SEQ ID NO: 1163030 - RNA, 19 nt, Homo sapiens
cagguaaucuucccacuuc

SEQ ID NO: 1163031 - RNA, 19 nt, Homo sapiens
ggaaggagagguauuucuu

SEQ ID NO: 1163032 - RNA, 19 nt, Homo sapiens
uauggugccuugaaauaaa

SEQ ID NO: 1163033 - RNA, 19 nt, Homo sapiens
auuccaagauugucaguua

SEQ ID NO: 1163034 - RNA, 19 nt, Homo sapiens
ggaguacaguggcaugauc

SEQ ID NO: 1163035 - RNA, 19 nt, Homo sapiens
aauaguacaucuagugguu

SEQ ID NO: 1163036 - RNA, 19 nt, Homo sapiens
aagcagaucuuccucucuu

SEQ ID NO: 1163037 - RNA, 19 nt, Homo sapiens
cugaaagaguuuacagaaa

SEQ ID NO: 1163038 - RNA, 19 nt, Homo sapiens
ggaauaccagccugaguga

SEQ ID NO: 1163039 - RNA, 19 nt, Homo sapiens
gggcagcucguuucucaaa

SEQ ID NO: 1163040 - RNA, 19 nt, Homo sapiens
aagcaaggcaagugaauuu

SEQ ID NO: 1163041 - RNA, 19 nt, Homo sapiens
gagagguauuucuuagaga

SEQ ID NO: 1163042 - RNA, 19 nt, Homo sapiens
guacaucuagugguucuuu

SEQ ID NO: 1163043 - RNA, 19 nt, Homo sapiens
uaaguguuguggguacaua

SEQ ID NO: 1163044 - RNA, 19 nt, Homo sapiens
guucaccucuguguccuuu

SEQ ID NO: 1163045 - RNA, 19 nt, Homo sapiens
gagaggaagugaggagaag

SEQ ID NO: 1163046 - RNA, 19 nt, Homo sapiens
ccacuaugcccagcuaauu

SEQ ID NO: 1163047 - RNA, 19 nt, Homo sapiens
cuacuugaaaugcuguuua

SEQ ID NO: 1163048 - RNA, 19 nt, Homo sapiens
ccacuggcucuucuuaauu

SEQ ID NO: 1163049 - RNA, 19 nt, Homo sapiens
ggagaggaagugaggagaa

SEQ ID NO: 1163050 - RNA, 19 nt, Homo sapiens
gcagcaguaugccuauaag

SEQ ID NO: 1163051 - RNA, 19 nt, Homo sapiens
aaagacaccugugcaccuu

SEQ ID NO: 1163052 - RNA, 19 nt, Homo sapiens
uaggguccauuccaagauu

SEQ ID NO: 1163053 - RNA, 19 nt, Homo sapiens
ccgggcagcucguuucuca

SEQ ID NO: 1163054 - RNA, 19 nt, Homo sapiens
cagcagcaguaugccuaua

SEQ ID NO: 1163055 - RNA, 19 nt, Homo sapiens
aauuagaagugaccaguuc

SEQ ID NO: 1163056 - RNA, 19 nt, Homo sapiens
ucuagugguucuuuccaaa

SEQ ID NO: 1163057 - RNA, 19 nt, Homo sapiens
aaggagagguauuucuuag

SEQ ID NO: 1163058 - RNA, 19 nt, Homo sapiens
uggucucacucgcgauuua

SEQ ID NO: 1163059 - RNA, 19 nt, Homo sapiens
ccaaagucuuccuggugaa

SEQ ID NO: 1163060 - RNA, 19 nt, Homo sapiens
gcugaaccgucaccucaag

SEQ ID NO: 1163061 - RNA, 19 nt, Homo sapiens
gauugucaguuaccguuag

SEQ ID NO: 1163062 - RNA, 19 nt, Homo sapiens
ccacuguuucuucuucuuu

SEQ ID NO: 1163063 - RNA, 19 nt, Homo sapiens
gaugagcucccggaugaga

SEQ ID NO: 1163064 - RNA, 19 nt, Homo sapiens
gagaugggguuuugcuaga

SEQ ID NO: 1163065 - RNA, 19 nt, Homo sapiens
ugugugauguuuaacuuca

SEQ ID NO: 1163066 - RNA, 19 nt, Homo sapiens
uggcgcaguugcucacauu

SEQ ID NO: 1163067 - RNA, 19 nt, Homo sapiens
cauacuguuuggaacuuug

SEQ ID NO: 1163068 - RNA, 19 nt, Homo sapiens
uuuauggugccuugaaaua

SEQ ID NO: 1163069 - RNA, 19 nt, Homo sapiens
cccacuggcucuucuuaau

SEQ ID NO: 1163070 - RNA, 19 nt, Homo sapiens
gcucucuguucagggcuua

SEQ ID NO: 1163071 - RNA, 19 nt, Homo sapiens
gcucacauucaccaaaguu

SEQ ID NO: 1163072 - RNA, 19 nt, Homo sapiens
gaggaagugaggagaagga

SEQ ID NO: 1163073 - RNA, 19 nt, Homo sapiens
cacuaugcccagcuaauuu

SEQ ID NO: 1163074 - RNA, 19 nt, Homo sapiens
gugccacuaugcccagcua

SEQ ID NO: 1163075 - RNA, 19 nt, Homo sapiens
gcuuauugugugauguuua

SEQ ID NO: 1163076 - RNA, 19 nt, Homo sapiens
acacacggaaggagaggua

SEQ ID NO: 1163077 - RNA, 19 nt, Homo sapiens
gggcuuauugugugauguu

SEQ ID NO: 1163078 - RNA, 19 nt, Homo sapiens
gaggacagacguucacacu

SEQ ID NO: 1163079 - RNA, 19 nt, Homo sapiens
gagugagccaggacuguga

SEQ ID NO: 1163080 - RNA, 19 nt, Homo sapiens
uaguagguguauaugcauu

SEQ ID NO: 1163081 - RNA, 19 nt, Homo sapiens
caaggcaagugaauuuugu

SEQ ID NO: 1163082 - RNA, 19 nt, Homo sapiens
gugaggaggaggagaggaa

SEQ ID NO: 1163083 - RNA, 19 nt, Homo sapiens
aggcauucgucccuacaaa

SEQ ID NO: 1163084 - RNA, 19 nt, Homo sapiens
gcuguccacuguuucuucu

SEQ ID NO: 1163085 - RNA, 19 nt, Homo sapiens
uaagcaaggcaagugaauu

SEQ ID NO: 1163086 - RNA, 19 nt, Homo sapiens
gagagaucaucauuuuaug

SEQ ID NO: 1163087 - RNA, 19 nt, Homo sapiens
uguccugucuggcgcaguu

SEQ ID NO: 1163088 - RNA, 19 nt, Homo sapiens
cuauaggugugugccacua

SEQ ID NO: 1163089 - RNA, 19 nt, Homo sapiens
gagguggggagguugauua

SEQ ID NO: 1163090 - RNA, 19 nt, Homo sapiens
gcgcaguugcucacauuca

SEQ ID NO: 1163091 - RNA, 19 nt, Homo sapiens
gcacguccgcacacacaca

SEQ ID NO: 1163092 - RNA, 19 nt, Homo sapiens
guaccuguagucccagcua

SEQ ID NO: 1163093 - RNA, 19 nt, Homo sapiens
uguccacuguuucuucuuc

SEQ ID NO: 1163094 - RNA, 19 nt, Homo sapiens
cacuucagccucccgagua

SEQ ID NO: 1163095 - RNA, 19 nt, Homo sapiens
ggucucacucgcgauuuaa

SEQ ID NO: 1163096 - RNA, 19 nt, Homo sapiens
cacggaaggagagguauuu

SEQ ID NO: 1163097 - RNA, 19 nt, Homo sapiens
gaccaguucaccucugugu

SEQ ID NO: 1163098 - RNA, 19 nt, Homo sapiens
ggagucccaccugaagaaa

SEQ ID NO: 1163099 - RNA, 19 nt, Homo sapiens
uacauacuguuuggaacuu

SEQ ID NO: 1163100 - RNA, 19 nt, Homo sapiens
gaguacaguggcaugauca

SEQ ID NO: 1163101 - RNA, 19 nt, Homo sapiens
agacaaguucucacucugu

SEQ ID NO: 1163102 - RNA, 19 nt, Homo sapiens
gcaaggcaagugaauuuug

SEQ ID NO: 1163103 - RNA, 19 nt, Homo sapiens
ggaggaggagaggaaguga

SEQ ID NO: 1163104 - RNA, 19 nt, Homo sapiens
caccaugcccaaagucuuc

SEQ ID NO: 1163105 - RNA, 19 nt, Homo sapiens
guuuggaacuuugcauuuu

SEQ ID NO: 1163106 - RNA, 19 nt, Homo sapiens
gcagaucuuccucucuuuu

SEQ ID NO: 1163107 - RNA, 19 nt, Homo sapiens
uuaguuguguggguuugaa

SEQ ID NO: 1163108 - RNA, 19 nt, Homo sapiens
guggggagguugauuacuu

SEQ ID NO: 1163109 - RNA, 19 nt, Homo sapiens
gggagguugauuacuuuau

SEQ ID NO: 1163110 - RNA, 19 nt, Homo sapiens
cuuagagagaucaucauuu

SEQ ID NO: 1163111 - RNA, 19 nt, Homo sapiens
gguauuucuuagagagauc

SEQ ID NO: 1163112 - RNA, 19 nt, Homo sapiens
uaauuagaagugaccaguu

SEQ ID NO: 1163113 - RNA, 19 nt, Homo sapiens
acacugccacguaugucua

SEQ ID NO: 1163114 - RNA, 19 nt, Homo sapiens
aagagaaucgcuugaaacu

SEQ ID NO: 1163115 - RNA, 19 nt, Homo sapiens
ggcauucgucccuacaaau

SEQ ID NO: 1163116 - RNA, 19 nt, Homo sapiens
gagguauuucuuagagaga

SEQ ID NO: 1163117 - RNA, 19 nt, Homo sapiens
acucgcgauuuaaggcaua

SEQ ID NO: 1163118 - RNA, 19 nt, Homo sapiens
gcagcagcaguaugccuau

SEQ ID NO: 1163119 - RNA, 19 nt, Homo sapiens
gaauauagcucugcauuua

SEQ ID NO: 1163120 - RNA, 19 nt, Homo sapiens
gguagacacuggauaaaga

SEQ ID NO: 1163121 - RNA, 19 nt, Homo sapiens
uggcagagauagauacuaa

SEQ ID NO: 1163122 - RNA, 19 nt, Homo sapiens
gauuggcccuguuguauga

SEQ ID NO: 1163123 - RNA, 19 nt, Homo sapiens
gcacaugguggcagagaua

SEQ ID NO: 1163124 - RNA, 19 nt, Homo sapiens
ucagagaaguguaccauca

SEQ ID NO: 1163125 - RNA, 19 nt, Homo sapiens
gaagguccauaugcuugua

SEQ ID NO: 1163126 - RNA, 19 nt, Homo sapiens
ggaauauagcucugcauuu

SEQ ID NO: 1163127 - RNA, 19 nt, Homo sapiens
cggaauugcugcucaguga

SEQ ID NO: 1163128 - RNA, 19 nt, Homo sapiens
aaagguagacacuggauaa

SEQ ID NO: 1163129 - RNA, 19 nt, Homo sapiens
gauacuaacccauggacuu

SEQ ID NO: 1163130 - RNA, 19 nt, Homo sapiens
ccuaaagucaguauaacua

SEQ ID NO: 1163131 - RNA, 19 nt, Homo sapiens
ggauggggaugcuugauuu

SEQ ID NO: 1163132 - RNA, 19 nt, Homo sapiens
gcauguacuuguuccucaa

SEQ ID NO: 1163133 - RNA, 19 nt, Homo sapiens
ugaucaccaucuauuauga

SEQ ID NO: 1163134 - RNA, 19 nt, Homo sapiens
gaauugcugcucagugaug

SEQ ID NO: 1163135 - RNA, 19 nt, Homo sapiens
gcucagaccuugucaaaac

SEQ ID NO: 1163136 - RNA, 19 nt, Homo sapiens
uagccuaaagucaguauaa

SEQ ID NO: 1163137 - RNA, 19 nt, Homo sapiens
cucaauaguucaggacuuu

SEQ ID NO: 1163138 - RNA, 19 nt, Homo sapiens
aaaguagccuaaagucagu

SEQ ID NO: 1163139 - RNA, 19 nt, Homo sapiens
gggauuggcccuguuguau

SEQ ID NO: 1163140 - RNA, 19 nt, Homo sapiens
ggagcguggccauggauaa

SEQ ID NO: 1163141 - RNA, 19 nt, Homo sapiens
aaaccacccugcagcuuag

SEQ ID NO: 1163142 - RNA, 19 nt, Homo sapiens
caaagguagacacuggaua

SEQ ID NO: 1163143 - RNA, 19 nt, Homo sapiens
aaacgcaacaccuacuuug

SEQ ID NO: 1163144 - RNA, 19 nt, Homo sapiens
guagacacuggauaaagaa

SEQ ID NO: 1163145 - RNA, 19 nt, Homo sapiens
gaacgaggugggacaaggu

SEQ ID NO: 1163146 - RNA, 19 nt, Homo sapiens
cauggugggcuucacagua

SEQ ID NO: 1163147 - RNA, 19 nt, Homo sapiens
gauaaagaacccgguagug

SEQ ID NO: 1163148 - RNA, 19 nt, Homo sapiens
gcucaucccugugcauggu

SEQ ID NO: 1163149 - RNA, 19 nt, Homo sapiens
ccaggguauuugagaguga

SEQ ID NO: 1163150 - RNA, 19 nt, Homo sapiens
ggauaaagaacccgguagu

SEQ ID NO: 1163151 - RNA, 19 nt, Homo sapiens
ggauuggcccuguuguaug

SEQ ID NO: 1163152 - RNA, 19 nt, Homo sapiens
gcugucaguacgauuauug

SEQ ID NO: 1163153 - RNA, 19 nt, Homo sapiens
cuauuaugaugucaagguu

SEQ ID NO: 1163154 - RNA, 19 nt, Homo sapiens
auauagcucugcauuuaca

SEQ ID NO: 1163155 - RNA, 19 nt, Homo sapiens
ugucaagguucgcuucauc

SEQ ID NO: 1163156 - RNA, 19 nt, Homo sapiens
aaaugaagguccauaugcu

SEQ ID NO: 1163157 - RNA, 19 nt, Homo sapiens
ccucacccuuccugaauuc

SEQ ID NO: 1163158 - RNA, 19 nt, Homo sapiens
ccucaauaguucaggacuu

SEQ ID NO: 1163159 - RNA, 19 nt, Homo sapiens
gugaucaccaucuauuaug

SEQ ID NO: 1163160 - RNA, 19 nt, Homo sapiens
gagcguggccauggauaau

SEQ ID NO: 1163161 - RNA, 19 nt, Homo sapiens
cgguagugcccagguauua

SEQ ID NO: 1163162 - RNA, 19 nt, Homo sapiens
gguaugcaagacaaaggua

SEQ ID NO: 1163163 - RNA, 19 nt, Homo sapiens
gagggaauaggucuuugga

SEQ ID NO: 1163164 - RNA, 19 nt, Homo sapiens
uggauaaucgggcuuccua

SEQ ID NO: 1163165 - RNA, 19 nt, Homo sapiens
cccugcagcuuaggauuaa

SEQ ID NO: 1163166 - RNA, 19 nt, Homo sapiens
gcugcucagugaugugugu

SEQ ID NO: 1163167 - RNA, 19 nt, Homo sapiens
auacuaacccauggacuuu

SEQ ID NO: 1163168 - RNA, 19 nt, Homo sapiens
guacuuguuccucaauagu

SEQ ID NO: 1163169 - RNA, 19 nt, Homo sapiens
gcauuucaggcucagagaa

SEQ ID NO: 1163170 - RNA, 19 nt, Homo sapiens
gggagggaauaggucuuug

SEQ ID NO: 1163171 - RNA, 19 nt, Homo sapiens
uccuaccgcugccaagaaa

SEQ ID NO: 1163172 - RNA, 19 nt, Homo sapiens
caagguucgcuucaucguu

SEQ ID NO: 1163173 - RNA, 19 nt, Homo sapiens
gauaaucgggcuuccuacu

SEQ ID NO: 1163174 - RNA, 19 nt, Homo sapiens
uggaggguaugcaagacaa

SEQ ID NO: 1163175 - RNA, 19 nt, Homo sapiens
acucccagauucagugguu

SEQ ID NO: 1163176 - RNA, 19 nt, Homo sapiens
ccccagaauuccaaaauga

SEQ ID NO: 1163177 - RNA, 19 nt, Homo sapiens
cugcucagaccuugucaaa

SEQ ID NO: 1163178 - RNA, 19 nt, Homo sapiens
ucaggaaccagacguugug

SEQ ID NO: 1163179 - RNA, 19 nt, Homo sapiens
gggcuucacaguaggaaag

SEQ ID NO: 1163180 - RNA, 19 nt, Homo sapiens
ggagggaauaggucuuugg

SEQ ID NO: 1163181 - RNA, 19 nt, Homo sapiens
uaacuaaaggguggaacga

SEQ ID NO: 1163182 - RNA, 19 nt, Homo sapiens
uauugcaacuccuggucaa

SEQ ID NO: 1163183 - RNA, 19 nt, Homo sapiens
gacaagguccggaauugcu

SEQ ID NO: 1163184 - RNA, 19 nt, Homo sapiens
aggaauauagcucugcauu

SEQ ID NO: 1163185 - RNA, 19 nt, Homo sapiens
ggaggguaugcaagacaaa

SEQ ID NO: 1163186 - RNA, 19 nt, Homo sapiens
caccucacccuuccugaau

SEQ ID NO: 1163187 - RNA, 19 nt, Homo sapiens
gaaccugggcuugucuuuu

SEQ ID NO: 1163188 - RNA, 19 nt, Homo sapiens
ccagugcugucaguacgau

SEQ ID NO: 1163189 - RNA, 19 nt, Homo sapiens
guggacaguacauuuccua

SEQ ID NO: 1163190 - RNA, 19 nt, Homo sapiens
gcucagagaaguguaccau

SEQ ID NO: 1163191 - RNA, 19 nt, Homo sapiens
aaaaccacccugcagcuua

SEQ ID NO: 1163192 - RNA, 19 nt, Homo sapiens
ugucccuccugccaaguaa

SEQ ID NO: 1163193 - RNA, 19 nt, Homo sapiens
gccauuacucccacacuca

SEQ ID NO: 1163194 - RNA, 19 nt, Homo sapiens
caagacaaagguagacacu

SEQ ID NO: 1163195 - RNA, 19 nt, Homo sapiens
gcagagauagauacuaacc

SEQ ID NO: 1163196 - RNA, 19 nt, Homo sapiens
auggugggcuucacaguag

SEQ ID NO: 1163197 - RNA, 19 nt, Homo sapiens
ggucauggugggcuucaca

SEQ ID NO: 1163198 - RNA, 19 nt, Homo sapiens
caaaaugaagguccauaug

SEQ ID NO: 1163199 - RNA, 19 nt, Homo sapiens
acccugcagcuuaggauua

SEQ ID NO: 1163200 - RNA, 19 nt, Homo sapiens
gcaaguaacucccugauuu

SEQ ID NO: 1163201 - RNA, 19 nt, Homo sapiens
caacagaacuggaaugaga

SEQ ID NO: 1163202 - RNA, 19 nt, Homo sapiens
gcaaauauguggagaaacu

SEQ ID NO: 1163203 - RNA, 19 nt, Homo sapiens
gcauggaucuugaacagaa

SEQ ID NO: 1163204 - RNA, 19 nt, Homo sapiens
caugacaucuucaguauga

SEQ ID NO: 1163205 - RNA, 19 nt, Homo sapiens
agagauggcugaauuucua

SEQ ID NO: 1163206 - RNA, 19 nt, Homo sapiens
gcaagacacuucacuacuc

SEQ ID NO: 1163207 - RNA, 19 nt, Homo sapiens
gguauacuguucucauaaa

SEQ ID NO: 1163208 - RNA, 19 nt, Homo sapiens
ccaggucucucgaaagaaa

SEQ ID NO: 1163209 - RNA, 19 nt, Homo sapiens
ccagaacccugacucuuga

SEQ ID NO: 1163210 - RNA, 19 nt, Homo sapiens
cagcaauucugucuucauu

SEQ ID NO: 1163211 - RNA, 19 nt, Homo sapiens
guagcuauguggaagguaa

SEQ ID NO: 1163212 - RNA, 19 nt, Homo sapiens
cagcaaauauguggagaaa

SEQ ID NO: 1163213 - RNA, 19 nt, Homo sapiens
ugucgaccaucauaucuua

SEQ ID NO: 1163214 - RNA, 19 nt, Homo sapiens
ggaaaugaagccugugauu

SEQ ID NO: 1163215 - RNA, 19 nt, Homo sapiens
ggcaugacaucuucaguau

SEQ ID NO: 1163216 - RNA, 19 nt, Homo sapiens
uugcagaucuccaugcuuu

SEQ ID NO: 1163217 - RNA, 19 nt, Homo sapiens
gaaaagaccagaagacuau

SEQ ID NO: 1163218 - RNA, 19 nt, Homo sapiens
gaccagaagacuaucuaua

SEQ ID NO: 1163219 - RNA, 19 nt, Homo sapiens
ccagagaguaucuugauuu

SEQ ID NO: 1163220 - RNA, 19 nt, Homo sapiens
agagugcgcuuuggaaauu

SEQ ID NO: 1163221 - RNA, 19 nt, Homo sapiens
cuaccugacucacuucaaa

SEQ ID NO: 1163222 - RNA, 19 nt, Homo sapiens
gaagugcagucagaucuca

SEQ ID NO: 1163223 - RNA, 19 nt, Homo sapiens
caaaggacagcaaauaugu

SEQ ID NO: 1163224 - RNA, 19 nt, Homo sapiens
guuuggagauucagcaauu

SEQ ID NO: 1163225 - RNA, 19 nt, Homo sapiens
gaaccaaaggaauuuaugu

SEQ ID NO: 1163226 - RNA, 19 nt, Homo sapiens
gaggcuaccugacucacuu

SEQ ID NO: 1163227 - RNA, 19 nt, Homo sapiens
ggccauuagugcaauauau

SEQ ID NO: 1163228 - RNA, 19 nt, Homo sapiens
cuaaugcucccauaaacua

SEQ ID NO: 1163229 - RNA, 19 nt, Homo sapiens
caacauggaccuuaaaauu

SEQ ID NO: 1163230 - RNA, 19 nt, Homo sapiens
caguuugacuucacuuuga

SEQ ID NO: 1163231 - RNA, 19 nt, Homo sapiens
aggaagcccugucagcaua

SEQ ID NO: 1163232 - RNA, 19 nt, Homo sapiens
gccauuagugcaauauaua

SEQ ID NO: 1163233 - RNA, 19 nt, Homo sapiens
caacugaggcugaggaagu

SEQ ID NO: 1163234 - RNA, 19 nt, Homo sapiens
uagcaggccuaucaauuuc

SEQ ID NO: 1163235 - RNA, 19 nt, Homo sapiens
gcaccucucucuauuuuau

SEQ ID NO: 1163236 - RNA, 19 nt, Homo sapiens
gcaaguggacaaggaauug

SEQ ID NO: 1163237 - RNA, 19 nt, Homo sapiens
aaacaacgaucugugaagu

SEQ ID NO: 1163238 - RNA, 19 nt, Homo sapiens
gacuagguguucccuggua

SEQ ID NO: 1163239 - RNA, 19 nt, Homo sapiens
gaacagauuagaggccauu

SEQ ID NO: 1163240 - RNA, 19 nt, Homo sapiens
ccaaaggacagcaaauaug

SEQ ID NO: 1163241 - RNA, 19 nt, Homo sapiens
agauugaccuccaugcauu

SEQ ID NO: 1163242 - RNA, 19 nt, Homo sapiens
ucacuugauugucuguauu

SEQ ID NO: 1163243 - RNA, 19 nt, Homo sapiens
gcaggccuaucaauuucuu

SEQ ID NO: 1163244 - RNA, 19 nt, Homo sapiens
gggucugucuccugccuua

SEQ ID NO: 1163245 - RNA, 19 nt, Homo sapiens
cagccucccuguccaagaa

SEQ ID NO: 1163246 - RNA, 19 nt, Homo sapiens
gggagcaaguggacaagga

SEQ ID NO: 1163247 - RNA, 19 nt, Homo sapiens
ggaagucuuugugccaguu

SEQ ID NO: 1163248 - RNA, 19 nt, Homo sapiens
gagcacucccucccacuaa

SEQ ID NO: 1163249 - RNA, 19 nt, Homo sapiens
cuaccaaucagacacauuu

SEQ ID NO: 1163250 - RNA, 19 nt, Homo sapiens
gaauuggacagggcaagua

SEQ ID NO: 1163251 - RNA, 19 nt, Homo sapiens
gaucaugaaccaaaggaau

SEQ ID NO: 1163252 - RNA, 19 nt, Homo sapiens
uuagcaggccuaucaauuu

SEQ ID NO: 1163253 - RNA, 19 nt, Homo sapiens
ggugugaugucuguagcua

SEQ ID NO: 1163254 - RNA, 19 nt, Homo sapiens
guucuaaugcucccauaaa

SEQ ID NO: 1163255 - RNA, 19 nt, Homo sapiens
gguguuugauucagagaug

SEQ ID NO: 1163256 - RNA, 19 nt, Homo sapiens
guauuucugugugguugua

SEQ ID NO: 1163257 - RNA, 19 nt, Homo sapiens
gaauaccugccucaagcua

SEQ ID NO: 1163258 - RNA, 19 nt, Homo sapiens
ugagauguuuggagauuca

SEQ ID NO: 1163259 - RNA, 19 nt, Homo sapiens
gugcggcaguuggcuauuu

SEQ ID NO: 1163260 - RNA, 19 nt, Homo sapiens
ccacuaacuuguucugcau

SEQ ID NO: 1163261 - RNA, 19 nt, Homo sapiens
gacaacagaacuggaauga

SEQ ID NO: 1163262 - RNA, 19 nt, Homo sapiens
gcaggagucccgaccucua

SEQ ID NO: 1163263 - RNA, 19 nt, Homo sapiens
ucacuucaaaugcauguuu

SEQ ID NO: 1163264 - RNA, 19 nt, Homo sapiens
uccaagaagugacuguuga

SEQ ID NO: 1163265 - RNA, 19 nt, Homo sapiens
gcaguuggcuauuuucugu

SEQ ID NO: 1163266 - RNA, 19 nt, Homo sapiens
cagcuaugauguccugguu

SEQ ID NO: 1163267 - RNA, 19 nt, Homo sapiens
ggugugaucaugaaccaaa

SEQ ID NO: 1163268 - RNA, 19 nt, Homo sapiens
gaucuaguuugggaacaga

SEQ ID NO: 1163269 - RNA, 19 nt, Homo sapiens
gccucaagcuagagagaaa

SEQ ID NO: 1163270 - RNA, 19 nt, Homo sapiens
gaagcccugucagcauauu

SEQ ID NO: 1163271 - RNA, 19 nt, Homo sapiens
uaaccuccaugccuaucuu

SEQ ID NO: 1163272 - RNA, 19 nt, Homo sapiens
gauugaccuccaugcauua

SEQ ID NO: 1163273 - RNA, 19 nt, Homo sapiens
aaagacaacagaacuggaa

SEQ ID NO: 1163274 - RNA, 19 nt, Homo sapiens
gcagcugcuuuaagaaugg

SEQ ID NO: 1163275 - RNA, 19 nt, Homo sapiens
cugguauacuguucucaua

SEQ ID NO: 1163276 - RNA, 19 nt, Homo sapiens
cagguucacuugauugucu

SEQ ID NO: 1163277 - RNA, 19 nt, Homo sapiens
gugcucagguucacuugau

SEQ ID NO: 1163278 - RNA, 19 nt, Homo sapiens
gauuagaggccauugucuu

SEQ ID NO: 1163279 - RNA, 19 nt, Homo sapiens
accaguaucugucauggaa

SEQ ID NO: 1163280 - RNA, 19 nt, Homo sapiens
gaugagugcccucuagauc

SEQ ID NO: 1163281 - RNA, 19 nt, Homo sapiens
caaguaacucccugauuuc

SEQ ID NO: 1163282 - RNA, 19 nt, Homo sapiens
acacccaggucucucgaaa

SEQ ID NO: 1163283 - RNA, 19 nt, Homo sapiens
gucccgaccucuacauguu

SEQ ID NO: 1163284 - RNA, 19 nt, Homo sapiens
gguguucccugguauucug

SEQ ID NO: 1163285 - RNA, 19 nt, Homo sapiens
gaagcauggaguucuaaug

SEQ ID NO: 1163286 - RNA, 19 nt, Homo sapiens
aaggaagcauggaguucua

SEQ ID NO: 1163287 - RNA, 19 nt, Homo sapiens
ugugaugucuguagcuaug

SEQ ID NO: 1163288 - RNA, 19 nt, Homo sapiens
gccuaucaauuucuuguca

SEQ ID NO: 1163289 - RNA, 19 nt, Homo sapiens
gaacccugacucuugagaa

SEQ ID NO: 1163290 - RNA, 19 nt, Homo sapiens
uggccuggcuguuucuuug

SEQ ID NO: 1163291 - RNA, 19 nt, Homo sapiens
gagagugcgcuuuggaaau

SEQ ID NO: 1163292 - RNA, 19 nt, Homo sapiens
ugaacagcuugguggauga

SEQ ID NO: 1163293 - RNA, 19 nt, Homo sapiens
acccaggucucucgaaaga

SEQ ID NO: 1163294 - RNA, 19 nt, Homo sapiens
ugaccuccaugcauuauac

SEQ ID NO: 1163295 - RNA, 19 nt, Homo sapiens
gcaaggacucagccucaug

SEQ ID NO: 1163296 - RNA, 19 nt, Homo sapiens
cagagaguaucuugauuuu

SEQ ID NO: 1163297 - RNA, 19 nt, Homo sapiens
cauaggcacucuuccaaaa

SEQ ID NO: 1163298 - RNA, 19 nt, Homo sapiens
gagaagugcagucagaucu

SEQ ID NO: 1163299 - RNA, 19 nt, Homo sapiens
uggcaugacaucuucagua

SEQ ID NO: 1163300 - RNA, 19 nt, Homo sapiens
ucaauaaacucuguugcaa

SEQ ID NO: 1163301 - RNA, 19 nt, Homo sapiens
gcaaagggguggugaacaa

SEQ ID NO: 1163302 - RNA, 19 nt, Homo sapiens
gcaccucaauaaacucugu

SEQ ID NO: 1163303 - RNA, 19 nt, Homo sapiens
ucacugugcuacaucauca

SEQ ID NO: 1163304 - RNA, 19 nt, Homo sapiens
cagcugagguggagcagau

SEQ ID NO: 1163305 - RNA, 19 nt, Homo sapiens
caauaaacucuguugcaaa

SEQ ID NO: 1163306 - RNA, 19 nt, Homo sapiens
gauacaggaguucaaagaa

SEQ ID NO: 1163307 - RNA, 19 nt, Homo sapiens
caacgucuuuuccauguuu

SEQ ID NO: 1163308 - RNA, 19 nt, Homo sapiens
auacaggaguucaaagaag

SEQ ID NO: 1163309 - RNA, 19 nt, Homo sapiens
ccagauacaggaguucaaa

SEQ ID NO: 1163310 - RNA, 19 nt, Homo sapiens
gagacgagaaagaggaaug

SEQ ID NO: 1163311 - RNA, 19 nt, Homo sapiens
acaagucacugugcuacau

SEQ ID NO: 1163312 - RNA, 19 nt, Homo sapiens
ucagcuguaucgaccagaa

SEQ ID NO: 1163313 - RNA, 19 nt, Homo sapiens
ggagaauggccagcaggaa

SEQ ID NO: 1163314 - RNA, 19 nt, Homo sapiens
gcagauguucgcccugaca

SEQ ID NO: 1163315 - RNA, 19 nt, Homo sapiens
cugagugccuuccgcaugu

SEQ ID NO: 1163316 - RNA, 19 nt, Homo sapiens
gacccaggcagacaaguuc

SEQ ID NO: 1163317 - RNA, 19 nt, Homo sapiens
agauacaggaguucaaaga

SEQ ID NO: 1163318 - RNA, 19 nt, Homo sapiens
guuugaacaagcccagaua

SEQ ID NO: 1163319 - RNA, 19 nt, Homo sapiens
gggaacaucgacuacaagu

SEQ ID NO: 1163320 - RNA, 19 nt, Homo sapiens
ugacccaggcagacaaguu

SEQ ID NO: 1163321 - RNA, 19 nt, Homo sapiens
aagcccagauacaggaguu

SEQ ID NO: 1163322 - RNA, 19 nt, Homo sapiens
aaacucuguugcaaaauug

SEQ ID NO: 1163323 - RNA, 19 nt, Homo sapiens
acaaggaugaguucaagca

SEQ ID NO: 1163324 - RNA, 19 nt, Homo sapiens
aaacugcucugauaucuua

SEQ ID NO: 1163325 - RNA, 19 nt, Homo sapiens
agaguaagauuaagcagua

SEQ ID NO: 1163326 - RNA, 19 nt, Homo sapiens
gagcaacuuuaaagaauga

SEQ ID NO: 1163327 - RNA, 19 nt, Homo sapiens
gaucagcuccucaacagua

SEQ ID NO: 1163328 - RNA, 19 nt, Homo sapiens
gaucuaaccagcacacuaa

SEQ ID NO: 1163329 - RNA, 19 nt, Homo sapiens
uagacaaccucgacucuuu

SEQ ID NO: 1163330 - RNA, 19 nt, Homo sapiens
agacuuaauucaccacuuu

SEQ ID NO: 1163331 - RNA, 19 nt, Homo sapiens
caaccguccucacacagua

SEQ ID NO: 1163332 - RNA, 19 nt, Homo sapiens
aaaccuacauuucccacua

SEQ ID NO: 1163333 - RNA, 19 nt, Homo sapiens
cauucuaucucaacucuuu

SEQ ID NO: 1163334 - RNA, 19 nt, Homo sapiens
gcucuuauuucauguuuca

SEQ ID NO: 1163335 - RNA, 19 nt, Homo sapiens
gaagaaauaaacugcaaug

SEQ ID NO: 1163336 - RNA, 19 nt, Homo sapiens
ggagcaacuuuaaagaaug

SEQ ID NO: 1163337 - RNA, 19 nt, Homo sapiens
uaucucaacucuuuccauu

SEQ ID NO: 1163338 - RNA, 19 nt, Homo sapiens
caaccaaacuauauuaagc

SEQ ID NO: 1163339 - RNA, 19 nt, Homo sapiens
cuaaccagcacacuaaaua

SEQ ID NO: 1163340 - RNA, 19 nt, Homo sapiens
gguugaacaugcaauaaau

SEQ ID NO: 1163341 - RNA, 19 nt, Homo sapiens
auacaacaaucaccacaaa

SEQ ID NO: 1163342 - RNA, 19 nt, Homo sapiens
cccuaugacucaagacuua

SEQ ID NO: 1163343 - RNA, 19 nt, Homo sapiens
caacaguaccuaucucuuc

SEQ ID NO: 1163344 - RNA, 19 nt, Homo sapiens
uuuccaaacugcucugaua

SEQ ID NO: 1163345 - RNA, 19 nt, Homo sapiens
ggaaccaacccugaucuaa

SEQ ID NO: 1163346 - RNA, 19 nt, Homo sapiens
caaugccacuguccaaguu

SEQ ID NO: 1163347 - RNA, 19 nt, Homo sapiens
ccuguuggcucuuauuuca

SEQ ID NO: 1163348 - RNA, 19 nt, Homo sapiens
guaccuaucucuucaacac

SEQ ID NO: 1163349 - RNA, 19 nt, Homo sapiens
ccagugagagucaaagauu

SEQ ID NO: 1163350 - RNA, 19 nt, Homo sapiens
uaaccagcacacuaaauaa

SEQ ID NO: 1163351 - RNA, 19 nt, Homo sapiens
gaaccaacccugaucuaac

SEQ ID NO: 1163352 - RNA, 19 nt, Homo sapiens
ccaaggagcaacuuuaaag

SEQ ID NO: 1163353 - RNA, 19 nt, Homo sapiens
cuaccaaggagcaacuuua

SEQ ID NO: 1163354 - RNA, 19 nt, Homo sapiens
ccaaacugcucugauaucu

SEQ ID NO: 1163355 - RNA, 19 nt, Homo sapiens
ucucaacucuuuccauugg

SEQ ID NO: 1163356 - RNA, 19 nt, Homo sapiens
caucuucuuucucucgauu

SEQ ID NO: 1163357 - RNA, 19 nt, Homo sapiens
uuaagcagcccagccuuua

SEQ ID NO: 1163358 - RNA, 19 nt, Homo sapiens
ccagcacacuaaauaaagu

SEQ ID NO: 1163359 - RNA, 19 nt, Homo sapiens
gaguaucuggcaagaguaa

SEQ ID NO: 1163360 - RNA, 19 nt, Homo sapiens
gaguaagauuaagcaguaa

SEQ ID NO: 1163361 - RNA, 19 nt, Homo sapiens
caaggagcaacuuuaaaga

SEQ ID NO: 1163362 - RNA, 19 nt, Homo sapiens
gcaagaguaagauuaagca

SEQ ID NO: 1163363 - RNA, 19 nt, Homo sapiens
aggagcaacuuuaaagaau

SEQ ID NO: 1163364 - RNA, 19 nt, Homo sapiens
uaccaaggagcaacuuuaa

SEQ ID NO: 1163365 - RNA, 19 nt, Homo sapiens
guuacgacuuccaaccaaa

SEQ ID NO: 1163366 - RNA, 19 nt, Homo sapiens
gccaagcagucauucuauc

SEQ ID NO: 1163367 - RNA, 19 nt, Homo sapiens
uagccaagcagucauucua

SEQ ID NO: 1163368 - RNA, 19 nt, Homo sapiens
uugaguaucuggcaagagu

SEQ ID NO: 1163369 - RNA, 19 nt, Homo sapiens
uaagcagcccagccuuuaa

SEQ ID NO: 1163370 - RNA, 19 nt, Homo sapiens
cgacuuccaaccaaacuau

SEQ ID NO: 1163371 - RNA, 19 nt, Homo sapiens
aaccuacauuucccacuaa

SEQ ID NO: 1163372 - RNA, 19 nt, Homo sapiens
aagcagucauucuaucuca

SEQ ID NO: 1163373 - RNA, 19 nt, Homo sapiens
ucuucuuucucucgauuua

SEQ ID NO: 1163374 - RNA, 19 nt, Homo sapiens
cagcacacuaaauaaagua

SEQ ID NO: 1163375 - RNA, 19 nt, Homo sapiens
gauacaacaaucaccacaa

SEQ ID NO: 1163376 - RNA, 19 nt, Homo sapiens
cuauuuaccuuccuaucuc

SEQ ID NO: 1163377 - RNA, 19 nt, Homo sapiens
gcuauuuaccuuccuaucu

SEQ ID NO: 1163378 - RNA, 19 nt, Homo sapiens
aacaguaccuaucucuuca

SEQ ID NO: 1163379 - RNA, 19 nt, Homo sapiens
uggcucuuauuucauguuu

SEQ ID NO: 1163380 - RNA, 19 nt, Homo sapiens
gcucaaugccacuguccaa

SEQ ID NO: 1163381 - RNA, 19 nt, Homo sapiens
gagccugccaccuccauau

SEQ ID NO: 1163382 - RNA, 19 nt, Homo sapiens
acaacaaucaccacaaauc

SEQ ID NO: 1163383 - RNA, 19 nt, Homo sapiens
cagugagagucaaagauuc

SEQ ID NO: 1163384 - RNA, 19 nt, Homo sapiens
aaacaucaccaccgcagau

SEQ ID NO: 1163385 - RNA, 19 nt, Homo sapiens
gaguuccaccaucuucuuu

SEQ ID NO: 1163386 - RNA, 19 nt, Homo sapiens
aagcagcccagccuuuaaa

SEQ ID NO: 1163387 - RNA, 19 nt, Homo sapiens
aaggagcaacuuuaaagaa

SEQ ID NO: 1163388 - RNA, 19 nt, Homo sapiens
uguuggcucuuauuucaug

SEQ ID NO: 1163389 - RNA, 19 nt, Homo sapiens
aaccagcacacuaaauaaa

SEQ ID NO: 1163390 - RNA, 19 nt, Homo sapiens
caccaggcacuuccacaaa

SEQ ID NO: 1163391 - RNA, 19 nt, Homo sapiens
caccgcagauacaacaauc

SEQ ID NO: 1163392 - RNA, 19 nt, Homo sapiens
cacuuucucuucccuuugu

SEQ ID NO: 1163393 - RNA, 19 nt, Homo sapiens
ugacucaagacuuaauuca

SEQ ID NO: 1163394 - RNA, 19 nt, Homo sapiens
gauggaaccaacccugauc

SEQ ID NO: 1163395 - RNA, 19 nt, Homo sapiens
ccaccaggcacuuccacaa

SEQ ID NO: 1163396 - RNA, 19 nt, Homo sapiens
guuauccaaaccuacauuu

SEQ ID NO: 1163397 - RNA, 19 nt, Homo sapiens
gucauucuaucucaacucu

SEQ ID NO: 1163398 - RNA, 19 nt, Homo sapiens
ccaaccaaacuauauuaag

SEQ ID NO: 1163399 - RNA, 19 nt, Homo sapiens
acgaucagcuccucaacag

SEQ ID NO: 1163400 - RNA, 19 nt, Homo sapiens
caacaaucaccacaaaucc

SEQ ID NO: 1163401 - RNA, 19 nt, Homo sapiens
gccaccaccuccacucuac

SEQ ID NO: 1163402 - RNA, 19 nt, Homo sapiens
ucuggcaagaguaagauua

SEQ ID NO: 1163403 - RNA, 19 nt, Homo sapiens
guaucuggcaagaguaaga

SEQ ID NO: 1163404 - RNA, 19 nt, Homo sapiens
caaacugcucugauaucuu

SEQ ID NO: 1163405 - RNA, 19 nt, Homo sapiens
cagaagaccauaucuaccu

SEQ ID NO: 1163406 - RNA, 19 nt, Homo sapiens
caucaccaccgcagauaca

SEQ ID NO: 1163407 - RNA, 19 nt, Homo sapiens
ccaagcagucauucuaucu

SEQ ID NO: 1163408 - RNA, 19 nt, Homo sapiens
cgauuuagccaagcaguca

SEQ ID NO: 1163409 - RNA, 19 nt, Homo sapiens
ggccuguuggcucuuauuu

SEQ ID NO: 1163410 - RNA, 19 nt, Homo sapiens
aagauggguuccaccaagu

SEQ ID NO: 1163411 - RNA, 19 nt, Homo sapiens
cauuuccuccuauuccuuu

SEQ ID NO: 1163412 - RNA, 19 nt, Homo sapiens
guuccaccaucuucuuucu

SEQ ID NO: 1163413 - RNA, 19 nt, Homo sapiens
guugaacaugcaauaaaug

SEQ ID NO: 1163414 - RNA, 19 nt, Homo sapiens
ugguugaacaugcaauaaa

SEQ ID NO: 1163415 - RNA, 19 nt, Homo sapiens
gacgaucagcuccucaaca

SEQ ID NO: 1163416 - RNA, 19 nt, Homo sapiens
gcagucauucuaucucaac

SEQ ID NO: 1163417 - RNA, 19 nt, Homo sapiens
cgaguuccaccaucuucuu

SEQ ID NO: 1163418 - RNA, 19 nt, Homo sapiens
ugaucuaaccagcacacua

SEQ ID NO: 1163419 - RNA, 19 nt, Homo sapiens
gacuuccaaccaaacuaua

SEQ ID NO: 1163420 - RNA, 19 nt, Homo sapiens
ucaaugccacuguccaagu

SEQ ID NO: 1163421 - RNA, 19 nt, Homo sapiens
cuggcaagaguaagauuaa

SEQ ID NO: 1163422 - RNA, 19 nt, Homo sapiens
cuaggaagcuugacuguug

SEQ ID NO: 1163423 - RNA, 19 nt, Homo sapiens
gaacagucagcuuucuuua

SEQ ID NO: 1163424 - RNA, 19 nt, Homo sapiens
acagucagcuuucuuuauu

SEQ ID NO: 1163425 - RNA, 19 nt, Homo sapiens
ggagccagcuggagagaga

SEQ ID NO: 1163426 - RNA, 19 nt, Homo sapiens
ggcgggaacuggcuuauga

SEQ ID NO: 1163427 - RNA, 19 nt, Homo sapiens
ggaacagucagcuuucuuu

SEQ ID NO: 1163428 - RNA, 19 nt, Homo sapiens
gaaauaaagcugcggaacu

SEQ ID NO: 1163429 - RNA, 19 nt, Homo sapiens
aaacgaaugucccgguuag

SEQ ID NO: 1163430 - RNA, 19 nt, Homo sapiens
cagucagcuuucuuuauua

SEQ ID NO: 1163431 - RNA, 19 nt, Homo sapiens
aaauaaagcugcggaacuc

SEQ ID NO: 1163432 - RNA, 19 nt, Homo sapiens
gaaugucccgguuagaaga

SEQ ID NO: 1163433 - RNA, 19 nt, Homo sapiens
agagagagagauccugaua

SEQ ID NO: 1163434 - RNA, 19 nt, Homo sapiens
agagggaaauggaggaguu

SEQ ID NO: 1163435 - RNA, 19 nt, Homo sapiens
ggaguuagaagcgucugua

SEQ ID NO: 1163436 - RNA, 19 nt, Homo sapiens
guuagaagcgucuguaucu

SEQ ID NO: 1163437 - RNA, 19 nt, Homo sapiens
aaacacagccagcucuuca

SEQ ID NO: 1163438 - RNA, 19 nt, Homo sapiens
gagggugugugguccuuuc

SEQ ID NO: 1163439 - RNA, 19 nt, Homo sapiens
ggagugcugaccugagaaa

SEQ ID NO: 1163440 - RNA, 19 nt, Homo sapiens
acaucaugcuggaaauaaa

SEQ ID NO: 1163441 - RNA, 19 nt, Homo sapiens
cgagagaguucuggcaucu

SEQ ID NO: 1163442 - RNA, 19 nt, Homo sapiens
uaaagcugcggaacucuga

SEQ ID NO: 1163443 - RNA, 19 nt, Homo sapiens
ggaggaaccagcuguugca

SEQ ID NO: 1163444 - RNA, 19 nt, Homo sapiens
gcaaacacagccagcucuu

SEQ ID NO: 1163445 - RNA, 19 nt, Homo sapiens
aaauacaucaugcuggaaa

SEQ ID NO: 1163446 - RNA, 19 nt, Homo sapiens
cuucauggccacagaaaug

SEQ ID NO: 1163447 - RNA, 19 nt, Homo sapiens
gcccuuacccaggaaauau

SEQ ID NO: 1163448 - RNA, 19 nt, Homo sapiens
gaauggcagagcucacuuc

SEQ ID NO: 1163449 - RNA, 19 nt, Homo sapiens
guacgagaggagugugaaa

SEQ ID NO: 1163450 - RNA, 19 nt, Homo sapiens
gcggugcucuccagaacag

SEQ ID NO: 1163451 - RNA, 19 nt, Homo sapiens
agagagagauccugauacc

SEQ ID NO: 1163452 - RNA, 19 nt, Homo sapiens
gaggaggaaccagcuguug

SEQ ID NO: 1163453 - RNA, 19 nt, Homo sapiens
agggagugcugaccugaga

SEQ ID NO: 1163454 - RNA, 19 nt, Homo sapiens
gugcagcccugggaagaag

SEQ ID NO: 1163455 - RNA, 19 nt, Homo sapiens
gagggaaauggaggaguuu

SEQ ID NO: 1163456 - RNA, 19 nt, Homo sapiens
uacaucaugcuggaaauaa

SEQ ID NO: 1163457 - RNA, 19 nt, Homo sapiens
gggaacagucagcuuucuu

SEQ ID NO: 1163458 - RNA, 19 nt, Homo sapiens
ggaauggcagagcucacuu

SEQ ID NO: 1163459 - RNA, 19 nt, Homo sapiens
gagaggagugugaaaagaa

SEQ ID NO: 1163460 - RNA, 19 nt, Homo sapiens
gagagagagauccugauac

SEQ ID NO: 1163461 - RNA, 19 nt, Homo sapiens
cgaaugucccgguuagaag

SEQ ID NO: 1163462 - RNA, 19 nt, Homo sapiens
gaguuagaagcgucuguau

SEQ ID NO: 1163463 - RNA, 19 nt, Homo sapiens
auacaucaugcuggaaaua

SEQ ID NO: 1163464 - RNA, 19 nt, Homo sapiens
agagcucacuucuguacca

SEQ ID NO: 1163465 - RNA, 19 nt, Homo sapiens
uacaggggcuggucacuga

SEQ ID NO: 1163466 - RNA, 19 nt, Homo sapiens
gaaggggacgguaccaaga

SEQ ID NO: 1163467 - RNA, 19 nt, Homo sapiens
gagauccugauaccucugu

SEQ ID NO: 1163468 - RNA, 19 nt, Homo sapiens
caucaugcuggaaauaaag

SEQ ID NO: 1163469 - RNA, 19 nt, Homo sapiens
uguccugccuggaguugga

SEQ ID NO: 1163470 - RNA, 19 nt, Homo sapiens
gagaugacauuucugauuu

SEQ ID NO: 1163471 - RNA, 19 nt, Homo sapiens
gaacggagcagaaauaaau

SEQ ID NO: 1163472 - RNA, 19 nt, Homo sapiens
gcauccagcuuccuauuua

SEQ ID NO: 1163473 - RNA, 19 nt, Homo sapiens
gaugguagauuauuucaga

SEQ ID NO: 1163474 - RNA, 19 nt, Homo sapiens
gagaagaaaucaguggaua

SEQ ID NO: 1163475 - RNA, 19 nt, Homo sapiens
cagaguaaauggacaauau

SEQ ID NO: 1163476 - RNA, 19 nt, Homo sapiens
uuacaacccucuuaacauu

SEQ ID NO: 1163477 - RNA, 19 nt, Homo sapiens
ccaccaacauggagacuuu

SEQ ID NO: 1163478 - RNA, 19 nt, Homo sapiens
gagacaaguuuaucacaga

SEQ ID NO: 1163479 - RNA, 19 nt, Homo sapiens
ggagaugacauuucugauu

SEQ ID NO: 1163480 - RNA, 19 nt, Homo sapiens
gaagcaagauuccguaagc

SEQ ID NO: 1163481 - RNA, 19 nt, Homo sapiens
ccaauccucuaauaugaaa

SEQ ID NO: 1163482 - RNA, 19 nt, Homo sapiens
gcuagaguauucaugagaa

SEQ ID NO: 1163483 - RNA, 19 nt, Homo sapiens
ggacaguugaucagcuuua

SEQ ID NO: 1163484 - RNA, 19 nt, Homo sapiens
uaccaauccucuaauauga

SEQ ID NO: 1163485 - RNA, 19 nt, Homo sapiens
guaccaauccucuaauaug

SEQ ID NO: 1163486 - RNA, 19 nt, Homo sapiens
gaucgaaugcaccaaauau

SEQ ID NO: 1163487 - RNA, 19 nt, Homo sapiens
gaaugaagagcagcaguaa

SEQ ID NO: 1163488 - RNA, 19 nt, Homo sapiens
cgggcuaucugauggguua

SEQ ID NO: 1163489 - RNA, 19 nt, Homo sapiens
gaagcuuggacuagaauuu

SEQ ID NO: 1163490 - RNA, 19 nt, Homo sapiens
ccaagugucgguucuauga

SEQ ID NO: 1163491 - RNA, 19 nt, Homo sapiens
gauuugcuccugucaauga

SEQ ID NO: 1163492 - RNA, 19 nt, Homo sapiens
uuucauggcuagaguauuc

SEQ ID NO: 1163493 - RNA, 19 nt, Homo sapiens
cucaauagauuccuucuuc

SEQ ID NO: 1163494 - RNA, 19 nt, Homo sapiens
uaugaacggagcagaaaua

SEQ ID NO: 1163495 - RNA, 19 nt, Homo sapiens
gcugagaacucuggacagu

SEQ ID NO: 1163496 - RNA, 19 nt, Homo sapiens
uuuaaaggcuguaccaauc

SEQ ID NO: 1163497 - RNA, 19 nt, Homo sapiens
agugugugaugguagauua

SEQ ID NO: 1163498 - RNA, 19 nt, Homo sapiens
gaagaaaucaguggauacu

SEQ ID NO: 1163499 - RNA, 19 nt, Homo sapiens
ggagguuuagguuucauaa

SEQ ID NO: 1163500 - RNA, 19 nt, Homo sapiens
agacaaguuuaucacagaa

SEQ ID NO: 1163501 - RNA, 19 nt, Homo sapiens
uauggugcuuugccuuuaa

SEQ ID NO: 1163502 - RNA, 19 nt, Homo sapiens
cuauggugcuuugccuuua

SEQ ID NO: 1163503 - RNA, 19 nt, Homo sapiens
gguauuaaagagacaaguu

SEQ ID NO: 1163504 - RNA, 19 nt, Homo sapiens
ccaaauaucccaaaacuca

SEQ ID NO: 1163505 - RNA, 19 nt, Homo sapiens
aaugggagguuuagguuuc

SEQ ID NO: 1163506 - RNA, 19 nt, Homo sapiens
caucaccggaggaauaauu

SEQ ID NO: 1163507 - RNA, 19 nt, Homo sapiens
gugugaugguagauuauuu

SEQ ID NO: 1163508 - RNA, 19 nt, Homo sapiens
uugaucagcuuuaccuaug

SEQ ID NO: 1163509 - RNA, 19 nt, Homo sapiens
agaaugaagagcagcagua

SEQ ID NO: 1163510 - RNA, 19 nt, Homo sapiens
cugcuggccuauugcuaua

SEQ ID NO: 1163511 - RNA, 19 nt, Homo sapiens
aaacaggaagcguauugaa

SEQ ID NO: 1163512 - RNA, 19 nt, Homo sapiens
uggauuugcuccugucaau

SEQ ID NO: 1163513 - RNA, 19 nt, Homo sapiens
uauugaagcuuggacuaga

SEQ ID NO: 1163514 - RNA, 19 nt, Homo sapiens
caacauggagacuuuguac

SEQ ID NO: 1163515 - RNA, 19 nt, Homo sapiens
gagugccucugagaagaaa

SEQ ID NO: 1163516 - RNA, 19 nt, Homo sapiens
ggauucgucuguguccuau

SEQ ID NO: 1163517 - RNA, 19 nt, Homo sapiens
uagagugugugaugguaga

SEQ ID NO: 1163518 - RNA, 19 nt, Homo sapiens
gccuuuaacuagagugugu

SEQ ID NO: 1163519 - RNA, 19 nt, Homo sapiens
gaucagcuuuaccuauggu

SEQ ID NO: 1163520 - RNA, 19 nt, Homo sapiens
cgucggccaugacugugua

SEQ ID NO: 1163521 - RNA, 19 nt, Homo sapiens
cuguaccaauccucuaaua

SEQ ID NO: 1163522 - RNA, 19 nt, Homo sapiens
uagauuccuucuucuguuc

SEQ ID NO: 1163523 - RNA, 19 nt, Homo sapiens
ucccaaaacucaauagauu

SEQ ID NO: 1163524 - RNA, 19 nt, Homo sapiens
uuucuuggccuacagagua

SEQ ID NO: 1163525 - RNA, 19 nt, Homo sapiens
gucccaaccugaagcugaa

SEQ ID NO: 1163526 - RNA, 19 nt, Homo sapiens
agguuuagguuucauaauc

SEQ ID NO: 1163527 - RNA, 19 nt, Homo sapiens
ucgguucuaugacugauga

SEQ ID NO: 1163528 - RNA, 19 nt, Homo sapiens
ggagcagaaauaaauacuu

SEQ ID NO: 1163529 - RNA, 19 nt, Homo sapiens
auagauuccuucuucuguu

SEQ ID NO: 1163530 - RNA, 19 nt, Homo sapiens
gcuauaccaaugauguuga

SEQ ID NO: 1163531 - RNA, 19 nt, Homo sapiens
gugcuuugccuuuaacuag

SEQ ID NO: 1163532 - RNA, 19 nt, Homo sapiens
gagcagcaguaaaagaaau

SEQ ID NO: 1163533 - RNA, 19 nt, Homo sapiens
gaaauguggaaaagaauga

SEQ ID NO: 1163534 - RNA, 19 nt, Homo sapiens
guucuuagugcucgaaugu

SEQ ID NO: 1163535 - RNA, 19 nt, Homo sapiens
ucuguguccuauugaguuu

SEQ ID NO: 1163536 - RNA, 19 nt, Homo sapiens
ucaccggaggaauaauuua

SEQ ID NO: 1163537 - RNA, 19 nt, Homo sapiens
gaagagcagcaguaaaaga

SEQ ID NO: 1163538 - RNA, 19 nt, Homo sapiens
auucgucuguguccuauug

SEQ ID NO: 1163539 - RNA, 19 nt, Homo sapiens
ucaauagauuccuucuucu

SEQ ID NO: 1163540 - RNA, 19 nt, Homo sapiens
caucagaggccaguagcuu

SEQ ID NO: 1163541 - RNA, 19 nt, Homo sapiens
caaugggagguuuagguuu

SEQ ID NO: 1163542 - RNA, 19 nt, Homo sapiens
ccagcuuccuauuuacaau

SEQ ID NO: 1163543 - RNA, 19 nt, Homo sapiens
ccaacauggagacuuugua

SEQ ID NO: 1163544 - RNA, 19 nt, Homo sapiens
cagaagcaagauuccguaa

SEQ ID NO: 1163545 - RNA, 19 nt, Homo sapiens
caauagauuccuucuucug

SEQ ID NO: 1163546 - RNA, 19 nt, Homo sapiens
cgaucgaaugcaccaaaua

SEQ ID NO: 1163547 - RNA, 19 nt, Homo sapiens
acaaugggagguuuagguu

SEQ ID NO: 1163548 - RNA, 19 nt, Homo sapiens
ccugaacaauaagauguau

SEQ ID NO: 1163549 - RNA, 19 nt, Homo sapiens
uuaacuagagugugugaug

SEQ ID NO: 1163550 - RNA, 19 nt, Homo sapiens
ccuauggugcuuugccuuu

SEQ ID NO: 1163551 - RNA, 19 nt, Homo sapiens
guugaucagcuuuaccuau

SEQ ID NO: 1163552 - RNA, 19 nt, Homo sapiens
gacaguugaucagcuuuac

SEQ ID NO: 1163553 - RNA, 19 nt, Homo sapiens
guaccgugucccguucuua

SEQ ID NO: 1163554 - RNA, 19 nt, Homo sapiens
ucgaaugucccaaccugaa

SEQ ID NO: 1163555 - RNA, 19 nt, Homo sapiens
acuagagugugugauggua

SEQ ID NO: 1163556 - RNA, 19 nt, Homo sapiens
acaacccucuuaacauuuu

SEQ ID NO: 1163557 - RNA, 19 nt, Homo sapiens
gauguugaguggcauuuuc

SEQ ID NO: 1163558 - RNA, 19 nt, Homo sapiens
cuacagaguaaauggacaa

SEQ ID NO: 1163559 - RNA, 19 nt, Homo sapiens
ccgaucgaaugcaccaaau

SEQ ID NO: 1163560 - RNA, 19 nt, Homo sapiens
gggagguuuagguuucaua

SEQ ID NO: 1163561 - RNA, 19 nt, Homo sapiens
cuucuucuguucauuggau

SEQ ID NO: 1163562 - RNA, 19 nt, Homo sapiens
uauuuacaaugggagguuu

SEQ ID NO: 1163563 - RNA, 19 nt, Homo sapiens
ugaacggagcagaaauaaa

SEQ ID NO: 1163564 - RNA, 19 nt, Homo sapiens
ucagaggccaguagcuuuc

SEQ ID NO: 1163565 - RNA, 19 nt, Homo sapiens
ggcuguaccaauccucuaa

SEQ ID NO: 1163566 - RNA, 19 nt, Homo sapiens
ucauuggauucgucugugu

SEQ ID NO: 1163567 - RNA, 19 nt, Homo sapiens
gguuuagguuucauaaucc

SEQ ID NO: 1163568 - RNA, 19 nt, Homo sapiens
uguaugaacggagcagaaa

SEQ ID NO: 1163569 - RNA, 19 nt, Homo sapiens
uacaacccucuuaacauuu

SEQ ID NO: 1163570 - RNA, 19 nt, Homo sapiens
gaacaggaauggaaauuua

SEQ ID NO: 1163571 - RNA, 19 nt, Homo sapiens
gaaagaacaugcugaauug

SEQ ID NO: 1163572 - RNA, 19 nt, Homo sapiens
gagaagagcucugcuauga

SEQ ID NO: 1163573 - RNA, 19 nt, Homo sapiens
aaucggagcuguuguauua

SEQ ID NO: 1163574 - RNA, 19 nt, Homo sapiens
gaacaaggauucccgagaa

SEQ ID NO: 1163575 - RNA, 19 nt, Homo sapiens
gaacgcaccuuauaguaaa

SEQ ID NO: 1163576 - RNA, 19 nt, Homo sapiens
gcaauggucuuucuggaua

SEQ ID NO: 1163577 - RNA, 19 nt, Homo sapiens
ggaaugaacuucugaaaca

SEQ ID NO: 1163578 - RNA, 19 nt, Homo sapiens
gaaguuacgugaaaucauu

SEQ ID NO: 1163579 - RNA, 19 nt, Homo sapiens
guacagaugucaaaugauu

SEQ ID NO: 1163580 - RNA, 19 nt, Homo sapiens
gaacugaacgcaccuuaua

SEQ ID NO: 1163581 - RNA, 19 nt, Homo sapiens
ggaaguggaugaacugaaa

SEQ ID NO: 1163582 - RNA, 19 nt, Homo sapiens
caagaggccucacaccuua

SEQ ID NO: 1163583 - RNA, 19 nt, Homo sapiens
gaaguacugucuccaaauu

SEQ ID NO: 1163584 - RNA, 19 nt, Homo sapiens
gaacacagguuucuuggau

SEQ ID NO: 1163585 - RNA, 19 nt, Homo sapiens
gaacuuaaauacugaggaa

SEQ ID NO: 1163586 - RNA, 19 nt, Homo sapiens
gaacugaaaugcauuccuu

SEQ ID NO: 1163587 - RNA, 19 nt, Homo sapiens
ccacagagcuugccaguuc

SEQ ID NO: 1163588 - RNA, 19 nt, Homo sapiens
gcaacaacaucuccacuuu

SEQ ID NO: 1163589 - RNA, 19 nt, Homo sapiens
gaacuagaccuuccaauug

SEQ ID NO: 1163590 - RNA, 19 nt, Homo sapiens
caaccuggaugaccucuua

SEQ ID NO: 1163591 - RNA, 19 nt, Homo sapiens
gaaacaacgucugauaauu

SEQ ID NO: 1163592 - RNA, 19 nt, Homo sapiens
uuacagagccucacaguua

SEQ ID NO: 1163593 - RNA, 19 nt, Homo sapiens
gaucaggucuuauaucugu

SEQ ID NO: 1163594 - RNA, 19 nt, Homo sapiens
gaagaugacuguacaaagg

SEQ ID NO: 1163595 - RNA, 19 nt, Homo sapiens
ugaaggaacuggauguuaa

SEQ ID NO: 1163596 - RNA, 19 nt, Homo sapiens
aaacacagaugaugacauu

SEQ ID NO: 1163597 - RNA, 19 nt, Homo sapiens
ggagguagauagacaaaga

SEQ ID NO: 1163598 - RNA, 19 nt, Homo sapiens
ggacuacuauucucaguug

SEQ ID NO: 1163599 - RNA, 19 nt, Homo sapiens
gaucccagcucucguauug

SEQ ID NO: 1163600 - RNA, 19 nt, Homo sapiens
gaagauuacuugccuguuc

SEQ ID NO: 1163601 - RNA, 19 nt, Homo sapiens
gcaguuaccagauacuuua

SEQ ID NO: 1163602 - RNA, 19 nt, Homo sapiens
ugaagaaggugauggauug

SEQ ID NO: 1163603 - RNA, 19 nt, Homo sapiens
gugaauggcagaacaauua

SEQ ID NO: 1163604 - RNA, 19 nt, Homo sapiens
ggaaugaaauggaagaagu

SEQ ID NO: 1163605 - RNA, 19 nt, Homo sapiens
caacagacguaugcaaauu

SEQ ID NO: 1163606 - RNA, 19 nt, Homo sapiens
aaagcaagcucacaagaaa

SEQ ID NO: 1163607 - RNA, 19 nt, Homo sapiens
ggucacagauggagcaauu

SEQ ID NO: 1163608 - RNA, 19 nt, Homo sapiens
ggagaggaaugaaauggaa

SEQ ID NO: 1163609 - RNA, 19 nt, Homo sapiens
ccaggucaaucaacaguua

SEQ ID NO: 1163610 - RNA, 19 nt, Homo sapiens
ccaaucaugugucaaguuu

SEQ ID NO: 1163611 - RNA, 19 nt, Homo sapiens
ccagcuauguacagaauua

SEQ ID NO: 1163612 - RNA, 19 nt, Homo sapiens
gguaggcccuccuucauuu

SEQ ID NO: 1163613 - RNA, 19 nt, Homo sapiens
gcaguuaccuugcagagau

SEQ ID NO: 1163614 - RNA, 19 nt, Homo sapiens
gcaauuacagauccuauaa

SEQ ID NO: 1163615 - RNA, 19 nt, Homo sapiens
gaagacuccugcuguguga

SEQ ID NO: 1163616 - RNA, 19 nt, Homo sapiens
caagguauaucaaccauuc

SEQ ID NO: 1163617 - RNA, 19 nt, Homo sapiens
ggagaggccuacaaaugaa

SEQ ID NO: 1163618 - RNA, 19 nt, Homo sapiens
ccaaagcauuucaucagua

SEQ ID NO: 1163619 - RNA, 19 nt, Homo sapiens
aauaaacucuuguggcaua

SEQ ID NO: 1163620 - RNA, 19 nt, Homo sapiens
ggaccuagauaugcuguuu

SEQ ID NO: 1163621 - RNA, 19 nt, Homo sapiens
gaagagcucugcuaugacu

SEQ ID NO: 1163622 - RNA, 19 nt, Homo sapiens
gcuaagagcuguccauggu

SEQ ID NO: 1163623 - RNA, 19 nt, Homo sapiens
gacaagcucuccauggaaa

SEQ ID NO: 1163624 - RNA, 19 nt, Homo sapiens
caagaaagcugggcgugaa

SEQ ID NO: 1163625 - RNA, 19 nt, Homo sapiens
gcaccaacauuuaucacuu

SEQ ID NO: 1163626 - RNA, 19 nt, Homo sapiens
gagaacaaacugcccaaua

SEQ ID NO: 1163627 - RNA, 19 nt, Homo sapiens
caacaucuguaccgucuga

SEQ ID NO: 1163628 - RNA, 19 nt, Homo sapiens
gagauacuccugacaguuu

SEQ ID NO: 1163629 - RNA, 19 nt, Homo sapiens
gaaacaagcuauguacucu

SEQ ID NO: 1163630 - RNA, 19 nt, Homo sapiens
ccaguucucuacaccaaua

SEQ ID NO: 1163631 - RNA, 19 nt, Homo sapiens
gaaaagauguugaagacuu

SEQ ID NO: 1163632 - RNA, 19 nt, Homo sapiens
gcagacaguucccaaagga

SEQ ID NO: 1163633 - RNA, 19 nt, Homo sapiens
guaguaagguagaaggaaa

SEQ ID NO: 1163634 - RNA, 19 nt, Homo sapiens
guaugcaaauucagaagua

SEQ ID NO: 1163635 - RNA, 19 nt, Homo sapiens
guacagaauuagagaacaa

SEQ ID NO: 1163636 - RNA, 19 nt, Homo sapiens
ggccaagauucuacuauaa

SEQ ID NO: 1163637 - RNA, 19 nt, Homo sapiens
gaacuugacaugggagaua

SEQ ID NO: 1163638 - RNA, 19 nt, Homo sapiens
gaagcggacugggaacuuu

SEQ ID NO: 1163639 - RNA, 19 nt, Homo sapiens
ugaaaugcauuccuugcua

SEQ ID NO: 1163640 - RNA, 19 nt, Homo sapiens
gaaaagagaugaugaugca

SEQ ID NO: 1163641 - RNA, 19 nt, Homo sapiens
ggccuaauccuccaaauuu

SEQ ID NO: 1163642 - RNA, 19 nt, Homo sapiens
gauaaacauucaccacaga

SEQ ID NO: 1163643 - RNA, 19 nt, Homo sapiens
agacuuagaugaugaagau

SEQ ID NO: 1163644 - RNA, 19 nt, Homo sapiens
ccucauggauuuagauuug

SEQ ID NO: 1163645 - RNA, 19 nt, Homo sapiens
uaacaacucuuggacauca

SEQ ID NO: 1163646 - RNA, 19 nt, Homo sapiens
aaggagaacuuauggauug

SEQ ID NO: 1163647 - RNA, 19 nt, Homo sapiens
uaaagugguucuuagcaaa

SEQ ID NO: 1163648 - RNA, 19 nt, Homo sapiens
caacacaccauuggaauuu

SEQ ID NO: 1163649 - RNA, 19 nt, Homo sapiens
gaagugaaaccaagaaaca

SEQ ID NO: 1163650 - RNA, 19 nt, Homo sapiens
uaaggaacguuuacgagaa

SEQ ID NO: 1163651 - RNA, 19 nt, Homo sapiens
ggauuuagauuuggauuuc

SEQ ID NO: 1163652 - RNA, 19 nt, Homo sapiens
ccaagaccaucuacacaaa

SEQ ID NO: 1163653 - RNA, 19 nt, Homo sapiens
caacaucucaggacccaua

SEQ ID NO: 1163654 - RNA, 19 nt, Homo sapiens
gcacagucauuccauaaag

SEQ ID NO: 1163655 - RNA, 19 nt, Homo sapiens
gggaagcuguggaugauga

SEQ ID NO: 1163656 - RNA, 19 nt, Homo sapiens
gcuggugccuuaauaaaug

SEQ ID NO: 1163657 - RNA, 19 nt, Homo sapiens
ggaaugacaucaaaacuga

SEQ ID NO: 1163658 - RNA, 19 nt, Homo sapiens
gcagggacauggaaaucuu

SEQ ID NO: 1163659 - RNA, 19 nt, Homo sapiens
cgacuuaccuugugauuuu

SEQ ID NO: 1163660 - RNA, 19 nt, Homo sapiens
cagaacaacucaagcaugu

SEQ ID NO: 1163661 - RNA, 19 nt, Homo sapiens
ucaaagacuuagaugauga

SEQ ID NO: 1163662 - RNA, 19 nt, Homo sapiens
ccaagcagauacagagaaa

SEQ ID NO: 1163663 - RNA, 19 nt, Homo sapiens
ucaaggcgauugucuguug

SEQ ID NO: 1163664 - RNA, 19 nt, Homo sapiens
cagaugauguguuuguaaa

SEQ ID NO: 1163665 - RNA, 19 nt, Homo sapiens
gcaaagagaaucagaacau

SEQ ID NO: 1163666 - RNA, 19 nt, Homo sapiens
caaauaaggaugaugaaga

SEQ ID NO: 1163667 - RNA, 19 nt, Homo sapiens
gaaauccucucauggaacu

SEQ ID NO: 1163668 - RNA, 19 nt, Homo sapiens
gaggagaggccuacaaaug

SEQ ID NO: 1163669 - RNA, 19 nt, Homo sapiens
ugcaaacccucccagauua

SEQ ID NO: 1163670 - RNA, 19 nt, Homo sapiens
gaacaggaauggaaauuua

SEQ ID NO: 1163671 - RNA, 19 nt, Homo sapiens
gaaagaacaugcugaauug

SEQ ID NO: 1163672 - RNA, 19 nt, Homo sapiens
gagaagagcucugcuauga

SEQ ID NO: 1163673 - RNA, 19 nt, Homo sapiens
aaucggagcuguuguauua

SEQ ID NO: 1163674 - RNA, 19 nt, Homo sapiens
gaacaaggauucccgagaa

SEQ ID NO: 1163675 - RNA, 19 nt, Homo sapiens
gaacgcaccuuauaguaaa

SEQ ID NO: 1163676 - RNA, 19 nt, Homo sapiens
gcaauggucuuucuggaua

SEQ ID NO: 1163677 - RNA, 19 nt, Homo sapiens
ggaaugaacuucugaaaca

SEQ ID NO: 1163678 - RNA, 19 nt, Homo sapiens
gaaguuacgugaaaucauu

SEQ ID NO: 1163679 - RNA, 19 nt, Homo sapiens
guacagaugucaaaugauu

SEQ ID NO: 1163680 - RNA, 19 nt, Homo sapiens
gaagaaccauuguuaguga

SEQ ID NO: 1163681 - RNA, 19 nt, Homo sapiens
gaacugaacgcaccuuaua

SEQ ID NO: 1163682 - RNA, 19 nt, Homo sapiens
ggaaguggaugaacugaaa

SEQ ID NO: 1163683 - RNA, 19 nt, Homo sapiens
gaaggaagaugcaaacugu

SEQ ID NO: 1163684 - RNA, 19 nt, Homo sapiens
gaaguacugucuccaaauu

SEQ ID NO: 1163685 - RNA, 19 nt, Homo sapiens
gaacacagguuucuuggau

SEQ ID NO: 1163686 - RNA, 19 nt, Homo sapiens
gaacuuaaauacugaggaa

SEQ ID NO: 1163687 - RNA, 19 nt, Homo sapiens
guacccagauguaucauua

SEQ ID NO: 1163688 - RNA, 19 nt, Homo sapiens
gaacugaaaugcauuccuu

SEQ ID NO: 1163689 - RNA, 19 nt, Homo sapiens
ccacagagcuugccaguuc

SEQ ID NO: 1163690 - RNA, 19 nt, Homo sapiens
gcaacaacaucuccacuuu

SEQ ID NO: 1163691 - RNA, 19 nt, Homo sapiens
gaacuagaccuuccaauug

SEQ ID NO: 1163692 - RNA, 19 nt, Homo sapiens
caaccuggaugaccucuua

SEQ ID NO: 1163693 - RNA, 19 nt, Homo sapiens
gaaacaacgucugauaauu

SEQ ID NO: 1163694 - RNA, 19 nt, Homo sapiens
uuacagagccucacaguua

SEQ ID NO: 1163695 - RNA, 19 nt, Homo sapiens
gaucaggucuuauaucugu

SEQ ID NO: 1163696 - RNA, 19 nt, Homo sapiens
gaagaugacuguacaaagg

SEQ ID NO: 1163697 - RNA, 19 nt, Homo sapiens
ugaaggaacuggauguuaa

SEQ ID NO: 1163698 - RNA, 19 nt, Homo sapiens
aaacacagaugaugacauu

SEQ ID NO: 1163699 - RNA, 19 nt, Homo sapiens
ugaaaugacuccuacaauu

SEQ ID NO: 1163700 - RNA, 19 nt, Homo sapiens
ggagguagauagacaaaga

SEQ ID NO: 1163701 - RNA, 19 nt, Homo sapiens
gaucccagcucucguauug

SEQ ID NO: 1163702 - RNA, 19 nt, Homo sapiens
gaagauuacuugccuguuc

SEQ ID NO: 1163703 - RNA, 19 nt, Homo sapiens
gaaaugacuccuacaauug

SEQ ID NO: 1163704 - RNA, 19 nt, Homo sapiens
gaguauaucugcauguauu

SEQ ID NO: 1163705 - RNA, 19 nt, Homo sapiens
gcaguuaccagauacuuua

SEQ ID NO: 1163706 - RNA, 19 nt, Homo sapiens
ugaagaaggugauggauug

SEQ ID NO: 1163707 - RNA, 19 nt, Homo sapiens
gugaauggcagaacaauua

SEQ ID NO: 1163708 - RNA, 19 nt, Homo sapiens
gcaccacaauugccugaua

SEQ ID NO: 1163709 - RNA, 19 nt, Homo sapiens
ggaaugaaauggaagaagu

SEQ ID NO: 1163710 - RNA, 19 nt, Homo sapiens
gcaagaugcuaguguguga

SEQ ID NO: 1163711 - RNA, 19 nt, Homo sapiens
caaaugcugugaagagaaa

SEQ ID NO: 1163712 - RNA, 19 nt, Homo sapiens
caacagacguaugcaaauu

SEQ ID NO: 1163713 - RNA, 19 nt, Homo sapiens
aaagcaagcucacaagaaa

SEQ ID NO: 1163714 - RNA, 19 nt, Homo sapiens
ggucacagauggagcaauu

SEQ ID NO: 1163715 - RNA, 19 nt, Homo sapiens
ugaccaagcuccugaaaga

SEQ ID NO: 1163716 - RNA, 19 nt, Homo sapiens
ggagaggaaugaaauggaa

SEQ ID NO: 1163717 - RNA, 19 nt, Homo sapiens
ccaggucaaucaacaguua

SEQ ID NO: 1163718 - RNA, 19 nt, Homo sapiens
ccaaucaugugucaaguuu

SEQ ID NO: 1163719 - RNA, 19 nt, Homo sapiens
ccagcuauguacagaauua

SEQ ID NO: 1163720 - RNA, 19 nt, Homo sapiens
gguaggcccuccuucauuu

SEQ ID NO: 1163721 - RNA, 19 nt, Homo sapiens
gcaguuaccuugcagagau

SEQ ID NO: 1163722 - RNA, 19 nt, Homo sapiens
agaaagacaugcuucauug

SEQ ID NO: 1163723 - RNA, 19 nt, Homo sapiens
gcaauuacagauccuauaa

SEQ ID NO: 1163724 - RNA, 19 nt, Homo sapiens
gaagacuccugcuguguga

SEQ ID NO: 1163725 - RNA, 19 nt, Homo sapiens
caagguauaucaaccauuc

SEQ ID NO: 1163726 - RNA, 19 nt, Homo sapiens
ggagaggccuacaaaugaa

SEQ ID NO: 1163727 - RNA, 19 nt, Homo sapiens
ccaaagcauuucaucagua

SEQ ID NO: 1163728 - RNA, 19 nt, Homo sapiens
aauaaacucuuguggcaua

SEQ ID NO: 1163729 - RNA, 19 nt, Homo sapiens
ggaccuagauaugcuguuu

SEQ ID NO: 1163730 - RNA, 19 nt, Homo sapiens
cuaaugaaguugauaguga

SEQ ID NO: 1163731 - RNA, 19 nt, Homo sapiens
gcaggcagcuaauaaagau

SEQ ID NO: 1163732 - RNA, 19 nt, Homo sapiens
caacagcaauggaaccuau

SEQ ID NO: 1163733 - RNA, 19 nt, Homo sapiens
gaagagcucugcuaugacu

SEQ ID NO: 1163734 - RNA, 19 nt, Homo sapiens
gcuaagagcuguccauggu

SEQ ID NO: 1163735 - RNA, 19 nt, Homo sapiens
gacaagcucuccauggaaa

SEQ ID NO: 1163736 - RNA, 19 nt, Homo sapiens
caagaaagcugggcgugaa

SEQ ID NO: 1163737 - RNA, 19 nt, Homo sapiens
ggauuuaucuugccaugga

SEQ ID NO: 1163738 - RNA, 19 nt, Homo sapiens
gcaccaacauuuaucacuu

SEQ ID NO: 1163739 - RNA, 19 nt, Homo sapiens
gagaacaaacugcccaaua

SEQ ID NO: 1163740 - RNA, 19 nt, Homo sapiens
caacaucuguaccgucuga

SEQ ID NO: 1163741 - RNA, 19 nt, Homo sapiens
uaacuuaugucccuucugu

SEQ ID NO: 1163742 - RNA, 19 nt, Homo sapiens
gagauacuccugacaguuu

SEQ ID NO: 1163743 - RNA, 19 nt, Homo sapiens
gaaacaagcuauguacucu

SEQ ID NO: 1163744 - RNA, 19 nt, Homo sapiens
ccaguucucuacaccaaua

SEQ ID NO: 1163745 - RNA, 19 nt, Homo sapiens
gaaaagauguugaagacuu

SEQ ID NO: 1163746 - RNA, 19 nt, Homo sapiens
gcagacaguucccaaagga

SEQ ID NO: 1163747 - RNA, 19 nt, Homo sapiens
cagaaagucuugacacaga

SEQ ID NO: 1163748 - RNA, 19 nt, Homo sapiens
guaguaagguagaaggaaa

SEQ ID NO: 1163749 - RNA, 19 nt, Homo sapiens
guaugcaaauucagaagua

SEQ ID NO: 1163750 - RNA, 19 nt, Homo sapiens
guacagaauuagagaacaa

SEQ ID NO: 1163751 - RNA, 19 nt, Homo sapiens
ggccaagauucuacuauaa

SEQ ID NO: 1163752 - RNA, 19 nt, Homo sapiens
gaacuugacaugggagaua

SEQ ID NO: 1163753 - RNA, 19 nt, Homo sapiens
gaagcggacugggaacuuu

SEQ ID NO: 1163754 - RNA, 19 nt, Homo sapiens
gaagagucaucccucagaa

SEQ ID NO: 1163755 - RNA, 19 nt, Homo sapiens
acaauugccugauauguga

SEQ ID NO: 1163756 - RNA, 19 nt, Homo sapiens
ugaaaugcauuccuugcua

SEQ ID NO: 1163757 - RNA, 19 nt, Homo sapiens
gaaaagagaugaugaugca

SEQ ID NO: 1163758 - RNA, 19 nt, Homo sapiens
ggccuaauccuccaaauuu

SEQ ID NO: 1163759 - RNA, 19 nt, Homo sapiens
gauaaacauucaccacaga

SEQ ID NO: 1163760 - RNA, 19 nt, Homo sapiens
agacuuagaugaugaagau

SEQ ID NO: 1163761 - RNA, 19 nt, Homo sapiens
ccucauggauuuagauuug

SEQ ID NO: 1163762 - RNA, 19 nt, Homo sapiens
uaacaacucuuggacauca

SEQ ID NO: 1163763 - RNA, 19 nt, Homo sapiens
gaaagaaaccucgaaguag

SEQ ID NO: 1163764 - RNA, 19 nt, Homo sapiens
aaggagaacuuauggauug

SEQ ID NO: 1163765 - RNA, 19 nt, Homo sapiens
uaaagugguucuuagcaaa

SEQ ID NO: 1163766 - RNA, 19 nt, Homo sapiens
gaaaccaaccuucuaacaa

SEQ ID NO: 1163767 - RNA, 19 nt, Homo sapiens
gaagugaaaccaagaaaca

SEQ ID NO: 1163768 - RNA, 19 nt, Homo sapiens
ggaaacagaaaucaaagaa

SEQ ID NO: 1163769 - RNA, 19 nt, Homo sapiens
uaaggaacguuuacgagaa

SEQ ID NO: 1163770 - RNA, 19 nt, Homo sapiens
gugcauaucuggacaagga

SEQ ID NO: 1163771 - RNA, 19 nt, Homo sapiens
caauaacacuacagcguuu

SEQ ID NO: 1163772 - RNA, 19 nt, Homo sapiens
ggaugggacugucuguuuc

SEQ ID NO: 1163773 - RNA, 19 nt, Homo sapiens
guacucggcucuguaagga

SEQ ID NO: 1163774 - RNA, 19 nt, Homo sapiens
gaggcuggcugaagcuaug

SEQ ID NO: 1163775 - RNA, 19 nt, Homo sapiens
ugacggcgcugaccaguac

SEQ ID NO: 1163776 - RNA, 19 nt, Homo sapiens
gguacgaggugcauaucug

SEQ ID NO: 1163777 - RNA, 19 nt, Homo sapiens
ccggcuauguaguguauaa

SEQ ID NO: 1163778 - RNA, 19 nt, Homo sapiens
ccaguacucggcucuguaa

SEQ ID NO: 1163779 - RNA, 19 nt, Homo sapiens
aggaagcaauugccacaaa

SEQ ID NO: 1163780 - RNA, 19 nt, Homo sapiens
ggaagcaauugccacaaaa

SEQ ID NO: 1163781 - RNA, 19 nt, Homo sapiens
ggcagucccugagcuuuga

SEQ ID NO: 1163782 - RNA, 19 nt, Homo sapiens
cuacagcguuuccaauuuu

SEQ ID NO: 1163783 - RNA, 19 nt, Homo sapiens
gcuauguaguguauaaguc

SEQ ID NO: 1163784 - RNA, 19 nt, Homo sapiens
acuacagcguuuccaauuu

SEQ ID NO: 1163785 - RNA, 19 nt, Homo sapiens
gccaggaugccgaaggaua

SEQ ID NO: 1163786 - RNA, 19 nt, Homo sapiens
aaacgugagaaccguauuu

SEQ ID NO: 1163787 - RNA, 19 nt, Homo sapiens
ccuguuacgugcucuguuc

SEQ ID NO: 1163788 - RNA, 19 nt, Homo sapiens
ggggucauguggucaauaa

SEQ ID NO: 1163789 - RNA, 19 nt, Homo sapiens
guauaaguccauucccuau

SEQ ID NO: 1163790 - RNA, 19 nt, Homo sapiens
uaccaggccugucuaaagg

SEQ ID NO: 1163791 - RNA, 19 nt, Homo sapiens
ggaguacaccucacugaac

SEQ ID NO: 1163792 - RNA, 19 nt, Homo sapiens
gaccaguacucggcucugu

SEQ ID NO: 1163793 - RNA, 19 nt, Homo sapiens
caaaguguugggauuacaa

SEQ ID NO: 1163794 - RNA, 19 nt, Homo sapiens
uggaugggacugucuguuu

SEQ ID NO: 1163795 - RNA, 19 nt, Homo sapiens
guuuguggcuggugagaca

SEQ ID NO: 1163796 - RNA, 19 nt, Homo sapiens
ggaugcuccggaccuguua

SEQ ID NO: 1163797 - RNA, 19 nt, Homo sapiens
ggacaacuucugggcaugu

SEQ ID NO: 1163798 - RNA, 19 nt, Homo sapiens
ccacaaugaggaaucuguu

SEQ ID NO: 1163799 - RNA, 19 nt, Homo sapiens
cuaccaggccugucuaaag

SEQ ID NO: 1163800 - RNA, 19 nt, Homo sapiens
guggugaggcgugguauga

SEQ ID NO: 1163801 - RNA, 19 nt, Homo sapiens
cacuacagcguuuccaauu

SEQ ID NO: 1163802 - RNA, 19 nt, Homo sapiens
gcugguacgaggugcauau

SEQ ID NO: 1163803 - RNA, 19 nt, Homo sapiens
gugcuaugcugcggugugu

SEQ ID NO: 1163804 - RNA, 19 nt, Homo sapiens
gcggaguacaccucacuga

SEQ ID NO: 1163805 - RNA, 19 nt, Homo sapiens
ugagaaccguauuuucaaa

SEQ ID NO: 1163806 - RNA, 19 nt, Homo sapiens
ugcaucggguggcacagua

SEQ ID NO: 1163807 - RNA, 19 nt, Homo sapiens
gacaacuucugggcaugug

SEQ ID NO: 1163808 - RNA, 19 nt, Homo sapiens
ggucauguggucaauaaaa

SEQ ID NO: 1163809 - RNA, 19 nt, Homo sapiens
ucuccgagcauccgucuau

SEQ ID NO: 1163810 - RNA, 19 nt, Homo sapiens
ccaggaugccgaaggauac

SEQ ID NO: 1163811 - RNA, 19 nt, Homo sapiens
acuaugaggccaccaguca

SEQ ID NO: 1163812 - RNA, 19 nt, Homo sapiens
gcaaggggcaguuggugaa

SEQ ID NO: 1163813 - RNA, 19 nt, Homo sapiens
gcugggcauuccucuggau

SEQ ID NO: 1163814 - RNA, 19 nt, Homo sapiens
gaggccaccagucagaguu

SEQ ID NO: 1163815 - RNA, 19 nt, Homo sapiens
uaugaggccaccagucaga

SEQ ID NO: 1163816 - RNA, 19 nt, Homo sapiens
cggaguacaccucacugaa

SEQ ID NO: 1163817 - RNA, 19 nt, Homo sapiens
aaaguguugggauuacaaa

SEQ ID NO: 1163818 - RNA, 19 nt, Homo sapiens
caacacagccuaucuaaua

SEQ ID NO: 1163819 - RNA, 19 nt, Homo sapiens
gacaagagcuuccuucaaa

SEQ ID NO: 1163820 - RNA, 19 nt, Homo sapiens
ggacacagguacuaucauu

SEQ ID NO: 1163821 - RNA, 19 nt, Homo sapiens
ggaagaaggcuaugauuau

SEQ ID NO: 1163822 - RNA, 19 nt, Homo sapiens
ccaagcauuucaaggauua

SEQ ID NO: 1163823 - RNA, 19 nt, Homo sapiens
ggaaagcuguggacugguu

SEQ ID NO: 1163824 - RNA, 19 nt, Homo sapiens
caaaguggcaucugcauaa

SEQ ID NO: 1163825 - RNA, 19 nt, Homo sapiens
gaagaaggcuaugauuauc

SEQ ID NO: 1163826 - RNA, 19 nt, Homo sapiens
gcaacaauuucaugcagaa

SEQ ID NO: 1163827 - RNA, 19 nt, Homo sapiens
uuaaaggccugugaauaua

SEQ ID NO: 1163828 - RNA, 19 nt, Homo sapiens
ucacgacacucuuauuuca

SEQ ID NO: 1163829 - RNA, 19 nt, Homo sapiens
gcugaagacacacuuguua

SEQ ID NO: 1163830 - RNA, 19 nt, Homo sapiens
gugagcaacuaaugaauga

SEQ ID NO: 1163831 - RNA, 19 nt, Homo sapiens
caaccaguaugaggcaaua

SEQ ID NO: 1163832 - RNA, 19 nt, Homo sapiens
gagacgaaauggacaaagu

SEQ ID NO: 1163833 - RNA, 19 nt, Homo sapiens
ucccuaaaccugugaauua

SEQ ID NO: 1163834 - RNA, 19 nt, Homo sapiens
gaagagugagcaacuaaug

SEQ ID NO: 1163835 - RNA, 19 nt, Homo sapiens
uaacaacacagccuaucua

SEQ ID NO: 1163836 - RNA, 19 nt, Homo sapiens
gaggaagagugagcaacua

SEQ ID NO: 1163837 - RNA, 19 nt, Homo sapiens
cggaagaaggcuaugauua

SEQ ID NO: 1163838 - RNA, 19 nt, Homo sapiens
cagccuaucuaauauacaa

SEQ ID NO: 1163839 - RNA, 19 nt, Homo sapiens
ggacauuacaacagcuaua

SEQ ID NO: 1163840 - RNA, 19 nt, Homo sapiens
acuagaagcuggaggaaga

SEQ ID NO: 1163841 - RNA, 19 nt, Homo sapiens
ccauuacaccuucuuuaua

SEQ ID NO: 1163842 - RNA, 19 nt, Homo sapiens
gcuguggacugguuuacuu

SEQ ID NO: 1163843 - RNA, 19 nt, Homo sapiens
gaacauccuuugcuuugcu

SEQ ID NO: 1163844 - RNA, 19 nt, Homo sapiens
gcucuuccuuggccucuuu

SEQ ID NO: 1163845 - RNA, 19 nt, Homo sapiens
cuaagaacauccuuugcuu

SEQ ID NO: 1163846 - RNA, 19 nt, Homo sapiens
gcuguggcaugaaauaaau

SEQ ID NO: 1163847 - RNA, 19 nt, Homo sapiens
gaaaggacacagguacuau

SEQ ID NO: 1163848 - RNA, 19 nt, Homo sapiens
caaggguucuggcugauuc

SEQ ID NO: 1163849 - RNA, 19 nt, Homo sapiens
ucaaguacaaccaguauga

SEQ ID NO: 1163850 - RNA, 19 nt, Homo sapiens
caugccaagugguguauuu

SEQ ID NO: 1163851 - RNA, 19 nt, Homo sapiens
gaagacacacuuguuaaca

SEQ ID NO: 1163852 - RNA, 19 nt, Homo sapiens
agacacacuuguuaacaga

SEQ ID NO: 1163853 - RNA, 19 nt, Homo sapiens
gaaaguauggacacaccaa

SEQ ID NO: 1163854 - RNA, 19 nt, Homo sapiens
uaucacgacacucuuauuu

SEQ ID NO: 1163855 - RNA, 19 nt, Homo sapiens
ucaaacugcucccuuccuu

SEQ ID NO: 1163856 - RNA, 19 nt, Homo sapiens
gaagcuggaggaagaguga

SEQ ID NO: 1163857 - RNA, 19 nt, Homo sapiens
uuuaaaggccugugaauau

SEQ ID NO: 1163858 - RNA, 19 nt, Homo sapiens
uaaauuaucacgacacucu

SEQ ID NO: 1163859 - RNA, 19 nt, Homo sapiens
caaggaaaguggagagacu

SEQ ID NO: 1163860 - RNA, 19 nt, Homo sapiens
gacaaugggucuucuucca

SEQ ID NO: 1163861 - RNA, 19 nt, Homo sapiens
gaucaugccaaguggugua

SEQ ID NO: 1163862 - RNA, 19 nt, Homo sapiens
acacagguacuaucauuga

SEQ ID NO: 1163863 - RNA, 19 nt, Homo sapiens
acacacuuguuaacagaaa

SEQ ID NO: 1163864 - RNA, 19 nt, Homo sapiens
uaagaacauccuuugcuuu

SEQ ID NO: 1163865 - RNA, 19 nt, Homo sapiens
gguucuggcugauucauuc

SEQ ID NO: 1163866 - RNA, 19 nt, Homo sapiens
gagagacuggguuagagua

SEQ ID NO: 1163867 - RNA, 19 nt, Homo sapiens
agaaguggaggauucauuu

SEQ ID NO: 1163868 - RNA, 19 nt, Homo sapiens
caaacugcucccuuccuua

SEQ ID NO: 1163869 - RNA, 19 nt, Homo sapiens
gaauuacagcagaaaguau

SEQ ID NO: 1163870 - RNA, 19 nt, Homo sapiens
ugaauuacagcagaaagua

SEQ ID NO: 1163871 - RNA, 19 nt, Homo sapiens
gcaagacugcuaagaacau

SEQ ID NO: 1163872 - RNA, 19 nt, Homo sapiens
gaaguggaggauucauuug

SEQ ID NO: 1163873 - RNA, 19 nt, Homo sapiens
aguggaggauucauuugua

SEQ ID NO: 1163874 - RNA, 19 nt, Homo sapiens
cauuacaacagcuauauga

SEQ ID NO: 1163875 - RNA, 19 nt, Homo sapiens
cuaugaaagcuguaaguaa

SEQ ID NO: 1163876 - RNA, 19 nt, Homo sapiens
ugaaaggacacagguacua

SEQ ID NO: 1163877 - RNA, 19 nt, Homo sapiens
aagaacauccuuugcuuug

SEQ ID NO: 1163878 - RNA, 19 nt, Homo sapiens
acacagccuaucuaauaua

SEQ ID NO: 1163879 - RNA, 19 nt, Homo sapiens
gagcaacuaaugaaugaca

SEQ ID NO: 1163880 - RNA, 19 nt, Homo sapiens
gcauuucaaggauuaguau

SEQ ID NO: 1163881 - RNA, 19 nt, Homo sapiens
uuaccaagcauuucaagga

SEQ ID NO: 1163882 - RNA, 19 nt, Homo sapiens
gacauguauuggagaccua

SEQ ID NO: 1163883 - RNA, 19 nt, Homo sapiens
ggccagcucaucagagauu

SEQ ID NO: 1163884 - RNA, 19 nt, Homo sapiens
gaaagcuguggacugguuu

SEQ ID NO: 1163885 - RNA, 19 nt, Homo sapiens
caacagcuauaugaagcau

SEQ ID NO: 1163886 - RNA, 19 nt, Homo sapiens
gacauuacaacagcuauau

SEQ ID NO: 1163887 - RNA, 19 nt, Homo sapiens
guccugcuguggcaugaaa

SEQ ID NO: 1163888 - RNA, 19 nt, Homo sapiens
cuuaccaugucuacaauau

SEQ ID NO: 1163889 - RNA, 19 nt, Homo sapiens
ggcaugaaauaaaugaaac

SEQ ID NO: 1163890 - RNA, 19 nt, Homo sapiens
ugaagcauaugccucuaag

SEQ ID NO: 1163891 - RNA, 19 nt, Homo sapiens
ggaagagugagcaacuaau

SEQ ID NO: 1163892 - RNA, 19 nt, Homo sapiens
caagacugcuaagaacauc

SEQ ID NO: 1163893 - RNA, 19 nt, Homo sapiens
uaccaagcauuucaaggau

SEQ ID NO: 1163894 - RNA, 19 nt, Homo sapiens
acaaaguggcaucugcaua

SEQ ID NO: 1163895 - RNA, 19 nt, Homo sapiens
uggcaagacugcuaagaac

SEQ ID NO: 1163896 - RNA, 19 nt, Homo sapiens
agagugagcaacuaaugaa

SEQ ID NO: 1163897 - RNA, 19 nt, Homo sapiens
ggaggaagagugagcaacu

SEQ ID NO: 1163898 - RNA, 19 nt, Homo sapiens
gggcagcaacaauuucaug

SEQ ID NO: 1163899 - RNA, 19 nt, Homo sapiens
cagaaguggaggauucauu

SEQ ID NO: 1163900 - RNA, 19 nt, Homo sapiens
ggagagacuggguuagagu

SEQ ID NO: 1163901 - RNA, 19 nt, Homo sapiens
gcaucugcauaacuuucaa

SEQ ID NO: 1163902 - RNA, 19 nt, Homo sapiens
aacacagccuaucuaauau

SEQ ID NO: 1163903 - RNA, 19 nt, Homo sapiens
acuuauaaccugcauauca

SEQ ID NO: 1163904 - RNA, 19 nt, Homo sapiens
cacagguacuaucauugaa

SEQ ID NO: 1163905 - RNA, 19 nt, Homo sapiens
gcuaagaacauccuuugcu

SEQ ID NO: 1163906 - RNA, 19 nt, Homo sapiens
ucauuuguacccagaauug

SEQ ID NO: 1163907 - RNA, 19 nt, Homo sapiens
aauagauucucagcucuug

SEQ ID NO: 1163908 - RNA, 19 nt, Homo sapiens
aauuaucacgacacucuua

SEQ ID NO: 1163909 - RNA, 19 nt, Homo sapiens
aguggcaucugcauaacuu

SEQ ID NO: 1163910 - RNA, 19 nt, Homo sapiens
cagaaaugaagaagggaaa

SEQ ID NO: 1163911 - RNA, 19 nt, Homo sapiens
ugaaagcuguaaguaaacu

SEQ ID NO: 1163912 - RNA, 19 nt, Homo sapiens
cgacacucuuauuucaguu

SEQ ID NO: 1163913 - RNA, 19 nt, Homo sapiens
cugaagacacacuuguuaa

SEQ ID NO: 1163914 - RNA, 19 nt, Homo sapiens
agacaagagcuuccuucaa

SEQ ID NO: 1163915 - RNA, 19 nt, Homo sapiens
accaggagcucauucacau

SEQ ID NO: 1163916 - RNA, 19 nt, Homo sapiens
caauagauucucagcucuu

SEQ ID NO: 1163917 - RNA, 19 nt, Homo sapiens
aagguuuacugcuguggaa

SEQ ID NO: 1163918 - RNA, 19 nt, Homo sapiens
caacacagccuaucuaaua

SEQ ID NO: 1163919 - RNA, 19 nt, Homo sapiens
gacaagagcuuccuucaaa

SEQ ID NO: 1163920 - RNA, 19 nt, Homo sapiens
ggacacagguacuaucauu

SEQ ID NO: 1163921 - RNA, 19 nt, Homo sapiens
ggaagaaggcuaugauuau

SEQ ID NO: 1163922 - RNA, 19 nt, Homo sapiens
ccaagcauuucaaggauua

SEQ ID NO: 1163923 - RNA, 19 nt, Homo sapiens
caaaguggcaucugcauaa

SEQ ID NO: 1163924 - RNA, 19 nt, Homo sapiens
gaagaaggcuaugauuauc

SEQ ID NO: 1163925 - RNA, 19 nt, Homo sapiens
gaagauuuacgccauuaua

SEQ ID NO: 1163926 - RNA, 19 nt, Homo sapiens
uuaaaggccugugaauaua

SEQ ID NO: 1163927 - RNA, 19 nt, Homo sapiens
ucacgacacucuuauuuca

SEQ ID NO: 1163928 - RNA, 19 nt, Homo sapiens
gcugaagacacacuuguua

SEQ ID NO: 1163929 - RNA, 19 nt, Homo sapiens
caaccaguaugaggcaaua

SEQ ID NO: 1163930 - RNA, 19 nt, Homo sapiens
gagacgaaauggacaaagu

SEQ ID NO: 1163931 - RNA, 19 nt, Homo sapiens
ucccuaaaccugugaauua

SEQ ID NO: 1163932 - RNA, 19 nt, Homo sapiens
uaacaacacagccuaucua

SEQ ID NO: 1163933 - RNA, 19 nt, Homo sapiens
cggaagaaggcuaugauua

SEQ ID NO: 1163934 - RNA, 19 nt, Homo sapiens
cagccuaucuaauauacaa

SEQ ID NO: 1163935 - RNA, 19 nt, Homo sapiens
guuuguaaguggaagauuu

SEQ ID NO: 1163936 - RNA, 19 nt, Homo sapiens
ccauuacaccuucuuuaua

SEQ ID NO: 1163937 - RNA, 19 nt, Homo sapiens
gaaauguugugggcguuug

SEQ ID NO: 1163938 - RNA, 19 nt, Homo sapiens
gaaaggacacagguacuau

SEQ ID NO: 1163939 - RNA, 19 nt, Homo sapiens
caaggguucuggcugauuc

SEQ ID NO: 1163940 - RNA, 19 nt, Homo sapiens
ucaaguacaaccaguauga

SEQ ID NO: 1163941 - RNA, 19 nt, Homo sapiens
caugccaagugguguauuu

SEQ ID NO: 1163942 - RNA, 19 nt, Homo sapiens
gaagacacacuuguuaaca

SEQ ID NO: 1163943 - RNA, 19 nt, Homo sapiens
agacacacuuguuaacaga

SEQ ID NO: 1163944 - RNA, 19 nt, Homo sapiens
gaaaguauggacacaccaa

SEQ ID NO: 1163945 - RNA, 19 nt, Homo sapiens
uaucacgacacucuuauuu

SEQ ID NO: 1163946 - RNA, 19 nt, Homo sapiens
ucaaacugcucccuuccuu

SEQ ID NO: 1163947 - RNA, 19 nt, Homo sapiens
uuuaaaggccugugaauau

SEQ ID NO: 1163948 - RNA, 19 nt, Homo sapiens
uaaauuaucacgacacucu

SEQ ID NO: 1163949 - RNA, 19 nt, Homo sapiens
gacaaugggucuucuucca

SEQ ID NO: 1163950 - RNA, 19 nt, Homo sapiens
gaucaugccaaguggugua

SEQ ID NO: 1163951 - RNA, 19 nt, Homo sapiens
uggaagauuuacgccauua

SEQ ID NO: 1163952 - RNA, 19 nt, Homo sapiens
acacagguacuaucauuga

SEQ ID NO: 1163953 - RNA, 19 nt, Homo sapiens
cuggguagcugguagaaau

SEQ ID NO: 1163954 - RNA, 19 nt, Homo sapiens
acacacuuguuaacagaaa

SEQ ID NO: 1163955 - RNA, 19 nt, Homo sapiens
gguucuggcugauucauuc

SEQ ID NO: 1163956 - RNA, 19 nt, Homo sapiens
agaaguggaggauucauuu

SEQ ID NO: 1163957 - RNA, 19 nt, Homo sapiens
caaacugcucccuuccuua

SEQ ID NO: 1163958 - RNA, 19 nt, Homo sapiens
auauauuccugcagaguaa

SEQ ID NO: 1163959 - RNA, 19 nt, Homo sapiens
gaauuacagcagaaaguau

SEQ ID NO: 1163960 - RNA, 19 nt, Homo sapiens
ugaauuacagcagaaagua

SEQ ID NO: 1163961 - RNA, 19 nt, Homo sapiens
gaaguggaggauucauuug

SEQ ID NO: 1163962 - RNA, 19 nt, Homo sapiens
aguggaggauucauuugua

SEQ ID NO: 1163963 - RNA, 19 nt, Homo sapiens
cuaugaaagcuguaaguaa

SEQ ID NO: 1163964 - RNA, 19 nt, Homo sapiens
ugaaaggacacagguacua

SEQ ID NO: 1163965 - RNA, 19 nt, Homo sapiens
acacagccuaucuaauaua

SEQ ID NO: 1163966 - RNA, 19 nt, Homo sapiens
gcauuucaaggauuaguau

SEQ ID NO: 1163967 - RNA, 19 nt, Homo sapiens
uuaccaagcauuucaagga

SEQ ID NO: 1163968 - RNA, 19 nt, Homo sapiens
gacauguauuggagaccua

SEQ ID NO: 1163969 - RNA, 19 nt, Homo sapiens
ggccagcucaucagagauu

SEQ ID NO: 1163970 - RNA, 19 nt, Homo sapiens
guggaagauuuacgccauu

SEQ ID NO: 1163971 - RNA, 19 nt, Homo sapiens
cuuaccaugucuacaauau

SEQ ID NO: 1163972 - RNA, 19 nt, Homo sapiens
uaccaagcauuucaaggau

SEQ ID NO: 1163973 - RNA, 19 nt, Homo sapiens
aauauauuccugcagagua

SEQ ID NO: 1163974 - RNA, 19 nt, Homo sapiens
acaaaguggcaucugcaua

SEQ ID NO: 1163975 - RNA, 19 nt, Homo sapiens
aacacagccuaucuaauau

SEQ ID NO: 1163976 - RNA, 19 nt, Homo sapiens
cagaaguggaggauucauu

SEQ ID NO: 1163977 - RNA, 19 nt, Homo sapiens
gguagcugguagaaauguu

SEQ ID NO: 1163978 - RNA, 19 nt, Homo sapiens
gcaucugcauaacuuucaa

SEQ ID NO: 1163979 - RNA, 19 nt, Homo sapiens
acuuauaaccugcauauca

SEQ ID NO: 1163980 - RNA, 19 nt, Homo sapiens
cacagguacuaucauugaa

SEQ ID NO: 1163981 - RNA, 19 nt, Homo sapiens
ucauuuguacccagaauug

SEQ ID NO: 1163982 - RNA, 19 nt, Homo sapiens
aauagauucucagcucuug

SEQ ID NO: 1163983 - RNA, 19 nt, Homo sapiens
aauuaucacgacacucuua

SEQ ID NO: 1163984 - RNA, 19 nt, Homo sapiens
aguggcaucugcauaacuu

SEQ ID NO: 1163985 - RNA, 19 nt, Homo sapiens
ggaagauuuacgccauuau

SEQ ID NO: 1163986 - RNA, 19 nt, Homo sapiens
ugaaagcuguaaguaaacu

SEQ ID NO: 1163987 - RNA, 19 nt, Homo sapiens
cgacacucuuauuucaguu

SEQ ID NO: 1163988 - RNA, 19 nt, Homo sapiens
cugaagacacacuuguuaa

SEQ ID NO: 1163989 - RNA, 19 nt, Homo sapiens
guaacaacacagccuaucu

SEQ ID NO: 1163990 - RNA, 19 nt, Homo sapiens
cacagccuaucuaauauac

SEQ ID NO: 1163991 - RNA, 19 nt, Homo sapiens
agacaagagcuuccuucaa

SEQ ID NO: 1163992 - RNA, 19 nt, Homo sapiens
accaggagcucauucacau

SEQ ID NO: 1163993 - RNA, 19 nt, Homo sapiens
caauagauucucagcucuu

SEQ ID NO: 1163994 - RNA, 19 nt, Homo sapiens
aagguuuacugcuguggaa

SEQ ID NO: 1163995 - RNA, 19 nt, Homo sapiens
acaaugauggagucccuaa

SEQ ID NO: 1163996 - RNA, 19 nt, Homo sapiens
agaaggcuaugauuaucca

SEQ ID NO: 1163997 - RNA, 19 nt, Homo sapiens
ggacacaccaaagguuuac

SEQ ID NO: 1163998 - RNA, 19 nt, Homo sapiens
guggaggauucauuuguac

SEQ ID NO: 1163999 - RNA, 19 nt, Homo sapiens
aaacugcucccuuccuuac

SEQ ID NO: 1164000 - RNA, 19 nt, Homo sapiens
caagagcuuccuucaaacu

SEQ ID NO: 1164001 - RNA, 19 nt, Homo sapiens
ccacaccaagccuucagaa

SEQ ID NO: 1164002 - RNA, 19 nt, Homo sapiens
caccagggccagcucauca

SEQ ID NO: 1164003 - RNA, 19 nt, Homo sapiens
guagcugguagaaauguug

SEQ ID NO: 1164004 - RNA, 19 nt, Homo sapiens
cagguacuaucauugaaaa

SEQ ID NO: 1164005 - RNA, 19 nt, Homo sapiens
acagguacuaucauugaaa

SEQ ID NO: 1164006 - RNA, 19 nt, Homo sapiens
aacaacacagccuaucuaa

SEQ ID NO: 1164007 - RNA, 19 nt, Homo sapiens
cucaacggcugaagacaca

SEQ ID NO: 1164008 - RNA, 19 nt, Homo sapiens
gcaggcuccucaccacacu

SEQ ID NO: 1164009 - RNA, 19 nt, Homo sapiens
uaaccugcauaucacaaaa

SEQ ID NO: 1164010 - RNA, 19 nt, Homo sapiens
cuuauaaccugcauaucac

SEQ ID NO: 1164011 - RNA, 19 nt, Homo sapiens
uaaaggccugugaauauac

SEQ ID NO: 1164012 - RNA, 19 nt, Homo sapiens
uccauuacaccuucuuuau

SEQ ID NO: 1164013 - RNA, 19 nt, Homo sapiens
gacacagguacuaucauug

SEQ ID NO: 1164014 - RNA, 19 nt, Homo sapiens
guugugggcguuuguaagu

SEQ ID NO: 1164015 - RNA, 19 nt, Homo sapiens
uggacacaccaaagguuua

SEQ ID NO: 1164016 - RNA, 19 nt, Homo sapiens
aagacacacuuguuaacag

SEQ ID NO: 1164017 - RNA, 19 nt, Homo sapiens
gugaauuacagcagaaagu

SEQ ID NO: 1164018 - RNA, 19 nt, Homo sapiens
gaaguuaccuugagcaauc

SEQ ID NO: 1164019 - RNA, 19 nt, Homo sapiens
gaacaagacauucgagaaa

SEQ ID NO: 1164020 - RNA, 19 nt, Homo sapiens
gaugagauauuccugaaga

SEQ ID NO: 1164021 - RNA, 19 nt, Homo sapiens
caaagaaagugacccauuc

SEQ ID NO: 1164022 - RNA, 19 nt, Homo sapiens
gaaagccucuugcccauca

SEQ ID NO: 1164023 - RNA, 19 nt, Homo sapiens
gcagacaacuucaacagau

SEQ ID NO: 1164024 - RNA, 19 nt, Homo sapiens
caauagugcugaaggcuuu

SEQ ID NO: 1164025 - RNA, 19 nt, Homo sapiens
ucaagagauugcccaguua

SEQ ID NO: 1164026 - RNA, 19 nt, Homo sapiens
gaugcgauuugaugagaua

SEQ ID NO: 1164027 - RNA, 19 nt, Homo sapiens
ggacuuggccgauccagaa

SEQ ID NO: 1164028 - RNA, 19 nt, Homo sapiens
ugaaggagcuugaugacau

SEQ ID NO: 1164029 - RNA, 19 nt, Homo sapiens
guaaaggguucuuggacaa

SEQ ID NO: 1164030 - RNA, 19 nt, Homo sapiens
agagaaauauucacuggaa

SEQ ID NO: 1164031 - RNA, 19 nt, Homo sapiens
gaaacaggaugcucaagac

SEQ ID NO: 1164032 - RNA, 19 nt, Homo sapiens
gcacuuggaucgagaugag

SEQ ID NO: 1164033 - RNA, 19 nt, Homo sapiens
gucaagagauugcccaguu

SEQ ID NO: 1164034 - RNA, 19 nt, Homo sapiens
ucaagaaacagacaaagaa

SEQ ID NO: 1164035 - RNA, 19 nt, Homo sapiens
gggcaggauucucagauga

SEQ ID NO: 1164036 - RNA, 19 nt, Homo sapiens
ccagcgaggugcaggaauu

SEQ ID NO: 1164037 - RNA, 19 nt, Homo sapiens
caaagaccaauucgcguua

SEQ ID NO: 1164038 - RNA, 19 nt, Homo sapiens
gaagucaacgcaagacgaa

SEQ ID NO: 1164039 - RNA, 19 nt, Homo sapiens
aaacgcaaauccaaucuca

SEQ ID NO: 1164040 - RNA, 19 nt, Homo sapiens
gaacagcagacaacuucaa

SEQ ID NO: 1164041 - RNA, 19 nt, Homo sapiens
gcaaauccaaucucaggaa

SEQ ID NO: 1164042 - RNA, 19 nt, Homo sapiens
ggaacaagacauucgagaa

SEQ ID NO: 1164043 - RNA, 19 nt, Homo sapiens
ucagugacauugacaagga

SEQ ID NO: 1164044 - RNA, 19 nt, Homo sapiens
ggccaaauuugaugggauu

SEQ ID NO: 1164045 - RNA, 19 nt, Homo sapiens
agaaacagacaaagaauga

SEQ ID NO: 1164046 - RNA, 19 nt, Homo sapiens
aauauucacuggaacaaga

SEQ ID NO: 1164047 - RNA, 19 nt, Homo sapiens
gagauugcccaguuacaaa

SEQ ID NO: 1164048 - RNA, 19 nt, Homo sapiens
gacaagaugcgauuugaug

SEQ ID NO: 1164049 - RNA, 19 nt, Homo sapiens
gcaacaacacgcaagaguu

SEQ ID NO: 1164050 - RNA, 19 nt, Homo sapiens
gaagaggcaaucagacaga

SEQ ID NO: 1164051 - RNA, 19 nt, Homo sapiens
gaaguuaagcaaagaccaa

SEQ ID NO: 1164052 - RNA, 19 nt, Homo sapiens
cagacaagaugcgauuuga

SEQ ID NO: 1164053 - RNA, 19 nt, Homo sapiens
caaauccaaucucaggaau

SEQ ID NO: 1164054 - RNA, 19 nt, Homo sapiens
ugaauccagugaucccuuu

SEQ ID NO: 1164055 - RNA, 19 nt, Homo sapiens
ggaguuuacuggcgugaag

SEQ ID NO: 1164056 - RNA, 19 nt, Homo sapiens
gcagacaagaugcgauuug

SEQ ID NO: 1164057 - RNA, 19 nt, Homo sapiens
ggaagaaaaggccaaauuu

SEQ ID NO: 1164058 - RNA, 19 nt, Homo sapiens
gaaaucaaccaggcaagga

SEQ ID NO: 1164059 - RNA, 19 nt, Homo sapiens
gcgauuugaugagauauuc

SEQ ID NO: 1164060 - RNA, 19 nt, Homo sapiens
aaacacagccaacagugaa

SEQ ID NO: 1164061 - RNA, 19 nt, Homo sapiens
cagaguggccaugaaguua

SEQ ID NO: 1164062 - RNA, 19 nt, Homo sapiens
ucaaagaaagugacccauu

SEQ ID NO: 1164063 - RNA, 19 nt, Homo sapiens
cagaacagcagacaacuuc

SEQ ID NO: 1164064 - RNA, 19 nt, Homo sapiens
gccaggaggugaaggagau

SEQ ID NO: 1164065 - RNA, 19 nt, Homo sapiens
gcacagaguggccaugaag

SEQ ID NO: 1164066 - RNA, 19 nt, Homo sapiens
gaaauauucacuggaacaa

SEQ ID NO: 1164067 - RNA, 19 nt, Homo sapiens
aaaccucccagcuucuuua

SEQ ID NO: 1164068 - RNA, 19 nt, Homo sapiens
gcgacccguuccaaaguaa

SEQ ID NO: 1164069 - RNA, 19 nt, Homo sapiens
ggcgacccguuccaaagua

SEQ ID NO: 1164070 - RNA, 19 nt, Homo sapiens
caucgacccuccucaaguc

SEQ ID NO: 1164071 - RNA, 19 nt, Homo sapiens
gaagaaaaggccaaauuug

SEQ ID NO: 1164072 - RNA, 19 nt, Homo sapiens
gcaugccaccgccuaaauu

SEQ ID NO: 1164073 - RNA, 19 nt, Homo sapiens
gacauuauccuugggaaga

SEQ ID NO: 1164074 - RNA, 19 nt, Homo sapiens
ucaagucccugaagucaac

SEQ ID NO: 1164075 - RNA, 19 nt, Homo sapiens
caaacacagccaacaguga

SEQ ID NO: 1164076 - RNA, 19 nt, Homo sapiens
aagcacagccucaagcaaa

SEQ ID NO: 1164077 - RNA, 19 nt, Homo sapiens
caagaaacagacaaagaau

SEQ ID NO: 1164078 - RNA, 19 nt, Homo sapiens
ccaauucgcguuagcuaug

SEQ ID NO: 1164079 - RNA, 19 nt, Homo sapiens
ccacuggaaauucguugua

SEQ ID NO: 1164080 - RNA, 19 nt, Homo sapiens
caacuucaacagauccauu

SEQ ID NO: 1164081 - RNA, 19 nt, Homo sapiens
gcagaacagcagacaacuu

SEQ ID NO: 1164082 - RNA, 19 nt, Homo sapiens
gcgacccguuccagaauga

SEQ ID NO: 1164083 - RNA, 19 nt, Homo sapiens
ugagcaaucugaauuugag

SEQ ID NO: 1164084 - RNA, 19 nt, Homo sapiens
cuucaccucuguaaguuga

SEQ ID NO: 1164085 - RNA, 19 nt, Homo sapiens
gaaccuucuagcacacaua

SEQ ID NO: 1164086 - RNA, 19 nt, Homo sapiens
caaagcugccucuugaugu

SEQ ID NO: 1164087 - RNA, 19 nt, Homo sapiens
aaaggaagaggcaaucaga

SEQ ID NO: 1164088 - RNA, 19 nt, Homo sapiens
gcaggucgauccggcauac

SEQ ID NO: 1164089 - RNA, 19 nt, Homo sapiens
ucaagccaguccucaugaa

SEQ ID NO: 1164090 - RNA, 19 nt, Homo sapiens
gcaaaccucccagcuucuu

SEQ ID NO: 1164091 - RNA, 19 nt, Homo sapiens
gccaugaaguuaccuugag

SEQ ID NO: 1164092 - RNA, 19 nt, Homo sapiens
gaucugaaccgagccaagu

SEQ ID NO: 1164093 - RNA, 19 nt, Homo sapiens
agaaacaggaugcucaaga

SEQ ID NO: 1164094 - RNA, 19 nt, Homo sapiens
gcucgaggcucagaaacag

SEQ ID NO: 1164095 - RNA, 19 nt, Homo sapiens
gaaaaggccaaauuugaug

SEQ ID NO: 1164096 - RNA, 19 nt, Homo sapiens
uggaaaccaucaucaaguc

SEQ ID NO: 1164097 - RNA, 19 nt, Homo sapiens
gaccaauucgcguuagcua

SEQ ID NO: 1164098 - RNA, 19 nt, Homo sapiens
aagaugcgauuugaugaga

SEQ ID NO: 1164099 - RNA, 19 nt, Homo sapiens
gagaaagaagacuguguuc

SEQ ID NO: 1164100 - RNA, 19 nt, Homo sapiens
cagcuucuuuagccucuug

SEQ ID NO: 1164101 - RNA, 19 nt, Homo sapiens
guuaagcaaagaccaauuc

SEQ ID NO: 1164102 - RNA, 19 nt, Homo sapiens
ggaccucagugacauugac

SEQ ID NO: 1164103 - RNA, 19 nt, Homo sapiens
cagacaacuucaacagauc

SEQ ID NO: 1164104 - RNA, 19 nt, Homo sapiens
gcagagaggggcaguuuug

SEQ ID NO: 1164105 - RNA, 19 nt, Homo sapiens
ccaguuacaaagagagaaa

SEQ ID NO: 1164106 - RNA, 19 nt, Homo sapiens
cagcagaaggucaguaaag

SEQ ID NO: 1164107 - RNA, 19 nt, Homo sapiens
agagaaagaagacuguguu

SEQ ID NO: 1164108 - RNA, 19 nt, Homo sapiens
gagcaugccaccgccuaaa

SEQ ID NO: 1164109 - RNA, 19 nt, Homo sapiens
ccuccagugucuccucaaa

SEQ ID NO: 1164110 - RNA, 19 nt, Homo sapiens
caggcaaggagcaaacuuu

SEQ ID NO: 1164111 - RNA, 19 nt, Homo sapiens
caacgcaagacgaaaucaa

SEQ ID NO: 1164112 - RNA, 19 nt, Homo sapiens
gugcaggaauuacaaaaug

SEQ ID NO: 1164113 - RNA, 19 nt, Homo sapiens
cagcgaggugcaggaauua

SEQ ID NO: 1164114 - RNA, 19 nt, Homo sapiens
gacaccagcagcccucuga

SEQ ID NO: 1164115 - RNA, 19 nt, Homo sapiens
uugaugagauauuccugaa

SEQ ID NO: 1164116 - RNA, 19 nt, Homo sapiens
ucuggccucucggacauua

SEQ ID NO: 1164117 - RNA, 19 nt, Homo sapiens
ccacugacgacuucuucaa

SEQ ID NO: 1164118 - RNA, 19 nt, Homo sapiens
gcagauguuugucucauua

SEQ ID NO: 1164119 - RNA, 19 nt, Homo sapiens
guaaaugucugcucuaaga

SEQ ID NO: 1164120 - RNA, 19 nt, Homo sapiens
gaacuggccugacugacau

SEQ ID NO: 1164121 - RNA, 19 nt, Homo sapiens
gggaauagcugaguuugug

SEQ ID NO: 1164122 - RNA, 19 nt, Homo sapiens
gaauguguaugucuaaaca

SEQ ID NO: 1164123 - RNA, 19 nt, Homo sapiens
uauggaaacucaucugauu

SEQ ID NO: 1164124 - RNA, 19 nt, Homo sapiens
gaagagggccaccaggaaa

SEQ ID NO: 1164125 - RNA, 19 nt, Homo sapiens
ggacuccucaucuuuauau

SEQ ID NO: 1164126 - RNA, 19 nt, Homo sapiens
gaauggacuccucaucuuu

SEQ ID NO: 1164127 - RNA, 19 nt, Homo sapiens
gacaugcaguuccauaaau

SEQ ID NO: 1164128 - RNA, 19 nt, Homo sapiens
gaaggaaaccaucaagaag

SEQ ID NO: 1164129 - RNA, 19 nt, Homo sapiens
gaugagcaguagaugaaug

SEQ ID NO: 1164130 - RNA, 19 nt, Homo sapiens
gggacaagaugguuuacau

SEQ ID NO: 1164131 - RNA, 19 nt, Homo sapiens
ggaagagggccaccaggaa

SEQ ID NO: 1164132 - RNA, 19 nt, Homo sapiens
cagauaugaugauggaaga

SEQ ID NO: 1164133 - RNA, 19 nt, Homo sapiens
agaauggacuccucaucuu

SEQ ID NO: 1164134 - RNA, 19 nt, Homo sapiens
ggaacuggccugacugaca

SEQ ID NO: 1164135 - RNA, 19 nt, Homo sapiens
ggaaggcugaccaugauga

SEQ ID NO: 1164136 - RNA, 19 nt, Homo sapiens
guggaaggcugaccaugau

SEQ ID NO: 1164137 - RNA, 19 nt, Homo sapiens
agaaggaaaccaucaagaa

SEQ ID NO: 1164138 - RNA, 19 nt, Homo sapiens
cgaagaauggguagaauca

SEQ ID NO: 1164139 - RNA, 19 nt, Homo sapiens
aagaagcuauggaaacuca

SEQ ID NO: 1164140 - RNA, 19 nt, Homo sapiens
gaugaauguguaugucuaa

SEQ ID NO: 1164141 - RNA, 19 nt, Homo sapiens
aagaauggguagaaucaau

SEQ ID NO: 1164142 - RNA, 19 nt, Homo sapiens
agcaguagaugaaugugua

SEQ ID NO: 1164143 - RNA, 19 nt, Homo sapiens
ugacaugcaguuccauaaa

SEQ ID NO: 1164144 - RNA, 19 nt, Homo sapiens
agaagaagcuauggaaacu

SEQ ID NO: 1164145 - RNA, 19 nt, Homo sapiens
agaugaauguguaugucua

SEQ ID NO: 1164146 - RNA, 19 nt, Homo sapiens
aauggacuccucaucuuua

SEQ ID NO: 1164147 - RNA, 19 nt, Homo sapiens
guguaugucuaaacaagga

SEQ ID NO: 1164148 - RNA, 19 nt, Homo sapiens
ggaugaggaagguaaaugu

SEQ ID NO: 1164149 - RNA, 19 nt, Homo sapiens
cauaaaugcagauguuugu

SEQ ID NO: 1164150 - RNA, 19 nt, Homo sapiens
aacaaggacugcucugugu

SEQ ID NO: 1164151 - RNA, 19 nt, Homo sapiens
guagaugaauguguauguc

SEQ ID NO: 1164152 - RNA, 19 nt, Homo sapiens
acaugcaguuccauaaaug

SEQ ID NO: 1164153 - RNA, 19 nt, Homo sapiens
gaagugggacaagaugguu

SEQ ID NO: 1164154 - RNA, 19 nt, Homo sapiens
uuccauaaaugcagauguu

SEQ ID NO: 1164155 - RNA, 19 nt, Homo sapiens
aggaaaccaucaagaagug

SEQ ID NO: 1164156 - RNA, 19 nt, Homo sapiens
gcuauggaaacucaucuga

SEQ ID NO: 1164157 - RNA, 19 nt, Homo sapiens
cuccucaucuuuauauuca

SEQ ID NO: 1164158 - RNA, 19 nt, Homo sapiens
gacaugcgcauucauagca

SEQ ID NO: 1164159 - RNA, 19 nt, Homo sapiens
gaauggguagaaucaauca

SEQ ID NO: 1164160 - RNA, 19 nt, Homo sapiens
gaagaauggguagaaucaa

SEQ ID NO: 1164161 - RNA, 19 nt, Homo sapiens
aaagaagaagcuauggaaa

SEQ ID NO: 1164162 - RNA, 19 nt, Homo sapiens
ccauaaaugcagauguuug

SEQ ID NO: 1164163 - RNA, 19 nt, Homo sapiens
ccggacaugcgcauucaua

SEQ ID NO: 1164164 - RNA, 19 nt, Homo sapiens
cagaauggacuccucaucu

SEQ ID NO: 1164165 - RNA, 19 nt, Homo sapiens
gcagaaggaaaccaucaag

SEQ ID NO: 1164166 - RNA, 19 nt, Homo sapiens
ggaagugggacaagauggu

SEQ ID NO: 1164167 - RNA, 19 nt, Homo sapiens
caaccggacaugcgcauuc

SEQ ID NO: 1164168 - RNA, 19 nt, Homo sapiens
agguaaaugucugcucuaa

SEQ ID NO: 1164169 - RNA, 19 nt, Homo sapiens
uagcugaguuugugguuuu

SEQ ID NO: 1164170 - RNA, 19 nt, Homo sapiens
gcagaauggacuccucauc

SEQ ID NO: 1164171 - RNA, 19 nt, Homo sapiens
cagaaggaaaccaucaaga

SEQ ID NO: 1164172 - RNA, 19 nt, Homo sapiens
gaagcuauggaaacucauc

SEQ ID NO: 1164173 - RNA, 19 nt, Homo sapiens
caaauaaaagccuguguau

SEQ ID NO: 1164174 - RNA, 19 nt, Homo sapiens
gagcaguagaugaaugugu

SEQ ID NO: 1164175 - RNA, 19 nt, Homo sapiens
caugaugagcaguagauga

SEQ ID NO: 1164176 - RNA, 19 nt, Homo sapiens
gcucuaagaagcagacaac

SEQ ID NO: 1164177 - RNA, 19 nt, Homo sapiens
uaaaugcagauguuugucu

SEQ ID NO: 1164178 - RNA, 19 nt, Homo sapiens
gcaguagaugaauguguau

SEQ ID NO: 1164179 - RNA, 19 nt, Homo sapiens
uaaaugucugcucuaagaa

SEQ ID NO: 1164180 - RNA, 19 nt, Homo sapiens
uaaacaaggacugcucugu

SEQ ID NO: 1164181 - RNA, 19 nt, Homo sapiens
gaaguggaaggcugaccau

SEQ ID NO: 1164182 - RNA, 19 nt, Homo sapiens
gauuccagauaugaugaug

SEQ ID NO: 1164183 - RNA, 19 nt, Homo sapiens
gcugguggaugaggaaggu

SEQ ID NO: 1164184 - RNA, 19 nt, Homo sapiens
gaggucaugcugggaauuc

SEQ ID NO: 1164185 - RNA, 19 nt, Homo sapiens
ggacaugcgcauucauagc

SEQ ID NO: 1164186 - RNA, 19 nt, Homo sapiens
gaugaggaagguaaauguc

SEQ ID NO: 1164187 - RNA, 19 nt, Homo sapiens
aaagcaaucugaagaaaac

SEQ ID NO: 1164188 - RNA, 19 nt, Homo sapiens
augaugagcaguagaugaa

SEQ ID NO: 1164189 - RNA, 19 nt, Homo sapiens
aguggaaggcugaccauga

SEQ ID NO: 1164190 - RNA, 19 nt, Homo sapiens
aaggaaaccaucaagaagu

SEQ ID NO: 1164191 - RNA, 19 nt, Homo sapiens
uagcagaaggaaaccauca

SEQ ID NO: 1164192 - RNA, 19 nt, Homo sapiens
aaaagaagaagcuauggaa

SEQ ID NO: 1164193 - RNA, 19 nt, Homo sapiens
ugcagauguuugucucauu

SEQ ID NO: 1164194 - RNA, 19 nt, Homo sapiens
aagaagaagcuauggaaac

SEQ ID NO: 1164195 - RNA, 19 nt, Homo sapiens
uguccucacagaugaauga

SEQ ID NO: 1164196 - RNA, 19 nt, Homo sapiens
ggacagccggagucagucu

SEQ ID NO: 1164197 - RNA, 19 nt, Homo sapiens
gcaagacccuguaugaaua

SEQ ID NO: 1164198 - RNA, 19 nt, Homo sapiens
ccacaaagcuacaaacuga

SEQ ID NO: 1164199 - RNA, 19 nt, Homo sapiens
ccaaguagcuggguuuaua

SEQ ID NO: 1164200 - RNA, 19 nt, Homo sapiens
uaacaagacucagugcuua

SEQ ID NO: 1164201 - RNA, 19 nt, Homo sapiens
ccaaagauguaccgaagua

SEQ ID NO: 1164202 - RNA, 19 nt, Homo sapiens
gaucaucucuacuucugua

SEQ ID NO: 1164203 - RNA, 19 nt, Homo sapiens
ggacagagaugggauuugu

SEQ ID NO: 1164204 - RNA, 19 nt, Homo sapiens
gagguaacuugacuauaua

SEQ ID NO: 1164205 - RNA, 19 nt, Homo sapiens
agagguaacuugacuauau

SEQ ID NO: 1164206 - RNA, 19 nt, Homo sapiens
gaugggauuuguuguauga

SEQ ID NO: 1164207 - RNA, 19 nt, Homo sapiens
auagagggcugcuguauuu

SEQ ID NO: 1164208 - RNA, 19 nt, Homo sapiens
gaacuuagagcucuucaau

SEQ ID NO: 1164209 - RNA, 19 nt, Homo sapiens
gaauaguaccaaagcauua

SEQ ID NO: 1164210 - RNA, 19 nt, Homo sapiens
guugugggaucaucuauaa

SEQ ID NO: 1164211 - RNA, 19 nt, Homo sapiens
aaacuggaaucauguggua

SEQ ID NO: 1164212 - RNA, 19 nt, Homo sapiens
gaccaugacucccaccaaa

SEQ ID NO: 1164213 - RNA, 19 nt, Homo sapiens
gagauauccugaacuuaga

SEQ ID NO: 1164214 - RNA, 19 nt, Homo sapiens
uaagauggcuggcuacucu

SEQ ID NO: 1164215 - RNA, 19 nt, Homo sapiens
gagaugggauuuguuguau

SEQ ID NO: 1164216 - RNA, 19 nt, Homo sapiens
gggauuuguuguaugauaa

SEQ ID NO: 1164217 - RNA, 19 nt, Homo sapiens
caucucuacuucuguauuu

SEQ ID NO: 1164218 - RNA, 19 nt, Homo sapiens
gacaauuucuagaguaguu

SEQ ID NO: 1164219 - RNA, 19 nt, Homo sapiens
caccagacccggcuaauuu

SEQ ID NO: 1164220 - RNA, 19 nt, Homo sapiens
ugacuucugugacuucauu

SEQ ID NO: 1164221 - RNA, 19 nt, Homo sapiens
gaaaagagguuuguguuca

SEQ ID NO: 1164222 - RNA, 19 nt, Homo sapiens
ggaaauggcaagucuuuag

SEQ ID NO: 1164223 - RNA, 19 nt, Homo sapiens
uuagagcucuucaauccua

SEQ ID NO: 1164224 - RNA, 19 nt, Homo sapiens
gugccucccuucauauuaa

SEQ ID NO: 1164225 - RNA, 19 nt, Homo sapiens
caaauaccuuggaggagaa

SEQ ID NO: 1164226 - RNA, 19 nt, Homo sapiens
uaacuuggauaccugcuau

SEQ ID NO: 1164227 - RNA, 19 nt, Homo sapiens
gcugaaugcugcuguaaag

SEQ ID NO: 1164228 - RNA, 19 nt, Homo sapiens
guagagaacacacucgauu

SEQ ID NO: 1164229 - RNA, 19 nt, Homo sapiens
gaaaccaggacgagaaguu

SEQ ID NO: 1164230 - RNA, 19 nt, Homo sapiens
uaauauggaucaucucuac

SEQ ID NO: 1164231 - RNA, 19 nt, Homo sapiens
uagaauggguguuugacuu

SEQ ID NO: 1164232 - RNA, 19 nt, Homo sapiens
gacaguaaacgcuaugaaa

SEQ ID NO: 1164233 - RNA, 19 nt, Homo sapiens
cuaaauauacagagaggua

SEQ ID NO: 1164234 - RNA, 19 nt, Homo sapiens
gccagugucuagcuuacua

SEQ ID NO: 1164235 - RNA, 19 nt, Homo sapiens
acauuugccugccuuguaa

SEQ ID NO: 1164236 - RNA, 19 nt, Homo sapiens
caaagaucccugucucuga

SEQ ID NO: 1164237 - RNA, 19 nt, Homo sapiens
aaagauguaccgaaguaua

SEQ ID NO: 1164238 - RNA, 19 nt, Homo sapiens
uagagaacacacucgauua

SEQ ID NO: 1164239 - RNA, 19 nt, Homo sapiens
uggcaagucuuuaggauag

SEQ ID NO: 1164240 - RNA, 19 nt, Homo sapiens
ccuguacuacugauuauua

SEQ ID NO: 1164241 - RNA, 19 nt, Homo sapiens
gcuacaaacugacccucuu

SEQ ID NO: 1164242 - RNA, 19 nt, Homo sapiens
ugacacacaucucuucaag

SEQ ID NO: 1164243 - RNA, 19 nt, Homo sapiens
ucagaugacggcucagaua

SEQ ID NO: 1164244 - RNA, 19 nt, Homo sapiens
guaaacugcagaaggaauu

SEQ ID NO: 1164245 - RNA, 19 nt, Homo sapiens
gaaguugccagcaggauca

SEQ ID NO: 1164246 - RNA, 19 nt, Homo sapiens
ggaaaagcauugccaguuc

SEQ ID NO: 1164247 - RNA, 19 nt, Homo sapiens
ggcaagacccuguaugaau

SEQ ID NO: 1164248 - RNA, 19 nt, Homo sapiens
gaacuugccccuagaggua

SEQ ID NO: 1164249 - RNA, 19 nt, Homo sapiens
gagcuaaguccuccaguuc

SEQ ID NO: 1164250 - RNA, 19 nt, Homo sapiens
gagaacacacucgauuaaa

SEQ ID NO: 1164251 - RNA, 19 nt, Homo sapiens
aaagacagaagauauguug

SEQ ID NO: 1164252 - RNA, 19 nt, Homo sapiens
gaaaccaaagaaagugaaa

SEQ ID NO: 1164253 - RNA, 19 nt, Homo sapiens
aaagaucccugucucugau

SEQ ID NO: 1164254 - RNA, 19 nt, Homo sapiens
ggacagcuaauugaccuaa

SEQ ID NO: 1164255 - RNA, 19 nt, Homo sapiens
ugagauauccugaacuuag

SEQ ID NO: 1164256 - RNA, 19 nt, Homo sapiens
ggagugcaguggcgugauc

SEQ ID NO: 1164257 - RNA, 19 nt, Homo sapiens
gaaggaauuuaaacgucau

SEQ ID NO: 1164258 - RNA, 19 nt, Homo sapiens
ccaagcuucugaugauuca

SEQ ID NO: 1164259 - RNA, 19 nt, Homo sapiens
gcaaccagaucaguaaacu

SEQ ID NO: 1164260 - RNA, 19 nt, Homo sapiens
aaagcaaccagaucaguaa

SEQ ID NO: 1164261 - RNA, 19 nt, Homo sapiens
ccuguaggauguacuguau

SEQ ID NO: 1164262 - RNA, 19 nt, Homo sapiens
agagaacacacucgauuaa

SEQ ID NO: 1164263 - RNA, 19 nt, Homo sapiens
ugggauuuguuguaugaua

SEQ ID NO: 1164264 - RNA, 19 nt, Homo sapiens
cagcucaaucuccuuguua

SEQ ID NO: 1164265 - RNA, 19 nt, Homo sapiens
ccaccucucuuugccugua

SEQ ID NO: 1164266 - RNA, 19 nt, Homo sapiens
uuacuucaguugaccuuug

SEQ ID NO: 1164267 - RNA, 19 nt, Homo sapiens
uuucagcucuggauuacuu

SEQ ID NO: 1164268 - RNA, 19 nt, Homo sapiens
aggcacaacuuccugaaug

SEQ ID NO: 1164269 - RNA, 19 nt, Homo sapiens
uuacaugacuucugugacu

SEQ ID NO: 1164270 - RNA, 19 nt, Homo sapiens
acaccuguacuacugauua

SEQ ID NO: 1164271 - RNA, 19 nt, Homo sapiens
ugucauaacucaguaacau

SEQ ID NO: 1164272 - RNA, 19 nt, Homo sapiens
agagauggcuucugguucu

SEQ ID NO: 1164273 - RNA, 19 nt, Homo sapiens
caaucuccuuguuacagua

SEQ ID NO: 1164274 - RNA, 19 nt, Homo sapiens
agacuacauugaaaccaaa

SEQ ID NO: 1164275 - RNA, 19 nt, Homo sapiens
gaaaagcauugccaguuca

SEQ ID NO: 1164276 - RNA, 19 nt, Homo sapiens
cuaauugaccuaagacuuc

SEQ ID NO: 1164277 - RNA, 19 nt, Homo sapiens
gcugaguguguaaauauaa

SEQ ID NO: 1164278 - RNA, 19 nt, Homo sapiens
ugaaaagccucucacuuga

SEQ ID NO: 1164279 - RNA, 19 nt, Homo sapiens
ccuccugaguuauuugaaa

SEQ ID NO: 1164280 - RNA, 19 nt, Homo sapiens
ucuuugaggugaauuacaa

SEQ ID NO: 1164281 - RNA, 19 nt, Homo sapiens
gagauggcuucugguucua

SEQ ID NO: 1164282 - RNA, 19 nt, Homo sapiens
gcagaaggaauuuaaacgu

SEQ ID NO: 1164283 - RNA, 19 nt, Homo sapiens
caaagaaagugaaaacucu

SEQ ID NO: 1164284 - RNA, 19 nt, Homo sapiens
uguaggauguacuguaugu

SEQ ID NO: 1164285 - RNA, 19 nt, Homo sapiens
caagacucagugcuuauuu

SEQ ID NO: 1164286 - RNA, 19 nt, Homo sapiens
gaauggguguuugacuugu

SEQ ID NO: 1164287 - RNA, 19 nt, Homo sapiens
agagaugggauuuguugua

SEQ ID NO: 1164288 - RNA, 19 nt, Homo sapiens
gaaugaaacuaggggaauu

SEQ ID NO: 1164289 - RNA, 19 nt, Homo sapiens
aaagcugaaugcugcugua

SEQ ID NO: 1164290 - RNA, 19 nt, Homo sapiens
uuaagaugcugaguauuuc

SEQ ID NO: 1164291 - RNA, 19 nt, Homo sapiens
gaagaaaagauguuugguu

SEQ ID NO: 1164292 - RNA, 19 nt, Homo sapiens
uuaucauccuccugaguua

SEQ ID NO: 1164293 - RNA, 19 nt, Homo sapiens
ggaguaagccaccuuuuau

SEQ ID NO: 1164294 - RNA, 19 nt, Homo sapiens
ugaauaguaccaaagcauu

SEQ ID NO: 1164295 - RNA, 19 nt, Homo sapiens
auacagagagguaacuuga

SEQ ID NO: 1164296 - RNA, 19 nt, Homo sapiens
gcugaguauuucauaggaa

SEQ ID NO: 1164297 - RNA, 19 nt, Homo sapiens
guacguagcuugccacuca

SEQ ID NO: 1164298 - RNA, 19 nt, Homo sapiens
gguaaucgguacuacuuua

SEQ ID NO: 1164299 - RNA, 19 nt, Homo sapiens
cagaagcacucgcucuuua

SEQ ID NO: 1164300 - RNA, 19 nt, Homo sapiens
ggaaccaacugacauucua

SEQ ID NO: 1164301 - RNA, 19 nt, Homo sapiens
ggacuuaaccgaaauggaa

SEQ ID NO: 1164302 - RNA, 19 nt, Homo sapiens
aagcaaaugugucaacuaa

SEQ ID NO: 1164303 - RNA, 19 nt, Homo sapiens
gcaaaugugucaacuaaaa

SEQ ID NO: 1164304 - RNA, 19 nt, Homo sapiens
gacauucuaucguguugua

SEQ ID NO: 1164305 - RNA, 19 nt, Homo sapiens
gaugaaggguuccacuguu

SEQ ID NO: 1164306 - RNA, 19 nt, Homo sapiens
gagaucggcuucggcaauu

SEQ ID NO: 1164307 - RNA, 19 nt, Homo sapiens
gcauucagccugugccuuu

SEQ ID NO: 1164308 - RNA, 19 nt, Homo sapiens
caccuuuccuggacuauaa

SEQ ID NO: 1164309 - RNA, 19 nt, Homo sapiens
gaaauggaaccaacugaca

SEQ ID NO: 1164310 - RNA, 19 nt, Homo sapiens
ccucagccaucgcgaguuu

SEQ ID NO: 1164311 - RNA, 19 nt, Homo sapiens
ggcccugugugaaguauuu

SEQ ID NO: 1164312 - RNA, 19 nt, Homo sapiens
uaacauuggcccuguguga

SEQ ID NO: 1164313 - RNA, 19 nt, Homo sapiens
ucucauuccucaaagcuuu

SEQ ID NO: 1164314 - RNA, 19 nt, Homo sapiens
uaauccagauguagacuau

SEQ ID NO: 1164315 - RNA, 19 nt, Homo sapiens
aagccaacauccucacuaa

SEQ ID NO: 1164316 - RNA, 19 nt, Homo sapiens
gcagcgagaacacugaauu

SEQ ID NO: 1164317 - RNA, 19 nt, Homo sapiens
gggccugcauucuauguug

SEQ ID NO: 1164318 - RNA, 19 nt, Homo sapiens
ggguuccacuguuguugua

SEQ ID NO: 1164319 - RNA, 19 nt, Homo sapiens
cgacaccuuuccuggacua

SEQ ID NO: 1164320 - RNA, 19 nt, Homo sapiens
uguauaagcuggcauuucg

SEQ ID NO: 1164321 - RNA, 19 nt, Homo sapiens
gcgauuccauugugauaag

SEQ ID NO: 1164322 - RNA, 19 nt, Homo sapiens
ggagaucggcuucggcaau

SEQ ID NO: 1164323 - RNA, 19 nt, Homo sapiens
caucucacccucucucauu

SEQ ID NO: 1164324 - RNA, 19 nt, Homo sapiens
gcuaggauugcaucaguuu

SEQ ID NO: 1164325 - RNA, 19 nt, Homo sapiens
gaaccaacugacauucuau

SEQ ID NO: 1164326 - RNA, 19 nt, Homo sapiens
gcacgugcauuccggucau

SEQ ID NO: 1164327 - RNA, 19 nt, Homo sapiens
gccaacauccucacuaaca

SEQ ID NO: 1164328 - RNA, 19 nt, Homo sapiens
gaaggguuccacuguuguu

SEQ ID NO: 1164329 - RNA, 19 nt, Homo sapiens
guacagccacuacgugcuu

SEQ ID NO: 1164330 - RNA, 19 nt, Homo sapiens
aaacuucagcgauuccauu

SEQ ID NO: 1164331 - RNA, 19 nt, Homo sapiens
caacauccucacuaacaga

SEQ ID NO: 1164332 - RNA, 19 nt, Homo sapiens
acacugugcucucgaaacu

SEQ ID NO: 1164333 - RNA, 19 nt, Homo sapiens
cuucagcgauuccauugug

SEQ ID NO: 1164334 - RNA, 19 nt, Homo sapiens
gcgcuggguugccacacuu

SEQ ID NO: 1164335 - RNA, 19 nt, Homo sapiens
ggacauguacagccacuac

SEQ ID NO: 1164336 - RNA, 19 nt, Homo sapiens
cagcgauuccauugugaua

SEQ ID NO: 1164337 - RNA, 19 nt, Homo sapiens
ccacuguuguuguaugucu

SEQ ID NO: 1164338 - RNA, 19 nt, Homo sapiens
ugugaaguauuucgaaucu

SEQ ID NO: 1164339 - RNA, 19 nt, Homo sapiens
guaaucgguacuacuuuau

SEQ ID NO: 1164340 - RNA, 19 nt, Homo sapiens
ccagaagcacucgcucuuu

SEQ ID NO: 1164341 - RNA, 19 nt, Homo sapiens
cgguacuacuuuauuaaug

SEQ ID NO: 1164342 - RNA, 19 nt, Homo sapiens
gcccaggcguugcuaggau

SEQ ID NO: 1164343 - RNA, 19 nt, Homo sapiens
gcgaagaagaccuggaaca

SEQ ID NO: 1164344 - RNA, 19 nt, Homo sapiens
ccagauguagacuauauuc

SEQ ID NO: 1164345 - RNA, 19 nt, Homo sapiens
gcauuucgccagcuuguac

SEQ ID NO: 1164346 - RNA, 19 nt, Homo sapiens
agaagcacucgcucuuuaa

SEQ ID NO: 1164347 - RNA, 19 nt, Homo sapiens
auccagauguagacuauau

SEQ ID NO: 1164348 - RNA, 19 nt, Homo sapiens
cagcgagaacacugaauug

SEQ ID NO: 1164349 - RNA, 19 nt, Homo sapiens
cauccucacuaacagauac

SEQ ID NO: 1164350 - RNA, 19 nt, Homo sapiens
ccaacgagcaggagagucu

SEQ ID NO: 1164351 - RNA, 19 nt, Homo sapiens
augaaggguuccacuguug

SEQ ID NO: 1164352 - RNA, 19 nt, Homo sapiens
uuuccuguuugcacuauuu

SEQ ID NO: 1164353 - RNA, 19 nt, Homo sapiens
ggguccagcugcuccaauc

SEQ ID NO: 1164354 - RNA, 19 nt, Homo sapiens
ccaccaugaugcaaaucug

SEQ ID NO: 1164355 - RNA, 19 nt, Homo sapiens
guuccacuguuguuguaug

SEQ ID NO: 1164356 - RNA, 19 nt, Homo sapiens
gugauaagcgcacaaacag

SEQ ID NO: 1164357 - RNA, 19 nt, Homo sapiens
ccaacauccucacuaacag

SEQ ID NO: 1164358 - RNA, 19 nt, Homo sapiens
uuccuggacuauaaauuga

SEQ ID NO: 1164359 - RNA, 19 nt, Homo sapiens
caaccaaggcacgugcauu

SEQ ID NO: 1164360 - RNA, 19 nt, Homo sapiens
acugugcucucgaaacuca

SEQ ID NO: 1164361 - RNA, 19 nt, Homo sapiens
gccacuacgugcuucucaa

SEQ ID NO: 1164362 - RNA, 19 nt, Homo sapiens
gaagcacucgcucuuuaac

SEQ ID NO: 1164363 - RNA, 19 nt, Homo sapiens
aaagcaaaugugucaacua

SEQ ID NO: 1164364 - RNA, 19 nt, Homo sapiens
ucaaguccauccgcaacga

SEQ ID NO: 1164365 - RNA, 19 nt, Homo sapiens
cggcgaagaagaccuggaa

SEQ ID NO: 1164366 - RNA, 19 nt, Homo sapiens
aaagccaacauccucacua

SEQ ID NO: 1164367 - RNA, 19 nt, Homo sapiens
uguuguacauagaaugaug

SEQ ID NO: 1164368 - RNA, 19 nt, Homo sapiens
ugugugaaguauuucgaau

SEQ ID NO: 1164369 - RNA, 19 nt, Homo sapiens
uugcuaggauugcaucagu

SEQ ID NO: 1164370 - RNA, 19 nt, Homo sapiens
cccaggcguugcuaggauu

SEQ ID NO: 1164371 - RNA, 19 nt, Homo sapiens
uuuccuggacuauaaauug

SEQ ID NO: 1164372 - RNA, 19 nt, Homo sapiens
ggccacgugugagagagaa

SEQ ID NO: 1164373 - RNA, 19 nt, Homo sapiens
cgaagaagaccuggaacag

SEQ ID NO: 1164374 - RNA, 19 nt, Homo sapiens
cguguuguacauagaauga

SEQ ID NO: 1164375 - RNA, 19 nt, Homo sapiens
ccuccuugcucugaaacuu

SEQ ID NO: 1164376 - RNA, 19 nt, Homo sapiens
gcucuuuaacgccaugaau

SEQ ID NO: 1164377 - RNA, 19 nt, Homo sapiens
cggccaccaugaugcaaau

SEQ ID NO: 1164378 - RNA, 19 nt, Homo sapiens
aaccaaggcacgugcauuc

SEQ ID NO: 1164379 - RNA, 19 nt, Homo sapiens
ugaugaaggguuccacugu

SEQ ID NO: 1164380 - RNA, 19 nt, Homo sapiens
ucacuaacagauacaagca

SEQ ID NO: 1164381 - RNA, 19 nt, Homo sapiens
gaaggaagauuguaacaua

SEQ ID NO: 1164382 - RNA, 19 nt, Homo sapiens
gaaaggagauucauguuuu

SEQ ID NO: 1164383 - RNA, 19 nt, Homo sapiens
gaauguggaucacgagguu

SEQ ID NO: 1164384 - RNA, 19 nt, Homo sapiens
cugguaaacuggaauauaa

SEQ ID NO: 1164385 - RNA, 19 nt, Homo sapiens
gggaauguuuguucauaaa

SEQ ID NO: 1164386 - RNA, 19 nt, Homo sapiens
ggaggaaauucaucguuug

SEQ ID NO: 1164387 - RNA, 19 nt, Homo sapiens
ucaggaaucugguuaggaa

SEQ ID NO: 1164388 - RNA, 19 nt, Homo sapiens
caagcaaacugaagaccaa

SEQ ID NO: 1164389 - RNA, 19 nt, Homo sapiens
gaccaacuccuaugagaaa

SEQ ID NO: 1164390 - RNA, 19 nt, Homo sapiens
gaaaguuaagcgugaaauu

SEQ ID NO: 1164391 - RNA, 19 nt, Homo sapiens
ggaaucugguuaggaauug

SEQ ID NO: 1164392 - RNA, 19 nt, Homo sapiens
caacuccuaugagaaauau

SEQ ID NO: 1164393 - RNA, 19 nt, Homo sapiens
gcagagaggcagcaaugaa

SEQ ID NO: 1164394 - RNA, 19 nt, Homo sapiens
gguaggaacucuuaaagcu

SEQ ID NO: 1164395 - RNA, 19 nt, Homo sapiens
gcaacaagcaaacugaaga

SEQ ID NO: 1164396 - RNA, 19 nt, Homo sapiens
gcaagauuaaugugguuua

SEQ ID NO: 1164397 - RNA, 19 nt, Homo sapiens
cgaaaggagauucauguuu

SEQ ID NO: 1164398 - RNA, 19 nt, Homo sapiens
aaacgaaggaagauuguaa

SEQ ID NO: 1164399 - RNA, 19 nt, Homo sapiens
caaccucuuugaagcauug

SEQ ID NO: 1164400 - RNA, 19 nt, Homo sapiens
uaaaugugccaaccucuuu

SEQ ID NO: 1164401 - RNA, 19 nt, Homo sapiens
uggaggaaauucaucguuu

SEQ ID NO: 1164402 - RNA, 19 nt, Homo sapiens
gcauugguaggaacucuua

SEQ ID NO: 1164403 - RNA, 19 nt, Homo sapiens
aaaugcugauggaaaguua

SEQ ID NO: 1164404 - RNA, 19 nt, Homo sapiens
gggcagggaugggaauguu

SEQ ID NO: 1164405 - RNA, 19 nt, Homo sapiens
gaaagcaacaagcaaacug

SEQ ID NO: 1164406 - RNA, 19 nt, Homo sapiens
ggaugggaauguuuguuca

SEQ ID NO: 1164407 - RNA, 19 nt, Homo sapiens
ccucuuccgugaugauaaa

SEQ ID NO: 1164408 - RNA, 19 nt, Homo sapiens
ggagauucauguuuuagaa

SEQ ID NO: 1164409 - RNA, 19 nt, Homo sapiens
gcgcagagaggcagcaaug

SEQ ID NO: 1164410 - RNA, 19 nt, Homo sapiens
gcagggaugggaauguuug

SEQ ID NO: 1164411 - RNA, 19 nt, Homo sapiens
ugggaauguuuguucauaa

SEQ ID NO: 1164412 - RNA, 19 nt, Homo sapiens
uauuugacauucugcgaaa

SEQ ID NO: 1164413 - RNA, 19 nt, Homo sapiens
gcaaaacgaaggaagauug

SEQ ID NO: 1164414 - RNA, 19 nt, Homo sapiens
ccaacuccuaugagaaaua

SEQ ID NO: 1164415 - RNA, 19 nt, Homo sapiens
aagaccaacuccuaugaga

SEQ ID NO: 1164416 - RNA, 19 nt, Homo sapiens
ugaagaccaacuccuauga

SEQ ID NO: 1164417 - RNA, 19 nt, Homo sapiens
caagauuaaugugguuuac

SEQ ID NO: 1164418 - RNA, 19 nt, Homo sapiens
ggaagauuguaacauaucc

SEQ ID NO: 1164419 - RNA, 19 nt, Homo sapiens
gagaggcagcaaugaaugu

SEQ ID NO: 1164420 - RNA, 19 nt, Homo sapiens
cagagaggcagcaaugaau

SEQ ID NO: 1164421 - RNA, 19 nt, Homo sapiens
gggaugggaauguuuguuc

SEQ ID NO: 1164422 - RNA, 19 nt, Homo sapiens
guaaacgaaaggagauuca

SEQ ID NO: 1164423 - RNA, 19 nt, Homo sapiens
gaagaccaacuccuaugag

SEQ ID NO: 1164424 - RNA, 19 nt, Homo sapiens
aaguuaagcgugaaauuug

SEQ ID NO: 1164425 - RNA, 19 nt, Homo sapiens
aaacgaaaggagauucaug

SEQ ID NO: 1164426 - RNA, 19 nt, Homo sapiens
aaagcaacaagcaaacuga

SEQ ID NO: 1164427 - RNA, 19 nt, Homo sapiens
gguaaacuggaauauaaag

SEQ ID NO: 1164428 - RNA, 19 nt, Homo sapiens
augggaauguuuguucaua

SEQ ID NO: 1164429 - RNA, 19 nt, Homo sapiens
ggaaaguuaagcgugaaau

SEQ ID NO: 1164430 - RNA, 19 nt, Homo sapiens
gaggaaauucaucguuugg

SEQ ID NO: 1164431 - RNA, 19 nt, Homo sapiens
gaacucuuaaagcugcaaa

SEQ ID NO: 1164432 - RNA, 19 nt, Homo sapiens
ucugguaaacuggaauaua

SEQ ID NO: 1164433 - RNA, 19 nt, Homo sapiens
cagcaaugaauguggauca

SEQ ID NO: 1164434 - RNA, 19 nt, Homo sapiens
gcaaacugaagaccaacuc

SEQ ID NO: 1164435 - RNA, 19 nt, Homo sapiens
ucugcaagguguucaugau

SEQ ID NO: 1164436 - RNA, 19 nt, Homo sapiens
cuuccgugaugauaaaugu

SEQ ID NO: 1164437 - RNA, 19 nt, Homo sapiens
cugcaagauuaaugugguu

SEQ ID NO: 1164438 - RNA, 19 nt, Homo sapiens
ucuuaaagcugcaaaacga

SEQ ID NO: 1164439 - RNA, 19 nt, Homo sapiens
ccucuuugaagcauuggua

SEQ ID NO: 1164440 - RNA, 19 nt, Homo sapiens
gccaaccucuuugaagcau

SEQ ID NO: 1164441 - RNA, 19 nt, Homo sapiens
caacaagcaaacugaagac

SEQ ID NO: 1164442 - RNA, 19 nt, Homo sapiens
ggagagcacuaauaagaua

SEQ ID NO: 1164443 - RNA, 19 nt, Homo sapiens
caacgaaacucuguucuug

SEQ ID NO: 1164444 - RNA, 19 nt, Homo sapiens
gcacugauauuugucauug

SEQ ID NO: 1164445 - RNA, 19 nt, Homo sapiens
ggacacauaccauugauuu

SEQ ID NO: 1164446 - RNA, 19 nt, Homo sapiens
gaaaagggcuaauugacua

SEQ ID NO: 1164447 - RNA, 19 nt, Homo sapiens
aaucagaccuuauccauga

SEQ ID NO: 1164448 - RNA, 19 nt, Homo sapiens
gcucugcugugauaugaua

SEQ ID NO: 1164449 - RNA, 19 nt, Homo sapiens
uagcaaaguuguucagaaa

SEQ ID NO: 1164450 - RNA, 19 nt, Homo sapiens
uaugagcucugcugugaua

SEQ ID NO: 1164451 - RNA, 19 nt, Homo sapiens
uaaaagaggugacaaaguu

SEQ ID NO: 1164452 - RNA, 19 nt, Homo sapiens
auacaaccgugcuuuauuu

SEQ ID NO: 1164453 - RNA, 19 nt, Homo sapiens
uaaaguggauggucuguca

SEQ ID NO: 1164454 - RNA, 19 nt, Homo sapiens
gaacaggagcacugauauu

SEQ ID NO: 1164455 - RNA, 19 nt, Homo sapiens
ugauagaugugguuauuga

SEQ ID NO: 1164456 - RNA, 19 nt, Homo sapiens
caacagcuccuuugucaau

SEQ ID NO: 1164457 - RNA, 19 nt, Homo sapiens
ucccaacucuggagaauuu

SEQ ID NO: 1164458 - RNA, 19 nt, Homo sapiens
gaaggccauucaugaaguu

SEQ ID NO: 1164459 - RNA, 19 nt, Homo sapiens
ggaaggccauucaugaagu

SEQ ID NO: 1164460 - RNA, 19 nt, Homo sapiens
ggaauccacagccaucaua

SEQ ID NO: 1164461 - RNA, 19 nt, Homo sapiens
agaaucggcugcagaagaa

SEQ ID NO: 1164462 - RNA, 19 nt, Homo sapiens
caagucgucuauucagaaa

SEQ ID NO: 1164463 - RNA, 19 nt, Homo sapiens
gagcucugcugugauauga

SEQ ID NO: 1164464 - RNA, 19 nt, Homo sapiens
ccuaugagcucugcuguga

SEQ ID NO: 1164465 - RNA, 19 nt, Homo sapiens
gaaaucagaccuuauccau

SEQ ID NO: 1164466 - RNA, 19 nt, Homo sapiens
gcugugauaugauagaugu

SEQ ID NO: 1164467 - RNA, 19 nt, Homo sapiens
ggacuucccaggacagauu

SEQ ID NO: 1164468 - RNA, 19 nt, Homo sapiens
caaaaugucucccaacgaa

SEQ ID NO: 1164469 - RNA, 19 nt, Homo sapiens
caggagcacugauauuugu

SEQ ID NO: 1164470 - RNA, 19 nt, Homo sapiens
gggaacaggagcacugaua

SEQ ID NO: 1164471 - RNA, 19 nt, Homo sapiens
gcaagucgucuauucagaa

SEQ ID NO: 1164472 - RNA, 19 nt, Homo sapiens
ugacaagcauauaugauca

SEQ ID NO: 1164473 - RNA, 19 nt, Homo sapiens
uauuugauguggucaguaa

SEQ ID NO: 1164474 - RNA, 19 nt, Homo sapiens
gaccagggccuacaaagug

SEQ ID NO: 1164475 - RNA, 19 nt, Homo sapiens
ggagggaguucuggacuuc

SEQ ID NO: 1164476 - RNA, 19 nt, Homo sapiens
ccuugcagaugcuggauua

SEQ ID NO: 1164477 - RNA, 19 nt, Homo sapiens
caaagugaauacugacauc

SEQ ID NO: 1164478 - RNA, 19 nt, Homo sapiens
agaauuugcugaacaucuu

SEQ ID NO: 1164479 - RNA, 19 nt, Homo sapiens
ccuacaaagugaauacuga

SEQ ID NO: 1164480 - RNA, 19 nt, Homo sapiens
gaaagaaaagggcuaauug

SEQ ID NO: 1164481 - RNA, 19 nt, Homo sapiens
gaaacugauuccacaacuc

SEQ ID NO: 1164482 - RNA, 19 nt, Homo sapiens
uccaacagcuccuuuguca

SEQ ID NO: 1164483 - RNA, 19 nt, Homo sapiens
gauaugauagaugugguua

SEQ ID NO: 1164484 - RNA, 19 nt, Homo sapiens
ggaacaggagcacugauau

SEQ ID NO: 1164485 - RNA, 19 nt, Homo sapiens
ccacagccaucauaaagcu

SEQ ID NO: 1164486 - RNA, 19 nt, Homo sapiens
gcagaugcuggauuagaaa

SEQ ID NO: 1164487 - RNA, 19 nt, Homo sapiens
cacauaccauugauuuguu

SEQ ID NO: 1164488 - RNA, 19 nt, Homo sapiens
gaggugagaaugaaaguag

SEQ ID NO: 1164489 - RNA, 19 nt, Homo sapiens
guuauugacaucucuugua

SEQ ID NO: 1164490 - RNA, 19 nt, Homo sapiens
gcaacccucuugaucuucu

SEQ ID NO: 1164491 - RNA, 19 nt, Homo sapiens
uaggugagguuucaggaau

SEQ ID NO: 1164492 - RNA, 19 nt, Homo sapiens
caacuucgagguguuuauu

SEQ ID NO: 1164493 - RNA, 19 nt, Homo sapiens
ggaagaggaagaaggagau

SEQ ID NO: 1164494 - RNA, 19 nt, Homo sapiens
cagaaucggcugcagaaga

SEQ ID NO: 1164495 - RNA, 19 nt, Homo sapiens
cugaacaucuuuaucucaa

SEQ ID NO: 1164496 - RNA, 19 nt, Homo sapiens
ugucagagaggaaagcuuu

SEQ ID NO: 1164497 - RNA, 19 nt, Homo sapiens
gaauccacagccaucauaa

SEQ ID NO: 1164498 - RNA, 19 nt, Homo sapiens
uuuauggucucaaagaaga

SEQ ID NO: 1164499 - RNA, 19 nt, Homo sapiens
guauuuauggucucaaaga

SEQ ID NO: 1164500 - RNA, 19 nt, Homo sapiens
acgaaacucuguucuugga

SEQ ID NO: 1164501 - RNA, 19 nt, Homo sapiens
guacuccgguggauaugca

SEQ ID NO: 1164502 - RNA, 19 nt, Homo sapiens
acagcuccuuugucaauuu

SEQ ID NO: 1164503 - RNA, 19 nt, Homo sapiens
agaaggagauugggacaca

SEQ ID NO: 1164504 - RNA, 19 nt, Homo sapiens
cuagagugcugcuguaggu

SEQ ID NO: 1164505 - RNA, 19 nt, Homo sapiens
gaagugaagccgagaaucc

SEQ ID NO: 1164506 - RNA, 19 nt, Homo sapiens
ggugagaaugaaaguagua

SEQ ID NO: 1164507 - RNA, 19 nt, Homo sapiens
gauaguacuccgguggaua

SEQ ID NO: 1164508 - RNA, 19 nt, Homo sapiens
uuagcaaaguuguucagaa

SEQ ID NO: 1164509 - RNA, 19 nt, Homo sapiens
ggcaagucgucuauucaga

SEQ ID NO: 1164510 - RNA, 19 nt, Homo sapiens
aaaggaagaggaagaagga

SEQ ID NO: 1164511 - RNA, 19 nt, Homo sapiens
auaauacaaccgugcuuua

SEQ ID NO: 1164512 - RNA, 19 nt, Homo sapiens
ugcagaugcuggauuagaa

SEQ ID NO: 1164513 - RNA, 19 nt, Homo sapiens
acaggaugauuacauggaa

SEQ ID NO: 1164514 - RNA, 19 nt, Homo sapiens
cugcaacccucuugaucuu

SEQ ID NO: 1164515 - RNA, 19 nt, Homo sapiens
gaagaggaagaaggagauu

SEQ ID NO: 1164516 - RNA, 19 nt, Homo sapiens
ucaggaaugucuuuugaaa

SEQ ID NO: 1164517 - RNA, 19 nt, Homo sapiens
gccaucauaaagcuuaaua

SEQ ID NO: 1164518 - RNA, 19 nt, Homo sapiens
gaauuugcugaacaucuuu

SEQ ID NO: 1164519 - RNA, 19 nt, Homo sapiens
uaauacaaccgugcuuuau

SEQ ID NO: 1164520 - RNA, 19 nt, Homo sapiens
uucgagguguuuauucaua

SEQ ID NO: 1164521 - RNA, 19 nt, Homo sapiens
aacaggagcacugauauuu

SEQ ID NO: 1164522 - RNA, 19 nt, Homo sapiens
acacauaccauugauuugu

SEQ ID NO: 1164523 - RNA, 19 nt, Homo sapiens
uuggagagcacuaauaaga

SEQ ID NO: 1164524 - RNA, 19 nt, Homo sapiens
auacugacaucaacuucga

SEQ ID NO: 1164525 - RNA, 19 nt, Homo sapiens
cgguggauaugcaaaccua

SEQ ID NO: 1164526 - RNA, 19 nt, Homo sapiens
gauguggucaguaaaauuu

SEQ ID NO: 1164527 - RNA, 19 nt, Homo sapiens
aaauugaaacccaaagaga

SEQ ID NO: 1164528 - RNA, 19 nt, Homo sapiens
gcugcgccauguugcacua

SEQ ID NO: 1164529 - RNA, 19 nt, Homo sapiens
gauaugccgggaagauguu

SEQ ID NO: 1164530 - RNA, 19 nt, Homo sapiens
ggugagguuucaggaaugu

SEQ ID NO: 1164531 - RNA, 19 nt, Homo sapiens
aguaaaaucucgaaagguu

SEQ ID NO: 1164532 - RNA, 19 nt, Homo sapiens
gcucucguuugcuuuguca

SEQ ID NO: 1164533 - RNA, 19 nt, Homo sapiens
gaauacugacaucaacuuc

SEQ ID NO: 1164534 - RNA, 19 nt, Homo sapiens
uaagauaugccgggaagau

SEQ ID NO: 1164535 - RNA, 19 nt, Homo sapiens
gaagcggcaagucgucuau

SEQ ID NO: 1164536 - RNA, 19 nt, Homo sapiens
gacccuacauuugacuaug

SEQ ID NO: 1164537 - RNA, 19 nt, Homo sapiens
aagggcuaauugacuauaa

SEQ ID NO: 1164538 - RNA, 19 nt, Homo sapiens
uacaaccgugcuuuauuua

SEQ ID NO: 1164539 - RNA, 19 nt, Homo sapiens
acagccaucauaaagcuua

SEQ ID NO: 1164540 - RNA, 19 nt, Homo sapiens
ccaacgaaacucuguucuu

SEQ ID NO: 1164541 - RNA, 19 nt, Homo sapiens
gagaauuugcugaacaucu

SEQ ID NO: 1164542 - RNA, 19 nt, Homo sapiens
aagcugaacuucccaaaua

SEQ ID NO: 1164543 - RNA, 19 nt, Homo sapiens
caacaggccuucuuucaau

SEQ ID NO: 1164544 - RNA, 19 nt, Homo sapiens
gaggaacugucgcugcuua

SEQ ID NO: 1164545 - RNA, 19 nt, Homo sapiens
uauggaaccugcucguuua

SEQ ID NO: 1164546 - RNA, 19 nt, Homo sapiens
gcgcucaucaucucuauua

SEQ ID NO: 1164547 - RNA, 19 nt, Homo sapiens
ggucagggauucucauaca

SEQ ID NO: 1164548 - RNA, 19 nt, Homo sapiens
ggagagaucuaccuuucca

SEQ ID NO: 1164549 - RNA, 19 nt, Homo sapiens
guggagaaguuuauuuaug

SEQ ID NO: 1164550 - RNA, 19 nt, Homo sapiens
caagggaugugauguugga

SEQ ID NO: 1164551 - RNA, 19 nt, Homo sapiens
gaggagcugugagguguuu

SEQ ID NO: 1164552 - RNA, 19 nt, Homo sapiens
caggagagcucaggcuuga

SEQ ID NO: 1164553 - RNA, 19 nt, Homo sapiens
ggguggagaaguuuauuua

SEQ ID NO: 1164554 - RNA, 19 nt, Homo sapiens
ggaaccugcucguuuaugg

SEQ ID NO: 1164555 - RNA, 19 nt, Homo sapiens
gcuccaagauguucaaacu

SEQ ID NO: 1164556 - RNA, 19 nt, Homo sapiens
gguguuuccuccucugauu

SEQ ID NO: 1164557 - RNA, 19 nt, Homo sapiens
gagaaccacccugauguuu

SEQ ID NO: 1164558 - RNA, 19 nt, Homo sapiens
gaaccacccugauguuuuc

SEQ ID NO: 1164559 - RNA, 19 nt, Homo sapiens
gaauccaccuccacaaugc

SEQ ID NO: 1164560 - RNA, 19 nt, Homo sapiens
gaucuaccuuuccauccuu

SEQ ID NO: 1164561 - RNA, 19 nt, Homo sapiens
ccaaauauaaguccuucaa

SEQ ID NO: 1164562 - RNA, 19 nt, Homo sapiens
gcugaacuucccaaauaua

SEQ ID NO: 1164563 - RNA, 19 nt, Homo sapiens
ccuaagugcuucuuuggau

SEQ ID NO: 1164564 - RNA, 19 nt, Homo sapiens
gauaugagaaggccuccaa

SEQ ID NO: 1164565 - RNA, 19 nt, Homo sapiens
gcacagcuggucagggauu

SEQ ID NO: 1164566 - RNA, 19 nt, Homo sapiens
gcaaugcccuaugguggau

SEQ ID NO: 1164567 - RNA, 19 nt, Homo sapiens
ucacuguguucaagaccua

SEQ ID NO: 1164568 - RNA, 19 nt, Homo sapiens
ggagaaguuuauuuaugag

SEQ ID NO: 1164569 - RNA, 19 nt, Homo sapiens
gucaauaaacuucaaggaa

SEQ ID NO: 1164570 - RNA, 19 nt, Homo sapiens
ccaguauccuuaugggaau

SEQ ID NO: 1164571 - RNA, 19 nt, Homo sapiens
ccaacaggccuucuuucaa

SEQ ID NO: 1164572 - RNA, 19 nt, Homo sapiens
agaugaggguggagaaguu

SEQ ID NO: 1164573 - RNA, 19 nt, Homo sapiens
gcaagcugaucauggaacu

SEQ ID NO: 1164574 - RNA, 19 nt, Homo sapiens
ggcucuaggugcaauguga

SEQ ID NO: 1164575 - RNA, 19 nt, Homo sapiens
ggagggagggaucuugguu

SEQ ID NO: 1164576 - RNA, 19 nt, Homo sapiens
gcagcucaguccuccaaag

SEQ ID NO: 1164577 - RNA, 19 nt, Homo sapiens
gcucaucaucucuauuaau

SEQ ID NO: 1164578 - RNA, 19 nt, Homo sapiens
gaaccugcucguuuaugga

SEQ ID NO: 1164579 - RNA, 19 nt, Homo sapiens
cccaagggaugugauguug

SEQ ID NO: 1164580 - RNA, 19 nt, Homo sapiens
cugaacuucccaaauauaa

SEQ ID NO: 1164581 - RNA, 19 nt, Homo sapiens
acucagagcuccccuucua

SEQ ID NO: 1164582 - RNA, 19 nt, Homo sapiens
gacaguauggcucugauca

SEQ ID NO: 1164583 - RNA, 19 nt, Homo sapiens
gaugaggguggagaaguuu

SEQ ID NO: 1164584 - RNA, 19 nt, Homo sapiens
guaacagucaauaaacuuc

SEQ ID NO: 1164585 - RNA, 19 nt, Homo sapiens
caguaacagucaauaaacu

SEQ ID NO: 1164586 - RNA, 19 nt, Homo sapiens
uaugagaaccacccugaug

SEQ ID NO: 1164587 - RNA, 19 nt, Homo sapiens
ggagagcucaggcuugaac

SEQ ID NO: 1164588 - RNA, 19 nt, Homo sapiens
ugaauccaccuccacaaug

SEQ ID NO: 1164589 - RNA, 19 nt, Homo sapiens
gaacugucgcugcuuacca

SEQ ID NO: 1164590 - RNA, 19 nt, Homo sapiens
cuaauaagaagaggaaauc

SEQ ID NO: 1164591 - RNA, 19 nt, Homo sapiens
caccaguaacagucaauaa

SEQ ID NO: 1164592 - RNA, 19 nt, Homo sapiens
ccugcucguuuauggaauu

SEQ ID NO: 1164593 - RNA, 19 nt, Homo sapiens
ccaaacgcaugaccuucca

SEQ ID NO: 1164594 - RNA, 19 nt, Homo sapiens
ugagaaccacccugauguu

SEQ ID NO: 1164595 - RNA, 19 nt, Homo sapiens
gguggagaaguuuauuuau

SEQ ID NO: 1164596 - RNA, 19 nt, Homo sapiens
guuaauccaguauccuuau

SEQ ID NO: 1164597 - RNA, 19 nt, Homo sapiens
gcucguuuauggaauuugc

SEQ ID NO: 1164598 - RNA, 19 nt, Homo sapiens
gacuacaacguggauauug

SEQ ID NO: 1164599 - RNA, 19 nt, Homo sapiens
ccaguaacagucaauaaac

SEQ ID NO: 1164600 - RNA, 19 nt, Homo sapiens
auauggaaccugcucguuu

SEQ ID NO: 1164601 - RNA, 19 nt, Homo sapiens
uuaauccaguauccuuaug

SEQ ID NO: 1164602 - RNA, 19 nt, Homo sapiens
acauaucacuguguucaag

SEQ ID NO: 1164603 - RNA, 19 nt, Homo sapiens
cagcagcucaguccuccaa

SEQ ID NO: 1164604 - RNA, 19 nt, Homo sapiens
ggauucucauacagcaaga

SEQ ID NO: 1164605 - RNA, 19 nt, Homo sapiens
gcaaggagggagggaucuu

SEQ ID NO: 1164606 - RNA, 19 nt, Homo sapiens
ccaccaguaacagucaaua

SEQ ID NO: 1164607 - RNA, 19 nt, Homo sapiens
uuaugggaauggagggaaa

SEQ ID NO: 1164608 - RNA, 19 nt, Homo sapiens
guguucaagaccuauauuu

SEQ ID NO: 1164609 - RNA, 19 nt, Homo sapiens
accaguaacagucaauaaa

SEQ ID NO: 1164610 - RNA, 19 nt, Homo sapiens
ccuaauaagaagaggaaau

SEQ ID NO: 1164611 - RNA, 19 nt, Homo sapiens
ggagaaggaaaacauauca

SEQ ID NO: 1164612 - RNA, 19 nt, Homo sapiens
ccuuccagaugcccaaguu

SEQ ID NO: 1164613 - RNA, 19 nt, Homo sapiens
acgcaugaccuuccagaug

SEQ ID NO: 1164614 - RNA, 19 nt, Homo sapiens
guucaagaccuauauuucc

SEQ ID NO: 1164615 - RNA, 19 nt, Homo sapiens
acaaugccgcucucaggaa

SEQ ID NO: 1164616 - RNA, 19 nt, Homo sapiens
agacuacaacguggauauu

SEQ ID NO: 1164617 - RNA, 19 nt, Homo sapiens
ggacaguauggcucugauc

SEQ ID NO: 1164618 - RNA, 19 nt, Homo sapiens
acagcucaauggaucacuu

SEQ ID NO: 1164619 - RNA, 19 nt, Homo sapiens
gcucuaggugcaaugugaa

SEQ ID NO: 1164620 - RNA, 19 nt, Homo sapiens
uagacuacaacguggauau

SEQ ID NO: 1164621 - RNA, 19 nt, Homo sapiens
gcccuaugguggauaugag

SEQ ID NO: 1164622 - RNA, 19 nt, Homo sapiens
gcucaaaggaucccaguua

SEQ ID NO: 1164623 - RNA, 19 nt, Homo sapiens
gcaaucaaguggagacaga

SEQ ID NO: 1164624 - RNA, 19 nt, Homo sapiens
ccucaugacucacaacaaa

SEQ ID NO: 1164625 - RNA, 19 nt, Homo sapiens
gaaacauccuucugugagu

SEQ ID NO: 1164626 - RNA, 19 nt, Homo sapiens
ggacaugccuuggauucug

SEQ ID NO: 1164627 - RNA, 19 nt, Homo sapiens
ggagggauccaaagaggaa

SEQ ID NO: 1164628 - RNA, 19 nt, Homo sapiens
gaacaagggacaucugaac

SEQ ID NO: 1164629 - RNA, 19 nt, Homo sapiens
gacaugccuuggauucuga

SEQ ID NO: 1164630 - RNA, 19 nt, Homo sapiens
caucuaaugugagaagaga

SEQ ID NO: 1164631 - RNA, 19 nt, Homo sapiens
caaaggaucccaguuaucu

SEQ ID NO: 1164632 - RNA, 19 nt, Homo sapiens
ggaacuauucuuugugguu

SEQ ID NO: 1164633 - RNA, 19 nt, Homo sapiens
caacaugcaggccaucuau

SEQ ID NO: 1164634 - RNA, 19 nt, Homo sapiens
ccaugucccucaccaccua

SEQ ID NO: 1164635 - RNA, 19 nt, Homo sapiens
caagggacaucugaacauc

SEQ ID NO: 1164636 - RNA, 19 nt, Homo sapiens
acgaacaccugucaugguu

SEQ ID NO: 1164637 - RNA, 19 nt, Homo sapiens
cgaaugcggugcuacaacu

SEQ ID NO: 1164638 - RNA, 19 nt, Homo sapiens
agggacaucugaacaucua

SEQ ID NO: 1164639 - RNA, 19 nt, Homo sapiens
gggaacaagggacaucuga

SEQ ID NO: 1164640 - RNA, 19 nt, Homo sapiens
agaucaagcuaccuggaaa

SEQ ID NO: 1164641 - RNA, 19 nt, Homo sapiens
gcugggacaugccuuggau

SEQ ID NO: 1164642 - RNA, 19 nt, Homo sapiens
guacuggugcgcugugcua

SEQ ID NO: 1164643 - RNA, 19 nt, Homo sapiens
ggaacaagggacaucugaa

SEQ ID NO: 1164644 - RNA, 19 nt, Homo sapiens
ggacaucugaacaucuaau

SEQ ID NO: 1164645 - RNA, 19 nt, Homo sapiens
gaggguguacgacgucuug

SEQ ID NO: 1164646 - RNA, 19 nt, Homo sapiens
gaccuugauucaccaacau

SEQ ID NO: 1164647 - RNA, 19 nt, Homo sapiens
cucaaaggaucccaguuau

SEQ ID NO: 1164648 - RNA, 19 nt, Homo sapiens
uaggucagcaccacaacua

SEQ ID NO: 1164649 - RNA, 19 nt, Homo sapiens
gcccaucauugcaaucaag

SEQ ID NO: 1164650 - RNA, 19 nt, Homo sapiens
caagggagcaagggaacaa

SEQ ID NO: 1164651 - RNA, 19 nt, Homo sapiens
gaagggaacaagggagcaa

SEQ ID NO: 1164652 - RNA, 19 nt, Homo sapiens
gggaguaggaguagagaag

SEQ ID NO: 1164653 - RNA, 19 nt, Homo sapiens
ugaccuugauucaccaaca

SEQ ID NO: 1164654 - RNA, 19 nt, Homo sapiens
gggacgaacaccugucaug

SEQ ID NO: 1164655 - RNA, 19 nt, Homo sapiens
ccugguagcccaaguccaa

SEQ ID NO: 1164656 - RNA, 19 nt, Homo sapiens
cagaucaagcuaccuggaa

SEQ ID NO: 1164657 - RNA, 19 nt, Homo sapiens
ucuaaugugagaagagaaa

SEQ ID NO: 1164658 - RNA, 19 nt, Homo sapiens
ggaucccaguuaucugcaa

SEQ ID NO: 1164659 - RNA, 19 nt, Homo sapiens
caccacaacuaccagaacu

SEQ ID NO: 1164660 - RNA, 19 nt, Homo sapiens
cuaccgcccugaccugucu

SEQ ID NO: 1164661 - RNA, 19 nt, Homo sapiens
ugaugcugcugcucacaau

SEQ ID NO: 1164662 - RNA, 19 nt, Homo sapiens
ggugggagacgugacuuau

SEQ ID NO: 1164663 - RNA, 19 nt, Homo sapiens
cccaggagccgaagaccaa

SEQ ID NO: 1164664 - RNA, 19 nt, Homo sapiens
ucaaaggaucccaguuauc

SEQ ID NO: 1164665 - RNA, 19 nt, Homo sapiens
gacgaacaccugucauggu

SEQ ID NO: 1164666 - RNA, 19 nt, Homo sapiens
gagccgaagaccaagaauc

SEQ ID NO: 1164667 - RNA, 19 nt, Homo sapiens
gacaucugaacaucuaaug

SEQ ID NO: 1164668 - RNA, 19 nt, Homo sapiens
ccgaagaccaagaaucauc

SEQ ID NO: 1164669 - RNA, 19 nt, Homo sapiens
gcaccacaacuaccagaac

SEQ ID NO: 1164670 - RNA, 19 nt, Homo sapiens
acaaugggccagggaguug

SEQ ID NO: 1164671 - RNA, 19 nt, Homo sapiens
auccuucugugagucauua

SEQ ID NO: 1164672 - RNA, 19 nt, Homo sapiens
agccgaagaccaagaauca

SEQ ID NO: 1164673 - RNA, 19 nt, Homo sapiens
ccacgaauccuccaugaaa

SEQ ID NO: 1164674 - RNA, 19 nt, Homo sapiens
gggaagaggaggagaaaga

SEQ ID NO: 1164675 - RNA, 19 nt, Homo sapiens
ggaagaggaggagaaagaa

SEQ ID NO: 1164676 - RNA, 19 nt, Homo sapiens
ggccacgaauccuccauga

SEQ ID NO: 1164677 - RNA, 19 nt, Homo sapiens
uaacuucuccuugucauca

SEQ ID NO: 1164678 - RNA, 19 nt, Homo sapiens
gauaacuucuccuugucau

SEQ ID NO: 1164679 - RNA, 19 nt, Homo sapiens
ggauaacuucuccuuguca

SEQ ID NO: 1164680 - RNA, 19 nt, Homo sapiens
gaagaggaggagaaagaag

SEQ ID NO: 1164681 - RNA, 19 nt, Homo sapiens
gcgaggaagaggaggaaga

SEQ ID NO: 1164682 - RNA, 19 nt, Homo sapiens
aagaggaggagaaagaaga

SEQ ID NO: 1164683 - RNA, 19 nt, Homo sapiens
ggaaagaggucugcuguaa

SEQ ID NO: 1164684 - RNA, 19 nt, Homo sapiens
ggauguagaugauuucuuu

SEQ ID NO: 1164685 - RNA, 19 nt, Homo sapiens
gaauuuaucuggcuucaug

SEQ ID NO: 1164686 - RNA, 19 nt, Homo sapiens
gaaauggcaucucgaacaa

SEQ ID NO: 1164687 - RNA, 19 nt, Homo sapiens
gaaaguuggcauacaaaua

SEQ ID NO: 1164688 - RNA, 19 nt, Homo sapiens
gaugaaaguuggcauacaa

SEQ ID NO: 1164689 - RNA, 19 nt, Homo sapiens
gcagaauacuugagaugaa

SEQ ID NO: 1164690 - RNA, 19 nt, Homo sapiens
gaacauuucuuuuggagua

SEQ ID NO: 1164691 - RNA, 19 nt, Homo sapiens
gaagaggaccgcggacuua

SEQ ID NO: 1164692 - RNA, 19 nt, Homo sapiens
caauuaagcaugagacaua

SEQ ID NO: 1164693 - RNA, 19 nt, Homo sapiens
gcaaaugcauuaguauguu

SEQ ID NO: 1164694 - RNA, 19 nt, Homo sapiens
uggaguagcuguaauaaau

SEQ ID NO: 1164695 - RNA, 19 nt, Homo sapiens
gaugaagaccucaaacuuu

SEQ ID NO: 1164696 - RNA, 19 nt, Homo sapiens
cgaaacuucccaacaauua

SEQ ID NO: 1164697 - RNA, 19 nt, Homo sapiens
ggacuuaaagcaauaaaug

SEQ ID NO: 1164698 - RNA, 19 nt, Homo sapiens
gcagaugauuacaauagaa

SEQ ID NO: 1164699 - RNA, 19 nt, Homo sapiens
uaaaggacauacugaccua

SEQ ID NO: 1164700 - RNA, 19 nt, Homo sapiens
caagaagaguugcugcauu

SEQ ID NO: 1164701 - RNA, 19 nt, Homo sapiens
gaagaauucacaaagauga

SEQ ID NO: 1164702 - RNA, 19 nt, Homo sapiens
ggacauuucugaugcucuu

SEQ ID NO: 1164703 - RNA, 19 nt, Homo sapiens
uaaaucagcagauggagua

SEQ ID NO: 1164704 - RNA, 19 nt, Homo sapiens
gaacugcuccucugugugu

SEQ ID NO: 1164705 - RNA, 19 nt, Homo sapiens
uaaaguagccucuauaacu

SEQ ID NO: 1164706 - RNA, 19 nt, Homo sapiens
gaacucaggauucuacaga

SEQ ID NO: 1164707 - RNA, 19 nt, Homo sapiens
gaaagaggucugcuguaaa

SEQ ID NO: 1164708 - RNA, 19 nt, Homo sapiens
guggauagauugguaugua

SEQ ID NO: 1164709 - RNA, 19 nt, Homo sapiens
gcgaguggauagauuggua

SEQ ID NO: 1164710 - RNA, 19 nt, Homo sapiens
gcagauggaguaaucguuu

SEQ ID NO: 1164711 - RNA, 19 nt, Homo sapiens
ucacuaaugucucccuuug

SEQ ID NO: 1164712 - RNA, 19 nt, Homo sapiens
aaagaggucugcuguaaag

SEQ ID NO: 1164713 - RNA, 19 nt, Homo sapiens
ggccgaaacuucccaacaa

SEQ ID NO: 1164714 - RNA, 19 nt, Homo sapiens
gcuaauaaagcacuggaua

SEQ ID NO: 1164715 - RNA, 19 nt, Homo sapiens
ggaugcaucugcuaaaucu

SEQ ID NO: 1164716 - RNA, 19 nt, Homo sapiens
ggaauauaaucaagaugug

SEQ ID NO: 1164717 - RNA, 19 nt, Homo sapiens
ccacucuuauuuaccuuua

SEQ ID NO: 1164718 - RNA, 19 nt, Homo sapiens
ccucaguucucgacucuaa

SEQ ID NO: 1164719 - RNA, 19 nt, Homo sapiens
gcgccuagcucagccaauu

SEQ ID NO: 1164720 - RNA, 19 nt, Homo sapiens
gaacaaaguccaccaaucc

SEQ ID NO: 1164721 - RNA, 19 nt, Homo sapiens
acuggaagcugaauauuug

SEQ ID NO: 1164722 - RNA, 19 nt, Homo sapiens
gaagcuuggugaaggagaa

SEQ ID NO: 1164723 - RNA, 19 nt, Homo sapiens
cauguugucuugccucauu

SEQ ID NO: 1164724 - RNA, 19 nt, Homo sapiens
ccaccaaucccuuuacaaa

SEQ ID NO: 1164725 - RNA, 19 nt, Homo sapiens
gaaggaagaauucacaaag

SEQ ID NO: 1164726 - RNA, 19 nt, Homo sapiens
gaaggagaagggucaauga

SEQ ID NO: 1164727 - RNA, 19 nt, Homo sapiens
cagaauacuugagaugaaa

SEQ ID NO: 1164728 - RNA, 19 nt, Homo sapiens
gcauauaccaccuuaguuc

SEQ ID NO: 1164729 - RNA, 19 nt, Homo sapiens
gcauacaaauaggauacua

SEQ ID NO: 1164730 - RNA, 19 nt, Homo sapiens
gaaauacaggagcagagua

SEQ ID NO: 1164731 - RNA, 19 nt, Homo sapiens
gccuuaaacuuguagacua

SEQ ID NO: 1164732 - RNA, 19 nt, Homo sapiens
ggucacuaguggauuauga

SEQ ID NO: 1164733 - RNA, 19 nt, Homo sapiens
gaguaaaggauguagauga

SEQ ID NO: 1164734 - RNA, 19 nt, Homo sapiens
aagagaaacuugaagacuu

SEQ ID NO: 1164735 - RNA, 19 nt, Homo sapiens
gcgauaacagugauaguuu

SEQ ID NO: 1164736 - RNA, 19 nt, Homo sapiens
acacuccgccuuccuguua

SEQ ID NO: 1164737 - RNA, 19 nt, Homo sapiens
ucaggauucuacagauaua

SEQ ID NO: 1164738 - RNA, 19 nt, Homo sapiens
gaacgaacauuucuuuugg

SEQ ID NO: 1164739 - RNA, 19 nt, Homo sapiens
aagaagaguugcugcauuc

SEQ ID NO: 1164740 - RNA, 19 nt, Homo sapiens
cuacagauauaugcaaguu

SEQ ID NO: 1164741 - RNA, 19 nt, Homo sapiens
ggaacuggaagcugaauau

SEQ ID NO: 1164742 - RNA, 19 nt, Homo sapiens
agaguucauugccaaauuu

SEQ ID NO: 1164743 - RNA, 19 nt, Homo sapiens
gccaguaguuauauuacaa

SEQ ID NO: 1164744 - RNA, 19 nt, Homo sapiens
ccuuaaacuuguagacuaa

SEQ ID NO: 1164745 - RNA, 19 nt, Homo sapiens
gcacgagugucugcugaug

SEQ ID NO: 1164746 - RNA, 19 nt, Homo sapiens
cuaugcagguuauaucauu

SEQ ID NO: 1164747 - RNA, 19 nt, Homo sapiens
ugaagacuaugcagguuau

SEQ ID NO: 1164748 - RNA, 19 nt, Homo sapiens
ugacaguuauuccugaaau

SEQ ID NO: 1164749 - RNA, 19 nt, Homo sapiens
gcagguuagugacaguuau

SEQ ID NO: 1164750 - RNA, 19 nt, Homo sapiens
guaaagcaucuuaaucaga

SEQ ID NO: 1164751 - RNA, 19 nt, Homo sapiens
gaaacuucccaacaauuau

SEQ ID NO: 1164752 - RNA, 19 nt, Homo sapiens
aguaaucguuucaggagua

SEQ ID NO: 1164753 - RNA, 19 nt, Homo sapiens
ggacagaggcagguuagug

SEQ ID NO: 1164754 - RNA, 19 nt, Homo sapiens
cgaacaaaguccaccaauc

SEQ ID NO: 1164755 - RNA, 19 nt, Homo sapiens
caccuuaguucauucaugu

SEQ ID NO: 1164756 - RNA, 19 nt, Homo sapiens
cuaauaaagcacuggauaa

SEQ ID NO: 1164757 - RNA, 19 nt, Homo sapiens
aaauuuccaugucuucuug

SEQ ID NO: 1164758 - RNA, 19 nt, Homo sapiens
gaacuggaagcugaauauu

SEQ ID NO: 1164759 - RNA, 19 nt, Homo sapiens
ggaagaauucacaaagaug

SEQ ID NO: 1164760 - RNA, 19 nt, Homo sapiens
aaggaagaauucacaaaga

SEQ ID NO: 1164761 - RNA, 19 nt, Homo sapiens
gacagaggcagguuaguga

SEQ ID NO: 1164762 - RNA, 19 nt, Homo sapiens
gaagacaguugcgaugcau

SEQ ID NO: 1164763 - RNA, 19 nt, Homo sapiens
gaugaaacaggaacuggaa

SEQ ID NO: 1164764 - RNA, 19 nt, Homo sapiens
aaaguuggcauacaaauag

SEQ ID NO: 1164765 - RNA, 19 nt, Homo sapiens
aaacagcgauaacagugau

SEQ ID NO: 1164766 - RNA, 19 nt, Homo sapiens
acucaggauucuacagaua

SEQ ID NO: 1164767 - RNA, 19 nt, Homo sapiens
guaaucguuucaggaguaa

SEQ ID NO: 1164768 - RNA, 19 nt, Homo sapiens
caugauuccuuuguugaaa

SEQ ID NO: 1164769 - RNA, 19 nt, Homo sapiens
gguguugugaggauuaaua

SEQ ID NO: 1164770 - RNA, 19 nt, Homo sapiens
ggucugcuguaaagaacaa

SEQ ID NO: 1164771 - RNA, 19 nt, Homo sapiens
ccgcggacuuaaagcaaua

SEQ ID NO: 1164772 - RNA, 19 nt, Homo sapiens
aaaguagccucuauaacuc

SEQ ID NO: 1164773 - RNA, 19 nt, Homo sapiens
acucagaaguccaaaguuc

SEQ ID NO: 1164774 - RNA, 19 nt, Homo sapiens
gcacucgucauacucagaa

SEQ ID NO: 1164775 - RNA, 19 nt, Homo sapiens
uaugcucacuggaaacaaa

SEQ ID NO: 1164776 - RNA, 19 nt, Homo sapiens
aagaguugcugcauucaga

SEQ ID NO: 1164777 - RNA, 19 nt, Homo sapiens
ccucaaacuuucugaucuu

SEQ ID NO: 1164778 - RNA, 19 nt, Homo sapiens
ugaaauggcaucucgaaca

SEQ ID NO: 1164779 - RNA, 19 nt, Homo sapiens
gaguagcuguaauaaaucu

SEQ ID NO: 1164780 - RNA, 19 nt, Homo sapiens
aaaggguaaucuacaguug

SEQ ID NO: 1164781 - RNA, 19 nt, Homo sapiens
aaagugcugcagaugauua

SEQ ID NO: 1164782 - RNA, 19 nt, Homo sapiens
ggaguaucauaaccgaguu

SEQ ID NO: 1164783 - RNA, 19 nt, Homo sapiens
ggaaagaggucugcuguaa

SEQ ID NO: 1164784 - RNA, 19 nt, Homo sapiens
ggauguagaugauuucuuu

SEQ ID NO: 1164785 - RNA, 19 nt, Homo sapiens
gaauuuaucuggcuucaug

SEQ ID NO: 1164786 - RNA, 19 nt, Homo sapiens
gaaauggcaucucgaacaa

SEQ ID NO: 1164787 - RNA, 19 nt, Homo sapiens
gaaaguuggcauacaaaua

SEQ ID NO: 1164788 - RNA, 19 nt, Homo sapiens
gaugaaaguuggcauacaa

SEQ ID NO: 1164789 - RNA, 19 nt, Homo sapiens
gcagaauacuugagaugaa

SEQ ID NO: 1164790 - RNA, 19 nt, Homo sapiens
gaacauuucuuuuggagua

SEQ ID NO: 1164791 - RNA, 19 nt, Homo sapiens
gaagaggaccgcggacuua

SEQ ID NO: 1164792 - RNA, 19 nt, Homo sapiens
caauuaagcaugagacaua

SEQ ID NO: 1164793 - RNA, 19 nt, Homo sapiens
gcaaaugcauuaguauguu

SEQ ID NO: 1164794 - RNA, 19 nt, Homo sapiens
uggaguagcuguaauaaau

SEQ ID NO: 1164795 - RNA, 19 nt, Homo sapiens
gaugaagaccucaaacuuu

SEQ ID NO: 1164796 - RNA, 19 nt, Homo sapiens
cgaaacuucccaacaauua

SEQ ID NO: 1164797 - RNA, 19 nt, Homo sapiens
ggacuuaaagcaauaaaug

SEQ ID NO: 1164798 - RNA, 19 nt, Homo sapiens
gcagaugauuacaauagaa

SEQ ID NO: 1164799 - RNA, 19 nt, Homo sapiens
uaaaggacauacugaccua

SEQ ID NO: 1164800 - RNA, 19 nt, Homo sapiens
caagaagaguugcugcauu

SEQ ID NO: 1164801 - RNA, 19 nt, Homo sapiens
gaagaauucacaaagauga

SEQ ID NO: 1164802 - RNA, 19 nt, Homo sapiens
ggacauuucugaugcucuu

SEQ ID NO: 1164803 - RNA, 19 nt, Homo sapiens
uaaaucagcagauggagua

SEQ ID NO: 1164804 - RNA, 19 nt, Homo sapiens
gaacugcuccucugugugu

SEQ ID NO: 1164805 - RNA, 19 nt, Homo sapiens
uaaaguagccucuauaacu

SEQ ID NO: 1164806 - RNA, 19 nt, Homo sapiens
gaacucaggauucuacaga

SEQ ID NO: 1164807 - RNA, 19 nt, Homo sapiens
gaaagaggucugcuguaaa

SEQ ID NO: 1164808 - RNA, 19 nt, Homo sapiens
guggauagauugguaugua

SEQ ID NO: 1164809 - RNA, 19 nt, Homo sapiens
gcgaguggauagauuggua

SEQ ID NO: 1164810 - RNA, 19 nt, Homo sapiens
gcagauggaguaaucguuu

SEQ ID NO: 1164811 - RNA, 19 nt, Homo sapiens
aaagaggucugcuguaaag

SEQ ID NO: 1164812 - RNA, 19 nt, Homo sapiens
ggccgaaacuucccaacaa

SEQ ID NO: 1164813 - RNA, 19 nt, Homo sapiens
gcuaauaaagcacuggaua

SEQ ID NO: 1164814 - RNA, 19 nt, Homo sapiens
ggaugcaucugcuaaaucu

SEQ ID NO: 1164815 - RNA, 19 nt, Homo sapiens
ggaauauaaucaagaugug

SEQ ID NO: 1164816 - RNA, 19 nt, Homo sapiens
ccacucuuauuuaccuuua

SEQ ID NO: 1164817 - RNA, 19 nt, Homo sapiens
ccucaguucucgacucuaa

SEQ ID NO: 1164818 - RNA, 19 nt, Homo sapiens
gcgccuagcucagccaauu

SEQ ID NO: 1164819 - RNA, 19 nt, Homo sapiens
gaacaaaguccaccaaucc

SEQ ID NO: 1164820 - RNA, 19 nt, Homo sapiens
acuggaagcugaauauuug

SEQ ID NO: 1164821 - RNA, 19 nt, Homo sapiens
gaagcuuggugaaggagaa

SEQ ID NO: 1164822 - RNA, 19 nt, Homo sapiens
cauguugucuugccucauu

SEQ ID NO: 1164823 - RNA, 19 nt, Homo sapiens
ccaccaaucccuuuacaaa

SEQ ID NO: 1164824 - RNA, 19 nt, Homo sapiens
gaaggaagaauucacaaag

SEQ ID NO: 1164825 - RNA, 19 nt, Homo sapiens
gaaggagaagggucaauga

SEQ ID NO: 1164826 - RNA, 19 nt, Homo sapiens
cagaauacuugagaugaaa

SEQ ID NO: 1164827 - RNA, 19 nt, Homo sapiens
gcauauaccaccuuaguuc

SEQ ID NO: 1164828 - RNA, 19 nt, Homo sapiens
gcauacaaauaggauacua

SEQ ID NO: 1164829 - RNA, 19 nt, Homo sapiens
gaaauacaggagcagagua

SEQ ID NO: 1164830 - RNA, 19 nt, Homo sapiens
gccuuaaacuuguagacua

SEQ ID NO: 1164831 - RNA, 19 nt, Homo sapiens
ggucacuaguggauuauga

SEQ ID NO: 1164832 - RNA, 19 nt, Homo sapiens
gaguaaaggauguagauga

SEQ ID NO: 1164833 - RNA, 19 nt, Homo sapiens
aagagaaacuugaagacuu

SEQ ID NO: 1164834 - RNA, 19 nt, Homo sapiens
gcgauaacagugauaguuu

SEQ ID NO: 1164835 - RNA, 19 nt, Homo sapiens
acacuccgccuuccuguua

SEQ ID NO: 1164836 - RNA, 19 nt, Homo sapiens
ucaggauucuacagauaua

SEQ ID NO: 1164837 - RNA, 19 nt, Homo sapiens
gaacgaacauuucuuuugg

SEQ ID NO: 1164838 - RNA, 19 nt, Homo sapiens
aagaagaguugcugcauuc

SEQ ID NO: 1164839 - RNA, 19 nt, Homo sapiens
cuacagauauaugcaaguu

SEQ ID NO: 1164840 - RNA, 19 nt, Homo sapiens
ggaacuggaagcugaauau

SEQ ID NO: 1164841 - RNA, 19 nt, Homo sapiens
agaguucauugccaaauuu

SEQ ID NO: 1164842 - RNA, 19 nt, Homo sapiens
gccaguaguuauauuacaa

SEQ ID NO: 1164843 - RNA, 19 nt, Homo sapiens
ccuuaaacuuguagacuaa

SEQ ID NO: 1164844 - RNA, 19 nt, Homo sapiens
gcacgagugucugcugaug

SEQ ID NO: 1164845 - RNA, 19 nt, Homo sapiens
cuaugcagguuauaucauu

SEQ ID NO: 1164846 - RNA, 19 nt, Homo sapiens
ugaagacuaugcagguuau

SEQ ID NO: 1164847 - RNA, 19 nt, Homo sapiens
ugacaguuauuccugaaau

SEQ ID NO: 1164848 - RNA, 19 nt, Homo sapiens
gcagguuagugacaguuau

SEQ ID NO: 1164849 - RNA, 19 nt, Homo sapiens
guaaagcaucuuaaucaga

SEQ ID NO: 1164850 - RNA, 19 nt, Homo sapiens
gaaacuucccaacaauuau

SEQ ID NO: 1164851 - RNA, 19 nt, Homo sapiens
aguaaucguuucaggagua

SEQ ID NO: 1164852 - RNA, 19 nt, Homo sapiens
ggacagaggcagguuagug

SEQ ID NO: 1164853 - RNA, 19 nt, Homo sapiens
cgaacaaaguccaccaauc

SEQ ID NO: 1164854 - RNA, 19 nt, Homo sapiens
caccuuaguucauucaugu

SEQ ID NO: 1164855 - RNA, 19 nt, Homo sapiens
cuaauaaagcacuggauaa

SEQ ID NO: 1164856 - RNA, 19 nt, Homo sapiens
aaauuuccaugucuucuug

SEQ ID NO: 1164857 - RNA, 19 nt, Homo sapiens
gaacuggaagcugaauauu

SEQ ID NO: 1164858 - RNA, 19 nt, Homo sapiens
ggaagaauucacaaagaug

SEQ ID NO: 1164859 - RNA, 19 nt, Homo sapiens
aaggaagaauucacaaaga

SEQ ID NO: 1164860 - RNA, 19 nt, Homo sapiens
gacagaggcagguuaguga

SEQ ID NO: 1164861 - RNA, 19 nt, Homo sapiens
gaagacaguugcgaugcau

SEQ ID NO: 1164862 - RNA, 19 nt, Homo sapiens
gaugaaacaggaacuggaa

SEQ ID NO: 1164863 - RNA, 19 nt, Homo sapiens
aaaguuggcauacaaauag

SEQ ID NO: 1164864 - RNA, 19 nt, Homo sapiens
aaacagcgauaacagugau

SEQ ID NO: 1164865 - RNA, 19 nt, Homo sapiens
acucaggauucuacagaua

SEQ ID NO: 1164866 - RNA, 19 nt, Homo sapiens
guaaucguuucaggaguaa

SEQ ID NO: 1164867 - RNA, 19 nt, Homo sapiens
caugauuccuuuguugaaa

SEQ ID NO: 1164868 - RNA, 19 nt, Homo sapiens
gguguugugaggauuaaua

SEQ ID NO: 1164869 - RNA, 19 nt, Homo sapiens
ggucugcuguaaagaacaa

SEQ ID NO: 1164870 - RNA, 19 nt, Homo sapiens
aaaguagccucuauaacuc

SEQ ID NO: 1164871 - RNA, 19 nt, Homo sapiens
acucagaaguccaaaguuc

SEQ ID NO: 1164872 - RNA, 19 nt, Homo sapiens
ccgcggacuuaaagcaaua

SEQ ID NO: 1164873 - RNA, 19 nt, Homo sapiens
gcacucgucauacucagaa

SEQ ID NO: 1164874 - RNA, 19 nt, Homo sapiens
uaugcucacuggaaacaaa

SEQ ID NO: 1164875 - RNA, 19 nt, Homo sapiens
aagaguugcugcauucaga

SEQ ID NO: 1164876 - RNA, 19 nt, Homo sapiens
ccucaaacuuucugaucuu

SEQ ID NO: 1164877 - RNA, 19 nt, Homo sapiens
ugaaauggcaucucgaaca

SEQ ID NO: 1164878 - RNA, 19 nt, Homo sapiens
gaguagcuguaauaaaucu

SEQ ID NO: 1164879 - RNA, 19 nt, Homo sapiens
aaaggguaaucuacaguug

SEQ ID NO: 1164880 - RNA, 19 nt, Homo sapiens
aaagugcugcagaugauua

SEQ ID NO: 1164881 - RNA, 19 nt, Homo sapiens
ggaguaucauaaccgaguu

SEQ ID NO: 1164882 - RNA, 19 nt, Homo sapiens
cacguaaccuucgcuggua

SEQ ID NO: 1164883 - RNA, 19 nt, Homo sapiens
caacauggauuuccucaga

SEQ ID NO: 1164884 - RNA, 19 nt, Homo sapiens
caaugagacuucuuguuua

SEQ ID NO: 1164885 - RNA, 19 nt, Homo sapiens
ggaagcagaugaagaaaca

SEQ ID NO: 1164886 - RNA, 19 nt, Homo sapiens
gaagaugacaugaagauug

SEQ ID NO: 1164887 - RNA, 19 nt, Homo sapiens
gaagauugaugagaaaugu

SEQ ID NO: 1164888 - RNA, 19 nt, Homo sapiens
gcacagguguuauccuaug

SEQ ID NO: 1164889 - RNA, 19 nt, Homo sapiens
ucaaugagacuucuuguuu

SEQ ID NO: 1164890 - RNA, 19 nt, Homo sapiens
uaaaugagcucagaagaca

SEQ ID NO: 1164891 - RNA, 19 nt, Homo sapiens
gaacaagugauccauauuc

SEQ ID NO: 1164892 - RNA, 19 nt, Homo sapiens
gcuauaugcuggagacaaa

SEQ ID NO: 1164893 - RNA, 19 nt, Homo sapiens
gaagaaacauuugaaucug

SEQ ID NO: 1164894 - RNA, 19 nt, Homo sapiens
gaacugaagcccuauguca

SEQ ID NO: 1164895 - RNA, 19 nt, Homo sapiens
gagcucagaagacaacuua

SEQ ID NO: 1164896 - RNA, 19 nt, Homo sapiens
ggagagaaguggguugcua

SEQ ID NO: 1164897 - RNA, 19 nt, Homo sapiens
guuaugugguuaccuauuu

SEQ ID NO: 1164898 - RNA, 19 nt, Homo sapiens
gagaaccuuucgcagauuu

SEQ ID NO: 1164899 - RNA, 19 nt, Homo sapiens
ggaagaagaagaugacaug

SEQ ID NO: 1164900 - RNA, 19 nt, Homo sapiens
gagacaaacugguagaagu

SEQ ID NO: 1164901 - RNA, 19 nt, Homo sapiens
auaaagccaucgaauauga

SEQ ID NO: 1164902 - RNA, 19 nt, Homo sapiens
gaaguggguugcuauaugc

SEQ ID NO: 1164903 - RNA, 19 nt, Homo sapiens
gguguuauccuaugaggua

SEQ ID NO: 1164904 - RNA, 19 nt, Homo sapiens
caagucaacccuaucaauu

SEQ ID NO: 1164905 - RNA, 19 nt, Homo sapiens
gcacaaucauguucaaggu

SEQ ID NO: 1164906 - RNA, 19 nt, Homo sapiens
auacagcgauccauaguug

SEQ ID NO: 1164907 - RNA, 19 nt, Homo sapiens
aagaugacaugaagauuga

SEQ ID NO: 1164908 - RNA, 19 nt, Homo sapiens
gaauaugagguguaugaaa

SEQ ID NO: 1164909 - RNA, 19 nt, Homo sapiens
agaagaagaugacaugaag

SEQ ID NO: 1164910 - RNA, 19 nt, Homo sapiens
caacaguauuugacccauu

SEQ ID NO: 1164911 - RNA, 19 nt, Homo sapiens
gaugaagaccuacaagaga

SEQ ID NO: 1164912 - RNA, 19 nt, Homo sapiens
gaauggaguuucaguugag

SEQ ID NO: 1164913 - RNA, 19 nt, Homo sapiens
gaugauacagucagacaaa

SEQ ID NO: 1164914 - RNA, 19 nt, Homo sapiens
ggaguauggugaguacaaa

SEQ ID NO: 1164915 - RNA, 19 nt, Homo sapiens
aauguuaagucacugagua

SEQ ID NO: 1164916 - RNA, 19 nt, Homo sapiens
gaaggaaagaucuguguca

SEQ ID NO: 1164917 - RNA, 19 nt, Homo sapiens
gaggauuguuuguuuagug

SEQ ID NO: 1164918 - RNA, 19 nt, Homo sapiens
gcuaacaggccacuaguau

SEQ ID NO: 1164919 - RNA, 19 nt, Homo sapiens
gguuauuacugacuacuau

SEQ ID NO: 1164920 - RNA, 19 nt, Homo sapiens
ccaagguuauuacugacua

SEQ ID NO: 1164921 - RNA, 19 nt, Homo sapiens
gcucagaagacaacuuauu

SEQ ID NO: 1164922 - RNA, 19 nt, Homo sapiens
acaugaagauugaugagaa

SEQ ID NO: 1164923 - RNA, 19 nt, Homo sapiens
agaaguggguugcuauaug

SEQ ID NO: 1164924 - RNA, 19 nt, Homo sapiens
gcuccaggcuccacacuuc

SEQ ID NO: 1164925 - RNA, 19 nt, Homo sapiens
ugagacuucuuguuuaaug

SEQ ID NO: 1164926 - RNA, 19 nt, Homo sapiens
aaauuuagcccaaagaaug

SEQ ID NO: 1164927 - RNA, 19 nt, Homo sapiens
caugaagauugaugagaaa

SEQ ID NO: 1164928 - RNA, 19 nt, Homo sapiens
cagcagagaugugaaugga

SEQ ID NO: 1164929 - RNA, 19 nt, Homo sapiens
gagcagauccaccagacaa

SEQ ID NO: 1164930 - RNA, 19 nt, Homo sapiens
caucgaauaugagguguau

SEQ ID NO: 1164931 - RNA, 19 nt, Homo sapiens
cacgauagcucagaaagau

SEQ ID NO: 1164932 - RNA, 19 nt, Homo sapiens
gaauggagugugucucuug

SEQ ID NO: 1164933 - RNA, 19 nt, Homo sapiens
ggaggaugauacagucaga

SEQ ID NO: 1164934 - RNA, 19 nt, Homo sapiens
acauggauuuccucagaua

SEQ ID NO: 1164935 - RNA, 19 nt, Homo sapiens
gaauuuaaucccagccauu

SEQ ID NO: 1164936 - RNA, 19 nt, Homo sapiens
agacaaguaccgccucaua

SEQ ID NO: 1164937 - RNA, 19 nt, Homo sapiens
acgaggagguggugaggua

SEQ ID NO: 1164938 - RNA, 19 nt, Homo sapiens
agaaggacaugaagcuuuc

SEQ ID NO: 1164939 - RNA, 19 nt, Homo sapiens
gauccauaguugcaaucua

SEQ ID NO: 1164940 - RNA, 19 nt, Homo sapiens
cgauagcucagaaagauuu

SEQ ID NO: 1164941 - RNA, 19 nt, Homo sapiens
gagugugucucuuguacga

SEQ ID NO: 1164942 - RNA, 19 nt, Homo sapiens
ugaaugggcgugaguauca

SEQ ID NO: 1164943 - RNA, 19 nt, Homo sapiens
ccuaugagguaguggaguu

SEQ ID NO: 1164944 - RNA, 19 nt, Homo sapiens
aacaguauuugacccauuu

SEQ ID NO: 1164945 - RNA, 19 nt, Homo sapiens
acacacuacucguacuaaa

SEQ ID NO: 1164946 - RNA, 19 nt, Homo sapiens
gcagaugaagaaacauuug

SEQ ID NO: 1164947 - RNA, 19 nt, Homo sapiens
ugagguaguggaguuauua

SEQ ID NO: 1164948 - RNA, 19 nt, Homo sapiens
auccauaguugcaaucuaa

SEQ ID NO: 1164949 - RNA, 19 nt, Homo sapiens
cagaagacaacuuauugaa

SEQ ID NO: 1164950 - RNA, 19 nt, Homo sapiens
aauaugagguguaugaaac

SEQ ID NO: 1164951 - RNA, 19 nt, Homo sapiens
cugaacaagugauccauau

SEQ ID NO: 1164952 - RNA, 19 nt, Homo sapiens
uccaagagcugagacaaau

SEQ ID NO: 1164953 - RNA, 19 nt, Homo sapiens
uuucgcagauuucacauga

SEQ ID NO: 1164954 - RNA, 19 nt, Homo sapiens
ggaugaagaccuacaagag

SEQ ID NO: 1164955 - RNA, 19 nt, Homo sapiens
gaaaugaaugggcgugagu

SEQ ID NO: 1164956 - RNA, 19 nt, Homo sapiens
guggaguuauuacgugaaa

SEQ ID NO: 1164957 - RNA, 19 nt, Homo sapiens
guuuaaugcuggaguuuua

SEQ ID NO: 1164958 - RNA, 19 nt, Homo sapiens
ucaaacaguccuugucgaa

SEQ ID NO: 1164959 - RNA, 19 nt, Homo sapiens
gaagaagaagaugacauga

SEQ ID NO: 1164960 - RNA, 19 nt, Homo sapiens
gcagggaggaugauacagu

SEQ ID NO: 1164961 - RNA, 19 nt, Homo sapiens
gaggugacuuuggcagcua

SEQ ID NO: 1164962 - RNA, 19 nt, Homo sapiens
ucgaauaugagguguauga

SEQ ID NO: 1164963 - RNA, 19 nt, Homo sapiens
ucaacccuaucaauuucua

SEQ ID NO: 1164964 - RNA, 19 nt, Homo sapiens
ccucacaccugccucaagu

SEQ ID NO: 1164965 - RNA, 19 nt, Homo sapiens
ccaggaggaucccgacauc

SEQ ID NO: 1164966 - RNA, 19 nt, Homo sapiens
caaggugguuccagucucu

SEQ ID NO: 1164967 - RNA, 19 nt, Homo sapiens
gagagaaguggguugcuau

SEQ ID NO: 1164968 - RNA, 19 nt, Homo sapiens
cuccaggaauuuaaagaaa

SEQ ID NO: 1164969 - RNA, 19 nt, Homo sapiens
agaauggccucucccagau

SEQ ID NO: 1164970 - RNA, 19 nt, Homo sapiens
ugagguguaugaaacaauc

SEQ ID NO: 1164971 - RNA, 19 nt, Homo sapiens
ccuagagccucaggauauu

SEQ ID NO: 1164972 - RNA, 19 nt, Homo sapiens
gaccuagagccucaggaua

SEQ ID NO: 1164973 - RNA, 19 nt, Homo sapiens
ugagaaauguguggaagca

SEQ ID NO: 1164974 - RNA, 19 nt, Homo sapiens
gaagaagaugacaugaaga

SEQ ID NO: 1164975 - RNA, 19 nt, Homo sapiens
ggacaugaagcuuucuaca

SEQ ID NO: 1164976 - RNA, 19 nt, Homo sapiens
guuaagucacugaguauga

SEQ ID NO: 1164977 - RNA, 19 nt, Homo sapiens
cgaugcaugugcccaguug

SEQ ID NO: 1164978 - RNA, 19 nt, Homo sapiens
gucacaggaugcuggagua

SEQ ID NO: 1164979 - RNA, 19 nt, Homo sapiens
ccuaucaauuucuauggaa

SEQ ID NO: 1164980 - RNA, 19 nt, Homo sapiens
agucaacccuaucaauuuc

SEQ ID NO: 1164981 - RNA, 19 nt, Homo sapiens
gaggcacaaucauguucaa

SEQ ID NO: 1164982 - RNA, 19 nt, Homo sapiens
uaacacuguacccuugaua

SEQ ID NO: 1164983 - RNA, 19 nt, Homo sapiens
guacugaugucacaacuuu

SEQ ID NO: 1164984 - RNA, 19 nt, Homo sapiens
gagcaaagcagcaugauaa

SEQ ID NO: 1164985 - RNA, 19 nt, Homo sapiens
gaagucaugucuuuaaagu

SEQ ID NO: 1164986 - RNA, 19 nt, Homo sapiens
aaagugagaucgauucaga

SEQ ID NO: 1164987 - RNA, 19 nt, Homo sapiens
ucacggagcucuacuaugc

SEQ ID NO: 1164988 - RNA, 19 nt, Homo sapiens
gcagagagaauaugaguuc

SEQ ID NO: 1164989 - RNA, 19 nt, Homo sapiens
gcuggaagcugcauguuag

SEQ ID NO: 1164990 - RNA, 19 nt, Homo sapiens
ucaaagugcucagggaauu

SEQ ID NO: 1164991 - RNA, 19 nt, Homo sapiens
caaagcagcaugauaagga

SEQ ID NO: 1164992 - RNA, 19 nt, Homo sapiens
ggaagcagagagaauauga

SEQ ID NO: 1164993 - RNA, 19 nt, Homo sapiens
ggacauggaccuacuccuu

SEQ ID NO: 1164994 - RNA, 19 nt, Homo sapiens
cauggaagguucuggcaaa

SEQ ID NO: 1164995 - RNA, 19 nt, Homo sapiens
gagggaagcagagagaaua

SEQ ID NO: 1164996 - RNA, 19 nt, Homo sapiens
cagcuucauuccucugaua

SEQ ID NO: 1164997 - RNA, 19 nt, Homo sapiens
caagcugugugacuucaaa

SEQ ID NO: 1164998 - RNA, 19 nt, Homo sapiens
guucaaaggugggaagaga

SEQ ID NO: 1164999 - RNA, 19 nt, Homo sapiens
aaggucagcuucagaaaga

SEQ ID NO: 1165000 - RNA, 19 nt, Homo sapiens
ggacgcugcugaccaucuu

SEQ ID NO: 1165001 - RNA, 19 nt, Homo sapiens
acaccuaccucauggaguu

SEQ ID NO: 1165002 - RNA, 19 nt, Homo sapiens
ggaggaaucccaagaagca

SEQ ID NO: 1165003 - RNA, 19 nt, Homo sapiens
gaagagagccuggaaaaga

SEQ ID NO: 1165004 - RNA, 19 nt, Homo sapiens
ugagaucgauucagaugau

SEQ ID NO: 1165005 - RNA, 19 nt, Homo sapiens
gggacuggguggcaaagaa

SEQ ID NO: 1165006 - RNA, 19 nt, Homo sapiens
ggacaccacaguaccuaaa

SEQ ID NO: 1165007 - RNA, 19 nt, Homo sapiens
gaaggaggcugggcagaac

SEQ ID NO: 1165008 - RNA, 19 nt, Homo sapiens
ggagcaaagcagcaugaua

SEQ ID NO: 1165009 - RNA, 19 nt, Homo sapiens
gaagcucaauucccauucu

SEQ ID NO: 1165010 - RNA, 19 nt, Homo sapiens
uaccugagcuacagauaug

SEQ ID NO: 1165011 - RNA, 19 nt, Homo sapiens
gggagcagcuuguguagac

SEQ ID NO: 1165012 - RNA, 19 nt, Homo sapiens
ggaagguucuggcaaagac

SEQ ID NO: 1165013 - RNA, 19 nt, Homo sapiens
caaccgcaccuaccaaaug

SEQ ID NO: 1165014 - RNA, 19 nt, Homo sapiens
caccugaugugaccuguau

SEQ ID NO: 1165015 - RNA, 19 nt, Homo sapiens
cuaacaccauggauucaaa

SEQ ID NO: 1165016 - RNA, 19 nt, Homo sapiens
ucuacagcaucgaguauaa

SEQ ID NO: 1165017 - RNA, 19 nt, Homo sapiens
caucuuccaugaccuguuc

SEQ ID NO: 1165018 - RNA, 19 nt, Homo sapiens
gauagaacaaagcgaaaug

SEQ ID NO: 1165019 - RNA, 19 nt, Homo sapiens
cagcuggccucccuccuau

SEQ ID NO: 1165020 - RNA, 19 nt, Homo sapiens
gguccagccuuccuccuau

SEQ ID NO: 1165021 - RNA, 19 nt, Homo sapiens
cgauucagaugauuguuca

SEQ ID NO: 1165022 - RNA, 19 nt, Homo sapiens
ggaguuguggugaagauga

SEQ ID NO: 1165023 - RNA, 19 nt, Homo sapiens
caucugggcucaaauucca

SEQ ID NO: 1165024 - RNA, 19 nt, Homo sapiens
gaacuggauucucuuuuca

SEQ ID NO: 1165025 - RNA, 19 nt, Homo sapiens
cauguuagguggccuuucu

SEQ ID NO: 1165026 - RNA, 19 nt, Homo sapiens
gaguuguggugaagaugaa

SEQ ID NO: 1165027 - RNA, 19 nt, Homo sapiens
ugaaaucagugcccagaac

SEQ ID NO: 1165028 - RNA, 19 nt, Homo sapiens
gggagacacacaagccuuu

SEQ ID NO: 1165029 - RNA, 19 nt, Homo sapiens
cuaaaggucagcuucagaa

SEQ ID NO: 1165030 - RNA, 19 nt, Homo sapiens
gagaucgauucagaugauu

SEQ ID NO: 1165031 - RNA, 19 nt, Homo sapiens
ucgguuuccucaucuguaa

SEQ ID NO: 1165032 - RNA, 19 nt, Homo sapiens
auaacacacuguacugaug

SEQ ID NO: 1165033 - RNA, 19 nt, Homo sapiens
uguccgagaucaccuacuu

SEQ ID NO: 1165034 - RNA, 19 nt, Homo sapiens
gcaucgaguauaagacgua

SEQ ID NO: 1165035 - RNA, 19 nt, Homo sapiens
ugaggacgcugcugaccau

SEQ ID NO: 1165036 - RNA, 19 nt, Homo sapiens
ggaagggacaccacaguac

SEQ ID NO: 1165037 - RNA, 19 nt, Homo sapiens
ggcauagccuguccgagau

SEQ ID NO: 1165038 - RNA, 19 nt, Homo sapiens
ugaccuguucuaccacuua

SEQ ID NO: 1165039 - RNA, 19 nt, Homo sapiens
ugaccuguaucuccaaagu

SEQ ID NO: 1165040 - RNA, 19 nt, Homo sapiens
gcagcacacuacccucaag

SEQ ID NO: 1165041 - RNA, 19 nt, Homo sapiens
acacuguacugaugucaca

SEQ ID NO: 1165042 - RNA, 19 nt, Homo sapiens
caauaacacacuguacuga

SEQ ID NO: 1165043 - RNA, 19 nt, Homo sapiens
gacccuauccugagaaugg

SEQ ID NO: 1165044 - RNA, 19 nt, Homo sapiens
uauaagacguacggagaga

SEQ ID NO: 1165045 - RNA, 19 nt, Homo sapiens
ggagggaagcagagagaau

SEQ ID NO: 1165046 - RNA, 19 nt, Homo sapiens
aggaggaaaugcagggaaa

SEQ ID NO: 1165047 - RNA, 19 nt, Homo sapiens
gacacuuucuaguccuaaa

SEQ ID NO: 1165048 - RNA, 19 nt, Homo sapiens
gaaugggguuugaaaggaa

SEQ ID NO: 1165049 - RNA, 19 nt, Homo sapiens
gccugacguugcacgauuu

SEQ ID NO: 1165050 - RNA, 19 nt, Homo sapiens
ucacauccuuggcugucaa

SEQ ID NO: 1165051 - RNA, 19 nt, Homo sapiens
guccaguacucccagauca

SEQ ID NO: 1165052 - RNA, 19 nt, Homo sapiens
ucauaacaccuaccucaug

SEQ ID NO: 1165053 - RNA, 19 nt, Homo sapiens
ccaagaugacugacagguu

SEQ ID NO: 1165054 - RNA, 19 nt, Homo sapiens
ggacggguacaauaacaca

SEQ ID NO: 1165055 - RNA, 19 nt, Homo sapiens
caaagugcucagggaauuu

SEQ ID NO: 1165056 - RNA, 19 nt, Homo sapiens
gaucgauucagaugauugu

SEQ ID NO: 1165057 - RNA, 19 nt, Homo sapiens
cugugugacuucaaacaaa

SEQ ID NO: 1165058 - RNA, 19 nt, Homo sapiens
cuucauuccucugauagaa

SEQ ID NO: 1165059 - RNA, 19 nt, Homo sapiens
ccucuucugucauuguuca

SEQ ID NO: 1165060 - RNA, 19 nt, Homo sapiens
aagcucaauucccauucua

SEQ ID NO: 1165061 - RNA, 19 nt, Homo sapiens
uaacacacuguacugaugu

SEQ ID NO: 1165062 - RNA, 19 nt, Homo sapiens
acuuagagcuccaggucaa

SEQ ID NO: 1165063 - RNA, 19 nt, Homo sapiens
ccaagaagcaaaaucauug

SEQ ID NO: 1165064 - RNA, 19 nt, Homo sapiens
uaaaggucagcuucagaaa

SEQ ID NO: 1165065 - RNA, 19 nt, Homo sapiens
ccacaggccaucucuaagg

SEQ ID NO: 1165066 - RNA, 19 nt, Homo sapiens
ucauuccucugauagaaca

SEQ ID NO: 1165067 - RNA, 19 nt, Homo sapiens
gcacgauuucagcuucauu

SEQ ID NO: 1165068 - RNA, 19 nt, Homo sapiens
ccacugggacacuuucuag

SEQ ID NO: 1165069 - RNA, 19 nt, Homo sapiens
gagccuuccuguucuccau

SEQ ID NO: 1165070 - RNA, 19 nt, Homo sapiens
gaccuguucuaccacuuag

SEQ ID NO: 1165071 - RNA, 19 nt, Homo sapiens
ugugugacuucaaacaaau

SEQ ID NO: 1165072 - RNA, 19 nt, Homo sapiens
accuguaucuccaaaguga

SEQ ID NO: 1165073 - RNA, 19 nt, Homo sapiens
gaccggacauggaccuacu

SEQ ID NO: 1165074 - RNA, 19 nt, Homo sapiens
uggugaagaugaaaugaag

SEQ ID NO: 1165075 - RNA, 19 nt, Homo sapiens
ggacuggguggcaaagaag

SEQ ID NO: 1165076 - RNA, 19 nt, Homo sapiens
ugccugacguugcacgauu

SEQ ID NO: 1165077 - RNA, 19 nt, Homo sapiens
gcuggagucccuugugugu

SEQ ID NO: 1165078 - RNA, 19 nt, Homo sapiens
ccaugucccucccuuugca

SEQ ID NO: 1165079 - RNA, 19 nt, Homo sapiens
cccaauaaacgguagcuau

SEQ ID NO: 1165080 - RNA, 19 nt, Homo sapiens
gggaagagagccuggaaaa

SEQ ID NO: 1165081 - RNA, 19 nt, Homo sapiens
ggucuacagcaucgaguau

SEQ ID NO: 1165082 - RNA, 19 nt, Homo sapiens
gggcuuccucgucgcagua

SEQ ID NO: 1165083 - RNA, 19 nt, Homo sapiens
ucaagacaguccugaaaua

SEQ ID NO: 1165084 - RNA, 19 nt, Homo sapiens
gaauaaauuggccuagaua

SEQ ID NO: 1165085 - RNA, 19 nt, Homo sapiens
gaacgauuguggacccuau

SEQ ID NO: 1165086 - RNA, 19 nt, Homo sapiens
caagaacgaucgggaggaa

SEQ ID NO: 1165087 - RNA, 19 nt, Homo sapiens
ugaauaaauuggccuagau

SEQ ID NO: 1165088 - RNA, 19 nt, Homo sapiens
uggccuagauacccucuua

SEQ ID NO: 1165089 - RNA, 19 nt, Homo sapiens
gcucaagacaguccugaaa

SEQ ID NO: 1165090 - RNA, 19 nt, Homo sapiens
agacagagaugcggaacga

SEQ ID NO: 1165091 - RNA, 19 nt, Homo sapiens
cccagaagaucgaguugaa

SEQ ID NO: 1165092 - RNA, 19 nt, Homo sapiens
cgcagaggcuguccuucua

SEQ ID NO: 1165093 - RNA, 19 nt, Homo sapiens
gaaauuccccugccacuau

SEQ ID NO: 1165094 - RNA, 19 nt, Homo sapiens
ggucgagauuuccaucaug

SEQ ID NO: 1165095 - RNA, 19 nt, Homo sapiens
guaguggccugcgugaaug

SEQ ID NO: 1165096 - RNA, 19 nt, Homo sapiens
ggagaucaccgugcacuuc

SEQ ID NO: 1165097 - RNA, 19 nt, Homo sapiens
ugagaaugcugaggacugu

SEQ ID NO: 1165098 - RNA, 19 nt, Homo sapiens
gcccuggacagauugauuu

SEQ ID NO: 1165099 - RNA, 19 nt, Homo sapiens
gcuacgacacgcugcagua

SEQ ID NO: 1165100 - RNA, 19 nt, Homo sapiens
gcucagcaaccucauguuc

SEQ ID NO: 1165101 - RNA, 19 nt, Homo sapiens
agacaguccugaaauacgu

SEQ ID NO: 1165102 - RNA, 19 nt, Homo sapiens
gaagcaaugccuccgucaa

SEQ ID NO: 1165103 - RNA, 19 nt, Homo sapiens
uuccuuggcuucaauacuu

SEQ ID NO: 1165104 - RNA, 19 nt, Homo sapiens
ugacuagcgacaacuacua

SEQ ID NO: 1165105 - RNA, 19 nt, Homo sapiens
gccuagauacccucuuaaa

SEQ ID NO: 1165106 - RNA, 19 nt, Homo sapiens
acuaucagaucugcaagaa

SEQ ID NO: 1165107 - RNA, 19 nt, Homo sapiens
uggcacggcucaagacagu

SEQ ID NO: 1165108 - RNA, 19 nt, Homo sapiens
cugaauaaauuggccuaga

SEQ ID NO: 1165109 - RNA, 19 nt, Homo sapiens
ccugaaauacgugcuguuu

SEQ ID NO: 1165110 - RNA, 19 nt, Homo sapiens
ccuucugccucacaaacua

SEQ ID NO: 1165111 - RNA, 19 nt, Homo sapiens
caugaugacuagcgacaac

SEQ ID NO: 1165112 - RNA, 19 nt, Homo sapiens
acaccuccaugaugacuag

SEQ ID NO: 1165113 - RNA, 19 nt, Homo sapiens
caagacaguccugaaauac

SEQ ID NO: 1165114 - RNA, 19 nt, Homo sapiens
cagagacagacaacuggua

SEQ ID NO: 1165115 - RNA, 19 nt, Homo sapiens
cguaguggccugcgugaau

SEQ ID NO: 1165116 - RNA, 19 nt, Homo sapiens
ucacgcggguggucgagau

SEQ ID NO: 1165117 - RNA, 19 nt, Homo sapiens
cagaggcuguccuucuaca

SEQ ID NO: 1165118 - RNA, 19 nt, Homo sapiens
gaccgguggcugcaaguga

SEQ ID NO: 1165119 - RNA, 19 nt, Homo sapiens
gcccuuccuuggcuucaau

SEQ ID NO: 1165120 - RNA, 19 nt, Homo sapiens
agauugauuuccagcugaa

SEQ ID NO: 1165121 - RNA, 19 nt, Homo sapiens
caaugccuccgucaacguu

SEQ ID NO: 1165122 - RNA, 19 nt, Homo sapiens
gcaccgcaccgagaagcaa

SEQ ID NO: 1165123 - RNA, 19 nt, Homo sapiens
agaaugcugaggacuguga

SEQ ID NO: 1165124 - RNA, 19 nt, Homo sapiens
cuagcgacaacuacuacua

SEQ ID NO: 1165125 - RNA, 19 nt, Homo sapiens
acgacacgcugcaguacug

SEQ ID NO: 1165126 - RNA, 19 nt, Homo sapiens
cccagaugcugugcuucua

SEQ ID NO: 1165127 - RNA, 19 nt, Homo sapiens
cacccugccuagcaacuuc

SEQ ID NO: 1165128 - RNA, 19 nt, Homo sapiens
uugauuuccagcugaauaa

SEQ ID NO: 1165129 - RNA, 19 nt, Homo sapiens
gccacuaucagaucugcaa

SEQ ID NO: 1165130 - RNA, 19 nt, Homo sapiens
gcaaugccuccgucaacgu

SEQ ID NO: 1165131 - RNA, 19 nt, Homo sapiens
gaggagcccuauuaaauua

SEQ ID NO: 1165132 - RNA, 19 nt, Homo sapiens
caacuaaagucagcaaaua

SEQ ID NO: 1165133 - RNA, 19 nt, Homo sapiens
caagaucgccacaugauua

SEQ ID NO: 1165134 - RNA, 19 nt, Homo sapiens
gaaaccaccuuccacaaau

SEQ ID NO: 1165135 - RNA, 19 nt, Homo sapiens
uagaaugcgucaacuuaua

SEQ ID NO: 1165136 - RNA, 19 nt, Homo sapiens
ggaggagcccuauuaaauu

SEQ ID NO: 1165137 - RNA, 19 nt, Homo sapiens
gcaguuggacacuauguua

SEQ ID NO: 1165138 - RNA, 19 nt, Homo sapiens
ggagcccuauuaaauuaua

SEQ ID NO: 1165139 - RNA, 19 nt, Homo sapiens
gcaaauacaggaaacaaug

SEQ ID NO: 1165140 - RNA, 19 nt, Homo sapiens
cagaagauguagagacaaa

SEQ ID NO: 1165141 - RNA, 19 nt, Homo sapiens
gcucuacuguugguacuua

SEQ ID NO: 1165142 - RNA, 19 nt, Homo sapiens
caaagaauuccuagaaaga

SEQ ID NO: 1165143 - RNA, 19 nt, Homo sapiens
cagcaucuguccucuagaa

SEQ ID NO: 1165144 - RNA, 19 nt, Homo sapiens
ccaaagaauuccuagaaag

SEQ ID NO: 1165145 - RNA, 19 nt, Homo sapiens
ggagaggauugucaucugu

SEQ ID NO: 1165146 - RNA, 19 nt, Homo sapiens
ggaaacaaugaaaggauaa

SEQ ID NO: 1165147 - RNA, 19 nt, Homo sapiens
ucaaaucacuucuccaaaa

SEQ ID NO: 1165148 - RNA, 19 nt, Homo sapiens
aggaaacaaugaaaggaua

SEQ ID NO: 1165149 - RNA, 19 nt, Homo sapiens
agacagaaacacagacuaa

SEQ ID NO: 1165150 - RNA, 19 nt, Homo sapiens
ugacuuggucccugaauuu

SEQ ID NO: 1165151 - RNA, 19 nt, Homo sapiens
caaauacaggaaacaauga

SEQ ID NO: 1165152 - RNA, 19 nt, Homo sapiens
cccaaagaauuccuagaaa

SEQ ID NO: 1165153 - RNA, 19 nt, Homo sapiens
uggaggagcccuauuaaau

SEQ ID NO: 1165154 - RNA, 19 nt, Homo sapiens
gagaagacagaaacacaga

SEQ ID NO: 1165155 - RNA, 19 nt, Homo sapiens
ucagaaggcccaacuaaag

SEQ ID NO: 1165156 - RNA, 19 nt, Homo sapiens
gaucgccacaugauuagaa

SEQ ID NO: 1165157 - RNA, 19 nt, Homo sapiens
aaaccaccuuccacaaaug

SEQ ID NO: 1165158 - RNA, 19 nt, Homo sapiens
agacuaacaugcccuucau

SEQ ID NO: 1165159 - RNA, 19 nt, Homo sapiens
auuagaaugcgucaacuua

SEQ ID NO: 1165160 - RNA, 19 nt, Homo sapiens
ggucaagaucgccacauga

SEQ ID NO: 1165161 - RNA, 19 nt, Homo sapiens
gaacacacggaagugaaga

SEQ ID NO: 1165162 - RNA, 19 nt, Homo sapiens
aaguggaggagcccuauua

SEQ ID NO: 1165163 - RNA, 19 nt, Homo sapiens
ugcgucaacuuauagauau

SEQ ID NO: 1165164 - RNA, 19 nt, Homo sapiens
gggagaagacagaaacaca

SEQ ID NO: 1165165 - RNA, 19 nt, Homo sapiens
gaagauguagagacaaacu

SEQ ID NO: 1165166 - RNA, 19 nt, Homo sapiens
uccagaagauguagagaca

SEQ ID NO: 1165167 - RNA, 19 nt, Homo sapiens
caaaucaagcucccaaggu

SEQ ID NO: 1165168 - RNA, 19 nt, Homo sapiens
aggucuagcucuacuguug

SEQ ID NO: 1165169 - RNA, 19 nt, Homo sapiens
gcccuucaugugauucuua

SEQ ID NO: 1165170 - RNA, 19 nt, Homo sapiens
gaagacagaaacacagacu

SEQ ID NO: 1165171 - RNA, 19 nt, Homo sapiens
gcagggagaagacagaaac

SEQ ID NO: 1165172 - RNA, 19 nt, Homo sapiens
cagaaacacagacuaacau

SEQ ID NO: 1165173 - RNA, 19 nt, Homo sapiens
gaaggcccaacuaaaguca

SEQ ID NO: 1165174 - RNA, 19 nt, Homo sapiens
cagaaggcccaacuaaagu

SEQ ID NO: 1165175 - RNA, 19 nt, Homo sapiens
ccaacuaaagucagcaaau

SEQ ID NO: 1165176 - RNA, 19 nt, Homo sapiens
gcgucaacuuauagauauu

SEQ ID NO: 1165177 - RNA, 19 nt, Homo sapiens
gaaugcgucaacuuauaga

SEQ ID NO: 1165178 - RNA, 19 nt, Homo sapiens
gauuagaaugcgucaacuu

SEQ ID NO: 1165179 - RNA, 19 nt, Homo sapiens
guggaggagcccuauuaaa

SEQ ID NO: 1165180 - RNA, 19 nt, Homo sapiens
acagaaacacagacuaaca

SEQ ID NO: 1165181 - RNA, 19 nt, Homo sapiens
uuucagaaggcccaacuaa

SEQ ID NO: 1165182 - RNA, 19 nt, Homo sapiens
gcaucuguccucuagaaca

SEQ ID NO: 1165183 - RNA, 19 nt, Homo sapiens
caaaucacuucuccaaaag

SEQ ID NO: 1165184 - RNA, 19 nt, Homo sapiens
acccaaagaauuccuagaa

SEQ ID NO: 1165185 - RNA, 19 nt, Homo sapiens
ucaagaucgccacaugauu

SEQ ID NO: 1165186 - RNA, 19 nt, Homo sapiens
cagcaaauacaggaaacaa

SEQ ID NO: 1165187 - RNA, 19 nt, Homo sapiens
gacacugguccacaaauca

SEQ ID NO: 1165188 - RNA, 19 nt, Homo sapiens
cuacuguugguacuuauga

SEQ ID NO: 1165189 - RNA, 19 nt, Homo sapiens
caaggucuagcucuacugu

SEQ ID NO: 1165190 - RNA, 19 nt, Homo sapiens
uggagaggauugucaucug

SEQ ID NO: 1165191 - RNA, 19 nt, Homo sapiens
uagaacacacggaagugaa

SEQ ID NO: 1165192 - RNA, 19 nt, Homo sapiens
guagagacaaacugugagu

SEQ ID NO: 1165193 - RNA, 19 nt, Homo sapiens
caggaaacaaugaaaggau

SEQ ID NO: 1165194 - RNA, 19 nt, Homo sapiens
uuagaaugcgucaacuuau

SEQ ID NO: 1165195 - RNA, 19 nt, Homo sapiens
gucaagaucgccacaugau

SEQ ID NO: 1165196 - RNA, 19 nt, Homo sapiens
agaaugcgucaacuuauag

SEQ ID NO: 1165197 - RNA, 19 nt, Homo sapiens
caucagcaucuguccucua

SEQ ID NO: 1165198 - RNA, 19 nt, Homo sapiens
cuagaacacacggaaguga

SEQ ID NO: 1165199 - RNA, 19 nt, Homo sapiens
augcgucaacuuauagaua

SEQ ID NO: 1165200 - RNA, 19 nt, Homo sapiens
caucuguccucuagaacac

SEQ ID NO: 1165201 - RNA, 19 nt, Homo sapiens
cagacuaacaugcccuuca

SEQ ID NO: 1165202 - RNA, 19 nt, Homo sapiens
acacugguccacaaaucaa

SEQ ID NO: 1165203 - RNA, 19 nt, Homo sapiens
gaagugaaaacgagaccaa

SEQ ID NO: 1165204 - RNA, 19 nt, Homo sapiens
uauuguugaucagcugaaa

SEQ ID NO: 1165205 - RNA, 19 nt, Homo sapiens
agaaacacagacuaacaug

SEQ ID NO: 1165206 - RNA, 19 nt, Homo sapiens
ggauaaggcucgagucuug

SEQ ID NO: 1165207 - RNA, 19 nt, Homo sapiens
gaagaagacccucaacuug

SEQ ID NO: 1165208 - RNA, 19 nt, Homo sapiens
aaagauggguuugcacuaa

SEQ ID NO: 1165209 - RNA, 19 nt, Homo sapiens
gaacaaagugagagaugaa

SEQ ID NO: 1165210 - RNA, 19 nt, Homo sapiens
gcaaauuuaucaagcaucu

SEQ ID NO: 1165211 - RNA, 19 nt, Homo sapiens
uaaaugccuugcuggauug

SEQ ID NO: 1165212 - RNA, 19 nt, Homo sapiens
auaaaugccuugcuggauu

SEQ ID NO: 1165213 - RNA, 19 nt, Homo sapiens
gaccaacucuugcguaaaa

SEQ ID NO: 1165214 - RNA, 19 nt, Homo sapiens
gaagacaugaacaaaguga

SEQ ID NO: 1165215 - RNA, 19 nt, Homo sapiens
ugaagaagacccucaacuu

SEQ ID NO: 1165216 - RNA, 19 nt, Homo sapiens
cuugcuggauugccuauua

SEQ ID NO: 1165217 - RNA, 19 nt, Homo sapiens
ucaagcaucucugugaaga

SEQ ID NO: 1165218 - RNA, 19 nt, Homo sapiens
ugaacaaagugagagauga

SEQ ID NO: 1165219 - RNA, 19 nt, Homo sapiens
uaucaagcaucucugugaa

SEQ ID NO: 1165220 - RNA, 19 nt, Homo sapiens
aggaagacaugaacaaagu

SEQ ID NO: 1165221 - RNA, 19 nt, Homo sapiens
ccuauuagaggaugaaguu

SEQ ID NO: 1165222 - RNA, 19 nt, Homo sapiens
cugaccaacucuugcguaa

SEQ ID NO: 1165223 - RNA, 19 nt, Homo sapiens
gcugcaaauuuaucaagca

SEQ ID NO: 1165224 - RNA, 19 nt, Homo sapiens
ccaggaagacaugaacaaa

SEQ ID NO: 1165225 - RNA, 19 nt, Homo sapiens
acccucaacuugccucaaa

SEQ ID NO: 1165226 - RNA, 19 nt, Homo sapiens
ucaacuugccucaaagaug

SEQ ID NO: 1165227 - RNA, 19 nt, Homo sapiens
aagcaucucugugaagaag

SEQ ID NO: 1165228 - RNA, 19 nt, Homo sapiens
agacaugaacaaagugaga

SEQ ID NO: 1165229 - RNA, 19 nt, Homo sapiens
gauaaggcucgagucuuga

SEQ ID NO: 1165230 - RNA, 19 nt, Homo sapiens
ggaagacaugaacaaagug

SEQ ID NO: 1165231 - RNA, 19 nt, Homo sapiens
gcaucucugugaagaagac

SEQ ID NO: 1165232 - RNA, 19 nt, Homo sapiens
uuaucaagcaucucuguga

SEQ ID NO: 1165233 - RNA, 19 nt, Homo sapiens
ggaaaaggacccaagucuu

SEQ ID NO: 1165234 - RNA, 19 nt, Homo sapiens
ugaaguuauuagccaggaa

SEQ ID NO: 1165235 - RNA, 19 nt, Homo sapiens
gccaggaagacaugaacaa

SEQ ID NO: 1165236 - RNA, 19 nt, Homo sapiens
guuauuagccaggaagaca

SEQ ID NO: 1165237 - RNA, 19 nt, Homo sapiens
gagucuugauugaccuugu

SEQ ID NO: 1165238 - RNA, 19 nt, Homo sapiens
aggcucgagucuugauuga

SEQ ID NO: 1165239 - RNA, 19 nt, Homo sapiens
caggaagacaugaacaaag

SEQ ID NO: 1165240 - RNA, 19 nt, Homo sapiens
agucuugauugaccuuguu

SEQ ID NO: 1165241 - RNA, 19 nt, Homo sapiens
ugaaauagcucaaccauua

SEQ ID NO: 1165242 - RNA, 19 nt, Homo sapiens
gaauaaagaugugagagua

SEQ ID NO: 1165243 - RNA, 19 nt, Homo sapiens
uaauagaacuugaccagua

SEQ ID NO: 1165244 - RNA, 19 nt, Homo sapiens
gaaguuaggauaucucaua

SEQ ID NO: 1165245 - RNA, 19 nt, Homo sapiens
acacugaacugaucaagua

SEQ ID NO: 1165246 - RNA, 19 nt, Homo sapiens
uagauaagauccugcuuua

SEQ ID NO: 1165247 - RNA, 19 nt, Homo sapiens
ucaaauaccugccuuacaa

SEQ ID NO: 1165248 - RNA, 19 nt, Homo sapiens
gcaguuacauauuuaggua

SEQ ID NO: 1165249 - RNA, 19 nt, Homo sapiens
gaugaaggguggcacauuu

SEQ ID NO: 1165250 - RNA, 19 nt, Homo sapiens
gaaaccaguuccaaacauu

SEQ ID NO: 1165251 - RNA, 19 nt, Homo sapiens
gaaguggauuugcauauug

SEQ ID NO: 1165252 - RNA, 19 nt, Homo sapiens
ggaagaagcgacaccaaua

SEQ ID NO: 1165253 - RNA, 19 nt, Homo sapiens
ggaagacccugaugacaug

SEQ ID NO: 1165254 - RNA, 19 nt, Homo sapiens
gcacccaugucacagaaua

SEQ ID NO: 1165255 - RNA, 19 nt, Homo sapiens
gauaaugcguuagcagaua

SEQ ID NO: 1165256 - RNA, 19 nt, Homo sapiens
aaaccuacccuaaccauua

SEQ ID NO: 1165257 - RNA, 19 nt, Homo sapiens
gcaauggccugaauagaag

SEQ ID NO: 1165258 - RNA, 19 nt, Homo sapiens
gggcauuucuugucuuauu

SEQ ID NO: 1165259 - RNA, 19 nt, Homo sapiens
guaauuauuugcuccuuug

SEQ ID NO: 1165260 - RNA, 19 nt, Homo sapiens
gccaugaacuccacagauu

SEQ ID NO: 1165261 - RNA, 19 nt, Homo sapiens
gucauacccuuauuucaua

SEQ ID NO: 1165262 - RNA, 19 nt, Homo sapiens
gaggaaagguuaauagaac

SEQ ID NO: 1165263 - RNA, 19 nt, Homo sapiens
gaagcaaguuacuaauguu

SEQ ID NO: 1165264 - RNA, 19 nt, Homo sapiens
gauggguacuuuaauuuga

SEQ ID NO: 1165265 - RNA, 19 nt, Homo sapiens
gcaaaggaauaaagaugug

SEQ ID NO: 1165266 - RNA, 19 nt, Homo sapiens
gaacugaucaaguacuuug

SEQ ID NO: 1165267 - RNA, 19 nt, Homo sapiens
aaagguggcauuacaaaua

SEQ ID NO: 1165268 - RNA, 19 nt, Homo sapiens
ccagaaagguggcauuaca

SEQ ID NO: 1165269 - RNA, 19 nt, Homo sapiens
gaagguaaauuugaugaag

SEQ ID NO: 1165270 - RNA, 19 nt, Homo sapiens
agaagaaggugauaagugu

SEQ ID NO: 1165271 - RNA, 19 nt, Homo sapiens
gaguaugucuccauuguuc

SEQ ID NO: 1165272 - RNA, 19 nt, Homo sapiens
agauaugcaugcugaaaua

SEQ ID NO: 1165273 - RNA, 19 nt, Homo sapiens
gaagacaccaugaauauac

SEQ ID NO: 1165274 - RNA, 19 nt, Homo sapiens
ggaacacucugaaccuaau

SEQ ID NO: 1165275 - RNA, 19 nt, Homo sapiens
gaagaagcgacaccaauau

SEQ ID NO: 1165276 - RNA, 19 nt, Homo sapiens
cuaauaaucccgaauaaug

SEQ ID NO: 1165277 - RNA, 19 nt, Homo sapiens
gcauagggauagauaagau

SEQ ID NO: 1165278 - RNA, 19 nt, Homo sapiens
guuaggauaucucauacaa

SEQ ID NO: 1165279 - RNA, 19 nt, Homo sapiens
ugaagcaaguuacuaaugu

SEQ ID NO: 1165280 - RNA, 19 nt, Homo sapiens
gcaaaagguucuacuaguu

SEQ ID NO: 1165281 - RNA, 19 nt, Homo sapiens
gaacgugguuuucauuuau

SEQ ID NO: 1165282 - RNA, 19 nt, Homo sapiens
gaauacuuguuacgcauug

SEQ ID NO: 1165283 - RNA, 19 nt, Homo sapiens
cagaaaccauuaagcaguu

SEQ ID NO: 1165284 - RNA, 19 nt, Homo sapiens
cauaagcgcuuuccuacuc

SEQ ID NO: 1165285 - RNA, 19 nt, Homo sapiens
ugaagucuaugaagcacua

SEQ ID NO: 1165286 - RNA, 19 nt, Homo sapiens
ugaaguggauuugcauauu

SEQ ID NO: 1165287 - RNA, 19 nt, Homo sapiens
gguccugccuucagaaaga

SEQ ID NO: 1165288 - RNA, 19 nt, Homo sapiens
gauaaccuuugaaccuuga

SEQ ID NO: 1165289 - RNA, 19 nt, Homo sapiens
gcucaaccauuauuacaag

SEQ ID NO: 1165290 - RNA, 19 nt, Homo sapiens
auaccugccuuacaagaua

SEQ ID NO: 1165291 - RNA, 19 nt, Homo sapiens
gacagauucguucuaaaua

SEQ ID NO: 1165292 - RNA, 19 nt, Homo sapiens
ccugauggguacuuuaauu

SEQ ID NO: 1165293 - RNA, 19 nt, Homo sapiens
ggagauguauucccaacag

SEQ ID NO: 1165294 - RNA, 19 nt, Homo sapiens
uuaaauuucucuccugaug

SEQ ID NO: 1165295 - RNA, 19 nt, Homo sapiens
caauauggaucacaaacca

SEQ ID NO: 1165296 - RNA, 19 nt, Homo sapiens
ugucacagaauacuuguua

SEQ ID NO: 1165297 - RNA, 19 nt, Homo sapiens
caacuuugcacuauguaaa

SEQ ID NO: 1165298 - RNA, 19 nt, Homo sapiens
uagcagauaugcauccaau

SEQ ID NO: 1165299 - RNA, 19 nt, Homo sapiens
gacaagaaguuaggauauc

SEQ ID NO: 1165300 - RNA, 19 nt, Homo sapiens
caaaagagcccauaaaucu

SEQ ID NO: 1165301 - RNA, 19 nt, Homo sapiens
gugggcauuucuugucuua

SEQ ID NO: 1165302 - RNA, 19 nt, Homo sapiens
ccauuaagcaguuacauau

SEQ ID NO: 1165303 - RNA, 19 nt, Homo sapiens
gaaauagcucaaccauuau

SEQ ID NO: 1165304 - RNA, 19 nt, Homo sapiens
ggucauacccuuauuucau

SEQ ID NO: 1165305 - RNA, 19 nt, Homo sapiens
ugacagauucguucuaaau

SEQ ID NO: 1165306 - RNA, 19 nt, Homo sapiens
ggcauuucuugucuuauuu

SEQ ID NO: 1165307 - RNA, 19 nt, Homo sapiens
gcauuuaauucacagucaa

SEQ ID NO: 1165308 - RNA, 19 nt, Homo sapiens
caaauacaacagucgaauu

SEQ ID NO: 1165309 - RNA, 19 nt, Homo sapiens
gcccauaaaucuuggucuu

SEQ ID NO: 1165310 - RNA, 19 nt, Homo sapiens
aaagagagucaaauacuga

SEQ ID NO: 1165311 - RNA, 19 nt, Homo sapiens
ggaauaaagaugugagagu

SEQ ID NO: 1165312 - RNA, 19 nt, Homo sapiens
ggauuugcauauugaagug

SEQ ID NO: 1165313 - RNA, 19 nt, Homo sapiens
aggauuaucuuacacugaa

SEQ ID NO: 1165314 - RNA, 19 nt, Homo sapiens
gaaagguggcauuacaaau

SEQ ID NO: 1165315 - RNA, 19 nt, Homo sapiens
uaacucacgcucauccuaa

SEQ ID NO: 1165316 - RNA, 19 nt, Homo sapiens
uuugguaacuggccucuuu

SEQ ID NO: 1165317 - RNA, 19 nt, Homo sapiens
gugauaaccuuugaaccuu

SEQ ID NO: 1165318 - RNA, 19 nt, Homo sapiens
uccaggaucugcucaauuc

SEQ ID NO: 1165319 - RNA, 19 nt, Homo sapiens
aaagaagacguuccagaaa

SEQ ID NO: 1165320 - RNA, 19 nt, Homo sapiens
uagcagccaucuugccaaa

SEQ ID NO: 1165321 - RNA, 19 nt, Homo sapiens
gagaagaagaaggugauaa

SEQ ID NO: 1165322 - RNA, 19 nt, Homo sapiens
gcacugagucuuucaacca

SEQ ID NO: 1165323 - RNA, 19 nt, Homo sapiens
uuacaugccuuacaaugag

SEQ ID NO: 1165324 - RNA, 19 nt, Homo sapiens
gaagcgacaccaauaugga

SEQ ID NO: 1165325 - RNA, 19 nt, Homo sapiens
gaacuccacagauuuguac

SEQ ID NO: 1165326 - RNA, 19 nt, Homo sapiens
ggugauaaguguugaaaau

SEQ ID NO: 1165327 - RNA, 19 nt, Homo sapiens
caagauaugcaugcugaaa

SEQ ID NO: 1165328 - RNA, 19 nt, Homo sapiens
uaugccaccuccucaauau

SEQ ID NO: 1165329 - RNA, 19 nt, Homo sapiens
aagaagacguuccagaaag

SEQ ID NO: 1165330 - RNA, 19 nt, Homo sapiens
gcagugcucugaggaaagg

SEQ ID NO: 1165331 - RNA, 19 nt, Homo sapiens
gaaugacgcagugcucuga

SEQ ID NO: 1165332 - RNA, 19 nt, Homo sapiens
cacaagugaucauggaaug

SEQ ID NO: 1165333 - RNA, 19 nt, Homo sapiens
ccguugggauuacuuauau

SEQ ID NO: 1165334 - RNA, 19 nt, Homo sapiens
caccaucucagcaauguuu

SEQ ID NO: 1165335 - RNA, 19 nt, Homo sapiens
gugauuuccugaugaguca

SEQ ID NO: 1165336 - RNA, 19 nt, Homo sapiens
ucccguugcuccaaacuaa

SEQ ID NO: 1165337 - RNA, 19 nt, Homo sapiens
ugucaguguuuaaagguuu

SEQ ID NO: 1165338 - RNA, 19 nt, Homo sapiens
guggaacacucugaaccua

SEQ ID NO: 1165339 - RNA, 19 nt, Homo sapiens
gggccugucauuucagaua

SEQ ID NO: 1165340 - RNA, 19 nt, Homo sapiens
gggaagacccugaugacau

SEQ ID NO: 1165341 - RNA, 19 nt, Homo sapiens
ggaagaaggugaucgauga

SEQ ID NO: 1165342 - RNA, 19 nt, Homo sapiens
ggacaugaaugcuggcuuu

SEQ ID NO: 1165343 - RNA, 19 nt, Homo sapiens
gaagacacccacacgauua

SEQ ID NO: 1165344 - RNA, 19 nt, Homo sapiens
gagagugccugugacauua

SEQ ID NO: 1165345 - RNA, 19 nt, Homo sapiens
gcacuucccugucaucaga

SEQ ID NO: 1165346 - RNA, 19 nt, Homo sapiens
ccacagcccucauccagua

SEQ ID NO: 1165347 - RNA, 19 nt, Homo sapiens
ugacacaucuugaccauga

SEQ ID NO: 1165348 - RNA, 19 nt, Homo sapiens
gcaaguacaucugccagua

SEQ ID NO: 1165349 - RNA, 19 nt, Homo sapiens
gagaacagcguuucaguuu

SEQ ID NO: 1165350 - RNA, 19 nt, Homo sapiens
caaagaagguacugcaguu

SEQ ID NO: 1165351 - RNA, 19 nt, Homo sapiens
gcuaaggucuccaaauuca

SEQ ID NO: 1165352 - RNA, 19 nt, Homo sapiens
gggaaaggcugauggugaa

SEQ ID NO: 1165353 - RNA, 19 nt, Homo sapiens
ccacagcucuugaccaaug

SEQ ID NO: 1165354 - RNA, 19 nt, Homo sapiens
gaacaacguccaaagaaau

SEQ ID NO: 1165355 - RNA, 19 nt, Homo sapiens
ggucauggauccugaacaa

SEQ ID NO: 1165356 - RNA, 19 nt, Homo sapiens
cagaagcuuugaaggaaua

SEQ ID NO: 1165357 - RNA, 19 nt, Homo sapiens
gagcaggccuccagaaucu

SEQ ID NO: 1165358 - RNA, 19 nt, Homo sapiens
ggccaucgcucaccaauag

SEQ ID NO: 1165359 - RNA, 19 nt, Homo sapiens
ugagaaggcuccacccaaa

SEQ ID NO: 1165360 - RNA, 19 nt, Homo sapiens
gaaggaggguacaaaucaa

SEQ ID NO: 1165361 - RNA, 19 nt, Homo sapiens
aauagcaucugaagucuuu

SEQ ID NO: 1165362 - RNA, 19 nt, Homo sapiens
agaaagugcuggugcguuu

SEQ ID NO: 1165363 - RNA, 19 nt, Homo sapiens
gaacagcguuucaguuuug

SEQ ID NO: 1165364 - RNA, 19 nt, Homo sapiens
uggcuaaggucuccaaauu

SEQ ID NO: 1165365 - RNA, 19 nt, Homo sapiens
gagaacaacguccaaagaa

SEQ ID NO: 1165366 - RNA, 19 nt, Homo sapiens
gaaaagggauaacuacgaa

SEQ ID NO: 1165367 - RNA, 19 nt, Homo sapiens
gcacagcuccgacccaaga

SEQ ID NO: 1165368 - RNA, 19 nt, Homo sapiens
ggacagaggagaacaucuu

SEQ ID NO: 1165369 - RNA, 19 nt, Homo sapiens
ccaaagggaaucugacuaa

SEQ ID NO: 1165370 - RNA, 19 nt, Homo sapiens
ucacgaagcucaucaccau

SEQ ID NO: 1165371 - RNA, 19 nt, Homo sapiens
ggaagcggcugaccaaagg

SEQ ID NO: 1165372 - RNA, 19 nt, Homo sapiens
guaaaucagugcccuccuu

SEQ ID NO: 1165373 - RNA, 19 nt, Homo sapiens
gaucaucuuuggcaagugu

SEQ ID NO: 1165374 - RNA, 19 nt, Homo sapiens
ggagaacaacguccaaaga

SEQ ID NO: 1165375 - RNA, 19 nt, Homo sapiens
guacugagucuggguauuu

SEQ ID NO: 1165376 - RNA, 19 nt, Homo sapiens
uggcaaaccucaccgaaga

SEQ ID NO: 1165377 - RNA, 19 nt, Homo sapiens
ggaagaggccagagaaauc

SEQ ID NO: 1165378 - RNA, 19 nt, Homo sapiens
gacauuaccugaaagaaaa

SEQ ID NO: 1165379 - RNA, 19 nt, Homo sapiens
caaaucaaacgaagaguau

SEQ ID NO: 1165380 - RNA, 19 nt, Homo sapiens
caagaaggcugagggaagu

SEQ ID NO: 1165381 - RNA, 19 nt, Homo sapiens
ccagagaaaucccacuuag

SEQ ID NO: 1165382 - RNA, 19 nt, Homo sapiens
agaacaacguccaaagaaa

SEQ ID NO: 1165383 - RNA, 19 nt, Homo sapiens
gagccguggucccaaauga

SEQ ID NO: 1165384 - RNA, 19 nt, Homo sapiens
agaaaucucugacacaucu

SEQ ID NO: 1165385 - RNA, 19 nt, Homo sapiens
caucugaagucuuugugaa

SEQ ID NO: 1165386 - RNA, 19 nt, Homo sapiens
auacugacauccuucauga

SEQ ID NO: 1165387 - RNA, 19 nt, Homo sapiens
acugccagcugaaauaaua

SEQ ID NO: 1165388 - RNA, 19 nt, Homo sapiens
cgaagaguauguauaugug

SEQ ID NO: 1165389 - RNA, 19 nt, Homo sapiens
caaacgaagaguauguaua

SEQ ID NO: 1165390 - RNA, 19 nt, Homo sapiens
gcaaagagacauacaccau

SEQ ID NO: 1165391 - RNA, 19 nt, Homo sapiens
gagaacacaggaccaguuu

SEQ ID NO: 1165392 - RNA, 19 nt, Homo sapiens
gcacccacauguugacugu

SEQ ID NO: 1165393 - RNA, 19 nt, Homo sapiens
ggaagagccaccugccuuu

SEQ ID NO: 1165394 - RNA, 19 nt, Homo sapiens
agagucagauugagcauga

SEQ ID NO: 1165395 - RNA, 19 nt, Homo sapiens
cagcugaaauaauacaaug

SEQ ID NO: 1165396 - RNA, 19 nt, Homo sapiens
ggagggagcuagaaaugcu

SEQ ID NO: 1165397 - RNA, 19 nt, Homo sapiens
ggaagaggaggaaagagaa

SEQ ID NO: 1165398 - RNA, 19 nt, Homo sapiens
gcaaucgaauuaccuuugg

SEQ ID NO: 1165399 - RNA, 19 nt, Homo sapiens
cgaaggaggguacaaauca

SEQ ID NO: 1165400 - RNA, 19 nt, Homo sapiens
gcucagaagcuuugaagga

SEQ ID NO: 1165401 - RNA, 19 nt, Homo sapiens
ugacauuaccugaaagaaa

SEQ ID NO: 1165402 - RNA, 19 nt, Homo sapiens
ccacacaucuccagaagcu

SEQ ID NO: 1165403 - RNA, 19 nt, Homo sapiens
ucuccaagcucuagaaauc

SEQ ID NO: 1165404 - RNA, 19 nt, Homo sapiens
gaaguggaacccaaggaaa

SEQ ID NO: 1165405 - RNA, 19 nt, Homo sapiens
ccgcagcagucacguguuu

SEQ ID NO: 1165406 - RNA, 19 nt, Homo sapiens
caacacaguucuccaagcu

SEQ ID NO: 1165407 - RNA, 19 nt, Homo sapiens
acucagaccuggacgaaga

SEQ ID NO: 1165408 - RNA, 19 nt, Homo sapiens
aagcaaacguguccuuuca

SEQ ID NO: 1165409 - RNA, 19 nt, Homo sapiens
uauggcagcuuguccuuga

SEQ ID NO: 1165410 - RNA, 19 nt, Homo sapiens
gcagccggcaaucgaauua

SEQ ID NO: 1165411 - RNA, 19 nt, Homo sapiens
gcuggaagccgaagaagga

SEQ ID NO: 1165412 - RNA, 19 nt, Homo sapiens
gaagguacggacucaaaga

SEQ ID NO: 1165413 - RNA, 19 nt, Homo sapiens
gagcagagccccaacguuu

SEQ ID NO: 1165414 - RNA, 19 nt, Homo sapiens
gcaaagacacagccuccaa

SEQ ID NO: 1165415 - RNA, 19 nt, Homo sapiens
cagaagaggcacacaagaa

SEQ ID NO: 1165416 - RNA, 19 nt, Homo sapiens
ugacauccuucaugacguu

SEQ ID NO: 1165417 - RNA, 19 nt, Homo sapiens
ccugugacauuaccugaaa

SEQ ID NO: 1165418 - RNA, 19 nt, Homo sapiens
aaccaagccugaacaauca

SEQ ID NO: 1165419 - RNA, 19 nt, Homo sapiens
cuaagcacaugaagucgaa

SEQ ID NO: 1165420 - RNA, 19 nt, Homo sapiens
caaggcagcucagcaacug

SEQ ID NO: 1165421 - RNA, 19 nt, Homo sapiens
gcaauguacaccacccuuu

SEQ ID NO: 1165422 - RNA, 19 nt, Homo sapiens
gaacacaggaccaguuugc

SEQ ID NO: 1165423 - RNA, 19 nt, Homo sapiens
ccacuuuccucgaaucauc

SEQ ID NO: 1165424 - RNA, 19 nt, Homo sapiens
gcugguuggugcauaaguu

SEQ ID NO: 1165425 - RNA, 19 nt, Homo sapiens
gucaguuggugcuauuuaa

SEQ ID NO: 1165426 - RNA, 19 nt, Homo sapiens
gaagcaaacguguccuuuc

SEQ ID NO: 1165427 - RNA, 19 nt, Homo sapiens
uaacuacgaagcccacaaa

SEQ ID NO: 1165428 - RNA, 19 nt, Homo sapiens
aaaccaagccugaacaauc

SEQ ID NO: 1165429 - RNA, 19 nt, Homo sapiens
uguuguaccuucccaugua

SEQ ID NO: 1165430 - RNA, 19 nt, Homo sapiens
guacaaaucaaacgaagag

SEQ ID NO: 1165431 - RNA, 19 nt, Homo sapiens
ucaccucccuucacugguu

SEQ ID NO: 1165432 - RNA, 19 nt, Homo sapiens
agaccaauaugccguccua

SEQ ID NO: 1165433 - RNA, 19 nt, Homo sapiens
gcaguuaccugugccuuuu

SEQ ID NO: 1165434 - RNA, 19 nt, Homo sapiens
ccacugagcgugaagaaag

SEQ ID NO: 1165435 - RNA, 19 nt, Homo sapiens
ugagaagacugaggaguuc

SEQ ID NO: 1165436 - RNA, 19 nt, Homo sapiens
gcaaacacucgcuaaccaa

SEQ ID NO: 1165437 - RNA, 19 nt, Homo sapiens
gaaagugagcaaagagaca

SEQ ID NO: 1165438 - RNA, 19 nt, Homo sapiens
ggaagcaaacguguccuuu

SEQ ID NO: 1165439 - RNA, 19 nt, Homo sapiens
uggcagagauggcccaauc

SEQ ID NO: 1165440 - RNA, 19 nt, Homo sapiens
caaaaggggugaucuacga

SEQ ID NO: 1165441 - RNA, 19 nt, Homo sapiens
gcagaaagauggugaauau

SEQ ID NO: 1165442 - RNA, 19 nt, Homo sapiens
gcaaaucauucaggaaaua

SEQ ID NO: 1165443 - RNA, 19 nt, Homo sapiens
gaucgaagguucugaggaa

SEQ ID NO: 1165444 - RNA, 19 nt, Homo sapiens
cgacuucucugguuaccua

SEQ ID NO: 1165445 - RNA, 19 nt, Homo sapiens
gagcaaaucauucaggaaa

SEQ ID NO: 1165446 - RNA, 19 nt, Homo sapiens
ggacagcgaggaugaagaa

SEQ ID NO: 1165447 - RNA, 19 nt, Homo sapiens
gaaagauggugaauauggu

SEQ ID NO: 1165448 - RNA, 19 nt, Homo sapiens
gaacauacucacagcgauu

SEQ ID NO: 1165449 - RNA, 19 nt, Homo sapiens
ccaaguuccucaacaucua

SEQ ID NO: 1165450 - RNA, 19 nt, Homo sapiens
aaacugcacugccaugaau

SEQ ID NO: 1165451 - RNA, 19 nt, Homo sapiens
caagaaacaugggccaguu

SEQ ID NO: 1165452 - RNA, 19 nt, Homo sapiens
gauggugaauaugguauaa

SEQ ID NO: 1165453 - RNA, 19 nt, Homo sapiens
ucaccgacuucucugguua

SEQ ID NO: 1165454 - RNA, 19 nt, Homo sapiens
acaccucgcucccaagaaa

SEQ ID NO: 1165455 - RNA, 19 nt, Homo sapiens
caggaaauauggaugaaca

SEQ ID NO: 1165456 - RNA, 19 nt, Homo sapiens
gcagggagcaaaucauuca

SEQ ID NO: 1165457 - RNA, 19 nt, Homo sapiens
ccagagggaagacagcuua

SEQ ID NO: 1165458 - RNA, 19 nt, Homo sapiens
uaaccaaacuccugcaaaa

SEQ ID NO: 1165459 - RNA, 19 nt, Homo sapiens
gaaacugcacugccaugaa

SEQ ID NO: 1165460 - RNA, 19 nt, Homo sapiens
cgaagguucugaggaaaga

SEQ ID NO: 1165461 - RNA, 19 nt, Homo sapiens
agaaggugcuggacgaaug

SEQ ID NO: 1165462 - RNA, 19 nt, Homo sapiens
gggcaagauuaccaaaugu

SEQ ID NO: 1165463 - RNA, 19 nt, Homo sapiens
caagauuaccaaaugugua

SEQ ID NO: 1165464 - RNA, 19 nt, Homo sapiens
gcgcagggagcaaaucauu

SEQ ID NO: 1165465 - RNA, 19 nt, Homo sapiens
gaauccaaguuccucaaca

SEQ ID NO: 1165466 - RNA, 19 nt, Homo sapiens
ucucagcgcucaccgacuu

SEQ ID NO: 1165467 - RNA, 19 nt, Homo sapiens
ggacaccucgcucccaaga

SEQ ID NO: 1165468 - RNA, 19 nt, Homo sapiens
gcaaaaucaucgucaacaa

SEQ ID NO: 1165469 - RNA, 19 nt, Homo sapiens
gcaagauuaccaaaugugu

SEQ ID NO: 1165470 - RNA, 19 nt, Homo sapiens
ccucggcauucuacgauaa

SEQ ID NO: 1165471 - RNA, 19 nt, Homo sapiens
gaaacaugggccaguucua

SEQ ID NO: 1165472 - RNA, 19 nt, Homo sapiens
cagcgaggaugaagaagag

SEQ ID NO: 1165473 - RNA, 19 nt, Homo sapiens
uuaaaugccaaccuaauga

SEQ ID NO: 1165474 - RNA, 19 nt, Homo sapiens
aagcagagaugcaaaauca

SEQ ID NO: 1165475 - RNA, 19 nt, Homo sapiens
ugggcaagauuaccaaaug

SEQ ID NO: 1165476 - RNA, 19 nt, Homo sapiens
acgcauguguucccaagaa

SEQ ID NO: 1165477 - RNA, 19 nt, Homo sapiens
uuacucagcuuugcaaguc

SEQ ID NO: 1165478 - RNA, 19 nt, Homo sapiens
gagcugcccugcuguucgu

SEQ ID NO: 1165479 - RNA, 19 nt, Homo sapiens
uaaaugccaaccuaaugaa

SEQ ID NO: 1165480 - RNA, 19 nt, Homo sapiens
agaaagauggugaauaugg

SEQ ID NO: 1165481 - RNA, 19 nt, Homo sapiens
gcagagcucgcagaaagga

SEQ ID NO: 1165482 - RNA, 19 nt, Homo sapiens
cuccuagucuccuuuaaau

SEQ ID NO: 1165483 - RNA, 19 nt, Homo sapiens
ggaaauauggaugaacagu

SEQ ID NO: 1165484 - RNA, 19 nt, Homo sapiens
aaagauggugaauauggua

SEQ ID NO: 1165485 - RNA, 19 nt, Homo sapiens
cgucaacaaucaccauuuu

SEQ ID NO: 1165486 - RNA, 19 nt, Homo sapiens
gcaggaggacccaggaaag

SEQ ID NO: 1165487 - RNA, 19 nt, Homo sapiens
gugaagaccaggagcugaa

SEQ ID NO: 1165488 - RNA, 19 nt, Homo sapiens
caaguccuaucccgaaggu

SEQ ID NO: 1165489 - RNA, 19 nt, Homo sapiens
gagcgcagggagcaaauca

SEQ ID NO: 1165490 - RNA, 19 nt, Homo sapiens
gcuaugggaagcagagaug

SEQ ID NO: 1165491 - RNA, 19 nt, Homo sapiens
ccaaggacuuccgcgacuu

SEQ ID NO: 1165492 - RNA, 19 nt, Homo sapiens
ggcagccuuugcuuacauu

SEQ ID NO: 1165493 - RNA, 19 nt, Homo sapiens
gaagcagaaagauggugaa

SEQ ID NO: 1165494 - RNA, 19 nt, Homo sapiens
ggagcaaaucauucaggaa

SEQ ID NO: 1165495 - RNA, 19 nt, Homo sapiens
agccuuugcuuacauuaga

SEQ ID NO: 1165496 - RNA, 19 nt, Homo sapiens
aauccaaguuccucaacau

SEQ ID NO: 1165497 - RNA, 19 nt, Homo sapiens
ccuccuagucuccuuuaaa

SEQ ID NO: 1165498 - RNA, 19 nt, Homo sapiens
gauuaccaaauguguaguu

SEQ ID NO: 1165499 - RNA, 19 nt, Homo sapiens
guccuggucugcuccaaag

SEQ ID NO: 1165500 - RNA, 19 nt, Homo sapiens
ggcaggaggacccaggaaa

SEQ ID NO: 1165501 - RNA, 19 nt, Homo sapiens
aaacaugggccaguucuac

SEQ ID NO: 1165502 - RNA, 19 nt, Homo sapiens
ggucugcuccaaagagauc

SEQ ID NO: 1165503 - RNA, 19 nt, Homo sapiens
aaaucaucgucaacaauca

SEQ ID NO: 1165504 - RNA, 19 nt, Homo sapiens
guccaggaagcaguaaaua

SEQ ID NO: 1165505 - RNA, 19 nt, Homo sapiens
ggcauucuacgauaagugu

SEQ ID NO: 1165506 - RNA, 19 nt, Homo sapiens
ggaggacagcgaggaugaa

SEQ ID NO: 1165507 - RNA, 19 nt, Homo sapiens
uccuuuaaaugccaaccua

SEQ ID NO: 1165508 - RNA, 19 nt, Homo sapiens
ccuagucuccuuuaaaugc

SEQ ID NO: 1165509 - RNA, 19 nt, Homo sapiens
caguaaauaccuccuaguc

SEQ ID NO: 1165510 - RNA, 19 nt, Homo sapiens
gcgcccuggucaucagaga

SEQ ID NO: 1165511 - RNA, 19 nt, Homo sapiens
gcagccuuugcuuacauua

SEQ ID NO: 1165512 - RNA, 19 nt, Homo sapiens
ggaauucuuguuagcaacu

SEQ ID NO: 1165513 - RNA, 19 nt, Homo sapiens
aaugccaaccuaaugaauu

SEQ ID NO: 1165514 - RNA, 19 nt, Homo sapiens
uuuaaaugccaaccuaaug

SEQ ID NO: 1165515 - RNA, 19 nt, Homo sapiens
gcaguaaauaccuccuagu

SEQ ID NO: 1165516 - RNA, 19 nt, Homo sapiens
aagauuaccaaauguguag

SEQ ID NO: 1165517 - RNA, 19 nt, Homo sapiens
auauacaguuccauagaag

SEQ ID NO: 1165518 - RNA, 19 nt, Homo sapiens
uggugaauaugguauaaac

SEQ ID NO: 1165519 - RNA, 19 nt, Homo sapiens
ugaaacugcacugccauga

SEQ ID NO: 1165520 - RNA, 19 nt, Homo sapiens
cuaaccaaacuccugcaaa

SEQ ID NO: 1165521 - RNA, 19 nt, Homo sapiens
ggcaagauuaccaaaugug

SEQ ID NO: 1165522 - RNA, 19 nt, Homo sapiens
ggacaaaucuguacucuuu

SEQ ID NO: 1165523 - RNA, 19 nt, Homo sapiens
gaacauaccuuugaagaga

SEQ ID NO: 1165524 - RNA, 19 nt, Homo sapiens
ccaagaaucuccuuuaauu

SEQ ID NO: 1165525 - RNA, 19 nt, Homo sapiens
gcacaaaggugacaaugga

SEQ ID NO: 1165526 - RNA, 19 nt, Homo sapiens
ggagguggauggucuuuaa

SEQ ID NO: 1165527 - RNA, 19 nt, Homo sapiens
gaagaccuguucuaucaaa

SEQ ID NO: 1165528 - RNA, 19 nt, Homo sapiens
gagaggagacuaugaagua

SEQ ID NO: 1165529 - RNA, 19 nt, Homo sapiens
ggagagagcaucuucauug

SEQ ID NO: 1165530 - RNA, 19 nt, Homo sapiens
gaauauggauggaucacuu

SEQ ID NO: 1165531 - RNA, 19 nt, Homo sapiens
gaacgacaaugaaauguac

SEQ ID NO: 1165532 - RNA, 19 nt, Homo sapiens
gccauuuacuuacauguua

SEQ ID NO: 1165533 - RNA, 19 nt, Homo sapiens
ugacauugcuuucaguauu

SEQ ID NO: 1165534 - RNA, 19 nt, Homo sapiens
gcgaguggcuaauuugaaa

SEQ ID NO: 1165535 - RNA, 19 nt, Homo sapiens
gaccaaagcaucaaaguga

SEQ ID NO: 1165536 - RNA, 19 nt, Homo sapiens
ccgaagaccuguucuauca

SEQ ID NO: 1165537 - RNA, 19 nt, Homo sapiens
gagagagcaucuucauuga

SEQ ID NO: 1165538 - RNA, 19 nt, Homo sapiens
gcaagcagcugaggccauu

SEQ ID NO: 1165539 - RNA, 19 nt, Homo sapiens
gaaauaauggcaaacaguu

SEQ ID NO: 1165540 - RNA, 19 nt, Homo sapiens
caaagcagacacucaauaa

SEQ ID NO: 1165541 - RNA, 19 nt, Homo sapiens
gacauugcuuucaguauuu

SEQ ID NO: 1165542 - RNA, 19 nt, Homo sapiens
ggacagaaaccaaacauag

SEQ ID NO: 1165543 - RNA, 19 nt, Homo sapiens
uacagaagcuggacagaaa

SEQ ID NO: 1165544 - RNA, 19 nt, Homo sapiens
ggacaaauggucugccuuu

SEQ ID NO: 1165545 - RNA, 19 nt, Homo sapiens
gcacaaagcagacacucaa

SEQ ID NO: 1165546 - RNA, 19 nt, Homo sapiens
caaguacuauggugauuug

SEQ ID NO: 1165547 - RNA, 19 nt, Homo sapiens
gcaaacgguugaacacaau

SEQ ID NO: 1165548 - RNA, 19 nt, Homo sapiens
gagagcaucuucauugaca

SEQ ID NO: 1165549 - RNA, 19 nt, Homo sapiens
ggacucugccauuuacuua

SEQ ID NO: 1165550 - RNA, 19 nt, Homo sapiens
uaauaugacucaaggauuc

SEQ ID NO: 1165551 - RNA, 19 nt, Homo sapiens
gcuaagaaauggagcuaau

SEQ ID NO: 1165552 - RNA, 19 nt, Homo sapiens
ucaagcagcuaaacaugaa

SEQ ID NO: 1165553 - RNA, 19 nt, Homo sapiens
gccauuauaugaagaguau

SEQ ID NO: 1165554 - RNA, 19 nt, Homo sapiens
gaucuuguauggaauaugg

SEQ ID NO: 1165555 - RNA, 19 nt, Homo sapiens
gaaguucuuuguaucuguu

SEQ ID NO: 1165556 - RNA, 19 nt, Homo sapiens
ggacaaguuuaaccacgaa

SEQ ID NO: 1165557 - RNA, 19 nt, Homo sapiens
gagcaugccugauagaaac

SEQ ID NO: 1165558 - RNA, 19 nt, Homo sapiens
ggugacaggucuaaagaga

SEQ ID NO: 1165559 - RNA, 19 nt, Homo sapiens
ugaaagaccagaacaagaa

SEQ ID NO: 1165560 - RNA, 19 nt, Homo sapiens
ugacaggucuaaagagaga

SEQ ID NO: 1165561 - RNA, 19 nt, Homo sapiens
gaucaucuguugcauaugc

SEQ ID NO: 1165562 - RNA, 19 nt, Homo sapiens
caacuacuuugagcccuua

SEQ ID NO: 1165563 - RNA, 19 nt, Homo sapiens
ggagaugaagcgagagaua

SEQ ID NO: 1165564 - RNA, 19 nt, Homo sapiens
gggcaaaguugaugaaugc

SEQ ID NO: 1165565 - RNA, 19 nt, Homo sapiens
ggaaagucauucaguggau

SEQ ID NO: 1165566 - RNA, 19 nt, Homo sapiens
guucagggauaaucuaaau

SEQ ID NO: 1165567 - RNA, 19 nt, Homo sapiens
uaaggccacugcucaacua

SEQ ID NO: 1165568 - RNA, 19 nt, Homo sapiens
aaauggagcuaaugaagga

SEQ ID NO: 1165569 - RNA, 19 nt, Homo sapiens
ggaacgacaaugaaaugua

SEQ ID NO: 1165570 - RNA, 19 nt, Homo sapiens
ggagauaaagcauaugaau

SEQ ID NO: 1165571 - RNA, 19 nt, Homo sapiens
gcaucucuguuccauguuu

SEQ ID NO: 1165572 - RNA, 19 nt, Homo sapiens
caaacaagcacucacgauu

SEQ ID NO: 1165573 - RNA, 19 nt, Homo sapiens
ccacaagaaugcuuauuac

SEQ ID NO: 1165574 - RNA, 19 nt, Homo sapiens
cccagucucuuaaaucuuu

SEQ ID NO: 1165575 - RNA, 19 nt, Homo sapiens
aaaccaagaaucuccuuua

SEQ ID NO: 1165576 - RNA, 19 nt, Homo sapiens
gaauggaacgacaaugaaa

SEQ ID NO: 1165577 - RNA, 19 nt, Homo sapiens
aaucagcucuuggagauaa

SEQ ID NO: 1165578 - RNA, 19 nt, Homo sapiens
gauauuagcaaaggagaaa

SEQ ID NO: 1165579 - RNA, 19 nt, Homo sapiens
ccgaucaucuguugcauau

SEQ ID NO: 1165580 - RNA, 19 nt, Homo sapiens
acaaugaaauguaccuguu

SEQ ID NO: 1165581 - RNA, 19 nt, Homo sapiens
ugacaacagccuagaguuu

SEQ ID NO: 1165582 - RNA, 19 nt, Homo sapiens
ggauuugacuucuguucug

SEQ ID NO: 1165583 - RNA, 19 nt, Homo sapiens
ucagagaucggaagaagaa

SEQ ID NO: 1165584 - RNA, 19 nt, Homo sapiens
aaccaagaaucuccuuuaa

SEQ ID NO: 1165585 - RNA, 19 nt, Homo sapiens
agaagacaaugaaacagaa

SEQ ID NO: 1165586 - RNA, 19 nt, Homo sapiens
uaagaaauggagcuaauga

SEQ ID NO: 1165587 - RNA, 19 nt, Homo sapiens
acaccaauauuacugaaga

SEQ ID NO: 1165588 - RNA, 19 nt, Homo sapiens
ucaaggaggccgagaaguu

SEQ ID NO: 1165589 - RNA, 19 nt, Homo sapiens
gaucugaggucggcaagca

SEQ ID NO: 1165590 - RNA, 19 nt, Homo sapiens
gacaagagcaaacgguuga

SEQ ID NO: 1165591 - RNA, 19 nt, Homo sapiens
ucacuugcuucuuggaauu

SEQ ID NO: 1165592 - RNA, 19 nt, Homo sapiens
gaccuguucuaucaaaguu

SEQ ID NO: 1165593 - RNA, 19 nt, Homo sapiens
aaacucauuucuacuguuc

SEQ ID NO: 1165594 - RNA, 19 nt, Homo sapiens
gagauaaagcauaugaaug

SEQ ID NO: 1165595 - RNA, 19 nt, Homo sapiens
ccgcaucucuguuccaugu

SEQ ID NO: 1165596 - RNA, 19 nt, Homo sapiens
gcacaaccuuuucugcuaa

SEQ ID NO: 1165597 - RNA, 19 nt, Homo sapiens
gaaugccuauccuuccuau

SEQ ID NO: 1165598 - RNA, 19 nt, Homo sapiens
ggaacaggccaagacauuu

SEQ ID NO: 1165599 - RNA, 19 nt, Homo sapiens
ggcaagagcaaaucauuau

SEQ ID NO: 1165600 - RNA, 19 nt, Homo sapiens
ggucuucagugcucucaga

SEQ ID NO: 1165601 - RNA, 19 nt, Homo sapiens
ccuuaugccuccaucgaua

SEQ ID NO: 1165602 - RNA, 19 nt, Homo sapiens
cagaaacuguucaauaugc

SEQ ID NO: 1165603 - RNA, 19 nt, Homo sapiens
ugaaggcccucugcacaaa

SEQ ID NO: 1165604 - RNA, 19 nt, Homo sapiens
aaacaagcacucacgauug

SEQ ID NO: 1165605 - RNA, 19 nt, Homo sapiens
uaaacuuccugcucaaaca

SEQ ID NO: 1165606 - RNA, 19 nt, Homo sapiens
ggucuucugucacccgauu

SEQ ID NO: 1165607 - RNA, 19 nt, Homo sapiens
gaagacaaugaaacagaaa

SEQ ID NO: 1165608 - RNA, 19 nt, Homo sapiens
gacagaaaccaaacauaga

SEQ ID NO: 1165609 - RNA, 19 nt, Homo sapiens
ccauauggcugauuguuuu

SEQ ID NO: 1165610 - RNA, 19 nt, Homo sapiens
gauaaagcauaugaaugga

SEQ ID NO: 1165611 - RNA, 19 nt, Homo sapiens
aaagugaggauaagccuaa

SEQ ID NO: 1165612 - RNA, 19 nt, Homo sapiens
caaguucaaaggcugauaa

SEQ ID NO: 1165613 - RNA, 19 nt, Homo sapiens
cccaggaaauguucagaaa

SEQ ID NO: 1165614 - RNA, 19 nt, Homo sapiens
caugcuuucuucacaguaa

SEQ ID NO: 1165615 - RNA, 19 nt, Homo sapiens
gggaaaguguguauuuggu

SEQ ID NO: 1165616 - RNA, 19 nt, Homo sapiens
caacauggccaaggagaga

SEQ ID NO: 1165617 - RNA, 19 nt, Homo sapiens
gauagugguuggcauuguc

SEQ ID NO: 1165618 - RNA, 19 nt, Homo sapiens
acaaagcagacacucaaua

SEQ ID NO: 1165619 - RNA, 19 nt, Homo sapiens
cuacagugauguuuggaau

SEQ ID NO: 1165620 - RNA, 19 nt, Homo sapiens
acaaggauauaucauugga

SEQ ID NO: 1165621 - RNA, 19 nt, Homo sapiens
ucaagaagacaaugaaaca

SEQ ID NO: 1165622 - RNA, 19 nt, Homo sapiens
gaggaaagaguaugaauuu

SEQ ID NO: 1165623 - RNA, 19 nt, Homo sapiens
aagcaaucguguugaauua

SEQ ID NO: 1165624 - RNA, 19 nt, Homo sapiens
guuaaaugcucgagaggaa

SEQ ID NO: 1165625 - RNA, 19 nt, Homo sapiens
guaugaauuugccauguga

SEQ ID NO: 1165626 - RNA, 19 nt, Homo sapiens
gaauuugccaugugauuug

SEQ ID NO: 1165627 - RNA, 19 nt, Homo sapiens
gaguauacuuggugaggaa

SEQ ID NO: 1165628 - RNA, 19 nt, Homo sapiens
ugaauuaggaguauacuug

SEQ ID NO: 1165629 - RNA, 19 nt, Homo sapiens
ggucauggguucauuucau

SEQ ID NO: 1165630 - RNA, 19 nt, Homo sapiens
gacuaaaggaagauacuua

SEQ ID NO: 1165631 - RNA, 19 nt, Homo sapiens
ggaaagaguaugaauuugc

SEQ ID NO: 1165632 - RNA, 19 nt, Homo sapiens
aaaggaagauacuuacucu

SEQ ID NO: 1165633 - RNA, 19 nt, Homo sapiens
uaagcaaucguguugaauu

SEQ ID NO: 1165634 - RNA, 19 nt, Homo sapiens
gcaaucguguugaauuagg

SEQ ID NO: 1165635 - RNA, 19 nt, Homo sapiens
ggucuucgcccaggacuuu

SEQ ID NO: 1165636 - RNA, 19 nt, Homo sapiens
gaggaaaggauuuugauuu

SEQ ID NO: 1165637 - RNA, 19 nt, Homo sapiens
gucauggguucauuucauu

SEQ ID NO: 1165638 - RNA, 19 nt, Homo sapiens
gaaggacaacucccagcuu

SEQ ID NO: 1165639 - RNA, 19 nt, Homo sapiens
aguagggacuggaagauau

SEQ ID NO: 1165640 - RNA, 19 nt, Homo sapiens
ggacuuuaccgccagugaa

SEQ ID NO: 1165641 - RNA, 19 nt, Homo sapiens
gccaggccaugcccaagaa

SEQ ID NO: 1165642 - RNA, 19 nt, Homo sapiens
gaguaugaauuugccaugu

SEQ ID NO: 1165643 - RNA, 19 nt, Homo sapiens
ggaggucauggguucauuu

SEQ ID NO: 1165644 - RNA, 19 nt, Homo sapiens
gaaaggaaggaaggaagga

SEQ ID NO: 1165645 - RNA, 19 nt, Homo sapiens
caaagaaaucauaggugaa

SEQ ID NO: 1165646 - RNA, 19 nt, Homo sapiens
gcugcacccugcuaucuca

SEQ ID NO: 1165647 - RNA, 19 nt, Homo sapiens
ugaggaaagaguaugaauu

SEQ ID NO: 1165648 - RNA, 19 nt, Homo sapiens
gauaugucaucugcugguu

SEQ ID NO: 1165649 - RNA, 19 nt, Homo sapiens
gagcgcggacagugaguuu

SEQ ID NO: 1165650 - RNA, 19 nt, Homo sapiens
uuuaagcaaucguguugaa

SEQ ID NO: 1165651 - RNA, 19 nt, Homo sapiens
cagcccgucuuccggaauu

SEQ ID NO: 1165652 - RNA, 19 nt, Homo sapiens
ugaauuugccaugugauuu

SEQ ID NO: 1165653 - RNA, 19 nt, Homo sapiens
gggagaggcugaggaacuc

SEQ ID NO: 1165654 - RNA, 19 nt, Homo sapiens
uaugucaucugcugguugu

SEQ ID NO: 1165655 - RNA, 19 nt, Homo sapiens
ggcgguggauggcaugaug

SEQ ID NO: 1165656 - RNA, 19 nt, Homo sapiens
uccggaauuucucaacuaa

SEQ ID NO: 1165657 - RNA, 19 nt, Homo sapiens
uaaaggaagauacuuacuc

SEQ ID NO: 1165658 - RNA, 19 nt, Homo sapiens
gaaggcugcacccugcuau

SEQ ID NO: 1165659 - RNA, 19 nt, Homo sapiens
caaucguguugaauuagga

SEQ ID NO: 1165660 - RNA, 19 nt, Homo sapiens
caagucacgggaccgcuuu

SEQ ID NO: 1165661 - RNA, 19 nt, Homo sapiens
cuacugugagcguguguuu

SEQ ID NO: 1165662 - RNA, 19 nt, Homo sapiens
caaagaaaggaaggaagga

SEQ ID NO: 1165663 - RNA, 19 nt, Homo sapiens
uuccggaauuucucaacua

SEQ ID NO: 1165664 - RNA, 19 nt, Homo sapiens
uaaaugcucgagaggaauc

SEQ ID NO: 1165665 - RNA, 19 nt, Homo sapiens
ccucuccauuuauaccaaa

SEQ ID NO: 1165666 - RNA, 19 nt, Homo sapiens
aguaugaauuugccaugug

SEQ ID NO: 1165667 - RNA, 19 nt, Homo sapiens
uauacuuggugaggaaaga

SEQ ID NO: 1165668 - RNA, 19 nt, Homo sapiens
cguguugaauuaggaguau

SEQ ID NO: 1165669 - RNA, 19 nt, Homo sapiens
gaggucauggguucauuuc

SEQ ID NO: 1165670 - RNA, 19 nt, Homo sapiens
guagggacuggaagauaug

SEQ ID NO: 1165671 - RNA, 19 nt, Homo sapiens
aaagaaaggaaggaaggaa

SEQ ID NO: 1165672 - RNA, 19 nt, Homo sapiens
aggaaagaguaugaauuug

SEQ ID NO: 1165673 - RNA, 19 nt, Homo sapiens
gucaucugcugguuguguu

SEQ ID NO: 1165674 - RNA, 19 nt, Homo sapiens
gggacuggaagauauguca

SEQ ID NO: 1165675 - RNA, 19 nt, Homo sapiens
ccacugcaagggcaagaug

SEQ ID NO: 1165676 - RNA, 19 nt, Homo sapiens
gacuuuaccgccagugaau

SEQ ID NO: 1165677 - RNA, 19 nt, Homo sapiens
acagggagaggcugaggaa

SEQ ID NO: 1165678 - RNA, 19 nt, Homo sapiens
guguugaauuaggaguaua

SEQ ID NO: 1165679 - RNA, 19 nt, Homo sapiens
gaaaugaccugaacgaaga

SEQ ID NO: 1165680 - RNA, 19 nt, Homo sapiens
gcaugggucuuaucuaauu

SEQ ID NO: 1165681 - RNA, 19 nt, Homo sapiens
uuaaagagcucauuugcaa

SEQ ID NO: 1165682 - RNA, 19 nt, Homo sapiens
uaagauggauagcacauaa

SEQ ID NO: 1165683 - RNA, 19 nt, Homo sapiens
ggaggcagcugauggcaaa

SEQ ID NO: 1165684 - RNA, 19 nt, Homo sapiens
ugaaaggucucgcaaaguu

SEQ ID NO: 1165685 - RNA, 19 nt, Homo sapiens
gaaacuaggugaagaugca

SEQ ID NO: 1165686 - RNA, 19 nt, Homo sapiens
gaggaaagcgaacauuaua

SEQ ID NO: 1165687 - RNA, 19 nt, Homo sapiens
cuacuucacucaccuaauu

SEQ ID NO: 1165688 - RNA, 19 nt, Homo sapiens
cauggaagccuuauaagua

SEQ ID NO: 1165689 - RNA, 19 nt, Homo sapiens
gaagaaaagucauggauau

SEQ ID NO: 1165690 - RNA, 19 nt, Homo sapiens
aaacauggaagccuuauaa

SEQ ID NO: 1165691 - RNA, 19 nt, Homo sapiens
gaaaaccccuacacugaua

SEQ ID NO: 1165692 - RNA, 19 nt, Homo sapiens
gaaaggagaauauguaugc

SEQ ID NO: 1165693 - RNA, 19 nt, Homo sapiens
uaacugcuccgcuacauuu

SEQ ID NO: 1165694 - RNA, 19 nt, Homo sapiens
gagaaaagauccaguuaga

SEQ ID NO: 1165695 - RNA, 19 nt, Homo sapiens
gaacacagugccauaugaa

SEQ ID NO: 1165696 - RNA, 19 nt, Homo sapiens
ccagaaaggagaauaugua

SEQ ID NO: 1165697 - RNA, 19 nt, Homo sapiens
ccacgccgaucaaugcaua

SEQ ID NO: 1165698 - RNA, 19 nt, Homo sapiens
gagaaagccuacugaagca

SEQ ID NO: 1165699 - RNA, 19 nt, Homo sapiens
gcaaugcacuuguauacac

SEQ ID NO: 1165700 - RNA, 19 nt, Homo sapiens
ggaagaugauguugucaag

SEQ ID NO: 1165701 - RNA, 19 nt, Homo sapiens
gcacuuguauacacuucaa

SEQ ID NO: 1165702 - RNA, 19 nt, Homo sapiens
gagagugcaaguagcauua

SEQ ID NO: 1165703 - RNA, 19 nt, Homo sapiens
acgaagagccucaacauuu

SEQ ID NO: 1165704 - RNA, 19 nt, Homo sapiens
gaacgaagagccucaacau

SEQ ID NO: 1165705 - RNA, 19 nt, Homo sapiens
cagaaaagguguuuguuaa

SEQ ID NO: 1165706 - RNA, 19 nt, Homo sapiens
uaauggcacuugucuaugu

SEQ ID NO: 1165707 - RNA, 19 nt, Homo sapiens
uauaagaacaggcaaacua

SEQ ID NO: 1165708 - RNA, 19 nt, Homo sapiens
caacacagaaggacaguau

SEQ ID NO: 1165709 - RNA, 19 nt, Homo sapiens
aagaugauguugucaagaa

SEQ ID NO: 1165710 - RNA, 19 nt, Homo sapiens
ggugacugcuguugaaaga

SEQ ID NO: 1165711 - RNA, 19 nt, Homo sapiens
ggacccauguuuaaauaca

SEQ ID NO: 1165712 - RNA, 19 nt, Homo sapiens
ggaaagcgaacauuauauc

SEQ ID NO: 1165713 - RNA, 19 nt, Homo sapiens
aauagcagcaugacauuua

SEQ ID NO: 1165714 - RNA, 19 nt, Homo sapiens
ggacagaggaugcacuugu

SEQ ID NO: 1165715 - RNA, 19 nt, Homo sapiens
ugaacacagugccauauga

SEQ ID NO: 1165716 - RNA, 19 nt, Homo sapiens
guagacacagaauuuguua

SEQ ID NO: 1165717 - RNA, 19 nt, Homo sapiens
caaguagcauuaagaugga

SEQ ID NO: 1165718 - RNA, 19 nt, Homo sapiens
ugauaaagguacucauguu

SEQ ID NO: 1165719 - RNA, 19 nt, Homo sapiens
acuaugcgaucuaugauuu

SEQ ID NO: 1165720 - RNA, 19 nt, Homo sapiens
auaaguacuuugcgacuaa

SEQ ID NO: 1165721 - RNA, 19 nt, Homo sapiens
gagaauauguaugcgugaa

SEQ ID NO: 1165722 - RNA, 19 nt, Homo sapiens
cauaauggcacuugucuau

SEQ ID NO: 1165723 - RNA, 19 nt, Homo sapiens
ggacaugaggauauaagaa

SEQ ID NO: 1165724 - RNA, 19 nt, Homo sapiens
caugggaaguguaugugua

SEQ ID NO: 1165725 - RNA, 19 nt, Homo sapiens
gaagggcgcuauuuguacu

SEQ ID NO: 1165726 - RNA, 19 nt, Homo sapiens
agaaagagcagccagagaa

SEQ ID NO: 1165727 - RNA, 19 nt, Homo sapiens
gauaaagguacucauguug

SEQ ID NO: 1165728 - RNA, 19 nt, Homo sapiens
ccuguggacuugcaaauau

SEQ ID NO: 1165729 - RNA, 19 nt, Homo sapiens
acacagugccauaugaaua

SEQ ID NO: 1165730 - RNA, 19 nt, Homo sapiens
agccuucucuuguguguua

SEQ ID NO: 1165731 - RNA, 19 nt, Homo sapiens
gaagaccucagacaggaaa

SEQ ID NO: 1165732 - RNA, 19 nt, Homo sapiens
ucagguaaaugcgaaugua

SEQ ID NO: 1165733 - RNA, 19 nt, Homo sapiens
gcacuucuacacucaggua

SEQ ID NO: 1165734 - RNA, 19 nt, Homo sapiens
caagugcaaugcugccuau

SEQ ID NO: 1165735 - RNA, 19 nt, Homo sapiens
caauguaugugauagucaa

SEQ ID NO: 1165736 - RNA, 19 nt, Homo sapiens
gaugggaaauuuggcuuug

SEQ ID NO: 1165737 - RNA, 19 nt, Homo sapiens
agacuggugucaugaaguu

SEQ ID NO: 1165738 - RNA, 19 nt, Homo sapiens
ggaaguguauguguaagca

SEQ ID NO: 1165739 - RNA, 19 nt, Homo sapiens
gaucaaugcauaccuguuc

SEQ ID NO: 1165740 - RNA, 19 nt, Homo sapiens
cgaagagccucaacauuuu

SEQ ID NO: 1165741 - RNA, 19 nt, Homo sapiens
gggaaauggacuuuaaauu

SEQ ID NO: 1165742 - RNA, 19 nt, Homo sapiens
gaauauguaugcgugaagu

SEQ ID NO: 1165743 - RNA, 19 nt, Homo sapiens
augcaugggucuuaucuaa

SEQ ID NO: 1165744 - RNA, 19 nt, Homo sapiens
gaacaggcaaacuaauugu

SEQ ID NO: 1165745 - RNA, 19 nt, Homo sapiens
gaaccucuccauguguaua

SEQ ID NO: 1165746 - RNA, 19 nt, Homo sapiens
gcaugacauuuagcaguaa

SEQ ID NO: 1165747 - RNA, 19 nt, Homo sapiens
caagaagggcgcuauuugu

SEQ ID NO: 1165748 - RNA, 19 nt, Homo sapiens
ccuggaagcugaauucuac

SEQ ID NO: 1165749 - RNA, 19 nt, Homo sapiens
cuaccgaacuguacugcuu

SEQ ID NO: 1165750 - RNA, 19 nt, Homo sapiens
gccaaggcauucuguggaa

SEQ ID NO: 1165751 - RNA, 19 nt, Homo sapiens
gaggagagguuauuuucaa

SEQ ID NO: 1165752 - RNA, 19 nt, Homo sapiens
gaaaagguguuuguuaaag

SEQ ID NO: 1165753 - RNA, 19 nt, Homo sapiens
uaaaugcgaauguaaggaa

SEQ ID NO: 1165754 - RNA, 19 nt, Homo sapiens
uggaguagcuggagugagu

SEQ ID NO: 1165755 - RNA, 19 nt, Homo sapiens
gcaugaacuuuggucugua

SEQ ID NO: 1165756 - RNA, 19 nt, Homo sapiens
uuacuuacguuugaugcua

SEQ ID NO: 1165757 - RNA, 19 nt, Homo sapiens
cuaccaaacugaagauuuu

SEQ ID NO: 1165758 - RNA, 19 nt, Homo sapiens
gaggucaaugugaagauua

SEQ ID NO: 1165759 - RNA, 19 nt, Homo sapiens
aagaagggcgcuauuugua

SEQ ID NO: 1165760 - RNA, 19 nt, Homo sapiens
ucaagaagggcgcuauuug

SEQ ID NO: 1165761 - RNA, 19 nt, Homo sapiens
cauuuggccuggaagauga

SEQ ID NO: 1165762 - RNA, 19 nt, Homo sapiens
ggacugauucugaaauucu

SEQ ID NO: 1165763 - RNA, 19 nt, Homo sapiens
cuggacccauguuuaaaua

SEQ ID NO: 1165764 - RNA, 19 nt, Homo sapiens
ccucaauccugguuuggaa

SEQ ID NO: 1165765 - RNA, 19 nt, Homo sapiens
ggaacagacauuaggaaau

SEQ ID NO: 1165766 - RNA, 19 nt, Homo sapiens
cacagugccauaugaauaa

SEQ ID NO: 1165767 - RNA, 19 nt, Homo sapiens
ggaaaagggugugugagaa

SEQ ID NO: 1165768 - RNA, 19 nt, Homo sapiens
ccgaggaaagcgaacauua

SEQ ID NO: 1165769 - RNA, 19 nt, Homo sapiens
uauaaguacuuugcgacua

SEQ ID NO: 1165770 - RNA, 19 nt, Homo sapiens
cgcauaaccacuauacaua

SEQ ID NO: 1165771 - RNA, 19 nt, Homo sapiens
gacauaugcuuggcuaaag

SEQ ID NO: 1165772 - RNA, 19 nt, Homo sapiens
cgaggaaagcgaacauuau

SEQ ID NO: 1165773 - RNA, 19 nt, Homo sapiens
gcaauggccacgccgauca

SEQ ID NO: 1165774 - RNA, 19 nt, Homo sapiens
aaacuaaccagaagagcuu

SEQ ID NO: 1165775 - RNA, 19 nt, Homo sapiens
ggagaaacuaggugaagau

SEQ ID NO: 1165776 - RNA, 19 nt, Homo sapiens
acaggugcauggugggaua

SEQ ID NO: 1165777 - RNA, 19 nt, Homo sapiens
ggaccgcucccaggacuuu

SEQ ID NO: 1165778 - RNA, 19 nt, Homo sapiens
cggaggaugugcacagaga

SEQ ID NO: 1165779 - RNA, 19 nt, Homo sapiens
gcgugaagaucaaucauuu

SEQ ID NO: 1165780 - RNA, 19 nt, Homo sapiens
ccaacacgcucaacaggaa

SEQ ID NO: 1165781 - RNA, 19 nt, Homo sapiens
cgacagcgcggaguaucua

SEQ ID NO: 1165782 - RNA, 19 nt, Homo sapiens
gcagcaggccugagcaaca

SEQ ID NO: 1165783 - RNA, 19 nt, Homo sapiens
gaggaucugcugccuggaa

SEQ ID NO: 1165784 - RNA, 19 nt, Homo sapiens
cauccuggccgaggugaua

SEQ ID NO: 1165785 - RNA, 19 nt, Homo sapiens
cagcaggccugagcaacau

SEQ ID NO: 1165786 - RNA, 19 nt, Homo sapiens
ggaaaaccacgccugugua

SEQ ID NO: 1165787 - RNA, 19 nt, Homo sapiens
aaagaggcgucugcgugaa

SEQ ID NO: 1165788 - RNA, 19 nt, Homo sapiens
ccaagaggaacaucauucu

SEQ ID NO: 1165789 - RNA, 19 nt, Homo sapiens
gaaaaccacgccuguguag

SEQ ID NO: 1165790 - RNA, 19 nt, Homo sapiens
caacacgcucaacaggaaa

SEQ ID NO: 1165791 - RNA, 19 nt, Homo sapiens
cggcugguccuucuacuuc

SEQ ID NO: 1165792 - RNA, 19 nt, Homo sapiens
caagaggaacaucauucug

SEQ ID NO: 1165793 - RNA, 19 nt, Homo sapiens
gcacugacuacuggcucua

SEQ ID NO: 1165794 - RNA, 19 nt, Homo sapiens
ucaucggcgugaucgugua

SEQ ID NO: 1165795 - RNA, 19 nt, Homo sapiens
gcuucugccugcgcuguga

SEQ ID NO: 1165796 - RNA, 19 nt, Homo sapiens
guggugggcuugguucuuu

SEQ ID NO: 1165797 - RNA, 19 nt, Homo sapiens
cagacucccuuauuucaau

SEQ ID NO: 1165798 - RNA, 19 nt, Homo sapiens
cccacagacucccuuauuu

SEQ ID NO: 1165799 - RNA, 19 nt, Homo sapiens
gaagccacggguacgguua

SEQ ID NO: 1165800 - RNA, 19 nt, Homo sapiens
gggcuugguucuuuacauc

SEQ ID NO: 1165801 - RNA, 19 nt, Homo sapiens
gcucuugucuaaaggaucu

SEQ ID NO: 1165802 - RNA, 19 nt, Homo sapiens
ccacagacucccuuauuuc

SEQ ID NO: 1165803 - RNA, 19 nt, Homo sapiens
gcccacagacucccuuauu

SEQ ID NO: 1165804 - RNA, 19 nt, Homo sapiens
agaggaccauucuggcuuu

SEQ ID NO: 1165805 - RNA, 19 nt, Homo sapiens
cgacguguccauccaaaug

SEQ ID NO: 1165806 - RNA, 19 nt, Homo sapiens
ggcaucuucuucauacuau

SEQ ID NO: 1165807 - RNA, 19 nt, Homo sapiens
uggcgagucugcuucuuug

SEQ ID NO: 1165808 - RNA, 19 nt, Homo sapiens
ccuggaaggucccauucuu

SEQ ID NO: 1165809 - RNA, 19 nt, Homo sapiens
gcuguguggccucagaaua

SEQ ID NO: 1165810 - RNA, 19 nt, Homo sapiens
gaauaccgaccauccucuu

SEQ ID NO: 1165811 - RNA, 19 nt, Homo sapiens
gaaggucccauucuuucuc

SEQ ID NO: 1165812 - RNA, 19 nt, Homo sapiens
ccguguaccuguucaccaa

SEQ ID NO: 1165813 - RNA, 19 nt, Homo sapiens
gaaaacacggagaauauuc

SEQ ID NO: 1165814 - RNA, 19 nt, Homo sapiens
gcacugacuacuggcugua

SEQ ID NO: 1165815 - RNA, 19 nt, Homo sapiens
cgacuacucgggccaguuc

SEQ ID NO: 1165816 - RNA, 19 nt, Homo sapiens
gaaccggagaucaauuugg

SEQ ID NO: 1165817 - RNA, 19 nt, Homo sapiens
caauggcuccgcccacaga

SEQ ID NO: 1165818 - RNA, 19 nt, Homo sapiens
cuuuacaucuccagcauca

SEQ ID NO: 1165819 - RNA, 19 nt, Homo sapiens
ggaaaacacggagaauauu

SEQ ID NO: 1165820 - RNA, 19 nt, Homo sapiens
cacagacucccuuauuuca

SEQ ID NO: 1165821 - RNA, 19 nt, Homo sapiens
acuacuggcuguacaugga

SEQ ID NO: 1165822 - RNA, 19 nt, Homo sapiens
ccauccaaaugacgcagaa

SEQ ID NO: 1165823 - RNA, 19 nt, Homo sapiens
ucaauuuggugacggaaaa

SEQ ID NO: 1165824 - RNA, 19 nt, Homo sapiens
ggaaggucccauucuuucu

SEQ ID NO: 1165825 - RNA, 19 nt, Homo sapiens
gacguguccauccaaauga

SEQ ID NO: 1165826 - RNA, 19 nt, Homo sapiens
guucacggccuucgucauc

SEQ ID NO: 1165827 - RNA, 19 nt, Homo sapiens
aaccggagaucaauuuggu

SEQ ID NO: 1165828 - RNA, 19 nt, Homo sapiens
uguguggccucagaauauu

SEQ ID NO: 1165829 - RNA, 19 nt, Homo sapiens
caucaacgacgaggucaug

SEQ ID NO: 1165830 - RNA, 19 nt, Homo sapiens
uaucgggccucuccuuggu

SEQ ID NO: 1165831 - RNA, 19 nt, Homo sapiens
uggcaucuucuucauacua

SEQ ID NO: 1165832 - RNA, 19 nt, Homo sapiens
ucuggcaucuucuucauac

SEQ ID NO: 1165833 - RNA, 19 nt, Homo sapiens
caacgacgaggucaugaac

SEQ ID NO: 1165834 - RNA, 19 nt, Homo sapiens
ggaccauucuggcuuuugu

SEQ ID NO: 1165835 - RNA, 19 nt, Homo sapiens
uggaaggucccauucuuuc

SEQ ID NO: 1165836 - RNA, 19 nt, Homo sapiens
ccaaaugacgcagaacuac

SEQ ID NO: 1165837 - RNA, 19 nt, Homo sapiens
ugauguccguguaccuguu

SEQ ID NO: 1165838 - RNA, 19 nt, Homo sapiens
ccuccuuccuacucaaaga

SEQ ID NO: 1165839 - RNA, 19 nt, Homo sapiens
cccucucacucccaaauga

SEQ ID NO: 1165840 - RNA, 19 nt, Homo sapiens
gggcucuugucuaaaggau

SEQ ID NO: 1165841 - RNA, 19 nt, Homo sapiens
cuggaaggucccauucuuu

SEQ ID NO: 1165842 - RNA, 19 nt, Homo sapiens
ucaacgacgaggucaugaa

SEQ ID NO: 1165843 - RNA, 19 nt, Homo sapiens
uggugggcuugguucuuua

SEQ ID NO: 1165844 - RNA, 19 nt, Homo sapiens
agacucccuuauuucaaug

SEQ ID NO: 1165845 - RNA, 19 nt, Homo sapiens
uccaaaugacgcagaacua

SEQ ID NO: 1165846 - RNA, 19 nt, Homo sapiens
acgcggaggaggagaugua

SEQ ID NO: 1165847 - RNA, 19 nt, Homo sapiens
gcucagaucucucaggaaa

SEQ ID NO: 1165848 - RNA, 19 nt, Homo sapiens
cagaagcaaucucgacuuu

SEQ ID NO: 1165849 - RNA, 19 nt, Homo sapiens
gauuugggauuaaagguuu

SEQ ID NO: 1165850 - RNA, 19 nt, Homo sapiens
gaucugauuugggauuaaa

SEQ ID NO: 1165851 - RNA, 19 nt, Homo sapiens
gaagcaaucucgacuuucg

SEQ ID NO: 1165852 - RNA, 19 nt, Homo sapiens
ggacucggcucucccucuu

SEQ ID NO: 1165853 - RNA, 19 nt, Homo sapiens
aaucucgacuuucgcauuu

SEQ ID NO: 1165854 - RNA, 19 nt, Homo sapiens
ccuuugaccuucuccauug

SEQ ID NO: 1165855 - RNA, 19 nt, Homo sapiens
gugaucugauuugggauua

SEQ ID NO: 1165856 - RNA, 19 nt, Homo sapiens
gggauuaaagguuuggaaa

SEQ ID NO: 1165857 - RNA, 19 nt, Homo sapiens
gaagccgaauucuaucucu

SEQ ID NO: 1165858 - RNA, 19 nt, Homo sapiens
ggauuaaagguuuggaaau

SEQ ID NO: 1165859 - RNA, 19 nt, Homo sapiens
ggccacaucuccuccaaac

SEQ ID NO: 1165860 - RNA, 19 nt, Homo sapiens
ggucuggccucgcugugau

SEQ ID NO: 1165861 - RNA, 19 nt, Homo sapiens
gccgaauucuaucucuaaa

SEQ ID NO: 1165862 - RNA, 19 nt, Homo sapiens
gacuuucgcauuugagauu

SEQ ID NO: 1165863 - RNA, 19 nt, Homo sapiens
cgaauucuaucucuaaacc

SEQ ID NO: 1165864 - RNA, 19 nt, Homo sapiens
uauccuuucucccucugua

SEQ ID NO: 1165865 - RNA, 19 nt, Homo sapiens
gagccacgcgugagacuuc

SEQ ID NO: 1165866 - RNA, 19 nt, Homo sapiens
gaugugguccaacuucuuc

SEQ ID NO: 1165867 - RNA, 19 nt, Homo sapiens
gaugaugugguccaacuuc

SEQ ID NO: 1165868 - RNA, 19 nt, Homo sapiens
cugggaagccgaauucuau

SEQ ID NO: 1165869 - RNA, 19 nt, Homo sapiens
ucucgacuuucgcauuuga

SEQ ID NO: 1165870 - RNA, 19 nt, Homo sapiens
ccacaucuccuccaaacac

SEQ ID NO: 1165871 - RNA, 19 nt, Homo sapiens
uggccucgcugugaucuga

SEQ ID NO: 1165872 - RNA, 19 nt, Homo sapiens
caaucucgacuuucgcauu

SEQ ID NO: 1165873 - RNA, 19 nt, Homo sapiens
cgucuucuuugccaaguuc

SEQ ID NO: 1165874 - RNA, 19 nt, Homo sapiens
gcgggcaccaguucucauu

SEQ ID NO: 1165875 - RNA, 19 nt, Homo sapiens
caaccaccgagcccuuuga

SEQ ID NO: 1165876 - RNA, 19 nt, Homo sapiens
aagaugaugugguccaacu

SEQ ID NO: 1165877 - RNA, 19 nt, Homo sapiens
aagccgaauucuaucucua

SEQ ID NO: 1165878 - RNA, 19 nt, Homo sapiens
gcaaccaccgagcccuuug

SEQ ID NO: 1165879 - RNA, 19 nt, Homo sapiens
ccuagacccuccucugaac

SEQ ID NO: 1165880 - RNA, 19 nt, Homo sapiens
aaacgaggguccccagaga

SEQ ID NO: 1165881 - RNA, 19 nt, Homo sapiens
cuuucucccucuguaaaua

SEQ ID NO: 1165882 - RNA, 19 nt, Homo sapiens
acucggcucucccucuuuc

SEQ ID NO: 1165883 - RNA, 19 nt, Homo sapiens
cggcucucccucuuucaua

SEQ ID NO: 1165884 - RNA, 19 nt, Homo sapiens
ugauuugggauuaaagguu

SEQ ID NO: 1165885 - RNA, 19 nt, Homo sapiens
cuggagguguuccggcauu

SEQ ID NO: 1165886 - RNA, 19 nt, Homo sapiens
ccagaagcaaucucgacuu

SEQ ID NO: 1165887 - RNA, 19 nt, Homo sapiens
ggaagccgaauucuaucuc

SEQ ID NO: 1165888 - RNA, 19 nt, Homo sapiens
ccugggaagccgaauucua

SEQ ID NO: 1165889 - RNA, 19 nt, Homo sapiens
ugaucugauuugggauuaa

SEQ ID NO: 1165890 - RNA, 19 nt, Homo sapiens
gcauuugagauuccagaca

SEQ ID NO: 1165891 - RNA, 19 nt, Homo sapiens
aaccuagacccuccucuga

SEQ ID NO: 1165892 - RNA, 19 nt, Homo sapiens
gaagcaaacugcaccuauu

SEQ ID NO: 1165893 - RNA, 19 nt, Homo sapiens
gcacgcaucuuucagagaa

SEQ ID NO: 1165894 - RNA, 19 nt, Homo sapiens
gcucagaucucucaggaaa

SEQ ID NO: 1165895 - RNA, 19 nt, Homo sapiens
cagaagcaaucucgacuuu

SEQ ID NO: 1165896 - RNA, 19 nt, Homo sapiens
gauuugggauuaaagguuu

SEQ ID NO: 1165897 - RNA, 19 nt, Homo sapiens
gaucugauuugggauuaaa

SEQ ID NO: 1165898 - RNA, 19 nt, Homo sapiens
gaagcaaucucgacuuucg

SEQ ID NO: 1165899 - RNA, 19 nt, Homo sapiens
ggacucggcucucccucuu

SEQ ID NO: 1165900 - RNA, 19 nt, Homo sapiens
caguaaaggugcagaguuc

SEQ ID NO: 1165901 - RNA, 19 nt, Homo sapiens
ucagagaaccacaaagaaa

SEQ ID NO: 1165902 - RNA, 19 nt, Homo sapiens
aaucucgacuuucgcauuu

SEQ ID NO: 1165903 - RNA, 19 nt, Homo sapiens
ccuuugaccuucuccauug

SEQ ID NO: 1165904 - RNA, 19 nt, Homo sapiens
gcaaacugcaccuauuuua

SEQ ID NO: 1165905 - RNA, 19 nt, Homo sapiens
caaagaaagaggugaaucu

SEQ ID NO: 1165906 - RNA, 19 nt, Homo sapiens
gugaucugauuugggauua

SEQ ID NO: 1165907 - RNA, 19 nt, Homo sapiens
gggauuaaagguuuggaaa

SEQ ID NO: 1165908 - RNA, 19 nt, Homo sapiens
ccacaaagaaagaggugaa

SEQ ID NO: 1165909 - RNA, 19 nt, Homo sapiens
gaagccgaauucuaucucu

SEQ ID NO: 1165910 - RNA, 19 nt, Homo sapiens
ggauuaaagguuuggaaau

SEQ ID NO: 1165911 - RNA, 19 nt, Homo sapiens
ucuggcagcugcggugaua

SEQ ID NO: 1165912 - RNA, 19 nt, Homo sapiens
aagcaaacugcaccuauuu

SEQ ID NO: 1165913 - RNA, 19 nt, Homo sapiens
ggccacaucuccuccaaac

SEQ ID NO: 1165914 - RNA, 19 nt, Homo sapiens
ggucuggccucgcugugau

SEQ ID NO: 1165915 - RNA, 19 nt, Homo sapiens
gccgaauucuaucucuaaa

SEQ ID NO: 1165916 - RNA, 19 nt, Homo sapiens
gacuuucgcauuugagauu

SEQ ID NO: 1165917 - RNA, 19 nt, Homo sapiens
cgaauucuaucucuaaacc

SEQ ID NO: 1165918 - RNA, 19 nt, Homo sapiens
uauccuuucucccucugua

SEQ ID NO: 1165919 - RNA, 19 nt, Homo sapiens
gagccacgcgugagacuuc

SEQ ID NO: 1165920 - RNA, 19 nt, Homo sapiens
ucaucauggugcucaguaa

SEQ ID NO: 1165921 - RNA, 19 nt, Homo sapiens
gaugugguccaacuucuuc

SEQ ID NO: 1165922 - RNA, 19 nt, Homo sapiens
gaugaugugguccaacuuc

SEQ ID NO: 1165923 - RNA, 19 nt, Homo sapiens
cugggaagccgaauucuau

SEQ ID NO: 1165924 - RNA, 19 nt, Homo sapiens
gggugccucuguaucauca

SEQ ID NO: 1165925 - RNA, 19 nt, Homo sapiens
cagagaaccacaaagaaag

SEQ ID NO: 1165926 - RNA, 19 nt, Homo sapiens
uuucagagaaccacaaaga

SEQ ID NO: 1165927 - RNA, 19 nt, Homo sapiens
ucucgacuuucgcauuuga

SEQ ID NO: 1165928 - RNA, 19 nt, Homo sapiens
gagaagcaaacugcaccua

SEQ ID NO: 1165929 - RNA, 19 nt, Homo sapiens
ucucaggccugcugcucuu

SEQ ID NO: 1165930 - RNA, 19 nt, Homo sapiens
caucauggugcucaguaaa

SEQ ID NO: 1165931 - RNA, 19 nt, Homo sapiens
uggccucgcugugaucuga

SEQ ID NO: 1165932 - RNA, 19 nt, Homo sapiens
ccacaucuccuccaaacac

SEQ ID NO: 1165933 - RNA, 19 nt, Homo sapiens
caaucucgacuuucgcauu

SEQ ID NO: 1165934 - RNA, 19 nt, Homo sapiens
cgucuucuuugccaaguuc

SEQ ID NO: 1165935 - RNA, 19 nt, Homo sapiens
gcgggcaccaguucucauu

SEQ ID NO: 1165936 - RNA, 19 nt, Homo sapiens
caaccaccgagcccuuuga

SEQ ID NO: 1165937 - RNA, 19 nt, Homo sapiens
ucaguaaaggugcagaguu

SEQ ID NO: 1165938 - RNA, 19 nt, Homo sapiens
agagaaccacaaagaaaga

SEQ ID NO: 1165939 - RNA, 19 nt, Homo sapiens
caaacugcaccuauuuuaa

SEQ ID NO: 1165940 - RNA, 19 nt, Homo sapiens
aagaugaugugguccaacu

SEQ ID NO: 1165941 - RNA, 19 nt, Homo sapiens
aagccgaauucuaucucua

SEQ ID NO: 1165942 - RNA, 19 nt, Homo sapiens
gcaaccaccgagcccuuug

SEQ ID NO: 1165943 - RNA, 19 nt, Homo sapiens
ccuagacccuccucugaac

SEQ ID NO: 1165944 - RNA, 19 nt, Homo sapiens
aaacgaggguccccagaga

SEQ ID NO: 1165945 - RNA, 19 nt, Homo sapiens
cuuucucccucuguaaaua

SEQ ID NO: 1165946 - RNA, 19 nt, Homo sapiens
agaagcaaacugcaccuau

SEQ ID NO: 1165947 - RNA, 19 nt, Homo sapiens
acucggcucucccucuuuc

SEQ ID NO: 1165948 - RNA, 19 nt, Homo sapiens
cgucugcuuuggccucuca

SEQ ID NO: 1165949 - RNA, 19 nt, Homo sapiens
aguuggagccgucugcuuu

SEQ ID NO: 1165950 - RNA, 19 nt, Homo sapiens
gugccucuguaucaucaug

SEQ ID NO: 1165951 - RNA, 19 nt, Homo sapiens
cggcucucccucuuucaua

SEQ ID NO: 1165952 - RNA, 19 nt, Homo sapiens
ugauuugggauuaaagguu

SEQ ID NO: 1165953 - RNA, 19 nt, Homo sapiens
ccugggaagccgaauucua

SEQ ID NO: 1165954 - RNA, 19 nt, Homo sapiens
cuggagguguuccggcauu

SEQ ID NO: 1165955 - RNA, 19 nt, Homo sapiens
ggaagccgaauucuaucuc

SEQ ID NO: 1165956 - RNA, 19 nt, Homo sapiens
aaagaaagaggugaaucug

SEQ ID NO: 1165957 - RNA, 19 nt, Homo sapiens
ccagaagcaaucucgacuu

SEQ ID NO: 1165958 - RNA, 19 nt, Homo sapiens
ugaucugauuugggauuaa

SEQ ID NO: 1165959 - RNA, 19 nt, Homo sapiens
gcauuugagauuccagaca

SEQ ID NO: 1165960 - RNA, 19 nt, Homo sapiens
aaccuagacccuccucuga

SEQ ID NO: 1165961 - RNA, 19 nt, Homo sapiens
gaagcaaacugcaccuauu

SEQ ID NO: 1165962 - RNA, 19 nt, Homo sapiens
gcacgcaucuuucagagaa

SEQ ID NO: 1165963 - RNA, 19 nt, Homo sapiens
gcucagaucucucaggaaa

SEQ ID NO: 1165964 - RNA, 19 nt, Homo sapiens
cagaagcaaucucgacuuu

SEQ ID NO: 1165965 - RNA, 19 nt, Homo sapiens
gauuugggauuaaagguuu

SEQ ID NO: 1165966 - RNA, 19 nt, Homo sapiens
gaucugauuugggauuaaa

SEQ ID NO: 1165967 - RNA, 19 nt, Homo sapiens
gaagcaaucucgacuuucg

SEQ ID NO: 1165968 - RNA, 19 nt, Homo sapiens
ggacucggcucucccucuu

SEQ ID NO: 1165969 - RNA, 19 nt, Homo sapiens
ucagagaaccacaaagaaa

SEQ ID NO: 1165970 - RNA, 19 nt, Homo sapiens
aaucucgacuuucgcauuu

SEQ ID NO: 1165971 - RNA, 19 nt, Homo sapiens
ccuuugaccuucuccauug

SEQ ID NO: 1165972 - RNA, 19 nt, Homo sapiens
gcaaacugcaccuauuuua

SEQ ID NO: 1165973 - RNA, 19 nt, Homo sapiens
gugaucugauuugggauua

SEQ ID NO: 1165974 - RNA, 19 nt, Homo sapiens
agaaaggccugcugcucuu

SEQ ID NO: 1165975 - RNA, 19 nt, Homo sapiens
gggauuaaagguuuggaaa

SEQ ID NO: 1165976 - RNA, 19 nt, Homo sapiens
gaagccgaauucuaucucu

SEQ ID NO: 1165977 - RNA, 19 nt, Homo sapiens
ggauuaaagguuuggaaau

SEQ ID NO: 1165978 - RNA, 19 nt, Homo sapiens
aagcaaacugcaccuauuu

SEQ ID NO: 1165979 - RNA, 19 nt, Homo sapiens
ggccacaucuccuccaaac

SEQ ID NO: 1165980 - RNA, 19 nt, Homo sapiens
ggucuggccucgcugugau

SEQ ID NO: 1165981 - RNA, 19 nt, Homo sapiens
gccgaauucuaucucuaaa

SEQ ID NO: 1165982 - RNA, 19 nt, Homo sapiens
gacuuucgcauuugagauu

SEQ ID NO: 1165983 - RNA, 19 nt, Homo sapiens
cgaauucuaucucuaaacc

SEQ ID NO: 1165984 - RNA, 19 nt, Homo sapiens
uauccuuucucccucugua

SEQ ID NO: 1165985 - RNA, 19 nt, Homo sapiens
gagccacgcgugagacuuc

SEQ ID NO: 1165986 - RNA, 19 nt, Homo sapiens
gaugugguccaacuucuuc

SEQ ID NO: 1165987 - RNA, 19 nt, Homo sapiens
gaugaugugguccaacuuc

SEQ ID NO: 1165988 - RNA, 19 nt, Homo sapiens
cugggaagccgaauucuau

SEQ ID NO: 1165989 - RNA, 19 nt, Homo sapiens
cagagaaccacaaagaaag

SEQ ID NO: 1165990 - RNA, 19 nt, Homo sapiens
uuucagagaaccacaaaga

SEQ ID NO: 1165991 - RNA, 19 nt, Homo sapiens
ucucgacuuucgcauuuga

SEQ ID NO: 1165992 - RNA, 19 nt, Homo sapiens
gagaagcaaacugcaccua

SEQ ID NO: 1165993 - RNA, 19 nt, Homo sapiens
gaaaggccugcugcucuug

SEQ ID NO: 1165994 - RNA, 19 nt, Homo sapiens
uggccucgcugugaucuga

SEQ ID NO: 1165995 - RNA, 19 nt, Homo sapiens
ccacaucuccuccaaacac

SEQ ID NO: 1165996 - RNA, 19 nt, Homo sapiens
caaucucgacuuucgcauu

SEQ ID NO: 1165997 - RNA, 19 nt, Homo sapiens
cgucuucuuugccaaguuc

SEQ ID NO: 1165998 - RNA, 19 nt, Homo sapiens
gcgggcaccaguucucauu

SEQ ID NO: 1165999 - RNA, 19 nt, Homo sapiens
caaccaccgagcccuuuga

SEQ ID NO: 1166000 - RNA, 19 nt, Homo sapiens
caaacugcaccuauuuuaa

SEQ ID NO: 1166001 - RNA, 19 nt, Homo sapiens
aagaugaugugguccaacu

SEQ ID NO: 1166002 - RNA, 19 nt, Homo sapiens
aagccgaauucuaucucua

SEQ ID NO: 1166003 - RNA, 19 nt, Homo sapiens
gcaaccaccgagcccuuug

SEQ ID NO: 1166004 - RNA, 19 nt, Homo sapiens
ccuagacccuccucugaac

SEQ ID NO: 1166005 - RNA, 19 nt, Homo sapiens
aaacgaggguccccagaga

SEQ ID NO: 1166006 - RNA, 19 nt, Homo sapiens
cuuucucccucuguaaaua

SEQ ID NO: 1166007 - RNA, 19 nt, Homo sapiens
agaagcaaacugcaccuau

SEQ ID NO: 1166008 - RNA, 19 nt, Homo sapiens
acucggcucucccucuuuc

SEQ ID NO: 1166009 - RNA, 19 nt, Homo sapiens
cggcucucccucuuucaua

SEQ ID NO: 1166010 - RNA, 19 nt, Homo sapiens
ugauuugggauuaaagguu

SEQ ID NO: 1166011 - RNA, 19 nt, Homo sapiens
cuggagguguuccggcauu

SEQ ID NO: 1166012 - RNA, 19 nt, Homo sapiens
ccagaagcaaucucgacuu

SEQ ID NO: 1166013 - RNA, 19 nt, Homo sapiens
ggaagccgaauucuaucuc

SEQ ID NO: 1166014 - RNA, 19 nt, Homo sapiens
ccugggaagccgaauucua

SEQ ID NO: 1166015 - RNA, 19 nt, Homo sapiens
ugaucugauuugggauuaa

SEQ ID NO: 1166016 - RNA, 19 nt, Homo sapiens
gcauuugagauuccagaca

SEQ ID NO: 1166017 - RNA, 19 nt, Homo sapiens
aaccuagacccuccucuga

SEQ ID NO: 1166018 - RNA, 19 nt, Homo sapiens
gauagaugcuuguuuguaa

SEQ ID NO: 1166019 - RNA, 19 nt, Homo sapiens
ggaugaaccuggagcuuua

SEQ ID NO: 1166020 - RNA, 19 nt, Homo sapiens
ggaagaagguccgcguuaa

SEQ ID NO: 1166021 - RNA, 19 nt, Homo sapiens
gaagaagguccgcguuaaa

SEQ ID NO: 1166022 - RNA, 19 nt, Homo sapiens
gaaccuggagcuuuauuau

SEQ ID NO: 1166023 - RNA, 19 nt, Homo sapiens
gggaagaagguccgcguua

SEQ ID NO: 1166024 - RNA, 19 nt, Homo sapiens
gaagaagugguacacgauu

SEQ ID NO: 1166025 - RNA, 19 nt, Homo sapiens
ggauagaugcuuguuugua

SEQ ID NO: 1166026 - RNA, 19 nt, Homo sapiens
ugggauagaugcuuguuug

SEQ ID NO: 1166027 - RNA, 19 nt, Homo sapiens
aagaagugguacacgauuu

SEQ ID NO: 1166028 - RNA, 19 nt, Homo sapiens
gggaugaaccuggagcuuu

SEQ ID NO: 1166029 - RNA, 19 nt, Homo sapiens
gaagguccgcguuaaaugc

SEQ ID NO: 1166030 - RNA, 19 nt, Homo sapiens
accuggagcuuuauuauca

SEQ ID NO: 1166031 - RNA, 19 nt, Homo sapiens
ugaucgagguuguuugcaa

SEQ ID NO: 1166032 - RNA, 19 nt, Homo sapiens
ugaaccuggagcuuuauua

SEQ ID NO: 1166033 - RNA, 19 nt, Homo sapiens
gaccuuaagaagcugauug

SEQ ID NO: 1166034 - RNA, 19 nt, Homo sapiens
uuaaaugcaacacggauga

SEQ ID NO: 1166035 - RNA, 19 nt, Homo sapiens
gguacccguuggaacaaga

SEQ ID NO: 1166036 - RNA, 19 nt, Homo sapiens
agauuguccugaagaagug

SEQ ID NO: 1166037 - RNA, 19 nt, Homo sapiens
gaugaucgagguuguuugc

SEQ ID NO: 1166038 - RNA, 19 nt, Homo sapiens
ugaagaagugguacacgau

SEQ ID NO: 1166039 - RNA, 19 nt, Homo sapiens
gcaacacggaugauaccau

SEQ ID NO: 1166040 - RNA, 19 nt, Homo sapiens
aaaugcaacacggaugaua

SEQ ID NO: 1166041 - RNA, 19 nt, Homo sapiens
aagaagguccgcguuaaau

SEQ ID NO: 1166042 - RNA, 19 nt, Homo sapiens
cuaggaugaucgagguugu

SEQ ID NO: 1166043 - RNA, 19 nt, Homo sapiens
agaagguccgcguuaaaug

SEQ ID NO: 1166044 - RNA, 19 nt, Homo sapiens
aagauuguccugaagaagu

SEQ ID NO: 1166045 - RNA, 19 nt, Homo sapiens
ccuggagcuuuauuaucaa

SEQ ID NO: 1166046 - RNA, 19 nt, Homo sapiens
gaccagcacugaagucuau

SEQ ID NO: 1166047 - RNA, 19 nt, Homo sapiens
gaaagacgggcuuccauug

SEQ ID NO: 1166048 - RNA, 19 nt, Homo sapiens
ucagagagcuggcccuaca

SEQ ID NO: 1166049 - RNA, 19 nt, Homo sapiens
ucaacgugcugcucuggua

SEQ ID NO: 1166050 - RNA, 19 nt, Homo sapiens
gaucucggcucgcgaaacu

SEQ ID NO: 1166051 - RNA, 19 nt, Homo sapiens
guccaaggaugauauguag

SEQ ID NO: 1166052 - RNA, 19 nt, Homo sapiens
ggucaaggccaaccuguca

SEQ ID NO: 1166053 - RNA, 19 nt, Homo sapiens
ugaaagacgggcuuccauu

SEQ ID NO: 1166054 - RNA, 19 nt, Homo sapiens
caacgugaccagcacugaa

SEQ ID NO: 1166055 - RNA, 19 nt, Homo sapiens
ccgccgaccucuuggugaa

SEQ ID NO: 1166056 - RNA, 19 nt, Homo sapiens
acuacagccuccacgagua

SEQ ID NO: 1166057 - RNA, 19 nt, Homo sapiens
gcccagcucuuggaucagu

SEQ ID NO: 1166058 - RNA, 19 nt, Homo sapiens
ccagagugcaggaucauag

SEQ ID NO: 1166059 - RNA, 19 nt, Homo sapiens
guacaggccgguggaagga

SEQ ID NO: 1166060 - RNA, 19 nt, Homo sapiens
cugcccagcucuuggauca

SEQ ID NO: 1166061 - RNA, 19 nt, Homo sapiens
uaugucaagugccgucuca

SEQ ID NO: 1166062 - RNA, 19 nt, Homo sapiens
uguccaaggaugauaugua

SEQ ID NO: 1166063 - RNA, 19 nt, Homo sapiens
gcagacccaucuucaucac

SEQ ID NO: 1166064 - RNA, 19 nt, Homo sapiens
uaaacgacgggaagcucua

SEQ ID NO: 1166065 - RNA, 19 nt, Homo sapiens
ccgcagacccaucuucauc

SEQ ID NO: 1166066 - RNA, 19 nt, Homo sapiens
ugacuccuuccuccgauuu

SEQ ID NO: 1166067 - RNA, 19 nt, Homo sapiens
ucuacugccugguguccaa

SEQ ID NO: 1166068 - RNA, 19 nt, Homo sapiens
ccaaggaugauauguagcu

SEQ ID NO: 1166069 - RNA, 19 nt, Homo sapiens
gugacuccuuccuccgauu

SEQ ID NO: 1166070 - RNA, 19 nt, Homo sapiens
gaagagacccggagagaug

SEQ ID NO: 1166071 - RNA, 19 nt, Homo sapiens
gaacaagcaugaggacuuc

SEQ ID NO: 1166072 - RNA, 19 nt, Homo sapiens
guaccucucuuguauucua

SEQ ID NO: 1166073 - RNA, 19 nt, Homo sapiens
gcaccagcaucuucuacaa

SEQ ID NO: 1166074 - RNA, 19 nt, Homo sapiens
cagaagauggucacuuuaa

SEQ ID NO: 1166075 - RNA, 19 nt, Homo sapiens
uccagaagauggucacuuu

SEQ ID NO: 1166076 - RNA, 19 nt, Homo sapiens
ugugggagguguucaauga

SEQ ID NO: 1166077 - RNA, 19 nt, Homo sapiens
gaaacucacacaacaccuu

SEQ ID NO: 1166078 - RNA, 19 nt, Homo sapiens
ggagcuggaugaccuacau

SEQ ID NO: 1166079 - RNA, 19 nt, Homo sapiens
gcagucauuuaccaggauu

SEQ ID NO: 1166080 - RNA, 19 nt, Homo sapiens
guggacaucugcaagaaca

SEQ ID NO: 1166081 - RNA, 19 nt, Homo sapiens
cuacaaggccauugagaug

SEQ ID NO: 1166082 - RNA, 19 nt, Homo sapiens
guaacgaacaggagcagaa

SEQ ID NO: 1166083 - RNA, 19 nt, Homo sapiens
gagucucccugcugcugua

SEQ ID NO: 1166084 - RNA, 19 nt, Homo sapiens
ccagaagauggucacuuua

SEQ ID NO: 1166085 - RNA, 19 nt, Homo sapiens
gggaagagacccggagaga

SEQ ID NO: 1166086 - RNA, 19 nt, Homo sapiens
gcuagaggaggaccagaaa

SEQ ID NO: 1166087 - RNA, 19 nt, Homo sapiens
aggaacugcugguguggua

SEQ ID NO: 1166088 - RNA, 19 nt, Homo sapiens
gaggagggcaagacuggaa

SEQ ID NO: 1166089 - RNA, 19 nt, Homo sapiens
gcaggagagcggacuuaga

SEQ ID NO: 1166090 - RNA, 19 nt, Homo sapiens
caagaacaacaaccucaug

SEQ ID NO: 1166091 - RNA, 19 nt, Homo sapiens
guccugugcuucggaauga

SEQ ID NO: 1166092 - RNA, 19 nt, Homo sapiens
uacggaaacucacacaaca

SEQ ID NO: 1166093 - RNA, 19 nt, Homo sapiens
gaucggcaccagcaucuuc

SEQ ID NO: 1166094 - RNA, 19 nt, Homo sapiens
caagugugcacguaacgaa

SEQ ID NO: 1166095 - RNA, 19 nt, Homo sapiens
acaaggccauugagaugau

SEQ ID NO: 1166096 - RNA, 19 nt, Homo sapiens
gagaguggaggcacaaugg

SEQ ID NO: 1166097 - RNA, 19 nt, Homo sapiens
guacggaaacucacacaac

SEQ ID NO: 1166098 - RNA, 19 nt, Homo sapiens
gaugaggaaggagcucuuu

SEQ ID NO: 1166099 - RNA, 19 nt, Homo sapiens
ggaagagacccggagagau

SEQ ID NO: 1166100 - RNA, 19 nt, Homo sapiens
gaagugucgggaguccuua

SEQ ID NO: 1166101 - RNA, 19 nt, Homo sapiens
caggagagcggacuuagag

SEQ ID NO: 1166102 - RNA, 19 nt, Homo sapiens
aaacugcguucuacuucca

SEQ ID NO: 1166103 - RNA, 19 nt, Homo sapiens
gcaagaacaacaaccucau

SEQ ID NO: 1166104 - RNA, 19 nt, Homo sapiens
gaguggaggcacaauggaa

SEQ ID NO: 1166105 - RNA, 19 nt, Homo sapiens
agaacaagcaugaggacuu

SEQ ID NO: 1166106 - RNA, 19 nt, Homo sapiens
gaggugaucaucgcucaga

SEQ ID NO: 1166107 - RNA, 19 nt, Homo sapiens
caucaagugugcacguaac

SEQ ID NO: 1166108 - RNA, 19 nt, Homo sapiens
auuuguaccucucuuguau

SEQ ID NO: 1166109 - RNA, 19 nt, Homo sapiens
ugucgccucucacacuuug

SEQ ID NO: 1166110 - RNA, 19 nt, Homo sapiens
ccugggaaggcgaaauaua

SEQ ID NO: 1166111 - RNA, 19 nt, Homo sapiens
uacaucaagugugcacgua

SEQ ID NO: 1166112 - RNA, 19 nt, Homo sapiens
gaccaccggagcuggauga

SEQ ID NO: 1166113 - RNA, 19 nt, Homo sapiens
agaagauggucacuuuaac

SEQ ID NO: 1166114 - RNA, 19 nt, Homo sapiens
ccucuggugucgccucuca

SEQ ID NO: 1166115 - RNA, 19 nt, Homo sapiens
gaagauggucacuuuaacc

SEQ ID NO: 1166116 - RNA, 19 nt, Homo sapiens
ucgcagaugaggacacuga

SEQ ID NO: 1166117 - RNA, 19 nt, Homo sapiens
gaggaaggagcucuuugca

SEQ ID NO: 1166118 - RNA, 19 nt, Homo sapiens
uacgcaaccuugacaugug

SEQ ID NO: 1166119 - RNA, 19 nt, Homo sapiens
gguuaucaccuccgacauc

SEQ ID NO: 1166120 - RNA, 19 nt, Homo sapiens
cauuuguaccucucuugua

SEQ ID NO: 1166121 - RNA, 19 nt, Homo sapiens
uuguaccucucuuguauuc

SEQ ID NO: 1166122 - RNA, 19 nt, Homo sapiens
agguuaagguggcuucugu

SEQ ID NO: 1166123 - RNA, 19 nt, Homo sapiens
ugaagugucgggaguccuu

SEQ ID NO: 1166124 - RNA, 19 nt, Homo sapiens
caccgagaguccugugcuu

SEQ ID NO: 1166125 - RNA, 19 nt, Homo sapiens
gggcccuucucuccuuuag

SEQ ID NO: 1166126 - RNA, 19 nt, Homo sapiens
ggugugguacggaaacuca

SEQ ID NO: 1166127 - RNA, 19 nt, Homo sapiens
uaccucucuuguauucuaa

SEQ ID NO: 1166128 - RNA, 19 nt, Homo sapiens
ucugggcccuucucuccuu

SEQ ID NO: 1166129 - RNA, 19 nt, Homo sapiens
ggauucccguagggcguuu

SEQ ID NO: 1166130 - RNA, 19 nt, Homo sapiens
gcucaagaccgggcugaag

SEQ ID NO: 1166131 - RNA, 19 nt, Homo sapiens
gguagcagguguacaaauu

SEQ ID NO: 1166132 - RNA, 19 nt, Homo sapiens
guucagagguggcguaaau

SEQ ID NO: 1166133 - RNA, 19 nt, Homo sapiens
gcgcaacucucucaccaaa

SEQ ID NO: 1166134 - RNA, 19 nt, Homo sapiens
ggaagcuauugcagacuua

SEQ ID NO: 1166135 - RNA, 19 nt, Homo sapiens
uaagagcacgcaauauaua

SEQ ID NO: 1166136 - RNA, 19 nt, Homo sapiens
ucuaagagcacgcaauaua

SEQ ID NO: 1166137 - RNA, 19 nt, Homo sapiens
gcaacucucucaccaaacu

SEQ ID NO: 1166138 - RNA, 19 nt, Homo sapiens
gaauacaaauguggugugu

SEQ ID NO: 1166139 - RNA, 19 nt, Homo sapiens
uacaguggguauaguauuu

SEQ ID NO: 1166140 - RNA, 19 nt, Homo sapiens
guacaaauuggucaaguug

SEQ ID NO: 1166141 - RNA, 19 nt, Homo sapiens
ugacauccauauacuuguu

SEQ ID NO: 1166142 - RNA, 19 nt, Homo sapiens
uaucuguucucaugucaaa

SEQ ID NO: 1166143 - RNA, 19 nt, Homo sapiens
auacaaauguggugugugu

SEQ ID NO: 1166144 - RNA, 19 nt, Homo sapiens
ggucaaguugcaauuauuu

SEQ ID NO: 1166145 - RNA, 19 nt, Homo sapiens
guuagcauuucauugcaua

SEQ ID NO: 1166146 - RNA, 19 nt, Homo sapiens
gagcacgcaauauauaauu

SEQ ID NO: 1166147 - RNA, 19 nt, Homo sapiens
guucucaugucaaagacua

SEQ ID NO: 1166148 - RNA, 19 nt, Homo sapiens
gcaaaacacuagucacaau

SEQ ID NO: 1166149 - RNA, 19 nt, Homo sapiens
uggaugagcucacccugaa

SEQ ID NO: 1166150 - RNA, 19 nt, Homo sapiens
gagaggagucgaggguuua

SEQ ID NO: 1166151 - RNA, 19 nt, Homo sapiens
gcuggaggacguuuagaua

SEQ ID NO: 1166152 - RNA, 19 nt, Homo sapiens
uggaggaaauugugccuuu

SEQ ID NO: 1166153 - RNA, 19 nt, Homo sapiens
ccagcaaucucaacaagca

SEQ ID NO: 1166154 - RNA, 19 nt, Homo sapiens
gcaaguaugggcucaagau

SEQ ID NO: 1166155 - RNA, 19 nt, Homo sapiens
gaucuucuaccgagcauug

SEQ ID NO: 1166156 - RNA, 19 nt, Homo sapiens
aaucuaagagcacgcaaua

SEQ ID NO: 1166157 - RNA, 19 nt, Homo sapiens
guauuucacguuagcauuu

SEQ ID NO: 1166158 - RNA, 19 nt, Homo sapiens
guguguguauuucacguua

SEQ ID NO: 1166159 - RNA, 19 nt, Homo sapiens
uauaaugacugcuguacag

SEQ ID NO: 1166160 - RNA, 19 nt, Homo sapiens
agagaggagucgaggguuu

SEQ ID NO: 1166161 - RNA, 19 nt, Homo sapiens
cuuauuacccgcucaaauu

SEQ ID NO: 1166162 - RNA, 19 nt, Homo sapiens
gaaauugugccuuuugaaa

SEQ ID NO: 1166163 - RNA, 19 nt, Homo sapiens
ccacagcgacuccgacuca

SEQ ID NO: 1166164 - RNA, 19 nt, Homo sapiens
guacaguggguauaguauu

SEQ ID NO: 1166165 - RNA, 19 nt, Homo sapiens
gagcugacagugugguauu

SEQ ID NO: 1166166 - RNA, 19 nt, Homo sapiens
cuaagagcacgcaauauau

SEQ ID NO: 1166167 - RNA, 19 nt, Homo sapiens
caaaugugguguguguugu

SEQ ID NO: 1166168 - RNA, 19 nt, Homo sapiens
ccuucaagcugggcaagua

SEQ ID NO: 1166169 - RNA, 19 nt, Homo sapiens
ggaagagggacccaaugga

SEQ ID NO: 1166170 - RNA, 19 nt, Homo sapiens
acaaauuggucaaguugca

SEQ ID NO: 1166171 - RNA, 19 nt, Homo sapiens
ggucugcucuugguguuca

SEQ ID NO: 1166172 - RNA, 19 nt, Homo sapiens
ugacagugugguauucuaa

SEQ ID NO: 1166173 - RNA, 19 nt, Homo sapiens
uguacaaauuggucaaguu

SEQ ID NO: 1166174 - RNA, 19 nt, Homo sapiens
gauuuuaacugccacguau

SEQ ID NO: 1166175 - RNA, 19 nt, Homo sapiens
gaguccaucuccuacuuca

SEQ ID NO: 1166176 - RNA, 19 nt, Homo sapiens
cgagaguuuuguucacuua

SEQ ID NO: 1166177 - RNA, 19 nt, Homo sapiens
uggaagcuauugcagacuu

SEQ ID NO: 1166178 - RNA, 19 nt, Homo sapiens
acaaaugugguguguguug

SEQ ID NO: 1166179 - RNA, 19 nt, Homo sapiens
cgaguucugcggcaaggua

SEQ ID NO: 1166180 - RNA, 19 nt, Homo sapiens
ugaaguauccggaguccau

SEQ ID NO: 1166181 - RNA, 19 nt, Homo sapiens
aagagcacgcaauauauaa

SEQ ID NO: 1166182 - RNA, 19 nt, Homo sapiens
aaacacuagucacaauugg

SEQ ID NO: 1166183 - RNA, 19 nt, Homo sapiens
cggccaccaccgcuuauua

SEQ ID NO: 1166184 - RNA, 19 nt, Homo sapiens
gggaggagcgcuacaucug

SEQ ID NO: 1166185 - RNA, 19 nt, Homo sapiens
gguguguguuguuuuauaa

SEQ ID NO: 1166186 - RNA, 19 nt, Homo sapiens
ucuaaagcaugaaucuaag

SEQ ID NO: 1166187 - RNA, 19 nt, Homo sapiens
guagcagguguacaaauug

SEQ ID NO: 1166188 - RNA, 19 nt, Homo sapiens
ucccacaucuggugcugaa

SEQ ID NO: 1166189 - RNA, 19 nt, Homo sapiens
gggaagagggacccaaugg

SEQ ID NO: 1166190 - RNA, 19 nt, Homo sapiens
gguuuauucucgcaguaga

SEQ ID NO: 1166191 - RNA, 19 nt, Homo sapiens
gcgcaaguaugggcucaag

SEQ ID NO: 1166192 - RNA, 19 nt, Homo sapiens
cagcaucgaccgagagauc

SEQ ID NO: 1166193 - RNA, 19 nt, Homo sapiens
aaugugguguguguuguuu

SEQ ID NO: 1166194 - RNA, 19 nt, Homo sapiens
uagcagguguacaaauugg

SEQ ID NO: 1166195 - RNA, 19 nt, Homo sapiens
gcggucugcucuugguguu

SEQ ID NO: 1166196 - RNA, 19 nt, Homo sapiens
ccaagagcgacgacaguga

SEQ ID NO: 1166197 - RNA, 19 nt, Homo sapiens
ggagagcagcagcaagcaa

SEQ ID NO: 1166198 - RNA, 19 nt, Homo sapiens
ggcgugcgcucagcuuuca

SEQ ID NO: 1166199 - RNA, 19 nt, Homo sapiens
ggaggaaauugugccuuuu

SEQ ID NO: 1166200 - RNA, 19 nt, Homo sapiens
agugagaggucccacaucu

SEQ ID NO: 1166201 - RNA, 19 nt, Homo sapiens
ggacgcacacgggcuacaa

SEQ ID NO: 1166202 - RNA, 19 nt, Homo sapiens
cauuuuaucuguucucaug

SEQ ID NO: 1166203 - RNA, 19 nt, Homo sapiens
guucagaaucacaucaaug

SEQ ID NO: 1166204 - RNA, 19 nt, Homo sapiens
gaccgugcccuggacauga

SEQ ID NO: 1166205 - RNA, 19 nt, Homo sapiens
uuaaggcacaccugcguuu

SEQ ID NO: 1166206 - RNA, 19 nt, Homo sapiens
uggucaaguugcaauuauu

SEQ ID NO: 1166207 - RNA, 19 nt, Homo sapiens
ccagaaacucccaggaaca

SEQ ID NO: 1166208 - RNA, 19 nt, Homo sapiens
gaaucuaagagcacgcaau

SEQ ID NO: 1166209 - RNA, 19 nt, Homo sapiens
gacauccauauacuuguuu

SEQ ID NO: 1166210 - RNA, 19 nt, Homo sapiens
ugugacauccauauacuug

SEQ ID NO: 1166211 - RNA, 19 nt, Homo sapiens
caucuggugcugaaacuca

SEQ ID NO: 1166212 - RNA, 19 nt, Homo sapiens
gaccuggagcgacauguca

SEQ ID NO: 1166213 - RNA, 19 nt, Homo sapiens
gcgccagauuugaaacagu

SEQ ID NO: 1166214 - RNA, 19 nt, Homo sapiens
gagaucgccaugcacaauc

SEQ ID NO: 1166215 - RNA, 19 nt, Homo sapiens
cuaaagcaugaaucuaaga

SEQ ID NO: 1166216 - RNA, 19 nt, Homo sapiens
uuggucaaguugcaauuau

SEQ ID NO: 1166217 - RNA, 19 nt, Homo sapiens
aguaugggcucaagaucca

SEQ ID NO: 1166218 - RNA, 19 nt, Homo sapiens
uuauuacccgcucaaauug

SEQ ID NO: 1166219 - RNA, 19 nt, Homo sapiens
cugacagugugguauucua

SEQ ID NO: 1166220 - RNA, 19 nt, Homo sapiens
ugugguguguguuguuuua

SEQ ID NO: 1166221 - RNA, 19 nt, Homo sapiens
gcuuauuacccgcucaaau

SEQ ID NO: 1166222 - RNA, 19 nt, Homo sapiens
caaauuggucaaguugcaa

SEQ ID NO: 1166223 - RNA, 19 nt, Homo sapiens
ucacguuagcauuucauug

SEQ ID NO: 1166224 - RNA, 19 nt, Homo sapiens
gagagaucgccaugcacaa

SEQ ID NO: 1166225 - RNA, 19 nt, Homo sapiens
ccggaggacagaucuucua

SEQ ID NO: 1166226 - RNA, 19 nt, Homo sapiens
gagcagcagcaagcaagga

SEQ ID NO: 1166227 - RNA, 19 nt, Homo sapiens
gcuguacaguggguauagu

SEQ ID NO: 1166228 - RNA, 19 nt, Homo sapiens
caaaacacuagucacaauu

SEQ ID NO: 1166229 - RNA, 19 nt, Homo sapiens
ggaccuggagcgacauguc

SEQ ID NO: 1166230 - RNA, 19 nt, Homo sapiens
agaucgccaugcacaauca

SEQ ID NO: 1166231 - RNA, 19 nt, Homo sapiens
gaaccuaccuucuggauca

SEQ ID NO: 1166232 - RNA, 19 nt, Homo sapiens
caagauaccuaaacucaug

SEQ ID NO: 1166233 - RNA, 19 nt, Homo sapiens
ggaaauuucuucgaaggua

SEQ ID NO: 1166234 - RNA, 19 nt, Homo sapiens
guuaagaccucaaaguaaa

SEQ ID NO: 1166235 - RNA, 19 nt, Homo sapiens
gcucuacucuuucaaacua

SEQ ID NO: 1166236 - RNA, 19 nt, Homo sapiens
gcucagaaaugccuuaugu

SEQ ID NO: 1166237 - RNA, 19 nt, Homo sapiens
ccucuuagguguacucuuu

SEQ ID NO: 1166238 - RNA, 19 nt, Homo sapiens
gagaugcacaguuggauua

SEQ ID NO: 1166239 - RNA, 19 nt, Homo sapiens
aaaggaaccucuucgugua

SEQ ID NO: 1166240 - RNA, 19 nt, Homo sapiens
gauggcagcuggaaugaga

SEQ ID NO: 1166241 - RNA, 19 nt, Homo sapiens
cuacaaugacuuccuauua

SEQ ID NO: 1166242 - RNA, 19 nt, Homo sapiens
guaaaugaauguggugaaa

SEQ ID NO: 1166243 - RNA, 19 nt, Homo sapiens
ggacaaccucuuugaaauu

SEQ ID NO: 1166244 - RNA, 19 nt, Homo sapiens
gaaccagcuuccaaaguga

SEQ ID NO: 1166245 - RNA, 19 nt, Homo sapiens
guauauaccugagggcuuu

SEQ ID NO: 1166246 - RNA, 19 nt, Homo sapiens
gugaaaguauugacagaaa

SEQ ID NO: 1166247 - RNA, 19 nt, Homo sapiens
gcaagugucuuacagaacu

SEQ ID NO: 1166248 - RNA, 19 nt, Homo sapiens
gaaauagguacuucagauu

SEQ ID NO: 1166249 - RNA, 19 nt, Homo sapiens
gacaaccucuuugaaauug

SEQ ID NO: 1166250 - RNA, 19 nt, Homo sapiens
ugaaugcucuguauauugu

SEQ ID NO: 1166251 - RNA, 19 nt, Homo sapiens
caaccucuuugaaauugua

SEQ ID NO: 1166252 - RNA, 19 nt, Homo sapiens
gcagucagauuuccuacau

SEQ ID NO: 1166253 - RNA, 19 nt, Homo sapiens
gcaccuugguugaaaauua

SEQ ID NO: 1166254 - RNA, 19 nt, Homo sapiens
ccucauagacagucgauua

SEQ ID NO: 1166255 - RNA, 19 nt, Homo sapiens
gggacaaccucuuugaaau

SEQ ID NO: 1166256 - RNA, 19 nt, Homo sapiens
ggaauggguaaauguguua

SEQ ID NO: 1166257 - RNA, 19 nt, Homo sapiens
ccauuaagcuuaccuacau

SEQ ID NO: 1166258 - RNA, 19 nt, Homo sapiens
caugacagcugacuucuag

SEQ ID NO: 1166259 - RNA, 19 nt, Homo sapiens
ggaguggccaaacuaaaua

SEQ ID NO: 1166260 - RNA, 19 nt, Homo sapiens
guaacaacgucucgaacuu

SEQ ID NO: 1166261 - RNA, 19 nt, Homo sapiens
gcaaagcgacauaaugaug

SEQ ID NO: 1166262 - RNA, 19 nt, Homo sapiens
cugaagagaugcacaguug

SEQ ID NO: 1166263 - RNA, 19 nt, Homo sapiens
caaagugacugaacaagcu

SEQ ID NO: 1166264 - RNA, 19 nt, Homo sapiens
uaaagagguucauaaaguc

SEQ ID NO: 1166265 - RNA, 19 nt, Homo sapiens
agaaauagguacuucagau

SEQ ID NO: 1166266 - RNA, 19 nt, Homo sapiens
acaauaggcuacuucaaau

SEQ ID NO: 1166267 - RNA, 19 nt, Homo sapiens
caaaggcggaguucuguuu

SEQ ID NO: 1166268 - RNA, 19 nt, Homo sapiens
agaaaugccuuauguggau

SEQ ID NO: 1166269 - RNA, 19 nt, Homo sapiens
cauagacagucgauuauuc

SEQ ID NO: 1166270 - RNA, 19 nt, Homo sapiens
cacaauaggcuacuucaaa

SEQ ID NO: 1166271 - RNA, 19 nt, Homo sapiens
ggaaccucuucguguaaua

SEQ ID NO: 1166272 - RNA, 19 nt, Homo sapiens
ugaacuauuucuaggcuuu

SEQ ID NO: 1166273 - RNA, 19 nt, Homo sapiens
aaagcuggauauuguguaa

SEQ ID NO: 1166274 - RNA, 19 nt, Homo sapiens
cuacuaagcuaaggccaaa

SEQ ID NO: 1166275 - RNA, 19 nt, Homo sapiens
cagcugacuucuagaguga

SEQ ID NO: 1166276 - RNA, 19 nt, Homo sapiens
guagugaauucauuugcuu

SEQ ID NO: 1166277 - RNA, 19 nt, Homo sapiens
gaagagaugcacaguugga

SEQ ID NO: 1166278 - RNA, 19 nt, Homo sapiens
aagcaaagcgacauaauga

SEQ ID NO: 1166279 - RNA, 19 nt, Homo sapiens
ucacaaagccaucuuccuu

SEQ ID NO: 1166280 - RNA, 19 nt, Homo sapiens
ugaauguggugaaaguauu

SEQ ID NO: 1166281 - RNA, 19 nt, Homo sapiens
cuaguuggcuuucacacaa

SEQ ID NO: 1166282 - RNA, 19 nt, Homo sapiens
gcuauucaggugauaauuu

SEQ ID NO: 1166283 - RNA, 19 nt, Homo sapiens
agaaccagcuuccaaagug

SEQ ID NO: 1166284 - RNA, 19 nt, Homo sapiens
uaaaccaccucaagauagu

SEQ ID NO: 1166285 - RNA, 19 nt, Homo sapiens
uaacaacgucucgaacuuu

SEQ ID NO: 1166286 - RNA, 19 nt, Homo sapiens
caaagcgacauaaugauga

SEQ ID NO: 1166287 - RNA, 19 nt, Homo sapiens
caagagaaccagcuuccaa

SEQ ID NO: 1166288 - RNA, 19 nt, Homo sapiens
cagcaacucuuuggucuca

SEQ ID NO: 1166289 - RNA, 19 nt, Homo sapiens
ugauagcccugaagagaug

SEQ ID NO: 1166290 - RNA, 19 nt, Homo sapiens
aaagccaucuuccuuacuu

SEQ ID NO: 1166291 - RNA, 19 nt, Homo sapiens
gcggaguucuguuuuguua

SEQ ID NO: 1166292 - RNA, 19 nt, Homo sapiens
cagaaucgcauuugugguu

SEQ ID NO: 1166293 - RNA, 19 nt, Homo sapiens
gguaacaauguauguguaa

SEQ ID NO: 1166294 - RNA, 19 nt, Homo sapiens
gcugauagcccugaagaga

SEQ ID NO: 1166295 - RNA, 19 nt, Homo sapiens
cacaaagccaucuuccuua

SEQ ID NO: 1166296 - RNA, 19 nt, Homo sapiens
aaaugaauguggugaaagu

SEQ ID NO: 1166297 - RNA, 19 nt, Homo sapiens
aagcaagugucuuacagaa

SEQ ID NO: 1166298 - RNA, 19 nt, Homo sapiens
agucagauuuccuacauga

SEQ ID NO: 1166299 - RNA, 19 nt, Homo sapiens
ucuuuggucucaaccuuua

SEQ ID NO: 1166300 - RNA, 19 nt, Homo sapiens
ccuaaaccaccucaagaua

SEQ ID NO: 1166301 - RNA, 19 nt, Homo sapiens
gggaguggccaaacuaaau

SEQ ID NO: 1166302 - RNA, 19 nt, Homo sapiens
aagcuuaccuacauuucaa

SEQ ID NO: 1166303 - RNA, 19 nt, Homo sapiens
ccucugccguccucaguuu

SEQ ID NO: 1166304 - RNA, 19 nt, Homo sapiens
acucacagccuaauucuga

SEQ ID NO: 1166305 - RNA, 19 nt, Homo sapiens
gaauuccuuuggugcaguu

SEQ ID NO: 1166306 - RNA, 19 nt, Homo sapiens
ggguggaguuuaugccauu

SEQ ID NO: 1166307 - RNA, 19 nt, Homo sapiens
ugguagaauucacauauga

SEQ ID NO: 1166308 - RNA, 19 nt, Homo sapiens
aaacacgcuuuccguccua

SEQ ID NO: 1166309 - RNA, 19 nt, Homo sapiens
caacgucucgaacuuucua

SEQ ID NO: 1166310 - RNA, 19 nt, Homo sapiens
gauuauuccagucuuguuu

SEQ ID NO: 1166311 - RNA, 19 nt, Homo sapiens
guccaggaauguaagcaaa

SEQ ID NO: 1166312 - RNA, 19 nt, Homo sapiens
cuauucaggugauaauuuc

SEQ ID NO: 1166313 - RNA, 19 nt, Homo sapiens
ugauuugcuuucucucuuu

SEQ ID NO: 1166314 - RNA, 19 nt, Homo sapiens
uuaagggauugguagaauu

SEQ ID NO: 1166315 - RNA, 19 nt, Homo sapiens
gguguacucuuuauaagcu

SEQ ID NO: 1166316 - RNA, 19 nt, Homo sapiens
gaauguggugaaaguauug

SEQ ID NO: 1166317 - RNA, 19 nt, Homo sapiens
gauagccucuucacucacu

SEQ ID NO: 1166318 - RNA, 19 nt, Homo sapiens
uaccuaaacucaugauguc

SEQ ID NO: 1166319 - RNA, 19 nt, Homo sapiens
ucaucugucugaagcauug

SEQ ID NO: 1166320 - RNA, 19 nt, Homo sapiens
uaagcaaagcgacauaaug

SEQ ID NO: 1166321 - RNA, 19 nt, Homo sapiens
gccuaauucugauaaccua

SEQ ID NO: 1166322 - RNA, 19 nt, Homo sapiens
gggucucucucuuguaguu

SEQ ID NO: 1166323 - RNA, 19 nt, Homo sapiens
gugauuugcuuucucucuu

SEQ ID NO: 1166324 - RNA, 19 nt, Homo sapiens
gaugcacaguuggauuaaa

SEQ ID NO: 1166325 - RNA, 19 nt, Homo sapiens
acaaggagcagugaugaaa

SEQ ID NO: 1166326 - RNA, 19 nt, Homo sapiens
aagauaguuucguguggua

SEQ ID NO: 1166327 - RNA, 19 nt, Homo sapiens
ugaaaacagugggaaauuu

SEQ ID NO: 1166328 - RNA, 19 nt, Homo sapiens
gaauucuuauuacccacuu

SEQ ID NO: 1166329 - RNA, 19 nt, Homo sapiens
uaaccuaagucgccauggu

SEQ ID NO: 1166330 - RNA, 19 nt, Homo sapiens
ccauucauauuagaccuuu

SEQ ID NO: 1166331 - RNA, 19 nt, Homo sapiens
caacagaucugcacuuuga

SEQ ID NO: 1166332 - RNA, 19 nt, Homo sapiens
gcucagagguauuccuuua

SEQ ID NO: 1166333 - RNA, 19 nt, Homo sapiens
ugaagagacugcaugauua

SEQ ID NO: 1166334 - RNA, 19 nt, Homo sapiens
caccacaccuggauaauua

SEQ ID NO: 1166335 - RNA, 19 nt, Homo sapiens
gaaccaagaugaauagcaa

SEQ ID NO: 1166336 - RNA, 19 nt, Homo sapiens
caagacaccacaauaauua

SEQ ID NO: 1166337 - RNA, 19 nt, Homo sapiens
gcacaagacaccacaauaa

SEQ ID NO: 1166338 - RNA, 19 nt, Homo sapiens
gaaaggaaaucuguguauu

SEQ ID NO: 1166339 - RNA, 19 nt, Homo sapiens
guacaugagugcuuagaaa

SEQ ID NO: 1166340 - RNA, 19 nt, Homo sapiens
ucacuaagcacucguguua

SEQ ID NO: 1166341 - RNA, 19 nt, Homo sapiens
ccaaagugcugggauuaua

SEQ ID NO: 1166342 - RNA, 19 nt, Homo sapiens
uagcauagguuauacuuug

SEQ ID NO: 1166343 - RNA, 19 nt, Homo sapiens
ggccaucucugacuucuuu

SEQ ID NO: 1166344 - RNA, 19 nt, Homo sapiens
gccuguaugucaauuauua

SEQ ID NO: 1166345 - RNA, 19 nt, Homo sapiens
caccaugccuggcuaauuu

SEQ ID NO: 1166346 - RNA, 19 nt, Homo sapiens
caaaugcugugucuuauag

SEQ ID NO: 1166347 - RNA, 19 nt, Homo sapiens
gaagagacugcaugauuaa

SEQ ID NO: 1166348 - RNA, 19 nt, Homo sapiens
caacaucuguggacacuca

SEQ ID NO: 1166349 - RNA, 19 nt, Homo sapiens
gcuaagagauggugaagag

SEQ ID NO: 1166350 - RNA, 19 nt, Homo sapiens
gagaacauauagaagaaga

SEQ ID NO: 1166351 - RNA, 19 nt, Homo sapiens
gaugaagucucacuguguu

SEQ ID NO: 1166352 - RNA, 19 nt, Homo sapiens
ggacacucauucagaggua

SEQ ID NO: 1166353 - RNA, 19 nt, Homo sapiens
ggaugaagguagugaaugu

SEQ ID NO: 1166354 - RNA, 19 nt, Homo sapiens
acacuuaugccuuacauua

SEQ ID NO: 1166355 - RNA, 19 nt, Homo sapiens
ucucaaagguccucaguga

SEQ ID NO: 1166356 - RNA, 19 nt, Homo sapiens
gaacauguugaacugcuua

SEQ ID NO: 1166357 - RNA, 19 nt, Homo sapiens
cagagguauuccuuuauua

SEQ ID NO: 1166358 - RNA, 19 nt, Homo sapiens
ucagagguauuccuuuauu

SEQ ID NO: 1166359 - RNA, 19 nt, Homo sapiens
ucacugaacuaguagaugu

SEQ ID NO: 1166360 - RNA, 19 nt, Homo sapiens
gaucagaaggcaagggaua

SEQ ID NO: 1166361 - RNA, 19 nt, Homo sapiens
gaagauuguuacucugaug

SEQ ID NO: 1166362 - RNA, 19 nt, Homo sapiens
cauauucucuguucacaau

SEQ ID NO: 1166363 - RNA, 19 nt, Homo sapiens
aaagaguagucucauguuu

SEQ ID NO: 1166364 - RNA, 19 nt, Homo sapiens
ucacaauuguccuuucauu

SEQ ID NO: 1166365 - RNA, 19 nt, Homo sapiens
ucucaaaugcugugucuua

SEQ ID NO: 1166366 - RNA, 19 nt, Homo sapiens
ggaaaggaaaucuguguau

SEQ ID NO: 1166367 - RNA, 19 nt, Homo sapiens
gugaagagacugcaugauu

SEQ ID NO: 1166368 - RNA, 19 nt, Homo sapiens
ggugugaucuccauuccuu

SEQ ID NO: 1166369 - RNA, 19 nt, Homo sapiens
gccugggugucaauaauua

SEQ ID NO: 1166370 - RNA, 19 nt, Homo sapiens
ucaagaaccaagaugaaua

SEQ ID NO: 1166371 - RNA, 19 nt, Homo sapiens
gugcuggccuucuuaguga

SEQ ID NO: 1166372 - RNA, 19 nt, Homo sapiens
aaucaggucugcccuuuau

SEQ ID NO: 1166373 - RNA, 19 nt, Homo sapiens
caacagguccuaaaucagu

SEQ ID NO: 1166374 - RNA, 19 nt, Homo sapiens
gaaagaguagucucauguu

SEQ ID NO: 1166375 - RNA, 19 nt, Homo sapiens
ucaaggagaucucuuucug

SEQ ID NO: 1166376 - RNA, 19 nt, Homo sapiens
gguagacuaucuucaagga

SEQ ID NO: 1166377 - RNA, 19 nt, Homo sapiens
agaauugucuggcuggauu

SEQ ID NO: 1166378 - RNA, 19 nt, Homo sapiens
gaagaagaaggcuaagaga

SEQ ID NO: 1166379 - RNA, 19 nt, Homo sapiens
caacacagucggucaguau

SEQ ID NO: 1166380 - RNA, 19 nt, Homo sapiens
aaagcaaccucuaccauca

SEQ ID NO: 1166381 - RNA, 19 nt, Homo sapiens
agacagaggagaaagagua

SEQ ID NO: 1166382 - RNA, 19 nt, Homo sapiens
uuaaugcauuugcccaaua

SEQ ID NO: 1166383 - RNA, 19 nt, Homo sapiens
gcguaguaaugcaaucaua

SEQ ID NO: 1166384 - RNA, 19 nt, Homo sapiens
gaacuaguagaugucaaua

SEQ ID NO: 1166385 - RNA, 19 nt, Homo sapiens
gcuuagagccaggagauua

SEQ ID NO: 1166386 - RNA, 19 nt, Homo sapiens
caagaugaauagcaauaca

SEQ ID NO: 1166387 - RNA, 19 nt, Homo sapiens
gagaugagguuuugccauu

SEQ ID NO: 1166388 - RNA, 19 nt, Homo sapiens
gcccaacucuguucugauc

SEQ ID NO: 1166389 - RNA, 19 nt, Homo sapiens
agaaguuccugcauccuuu

SEQ ID NO: 1166390 - RNA, 19 nt, Homo sapiens
gguccucagugaaguuauu

SEQ ID NO: 1166391 - RNA, 19 nt, Homo sapiens
ugaaucaggucugcccuuu

SEQ ID NO: 1166392 - RNA, 19 nt, Homo sapiens
cuaaaucaguuugguauag

SEQ ID NO: 1166393 - RNA, 19 nt, Homo sapiens
ccaagucacuggccauucu

SEQ ID NO: 1166394 - RNA, 19 nt, Homo sapiens
guacauccuugccaucaca

SEQ ID NO: 1166395 - RNA, 19 nt, Homo sapiens
ucaguuugguauagaauug

SEQ ID NO: 1166396 - RNA, 19 nt, Homo sapiens
caugagugcuuagaaaugu

SEQ ID NO: 1166397 - RNA, 19 nt, Homo sapiens
gaaucaggucugcccuuua

SEQ ID NO: 1166398 - RNA, 19 nt, Homo sapiens
gcaucuguauauaacauug

SEQ ID NO: 1166399 - RNA, 19 nt, Homo sapiens
uaaugcauuugcccaauau

SEQ ID NO: 1166400 - RNA, 19 nt, Homo sapiens
caaggugggcggaucauga

SEQ ID NO: 1166401 - RNA, 19 nt, Homo sapiens
gagaggagagagcugauga

SEQ ID NO: 1166402 - RNA, 19 nt, Homo sapiens
ccaaagggaacauguugaa

SEQ ID NO: 1166403 - RNA, 19 nt, Homo sapiens
gaagcgugaucaucucagu

SEQ ID NO: 1166404 - RNA, 19 nt, Homo sapiens
uauagaagaagaaggcuaa

SEQ ID NO: 1166405 - RNA, 19 nt, Homo sapiens
gagguagacuaucuucaag

SEQ ID NO: 1166406 - RNA, 19 nt, Homo sapiens
gguauuccuuuauuaugug

SEQ ID NO: 1166407 - RNA, 19 nt, Homo sapiens
acaagacaccacaauaauu

SEQ ID NO: 1166408 - RNA, 19 nt, Homo sapiens
agaagaaggcuaagagaug

SEQ ID NO: 1166409 - RNA, 19 nt, Homo sapiens
cauaauacagucuuaagug

SEQ ID NO: 1166410 - RNA, 19 nt, Homo sapiens
gccaaugauucuaguuuca

SEQ ID NO: 1166411 - RNA, 19 nt, Homo sapiens
ucaaaugcugugucuuaua

SEQ ID NO: 1166412 - RNA, 19 nt, Homo sapiens
agacaucgaaguaguuauu

SEQ ID NO: 1166413 - RNA, 19 nt, Homo sapiens
gaacauauagaagaagaag

SEQ ID NO: 1166414 - RNA, 19 nt, Homo sapiens
guucacaauuguccuuuca

SEQ ID NO: 1166415 - RNA, 19 nt, Homo sapiens
ggaacauguugaacugcuu

SEQ ID NO: 1166416 - RNA, 19 nt, Homo sapiens
caagaaccaagaugaauag

SEQ ID NO: 1166417 - RNA, 19 nt, Homo sapiens
cgugaucccagucaucuua

SEQ ID NO: 1166418 - RNA, 19 nt, Homo sapiens
caaugauucuaguuucaga

SEQ ID NO: 1166419 - RNA, 19 nt, Homo sapiens
auacuuugcugacgauuca

SEQ ID NO: 1166420 - RNA, 19 nt, Homo sapiens
gugguuagcauagguuaua

SEQ ID NO: 1166421 - RNA, 19 nt, Homo sapiens
gagacugcaugauuaaacu

SEQ ID NO: 1166422 - RNA, 19 nt, Homo sapiens
aauuugaccuucuucauca

SEQ ID NO: 1166423 - RNA, 19 nt, Homo sapiens
caucacaucauucuuggaa

SEQ ID NO: 1166424 - RNA, 19 nt, Homo sapiens
ggccaaugauucuaguuuc

SEQ ID NO: 1166425 - RNA, 19 nt, Homo sapiens
aagcgauucuugugccuaa

SEQ ID NO: 1166426 - RNA, 19 nt, Homo sapiens
ggagugcaguagcaugauc

SEQ ID NO: 1166427 - RNA, 19 nt, Homo sapiens
gaugugaugccagauacua

SEQ ID NO: 1166428 - RNA, 19 nt, Homo sapiens
ugacugcugucucuuccaa

SEQ ID NO: 1166429 - RNA, 19 nt, Homo sapiens
uaagcacucguguuacuuu

SEQ ID NO: 1166430 - RNA, 19 nt, Homo sapiens
gcuauaaugcuaggaaaug

SEQ ID NO: 1166431 - RNA, 19 nt, Homo sapiens
ggaagaagaucauagagaa

SEQ ID NO: 1166432 - RNA, 19 nt, Homo sapiens
gaaaugcccuggagugaau

SEQ ID NO: 1166433 - RNA, 19 nt, Homo sapiens
gcacaccgccguacccuua

SEQ ID NO: 1166434 - RNA, 19 nt, Homo sapiens
ucaaagacuuguucaugaa

SEQ ID NO: 1166435 - RNA, 19 nt, Homo sapiens
gaccaaaucugcgcaugaa

SEQ ID NO: 1166436 - RNA, 19 nt, Homo sapiens
caaccggccuauccucuuu

SEQ ID NO: 1166437 - RNA, 19 nt, Homo sapiens
ucaacuaccugacggagaa

SEQ ID NO: 1166438 - RNA, 19 nt, Homo sapiens
gaaccuggcagaggccuua

SEQ ID NO: 1166439 - RNA, 19 nt, Homo sapiens
gaaugagaccuaccaguau

SEQ ID NO: 1166440 - RNA, 19 nt, Homo sapiens
gcaaguggaggacugauga

SEQ ID NO: 1166441 - RNA, 19 nt, Homo sapiens
agaaugagaccuaccagua

SEQ ID NO: 1166442 - RNA, 19 nt, Homo sapiens
ggaggaagaagaucauaga

SEQ ID NO: 1166443 - RNA, 19 nt, Homo sapiens
ggccaugccuucugugugu

SEQ ID NO: 1166444 - RNA, 19 nt, Homo sapiens
gcaaugaggaccagaccaa

SEQ ID NO: 1166445 - RNA, 19 nt, Homo sapiens
gaacccgugugccaacaug

SEQ ID NO: 1166446 - RNA, 19 nt, Homo sapiens
gaugaaugcccuuuacuuc

SEQ ID NO: 1166447 - RNA, 19 nt, Homo sapiens
agaaacgccuaacugauga

SEQ ID NO: 1166448 - RNA, 19 nt, Homo sapiens
ccaccugucuugcuccuau

SEQ ID NO: 1166449 - RNA, 19 nt, Homo sapiens
aacaagagguggaggaaga

SEQ ID NO: 1166450 - RNA, 19 nt, Homo sapiens
cagcuucucugcccacuca

SEQ ID NO: 1166451 - RNA, 19 nt, Homo sapiens
aaugagaccuaccaguauu

SEQ ID NO: 1166452 - RNA, 19 nt, Homo sapiens
ccaccauccuggacauuga

SEQ ID NO: 1166453 - RNA, 19 nt, Homo sapiens
ucaccaacaucaaagacuu

SEQ ID NO: 1166454 - RNA, 19 nt, Homo sapiens
acaagaaacgccuaacuga

SEQ ID NO: 1166455 - RNA, 19 nt, Homo sapiens
acaugaaggugugcaauga

SEQ ID NO: 1166456 - RNA, 19 nt, Homo sapiens
ggaugaaugcccuuuacuu

SEQ ID NO: 1166457 - RNA, 19 nt, Homo sapiens
guccugggcuggaugaaug

SEQ ID NO: 1166458 - RNA, 19 nt, Homo sapiens
caucaaagacuuguucaug

SEQ ID NO: 1166459 - RNA, 19 nt, Homo sapiens
ggacaaguggcgcaaguuc

SEQ ID NO: 1166460 - RNA, 19 nt, Homo sapiens
ccaaguuuguuaccaagau

SEQ ID NO: 1166461 - RNA, 19 nt, Homo sapiens
aagaaacgccuaacugaug

SEQ ID NO: 1166462 - RNA, 19 nt, Homo sapiens
ugguggaacugaacaagaa

SEQ ID NO: 1166463 - RNA, 19 nt, Homo sapiens
caaaucugcgcaugaaguu

SEQ ID NO: 1166464 - RNA, 19 nt, Homo sapiens
gcaccugucccgcaaguuc

SEQ ID NO: 1166465 - RNA, 19 nt, Homo sapiens
gccucuccauuauuuauuu

SEQ ID NO: 1166466 - RNA, 19 nt, Homo sapiens
gaccgcagguggugcuuca

SEQ ID NO: 1166467 - RNA, 19 nt, Homo sapiens
acaccaaguuuguuaccaa

SEQ ID NO: 1166468 - RNA, 19 nt, Homo sapiens
gaaagcacccauggacuca

SEQ ID NO: 1166469 - RNA, 19 nt, Homo sapiens
gaacuugggcaucaucaac

SEQ ID NO: 1166470 - RNA, 19 nt, Homo sapiens
caagaaacgccuaacugau

SEQ ID NO: 1166471 - RNA, 19 nt, Homo sapiens
aucaaagacuuguucauga

SEQ ID NO: 1166472 - RNA, 19 nt, Homo sapiens
caaguuuguuaccaagaug

SEQ ID NO: 1166473 - RNA, 19 nt, Homo sapiens
gcaucaugauccagaagau

SEQ ID NO: 1166474 - RNA, 19 nt, Homo sapiens
aaagacuuguucaugaaga

SEQ ID NO: 1166475 - RNA, 19 nt, Homo sapiens
uggacucacuguuugacua

SEQ ID NO: 1166476 - RNA, 19 nt, Homo sapiens
gcaagaaugagaccuacca

SEQ ID NO: 1166477 - RNA, 19 nt, Homo sapiens
aaccagaacuugggcauca

SEQ ID NO: 1166478 - RNA, 19 nt, Homo sapiens
gaagaagaucauagagaag

SEQ ID NO: 1166479 - RNA, 19 nt, Homo sapiens
cccauggacucacuguuug

SEQ ID NO: 1166480 - RNA, 19 nt, Homo sapiens
ggaccuauagcaucaugau

SEQ ID NO: 1166481 - RNA, 19 nt, Homo sapiens
ugccggugcucaauaaaug

SEQ ID NO: 1166482 - RNA, 19 nt, Homo sapiens
gcaagcacaucuggaagcu

SEQ ID NO: 1166483 - RNA, 19 nt, Homo sapiens
cuacaucauccucaccuuu

SEQ ID NO: 1166484 - RNA, 19 nt, Homo sapiens
ccaaaucugcgcaugaagu

SEQ ID NO: 1166485 - RNA, 19 nt, Homo sapiens
cagcugcucuacuucaucu

SEQ ID NO: 1166486 - RNA, 19 nt, Homo sapiens
gccaagacgggcaagauug

SEQ ID NO: 1166487 - RNA, 19 nt, Homo sapiens
uggagugaauucucucuuc

SEQ ID NO: 1166488 - RNA, 19 nt, Homo sapiens
ccaguguauuccucgcuuu

SEQ ID NO: 1166489 - RNA, 19 nt, Homo sapiens
gauuugccggugcucaaua

SEQ ID NO: 1166490 - RNA, 19 nt, Homo sapiens
cgaccaaaucugcgcauga

SEQ ID NO: 1166491 - RNA, 19 nt, Homo sapiens
guguauuccucgcuuuaug

SEQ ID NO: 1166492 - RNA, 19 nt, Homo sapiens
ccuaugggccaguguauuc

SEQ ID NO: 1166493 - RNA, 19 nt, Homo sapiens
gugagaacaccaaguuugu

SEQ ID NO: 1166494 - RNA, 19 nt, Homo sapiens
uggacgggcugcucccauu

SEQ ID NO: 1166495 - RNA, 19 nt, Homo sapiens
gcuggaugaaugcccuuua

SEQ ID NO: 1166496 - RNA, 19 nt, Homo sapiens
cuguggagcccaucaauga

SEQ ID NO: 1166497 - RNA, 19 nt, Homo sapiens
cgugagaacaccaaguuug

SEQ ID NO: 1166498 - RNA, 19 nt, Homo sapiens
gcugacaacacccgugaga

SEQ ID NO: 1166499 - RNA, 19 nt, Homo sapiens
cccugccucuccauuauuu

SEQ ID NO: 1166500 - RNA, 19 nt, Homo sapiens
gauuccugcucgucuacuu

SEQ ID NO: 1166501 - RNA, 19 nt, Homo sapiens
gaacugcugcgggacaagu

SEQ ID NO: 1166502 - RNA, 19 nt, Homo sapiens
uggagauccugguguacaa

SEQ ID NO: 1166503 - RNA, 19 nt, Homo sapiens
caguguauuccucgcuuua

SEQ ID NO: 1166504 - RNA, 19 nt, Homo sapiens
acaucaacguggucuccua

SEQ ID NO: 1166505 - RNA, 19 nt, Homo sapiens
ugacaacacccgugagaac

SEQ ID NO: 1166506 - RNA, 19 nt, Homo sapiens
agagcaagcacaucuggaa

SEQ ID NO: 1166507 - RNA, 19 nt, Homo sapiens
ccaaggagagcaagcacau

SEQ ID NO: 1166508 - RNA, 19 nt, Homo sapiens
gcccuggagugaauucucu

SEQ ID NO: 1166509 - RNA, 19 nt, Homo sapiens
ccaagaaagcacccaugga

SEQ ID NO: 1166510 - RNA, 19 nt, Homo sapiens
cacaagaaacgccuaacug

SEQ ID NO: 1166511 - RNA, 19 nt, Homo sapiens
gcuggugaccuacaucauc

SEQ ID NO: 1166512 - RNA, 19 nt, Homo sapiens
aagacuuguucaugaagaa

SEQ ID NO: 1166513 - RNA, 19 nt, Homo sapiens
cugcaaacacuacguggaa

SEQ ID NO: 1166514 - RNA, 19 nt, Homo sapiens
gcccuuccgugacaucuac

SEQ ID NO: 1166515 - RNA, 19 nt, Homo sapiens
cagcguggcagcuuugcaa

SEQ ID NO: 1166516 - RNA, 19 nt, Homo sapiens
agaccuaccaguauuaugg

SEQ ID NO: 1166517 - RNA, 19 nt, Homo sapiens
acccauggacucacuguuu

SEQ ID NO: 1166518 - RNA, 19 nt, Homo sapiens
ccuuccagcugcucuacuu

SEQ ID NO: 1166519 - RNA, 19 nt, Homo sapiens
uacaacagcaagauugaga

SEQ ID NO: 1166520 - RNA, 19 nt, Homo sapiens
gacaacacccgugagaaca

SEQ ID NO: 1166521 - RNA, 19 nt, Homo sapiens
ggacucacuguuugacuac

SEQ ID NO: 1166522 - RNA, 19 nt, Homo sapiens
ucuguagugucugggauuu

SEQ ID NO: 1166523 - RNA, 19 nt, Homo sapiens
caugaucggcuacgcuuca

SEQ ID NO: 1166524 - RNA, 19 nt, Homo sapiens
ggaguccacccuauaugag

SEQ ID NO: 1166525 - RNA, 19 nt, Homo sapiens
aauucucucuucauugaug

SEQ ID NO: 1166526 - RNA, 19 nt, Homo sapiens
ggccuauccucuuugacau

SEQ ID NO: 1166527 - RNA, 19 nt, Homo sapiens
guguacaacagcaagauug

SEQ ID NO: 1166528 - RNA, 19 nt, Homo sapiens
gguguacaacagcaagauu

SEQ ID NO: 1166529 - RNA, 19 nt, Homo sapiens
uggaggccgugcucaacaa

SEQ ID NO: 1166530 - RNA, 19 nt, Homo sapiens
ccucuccauuauuuauuug

SEQ ID NO: 1166531 - RNA, 19 nt, Homo sapiens
ggaagaagaucauagagaa

SEQ ID NO: 1166532 - RNA, 19 nt, Homo sapiens
gaaaugcccuggagugaau

SEQ ID NO: 1166533 - RNA, 19 nt, Homo sapiens
gcacaccgccguacccuua

SEQ ID NO: 1166534 - RNA, 19 nt, Homo sapiens
ucaaagacuuguucaugaa

SEQ ID NO: 1166535 - RNA, 19 nt, Homo sapiens
gaccaaaucugcgcaugaa

SEQ ID NO: 1166536 - RNA, 19 nt, Homo sapiens
caaccggccuauccucuuu

SEQ ID NO: 1166537 - RNA, 19 nt, Homo sapiens
ucaacuaccugacggagaa

SEQ ID NO: 1166538 - RNA, 19 nt, Homo sapiens
gaaccuggcagaggccuua

SEQ ID NO: 1166539 - RNA, 19 nt, Homo sapiens
gaaugagaccuaccaguau

SEQ ID NO: 1166540 - RNA, 19 nt, Homo sapiens
gcaaguggaggacugauga

SEQ ID NO: 1166541 - RNA, 19 nt, Homo sapiens
agaaugagaccuaccagua

SEQ ID NO: 1166542 - RNA, 19 nt, Homo sapiens
ggaggaagaagaucauaga

SEQ ID NO: 1166543 - RNA, 19 nt, Homo sapiens
ggccaugccuucugugugu

SEQ ID NO: 1166544 - RNA, 19 nt, Homo sapiens
gcaaugaggaccagaccaa

SEQ ID NO: 1166545 - RNA, 19 nt, Homo sapiens
gaacccgugugccaacaug

SEQ ID NO: 1166546 - RNA, 19 nt, Homo sapiens
gaugaaugcccuuuacuuc

SEQ ID NO: 1166547 - RNA, 19 nt, Homo sapiens
agaaacgccuaacugauga

SEQ ID NO: 1166548 - RNA, 19 nt, Homo sapiens
ccaccugucuugcuccuau

SEQ ID NO: 1166549 - RNA, 19 nt, Homo sapiens
aacaagagguggaggaaga

SEQ ID NO: 1166550 - RNA, 19 nt, Homo sapiens
cagcuucucugcccacuca

SEQ ID NO: 1166551 - RNA, 19 nt, Homo sapiens
aaugagaccuaccaguauu

SEQ ID NO: 1166552 - RNA, 19 nt, Homo sapiens
ccaccauccuggacauuga

SEQ ID NO: 1166553 - RNA, 19 nt, Homo sapiens
ucaccaacaucaaagacuu

SEQ ID NO: 1166554 - RNA, 19 nt, Homo sapiens
acaagaaacgccuaacuga

SEQ ID NO: 1166555 - RNA, 19 nt, Homo sapiens
acaugaaggugugcaauga

SEQ ID NO: 1166556 - RNA, 19 nt, Homo sapiens
ggaugaaugcccuuuacuu

SEQ ID NO: 1166557 - RNA, 19 nt, Homo sapiens
guccugggcuggaugaaug

SEQ ID NO: 1166558 - RNA, 19 nt, Homo sapiens
caucaaagacuuguucaug

SEQ ID NO: 1166559 - RNA, 19 nt, Homo sapiens
ggacaaguggcgcaaguuc

SEQ ID NO: 1166560 - RNA, 19 nt, Homo sapiens
ccaaguuuguuaccaagau

SEQ ID NO: 1166561 - RNA, 19 nt, Homo sapiens
aagaaacgccuaacugaug

SEQ ID NO: 1166562 - RNA, 19 nt, Homo sapiens
ugguggaacugaacaagaa

SEQ ID NO: 1166563 - RNA, 19 nt, Homo sapiens
caaaucugcgcaugaaguu

SEQ ID NO: 1166564 - RNA, 19 nt, Homo sapiens
gccucuccauuauuuauuu

SEQ ID NO: 1166565 - RNA, 19 nt, Homo sapiens
gaccgcagguggugcuuca

SEQ ID NO: 1166566 - RNA, 19 nt, Homo sapiens
acaccaaguuuguuaccaa

SEQ ID NO: 1166567 - RNA, 19 nt, Homo sapiens
gaaagcacccauggacuca

SEQ ID NO: 1166568 - RNA, 19 nt, Homo sapiens
gaacuugggcaucaucaac

SEQ ID NO: 1166569 - RNA, 19 nt, Homo sapiens
caagaaacgccuaacugau

SEQ ID NO: 1166570 - RNA, 19 nt, Homo sapiens
aucaaagacuuguucauga

SEQ ID NO: 1166571 - RNA, 19 nt, Homo sapiens
caaguuuguuaccaagaug

SEQ ID NO: 1166572 - RNA, 19 nt, Homo sapiens
gcaucaugauccagaagau

SEQ ID NO: 1166573 - RNA, 19 nt, Homo sapiens
aaagacuuguucaugaaga

SEQ ID NO: 1166574 - RNA, 19 nt, Homo sapiens
uggacucacuguuugacua

SEQ ID NO: 1166575 - RNA, 19 nt, Homo sapiens
gcaagaaugagaccuacca

SEQ ID NO: 1166576 - RNA, 19 nt, Homo sapiens
aaccagaacuugggcauca

SEQ ID NO: 1166577 - RNA, 19 nt, Homo sapiens
gaagaagaucauagagaag

SEQ ID NO: 1166578 - RNA, 19 nt, Homo sapiens
cccauggacucacuguuug

SEQ ID NO: 1166579 - RNA, 19 nt, Homo sapiens
ggaccuauagcaucaugau

SEQ ID NO: 1166580 - RNA, 19 nt, Homo sapiens
ugccggugcucaauaaaug

SEQ ID NO: 1166581 - RNA, 19 nt, Homo sapiens
gcaagcacaucuggaagcu

SEQ ID NO: 1166582 - RNA, 19 nt, Homo sapiens
cuacaucauccucaccuuu

SEQ ID NO: 1166583 - RNA, 19 nt, Homo sapiens
ccaaaucugcgcaugaagu

SEQ ID NO: 1166584 - RNA, 19 nt, Homo sapiens
cagcugcucuacuucaucu

SEQ ID NO: 1166585 - RNA, 19 nt, Homo sapiens
gccaagacgggcaagauug

SEQ ID NO: 1166586 - RNA, 19 nt, Homo sapiens
uggagugaauucucucuuc

SEQ ID NO: 1166587 - RNA, 19 nt, Homo sapiens
gauuugccggugcucaaua

SEQ ID NO: 1166588 - RNA, 19 nt, Homo sapiens
cgaccaaaucugcgcauga

SEQ ID NO: 1166589 - RNA, 19 nt, Homo sapiens
gugagaacaccaaguuugu

SEQ ID NO: 1166590 - RNA, 19 nt, Homo sapiens
uggacgggcugcucccauu

SEQ ID NO: 1166591 - RNA, 19 nt, Homo sapiens
gcuggaugaaugcccuuua

SEQ ID NO: 1166592 - RNA, 19 nt, Homo sapiens
cuguggagcccaucaauga

SEQ ID NO: 1166593 - RNA, 19 nt, Homo sapiens
cgugagaacaccaaguuug

SEQ ID NO: 1166594 - RNA, 19 nt, Homo sapiens
gcugacaacacccgugaga

SEQ ID NO: 1166595 - RNA, 19 nt, Homo sapiens
cccugccucuccauuauuu

SEQ ID NO: 1166596 - RNA, 19 nt, Homo sapiens
gauuccugcucgucuacuu

SEQ ID NO: 1166597 - RNA, 19 nt, Homo sapiens
gaacugcugcgggacaagu

SEQ ID NO: 1166598 - RNA, 19 nt, Homo sapiens
acaucaacguggucuccua

SEQ ID NO: 1166599 - RNA, 19 nt, Homo sapiens
ugacaacacccgugagaac

SEQ ID NO: 1166600 - RNA, 19 nt, Homo sapiens
agagcaagcacaucuggaa

SEQ ID NO: 1166601 - RNA, 19 nt, Homo sapiens
ccaaggagagcaagcacau

SEQ ID NO: 1166602 - RNA, 19 nt, Homo sapiens
gcccuggagugaauucucu

SEQ ID NO: 1166603 - RNA, 19 nt, Homo sapiens
ccaagaaagcacccaugga

SEQ ID NO: 1166604 - RNA, 19 nt, Homo sapiens
cacaagaaacgccuaacug

SEQ ID NO: 1166605 - RNA, 19 nt, Homo sapiens
gcuggugaccuacaucauc

SEQ ID NO: 1166606 - RNA, 19 nt, Homo sapiens
aagacuuguucaugaagaa

SEQ ID NO: 1166607 - RNA, 19 nt, Homo sapiens
cugcaaacacuacguggaa

SEQ ID NO: 1166608 - RNA, 19 nt, Homo sapiens
gcccuuccgugacaucuac

SEQ ID NO: 1166609 - RNA, 19 nt, Homo sapiens
cagcguggcagcuuugcaa

SEQ ID NO: 1166610 - RNA, 19 nt, Homo sapiens
agaccuaccaguauuaugg

SEQ ID NO: 1166611 - RNA, 19 nt, Homo sapiens
acccauggacucacuguuu

SEQ ID NO: 1166612 - RNA, 19 nt, Homo sapiens
ccuuccagcugcucuacuu

SEQ ID NO: 1166613 - RNA, 19 nt, Homo sapiens
gacaacacccgugagaaca

SEQ ID NO: 1166614 - RNA, 19 nt, Homo sapiens
ucuguagugucugggauuu

SEQ ID NO: 1166615 - RNA, 19 nt, Homo sapiens
ggacucacuguuugacuac

SEQ ID NO: 1166616 - RNA, 19 nt, Homo sapiens
caugaucggcuacgcuuca

SEQ ID NO: 1166617 - RNA, 19 nt, Homo sapiens
ggaguccacccuauaugag

SEQ ID NO: 1166618 - RNA, 19 nt, Homo sapiens
aauucucucuucauugaug

SEQ ID NO: 1166619 - RNA, 19 nt, Homo sapiens
uggaggccgugcucaacaa

SEQ ID NO: 1166620 - RNA, 19 nt, Homo sapiens
ggccuauccucuuugacau

SEQ ID NO: 1166621 - RNA, 19 nt, Homo sapiens
ccucuccauuauuuauuug

SEQ ID NO: 1166622 - RNA, 19 nt, Homo sapiens
gcgaugggcgaccaaaucu

SEQ ID NO: 1166623 - RNA, 19 nt, Homo sapiens
uacaucauccucaccuuug

SEQ ID NO: 1166624 - RNA, 19 nt, Homo sapiens
caacaugaaggugugcaau

SEQ ID NO: 1166625 - RNA, 19 nt, Homo sapiens
ucuacuugcucuucaugau

SEQ ID NO: 1166626 - RNA, 19 nt, Homo sapiens
caucaugauccagaagauu

SEQ ID NO: 1166627 - RNA, 19 nt, Homo sapiens
aagaaaugcccuggaguga

SEQ ID NO: 1166628 - RNA, 19 nt, Homo sapiens
caaagacuuguucaugaag

SEQ ID NO: 1166629 - RNA, 19 nt, Homo sapiens
gcgaggucauuacgcucuu

SEQ ID NO: 1166630 - RNA, 19 nt, Homo sapiens
gggauuugccggugcucaa

SEQ ID NO: 1166631 - RNA, 19 nt, Homo sapiens
ggaaggcccuguacaguga

SEQ ID NO: 1166632 - RNA, 19 nt, Homo sapiens
ggccagaacugccuaaauu

SEQ ID NO: 1166633 - RNA, 19 nt, Homo sapiens
gcaaggaaguaugggauua

SEQ ID NO: 1166634 - RNA, 19 nt, Homo sapiens
ggacauggcucugaagaug

SEQ ID NO: 1166635 - RNA, 19 nt, Homo sapiens
gcauuggucuagagcuuua

SEQ ID NO: 1166636 - RNA, 19 nt, Homo sapiens
gaaagcuggucauaugguu

SEQ ID NO: 1166637 - RNA, 19 nt, Homo sapiens
uaagcacuguuaccaauuu

SEQ ID NO: 1166638 - RNA, 19 nt, Homo sapiens
ggaaauacagguacccaaa

SEQ ID NO: 1166639 - RNA, 19 nt, Homo sapiens
cagcaugucucuucucgaa

SEQ ID NO: 1166640 - RNA, 19 nt, Homo sapiens
acacagagccaccuaguuu

SEQ ID NO: 1166641 - RNA, 19 nt, Homo sapiens
ucugaaagcuggucauaug

SEQ ID NO: 1166642 - RNA, 19 nt, Homo sapiens
gaacgcaggagcugucauu

SEQ ID NO: 1166643 - RNA, 19 nt, Homo sapiens
gcaaggaugccuacauguu

SEQ ID NO: 1166644 - RNA, 19 nt, Homo sapiens
ggagucgagucuagaauuc

SEQ ID NO: 1166645 - RNA, 19 nt, Homo sapiens
agaagcaaaugaugugauu

SEQ ID NO: 1166646 - RNA, 19 nt, Homo sapiens
gacccuaaaucuuuggaaa

SEQ ID NO: 1166647 - RNA, 19 nt, Homo sapiens
cauauguccuugcagaauu

SEQ ID NO: 1166648 - RNA, 19 nt, Homo sapiens
acaguuccauucuacauuu

SEQ ID NO: 1166649 - RNA, 19 nt, Homo sapiens
acagugacccuaaaucuuu

SEQ ID NO: 1166650 - RNA, 19 nt, Homo sapiens
uaagccagcucaugaaugg

SEQ ID NO: 1166651 - RNA, 19 nt, Homo sapiens
ccaccuaguuugucuuugu

SEQ ID NO: 1166652 - RNA, 19 nt, Homo sapiens
gaccuuaccuguacagcau

SEQ ID NO: 1166653 - RNA, 19 nt, Homo sapiens
ggaucaacgugacggugua

SEQ ID NO: 1166654 - RNA, 19 nt, Homo sapiens
ccaaggaccuggcuauggu

SEQ ID NO: 1166655 - RNA, 19 nt, Homo sapiens
aaauacagguacccaaaga

SEQ ID NO: 1166656 - RNA, 19 nt, Homo sapiens
gaacauggaggaggacuuc

SEQ ID NO: 1166657 - RNA, 19 nt, Homo sapiens
uaugguggcuucagacaug

SEQ ID NO: 1166658 - RNA, 19 nt, Homo sapiens
caauuuagcauauguccuu

SEQ ID NO: 1166659 - RNA, 19 nt, Homo sapiens
ggaaguaugggauuaugug

SEQ ID NO: 1166660 - RNA, 19 nt, Homo sapiens
ccacaaagaauuccagaca

SEQ ID NO: 1166661 - RNA, 19 nt, Homo sapiens
gcacuggauuuggaaacuu

SEQ ID NO: 1166662 - RNA, 19 nt, Homo sapiens
ugaggccgcugaagcugua

SEQ ID NO: 1166663 - RNA, 19 nt, Homo sapiens
ggaaacaucugcuuuuguc

SEQ ID NO: 1166664 - RNA, 19 nt, Homo sapiens
guacugaaugccguaaaua

SEQ ID NO: 1166665 - RNA, 19 nt, Homo sapiens
ccgcaaggaugccuacaug

SEQ ID NO: 1166666 - RNA, 19 nt, Homo sapiens
acaaagaauuccagacagu

SEQ ID NO: 1166667 - RNA, 19 nt, Homo sapiens
gaguaaaucaacaucugua

SEQ ID NO: 1166668 - RNA, 19 nt, Homo sapiens
cuaaaucuuuggaaacauc

SEQ ID NO: 1166669 - RNA, 19 nt, Homo sapiens
ccagacaguuccauucuac

SEQ ID NO: 1166670 - RNA, 19 nt, Homo sapiens
gaaugguaguggugccuau

SEQ ID NO: 1166671 - RNA, 19 nt, Homo sapiens
gaaguaugggauuauguga

SEQ ID NO: 1166672 - RNA, 19 nt, Homo sapiens
caaggaugccuacauguuc

SEQ ID NO: 1166673 - RNA, 19 nt, Homo sapiens
gaaauacagguacccaaag

SEQ ID NO: 1166674 - RNA, 19 nt, Homo sapiens
acagcuggaucucaucgua

SEQ ID NO: 1166675 - RNA, 19 nt, Homo sapiens
uggcagaggugucuaaggu

SEQ ID NO: 1166676 - RNA, 19 nt, Homo sapiens
acagguacccaaagaguaa

SEQ ID NO: 1166677 - RNA, 19 nt, Homo sapiens
aaacugaaguggccagaac

SEQ ID NO: 1166678 - RNA, 19 nt, Homo sapiens
caacgucuuugugaacaug

SEQ ID NO: 1166679 - RNA, 19 nt, Homo sapiens
gcagagcaaguacugaaug

SEQ ID NO: 1166680 - RNA, 19 nt, Homo sapiens
gagggaccaucaagugcaa

SEQ ID NO: 1166681 - RNA, 19 nt, Homo sapiens
guacagugacccuaaaucu

SEQ ID NO: 1166682 - RNA, 19 nt, Homo sapiens
gcgccauucuucccuguau

SEQ ID NO: 1166683 - RNA, 19 nt, Homo sapiens
cuaccaacgucuuugugaa

SEQ ID NO: 1166684 - RNA, 19 nt, Homo sapiens
ugacagugaucucaaacca

SEQ ID NO: 1166685 - RNA, 19 nt, Homo sapiens
aagcacuguuaccaauuua

SEQ ID NO: 1166686 - RNA, 19 nt, Homo sapiens
ugacagaagcaaaugaugu

SEQ ID NO: 1166687 - RNA, 19 nt, Homo sapiens
gucauaugguuccuucuga

SEQ ID NO: 1166688 - RNA, 19 nt, Homo sapiens
ucaacgugacgguguauaa

SEQ ID NO: 1166689 - RNA, 19 nt, Homo sapiens
acaauggagucgagucuag

SEQ ID NO: 1166690 - RNA, 19 nt, Homo sapiens
aaacugggaaauacaggua

SEQ ID NO: 1166691 - RNA, 19 nt, Homo sapiens
gacagaagcaaaugaugug

SEQ ID NO: 1166692 - RNA, 19 nt, Homo sapiens
gccaccaacuccugcaaga

SEQ ID NO: 1166693 - RNA, 19 nt, Homo sapiens
gucaauaaauguucuucuc

SEQ ID NO: 1166694 - RNA, 19 nt, Homo sapiens
gcauauguccuugcagaau

SEQ ID NO: 1166695 - RNA, 19 nt, Homo sapiens
aagaguaaaucaacaucug

SEQ ID NO: 1166696 - RNA, 19 nt, Homo sapiens
ccagaacugccuaaauuca

SEQ ID NO: 1166697 - RNA, 19 nt, Homo sapiens
caaagaauuccagacaguu

SEQ ID NO: 1166698 - RNA, 19 nt, Homo sapiens
cacuggauuuggaaacuuu

SEQ ID NO: 1166699 - RNA, 19 nt, Homo sapiens
gggcugugaucaagaaggu

SEQ ID NO: 1166700 - RNA, 19 nt, Homo sapiens
ggggugaacuucuauaaca

SEQ ID NO: 1166701 - RNA, 19 nt, Homo sapiens
cuucuucaguugccacaaa

SEQ ID NO: 1166702 - RNA, 19 nt, Homo sapiens
uggaaacuuugaggaaauu

SEQ ID NO: 1166703 - RNA, 19 nt, Homo sapiens
gaaucauuacucuauguug

SEQ ID NO: 1166704 - RNA, 19 nt, Homo sapiens
ucaguugccacaaagaauu

SEQ ID NO: 1166705 - RNA, 19 nt, Homo sapiens
caugaugguucuccugaag

SEQ ID NO: 1166706 - RNA, 19 nt, Homo sapiens
ugacucagcaagaauagga

SEQ ID NO: 1166707 - RNA, 19 nt, Homo sapiens
gcuuucuacuggauucuga

SEQ ID NO: 1166708 - RNA, 19 nt, Homo sapiens
gaagccagucauuagcauu

SEQ ID NO: 1166709 - RNA, 19 nt, Homo sapiens
gcuaccaacgucuuuguga

SEQ ID NO: 1166710 - RNA, 19 nt, Homo sapiens
acaacgagaugccuuaagc

SEQ ID NO: 1166711 - RNA, 19 nt, Homo sapiens
gcacucccacgucuacaau

SEQ ID NO: 1166712 - RNA, 19 nt, Homo sapiens
ccaaagaguaaaucaacau

SEQ ID NO: 1166713 - RNA, 19 nt, Homo sapiens
gacaguuccauucuacauu

SEQ ID NO: 1166714 - RNA, 19 nt, Homo sapiens
auauguccuugcagaauuu

SEQ ID NO: 1166715 - RNA, 19 nt, Homo sapiens
ucugguggcucuauuaugc

SEQ ID NO: 1166716 - RNA, 19 nt, Homo sapiens
ccacagaggagggcaagga

SEQ ID NO: 1166717 - RNA, 19 nt, Homo sapiens
caaggaaguaugggauuau

SEQ ID NO: 1166718 - RNA, 19 nt, Homo sapiens
cagugacccuaaaucuuug

SEQ ID NO: 1166719 - RNA, 19 nt, Homo sapiens
caacgugacgguguauaau

SEQ ID NO: 1166720 - RNA, 19 nt, Homo sapiens
agucuagaauucacacaga

SEQ ID NO: 1166721 - RNA, 19 nt, Homo sapiens
gaacacagauggggugaac

SEQ ID NO: 1166722 - RNA, 19 nt, Homo sapiens
gugcgguacuugucaugga

SEQ ID NO: 1166723 - RNA, 19 nt, Homo sapiens
cagcuucugcagaggauaa

SEQ ID NO: 1166724 - RNA, 19 nt, Homo sapiens
gacauggcucugaagauga

SEQ ID NO: 1166725 - RNA, 19 nt, Homo sapiens
ugaaguggaaggcccugua

SEQ ID NO: 1166726 - RNA, 19 nt, Homo sapiens
gccuuaagccagcucauga

SEQ ID NO: 1166727 - RNA, 19 nt, Homo sapiens
gggugaacuucuauaacau

SEQ ID NO: 1166728 - RNA, 19 nt, Homo sapiens
ggcugccagucuccuauuu

SEQ ID NO: 1166729 - RNA, 19 nt, Homo sapiens
ucauugaacagaacacaga

SEQ ID NO: 1166730 - RNA, 19 nt, Homo sapiens
uacugaaugccguaaauaa

SEQ ID NO: 1166731 - RNA, 19 nt, Homo sapiens
gaacaaacgcuaacuaaua

SEQ ID NO: 1166732 - RNA, 19 nt, Homo sapiens
ggacaaaccuaucacauuu

SEQ ID NO: 1166733 - RNA, 19 nt, Homo sapiens
ucacagacauuuccauaua

SEQ ID NO: 1166734 - RNA, 19 nt, Homo sapiens
gagcguaacugccacuuaa

SEQ ID NO: 1166735 - RNA, 19 nt, Homo sapiens
gaagucagauggacacauu

SEQ ID NO: 1166736 - RNA, 19 nt, Homo sapiens
gguaauaaaucuccuaaug

SEQ ID NO: 1166737 - RNA, 19 nt, Homo sapiens
gaggagauauucagacauu

SEQ ID NO: 1166738 - RNA, 19 nt, Homo sapiens
gaaaggacauguuacucaa

SEQ ID NO: 1166739 - RNA, 19 nt, Homo sapiens
ucagaaggcuguaauagaa

SEQ ID NO: 1166740 - RNA, 19 nt, Homo sapiens
ccauauaccucaugcauug

SEQ ID NO: 1166741 - RNA, 19 nt, Homo sapiens
ggaguggacuggagcguaa

SEQ ID NO: 1166742 - RNA, 19 nt, Homo sapiens
ccagagaguucuuuaaugu

SEQ ID NO: 1166743 - RNA, 19 nt, Homo sapiens
ggaggaaagugucaauaau

SEQ ID NO: 1166744 - RNA, 19 nt, Homo sapiens
ggaccucuauguucauuga

SEQ ID NO: 1166745 - RNA, 19 nt, Homo sapiens
gaaacuggguaauaaaucu

SEQ ID NO: 1166746 - RNA, 19 nt, Homo sapiens
gaugaaauccuaaguagug

SEQ ID NO: 1166747 - RNA, 19 nt, Homo sapiens
gaaaagagguguucaaagg

SEQ ID NO: 1166748 - RNA, 19 nt, Homo sapiens
uaaagaaaguggucaugga

SEQ ID NO: 1166749 - RNA, 19 nt, Homo sapiens
ggagauauucagacauuaa

SEQ ID NO: 1166750 - RNA, 19 nt, Homo sapiens
gaggaaagugucaauaauu

SEQ ID NO: 1166751 - RNA, 19 nt, Homo sapiens
ccucaugcauuguggguua

SEQ ID NO: 1166752 - RNA, 19 nt, Homo sapiens
guaaaucucuuugaacaag

SEQ ID NO: 1166753 - RNA, 19 nt, Homo sapiens
ggguaaaucucuuugaaca

SEQ ID NO: 1166754 - RNA, 19 nt, Homo sapiens
gcaaggcuauccagcacuu

SEQ ID NO: 1166755 - RNA, 19 nt, Homo sapiens
gaagauggucggaaucaga

SEQ ID NO: 1166756 - RNA, 19 nt, Homo sapiens
ggaacaacaugcugaaacu

SEQ ID NO: 1166757 - RNA, 19 nt, Homo sapiens
guacugagcugucaaaagu

SEQ ID NO: 1166758 - RNA, 19 nt, Homo sapiens
gaacggacgaucuccuuga

SEQ ID NO: 1166759 - RNA, 19 nt, Homo sapiens
gcaaagagagggacagaag

SEQ ID NO: 1166760 - RNA, 19 nt, Homo sapiens
guacuuucuucuauccuaa

SEQ ID NO: 1166761 - RNA, 19 nt, Homo sapiens
gacgaucuccuugaacuua

SEQ ID NO: 1166762 - RNA, 19 nt, Homo sapiens
gaugauuucugaagagagu

SEQ ID NO: 1166763 - RNA, 19 nt, Homo sapiens
cagagaagauggucggaau

SEQ ID NO: 1166764 - RNA, 19 nt, Homo sapiens
gagaugauuucugaagaga

SEQ ID NO: 1166765 - RNA, 19 nt, Homo sapiens
gacaaaccuaucacauuua

SEQ ID NO: 1166766 - RNA, 19 nt, Homo sapiens
gggacaaaccuaucacauu

SEQ ID NO: 1166767 - RNA, 19 nt, Homo sapiens
gaaauagugaucugaaucu

SEQ ID NO: 1166768 - RNA, 19 nt, Homo sapiens
agagaaguaccgaaaguua

SEQ ID NO: 1166769 - RNA, 19 nt, Homo sapiens
caaagcccaugguaacuuc

SEQ ID NO: 1166770 - RNA, 19 nt, Homo sapiens
ggacacugaugaaauacca

SEQ ID NO: 1166771 - RNA, 19 nt, Homo sapiens
aaguagugcuuucaaauug

SEQ ID NO: 1166772 - RNA, 19 nt, Homo sapiens
acagauggcugguuaggau

SEQ ID NO: 1166773 - RNA, 19 nt, Homo sapiens
caagaacaaacgcuaacua

SEQ ID NO: 1166774 - RNA, 19 nt, Homo sapiens
uguggaauguuuacuugua

SEQ ID NO: 1166775 - RNA, 19 nt, Homo sapiens
gcacuucauguauucagua

SEQ ID NO: 1166776 - RNA, 19 nt, Homo sapiens
gaacucagaaggcuguaau

SEQ ID NO: 1166777 - RNA, 19 nt, Homo sapiens
caugguaacuucugcuugu

SEQ ID NO: 1166778 - RNA, 19 nt, Homo sapiens
caaauuaucacaguucuca

SEQ ID NO: 1166779 - RNA, 19 nt, Homo sapiens
gagaaguaccgaaaguuau

SEQ ID NO: 1166780 - RNA, 19 nt, Homo sapiens
gaauaagugacuauccaaa

SEQ ID NO: 1166781 - RNA, 19 nt, Homo sapiens
gagugauuguggaauguuu

SEQ ID NO: 1166782 - RNA, 19 nt, Homo sapiens
gcgaauuacucgaggagau

SEQ ID NO: 1166783 - RNA, 19 nt, Homo sapiens
gugaaacgauggaccaaag

SEQ ID NO: 1166784 - RNA, 19 nt, Homo sapiens
aaagagagaaguaccgaaa

SEQ ID NO: 1166785 - RNA, 19 nt, Homo sapiens
auaagugacuauccaaaga

SEQ ID NO: 1166786 - RNA, 19 nt, Homo sapiens
caugaaaccacacgagauu

SEQ ID NO: 1166787 - RNA, 19 nt, Homo sapiens
guaauaaaucuccuaaugg

SEQ ID NO: 1166788 - RNA, 19 nt, Homo sapiens
ccacaaagcccaugguaac

SEQ ID NO: 1166789 - RNA, 19 nt, Homo sapiens
gaaaguaagaccaaaagaa

SEQ ID NO: 1166790 - RNA, 19 nt, Homo sapiens
ccuaaguagugcuuucaaa

SEQ ID NO: 1166791 - RNA, 19 nt, Homo sapiens
ugaaucgcgucacaaauca

SEQ ID NO: 1166792 - RNA, 19 nt, Homo sapiens
ggaugaaaguaagaccaaa

SEQ ID NO: 1166793 - RNA, 19 nt, Homo sapiens
ugaaaggacauguuacuca

SEQ ID NO: 1166794 - RNA, 19 nt, Homo sapiens
aagaacaaacgcuaacuaa

SEQ ID NO: 1166795 - RNA, 19 nt, Homo sapiens
caaagguaauccagagagu

SEQ ID NO: 1166796 - RNA, 19 nt, Homo sapiens
aagaucagagugacaguua

SEQ ID NO: 1166797 - RNA, 19 nt, Homo sapiens
gguaacuucugcuuguaau

SEQ ID NO: 1166798 - RNA, 19 nt, Homo sapiens
cauuccagcugaccacaaa

SEQ ID NO: 1166799 - RNA, 19 nt, Homo sapiens
cgaauuacucgaggagaua

SEQ ID NO: 1166800 - RNA, 19 nt, Homo sapiens
gaaaaggaaaucaguaaug

SEQ ID NO: 1166801 - RNA, 19 nt, Homo sapiens
ggaauaagugacuauccaa

SEQ ID NO: 1166802 - RNA, 19 nt, Homo sapiens
ggagcguaacugccacuua

SEQ ID NO: 1166803 - RNA, 19 nt, Homo sapiens
gaaggccucucacuguacu

SEQ ID NO: 1166804 - RNA, 19 nt, Homo sapiens
gguggugauugaccuaaga

SEQ ID NO: 1166805 - RNA, 19 nt, Homo sapiens
cuucauguauucaguacuu

SEQ ID NO: 1166806 - RNA, 19 nt, Homo sapiens
aaagagagggacagaagaa

SEQ ID NO: 1166807 - RNA, 19 nt, Homo sapiens
gagaagauggucggaauca

SEQ ID NO: 1166808 - RNA, 19 nt, Homo sapiens
gagauucuuuucccuauga

SEQ ID NO: 1166809 - RNA, 19 nt, Homo sapiens
gauucuccuucaguauuua

SEQ ID NO: 1166810 - RNA, 19 nt, Homo sapiens
agauucuccuucaguauuu

SEQ ID NO: 1166811 - RNA, 19 nt, Homo sapiens
gcucuugaaucgcgucaca

SEQ ID NO: 1166812 - RNA, 19 nt, Homo sapiens
cagauggacacauuaaaga

SEQ ID NO: 1166813 - RNA, 19 nt, Homo sapiens
agagagaaguaccgaaagu

SEQ ID NO: 1166814 - RNA, 19 nt, Homo sapiens
cugcugcucuuuaacaguu

SEQ ID NO: 1166815 - RNA, 19 nt, Homo sapiens
caugaaggccucucacugu

SEQ ID NO: 1166816 - RNA, 19 nt, Homo sapiens
ggagccugguggugauuga

SEQ ID NO: 1166817 - RNA, 19 nt, Homo sapiens
aaagaaaguggucauggaa

SEQ ID NO: 1166818 - RNA, 19 nt, Homo sapiens
agaaguaccgaaaguuauu

SEQ ID NO: 1166819 - RNA, 19 nt, Homo sapiens
ggccugguauguacagaug

SEQ ID NO: 1166820 - RNA, 19 nt, Homo sapiens
ucagagcuuuggacuguuc

SEQ ID NO: 1166821 - RNA, 19 nt, Homo sapiens
gaaauccuaaguagugcuu

SEQ ID NO: 1166822 - RNA, 19 nt, Homo sapiens
ccaaaacaauauagacuug

SEQ ID NO: 1166823 - RNA, 19 nt, Homo sapiens
guccuguaacuucaaauua

SEQ ID NO: 1166824 - RNA, 19 nt, Homo sapiens
guaccgaaaguuauuggaa

SEQ ID NO: 1166825 - RNA, 19 nt, Homo sapiens
agaaggcuguaauagaaga

SEQ ID NO: 1166826 - RNA, 19 nt, Homo sapiens
gaccaagauuagauugcuu

SEQ ID NO: 1166827 - RNA, 19 nt, Homo sapiens
acaaaccuaucacauuuac

SEQ ID NO: 1166828 - RNA, 19 nt, Homo sapiens
gcugaaacuggguaauaaa

SEQ ID NO: 1166829 - RNA, 19 nt, Homo sapiens
caucacuucuguucucaca

SEQ ID NO: 1166830 - RNA, 19 nt, Homo sapiens
aaauuauucuggugccuau

SEQ ID NO: 1166831 - RNA, 19 nt, Homo sapiens
ggaagaagcuggaugacau

SEQ ID NO: 1166832 - RNA, 19 nt, Homo sapiens
ccaccacccugaagacuua

SEQ ID NO: 1166833 - RNA, 19 nt, Homo sapiens
cauaagaccuucacgacaa

SEQ ID NO: 1166834 - RNA, 19 nt, Homo sapiens
gaagugaacaucagcugua

SEQ ID NO: 1166835 - RNA, 19 nt, Homo sapiens
caggagagauggugaaguu

SEQ ID NO: 1166836 - RNA, 19 nt, Homo sapiens
gcagggagcuucggagaga

SEQ ID NO: 1166837 - RNA, 19 nt, Homo sapiens
ugacaaagacgacaacuug

SEQ ID NO: 1166838 - RNA, 19 nt, Homo sapiens
ggagggcagugucccaauu

SEQ ID NO: 1166839 - RNA, 19 nt, Homo sapiens
gauacacgcugcaggugaa

SEQ ID NO: 1166840 - RNA, 19 nt, Homo sapiens
gaacagcaagaacuauuug

SEQ ID NO: 1166841 - RNA, 19 nt, Homo sapiens
acacaugccugcagacaga

SEQ ID NO: 1166842 - RNA, 19 nt, Homo sapiens
caaaguccaaugcacaaua

SEQ ID NO: 1166843 - RNA, 19 nt, Homo sapiens
ggcaagcaaacaaguauua

SEQ ID NO: 1166844 - RNA, 19 nt, Homo sapiens
uaacggcuguucucaggaa

SEQ ID NO: 1166845 - RNA, 19 nt, Homo sapiens
ggaacagcaagaacuauuu

SEQ ID NO: 1166846 - RNA, 19 nt, Homo sapiens
guaacaaccuccuccucuu

SEQ ID NO: 1166847 - RNA, 19 nt, Homo sapiens
gaacaucagcuguaacaac

SEQ ID NO: 1166848 - RNA, 19 nt, Homo sapiens
ggagucagacaagaaauuu

SEQ ID NO: 1166849 - RNA, 19 nt, Homo sapiens
gagggcagugucccaauua

SEQ ID NO: 1166850 - RNA, 19 nt, Homo sapiens
ccaaagauuucauccaacu

SEQ ID NO: 1166851 - RNA, 19 nt, Homo sapiens
caaauaccaccaaagaaga

SEQ ID NO: 1166852 - RNA, 19 nt, Homo sapiens
uaccaugccuuucuacguu

SEQ ID NO: 1166853 - RNA, 19 nt, Homo sapiens
gcacagcagcguccagguu

SEQ ID NO: 1166854 - RNA, 19 nt, Homo sapiens
ggccuggacuggcgagauu

SEQ ID NO: 1166855 - RNA, 19 nt, Homo sapiens
ccaaauaccaccaaagaag

SEQ ID NO: 1166856 - RNA, 19 nt, Homo sapiens
cagaugagcacuucacaga

SEQ ID NO: 1166857 - RNA, 19 nt, Homo sapiens
guaccugaauggugucaau

SEQ ID NO: 1166858 - RNA, 19 nt, Homo sapiens
caacagcuuucaggagaug

SEQ ID NO: 1166859 - RNA, 19 nt, Homo sapiens
gaaagaaagguccaagcau

SEQ ID NO: 1166860 - RNA, 19 nt, Homo sapiens
ucacugcaaucaucuucaa

SEQ ID NO: 1166861 - RNA, 19 nt, Homo sapiens
cgcaagggcuccuggaaga

SEQ ID NO: 1166862 - RNA, 19 nt, Homo sapiens
gagauggagucagacaaga

SEQ ID NO: 1166863 - RNA, 19 nt, Homo sapiens
gaaacugggcacagaagga

SEQ ID NO: 1166864 - RNA, 19 nt, Homo sapiens
ggaaccgcuucacuucuug

SEQ ID NO: 1166865 - RNA, 19 nt, Homo sapiens
gggcagugucccaauuaua

SEQ ID NO: 1166866 - RNA, 19 nt, Homo sapiens
gauggagucagacaagaaa

SEQ ID NO: 1166867 - RNA, 19 nt, Homo sapiens
cgaaccggaugguagugua

SEQ ID NO: 1166868 - RNA, 19 nt, Homo sapiens
cuccaaagauuucauccaa

SEQ ID NO: 1166869 - RNA, 19 nt, Homo sapiens
gaaaucgugggcuacuauu

SEQ ID NO: 1166870 - RNA, 19 nt, Homo sapiens
caagcugccugucaccaau

SEQ ID NO: 1166871 - RNA, 19 nt, Homo sapiens
gaagaagcuggaugacaug

SEQ ID NO: 1166872 - RNA, 19 nt, Homo sapiens
cuggaucgguacagaagua

SEQ ID NO: 1166873 - RNA, 19 nt, Homo sapiens
aaaguccaaugcacaauag

SEQ ID NO: 1166874 - RNA, 19 nt, Homo sapiens
cacagcagcguccagguua

SEQ ID NO: 1166875 - RNA, 19 nt, Homo sapiens
ugaaguuccucacugcaau

SEQ ID NO: 1166876 - RNA, 19 nt, Homo sapiens
acagagcacuggugugaag

SEQ ID NO: 1166877 - RNA, 19 nt, Homo sapiens
ccaggaacagcaagaacua

SEQ ID NO: 1166878 - RNA, 19 nt, Homo sapiens
gagagaaagcccaggaaca

SEQ ID NO: 1166879 - RNA, 19 nt, Homo sapiens
gaggcaagcaaacaaguau

SEQ ID NO: 1166880 - RNA, 19 nt, Homo sapiens
ggagauggagucagacaag

SEQ ID NO: 1166881 - RNA, 19 nt, Homo sapiens
cagcaagaacuauuuguca

SEQ ID NO: 1166882 - RNA, 19 nt, Homo sapiens
cagcccagcuuccuucucu

SEQ ID NO: 1166883 - RNA, 19 nt, Homo sapiens
cagaaaucgugggcuacua

SEQ ID NO: 1166884 - RNA, 19 nt, Homo sapiens
ccacuucaccuacaccaau

SEQ ID NO: 1166885 - RNA, 19 nt, Homo sapiens
gcaagcugccugucaccaa

SEQ ID NO: 1166886 - RNA, 19 nt, Homo sapiens
cgaucucgcugcucuucaa

SEQ ID NO: 1166887 - RNA, 19 nt, Homo sapiens
gcccaauguucgauacuca

SEQ ID NO: 1166888 - RNA, 19 nt, Homo sapiens
caagcaaacaaguauuaga

SEQ ID NO: 1166889 - RNA, 19 nt, Homo sapiens
uaacaaccuccuccucuuc

SEQ ID NO: 1166890 - RNA, 19 nt, Homo sapiens
gcucuggcaucauacaaac

SEQ ID NO: 1166891 - RNA, 19 nt, Homo sapiens
guuccucacugcaaucauc

SEQ ID NO: 1166892 - RNA, 19 nt, Homo sapiens
auaagaccuucacgacaaa

SEQ ID NO: 1166893 - RNA, 19 nt, Homo sapiens
gaaccggaugguaguguau

SEQ ID NO: 1166894 - RNA, 19 nt, Homo sapiens
gugccugggucuaacaugu

SEQ ID NO: 1166895 - RNA, 19 nt, Homo sapiens
aggaaccgcuucacuucuu

SEQ ID NO: 1166896 - RNA, 19 nt, Homo sapiens
cauccucccuguucucagu

SEQ ID NO: 1166897 - RNA, 19 nt, Homo sapiens
gugaacaucagcuguaaca

SEQ ID NO: 1166898 - RNA, 19 nt, Homo sapiens
agaucugucuuucuccaaa

SEQ ID NO: 1166899 - RNA, 19 nt, Homo sapiens
aagaaagguccaagcauga

SEQ ID NO: 1166900 - RNA, 19 nt, Homo sapiens
uggaugacaugcagaacau

SEQ ID NO: 1166901 - RNA, 19 nt, Homo sapiens
auacaggcguuaccuccuu

SEQ ID NO: 1166902 - RNA, 19 nt, Homo sapiens
ccuggaaacugggcacaga

SEQ ID NO: 1166903 - RNA, 19 nt, Homo sapiens
uacguucucuuucuuccaa

SEQ ID NO: 1166904 - RNA, 19 nt, Homo sapiens
ccugaagacuuaccuagac

SEQ ID NO: 1166905 - RNA, 19 nt, Homo sapiens
gagcuuugucucagaaauc

SEQ ID NO: 1166906 - RNA, 19 nt, Homo sapiens
aaacaacacgcacuuucug

SEQ ID NO: 1166907 - RNA, 19 nt, Homo sapiens
ggacacaugccugcagaca

SEQ ID NO: 1166908 - RNA, 19 nt, Homo sapiens
gagcacuggugugaagauc

SEQ ID NO: 1166909 - RNA, 19 nt, Homo sapiens
gagcccagugaguucaaua

SEQ ID NO: 1166910 - RNA, 19 nt, Homo sapiens
caccaaagaagaaagaaag

SEQ ID NO: 1166911 - RNA, 19 nt, Homo sapiens
ccaccaaagaagaaagaaa

SEQ ID NO: 1166912 - RNA, 19 nt, Homo sapiens
ggcagugucccaauuauac

SEQ ID NO: 1166913 - RNA, 19 nt, Homo sapiens
aagugaacaucagcuguaa

SEQ ID NO: 1166914 - RNA, 19 nt, Homo sapiens
aaucgugggcuacuauuau

SEQ ID NO: 1166915 - RNA, 19 nt, Homo sapiens
gagagagaaagcccaggaa

SEQ ID NO: 1166916 - RNA, 19 nt, Homo sapiens
gaccuucacgacaaaguau

SEQ ID NO: 1166917 - RNA, 19 nt, Homo sapiens
gguagacgucaacagcuuu

SEQ ID NO: 1166918 - RNA, 19 nt, Homo sapiens
gcccagugaguucaauaaa

SEQ ID NO: 1166919 - RNA, 19 nt, Homo sapiens
caaacuccuucuccuacca

SEQ ID NO: 1166920 - RNA, 19 nt, Homo sapiens
gcaagcaaacaaguauuag

SEQ ID NO: 1166921 - RNA, 19 nt, Homo sapiens
agaaaucgugggcuacuau

SEQ ID NO: 1166922 - RNA, 19 nt, Homo sapiens
ggcaaggccucaucuaccu

SEQ ID NO: 1166923 - RNA, 19 nt, Homo sapiens
gcaagggcuccuggaagaa

SEQ ID NO: 1166924 - RNA, 19 nt, Homo sapiens
ggagcccaauguucgauac

SEQ ID NO: 1166925 - RNA, 19 nt, Homo sapiens
uucaggagauggagucaga

SEQ ID NO: 1166926 - RNA, 19 nt, Homo sapiens
agagaaagcccaggaacau

SEQ ID NO: 1166927 - RNA, 19 nt, Homo sapiens
acagcagcguccagguuaa

SEQ ID NO: 1166928 - RNA, 19 nt, Homo sapiens
gcaugaggaggaccaguuc

SEQ ID NO: 1166929 - RNA, 19 nt, Homo sapiens
agaaagaaagguccaagca

SEQ ID NO: 1166930 - RNA, 19 nt, Homo sapiens
aaauaccaccaaagaagaa

SEQ ID NO: 1166931 - RNA, 19 nt, Homo sapiens
ccugauagcuucauguuua

SEQ ID NO: 1166932 - RNA, 19 nt, Homo sapiens
caaaggaugucuagaugua

SEQ ID NO: 1166933 - RNA, 19 nt, Homo sapiens
ugaaauaucugugccuuua

SEQ ID NO: 1166934 - RNA, 19 nt, Homo sapiens
caaauaagaugcaugcuau

SEQ ID NO: 1166935 - RNA, 19 nt, Homo sapiens
gacaacaucugcucuauau

SEQ ID NO: 1166936 - RNA, 19 nt, Homo sapiens
ggacaugucucagauauca

SEQ ID NO: 1166937 - RNA, 19 nt, Homo sapiens
gagaggaaaugcaauguga

SEQ ID NO: 1166938 - RNA, 19 nt, Homo sapiens
gaugacagccaaauuguua

SEQ ID NO: 1166939 - RNA, 19 nt, Homo sapiens
gcauauaaaugguucuuga

SEQ ID NO: 1166940 - RNA, 19 nt, Homo sapiens
gaaacagacagaaaugaua

SEQ ID NO: 1166941 - RNA, 19 nt, Homo sapiens
gguaaagucuuggauuauu

SEQ ID NO: 1166942 - RNA, 19 nt, Homo sapiens
ggccagagauuagagauuu

SEQ ID NO: 1166943 - RNA, 19 nt, Homo sapiens
caacaucugcucuauauau

SEQ ID NO: 1166944 - RNA, 19 nt, Homo sapiens
gcacagaaacagacagaaa

SEQ ID NO: 1166945 - RNA, 19 nt, Homo sapiens
gguaauagcauauaaaugg

SEQ ID NO: 1166946 - RNA, 19 nt, Homo sapiens
gaacaacugcggaaucaga

SEQ ID NO: 1166947 - RNA, 19 nt, Homo sapiens
ugauauaucuggagaaauc

SEQ ID NO: 1166948 - RNA, 19 nt, Homo sapiens
ugaugccucuuccaaauua

SEQ ID NO: 1166949 - RNA, 19 nt, Homo sapiens
ggauaaaggcaaauuaaga

SEQ ID NO: 1166950 - RNA, 19 nt, Homo sapiens
uaaaggaguuagagagcua

SEQ ID NO: 1166951 - RNA, 19 nt, Homo sapiens
uaaagcaguucuuaaagga

SEQ ID NO: 1166952 - RNA, 19 nt, Homo sapiens
caucaaauauggacucugu

SEQ ID NO: 1166953 - RNA, 19 nt, Homo sapiens
uaaaguggauaaaggcaaa

SEQ ID NO: 1166954 - RNA, 19 nt, Homo sapiens
agagaagugugaaaucuaa

SEQ ID NO: 1166955 - RNA, 19 nt, Homo sapiens
gcaagaagcagaacaacug

SEQ ID NO: 1166956 - RNA, 19 nt, Homo sapiens
ggagagaagugugaaaucu

SEQ ID NO: 1166957 - RNA, 19 nt, Homo sapiens
ggacaacaucugcucuaua

SEQ ID NO: 1166958 - RNA, 19 nt, Homo sapiens
cagaguggcuuacaccuau

SEQ ID NO: 1166959 - RNA, 19 nt, Homo sapiens
ggacauacauaagaaacau

SEQ ID NO: 1166960 - RNA, 19 nt, Homo sapiens
ggaccaguguauuaauuug

SEQ ID NO: 1166961 - RNA, 19 nt, Homo sapiens
guaaagucuuggauuauuc

SEQ ID NO: 1166962 - RNA, 19 nt, Homo sapiens
gauuagagauuucacugau

SEQ ID NO: 1166963 - RNA, 19 nt, Homo sapiens
ggaagaaccaggcacagaa

SEQ ID NO: 1166964 - RNA, 19 nt, Homo sapiens
cagauuacaucaaauaugg

SEQ ID NO: 1166965 - RNA, 19 nt, Homo sapiens
uaugaucaguugacacuuu

SEQ ID NO: 1166966 - RNA, 19 nt, Homo sapiens
cuaaauagcuggacuuucc

SEQ ID NO: 1166967 - RNA, 19 nt, Homo sapiens
caaaaggaccaguguauua

SEQ ID NO: 1166968 - RNA, 19 nt, Homo sapiens
gaagaaccaggcacagaaa

SEQ ID NO: 1166969 - RNA, 19 nt, Homo sapiens
gacaauaucaucuguggaa

SEQ ID NO: 1166970 - RNA, 19 nt, Homo sapiens
ggagaugugaugagucuuu

SEQ ID NO: 1166971 - RNA, 19 nt, Homo sapiens
caaaugcgaacaagacgua

SEQ ID NO: 1166972 - RNA, 19 nt, Homo sapiens
gcuaauaugugcaucaacu

SEQ ID NO: 1166973 - RNA, 19 nt, Homo sapiens
guauacaucuagagaggaa

SEQ ID NO: 1166974 - RNA, 19 nt, Homo sapiens
uaagagauccugauagcuu

SEQ ID NO: 1166975 - RNA, 19 nt, Homo sapiens
cuaaauacucccaaacuuu

SEQ ID NO: 1166976 - RNA, 19 nt, Homo sapiens
uaaccuaaauacucccaaa

SEQ ID NO: 1166977 - RNA, 19 nt, Homo sapiens
gaacauguguaacuuaacc

SEQ ID NO: 1166978 - RNA, 19 nt, Homo sapiens
uaaccuuggugaauuguug

SEQ ID NO: 1166979 - RNA, 19 nt, Homo sapiens
ugggauagcuauacaacaa

SEQ ID NO: 1166980 - RNA, 19 nt, Homo sapiens
ggaguuagagagcuauauu

SEQ ID NO: 1166981 - RNA, 19 nt, Homo sapiens
cagaacaacugcggaauca

SEQ ID NO: 1166982 - RNA, 19 nt, Homo sapiens
gauggaauguguagacagu

SEQ ID NO: 1166983 - RNA, 19 nt, Homo sapiens
gagaguaagccgagaguug

SEQ ID NO: 1166984 - RNA, 19 nt, Homo sapiens
ggauagcuauacaacaaau

SEQ ID NO: 1166985 - RNA, 19 nt, Homo sapiens
ggugguuuauuucauguuu

SEQ ID NO: 1166986 - RNA, 19 nt, Homo sapiens
uauagcagcucgccauugu

SEQ ID NO: 1166987 - RNA, 19 nt, Homo sapiens
guagauggcaguuaugaau

SEQ ID NO: 1166988 - RNA, 19 nt, Homo sapiens
auauagacgugcauuguuu

SEQ ID NO: 1166989 - RNA, 19 nt, Homo sapiens
gaguuagagagcuauauua

SEQ ID NO: 1166990 - RNA, 19 nt, Homo sapiens
ucugauaucucuuugaauc

SEQ ID NO: 1166991 - RNA, 19 nt, Homo sapiens
gcagcucgccauuguguuu

SEQ ID NO: 1166992 - RNA, 19 nt, Homo sapiens
cgaacaagacguacacuga

SEQ ID NO: 1166993 - RNA, 19 nt, Homo sapiens
uaaugugucucuuacuaga

SEQ ID NO: 1166994 - RNA, 19 nt, Homo sapiens
gaaauaucugugccuuuaa

SEQ ID NO: 1166995 - RNA, 19 nt, Homo sapiens
gagagaagugugaaaucua

SEQ ID NO: 1166996 - RNA, 19 nt, Homo sapiens
gcaacgcuuguucagauua

SEQ ID NO: 1166997 - RNA, 19 nt, Homo sapiens
ccuauaaucccagcaauuu

SEQ ID NO: 1166998 - RNA, 19 nt, Homo sapiens
guuacaaguucaggagaua

SEQ ID NO: 1166999 - RNA, 19 nt, Homo sapiens
gaauacaaaugcgaacaag

SEQ ID NO: 1167000 - RNA, 19 nt, Homo sapiens
gcagaguggcuuacaccua

SEQ ID NO: 1167001 - RNA, 19 nt, Homo sapiens
ucccaaacuuuaccucuaa

SEQ ID NO: 1167002 - RNA, 19 nt, Homo sapiens
ccuaaauacucccaaacuu

SEQ ID NO: 1167003 - RNA, 19 nt, Homo sapiens
guauguguguguauuuaug

SEQ ID NO: 1167004 - RNA, 19 nt, Homo sapiens
cauauuuguucuccauuga

SEQ ID NO: 1167005 - RNA, 19 nt, Homo sapiens
cggaaagcauguaaugaug

SEQ ID NO: 1167006 - RNA, 19 nt, Homo sapiens
augguaaagucuuggauua

SEQ ID NO: 1167007 - RNA, 19 nt, Homo sapiens
cuaaagcaguucuuaaagg

SEQ ID NO: 1167008 - RNA, 19 nt, Homo sapiens
gcucuggucucggcuguga

SEQ ID NO: 1167009 - RNA, 19 nt, Homo sapiens
ucgugcagaucaagaguua

SEQ ID NO: 1167010 - RNA, 19 nt, Homo sapiens
guuguaauacggugguuua

SEQ ID NO: 1167011 - RNA, 19 nt, Homo sapiens
gauugucccugcaucugaa

SEQ ID NO: 1167012 - RNA, 19 nt, Homo sapiens
aaacaagcuuucaguaaac

SEQ ID NO: 1167013 - RNA, 19 nt, Homo sapiens
gugaugaccugugcuuaug

SEQ ID NO: 1167014 - RNA, 19 nt, Homo sapiens
gcagugagccgagauugug

SEQ ID NO: 1167015 - RNA, 19 nt, Homo sapiens
guggauaaaggcaaauuaa

SEQ ID NO: 1167016 - RNA, 19 nt, Homo sapiens
gaauucugauaucucuuug

SEQ ID NO: 1167017 - RNA, 19 nt, Homo sapiens
gaaaccccaucucuucuaa

SEQ ID NO: 1167018 - RNA, 19 nt, Homo sapiens
uggcaguuaugaauguaua

SEQ ID NO: 1167019 - RNA, 19 nt, Homo sapiens
auaggucuguguuaacuuu

SEQ ID NO: 1167020 - RNA, 19 nt, Homo sapiens
ggaauuaacagugucauac

SEQ ID NO: 1167021 - RNA, 19 nt, Homo sapiens
gugaugagucuuucuuuga

SEQ ID NO: 1167022 - RNA, 19 nt, Homo sapiens
acaaauaagaugcaugcua

SEQ ID NO: 1167023 - RNA, 19 nt, Homo sapiens
gauggcaguuaugaaugua

SEQ ID NO: 1167024 - RNA, 19 nt, Homo sapiens
uauuguagauggcaguuau

SEQ ID NO: 1167025 - RNA, 19 nt, Homo sapiens
cuguaaagauguaucaguu

SEQ ID NO: 1167026 - RNA, 19 nt, Homo sapiens
ggacuuuccuuuucauuuc

SEQ ID NO: 1167027 - RNA, 19 nt, Homo sapiens
ccaccuagcuaaaaucuau

SEQ ID NO: 1167028 - RNA, 19 nt, Homo sapiens
gcagaucaagaguuauuau

SEQ ID NO: 1167029 - RNA, 19 nt, Homo sapiens
agagggaaaugugagagua

SEQ ID NO: 1167030 - RNA, 19 nt, Homo sapiens
cuccugagguaaacaaauu

SEQ ID NO: 1167031 - RNA, 19 nt, Homo sapiens
gaacaaaucaagcacaucu

SEQ ID NO: 1167032 - RNA, 19 nt, Homo sapiens
gaacagagaccagaaagag

SEQ ID NO: 1167033 - RNA, 19 nt, Homo sapiens
agaaauuccuccucugaaa

SEQ ID NO: 1167034 - RNA, 19 nt, Homo sapiens
gaaagcaucuucacaaaag

SEQ ID NO: 1167035 - RNA, 19 nt, Homo sapiens
gcacaucuuugcuaauuuu

SEQ ID NO: 1167036 - RNA, 19 nt, Homo sapiens
gaagaacagagaccagaaa

SEQ ID NO: 1167037 - RNA, 19 nt, Homo sapiens
gaaagcacgauaaucacua

SEQ ID NO: 1167038 - RNA, 19 nt, Homo sapiens
caacagggaacacugauga

SEQ ID NO: 1167039 - RNA, 19 nt, Homo sapiens
guaaggauggucaguauga

SEQ ID NO: 1167040 - RNA, 19 nt, Homo sapiens
gcacgauaaucacuagugu

SEQ ID NO: 1167041 - RNA, 19 nt, Homo sapiens
cagaagaugcucaguaaga

SEQ ID NO: 1167042 - RNA, 19 nt, Homo sapiens
ucacuaguguugauauugu

SEQ ID NO: 1167043 - RNA, 19 nt, Homo sapiens
gaaugaagaacaaaucaag

SEQ ID NO: 1167044 - RNA, 19 nt, Homo sapiens
aaagaagccuacaagaagu

SEQ ID NO: 1167045 - RNA, 19 nt, Homo sapiens
ugaaaguacugaggaugaa

SEQ ID NO: 1167046 - RNA, 19 nt, Homo sapiens
gaggaugaaguuacugaaa

SEQ ID NO: 1167047 - RNA, 19 nt, Homo sapiens
acaaaucaagcacaucuuu

SEQ ID NO: 1167048 - RNA, 19 nt, Homo sapiens
caaaagaagccuacaagaa

SEQ ID NO: 1167049 - RNA, 19 nt, Homo sapiens
aggaaagcaucuucacaaa

SEQ ID NO: 1167050 - RNA, 19 nt, Homo sapiens
aaccaucacuugcaggaaa

SEQ ID NO: 1167051 - RNA, 19 nt, Homo sapiens
ucucugacauuuacaagau

SEQ ID NO: 1167052 - RNA, 19 nt, Homo sapiens
ggaaugaagaacaaaucaa

SEQ ID NO: 1167053 - RNA, 19 nt, Homo sapiens
caggaaagcaucuucacaa

SEQ ID NO: 1167054 - RNA, 19 nt, Homo sapiens
uaacagggaaugaagaaca

SEQ ID NO: 1167055 - RNA, 19 nt, Homo sapiens
gaaauuccuccucugaaag

SEQ ID NO: 1167056 - RNA, 19 nt, Homo sapiens
ccguaaggauggucaguau

SEQ ID NO: 1167057 - RNA, 19 nt, Homo sapiens
caugaaaucaaucaacgaa

SEQ ID NO: 1167058 - RNA, 19 nt, Homo sapiens
ucugggagaucacaaaugg

SEQ ID NO: 1167059 - RNA, 19 nt, Homo sapiens
ggaugaaguuacugaaagc

SEQ ID NO: 1167060 - RNA, 19 nt, Homo sapiens
gaacuaccguaaggauggu

SEQ ID NO: 1167061 - RNA, 19 nt, Homo sapiens
acugaaagcacgauaauca

SEQ ID NO: 1167062 - RNA, 19 nt, Homo sapiens
guacugaggaugaaguuac

SEQ ID NO: 1167063 - RNA, 19 nt, Homo sapiens
ggaaguggagcagaagaug

SEQ ID NO: 1167064 - RNA, 19 nt, Homo sapiens
gcaggaaagcaucuucaca

SEQ ID NO: 1167065 - RNA, 19 nt, Homo sapiens
gaagaugcucaguaagaca

SEQ ID NO: 1167066 - RNA, 19 nt, Homo sapiens
gggaaugaagaacaaauca

SEQ ID NO: 1167067 - RNA, 19 nt, Homo sapiens
uauaacagggaaugaagaa

SEQ ID NO: 1167068 - RNA, 19 nt, Homo sapiens
aaagcacgauaaucacuag

SEQ ID NO: 1167069 - RNA, 19 nt, Homo sapiens
agggaacacugaugacuca

SEQ ID NO: 1167070 - RNA, 19 nt, Homo sapiens
ugguugcucugcugaacua

SEQ ID NO: 1167071 - RNA, 19 nt, Homo sapiens
aaauccaccuggcaugguu

SEQ ID NO: 1167072 - RNA, 19 nt, Homo sapiens
ggaaagcaucuucacaaaa

SEQ ID NO: 1167073 - RNA, 19 nt, Homo sapiens
aagaacaaaucaagcacau

SEQ ID NO: 1167074 - RNA, 19 nt, Homo sapiens
gagaccagaaagagugaaa

SEQ ID NO: 1167075 - RNA, 19 nt, Homo sapiens
agacaacagggaacacuga

SEQ ID NO: 1167076 - RNA, 19 nt, Homo sapiens
acgauaaucacuaguguug

SEQ ID NO: 1167077 - RNA, 19 nt, Homo sapiens
gaccucaucagccacaaug

SEQ ID NO: 1167078 - RNA, 19 nt, Homo sapiens
aggaugaaguuacugaaag

SEQ ID NO: 1167079 - RNA, 19 nt, Homo sapiens
ucacucauuggcagaaauu

SEQ ID NO: 1167080 - RNA, 19 nt, Homo sapiens
gccuggaaguggagcagaa

SEQ ID NO: 1167081 - RNA, 19 nt, Homo sapiens
uuacaaaccaucacuugca

SEQ ID NO: 1167082 - RNA, 19 nt, Homo sapiens
ccaguucuuuauuggugaa

SEQ ID NO: 1167083 - RNA, 19 nt, Homo sapiens
aacagggaaugaagaacaa

SEQ ID NO: 1167084 - RNA, 19 nt, Homo sapiens
gaagccuacaagaaguaua

SEQ ID NO: 1167085 - RNA, 19 nt, Homo sapiens
aaaagaagccuacaagaag

SEQ ID NO: 1167086 - RNA, 19 nt, Homo sapiens
aagaagccuacaagaagua

SEQ ID NO: 1167087 - RNA, 19 nt, Homo sapiens
cugaaaguacugaggauga

SEQ ID NO: 1167088 - RNA, 19 nt, Homo sapiens
ugaagaacagagaccagaa

SEQ ID NO: 1167089 - RNA, 19 nt, Homo sapiens
cugcugaacuaccguaagg

SEQ ID NO: 1167090 - RNA, 19 nt, Homo sapiens
uuacugaaagcacgauaau

SEQ ID NO: 1167091 - RNA, 19 nt, Homo sapiens
gcugaacuaccguaaggau

SEQ ID NO: 1167092 - RNA, 19 nt, Homo sapiens
guuacugaaagcacgauaa

SEQ ID NO: 1167093 - RNA, 19 nt, Homo sapiens
agaagaugcucaguaagac

SEQ ID NO: 1167094 - RNA, 19 nt, Homo sapiens
aagccuacaagaaguauau

SEQ ID NO: 1167095 - RNA, 19 nt, Homo sapiens
gaccagaaagagugaaacu

SEQ ID NO: 1167096 - RNA, 19 nt, Homo sapiens
cacuaguguugauauuguu

SEQ ID NO: 1167097 - RNA, 19 nt, Homo sapiens
gaaaguacugaggaugaag

SEQ ID NO: 1167098 - RNA, 19 nt, Homo sapiens
cagccacaaugagauguuc

SEQ ID NO: 1167099 - RNA, 19 nt, Homo sapiens
ccuacaagaaguauaucaa

SEQ ID NO: 1167100 - RNA, 19 nt, Homo sapiens
gaaaggaaaucucauugua

SEQ ID NO: 1167101 - RNA, 19 nt, Homo sapiens
gaaaucaggucucauuaaa

SEQ ID NO: 1167102 - RNA, 19 nt, Homo sapiens
gaacaacuguggacaauug

SEQ ID NO: 1167103 - RNA, 19 nt, Homo sapiens
gagcaaaggcuaugaaaua

SEQ ID NO: 1167104 - RNA, 19 nt, Homo sapiens
ggaaagggcuaauacugua

SEQ ID NO: 1167105 - RNA, 19 nt, Homo sapiens
ggaaagcguuugcguauau

SEQ ID NO: 1167106 - RNA, 19 nt, Homo sapiens
gaacaucagcgaacucaua

SEQ ID NO: 1167107 - RNA, 19 nt, Homo sapiens
gaaaugaaguacugugaau

SEQ ID NO: 1167108 - RNA, 19 nt, Homo sapiens
gagaaacccuuugaaugua

SEQ ID NO: 1167109 - RNA, 19 nt, Homo sapiens
gaaaguucaugcuuacuga

SEQ ID NO: 1167110 - RNA, 19 nt, Homo sapiens
ggaaagccuucaucaagaa

SEQ ID NO: 1167111 - RNA, 19 nt, Homo sapiens
ggagagaaacccuauauau

SEQ ID NO: 1167112 - RNA, 19 nt, Homo sapiens
ggaaaaggcuucauucaga

SEQ ID NO: 1167113 - RNA, 19 nt, Homo sapiens
gggaaagccuucaucaaga

SEQ ID NO: 1167114 - RNA, 19 nt, Homo sapiens
gaaaucacggcucaacaua

SEQ ID NO: 1167115 - RNA, 19 nt, Homo sapiens
gcucgacugugucaauuaa

SEQ ID NO: 1167116 - RNA, 19 nt, Homo sapiens
ggacagaaaccuugugaau

SEQ ID NO: 1167117 - RNA, 19 nt, Homo sapiens
ugagaaaccuuauauaugc

SEQ ID NO: 1167118 - RNA, 19 nt, Homo sapiens
caaaggcuaugaaauaaag

SEQ ID NO: 1167119 - RNA, 19 nt, Homo sapiens
ggaaaaggguugagcaaaa

SEQ ID NO: 1167120 - RNA, 19 nt, Homo sapiens
gaagaaaacucagaucuau

SEQ ID NO: 1167121 - RNA, 19 nt, Homo sapiens
gagagaaacccuauauaug

SEQ ID NO: 1167122 - RNA, 19 nt, Homo sapiens
gaaauaaagaacucuguug

SEQ ID NO: 1167123 - RNA, 19 nt, Homo sapiens
gaacaugaugcauuugaaa

SEQ ID NO: 1167124 - RNA, 19 nt, Homo sapiens
gagagaaacccuuugaaug

SEQ ID NO: 1167125 - RNA, 19 nt, Homo sapiens
gagaacaacuguggacaau

SEQ ID NO: 1167126 - RNA, 19 nt, Homo sapiens
ggugagaaaccuuauauau

SEQ ID NO: 1167127 - RNA, 19 nt, Homo sapiens
ucagacauauggaaaguug

SEQ ID NO: 1167128 - RNA, 19 nt, Homo sapiens
gagauagccugauaaacuc

SEQ ID NO: 1167129 - RNA, 19 nt, Homo sapiens
ggagagaaacccuuugaau

SEQ ID NO: 1167130 - RNA, 19 nt, Homo sapiens
gagaaacccuauauaugca

SEQ ID NO: 1167131 - RNA, 19 nt, Homo sapiens
uaaauucccugcaagucaa

SEQ ID NO: 1167132 - RNA, 19 nt, Homo sapiens
ccucagacaucauuaaaca

SEQ ID NO: 1167133 - RNA, 19 nt, Homo sapiens
gaacagaaggaaaccaugu

SEQ ID NO: 1167134 - RNA, 19 nt, Homo sapiens
ggagauaacagaggauuug

SEQ ID NO: 1167135 - RNA, 19 nt, Homo sapiens
aaucaggucucauuaaaca

SEQ ID NO: 1167136 - RNA, 19 nt, Homo sapiens
guacaccagcgaauucaua

SEQ ID NO: 1167137 - RNA, 19 nt, Homo sapiens
gcuaacugaucaccaggua

SEQ ID NO: 1167138 - RNA, 19 nt, Homo sapiens
gaacaaggagaacaacugu

SEQ ID NO: 1167139 - RNA, 19 nt, Homo sapiens
ucaauucaguuuccuuaga

SEQ ID NO: 1167140 - RNA, 19 nt, Homo sapiens
gaagagaaggccagaagau

SEQ ID NO: 1167141 - RNA, 19 nt, Homo sapiens
acagaaaccuugugaaugc

SEQ ID NO: 1167142 - RNA, 19 nt, Homo sapiens
gggaaagcguuugcguaua

SEQ ID NO: 1167143 - RNA, 19 nt, Homo sapiens
gcaaaggcuaugaaauaaa

SEQ ID NO: 1167144 - RNA, 19 nt, Homo sapiens
aaaggaagcccaaguacuu

SEQ ID NO: 1167145 - RNA, 19 nt, Homo sapiens
cugauaaacucauccuauu

SEQ ID NO: 1167146 - RNA, 19 nt, Homo sapiens
agagggaucugugaaacua

SEQ ID NO: 1167147 - RNA, 19 nt, Homo sapiens
ccauaaacuuucagaacuu

SEQ ID NO: 1167148 - RNA, 19 nt, Homo sapiens
gaaaaggcuucauucagaa

SEQ ID NO: 1167149 - RNA, 19 nt, Homo sapiens
uccagaaaguucaugcuua

SEQ ID NO: 1167150 - RNA, 19 nt, Homo sapiens
cggaugcacucuucaaguu

SEQ ID NO: 1167151 - RNA, 19 nt, Homo sapiens
acaggcaaauuugauguua

SEQ ID NO: 1167152 - RNA, 19 nt, Homo sapiens
ugccuuccgugaucaauua

SEQ ID NO: 1167153 - RNA, 19 nt, Homo sapiens
agagaaacccuuugaaugu

SEQ ID NO: 1167154 - RNA, 19 nt, Homo sapiens
ucagaaaucaggucucauu

SEQ ID NO: 1167155 - RNA, 19 nt, Homo sapiens
ccauaacacuggaggaugu

SEQ ID NO: 1167156 - RNA, 19 nt, Homo sapiens
gugccaguguggaggauua

SEQ ID NO: 1167157 - RNA, 19 nt, Homo sapiens
ugagauagccugauaaacu

SEQ ID NO: 1167158 - RNA, 19 nt, Homo sapiens
caucaugugugcagugaau

SEQ ID NO: 1167159 - RNA, 19 nt, Homo sapiens
ggauguggcuguggacuuc

SEQ ID NO: 1167160 - RNA, 19 nt, Homo sapiens
gaaagggcuaauacuguaa

SEQ ID NO: 1167161 - RNA, 19 nt, Homo sapiens
ggaaaugaaguacugugaa

SEQ ID NO: 1167162 - RNA, 19 nt, Homo sapiens
ggaaaauccuguucucaga

SEQ ID NO: 1167163 - RNA, 19 nt, Homo sapiens
gugagaaaccuuauauaug

SEQ ID NO: 1167164 - RNA, 19 nt, Homo sapiens
gaaaaggcuucauccagaa

SEQ ID NO: 1167165 - RNA, 19 nt, Homo sapiens
ccagaaaguucaugcuuac

SEQ ID NO: 1167166 - RNA, 19 nt, Homo sapiens
uauaugucgugucugguua

SEQ ID NO: 1167167 - RNA, 19 nt, Homo sapiens
cauagcacaucagagauuu

SEQ ID NO: 1167168 - RNA, 19 nt, Homo sapiens
gggaugugauguuggagaa

SEQ ID NO: 1167169 - RNA, 19 nt, Homo sapiens
gugauacacaggcaaauuu

SEQ ID NO: 1167170 - RNA, 19 nt, Homo sapiens
cuacacaagugccuucugu

SEQ ID NO: 1167171 - RNA, 19 nt, Homo sapiens
caaaccggaugcacucuuc

SEQ ID NO: 1167172 - RNA, 19 nt, Homo sapiens
gagagacccuauggcugua

SEQ ID NO: 1167173 - RNA, 19 nt, Homo sapiens
ccagaaaggaaaucucauu

SEQ ID NO: 1167174 - RNA, 19 nt, Homo sapiens
gacagaccaucccaguuga

SEQ ID NO: 1167175 - RNA, 19 nt, Homo sapiens
guaccgggaugugauguug

SEQ ID NO: 1167176 - RNA, 19 nt, Homo sapiens
cugugaaacuagucaauuu

SEQ ID NO: 1167177 - RNA, 19 nt, Homo sapiens
uguggaggauuaauugaaa

SEQ ID NO: 1167178 - RNA, 19 nt, Homo sapiens
gggaaagggcuaauacugu

SEQ ID NO: 1167179 - RNA, 19 nt, Homo sapiens
agacagaccaucccaguug

SEQ ID NO: 1167180 - RNA, 19 nt, Homo sapiens
ccaguugaaugcugucuuc

SEQ ID NO: 1167181 - RNA, 19 nt, Homo sapiens
cauaagagaauacacacaa

SEQ ID NO: 1167182 - RNA, 19 nt, Homo sapiens
gaaagcguuugcguauaug

SEQ ID NO: 1167183 - RNA, 19 nt, Homo sapiens
aaggaaaucucauuguaca

SEQ ID NO: 1167184 - RNA, 19 nt, Homo sapiens
ccacagaugcagucuaugu

SEQ ID NO: 1167185 - RNA, 19 nt, Homo sapiens
gcuaugaaauaaagaacuc

SEQ ID NO: 1167186 - RNA, 19 nt, Homo sapiens
gaagagggaggaaguggau

SEQ ID NO: 1167187 - RNA, 19 nt, Homo sapiens
agcaaaggcuaugaaauaa

SEQ ID NO: 1167188 - RNA, 19 nt, Homo sapiens
guugaaugcugucuuccaa

SEQ ID NO: 1167189 - RNA, 19 nt, Homo sapiens
gccagaagauacaaagaca

SEQ ID NO: 1167190 - RNA, 19 nt, Homo sapiens
gcacuaagucccaauucau

SEQ ID NO: 1167191 - RNA, 19 nt, Homo sapiens
uauggaaaguugaucaugu

SEQ ID NO: 1167192 - RNA, 19 nt, Homo sapiens
agaaaucaggucucauuaa

SEQ ID NO: 1167193 - RNA, 19 nt, Homo sapiens
gcacaucagagauuucaca

SEQ ID NO: 1167194 - RNA, 19 nt, Homo sapiens
gaucaccagguaaugcaua

SEQ ID NO: 1167195 - RNA, 19 nt, Homo sapiens
ggagaacaacuguggacaa

SEQ ID NO: 1167196 - RNA, 19 nt, Homo sapiens
caggcaaauuugauguuaa

SEQ ID NO: 1167197 - RNA, 19 nt, Homo sapiens
gcugagauagccugauaaa

SEQ ID NO: 1167198 - RNA, 19 nt, Homo sapiens
acugagagaacauguauaa

SEQ ID NO: 1167199 - RNA, 19 nt, Homo sapiens
aggcacagcucauuacaca

SEQ ID NO: 1167200 - RNA, 19 nt, Homo sapiens
gaacagcacugaaguauua

SEQ ID NO: 1167201 - RNA, 19 nt, Homo sapiens
gcaaagaaguuucaucuga

SEQ ID NO: 1167202 - RNA, 19 nt, Homo sapiens
gcacugaaguauuacauaa

SEQ ID NO: 1167203 - RNA, 19 nt, Homo sapiens
gcagggaucugguugauga

SEQ ID NO: 1167204 - RNA, 19 nt, Homo sapiens
guauugaccuacagaguua

SEQ ID NO: 1167205 - RNA, 19 nt, Homo sapiens
ccaaagacauaaugacaaa

SEQ ID NO: 1167206 - RNA, 19 nt, Homo sapiens
ggacuaauguuacaccaau

SEQ ID NO: 1167207 - RNA, 19 nt, Homo sapiens
gaguagcccugcugaauga

SEQ ID NO: 1167208 - RNA, 19 nt, Homo sapiens
caacacaguuccauucuag

SEQ ID NO: 1167209 - RNA, 19 nt, Homo sapiens
gaaugucuguuucucacua

SEQ ID NO: 1167210 - RNA, 19 nt, Homo sapiens
guaauucccugcuaaguag

SEQ ID NO: 1167211 - RNA, 19 nt, Homo sapiens
ggagugaucuacugucuag

SEQ ID NO: 1167212 - RNA, 19 nt, Homo sapiens
gacaagggcucgccuagga

SEQ ID NO: 1167213 - RNA, 19 nt, Homo sapiens
gcaaagaacuaaggugagu

SEQ ID NO: 1167214 - RNA, 19 nt, Homo sapiens
ccucauauguugcaaagaa

SEQ ID NO: 1167215 - RNA, 19 nt, Homo sapiens
uaaacaaccuuugcucuga

SEQ ID NO: 1167216 - RNA, 19 nt, Homo sapiens
gcaacacaguuccauucua

SEQ ID NO: 1167217 - RNA, 19 nt, Homo sapiens
gacaaauacucaugcuaaa

SEQ ID NO: 1167218 - RNA, 19 nt, Homo sapiens
ccacaugcuugguguacua

SEQ ID NO: 1167219 - RNA, 19 nt, Homo sapiens
gaugguaauucccugcuaa

SEQ ID NO: 1167220 - RNA, 19 nt, Homo sapiens
ggauaugacggcuugaaua

SEQ ID NO: 1167221 - RNA, 19 nt, Homo sapiens
gcaauacccucugugaugu

SEQ ID NO: 1167222 - RNA, 19 nt, Homo sapiens
cuaaauccauccucaauuc

SEQ ID NO: 1167223 - RNA, 19 nt, Homo sapiens
ugacaaauacucaugcuaa

SEQ ID NO: 1167224 - RNA, 19 nt, Homo sapiens
gagagagacucaucugaca

SEQ ID NO: 1167225 - RNA, 19 nt, Homo sapiens
ugaauuugauugugaguga

SEQ ID NO: 1167226 - RNA, 19 nt, Homo sapiens
ggucaggauuuguauauca

SEQ ID NO: 1167227 - RNA, 19 nt, Homo sapiens
gaacuaaggugaguauagc

SEQ ID NO: 1167228 - RNA, 19 nt, Homo sapiens
gaaauacgacccucauaca

SEQ ID NO: 1167229 - RNA, 19 nt, Homo sapiens
cuagaugauuggaaagaua

SEQ ID NO: 1167230 - RNA, 19 nt, Homo sapiens
ggaaggugccggacucgua

SEQ ID NO: 1167231 - RNA, 19 nt, Homo sapiens
gcagugaugauuguacuua

SEQ ID NO: 1167232 - RNA, 19 nt, Homo sapiens
gguaauucccugcuaagua

SEQ ID NO: 1167233 - RNA, 19 nt, Homo sapiens
gcacuuuccugucauuucu

SEQ ID NO: 1167234 - RNA, 19 nt, Homo sapiens
guacuuauuugacacauac

SEQ ID NO: 1167235 - RNA, 19 nt, Homo sapiens
ggugaagcaugccaagaaa

SEQ ID NO: 1167236 - RNA, 19 nt, Homo sapiens
aaacaagccugcugugagu

SEQ ID NO: 1167237 - RNA, 19 nt, Homo sapiens
cagccuagaugauuggaaa

SEQ ID NO: 1167238 - RNA, 19 nt, Homo sapiens
gcgcuaugauccaaacauu

SEQ ID NO: 1167239 - RNA, 19 nt, Homo sapiens
ggagugaaauucuuguuuu

SEQ ID NO: 1167240 - RNA, 19 nt, Homo sapiens
gaaggguggguaacagaua

SEQ ID NO: 1167241 - RNA, 19 nt, Homo sapiens
gcuaugauccaaacauuga

SEQ ID NO: 1167242 - RNA, 19 nt, Homo sapiens
ccagguauaucacagaugu

SEQ ID NO: 1167243 - RNA, 19 nt, Homo sapiens
gagaaggguauauuauuug

SEQ ID NO: 1167244 - RNA, 19 nt, Homo sapiens
aagcaucacucguaagaga

SEQ ID NO: 1167245 - RNA, 19 nt, Homo sapiens
cuacagaguuaauuuccuu

SEQ ID NO: 1167246 - RNA, 19 nt, Homo sapiens
caaauacucaugcuaaauc

SEQ ID NO: 1167247 - RNA, 19 nt, Homo sapiens
uuggaaagauaccaguuua

SEQ ID NO: 1167248 - RNA, 19 nt, Homo sapiens
gaaccuagaacagcacuga

SEQ ID NO: 1167249 - RNA, 19 nt, Homo sapiens
gaaagauaccaguuuaagu

SEQ ID NO: 1167250 - RNA, 19 nt, Homo sapiens
ggaaugugauaaccuaaac

SEQ ID NO: 1167251 - RNA, 19 nt, Homo sapiens
gggagacucuaugcaauug

SEQ ID NO: 1167252 - RNA, 19 nt, Homo sapiens
ugccuaaccugcuacagua

SEQ ID NO: 1167253 - RNA, 19 nt, Homo sapiens
guugaaaggugugaaacaa

SEQ ID NO: 1167254 - RNA, 19 nt, Homo sapiens
agaagaaccugugauuuua

SEQ ID NO: 1167255 - RNA, 19 nt, Homo sapiens
gauggccguucccgccuua

SEQ ID NO: 1167256 - RNA, 19 nt, Homo sapiens
gaccggaucuacgucauug

SEQ ID NO: 1167257 - RNA, 19 nt, Homo sapiens
ccauugaugugguagagaa

SEQ ID NO: 1167258 - RNA, 19 nt, Homo sapiens
gaagaauccuugccuaacc

SEQ ID NO: 1167259 - RNA, 19 nt, Homo sapiens
gugggaaugugauaaccua

SEQ ID NO: 1167260 - RNA, 19 nt, Homo sapiens
uaucaacauuucugagcua

SEQ ID NO: 1167261 - RNA, 19 nt, Homo sapiens
uaccucagcuaucaacauu

SEQ ID NO: 1167262 - RNA, 19 nt, Homo sapiens
ucacaggacagaauaauca

SEQ ID NO: 1167263 - RNA, 19 nt, Homo sapiens
ggaaagauaccaguuuaag

SEQ ID NO: 1167264 - RNA, 19 nt, Homo sapiens
ggagcaccauccagagcua

SEQ ID NO: 1167265 - RNA, 19 nt, Homo sapiens
gagaaauacgacccucaua

SEQ ID NO: 1167266 - RNA, 19 nt, Homo sapiens
uaauagaugcugagccuuu

SEQ ID NO: 1167267 - RNA, 19 nt, Homo sapiens
gggaagaauccuugccuaa

SEQ ID NO: 1167268 - RNA, 19 nt, Homo sapiens
aaacaaccuuugcucugaa

SEQ ID NO: 1167269 - RNA, 19 nt, Homo sapiens
gguuuguacugcuguguuu

SEQ ID NO: 1167270 - RNA, 19 nt, Homo sapiens
gagugacaguagccuagua

SEQ ID NO: 1167271 - RNA, 19 nt, Homo sapiens
gaucaaauacuacuacacu

SEQ ID NO: 1167272 - RNA, 19 nt, Homo sapiens
ggagcacuuuccugucauu

SEQ ID NO: 1167273 - RNA, 19 nt, Homo sapiens
gaggucaggauuuguauau

SEQ ID NO: 1167274 - RNA, 19 nt, Homo sapiens
ggaguagcccugcugaaug

SEQ ID NO: 1167275 - RNA, 19 nt, Homo sapiens
gaguagagcagaaagacuu

SEQ ID NO: 1167276 - RNA, 19 nt, Homo sapiens
uaugacggcuugaauaucu

SEQ ID NO: 1167277 - RNA, 19 nt, Homo sapiens
caagaaagagcgggaagaa

SEQ ID NO: 1167278 - RNA, 19 nt, Homo sapiens
ccucagcuaucaacauuuc

SEQ ID NO: 1167279 - RNA, 19 nt, Homo sapiens
gacaguagccuaguaguuc

SEQ ID NO: 1167280 - RNA, 19 nt, Homo sapiens
cuauuacacuuccacacua

SEQ ID NO: 1167281 - RNA, 19 nt, Homo sapiens
cuacuacacuauuacacuu

SEQ ID NO: 1167282 - RNA, 19 nt, Homo sapiens
guacagcccaccuuucuuc

SEQ ID NO: 1167283 - RNA, 19 nt, Homo sapiens
gcaauugcaggauaugaug

SEQ ID NO: 1167284 - RNA, 19 nt, Homo sapiens
agaaagagcgggaagaauc

SEQ ID NO: 1167285 - RNA, 19 nt, Homo sapiens
ccaagcaucacucguaaga

SEQ ID NO: 1167286 - RNA, 19 nt, Homo sapiens
gagcggaguugcagaaucc

SEQ ID NO: 1167287 - RNA, 19 nt, Homo sapiens
caacauuucugagcuacca

SEQ ID NO: 1167288 - RNA, 19 nt, Homo sapiens
ccaccuuucuuccguugaa

SEQ ID NO: 1167289 - RNA, 19 nt, Homo sapiens
cuaugucucuggaggcuuu

SEQ ID NO: 1167290 - RNA, 19 nt, Homo sapiens
gcuaaauccauccucaauu

SEQ ID NO: 1167291 - RNA, 19 nt, Homo sapiens
uuugguacaucuagucuuu

SEQ ID NO: 1167292 - RNA, 19 nt, Homo sapiens
ccagugcagugaugauugu

SEQ ID NO: 1167293 - RNA, 19 nt, Homo sapiens
cagccugucugcuucaguu

SEQ ID NO: 1167294 - RNA, 19 nt, Homo sapiens
aaucaacggucucaaaugc

SEQ ID NO: 1167295 - RNA, 19 nt, Homo sapiens
cauacaacauucgcacuga

SEQ ID NO: 1167296 - RNA, 19 nt, Homo sapiens
ggccugaacuucggaguca

SEQ ID NO: 1167297 - RNA, 19 nt, Homo sapiens
gguacagcaugaagaguuc

SEQ ID NO: 1167298 - RNA, 19 nt, Homo sapiens
gacugagaaggguauauua

SEQ ID NO: 1167299 - RNA, 19 nt, Homo sapiens
gcaauauccagccuagaug

SEQ ID NO: 1167300 - RNA, 19 nt, Homo sapiens
gcaaccauauccauaauuu

SEQ ID NO: 1167301 - RNA, 19 nt, Homo sapiens
ugaaggagcugucacaauu

SEQ ID NO: 1167302 - RNA, 19 nt, Homo sapiens
ggacuaaauucucuuauuc

SEQ ID NO: 1167303 - RNA, 19 nt, Homo sapiens
gaaauacggaaucaaguua

SEQ ID NO: 1167304 - RNA, 19 nt, Homo sapiens
uagaauggcugauaauuga

SEQ ID NO: 1167305 - RNA, 19 nt, Homo sapiens
caacgagacucaauuccua

SEQ ID NO: 1167306 - RNA, 19 nt, Homo sapiens
gaaucucucucacauauau

SEQ ID NO: 1167307 - RNA, 19 nt, Homo sapiens
ggagaugccaccugaguua

SEQ ID NO: 1167308 - RNA, 19 nt, Homo sapiens
gaaacuggaugaauuggau

SEQ ID NO: 1167309 - RNA, 19 nt, Homo sapiens
ccaauucucuauacucuga

SEQ ID NO: 1167310 - RNA, 19 nt, Homo sapiens
caaaaugacuucccaauau

SEQ ID NO: 1167311 - RNA, 19 nt, Homo sapiens
cauaacagcaacugaaaua

SEQ ID NO: 1167312 - RNA, 19 nt, Homo sapiens
ggaguaugcuucccucuuc

SEQ ID NO: 1167313 - RNA, 19 nt, Homo sapiens
ggaaaaugcagaacaauua

SEQ ID NO: 1167314 - RNA, 19 nt, Homo sapiens
gagcuugacugugaugaaa

SEQ ID NO: 1167315 - RNA, 19 nt, Homo sapiens
uaacauuucugacauugga

SEQ ID NO: 1167316 - RNA, 19 nt, Homo sapiens
gaaggcaaccauauccaua

SEQ ID NO: 1167317 - RNA, 19 nt, Homo sapiens
aaacauaugcuccaucauu

SEQ ID NO: 1167318 - RNA, 19 nt, Homo sapiens
gauaaucaccucagucgaa

SEQ ID NO: 1167319 - RNA, 19 nt, Homo sapiens
uagaagggauugaaauuuc

SEQ ID NO: 1167320 - RNA, 19 nt, Homo sapiens
gaauuggauuuaggaagua

SEQ ID NO: 1167321 - RNA, 19 nt, Homo sapiens
agacuagaauggcugauaa

SEQ ID NO: 1167322 - RNA, 19 nt, Homo sapiens
gaaaacauaugcuccauca

SEQ ID NO: 1167323 - RNA, 19 nt, Homo sapiens
gaucggaggcuuugaccua

SEQ ID NO: 1167324 - RNA, 19 nt, Homo sapiens
caacugaaauacggaauca

SEQ ID NO: 1167325 - RNA, 19 nt, Homo sapiens
ccacaagaccauuuaaaga

SEQ ID NO: 1167326 - RNA, 19 nt, Homo sapiens
ucaaauauccaacaaagga

SEQ ID NO: 1167327 - RNA, 19 nt, Homo sapiens
ggacaacuguggagacaac

SEQ ID NO: 1167328 - RNA, 19 nt, Homo sapiens
ggacagcaaaggucagaaa

SEQ ID NO: 1167329 - RNA, 19 nt, Homo sapiens
guuuagaccucuuaugaau

SEQ ID NO: 1167330 - RNA, 19 nt, Homo sapiens
ccugauugcuucaagaauu

SEQ ID NO: 1167331 - RNA, 19 nt, Homo sapiens
gaaaaucuauggacagcaa

SEQ ID NO: 1167332 - RNA, 19 nt, Homo sapiens
ugaauuggauuuaggaagu

SEQ ID NO: 1167333 - RNA, 19 nt, Homo sapiens
ggacugaauagccuuacua

SEQ ID NO: 1167334 - RNA, 19 nt, Homo sapiens
cugauugcuucaagaauua

SEQ ID NO: 1167335 - RNA, 19 nt, Homo sapiens
ucauuuggauuacugguuu

SEQ ID NO: 1167336 - RNA, 19 nt, Homo sapiens
guucgcagcuguaaaccaa

SEQ ID NO: 1167337 - RNA, 19 nt, Homo sapiens
ugaauagccuuacuaaacu

SEQ ID NO: 1167338 - RNA, 19 nt, Homo sapiens
gaaagcuuccuccugauug

SEQ ID NO: 1167339 - RNA, 19 nt, Homo sapiens
gagacucaauuccuauuca

SEQ ID NO: 1167340 - RNA, 19 nt, Homo sapiens
gcaaaggucagaaaacaua

SEQ ID NO: 1167341 - RNA, 19 nt, Homo sapiens
uuacauccaucuccaucua

SEQ ID NO: 1167342 - RNA, 19 nt, Homo sapiens
cacaagaccauuuaaagaa

SEQ ID NO: 1167343 - RNA, 19 nt, Homo sapiens
gagcccagauuuauucagu

SEQ ID NO: 1167344 - RNA, 19 nt, Homo sapiens
aaacacugauggaauuuca

SEQ ID NO: 1167345 - RNA, 19 nt, Homo sapiens
ugauaaaccucucugucaa

SEQ ID NO: 1167346 - RNA, 19 nt, Homo sapiens
ggauggagaguacucauug

SEQ ID NO: 1167347 - RNA, 19 nt, Homo sapiens
gaaaaucuuccaccgcuua

SEQ ID NO: 1167348 - RNA, 19 nt, Homo sapiens
uacauuggcuggaccuuga

SEQ ID NO: 1167349 - RNA, 19 nt, Homo sapiens
guauuaauuuggccgcauu

SEQ ID NO: 1167350 - RNA, 19 nt, Homo sapiens
guauuggagcccagauuua

SEQ ID NO: 1167351 - RNA, 19 nt, Homo sapiens
aaauacaucugcauugucu

SEQ ID NO: 1167352 - RNA, 19 nt, Homo sapiens
ucuuaguccugaugaauaa

SEQ ID NO: 1167353 - RNA, 19 nt, Homo sapiens
gaauagccuuacuaaacug

SEQ ID NO: 1167354 - RNA, 19 nt, Homo sapiens
gucuggagcuugacuguga

SEQ ID NO: 1167355 - RNA, 19 nt, Homo sapiens
ugguauaacuacagacaaa

SEQ ID NO: 1167356 - RNA, 19 nt, Homo sapiens
ggucugagaacaagcugua

SEQ ID NO: 1167357 - RNA, 19 nt, Homo sapiens
guauuugucuggguuguau

SEQ ID NO: 1167358 - RNA, 19 nt, Homo sapiens
gcuguaaaccaaacacuga

SEQ ID NO: 1167359 - RNA, 19 nt, Homo sapiens
ccaauuugauuaucuuguc

SEQ ID NO: 1167360 - RNA, 19 nt, Homo sapiens
gaaggagcugucacaauug

SEQ ID NO: 1167361 - RNA, 19 nt, Homo sapiens
ggaagcauguuuuauagug

SEQ ID NO: 1167362 - RNA, 19 nt, Homo sapiens
aaacuacuauggcaccaau

SEQ ID NO: 1167363 - RNA, 19 nt, Homo sapiens
gaggacaacuguggagaca

SEQ ID NO: 1167364 - RNA, 19 nt, Homo sapiens
aaaccucucugucaacaca

SEQ ID NO: 1167365 - RNA, 19 nt, Homo sapiens
gaugccaccugaguuaaug

SEQ ID NO: 1167366 - RNA, 19 nt, Homo sapiens
gaacccaauucucuauacu

SEQ ID NO: 1167367 - RNA, 19 nt, Homo sapiens
ccacagaaguaucaguuuu

SEQ ID NO: 1167368 - RNA, 19 nt, Homo sapiens
accaaacacugauggaauu

SEQ ID NO: 1167369 - RNA, 19 nt, Homo sapiens
gaucuucacagacuagaau

SEQ ID NO: 1167370 - RNA, 19 nt, Homo sapiens
ugaaauacggaaucaaguu

SEQ ID NO: 1167371 - RNA, 19 nt, Homo sapiens
caagcuguaugccauguca

SEQ ID NO: 1167372 - RNA, 19 nt, Homo sapiens
augaaucucucucacauau

SEQ ID NO: 1167373 - RNA, 19 nt, Homo sapiens
cagaagcuguaccugcaaa

SEQ ID NO: 1167374 - RNA, 19 nt, Homo sapiens
gugggaacaucacaaagug

SEQ ID NO: 1167375 - RNA, 19 nt, Homo sapiens
caaagugccauaacagcaa

SEQ ID NO: 1167376 - RNA, 19 nt, Homo sapiens
ggccgcauuuaucaucaua

SEQ ID NO: 1167377 - RNA, 19 nt, Homo sapiens
gaccacaagaccauuuaaa

SEQ ID NO: 1167378 - RNA, 19 nt, Homo sapiens
uauaguggcuuucauucca

SEQ ID NO: 1167379 - RNA, 19 nt, Homo sapiens
cugauucucauuuggauua

SEQ ID NO: 1167380 - RNA, 19 nt, Homo sapiens
guuaacauuucugacauug

SEQ ID NO: 1167381 - RNA, 19 nt, Homo sapiens
uaugccaugucaaucauuu

SEQ ID NO: 1167382 - RNA, 19 nt, Homo sapiens
aaggagcugucacaauuga

SEQ ID NO: 1167383 - RNA, 19 nt, Homo sapiens
caacacaugccaagacuac

SEQ ID NO: 1167384 - RNA, 19 nt, Homo sapiens
ucucagucauaacagaaua

SEQ ID NO: 1167385 - RNA, 19 nt, Homo sapiens
caauuacaguucugauucu

SEQ ID NO: 1167386 - RNA, 19 nt, Homo sapiens
gauggagaguacucauugu

SEQ ID NO: 1167387 - RNA, 19 nt, Homo sapiens
uuagaccucuuaugaaucu

SEQ ID NO: 1167388 - RNA, 19 nt, Homo sapiens
cuagaauggcugauaauug

SEQ ID NO: 1167389 - RNA, 19 nt, Homo sapiens
ugacugugaugaaaccaau

SEQ ID NO: 1167390 - RNA, 19 nt, Homo sapiens
cauaaccucuuggguagug

SEQ ID NO: 1167391 - RNA, 19 nt, Homo sapiens
uguaggaucuuuggccauu

SEQ ID NO: 1167392 - RNA, 19 nt, Homo sapiens
uaaaguuucguggagaaua

SEQ ID NO: 1167393 - RNA, 19 nt, Homo sapiens
ccuaaaguuucguggagaa

SEQ ID NO: 1167394 - RNA, 19 nt, Homo sapiens
uuaagaaauuccaguacug

SEQ ID NO: 1167395 - RNA, 19 nt, Homo sapiens
cugaauagccuuacuaaac

SEQ ID NO: 1167396 - RNA, 19 nt, Homo sapiens
cuucaaaugugacugcaau

SEQ ID NO: 1167397 - RNA, 19 nt, Homo sapiens
cuagaagggauugaaauuu

SEQ ID NO: 1167398 - RNA, 19 nt, Homo sapiens
ucaagucucucagccuaga

SEQ ID NO: 1167399 - RNA, 19 nt, Homo sapiens
uuccaucgguuucuucaaa

SEQ ID NO: 1167400 - RNA, 19 nt, Homo sapiens
caacagaguucauugauua

SEQ ID NO: 1167401 - RNA, 19 nt, Homo sapiens
cgacaguacugauacauaa

SEQ ID NO: 1167402 - RNA, 19 nt, Homo sapiens
guaagacucugccauuaaa

SEQ ID NO: 1167403 - RNA, 19 nt, Homo sapiens
gagcugagauugcacuauu

SEQ ID NO: 1167404 - RNA, 19 nt, Homo sapiens
ccaaguaacugaaccauuc

SEQ ID NO: 1167405 - RNA, 19 nt, Homo sapiens
ucagagaacuuucccauuc

SEQ ID NO: 1167406 - RNA, 19 nt, Homo sapiens
gcaacagaguucauugauu

SEQ ID NO: 1167407 - RNA, 19 nt, Homo sapiens
uauagaacauccagaguaa

SEQ ID NO: 1167408 - RNA, 19 nt, Homo sapiens
gaaagguuccucaaugaaa

SEQ ID NO: 1167409 - RNA, 19 nt, Homo sapiens
cuacagagcuacaauucaa

SEQ ID NO: 1167410 - RNA, 19 nt, Homo sapiens
uaacuaaacuaacgagcaa

SEQ ID NO: 1167411 - RNA, 19 nt, Homo sapiens
gcaauucugcuaccaauga

SEQ ID NO: 1167412 - RNA, 19 nt, Homo sapiens
gaacuuucccauucuguuu

SEQ ID NO: 1167413 - RNA, 19 nt, Homo sapiens
caugaaagguuccucaaug

SEQ ID NO: 1167414 - RNA, 19 nt, Homo sapiens
aaacugugcucuuaccauu

SEQ ID NO: 1167415 - RNA, 19 nt, Homo sapiens
uaaggaaccagaaauauga

SEQ ID NO: 1167416 - RNA, 19 nt, Homo sapiens
caaacagucuuucuuccuu

SEQ ID NO: 1167417 - RNA, 19 nt, Homo sapiens
gaaaugguggugcuuuaaa

SEQ ID NO: 1167418 - RNA, 19 nt, Homo sapiens
ucucaaacuucacuaauga

SEQ ID NO: 1167419 - RNA, 19 nt, Homo sapiens
aaagaaagaugggaggaaa

SEQ ID NO: 1167420 - RNA, 19 nt, Homo sapiens
cacauugacuuugcaguua

SEQ ID NO: 1167421 - RNA, 19 nt, Homo sapiens
ugaaggcagucauaucaaa

SEQ ID NO: 1167422 - RNA, 19 nt, Homo sapiens
aaucacaucuccaggcuuu

SEQ ID NO: 1167423 - RNA, 19 nt, Homo sapiens
gaacauccagaguaaguga

SEQ ID NO: 1167424 - RNA, 19 nt, Homo sapiens
ggaaugcugucuucucuac

SEQ ID NO: 1167425 - RNA, 19 nt, Homo sapiens
aaacuaaccaucugaagaa

SEQ ID NO: 1167426 - RNA, 19 nt, Homo sapiens
gcacacucccuuccacuuu

SEQ ID NO: 1167427 - RNA, 19 nt, Homo sapiens
gcuacaagguauuucgaaa

SEQ ID NO: 1167428 - RNA, 19 nt, Homo sapiens
uaccagaacucuaauugga

SEQ ID NO: 1167429 - RNA, 19 nt, Homo sapiens
gaagagggaaggcuguuug

SEQ ID NO: 1167430 - RNA, 19 nt, Homo sapiens
guaggagguuauuucaauu

SEQ ID NO: 1167431 - RNA, 19 nt, Homo sapiens
uuacuaggcguuuguuaua

SEQ ID NO: 1167432 - RNA, 19 nt, Homo sapiens
ggaccacccugaagcuuag

SEQ ID NO: 1167433 - RNA, 19 nt, Homo sapiens
guguaagacucugccauua

SEQ ID NO: 1167434 - RNA, 19 nt, Homo sapiens
uggaaaugguggugcuuua

SEQ ID NO: 1167435 - RNA, 19 nt, Homo sapiens
gaaaaucuccaucucaaaa

SEQ ID NO: 1167436 - RNA, 19 nt, Homo sapiens
cgagguggcuaauugaugu

SEQ ID NO: 1167437 - RNA, 19 nt, Homo sapiens
uguaggagguuauuucaau

SEQ ID NO: 1167438 - RNA, 19 nt, Homo sapiens
cagacacacuugaccauga

SEQ ID NO: 1167439 - RNA, 19 nt, Homo sapiens
uccagaaacugugcucuua

SEQ ID NO: 1167440 - RNA, 19 nt, Homo sapiens
aaacagucuuucuuccuuu

SEQ ID NO: 1167441 - RNA, 19 nt, Homo sapiens
ccauuucacucucaaacuu

SEQ ID NO: 1167442 - RNA, 19 nt, Homo sapiens
ggaaaugguggugcuuuaa

SEQ ID NO: 1167443 - RNA, 19 nt, Homo sapiens
ggagguuauuucaauucua

SEQ ID NO: 1167444 - RNA, 19 nt, Homo sapiens
guggcuaauugauguauaa

SEQ ID NO: 1167445 - RNA, 19 nt, Homo sapiens
cucaauggcuucaggcuaa

SEQ ID NO: 1167446 - RNA, 19 nt, Homo sapiens
uaaagacacuuaguagagu

SEQ ID NO: 1167447 - RNA, 19 nt, Homo sapiens
gaagccauauuauucacau

SEQ ID NO: 1167448 - RNA, 19 nt, Homo sapiens
ucucaucacucaaccuuau

SEQ ID NO: 1167449 - RNA, 19 nt, Homo sapiens
ggacuaccagccauacaaa

SEQ ID NO: 1167450 - RNA, 19 nt, Homo sapiens
gagggaaggcuguuugaga

SEQ ID NO: 1167451 - RNA, 19 nt, Homo sapiens
gaggaaaacucaguaagaa

SEQ ID NO: 1167452 - RNA, 19 nt, Homo sapiens
acuaggcguuuguuauaua

SEQ ID NO: 1167453 - RNA, 19 nt, Homo sapiens
uaaacucuguccacgauuc

SEQ ID NO: 1167454 - RNA, 19 nt, Homo sapiens
uaagcagcaagacaaauua

SEQ ID NO: 1167455 - RNA, 19 nt, Homo sapiens
gcugaaggcagucauauca

SEQ ID NO: 1167456 - RNA, 19 nt, Homo sapiens
agaauuugaugauguagga

SEQ ID NO: 1167457 - RNA, 19 nt, Homo sapiens
ggucuggaaugcugucuuc

SEQ ID NO: 1167458 - RNA, 19 nt, Homo sapiens
gcaagacaaauuagccauu

SEQ ID NO: 1167459 - RNA, 19 nt, Homo sapiens
ccacagaucauauaaacuc

SEQ ID NO: 1167460 - RNA, 19 nt, Homo sapiens
cagaguucauugauuauuc

SEQ ID NO: 1167461 - RNA, 19 nt, Homo sapiens
gagaaccauuuacuuagca

SEQ ID NO: 1167462 - RNA, 19 nt, Homo sapiens
guaaacacuuggaaauggu

SEQ ID NO: 1167463 - RNA, 19 nt, Homo sapiens
cuaggcguuuguuauauaa

SEQ ID NO: 1167464 - RNA, 19 nt, Homo sapiens
cgcuagagauugcuacaaa

SEQ ID NO: 1167465 - RNA, 19 nt, Homo sapiens
ggaaaacucaguaagaauu

SEQ ID NO: 1167466 - RNA, 19 nt, Homo sapiens
gccauauuauucacauuga

SEQ ID NO: 1167467 - RNA, 19 nt, Homo sapiens
aaagguuccucaaugaaau

SEQ ID NO: 1167468 - RNA, 19 nt, Homo sapiens
gcuagagauugcuacaaau

SEQ ID NO: 1167469 - RNA, 19 nt, Homo sapiens
agggaaggcuguuugagaa

SEQ ID NO: 1167470 - RNA, 19 nt, Homo sapiens
aaauugaggcacagauuaa

SEQ ID NO: 1167471 - RNA, 19 nt, Homo sapiens
cuauagaacauccagagua

SEQ ID NO: 1167472 - RNA, 19 nt, Homo sapiens
gaaaccaaggaaagugaaa

SEQ ID NO: 1167473 - RNA, 19 nt, Homo sapiens
agacacacuugaccaugaa

SEQ ID NO: 1167474 - RNA, 19 nt, Homo sapiens
guuauaagcagcaagacaa

SEQ ID NO: 1167475 - RNA, 19 nt, Homo sapiens
acacuucccugcauuaacu

SEQ ID NO: 1167476 - RNA, 19 nt, Homo sapiens
gggacuaguguauuuauau

SEQ ID NO: 1167477 - RNA, 19 nt, Homo sapiens
cagaucauauaaacucuca

SEQ ID NO: 1167478 - RNA, 19 nt, Homo sapiens
ucuccaggcuuucaauguu

SEQ ID NO: 1167479 - RNA, 19 nt, Homo sapiens
acauugacuuugcaguuaa

SEQ ID NO: 1167480 - RNA, 19 nt, Homo sapiens
augaaagguuccucaauga

SEQ ID NO: 1167481 - RNA, 19 nt, Homo sapiens
gaccaaaugccccgaguua

SEQ ID NO: 1167482 - RNA, 19 nt, Homo sapiens
cacagugccugacacauag

SEQ ID NO: 1167483 - RNA, 19 nt, Homo sapiens
gucaauaacuaaacuaacg

SEQ ID NO: 1167484 - RNA, 19 nt, Homo sapiens
ccauuccaacuucaauuua

SEQ ID NO: 1167485 - RNA, 19 nt, Homo sapiens
gaaccauuccaacuucaau

SEQ ID NO: 1167486 - RNA, 19 nt, Homo sapiens
ucacauugacuuugcaguu

SEQ ID NO: 1167487 - RNA, 19 nt, Homo sapiens
gcggugagcugagauugca

SEQ ID NO: 1167488 - RNA, 19 nt, Homo sapiens
uguaagacucugccauuaa

SEQ ID NO: 1167489 - RNA, 19 nt, Homo sapiens
gcuaggcaccagagggaua

SEQ ID NO: 1167490 - RNA, 19 nt, Homo sapiens
aaacccauguugaucuuuc

SEQ ID NO: 1167491 - RNA, 19 nt, Homo sapiens
gaacagucacaccaugcaa

SEQ ID NO: 1167492 - RNA, 19 nt, Homo sapiens
auaucgagguggcuaauug

SEQ ID NO: 1167493 - RNA, 19 nt, Homo sapiens
cuaaccaucugaagaaacu

SEQ ID NO: 1167494 - RNA, 19 nt, Homo sapiens
ggaaaccaaggaaagugaa

SEQ ID NO: 1167495 - RNA, 19 nt, Homo sapiens
guaauggaaaccaaggaaa

SEQ ID NO: 1167496 - RNA, 19 nt, Homo sapiens
gcaauuaguaagccaugug

SEQ ID NO: 1167497 - RNA, 19 nt, Homo sapiens
gguggcuaauugauguaua

SEQ ID NO: 1167498 - RNA, 19 nt, Homo sapiens
acaaacccauguugaucuu

SEQ ID NO: 1167499 - RNA, 19 nt, Homo sapiens
gauguaggagguuauuuca

SEQ ID NO: 1167500 - RNA, 19 nt, Homo sapiens
gaagcuauauccaguguuu

SEQ ID NO: 1167501 - RNA, 19 nt, Homo sapiens
ucacugagcuuugcuagua

SEQ ID NO: 1167502 - RNA, 19 nt, Homo sapiens
gagcaacccuccuuauaug

SEQ ID NO: 1167503 - RNA, 19 nt, Homo sapiens
gggcaacucucacaucuug

SEQ ID NO: 1167504 - RNA, 19 nt, Homo sapiens
ggaagaguacuuauuauug

SEQ ID NO: 1167505 - RNA, 19 nt, Homo sapiens
ggacauuucauaaggguua

SEQ ID NO: 1167506 - RNA, 19 nt, Homo sapiens
ggaaggacauuucauaagg

SEQ ID NO: 1167507 - RNA, 19 nt, Homo sapiens
ccaaagauguggccaacuu

SEQ ID NO: 1167508 - RNA, 19 nt, Homo sapiens
gaucagcccuguuagaagu

SEQ ID NO: 1167509 - RNA, 19 nt, Homo sapiens
gcaaagugaaggugucaua

SEQ ID NO: 1167510 - RNA, 19 nt, Homo sapiens
gcaaggaugccuacaguga

SEQ ID NO: 1167511 - RNA, 19 nt, Homo sapiens
ucacuacucuuacugauuc

SEQ ID NO: 1167512 - RNA, 19 nt, Homo sapiens
gcgcugaucuugaacuaau

SEQ ID NO: 1167513 - RNA, 19 nt, Homo sapiens
gaaguguaauugugagaug

SEQ ID NO: 1167514 - RNA, 19 nt, Homo sapiens
gacacugaguuauauauga

SEQ ID NO: 1167515 - RNA, 19 nt, Homo sapiens
gcaaguuaaugacccuauu

SEQ ID NO: 1167516 - RNA, 19 nt, Homo sapiens
gaugaaacgugcuuacaag

SEQ ID NO: 1167517 - RNA, 19 nt, Homo sapiens
agaaggcgcugaucuugaa

SEQ ID NO: 1167518 - RNA, 19 nt, Homo sapiens
gugggaagaguacuuauua

SEQ ID NO: 1167519 - RNA, 19 nt, Homo sapiens
ccaaacagauucacuacuc

SEQ ID NO: 1167520 - RNA, 19 nt, Homo sapiens
gaaauuaauuaggcucuag

SEQ ID NO: 1167521 - RNA, 19 nt, Homo sapiens
ccacagauacuaacaacuu

SEQ ID NO: 1167522 - RNA, 19 nt, Homo sapiens
ggcagcugcuccacuguua

SEQ ID NO: 1167523 - RNA, 19 nt, Homo sapiens
uaauuaggcucuaguccaa

SEQ ID NO: 1167524 - RNA, 19 nt, Homo sapiens
guauuuaacuacucugugu

SEQ ID NO: 1167525 - RNA, 19 nt, Homo sapiens
cacagauacuaacaacuua

SEQ ID NO: 1167526 - RNA, 19 nt, Homo sapiens
agagaauccugauaugaaa

SEQ ID NO: 1167527 - RNA, 19 nt, Homo sapiens
gggaagaguacuuauuauu

SEQ ID NO: 1167528 - RNA, 19 nt, Homo sapiens
gcaugugacugugagauug

SEQ ID NO: 1167529 - RNA, 19 nt, Homo sapiens
ugaaacaagucauguaguc

SEQ ID NO: 1167530 - RNA, 19 nt, Homo sapiens
ggucggugauccucucaaa

SEQ ID NO: 1167531 - RNA, 19 nt, Homo sapiens
gaaguuucaccuugccuuu

SEQ ID NO: 1167532 - RNA, 19 nt, Homo sapiens
guguacaucuauaugcuaa

SEQ ID NO: 1167533 - RNA, 19 nt, Homo sapiens
ccuauuggcuuguguacau

SEQ ID NO: 1167534 - RNA, 19 nt, Homo sapiens
cagcaaggaugccuacagu

SEQ ID NO: 1167535 - RNA, 19 nt, Homo sapiens
gagaaggcgcugaucuuga

SEQ ID NO: 1167536 - RNA, 19 nt, Homo sapiens
aagugaaggugucauagaa

SEQ ID NO: 1167537 - RNA, 19 nt, Homo sapiens
caacccuccuuauaugaga

SEQ ID NO: 1167538 - RNA, 19 nt, Homo sapiens
ccgggaaucucuccacaga

SEQ ID NO: 1167539 - RNA, 19 nt, Homo sapiens
cugggacucuucuuuguuu

SEQ ID NO: 1167540 - RNA, 19 nt, Homo sapiens
ccagaaccguaacuauugu

SEQ ID NO: 1167541 - RNA, 19 nt, Homo sapiens
ccaacaagcaugugacugu

SEQ ID NO: 1167542 - RNA, 19 nt, Homo sapiens
gguguuggcugugcucuuc

SEQ ID NO: 1167543 - RNA, 19 nt, Homo sapiens
gggaucagcccuguuagaa

SEQ ID NO: 1167544 - RNA, 19 nt, Homo sapiens
ggacacugaguuauauaug

SEQ ID NO: 1167545 - RNA, 19 nt, Homo sapiens
aagagaauccugauaugaa

SEQ ID NO: 1167546 - RNA, 19 nt, Homo sapiens
acaggcauccuucccuuua

SEQ ID NO: 1167547 - RNA, 19 nt, Homo sapiens
gaagaugucaguguguguu

SEQ ID NO: 1167548 - RNA, 19 nt, Homo sapiens
aggcauccuucccuuuaua

SEQ ID NO: 1167549 - RNA, 19 nt, Homo sapiens
guaaucugcaaguuaauga

SEQ ID NO: 1167550 - RNA, 19 nt, Homo sapiens
gcuccacuguuacgguuga

SEQ ID NO: 1167551 - RNA, 19 nt, Homo sapiens
ugagcaguauggacauuug

SEQ ID NO: 1167552 - RNA, 19 nt, Homo sapiens
cagcaaaggcggaauaaaa

SEQ ID NO: 1167553 - RNA, 19 nt, Homo sapiens
caaacagauucacuacucu

SEQ ID NO: 1167554 - RNA, 19 nt, Homo sapiens
gaugcaugcagucaaauug

SEQ ID NO: 1167555 - RNA, 19 nt, Homo sapiens
ggaugcaugcagucaaauu

SEQ ID NO: 1167556 - RNA, 19 nt, Homo sapiens
auagauugauuccagcaaa

SEQ ID NO: 1167557 - RNA, 19 nt, Homo sapiens
cuauugaaguguaauugug

SEQ ID NO: 1167558 - RNA, 19 nt, Homo sapiens
caaguuaaugacccuauug

SEQ ID NO: 1167559 - RNA, 19 nt, Homo sapiens
gcuaguauaagcagaguuc

SEQ ID NO: 1167560 - RNA, 19 nt, Homo sapiens
gcacacacaagcagagaag

SEQ ID NO: 1167561 - RNA, 19 nt, Homo sapiens
aagcauuggugcccuugaa

SEQ ID NO: 1167562 - RNA, 19 nt, Homo sapiens
guguaauuguucuugguaa

SEQ ID NO: 1167563 - RNA, 19 nt, Homo sapiens
uggcuuguguacaucuaua

SEQ ID NO: 1167564 - RNA, 19 nt, Homo sapiens
gccaacuucuuccuacugu

SEQ ID NO: 1167565 - RNA, 19 nt, Homo sapiens
gggaaggacauuucauaag

SEQ ID NO: 1167566 - RNA, 19 nt, Homo sapiens
cagcagccaaccaggauuu

SEQ ID NO: 1167567 - RNA, 19 nt, Homo sapiens
gcagagaaggcgcugaucu

SEQ ID NO: 1167568 - RNA, 19 nt, Homo sapiens
aaggaugccuacagugaga

SEQ ID NO: 1167569 - RNA, 19 nt, Homo sapiens
cccagaaccguaacuauug

SEQ ID NO: 1167570 - RNA, 19 nt, Homo sapiens
cagagaaggcgcugaucuu

SEQ ID NO: 1167571 - RNA, 19 nt, Homo sapiens
uaaaaugacuuccccacau

SEQ ID NO: 1167572 - RNA, 19 nt, Homo sapiens
gguugucucuacauuucuu

SEQ ID NO: 1167573 - RNA, 19 nt, Homo sapiens
cuaggguugucucuacauu

SEQ ID NO: 1167574 - RNA, 19 nt, Homo sapiens
aagaagcuauauccagugu

SEQ ID NO: 1167575 - RNA, 19 nt, Homo sapiens
ccuguucucugcaaucauc

SEQ ID NO: 1167576 - RNA, 19 nt, Homo sapiens
cagauucacuacucuuacu

SEQ ID NO: 1167577 - RNA, 19 nt, Homo sapiens
uuucggacacugaguuaua

SEQ ID NO: 1167578 - RNA, 19 nt, Homo sapiens
gugaaggugucauagaaaa

SEQ ID NO: 1167579 - RNA, 19 nt, Homo sapiens
uaauugauaccucucuguu

SEQ ID NO: 1167580 - RNA, 19 nt, Homo sapiens
ugggaagaguacuuauuau

SEQ ID NO: 1167581 - RNA, 19 nt, Homo sapiens
acugagcuuugcuaguaua

SEQ ID NO: 1167582 - RNA, 19 nt, Homo sapiens
ugucuuaagcccaaaguug

SEQ ID NO: 1167583 - RNA, 19 nt, Homo sapiens
agggaugcaugcagucaaa

SEQ ID NO: 1167584 - RNA, 19 nt, Homo sapiens
gagaugaaacgugcuuaca

SEQ ID NO: 1167585 - RNA, 19 nt, Homo sapiens
aaagugaaggugucauaga

SEQ ID NO: 1167586 - RNA, 19 nt, Homo sapiens
aggguugucucuacauuuc

SEQ ID NO: 1167587 - RNA, 19 nt, Homo sapiens
uaagcagaguuccaagucu

SEQ ID NO: 1167588 - RNA, 19 nt, Homo sapiens
cugaagcaguaaacuuguu

SEQ ID NO: 1167589 - RNA, 19 nt, Homo sapiens
caauuucggacacugaguu

SEQ ID NO: 1167590 - RNA, 19 nt, Homo sapiens
gaaacaagucauguagucu

SEQ ID NO: 1167591 - RNA, 19 nt, Homo sapiens
auccuucccuuuauagauu

SEQ ID NO: 1167592 - RNA, 19 nt, Homo sapiens
caguauggacauuugcuuu

SEQ ID NO: 1167593 - RNA, 19 nt, Homo sapiens
gccucaaacucuaccuguu

SEQ ID NO: 1167594 - RNA, 19 nt, Homo sapiens
guccaagccccaccuauua

SEQ ID NO: 1167595 - RNA, 19 nt, Homo sapiens
caggcauccuucccuuuau

SEQ ID NO: 1167596 - RNA, 19 nt, Homo sapiens
gcaguauggacauuugcuu

SEQ ID NO: 1167597 - RNA, 19 nt, Homo sapiens
gauucacuacucuuacuga

SEQ ID NO: 1167598 - RNA, 19 nt, Homo sapiens
ccucaaacucuaccuguuc

SEQ ID NO: 1167599 - RNA, 19 nt, Homo sapiens
aacagauucacuacucuua

SEQ ID NO: 1167600 - RNA, 19 nt, Homo sapiens
gcacgggacuuuacaguua

SEQ ID NO: 1167601 - RNA, 19 nt, Homo sapiens
gaaggaggauaauucauuu

SEQ ID NO: 1167602 - RNA, 19 nt, Homo sapiens
gaaagaaacaggcaaagaa

SEQ ID NO: 1167603 - RNA, 19 nt, Homo sapiens
gaaacugucuucagagaga

SEQ ID NO: 1167604 - RNA, 19 nt, Homo sapiens
gaacuugaauugauugcaa

SEQ ID NO: 1167605 - RNA, 19 nt, Homo sapiens
gcccguaguucaugaaaua

SEQ ID NO: 1167606 - RNA, 19 nt, Homo sapiens
ggaaagcggucucccaugu

SEQ ID NO: 1167607 - RNA, 19 nt, Homo sapiens
gaagcaaguuccggaauuu

SEQ ID NO: 1167608 - RNA, 19 nt, Homo sapiens
gcucagggcucuuuccauu

SEQ ID NO: 1167609 - RNA, 19 nt, Homo sapiens
gagugugucugauuucaua

SEQ ID NO: 1167610 - RNA, 19 nt, Homo sapiens
uuucagagguuccuuauuu

SEQ ID NO: 1167611 - RNA, 19 nt, Homo sapiens
ggaaggaguuugagguuca

SEQ ID NO: 1167612 - RNA, 19 nt, Homo sapiens
ucaaauaguuucccugguu

SEQ ID NO: 1167613 - RNA, 19 nt, Homo sapiens
gaagaaaaguuccaaauca

SEQ ID NO: 1167614 - RNA, 19 nt, Homo sapiens
caaagaaacagcaaagauu

SEQ ID NO: 1167615 - RNA, 19 nt, Homo sapiens
cuccaaggcuguaacauua

SEQ ID NO: 1167616 - RNA, 19 nt, Homo sapiens
ccaaacugcugugcuauaa

SEQ ID NO: 1167617 - RNA, 19 nt, Homo sapiens
gaacuucgucucuuucuug

SEQ ID NO: 1167618 - RNA, 19 nt, Homo sapiens
ggaaagguguuugaaagga

SEQ ID NO: 1167619 - RNA, 19 nt, Homo sapiens
cggaauacaucacaucaaa

SEQ ID NO: 1167620 - RNA, 19 nt, Homo sapiens
acacuuagaucaaggaguu

SEQ ID NO: 1167621 - RNA, 19 nt, Homo sapiens
ggaggcaucuucuucugaa

SEQ ID NO: 1167622 - RNA, 19 nt, Homo sapiens
gauacucccuugaaauuuc

SEQ ID NO: 1167623 - RNA, 19 nt, Homo sapiens
gggaagaugcagucacuua

SEQ ID NO: 1167624 - RNA, 19 nt, Homo sapiens
uaucuaaccucaacuguca

SEQ ID NO: 1167625 - RNA, 19 nt, Homo sapiens
ucacugaauuuccugcuuu

SEQ ID NO: 1167626 - RNA, 19 nt, Homo sapiens
cauggaagauacuuucaaa

SEQ ID NO: 1167627 - RNA, 19 nt, Homo sapiens
gucacugucuucuuucuua

SEQ ID NO: 1167628 - RNA, 19 nt, Homo sapiens
caguuaggauucauguuua

SEQ ID NO: 1167629 - RNA, 19 nt, Homo sapiens
ccagauaggccauugcuuu

SEQ ID NO: 1167630 - RNA, 19 nt, Homo sapiens
gaagugacaucuuucuaac

SEQ ID NO: 1167631 - RNA, 19 nt, Homo sapiens
gaaagguguuugaaaggau

SEQ ID NO: 1167632 - RNA, 19 nt, Homo sapiens
aaagaaacuugcaaggaaa

SEQ ID NO: 1167633 - RNA, 19 nt, Homo sapiens
gcaaagaaacagcaaagau

SEQ ID NO: 1167634 - RNA, 19 nt, Homo sapiens
gguugucacugucuucuuu

SEQ ID NO: 1167635 - RNA, 19 nt, Homo sapiens
cacauuccaucaaaguuua

SEQ ID NO: 1167636 - RNA, 19 nt, Homo sapiens
ucaaguccaugacauaguu

SEQ ID NO: 1167637 - RNA, 19 nt, Homo sapiens
ccacggcaguugcaaggua

SEQ ID NO: 1167638 - RNA, 19 nt, Homo sapiens
auacagaggugccauacuu

SEQ ID NO: 1167639 - RNA, 19 nt, Homo sapiens
gaaaggagcaagugaagag

SEQ ID NO: 1167640 - RNA, 19 nt, Homo sapiens
aggcagaacuggagaagaa

SEQ ID NO: 1167641 - RNA, 19 nt, Homo sapiens
uggcaauguuucaauguua

SEQ ID NO: 1167642 - RNA, 19 nt, Homo sapiens
cgacugccauccagagaaa

SEQ ID NO: 1167643 - RNA, 19 nt, Homo sapiens
caaguuaaaccacuaaugu

SEQ ID NO: 1167644 - RNA, 19 nt, Homo sapiens
cgaagugacaucuuucuaa

SEQ ID NO: 1167645 - RNA, 19 nt, Homo sapiens
ggcaauguuucaauguuaa

SEQ ID NO: 1167646 - RNA, 19 nt, Homo sapiens
cagcugggcccacuucaua

SEQ ID NO: 1167647 - RNA, 19 nt, Homo sapiens
caagggccacguuggauua

SEQ ID NO: 1167648 - RNA, 19 nt, Homo sapiens
ccaggagguugcaguauug

SEQ ID NO: 1167649 - RNA, 19 nt, Homo sapiens
gccaggagguugcaguauu

SEQ ID NO: 1167650 - RNA, 19 nt, Homo sapiens
uuacguacaucccgaaaga

SEQ ID NO: 1167651 - RNA, 19 nt, Homo sapiens
acaccaaacugcugugcua

SEQ ID NO: 1167652 - RNA, 19 nt, Homo sapiens
gaaggaccaugcucagaag

SEQ ID NO: 1167653 - RNA, 19 nt, Homo sapiens
gaaacaacuaucagauuug

SEQ ID NO: 1167654 - RNA, 19 nt, Homo sapiens
gaaagcggucucccaugua

SEQ ID NO: 1167655 - RNA, 19 nt, Homo sapiens
aaagaggcccugcggaaua

SEQ ID NO: 1167656 - RNA, 19 nt, Homo sapiens
cggaggcucugcacuauga

SEQ ID NO: 1167657 - RNA, 19 nt, Homo sapiens
ugaaauaguuccggcuuug

SEQ ID NO: 1167658 - RNA, 19 nt, Homo sapiens
gcuggcaggugaaguguga

SEQ ID NO: 1167659 - RNA, 19 nt, Homo sapiens
aaacguuccugccguaaau

SEQ ID NO: 1167660 - RNA, 19 nt, Homo sapiens
acucaucccagaauuauua

SEQ ID NO: 1167661 - RNA, 19 nt, Homo sapiens
gagcggcuauugaagugaa

SEQ ID NO: 1167662 - RNA, 19 nt, Homo sapiens
aaagaagccuacagugguu

SEQ ID NO: 1167663 - RNA, 19 nt, Homo sapiens
gaagaugcagucacuuaug

SEQ ID NO: 1167664 - RNA, 19 nt, Homo sapiens
guacaaguauggcaagaac

SEQ ID NO: 1167665 - RNA, 19 nt, Homo sapiens
ccuucaaccuccauuuaua

SEQ ID NO: 1167666 - RNA, 19 nt, Homo sapiens
gcaaugucacugguacuua

SEQ ID NO: 1167667 - RNA, 19 nt, Homo sapiens
ggucucccauguauaagaa

SEQ ID NO: 1167668 - RNA, 19 nt, Homo sapiens
aagaugcagucacuuauga

SEQ ID NO: 1167669 - RNA, 19 nt, Homo sapiens
ugucaggaauucuccagua

SEQ ID NO: 1167670 - RNA, 19 nt, Homo sapiens
uuaaaccacuaauguguug

SEQ ID NO: 1167671 - RNA, 19 nt, Homo sapiens
gaucaaagaagccuacagu

SEQ ID NO: 1167672 - RNA, 19 nt, Homo sapiens
aaaagaaacuugcaaggaa

SEQ ID NO: 1167673 - RNA, 19 nt, Homo sapiens
caccugaacuugaauugau

SEQ ID NO: 1167674 - RNA, 19 nt, Homo sapiens
ccagggcaguccuuugaaa

SEQ ID NO: 1167675 - RNA, 19 nt, Homo sapiens
ccacuuguauucuuucuac

SEQ ID NO: 1167676 - RNA, 19 nt, Homo sapiens
gcucuuaugagucguauga

SEQ ID NO: 1167677 - RNA, 19 nt, Homo sapiens
caggugaggugcuguguuc

SEQ ID NO: 1167678 - RNA, 19 nt, Homo sapiens
aaaguuugcuccuccauag

SEQ ID NO: 1167679 - RNA, 19 nt, Homo sapiens
caggcgaagugacaucuuu

SEQ ID NO: 1167680 - RNA, 19 nt, Homo sapiens
caagggcacugugucgaaa

SEQ ID NO: 1167681 - RNA, 19 nt, Homo sapiens
ggcugaaggugaucaaaga

SEQ ID NO: 1167682 - RNA, 19 nt, Homo sapiens
aaagaaacaggcaaagaaa

SEQ ID NO: 1167683 - RNA, 19 nt, Homo sapiens
caaugucacugguacuuag

SEQ ID NO: 1167684 - RNA, 19 nt, Homo sapiens
ucacauuccaucaaaguuu

SEQ ID NO: 1167685 - RNA, 19 nt, Homo sapiens
aggaagagauggcgggaaa

SEQ ID NO: 1167686 - RNA, 19 nt, Homo sapiens
ggaagaugcagucacuuau

SEQ ID NO: 1167687 - RNA, 19 nt, Homo sapiens
gaaagaggcccugcggaau

SEQ ID NO: 1167688 - RNA, 19 nt, Homo sapiens
gagguucauugucauuaug

SEQ ID NO: 1167689 - RNA, 19 nt, Homo sapiens
ggaacuauaacaccuuaga

SEQ ID NO: 1167690 - RNA, 19 nt, Homo sapiens
gauggaaagguguuugaaa

SEQ ID NO: 1167691 - RNA, 19 nt, Homo sapiens
ucaccaagaucaucagucu

SEQ ID NO: 1167692 - RNA, 19 nt, Homo sapiens
ccacuucaaaugacuguaa

SEQ ID NO: 1167693 - RNA, 19 nt, Homo sapiens
gcagugauaaccaacauuc

SEQ ID NO: 1167694 - RNA, 19 nt, Homo sapiens
gcaagggccacguuggauu

SEQ ID NO: 1167695 - RNA, 19 nt, Homo sapiens
acaguuaggauucauguuu

SEQ ID NO: 1167696 - RNA, 19 nt, Homo sapiens
ggacuuuacaguuaggauu

SEQ ID NO: 1167697 - RNA, 19 nt, Homo sapiens
ucaaggagagccugaagaa

SEQ ID NO: 1167698 - RNA, 19 nt, Homo sapiens
cuaaacauccucugacguu

SEQ ID NO: 1167699 - RNA, 19 nt, Homo sapiens
gcgaggugaucccggguuu

SEQ ID NO: 1167700 - RNA, 19 nt, Homo sapiens
gaagguagauuuggaguaa

SEQ ID NO: 1167701 - RNA, 19 nt, Homo sapiens
gaggaaggcugucaucaaa

SEQ ID NO: 1167702 - RNA, 19 nt, Homo sapiens
gaacauagauacagcucuu

SEQ ID NO: 1167703 - RNA, 19 nt, Homo sapiens
caaagugacuauugaaguu

SEQ ID NO: 1167704 - RNA, 19 nt, Homo sapiens
gugacaagcuggaagauuu

SEQ ID NO: 1167705 - RNA, 19 nt, Homo sapiens
gagaagaaauggcuuugga

SEQ ID NO: 1167706 - RNA, 19 nt, Homo sapiens
ugaaugaggugaacauaga

SEQ ID NO: 1167707 - RNA, 19 nt, Homo sapiens
ggaaguaggcauauaaaug

SEQ ID NO: 1167708 - RNA, 19 nt, Homo sapiens
gagaagcacuugcaaagca

SEQ ID NO: 1167709 - RNA, 19 nt, Homo sapiens
gagcacagguuauugaaag

SEQ ID NO: 1167710 - RNA, 19 nt, Homo sapiens
gaagaaauggcuuuggaaa

SEQ ID NO: 1167711 - RNA, 19 nt, Homo sapiens
ggacuuuccuuccuugaau

SEQ ID NO: 1167712 - RNA, 19 nt, Homo sapiens
gagagcaauuggcuuguuu

SEQ ID NO: 1167713 - RNA, 19 nt, Homo sapiens
cgacauaauuccucugaug

SEQ ID NO: 1167714 - RNA, 19 nt, Homo sapiens
ggaaccaaauaguuuaaga

SEQ ID NO: 1167715 - RNA, 19 nt, Homo sapiens
ccaaauaguuuaagaugag

SEQ ID NO: 1167716 - RNA, 19 nt, Homo sapiens
gaauagagacugugacaag

SEQ ID NO: 1167717 - RNA, 19 nt, Homo sapiens
gcagagcacagguuauuga

SEQ ID NO: 1167718 - RNA, 19 nt, Homo sapiens
ccuguuaucugcuuuauag

SEQ ID NO: 1167719 - RNA, 19 nt, Homo sapiens
cagagcagcugagaagaaa

SEQ ID NO: 1167720 - RNA, 19 nt, Homo sapiens
gaagagugaguuccugaaa

SEQ ID NO: 1167721 - RNA, 19 nt, Homo sapiens
gaaagaagacaagguggaa

SEQ ID NO: 1167722 - RNA, 19 nt, Homo sapiens
caagggaaauaaucauauc

SEQ ID NO: 1167723 - RNA, 19 nt, Homo sapiens
caucagccaugcagaccua

SEQ ID NO: 1167724 - RNA, 19 nt, Homo sapiens
aguuaaaucugacccagua

SEQ ID NO: 1167725 - RNA, 19 nt, Homo sapiens
ggaggaaggcugucaucaa

SEQ ID NO: 1167726 - RNA, 19 nt, Homo sapiens
gcaacaucauagugccaua

SEQ ID NO: 1167727 - RNA, 19 nt, Homo sapiens
ccuaaugcauggaaagcua

SEQ ID NO: 1167728 - RNA, 19 nt, Homo sapiens
ccaagaugcuaguuaucaa

SEQ ID NO: 1167729 - RNA, 19 nt, Homo sapiens
cagaggagaagguagauuu

SEQ ID NO: 1167730 - RNA, 19 nt, Homo sapiens
caacaccacagucagcuaa

SEQ ID NO: 1167731 - RNA, 19 nt, Homo sapiens
uuauuguucuucccuguua

SEQ ID NO: 1167732 - RNA, 19 nt, Homo sapiens
gugcaaauauccaugucuu

SEQ ID NO: 1167733 - RNA, 19 nt, Homo sapiens
cagcacaccugaaccaaag

SEQ ID NO: 1167734 - RNA, 19 nt, Homo sapiens
ugaaaacucugaaggauga

SEQ ID NO: 1167735 - RNA, 19 nt, Homo sapiens
ccaguaaacucuguguguu

SEQ ID NO: 1167736 - RNA, 19 nt, Homo sapiens
gaaaccaguagcagugaaa

SEQ ID NO: 1167737 - RNA, 19 nt, Homo sapiens
gcauucaccucaccaggau

SEQ ID NO: 1167738 - RNA, 19 nt, Homo sapiens
guuaucugcuuuauagaga

SEQ ID NO: 1167739 - RNA, 19 nt, Homo sapiens
gcucugaguucucccaaag

SEQ ID NO: 1167740 - RNA, 19 nt, Homo sapiens
caaauugucauccgugguu

SEQ ID NO: 1167741 - RNA, 19 nt, Homo sapiens
ugggacaccuucuggagua

SEQ ID NO: 1167742 - RNA, 19 nt, Homo sapiens
ucaggaaccaaauaguuua

SEQ ID NO: 1167743 - RNA, 19 nt, Homo sapiens
ggaaacuacugcauaaaau

SEQ ID NO: 1167744 - RNA, 19 nt, Homo sapiens
gaacugcaggagauucuug

SEQ ID NO: 1167745 - RNA, 19 nt, Homo sapiens
gcaccuacccagaggagaa

SEQ ID NO: 1167746 - RNA, 19 nt, Homo sapiens
gagcagcugagaagaaaug

SEQ ID NO: 1167747 - RNA, 19 nt, Homo sapiens
uccaaucucuguuaccaaa

SEQ ID NO: 1167748 - RNA, 19 nt, Homo sapiens
caggguggauuguaaaaua

SEQ ID NO: 1167749 - RNA, 19 nt, Homo sapiens
gcagcaacagcuucuacua

SEQ ID NO: 1167750 - RNA, 19 nt, Homo sapiens
gcaaauauccaugucuuac

SEQ ID NO: 1167751 - RNA, 19 nt, Homo sapiens
ggaaggcugucaucaaaau

SEQ ID NO: 1167752 - RNA, 19 nt, Homo sapiens
gagaauagagacugugaca

SEQ ID NO: 1167753 - RNA, 19 nt, Homo sapiens
ccuccaagaugcuaguuau

SEQ ID NO: 1167754 - RNA, 19 nt, Homo sapiens
gaagacagagcagcugaga

SEQ ID NO: 1167755 - RNA, 19 nt, Homo sapiens
caagcaacccuccaagaug

SEQ ID NO: 1167756 - RNA, 19 nt, Homo sapiens
cauaauuccucugaugguu

SEQ ID NO: 1167757 - RNA, 19 nt, Homo sapiens
auccaugucuuaccuaauu

SEQ ID NO: 1167758 - RNA, 19 nt, Homo sapiens
cgacucgaguucagaaaca

SEQ ID NO: 1167759 - RNA, 19 nt, Homo sapiens
acacuggucugcagcaaca

SEQ ID NO: 1167760 - RNA, 19 nt, Homo sapiens
gaaguugaaugaggugaac

SEQ ID NO: 1167761 - RNA, 19 nt, Homo sapiens
agaagcagagcacagguua

SEQ ID NO: 1167762 - RNA, 19 nt, Homo sapiens
caagaugcuaguuaucaaa

SEQ ID NO: 1167763 - RNA, 19 nt, Homo sapiens
ggaaccaucgccauuggaa

SEQ ID NO: 1167764 - RNA, 19 nt, Homo sapiens
ugccauaacucaaggaagu

SEQ ID NO: 1167765 - RNA, 19 nt, Homo sapiens
gucaggaaccaaauaguuu

SEQ ID NO: 1167766 - RNA, 19 nt, Homo sapiens
ccucucgucugaccaaguu

SEQ ID NO: 1167767 - RNA, 19 nt, Homo sapiens
ggauauaggaaauguugug

SEQ ID NO: 1167768 - RNA, 19 nt, Homo sapiens
cacaagggaaauaaucaua

SEQ ID NO: 1167769 - RNA, 19 nt, Homo sapiens
ggacaacagcacaccugaa

SEQ ID NO: 1167770 - RNA, 19 nt, Homo sapiens
ccaagcaacccuccaagau

SEQ ID NO: 1167771 - RNA, 19 nt, Homo sapiens
caacaucauagugccauaa

SEQ ID NO: 1167772 - RNA, 19 nt, Homo sapiens
gguuggaugccucaccuua

SEQ ID NO: 1167773 - RNA, 19 nt, Homo sapiens
aaacaggaccacagagguu

SEQ ID NO: 1167774 - RNA, 19 nt, Homo sapiens
agagagugaucgacacaga

SEQ ID NO: 1167775 - RNA, 19 nt, Homo sapiens
uauucaggguggauuguaa

SEQ ID NO: 1167776 - RNA, 19 nt, Homo sapiens
agacagagcagcugagaag

SEQ ID NO: 1167777 - RNA, 19 nt, Homo sapiens
gcuauggguuggcaggaau

SEQ ID NO: 1167778 - RNA, 19 nt, Homo sapiens
ggaaauguuguguuauucu

SEQ ID NO: 1167779 - RNA, 19 nt, Homo sapiens
ugacaaagugacuauugaa

SEQ ID NO: 1167780 - RNA, 19 nt, Homo sapiens
aaacgugucaggaaccaaa

SEQ ID NO: 1167781 - RNA, 19 nt, Homo sapiens
caguagcagugaaacauca

SEQ ID NO: 1167782 - RNA, 19 nt, Homo sapiens
cgaaaccaguagcagugaa

SEQ ID NO: 1167783 - RNA, 19 nt, Homo sapiens
ggaauauccugaaaaugau

SEQ ID NO: 1167784 - RNA, 19 nt, Homo sapiens
cuaacaggauggagcacaa

SEQ ID NO: 1167785 - RNA, 19 nt, Homo sapiens
ggcaugagccaacguagug

SEQ ID NO: 1167786 - RNA, 19 nt, Homo sapiens
ggacucuggugucucuaag

SEQ ID NO: 1167787 - RNA, 19 nt, Homo sapiens
guuccugcuuggcuaaauu

SEQ ID NO: 1167788 - RNA, 19 nt, Homo sapiens
gcaacagcuucuacuacca

SEQ ID NO: 1167789 - RNA, 19 nt, Homo sapiens
ggacugagagagugaucga

SEQ ID NO: 1167790 - RNA, 19 nt, Homo sapiens
ggaaguugaaugaggugaa

SEQ ID NO: 1167791 - RNA, 19 nt, Homo sapiens
aagcagagcacagguuauu

SEQ ID NO: 1167792 - RNA, 19 nt, Homo sapiens
caacagcacaccugaacca

SEQ ID NO: 1167793 - RNA, 19 nt, Homo sapiens
uggaagauuuggaggacaa

SEQ ID NO: 1167794 - RNA, 19 nt, Homo sapiens
ggaaacgugucaggaacca

SEQ ID NO: 1167795 - RNA, 19 nt, Homo sapiens
uaaauggcgcagcaugauu

SEQ ID NO: 1167796 - RNA, 19 nt, Homo sapiens
ggagacacuggaccuaaau

SEQ ID NO: 1167797 - RNA, 19 nt, Homo sapiens
ugaccggaauggagacuuc

SEQ ID NO: 1167798 - RNA, 19 nt, Homo sapiens
cuauggagauuagggaaga

SEQ ID NO: 1167799 - RNA, 19 nt, Homo sapiens
ccuacgaacugcaggagau

SEQ ID NO: 1167800 - RNA, 19 nt, Homo sapiens
ccacaaaucuccuagucua

SEQ ID NO: 1167801 - RNA, 19 nt, Homo sapiens
gcucauaccucccacaaau

SEQ ID NO: 1167802 - RNA, 19 nt, Homo sapiens
caaaucuccuagucuaaua

SEQ ID NO: 1167803 - RNA, 19 nt, Homo sapiens
caagauguaugagaacuuu

SEQ ID NO: 1167804 - RNA, 19 nt, Homo sapiens
caauggaucugguucaaga

SEQ ID NO: 1167805 - RNA, 19 nt, Homo sapiens
ggacccaaguggagagauu

SEQ ID NO: 1167806 - RNA, 19 nt, Homo sapiens
guggccaucuucuuuguua

SEQ ID NO: 1167807 - RNA, 19 nt, Homo sapiens
gauaugcacugaccacuac

SEQ ID NO: 1167808 - RNA, 19 nt, Homo sapiens
guaccgggaugcagagauu

SEQ ID NO: 1167809 - RNA, 19 nt, Homo sapiens
ggaaggagcaucucuacca

SEQ ID NO: 1167810 - RNA, 19 nt, Homo sapiens
ggacaguggcgaauacagu

SEQ ID NO: 1167811 - RNA, 19 nt, Homo sapiens
gugcgggacucaucuaucu

SEQ ID NO: 1167812 - RNA, 19 nt, Homo sapiens
guggagagauuguggaacu

SEQ ID NO: 1167813 - RNA, 19 nt, Homo sapiens
gagccucgauaugcacuga

SEQ ID NO: 1167814 - RNA, 19 nt, Homo sapiens
aauaaaaccuuccaucuca

SEQ ID NO: 1167815 - RNA, 19 nt, Homo sapiens
guucaagcgugcaauggau

SEQ ID NO: 1167816 - RNA, 19 nt, Homo sapiens
gcugggaccuagugaagag

SEQ ID NO: 1167817 - RNA, 19 nt, Homo sapiens
gacuuaauccuaccuggaa

SEQ ID NO: 1167818 - RNA, 19 nt, Homo sapiens
ccaaggagccccacucauu

SEQ ID NO: 1167819 - RNA, 19 nt, Homo sapiens
caucuucuuuguuaucuac

SEQ ID NO: 1167820 - RNA, 19 nt, Homo sapiens
ucuaugacaagauguauga

SEQ ID NO: 1167821 - RNA, 19 nt, Homo sapiens
gcuggacaguggcgaauac

SEQ ID NO: 1167822 - RNA, 19 nt, Homo sapiens
gagcagugcgggacucauc

SEQ ID NO: 1167823 - RNA, 19 nt, Homo sapiens
cugcagagauuagauuucu

SEQ ID NO: 1167824 - RNA, 19 nt, Homo sapiens
aggaguuucugcagagauu

SEQ ID NO: 1167825 - RNA, 19 nt, Homo sapiens
augacaagauguaugagaa

SEQ ID NO: 1167826 - RNA, 19 nt, Homo sapiens
gaaucgggacgcacaaugg

SEQ ID NO: 1167827 - RNA, 19 nt, Homo sapiens
gguggaugcuguggacaau

SEQ ID NO: 1167828 - RNA, 19 nt, Homo sapiens
gacaagauguaugagaacu

SEQ ID NO: 1167829 - RNA, 19 nt, Homo sapiens
gcagugcgggacucaucua

SEQ ID NO: 1167830 - RNA, 19 nt, Homo sapiens
cgauaugcacugaccacua

SEQ ID NO: 1167831 - RNA, 19 nt, Homo sapiens
ccaguggccaucuucuuug

SEQ ID NO: 1167832 - RNA, 19 nt, Homo sapiens
ggaguuucugcagagauua

SEQ ID NO: 1167833 - RNA, 19 nt, Homo sapiens
acaaaucuccuagucuaau

SEQ ID NO: 1167834 - RNA, 19 nt, Homo sapiens
uacagugugugcccaagga

SEQ ID NO: 1167835 - RNA, 19 nt, Homo sapiens
cacccucuaugacaagaug

SEQ ID NO: 1167836 - RNA, 19 nt, Homo sapiens
cagaggucuuucacagaga

SEQ ID NO: 1167837 - RNA, 19 nt, Homo sapiens
uccaguggccaucuucuuu

SEQ ID NO: 1167838 - RNA, 19 nt, Homo sapiens
uggaugcuguggacaaugg

SEQ ID NO: 1167839 - RNA, 19 nt, Homo sapiens
cacaaaucuccuagucuaa

SEQ ID NO: 1167840 - RNA, 19 nt, Homo sapiens
caguggccaucuucuuugu

SEQ ID NO: 1167841 - RNA, 19 nt, Homo sapiens
aaacucgcuuccugugaca

SEQ ID NO: 1167842 - RNA, 19 nt, Homo sapiens
gugcaugucccuggaagga

SEQ ID NO: 1167843 - RNA, 19 nt, Homo sapiens
ucccacaaaucuccuaguc

SEQ ID NO: 1167844 - RNA, 19 nt, Homo sapiens
gcgcucauaccucccacaa

SEQ ID NO: 1167845 - RNA, 19 nt, Homo sapiens
gcaucucuaccaccuggaa

SEQ ID NO: 1167846 - RNA, 19 nt, Homo sapiens
acucaucuaucugcacuuc

SEQ ID NO: 1167847 - RNA, 19 nt, Homo sapiens
guugcucgacuuaauccua

SEQ ID NO: 1167848 - RNA, 19 nt, Homo sapiens
uaugacaagauguaugaga

SEQ ID NO: 1167849 - RNA, 19 nt, Homo sapiens
cgaaucgggacgcacaaug

SEQ ID NO: 1167850 - RNA, 19 nt, Homo sapiens
gagccccacucauuccaaa

SEQ ID NO: 1167851 - RNA, 19 nt, Homo sapiens
ugcaauggaucugguucaa

SEQ ID NO: 1167852 - RNA, 19 nt, Homo sapiens
ccagaaagcucuucaguga

SEQ ID NO: 1167853 - RNA, 19 nt, Homo sapiens
ccaccaagaugaaugaaga

SEQ ID NO: 1167854 - RNA, 19 nt, Homo sapiens
guaagcacagcaacaagua

SEQ ID NO: 1167855 - RNA, 19 nt, Homo sapiens
ccaagggugugcagaacaa

SEQ ID NO: 1167856 - RNA, 19 nt, Homo sapiens
gaacaucgcccuggugaac

SEQ ID NO: 1167857 - RNA, 19 nt, Homo sapiens
ggacaaacaggucguagca

SEQ ID NO: 1167858 - RNA, 19 nt, Homo sapiens
gcacugcgggcuaaacaug

SEQ ID NO: 1167859 - RNA, 19 nt, Homo sapiens
ggagaagcacggccagcua

SEQ ID NO: 1167860 - RNA, 19 nt, Homo sapiens
ugaaugaagagaccagaaa

SEQ ID NO: 1167861 - RNA, 19 nt, Homo sapiens
gagcagcacgugaagaaca

SEQ ID NO: 1167862 - RNA, 19 nt, Homo sapiens
gaggacaagaugcugauga

SEQ ID NO: 1167863 - RNA, 19 nt, Homo sapiens
aaaccuguccuuccgcuuu

SEQ ID NO: 1167864 - RNA, 19 nt, Homo sapiens
caacccagcaggagaagug

SEQ ID NO: 1167865 - RNA, 19 nt, Homo sapiens
cccgguggcugcuucauga

SEQ ID NO: 1167866 - RNA, 19 nt, Homo sapiens
caggguacccgccuccuuu

SEQ ID NO: 1167867 - RNA, 19 nt, Homo sapiens
gagaaguggacaugagguu

SEQ ID NO: 1167868 - RNA, 19 nt, Homo sapiens
gcacagcaacaaguacgaa

SEQ ID NO: 1167869 - RNA, 19 nt, Homo sapiens
gaaugaagagaccagaaag

SEQ ID NO: 1167870 - RNA, 19 nt, Homo sapiens
aacgaccuguugaaguuua

SEQ ID NO: 1167871 - RNA, 19 nt, Homo sapiens
caggagaaguggacaugag

SEQ ID NO: 1167872 - RNA, 19 nt, Homo sapiens
ggagauggaaggcuguauc

SEQ ID NO: 1167873 - RNA, 19 nt, Homo sapiens
cgggacagcuggguguuug

SEQ ID NO: 1167874 - RNA, 19 nt, Homo sapiens
gaugaccccuuaauaaagu

SEQ ID NO: 1167875 - RNA, 19 nt, Homo sapiens
gaccagaaagcucuucagu

SEQ ID NO: 1167876 - RNA, 19 nt, Homo sapiens
cgacccagccaccaagaug

SEQ ID NO: 1167877 - RNA, 19 nt, Homo sapiens
gggccaagggugugcagaa

SEQ ID NO: 1167878 - RNA, 19 nt, Homo sapiens
gcaggagaaguggacauga

SEQ ID NO: 1167879 - RNA, 19 nt, Homo sapiens
uagaugaccccuuaauaaa

SEQ ID NO: 1167880 - RNA, 19 nt, Homo sapiens
acaguaagcacagcaacaa

SEQ ID NO: 1167881 - RNA, 19 nt, Homo sapiens
gcagcaggaacgccaagga

SEQ ID NO: 1167882 - RNA, 19 nt, Homo sapiens
gacccagccaccaagauga

SEQ ID NO: 1167883 - RNA, 19 nt, Homo sapiens
cagccaccaagaugaauga

SEQ ID NO: 1167884 - RNA, 19 nt, Homo sapiens
ugagcagcgucaaggacaa

SEQ ID NO: 1167885 - RNA, 19 nt, Homo sapiens
gaagcacggccagcuagca

SEQ ID NO: 1167886 - RNA, 19 nt, Homo sapiens
ggccaagggugugcagaac

SEQ ID NO: 1167887 - RNA, 19 nt, Homo sapiens
gcaaaugucuguaaucugu

SEQ ID NO: 1167888 - RNA, 19 nt, Homo sapiens
gcucuaacccugcauauua

SEQ ID NO: 1167889 - RNA, 19 nt, Homo sapiens
caaaguagcugccggcaau

SEQ ID NO: 1167890 - RNA, 19 nt, Homo sapiens
gcgcagggaucccaucauu

SEQ ID NO: 1167891 - RNA, 19 nt, Homo sapiens
gcugcuaucucgaccauuu

SEQ ID NO: 1167892 - RNA, 19 nt, Homo sapiens
cuagggauuugucaucuua

SEQ ID NO: 1167893 - RNA, 19 nt, Homo sapiens
guggaggcguuuagaauuu

SEQ ID NO: 1167894 - RNA, 19 nt, Homo sapiens
ggccaucucuguuuacuca

SEQ ID NO: 1167895 - RNA, 19 nt, Homo sapiens
ugaugccucugauggaaua

SEQ ID NO: 1167896 - RNA, 19 nt, Homo sapiens
ccucugauggaauaaauua

SEQ ID NO: 1167897 - RNA, 19 nt, Homo sapiens
caccggccaucucuguuua

SEQ ID NO: 1167898 - RNA, 19 nt, Homo sapiens
uuucgaugcuuguuucuuu

SEQ ID NO: 1167899 - RNA, 19 nt, Homo sapiens
caucaccuccugcaucuuu

SEQ ID NO: 1167900 - RNA, 19 nt, Homo sapiens
ccgaaggccuguuugacaa

SEQ ID NO: 1167901 - RNA, 19 nt, Homo sapiens
gcagggaucccaucauuuu

SEQ ID NO: 1167902 - RNA, 19 nt, Homo sapiens
ucuguaaucuguaauugug

SEQ ID NO: 1167903 - RNA, 19 nt, Homo sapiens
gguggaggcguuuagaauu

SEQ ID NO: 1167904 - RNA, 19 nt, Homo sapiens
guaauugugaugccucuga

SEQ ID NO: 1167905 - RNA, 19 nt, Homo sapiens
ucacuaucuuugucuauca

SEQ ID NO: 1167906 - RNA, 19 nt, Homo sapiens
aaaaggggcugagggauuu

SEQ ID NO: 1167907 - RNA, 19 nt, Homo sapiens
caucucuguuuacucauga

SEQ ID NO: 1167908 - RNA, 19 nt, Homo sapiens
ucauguagcuuucgaugcu

SEQ ID NO: 1167909 - RNA, 19 nt, Homo sapiens
cuauauccauuuacagcuu

SEQ ID NO: 1167910 - RNA, 19 nt, Homo sapiens
gccaucgccuucuccauca

SEQ ID NO: 1167911 - RNA, 19 nt, Homo sapiens
ccaccggccaucucuguuu

SEQ ID NO: 1167912 - RNA, 19 nt, Homo sapiens
gcugugagacccaagacaa

SEQ ID NO: 1167913 - RNA, 19 nt, Homo sapiens
aaacggggcucggcauuuu

SEQ ID NO: 1167914 - RNA, 19 nt, Homo sapiens
gagaccacguccuggaagu

SEQ ID NO: 1167915 - RNA, 19 nt, Homo sapiens
ucuguuuacucaugaaugu

SEQ ID NO: 1167916 - RNA, 19 nt, Homo sapiens
caagaguucgugcgggaaa

SEQ ID NO: 1167917 - RNA, 19 nt, Homo sapiens
acucuaggauggcuucguu

SEQ ID NO: 1167918 - RNA, 19 nt, Homo sapiens
gcaccucuccaucuucauc

SEQ ID NO: 1167919 - RNA, 19 nt, Homo sapiens
ccgcaccucuccaucuuca

SEQ ID NO: 1167920 - RNA, 19 nt, Homo sapiens
ccuccugcaucuuuaccua

SEQ ID NO: 1167921 - RNA, 19 nt, Homo sapiens
ccaucucuguuuacucaug

SEQ ID NO: 1167922 - RNA, 19 nt, Homo sapiens
ggacgagggcugcuaucuc

SEQ ID NO: 1167923 - RNA, 19 nt, Homo sapiens
gaaauaggggugcuguuug

SEQ ID NO: 1167924 - RNA, 19 nt, Homo sapiens
gggcugcuaucucgaccau

SEQ ID NO: 1167925 - RNA, 19 nt, Homo sapiens
guagcugccggcaaugaaa

SEQ ID NO: 1167926 - RNA, 19 nt, Homo sapiens
uccugcaucuuuaccuaua

SEQ ID NO: 1167927 - RNA, 19 nt, Homo sapiens
ugugaugccucugauggaa

SEQ ID NO: 1167928 - RNA, 19 nt, Homo sapiens
caaaugucuguaaucugua

SEQ ID NO: 1167929 - RNA, 19 nt, Homo sapiens
ggauuucucauugacaaga

SEQ ID NO: 1167930 - RNA, 19 nt, Homo sapiens
caaaaggggcugagggauu

SEQ ID NO: 1167931 - RNA, 19 nt, Homo sapiens
cagagugcgcccaaucuug

SEQ ID NO: 1167932 - RNA, 19 nt, Homo sapiens
gcucagagugcgcccaauc

SEQ ID NO: 1167933 - RNA, 19 nt, Homo sapiens
gauugagccccguuuauaa

SEQ ID NO: 1167934 - RNA, 19 nt, Homo sapiens
ggguggaggcguuuagaau

SEQ ID NO: 1167935 - RNA, 19 nt, Homo sapiens
ugucuguaaucuguaauug

SEQ ID NO: 1167936 - RNA, 19 nt, Homo sapiens
uugcaaaugucuguaaucu

SEQ ID NO: 1167937 - RNA, 19 nt, Homo sapiens
ugagccccguuuauaauua

SEQ ID NO: 1167938 - RNA, 19 nt, Homo sapiens
cucuaacccugcauauuau

SEQ ID NO: 1167939 - RNA, 19 nt, Homo sapiens
cgaguccgaaggccuguuu

SEQ ID NO: 1167940 - RNA, 19 nt, Homo sapiens
uaauugugaugccucugau

SEQ ID NO: 1167941 - RNA, 19 nt, Homo sapiens
cuaucuuugucuaucagua

SEQ ID NO: 1167942 - RNA, 19 nt, Homo sapiens
cuaacccugcauauuauuu

SEQ ID NO: 1167943 - RNA, 19 nt, Homo sapiens
ccuagggauuugucaucuu

SEQ ID NO: 1167944 - RNA, 19 nt, Homo sapiens
agggauuucucauugacaa

SEQ ID NO: 1167945 - RNA, 19 nt, Homo sapiens
gcuuguuucuuuccgucuu

SEQ ID NO: 1167946 - RNA, 19 nt, Homo sapiens
gaaaacggggcucggcauu

SEQ ID NO: 1167947 - RNA, 19 nt, Homo sapiens
ugaaauaggggugcuguuu

SEQ ID NO: 1167948 - RNA, 19 nt, Homo sapiens
gucuaucaguacgaaagua

SEQ ID NO: 1167949 - RNA, 19 nt, Homo sapiens
gucacuaucuuugucuauc

SEQ ID NO: 1167950 - RNA, 19 nt, Homo sapiens
ggagcugugagacccaaga

SEQ ID NO: 1167951 - RNA, 19 nt, Homo sapiens
gcgggacucgacuuuguug

SEQ ID NO: 1167952 - RNA, 19 nt, Homo sapiens
uggaaucuuuaagggauga

SEQ ID NO: 1167953 - RNA, 19 nt, Homo sapiens
gagcugcccuucaguguga

SEQ ID NO: 1167954 - RNA, 19 nt, Homo sapiens
ccacugaccugcuccauuc

SEQ ID NO: 1167955 - RNA, 19 nt, Homo sapiens
guugagcucuccauuaugu

SEQ ID NO: 1167956 - RNA, 19 nt, Homo sapiens
ggcagugucuucccucuug

SEQ ID NO: 1167957 - RNA, 19 nt, Homo sapiens
caagcuaccuccaccagau

SEQ ID NO: 1167958 - RNA, 19 nt, Homo sapiens
uaucugcacucuaggaaga

SEQ ID NO: 1167959 - RNA, 19 nt, Homo sapiens
gcagauccaaggccuguuu

SEQ ID NO: 1167960 - RNA, 19 nt, Homo sapiens
gaaggaagagagacuuuag

SEQ ID NO: 1167961 - RNA, 19 nt, Homo sapiens
ucaagaggcugcgcaggaa

SEQ ID NO: 1167962 - RNA, 19 nt, Homo sapiens
ccacucaugcuacuaauca

SEQ ID NO: 1167963 - RNA, 19 nt, Homo sapiens
ccacaguccuucccagucu

SEQ ID NO: 1167964 - RNA, 19 nt, Homo sapiens
cuguugagcucuccauuau

SEQ ID NO: 1167965 - RNA, 19 nt, Homo sapiens
cagccucgguggucaguga

SEQ ID NO: 1167966 - RNA, 19 nt, Homo sapiens
ugucuucccucuugccaaa

SEQ ID NO: 1167967 - RNA, 19 nt, Homo sapiens
ccacagagugccacagaga

SEQ ID NO: 1167968 - RNA, 19 nt, Homo sapiens
ugaaggaagagagacuuua

SEQ ID NO: 1167969 - RNA, 19 nt, Homo sapiens
ucaccacucaugcuacuaa

SEQ ID NO: 1167970 - RNA, 19 nt, Homo sapiens
agacacugauccagggaaa

SEQ ID NO: 1167971 - RNA, 19 nt, Homo sapiens
gcacuggccaacccacaga

SEQ ID NO: 1167972 - RNA, 19 nt, Homo sapiens
gaggaacgggcacagauca

SEQ ID NO: 1167973 - RNA, 19 nt, Homo sapiens
ggaggugaaggaagagaga

SEQ ID NO: 1167974 - RNA, 19 nt, Homo sapiens
uuccugggcugcaugauau

SEQ ID NO: 1167975 - RNA, 19 nt, Homo sapiens
guaguuuaaguggcaaaua

SEQ ID NO: 1167976 - RNA, 19 nt, Homo sapiens
ggacccauuccucaccaaa

SEQ ID NO: 1167977 - RNA, 19 nt, Homo sapiens
ucuguugagcucuccauua

SEQ ID NO: 1167978 - RNA, 19 nt, Homo sapiens
cgccggaacuggaggaagu

SEQ ID NO: 1167979 - RNA, 19 nt, Homo sapiens
gauccaaggccuguuucaa

SEQ ID NO: 1167980 - RNA, 19 nt, Homo sapiens
gugaaggaagagagacuuu

SEQ ID NO: 1167981 - RNA, 19 nt, Homo sapiens
cagagacagccuccaguga

SEQ ID NO: 1167982 - RNA, 19 nt, Homo sapiens
aagacuggaugcuucuguu

SEQ ID NO: 1167983 - RNA, 19 nt, Homo sapiens
acacugauccagggaaaga

SEQ ID NO: 1167984 - RNA, 19 nt, Homo sapiens
ucaagcaaccagguacgua

SEQ ID NO: 1167985 - RNA, 19 nt, Homo sapiens
ugucggagcugcccuucag

SEQ ID NO: 1167986 - RNA, 19 nt, Homo sapiens
cgaccgccagauccacuua

SEQ ID NO: 1167987 - RNA, 19 nt, Homo sapiens
ugcugcagaugucgccuua

SEQ ID NO: 1167988 - RNA, 19 nt, Homo sapiens
ccaaagggguaaaugaaag

SEQ ID NO: 1167989 - RNA, 19 nt, Homo sapiens
ggaacgggcacagaucauc

SEQ ID NO: 1167990 - RNA, 19 nt, Homo sapiens
gaagcggccacgucugagu

SEQ ID NO: 1167991 - RNA, 19 nt, Homo sapiens
cagcauuucaccacucaug

SEQ ID NO: 1167992 - RNA, 19 nt, Homo sapiens
gacuggaugcuucuguuga

SEQ ID NO: 1167993 - RNA, 19 nt, Homo sapiens
ccucugccaugcucuugug

SEQ ID NO: 1167994 - RNA, 19 nt, Homo sapiens
aaucaucuaccugcuacua

SEQ ID NO: 1167995 - RNA, 19 nt, Homo sapiens
ucugaaggcuguggaagag

SEQ ID NO: 1167996 - RNA, 19 nt, Homo sapiens
ugacaggcacuuagaugca

SEQ ID NO: 1167997 - RNA, 19 nt, Homo sapiens
ggagugggcgcaucuuagc

SEQ ID NO: 1167998 - RNA, 19 nt, Homo sapiens
ucaugcuacuaaucaucua

SEQ ID NO: 1167999 - RNA, 19 nt, Homo sapiens
cugcagaugucgccuuagg

SEQ ID NO: 1168000 - RNA, 19 nt, Homo sapiens
cacaguccuucccagucua

SEQ ID NO: 1168001 - RNA, 19 nt, Homo sapiens
ggauagcacagggaaacug

SEQ ID NO: 1168002 - RNA, 19 nt, Homo sapiens
caagacuggaugcuucugu

SEQ ID NO: 1168003 - RNA, 19 nt, Homo sapiens
ccugcuccauucagaacaa

SEQ ID NO: 1168004 - RNA, 19 nt, Homo sapiens
gagagacuuuaggcaagca

SEQ ID NO: 1168005 - RNA, 19 nt, Homo sapiens
cgacuggcccuuguaagca

SEQ ID NO: 1168006 - RNA, 19 nt, Homo sapiens
ggaagaugcugaaaucaaa

SEQ ID NO: 1168007 - RNA, 19 nt, Homo sapiens
uaaauggccucucaugcua

SEQ ID NO: 1168008 - RNA, 19 nt, Homo sapiens
gcauucaacucaaggagaa

SEQ ID NO: 1168009 - RNA, 19 nt, Homo sapiens
gcaagaggcagaagaguug

SEQ ID NO: 1168010 - RNA, 19 nt, Homo sapiens
gcgagaaucuggagagaag

SEQ ID NO: 1168011 - RNA, 19 nt, Homo sapiens
ggccugaccucuccaugaa

SEQ ID NO: 1168012 - RNA, 19 nt, Homo sapiens
ucgaagagcugaggagaga

SEQ ID NO: 1168013 - RNA, 19 nt, Homo sapiens
ucagcaaccugccacuuga

SEQ ID NO: 1168014 - RNA, 19 nt, Homo sapiens
gucagaggcuacacaagaa

SEQ ID NO: 1168015 - RNA, 19 nt, Homo sapiens
aacaauaaauggccucuca

SEQ ID NO: 1168016 - RNA, 19 nt, Homo sapiens
aaaccaacgucuugaagca

SEQ ID NO: 1168017 - RNA, 19 nt, Homo sapiens
gagcgagaaucuggagaga

SEQ ID NO: 1168018 - RNA, 19 nt, Homo sapiens
uguggaagaugcugaaauc

SEQ ID NO: 1168019 - RNA, 19 nt, Homo sapiens
guacugcauucaacucaag

SEQ ID NO: 1168020 - RNA, 19 nt, Homo sapiens
caauaaauggccucucaug

SEQ ID NO: 1168021 - RNA, 19 nt, Homo sapiens
ugucagaggcuacacaaga

SEQ ID NO: 1168022 - RNA, 19 nt, Homo sapiens
acgcagacaucacggaaau

SEQ ID NO: 1168023 - RNA, 19 nt, Homo sapiens
ggcaagaggcagaagaguu

SEQ ID NO: 1168024 - RNA, 19 nt, Homo sapiens
gcgccaggccuuagccaaa

SEQ ID NO: 1168025 - RNA, 19 nt, Homo sapiens
ccaaggggaucccgaagaa

SEQ ID NO: 1168026 - RNA, 19 nt, Homo sapiens
gaccaucuacacuugaaga

SEQ ID NO: 1168027 - RNA, 19 nt, Homo sapiens
gggccugaccucuccauga

SEQ ID NO: 1168028 - RNA, 19 nt, Homo sapiens
gaccucagcggccaacuca

SEQ ID NO: 1168029 - RNA, 19 nt, Homo sapiens
ggaggcagcagugcaggaa

SEQ ID NO: 1168030 - RNA, 19 nt, Homo sapiens
gguacugcauucaacucaa

SEQ ID NO: 1168031 - RNA, 19 nt, Homo sapiens
gcuguucaccggcaucgaa

SEQ ID NO: 1168032 - RNA, 19 nt, Homo sapiens
cggaugagcugugcaccau

SEQ ID NO: 1168033 - RNA, 19 nt, Homo sapiens
ucuggaccaucuacacuug

SEQ ID NO: 1168034 - RNA, 19 nt, Homo sapiens
gaugugcucccuccacgau

SEQ ID NO: 1168035 - RNA, 19 nt, Homo sapiens
aggagaagauggccacucu

SEQ ID NO: 1168036 - RNA, 19 nt, Homo sapiens
gcuggccucuccuggaaca

SEQ ID NO: 1168037 - RNA, 19 nt, Homo sapiens
uggaagaugcugaaaucaa

SEQ ID NO: 1168038 - RNA, 19 nt, Homo sapiens
agaugaagccagaggagaa

SEQ ID NO: 1168039 - RNA, 19 nt, Homo sapiens
ucaaggagaacugcuggaa

SEQ ID NO: 1168040 - RNA, 19 nt, Homo sapiens
gaagccagaggagaagaug

SEQ ID NO: 1168041 - RNA, 19 nt, Homo sapiens
ccaacgucuugaagcagaa

SEQ ID NO: 1168042 - RNA, 19 nt, Homo sapiens
uggaccaucuacacuugaa

SEQ ID NO: 1168043 - RNA, 19 nt, Homo sapiens
guggagcggucagcagugu

SEQ ID NO: 1168044 - RNA, 19 nt, Homo sapiens
cgaucuggcaguccaaaga

SEQ ID NO: 1168045 - RNA, 19 nt, Homo sapiens
ugcaggagccggaggagaa

SEQ ID NO: 1168046 - RNA, 19 nt, Homo sapiens
agaaccuacugcugacaga

SEQ ID NO: 1168047 - RNA, 19 nt, Homo sapiens
cagggucgacggcuuccua

SEQ ID NO: 1168048 - RNA, 19 nt, Homo sapiens
gcgagcaggaauugcagaa

SEQ ID NO: 1168049 - RNA, 19 nt, Homo sapiens
aaaagaaggccgugucguu

SEQ ID NO: 1168050 - RNA, 19 nt, Homo sapiens
gaucuggcaguccaaagag

SEQ ID NO: 1168051 - RNA, 19 nt, Homo sapiens
ggagagaaggcggcaagag

SEQ ID NO: 1168052 - RNA, 19 nt, Homo sapiens
ggaauugcagaagcuguuc

SEQ ID NO: 1168053 - RNA, 19 nt, Homo sapiens
gagaggagcuagccuugaa

SEQ ID NO: 1168054 - RNA, 19 nt, Homo sapiens
ggaaacagacgccauccua

SEQ ID NO: 1168055 - RNA, 19 nt, Homo sapiens
gcugagcucugguggauga

SEQ ID NO: 1168056 - RNA, 19 nt, Homo sapiens
cguaugaauucuucuguaa

SEQ ID NO: 1168057 - RNA, 19 nt, Homo sapiens
gcaggaaguugcuguuucu

SEQ ID NO: 1168058 - RNA, 19 nt, Homo sapiens
gcaagacccugacauaucc

SEQ ID NO: 1168059 - RNA, 19 nt, Homo sapiens
ugaagcaccuguacaagug

SEQ ID NO: 1168060 - RNA, 19 nt, Homo sapiens
caagauccguuuccagcuu

SEQ ID NO: 1168061 - RNA, 19 nt, Homo sapiens
ggaauucucagugcacuuu

SEQ ID NO: 1168062 - RNA, 19 nt, Homo sapiens
gcaggaauaacaccaaguu

SEQ ID NO: 1168063 - RNA, 19 nt, Homo sapiens
caaaccagauggcaggaau

SEQ ID NO: 1168064 - RNA, 19 nt, Homo sapiens
guccaauucuugucauuug

SEQ ID NO: 1168065 - RNA, 19 nt, Homo sapiens
gagcccaaggucuauaaua

SEQ ID NO: 1168066 - RNA, 19 nt, Homo sapiens
ggagucaggucccuacacu

SEQ ID NO: 1168067 - RNA, 19 nt, Homo sapiens
gaauucuucuguaaugucu

SEQ ID NO: 1168068 - RNA, 19 nt, Homo sapiens
ccacaggcuucauguucuu

SEQ ID NO: 1168069 - RNA, 19 nt, Homo sapiens
gcuacagguuggaggguuu

SEQ ID NO: 1168070 - RNA, 19 nt, Homo sapiens
guacgacgcccuggaauuc

SEQ ID NO: 1168071 - RNA, 19 nt, Homo sapiens
ccagauggcaggaauaaca

SEQ ID NO: 1168072 - RNA, 19 nt, Homo sapiens
gaaggaaggaagauucagu

SEQ ID NO: 1168073 - RNA, 19 nt, Homo sapiens
caguggagcuggugucauc

SEQ ID NO: 1168074 - RNA, 19 nt, Homo sapiens
guuuccagcuucagcauga

SEQ ID NO: 1168075 - RNA, 19 nt, Homo sapiens
gagagaaucagagggaaug

SEQ ID NO: 1168076 - RNA, 19 nt, Homo sapiens
gcucagauucucuccauag

SEQ ID NO: 1168077 - RNA, 19 nt, Homo sapiens
cauauccgcuggaccucuu

SEQ ID NO: 1168078 - RNA, 19 nt, Homo sapiens
guucuucucguaugaauuc

SEQ ID NO: 1168079 - RNA, 19 nt, Homo sapiens
cagcucagauucucuccau

SEQ ID NO: 1168080 - RNA, 19 nt, Homo sapiens
aaaaguacaucuccuggaa

SEQ ID NO: 1168081 - RNA, 19 nt, Homo sapiens
gaccagcccacacugcaaa

SEQ ID NO: 1168082 - RNA, 19 nt, Homo sapiens
gaaugcaggacguggucua

SEQ ID NO: 1168083 - RNA, 19 nt, Homo sapiens
ggccauaccagccgaagga

SEQ ID NO: 1168084 - RNA, 19 nt, Homo sapiens
gacauuaaagcuaaacaca

SEQ ID NO: 1168085 - RNA, 19 nt, Homo sapiens
ggauggggcugcugcuuga

SEQ ID NO: 1168086 - RNA, 19 nt, Homo sapiens
aaacagacgccauccuaca

SEQ ID NO: 1168087 - RNA, 19 nt, Homo sapiens
cagcaagacccugacauau

SEQ ID NO: 1168088 - RNA, 19 nt, Homo sapiens
ccacagaggcagcguguac

SEQ ID NO: 1168089 - RNA, 19 nt, Homo sapiens
ucguaugaauucuucugua

SEQ ID NO: 1168090 - RNA, 19 nt, Homo sapiens
gauacaagggccucaugga

SEQ ID NO: 1168091 - RNA, 19 nt, Homo sapiens
caagaagcggcuacagguu

SEQ ID NO: 1168092 - RNA, 19 nt, Homo sapiens
ucagugcacuuuguaugug

SEQ ID NO: 1168093 - RNA, 19 nt, Homo sapiens
ccaccuugaucgccaucuu

SEQ ID NO: 1168094 - RNA, 19 nt, Homo sapiens
cagggaugguuggcuauga

SEQ ID NO: 1168095 - RNA, 19 nt, Homo sapiens
gagauacaagggccucaug

SEQ ID NO: 1168096 - RNA, 19 nt, Homo sapiens
gagaaggagcaggaaguug

SEQ ID NO: 1168097 - RNA, 19 nt, Homo sapiens
agucaggucccuacacuug

SEQ ID NO: 1168098 - RNA, 19 nt, Homo sapiens
ccaauucuugucauuugaa

SEQ ID NO: 1168099 - RNA, 19 nt, Homo sapiens
acacgucccagcucagauu

SEQ ID NO: 1168100 - RNA, 19 nt, Homo sapiens
ugauacugauggacauugu

SEQ ID NO: 1168101 - RNA, 19 nt, Homo sapiens
aaaaugagaaccuccaaaa

SEQ ID NO: 1168102 - RNA, 19 nt, Homo sapiens
acacacuccuggucuggau

SEQ ID NO: 1168103 - RNA, 19 nt, Homo sapiens
gcuucauguucuucucgua

SEQ ID NO: 1168104 - RNA, 19 nt, Homo sapiens
gcgcgaggagcuagagaga

SEQ ID NO: 1168105 - RNA, 19 nt, Homo sapiens
ggcugcaguucucuugcua

SEQ ID NO: 1168106 - RNA, 19 nt, Homo sapiens
gaggaggguccgacagcuu

SEQ ID NO: 1168107 - RNA, 19 nt, Homo sapiens
guaaugucuuccacugcau

SEQ ID NO: 1168108 - RNA, 19 nt, Homo sapiens
guucugcgcacccgcuuug

SEQ ID NO: 1168109 - RNA, 19 nt, Homo sapiens
uggccuggcugccuguaug

SEQ ID NO: 1168110 - RNA, 19 nt, Homo sapiens
ggagcuguccaauucuugu

SEQ ID NO: 1168111 - RNA, 19 nt, Homo sapiens
aaaccagauggcaggaaua

SEQ ID NO: 1168112 - RNA, 19 nt, Homo sapiens
cauaccagccgaaggaaag

SEQ ID NO: 1168113 - RNA, 19 nt, Homo sapiens
gugagcccaaggucuauaa

SEQ ID NO: 1168114 - RNA, 19 nt, Homo sapiens
uccaauucuugucauuuga

SEQ ID NO: 1168115 - RNA, 19 nt, Homo sapiens
gucugugucuggacuuguu

SEQ ID NO: 1168116 - RNA, 19 nt, Homo sapiens
guugcuguuucuccucuga

SEQ ID NO: 1168117 - RNA, 19 nt, Homo sapiens
ugagaaggagcaggaaguu

SEQ ID NO: 1168118 - RNA, 19 nt, Homo sapiens
cuucucguaugaauucuuc

SEQ ID NO: 1168119 - RNA, 19 nt, Homo sapiens
guacaagugggccauacca

SEQ ID NO: 1168120 - RNA, 19 nt, Homo sapiens
aaccagauggcaggaauaa

SEQ ID NO: 1168121 - RNA, 19 nt, Homo sapiens
agcccaaggucuauaauac

SEQ ID NO: 1168122 - RNA, 19 nt, Homo sapiens
ugcaggacguggucuaugg

SEQ ID NO: 1168123 - RNA, 19 nt, Homo sapiens
ccuugaagcaccuguacaa

SEQ ID NO: 1168124 - RNA, 19 nt, Homo sapiens
gggcugcaguucucuugcu

SEQ ID NO: 1168125 - RNA, 19 nt, Homo sapiens
caggagaacagaacacacu

SEQ ID NO: 1168126 - RNA, 19 nt, Homo sapiens
gugagaaggagcaggaagu

SEQ ID NO: 1168127 - RNA, 19 nt, Homo sapiens
gacaggagcuauccaagga

SEQ ID NO: 1168128 - RNA, 19 nt, Homo sapiens
gagguuugcugcaguuuga

SEQ ID NO: 1168129 - RNA, 19 nt, Homo sapiens
caaugugccuuccaguuga

SEQ ID NO: 1168130 - RNA, 19 nt, Homo sapiens
gcaagcaguucuucaacag

SEQ ID NO: 1168131 - RNA, 19 nt, Homo sapiens
caccacagaugucagaguu

SEQ ID NO: 1168132 - RNA, 19 nt, Homo sapiens
gagacaggcuggagcucaa

SEQ ID NO: 1168133 - RNA, 19 nt, Homo sapiens
caaugugcccuuugaaguu

SEQ ID NO: 1168134 - RNA, 19 nt, Homo sapiens
gacugcagcucgacuagug

SEQ ID NO: 1168135 - RNA, 19 nt, Homo sapiens
gcacagcuaccucuaaugc

SEQ ID NO: 1168136 - RNA, 19 nt, Homo sapiens
ucaaugugccuuccaguug

SEQ ID NO: 1168137 - RNA, 19 nt, Homo sapiens
uuucagacccagccacuua

SEQ ID NO: 1168138 - RNA, 19 nt, Homo sapiens
ggagcucaaugugcccuuu

SEQ ID NO: 1168139 - RNA, 19 nt, Homo sapiens
gcaguuugaggcugauaaa

SEQ ID NO: 1168140 - RNA, 19 nt, Homo sapiens
caaggauugugguuaugga

SEQ ID NO: 1168141 - RNA, 19 nt, Homo sapiens
aaggucaacugcacagcua

SEQ ID NO: 1168142 - RNA, 19 nt, Homo sapiens
caccugugcugucaucaau

SEQ ID NO: 1168143 - RNA, 19 nt, Homo sapiens
ugagugagaacaucuuuca

SEQ ID NO: 1168144 - RNA, 19 nt, Homo sapiens
ccaagugagugagaacauc

SEQ ID NO: 1168145 - RNA, 19 nt, Homo sapiens
caucaaucguguucagaag

SEQ ID NO: 1168146 - RNA, 19 nt, Homo sapiens
caaaggaggaaucucucuu

SEQ ID NO: 1168147 - RNA, 19 nt, Homo sapiens
cugcacagcuaccucuaau

SEQ ID NO: 1168148 - RNA, 19 nt, Homo sapiens
caucaccugugcugucauc

SEQ ID NO: 1168149 - RNA, 19 nt, Homo sapiens
cagcaaaggaggaaucucu

SEQ ID NO: 1168150 - RNA, 19 nt, Homo sapiens
ucaaucguguucagaaggu

SEQ ID NO: 1168151 - RNA, 19 nt, Homo sapiens
ggaaacacagucgaaagca

SEQ ID NO: 1168152 - RNA, 19 nt, Homo sapiens
gcaaaggaggaaucucucu

SEQ ID NO: 1168153 - RNA, 19 nt, Homo sapiens
guggagguuugcugcaguu

SEQ ID NO: 1168154 - RNA, 19 nt, Homo sapiens
caggaggccacacuuguug

SEQ ID NO: 1168155 - RNA, 19 nt, Homo sapiens
ggagguuugcugcaguuug

SEQ ID NO: 1168156 - RNA, 19 nt, Homo sapiens
ucaggaggccacacuuguu

SEQ ID NO: 1168157 - RNA, 19 nt, Homo sapiens
gggacuguuugcccagguu

SEQ ID NO: 1168158 - RNA, 19 nt, Homo sapiens
aaaggaggaaucucucuuc

SEQ ID NO: 1168159 - RNA, 19 nt, Homo sapiens
aaacagcaaaggaggaauc

SEQ ID NO: 1168160 - RNA, 19 nt, Homo sapiens
ugaaguucccagcccuuaa

SEQ ID NO: 1168161 - RNA, 19 nt, Homo sapiens
aaugugcccuuugaaguuc

SEQ ID NO: 1168162 - RNA, 19 nt, Homo sapiens
agugagaacaucuuucaga

SEQ ID NO: 1168163 - RNA, 19 nt, Homo sapiens
gggaaacacagucgaaagc

SEQ ID NO: 1168164 - RNA, 19 nt, Homo sapiens
ugcaagcaguucuucaaca

SEQ ID NO: 1168165 - RNA, 19 nt, Homo sapiens
uuccagcucugccuccuau

SEQ ID NO: 1168166 - RNA, 19 nt, Homo sapiens
cccagccacuuaacccuau

SEQ ID NO: 1168167 - RNA, 19 nt, Homo sapiens
gagcucaaugugcccuuug

SEQ ID NO: 1168168 - RNA, 19 nt, Homo sapiens
caagcaguucuucaacaga

SEQ ID NO: 1168169 - RNA, 19 nt, Homo sapiens
ucaucaaucguguucagaa

SEQ ID NO: 1168170 - RNA, 19 nt, Homo sapiens
cccagguucuaccgaaaga

SEQ ID NO: 1168171 - RNA, 19 nt, Homo sapiens
caagugagugagaacaucu

SEQ ID NO: 1168172 - RNA, 19 nt, Homo sapiens
ccgaaagacacgcauugga

SEQ ID NO: 1168173 - RNA, 19 nt, Homo sapiens
gaaccugggugauaaauua

SEQ ID NO: 1168174 - RNA, 19 nt, Homo sapiens
caaggaagauuuagaauug

SEQ ID NO: 1168175 - RNA, 19 nt, Homo sapiens
gaauauggcucaacccaaa

SEQ ID NO: 1168176 - RNA, 19 nt, Homo sapiens
gaagauaacuaccguuuag

SEQ ID NO: 1168177 - RNA, 19 nt, Homo sapiens
ggaggaaggugguaucaaa

SEQ ID NO: 1168178 - RNA, 19 nt, Homo sapiens
ggaagaagauuucauaagg

SEQ ID NO: 1168179 - RNA, 19 nt, Homo sapiens
ggacaucaaggaagauuua

SEQ ID NO: 1168180 - RNA, 19 nt, Homo sapiens
gagaggagguguaaggauu

SEQ ID NO: 1168181 - RNA, 19 nt, Homo sapiens
gcuggaagcucaaguguga

SEQ ID NO: 1168182 - RNA, 19 nt, Homo sapiens
cuaccaaacuggaugaaua

SEQ ID NO: 1168183 - RNA, 19 nt, Homo sapiens
gaaaggcaauucaaacauc

SEQ ID NO: 1168184 - RNA, 19 nt, Homo sapiens
gaacauugcaucucacuug

SEQ ID NO: 1168185 - RNA, 19 nt, Homo sapiens
ggaggaagaagauuucaua

SEQ ID NO: 1168186 - RNA, 19 nt, Homo sapiens
ucaaauaaauggcuucuca

SEQ ID NO: 1168187 - RNA, 19 nt, Homo sapiens
ggaaggugguaucaaauug

SEQ ID NO: 1168188 - RNA, 19 nt, Homo sapiens
ucacagagcgcaucacuaa

SEQ ID NO: 1168189 - RNA, 19 nt, Homo sapiens
gcuauuaacugaguacuug

SEQ ID NO: 1168190 - RNA, 19 nt, Homo sapiens
gaugacaacuuaauugaag

SEQ ID NO: 1168191 - RNA, 19 nt, Homo sapiens
ccaaaucguuccaggauau

SEQ ID NO: 1168192 - RNA, 19 nt, Homo sapiens
gagcaggaguugaagcaaa

SEQ ID NO: 1168193 - RNA, 19 nt, Homo sapiens
ugaagaagccuacgagaaa

SEQ ID NO: 1168194 - RNA, 19 nt, Homo sapiens
acaaguggauggauuacua

SEQ ID NO: 1168195 - RNA, 19 nt, Homo sapiens
ccaaacagcugaggccaaa

SEQ ID NO: 1168196 - RNA, 19 nt, Homo sapiens
gcaggaagauaucaaacug

SEQ ID NO: 1168197 - RNA, 19 nt, Homo sapiens
guacagcacuacacagaau

SEQ ID NO: 1168198 - RNA, 19 nt, Homo sapiens
cagcacaaguuccaguaua

SEQ ID NO: 1168199 - RNA, 19 nt, Homo sapiens
gaauugagcauaagcaugu

SEQ ID NO: 1168200 - RNA, 19 nt, Homo sapiens
gaagaucccagaaacaguu

SEQ ID NO: 1168201 - RNA, 19 nt, Homo sapiens
gacuagagcuucacagcaa

SEQ ID NO: 1168202 - RNA, 19 nt, Homo sapiens
gaagaagccuacgagaaau

SEQ ID NO: 1168203 - RNA, 19 nt, Homo sapiens
guaggguucuauuacauaa

SEQ ID NO: 1168204 - RNA, 19 nt, Homo sapiens
ucagugaacuugccaaauc

SEQ ID NO: 1168205 - RNA, 19 nt, Homo sapiens
gaagauaucaaacuguaug

SEQ ID NO: 1168206 - RNA, 19 nt, Homo sapiens
gaacuuguuggaugaaauu

SEQ ID NO: 1168207 - RNA, 19 nt, Homo sapiens
cgacagccauucgcacaua

SEQ ID NO: 1168208 - RNA, 19 nt, Homo sapiens
gaacaacuacuuuaaugca

SEQ ID NO: 1168209 - RNA, 19 nt, Homo sapiens
uggaaaguauggauuauga

SEQ ID NO: 1168210 - RNA, 19 nt, Homo sapiens
caaggagucugaaguucuu

SEQ ID NO: 1168211 - RNA, 19 nt, Homo sapiens
caacaaacuucccuaacca

SEQ ID NO: 1168212 - RNA, 19 nt, Homo sapiens
agaagcagcuggugggaaa

SEQ ID NO: 1168213 - RNA, 19 nt, Homo sapiens
gaacugaccacccagaaca

SEQ ID NO: 1168214 - RNA, 19 nt, Homo sapiens
gaagauccaagauguucua

SEQ ID NO: 1168215 - RNA, 19 nt, Homo sapiens
ugaccuggaugaauugauu

SEQ ID NO: 1168216 - RNA, 19 nt, Homo sapiens
cagcugagccugucucuga

SEQ ID NO: 1168217 - RNA, 19 nt, Homo sapiens
ucaaauuguuggacucuga

SEQ ID NO: 1168218 - RNA, 19 nt, Homo sapiens
acacggagcuggaguacau

SEQ ID NO: 1168219 - RNA, 19 nt, Homo sapiens
gagaggaggaagaagauuu

SEQ ID NO: 1168220 - RNA, 19 nt, Homo sapiens
cagaaacauuaccgucaua

SEQ ID NO: 1168221 - RNA, 19 nt, Homo sapiens
gcagauguaugggugaaga

SEQ ID NO: 1168222 - RNA, 19 nt, Homo sapiens
accaagagccagacaauua

SEQ ID NO: 1168223 - RNA, 19 nt, Homo sapiens
uaauuuagggcuaggaaua

SEQ ID NO: 1168224 - RNA, 19 nt, Homo sapiens
ucucuacagugauacuuua

SEQ ID NO: 1168225 - RNA, 19 nt, Homo sapiens
ugaaaucucuaccaaacug

SEQ ID NO: 1168226 - RNA, 19 nt, Homo sapiens
gauaucagcagacucuuga

SEQ ID NO: 1168227 - RNA, 19 nt, Homo sapiens
gaaagaugcuucuguuccu

SEQ ID NO: 1168228 - RNA, 19 nt, Homo sapiens
aagagaaccugcuuucaug

SEQ ID NO: 1168229 - RNA, 19 nt, Homo sapiens
gauccaagauguucuacag

SEQ ID NO: 1168230 - RNA, 19 nt, Homo sapiens
aggaagauaucaaacugua

SEQ ID NO: 1168231 - RNA, 19 nt, Homo sapiens
agaauuggauccagaggaa

SEQ ID NO: 1168232 - RNA, 19 nt, Homo sapiens
cgucauauuccacccauua

SEQ ID NO: 1168233 - RNA, 19 nt, Homo sapiens
caaaucgacuagccgaguu

SEQ ID NO: 1168234 - RNA, 19 nt, Homo sapiens
ugucagcaguugagucuuu

SEQ ID NO: 1168235 - RNA, 19 nt, Homo sapiens
guacaacuuuggucuugau

SEQ ID NO: 1168236 - RNA, 19 nt, Homo sapiens
agacaacuauggaggaaug

SEQ ID NO: 1168237 - RNA, 19 nt, Homo sapiens
gaaauaaguguaugugcau

SEQ ID NO: 1168238 - RNA, 19 nt, Homo sapiens
aaacauuaccgucauauuc

SEQ ID NO: 1168239 - RNA, 19 nt, Homo sapiens
ugaagaagaucccagaaac

SEQ ID NO: 1168240 - RNA, 19 nt, Homo sapiens
gaauaaugguuagagaaca

SEQ ID NO: 1168241 - RNA, 19 nt, Homo sapiens
gagaauaaugguuagagaa

SEQ ID NO: 1168242 - RNA, 19 nt, Homo sapiens
ccagacaauuagacaacua

SEQ ID NO: 1168243 - RNA, 19 nt, Homo sapiens
guuguagguugguuuauug

SEQ ID NO: 1168244 - RNA, 19 nt, Homo sapiens
ugacuugagugcauauuca

SEQ ID NO: 1168245 - RNA, 19 nt, Homo sapiens
cuugauaccucucacuauu

SEQ ID NO: 1168246 - RNA, 19 nt, Homo sapiens
cgugaaagaugcuucuguu

SEQ ID NO: 1168247 - RNA, 19 nt, Homo sapiens
gggaugagcuucggaaacu

SEQ ID NO: 1168248 - RNA, 19 nt, Homo sapiens
gggaggagaugggacuuug

SEQ ID NO: 1168249 - RNA, 19 nt, Homo sapiens
cauugcaucucacuugaaa

SEQ ID NO: 1168250 - RNA, 19 nt, Homo sapiens
uaaaacaucugacccuuug

SEQ ID NO: 1168251 - RNA, 19 nt, Homo sapiens
gaaacauuaccgucauauu

SEQ ID NO: 1168252 - RNA, 19 nt, Homo sapiens
gaagaagaucccagaaaca

SEQ ID NO: 1168253 - RNA, 19 nt, Homo sapiens
gguuguagguugguuuauu

SEQ ID NO: 1168254 - RNA, 19 nt, Homo sapiens
gaauagaagucuuuugauc

SEQ ID NO: 1168255 - RNA, 19 nt, Homo sapiens
ggagguguaaggauucuuu

SEQ ID NO: 1168256 - RNA, 19 nt, Homo sapiens
uggcugagaucaacaagga

SEQ ID NO: 1168257 - RNA, 19 nt, Homo sapiens
uaacugaguacuuggauau

SEQ ID NO: 1168258 - RNA, 19 nt, Homo sapiens
gggugaagauccaagaugu

SEQ ID NO: 1168259 - RNA, 19 nt, Homo sapiens
ugacaaguuuaaugcugua

SEQ ID NO: 1168260 - RNA, 19 nt, Homo sapiens
uggcgaaacugaagaagau

SEQ ID NO: 1168261 - RNA, 19 nt, Homo sapiens
caucaaggaagauuuagaa

SEQ ID NO: 1168262 - RNA, 19 nt, Homo sapiens
ucacuugguucucauagau

SEQ ID NO: 1168263 - RNA, 19 nt, Homo sapiens
uugaaggaauugagcauaa

SEQ ID NO: 1168264 - RNA, 19 nt, Homo sapiens
gcaucucacuugaaacauc

SEQ ID NO: 1168265 - RNA, 19 nt, Homo sapiens
gguuuuggcuuuucauaua

SEQ ID NO: 1168266 - RNA, 19 nt, Homo sapiens
cagcagaauuugaccaaca

SEQ ID NO: 1168267 - RNA, 19 nt, Homo sapiens
uggcuaauguggaaaguau

SEQ ID NO: 1168268 - RNA, 19 nt, Homo sapiens
gccaaaucguuccaggaua

SEQ ID NO: 1168269 - RNA, 19 nt, Homo sapiens
cagaaacaguuaaggcaau

SEQ ID NO: 1168270 - RNA, 19 nt, Homo sapiens
ucugagagaauaaugguua

SEQ ID NO: 1168271 - RNA, 19 nt, Homo sapiens
cuacuuuaaugcagucaaa

SEQ ID NO: 1168272 - RNA, 19 nt, Homo sapiens
cuugguauguuauugagua

SEQ ID NO: 1168273 - RNA, 19 nt, Homo sapiens
caaagacccuaaucaguuu

SEQ ID NO: 1168274 - RNA, 19 nt, Homo sapiens
gcaaagacccuaaucaguu

SEQ ID NO: 1168275 - RNA, 19 nt, Homo sapiens
caggaaagcugccaaauuc

SEQ ID NO: 1168276 - RNA, 19 nt, Homo sapiens
gaaguaaacuagacugaag

SEQ ID NO: 1168277 - RNA, 19 nt, Homo sapiens
gaaagacaguaacaugugu

SEQ ID NO: 1168278 - RNA, 19 nt, Homo sapiens
gagaaaagguuccuggaua

SEQ ID NO: 1168279 - RNA, 19 nt, Homo sapiens
ccgaguagcugggauuaua

SEQ ID NO: 1168280 - RNA, 19 nt, Homo sapiens
ccuaaucaguuuaccauuu

SEQ ID NO: 1168281 - RNA, 19 nt, Homo sapiens
gcacaguugucccauugaa

SEQ ID NO: 1168282 - RNA, 19 nt, Homo sapiens
ggacgacagccuuuaguuu

SEQ ID NO: 1168283 - RNA, 19 nt, Homo sapiens
ggacccaucacucccauua

SEQ ID NO: 1168284 - RNA, 19 nt, Homo sapiens
ggagaaagacaguaacaug

SEQ ID NO: 1168285 - RNA, 19 nt, Homo sapiens
aaacacuaauccuagguua

SEQ ID NO: 1168286 - RNA, 19 nt, Homo sapiens
ccaguugaauguuuagauu

SEQ ID NO: 1168287 - RNA, 19 nt, Homo sapiens
gagccaugcugcugaauuc

SEQ ID NO: 1168288 - RNA, 19 nt, Homo sapiens
cgacuccaguugaauguuu

SEQ ID NO: 1168289 - RNA, 19 nt, Homo sapiens
gaagcacaguugucccauu

SEQ ID NO: 1168290 - RNA, 19 nt, Homo sapiens
agauaaaccuggaggagaa

SEQ ID NO: 1168291 - RNA, 19 nt, Homo sapiens
uaacugaugcugccauuug

SEQ ID NO: 1168292 - RNA, 19 nt, Homo sapiens
acagagggcugcugagaug

SEQ ID NO: 1168293 - RNA, 19 nt, Homo sapiens
guagggaacucuggaagug

SEQ ID NO: 1168294 - RNA, 19 nt, Homo sapiens
cuaagucucugcaguagug

SEQ ID NO: 1168295 - RNA, 19 nt, Homo sapiens
ggguuugguuguaagauaa

SEQ ID NO: 1168296 - RNA, 19 nt, Homo sapiens
gagaaagacaguaacaugu

SEQ ID NO: 1168297 - RNA, 19 nt, Homo sapiens
gaucucagcucacuguacu

SEQ ID NO: 1168298 - RNA, 19 nt, Homo sapiens
cggaggaacugccuucaga

SEQ ID NO: 1168299 - RNA, 19 nt, Homo sapiens
aaagguuccuggauacuga

SEQ ID NO: 1168300 - RNA, 19 nt, Homo sapiens
gcacacucccaucccuuua

SEQ ID NO: 1168301 - RNA, 19 nt, Homo sapiens
cuaaucaguuuaccauuuc

SEQ ID NO: 1168302 - RNA, 19 nt, Homo sapiens
cuaagaaacacuaauccua

SEQ ID NO: 1168303 - RNA, 19 nt, Homo sapiens
agacugaagcgauggauuu

SEQ ID NO: 1168304 - RNA, 19 nt, Homo sapiens
gcagagaaagauaagauca

SEQ ID NO: 1168305 - RNA, 19 nt, Homo sapiens
ggacauuccaaguucauau

SEQ ID NO: 1168306 - RNA, 19 nt, Homo sapiens
ugucagugcugcaaauaug

SEQ ID NO: 1168307 - RNA, 19 nt, Homo sapiens
aagcacaguugucccauug

SEQ ID NO: 1168308 - RNA, 19 nt, Homo sapiens
guuccuggauacugacuaa

SEQ ID NO: 1168309 - RNA, 19 nt, Homo sapiens
ggaaguaaacuagacugaa

SEQ ID NO: 1168310 - RNA, 19 nt, Homo sapiens
ccaaaugguuguuuuauca

SEQ ID NO: 1168311 - RNA, 19 nt, Homo sapiens
cagcuaagucucugcagua

SEQ ID NO: 1168312 - RNA, 19 nt, Homo sapiens
gaucaggacgacagccuuu

SEQ ID NO: 1168313 - RNA, 19 nt, Homo sapiens
gaaacacuaauccuagguu

SEQ ID NO: 1168314 - RNA, 19 nt, Homo sapiens
uagcugggauugucuuugu

SEQ ID NO: 1168315 - RNA, 19 nt, Homo sapiens
ucaggaaagcugccaaauu

SEQ ID NO: 1168316 - RNA, 19 nt, Homo sapiens
gacuccaguugaauguuua

SEQ ID NO: 1168317 - RNA, 19 nt, Homo sapiens
acacuaauccuagguuauu

SEQ ID NO: 1168318 - RNA, 19 nt, Homo sapiens
gcaccuagcagagaaagau

SEQ ID NO: 1168319 - RNA, 19 nt, Homo sapiens
gaacucuggaaguguauug

SEQ ID NO: 1168320 - RNA, 19 nt, Homo sapiens
gcaguagugugaaauucca

SEQ ID NO: 1168321 - RNA, 19 nt, Homo sapiens
caagccagguguggacauu

SEQ ID NO: 1168322 - RNA, 19 nt, Homo sapiens
uggguuugguuguaagaua

SEQ ID NO: 1168323 - RNA, 19 nt, Homo sapiens
auauguaacugguucauca

SEQ ID NO: 1168324 - RNA, 19 nt, Homo sapiens
guaacugguucaucaaugc

SEQ ID NO: 1168325 - RNA, 19 nt, Homo sapiens
gggacuggcuguacuugca

SEQ ID NO: 1168326 - RNA, 19 nt, Homo sapiens
gcacagaaggguagaaagc

SEQ ID NO: 1168327 - RNA, 19 nt, Homo sapiens
uggcaccacugcacuguga

SEQ ID NO: 1168328 - RNA, 19 nt, Homo sapiens
gcaggaaacuuuggggaaa

SEQ ID NO: 1168329 - RNA, 19 nt, Homo sapiens
caggagaagcugagccuuu

SEQ ID NO: 1168330 - RNA, 19 nt, Homo sapiens
gaaagcugccaaauucagu

SEQ ID NO: 1168331 - RNA, 19 nt, Homo sapiens
agggaacucuggaagugua

SEQ ID NO: 1168332 - RNA, 19 nt, Homo sapiens
guuaacugaugcugccauu

SEQ ID NO: 1168333 - RNA, 19 nt, Homo sapiens
ggucuagccaggagaaaga

SEQ ID NO: 1168334 - RNA, 19 nt, Homo sapiens
gaggaacugccuucagaga

SEQ ID NO: 1168335 - RNA, 19 nt, Homo sapiens
gaacccaguggauguaaca

SEQ ID NO: 1168336 - RNA, 19 nt, Homo sapiens
ccaaggagucggugaagau

SEQ ID NO: 1168337 - RNA, 19 nt, Homo sapiens
acaguugucccauugaauu

SEQ ID NO: 1168338 - RNA, 19 nt, Homo sapiens
gaacaaaagaaaagaggaa

SEQ ID NO: 1168339 - RNA, 19 nt, Homo sapiens
guccagaggucuucaacag

SEQ ID NO: 1168340 - RNA, 19 nt, Homo sapiens
guugucccauugaauuauu

SEQ ID NO: 1168341 - RNA, 19 nt, Homo sapiens
ugaaggagagggagcuuug

SEQ ID NO: 1168342 - RNA, 19 nt, Homo sapiens
gccaggagaaagacaguaa

SEQ ID NO: 1168343 - RNA, 19 nt, Homo sapiens
gaaagccgcugggaaaagu

SEQ ID NO: 1168344 - RNA, 19 nt, Homo sapiens
ccacugccacugaggauug

SEQ ID NO: 1168345 - RNA, 19 nt, Homo sapiens
cccaguggauguaacagaa

SEQ ID NO: 1168346 - RNA, 19 nt, Homo sapiens
ggccuccgcucagugauga

SEQ ID NO: 1168347 - RNA, 19 nt, Homo sapiens
ggagccaugcugcugaauu

SEQ ID NO: 1168348 - RNA, 19 nt, Homo sapiens
gaggaacccaguggaugua

SEQ ID NO: 1168349 - RNA, 19 nt, Homo sapiens
gaauucugguuggcauuuc

SEQ ID NO: 1168350 - RNA, 19 nt, Homo sapiens
gccaucugcuggucaggaa

SEQ ID NO: 1168351 - RNA, 19 nt, Homo sapiens
gcauucacggcaguaguua

SEQ ID NO: 1168352 - RNA, 19 nt, Homo sapiens
ggaaagcugccaaauucag

SEQ ID NO: 1168353 - RNA, 19 nt, Homo sapiens
gcauggugcugcugcuucu

SEQ ID NO: 1168354 - RNA, 19 nt, Homo sapiens
uuucauugcugacaguguu

SEQ ID NO: 1168355 - RNA, 19 nt, Homo sapiens
gcugggauugucuuuguuu

SEQ ID NO: 1168356 - RNA, 19 nt, Homo sapiens
gaaauuccaaaugguuguu

SEQ ID NO: 1168357 - RNA, 19 nt, Homo sapiens
gugaugagaccaagagauc

SEQ ID NO: 1168358 - RNA, 19 nt, Homo sapiens
cugcugagauggagcuuca

SEQ ID NO: 1168359 - RNA, 19 nt, Homo sapiens
caguugucccauugaauua

SEQ ID NO: 1168360 - RNA, 19 nt, Homo sapiens
agaaccgacuccaguugaa

SEQ ID NO: 1168361 - RNA, 19 nt, Homo sapiens
ggcaaagacccuaaucagu

SEQ ID NO: 1168362 - RNA, 19 nt, Homo sapiens
agaaagacaguaacaugug

SEQ ID NO: 1168363 - RNA, 19 nt, Homo sapiens
aaugguggcaggaaacuuu

SEQ ID NO: 1168364 - RNA, 19 nt, Homo sapiens
uagcagagaaagauaagau

SEQ ID NO: 1168365 - RNA, 19 nt, Homo sapiens
gaaccgacuccaguugaau

SEQ ID NO: 1168366 - RNA, 19 nt, Homo sapiens
cugcuuggguuugguugua

SEQ ID NO: 1168367 - RNA, 19 nt, Homo sapiens
uguaacugguucaucaaug

SEQ ID NO: 1168368 - RNA, 19 nt, Homo sapiens
gggaaguaaacuagacuga

SEQ ID NO: 1168369 - RNA, 19 nt, Homo sapiens
cagaaccgacuccaguuga

SEQ ID NO: 1168370 - RNA, 19 nt, Homo sapiens
ccuggauacugacuaacuu

SEQ ID NO: 1168371 - RNA, 19 nt, Homo sapiens
gacgacagccuuuaguuuu

SEQ ID NO: 1168372 - RNA, 19 nt, Homo sapiens
ggguaaggccucagaugug

SEQ ID NO: 1168373 - RNA, 19 nt, Homo sapiens
ggaaauauauucagaguca

SEQ ID NO: 1168374 - RNA, 19 nt, Homo sapiens
gaacugugcugaacuuuau

SEQ ID NO: 1168375 - RNA, 19 nt, Homo sapiens
gcagagacauugaaucaga

SEQ ID NO: 1168376 - RNA, 19 nt, Homo sapiens
caauauuacuggccagaua

SEQ ID NO: 1168377 - RNA, 19 nt, Homo sapiens
gugcugaacuuuauagcua

SEQ ID NO: 1168378 - RNA, 19 nt, Homo sapiens
ccaaugugcuggaagauga

SEQ ID NO: 1168379 - RNA, 19 nt, Homo sapiens
gaacaagauccucaugaaa

SEQ ID NO: 1168380 - RNA, 19 nt, Homo sapiens
gaacagcagguaauacuga

SEQ ID NO: 1168381 - RNA, 19 nt, Homo sapiens
ggaugaggacacacuauua

SEQ ID NO: 1168382 - RNA, 19 nt, Homo sapiens
gaaacuccauguugccaau

SEQ ID NO: 1168383 - RNA, 19 nt, Homo sapiens
ggaacugugcugaacuuua

SEQ ID NO: 1168384 - RNA, 19 nt, Homo sapiens
gaggaaauauauucagagu

SEQ ID NO: 1168385 - RNA, 19 nt, Homo sapiens
agaacaagauccucaugaa

SEQ ID NO: 1168386 - RNA, 19 nt, Homo sapiens
ugacugaguuauacaugaa

SEQ ID NO: 1168387 - RNA, 19 nt, Homo sapiens
gaucagccaucuugaacca

SEQ ID NO: 1168388 - RNA, 19 nt, Homo sapiens
caugaaaccucugauaugg

SEQ ID NO: 1168389 - RNA, 19 nt, Homo sapiens
uuaaggaucucgaggaagu

SEQ ID NO: 1168390 - RNA, 19 nt, Homo sapiens
cugauuugcuggacucuuu

SEQ ID NO: 1168391 - RNA, 19 nt, Homo sapiens
guucaugacugaguuauac

SEQ ID NO: 1168392 - RNA, 19 nt, Homo sapiens
cuacacagaugacuaagac

SEQ ID NO: 1168393 - RNA, 19 nt, Homo sapiens
ggccagauaguauuauuga

SEQ ID NO: 1168394 - RNA, 19 nt, Homo sapiens
ucagccaucuugaaccaaa

SEQ ID NO: 1168395 - RNA, 19 nt, Homo sapiens
gaaggaaggauggcagaga

SEQ ID NO: 1168396 - RNA, 19 nt, Homo sapiens
aaucagaaacuccauguug

SEQ ID NO: 1168397 - RNA, 19 nt, Homo sapiens
gaaggauggcagagacauu

SEQ ID NO: 1168398 - RNA, 19 nt, Homo sapiens
gcuuugauauucucagauc

SEQ ID NO: 1168399 - RNA, 19 nt, Homo sapiens
cagagacauugaaucagaa

SEQ ID NO: 1168400 - RNA, 19 nt, Homo sapiens
aaacaguuauguagcaucu

SEQ ID NO: 1168401 - RNA, 19 nt, Homo sapiens
gaugaggacacacuauuag

SEQ ID NO: 1168402 - RNA, 19 nt, Homo sapiens
cuaccuaccucacgucuac

SEQ ID NO: 1168403 - RNA, 19 nt, Homo sapiens
cuuuauagcuacacagaug

SEQ ID NO: 1168404 - RNA, 19 nt, Homo sapiens
cgacuccguuugaggaaau

SEQ ID NO: 1168405 - RNA, 19 nt, Homo sapiens
ugacuaagacgcaauuugg

SEQ ID NO: 1168406 - RNA, 19 nt, Homo sapiens
uagcuacacagaugacuaa

SEQ ID NO: 1168407 - RNA, 19 nt, Homo sapiens
ggaguugcaaccugauuug

SEQ ID NO: 1168408 - RNA, 19 nt, Homo sapiens
gcuuugaggguaaaugaaa

SEQ ID NO: 1168409 - RNA, 19 nt, Homo sapiens
uagauuacccagccacuug

SEQ ID NO: 1168410 - RNA, 19 nt, Homo sapiens
ucaacaaacaguuauguag

SEQ ID NO: 1168411 - RNA, 19 nt, Homo sapiens
ucaugaaaccucugauaug

SEQ ID NO: 1168412 - RNA, 19 nt, Homo sapiens
ccucaugaaaccucugaua

SEQ ID NO: 1168413 - RNA, 19 nt, Homo sapiens
aaauuaccuucuaguccua

SEQ ID NO: 1168414 - RNA, 19 nt, Homo sapiens
agucagguguuccuuccua

SEQ ID NO: 1168415 - RNA, 19 nt, Homo sapiens
uggcagagacauugaauca

SEQ ID NO: 1168416 - RNA, 19 nt, Homo sapiens
uuacccagaugccacaaug

SEQ ID NO: 1168417 - RNA, 19 nt, Homo sapiens
cagaacaagauccucauga

SEQ ID NO: 1168418 - RNA, 19 nt, Homo sapiens
gcagguaauacugaagaaa

SEQ ID NO: 1168419 - RNA, 19 nt, Homo sapiens
caucuugaaccaaagcaaa

SEQ ID NO: 1168420 - RNA, 19 nt, Homo sapiens
gggaacagcagguaauacu

SEQ ID NO: 1168421 - RNA, 19 nt, Homo sapiens
ggacccacgcagggaguua

SEQ ID NO: 1168422 - RNA, 19 nt, Homo sapiens
aacaaacaguuauguagca

SEQ ID NO: 1168423 - RNA, 19 nt, Homo sapiens
gcuggacucuuuggguuca

SEQ ID NO: 1168424 - RNA, 19 nt, Homo sapiens
ccucugauauggacauggu

SEQ ID NO: 1168425 - RNA, 19 nt, Homo sapiens
cagcagguaauacugaaga

SEQ ID NO: 1168426 - RNA, 19 nt, Homo sapiens
ccacuggcagccuagcuuu

SEQ ID NO: 1168427 - RNA, 19 nt, Homo sapiens
uagcuuugaggguaaauga

SEQ ID NO: 1168428 - RNA, 19 nt, Homo sapiens
gacauugaaucagaaacuc

SEQ ID NO: 1168429 - RNA, 19 nt, Homo sapiens
gucagguguuccuuccuaa

SEQ ID NO: 1168430 - RNA, 19 nt, Homo sapiens
gaaucagaaacuccauguu

SEQ ID NO: 1168431 - RNA, 19 nt, Homo sapiens
aguuaaggaucucgaggaa

SEQ ID NO: 1168432 - RNA, 19 nt, Homo sapiens
ggaacagcagguaauacug

SEQ ID NO: 1168433 - RNA, 19 nt, Homo sapiens
aaagcaaaaccacaaguua

SEQ ID NO: 1168434 - RNA, 19 nt, Homo sapiens
gcgacuccguuugaggaaa

SEQ ID NO: 1168435 - RNA, 19 nt, Homo sapiens
auauggacauggucagaug

SEQ ID NO: 1168436 - RNA, 19 nt, Homo sapiens
uacaugaacagaacaagau

SEQ ID NO: 1168437 - RNA, 19 nt, Homo sapiens
cuggaacugugcugaacuu

SEQ ID NO: 1168438 - RNA, 19 nt, Homo sapiens
cauggaagggaaucacuau

SEQ ID NO: 1168439 - RNA, 19 nt, Homo sapiens
gcugaacuuuauagcuaca

SEQ ID NO: 1168440 - RNA, 19 nt, Homo sapiens
gcuacacagaugacuaaga

SEQ ID NO: 1168441 - RNA, 19 nt, Homo sapiens
ggauggcagagacauugaa

SEQ ID NO: 1168442 - RNA, 19 nt, Homo sapiens
gcagggaguuaaggaucuc

SEQ ID NO: 1168443 - RNA, 19 nt, Homo sapiens
gaguuauacaugaacagaa

SEQ ID NO: 1168444 - RNA, 19 nt, Homo sapiens
gauggcagagacauugaau

SEQ ID NO: 1168445 - RNA, 19 nt, Homo sapiens
ugaaucagaaacuccaugu

SEQ ID NO: 1168446 - RNA, 19 nt, Homo sapiens
ccacgcagggaguuaagga

SEQ ID NO: 1168447 - RNA, 19 nt, Homo sapiens
gauauggacauggucagau

SEQ ID NO: 1168448 - RNA, 19 nt, Homo sapiens
aacagcagguaauacugaa

SEQ ID NO: 1168449 - RNA, 19 nt, Homo sapiens
gguuauggcaagcccuuug

SEQ ID NO: 1168450 - RNA, 19 nt, Homo sapiens
aacaagauccucaugaaac

SEQ ID NO: 1168451 - RNA, 19 nt, Homo sapiens
auacaugaacagaacaaga

SEQ ID NO: 1168452 - RNA, 19 nt, Homo sapiens
ucauggaagggaaucacua

SEQ ID NO: 1168453 - RNA, 19 nt, Homo sapiens
uugccaaugugcuggaaga

SEQ ID NO: 1168454 - RNA, 19 nt, Homo sapiens
augacugaguuauacauga

SEQ ID NO: 1168455 - RNA, 19 nt, Homo sapiens
uacacucuacuccugcuua

SEQ ID NO: 1168456 - RNA, 19 nt, Homo sapiens
guuauggcaagcccuuuga

SEQ ID NO: 1168457 - RNA, 19 nt, Homo sapiens
ggaaggauggcagagacau

SEQ ID NO: 1168458 - RNA, 19 nt, Homo sapiens
gacccacgcagggaguuaa

SEQ ID NO: 1168459 - RNA, 19 nt, Homo sapiens
ggagauauguugcuggaua

SEQ ID NO: 1168460 - RNA, 19 nt, Homo sapiens
ccaaacaaauucccacuaa

SEQ ID NO: 1168461 - RNA, 19 nt, Homo sapiens
gauaugaacugugauaaug

SEQ ID NO: 1168462 - RNA, 19 nt, Homo sapiens
gaaagaaccuaaggaacaa

SEQ ID NO: 1168463 - RNA, 19 nt, Homo sapiens
gcaauggcgucaaguacua

SEQ ID NO: 1168464 - RNA, 19 nt, Homo sapiens
caagugauaugaacuguga

SEQ ID NO: 1168465 - RNA, 19 nt, Homo sapiens
gauacgaugucucagauuu

SEQ ID NO: 1168466 - RNA, 19 nt, Homo sapiens
gaagauggguuaagagucu

SEQ ID NO: 1168467 - RNA, 19 nt, Homo sapiens
gaaugcagcugaccaaaca

SEQ ID NO: 1168468 - RNA, 19 nt, Homo sapiens
cagaggagcuaagcauuua

SEQ ID NO: 1168469 - RNA, 19 nt, Homo sapiens
gaucaaaucacaaaucuug

SEQ ID NO: 1168470 - RNA, 19 nt, Homo sapiens
gaagagaucaaaucacaaa

SEQ ID NO: 1168471 - RNA, 19 nt, Homo sapiens
gaaaugauacgaugucuca

SEQ ID NO: 1168472 - RNA, 19 nt, Homo sapiens
gaacugugauaaugcagaa

SEQ ID NO: 1168473 - RNA, 19 nt, Homo sapiens
gcaacacacugucuuuaau

SEQ ID NO: 1168474 - RNA, 19 nt, Homo sapiens
uaacacugcuuaccucuug

SEQ ID NO: 1168475 - RNA, 19 nt, Homo sapiens
guauggagccugaauuuaa

SEQ ID NO: 1168476 - RNA, 19 nt, Homo sapiens
caaauucccacuaauguaa

SEQ ID NO: 1168477 - RNA, 19 nt, Homo sapiens
gagauauguugcuggauaa

SEQ ID NO: 1168478 - RNA, 19 nt, Homo sapiens
ggaaagggcugagugucaa

SEQ ID NO: 1168479 - RNA, 19 nt, Homo sapiens
gaagagcaauuggugaaga

SEQ ID NO: 1168480 - RNA, 19 nt, Homo sapiens
caacacacugucuuuaaua

SEQ ID NO: 1168481 - RNA, 19 nt, Homo sapiens
cccaggagcucgugccuua

SEQ ID NO: 1168482 - RNA, 19 nt, Homo sapiens
gaauuucagucaugucuuc

SEQ ID NO: 1168483 - RNA, 19 nt, Homo sapiens
gaagagcaauggcgucaag

SEQ ID NO: 1168484 - RNA, 19 nt, Homo sapiens
gauggaggcugcccuggaa

SEQ ID NO: 1168485 - RNA, 19 nt, Homo sapiens
gcaggacaauggagagcua

SEQ ID NO: 1168486 - RNA, 19 nt, Homo sapiens
ggaagaagaggaacacguu

SEQ ID NO: 1168487 - RNA, 19 nt, Homo sapiens
gcaaacaaacacauuucua

SEQ ID NO: 1168488 - RNA, 19 nt, Homo sapiens
uaacaggggcuucuaauua

SEQ ID NO: 1168489 - RNA, 19 nt, Homo sapiens
aagaguguguguacuauuu

SEQ ID NO: 1168490 - RNA, 19 nt, Homo sapiens
uagcagagcuucacuagac

SEQ ID NO: 1168491 - RNA, 19 nt, Homo sapiens
gaaaucagugccuguguga

SEQ ID NO: 1168492 - RNA, 19 nt, Homo sapiens
gacaaucaguuaauaagca

SEQ ID NO: 1168493 - RNA, 19 nt, Homo sapiens
gcagccaccuucucaggaa

SEQ ID NO: 1168494 - RNA, 19 nt, Homo sapiens
auaguagggugcucaauaa

SEQ ID NO: 1168495 - RNA, 19 nt, Homo sapiens
aaacagccaaggugacuua

SEQ ID NO: 1168496 - RNA, 19 nt, Homo sapiens
gaggugauguuagguaaug

SEQ ID NO: 1168497 - RNA, 19 nt, Homo sapiens
ggugugaguugauaauugu

SEQ ID NO: 1168498 - RNA, 19 nt, Homo sapiens
uauggagccugaauuuaaa

SEQ ID NO: 1168499 - RNA, 19 nt, Homo sapiens
gaguaggugugaguugaua

SEQ ID NO: 1168500 - RNA, 19 nt, Homo sapiens
ccacaguccuugcccuuug

SEQ ID NO: 1168501 - RNA, 19 nt, Homo sapiens
ugaaagaaccuaaggaaca

SEQ ID NO: 1168502 - RNA, 19 nt, Homo sapiens
gaugacauaacacugcuua

SEQ ID NO: 1168503 - RNA, 19 nt, Homo sapiens
ggccuugacuggugagauu

SEQ ID NO: 1168504 - RNA, 19 nt, Homo sapiens
uguggugacuguagauaua

SEQ ID NO: 1168505 - RNA, 19 nt, Homo sapiens
aaaugaauguggaggguuu

SEQ ID NO: 1168506 - RNA, 19 nt, Homo sapiens
cagagucuaugauacugua

SEQ ID NO: 1168507 - RNA, 19 nt, Homo sapiens
aaacaaauucccacuaaug

SEQ ID NO: 1168508 - RNA, 19 nt, Homo sapiens
caaaaucucuuccuugugu

SEQ ID NO: 1168509 - RNA, 19 nt, Homo sapiens
cagauggccuuuuaaauuu

SEQ ID NO: 1168510 - RNA, 19 nt, Homo sapiens
uaauguaacugguaguauc

SEQ ID NO: 1168511 - RNA, 19 nt, Homo sapiens
caagauuguuguauaugug

SEQ ID NO: 1168512 - RNA, 19 nt, Homo sapiens
gcugaaagcaaaugaaugu

SEQ ID NO: 1168513 - RNA, 19 nt, Homo sapiens
gcuagauacuggagauaug

SEQ ID NO: 1168514 - RNA, 19 nt, Homo sapiens
uauaguagggugcucaaua

SEQ ID NO: 1168515 - RNA, 19 nt, Homo sapiens
gcaggacuguguggaggua

SEQ ID NO: 1168516 - RNA, 19 nt, Homo sapiens
gauauaugagugugcauuu

SEQ ID NO: 1168517 - RNA, 19 nt, Homo sapiens
gaauguggaggguuucaaa

SEQ ID NO: 1168518 - RNA, 19 nt, Homo sapiens
cagccucucugcaaacauu

SEQ ID NO: 1168519 - RNA, 19 nt, Homo sapiens
caaacaaauucccacuaau

SEQ ID NO: 1168520 - RNA, 19 nt, Homo sapiens
ggaggaagagaucaaauca

SEQ ID NO: 1168521 - RNA, 19 nt, Homo sapiens
ggaaaagcauguugcauuc

SEQ ID NO: 1168522 - RNA, 19 nt, Homo sapiens
gaugggcucugcacaccaa

SEQ ID NO: 1168523 - RNA, 19 nt, Homo sapiens
cuucacauguuugcuguua

SEQ ID NO: 1168524 - RNA, 19 nt, Homo sapiens
ggcauggacugcuugaguu

SEQ ID NO: 1168525 - RNA, 19 nt, Homo sapiens
cagcagcuccucucuggua

SEQ ID NO: 1168526 - RNA, 19 nt, Homo sapiens
gaacucuccugugggcauu

SEQ ID NO: 1168527 - RNA, 19 nt, Homo sapiens
gcagagcgccagcagguau

SEQ ID NO: 1168528 - RNA, 19 nt, Homo sapiens
ucaguacguggguuuauua

SEQ ID NO: 1168529 - RNA, 19 nt, Homo sapiens
gcaagcaccuggguucucu

SEQ ID NO: 1168530 - RNA, 19 nt, Homo sapiens
guagggugcucaauaaagg

SEQ ID NO: 1168531 - RNA, 19 nt, Homo sapiens
gcagcugaccaaacaaauu

SEQ ID NO: 1168532 - RNA, 19 nt, Homo sapiens
caagaguucuguggagaga

SEQ ID NO: 1168533 - RNA, 19 nt, Homo sapiens
aggaagagaucaaaucaca

SEQ ID NO: 1168534 - RNA, 19 nt, Homo sapiens
uagcaaacauucuucacau

SEQ ID NO: 1168535 - RNA, 19 nt, Homo sapiens
uguaacugguaguaucuua

SEQ ID NO: 1168536 - RNA, 19 nt, Homo sapiens
guacguggguuuauuacac

SEQ ID NO: 1168537 - RNA, 19 nt, Homo sapiens
ugucucagauuugcuuuaa

SEQ ID NO: 1168538 - RNA, 19 nt, Homo sapiens
gcacaccaacuccaggaaa

SEQ ID NO: 1168539 - RNA, 19 nt, Homo sapiens
aaagguggguugccugaau

SEQ ID NO: 1168540 - RNA, 19 nt, Homo sapiens
ugauugggcugauguguag

SEQ ID NO: 1168541 - RNA, 19 nt, Homo sapiens
gaauccaagucaccugugu

SEQ ID NO: 1168542 - RNA, 19 nt, Homo sapiens
gggaagagcaauuggugaa

SEQ ID NO: 1168543 - RNA, 19 nt, Homo sapiens
gaccagcacugaccaccau

SEQ ID NO: 1168544 - RNA, 19 nt, Homo sapiens
gcacaguuccucccagcaa

SEQ ID NO: 1168545 - RNA, 19 nt, Homo sapiens
ucacauguuugcuguuauc

SEQ ID NO: 1168546 - RNA, 19 nt, Homo sapiens
gguuaagagucucaagguu

SEQ ID NO: 1168547 - RNA, 19 nt, Homo sapiens
caacuucuguaucuguauc

SEQ ID NO: 1168548 - RNA, 19 nt, Homo sapiens
ucagaggagcuaagcauuu

SEQ ID NO: 1168549 - RNA, 19 nt, Homo sapiens
gguauggagccugaauuua

SEQ ID NO: 1168550 - RNA, 19 nt, Homo sapiens
uaaggaacaaugucuaaug

SEQ ID NO: 1168551 - RNA, 19 nt, Homo sapiens
ucugugagaugacauaaca

SEQ ID NO: 1168552 - RNA, 19 nt, Homo sapiens
gcugugcuguagccuguaa

SEQ ID NO: 1168553 - RNA, 19 nt, Homo sapiens
caagcacacuuuccuaaaa

SEQ ID NO: 1168554 - RNA, 19 nt, Homo sapiens
gugaagaguguguguacua

SEQ ID NO: 1168555 - RNA, 19 nt, Homo sapiens
ggccuuggcuucccuagca

SEQ ID NO: 1168556 - RNA, 19 nt, Homo sapiens
gagcuucacuagacauggu

SEQ ID NO: 1168557 - RNA, 19 nt, Homo sapiens
gaaacaggaguagguguga

SEQ ID NO: 1168558 - RNA, 19 nt, Homo sapiens
uuaagagucucaagguugu

SEQ ID NO: 1168559 - RNA, 19 nt, Homo sapiens
gaacauaucugucacaaau

SEQ ID NO: 1168560 - RNA, 19 nt, Homo sapiens
gaaaggcuguugaugcuua

SEQ ID NO: 1168561 - RNA, 19 nt, Homo sapiens
gaagauaacucuagcaaca

SEQ ID NO: 1168562 - RNA, 19 nt, Homo sapiens
gaauaaagcuguucguugu

SEQ ID NO: 1168563 - RNA, 19 nt, Homo sapiens
ggaaaugacugauaagugu

SEQ ID NO: 1168564 - RNA, 19 nt, Homo sapiens
ggaacgagcugccauguga

SEQ ID NO: 1168565 - RNA, 19 nt, Homo sapiens
gcacucaggugauaauuau

SEQ ID NO: 1168566 - RNA, 19 nt, Homo sapiens
gaacuucauuuacucauug

SEQ ID NO: 1168567 - RNA, 19 nt, Homo sapiens
ggaauuggaacuucauuua

SEQ ID NO: 1168568 - RNA, 19 nt, Homo sapiens
gaacaaaagucuagugauu

SEQ ID NO: 1168569 - RNA, 19 nt, Homo sapiens
acacauaucuaccuguaua

SEQ ID NO: 1168570 - RNA, 19 nt, Homo sapiens
gaagaguguuugcacagua

SEQ ID NO: 1168571 - RNA, 19 nt, Homo sapiens
gcagauugagcauaaauua

SEQ ID NO: 1168572 - RNA, 19 nt, Homo sapiens
gcuaugaacuaauggaauu

SEQ ID NO: 1168573 - RNA, 19 nt, Homo sapiens
gaagggacuuggacaaaga

SEQ ID NO: 1168574 - RNA, 19 nt, Homo sapiens
gcaccaagaccauucauuu

SEQ ID NO: 1168575 - RNA, 19 nt, Homo sapiens
gggaauagaugguugacuu

SEQ ID NO: 1168576 - RNA, 19 nt, Homo sapiens
gaacagcccaggaaagauu

SEQ ID NO: 1168577 - RNA, 19 nt, Homo sapiens
ggucaaaccuauuuucuua

SEQ ID NO: 1168578 - RNA, 19 nt, Homo sapiens
ucaaacugcuucacuauug

SEQ ID NO: 1168579 - RNA, 19 nt, Homo sapiens
caagugaccucuccucuuc

SEQ ID NO: 1168580 - RNA, 19 nt, Homo sapiens
gaaagauuauaccuaguga

SEQ ID NO: 1168581 - RNA, 19 nt, Homo sapiens
ggaauaaucagacgcauau

SEQ ID NO: 1168582 - RNA, 19 nt, Homo sapiens
gagaaacuguugucagaga

SEQ ID NO: 1168583 - RNA, 19 nt, Homo sapiens
aaaggaaacuggacuguau

SEQ ID NO: 1168584 - RNA, 19 nt, Homo sapiens
aaacagaucuugauaaagc

SEQ ID NO: 1168585 - RNA, 19 nt, Homo sapiens
gaaacagguuccaacauuc

SEQ ID NO: 1168586 - RNA, 19 nt, Homo sapiens
agaaacagguuccaacauu

SEQ ID NO: 1168587 - RNA, 19 nt, Homo sapiens
caagagagccugugacaau

SEQ ID NO: 1168588 - RNA, 19 nt, Homo sapiens
gauagagaguucagaguug

SEQ ID NO: 1168589 - RNA, 19 nt, Homo sapiens
caagugcaccucuaauaua

SEQ ID NO: 1168590 - RNA, 19 nt, Homo sapiens
gaaccagucugaugcaagu

SEQ ID NO: 1168591 - RNA, 19 nt, Homo sapiens
gccaggaaaugacugauaa

SEQ ID NO: 1168592 - RNA, 19 nt, Homo sapiens
guaccaagaaugucuauaa

SEQ ID NO: 1168593 - RNA, 19 nt, Homo sapiens
gcagaagugugcaccaaga

SEQ ID NO: 1168594 - RNA, 19 nt, Homo sapiens
gauaaacagcucugacuuu

SEQ ID NO: 1168595 - RNA, 19 nt, Homo sapiens
gcacaguacaguaacauuu

SEQ ID NO: 1168596 - RNA, 19 nt, Homo sapiens
gguaacaacucaugugcaa

SEQ ID NO: 1168597 - RNA, 19 nt, Homo sapiens
gaaguggugugcaguagga

SEQ ID NO: 1168598 - RNA, 19 nt, Homo sapiens
aaacuggacuguauucaga

SEQ ID NO: 1168599 - RNA, 19 nt, Homo sapiens
uaaacuaggagcugucuua

SEQ ID NO: 1168600 - RNA, 19 nt, Homo sapiens
aaaccuagccugucucuuu

SEQ ID NO: 1168601 - RNA, 19 nt, Homo sapiens
ucacacauaucuaccugua

SEQ ID NO: 1168602 - RNA, 19 nt, Homo sapiens
ggagcugucuuagaaauga

SEQ ID NO: 1168603 - RNA, 19 nt, Homo sapiens
gcaaauuggugugugagaa

SEQ ID NO: 1168604 - RNA, 19 nt, Homo sapiens
ucacauagcucccaguuuu

SEQ ID NO: 1168605 - RNA, 19 nt, Homo sapiens
acuaggagcugucuuagaa

SEQ ID NO: 1168606 - RNA, 19 nt, Homo sapiens
ggaacuucauuuacucauu

SEQ ID NO: 1168607 - RNA, 19 nt, Homo sapiens
gcaagugcaccucuaauau

SEQ ID NO: 1168608 - RNA, 19 nt, Homo sapiens
uagcuagacuguacauauu

SEQ ID NO: 1168609 - RNA, 19 nt, Homo sapiens
ccaguucccugcauccuaa

SEQ ID NO: 1168610 - RNA, 19 nt, Homo sapiens
acaaauaggugugugcaaa

SEQ ID NO: 1168611 - RNA, 19 nt, Homo sapiens
uaaugaacaucccaccuaa

SEQ ID NO: 1168612 - RNA, 19 nt, Homo sapiens
caaacggccucaaguggaa

SEQ ID NO: 1168613 - RNA, 19 nt, Homo sapiens
ggaauuucuuggccuacua

SEQ ID NO: 1168614 - RNA, 19 nt, Homo sapiens
ggaguaagucccauucauu

SEQ ID NO: 1168615 - RNA, 19 nt, Homo sapiens
gaagaauacccacuugguu

SEQ ID NO: 1168616 - RNA, 19 nt, Homo sapiens
gagcaagaaucaaguuugg

SEQ ID NO: 1168617 - RNA, 19 nt, Homo sapiens
gaguaagucccauucauuu

SEQ ID NO: 1168618 - RNA, 19 nt, Homo sapiens
gaugggagauggaauguac

SEQ ID NO: 1168619 - RNA, 19 nt, Homo sapiens
ccaagaaugucuauaaugc

SEQ ID NO: 1168620 - RNA, 19 nt, Homo sapiens
gcagaggccaacuuucaua

SEQ ID NO: 1168621 - RNA, 19 nt, Homo sapiens
aggaagagcugccugcaaa

SEQ ID NO: 1168622 - RNA, 19 nt, Homo sapiens
gaugcuggauguucagauu

SEQ ID NO: 1168623 - RNA, 19 nt, Homo sapiens
guacaguaauggucaacuu

SEQ ID NO: 1168624 - RNA, 19 nt, Homo sapiens
aagagaaacuguugucaga

SEQ ID NO: 1168625 - RNA, 19 nt, Homo sapiens
ucagaacaguuagaguuua

SEQ ID NO: 1168626 - RNA, 19 nt, Homo sapiens
agaaggagguguccaacuu

SEQ ID NO: 1168627 - RNA, 19 nt, Homo sapiens
cacuauugcuuacaguuua

SEQ ID NO: 1168628 - RNA, 19 nt, Homo sapiens
ccugggaaguugaaugaua

SEQ ID NO: 1168629 - RNA, 19 nt, Homo sapiens
aaauaggugugugcaaaua

SEQ ID NO: 1168630 - RNA, 19 nt, Homo sapiens
ggcauuggcuccuagaaau

SEQ ID NO: 1168631 - RNA, 19 nt, Homo sapiens
ucacagggauagacuacaa

SEQ ID NO: 1168632 - RNA, 19 nt, Homo sapiens
gaaugucuauaaugcauca

SEQ ID NO: 1168633 - RNA, 19 nt, Homo sapiens
gagcuucaggugcuuguua

SEQ ID NO: 1168634 - RNA, 19 nt, Homo sapiens
aaacagcucugacuuucau

SEQ ID NO: 1168635 - RNA, 19 nt, Homo sapiens
cugcaaagcuuucucaagu

SEQ ID NO: 1168636 - RNA, 19 nt, Homo sapiens
guucugugcuucaccauga

SEQ ID NO: 1168637 - RNA, 19 nt, Homo sapiens
gacacaggcugacacauuc

SEQ ID NO: 1168638 - RNA, 19 nt, Homo sapiens
uaggauguguagacaauaa

SEQ ID NO: 1168639 - RNA, 19 nt, Homo sapiens
ggaaagauuauaccuagug

SEQ ID NO: 1168640 - RNA, 19 nt, Homo sapiens
ucucauaacuggucaacga

SEQ ID NO: 1168641 - RNA, 19 nt, Homo sapiens
gagagccugugacaauuug

SEQ ID NO: 1168642 - RNA, 19 nt, Homo sapiens
gcaccaccuuugcuaguga

SEQ ID NO: 1168643 - RNA, 19 nt, Homo sapiens
ugagugacccugagacuaa

SEQ ID NO: 1168644 - RNA, 19 nt, Homo sapiens
gaacagcaaggaagagugu

SEQ ID NO: 1168645 - RNA, 19 nt, Homo sapiens
ugaacaagguggacacuca

SEQ ID NO: 1168646 - RNA, 19 nt, Homo sapiens
ggaaugaggagaaucuuca

SEQ ID NO: 1168647 - RNA, 19 nt, Homo sapiens
gcucugacauaaagacaug

SEQ ID NO: 1168648 - RNA, 19 nt, Homo sapiens
gcucugacuuucauucuca

SEQ ID NO: 1168649 - RNA, 19 nt, Homo sapiens
gcuguucguuguaucauga

SEQ ID NO: 1168650 - RNA, 19 nt, Homo sapiens
ugagaggacuggcuaaagu

SEQ ID NO: 1168651 - RNA, 19 nt, Homo sapiens
ggaaagacagcagugauga

SEQ ID NO: 1168652 - RNA, 19 nt, Homo sapiens
gaaaugacugauaagugua

SEQ ID NO: 1168653 - RNA, 19 nt, Homo sapiens
agagaggaaucaacugaaa

SEQ ID NO: 1168654 - RNA, 19 nt, Homo sapiens
gaggauggccuguuugugu

SEQ ID NO: 1168655 - RNA, 19 nt, Homo sapiens
ccagaaauuugucaguuca

SEQ ID NO: 1168656 - RNA, 19 nt, Homo sapiens
ggagagaguuuggacaucu

SEQ ID NO: 1168657 - RNA, 19 nt, Homo sapiens
gacaacuucuccugccuuu

SEQ ID NO: 1168658 - RNA, 19 nt, Homo sapiens
cagaacaguuagaguuuau

SEQ ID NO: 1168659 - RNA, 19 nt, Homo sapiens
ggauauaccuacauuguua

SEQ ID NO: 1168660 - RNA, 19 nt, Homo sapiens
gcccaaagcuuauuaguuu

SEQ ID NO: 1168661 - RNA, 19 nt, Homo sapiens
gagagaggauguauacuuu

SEQ ID NO: 1168662 - RNA, 19 nt, Homo sapiens
caaagaccaugauuuauga

SEQ ID NO: 1168663 - RNA, 19 nt, Homo sapiens
gcuguugccuuauuaguua

SEQ ID NO: 1168664 - RNA, 19 nt, Homo sapiens
gagagaugauugccuauuu

SEQ ID NO: 1168665 - RNA, 19 nt, Homo sapiens
ugacacagauuuccuugua

SEQ ID NO: 1168666 - RNA, 19 nt, Homo sapiens
caugauaggugcugaauug

SEQ ID NO: 1168667 - RNA, 19 nt, Homo sapiens
gauaggugcugaauuguga

SEQ ID NO: 1168668 - RNA, 19 nt, Homo sapiens
gaauuuagccucugaauac

SEQ ID NO: 1168669 - RNA, 19 nt, Homo sapiens
aaucacaucucacacauuu

SEQ ID NO: 1168670 - RNA, 19 nt, Homo sapiens
ggacuucuuucaucaauuc

SEQ ID NO: 1168671 - RNA, 19 nt, Homo sapiens
ggaaagggaguauuauuau

SEQ ID NO: 1168672 - RNA, 19 nt, Homo sapiens
uggcaucuguuuacauuua

SEQ ID NO: 1168673 - RNA, 19 nt, Homo sapiens
agagguaacuuguuuaaug

SEQ ID NO: 1168674 - RNA, 19 nt, Homo sapiens
uaacuagucuggccuacaa

SEQ ID NO: 1168675 - RNA, 19 nt, Homo sapiens
ugauagagguaacuuguuu

SEQ ID NO: 1168676 - RNA, 19 nt, Homo sapiens
gggauaagauuucuaacau

SEQ ID NO: 1168677 - RNA, 19 nt, Homo sapiens
ggaaagaccaccugaagga

SEQ ID NO: 1168678 - RNA, 19 nt, Homo sapiens
uaucugcucugucauauau

SEQ ID NO: 1168679 - RNA, 19 nt, Homo sapiens
gcucaaaucuaguggaaca

SEQ ID NO: 1168680 - RNA, 19 nt, Homo sapiens
caaggaagcugcggaagga

SEQ ID NO: 1168681 - RNA, 19 nt, Homo sapiens
cagauuggauacaugauuu

SEQ ID NO: 1168682 - RNA, 19 nt, Homo sapiens
gccuauugguucucuauua

SEQ ID NO: 1168683 - RNA, 19 nt, Homo sapiens
cugaauaccuucuccauug

SEQ ID NO: 1168684 - RNA, 19 nt, Homo sapiens
gagguaacuuguuuaaugu

SEQ ID NO: 1168685 - RNA, 19 nt, Homo sapiens
agagaugauugccuauuua

SEQ ID NO: 1168686 - RNA, 19 nt, Homo sapiens
gcaggagaaucagauauga

SEQ ID NO: 1168687 - RNA, 19 nt, Homo sapiens
ucacaaacuucuacauuca

SEQ ID NO: 1168688 - RNA, 19 nt, Homo sapiens
uaucaaaccuagaaugugu

SEQ ID NO: 1168689 - RNA, 19 nt, Homo sapiens
uguaauagcucuguuuaga

SEQ ID NO: 1168690 - RNA, 19 nt, Homo sapiens
ggaauuuagccucugaaua

SEQ ID NO: 1168691 - RNA, 19 nt, Homo sapiens
caagcaggcucaaaucuag

SEQ ID NO: 1168692 - RNA, 19 nt, Homo sapiens
uaggguauguuucaaguuu

SEQ ID NO: 1168693 - RNA, 19 nt, Homo sapiens
gcaugugauuguaaaugua

SEQ ID NO: 1168694 - RNA, 19 nt, Homo sapiens
caaaccacgucaucugauu

SEQ ID NO: 1168695 - RNA, 19 nt, Homo sapiens
ucaauagugugcugucaaa

SEQ ID NO: 1168696 - RNA, 19 nt, Homo sapiens
cauggcaucuguuuacauu

SEQ ID NO: 1168697 - RNA, 19 nt, Homo sapiens
acacagauuuccuuguaaa

SEQ ID NO: 1168698 - RNA, 19 nt, Homo sapiens
uggaaccacucaugacaua

SEQ ID NO: 1168699 - RNA, 19 nt, Homo sapiens
guuuagaaccucuuguuua

SEQ ID NO: 1168700 - RNA, 19 nt, Homo sapiens
gguuucuucuggacaauua

SEQ ID NO: 1168701 - RNA, 19 nt, Homo sapiens
gugcuuagcucaccuggau

SEQ ID NO: 1168702 - RNA, 19 nt, Homo sapiens
ucaaacagguaaagccuau

SEQ ID NO: 1168703 - RNA, 19 nt, Homo sapiens
uggaaagggaguauuauua

SEQ ID NO: 1168704 - RNA, 19 nt, Homo sapiens
ucacacugcugucucugua

SEQ ID NO: 1168705 - RNA, 19 nt, Homo sapiens
ccacucaugacauaucuua

SEQ ID NO: 1168706 - RNA, 19 nt, Homo sapiens
ucaaagaccaugauuuaug

SEQ ID NO: 1168707 - RNA, 19 nt, Homo sapiens
guagggauaagauuucuaa

SEQ ID NO: 1168708 - RNA, 19 nt, Homo sapiens
ucuccaaacucauagaauu

SEQ ID NO: 1168709 - RNA, 19 nt, Homo sapiens
guaccuauuucaaggcauu

SEQ ID NO: 1168710 - RNA, 19 nt, Homo sapiens
acacugcugucucuguaua

SEQ ID NO: 1168711 - RNA, 19 nt, Homo sapiens
ugauugcucucuucacaaa

SEQ ID NO: 1168712 - RNA, 19 nt, Homo sapiens
ucauagcgcuugauucauc

SEQ ID NO: 1168713 - RNA, 19 nt, Homo sapiens
ggaagaaguacaucacuca

SEQ ID NO: 1168714 - RNA, 19 nt, Homo sapiens
guauauguucugugaguua

SEQ ID NO: 1168715 - RNA, 19 nt, Homo sapiens
guacuaauuugcagauguc

SEQ ID NO: 1168716 - RNA, 19 nt, Homo sapiens
ucacaucucacacauuuga

SEQ ID NO: 1168717 - RNA, 19 nt, Homo sapiens
caaauauagcuacagcaua

SEQ ID NO: 1168718 - RNA, 19 nt, Homo sapiens
cuacagcagucgugaugaa

SEQ ID NO: 1168719 - RNA, 19 nt, Homo sapiens
acacuguaauccaaacuuu

SEQ ID NO: 1168720 - RNA, 19 nt, Homo sapiens
guccauggcugcugugaau

SEQ ID NO: 1168721 - RNA, 19 nt, Homo sapiens
gcaaauacaacuucuucug

SEQ ID NO: 1168722 - RNA, 19 nt, Homo sapiens
guaaaaggaugguuucuuc

SEQ ID NO: 1168723 - RNA, 19 nt, Homo sapiens
gacacagauuuccuuguaa

SEQ ID NO: 1168724 - RNA, 19 nt, Homo sapiens
gcagucgugaugaaacuua

SEQ ID NO: 1168725 - RNA, 19 nt, Homo sapiens
gaaucaagcaggcucaaau

SEQ ID NO: 1168726 - RNA, 19 nt, Homo sapiens
cuauuagucuuguggguuu

SEQ ID NO: 1168727 - RNA, 19 nt, Homo sapiens
gaaauuugauagagguaac

SEQ ID NO: 1168728 - RNA, 19 nt, Homo sapiens
acacugcuguugccuuauu

SEQ ID NO: 1168729 - RNA, 19 nt, Homo sapiens
ucacgaaaguucuauuguc

SEQ ID NO: 1168730 - RNA, 19 nt, Homo sapiens
caaauacaacuucuucugu

SEQ ID NO: 1168731 - RNA, 19 nt, Homo sapiens
acauuuaucugcucuguca

SEQ ID NO: 1168732 - RNA, 19 nt, Homo sapiens
uaaagccuaugaugugugu

SEQ ID NO: 1168733 - RNA, 19 nt, Homo sapiens
gaucacgaaaguucuauug

SEQ ID NO: 1168734 - RNA, 19 nt, Homo sapiens
cuacuucuccaaacucaua

SEQ ID NO: 1168735 - RNA, 19 nt, Homo sapiens
ggagucauggcaucuguuu

SEQ ID NO: 1168736 - RNA, 19 nt, Homo sapiens
gauagagguaacuuguuua

SEQ ID NO: 1168737 - RNA, 19 nt, Homo sapiens
cgagagaggauguauacuu

SEQ ID NO: 1168738 - RNA, 19 nt, Homo sapiens
acaauagugugauucaugu

SEQ ID NO: 1168739 - RNA, 19 nt, Homo sapiens
gaugguuucuucuggacaa

SEQ ID NO: 1168740 - RNA, 19 nt, Homo sapiens
gguaaagccuaugaugugu

SEQ ID NO: 1168741 - RNA, 19 nt, Homo sapiens
guaauagcucuguuuagaa

SEQ ID NO: 1168742 - RNA, 19 nt, Homo sapiens
uauggacacuuucuucuuc

SEQ ID NO: 1168743 - RNA, 19 nt, Homo sapiens
cuaauuugcagaugucuuu

SEQ ID NO: 1168744 - RNA, 19 nt, Homo sapiens
gguacuaauuugcagaugu

SEQ ID NO: 1168745 - RNA, 19 nt, Homo sapiens
gaaccacucaugacauauc

SEQ ID NO: 1168746 - RNA, 19 nt, Homo sapiens
gaaggaaagaccaccugaa

SEQ ID NO: 1168747 - RNA, 19 nt, Homo sapiens
uaucuuagaaggucauuga

SEQ ID NO: 1168748 - RNA, 19 nt, Homo sapiens
gauugccuauuuaccguuu

SEQ ID NO: 1168749 - RNA, 19 nt, Homo sapiens
gaccaugauuuaugaaacu

SEQ ID NO: 1168750 - RNA, 19 nt, Homo sapiens
auacaugauuucccugauu

SEQ ID NO: 1168751 - RNA, 19 nt, Homo sapiens
cugaacaucuggugguuug

SEQ ID NO: 1168752 - RNA, 19 nt, Homo sapiens
gagaaucagauaugaagau

SEQ ID NO: 1168753 - RNA, 19 nt, Homo sapiens
ucaagcaggcucaaaucua

SEQ ID NO: 1168754 - RNA, 19 nt, Homo sapiens
guaagcacaauaugaguug

SEQ ID NO: 1168755 - RNA, 19 nt, Homo sapiens
ccacgucaucugauuguaa

SEQ ID NO: 1168756 - RNA, 19 nt, Homo sapiens
ccauaccucugguggaaga

SEQ ID NO: 1168757 - RNA, 19 nt, Homo sapiens
gcaguggucaaacagguaa

SEQ ID NO: 1168758 - RNA, 19 nt, Homo sapiens
auaaacagccauucucuug

SEQ ID NO: 1168759 - RNA, 19 nt, Homo sapiens
gaaauuaggccuuauguaa

SEQ ID NO: 1168760 - RNA, 19 nt, Homo sapiens
gcacgaagcuaugagaaua

SEQ ID NO: 1168761 - RNA, 19 nt, Homo sapiens
agaagaaucuggaucauua

SEQ ID NO: 1168762 - RNA, 19 nt, Homo sapiens
gaagugaaauuaggccuua

SEQ ID NO: 1168763 - RNA, 19 nt, Homo sapiens
gaagagcacugggcuaauu

SEQ ID NO: 1168764 - RNA, 19 nt, Homo sapiens
ccaauuggauauucucuua

SEQ ID NO: 1168765 - RNA, 19 nt, Homo sapiens
gcacugggcuaauuuguau

SEQ ID NO: 1168766 - RNA, 19 nt, Homo sapiens
ccacaaauaugcuaaaugu

SEQ ID NO: 1168767 - RNA, 19 nt, Homo sapiens
cuacaggucucucucuuua

SEQ ID NO: 1168768 - RNA, 19 nt, Homo sapiens
guucugagcuauaacauuu

SEQ ID NO: 1168769 - RNA, 19 nt, Homo sapiens
gaaggaagcaccuaugaaa

SEQ ID NO: 1168770 - RNA, 19 nt, Homo sapiens
gaacaaagggccaaauaga

SEQ ID NO: 1168771 - RNA, 19 nt, Homo sapiens
ggaaacaccucacucauac

SEQ ID NO: 1168772 - RNA, 19 nt, Homo sapiens
gcucaacuuucaccaauaa

SEQ ID NO: 1168773 - RNA, 19 nt, Homo sapiens
gacaauggcuauauuaauc

SEQ ID NO: 1168774 - RNA, 19 nt, Homo sapiens
gagaauaacuucagucacu

SEQ ID NO: 1168775 - RNA, 19 nt, Homo sapiens
gaggcacacugcuaaauuu

SEQ ID NO: 1168776 - RNA, 19 nt, Homo sapiens
gcuauuacccugaugauaa

SEQ ID NO: 1168777 - RNA, 19 nt, Homo sapiens
gcacagacuuccaccaugu

SEQ ID NO: 1168778 - RNA, 19 nt, Homo sapiens
ucacaccagucacacauua

SEQ ID NO: 1168779 - RNA, 19 nt, Homo sapiens
aacaguaccugaaggauua

SEQ ID NO: 1168780 - RNA, 19 nt, Homo sapiens
caucaucucugcacucauu

SEQ ID NO: 1168781 - RNA, 19 nt, Homo sapiens
gcacauuucugucaucauc

SEQ ID NO: 1168782 - RNA, 19 nt, Homo sapiens
aaagaaaucguuuggguua

SEQ ID NO: 1168783 - RNA, 19 nt, Homo sapiens
gucacaaggucuuuacuua

SEQ ID NO: 1168784 - RNA, 19 nt, Homo sapiens
gcacugaugagucuaguuu

SEQ ID NO: 1168785 - RNA, 19 nt, Homo sapiens
gagaacaaagggccaaaua

SEQ ID NO: 1168786 - RNA, 19 nt, Homo sapiens
ccacagauacugaaacauu

SEQ ID NO: 1168787 - RNA, 19 nt, Homo sapiens
guacauggaagaaguauau

SEQ ID NO: 1168788 - RNA, 19 nt, Homo sapiens
gaaagugagucugaauugu

SEQ ID NO: 1168789 - RNA, 19 nt, Homo sapiens
gugaagaagccaucaauuu

SEQ ID NO: 1168790 - RNA, 19 nt, Homo sapiens
aaaggaaauuggacaguuu

SEQ ID NO: 1168791 - RNA, 19 nt, Homo sapiens
ccaaguaucuauuugaaag

SEQ ID NO: 1168792 - RNA, 19 nt, Homo sapiens
guagccagcugcagaagaa

SEQ ID NO: 1168793 - RNA, 19 nt, Homo sapiens
caucugaagucuacucuug

SEQ ID NO: 1168794 - RNA, 19 nt, Homo sapiens
gaucaucgauguggauaug

SEQ ID NO: 1168795 - RNA, 19 nt, Homo sapiens
guucugggcugcagcaauu

SEQ ID NO: 1168796 - RNA, 19 nt, Homo sapiens
gaagaagccaucaauuuua

SEQ ID NO: 1168797 - RNA, 19 nt, Homo sapiens
cagcaucuguuacgguuaa

SEQ ID NO: 1168798 - RNA, 19 nt, Homo sapiens
acucuuggcuugauaguuu

SEQ ID NO: 1168799 - RNA, 19 nt, Homo sapiens
ugaauuaaccagcugauuu

SEQ ID NO: 1168800 - RNA, 19 nt, Homo sapiens
gaaccuugccaccuaaauu

SEQ ID NO: 1168801 - RNA, 19 nt, Homo sapiens
aaagaggccuuccuugaug

SEQ ID NO: 1168802 - RNA, 19 nt, Homo sapiens
gcugggaacuguugacuca

SEQ ID NO: 1168803 - RNA, 19 nt, Homo sapiens
ggaggaggguauaucaaug

SEQ ID NO: 1168804 - RNA, 19 nt, Homo sapiens
cacaaggucuuuacuuaug

SEQ ID NO: 1168805 - RNA, 19 nt, Homo sapiens
gagacuagacaaauaacua

SEQ ID NO: 1168806 - RNA, 19 nt, Homo sapiens
cuuagagacuagacaaaua

SEQ ID NO: 1168807 - RNA, 19 nt, Homo sapiens
gcuacuauaugcauaaaca

SEQ ID NO: 1168808 - RNA, 19 nt, Homo sapiens
gauggugaauauuacauug

SEQ ID NO: 1168809 - RNA, 19 nt, Homo sapiens
gguaauaggaagaacagua

SEQ ID NO: 1168810 - RNA, 19 nt, Homo sapiens
ugaauggugcaaugaauua

SEQ ID NO: 1168811 - RNA, 19 nt, Homo sapiens
uagcuggacugcaauauca

SEQ ID NO: 1168812 - RNA, 19 nt, Homo sapiens
ugugaaaugugcaagagua

SEQ ID NO: 1168813 - RNA, 19 nt, Homo sapiens
gcauaaauuuccacccaau

SEQ ID NO: 1168814 - RNA, 19 nt, Homo sapiens
guucugaccuuguuuacau

SEQ ID NO: 1168815 - RNA, 19 nt, Homo sapiens
gaagaggcagacaugauuu

SEQ ID NO: 1168816 - RNA, 19 nt, Homo sapiens
gcacagcugaagcaguuua

SEQ ID NO: 1168817 - RNA, 19 nt, Homo sapiens
gcaagaguauacuuuguac

SEQ ID NO: 1168818 - RNA, 19 nt, Homo sapiens
cacagauacugaaacauuu

SEQ ID NO: 1168819 - RNA, 19 nt, Homo sapiens
ggaaucugaucccauaaag

SEQ ID NO: 1168820 - RNA, 19 nt, Homo sapiens
ggucugggacugaagauaa

SEQ ID NO: 1168821 - RNA, 19 nt, Homo sapiens
gcuuguagcuggacugcaa

SEQ ID NO: 1168822 - RNA, 19 nt, Homo sapiens
uaaagaaagugagucugaa

SEQ ID NO: 1168823 - RNA, 19 nt, Homo sapiens
uagaugaacuugcacuugu

SEQ ID NO: 1168824 - RNA, 19 nt, Homo sapiens
gaccuuguuuacaucguua

SEQ ID NO: 1168825 - RNA, 19 nt, Homo sapiens
uggcacagcugaagcaguu

SEQ ID NO: 1168826 - RNA, 19 nt, Homo sapiens
ucacucauacugucauaua

SEQ ID NO: 1168827 - RNA, 19 nt, Homo sapiens
ucucagguauugauugaaa

SEQ ID NO: 1168828 - RNA, 19 nt, Homo sapiens
caacaguaccugaaggauu

SEQ ID NO: 1168829 - RNA, 19 nt, Homo sapiens
gagucuaguuucauuauag

SEQ ID NO: 1168830 - RNA, 19 nt, Homo sapiens
cagcuuuccuucagacaaa

SEQ ID NO: 1168831 - RNA, 19 nt, Homo sapiens
caacuucauugcuacacuu

SEQ ID NO: 1168832 - RNA, 19 nt, Homo sapiens
ggcaacaccuguggauaaa

SEQ ID NO: 1168833 - RNA, 19 nt, Homo sapiens
ccacgauucucagguauug

SEQ ID NO: 1168834 - RNA, 19 nt, Homo sapiens
gcuauaacauuugcugaau

SEQ ID NO: 1168835 - RNA, 19 nt, Homo sapiens
cggaacaucuaccagcuuu

SEQ ID NO: 1168836 - RNA, 19 nt, Homo sapiens
cagcgaagccaucauaguu

SEQ ID NO: 1168837 - RNA, 19 nt, Homo sapiens
gugaugagcugaaaaguga

SEQ ID NO: 1168838 - RNA, 19 nt, Homo sapiens
gggcuaauuuguauguuuc

SEQ ID NO: 1168839 - RNA, 19 nt, Homo sapiens
gcgcagcgaagccaucaua

SEQ ID NO: 1168840 - RNA, 19 nt, Homo sapiens
ggacugaagauaauuuaca

SEQ ID NO: 1168841 - RNA, 19 nt, Homo sapiens
ggauuuaccaugacagcua

SEQ ID NO: 1168842 - RNA, 19 nt, Homo sapiens
cugaaacauuugacacaua

SEQ ID NO: 1168843 - RNA, 19 nt, Homo sapiens
aaacagaagguaauaggaa

SEQ ID NO: 1168844 - RNA, 19 nt, Homo sapiens
gaaguagccagcugcagaa

SEQ ID NO: 1168845 - RNA, 19 nt, Homo sapiens
ucuccuaucuagccaagua

SEQ ID NO: 1168846 - RNA, 19 nt, Homo sapiens
caguuuauguaccagguua

SEQ ID NO: 1168847 - RNA, 19 nt, Homo sapiens
gaaaugugcaagaguauac

SEQ ID NO: 1168848 - RNA, 19 nt, Homo sapiens
ccaagacaguuguaucaca

SEQ ID NO: 1168849 - RNA, 19 nt, Homo sapiens
gaaaauguuugcccuguuc

SEQ ID NO: 1168850 - RNA, 19 nt, Homo sapiens
aaucugaucccauaaagaa

SEQ ID NO: 1168851 - RNA, 19 nt, Homo sapiens
guuacagcaucuacucuuu

SEQ ID NO: 1168852 - RNA, 19 nt, Homo sapiens
caacaccuccugauaguag

SEQ ID NO: 1168853 - RNA, 19 nt, Homo sapiens
gaagcuaugagaauaacuu

SEQ ID NO: 1168854 - RNA, 19 nt, Homo sapiens
ggccuacacugaugucguu

SEQ ID NO: 1168855 - RNA, 19 nt, Homo sapiens
ccacaacaccuccugauag

SEQ ID NO: 1168856 - RNA, 19 nt, Homo sapiens
uggccgagauauugguuua

SEQ ID NO: 1168857 - RNA, 19 nt, Homo sapiens
ggaagcaccuaugaaagca

SEQ ID NO: 1168858 - RNA, 19 nt, Homo sapiens
uaaagaggccuuccuugau

SEQ ID NO: 1168859 - RNA, 19 nt, Homo sapiens
ggcauuaacugaccucuga

SEQ ID NO: 1168860 - RNA, 19 nt, Homo sapiens
gagaccagcuucuaacaga

SEQ ID NO: 1168861 - RNA, 19 nt, Homo sapiens
gguaccaguucaauuacua

SEQ ID NO: 1168862 - RNA, 19 nt, Homo sapiens
gccauuacccacagaauaa

SEQ ID NO: 1168863 - RNA, 19 nt, Homo sapiens
gccgguaccaguucaauua

SEQ ID NO: 1168864 - RNA, 19 nt, Homo sapiens
gaaagucuguuugcaaagg

SEQ ID NO: 1168865 - RNA, 19 nt, Homo sapiens
gggaaacgcugauccucau

SEQ ID NO: 1168866 - RNA, 19 nt, Homo sapiens
cugaaagucuguuugcaaa

SEQ ID NO: 1168867 - RNA, 19 nt, Homo sapiens
gaaaggacagacagacaga

SEQ ID NO: 1168868 - RNA, 19 nt, Homo sapiens
uaacugaccucugaguaca

SEQ ID NO: 1168869 - RNA, 19 nt, Homo sapiens
ggacagacagacagacaga

SEQ ID NO: 1168870 - RNA, 19 nt, Homo sapiens
ggauaguucccaccugaaa

SEQ ID NO: 1168871 - RNA, 19 nt, Homo sapiens
caaaggcaaugcgcacuca

SEQ ID NO: 1168872 - RNA, 19 nt, Homo sapiens
gaaggaaaggacagacaga

SEQ ID NO: 1168873 - RNA, 19 nt, Homo sapiens
agacagagacaaugggaaa

SEQ ID NO: 1168874 - RNA, 19 nt, Homo sapiens
ggcaaaccuucauccagaa

SEQ ID NO: 1168875 - RNA, 19 nt, Homo sapiens
uaaccugggcaucuuuaaa

SEQ ID NO: 1168876 - RNA, 19 nt, Homo sapiens
agugugcgcuucccaauca

SEQ ID NO: 1168877 - RNA, 19 nt, Homo sapiens
ggucuggacugguguaacg

SEQ ID NO: 1168878 - RNA, 19 nt, Homo sapiens
gagguccgguuucuugaag

SEQ ID NO: 1168879 - RNA, 19 nt, Homo sapiens
uggaaguccuggauaguuc

SEQ ID NO: 1168880 - RNA, 19 nt, Homo sapiens
gaaccucuuccucaagcaa

SEQ ID NO: 1168881 - RNA, 19 nt, Homo sapiens
gagaaggaaaggacagaca

SEQ ID NO: 1168882 - RNA, 19 nt, Homo sapiens
gaaaagacagagacaaugg

SEQ ID NO: 1168883 - RNA, 19 nt, Homo sapiens
ccucugaguacagcaauaa

SEQ ID NO: 1168884 - RNA, 19 nt, Homo sapiens
ccuaugggaccuacugcua

SEQ ID NO: 1168885 - RNA, 19 nt, Homo sapiens
uccagaaccucuuccucaa

SEQ ID NO: 1168886 - RNA, 19 nt, Homo sapiens
ggcucaaguuccaggguuu

SEQ ID NO: 1168887 - RNA, 19 nt, Homo sapiens
acagagacaaugggaaauu

SEQ ID NO: 1168888 - RNA, 19 nt, Homo sapiens
acugcuacgccgagaauua

SEQ ID NO: 1168889 - RNA, 19 nt, Homo sapiens
gcagugugcgcuucccaau

SEQ ID NO: 1168890 - RNA, 19 nt, Homo sapiens
uacagaagagguccgguuu

SEQ ID NO: 1168891 - RNA, 19 nt, Homo sapiens
aauaaccugggcaucuuua

SEQ ID NO: 1168892 - RNA, 19 nt, Homo sapiens
cagcuggaaguccuggaua

SEQ ID NO: 1168893 - RNA, 19 nt, Homo sapiens
aaaauaaccugggcaucuu

SEQ ID NO: 1168894 - RNA, 19 nt, Homo sapiens
ccugaaagucuguuugcaa

SEQ ID NO: 1168895 - RNA, 19 nt, Homo sapiens
aaauaaccugggcaucuuu

SEQ ID NO: 1168896 - RNA, 19 nt, Homo sapiens
cuuggagggugugguguuu

SEQ ID NO: 1168897 - RNA, 19 nt, Homo sapiens
gguccgguuucuugaagca

SEQ ID NO: 1168898 - RNA, 19 nt, Homo sapiens
gcuacgacgccuucugcuu

SEQ ID NO: 1168899 - RNA, 19 nt, Homo sapiens
ggaaaagacagagacaaug

SEQ ID NO: 1168900 - RNA, 19 nt, Homo sapiens
gauaguucccaccugaaag

SEQ ID NO: 1168901 - RNA, 19 nt, Homo sapiens
gggaaaagacagagacaau

SEQ ID NO: 1168902 - RNA, 19 nt, Homo sapiens
gggcagaggggcucaaguu

SEQ ID NO: 1168903 - RNA, 19 nt, Homo sapiens
gaagaaauguugacaaugu

SEQ ID NO: 1168904 - RNA, 19 nt, Homo sapiens
ggaaagggaugguuuaaau

SEQ ID NO: 1168905 - RNA, 19 nt, Homo sapiens
caaguacucugguuaauaa

SEQ ID NO: 1168906 - RNA, 19 nt, Homo sapiens
ggaaguacgugaagaagga

SEQ ID NO: 1168907 - RNA, 19 nt, Homo sapiens
caaauaagaaggcccaaua

SEQ ID NO: 1168908 - RNA, 19 nt, Homo sapiens
gaaggaugcugucccgaaa

SEQ ID NO: 1168909 - RNA, 19 nt, Homo sapiens
gaaagggaugguuuaaaua

SEQ ID NO: 1168910 - RNA, 19 nt, Homo sapiens
uaaaguugcucuucaugaa

SEQ ID NO: 1168911 - RNA, 19 nt, Homo sapiens
gaagagaaagcaacagauu

SEQ ID NO: 1168912 - RNA, 19 nt, Homo sapiens
gcaaacaaguacucugguu

SEQ ID NO: 1168913 - RNA, 19 nt, Homo sapiens
gagaguuccugacagcaua

SEQ ID NO: 1168914 - RNA, 19 nt, Homo sapiens
gacaagcccuucuuacaga

SEQ ID NO: 1168915 - RNA, 19 nt, Homo sapiens
uggcugaccuggauacaua

SEQ ID NO: 1168916 - RNA, 19 nt, Homo sapiens
gcuaacaucaucuuccuua

SEQ ID NO: 1168917 - RNA, 19 nt, Homo sapiens
gcaaauccauaucauacug

SEQ ID NO: 1168918 - RNA, 19 nt, Homo sapiens
ggugauacuucuaaacuau

SEQ ID NO: 1168919 - RNA, 19 nt, Homo sapiens
ccaugguucugaagauuua

SEQ ID NO: 1168920 - RNA, 19 nt, Homo sapiens
aauaaaugcugcuuccuuu

SEQ ID NO: 1168921 - RNA, 19 nt, Homo sapiens
gcuguagugugaaauauug

SEQ ID NO: 1168922 - RNA, 19 nt, Homo sapiens
ggcaaacacuuucaaauac

SEQ ID NO: 1168923 - RNA, 19 nt, Homo sapiens
gcaguaguaccuucuuuaa

SEQ ID NO: 1168924 - RNA, 19 nt, Homo sapiens
uaaagcauguugagaaagu

SEQ ID NO: 1168925 - RNA, 19 nt, Homo sapiens
uggcaaacacuuucaaaua

SEQ ID NO: 1168926 - RNA, 19 nt, Homo sapiens
guacucugguuaauaaaug

SEQ ID NO: 1168927 - RNA, 19 nt, Homo sapiens
gaauuggagcagauuguua

SEQ ID NO: 1168928 - RNA, 19 nt, Homo sapiens
gcaaacaaauuggugauac

SEQ ID NO: 1168929 - RNA, 19 nt, Homo sapiens
caaaguugcuaacaucauc

SEQ ID NO: 1168930 - RNA, 19 nt, Homo sapiens
aauaggauuuggaaccuua

SEQ ID NO: 1168931 - RNA, 19 nt, Homo sapiens
caugaagacuacagauauu

SEQ ID NO: 1168932 - RNA, 19 nt, Homo sapiens
ggaaucuuaugccuucauu

SEQ ID NO: 1168933 - RNA, 19 nt, Homo sapiens
caaacaaguacucugguua

SEQ ID NO: 1168934 - RNA, 19 nt, Homo sapiens
gcagugguaugcccaacaa

SEQ ID NO: 1168935 - RNA, 19 nt, Homo sapiens
gcaaacacuuucaaauacu

SEQ ID NO: 1168936 - RNA, 19 nt, Homo sapiens
guagaucacacaaauaaga

SEQ ID NO: 1168937 - RNA, 19 nt, Homo sapiens
gaaggugcgugaaacucaa

SEQ ID NO: 1168938 - RNA, 19 nt, Homo sapiens
uagcagaugucccuagaga

SEQ ID NO: 1168939 - RNA, 19 nt, Homo sapiens
gaacuccaauucaaagaac

SEQ ID NO: 1168940 - RNA, 19 nt, Homo sapiens
gagaguugcugcuacaucu

SEQ ID NO: 1168941 - RNA, 19 nt, Homo sapiens
ggagauguaguuucaagaa

SEQ ID NO: 1168942 - RNA, 19 nt, Homo sapiens
cauauaagcaggaauacuu

SEQ ID NO: 1168943 - RNA, 19 nt, Homo sapiens
aaaagaaucugcgguauuu

SEQ ID NO: 1168944 - RNA, 19 nt, Homo sapiens
aaacaaguacucugguuaa

SEQ ID NO: 1168945 - RNA, 19 nt, Homo sapiens
gaauacauauaagcaggaa

SEQ ID NO: 1168946 - RNA, 19 nt, Homo sapiens
ugaaagaauuggagcagau

SEQ ID NO: 1168947 - RNA, 19 nt, Homo sapiens
ccagaagucuagcagaugu

SEQ ID NO: 1168948 - RNA, 19 nt, Homo sapiens
gagaagagaaagcaacaga

SEQ ID NO: 1168949 - RNA, 19 nt, Homo sapiens
aaccagaguuuccuuagaa

SEQ ID NO: 1168950 - RNA, 19 nt, Homo sapiens
gauuaucugcaccuucuua

SEQ ID NO: 1168951 - RNA, 19 nt, Homo sapiens
ugugaaauauugucuggaa

SEQ ID NO: 1168952 - RNA, 19 nt, Homo sapiens
gaaagaauuggagcagauu

SEQ ID NO: 1168953 - RNA, 19 nt, Homo sapiens
acagcaaacugaaagaaau

SEQ ID NO: 1168954 - RNA, 19 nt, Homo sapiens
caaagaaugccacagaauc

SEQ ID NO: 1168955 - RNA, 19 nt, Homo sapiens
cugaagaaauguugacaau

SEQ ID NO: 1168956 - RNA, 19 nt, Homo sapiens
gaaccuauuauguagauca

SEQ ID NO: 1168957 - RNA, 19 nt, Homo sapiens
gaauuuggaaccuauuaug

SEQ ID NO: 1168958 - RNA, 19 nt, Homo sapiens
gaggcaugcuucagguauu

SEQ ID NO: 1168959 - RNA, 19 nt, Homo sapiens
gaaguuaguuuugcuguug

SEQ ID NO: 1168960 - RNA, 19 nt, Homo sapiens
gcagaugucccuagagagu

SEQ ID NO: 1168961 - RNA, 19 nt, Homo sapiens
gcauuuagcauggcucuga

SEQ ID NO: 1168962 - RNA, 19 nt, Homo sapiens
gaaauauugucuggaaagg

SEQ ID NO: 1168963 - RNA, 19 nt, Homo sapiens
gaaauaugaccacauucug

SEQ ID NO: 1168964 - RNA, 19 nt, Homo sapiens
gcugcuacaucuuuaggaa

SEQ ID NO: 1168965 - RNA, 19 nt, Homo sapiens
ggacuuuaacaccauauau

SEQ ID NO: 1168966 - RNA, 19 nt, Homo sapiens
ggaaggugcgugaaacuca

SEQ ID NO: 1168967 - RNA, 19 nt, Homo sapiens
cagcaguaguaccuucuuu

SEQ ID NO: 1168968 - RNA, 19 nt, Homo sapiens
ucuguggacuggacaauga

SEQ ID NO: 1168969 - RNA, 19 nt, Homo sapiens
caaccaugaucucuuccaa

SEQ ID NO: 1168970 - RNA, 19 nt, Homo sapiens
gaagacuacagauauuaug

SEQ ID NO: 1168971 - RNA, 19 nt, Homo sapiens
ccuuagaacuccaauucaa

SEQ ID NO: 1168972 - RNA, 19 nt, Homo sapiens
aagacgaacugauaucugu

SEQ ID NO: 1168973 - RNA, 19 nt, Homo sapiens
caaacacuuucaaauacug

SEQ ID NO: 1168974 - RNA, 19 nt, Homo sapiens
aagagaaagcaacagauua

SEQ ID NO: 1168975 - RNA, 19 nt, Homo sapiens
aauuagugcuguacauuug

SEQ ID NO: 1168976 - RNA, 19 nt, Homo sapiens
gaucaaccaccuccuguca

SEQ ID NO: 1168977 - RNA, 19 nt, Homo sapiens
auacaaccaugaucucuuc

SEQ ID NO: 1168978 - RNA, 19 nt, Homo sapiens
agagaaagcaacagauuau

SEQ ID NO: 1168979 - RNA, 19 nt, Homo sapiens
ggaacugaccagcgacuga

SEQ ID NO: 1168980 - RNA, 19 nt, Homo sapiens
caaacaaauuggugauacu

SEQ ID NO: 1168981 - RNA, 19 nt, Homo sapiens
gaguaugguucuucucagu

SEQ ID NO: 1168982 - RNA, 19 nt, Homo sapiens
guauuuaucacaggacuuu

SEQ ID NO: 1168983 - RNA, 19 nt, Homo sapiens
aaacgcagcggaaauguca

SEQ ID NO: 1168984 - RNA, 19 nt, Homo sapiens
ccaauauggcaaacacuuu

SEQ ID NO: 1168985 - RNA, 19 nt, Homo sapiens
acaaguacucugguuaaua

SEQ ID NO: 1168986 - RNA, 19 nt, Homo sapiens
guaugguucuucucaguca

SEQ ID NO: 1168987 - RNA, 19 nt, Homo sapiens
gaugcugucccgaaagaaa

SEQ ID NO: 1168988 - RNA, 19 nt, Homo sapiens
acucaaaguugcuaacauc

SEQ ID NO: 1168989 - RNA, 19 nt, Homo sapiens
gcauguugagaaaguauuu

SEQ ID NO: 1168990 - RNA, 19 nt, Homo sapiens
gggaacgaguugagucauc

SEQ ID NO: 1168991 - RNA, 19 nt, Homo sapiens
aaagaaugccacagaauca

SEQ ID NO: 1168992 - RNA, 19 nt, Homo sapiens
cacaugaagacuacagaua

SEQ ID NO: 1168993 - RNA, 19 nt, Homo sapiens
cauaauuagugcuguacau

SEQ ID NO: 1168994 - RNA, 19 nt, Homo sapiens
ugacaaccagggauucaaa

SEQ ID NO: 1168995 - RNA, 19 nt, Homo sapiens
uaaaugcugcuuccuuugu

SEQ ID NO: 1168996 - RNA, 19 nt, Homo sapiens
uaauaaaugcugcuuccuu

SEQ ID NO: 1168997 - RNA, 19 nt, Homo sapiens
aaauaugaccacauucuga

SEQ ID NO: 1168998 - RNA, 19 nt, Homo sapiens
gaguugcugcuacaucuuu

SEQ ID NO: 1168999 - RNA, 19 nt, Homo sapiens
caaauuggugauacuucua

SEQ ID NO: 1169000 - RNA, 19 nt, Homo sapiens
gugaaauauugucuggaaa

SEQ ID NO: 1169001 - RNA, 19 nt, Homo sapiens
ucaaccaccuccugucaca

SEQ ID NO: 1169002 - RNA, 19 nt, Homo sapiens
acaaauuggugauacuucu

SEQ ID NO: 1169003 - RNA, 19 nt, Homo sapiens
gggcugggcuccugucauu

SEQ ID NO: 1169004 - RNA, 19 nt, Homo sapiens
cauugagcaucauuucuua

SEQ ID NO: 1169005 - RNA, 19 nt, Homo sapiens
gaaguagaggugcaaauga

SEQ ID NO: 1169006 - RNA, 19 nt, Homo sapiens
gcaucgggaucuucuuuga

SEQ ID NO: 1169007 - RNA, 19 nt, Homo sapiens
ggcaggagcugaacaagag

SEQ ID NO: 1169008 - RNA, 19 nt, Homo sapiens
ggauguaacuccaaaauca

SEQ ID NO: 1169009 - RNA, 19 nt, Homo sapiens
gagcacggaucaccuacug

SEQ ID NO: 1169010 - RNA, 19 nt, Homo sapiens
ggaaguagaggugcaaaug

SEQ ID NO: 1169011 - RNA, 19 nt, Homo sapiens
gcauugagcaucauuucuu

SEQ ID NO: 1169012 - RNA, 19 nt, Homo sapiens
ccaugucacucaauaagga

SEQ ID NO: 1169013 - RNA, 19 nt, Homo sapiens
ggaagcaggcagugucuug

SEQ ID NO: 1169014 - RNA, 19 nt, Homo sapiens
gcugagagacaauggaaga

SEQ ID NO: 1169015 - RNA, 19 nt, Homo sapiens
gaugcuuccugccagauuc

SEQ ID NO: 1169016 - RNA, 19 nt, Homo sapiens
gcucccaccucguuaaagg

SEQ ID NO: 1169017 - RNA, 19 nt, Homo sapiens
aaaggugauuucccucuca

SEQ ID NO: 1169018 - RNA, 19 nt, Homo sapiens
ccucagagccugcuuugca

SEQ ID NO: 1169019 - RNA, 19 nt, Homo sapiens
caagagccuucaggagugu

SEQ ID NO: 1169020 - RNA, 19 nt, Homo sapiens
cagaagcccaggucuccua

SEQ ID NO: 1169021 - RNA, 19 nt, Homo sapiens
ucuuagagcuggaccacau

SEQ ID NO: 1169022 - RNA, 19 nt, Homo sapiens
ucagagcacggaucaccua

SEQ ID NO: 1169023 - RNA, 19 nt, Homo sapiens
gggcauugagcaucauuuc

SEQ ID NO: 1169024 - RNA, 19 nt, Homo sapiens
cucugaagcucaaggagaa

SEQ ID NO: 1169025 - RNA, 19 nt, Homo sapiens
ccuggcagaugaucaugau

SEQ ID NO: 1169026 - RNA, 19 nt, Homo sapiens
cggcaucgggaucuucuuu

SEQ ID NO: 1169027 - RNA, 19 nt, Homo sapiens
ccauguaggcucuguccuu

SEQ ID NO: 1169028 - RNA, 19 nt, Homo sapiens
aaguagaggugcaaaugag

SEQ ID NO: 1169029 - RNA, 19 nt, Homo sapiens
cggcugacgccauccauga

SEQ ID NO: 1169030 - RNA, 19 nt, Homo sapiens
ggcaugcucccaccucguu

SEQ ID NO: 1169031 - RNA, 19 nt, Homo sapiens
ggaugcuuccugccagauu

SEQ ID NO: 1169032 - RNA, 19 nt, Homo sapiens
ggcagaugaucaugauguc

SEQ ID NO: 1169033 - RNA, 19 nt, Homo sapiens
gcgcauguccuugaacagu

SEQ ID NO: 1169034 - RNA, 19 nt, Homo sapiens
gcaugcucccaccucguua

SEQ ID NO: 1169035 - RNA, 19 nt, Homo sapiens
uguucuaccuccucauuca

SEQ ID NO: 1169036 - RNA, 19 nt, Homo sapiens
cuacgcagguuugaguaca

SEQ ID NO: 1169037 - RNA, 19 nt, Homo sapiens
ccacgcacaccugagcuuu

SEQ ID NO: 1169038 - RNA, 19 nt, Homo sapiens
ggcccaggcugagagacaa

SEQ ID NO: 1169039 - RNA, 19 nt, Homo sapiens
gggcuggaauacccuucug

SEQ ID NO: 1169040 - RNA, 19 nt, Homo sapiens
ccagugauccaggugaguu

SEQ ID NO: 1169041 - RNA, 19 nt, Homo sapiens
ccugcagccuggcaucuuc

SEQ ID NO: 1169042 - RNA, 19 nt, Homo sapiens
uggcagaugaucaugaugu

SEQ ID NO: 1169043 - RNA, 19 nt, Homo sapiens
gagccugcuuugcaucacu

SEQ ID NO: 1169044 - RNA, 19 nt, Homo sapiens
ugaguucuguguggaugug

SEQ ID NO: 1169045 - RNA, 19 nt, Homo sapiens
ggacggcaucgggaucuuc

SEQ ID NO: 1169046 - RNA, 19 nt, Homo sapiens
gcgaauagaugcacuugaa

SEQ ID NO: 1169047 - RNA, 19 nt, Homo sapiens
ggacagacauagacuacaa

SEQ ID NO: 1169048 - RNA, 19 nt, Homo sapiens
ucuagaagcuucaauaaug

SEQ ID NO: 1169049 - RNA, 19 nt, Homo sapiens
ggaggaagggcacauauuu

SEQ ID NO: 1169050 - RNA, 19 nt, Homo sapiens
ggacagagagagcuuauug

SEQ ID NO: 1169051 - RNA, 19 nt, Homo sapiens
ucaagaaacuuauggaaag

SEQ ID NO: 1169052 - RNA, 19 nt, Homo sapiens
cgauuuacauugccacuaa

SEQ ID NO: 1169053 - RNA, 19 nt, Homo sapiens
gagaauccgcauaauauuu

SEQ ID NO: 1169054 - RNA, 19 nt, Homo sapiens
gggccaaucuucgucaaua

SEQ ID NO: 1169055 - RNA, 19 nt, Homo sapiens
gaauagaugcacuugaauu

SEQ ID NO: 1169056 - RNA, 19 nt, Homo sapiens
cagagaaucuacaagaaga

SEQ ID NO: 1169057 - RNA, 19 nt, Homo sapiens
gcaagaaauuugaugaaac

SEQ ID NO: 1169058 - RNA, 19 nt, Homo sapiens
gcugguuugucauucauua

SEQ ID NO: 1169059 - RNA, 19 nt, Homo sapiens
gagagcuuauugagucaua

SEQ ID NO: 1169060 - RNA, 19 nt, Homo sapiens
uaaagaaaccgcaacaugu

SEQ ID NO: 1169061 - RNA, 19 nt, Homo sapiens
ugagugauauguuucuuga

SEQ ID NO: 1169062 - RNA, 19 nt, Homo sapiens
aaagaaaccgcaacaugua

SEQ ID NO: 1169063 - RNA, 19 nt, Homo sapiens
cugaagauauugcaagaaa

SEQ ID NO: 1169064 - RNA, 19 nt, Homo sapiens
agaauacacugaagagaug

SEQ ID NO: 1169065 - RNA, 19 nt, Homo sapiens
augaagaccuuuaugauga

SEQ ID NO: 1169066 - RNA, 19 nt, Homo sapiens
cuagaagcuucaauaauga

SEQ ID NO: 1169067 - RNA, 19 nt, Homo sapiens
gaugaagaccuuuaugaug

SEQ ID NO: 1169068 - RNA, 19 nt, Homo sapiens
gagcuguacaguucucuua

SEQ ID NO: 1169069 - RNA, 19 nt, Homo sapiens
uaaaacaucugcuggauau

SEQ ID NO: 1169070 - RNA, 19 nt, Homo sapiens
cauaauuccuuccgugaga

SEQ ID NO: 1169071 - RNA, 19 nt, Homo sapiens
gugauuggauggaauugaa

SEQ ID NO: 1169072 - RNA, 19 nt, Homo sapiens
gcuguacaguucucuuaaa

SEQ ID NO: 1169073 - RNA, 19 nt, Homo sapiens
gaaaccgcaacauguauuu

SEQ ID NO: 1169074 - RNA, 19 nt, Homo sapiens
caaacugcaucccugagaa

SEQ ID NO: 1169075 - RNA, 19 nt, Homo sapiens
caagaaauuugaugaaacg

SEQ ID NO: 1169076 - RNA, 19 nt, Homo sapiens
aagagacacuuuauuggaa

SEQ ID NO: 1169077 - RNA, 19 nt, Homo sapiens
cugaggagcuguacaguuc

SEQ ID NO: 1169078 - RNA, 19 nt, Homo sapiens
gcgcugucguguacccuua

SEQ ID NO: 1169079 - RNA, 19 nt, Homo sapiens
ugauggagauagacucaaa

SEQ ID NO: 1169080 - RNA, 19 nt, Homo sapiens
uggaaaggcuacuaggaaa

SEQ ID NO: 1169081 - RNA, 19 nt, Homo sapiens
gauugcagauggacagaga

SEQ ID NO: 1169082 - RNA, 19 nt, Homo sapiens
cauucggacucuacauaua

SEQ ID NO: 1169083 - RNA, 19 nt, Homo sapiens
gauauugucuuugauccau

SEQ ID NO: 1169084 - RNA, 19 nt, Homo sapiens
gcaauggcgcugucgugua

SEQ ID NO: 1169085 - RNA, 19 nt, Homo sapiens
caauggcgcugucguguac

SEQ ID NO: 1169086 - RNA, 19 nt, Homo sapiens
aauaagacauugacacaag

SEQ ID NO: 1169087 - RNA, 19 nt, Homo sapiens
uggaaaaggugaagaaauu

SEQ ID NO: 1169088 - RNA, 19 nt, Homo sapiens
gaaagccauguuccuguuu

SEQ ID NO: 1169089 - RNA, 19 nt, Homo sapiens
gcacauauuuugaugcaau

SEQ ID NO: 1169090 - RNA, 19 nt, Homo sapiens
agacauagacuacaacaca

SEQ ID NO: 1169091 - RNA, 19 nt, Homo sapiens
gugaagaaauuugagaauc

SEQ ID NO: 1169092 - RNA, 19 nt, Homo sapiens
ugaguuaucaucugaguga

SEQ ID NO: 1169093 - RNA, 19 nt, Homo sapiens
uaucagagaaucuacaaga

SEQ ID NO: 1169094 - RNA, 19 nt, Homo sapiens
ggaugaagaccuuuaugau

SEQ ID NO: 1169095 - RNA, 19 nt, Homo sapiens
ggaccaguauucacaucug

SEQ ID NO: 1169096 - RNA, 19 nt, Homo sapiens
ugaagaaauuugagaaucg

SEQ ID NO: 1169097 - RNA, 19 nt, Homo sapiens
agaaagccauguuccuguu

SEQ ID NO: 1169098 - RNA, 19 nt, Homo sapiens
uuuggaggauuaugguuua

SEQ ID NO: 1169099 - RNA, 19 nt, Homo sapiens
ccugagaauccgcauaaua

SEQ ID NO: 1169100 - RNA, 19 nt, Homo sapiens
uagaugcacuugaauuucu

SEQ ID NO: 1169101 - RNA, 19 nt, Homo sapiens
ucaauaugguuuagagaag

SEQ ID NO: 1169102 - RNA, 19 nt, Homo sapiens
aaacaucugcuggauauau

SEQ ID NO: 1169103 - RNA, 19 nt, Homo sapiens
agcagaagcuuuccaguca

SEQ ID NO: 1169104 - RNA, 19 nt, Homo sapiens
gagaaguauuaccuugaug

SEQ ID NO: 1169105 - RNA, 19 nt, Homo sapiens
ugucauucauuauggcuaa

SEQ ID NO: 1169106 - RNA, 19 nt, Homo sapiens
gaugcugguuugucauuca

SEQ ID NO: 1169107 - RNA, 19 nt, Homo sapiens
agagacacuuuauuggaaa

SEQ ID NO: 1169108 - RNA, 19 nt, Homo sapiens
gagagagcuuauugaguca

SEQ ID NO: 1169109 - RNA, 19 nt, Homo sapiens
cugagaauccgcauaauau

SEQ ID NO: 1169110 - RNA, 19 nt, Homo sapiens
gcaggagcaucuggaguuc

SEQ ID NO: 1169111 - RNA, 19 nt, Homo sapiens
uauguuucuugaccuguua

SEQ ID NO: 1169112 - RNA, 19 nt, Homo sapiens
ucaucugagugauauguuu

SEQ ID NO: 1169113 - RNA, 19 nt, Homo sapiens
uuaaagaaaccgcaacaug

SEQ ID NO: 1169114 - RNA, 19 nt, Homo sapiens
uugaauuucugccauuuga

SEQ ID NO: 1169115 - RNA, 19 nt, Homo sapiens
ggccaaucuucgucaauau

SEQ ID NO: 1169116 - RNA, 19 nt, Homo sapiens
cacuuccacuucaugaaua

SEQ ID NO: 1169117 - RNA, 19 nt, Homo sapiens
gaugauccacuuccacuuc

SEQ ID NO: 1169118 - RNA, 19 nt, Homo sapiens
cagaauacacugaagagau

SEQ ID NO: 1169119 - RNA, 19 nt, Homo sapiens
agagaaguauuaccuugau

SEQ ID NO: 1169120 - RNA, 19 nt, Homo sapiens
uauggaugcugguuuguca

SEQ ID NO: 1169121 - RNA, 19 nt, Homo sapiens
gucaagaaacuuauggaaa

SEQ ID NO: 1169122 - RNA, 19 nt, Homo sapiens
gagaaucgggaccaguauu

SEQ ID NO: 1169123 - RNA, 19 nt, Homo sapiens
uuacugauccuccauaugg

SEQ ID NO: 1169124 - RNA, 19 nt, Homo sapiens
gaugugugauuggauggaa

SEQ ID NO: 1169125 - RNA, 19 nt, Homo sapiens
cuucaauaaugauguguga

SEQ ID NO: 1169126 - RNA, 19 nt, Homo sapiens
ugccaagucuauauuugaa

SEQ ID NO: 1169127 - RNA, 19 nt, Homo sapiens
caauaugguuuagagaagu

SEQ ID NO: 1169128 - RNA, 19 nt, Homo sapiens
gagauagacucaaaacagu

SEQ ID NO: 1169129 - RNA, 19 nt, Homo sapiens
ugaagaccuuuaugaugau

SEQ ID NO: 1169130 - RNA, 19 nt, Homo sapiens
gaauuucugccauuugaag

SEQ ID NO: 1169131 - RNA, 19 nt, Homo sapiens
aaacuacccuguggagaag

SEQ ID NO: 1169132 - RNA, 19 nt, Homo sapiens
ugucaucgauuuacauugc

SEQ ID NO: 1169133 - RNA, 19 nt, Homo sapiens
gauagacucaaaacaguua

SEQ ID NO: 1169134 - RNA, 19 nt, Homo sapiens
cagaagcuuuccagucaca

SEQ ID NO: 1169135 - RNA, 19 nt, Homo sapiens
gccuggaacucguuagcaa

SEQ ID NO: 1169136 - RNA, 19 nt, Homo sapiens
acaugaaggugaugaggau

SEQ ID NO: 1169137 - RNA, 19 nt, Homo sapiens
gagacacuuuauuggaaau

SEQ ID NO: 1169138 - RNA, 19 nt, Homo sapiens
ggaggauuaugguuuagac

SEQ ID NO: 1169139 - RNA, 19 nt, Homo sapiens
gacagugugugccaagucu

SEQ ID NO: 1169140 - RNA, 19 nt, Homo sapiens
ccaagucuauauuugaacu

SEQ ID NO: 1169141 - RNA, 19 nt, Homo sapiens
gugccaagucuauauuuga

SEQ ID NO: 1169142 - RNA, 19 nt, Homo sapiens
ccacuuccacuucaugaau

SEQ ID NO: 1169143 - RNA, 19 nt, Homo sapiens
ugaugaggaugaagaccuu

SEQ ID NO: 1169144 - RNA, 19 nt, Homo sapiens
ugucuuugauccauuuguu

SEQ ID NO: 1169145 - RNA, 19 nt, Homo sapiens
aacaucugcuggauauauu

SEQ ID NO: 1169146 - RNA, 19 nt, Homo sapiens
gaaaauagcucaucagaaa

SEQ ID NO: 1169147 - RNA, 19 nt, Homo sapiens
gaugaaagcugcugagaaa

SEQ ID NO: 1169148 - RNA, 19 nt, Homo sapiens
gaguaaagcuuuccaguuu

SEQ ID NO: 1169149 - RNA, 19 nt, Homo sapiens
guaguagucuuaagaguaa

SEQ ID NO: 1169150 - RNA, 19 nt, Homo sapiens
caauguagcugucaauuca

SEQ ID NO: 1169151 - RNA, 19 nt, Homo sapiens
gugaagcccuuaaagauuu

SEQ ID NO: 1169152 - RNA, 19 nt, Homo sapiens
acagauaggugcccuuuaa

SEQ ID NO: 1169153 - RNA, 19 nt, Homo sapiens
ugacaugaauuauggagua

SEQ ID NO: 1169154 - RNA, 19 nt, Homo sapiens
ggagggaaaucuagaacuu

SEQ ID NO: 1169155 - RNA, 19 nt, Homo sapiens
ggaggucucugauuucuuc

SEQ ID NO: 1169156 - RNA, 19 nt, Homo sapiens
gaaauugacagcacugauu

SEQ ID NO: 1169157 - RNA, 19 nt, Homo sapiens
ugacagcacugauuauguu

SEQ ID NO: 1169158 - RNA, 19 nt, Homo sapiens
guaaagcuuuccaguuuga

SEQ ID NO: 1169159 - RNA, 19 nt, Homo sapiens
ggaggcagaauuacgauua

SEQ ID NO: 1169160 - RNA, 19 nt, Homo sapiens
gggaaacccugcauucaau

SEQ ID NO: 1169161 - RNA, 19 nt, Homo sapiens
ggagagcgauacugcaaga

SEQ ID NO: 1169162 - RNA, 19 nt, Homo sapiens
gaauguaauuggaguaagu

SEQ ID NO: 1169163 - RNA, 19 nt, Homo sapiens
gaagagcuccuugguacua

SEQ ID NO: 1169164 - RNA, 19 nt, Homo sapiens
gaaaggccaccaagaagaa

SEQ ID NO: 1169165 - RNA, 19 nt, Homo sapiens
auaacgaccuugaauguaa

SEQ ID NO: 1169166 - RNA, 19 nt, Homo sapiens
ucacaugacugcugucuag

SEQ ID NO: 1169167 - RNA, 19 nt, Homo sapiens
gugaagagacuauuaaaug

SEQ ID NO: 1169168 - RNA, 19 nt, Homo sapiens
aagcagacauggaagagua

SEQ ID NO: 1169169 - RNA, 19 nt, Homo sapiens
ugucaacucugguuagaaa

SEQ ID NO: 1169170 - RNA, 19 nt, Homo sapiens
cgaauggguuauccaguaa

SEQ ID NO: 1169171 - RNA, 19 nt, Homo sapiens
gaaagaaauauccuggaaa

SEQ ID NO: 1169172 - RNA, 19 nt, Homo sapiens
ucgaauggguuauccagua

SEQ ID NO: 1169173 - RNA, 19 nt, Homo sapiens
agaaagaaauauccuggaa

SEQ ID NO: 1169174 - RNA, 19 nt, Homo sapiens
acuaggaggucucugauuu

SEQ ID NO: 1169175 - RNA, 19 nt, Homo sapiens
uaccaugagucuuggaaua

SEQ ID NO: 1169176 - RNA, 19 nt, Homo sapiens
ggacuggccuaguguuuac

SEQ ID NO: 1169177 - RNA, 19 nt, Homo sapiens
guacaccugucagcuguuu

SEQ ID NO: 1169178 - RNA, 19 nt, Homo sapiens
gcauaacgaccuugaaugu

SEQ ID NO: 1169179 - RNA, 19 nt, Homo sapiens
ggaaacgcuucuccagaug

SEQ ID NO: 1169180 - RNA, 19 nt, Homo sapiens
gaacccauuuccuugacuu

SEQ ID NO: 1169181 - RNA, 19 nt, Homo sapiens
gcauuucaguaguugcuuu

SEQ ID NO: 1169182 - RNA, 19 nt, Homo sapiens
caaagaauccgugaagaga

SEQ ID NO: 1169183 - RNA, 19 nt, Homo sapiens
gcauuugacuccuguagca

SEQ ID NO: 1169184 - RNA, 19 nt, Homo sapiens
cgaugguugugauuaauuu

SEQ ID NO: 1169185 - RNA, 19 nt, Homo sapiens
gcuuugguauucauguaua

SEQ ID NO: 1169186 - RNA, 19 nt, Homo sapiens
gaagagacuauuaaaugug

SEQ ID NO: 1169187 - RNA, 19 nt, Homo sapiens
ccucaggaguauucucuaa

SEQ ID NO: 1169188 - RNA, 19 nt, Homo sapiens
uuuaucaccuuucccauuu

SEQ ID NO: 1169189 - RNA, 19 nt, Homo sapiens
aaagaaauauccuggaaac

SEQ ID NO: 1169190 - RNA, 19 nt, Homo sapiens
aguauucucuaaccugaua

SEQ ID NO: 1169191 - RNA, 19 nt, Homo sapiens
guacaaagaauccgugaag

SEQ ID NO: 1169192 - RNA, 19 nt, Homo sapiens
gaccuugaauguaauugga

SEQ ID NO: 1169193 - RNA, 19 nt, Homo sapiens
gaggcagaauuacgauuau

SEQ ID NO: 1169194 - RNA, 19 nt, Homo sapiens
caaggacucugcgugcauu

SEQ ID NO: 1169195 - RNA, 19 nt, Homo sapiens
cauccuacuuucuagauug

SEQ ID NO: 1169196 - RNA, 19 nt, Homo sapiens
ggucucugauuucuucuug

SEQ ID NO: 1169197 - RNA, 19 nt, Homo sapiens
caugaauuauggaguagaa

SEQ ID NO: 1169198 - RNA, 19 nt, Homo sapiens
gaaacgcuucuccagauga

SEQ ID NO: 1169199 - RNA, 19 nt, Homo sapiens
gaugaucacgcaaagaaga

SEQ ID NO: 1169200 - RNA, 19 nt, Homo sapiens
aaauugacagcacugauua

SEQ ID NO: 1169201 - RNA, 19 nt, Homo sapiens
gagaagcauuuuccaauug

SEQ ID NO: 1169202 - RNA, 19 nt, Homo sapiens
gcaaaggagggaaaucuag

SEQ ID NO: 1169203 - RNA, 19 nt, Homo sapiens
ccacuucgaugguugugau

SEQ ID NO: 1169204 - RNA, 19 nt, Homo sapiens
ugacuccuguagcaauuaa

SEQ ID NO: 1169205 - RNA, 19 nt, Homo sapiens
uaacgaccuugaauguaau

SEQ ID NO: 1169206 - RNA, 19 nt, Homo sapiens
cuacauaauagcuuuggua

SEQ ID NO: 1169207 - RNA, 19 nt, Homo sapiens
aaagaagagcuccuuggua

SEQ ID NO: 1169208 - RNA, 19 nt, Homo sapiens
ggacagugacgagaaaugu

SEQ ID NO: 1169209 - RNA, 19 nt, Homo sapiens
gcacugugaagcccuuaaa

SEQ ID NO: 1169210 - RNA, 19 nt, Homo sapiens
cugucuagcugaugcauuu

SEQ ID NO: 1169211 - RNA, 19 nt, Homo sapiens
uagcuuugguauucaugua

SEQ ID NO: 1169212 - RNA, 19 nt, Homo sapiens
uagaugaucacgcaaagaa

SEQ ID NO: 1169213 - RNA, 19 nt, Homo sapiens
cagcacugauuauguuuca

SEQ ID NO: 1169214 - RNA, 19 nt, Homo sapiens
gaugaggcauaacgaccuu

SEQ ID NO: 1169215 - RNA, 19 nt, Homo sapiens
gcauccuacuuucuagauu

SEQ ID NO: 1169216 - RNA, 19 nt, Homo sapiens
ccaguugcagcaccauuua

SEQ ID NO: 1169217 - RNA, 19 nt, Homo sapiens
cuucgaugguugugauuaa

SEQ ID NO: 1169218 - RNA, 19 nt, Homo sapiens
uggaguaagugacaaaaua

SEQ ID NO: 1169219 - RNA, 19 nt, Homo sapiens
gcccagaacccauuuccuu

SEQ ID NO: 1169220 - RNA, 19 nt, Homo sapiens
cccacaagcuggcauuuca

SEQ ID NO: 1169221 - RNA, 19 nt, Homo sapiens
aaugaaaggccaccaagaa

SEQ ID NO: 1169222 - RNA, 19 nt, Homo sapiens
aaacgcuucuccagaugaa

SEQ ID NO: 1169223 - RNA, 19 nt, Homo sapiens
agacauggaagaguauaua

SEQ ID NO: 1169224 - RNA, 19 nt, Homo sapiens
gcuuuccaguuugaauuua

SEQ ID NO: 1169225 - RNA, 19 nt, Homo sapiens
gcacugauuauguuucauc

SEQ ID NO: 1169226 - RNA, 19 nt, Homo sapiens
caaaggagggaaaucuaga

SEQ ID NO: 1169227 - RNA, 19 nt, Homo sapiens
uaagaacuacccugggaaa

SEQ ID NO: 1169228 - RNA, 19 nt, Homo sapiens
ugaaaggccaccaagaaga

SEQ ID NO: 1169229 - RNA, 19 nt, Homo sapiens
guaauuggaguaagugaca

SEQ ID NO: 1169230 - RNA, 19 nt, Homo sapiens
ccagaacccauuuccuuga

SEQ ID NO: 1169231 - RNA, 19 nt, Homo sapiens
gcuccuugguacuaaagaa

SEQ ID NO: 1169232 - RNA, 19 nt, Homo sapiens
aaauagcucaucagaaaga

SEQ ID NO: 1169233 - RNA, 19 nt, Homo sapiens
gaagaguauauaugggaaa

SEQ ID NO: 1169234 - RNA, 19 nt, Homo sapiens
gcacgaguaguagucuuaa

SEQ ID NO: 1169235 - RNA, 19 nt, Homo sapiens
gagggaaaucuagaacuuu

SEQ ID NO: 1169236 - RNA, 19 nt, Homo sapiens
acaccuagccugccggaaa

SEQ ID NO: 1169237 - RNA, 19 nt, Homo sapiens
cauaacgaccuugaaugua

SEQ ID NO: 1169238 - RNA, 19 nt, Homo sapiens
ucaccuuucccauuucuuu

SEQ ID NO: 1169239 - RNA, 19 nt, Homo sapiens
uuacgauuaugcaguguau

SEQ ID NO: 1169240 - RNA, 19 nt, Homo sapiens
uaaggaggcagaauuacga

SEQ ID NO: 1169241 - RNA, 19 nt, Homo sapiens
aaacagauaggugcccuuu

SEQ ID NO: 1169242 - RNA, 19 nt, Homo sapiens
cgagaaaugugagaagcau

SEQ ID NO: 1169243 - RNA, 19 nt, Homo sapiens
gggccaagcuaccagaaaa

SEQ ID NO: 1169244 - RNA, 19 nt, Homo sapiens
ucacgcaaagaagaaauua

SEQ ID NO: 1169245 - RNA, 19 nt, Homo sapiens
agaaaggcacuaccuccua

SEQ ID NO: 1169246 - RNA, 19 nt, Homo sapiens
ggaauaaucugccuaaaua

SEQ ID NO: 1169247 - RNA, 19 nt, Homo sapiens
caaccaggcuccacauaaa

SEQ ID NO: 1169248 - RNA, 19 nt, Homo sapiens
gaccaggacuacaggguua

SEQ ID NO: 1169249 - RNA, 19 nt, Homo sapiens
gcaaugcacuccugaccaa

SEQ ID NO: 1169250 - RNA, 19 nt, Homo sapiens
guacuaagauugugcucaa

SEQ ID NO: 1169251 - RNA, 19 nt, Homo sapiens
agacuuaccuguguuauga

SEQ ID NO: 1169252 - RNA, 19 nt, Homo sapiens
cacauucacuuucaacuuu

SEQ ID NO: 1169253 - RNA, 19 nt, Homo sapiens
gaggacggcaugagacuua

SEQ ID NO: 1169254 - RNA, 19 nt, Homo sapiens
caagggauauggccacguu

SEQ ID NO: 1169255 - RNA, 19 nt, Homo sapiens
uauaauagacccauccuuu

SEQ ID NO: 1169256 - RNA, 19 nt, Homo sapiens
gcaaccaggcuccacauaa

SEQ ID NO: 1169257 - RNA, 19 nt, Homo sapiens
gcaugagacuuaccugugu

SEQ ID NO: 1169258 - RNA, 19 nt, Homo sapiens
gaaacacaguggagcgaau

SEQ ID NO: 1169259 - RNA, 19 nt, Homo sapiens
caaugaaccuugggucaga

SEQ ID NO: 1169260 - RNA, 19 nt, Homo sapiens
cccaggaaauggcuaaauu

SEQ ID NO: 1169261 - RNA, 19 nt, Homo sapiens
gcgaauguaucgagacaca

SEQ ID NO: 1169262 - RNA, 19 nt, Homo sapiens
gagcgaauguaucgagaca

SEQ ID NO: 1169263 - RNA, 19 nt, Homo sapiens
ggugagagacugaggaaga

SEQ ID NO: 1169264 - RNA, 19 nt, Homo sapiens
gaucacagacaccagcaaa

SEQ ID NO: 1169265 - RNA, 19 nt, Homo sapiens
gagagacugaggaagauaa

SEQ ID NO: 1169266 - RNA, 19 nt, Homo sapiens
gacauacagugaauuuaag

SEQ ID NO: 1169267 - RNA, 19 nt, Homo sapiens
uagagugcauuacuuugaa

SEQ ID NO: 1169268 - RNA, 19 nt, Homo sapiens
ccagguguauuccgaacuu

SEQ ID NO: 1169269 - RNA, 19 nt, Homo sapiens
cacauucuccuacaacuuu

SEQ ID NO: 1169270 - RNA, 19 nt, Homo sapiens
ccagaaagagggugagaga

SEQ ID NO: 1169271 - RNA, 19 nt, Homo sapiens
gcacugcugggacaccuuu

SEQ ID NO: 1169272 - RNA, 19 nt, Homo sapiens
ccagaagcuuggagcagaa

SEQ ID NO: 1169273 - RNA, 19 nt, Homo sapiens
ucacugcccgcaucuauga

SEQ ID NO: 1169274 - RNA, 19 nt, Homo sapiens
ccacccacauucacuuuca

SEQ ID NO: 1169275 - RNA, 19 nt, Homo sapiens
gccgaggacccgaagguua

SEQ ID NO: 1169276 - RNA, 19 nt, Homo sapiens
ggagcaaguucguguacag

SEQ ID NO: 1169277 - RNA, 19 nt, Homo sapiens
gcccugggauggacuagau

SEQ ID NO: 1169278 - RNA, 19 nt, Homo sapiens
ggaugggccucagucucua

SEQ ID NO: 1169279 - RNA, 19 nt, Homo sapiens
caauaaugacauacaguga

SEQ ID NO: 1169280 - RNA, 19 nt, Homo sapiens
gggccucagucucuaagga

SEQ ID NO: 1169281 - RNA, 19 nt, Homo sapiens
ccacauucacuuucaacuu

SEQ ID NO: 1169282 - RNA, 19 nt, Homo sapiens
ggccaaaauuucaauaaug

SEQ ID NO: 1169283 - RNA, 19 nt, Homo sapiens
cuacuaauccagcgacaau

SEQ ID NO: 1169284 - RNA, 19 nt, Homo sapiens
gcccugggaggucacuuua

SEQ ID NO: 1169285 - RNA, 19 nt, Homo sapiens
ugacgaauuucagcacugu

SEQ ID NO: 1169286 - RNA, 19 nt, Homo sapiens
gcuacgaagugaaaacaaa

SEQ ID NO: 1169287 - RNA, 19 nt, Homo sapiens
gcacagccaagaccugagu

SEQ ID NO: 1169288 - RNA, 19 nt, Homo sapiens
gugagagacugaggaagau

SEQ ID NO: 1169289 - RNA, 19 nt, Homo sapiens
aagccucacuucagaaaca

SEQ ID NO: 1169290 - RNA, 19 nt, Homo sapiens
uuagagugcauuacuuuga

SEQ ID NO: 1169291 - RNA, 19 nt, Homo sapiens
guacagccaaagagagcua

SEQ ID NO: 1169292 - RNA, 19 nt, Homo sapiens
caggaaauggcuaaauuca

SEQ ID NO: 1169293 - RNA, 19 nt, Homo sapiens
gagacuuaccuguguuaug

SEQ ID NO: 1169294 - RNA, 19 nt, Homo sapiens
caugagacuuaccuguguu

SEQ ID NO: 1169295 - RNA, 19 nt, Homo sapiens
cgauggauccacccacauu

SEQ ID NO: 1169296 - RNA, 19 nt, Homo sapiens
gcugugcuacgaagugaaa

SEQ ID NO: 1169297 - RNA, 19 nt, Homo sapiens
uggagcgcaugcacaauga

SEQ ID NO: 1169298 - RNA, 19 nt, Homo sapiens
uggaauaaucugccuaaau

SEQ ID NO: 1169299 - RNA, 19 nt, Homo sapiens
uaauagacccauccuuucu

SEQ ID NO: 1169300 - RNA, 19 nt, Homo sapiens
acuaauccagcgacaauuu

SEQ ID NO: 1169301 - RNA, 19 nt, Homo sapiens
gcuuggagcagaaagugaa

SEQ ID NO: 1169302 - RNA, 19 nt, Homo sapiens
ccaggaaauggcuaaauuc

SEQ ID NO: 1169303 - RNA, 19 nt, Homo sapiens
ugagauucuuccacugguu

SEQ ID NO: 1169304 - RNA, 19 nt, Homo sapiens
cuucagcugugcccaggaa

SEQ ID NO: 1169305 - RNA, 19 nt, Homo sapiens
acaccuggguccugcugaa

SEQ ID NO: 1169306 - RNA, 19 nt, Homo sapiens
caaaguguacaagggauau

SEQ ID NO: 1169307 - RNA, 19 nt, Homo sapiens
uaaguaccacccagagaug

SEQ ID NO: 1169308 - RNA, 19 nt, Homo sapiens
cagguguauuccgaacuua

SEQ ID NO: 1169309 - RNA, 19 nt, Homo sapiens
gcuccagacaaagaucuua

SEQ ID NO: 1169310 - RNA, 19 nt, Homo sapiens
gaauuucagcacuguugga

SEQ ID NO: 1169311 - RNA, 19 nt, Homo sapiens
augcacuccugaccaagua

SEQ ID NO: 1169312 - RNA, 19 nt, Homo sapiens
uagaugagcacagccaaga

SEQ ID NO: 1169313 - RNA, 19 nt, Homo sapiens
guggagcgcaugcacaaug

SEQ ID NO: 1169314 - RNA, 19 nt, Homo sapiens
acaaaguguacaagggaua

SEQ ID NO: 1169315 - RNA, 19 nt, Homo sapiens
gggccaaaauuucaauaau

SEQ ID NO: 1169316 - RNA, 19 nt, Homo sapiens
gauccacccacauucacuu

SEQ ID NO: 1169317 - RNA, 19 nt, Homo sapiens
uuucaaaccuacuaaucca

SEQ ID NO: 1169318 - RNA, 19 nt, Homo sapiens
cugaccaaguagauucuuu

SEQ ID NO: 1169319 - RNA, 19 nt, Homo sapiens
gaugggccucagucucuaa

SEQ ID NO: 1169320 - RNA, 19 nt, Homo sapiens
gaagcuuggagcagaaagu

SEQ ID NO: 1169321 - RNA, 19 nt, Homo sapiens
cagccaaagagagcuauuu

SEQ ID NO: 1169322 - RNA, 19 nt, Homo sapiens
ccugggaggucacuuuagg

SEQ ID NO: 1169323 - RNA, 19 nt, Homo sapiens
guagguagaggaauaaaau

SEQ ID NO: 1169324 - RNA, 19 nt, Homo sapiens
uaauccagcgacaauuuga

SEQ ID NO: 1169325 - RNA, 19 nt, Homo sapiens
cauccuuucucgucggaau

SEQ ID NO: 1169326 - RNA, 19 nt, Homo sapiens
cuaauccagcgacaauuug

SEQ ID NO: 1169327 - RNA, 19 nt, Homo sapiens
agggagggcuguccuaaaa

SEQ ID NO: 1169328 - RNA, 19 nt, Homo sapiens
gaccaaguagauucuuuua

SEQ ID NO: 1169329 - RNA, 19 nt, Homo sapiens
gcacuccugaccaaguaga

SEQ ID NO: 1169330 - RNA, 19 nt, Homo sapiens
gacacauucuccuacaacu

SEQ ID NO: 1169331 - RNA, 19 nt, Homo sapiens
agaaagagggugagagacu

SEQ ID NO: 1169332 - RNA, 19 nt, Homo sapiens
uuaaguaccacccagagau

SEQ ID NO: 1169333 - RNA, 19 nt, Homo sapiens
gaaggaugggccucagucu

SEQ ID NO: 1169334 - RNA, 19 nt, Homo sapiens
gaugaucaaggaagauguc

SEQ ID NO: 1169335 - RNA, 19 nt, Homo sapiens
auaauagacccauccuuuc

SEQ ID NO: 1169336 - RNA, 19 nt, Homo sapiens
cuucgcagccugugucaga

SEQ ID NO: 1169337 - RNA, 19 nt, Homo sapiens
acccagagaugagauucuu

SEQ ID NO: 1169338 - RNA, 19 nt, Homo sapiens
caccaucuccagcugauca

SEQ ID NO: 1169339 - RNA, 19 nt, Homo sapiens
ggccucagucucuaaggaa

SEQ ID NO: 1169340 - RNA, 19 nt, Homo sapiens
uauauuacugcacaucaug

SEQ ID NO: 1169341 - RNA, 19 nt, Homo sapiens
aaagagggugagagacuga

SEQ ID NO: 1169342 - RNA, 19 nt, Homo sapiens
agagugcauuacuuugaau

SEQ ID NO: 1169343 - RNA, 19 nt, Homo sapiens
gugagccugugcaucuuca

SEQ ID NO: 1169344 - RNA, 19 nt, Homo sapiens
cacgugagccugugcaucu

SEQ ID NO: 1169345 - RNA, 19 nt, Homo sapiens
cagcugugcccaggaaaug

SEQ ID NO: 1169346 - RNA, 19 nt, Homo sapiens
gaagauggauguuggcaaa

SEQ ID NO: 1169347 - RNA, 19 nt, Homo sapiens
ggaaguagauccagagaca

SEQ ID NO: 1169348 - RNA, 19 nt, Homo sapiens
ccagagagcuuuccuagca

SEQ ID NO: 1169349 - RNA, 19 nt, Homo sapiens
uaccucagcuaucuuguua

SEQ ID NO: 1169350 - RNA, 19 nt, Homo sapiens
gaacguaguaaaugucaaa

SEQ ID NO: 1169351 - RNA, 19 nt, Homo sapiens
cguaguaaaugucaaauca

SEQ ID NO: 1169352 - RNA, 19 nt, Homo sapiens
aaacuaggcaugcauauau

SEQ ID NO: 1169353 - RNA, 19 nt, Homo sapiens
ggacugagcgacugggaaa

SEQ ID NO: 1169354 - RNA, 19 nt, Homo sapiens
caacucaccggcacucuuu

SEQ ID NO: 1169355 - RNA, 19 nt, Homo sapiens
ccaagucggugaagaugga

SEQ ID NO: 1169356 - RNA, 19 nt, Homo sapiens
gcucaaggccuuuggcuau

SEQ ID NO: 1169357 - RNA, 19 nt, Homo sapiens
cagcgaagccugcgaguug

SEQ ID NO: 1169358 - RNA, 19 nt, Homo sapiens
ggaagggucuggguucaca

SEQ ID NO: 1169359 - RNA, 19 nt, Homo sapiens
gggcuugucugcguauuug

SEQ ID NO: 1169360 - RNA, 19 nt, Homo sapiens
ucacuuaccucagcuaucu

SEQ ID NO: 1169361 - RNA, 19 nt, Homo sapiens
gcaguuugguucaggacuu

SEQ ID NO: 1169362 - RNA, 19 nt, Homo sapiens
gaucacagcgcagcaggua

SEQ ID NO: 1169363 - RNA, 19 nt, Homo sapiens
caacagcacuugacuucac

SEQ ID NO: 1169364 - RNA, 19 nt, Homo sapiens
cuacccagcuuuugacuua

SEQ ID NO: 1169365 - RNA, 19 nt, Homo sapiens
ugagagagccaaacauuuc

SEQ ID NO: 1169366 - RNA, 19 nt, Homo sapiens
ggucuggguucacaacuca

SEQ ID NO: 1169367 - RNA, 19 nt, Homo sapiens
caggugacccuuugggaua

SEQ ID NO: 1169368 - RNA, 19 nt, Homo sapiens
ggacaaagugaaagaaguc

SEQ ID NO: 1169369 - RNA, 19 nt, Homo sapiens
gcugguggcuccucuugau

SEQ ID NO: 1169370 - RNA, 19 nt, Homo sapiens
guaaaugucaaaucaaugg

SEQ ID NO: 1169371 - RNA, 19 nt, Homo sapiens
gagagaaaauuccauguuc

SEQ ID NO: 1169372 - RNA, 19 nt, Homo sapiens
ugacuuaauugccauuugg

SEQ ID NO: 1169373 - RNA, 19 nt, Homo sapiens
uggcaucugugacaacuug

SEQ ID NO: 1169374 - RNA, 19 nt, Homo sapiens
uaaguugacacaucccuuu

SEQ ID NO: 1169375 - RNA, 19 nt, Homo sapiens
guugacacaucccuuuaug

SEQ ID NO: 1169376 - RNA, 19 nt, Homo sapiens
caacugagagagccaaaca

SEQ ID NO: 1169377 - RNA, 19 nt, Homo sapiens
ugccuuaggguaugaaaua

SEQ ID NO: 1169378 - RNA, 19 nt, Homo sapiens
gagcuuuccuagcauuuac

SEQ ID NO: 1169379 - RNA, 19 nt, Homo sapiens
acauggugguuaaggauaa

SEQ ID NO: 1169380 - RNA, 19 nt, Homo sapiens
ggaccaucguggacaaagu

SEQ ID NO: 1169381 - RNA, 19 nt, Homo sapiens
ggaaguaucaguggucaca

SEQ ID NO: 1169382 - RNA, 19 nt, Homo sapiens
ccucagcuaucuuguuauc

SEQ ID NO: 1169383 - RNA, 19 nt, Homo sapiens
caguuugguucaggacuua

SEQ ID NO: 1169384 - RNA, 19 nt, Homo sapiens
ugagagcacugagaguaga

SEQ ID NO: 1169385 - RNA, 19 nt, Homo sapiens
uggcaggacucugagguuu

SEQ ID NO: 1169386 - RNA, 19 nt, Homo sapiens
aaacucggcucuacaucuc

SEQ ID NO: 1169387 - RNA, 19 nt, Homo sapiens
gauggauguuggcaaaaua

SEQ ID NO: 1169388 - RNA, 19 nt, Homo sapiens
ggucucaguuucuuucaac

SEQ ID NO: 1169389 - RNA, 19 nt, Homo sapiens
ccacagccuuuaucucaac

SEQ ID NO: 1169390 - RNA, 19 nt, Homo sapiens
gagaguagaggugccuuga

SEQ ID NO: 1169391 - RNA, 19 nt, Homo sapiens
ugacacaucccuuuaugca

SEQ ID NO: 1169392 - RNA, 19 nt, Homo sapiens
agagagcuuuccuagcauu

SEQ ID NO: 1169393 - RNA, 19 nt, Homo sapiens
gcccaggucucaguuucuu

SEQ ID NO: 1169394 - RNA, 19 nt, Homo sapiens
gaguugaccugggauuucu

SEQ ID NO: 1169395 - RNA, 19 nt, Homo sapiens
ucacagcgcagcagguaga

SEQ ID NO: 1169396 - RNA, 19 nt, Homo sapiens
cuucuggugucaaagcuuu

SEQ ID NO: 1169397 - RNA, 19 nt, Homo sapiens
gccuuaggguaugaaauaa

SEQ ID NO: 1169398 - RNA, 19 nt, Homo sapiens
ccuggaacguaguaaaugu

SEQ ID NO: 1169399 - RNA, 19 nt, Homo sapiens
gaccugggauuucugucau

SEQ ID NO: 1169400 - RNA, 19 nt, Homo sapiens
caucguggacaaagugaaa

SEQ ID NO: 1169401 - RNA, 19 nt, Homo sapiens
gcugaugaaugggagaugu

SEQ ID NO: 1169402 - RNA, 19 nt, Homo sapiens
cagcuaucuuguuauccua

SEQ ID NO: 1169403 - RNA, 19 nt, Homo sapiens
ggaaggcccaggucucagu

SEQ ID NO: 1169404 - RNA, 19 nt, Homo sapiens
uuaugcaagugacagguaa

SEQ ID NO: 1169405 - RNA, 19 nt, Homo sapiens
agaauacccaugccacuga

SEQ ID NO: 1169406 - RNA, 19 nt, Homo sapiens
gguuaaggauaaagaucug

SEQ ID NO: 1169407 - RNA, 19 nt, Homo sapiens
gaaugggagauguggaaga

SEQ ID NO: 1169408 - RNA, 19 nt, Homo sapiens
ccuaaaucccgacagcuuu

SEQ ID NO: 1169409 - RNA, 19 nt, Homo sapiens
ucucauccuuucagcuuug

SEQ ID NO: 1169410 - RNA, 19 nt, Homo sapiens
gcagguagaccagcucaag

SEQ ID NO: 1169411 - RNA, 19 nt, Homo sapiens
ggaacguaguaaaugucaa

SEQ ID NO: 1169412 - RNA, 19 nt, Homo sapiens
gagguuuccugcagaccau

SEQ ID NO: 1169413 - RNA, 19 nt, Homo sapiens
ucaugggugucccucugua

SEQ ID NO: 1169414 - RNA, 19 nt, Homo sapiens
ugacccaguucugcacauu

SEQ ID NO: 1169415 - RNA, 19 nt, Homo sapiens
uaaaauugccuuaggguau

SEQ ID NO: 1169416 - RNA, 19 nt, Homo sapiens
ucugagagcacugagagua

SEQ ID NO: 1169417 - RNA, 19 nt, Homo sapiens
guucucauccuuucagcuu

SEQ ID NO: 1169418 - RNA, 19 nt, Homo sapiens
gagccaaacauuucuacag

SEQ ID NO: 1169419 - RNA, 19 nt, Homo sapiens
ccucuguucucauccuuuc

SEQ ID NO: 1169420 - RNA, 19 nt, Homo sapiens
cacccuugauggagagaaa

SEQ ID NO: 1169421 - RNA, 19 nt, Homo sapiens
gguuuccucuguucucauc

SEQ ID NO: 1169422 - RNA, 19 nt, Homo sapiens
gaccaucguggacaaagug

SEQ ID NO: 1169423 - RNA, 19 nt, Homo sapiens
ucaaggccuuuggcuaugu

SEQ ID NO: 1169424 - RNA, 19 nt, Homo sapiens
acccaguucugcacauuga

SEQ ID NO: 1169425 - RNA, 19 nt, Homo sapiens
ggagagaaaauuccauguu

SEQ ID NO: 1169426 - RNA, 19 nt, Homo sapiens
gaaauuuugugugcagaau

SEQ ID NO: 1169427 - RNA, 19 nt, Homo sapiens
gcaggacucugagguuucc

SEQ ID NO: 1169428 - RNA, 19 nt, Homo sapiens
caggagagcaagcaguguu

SEQ ID NO: 1169429 - RNA, 19 nt, Homo sapiens
gaaggcccaggucucaguu

SEQ ID NO: 1169430 - RNA, 19 nt, Homo sapiens
gcagaguugaccugggauu

SEQ ID NO: 1169431 - RNA, 19 nt, Homo sapiens
gaaaauuccauguucuugu

SEQ ID NO: 1169432 - RNA, 19 nt, Homo sapiens
gagagcuuuccuagcauuu

SEQ ID NO: 1169433 - RNA, 19 nt, Homo sapiens
gggaguuguugagaggauu

SEQ ID NO: 1169434 - RNA, 19 nt, Homo sapiens
cagcuguggucccagagau

SEQ ID NO: 1169435 - RNA, 19 nt, Homo sapiens
uggacaaagugaaagaagu

SEQ ID NO: 1169436 - RNA, 19 nt, Homo sapiens
ggugacccuuugggauaaa

SEQ ID NO: 1169437 - RNA, 19 nt, Homo sapiens
uuacugcaaugcccugucu

SEQ ID NO: 1169438 - RNA, 19 nt, Homo sapiens
cauggugguuaaggauaaa

SEQ ID NO: 1169439 - RNA, 19 nt, Homo sapiens
ccagaacggcuuuuagaaa

SEQ ID NO: 1169440 - RNA, 19 nt, Homo sapiens
acugagagagccaaacauu

SEQ ID NO: 1169441 - RNA, 19 nt, Homo sapiens
cuuaggguaugaaauaaac

SEQ ID NO: 1169442 - RNA, 19 nt, Homo sapiens
cuccacagccuuuaucuca

SEQ ID NO: 1169443 - RNA, 19 nt, Homo sapiens
ucagcuaucuuguuauccu

SEQ ID NO: 1169444 - RNA, 19 nt, Homo sapiens
gcaguggcaguuugguuca

SEQ ID NO: 1169445 - RNA, 19 nt, Homo sapiens
gggugucccucuguacuca

SEQ ID NO: 1169446 - RNA, 19 nt, Homo sapiens
gaaccaagcccaccacaua

SEQ ID NO: 1169447 - RNA, 19 nt, Homo sapiens
gaacgaggcuuucuuucug

SEQ ID NO: 1169448 - RNA, 19 nt, Homo sapiens
gaacaaacacggauuaauc

SEQ ID NO: 1169449 - RNA, 19 nt, Homo sapiens
gaaaggaauugacgguguu

SEQ ID NO: 1169450 - RNA, 19 nt, Homo sapiens
ggauuaaucugaauuguac

SEQ ID NO: 1169451 - RNA, 19 nt, Homo sapiens
cgaguagaauucaacguua

SEQ ID NO: 1169452 - RNA, 19 nt, Homo sapiens
gaguagaauucaacguuaa

SEQ ID NO: 1169453 - RNA, 19 nt, Homo sapiens
gaacagagucgguaucuac

SEQ ID NO: 1169454 - RNA, 19 nt, Homo sapiens
caucauuuccgguuuguua

SEQ ID NO: 1169455 - RNA, 19 nt, Homo sapiens
ucagcuggaugccaacuua

SEQ ID NO: 1169456 - RNA, 19 nt, Homo sapiens
gcacugaaaugaggcauag

SEQ ID NO: 1169457 - RNA, 19 nt, Homo sapiens
ggacaauguuggauuacug

SEQ ID NO: 1169458 - RNA, 19 nt, Homo sapiens
gcccauacauccuuccaaa

SEQ ID NO: 1169459 - RNA, 19 nt, Homo sapiens
gguaucuacucuccucaua

SEQ ID NO: 1169460 - RNA, 19 nt, Homo sapiens
aaacacggauuaaucugaa

SEQ ID NO: 1169461 - RNA, 19 nt, Homo sapiens
ggauaacacauucuacaaa

SEQ ID NO: 1169462 - RNA, 19 nt, Homo sapiens
gaggaacaaacacggauua

SEQ ID NO: 1169463 - RNA, 19 nt, Homo sapiens
gcauuaaccuggaacacau

SEQ ID NO: 1169464 - RNA, 19 nt, Homo sapiens
agacuuaacuggcuguguu

SEQ ID NO: 1169465 - RNA, 19 nt, Homo sapiens
gaugccaacuuaaauuugu

SEQ ID NO: 1169466 - RNA, 19 nt, Homo sapiens
uaaaugucauccucuguga

SEQ ID NO: 1169467 - RNA, 19 nt, Homo sapiens
ggaacaaacaacuuuauca

SEQ ID NO: 1169468 - RNA, 19 nt, Homo sapiens
ugaugcaggugguagauuu

SEQ ID NO: 1169469 - RNA, 19 nt, Homo sapiens
gaaaugaggcauagaugag

SEQ ID NO: 1169470 - RNA, 19 nt, Homo sapiens
caaacaacuuuaucagaag

SEQ ID NO: 1169471 - RNA, 19 nt, Homo sapiens
gaacaaacaacuuuaucag

SEQ ID NO: 1169472 - RNA, 19 nt, Homo sapiens
agucaugucugcagugaaa

SEQ ID NO: 1169473 - RNA, 19 nt, Homo sapiens
gcagaaacaucaggauaac

SEQ ID NO: 1169474 - RNA, 19 nt, Homo sapiens
gaacacagcaacacugaac

SEQ ID NO: 1169475 - RNA, 19 nt, Homo sapiens
gaaaccaccgaguagaauu

SEQ ID NO: 1169476 - RNA, 19 nt, Homo sapiens
aaagaaggcagaccucauu

SEQ ID NO: 1169477 - RNA, 19 nt, Homo sapiens
cuuagagucucaagucaaa

SEQ ID NO: 1169478 - RNA, 19 nt, Homo sapiens
cccaagaccuggacaaagu

SEQ ID NO: 1169479 - RNA, 19 nt, Homo sapiens
caaacacggauuaaucuga

SEQ ID NO: 1169480 - RNA, 19 nt, Homo sapiens
aaccaugauugaucgaaua

SEQ ID NO: 1169481 - RNA, 19 nt, Homo sapiens
gaagggagcgccuggugau

SEQ ID NO: 1169482 - RNA, 19 nt, Homo sapiens
ucacuuggagaauaagaua

SEQ ID NO: 1169483 - RNA, 19 nt, Homo sapiens
caaccaugauugaucgaau

SEQ ID NO: 1169484 - RNA, 19 nt, Homo sapiens
uaucuacucuccucauaca

SEQ ID NO: 1169485 - RNA, 19 nt, Homo sapiens
ggaugcugcuucccaagga

SEQ ID NO: 1169486 - RNA, 19 nt, Homo sapiens
gggaaaccaccgaguagaa

SEQ ID NO: 1169487 - RNA, 19 nt, Homo sapiens
gcugagaguugggacaaug

SEQ ID NO: 1169488 - RNA, 19 nt, Homo sapiens
uaucaucauuuccgguuug

SEQ ID NO: 1169489 - RNA, 19 nt, Homo sapiens
ugaaaugaggcauagauga

SEQ ID NO: 1169490 - RNA, 19 nt, Homo sapiens
gaauugacgguguuucugu

SEQ ID NO: 1169491 - RNA, 19 nt, Homo sapiens
ggaaugggacgguuaugca

SEQ ID NO: 1169492 - RNA, 19 nt, Homo sapiens
guguuucugucacuucuuu

SEQ ID NO: 1169493 - RNA, 19 nt, Homo sapiens
ggaaaccaccgaguagaau

SEQ ID NO: 1169494 - RNA, 19 nt, Homo sapiens
gaagcgcauuaaccuggaa

SEQ ID NO: 1169495 - RNA, 19 nt, Homo sapiens
gaggagauugggucagaaa

SEQ ID NO: 1169496 - RNA, 19 nt, Homo sapiens
gaagacggaaauucuguca

SEQ ID NO: 1169497 - RNA, 19 nt, Homo sapiens
uugggacaauguuggauua

SEQ ID NO: 1169498 - RNA, 19 nt, Homo sapiens
guguugaggcugaccuuua

SEQ ID NO: 1169499 - RNA, 19 nt, Homo sapiens
ggaacaaacacggauuaau

SEQ ID NO: 1169500 - RNA, 19 nt, Homo sapiens
uaugcuggauucucacuug

SEQ ID NO: 1169501 - RNA, 19 nt, Homo sapiens
aaagucaugucugcaguga

SEQ ID NO: 1169502 - RNA, 19 nt, Homo sapiens
aauguucuaucgcucguaa

SEQ ID NO: 1169503 - RNA, 19 nt, Homo sapiens
guuuguagauucccugauc

SEQ ID NO: 1169504 - RNA, 19 nt, Homo sapiens
cggauuaaucugaauugua

SEQ ID NO: 1169505 - RNA, 19 nt, Homo sapiens
gaauucaacguuaacuaca

SEQ ID NO: 1169506 - RNA, 19 nt, Homo sapiens
aagaggagauugggucaga

SEQ ID NO: 1169507 - RNA, 19 nt, Homo sapiens
gcagaggacagcagaagag

SEQ ID NO: 1169508 - RNA, 19 nt, Homo sapiens
caacacugaacgaggcuuu

SEQ ID NO: 1169509 - RNA, 19 nt, Homo sapiens
uuccaaagcucccaacuac

SEQ ID NO: 1169510 - RNA, 19 nt, Homo sapiens
uaaagggcuuggagcuugu

SEQ ID NO: 1169511 - RNA, 19 nt, Homo sapiens
agacggaaauucugucacu

SEQ ID NO: 1169512 - RNA, 19 nt, Homo sapiens
ucccugaucugcaauucuu

SEQ ID NO: 1169513 - RNA, 19 nt, Homo sapiens
gaaggcagaccucauucuc

SEQ ID NO: 1169514 - RNA, 19 nt, Homo sapiens
uaaacucuaggaaagauug

SEQ ID NO: 1169515 - RNA, 19 nt, Homo sapiens
ggaugccaacuuaaauuug

SEQ ID NO: 1169516 - RNA, 19 nt, Homo sapiens
uuucugaccuucgagauau

SEQ ID NO: 1169517 - RNA, 19 nt, Homo sapiens
gagggaaaccaccgaguag

SEQ ID NO: 1169518 - RNA, 19 nt, Homo sapiens
cuucgaggguaucaucauu

SEQ ID NO: 1169519 - RNA, 19 nt, Homo sapiens
gcacacuggaugaaucugu

SEQ ID NO: 1169520 - RNA, 19 nt, Homo sapiens
ggacugguaaugaggaaca

SEQ ID NO: 1169521 - RNA, 19 nt, Homo sapiens
gcucuccuuucuuccuuga

SEQ ID NO: 1169522 - RNA, 19 nt, Homo sapiens
uucuaucgcucguaaggua

SEQ ID NO: 1169523 - RNA, 19 nt, Homo sapiens
ugcagaaacaucaggauaa

SEQ ID NO: 1169524 - RNA, 19 nt, Homo sapiens
agagggaaaccaccgagua

SEQ ID NO: 1169525 - RNA, 19 nt, Homo sapiens
guaucaucauuuccgguuu

SEQ ID NO: 1169526 - RNA, 19 nt, Homo sapiens
ucgaggguaucaucauuuc

SEQ ID NO: 1169527 - RNA, 19 nt, Homo sapiens
guacucagaaggcuuugau

SEQ ID NO: 1169528 - RNA, 19 nt, Homo sapiens
ugaccugacugaggaagug

SEQ ID NO: 1169529 - RNA, 19 nt, Homo sapiens
ccgaguagaauucaacguu

SEQ ID NO: 1169530 - RNA, 19 nt, Homo sapiens
ccacgacaguccgguuugu

SEQ ID NO: 1169531 - RNA, 19 nt, Homo sapiens
uggaugccaacuuaaauuu

SEQ ID NO: 1169532 - RNA, 19 nt, Homo sapiens
gugaacacagcaacacuga

SEQ ID NO: 1169533 - RNA, 19 nt, Homo sapiens
gagaacagagucgguaucu

SEQ ID NO: 1169534 - RNA, 19 nt, Homo sapiens
gauccgggcucuggagaac

SEQ ID NO: 1169535 - RNA, 19 nt, Homo sapiens
caggauaacacauucuaca

SEQ ID NO: 1169536 - RNA, 19 nt, Homo sapiens
gcuggaugccaacuuaaau

SEQ ID NO: 1169537 - RNA, 19 nt, Homo sapiens
ugguauaauugcagaaaca

SEQ ID NO: 1169538 - RNA, 19 nt, Homo sapiens
ugaacgaggcuuucuuucu

SEQ ID NO: 1169539 - RNA, 19 nt, Homo sapiens
acaguccgguuuguagauu

SEQ ID NO: 1169540 - RNA, 19 nt, Homo sapiens
cgacccaugaagcgcauua

SEQ ID NO: 1169541 - RNA, 19 nt, Homo sapiens
ugaccaaugaccugacuga

SEQ ID NO: 1169542 - RNA, 19 nt, Homo sapiens
gagaguugggacaauguug

SEQ ID NO: 1169543 - RNA, 19 nt, Homo sapiens
gaaacaucaggauaacaca

SEQ ID NO: 1169544 - RNA, 19 nt, Homo sapiens
caaagucguggcccugugu

SEQ ID NO: 1169545 - RNA, 19 nt, Homo sapiens
uaugcacacuggaugaauc

SEQ ID NO: 1169546 - RNA, 19 nt, Homo sapiens
ggaaacaacuacagaauuu

SEQ ID NO: 1169547 - RNA, 19 nt, Homo sapiens
ggauauaacuccuuuagaa

SEQ ID NO: 1169548 - RNA, 19 nt, Homo sapiens
gaggugagcuugugacaga

SEQ ID NO: 1169549 - RNA, 19 nt, Homo sapiens
gagauacugugucuuuauu

SEQ ID NO: 1169550 - RNA, 19 nt, Homo sapiens
gauggaaucuaacaaacuu

SEQ ID NO: 1169551 - RNA, 19 nt, Homo sapiens
gcaggugugugucuuuauu

SEQ ID NO: 1169552 - RNA, 19 nt, Homo sapiens
ggagccagcuguuggacua

SEQ ID NO: 1169553 - RNA, 19 nt, Homo sapiens
ggagagaguucuucacuac

SEQ ID NO: 1169554 - RNA, 19 nt, Homo sapiens
gagaagagauacugugucu

SEQ ID NO: 1169555 - RNA, 19 nt, Homo sapiens
aaacacugauggaaucuaa

SEQ ID NO: 1169556 - RNA, 19 nt, Homo sapiens
gauaucaacuuagaaagga

SEQ ID NO: 1169557 - RNA, 19 nt, Homo sapiens
gaaagccugugcgagauuu

SEQ ID NO: 1169558 - RNA, 19 nt, Homo sapiens
cgggagagauuuacuuuga

SEQ ID NO: 1169559 - RNA, 19 nt, Homo sapiens
gaacaguuguguaaaucau

SEQ ID NO: 1169560 - RNA, 19 nt, Homo sapiens
auaaagagauggucacuca

SEQ ID NO: 1169561 - RNA, 19 nt, Homo sapiens
cuaacaaacuugagacaau

SEQ ID NO: 1169562 - RNA, 19 nt, Homo sapiens
ggaaauaacaguacaacag

SEQ ID NO: 1169563 - RNA, 19 nt, Homo sapiens
caacaacuaaugcaugaaa

SEQ ID NO: 1169564 - RNA, 19 nt, Homo sapiens
cuuggaaacucauggauuu

SEQ ID NO: 1169565 - RNA, 19 nt, Homo sapiens
ggaagguucucugacaaga

SEQ ID NO: 1169566 - RNA, 19 nt, Homo sapiens
gaacuaccuugcccgaaag

SEQ ID NO: 1169567 - RNA, 19 nt, Homo sapiens
gauacugugucuuuauugu

SEQ ID NO: 1169568 - RNA, 19 nt, Homo sapiens
caagauuauucgaagugua

SEQ ID NO: 1169569 - RNA, 19 nt, Homo sapiens
cagcuucaguguuuacuug

SEQ ID NO: 1169570 - RNA, 19 nt, Homo sapiens
caacuuauggaaacaacua

SEQ ID NO: 1169571 - RNA, 19 nt, Homo sapiens
ggaaagacauggucauccu

SEQ ID NO: 1169572 - RNA, 19 nt, Homo sapiens
acagauauguuuacagauc

SEQ ID NO: 1169573 - RNA, 19 nt, Homo sapiens
agaacuaccuugcccgaaa

SEQ ID NO: 1169574 - RNA, 19 nt, Homo sapiens
gcagauaauaaacuggaua

SEQ ID NO: 1169575 - RNA, 19 nt, Homo sapiens
ucaaaugucagccuggaua

SEQ ID NO: 1169576 - RNA, 19 nt, Homo sapiens
gugcaggugugugucuuua

SEQ ID NO: 1169577 - RNA, 19 nt, Homo sapiens
gauucuggaaguaguauua

SEQ ID NO: 1169578 - RNA, 19 nt, Homo sapiens
cgaaucagagcagauaaua

SEQ ID NO: 1169579 - RNA, 19 nt, Homo sapiens
aaaggauacucaaaccaaa

SEQ ID NO: 1169580 - RNA, 19 nt, Homo sapiens
ucccuagccuacauauuua

SEQ ID NO: 1169581 - RNA, 19 nt, Homo sapiens
ggagagauuuacuuugaac

SEQ ID NO: 1169582 - RNA, 19 nt, Homo sapiens
gaaucagagcagauaauaa

SEQ ID NO: 1169583 - RNA, 19 nt, Homo sapiens
ugaaaccagucgaaucaga

SEQ ID NO: 1169584 - RNA, 19 nt, Homo sapiens
gauggucacucaagcucaa

SEQ ID NO: 1169585 - RNA, 19 nt, Homo sapiens
ccugauaaccauugcauaa

SEQ ID NO: 1169586 - RNA, 19 nt, Homo sapiens
gggagagauuuacuuugaa

SEQ ID NO: 1169587 - RNA, 19 nt, Homo sapiens
gaaaggagcagaguaacag

SEQ ID NO: 1169588 - RNA, 19 nt, Homo sapiens
gaaagacauggucauccua

SEQ ID NO: 1169589 - RNA, 19 nt, Homo sapiens
uaucagcguuaacugcuuu

SEQ ID NO: 1169590 - RNA, 19 nt, Homo sapiens
ggagaucguuggguuucaa

SEQ ID NO: 1169591 - RNA, 19 nt, Homo sapiens
cgaaguguauacggacuaa

SEQ ID NO: 1169592 - RNA, 19 nt, Homo sapiens
ccaaaccgggagagauuua

SEQ ID NO: 1169593 - RNA, 19 nt, Homo sapiens
ucuugcagcuucaguguuu

SEQ ID NO: 1169594 - RNA, 19 nt, Homo sapiens
ggagcagaguaacagauau

SEQ ID NO: 1169595 - RNA, 19 nt, Homo sapiens
uuagaaaggagcagaguaa

SEQ ID NO: 1169596 - RNA, 19 nt, Homo sapiens
uaacuuuccugauaaccau

SEQ ID NO: 1169597 - RNA, 19 nt, Homo sapiens
gaaaagcaacuuauggaaa

SEQ ID NO: 1169598 - RNA, 19 nt, Homo sapiens
gacaagaucucgcuuuccu

SEQ ID NO: 1169599 - RNA, 19 nt, Homo sapiens
caugaaaccagucgaauca

SEQ ID NO: 1169600 - RNA, 19 nt, Homo sapiens
ugaauuagaccaaguuaag

SEQ ID NO: 1169601 - RNA, 19 nt, Homo sapiens
gagacaauucguuaucuug

SEQ ID NO: 1169602 - RNA, 19 nt, Homo sapiens
ggaaaacucugaggacaug

SEQ ID NO: 1169603 - RNA, 19 nt, Homo sapiens
acaauuguaucagcguuaa

SEQ ID NO: 1169604 - RNA, 19 nt, Homo sapiens
caaccaaggagggauauga

SEQ ID NO: 1169605 - RNA, 19 nt, Homo sapiens
gaaccagaguuuucuuaug

SEQ ID NO: 1169606 - RNA, 19 nt, Homo sapiens
gaaucuaacaaacuugaga

SEQ ID NO: 1169607 - RNA, 19 nt, Homo sapiens
cagagcagauaauaaacug

SEQ ID NO: 1169608 - RNA, 19 nt, Homo sapiens
ccacaaccaaggagggaua

SEQ ID NO: 1169609 - RNA, 19 nt, Homo sapiens
uuucagagaccaguaauaa

SEQ ID NO: 1169610 - RNA, 19 nt, Homo sapiens
gagcagaguaacagauaug

SEQ ID NO: 1169611 - RNA, 19 nt, Homo sapiens
gaacugugggucugucugu

SEQ ID NO: 1169612 - RNA, 19 nt, Homo sapiens
gagagcagagaaugagaaa

SEQ ID NO: 1169613 - RNA, 19 nt, Homo sapiens
agaaauugaaccagaguuu

SEQ ID NO: 1169614 - RNA, 19 nt, Homo sapiens
cagauauguuuacagauca

SEQ ID NO: 1169615 - RNA, 19 nt, Homo sapiens
cggagagaguucuucacua

SEQ ID NO: 1169616 - RNA, 19 nt, Homo sapiens
caccaaaccgggagagauu

SEQ ID NO: 1169617 - RNA, 19 nt, Homo sapiens
ugagacaauucguuaucuu

SEQ ID NO: 1169618 - RNA, 19 nt, Homo sapiens
caguggauauaacuccuuu

SEQ ID NO: 1169619 - RNA, 19 nt, Homo sapiens
gcugaaauugcuuccuuaa

SEQ ID NO: 1169620 - RNA, 19 nt, Homo sapiens
gccggaagguucucugaca

SEQ ID NO: 1169621 - RNA, 19 nt, Homo sapiens
caacaggaaauaacaguac

SEQ ID NO: 1169622 - RNA, 19 nt, Homo sapiens
aaacuacaauucccagcau

SEQ ID NO: 1169623 - RNA, 19 nt, Homo sapiens
gaagagcauuuuguccuuu

SEQ ID NO: 1169624 - RNA, 19 nt, Homo sapiens
ggugugugucuuuauuaua

SEQ ID NO: 1169625 - RNA, 19 nt, Homo sapiens
cacucaagcucaacaggaa

SEQ ID NO: 1169626 - RNA, 19 nt, Homo sapiens
agcguuaacugcuuuauca

SEQ ID NO: 1169627 - RNA, 19 nt, Homo sapiens
cuugaacaguuguguaaau

SEQ ID NO: 1169628 - RNA, 19 nt, Homo sapiens
gaccugguuugagauagaa

SEQ ID NO: 1169629 - RNA, 19 nt, Homo sapiens
gacaauucguuaucuugca

SEQ ID NO: 1169630 - RNA, 19 nt, Homo sapiens
ggauaucaacuuagaaagg

SEQ ID NO: 1169631 - RNA, 19 nt, Homo sapiens
gcaugaaaccagucgaauc

SEQ ID NO: 1169632 - RNA, 19 nt, Homo sapiens
agcaacaacuaaugcauga

SEQ ID NO: 1169633 - RNA, 19 nt, Homo sapiens
gagcagagaaugagaaaau

SEQ ID NO: 1169634 - RNA, 19 nt, Homo sapiens
gaggaaguguuuuagaaug

SEQ ID NO: 1169635 - RNA, 19 nt, Homo sapiens
gcauugggauuuuauagau

SEQ ID NO: 1169636 - RNA, 19 nt, Homo sapiens
uucccuagccuacauauuu

SEQ ID NO: 1169637 - RNA, 19 nt, Homo sapiens
agaccugguuugagauaga

SEQ ID NO: 1169638 - RNA, 19 nt, Homo sapiens
ggaaacucauggauuugac

SEQ ID NO: 1169639 - RNA, 19 nt, Homo sapiens
ggacuuggaaacucaugga

SEQ ID NO: 1169640 - RNA, 19 nt, Homo sapiens
gccuacauauuuauuacug

SEQ ID NO: 1169641 - RNA, 19 nt, Homo sapiens
caggugugugucuuuauua

SEQ ID NO: 1169642 - RNA, 19 nt, Homo sapiens
cuacacaagauuauucgaa

SEQ ID NO: 1169643 - RNA, 19 nt, Homo sapiens
uggaaacaacuacagaauu

SEQ ID NO: 1169644 - RNA, 19 nt, Homo sapiens
gacauggucauccuagaga

SEQ ID NO: 1169645 - RNA, 19 nt, Homo sapiens
aaacacaagcagaaacaau

SEQ ID NO: 1169646 - RNA, 19 nt, Homo sapiens
gaaacgaacucgcuuagaa

SEQ ID NO: 1169647 - RNA, 19 nt, Homo sapiens
ccaaagagaucaauacuga

SEQ ID NO: 1169648 - RNA, 19 nt, Homo sapiens
guacuaaucucucugaauu

SEQ ID NO: 1169649 - RNA, 19 nt, Homo sapiens
gaaauugccuggucaaauc

SEQ ID NO: 1169650 - RNA, 19 nt, Homo sapiens
guacuuuccuguagaguua

SEQ ID NO: 1169651 - RNA, 19 nt, Homo sapiens
guaaagauguugccaagau

SEQ ID NO: 1169652 - RNA, 19 nt, Homo sapiens
gaagcuggcuguucaguuc

SEQ ID NO: 1169653 - RNA, 19 nt, Homo sapiens
gaauguaaguuuggcgaua

SEQ ID NO: 1169654 - RNA, 19 nt, Homo sapiens
acagaaagaugccugaauu

SEQ ID NO: 1169655 - RNA, 19 nt, Homo sapiens
guacucaccuucagcaaga

SEQ ID NO: 1169656 - RNA, 19 nt, Homo sapiens
gaagcagauuggagagaua

SEQ ID NO: 1169657 - RNA, 19 nt, Homo sapiens
ccauggaguuggagaauaa

SEQ ID NO: 1169658 - RNA, 19 nt, Homo sapiens
gguuagagcuaguguaugu

SEQ ID NO: 1169659 - RNA, 19 nt, Homo sapiens
uacccgaucuucugacuua

SEQ ID NO: 1169660 - RNA, 19 nt, Homo sapiens
gaaagaugccugaauucaa

SEQ ID NO: 1169661 - RNA, 19 nt, Homo sapiens
guaguuggauuguacaaau

SEQ ID NO: 1169662 - RNA, 19 nt, Homo sapiens
uggcaaagcuauaggugua

SEQ ID NO: 1169663 - RNA, 19 nt, Homo sapiens
cagcuacucucaagucauu

SEQ ID NO: 1169664 - RNA, 19 nt, Homo sapiens
ggucugaauugcuguggua

SEQ ID NO: 1169665 - RNA, 19 nt, Homo sapiens
ccacaggaguugaugaaga

SEQ ID NO: 1169666 - RNA, 19 nt, Homo sapiens
ugaggagacuuaauuguau

SEQ ID NO: 1169667 - RNA, 19 nt, Homo sapiens
cugaagccauuaccauuua

SEQ ID NO: 1169668 - RNA, 19 nt, Homo sapiens
gaauugcugugguauuuag

SEQ ID NO: 1169669 - RNA, 19 nt, Homo sapiens
gcauugaguguccagauua

SEQ ID NO: 1169670 - RNA, 19 nt, Homo sapiens
caauguagcagauaaauca

SEQ ID NO: 1169671 - RNA, 19 nt, Homo sapiens
ucaugcaccugacucuuua

SEQ ID NO: 1169672 - RNA, 19 nt, Homo sapiens
ucagcuaguucacuuaauu

SEQ ID NO: 1169673 - RNA, 19 nt, Homo sapiens
ggagucagccuuacagaug

SEQ ID NO: 1169674 - RNA, 19 nt, Homo sapiens
gcacaaagucagaguuaau

SEQ ID NO: 1169675 - RNA, 19 nt, Homo sapiens
gcaaucgucuuaguacuca

SEQ ID NO: 1169676 - RNA, 19 nt, Homo sapiens
uaaagauguugccaagauu

SEQ ID NO: 1169677 - RNA, 19 nt, Homo sapiens
gaauauggaucagcuccuu

SEQ ID NO: 1169678 - RNA, 19 nt, Homo sapiens
gaucacaucaauuucauga

SEQ ID NO: 1169679 - RNA, 19 nt, Homo sapiens
gaauggcucccacuacuga

SEQ ID NO: 1169680 - RNA, 19 nt, Homo sapiens
gaaugaaggaguaaugaau

SEQ ID NO: 1169681 - RNA, 19 nt, Homo sapiens
ucacguggaucacaucaau

SEQ ID NO: 1169682 - RNA, 19 nt, Homo sapiens
gcagagaaggauaugaauu

SEQ ID NO: 1169683 - RNA, 19 nt, Homo sapiens
ucacaucaauuucaugaag

SEQ ID NO: 1169684 - RNA, 19 nt, Homo sapiens
gugauaugcugaagauuuc

SEQ ID NO: 1169685 - RNA, 19 nt, Homo sapiens
ucacaaacaggaaccagua

SEQ ID NO: 1169686 - RNA, 19 nt, Homo sapiens
gggcuuccuuugcaaugua

SEQ ID NO: 1169687 - RNA, 19 nt, Homo sapiens
cugaauugcugugguauuu

SEQ ID NO: 1169688 - RNA, 19 nt, Homo sapiens
ggaacuauauacccucgau

SEQ ID NO: 1169689 - RNA, 19 nt, Homo sapiens
guaauguaguuggauugua

SEQ ID NO: 1169690 - RNA, 19 nt, Homo sapiens
aguagucgcuccuuaguga

SEQ ID NO: 1169691 - RNA, 19 nt, Homo sapiens
ugugaggacuguauucuga

SEQ ID NO: 1169692 - RNA, 19 nt, Homo sapiens
gaauuguaauguaguugga

SEQ ID NO: 1169693 - RNA, 19 nt, Homo sapiens
gagucagccuuacagauga

SEQ ID NO: 1169694 - RNA, 19 nt, Homo sapiens
cagguuagcucaggagaga

SEQ ID NO: 1169695 - RNA, 19 nt, Homo sapiens
gaagauuuccaggcaguuu

SEQ ID NO: 1169696 - RNA, 19 nt, Homo sapiens
caaacaggaaccaguauug

SEQ ID NO: 1169697 - RNA, 19 nt, Homo sapiens
aaagaugccugaauucaac

SEQ ID NO: 1169698 - RNA, 19 nt, Homo sapiens
ccaagauucuguggucauu

SEQ ID NO: 1169699 - RNA, 19 nt, Homo sapiens
uaugggagaugaauaugga

SEQ ID NO: 1169700 - RNA, 19 nt, Homo sapiens
agaaguguuugauuccuuu

SEQ ID NO: 1169701 - RNA, 19 nt, Homo sapiens
gcucuaaucaagcaccaua

SEQ ID NO: 1169702 - RNA, 19 nt, Homo sapiens
guauacauguuacucuuag

SEQ ID NO: 1169703 - RNA, 19 nt, Homo sapiens
cagagaaggauaugaauuc

SEQ ID NO: 1169704 - RNA, 19 nt, Homo sapiens
ggcauugaguguccagauu

SEQ ID NO: 1169705 - RNA, 19 nt, Homo sapiens
guggcacacugucgaagua

SEQ ID NO: 1169706 - RNA, 19 nt, Homo sapiens
agauacagcucuuugauac

SEQ ID NO: 1169707 - RNA, 19 nt, Homo sapiens
guucacagcuauaaugcau

SEQ ID NO: 1169708 - RNA, 19 nt, Homo sapiens
uguaagauaccgagcauuu

SEQ ID NO: 1169709 - RNA, 19 nt, Homo sapiens
uaauguaguuggauuguac

SEQ ID NO: 1169710 - RNA, 19 nt, Homo sapiens
ggacugcacaauaugaaga

SEQ ID NO: 1169711 - RNA, 19 nt, Homo sapiens
cauuuggaacucugaauua

SEQ ID NO: 1169712 - RNA, 19 nt, Homo sapiens
ucuccaggcucaagucauu

SEQ ID NO: 1169713 - RNA, 19 nt, Homo sapiens
cacauuagccucugccauu

SEQ ID NO: 1169714 - RNA, 19 nt, Homo sapiens
aaacgaacucgcuuagaaa

SEQ ID NO: 1169715 - RNA, 19 nt, Homo sapiens
aauuaaggcuugagcaugu

SEQ ID NO: 1169716 - RNA, 19 nt, Homo sapiens
uggcugaucucuggaggua

SEQ ID NO: 1169717 - RNA, 19 nt, Homo sapiens
gaagaggacguagaagugu

SEQ ID NO: 1169718 - RNA, 19 nt, Homo sapiens
cuaaucaagcaccauauaa

SEQ ID NO: 1169719 - RNA, 19 nt, Homo sapiens
ccuguagaguuaauugauu

SEQ ID NO: 1169720 - RNA, 19 nt, Homo sapiens
aagauucuguggucauuug

SEQ ID NO: 1169721 - RNA, 19 nt, Homo sapiens
acuaaucucucugaauuug

SEQ ID NO: 1169722 - RNA, 19 nt, Homo sapiens
ggacaggacccuccagaac

SEQ ID NO: 1169723 - RNA, 19 nt, Homo sapiens
uuagagcuaguguauguua

SEQ ID NO: 1169724 - RNA, 19 nt, Homo sapiens
gaggagacuuaauuguauc

SEQ ID NO: 1169725 - RNA, 19 nt, Homo sapiens
aauguaaguuuggcgauaa

SEQ ID NO: 1169726 - RNA, 19 nt, Homo sapiens
ugugauaugcugaagauuu

SEQ ID NO: 1169727 - RNA, 19 nt, Homo sapiens
ggaaagcaagaggacauuu

SEQ ID NO: 1169728 - RNA, 19 nt, Homo sapiens
uagcagagaaggauaugaa

SEQ ID NO: 1169729 - RNA, 19 nt, Homo sapiens
ggaguacuuuccuguagag

SEQ ID NO: 1169730 - RNA, 19 nt, Homo sapiens
ggagguugguaccaucugu

SEQ ID NO: 1169731 - RNA, 19 nt, Homo sapiens
ucucagcuccugucuguuu

SEQ ID NO: 1169732 - RNA, 19 nt, Homo sapiens
ccacccagguuuggaauuc

SEQ ID NO: 1169733 - RNA, 19 nt, Homo sapiens
gcagugcccacccagguuu

SEQ ID NO: 1169734 - RNA, 19 nt, Homo sapiens
guuaagaacauauguagca

SEQ ID NO: 1169735 - RNA, 19 nt, Homo sapiens
ccuuacagaugauuugaug

SEQ ID NO: 1169736 - RNA, 19 nt, Homo sapiens
ucaaaucugugaggacugu

SEQ ID NO: 1169737 - RNA, 19 nt, Homo sapiens
guacaaauuacugcaaaug

SEQ ID NO: 1169738 - RNA, 19 nt, Homo sapiens
gagacuuaauuguauccaa

SEQ ID NO: 1169739 - RNA, 19 nt, Homo sapiens
ugaagccauuaccauuuaa

SEQ ID NO: 1169740 - RNA, 19 nt, Homo sapiens
gccuuacgcuuccugaaug

SEQ ID NO: 1169741 - RNA, 19 nt, Homo sapiens
gauagcuccucagcgaauu

SEQ ID NO: 1169742 - RNA, 19 nt, Homo sapiens
caaguacuaaucucucuga

SEQ ID NO: 1169743 - RNA, 19 nt, Homo sapiens
gucaagcaccauaugauuu

SEQ ID NO: 1169744 - RNA, 19 nt, Homo sapiens
uguaugagaccaaguguug

SEQ ID NO: 1169745 - RNA, 19 nt, Homo sapiens
ucaagcaccauauaaacaa

SEQ ID NO: 1169746 - RNA, 19 nt, Homo sapiens
gaaaggaagugcaaguuaa

SEQ ID NO: 1169747 - RNA, 19 nt, Homo sapiens
gaagaaggcaccagagaua

SEQ ID NO: 1169748 - RNA, 19 nt, Homo sapiens
ggaaagccauccugcauca

SEQ ID NO: 1169749 - RNA, 19 nt, Homo sapiens
uaagaaaccacaagaauga

SEQ ID NO: 1169750 - RNA, 19 nt, Homo sapiens
gaaugagggugaacugaug

SEQ ID NO: 1169751 - RNA, 19 nt, Homo sapiens
gauguaaccuugcucuguu

SEQ ID NO: 1169752 - RNA, 19 nt, Homo sapiens
cuauagcgcuuaacauaaa

SEQ ID NO: 1169753 - RNA, 19 nt, Homo sapiens
ggaaugggauccagcuuca

SEQ ID NO: 1169754 - RNA, 19 nt, Homo sapiens
gauuuaagcucuggacuau

SEQ ID NO: 1169755 - RNA, 19 nt, Homo sapiens
gacuauagcgcuuaacaua

SEQ ID NO: 1169756 - RNA, 19 nt, Homo sapiens
uaaauagagucaaccaaug

SEQ ID NO: 1169757 - RNA, 19 nt, Homo sapiens
ccugaaagcuuaucauauc

SEQ ID NO: 1169758 - RNA, 19 nt, Homo sapiens
gcagagaggccuugaggaa

SEQ ID NO: 1169759 - RNA, 19 nt, Homo sapiens
caagagagcuuuggaugca

SEQ ID NO: 1169760 - RNA, 19 nt, Homo sapiens
ggauccagcuucauuaugg

SEQ ID NO: 1169761 - RNA, 19 nt, Homo sapiens
gaaagcuuaucauauccaa

SEQ ID NO: 1169762 - RNA, 19 nt, Homo sapiens
guaaauagagucaaccaau

SEQ ID NO: 1169763 - RNA, 19 nt, Homo sapiens
ggagacccuuguagaagaa

SEQ ID NO: 1169764 - RNA, 19 nt, Homo sapiens
gagaguggugggaagauua

SEQ ID NO: 1169765 - RNA, 19 nt, Homo sapiens
uaacaaggcaggacagaug

SEQ ID NO: 1169766 - RNA, 19 nt, Homo sapiens
ugaauucacuccugcuuuc

SEQ ID NO: 1169767 - RNA, 19 nt, Homo sapiens
gugguagccuugccuauga

SEQ ID NO: 1169768 - RNA, 19 nt, Homo sapiens
agaagaauguggagagaau

SEQ ID NO: 1169769 - RNA, 19 nt, Homo sapiens
agaaaggaagugcaaguua

SEQ ID NO: 1169770 - RNA, 19 nt, Homo sapiens
gaaaggagugcugcgauga

SEQ ID NO: 1169771 - RNA, 19 nt, Homo sapiens
gaaacaaauggauaacaga

SEQ ID NO: 1169772 - RNA, 19 nt, Homo sapiens
uggaguugcugaagcuaua

SEQ ID NO: 1169773 - RNA, 19 nt, Homo sapiens
gaccucagccuagauguaa

SEQ ID NO: 1169774 - RNA, 19 nt, Homo sapiens
gagcuggagcgaguaaaua

SEQ ID NO: 1169775 - RNA, 19 nt, Homo sapiens
ggauuuaagcucuggacua

SEQ ID NO: 1169776 - RNA, 19 nt, Homo sapiens
caagaaaaguaucguggua

SEQ ID NO: 1169777 - RNA, 19 nt, Homo sapiens
caaagacaauacagagagu

SEQ ID NO: 1169778 - RNA, 19 nt, Homo sapiens
cgaaauaaagcaaagacaa

SEQ ID NO: 1169779 - RNA, 19 nt, Homo sapiens
guagaagaauguggagaga

SEQ ID NO: 1169780 - RNA, 19 nt, Homo sapiens
ugaaacaaauggauaacag

SEQ ID NO: 1169781 - RNA, 19 nt, Homo sapiens
gaaacacgacagugagaug

SEQ ID NO: 1169782 - RNA, 19 nt, Homo sapiens
ggaccucagccuagaugua

SEQ ID NO: 1169783 - RNA, 19 nt, Homo sapiens
caaaagacuucgagauaga

SEQ ID NO: 1169784 - RNA, 19 nt, Homo sapiens
gaagaauguggagagaaua

SEQ ID NO: 1169785 - RNA, 19 nt, Homo sapiens
ggagugcugcgaugaagaa

SEQ ID NO: 1169786 - RNA, 19 nt, Homo sapiens
gaaaccacaagaaugagaa

SEQ ID NO: 1169787 - RNA, 19 nt, Homo sapiens
uuuaagcucuggacuauag

SEQ ID NO: 1169788 - RNA, 19 nt, Homo sapiens
cagugaaggugucugaaug

SEQ ID NO: 1169789 - RNA, 19 nt, Homo sapiens
gagaauagagaaaggaagu

SEQ ID NO: 1169790 - RNA, 19 nt, Homo sapiens
uaucggcgcugcaagcaau

SEQ ID NO: 1169791 - RNA, 19 nt, Homo sapiens
ggaaguggcccagcagugu

SEQ ID NO: 1169792 - RNA, 19 nt, Homo sapiens
guaaugaauaguggcaaua

SEQ ID NO: 1169793 - RNA, 19 nt, Homo sapiens
cuagagaacagaaucagaa

SEQ ID NO: 1169794 - RNA, 19 nt, Homo sapiens
gagaaaggaagugcaaguu

SEQ ID NO: 1169795 - RNA, 19 nt, Homo sapiens
uagagucaaccaaugcuua

SEQ ID NO: 1169796 - RNA, 19 nt, Homo sapiens
aagauaagauggaagaaac

SEQ ID NO: 1169797 - RNA, 19 nt, Homo sapiens
gaaugagaaaccggaauuu

SEQ ID NO: 1169798 - RNA, 19 nt, Homo sapiens
gcgcuuaacauaaacaaca

SEQ ID NO: 1169799 - RNA, 19 nt, Homo sapiens
ucaaggagauggaaaacaa

SEQ ID NO: 1169800 - RNA, 19 nt, Homo sapiens
cagcuugccaggaucauaa

SEQ ID NO: 1169801 - RNA, 19 nt, Homo sapiens
uggagacccuuguagaaga

SEQ ID NO: 1169802 - RNA, 19 nt, Homo sapiens
gcagugaaggugucugaau

SEQ ID NO: 1169803 - RNA, 19 nt, Homo sapiens
gcuauaagaaaccacaaga

SEQ ID NO: 1169804 - RNA, 19 nt, Homo sapiens
aaaggaagugcaaguuaaa

SEQ ID NO: 1169805 - RNA, 19 nt, Homo sapiens
gagagaauagagaaaggaa

SEQ ID NO: 1169806 - RNA, 19 nt, Homo sapiens
agagaggccuugaggaagu

SEQ ID NO: 1169807 - RNA, 19 nt, Homo sapiens
uagguuuggugcuuucauu

SEQ ID NO: 1169808 - RNA, 19 nt, Homo sapiens
gcacagauaaagaacaaac

SEQ ID NO: 1169809 - RNA, 19 nt, Homo sapiens
gcgaguaaauagagucaac

SEQ ID NO: 1169810 - RNA, 19 nt, Homo sapiens
gcagugugcuugcguuucc

SEQ ID NO: 1169811 - RNA, 19 nt, Homo sapiens
guuuggugcuuucauuaga

SEQ ID NO: 1169812 - RNA, 19 nt, Homo sapiens
caggaggacugggaaagga

SEQ ID NO: 1169813 - RNA, 19 nt, Homo sapiens
gcgcaaagagcgaaauuuu

SEQ ID NO: 1169814 - RNA, 19 nt, Homo sapiens
ugaaaagucuggcuacuag

SEQ ID NO: 1169815 - RNA, 19 nt, Homo sapiens
ugagaguggugggaagauu

SEQ ID NO: 1169816 - RNA, 19 nt, Homo sapiens
ccagucagacaaagaagaa

SEQ ID NO: 1169817 - RNA, 19 nt, Homo sapiens
gaaaacaaacugccuaugg

SEQ ID NO: 1169818 - RNA, 19 nt, Homo sapiens
cauccugcaucaacuagug

SEQ ID NO: 1169819 - RNA, 19 nt, Homo sapiens
ggaacaagugcaacucaca

SEQ ID NO: 1169820 - RNA, 19 nt, Homo sapiens
agaaugagaaaccggaauu

SEQ ID NO: 1169821 - RNA, 19 nt, Homo sapiens
ggaaaaguuugaacgaagu

SEQ ID NO: 1169822 - RNA, 19 nt, Homo sapiens
ggacacaaagagagcacuu

SEQ ID NO: 1169823 - RNA, 19 nt, Homo sapiens
caaaagcgagaacaaaauu

SEQ ID NO: 1169824 - RNA, 19 nt, Homo sapiens
ccacucaguccugcgcuua

SEQ ID NO: 1169825 - RNA, 19 nt, Homo sapiens
aaaguuuggcucuucguuu

SEQ ID NO: 1169826 - RNA, 19 nt, Homo sapiens
gaaggcaccagagauaucu

SEQ ID NO: 1169827 - RNA, 19 nt, Homo sapiens
ggagagaauagagaaagga

SEQ ID NO: 1169828 - RNA, 19 nt, Homo sapiens
ccucugagcccaucuuugg

SEQ ID NO: 1169829 - RNA, 19 nt, Homo sapiens
auaagaaaccacaagaaug

SEQ ID NO: 1169830 - RNA, 19 nt, Homo sapiens
cugccaaagugacaaaugu

SEQ ID NO: 1169831 - RNA, 19 nt, Homo sapiens
uauggagacccuuguagaa

SEQ ID NO: 1169832 - RNA, 19 nt, Homo sapiens
gagaggccuugaggaagug

SEQ ID NO: 1169833 - RNA, 19 nt, Homo sapiens
ggacuauagcgcuuaacau

SEQ ID NO: 1169834 - RNA, 19 nt, Homo sapiens
aaaacaaacugccuaugga

SEQ ID NO: 1169835 - RNA, 19 nt, Homo sapiens
aaguuuggcucuucguuuc

SEQ ID NO: 1169836 - RNA, 19 nt, Homo sapiens
gcucccgguugcuugugua

SEQ ID NO: 1169837 - RNA, 19 nt, Homo sapiens
uaugaccccugaaagcuua

SEQ ID NO: 1169838 - RNA, 19 nt, Homo sapiens
ccaaaagacuucgagauag

SEQ ID NO: 1169839 - RNA, 19 nt, Homo sapiens
augcacagauaaagaacaa

SEQ ID NO: 1169840 - RNA, 19 nt, Homo sapiens
caaggcaggacagaugaaa

SEQ ID NO: 1169841 - RNA, 19 nt, Homo sapiens
agagagcacuuggcagaca

SEQ ID NO: 1169842 - RNA, 19 nt, Homo sapiens
gcaaaagcgagaacaaaau

SEQ ID NO: 1169843 - RNA, 19 nt, Homo sapiens
gcaacucacagaggaacuu

SEQ ID NO: 1169844 - RNA, 19 nt, Homo sapiens
aaugcugccuauaaucuug

SEQ ID NO: 1169845 - RNA, 19 nt, Homo sapiens
aaacacgacagugagauga

SEQ ID NO: 1169846 - RNA, 19 nt, Homo sapiens
gaaagaagauuuggcuuga

SEQ ID NO: 1169847 - RNA, 19 nt, Homo sapiens
gcaguuaccuggcaacauu

SEQ ID NO: 1169848 - RNA, 19 nt, Homo sapiens
gaagugauguugccuuaga

SEQ ID NO: 1169849 - RNA, 19 nt, Homo sapiens
cagaaaggcugcaagauug

SEQ ID NO: 1169850 - RNA, 19 nt, Homo sapiens
guaaugagccaaauaacua

SEQ ID NO: 1169851 - RNA, 19 nt, Homo sapiens
gaagagagguuuaaaucag

SEQ ID NO: 1169852 - RNA, 19 nt, Homo sapiens
agacagagcugcagguuug

SEQ ID NO: 1169853 - RNA, 19 nt, Homo sapiens
caacauugcuacauugaug

SEQ ID NO: 1169854 - RNA, 19 nt, Homo sapiens
gacaucaccuguaccuaua

SEQ ID NO: 1169855 - RNA, 19 nt, Homo sapiens
ucaagaaugucaaugcuuu

SEQ ID NO: 1169856 - RNA, 19 nt, Homo sapiens
gggcauugaugucgugaua

SEQ ID NO: 1169857 - RNA, 19 nt, Homo sapiens
gagcaauucuccaauacuu

SEQ ID NO: 1169858 - RNA, 19 nt, Homo sapiens
gauaaaggcauguguauag

SEQ ID NO: 1169859 - RNA, 19 nt, Homo sapiens
ccaaagagacuaaauguca

SEQ ID NO: 1169860 - RNA, 19 nt, Homo sapiens
gggacaaacuaaggauuua

SEQ ID NO: 1169861 - RNA, 19 nt, Homo sapiens
gaaagugguuaauacauac

SEQ ID NO: 1169862 - RNA, 19 nt, Homo sapiens
gcaggauucuuaugguuga

SEQ ID NO: 1169863 - RNA, 19 nt, Homo sapiens
uaaaugcacugcgucguaa

SEQ ID NO: 1169864 - RNA, 19 nt, Homo sapiens
ccaguaguauccucuguuu

SEQ ID NO: 1169865 - RNA, 19 nt, Homo sapiens
caugauggcuggcucgauu

SEQ ID NO: 1169866 - RNA, 19 nt, Homo sapiens
ccacauccaucccaaagga

SEQ ID NO: 1169867 - RNA, 19 nt, Homo sapiens
guugaacacuuuaggaaug

SEQ ID NO: 1169868 - RNA, 19 nt, Homo sapiens
ggacuccaccugauauuug

SEQ ID NO: 1169869 - RNA, 19 nt, Homo sapiens
gaaggcagcucagaugcau

SEQ ID NO: 1169870 - RNA, 19 nt, Homo sapiens
ggagaaggcagcucagaug

SEQ ID NO: 1169871 - RNA, 19 nt, Homo sapiens
ucgaagugauguugccuua

SEQ ID NO: 1169872 - RNA, 19 nt, Homo sapiens
caucaccuguaccuauaua

SEQ ID NO: 1169873 - RNA, 19 nt, Homo sapiens
ggaccgacuuccugcaguu

SEQ ID NO: 1169874 - RNA, 19 nt, Homo sapiens
ggaagagagguuuaaauca

SEQ ID NO: 1169875 - RNA, 19 nt, Homo sapiens
gcacaaaccaccacaacca

SEQ ID NO: 1169876 - RNA, 19 nt, Homo sapiens
ggauaaaggcauguguaua

SEQ ID NO: 1169877 - RNA, 19 nt, Homo sapiens
ccugaaaacucgccuguua

SEQ ID NO: 1169878 - RNA, 19 nt, Homo sapiens
caacauuucuugggaacug

SEQ ID NO: 1169879 - RNA, 19 nt, Homo sapiens
uaggaaugcuggccaauca

SEQ ID NO: 1169880 - RNA, 19 nt, Homo sapiens
caccugauauuugcucuaa

SEQ ID NO: 1169881 - RNA, 19 nt, Homo sapiens
acagaaaggcugcaagauu

SEQ ID NO: 1169882 - RNA, 19 nt, Homo sapiens
gaaaagacccugauucuac

SEQ ID NO: 1169883 - RNA, 19 nt, Homo sapiens
cagacuugcucuccaaaga

SEQ ID NO: 1169884 - RNA, 19 nt, Homo sapiens
caaagagacuaaaugucau

SEQ ID NO: 1169885 - RNA, 19 nt, Homo sapiens
uugcaucgaucaagaaaga

SEQ ID NO: 1169886 - RNA, 19 nt, Homo sapiens
ggugauggacuuccugaaa

SEQ ID NO: 1169887 - RNA, 19 nt, Homo sapiens
gaaguacagcgccagcaaa

SEQ ID NO: 1169888 - RNA, 19 nt, Homo sapiens
cccaauaacuccuggaaca

SEQ ID NO: 1169889 - RNA, 19 nt, Homo sapiens
cagcuuauauggcccuaau

SEQ ID NO: 1169890 - RNA, 19 nt, Homo sapiens
ccuccuagauggauucaug

SEQ ID NO: 1169891 - RNA, 19 nt, Homo sapiens
gcccagcacccugauguua

SEQ ID NO: 1169892 - RNA, 19 nt, Homo sapiens
acacagacuugcucuccaa

SEQ ID NO: 1169893 - RNA, 19 nt, Homo sapiens
aaacagaaaggcugcaaga

SEQ ID NO: 1169894 - RNA, 19 nt, Homo sapiens
ugccuuagauaaacagaaa

SEQ ID NO: 1169895 - RNA, 19 nt, Homo sapiens
gaagguggcaggaaguaca

SEQ ID NO: 1169896 - RNA, 19 nt, Homo sapiens
cuaaaugcacugcgucgua

SEQ ID NO: 1169897 - RNA, 19 nt, Homo sapiens
ccagcacccugauguuaug

SEQ ID NO: 1169898 - RNA, 19 nt, Homo sapiens
gauguugccuuagauaaac

SEQ ID NO: 1169899 - RNA, 19 nt, Homo sapiens
ucaggacagucaaugagaa

SEQ ID NO: 1169900 - RNA, 19 nt, Homo sapiens
agacaucaccuguaccuau

SEQ ID NO: 1169901 - RNA, 19 nt, Homo sapiens
uaagcuauccucacacuca

SEQ ID NO: 1169902 - RNA, 19 nt, Homo sapiens
ucuuaugguugaacacuuu

SEQ ID NO: 1169903 - RNA, 19 nt, Homo sapiens
aagagagguuuaaaucaga

SEQ ID NO: 1169904 - RNA, 19 nt, Homo sapiens
gcaauucuccaauacuuac

SEQ ID NO: 1169905 - RNA, 19 nt, Homo sapiens
cuaugaggaugacauuguu

SEQ ID NO: 1169906 - RNA, 19 nt, Homo sapiens
ggacagucaaugagaacuu

SEQ ID NO: 1169907 - RNA, 19 nt, Homo sapiens
ggagacccuugccuguaga

SEQ ID NO: 1169908 - RNA, 19 nt, Homo sapiens
cuugggaacuggguaauga

SEQ ID NO: 1169909 - RNA, 19 nt, Homo sapiens
gacagucaaugagaacuuc

SEQ ID NO: 1169910 - RNA, 19 nt, Homo sapiens
gcaucgaucaagaaagaaa

SEQ ID NO: 1169911 - RNA, 19 nt, Homo sapiens
gacaaacuaaggauuuaug

SEQ ID NO: 1169912 - RNA, 19 nt, Homo sapiens
ggacaaacuaaggauuuau

SEQ ID NO: 1169913 - RNA, 19 nt, Homo sapiens
ggcaggaaguacaguagau

SEQ ID NO: 1169914 - RNA, 19 nt, Homo sapiens
ggucaagaaugucaaugcu

SEQ ID NO: 1169915 - RNA, 19 nt, Homo sapiens
aagaagauuuggcuugaag

SEQ ID NO: 1169916 - RNA, 19 nt, Homo sapiens
auacauacacuccaggaaa

SEQ ID NO: 1169917 - RNA, 19 nt, Homo sapiens
cccugagucuguugaagua

SEQ ID NO: 1169918 - RNA, 19 nt, Homo sapiens
gcauugaugucgugauacg

SEQ ID NO: 1169919 - RNA, 19 nt, Homo sapiens
aaagaagauuuggcuugaa

SEQ ID NO: 1169920 - RNA, 19 nt, Homo sapiens
gauuacauccagcugaaga

SEQ ID NO: 1169921 - RNA, 19 nt, Homo sapiens
ggaugacauuguucgaagu

SEQ ID NO: 1169922 - RNA, 19 nt, Homo sapiens
gcugcagguuugaaggaaa

SEQ ID NO: 1169923 - RNA, 19 nt, Homo sapiens
aaacuaugaggaugacauu

SEQ ID NO: 1169924 - RNA, 19 nt, Homo sapiens
auaaaggcauguguauaga

SEQ ID NO: 1169925 - RNA, 19 nt, Homo sapiens
ugucauagcgugaucuuag

SEQ ID NO: 1169926 - RNA, 19 nt, Homo sapiens
ccacaaccacaacuacguu

SEQ ID NO: 1169927 - RNA, 19 nt, Homo sapiens
cgggacaaacuaaggauuu

SEQ ID NO: 1169928 - RNA, 19 nt, Homo sapiens
gguaaugagccaaauaacu

SEQ ID NO: 1169929 - RNA, 19 nt, Homo sapiens
ugauguugccuuagauaaa

SEQ ID NO: 1169930 - RNA, 19 nt, Homo sapiens
uaaaugucauagcgugauc

SEQ ID NO: 1169931 - RNA, 19 nt, Homo sapiens
cgugauacggcacucauuu

SEQ ID NO: 1169932 - RNA, 19 nt, Homo sapiens
gaaugucaucgcccuccua

SEQ ID NO: 1169933 - RNA, 19 nt, Homo sapiens
gcagccaguugggaaagga

SEQ ID NO: 1169934 - RNA, 19 nt, Homo sapiens
ugaaugagggugcuuugug

SEQ ID NO: 1169935 - RNA, 19 nt, Homo sapiens
ugacauuguucgaagugau

SEQ ID NO: 1169936 - RNA, 19 nt, Homo sapiens
gaggaugacauuguucgaa

SEQ ID NO: 1169937 - RNA, 19 nt, Homo sapiens
ccacuccuccacuccagua

SEQ ID NO: 1169938 - RNA, 19 nt, Homo sapiens
gaagauuuggcuugaaggu

SEQ ID NO: 1169939 - RNA, 19 nt, Homo sapiens
uacauacacuccaggaaag

SEQ ID NO: 1169940 - RNA, 19 nt, Homo sapiens
gugauggacuuccugaaaa

SEQ ID NO: 1169941 - RNA, 19 nt, Homo sapiens
ugucaucgcccuccuagau

SEQ ID NO: 1169942 - RNA, 19 nt, Homo sapiens
ggaaaagacccugauucua

SEQ ID NO: 1169943 - RNA, 19 nt, Homo sapiens
cagcccauccggauuuauu

SEQ ID NO: 1169944 - RNA, 19 nt, Homo sapiens
cuccuccacuccaguagua

SEQ ID NO: 1169945 - RNA, 19 nt, Homo sapiens
ucagaaagugguuaauaca

SEQ ID NO: 1169946 - RNA, 19 nt, Homo sapiens
gaaauuaguugcagagaaa

SEQ ID NO: 1169947 - RNA, 19 nt, Homo sapiens
gcaaaugaauccauauuga

SEQ ID NO: 1169948 - RNA, 19 nt, Homo sapiens
ggacucagcuggauauguu

SEQ ID NO: 1169949 - RNA, 19 nt, Homo sapiens
gaaacaaucagaagcuuua

SEQ ID NO: 1169950 - RNA, 19 nt, Homo sapiens
caagauagcucacuggaau

SEQ ID NO: 1169951 - RNA, 19 nt, Homo sapiens
cacaagagcugcugcuaua

SEQ ID NO: 1169952 - RNA, 19 nt, Homo sapiens
uaacaucucucaucaagga

SEQ ID NO: 1169953 - RNA, 19 nt, Homo sapiens
gcaaaggacucaucgaauc

SEQ ID NO: 1169954 - RNA, 19 nt, Homo sapiens
guucauagggcuuuaauua

SEQ ID NO: 1169955 - RNA, 19 nt, Homo sapiens
gaaguagacucuguugaaa

SEQ ID NO: 1169956 - RNA, 19 nt, Homo sapiens
gcacaucuacuguucauaa

SEQ ID NO: 1169957 - RNA, 19 nt, Homo sapiens
guaacaguguccaaauaua

SEQ ID NO: 1169958 - RNA, 19 nt, Homo sapiens
gcaaagaacugcaaaagga

SEQ ID NO: 1169959 - RNA, 19 nt, Homo sapiens
ggaaauuaguugcagagaa

SEQ ID NO: 1169960 - RNA, 19 nt, Homo sapiens
gaaggauggcggaaucuua

SEQ ID NO: 1169961 - RNA, 19 nt, Homo sapiens
gaagaaauuccaauacgaa

SEQ ID NO: 1169962 - RNA, 19 nt, Homo sapiens
ggauauaggccaaguuuau

SEQ ID NO: 1169963 - RNA, 19 nt, Homo sapiens
uaaguaaccuaggaaauug

SEQ ID NO: 1169964 - RNA, 19 nt, Homo sapiens
gcagagaaauugaauaucc

SEQ ID NO: 1169965 - RNA, 19 nt, Homo sapiens
gaccucaguugguuuguuu

SEQ ID NO: 1169966 - RNA, 19 nt, Homo sapiens
gaaauuccaauacgaaaug

SEQ ID NO: 1169967 - RNA, 19 nt, Homo sapiens
ucacuggaauacauguuua

SEQ ID NO: 1169968 - RNA, 19 nt, Homo sapiens
gagguccgcuuucagugua

SEQ ID NO: 1169969 - RNA, 19 nt, Homo sapiens
gaauacauguuuaccucuu

SEQ ID NO: 1169970 - RNA, 19 nt, Homo sapiens
gaaaguuuaccaacaaaga

SEQ ID NO: 1169971 - RNA, 19 nt, Homo sapiens
ggucaaguagcauuuauaa

SEQ ID NO: 1169972 - RNA, 19 nt, Homo sapiens
gaucuuccguauucacuga

SEQ ID NO: 1169973 - RNA, 19 nt, Homo sapiens
gaaacccgauggaucuaga

SEQ ID NO: 1169974 - RNA, 19 nt, Homo sapiens
cauauucguuugcaaagaa

SEQ ID NO: 1169975 - RNA, 19 nt, Homo sapiens
aaauaaaggucaaguagca

SEQ ID NO: 1169976 - RNA, 19 nt, Homo sapiens
uauuaagcaugcccaguua

SEQ ID NO: 1169977 - RNA, 19 nt, Homo sapiens
aaaguggaaugauugguuu

SEQ ID NO: 1169978 - RNA, 19 nt, Homo sapiens
cagagugaauguccuugua

SEQ ID NO: 1169979 - RNA, 19 nt, Homo sapiens
ggaaauuguuugacauaac

SEQ ID NO: 1169980 - RNA, 19 nt, Homo sapiens
cagaggcaauuuacuauuc

SEQ ID NO: 1169981 - RNA, 19 nt, Homo sapiens
guaaauaaaggucaaguag

SEQ ID NO: 1169982 - RNA, 19 nt, Homo sapiens
gugcaugucuuggaguuaa

SEQ ID NO: 1169983 - RNA, 19 nt, Homo sapiens
ccauuaaacuuggauauag

SEQ ID NO: 1169984 - RNA, 19 nt, Homo sapiens
gaauugggcacuuaaggaa

SEQ ID NO: 1169985 - RNA, 19 nt, Homo sapiens
gaauacuccuuggucaauu

SEQ ID NO: 1169986 - RNA, 19 nt, Homo sapiens
gaaaugguacaaagucaug

SEQ ID NO: 1169987 - RNA, 19 nt, Homo sapiens
uauaggaauugggcacuua

SEQ ID NO: 1169988 - RNA, 19 nt, Homo sapiens
uagaucagguuacagagaa

SEQ ID NO: 1169989 - RNA, 19 nt, Homo sapiens
guucuaauguacucuguug

SEQ ID NO: 1169990 - RNA, 19 nt, Homo sapiens
gcaaguuggaauugauaua

SEQ ID NO: 1169991 - RNA, 19 nt, Homo sapiens
cuaaguaaccuaggaaauu

SEQ ID NO: 1169992 - RNA, 19 nt, Homo sapiens
ucagaagcuuuaaggauga

SEQ ID NO: 1169993 - RNA, 19 nt, Homo sapiens
ggaaacaaucagaagcuuu

SEQ ID NO: 1169994 - RNA, 19 nt, Homo sapiens
gaaccugagcugcaaguug

SEQ ID NO: 1169995 - RNA, 19 nt, Homo sapiens
gaaaaccaguucuugcaaa

SEQ ID NO: 1169996 - RNA, 19 nt, Homo sapiens
gaauaucccuuggaaucau

SEQ ID NO: 1169997 - RNA, 19 nt, Homo sapiens
uuucgucucucauuuguuu

SEQ ID NO: 1169998 - RNA, 19 nt, Homo sapiens
caacaaagaaugggaaaca

SEQ ID NO: 1169999 - RNA, 19 nt, Homo sapiens
gcaauuuacuauucucaac

SEQ ID NO: 1170000 - RNA, 19 nt, Homo sapiens
ggacuaggauuugaauugc

SEQ ID NO: 1170001 - RNA, 19 nt, Homo sapiens
ggaauugggcacuuaagga

SEQ ID NO: 1170002 - RNA, 19 nt, Homo sapiens
ccacugccuucccauaaga

SEQ ID NO: 1170003 - RNA, 19 nt, Homo sapiens
ugacuuagaucagguuaca

SEQ ID NO: 1170004 - RNA, 19 nt, Homo sapiens
caugaugauucccugagua

SEQ ID NO: 1170005 - RNA, 19 nt, Homo sapiens
agaaguagacucuguugaa

SEQ ID NO: 1170006 - RNA, 19 nt, Homo sapiens
gguaacaguguccaaauau

SEQ ID NO: 1170007 - RNA, 19 nt, Homo sapiens
guaacaaagggaaaugaaa

SEQ ID NO: 1170008 - RNA, 19 nt, Homo sapiens
ugccaagcauaguaaauaa

SEQ ID NO: 1170009 - RNA, 19 nt, Homo sapiens
guacucuguuguauagcua

SEQ ID NO: 1170010 - RNA, 19 nt, Homo sapiens
aauguacucuguuguauag

SEQ ID NO: 1170011 - RNA, 19 nt, Homo sapiens
ggccaaguuuauaaagaaa

SEQ ID NO: 1170012 - RNA, 19 nt, Homo sapiens
gccauuucgucucucauuu

SEQ ID NO: 1170013 - RNA, 19 nt, Homo sapiens
agaagaaauuccaauacga

SEQ ID NO: 1170014 - RNA, 19 nt, Homo sapiens
uaagcuaggugugaagaau

SEQ ID NO: 1170015 - RNA, 19 nt, Homo sapiens
ccuaggaaauuguuugaca

SEQ ID NO: 1170016 - RNA, 19 nt, Homo sapiens
caaagaaugggaaacaauc

SEQ ID NO: 1170017 - RNA, 19 nt, Homo sapiens
uacccgaauuucaacuuua

SEQ ID NO: 1170018 - RNA, 19 nt, Homo sapiens
guguaauggugauaugaaa

SEQ ID NO: 1170019 - RNA, 19 nt, Homo sapiens
gaagauuuccccucaguuu

SEQ ID NO: 1170020 - RNA, 19 nt, Homo sapiens
gcggaaucuuaaagugaua

SEQ ID NO: 1170021 - RNA, 19 nt, Homo sapiens
uuugugaucuuccguauuc

SEQ ID NO: 1170022 - RNA, 19 nt, Homo sapiens
agagaaaggcaaugucuga

SEQ ID NO: 1170023 - RNA, 19 nt, Homo sapiens
agguaacaguguccaaaua

SEQ ID NO: 1170024 - RNA, 19 nt, Homo sapiens
cagaagaaauuccaauacg

SEQ ID NO: 1170025 - RNA, 19 nt, Homo sapiens
gccaggaccaucauauuga

SEQ ID NO: 1170026 - RNA, 19 nt, Homo sapiens
guauuccucuuaacgugaa

SEQ ID NO: 1170027 - RNA, 19 nt, Homo sapiens
cacagaagaaauuccaaua

SEQ ID NO: 1170028 - RNA, 19 nt, Homo sapiens
gggaaacaaucagaagcuu

SEQ ID NO: 1170029 - RNA, 19 nt, Homo sapiens
aaccgucuguucauuguuu

SEQ ID NO: 1170030 - RNA, 19 nt, Homo sapiens
cauagggcuuuaauuauac

SEQ ID NO: 1170031 - RNA, 19 nt, Homo sapiens
gagcugcugcuauaacuuc

SEQ ID NO: 1170032 - RNA, 19 nt, Homo sapiens
cuaauguacucuguuguau

SEQ ID NO: 1170033 - RNA, 19 nt, Homo sapiens
ggcggaaucuuaaagugau

SEQ ID NO: 1170034 - RNA, 19 nt, Homo sapiens
gaugauucccugaguaaca

SEQ ID NO: 1170035 - RNA, 19 nt, Homo sapiens
gagugaauguccuuguaca

SEQ ID NO: 1170036 - RNA, 19 nt, Homo sapiens
aggccaaguuuauaaagaa

SEQ ID NO: 1170037 - RNA, 19 nt, Homo sapiens
uagaggaaguauuguuauc

SEQ ID NO: 1170038 - RNA, 19 nt, Homo sapiens
guuauuggcuuuucguauu

SEQ ID NO: 1170039 - RNA, 19 nt, Homo sapiens
cacaucuacuguucauaaa

SEQ ID NO: 1170040 - RNA, 19 nt, Homo sapiens
aauaucccuuggaaucaua

SEQ ID NO: 1170041 - RNA, 19 nt, Homo sapiens
cauguuuaccucuuucuuu

SEQ ID NO: 1170042 - RNA, 19 nt, Homo sapiens
ugaucuaucuccauuaaac

SEQ ID NO: 1170043 - RNA, 19 nt, Homo sapiens
gaaugggaaacaaucagaa

SEQ ID NO: 1170044 - RNA, 19 nt, Homo sapiens
gcuggucgucugaugauaa

SEQ ID NO: 1170045 - RNA, 19 nt, Homo sapiens
uuacccgaauuucaacuuu

SEQ ID NO: 1170046 - RNA, 19 nt, Homo sapiens
gacaaaggguuuccuaaua

SEQ ID NO: 1170047 - RNA, 19 nt, Homo sapiens
ggagagagauuuaagacaa

SEQ ID NO: 1170048 - RNA, 19 nt, Homo sapiens
gaaggaaugugaggaagaa

SEQ ID NO: 1170049 - RNA, 19 nt, Homo sapiens
guuaagagccgucccauuu

SEQ ID NO: 1170050 - RNA, 19 nt, Homo sapiens
uaacugggcuugagugugu

SEQ ID NO: 1170051 - RNA, 19 nt, Homo sapiens
aaacaaagauccaguucau

SEQ ID NO: 1170052 - RNA, 19 nt, Homo sapiens
gagagagauuuaagacaaa

SEQ ID NO: 1170053 - RNA, 19 nt, Homo sapiens
ccuaauagauccaaacugu

SEQ ID NO: 1170054 - RNA, 19 nt, Homo sapiens
caaagauccaguucauuua

SEQ ID NO: 1170055 - RNA, 19 nt, Homo sapiens
acaaagauccaguucauuu

SEQ ID NO: 1170056 - RNA, 19 nt, Homo sapiens
caaaggguuuccuaauaga

SEQ ID NO: 1170057 - RNA, 19 nt, Homo sapiens
acaaaggguuuccuaauag

SEQ ID NO: 1170058 - RNA, 19 nt, Homo sapiens
ggucugagauguguuagga

SEQ ID NO: 1170059 - RNA, 19 nt, Homo sapiens
gagaugggagagagauuua

SEQ ID NO: 1170060 - RNA, 19 nt, Homo sapiens
acaccgaaguccuuuguuu

SEQ ID NO: 1170061 - RNA, 19 nt, Homo sapiens
gaaaagagaagcaagaaug

SEQ ID NO: 1170062 - RNA, 19 nt, Homo sapiens
uaagaaggaaggaauguga

SEQ ID NO: 1170063 - RNA, 19 nt, Homo sapiens
acaccagggucauuaagaa

SEQ ID NO: 1170064 - RNA, 19 nt, Homo sapiens
ggagaugggagagagauuu

SEQ ID NO: 1170065 - RNA, 19 nt, Homo sapiens
ggaaugugaggaagaaaga

SEQ ID NO: 1170066 - RNA, 19 nt, Homo sapiens
gggaggaugguauggauuu

SEQ ID NO: 1170067 - RNA, 19 nt, Homo sapiens
gaaagaaaggcagggcauu

SEQ ID NO: 1170068 - RNA, 19 nt, Homo sapiens
cagagucuuucauaugcua

SEQ ID NO: 1170069 - RNA, 19 nt, Homo sapiens
uccauuggcuaaguaguua

SEQ ID NO: 1170070 - RNA, 19 nt, Homo sapiens
ggaaggaaugugaggaaga

SEQ ID NO: 1170071 - RNA, 19 nt, Homo sapiens
guggggagcuucugauuuu

SEQ ID NO: 1170072 - RNA, 19 nt, Homo sapiens
uaagagccgucccauuucu

SEQ ID NO: 1170073 - RNA, 19 nt, Homo sapiens
gcagggcauucaggaagaa

SEQ ID NO: 1170074 - RNA, 19 nt, Homo sapiens
ugacaaaggguuuccuaau

SEQ ID NO: 1170075 - RNA, 19 nt, Homo sapiens
ugguauggauuucugcuuu

SEQ ID NO: 1170076 - RNA, 19 nt, Homo sapiens
uucauuuacuccacaguua

SEQ ID NO: 1170077 - RNA, 19 nt, Homo sapiens
augcuaacauucauuguga

SEQ ID NO: 1170078 - RNA, 19 nt, Homo sapiens
acaacaaccuguccuucau

SEQ ID NO: 1170079 - RNA, 19 nt, Homo sapiens
ggacgguaagcaacauuug

SEQ ID NO: 1170080 - RNA, 19 nt, Homo sapiens
gaaaggccgagggauguug

SEQ ID NO: 1170081 - RNA, 19 nt, Homo sapiens
ggcagggcauucaggaaga

SEQ ID NO: 1170082 - RNA, 19 nt, Homo sapiens
ccagggucauuaagaagga

SEQ ID NO: 1170083 - RNA, 19 nt, Homo sapiens
uguaaaguccgaggauuaa

SEQ ID NO: 1170084 - RNA, 19 nt, Homo sapiens
gagacucccaggacgguaa

SEQ ID NO: 1170085 - RNA, 19 nt, Homo sapiens
cugcaaggccugaauuaga

SEQ ID NO: 1170086 - RNA, 19 nt, Homo sapiens
ggaggaugguauggauuuc

SEQ ID NO: 1170087 - RNA, 19 nt, Homo sapiens
caacauuugaggaccauuc

SEQ ID NO: 1170088 - RNA, 19 nt, Homo sapiens
cauaugcuaacauucauug

SEQ ID NO: 1170089 - RNA, 19 nt, Homo sapiens
gacgguaagcaacauuuga

SEQ ID NO: 1170090 - RNA, 19 nt, Homo sapiens
cauugugaaucucccaaga

SEQ ID NO: 1170091 - RNA, 19 nt, Homo sapiens
ccaacaccagggucauuaa

SEQ ID NO: 1170092 - RNA, 19 nt, Homo sapiens
uuguaaaguccgaggauua

SEQ ID NO: 1170093 - RNA, 19 nt, Homo sapiens
uuagagagacuuccauugg

SEQ ID NO: 1170094 - RNA, 19 nt, Homo sapiens
gcaacagcaucgccuucgu

SEQ ID NO: 1170095 - RNA, 19 nt, Homo sapiens
uguguuaggaggcguuuaa

SEQ ID NO: 1170096 - RNA, 19 nt, Homo sapiens
ugcaaggccugaauuagag

SEQ ID NO: 1170097 - RNA, 19 nt, Homo sapiens
ucagcagccuccucuccaa

SEQ ID NO: 1170098 - RNA, 19 nt, Homo sapiens
ggcccuagccacaaaggaa

SEQ ID NO: 1170099 - RNA, 19 nt, Homo sapiens
gggcuugaguguguuugug

SEQ ID NO: 1170100 - RNA, 19 nt, Homo sapiens
caacaaccuguccuucauc

SEQ ID NO: 1170101 - RNA, 19 nt, Homo sapiens
guaaaguccgaggauuaaa

SEQ ID NO: 1170102 - RNA, 19 nt, Homo sapiens
guaggcaggacgugagaga

SEQ ID NO: 1170103 - RNA, 19 nt, Homo sapiens
cacaacaaccuguccuuca

SEQ ID NO: 1170104 - RNA, 19 nt, Homo sapiens
ggauguugguccugcuucu

SEQ ID NO: 1170105 - RNA, 19 nt, Homo sapiens
ugggugaccuguccuuucu

SEQ ID NO: 1170106 - RNA, 19 nt, Homo sapiens
uuucagagucuuucauaug

SEQ ID NO: 1170107 - RNA, 19 nt, Homo sapiens
gaugggagagagauuuaag

SEQ ID NO: 1170108 - RNA, 19 nt, Homo sapiens
aaagagaagcaagaaugaa

SEQ ID NO: 1170109 - RNA, 19 nt, Homo sapiens
aaagaaaggcagggcauuc

SEQ ID NO: 1170110 - RNA, 19 nt, Homo sapiens
cgaaguccuuuguuuucua

SEQ ID NO: 1170111 - RNA, 19 nt, Homo sapiens
gcaaggccugaauuagaga

SEQ ID NO: 1170112 - RNA, 19 nt, Homo sapiens
gguauggauuucugcuuuu

SEQ ID NO: 1170113 - RNA, 19 nt, Homo sapiens
cccaacaccagggucauua

SEQ ID NO: 1170114 - RNA, 19 nt, Homo sapiens
guucauuuacuccacaguu

SEQ ID NO: 1170115 - RNA, 19 nt, Homo sapiens
ccguuugccuccagagaug

SEQ ID NO: 1170116 - RNA, 19 nt, Homo sapiens
gguuucuccucgccucuug

SEQ ID NO: 1170117 - RNA, 19 nt, Homo sapiens
cauuuacuccacaguuauu

SEQ ID NO: 1170118 - RNA, 19 nt, Homo sapiens
caacaccagggucauuaag

SEQ ID NO: 1170119 - RNA, 19 nt, Homo sapiens
uuucuguuguuacugguuu

SEQ ID NO: 1170120 - RNA, 19 nt, Homo sapiens
cuugcuggguugucaguga

SEQ ID NO: 1170121 - RNA, 19 nt, Homo sapiens
ccuggaaacacuaggauuc

SEQ ID NO: 1170122 - RNA, 19 nt, Homo sapiens
ccauuacaccgaaguccuu

SEQ ID NO: 1170123 - RNA, 19 nt, Homo sapiens
ggagaggagccggaaugga

SEQ ID NO: 1170124 - RNA, 19 nt, Homo sapiens
ccaccaccgugagcagguu

SEQ ID NO: 1170125 - RNA, 19 nt, Homo sapiens
aacaaccuguccuucauca

SEQ ID NO: 1170126 - RNA, 19 nt, Homo sapiens
gaaugugaggaagaaagaa

SEQ ID NO: 1170127 - RNA, 19 nt, Homo sapiens
aaagauccaguucauuuac

SEQ ID NO: 1170128 - RNA, 19 nt, Homo sapiens
ugaggaccauucacuaacg

SEQ ID NO: 1170129 - RNA, 19 nt, Homo sapiens
gaauuagagagacuuccau

SEQ ID NO: 1170130 - RNA, 19 nt, Homo sapiens
aaugugaggaagaaagaaa

SEQ ID NO: 1170131 - RNA, 19 nt, Homo sapiens
uuugaggaccauucacuaa

SEQ ID NO: 1170132 - RNA, 19 nt, Homo sapiens
uaaaguccgaggauuaaaa

SEQ ID NO: 1170133 - RNA, 19 nt, Homo sapiens
uuaagagccgucccauuuc

SEQ ID NO: 1170134 - RNA, 19 nt, Homo sapiens
ucauuaagaaggaaggaau

SEQ ID NO: 1170135 - RNA, 19 nt, Homo sapiens
gggagagagauuuaagaca

SEQ ID NO: 1170136 - RNA, 19 nt, Homo sapiens
gacuaggaaucggaagcuu

SEQ ID NO: 1170137 - RNA, 19 nt, Homo sapiens
uugaguguguuugugguaa

SEQ ID NO: 1170138 - RNA, 19 nt, Homo sapiens
ggaaacagcuuuagugaug

SEQ ID NO: 1170139 - RNA, 19 nt, Homo sapiens
ggaagacucugaggaaaua

SEQ ID NO: 1170140 - RNA, 19 nt, Homo sapiens
gagcagcuauuuccugaua

SEQ ID NO: 1170141 - RNA, 19 nt, Homo sapiens
cuacaaagccucagggaua

SEQ ID NO: 1170142 - RNA, 19 nt, Homo sapiens
gcugaagccuggaaacaaa

SEQ ID NO: 1170143 - RNA, 19 nt, Homo sapiens
gagcacagcagccuuacua

SEQ ID NO: 1170144 - RNA, 19 nt, Homo sapiens
uggagaagguggaaucuuu

SEQ ID NO: 1170145 - RNA, 19 nt, Homo sapiens
gaaacggaauuugagaaug

SEQ ID NO: 1170146 - RNA, 19 nt, Homo sapiens
gaaugugggugucaacaag

SEQ ID NO: 1170147 - RNA, 19 nt, Homo sapiens
gaaacagcuuuagugauga

SEQ ID NO: 1170148 - RNA, 19 nt, Homo sapiens
gagaaccacccuacccaua

SEQ ID NO: 1170149 - RNA, 19 nt, Homo sapiens
ccaacaaucuccaaaauga

SEQ ID NO: 1170150 - RNA, 19 nt, Homo sapiens
gauacacuguggaacuauu

SEQ ID NO: 1170151 - RNA, 19 nt, Homo sapiens
cagauacacuguggaacua

SEQ ID NO: 1170152 - RNA, 19 nt, Homo sapiens
aagcucaucuccuugaauu

SEQ ID NO: 1170153 - RNA, 19 nt, Homo sapiens
aaacggaauuugagaaugg

SEQ ID NO: 1170154 - RNA, 19 nt, Homo sapiens
caugugcacucucgucuga

SEQ ID NO: 1170155 - RNA, 19 nt, Homo sapiens
uaaggaagacucugaggaa

SEQ ID NO: 1170156 - RNA, 19 nt, Homo sapiens
aacagaagcucaacagugu

SEQ ID NO: 1170157 - RNA, 19 nt, Homo sapiens
ugacagagacgcaguuugu

SEQ ID NO: 1170158 - RNA, 19 nt, Homo sapiens
gcuguucaguucucgcuuu

SEQ ID NO: 1170159 - RNA, 19 nt, Homo sapiens
aaacagagccagcagaaca

SEQ ID NO: 1170160 - RNA, 19 nt, Homo sapiens
gcuacacacuugaaugcaa

SEQ ID NO: 1170161 - RNA, 19 nt, Homo sapiens
uacaaagccucagggauaa

SEQ ID NO: 1170162 - RNA, 19 nt, Homo sapiens
gagauggccagucuaaaga

SEQ ID NO: 1170163 - RNA, 19 nt, Homo sapiens
gagacuccaucuagcuuug

SEQ ID NO: 1170164 - RNA, 19 nt, Homo sapiens
ugacagccguuaaguccuu

SEQ ID NO: 1170165 - RNA, 19 nt, Homo sapiens
caacaaaauucuccacaga

SEQ ID NO: 1170166 - RNA, 19 nt, Homo sapiens
ggauggacuucguguagau

SEQ ID NO: 1170167 - RNA, 19 nt, Homo sapiens
gcacagcagccuuacuaau

SEQ ID NO: 1170168 - RNA, 19 nt, Homo sapiens
ccaaagcucaucuccuuga

SEQ ID NO: 1170169 - RNA, 19 nt, Homo sapiens
ggccuaagcagcacucuga

SEQ ID NO: 1170170 - RNA, 19 nt, Homo sapiens
ucagagcacagcagccuua

SEQ ID NO: 1170171 - RNA, 19 nt, Homo sapiens
gcucaacaguguguggauu

SEQ ID NO: 1170172 - RNA, 19 nt, Homo sapiens
cgaccagacugugcugaaa

SEQ ID NO: 1170173 - RNA, 19 nt, Homo sapiens
ccuauauccuguagucuau

SEQ ID NO: 1170174 - RNA, 19 nt, Homo sapiens
gaguggcguugcuuacuau

SEQ ID NO: 1170175 - RNA, 19 nt, Homo sapiens
gccaggaacugcuaaacca

SEQ ID NO: 1170176 - RNA, 19 nt, Homo sapiens
ggauuaaggaagacucuga

SEQ ID NO: 1170177 - RNA, 19 nt, Homo sapiens
caaagcucaucuccuugaa

SEQ ID NO: 1170178 - RNA, 19 nt, Homo sapiens
agaguggcguugcuuacua

SEQ ID NO: 1170179 - RNA, 19 nt, Homo sapiens
gaucaacauuaugaacaug

SEQ ID NO: 1170180 - RNA, 19 nt, Homo sapiens
gggccuggaugcugaaaca

SEQ ID NO: 1170181 - RNA, 19 nt, Homo sapiens
ggagaagguggaaucuuug

SEQ ID NO: 1170182 - RNA, 19 nt, Homo sapiens
ggcagcuucuuguuccaua

SEQ ID NO: 1170183 - RNA, 19 nt, Homo sapiens
ccaaggcauuacagaguau

SEQ ID NO: 1170184 - RNA, 19 nt, Homo sapiens
uccaaggcauuacagagua

SEQ ID NO: 1170185 - RNA, 19 nt, Homo sapiens
cuccacagaugaagaauuc

SEQ ID NO: 1170186 - RNA, 19 nt, Homo sapiens
gggacgagcuauggccauu

SEQ ID NO: 1170187 - RNA, 19 nt, Homo sapiens
guguagaucugcugacgau

SEQ ID NO: 1170188 - RNA, 19 nt, Homo sapiens
gugcugaaacggaauuuga

SEQ ID NO: 1170189 - RNA, 19 nt, Homo sapiens
gaaucuuuguccagugaug

SEQ ID NO: 1170190 - RNA, 19 nt, Homo sapiens
ggguaacagugggaaauau

SEQ ID NO: 1170191 - RNA, 19 nt, Homo sapiens
cagcagccuuacuaaucua

SEQ ID NO: 1170192 - RNA, 19 nt, Homo sapiens
gaaaacaugcuauauccaa

SEQ ID NO: 1170193 - RNA, 19 nt, Homo sapiens
ugacaggcauaacgcugaa

SEQ ID NO: 1170194 - RNA, 19 nt, Homo sapiens
guucaguucucgcuuugau

SEQ ID NO: 1170195 - RNA, 19 nt, Homo sapiens
aguaucaccuugagacaga

SEQ ID NO: 1170196 - RNA, 19 nt, Homo sapiens
gcucaucuccuugaauuca

SEQ ID NO: 1170197 - RNA, 19 nt, Homo sapiens
uaagcugauucccauguug

SEQ ID NO: 1170198 - RNA, 19 nt, Homo sapiens
gaaccacccuacccauagc

SEQ ID NO: 1170199 - RNA, 19 nt, Homo sapiens
cgucgccucuucgucuuua

SEQ ID NO: 1170200 - RNA, 19 nt, Homo sapiens
ccaucuagcuuugucuuca

SEQ ID NO: 1170201 - RNA, 19 nt, Homo sapiens
caggaaaacucaucaagau

SEQ ID NO: 1170202 - RNA, 19 nt, Homo sapiens
cacaauggguugccugucu

SEQ ID NO: 1170203 - RNA, 19 nt, Homo sapiens
auccaaagcucaucuccuu

SEQ ID NO: 1170204 - RNA, 19 nt, Homo sapiens
aaaaggggcugcuucaugu

SEQ ID NO: 1170205 - RNA, 19 nt, Homo sapiens
agacgcaguuuguguuauc

SEQ ID NO: 1170206 - RNA, 19 nt, Homo sapiens
uccauaggauuaaggaaga

SEQ ID NO: 1170207 - RNA, 19 nt, Homo sapiens
aagcugggcuccugucuac

SEQ ID NO: 1170208 - RNA, 19 nt, Homo sapiens
cuaagcagcacucugaaug

SEQ ID NO: 1170209 - RNA, 19 nt, Homo sapiens
gagcaggugggacgagcua

SEQ ID NO: 1170210 - RNA, 19 nt, Homo sapiens
gaaagccaacaaucuccaa

SEQ ID NO: 1170211 - RNA, 19 nt, Homo sapiens
gcaguuuguguuauccuuu

SEQ ID NO: 1170212 - RNA, 19 nt, Homo sapiens
ggucaugguucuacuucag

SEQ ID NO: 1170213 - RNA, 19 nt, Homo sapiens
gaaaacucaucaagaucaa

SEQ ID NO: 1170214 - RNA, 19 nt, Homo sapiens
ggaaaacucaucaagauca

SEQ ID NO: 1170215 - RNA, 19 nt, Homo sapiens
gguaacagugggaaauaug

SEQ ID NO: 1170216 - RNA, 19 nt, Homo sapiens
cacagcagccuuacuaauc

SEQ ID NO: 1170217 - RNA, 19 nt, Homo sapiens
ucaauggcuuucuggacuu

SEQ ID NO: 1170218 - RNA, 19 nt, Homo sapiens
caucuagcuuugucuucaa

SEQ ID NO: 1170219 - RNA, 19 nt, Homo sapiens
gagacgcaguuuguguuau

SEQ ID NO: 1170220 - RNA, 19 nt, Homo sapiens
uuacagaguaucaccuuga

SEQ ID NO: 1170221 - RNA, 19 nt, Homo sapiens
gccguuaaguccuuggaau

SEQ ID NO: 1170222 - RNA, 19 nt, Homo sapiens
cagaggcugucaugguaau

SEQ ID NO: 1170223 - RNA, 19 nt, Homo sapiens
ucuacugccugauucauuc

SEQ ID NO: 1170224 - RNA, 19 nt, Homo sapiens
ccuggaugcugaaacaugu

SEQ ID NO: 1170225 - RNA, 19 nt, Homo sapiens
ccacagcuacacacuugaa

SEQ ID NO: 1170226 - RNA, 19 nt, Homo sapiens
gauaauccacagcuacaca

SEQ ID NO: 1170227 - RNA, 19 nt, Homo sapiens
caaagagaguggcguugcu

SEQ ID NO: 1170228 - RNA, 19 nt, Homo sapiens
aagcagagcaagcuguauu

SEQ ID NO: 1170229 - RNA, 19 nt, Homo sapiens
aaggaagacucugaggaaa

SEQ ID NO: 1170230 - RNA, 19 nt, Homo sapiens
acacuugaaugcaacuaca

SEQ ID NO: 1170231 - RNA, 19 nt, Homo sapiens
cagcagaacagaagcucaa

SEQ ID NO: 1170232 - RNA, 19 nt, Homo sapiens
acaaacagagccagcagaa

SEQ ID NO: 1170233 - RNA, 19 nt, Homo sapiens
cccuggauaccaucuauua

SEQ ID NO: 1170234 - RNA, 19 nt, Homo sapiens
caguuuguguuauccuuug

SEQ ID NO: 1170235 - RNA, 19 nt, Homo sapiens
caaaccagaggcugucaug

SEQ ID NO: 1170236 - RNA, 19 nt, Homo sapiens
acagcagccuuacuaaucu

SEQ ID NO: 1170237 - RNA, 19 nt, Homo sapiens
cagagaagaauauguaugc

SEQ ID NO: 1170238 - RNA, 19 nt, Homo sapiens
ggacagaccucuuucauga

SEQ ID NO: 1170239 - RNA, 19 nt, Homo sapiens
guacacagauccuuuauug

SEQ ID NO: 1170240 - RNA, 19 nt, Homo sapiens
ggaaaucccucauggcauu

SEQ ID NO: 1170241 - RNA, 19 nt, Homo sapiens
ggacagaaauggacucaga

SEQ ID NO: 1170242 - RNA, 19 nt, Homo sapiens
gaaccugggucuccuguaa

SEQ ID NO: 1170243 - RNA, 19 nt, Homo sapiens
caaacuagcuuuccugaga

SEQ ID NO: 1170244 - RNA, 19 nt, Homo sapiens
guucuuagcuacuuaauga

SEQ ID NO: 1170245 - RNA, 19 nt, Homo sapiens
gcacagaucuuggcugaga

SEQ ID NO: 1170246 - RNA, 19 nt, Homo sapiens
gagcauuuauguaagcuua

SEQ ID NO: 1170247 - RNA, 19 nt, Homo sapiens
cguaugaaauugugucuua

SEQ ID NO: 1170248 - RNA, 19 nt, Homo sapiens
gaaccaaacccagccauua

SEQ ID NO: 1170249 - RNA, 19 nt, Homo sapiens
ggaaauggcagacaugauu

SEQ ID NO: 1170250 - RNA, 19 nt, Homo sapiens
gaacucaugugccaaagga

SEQ ID NO: 1170251 - RNA, 19 nt, Homo sapiens
aaacauaccucaugcuuuc

SEQ ID NO: 1170252 - RNA, 19 nt, Homo sapiens
gaaccuagagaaugaauuu

SEQ ID NO: 1170253 - RNA, 19 nt, Homo sapiens
aaucauaccuaccagaaua

SEQ ID NO: 1170254 - RNA, 19 nt, Homo sapiens
gaaauggacucagaacuca

SEQ ID NO: 1170255 - RNA, 19 nt, Homo sapiens
gaauaaaguucaccagaca

SEQ ID NO: 1170256 - RNA, 19 nt, Homo sapiens
gggaagagcuaauagauac

SEQ ID NO: 1170257 - RNA, 19 nt, Homo sapiens
uaaugaaccuagagaauga

SEQ ID NO: 1170258 - RNA, 19 nt, Homo sapiens
gguaagugcugaaugaguu

SEQ ID NO: 1170259 - RNA, 19 nt, Homo sapiens
gaagagagaugacgaaacc

SEQ ID NO: 1170260 - RNA, 19 nt, Homo sapiens
gaaccauucugccuugcua

SEQ ID NO: 1170261 - RNA, 19 nt, Homo sapiens
gauacucacugauacuaaa

SEQ ID NO: 1170262 - RNA, 19 nt, Homo sapiens
uggcauagcuucuacauca

SEQ ID NO: 1170263 - RNA, 19 nt, Homo sapiens
caaaggacaugaaacuugu

SEQ ID NO: 1170264 - RNA, 19 nt, Homo sapiens
agagugggcugacaauauu

SEQ ID NO: 1170265 - RNA, 19 nt, Homo sapiens
ggaaaucuucuagugaaua

SEQ ID NO: 1170266 - RNA, 19 nt, Homo sapiens
uggacuaaauggacaaaua

SEQ ID NO: 1170267 - RNA, 19 nt, Homo sapiens
cugauuugcugccaacuua

SEQ ID NO: 1170268 - RNA, 19 nt, Homo sapiens
gcagagaagacacauauuc

SEQ ID NO: 1170269 - RNA, 19 nt, Homo sapiens
aaacccagccauuaaguua

SEQ ID NO: 1170270 - RNA, 19 nt, Homo sapiens
acaaauagagcacaaacua

SEQ ID NO: 1170271 - RNA, 19 nt, Homo sapiens
gaauucaccuucuauagac

SEQ ID NO: 1170272 - RNA, 19 nt, Homo sapiens
ugacaaggauacacucaug

SEQ ID NO: 1170273 - RNA, 19 nt, Homo sapiens
uucaaacgcucaagaaauu

SEQ ID NO: 1170274 - RNA, 19 nt, Homo sapiens
aacagacgcuuuccaguuu

SEQ ID NO: 1170275 - RNA, 19 nt, Homo sapiens
gccauuaaguuaugugaau

SEQ ID NO: 1170276 - RNA, 19 nt, Homo sapiens
uaacuucauuugcuggaaa

SEQ ID NO: 1170277 - RNA, 19 nt, Homo sapiens
uacauuaacucuccauuuc

SEQ ID NO: 1170278 - RNA, 19 nt, Homo sapiens
uaacuuagcacagaucuug

SEQ ID NO: 1170279 - RNA, 19 nt, Homo sapiens
acucagaacucaaggaaga

SEQ ID NO: 1170280 - RNA, 19 nt, Homo sapiens
caggagauacucacugaua

SEQ ID NO: 1170281 - RNA, 19 nt, Homo sapiens
gcugagaucaucaauguga

SEQ ID NO: 1170282 - RNA, 19 nt, Homo sapiens
guuauaggcugaaguaaac

SEQ ID NO: 1170283 - RNA, 19 nt, Homo sapiens
agugagaaccuuugucuua

SEQ ID NO: 1170284 - RNA, 19 nt, Homo sapiens
ccaaaggacaugaaacuug

SEQ ID NO: 1170285 - RNA, 19 nt, Homo sapiens
caacaucagaggauucaaa

SEQ ID NO: 1170286 - RNA, 19 nt, Homo sapiens
gccuagaaaucggauguua

SEQ ID NO: 1170287 - RNA, 19 nt, Homo sapiens
cuaaccagauaaagaauug

SEQ ID NO: 1170288 - RNA, 19 nt, Homo sapiens
uggcugagaucaucaaugu

SEQ ID NO: 1170289 - RNA, 19 nt, Homo sapiens
gacagaagaugaagaugag

SEQ ID NO: 1170290 - RNA, 19 nt, Homo sapiens
gaaguaaacacaguugaug

SEQ ID NO: 1170291 - RNA, 19 nt, Homo sapiens
cuauguuacuggcuacuua

SEQ ID NO: 1170292 - RNA, 19 nt, Homo sapiens
ggacaaccagcaaguucua

SEQ ID NO: 1170293 - RNA, 19 nt, Homo sapiens
guaaugaaccuagagaaug

SEQ ID NO: 1170294 - RNA, 19 nt, Homo sapiens
ggacuaaauggacaaauag

SEQ ID NO: 1170295 - RNA, 19 nt, Homo sapiens
ucaaugagccaaauagugu

SEQ ID NO: 1170296 - RNA, 19 nt, Homo sapiens
gaguauaguuagauaugug

SEQ ID NO: 1170297 - RNA, 19 nt, Homo sapiens
ggacucagaacucaaggaa

SEQ ID NO: 1170298 - RNA, 19 nt, Homo sapiens
gagagaugacgaaaccaua

SEQ ID NO: 1170299 - RNA, 19 nt, Homo sapiens
guuacuggcuacuuauuau

SEQ ID NO: 1170300 - RNA, 19 nt, Homo sapiens
uaaggacauuuauggacua

SEQ ID NO: 1170301 - RNA, 19 nt, Homo sapiens
aaacagacgcuuuccaguu

SEQ ID NO: 1170302 - RNA, 19 nt, Homo sapiens
aaacaauacuggguaaauc

SEQ ID NO: 1170303 - RNA, 19 nt, Homo sapiens
cagcuaaccagauaaagaa

SEQ ID NO: 1170304 - RNA, 19 nt, Homo sapiens
gcacuagacagagaauaaa

SEQ ID NO: 1170305 - RNA, 19 nt, Homo sapiens
acacagugaucuacacaga

SEQ ID NO: 1170306 - RNA, 19 nt, Homo sapiens
gaaauggcagacaugauug

SEQ ID NO: 1170307 - RNA, 19 nt, Homo sapiens
gauauguucucuauguuac

SEQ ID NO: 1170308 - RNA, 19 nt, Homo sapiens
ucaucaaugugacgucuaa

SEQ ID NO: 1170309 - RNA, 19 nt, Homo sapiens
cgauauguucucuauguua

SEQ ID NO: 1170310 - RNA, 19 nt, Homo sapiens
ugaauucaccuucuauaga

SEQ ID NO: 1170311 - RNA, 19 nt, Homo sapiens
cagugaauguuaagaguau

SEQ ID NO: 1170312 - RNA, 19 nt, Homo sapiens
agaguacuaugaagacauu

SEQ ID NO: 1170313 - RNA, 19 nt, Homo sapiens
uacaggagauacucacuga

SEQ ID NO: 1170314 - RNA, 19 nt, Homo sapiens
uguaugagauuaugacaag

SEQ ID NO: 1170315 - RNA, 19 nt, Homo sapiens
uaaacacaguugaugaauc

SEQ ID NO: 1170316 - RNA, 19 nt, Homo sapiens
gcagcuauuucacacuuca

SEQ ID NO: 1170317 - RNA, 19 nt, Homo sapiens
aaacuagcuuuccugagaa

SEQ ID NO: 1170318 - RNA, 19 nt, Homo sapiens
caaacgcucaagaaauuaa

SEQ ID NO: 1170319 - RNA, 19 nt, Homo sapiens
cuaccagaauaaagaguaa

SEQ ID NO: 1170320 - RNA, 19 nt, Homo sapiens
uaaaucauaccuaccagaa

SEQ ID NO: 1170321 - RNA, 19 nt, Homo sapiens
caaggcauguaaacaauac

SEQ ID NO: 1170322 - RNA, 19 nt, Homo sapiens
ugaaugaguuacugugcuu

SEQ ID NO: 1170323 - RNA, 19 nt, Homo sapiens
cuggaaaucuucuagugaa

SEQ ID NO: 1170324 - RNA, 19 nt, Homo sapiens
gccuuagccucccagguua

SEQ ID NO: 1170325 - RNA, 19 nt, Homo sapiens
ugaaagauuuggcucugau

SEQ ID NO: 1170326 - RNA, 19 nt, Homo sapiens
gcacuaaaacuccauuaaa

SEQ ID NO: 1170327 - RNA, 19 nt, Homo sapiens
agacagaagaugaagauga

SEQ ID NO: 1170328 - RNA, 19 nt, Homo sapiens
gaaaugaagaaagugagaa

SEQ ID NO: 1170329 - RNA, 19 nt, Homo sapiens
uguaaacaauacuggguaa

SEQ ID NO: 1170330 - RNA, 19 nt, Homo sapiens
gagauacucacugauacua

SEQ ID NO: 1170331 - RNA, 19 nt, Homo sapiens
uaauguaccugcacuagac

SEQ ID NO: 1170332 - RNA, 19 nt, Homo sapiens
caaugugacgucuaaugua

SEQ ID NO: 1170333 - RNA, 19 nt, Homo sapiens
uaagaaggauuuuccagaa

SEQ ID NO: 1170334 - RNA, 19 nt, Homo sapiens
cuagaaaucggauguuaga

SEQ ID NO: 1170335 - RNA, 19 nt, Homo sapiens
caugagaggccuagaaauc

SEQ ID NO: 1170336 - RNA, 19 nt, Homo sapiens
uaaaguucaccagacauua

SEQ ID NO: 1170337 - RNA, 19 nt, Homo sapiens
ggaggaaauuaugaaauac

SEQ ID NO: 1170338 - RNA, 19 nt, Homo sapiens
gcaagcagaugaacuaauu

SEQ ID NO: 1170339 - RNA, 19 nt, Homo sapiens
gcagagggaugccauuauu

SEQ ID NO: 1170340 - RNA, 19 nt, Homo sapiens
ggucguagcuuucaucugu

SEQ ID NO: 1170341 - RNA, 19 nt, Homo sapiens
gugaaugccuccucaagua

SEQ ID NO: 1170342 - RNA, 19 nt, Homo sapiens
gaagcaagcagaugaacua

SEQ ID NO: 1170343 - RNA, 19 nt, Homo sapiens
gcacaccucuggcuggaaa

SEQ ID NO: 1170344 - RNA, 19 nt, Homo sapiens
cgaaugcacuggucuaaug

SEQ ID NO: 1170345 - RNA, 19 nt, Homo sapiens
gggcuuaaguggaaugauu

SEQ ID NO: 1170346 - RNA, 19 nt, Homo sapiens
guggaaagauugaucaguu

SEQ ID NO: 1170347 - RNA, 19 nt, Homo sapiens
gaacaugugauuuggaaga

SEQ ID NO: 1170348 - RNA, 19 nt, Homo sapiens
gguagaauguccagaugaa

SEQ ID NO: 1170349 - RNA, 19 nt, Homo sapiens
gcgaacaugugauuuggaa

SEQ ID NO: 1170350 - RNA, 19 nt, Homo sapiens
cauaagcacuagucuauag

SEQ ID NO: 1170351 - RNA, 19 nt, Homo sapiens
gggaugccauuauuacuug

SEQ ID NO: 1170352 - RNA, 19 nt, Homo sapiens
gcuggaaaguggucuauuc

SEQ ID NO: 1170353 - RNA, 19 nt, Homo sapiens
ggaaaagcaucacucauga

SEQ ID NO: 1170354 - RNA, 19 nt, Homo sapiens
aaaccgggcuuccaaagug

SEQ ID NO: 1170355 - RNA, 19 nt, Homo sapiens
aagcaucacucaugaagga

SEQ ID NO: 1170356 - RNA, 19 nt, Homo sapiens
ggcggcaccuuuccucuaa

SEQ ID NO: 1170357 - RNA, 19 nt, Homo sapiens
ggucagagcccagugaaga

SEQ ID NO: 1170358 - RNA, 19 nt, Homo sapiens
gagaaugccaccuuucaga

SEQ ID NO: 1170359 - RNA, 19 nt, Homo sapiens
ccagagacaagcagaguaa

SEQ ID NO: 1170360 - RNA, 19 nt, Homo sapiens
gaacgcgccuuggcaucuu

SEQ ID NO: 1170361 - RNA, 19 nt, Homo sapiens
cgaugaagauucgaaaugu

SEQ ID NO: 1170362 - RNA, 19 nt, Homo sapiens
caucauugcugcugucaag

SEQ ID NO: 1170363 - RNA, 19 nt, Homo sapiens
ugccaucgcucccaucauu

SEQ ID NO: 1170364 - RNA, 19 nt, Homo sapiens
caacccaucugugagaaug

SEQ ID NO: 1170365 - RNA, 19 nt, Homo sapiens
ggaagaggaagcaguggaa

SEQ ID NO: 1170366 - RNA, 19 nt, Homo sapiens
ccuggaagaugguuuggaa

SEQ ID NO: 1170367 - RNA, 19 nt, Homo sapiens
gcacugcaagcaugcguuu

SEQ ID NO: 1170368 - RNA, 19 nt, Homo sapiens
ccugaggaauucauaguug

SEQ ID NO: 1170369 - RNA, 19 nt, Homo sapiens
cacauaagcacuagucuau

SEQ ID NO: 1170370 - RNA, 19 nt, Homo sapiens
gagaaggcguucagagacu

SEQ ID NO: 1170371 - RNA, 19 nt, Homo sapiens
ccacauaagcacuagucua

SEQ ID NO: 1170372 - RNA, 19 nt, Homo sapiens
gaaggucagagcccaguga

SEQ ID NO: 1170373 - RNA, 19 nt, Homo sapiens
caugugauuuggaagaguu

SEQ ID NO: 1170374 - RNA, 19 nt, Homo sapiens
caacaaugcccaagcugau

SEQ ID NO: 1170375 - RNA, 19 nt, Homo sapiens
ccacaugaaggucugcuuu

SEQ ID NO: 1170376 - RNA, 19 nt, Homo sapiens
ggaagaugguuuggaagag

SEQ ID NO: 1170377 - RNA, 19 nt, Homo sapiens
gaugaagauucgaaauguc

SEQ ID NO: 1170378 - RNA, 19 nt, Homo sapiens
ggaggcagcucaggauagg

SEQ ID NO: 1170379 - RNA, 19 nt, Homo sapiens
agaagucaguacccagaaa

SEQ ID NO: 1170380 - RNA, 19 nt, Homo sapiens
cagagggaugccauuauua

SEQ ID NO: 1170381 - RNA, 19 nt, Homo sapiens
ccagagcgaucuucagacu

SEQ ID NO: 1170382 - RNA, 19 nt, Homo sapiens
gaagucaguacccagaaau

SEQ ID NO: 1170383 - RNA, 19 nt, Homo sapiens
caugacaguuuaccagauc

SEQ ID NO: 1170384 - RNA, 19 nt, Homo sapiens
gaaaccgggcuuccaaagu

SEQ ID NO: 1170385 - RNA, 19 nt, Homo sapiens
ucagaaggcugugugucuu

SEQ ID NO: 1170386 - RNA, 19 nt, Homo sapiens
guaucuugcugcagagaga

SEQ ID NO: 1170387 - RNA, 19 nt, Homo sapiens
uuucagagguaccaaggaa

SEQ ID NO: 1170388 - RNA, 19 nt, Homo sapiens
ccacccuccugauacauga

SEQ ID NO: 1170389 - RNA, 19 nt, Homo sapiens
ugccacacuugucaacaua

SEQ ID NO: 1170390 - RNA, 19 nt, Homo sapiens
gcagguaccagcaguggau

SEQ ID NO: 1170391 - RNA, 19 nt, Homo sapiens
gaagaggaagcaguggaaa

SEQ ID NO: 1170392 - RNA, 19 nt, Homo sapiens
gcucaaagcaaaggagaug

SEQ ID NO: 1170393 - RNA, 19 nt, Homo sapiens
ucauuaugcugaaccacuu

SEQ ID NO: 1170394 - RNA, 19 nt, Homo sapiens
guccugcaguggaaagauu

SEQ ID NO: 1170395 - RNA, 19 nt, Homo sapiens
cgacacgucucugcuacug

SEQ ID NO: 1170396 - RNA, 19 nt, Homo sapiens
gaaacuucuuggugcucaa

SEQ ID NO: 1170397 - RNA, 19 nt, Homo sapiens
gcaguggaaagauugauca

SEQ ID NO: 1170398 - RNA, 19 nt, Homo sapiens
aaacccagcucaaccucau

SEQ ID NO: 1170399 - RNA, 19 nt, Homo sapiens
caaccgguaucucuucaac

SEQ ID NO: 1170400 - RNA, 19 nt, Homo sapiens
ggacaacauauuccugaca

SEQ ID NO: 1170401 - RNA, 19 nt, Homo sapiens
gagccacaccuuccacaug

SEQ ID NO: 1170402 - RNA, 19 nt, Homo sapiens
ccacugaaagcccuguuug

SEQ ID NO: 1170403 - RNA, 19 nt, Homo sapiens
uggaaagauugaucaguuc

SEQ ID NO: 1170404 - RNA, 19 nt, Homo sapiens
caucacucaugaaggaaga

SEQ ID NO: 1170405 - RNA, 19 nt, Homo sapiens
gaaaagacacacagcacaa

SEQ ID NO: 1170406 - RNA, 19 nt, Homo sapiens
cugaggaauucauaguuga

SEQ ID NO: 1170407 - RNA, 19 nt, Homo sapiens
gucuauagaugccucuuag

SEQ ID NO: 1170408 - RNA, 19 nt, Homo sapiens
ccacacuugucaacauaag

SEQ ID NO: 1170409 - RNA, 19 nt, Homo sapiens
caugcaggagcacaaguua

SEQ ID NO: 1170410 - RNA, 19 nt, Homo sapiens
ucauucaacccaucuguga

SEQ ID NO: 1170411 - RNA, 19 nt, Homo sapiens
gugguagaauguccagaug

SEQ ID NO: 1170412 - RNA, 19 nt, Homo sapiens
ggaugaaaccaugacaguu

SEQ ID NO: 1170413 - RNA, 19 nt, Homo sapiens
gaagccacccuggaagaug

SEQ ID NO: 1170414 - RNA, 19 nt, Homo sapiens
gggaaaagcaucacucaug

SEQ ID NO: 1170415 - RNA, 19 nt, Homo sapiens
gguguuagccagagaagag

SEQ ID NO: 1170416 - RNA, 19 nt, Homo sapiens
gugccacacuugucaacau

SEQ ID NO: 1170417 - RNA, 19 nt, Homo sapiens
ugcaggagcacaaguuaaa

SEQ ID NO: 1170418 - RNA, 19 nt, Homo sapiens
caugaaggaagagagauuu

SEQ ID NO: 1170419 - RNA, 19 nt, Homo sapiens
ucguagcuuucaucuguaa

SEQ ID NO: 1170420 - RNA, 19 nt, Homo sapiens
ggacucuucccuggucgua

SEQ ID NO: 1170421 - RNA, 19 nt, Homo sapiens
gaaugcacuggucuaaugu

SEQ ID NO: 1170422 - RNA, 19 nt, Homo sapiens
uaugauuccugccaaaugc

SEQ ID NO: 1170423 - RNA, 19 nt, Homo sapiens
guaugauuccugccaaaug

SEQ ID NO: 1170424 - RNA, 19 nt, Homo sapiens
caguaugauuccugccaaa

SEQ ID NO: 1170425 - RNA, 19 nt, Homo sapiens
gugagaaugccaccuuuca

SEQ ID NO: 1170426 - RNA, 19 nt, Homo sapiens
gcuguguacuccuccagau

SEQ ID NO: 1170427 - RNA, 19 nt, Homo sapiens
guccagagcgaucuucaga

SEQ ID NO: 1170428 - RNA, 19 nt, Homo sapiens
ccaugacaguuuaccagau

SEQ ID NO: 1170429 - RNA, 19 nt, Homo sapiens
ccucuaauccagcaaagug

SEQ ID NO: 1170430 - RNA, 19 nt, Homo sapiens
cuauagaugccucuuagga

SEQ ID NO: 1170431 - RNA, 19 nt, Homo sapiens
ucaccaguuuccgcuguaa

SEQ ID NO: 1170432 - RNA, 19 nt, Homo sapiens
uggagaaggcguucagaga

SEQ ID NO: 1170433 - RNA, 19 nt, Homo sapiens
ccucgaagcaaucaaaaua

SEQ ID NO: 1170434 - RNA, 19 nt, Homo sapiens
ggagcacaaguuaaagguu

SEQ ID NO: 1170435 - RNA, 19 nt, Homo sapiens
ccgaugaagauucgaaaug

SEQ ID NO: 1170436 - RNA, 19 nt, Homo sapiens
ggugaaugccuccucaagu

SEQ ID NO: 1170437 - RNA, 19 nt, Homo sapiens
caagcagaugaacuaauuu

SEQ ID NO: 1170438 - RNA, 19 nt, Homo sapiens
ccacucgacuuuccucuua

SEQ ID NO: 1170439 - RNA, 19 nt, Homo sapiens
gcacaugggcagccuguuu

SEQ ID NO: 1170440 - RNA, 19 nt, Homo sapiens
ggaggaagcgggagcguuu

SEQ ID NO: 1170441 - RNA, 19 nt, Homo sapiens
gcaaccgcaucuuuacuug

SEQ ID NO: 1170442 - RNA, 19 nt, Homo sapiens
gggaacagcuggccaugag

SEQ ID NO: 1170443 - RNA, 19 nt, Homo sapiens
ggaccaccuucaccagcua

SEQ ID NO: 1170444 - RNA, 19 nt, Homo sapiens
uggaggagcuggagaaggu

SEQ ID NO: 1170445 - RNA, 19 nt, Homo sapiens
gcagcuaccugagugucaa

SEQ ID NO: 1170446 - RNA, 19 nt, Homo sapiens
ggacagcagcuaccugagu

SEQ ID NO: 1170447 - RNA, 19 nt, Homo sapiens
ccacuucuccacugcauau

SEQ ID NO: 1170448 - RNA, 19 nt, Homo sapiens
ccgcgcaaccgcaucuuua

SEQ ID NO: 1170449 - RNA, 19 nt, Homo sapiens
gaacggcagccucaaacuc

SEQ ID NO: 1170450 - RNA, 19 nt, Homo sapiens
gaacuacgcccagauucag

SEQ ID NO: 1170451 - RNA, 19 nt, Homo sapiens
ccacuacccagacguguau

SEQ ID NO: 1170452 - RNA, 19 nt, Homo sapiens
gagaaggccgacucagaga

SEQ ID NO: 1170453 - RNA, 19 nt, Homo sapiens
ugagaacuacgcccagauu

SEQ ID NO: 1170454 - RNA, 19 nt, Homo sapiens
ucaccgacuuccugagugu

SEQ ID NO: 1170455 - RNA, 19 nt, Homo sapiens
gcgcaagccaggcaugaau

SEQ ID NO: 1170456 - RNA, 19 nt, Homo sapiens
gagcaacaagggcaagaag

SEQ ID NO: 1170457 - RNA, 19 nt, Homo sapiens
gagaacuacgcccagauuc

SEQ ID NO: 1170458 - RNA, 19 nt, Homo sapiens
cagccucccacucgacuuu

SEQ ID NO: 1170459 - RNA, 19 nt, Homo sapiens
cacccgagcugagaacuac

SEQ ID NO: 1170460 - RNA, 19 nt, Homo sapiens
uggagaaggccgacucaga

SEQ ID NO: 1170461 - RNA, 19 nt, Homo sapiens
cguccuggcucggcaacaa

SEQ ID NO: 1170462 - RNA, 19 nt, Homo sapiens
gaagggccaaguggaggaa

SEQ ID NO: 1170463 - RNA, 19 nt, Homo sapiens
gggcuccuuuaacaaguuc

SEQ ID NO: 1170464 - RNA, 19 nt, Homo sapiens
cacaugggcagccuguuug

SEQ ID NO: 1170465 - RNA, 19 nt, Homo sapiens
ccagcagcgucaccgacuu

SEQ ID NO: 1170466 - RNA, 19 nt, Homo sapiens
agaacuacgcccagauuca

SEQ ID NO: 1170467 - RNA, 19 nt, Homo sapiens
aaccgcaucuuuacuugca

SEQ ID NO: 1170468 - RNA, 19 nt, Homo sapiens
gcaaauaggagauacauua

SEQ ID NO: 1170469 - RNA, 19 nt, Homo sapiens
gcagccaacucauaaauua

SEQ ID NO: 1170470 - RNA, 19 nt, Homo sapiens
agacaaagcucauucaauu

SEQ ID NO: 1170471 - RNA, 19 nt, Homo sapiens
gaaacugacuuuaagcaaa

SEQ ID NO: 1170472 - RNA, 19 nt, Homo sapiens
gaaagaggaaucacuguua

SEQ ID NO: 1170473 - RNA, 19 nt, Homo sapiens
gaagagcaguucagaagaa

SEQ ID NO: 1170474 - RNA, 19 nt, Homo sapiens
gcacaauguucuugaauga

SEQ ID NO: 1170475 - RNA, 19 nt, Homo sapiens
gaagaaugcugauccugaa

SEQ ID NO: 1170476 - RNA, 19 nt, Homo sapiens
gaugaaagaugucacugaa

SEQ ID NO: 1170477 - RNA, 19 nt, Homo sapiens
gaacuuacagggacaauug

SEQ ID NO: 1170478 - RNA, 19 nt, Homo sapiens
guagcaaacuucuuucuug

SEQ ID NO: 1170479 - RNA, 19 nt, Homo sapiens
guaauaugcugacaacaga

SEQ ID NO: 1170480 - RNA, 19 nt, Homo sapiens
ucugagagcuuugguauuu

SEQ ID NO: 1170481 - RNA, 19 nt, Homo sapiens
gcacagcuaucgguaauuc

SEQ ID NO: 1170482 - RNA, 19 nt, Homo sapiens
caaauaaccuacuagucuu

SEQ ID NO: 1170483 - RNA, 19 nt, Homo sapiens
gagaaaguguuugauauuc

SEQ ID NO: 1170484 - RNA, 19 nt, Homo sapiens
aguaagcacucaauuguaa

SEQ ID NO: 1170485 - RNA, 19 nt, Homo sapiens
aaagaggaaucacuguuaa

SEQ ID NO: 1170486 - RNA, 19 nt, Homo sapiens
gaccggagcaagaauauaa

SEQ ID NO: 1170487 - RNA, 19 nt, Homo sapiens
gagauuauacuacuaccua

SEQ ID NO: 1170488 - RNA, 19 nt, Homo sapiens
cuaaauaauuggugggaaa

SEQ ID NO: 1170489 - RNA, 19 nt, Homo sapiens
auaagcagguucuugauaa

SEQ ID NO: 1170490 - RNA, 19 nt, Homo sapiens
uaaaugccaucgaaagguu

SEQ ID NO: 1170491 - RNA, 19 nt, Homo sapiens
cuacauaaguuguuguugu

SEQ ID NO: 1170492 - RNA, 19 nt, Homo sapiens
cuacuagucuuucguugaa

SEQ ID NO: 1170493 - RNA, 19 nt, Homo sapiens
ugaaugaaauugugguaga

SEQ ID NO: 1170494 - RNA, 19 nt, Homo sapiens
caaaagacauacgaaguua

SEQ ID NO: 1170495 - RNA, 19 nt, Homo sapiens
gcagguucuugauaaauug

SEQ ID NO: 1170496 - RNA, 19 nt, Homo sapiens
gauaaaggaacauagagaa

SEQ ID NO: 1170497 - RNA, 19 nt, Homo sapiens
auauaaagcuguacuguca

SEQ ID NO: 1170498 - RNA, 19 nt, Homo sapiens
cauguugccuguucucaaa

SEQ ID NO: 1170499 - RNA, 19 nt, Homo sapiens
uagaggagcuaguaacugu

SEQ ID NO: 1170500 - RNA, 19 nt, Homo sapiens
gcaaguggaacgagaaaga

SEQ ID NO: 1170501 - RNA, 19 nt, Homo sapiens
gaagccauguugccuguuc

SEQ ID NO: 1170502 - RNA, 19 nt, Homo sapiens
uaucaauccugcacaauuc

SEQ ID NO: 1170503 - RNA, 19 nt, Homo sapiens
gugaacggcugaaggauuc

SEQ ID NO: 1170504 - RNA, 19 nt, Homo sapiens
gaauggaaauacuguagag

SEQ ID NO: 1170505 - RNA, 19 nt, Homo sapiens
gaaaguguuugauauucca

SEQ ID NO: 1170506 - RNA, 19 nt, Homo sapiens
ucaaauaaccuacuagucu

SEQ ID NO: 1170507 - RNA, 19 nt, Homo sapiens
guauuugacuccaccuuug

SEQ ID NO: 1170508 - RNA, 19 nt, Homo sapiens
gagcaguucagaagaauau

SEQ ID NO: 1170509 - RNA, 19 nt, Homo sapiens
gagacaagcagaagggaaa

SEQ ID NO: 1170510 - RNA, 19 nt, Homo sapiens
uuaaaugauuccaguguga

SEQ ID NO: 1170511 - RNA, 19 nt, Homo sapiens
ggacaggugggcuaucuga

SEQ ID NO: 1170512 - RNA, 19 nt, Homo sapiens
uaagcagguucuugauaaa

SEQ ID NO: 1170513 - RNA, 19 nt, Homo sapiens
gcuaguaacuguuguacac

SEQ ID NO: 1170514 - RNA, 19 nt, Homo sapiens
acacguggaucauggcaaa

SEQ ID NO: 1170515 - RNA, 19 nt, Homo sapiens
gaaugaaauugugguagau

SEQ ID NO: 1170516 - RNA, 19 nt, Homo sapiens
ugagagcuuugguauuuga

SEQ ID NO: 1170517 - RNA, 19 nt, Homo sapiens
gacaggcuccuagaacuua

SEQ ID NO: 1170518 - RNA, 19 nt, Homo sapiens
caggugggcuaucugauug

SEQ ID NO: 1170519 - RNA, 19 nt, Homo sapiens
acaauguucuugaaugaug

SEQ ID NO: 1170520 - RNA, 19 nt, Homo sapiens
cgaaguuaaugaaguagga

SEQ ID NO: 1170521 - RNA, 19 nt, Homo sapiens
acagacagcaucucucuuu

SEQ ID NO: 1170522 - RNA, 19 nt, Homo sapiens
gaugucauuuccuuaagug

SEQ ID NO: 1170523 - RNA, 19 nt, Homo sapiens
gcuaggauuucuuggacuu

SEQ ID NO: 1170524 - RNA, 19 nt, Homo sapiens
gaagcacagcuaucgguaa

SEQ ID NO: 1170525 - RNA, 19 nt, Homo sapiens
gaaguaggagucuugaauc

SEQ ID NO: 1170526 - RNA, 19 nt, Homo sapiens
ccaagugaugaauguauua

SEQ ID NO: 1170527 - RNA, 19 nt, Homo sapiens
uuacagggacaauugauaa

SEQ ID NO: 1170528 - RNA, 19 nt, Homo sapiens
guagcacaauguucuugaa

SEQ ID NO: 1170529 - RNA, 19 nt, Homo sapiens
guggugauauuacccgaaa

SEQ ID NO: 1170530 - RNA, 19 nt, Homo sapiens
cuacagcuccgcagaauuc

SEQ ID NO: 1170531 - RNA, 19 nt, Homo sapiens
uccaaccacucacuaguaa

SEQ ID NO: 1170532 - RNA, 19 nt, Homo sapiens
cugcuaaacuuggaacaaa

SEQ ID NO: 1170533 - RNA, 19 nt, Homo sapiens
gcacagacagcaucucucu

SEQ ID NO: 1170534 - RNA, 19 nt, Homo sapiens
guccuuaaaugccaucgaa

SEQ ID NO: 1170535 - RNA, 19 nt, Homo sapiens
cauaguaagcacucaauug

SEQ ID NO: 1170536 - RNA, 19 nt, Homo sapiens
cuagaccaaucugaauaua

SEQ ID NO: 1170537 - RNA, 19 nt, Homo sapiens
ccaaugguauuugcaggaa

SEQ ID NO: 1170538 - RNA, 19 nt, Homo sapiens
uaaaucagcgaaaccaaug

SEQ ID NO: 1170539 - RNA, 19 nt, Homo sapiens
ggaugaaagaugucacuga

SEQ ID NO: 1170540 - RNA, 19 nt, Homo sapiens
gagcagccaacucauaaau

SEQ ID NO: 1170541 - RNA, 19 nt, Homo sapiens
agacauacgaaguuaauga

SEQ ID NO: 1170542 - RNA, 19 nt, Homo sapiens
ccaaauugagaaaguguuu

SEQ ID NO: 1170543 - RNA, 19 nt, Homo sapiens
cauaaguuguuguugugaa

SEQ ID NO: 1170544 - RNA, 19 nt, Homo sapiens
cuaccagacugcagaacuu

SEQ ID NO: 1170545 - RNA, 19 nt, Homo sapiens
gcaguucagaagaauauga

SEQ ID NO: 1170546 - RNA, 19 nt, Homo sapiens
agaccaaucugaauauaac

SEQ ID NO: 1170547 - RNA, 19 nt, Homo sapiens
cauacgaaguuaaugaagu

SEQ ID NO: 1170548 - RNA, 19 nt, Homo sapiens
gcaaaugagggaauucaag

SEQ ID NO: 1170549 - RNA, 19 nt, Homo sapiens
gaacgagaaagaggaauca

SEQ ID NO: 1170550 - RNA, 19 nt, Homo sapiens
ucugaagagugcuauagaa

SEQ ID NO: 1170551 - RNA, 19 nt, Homo sapiens
auaauaagcagguucuuga

SEQ ID NO: 1170552 - RNA, 19 nt, Homo sapiens
uuccuuaagugguuuguaa

SEQ ID NO: 1170553 - RNA, 19 nt, Homo sapiens
agugaaagccuauaggaaa

SEQ ID NO: 1170554 - RNA, 19 nt, Homo sapiens
gcccuugccuggguuuaaa

SEQ ID NO: 1170555 - RNA, 19 nt, Homo sapiens
gaggugugauagccaaugu

SEQ ID NO: 1170556 - RNA, 19 nt, Homo sapiens
aagcacagcuaucgguaau

SEQ ID NO: 1170557 - RNA, 19 nt, Homo sapiens
ggugcaagacacauaguaa

SEQ ID NO: 1170558 - RNA, 19 nt, Homo sapiens
gguauuugcaggaauguau

SEQ ID NO: 1170559 - RNA, 19 nt, Homo sapiens
ugaaguaggagucuugaau

SEQ ID NO: 1170560 - RNA, 19 nt, Homo sapiens
gaauucaagcccaaacugu

SEQ ID NO: 1170561 - RNA, 19 nt, Homo sapiens
aggaaucacuguuaaagca

SEQ ID NO: 1170562 - RNA, 19 nt, Homo sapiens
ugucuucgcuucacaggau

SEQ ID NO: 1170563 - RNA, 19 nt, Homo sapiens
uacauaaguuguuguugug

SEQ ID NO: 1170564 - RNA, 19 nt, Homo sapiens
acuacuaccuacauaaguu

SEQ ID NO: 1170565 - RNA, 19 nt, Homo sapiens
uaaccuuuguuuccucuuc

SEQ ID NO: 1170566 - RNA, 19 nt, Homo sapiens
cuaggcaacuguuugagau

SEQ ID NO: 1170567 - RNA, 19 nt, Homo sapiens
gaggagcuaguaacuguug

SEQ ID NO: 1170568 - RNA, 19 nt, Homo sapiens
gaaauggucucaagggaaa

SEQ ID NO: 1170569 - RNA, 19 nt, Homo sapiens
gaagugaucugggauuuau

SEQ ID NO: 1170570 - RNA, 19 nt, Homo sapiens
acacguaucugucccauuu

SEQ ID NO: 1170571 - RNA, 19 nt, Homo sapiens
ucauuaaucucuucccuua

SEQ ID NO: 1170572 - RNA, 19 nt, Homo sapiens
gaaccaaguuguccuaugg

SEQ ID NO: 1170573 - RNA, 19 nt, Homo sapiens
gcaacuuucuccacuuaaa

SEQ ID NO: 1170574 - RNA, 19 nt, Homo sapiens
guuaagcaguuguuucuuu

SEQ ID NO: 1170575 - RNA, 19 nt, Homo sapiens
ugauauaacugcugaucua

SEQ ID NO: 1170576 - RNA, 19 nt, Homo sapiens
gaaacaggaaugucacuuu

SEQ ID NO: 1170577 - RNA, 19 nt, Homo sapiens
uagcaacuuucuccacuua

SEQ ID NO: 1170578 - RNA, 19 nt, Homo sapiens
aaaguaagcaugaaaggua

SEQ ID NO: 1170579 - RNA, 19 nt, Homo sapiens
aaacaggaaugucacuuug

SEQ ID NO: 1170580 - RNA, 19 nt, Homo sapiens
ggaauucuaccucuuguga

SEQ ID NO: 1170581 - RNA, 19 nt, Homo sapiens
gcguugccauugaaaguua

SEQ ID NO: 1170582 - RNA, 19 nt, Homo sapiens
ggaaggcccauaauacuug

SEQ ID NO: 1170583 - RNA, 19 nt, Homo sapiens
ugaaguauucccuguauuu

SEQ ID NO: 1170584 - RNA, 19 nt, Homo sapiens
gaucugggauuuaucacau

SEQ ID NO: 1170585 - RNA, 19 nt, Homo sapiens
cgaagcugcugcugaaaga

SEQ ID NO: 1170586 - RNA, 19 nt, Homo sapiens
ugaguuauguuucuucuag

SEQ ID NO: 1170587 - RNA, 19 nt, Homo sapiens
gggagacgaucgcgaugaa

SEQ ID NO: 1170588 - RNA, 19 nt, Homo sapiens
cugcugaucuagagaauau

SEQ ID NO: 1170589 - RNA, 19 nt, Homo sapiens
aaacguuccuuuauagcuu

SEQ ID NO: 1170590 - RNA, 19 nt, Homo sapiens
gguauaagaacuaacauca

SEQ ID NO: 1170591 - RNA, 19 nt, Homo sapiens
gacaggaucaggacacgua

SEQ ID NO: 1170592 - RNA, 19 nt, Homo sapiens
cuucauguauuguugguuu

SEQ ID NO: 1170593 - RNA, 19 nt, Homo sapiens
cuucagugcuuucucuaaa

SEQ ID NO: 1170594 - RNA, 19 nt, Homo sapiens
gaucaggacacguaucugu

SEQ ID NO: 1170595 - RNA, 19 nt, Homo sapiens
caaaaggccuguuuaaagg

SEQ ID NO: 1170596 - RNA, 19 nt, Homo sapiens
acaugugacuagcaacuuu

SEQ ID NO: 1170597 - RNA, 19 nt, Homo sapiens
ucucuucccuuacaucuuc

SEQ ID NO: 1170598 - RNA, 19 nt, Homo sapiens
cauaugaaauaacgaagag

SEQ ID NO: 1170599 - RNA, 19 nt, Homo sapiens
gaaggcccauaauacuugu

SEQ ID NO: 1170600 - RNA, 19 nt, Homo sapiens
guuagaagucugguuuaua

SEQ ID NO: 1170601 - RNA, 19 nt, Homo sapiens
guagagucauaauaacugu

SEQ ID NO: 1170602 - RNA, 19 nt, Homo sapiens
gaagauuucacuggaccua

SEQ ID NO: 1170603 - RNA, 19 nt, Homo sapiens
gccuguagagucauaauaa

SEQ ID NO: 1170604 - RNA, 19 nt, Homo sapiens
cagcagaauauucaacaaa

SEQ ID NO: 1170605 - RNA, 19 nt, Homo sapiens
aagaagugaucugggauuu

SEQ ID NO: 1170606 - RNA, 19 nt, Homo sapiens
ggaccuagagaaagaagug

SEQ ID NO: 1170607 - RNA, 19 nt, Homo sapiens
ugguuuacccucugaguua

SEQ ID NO: 1170608 - RNA, 19 nt, Homo sapiens
ucacgcaaauucacauugg

SEQ ID NO: 1170609 - RNA, 19 nt, Homo sapiens
gaaguauucccuguauuuc

SEQ ID NO: 1170610 - RNA, 19 nt, Homo sapiens
uauaacugcugaucuagag

SEQ ID NO: 1170611 - RNA, 19 nt, Homo sapiens
caucaccaccgccuucaaa

SEQ ID NO: 1170612 - RNA, 19 nt, Homo sapiens
accaaaugcuggaauucua

SEQ ID NO: 1170613 - RNA, 19 nt, Homo sapiens
auaaugcucugaaccaagu

SEQ ID NO: 1170614 - RNA, 19 nt, Homo sapiens
caaaaugugugucuucagu

SEQ ID NO: 1170615 - RNA, 19 nt, Homo sapiens
cgauggaaauggucucaag

SEQ ID NO: 1170616 - RNA, 19 nt, Homo sapiens
aaauaaugcucugaaccaa

SEQ ID NO: 1170617 - RNA, 19 nt, Homo sapiens
cguaccaaaugcuggaauu

SEQ ID NO: 1170618 - RNA, 19 nt, Homo sapiens
cuuaggaaggcccauaaua

SEQ ID NO: 1170619 - RNA, 19 nt, Homo sapiens
cacuggaccuagagaaaga

SEQ ID NO: 1170620 - RNA, 19 nt, Homo sapiens
ggaauguuaagcaguuguu

SEQ ID NO: 1170621 - RNA, 19 nt, Homo sapiens
ucugggauuuaucacauuu

SEQ ID NO: 1170622 - RNA, 19 nt, Homo sapiens
uaacugcugaucuagagaa

SEQ ID NO: 1170623 - RNA, 19 nt, Homo sapiens
gcaugccugcugucacuaa

SEQ ID NO: 1170624 - RNA, 19 nt, Homo sapiens
ugaaccaaguuguccuaug

SEQ ID NO: 1170625 - RNA, 19 nt, Homo sapiens
ugggauuuaucacauuuga

SEQ ID NO: 1170626 - RNA, 19 nt, Homo sapiens
ccacuuaaagacuaaauac

SEQ ID NO: 1170627 - RNA, 19 nt, Homo sapiens
uuucuccacuuaaagacua

SEQ ID NO: 1170628 - RNA, 19 nt, Homo sapiens
gagacgaucgcgaugaaca

SEQ ID NO: 1170629 - RNA, 19 nt, Homo sapiens
gcuggaauucuaccucuug

SEQ ID NO: 1170630 - RNA, 19 nt, Homo sapiens
ucacuuugacccugucuug

SEQ ID NO: 1170631 - RNA, 19 nt, Homo sapiens
aagcugcugcugaaagaua

SEQ ID NO: 1170632 - RNA, 19 nt, Homo sapiens
gcugaucuagagaauauau

SEQ ID NO: 1170633 - RNA, 19 nt, Homo sapiens
agauuucacuggaccuaga

SEQ ID NO: 1170634 - RNA, 19 nt, Homo sapiens
auuaaucucuucccuuaca

SEQ ID NO: 1170635 - RNA, 19 nt, Homo sapiens
uuugaaguauucccuguau

SEQ ID NO: 1170636 - RNA, 19 nt, Homo sapiens
uaaagggaaagguuaaugg

SEQ ID NO: 1170637 - RNA, 19 nt, Homo sapiens
gcacgucucgcggaucaug

SEQ ID NO: 1170638 - RNA, 19 nt, Homo sapiens
ggaaacaggaaugucacuu

SEQ ID NO: 1170639 - RNA, 19 nt, Homo sapiens
gguuuacccucugaguuau

SEQ ID NO: 1170640 - RNA, 19 nt, Homo sapiens
ucaaaaggccuguuuaaag

SEQ ID NO: 1170641 - RNA, 19 nt, Homo sapiens
ucucgcggaucaugcuaaa

SEQ ID NO: 1170642 - RNA, 19 nt, Homo sapiens
agaagugaucugggauuua

SEQ ID NO: 1170643 - RNA, 19 nt, Homo sapiens
gaauguuaagcaguuguuu

SEQ ID NO: 1170644 - RNA, 19 nt, Homo sapiens
ucagcagaauauucaacaa

SEQ ID NO: 1170645 - RNA, 19 nt, Homo sapiens
guuccuuuauagcuuugua

SEQ ID NO: 1170646 - RNA, 19 nt, Homo sapiens
uuaggaaggcccauaauac

SEQ ID NO: 1170647 - RNA, 19 nt, Homo sapiens
aagcaugaaagguaguuaa

SEQ ID NO: 1170648 - RNA, 19 nt, Homo sapiens
gggcuacuuaauauuauga

SEQ ID NO: 1170649 - RNA, 19 nt, Homo sapiens
aagguuaaugggcuacuua

SEQ ID NO: 1170650 - RNA, 19 nt, Homo sapiens
aaagaagugaucugggauu

SEQ ID NO: 1170651 - RNA, 19 nt, Homo sapiens
uguuagaagucugguuuau

SEQ ID NO: 1170652 - RNA, 19 nt, Homo sapiens
caucaaaaggccuguuuaa

SEQ ID NO: 1170653 - RNA, 19 nt, Homo sapiens
cugcacgucucgcggauca

SEQ ID NO: 1170654 - RNA, 19 nt, Homo sapiens
ggaacgucguaccaaaugc

SEQ ID NO: 1170655 - RNA, 19 nt, Homo sapiens
gaacgucguaccaaaugcu

SEQ ID NO: 1170656 - RNA, 19 nt, Homo sapiens
auuggaauguuaagcaguu

SEQ ID NO: 1170657 - RNA, 19 nt, Homo sapiens
gcugaaagauaugaaaaca

SEQ ID NO: 1170658 - RNA, 19 nt, Homo sapiens
auccgaagcugcugcugaa

SEQ ID NO: 1170659 - RNA, 19 nt, Homo sapiens
gauauaacugcugaucuag

SEQ ID NO: 1170660 - RNA, 19 nt, Homo sapiens
cuagcaacuuucuccacuu

SEQ ID NO: 1170661 - RNA, 19 nt, Homo sapiens
ccaaaagugauggaauuua

SEQ ID NO: 1170662 - RNA, 19 nt, Homo sapiens
aauucuaccucuugugaca

SEQ ID NO: 1170663 - RNA, 19 nt, Homo sapiens
ucaccaccgccuucaaaga

SEQ ID NO: 1170664 - RNA, 19 nt, Homo sapiens
gaguuauguuucuucuagu

SEQ ID NO: 1170665 - RNA, 19 nt, Homo sapiens
uaggaaggcccauaauacu

SEQ ID NO: 1170666 - RNA, 19 nt, Homo sapiens
caugaaagguaguuaaaac

SEQ ID NO: 1170667 - RNA, 19 nt, Homo sapiens
uaaaguaagcaugaaaggu

SEQ ID NO: 1170668 - RNA, 19 nt, Homo sapiens
gaaauuuacucguguguua

SEQ ID NO: 1170669 - RNA, 19 nt, Homo sapiens
gaacucaucucaugcaaga

SEQ ID NO: 1170670 - RNA, 19 nt, Homo sapiens
gaaguaggcauaaugguua

SEQ ID NO: 1170671 - RNA, 19 nt, Homo sapiens
gagauaagcuuggucauau

SEQ ID NO: 1170672 - RNA, 19 nt, Homo sapiens
gggaagaaauggugaacua

SEQ ID NO: 1170673 - RNA, 19 nt, Homo sapiens
uaacagggcucgacagaga

SEQ ID NO: 1170674 - RNA, 19 nt, Homo sapiens
ugaagaagcuugucgagaa

SEQ ID NO: 1170675 - RNA, 19 nt, Homo sapiens
agaaagagauccagaaguu

SEQ ID NO: 1170676 - RNA, 19 nt, Homo sapiens
gagaacuacuucaugauaa

SEQ ID NO: 1170677 - RNA, 19 nt, Homo sapiens
gaaaccaaguuaaucgaaa

SEQ ID NO: 1170678 - RNA, 19 nt, Homo sapiens
gauaagcuauuuggucuuu

SEQ ID NO: 1170679 - RNA, 19 nt, Homo sapiens
caaagaagaguaaagagua

SEQ ID NO: 1170680 - RNA, 19 nt, Homo sapiens
ggagaacuacuucaugaua

SEQ ID NO: 1170681 - RNA, 19 nt, Homo sapiens
uaugaaagcuucuguagau

SEQ ID NO: 1170682 - RNA, 19 nt, Homo sapiens
gaaaggccguaguaguaaa

SEQ ID NO: 1170683 - RNA, 19 nt, Homo sapiens
cagaaaggccguaguagua

SEQ ID NO: 1170684 - RNA, 19 nt, Homo sapiens
gaagaaauggugaacuauu

SEQ ID NO: 1170685 - RNA, 19 nt, Homo sapiens
ccaacgauguuuagcagua

SEQ ID NO: 1170686 - RNA, 19 nt, Homo sapiens
uaccauaaccuucgcauua

SEQ ID NO: 1170687 - RNA, 19 nt, Homo sapiens
gaagaagcuugucgagaau

SEQ ID NO: 1170688 - RNA, 19 nt, Homo sapiens
ucugugagguugugaauuu

SEQ ID NO: 1170689 - RNA, 19 nt, Homo sapiens
gaccagugcuguugcagaa

SEQ ID NO: 1170690 - RNA, 19 nt, Homo sapiens
caagaucucuguuacaaac

SEQ ID NO: 1170691 - RNA, 19 nt, Homo sapiens
caccuugccugaacugaua

SEQ ID NO: 1170692 - RNA, 19 nt, Homo sapiens
gaaagcuucuguagaugau

SEQ ID NO: 1170693 - RNA, 19 nt, Homo sapiens
uguaucgacuccuuuguua

SEQ ID NO: 1170694 - RNA, 19 nt, Homo sapiens
gaacugauagggauuaugg

SEQ ID NO: 1170695 - RNA, 19 nt, Homo sapiens
uaucaaggauggcacuauu

SEQ ID NO: 1170696 - RNA, 19 nt, Homo sapiens
gaagccaugucugcuauug

SEQ ID NO: 1170697 - RNA, 19 nt, Homo sapiens
gaauuggaacucuacagua

SEQ ID NO: 1170698 - RNA, 19 nt, Homo sapiens
uaaaagauguggaggauga

SEQ ID NO: 1170699 - RNA, 19 nt, Homo sapiens
guaaauaaagcugcuguuu

SEQ ID NO: 1170700 - RNA, 19 nt, Homo sapiens
gcaaagaagaguaaagagu

SEQ ID NO: 1170701 - RNA, 19 nt, Homo sapiens
agaagcuugucgagaauua

SEQ ID NO: 1170702 - RNA, 19 nt, Homo sapiens
gaaaugauggaucccaaga

SEQ ID NO: 1170703 - RNA, 19 nt, Homo sapiens
aaaaggagaucauccaauu

SEQ ID NO: 1170704 - RNA, 19 nt, Homo sapiens
uagaagauccugcuaugaa

SEQ ID NO: 1170705 - RNA, 19 nt, Homo sapiens
ugaacaagcuaucaaggau

SEQ ID NO: 1170706 - RNA, 19 nt, Homo sapiens
gccgauggcucucaaaugg

SEQ ID NO: 1170707 - RNA, 19 nt, Homo sapiens
gaaagagaccagugcuguu

SEQ ID NO: 1170708 - RNA, 19 nt, Homo sapiens
gaagaaagagauccagaag

SEQ ID NO: 1170709 - RNA, 19 nt, Homo sapiens
gaggaugacaugcaaagaa

SEQ ID NO: 1170710 - RNA, 19 nt, Homo sapiens
cacgagauacuauuacaua

SEQ ID NO: 1170711 - RNA, 19 nt, Homo sapiens
cccaagugcuaccuauaua

SEQ ID NO: 1170712 - RNA, 19 nt, Homo sapiens
uuacgugccuuuacauuca

SEQ ID NO: 1170713 - RNA, 19 nt, Homo sapiens
ugggagaacuacuucauga

SEQ ID NO: 1170714 - RNA, 19 nt, Homo sapiens
gaucucaccuugccugaac

SEQ ID NO: 1170715 - RNA, 19 nt, Homo sapiens
caaacuggguggacauuac

SEQ ID NO: 1170716 - RNA, 19 nt, Homo sapiens
gcagaaaggccguaguagu

SEQ ID NO: 1170717 - RNA, 19 nt, Homo sapiens
cagcagaaaggccguagua

SEQ ID NO: 1170718 - RNA, 19 nt, Homo sapiens
cggccauucuguagucuua

SEQ ID NO: 1170719 - RNA, 19 nt, Homo sapiens
ccaccuaccuucccucgau

SEQ ID NO: 1170720 - RNA, 19 nt, Homo sapiens
cauaauucauugcaucaug

SEQ ID NO: 1170721 - RNA, 19 nt, Homo sapiens
ucaaggauggcacuauuaa

SEQ ID NO: 1170722 - RNA, 19 nt, Homo sapiens
cauuuggccugguuaggua

SEQ ID NO: 1170723 - RNA, 19 nt, Homo sapiens
aaagagauccagaaguuga

SEQ ID NO: 1170724 - RNA, 19 nt, Homo sapiens
ugacagaucuucgaguuac

SEQ ID NO: 1170725 - RNA, 19 nt, Homo sapiens
gcacuucggucuuuuguca

SEQ ID NO: 1170726 - RNA, 19 nt, Homo sapiens
ugcaagacauggugaaaga

SEQ ID NO: 1170727 - RNA, 19 nt, Homo sapiens
guauuuacgugccuuuaca

SEQ ID NO: 1170728 - RNA, 19 nt, Homo sapiens
ggaaaccaaguuaaucgaa

SEQ ID NO: 1170729 - RNA, 19 nt, Homo sapiens
aauuggaacucuacaguau

SEQ ID NO: 1170730 - RNA, 19 nt, Homo sapiens
gaaaaucugugacauugca

SEQ ID NO: 1170731 - RNA, 19 nt, Homo sapiens
gcacagacaguauuuacgu

SEQ ID NO: 1170732 - RNA, 19 nt, Homo sapiens
caacgauguuuagcaguau

SEQ ID NO: 1170733 - RNA, 19 nt, Homo sapiens
gaaagagauccagaaguug

SEQ ID NO: 1170734 - RNA, 19 nt, Homo sapiens
ggacauuacccaagauuuu

SEQ ID NO: 1170735 - RNA, 19 nt, Homo sapiens
guaaagaguacucgaaguc

SEQ ID NO: 1170736 - RNA, 19 nt, Homo sapiens
gaauuaaaguugggagaac

SEQ ID NO: 1170737 - RNA, 19 nt, Homo sapiens
gauaagcuuggucauauuc

SEQ ID NO: 1170738 - RNA, 19 nt, Homo sapiens
ccaagugcuaccuauauaa

SEQ ID NO: 1170739 - RNA, 19 nt, Homo sapiens
ugaauuuagugaacaguca

SEQ ID NO: 1170740 - RNA, 19 nt, Homo sapiens
ggauggcacuauuaaaauu

SEQ ID NO: 1170741 - RNA, 19 nt, Homo sapiens
aaugauggaucccaagaug

SEQ ID NO: 1170742 - RNA, 19 nt, Homo sapiens
cuaaguggcuuugaauugg

SEQ ID NO: 1170743 - RNA, 19 nt, Homo sapiens
uuagguaccuggguccuuu

SEQ ID NO: 1170744 - RNA, 19 nt, Homo sapiens
gccauucuguagucuuauu

SEQ ID NO: 1170745 - RNA, 19 nt, Homo sapiens
aaaggagaucauccaauua

SEQ ID NO: 1170746 - RNA, 19 nt, Homo sapiens
ggauuauggauacauguuu

SEQ ID NO: 1170747 - RNA, 19 nt, Homo sapiens
ugauagggauuauggauac

SEQ ID NO: 1170748 - RNA, 19 nt, Homo sapiens
ccuggguccuuuaccauaa

SEQ ID NO: 1170749 - RNA, 19 nt, Homo sapiens
agagauaagcuuggucaua

SEQ ID NO: 1170750 - RNA, 19 nt, Homo sapiens
gaacuagaacaccaacgau

SEQ ID NO: 1170751 - RNA, 19 nt, Homo sapiens
gacaugcaaagaagaguaa

SEQ ID NO: 1170752 - RNA, 19 nt, Homo sapiens
ugugacagaucuucgaguu

SEQ ID NO: 1170753 - RNA, 19 nt, Homo sapiens
ugaaagcuucuguagauga

SEQ ID NO: 1170754 - RNA, 19 nt, Homo sapiens
guaucucucugaauuccuu

SEQ ID NO: 1170755 - RNA, 19 nt, Homo sapiens
auugguaucucucugaauu

SEQ ID NO: 1170756 - RNA, 19 nt, Homo sapiens
auaauaaucaccaggcuaa

SEQ ID NO: 1170757 - RNA, 19 nt, Homo sapiens
gacagugcuuauagccuuu

SEQ ID NO: 1170758 - RNA, 19 nt, Homo sapiens
gcaguauucagcagaguga

SEQ ID NO: 1170759 - RNA, 19 nt, Homo sapiens
guaccuggguccuuuacca

SEQ ID NO: 1170760 - RNA, 19 nt, Homo sapiens
caagugcuaccuauauaau

SEQ ID NO: 1170761 - RNA, 19 nt, Homo sapiens
gcauccaggcccagaauga

SEQ ID NO: 1170762 - RNA, 19 nt, Homo sapiens
gaucuucuuucugccauuc

SEQ ID NO: 1170763 - RNA, 19 nt, Homo sapiens
gugcuuauagccuuuacua

SEQ ID NO: 1170764 - RNA, 19 nt, Homo sapiens
gggagaaguaggcauaaug

SEQ ID NO: 1170765 - RNA, 19 nt, Homo sapiens
ggagaaguaggcauaaugg

SEQ ID NO: 1170766 - RNA, 19 nt, Homo sapiens
gcagaggaaaggauaaugg

SEQ ID NO: 1170767 - RNA, 19 nt, Homo sapiens
uaaguggcuuugaauugga

SEQ ID NO: 1170768 - RNA, 19 nt, Homo sapiens
gaaauucuguuguggauaa

SEQ ID NO: 1170769 - RNA, 19 nt, Homo sapiens
ccaauuggauuucaaguua

SEQ ID NO: 1170770 - RNA, 19 nt, Homo sapiens
gaaguacucuuguuugaaa

SEQ ID NO: 1170771 - RNA, 19 nt, Homo sapiens
gaacagguacuuacaauuu

SEQ ID NO: 1170772 - RNA, 19 nt, Homo sapiens
ggaagaaccucgaggagaa

SEQ ID NO: 1170773 - RNA, 19 nt, Homo sapiens
uagagaagcuggauguaua

SEQ ID NO: 1170774 - RNA, 19 nt, Homo sapiens
aaagaagccuguauuguuu

SEQ ID NO: 1170775 - RNA, 19 nt, Homo sapiens
guacucaucuucuugguuu

SEQ ID NO: 1170776 - RNA, 19 nt, Homo sapiens
gcaggaaacucaucucuuc

SEQ ID NO: 1170777 - RNA, 19 nt, Homo sapiens
gaacagaggacaguaagua

SEQ ID NO: 1170778 - RNA, 19 nt, Homo sapiens
gaaguuagccacugauauu

SEQ ID NO: 1170779 - RNA, 19 nt, Homo sapiens
uaacacaagugaugaaaga

SEQ ID NO: 1170780 - RNA, 19 nt, Homo sapiens
gaagauucagccaauauua

SEQ ID NO: 1170781 - RNA, 19 nt, Homo sapiens
uggcagaacuugacauuaa

SEQ ID NO: 1170782 - RNA, 19 nt, Homo sapiens
gugauaacauucagcaaua

SEQ ID NO: 1170783 - RNA, 19 nt, Homo sapiens
gaaaugaaaguuccagauu

SEQ ID NO: 1170784 - RNA, 19 nt, Homo sapiens
guacuuauguggauuggaa

SEQ ID NO: 1170785 - RNA, 19 nt, Homo sapiens
caaacuggcucaacaagau

SEQ ID NO: 1170786 - RNA, 19 nt, Homo sapiens
gaucuuggaaccaugauua

SEQ ID NO: 1170787 - RNA, 19 nt, Homo sapiens
ggaaaugaccuuaaaucuu

SEQ ID NO: 1170788 - RNA, 19 nt, Homo sapiens
ugacaugauuaaccucuua

SEQ ID NO: 1170789 - RNA, 19 nt, Homo sapiens
ggagagcucugucuuugau

SEQ ID NO: 1170790 - RNA, 19 nt, Homo sapiens
caacaguacuagcagauug

SEQ ID NO: 1170791 - RNA, 19 nt, Homo sapiens
ugacguggaugaaaugaaa

SEQ ID NO: 1170792 - RNA, 19 nt, Homo sapiens
gaacuugacauuaaacuuc

SEQ ID NO: 1170793 - RNA, 19 nt, Homo sapiens
gaacuacaucucaacagua

SEQ ID NO: 1170794 - RNA, 19 nt, Homo sapiens
gcaguuagaagaacaggua

SEQ ID NO: 1170795 - RNA, 19 nt, Homo sapiens
gaaguaaacaagucaguga

SEQ ID NO: 1170796 - RNA, 19 nt, Homo sapiens
guauacaucuaccaagaaa

SEQ ID NO: 1170797 - RNA, 19 nt, Homo sapiens
gguuauaacugacagguau

SEQ ID NO: 1170798 - RNA, 19 nt, Homo sapiens
gcagaagaaucaaagcaau

SEQ ID NO: 1170799 - RNA, 19 nt, Homo sapiens
acaguuaaauucuggcaua

SEQ ID NO: 1170800 - RNA, 19 nt, Homo sapiens
ggaaucaucuuguacucau

SEQ ID NO: 1170801 - RNA, 19 nt, Homo sapiens
gcaaaugcuuguagagaag

SEQ ID NO: 1170802 - RNA, 19 nt, Homo sapiens
ggcaaaugcuuguagagaa

SEQ ID NO: 1170803 - RNA, 19 nt, Homo sapiens
acaaaccucagaugaauua

SEQ ID NO: 1170804 - RNA, 19 nt, Homo sapiens
gauaugacucggaaucuuu

SEQ ID NO: 1170805 - RNA, 19 nt, Homo sapiens
gcagcuuuguuucuccuua

SEQ ID NO: 1170806 - RNA, 19 nt, Homo sapiens
ggauaucacugacguggau

SEQ ID NO: 1170807 - RNA, 19 nt, Homo sapiens
ggagaaaagugacauaaau

SEQ ID NO: 1170808 - RNA, 19 nt, Homo sapiens
cuacaaaccucagaugaau

SEQ ID NO: 1170809 - RNA, 19 nt, Homo sapiens
gaacuaagugauaacauuc

SEQ ID NO: 1170810 - RNA, 19 nt, Homo sapiens
gcaagagaccagaaaauua

SEQ ID NO: 1170811 - RNA, 19 nt, Homo sapiens
aaaugaaaguuccagauug

SEQ ID NO: 1170812 - RNA, 19 nt, Homo sapiens
cagaagagguucagguauc

SEQ ID NO: 1170813 - RNA, 19 nt, Homo sapiens
uaagggaaauucuguugug

SEQ ID NO: 1170814 - RNA, 19 nt, Homo sapiens
gauguugagauucuacuua

SEQ ID NO: 1170815 - RNA, 19 nt, Homo sapiens
ucacugacguggaugaaau

SEQ ID NO: 1170816 - RNA, 19 nt, Homo sapiens
gaagaacagguacuuacaa

SEQ ID NO: 1170817 - RNA, 19 nt, Homo sapiens
uaaagaugcugcaaaauug

SEQ ID NO: 1170818 - RNA, 19 nt, Homo sapiens
ccacugauauuccuugucu

SEQ ID NO: 1170819 - RNA, 19 nt, Homo sapiens
uggaaaccauacugaauuu

SEQ ID NO: 1170820 - RNA, 19 nt, Homo sapiens
gagaagauucagccaauau

SEQ ID NO: 1170821 - RNA, 19 nt, Homo sapiens
agacuaauguguuaagcaa

SEQ ID NO: 1170822 - RNA, 19 nt, Homo sapiens
aggacaagcuuacaaguga

SEQ ID NO: 1170823 - RNA, 19 nt, Homo sapiens
caugagagccacaguuaaa

SEQ ID NO: 1170824 - RNA, 19 nt, Homo sapiens
ggcagaacuugacauuaaa

SEQ ID NO: 1170825 - RNA, 19 nt, Homo sapiens
gaagagaucgaacgucauc

SEQ ID NO: 1170826 - RNA, 19 nt, Homo sapiens
gaacguuuaaagcaugaua

SEQ ID NO: 1170827 - RNA, 19 nt, Homo sapiens
gauauuccuugucugcuau

SEQ ID NO: 1170828 - RNA, 19 nt, Homo sapiens
gagggaaccggcagacuaa

SEQ ID NO: 1170829 - RNA, 19 nt, Homo sapiens
caaagcaacucccagaaaa

SEQ ID NO: 1170830 - RNA, 19 nt, Homo sapiens
cagaaggacuuaguagaug

SEQ ID NO: 1170831 - RNA, 19 nt, Homo sapiens
ggaugaaguacucuuguuu

SEQ ID NO: 1170832 - RNA, 19 nt, Homo sapiens
uaagcaagccagaauggua

SEQ ID NO: 1170833 - RNA, 19 nt, Homo sapiens
guucagguaucacuucaga

SEQ ID NO: 1170834 - RNA, 19 nt, Homo sapiens
cagaugaauuacuuacuga

SEQ ID NO: 1170835 - RNA, 19 nt, Homo sapiens
auggugaucucccuucuua

SEQ ID NO: 1170836 - RNA, 19 nt, Homo sapiens
gggaaauucuguuguggau

SEQ ID NO: 1170837 - RNA, 19 nt, Homo sapiens
guauaaaugcugaguaugu

SEQ ID NO: 1170838 - RNA, 19 nt, Homo sapiens
ggacaaauuggccuaauac

SEQ ID NO: 1170839 - RNA, 19 nt, Homo sapiens
gcacuacugcugaaagaug

SEQ ID NO: 1170840 - RNA, 19 nt, Homo sapiens
uaggacagcuagccucuau

SEQ ID NO: 1170841 - RNA, 19 nt, Homo sapiens
guaugcauauucuaucaga

SEQ ID NO: 1170842 - RNA, 19 nt, Homo sapiens
ccaaagcaacucccagaaa

SEQ ID NO: 1170843 - RNA, 19 nt, Homo sapiens
caauaucugaugaccaaua

SEQ ID NO: 1170844 - RNA, 19 nt, Homo sapiens
gaaguuggaaaugaccuua

SEQ ID NO: 1170845 - RNA, 19 nt, Homo sapiens
gaagccaauuggauuucaa

SEQ ID NO: 1170846 - RNA, 19 nt, Homo sapiens
gacguuacgagaccauuua

SEQ ID NO: 1170847 - RNA, 19 nt, Homo sapiens
acucuacucuugguuauaa

SEQ ID NO: 1170848 - RNA, 19 nt, Homo sapiens
ucagaugaauuacuuacug

SEQ ID NO: 1170849 - RNA, 19 nt, Homo sapiens
cuucaggaaucaucuugua

SEQ ID NO: 1170850 - RNA, 19 nt, Homo sapiens
gaggaagccaauuggauuu

SEQ ID NO: 1170851 - RNA, 19 nt, Homo sapiens
gaaagaggaagccaauugg

SEQ ID NO: 1170852 - RNA, 19 nt, Homo sapiens
ggagguguuugcagagaau

SEQ ID NO: 1170853 - RNA, 19 nt, Homo sapiens
gagaaguuagccacugaua

SEQ ID NO: 1170854 - RNA, 19 nt, Homo sapiens
gccaauauuagacaaagua

SEQ ID NO: 1170855 - RNA, 19 nt, Homo sapiens
auacugaauuucuggauga

SEQ ID NO: 1170856 - RNA, 19 nt, Homo sapiens
cuacuuaauuugaggacaa

SEQ ID NO: 1170857 - RNA, 19 nt, Homo sapiens
cagcugcaguuugauauga

SEQ ID NO: 1170858 - RNA, 19 nt, Homo sapiens
ggaguuacagaaggacuua

SEQ ID NO: 1170859 - RNA, 19 nt, Homo sapiens
ugagaagauucagccaaua

SEQ ID NO: 1170860 - RNA, 19 nt, Homo sapiens
ggaagccaauuggauuuca

SEQ ID NO: 1170861 - RNA, 19 nt, Homo sapiens
agaaagaggaagccaauug

SEQ ID NO: 1170862 - RNA, 19 nt, Homo sapiens
cacaagugaugaaagaaga

SEQ ID NO: 1170863 - RNA, 19 nt, Homo sapiens
agaaggacuuaguagauga

SEQ ID NO: 1170864 - RNA, 19 nt, Homo sapiens
aaugaaaguuccagauugu

SEQ ID NO: 1170865 - RNA, 19 nt, Homo sapiens
aaaauggacucaaugcuuu

SEQ ID NO: 1170866 - RNA, 19 nt, Homo sapiens
gguugacgguggagagaaa

SEQ ID NO: 1170867 - RNA, 19 nt, Homo sapiens
gaugaaguacucuuguuug

SEQ ID NO: 1170868 - RNA, 19 nt, Homo sapiens
ggaaauagauggaggcuaa

SEQ ID NO: 1170869 - RNA, 19 nt, Homo sapiens
gaaaguggauuaaguuuga

SEQ ID NO: 1170870 - RNA, 19 nt, Homo sapiens
gcuagugucucuuuaauua

SEQ ID NO: 1170871 - RNA, 19 nt, Homo sapiens
gaaaagagauccacuaaug

SEQ ID NO: 1170872 - RNA, 19 nt, Homo sapiens
gagaugcucuugccuauga

SEQ ID NO: 1170873 - RNA, 19 nt, Homo sapiens
gaaauaggguggaaaagua

SEQ ID NO: 1170874 - RNA, 19 nt, Homo sapiens
gacuuuagcugugugaaua

SEQ ID NO: 1170875 - RNA, 19 nt, Homo sapiens
uguaagaguugaugaauga

SEQ ID NO: 1170876 - RNA, 19 nt, Homo sapiens
gaagauaaugucagaugua

SEQ ID NO: 1170877 - RNA, 19 nt, Homo sapiens
guaaggaaaucaauauugg

SEQ ID NO: 1170878 - RNA, 19 nt, Homo sapiens
ggaaaucaauauuggaagu

SEQ ID NO: 1170879 - RNA, 19 nt, Homo sapiens
cuuauuaucuugcucagua

SEQ ID NO: 1170880 - RNA, 19 nt, Homo sapiens
gaacaguuacaaagaguuu

SEQ ID NO: 1170881 - RNA, 19 nt, Homo sapiens
ggaaagaggaggaggaaga

SEQ ID NO: 1170882 - RNA, 19 nt, Homo sapiens
caacauuucucuugcagau

SEQ ID NO: 1170883 - RNA, 19 nt, Homo sapiens
guagagacuuuaugauuag

SEQ ID NO: 1170884 - RNA, 19 nt, Homo sapiens
gagaguaaccuguauuuua

SEQ ID NO: 1170885 - RNA, 19 nt, Homo sapiens
gaugaugaaugcugacaug

SEQ ID NO: 1170886 - RNA, 19 nt, Homo sapiens
guuauuagauuugggcuuu

SEQ ID NO: 1170887 - RNA, 19 nt, Homo sapiens
aaagagauccacuaaugua

SEQ ID NO: 1170888 - RNA, 19 nt, Homo sapiens
gaaugcuagugucucuuua

SEQ ID NO: 1170889 - RNA, 19 nt, Homo sapiens
gaugaaugcugacauggau

SEQ ID NO: 1170890 - RNA, 19 nt, Homo sapiens
gaauugcugcugaacauuu

SEQ ID NO: 1170891 - RNA, 19 nt, Homo sapiens
ggaaugcuagugucucuuu

SEQ ID NO: 1170892 - RNA, 19 nt, Homo sapiens
gaaaauaaccaccguguug

SEQ ID NO: 1170893 - RNA, 19 nt, Homo sapiens
ugacauggaugcaguugau

SEQ ID NO: 1170894 - RNA, 19 nt, Homo sapiens
gaccuaauuuacagacauu

SEQ ID NO: 1170895 - RNA, 19 nt, Homo sapiens
uaaccaccguguugugaaa

SEQ ID NO: 1170896 - RNA, 19 nt, Homo sapiens
uaacaggagacuuccauaa

SEQ ID NO: 1170897 - RNA, 19 nt, Homo sapiens
gguaaggaaaucaauauug

SEQ ID NO: 1170898 - RNA, 19 nt, Homo sapiens
gagaacaguuacaaagagu

SEQ ID NO: 1170899 - RNA, 19 nt, Homo sapiens
gcuugucauuuguguauuu

SEQ ID NO: 1170900 - RNA, 19 nt, Homo sapiens
uggcuucauuggauauuua

SEQ ID NO: 1170901 - RNA, 19 nt, Homo sapiens
ucaaacaacugacacaaaa

SEQ ID NO: 1170902 - RNA, 19 nt, Homo sapiens
caugucagcuucuaguguu

SEQ ID NO: 1170903 - RNA, 19 nt, Homo sapiens
gguaaacaguaguaaccaa

SEQ ID NO: 1170904 - RNA, 19 nt, Homo sapiens
gauugacacccuucuguuu

SEQ ID NO: 1170905 - RNA, 19 nt, Homo sapiens
ugggaaaguuauacaugua

SEQ ID NO: 1170906 - RNA, 19 nt, Homo sapiens
gaugagaacaguuacaaag

SEQ ID NO: 1170907 - RNA, 19 nt, Homo sapiens
guaaacaguaguaaccaaa

SEQ ID NO: 1170908 - RNA, 19 nt, Homo sapiens
cauagaccauuccucaaga

SEQ ID NO: 1170909 - RNA, 19 nt, Homo sapiens
acauuucucuugcagauga

SEQ ID NO: 1170910 - RNA, 19 nt, Homo sapiens
guucugcuuugccguuuaa

SEQ ID NO: 1170911 - RNA, 19 nt, Homo sapiens
ccacuaauguagcuuaagg

SEQ ID NO: 1170912 - RNA, 19 nt, Homo sapiens
gaguagaucuuuugggaaa

SEQ ID NO: 1170913 - RNA, 19 nt, Homo sapiens
cagaugacauagaccauuc

SEQ ID NO: 1170914 - RNA, 19 nt, Homo sapiens
cuacuggguuugaagaguu

SEQ ID NO: 1170915 - RNA, 19 nt, Homo sapiens
uauaauuucuggucaugug

SEQ ID NO: 1170916 - RNA, 19 nt, Homo sapiens
gaagaaaaucugaagcuaa

SEQ ID NO: 1170917 - RNA, 19 nt, Homo sapiens
uaaauuguguugcaguucu

SEQ ID NO: 1170918 - RNA, 19 nt, Homo sapiens
uagucaaacugcaaacauu

SEQ ID NO: 1170919 - RNA, 19 nt, Homo sapiens
gauccacuaauguagcuua

SEQ ID NO: 1170920 - RNA, 19 nt, Homo sapiens
guacuaaaugcacagcuuu

SEQ ID NO: 1170921 - RNA, 19 nt, Homo sapiens
gcugagcaaauuuaucuuu

SEQ ID NO: 1170922 - RNA, 19 nt, Homo sapiens
guaccuuuguggcuucauu

SEQ ID NO: 1170923 - RNA, 19 nt, Homo sapiens
ggaagaaaaucugaagcua

SEQ ID NO: 1170924 - RNA, 19 nt, Homo sapiens
aagaguagaugcaguuaag

SEQ ID NO: 1170925 - RNA, 19 nt, Homo sapiens
gcaagaguagaugcaguua

SEQ ID NO: 1170926 - RNA, 19 nt, Homo sapiens
gaacuccaacacacacuug

SEQ ID NO: 1170927 - RNA, 19 nt, Homo sapiens
ggaugcaguugaugcugaa

SEQ ID NO: 1170928 - RNA, 19 nt, Homo sapiens
uaucucacuuguucuagaa

SEQ ID NO: 1170929 - RNA, 19 nt, Homo sapiens
gaaaaguacucgguaaaca

SEQ ID NO: 1170930 - RNA, 19 nt, Homo sapiens
gugcaaauguauuguagag

SEQ ID NO: 1170931 - RNA, 19 nt, Homo sapiens
ggauagauuccaaaaguua

SEQ ID NO: 1170932 - RNA, 19 nt, Homo sapiens
uagaugcaguuaaggaaga

SEQ ID NO: 1170933 - RNA, 19 nt, Homo sapiens
ugagaacaguuacaaagag

SEQ ID NO: 1170934 - RNA, 19 nt, Homo sapiens
ugaagauaaugucagaugu

SEQ ID NO: 1170935 - RNA, 19 nt, Homo sapiens
gcagaugacauagaccauu

SEQ ID NO: 1170936 - RNA, 19 nt, Homo sapiens
cugcuuugccguuuaauaa

SEQ ID NO: 1170937 - RNA, 19 nt, Homo sapiens
gggcuugucauuuguguau

SEQ ID NO: 1170938 - RNA, 19 nt, Homo sapiens
cuaauguagcuuaagguua

SEQ ID NO: 1170939 - RNA, 19 nt, Homo sapiens
uaagauacugucucagcua

SEQ ID NO: 1170940 - RNA, 19 nt, Homo sapiens
gauaaugucagauguagac

SEQ ID NO: 1170941 - RNA, 19 nt, Homo sapiens
cggagaugcucuugccuau

SEQ ID NO: 1170942 - RNA, 19 nt, Homo sapiens
ucucuaaguugauuuguac

SEQ ID NO: 1170943 - RNA, 19 nt, Homo sapiens
gcacagaguagaucuuuug

SEQ ID NO: 1170944 - RNA, 19 nt, Homo sapiens
gaggaagacagcacacuca

SEQ ID NO: 1170945 - RNA, 19 nt, Homo sapiens
gcuagggcuugucauuugu

SEQ ID NO: 1170946 - RNA, 19 nt, Homo sapiens
cacaauaacaggagacuuc

SEQ ID NO: 1170947 - RNA, 19 nt, Homo sapiens
ugaaugacuuuagcugugu

SEQ ID NO: 1170948 - RNA, 19 nt, Homo sapiens
ugacuacccuuauguuagc

SEQ ID NO: 1170949 - RNA, 19 nt, Homo sapiens
guagaucuuuugggaaaua

SEQ ID NO: 1170950 - RNA, 19 nt, Homo sapiens
uggaauugcugcugaacau

SEQ ID NO: 1170951 - RNA, 19 nt, Homo sapiens
gaaaaucucaugucagcuu

SEQ ID NO: 1170952 - RNA, 19 nt, Homo sapiens
guguaagaguugaugaaug

SEQ ID NO: 1170953 - RNA, 19 nt, Homo sapiens
ugaccaaaaucauguacua

SEQ ID NO: 1170954 - RNA, 19 nt, Homo sapiens
gcuucuagauuccauuugg

SEQ ID NO: 1170955 - RNA, 19 nt, Homo sapiens
ggaugagaacaguuacaaa

SEQ ID NO: 1170956 - RNA, 19 nt, Homo sapiens
gcacacucaccaacauuuc

SEQ ID NO: 1170957 - RNA, 19 nt, Homo sapiens
ggauugacacccuucuguu

SEQ ID NO: 1170958 - RNA, 19 nt, Homo sapiens
caagaguagaugcaguuaa

SEQ ID NO: 1170959 - RNA, 19 nt, Homo sapiens
gagauccacuaauguagcu

SEQ ID NO: 1170960 - RNA, 19 nt, Homo sapiens
cugaagcugagcaaauuua

SEQ ID NO: 1170961 - RNA, 19 nt, Homo sapiens
caucugaagcugagcaaau

SEQ ID NO: 1170962 - RNA, 19 nt, Homo sapiens
gaguagaugcaguuaagga

SEQ ID NO: 1170963 - RNA, 19 nt, Homo sapiens
ugaaaguggauuaaguuug

SEQ ID NO: 1170964 - RNA, 19 nt, Homo sapiens
gaaauagauggaggcuaaa

SEQ ID NO: 1170965 - RNA, 19 nt, Homo sapiens
cagcuagggcuugucauuu

SEQ ID NO: 1170966 - RNA, 19 nt, Homo sapiens
aagauaaugucagauguag

SEQ ID NO: 1170967 - RNA, 19 nt, Homo sapiens
caacacacacuugaagauc

SEQ ID NO: 1170968 - RNA, 19 nt, Homo sapiens
cacgagcaguuucucauua

SEQ ID NO: 1170969 - RNA, 19 nt, Homo sapiens
ggcaaggucuucugcaugu

SEQ ID NO: 1170970 - RNA, 19 nt, Homo sapiens
ccacgagcaguuucucauu

SEQ ID NO: 1170971 - RNA, 19 nt, Homo sapiens
gcaaggucuucugcauguu

SEQ ID NO: 1170972 - RNA, 19 nt, Homo sapiens
auauuacagucacaccaua

SEQ ID NO: 1170973 - RNA, 19 nt, Homo sapiens
ggucuggcuucagcuauca

SEQ ID NO: 1170974 - RNA, 19 nt, Homo sapiens
caaggucuucugcauguuc

SEQ ID NO: 1170975 - RNA, 19 nt, Homo sapiens
gccaucaccgucaucacua

SEQ ID NO: 1170976 - RNA, 19 nt, Homo sapiens
gccuucagcuuccucuaca

SEQ ID NO: 1170977 - RNA, 19 nt, Homo sapiens
gggucuggcuucagcuauc

SEQ ID NO: 1170978 - RNA, 19 nt, Homo sapiens
uaaguccccucccuccuuu

SEQ ID NO: 1170979 - RNA, 19 nt, Homo sapiens
gagggucuggcuucagcua

SEQ ID NO: 1170980 - RNA, 19 nt, Homo sapiens
uauuacagucacaccauaa

SEQ ID NO: 1170981 - RNA, 19 nt, Homo sapiens
cuacuacuacugcuucauc

SEQ ID NO: 1170982 - RNA, 19 nt, Homo sapiens
gaacaucacugguguauuu

SEQ ID NO: 1170983 - RNA, 19 nt, Homo sapiens
gcacacagauuccucagua

SEQ ID NO: 1170984 - RNA, 19 nt, Homo sapiens
gaaacaaggaggaaaguua

SEQ ID NO: 1170985 - RNA, 19 nt, Homo sapiens
gcagaaaccucuaucacaa

SEQ ID NO: 1170986 - RNA, 19 nt, Homo sapiens
gaacgcaccugucucugaa

SEQ ID NO: 1170987 - RNA, 19 nt, Homo sapiens
gagaguagcugaagaaagg

SEQ ID NO: 1170988 - RNA, 19 nt, Homo sapiens
ccacagggccuccucuuua

SEQ ID NO: 1170989 - RNA, 19 nt, Homo sapiens
gcagcgagguuucauucua

SEQ ID NO: 1170990 - RNA, 19 nt, Homo sapiens
ggacagcuauugaaugcuu

SEQ ID NO: 1170991 - RNA, 19 nt, Homo sapiens
ccagaagucucacgcaauu

SEQ ID NO: 1170992 - RNA, 19 nt, Homo sapiens
gaacauuuccgguggauau

SEQ ID NO: 1170993 - RNA, 19 nt, Homo sapiens
gaucuucgauugauuguag

SEQ ID NO: 1170994 - RNA, 19 nt, Homo sapiens
gcagacaaauuccgggauu

SEQ ID NO: 1170995 - RNA, 19 nt, Homo sapiens
gcaagggauuggugauuga

SEQ ID NO: 1170996 - RNA, 19 nt, Homo sapiens
gaggaaaguuagccacuga

SEQ ID NO: 1170997 - RNA, 19 nt, Homo sapiens
gcacugggaugaagagaca

SEQ ID NO: 1170998 - RNA, 19 nt, Homo sapiens
caaaucaacugucgaaacu

SEQ ID NO: 1170999 - RNA, 19 nt, Homo sapiens
gaacauuuccugaauuaca

SEQ ID NO: 1171000 - RNA, 19 nt, Homo sapiens
gaagagacaccuccgaguu

SEQ ID NO: 1171001 - RNA, 19 nt, Homo sapiens
gaaacaggaugugggaaga

SEQ ID NO: 1171002 - RNA, 19 nt, Homo sapiens
gcugaaagcacuaggaauu

SEQ ID NO: 1171003 - RNA, 19 nt, Homo sapiens
gcagaggauuuguguuuca

SEQ ID NO: 1171004 - RNA, 19 nt, Homo sapiens
ggucaucuauaacgaaguu

SEQ ID NO: 1171005 - RNA, 19 nt, Homo sapiens
aaaguccuguuccagauua

SEQ ID NO: 1171006 - RNA, 19 nt, Homo sapiens
gaugguugauccguuguua

SEQ ID NO: 1171007 - RNA, 19 nt, Homo sapiens
gggaagagcacacagauuc

SEQ ID NO: 1171008 - RNA, 19 nt, Homo sapiens
ggaagccuuugacaaguug

SEQ ID NO: 1171009 - RNA, 19 nt, Homo sapiens
uagcagaggauuuguguuu

SEQ ID NO: 1171010 - RNA, 19 nt, Homo sapiens
ugaaagcacuaggaauuga

SEQ ID NO: 1171011 - RNA, 19 nt, Homo sapiens
gagaugcagcguaguaauu

SEQ ID NO: 1171012 - RNA, 19 nt, Homo sapiens
ugucagagcugcgacugua

SEQ ID NO: 1171013 - RNA, 19 nt, Homo sapiens
cagcuggccacgagaauua

SEQ ID NO: 1171014 - RNA, 19 nt, Homo sapiens
aagcaugucucuacgaaug

SEQ ID NO: 1171015 - RNA, 19 nt, Homo sapiens
ggaacgcaccugucucuga

SEQ ID NO: 1171016 - RNA, 19 nt, Homo sapiens
ugaugcagauccagaauau

SEQ ID NO: 1171017 - RNA, 19 nt, Homo sapiens
ucagggaaaugaugguuga

SEQ ID NO: 1171018 - RNA, 19 nt, Homo sapiens
gaugaugauugcauuucaa

SEQ ID NO: 1171019 - RNA, 19 nt, Homo sapiens
ccaaagggcaugucugaug

SEQ ID NO: 1171020 - RNA, 19 nt, Homo sapiens
gaagagguagaaacuguug

SEQ ID NO: 1171021 - RNA, 19 nt, Homo sapiens
caaagacugucgccuaacu

SEQ ID NO: 1171022 - RNA, 19 nt, Homo sapiens
gaucgacuguggcuuugug

SEQ ID NO: 1171023 - RNA, 19 nt, Homo sapiens
guuaucgccuuuauacaga

SEQ ID NO: 1171024 - RNA, 19 nt, Homo sapiens
gacaaagucuggcugaaaa

SEQ ID NO: 1171025 - RNA, 19 nt, Homo sapiens
cagcuccuguggaauguuu

SEQ ID NO: 1171026 - RNA, 19 nt, Homo sapiens
guucugaggugcauugucu

SEQ ID NO: 1171027 - RNA, 19 nt, Homo sapiens
gagcugcgacuguaagaga

SEQ ID NO: 1171028 - RNA, 19 nt, Homo sapiens
acaauaaggacucuaaaug

SEQ ID NO: 1171029 - RNA, 19 nt, Homo sapiens
ccacagcauuugcauccuu

SEQ ID NO: 1171030 - RNA, 19 nt, Homo sapiens
gaggaagccuuugacaagu

SEQ ID NO: 1171031 - RNA, 19 nt, Homo sapiens
ugucgaaacuguggugaaa

SEQ ID NO: 1171032 - RNA, 19 nt, Homo sapiens
acaagcaugucucuacgaa

SEQ ID NO: 1171033 - RNA, 19 nt, Homo sapiens
caauaaggacucuaaaugg

SEQ ID NO: 1171034 - RNA, 19 nt, Homo sapiens
ggagugacccagccucgaa

SEQ ID NO: 1171035 - RNA, 19 nt, Homo sapiens
caucacugguguauuuguu

SEQ ID NO: 1171036 - RNA, 19 nt, Homo sapiens
gagaugugacugccauuga

SEQ ID NO: 1171037 - RNA, 19 nt, Homo sapiens
cgagugcaccguaaauuug

SEQ ID NO: 1171038 - RNA, 19 nt, Homo sapiens
gaauugcagaguuuccuuu

SEQ ID NO: 1171039 - RNA, 19 nt, Homo sapiens
ugggaggucuggacaaaga

SEQ ID NO: 1171040 - RNA, 19 nt, Homo sapiens
caggacagcuauugaaugc

SEQ ID NO: 1171041 - RNA, 19 nt, Homo sapiens
gcccuaaacuucuguagcu

SEQ ID NO: 1171042 - RNA, 19 nt, Homo sapiens
ggcaccagcuccuguggaa

SEQ ID NO: 1171043 - RNA, 19 nt, Homo sapiens
cuggacagcugaaggaaga

SEQ ID NO: 1171044 - RNA, 19 nt, Homo sapiens
gauuggugauugacagaga

SEQ ID NO: 1171045 - RNA, 19 nt, Homo sapiens
guucauuaguccuuucuuc

SEQ ID NO: 1171046 - RNA, 19 nt, Homo sapiens
aauaaggacucuaaauggu

SEQ ID NO: 1171047 - RNA, 19 nt, Homo sapiens
caauucgagugcaccguaa

SEQ ID NO: 1171048 - RNA, 19 nt, Homo sapiens
uugcagaguuuccuuugaa

SEQ ID NO: 1171049 - RNA, 19 nt, Homo sapiens
aaucaacugucgaaacugu

SEQ ID NO: 1171050 - RNA, 19 nt, Homo sapiens
aagaguggcugcuguuaca

SEQ ID NO: 1171051 - RNA, 19 nt, Homo sapiens
gcaugucucuacgaaugaa

SEQ ID NO: 1171052 - RNA, 19 nt, Homo sapiens
uagaaacuguugugucgau

SEQ ID NO: 1171053 - RNA, 19 nt, Homo sapiens
acaaaguccuguuccagau

SEQ ID NO: 1171054 - RNA, 19 nt, Homo sapiens
acacugacauugccauugg

SEQ ID NO: 1171055 - RNA, 19 nt, Homo sapiens
ucacucagcacgcucacua

SEQ ID NO: 1171056 - RNA, 19 nt, Homo sapiens
gaugcagcguaguaauuug

SEQ ID NO: 1171057 - RNA, 19 nt, Homo sapiens
gauaguggccaccaaugug

SEQ ID NO: 1171058 - RNA, 19 nt, Homo sapiens
aggaagagguagaaacugu

SEQ ID NO: 1171059 - RNA, 19 nt, Homo sapiens
gcaagggauacauguguga

SEQ ID NO: 1171060 - RNA, 19 nt, Homo sapiens
ggaaugcuggucagggaaa

SEQ ID NO: 1171061 - RNA, 19 nt, Homo sapiens
caccaaagggcaugucuga

SEQ ID NO: 1171062 - RNA, 19 nt, Homo sapiens
cagcuguguuaaccaauga

SEQ ID NO: 1171063 - RNA, 19 nt, Homo sapiens
uuauacagaccuccaagua

SEQ ID NO: 1171064 - RNA, 19 nt, Homo sapiens
ucaggaaacuucggcuguu

SEQ ID NO: 1171065 - RNA, 19 nt, Homo sapiens
cgacuguggcuuugugaaa

SEQ ID NO: 1171066 - RNA, 19 nt, Homo sapiens
agaaaccucuaucacaauc

SEQ ID NO: 1171067 - RNA, 19 nt, Homo sapiens
gauugcauuucaacacaug

SEQ ID NO: 1171068 - RNA, 19 nt, Homo sapiens
gauccagaauaucuuugug

SEQ ID NO: 1171069 - RNA, 19 nt, Homo sapiens
ggaaaauguuaucgccuuu

SEQ ID NO: 1171070 - RNA, 19 nt, Homo sapiens
uaucaaaucaacugucgaa

SEQ ID NO: 1171071 - RNA, 19 nt, Homo sapiens
cccaguggcuucugucugu

SEQ ID NO: 1171072 - RNA, 19 nt, Homo sapiens
agaugugacugccauugaa

SEQ ID NO: 1171073 - RNA, 19 nt, Homo sapiens
ggaagagguagaaacuguu

SEQ ID NO: 1171074 - RNA, 19 nt, Homo sapiens
gggcugcuuugcugugaug

SEQ ID NO: 1171075 - RNA, 19 nt, Homo sapiens
gcaggaauucacaacaguu

SEQ ID NO: 1171076 - RNA, 19 nt, Homo sapiens
caaacccaguggcuucugu

SEQ ID NO: 1171077 - RNA, 19 nt, Homo sapiens
auacagaccuccaaguacu

SEQ ID NO: 1171078 - RNA, 19 nt, Homo sapiens
uaaauggugucaggaacau

SEQ ID NO: 1171079 - RNA, 19 nt, Homo sapiens
ccaaaaugcugcuugaauc

SEQ ID NO: 1171080 - RNA, 19 nt, Homo sapiens
ggaauucacaacaguuugg

SEQ ID NO: 1171081 - RNA, 19 nt, Homo sapiens
cacagggccuccucuuuag

SEQ ID NO: 1171082 - RNA, 19 nt, Homo sapiens
gaccauagauugagauuua

SEQ ID NO: 1171083 - RNA, 19 nt, Homo sapiens
ggaagacgcugcccuuuac

SEQ ID NO: 1171084 - RNA, 19 nt, Homo sapiens
gagaagcguuugcacaaga

SEQ ID NO: 1171085 - RNA, 19 nt, Homo sapiens
ugacacaccuggacacaga

SEQ ID NO: 1171086 - RNA, 19 nt, Homo sapiens
ucaaagugcucuucaacau

SEQ ID NO: 1171087 - RNA, 19 nt, Homo sapiens
gaaaggagugcgccugcua

SEQ ID NO: 1171088 - RNA, 19 nt, Homo sapiens
gacaagcucuccaggaaca

SEQ ID NO: 1171089 - RNA, 19 nt, Homo sapiens
aaagugcucuucaacauca

SEQ ID NO: 1171090 - RNA, 19 nt, Homo sapiens
caauuaaaccuccuuccua

SEQ ID NO: 1171091 - RNA, 19 nt, Homo sapiens
ucccagagcuucacguuug

SEQ ID NO: 1171092 - RNA, 19 nt, Homo sapiens
cagacgaaguacuuucuuu

SEQ ID NO: 1171093 - RNA, 19 nt, Homo sapiens
gaaaaugccccucguguga

SEQ ID NO: 1171094 - RNA, 19 nt, Homo sapiens
caagaggaauguguucaga

SEQ ID NO: 1171095 - RNA, 19 nt, Homo sapiens
gaauuccacagacgaagua

SEQ ID NO: 1171096 - RNA, 19 nt, Homo sapiens
ccauggagauccucaaagu

SEQ ID NO: 1171097 - RNA, 19 nt, Homo sapiens
gaaaaccugucagaacuuu

SEQ ID NO: 1171098 - RNA, 19 nt, Homo sapiens
gcaagcaccaucugggauu

SEQ ID NO: 1171099 - RNA, 19 nt, Homo sapiens
agacuacacuuacaacaag

SEQ ID NO: 1171100 - RNA, 19 nt, Homo sapiens
uggaagcucugcggucaua

SEQ ID NO: 1171101 - RNA, 19 nt, Homo sapiens
gaagccaaagccagcauaa

SEQ ID NO: 1171102 - RNA, 19 nt, Homo sapiens
guacacaggcuaugggaau

SEQ ID NO: 1171103 - RNA, 19 nt, Homo sapiens
ggagugcgccugcuaacug

SEQ ID NO: 1171104 - RNA, 19 nt, Homo sapiens
ggaggccucuuagacauuc

SEQ ID NO: 1171105 - RNA, 19 nt, Homo sapiens
caacggucuucuugugcua

SEQ ID NO: 1171106 - RNA, 19 nt, Homo sapiens
guacuggagucccucaagu

SEQ ID NO: 1171107 - RNA, 19 nt, Homo sapiens
ugacagaggagcagaagga

SEQ ID NO: 1171108 - RNA, 19 nt, Homo sapiens
acacagacacagaugagua

SEQ ID NO: 1171109 - RNA, 19 nt, Homo sapiens
gagugcgccugcuaacuga

SEQ ID NO: 1171110 - RNA, 19 nt, Homo sapiens
gcacacagaagagcauaug

SEQ ID NO: 1171111 - RNA, 19 nt, Homo sapiens
gagaaaaccugucagaacu

SEQ ID NO: 1171112 - RNA, 19 nt, Homo sapiens
ucucaucucuggacugcaa

SEQ ID NO: 1171113 - RNA, 19 nt, Homo sapiens
ucaagugucuggauguucu

SEQ ID NO: 1171114 - RNA, 19 nt, Homo sapiens
caagguauguaugcucugu

SEQ ID NO: 1171115 - RNA, 19 nt, Homo sapiens
gagugaauauggaugugau

SEQ ID NO: 1171116 - RNA, 19 nt, Homo sapiens
ggacugcaacggucuucuu

SEQ ID NO: 1171117 - RNA, 19 nt, Homo sapiens
uugacaagcucuccaggaa

SEQ ID NO: 1171118 - RNA, 19 nt, Homo sapiens
ggaagccaaagccagcaua

SEQ ID NO: 1171119 - RNA, 19 nt, Homo sapiens
gggagaugcugcggaacaa

SEQ ID NO: 1171120 - RNA, 19 nt, Homo sapiens
cggcuccucuuccugcuaa

SEQ ID NO: 1171121 - RNA, 19 nt, Homo sapiens
gcugagaucguuuccuguu

SEQ ID NO: 1171122 - RNA, 19 nt, Homo sapiens
gaagccgccuaacccuaug

SEQ ID NO: 1171123 - RNA, 19 nt, Homo sapiens
agacacagaugaguacaag

SEQ ID NO: 1171124 - RNA, 19 nt, Homo sapiens
ggacacagacacagaugag

SEQ ID NO: 1171125 - RNA, 19 nt, Homo sapiens
gaaugcugcuggccuucug

SEQ ID NO: 1171126 - RNA, 19 nt, Homo sapiens
uagagaagcguuugcacaa

SEQ ID NO: 1171127 - RNA, 19 nt, Homo sapiens
guauguaugcucuguuguu

SEQ ID NO: 1171128 - RNA, 19 nt, Homo sapiens
ugaggaggaugugauuaug

SEQ ID NO: 1171129 - RNA, 19 nt, Homo sapiens
agaggaauguguucagaag

SEQ ID NO: 1171130 - RNA, 19 nt, Homo sapiens
aggaagacgcugcccuuua

SEQ ID NO: 1171131 - RNA, 19 nt, Homo sapiens
gugaggaggaugugauuau

SEQ ID NO: 1171132 - RNA, 19 nt, Homo sapiens
ugucagaacuuuccauacg

SEQ ID NO: 1171133 - RNA, 19 nt, Homo sapiens
acacagaugaguacaagga

SEQ ID NO: 1171134 - RNA, 19 nt, Homo sapiens
ggagacgggugaggaggau

SEQ ID NO: 1171135 - RNA, 19 nt, Homo sapiens
gagcuucacguuugaugau

SEQ ID NO: 1171136 - RNA, 19 nt, Homo sapiens
caagcaccaucugggauug

SEQ ID NO: 1171137 - RNA, 19 nt, Homo sapiens
cccguucuguucaugauuu

SEQ ID NO: 1171138 - RNA, 19 nt, Homo sapiens
gagaucguuuccuguugga

SEQ ID NO: 1171139 - RNA, 19 nt, Homo sapiens
ugagcgugcugacugaaug

SEQ ID NO: 1171140 - RNA, 19 nt, Homo sapiens
ccuccuuccuacugguuua

SEQ ID NO: 1171141 - RNA, 19 nt, Homo sapiens
cugcaacggucuucuugug

SEQ ID NO: 1171142 - RNA, 19 nt, Homo sapiens
gguuuagacuacacuuaca

SEQ ID NO: 1171143 - RNA, 19 nt, Homo sapiens
gaggauggcagcucuucug

SEQ ID NO: 1171144 - RNA, 19 nt, Homo sapiens
ggagugaauauggauguga

SEQ ID NO: 1171145 - RNA, 19 nt, Homo sapiens
cagaaacaucaucuugaaa

SEQ ID NO: 1171146 - RNA, 19 nt, Homo sapiens
gcaauuaaaccuccuuccu

SEQ ID NO: 1171147 - RNA, 19 nt, Homo sapiens
gcuggaggccucuuagaca

SEQ ID NO: 1171148 - RNA, 19 nt, Homo sapiens
aggaggaugugauuaugga

SEQ ID NO: 1171149 - RNA, 19 nt, Homo sapiens
gaggaagacgcugcccuuu

SEQ ID NO: 1171150 - RNA, 19 nt, Homo sapiens
caaagugcucuucaacauc

SEQ ID NO: 1171151 - RNA, 19 nt, Homo sapiens
uauguaugcucuguuguuc

SEQ ID NO: 1171152 - RNA, 19 nt, Homo sapiens
ugacucggacccugacuga

SEQ ID NO: 1171153 - RNA, 19 nt, Homo sapiens
ccucaagugucuggauguu

SEQ ID NO: 1171154 - RNA, 19 nt, Homo sapiens
gucagaacuuuccauacga

SEQ ID NO: 1171155 - RNA, 19 nt, Homo sapiens
gaugccaugugcgagacua

SEQ ID NO: 1171156 - RNA, 19 nt, Homo sapiens
gaagcucugcggucauaca

SEQ ID NO: 1171157 - RNA, 19 nt, Homo sapiens
aagcuuguccgccucauga

SEQ ID NO: 1171158 - RNA, 19 nt, Homo sapiens
caacaggaggaccggaaga

SEQ ID NO: 1171159 - RNA, 19 nt, Homo sapiens
uagacuacacuuacaacaa

SEQ ID NO: 1171160 - RNA, 19 nt, Homo sapiens
gaaguacuuucuuuugucu

SEQ ID NO: 1171161 - RNA, 19 nt, Homo sapiens
ccacagacgaaguacuuuc

SEQ ID NO: 1171162 - RNA, 19 nt, Homo sapiens
gcuggucuccguccuggaa

SEQ ID NO: 1171163 - RNA, 19 nt, Homo sapiens
cuccucaucuuccuagaga

SEQ ID NO: 1171164 - RNA, 19 nt, Homo sapiens
aaaggagugcgccugcuaa

SEQ ID NO: 1171165 - RNA, 19 nt, Homo sapiens
agaagccgccuaacccuau

SEQ ID NO: 1171166 - RNA, 19 nt, Homo sapiens
ucaugggagugaauaugga

SEQ ID NO: 1171167 - RNA, 19 nt, Homo sapiens
ucagcugcccacuguagua

SEQ ID NO: 1171168 - RNA, 19 nt, Homo sapiens
ggccauggagauccucaaa

SEQ ID NO: 1171169 - RNA, 19 nt, Homo sapiens
gauguccaguucuuugacu

SEQ ID NO: 1171170 - RNA, 19 nt, Homo sapiens
ugagauuuauaccacauac

SEQ ID NO: 1171171 - RNA, 19 nt, Homo sapiens
uauccacagugcccgaguu

SEQ ID NO: 1171172 - RNA, 19 nt, Homo sapiens
ucagaacacacccuuccaa

SEQ ID NO: 1171173 - RNA, 19 nt, Homo sapiens
ggagaaaaccugucagaac

SEQ ID NO: 1171174 - RNA, 19 nt, Homo sapiens
ggugaggaggaugugauua

SEQ ID NO: 1171175 - RNA, 19 nt, Homo sapiens
cagaggaugaggacacaga

SEQ ID NO: 1171176 - RNA, 19 nt, Homo sapiens
uggaacuucuggcccaaga

SEQ ID NO: 1171177 - RNA, 19 nt, Homo sapiens
gcuccuuccuucccaagag

SEQ ID NO: 1171178 - RNA, 19 nt, Homo sapiens
ccuguccugucuucacuga

SEQ ID NO: 1171179 - RNA, 19 nt, Homo sapiens
agguauguaugcucuguug

SEQ ID NO: 1171180 - RNA, 19 nt, Homo sapiens
ccugucagaacuuuccaua

SEQ ID NO: 1171181 - RNA, 19 nt, Homo sapiens
gcgccaagaggaauguguu

SEQ ID NO: 1171182 - RNA, 19 nt, Homo sapiens
ccagagacguccucaacuu

SEQ ID NO: 1171183 - RNA, 19 nt, Homo sapiens
ggugagggauucuguggaa

SEQ ID NO: 1171184 - RNA, 19 nt, Homo sapiens
gacaccagcucuuccauca

SEQ ID NO: 1171185 - RNA, 19 nt, Homo sapiens
gggauucuguggaaguuug

SEQ ID NO: 1171186 - RNA, 19 nt, Homo sapiens
cagaagcccugaggacuga

SEQ ID NO: 1171187 - RNA, 19 nt, Homo sapiens
augaaugcguguacuguua

SEQ ID NO: 1171188 - RNA, 19 nt, Homo sapiens
ggaggaagaccaugaaugc

SEQ ID NO: 1171189 - RNA, 19 nt, Homo sapiens
gagggauucuguggaaguu

SEQ ID NO: 1171190 - RNA, 19 nt, Homo sapiens
ggaaguuuguaaauaaagc

SEQ ID NO: 1171191 - RNA, 19 nt, Homo sapiens
cugcugggcugggacauuu

SEQ ID NO: 1171192 - RNA, 19 nt, Homo sapiens
ccaacaaggaggaguguau

SEQ ID NO: 1171193 - RNA, 19 nt, Homo sapiens
cuguggaaguuuguaaaua

SEQ ID NO: 1171194 - RNA, 19 nt, Homo sapiens
gguggaggcugaggaacug

SEQ ID NO: 1171195 - RNA, 19 nt, Homo sapiens
agugacaccugcugagaga

SEQ ID NO: 1171196 - RNA, 19 nt, Homo sapiens
gaccuucucugaggagucu

SEQ ID NO: 1171197 - RNA, 19 nt, Homo sapiens
gguggagggugagggauuc

SEQ ID NO: 1171198 - RNA, 19 nt, Homo sapiens
caagugacaccugcugaga

SEQ ID NO: 1171199 - RNA, 19 nt, Homo sapiens
cagcagcagcuacaacuca

SEQ ID NO: 1171200 - RNA, 19 nt, Homo sapiens
gaugguggaggcugaggaa

SEQ ID NO: 1171201 - RNA, 19 nt, Homo sapiens
gcacccaggagauggaauc

SEQ ID NO: 1171202 - RNA, 19 nt, Homo sapiens
ccagggugaccuucucuga

SEQ ID NO: 1171203 - RNA, 19 nt, Homo sapiens
gguccauccuggcucaaca

SEQ ID NO: 1171204 - RNA, 19 nt, Homo sapiens
ccugggcuaugacuggauu

SEQ ID NO: 1171205 - RNA, 19 nt, Homo sapiens
gcugagagaggcccaggau

SEQ ID NO: 1171206 - RNA, 19 nt, Homo sapiens
caacaaggaggaguguauc

SEQ ID NO: 1171207 - RNA, 19 nt, Homo sapiens
gaauccagcagcagcuaca

SEQ ID NO: 1171208 - RNA, 19 nt, Homo sapiens
ggagggugagggauucugu

SEQ ID NO: 1171209 - RNA, 19 nt, Homo sapiens
cagagacguccucaacuuc

SEQ ID NO: 1171210 - RNA, 19 nt, Homo sapiens
caugaaugcguguacuguu

SEQ ID NO: 1171211 - RNA, 19 nt, Homo sapiens
gagagaggcccaggauggu

SEQ ID NO: 1171212 - RNA, 19 nt, Homo sapiens
ggaauaaaguugagaacau

SEQ ID NO: 1171213 - RNA, 19 nt, Homo sapiens
ggagguggauaacguguuu

SEQ ID NO: 1171214 - RNA, 19 nt, Homo sapiens
gaauaaaguugagaacaug

SEQ ID NO: 1171215 - RNA, 19 nt, Homo sapiens
ggagagugguggcaucuga

SEQ ID NO: 1171216 - RNA, 19 nt, Homo sapiens
gagccgagcuugaggaauc

SEQ ID NO: 1171217 - RNA, 19 nt, Homo sapiens
gagaaacucugcgagaaga

SEQ ID NO: 1171218 - RNA, 19 nt, Homo sapiens
gcgagaagaucaucaacau

SEQ ID NO: 1171219 - RNA, 19 nt, Homo sapiens
gcuccaaacucuacacuca

SEQ ID NO: 1171220 - RNA, 19 nt, Homo sapiens
gagggcaccuacuccauug

SEQ ID NO: 1171221 - RNA, 19 nt, Homo sapiens
gggagaaggugggugagaa

SEQ ID NO: 1171222 - RNA, 19 nt, Homo sapiens
gcaaguuccacuacaagaa

SEQ ID NO: 1171223 - RNA, 19 nt, Homo sapiens
gcacaggcaaguuccacua

SEQ ID NO: 1171224 - RNA, 19 nt, Homo sapiens
gugagaaacucugcgagaa

SEQ ID NO: 1171225 - RNA, 19 nt, Homo sapiens
ccucuacugucucuccaua

SEQ ID NO: 1171226 - RNA, 19 nt, Homo sapiens
gaaggugggugagaaacuc

SEQ ID NO: 1171227 - RNA, 19 nt, Homo sapiens
ggagaaggugggugagaaa

SEQ ID NO: 1171228 - RNA, 19 nt, Homo sapiens
gcagauguccuuggaguuc

SEQ ID NO: 1171229 - RNA, 19 nt, Homo sapiens
guuacugggugcaggauga

SEQ ID NO: 1171230 - RNA, 19 nt, Homo sapiens
gauguugacugugacuuca

SEQ ID NO: 1171231 - RNA, 19 nt, Homo sapiens
ggucauccuuuuaaucuuu

SEQ ID NO: 1171232 - RNA, 19 nt, Homo sapiens
gaaucggcaugaguacuug

SEQ ID NO: 1171233 - RNA, 19 nt, Homo sapiens
gcgugucucuucugaggaa

SEQ ID NO: 1171234 - RNA, 19 nt, Homo sapiens
guccguuccucccugguua

SEQ ID NO: 1171235 - RNA, 19 nt, Homo sapiens
cccaggauguugacuguga

SEQ ID NO: 1171236 - RNA, 19 nt, Homo sapiens
ggucaaggugcauguggua

SEQ ID NO: 1171237 - RNA, 19 nt, Homo sapiens
cuguggagcuggucucuug

SEQ ID NO: 1171238 - RNA, 19 nt, Homo sapiens
ugaugaaucggcaugagua

SEQ ID NO: 1171239 - RNA, 19 nt, Homo sapiens
ccacugggauggggaauaa

SEQ ID NO: 1171240 - RNA, 19 nt, Homo sapiens
caggcaaguuccacuacaa

SEQ ID NO: 1171241 - RNA, 19 nt, Homo sapiens
aaucuuugcugacgguuca

SEQ ID NO: 1171242 - RNA, 19 nt, Homo sapiens
uauccuaguuccacaccuu

SEQ ID NO: 1171243 - RNA, 19 nt, Homo sapiens
gggcaugagccgagcuuga

SEQ ID NO: 1171244 - RNA, 19 nt, Homo sapiens
gcucccagaccuuggcuuu

SEQ ID NO: 1171245 - RNA, 19 nt, Homo sapiens
agacacccuugcccucuga

SEQ ID NO: 1171246 - RNA, 19 nt, Homo sapiens
ggaggugggagcuguuuua

SEQ ID NO: 1171247 - RNA, 19 nt, Homo sapiens
ugaaucggcaugaguacuu

SEQ ID NO: 1171248 - RNA, 19 nt, Homo sapiens
cccgcuggcuucuugguuu

SEQ ID NO: 1171249 - RNA, 19 nt, Homo sapiens
gaccuuggcuuuugggaau

SEQ ID NO: 1171250 - RNA, 19 nt, Homo sapiens
guggauaacguguuugaca

SEQ ID NO: 1171251 - RNA, 19 nt, Homo sapiens
ucaucgacuucacuuaugu

SEQ ID NO: 1171252 - RNA, 19 nt, Homo sapiens
ggauguugacugugacuuc

SEQ ID NO: 1171253 - RNA, 19 nt, Homo sapiens
gaggaauccgugcuccaaa

SEQ ID NO: 1171254 - RNA, 19 nt, Homo sapiens
gaaccugcucugggucauu

SEQ ID NO: 1171255 - RNA, 19 nt, Homo sapiens
gugcagcccuaccuguaca

SEQ ID NO: 1171256 - RNA, 19 nt, Homo sapiens
caaguuccacuacaagaag

SEQ ID NO: 1171257 - RNA, 19 nt, Homo sapiens
gaaacucugcgagaagauc

SEQ ID NO: 1171258 - RNA, 19 nt, Homo sapiens
gagcaggagcggcagaucu

SEQ ID NO: 1171259 - RNA, 19 nt, Homo sapiens
cacccaggauguugacugu

SEQ ID NO: 1171260 - RNA, 19 nt, Homo sapiens
guugagaacaugaguuugg

SEQ ID NO: 1171261 - RNA, 19 nt, Homo sapiens
aaguugagaacaugaguuu

SEQ ID NO: 1171262 - RNA, 19 nt, Homo sapiens
gggaauaaaguugagaaca

SEQ ID NO: 1171263 - RNA, 19 nt, Homo sapiens
cacagucggagguggauaa

SEQ ID NO: 1171264 - RNA, 19 nt, Homo sapiens
ugcgcaggcucaucaaaga

SEQ ID NO: 1171265 - RNA, 19 nt, Homo sapiens
cuucaucgacuucacuuau

SEQ ID NO: 1171266 - RNA, 19 nt, Homo sapiens
aaccugcucugggucauug

SEQ ID NO: 1171267 - RNA, 19 nt, Homo sapiens
agucggagguggauaacgu

SEQ ID NO: 1171268 - RNA, 19 nt, Homo sapiens
uccaaacucuacacucaag

SEQ ID NO: 1171269 - RNA, 19 nt, Homo sapiens
agcccuaccuguacaagau

SEQ ID NO: 1171270 - RNA, 19 nt, Homo sapiens
ggacggucaaggugcaugu

SEQ ID NO: 1171271 - RNA, 19 nt, Homo sapiens
agauguccuuggaguucua

SEQ ID NO: 1171272 - RNA, 19 nt, Homo sapiens
ggcaaguuccacuacaaga

SEQ ID NO: 1171273 - RNA, 19 nt, Homo sapiens
uguacaagaucuccuucca

SEQ ID NO: 1171274 - RNA, 19 nt, Homo sapiens
ugagaaacucugcgagaag

SEQ ID NO: 1171275 - RNA, 19 nt, Homo sapiens
acaagaaggagggcaccua

SEQ ID NO: 1171276 - RNA, 19 nt, Homo sapiens
guucaguccugccucuacu

SEQ ID NO: 1171277 - RNA, 19 nt, Homo sapiens
ugaggaauccgugcuccaa

SEQ ID NO: 1171278 - RNA, 19 nt, Homo sapiens
acaggcaaguuccacuaca

SEQ ID NO: 1171279 - RNA, 19 nt, Homo sapiens
ccgcagcacaggcaaguuc

SEQ ID NO: 1171280 - RNA, 19 nt, Homo sapiens
gcucuuaccuuacuuuauu

SEQ ID NO: 1171281 - RNA, 19 nt, Homo sapiens
ggaauggaaagccaaauua

SEQ ID NO: 1171282 - RNA, 19 nt, Homo sapiens
gcacaacacuaauuaccau

SEQ ID NO: 1171283 - RNA, 19 nt, Homo sapiens
caaauacaccuacagcuuu

SEQ ID NO: 1171284 - RNA, 19 nt, Homo sapiens
ggacuucauuuaaccgauu

SEQ ID NO: 1171285 - RNA, 19 nt, Homo sapiens
gaauggaaagccaaauuaa

SEQ ID NO: 1171286 - RNA, 19 nt, Homo sapiens
acugaaaggucgauuguaa

SEQ ID NO: 1171287 - RNA, 19 nt, Homo sapiens
guuuguaccuguaucagua

SEQ ID NO: 1171288 - RNA, 19 nt, Homo sapiens
gucaagagcauaaggauuu

SEQ ID NO: 1171289 - RNA, 19 nt, Homo sapiens
gacaaggacucccaaugug

SEQ ID NO: 1171290 - RNA, 19 nt, Homo sapiens
gaaaagaguguauauguga

SEQ ID NO: 1171291 - RNA, 19 nt, Homo sapiens
gaguagaaaccaaauguga

SEQ ID NO: 1171292 - RNA, 19 nt, Homo sapiens
guggaggguuugucucuuu

SEQ ID NO: 1171293 - RNA, 19 nt, Homo sapiens
ggauagaaauaugaagugu

SEQ ID NO: 1171294 - RNA, 19 nt, Homo sapiens
aaaggucgauuguaaugga

SEQ ID NO: 1171295 - RNA, 19 nt, Homo sapiens
aaagcgguauuaaguugua

SEQ ID NO: 1171296 - RNA, 19 nt, Homo sapiens
gaacuugacacuccaaacu

SEQ ID NO: 1171297 - RNA, 19 nt, Homo sapiens
gaguguauaugugaacuug

SEQ ID NO: 1171298 - RNA, 19 nt, Homo sapiens
uguaauggauugccguuug

SEQ ID NO: 1171299 - RNA, 19 nt, Homo sapiens
guaauggauugccguuugu

SEQ ID NO: 1171300 - RNA, 19 nt, Homo sapiens
ugacaaggacucccaaugu

SEQ ID NO: 1171301 - RNA, 19 nt, Homo sapiens
uaaucgcucuggaguagaa

SEQ ID NO: 1171302 - RNA, 19 nt, Homo sapiens
uaucaguauugcuguguaa

SEQ ID NO: 1171303 - RNA, 19 nt, Homo sapiens
ggguuugucucuuugaguu

SEQ ID NO: 1171304 - RNA, 19 nt, Homo sapiens
guucuuauuucccuguuug

SEQ ID NO: 1171305 - RNA, 19 nt, Homo sapiens
gccauccacugacucguaa

SEQ ID NO: 1171306 - RNA, 19 nt, Homo sapiens
gaaggaauggaaagccaaa

SEQ ID NO: 1171307 - RNA, 19 nt, Homo sapiens
uaugaaguguaaggcauua

SEQ ID NO: 1171308 - RNA, 19 nt, Homo sapiens
guagaaaccaaaugugaau

SEQ ID NO: 1171309 - RNA, 19 nt, Homo sapiens
gcaucacacuugcccaugu

SEQ ID NO: 1171310 - RNA, 19 nt, Homo sapiens
cuaaaccugucacucaaga

SEQ ID NO: 1171311 - RNA, 19 nt, Homo sapiens
ggaggaugcaucacacuug

SEQ ID NO: 1171312 - RNA, 19 nt, Homo sapiens
guccagauuucuagguuug

SEQ ID NO: 1171313 - RNA, 19 nt, Homo sapiens
ugaaaggucgauuguaaug

SEQ ID NO: 1171314 - RNA, 19 nt, Homo sapiens
auaaggauuugcacaccua

SEQ ID NO: 1171315 - RNA, 19 nt, Homo sapiens
gcucuugcuuccucaacuu

SEQ ID NO: 1171316 - RNA, 19 nt, Homo sapiens
guaucaguauugcugugua

SEQ ID NO: 1171317 - RNA, 19 nt, Homo sapiens
uaacugaaaggucgauugu

SEQ ID NO: 1171318 - RNA, 19 nt, Homo sapiens
ggacagaaggaauggaaag

SEQ ID NO: 1171319 - RNA, 19 nt, Homo sapiens
ggucgauuguaauggauug

SEQ ID NO: 1171320 - RNA, 19 nt, Homo sapiens
uaaucuggcacaacacuaa

SEQ ID NO: 1171321 - RNA, 19 nt, Homo sapiens
acaaauacaccuacagcuu

SEQ ID NO: 1171322 - RNA, 19 nt, Homo sapiens
gucaguaucugggucaaga

SEQ ID NO: 1171323 - RNA, 19 nt, Homo sapiens
gcuggcauuuaaauaguga

SEQ ID NO: 1171324 - RNA, 19 nt, Homo sapiens
gcacaccuaugggcaaacu

SEQ ID NO: 1171325 - RNA, 19 nt, Homo sapiens
ccacugacucguaaaguuc

SEQ ID NO: 1171326 - RNA, 19 nt, Homo sapiens
gugaauagccacaucuuac

SEQ ID NO: 1171327 - RNA, 19 nt, Homo sapiens
gaaaccaaaugugaauagc

SEQ ID NO: 1171328 - RNA, 19 nt, Homo sapiens
gcucuggaguagaaaccaa

SEQ ID NO: 1171329 - RNA, 19 nt, Homo sapiens
ucaagagcauaaggauuug

SEQ ID NO: 1171330 - RNA, 19 nt, Homo sapiens
gaaaaugucacuugaagag

SEQ ID NO: 1171331 - RNA, 19 nt, Homo sapiens
acuccaaacuccugucaug

SEQ ID NO: 1171332 - RNA, 19 nt, Homo sapiens
aguaaucgcucuggaguag

SEQ ID NO: 1171333 - RNA, 19 nt, Homo sapiens
gacuucauuuaaccgauuu

SEQ ID NO: 1171334 - RNA, 19 nt, Homo sapiens
ggucaagagcauaaggauu

SEQ ID NO: 1171335 - RNA, 19 nt, Homo sapiens
ugaguuugauggcagaauc

SEQ ID NO: 1171336 - RNA, 19 nt, Homo sapiens
guuuacggacuucauuuaa

SEQ ID NO: 1171337 - RNA, 19 nt, Homo sapiens
uuauuucccuguuuguguu

SEQ ID NO: 1171338 - RNA, 19 nt, Homo sapiens
gugcugugcugucaguauc

SEQ ID NO: 1171339 - RNA, 19 nt, Homo sapiens
guaacugaaaggucgauug

SEQ ID NO: 1171340 - RNA, 19 nt, Homo sapiens
gaaguguaaggcauuaugg

SEQ ID NO: 1171341 - RNA, 19 nt, Homo sapiens
ucuggcacaacacuaauua

SEQ ID NO: 1171342 - RNA, 19 nt, Homo sapiens
uuccuuagucuccuacuua

SEQ ID NO: 1171343 - RNA, 19 nt, Homo sapiens
gggcugguguguggacaga

SEQ ID NO: 1171344 - RNA, 19 nt, Homo sapiens
ggaguagaaaccaaaugug

SEQ ID NO: 1171345 - RNA, 19 nt, Homo sapiens
uccacugacucguaaaguu

SEQ ID NO: 1171346 - RNA, 19 nt, Homo sapiens
ggcaugugcugugcuguca

SEQ ID NO: 1171347 - RNA, 19 nt, Homo sapiens
uaaaguggaggguuugucu

SEQ ID NO: 1171348 - RNA, 19 nt, Homo sapiens
gcugguguguggacagaag

SEQ ID NO: 1171349 - RNA, 19 nt, Homo sapiens
ugaaaagaguguauaugug

SEQ ID NO: 1171350 - RNA, 19 nt, Homo sapiens
caucacacuugcccauguc

SEQ ID NO: 1171351 - RNA, 19 nt, Homo sapiens
gcugcuggacccuuccuaa

SEQ ID NO: 1171352 - RNA, 19 nt, Homo sapiens
guuugucucuuugaguuug

SEQ ID NO: 1171353 - RNA, 19 nt, Homo sapiens
aaauacaccuacagcuuuu

SEQ ID NO: 1171354 - RNA, 19 nt, Homo sapiens
gggcggaggaugcaucaca

SEQ ID NO: 1171355 - RNA, 19 nt, Homo sapiens
uagaaaaugucacuugaag

SEQ ID NO: 1171356 - RNA, 19 nt, Homo sapiens
uaguccagauuucuagguu

SEQ ID NO: 1171357 - RNA, 19 nt, Homo sapiens
uguuuacggacuucauuua

SEQ ID NO: 1171358 - RNA, 19 nt, Homo sapiens
uguaaggcauuauggaacu

SEQ ID NO: 1171359 - RNA, 19 nt, Homo sapiens
ugaaguguaaggcauuaug

SEQ ID NO: 1171360 - RNA, 19 nt, Homo sapiens
gaaaggucgauuguaaugg

SEQ ID NO: 1171361 - RNA, 19 nt, Homo sapiens
caugugcugugcugucagu

SEQ ID NO: 1171362 - RNA, 19 nt, Homo sapiens
agaaaccaaaugugaauag

SEQ ID NO: 1171363 - RNA, 19 nt, Homo sapiens
guaucugggucaagagcau

SEQ ID NO: 1171364 - RNA, 19 nt, Homo sapiens
guggacagaaggaauggaa

SEQ ID NO: 1171365 - RNA, 19 nt, Homo sapiens
gcuggacccuuccuaaacc

SEQ ID NO: 1171366 - RNA, 19 nt, Homo sapiens
guguauaugugaacuugac

SEQ ID NO: 1171367 - RNA, 19 nt, Homo sapiens
gugaaaagaguguauaugu

SEQ ID NO: 1171368 - RNA, 19 nt, Homo sapiens
gaggguuugucucuuugag

SEQ ID NO: 1171369 - RNA, 19 nt, Homo sapiens
ucucuucccuccucuugca

SEQ ID NO: 1171370 - RNA, 19 nt, Homo sapiens
aaugucacuugaagaggaa

SEQ ID NO: 1171371 - RNA, 19 nt, Homo sapiens
gguucuuauuucccuguuu

SEQ ID NO: 1171372 - RNA, 19 nt, Homo sapiens
guaaggcauuauggaacug

SEQ ID NO: 1171373 - RNA, 19 nt, Homo sapiens
guaccuguaucaguauugc

SEQ ID NO: 1171374 - RNA, 19 nt, Homo sapiens
aggaauggaaagccaaauu

SEQ ID NO: 1171375 - RNA, 19 nt, Homo sapiens
uccuaaaccugucacucaa

SEQ ID NO: 1171376 - RNA, 19 nt, Homo sapiens
ggaggguuugucucuuuga

SEQ ID NO: 1171377 - RNA, 19 nt, Homo sapiens
uggaggguuugucucuuug

SEQ ID NO: 1171378 - RNA, 19 nt, Homo sapiens
gacagcugccauccacuga

SEQ ID NO: 1171379 - RNA, 19 nt, Homo sapiens
agaaauaugaaguguaagg

SEQ ID NO: 1171380 - RNA, 19 nt, Homo sapiens
gaagacaucuggagaauga

SEQ ID NO: 1171381 - RNA, 19 nt, Homo sapiens
gaagaacaaucaugaaaug

SEQ ID NO: 1171382 - RNA, 19 nt, Homo sapiens
ggaacaagcuccugaagau

SEQ ID NO: 1171383 - RNA, 19 nt, Homo sapiens
gaacaaucaugaaauggaa

SEQ ID NO: 1171384 - RNA, 19 nt, Homo sapiens
guacaaaugugaacaagga

SEQ ID NO: 1171385 - RNA, 19 nt, Homo sapiens
gaaccucauucccuaauuu

SEQ ID NO: 1171386 - RNA, 19 nt, Homo sapiens
gaacaaggauaugggauug

SEQ ID NO: 1171387 - RNA, 19 nt, Homo sapiens
gaaagagaauccugcaaug

SEQ ID NO: 1171388 - RNA, 19 nt, Homo sapiens
ggaggaagguuucaacugu

SEQ ID NO: 1171389 - RNA, 19 nt, Homo sapiens
ccaagaaggucauuccauu

SEQ ID NO: 1171390 - RNA, 19 nt, Homo sapiens
caaguuggaugagggauua

SEQ ID NO: 1171391 - RNA, 19 nt, Homo sapiens
gaugauaacugcacugaca

SEQ ID NO: 1171392 - RNA, 19 nt, Homo sapiens
gguaugaugugcuuaaaga

SEQ ID NO: 1171393 - RNA, 19 nt, Homo sapiens
gaagaaagaggaugagguu

SEQ ID NO: 1171394 - RNA, 19 nt, Homo sapiens
caaaguguguuucaauaga

SEQ ID NO: 1171395 - RNA, 19 nt, Homo sapiens
gaagguagccugaagaaag

SEQ ID NO: 1171396 - RNA, 19 nt, Homo sapiens
caacuucacuccuaaccaa

SEQ ID NO: 1171397 - RNA, 19 nt, Homo sapiens
uaaaguggcaguugauuaa

SEQ ID NO: 1171398 - RNA, 19 nt, Homo sapiens
uaacugcacugacaacuuc

SEQ ID NO: 1171399 - RNA, 19 nt, Homo sapiens
ccucagugcugccgaauuu

SEQ ID NO: 1171400 - RNA, 19 nt, Homo sapiens
aagaagaaguguccuguuu

SEQ ID NO: 1171401 - RNA, 19 nt, Homo sapiens
gaauugaucucccaguaca

SEQ ID NO: 1171402 - RNA, 19 nt, Homo sapiens
ggaaacaaagggugaauga

SEQ ID NO: 1171403 - RNA, 19 nt, Homo sapiens
acagagaucuugcuggaaa

SEQ ID NO: 1171404 - RNA, 19 nt, Homo sapiens
ggaccuggcugaagacauc

SEQ ID NO: 1171405 - RNA, 19 nt, Homo sapiens
gauggaaccugucaaaguc

SEQ ID NO: 1171406 - RNA, 19 nt, Homo sapiens
gggaggaaauucaaaggaa

SEQ ID NO: 1171407 - RNA, 19 nt, Homo sapiens
gaaugaagaagaacaauca

SEQ ID NO: 1171408 - RNA, 19 nt, Homo sapiens
caucauaccauccagauuu

SEQ ID NO: 1171409 - RNA, 19 nt, Homo sapiens
ggucacaccuggacagaug

SEQ ID NO: 1171410 - RNA, 19 nt, Homo sapiens
gaagauacaaugccuggaa

SEQ ID NO: 1171411 - RNA, 19 nt, Homo sapiens
gaacaagcuccugaagaua

SEQ ID NO: 1171412 - RNA, 19 nt, Homo sapiens
gaaauucugcucacauguu

SEQ ID NO: 1171413 - RNA, 19 nt, Homo sapiens
gaauaagccuggcgauuuu

SEQ ID NO: 1171414 - RNA, 19 nt, Homo sapiens
ggaagaagagaaagaaaug

SEQ ID NO: 1171415 - RNA, 19 nt, Homo sapiens
gaaugaaaguuaaguacca

SEQ ID NO: 1171416 - RNA, 19 nt, Homo sapiens
ggaugacucucucucuuga

SEQ ID NO: 1171417 - RNA, 19 nt, Homo sapiens
gagcaugaaggaucuuaua

SEQ ID NO: 1171418 - RNA, 19 nt, Homo sapiens
gaauaucacugcugacacu

SEQ ID NO: 1171419 - RNA, 19 nt, Homo sapiens
gaaagaggaugagguuugg

SEQ ID NO: 1171420 - RNA, 19 nt, Homo sapiens
gagcaagaaauccaucaua

SEQ ID NO: 1171421 - RNA, 19 nt, Homo sapiens
gaaggcauguaugaaugua

SEQ ID NO: 1171422 - RNA, 19 nt, Homo sapiens
ugagggagauggcauaugu

SEQ ID NO: 1171423 - RNA, 19 nt, Homo sapiens
gcacaguucucagcauuca

SEQ ID NO: 1171424 - RNA, 19 nt, Homo sapiens
ucaaguagcccaaguagga

SEQ ID NO: 1171425 - RNA, 19 nt, Homo sapiens
gaugggaccuuucgucagu

SEQ ID NO: 1171426 - RNA, 19 nt, Homo sapiens
gaaggaagaagagaaagaa

SEQ ID NO: 1171427 - RNA, 19 nt, Homo sapiens
gcagaugguuggugugaca

SEQ ID NO: 1171428 - RNA, 19 nt, Homo sapiens
gaguuuaaguugugugaga

SEQ ID NO: 1171429 - RNA, 19 nt, Homo sapiens
ucauggagcuccuuauugu

SEQ ID NO: 1171430 - RNA, 19 nt, Homo sapiens
gaaagccaccaucuugauu

SEQ ID NO: 1171431 - RNA, 19 nt, Homo sapiens
gaacaacccagccaucauc

SEQ ID NO: 1171432 - RNA, 19 nt, Homo sapiens
ggaagagcaugaaggaucu

SEQ ID NO: 1171433 - RNA, 19 nt, Homo sapiens
gaagaagaacaaucaugaa

SEQ ID NO: 1171434 - RNA, 19 nt, Homo sapiens
caucaucgcagguguguuu

SEQ ID NO: 1171435 - RNA, 19 nt, Homo sapiens
caagagaaauuaacuucgu

SEQ ID NO: 1171436 - RNA, 19 nt, Homo sapiens
caucuacacucccaaagga

SEQ ID NO: 1171437 - RNA, 19 nt, Homo sapiens
ugaagaagaacaaucauga

SEQ ID NO: 1171438 - RNA, 19 nt, Homo sapiens
ggaagcaaccacucucuug

SEQ ID NO: 1171439 - RNA, 19 nt, Homo sapiens
ggagaagagugugaugaug

SEQ ID NO: 1171440 - RNA, 19 nt, Homo sapiens
guaccaaguucuagcugaa

SEQ ID NO: 1171441 - RNA, 19 nt, Homo sapiens
guaacaacaugcugaacga

SEQ ID NO: 1171442 - RNA, 19 nt, Homo sapiens
ggaggaagcgacugacuug

SEQ ID NO: 1171443 - RNA, 19 nt, Homo sapiens
gagaagcagagaccuuuaa

SEQ ID NO: 1171444 - RNA, 19 nt, Homo sapiens
gcccaagcauucccuuaaa

SEQ ID NO: 1171445 - RNA, 19 nt, Homo sapiens
gcaagaggauauugauagg

SEQ ID NO: 1171446 - RNA, 19 nt, Homo sapiens
ggugaacuaugcaaacuuc

SEQ ID NO: 1171447 - RNA, 19 nt, Homo sapiens
gcccaggucucaugaagug

SEQ ID NO: 1171448 - RNA, 19 nt, Homo sapiens
ggugaacuguaccucuaua

SEQ ID NO: 1171449 - RNA, 19 nt, Homo sapiens
ggagaggccagagcaauuu

SEQ ID NO: 1171450 - RNA, 19 nt, Homo sapiens
ucgcagguguguuugauaa

SEQ ID NO: 1171451 - RNA, 19 nt, Homo sapiens
agaauaagccuggcgauuu

SEQ ID NO: 1171452 - RNA, 19 nt, Homo sapiens
ggagaaugaaaguuaagua

SEQ ID NO: 1171453 - RNA, 19 nt, Homo sapiens
ugaauucuguggaguacaa

SEQ ID NO: 1171454 - RNA, 19 nt, Homo sapiens
gagcaaggcagcugcauuc

SEQ ID NO: 1171455 - RNA, 19 nt, Homo sapiens
gcucagagggaaccaaauu

SEQ ID NO: 1171456 - RNA, 19 nt, Homo sapiens
auacaucucugcacuuuca

SEQ ID NO: 1171457 - RNA, 19 nt, Homo sapiens
ccgaaugcauugcuauuug

SEQ ID NO: 1171458 - RNA, 19 nt, Homo sapiens
ugauacaucucugcacuuu

SEQ ID NO: 1171459 - RNA, 19 nt, Homo sapiens
gaaaugcugugagccuugu

SEQ ID NO: 1171460 - RNA, 19 nt, Homo sapiens
ggagguaugaugugcuuaa

SEQ ID NO: 1171461 - RNA, 19 nt, Homo sapiens
caagaaggucauuccauuu

SEQ ID NO: 1171462 - RNA, 19 nt, Homo sapiens
cagcacaguucucagcauu

SEQ ID NO: 1171463 - RNA, 19 nt, Homo sapiens
ggaggaagagcaugaagga

SEQ ID NO: 1171464 - RNA, 19 nt, Homo sapiens
gaaggaaauucugcucaca

SEQ ID NO: 1171465 - RNA, 19 nt, Homo sapiens
cgucauugcugcuugauca

SEQ ID NO: 1171466 - RNA, 19 nt, Homo sapiens
gaagaaguguccuguuucc

SEQ ID NO: 1171467 - RNA, 19 nt, Homo sapiens
uuaguggaguuguauauga

SEQ ID NO: 1171468 - RNA, 19 nt, Homo sapiens
gcaccgaccgcgugaagaa

SEQ ID NO: 1171469 - RNA, 19 nt, Homo sapiens
ggucuucucuucuaguauc

SEQ ID NO: 1171470 - RNA, 19 nt, Homo sapiens
ggaaggaagaagagaaaga

SEQ ID NO: 1171471 - RNA, 19 nt, Homo sapiens
gcucaacuguaaccaggaa

SEQ ID NO: 1171472 - RNA, 19 nt, Homo sapiens
guggugaacuguaccucua

SEQ ID NO: 1171473 - RNA, 19 nt, Homo sapiens
ugaaucaggugcuguugga

SEQ ID NO: 1171474 - RNA, 19 nt, Homo sapiens
gcaguugauuaacauggaa

SEQ ID NO: 1171475 - RNA, 19 nt, Homo sapiens
caaguaggagagaaucaua

SEQ ID NO: 1171476 - RNA, 19 nt, Homo sapiens
ggauggaaccugucaaagu

SEQ ID NO: 1171477 - RNA, 19 nt, Homo sapiens
cucaaaguguguuucaaua

SEQ ID NO: 1171478 - RNA, 19 nt, Homo sapiens
uaaaggagucagugaaaga

SEQ ID NO: 1171479 - RNA, 19 nt, Homo sapiens
gggcauacaugagugugaa

SEQ ID NO: 1171480 - RNA, 19 nt, Homo sapiens
gaagacaucuggagaauga

SEQ ID NO: 1171481 - RNA, 19 nt, Homo sapiens
gaaagagaauccugcaaug

SEQ ID NO: 1171482 - RNA, 19 nt, Homo sapiens
guaauuaggccacauguuu

SEQ ID NO: 1171483 - RNA, 19 nt, Homo sapiens
caaguuggaugagggauua

SEQ ID NO: 1171484 - RNA, 19 nt, Homo sapiens
ggaauaaaggaaagaguua

SEQ ID NO: 1171485 - RNA, 19 nt, Homo sapiens
gguaugaugugcuuaaaga

SEQ ID NO: 1171486 - RNA, 19 nt, Homo sapiens
gaauugaucucccaguaca

SEQ ID NO: 1171487 - RNA, 19 nt, Homo sapiens
ggaccuggcugaagacauc

SEQ ID NO: 1171488 - RNA, 19 nt, Homo sapiens
uaucaccacugucuuguuu

SEQ ID NO: 1171489 - RNA, 19 nt, Homo sapiens
gggaggaaauucaaaggaa

SEQ ID NO: 1171490 - RNA, 19 nt, Homo sapiens
gaauaagccuggcgauuuu

SEQ ID NO: 1171491 - RNA, 19 nt, Homo sapiens
ggaagaagagaaagaaaug

SEQ ID NO: 1171492 - RNA, 19 nt, Homo sapiens
gaaugaaaguuaaguacca

SEQ ID NO: 1171493 - RNA, 19 nt, Homo sapiens
ggaugacucucucucuuga

SEQ ID NO: 1171494 - RNA, 19 nt, Homo sapiens
gagcaagaaauccaucaua

SEQ ID NO: 1171495 - RNA, 19 nt, Homo sapiens
gcacaguucucagcauuca

SEQ ID NO: 1171496 - RNA, 19 nt, Homo sapiens
gcugaugggagaaugauua

SEQ ID NO: 1171497 - RNA, 19 nt, Homo sapiens
gaaggaagaagagaaagaa

SEQ ID NO: 1171498 - RNA, 19 nt, Homo sapiens
gagaguccauggaauaaag

SEQ ID NO: 1171499 - RNA, 19 nt, Homo sapiens
ugagagaguccauggaaua

SEQ ID NO: 1171500 - RNA, 19 nt, Homo sapiens
gaaagccaccaucuugauu

SEQ ID NO: 1171501 - RNA, 19 nt, Homo sapiens
gaacaacccagccaucauc

SEQ ID NO: 1171502 - RNA, 19 nt, Homo sapiens
gaacuugaagaaauacuga

SEQ ID NO: 1171503 - RNA, 19 nt, Homo sapiens
caucaucgcagguguguuu

SEQ ID NO: 1171504 - RNA, 19 nt, Homo sapiens
caagagaaauuaacuucgu

SEQ ID NO: 1171505 - RNA, 19 nt, Homo sapiens
guaacaacaugcugaacga

SEQ ID NO: 1171506 - RNA, 19 nt, Homo sapiens
ggaggaagcgacugacuug

SEQ ID NO: 1171507 - RNA, 19 nt, Homo sapiens
gagaagcagagaccuuuaa

SEQ ID NO: 1171508 - RNA, 19 nt, Homo sapiens
gcccaagcauucccuuaaa

SEQ ID NO: 1171509 - RNA, 19 nt, Homo sapiens
uaauuaggccacauguuua

SEQ ID NO: 1171510 - RNA, 19 nt, Homo sapiens
ugaauucucuccuacagau

SEQ ID NO: 1171511 - RNA, 19 nt, Homo sapiens
ucgcagguguguuugauaa

SEQ ID NO: 1171512 - RNA, 19 nt, Homo sapiens
agaauaagccuggcgauuu

SEQ ID NO: 1171513 - RNA, 19 nt, Homo sapiens
ggagaaugaaaguuaagua

SEQ ID NO: 1171514 - RNA, 19 nt, Homo sapiens
auacaucucugcacuuuca

SEQ ID NO: 1171515 - RNA, 19 nt, Homo sapiens
ugauacaucucugcacuuu

SEQ ID NO: 1171516 - RNA, 19 nt, Homo sapiens
gaaaugcugugagccuugu

SEQ ID NO: 1171517 - RNA, 19 nt, Homo sapiens
ggagguaugaugugcuuaa

SEQ ID NO: 1171518 - RNA, 19 nt, Homo sapiens
cagcacaguucucagcauu

SEQ ID NO: 1171519 - RNA, 19 nt, Homo sapiens
gcaccgaccgcgugaagaa

SEQ ID NO: 1171520 - RNA, 19 nt, Homo sapiens
ggucuucucuucuaguauc

SEQ ID NO: 1171521 - RNA, 19 nt, Homo sapiens
ggaaggaagaagagaaaga

SEQ ID NO: 1171522 - RNA, 19 nt, Homo sapiens
gagagaguccauggaauaa

SEQ ID NO: 1171523 - RNA, 19 nt, Homo sapiens
ugaaucaggugcuguugga

SEQ ID NO: 1171524 - RNA, 19 nt, Homo sapiens
ggccacauguuuacugaug

SEQ ID NO: 1171525 - RNA, 19 nt, Homo sapiens
uaaaggagucagugaaaga

SEQ ID NO: 1171526 - RNA, 19 nt, Homo sapiens
gggcauacaugagugugaa

SEQ ID NO: 1171527 - RNA, 19 nt, Homo sapiens
ucaaaggaaccaagagaaa

SEQ ID NO: 1171528 - RNA, 19 nt, Homo sapiens
uggaauugaucucccagua

SEQ ID NO: 1171529 - RNA, 19 nt, Homo sapiens
gcagcaaaccagacacuga

SEQ ID NO: 1171530 - RNA, 19 nt, Homo sapiens
gcaagaaauccaucauaca

SEQ ID NO: 1171531 - RNA, 19 nt, Homo sapiens
gaagaagagaaagaaauga

SEQ ID NO: 1171532 - RNA, 19 nt, Homo sapiens
gcaucaaacugaaggaaac

SEQ ID NO: 1171533 - RNA, 19 nt, Homo sapiens
caguaucaauugucuguga

SEQ ID NO: 1171534 - RNA, 19 nt, Homo sapiens
cagaagugcuggcugagau

SEQ ID NO: 1171535 - RNA, 19 nt, Homo sapiens
ggaaacauucuaaccuuca

SEQ ID NO: 1171536 - RNA, 19 nt, Homo sapiens
uaaauuccuucucacaaca

SEQ ID NO: 1171537 - RNA, 19 nt, Homo sapiens
ucuuagacauuuacucuga

SEQ ID NO: 1171538 - RNA, 19 nt, Homo sapiens
gagaguugaaguguauuua

SEQ ID NO: 1171539 - RNA, 19 nt, Homo sapiens
cagaguggguucccuuuag

SEQ ID NO: 1171540 - RNA, 19 nt, Homo sapiens
gagguaugaugugcuuaaa

SEQ ID NO: 1171541 - RNA, 19 nt, Homo sapiens
ucggagaguugaaguguau

SEQ ID NO: 1171542 - RNA, 19 nt, Homo sapiens
gggcuccguucaccaacua

SEQ ID NO: 1171543 - RNA, 19 nt, Homo sapiens
aaccagagcccacuaguga

SEQ ID NO: 1171544 - RNA, 19 nt, Homo sapiens
gacccugacucacccaaga

SEQ ID NO: 1171545 - RNA, 19 nt, Homo sapiens
ucucugcacuuucaguauu

SEQ ID NO: 1171546 - RNA, 19 nt, Homo sapiens
ccaucacucugguguggua

SEQ ID NO: 1171547 - RNA, 19 nt, Homo sapiens
uaacuucguucugcaagga

SEQ ID NO: 1171548 - RNA, 19 nt, Homo sapiens
gaaccaagagaaauuaacu

SEQ ID NO: 1171549 - RNA, 19 nt, Homo sapiens
aaaggaaccaagagaaauu

SEQ ID NO: 1171550 - RNA, 19 nt, Homo sapiens
aaagagaagguaauuccua

SEQ ID NO: 1171551 - RNA, 19 nt, Homo sapiens
caaaagcccucuugugauc

SEQ ID NO: 1171552 - RNA, 19 nt, Homo sapiens
ggagaguugaaguguauuu

SEQ ID NO: 1171553 - RNA, 19 nt, Homo sapiens
gaugggagaaugauuaagu

SEQ ID NO: 1171554 - RNA, 19 nt, Homo sapiens
caagagggcauacaugagu

SEQ ID NO: 1171555 - RNA, 19 nt, Homo sapiens
aaagccaccaucuugauua

SEQ ID NO: 1171556 - RNA, 19 nt, Homo sapiens
gggagaugaugacgcuuau

SEQ ID NO: 1171557 - RNA, 19 nt, Homo sapiens
ucagguggcuagcagucua

SEQ ID NO: 1171558 - RNA, 19 nt, Homo sapiens
caagaaauccaucauacag

SEQ ID NO: 1171559 - RNA, 19 nt, Homo sapiens
ccgcauucuuagacauuua

SEQ ID NO: 1171560 - RNA, 19 nt, Homo sapiens
gaaccagagcccacuagug

SEQ ID NO: 1171561 - RNA, 19 nt, Homo sapiens
ugaaagagaauccugcaau

SEQ ID NO: 1171562 - RNA, 19 nt, Homo sapiens
gaugcucgcuucuucuucu

SEQ ID NO: 1171563 - RNA, 19 nt, Homo sapiens
gcgggaugcucgcuucuuc

SEQ ID NO: 1171564 - RNA, 19 nt, Homo sapiens
caaaggaaccaagagaaau

SEQ ID NO: 1171565 - RNA, 19 nt, Homo sapiens
gaaggaaacauucuaaccu

SEQ ID NO: 1171566 - RNA, 19 nt, Homo sapiens
guacucacuuccucaacau

SEQ ID NO: 1171567 - RNA, 19 nt, Homo sapiens
gcugaacaguacucacuuc

SEQ ID NO: 1171568 - RNA, 19 nt, Homo sapiens
uccgguaucucuucacauu

SEQ ID NO: 1171569 - RNA, 19 nt, Homo sapiens
caacaugcugaacgacuuu

SEQ ID NO: 1171570 - RNA, 19 nt, Homo sapiens
ggaaacgggagaccucugu

SEQ ID NO: 1171571 - RNA, 19 nt, Homo sapiens
gagauucugucgccuuugc

SEQ ID NO: 1171572 - RNA, 19 nt, Homo sapiens
cgguaucucuucacauuuc

SEQ ID NO: 1171573 - RNA, 19 nt, Homo sapiens
cagcaaaccagacacugaa

SEQ ID NO: 1171574 - RNA, 19 nt, Homo sapiens
gggagggauuacugaagaa

SEQ ID NO: 1171575 - RNA, 19 nt, Homo sapiens
uaaguaccagcuugcauuu

SEQ ID NO: 1171576 - RNA, 19 nt, Homo sapiens
acucuaccaugucuuuaaa

SEQ ID NO: 1171577 - RNA, 19 nt, Homo sapiens
gaccuuuaacucccaagua

SEQ ID NO: 1171578 - RNA, 19 nt, Homo sapiens
gaguaucaauggcaguauc

SEQ ID NO: 1171579 - RNA, 19 nt, Homo sapiens
gagaaugaaaguuaaguac

SEQ ID NO: 1171580 - RNA, 19 nt, Homo sapiens
uguagaagcuucagaauua

SEQ ID NO: 1171581 - RNA, 19 nt, Homo sapiens
gaaagaaacagaagaguga

SEQ ID NO: 1171582 - RNA, 19 nt, Homo sapiens
caacagacuuggaagguuu

SEQ ID NO: 1171583 - RNA, 19 nt, Homo sapiens
gcagguaauuagaacguua

SEQ ID NO: 1171584 - RNA, 19 nt, Homo sapiens
gcuguaaccucuucaucua

SEQ ID NO: 1171585 - RNA, 19 nt, Homo sapiens
caagggaagcccagauuua

SEQ ID NO: 1171586 - RNA, 19 nt, Homo sapiens
gcaagagugucucacaugu

SEQ ID NO: 1171587 - RNA, 19 nt, Homo sapiens
ccgacacgcucuacaauaa

SEQ ID NO: 1171588 - RNA, 19 nt, Homo sapiens
uacagugggugccauauaa

SEQ ID NO: 1171589 - RNA, 19 nt, Homo sapiens
gaaagauuguucugugucu

SEQ ID NO: 1171590 - RNA, 19 nt, Homo sapiens
auauaaagcugaucaaugg

SEQ ID NO: 1171591 - RNA, 19 nt, Homo sapiens
gaagguuugcuacuguaua

SEQ ID NO: 1171592 - RNA, 19 nt, Homo sapiens
guagagggcugugacaaca

SEQ ID NO: 1171593 - RNA, 19 nt, Homo sapiens
uaaguuugcccaccuguaa

SEQ ID NO: 1171594 - RNA, 19 nt, Homo sapiens
gcugagacaccuccuguuu

SEQ ID NO: 1171595 - RNA, 19 nt, Homo sapiens
guaauuagaacguuaugga

SEQ ID NO: 1171596 - RNA, 19 nt, Homo sapiens
gcaagggaagcccagauuu

SEQ ID NO: 1171597 - RNA, 19 nt, Homo sapiens
uaaggccacucuaaggauu

SEQ ID NO: 1171598 - RNA, 19 nt, Homo sapiens
gaaguggugugugcucugu

SEQ ID NO: 1171599 - RNA, 19 nt, Homo sapiens
gcucacaugcagguaauua

SEQ ID NO: 1171600 - RNA, 19 nt, Homo sapiens
caagacaaacaacuacaaa

SEQ ID NO: 1171601 - RNA, 19 nt, Homo sapiens
uaaccgaggugcuucuagu

SEQ ID NO: 1171602 - RNA, 19 nt, Homo sapiens
gagcaaguguuuuggguuu

SEQ ID NO: 1171603 - RNA, 19 nt, Homo sapiens
guaaaguagauucaggaua

SEQ ID NO: 1171604 - RNA, 19 nt, Homo sapiens
gcugaucaaugguggugaa

SEQ ID NO: 1171605 - RNA, 19 nt, Homo sapiens
gacaguauagagucucaua

SEQ ID NO: 1171606 - RNA, 19 nt, Homo sapiens
cauauaaagcugaucaaug

SEQ ID NO: 1171607 - RNA, 19 nt, Homo sapiens
gaccaaaggacuauugcuu

SEQ ID NO: 1171608 - RNA, 19 nt, Homo sapiens
cuacaucuuuccuaugcaa

SEQ ID NO: 1171609 - RNA, 19 nt, Homo sapiens
gcuccaggcuaccuucugu

SEQ ID NO: 1171610 - RNA, 19 nt, Homo sapiens
cagagugcaucccagaaga

SEQ ID NO: 1171611 - RNA, 19 nt, Homo sapiens
gagccguugucucugcuaa

SEQ ID NO: 1171612 - RNA, 19 nt, Homo sapiens
gagcaguguugagcuuaga

SEQ ID NO: 1171613 - RNA, 19 nt, Homo sapiens
ggugagcaguguugagcuu

SEQ ID NO: 1171614 - RNA, 19 nt, Homo sapiens
caguauagagucucauaaa

SEQ ID NO: 1171615 - RNA, 19 nt, Homo sapiens
gggaagcccagauuuacuu

SEQ ID NO: 1171616 - RNA, 19 nt, Homo sapiens
uuacugaccugcuuucacu

SEQ ID NO: 1171617 - RNA, 19 nt, Homo sapiens
ccaaaauacuucuucauuc

SEQ ID NO: 1171618 - RNA, 19 nt, Homo sapiens
ggagggaaguagauguuuu

SEQ ID NO: 1171619 - RNA, 19 nt, Homo sapiens
gcuaaggccacucuaagga

SEQ ID NO: 1171620 - RNA, 19 nt, Homo sapiens
gagaagaaaggagaggaaa

SEQ ID NO: 1171621 - RNA, 19 nt, Homo sapiens
acagaagagugagaagaaa

SEQ ID NO: 1171622 - RNA, 19 nt, Homo sapiens
gcugugccuuugugaaguu

SEQ ID NO: 1171623 - RNA, 19 nt, Homo sapiens
aagguuugcuacuguauau

SEQ ID NO: 1171624 - RNA, 19 nt, Homo sapiens
ccaaccagagcaaguguuu

SEQ ID NO: 1171625 - RNA, 19 nt, Homo sapiens
gcagugaacccacaaucca

SEQ ID NO: 1171626 - RNA, 19 nt, Homo sapiens
ucacugaccagccacagaa

SEQ ID NO: 1171627 - RNA, 19 nt, Homo sapiens
gcucaccggccuccacaaa

SEQ ID NO: 1171628 - RNA, 19 nt, Homo sapiens
guagaagcuucagaauuag

SEQ ID NO: 1171629 - RNA, 19 nt, Homo sapiens
guucugugccugcagcaua

SEQ ID NO: 1171630 - RNA, 19 nt, Homo sapiens
ccacuacgcagcagccuau

SEQ ID NO: 1171631 - RNA, 19 nt, Homo sapiens
gcccagauuuacuucuuuc

SEQ ID NO: 1171632 - RNA, 19 nt, Homo sapiens
gcucaaggcccagcuaaag

SEQ ID NO: 1171633 - RNA, 19 nt, Homo sapiens
uggaagguuugcuacugua

SEQ ID NO: 1171634 - RNA, 19 nt, Homo sapiens
gaccagccacagaaagaaa

SEQ ID NO: 1171635 - RNA, 19 nt, Homo sapiens
agacauuccugcccuuugg

SEQ ID NO: 1171636 - RNA, 19 nt, Homo sapiens
ucacaugcagguaauuaga

SEQ ID NO: 1171637 - RNA, 19 nt, Homo sapiens
gagcuuagaaguggugugu

SEQ ID NO: 1171638 - RNA, 19 nt, Homo sapiens
gagaggaccgaaagcuguu

SEQ ID NO: 1171639 - RNA, 19 nt, Homo sapiens
guauacagugggugccaua

SEQ ID NO: 1171640 - RNA, 19 nt, Homo sapiens
caggcuaccuucugucucu

SEQ ID NO: 1171641 - RNA, 19 nt, Homo sapiens
gaacccacaauccacaauc

SEQ ID NO: 1171642 - RNA, 19 nt, Homo sapiens
gcugugccuuccucaccua

SEQ ID NO: 1171643 - RNA, 19 nt, Homo sapiens
aaacagaagagugagaaga

SEQ ID NO: 1171644 - RNA, 19 nt, Homo sapiens
acaacagacuuggaagguu

SEQ ID NO: 1171645 - RNA, 19 nt, Homo sapiens
uggaaagauuguucugugu

SEQ ID NO: 1171646 - RNA, 19 nt, Homo sapiens
gauucaggauaucuguaga

SEQ ID NO: 1171647 - RNA, 19 nt, Homo sapiens
uguaaccucuucaucuauc

SEQ ID NO: 1171648 - RNA, 19 nt, Homo sapiens
acgcugggaugcaccacua

SEQ ID NO: 1171649 - RNA, 19 nt, Homo sapiens
ggaccacgacgccaucaag

SEQ ID NO: 1171650 - RNA, 19 nt, Homo sapiens
ucaccggccuccacaaagg

SEQ ID NO: 1171651 - RNA, 19 nt, Homo sapiens
guauauacugccauugaga

SEQ ID NO: 1171652 - RNA, 19 nt, Homo sapiens
agacuuggaagguuugcua

SEQ ID NO: 1171653 - RNA, 19 nt, Homo sapiens
ugagacaccuccuguuucc

SEQ ID NO: 1171654 - RNA, 19 nt, Homo sapiens
caagagugggauugccuuu

SEQ ID NO: 1171655 - RNA, 19 nt, Homo sapiens
aaacaagacaaacaacuac

SEQ ID NO: 1171656 - RNA, 19 nt, Homo sapiens
uauauacugccauugagaa

SEQ ID NO: 1171657 - RNA, 19 nt, Homo sapiens
aagcccagauuuacuucuu

SEQ ID NO: 1171658 - RNA, 19 nt, Homo sapiens
gggcuaaggccacucuaag

SEQ ID NO: 1171659 - RNA, 19 nt, Homo sapiens
ccacagaaagaaacagaag

SEQ ID NO: 1171660 - RNA, 19 nt, Homo sapiens
guaaccucuucaucuauca

SEQ ID NO: 1171661 - RNA, 19 nt, Homo sapiens
auacagugggugccauaua

SEQ ID NO: 1171662 - RNA, 19 nt, Homo sapiens
ggaagguuugcuacuguau

SEQ ID NO: 1171663 - RNA, 19 nt, Homo sapiens
ucauaucauuccuuagagu

SEQ ID NO: 1171664 - RNA, 19 nt, Homo sapiens
gaagagugagaagaaagga

SEQ ID NO: 1171665 - RNA, 19 nt, Homo sapiens
ccucaggaguuuggugaug

SEQ ID NO: 1171666 - RNA, 19 nt, Homo sapiens
gcuccgacacgcucuacaa

SEQ ID NO: 1171667 - RNA, 19 nt, Homo sapiens
uuaaggauuugaggucuag

SEQ ID NO: 1171668 - RNA, 19 nt, Homo sapiens
ugugucucauucccucuua

SEQ ID NO: 1171669 - RNA, 19 nt, Homo sapiens
aacagaagagugagaagaa

SEQ ID NO: 1171670 - RNA, 19 nt, Homo sapiens
gccaaaauacuucuucauu

SEQ ID NO: 1171671 - RNA, 19 nt, Homo sapiens
auaacgggcucuccccuua

SEQ ID NO: 1171672 - RNA, 19 nt, Homo sapiens
gcccaccuguaaaguagau

SEQ ID NO: 1171673 - RNA, 19 nt, Homo sapiens
cauaucauuccuuagaguu

SEQ ID NO: 1171674 - RNA, 19 nt, Homo sapiens
ccagauuuacuucuuucaa

SEQ ID NO: 1171675 - RNA, 19 nt, Homo sapiens
gaacucauacagacauucc

SEQ ID NO: 1171676 - RNA, 19 nt, Homo sapiens
caagagugucucacaugug

SEQ ID NO: 1171677 - RNA, 19 nt, Homo sapiens
caaaauacuucuucauucc

SEQ ID NO: 1171678 - RNA, 19 nt, Homo sapiens
gccuuuggcugagcugaga

SEQ ID NO: 1171679 - RNA, 19 nt, Homo sapiens
gaguuuagggaccaaagga

SEQ ID NO: 1171680 - RNA, 19 nt, Homo sapiens
ggagaucccugcccucaag

SEQ ID NO: 1171681 - RNA, 19 nt, Homo sapiens
gaacaaaauagaccucuua

SEQ ID NO: 1171682 - RNA, 19 nt, Homo sapiens
ugaagaaggugaaguccau

SEQ ID NO: 1171683 - RNA, 19 nt, Homo sapiens
cuugauggcuacaaauaaa

SEQ ID NO: 1171684 - RNA, 19 nt, Homo sapiens
gaaagagacaggcagcaau

SEQ ID NO: 1171685 - RNA, 19 nt, Homo sapiens
ugaaguccaugcagauguu

SEQ ID NO: 1171686 - RNA, 19 nt, Homo sapiens
ccucuuaccugaaggaaag

SEQ ID NO: 1171687 - RNA, 19 nt, Homo sapiens
uguacaagcugaagcacaa

SEQ ID NO: 1171688 - RNA, 19 nt, Homo sapiens
ucacccaguuugacccuaa

SEQ ID NO: 1171689 - RNA, 19 nt, Homo sapiens
ggaaagagacaggcagcaa

SEQ ID NO: 1171690 - RNA, 19 nt, Homo sapiens
guuccgaggugcaccgauu

SEQ ID NO: 1171691 - RNA, 19 nt, Homo sapiens
gaccguuccucaugucugu

SEQ ID NO: 1171692 - RNA, 19 nt, Homo sapiens
agacaggcagcaauugaua

SEQ ID NO: 1171693 - RNA, 19 nt, Homo sapiens
gcagaagacccuagagaac

SEQ ID NO: 1171694 - RNA, 19 nt, Homo sapiens
aaagagacaggcagcaauu

SEQ ID NO: 1171695 - RNA, 19 nt, Homo sapiens
aaggccaaguuccacauua

SEQ ID NO: 1171696 - RNA, 19 nt, Homo sapiens
ccaaggcacugugaugaca

SEQ ID NO: 1171697 - RNA, 19 nt, Homo sapiens
aaaccaacauccagcucuu

SEQ ID NO: 1171698 - RNA, 19 nt, Homo sapiens
ggcgauggaugacuacagu

SEQ ID NO: 1171699 - RNA, 19 nt, Homo sapiens
ggaacuacgccgacagcuu

SEQ ID NO: 1171700 - RNA, 19 nt, Homo sapiens
gcaaaccaaggccaaguuc

SEQ ID NO: 1171701 - RNA, 19 nt, Homo sapiens
gacaggcagcaauugauaa

SEQ ID NO: 1171702 - RNA, 19 nt, Homo sapiens
gcccucaucucuguggaaa

SEQ ID NO: 1171703 - RNA, 19 nt, Homo sapiens
ggucgucuuugcccgaguu

SEQ ID NO: 1171704 - RNA, 19 nt, Homo sapiens
ggcacuugauggcuacaaa

SEQ ID NO: 1171705 - RNA, 19 nt, Homo sapiens
ggccagagcggcaaguuca

SEQ ID NO: 1171706 - RNA, 19 nt, Homo sapiens
ccgagucccugcacacugu

SEQ ID NO: 1171707 - RNA, 19 nt, Homo sapiens
gcaucugcgucacccaguu

SEQ ID NO: 1171708 - RNA, 19 nt, Homo sapiens
ugacagggaccauccuuuc

SEQ ID NO: 1171709 - RNA, 19 nt, Homo sapiens
cuccugacgucccagauuu

SEQ ID NO: 1171710 - RNA, 19 nt, Homo sapiens
caggcuagaugcggacauu

SEQ ID NO: 1171711 - RNA, 19 nt, Homo sapiens
gcagugacagacaaugaug

SEQ ID NO: 1171712 - RNA, 19 nt, Homo sapiens
cagcagugacagacaauga

SEQ ID NO: 1171713 - RNA, 19 nt, Homo sapiens
ucagcggaaugccuuguga

SEQ ID NO: 1171714 - RNA, 19 nt, Homo sapiens
ucaagguggugaagaaggu

SEQ ID NO: 1171715 - RNA, 19 nt, Homo sapiens
gaccacuguuucuccauca

SEQ ID NO: 1171716 - RNA, 19 nt, Homo sapiens
caccagcagugacagacaa

SEQ ID NO: 1171717 - RNA, 19 nt, Homo sapiens
ccacaugcccaucacuuca

SEQ ID NO: 1171718 - RNA, 19 nt, Homo sapiens
gcacuugauggcuacaaau

SEQ ID NO: 1171719 - RNA, 19 nt, Homo sapiens
uuucaagcguuaugucuuc

SEQ ID NO: 1171720 - RNA, 19 nt, Homo sapiens
gccugacuuucaagcguua

SEQ ID NO: 1171721 - RNA, 19 nt, Homo sapiens
agcaguaccuguccaagga

SEQ ID NO: 1171722 - RNA, 19 nt, Homo sapiens
cagaagacccuagagaaca

SEQ ID NO: 1171723 - RNA, 19 nt, Homo sapiens
gagacaggcagcaauugau

SEQ ID NO: 1171724 - RNA, 19 nt, Homo sapiens
acuggacucuuucaacuuc

SEQ ID NO: 1171725 - RNA, 19 nt, Homo sapiens
ggccaaggcacugugauga

SEQ ID NO: 1171726 - RNA, 19 nt, Homo sapiens
cacuugauggcuacaaaua

SEQ ID NO: 1171727 - RNA, 19 nt, Homo sapiens
auacuggacucuuucaacu

SEQ ID NO: 1171728 - RNA, 19 nt, Homo sapiens
agccuauacuggacucuuu

SEQ ID NO: 1171729 - RNA, 19 nt, Homo sapiens
agagacaggcagcaauuga

SEQ ID NO: 1171730 - RNA, 19 nt, Homo sapiens
ugcccaggcugaaggugua

SEQ ID NO: 1171731 - RNA, 19 nt, Homo sapiens
ccagauugccugccagaag

SEQ ID NO: 1171732 - RNA, 19 nt, Homo sapiens
acaggcagcaauugauaaa

SEQ ID NO: 1171733 - RNA, 19 nt, Homo sapiens
gggcccugguggaguuuga

SEQ ID NO: 1171734 - RNA, 19 nt, Homo sapiens
gauuugacaccagcaguga

SEQ ID NO: 1171735 - RNA, 19 nt, Homo sapiens
gacagggaccauccuuuca

SEQ ID NO: 1171736 - RNA, 19 nt, Homo sapiens
gagcgagcccucacagcau

SEQ ID NO: 1171737 - RNA, 19 nt, Homo sapiens
caucugcgucacccaguuu

SEQ ID NO: 1171738 - RNA, 19 nt, Homo sapiens
gcuccugacgucccagauu

SEQ ID NO: 1171739 - RNA, 19 nt, Homo sapiens
auggaugacuacaguguga

SEQ ID NO: 1171740 - RNA, 19 nt, Homo sapiens
auagaccucuuaccugaag

SEQ ID NO: 1171741 - RNA, 19 nt, Homo sapiens
caguaccuguccaaggauu

SEQ ID NO: 1171742 - RNA, 19 nt, Homo sapiens
ucaguccugcuccagauaa

SEQ ID NO: 1171743 - RNA, 19 nt, Homo sapiens
ccacuguuucuccaucaaa

SEQ ID NO: 1171744 - RNA, 19 nt, Homo sapiens
caaggccaaguuccacauu

SEQ ID NO: 1171745 - RNA, 19 nt, Homo sapiens
gagcggcaaguucaagauc

SEQ ID NO: 1171746 - RNA, 19 nt, Homo sapiens
guaccuguccaaggauuug

SEQ ID NO: 1171747 - RNA, 19 nt, Homo sapiens
cccucaagguggugaagaa

SEQ ID NO: 1171748 - RNA, 19 nt, Homo sapiens
caggugggcaggcacuuga

SEQ ID NO: 1171749 - RNA, 19 nt, Homo sapiens
ccaggcugcugugccaaau

SEQ ID NO: 1171750 - RNA, 19 nt, Homo sapiens
ggcugaagguguacaagcu

SEQ ID NO: 1171751 - RNA, 19 nt, Homo sapiens
caaaauagaccucuuaccu

SEQ ID NO: 1171752 - RNA, 19 nt, Homo sapiens
gcauuccagagcucauuga

SEQ ID NO: 1171753 - RNA, 19 nt, Homo sapiens
cgaggugcaccgauuauac

SEQ ID NO: 1171754 - RNA, 19 nt, Homo sapiens
ugcagaagacccuagagaa

SEQ ID NO: 1171755 - RNA, 19 nt, Homo sapiens
ccaagaaaaugcagaagac

SEQ ID NO: 1171756 - RNA, 19 nt, Homo sapiens
augaugaggccgacaagaa

SEQ ID NO: 1171757 - RNA, 19 nt, Homo sapiens
cuucaguccugcuccagau

SEQ ID NO: 1171758 - RNA, 19 nt, Homo sapiens
gggcauuccagagcucauu

SEQ ID NO: 1171759 - RNA, 19 nt, Homo sapiens
gcggcaaguucaagaucca

SEQ ID NO: 1171760 - RNA, 19 nt, Homo sapiens
ucuuucaacuucucucaag

SEQ ID NO: 1171761 - RNA, 19 nt, Homo sapiens
ccaaguuccacauuacagu

SEQ ID NO: 1171762 - RNA, 19 nt, Homo sapiens
agaagacccuagagaacac

SEQ ID NO: 1171763 - RNA, 19 nt, Homo sapiens
gcuguaaccuguuuaucua

SEQ ID NO: 1171764 - RNA, 19 nt, Homo sapiens
gcccagaccugcgugauuu

SEQ ID NO: 1171765 - RNA, 19 nt, Homo sapiens
cgaguaauuucaugaaguu

SEQ ID NO: 1171766 - RNA, 19 nt, Homo sapiens
caaagcgucuuaauguuca

SEQ ID NO: 1171767 - RNA, 19 nt, Homo sapiens
gcaaagcgucuuaauguuc

SEQ ID NO: 1171768 - RNA, 19 nt, Homo sapiens
cagcaaagcgucuuaaugu

SEQ ID NO: 1171769 - RNA, 19 nt, Homo sapiens
gcaauaucauuuccuccaa

SEQ ID NO: 1171770 - RNA, 19 nt, Homo sapiens
acacggagcugacgcagau

SEQ ID NO: 1171771 - RNA, 19 nt, Homo sapiens
ggacaaaccaacacacaca

SEQ ID NO: 1171772 - RNA, 19 nt, Homo sapiens
ggaccuggacgccaucaaa

SEQ ID NO: 1171773 - RNA, 19 nt, Homo sapiens
gcagcaaagcgucuuaaug

SEQ ID NO: 1171774 - RNA, 19 nt, Homo sapiens
gagguugguguuccuguua

SEQ ID NO: 1171775 - RNA, 19 nt, Homo sapiens
gaaagcaaagaacuuggaa

SEQ ID NO: 1171776 - RNA, 19 nt, Homo sapiens
gaagagaaagcaaagaacu

SEQ ID NO: 1171777 - RNA, 19 nt, Homo sapiens
cagaagagaaagcaaagaa

SEQ ID NO: 1171778 - RNA, 19 nt, Homo sapiens
cgagggcuguaaccuguuu

SEQ ID NO: 1171779 - RNA, 19 nt, Homo sapiens
gaagcagcaaagcgucuua

SEQ ID NO: 1171780 - RNA, 19 nt, Homo sapiens
gaaaccgucuaugccaaug

SEQ ID NO: 1171781 - RNA, 19 nt, Homo sapiens
caacuugcaaacugacuuu

SEQ ID NO: 1171782 - RNA, 19 nt, Homo sapiens
gcugugcuuucgugaaguu

SEQ ID NO: 1171783 - RNA, 19 nt, Homo sapiens
gcaugaagaggcucaaagu

SEQ ID NO: 1171784 - RNA, 19 nt, Homo sapiens
ccaaccagagcaaguguuu

SEQ ID NO: 1171785 - RNA, 19 nt, Homo sapiens
acacagaagagaaagcaaa

SEQ ID NO: 1171786 - RNA, 19 nt, Homo sapiens
ggaaaccgucuaugccaau

SEQ ID NO: 1171787 - RNA, 19 nt, Homo sapiens
agagaaagcaaagaacuug

SEQ ID NO: 1171788 - RNA, 19 nt, Homo sapiens
gcugugccuuccucaccua

SEQ ID NO: 1171789 - RNA, 19 nt, Homo sapiens
caacacacacacagaagag

SEQ ID NO: 1171790 - RNA, 19 nt, Homo sapiens
guagggaccggaagcuguu

SEQ ID NO: 1171791 - RNA, 19 nt, Homo sapiens
gcaggugucgugcccuuuc

SEQ ID NO: 1171792 - RNA, 19 nt, Homo sapiens
ggugaagccugcggacagu

SEQ ID NO: 1171793 - RNA, 19 nt, Homo sapiens
guucaaaacgccucucuuu

SEQ ID NO: 1171794 - RNA, 19 nt, Homo sapiens
guguuccuguuacguguuu

SEQ ID NO: 1171795 - RNA, 19 nt, Homo sapiens
ccaacacacacacagaaga

SEQ ID NO: 1171796 - RNA, 19 nt, Homo sapiens
gcuacgaguaauuucauga

SEQ ID NO: 1171797 - RNA, 19 nt, Homo sapiens
caucaccaauggcuuugca

SEQ ID NO: 1171798 - RNA, 19 nt, Homo sapiens
agcaaagcgucuuaauguu

SEQ ID NO: 1171799 - RNA, 19 nt, Homo sapiens
ggacgagaaggaccucaag

SEQ ID NO: 1171800 - RNA, 19 nt, Homo sapiens
gaagaccuugcccggaaug

SEQ ID NO: 1171801 - RNA, 19 nt, Homo sapiens
acacacacacagaagagaa

SEQ ID NO: 1171802 - RNA, 19 nt, Homo sapiens
aaaccaacacacacacaga

SEQ ID NO: 1171803 - RNA, 19 nt, Homo sapiens
cuacgaguaauuucaugaa

SEQ ID NO: 1171804 - RNA, 19 nt, Homo sapiens
caugaacggcuuccagauc

SEQ ID NO: 1171805 - RNA, 19 nt, Homo sapiens
gaaggucccgagggcugua

SEQ ID NO: 1171806 - RNA, 19 nt, Homo sapiens
ucuccggaguccagcagua

SEQ ID NO: 1171807 - RNA, 19 nt, Homo sapiens
agagguugguguuccuguu

SEQ ID NO: 1171808 - RNA, 19 nt, Homo sapiens
acgaguaauuucaugaagu

SEQ ID NO: 1171809 - RNA, 19 nt, Homo sapiens
gcucaaaguccagcugaag

SEQ ID NO: 1171810 - RNA, 19 nt, Homo sapiens
cccaggcucucaugcaaca

SEQ ID NO: 1171811 - RNA, 19 nt, Homo sapiens
uuauuucugcuacgaguaa

SEQ ID NO: 1171812 - RNA, 19 nt, Homo sapiens
gagcuaccaaccagagcaa

SEQ ID NO: 1171813 - RNA, 19 nt, Homo sapiens
uuccuacccuucggcaaua

SEQ ID NO: 1171814 - RNA, 19 nt, Homo sapiens
ggcuguaaccuguuuaucu

SEQ ID NO: 1171815 - RNA, 19 nt, Homo sapiens
agaaagcaaagaacuugga

SEQ ID NO: 1171816 - RNA, 19 nt, Homo sapiens
ugcgugauuuguacaaugu

SEQ ID NO: 1171817 - RNA, 19 nt, Homo sapiens
agaccugcgugauuuguac

SEQ ID NO: 1171818 - RNA, 19 nt, Homo sapiens
cgcccaggcucucaugcaa

SEQ ID NO: 1171819 - RNA, 19 nt, Homo sapiens
aagagaaagcaaagaacuu

SEQ ID NO: 1171820 - RNA, 19 nt, Homo sapiens
ugaagccugcggacaguga

SEQ ID NO: 1171821 - RNA, 19 nt, Homo sapiens
ggcccagaccugcgugauu

SEQ ID NO: 1171822 - RNA, 19 nt, Homo sapiens
cagggauuccgccaucaaa

SEQ ID NO: 1171823 - RNA, 19 nt, Homo sapiens
cugcgugauuuguacaaug

SEQ ID NO: 1171824 - RNA, 19 nt, Homo sapiens
gcaaguguuucggcuucgu

SEQ ID NO: 1171825 - RNA, 19 nt, Homo sapiens
guuccuacccuucggcaau

SEQ ID NO: 1171826 - RNA, 19 nt, Homo sapiens
agaagaccuugcccggaau

SEQ ID NO: 1171827 - RNA, 19 nt, Homo sapiens
ggacgccaucaaacucuuc

SEQ ID NO: 1171828 - RNA, 19 nt, Homo sapiens
gcagccauccaggccauga

SEQ ID NO: 1171829 - RNA, 19 nt, Homo sapiens
gaagccugcggacagugaa

SEQ ID NO: 1171830 - RNA, 19 nt, Homo sapiens
aggcugugcuuucgugaag

SEQ ID NO: 1171831 - RNA, 19 nt, Homo sapiens
ggagagagaaggaagauua

SEQ ID NO: 1171832 - RNA, 19 nt, Homo sapiens
gaauggaacuggagacaag

SEQ ID NO: 1171833 - RNA, 19 nt, Homo sapiens
gaagauggcaagaaguuug

SEQ ID NO: 1171834 - RNA, 19 nt, Homo sapiens
aaacaaagggcauguguga

SEQ ID NO: 1171835 - RNA, 19 nt, Homo sapiens
gugcugugcugcuguuuga

SEQ ID NO: 1171836 - RNA, 19 nt, Homo sapiens
uaggagacauguuccagaa

SEQ ID NO: 1171837 - RNA, 19 nt, Homo sapiens
ucugagaccugcaaugaga

SEQ ID NO: 1171838 - RNA, 19 nt, Homo sapiens
gagagaaggaagauuauca

SEQ ID NO: 1171839 - RNA, 19 nt, Homo sapiens
gcaaugagaccaccaagcu

SEQ ID NO: 1171840 - RNA, 19 nt, Homo sapiens
caaccuguuugaagacaug

SEQ ID NO: 1171841 - RNA, 19 nt, Homo sapiens
ggggaacgccggagaauua

SEQ ID NO: 1171842 - RNA, 19 nt, Homo sapiens
acagaccucuaccguguuu

SEQ ID NO: 1171843 - RNA, 19 nt, Homo sapiens
acauggaccucaacaagga

SEQ ID NO: 1171844 - RNA, 19 nt, Homo sapiens
cuaaaccacuuccuuaaaa

SEQ ID NO: 1171845 - RNA, 19 nt, Homo sapiens
caucugagaccugcaauga

SEQ ID NO: 1171846 - RNA, 19 nt, Homo sapiens
ggacuuuguucgauaccau

SEQ ID NO: 1171847 - RNA, 19 nt, Homo sapiens
ggacggcacccucuucgau

SEQ ID NO: 1171848 - RNA, 19 nt, Homo sapiens
caacggcacuuuugaagau

SEQ ID NO: 1171849 - RNA, 19 nt, Homo sapiens
uuagggcuaugaaaucuug

SEQ ID NO: 1171850 - RNA, 19 nt, Homo sapiens
gggcaaaggacgccucaug

SEQ ID NO: 1171851 - RNA, 19 nt, Homo sapiens
gcucugccgugcuaaucuu

SEQ ID NO: 1171852 - RNA, 19 nt, Homo sapiens
gagagagaaggaagauuau

SEQ ID NO: 1171853 - RNA, 19 nt, Homo sapiens
ggauuugcaaagccaauuu

SEQ ID NO: 1171854 - RNA, 19 nt, Homo sapiens
gcuaugaucgcaacaccuu

SEQ ID NO: 1171855 - RNA, 19 nt, Homo sapiens
ccuaaaccacuuccuuaaa

SEQ ID NO: 1171856 - RNA, 19 nt, Homo sapiens
cugccaaccuguuugaaga

SEQ ID NO: 1171857 - RNA, 19 nt, Homo sapiens
gcaaccacaccuacaauac

SEQ ID NO: 1171858 - RNA, 19 nt, Homo sapiens
gacaccagcuacaguaagg

SEQ ID NO: 1171859 - RNA, 19 nt, Homo sapiens
gguguuagggcuaugaaau

SEQ ID NO: 1171860 - RNA, 19 nt, Homo sapiens
gaagagaggaagaaaacaa

SEQ ID NO: 1171861 - RNA, 19 nt, Homo sapiens
agacugggcuguaguuagc

SEQ ID NO: 1171862 - RNA, 19 nt, Homo sapiens
ccaaacuuucucuuucuuu

SEQ ID NO: 1171863 - RNA, 19 nt, Homo sapiens
ucaagugagugagggcaaa

SEQ ID NO: 1171864 - RNA, 19 nt, Homo sapiens
cauuacaacuguucuuugc

SEQ ID NO: 1171865 - RNA, 19 nt, Homo sapiens
gcacuuaugacaccuacgu

SEQ ID NO: 1171866 - RNA, 19 nt, Homo sapiens
uaaggaaccauagaagaga

SEQ ID NO: 1171867 - RNA, 19 nt, Homo sapiens
cauguguccuggagagaga

SEQ ID NO: 1171868 - RNA, 19 nt, Homo sapiens
ucccuaaaccacuuccuua

SEQ ID NO: 1171869 - RNA, 19 nt, Homo sapiens
gaagacauggaccucaaca

SEQ ID NO: 1171870 - RNA, 19 nt, Homo sapiens
ucgauaccauuacaacugu

SEQ ID NO: 1171871 - RNA, 19 nt, Homo sapiens
acaccuacaauaccuauau

SEQ ID NO: 1171872 - RNA, 19 nt, Homo sapiens
guggaaaucaggacacugu

SEQ ID NO: 1171873 - RNA, 19 nt, Homo sapiens
gaacgccggagaauuacca

SEQ ID NO: 1171874 - RNA, 19 nt, Homo sapiens
ccuaaggaaccauagaaga

SEQ ID NO: 1171875 - RNA, 19 nt, Homo sapiens
ccacagcacagaccucuac

SEQ ID NO: 1171876 - RNA, 19 nt, Homo sapiens
caaccaggacggcaagauc

SEQ ID NO: 1171877 - RNA, 19 nt, Homo sapiens
agacauggaccucaacaag

SEQ ID NO: 1171878 - RNA, 19 nt, Homo sapiens
cuacaauggcuccuugaug

SEQ ID NO: 1171879 - RNA, 19 nt, Homo sapiens
gagaaggaagauuaucauc

SEQ ID NO: 1171880 - RNA, 19 nt, Homo sapiens
gaaaacaaagggcaugugu

SEQ ID NO: 1171881 - RNA, 19 nt, Homo sapiens
cuaaggaaccauagaagag

SEQ ID NO: 1171882 - RNA, 19 nt, Homo sapiens
cugcggaugugguggaaau

SEQ ID NO: 1171883 - RNA, 19 nt, Homo sapiens
ccacuuccuuaaaauguuu

SEQ ID NO: 1171884 - RNA, 19 nt, Homo sapiens
gacggcacccucuucgauu

SEQ ID NO: 1171885 - RNA, 19 nt, Homo sapiens
ggaugccacccucuacuuc

SEQ ID NO: 1171886 - RNA, 19 nt, Homo sapiens
gagaauggaacuggagaca

SEQ ID NO: 1171887 - RNA, 19 nt, Homo sapiens
cauagaagagaggaagaaa

SEQ ID NO: 1171888 - RNA, 19 nt, Homo sapiens
ggagccaacuaaaacaaug

SEQ ID NO: 1171889 - RNA, 19 nt, Homo sapiens
gauggcaagaaguuugauu

SEQ ID NO: 1171890 - RNA, 19 nt, Homo sapiens
aggccucgcuggucuuuca

SEQ ID NO: 1171891 - RNA, 19 nt, Homo sapiens
cgcaaccacaccuacaaua

SEQ ID NO: 1171892 - RNA, 19 nt, Homo sapiens
cuacuucgaugugguucug

SEQ ID NO: 1171893 - RNA, 19 nt, Homo sapiens
gauuaucaucccuccauuc

SEQ ID NO: 1171894 - RNA, 19 nt, Homo sapiens
cccaaacuuucucuuucuu

SEQ ID NO: 1171895 - RNA, 19 nt, Homo sapiens
aaccauaggagacauguuc

SEQ ID NO: 1171896 - RNA, 19 nt, Homo sapiens
ccauuacaacuguucuuug

SEQ ID NO: 1171897 - RNA, 19 nt, Homo sapiens
cuucaacguccaugucauu

SEQ ID NO: 1171898 - RNA, 19 nt, Homo sapiens
ccacaccuacaauaccuau

SEQ ID NO: 1171899 - RNA, 19 nt, Homo sapiens
ccauagaagagaggaagaa

SEQ ID NO: 1171900 - RNA, 19 nt, Homo sapiens
ccucuaccguguuucucuu

SEQ ID NO: 1171901 - RNA, 19 nt, Homo sapiens
ccaccacccuagaugaaaa

SEQ ID NO: 1171902 - RNA, 19 nt, Homo sapiens
caccuacaauaccuauauc

SEQ ID NO: 1171903 - RNA, 19 nt, Homo sapiens
gauggacggcacccucuuc

SEQ ID NO: 1171904 - RNA, 19 nt, Homo sapiens
caacuccaggcaccauguu

SEQ ID NO: 1171905 - RNA, 19 nt, Homo sapiens
gaaccauagaagagaggaa

SEQ ID NO: 1171906 - RNA, 19 nt, Homo sapiens
uugaagauggcaagaaguu

SEQ ID NO: 1171907 - RNA, 19 nt, Homo sapiens
ugaagauggcaagaaguuu

SEQ ID NO: 1171908 - RNA, 19 nt, Homo sapiens
gguccaggagccaacuaaa

SEQ ID NO: 1171909 - RNA, 19 nt, Homo sapiens
cccuaaaccacuuccuuaa

SEQ ID NO: 1171910 - RNA, 19 nt, Homo sapiens
gagagaggcggcagcucau

SEQ ID NO: 1171911 - RNA, 19 nt, Homo sapiens
caaugagaccaccaagcuu

SEQ ID NO: 1171912 - RNA, 19 nt, Homo sapiens
ccuggccuauggcgagaaa

SEQ ID NO: 1171913 - RNA, 19 nt, Homo sapiens
gauaccauuacaacuguuc

SEQ ID NO: 1171914 - RNA, 19 nt, Homo sapiens
gaagguauaucuagguuua

SEQ ID NO: 1171915 - RNA, 19 nt, Homo sapiens
ggaaguaguuaucauguua

SEQ ID NO: 1171916 - RNA, 19 nt, Homo sapiens
gcaaaguacuccuggugua

SEQ ID NO: 1171917 - RNA, 19 nt, Homo sapiens
gaagaaagaucagcaacug

SEQ ID NO: 1171918 - RNA, 19 nt, Homo sapiens
guaggaagguacuguauga

SEQ ID NO: 1171919 - RNA, 19 nt, Homo sapiens
gcagauggcuggcaugagu

SEQ ID NO: 1171920 - RNA, 19 nt, Homo sapiens
gcucuaauguuugcauaua

SEQ ID NO: 1171921 - RNA, 19 nt, Homo sapiens
cagaagaaguggcaaagaa

SEQ ID NO: 1171922 - RNA, 19 nt, Homo sapiens
ggaagguacuguaugauca

SEQ ID NO: 1171923 - RNA, 19 nt, Homo sapiens
gcacaaguguaaugaauac

SEQ ID NO: 1171924 - RNA, 19 nt, Homo sapiens
ugaaugcucuguagccuaa

SEQ ID NO: 1171925 - RNA, 19 nt, Homo sapiens
ccaaacauccucuuccaua

SEQ ID NO: 1171926 - RNA, 19 nt, Homo sapiens
cagaacaaaugaagacaaa

SEQ ID NO: 1171927 - RNA, 19 nt, Homo sapiens
caaacaggguaacuaacua

SEQ ID NO: 1171928 - RNA, 19 nt, Homo sapiens
ccaauuagcuuaugguaac

SEQ ID NO: 1171929 - RNA, 19 nt, Homo sapiens
gauccacgacgcuuaaaua

SEQ ID NO: 1171930 - RNA, 19 nt, Homo sapiens
cauuaaacaugacuccaua

SEQ ID NO: 1171931 - RNA, 19 nt, Homo sapiens
gauuucauguacugcauua

SEQ ID NO: 1171932 - RNA, 19 nt, Homo sapiens
caagauaugggaaauacua

SEQ ID NO: 1171933 - RNA, 19 nt, Homo sapiens
guuguuaucuguuugagaa

SEQ ID NO: 1171934 - RNA, 19 nt, Homo sapiens
guacauagugcuaacauga

SEQ ID NO: 1171935 - RNA, 19 nt, Homo sapiens
ggaaucaucaggaacguuu

SEQ ID NO: 1171936 - RNA, 19 nt, Homo sapiens
ggucuguacugauucaauu

SEQ ID NO: 1171937 - RNA, 19 nt, Homo sapiens
cgacuguuguuaucuguuu

SEQ ID NO: 1171938 - RNA, 19 nt, Homo sapiens
caaacauccucuuccauau

SEQ ID NO: 1171939 - RNA, 19 nt, Homo sapiens
guucaagucuaccaauuau

SEQ ID NO: 1171940 - RNA, 19 nt, Homo sapiens
aagcaagacuacucuauga

SEQ ID NO: 1171941 - RNA, 19 nt, Homo sapiens
gaagauaaacguggauguu

SEQ ID NO: 1171942 - RNA, 19 nt, Homo sapiens
gcucuuauuucaucauuca

SEQ ID NO: 1171943 - RNA, 19 nt, Homo sapiens
ggucaaaucagucaaccua

SEQ ID NO: 1171944 - RNA, 19 nt, Homo sapiens
ccaauggguuuaugggaaa

SEQ ID NO: 1171945 - RNA, 19 nt, Homo sapiens
ccagagaacuuucgaagac

SEQ ID NO: 1171946 - RNA, 19 nt, Homo sapiens
ccacgacgcuuaaauacag

SEQ ID NO: 1171947 - RNA, 19 nt, Homo sapiens
cugacaagcuccauuuaaa

SEQ ID NO: 1171948 - RNA, 19 nt, Homo sapiens
ucacugugcuguuguuaug

SEQ ID NO: 1171949 - RNA, 19 nt, Homo sapiens
uaacugacaagcuccauuu

SEQ ID NO: 1171950 - RNA, 19 nt, Homo sapiens
gggaggaggacaacaagua

SEQ ID NO: 1171951 - RNA, 19 nt, Homo sapiens
gggcagcuuugcucauauu

SEQ ID NO: 1171952 - RNA, 19 nt, Homo sapiens
gggaaauacuaaagcaaga

SEQ ID NO: 1171953 - RNA, 19 nt, Homo sapiens
ucaaaucagucaaccuaga

SEQ ID NO: 1171954 - RNA, 19 nt, Homo sapiens
cagcacaaguguaaugaau

SEQ ID NO: 1171955 - RNA, 19 nt, Homo sapiens
cagggaacgugauuaguga

SEQ ID NO: 1171956 - RNA, 19 nt, Homo sapiens
gcauauaagggaaguaguu

SEQ ID NO: 1171957 - RNA, 19 nt, Homo sapiens
caaaaugacuugaagacuu

SEQ ID NO: 1171958 - RNA, 19 nt, Homo sapiens
gagaaaacaugcagaacaa

SEQ ID NO: 1171959 - RNA, 19 nt, Homo sapiens
caauuuaguuguuguagag

SEQ ID NO: 1171960 - RNA, 19 nt, Homo sapiens
gguacuguaugaucaaaug

SEQ ID NO: 1171961 - RNA, 19 nt, Homo sapiens
gugcuggaauucauagaaa

SEQ ID NO: 1171962 - RNA, 19 nt, Homo sapiens
gaaaggcugcuguacugaa

SEQ ID NO: 1171963 - RNA, 19 nt, Homo sapiens
aagaaaggcugcuguacug

SEQ ID NO: 1171964 - RNA, 19 nt, Homo sapiens
gggaaguaguuaucauguu

SEQ ID NO: 1171965 - RNA, 19 nt, Homo sapiens
ucacugagcaaacuacaaa

SEQ ID NO: 1171966 - RNA, 19 nt, Homo sapiens
ugccauagcuauuacaaau

SEQ ID NO: 1171967 - RNA, 19 nt, Homo sapiens
caagcuccauuuaaacaga

SEQ ID NO: 1171968 - RNA, 19 nt, Homo sapiens
gaacgugauuagugaaagg

SEQ ID NO: 1171969 - RNA, 19 nt, Homo sapiens
ucacuucacugugcuguug

SEQ ID NO: 1171970 - RNA, 19 nt, Homo sapiens
gcacaggaaccauucaaca

SEQ ID NO: 1171971 - RNA, 19 nt, Homo sapiens
ggaucuagauuuauucacu

SEQ ID NO: 1171972 - RNA, 19 nt, Homo sapiens
gcaaacaggguaacuaacu

SEQ ID NO: 1171973 - RNA, 19 nt, Homo sapiens
guacugcauuauuugagaa

SEQ ID NO: 1171974 - RNA, 19 nt, Homo sapiens
gaagaccacagacagauca

SEQ ID NO: 1171975 - RNA, 19 nt, Homo sapiens
ggaauucauagaaaucuug

SEQ ID NO: 1171976 - RNA, 19 nt, Homo sapiens
agagugguaucuugcagua

SEQ ID NO: 1171977 - RNA, 19 nt, Homo sapiens
cuaccaaccuguucaaguc

SEQ ID NO: 1171978 - RNA, 19 nt, Homo sapiens
ccauagaccuuuucauuug

SEQ ID NO: 1171979 - RNA, 19 nt, Homo sapiens
gugcuaacaugaagaccuu

SEQ ID NO: 1171980 - RNA, 19 nt, Homo sapiens
aagggcagcuuugcucaua

SEQ ID NO: 1171981 - RNA, 19 nt, Homo sapiens
aagccaaucuuccagagaa

SEQ ID NO: 1171982 - RNA, 19 nt, Homo sapiens
aaauacagcuuuuggauug

SEQ ID NO: 1171983 - RNA, 19 nt, Homo sapiens
ccaauuuaguuguuguaga

SEQ ID NO: 1171984 - RNA, 19 nt, Homo sapiens
cauauaagggaaguaguua

SEQ ID NO: 1171985 - RNA, 19 nt, Homo sapiens
ucuaaucccuuaccugcaa

SEQ ID NO: 1171986 - RNA, 19 nt, Homo sapiens
caaguguaaugaauaccuu

SEQ ID NO: 1171987 - RNA, 19 nt, Homo sapiens
gacaagaaaggcugcugua

SEQ ID NO: 1171988 - RNA, 19 nt, Homo sapiens
aagauaaacguggauguua

SEQ ID NO: 1171989 - RNA, 19 nt, Homo sapiens
gaacuaccaccugacauuc

SEQ ID NO: 1171990 - RNA, 19 nt, Homo sapiens
cuugaagacuuacagcaaa

SEQ ID NO: 1171991 - RNA, 19 nt, Homo sapiens
gacaagcuccauuuaaaca

SEQ ID NO: 1171992 - RNA, 19 nt, Homo sapiens
aaacaugcagaacaaauga

SEQ ID NO: 1171993 - RNA, 19 nt, Homo sapiens
uaacagggaacgugauuag

SEQ ID NO: 1171994 - RNA, 19 nt, Homo sapiens
cugaaaagcugcagaagaa

SEQ ID NO: 1171995 - RNA, 19 nt, Homo sapiens
gcaagacuacucuaugaag

SEQ ID NO: 1171996 - RNA, 19 nt, Homo sapiens
aaacaggguaacuaacuaa

SEQ ID NO: 1171997 - RNA, 19 nt, Homo sapiens
gaucucuucuuaauguaca

SEQ ID NO: 1171998 - RNA, 19 nt, Homo sapiens
gaagguacuguaugaucaa

SEQ ID NO: 1171999 - RNA, 19 nt, Homo sapiens
guguuggucuguacugauu

SEQ ID NO: 1172000 - RNA, 19 nt, Homo sapiens
gcagaacaaaugaagacaa

SEQ ID NO: 1172001 - RNA, 19 nt, Homo sapiens
uuggaucucuucuuaaugu

SEQ ID NO: 1172002 - RNA, 19 nt, Homo sapiens
ggaauauugguguguuuau

SEQ ID NO: 1172003 - RNA, 19 nt, Homo sapiens
auacagugcaugcaagaua

SEQ ID NO: 1172004 - RNA, 19 nt, Homo sapiens
guaccaaccauccaauuag

SEQ ID NO: 1172005 - RNA, 19 nt, Homo sapiens
gcaaagucaggaaucauca

SEQ ID NO: 1172006 - RNA, 19 nt, Homo sapiens
ugauguauacugccacuaa

SEQ ID NO: 1172007 - RNA, 19 nt, Homo sapiens
gugaaaagcagguugauaa

SEQ ID NO: 1172008 - RNA, 19 nt, Homo sapiens
ugacauuccuugcugaaac

SEQ ID NO: 1172009 - RNA, 19 nt, Homo sapiens
uuaucugccucucuuguaa

SEQ ID NO: 1172010 - RNA, 19 nt, Homo sapiens
auacaaguuucauccagaa

SEQ ID NO: 1172011 - RNA, 19 nt, Homo sapiens
uaaagcaagacuacucuau

SEQ ID NO: 1172012 - RNA, 19 nt, Homo sapiens
gaaagucagauucuugcau

SEQ ID NO: 1172013 - RNA, 19 nt, Homo sapiens
guugcugcuucaauuuaua

SEQ ID NO: 1172014 - RNA, 19 nt, Homo sapiens
ggaaaccuguccuaaguaa

SEQ ID NO: 1172015 - RNA, 19 nt, Homo sapiens
ccuguugacuuguaugaua

SEQ ID NO: 1172016 - RNA, 19 nt, Homo sapiens
cgucauuccugauuuagaa

SEQ ID NO: 1172017 - RNA, 19 nt, Homo sapiens
ggagcuucaucuagugauu

SEQ ID NO: 1172018 - RNA, 19 nt, Homo sapiens
ugggaaaccuguccuaagu

SEQ ID NO: 1172019 - RNA, 19 nt, Homo sapiens
aaaccacguuccugccuuu

SEQ ID NO: 1172020 - RNA, 19 nt, Homo sapiens
gcacaaagacacugguuuu

SEQ ID NO: 1172021 - RNA, 19 nt, Homo sapiens
gguaggagccaguuugugu

SEQ ID NO: 1172022 - RNA, 19 nt, Homo sapiens
gugcgacucgucucuguua

SEQ ID NO: 1172023 - RNA, 19 nt, Homo sapiens
aggcagaggugcugacguu

SEQ ID NO: 1172024 - RNA, 19 nt, Homo sapiens
ggccauuucuggucuuugu

SEQ ID NO: 1172025 - RNA, 19 nt, Homo sapiens
cugcgucauuccugauuua

SEQ ID NO: 1172026 - RNA, 19 nt, Homo sapiens
gacgugagccauccuucua

SEQ ID NO: 1172027 - RNA, 19 nt, Homo sapiens
caaagacacugguuuucaa

SEQ ID NO: 1172028 - RNA, 19 nt, Homo sapiens
gcacaccuccugccucuac

SEQ ID NO: 1172029 - RNA, 19 nt, Homo sapiens
gggaaaccuguccuaagua

SEQ ID NO: 1172030 - RNA, 19 nt, Homo sapiens
gagcagaauguuuccuguu

SEQ ID NO: 1172031 - RNA, 19 nt, Homo sapiens
gcucuucggaggcaucaaa

SEQ ID NO: 1172032 - RNA, 19 nt, Homo sapiens
cuucauggcugcgucauuc

SEQ ID NO: 1172033 - RNA, 19 nt, Homo sapiens
gccagccucuccuuucuuc

SEQ ID NO: 1172034 - RNA, 19 nt, Homo sapiens
gguguguucauuuguuuaa

SEQ ID NO: 1172035 - RNA, 19 nt, Homo sapiens
ugucgacucugcaguuugu

SEQ ID NO: 1172036 - RNA, 19 nt, Homo sapiens
ggagaaugccguccuaagc

SEQ ID NO: 1172037 - RNA, 19 nt, Homo sapiens
ucucagagcagaauguuuc

SEQ ID NO: 1172038 - RNA, 19 nt, Homo sapiens
uguguaggcugcaucuguu

SEQ ID NO: 1172039 - RNA, 19 nt, Homo sapiens
aaccggagcuucaucuagu

SEQ ID NO: 1172040 - RNA, 19 nt, Homo sapiens
gcugcgucauuccugauuu

SEQ ID NO: 1172041 - RNA, 19 nt, Homo sapiens
agaaugccguccuaagcuu

SEQ ID NO: 1172042 - RNA, 19 nt, Homo sapiens
gaagcccucgagugacuuu

SEQ ID NO: 1172043 - RNA, 19 nt, Homo sapiens
gaaaccuguccuaaguaaa

SEQ ID NO: 1172044 - RNA, 19 nt, Homo sapiens
ccacguuccugccuuucau

SEQ ID NO: 1172045 - RNA, 19 nt, Homo sapiens
cuggaugccuuuaacuuca

SEQ ID NO: 1172046 - RNA, 19 nt, Homo sapiens
gcccucgagugacuuucua

SEQ ID NO: 1172047 - RNA, 19 nt, Homo sapiens
gaacagagaggggagaaug

SEQ ID NO: 1172048 - RNA, 19 nt, Homo sapiens
gagaaugccguccuaagcu

SEQ ID NO: 1172049 - RNA, 19 nt, Homo sapiens
cgacucgucucuguuaggu

SEQ ID NO: 1172050 - RNA, 19 nt, Homo sapiens
ggugguaggagccaguuug

SEQ ID NO: 1172051 - RNA, 19 nt, Homo sapiens
cacgguguguucauuuguu

SEQ ID NO: 1172052 - RNA, 19 nt, Homo sapiens
gagcuucaucuagugauug

SEQ ID NO: 1172053 - RNA, 19 nt, Homo sapiens
gcugggagaaccuguguca

SEQ ID NO: 1172054 - RNA, 19 nt, Homo sapiens
guuccugccuuucauugca

SEQ ID NO: 1172055 - RNA, 19 nt, Homo sapiens
agcagaauguuuccuguuc

SEQ ID NO: 1172056 - RNA, 19 nt, Homo sapiens
ggacgugagccauccuucu

SEQ ID NO: 1172057 - RNA, 19 nt, Homo sapiens
ggaugccuuuaacuucaug

SEQ ID NO: 1172058 - RNA, 19 nt, Homo sapiens
gcagaggugcugacguucu

SEQ ID NO: 1172059 - RNA, 19 nt, Homo sapiens
caaaugccagccucuccuu

SEQ ID NO: 1172060 - RNA, 19 nt, Homo sapiens
ugaguaaguuuagaugacu

SEQ ID NO: 1172061 - RNA, 19 nt, Homo sapiens
ccugucgacucugcaguuu

SEQ ID NO: 1172062 - RNA, 19 nt, Homo sapiens
uaaccggagcuucaucuag

SEQ ID NO: 1172063 - RNA, 19 nt, Homo sapiens
gugacuuucuaacccaaga

SEQ ID NO: 1172064 - RNA, 19 nt, Homo sapiens
aaaccuguccuaaguaaaa

SEQ ID NO: 1172065 - RNA, 19 nt, Homo sapiens
gugcugguccuguugacuu

SEQ ID NO: 1172066 - RNA, 19 nt, Homo sapiens
gcucgagccgucauagauc

SEQ ID NO: 1172067 - RNA, 19 nt, Homo sapiens
ggauggaagcgccuuuguc

SEQ ID NO: 1172068 - RNA, 19 nt, Homo sapiens
acgguguguucauuuguuu
